United States Patent 10,706,955 (BIOINFORMATIC PROCESSES FOR DETERMINATION OF PEPTIDE BINDING) - sequence listing, part 79

SEQ ID NO: 3007027 - protein, 17 aa, Entamoeba invadens
LLMAYEEAIGFVIGNMS

SEQ ID NO: 3007028 - protein, 18 aa, Entamoeba invadens
LLMDVLREFGYKFESRYT

SEQ ID NO: 3007029 - protein, 27 aa, Entamoeba invadens
LLMQVNDDYIFVFSAPPPSPRLCVFKK

SEQ ID NO: 3007030 - protein, 17 aa, Entamoeba invadens
LLMRFEIIHSKNVIHRD

SEQ ID NO: 3007031 - protein, 22 aa, Entamoeba invadens
LLMRYFGKYISGLNSQNLQVSL

SEQ ID NO: 3007032 - protein, 18 aa, Entamoeba invadens
LLMVFEYLCLEDVISAML

SEQ ID NO: 3007033 - protein, 18 aa, Entamoeba invadens
LLMVMNEFQLCIKWCEYN

SEQ ID NO: 3007034 - protein, 25 aa, Entamoeba invadens
LLNCDKLVRVTFPTSLTRFGDFVFE

SEQ ID NO: 3007035 - protein, 24 aa, Entamoeba invadens
LLNCKRLSLLPTSVGSWTIDPASI

SEQ ID NO: 3007036 - protein, 18 aa, Entamoeba invadens
LLNDLRRGFRRSEIRGGL

SEQ ID NO: 3007037 - protein, 21 aa, Entamoeba invadens
LLNEIHDLFDALPLACLVEGN

SEQ ID NO: 3007038 - protein, 23 aa, Entamoeba invadens
LLNEQKVIFEERNAKLRKQNDEN

SEQ ID NO: 3007039 - protein, 19 aa, Entamoeba invadens
LLNFKFYREDVESEKKLFD

SEQ ID NO: 3007040 - protein, 25 aa, Entamoeba invadens
LLNFSTKYNGILSSLLLSVSEVAFC

SEQ ID NO: 3007041 - protein, 19 aa, Entamoeba invadens
LLNHGPIKKKTGFYGSIVS

SEQ ID NO: 3007042 - protein, 28 aa, Entamoeba invadens
LLNITQNFLLKCPDLFRLASHFVNLPNF

SEQ ID NO: 3007043 - protein, 28 aa, Entamoeba invadens
LLNKNSMNILPLLSFKTPFTLGTNSEIG

SEQ ID NO: 3007044 - protein, 23 aa, Entamoeba invadens
LLNKQLDPLYTGEKERVMVALKA

SEQ ID NO: 3007045 - protein, 17 aa, Entamoeba invadens
LLNLLFHAYGRSKKTLL

SEQ ID NO: 3007046 - protein, 19 aa, Entamoeba invadens
LLNNFPTPLLELTGLVVLK

SEQ ID NO: 3007047 - protein, 23 aa, Entamoeba invadens
LLNRTIWELLQKNSVELPFKPKV

SEQ ID NO: 3007048 - protein, 31 aa, Entamoeba invadens
LLNTIMELFVVWLLPNPSKLPALKTFAKLLF

SEQ ID NO: 3007049 - protein, 19 aa, Entamoeba invadens
LLNVAYYFQSFDDIKNLVL

SEQ ID NO: 3007050 - protein, 19 aa, Entamoeba invadens
LLNVVLFFENTEVLLNFIQ

SEQ ID NO: 3007051 - protein, 25 aa, Entamoeba invadens
LLPMQRLPRYELLLMDLIKSPQLQG

SEQ ID NO: 3007052 - protein, 23 aa, Entamoeba invadens
LLPSNLTVLPSGLFISCALTTFV

SEQ ID NO: 3007053 - protein, 30 aa, Entamoeba invadens
LLPSQLVGGILFLRVICAFIATPDANNLLY

SEQ ID NO: 3007054 - protein, 18 aa, Entamoeba invadens
LLPVVDTQFFVSPKLEYL

SEQ ID NO: 3007055 - protein, 18 aa, Entamoeba invadens
LLPYKDIGTLYLSEAIWA

SEQ ID NO: 3007056 - protein, 17 aa, Entamoeba invadens
LLQCFKSPKERLCNTTN

SEQ ID NO: 3007057 - protein, 18 aa, Entamoeba invadens
LLQELWYTEQTHVNNLDI

SEQ ID NO: 3007058 - protein, 18 aa, Entamoeba invadens
LLQIPKFVKSISLKNGFT

SEQ ID NO: 3007059 - protein, 18 aa, Entamoeba invadens
LLQIPKFVKSISLNKEFV

SEQ ID NO: 3007060 - protein, 17 aa, Entamoeba invadens
LLQIQHLSEKLDTQHQS

SEQ ID NO: 3007061 - protein, 19 aa, Entamoeba invadens
LLQLNLHAKTFTPKIKKRV

SEQ ID NO: 3007062 - protein, 20 aa, Entamoeba invadens
LLQNGRLLRYGSTSIIYCHL

SEQ ID NO: 3007063 - protein, 26 aa, Entamoeba invadens
LLQNGVAYALLTTQYRMHPAISQFPN

SEQ ID NO: 3007064 - protein, 42 aa, Entamoeba invadens
LLQPTIFAFQYLLTPFVWQQILIPVLPMFLSGYISTIIPCII

SEQ ID NO: 3007065 - protein, 21 aa, Entamoeba invadens
LLQQIFQYDPIKRPTAMDIML

SEQ ID NO: 3007066 - protein, 31 aa, Entamoeba invadens
LLQQLHHPNIITLWAMFYKNTHLNLVIEEAS

SEQ ID NO: 3007067 - protein, 17 aa, Entamoeba invadens
LLQRSAAFLLDVLGRLK

SEQ ID NO: 3007068 - protein, 30 aa, Entamoeba invadens
LLQSALHLSAIFFLVDSLDYIIQLMRSLAC

SEQ ID NO: 3007069 - protein, 17 aa, Entamoeba invadens
LLRDNSMIPKEAFNIGI

SEQ ID NO: 3007070 - protein, 19 aa, Entamoeba invadens
LLRERDDILKIFQAEKEGL

SEQ ID NO: 3007071 - protein, 18 aa, Entamoeba invadens
LLRGYLTRQETSGTKGWN

SEQ ID NO: 3007072 - protein, 21 aa, Entamoeba invadens
LLRKFVKRRFAVDQPKVSIKT

SEQ ID NO: 3007073 - protein, 17 aa, Entamoeba invadens
LLRKLEPLCTHVLKLLE

SEQ ID NO: 3007074 - protein, 29 aa, Entamoeba invadens
LLRNGAKSVYLYSLFLARVAAGLVCEEEL

SEQ ID NO: 3007075 - protein, 20 aa, Entamoeba invadens
LLRNIGAYCPFLSQIELRMC

SEQ ID NO: 3007076 - protein, 26 aa, Entamoeba invadens
LLRQLSILIHVLHSFISLPTIKMTLQ

SEQ ID NO: 3007077 - protein, 27 aa, Entamoeba invadens
LLRSESPIIFFEFKKVNNLLLVVDGQN

SEQ ID NO: 3007078 - protein, 27 aa, Entamoeba invadens
LLRTLISLNIKDVFLSKIPLSKNLKTQ

SEQ ID NO: 3007079 - protein, 17 aa, Entamoeba invadens
LLRVLQLPKFKDMKIPD

SEQ ID NO: 3007080 - protein, 18 aa, Entamoeba invadens
LLSDVFTFMAPTRTANLT

SEQ ID NO: 3007081 - protein, 21 aa, Entamoeba invadens
LLSELSLWTVLLTPEMMRAKH

SEQ ID NO: 3007082 - protein, 17 aa, Entamoeba invadens
LLSERGFFGRHLAEVLV

SEQ ID NO: 3007083 - protein, 28 aa, Entamoeba invadens
LLSEYHPDIILDPRYNIKTGLVSCQIIF

SEQ ID NO: 3007084 - protein, 18 aa, Entamoeba invadens
LLSFIELPYRNSSGLKEF

SEQ ID NO: 3007085 - protein, 19 aa, Entamoeba invadens
LLSFKYTFDLAQWEKVKEV

SEQ ID NO: 3007086 - protein, 18 aa, Entamoeba invadens
LLSFLFSNVLGNCRVYLP

SEQ ID NO: 3007087 - protein, 19 aa, Entamoeba invadens
LLSGTSKPLPLLSSSSSEE

SEQ ID NO: 3007088 - protein, 18 aa, Entamoeba invadens
LLSLFCGDIDVKKKWITA

SEQ ID NO: 3007089 - protein, 31 aa, Entamoeba invadens
LLSLRKQGSLFIYLFRLMLATGIPELRSEDD

SEQ ID NO: 3007090 - protein, 23 aa, Entamoeba invadens
LLSNGINAVRWVGGVELELLAIA

SEQ ID NO: 3007091 - protein, 17 aa, Entamoeba invadens
LLSPNTLLLTSDTLIHV

SEQ ID NO: 3007092 - protein, 18 aa, Entamoeba invadens
LLSPRSPPLAVFDEYTYV

SEQ ID NO: 3007093 - protein, 18 aa, Entamoeba invadens
LLSSLGELPQRFIENVRV

SEQ ID NO: 3007094 - protein, 26 aa, Entamoeba invadens
LLSVCELLKYYFCGEMRSVLLKAYSG

SEQ ID NO: 3007095 - protein, 21 aa, Entamoeba invadens
LLSVGLYPLYNSLRIVVYRNL

SEQ ID NO: 3007096 - protein, 26 aa, Entamoeba invadens
LLTEDNIVHLFNMYSKYISNTAKRHF

SEQ ID NO: 3007097 - protein, 26 aa, Entamoeba invadens
LLTETYHLIIYIIDKYLSLNKRVGKG

SEQ ID NO: 3007098 - protein, 24 aa, Entamoeba invadens
LLTGKCRLFDIGLPPSLVLHFETM

SEQ ID NO: 3007099 - protein, 18 aa, Entamoeba invadens
LLTIPEKCQYFQSVEVLS

SEQ ID NO: 3007100 - protein, 20 aa, Entamoeba invadens
LLTKSFTDLIYFLQNLPTQD

SEQ ID NO: 3007101 - protein, 17 aa, Entamoeba invadens
LLTLRGAKVRSGKLWSK

SEQ ID NO: 3007102 - protein, 26 aa, Entamoeba invadens
LLTQLTKYMLVILKEKRIARSKTLRS

SEQ ID NO: 3007103 - protein, 17 aa, Entamoeba invadens
LLTQPMKIDWTFYCHKC

SEQ ID NO: 3007104 - protein, 26 aa, Entamoeba invadens
LLTQVPYFVSHIHFLEALLLQPELNS

SEQ ID NO: 3007105 - protein, 17 aa, Entamoeba invadens
LLTRPIPLNYLYHNKKV

SEQ ID NO: 3007106 - protein, 33 aa, Entamoeba invadens
LLTSDTLIHVSYDGYFIFYSFSGEVVNYDCFDR

SEQ ID NO: 3007107 - protein, 25 aa, Entamoeba invadens
LLTTQVMLCLPLKYYSVDQCTIEQP

SEQ ID NO: 3007108 - protein, 27 aa, Entamoeba invadens
LLTTRHPFIVHLYWSFSTEMCFYFVMD

SEQ ID NO: 3007109 - protein, 26 aa, Entamoeba invadens
LLVALKYGCTLLLPQNIHPTVDFFLT

SEQ ID NO: 3007110 - protein, 26 aa, Entamoeba invadens
LLVDCPGMMFPMKNQPLLIQVISGVY

SEQ ID NO: 3007111 - protein, 26 aa, Entamoeba invadens
LLVDKNFLYFYAIKVIETVTRDQATF

SEQ ID NO: 3007112 - protein, 21 aa, Entamoeba invadens
LLVGTLPNKFFKRGFEFVRDY

SEQ ID NO: 3007113 - protein, 26 aa, Entamoeba invadens
LLVKEQMLLIKTLAPKITSLSLKIDE

SEQ ID NO: 3007114 - protein, 18 aa, Entamoeba invadens
LLVKLQNLEKLKNLEVTD

SEQ ID NO: 3007115 - protein, 24 aa, Entamoeba invadens
LLVKYTEVIPYLHKYDELFTRLNS

SEQ ID NO: 3007116 - protein, 18 aa, Entamoeba invadens
LLVLLSFAGVDPSKRDSA

SEQ ID NO: 3007117 - protein, 18 aa, Entamoeba invadens
LLVMTRYLKFDHPYIKNV

SEQ ID NO: 3007118 - protein, 18 aa, Entamoeba invadens
LLVNPQIANALSSALNTE

SEQ ID NO: 3007119 - protein, 34 aa, Entamoeba invadens
LLVQNDTVTYFKGLQLKFFFSILDGEMMENTTLK

SEQ ID NO: 3007120 - protein, 18 aa, Entamoeba invadens
LLVQYLKHGDRRVVDMIY

SEQ ID NO: 3007121 - protein, 19 aa, Entamoeba invadens
LLVSFQPQDRPFITGKKVS

SEQ ID NO: 3007122 - protein, 19 aa, Entamoeba invadens
LLVSKKKVYWVDFEKSESL

SEQ ID NO: 3007123 - protein, 17 aa, Entamoeba invadens
LLVSKSRAVYSAYTGTV

SEQ ID NO: 3007124 - protein, 18 aa, Entamoeba invadens
LLYALKMIQKYGVVDCFH

SEQ ID NO: 3007125 - protein, 22 aa, Entamoeba invadens
LLYASMLDKKINFNYVPSVSSI

SEQ ID NO: 3007126 - protein, 22 aa, Entamoeba invadens
LLYIQTGIIVFHQLEKAQLIFI

SEQ ID NO: 3007127 - protein, 17 aa, Entamoeba invadens
LLYSYYRIAEIVSQSLT

SEQ ID NO: 3007128 - protein, 39 aa, Entamoeba invadens
LLYYCSTFIDPLTTQLFYIYFCPLTSQYLSLFVDPVTNG

SEQ ID NO: 3007129 - protein, 18 aa, Entamoeba invadens
LMATNRIDILDPALLRPG

SEQ ID NO: 3007130 - protein, 24 aa, Entamoeba invadens
LMCDYRKICLWTKMTNFEQIGKSE

SEQ ID NO: 3007131 - protein, 34 aa, Entamoeba invadens
LMCGHYFLTPLVVKFSPPFTFVNMTPLTLELTCV

SEQ ID NO: 3007132 - protein, 31 aa, Entamoeba invadens
LMCTGNFKYSIFLVKEFRYFQIECPSTIDVL

SEQ ID NO: 3007133 - protein, 18 aa, Entamoeba invadens
LMDATPLSLVSKKIAFLS

SEQ ID NO: 3007134 - protein, 25 aa, Entamoeba invadens
LMDDRDFVYQLIRYHNKEKTDYILY

SEQ ID NO: 3007135 - protein, 26 aa, Entamoeba invadens
LMDHVLIAAILKKYLREAPSPVWPIS

SEQ ID NO: 3007136 - protein, 19 aa, Entamoeba invadens
LMDIFCELGDIIGTHFSFV

SEQ ID NO: 3007137 - protein, 19 aa, Entamoeba invadens
LMDITEQLRIFVLDAQSKN

SEQ ID NO: 3007138 - protein, 29 aa, Entamoeba invadens
LMDKNMIVDLLDNWLILLNDVLRNSMHYF

SEQ ID NO: 3007139 - protein, 18 aa, Entamoeba invadens
LMDKYNITYWIYGHTHSN

SEQ ID NO: 3007140 - protein, 18 aa, Entamoeba invadens
LMDLCTENGFFFNSHLSK

SEQ ID NO: 3007141 - protein, 27 aa, Entamoeba invadens
LMDTLTRVYHVWKTVLDMLKDRGYVTN

SEQ ID NO: 3007142 - protein, 26 aa, Entamoeba invadens
LMEDQRLRDWFTEDQLLIMKEAIEDH

SEQ ID NO: 3007143 - protein, 28 aa, Entamoeba invadens
LMEKHFKALQFWTKLNHFTLIYDSHKNK

SEQ ID NO: 3007144 - protein, 21 aa, Entamoeba invadens
LMELGELLEVFQEWSGLKVCD

SEQ ID NO: 3007145 - protein, 17 aa, Entamoeba invadens
LMELWFTEEAHVQSLDI

SEQ ID NO: 3007146 - protein, 17 aa, Entamoeba invadens
LMELWNLMDFTTDGELL

SEQ ID NO: 3007147 - protein, 36 aa, Entamoeba invadens
LMEMKTSLLCLRRIAFKLDQFFGPTALPFSDDILKA

SEQ ID NO: 3007148 - protein, 22 aa, Entamoeba invadens
LMESVLEMVLYLLKFECYSERR

SEQ ID NO: 3007149 - protein, 20 aa, Entamoeba invadens
LMEYSLEDKLFKKLKSAVKK

SEQ ID NO: 3007150 - protein, 19 aa, Entamoeba invadens
LMFSKYGIPIKGMAKAATE

SEQ ID NO: 3007151 - protein, 23 aa, Entamoeba invadens
LMFTEFTFCAKLEIFQIFEEEIR

SEQ ID NO: 3007152 - protein, 19 aa, Entamoeba invadens
LMGDFYFRGKDLYPNGYNR

SEQ ID NO: 3007153 - protein, 20 aa, Entamoeba invadens
LMGHSIGCGPTLWLAREIQN

SEQ ID NO: 3007154 - protein, 17 aa, Entamoeba invadens
LMGIIQEFERSVKDLNM

SEQ ID NO: 3007155 - protein, 26 aa, Entamoeba invadens
LMGKDVDALQLYLQKNWKLIEKGEYN

SEQ ID NO: 3007156 - protein, 18 aa, Entamoeba invadens
LMGYIKEWTGKNTFKVVF

SEQ ID NO: 3007157 - protein, 19 aa, Entamoeba invadens
LMICEHTFLSKLQPKDFYL

SEQ ID NO: 3007158 - protein, 17 aa, Entamoeba invadens
LMIISKYFKTIEDFIHL

SEQ ID NO: 3007159 - protein, 18 aa, Entamoeba invadens
LMIRKLDQQLFLNYTANP

SEQ ID NO: 3007160 - protein, 19 aa, Entamoeba invadens
LMIVAKYFRSISDFMNIEM

SEQ ID NO: 3007161 - protein, 27 aa, Entamoeba invadens
LMIVAKYLPNFKTFSNVLLISKRYATI

SEQ ID NO: 3007162 - protein, 18 aa, Entamoeba invadens
LMIVSKYFTSITDFKNIE

SEQ ID NO: 3007163 - protein, 19 aa, Entamoeba invadens
LMIVTKYFDTIEDFINVEF

SEQ ID NO: 3007164 - protein, 24 aa, Entamoeba invadens
LMKDNGLYSKCECTMESGVLSVVF

SEQ ID NO: 3007165 - protein, 27 aa, Entamoeba invadens
LMKFHYNPIPINFRTRKYFPNLETQHL

SEQ ID NO: 3007166 - protein, 22 aa, Entamoeba invadens
LMKIALHLFSMSDITTFLQVNK

SEQ ID NO: 3007167 - protein, 19 aa, Entamoeba invadens
LMKKKLPPIPTRRSQTSLA

SEQ ID NO: 3007168 - protein, 33 aa, Entamoeba invadens
LMKKTTEVLSPIYDFLIPSQELSPFMTLAVTDP

SEQ ID NO: 3007169 - protein, 18 aa, Entamoeba invadens
LMKRDVPLDLLETTAKVA

SEQ ID NO: 3007170 - protein, 29 aa, Entamoeba invadens
LMKRRECVRLLQDLLVEFGFIVCFEKETV

SEQ ID NO: 3007171 - protein, 21 aa, Entamoeba invadens
LMKVALNFGTYDVLYQFICVS

SEQ ID NO: 3007172 - protein, 17 aa, Entamoeba invadens
LMKVLHWINTKKVFQHE

SEQ ID NO: 3007173 - protein, 22 aa, Entamoeba invadens
LMKYNETSYILTLLTCDGRDPL

SEQ ID NO: 3007174 - protein, 29 aa, Entamoeba invadens
LMKYTKDIISLYRTVLLTIPKNGMKHLSR

SEQ ID NO: 3007175 - protein, 24 aa, Entamoeba invadens
LMLFGNWFVGKSSLQLRFIFDKFE

SEQ ID NO: 3007176 - protein, 19 aa, Entamoeba invadens
LMNEYGLVYSFKRALSVTK

SEQ ID NO: 3007177 - protein, 19 aa, Entamoeba invadens
LMNIALYINSPHTAKIFHL

SEQ ID NO: 3007178 - protein, 32 aa, Entamoeba invadens
LMNKQALCKQLGLILDFVLAFDNKKVTTPGIQ

SEQ ID NO: 3007179 - protein, 18 aa, Entamoeba invadens
LMNMINAVSFLKLTNYLT

SEQ ID NO: 3007180 - protein, 19 aa, Entamoeba invadens
LMNSFDIQPALLGYDKEND

SEQ ID NO: 3007181 - protein, 19 aa, Entamoeba invadens
LMNVFLHLKTFSDVLNIIN

SEQ ID NO: 3007182 - protein, 20 aa, Entamoeba invadens
LMNVILFLDSLKTFQKFVLI

SEQ ID NO: 3007183 - protein, 19 aa, Entamoeba invadens
LMNVILYLDSISTATKLLY

SEQ ID NO: 3007184 - protein, 20 aa, Entamoeba invadens
LMNVILYLDSLDTLKTFLLV

SEQ ID NO: 3007185 - protein, 19 aa, Entamoeba invadens
LMNVIYKQNYRQLISLVSH

SEQ ID NO: 3007186 - protein, 18 aa, Entamoeba invadens
LMNVVKYFDKMDTLRLFI

SEQ ID NO: 3007187 - protein, 19 aa, Entamoeba invadens
LMNVYLYLETYNDVMNFIK

SEQ ID NO: 3007188 - protein, 22 aa, Entamoeba invadens
LMNYFTARKLLPQLLQTLAKFE

SEQ ID NO: 3007189 - protein, 26 aa, Entamoeba invadens
LMPFPSIIEGWFYLRPLAFTDNVSTG

SEQ ID NO: 3007190 - protein, 24 aa, Entamoeba invadens
LMPIVEINIVALKKLFPTSFVEGS

SEQ ID NO: 3007191 - protein, 27 aa, Entamoeba invadens
LMPSSPYYKFNIFPRKVGSETIAVYVK

SEQ ID NO: 3007192 - protein, 20 aa, Entamoeba invadens
LMQAVLFGLKGVCAYISHAY

SEQ ID NO: 3007193 - protein, 18 aa, Entamoeba invadens
LMQISLYLPTMKDVLTFI

SEQ ID NO: 3007194 - protein, 19 aa, Entamoeba invadens
LMQSSVRSIIFASGTLSPM

SEQ ID NO: 3007195 - protein, 20 aa, Entamoeba invadens
LMQVSLYLPSLKDIMTFITI

SEQ ID NO: 3007196 - protein, 21 aa, Entamoeba invadens
LMQVSLYLPTFSDVITFIQVN

SEQ ID NO: 3007197 - protein, 22 aa, Entamoeba invadens
LMQVSLYLPTLKDIMTFITINK

SEQ ID NO: 3007198 - protein, 19 aa, Entamoeba invadens
LMQVSLYLPTLSDVFTFIQ

SEQ ID NO: 3007199 - protein, 22 aa, Entamoeba invadens
LMQVSLYLPTLSDVFTFIQVNH

SEQ ID NO: 3007200 - protein, 21 aa, Entamoeba invadens
LMQVSLYLPTLYDVFTFIQVN

SEQ ID NO: 3007201 - protein, 18 aa, Entamoeba invadens
LMRLMNTDEIFLTQFSLL

SEQ ID NO: 3007202 - protein, 23 aa, Entamoeba invadens
LMRMQMMPPMQNLEQPPTLPELP

SEQ ID NO: 3007203 - protein, 21 aa, Entamoeba invadens
LMSISNFFYKITDLINMEMVC

SEQ ID NO: 3007204 - protein, 24 aa, Entamoeba invadens
LMSKVIQPYVKPITKYVLDSVVIP

SEQ ID NO: 3007205 - protein, 19 aa, Entamoeba invadens
LMSNLTFTRGVGTPSFMAP

SEQ ID NO: 3007206 - protein, 18 aa, Entamoeba invadens
LMSRDFLTAMEKVKLFNQ

SEQ ID NO: 3007207 - protein, 22 aa, Entamoeba invadens
LMSRDFLTAMEKVKLFNQEILK

SEQ ID NO: 3007208 - protein, 18 aa, Entamoeba invadens
LMSSFFVISIELAYNDIF

SEQ ID NO: 3007209 - protein, 25 aa, Entamoeba invadens
LMSSPELMMFVGKLIGKMICDNMTL

SEQ ID NO: 3007210 - protein, 19 aa, Entamoeba invadens
LMSTLYSKDFLLSRYFADC

SEQ ID NO: 3007211 - protein, 19 aa, Entamoeba invadens
LMTHLKKKVTLQYPKDLKI

SEQ ID NO: 3007212 - protein, 29 aa, Entamoeba invadens
LMVIYRSKLTDIKKIIPFSLIGKKENQLK

SEQ ID NO: 3007213 - protein, 23 aa, Entamoeba invadens
LNAIFNQRYYNGVLSIGLNPFYN

SEQ ID NO: 3007214 - protein, 17 aa, Entamoeba invadens
LNAKIPSLPSFSQSVQV

SEQ ID NO: 3007215 - protein, 37 aa, Entamoeba invadens
LNASGETIVLRFLENFRLWIGLRRFNVLFDESILSNN

SEQ ID NO: 3007216 - protein, 18 aa, Entamoeba invadens
LNATIPLIESEFTLPKKK

SEQ ID NO: 3007217 - protein, 27 aa, Entamoeba invadens
LNAVIWLEHYLMGWKKSLLLVSHDTSF

SEQ ID NO: 3007218 - protein, 19 aa, Entamoeba invadens
LNAYCKYLEELYGTANLDI

SEQ ID NO: 3007219 - protein, 23 aa, Entamoeba invadens
LNCKLYEDKLWLFPKSLEDCLSY

SEQ ID NO: 3007220 - protein, 20 aa, Entamoeba invadens
LNCNFLPIHFEVIKNAKIVR

SEQ ID NO: 3007221 - protein, 32 aa, Entamoeba invadens
LNCNFLPVSFGYLSKPIFIRNYKIECTPEIIE

SEQ ID NO: 3007222 - protein, 25 aa, Entamoeba invadens
LNCSTITMPYACKLLFQEMQSMNVV

SEQ ID NO: 3007223 - protein, 22 aa, Entamoeba invadens
LNCVNLQRIYLPKSVSKLSPIA

SEQ ID NO: 3007224 - protein, 18 aa, Entamoeba invadens
LNCYYVFIGPEETPFEGG

SEQ ID NO: 3007225 - protein, 24 aa, Entamoeba invadens
LNDDSSFLLRYFALHLNDVVKLYK

SEQ ID NO: 3007226 - protein, 27 aa, Entamoeba invadens
LNDGLIVMGLWLNIYTYDIVQAPDGIS

SEQ ID NO: 3007227 - protein, 23 aa, Entamoeba invadens
LNDIGHIPPLKHLLVYTHNSKTF

SEQ ID NO: 3007228 - protein, 18 aa, Entamoeba invadens
LNDIGPARTFLPNEPFDS

SEQ ID NO: 3007229 - protein, 21 aa, Entamoeba invadens
LNDKHVIFAGYRQPHPLKYVI

SEQ ID NO: 3007230 - protein, 31 aa, Entamoeba invadens
LNDLAKAIYMKWKGREYLREAPTLTMKQAEE

SEQ ID NO: 3007231 - protein, 24 aa, Entamoeba invadens
LNDQHHFFFLIEDVTFPDEQKRDT

SEQ ID NO: 3007232 - protein, 24 aa, Entamoeba invadens
LNDRKIVEAFLLKLPASAEAKNVI

SEQ ID NO: 3007233 - protein, 22 aa, Entamoeba invadens
LNDRLCDIKILIKSNITINLSP

SEQ ID NO: 3007234 - protein, 20 aa, Entamoeba invadens
LNDTCARKVPYGNGCLVCKV

SEQ ID NO: 3007235 - protein, 18 aa, Entamoeba invadens
LNDVFLYEGGIKLRDCLS

SEQ ID NO: 3007236 - protein, 23 aa, Entamoeba invadens
LNDYKLIGTLFGLAIYNGVILEA

SEQ ID NO: 3007237 - protein, 24 aa, Entamoeba invadens
LNDYYFVDVTADYLFFGKYIQNNP

SEQ ID NO: 3007238 - protein, 35 aa, Entamoeba invadens
LNECEGISCNPACGALYLFPKIDLPQKFVDECLAQ

SEQ ID NO: 3007239 - protein, 34 aa, Entamoeba invadens
LNEFPTNLVPFPRVHFAMMSYAPIVTPEKAQRQT

SEQ ID NO: 3007240 - protein, 24 aa, Entamoeba invadens
LNEGYAFWITKIMKEALDEYKPTK

SEQ ID NO: 3007241 - protein, 20 aa, Entamoeba invadens
LNEISIIRKVNHPCILGCSN

SEQ ID NO: 3007242 - protein, 25 aa, Entamoeba invadens
LNELPLVYLNVLKTLIQFLVLVEQK

SEQ ID NO: 3007243 - protein, 24 aa, Entamoeba invadens
LNENVLYCLCLIIQSLPRVCISED

SEQ ID NO: 3007244 - protein, 35 aa, Entamoeba invadens
LNERQSLLCKCGNLLIGAVFVFCCGETICENCLAK

SEQ ID NO: 3007245 - protein, 28 aa, Entamoeba invadens
LNETPKNWKYFFLFNDRLVMSEVVSYNN

SEQ ID NO: 3007246 - protein, 24 aa, Entamoeba invadens
LNEVRELFRVYGTLRGVRVPKKID

SEQ ID NO: 3007247 - protein, 23 aa, Entamoeba invadens
LNEVRKLWAIIHNTKTVDKTKGH

SEQ ID NO: 3007248 - protein, 23 aa, Entamoeba invadens
LNEYKKFHIMPDPSTIEAPLPDR

SEQ ID NO: 3007249 - protein, 18 aa, Entamoeba invadens
LNFLLNKIEQFLSLSDIT

SEQ ID NO: 3007250 - protein, 29 aa, Entamoeba invadens
LNFPQLMEKKLKTLSFKALPKILEVNETG

SEQ ID NO: 3007251 - protein, 24 aa, Entamoeba invadens
LNFQDYIEHLILASGKSIAKTSKN

SEQ ID NO: 3007252 - protein, 31 aa, Entamoeba invadens
LNGFIPQVIEGYNCTFFAYGQTGTGKTFTME

SEQ ID NO: 3007253 - protein, 21 aa, Entamoeba invadens
LNGHFVGRCRADFINFGAAVC

SEQ ID NO: 3007254 - protein, 53 aa, Entamoeba invadens
LNGNKKSTLALIFQLILRYRLFNIKFKMTDFSHWIYSLVKDEKECFDVKFCLS

SEQ ID NO: 3007255 - protein, 30 aa, Entamoeba invadens
LNGNKLDAFNLWLCSIPLAVNLVDEETLSY

SEQ ID NO: 3007256 - protein, 32 aa, Entamoeba invadens
LNGQMLPQSHILTFFRAIGLNVNNPHFLIMQG

SEQ ID NO: 3007257 - protein, 21 aa, Entamoeba invadens
LNGSIKRLQRHLEANNSELIE

SEQ ID NO: 3007258 - protein, 25 aa, Entamoeba invadens
LNGTFGLFHVSLATFADPPLFQARV

SEQ ID NO: 3007259 - protein, 25 aa, Entamoeba invadens
LNGTSVIFKWCPMGHLVLAITSTEF

SEQ ID NO: 3007260 - protein, 23 aa, Entamoeba invadens
LNGYACAYYSYKWAEVLEADAFE

SEQ ID NO: 3007261 - protein, 20 aa, Entamoeba invadens
LNGYQLNGGCLNCMWGKESF

SEQ ID NO: 3007262 - protein, 20 aa, Entamoeba invadens
LNHLVFFNYNNEKAKELLAN

SEQ ID NO: 3007263 - protein, 23 aa, Entamoeba invadens
LNHRRTWFTSFHPDFFGKKGMRV

SEQ ID NO: 3007264 - protein, 19 aa, Entamoeba invadens
LNHSILVAYLAIIKKQIDQ

SEQ ID NO: 3007265 - protein, 24 aa, Entamoeba invadens
LNHSNFYIPGYWKAEAVGYASDTY

SEQ ID NO: 3007266 - protein, 17 aa, Entamoeba invadens
LNHVLRWEKPRALVLYN

SEQ ID NO: 3007267 - protein, 25 aa, Entamoeba invadens
LNHVRLFTRLEYLCGNLAHIVDFFV

SEQ ID NO: 3007268 - protein, 25 aa, Entamoeba invadens
LNHYNYIFTRRVDFSFNLLKNILKL

SEQ ID NO: 3007269 - protein, 20 aa, Entamoeba invadens
LNIFLELHNMKMLRIISSGK

SEQ ID NO: 3007270 - protein, 17 aa, Entamoeba invadens
LNIKKAFVVGDYFTFFN

SEQ ID NO: 3007271 - protein, 22 aa, Entamoeba invadens
LNIKMGQIWKELSEDEKKVYTE

SEQ ID NO: 3007272 - protein, 25 aa, Entamoeba invadens
LNINIDTIIHFVLKNLRNPPQLQQQ

SEQ ID NO: 3007273 - protein, 23 aa, Entamoeba invadens
LNITYTVMSKRKLLALVTKKYVR

SEQ ID NO: 3007274 - protein, 20 aa, Entamoeba invadens
LNIYLCPYRIIATGPDCGII

SEQ ID NO: 3007275 - protein, 23 aa, Entamoeba invadens
LNKDFIQPITVFFLSVLEHVTEN

SEQ ID NO: 3007276 - protein, 25 aa, Entamoeba invadens
LNKDIVQVVQIAKTIFCVCKGKSKK

SEQ ID NO: 3007277 - protein, 23 aa, Entamoeba invadens
LNKDLTYLNKMLANRPRIADKIN

SEQ ID NO: 3007278 - protein, 25 aa, Entamoeba invadens
LNKEFVPNFFKPISPYNVNIPILIG

SEQ ID NO: 3007279 - protein, 25 aa, Entamoeba invadens
LNKENFGFIPNIFNLITSTVAIVNR

SEQ ID NO: 3007280 - protein, 27 aa, Entamoeba invadens
LNKENFGFIPNIFNLITSTVAIVNRTP

SEQ ID NO: 3007281 - protein, 31 aa, Entamoeba invadens
LNKFRSDFIVHFYGAVFILSKVCLVTEFAQF

SEQ ID NO: 3007282 - protein, 23 aa, Entamoeba invadens
LNKIELFTFCECKNLKIVKNMRR

SEQ ID NO: 3007283 - protein, 26 aa, Entamoeba invadens
LNKIINQLYDSFIARNPQYAPSKSDL

SEQ ID NO: 3007284 - protein, 21 aa, Entamoeba invadens
LNKKMFLIGVYLQAKYLNIFN

SEQ ID NO: 3007285 - protein, 17 aa, Entamoeba invadens
LNKKPSKTNFLFARKEV

SEQ ID NO: 3007286 - protein, 32 aa, Entamoeba invadens
LNKKSLPFIPQILSIYLKLFKTCLPGVRPALI

SEQ ID NO: 3007287 - protein, 35 aa, Entamoeba invadens
LNKKVFKDQAIWMLNAVWPAYKDTLAEEMWGFTNT

SEQ ID NO: 3007288 - protein, 20 aa, Entamoeba invadens
LNKKWKLRFATINGSTLYYY

SEQ ID NO: 3007289 - protein, 29 aa, Entamoeba invadens
LNKKYTYEELLKRPTYLDKTKLETYLSDE

SEQ ID NO: 3007290 - protein, 23 aa, Entamoeba invadens
LNKNTVFLKLIGIKFKTIESNKT

SEQ ID NO: 3007291 - protein, 23 aa, Entamoeba invadens
LNKVRARLALLRSSYLIDNKQSF

SEQ ID NO: 3007292 - protein, 18 aa, Entamoeba invadens
LNKYFAEIKLVGSGAYGK

SEQ ID NO: 3007293 - protein, 24 aa, Entamoeba invadens
LNLFLVHPTLIKTEKNWKIVLRHT

SEQ ID NO: 3007294 - protein, 20 aa, Entamoeba invadens
LNLFTESALRVLVQRVYTLY

SEQ ID NO: 3007295 - protein, 21 aa, Entamoeba invadens
LNLQIPPLKIPQCDELGFLSP

SEQ ID NO: 3007296 - protein, 36 aa, Entamoeba invadens
LNLRNNLIISLPSFIQVPLLFFDISYNPIADVNKGI

SEQ ID NO: 3007297 - protein, 17 aa, Entamoeba invadens
LNMKCPLKFDIGAIYDK

SEQ ID NO: 3007298 - protein, 27 aa, Entamoeba invadens
LNMLQKMKILRDVAVGLTFIHDIKDMF

SEQ ID NO: 3007299 - protein, 17 aa, Entamoeba invadens
LNMTWNYNFDKMTYFNE

SEQ ID NO: 3007300 - protein, 19 aa, Entamoeba invadens
LNMWFDELVRYGPNKGIIP

SEQ ID NO: 3007301 - protein, 18 aa, Entamoeba invadens
LNNALLYMLHKVGFEFEE

SEQ ID NO: 3007302 - protein, 49 aa, Entamoeba invadens
LNNEMVLSYLRCELMLLHTQAPYSQILKIYLTFNISPEPTIPQDLFMMI

SEQ ID NO: 3007303 - protein, 22 aa, Entamoeba invadens
LNNFEYYKYIPMGYKVIGGDQY

SEQ ID NO: 3007304 - protein, 23 aa, Entamoeba invadens
LNNFKYLMVIKHYEPYSLCLNDR

SEQ ID NO: 3007305 - protein, 25 aa, Entamoeba invadens
LNNHKIAFHIKKGEKVILETGAYFE

SEQ ID NO: 3007306 - protein, 20 aa, Entamoeba invadens
LNNLDYVVFCEEANYVDVVD

SEQ ID NO: 3007307 - protein, 33 aa, Entamoeba invadens
LNNNVLMKILQYLRLKHIVSLKLTCRKFYQQIA

SEQ ID NO: 3007308 - protein, 27 aa, Entamoeba invadens
LNNPDITLYIEIFYRGLGVSLIETQKV

SEQ ID NO: 3007309 - protein, 24 aa, Entamoeba invadens
LNNSGVMVCTVIGFPLGSTPTEVK

SEQ ID NO: 3007310 - protein, 25 aa, Entamoeba invadens
LNNSYLVPLPRTPSVRAILQDFIKT

SEQ ID NO: 3007311 - protein, 21 aa, Entamoeba invadens
LNNVVYIQSLAFSNDLLFVFS

SEQ ID NO: 3007312 - protein, 27 aa, Entamoeba invadens
LNPFTEGVVFSVRPPKKAWKNITNLSG

SEQ ID NO: 3007313 - protein, 44 aa, Entamoeba invadens
LNPIIQAFTFVLQPFVWQHIFVPILPMFLNAYLSSILPCIIGCT

SEQ ID NO: 3007314 - protein, 26 aa, Entamoeba invadens
LNPQSYKPTYFRPMSIKYERMLRNKK

SEQ ID NO: 3007315 - protein, 25 aa, Entamoeba invadens
LNQFDDIKILFWSVELYFEEKNLDV

SEQ ID NO: 3007316 - protein, 17 aa, Entamoeba invadens
LNQILLNNAKRTTLQNN

SEQ ID NO: 3007317 - protein, 26 aa, Entamoeba invadens
LNQIPNRRFTLWWSPTINRGSVYVGF

SEQ ID NO: 3007318 - protein, 19 aa, Entamoeba invadens
LNQIYFSSFGSEKVLCVWD

SEQ ID NO: 3007319 - protein, 24 aa, Entamoeba invadens
LNQKAALNAILQFLRNIDTSFNNL

SEQ ID NO: 3007320 - protein, 28 aa, Entamoeba invadens
LNQKRLENYGLLKTPFHLIADSQTCCGE

SEQ ID NO: 3007321 - protein, 18 aa, Entamoeba invadens
LNQLFNNLSKLDNLLRAK

SEQ ID NO: 3007322 - protein, 36 aa, Entamoeba invadens
LNQVAATPFLLYDVPSNYGWLFLSARNGMLSESVSK

SEQ ID NO: 3007323 - protein, 22 aa, Entamoeba invadens
LNQYFVSDQLLIEAIAWKGNAN

SEQ ID NO: 3007324 - protein, 21 aa, Entamoeba invadens
LNRAYQRNLALKAEKSRLEKI

SEQ ID NO: 3007325 - protein, 26 aa, Entamoeba invadens
LNRDDPMLLHLTYVQAHDNIVDGLYP

SEQ ID NO: 3007326 - protein, 17 aa, Entamoeba invadens
LNREESFFVTPKVFWRT

SEQ ID NO: 3007327 - protein, 24 aa, Entamoeba invadens
LNRESVLFMFVTENNEIFWMFIED

SEQ ID NO: 3007328 - protein, 20 aa, Entamoeba invadens
LNRFHINPIPITKKMIKHFP

SEQ ID NO: 3007329 - protein, 23 aa, Entamoeba invadens
LNRHLPFTEYPNPLPKEFSPLTL

SEQ ID NO: 3007330 - protein, 31 aa, Entamoeba invadens
LNRIELYCTTKILFGFWNEDLAKKFEKKFAA

SEQ ID NO: 3007331 - protein, 24 aa, Entamoeba invadens
LNRIPYNPYYADIYSCGILLHVML

SEQ ID NO: 3007332 - protein, 28 aa, Entamoeba invadens
LNRLERLSYFNNIVFLKSLAVLVETKVD

SEQ ID NO: 3007333 - protein, 18 aa, Entamoeba invadens
LNRLVVSDGWYTITLIVD

SEQ ID NO: 3007334 - protein, 18 aa, Entamoeba invadens
LNRPLLHSELLKIEKRLI

SEQ ID NO: 3007335 - protein, 25 aa, Entamoeba invadens
LNRTRLIMYQIVQGVRYMHSKKVVH

SEQ ID NO: 3007336 - protein, 26 aa, Entamoeba invadens
LNSDVAILDLLFTKLEPLFCGVVDKV

SEQ ID NO: 3007337 - protein, 17 aa, Entamoeba invadens
LNSFGQPSAIEYAYLNK

SEQ ID NO: 3007338 - protein, 21 aa, Entamoeba invadens
LNSFLLQSPPCEYVELVKDLK

SEQ ID NO: 3007339 - protein, 17 aa, Entamoeba invadens
LNSFWIIKETCITRVSM

SEQ ID NO: 3007340 - protein, 26 aa, Entamoeba invadens
LNSGSIPPLALILSQGDYKVIDSVVL

SEQ ID NO: 3007341 - protein, 18 aa, Entamoeba invadens
LNSKTFVYFPNIETLHLW

SEQ ID NO: 3007342 - protein, 26 aa, Entamoeba invadens
LNSKTIVYFPKIETLHLWVNKHENFG

SEQ ID NO: 3007343 - protein, 18 aa, Entamoeba invadens
LNSKTLFNFSHIETLHLF

SEQ ID NO: 3007344 - protein, 17 aa, Entamoeba invadens
LNSLGYSFQFKKLKDKI

SEQ ID NO: 3007345 - protein, 25 aa, Entamoeba invadens
LNSLTRILFASEVAGGFLVQFDYGG

SEQ ID NO: 3007346 - protein, 19 aa, Entamoeba invadens
LNSLVNLANILLTASQRKG

SEQ ID NO: 3007347 - protein, 21 aa, Entamoeba invadens
LNSLYFVHKLYTSQKRKIIKT

SEQ ID NO: 3007348 - protein, 17 aa, Entamoeba invadens
LNSRAVLIVSNGTLHVR

SEQ ID NO: 3007349 - protein, 25 aa, Entamoeba invadens
LNSTSPELYLLYVTPEQIKTQRFQN

SEQ ID NO: 3007350 - protein, 25 aa, Entamoeba invadens
LNSVKPWFEVVPRRLIKSPDNTSIF

SEQ ID NO: 3007351 - protein, 27 aa, Entamoeba invadens
LNTAIDPPLLSRFDIILIMLDERNQQW

SEQ ID NO: 3007352 - protein, 18 aa, Entamoeba invadens
LNTALHIAIIKKNERMTS

SEQ ID NO: 3007353 - protein, 20 aa, Entamoeba invadens
LNTLILADPQALKKSPFPLT

SEQ ID NO: 3007354 - protein, 19 aa, Entamoeba invadens
LNTLKVSPSFRGVVTLPGH

SEQ ID NO: 3007355 - protein, 27 aa, Entamoeba invadens
LNTLLDKVLLLENSHKELLARVSLLES

SEQ ID NO: 3007356 - protein, 26 aa, Entamoeba invadens
LNTLVMFYNNFQKYFQVLILTAQSKQ

SEQ ID NO: 3007357 - protein, 28 aa, Entamoeba invadens
LNTSDLLDILNLISLTFASKTNVVLVEL

SEQ ID NO: 3007358 - protein, 23 aa, Entamoeba invadens
LNTTEQILAFIGQKFRVVMVTGA

SEQ ID NO: 3007359 - protein, 25 aa, Entamoeba invadens
LNTTTDVFVDLTYKGNYFGNVLVTK

SEQ ID NO: 3007360 - protein, 24 aa, Entamoeba invadens
LNVALRWIDVAKPATRLRCAGFTK

SEQ ID NO: 3007361 - protein, 25 aa, Entamoeba invadens
LNVDILSHSNLIIPLLALANTNTPV

SEQ ID NO: 3007362 - protein, 23 aa, Entamoeba invadens
LNVIDVLYFGKFVFFNHDQIVGK

SEQ ID NO: 3007363 - protein, 22 aa, Entamoeba invadens
LNVILVCKKYEYILDRIRMNPI

SEQ ID NO: 3007364 - protein, 26 aa, Entamoeba invadens
LNVKNILCVAPQIPRLYPTQFNYKNC

SEQ ID NO: 3007365 - protein, 23 aa, Entamoeba invadens
LNVLRKRMLNKKDSVVRLALELM

SEQ ID NO: 3007366 - protein, 17 aa, Entamoeba invadens
LNVPSTSIILFGVGAGC

SEQ ID NO: 3007367 - protein, 19 aa, Entamoeba invadens
LNVREMNANITAKLSAFKY

SEQ ID NO: 3007368 - protein, 26 aa, Entamoeba invadens
LNVWNTIIFMKSYQLLIIGTDIILNL

SEQ ID NO: 3007369 - protein, 18 aa, Entamoeba invadens
LNVYWKRSEPMPQNFLDT

SEQ ID NO: 3007370 - protein, 29 aa, Entamoeba invadens
LNYGTLLQRLVQKPILEYPGSGAAGGIGG

SEQ ID NO: 3007371 - protein, 36 aa, Entamoeba invadens
LNYIFAVLTMDKKLHLFIPRMPCFSVTLDFLKSLPK

SEQ ID NO: 3007372 - protein, 18 aa, Entamoeba invadens
LNYLNLMSALEDLKKEVN

SEQ ID NO: 3007373 - protein, 20 aa, Entamoeba invadens
LNYNTKLIPRLFKASKKDDQ

SEQ ID NO: 3007374 - protein, 28 aa, Entamoeba invadens
LPAALVSRFDLLFVLLDNQNEDFDRELA

SEQ ID NO: 3007375 - protein, 19 aa, Entamoeba invadens
LPAYIRQSALYFINTFVEY

SEQ ID NO: 3007376 - protein, 28 aa, Entamoeba invadens
LPDKLEMFKKIYTFRNVLLGAFKVRSLN

SEQ ID NO: 3007377 - protein, 34 aa, Entamoeba invadens
LPDKMTKIMRLLYQVTLELPFHLVPPVVSFGYNV

SEQ ID NO: 3007378 - protein, 23 aa, Entamoeba invadens
LPDNCFYACYNLQNISFESRLKS

SEQ ID NO: 3007379 - protein, 32 aa, Entamoeba invadens
LPDTFVTSILPLLRPPEVFLSILLTKPHLYKQ

SEQ ID NO: 3007380 - protein, 29 aa, Entamoeba invadens
LPDTITNEKLLELVKQALPSLLEDKKRLF

SEQ ID NO: 3007381 - protein, 18 aa, Entamoeba invadens
LPDTKTVPVYKPVDKQRL

SEQ ID NO: 3007382 - protein, 18 aa, Entamoeba invadens
LPEELFSVLFSFALEFLD

SEQ ID NO: 3007383 - protein, 19 aa, Entamoeba invadens
LPEFLIPFCEFHKICEDFG

SEQ ID NO: 3007384 - protein, 19 aa, Entamoeba invadens
LPEFTFVGSLTNVVDFVWS

SEQ ID NO: 3007385 - protein, 27 aa, Entamoeba invadens
LPEGIARFFRVVIVDALFIGYGLTETC

SEQ ID NO: 3007386 - protein, 24 aa, Entamoeba invadens
LPEGTEVFMKWRRGDKKENKGHLD

SEQ ID NO: 3007387 - protein, 26 aa, Entamoeba invadens
LPEKYRYNPIALTKKTRKLFPKIQTL

SEQ ID NO: 3007388 - protein, 22 aa, Entamoeba invadens
LPENIVGGYLYPMLSSSMQTTS

SEQ ID NO: 3007389 - protein, 23 aa, Entamoeba invadens
LPETFKIIGKFTFKNCFTLESLT

SEQ ID NO: 3007390 - protein, 32 aa, Entamoeba invadens
LPETLKTIEKFAFKNCYFLESLTFPKTLVKME

SEQ ID NO: 3007391 - protein, 22 aa, Entamoeba invadens
LPETLKTIEKFAFKNCYSLENI

SEQ ID NO: 3007392 - protein, 20 aa, Entamoeba invadens
LPFALSLLDVLCRRFNDVFI

SEQ ID NO: 3007393 - protein, 17 aa, Entamoeba invadens
LPFLKEIVEVLFSQGIL

SEQ ID NO: 3007394 - protein, 18 aa, Entamoeba invadens
LPFRTGISASSYFAVLLL

SEQ ID NO: 3007395 - protein, 21 aa, Entamoeba invadens
LPFVYIIREEMEFTKPNIICD

SEQ ID NO: 3007396 - protein, 17 aa, Entamoeba invadens
LPGIFKALLPHISHFDE

SEQ ID NO: 3007397 - protein, 17 aa, Entamoeba invadens
LPGQNIVIDILYIWKEK

SEQ ID NO: 3007398 - protein, 24 aa, Entamoeba invadens
LPGSMKRALAKKNIKFYVIDAIKI

SEQ ID NO: 3007399 - protein, 29 aa, Entamoeba invadens
LPHIESFIFDILNLFITKDLPKVTLEDFY

SEQ ID NO: 3007400 - protein, 24 aa, Entamoeba invadens
LPHIMHFIYHYPITYTNYLKRIET

SEQ ID NO: 3007401 - protein, 28 aa, Entamoeba invadens
LPHVIRYNGIIPRKLSMWPKYNTYVADE

SEQ ID NO: 3007402 - protein, 27 aa, Entamoeba invadens
LPHVIRYNGVVPRKLAMWPKYNVYVAD

SEQ ID NO: 3007403 - protein, 24 aa, Entamoeba invadens
LPHVNTMLRIRLFNITSAHINASL

SEQ ID NO: 3007404 - protein, 19 aa, Entamoeba invadens
LPIDVYSFAMTMYHIFTNE

SEQ ID NO: 3007405 - protein, 25 aa, Entamoeba invadens
LPIKVSGFLVKKELGYFAQAFDHIN

SEQ ID NO: 3007406 - protein, 31 aa, Entamoeba invadens
LPITFDSFCLFVRLLEYLPPSTLSAHFQLLV

SEQ ID NO: 3007407 - protein, 18 aa, Entamoeba invadens
LPKCVVCNNPISTTAWEF

SEQ ID NO: 3007408 - protein, 17 aa, Entamoeba invadens
LPKDLIVMISYIGKMEL

SEQ ID NO: 3007409 - protein, 18 aa, Entamoeba invadens
LPKEAPRPTLYLNRNFMP

SEQ ID NO: 3007410 - protein, 26 aa, Entamoeba invadens
LPKEVLLPLTPILVNPIRASLASTSQ

SEQ ID NO: 3007411 - protein, 22 aa, Entamoeba invadens
LPKIQRYFPNIQTIYLEATTLE

SEQ ID NO: 3007412 - protein, 18 aa, Entamoeba invadens
LPKLISRLQLVNGNLRVV

SEQ ID NO: 3007413 - protein, 30 aa, Entamoeba invadens
LPKNAEVYLIKYLPLFTSLAASATGKYESV

SEQ ID NO: 3007414 - protein, 24 aa, Entamoeba invadens
LPKQLFSMMIANRIALGFQFNSDT

SEQ ID NO: 3007415 - protein, 27 aa, Entamoeba invadens
LPKRETFYKIVVWYLVSYSSSLQTNHG

SEQ ID NO: 3007416 - protein, 18 aa, Entamoeba invadens
LPKSLITRFDFSSLTTIK

SEQ ID NO: 3007417 - protein, 23 aa, Entamoeba invadens
LPLAIESIVNYLYEKGFNVPGIF

SEQ ID NO: 3007418 - protein, 18 aa, Entamoeba invadens
LPLAPLPKRIEVKPLSSG

SEQ ID NO: 3007419 - protein, 27 aa, Entamoeba invadens
LPLEFSGFYPLWKFEVIYMAHNSTFHF

SEQ ID NO: 3007420 - protein, 30 aa, Entamoeba invadens
LPLENHNTLWYFFSFLRRVIEKEKINKMNS

SEQ ID NO: 3007421 - protein, 41 aa, Entamoeba invadens
LPLHLVKALYRLFPEKYHKNLYKIYLILNPSIKLKITTSFL

SEQ ID NO: 3007422 - protein, 19 aa, Entamoeba invadens
LPLIITRGNNVYGPHQFPE

SEQ ID NO: 3007423 - protein, 17 aa, Entamoeba invadens
LPLLDDKTTPRLSMGIM

SEQ ID NO: 3007424 - protein, 17 aa, Entamoeba invadens
LPLLSLKCKADKPKPRQ

SEQ ID NO: 3007425 - protein, 37 aa, Entamoeba invadens
LPLPPPNDLAPPPDLLPPPPGLAPPPANMPLPKMPPP

SEQ ID NO: 3007426 - protein, 22 aa, Entamoeba invadens
LPLRHPQLFKNIGIKPPRGVLM

SEQ ID NO: 3007427 - protein, 17 aa, Entamoeba invadens
LPLVIKTDCLCGTEILA

SEQ ID NO: 3007428 - protein, 17 aa, Entamoeba invadens
LPNAFHYSLSVSKTEFG

SEQ ID NO: 3007429 - protein, 17 aa, Entamoeba invadens
LPNIHVTLPNATFLLWL

SEQ ID NO: 3007430 - protein, 28 aa, Entamoeba invadens
LPNIMNYSLYYLLEIFHVSLPVQVNMCI

SEQ ID NO: 3007431 - protein, 31 aa, Entamoeba invadens
LPNNCDFCFSLRSLFSKSPTLLLSKKDGKIE

SEQ ID NO: 3007432 - protein, 26 aa, Entamoeba invadens
LPNSITSLPAYFFKNCVSLTLDNING

SEQ ID NO: 3007433 - protein, 23 aa, Entamoeba invadens
LPNVLLYLYRGGYVTKKALQEWY

SEQ ID NO: 3007434 - protein, 17 aa, Entamoeba invadens
LPPPEEMIILIDKYLKN

SEQ ID NO: 3007435 - protein, 20 aa, Entamoeba invadens
LPPQVETLFLRTIGKYEKTL

SEQ ID NO: 3007436 - protein, 32 aa, Entamoeba invadens
LPQAMSDSRFNFTFSHFKPISSVLAKSDKGGR

SEQ ID NO: 3007437 - protein, 19 aa, Entamoeba invadens
LPQFNAKFTGQLGLLKMGS

SEQ ID NO: 3007438 - protein, 24 aa, Entamoeba invadens
LPQGVLFNPMLFNTPVFNQNSQIY

SEQ ID NO: 3007439 - protein, 21 aa, Entamoeba invadens
LPQIPLPRPLSLLNKKEVTSA

SEQ ID NO: 3007440 - protein, 19 aa, Entamoeba invadens
LPQKRQLQLNLRLSPDFQQ

SEQ ID NO: 3007441 - protein, 30 aa, Entamoeba invadens
LPQNMQFHMNFLPYMSLIKQPKPVGRVENI

SEQ ID NO: 3007442 - protein, 27 aa, Entamoeba invadens
LPQNQRIPQLLRIISSLNAQETALMSE

SEQ ID NO: 3007443 - protein, 21 aa, Entamoeba invadens
LPRHVVIPAFLIDSGKEPRVC

SEQ ID NO: 3007444 - protein, 20 aa, Entamoeba invadens
LPRLLLLLQDEDTNIQKLCL

SEQ ID NO: 3007445 - protein, 17 aa, Entamoeba invadens
LPRLVGCGISLDTIFCL

SEQ ID NO: 3007446 - protein, 21 aa, Entamoeba invadens
LPRRTLLDAISRRLSSMKETR

SEQ ID NO: 3007447 - protein, 30 aa, Entamoeba invadens
LPRTGNSFTIIPQPFHLNLSASYQNTNEVQ

SEQ ID NO: 3007448 - protein, 33 aa, Entamoeba invadens
LPRVIRYNCVVPRKLVMWLKYSIYVADQRYQQL

SEQ ID NO: 3007449 - protein, 24 aa, Entamoeba invadens
LPRYRMLLDAIGKAGYKWFPLWKQ

SEQ ID NO: 3007450 - protein, 20 aa, Entamoeba invadens
LPSDEVALYQFKKILSVLSN

SEQ ID NO: 3007451 - protein, 19 aa, Entamoeba invadens
LPSFLAATSARDKALEYFT

SEQ ID NO: 3007452 - protein, 19 aa, Entamoeba invadens
LPSGCVFGVYRGKRYIVDY

SEQ ID NO: 3007453 - protein, 19 aa, Entamoeba invadens
LPSGCVFGVYRGQRYIVDY

SEQ ID NO: 3007454 - protein, 20 aa, Entamoeba invadens
LPSIFGQFRPDTIFSLFSST

SEQ ID NO: 3007455 - protein, 17 aa, Entamoeba invadens
LPSIVTLKRGEACEFEI

SEQ ID NO: 3007456 - protein, 35 aa, Entamoeba invadens
LPSLLNSLLMHIRRALLLFSRYPYTFLANSTMTFK

SEQ ID NO: 3007457 - protein, 17 aa, Entamoeba invadens
LPSLLQQNSEMPTVLED

SEQ ID NO: 3007458 - protein, 17 aa, Entamoeba invadens
LPSMLSSVYNKLCITVG

SEQ ID NO: 3007459 - protein, 22 aa, Entamoeba invadens
LPSQKNLFFYGNEQPKTLAKIN

SEQ ID NO: 3007460 - protein, 21 aa, Entamoeba invadens
LPSRPVLFEMIKIISEFLVVR

SEQ ID NO: 3007461 - protein, 24 aa, Entamoeba invadens
LPSSDFFPLFWDIVSKNLESTAPG

SEQ ID NO: 3007462 - protein, 27 aa, Entamoeba invadens
LPSSLNILITMPFPYPPGVLEQLVQFV

SEQ ID NO: 3007463 - protein, 27 aa, Entamoeba invadens
LPTDSLILLWDRLLTDLKSKKYLMYFC

SEQ ID NO: 3007464 - protein, 18 aa, Entamoeba invadens
LPTFLISPVQRIPRYILL

SEQ ID NO: 3007465 - protein, 17 aa, Entamoeba invadens
LPTFVFFQNQKVIIKRL

SEQ ID NO: 3007466 - protein, 33 aa, Entamoeba invadens
LPTHRLTVGSTYRVFLRIMKILQLIHNEGIVHG

SEQ ID NO: 3007467 - protein, 17 aa, Entamoeba invadens
LPTQQFEYQPAPTTNTI

SEQ ID NO: 3007468 - protein, 19 aa, Entamoeba invadens
LPTTLTKIRKFMFKNCRKL

SEQ ID NO: 3007469 - protein, 26 aa, Entamoeba invadens
LPTVIIFHLRKEVFRFTFASIQNVIK

SEQ ID NO: 3007470 - protein, 21 aa, Entamoeba invadens
LPVDIWLHVVPQIIARIQSDV

SEQ ID NO: 3007471 - protein, 20 aa, Entamoeba invadens
LPVDYVIQLLDIVCDLFTNT

SEQ ID NO: 3007472 - protein, 18 aa, Entamoeba invadens
LPVHLIVHLLKNVYQSLQ

SEQ ID NO: 3007473 - protein, 20 aa, Entamoeba invadens
LPVRPTLSPNLLQDIRRKSG

SEQ ID NO: 3007474 - protein, 24 aa, Entamoeba invadens
LPVSFARLTSLRKISFTANKFVEI

SEQ ID NO: 3007475 - protein, 18 aa, Entamoeba invadens
LPVWNAIDALLKKKDDVL

SEQ ID NO: 3007476 - protein, 18 aa, Entamoeba invadens
LPYALIPQQNQNLQQVVH

SEQ ID NO: 3007477 - protein, 19 aa, Entamoeba invadens
LPYMVKVYIPTRVVIVLVK

SEQ ID NO: 3007478 - protein, 27 aa, Entamoeba invadens
LPYRRPVGYMRYAINVLGKFDNGNDTW

SEQ ID NO: 3007479 - protein, 17 aa, Entamoeba invadens
LQAAVVNGFVGLTTYIL

SEQ ID NO: 3007480 - protein, 24 aa, Entamoeba invadens
LQADVERIWLLSEEKRLLSQKDEH

SEQ ID NO: 3007481 - protein, 32 aa, Entamoeba invadens
LQAKLLNQLYQLFPLFYRNLGFVLSTQESITP

SEQ ID NO: 3007482 - protein, 19 aa, Entamoeba invadens
LQALWVAWKFNAKNNIITL

SEQ ID NO: 3007483 - protein, 17 aa, Entamoeba invadens
LQARNYVGPLKFYVTLS

SEQ ID NO: 3007484 - protein, 18 aa, Entamoeba invadens
LQCFEIIKYSFLNVQKRQ

SEQ ID NO: 3007485 - protein, 17 aa, Entamoeba invadens
LQCFSHFSFFVSSKQFV

SEQ ID NO: 3007486 - protein, 33 aa, Entamoeba invadens
LQCKYNDILYTTDLVYFIGKKYIEYAKTQIELK

SEQ ID NO: 3007487 - protein, 33 aa, Entamoeba invadens
LQCKYNDILYTTDLVYFIGKKYIEYAKTQIESK

SEQ ID NO: 3007488 - protein, 29 aa, Entamoeba invadens
LQCTTNKVVLFLKDLFDAFSSFYNEYQTQ

SEQ ID NO: 3007489 - protein, 23 aa, Entamoeba invadens
LQDDALLPYVAPPVYDHIQTPTT

SEQ ID NO: 3007490 - protein, 24 aa, Entamoeba invadens
LQDDNITTFPFKKSPHPAPSKSKV

SEQ ID NO: 3007491 - protein, 23 aa, Entamoeba invadens
LQDGDYFGVSTRNQFIASQAGCI

SEQ ID NO: 3007492 - protein, 26 aa, Entamoeba invadens
LQDGIVFRDLLRKIGVPCGDTLPDVI

SEQ ID NO: 3007493 - protein, 26 aa, Entamoeba invadens
LQDGKMKWALLSRRIDQLDQLFNMLY

SEQ ID NO: 3007494 - protein, 26 aa, Entamoeba invadens
LQDLEYRPRDNQIADLEKAVAALKEQ

SEQ ID NO: 3007495 - protein, 33 aa, Entamoeba invadens
LQEFRLINSFFEKPFSFIFPTSLTRLEITTSAY

SEQ ID NO: 3007496 - protein, 18 aa, Entamoeba invadens
LQEIAIFLSSLCIGGVTS

SEQ ID NO: 3007497 - protein, 18 aa, Entamoeba invadens
LQEVLTKNINELYKYISE

SEQ ID NO: 3007498 - protein, 17 aa, Entamoeba invadens
LQFFFKNKTRKGDTAIF

SEQ ID NO: 3007499 - protein, 18 aa, Entamoeba invadens
LQFGELKERLISLSLSGC

SEQ ID NO: 3007500 - protein, 20 aa, Entamoeba invadens
LQFVTILRKNEVIFLSNELH

SEQ ID NO: 3007501 - protein, 19 aa, Entamoeba invadens
LQFVYKYGMLCNIMLSDPE

SEQ ID NO: 3007502 - protein, 22 aa, Entamoeba invadens
LQGITEVQYLLSRYPLDRTIDH

SEQ ID NO: 3007503 - protein, 18 aa, Entamoeba invadens
LQGKAKGFWTQQKTVDEK

SEQ ID NO: 3007504 - protein, 24 aa, Entamoeba invadens
LQGQSLLHYCAIYGRAIMAEEILK

SEQ ID NO: 3007505 - protein, 25 aa, Entamoeba invadens
LQGSYFSGWVGKVFLSCLIPKQDME

SEQ ID NO: 3007506 - protein, 27 aa, Entamoeba invadens
LQHEDYLPYLQMIIAHIIHILDTRCTN

SEQ ID NO: 3007507 - protein, 29 aa, Entamoeba invadens
LQHFPPQMQIYFGYRFLALHSPEEKRIGI

SEQ ID NO: 3007508 - protein, 22 aa, Entamoeba invadens
LQHGALLILTALLHNCREFMVS

SEQ ID NO: 3007509 - protein, 20 aa, Entamoeba invadens
LQHKNIIKPIGIFTDNEHLS

SEQ ID NO: 3007510 - protein, 17 aa, Entamoeba invadens
LQHNNVPLFTQKTIPLQ

SEQ ID NO: 3007511 - protein, 29 aa, Entamoeba invadens
LQIACIGNPLFDIISPLTDIFVNALKEIG

SEQ ID NO: 3007512 - protein, 18 aa, Entamoeba invadens
LQILINSVQDKLVKVCDL

SEQ ID NO: 3007513 - protein, 19 aa, Entamoeba invadens
LQILRIMYSMLKNAELDVR

SEQ ID NO: 3007514 - protein, 26 aa, Entamoeba invadens
LQIQSDEYLPLTPEFVPTGEFVKVAE

SEQ ID NO: 3007515 - protein, 18 aa, Entamoeba invadens
LQITLRPNVKESSIYCGF

SEQ ID NO: 3007516 - protein, 26 aa, Entamoeba invadens
LQIYESPLVNLTLPSSLTYLDLNLDS

SEQ ID NO: 3007517 - protein, 19 aa, Entamoeba invadens
LQKGGELFNRLIKMEQIEY

SEQ ID NO: 3007518 - protein, 29 aa, Entamoeba invadens
LQKGKEMPFRQVRFSIIPSKQELKKDWKT

SEQ ID NO: 3007519 - protein, 20 aa, Entamoeba invadens
LQKLFSHYLHFLRVPEVNAL

SEQ ID NO: 3007520 - protein, 24 aa, Entamoeba invadens
LQKNITIRLGYANAKIYKCSNPNC

SEQ ID NO: 3007521 - protein, 28 aa, Entamoeba invadens
LQKNVGRGILFLKKWKILMSDEGALNII

SEQ ID NO: 3007522 - protein, 17 aa, Entamoeba invadens
LQKRPIVVLAGNKCDLT

SEQ ID NO: 3007523 - protein, 25 aa, Entamoeba invadens
LQKYGTKLNAFLYLMNSQNIDQDIV

SEQ ID NO: 3007524 - protein, 33 aa, Entamoeba invadens
LQLEVKQQRLRELTERLRFLEERDALIQRALVV

SEQ ID NO: 3007525 - protein, 28 aa, Entamoeba invadens
LQLGRQNYFILRFPPDFFTDIKIYRVHS

SEQ ID NO: 3007526 - protein, 19 aa, Entamoeba invadens
LQLHSEGLTLLMVTHDVSL

SEQ ID NO: 3007527 - protein, 19 aa, Entamoeba invadens
LQLIGLLPPSVRKSQICTP

SEQ ID NO: 3007528 - protein, 34 aa, Entamoeba invadens
LQLKNVVLPPLIDTIPFYGFMNCLSLSSVTVPNK

SEQ ID NO: 3007529 - protein, 37 aa, Entamoeba invadens
LQLLKKNHLKYRKSVLWPFLDFFLVNNNTPLSCYQNS

SEQ ID NO: 3007530 - protein, 18 aa, Entamoeba invadens
LQLQLTTLKEIINTIIKS

SEQ ID NO: 3007531 - protein, 26 aa, Entamoeba invadens
LQLQMQSLQLGMLWINCIRNEMQAFI

SEQ ID NO: 3007532 - protein, 18 aa, Entamoeba invadens
LQLSIKFICGSHDFSPVL

SEQ ID NO: 3007533 - protein, 23 aa, Entamoeba invadens
LQLTNLAVHGVLPFFSKELLLFD

SEQ ID NO: 3007534 - protein, 21 aa, Entamoeba invadens
LQMILLTILQCQTPLKMCTKL

SEQ ID NO: 3007535 - protein, 19 aa, Entamoeba invadens
LQMLQLMNNIWKSAGLDLR

SEQ ID NO: 3007536 - protein, 25 aa, Entamoeba invadens
LQMVKAMFVILSYDQQIPPNNFINF

SEQ ID NO: 3007537 - protein, 18 aa, Entamoeba invadens
LQMWTNKKMYKVIYSSIT

SEQ ID NO: 3007538 - protein, 23 aa, Entamoeba invadens
LQNEPILLEIEKKLNLAPGSLRF

SEQ ID NO: 3007539 - protein, 19 aa, Entamoeba invadens
LQNIHNLFDSLPLAALVEG

SEQ ID NO: 3007540 - protein, 25 aa, Entamoeba invadens
LQNIKSNIKILYTPQLLPGNEQIFK

SEQ ID NO: 3007541 - protein, 18 aa, Entamoeba invadens
LQNILSFITGEKTFFERM

SEQ ID NO: 3007542 - protein, 17 aa, Entamoeba invadens
LQNIVFPSSLHSIGKEC

SEQ ID NO: 3007543 - protein, 28 aa, Entamoeba invadens
LQNLKKTVPFLLEKLLADAWNSDPFQRP

SEQ ID NO: 3007544 - protein, 26 aa, Entamoeba invadens
LQNNWNVQLLFSQKLAVPSNMSLFQM

SEQ ID NO: 3007545 - protein, 33 aa, Entamoeba invadens
LQNRYIGLLLDILAKISPLFPSLSLEFQLLLEH

SEQ ID NO: 3007546 - protein, 25 aa, Entamoeba invadens
LQNSDLLYLNLLNARVFLSQNNLIE

SEQ ID NO: 3007547 - protein, 30 aa, Entamoeba invadens
LQNSKDFFEIIFAFALPLKPNAREVLSDLV

SEQ ID NO: 3007548 - protein, 23 aa, Entamoeba invadens
LQNSVPLLQLPGTTIREILKTLT

SEQ ID NO: 3007549 - protein, 22 aa, Entamoeba invadens
LQPEFLAEQLILFDLKEFQKVH

SEQ ID NO: 3007550 - protein, 18 aa, Entamoeba invadens
LQPEVFAFHTKVEQIQFI

SEQ ID NO: 3007551 - protein, 18 aa, Entamoeba invadens
LQPILWKEYYMCFRGCHT

SEQ ID NO: 3007552 - protein, 32 aa, Entamoeba invadens
LQPKHVDNPYFPQIPFFKLKNQDKKTNNSLSK

SEQ ID NO: 3007553 - protein, 25 aa, Entamoeba invadens
LQPKKTSELFLPPEAINNIEISHVN

SEQ ID NO: 3007554 - protein, 19 aa, Entamoeba invadens
LQPLHVYVCQGHLSDIVKL

SEQ ID NO: 3007555 - protein, 20 aa, Entamoeba invadens
LQPLSQMNFLKVGVSMVTTP

SEQ ID NO: 3007556 - protein, 30 aa, Entamoeba invadens
LQPNIDTNPPLCQIIPFVISEPIISVTDIT

SEQ ID NO: 3007557 - protein, 24 aa, Entamoeba invadens
LQPNILVVVLMFLKAPIGEQTLTS

SEQ ID NO: 3007558 - protein, 22 aa, Entamoeba invadens
LQPRIITVLYNGEYIKVFKRET

SEQ ID NO: 3007559 - protein, 35 aa, Entamoeba invadens
LQQEDYYHMFQVISYLYFAPFRQQSNVRIINKLDQ

SEQ ID NO: 3007560 - protein, 24 aa, Entamoeba invadens
LQQGILKGGLLYLLNHFVSGIDLE

SEQ ID NO: 3007561 - protein, 18 aa, Entamoeba invadens
LQQISWFVVVIDEAQRLK

SEQ ID NO: 3007562 - protein, 28 aa, Entamoeba invadens
LQQKDISSFIYLYPIFDNYKYYVRFDNH

SEQ ID NO: 3007563 - protein, 18 aa, Entamoeba invadens
LQQLTPYFIRYISNHVLT

SEQ ID NO: 3007564 - protein, 26 aa, Entamoeba invadens
LQQQMKLLRSEKWLERVSIETKAKVL

SEQ ID NO: 3007565 - protein, 17 aa, Entamoeba invadens
LQQQVVMKQLSPAALKT

SEQ ID NO: 3007566 - protein, 28 aa, Entamoeba invadens
LQRAMQGGMPQMGGFPPPPMTSQPQQQF

SEQ ID NO: 3007567 - protein, 25 aa, Entamoeba invadens
LQRDESIMLPLLPISDRTLNLAYEE

SEQ ID NO: 3007568 - protein, 19 aa, Entamoeba invadens
LQRIILKENVVLEKGAFSN

SEQ ID NO: 3007569 - protein, 23 aa, Entamoeba invadens
LQRIKMVLKYMYPDGIYDYNILK

SEQ ID NO: 3007570 - protein, 24 aa, Entamoeba invadens
LQRKPPYFMPAPNNKFEIGKITIG

SEQ ID NO: 3007571 - protein, 34 aa, Entamoeba invadens
LQSIKPDQILLLDTYFYLIVFRGNVVADWMKQKL

SEQ ID NO: 3007572 - protein, 27 aa, Entamoeba invadens
LQSKMQSVLIMFLLKYCDMTVGRPHRK

SEQ ID NO: 3007573 - protein, 18 aa, Entamoeba invadens
LQSLFIPNEPIATFPPQE

SEQ ID NO: 3007574 - protein, 22 aa, Entamoeba invadens
LQSRLVVRLTLFNITKQTICNL

SEQ ID NO: 3007575 - protein, 26 aa, Entamoeba invadens
LQTDLECFLLSLLSQRYGLTVTQPQK

SEQ ID NO: 3007576 - protein, 18 aa, Entamoeba invadens
LQTEGKMPLKRLGELLSV

SEQ ID NO: 3007577 - protein, 24 aa, Entamoeba invadens
LQTFKTFWEDFDGKTIELYNARGK

SEQ ID NO: 3007578 - protein, 38 aa, Entamoeba invadens
LQTIDSFRFDILEKKIDIILFRTDLIMKELRTIPRCKD

SEQ ID NO: 3007579 - protein, 17 aa, Entamoeba invadens
LQTIELIPDLLLQLQEC

SEQ ID NO: 3007580 - protein, 26 aa, Entamoeba invadens
LQTIKIALFVEKCLLREVMREEFEKI

SEQ ID NO: 3007581 - protein, 31 aa, Entamoeba invadens
LQTKPMFKKPHLSIKRFKFSAPTAKTKLMDK

SEQ ID NO: 3007582 - protein, 25 aa, Entamoeba invadens
LQTKRSSLTLKYETLQKEFNQYKIT

SEQ ID NO: 3007583 - protein, 20 aa, Entamoeba invadens
LQTLFKRLEKLPVGADTSVS

SEQ ID NO: 3007584 - protein, 21 aa, Entamoeba invadens
LQTLINIIIGALRIMSQPQTQ

SEQ ID NO: 3007585 - protein, 23 aa, Entamoeba invadens
LQTLQQCLCICLLSEFADITIKQ

SEQ ID NO: 3007586 - protein, 19 aa, Entamoeba invadens
LQTQKLSRTPKIKSAIDAL

SEQ ID NO: 3007587 - protein, 22 aa, Entamoeba invadens
LQTQRPWKCVHYKNIVVMLLIE

SEQ ID NO: 3007588 - protein, 20 aa, Entamoeba invadens
LQTRVFFFTKQNETAKIAMA

SEQ ID NO: 3007589 - protein, 21 aa, Entamoeba invadens
LQTTYYRGLTKAKIQQLFITE

SEQ ID NO: 3007590 - protein, 28 aa, Entamoeba invadens
LQTVKGPYMVFLSIGDTRVYYYSKQHHH

SEQ ID NO: 3007591 - protein, 17 aa, Entamoeba invadens
LQTWFKVKVRSLGEKCF

SEQ ID NO: 3007592 - protein, 31 aa, Entamoeba invadens
LQTWSGQNVGPIIYDVFKDLSVRGSNGLIKK

SEQ ID NO: 3007593 - protein, 25 aa, Entamoeba invadens
LQVDLFKITLLLDCSKRFSFEFFSI

SEQ ID NO: 3007594 - protein, 17 aa, Entamoeba invadens
LQVFYDALGVDVSKHQI

SEQ ID NO: 3007595 - protein, 18 aa, Entamoeba invadens
LQVVGILRDILFEVKKKD

SEQ ID NO: 3007596 - protein, 26 aa, Entamoeba invadens
LQWIKEFVVLMKKWYGVQKAFNIDKK

SEQ ID NO: 3007597 - protein, 25 aa, Entamoeba invadens
LQWVNSIPLFSNFTGVFGYPLQSIT

SEQ ID NO: 3007598 - protein, 20 aa, Entamoeba invadens
LQYNIPQDLIRLLCLPLTIA

SEQ ID NO: 3007599 - protein, 19 aa, Entamoeba invadens
LRCDPQDHYFLLTEPPMNP

SEQ ID NO: 3007600 - protein, 24 aa, Entamoeba invadens
LRCESVLTFLEYQRKVIAEEERIN

SEQ ID NO: 3007601 - protein, 18 aa, Entamoeba invadens
LRCFIHNRILRKITLSPN

SEQ ID NO: 3007602 - protein, 17 aa, Entamoeba invadens
LRCLTCNSTNYKTLTGD

SEQ ID NO: 3007603 - protein, 18 aa, Entamoeba invadens
LRCNGVLEGIRITRLGYP

SEQ ID NO: 3007604 - protein, 25 aa, Entamoeba invadens
LRDEALFYVLTKLNPGKTLVFVNAI

SEQ ID NO: 3007605 - protein, 22 aa, Entamoeba invadens
LRDFSSLYPWNAFVSTFNVMPF

SEQ ID NO: 3007606 - protein, 20 aa, Entamoeba invadens
LRDLLDDFPPLIFQSESSQE

SEQ ID NO: 3007607 - protein, 18 aa, Entamoeba invadens
LRDLVIPSLVTYLHDGLF

SEQ ID NO: 3007608 - protein, 25 aa, Entamoeba invadens
LRDRAHIYWRILFNHPEEAKKIINE

SEQ ID NO: 3007609 - protein, 30 aa, Entamoeba invadens
LRDVKNVYPVPFVLLFNPEEFRNFVHEFNS

SEQ ID NO: 3007610 - protein, 19 aa, Entamoeba invadens
LRDVLNLHLVSRQYKTLLI

SEQ ID NO: 3007611 - protein, 19 aa, Entamoeba invadens
LRDVRKLANPVWSFSAHTK

SEQ ID NO: 3007612 - protein, 26 aa, Entamoeba invadens
LRDYTYEVVAKWYKAPELLLGAKAYG

SEQ ID NO: 3007613 - protein, 23 aa, Entamoeba invadens
LREDFIPTIKFSYTNLRSMQIIS

SEQ ID NO: 3007614 - protein, 17 aa, Entamoeba invadens
LREEMAHIIGFNTIADF

SEQ ID NO: 3007615 - protein, 30 aa, Entamoeba invadens
LREKANGKQKIYWYNQDLIEGVSAEALHDL

SEQ ID NO: 3007616 - protein, 18 aa, Entamoeba invadens
LREKIIGGAVELLQSFKG

SEQ ID NO: 3007617 - protein, 28 aa, Entamoeba invadens
LREPYSIIRFFIERLPLEKNYGIELKEG

SEQ ID NO: 3007618 - protein, 26 aa, Entamoeba invadens
LREQNDFIVYWVKTLVKYKKIGITVC

SEQ ID NO: 3007619 - protein, 24 aa, Entamoeba invadens
LRERALKLLCRFLDLGPWACDQAL

SEQ ID NO: 3007620 - protein, 34 aa, Entamoeba invadens
LRERLTFLMQPKRLDLVCFKKSFGVEETYKVCED

SEQ ID NO: 3007621 - protein, 17 aa, Entamoeba invadens
LRERRSHVTQEDFELAA

SEQ ID NO: 3007622 - protein, 24 aa, Entamoeba invadens
LRESEDLWKLKKKPLLMTYDEMSK

SEQ ID NO: 3007623 - protein, 17 aa, Entamoeba invadens
LRESIIWCDSRGISYGK

SEQ ID NO: 3007624 - protein, 18 aa, Entamoeba invadens
LRFDVLLDLIRRLFVEEK

SEQ ID NO: 3007625 - protein, 21 aa, Entamoeba invadens
LRFDYKIDFIKWCLKVPNYQR

SEQ ID NO: 3007626 - protein, 21 aa, Entamoeba invadens
LRFMRVFDSLKTGHLTIYEFV

SEQ ID NO: 3007627 - protein, 22 aa, Entamoeba invadens
LRFVNKKIFFLTQHISHLSIYD

SEQ ID NO: 3007628 - protein, 24 aa, Entamoeba invadens
LRGHISKIYAMHWAADSTHLVSAS

SEQ ID NO: 3007629 - protein, 29 aa, Entamoeba invadens
LRGKKEILDRFKLFRFNKYTFEDQPFAED

SEQ ID NO: 3007630 - protein, 21 aa, Entamoeba invadens
LRHPQLFQAIGIKPPKGVLLY

SEQ ID NO: 3007631 - protein, 23 aa, Entamoeba invadens
LRIEPTPLLLTAIVNFLKTEKWM

SEQ ID NO: 3007632 - protein, 27 aa, Entamoeba invadens
LRIFNRNVFVFTNNLLLDLCLEEGYYI

SEQ ID NO: 3007633 - protein, 20 aa, Entamoeba invadens
LRIHQFPFLNRFADSLKFRP

SEQ ID NO: 3007634 - protein, 21 aa, Entamoeba invadens
LRILEFFSGIGGLRASLERSK

SEQ ID NO: 3007635 - protein, 32 aa, Entamoeba invadens
LRINPYKVVSYLPFLLNSLPNINTLYITVLDA

SEQ ID NO: 3007636 - protein, 23 aa, Entamoeba invadens
LRIRSFLLNKFAYSLLNFLEENE

SEQ ID NO: 3007637 - protein, 18 aa, Entamoeba invadens
LRITLTPAIKLKLCSEMA

SEQ ID NO: 3007638 - protein, 17 aa, Entamoeba invadens
LRKDPFCKVKIPGATLV

SEQ ID NO: 3007639 - protein, 28 aa, Entamoeba invadens
LRKEKEDFVILPYKLKVRMLFDTARGMQ

SEQ ID NO: 3007640 - protein, 24 aa, Entamoeba invadens
LRKETFPHLFPSFSTPDVAVELRD

SEQ ID NO: 3007641 - protein, 32 aa, Entamoeba invadens
LRKHKILHEKYPHLPFFFHCRSAWEDFKTICE

SEQ ID NO: 3007642 - protein, 17 aa, Entamoeba invadens
LRKIDPLIFVNTKNLEI

SEQ ID NO: 3007643 - protein, 19 aa, Entamoeba invadens
LRKIVLPTNLLFLGNNCFS

SEQ ID NO: 3007644 - protein, 21 aa, Entamoeba invadens
LRKKHPTLLPTGLAHEFFIDS

SEQ ID NO: 3007645 - protein, 25 aa, Entamoeba invadens
LRKKIVLPALCFKILQITPKSKNVF

SEQ ID NO: 3007646 - protein, 25 aa, Entamoeba invadens
LRKMHDTHLYMFRAVKKYISMKACA

SEQ ID NO: 3007647 - protein, 24 aa, Entamoeba invadens
LRKMVDVFKAEWWFGGITKDDAVA

SEQ ID NO: 3007648 - protein, 21 aa, Entamoeba invadens
LRKNSLLVKSFYDVAENIRCF

SEQ ID NO: 3007649 - protein, 17 aa, Entamoeba invadens
LRKRFYDEGPAPSFEAF

SEQ ID NO: 3007650 - protein, 21 aa, Entamoeba invadens
LRKRKKLPLGFPYIQHIKEEH

SEQ ID NO: 3007651 - protein, 19 aa, Entamoeba invadens
LRKSIVPGVVCIIVAGKYA

SEQ ID NO: 3007652 - protein, 25 aa, Entamoeba invadens
LRKTADVIALKKYHKKDLTIALKQS

SEQ ID NO: 3007653 - protein, 22 aa, Entamoeba invadens
LRKTEMFYQLLDWGFDVISEEA

SEQ ID NO: 3007654 - protein, 32 aa, Entamoeba invadens
LRKYPADFLVMSFYKIVGYPTGLGALIVKNSV

SEQ ID NO: 3007655 - protein, 25 aa, Entamoeba invadens
LRLATMEFVKFLKGLVSNSQFLLSP

SEQ ID NO: 3007656 - protein, 17 aa, Entamoeba invadens
LRLIVYGKVIGPGPSPV

SEQ ID NO: 3007657 - protein, 20 aa, Entamoeba invadens
LRLLLPMRCDEFENQKRCYV

SEQ ID NO: 3007658 - protein, 21 aa, Entamoeba invadens
LRLNHITYHKLALSTKNVLRE

SEQ ID NO: 3007659 - protein, 39 aa, Entamoeba invadens
LRLRFSNIRRQITYILLTNHFLIFDTMLQFSLSTIDLPE

SEQ ID NO: 3007660 - protein, 26 aa, Entamoeba invadens
LRLSLKPTMEMILKQDSRRLSVPGNL

SEQ ID NO: 3007661 - protein, 19 aa, Entamoeba invadens
LRLVLINGKYYLQAETEDQ

SEQ ID NO: 3007662 - protein, 21 aa, Entamoeba invadens
LRMCVEMALGISWLNNVVGVV

SEQ ID NO: 3007663 - protein, 18 aa, Entamoeba invadens
LRMKGVNIEPLILVYEYC

SEQ ID NO: 3007664 - protein, 21 aa, Entamoeba invadens
LRMTERRLLTKGHIVIVIAEG

SEQ ID NO: 3007665 - protein, 20 aa, Entamoeba invadens
LRMTFADVQIYFNSGDRVKV

SEQ ID NO: 3007666 - protein, 19 aa, Entamoeba invadens
LRMVKIVSYYVLNCQLPPA

SEQ ID NO: 3007667 - protein, 26 aa, Entamoeba invadens
LRNDFSLAVRFLISQNISQLKKCRAG

SEQ ID NO: 3007668 - protein, 29 aa, Entamoeba invadens
LRNKNIIGHQFFWFLKAEMHDNRVAERYG

SEQ ID NO: 3007669 - protein, 29 aa, Entamoeba invadens
LRNKNRIGHQFFWFLKAELHDNRVTERYG

SEQ ID NO: 3007670 - protein, 20 aa, Entamoeba invadens
LRNLGQLYTYLVISVSITQI

SEQ ID NO: 3007671 - protein, 17 aa, Entamoeba invadens
LRNPDTMYYIPGYLGFS

SEQ ID NO: 3007672 - protein, 32 aa, Entamoeba invadens
LRNRNGIYSGIKFILQIKGRPYYYASHDREMY

SEQ ID NO: 3007673 - protein, 29 aa, Entamoeba invadens
LRNRPAHILFIKHFYLNVLQLPPDETTKG

SEQ ID NO: 3007674 - protein, 20 aa, Entamoeba invadens
LRNVCPTTNLLWREQTAVFH

SEQ ID NO: 3007675 - protein, 30 aa, Entamoeba invadens
LRNVFENFLISQLNYSLVVLSLKNTQIGRL

SEQ ID NO: 3007676 - protein, 22 aa, Entamoeba invadens
LRNVVLYLPKLSDLINFVCINK

SEQ ID NO: 3007677 - protein, 21 aa, Entamoeba invadens
LRNVVLYLPTLKDLLNFVCIN

SEQ ID NO: 3007678 - protein, 22 aa, Entamoeba invadens
LRNVVLYLPTLSDLINFVCINK

SEQ ID NO: 3007679 - protein, 22 aa, Entamoeba invadens
LRNYFTFLNIVASKSALKFIFV

SEQ ID NO: 3007680 - protein, 24 aa, Entamoeba invadens
LRNYNSKFLPFTSLTQLRELTIYG

SEQ ID NO: 3007681 - protein, 23 aa, Entamoeba invadens
LRPNTEYFTLKKDIYGYVAEHWY

SEQ ID NO: 3007682 - protein, 19 aa, Entamoeba invadens
LRPVLKPSVLPKRTTPKKE

SEQ ID NO: 3007683 - protein, 21 aa, Entamoeba invadens
LRPVSYSNASVFLLCFAVNSA

SEQ ID NO: 3007684 - protein, 23 aa, Entamoeba invadens
LRPYWKCYYEKCSAIIFVVDSTD

SEQ ID NO: 3007685 - protein, 21 aa, Entamoeba invadens
LRPYWRCYYSNTNAIIFVVDS

SEQ ID NO: 3007686 - protein, 27 aa, Entamoeba invadens
LRQCQTCSTGFYPLQTSPYTCQQCHSS

SEQ ID NO: 3007687 - protein, 26 aa, Entamoeba invadens
LRQDCLILRAFQLFDDIWKNEGKDYR

SEQ ID NO: 3007688 - protein, 19 aa, Entamoeba invadens
LRQFVHTIPYIMTEQFFFE

SEQ ID NO: 3007689 - protein, 19 aa, Entamoeba invadens
LRQGMLEITVLTILNDFYN

SEQ ID NO: 3007690 - protein, 19 aa, Entamoeba invadens
LRQNCFNSNKFLVKVTLKG

SEQ ID NO: 3007691 - protein, 22 aa, Entamoeba invadens
LRQNLTYSKTFGLWIKNIQVDQ

SEQ ID NO: 3007692 - protein, 20 aa, Entamoeba invadens
LRQQNLVLDPKILTMQNPQM

SEQ ID NO: 3007693 - protein, 17 aa, Entamoeba invadens
LRQTSVLYGPRGLLNFL

SEQ ID NO: 3007694 - protein, 31 aa, Entamoeba invadens
LRQVKVWEDYINWLTKNRLILEFDDIIQQPD

SEQ ID NO: 3007695 - protein, 18 aa, Entamoeba invadens
LRRHCAFKILTENVLYTF

SEQ ID NO: 3007696 - protein, 25 aa, Entamoeba invadens
LRRHITMINRFFKTLTDLPTNLSDI

SEQ ID NO: 3007697 - protein, 26 aa, Entamoeba invadens
LRRHVNSSIFPLYIAHCLTVGSETSF

SEQ ID NO: 3007698 - protein, 24 aa, Entamoeba invadens
LRRMELCADLLFYADDYTIRSEEE

SEQ ID NO: 3007699 - protein, 17 aa, Entamoeba invadens
LRRMVIPSSVTFIGECC

SEQ ID NO: 3007700 - protein, 25 aa, Entamoeba invadens
LRRQEEIWIVMEFCFYGSVADMIDI

SEQ ID NO: 3007701 - protein, 33 aa, Entamoeba invadens
LRRWKERFVVVKNTFLFYFVNEKSMLKLEQPHS

SEQ ID NO: 3007702 - protein, 25 aa, Entamoeba invadens
LRSCFHFPGRYNLVQTLACEESGAG

SEQ ID NO: 3007703 - protein, 24 aa, Entamoeba invadens
LRSNQLMTKGFYRYGRYLDDTRKE

SEQ ID NO: 3007704 - protein, 25 aa, Entamoeba invadens
LRSQKGVLSVLFGNAQFLNELTVQV

SEQ ID NO: 3007705 - protein, 17 aa, Entamoeba invadens
LRSSKWCLRCSDGDYIM

SEQ ID NO: 3007706 - protein, 28 aa, Entamoeba invadens
LRSVYQNMDVQLIPKVPNFQGNFNIIIE

SEQ ID NO: 3007707 - protein, 19 aa, Entamoeba invadens
LRTHRDILRKEYEIAFDKL

SEQ ID NO: 3007708 - protein, 19 aa, Entamoeba invadens
LRTLDIWEAFTQHLHLPVV

SEQ ID NO: 3007709 - protein, 22 aa, Entamoeba invadens
LRTLFLKIKIIQWKKTIWDKGV

SEQ ID NO: 3007710 - protein, 19 aa, Entamoeba invadens
LRTNLVVCSKLLQFVFETP

SEQ ID NO: 3007711 - protein, 28 aa, Entamoeba invadens
LRTRDNLLMFFQFFYQKALALPPTDETI

SEQ ID NO: 3007712 - protein, 31 aa, Entamoeba invadens
LRVDSCPWGFLLRLLDRYKLRVPVKGGYVAW

SEQ ID NO: 3007713 - protein, 28 aa, Entamoeba invadens
LRVEEGVLKKVYFWHEGLGFTFVHNGIE

SEQ ID NO: 3007714 - protein, 28 aa, Entamoeba invadens
LRVEEGVLKKVYFWHQGLGFTFVHNGGE

SEQ ID NO: 3007715 - protein, 20 aa, Entamoeba invadens
LRVFDIIMHTPFGTSYNSFL

SEQ ID NO: 3007716 - protein, 35 aa, Entamoeba invadens
LRVLDVGCGCGYTLLLLFQAGYTRLYGVDYCEGSV

SEQ ID NO: 3007717 - protein, 19 aa, Entamoeba invadens
LRVVFADQSVAKHVMLLKT

SEQ ID NO: 3007718 - protein, 19 aa, Entamoeba invadens
LRVVLPQVAITRELFDYFA

SEQ ID NO: 3007719 - protein, 17 aa, Entamoeba invadens
LRVWETDSGTLVKEMRR

SEQ ID NO: 3007720 - protein, 18 aa, Entamoeba invadens
LRYEVAWCFVNILSILDE

SEQ ID NO: 3007721 - protein, 20 aa, Entamoeba invadens
LRYIEHWSNSALMKPTLVGD

SEQ ID NO: 3007722 - protein, 18 aa, Entamoeba invadens
LRYPLFATSCSVVNWWTV

SEQ ID NO: 3007723 - protein, 17 aa, Entamoeba invadens
LSADFLKINLWNYNHAD

SEQ ID NO: 3007724 - protein, 21 aa, Entamoeba invadens
LSAILCFRISADGKGMIMNQF

SEQ ID NO: 3007725 - protein, 17 aa, Entamoeba invadens
LSALRILAPTYADNLLD

SEQ ID NO: 3007726 - protein, 19 aa, Entamoeba invadens
LSCFHYNPISLTLKTRRLF

SEQ ID NO: 3007727 - protein, 25 aa, Entamoeba invadens
LSCGHTFCLTCIRKIFREDNVCPTC

SEQ ID NO: 3007728 - protein, 27 aa, Entamoeba invadens
LSCRDFEYNWVLPTNLTRLYMFDQNIV

SEQ ID NO: 3007729 - protein, 26 aa, Entamoeba invadens
LSCRNFEYNWVLPTNLTRLDMFDQNI

SEQ ID NO: 3007730 - protein, 23 aa, Entamoeba invadens
LSCSKTFLFIQFNKKNIIEKIRK

SEQ ID NO: 3007731 - protein, 31 aa, Entamoeba invadens
LSCSTENWRFFYLNMFVYNLKNSFAERKSFI

SEQ ID NO: 3007732 - protein, 20 aa, Entamoeba invadens
LSCTIVITKDYYSNVLIDVW

SEQ ID NO: 3007733 - protein, 18 aa, Entamoeba invadens
LSCYSLKEITLPKNIQTI

SEQ ID NO: 3007734 - protein, 28 aa, Entamoeba invadens
LSDDAFFQTLYLPALLDDKQYQIMKNTL

SEQ ID NO: 3007735 - protein, 17 aa, Entamoeba invadens
LSDECFSDCINLRIVEL

SEQ ID NO: 3007736 - protein, 28 aa, Entamoeba invadens
LSDGGCAICQNEYYWQGRNCYKCGNNCT

SEQ ID NO: 3007737 - protein, 20 aa, Entamoeba invadens
LSDGLIPSALYQQFVSAGNT

SEQ ID NO: 3007738 - protein, 24 aa, Entamoeba invadens
LSDHWGIIWGSFQTLLKSGIDPTV

SEQ ID NO: 3007739 - protein, 19 aa, Entamoeba invadens
LSDIIVFVCVNKKCLKLVQ

SEQ ID NO: 3007740 - protein, 28 aa, Entamoeba invadens
LSDINLHIEILPLNLLEIQGSPLKIIEY

SEQ ID NO: 3007741 - protein, 23 aa, Entamoeba invadens
LSDKKRVKFLKSLDVLMDQALTK

SEQ ID NO: 3007742 - protein, 25 aa, Entamoeba invadens
LSDKVLQVTLLYKAYDFCKKNKVNK

SEQ ID NO: 3007743 - protein, 30 aa, Entamoeba invadens
LSDLGITLGLSFLPTLPLDKSNKVPSEYLV

SEQ ID NO: 3007744 - protein, 20 aa, Entamoeba invadens
LSDLKCHVLIILISNAVSDT

SEQ ID NO: 3007745 - protein, 26 aa, Entamoeba invadens
LSDSEFFLPIFNSFSTRYLGNLVNLI

SEQ ID NO: 3007746 - protein, 23 aa, Entamoeba invadens
LSDSLALNFFKENVFPTLQKNVG

SEQ ID NO: 3007747 - protein, 22 aa, Entamoeba invadens
LSDVVMRSFATPGFFTCHQSYV

SEQ ID NO: 3007748 - protein, 17 aa, Entamoeba invadens
LSDYVDFALAKYLQETF

SEQ ID NO: 3007749 - protein, 24 aa, Entamoeba invadens
LSDYVYTLMRNLFNSANYSSVDLI

SEQ ID NO: 3007750 - protein, 25 aa, Entamoeba invadens
LSEDDFFLMSILLHSQKKKVFVFLA

SEQ ID NO: 3007751 - protein, 44 aa, Entamoeba invadens
LSEEDKILILQNNFIPLGLFTKLLRFLRLLLKFNQFKDNEGLVQ

SEQ ID NO: 3007752 - protein, 22 aa, Entamoeba invadens
LSEEVYSLVALLWERGVFDVKN

SEQ ID NO: 3007753 - protein, 25 aa, Entamoeba invadens
LSEFSHCLVYFKFHLNTNTVYHPLV

SEQ ID NO: 3007754 - protein, 24 aa, Entamoeba invadens
LSEHNLLELCFLAKSIMSLESNVI

SEQ ID NO: 3007755 - protein, 23 aa, Entamoeba invadens
LSEIFPECRFYAGLAMLHGFGVK

SEQ ID NO: 3007756 - protein, 18 aa, Entamoeba invadens
LSEIILPKSISDISYGCF

SEQ ID NO: 3007757 - protein, 20 aa, Entamoeba invadens
LSEITLPLKVTVLPKSCFAD

SEQ ID NO: 3007758 - protein, 23 aa, Entamoeba invadens
LSEKLAPFIPKIFEGVFVTLNTN

SEQ ID NO: 3007759 - protein, 20 aa, Entamoeba invadens
LSELIEDLNFYPIADIKSVY

SEQ ID NO: 3007760 - protein, 25 aa, Entamoeba invadens
LSELQHLTIRLIYCSSFTISNSNDI

SEQ ID NO: 3007761 - protein, 19 aa, Entamoeba invadens
LSELSTEPYLPEWLHFACD

SEQ ID NO: 3007762 - protein, 25 aa, Entamoeba invadens
LSEMNLPFQWAVRKNIFYVNNISIV

SEQ ID NO: 3007763 - protein, 30 aa, Entamoeba invadens
LSEPYSIYTYRYFLRNWPNLCFLAKDEDTK

SEQ ID NO: 3007764 - protein, 25 aa, Entamoeba invadens
LSERNYINANYIFGKKYISCQAPLE

SEQ ID NO: 3007765 - protein, 29 aa, Entamoeba invadens
LSETLRYWDFFFLDLDNFPLVKATCVGIL

SEQ ID NO: 3007766 - protein, 24 aa, Entamoeba invadens
LSETRFLYNVLVSNWVFEYYKEFV

SEQ ID NO: 3007767 - protein, 18 aa, Entamoeba invadens
LSEVMWKCRSIGAYYGEE

SEQ ID NO: 3007768 - protein, 28 aa, Entamoeba invadens
LSFEIFMTGFVRNLTPLPLPINSIDVPN

SEQ ID NO: 3007769 - protein, 17 aa, Entamoeba invadens
LSFIGECAFWGCSSLEK

SEQ ID NO: 3007770 - protein, 22 aa, Entamoeba invadens
LSFINSFYMVIASSPTKPLVVG

SEQ ID NO: 3007771 - protein, 20 aa, Entamoeba invadens
LSFITKFFHKTEYIKLFIDT

SEQ ID NO: 3007772 - protein, 25 aa, Entamoeba invadens
LSFLDTIPKFCFFNCCSLTSLKLSS

SEQ ID NO: 3007773 - protein, 25 aa, Entamoeba invadens
LSFPDLLSCRLVCKKWRDILTETQS

SEQ ID NO: 3007774 - protein, 21 aa, Entamoeba invadens
LSFSGMLRENVDIKKMLAKVV

SEQ ID NO: 3007775 - protein, 19 aa, Entamoeba invadens
LSFSINDFYELIFDQIDTN

SEQ ID NO: 3007776 - protein, 19 aa, Entamoeba invadens
LSFSLFYNDEFVFVGKTKE

SEQ ID NO: 3007777 - protein, 30 aa, Entamoeba invadens
LSFYTKIVNDLVFLFTFGKVAISLFDNSSS

SEQ ID NO: 3007778 - protein, 17 aa, Entamoeba invadens
LSFYYNDPQFFANASSD

SEQ ID NO: 3007779 - protein, 23 aa, Entamoeba invadens
LSGCNFLYELFLNEARFNTRITL

SEQ ID NO: 3007780 - protein, 18 aa, Entamoeba invadens
LSGDIMFSLCRIAKEAAP

SEQ ID NO: 3007781 - protein, 19 aa, Entamoeba invadens
LSGDKLIIGDKKPFFISLP

SEQ ID NO: 3007782 - protein, 20 aa, Entamoeba invadens
LSGGMTIINFGLSQAKMSDK

SEQ ID NO: 3007783 - protein, 38 aa, Entamoeba invadens
LSGGQKSLLALSLILAILVYKPSPLYILDEVDAALDVS

SEQ ID NO: 3007784 - protein, 34 aa, Entamoeba invadens
LSGHNQMIATPFDLFFLALHFLTIEHVLSLHATE

SEQ ID NO: 3007785 - protein, 24 aa, Entamoeba invadens
LSGHNTLVLMPTGGGKSLCYQLAS

SEQ ID NO: 3007786 - protein, 27 aa, Entamoeba invadens
LSGKITNWLSTKGFLVDLFQSNYCLAI

SEQ ID NO: 3007787 - protein, 24 aa, Entamoeba invadens
LSGKMFMFNGLTLMHKIVTTKKRS

SEQ ID NO: 3007788 - protein, 19 aa, Entamoeba invadens
LSGLLTFILIAGEGMERIS

SEQ ID NO: 3007789 - protein, 25 aa, Entamoeba invadens
LSGQSLWDLYTFSSTKKDLVVEGNL

SEQ ID NO: 3007790 - protein, 25 aa, Entamoeba invadens
LSGSQLYEMFLQGKLLLHECTVKSQ

SEQ ID NO: 3007791 - protein, 25 aa, Entamoeba invadens
LSGTLIEMYLNIFDFVRVLQNLQEL

SEQ ID NO: 3007792 - protein, 28 aa, Entamoeba invadens
LSGWCQGKVKLLFLSDERKIDSQHVNKK

SEQ ID NO: 3007793 - protein, 39 aa, Entamoeba invadens
LSGWKLYYQDTLGRNIFLLPFNQYMLLETFPIPKEITST

SEQ ID NO: 3007794 - protein, 19 aa, Entamoeba invadens
LSHARVFDGRRLFCAKDKK

SEQ ID NO: 3007795 - protein, 19 aa, Entamoeba invadens
LSHHYAKDMLKLFSNIKTL

SEQ ID NO: 3007796 - protein, 26 aa, Entamoeba invadens
LSHLTKQFIKIKKIVFSNLDSIDVLQ

SEQ ID NO: 3007797 - protein, 17 aa, Entamoeba invadens
LSHVELCYYLRELLKAL

SEQ ID NO: 3007798 - protein, 17 aa, Entamoeba invadens
LSHYIATQTNYKLFKHI

SEQ ID NO: 3007799 - protein, 17 aa, Entamoeba invadens
LSHYLAAFGCQLLGTMR

SEQ ID NO: 3007800 - protein, 19 aa, Entamoeba invadens
LSHYLASCGCQLLGTTRIN

SEQ ID NO: 3007801 - protein, 18 aa, Entamoeba invadens
LSIAFEKWDQMTVTESGR

SEQ ID NO: 3007802 - protein, 23 aa, Entamoeba invadens
LSIGDCRAFLYNGISGNFESIGK

SEQ ID NO: 3007803 - protein, 27 aa, Entamoeba invadens
LSIGVKKSGWRFPLPLYRCIDYLERNN

SEQ ID NO: 3007804 - protein, 17 aa, Entamoeba invadens
LSIGYLDDFVRIIDNYI

SEQ ID NO: 3007805 - protein, 18 aa, Entamoeba invadens
LSIISIPSSVVSIGNGCF

SEQ ID NO: 3007806 - protein, 17 aa, Entamoeba invadens
LSIIVCDMVKRIVLPHS

SEQ ID NO: 3007807 - protein, 21 aa, Entamoeba invadens
LSILAFKIMLEHANDLFTVCI

SEQ ID NO: 3007808 - protein, 18 aa, Entamoeba invadens
LSILCVNTFYKDCRAANP

SEQ ID NO: 3007809 - protein, 20 aa, Entamoeba invadens
LSILFFSTFSYNGGSDFLGD

SEQ ID NO: 3007810 - protein, 20 aa, Entamoeba invadens
LSILGVVAGLIPYPHHNQSP

SEQ ID NO: 3007811 - protein, 25 aa, Entamoeba invadens
LSIMDVKCHWVLPTNLTRLSVLDEN

SEQ ID NO: 3007812 - protein, 27 aa, Entamoeba invadens
LSIMQLLEPLTWPHPIVTLLPKCFSEL

SEQ ID NO: 3007813 - protein, 19 aa, Entamoeba invadens
LSINLTFDSLVPKQLGYTT

SEQ ID NO: 3007814 - protein, 18 aa, Entamoeba invadens
LSIPLQYYGFTQIQGHRK

SEQ ID NO: 3007815 - protein, 24 aa, Entamoeba invadens
LSIQKTFLMQILKKVYVEDSDGES

SEQ ID NO: 3007816 - protein, 17 aa, Entamoeba invadens
LSITLPDTLTILRKFCF

SEQ ID NO: 3007817 - protein, 36 aa, Entamoeba invadens
LSKACELWGCEPEALRKALIQPSFKTGKEVIEKKYN

SEQ ID NO: 3007818 - protein, 23 aa, Entamoeba invadens
LSKCLTPVISKENSLFHVNTLPR

SEQ ID NO: 3007819 - protein, 23 aa, Entamoeba invadens
LSKDNFIKIISHKTLRNVTFNAE

SEQ ID NO: 3007820 - protein, 19 aa, Entamoeba invadens
LSKFDYSKHPLTEYVFIVI

SEQ ID NO: 3007821 - protein, 27 aa, Entamoeba invadens
LSKGDKYIPYRSSALTRILADALGGKS

SEQ ID NO: 3007822 - protein, 29 aa, Entamoeba invadens
LSKISKLLSQWVVLSPLSVIPVFSEAATK

SEQ ID NO: 3007823 - protein, 26 aa, Entamoeba invadens
LSKITTPPLFKIFKYMDDSERVTGYG

SEQ ID NO: 3007824 - protein, 17 aa, Entamoeba invadens
LSKKCFYKCYELGIVEC

SEQ ID NO: 3007825 - protein, 18 aa, Entamoeba invadens
LSKLFATTILIVKCTKLE

SEQ ID NO: 3007826 - protein, 21 aa, Entamoeba invadens
LSKLTTEYKLLEADNQRLQDE

SEQ ID NO: 3007827 - protein, 17 aa, Entamoeba invadens
LSKMRIITCSNIGLYDH

SEQ ID NO: 3007828 - protein, 36 aa, Entamoeba invadens
LSKPEKSSASLVLGFVWGLLDKFQEKKIKDLMSGNE

SEQ ID NO: 3007829 - protein, 25 aa, Entamoeba invadens
LSKTSILRYLGILLYMETHHDVINP

SEQ ID NO: 3007830 - protein, 20 aa, Entamoeba invadens
LSKVIRVDGIIVSISRVEPK

SEQ ID NO: 3007831 - protein, 26 aa, Entamoeba invadens
LSKYHYKAFCFLKSLFSKNVEYRTTE

SEQ ID NO: 3007832 - protein, 29 aa, Entamoeba invadens
LSLATQYFVRPFPTLQLIFAQLKTQLGLN

SEQ ID NO: 3007833 - protein, 20 aa, Entamoeba invadens
LSLEDLLITPVQRIMRYQTL

SEQ ID NO: 3007834 - protein, 19 aa, Entamoeba invadens
LSLEHRVVIRLRKVEIKEE

SEQ ID NO: 3007835 - protein, 22 aa, Entamoeba invadens
LSLFNGLVLAKKRKIGNEKMSE

SEQ ID NO: 3007836 - protein, 17 aa, Entamoeba invadens
LSLFQKKTSYDFRRLLL

SEQ ID NO: 3007837 - protein, 26 aa, Entamoeba invadens
LSLGNFFLCHGGISPSLQFIDQLQQI

SEQ ID NO: 3007838 - protein, 32 aa, Entamoeba invadens
LSLHSSIDDILFFFPKLETLYFCAVSTRLRKV

SEQ ID NO: 3007839 - protein, 35 aa, Entamoeba invadens
LSLHSSIDDILFFFPKLETLYFRAVSTRLRKMSSN

SEQ ID NO: 3007840 - protein, 18 aa, Entamoeba invadens
LSLILNDPFLITERDRIM

SEQ ID NO: 3007841 - protein, 26 aa, Entamoeba invadens
LSLLGKLRSFPNIKKIAIVAGKNSEL

SEQ ID NO: 3007842 - protein, 18 aa, Entamoeba invadens
LSLLIDILRNVKRFKNWV

SEQ ID NO: 3007843 - protein, 18 aa, Entamoeba invadens
LSLLKLPNNNMKISFTPT

SEQ ID NO: 3007844 - protein, 19 aa, Entamoeba invadens
LSLLLSNYSVIYTLVDEHG

SEQ ID NO: 3007845 - protein, 17 aa, Entamoeba invadens
LSLPLDITTFDDGKIKV

SEQ ID NO: 3007846 - protein, 19 aa, Entamoeba invadens
LSLPLELTRHKKGTTTLAM

SEQ ID NO: 3007847 - protein, 23 aa, Entamoeba invadens
LSLPSQCFFWCTSLQNVKLNTSL

SEQ ID NO: 3007848 - protein, 18 aa, Entamoeba invadens
LSLPTNLINKKTLLLFHV

SEQ ID NO: 3007849 - protein, 26 aa, Entamoeba invadens
LSLRTLYMKITFSSMLLFLCQRASHV

SEQ ID NO: 3007850 - protein, 33 aa, Entamoeba invadens
LSLSIKFSLFYMQTVLFRNPNLPNYEAWAAYFD

SEQ ID NO: 3007851 - protein, 23 aa, Entamoeba invadens
LSLSLPILVNLLSTIPCCKQQVV

SEQ ID NO: 3007852 - protein, 20 aa, Entamoeba invadens
LSLTCLVKFWEVKGHIIKML

SEQ ID NO: 3007853 - protein, 26 aa, Entamoeba invadens
LSMDKPYRDSFILGLFDALSGHVSST

SEQ ID NO: 3007854 - protein, 27 aa, Entamoeba invadens
LSMKIEHNILPYIKKMLVPQKVMMNTT

SEQ ID NO: 3007855 - protein, 28 aa, Entamoeba invadens
LSMQQYNRALFLFYLEVKLFPDEDLNDA

SEQ ID NO: 3007856 - protein, 17 aa, Entamoeba invadens
LSMVLFVAQLCAIKKEK

SEQ ID NO: 3007857 - protein, 20 aa, Entamoeba invadens
LSNFFELKRFIFQFEYDLSN

SEQ ID NO: 3007858 - protein, 22 aa, Entamoeba invadens
LSNFHKTYFWFAGDFSIAQNTK

SEQ ID NO: 3007859 - protein, 18 aa, Entamoeba invadens
LSNFPTPLLELTGLVVLK

SEQ ID NO: 3007860 - protein, 17 aa, Entamoeba invadens
LSNIQILCAAGNKINRI

SEQ ID NO: 3007861 - protein, 18 aa, Entamoeba invadens
LSNIRDWFDPSYDLKPTG

SEQ ID NO: 3007862 - protein, 28 aa, Entamoeba invadens
LSNITKIIKLMLLPFRTVLYSQIPANTS

SEQ ID NO: 3007863 - protein, 23 aa, Entamoeba invadens
LSNKHLLFLKTMIGHPMGASIHE

SEQ ID NO: 3007864 - protein, 27 aa, Entamoeba invadens
LSNKINFFRIIIWFEVDYSFSLKHKNT

SEQ ID NO: 3007865 - protein, 40 aa, Entamoeba invadens
LSNLELIKKHPFFKGFDWDNIFEQAPPYMPKLKSPFDTSN

SEQ ID NO: 3007866 - protein, 19 aa, Entamoeba invadens
LSNPLSYSPIIIKAIGIVK

SEQ ID NO: 3007867 - protein, 18 aa, Entamoeba invadens
LSNPPPVYKAYTLLTNIV

SEQ ID NO: 3007868 - protein, 19 aa, Entamoeba invadens
LSNQKLIRFCPTVAFNNIV

SEQ ID NO: 3007869 - protein, 18 aa, Entamoeba invadens
LSNQKYYDFRKIFGKVGI

SEQ ID NO: 3007870 - protein, 18 aa, Entamoeba invadens
LSNRVKVCDARRSYFNYF

SEQ ID NO: 3007871 - protein, 19 aa, Entamoeba invadens
LSNSFNWNYGFDSTFTSLI

SEQ ID NO: 3007872 - protein, 24 aa, Entamoeba invadens
LSNTRWFYYQLLVKFCFENLEKIE

SEQ ID NO: 3007873 - protein, 18 aa, Entamoeba invadens
LSNVALYINALDSLYNFV

SEQ ID NO: 3007874 - protein, 22 aa, Entamoeba invadens
LSNVVEFKYGFYIQNNVCNDCT

SEQ ID NO: 3007875 - protein, 25 aa, Entamoeba invadens
LSPDIQMYFALRFMKKESAEEKRIG

SEQ ID NO: 3007876 - protein, 21 aa, Entamoeba invadens
LSPDVLFLLKKFQKSNETTLT

SEQ ID NO: 3007877 - protein, 24 aa, Entamoeba invadens
LSPFYLKMDFLQRVALTLGNSNEY

SEQ ID NO: 3007878 - protein, 22 aa, Entamoeba invadens
LSPKFDFFRINVWFEVNYTSTQ

SEQ ID NO: 3007879 - protein, 17 aa, Entamoeba invadens
LSPKIKVNLLANDSTRA

SEQ ID NO: 3007880 - protein, 24 aa, Entamoeba invadens
LSPKRLQTLVTMALGCAHLVMHIN

SEQ ID NO: 3007881 - protein, 31 aa, Entamoeba invadens
LSPNGAFLDTIFALLVLSFLSVGFQETLVSK

SEQ ID NO: 3007882 - protein, 23 aa, Entamoeba invadens
LSPNLIFAICHYFDHYAAPRPVD

SEQ ID NO: 3007883 - protein, 24 aa, Entamoeba invadens
LSPPPIMQTLTLKSIPFLTAIAHM

SEQ ID NO: 3007884 - protein, 27 aa, Entamoeba invadens
LSPTPELKPFYALVGALLSPLTSEPQR

SEQ ID NO: 3007885 - protein, 17 aa, Entamoeba invadens
LSPTVIDSILGLNTKFE

SEQ ID NO: 3007886 - protein, 25 aa, Entamoeba invadens
LSPYMKAFGVFQYPIEVAIKKSRWR

SEQ ID NO: 3007887 - protein, 24 aa, Entamoeba invadens
LSPYNIEFLGYFGIGIDAYSLTAK

SEQ ID NO: 3007888 - protein, 17 aa, Entamoeba invadens
LSQFPPRLPPQLTELMV

SEQ ID NO: 3007889 - protein, 27 aa, Entamoeba invadens
LSQGYPNPFLRKLTRDVWKTNPDFVFF

SEQ ID NO: 3007890 - protein, 25 aa, Entamoeba invadens
LSQLMSLIILTVPQSPRFSLPSGLL

SEQ ID NO: 3007891 - protein, 19 aa, Entamoeba invadens
LSQLPNIRKVVFDGEINFG

SEQ ID NO: 3007892 - protein, 19 aa, Entamoeba invadens
LSQLTLIENLVRKEKAHNV

SEQ ID NO: 3007893 - protein, 18 aa, Entamoeba invadens
LSQNDFFAFCGQLIKHTN

SEQ ID NO: 3007894 - protein, 27 aa, Entamoeba invadens
LSQNRSYLLCLLSYYKSKSTSQNAVTY

SEQ ID NO: 3007895 - protein, 17 aa, Entamoeba invadens
LSQSLLELLDTFDTNDV

SEQ ID NO: 3007896 - protein, 27 aa, Entamoeba invadens
LSQSQIRFSAIIKFIGHLNLRGFFPSH

SEQ ID NO: 3007897 - protein, 30 aa, Entamoeba invadens
LSQYECTRVIVLFNMFFPEDLNNEQRYIEL

SEQ ID NO: 3007898 - protein, 31 aa, Entamoeba invadens
LSQYILSHQFPILYFLLGEMHFALFHRNEAL

SEQ ID NO: 3007899 - protein, 25 aa, Entamoeba invadens
LSQYMDVLVPIFEFFAESNSSVVGK

SEQ ID NO: 3007900 - protein, 17 aa, Entamoeba invadens
LSRDYCVLLRFYEDRAE

SEQ ID NO: 3007901 - protein, 20 aa, Entamoeba invadens
LSRLCYTQMRGGDKLDVILP

SEQ ID NO: 3007902 - protein, 21 aa, Entamoeba invadens
LSRLGGMQILLKLLDELCVSI

SEQ ID NO: 3007903 - protein, 17 aa, Entamoeba invadens
LSRLKMPPPPLTSMRQN

SEQ ID NO: 3007904 - protein, 19 aa, Entamoeba invadens
LSRLQSLDGLKIVGNLPGQ

SEQ ID NO: 3007905 - protein, 34 aa, Entamoeba invadens
LSRNLVEFPYVETFLTKLFEWTDLSKARIVFDSE

SEQ ID NO: 3007906 - protein, 26 aa, Entamoeba invadens
LSRNVLPYVVIFLTDSILDVRVKAVE

SEQ ID NO: 3007907 - protein, 23 aa, Entamoeba invadens
LSRRRQNYIIAERTKFLVDLLRE

SEQ ID NO: 3007908 - protein, 23 aa, Entamoeba invadens
LSRRRSVYTPPTNVTFLNNEDLD

SEQ ID NO: 3007909 - protein, 24 aa, Entamoeba invadens
LSSDLRLVLKIKPAIFPMEYPSSE

SEQ ID NO: 3007910 - protein, 25 aa, Entamoeba invadens
LSSEDFLNIYLSLSRLVMVWHTEEE

SEQ ID NO: 3007911 - protein, 19 aa, Entamoeba invadens
LSSFIFHSIDFMTKLRRES

SEQ ID NO: 3007912 - protein, 23 aa, Entamoeba invadens
LSSFLLYDGIYHPIKNNYKNRIL

SEQ ID NO: 3007913 - protein, 17 aa, Entamoeba invadens
LSSFTIPPNIKSIGYKC

SEQ ID NO: 3007914 - protein, 21 aa, Entamoeba invadens
LSSGCYYCKSGYYLIGNSTCA

SEQ ID NO: 3007915 - protein, 25 aa, Entamoeba invadens
LSSGYLLPQTILKSVYRDVEKYVQA

SEQ ID NO: 3007916 - protein, 17 aa, Entamoeba invadens
LSSILPCIIGCTRGTYG

SEQ ID NO: 3007917 - protein, 26 aa, Entamoeba invadens
LSSKNVKCPVLFLWGNYYGDVEFVKQ

SEQ ID NO: 3007918 - protein, 18 aa, Entamoeba invadens
LSSLIQFVQSQKSAILSK

SEQ ID NO: 3007919 - protein, 25 aa, Entamoeba invadens
LSSLKLMHPVLISTTLWMIQKNFDD

SEQ ID NO: 3007920 - protein, 17 aa, Entamoeba invadens
LSSLLLSKEKAVNDLLF

SEQ ID NO: 3007921 - protein, 24 aa, Entamoeba invadens
LSSLYFLHLFPKMNTIQITSSALL

SEQ ID NO: 3007922 - protein, 26 aa, Entamoeba invadens
LSSMKETRLWENLDFEISLVTAYPNV

SEQ ID NO: 3007923 - protein, 18 aa, Entamoeba invadens
LSSMWKELSEDEKQRYIG

SEQ ID NO: 3007924 - protein, 25 aa, Entamoeba invadens
LSSNGKIIYIVYEKGIKEVQLDTSK

SEQ ID NO: 3007925 - protein, 22 aa, Entamoeba invadens
LSSRFRPPVPLVKRTIESLIER

SEQ ID NO: 3007926 - protein, 31 aa, Entamoeba invadens
LSSSPRFFKILKMNRPMLLDFQSSFERKEDD

SEQ ID NO: 3007927 - protein, 35 aa, Entamoeba invadens
LSSTFESPYLFRLRKFISLSYMLYIENNKFYKSSP

SEQ ID NO: 3007928 - protein, 32 aa, Entamoeba invadens
LSSTRITPVHQYYLMLILALTSSMLQHPLQKE

SEQ ID NO: 3007929 - protein, 17 aa, Entamoeba invadens
LSSVELPLIKTFGSYCF

SEQ ID NO: 3007930 - protein, 20 aa, Entamoeba invadens
LSSVIIPPSVISIGKACFCR

SEQ ID NO: 3007931 - protein, 19 aa, Entamoeba invadens
LSSVTIPLSITSLNQYCFY

SEQ ID NO: 3007932 - protein, 22 aa, Entamoeba invadens
LSSYHIMIISKYFKTIKDLINL

SEQ ID NO: 3007933 - protein, 25 aa, Entamoeba invadens
LSSYSPLIQTYFAYRFIALGTVEEK

SEQ ID NO: 3007934 - protein, 25 aa, Entamoeba invadens
LSTCLPPIIFALLHTGQNFPKLREK

SEQ ID NO: 3007935 - protein, 25 aa, Entamoeba invadens
LSTELFKQFFPKVRFLDIDDDVIVS

SEQ ID NO: 3007936 - protein, 33 aa, Entamoeba invadens
LSTFITKPITPFSLLCCALLFDGVRKNYLRVNC

SEQ ID NO: 3007937 - protein, 30 aa, Entamoeba invadens
LSTFMQRDAYLMWGFYSNPEKVEEIYIGNG

SEQ ID NO: 3007938 - protein, 19 aa, Entamoeba invadens
LSTIKLPIGLTRLGTSCFS

SEQ ID NO: 3007939 - protein, 25 aa, Entamoeba invadens
LSTIMMQLIQSLKFEATPLSDLAIF

SEQ ID NO: 3007940 - protein, 18 aa, Entamoeba invadens
LSTIVKPMNDFKPKENFI

SEQ ID NO: 3007941 - protein, 18 aa, Entamoeba invadens
LSTLCPPLALTLLSQRGL

SEQ ID NO: 3007942 - protein, 25 aa, Entamoeba invadens
LSTLKCEMLTLIAKLIDVTSAAVFA

SEQ ID NO: 3007943 - protein, 18 aa, Entamoeba invadens
LSTLLPIDKVCTSNSLYI

SEQ ID NO: 3007944 - protein, 24 aa, Entamoeba invadens
LSTLSLKMPWAVKKSKPLLEEIDA

SEQ ID NO: 3007945 - protein, 32 aa, Entamoeba invadens
LSTPIELIPEFFYLPQFLINFNQINFAKEPNA

SEQ ID NO: 3007946 - protein, 25 aa, Entamoeba invadens
LSTPPLPDYLIEAFLQSPSNVFLAE

SEQ ID NO: 3007947 - protein, 19 aa, Entamoeba invadens
LSTQTIFRYRNFTMTLTMS

SEQ ID NO: 3007948 - protein, 25 aa, Entamoeba invadens
LSTSEFLKDIIDYLKLHEPKKEPLR

SEQ ID NO: 3007949 - protein, 27 aa, Entamoeba invadens
LSTTFYRLCCYIVVYLSFLSKGLSSRN

SEQ ID NO: 3007950 - protein, 23 aa, Entamoeba invadens
LSTWGGLWRYIGIERHAQYGYYY

SEQ ID NO: 3007951 - protein, 20 aa, Entamoeba invadens
LSVATLNQKVKERKIPMCQW

SEQ ID NO: 3007952 - protein, 23 aa, Entamoeba invadens
LSVAYKNVIGSRRASWRIISSME

SEQ ID NO: 3007953 - protein, 20 aa, Entamoeba invadens
LSVCVYLSRCQKFIPFPEVK

SEQ ID NO: 3007954 - protein, 24 aa, Entamoeba invadens
LSVDAVIERYLQIAMKLSQNRFTE

SEQ ID NO: 3007955 - protein, 31 aa, Entamoeba invadens
LSVEKCGVPFFWVRLLYKLGLFMSYTPSDDD

SEQ ID NO: 3007956 - protein, 29 aa, Entamoeba invadens
LSVFKISIFKSLKFLKLLVLYSNDPQDKY

SEQ ID NO: 3007957 - protein, 17 aa, Entamoeba invadens
LSVFPYYSILTNLIGRL

SEQ ID NO: 3007958 - protein, 19 aa, Entamoeba invadens
LSVGLIPQPDLTVQAGHNV

SEQ ID NO: 3007959 - protein, 22 aa, Entamoeba invadens
LSVGTMEQLMRHKLDLGEDCED

SEQ ID NO: 3007960 - protein, 19 aa, Entamoeba invadens
LSVIPVFSEAATKAVFMLY

SEQ ID NO: 3007961 - protein, 18 aa, Entamoeba invadens
LSVIYPLVQFPSHLSVLF

SEQ ID NO: 3007962 - protein, 22 aa, Entamoeba invadens
LSVLGNLRLLNLSHNRLYQIPH

SEQ ID NO: 3007963 - protein, 19 aa, Entamoeba invadens
LSVMKGCDYYTIRSVPSLV

SEQ ID NO: 3007964 - protein, 20 aa, Entamoeba invadens
LSVMPLINFYSEGTYTLLEM

SEQ ID NO: 3007965 - protein, 18 aa, Entamoeba invadens
LSVNKFLEKYPHTALKEF

SEQ ID NO: 3007966 - protein, 23 aa, Entamoeba invadens
LSVQAFFISVLLKTYDELFEKTN

SEQ ID NO: 3007967 - protein, 26 aa, Entamoeba invadens
LSVSDLLITHLVLPPTLKNLEIENLS

SEQ ID NO: 3007968 - protein, 20 aa, Entamoeba invadens
LSVVAFNKYGKKMVPCYVCG

SEQ ID NO: 3007969 - protein, 25 aa, Entamoeba invadens
LSVVKIRKFKIISAKYFSIQESTLN

SEQ ID NO: 3007970 - protein, 34 aa, Entamoeba invadens
LSWNRIKSFNPRISWIRLQVLDLSFNELSVIDMT

SEQ ID NO: 3007971 - protein, 22 aa, Entamoeba invadens
LSYIKPSHMITTIPPYCFQGCS

SEQ ID NO: 3007972 - protein, 18 aa, Entamoeba invadens
LSYIKYIDVLLKMEPWQR

SEQ ID NO: 3007973 - protein, 25 aa, Entamoeba invadens
LSYNEWFKMLWHEGLFNYYRKELKM

SEQ ID NO: 3007974 - protein, 18 aa, Entamoeba invadens
LSYPGTHCFLICFSIISR

SEQ ID NO: 3007975 - protein, 17 aa, Entamoeba invadens
LSYVLIQQNFKLTCQVS

SEQ ID NO: 3007976 - protein, 18 aa, Entamoeba invadens
LTAFLRLPKDPTFEVYVS

SEQ ID NO: 3007977 - protein, 26 aa, Entamoeba invadens
LTAKYYTYVPHVLTAGEMRLIDTDEK

SEQ ID NO: 3007978 - protein, 18 aa, Entamoeba invadens
LTALEIPEKCTELRIGGM

SEQ ID NO: 3007979 - protein, 20 aa, Entamoeba invadens
LTALKYLYIDFESFIDFIAD

SEQ ID NO: 3007980 - protein, 18 aa, Entamoeba invadens
LTALPKYFMSECVKLSEV

SEQ ID NO: 3007981 - protein, 20 aa, Entamoeba invadens
LTALSVFQPLGTVNLKIPSG

SEQ ID NO: 3007982 - protein, 18 aa, Entamoeba invadens
LTALYYLNIDLDYFVRFL

SEQ ID NO: 3007983 - protein, 19 aa, Entamoeba invadens
LTAPLRMVKMPHGRPNNVG

SEQ ID NO: 3007984 - protein, 22 aa, Entamoeba invadens
LTAVNTLKWSVGRLIDMVDLNI

SEQ ID NO: 3007985 - protein, 19 aa, Entamoeba invadens
LTCGCGKYKFFKEDLGEID

SEQ ID NO: 3007986 - protein, 18 aa, Entamoeba invadens
LTCKCYYYLSGNTCIKCD

SEQ ID NO: 3007987 - protein, 21 aa, Entamoeba invadens
LTCKTFRFFRNIETLHLWNEE

SEQ ID NO: 3007988 - protein, 24 aa, Entamoeba invadens
LTCKTIRFFLNIETLHLWHKNDET

SEQ ID NO: 3007989 - protein, 23 aa, Entamoeba invadens
LTCKTIRFFLNIETLHLWNKNDE

SEQ ID NO: 3007990 - protein, 18 aa, Entamoeba invadens
LTCLHCVDGYYPDDGKCK

SEQ ID NO: 3007991 - protein, 18 aa, Entamoeba invadens
LTCLHCVDGYYPDEGKCK

SEQ ID NO: 3007992 - protein, 19 aa, Entamoeba invadens
LTCVITPTYCLSCPPGFYI

SEQ ID NO: 3007993 - protein, 23 aa, Entamoeba invadens
LTDDNFIFGDGWLLWICPQVNAM

SEQ ID NO: 3007994 - protein, 26 aa, Entamoeba invadens
LTDEFASKFFPKITRIVLYSSENRAS

SEQ ID NO: 3007995 - protein, 21 aa, Entamoeba invadens
LTDEIVINLPFILTDMHHLYV

SEQ ID NO: 3007996 - protein, 26 aa, Entamoeba invadens
LTDETPYTIIIWYQVTYTEMALSKRP

SEQ ID NO: 3007997 - protein, 28 aa, Entamoeba invadens
LTDFSDYIKPVLYFAPLSQTDPKILLSR

SEQ ID NO: 3007998 - protein, 23 aa, Entamoeba invadens
LTDGVVMKVLCKHSNKFHIKFAN

SEQ ID NO: 3007999 - protein, 24 aa, Entamoeba invadens
LTDKIPFKQVLFHSIIRDAQGRKM

SEQ ID NO: 3008000 - protein, 24 aa, Entamoeba invadens
LTDMKGVIQIFQSLKATVVSINNQ

SEQ ID NO: 3008001 - protein, 19 aa, Entamoeba invadens
LTDNSVMELGGFKLSFHYN

SEQ ID NO: 3008002 - protein, 35 aa, Entamoeba invadens
LTDQYIFVCHFYTDEYYFLLRSVNPRQLVFDPHDF

SEQ ID NO: 3008003 - protein, 27 aa, Entamoeba invadens
LTDSTINALWILETIFIGLKKSKHHNE

SEQ ID NO: 3008004 - protein, 20 aa, Entamoeba invadens
LTDYLMKILTERGYSFTTTA

SEQ ID NO: 3008005 - protein, 35 aa, Entamoeba invadens
LTDYLTFADFDILSKRYLNILFEVDYTTAKSLQSD

SEQ ID NO: 3008006 - protein, 25 aa, Entamoeba invadens
LTEANNQMYILCEGVLRQCENVYQR

SEQ ID NO: 3008007 - protein, 48 aa, Entamoeba invadens
LTEDRSLIGIFETTLRFNFWDKITFKFEVEIIGKIKLVVLDKDGNQDP

SEQ ID NO: 3008008 - protein, 28 aa, Entamoeba invadens
LTEDVPLIMMLAFLALPSLRKVTAYIPS

SEQ ID NO: 3008009 - protein, 28 aa, Entamoeba invadens
LTEEEIRLLWIYRGLVMNTKPRALARLV

SEQ ID NO: 3008010 - protein, 26 aa, Entamoeba invadens
LTEETAQRLALMEIERGKDSEWKQKN

SEQ ID NO: 3008011 - protein, 25 aa, Entamoeba invadens
LTEGEKYFFLCDLSICMEYLIQSLH

SEQ ID NO: 3008012 - protein, 17 aa, Entamoeba invadens
LTELNEQLDLERTTAQQ

SEQ ID NO: 3008013 - protein, 28 aa, Entamoeba invadens
LTELNIRFPSLQFIHPINNGFLCVCSSL

SEQ ID NO: 3008014 - protein, 18 aa, Entamoeba invadens
LTELPISVKNYTSLVQLN

SEQ ID NO: 3008015 - protein, 46 aa, Entamoeba invadens
LTEMGFPDYISIFALKKFNWDINECIPWIIENLATFPRPELPKEVK

SEQ ID NO: 3008016 - protein, 22 aa, Entamoeba invadens
LTEPGWREILKPIFQKYINSES

SEQ ID NO: 3008017 - protein, 28 aa, Entamoeba invadens
LTEQIVSYYKFKPFPTLRVEVENILFDL

SEQ ID NO: 3008018 - protein, 28 aa, Entamoeba invadens
LTESNVLVLLTPILLFLSCDVESLHASA

SEQ ID NO: 3008019 - protein, 29 aa, Entamoeba invadens
LTEVECFMLYLGILLYMGAHHDVINPLEE

SEQ ID NO: 3008020 - protein, 28 aa, Entamoeba invadens
LTEVECFRYLGILLYMGAHHDVINPVEE

SEQ ID NO: 3008021 - protein, 21 aa, Entamoeba invadens
LTEVECVLLALLSRKYGFVLS

SEQ ID NO: 3008022 - protein, 24 aa, Entamoeba invadens
LTFDQFQLWDYLTKKFNVTTQFVI

SEQ ID NO: 3008023 - protein, 28 aa, Entamoeba invadens
LTFETSLMFLNFFHSFNATYTTGELYFS

SEQ ID NO: 3008024 - protein, 21 aa, Entamoeba invadens
LTFHNNFKIFMELINTVYQHA

SEQ ID NO: 3008025 - protein, 21 aa, Entamoeba invadens
LTFLNLFNDLRSTAADVFPLI

SEQ ID NO: 3008026 - protein, 17 aa, Entamoeba invadens
LTFLRAEEFLDKVKLYE

SEQ ID NO: 3008027 - protein, 17 aa, Entamoeba invadens
LTFLSNALQIKGVKFQM

SEQ ID NO: 3008028 - protein, 19 aa, Entamoeba invadens
LTFSFKLDLFIQCCLGVQW

SEQ ID NO: 3008029 - protein, 30 aa, Entamoeba invadens
LTFSRMHETPFDALYLIDYGANGDQMVAVI

SEQ ID NO: 3008030 - protein, 19 aa, Entamoeba invadens
LTFVGVFNNLCKCTVNNTN

SEQ ID NO: 3008031 - protein, 28 aa, Entamoeba invadens
LTGCSQFEIVILYCLLKLNEEERNIQNL

SEQ ID NO: 3008032 - protein, 20 aa, Entamoeba invadens
LTGFSFTLKQLDGRELFIES

SEQ ID NO: 3008033 - protein, 25 aa, Entamoeba invadens
LTGNRLVQLFSSRILYVVLSLVPVL

SEQ ID NO: 3008034 - protein, 27 aa, Entamoeba invadens
LTGTFFIEYYPLLFRDTCLTNGLLFPQ

SEQ ID NO: 3008035 - protein, 30 aa, Entamoeba invadens
LTGYFQGNLRYLFLESLLDLGSFERKASYL

SEQ ID NO: 3008036 - protein, 18 aa, Entamoeba invadens
LTGYVGFPKIMYYGTEGE

SEQ ID NO: 3008037 - protein, 18 aa, Entamoeba invadens
LTHCMRLRTTPPREALVF

SEQ ID NO: 3008038 - protein, 31 aa, Entamoeba invadens
LTHEKLELYGNLFFLLQTEPVYLARLINCLQ

SEQ ID NO: 3008039 - protein, 19 aa, Entamoeba invadens
LTHKLTLATLPPNTIIQFD

SEQ ID NO: 3008040 - protein, 29 aa, Entamoeba invadens
LTHPRGSLLFEKFIPYFTKDQINALFGNI

SEQ ID NO: 3008041 - protein, 26 aa, Entamoeba invadens
LTHQITKLTLFNISNNKLSKLFATTI

SEQ ID NO: 3008042 - protein, 17 aa, Entamoeba invadens
LTHWKYHLLHSSFNNKY

SEQ ID NO: 3008043 - protein, 31 aa, Entamoeba invadens
LTINNIFYPGWLLSQMLLYGSLNVVHIFNDC

SEQ ID NO: 3008044 - protein, 18 aa, Entamoeba invadens
LTINPNEYLFKLNVFSRD

SEQ ID NO: 3008045 - protein, 31 aa, Entamoeba invadens
LTIPDIPPQQILYLLIRTFEICVPRIPFDDT

SEQ ID NO: 3008046 - protein, 34 aa, Entamoeba invadens
LTKCSTIPERVYWKWFLRLSEIPRPSYHCLPFSD

SEQ ID NO: 3008047 - protein, 20 aa, Entamoeba invadens
LTKCYGIGKVKPFSDFTLRG

SEQ ID NO: 3008048 - protein, 23 aa, Entamoeba invadens
LTKDDTLFLRTSSLRYPKTTVPP

SEQ ID NO: 3008049 - protein, 18 aa, Entamoeba invadens
LTKDVVIKYIPDLLNDEK

SEQ ID NO: 3008050 - protein, 29 aa, Entamoeba invadens
LTKERLFNRIGLLFSYVFMMNNASIHSVI

SEQ ID NO: 3008051 - protein, 22 aa, Entamoeba invadens
LTKETITVCVIILLNNHKIIPW

SEQ ID NO: 3008052 - protein, 22 aa, Entamoeba invadens
LTKFRVHKFLPQTTKLVVVNRE

SEQ ID NO: 3008053 - protein, 24 aa, Entamoeba invadens
LTKIHHPFIVQLHYAFQTKEKLYM

SEQ ID NO: 3008054 - protein, 24 aa, Entamoeba invadens
LTKIRNFMFKNCKSLSFIDIPTSI

SEQ ID NO: 3008055 - protein, 23 aa, Entamoeba invadens
LTKKKVSFKFNKQPKMKIAKLEN

SEQ ID NO: 3008056 - protein, 18 aa, Entamoeba invadens
LTKLPIYCFRCCYNLQHV

SEQ ID NO: 3008057 - protein, 33 aa, Entamoeba invadens
LTKLSGAFTYVYKLKDLVIPSLVTTLHSCLFVE

SEQ ID NO: 3008058 - protein, 18 aa, Entamoeba invadens
LTKNDFVPYKRDDLLVKK

SEQ ID NO: 3008059 - protein, 25 aa, Entamoeba invadens
LTKNKRDIWLLSETGEIVTYKPSKK

SEQ ID NO: 3008060 - protein, 26 aa, Entamoeba invadens
LTKNYANILVNFLEKLYNPNERQKMR

SEQ ID NO: 3008061 - protein, 23 aa, Entamoeba invadens
LTKQKTWDLSAFTGLTSLKLKKS

SEQ ID NO: 3008062 - protein, 18 aa, Entamoeba invadens
LTKQLEEVTRQKVSFESQ

SEQ ID NO: 3008063 - protein, 17 aa, Entamoeba invadens
LTKQQLQQITWIDLSFS

SEQ ID NO: 3008064 - protein, 19 aa, Entamoeba invadens
LTKRIPLIFSTALSTWIDD

SEQ ID NO: 3008065 - protein, 22 aa, Entamoeba invadens
LTKSMIFQNRKLKLIFNDTCGA

SEQ ID NO: 3008066 - protein, 23 aa, Entamoeba invadens
LTKVPRIDMIYKAESYYLKEKSD

SEQ ID NO: 3008067 - protein, 23 aa, Entamoeba invadens
LTKVQPVLFSQNPFVKKIDDVVQ

SEQ ID NO: 3008068 - protein, 21 aa, Entamoeba invadens
LTKVVTRWYLELRSVVDTIGE

SEQ ID NO: 3008069 - protein, 22 aa, Entamoeba invadens
LTKWHPEVVHFAPKVPIILVGT

SEQ ID NO: 3008070 - protein, 19 aa, Entamoeba invadens
LTKYLPRVTSCVVVGGLAS

SEQ ID NO: 3008071 - protein, 18 aa, Entamoeba invadens
LTLCTLLVENDNDFLIWL

SEQ ID NO: 3008072 - protein, 17 aa, Entamoeba invadens
LTLFNNLKEKSKYKVLY

SEQ ID NO: 3008073 - protein, 25 aa, Entamoeba invadens
LTLGSWEFKLKVGGLIEAFYRVFQD

SEQ ID NO: 3008074 - protein, 27 aa, Entamoeba invadens
LTLHTDNIFILRKFTPPTKQYSRPKKN

SEQ ID NO: 3008075 - protein, 25 aa, Entamoeba invadens
LTLLDVFMLWKTTTIPRAINKPDNT

SEQ ID NO: 3008076 - protein, 32 aa, Entamoeba invadens
LTLLVKELMFDLVILRITVMLSFYTSVFDINS

SEQ ID NO: 3008077 - protein, 25 aa, Entamoeba invadens
LTLQKPLLTPHTRTIRKLRCNQNGT

SEQ ID NO: 3008078 - protein, 23 aa, Entamoeba invadens
LTLQNVIAFVQAFEWIDENAQEF

SEQ ID NO: 3008079 - protein, 20 aa, Entamoeba invadens
LTLRRLLYVVLDDMVPLTSN

SEQ ID NO: 3008080 - protein, 26 aa, Entamoeba invadens
LTLTDSVNFLYLLKDIPHGVIKFSDD

SEQ ID NO: 3008081 - protein, 19 aa, Entamoeba invadens
LTLVLKYLKTPDDYVKISQ

SEQ ID NO: 3008082 - protein, 17 aa, Entamoeba invadens
LTLYKRYGLYNLVEMSL

SEQ ID NO: 3008083 - protein, 18 aa, Entamoeba invadens
LTLYNKNIPEKLSLIFIV

SEQ ID NO: 3008084 - protein, 24 aa, Entamoeba invadens
LTMCYTLVISLLNYSVKIPFSVVV

SEQ ID NO: 3008085 - protein, 17 aa, Entamoeba invadens
LTMQDLYIKEGDGFILV

SEQ ID NO: 3008086 - protein, 19 aa, Entamoeba invadens
LTNCKLIDFIFDRTMKSMT

SEQ ID NO: 3008087 - protein, 23 aa, Entamoeba invadens
LTNEKYYIYINSLAPLLQEICEH

SEQ ID NO: 3008088 - protein, 22 aa, Entamoeba invadens
LTNFDFRDLYYFAFETFSENTT

SEQ ID NO: 3008089 - protein, 23 aa, Entamoeba invadens
LTNGFVIFVKAESSLFGVAVFAD

SEQ ID NO: 3008090 - protein, 24 aa, Entamoeba invadens
LTNKMKIFNMLKAGSPIPCKYKET

SEQ ID NO: 3008091 - protein, 18 aa, Entamoeba invadens
LTNLGYLFDTYISTPKSS

SEQ ID NO: 3008092 - protein, 17 aa, Entamoeba invadens
LTNLMKEYSELKRNTFG

SEQ ID NO: 3008093 - protein, 29 aa, Entamoeba invadens
LTNPMMTEVMFYVLLKFKAFEGNEEVLMR

SEQ ID NO: 3008094 - protein, 20 aa, Entamoeba invadens
LTNRFVFTLDPPSTRLYDDA

SEQ ID NO: 3008095 - protein, 19 aa, Entamoeba invadens
LTPAVMLSRFKLKTLTVHF

SEQ ID NO: 3008096 - protein, 25 aa, Entamoeba invadens
LTPKTRRFFPNLNTLHLYSKDDLLF

SEQ ID NO: 3008097 - protein, 26 aa, Entamoeba invadens
LTPKTRRFFPNLNTLHLYTKNDLLFT

SEQ ID NO: 3008098 - protein, 26 aa, Entamoeba invadens
LTPKTRRFFPNLNTLRLYTKNDLLFT

SEQ ID NO: 3008099 - protein, 19 aa, Entamoeba invadens
LTPKYLVLPSPSSVDLSVC

SEQ ID NO: 3008100 - protein, 21 aa, Entamoeba invadens
LTPRFFNYCTNIIATRGIMEE

SEQ ID NO: 3008101 - protein, 17 aa, Entamoeba invadens
LTPSFKLRRPQIKKRYA

SEQ ID NO: 3008102 - protein, 22 aa, Entamoeba invadens
LTPTLLVQVIILIIRGVSNENE

SEQ ID NO: 3008103 - protein, 36 aa, Entamoeba invadens
LTPYEKMQRRYFPYKYRKVYTHRVIPKYLNKYTNKK

SEQ ID NO: 3008104 - protein, 26 aa, Entamoeba invadens
LTQKMKNSIFPNFKTTHILFEESPSE

SEQ ID NO: 3008105 - protein, 23 aa, Entamoeba invadens
LTQKTLRMFPAAKTISFGLENYV

SEQ ID NO: 3008106 - protein, 21 aa, Entamoeba invadens
LTQNMIRLPISLKALESKHNR

SEQ ID NO: 3008107 - protein, 25 aa, Entamoeba invadens
LTQPQSILMYLAVMYAVQDFNEKHG

SEQ ID NO: 3008108 - protein, 18 aa, Entamoeba invadens
LTQVLFSTMQRLLGKFMR

SEQ ID NO: 3008109 - protein, 22 aa, Entamoeba invadens
LTRAEVLAFFTKLGAQRVVDHV

SEQ ID NO: 3008110 - protein, 23 aa, Entamoeba invadens
LTREFVHLNIWYEVSYSRSLITE

SEQ ID NO: 3008111 - protein, 28 aa, Entamoeba invadens
LTRIHGLFEIIPYKVYQFRGFDLANMSF

SEQ ID NO: 3008112 - protein, 28 aa, Entamoeba invadens
LTRIHGLFELIPGKLYQFRGFDIANMSF

SEQ ID NO: 3008113 - protein, 17 aa, Entamoeba invadens
LTRKEIYLTQDPELFAT

SEQ ID NO: 3008114 - protein, 20 aa, Entamoeba invadens
LTRKLEMLTTLLKVNEQKNT

SEQ ID NO: 3008115 - protein, 24 aa, Entamoeba invadens
LTRPEFELVALNDPFMDPKYMEYM

SEQ ID NO: 3008116 - protein, 20 aa, Entamoeba invadens
LTRQVLLKRLKEKSNVFLLL

SEQ ID NO: 3008117 - protein, 23 aa, Entamoeba invadens
LTRRQVAGLLALSLLGFYTLPQT

SEQ ID NO: 3008118 - protein, 32 aa, Entamoeba invadens
LTRSKLIFFENLETLILWPKDNFLAFKHLTSY

SEQ ID NO: 3008119 - protein, 26 aa, Entamoeba invadens
LTRVFKSLFCIKKLFRVVVWFNVDCR

SEQ ID NO: 3008120 - protein, 24 aa, Entamoeba invadens
LTSDTSFLISKPQKWSITSKSFIK

SEQ ID NO: 3008121 - protein, 19 aa, Entamoeba invadens
LTSFIFPLSLRRICDKSFA

SEQ ID NO: 3008122 - protein, 19 aa, Entamoeba invadens
LTSIVLPSSVLHLGSNCFL

SEQ ID NO: 3008123 - protein, 17 aa, Entamoeba invadens
LTSKDTLITFKRVTYTQ

SEQ ID NO: 3008124 - protein, 18 aa, Entamoeba invadens
LTSLFIPSSLVLSDTVSV

SEQ ID NO: 3008125 - protein, 17 aa, Entamoeba invadens
LTSLMISRFGFKKNCLE

SEQ ID NO: 3008126 - protein, 18 aa, Entamoeba invadens
LTSLTSFQKMWVTREDYE

SEQ ID NO: 3008127 - protein, 23 aa, Entamoeba invadens
LTSNIFPFIQSDSGLQFIAESKA

SEQ ID NO: 3008128 - protein, 24 aa, Entamoeba invadens
LTSSHSFVLIPHTAARLGLDMVLE

SEQ ID NO: 3008129 - protein, 19 aa, Entamoeba invadens
LTSVAFSALILYFENSPAN

SEQ ID NO: 3008130 - protein, 18 aa, Entamoeba invadens
LTSVPVPPLTIRPSVSMD

SEQ ID NO: 3008131 - protein, 17 aa, Entamoeba invadens
LTSYFYREFYRIIVYEE

SEQ ID NO: 3008132 - protein, 31 aa, Entamoeba invadens
LTTDAEVISFYNFWYGFKTWREMAPEEMYDI

SEQ ID NO: 3008133 - protein, 24 aa, Entamoeba invadens
LTTELELYRGKLSEKPLFNTKVPR

SEQ ID NO: 3008134 - protein, 30 aa, Entamoeba invadens
LTTELIRRTPKLIQFYKLYCTFHQLNYNLQ

SEQ ID NO: 3008135 - protein, 18 aa, Entamoeba invadens
LTTFLGTVILRTGTSFAV

SEQ ID NO: 3008136 - protein, 26 aa, Entamoeba invadens
LTTFNRYVIDYAPVKTTKGVSGIILT

SEQ ID NO: 3008137 - protein, 19 aa, Entamoeba invadens
LTTKESVLKCWLKSKFYNP

SEQ ID NO: 3008138 - protein, 22 aa, Entamoeba invadens
LTTKIFDVFFHCSPTMTDPITK

SEQ ID NO: 3008139 - protein, 25 aa, Entamoeba invadens
LTTLFTNIQLHIISQNYRISDLLAE

SEQ ID NO: 3008140 - protein, 29 aa, Entamoeba invadens
LTTMNGLPVTIRLLDPPLHEFLPTLEELM

SEQ ID NO: 3008141 - protein, 19 aa, Entamoeba invadens
LTTNERCVMLTGLQKNHFD

SEQ ID NO: 3008142 - protein, 24 aa, Entamoeba invadens
LTTNQRKILLGKLLPVVDTQFFVS

SEQ ID NO: 3008143 - protein, 29 aa, Entamoeba invadens
LTTPAFVPVPYLPFTFETLNLLRNQAMQE

SEQ ID NO: 3008144 - protein, 17 aa, Entamoeba invadens
LTTPLILEMIKGSLTSV

SEQ ID NO: 3008145 - protein, 22 aa, Entamoeba invadens
LTVDLINELKIDFIFHGVVNSF

SEQ ID NO: 3008146 - protein, 35 aa, Entamoeba invadens
LTVEHRQYMFLFYTTLPLGPFTYSAQIVILNGKTY

SEQ ID NO: 3008147 - protein, 25 aa, Entamoeba invadens
LTVELSYPFRLIVQDNPRVPTRWQF

SEQ ID NO: 3008148 - protein, 31 aa, Entamoeba invadens
LTVIEKGVKIGWLYCLRGYDCGYVPQNFTTI

SEQ ID NO: 3008149 - protein, 19 aa, Entamoeba invadens
LTVNDFLINWVNEALEKEG

SEQ ID NO: 3008150 - protein, 18 aa, Entamoeba invadens
LTVNFVVNFSIPVSYPTK

SEQ ID NO: 3008151 - protein, 28 aa, Entamoeba invadens
LTVNRTMQLLKVLKYFPSAKCLQCDTDT

SEQ ID NO: 3008152 - protein, 17 aa, Entamoeba invadens
LTVTILKEKKKLKLQRK

SEQ ID NO: 3008153 - protein, 30 aa, Entamoeba invadens; identical to SEQ ID NO: 2822220

SEQ ID NO: 3008154 - protein, 30 aa, Entamoeba invadens
LTWKDPFDEKLFPYSWDITNLISSGKRPQI

SEQ ID NO: 3008155 - protein, 20 aa, Entamoeba invadens
LTYDQIRLLFSSITVIYGVN

SEQ ID NO: 3008156 - protein, 34 aa, Entamoeba invadens
LTYLESWRVVELSNALFGFDGWSSCITNLNVDYV

SEQ ID NO: 3008157 - protein, 18 aa, Entamoeba invadens
LTYLNAWLNAFTLDKPTL

SEQ ID NO: 3008158 - protein, 19 aa, Entamoeba invadens
LTYLTSYKSIEDYTECIGF

SEQ ID NO: 3008159 - protein, 36 aa, Entamoeba invadens
LTYNGKYMFYAPIKEKVLPTFAMLQKTLLICETLCN

SEQ ID NO: 3008160 - protein, 18 aa, Entamoeba invadens
LTYPDKPSNPCPLPMLFR

SEQ ID NO: 3008161 - protein, 24 aa, Entamoeba invadens
LTYVKLPFDLKVLNNSLFEKCFSL

SEQ ID NO: 3008162 - protein, 20 aa, Entamoeba invadens
LTYYANPWTLSLKDSTLNVK

SEQ ID NO: 3008163 - protein, 17 aa, Entamoeba invadens
LVAIDCLIKGKNVEFDM

SEQ ID NO: 3008164 - protein, 18 aa, Entamoeba invadens
LVAKCTCGVSKVVNCTHN

SEQ ID NO: 3008165 - protein, 26 aa, Entamoeba invadens
LVAVGGIFFLRLINPAVVTPQRFGEG

SEQ ID NO: 3008166 - protein, 17 aa, Entamoeba invadens
LVAYLKSLGIDQDYVPP

SEQ ID NO: 3008167 - protein, 22 aa, Entamoeba invadens
LVAYRIKYFPHPVTGDKLCCYP

SEQ ID NO: 3008168 - protein, 18 aa, Entamoeba invadens
LVCCGSFNPIHELHLLIF

SEQ ID NO: 3008169 - protein, 22 aa, Entamoeba invadens
LVCGRDVFLDCPNLVKFNVIEK

SEQ ID NO: 3008170 - protein, 26 aa, Entamoeba invadens
LVCISLVERLLQALQFRFANPFQKST

SEQ ID NO: 3008171 - protein, 33 aa, Entamoeba invadens
LVCKRWKEILFFFPLKHTLFTKNSIGKIFPFMF

SEQ ID NO: 3008172 - protein, 24 aa, Entamoeba invadens
LVCLSMILVDPYYRTFDGFGILIE

SEQ ID NO: 3008173 - protein, 19 aa, Entamoeba invadens
LVCLVALCFFFDDKIDKKF

SEQ ID NO: 3008174 - protein, 24 aa, Entamoeba invadens
LVCLYTQKKFSFFFSLLLESEVTT

SEQ ID NO: 3008175 - protein, 25 aa, Entamoeba invadens
LVCRSMIRLQPFAGMLWTEMSERCF

SEQ ID NO: 3008176 - protein, 33 aa, Entamoeba invadens
LVCSERVTFAKGLQLKFFFSILEGEMEDSSDLK

SEQ ID NO: 3008177 - protein, 17 aa, Entamoeba invadens
LVDDLLKRISSLELENQ

SEQ ID NO: 3008178 - protein, 25 aa, Entamoeba invadens
LVDDYTYFKYCGLLITGFIENNKQI

SEQ ID NO: 3008179 - protein, 28 aa, Entamoeba invadens
LVDEMHNKLCVWLRLLGYDAKGSKDYEV

SEQ ID NO: 3008180 - protein, 18 aa, Entamoeba invadens
LVDILIVINTDVTALVVI

SEQ ID NO: 3008181 - protein, 21 aa, Entamoeba invadens
LVDIYSLPQLKLVKITALSLT

SEQ ID NO: 3008182 - protein, 21 aa, Entamoeba invadens
LVDKILKRFLNFEVYTPSVIT

SEQ ID NO: 3008183 - protein, 25 aa, Entamoeba invadens
LVDKNFLAMNLWTNLKFTRLSLVIV

SEQ ID NO: 3008184 - protein, 22 aa, Entamoeba invadens
LVDPMIFLRGLVTRKDLQGEWL

SEQ ID NO: 3008185 - protein, 17 aa, Entamoeba invadens
LVEAKNGLENFCYSMKN

SEQ ID NO: 3008186 - protein, 25 aa, Entamoeba invadens
LVEAVVIILRDEDFHHFSAKGRYAA

SEQ ID NO: 3008187 - protein, 17 aa, Entamoeba invadens
LVEFGVVDKFRVLNDRF

SEQ ID NO: 3008188 - protein, 18 aa, Entamoeba invadens
LVEHFYNCTCGGYSLQIW

SEQ ID NO: 3008189 - protein, 25 aa, Entamoeba invadens
LVEICFDTVFYESLHLPKSLKFIKM

SEQ ID NO: 3008190 - protein, 28 aa, Entamoeba invadens
LVEIGPRLCLRLIKILMGCFQGATAYVN

SEQ ID NO: 3008191 - protein, 18 aa, Entamoeba invadens
LVEIVKFLKNVFGDVGNK

SEQ ID NO: 3008192 - protein, 26 aa, Entamoeba invadens
LVEKAHKFFRVKIRIMPKCALCGFNW

SEQ ID NO: 3008193 - protein, 17 aa, Entamoeba invadens
LVEKYMKSVLFSKVPGY

SEQ ID NO: 3008194 - protein, 17 aa, Entamoeba invadens
LVELMGIPAIEANCEAE

SEQ ID NO: 3008195 - protein, 26 aa, Entamoeba invadens
LVEMAMLLHCNIIAYEFPGFSDDSTD

SEQ ID NO: 3008196 - protein, 25 aa, Entamoeba invadens
LVENDNDFLIWLGAIQEMTTQRQLV

SEQ ID NO: 3008197 - protein, 23 aa, Entamoeba invadens
LVEQLHSSPSPMIVFDKKVEETI

SEQ ID NO: 3008198 - protein, 19 aa, Entamoeba invadens
LVERMKLGYWSCFCKAKCA

SEQ ID NO: 3008199 - protein, 21 aa, Entamoeba invadens
LVERSFLTHTILPLSPRDYIK

SEQ ID NO: 3008200 - protein, 25 aa, Entamoeba invadens
LVESTLSLVLLLSDIFVKGIDESII

SEQ ID NO: 3008201 - protein, 27 aa, Entamoeba invadens
LVETFIQFPELMLGMLVQVVLQMYSMT

SEQ ID NO: 3008202 - protein, 24 aa, Entamoeba invadens
LVEYKDFFGWDYSMVSELVGMAKV

SEQ ID NO: 3008203 - protein, 23 aa, Entamoeba invadens
LVEYKDFFTWNKSIVADFVGGNN

SEQ ID NO: 3008204 - protein, 23 aa, Entamoeba invadens
LVEYYGYFQLSYSLSASFNSTFG

SEQ ID NO: 3008205 - protein, 21 aa, Entamoeba invadens
LVFDNVFPTTFWVGKTNKKLL

SEQ ID NO: 3008206 - protein, 20 aa, Entamoeba invadens
LVFEKEEDMFWAGVATFECE

SEQ ID NO: 3008207 - protein, 20 aa, Entamoeba invadens
LVFFSSYKIMEKIHKLWECR

SEQ ID NO: 3008208 - protein, 26 aa, Entamoeba invadens
LVFGSFLRNPIIPQFRTIDPNFFIFF

SEQ ID NO: 3008209 - protein, 18 aa, Entamoeba invadens
LVFVCRKMKEIPLMFHFN

SEQ ID NO: 3008210 - protein, 24 aa, Entamoeba invadens
LVFVDMFTHLLPVYSFDAMEKIAD

SEQ ID NO: 3008211 - protein, 17 aa, Entamoeba invadens
LVFVHNTLTKITFCGKK

SEQ ID NO: 3008212 - protein, 20 aa, Entamoeba invadens
LVGDKTISFWLMDKEMYTGM

SEQ ID NO: 3008213 - protein, 27 aa, Entamoeba invadens
LVGEALPPMYIILAHLNPIVHCSRYVQ

SEQ ID NO: 3008214 - protein, 17 aa, Entamoeba invadens
LVGFWFNLVELTTGKVV

SEQ ID NO: 3008215 - protein, 18 aa, Entamoeba invadens
LVGGMEGVIRFYDFGGMD

SEQ ID NO: 3008216 - protein, 17 aa, Entamoeba invadens
LVGILEFPDRMYHQLGV

SEQ ID NO: 3008217 - protein, 19 aa, Entamoeba invadens
LVGIPTLTCVEGCDKLVNL

SEQ ID NO: 3008218 - protein, 27 aa, Entamoeba invadens
LVGKERFLACEAYFQPSLLNLECLGIH

SEQ ID NO: 3008219 - protein, 17 aa, Entamoeba invadens
LVGLFEDTNLCAIHAKR

SEQ ID NO: 3008220 - protein, 24 aa, Entamoeba invadens
LVGNKYLREFIFTLVINAVCASNV

SEQ ID NO: 3008221 - protein, 27 aa, Entamoeba invadens
LVGQFRYIFEAISSKFLWVFVGTNTQQ

SEQ ID NO: 3008222 - protein, 33 aa, Entamoeba invadens
LVGQNIDCQFLYNAFLFLVRQNVDISLTHLCIG

SEQ ID NO: 3008223 - protein, 28 aa, Entamoeba invadens
LVGSEQLQLPFLLNSPDFEPDSEREALY

SEQ ID NO: 3008224 - protein, 20 aa, Entamoeba invadens
LVGSLKIMLLDIKTVPPLRV

SEQ ID NO: 3008225 - protein, 17 aa, Entamoeba invadens
LVGSQRKLKPVSFDSDF

SEQ ID NO: 3008226 - protein, 18 aa, Entamoeba invadens
LVHELLRHGKFHAASAVM

SEQ ID NO: 3008227 - protein, 20 aa, Entamoeba invadens
LVHIIKRQHFSIKCNGLVLA

SEQ ID NO: 3008228 - protein, 19 aa, Entamoeba invadens
LVHIKLSSNLTKLPDAAFA

SEQ ID NO: 3008229 - protein, 26 aa, Entamoeba invadens
LVHKRFSYFFFHWSDLIRNAFYHIIL

SEQ ID NO: 3008230 - protein, 19 aa, Entamoeba invadens
LVHVIIEHPIKGPDAIITA

SEQ ID NO: 3008231 - protein, 27 aa, Entamoeba invadens
LVIARATELFLIDLIKKTNAIAEEKQS

SEQ ID NO: 3008232 - protein, 19 aa, Entamoeba invadens
LVIDAFATLVSSYSFIFSN

SEQ ID NO: 3008233 - protein, 19 aa, Entamoeba invadens
LVIDMTLPPLFDGKARISS

SEQ ID NO: 3008234 - protein, 17 aa, Entamoeba invadens
LVIFGVYVRLFNEQIRV

SEQ ID NO: 3008235 - protein, 40 aa, Entamoeba invadens
LVIGKIKTFVVFPVRDNLLSWLLDGFLGLAPDKYEQLFNF

SEQ ID NO: 3008236 - protein, 18 aa, Entamoeba invadens
LVIIKLPESVTELHFGCF

SEQ ID NO: 3008237 - protein, 24 aa, Entamoeba invadens
LVIKMIDTLILPDFLVGNQTTLYI

SEQ ID NO: 3008238 - protein, 19 aa, Entamoeba invadens
LVINQCMMYRIKPMTSPTM

SEQ ID NO: 3008239 - protein, 26 aa, Entamoeba invadens
LVINSMLFFHDWKNLQKPFKSVALKE

SEQ ID NO: 3008240 - protein, 19 aa, Entamoeba invadens
LVIPIFTVFLEEYSPLKTP

SEQ ID NO: 3008241 - protein, 27 aa, Entamoeba invadens
LVIPNANFFRNYLLGFREVFTSGQIPP

SEQ ID NO: 3008242 - protein, 17 aa, Entamoeba invadens
LVIQFAVEYSQILVLWR

SEQ ID NO: 3008243 - protein, 29 aa, Entamoeba invadens
LVIRMLEGPLILLKLRVNPFFIEVQGIIH

SEQ ID NO: 3008244 - protein, 22 aa, Entamoeba invadens
LVISVFEFFVSAFRFDKLTNIS

SEQ ID NO: 3008245 - protein, 26 aa, Entamoeba invadens
LVITIERTFPLLNFVSKNVIYKRLDV

SEQ ID NO: 3008246 - protein, 22 aa, Entamoeba invadens
LVKCIDLLLTKKDLIVEDIVQE

SEQ ID NO: 3008247 - protein, 27 aa, Entamoeba invadens
LVKCSGKMVLLDKLLPKLKQDDHRVLI

SEQ ID NO: 3008248 - protein, 26 aa, Entamoeba invadens
LVKFENFFTYQRYKFGVLYGSPGQTK

SEQ ID NO: 3008249 - protein, 29 aa, Entamoeba invadens
LVKGRKCYSMPLILKQYKGQTDAKTLAKW

SEQ ID NO: 3008250 - protein, 18 aa, Entamoeba invadens
LVKKFKNFKFYFKVIYDD

SEQ ID NO: 3008251 - protein, 25 aa, Entamoeba invadens
LVKLPKSLEKEFYCRGYYGTLSHNI

SEQ ID NO: 3008252 - protein, 18 aa, Entamoeba invadens
LVKLVCKAKRFGNKCFYD

SEQ ID NO: 3008253 - protein, 19 aa, Entamoeba invadens
LVKLVCKAKRFGNKCFYDC

SEQ ID NO: 3008254 - protein, 17 aa, Entamoeba invadens
LVKNMNQIDLYLRRYLE

SEQ ID NO: 3008255 - protein, 24 aa, Entamoeba invadens
LVKPFGVYMNYLTKKFPMCKGEGI

SEQ ID NO: 3008256 - protein, 19 aa, Entamoeba invadens
LVKRNVFGNVLTLFEISKI

SEQ ID NO: 3008257 - protein, 26 aa, Entamoeba invadens
LVKTHINIMMPYGKPPIKMLDIMNAK

SEQ ID NO: 3008258 - protein, 17 aa, Entamoeba invadens
LVKVFLLKDNDWKDAGT

SEQ ID NO: 3008259 - protein, 18 aa, Entamoeba invadens
LVKVILLGDGGVGKSVLT

SEQ ID NO: 3008260 - protein, 34 aa, Entamoeba invadens
LVKYAQIHKMTLKNFAMILGPLVIHPGSSVNAIN

SEQ ID NO: 3008261 - protein, 21 aa, Entamoeba invadens
LVKYFKRPLETMAYTSTEKGG

SEQ ID NO: 3008262 - protein, 19 aa, Entamoeba invadens
LVLDFKLLKNYAHRVEYVL

SEQ ID NO: 3008263 - protein, 20 aa, Entamoeba invadens
LVLESVFHTEFFVYEVGADV

SEQ ID NO: 3008264 - protein, 20 aa, Entamoeba invadens
LVLFIPVMQNVFIKVLICGE

SEQ ID NO: 3008265 - protein, 26 aa, Entamoeba invadens
LVLHKELAPLVLPPQQLPLEKQLEKT

SEQ ID NO: 3008266 - protein, 17 aa, Entamoeba invadens
LVLIFNGCVYTYNDNTH

SEQ ID NO: 3008267 - protein, 40 aa, Entamoeba invadens
LVLKCPHEELLRHSLPVIFRIFIFGSLPPNFGITLYNTAS

SEQ ID NO: 3008268 - protein, 38 aa, Entamoeba invadens
LVLKDILNFSLAIFSPLKALLMRLFISKTVSSIITDNM

SEQ ID NO: 3008269 - protein, 17 aa, Entamoeba invadens
LVLLDVVELAFNGLFGR

SEQ ID NO: 3008270 - protein, 23 aa, Entamoeba invadens
LVLLKDFFSLENASAPEPCKKRK

SEQ ID NO: 3008271 - protein, 17 aa, Entamoeba invadens
LVLPSVETLFLYDSVIA

SEQ ID NO: 3008272 - protein, 18 aa, Entamoeba invadens
LVLQMIFDGSLKAKIDQF

SEQ ID NO: 3008273 - protein, 34 aa, Entamoeba invadens
LVLQNVLLVIKTKGFAFGLFLGNWFKESNNIYVF

SEQ ID NO: 3008274 - protein, 20 aa, Entamoeba invadens
LVLSLLELLELYSAGILNGL

SEQ ID NO: 3008275 - protein, 19 aa, Entamoeba invadens
LVLSYFMYEQHMSFEEALA

SEQ ID NO: 3008276 - protein, 27 aa, Entamoeba invadens
LVLTDNFSVPLLNFFKTPLAELSDISI

SEQ ID NO: 3008277 - protein, 25 aa, Entamoeba invadens
LVLTNDDFFIEHMYLLFSDITDSIV

SEQ ID NO: 3008278 - protein, 19 aa, Entamoeba invadens
LVLYALLDLLEELISVFPK

SEQ ID NO: 3008279 - protein, 21 aa, Entamoeba invadens
LVMEPVPWALISVGSLGCTVD

SEQ ID NO: 3008280 - protein, 17 aa, Entamoeba invadens
LVMFAKRNISTPSMVLY

SEQ ID NO: 3008281 - protein, 19 aa, Entamoeba invadens
LVMMGIGGFSPLDGFMSRA

SEQ ID NO: 3008282 - protein, 24 aa, Entamoeba invadens
LVNADGFCYFNTTFQGRPTPVRPV

SEQ ID NO: 3008283 - protein, 18 aa, Entamoeba invadens
LVNALKFSTKHFNDSDTP

SEQ ID NO: 3008284 - protein, 26 aa, Entamoeba invadens
LVNDVKIFYCKYNDPLYIKVEKLEII

SEQ ID NO: 3008285 - protein, 31 aa, Entamoeba invadens
LVNEKAIKIILTWGQLYPDELCEYTVLRDKY

SEQ ID NO: 3008286 - protein, 26 aa, Entamoeba invadens
LVNENKFVFFLTLNGKIVFKTGFRSC

SEQ ID NO: 3008287 - protein, 20 aa, Entamoeba invadens
LVNGVLLVGYGTETYYYCFL

SEQ ID NO: 3008288 - protein, 18 aa, Entamoeba invadens
LVNIQFLGGKFISIKNNA

SEQ ID NO: 3008289 - protein, 17 aa, Entamoeba invadens
LVNIYHKNISESEKLTK

SEQ ID NO: 3008290 - protein, 17 aa, Entamoeba invadens
LVNLKRLNLSFNSIVSV

SEQ ID NO: 3008291 - protein, 23 aa, Entamoeba invadens
LVNNPLVQYFDDSTYRKINDICE

SEQ ID NO: 3008292 - protein, 27 aa, Entamoeba invadens
LVNNRSVLWSFRILRKVRIILRDETHI

SEQ ID NO: 3008293 - protein, 17 aa, Entamoeba invadens
LVNVKKFTTFSLTGSEV

SEQ ID NO: 3008294 - protein, 20 aa, Entamoeba invadens
LVNYHFYTMVNWVLQNDKDT

SEQ ID NO: 3008295 - protein, 24 aa, Entamoeba invadens
LVPKAVIHFLVFKTRDSIQKELIK

SEQ ID NO: 3008296 - protein, 21 aa, Entamoeba invadens
LVPKQTLIPPQLNNSITLTAP

SEQ ID NO: 3008297 - protein, 18 aa, Entamoeba invadens
LVPLVIEIPQRESIKDKM

SEQ ID NO: 3008298 - protein, 37 aa, Entamoeba invadens
LVPYETLQFVFFYFDVVYLRLPRLPLASKWNVTFHEL

SEQ ID NO: 3008299 - protein, 17 aa, Entamoeba invadens
LVQAYILQLPMSSYNSS

SEQ ID NO: 3008300 - protein, 25 aa, Entamoeba invadens
LVQDFFMMQSQAYYPLSKFMEFLTI

SEQ ID NO: 3008301 - protein, 33 aa, Entamoeba invadens
LVQDFRQKKICGPNSLFYGTVKDALESYLNAIE

SEQ ID NO: 3008302 - protein, 23 aa, Entamoeba invadens
LVQEMFLYSVLLNSKTKNCRINT

SEQ ID NO: 3008303 - protein, 20 aa, Entamoeba invadens
LVQFGQRIYDILEGLPAGNQ

SEQ ID NO: 3008304 - protein, 20 aa, Entamoeba invadens
LVQFLPHLATLLWVGNRNNL

SEQ ID NO: 3008305 - protein, 20 aa, Entamoeba invadens
LVQKKYYRALYEKNREFLNK

SEQ ID NO: 3008306 - protein, 17 aa, Entamoeba invadens
LVQLIKALSYCHSHRTF

SEQ ID NO: 3008307 - protein, 18 aa, Entamoeba invadens
LVQLLREMMLTAVNIVDV

SEQ ID NO: 3008308 - protein, 22 aa, Entamoeba invadens
LVQNLFARIYDFDGVDLHGQGI

SEQ ID NO: 3008309 - protein, 27 aa, Entamoeba invadens
LVQNSVFGFLVCLPNKVTKTTYLAPEV

SEQ ID NO: 3008310 - protein, 35 aa, Entamoeba invadens
LVQTKLECNFLYEPFIKIPLTMNALLNFSDLSHFL

SEQ ID NO: 3008311 - protein, 26 aa, Entamoeba invadens
LVREENTLIALKKKLENLRKTADVIA

SEQ ID NO: 3008312 - protein, 25 aa, Entamoeba invadens
LVREVQDFPIFKESIFFYGEKEYNK

SEQ ID NO: 3008313 - protein, 17 aa, Entamoeba invadens
LVRIFQRNGIPPDQQYL

SEQ ID NO: 3008314 - protein, 17 aa, Entamoeba invadens
LVRMLTGKYPFYSKDPE

SEQ ID NO: 3008315 - protein, 19 aa, Entamoeba invadens
LVRPINFLDFFAMKEMLHK

SEQ ID NO: 3008316 - protein, 28 aa, Entamoeba invadens
LVRSEFIEFFSAIYFKVIPSLPPVSDVF

SEQ ID NO: 3008317 - protein, 56 aa, Entamoeba invadens
LVRTIENFKLLLYPLHWVYVCVPILPRILLEYITSPFPYILGLLASFRADAADILR

SEQ ID NO: 3008318 - protein, 17 aa, Entamoeba invadens
LVRYFADGYQFGWVNAN

SEQ ID NO: 3008319 - protein, 27 aa, Entamoeba invadens
LVSFKKLIYVLQLLDYLNVLMKELSYK

SEQ ID NO: 3008320 - protein, 18 aa, Entamoeba invadens
LVSIFDIQGKAKSKWYSS

SEQ ID NO: 3008321 - protein, 17 aa, Entamoeba invadens
LVSIPQTKYFRNPVLNG

SEQ ID NO: 3008322 - protein, 35 aa, Entamoeba invadens
LVSITLSSNLYEIPYKCFFLCANLKEINLEHIRVF

SEQ ID NO: 3008323 - protein, 27 aa, Entamoeba invadens
LVSKEELFPFLFKYLKIKEGGPGSGFQ

SEQ ID NO: 3008324 - protein, 17 aa, Entamoeba invadens
LVSKMFSILIERPPKQS

SEQ ID NO: 3008325 - protein, 28 aa, Entamoeba invadens
LVSKYSDAFYFYVYPEELHVLTYDQKFS

SEQ ID NO: 3008326 - protein, 17 aa, Entamoeba invadens
LVSLFSIPETCGLSVEI

SEQ ID NO: 3008327 - protein, 28 aa, Entamoeba invadens
LVSLRPHPFDPFVVSAIPFINDPFQTLG

SEQ ID NO: 3008328 - protein, 22 aa, Entamoeba invadens
LVSLTLSPFIPTIPSGLCWGCI

SEQ ID NO: 3008329 - protein, 19 aa, Entamoeba invadens
LVSMSFLNEDDKPIKAVFR

SEQ ID NO: 3008330 - protein, 18 aa, Entamoeba invadens
LVSRFLLLKNIQKDHEKR

SEQ ID NO: 3008331 - protein, 18 aa, Entamoeba invadens
LVSRFLNQNLFGKLVTAV

SEQ ID NO: 3008332 - protein, 28 aa, Entamoeba invadens
LVSTQYFLENIFYLMKDDRLFVSSCLLI

SEQ ID NO: 3008333 - protein, 24 aa, Entamoeba invadens
LVSVRFPITLTSIGSLAFSKCKLQ

SEQ ID NO: 3008334 - protein, 17 aa, Entamoeba invadens
LVSYVPVASFKGLLTKT

SEQ ID NO: 3008335 - protein, 20 aa, Entamoeba invadens
LVTCGAAKCPLWDVGIMLSE

SEQ ID NO: 3008336 - protein, 19 aa, Entamoeba invadens
LVTFLPERNDFVARRIIVL

SEQ ID NO: 3008337 - protein, 35 aa, Entamoeba invadens
LVTGLENIRYIYSGAFINCSLLQKVKLNALQVIEN

SEQ ID NO: 3008338 - protein, 25 aa, Entamoeba invadens
LVTKARRFLYKLQTADMVIIPSIDE

SEQ ID NO: 3008339 - protein, 25 aa, Entamoeba invadens
LVTKILQEGLGGQGMLLCIGCIDLN

SEQ ID NO: 3008340 - protein, 25 aa, Entamoeba invadens
LVTKLFGVLDSFILCIQTLEKNIDF

SEQ ID NO: 3008341 - protein, 21 aa, Entamoeba invadens
LVTLDKLCFSKCISLRSVSFK

SEQ ID NO: 3008342 - protein, 18 aa, Entamoeba invadens
LVTLPYSVKGMDISLTGL

SEQ ID NO: 3008343 - protein, 17 aa, Entamoeba invadens
LVTMKYQLGNLVEKRNR

SEQ ID NO: 3008344 - protein, 25 aa, Entamoeba invadens
LVTNNYKLLRYLIKTNAVLMLPQPA

SEQ ID NO: 3008345 - protein, 25 aa, Entamoeba invadens
LVTTHHPIFIAIRVEQTMFGVYVNN

SEQ ID NO: 3008346 - protein, 17 aa, Entamoeba invadens
LVTTPKGFLSVDEIVKK

SEQ ID NO: 3008347 - protein, 18 aa, Entamoeba invadens
LVTTPKGFLSVDEIVKKV

SEQ ID NO: 3008348 - protein, 17 aa, Entamoeba invadens
LVTYEEMLLRFKNETFG

SEQ ID NO: 3008349 - protein, 17 aa, Entamoeba invadens
LVVDLMMSSSFPADVKE

SEQ ID NO: 3008350 - protein, 19 aa, Entamoeba invadens
LVVEKILPPMYVSESIQKI

SEQ ID NO: 3008351 - protein, 28 aa, Entamoeba invadens
LVVGGRLVFWFPVIFPQDHGKLFPEMVM

SEQ ID NO: 3008352 - protein, 18 aa, Entamoeba invadens
LVVIGDGAVGKTCMLMSY

SEQ ID NO: 3008353 - protein, 18 aa, Entamoeba invadens
LVVKRLVDMLKLKGVVEA

SEQ ID NO: 3008354 - protein, 17 aa, Entamoeba invadens
LVVLNIGGVIETESWKD

SEQ ID NO: 3008355 - protein, 28 aa, Entamoeba invadens
LVVNSEFFQFFRSFGKIVNFYLTEINET

SEQ ID NO: 3008356 - protein, 18 aa, Entamoeba invadens
LVVPFEYMKRVYVATESE

SEQ ID NO: 3008357 - protein, 18 aa, Entamoeba invadens
LVVQQIYLISLLTQNGFD

SEQ ID NO: 3008358 - protein, 18 aa, Entamoeba invadens
LVVTPLMSLLRSNALVPS

SEQ ID NO: 3008359 - protein, 36 aa, Entamoeba invadens
LVVVPHHYFRMNKAKTILYVIFAKEELADKPKIEII

SEQ ID NO: 3008360 - protein, 27 aa, Entamoeba invadens
LVVVTKHRIYFFNPKEFKAPVYQSHLF

SEQ ID NO: 3008361 - protein, 25 aa, Entamoeba invadens
LVWRENGNFLLGCYDGTVAEFDLRN

SEQ ID NO: 3008362 - protein, 18 aa, Entamoeba invadens
LVYGRGLDWKISVLDIIP

SEQ ID NO: 3008363 - protein, 21 aa, Entamoeba invadens
LVYNRLPPSLPSLEKLTLEGV

SEQ ID NO: 3008364 - protein, 25 aa, Entamoeba invadens
LVYVREMLQMRLIITPQNLINDDGT

SEQ ID NO: 3008365 - protein, 17 aa, Entamoeba invadens
LVYWEHIYDEILLTEES

SEQ ID NO: 3008366 - protein, 19 aa, Entamoeba invadens
LVYYLKTTTNPIVNLVART

SEQ ID NO: 3008367 - protein, 42 aa, Entamoeba invadens
LVYYTDGKIKWYSPSKSALLSKLSLPKFHRFVKSSVNGDVLV

SEQ ID NO: 3008368 - protein, 27 aa, Entamoeba invadens
LWAPSPEYFMQIYSPPLRDMGILLEVQ

SEQ ID NO: 3008369 - protein, 17 aa, Entamoeba invadens
LWDGCERDIFWKSQYKL

SEQ ID NO: 3008370 - protein, 18 aa, Entamoeba invadens
LWDRNRLFDRIACLILYE

SEQ ID NO: 3008371 - protein, 27 aa, Entamoeba invadens
LWDVDKTIFFVNLTIQRHFLLTVIESD

SEQ ID NO: 3008372 - protein, 23 aa, Entamoeba invadens
LWKCCSLVRHPKFVPAKGAKLLD

SEQ ID NO: 3008373 - protein, 24 aa, Entamoeba invadens
LWKCCSLVRHPKFVPAKGAKLLDN

SEQ ID NO: 3008374 - protein, 17 aa, Entamoeba invadens
LWNAFKFASMNFSEDFT

SEQ ID NO: 3008375 - protein, 19 aa, Entamoeba invadens
LWNEKHWKPNIYNKAMPRN

SEQ ID NO: 3008376 - protein, 24 aa, Entamoeba invadens
LWTGKQLYGLALRPNPNFGVDICL

SEQ ID NO: 3008377 - protein, 17 aa, Entamoeba invadens
LWTNVQPVYEKGEYVQF

SEQ ID NO: 3008378 - protein, 17 aa, Entamoeba invadens
LWVAYMFSAKDFTITAV

SEQ ID NO: 3008379 - protein, 24 aa, Entamoeba invadens
LWVSKRGQLCYLENAFKGCVQDIT

SEQ ID NO: 3008380 - protein, 25 aa, Entamoeba invadens
LWYSDIVTGLLYKQGEKYSYIQEET

SEQ ID NO: 3008381 - protein, 31 aa, Entamoeba invadens
LYACFLTTFVFDIGWLLREVPILKTVQVQFV

SEQ ID NO: 3008382 - protein, 18 aa, Entamoeba invadens
LYAFLGMANVYYKFGKNN

SEQ ID NO: 3008383 - protein, 28 aa, Entamoeba invadens
LYARQVEIINTLYFWVNAMSITKYVKIR

SEQ ID NO: 3008384 - protein, 31 aa, Entamoeba invadens
LYATHNYLLDILRICGFFFESTYPKKSCKCM

SEQ ID NO: 3008385 - protein, 20 aa, Entamoeba invadens
LYCEGKGTVYVLATQYADDG

SEQ ID NO: 3008386 - protein, 19 aa, Entamoeba invadens
LYCLEYLESNVDWMLDKIA

SEQ ID NO: 3008387 - protein, 25 aa, Entamoeba invadens
LYDDLTKVFDEKSVLELKMETNTKE

SEQ ID NO: 3008388 - protein, 28 aa, Entamoeba invadens
LYDKYTQVFLMDYLRLSLKPTMEMILKQ

SEQ ID NO: 3008389 - protein, 21 aa, Entamoeba invadens
LYDLFYDTVLSGLNSYGLILL

SEQ ID NO: 3008390 - protein, 21 aa, Entamoeba invadens
LYDMGPLGCALKQNILQFWRK

SEQ ID NO: 3008391 - protein, 31 aa, Entamoeba invadens
LYDSQCFMNCFNLKFISKVKHLKSCVFWCCN

SEQ ID NO: 3008392 - protein, 18 aa, Entamoeba invadens
LYDTYKYFPKSPESIIKL

SEQ ID NO: 3008393 - protein, 26 aa, Entamoeba invadens
LYDVMEVGLRALHPFMPFVTEELWQR

SEQ ID NO: 3008394 - protein, 39 aa, Entamoeba invadens
LYEHYALDILKLFPNIQTLYLPFYEMFVPDNVLSKIKYI

SEQ ID NO: 3008395 - protein, 30 aa, Entamoeba invadens
LYENGITSLWRKKLPVKYPTSFVILDEQNA

SEQ ID NO: 3008396 - protein, 18 aa, Entamoeba invadens
LYETARMSNWKPPKNWLK

SEQ ID NO: 3008397 - protein, 23 aa, Entamoeba invadens
LYEVLRYTIGIYGVIGLTPKNLV

SEQ ID NO: 3008398 - protein, 17 aa, Entamoeba invadens
LYEYPISYSCYLNEKTK

SEQ ID NO: 3008399 - protein, 23 aa, Entamoeba invadens
LYFDEQFYNLLSKVMKVLPSFWC

SEQ ID NO: 3008400 - protein, 18 aa, Entamoeba invadens
LYFHPTLRHQVSVKDSWG

SEQ ID NO: 3008401 - protein, 18 aa, Entamoeba invadens
LYFKTRITTYIAFSKCLS

SEQ ID NO: 3008402 - protein, 21 aa, Entamoeba invadens
LYFRDCESFVGAYRTIANKTS

SEQ ID NO: 3008403 - protein, 28 aa, Entamoeba invadens
LYFSDKKMMYAFNDFKMYLPLGPEKMEE

SEQ ID NO: 3008404 - protein, 20 aa, Entamoeba invadens
LYHMFKLHMMIIHAIVRMTY

SEQ ID NO: 3008405 - protein, 19 aa, Entamoeba invadens
LYHNSCACIFVYDVANNDT

SEQ ID NO: 3008406 - protein, 19 aa, Entamoeba invadens
LYHSLFKNQLFAKPKYSKY

SEQ ID NO: 3008407 - protein, 20 aa, Entamoeba invadens
LYINPFNLPQSIPIQKIVTL

SEQ ID NO: 3008408 - protein, 39 aa, Entamoeba invadens
LYINSYALSMKYPLQIMIKYFPKIETFYLNKVPLDVTEC

SEQ ID NO: 3008409 - protein, 18 aa, Entamoeba invadens
LYIPYVGNLVLLSLQLFN

SEQ ID NO: 3008410 - protein, 19 aa, Entamoeba invadens
LYKELRDMYNIRPVLDECA

SEQ ID NO: 3008411 - protein, 30 aa, Entamoeba invadens
LYKKASKVFWVCRECGFIFEGTQAPKNCPL

SEQ ID NO: 3008412 - protein, 20 aa, Entamoeba invadens
LYKKTLGYSFLPTLTKKEVT

SEQ ID NO: 3008413 - protein, 18 aa, Entamoeba invadens
LYKLYADYVLKDPFIILE

SEQ ID NO: 3008414 - protein, 25 aa, Entamoeba invadens
LYKNGGIYFITSRILISDLISEDFT

SEQ ID NO: 3008415 - protein, 21 aa, Entamoeba invadens
LYLGDRWLRFDPPLGCVIDLD

SEQ ID NO: 3008416 - protein, 20 aa, Entamoeba invadens
LYLGLFTPIMNEKPFARIKL

SEQ ID NO: 3008417 - protein, 18 aa, Entamoeba invadens
LYLGNIYQTLIIGDKNSS

SEQ ID NO: 3008418 - protein, 18 aa, Entamoeba invadens
LYLLTECFTTGFSSNLYT

SEQ ID NO: 3008419 - protein, 24 aa, Entamoeba invadens
LYLTYPEIYVIKNGAFDVFNKAKK

SEQ ID NO: 3008420 - protein, 26 aa, Entamoeba invadens
LYMKEGDAFVLVFSLQSVSTFNDLSS

SEQ ID NO: 3008421 - protein, 20 aa, Entamoeba invadens
LYMWDFCQCDPKKCSGRKLV

SEQ ID NO: 3008422 - protein, 18 aa, Entamoeba invadens
LYNHIATTLPKFSNKRVM

SEQ ID NO: 3008423 - protein, 29 aa, Entamoeba invadens
LYNKYPQLKTLFDIEIFSFDYGRTKGDGG

SEQ ID NO: 3008424 - protein, 17 aa, Entamoeba invadens
LYNLILDKQFDGIEILS

SEQ ID NO: 3008425 - protein, 26 aa, Entamoeba invadens
LYNVGRFYHQLDVLYLASNFYEQALS

SEQ ID NO: 3008426 - protein, 23 aa, Entamoeba invadens
LYPIAIHMLKLASGKPIFIPQET

SEQ ID NO: 3008427 - protein, 33 aa, Entamoeba invadens
LYPKENICVFPYNSVIYTLSFIVNKVCYNNIKI

SEQ ID NO: 3008428 - protein, 19 aa, Entamoeba invadens
LYPRMFVDCVNFTSVVLSR

SEQ ID NO: 3008429 - protein, 18 aa, Entamoeba invadens
LYPSAIHRLKLATGKPIV

SEQ ID NO: 3008430 - protein, 27 aa, Entamoeba invadens
LYQADGVFVFYSYRDPHIFETLDIYKQ

SEQ ID NO: 3008431 - protein, 18 aa, Entamoeba invadens
LYQFSSVALMEKALYELY

SEQ ID NO: 3008432 - protein, 17 aa, Entamoeba invadens
LYQLQLWDTAGQEKYHS

SEQ ID NO: 3008433 - protein, 32 aa, Entamoeba invadens
LYQLTDPKIFSVKNYVVWYPVCYSHAKSYQND

SEQ ID NO: 3008434 - protein, 21 aa, Entamoeba invadens
LYQNKEACKFVFEIAVKFTKH

SEQ ID NO: 3008435 - protein, 24 aa, Entamoeba invadens
LYQQKVALFLIRTTADRLQHAVDI

SEQ ID NO: 3008436 - protein, 19 aa, Entamoeba invadens
LYRDFPLAHVLRDSVFIVH

SEQ ID NO: 3008437 - protein, 26 aa, Entamoeba invadens
LYRDGDVLVYSGYFSRILSREKVFGF

SEQ ID NO: 3008438 - protein, 19 aa, Entamoeba invadens
LYRDIKPDNILVFSLETIE

SEQ ID NO: 3008439 - protein, 17 aa, Entamoeba invadens
LYRDRPLSQILTEEKRK

SEQ ID NO: 3008440 - protein, 26 aa, Entamoeba invadens
LYRFRAMSFCLVLGKLSIKNLYGDVD

SEQ ID NO: 3008441 - protein, 28 aa, Entamoeba invadens
LYRHANDKHFLIPFYQRPSGEGDKYVGA

SEQ ID NO: 3008442 - protein, 17 aa, Entamoeba invadens
LYRRTLVMVFATAAYQT

SEQ ID NO: 3008443 - protein, 25 aa, Entamoeba invadens
LYSFRSVRKFAPYIKNYFLVTDDQV

SEQ ID NO: 3008444 - protein, 23 aa, Entamoeba invadens
LYSMGNLMFGGCISLKEVVIDNI

SEQ ID NO: 3008445 - protein, 20 aa, Entamoeba invadens
LYSRFYEIISNGLPLMPVVI

SEQ ID NO: 3008446 - protein, 42 aa, Entamoeba invadens
LYSSIPEISVLNGPKFSPTSNPLPFQHFMNSEGNIQAVQNES

SEQ ID NO: 3008447 - protein, 31 aa, Entamoeba invadens
LYSVISDVPVFFFYQVGFYGRDFFGKDHQQK

SEQ ID NO: 3008448 - protein, 24 aa, Entamoeba invadens
LYSVLLQKILQFHKDYSFLTGYFT

SEQ ID NO: 3008449 - protein, 23 aa, Entamoeba invadens
LYTCVFKIFKALLLSINKENANC

SEQ ID NO: 3008450 - protein, 18 aa, Entamoeba invadens
LYTLMEDGLPWDKKKRYN

SEQ ID NO: 3008451 - protein, 18 aa, Entamoeba invadens
LYTPIKQTASEKSPIVIA

SEQ ID NO: 3008452 - protein, 28 aa, Entamoeba invadens
LYVAHVGDSPVFLIRNKKIEKTEEAGDV

SEQ ID NO: 3008453 - protein, 21 aa, Entamoeba invadens
LYVAIHSIPFKKLLNLMQSGK

SEQ ID NO: 3008454 - protein, 21 aa, Entamoeba invadens
LYVATEKYWVHLRKSNTEPIV

SEQ ID NO: 3008455 - protein, 27 aa, Entamoeba invadens
LYVEENIGIFPHFGFEVLYKEENPATE

SEQ ID NO: 3008456 - protein, 20 aa, Entamoeba invadens
LYVESIPLVITFTYLGNWPD

SEQ ID NO: 3008457 - protein, 18 aa, Entamoeba invadens
LYVGYKWMRGVSEKYKEI

SEQ ID NO: 3008458 - protein, 20 aa, Entamoeba invadens
LYVLGKLYNEIGRDLINQLM

SEQ ID NO: 3008459 - protein, 18 aa, Entamoeba invadens
LYVNVIVDPIGKWMKGEV

SEQ ID NO: 3008460 - protein, 19 aa, Entamoeba invadens
LYVSHLTFTLRPLEVLIEM

SEQ ID NO: 3008461 - protein, 24 aa, Entamoeba invadens
LYVSPLCTVIVQLLLREAVTVVFK

SEQ ID NO: 3008462 - protein, 28 aa, Entamoeba invadens
LYVTCDKSFLTMEIHKFAVALYDFEGES

SEQ ID NO: 3008463 - protein, 27 aa, Entamoeba invadens
LYVTGDLTGLIPWNKELFKETQKPLQT

SEQ ID NO: 3008464 - protein, 25 aa, Entamoeba invadens
LYWEQQLRVLQPSESLLRVASKPAE

SEQ ID NO: 3008465 - protein, 26 aa, Entamoeba invadens
LYYDVEPFYFYVLCEYEPKTELEDEN

SEQ ID NO: 3008466 - protein, 17 aa, Entamoeba invadens
LYYKCDLLRENTIKTLD

SEQ ID NO: 3008467 - protein, 19 aa, Entamoeba invadens
LYYTQNQPPVPLPVHTQPL

SEQ ID NO: 3008468 - protein, 23 aa, Entamoeba invadens
MAAELFVGIPIFPGNSEYNMLYK

SEQ ID NO: 3008469 - protein, 19 aa, Entamoeba invadens
MADAKIGLKVLYKLMDADG

SEQ ID NO: 3008470 - protein, 33 aa, Entamoeba invadens
MAEGDPPYMEFPPLRALFLITTKGIPPLKNADK

SEQ ID NO: 3008471 - protein, 32 aa, Entamoeba invadens
MAELYPPYYNIYPMKVLMLIHKNPPPKLKNEN

SEQ ID NO: 3008472 - protein, 18 aa, Entamoeba invadens
MAFLRQFKVDRIALGDYL

SEQ ID NO: 3008473 - protein, 24 aa, Entamoeba invadens
MAIDGLMMIILSSPIGFDAGLVSS

SEQ ID NO: 3008474 - protein, 23 aa, Entamoeba invadens
MAKDDYAWWKGRLSQMAQYFSAY

SEQ ID NO: 3008475 - protein, 25 aa, Entamoeba invadens
MAKFHFNPIPLTRMTKHYFPKLETL

SEQ ID NO: 3008476 - protein, 29 aa, Entamoeba invadens
MAKFHYNPIPLTIKTRKYFPHLQTICLYS

SEQ ID NO: 3008477 - protein, 33 aa, Entamoeba invadens
MAKKFIGKPAPFTPFTAFLTENWKKQKYFKKKR

SEQ ID NO: 3008478 - protein, 30 aa, Entamoeba invadens
MAKKVEVVLGVPFIYLTKVQQILAGEANGA

SEQ ID NO: 3008479 - protein, 26 aa, Entamoeba invadens
MAKLIKHAFALVYLRDVVIARFADET

SEQ ID NO: 3008480 - protein, 21 aa, Entamoeba invadens
MAKRFNAFFMETSCLNGNGVN

SEQ ID NO: 3008481 - protein, 21 aa, Entamoeba invadens
MAKVFVQWLCRKKRLADYCDG

SEQ ID NO: 3008482 - protein, 18 aa, Entamoeba invadens
MALKTKEDEFKIATKKIE

SEQ ID NO: 3008483 - protein, 25 aa, Entamoeba invadens
MANCRPSVLNIFYCKADMSCINDDN

SEQ ID NO: 3008484 - protein, 24 aa, Entamoeba invadens
MANKFIEFVIPVVVNFINLDESAV

SEQ ID NO: 3008485 - protein, 17 aa, Entamoeba invadens
MANNIFKIFAAKSYRFF

SEQ ID NO: 3008486 - protein, 20 aa, Entamoeba invadens
MAQRLFFKSAKDKRSFIANL

SEQ ID NO: 3008487 - protein, 20 aa, Entamoeba invadens
MARNRYFNPLPESDFKSVLA

SEQ ID NO: 3008488 - protein, 24 aa, Entamoeba invadens
MASFLEANSFREQLFRVLEKDFSE

SEQ ID NO: 3008489 - protein, 24 aa, Entamoeba invadens
MASPEFNIIALKENMPHVSGSVMY

SEQ ID NO: 3008490 - protein, 19 aa, Entamoeba invadens
MASPTFLIVVPRVLQKLYD

SEQ ID NO: 3008491 - protein, 25 aa, Entamoeba invadens
MASRLTVVLGYILCILYHLKRYGDA

SEQ ID NO: 3008492 - protein, 24 aa, Entamoeba invadens
MASVIICGIILWMKEDVLSNPKAL

SEQ ID NO: 3008493 - protein, 28 aa, Entamoeba invadens
MASVYLTAVIEYLVAEVLELAGGQAKDF

SEQ ID NO: 3008494 - protein, 29 aa, Entamoeba invadens
MATHKMYYPFTCNSILLYSSDLAHFMGSV

SEQ ID NO: 3008495 - protein, 33 aa, Entamoeba invadens
MATLIGLAIRTKLIRVLPYRIKVDIYLTEGTHQ

SEQ ID NO: 3008496 - protein, 17 aa, Entamoeba invadens
MAVLLINNAQNIRKLLC

SEQ ID NO: 3008497 - protein, 21 aa, Entamoeba invadens
MAVMSLISFLQRLDLNINLQS

SEQ ID NO: 3008498 - protein, 35 aa, Entamoeba invadens
MAVPLDRYMPFMKPLQLKFLNISGNRFTKLDKAME

SEQ ID NO: 3008499 - protein, 24 aa, Entamoeba invadens
MAVSPWSVVFKNWNNVLPMGVKIL

SEQ ID NO: 3008500 - protein, 17 aa, Entamoeba invadens
MAYVSYFRHYEAEKEKM

SEQ ID NO: 3008501 - protein, 23 aa, Entamoeba invadens
MCEIFAIKIRILMKFLESQNAIN

SEQ ID NO: 3008502 - protein, 19 aa, Entamoeba invadens
MCEYMTFLLECNAKYNIKV

SEQ ID NO: 3008503 - protein, 19 aa, Entamoeba invadens
MCFGDAPFYDTAPAMICKK

SEQ ID NO: 3008504 - protein, 17 aa, Entamoeba invadens
MCFRKGMRLVHEDVVKL

SEQ ID NO: 3008505 - protein, 27 aa, Entamoeba invadens
MCGGEVRILYPIVPYKVVENNEVTSPL

SEQ ID NO: 3008506 - protein, 26 aa, Entamoeba invadens
MCIDFLIERVAFIGFFKRCRPVTACQ

SEQ ID NO: 3008507 - protein, 17 aa, Entamoeba invadens
MCLFTKNNFIQCGNITR

SEQ ID NO: 3008508 - protein, 18 aa, Entamoeba invadens
MCLKPLPCGHVCTALCHS

SEQ ID NO: 3008509 - protein, 20 aa, Entamoeba invadens
MCMPPTLQVPYTINKPLPKP

SEQ ID NO: 3008510 - protein, 17 aa, Entamoeba invadens
MCMYVDKVLNGAHAVQT

SEQ ID NO: 3008511 - protein, 17 aa, Entamoeba invadens
MCNMTSWIPLRETVHIT

SEQ ID NO: 3008512 - protein, 32 aa, Entamoeba invadens
MCNVQGVDKWYVQLKLWEKKTFIKKNMVVVFT

SEQ ID NO: 3008513 - protein, 24 aa, Entamoeba invadens
MCRKINVFPTKFGSKHLPLLAMLF

SEQ ID NO: 3008514 - protein, 21 aa, Entamoeba invadens
MCTEALFIALLNRTEDIILLP

SEQ ID NO: 3008515 - protein, 39 aa, Entamoeba invadens
MCTNHKLWSVLLPVAQQWRTFMYVLTQKLVDMLYSSVEC

SEQ ID NO: 3008516 - protein, 34 aa, Entamoeba invadens
MCTVEGGDYLLLQSFKTFFAYKRVNGKYVIHFTH

SEQ ID NO: 3008517 - protein, 23 aa, Entamoeba invadens
MCYKKFCFLVRLGDGQYSRVYKA

SEQ ID NO: 3008518 - protein, 26 aa, Entamoeba invadens
MCYNCNLHLLTLPFGVTKISSFAFMN

SEQ ID NO: 3008519 - protein, 25 aa, Entamoeba invadens
MDAANILKPILSRGELWCIEVTTHK

SEQ ID NO: 3008520 - protein, 24 aa, Entamoeba invadens
MDAANILKPMLSRGELRCIGATTL

SEQ ID NO: 3008521 - protein, 25 aa, Entamoeba invadens
MDADLIMLTLASNLPFVYIIREEME

SEQ ID NO: 3008522 - protein, 26 aa, Entamoeba invadens
MDCSKLLTNMLIAPAFIAATKAKEGK

SEQ ID NO: 3008523 - protein, 29 aa, Entamoeba invadens
MDCVSLAVRAALLSTLIPVVTVISGDAEE

SEQ ID NO: 3008524 - protein, 22 aa, Entamoeba invadens
MDDRFCIKIIDFGLVVRKSSMP

SEQ ID NO: 3008525 - protein, 22 aa, Entamoeba invadens
MDDTLFCHIIRVSNNNNKYIDS

SEQ ID NO: 3008526 - protein, 18 aa, Entamoeba invadens
MDDYPVFANIFKSEKMIV

SEQ ID NO: 3008527 - protein, 18 aa, Entamoeba invadens
MDEEFAFIALRRMIGGEE

SEQ ID NO: 3008528 - protein, 22 aa, Entamoeba invadens
MDEMWKFNYVLDVCLEKLKTSQ

SEQ ID NO: 3008529 - protein, 27 aa, Entamoeba invadens
MDESNVAVMYIFTKLLIVVESKKEINK

SEQ ID NO: 3008530 - protein, 32 aa, Entamoeba invadens
MDEYRDTIRVWIRMTCYSVKYDSTIHGMSALN

SEQ ID NO: 3008531 - protein, 17 aa, Entamoeba invadens
MDGNVNVFTYYPKVFDA

SEQ ID NO: 3008532 - protein, 17 aa, Entamoeba invadens
MDIFVALDDLEKGYQND

SEQ ID NO: 3008533 - protein, 34 aa, Entamoeba invadens
MDISGLFKKKDPKFCPLWRLAAVKCDGVKFTGKL

SEQ ID NO: 3008534 - protein, 25 aa, Entamoeba invadens
MDKFRSEYIIHFYGAVFFTNNVSVV

SEQ ID NO: 3008535 - protein, 36 aa, Entamoeba invadens
MDKKRLPKVLGLLEAYRILYLLATRAKTLRFNKNYV

SEQ ID NO: 3008536 - protein, 22 aa, Entamoeba invadens
MDKVLLINPSYQHKLGVSWKSE

SEQ ID NO: 3008537 - protein, 18 aa, Entamoeba invadens
MDNCKLLLIFHHSPRNPQ

SEQ ID NO: 3008538 - protein, 24 aa, Entamoeba invadens
MDNKINIFEFDPTLQQIYEEHKDD

SEQ ID NO: 3008539 - protein, 22 aa, Entamoeba invadens
MDNSYIMFGSVNSGIYKKRKGI

SEQ ID NO: 3008540 - protein, 22 aa, Entamoeba invadens
MDNYKLVFFFDDSVDEIREFYK

SEQ ID NO: 3008541 - protein, 26 aa, Entamoeba invadens
MDPIRKPFLFLHCHILREYLSKTIRI

SEQ ID NO: 3008542 - protein, 17 aa, Entamoeba invadens
MDPQRFSKFLSCIANTI

SEQ ID NO: 3008543 - protein, 20 aa, Entamoeba invadens
MDPYGMQQPGMNPYGAMGGM

SEQ ID NO: 3008544 - protein, 25 aa, Entamoeba invadens
MDQFAWNLLHLDYYCDISMPVLAPR

SEQ ID NO: 3008545 - protein, 24 aa, Entamoeba invadens
MDQQKLFELIIAANVLDVQELLDL

SEQ ID NO: 3008546 - protein, 23 aa, Entamoeba invadens
MDRRSIFMYGQNLPINPLGMVGC

SEQ ID NO: 3008547 - protein, 24 aa, Entamoeba invadens
MDSAQILPLLMKKHKLSTKSVYCT

SEQ ID NO: 3008548 - protein, 21 aa, Entamoeba invadens
MDSFSLQMYLYYVGCIALNNR

SEQ ID NO: 3008549 - protein, 29 aa, Entamoeba invadens
MDTLILPTKFITPTKVLPLKALDTQFVIH

SEQ ID NO: 3008550 - protein, 24 aa, Entamoeba invadens
MDTTKFCNGVVLPVLQNSPIKVQQ

SEQ ID NO: 3008551 - protein, 18 aa, Entamoeba invadens
MDVDLFRLHFMLESDQNV

SEQ ID NO: 3008552 - protein, 24 aa, Entamoeba invadens
MDVKNMKFLWTLSNDKASFFFHVL

SEQ ID NO: 3008553 - protein, 28 aa, Entamoeba invadens
MDVLMGRVYPLKLGYIGVVNRSQQDINN

SEQ ID NO: 3008554 - protein, 35 aa, Entamoeba invadens
MDVWFYDEKHFIFSLDSKGLFPAPTRWNSKLGEQG

SEQ ID NO: 3008555 - protein, 30 aa, Entamoeba invadens
MDVWSTGVVLFFTALRYLPFSTDLDTYRRQ

SEQ ID NO: 3008556 - protein, 20 aa, Entamoeba invadens
MDWRMDLDITLVRTPHPLQS

SEQ ID NO: 3008557 - protein, 18 aa, Entamoeba invadens
MDYFGLLVNYSNTIFEIV

SEQ ID NO: 3008558 - protein, 40 aa, Entamoeba invadens
MDYLSRIMKLFPNIQTLYLPSYKCIIPQLSKFNISFIKVK

SEQ ID NO: 3008559 - protein, 22 aa, Entamoeba invadens
MEDDWLSLILDITSNICRLHPT

SEQ ID NO: 3008560 - protein, 20 aa, Entamoeba invadens
MEDILKKIQFMKTELTYIGN

SEQ ID NO: 3008561 - protein, 24 aa, Entamoeba invadens
MEDKLALEFLDKFESKFIAQDYYE

SEQ ID NO: 3008562 - protein, 19 aa, Entamoeba invadens
MEDMVLLDFGVLTTTLNWF

SEQ ID NO: 3008563 - protein, 22 aa, Entamoeba invadens
MEDQIKALNAQVLLLKVIVLIV

SEQ ID NO: 3008564 - protein, 30 aa, Entamoeba invadens
MEDWKSLKDVTVLKWYLLKEDTGVLSPLEL

SEQ ID NO: 3008565 - protein, 23 aa, Entamoeba invadens
MEEGFKLHYFLQNTDIPPCITVF

SEQ ID NO: 3008566 - protein, 19 aa, Entamoeba invadens
MEEVLKHPFILMCKNHKYG

SEQ ID NO: 3008567 - protein, 17 aa, Entamoeba invadens
MEEVPLPVIIVDDVKAI

SEQ ID NO: 3008568 - protein, 18 aa, Entamoeba invadens
MEFFIQQVETARSGLWLN

SEQ ID NO: 3008569 - protein, 17 aa, Entamoeba invadens
MEHLHVLMDFIKGDPVY

SEQ ID NO: 3008570 - protein, 17 aa, Entamoeba invadens
MEHLSVLRMSQSVLLCC

SEQ ID NO: 3008571 - protein, 19 aa, Entamoeba invadens
MEIELPKKLVIVTSLCFPT

SEQ ID NO: 3008572 - protein, 17 aa, Entamoeba invadens
MEILKDILQFSYKKRDV

SEQ ID NO: 3008573 - protein, 17 aa, Entamoeba invadens
MEISNIQLGIFQKTFEM

SEQ ID NO: 3008574 - protein, 18 aa, Entamoeba invadens
MEKAGYLQHIEELEMGMI

SEQ ID NO: 3008575 - protein, 27 aa, Entamoeba invadens
MEKALYELYAIFLIRKRRDSSFFTYTV

SEQ ID NO: 3008576 - protein, 23 aa, Entamoeba invadens
MEKDNYAWWKGRLSQMAQYFNAY

SEQ ID NO: 3008577 - protein, 21 aa, Entamoeba invadens
MEKEKIAVPFLLKCCNDCANA

SEQ ID NO: 3008578 - protein, 19 aa, Entamoeba invadens
MEKFHFNPIPLSYKTIKYF

SEQ ID NO: 3008579 - protein, 30 aa, Entamoeba invadens
MEKFHFNPIPLTIQQRKFFPSLETCFLYSK

SEQ ID NO: 3008580 - protein, 19 aa, Entamoeba invadens
MEKFKILMNLILNTNAIQT

SEQ ID NO: 3008581 - protein, 22 aa, Entamoeba invadens
MEKFYFNPIPLNSKTIRYFPNI

SEQ ID NO: 3008582 - protein, 18 aa, Entamoeba invadens
MEKIMVFYTEKEFSKDKN

SEQ ID NO: 3008583 - protein, 29 aa, Entamoeba invadens
MEKLDVVNPLLVFLSAVKLASDTVGVILK

SEQ ID NO: 3008584 - protein, 20 aa, Entamoeba invadens
MEKLLIFTEGAPTIVFCFYL

SEQ ID NO: 3008585 - protein, 24 aa, Entamoeba invadens
MEKLLIFTEGAPTLVFCFYLNNEE

SEQ ID NO: 3008586 - protein, 25 aa, Entamoeba invadens
MEKNRKLIKLTLKDYNFARHCIGKG

SEQ ID NO: 3008587 - protein, 17 aa, Entamoeba invadens
MEKVKLPSTLQIASNFC

SEQ ID NO: 3008588 - protein, 18 aa, Entamoeba invadens
MELIKLYEQIKELDEKKF

SEQ ID NO: 3008589 - protein, 17 aa, Entamoeba invadens
MELKQKLKYNAFKSDVW

SEQ ID NO: 3008590 - protein, 20 aa, Entamoeba invadens
MEMELCCQLKKWAETLGGEE

SEQ ID NO: 3008591 - protein, 27 aa, Entamoeba invadens
MEMNSEEMIFLTLLRLDAVNEFSKFPY

SEQ ID NO: 3008592 - protein, 25 aa, Entamoeba invadens
MENTFNACIAMYLSNPKKVMKTFTS

SEQ ID NO: 3008593 - protein, 23 aa, Entamoeba invadens
MENTLKTKWFPPKVRKIRLSSNE

SEQ ID NO: 3008594 - protein, 17 aa, Entamoeba invadens
MENVLMVWALRHPACGY

SEQ ID NO: 3008595 - protein, 20 aa, Entamoeba invadens
MEQIIVLGATNRPFDLDDAI

SEQ ID NO: 3008596 - protein, 19 aa, Entamoeba invadens
MEQKKLWTTAFRRVQPLFM

SEQ ID NO: 3008597 - protein, 17 aa, Entamoeba invadens
MEQKNIVSLVFSKFKYP

SEQ ID NO: 3008598 - protein, 18 aa, Entamoeba invadens
MEQLWHRVFYNELEIKPE

SEQ ID NO: 3008599 - protein, 20 aa, Entamoeba invadens
MEQVLKHPFILMCKTHKYGL

SEQ ID NO: 3008600 - protein, 17 aa, Entamoeba invadens
MERFHFNPIPLNMNMIK

SEQ ID NO: 3008601 - protein, 23 aa, Entamoeba invadens
MERHITLQNLFSGKLSAIVVPLQ

SEQ ID NO: 3008602 - protein, 18 aa, Entamoeba invadens
MERTDLSKLGLYFDKDTT

SEQ ID NO: 3008603 - protein, 24 aa, Entamoeba invadens
MESCKLYHNVLAAADLFKGKMQII

SEQ ID NO: 3008604 - protein, 24 aa, Entamoeba invadens
MESIIKNMYDFFYTDVRATISFYD

SEQ ID NO: 3008605 - protein, 26 aa, Entamoeba invadens
MESKRALYFNILKNTLDLLNIKNKGY

SEQ ID NO: 3008606 - protein, 19 aa, Entamoeba invadens
METFKQWISKAVKIVSDFI

SEQ ID NO: 3008607 - protein, 22 aa, Entamoeba invadens
METKFKNIWEQHADHPLLARDL

SEQ ID NO: 3008608 - protein, 24 aa, Entamoeba invadens
METLLIRLFERLVVPLSQPIDRWV

SEQ ID NO: 3008609 - protein, 29 aa, Entamoeba invadens
MEVKCNNVFYTYYLSEFFTYNYSPQLVVT

SEQ ID NO: 3008610 - protein, 18 aa, Entamoeba invadens
MEVKKEFLMLKKQCERKA

SEQ ID NO: 3008611 - protein, 27 aa, Entamoeba invadens
MEVKNDALLFIQLLGGLYPVELSKVAE

SEQ ID NO: 3008612 - protein, 37 aa, Entamoeba invadens
MEVKRYGLECPGLWLKNLVIKFMLSKLGYTDERERME

SEQ ID NO: 3008613 - protein, 20 aa, Entamoeba invadens
MEVLKILFVESYSLHCKETN

SEQ ID NO: 3008614 - protein, 20 aa, Entamoeba invadens
MEVMRSYYQPPLVKVNIPET

SEQ ID NO: 3008615 - protein, 33 aa, Entamoeba invadens
MEVTTEDYLLYYLFQFTLSLVHDIYGGNGPIST

SEQ ID NO: 3008616 - protein, 22 aa, Entamoeba invadens
MEWCKLHNHQYFETSALNASNV

SEQ ID NO: 3008617 - protein, 18 aa, Entamoeba invadens
MEWIYDRNNAFFHIGLLL

SEQ ID NO: 3008618 - protein, 35 aa, Entamoeba invadens
MEYDQLRALSYPQTDIFLICFSVVSPPSFDNVSTK

SEQ ID NO: 3008619 - protein, 27 aa, Entamoeba invadens
MEYLKINNMLFNCHSPFVLDLKVGTQT

SEQ ID NO: 3008620 - protein, 17 aa, Entamoeba invadens
MEYLQNILSLYSMNDKL

SEQ ID NO: 3008621 - protein, 21 aa, Entamoeba invadens
MFCNTELFHLLMDELLNEQEG

SEQ ID NO: 3008622 - protein, 27 aa, Entamoeba invadens
MFDDSHIILDNALLLIMDLHCRLINHP

SEQ ID NO: 3008623 - protein, 26 aa, Entamoeba invadens
MFECFKWGEIYPKKDFQFAWSIADFI

SEQ ID NO: 3008624 - protein, 26 aa, Entamoeba invadens
MFECFKWGEIYPKKDFQFAWSIADFV

SEQ ID NO: 3008625 - protein, 28 aa, Entamoeba invadens
MFECITWSYAYSKDKFKFPWSIAEFVIK

SEQ ID NO: 3008626 - protein, 35 aa, Entamoeba invadens
MFECLNWVHAYPKQKFKFPWTIAEYVIRGNRLPKP

SEQ ID NO: 3008627 - protein, 32 aa, Entamoeba invadens
MFEEFEVKGLYIGLQPLLTLYNAGRTTGTVLE

SEQ ID NO: 3008628 - protein, 28 aa, Entamoeba invadens
MFESILEEFPKRYDLWNVYLDMESRVGE

SEQ ID NO: 3008629 - protein, 26 aa, Entamoeba invadens
MFEVFGWCEAYPKEMFKFPWNIAEMV

SEQ ID NO: 3008630 - protein, 20 aa, Entamoeba invadens
MFFECKSLCQISLSQNCKEI

SEQ ID NO: 3008631 - protein, 35 aa, Entamoeba invadens
MFFRNEHLLFLEMISLFNTIIVNLRRYTSAVYSLQ

SEQ ID NO: 3008632 - protein, 19 aa, Entamoeba invadens
MFGAPDWFNKLIGQFWNGN

SEQ ID NO: 3008633 - protein, 25 aa, Entamoeba invadens
MFGKCLLRYYQFELSVNVFEDVISD

SEQ ID NO: 3008634 - protein, 26 aa, Entamoeba invadens
MFGKGNIFYKVKLPKKIFNVNESFMY

SEQ ID NO: 3008635 - protein, 28 aa, Entamoeba invadens
MFGNTTPVPAFYKFLDLLADKVTLQGFD

SEQ ID NO: 3008636 - protein, 31 aa, Entamoeba invadens
MFHYNPICLRSHFKFFPNVETYYIYKKNDKV

SEQ ID NO: 3008637 - protein, 21 aa, Entamoeba invadens
MFIDLCILLGCDYCETIKGIG

SEQ ID NO: 3008638 - protein, 19 aa, Entamoeba invadens
MFKALEYLIIEKNILHRDL

SEQ ID NO: 3008639 - protein, 28 aa, Entamoeba invadens
MFKKRWKKRYLVWKNSYIIFFDKNSQNE

SEQ ID NO: 3008640 - protein, 18 aa, Entamoeba invadens
MFKNPREALVKRLHDKIE

SEQ ID NO: 3008641 - protein, 17 aa, Entamoeba invadens
MFKRVYQWESESDLNVV

SEQ ID NO: 3008642 - protein, 24 aa, Entamoeba invadens
MFKWVYNRIVMVKLGIRIERTYGR

SEQ ID NO: 3008643 - protein, 26 aa, Entamoeba invadens
MFNGKPLYPFMCRTAGLSYLGALHIV

SEQ ID NO: 3008644 - protein, 20 aa, Entamoeba invadens
MFNLLKNYGVLFKTAAFVYV

SEQ ID NO: 3008645 - protein, 19 aa, Entamoeba invadens
MFNVIKYFHTFTDMCNSIL

SEQ ID NO: 3008646 - protein, 25 aa, Entamoeba invadens
MFPGILDFLKEYRSLGGIIIVCTHG

SEQ ID NO: 3008647 - protein, 19 aa, Entamoeba invadens
MFPYYEMMIPLSHNIKYML

SEQ ID NO: 3008648 - protein, 24 aa, Entamoeba invadens
MFQDPSHLFMIKVCDTTFAFNMEE

SEQ ID NO: 3008649 - protein, 17 aa, Entamoeba invadens
MFQLCQNVHISTLDISN

SEQ ID NO: 3008650 - protein, 17 aa, Entamoeba invadens
MFQPGTGIELRGKTLGL

SEQ ID NO: 3008651 - protein, 21 aa, Entamoeba invadens
MFQTALHEAIPYLSEAMGIPL

SEQ ID NO: 3008652 - protein, 18 aa, Entamoeba invadens
MFRYPWEVVNFITGGRRL

SEQ ID NO: 3008653 - protein, 19 aa, Entamoeba invadens
MFRYPWEVVNFITGGRRLD

SEQ ID NO: 3008654 - protein, 26 aa, Entamoeba invadens
MFTELNFKVILFYTANYTTADPQFAK

SEQ ID NO: 3008655 - protein, 19 aa, Entamoeba invadens
MFYDKYPLQVGNDGTVLVF

SEQ ID NO: 3008656 - protein, 18 aa, Entamoeba invadens
MGALKLTEWCTVDSVVII

SEQ ID NO: 3008657 - protein, 24 aa, Entamoeba invadens
MGAPDFVFTGLKNFTPKKVLIVQM

SEQ ID NO: 3008658 - protein, 18 aa, Entamoeba invadens
MGAYPPPMGGAYPPPMGA

SEQ ID NO: 3008659 - protein, 32 aa, Entamoeba invadens
MGCCIDLLAPLFTFVGYQLDLLMNIKAKIVFG

SEQ ID NO: 3008660 - protein, 20 aa, Entamoeba invadens
MGCLTCDIGYYTDGQICFEC

SEQ ID NO: 3008661 - protein, 26 aa, Entamoeba invadens
MGDAGLVQWLIKLSDFTIFARKEMAV

SEQ ID NO: 3008662 - protein, 23 aa, Entamoeba invadens
MGDELFLLFQNKIGCYDFDTKNS

SEQ ID NO: 3008663 - protein, 17 aa, Entamoeba invadens
MGDVMFEKFGFNRVYVA

SEQ ID NO: 3008664 - protein, 24 aa, Entamoeba invadens
MGEGCFYGCKVLTKIVIPNKMKII

SEQ ID NO: 3008665 - protein, 17 aa, Entamoeba invadens
MGETILKNYKFPVTFLI

SEQ ID NO: 3008666 - protein, 23 aa, Entamoeba invadens
MGFYDTCVKFGLFPTFEMVNREI

SEQ ID NO: 3008667 - protein, 21 aa, Entamoeba invadens
MGGFIKRFPSFFKQDNTILTH

SEQ ID NO: 3008668 - protein, 19 aa, Entamoeba invadens
MGGRRNLILLSKVLQNLSN

SEQ ID NO: 3008669 - protein, 24 aa, Entamoeba invadens
MGGVAYLRSPPGKFFFDFFGENML

SEQ ID NO: 3008670 - protein, 21 aa, Entamoeba invadens
MGGVAYLRSPPGKFFYDFYGE

SEQ ID NO: 3008671 - protein, 17 aa, Entamoeba invadens
MGHLFPTVSIIDKTFQA

SEQ ID NO: 3008672 - protein, 17 aa, Entamoeba invadens
MGIIGIKVNIMLNTDPT

SEQ ID NO: 3008673 - protein, 26 aa, Entamoeba invadens
MGINWVKTMFNMIDPALILTAITEFL

SEQ ID NO: 3008674 - protein, 17 aa, Entamoeba invadens
MGKAAFKVYLDYFGFRA

SEQ ID NO: 3008675 - protein, 26 aa, Entamoeba invadens
MGKCKFRNFLLKALELEIRRGDLLLG

SEQ ID NO: 3008676 - protein, 27 aa, Entamoeba invadens
MGKDRVVNVIKYPLSPMKHTKIPKAAG

SEQ ID NO: 3008677 - protein, 32 aa, Entamoeba invadens
MGKLKELKVPVLFEIPFRELRFNGTIKRNTAT

SEQ ID NO: 3008678 - protein, 26 aa, Entamoeba invadens
MGKTAVFVITILNQGLFIGKKGVSTL

SEQ ID NO: 3008679 - protein, 24 aa, Entamoeba invadens
MGKVLGGILKRTKLKRCKVVALCG

SEQ ID NO: 3008680 - protein, 17 aa, Entamoeba invadens
MGLAVDWRRSFITTDHN

SEQ ID NO: 3008681 - protein, 25 aa, Entamoeba invadens
MGLGKTLMVLSFLEGLHSTLYAKCT

SEQ ID NO: 3008682 - protein, 24 aa, Entamoeba invadens
MGLHPTIIVDGYRAGLKYFVEHTD

SEQ ID NO: 3008683 - protein, 24 aa, Entamoeba invadens
MGLNPPVIPILVLQSLYKETTHPE

SEQ ID NO: 3008684 - protein, 18 aa, Entamoeba invadens
MGLPFFSNQIVMNPSFHQ

SEQ ID NO: 3008685 - protein, 18 aa, Entamoeba invadens
MGLTKATHFLKENYPAVF

SEQ ID NO: 3008686 - protein, 22 aa, Entamoeba invadens
MGMLRQVNFQMAMNPAFMGQMQ

SEQ ID NO: 3008687 - protein, 18 aa, Entamoeba invadens
MGMLYNDEKMKKIFPSFG

SEQ ID NO: 3008688 - protein, 27 aa, Entamoeba invadens
MGNVNFGCFGISKLSLRKNVCLNLSNE

SEQ ID NO: 3008689 - protein, 25 aa, Entamoeba invadens
MGNYRGNFVAIKKMKQIASPNTLTN

SEQ ID NO: 3008690 - protein, 28 aa, Entamoeba invadens
MGPPVWTKYGHFISVNSFDGDYVWAHDP

SEQ ID NO: 3008691 - protein, 29 aa, Entamoeba invadens
MGQHYCGVCDKYFLTRAIYLKHCTQTPHK

SEQ ID NO: 3008692 - protein, 31 aa, Entamoeba invadens
MGQQMRGYQQPPLPPPQFPCVYHIPSYDEFP

SEQ ID NO: 3008693 - protein, 27 aa, Entamoeba invadens
MGSLGNFNLPIFNIAPASEQTPTTKPL

SEQ ID NO: 3008694 - protein, 30 aa, Entamoeba invadens
MGTEYMVNRLNLLLLQHIQKCLPGLRQQIN

SEQ ID NO: 3008695 - protein, 22 aa, Entamoeba invadens
MGTNCFIICFSLVDKKSYQEVG

SEQ ID NO: 3008696 - protein, 26 aa, Entamoeba invadens
MGTRTAFEAYLPVYKIEIVSVADRKA

SEQ ID NO: 3008697 - protein, 21 aa, Entamoeba invadens
MGVRFFLCCYSDGRCYFIDEN

SEQ ID NO: 3008698 - protein, 25 aa, Entamoeba invadens
MGYLDMYPRIIFSNNFVSILTNTDY

SEQ ID NO: 3008699 - protein, 17 aa, Entamoeba invadens
MGYPVIMKILSPDIMHK

SEQ ID NO: 3008700 - protein, 17 aa, Entamoeba invadens
MGYYTMLSLFSIGSRRG

SEQ ID NO: 3008701 - protein, 19 aa, Entamoeba invadens
MHDYFMYYNHICIVTEMLG

SEQ ID NO: 3008702 - protein, 23 aa, Entamoeba invadens
MHERNSEFGSFKKSLELNYSKAE

SEQ ID NO: 3008703 - protein, 40 aa, Entamoeba invadens
MHEVTEFLIINNVQYILGLDPYFTIPHFDINIKVSAITFT

SEQ ID NO: 3008704 - protein, 17 aa, Entamoeba invadens
MHFPKHQLVSKEITYFF

SEQ ID NO: 3008705 - protein, 22 aa, Entamoeba invadens
MHKENVFVILNDTFGNVFGGFA

SEQ ID NO: 3008706 - protein, 26 aa, Entamoeba invadens
MHKTVLVVVLTLCKWMAAFPHDFLDQ

SEQ ID NO: 3008707 - protein, 17 aa, Entamoeba invadens
MHLMLKQSVPTMTVDVD

SEQ ID NO: 3008708 - protein, 20 aa, Entamoeba invadens
MHNQWDFSFSSLVSLSLYQC

SEQ ID NO: 3008709 - protein, 25 aa, Entamoeba invadens
MHPAISKFSNEFFYRGKLNDGVTAN

SEQ ID NO: 3008710 - protein, 23 aa, Entamoeba invadens
MHQQTFFQILVPQPDIQLLIEKS

SEQ ID NO: 3008711 - protein, 26 aa, Entamoeba invadens
MHSKYPKEEIITIILGNLFLTTCQYN

SEQ ID NO: 3008712 - protein, 23 aa, Entamoeba invadens
MHSPKDWHEGIVGVLNSFDKDDS

SEQ ID NO: 3008713 - protein, 25 aa, Entamoeba invadens
MIARADVMSLVRALGYAPSPEEEDQ

SEQ ID NO: 3008714 - protein, 19 aa, Entamoeba invadens
MICDQWEDLKYSKKNKKLE

SEQ ID NO: 3008715 - protein, 17 aa, Entamoeba invadens
MIDLTTFPVLKRLVLTF

SEQ ID NO: 3008716 - protein, 21 aa, Entamoeba invadens
MIEICRGCVGIIFKATYKGRT

SEQ ID NO: 3008717 - protein, 17 aa, Entamoeba invadens
MIEIYKYIMRDRQEDCK

SEQ ID NO: 3008718 - protein, 27 aa, Entamoeba invadens
MIEKPTQLCYIFLFNDMLVQTKVVKMN

SEQ ID NO: 3008719 - protein, 27 aa, Entamoeba invadens
MIEPLSLLTQLILIDVTLPTPIIVDDF

SEQ ID NO: 3008720 - protein, 27 aa, Entamoeba invadens
MIEYSLMELFLKKFDLTNTLLPDIFMY

SEQ ID NO: 3008721 - protein, 33 aa, Entamoeba invadens
MIFESSQVRYLNRFPFIVYVNTNGTALWRAAAV

SEQ ID NO: 3008722 - protein, 21 aa, Entamoeba invadens
MIGARVPIIKCYIDRVSVDIS

SEQ ID NO: 3008723 - protein, 27 aa, Entamoeba invadens
MIHDLVFLQRIQTSIIFINMRPIEVDV

SEQ ID NO: 3008724 - protein, 44 aa, Entamoeba invadens
MIHMHLLASFAYRLMLLQKYPYPLFLFLHGMSCLLQSYPSMFEF

SEQ ID NO: 3008725 - protein, 19 aa, Entamoeba invadens
MIHWGTLRPYDKMYDGIEL

SEQ ID NO: 3008726 - protein, 18 aa, Entamoeba invadens
MIIISQHFKNITDFINVE

SEQ ID NO: 3008727 - protein, 17 aa, Entamoeba invadens
MIIVFPEEDRPFGCYLE

SEQ ID NO: 3008728 - protein, 24 aa, Entamoeba invadens
MIKKALIQALPEFASFDASQFAPK

SEQ ID NO: 3008729 - protein, 19 aa, Entamoeba invadens
MIKKQKDFIAWTKKLERET

SEQ ID NO: 3008730 - protein, 29 aa, Entamoeba invadens
MIKNPKYGRNALLFNLVFVFSRDTSDSTI

SEQ ID NO: 3008731 - protein, 19 aa, Entamoeba invadens
MIKTQFLGVFEGSLKLYEA

SEQ ID NO: 3008732 - protein, 29 aa, Entamoeba invadens
MIKTRCVLQFYIPSFRKLGFGGIKKRITI

SEQ ID NO: 3008733 - protein, 18 aa, Entamoeba invadens
MILRIKMMLDASSGILYL

SEQ ID NO: 3008734 - protein, 18 aa, Entamoeba invadens
MILSFEKLSHRIFAVEYF

SEQ ID NO: 3008735 - protein, 18 aa, Entamoeba invadens
MIMTLDGYLDTASWMPCI

SEQ ID NO: 3008736 - protein, 23 aa, Entamoeba invadens
MINGIVFFYTIEGPSLIIKVPPA

SEQ ID NO: 3008737 - protein, 18 aa, Entamoeba invadens
MINNIFLPNTITKLELSK

SEQ ID NO: 3008738 - protein, 17 aa, Entamoeba invadens
MINSMWDFKPKNEFYAT

SEQ ID NO: 3008739 - protein, 30 aa, Entamoeba invadens
MINTLRSNIWRILLKVKPIKLPNPLHLTVV

SEQ ID NO: 3008740 - protein, 26 aa, Entamoeba invadens
MIQAKLSIIPVRRGYWGATIGTVHTV

SEQ ID NO: 3008741 - protein, 19 aa, Entamoeba invadens
MIQDLYVKFMFQIHRKISG

SEQ ID NO: 3008742 - protein, 18 aa, Entamoeba invadens
MIQQWGNKFPNELAEYDF

SEQ ID NO: 3008743 - protein, 26 aa, Entamoeba invadens
MIREIAFKNFLQLALKCLEIRNFNSF

SEQ ID NO: 3008744 - protein, 18 aa, Entamoeba invadens
MIRPIVQASKYEAYLKVL

SEQ ID NO: 3008745 - protein, 17 aa, Entamoeba invadens
MISFNVVAMLLHYGVPP

SEQ ID NO: 3008746 - protein, 25 aa, Entamoeba invadens
MISFYLITPIQRIPRYELLIRDMLK

SEQ ID NO: 3008747 - protein, 34 aa, Entamoeba invadens
MISFYLITPIQRIPRYELLIRDMLRDVGKDFPDL

SEQ ID NO: 3008748 - protein, 30 aa, Entamoeba invadens
MISSQFMTLPSIYIPVLMNGKVIGKVAPHD

SEQ ID NO: 3008749 - protein, 22 aa, Entamoeba invadens
MITNVAIPLTKIGDFDLEGWDF

SEQ ID NO: 3008750 - protein, 25 aa, Entamoeba invadens
MIVGDMFLVLSRRFYIVDTPPDNVS

SEQ ID NO: 3008751 - protein, 17 aa, Entamoeba invadens
MIVSKYFETIKDFVNLE

SEQ ID NO: 3008752 - protein, 17 aa, Entamoeba invadens
MIVSKYFKTIEDFKVIT

SEQ ID NO: 3008753 - protein, 21 aa, Entamoeba invadens
MIVSKYFLIPNDFLNLICVCK

SEQ ID NO: 3008754 - protein, 17 aa, Entamoeba invadens
MIVSKYFTSIDQFIAVE

SEQ ID NO: 3008755 - protein, 27 aa, Entamoeba invadens
MIYKNCDCFVFIYSILSIDSFNELESF

SEQ ID NO: 3008756 - protein, 18 aa, Entamoeba invadens
MKALFYQYFTTYTEELMK

SEQ ID NO: 3008757 - protein, 18 aa, Entamoeba invadens
MKCFDNRLCISLALKMIN

SEQ ID NO: 3008758 - protein, 22 aa, Entamoeba invadens
MKCFMSFMEDPFWRVRLQIASS

SEQ ID NO: 3008759 - protein, 29 aa, Entamoeba invadens
MKDLEELVSYLKMVCKMVNLDWEVGRKKF

SEQ ID NO: 3008760 - protein, 17 aa, Entamoeba invadens
MKDSIINKLFTLPKETI

SEQ ID NO: 3008761 - protein, 23 aa, Entamoeba invadens
MKEDGHFLLKCVSHFMTPAPFFN

SEQ ID NO: 3008762 - protein, 20 aa, Entamoeba invadens
MKEFKPAFPDLTKGVFSKVV

SEQ ID NO: 3008763 - protein, 17 aa, Entamoeba invadens
MKEFLVVKLNEWYKNKS

SEQ ID NO: 3008764 - protein, 19 aa, Entamoeba invadens
MKEIPLMFHFNPVQVDHKT

SEQ ID NO: 3008765 - protein, 22 aa, Entamoeba invadens
MKEIRIMKLFHHPNICSFFDYF

SEQ ID NO: 3008766 - protein, 18 aa, Entamoeba invadens
MKEKYTFTLLADTGRSVD

SEQ ID NO: 3008767 - protein, 29 aa, Entamoeba invadens
MKEQDLKSDVFAFGASFTTEKEHTPTMTP

SEQ ID NO: 3008768 - protein, 25 aa, Entamoeba invadens
MKEQRFLHNKLLFGALDLLEAQTVA

SEQ ID NO: 3008769 - protein, 26 aa, Entamoeba invadens
MKESYDPVFGYPNFVRFGWETSKRIV

SEQ ID NO: 3008770 - protein, 29 aa, Entamoeba invadens
MKEVKATTLCLWILKSLKQLNPDQEFFSF

SEQ ID NO: 3008771 - protein, 21 aa, Entamoeba invadens
MKEVRREKEMIGMQLEEAKNE

SEQ ID NO: 3008772 - protein, 20 aa, Entamoeba invadens
MKEWVCVLCGEENKLFQVGT

SEQ ID NO: 3008773 - protein, 18 aa, Entamoeba invadens
MKFAISLRDLITLSPKNT

SEQ ID NO: 3008774 - protein, 31 aa, Entamoeba invadens
MKFDLCTWEFFHIDFGYLFNSRPNFDANLFA

SEQ ID NO: 3008775 - protein, 21 aa, Entamoeba invadens
MKFDQILYNSLPRELEIILRG

SEQ ID NO: 3008776 - protein, 18 aa, Entamoeba invadens
MKFFEVSTLLPTQVKEYI

SEQ ID NO: 3008777 - protein, 20 aa, Entamoeba invadens
MKFGMVLWDTVFETIAMEYP

SEQ ID NO: 3008778 - protein, 24 aa, Entamoeba invadens
MKFHFNPIPLNKKNISYFLNIETL

SEQ ID NO: 3008779 - protein, 21 aa, Entamoeba invadens
MKFKQFDILSHKILNVLFEVD

SEQ ID NO: 3008780 - protein, 30 aa, Entamoeba invadens
MKFLMEKYQIHYWIYGHTHSNFKDFEYHGC

SEQ ID NO: 3008781 - protein, 18 aa, Entamoeba invadens
MKGILNVMVYMDTMNRVR

SEQ ID NO: 3008782 - protein, 36 aa, Entamoeba invadens
MKGLGLYDVNLLSEAFLIYLRALGQLFTMSIFMVND

SEQ ID NO: 3008783 - protein, 30 aa, Entamoeba invadens
MKGNVPLLQFLFMSKPPFKFNRRASLIIND

SEQ ID NO: 3008784 - protein, 25 aa, Entamoeba invadens
MKGSELYELFLQGKLLLHECTVKSQ

SEQ ID NO: 3008785 - protein, 24 aa, Entamoeba invadens
MKGVILLRSIIIKAVPIQVIPAVF

SEQ ID NO: 3008786 - protein, 23 aa, Entamoeba invadens
MKHIGRIGFVIMRLLLSMQHPPQ

SEQ ID NO: 3008787 - protein, 24 aa, Entamoeba invadens
MKHLGVLLSGYFLYHKNAMAKVNG

SEQ ID NO: 3008788 - protein, 18 aa, Entamoeba invadens
MKIEDDCVRMLNSAYRKW

SEQ ID NO: 3008789 - protein, 17 aa, Entamoeba invadens
MKIKNKPENLRKHLKSC

SEQ ID NO: 3008790 - protein, 31 aa, Entamoeba invadens
MKKAKVFFEQLFRMPFYLPANGDVVTLGLAP

SEQ ID NO: 3008791 - protein, 17 aa, Entamoeba invadens
MKKAVVNGPMTWPGALS

SEQ ID NO: 3008792 - protein, 24 aa, Entamoeba invadens
MKKCRNIFFQSKSKYFRKITIFDC

SEQ ID NO: 3008793 - protein, 24 aa, Entamoeba invadens
MKKGKVLIQLDISFFGSIDNVFDM

SEQ ID NO: 3008794 - protein, 21 aa, Entamoeba invadens
MKKMPLTKWKLKNCGDNLLFM

SEQ ID NO: 3008795 - protein, 27 aa, Entamoeba invadens
MKKQKVLDFGRLPWKRIQIENENKGTY

SEQ ID NO: 3008796 - protein, 18 aa, Entamoeba invadens
MKKQPSVETLLKELFRIA

SEQ ID NO: 3008797 - protein, 18 aa, Entamoeba invadens
MKKSNPIPVIFMKNTQQK

SEQ ID NO: 3008798 - protein, 24 aa, Entamoeba invadens
MKKTDFINWKLDNGPLKAAIMRKY

SEQ ID NO: 3008799 - protein, 23 aa, Entamoeba invadens
MKKTFKYCYQLSSIDIPKSVIKI

SEQ ID NO: 3008800 - protein, 24 aa, Entamoeba invadens
MKKTKTFLYSPEPSFWVSYTISAN

SEQ ID NO: 3008801 - protein, 23 aa, Entamoeba invadens
MKKTSVALQFLKIESLKKGNDCV

SEQ ID NO: 3008802 - protein, 20 aa, Entamoeba invadens
MKLLLALCNAVDLKKKIEAE

SEQ ID NO: 3008803 - protein, 17 aa, Entamoeba invadens
MKLNYHKKRIVLKDSYS

SEQ ID NO: 3008804 - protein, 23 aa, Entamoeba invadens
MKLRVKMMLDCFKGILYLHSNDI

SEQ ID NO: 3008805 - protein, 30 aa, Entamoeba invadens
MKMENRNWMKEILQEAYKYSCDERPKYRIK

SEQ ID NO: 3008806 - protein, 19 aa, Entamoeba invadens
MKMNPHFKMPTRPFKRMTY

SEQ ID NO: 3008807 - protein, 27 aa, Entamoeba invadens
MKNDAFSQFLFFLKSLGVSLANGIIQT

SEQ ID NO: 3008808 - protein, 17 aa, Entamoeba invadens
MKNEFMSLWDGIKSKDM

SEQ ID NO: 3008809 - protein, 26 aa, Entamoeba invadens
MKNIENLLDLYKAWARSVRPGIPFEE

SEQ ID NO: 3008810 - protein, 20 aa, Entamoeba invadens
MKNIILYLNTLEDVTNFMLI

SEQ ID NO: 3008811 - protein, 22 aa, Entamoeba invadens
MKNMKMLKLKSQKYFYVFGKEM

SEQ ID NO: 3008812 - protein, 18 aa, Entamoeba invadens
MKNSNITNVLRITQIILN

SEQ ID NO: 3008813 - protein, 18 aa, Entamoeba invadens
MKNVILYFDTLEDVTNFM

SEQ ID NO: 3008814 - protein, 27 aa, Entamoeba invadens
MKQIHSLYNMKYSLLTLGDKGSYVLYN

SEQ ID NO: 3008815 - protein, 23 aa, Entamoeba invadens
MKQQPLMQQCGMPQMVGVQPQPA

SEQ ID NO: 3008816 - protein, 18 aa, Entamoeba invadens
MKQRLHFSYFPPNGDMNN

SEQ ID NO: 3008817 - protein, 26 aa, Entamoeba invadens
MKQTLRYTDLLMRIGFEDEGLQQYVL

SEQ ID NO: 3008818 - protein, 23 aa, Entamoeba invadens
MKREFDYFCTQMPIRGCSFLTGQ

SEQ ID NO: 3008819 - protein, 26 aa, Entamoeba invadens
MKRKEEWHPYLLFCKQHREELKQEGV

SEQ ID NO: 3008820 - protein, 24 aa, Entamoeba invadens
MKRKRPIRGVVPPKIGITQDGTPD

SEQ ID NO: 3008821 - protein, 26 aa, Entamoeba invadens
MKRPTVRECLLFPFFSGKKRERGDFY

SEQ ID NO: 3008822 - protein, 17 aa, Entamoeba invadens
MKRTIIVRRDYFHYIPK

SEQ ID NO: 3008823 - protein, 18 aa, Entamoeba invadens
MKRTIIVRRDYFHYIPKY

SEQ ID NO: 3008824 - protein, 24 aa, Entamoeba invadens
MKSAFLNNIDFWAKNYKAIVTKYD

SEQ ID NO: 3008825 - protein, 27 aa, Entamoeba invadens
MKSDIYSFGIVFWEVIYKVYTKKYAAP

SEQ ID NO: 3008826 - protein, 17 aa, Entamoeba invadens
MKSDLVWKALDKTPLVK

SEQ ID NO: 3008827 - protein, 26 aa, Entamoeba invadens
MKSGKLFQEFFLKKLINAERMMMHST

SEQ ID NO: 3008828 - protein, 23 aa, Entamoeba invadens
MKSLGAPEWFIQMVKNMVDSNPA

SEQ ID NO: 3008829 - protein, 23 aa, Entamoeba invadens
MKSQQAWLIDTFGINVNLGNIAP

SEQ ID NO: 3008830 - protein, 27 aa, Entamoeba invadens
MKSSAYLEYLFRPTGFKEFVGPEDKDK

SEQ ID NO: 3008831 - protein, 27 aa, Entamoeba invadens
MKSYVYNTKIKQPLFPVACDGLGRIID

SEQ ID NO: 3008832 - protein, 21 aa, Entamoeba invadens
MKTHPFFQGLDFDRLLKLEVV

SEQ ID NO: 3008833 - protein, 27 aa, Entamoeba invadens
MKTIEKNIFALYFSQIPFKEQDDFVND

SEQ ID NO: 3008834 - protein, 24 aa, Entamoeba invadens
MKTPLYYSVYYIIKNNNVPFINPM

SEQ ID NO: 3008835 - protein, 24 aa, Entamoeba invadens
MKTTRLSILILRSLHCLNPQKDFF

SEQ ID NO: 3008836 - protein, 17 aa, Entamoeba invadens
MKTWIKLEEFDVLQLPR

SEQ ID NO: 3008837 - protein, 21 aa, Entamoeba invadens
MKVALALYPVSMKQIMDIADS

SEQ ID NO: 3008838 - protein, 28 aa, Entamoeba invadens
MKVHKTEGFFPYRIPPRTIYGGQNIDDA

SEQ ID NO: 3008839 - protein, 30 aa, Entamoeba invadens
MKVPGRIWPVMINPVCIIIASYEPIEVVFN

SEQ ID NO: 3008840 - protein, 27 aa, Entamoeba invadens
MKVQVTFSKWYVALQTNNWIGFEENFG

SEQ ID NO: 3008841 - protein, 17 aa, Entamoeba invadens
MKYIHMNLEFSDVFWRK

SEQ ID NO: 3008842 - protein, 26 aa, Entamoeba invadens
MKYTDKTVLILPEDYKKYGKGCDATF

SEQ ID NO: 3008843 - protein, 26 aa, Entamoeba invadens
MLADGLFDFLIELFMITTDDNTRAVL

SEQ ID NO: 3008844 - protein, 19 aa, Entamoeba invadens
MLCEFLLEKSTQPTLTEIL

SEQ ID NO: 3008845 - protein, 28 aa, Entamoeba invadens
MLCNDDVPVMLFISLFRNKEIELKRVEA

SEQ ID NO: 3008846 - protein, 32 aa, Entamoeba invadens
MLDAIDFLKYVKKVSYMLFMDCINIKNINLNH

SEQ ID NO: 3008847 - protein, 19 aa, Entamoeba invadens
MLDALEAKLNHTLSREKKA

SEQ ID NO: 3008848 - protein, 25 aa, Entamoeba invadens
MLDCLFSIWRVLLDCLSKLDHLVLP

SEQ ID NO: 3008849 - protein, 17 aa, Entamoeba invadens
MLDFIKRGMKHLGVLLS

SEQ ID NO: 3008850 - protein, 17 aa, Entamoeba invadens
MLDIMNAKYGDKLRALI

SEQ ID NO: 3008851 - protein, 26 aa, Entamoeba invadens
MLDNDCFYMCFKLKQITLPDTIRFIG

SEQ ID NO: 3008852 - protein, 20 aa, Entamoeba invadens
MLDVCQPIKGLIAAIADKMS

SEQ ID NO: 3008853 - protein, 25 aa, Entamoeba invadens
MLDVYQYVLTQYPSSSIYLIGNVEG

SEQ ID NO: 3008854 - protein, 18 aa, Entamoeba invadens
MLEAFQKGTAACYPLGGY

SEQ ID NO: 3008855 - protein, 25 aa, Entamoeba invadens
MLEKLWDDNFWDAKAKKWKHTPKGD

SEQ ID NO: 3008856 - protein, 19 aa, Entamoeba invadens
MLEKPNVISFYTLQPSEPF

SEQ ID NO: 3008857 - protein, 17 aa, Entamoeba invadens
MLELINQLDGFDKRGNI

SEQ ID NO: 3008858 - protein, 28 aa, Entamoeba invadens
MLENYKKEFNLHPFYFVLDYPEDGAKIL

SEQ ID NO: 3008859 - protein, 19 aa, Entamoeba invadens
MLERIIPKALLAYLDSTDE

SEQ ID NO: 3008860 - protein, 17 aa, Entamoeba invadens
MLERKRFVGNDVVVVVF

SEQ ID NO: 3008861 - protein, 28 aa, Entamoeba invadens
MLESHKNLYVFLVKFISNLILKGVDKNR

SEQ ID NO: 3008862 - protein, 19 aa, Entamoeba invadens
MLESSGTFFFNAIDYTVQG

SEQ ID NO: 3008863 - protein, 19 aa, Entamoeba invadens
MLEVIILRRIIEHNPKFIE

SEQ ID NO: 3008864 - protein, 26 aa, Entamoeba invadens
MLEVMHSDWWFPFYSKDEAAAQLEST

SEQ ID NO: 3008865 - protein, 22 aa, Entamoeba invadens
MLFPREKKVPVPKPPTKWELFA

SEQ ID NO: 3008866 - protein, 25 aa, Entamoeba invadens
MLGSLIVLNSLFLTGNPICSIQNYR

SEQ ID NO: 3008867 - protein, 18 aa, Entamoeba invadens
MLGVIGLKALCMILMRML

SEQ ID NO: 3008868 - protein, 30 aa, Entamoeba invadens
MLHINPPRVLRYIPFLRKYIPNLETYEGNI

SEQ ID NO: 3008869 - protein, 28 aa, Entamoeba invadens
MLHVETVFLIWVFLREVKRVPDLRAEQI

SEQ ID NO: 3008870 - protein, 20 aa, Entamoeba invadens
MLHVGHYELFRIAKDMGKHL

SEQ ID NO: 3008871 - protein, 17 aa, Entamoeba invadens
MLIALLDGHTTWLNEEA

SEQ ID NO: 3008872 - protein, 17 aa, Entamoeba invadens
MLILERPQDKQADIITQ

SEQ ID NO: 3008873 - protein, 19 aa, Entamoeba invadens
MLISRRQKGKLFQRKETGK

SEQ ID NO: 3008874 - protein, 25 aa, Entamoeba invadens
MLITEGFFKTFTFLFEKITDKAQSE

SEQ ID NO: 3008875 - protein, 21 aa, Entamoeba invadens
MLKFINYVTKNAKLLLRIWNA

SEQ ID NO: 3008876 - protein, 20 aa, Entamoeba invadens
MLKILCQWFCRKRKSSDYNQ

SEQ ID NO: 3008877 - protein, 18 aa, Entamoeba invadens
MLKISEIVKQFDKENSGK

SEQ ID NO: 3008878 - protein, 17 aa, Entamoeba invadens
MLLDIICGILLGKSYVP

SEQ ID NO: 3008879 - protein, 26 aa, Entamoeba invadens
MLLDSICGILLGKAYIPFGAPEHLKM

SEQ ID NO: 3008880 - protein, 19 aa, Entamoeba invadens
MLLELNFEEIYGFAESFFK

SEQ ID NO: 3008881 - protein, 29 aa, Entamoeba invadens
MLLKEAQDFVFKLKSPELLEIFLTRLQEI

SEQ ID NO: 3008882 - protein, 18 aa, Entamoeba invadens
MLLKKVVFQFGDDKSLEV

SEQ ID NO: 3008883 - protein, 18 aa, Entamoeba invadens
MLLNQFFGLFLGKLDHLI

SEQ ID NO: 3008884 - protein, 20 aa, Entamoeba invadens
MLLTDKAIYFAQKQIKKKIL

SEQ ID NO: 3008885 - protein, 18 aa, Entamoeba invadens
MLLTSFSQVLLYMSEMFM

SEQ ID NO: 3008886 - protein, 19 aa, Entamoeba invadens
MLMDRYLLVKGLGKGSFGQ

SEQ ID NO: 3008887 - protein, 20 aa, Entamoeba invadens
MLMFFTQYCVKYYHKLKRGY

SEQ ID NO: 3008888 - protein, 18 aa, Entamoeba invadens
MLNALVDINFGALIFSVS

SEQ ID NO: 3008889 - protein, 25 aa, Entamoeba invadens
MLNDPKHLIVLLHIQSSNTAKTEKT

SEQ ID NO: 3008890 - protein, 17 aa, Entamoeba invadens
MLNPTSQDHWTGYRHSI

SEQ ID NO: 3008891 - protein, 20 aa, Entamoeba invadens
MLNVLSKYPLTSSHSFVLIP

SEQ ID NO: 3008892 - protein, 18 aa, Entamoeba invadens
MLNVWFFSLKEIEGVKDV

SEQ ID NO: 3008893 - protein, 27 aa, Entamoeba invadens
MLNYINWSGYIKGLFCILKTLKNMEMG

SEQ ID NO: 3008894 - protein, 26 aa, Entamoeba invadens
MLQFIVEHWYLFQKLQQFRTSPSKWK

SEQ ID NO: 3008895 - protein, 27 aa, Entamoeba invadens
MLQGMGKLCEVPWKTNTPKVDSRYRFQ

SEQ ID NO: 3008896 - protein, 19 aa, Entamoeba invadens
MLQIKLMFEHPSDPLVFTA

SEQ ID NO: 3008897 - protein, 19 aa, Entamoeba invadens
MLQKINFPSDLRFIGESAF

SEQ ID NO: 3008898 - protein, 23 aa, Entamoeba invadens
MLQLLPICMDGFFLSRKAMADVT

SEQ ID NO: 3008899 - protein, 28 aa, Entamoeba invadens
MLQLVFKTFKLLSFCEVPFVASIVKMLS

SEQ ID NO: 3008900 - protein, 27 aa, Entamoeba invadens
MLQMDNSKYLKYIYISTPQGSVKFTGL

SEQ ID NO: 3008901 - protein, 23 aa, Entamoeba invadens
MLRAKFGMYGVIEKITRIENAKG

SEQ ID NO: 3008902 - protein, 19 aa, Entamoeba invadens
MLRILPFHDDGKDDFRHIV

SEQ ID NO: 3008903 - protein, 25 aa, Entamoeba invadens
MLRKDEWLMLYDFFNNIKEDLSNYQ

SEQ ID NO: 3008904 - protein, 19 aa, Entamoeba invadens
MLSDIFSFAITMYEIINWE

SEQ ID NO: 3008905 - protein, 34 aa, Entamoeba invadens
MLSDLRIVFVVSFHSALMWWNTHFALGNSADEVV

SEQ ID NO: 3008906 - protein, 19 aa, Entamoeba invadens
MLSPEEMKMFLFDTVSKIT

SEQ ID NO: 3008907 - protein, 28 aa, Entamoeba invadens
MLSQTKSKLFELKFGRASDEETRRLRIE

SEQ ID NO: 3008908 - protein, 18 aa, Entamoeba invadens
MLSSYYNSVITSLYVPLF

SEQ ID NO: 3008909 - protein, 19 aa, Entamoeba invadens
MLSTFFALKSLTKVFIHTP

SEQ ID NO: 3008910 - protein, 17 aa, Entamoeba invadens
MLSTLITILQKQGKLNQ

SEQ ID NO: 3008911 - protein, 23 aa, Entamoeba invadens
MLTAMHYCMGYIAFYSEDYEMAK

SEQ ID NO: 3008912 - protein, 17 aa, Entamoeba invadens
MLTFFEDDKYFYIVMEY

SEQ ID NO: 3008913 - protein, 19 aa, Entamoeba invadens
MLTHLYRDWSIEGSHERSL

SEQ ID NO: 3008914 - protein, 17 aa, Entamoeba invadens
MLTLDFNTNKRVVDEFA

SEQ ID NO: 3008915 - protein, 17 aa, Entamoeba invadens
MLTLIAKLIDVTSAAVF

SEQ ID NO: 3008916 - protein, 19 aa, Entamoeba invadens
MLTLNNLTINTLSFANFPK

SEQ ID NO: 3008917 - protein, 20 aa, Entamoeba invadens
MLTQHAYMRPFGVSSMFIGW

SEQ ID NO: 3008918 - protein, 17 aa, Entamoeba invadens
MLVNLFDSKMTGSWCRI

SEQ ID NO: 3008919 - protein, 18 aa, Entamoeba invadens
MLVPFCDIVFGRPSKRTT

SEQ ID NO: 3008920 - protein, 25 aa, Entamoeba invadens
MLVSKYPRFLKHKPQILEIVLKKIF

SEQ ID NO: 3008921 - protein, 25 aa, Entamoeba invadens
MLVSMPFQHIMRYKIQINRIIETLQ

SEQ ID NO: 3008922 - protein, 19 aa, Entamoeba invadens
MLYDVLKNKKIELGTDVFV

SEQ ID NO: 3008923 - protein, 19 aa, Entamoeba invadens
MLYKFINMIGMPPRSLLDR

SEQ ID NO: 3008924 - protein, 18 aa, Entamoeba invadens
MLYLSKSTTLIRHDTPRK

SEQ ID NO: 3008925 - protein, 18 aa, Entamoeba invadens
MMCHRFHGKNPSKNKIKR

SEQ ID NO: 3008926 - protein, 18 aa, Entamoeba invadens
MMDYSPEASLLAIKRAET

SEQ ID NO: 3008927 - protein, 25 aa, Entamoeba invadens
MMEKKLPRSAYLKLQMLFENGGTLD

SEQ ID NO: 3008928 - protein, 26 aa, Entamoeba invadens
MMEKVINSYLYLMCLSRDYCVLLRFY

SEQ ID NO: 3008929 - protein, 34 aa, Entamoeba invadens
MMELKGNIRVFCRVRPIIFAPSATMYVKENSIVY

SEQ ID NO: 3008930 - protein, 29 aa, Entamoeba invadens
MMFDKHDETKKTLIFGFHPLEKNEDDIKE

SEQ ID NO: 3008931 - protein, 25 aa, Entamoeba invadens
MMGHRARVLPFSTFRMNLCDTTPYN

SEQ ID NO: 3008932 - protein, 23 aa, Entamoeba invadens
MMGTFILVLEMYPLNKYDGETME

SEQ ID NO: 3008933 - protein, 18 aa, Entamoeba invadens
MMIIGKYFESVKDFKVVM

SEQ ID NO: 3008934 - protein, 19 aa, Entamoeba invadens
MMIISKYFETFSDFVSLMF

SEQ ID NO: 3008935 - protein, 21 aa, Entamoeba invadens
MMIVAKYFLFEDDFIKMTMIC

SEQ ID NO: 3008936 - protein, 21 aa, Entamoeba invadens
MMIVAQYFLFTQDFVLLQMVC

SEQ ID NO: 3008937 - protein, 25 aa, Entamoeba invadens
MMIVCKYLKLFRDVRNLVLVSKKNS

SEQ ID NO: 3008938 - protein, 18 aa, Entamoeba invadens
MMIVSKYFRTIEDFINVE

SEQ ID NO: 3008939 - protein, 20 aa, Entamoeba invadens
MMIVSKYFSTIYDFISIEFV

SEQ ID NO: 3008940 - protein, 17 aa, Entamoeba invadens
MMIVSKYFTLFEDFVKL

SEQ ID NO: 3008941 - protein, 17 aa, Entamoeba invadens
MMIVSKYFTLFEDFVKV

SEQ ID NO: 3008942 - protein, 19 aa, Entamoeba invadens
MMIVSKYFTQIRDFIRLEF

SEQ ID NO: 3008943 - protein, 17 aa, Entamoeba invadens
MMIVSKYFVTLEDFCNI

SEQ ID NO: 3008944 - protein, 19 aa, Entamoeba invadens
MMIVSKYFYSVGDFIKLIK

SEQ ID NO: 3008945 - protein, 18 aa, Entamoeba invadens
MMIVSMYFNTIKDFINLK

SEQ ID NO: 3008946 - protein, 25 aa, Entamoeba invadens
MMKFHFNPIPLNKKNISYFLNIETL

SEQ ID NO: 3008947 - protein, 19 aa, Entamoeba invadens
MMKGFHMIGLFDGHGGDNV

SEQ ID NO: 3008948 - protein, 25 aa, Entamoeba invadens
MMKKLFDMYEYLTFISKSSPVMDHI

SEQ ID NO: 3008949 - protein, 18 aa, Entamoeba invadens
MMMTLQSKMQSVLIMFLL

SEQ ID NO: 3008950 - protein, 34 aa, Entamoeba invadens
MMNESETILIQKWTNLLVEKVIFDSYPSTDKKNN

SEQ ID NO: 3008951 - protein, 17 aa, Entamoeba invadens
MMNVALYINTVESLKTF

SEQ ID NO: 3008952 - protein, 22 aa, Entamoeba invadens
MMNVFLHLKTFNDVRTFIQVSK

SEQ ID NO: 3008953 - protein, 20 aa, Entamoeba invadens
MMNVLLYISDLRSLETFITV

SEQ ID NO: 3008954 - protein, 17 aa, Entamoeba invadens
MMNVVLYIETMSTLKKL

SEQ ID NO: 3008955 - protein, 17 aa, Entamoeba invadens
MMNYGNSPLLRACSSDL

SEQ ID NO: 3008956 - protein, 23 aa, Entamoeba invadens
MMQELMVLFIHRLEKGGLVEFTL

SEQ ID NO: 3008957 - protein, 24 aa, Entamoeba invadens
MMQVSLYLPTLKDILTFISINKKC

SEQ ID NO: 3008958 - protein, 18 aa, Entamoeba invadens
MMSHVFYNAKYFKRGYNT

SEQ ID NO: 3008959 - protein, 18 aa, Entamoeba invadens
MMTATLKSAGLNVANMPL

SEQ ID NO: 3008960 - protein, 21 aa, Entamoeba invadens
MMTLHKVVFSKFFIKKMFLEK

SEQ ID NO: 3008961 - protein, 28 aa, Entamoeba invadens
MMVDDFKYLHPTFLITVPRVLQKIYDKF

SEQ ID NO: 3008962 - protein, 25 aa, Entamoeba invadens
MMVISQYFPSIKIFVSIELVCKKYN

SEQ ID NO: 3008963 - protein, 17 aa, Entamoeba invadens
MMVISQYLMTFEDFVKI

SEQ ID NO: 3008964 - protein, 26 aa, Entamoeba invadens
MMVISQYLPSIKYFVSIELVCKKYNG

SEQ ID NO: 3008965 - protein, 19 aa, Entamoeba invadens
MMVITQYFSLLKDFISIES

SEQ ID NO: 3008966 - protein, 18 aa, Entamoeba invadens
MMVIYAKRKEGLKFLADT

SEQ ID NO: 3008967 - protein, 27 aa, Entamoeba invadens
MMVSRMGFIYCFYAGDGTLLFQGKALD

SEQ ID NO: 3008968 - protein, 18 aa, Entamoeba invadens
MNAMLRKTGLTRSDKIHV

SEQ ID NO: 3008969 - protein, 17 aa, Entamoeba invadens
MNCFNLKTIPKIQFLKR

SEQ ID NO: 3008970 - protein, 18 aa, Entamoeba invadens
MNCLTKWINLSNNEIIFT

SEQ ID NO: 3008971 - protein, 25 aa, Entamoeba invadens
MNDAICVQFLLEKGANLEEVDIRKM

SEQ ID NO: 3008972 - protein, 17 aa, Entamoeba invadens
MNDLRLVWTNGMKYNYP

SEQ ID NO: 3008973 - protein, 24 aa, Entamoeba invadens
MNEFRREFNDYFQKISLSQSQTDH

SEQ ID NO: 3008974 - protein, 17 aa, Entamoeba invadens
MNEIPFVTSVLGQFGYI

SEQ ID NO: 3008975 - protein, 18 aa, Entamoeba invadens
MNEKLCCKNLGWAIYTEQ

SEQ ID NO: 3008976 - protein, 22 aa, Entamoeba invadens
MNFIHKLAEMYKKAIKIHPEDE

SEQ ID NO: 3008977 - protein, 32 aa, Entamoeba invadens
MNFSCSIPLHDKLAIPPVFKLLGKAAEEHCNE

SEQ ID NO: 3008978 - protein, 17 aa, Entamoeba invadens
MNGAYKNRKEFAKDMVL

SEQ ID NO: 3008979 - protein, 24 aa, Entamoeba invadens
MNGQYDFCYIPPVVGNYAIAIYHN

SEQ ID NO: 3008980 - protein, 17 aa, Entamoeba invadens
MNGWIRKPNILQRIFEL

SEQ ID NO: 3008981 - protein, 23 aa, Entamoeba invadens
MNIDAVPELVWKGSVTFTEQGQL

SEQ ID NO: 3008982 - protein, 25 aa, Entamoeba invadens
MNIHFAQVPCIVLDIVRILGRNAPE

SEQ ID NO: 3008983 - protein, 18 aa, Entamoeba invadens
MNIPFIPISSPSTSMPYP

SEQ ID NO: 3008984 - protein, 23 aa, Entamoeba invadens
MNISDFHEIWVRLGRFAKTISEI

SEQ ID NO: 3008985 - protein, 32 aa, Entamoeba invadens
MNISNLSMKMGLTKSLTFLKPSEELDNLNARI

SEQ ID NO: 3008986 - protein, 30 aa, Entamoeba invadens
MNKIKAFKTLLLLLDLLFQMYSNMCDSLDD

SEQ ID NO: 3008987 - protein, 18 aa, Entamoeba invadens
MNLCDEIMIISLDLINGK

SEQ ID NO: 3008988 - protein, 18 aa, Entamoeba invadens
MNLEFSDVFWRKVDERIK

SEQ ID NO: 3008989 - protein, 33 aa, Entamoeba invadens
MNLPVGWAMGYFRNERYFFNVKTLMSTWIDPRE

SEQ ID NO: 3008990 - protein, 25 aa, Entamoeba invadens
MNLQRFFIESLHSPSLYLIGIVRKY

SEQ ID NO: 3008991 - protein, 28 aa, Entamoeba invadens
MNLRYTNNFIYMYDWFKSYFDEDETTQM

SEQ ID NO: 3008992 - protein, 17 aa, Entamoeba invadens
MNNEHLFELNIPDTFFL

SEQ ID NO: 3008993 - protein, 23 aa, Entamoeba invadens
MNNIPIHLYERYIINNAKEHNGK

SEQ ID NO: 3008994 - protein, 29 aa, Entamoeba invadens
MNNLFPNTQFPLQFKFDLKGSLYGRKADE

SEQ ID NO: 3008995 - protein, 29 aa, Entamoeba invadens
MNNTDKLLFLMNFMNYKIKTFFPSKNQSE

SEQ ID NO: 3008996 - protein, 27 aa, Entamoeba invadens
MNPEMNKFVFLLCTRAGGFGINLSEAD

SEQ ID NO: 3008997 - protein, 28 aa, Entamoeba invadens
MNPFDITVGTLYLYVLNLQLLDEVYMEH

SEQ ID NO: 3008998 - protein, 28 aa, Entamoeba invadens
MNQCLKVLPKEPRVWIYSAVIEEVKGKD

SEQ ID NO: 3008999 - protein, 19 aa, Entamoeba invadens
MNQIKTKIPTIVRPNMFVG

SEQ ID NO: 3009000 - protein, 27 aa, Entamoeba invadens
MNQKNLGVVLAPILLTLPDPETLKNTG

SEQ ID NO: 3009001 - protein, 22 aa, Entamoeba invadens
MNQQWKALVFLYVKEDQVKAID

SEQ ID NO: 3009002 - protein, 32 aa, Entamoeba invadens
MNRKYAEQLFAFVRKLLLNHYNYIFTRRVDFS

SEQ ID NO: 3009003 - protein, 24 aa, Entamoeba invadens
MNRVRMIDIEWVISSISMHITSDL

SEQ ID NO: 3009004 - protein, 29 aa, Entamoeba invadens
MNTPPNKMVFLFLFNDVLLETIPTKIDGR

SEQ ID NO: 3009005 - protein, 18 aa, Entamoeba invadens
MNTQYYKCLIFKPEVHVL

SEQ ID NO: 3009006 - protein, 29 aa, Entamoeba invadens
MNTSFFKVFAEWLFLNRDGLLRNSVKRVL

SEQ ID NO: 3009007 - protein, 29 aa, Entamoeba invadens
MNTSINELIFKSKFFYVKRYEYLDQIYKS

SEQ ID NO: 3009008 - protein, 24 aa, Entamoeba invadens
MNVDLLFMHYFENFELLTDGLKVI

SEQ ID NO: 3009009 - protein, 27 aa, Entamoeba invadens
MNVETDNFFLFSFKLTDSTPSVYSRKT

SEQ ID NO: 3009010 - protein, 30 aa, Entamoeba invadens
MNVLVEPTITKLLRKSFDWLKSIKDSQIDQ

SEQ ID NO: 3009011 - protein, 18 aa, Entamoeba invadens
MNVSLYFTNKEIVLNFIC

SEQ ID NO: 3009012 - protein, 25 aa, Entamoeba invadens
MNVSQLLIMFYDQTRVIVALKKAER

SEQ ID NO: 3009013 - protein, 30 aa, Entamoeba invadens
MNWTSDENFFVFSLLRGGVPVYGFYKKRSG

SEQ ID NO: 3009014 - protein, 33 aa, Entamoeba invadens
MNWYATSLLCKLLKSTFLPSQYVVPSLGLAVEE

SEQ ID NO: 3009015 - protein, 21 aa, Entamoeba invadens
MNYLAWDPIGLYVAAVRSAVY

SEQ ID NO: 3009016 - protein, 17 aa, Entamoeba invadens
MNYLYNKGCTTKGIFRE

SEQ ID NO: 3009017 - protein, 17 aa, Entamoeba invadens
MNYRKMVSSLVLDPVIT

SEQ ID NO: 3009018 - protein, 26 aa, Entamoeba invadens
MPAREYMIKTLIWAFETLNIPELFPF

SEQ ID NO: 3009019 - protein, 24 aa, Entamoeba invadens
MPCDVVANVYKRFLRNIPGSIVNR

SEQ ID NO: 3009020 - protein, 27 aa, Entamoeba invadens
MPEEVEKYVFTLPLPDKCRVNSFLEVL

SEQ ID NO: 3009021 - protein, 18 aa, Entamoeba invadens
MPEIKDPNLFPLINPKKN

SEQ ID NO: 3009022 - protein, 19 aa, Entamoeba invadens
MPFKDSHPMFWEIVIVFQD

SEQ ID NO: 3009023 - protein, 18 aa, Entamoeba invadens
MPFSVNELHFSVQGDYLV

SEQ ID NO: 3009024 - protein, 26 aa, Entamoeba invadens
MPGHDELMFLIPEINFMPIFDPTQIS

SEQ ID NO: 3009025 - protein, 26 aa, Entamoeba invadens
MPGPTKDFWVVFGDELMMSLVCTLNE

SEQ ID NO: 3009026 - protein, 19 aa, Entamoeba invadens
MPIKIDCKFNLPNERFSLF

SEQ ID NO: 3009027 - protein, 27 aa, Entamoeba invadens
MPISPLSFKQLFLINLNLPKRGNITLR

SEQ ID NO: 3009028 - protein, 23 aa, Entamoeba invadens
MPISRKFLQTLFTKKTPENTKES

SEQ ID NO: 3009029 - protein, 27 aa, Entamoeba invadens
MPKDFSNRKVAIATMLFNLIDIDKSGT

SEQ ID NO: 3009030 - protein, 20 aa, Entamoeba invadens
MPLAKVLNYFNTLIFSRVSY

SEQ ID NO: 3009031 - protein, 22 aa, Entamoeba invadens
MPLLKKFKAVFLPSPQDHTIAK

SEQ ID NO: 3009032 - protein, 27 aa, Entamoeba invadens
MPLNKIMTIIYIPWIVQQIGKGHYVTA

SEQ ID NO: 3009033 - protein, 30 aa, Entamoeba invadens
MPMGQPQMQVPYPYRQYAPMGRFSRVAGGQ

SEQ ID NO: 3009034 - protein, 49 aa, Entamoeba invadens
MPNQLLRVLSNIPSPLFSFPFNATVPTLLAIFFSHFEYRVLKIAHNQLV

SEQ ID NO: 3009035 - protein, 17 aa, Entamoeba invadens
MPPPTFIDLMQYLNKET

SEQ ID NO: 3009036 - protein, 18 aa, Entamoeba invadens
MPRNVFQLINANIETYDV

SEQ ID NO: 3009037 - protein, 25 aa, Entamoeba invadens
MPSHPIAYNLIRLANTPIAAPSANL

SEQ ID NO: 3009038 - protein, 23 aa, Entamoeba invadens
MPVKNILLLYKRENLVSRGQVPL

SEQ ID NO: 3009039 - protein, 21 aa, Entamoeba invadens
MPYDRTHFQRVIYGRQNVMGI

SEQ ID NO: 3009040 - protein, 21 aa, Entamoeba invadens
MPYVNYFLTMLSQFDRDVLLI

SEQ ID NO: 3009041 - protein, 31 aa, Entamoeba invadens
MQDLYIKEGDGFILVFSWASVGTFQELEKIL

SEQ ID NO: 3009042 - protein, 20 aa, Entamoeba invadens
MQDMLTLQMFKLMDGMWKKE

SEQ ID NO: 3009043 - protein, 18 aa, Entamoeba invadens
MQELLGQIDLIIGAAECS

SEQ ID NO: 3009044 - protein, 18 aa, Entamoeba invadens
MQESAVWRNIYLTGAFEL

SEQ ID NO: 3009045 - protein, 29 aa, Entamoeba invadens
MQFMECMEKFIDSLLIDPVSLYTVQNCES

SEQ ID NO: 3009046 - protein, 27 aa, Entamoeba invadens
MQHANILFSLSFVETLCRYGEDLQYWP

SEQ ID NO: 3009047 - protein, 18 aa, Entamoeba invadens
MQHGCTCRINYVLVKKAC

SEQ ID NO: 3009048 - protein, 27 aa, Entamoeba invadens
MQHKEFRIFMIMGYYTETLNQITFLCV

SEQ ID NO: 3009049 - protein, 17 aa, Entamoeba invadens
MQHLFFSEKVRKITFSL

SEQ ID NO: 3009050 - protein, 50 aa, Entamoeba invadens
MQIIAKYFLVFSDYFSIIQVCKKYEFLLDRFRINPIRISPESKPLFTHIQ

SEQ ID NO: 3009051 - protein, 19 aa, Entamoeba invadens
MQIIAKYLLTPTDYLSIIQ

SEQ ID NO: 3009052 - protein, 21 aa, Entamoeba invadens
MQKKLPLPVIKTINMCVIPKN

SEQ ID NO: 3009053 - protein, 20 aa, Entamoeba invadens
MQKYHYPVVTLEKCKICPFE

SEQ ID NO: 3009054 - protein, 18 aa, Entamoeba invadens
MQMNEVLEWIIPENVYEK

SEQ ID NO: 3009055 - protein, 20 aa, Entamoeba invadens
MQPCRGAVAVFLPPYNRIVF

SEQ ID NO: 3009056 - protein, 19 aa, Entamoeba invadens
MQPEHFAKLCPSTLQYWVR

SEQ ID NO: 3009057 - protein, 25 aa, Entamoeba invadens
MQPEQVLHFVNFKYSFRSANQTIPI

SEQ ID NO: 3009058 - protein, 26 aa, Entamoeba invadens
MQPMSYPFMYNPIQQPPPPPVALPPE

SEQ ID NO: 3009059 - protein, 26 aa, Entamoeba invadens
MQQFQDTLCALPLYSSLDPEKQRKVF

SEQ ID NO: 3009060 - protein, 24 aa, Entamoeba invadens
MQRFALRTLLIKRTTRFTTLFQVV

SEQ ID NO: 3009061 - protein, 23 aa, Entamoeba invadens
MQRMAQCINFFSPNIKPFKREAF

SEQ ID NO: 3009062 - protein, 19 aa, Entamoeba invadens
MQSPHLPSLLQQNSEMPTV

SEQ ID NO: 3009063 - protein, 25 aa, Entamoeba invadens
MQTKERPRWNFSNKGPYLDVCKQIA

SEQ ID NO: 3009064 - protein, 28 aa, Entamoeba invadens
MQTKFRLDLELLFNQRRLLLMRKEELGV

SEQ ID NO: 3009065 - protein, 21 aa, Entamoeba invadens
MQTLTNWVGLKEAKKLYDSDE

SEQ ID NO: 3009066 - protein, 17 aa, Entamoeba invadens
MQTNKLELKKLVYLYLM

SEQ ID NO: 3009067 - protein, 25 aa, Entamoeba invadens
MQTRKKRWCVLTRNKLFYFDQKPDG

SEQ ID NO: 3009068 - protein, 37 aa, Entamoeba invadens
MQVFKKQFLSTDINSPVFFKIICFVCAFINENQSIQN

SEQ ID NO: 3009069 - protein, 22 aa, Entamoeba invadens
MQVKVMIFRLFQYSTAEVSEKL

SEQ ID NO: 3009070 - protein, 17 aa, Entamoeba invadens
MQVRLANHLESFNSYVI

SEQ ID NO: 3009071 - protein, 27 aa, Entamoeba invadens
MQWKGNGPAYYLTDKELKIFGLGSFFE

SEQ ID NO: 3009072 - protein, 27 aa, Entamoeba invadens
MQYKHYIGEALLLKNFPRIKTVITKLE

SEQ ID NO: 3009073 - protein, 35 aa, Entamoeba invadens
MRACPFAAILPRSNLLDVLQRLHKTKIYACPAPSI

SEQ ID NO: 3009074 - protein, 17 aa, Entamoeba invadens
MRCWIEHVTLFAKDDIK

SEQ ID NO: 3009075 - protein, 17 aa, Entamoeba invadens
MRDISRSVLQLANKLYV

SEQ ID NO: 3009076 - protein, 25 aa, Entamoeba invadens
MRDMKKPIWPIELFEDLIAITQDHS

SEQ ID NO: 3009077 - protein, 18 aa, Entamoeba invadens
MREFAMLREFYTKDLIFQ

SEQ ID NO: 3009078 - protein, 48 aa, Entamoeba invadens
MREIGLIRNLCRDYLLIVKKSMKDLVPKSIIHFLVFKTRDSVQKELIK

SEQ ID NO: 3009079 - protein, 30 aa, Entamoeba invadens
MRELFKVVGKLSIAQQGRLVRYLNLEHRIR

SEQ ID NO: 3009080 - protein, 25 aa, Entamoeba invadens
MREMMPSFKYLFSHLIDLVSTCGQL

SEQ ID NO: 3009081 - protein, 17 aa, Entamoeba invadens
MREVILTDLLLINNLVL

SEQ ID NO: 3009082 - protein, 18 aa, Entamoeba invadens
MRFARDCFGLFEVLCGDV

SEQ ID NO: 3009083 - protein, 17 aa, Entamoeba invadens
MRFEDINTVIFQKCLIG

SEQ ID NO: 3009084 - protein, 20 aa, Entamoeba invadens
MRGTWGLPLLNASGMMRWAE

SEQ ID NO: 3009085 - protein, 19 aa, Entamoeba invadens
MRHPPLLILNGFNKGGEEM

SEQ ID NO: 3009086 - protein, 27 aa, Entamoeba invadens
MRIPHPLSSVYLLFSLNQRKAVLTSLV

SEQ ID NO: 3009087 - protein, 22 aa, Entamoeba invadens
MRKDYASLVILRALRETTKKHN

SEQ ID NO: 3009088 - protein, 32 aa, Entamoeba invadens
MRKKVQLIYSLNELKDYYFYGDASLTCLELPT

SEQ ID NO: 3009089 - protein, 21 aa, Entamoeba invadens
MRLEVYPPRFVSKDEEALFAQ

SEQ ID NO: 3009090 - protein, 33 aa, Entamoeba invadens
MRLIEMRHLVFKKWVGTMQLPIPVSFAKDALLY

SEQ ID NO: 3009091 - protein, 23 aa, Entamoeba invadens
MRNELYGNIIFSGGNTLFKGYVE

SEQ ID NO: 3009092 - protein, 17 aa, Entamoeba invadens
MRNNLGLLFSKVVTVLL

SEQ ID NO: 3009093 - protein, 23 aa, Entamoeba invadens
MRPDVFLSYILLVGDMALSAQSE

SEQ ID NO: 3009094 - protein, 19 aa, Entamoeba invadens
MRPLPHQPYPQFKNPPINP

SEQ ID NO: 3009095 - protein, 18 aa, Entamoeba invadens
MRPVPFVNASPIRFKVQH

SEQ ID NO: 3009096 - protein, 29 aa, Entamoeba invadens
MRPVRYCKYGLTKFDYFISQGWSLFMEGC

SEQ ID NO: 3009097 - protein, 18 aa, Entamoeba invadens
MRQFLFPKTTQIYDHKVL

SEQ ID NO: 3009098 - protein, 18 aa, Entamoeba invadens
MRQHLILLMKSEEINRIS

SEQ ID NO: 3009099 - protein, 29 aa, Entamoeba invadens
MRQLFCSLRLAHYLAQYGSTLLGSVRKNR

SEQ ID NO: 3009100 - protein, 19 aa, Entamoeba invadens
MRSLQYLDISFTKFTPETI

SEQ ID NO: 3009101 - protein, 18 aa, Entamoeba invadens
MRSNITIPMLFVDKIQNA

SEQ ID NO: 3009102 - protein, 24 aa, Entamoeba invadens
MRSRLAVLFVIYKMGLSETNKARY

SEQ ID NO: 3009103 - protein, 25 aa, Entamoeba invadens
MRVDKRSTFLVLMYQMMNSSIGTDF

SEQ ID NO: 3009104 - protein, 29 aa, Entamoeba invadens
MRVELIPDPTFPILYINKKTIQVIRAFIT

SEQ ID NO: 3009105 - protein, 18 aa, Entamoeba invadens
MRVSFRVQHEPVLGLRII

SEQ ID NO: 3009106 - protein, 22 aa, Entamoeba invadens
MRYDLRFAGFNKVKTPAFIPFD

SEQ ID NO: 3009107 - protein, 23 aa, Entamoeba invadens
MRYEERTKFLQNCRNRTIASENE

SEQ ID NO: 3009108 - protein, 21 aa, Entamoeba invadens
MRYVYMALEWLSQTSFYVRAT

SEQ ID NO: 3009109 - protein, 23 aa, Entamoeba invadens
MRYYEWVLSILSEIIRRLRSEKV

SEQ ID NO: 3009110 - protein, 22 aa, Entamoeba invadens
MSAFTANMRFPSTLYSGMDSLI

SEQ ID NO: 3009111 - protein, 29 aa, Entamoeba invadens
MSALEHFFNIWTYYIPKQLPMISDKKINI

SEQ ID NO: 3009112 - protein, 25 aa, Entamoeba invadens
MSALLVQIEYYFCDLNIIQDKFLLG

SEQ ID NO: 3009113 - protein, 29 aa, Entamoeba invadens
MSALQIVNHTPFFVLKKVDDLVVVASLHN

SEQ ID NO: 3009114 - protein, 20 aa, Entamoeba invadens
MSALTRLVLEKKARTVKGFF

SEQ ID NO: 3009115 - protein, 18 aa, Entamoeba invadens
MSAPWEMRYSLPLCEKYK

SEQ ID NO: 3009116 - protein, 24 aa, Entamoeba invadens
MSAQWQMPIDKKHIALLLGAFSHT

SEQ ID NO: 3009117 - protein, 25 aa, Entamoeba invadens
MSCSDKILKWNLIGLQGSILSKYYT

SEQ ID NO: 3009118 - protein, 20 aa, Entamoeba invadens
MSCSSAFKPVLNYSHYEFFR

SEQ ID NO: 3009119 - protein, 18 aa, Entamoeba invadens
MSDLFYQPILCVVGNQRD

SEQ ID NO: 3009120 - protein, 20 aa, Entamoeba invadens
MSDMHLIDYSLLVGVHQLSD

SEQ ID NO: 3009121 - protein, 24 aa, Entamoeba invadens
MSDRIYEILKSQPLIFDFSGIGIF

SEQ ID NO: 3009122 - protein, 26 aa, Entamoeba invadens
MSESDLALFPLLLDYSQKVEALNVTS

SEQ ID NO: 3009123 - protein, 31 aa, Entamoeba invadens
MSEYKGKFIVLLFYPLDWTFVCPTEMMGYSK

SEQ ID NO: 3009124 - protein, 19 aa, Entamoeba invadens
MSFFSSRGKLIDLLTVLAR

SEQ ID NO: 3009125 - protein, 25 aa, Entamoeba invadens
MSFKNLAVCFSPVLLTFYKDEKNTN

SEQ ID NO: 3009126 - protein, 17 aa, Entamoeba invadens
MSFNSCCNLQFVSLGYS

SEQ ID NO: 3009127 - protein, 18 aa, Entamoeba invadens
MSFSLDYLMEGIITILQE

SEQ ID NO: 3009128 - protein, 25 aa, Entamoeba invadens
MSFVTSAFYQNAVTCIFLYDVSNKD

SEQ ID NO: 3009129 - protein, 22 aa, Entamoeba invadens
MSGFCCYFDCFFDHHSILTTQP

SEQ ID NO: 3009130 - protein, 19 aa, Entamoeba invadens
MSGMQFTDLVFNSTKIYQF

SEQ ID NO: 3009131 - protein, 19 aa, Entamoeba invadens
MSGPFKKKYSHSWTLEEDR

SEQ ID NO: 3009132 - protein, 27 aa, Entamoeba invadens
MSGPTNFAPLIYKTIDIVKRTQAYHIL

SEQ ID NO: 3009133 - protein, 24 aa, Entamoeba invadens
MSGRPFYIFNLLEELDEEGEYYID

SEQ ID NO: 3009134 - protein, 40 aa, Entamoeba invadens
MSHAPLALRKYTLTSLLITPVQRLPRYKLMLVDLLKHYRL

SEQ ID NO: 3009135 - protein, 27 aa, Entamoeba invadens
MSIGPLLNVYFVFDFDLTLLAQMSTNY

SEQ ID NO: 3009136 - protein, 25 aa, Entamoeba invadens
MSIKNVMKLIPMISTFVTEKVGYSC

SEQ ID NO: 3009137 - protein, 23 aa, Entamoeba invadens
MSILHYICYEFMMDASPLLALLE

SEQ ID NO: 3009138 - protein, 20 aa, Entamoeba invadens
MSIRALFNNIKLVLPSTLKK

SEQ ID NO: 3009139 - protein, 22 aa, Entamoeba invadens
MSIRSIAWRVFLGSLKGVCGDE

SEQ ID NO: 3009140 - protein, 24 aa, Entamoeba invadens
MSKDKTRCLVKWQKLGYNEATWEN

SEQ ID NO: 3009141 - protein, 26 aa, Entamoeba invadens
MSKEVLGYLRVLLFPVDFKETEDVDV

SEQ ID NO: 3009142 - protein, 32 aa, Entamoeba invadens
MSKEYYTQFADLLIQSGPFNFLEKYSDFYTKE

SEQ ID NO: 3009143 - protein, 18 aa, Entamoeba invadens
MSKLRLDIYEKDVSLDVS

SEQ ID NO: 3009144 - protein, 24 aa, Entamoeba invadens
MSLFERFGYLTDVVPISALGQGAF

SEQ ID NO: 3009145 - protein, 30 aa, Entamoeba invadens
MSLGISIEKPLFIEYLGIGLPVLGQPDKRG

SEQ ID NO: 3009146 - protein, 20 aa, Entamoeba invadens
MSLKNFAMILGPLVIHSVPG

SEQ ID NO: 3009147 - protein, 20 aa, Entamoeba invadens
MSLLILKKDLCDLAALLENN

SEQ ID NO: 3009148 - protein, 25 aa, Entamoeba invadens
MSLNDIELPLTLFGELWEIFMAANV

SEQ ID NO: 3009149 - protein, 43 aa, Entamoeba invadens
MSLNTLVTAFKPQVALRFGLPFDRPFYLVHRNTFLESNLSLHK

SEQ ID NO: 3009150 - protein, 19 aa, Entamoeba invadens
MSMPGMMDTILNLGLNDKT

SEQ ID NO: 3009151 - protein, 22 aa, Entamoeba invadens
MSNLEEVVLSPLFNVIPKDTFK

SEQ ID NO: 3009152 - protein, 22 aa, Entamoeba invadens
MSNQFCDYLLKGGFFNSFISDV

SEQ ID NO: 3009153 - protein, 19 aa, Entamoeba invadens
MSNSKSFHFPYTHSPKEKN

SEQ ID NO: 3009154 - protein, 27 aa, Entamoeba invadens
MSPDSFILIPSILSAVLRLPDFPVLKS

SEQ ID NO: 3009155 - protein, 17 aa, Entamoeba invadens
MSPLLKILNDQFALETL

SEQ ID NO: 3009156 - protein, 17 aa, Entamoeba invadens
MSPPPPMMTVHRDPYEQ

SEQ ID NO: 3009157 - protein, 30 aa, Entamoeba invadens
MSQDGGMDGGWFFPVDIALGTAKSAGDVGE

SEQ ID NO: 3009158 - protein, 17 aa, Entamoeba invadens
MSQFCDHTRLCELIVRG

SEQ ID NO: 3009159 - protein, 23 aa, Entamoeba invadens
MSQIVNFVTYKVIELLVCSERVT

SEQ ID NO: 3009160 - protein, 32 aa, Entamoeba invadens
MSQLAYQRALRRRRIAKRRQIAFARARRIRMK

SEQ ID NO: 3009161 - protein, 24 aa, Entamoeba invadens
MSQTWEKIIFYIDNVTLLTSNQKF

SEQ ID NO: 3009162 - protein, 32 aa, Entamoeba invadens
MSQYVFEEFEVPSLLFGRPSVMAMFASGRPSG

SEQ ID NO: 3009163 - protein, 18 aa, Entamoeba invadens
MSRALRLTETPLSCRELR

SEQ ID NO: 3009164 - protein, 24 aa, Entamoeba invadens
MSRDVVLLALLKDTSKRYIVFCNS

SEQ ID NO: 3009165 - protein, 17 aa, Entamoeba invadens
MSRELLQTLIADDLKVI

SEQ ID NO: 3009166 - protein, 27 aa, Entamoeba invadens
MSRMMCDVPLVLLFVALGYETDEKIVD

SEQ ID NO: 3009167 - protein, 20 aa, Entamoeba invadens
MSSEGAFNIMACLGLFIMFM

SEQ ID NO: 3009168 - protein, 32 aa, Entamoeba invadens
MSSLKDVGNSVLGWFGLSTDNFAVNQDPKTGG

SEQ ID NO: 3009169 - protein, 25 aa, Entamoeba invadens
MSSPEHWIFPLRLVGRTNPDRQLKE

SEQ ID NO: 3009170 - protein, 30 aa, Entamoeba invadens
MSSSPIIDRLIYLRVLIERTKPIEKKLRYQ

SEQ ID NO: 3009171 - protein, 20 aa, Entamoeba invadens
MSSYLRNRLLGMPKNPMDMV

SEQ ID NO: 3009172 - protein, 18 aa, Entamoeba invadens
MSTAKLREVIFKLNSYMK

SEQ ID NO: 3009173 - protein, 23 aa, Entamoeba invadens
MSTKILLYNTYKILLSAENDVPD

SEQ ID NO: 3009174 - protein, 20 aa, Entamoeba invadens
MSVVRFPVVQNFLEIERSLY

SEQ ID NO: 3009175 - protein, 26 aa, Entamoeba invadens
MSVYADALLSIPHALAENSGLNAIET

SEQ ID NO: 3009176 - protein, 29 aa, Entamoeba invadens
MSWCIDFFESCITLFPLIFPDEYGMDYNT

SEQ ID NO: 3009177 - protein, 22 aa, Entamoeba invadens
MSWEDFYILNKDTPPTKPTRSR

SEQ ID NO: 3009178 - protein, 17 aa, Entamoeba invadens
MSWYKGPTLLGALDNVN

SEQ ID NO: 3009179 - protein, 25 aa, Entamoeba invadens
MSYFEGSVHFLLELAPYGGFDTKMK

SEQ ID NO: 3009180 - protein, 27 aa, Entamoeba invadens
MSYLKGVLKIGFPMAMFLSGIGYDKYG

SEQ ID NO: 3009181 - protein, 26 aa, Entamoeba invadens
MTAEMIEFVIYFAHLLVCDTNIKMIT

SEQ ID NO: 3009182 - protein, 17 aa, Entamoeba invadens
MTAFNRRLKLVFPDTCG

SEQ ID NO: 3009183 - protein, 27 aa, Entamoeba invadens
MTCANCGYQFCWLCMAPYTSNHFRNGK

SEQ ID NO: 3009184 - protein, 24 aa, Entamoeba invadens
MTCEKAIEYLKVNPLPVLKCTVRA

SEQ ID NO: 3009185 - protein, 20 aa, Entamoeba invadens
MTCSCGHQFCWLCMADYTNT

SEQ ID NO: 3009186 - protein, 24 aa, Entamoeba invadens
MTDTLLKVVGPYLDEARLYLTKGE

SEQ ID NO: 3009187 - protein, 21 aa, Entamoeba invadens
MTEFVIFNFSNKHPLVPEKSG

SEQ ID NO: 3009188 - protein, 33 aa, Entamoeba invadens
MTEGDPPYMELPPLRALFLITTKGIPPLKERES

SEQ ID NO: 3009189 - protein, 18 aa, Entamoeba invadens
MTEKMVFPSIIPDQLKRL

SEQ ID NO: 3009190 - protein, 19 aa, Entamoeba invadens
MTELCGVMYLMPVKSTKRV

SEQ ID NO: 3009191 - protein, 20 aa, Entamoeba invadens
MTEMLSTPFNLFEELSEVEK

SEQ ID NO: 3009192 - protein, 17 aa, Entamoeba invadens
MTFNIKTIRFITSDDVT

SEQ ID NO: 3009193 - protein, 19 aa, Entamoeba invadens
MTGLLMKLQSLVCQDRMCL

SEQ ID NO: 3009194 - protein, 17 aa, Entamoeba invadens
MTHWTIDYGIKEYGYYG

SEQ ID NO: 3009195 - protein, 25 aa, Entamoeba invadens
MTIHWELQTWIPLGTYLLPSDDNLA

SEQ ID NO: 3009196 - protein, 18 aa, Entamoeba invadens
MTIIGWTDIYLFDYRKLM

SEQ ID NO: 3009197 - protein, 29 aa, Entamoeba invadens
MTITALLCKPIVLNPKQNFPPPTLESAEE

SEQ ID NO: 3009198 - protein, 19 aa, Entamoeba invadens
MTITLYFESTFDVINSLTS

SEQ ID NO: 3009199 - protein, 34 aa, Entamoeba invadens
MTIVSYFHSFNKTNFLFHWGYKQEFLHTENTYED

SEQ ID NO: 3009200 - protein, 26 aa, Entamoeba invadens
MTKDNNFFCFVLKSPVIKEPIKVMRK

SEQ ID NO: 3009201 - protein, 24 aa, Entamoeba invadens
MTKDPTRLQLYLDRLEFEGNNLNI

SEQ ID NO: 3009202 - protein, 22 aa, Entamoeba invadens
MTKYGNMIMPLNSGSYLEVTQE

SEQ ID NO: 3009203 - protein, 20 aa, Entamoeba invadens
MTLIIQFMDWGFSIPNEVLV

SEQ ID NO: 3009204 - protein, 27 aa, Entamoeba invadens
MTLMIHSAFCKIKLYEFFKWTNEKVGC

SEQ ID NO: 3009205 - protein, 32 aa, Entamoeba invadens
MTMLRAKNLLDVNILYLVFDLSSKESYNYALE

SEQ ID NO: 3009206 - protein, 17 aa, Entamoeba invadens
MTMNMYNVLLKNSQIII

SEQ ID NO: 3009207 - protein, 19 aa, Entamoeba invadens
MTNLPVILTLSIGDCSAFI

SEQ ID NO: 3009208 - protein, 28 aa, Entamoeba invadens
MTNPVQTDMLLFLKLVDYFQDDNDTDVK

SEQ ID NO: 3009209 - protein, 35 aa, Entamoeba invadens
MTPKAKVVFMNAFIKFLVKFNKDLSFFSVYKLLPT

SEQ ID NO: 3009210 - protein, 18 aa, Entamoeba invadens
MTPLQYACVMKNVPIAIF

SEQ ID NO: 3009211 - protein, 17 aa, Entamoeba invadens
MTQKFMMNYGNSPLLRA

SEQ ID NO: 3009212 - protein, 29 aa, Entamoeba invadens
MTQRSRALILPLLFFEGSVPPPTLRAFLH

SEQ ID NO: 3009213 - protein, 25 aa, Entamoeba invadens
MTQTDKYHILVFYCKDFSTVCPKEL

SEQ ID NO: 3009214 - protein, 26 aa, Entamoeba invadens
MTREKLEVYIWYDAELKRLNLEKERR

SEQ ID NO: 3009215 - protein, 23 aa, Entamoeba invadens
MTRNRYEWYILQFAMERQGIIPI

SEQ ID NO: 3009216 - protein, 17 aa, Entamoeba invadens
MTSADEELYWGVVSQIT

SEQ ID NO: 3009217 - protein, 28 aa, Entamoeba invadens
MTSENMPYIQLMWALMKIRLENDKIASN

SEQ ID NO: 3009218 - protein, 20 aa, Entamoeba invadens
MTSFIIPENITSLGYKCFFT

SEQ ID NO: 3009219 - protein, 19 aa, Entamoeba invadens
MTSLLYSGVDMKSIVVGMC

SEQ ID NO: 3009220 - protein, 28 aa, Entamoeba invadens
MTSLSSCGMAFVFKYIEAATQAGVEMGI

SEQ ID NO: 3009221 - protein, 25 aa, Entamoeba invadens
MTSPMKLPVIFTCPISINEIKQRII

SEQ ID NO: 3009222 - protein, 17 aa, Entamoeba invadens
MTSPSTRLFFMTDGILL

SEQ ID NO: 3009223 - protein, 18 aa, Entamoeba invadens
MTSSIYFYVVIASLEYEE

SEQ ID NO: 3009224 - protein, 19 aa, Entamoeba invadens
MTTKDGFFLGFSQEGLIPP

SEQ ID NO: 3009225 - protein, 18 aa, Entamoeba invadens
MTVGLPMTLYDGRKTRSL

SEQ ID NO: 3009226 - protein, 25 aa, Entamoeba invadens
MTVKNNFIWGTYNGVSYFGGSDIAH

SEQ ID NO: 3009227 - protein, 17 aa, Entamoeba invadens
MTVSSSVMLKWVSSINE

SEQ ID NO: 3009228 - protein, 25 aa, Entamoeba invadens
MTYCAGGDFWRLLNRQPGKCFKENV

SEQ ID NO: 3009229 - protein, 26 aa, Entamoeba invadens
MTYQNLLNTIVEIRFEIYTMRQKPKN

SEQ ID NO: 3009230 - protein, 27 aa, Entamoeba invadens
MTYVYRKLFLRITKVEFLYYLDKELKE

SEQ ID NO: 3009231 - protein, 26 aa, Entamoeba invadens
MVAEMFFGIPLFVASSELGLLRKQVQ

SEQ ID NO: 3009232 - protein, 32 aa, Entamoeba invadens
MVAPPADLLAPPPGLAPPPLAPPPGGAGAPPP

SEQ ID NO: 3009233 - protein, 18 aa, Entamoeba invadens
MVDFFWNVGAPENEIDRL

SEQ ID NO: 3009234 - protein, 18 aa, Entamoeba invadens
MVDFTKWVKGRIGVKDPE

SEQ ID NO: 3009235 - protein, 22 aa, Entamoeba invadens
MVDTVDKIYVWIGKDCNRLKRT

SEQ ID NO: 3009236 - protein, 33 aa, Entamoeba invadens
MVEADVVIFSYPVYWYYMPAQVKLLLDRTVSLF

SEQ ID NO: 3009237 - protein, 17 aa, Entamoeba invadens
MVECYHVILDVASWINE

SEQ ID NO: 3009238 - protein, 25 aa, Entamoeba invadens
MVECYPLPGILLLASVSVLYISTTS

SEQ ID NO: 3009239 - protein, 24 aa, Entamoeba invadens
MVEDFPHFGVIKKLLTFDFNERAT

SEQ ID NO: 3009240 - protein, 20 aa, Entamoeba invadens
MVEFKFPRHLYFIGNNSFAQ

SEQ ID NO: 3009241 - protein, 23 aa, Entamoeba invadens
MVELRMFEYALVKHKQLFDDWES

SEQ ID NO: 3009242 - protein, 18 aa, Entamoeba invadens
MVEPQLSQLPLFQQILKN

SEQ ID NO: 3009243 - protein, 22 aa, Entamoeba invadens
MVESFLSFFQILTGKEEVDVWY

SEQ ID NO: 3009244 - protein, 17 aa, Entamoeba invadens
MVFFTRNGSFLCAVPYN

SEQ ID NO: 3009245 - protein, 20 aa, Entamoeba invadens
MVGIIHEGVWKPGMDAGNII

SEQ ID NO: 3009246 - protein, 18 aa, Entamoeba invadens
MVGLLTEAGFSFDLKCPE

SEQ ID NO: 3009247 - protein, 31 aa, Entamoeba invadens
MVHADLSEYNLLWWKGLVYVIDVGQAIELSH

SEQ ID NO: 3009248 - protein, 18 aa, Entamoeba invadens
MVIVSRYLTTLHDLFNIE

SEQ ID NO: 3009249 - protein, 23 aa, Entamoeba invadens
MVKALKVKSLIVPTQQIRIADDL

SEQ ID NO: 3009250 - protein, 23 aa, Entamoeba invadens
MVKYDFEIYNLFISTFECLPLAA

SEQ ID NO: 3009251 - protein, 28 aa, Entamoeba invadens
MVLEKYIHLFDLLIIDPPFLSEDTTDKV

SEQ ID NO: 3009252 - protein, 17 aa, Entamoeba invadens
MVLGNVCFLTIMKGEFN

SEQ ID NO: 3009253 - protein, 18 aa, Entamoeba invadens
MVLLQTQMNTLEKDNKHL

SEQ ID NO: 3009254 - protein, 18 aa, Entamoeba invadens
MVLSLLAGIIKLISFDNL

SEQ ID NO: 3009255 - protein, 31 aa, Entamoeba invadens
MVLTSITYLPYDIFKPLIPLGVFQVVMFYMK

SEQ ID NO: 3009256 - protein, 19 aa, Entamoeba invadens
MVMNTNLVARRLLNTISGF

SEQ ID NO: 3009257 - protein, 23 aa, Entamoeba invadens
MVMRNSLLYFYSQKDTHVIALGY

SEQ ID NO: 3009258 - protein, 26 aa, Entamoeba invadens
MVNCKWLEVLYLIRTKVSDKAITSLL

SEQ ID NO: 3009259 - protein, 33 aa, Entamoeba invadens
MVNVSLLSRMLEPFCYALIYPKGQMGWQQEAKK

SEQ ID NO: 3009260 - protein, 24 aa, Entamoeba invadens
MVPGDVVFVILTNPNSKFTRIGNN

SEQ ID NO: 3009261 - protein, 24 aa, Entamoeba invadens
MVPNKVYIYFDKAEKIKAADFGGT

SEQ ID NO: 3009262 - protein, 21 aa, Entamoeba invadens
MVRDLFDMAKSKKSCIIFFDE

SEQ ID NO: 3009263 - protein, 23 aa, Entamoeba invadens
MVRKAKLQTRKLLVGRCSRCGSI

SEQ ID NO: 3009264 - protein, 22 aa, Entamoeba invadens
MVRNGFTRLIKDRDFLDIIFKE

SEQ ID NO: 3009265 - protein, 19 aa, Entamoeba invadens
MVSIFYRPPESFICTTEFP

SEQ ID NO: 3009266 - protein, 25 aa, Entamoeba invadens
MVSIRDWLGLLSAVLKVRVICWEYP

SEQ ID NO: 3009267 - protein, 25 aa, Entamoeba invadens
MVTARGHHIAGVSQIPLVLNSKSIS

SEQ ID NO: 3009268 - protein, 24 aa, Entamoeba invadens
MVTEALKFYKHPRLTFHYVSNVDG

SEQ ID NO: 3009269 - protein, 20 aa, Entamoeba invadens
MVTLMKKYFNFCYNGNYTFT

SEQ ID NO: 3009270 - protein, 24 aa, Entamoeba invadens
MVVLEPVFLKNVVLYLDTLNDVYY

SEQ ID NO: 3009271 - protein, 20 aa, Entamoeba invadens
MVVSKYFITIADFINLELVC

SEQ ID NO: 3009272 - protein, 18 aa, Entamoeba invadens
MVVSKYFRTFQDYINFEL

SEQ ID NO: 3009273 - protein, 20 aa, Entamoeba invadens
MVYHSHPYFLSLTFNNEIAK

SEQ ID NO: 3009274 - protein, 21 aa, Entamoeba invadens
MVYITTHRVIFSPDTLPSKQE

SEQ ID NO: 3009275 - protein, 20 aa, Entamoeba invadens
MWEMVPQKLFVMSGGDLLFS

SEQ ID NO: 3009276 - protein, 19 aa, Entamoeba invadens
MWIDKVRIYKTYDQNYKEA

SEQ ID NO: 3009277 - protein, 18 aa, Entamoeba invadens
MWKIPTPVQKTLQTLSIE

SEQ ID NO: 3009278 - protein, 30 aa, Entamoeba invadens
MWNTSLSIVQLFFRFLEKYGFDATALTNAH

SEQ ID NO: 3009279 - protein, 27 aa, Entamoeba invadens
MWTKEGFELIQPHRLFILEGNVMQATH

SEQ ID NO: 3009280 - protein, 26 aa, Entamoeba invadens
MWVNNETGLILPIKELCQIAHDHGAY

SEQ ID NO: 3009281 - protein, 20 aa, Entamoeba invadens
MYADALFKKFNPEGLQDLNE

SEQ ID NO: 3009282 - protein, 21 aa, Entamoeba invadens
MYAKNFLGILVHRVMGYDPTL

SEQ ID NO: 3009283 - protein, 24 aa, Entamoeba invadens
MYCMQQLIEYVPVPRTFTLFYQVF

SEQ ID NO: 3009284 - protein, 36 aa, Entamoeba invadens
MYCTQQLIEFIPVPRVFTLFYQIYPNLLENGISQNL

SEQ ID NO: 3009285 - protein, 19 aa, Entamoeba invadens
MYCVLFLNKVVYNYKPSHK

SEQ ID NO: 3009286 - protein, 26 aa, Entamoeba invadens
MYDVFESIYFVFVVSHPITIPSKELW

SEQ ID NO: 3009287 - protein, 21 aa, Entamoeba invadens
MYECFKWKDPYPKSDFKYAWS

SEQ ID NO: 3009288 - protein, 19 aa, Entamoeba invadens
MYECFTWSDAFPKDVYRYA

SEQ ID NO: 3009289 - protein, 34 aa, Entamoeba invadens
MYECFVWGNAYPKEKFNFPWKIAEFVNEGNRLQN

SEQ ID NO: 3009290 - protein, 18 aa, Entamoeba invadens
MYEKYEKKGFFKILEKEG

SEQ ID NO: 3009291 - protein, 27 aa, Entamoeba invadens
MYELYDPVTVMFFFRKKHIQVDLGTGN

SEQ ID NO: 3009292 - protein, 33 aa, Entamoeba invadens
MYEVFGWCDAYPKQSFKFPWKIAEFVMSKKRLV

SEQ ID NO: 3009293 - protein, 19 aa, Entamoeba invadens
MYEVFGWCEAYQNDTFKFP

SEQ ID NO: 3009294 - protein, 24 aa, Entamoeba invadens
MYFLEACCIFAQYVLMLQEEPEKA

SEQ ID NO: 3009295 - protein, 36 aa, Entamoeba invadens
MYFSQKRQHFLLDKGYVFKTINLQKIMPLKPENKKQ

SEQ ID NO: 3009296 - protein, 27 aa, Entamoeba invadens
MYGSLWCGLLKFMFLFDEKESGWMFSF

SEQ ID NO: 3009297 - protein, 30 aa, Entamoeba invadens
MYIDYIHLMKRLINLLHYCILRGASTASMY

SEQ ID NO: 3009298 - protein, 22 aa, Entamoeba invadens
MYKIKAENFDWAFSVGVKCSTK

SEQ ID NO: 3009299 - protein, 19 aa, Entamoeba invadens
MYKTKKTLVIGFYANNNTT

SEQ ID NO: 3009300 - protein, 27 aa, Entamoeba invadens
MYKTKSLYLHAYQSYIWNTVVSKRVEK

SEQ ID NO: 3009301 - protein, 18 aa, Entamoeba invadens
MYLKLEDILAKQDKLLIL

SEQ ID NO: 3009302 - protein, 17 aa, Entamoeba invadens
MYLPTTPEKSMSPMETE

SEQ ID NO: 3009303 - protein, 24 aa, Entamoeba invadens
MYMIFAAVLIRPSPTLQPLFLQVE

SEQ ID NO: 3009304 - protein, 18 aa, Entamoeba invadens
MYMRVRRILKNEATILDT

SEQ ID NO: 3009305 - protein, 26 aa, Entamoeba invadens
MYNDRFIINIPLQYIENYNFTPKVYF

SEQ ID NO: 3009306 - protein, 24 aa, Entamoeba invadens
MYNETLLQDLLAENPALVSERKVV

SEQ ID NO: 3009307 - protein, 20 aa, Entamoeba invadens
MYNQGYIQLLDLLKMKNKED

SEQ ID NO: 3009308 - protein, 17 aa, Entamoeba invadens
MYPDFVIGDRDKNADLH

SEQ ID NO: 3009309 - protein, 29 aa, Entamoeba invadens
MYSDNYCEWIYRFLLIAQEPLDSTISSSL

SEQ ID NO: 3009310 - protein, 26 aa, Entamoeba invadens
MYSDWPLYQLYDQFSGGMWDLTDEQK

SEQ ID NO: 3009311 - protein, 18 aa, Entamoeba invadens
MYSRKYPNDLPQKEKDGY

SEQ ID NO: 3009312 - protein, 27 aa, Entamoeba invadens
MYTFGPSYIYLFNCDGKWNIQFNIKVF

SEQ ID NO: 3009313 - protein, 18 aa, Entamoeba invadens
MYVNSYKLSLKSPIEKIL

SEQ ID NO: 3009314 - protein, 26 aa, Entamoeba invadens
MYYSSSHFHFLNPAFEGFFRSINESV

SEQ ID NO: 3009315 - protein, 17 aa, Entamoeba invadens
NAAAIIRTAKTLGLEIT

SEQ ID NO: 3009316 - protein, 29 aa, Entamoeba invadens
NAACYGCNYGFYYVYYDTCLQCPFPCVTC

SEQ ID NO: 3009317 - protein, 18 aa, Entamoeba invadens
NAADLYQLVDILGLVYHE

SEQ ID NO: 3009318 - protein, 20 aa, Entamoeba invadens
NAAFILGMQAILISQGYTIV

SEQ ID NO: 3009319 - protein, 19 aa, Entamoeba invadens
NAALVFTNLLMAKPFVGMD

SEQ ID NO: 3009320 - protein, 26 aa, Entamoeba invadens
NAALYWLHRMVLAGENPKYIARRLIR

SEQ ID NO: 3009321 - protein, 23 aa, Entamoeba invadens
NADDEVLVYIPKTTLPAFHVSTQ

SEQ ID NO: 3009322 - protein, 23 aa, Entamoeba invadens
NADDWYLHLNGELSDIAWNFMLD

SEQ ID NO: 3009323 - protein, 17 aa, Entamoeba invadens
NADFVLIKELSSILMLQ

SEQ ID NO: 3009324 - protein, 20 aa, Entamoeba invadens
NADKLREVIKNEFGEYKEHV

SEQ ID NO: 3009325 - protein, 27 aa, Entamoeba invadens
NADLVITNILIVYLHSLNALLETADYD

SEQ ID NO: 3009326 - protein, 33 aa, Entamoeba invadens
NADQPKLIELLTLPFTNLNNLHPFFTILKNDLP

SEQ ID NO: 3009327 - protein, 18 aa, Entamoeba invadens
NADVLLGYILAQNSFDGF

SEQ ID NO: 3009328 - protein, 26 aa, Entamoeba invadens
NAEFKRLTLLMTNLPNKRLRDVSLRV

SEQ ID NO: 3009329 - protein, 24 aa, Entamoeba invadens
NAELTPGVLFIDEVHMLDAECFAF

SEQ ID NO: 3009330 - protein, 26 aa, Entamoeba invadens
NAESDNFFLFSFKLTDSTPSEFLRKT

SEQ ID NO: 3009331 - protein, 25 aa, Entamoeba invadens
NAESFIFIGFFNGKVKRYNIKNELL

SEQ ID NO: 3009332 - protein, 29 aa, Entamoeba invadens
NAETFIDVFYLHLGEFYQVFMRRCAIYKD

SEQ ID NO: 3009333 - protein, 26 aa, Entamoeba invadens
NAETRYPITCPLVLLDDVIPTFNLQS

SEQ ID NO: 3009334 - protein, 18 aa, Entamoeba invadens
NAEVLISFITPFVTPQYL

SEQ ID NO: 3009335 - protein, 28 aa, Entamoeba invadens
NAEYLPDFVRMFFTKFFKIMREGEVETV

SEQ ID NO: 3009336 - protein, 19 aa, Entamoeba invadens
NAFDFDVFMLISALEMLKS

SEQ ID NO: 3009337 - protein, 20 aa, Entamoeba invadens
NAFKNFVYDFGDLAWLEKNC

SEQ ID NO: 3009338 - protein, 20 aa, Entamoeba invadens
NAFVANLYISAAFSNPRKEV

SEQ ID NO: 3009339 - protein, 19 aa, Entamoeba invadens
NAFVNYALVEIAQLDIPVK

SEQ ID NO: 3009340 - protein, 22 aa, Entamoeba invadens
NAFYVNHLWRKCYEDERCTNFL

SEQ ID NO: 3009341 - protein, 25 aa, Entamoeba invadens
NAGGKDYHIACFKCKTCGLKLNNSN

SEQ ID NO: 3009342 - protein, 28 aa, Entamoeba invadens
NAGIVVWPCVAEILPQFVFNDRNPIICG

SEQ ID NO: 3009343 - protein, 18 aa, Entamoeba invadens
NAHAFVRKLPYMAEWSVV

SEQ ID NO: 3009344 - protein, 24 aa, Entamoeba invadens
NAHFSYFVRSVIESGYRAEGLKMM

SEQ ID NO: 3009345 - protein, 29 aa, Entamoeba invadens
NAHNNSVVKLFWAFQDDVNLYLIMEYCPG

SEQ ID NO: 3009346 - protein, 22 aa, Entamoeba invadens
NAHSFVLPFFNILLIEQSNTVT

SEQ ID NO: 3009347 - protein, 43 aa, Entamoeba invadens
NAIDIDHLITLFRKDKYIVTKKLLREFLIEKCVNFADAAREAA

SEQ ID NO: 3009348 - protein, 25 aa, Entamoeba invadens
NAIFGDYVFFLNKNLKRVDLNGVTK

SEQ ID NO: 3009349 - protein, 23 aa, Entamoeba invadens
NAIGNHLTFKYIFNKMYDKMNLV

SEQ ID NO: 3009350 - protein, 36 aa, Entamoeba invadens
NAIIMVYKEVTLLGCWFHFKQAIFKKVSKLGLSKIY

SEQ ID NO: 3009351 - protein, 27 aa, Entamoeba invadens
NAIKHLTLLNVLKFIKIKAVVVKGTSI

SEQ ID NO: 3009352 - protein, 34 aa, Entamoeba invadens
NAIKYKPGWARGYSRKAFALVKLEKYDEAEKVCE

SEQ ID NO: 3009353 - protein, 24 aa, Entamoeba invadens
NAILEIVGPFKLLFKRETAAMNSV

SEQ ID NO: 3009354 - protein, 24 aa, Entamoeba invadens
NAILGCSMCICRAAASFKKLPLYK

SEQ ID NO: 3009355 - protein, 31 aa, Entamoeba invadens
NAILSLFDCLPLAIVLDSDIGRFFLCHGGLS

SEQ ID NO: 3009356 - protein, 33 aa, Entamoeba invadens
NAIPQVVFNMCWWIYTYGHSIEGIFRISGKTDF

SEQ ID NO: 3009357 - protein, 26 aa, Entamoeba invadens
NAIPSAFVPVQCLPSFFSVENNVSNT

SEQ ID NO: 3009358 - protein, 35 aa, Entamoeba invadens
NAIQVIEFILDPLNTRFLPPTIIDPLKDKGTFSIK

SEQ ID NO: 3009359 - protein, 23 aa, Entamoeba invadens
NAISCMEWLLQLLKTVKSNEENV

SEQ ID NO: 3009360 - protein, 25 aa, Entamoeba invadens
NAIWAGMDLKFKDQFLAAVAKMECQ

SEQ ID NO: 3009361 - protein, 24 aa, Entamoeba invadens
NAIYRVFRMISLNHTLPITKEEFL

SEQ ID NO: 3009362 - protein, 23 aa, Entamoeba invadens
NAKAAMIWIIGEYNKLITNSSEL

SEQ ID NO: 3009363 - protein, 21 aa, Entamoeba invadens
NAKILQLYEEHNRVLDILEKL

SEQ ID NO: 3009364 - protein, 19 aa, Entamoeba invadens
NAKIQAELELTKTVEELNA

SEQ ID NO: 3009365 - protein, 23 aa, Entamoeba invadens
NAKKIPFCVINQKGIVLYSIYDK

SEQ ID NO: 3009366 - protein, 24 aa, Entamoeba invadens
NAKKVLMTLAKIYQSFIQQGQEPL

SEQ ID NO: 3009367 - protein, 28 aa, Entamoeba invadens
NAKVAIISLKPRLLEQLSGTLIRAGKDI

SEQ ID NO: 3009368 - protein, 21 aa, Entamoeba invadens
NAKVFLFDLSNPTSLAKVYEA

SEQ ID NO: 3009369 - protein, 23 aa, Entamoeba invadens
NAKVKIITLPERKLSAWIGGSIL

SEQ ID NO: 3009370 - protein, 30 aa, Entamoeba invadens
NAKVYKEQAIWMLNAMWPSTKSAKAEEIWK

SEQ ID NO: 3009371 - protein, 22 aa, Entamoeba invadens
NAKYWDILHLSTLYPVIMRCSA

SEQ ID NO: 3009372 - protein, 27 aa, Entamoeba invadens
NALDKIDFGLKLTKSYALIVDMAKLTT

SEQ ID NO: 3009373 - protein, 26 aa, Entamoeba invadens
NALEGFTLIQLLIPQNKLAAVESWIV

SEQ ID NO: 3009374 - protein, 19 aa, Entamoeba invadens
NALFKIVSDSWRNNSNERN

SEQ ID NO: 3009375 - protein, 17 aa, Entamoeba invadens
NALGYIKKYLQVKITNL

SEQ ID NO: 3009376 - protein, 24 aa, Entamoeba invadens
NALKIFKHLTLIQNIKFSFQVPYV

SEQ ID NO: 3009377 - protein, 19 aa, Entamoeba invadens
NALKKKLIIVCKESAFVPA

SEQ ID NO: 3009378 - protein, 17 aa, Entamoeba invadens
NALLDEYLDKFKKYFRK

SEQ ID NO: 3009379 - protein, 19 aa, Entamoeba invadens
NALLLIKKYIEMNVDSCFE

SEQ ID NO: 3009380 - protein, 22 aa, Entamoeba invadens
NALRAYHIAIEWVRQSLFNERI

SEQ ID NO: 3009381 - protein, 24 aa, Entamoeba invadens
NALRLEITNLLKKLRKVNQSYVKL

SEQ ID NO: 3009382 - protein, 17 aa, Entamoeba invadens
NALTKLGCYIHGCYFHY

SEQ ID NO: 3009383 - protein, 30 aa, Entamoeba invadens
NALVQYHATRLFFFIKQQDPHALLRFITTK

SEQ ID NO: 3009384 - protein, 32 aa, Entamoeba invadens
NALYDLNLFFRDFEYNWILPTNLTQLYMYDQN

SEQ ID NO: 3009385 - protein, 27 aa, Entamoeba invadens
NAMFDEAWFPYAHFHPFYASFHSMNKD

SEQ ID NO: 3009386 - protein, 19 aa, Entamoeba invadens
NAMFVKCVLLIQNRHSLDA

SEQ ID NO: 3009387 - protein, 25 aa, Entamoeba invadens
NAMKRILFLYALRHPACGYVQGLND

SEQ ID NO: 3009388 - protein, 17 aa, Entamoeba invadens
NAMLRRKAFMHQYTEEG

SEQ ID NO: 3009389 - protein, 20 aa, Entamoeba invadens
NAMLTAYKQCFRLSNKSLIK

SEQ ID NO: 3009390 - protein, 23 aa, Entamoeba invadens
NANFKIIAILIILKNIDRINERH

SEQ ID NO: 3009391 - protein, 24 aa, Entamoeba invadens
NAPKFSIFHKYPYAVIAYSLSKDV

SEQ ID NO: 3009392 - protein, 24 aa, Entamoeba invadens
NAPPQTTFLDVPKLNFLDEKQDKF

SEQ ID NO: 3009393 - protein, 23 aa, Entamoeba invadens
NAPTLIHLYKKNTVLGRSSQCDV

SEQ ID NO: 3009394 - protein, 32 aa, Entamoeba invadens
NAPYVKIEFITPLFPFIKMMLRSIVVSLCVDG

SEQ ID NO: 3009395 - protein, 24 aa, Entamoeba invadens
NAQDTYRRSAFVRYITAPKRSVIE

SEQ ID NO: 3009396 - protein, 22 aa, Entamoeba invadens
NAQFGFYRFVTEFKTAFPSILL

SEQ ID NO: 3009397 - protein, 25 aa, Entamoeba invadens
NAQLSKLLFTMAKTLSRGGYGGHRG

SEQ ID NO: 3009398 - protein, 24 aa, Entamoeba invadens
NAQVSLLKFQVSAPASVAQEEEKN

SEQ ID NO: 3009399 - protein, 25 aa, Entamoeba invadens
NARANNPLFFLVSFITRCVSGSDDL

SEQ ID NO: 3009400 - protein, 24 aa, Entamoeba invadens
NARDFIIRCLYPDPRLRMNAEQAL

SEQ ID NO: 3009401 - protein, 25 aa, Entamoeba invadens
NARISIPPQFRRKSSHKLMRQDTPL

SEQ ID NO: 3009402 - protein, 24 aa, Entamoeba invadens
NARKQWFHYSVQLKKILDGEQNWL

SEQ ID NO: 3009403 - protein, 21 aa, Entamoeba invadens
NARPIETLIIIKCVKTSETTS

SEQ ID NO: 3009404 - protein, 25 aa, Entamoeba invadens
NASDQFLLARLEIKWILSVCDVVPF

SEQ ID NO: 3009405 - protein, 34 aa, Entamoeba invadens
NASDRAHLELAYLPRFFLGAFKAFVNLSAVNNVN

SEQ ID NO: 3009406 - protein, 25 aa, Entamoeba invadens
NASGTRPCLYVPQTAFENLIAKQVK

SEQ ID NO: 3009407 - protein, 25 aa, Entamoeba invadens
NASGTRPCLYVPQTAFENLIAKQVR

SEQ ID NO: 3009408 - protein, 21 aa, Entamoeba invadens
NASLLQRWSNAIGRFPITFND

SEQ ID NO: 3009409 - protein, 29 aa, Entamoeba invadens
NASPNKLHFLPTYLFMPSPLSDLDNKILT

SEQ ID NO: 3009410 - protein, 32 aa, Entamoeba invadens
NASRIFRSIFEILLLKRWAQPALKALEISISV

SEQ ID NO: 3009411 - protein, 24 aa, Entamoeba invadens
NASTQFRQMFLNSLSLYYNQEKNT

SEQ ID NO: 3009412 - protein, 29 aa, Entamoeba invadens
NATKRYQVIFRFLFDLEYHRYLLARTMKK

SEQ ID NO: 3009413 - protein, 28 aa, Entamoeba invadens
NATSDNFMLFGRPFSWEDPIFIQKKETK

SEQ ID NO: 3009414 - protein, 31 aa, Entamoeba invadens
NAVAELAIGMMIYAFRNMFQPGTGIELRGKT

SEQ ID NO: 3009415 - protein, 27 aa, Entamoeba invadens
NAVCQELITRILFPKNTTQFDCKFDCW

SEQ ID NO: 3009416 - protein, 21 aa, Entamoeba invadens
NAVDCPLLKLYESFCYLISGR

SEQ ID NO: 3009417 - protein, 23 aa, Entamoeba invadens
NAVDVLCLKLIDAGLSVVRVISD

SEQ ID NO: 3009418 - protein, 25 aa, Entamoeba invadens
NAVDYLNLMKVYLDAVFLPRVRHDK

SEQ ID NO: 3009419 - protein, 28 aa, Entamoeba invadens
NAVFSLQLFRDFPLTTSPQFARIFHVAC

SEQ ID NO: 3009420 - protein, 32 aa, Entamoeba invadens
NAVISLRYRVPFKQVYFFDTFNCFVSSESKFT

SEQ ID NO: 3009421 - protein, 23 aa, Entamoeba invadens
NAVLLLINLGLFEYLTEAFDTLD

SEQ ID NO: 3009422 - protein, 21 aa, Entamoeba invadens
NAVRSFLMNNDLRAIIRAHEC

SEQ ID NO: 3009423 - protein, 25 aa, Entamoeba invadens
NAVVDMPIFILNKQVLKYLNTIDAM

SEQ ID NO: 3009424 - protein, 17 aa, Entamoeba invadens
NAYAQIKSLLFTHSSRG

SEQ ID NO: 3009425 - protein, 17 aa, Entamoeba invadens
NAYFKEKSAKRKANGDS

SEQ ID NO: 3009426 - protein, 18 aa, Entamoeba invadens
NAYGFLVVYSITDRVSFD

SEQ ID NO: 3009427 - protein, 20 aa, Entamoeba invadens
NAYIVSYLREQMPTFGKDKK

SEQ ID NO: 3009428 - protein, 19 aa, Entamoeba invadens
NAYTYDMRYMKTPYRIHSG

SEQ ID NO: 3009429 - protein, 26 aa, Entamoeba invadens
NCADNYYKLSGFCMKCGSPNVCTTCS

SEQ ID NO: 3009430 - protein, 17 aa, Entamoeba invadens
NCAVRICFFKFISEMLG

SEQ ID NO: 3009431 - protein, 18 aa, Entamoeba invadens
NCDLYNLTRNRNRLCFLV

SEQ ID NO: 3009432 - protein, 25 aa, Entamoeba invadens
NCDQKTIFFFFKKNLEDERCMIRFD

SEQ ID NO: 3009433 - protein, 30 aa, Entamoeba invadens
NCEEMNYLIKYPFMISNMLPRVVNVSIEKN

SEQ ID NO: 3009434 - protein, 18 aa, Entamoeba invadens
NCEKIPQNIWLFCEPDGL

SEQ ID NO: 3009435 - protein, 19 aa, Entamoeba invadens
NCEQIKSFYFCESVTQLKK

SEQ ID NO: 3009436 - protein, 22 aa, Entamoeba invadens
NCESLILNCAFLSCSHLTSVSI

SEQ ID NO: 3009437 - protein, 21 aa, Entamoeba invadens
NCFIFVLKENGIKRRRKYLIK

SEQ ID NO: 3009438 - protein, 18 aa, Entamoeba invadens
NCFKGKVLLYYFETLSLK

SEQ ID NO: 3009439 - protein, 18 aa, Entamoeba invadens
NCFLFTLKVDGKVQFQKF

SEQ ID NO: 3009440 - protein, 22 aa, Entamoeba invadens
NCFQFCTRLSFICLPNTLNILP

SEQ ID NO: 3009441 - protein, 24 aa, Entamoeba invadens
NCFRECFSLSSVKIPLSVKLFGNN

SEQ ID NO: 3009442 - protein, 34 aa, Entamoeba invadens
NCFTCSPDFSRKCKVCVIGFYPDDVFGKCVACAT

SEQ ID NO: 3009443 - protein, 25 aa, Entamoeba invadens
NCGIYTKYIFKTEKKDYYLGLNIEK

SEQ ID NO: 3009444 - protein, 25 aa, Entamoeba invadens
NCGRTGTAFIVTDFNIFVCTSCSGI

SEQ ID NO: 3009445 - protein, 27 aa, Entamoeba invadens
NCHQFEILMMDCAIMLKLAACNNYIQQ

SEQ ID NO: 3009446 - protein, 22 aa, Entamoeba invadens
NCIAPVISFVGYQLDCPRVFPS

SEQ ID NO: 3009447 - protein, 30 aa, Entamoeba invadens
NCIARGNYFHDIFPIMFYSDNGRNLLIENN

SEQ ID NO: 3009448 - protein, 26 aa, Entamoeba invadens
NCINLKEIKLPKLLKFIPDSCFNRCT

SEQ ID NO: 3009449 - protein, 26 aa, Entamoeba invadens
NCITLLPNCITLYPEQNEIAFAINNT

SEQ ID NO: 3009450 - protein, 20 aa, Entamoeba invadens
NCIVCGKIVHNGLYCSYCPA

SEQ ID NO: 3009451 - protein, 18 aa, Entamoeba invadens
NCKKILTFSIPQSVTYLS

SEQ ID NO: 3009452 - protein, 18 aa, Entamoeba invadens
NCKLKEIVFPKSLSFLGA

SEQ ID NO: 3009453 - protein, 17 aa, Entamoeba invadens
NCKSLSKIVLEYGLKSI

SEQ ID NO: 3009454 - protein, 23 aa, Entamoeba invadens
NCKSNFLAMKNDDSKTILLLDNS

SEQ ID NO: 3009455 - protein, 18 aa, Entamoeba invadens
NCLDIMPEATKALSSFCM

SEQ ID NO: 3009456 - protein, 25 aa, Entamoeba invadens
NCLGFPDIAYILLSTLSGLDYIHKS

SEQ ID NO: 3009457 - protein, 27 aa, Entamoeba invadens
NCLIVGMFELGNDLDIELLKNSSKYCL

SEQ ID NO: 3009458 - protein, 20 aa, Entamoeba invadens
NCLKALRRQLPMSKQKINWQ

SEQ ID NO: 3009459 - protein, 18 aa, Entamoeba invadens
NCLLCDTTRKLNIKGILC

SEQ ID NO: 3009460 - protein, 24 aa, Entamoeba invadens
NCLLRLYQNLIEKITFADNGTFEL

SEQ ID NO: 3009461 - protein, 20 aa, Entamoeba invadens
NCLNCCSGKRYICSNCLVTH

SEQ ID NO: 3009462 - protein, 21 aa, Entamoeba invadens
NCLPLYEIYHDTTSPCNQWML

SEQ ID NO: 3009463 - protein, 26 aa, Entamoeba invadens
NCLQLSFHKVFGISSLTLSNCQNILF

SEQ ID NO: 3009464 - protein, 17 aa, Entamoeba invadens
NCLRKMVDVFKAEWWFG

SEQ ID NO: 3009465 - protein, 17 aa, Entamoeba invadens
NCLSCKTGYYLSNGYCF

SEQ ID NO: 3009466 - protein, 18 aa, Entamoeba invadens
NCLTCDEGKFLINGRCLD

SEQ ID NO: 3009467 - protein, 25 aa, Entamoeba invadens
NCLTCKIYFYLTNGYCQPCDSSCNK

SEQ ID NO: 3009468 - protein, 26 aa, Entamoeba invadens
NCLTCRYYYYYLSNGYCLKCDSTCLR

SEQ ID NO: 3009469 - protein, 26 aa, Entamoeba invadens
NCLTKELFCFSFIDFFSTIDINTIPT

SEQ ID NO: 3009470 - protein, 23 aa, Entamoeba invadens
NCNETVFVGCPLLSRNGAIKKDN

SEQ ID NO: 3009471 - protein, 21 aa, Entamoeba invadens
NCNFAFYSWCDFAQSPVFSVM

SEQ ID NO: 3009472 - protein, 20 aa, Entamoeba invadens
NCNFVAPFEFMKNNFMLNVV

SEQ ID NO: 3009473 - protein, 24 aa, Entamoeba invadens
NCNFVTVFVFGIVNSALNVVELKM

SEQ ID NO: 3009474 - protein, 25 aa, Entamoeba invadens
NCNSLVQHEIPILQPLHVYVCQGHL

SEQ ID NO: 3009475 - protein, 25 aa, Entamoeba invadens
NCPTNLLCQCLFEAIFIDQLIEKMK

SEQ ID NO: 3009476 - protein, 17 aa, Entamoeba invadens
NCRALFVGLARNILTQI

SEQ ID NO: 3009477 - protein, 31 aa, Entamoeba invadens
NCRALYVGLTRSILLQLLEALTVLYKNGGSS

SEQ ID NO: 3009478 - protein, 18 aa, Entamoeba invadens
NCSKLEQLDFPKSLTFIK

SEQ ID NO: 3009479 - protein, 19 aa, Entamoeba invadens
NCSLERVLLFPKSEKILVE

SEQ ID NO: 3009480 - protein, 23 aa, Entamoeba invadens
NCSNCEFVFPLISSFQIESATCD

SEQ ID NO: 3009481 - protein, 17 aa, Entamoeba invadens
NCTGIVDYYTSKLIPFL

SEQ ID NO: 3009482 - protein, 22 aa, Entamoeba invadens
NCTKQKIIIPHLSPKPQRVCDQ

SEQ ID NO: 3009483 - protein, 17 aa, Entamoeba invadens
NCTNLTYVVLPNDLTKI

SEQ ID NO: 3009484 - protein, 19 aa, Entamoeba invadens
NCTSLSKVLFHRNVFALKS

SEQ ID NO: 3009485 - protein, 22 aa, Entamoeba invadens
NCVALKTITLPLKLTEIPEMCF

SEQ ID NO: 3009486 - protein, 23 aa, Entamoeba invadens
NCVAQLLRMLTINAVRGDVLSMV

SEQ ID NO: 3009487 - protein, 31 aa, Entamoeba invadens
NCVDMKRMDDAIWSEIYLHELDKCEYLGLYY

SEQ ID NO: 3009488 - protein, 17 aa, Entamoeba invadens
NCVTLTQIILNTNLTKL

SEQ ID NO: 3009489 - protein, 19 aa, Entamoeba invadens
NCWMTSRLYFGCLVAQSNL

SEQ ID NO: 3009490 - protein, 35 aa, Entamoeba invadens
NCYLNGFRSYLLTFSFLAKLLQPPSNFSSTTCLAK

SEQ ID NO: 3009491 - protein, 25 aa, Entamoeba invadens
NCYNITYCLTCDPQYYLSSTFTCEP

SEQ ID NO: 3009492 - protein, 28 aa, Entamoeba invadens
NDAFPTAFHIAGLWKIDRLVAEMKTVYD

SEQ ID NO: 3009493 - protein, 26 aa, Entamoeba invadens
NDAFQRFYVVVKKFLDFYSSLVDVEL

SEQ ID NO: 3009494 - protein, 18 aa, Entamoeba invadens
NDAFVLNNVTPESFLIFN

SEQ ID NO: 3009495 - protein, 18 aa, Entamoeba invadens
NDAKLGLKVLYKLMDTDN

SEQ ID NO: 3009496 - protein, 22 aa, Entamoeba invadens
NDALVKIKLSFRPGAVDAEKAV

SEQ ID NO: 3009497 - protein, 17 aa, Entamoeba invadens
NDANIVMFGLPKVGKTT

SEQ ID NO: 3009498 - protein, 37 aa, Entamoeba invadens
NDAPQKIALKIRKRGFVSQNVYIFRKMTDQQGIEVNL

SEQ ID NO: 3009499 - protein, 18 aa, Entamoeba invadens
NDARDLFFLDVPKVLSEK

SEQ ID NO: 3009500 - protein, 20 aa, Entamoeba invadens
NDCILFAGVLKEGKIVCLGK

SEQ ID NO: 3009501 - protein, 25 aa, Entamoeba invadens
NDCIYVVELAEKCKLFLLSGVDCAT

SEQ ID NO: 3009502 - protein, 24 aa, Entamoeba invadens
NDCLQTANLLYPVAYQRVEDLISN

SEQ ID NO: 3009503 - protein, 24 aa, Entamoeba invadens
NDCLQTANLLYPVAYQRVEDSISN

SEQ ID NO: 3009504 - protein, 21 aa, Entamoeba invadens
NDDFRCVCLPPPTGKGMRSSK

SEQ ID NO: 3009505 - protein, 22 aa, Entamoeba invadens
NDDFTYPWKIADFVTRGLRLPK

SEQ ID NO: 3009506 - protein, 18 aa, Entamoeba invadens
NDDIRIMRKYKGKTICFC

SEQ ID NO: 3009507 - protein, 25 aa, Entamoeba invadens
NDDKYGFIVMDGNGTLFGTLQGNTR

SEQ ID NO: 3009508 - protein, 28 aa, Entamoeba invadens
NDDLLIYLSLCHLQILRITAPVPPHTED

SEQ ID NO: 3009509 - protein, 25 aa, Entamoeba invadens
NDEDIETLIYVFTRIAGHCDLAETN

SEQ ID NO: 3009510 - protein, 25 aa, Entamoeba invadens
NDEFDDIFDIILYNGRWDAVNRKYV

SEQ ID NO: 3009511 - protein, 22 aa, Entamoeba invadens
NDEFLQMQTSHLSKKILMVGND

SEQ ID NO: 3009512 - protein, 24 aa, Entamoeba invadens
NDEFMLRVLYRLKCQLQLRFHQVS

SEQ ID NO: 3009513 - protein, 25 aa, Entamoeba invadens
NDEHFWEKVLPKLRTPSQLFKDLDA

SEQ ID NO: 3009514 - protein, 24 aa, Entamoeba invadens
NDEKNWITCLRGVNGYLFSGNNIS

SEQ ID NO: 3009515 - protein, 33 aa, Entamoeba invadens
NDENVYLVYVQRIDWLLDKSAWLEKSKAKRVVF

SEQ ID NO: 3009516 - protein, 28 aa, Entamoeba invadens
NDESTSYVILKYRKWQLKERKNVPLKMF

SEQ ID NO: 3009517 - protein, 27 aa, Entamoeba invadens
NDEVLFSEKWLLEEGAKFHNLVYSYMY

SEQ ID NO: 3009518 - protein, 21 aa, Entamoeba invadens
NDFCSYLHYTYMSFVKDNKDN

SEQ ID NO: 3009519 - protein, 24 aa, Entamoeba invadens
NDFITPKCKILKGQLIRCGSNIDN

SEQ ID NO: 3009520 - protein, 20 aa, Entamoeba invadens
NDFPFVNVEKLKISFLPLKC

SEQ ID NO: 3009521 - protein, 26 aa, Entamoeba invadens
NDFTSHIDYFLFVQRFYPSSKCFCGP

SEQ ID NO: 3009522 - protein, 25 aa, Entamoeba invadens
NDGKGFLALCHAYTKLTGENTFDYE

SEQ ID NO: 3009523 - protein, 27 aa, Entamoeba invadens
NDGLEILLVMCLWKIVCPEYIHFLRGN

SEQ ID NO: 3009524 - protein, 18 aa, Entamoeba invadens
NDGLFVDHMRMCYTKIMC

SEQ ID NO: 3009525 - protein, 22 aa, Entamoeba invadens
NDGLLICQIVDKIKPGSVNWNL

SEQ ID NO: 3009526 - protein, 26 aa, Entamoeba invadens
NDGLSLYQFPPFPIQIKQFTSISNID

SEQ ID NO: 3009527 - protein, 25 aa, Entamoeba invadens
NDGNWQILFAWKNIDLHNFLYRVAL

SEQ ID NO: 3009528 - protein, 27 aa, Entamoeba invadens
NDGSSITPAWLRFISDTPKSKMSFVVG

SEQ ID NO: 3009529 - protein, 25 aa, Entamoeba invadens
NDGYFQECFILAYRLVTTPERLLDL

SEQ ID NO: 3009530 - protein, 18 aa, Entamoeba invadens
NDIADRYLEIYNITQKVF

SEQ ID NO: 3009531 - protein, 19 aa, Entamoeba invadens
NDICDYKNWFVCDFEELKN

SEQ ID NO: 3009532 - protein, 19 aa, Entamoeba invadens
NDIFVIGKVDIRDDFKSEK

SEQ ID NO: 3009533 - protein, 34 aa, Entamoeba invadens
NDIHNSMEFIARFLQYWALKKIEVDYLIVCGDIC

SEQ ID NO: 3009534 - protein, 17 aa, Entamoeba invadens
NDIINGALMNSFSYFKK

SEQ ID NO: 3009535 - protein, 21 aa, Entamoeba invadens
NDIIQFENFRVISDSSRYVDD

SEQ ID NO: 3009536 - protein, 33 aa, Entamoeba invadens
NDIITVGTLPPLYDRFHKVSLSNSFLIGKKEYY

SEQ ID NO: 3009537 - protein, 25 aa, Entamoeba invadens
NDIKQKYHMLEKKNLIVFELSVKDS

SEQ ID NO: 3009538 - protein, 23 aa, Entamoeba invadens
NDILRVKTLLTNEKLTLVLCGNK

SEQ ID NO: 3009539 - protein, 32 aa, Entamoeba invadens
NDINKLFCVQPIPRLPRKFCSTIQIQMFSIFF

SEQ ID NO: 3009540 - protein, 25 aa, Entamoeba invadens
NDIPIHYFQIMVFAKELISHFHAQK

SEQ ID NO: 3009541 - protein, 19 aa, Entamoeba invadens
NDIRIFKTLTELPTLINVE

SEQ ID NO: 3009542 - protein, 21 aa, Entamoeba invadens
NDIRLAFFDLVSAQSVVVLKD

SEQ ID NO: 3009543 - protein, 25 aa, Entamoeba invadens
NDITVFISGIFYNVGFDMPKIYEID

SEQ ID NO: 3009544 - protein, 26 aa, Entamoeba invadens
NDIVGKEYFVFTTNTLINVERLVALE

SEQ ID NO: 3009545 - protein, 31 aa, Entamoeba invadens
NDIWFNDGLIFKHVIWYEVFYHNTFPQKEHG

SEQ ID NO: 3009546 - protein, 25 aa, Entamoeba invadens
NDIYDKNYWVLPPSGPEAWHGFPNI

SEQ ID NO: 3009547 - protein, 25 aa, Entamoeba invadens
NDKASFFFHVLPNGKLISKNKDFDL

SEQ ID NO: 3009548 - protein, 25 aa, Entamoeba invadens
NDKDWKVLLNFSRSMFRVLSKVMPQ

SEQ ID NO: 3009549 - protein, 17 aa, Entamoeba invadens
NDKEVEYLFWEGKTTGK

SEQ ID NO: 3009550 - protein, 17 aa, Entamoeba invadens
NDKFVIPSKIEVLDRCF

SEQ ID NO: 3009551 - protein, 22 aa, Entamoeba invadens
NDKGFFAFTLNNSRSVPPTKFT

SEQ ID NO: 3009552 - protein, 24 aa, Entamoeba invadens
NDKGRFYAFGRVFSGTIRTGGKAR

SEQ ID NO: 3009553 - protein, 22 aa, Entamoeba invadens
NDKNLFSFIQKALPKELQVVKD

SEQ ID NO: 3009554 - protein, 23 aa, Entamoeba invadens
NDKNLFSFIQKALPKELQVVKDF

SEQ ID NO: 3009555 - protein, 17 aa, Entamoeba invadens
NDKPTNLKFGDANFENK

SEQ ID NO: 3009556 - protein, 24 aa, Entamoeba invadens
NDKQIAAILTRCMFLYGELEMCKK

SEQ ID NO: 3009557 - protein, 25 aa, Entamoeba invadens
NDKTLEYFMLLEEICNFTKQFSLDP

SEQ ID NO: 3009558 - protein, 24 aa, Entamoeba invadens
NDKTLMVWDIRKPDVPIKTLQNHT

SEQ ID NO: 3009559 - protein, 29 aa, Entamoeba invadens
NDKTSYQIRLLLTYKNILKKQPTIQDESI

SEQ ID NO: 3009560 - protein, 26 aa, Entamoeba invadens
NDLDENTFIFLFKIKAENDVIEPNVF

SEQ ID NO: 3009561 - protein, 22 aa, Entamoeba invadens
NDLELIVCVCTYGVGVYNLYIQ

SEQ ID NO: 3009562 - protein, 20 aa, Entamoeba invadens
NDLFIAVAELFKFPQYVQFW

SEQ ID NO: 3009563 - protein, 23 aa, Entamoeba invadens
NDLHAILSILQFHFDEQLAFHLQ

SEQ ID NO: 3009564 - protein, 18 aa, Entamoeba invadens
NDLKRVIGLVSLSVVWRI

SEQ ID NO: 3009565 - protein, 37 aa, Entamoeba invadens
NDLKTLFNCAQPIRFPILLPVLLELVFKQICPLDLYV

SEQ ID NO: 3009566 - protein, 22 aa, Entamoeba invadens
NDLLLKIFCFLSSDEIAQMPFI

SEQ ID NO: 3009567 - protein, 20 aa, Entamoeba invadens
NDLYKELISLGFDQIKDPKK

SEQ ID NO: 3009568 - protein, 25 aa, Entamoeba invadens
NDMCNLFAQGPFIKQRNLSLFKLYD

SEQ ID NO: 3009569 - protein, 27 aa, Entamoeba invadens
NDMERGIWGLYFAMIAQRLALVKLDVE

SEQ ID NO: 3009570 - protein, 27 aa, Entamoeba invadens
NDMIIPDIHRLVVWYPVSLQESKTLFS

SEQ ID NO: 3009571 - protein, 26 aa, Entamoeba invadens
NDMKLLISLAKCSLIKTPNAFNGLVA

SEQ ID NO: 3009572 - protein, 23 aa, Entamoeba invadens
NDMTGARKFLCSGPLFIVEKVME

SEQ ID NO: 3009573 - protein, 27 aa, Entamoeba invadens
NDNGNLYFYNTKTFAFIKSLCLSYAPI

SEQ ID NO: 3009574 - protein, 26 aa, Entamoeba invadens
NDNGNWIRRMYFWEGKRTNELYYTQF

SEQ ID NO: 3009575 - protein, 25 aa, Entamoeba invadens
NDNGVVFQFLEPHSAPFVLPNEVCL

SEQ ID NO: 3009576 - protein, 17 aa, Entamoeba invadens
NDNKTVVPLKRFVVYKL

SEQ ID NO: 3009577 - protein, 32 aa, Entamoeba invadens
NDNTRILANRYPYFLVKNKHVPLFLQNYCLKT

SEQ ID NO: 3009578 - protein, 20 aa, Entamoeba invadens
NDPDFLWEVPKTLEMPEDVR

SEQ ID NO: 3009579 - protein, 25 aa, Entamoeba invadens
NDPKQIEILLKYKPDTKLKDNNGRN

SEQ ID NO: 3009580 - protein, 22 aa, Entamoeba invadens
NDPLCVLKPWDVGYYSQKYLLQ

SEQ ID NO: 3009581 - protein, 34 aa, Entamoeba invadens
NDPLYGFAQSYLRLLSFYLPMDSVGFAPNSVLRE

SEQ ID NO: 3009582 - protein, 28 aa, Entamoeba invadens
NDPPVKTVFVFLFNDLLIVTKVKKFNDN

SEQ ID NO: 3009583 - protein, 30 aa, Entamoeba invadens
NDPQKLANLPKSLPFVLKIDSFKKGVFTVG

SEQ ID NO: 3009584 - protein, 38 aa, Entamoeba invadens
NDPQQIQDLAFFKNKFQDLLLDIPEPQPILTCNNTTTI

SEQ ID NO: 3009585 - protein, 22 aa, Entamoeba invadens
NDQERVLRQMLWFGDYSFASEQ

SEQ ID NO: 3009586 - protein, 17 aa, Entamoeba invadens
NDQFYMCSDSFKGFLKC

SEQ ID NO: 3009587 - protein, 23 aa, Entamoeba invadens
NDQKTLLEMDLSQEKDKSKHLYD

SEQ ID NO: 3009588 - protein, 19 aa, Entamoeba invadens
NDQNNPFLMPFAVGMTQAN

SEQ ID NO: 3009589 - protein, 25 aa, Entamoeba invadens
NDQTTYVIALPAPLPEIVHDTQPGF

SEQ ID NO: 3009590 - protein, 40 aa, Entamoeba invadens
NDQYVPSYLIQPIQRIPRYVLLLETLLKCLPDYLEEKLLI

SEQ ID NO: 3009591 - protein, 22 aa, Entamoeba invadens
NDRIKQVVLLLNTLPEENYVVI

SEQ ID NO: 3009592 - protein, 22 aa, Entamoeba invadens
NDRMINPILKFLEGILTIELVD

SEQ ID NO: 3009593 - protein, 19 aa, Entamoeba invadens
NDRVLFRLMLLHKNVNCCF

SEQ ID NO: 3009594 - protein, 27 aa, Entamoeba invadens
NDSFPNAKRLVLLLPGEENKDFENITK

SEQ ID NO: 3009595 - protein, 20 aa, Entamoeba invadens
NDSILIILDCRPYTNAYANR

SEQ ID NO: 3009596 - protein, 24 aa, Entamoeba invadens
NDSNTTNFAFSLSKSTLNVEEVSP

SEQ ID NO: 3009597 - protein, 24 aa, Entamoeba invadens
NDTEMFVYHVVRWLNKIVSFQPVR

SEQ ID NO: 3009598 - protein, 39 aa, Entamoeba invadens
NDTKPHNLILHFFYNIFITLKFLWKYFCNGLCDSLIHCN

SEQ ID NO: 3009599 - protein, 23 aa, Entamoeba invadens
NDTKTIIMKTFDAAQTLVEKASL

SEQ ID NO: 3009600 - protein, 31 aa, Entamoeba invadens
NDTKWYCLPRLIFISLRWKLEMWDCIKEVII

SEQ ID NO: 3009601 - protein, 21 aa, Entamoeba invadens
NDTLFLDKLVTFLTTNKTCVV

SEQ ID NO: 3009602 - protein, 48 aa, Entamoeba invadens
NDTNIIHLLQYYFESYALNMFFVVDKCLFILEFLQKIEFISALQSIVI

SEQ ID NO: 3009603 - protein, 59 aa, Entamoeba invadens
NDTRDDWACLKIYKFILPFLFKHNNLEYLVRMRIEITPYTIPMLITLVMSRFSDQISHE

SEQ ID NO: 3009604 - protein, 29 aa, Entamoeba invadens
NDTRVRDIILRVHNIWMSISDTITQPNTE

SEQ ID NO: 3009605 - protein, 28 aa, Entamoeba invadens
NDTSYYLNYLLYSAFLISLGNDGKRTAK

SEQ ID NO: 3009606 - protein, 17 aa, Entamoeba invadens
NDVCYFHNLKYDGSFLA

SEQ ID NO: 3009607 - protein, 18 aa, Entamoeba invadens
NDVDYVIYFPVKDISREL

SEQ ID NO: 3009608 - protein, 22 aa, Entamoeba invadens
NDVERMLVVASNQIREIYDVSS

SEQ ID NO: 3009609 - protein, 20 aa, Entamoeba invadens
NDVLFEHLYQQQLEYQQNAQ

SEQ ID NO: 3009610 - protein, 26 aa, Entamoeba invadens
NDVSGIIQLFLFTGQYTRLSQQLLVD

SEQ ID NO: 3009611 - protein, 17 aa, Entamoeba invadens
NDVVHLLEDLLFEDNIT

SEQ ID NO: 3009612 - protein, 32 aa, Entamoeba invadens
NDWVEMDNFCIFKLFAKGKNCWNMWKQNPSDK

SEQ ID NO: 3009613 - protein, 26 aa, Entamoeba invadens
NDYAKTPFLCNPFLPLAPSISLPFSL

SEQ ID NO: 3009614 - protein, 17 aa, Entamoeba invadens
NDYCYLANEYHYTSIEN

SEQ ID NO: 3009615 - protein, 24 aa, Entamoeba invadens
NDYDVMFSFGFGLDLCICKTNSGI

SEQ ID NO: 3009616 - protein, 25 aa, Entamoeba invadens
NDYETELILYNTFLLSLQSNDKHYL

SEQ ID NO: 3009617 - protein, 18 aa, Entamoeba invadens
NDYFRNSLNRQMVLSIID

SEQ ID NO: 3009618 - protein, 22 aa, Entamoeba invadens
NDYTSLRYMFTDMHLFLKDEAE

SEQ ID NO: 3009619 - protein, 32 aa, Entamoeba invadens
NDYTSLTFILTTLFTLFFYQSNVSISEEYLFE

SEQ ID NO: 3009620 - protein, 30 aa, Entamoeba invadens
NEAKFDREFIRLRRFVFGMCKKNFPKIYGQ

SEQ ID NO: 3009621 - protein, 25 aa, Entamoeba invadens
NEAKGANFIRPVFVPDSESPECALC

SEQ ID NO: 3009622 - protein, 25 aa, Entamoeba invadens
NEALTGLHFVMKHLDGRELYVESKD

SEQ ID NO: 3009623 - protein, 25 aa, Entamoeba invadens
NEARHQCEFLIYGKKQPSLEKIKGM

SEQ ID NO: 3009624 - protein, 28 aa, Entamoeba invadens
NEASNIKFLYVLKNVFYMFAKNGNNVMD

SEQ ID NO: 3009625 - protein, 33 aa, Entamoeba invadens
NEATTLFLGDILHKLTFICYGNSVKSGPSGLRG

SEQ ID NO: 3009626 - protein, 22 aa, Entamoeba invadens
NECFALFEYGKSITLGWENPTI

SEQ ID NO: 3009627 - protein, 23 aa, Entamoeba invadens
NECKNIISVLIPTGLTSIGIQCF

SEQ ID NO: 3009628 - protein, 24 aa, Entamoeba invadens
NECYRTHMRWIVNNFGITESKRNY

SEQ ID NO: 3009629 - protein, 26 aa, Entamoeba invadens
NEDAQIYNFIARWLAETFELGSEARK

SEQ ID NO: 3009630 - protein, 31 aa, Entamoeba invadens
NEDDPYKRMKLITLWYLTGFSNAMKLVRKPY

SEQ ID NO: 3009631 - protein, 25 aa, Entamoeba invadens
NEDEKRYYYLRAMSGYLSGVKTSGD

SEQ ID NO: 3009632 - protein, 26 aa, Entamoeba invadens
NEDFEQWLNYYGDITRYVLRDVQKGY

SEQ ID NO: 3009633 - protein, 31 aa, Entamoeba invadens
NEDGKNWREIYKSLLVLDNVLKNGSEEAVEI

SEQ ID NO: 3009634 - protein, 26 aa, Entamoeba invadens
NEDGVTPLIYAIQLGFDDVVTELLRI

SEQ ID NO: 3009635 - protein, 28 aa, Entamoeba invadens
NEDLRQLLFLFIAELLRFQDTLPKKIVS

SEQ ID NO: 3009636 - protein, 31 aa, Entamoeba invadens
NEDLVISTLTRRAIFKLFCTFGASSYGYKLL

SEQ ID NO: 3009637 - protein, 24 aa, Entamoeba invadens
NEDQIPIMFTVFSSAGYNGNNKAG

SEQ ID NO: 3009638 - protein, 34 aa, Entamoeba invadens
NEDTASYYEISRGNKLLLFDLKEVYDCAHGIKGI

SEQ ID NO: 3009639 - protein, 17 aa, Entamoeba invadens
NEDTLFSKLIDFDNKEY

SEQ ID NO: 3009640 - protein, 29 aa, Entamoeba invadens
NEDVIFDYINRLYIYPIDIVYGKEKKRKS

SEQ ID NO: 3009641 - protein, 26 aa, Entamoeba invadens
NEDVIRSLLKLNPQLDPTIIKKLCDE

SEQ ID NO: 3009642 - protein, 28 aa, Entamoeba invadens
NEDVVSGILFITTFRIIFCPFDEVQVNK

SEQ ID NO: 3009643 - protein, 27 aa, Entamoeba invadens
NEDWITKRLLILLGKRNFWCLVCNEKI

SEQ ID NO: 3009644 - protein, 19 aa, Entamoeba invadens
NEEARTSCLAFIEAMNKRI

SEQ ID NO: 3009645 - protein, 21 aa, Entamoeba invadens
NEEEHMIVLGLLEKMTKEIHV

SEQ ID NO: 3009646 - protein, 25 aa, Entamoeba invadens
NEEFDSWFLLLNSKGEMEKTIATTF

SEQ ID NO: 3009647 - protein, 29 aa, Entamoeba invadens
NEEHWNKRRAVFYDNLLSLYQENSLEKLC

SEQ ID NO: 3009648 - protein, 31 aa, Entamoeba invadens
NEEIRITINDTLMFFLPLKGKSVEVNEIHTY

SEQ ID NO: 3009649 - protein, 24 aa, Entamoeba invadens
NEEKKKILMLIDNNEPHLKLLEKA

SEQ ID NO: 3009650 - protein, 25 aa, Entamoeba invadens
NEEKQIFFISDIETIALHKSFKKLE

SEQ ID NO: 3009651 - protein, 18 aa, Entamoeba invadens
NEEKRVFFLSDKMGMVYS

SEQ ID NO: 3009652 - protein, 25 aa, Entamoeba invadens
NEEKRYFVQVIWQDNKKQKVIVDKL

SEQ ID NO: 3009653 - protein, 19 aa, Entamoeba invadens
NEELGIENVYLMCSNKSVQ

SEQ ID NO: 3009654 - protein, 19 aa, Entamoeba invadens
NEELLNIKKEFVALNSKYE

SEQ ID NO: 3009655 - protein, 22 aa, Entamoeba invadens
NEELVPFPLSTVYSGGIYNCHG

SEQ ID NO: 3009656 - protein, 17 aa, Entamoeba invadens
NEEMLFDIVNDPNMLML

SEQ ID NO: 3009657 - protein, 24 aa, Entamoeba invadens
NEENKIAWIVYKKGLGDFVVYVKT

SEQ ID NO: 3009658 - protein, 25 aa, Entamoeba invadens
NEEPPFSMDLFLSDSGYDGKKNIFI

SEQ ID NO: 3009659 - protein, 29 aa, Entamoeba invadens
NEEQFVKYFETFGPLRKNPDNKFQVLFAS

SEQ ID NO: 3009660 - protein, 27 aa, Entamoeba invadens
NEERLIQFYRAVLLYRNIKTENVRSWV

SEQ ID NO: 3009661 - protein, 24 aa, Entamoeba invadens
NEESQFWGFFAVTITEMRYKPLTK

SEQ ID NO: 3009662 - protein, 24 aa, Entamoeba invadens
NEETLCQIVKERETFKCQMKEQNE

SEQ ID NO: 3009663 - protein, 19 aa, Entamoeba invadens
NEFFISGVKYLKFVDQSSL

SEQ ID NO: 3009664 - protein, 25 aa, Entamoeba invadens
NEFIKALLMLHFGTDIEGALKMLQD

SEQ ID NO: 3009665 - protein, 24 aa, Entamoeba invadens
NEFIVYLSPMRDLVLQLTRPNVRE

SEQ ID NO: 3009666 - protein, 34 aa, Entamoeba invadens
NEFLRSVDPNYLIKSYFDELKGWVGKEEFTIVFD

SEQ ID NO: 3009667 - protein, 18 aa, Entamoeba invadens
NEFNILVKYLNDNLDRLI

SEQ ID NO: 3009668 - protein, 27 aa, Entamoeba invadens
NEFTSRQILEILSIDLQKGGELFNRLI

SEQ ID NO: 3009669 - protein, 18 aa, Entamoeba invadens
NEFVIFKEYFHDLAVKDE

SEQ ID NO: 3009670 - protein, 21 aa, Entamoeba invadens
NEGGNLIQMAGEKMGLGEAIS

SEQ ID NO: 3009671 - protein, 24 aa, Entamoeba invadens
NEGIERKRLFLDGKYRDCYIYSLL

SEQ ID NO: 3009672 - protein, 26 aa, Entamoeba invadens
NEGLNTRLPLTLTFDRLPQNVETMVR

SEQ ID NO: 3009673 - protein, 27 aa, Entamoeba invadens
NEGNNITTILRLVGLLSGRTIQQITTR

SEQ ID NO: 3009674 - protein, 24 aa, Entamoeba invadens
NEGQLLSLAFYIGQKSGTRVPKRK

SEQ ID NO: 3009675 - protein, 24 aa, Entamoeba invadens
NEGVESYFKIKANFMPVALKTRVA

SEQ ID NO: 3009676 - protein, 24 aa, Entamoeba invadens
NEHFFDLMEILKALLKGRKVLEKV

SEQ ID NO: 3009677 - protein, 25 aa, Entamoeba invadens
NEHFKIACFLFPPERDKYLNLRDQE

SEQ ID NO: 3009678 - protein, 24 aa, Entamoeba invadens
NEHLFELNIPDTFFLELSKEKMEN

SEQ ID NO: 3009679 - protein, 22 aa, Entamoeba invadens
NEHMNLIGNLVFGVCVSLKEVA

SEQ ID NO: 3009680 - protein, 18 aa, Entamoeba invadens
NEIAVRQLRVENTKLRCS

SEQ ID NO: 3009681 - protein, 21 aa, Entamoeba invadens
NEIFKNFHIELHATSLDDLKE

SEQ ID NO: 3009682 - protein, 18 aa, Entamoeba invadens
NEIGCFCVFATHFHEVTA

SEQ ID NO: 3009683 - protein, 30 aa, Entamoeba invadens
NEIGTLCFVELSPILFKVVWRTEIDFEGMT

SEQ ID NO: 3009684 - protein, 23 aa, Entamoeba invadens
NEIKSNCFVFFKLVKNNFKSNKM

SEQ ID NO: 3009685 - protein, 23 aa, Entamoeba invadens
NEIKYPMMVLEKSTTEQIRAIQD

SEQ ID NO: 3009686 - protein, 18 aa, Entamoeba invadens
NEILKLQNRLTEVTRMSA

SEQ ID NO: 3009687 - protein, 17 aa, Entamoeba invadens
NEIMLGLYTISSALDFL

SEQ ID NO: 3009688 - protein, 19 aa, Entamoeba invadens
NEIMTVFDALPLAVIVSST

SEQ ID NO: 3009689 - protein, 29 aa, Entamoeba invadens
NEIPIVQNTFLISLLNLTHKITLFQSSKH

SEQ ID NO: 3009690 - protein, 24 aa, Entamoeba invadens
NEIPKYLEEILKKAWKDKPTSRSD

SEQ ID NO: 3009691 - protein, 25 aa, Entamoeba invadens
NEITQLPLNFSLLTALTQLQLENNP

SEQ ID NO: 3009692 - protein, 27 aa, Entamoeba invadens
NEIVDEKTRRLFEQLQRDMAEKQAADI

SEQ ID NO: 3009693 - protein, 17 aa, Entamoeba invadens
NEIVIPHFVKEVGWMCF

SEQ ID NO: 3009694 - protein, 18 aa, Entamoeba invadens
NEIVVFSDHFCYSACSIF

SEQ ID NO: 3009695 - protein, 24 aa, Entamoeba invadens
NEKDKIVEQIKTIEFDKNTFKKEL

SEQ ID NO: 3009696 - protein, 27 aa, Entamoeba invadens
NEKDTEYYLKAYYSDVACVSIQYEEVF

SEQ ID NO: 3009697 - protein, 22 aa, Entamoeba invadens
NEKFKVIYIAPMKSLVQEMVGT

SEQ ID NO: 3009698 - protein, 25 aa, Entamoeba invadens
NEKHLLCQFRMNCSFFGLLVDTQVN

SEQ ID NO: 3009699 - protein, 25 aa, Entamoeba invadens
NEKIDFTIYKLLKNKYKFEGDVVLF

SEQ ID NO: 3009700 - protein, 17 aa, Entamoeba invadens
NEKIMMSGVVLSIEMSA

SEQ ID NO: 3009701 - protein, 24 aa, Entamoeba invadens
NEKIYWLTILCTSLAHRTNFTKYG

SEQ ID NO: 3009702 - protein, 17 aa, Entamoeba invadens
NEKKLCYVLDGISLKEI

SEQ ID NO: 3009703 - protein, 23 aa, Entamoeba invadens
NEKKSMYALMYNTLSQHIITTNF

SEQ ID NO: 3009704 - protein, 33 aa, Entamoeba invadens
NEKKVQSMFWRYLRMFLYLKYNIKTIVSKKTHI

SEQ ID NO: 3009705 - protein, 17 aa, Entamoeba invadens
NEKLRKLVFPASYTHIV

SEQ ID NO: 3009706 - protein, 23 aa, Entamoeba invadens
NEKNLITFSGIEQHKKIKDVQFE

SEQ ID NO: 3009707 - protein, 19 aa, Entamoeba invadens
NEKQFFTVFAKDQNGRTVG

SEQ ID NO: 3009708 - protein, 17 aa, Entamoeba invadens
NEKRTLINSFKLKIHKL

SEQ ID NO: 3009709 - protein, 30 aa, Entamoeba invadens
NEKSKDYLFSVPNFFVFKKKECKVIEGFEK

SEQ ID NO: 3009710 - protein, 23 aa, Entamoeba invadens
NEKSLYHIIKPEIDFPEGTLDTD

SEQ ID NO: 3009711 - protein, 31 aa, Entamoeba invadens
NEKSPDFFISVAYIYTFAFLKENKKIDDQKI

SEQ ID NO: 3009712 - protein, 22 aa, Entamoeba invadens
NEKTIYDFVVRSYLANLSDDAR

SEQ ID NO: 3009713 - protein, 18 aa, Entamoeba invadens
NEKTLWENAFNLIKDINE

SEQ ID NO: 3009714 - protein, 27 aa, Entamoeba invadens
NEKTTIMVEKLAFISGGLESSNTLTKN

SEQ ID NO: 3009715 - protein, 17 aa, Entamoeba invadens
NEKVNFRILKDGDIITL

SEQ ID NO: 3009716 - protein, 28 aa, Entamoeba invadens
NELALYEFIHFLIQIYDVLFDNACEIDI

SEQ ID NO: 3009717 - protein, 31 aa, Entamoeba invadens
NELEFIQIITMLSPLVRPIGVFRFPINSTIT

SEQ ID NO: 3009718 - protein, 26 aa, Entamoeba invadens
NELENWINFLLYRDWKNIIKPDYSIW

SEQ ID NO: 3009719 - protein, 28 aa, Entamoeba invadens
NELGLCFICGEFGHPAFRCPLKKSEEMK

SEQ ID NO: 3009720 - protein, 20 aa, Entamoeba invadens
NELILQKIHPSSVISGFRLA

SEQ ID NO: 3009721 - protein, 18 aa, Entamoeba invadens
NELKIDVMFVREMQSKKK

SEQ ID NO: 3009722 - protein, 17 aa, Entamoeba invadens
NELKLLSTSWKLSKEQG

SEQ ID NO: 3009723 - protein, 26 aa, Entamoeba invadens
NELKRVCVELLKMIPNIFKKASEVVG

SEQ ID NO: 3009724 - protein, 24 aa, Entamoeba invadens
NELKTLLEKFKLPATPYDIQNVMT

SEQ ID NO: 3009725 - protein, 22 aa, Entamoeba invadens
NELLFLFYSNYPFLNSFKSFLQ

SEQ ID NO: 3009726 - protein, 25 aa, Entamoeba invadens
NELLIDIFEYRFPITSLSFTTESIY

SEQ ID NO: 3009727 - protein, 32 aa, Entamoeba invadens
NELLMTRFYTCRNLILTPLRLSVKIPEVKDVA

SEQ ID NO: 3009728 - protein, 24 aa, Entamoeba invadens
NELLPYFEIILKKRSLSAEFLIEM

SEQ ID NO: 3009729 - protein, 39 aa, Entamoeba invadens
NELLQYINIFKTTEPILILYFLEQIPLVGKVYGTKEFEL

SEQ ID NO: 3009730 - protein, 27 aa, Entamoeba invadens
NELMMGERLVRDIGLFLGKYIGQYLVK

SEQ ID NO: 3009731 - protein, 41 aa, Entamoeba invadens
NELPLHIYLSWYEQKAVCILLTVIYLGLKNVFYGPTKPAFL

SEQ ID NO: 3009732 - protein, 28 aa, Entamoeba invadens
NELQTLRNFHIHFVLLGDVLTPTSHTRT

SEQ ID NO: 3009733 - protein, 17 aa, Entamoeba invadens
NELRCSFNCEYQIIVKP

SEQ ID NO: 3009734 - protein, 25 aa, Entamoeba invadens
NELRKSLNSILDFVEKLQIEATNRL

SEQ ID NO: 3009735 - protein, 18 aa, Entamoeba invadens
NELTSTFWQRCNASHLNS

SEQ ID NO: 3009736 - protein, 18 aa, Entamoeba invadens
NELVGFENLLKIGDSAFS

SEQ ID NO: 3009737 - protein, 17 aa, Entamoeba invadens
NELVNIERLNFIMDTLE

SEQ ID NO: 3009738 - protein, 26 aa, Entamoeba invadens
NEMDKMTMKIEWTKKSKWKNIKLIQE

SEQ ID NO: 3009739 - protein, 26 aa, Entamoeba invadens
NEMDTFILPDKKYLNLAKIRSLSEFL

SEQ ID NO: 3009740 - protein, 20 aa, Entamoeba invadens
NEMFMMDKPLQKPINIFEEK

SEQ ID NO: 3009741 - protein, 21 aa, Entamoeba invadens
NEMFYLFCYDNISLSCYENIQ

SEQ ID NO: 3009742 - protein, 29 aa, Entamoeba invadens
NEMKFKDQAVWMLNAMWPKDGDSKAEEIW

SEQ ID NO: 3009743 - protein, 29 aa, Entamoeba invadens
NEMLLYKKKLIAQKFFLMNPQLNIKVYDV

SEQ ID NO: 3009744 - protein, 17 aa, Entamoeba invadens
NEMLYRTHLTQNEFFEV

SEQ ID NO: 3009745 - protein, 22 aa, Entamoeba invadens
NEMNALNVIGLFFAIKSPNEQP

SEQ ID NO: 3009746 - protein, 51 aa, Entamoeba invadens
NEMSKDLDGKVFRTTKIKLVCIDDCGTTLRKCFICGMYGHKSQDCLEKKGT

SEQ ID NO: 3009747 - protein, 24 aa, Entamoeba invadens
NEMSLFVQLNYPALAQHFKLERRR

SEQ ID NO: 3009748 - protein, 23 aa, Entamoeba invadens
NEMYMTIYAYPKNATLLNVNLSM

SEQ ID NO: 3009749 - protein, 33 aa, Entamoeba invadens
NENEIPTISKLLRYFFHFSKGTCPYIVEYNSNL

SEQ ID NO: 3009750 - protein, 31 aa, Entamoeba invadens
NENETNILMQRRKLVILKSVEQLAKSLKSVK

SEQ ID NO: 3009751 - protein, 17 aa, Entamoeba invadens
NENEVLTLLKYLTSVTG

SEQ ID NO: 3009752 - protein, 18 aa, Entamoeba invadens
NENFFTYQFSFNPELEQY

SEQ ID NO: 3009753 - protein, 37 aa, Entamoeba invadens
NENFKKFYELLKLYGYKMPLFDKLKSWNSIMWESSKV

SEQ ID NO: 3009754 - protein, 26 aa, Entamoeba invadens
NENFLFNPLFFFNHLERQYMVTVSKY

SEQ ID NO: 3009755 - protein, 18 aa, Entamoeba invadens
NENLIRQYSSRQIRGMYA

SEQ ID NO: 3009756 - protein, 30 aa, Entamoeba invadens
NENSRLLYVGVLKWIAMSFPKQLEKKLPRN

SEQ ID NO: 3009757 - protein, 27 aa, Entamoeba invadens
NENTLQPLMSFLINSIPNPNYTKIIIE

SEQ ID NO: 3009758 - protein, 24 aa, Entamoeba invadens
NENTRIELLKLLEKYFVIGGFNKE

SEQ ID NO: 3009759 - protein, 22 aa, Entamoeba invadens
NEPTVFLEYALDVARIAKAKGL

SEQ ID NO: 3009760 - protein, 24 aa, Entamoeba invadens
NEQEIFCVMLRLVKGRKCYSMPII

SEQ ID NO: 3009761 - protein, 26 aa, Entamoeba invadens
NEQFVHMLLHGVLRIFYENDGVYQLT

SEQ ID NO: 3009762 - protein, 26 aa, Entamoeba invadens
NEQPLFVIHILWQRVLQKVVLKDDDF

SEQ ID NO: 3009763 - protein, 22 aa, Entamoeba invadens
NERAYPIWMYKEAIHGEGDLLK

SEQ ID NO: 3009764 - protein, 19 aa, Entamoeba invadens
NEREFINLVIKEKAAFIPT

SEQ ID NO: 3009765 - protein, 23 aa, Entamoeba invadens
NERENVCFFVFVKGKPDVCVGCV

SEQ ID NO: 3009766 - protein, 45 aa, Entamoeba invadens
NERFYINKLFQFVLGFLLRELATTFFRLCCYIPVFISKLSKTPSA

SEQ ID NO: 3009767 - protein, 30 aa, Entamoeba invadens
NERHLPVTLPFLFHVLITTFFGVEPNTLEK

SEQ ID NO: 3009768 - protein, 31 aa, Entamoeba invadens
NERLQSYLKMEIPNVVELPQKVIPMEMDKSQ

SEQ ID NO: 3009769 - protein, 26 aa, Entamoeba invadens
NERLSIQIAENQKRLTEMQKSIENGE

SEQ ID NO: 3009770 - protein, 24 aa, Entamoeba invadens
NERNVEALVFNKHNLQTPGSRREQ

SEQ ID NO: 3009771 - protein, 22 aa, Entamoeba invadens
NERPLLFVFRELDPLCTVEYEN

SEQ ID NO: 3009772 - protein, 24 aa, Entamoeba invadens
NERRIREFMKLKYQDKRWFDQNAF

SEQ ID NO: 3009773 - protein, 25 aa, Entamoeba invadens
NERSRNLLGWLFNLMIEVSKNRDTN

SEQ ID NO: 3009774 - protein, 19 aa, Entamoeba invadens
NERVYLTSVLLLNEKMKTI

SEQ ID NO: 3009775 - protein, 17 aa, Entamoeba invadens
NESEIFKLLQIAHRNRS

SEQ ID NO: 3009776 - protein, 24 aa, Entamoeba invadens
NESFLLLHKTFVLYPDLVDVIVKS

SEQ ID NO: 3009777 - protein, 26 aa, Entamoeba invadens
NESIEDFLVLIYNKVLEMYNIGMYQA

SEQ ID NO: 3009778 - protein, 18 aa, Entamoeba invadens
NESLLSLTVLEEDYRICC

SEQ ID NO: 3009779 - protein, 33 aa, Entamoeba invadens
NESRPKLLFELFAPLFRFKDQALTLAGVHEDVE

SEQ ID NO: 3009780 - protein, 24 aa, Entamoeba invadens
NESVKHFLGFVQQYYEVPQREIDR

SEQ ID NO: 3009781 - protein, 22 aa, Entamoeba invadens
NESWDWKNEKFSDEEEIELGDY

SEQ ID NO: 3009782 - protein, 25 aa, Entamoeba invadens
NETETPIIIFQPKTMNPPKPNFNPT

SEQ ID NO: 3009783 - protein, 24 aa, Entamoeba invadens
NETFTFNNVYPGTTAEFQVMDFDK

SEQ ID NO: 3009784 - protein, 27 aa, Entamoeba invadens
NETKKDITVIPLPKQSFGKSILEQMKR

SEQ ID NO: 3009785 - protein, 31 aa, Entamoeba invadens
NETKVLVVCDGLLYLFWSESGILCCSPVVLT

SEQ ID NO: 3009786 - protein, 22 aa, Entamoeba invadens
NETMLCLPFNELTQFCLKKTKN

SEQ ID NO: 3009787 - protein, 25 aa, Entamoeba invadens
NETRLRIAVMFLRKLYSDALNSKAR

SEQ ID NO: 3009788 - protein, 24 aa, Entamoeba invadens
NETSYGTVFLNKDKTYPFTSKNSN

SEQ ID NO: 3009789 - protein, 24 aa, Entamoeba invadens
NETTNLLDFLRRVFVYDPSKRMSA

SEQ ID NO: 3009790 - protein, 29 aa, Entamoeba invadens
NETVRNALWQLFLTWSGVFPLETLNQIRM

SEQ ID NO: 3009791 - protein, 17 aa, Entamoeba invadens
NETVVFMKWRRGSTRNS

SEQ ID NO: 3009792 - protein, 29 aa, Entamoeba invadens
NEVFFIQHCLFLLVESLKLITYRNLFNTA

SEQ ID NO: 3009793 - protein, 28 aa, Entamoeba invadens
NEVKAFPGALEILKKLKGLGMKVAIATS

SEQ ID NO: 3009794 - protein, 23 aa, Entamoeba invadens
NEVKPLFVLKINQFKRVVEFLVV

SEQ ID NO: 3009795 - protein, 27 aa, Entamoeba invadens
NEVLDHFNIPFDNPCILLMQETSKTFL

SEQ ID NO: 3009796 - protein, 19 aa, Entamoeba invadens
NEVLERQRKSLRSCFNVFG

SEQ ID NO: 3009797 - protein, 20 aa, Entamoeba invadens
NEWDLLYVVGEGKQFVFVCE

SEQ ID NO: 3009798 - protein, 22 aa, Entamoeba invadens
NEWFCCYIAAVKRNIWKRLLHI

SEQ ID NO: 3009799 - protein, 20 aa, Entamoeba invadens
NEWFGFYHEDPLCYKHNRKI

SEQ ID NO: 3009800 - protein, 32 aa, Entamoeba invadens
NEWIYQICTILLEYLCRDYRIINAFFDSCFDD

SEQ ID NO: 3009801 - protein, 23 aa, Entamoeba invadens
NEWKKNFIVLNNQQLEDSRNKEE

SEQ ID NO: 3009802 - protein, 27 aa, Entamoeba invadens
NEYGTKIMIYLINLSDIKSLEYAQTAF

SEQ ID NO: 3009803 - protein, 21 aa, Entamoeba invadens
NEYIVHFYGAVFIPNKVCLVT

SEQ ID NO: 3009804 - protein, 20 aa, Entamoeba invadens
NEYLDFGVFYHQVKSRKEMF

SEQ ID NO: 3009805 - protein, 24 aa, Entamoeba invadens
NEYLNEIMLFLLRELCNTNPILNK

SEQ ID NO: 3009806 - protein, 28 aa, Entamoeba invadens
NEYQDIADIFPVLPSFMQLLNSSDNIQL

SEQ ID NO: 3009807 - protein, 35 aa, Entamoeba invadens
NEYQKLHRVFADHFMYCILIVRVARIVDSGLWPKL

SEQ ID NO: 3009808 - protein, 24 aa, Entamoeba invadens
NEYSYFLPEFLALTGLSEKMEKDK

SEQ ID NO: 3009809 - protein, 21 aa, Entamoeba invadens
NEYVLNQFVILSALDFIEEKK

SEQ ID NO: 3009810 - protein, 18 aa, Entamoeba invadens
NFANRTTFRPEYIANLFA

SEQ ID NO: 3009811 - protein, 23 aa, Entamoeba invadens
NFCTGRWKSVWNVTLNSSNVEVT

SEQ ID NO: 3009812 - protein, 18 aa, Entamoeba invadens
NFCVITEAPLIYDIATIE

SEQ ID NO: 3009813 - protein, 22 aa, Entamoeba invadens
NFDAKLWRRDILAGLISICFDY

SEQ ID NO: 3009814 - protein, 33 aa, Entamoeba invadens
NFDATYCYALGYTSFILAAYKKTGQICCISGLK

SEQ ID NO: 3009815 - protein, 25 aa, Entamoeba invadens
NFDIDHFFCFGITSLIKMLQEIHDS

SEQ ID NO: 3009816 - protein, 27 aa, Entamoeba invadens
NFDLQYFPPDVLIQDWFQLSCFGQKDT

SEQ ID NO: 3009817 - protein, 17 aa, Entamoeba invadens
NFDPEDVMFLFNSSRGC

SEQ ID NO: 3009818 - protein, 19 aa, Entamoeba invadens
NFDTYQQSFLIGLLNNHCG

SEQ ID NO: 3009819 - protein, 24 aa, Entamoeba invadens
NFEFNHIASLYFLDKRKNGYFLRD

SEQ ID NO: 3009820 - protein, 19 aa, Entamoeba invadens
NFEKIISSIFRIFPKIEIL

SEQ ID NO: 3009821 - protein, 33 aa, Entamoeba invadens
NFEKLFHLVEALLSYIFPLFAEASKYKYKLAHP

SEQ ID NO: 3009822 - protein, 24 aa, Entamoeba invadens
NFEKSLIITPFASYSTHLPHSQIA

SEQ ID NO: 3009823 - protein, 36 aa, Entamoeba invadens
NFELTSFLITPIQRIPRYKLLLNDLLKHTPHNHIDY

SEQ ID NO: 3009824 - protein, 27 aa, Entamoeba invadens
NFELYGDIGLFLTYREKWYKTNILNEL

SEQ ID NO: 3009825 - protein, 20 aa, Entamoeba invadens
NFENLSSRKFICGGPVYIIA

SEQ ID NO: 3009826 - protein, 22 aa, Entamoeba invadens
NFETFPIAGDLPRLLKHLSIVR

SEQ ID NO: 3009827 - protein, 23 aa, Entamoeba invadens
NFETQITALTQKIAGGDSSAVLL

SEQ ID NO: 3009828 - protein, 20 aa, Entamoeba invadens
NFEVYQQAMLIALINSQASV

SEQ ID NO: 3009829 - protein, 17 aa, Entamoeba invadens
NFEYLTQIVSSKNTKQF

SEQ ID NO: 3009830 - protein, 20 aa, Entamoeba invadens
NFFASCIYLKEVVMDNSVVT

SEQ ID NO: 3009831 - protein, 26 aa, Entamoeba invadens
NFFGLCAIVFAFHKVPDFGYVKSNLS

SEQ ID NO: 3009832 - protein, 21 aa, Entamoeba invadens
NFFNQNAVLAFYEIWEVVFTE

SEQ ID NO: 3009833 - protein, 25 aa, Entamoeba invadens
NFFQVNIWFEVAFTDYLNVGAISYL

SEQ ID NO: 3009834 - protein, 29 aa, Entamoeba invadens
NFGKFTALTLVRFRGNLLSKVPEVLLSLQ

SEQ ID NO: 3009835 - protein, 17 aa, Entamoeba invadens
NFHMFYQNTRFTLFGAA

SEQ ID NO: 3009836 - protein, 26 aa, Entamoeba invadens
NFHPLKPFDITHPVFIFGLSYTHDTP

SEQ ID NO: 3009837 - protein, 28 aa, Entamoeba invadens
NFIKIRADFMVVLFIEFFRAIDTNMGGT

SEQ ID NO: 3009838 - protein, 24 aa, Entamoeba invadens
NFIKSVFPKITRLVLFSLGDENEI

SEQ ID NO: 3009839 - protein, 26 aa, Entamoeba invadens
NFISNDIYELMLDLFGNYVIQKLFEF

SEQ ID NO: 3009840 - protein, 25 aa, Entamoeba invadens
NFKANLVNFNYAIINSLIAQNYSDM

SEQ ID NO: 3009841 - protein, 24 aa, Entamoeba invadens
NFKEEYIKYIYYDGVLLFNSNSIQ

SEQ ID NO: 3009842 - protein, 29 aa, Entamoeba invadens
NFKEQVISIINFLLSPYISPPHPNHSTNS

SEQ ID NO: 3009843 - protein, 21 aa, Entamoeba invadens
NFKHLMVFAVQDGISIPKSLT

SEQ ID NO: 3009844 - protein, 36 aa, Entamoeba invadens
NFKHVLHAWFHLKILRLFTDSVLHYGLPTKYDLIVM

SEQ ID NO: 3009845 - protein, 23 aa, Entamoeba invadens
NFKIAFFSRTVTVKNPLPVVVKT

SEQ ID NO: 3009846 - protein, 19 aa, Entamoeba invadens
NFKIPISLVIDILPETWES

SEQ ID NO: 3009847 - protein, 23 aa, Entamoeba invadens
NFKNIFTFDFKHFNLASTTLIID

SEQ ID NO: 3009848 - protein, 17 aa, Entamoeba invadens
NFKYETFVLKNALEEVM

SEQ ID NO: 3009849 - protein, 25 aa, Entamoeba invadens
NFKYKFFIFYKSCFYPFNFIHFRVL

SEQ ID NO: 3009850 - protein, 25 aa, Entamoeba invadens
NFLAFKHLTSYFYREFYRIIVYEEV

SEQ ID NO: 3009851 - protein, 25 aa, Entamoeba invadens
NFLASVLIERGFTLNLTLITFKNST

SEQ ID NO: 3009852 - protein, 18 aa, Entamoeba invadens
NFLDIPTTVVSIGVSCFE

SEQ ID NO: 3009853 - protein, 17 aa, Entamoeba invadens
NFLDSYKNLCMNGQLFF

SEQ ID NO: 3009854 - protein, 20 aa, Entamoeba invadens
NFLEKILHRVHFSLFKNCTT

SEQ ID NO: 3009855 - protein, 27 aa, Entamoeba invadens
NFLIVDHTPYPLVKITDFGFSRSLANE

SEQ ID NO: 3009856 - protein, 22 aa, Entamoeba invadens
NFLKFTFDTLATEKKITLAFGN

SEQ ID NO: 3009857 - protein, 23 aa, Entamoeba invadens
NFLSLILEPLIRAIFEYLNDKTR

SEQ ID NO: 3009858 - protein, 18 aa, Entamoeba invadens
NFLVFEECPMKIKMCDFG

SEQ ID NO: 3009859 - protein, 19 aa, Entamoeba invadens
NFMSLPLLQSVDLKNVIFL

SEQ ID NO: 3009860 - protein, 30 aa, Entamoeba invadens
NFNDFRIKGIRYEIPYWKDKIYDERSIERV

SEQ ID NO: 3009861 - protein, 26 aa, Entamoeba invadens
NFNGEKFPILIVLKDSTSIGNLGNLV

SEQ ID NO: 3009862 - protein, 24 aa, Entamoeba invadens
NFNQTICYICKPSHYPEISCHECT

SEQ ID NO: 3009863 - protein, 23 aa, Entamoeba invadens
NFNRRLVNGFVLNLVVPNDMKYA

SEQ ID NO: 3009864 - protein, 18 aa, Entamoeba invadens
NFPDFLDCFNYSLPSLME

SEQ ID NO: 3009865 - protein, 28 aa, Entamoeba invadens
NFPLNACDFFNFLQQKMLSVNLLGPVDL

SEQ ID NO: 3009866 - protein, 26 aa, Entamoeba invadens
NFPQSGILQFFINPADDYGMESYKLI

SEQ ID NO: 3009867 - protein, 17 aa, Entamoeba invadens
NFPRLKFLDVSNNNLTC

SEQ ID NO: 3009868 - protein, 21 aa, Entamoeba invadens
NFPSRPFLLSQSTTSLIPSLT

SEQ ID NO: 3009869 - protein, 18 aa, Entamoeba invadens
NFQAFYTSGIIAFPDAEV

SEQ ID NO: 3009870 - protein, 23 aa, Entamoeba invadens
NFQFLKRVFERAIAILRPRPNVE

SEQ ID NO: 3009871 - protein, 21 aa, Entamoeba invadens
NFQFYGQNYPFKAPLEKFDTT

SEQ ID NO: 3009872 - protein, 19 aa, Entamoeba invadens
NFQIGNIIEMLIIKNTTIN

SEQ ID NO: 3009873 - protein, 23 aa, Entamoeba invadens
NFQIVVQYFYFEKDFINSILMCK

SEQ ID NO: 3009874 - protein, 24 aa, Entamoeba invadens
NFQIVVQYLFFSDDFVNSILVCKK

SEQ ID NO: 3009875 - protein, 24 aa, Entamoeba invadens
NFQKMLCVAVWMGVRTNCDTSCIT

SEQ ID NO: 3009876 - protein, 47 aa, Entamoeba invadens
NFQNIKGKILANLYLIVCYDFCVKLAQNLFFDVFFKVGKMSENGARK

SEQ ID NO: 3009877 - protein, 24 aa, Entamoeba invadens
NFQPTLIVPDLFIVASYSLQGFVI

SEQ ID NO: 3009878 - protein, 26 aa, Entamoeba invadens
NFQSDLQAIFIAILSKYTTISIGRPH

SEQ ID NO: 3009879 - protein, 20 aa, Entamoeba invadens
NFRCDKLPLHFMRQEIDAEK

SEQ ID NO: 3009880 - protein, 26 aa, Entamoeba invadens
NFRKAMTLMFHGFFDDSSFSVTLRKY

SEQ ID NO: 3009881 - protein, 23 aa, Entamoeba invadens
NFRMCKNIKKLLLPKCLQTSFNF

SEQ ID NO: 3009882 - protein, 34 aa, Entamoeba invadens
NFRMDHPCIKSLFFKSREIFSHLFEIVASLQEDN

SEQ ID NO: 3009883 - protein, 24 aa, Entamoeba invadens
NFRTSLMSFFVYTVANYETKPVWK

SEQ ID NO: 3009884 - protein, 39 aa, Entamoeba invadens
NFSCENVIQGLYFFDPTNPLIPFMKILKGVSVALFGQMN

SEQ ID NO: 3009885 - protein, 20 aa, Entamoeba invadens
NFSGLFGDMYFSTSKLNLPS

SEQ ID NO: 3009886 - protein, 23 aa, Entamoeba invadens
NFSIRSFLELQISYSKSTIVCRL

SEQ ID NO: 3009887 - protein, 30 aa, Entamoeba invadens; identical to SEQ ID NO: 2957820

SEQ ID NO: 3009888 - protein, 20 aa, Entamoeba invadens
NFSPFSFFEGSLPLTQQTQQ

SEQ ID NO: 3009889 - protein, 33 aa, Entamoeba invadens
NFSPIQIDLLQKELPFKLWFNQIQFSVVHCQSI

SEQ ID NO: 3009890 - protein, 28 aa, Entamoeba invadens
NFSRYLYDAYNYLSLKNLLGLFNGMRLF

SEQ ID NO: 3009891 - protein, 24 aa, Entamoeba invadens
NFSTEIIALLLKYTKERTDDIALL

SEQ ID NO: 3009892 - protein, 17 aa, Entamoeba invadens
NFSVHSYFADFENNRLF

SEQ ID NO: 3009893 - protein, 33 aa, Entamoeba invadens
NFTDMFNVIKPLDQFFFVFQMTSGETFGAYFEK

SEQ ID NO: 3009894 - protein, 32 aa, Entamoeba invadens
NFTITPDNFFFFRLPRFTPFDGKLLEPYKNKF

SEQ ID NO: 3009895 - protein, 30 aa, Entamoeba invadens
NFTLDQLLVCLPITYFLNVNKWDLNTMNKE

SEQ ID NO: 3009896 - protein, 24 aa, Entamoeba invadens
NFTLQNYVFGIFDMLARNCSSSEK

SEQ ID NO: 3009897 - protein, 25 aa, Entamoeba invadens
NFTSGIKYFLFNKHKQQMTSSIVTI

SEQ ID NO: 3009898 - protein, 26 aa, Entamoeba invadens
NFTSSLVCFYGTPKLYVVPDYFSASV

SEQ ID NO: 3009899 - protein, 21 aa, Entamoeba invadens
NFVDCGCYVLYFIRKMACSPS

SEQ ID NO: 3009900 - protein, 22 aa, Entamoeba invadens
NFVKFTSFIKLLMNNTLINCEQ

SEQ ID NO: 3009901 - protein, 17 aa, Entamoeba invadens
NFVLPFQSDGEPFLLQN

SEQ ID NO: 3009902 - protein, 24 aa, Entamoeba invadens
NFVMEDFFVIWNVFYDKKVQRAVD

SEQ ID NO: 3009903 - protein, 28 aa, Entamoeba invadens
NFVREIFCVIMTKFAFLYSDFGKEKKTL

SEQ ID NO: 3009904 - protein, 19 aa, Entamoeba invadens
NFVRGCTNLKYVVFENGRH

SEQ ID NO: 3009905 - protein, 23 aa, Entamoeba invadens
NFVVTCFCAFWVTSDGKIYVHHL

SEQ ID NO: 3009906 - protein, 24 aa, Entamoeba invadens
NFVVYFHNLKYDSCLLAKYGIETC

SEQ ID NO: 3009907 - protein, 17 aa, Entamoeba invadens
NFYNSHIINQLLQNQHN

SEQ ID NO: 3009908 - protein, 18 aa, Entamoeba invadens
NFYRLKKVLSFEGKILNE

SEQ ID NO: 3009909 - protein, 19 aa, Entamoeba invadens
NFYYHYLNNLHKRSALLCE

SEQ ID NO: 3009910 - protein, 20 aa, Entamoeba invadens
NFYYQFYCPDFAKASPRKHA

SEQ ID NO: 3009911 - protein, 19 aa, Entamoeba invadens
NGALLFPPADYNNIQIPKT

SEQ ID NO: 3009912 - protein, 23 aa, Entamoeba invadens
NGAPLFNPPTKPEFPLRFGDISK

SEQ ID NO: 3009913 - protein, 26 aa, Entamoeba invadens
NGARKMQMIFSSIKTFALKLNDVNGE

SEQ ID NO: 3009914 - protein, 25 aa, Entamoeba invadens
NGAVPFLEYILSTALNFSPEKYKNG

SEQ ID NO: 3009915 - protein, 30 aa, Entamoeba invadens
NGAVTYFKKAFVLSLYQYVPFEQSDLSFVL

SEQ ID NO: 3009916 - protein, 23 aa, Entamoeba invadens
NGCALLTTLYFSQKNKTGLVSFK

SEQ ID NO: 3009917 - protein, 22 aa, Entamoeba invadens
NGCFYQCTNLEKIYLHCLISKI

SEQ ID NO: 3009918 - protein, 26 aa, Entamoeba invadens
NGCGKTTFLKLLINSLSPVEGTVQRN

SEQ ID NO: 3009919 - protein, 22 aa, Entamoeba invadens
NGCHEMLGYSLFMVGKSFAIHT

SEQ ID NO: 3009920 - protein, 24 aa, Entamoeba invadens
NGCNTITCKCGCIFCWTCGKDVTN

SEQ ID NO: 3009921 - protein, 20 aa, Entamoeba invadens
NGCNYYTIRSVPSLVTLHKG

SEQ ID NO: 3009922 - protein, 18 aa, Entamoeba invadens
NGCRFGVFVGAKVEKNGE

SEQ ID NO: 3009923 - protein, 25 aa, Entamoeba invadens
NGCSSLSILTIPSSILKLGNSCFCK

SEQ ID NO: 3009924 - protein, 31 aa, Entamoeba invadens
NGCSWGWVNDKLLPGFLWIEKPTVTPRLDPP

SEQ ID NO: 3009925 - protein, 25 aa, Entamoeba invadens
NGCTACVVLLVGKRLYTANLGDAEA

SEQ ID NO: 3009926 - protein, 27 aa, Entamoeba invadens
NGCTNLTRVTLPSSLKYIPSQTFEKCV

SEQ ID NO: 3009927 - protein, 25 aa, Entamoeba invadens
NGDDINWTAVLIKSGAGAIKGAIAT

SEQ ID NO: 3009928 - protein, 23 aa, Entamoeba invadens
NGDEFNFQFQKFLKVRSSEYITQ

SEQ ID NO: 3009929 - protein, 19 aa, Entamoeba invadens
NGDEIAKILGRKKGPWLKE

SEQ ID NO: 3009930 - protein, 22 aa, Entamoeba invadens
NGDIIEQPVLCQSFIASRGNLT

SEQ ID NO: 3009931 - protein, 35 aa, Entamoeba invadens
NGDIMSFLIFPVQRIPRYILLMKEYIKNTDKEHPD

SEQ ID NO: 3009932 - protein, 31 aa, Entamoeba invadens
NGDITILKKKFFRIIVWFSVDFGTVDRNKSR

SEQ ID NO: 3009933 - protein, 26 aa, Entamoeba invadens
NGDMNMDNFLFRALLQGERLQDLIGR

SEQ ID NO: 3009934 - protein, 20 aa, Entamoeba invadens
NGDNMLTAEQLKYAIRAFGV

SEQ ID NO: 3009935 - protein, 18 aa, Entamoeba invadens
NGDPMPIQLLIKAEFFQK

SEQ ID NO: 3009936 - protein, 20 aa, Entamoeba invadens
NGEDAPPLPPPRRTKRTTPS

SEQ ID NO: 3009937 - protein, 32 aa, Entamoeba invadens
NGEGVVLDIFKGYTMWVKTFENSKFVEKIIKM

SEQ ID NO: 3009938 - protein, 32 aa, Entamoeba invadens
NGEHFVIIQFAPILFGSKINLEKYFSAHRKII

SEQ ID NO: 3009939 - protein, 18 aa, Entamoeba invadens
NGEKYEFNLLELRPSFEF

SEQ ID NO: 3009940 - protein, 24 aa, Entamoeba invadens
NGEKYEFNLLELRPSFEFDKQFNI

SEQ ID NO: 3009941 - protein, 31 aa, Entamoeba invadens
NGELKVWDFRTFDFPIATFDWHKKAITSVEW

SEQ ID NO: 3009942 - protein, 27 aa, Entamoeba invadens
NGELWKFTLYIMSIFPTSVISESTFSI

SEQ ID NO: 3009943 - protein, 25 aa, Entamoeba invadens
NGEPAKIDKFLLKSAFKGLTKSKKE

SEQ ID NO: 3009944 - protein, 32 aa, Entamoeba invadens
NGEPLIDTVYPLWKSVLLPPGITFGKHKNKEC

SEQ ID NO: 3009945 - protein, 27 aa, Entamoeba invadens
NGERKWKLKMFNFKKNFGYLKEGAEVY

SEQ ID NO: 3009946 - protein, 28 aa, Entamoeba invadens
NGESYCFQYMFDYGGLKNALCGRQHPGT

SEQ ID NO: 3009947 - protein, 28 aa, Entamoeba invadens
NGEYSYYLTNLFGAISFLLQVTGKQLTI

SEQ ID NO: 3009948 - protein, 21 aa, Entamoeba invadens
NGFAEYLPLNLKIKGCDEVEF

SEQ ID NO: 3009949 - protein, 25 aa, Entamoeba invadens
NGFDRLLCHCIANYYNLVSYSTGTG

SEQ ID NO: 3009950 - protein, 26 aa, Entamoeba invadens
NGFGGFGVLVVHFWALGKGGMDVTQN

SEQ ID NO: 3009951 - protein, 23 aa, Entamoeba invadens
NGFGPTPYYRGADGIFLIVDGTT

SEQ ID NO: 3009952 - protein, 21 aa, Entamoeba invadens
NGFGYVKYRTIEAALKAVENA

SEQ ID NO: 3009953 - protein, 20 aa, Entamoeba invadens
NGFLIVIQDLTQNLFGVCVS

SEQ ID NO: 3009954 - protein, 26 aa, Entamoeba invadens
NGFMVGLGTRVFNFSAPSPLQQRQWC

SEQ ID NO: 3009955 - protein, 30 aa, Entamoeba invadens
NGFSCYISRIKKFFPNIKTLLLPSYQCLVP

SEQ ID NO: 3009956 - protein, 17 aa, Entamoeba invadens
NGFSLKFDVIIPKLIEA

SEQ ID NO: 3009957 - protein, 21 aa, Entamoeba invadens
NGFVIVIDDIKGNRFGAAIFS

SEQ ID NO: 3009958 - protein, 25 aa, Entamoeba invadens
NGFVVNDGPLREYNTPENKKFIDDV

SEQ ID NO: 3009959 - protein, 24 aa, Entamoeba invadens
NGGYKDFGGYLLIYKKREFCVENK

SEQ ID NO: 3009960 - protein, 23 aa, Entamoeba invadens
NGHFLLAVSYDRRRFRPSIVCDD

SEQ ID NO: 3009961 - protein, 20 aa, Entamoeba invadens
NGHFLLAVSYDRRRYRPSIV

SEQ ID NO: 3009962 - protein, 26 aa, Entamoeba invadens
NGHGSSLLYLMNHLCGYKVSLDDLKQ

SEQ ID NO: 3009963 - protein, 24 aa, Entamoeba invadens
NGHIYSLYCIFDGHGGRTASQHAA

SEQ ID NO: 3009964 - protein, 31 aa, Entamoeba invadens
NGHMQQRKSMLFFPPIAPLPQESSKAISFKG

SEQ ID NO: 3009965 - protein, 25 aa, Entamoeba invadens
NGIAKEIRPVVWYYFATEGITFDEV

SEQ ID NO: 3009966 - protein, 25 aa, Entamoeba invadens
NGIDLEYYMKSGLIPYFVKLLQDQN

SEQ ID NO: 3009967 - protein, 25 aa, Entamoeba invadens
NGIGLPLRYRKNSVCGILADLYDEV

SEQ ID NO: 3009968 - protein, 22 aa, Entamoeba invadens
NGIHIAFLLYGKTGLIDENGFV

SEQ ID NO: 3009969 - protein, 17 aa, Entamoeba invadens
NGIIMIDGNRRSMMIKP

SEQ ID NO: 3009970 - protein, 18 aa, Entamoeba invadens
NGIIYIPSLTQPNRHRNT

SEQ ID NO: 3009971 - protein, 22 aa, Entamoeba invadens
NGILVGFQRIYTEDFKMLKEII

SEQ ID NO: 3009972 - protein, 23 aa, Entamoeba invadens
NGILYLLNTLGYTFAVKQTKRTK

SEQ ID NO: 3009973 - protein, 26 aa, Entamoeba invadens
NGINVIPYGFFFNAVNLYEINGLENV

SEQ ID NO: 3009974 - protein, 31 aa, Entamoeba invadens
NGIPAELRCYIWYALLLRPTDPWEIRALYSE

SEQ ID NO: 3009975 - protein, 22 aa, Entamoeba invadens
NGIPIMMIWMHDIVNINCIPTK

SEQ ID NO: 3009976 - protein, 17 aa, Entamoeba invadens
NGIPLISPVHRTVSMYE

SEQ ID NO: 3009977 - protein, 29 aa, Entamoeba invadens
NGIRKIANYLLRLNYFALQGICINDGYIF

SEQ ID NO: 3009978 - protein, 23 aa, Entamoeba invadens
NGIVARVFVKIRPSYERCLNVFF

SEQ ID NO: 3009979 - protein, 31 aa, Entamoeba invadens
NGKCYKYEDGYFYWVYKNYVVFKTLNKQKFE

SEQ ID NO: 3009980 - protein, 26 aa, Entamoeba invadens
NGKEKYLRLPKIVLIDTIGGNPIELN

SEQ ID NO: 3009981 - protein, 17 aa, Entamoeba invadens
NGKEQTILLIPKVNYVL

SEQ ID NO: 3009982 - protein, 25 aa, Entamoeba invadens
NGKEVLTILSEMWKKLDPLEKNRYV

SEQ ID NO: 3009983 - protein, 27 aa, Entamoeba invadens
NGKFGNVYLVKYKKYNYVCALKIVFKK

SEQ ID NO: 3009984 - protein, 22 aa, Entamoeba invadens
NGKFLRCNVLTQNLEGGGLAPF

SEQ ID NO: 3009985 - protein, 21 aa, Entamoeba invadens
NGKFLWIHRNPRDSFKSLLPV

SEQ ID NO: 3009986 - protein, 26 aa, Entamoeba invadens
NGKGYLISNKKLIRFCPQGTPLDKDV

SEQ ID NO: 3009987 - protein, 26 aa, Entamoeba invadens
NGKIPLFCILITKDVFFRVDIKYIEI

SEQ ID NO: 3009988 - protein, 28 aa, Entamoeba invadens
NGKKLLENYILHPLTNKTQINFRLDLVQ

SEQ ID NO: 3009989 - protein, 21 aa, Entamoeba invadens
NGKLYECDFLKKEIGNIFTSK

SEQ ID NO: 3009990 - protein, 18 aa, Entamoeba invadens
NGKRKEILTSREAIAAAQ

SEQ ID NO: 3009991 - protein, 22 aa, Entamoeba invadens
NGKTLVAMLAPSTRLGVAECMG

SEQ ID NO: 3009992 - protein, 24 aa, Entamoeba invadens
NGKTSLIRRVSLLMLSDLCKISPE

SEQ ID NO: 3009993 - protein, 31 aa, Entamoeba invadens
NGKVEQFTGFLLDKSFVGMTAPATIRNELLT

SEQ ID NO: 3009994 - protein, 24 aa, Entamoeba invadens
NGKVGFLRLFLYLFKESSNLDYTS

SEQ ID NO: 3009995 - protein, 27 aa, Entamoeba invadens
NGKVGFMKFFHFLLKKENPIDYTSLQS

SEQ ID NO: 3009996 - protein, 32 aa, Entamoeba invadens
NGKVKMNIGVLHRFLIFKYPHFKEELNTIEAH

SEQ ID NO: 3009997 - protein, 24 aa, Entamoeba invadens
NGKYKVLVFYCKDYSIVCPKELVA

SEQ ID NO: 3009998 - protein, 19 aa, Entamoeba invadens
NGLDRFFKVTLNMSPDAVT

SEQ ID NO: 3009999 - protein, 23 aa, Entamoeba invadens
NGLDVIMALLYSGAVTTFMYDCD

SEQ ID NO: 3010000 - protein, 17 aa, Entamoeba invadens
NGLLSKYDKVHLYHFGC

SEQ ID NO: 3010001 - protein, 29 aa, Entamoeba invadens
NGLQKTLMLFYNTALFGAKKGLSFCFIKF

SEQ ID NO: 3010002 - protein, 21 aa, Entamoeba invadens
NGLVLFGMLSLLDSLIECFPK

SEQ ID NO: 3010003 - protein, 18 aa, Entamoeba invadens
NGMFYKYILSKKEDKPLL

SEQ ID NO: 3010004 - protein, 22 aa, Entamoeba invadens
NGMTLLFEFCKNSHIRLDVSNQ

SEQ ID NO: 3010005 - protein, 17 aa, Entamoeba invadens
NGMYRIEMFYKAGGGWG

SEQ ID NO: 3010006 - protein, 21 aa, Entamoeba invadens
NGNDLVVQWLLNKGASCETEN

SEQ ID NO: 3010007 - protein, 25 aa, Entamoeba invadens
NGNILPTIIFVPLRLGPVNAEEDFR

SEQ ID NO: 3010008 - protein, 23 aa, Entamoeba invadens
NGNLALLVPFLTSQPHQHLTTVT

SEQ ID NO: 3010009 - protein, 29 aa, Entamoeba invadens
NGNNHQELFLQFLLQDTPITEWKDILITK

SEQ ID NO: 3010010 - protein, 27 aa, Entamoeba invadens
NGNSMNRLLSLSFKTPFTFGTNSETGS

SEQ ID NO: 3010011 - protein, 17 aa, Entamoeba invadens
NGNVFYEVAPGKHLFPF

SEQ ID NO: 3010012 - protein, 17 aa, Entamoeba invadens
NGNYIMMLVGNKCDIVE

SEQ ID NO: 3010013 - protein, 27 aa, Entamoeba invadens
NGPKSAIWLYLRLIFEENKDYKKLMVK

SEQ ID NO: 3010014 - protein, 24 aa, Entamoeba invadens
NGQCLTCYAGYRLNSNGTCEMCGD

SEQ ID NO: 3010015 - protein, 17 aa, Entamoeba invadens
NGQLKLINFFRVRTYGS

SEQ ID NO: 3010016 - protein, 18 aa, Entamoeba invadens
NGQPKYYPRFDFAKVECI

SEQ ID NO: 3010017 - protein, 23 aa, Entamoeba invadens
NGQPLSLIKTESSIFNKLVQQSG

SEQ ID NO: 3010018 - protein, 18 aa, Entamoeba invadens
NGQQQYLKMCLMLLKVHG

SEQ ID NO: 3010019 - protein, 25 aa, Entamoeba invadens
NGQTNYASLWPIPQFFKNDGKQFVG

SEQ ID NO: 3010020 - protein, 29 aa, Entamoeba invadens
NGQTNYASLWPIPQFFKYDGKKCVGQPLC

SEQ ID NO: 3010021 - protein, 18 aa, Entamoeba invadens
NGRLIACQAPIPTTVEDF

SEQ ID NO: 3010022 - protein, 19 aa, Entamoeba invadens
NGRLIIEIVINILGLNDTI

SEQ ID NO: 3010023 - protein, 28 aa, Entamoeba invadens
NGRSGVMIIVFPTLYEPFGCFIDNEIKG

SEQ ID NO: 3010024 - protein, 27 aa, Entamoeba invadens
NGSFCNLPLLEHLSFIDSPGVLSGEKQ

SEQ ID NO: 3010025 - protein, 29 aa, Entamoeba invadens
NGSFFLCTSLTSFIFPLSLRRICDNSFAQ

SEQ ID NO: 3010026 - protein, 19 aa, Entamoeba invadens
NGSIKKLQRDLEANNTELT

SEQ ID NO: 3010027 - protein, 26 aa, Entamoeba invadens
NGSIRRVVVPLFPIGGGETLQIFENL

SEQ ID NO: 3010028 - protein, 25 aa, Entamoeba invadens
NGSKKKEVISWLHSCRRGKSTKKMM

SEQ ID NO: 3010029 - protein, 32 aa, Entamoeba invadens
NGSNVFVFALSRNFYVVYIEQFDEYYLVPNNP

SEQ ID NO: 3010030 - protein, 26 aa, Entamoeba invadens
NGSSITPAWLRFISDTPKSKMSFVVG

SEQ ID NO: 3010031 - protein, 23 aa, Entamoeba invadens
NGTEFWPVVVERGTPLPLEEYSF

SEQ ID NO: 3010032 - protein, 22 aa, Entamoeba invadens
NGTFFQIDFGYLLNRRPHFDAN

SEQ ID NO: 3010033 - protein, 17 aa, Entamoeba invadens
NGTVCIGNFFATEKRVD

SEQ ID NO: 3010034 - protein, 28 aa, Entamoeba invadens
NGVCFVLKYMMLFDLLRRNRVVGNVRLF

SEQ ID NO: 3010035 - protein, 26 aa, Entamoeba invadens
NGVEYFSLFVRFVFSDGSFVEKRVKI

SEQ ID NO: 3010036 - protein, 22 aa, Entamoeba invadens
NGVGGLYFIDYLDEMKNTNSSV

SEQ ID NO: 3010037 - protein, 20 aa, Entamoeba invadens
NGVLCDFAFVVNDVLVGMSV

SEQ ID NO: 3010038 - protein, 20 aa, Entamoeba invadens
NGVLICYDTISKLSLWEVKE

SEQ ID NO: 3010039 - protein, 23 aa, Entamoeba invadens
NGVMRMPLGLLPQRQPITQPQRQ

SEQ ID NO: 3010040 - protein, 32 aa, Entamoeba invadens
NGVPLDLIQPPMLRIKAFEPLFVIGKEYYAQL

SEQ ID NO: 3010041 - protein, 22 aa, Entamoeba invadens
NGVVYSYIPGRTLCLGDLIDLK

SEQ ID NO: 3010042 - protein, 38 aa, Entamoeba invadens
NGWDITCQLISLVLIMLDPYYRTIEGFLVLIQREWISA

SEQ ID NO: 3010043 - protein, 26 aa, Entamoeba invadens
NGWKFLLAICYDVRFPVFLRNKESDL

SEQ ID NO: 3010044 - protein, 21 aa, Entamoeba invadens
NGWKKMNAMTPIDAKYKYLQL

SEQ ID NO: 3010045 - protein, 21 aa, Entamoeba invadens
NGWSHPEIVPYHNLSIDPAAS

SEQ ID NO: 3010046 - protein, 35 aa, Entamoeba invadens
NGYCTLPQMNRDLLDWLFALLIKVSKHKDENKMTL

SEQ ID NO: 3010047 - protein, 26 aa, Entamoeba invadens
NHCPQSFNLLFNGKGGLDTARGILAM

SEQ ID NO: 3010048 - protein, 46 aa, Entamoeba invadens
NHCSIIFPQNLNFIPHPYFFNNNIKKIILPKLFIPRDRFSFEQMEA

SEQ ID NO: 3010049 - protein, 18 aa, Entamoeba invadens
NHCSVLNCTFRHGGKRGV

SEQ ID NO: 3010050 - protein, 18 aa, Entamoeba invadens
NHDDTINCFILTTRVGGL

SEQ ID NO: 3010051 - protein, 29 aa, Entamoeba invadens
NHDEFTLVSLFVEAIKKFKGLSKFEMRDT

SEQ ID NO: 3010052 - protein, 31 aa, Entamoeba invadens
NHDIFLFEKLKEKVIMLIVSSFSKKINLSGF

SEQ ID NO: 3010053 - protein, 25 aa, Entamoeba invadens
NHEKPRLPLDFIYSDVLDICYAPNK

SEQ ID NO: 3010054 - protein, 18 aa, Entamoeba invadens
NHELRFNDAFSNLGFDHL

SEQ ID NO: 3010055 - protein, 21 aa, Entamoeba invadens
NHFVYCYNICCQPNFIKIRAD

SEQ ID NO: 3010056 - protein, 21 aa, Entamoeba invadens
NHIPIVRELFGLFYKINTYSD

SEQ ID NO: 3010057 - protein, 20 aa, Entamoeba invadens
NHKLQFVGPLLGFLVKHYQG

SEQ ID NO: 3010058 - protein, 20 aa, Entamoeba invadens
NHLELPMWVCTQSRIFVETS

SEQ ID NO: 3010059 - protein, 24 aa, Entamoeba invadens
NHLVFKNCISLSKLIIPKSVTLIG

SEQ ID NO: 3010060 - protein, 34 aa, Entamoeba invadens
NHLVPGGLFDYLLCFQFFEYSKIEVLYQLFCNEE

SEQ ID NO: 3010061 - protein, 31 aa, Entamoeba invadens
NHMDIHFMQRVFKCFMPFAGNLQARNWHGMM

SEQ ID NO: 3010062 - protein, 18 aa, Entamoeba invadens
NHMKHKKIVLVLNKCDLV

SEQ ID NO: 3010063 - protein, 24 aa, Entamoeba invadens
NHMRRTPVLYPKDRFALVLFGVDA

SEQ ID NO: 3010064 - protein, 22 aa, Entamoeba invadens
NHMTCRCGHQFCWLCMADYNSN

SEQ ID NO: 3010065 - protein, 28 aa, Entamoeba invadens
NHMTCSCGHQFCWLCMADYTNTHFKSNT

SEQ ID NO: 3010066 - protein, 23 aa, Entamoeba invadens
NHNMFKLYIEKGISFLNNYIKAN

SEQ ID NO: 3010067 - protein, 19 aa, Entamoeba invadens
NHPFPPYIQSSFMKSGKLF

SEQ ID NO: 3010068 - protein, 31 aa, Entamoeba invadens
NHPKLLNYFGLLFKCWELIYLIDFSQDVSKE

SEQ ID NO: 3010069 - protein, 24 aa, Entamoeba invadens
NHPNKMFKYYVPSTQLFYTTYPED

SEQ ID NO: 3010070 - protein, 31 aa, Entamoeba invadens
NHQIFGSILKFLQIPSLLTLPIATDVLVTLN

SEQ ID NO: 3010071 - protein, 24 aa, Entamoeba invadens
NHQMMVFGVKRFIKVKRFGRCELT

SEQ ID NO: 3010072 - protein, 23 aa, Entamoeba invadens
NHQSFKSWWGYIDLFDDTHFQEK

SEQ ID NO: 3010073 - protein, 33 aa, Entamoeba invadens
NHQTVIFKKFCSLELKFPQNLVGRFAELWAMME

SEQ ID NO: 3010074 - protein, 17 aa, Entamoeba invadens
NHRNGIGCIPFGINFTS

SEQ ID NO: 3010075 - protein, 26 aa, Entamoeba invadens
NHSDAYIYFDMKKIVVWFGAKCNDFK

SEQ ID NO: 3010076 - protein, 23 aa, Entamoeba invadens
NHSLDIIDLRFPKHFLYTNQSHK

SEQ ID NO: 3010077 - protein, 30 aa, Entamoeba invadens
NHTSYLVRLHYLFYTLLADISNFIEGFLTS

SEQ ID NO: 3010078 - protein, 25 aa, Entamoeba invadens
NHTTFTYTRLLKKLQKTFKKLQFYV

SEQ ID NO: 3010079 - protein, 21 aa, Entamoeba invadens
NHVFHEVYADSFYLGASPLMA

SEQ ID NO: 3010080 - protein, 18 aa, Entamoeba invadens
NHVIQRFIEFMPSIYSSM

SEQ ID NO: 3010081 - protein, 24 aa, Entamoeba invadens
NHVLQQFVEFFFTNGQISKFENNE

SEQ ID NO: 3010082 - protein, 19 aa, Entamoeba invadens
NHVSLLYVIQKDSKRGEQW

SEQ ID NO: 3010083 - protein, 20 aa, Entamoeba invadens
NHVVYGLYSLFLEPNPNDPL

SEQ ID NO: 3010084 - protein, 20 aa, Entamoeba invadens
NHWLFVFGKNEARDTRDICI

SEQ ID NO: 3010085 - protein, 24 aa, Entamoeba invadens
NHYHLFLNVIHPMSRVLPFRDSHM

SEQ ID NO: 3010086 - protein, 18 aa, Entamoeba invadens
NHYKKPADIYSFAITMYE

SEQ ID NO: 3010087 - protein, 20 aa, Entamoeba invadens
NHYSSIATSLIFLFSAEPYS

SEQ ID NO: 3010088 - protein, 25 aa, Entamoeba invadens
NIAEKITSLIIIKPPKPVDTNQQIG

SEQ ID NO: 3010089 - protein, 29 aa, Entamoeba invadens
NIAKFLEGVAYLIAFYDMTAEMIEFVIYF

SEQ ID NO: 3010090 - protein, 24 aa, Entamoeba invadens
NIAKQLFEALKYLHSLGVIHRDIK

SEQ ID NO: 3010091 - protein, 18 aa, Entamoeba invadens
NIALIYGLATHAIYARRA

SEQ ID NO: 3010092 - protein, 20 aa, Entamoeba invadens
NIAPDYWLIGEKMMIGFYHF

SEQ ID NO: 3010093 - protein, 22 aa, Entamoeba invadens
NIAVITPYFRQKSLIQQRQVTK

SEQ ID NO: 3010094 - protein, 34 aa, Entamoeba invadens
NICDGNLKLILGLLWTLILKYQISKNKMDASRNA

SEQ ID NO: 3010095 - protein, 23 aa, Entamoeba invadens
NICKLCKNLLTKIRPENFESLLN

SEQ ID NO: 3010096 - protein, 25 aa, Entamoeba invadens
NICVSHLFYESYISQIVLPDNVCCI

SEQ ID NO: 3010097 - protein, 20 aa, Entamoeba invadens
NIDFLPLRDGLSASTHIVMM

SEQ ID NO: 3010098 - protein, 26 aa, Entamoeba invadens
NIDHVFHLVEVLLSYVFPVFADNAHY

SEQ ID NO: 3010099 - protein, 19 aa, Entamoeba invadens
NIDKIISGDLSLWQSHTFL

SEQ ID NO: 3010100 - protein, 19 aa, Entamoeba invadens
NIDLKPLQEWSGLKGHRVL

SEQ ID NO: 3010101 - protein, 29 aa, Entamoeba invadens
NIDNTPCAIPLFDMNYFNTIQPCYVDKEN

SEQ ID NO: 3010102 - protein, 22 aa, Entamoeba invadens
NIDSTYFLIKNLYEGNATITPS

SEQ ID NO: 3010103 - protein, 20 aa, Entamoeba invadens
NIDVVLPLQLLTKCLRVRGD

SEQ ID NO: 3010104 - protein, 20 aa, Entamoeba invadens
NIEDQIKALNAKSLDESKLQ

SEQ ID NO: 3010105 - protein, 25 aa, Entamoeba invadens
NIEENFFLHGLWPQLNANQNLFCCF

SEQ ID NO: 3010106 - protein, 26 aa, Entamoeba invadens
NIEIDKALFVAFAQEECKLYKKPWYS

SEQ ID NO: 3010107 - protein, 19 aa, Entamoeba invadens
NIELILNTGLPIKFIEEKF

SEQ ID NO: 3010108 - protein, 19 aa, Entamoeba invadens
NIELLRSLSLTTGNKRCMD

SEQ ID NO: 3010109 - protein, 24 aa, Entamoeba invadens
NIELQTQLEALQKQFKGETKTVVI

SEQ ID NO: 3010110 - protein, 19 aa, Entamoeba invadens
NIENELVFIQMFRGVVDSS

SEQ ID NO: 3010111 - protein, 20 aa, Entamoeba invadens
NIENYCRLNLFFETVREKDG

SEQ ID NO: 3010112 - protein, 18 aa, Entamoeba invadens
NIEPVFFAYPDRPELDKI

SEQ ID NO: 3010113 - protein, 28 aa, Entamoeba invadens
NIEQFKKLFFKTVAVSYAFYLQMKAFGY

SEQ ID NO: 3010114 - protein, 26 aa, Entamoeba invadens
NIEQFPPQFLELTKLKKLVINNNKIK

SEQ ID NO: 3010115 - protein, 22 aa, Entamoeba invadens
NIEQIIPLMRDITNVLKLGAVS

SEQ ID NO: 3010116 - protein, 21 aa, Entamoeba invadens
NIERFHFNPISLTLKTRKYFP

SEQ ID NO: 3010117 - protein, 17 aa, Entamoeba invadens
NIEVTVEIGFLIQNFQK

SEQ ID NO: 3010118 - protein, 25 aa, Entamoeba invadens
NIFENPLDTLLLPLNNDIPAGLLKH

SEQ ID NO: 3010119 - protein, 18 aa, Entamoeba invadens
NIFFKSKSKFLKTIKLEH

SEQ ID NO: 3010120 - protein, 21 aa, Entamoeba invadens
NIFGENILHFLTFATVTKEDE

SEQ ID NO: 3010121 - protein, 23 aa, Entamoeba invadens
NIFHLLRAMVLHKSILMEGSPGN

SEQ ID NO: 3010122 - protein, 20 aa, Entamoeba invadens
NIFKLFFNVYGNVKQCGCSF

SEQ ID NO: 3010123 - protein, 17 aa, Entamoeba invadens
NIFLQLFDAILQDKDRK

SEQ ID NO: 3010124 - protein, 26 aa, Entamoeba invadens
NIFSLQQLFQRPLSLTLPSEIEDIWK

SEQ ID NO: 3010125 - protein, 24 aa, Entamoeba invadens
NIGCCYYFMKEYETALKWFEKAES

SEQ ID NO: 3010126 - protein, 17 aa, Entamoeba invadens
NIGDSMVFILKNGILSR

SEQ ID NO: 3010127 - protein, 26 aa, Entamoeba invadens
NIGGAPPAFLALMKHPNRTKYNLSSL

SEQ ID NO: 3010128 - protein, 30 aa, Entamoeba invadens
NIGGQSIIYWDIPFAEYKLGRTLDFAKEKV

SEQ ID NO: 3010129 - protein, 17 aa, Entamoeba invadens
NIGVFVYGDGGYVFGIY

SEQ ID NO: 3010130 - protein, 27 aa, Entamoeba invadens
NIGYIYKTFGYFFKSADFDLFCKTMEE

SEQ ID NO: 3010131 - protein, 37 aa, Entamoeba invadens
NIHEVFVAELKKKYPNYLFDIVYKGDTTPIIITDNKT

SEQ ID NO: 3010132 - protein, 24 aa, Entamoeba invadens
NIHLAQVPCIVLDIVRILGRNAPE

SEQ ID NO: 3010133 - protein, 18 aa, Entamoeba invadens
NIHLAQVPCVVLDIVKIS

SEQ ID NO: 3010134 - protein, 20 aa, Entamoeba invadens
NIHPELIITNDWLTGMVPAY

SEQ ID NO: 3010135 - protein, 22 aa, Entamoeba invadens
NIHVRMLLTKLFLDVNPFTDEA

SEQ ID NO: 3010136 - protein, 28 aa, Entamoeba invadens
NIHVTLPNATFLLWLDFSNLNLENDEID

SEQ ID NO: 3010137 - protein, 17 aa, Entamoeba invadens
NIIADLEKQVKKLQNTI

SEQ ID NO: 3010138 - protein, 17 aa, Entamoeba invadens
NIIAFTQNFIFDTCLEL

SEQ ID NO: 3010139 - protein, 20 aa, Entamoeba invadens
NIICLRLFNTMVRNGFTRLI

SEQ ID NO: 3010140 - protein, 24 aa, Entamoeba invadens
NIIEKYLKYKGYLYERLDGSIRAL

SEQ ID NO: 3010141 - protein, 21 aa, Entamoeba invadens
NIIEMEGMSKQLCDAQKIKSE

SEQ ID NO: 3010142 - protein, 18 aa, Entamoeba invadens
NIIERKFYGVHCPAHRCN

SEQ ID NO: 3010143 - protein, 20 aa, Entamoeba invadens
NIIFITIEEAYCGCTKIVTD

SEQ ID NO: 3010144 - protein, 19 aa, Entamoeba invadens
NIIIASYKRSGVVGVNIGK

SEQ ID NO: 3010145 - protein, 31 aa, Entamoeba invadens
NIIIEKLEKVIMKGYFYCVVEIKDLVYKTAY

SEQ ID NO: 3010146 - protein, 24 aa, Entamoeba invadens
NIIIGNIMRLNVLVIAFVLGGEKK

SEQ ID NO: 3010147 - protein, 19 aa, Entamoeba invadens
NIIIILPKEKYIYKQFAKE

SEQ ID NO: 3010148 - protein, 17 aa, Entamoeba invadens
NIIITLLENGYASLRLS

SEQ ID NO: 3010149 - protein, 19 aa, Entamoeba invadens
NIIRDLNKAYLGFKSGRGR

SEQ ID NO: 3010150 - protein, 20 aa, Entamoeba invadens
NIISLSLLKSKEKVLDALFN

SEQ ID NO: 3010151 - protein, 17 aa, Entamoeba invadens
NIIVLNTDKTYPQLVCV

SEQ ID NO: 3010152 - protein, 24 aa, Entamoeba invadens
NIIYNNIFYNCKTGYLGDSRGPRR

SEQ ID NO: 3010153 - protein, 19 aa, Entamoeba invadens
NIKAIAHYPHLISYNNYLS

SEQ ID NO: 3010154 - protein, 24 aa, Entamoeba invadens
NIKEKNMFIILDFEFDPTKLEQYR

SEQ ID NO: 3010155 - protein, 25 aa, Entamoeba invadens
NIKENVHLPILFVGNKSDLEIQRTV

SEQ ID NO: 3010156 - protein, 17 aa, Entamoeba invadens
NIKFYVIDAIKIGQEVK

SEQ ID NO: 3010157 - protein, 28 aa, Entamoeba invadens
NIKHLGIGYFWNCSMLSKIVIPLGITHL

SEQ ID NO: 3010158 - protein, 27 aa, Entamoeba invadens
NIKKRFDTKIYFLYTKKYINDKDDLRD

SEQ ID NO: 3010159 - protein, 22 aa, Entamoeba invadens
NIKLCLFHLNQAVFRMLGKKGL

SEQ ID NO: 3010160 - protein, 30 aa, Entamoeba invadens
NIKNSTLLAKGYYRLIRLNIFLENFHQANT

SEQ ID NO: 3010161 - protein, 20 aa, Entamoeba invadens
NIKTLVYYFDELRAQPQFSL

SEQ ID NO: 3010162 - protein, 24 aa, Entamoeba invadens
NIKTQMVLISPERNGVKEKTEQNL

SEQ ID NO: 3010163 - protein, 17 aa, Entamoeba invadens
NIKYLPFFSEKSLNRTS

SEQ ID NO: 3010164 - protein, 27 aa, Entamoeba invadens
NILDEKCLLVVLFRLLDKNSSGKVSLK

SEQ ID NO: 3010165 - protein, 20 aa, Entamoeba invadens
NILDSYIFIDSSTDLPQRRK

SEQ ID NO: 3010166 - protein, 31 aa, Entamoeba invadens
NILEDVQVRYIVYQLLKALKYLHSAGIVHRD

SEQ ID NO: 3010167 - protein, 28 aa, Entamoeba invadens
NILHRDLKLQNFLLKNSKESPFPIVKLC

SEQ ID NO: 3010168 - protein, 20 aa, Entamoeba invadens
NILIPLKRCLKLSEKMLPLP

SEQ ID NO: 3010169 - protein, 20 aa, Entamoeba invadens
NILITRNQIIGHIEALKLSQ

SEQ ID NO: 3010170 - protein, 19 aa, Entamoeba invadens
NILKLLVHSLCPPIFGHYI

SEQ ID NO: 3010171 - protein, 20 aa, Entamoeba invadens
NILKPMLSRGELRCIGATTL

SEQ ID NO: 3010172 - protein, 18 aa, Entamoeba invadens
NILKRRRITRNAVNKMES

SEQ ID NO: 3010173 - protein, 32 aa, Entamoeba invadens
NILKYVECYLINDMLWLVTELMDFGELTNLID

SEQ ID NO: 3010174 - protein, 20 aa, Entamoeba invadens
NILLDLPVFCEDTTEPYFRA

SEQ ID NO: 3010175 - protein, 22 aa, Entamoeba invadens
NILMINKIFQQLFQQQEPFPNT

SEQ ID NO: 3010176 - protein, 27 aa, Entamoeba invadens
NILMKVKHPFLVNLYYSFQTTTHLHYV

SEQ ID NO: 3010177 - protein, 19 aa, Entamoeba invadens
NILNLLRKKHSEGGKWFGV

SEQ ID NO: 3010178 - protein, 27 aa, Entamoeba invadens
NILNSNPFYLQPMTPPSLIRLNQFEEE

SEQ ID NO: 3010179 - protein, 19 aa, Entamoeba invadens
NILPELSLPTSVLSIGNEC

SEQ ID NO: 3010180 - protein, 20 aa, Entamoeba invadens
NILPYVPMVLPKILERVNMN

SEQ ID NO: 3010181 - protein, 21 aa, Entamoeba invadens
NILSILNRAFAKSNLKEIVLP

SEQ ID NO: 3010182 - protein, 19 aa, Entamoeba invadens
NILTLADYIVQNSPLFRTQ

SEQ ID NO: 3010183 - protein, 17 aa, Entamoeba invadens
NILVDHIHVEQIAVAET

SEQ ID NO: 3010184 - protein, 20 aa, Entamoeba invadens
NILVLRSKVQWLNNGQIASL

SEQ ID NO: 3010185 - protein, 20 aa, Entamoeba invadens
NILYTLKDLTKSFSGRIVIL

SEQ ID NO: 3010186 - protein, 20 aa, Entamoeba invadens
NIMPPKTTWFEPKLRSGMVI

SEQ ID NO: 3010187 - protein, 24 aa, Entamoeba invadens
NINELEFMIGPKLYEASWQDLANQ

SEQ ID NO: 3010188 - protein, 18 aa, Entamoeba invadens
NINFWSVETMKCVATIDT

SEQ ID NO: 3010189 - protein, 19 aa, Entamoeba invadens
NINIPLEQYVKFRVDEVEL

SEQ ID NO: 3010190 - protein, 26 aa, Entamoeba invadens
NINLQVILIPMFLGGITDFYFRDDTK

SEQ ID NO: 3010191 - protein, 20 aa, Entamoeba invadens
NINMLRNHFFREGRLSIDCA

SEQ ID NO: 3010192 - protein, 23 aa, Entamoeba invadens
NINMVDPFFEAMFSLGEQDLYLM

SEQ ID NO: 3010193 - protein, 30 aa, Entamoeba invadens
NINQSALFNFTYQLAHLYFNGTNSVCFPTS

SEQ ID NO: 3010194 - protein, 27 aa, Entamoeba invadens
NINQTDSFVLIFSITSRKSFEQIPTLR

SEQ ID NO: 3010195 - protein, 26 aa, Entamoeba invadens
NINTFRPVLMLFDAMIVDGYNITKQI

SEQ ID NO: 3010196 - protein, 21 aa, Entamoeba invadens
NIPAEFLLHVAHAIHWSDRKE

SEQ ID NO: 3010197 - protein, 26 aa, Entamoeba invadens
NIPAKQLMYLAFDRKTILPSDCEIFV

SEQ ID NO: 3010198 - protein, 25 aa, Entamoeba invadens
NIPESFVNLLLYTLNEYISDSKELQ

SEQ ID NO: 3010199 - protein, 23 aa, Entamoeba invadens
NIPHDFLPFISRLGNYAIRPRTL

SEQ ID NO: 3010200 - protein, 19 aa, Entamoeba invadens
NIPIIPQDALELEHSLLTL

SEQ ID NO: 3010201 - protein, 24 aa, Entamoeba invadens
NIPKLQEWTPFKTYERIYDSKTDC

SEQ ID NO: 3010202 - protein, 17 aa, Entamoeba invadens
NIPLDDKFIYVSERIRS

SEQ ID NO: 3010203 - protein, 22 aa, Entamoeba invadens
NIPLLLVELLLKNGANIDAKTQ

SEQ ID NO: 3010204 - protein, 18 aa, Entamoeba invadens
NIPLLWKTNEEDTFAPKG

SEQ ID NO: 3010205 - protein, 24 aa, Entamoeba invadens
NIPRSFLLNCINLKTIKFVDSVYR

SEQ ID NO: 3010206 - protein, 21 aa, Entamoeba invadens
NIPSRLALYNKTPVIPSVSVQ

SEQ ID NO: 3010207 - protein, 20 aa, Entamoeba invadens
NIPTLKTFFVIYENKKQKFV

SEQ ID NO: 3010208 - protein, 20 aa, Entamoeba invadens
NIPYLSMHYLQNLELGKYEK

SEQ ID NO: 3010209 - protein, 25 aa, Entamoeba invadens
NIQAYELMILLSILNKTFNITLNVP

SEQ ID NO: 3010210 - protein, 27 aa, Entamoeba invadens
NIQDVFLEMAPLLVFIRDFVGNNQRAI

SEQ ID NO: 3010211 - protein, 25 aa, Entamoeba invadens
NIQEIIRTIFNDVTVITVAHRLQTI

SEQ ID NO: 3010212 - protein, 23 aa, Entamoeba invadens
NIQFPSHFVIPKNVTKIGSFFFS

SEQ ID NO: 3010213 - protein, 22 aa, Entamoeba invadens
NIQITVKKLWKGVWKNVCGVIK

SEQ ID NO: 3010214 - protein, 28 aa, Entamoeba invadens
NIQKFDKYLTFIPIFRGFQNHNPNYSRH

SEQ ID NO: 3010215 - protein, 24 aa, Entamoeba invadens
NIQLLPVTAYLDAPVNRFLKYPKI

SEQ ID NO: 3010216 - protein, 32 aa, Entamoeba invadens
NIQMPPSLLSRFDLIYLILDRPDLERDKRLAR

SEQ ID NO: 3010217 - protein, 27 aa, Entamoeba invadens
NIQNPNPFALPLMTPPSLLQLNVLAIK

SEQ ID NO: 3010218 - protein, 24 aa, Entamoeba invadens
NIQQPALPQILQPTLPTMPTIPQN

SEQ ID NO: 3010219 - protein, 27 aa, Entamoeba invadens
NIQVFSYGCAILYVSKFFSKIDELKTL

SEQ ID NO: 3010220 - protein, 27 aa, Entamoeba invadens
NIQYLVMEYVEYPLLGYISQQERIGKY

SEQ ID NO: 3010221 - protein, 27 aa, Entamoeba invadens
NIRDMYIHYHVLEPHLFTLSMENSYCA

SEQ ID NO: 3010222 - protein, 25 aa, Entamoeba invadens
NIREYDVIIISRPWGRPGAFRNKQS

SEQ ID NO: 3010223 - protein, 18 aa, Entamoeba invadens
NIRHIFLRENMMANLFFN

SEQ ID NO: 3010224 - protein, 21 aa, Entamoeba invadens
NIRKCFVCGKFGHKSQDCPEK

SEQ ID NO: 3010225 - protein, 23 aa, Entamoeba invadens
NIRKLKIEGYMLFIIAVNNNEFV

SEQ ID NO: 3010226 - protein, 30 aa, Entamoeba invadens
NIRVSFLEGLVFVFVYFMDVAHAEECVSMT

SEQ ID NO: 3010227 - protein, 23 aa, Entamoeba invadens
NISAFIQNFVFDACLEFGYFFDS

SEQ ID NO: 3010228 - protein, 26 aa, Entamoeba invadens
NISAFPRYLALLNFERIKVIFKVIGL

SEQ ID NO: 3010229 - protein, 27 aa, Entamoeba invadens
NISCFSCVTGYFLNRFSCVQCSVGCAT

SEQ ID NO: 3010230 - protein, 27 aa, Entamoeba invadens
NISCKDRLIFIFRVNGDIFGLYQDGFV

SEQ ID NO: 3010231 - protein, 23 aa, Entamoeba invadens
NISFINRFEIINSGVFEGTKIKS

SEQ ID NO: 3010232 - protein, 19 aa, Entamoeba invadens
NISHFAFRWLTCCLSREFS

SEQ ID NO: 3010233 - protein, 23 aa, Entamoeba invadens
NISIIFHDHFTPLRIHQTRTSYR

SEQ ID NO: 3010234 - protein, 30 aa, Entamoeba invadens
NISKMSPFIFFMQEFAQNKFYVCYRLEPLT

SEQ ID NO: 3010235 - protein, 25 aa, Entamoeba invadens
NISKRFETRLLWKDGPVFQSLNYEN

SEQ ID NO: 3010236 - protein, 22 aa, Entamoeba invadens
NISMKMYFNKTCSYLGNVIALD

SEQ ID NO: 3010237 - protein, 26 aa, Entamoeba invadens
NISNWLILRERLVADDIPYVKVLVQN

SEQ ID NO: 3010238 - protein, 18 aa, Entamoeba invadens
NISPNFYIQFASPNVYQF

SEQ ID NO: 3010239 - protein, 26 aa, Entamoeba invadens
NISPPTLFLEKLYKHRLTSFPKILQE

SEQ ID NO: 3010240 - protein, 18 aa, Entamoeba invadens
NISPRLRSSTPSNVAFRT

SEQ ID NO: 3010241 - protein, 23 aa, Entamoeba invadens
NISQKIIPFLQTGKMQRVIILLM

SEQ ID NO: 3010242 - protein, 26 aa, Entamoeba invadens
NISSFGEFLIYYQVIEKAICKELNVS

SEQ ID NO: 3010243 - protein, 22 aa, Entamoeba invadens
NISYICSRYYRAPELIFGATKY

SEQ ID NO: 3010244 - protein, 18 aa, Entamoeba invadens
NISYYKKIQTKLLFEPKS

SEQ ID NO: 3010245 - protein, 36 aa, Entamoeba invadens
NITAVELLICDILIEAYPYVPILKSGPDDLDSFIQL

SEQ ID NO: 3010246 - protein, 21 aa, Entamoeba invadens
NITELMWDQKFTRIPDRIVYG

SEQ ID NO: 3010247 - protein, 30 aa, Entamoeba invadens
NITELVWDQKFTRIPDRIVYGCVNISRIEI

SEQ ID NO: 3010248 - protein, 25 aa, Entamoeba invadens
NITEPVKHFILLASAVIGVDNGEED

SEQ ID NO: 3010249 - protein, 34 aa, Entamoeba invadens
NITFIMVQIVPDYLYILEPIYLANVAIYIDRFSS

SEQ ID NO: 3010250 - protein, 25 aa, Entamoeba invadens
NITFKDLRRILRKMLSYDEKERIGY

SEQ ID NO: 3010251 - protein, 24 aa, Entamoeba invadens
NITFRFKFQFTDTVLLFQKGAFDY

SEQ ID NO: 3010252 - protein, 18 aa, Entamoeba invadens
NITITRYKKELERLNTKI

SEQ ID NO: 3010253 - protein, 26 aa, Entamoeba invadens
NITKSGEKFAFRLSPVRSSRILDVGI

SEQ ID NO: 3010254 - protein, 17 aa, Entamoeba invadens
NITLFSNNLHLVLKMQL

SEQ ID NO: 3010255 - protein, 31 aa, Entamoeba invadens
NITLTQYWRSKMVMWPDLAKAALRYTTLLCV

SEQ ID NO: 3010256 - protein, 26 aa, Entamoeba invadens
NITNSVVIYILIVSTFLERSEAITNI

SEQ ID NO: 3010257 - protein, 21 aa, Entamoeba invadens
NITNVLRITQIILNKNTIGAQ

SEQ ID NO: 3010258 - protein, 29 aa, Entamoeba invadens
NITPRRMCTLYWDYAIRRKWDSFYTVIED

SEQ ID NO: 3010259 - protein, 23 aa, Entamoeba invadens
NITQCGIGLFVSEKGRGCITDTL

SEQ ID NO: 3010260 - protein, 27 aa, Entamoeba invadens
NITSINKLCFGYCTMLSFIEIPTSVKS

SEQ ID NO: 3010261 - protein, 27 aa, Entamoeba invadens
NITTSLLFEFIWPPAYGDRIDTKELVD

SEQ ID NO: 3010262 - protein, 17 aa, Entamoeba invadens
NITVLRNLLMSHLSSIL

SEQ ID NO: 3010263 - protein, 36 aa, Entamoeba invadens
NITWDKTSLPPPHFTRRLHPLYHVVDIIAVSKPNAV

SEQ ID NO: 3010264 - protein, 27 aa, Entamoeba invadens
NIVAFFKACVIVPFRAILTEYVANGTL

SEQ ID NO: 3010265 - protein, 25 aa, Entamoeba invadens
NIVDIPYTLIWDIRVIVQSIRETSI

SEQ ID NO: 3010266 - protein, 17 aa, Entamoeba invadens
NIVEPFPYFCLKNVYEE

SEQ ID NO: 3010267 - protein, 18 aa, Entamoeba invadens
NIVHLPDSISNLSSLRYL

SEQ ID NO: 3010268 - protein, 21 aa, Entamoeba invadens
NIVIDILYIWKEKAVSAIQSL

SEQ ID NO: 3010269 - protein, 19 aa, Entamoeba invadens
NIVLPYTLTSIGKMSFWCC

SEQ ID NO: 3010270 - protein, 17 aa, Entamoeba invadens
NIVMKRYNLVAGDFPPI

SEQ ID NO: 3010271 - protein, 18 aa, Entamoeba invadens
NIVMRRYNLAAGDFPPID

SEQ ID NO: 3010272 - protein, 27 aa, Entamoeba invadens
NIVPSARMMLFESVLMTFKGKLSYQYV

SEQ ID NO: 3010273 - protein, 18 aa, Entamoeba invadens
NIVQLTKGFLGKKNSALV

SEQ ID NO: 3010274 - protein, 29 aa, Entamoeba invadens
NIVQYVECYLINDMLWLVTELMNAGELTN

SEQ ID NO: 3010275 - protein, 20 aa, Entamoeba invadens
NIVSMLSYKKTKLTTFLVIE

SEQ ID NO: 3010276 - protein, 19 aa, Entamoeba invadens
NIVTIYQFIEAPNSVLHTF

SEQ ID NO: 3010277 - protein, 22 aa, Entamoeba invadens
NIVTLLNIYNTGKTLYLVFEYC

SEQ ID NO: 3010278 - protein, 20 aa, Entamoeba invadens
NIVVFLFPHNKYVIGFHYFQ

SEQ ID NO: 3010279 - protein, 18 aa, Entamoeba invadens
NIVVKRLLEWMRTIDDES

SEQ ID NO: 3010280 - protein, 24 aa, Entamoeba invadens
NIVVLRELYKLIDISKLDSLKNRG

SEQ ID NO: 3010281 - protein, 26 aa, Entamoeba invadens
NIVYRDILGYCRLLHAVKKVLLLAYE

SEQ ID NO: 3010282 - protein, 27 aa, Entamoeba invadens
NIVYYIGDYSCRYPNLLEGWVGYLYGR

SEQ ID NO: 3010283 - protein, 25 aa, Entamoeba invadens
NIWANFYCANFIPPTLKNSGRDLTG

SEQ ID NO: 3010284 - protein, 21 aa, Entamoeba invadens
NIWSYLIQYKVHDKSKNLHKA

SEQ ID NO: 3010285 - protein, 21 aa, Entamoeba invadens
NIYNKYGKYCAYNFLCDLPHN

SEQ ID NO: 3010286 - protein, 17 aa, Entamoeba invadens
NIYSYDGFAKQLETFKT

SEQ ID NO: 3010287 - protein, 25 aa, Entamoeba invadens
NKADKLLLEATKLVPMGFVNASDIN

SEQ ID NO: 3010288 - protein, 22 aa, Entamoeba invadens
NKAFLEGLIALCLKIIENPTSK

SEQ ID NO: 3010289 - protein, 31 aa, Entamoeba invadens
NKAVLVPDKMFSNDFAYFQMNGVTIGNHEYA

SEQ ID NO: 3010290 - protein, 21 aa, Entamoeba invadens
NKAYYEVKAFADFLTIGQSPI

SEQ ID NO: 3010291 - protein, 24 aa, Entamoeba invadens
NKCAKCQSGYWVDTLTNTCVDHEP

SEQ ID NO: 3010292 - protein, 26 aa, Entamoeba invadens
NKCDIYTRTILYGNILLSGGTSMVFN

SEQ ID NO: 3010293 - protein, 18 aa, Entamoeba invadens
NKCHSLVNITLPSSLSLL

SEQ ID NO: 3010294 - protein, 29 aa, Entamoeba invadens
NKCTDDMILWGLFSLANALHFLNVSAKLG

SEQ ID NO: 3010295 - protein, 24 aa, Entamoeba invadens
NKCVRCLPTTLLGISNRETVCSKS

SEQ ID NO: 3010296 - protein, 25 aa, Entamoeba invadens
NKDDWKKFYEAFGKNLKLGIHEDTT

SEQ ID NO: 3010297 - protein, 23 aa, Entamoeba invadens
NKDEIILLIMSFSHFLALDDQTV

SEQ ID NO: 3010298 - protein, 26 aa, Entamoeba invadens
NKDIIKEFIYILPPAELYKGVRIDAE

SEQ ID NO: 3010299 - protein, 23 aa, Entamoeba invadens
NKDIVPLFFKKNCVTKHSFSVYD

SEQ ID NO: 3010300 - protein, 21 aa, Entamoeba invadens
NKDIYLMFEYMETDLHAVIRA

SEQ ID NO: 3010301 - protein, 34 aa, Entamoeba invadens
NKDKLKLLMTYFNKVWIVRYPPPEWNQSLDLLMK

SEQ ID NO: 3010302 - protein, 27 aa, Entamoeba invadens
NKDKLKSGLALLLKQKDDLQNKICAMK

SEQ ID NO: 3010303 - protein, 26 aa, Entamoeba invadens
NKDLMVINEYLFAPKILCVELTHLDV

SEQ ID NO: 3010304 - protein, 22 aa, Entamoeba invadens
NKDLTLKMHFKTFEKYFKVTEK

SEQ ID NO: 3010305 - protein, 22 aa, Entamoeba invadens
NKDTNIFFRLPVEITTLEVNSP

SEQ ID NO: 3010306 - protein, 20 aa, Entamoeba invadens
NKDVLMFITENYPDFIDQPN

SEQ ID NO: 3010307 - protein, 22 aa, Entamoeba invadens
NKDVMLLHYRKCLSKRVIYDDQ

SEQ ID NO: 3010308 - protein, 27 aa, Entamoeba invadens
NKEACFVNYLSYNLLQFGYSFSINISR

SEQ ID NO: 3010309 - protein, 22 aa, Entamoeba invadens
NKEDALYMFKKGEISFLNENYL

SEQ ID NO: 3010310 - protein, 34 aa, Entamoeba invadens
NKEEYQRRLLLDINLFEIRIDIIKKLAQLTKTFR

SEQ ID NO: 3010311 - protein, 18 aa, Entamoeba invadens
NKEFPAYRKLELNGKKIL

SEQ ID NO: 3010312 - protein, 23 aa, Entamoeba invadens
NKEFVPNFLKPISPYNGIIPILI

SEQ ID NO: 3010313 - protein, 25 aa, Entamoeba invadens
NKEGKWEFFFLFQVIESKSDITKVE

SEQ ID NO: 3010314 - protein, 17 aa, Entamoeba invadens
NKEGVDVFGRRVTDYII

SEQ ID NO: 3010315 - protein, 28 aa, Entamoeba invadens
NKEIEVQKYVFIFTNFKDLIGELQKLMN

SEQ ID NO: 3010316 - protein, 29 aa, Entamoeba invadens
NKELQSEIEWLKKKIAVREKLDEKKKLEK

SEQ ID NO: 3010317 - protein, 27 aa, Entamoeba invadens
NKENDTLKTVILTEQKKSKQFEDQLLK

SEQ ID NO: 3010318 - protein, 30 aa, Entamoeba invadens
NKENFSRAYSWMPIIFGVSYEEFFASLIHF

SEQ ID NO: 3010319 - protein, 43 aa, Entamoeba invadens
NKENSKPIFLLVVDLIDLLSAFIPLPPEMIQVKTFIVTSRFIP

SEQ ID NO: 3010320 - protein, 25 aa, Entamoeba invadens
NKEVEFSFQILSKKSFSVIAENKEL

SEQ ID NO: 3010321 - protein, 25 aa, Entamoeba invadens
NKEVGTFHRLLSPGPYQNIFNRASK

SEQ ID NO: 3010322 - protein, 25 aa, Entamoeba invadens
NKEVNIMLMRFFSSVGIPFSQIRNP

SEQ ID NO: 3010323 - protein, 23 aa, Entamoeba invadens
NKFDMRLYCKFYFCQDVRILKEG

SEQ ID NO: 3010324 - protein, 21 aa, Entamoeba invadens
NKFHLRCIINLFGDGPGSLFS

SEQ ID NO: 3010325 - protein, 24 aa, Entamoeba invadens
NKFLGEKPWKKDPYYFKRCLISAV

SEQ ID NO: 3010326 - protein, 24 aa, Entamoeba invadens
NKFLNELMPLQKEDFRGLLTTMNG

SEQ ID NO: 3010327 - protein, 25 aa, Entamoeba invadens
NKFTREVHILPYYFQVIDGVNSKNE

SEQ ID NO: 3010328 - protein, 22 aa, Entamoeba invadens
NKGDYIMKVFDTPSPDYKTPFL

SEQ ID NO: 3010329 - protein, 22 aa, Entamoeba invadens
NKGRWIILTEKCIKYLRQVIVA

SEQ ID NO: 3010330 - protein, 25 aa, Entamoeba invadens
NKGYTMPQIMPLVTDKFIHKIARNN

SEQ ID NO: 3010331 - protein, 23 aa, Entamoeba invadens
NKHDYTLALHYYESALKVVPSHQ

SEQ ID NO: 3010332 - protein, 19 aa, Entamoeba invadens
NKHFSTTYGIFLDTSGELV

SEQ ID NO: 3010333 - protein, 20 aa, Entamoeba invadens
NKICERQQLIAEYESGSAIP

SEQ ID NO: 3010334 - protein, 27 aa, Entamoeba invadens
NKIDKECFWLCPYIENVNLPASLTSIG

SEQ ID NO: 3010335 - protein, 23 aa, Entamoeba invadens
NKIDNLRPKWLISGKMNGGTRDW

SEQ ID NO: 3010336 - protein, 26 aa, Entamoeba invadens
NKIEEQLNLVSSEKEKLLGDLAHGSD

SEQ ID NO: 3010337 - protein, 21 aa, Entamoeba invadens
NKIEFFEVVVWYIVNYTTTQK

SEQ ID NO: 3010338 - protein, 41 aa, Entamoeba invadens
NKIGLVMFGTPFGWNWIPGISWYFYRGFLEPIVSAQPNAAH

SEQ ID NO: 3010339 - protein, 29 aa, Entamoeba invadens
NKIICNNLSWIIMLVSSWKAMGPINKEKK

SEQ ID NO: 3010340 - protein, 35 aa, Entamoeba invadens
NKIINFLLTCTSPYKFFQLLFSHLIMAEAAFKAID

SEQ ID NO: 3010341 - protein, 22 aa, Entamoeba invadens
NKIIVKVLKHKGVPVAAKQILV

SEQ ID NO: 3010342 - protein, 31 aa, Entamoeba invadens
NKIKIKYVINLFALTMYWADDTHFTLQNTNF

SEQ ID NO: 3010343 - protein, 19 aa, Entamoeba invadens
NKILETIPVFTQKALACLV

SEQ ID NO: 3010344 - protein, 28 aa, Entamoeba invadens
NKIMMDDDLYGECYPVIGGSVFADVDKN

SEQ ID NO: 3010345 - protein, 18 aa, Entamoeba invadens
NKIRFNFKQMLQTGKDKI

SEQ ID NO: 3010346 - protein, 24 aa, Entamoeba invadens
NKIVLGCHTVLANGGLIAAAGAFN

SEQ ID NO: 3010347 - protein, 24 aa, Entamoeba invadens
NKIVTSAYWVYSDQVSKTAPSGEY

SEQ ID NO: 3010348 - protein, 24 aa, Entamoeba invadens
NKKAYLRQGLLECAALTMLNTYFD

SEQ ID NO: 3010349 - protein, 26 aa, Entamoeba invadens
NKKCFFSCEFLKEIVLPDAITSIGNS

SEQ ID NO: 3010350 - protein, 23 aa, Entamoeba invadens
NKKCLHVLDLFTFNPISETQLFP

SEQ ID NO: 3010351 - protein, 39 aa, Entamoeba invadens
NKKDAIFSTRWFPPKIRKMRIKYLPIINMTKALSFYSQL

SEQ ID NO: 3010352 - protein, 30 aa, Entamoeba invadens
NKKDDIIITPRSLLGIIRLSQSLARIRFSQ

SEQ ID NO: 3010353 - protein, 24 aa, Entamoeba invadens
NKKDFYKIVVWYQVDFDTFHKVAK

SEQ ID NO: 3010354 - protein, 20 aa, Entamoeba invadens
NKKELAKFLKLIGTTKKEDI

SEQ ID NO: 3010355 - protein, 24 aa, Entamoeba invadens
NKKGSFITMMAALMMGACGLTNNQ

SEQ ID NO: 3010356 - protein, 21 aa, Entamoeba invadens
NKKIEDCRMVFIGAGSSNTTC

SEQ ID NO: 3010357 - protein, 29 aa, Entamoeba invadens
NKKIKVRLVPRFDIQKYQTIAKKKLELMK

SEQ ID NO: 3010358 - protein, 25 aa, Entamoeba invadens
NKKLLAFYMNMFYEFCTMSNIHKME

SEQ ID NO: 3010359 - protein, 22 aa, Entamoeba invadens
NKKLPIKRYSLKNSIPTAYASK

SEQ ID NO: 3010360 - protein, 24 aa, Entamoeba invadens
NKKNLIFIMFDVVHNVFGCYVEDS

SEQ ID NO: 3010361 - protein, 30 aa, Entamoeba invadens
NKKNQLTYEDLLLLLLTQLHGDYRYKELFE

SEQ ID NO: 3010362 - protein, 17 aa, Entamoeba invadens
NKKPFAPSFHKSHPFCL

SEQ ID NO: 3010363 - protein, 26 aa, Entamoeba invadens
NKKQNLDFLLLTNCTDLSLLGKLRSF

SEQ ID NO: 3010364 - protein, 24 aa, Entamoeba invadens
NKKQQSLHLLPLNQQIIQLFEKCV

SEQ ID NO: 3010365 - protein, 21 aa, Entamoeba invadens
NKKRGIYVLDFLLHKKKDLLS

SEQ ID NO: 3010366 - protein, 22 aa, Entamoeba invadens
NKKSFDSINFWIDDFKKSEGDT

SEQ ID NO: 3010367 - protein, 28 aa, Entamoeba invadens
NKKSLNYMYGLYGNPFYRSVFSEHRFKQ

SEQ ID NO: 3010368 - protein, 30 aa, Entamoeba invadens
NKKSYGVPYCLKLLELFYKTNVIDQKDVIN

SEQ ID NO: 3010369 - protein, 23 aa, Entamoeba invadens
NKKTIKFFPKIETLNLWNCDNEV

SEQ ID NO: 3010370 - protein, 24 aa, Entamoeba invadens
NKKTIKYFPNIKTLNLWSFDDENF

SEQ ID NO: 3010371 - protein, 20 aa, Entamoeba invadens
NKKVLVIVKTTKNDIFGGYC

SEQ ID NO: 3010372 - protein, 33 aa, Entamoeba invadens
NKKVVGVIVYWKLLNSFFYIEHFAVFSEFRGEK

SEQ ID NO: 3010373 - protein, 20 aa, Entamoeba invadens
NKKYFIPKCVAKKLLDNVEG

SEQ ID NO: 3010374 - protein, 27 aa, Entamoeba invadens
NKKYKQVFEYIFYFITGQRASEKTKVS

SEQ ID NO: 3010375 - protein, 25 aa, Entamoeba invadens
NKLAPIIEVPPPMLPNRDKIIQVLG

SEQ ID NO: 3010376 - protein, 21 aa, Entamoeba invadens
NKLCQFQVPQKVRFVGSFAFK

SEQ ID NO: 3010377 - protein, 21 aa, Entamoeba invadens
NKLEFSSPKSLPKKKSESPSK

SEQ ID NO: 3010378 - protein, 20 aa, Entamoeba invadens
NKLFTLPKETIVIPGHGSRT

SEQ ID NO: 3010379 - protein, 25 aa, Entamoeba invadens
NKLGVLGNFLFYIREGKARVTIRTV

SEQ ID NO: 3010380 - protein, 25 aa, Entamoeba invadens
NKLHDQLLVPLKTYYEQFVMLSNRV

SEQ ID NO: 3010381 - protein, 20 aa, Entamoeba invadens
NKLKAWRHSLPYKRVVISPF

SEQ ID NO: 3010382 - protein, 22 aa, Entamoeba invadens
NKLKLGVLKFLESYKDVPTIKL

SEQ ID NO: 3010383 - protein, 29 aa, Entamoeba invadens
NKLNRQTAWLRKHLIRPNILLTAVQEHVT

SEQ ID NO: 3010384 - protein, 26 aa, Entamoeba invadens
NKLQKTMIGTPYWMPPEIILETGHNQ

SEQ ID NO: 3010385 - protein, 26 aa, Entamoeba invadens
NKLSKLFATTILIMKCTKLEVSISAV

SEQ ID NO: 3010386 - protein, 29 aa, Entamoeba invadens
NKLSKTSILRYLGILLYMGAHHDVINPVE

SEQ ID NO: 3010387 - protein, 26 aa, Entamoeba invadens
NKLSQLIFECSLSFSINDFYELIFDQ

SEQ ID NO: 3010388 - protein, 24 aa, Entamoeba invadens
NKLVPVNLWNFCFGDGLRLKRRCP

SEQ ID NO: 3010389 - protein, 17 aa, Entamoeba invadens
NKLYFVMDFVNGGELFF

SEQ ID NO: 3010390 - protein, 23 aa, Entamoeba invadens
NKMEKFVCTLKKKCKQLSYQITK

SEQ ID NO: 3010391 - protein, 19 aa, Entamoeba invadens
NKMEVYQLAALFSVFVFEP

SEQ ID NO: 3010392 - protein, 27 aa, Entamoeba invadens
NKMFREVLVIIKKIKALSPLIAIKCSL

SEQ ID NO: 3010393 - protein, 34 aa, Entamoeba invadens
NKMKAYCTGFIPIKEMFYTLSLAGDLFDNAAPFQ

SEQ ID NO: 3010394 - protein, 17 aa, Entamoeba invadens
NKMKPTPLVPKNKKDDF

SEQ ID NO: 3010395 - protein, 26 aa, Entamoeba invadens
NKMPKRILLLWKRGEALIWTEEVCGY

SEQ ID NO: 3010396 - protein, 39 aa, Entamoeba invadens
NKNEIITFVHYLPSFWHFHVHFCSIYSPLFKSANVNIGK

SEQ ID NO: 3010397 - protein, 31 aa, Entamoeba invadens
NKNFQYFEFAPYKMFISFVYPKRVHDIRGGA

SEQ ID NO: 3010398 - protein, 26 aa, Entamoeba invadens
NKNIDSIILRRFPFGRTNSAVHICPV

SEQ ID NO: 3010399 - protein, 28 aa, Entamoeba invadens
NKNIFLTNMLFDFALEYGYFFNSKLARN

SEQ ID NO: 3010400 - protein, 29 aa, Entamoeba invadens
NKNIPEKLSLIFIVKKYLTNIVRSLSKSK

SEQ ID NO: 3010401 - protein, 26 aa, Entamoeba invadens
NKNKEGVQVSLESKQEKPVDESTSQI

SEQ ID NO: 3010402 - protein, 23 aa, Entamoeba invadens
NKNLLSQYAYIYTRFRVEFEDVT

SEQ ID NO: 3010403 - protein, 20 aa, Entamoeba invadens
NKNVFLDKGVRHPALSAVFM

SEQ ID NO: 3010404 - protein, 28 aa, Entamoeba invadens
NKNVGVQIIQLFKFLPGKDMFEQHYQLM

SEQ ID NO: 3010405 - protein, 17 aa, Entamoeba invadens
NKNVLVIFYSPDCAKCK

SEQ ID NO: 3010406 - protein, 17 aa, Entamoeba invadens
NKNVLVIFYSPECAKCE

SEQ ID NO: 3010407 - protein, 17 aa, Entamoeba invadens
NKNVLVIFYSPECAKCK

SEQ ID NO: 3010408 - protein, 29 aa, Entamoeba invadens
NKNVSAFLRNFLFDACFEFGFFFESKMSK

SEQ ID NO: 3010409 - protein, 24 aa, Entamoeba invadens
NKPDNTEYFFWKEVLCMTNEYNEY

SEQ ID NO: 3010410 - protein, 25 aa, Entamoeba invadens
NKPFDDFYVPNLIGVQILSMSKRIM

SEQ ID NO: 3010411 - protein, 21 aa, Entamoeba invadens
NKPFVFVSILDVRKLIYLLGM

SEQ ID NO: 3010412 - protein, 23 aa, Entamoeba invadens
NKPNNIHFVYTKKGKVNIITCNI

SEQ ID NO: 3010413 - protein, 24 aa, Entamoeba invadens
NKPTRFFGDQFGKMVRFNVFKDKE

SEQ ID NO: 3010414 - protein, 26 aa, Entamoeba invadens
NKQCRVCIDGYYPSNANLSCIPCDST

SEQ ID NO: 3010415 - protein, 25 aa, Entamoeba invadens
NKQGRVFWVSKPTEACLFVVGNNDI

SEQ ID NO: 3010416 - protein, 26 aa, Entamoeba invadens
NKQLLGQCKYLNKKYIRAIQTIKTND

SEQ ID NO: 3010417 - protein, 18 aa, Entamoeba invadens
NKQMFSELYLIQGGFCDL

SEQ ID NO: 3010418 - protein, 21 aa, Entamoeba invadens
NKQMYWLPYNDSGNFMRMSSL

SEQ ID NO: 3010419 - protein, 27 aa, Entamoeba invadens
NKQNKPLRLIIMSATLRVSEFLDNTNL

SEQ ID NO: 3010420 - protein, 26 aa, Entamoeba invadens
NKQSLNSLFPGLKNLFCECVEKCTNV

SEQ ID NO: 3010421 - protein, 21 aa, Entamoeba invadens
NKRARWILDLLKTDEKEKKTN

SEQ ID NO: 3010422 - protein, 24 aa, Entamoeba invadens
NKRDLIYTDLPRLFYTVAKTPNIK

SEQ ID NO: 3010423 - protein, 22 aa, Entamoeba invadens
NKRDLWLTAVGFKDVNYFKLIQ

SEQ ID NO: 3010424 - protein, 26 aa, Entamoeba invadens
NKRDMSFVIAFLLYKGVIVRELTKQL

SEQ ID NO: 3010425 - protein, 23 aa, Entamoeba invadens
NKRDTMINLGRYTRIGAVIDVLG

SEQ ID NO: 3010426 - protein, 25 aa, Entamoeba invadens
NKRGSFITMMAALMMGACGLTNNQI

SEQ ID NO: 3010427 - protein, 21 aa, Entamoeba invadens
NKRIKHFFDVDQIEILELYNK

SEQ ID NO: 3010428 - protein, 19 aa, Entamoeba invadens
NKRLKTILECSEANLKDLK

SEQ ID NO: 3010429 - protein, 23 aa, Entamoeba invadens
NKRLSHILVHSPYLFSSSFQNLT

SEQ ID NO: 3010430 - protein, 24 aa, Entamoeba invadens
NKRSEWFRKQFHPIELRERRLLKQ

SEQ ID NO: 3010431 - protein, 24 aa, Entamoeba invadens
NKRTESPLVFHTHLGATAARKRCN

SEQ ID NO: 3010432 - protein, 24 aa, Entamoeba invadens
NKRVEWVFMKKVVASSFIGGCLSG

SEQ ID NO: 3010433 - protein, 18 aa, Entamoeba invadens
NKRVFTQNLLFDICSEVG

SEQ ID NO: 3010434 - protein, 19 aa, Entamoeba invadens
NKSAVFFEMKNWKFVIQIC

SEQ ID NO: 3010435 - protein, 28 aa, Entamoeba invadens
NKSENPPYFYYMYYTYANIAVLNSYRTT

SEQ ID NO: 3010436 - protein, 25 aa, Entamoeba invadens
NKSFDNFYVPNLIGVQILSMSKRIM

SEQ ID NO: 3010437 - protein, 19 aa, Entamoeba invadens
NKSFRYELKCHCKSIASTS

SEQ ID NO: 3010438 - protein, 25 aa, Entamoeba invadens
NKSGTLFYLHCENKWFGECKILYTH

SEQ ID NO: 3010439 - protein, 33 aa, Entamoeba invadens
NKSIFIQNFFIDTLLEKGFFFNSKLSKKSDKTL

SEQ ID NO: 3010440 - protein, 25 aa, Entamoeba invadens
NKSLKKMSRLVSVSKLIAPTNSISS

SEQ ID NO: 3010441 - protein, 24 aa, Entamoeba invadens
NKSNKKLNILKPKNIYVTFEKENL

SEQ ID NO: 3010442 - protein, 23 aa, Entamoeba invadens
NKSNKKLNILKTKNIYVTFEKEN

SEQ ID NO: 3010443 - protein, 29 aa, Entamoeba invadens
NKSVLKKTFFQIIVWFDVDFETVDKNKSR

SEQ ID NO: 3010444 - protein, 24 aa, Entamoeba invadens
NKTDFFKIVVFYTVPYTPFKEDCA

SEQ ID NO: 3010445 - protein, 30 aa, Entamoeba invadens
NKTGVDCFQFTIIAKSKRGGPVKPGHAKFA

SEQ ID NO: 3010446 - protein, 24 aa, Entamoeba invadens
NKTIPINKKWQRPLEKVQDSLGCI

SEQ ID NO: 3010447 - protein, 29 aa, Entamoeba invadens
NKTKIFKKAFYNIVVWFSVDFETVDKNKG

SEQ ID NO: 3010448 - protein, 24 aa, Entamoeba invadens
NKTKSMVIGFFKYIKNTESDISTF

SEQ ID NO: 3010449 - protein, 23 aa, Entamoeba invadens
NKTQIFKFPSFKTLQSAVDKLKG

SEQ ID NO: 3010450 - protein, 23 aa, Entamoeba invadens
NKTRKLFAHGIPSTLKTIGYTAF

SEQ ID NO: 3010451 - protein, 27 aa, Entamoeba invadens
NKTSTSFNWLMERCEKFGYQFKKRSTK

SEQ ID NO: 3010452 - protein, 21 aa, Entamoeba invadens
NKTTFLKQISLPTSLQFFSMK

SEQ ID NO: 3010453 - protein, 29 aa, Entamoeba invadens
NKTTVVPVDPFFVMLDLLSGKTTDISADT

SEQ ID NO: 3010454 - protein, 24 aa, Entamoeba invadens
NKTVDPIPFITKSSVFPVTRVVKF

SEQ ID NO: 3010455 - protein, 26 aa, Entamoeba invadens
NKTVSFLAYKKTLKWLSERGLITIRR

SEQ ID NO: 3010456 - protein, 31 aa, Entamoeba invadens
NKTYILRDDVKLIFFVFDKQGKKINKAFKEM

SEQ ID NO: 3010457 - protein, 23 aa, Entamoeba invadens
NKVAQCCICFTGDFMSPEEKIYT

SEQ ID NO: 3010458 - protein, 30 aa, Entamoeba invadens
NKVEAAFWYKAIAPLTHPYGVFGYPLEIAV

SEQ ID NO: 3010459 - protein, 20 aa, Entamoeba invadens
NKVFPLVQFEKTKYLVIPDV

SEQ ID NO: 3010460 - protein, 26 aa, Entamoeba invadens
NKVIGCKMTMYLLEKSRIVSQAKEDR

SEQ ID NO: 3010461 - protein, 36 aa, Entamoeba invadens
NKVINDIRRLIIKFPIENQIFIRRLLLLCKNVTNTK

SEQ ID NO: 3010462 - protein, 21 aa, Entamoeba invadens
NKVIPYFEITGKLLYENSKEA

SEQ ID NO: 3010463 - protein, 33 aa, Entamoeba invadens
NKVITSCITLPKGFYSWFFRVDKRALYSVLVLN

SEQ ID NO: 3010464 - protein, 31 aa, Entamoeba invadens
NKVKDNYFGGKVPPIFVVHSLKHVPKEIAAI

SEQ ID NO: 3010465 - protein, 18 aa, Entamoeba invadens
NKVPFFLARKVVKNPKMH

SEQ ID NO: 3010466 - protein, 22 aa, Entamoeba invadens
NKVPFVFRYDTQNVLLSLAVDV

SEQ ID NO: 3010467 - protein, 33 aa, Entamoeba invadens
NKVVPMVADLMRYFFHFVKATCPYIVEYNANLR

SEQ ID NO: 3010468 - protein, 21 aa, Entamoeba invadens
NKWMMVIFHTPNNPKYTFYFD

SEQ ID NO: 3010469 - protein, 25 aa, Entamoeba invadens
NKYCRGYLGRLKAKPTMKMLSQRRN

SEQ ID NO: 3010470 - protein, 23 aa, Entamoeba invadens
NKYHNMIHKPGKPGFSCPFAGKY

SEQ ID NO: 3010471 - protein, 22 aa, Entamoeba invadens
NKYMDIFVALDDLEKGYQDDIT

SEQ ID NO: 3010472 - protein, 23 aa, Entamoeba invadens
NKYPTLMFGVKRWNFTTQFINSY

SEQ ID NO: 3010473 - protein, 23 aa, Entamoeba invadens
NKYQLAQMFINCGGLTILSQILA

SEQ ID NO: 3010474 - protein, 31 aa, Entamoeba invadens
NKYSCITCDIGYYFLFAKCYHVLKIAQVVLK

SEQ ID NO: 3010475 - protein, 27 aa, Entamoeba invadens
NKYTGFMHPYSYGLFHPKQVELAKKDE

SEQ ID NO: 3010476 - protein, 25 aa, Entamoeba invadens
NKYVEKGIVFPPPIVRKDTHLEQQE

SEQ ID NO: 3010477 - protein, 19 aa, Entamoeba invadens
NKYYTFGFFTCVSPQYCVV

SEQ ID NO: 3010478 - protein, 28 aa, Entamoeba invadens
NLADNTFNIFNFEKSPKLTWRDVEKCFC

SEQ ID NO: 3010479 - protein, 28 aa, Entamoeba invadens
NLAELWSLFDFVYPGKLGTLPVFKQQFI

SEQ ID NO: 3010480 - protein, 32 aa, Entamoeba invadens
NLAFKLMQQGAQLLWRYITSWEIYTKKTTEKV

SEQ ID NO: 3010481 - protein, 22 aa, Entamoeba invadens
NLAIIFPSKIQIIRFFGQSEVV

SEQ ID NO: 3010482 - protein, 34 aa, Entamoeba invadens
NLAKDAIETIPIKKPIYIVALPRSGSTFTHTMLG

SEQ ID NO: 3010483 - protein, 18 aa, Entamoeba invadens
NLANFFQPMSTLTFETNT

SEQ ID NO: 3010484 - protein, 18 aa, Entamoeba invadens
NLAVLAYVDVPRSVKDKE

SEQ ID NO: 3010485 - protein, 26 aa, Entamoeba invadens
NLAYVQFLMKMFRLMGRSEALVMLEY

SEQ ID NO: 3010486 - protein, 21 aa, Entamoeba invadens
NLCELTLPDTLIDIGKHIFSD

SEQ ID NO: 3010487 - protein, 19 aa, Entamoeba invadens
NLCNKDIALRHHHSKNGQL

SEQ ID NO: 3010488 - protein, 26 aa, Entamoeba invadens
NLCPNGRNYFFMKGKTLMAVNKKVGE

SEQ ID NO: 3010489 - protein, 18 aa, Entamoeba invadens
NLDDVRPLFFVVNGSRHD

SEQ ID NO: 3010490 - protein, 38 aa, Entamoeba invadens
NLDFSKFPLLKRVILNMKILFPLSTLFPNKTQHFDMVK

SEQ ID NO: 3010491 - protein, 17 aa, Entamoeba invadens
NLDFVFPDELFSVPVSS

SEQ ID NO: 3010492 - protein, 35 aa, Entamoeba invadens
NLDLRSYLIMPVQRLPRYKLLLQELLKNTENTHED

SEQ ID NO: 3010493 - protein, 18 aa, Entamoeba invadens
NLDRLFVDEIRQMITLGL

SEQ ID NO: 3010494 - protein, 26 aa, Entamoeba invadens
NLDTFKSLKTLWLPEIKRLNRDIPIL

SEQ ID NO: 3010495 - protein, 28 aa, Entamoeba invadens
NLDYIQYILCIMWFKTVTPQDRVFLVNN

SEQ ID NO: 3010496 - protein, 25 aa, Entamoeba invadens
NLDYLSFWYFYLALGTRHDVFFTIE

SEQ ID NO: 3010497 - protein, 34 aa, Entamoeba invadens
NLEAFDLRKFPYNPIQFLQLQNSYYPKLKCSLDG

SEQ ID NO: 3010498 - protein, 20 aa, Entamoeba invadens
NLEDFQLRINGHKHRIEMLE

SEQ ID NO: 3010499 - protein, 23 aa, Entamoeba invadens
NLEDSLHIYNGFDFHSLTMQIEE

SEQ ID NO: 3010500 - protein, 23 aa, Entamoeba invadens
NLEDVVLKLKMLGIGLEETFFVE

SEQ ID NO: 3010501 - protein, 20 aa, Entamoeba invadens
NLEEILAIIMYADSTQVVIN

SEQ ID NO: 3010502 - protein, 23 aa, Entamoeba invadens
NLEFNVVIDLEKGKFVFAKKDEG

SEQ ID NO: 3010503 - protein, 28 aa, Entamoeba invadens
NLEHIIMSKTLRWIFVGGKGGVGKTTTA

SEQ ID NO: 3010504 - protein, 18 aa, Entamoeba invadens
NLEIKTFALFKEPCEVLY

SEQ ID NO: 3010505 - protein, 18 aa, Entamoeba invadens
NLEIMQFLINAGAKIDRY

SEQ ID NO: 3010506 - protein, 28 aa, Entamoeba invadens
NLEKKREPFMCPALYLISPSQESVDKII

SEQ ID NO: 3010507 - protein, 18 aa, Entamoeba invadens
NLEKLIPVLFTHKNFMAF

SEQ ID NO: 3010508 - protein, 19 aa, Entamoeba invadens
NLELIIQLITQLDRLNELV

SEQ ID NO: 3010509 - protein, 20 aa, Entamoeba invadens
NLELNELVRFMKAVKVEIGE

SEQ ID NO: 3010510 - protein, 19 aa, Entamoeba invadens
NLEMICKCAFFNCNKLSQF

SEQ ID NO: 3010511 - protein, 25 aa, Entamoeba invadens
NLEMLLKWIELVHLPITAVGPIFSP

SEQ ID NO: 3010512 - protein, 33 aa, Entamoeba invadens
NLEMVKALFYTKVRLVLILSGLDDKILEELSNE

SEQ ID NO: 3010513 - protein, 31 aa, Entamoeba invadens
NLEQDFDIEILYIFEILTLSKQLMNYIQDFI

SEQ ID NO: 3010514 - protein, 25 aa, Entamoeba invadens
NLERFYLLNVILYLNKRETILKFIL

SEQ ID NO: 3010515 - protein, 21 aa, Entamoeba invadens
NLERITIPSILTFFGKNAFKN

SEQ ID NO: 3010516 - protein, 20 aa, Entamoeba invadens
NLESFLPSTWDFVVRRVICI

SEQ ID NO: 3010517 - protein, 29 aa, Entamoeba invadens
NLFCGLNTLPFLFDLVFCSTFGGSYKISG

SEQ ID NO: 3010518 - protein, 21 aa, Entamoeba invadens
NLFGWLVTTFKMMRNVWKLPL

SEQ ID NO: 3010519 - protein, 35 aa, Entamoeba invadens
NLFHKTLEFLLENATFVFLLEKILDFAMYVIYNEG

SEQ ID NO: 3010520 - protein, 19 aa, Entamoeba invadens
NLFIKDAQPMVWEIAVILD

SEQ ID NO: 3010521 - protein, 23 aa, Entamoeba invadens
NLFLEVIQCFVKTPLWSEVSEML

SEQ ID NO: 3010522 - protein, 21 aa, Entamoeba invadens
NLFNFGKFVVRFYNIGDLKAV

SEQ ID NO: 3010523 - protein, 23 aa, Entamoeba invadens
NLFVDNRYLIWAGFTTDKHKTKI

SEQ ID NO: 3010524 - protein, 32 aa, Entamoeba invadens
NLFVIYMMRGFAHGFYRKPTFHLTGPYGVLTR

SEQ ID NO: 3010525 - protein, 26 aa, Entamoeba invadens
NLGDLNFLLPAIYSTARRYFYDSMYF

SEQ ID NO: 3010526 - protein, 24 aa, Entamoeba invadens
NLGELWTLLNYIEPKKFGSLEEFD

SEQ ID NO: 3010527 - protein, 43 aa, Entamoeba invadens
NLGKVNIVAPLMLFPPYNFYMCFTLSAVTLPSTLKSLGNFCFA

SEQ ID NO: 3010528 - protein, 22 aa, Entamoeba invadens
NLGVPLFVHILNFQPDFIQLKD

SEQ ID NO: 3010529 - protein, 18 aa, Entamoeba invadens
NLHICGMNFPPEQIGAIF

SEQ ID NO: 3010530 - protein, 28 aa, Entamoeba invadens
NLHKEVGNHWSYMKKYLPGRTANAIKID

SEQ ID NO: 3010531 - protein, 17 aa, Entamoeba invadens
NLHLVSRQYKTLLIMFK

SEQ ID NO: 3010532 - protein, 28 aa, Entamoeba invadens
NLHRYIMGLKLFEYVLGIPDENFRVKVE

SEQ ID NO: 3010533 - protein, 19 aa, Entamoeba invadens
NLIGRLCAECIVGELTLAK

SEQ ID NO: 3010534 - protein, 27 aa, Entamoeba invadens
NLIHRDLKPTNFLLTKTFEIKICDFNF

SEQ ID NO: 3010535 - protein, 19 aa, Entamoeba invadens
NLIIARMKNVSKRKAKMVK

SEQ ID NO: 3010536 - protein, 32 aa, Entamoeba invadens
NLIMQILRVDRFTIPFIFFVITENEVLLNCDD

SEQ ID NO: 3010537 - protein, 28 aa, Entamoeba invadens
NLINKKTLLLFHVWANGFFKESIGTLKV

SEQ ID NO: 3010538 - protein, 23 aa, Entamoeba invadens
NLINLPEAWVKNKNVFTCFEVDP

SEQ ID NO: 3010539 - protein, 30 aa, Entamoeba invadens
NLINVCKKFWDIPLMFHYNPITFNYTTKKY

SEQ ID NO: 3010540 - protein, 21 aa, Entamoeba invadens
NLINVYKWRKIYELIEQVIGA

SEQ ID NO: 3010541 - protein, 19 aa, Entamoeba invadens
NLIPIKTQAFCDCSQLVDI

SEQ ID NO: 3010542 - protein, 19 aa, Entamoeba invadens
NLIRPFFSLVQDANKPNAI

SEQ ID NO: 3010543 - protein, 19 aa, Entamoeba invadens
NLIRYATAYGFLKEMIISL

SEQ ID NO: 3010544 - protein, 18 aa, Entamoeba invadens
NLISEMGGFIKRFPSFFK

SEQ ID NO: 3010545 - protein, 21 aa, Entamoeba invadens
NLITDLPFGTFLNCNHLTNIT

SEQ ID NO: 3010546 - protein, 18 aa, Entamoeba invadens
NLKALLRRGKAYLEKLQV

SEQ ID NO: 3010547 - protein, 19 aa, Entamoeba invadens
NLKCKIGVQNPFDVVLQNE

SEQ ID NO: 3010548 - protein, 29 aa, Entamoeba invadens
NLKEERDILLFLPLYTTILARGSTQPLPI

SEQ ID NO: 3010549 - protein, 28 aa, Entamoeba invadens
NLKELTLSGVKMKVPLNLQLPECIKEIT

SEQ ID NO: 3010550 - protein, 17 aa, Entamoeba invadens
NLKFSKDGKFYFYGNLH

SEQ ID NO: 3010551 - protein, 19 aa, Entamoeba invadens
NLKFYVIGDFHIPHRTAAI

SEQ ID NO: 3010552 - protein, 19 aa, Entamoeba invadens
NLKIIEFLIKRIKQLELKQ

SEQ ID NO: 3010553 - protein, 24 aa, Entamoeba invadens
NLKIKFYTPEEFFLKEAPVSYEND

SEQ ID NO: 3010554 - protein, 17 aa, Entamoeba invadens
NLKILILNDNKFETIPD

SEQ ID NO: 3010555 - protein, 17 aa, Entamoeba invadens
NLKLLKNHFQREGKLTT

SEQ ID NO: 3010556 - protein, 18 aa, Entamoeba invadens
NLKLNREFIVRLEDLFSK

SEQ ID NO: 3010557 - protein, 23 aa, Entamoeba invadens
NLKMSVELPLCKKRIIFMSQNCD

SEQ ID NO: 3010558 - protein, 17 aa, Entamoeba invadens
NLKMSVELPVCKILIIS

SEQ ID NO: 3010559 - protein, 35 aa, Entamoeba invadens
NLKNFELNFYLMRQREFFIFTKTAYYIKNIKPDNI

SEQ ID NO: 3010560 - protein, 20 aa, Entamoeba invadens
NLKNIVILPSVISIGDGCFG

SEQ ID NO: 3010561 - protein, 18 aa, Entamoeba invadens
NLKPCLQVGFPGLIELGK

SEQ ID NO: 3010562 - protein, 22 aa, Entamoeba invadens
NLKPSYITLQPLSFNTPDDLDS

SEQ ID NO: 3010563 - protein, 18 aa, Entamoeba invadens
NLKRISPCTVECGGSVLV

SEQ ID NO: 3010564 - protein, 39 aa, Entamoeba invadens
NLKSDDEIFVSIEYLFFDALWVPLKMEILEEEIEEDTQR

SEQ ID NO: 3010565 - protein, 33 aa, Entamoeba invadens
NLKSGFEKIKLDDLQLLLIRDVQKVKTRPLKEG

SEQ ID NO: 3010566 - protein, 18 aa, Entamoeba invadens
NLKTIKAYAFYNCKSLVT

SEQ ID NO: 3010567 - protein, 30 aa, Entamoeba invadens
NLKVDPVPSYPLTNFVYHGVVSPLNYVAGE

SEQ ID NO: 3010568 - protein, 20 aa, Entamoeba invadens
NLKVDYLFETIARGSARKRF

SEQ ID NO: 3010569 - protein, 17 aa, Entamoeba invadens
NLKVIGGFAFYNCTGLT

SEQ ID NO: 3010570 - protein, 24 aa, Entamoeba invadens
NLKVIRKKAFLKCPNLKSLRFGSQ

SEQ ID NO: 3010571 - protein, 25 aa, Entamoeba invadens
NLKVLAFYMNFFYNLTINNQSVHKM

SEQ ID NO: 3010572 - protein, 19 aa, Entamoeba invadens
NLKVLLLAGNLISEIPQEL

SEQ ID NO: 3010573 - protein, 31 aa, Entamoeba invadens
NLKVTPYFINDVSIIWFVAHFSPETVECRNT

SEQ ID NO: 3010574 - protein, 24 aa, Entamoeba invadens
NLKYDLDLLRITAPLFVESGYGIN

SEQ ID NO: 3010575 - protein, 17 aa, Entamoeba invadens
NLLAELGLAYKSGKMLF

SEQ ID NO: 3010576 - protein, 19 aa, Entamoeba invadens
NLLCVMLDVYQYVLTQYPS

SEQ ID NO: 3010577 - protein, 21 aa, Entamoeba invadens
NLLDRFRYNPIPISSMKLFPC

SEQ ID NO: 3010578 - protein, 20 aa, Entamoeba invadens
NLLEGWVGYLYGRLKDESAL

SEQ ID NO: 3010579 - protein, 17 aa, Entamoeba invadens
NLLFHAYGRSKKTLLKV

SEQ ID NO: 3010580 - protein, 19 aa, Entamoeba invadens
NLLGVRFCGCKRVVGDQTL

SEQ ID NO: 3010581 - protein, 18 aa, Entamoeba invadens
NLLHFYRMEGYKVNPILD

SEQ ID NO: 3010582 - protein, 20 aa, Entamoeba invadens
NLLISNFPFERIVNSCWDGA

SEQ ID NO: 3010583 - protein, 18 aa, Entamoeba invadens
NLLKLFTKKDFEIFKYRK

SEQ ID NO: 3010584 - protein, 19 aa, Entamoeba invadens
NLLKRGIGMLMFEAIKGIK

SEQ ID NO: 3010585 - protein, 29 aa, Entamoeba invadens
NLLKSERLLRRLMVDHYPQADLHLGIVLY

SEQ ID NO: 3010586 - protein, 28 aa, Entamoeba invadens
NLLMDDYINMISYFKSLFAIATESAILD

SEQ ID NO: 3010587 - protein, 24 aa, Entamoeba invadens
NLLRVHSIVRTYEMLRLAIEKQIR

SEQ ID NO: 3010588 - protein, 19 aa, Entamoeba invadens
NLLSITFKSKIQKYKMLCF

SEQ ID NO: 3010589 - protein, 28 aa, Entamoeba invadens
NLLSKHFYKLRGPFFELLRTFLQYDCCR

SEQ ID NO: 3010590 - protein, 27 aa, Entamoeba invadens
NLLTKVYFTFIILREELTGMKILINQP

SEQ ID NO: 3010591 - protein, 32 aa, Entamoeba invadens
NLLVAGYMEVVRVFDLRKMQTLALITEAHSDD

SEQ ID NO: 3010592 - protein, 19 aa, Entamoeba invadens
NLLVLNKDTNIFFRLPVEI

SEQ ID NO: 3010593 - protein, 25 aa, Entamoeba invadens
NLLVQLSDEYFVQLTAKETEELLNK

SEQ ID NO: 3010594 - protein, 18 aa, Entamoeba invadens
NLMDVFGTYYLRALSSVE

SEQ ID NO: 3010595 - protein, 19 aa, Entamoeba invadens
NLMFFGFVVDQRTQFAQFF

SEQ ID NO: 3010596 - protein, 25 aa, Entamoeba invadens
NLMKIYLDAVFLPRVRKDKFPFLQE

SEQ ID NO: 3010597 - protein, 29 aa, Entamoeba invadens
NLMKVYLDAVFLPKMKYEILPLAQEGFRW

SEQ ID NO: 3010598 - protein, 22 aa, Entamoeba invadens
NLNFFCLYDCSALFLDDFFNSA

SEQ ID NO: 3010599 - protein, 19 aa, Entamoeba invadens
NLNFTGFFEFYSGINSSVV

SEQ ID NO: 3010600 - protein, 24 aa, Entamoeba invadens
NLNKIELFTFCDCKNLKIVKNMRR

SEQ ID NO: 3010601 - protein, 20 aa, Entamoeba invadens
NLNKLFLDMATKLIENCVSN

SEQ ID NO: 3010602 - protein, 20 aa, Entamoeba invadens
NLNNFIQQLGMFVNPNFDAN

SEQ ID NO: 3010603 - protein, 23 aa, Entamoeba invadens
NLNPQTIYFQNGAPIIGSVEYSQ

SEQ ID NO: 3010604 - protein, 17 aa, Entamoeba invadens
NLNPYLSQYPTSAAQQF

SEQ ID NO: 3010605 - protein, 18 aa, Entamoeba invadens
NLNRQFLFRRKDVGRPKS

SEQ ID NO: 3010606 - protein, 27 aa, Entamoeba invadens
NLNRRNPFMEKIYALAIKPIEEQYIDF

SEQ ID NO: 3010607 - protein, 19 aa, Entamoeba invadens
NLNTIILPKSITSIGERCF

SEQ ID NO: 3010608 - protein, 32 aa, Entamoeba invadens
NLPENYSMQLYYYHLILWPTTTFVAVNKEGKI

SEQ ID NO: 3010609 - protein, 26 aa, Entamoeba invadens
NLPHLYYLQCFFSTFNFDLNALTSLT

SEQ ID NO: 3010610 - protein, 24 aa, Entamoeba invadens
NLPKDLIVMISYIGKMEIHYPLIE

SEQ ID NO: 3010611 - protein, 18 aa, Entamoeba invadens
NLPLVFPVEVPRCDNVTE

SEQ ID NO: 3010612 - protein, 19 aa, Entamoeba invadens
NLPTFYFDSILNPIQSRMD

SEQ ID NO: 3010613 - protein, 25 aa, Entamoeba invadens
NLQPNQLVFIPYNAATALLHALGSS

SEQ ID NO: 3010614 - protein, 23 aa, Entamoeba invadens
NLQSRLVVRLTLFNITKQTICNL

SEQ ID NO: 3010615 - protein, 24 aa, Entamoeba invadens
NLQSRLVVRLTLFNITKQTICNLF

SEQ ID NO: 3010616 - protein, 17 aa, Entamoeba invadens
NLQVLFWGNTLPAENQC

SEQ ID NO: 3010617 - protein, 34 aa, Entamoeba invadens
NLRENIKFLEDADFPFLFILKVIYALTREEDNNS

SEQ ID NO: 3010618 - protein, 26 aa, Entamoeba invadens
NLRIMTGCILLYDTVVPTGVFNTKGK

SEQ ID NO: 3010619 - protein, 17 aa, Entamoeba invadens
NLRLWSSKPSTVFDLDH

SEQ ID NO: 3010620 - protein, 20 aa, Entamoeba invadens
NLRNRNFIYKSLVICENCYY

SEQ ID NO: 3010621 - protein, 25 aa, Entamoeba invadens
NLRQLKVISVRFFDFSVFLCPNLET

SEQ ID NO: 3010622 - protein, 24 aa, Entamoeba invadens
NLRRANLVFSFFPNEFRPNPRKVI

SEQ ID NO: 3010623 - protein, 27 aa, Entamoeba invadens
NLRSKSPDMFVPWIPNNMQLAVCDVPP

SEQ ID NO: 3010624 - protein, 21 aa, Entamoeba invadens
NLRSMILPPIIKSISAYCFSG

SEQ ID NO: 3010625 - protein, 17 aa, Entamoeba invadens
NLSCNPLLKIPYEFFEE

SEQ ID NO: 3010626 - protein, 17 aa, Entamoeba invadens
NLSDMYIKRIYIERTTK

SEQ ID NO: 3010627 - protein, 23 aa, Entamoeba invadens
NLSFEDLLITPVQRLMRYKSLLS

SEQ ID NO: 3010628 - protein, 18 aa, Entamoeba invadens
NLSHLLFSILVRKSIEVQ

SEQ ID NO: 3010629 - protein, 25 aa, Entamoeba invadens
NLSIDAISYALLKYELRNINAPERI

SEQ ID NO: 3010630 - protein, 19 aa, Entamoeba invadens
NLSIIKLPSTISYIGYSCF

SEQ ID NO: 3010631 - protein, 17 aa, Entamoeba invadens
NLSPNDYLIQWVNQTLK

SEQ ID NO: 3010632 - protein, 23 aa, Entamoeba invadens
NLSPSFTFPCGHSFCLGCSRDTV

SEQ ID NO: 3010633 - protein, 28 aa, Entamoeba invadens
NLSQKKFMPTFPFPYMNGRLHLGHTFTL

SEQ ID NO: 3010634 - protein, 25 aa, Entamoeba invadens
NLSRCPVWITVPLAADGWQMWNTIR

SEQ ID NO: 3010635 - protein, 26 aa, Entamoeba invadens
NLSTNILLVHTLIPKLKVVLVDFAPT

SEQ ID NO: 3010636 - protein, 21 aa, Entamoeba invadens
NLTFLLRCHFITLKKCLSPEV

SEQ ID NO: 3010637 - protein, 23 aa, Entamoeba invadens
NLTFVGLIFNYLVRLNYECQSSL

SEQ ID NO: 3010638 - protein, 24 aa, Entamoeba invadens
NLTGSFIMLRYVNPAIFSPEKYGI

SEQ ID NO: 3010639 - protein, 17 aa, Entamoeba invadens
NLTINTLSFANFPKLIH

SEQ ID NO: 3010640 - protein, 18 aa, Entamoeba invadens
NLTKRKMNATAHKVRLIG

SEQ ID NO: 3010641 - protein, 24 aa, Entamoeba invadens
NLTKVTLLKIPKWSNYKNTNFVQC

SEQ ID NO: 3010642 - protein, 17 aa, Entamoeba invadens
NLTLLFQTKNSDLFGCY

SEQ ID NO: 3010643 - protein, 26 aa, Entamoeba invadens
NLTNFEDVIFLLNYFSSDSSLDESVK

SEQ ID NO: 3010644 - protein, 18 aa, Entamoeba invadens
NLTNSIEFLLNNFSEMCR

SEQ ID NO: 3010645 - protein, 24 aa, Entamoeba invadens
NLTPEFLSVFLLISQFFTSEGKTI

SEQ ID NO: 3010646 - protein, 20 aa, Entamoeba invadens
NLTQMSAWANLQKYKLIFDS

SEQ ID NO: 3010647 - protein, 17 aa, Entamoeba invadens
NLTRLVVRNLPITHIPG

SEQ ID NO: 3010648 - protein, 30 aa, Entamoeba invadens
NLTTPAFVPVLDLPFTFETPNPLRNRAMQE

SEQ ID NO: 3010649 - protein, 33 aa, Entamoeba invadens
NLTTPAFVPVPDLPFTFETPNLLRNRAMQEHQI

SEQ ID NO: 3010650 - protein, 30 aa, Entamoeba invadens
NLTTPAFVPVPDLPFTFETPNPLRNRAMQE

SEQ ID NO: 3010651 - protein, 26 aa, Entamoeba invadens
NLVARTIIIEYFRDEGFRIELTNYFK

SEQ ID NO: 3010652 - protein, 19 aa, Entamoeba invadens
NLVDLIYAQVLIGATDTFA

SEQ ID NO: 3010653 - protein, 24 aa, Entamoeba invadens
NLVKITEMFLGPAPKDYVFVPKHN

SEQ ID NO: 3010654 - protein, 25 aa, Entamoeba invadens
NLVLPPTILTPHYAPASFFSDAKYS

SEQ ID NO: 3010655 - protein, 18 aa, Entamoeba invadens
NLVLQKLRIFNCKSVTVA

SEQ ID NO: 3010656 - protein, 22 aa, Entamoeba invadens
NLVLSCYSSFWIKKNKQIEFNV

SEQ ID NO: 3010657 - protein, 26 aa, Entamoeba invadens
NLVPKHLFEIFKIPFVPLAIDSNKML

SEQ ID NO: 3010658 - protein, 38 aa, Entamoeba invadens
NLVQDIYGVWALLISKLKLLITDVFACPLRYVVCLPTG

SEQ ID NO: 3010659 - protein, 18 aa, Entamoeba invadens
NLVRQWCLSLKRNAPKMV

SEQ ID NO: 3010660 - protein, 26 aa, Entamoeba invadens
NLVTSKLPGRFLTNRSFAARPMMYIR

SEQ ID NO: 3010661 - protein, 26 aa, Entamoeba invadens
NLWMATFDQFEIDYSLPLTPHEVRLQ

SEQ ID NO: 3010662 - protein, 21 aa, Entamoeba invadens
NLYGQSVLLLELQVLKDVEFN

SEQ ID NO: 3010663 - protein, 19 aa, Entamoeba invadens
NLYKIIILGDSGVGKTSLL

SEQ ID NO: 3010664 - protein, 30 aa, Entamoeba invadens
NLYKKDSKVFWVCRECGFIFEGTQAPKNCP

SEQ ID NO: 3010665 - protein, 25 aa, Entamoeba invadens
NMALGKFVMGIYLLGKKVLSENSIV

SEQ ID NO: 3010666 - protein, 44 aa, Entamoeba invadens
NMARFHYNPIPLTLKTRQFFPNLKILHLYAKDDLLFTDYKITSH

SEQ ID NO: 3010667 - protein, 19 aa, Entamoeba invadens
NMAVLLKMTEMAYGTNVSY

SEQ ID NO: 3010668 - protein, 25 aa, Entamoeba invadens
NMCRRSELLLTRYAIHRLSPDVEMT

SEQ ID NO: 3010669 - protein, 28 aa, Entamoeba invadens
NMCRRTEAFLLRLALHKTFPSTRMAVIA

SEQ ID NO: 3010670 - protein, 24 aa, Entamoeba invadens
NMCSRRLYTLFKTFIEMHAESLIR

SEQ ID NO: 3010671 - protein, 26 aa, Entamoeba invadens
NMCWQAIQLLRIDFLNVLSSYQYFYE

SEQ ID NO: 3010672 - protein, 20 aa, Entamoeba invadens
NMDNFFAPVFTMGKYYTQGD

SEQ ID NO: 3010673 - protein, 28 aa, Entamoeba invadens
NMEKFHFNPILLNSKTIRYFPNIETLHL

SEQ ID NO: 3010674 - protein, 25 aa, Entamoeba invadens
NMEKFHFNPIPLNSKTFRNFPNIET

SEQ ID NO: 3010675 - protein, 24 aa, Entamoeba invadens
NMEKFHFNPIPLTCKTIGFFLNIE

SEQ ID NO: 3010676 - protein, 32 aa, Entamoeba invadens
NMEKQLYVSMYYIPTFPILYQKNSKFDVYVNC

SEQ ID NO: 3010677 - protein, 20 aa, Entamoeba invadens
NMFAWAYHIDETCKWASALY

SEQ ID NO: 3010678 - protein, 18 aa, Entamoeba invadens
NMFDKFKHIYDVKVNADT

SEQ ID NO: 3010679 - protein, 27 aa, Entamoeba invadens
NMFGRRWTHISSFLPHRAPNSIKNRFY

SEQ ID NO: 3010680 - protein, 18 aa, Entamoeba invadens
NMFPFGVTVSIVLDIFAN

SEQ ID NO: 3010681 - protein, 27 aa, Entamoeba invadens
NMGKEEFSMILQIKLIYEKFNEINEDR

SEQ ID NO: 3010682 - protein, 19 aa, Entamoeba invadens
NMHRVFEKLGNQLTMQEMR

SEQ ID NO: 3010683 - protein, 20 aa, Entamoeba invadens
NMIEKYYPMLTLDFNTNKRV

SEQ ID NO: 3010684 - protein, 18 aa, Entamoeba invadens
NMILLSMGCLCGCTQLQS

SEQ ID NO: 3010685 - protein, 17 aa, Entamoeba invadens
NMIPTHTPLDCPVVEPG

SEQ ID NO: 3010686 - protein, 20 aa, Entamoeba invadens
NMKDLVTEFSWFFAQVLQAA

SEQ ID NO: 3010687 - protein, 21 aa, Entamoeba invadens
NMKEAIVCLPSYFLDNNKCNL

SEQ ID NO: 3010688 - protein, 24 aa, Entamoeba invadens
NMKKFHFNPIPITKFTIKHLPNIE

SEQ ID NO: 3010689 - protein, 23 aa, Entamoeba invadens
NMKKFHFNPIPLNSKTIVYFPKI

SEQ ID NO: 3010690 - protein, 17 aa, Entamoeba invadens
NMKKFHFNPISLNSKTI

SEQ ID NO: 3010691 - protein, 23 aa, Entamoeba invadens
NMKKLYQWDFSDPNLKNIVSEDV

SEQ ID NO: 3010692 - protein, 18 aa, Entamoeba invadens
NMKNLAYDKDLLSSEKKK

SEQ ID NO: 3010693 - protein, 19 aa, Entamoeba invadens
NMKPLTKWTAFMTESSRDD

SEQ ID NO: 3010694 - protein, 24 aa, Entamoeba invadens
NMKQTDMLTYFLITQSREEKYLKY

SEQ ID NO: 3010695 - protein, 26 aa, Entamoeba invadens
NMKSKRMVLPLIKSYLDNFPPELVVQ

SEQ ID NO: 3010696 - protein, 30 aa, Entamoeba invadens
NMKWLENQLRHVIWKHLGYYFHNRTILNEV

SEQ ID NO: 3010697 - protein, 26 aa, Entamoeba invadens
NMLDPLQYVLKKYPSNLNIICLTDGC

SEQ ID NO: 3010698 - protein, 24 aa, Entamoeba invadens
NMLLDLLRQYFGFTFQEVVKKKPE

SEQ ID NO: 3010699 - protein, 18 aa, Entamoeba invadens
NMLLESSTKCFISFVLES

SEQ ID NO: 3010700 - protein, 19 aa, Entamoeba invadens
NMLNARIAGIQTQLDEERQ

SEQ ID NO: 3010701 - protein, 19 aa, Entamoeba invadens
NMMKFLFDVADDKNLNIIT

SEQ ID NO: 3010702 - protein, 17 aa, Entamoeba invadens
NMMSCAHDKIVAGNLIR

SEQ ID NO: 3010703 - protein, 24 aa, Entamoeba invadens
NMNEVLVRIVYARILKKMGLSQLA

SEQ ID NO: 3010704 - protein, 25 aa, Entamoeba invadens
NMNFELPFVTFLSKADLIGNYGFKT

SEQ ID NO: 3010705 - protein, 22 aa, Entamoeba invadens
NMNIFNYLLKNKIITAIFDAFQ

SEQ ID NO: 3010706 - protein, 17 aa, Entamoeba invadens
NMNLLEKVLEFLKNYDS

SEQ ID NO: 3010707 - protein, 25 aa, Entamoeba invadens
NMNQKVIPMLLYFSYVFDEEELSVE

SEQ ID NO: 3010708 - protein, 24 aa, Entamoeba invadens
NMNTIPQILAKMKYQPPVTPAAAK

SEQ ID NO: 3010709 - protein, 20 aa, Entamoeba invadens
NMPAIPQPMKPIIPTQQNIP

SEQ ID NO: 3010710 - protein, 21 aa, Entamoeba invadens
NMPFDFVFNEKIDFTIYKLLK

SEQ ID NO: 3010711 - protein, 17 aa, Entamoeba invadens
NMPIHTVKFLNVPVIAK

SEQ ID NO: 3010712 - protein, 21 aa, Entamoeba invadens
NMPMNFVFRGNIDFTIYDVLK

SEQ ID NO: 3010713 - protein, 19 aa, Entamoeba invadens
NMPSILHRDFKSLNVLVTA

SEQ ID NO: 3010714 - protein, 36 aa, Entamoeba invadens
NMQHLVLTKQYDCIWIQWSILYLRDEDLVNMLQVCK

SEQ ID NO: 3010715 - protein, 21 aa, Entamoeba invadens
NMRKHLKLCKYFRAQYSIDPN

SEQ ID NO: 3010716 - protein, 17 aa, Entamoeba invadens
NMRLFAMSKIERRIVCI

SEQ ID NO: 3010717 - protein, 17 aa, Entamoeba invadens
NMRLRPRFLLKYLDAEG

SEQ ID NO: 3010718 - protein, 29 aa, Entamoeba invadens
NMRNYPHYFRLAFYILRNTPQMKENAFKM

SEQ ID NO: 3010719 - protein, 26 aa, Entamoeba invadens
NMRSQVWKLLLGYYTPLKNDWQVIDE

SEQ ID NO: 3010720 - protein, 19 aa, Entamoeba invadens
NMSEMKTELRQHLKTVEKH

SEQ ID NO: 3010721 - protein, 40 aa, Entamoeba invadens
NMSGHNYLRVTRIFNSLRAFGFAQYAKSFWDFFEENLKNF

SEQ ID NO: 3010722 - protein, 23 aa, Entamoeba invadens
NMSKFHFNPIPLTSKTISYFPNI

SEQ ID NO: 3010723 - protein, 24 aa, Entamoeba invadens
NMSLFQMDLLVTQQLAAIGMKPYI

SEQ ID NO: 3010724 - protein, 18 aa, Entamoeba invadens
NMSVPIDIPLSISNDPFN

SEQ ID NO: 3010725 - protein, 17 aa, Entamoeba invadens
NMTFTRSDRILFGENIP

SEQ ID NO: 3010726 - protein, 18 aa, Entamoeba invadens
NMTGGIEVLLLLLAEVKT

SEQ ID NO: 3010727 - protein, 18 aa, Entamoeba invadens
NMTIKTIRFGQCERFIAI

SEQ ID NO: 3010728 - protein, 17 aa, Entamoeba invadens
NMTMKEFLVVKLNEWYK

SEQ ID NO: 3010729 - protein, 20 aa, Entamoeba invadens
NMTTDLIKDEIKYFSDLKLF

SEQ ID NO: 3010730 - protein, 17 aa, Entamoeba invadens
NMVLLDILSFPEEPHKH

SEQ ID NO: 3010731 - protein, 17 aa, Entamoeba invadens
NMVNKMSNMVDKDVLGK

SEQ ID NO: 3010732 - protein, 36 aa, Entamoeba invadens
NMYAETSFRTLPFGTELFIGLLKINGKKLLLKLLSN

SEQ ID NO: 3010733 - protein, 22 aa, Entamoeba invadens
NNAKLLALTLPQSIQKFANVFD

SEQ ID NO: 3010734 - protein, 20 aa, Entamoeba invadens
NNALIRTRFIFSVKSLHSDS

SEQ ID NO: 3010735 - protein, 18 aa, Entamoeba invadens
NNAVITFPVYFNDSQRQA

SEQ ID NO: 3010736 - protein, 19 aa, Entamoeba invadens
NNAVITFPVYFNDSQRQAT

SEQ ID NO: 3010737 - protein, 26 aa, Entamoeba invadens
NNAVLFSVCGGAFWIGKKNAAVRGEC

SEQ ID NO: 3010738 - protein, 30 aa, Entamoeba invadens
NNCDKELLYELRFYLMTQSALRNDLINGRK

SEQ ID NO: 3010739 - protein, 23 aa, Entamoeba invadens
NNCDSLMSLFIPSSVKSFGEKCF

SEQ ID NO: 3010740 - protein, 20 aa, Entamoeba invadens
NNCIMCYSNYYLYPNCNGCN

SEQ ID NO: 3010741 - protein, 24 aa, Entamoeba invadens
NNCLFTSLIMRLMVSLGSEPSQLE

SEQ ID NO: 3010742 - protein, 18 aa, Entamoeba invadens
NNCLSCISGYSLLNGYCI

SEQ ID NO: 3010743 - protein, 23 aa, Entamoeba invadens
NNDAYLYLHCWELELVRCQHCFI

SEQ ID NO: 3010744 - protein, 27 aa, Entamoeba invadens
NNDECSPAFWKFMDLLGKRYEQNGFIR

SEQ ID NO: 3010745 - protein, 24 aa, Entamoeba invadens
NNDFNNMFGMDFMFGNNFANNQQN

SEQ ID NO: 3010746 - protein, 33 aa, Entamoeba invadens
NNDKIRTKFVCWTGKELWAFKDVVNGETVVYSY

SEQ ID NO: 3010747 - protein, 19 aa, Entamoeba invadens
NNDNAIIELWASGSDCCLL

SEQ ID NO: 3010748 - protein, 26 aa, Entamoeba invadens
NNDPHYFVFSLVNKSFYGAFSLTLSD

SEQ ID NO: 3010749 - protein, 18 aa, Entamoeba invadens
NNDSFLLNSLLKVIGDLI

SEQ ID NO: 3010750 - protein, 32 aa, Entamoeba invadens
NNDYNTIVFPIFLQLCTWTLTPKLSWNNSEKA

SEQ ID NO: 3010751 - protein, 32 aa, Entamoeba invadens
NNEELLKSFLEKYPKIMFFKTSLQNPDEMKKA

SEQ ID NO: 3010752 - protein, 31 aa, Entamoeba invadens
NNEKFILKKYSIHLLLKLGDAMILRFAIPSR

SEQ ID NO: 3010753 - protein, 27 aa, Entamoeba invadens
NNEKLRKLVFPASFPASTYFTNTFTHA

SEQ ID NO: 3010754 - protein, 27 aa, Entamoeba invadens
NNELEIWINFLLYRDWKNIIKPDYSIW

SEQ ID NO: 3010755 - protein, 20 aa, Entamoeba invadens
NNELKMNITNTLSELEKLKN

SEQ ID NO: 3010756 - protein, 22 aa, Entamoeba invadens
NNELLVFSSLTHSLTPSAFQTT

SEQ ID NO: 3010757 - protein, 25 aa, Entamoeba invadens
NNERVYLTIVFLLNEKMKTIDMLTK

SEQ ID NO: 3010758 - protein, 26 aa, Entamoeba invadens
NNETSHLWVLKTLKEVYLPALSKSVN

SEQ ID NO: 3010759 - protein, 20 aa, Entamoeba invadens
NNFAFFPKELLKPYVMYFVN

SEQ ID NO: 3010760 - protein, 22 aa, Entamoeba invadens
NNFDILHVYSLHSKTSSATFHG

SEQ ID NO: 3010761 - protein, 19 aa, Entamoeba invadens
NNFIFQNRSLLLRKTPSYI

SEQ ID NO: 3010762 - protein, 24 aa, Entamoeba invadens
NNFITDFIYYTFQGHFDLQDDDKL

SEQ ID NO: 3010763 - protein, 28 aa, Entamoeba invadens
NNFKDNQLFILLPNRVMYRVIENNLIRD

SEQ ID NO: 3010764 - protein, 20 aa, Entamoeba invadens
NNFLLSLPDDLLSYCYSLAS

SEQ ID NO: 3010765 - protein, 21 aa, Entamoeba invadens
NNFNYSYRSLLKCLSYSMGEA

SEQ ID NO: 3010766 - protein, 19 aa, Entamoeba invadens
NNFVRLFTKLLGLVTKEKA

SEQ ID NO: 3010767 - protein, 32 aa, Entamoeba invadens
NNFVSDWADGFLMKFLFASETPFEKFQQFGIC

SEQ ID NO: 3010768 - protein, 24 aa, Entamoeba invadens
NNGAAFFAYYYTEEYKCFSKYLKI

SEQ ID NO: 3010769 - protein, 24 aa, Entamoeba invadens
NNGILMQMGYILSRVRDDAILSLV

SEQ ID NO: 3010770 - protein, 36 aa, Entamoeba invadens
NNGITFFIDHIAVIGLRAHFFSAIQALYLANTKRGL

SEQ ID NO: 3010771 - protein, 30 aa, Entamoeba invadens
NNGQTNYASLWPIPQFFKNDGKQFVGQPLC

SEQ ID NO: 3010772 - protein, 48 aa, Entamoeba invadens
NNGQYIALSLLLNEFDVLLTFVTCNWLYGWNLPTITTAASPLIITQGR

SEQ ID NO: 3010773 - protein, 25 aa, Entamoeba invadens
NNHFKLFVRRIIGTALLPIEFITIK

SEQ ID NO: 3010774 - protein, 21 aa, Entamoeba invadens
NNIFKIFAAKSYRFFEDVDNN

SEQ ID NO: 3010775 - protein, 17 aa, Entamoeba invadens
NNIIRICTPARTFHLSA

SEQ ID NO: 3010776 - protein, 18 aa, Entamoeba invadens
NNIIRICTPARTFHLSAA

SEQ ID NO: 3010777 - protein, 32 aa, Entamoeba invadens
NNIISRPFLNIETLIFDWLYGYTATTFNTNLK

SEQ ID NO: 3010778 - protein, 24 aa, Entamoeba invadens
NNIKVFCEVIKIVFLYNSDNIVFV

SEQ ID NO: 3010779 - protein, 23 aa, Entamoeba invadens
NNILEVFCVVANGSVFKAKVEDV

SEQ ID NO: 3010780 - protein, 23 aa, Entamoeba invadens
NNIRTYGTCVMMWKKNICDEMNV

SEQ ID NO: 3010781 - protein, 27 aa, Entamoeba invadens
NNISSLPMPIFEIFKKLFEMSKKHYPD

SEQ ID NO: 3010782 - protein, 36 aa, Entamoeba invadens
NNITEFLPIDFTHTKFLRLFGLSRFSFNTIFENCEI

SEQ ID NO: 3010783 - protein, 19 aa, Entamoeba invadens
NNIVLWKPVSLTDSIDIST

SEQ ID NO: 3010784 - protein, 24 aa, Entamoeba invadens
NNIVQVFPYLTVDKVLMELTSPNQ

SEQ ID NO: 3010785 - protein, 25 aa, Entamoeba invadens
NNIVRFFDCIKTQIFVFLVMEFVEG

SEQ ID NO: 3010786 - protein, 24 aa, Entamoeba invadens
NNIVSFLPYIFKNVTVVPGHYLYC

SEQ ID NO: 3010787 - protein, 20 aa, Entamoeba invadens
NNKCLMCSSYCTTNKCDTIQ

SEQ ID NO: 3010788 - protein, 30 aa, Entamoeba invadens
NNKDILESVFLWFVGKDKKFMSLEKLDFVL

SEQ ID NO: 3010789 - protein, 27 aa, Entamoeba invadens
NNKDQLRLFLVKFPIKNYKSLEKKVGP

SEQ ID NO: 3010790 - protein, 17 aa, Entamoeba invadens
NNKFEGNMWYQIKNKET

SEQ ID NO: 3010791 - protein, 21 aa, Entamoeba invadens
NNKIIMERLVATPKPLDNASL

SEQ ID NO: 3010792 - protein, 30 aa, Entamoeba invadens
NNKINLFISRKYQPIYYLQQLALLHKNNAK

SEQ ID NO: 3010793 - protein, 23 aa, Entamoeba invadens
NNKIPSLLMCPSTYSTIIGKDLR

SEQ ID NO: 3010794 - protein, 32 aa, Entamoeba invadens
NNKKGKLALYLNLAICFIKVSKFNKALDNADS

SEQ ID NO: 3010795 - protein, 28 aa, Entamoeba invadens
NNKKIELLHLLIDLLVVRCGYEFESKYT

SEQ ID NO: 3010796 - protein, 25 aa, Entamoeba invadens
NNKKIEMIHFLSDLLFMCGYEVNSS

SEQ ID NO: 3010797 - protein, 22 aa, Entamoeba invadens
NNKKMCLQMLNWIIADKSVAAF

SEQ ID NO: 3010798 - protein, 28 aa, Entamoeba invadens
NNKLRSKVWKLLLRYYSPDQRTWVNTDQ

SEQ ID NO: 3010799 - protein, 28 aa, Entamoeba invadens
NNKNICKNLFLFILKKSMIDTSVLEQLL

SEQ ID NO: 3010800 - protein, 23 aa, Entamoeba invadens
NNKNLFQCLQTQFLYSSLDPKLP

SEQ ID NO: 3010801 - protein, 23 aa, Entamoeba invadens
NNKPFALKTLFKNSLNQTEIDYI

SEQ ID NO: 3010802 - protein, 20 aa, Entamoeba invadens
NNKRYIRVVCDFLDTFIRMD

SEQ ID NO: 3010803 - protein, 28 aa, Entamoeba invadens
NNKYKFANCHYLLNDYCYLANEYHYTSI

SEQ ID NO: 3010804 - protein, 23 aa, Entamoeba invadens
NNKYLAVSYASGLIYIYDLDIPR

SEQ ID NO: 3010805 - protein, 40 aa, Entamoeba invadens
NNLAVHFFVVLFFKHYVAIPFIKFAPFKTALIKLATSSMN

SEQ ID NO: 3010806 - protein, 27 aa, Entamoeba invadens
NNLCGVFFPVILALFHNNNLSVPVVQA

SEQ ID NO: 3010807 - protein, 28 aa, Entamoeba invadens
NNLCLTFLQNILITFKFMWKFCCDGLCD

SEQ ID NO: 3010808 - protein, 19 aa, Entamoeba invadens
NNLFAEIALLIFSLDDFKN

SEQ ID NO: 3010809 - protein, 31 aa, Entamoeba invadens
NNLIHLQKCYFNHLIPISFPQNMTSLVIGSQ

SEQ ID NO: 3010810 - protein, 21 aa, Entamoeba invadens
NNLLFRAVTDRDFDLGLLSEA

SEQ ID NO: 3010811 - protein, 23 aa, Entamoeba invadens
NNLLYPGVKLSSQGRRRLVLVSK

SEQ ID NO: 3010812 - protein, 25 aa, Entamoeba invadens
NNLPNGMVFFFDFGGGTLDTAVGEK

SEQ ID NO: 3010813 - protein, 30 aa, Entamoeba invadens
NNLPSNFDVLKIRRILFAMLERIEEISDDI

SEQ ID NO: 3010814 - protein, 19 aa, Entamoeba invadens
NNLQLLTPLLHFTSDYEYA

SEQ ID NO: 3010815 - protein, 20 aa, Entamoeba invadens
NNLSAFKPVPSILLDFDGTN

SEQ ID NO: 3010816 - protein, 27 aa, Entamoeba invadens
NNLSFAIVYTSFFSQLLELSKKLALKE

SEQ ID NO: 3010817 - protein, 29 aa, Entamoeba invadens
NNLSMFHFNPFPLNLATIKYFPNIETLNV

SEQ ID NO: 3010818 - protein, 28 aa, Entamoeba invadens
NNLVDKRFFLFTLIEIFQANVYLSLDFY

SEQ ID NO: 3010819 - protein, 18 aa, Entamoeba invadens
NNLVFIVKTDKNLVFGGF

SEQ ID NO: 3010820 - protein, 21 aa, Entamoeba invadens
NNLYSLFQIKQPLFSSRFEYP

SEQ ID NO: 3010821 - protein, 28 aa, Entamoeba invadens
NNMEHEKLLFFWKQMFLLVSNASCVSQG

SEQ ID NO: 3010822 - protein, 20 aa, Entamoeba invadens
NNMITIDLFLSLHTSYDTAT

SEQ ID NO: 3010823 - protein, 25 aa, Entamoeba invadens
NNMKKFHFNPFPLNSKTLRCFPNIE

SEQ ID NO: 3010824 - protein, 24 aa, Entamoeba invadens
NNMKKFHFNPIPLNCKTLEYFSNI

SEQ ID NO: 3010825 - protein, 24 aa, Entamoeba invadens
NNMKKFHFNPISFTLNTLKYFPNI

SEQ ID NO: 3010826 - protein, 29 aa, Entamoeba invadens
NNMNRLLINKLFKHLWPPTISLSEKISFD

SEQ ID NO: 3010827 - protein, 28 aa, Entamoeba invadens
NNNDKLLYLMNFMNYKIKTFFPSENQSE

SEQ ID NO: 3010828 - protein, 30 aa, Entamoeba invadens
NNNDKLLYLMNFMNYKINFFFPSEKQSKTQ

SEQ ID NO: 3010829 - protein, 34 aa, Entamoeba invadens
NNNDKLLYLMNFMNYKINFFFPSEKQSKTQTRTA

SEQ ID NO: 3010830 - protein, 29 aa, Entamoeba invadens
NNNDNLLYLMNFMNYKINFFFPSEKQNKT

SEQ ID NO: 3010831 - protein, 31 aa, Entamoeba invadens
NNNDTTLLYLIRRYLILRYAQMHDYVEGKKY

SEQ ID NO: 3010832 - protein, 24 aa, Entamoeba invadens
NNNFYYYRSLPQKGVFERLKIEIP

SEQ ID NO: 3010833 - protein, 25 aa, Entamoeba invadens
NNNIMFDIMPLLKNPDPAGDVLKYL

SEQ ID NO: 3010834 - protein, 19 aa, Entamoeba invadens
NNNIRIITLPESLEIIEDM

SEQ ID NO: 3010835 - protein, 31 aa, Entamoeba invadens
NNNKTDYILVVTLYTILILTTDYSIVDEIHC

SEQ ID NO: 3010836 - protein, 27 aa, Entamoeba invadens
NNNNCKFVWLSLLRNSFYTHCKSIMDL

SEQ ID NO: 3010837 - protein, 23 aa, Entamoeba invadens
NNNSKIEIFDFNSSITGTEQKEE

SEQ ID NO: 3010838 - protein, 24 aa, Entamoeba invadens
NNPKGIPMILDHALSLGGENAVTT

SEQ ID NO: 3010839 - protein, 25 aa, Entamoeba invadens
NNQKLLDVTLPVTLTKLGRTAFYSC

SEQ ID NO: 3010840 - protein, 17 aa, Entamoeba invadens
NNQLFELVNLIVSIPNA

SEQ ID NO: 3010841 - protein, 25 aa, Entamoeba invadens
NNQNVYFCPFCKRCLRRTCRSTHYT

SEQ ID NO: 3010842 - protein, 24 aa, Entamoeba invadens
NNQRFVYAFPYENSYYIAAFEKRW

SEQ ID NO: 3010843 - protein, 18 aa, Entamoeba invadens
NNQSDIFGRQLINMGFIK

SEQ ID NO: 3010844 - protein, 23 aa, Entamoeba invadens
NNQTSLFELLKQCNERLDKLDPI

SEQ ID NO: 3010845 - protein, 22 aa, Entamoeba invadens
NNQYAFYLYCKSHECLFGFGGG

SEQ ID NO: 3010846 - protein, 29 aa, Entamoeba invadens
NNQYVTSVLSFLFFYTQKSTLVDCAANSL

SEQ ID NO: 3010847 - protein, 30 aa, Entamoeba invadens
NNRFHYNPIPLDKKFRKLFPAIETFYVYSE

SEQ ID NO: 3010848 - protein, 17 aa, Entamoeba invadens
NNRFVFYVDIKSASRLV

SEQ ID NO: 3010849 - protein, 27 aa, Entamoeba invadens
NNRLASLPLPPLPFLKELDLSHNVLKK

SEQ ID NO: 3010850 - protein, 23 aa, Entamoeba invadens
NNRLLLEALVLRLIKDEQRPLLF

SEQ ID NO: 3010851 - protein, 24 aa, Entamoeba invadens
NNRLPLANTITSIGFFNLPTKCTV

SEQ ID NO: 3010852 - protein, 25 aa, Entamoeba invadens
NNSAWSHRFYTLKVLGFLNDSEKLP

SEQ ID NO: 3010853 - protein, 34 aa, Entamoeba invadens
NNSGFLNGFLNSPFYRKSTPKARYLIVTKAKEED

SEQ ID NO: 3010854 - protein, 25 aa, Entamoeba invadens
NNSIDMWSAGCICAELVLGIPLFPG

SEQ ID NO: 3010855 - protein, 25 aa, Entamoeba invadens
NNSINIIYHVAPYLPYSDFEKQQLD

SEQ ID NO: 3010856 - protein, 24 aa, Entamoeba invadens
NNSLKFTTWTFKNSIIPRPITLTK

SEQ ID NO: 3010857 - protein, 26 aa, Entamoeba invadens
NNSMFINKEFLFNVVFAAADAFRKQN

SEQ ID NO: 3010858 - protein, 22 aa, Entamoeba invadens
NNSNYEIHLINNLSPIQTTQEK

SEQ ID NO: 3010859 - protein, 22 aa, Entamoeba invadens
NNSPEYIYFKPFPEAFKNIEKT

SEQ ID NO: 3010860 - protein, 24 aa, Entamoeba invadens
NNSQPIPITRANKPLFLGIGNCWS

SEQ ID NO: 3010861 - protein, 18 aa, Entamoeba invadens
NNSYYPKYPDCISCDIKC

SEQ ID NO: 3010862 - protein, 27 aa, Entamoeba invadens
NNTDELWTLLNYVNPIGFPSIEAFHQK

SEQ ID NO: 3010863 - protein, 28 aa, Entamoeba invadens
NNTDKLLYLMNFMNYKIKTFFPSKNQSE

SEQ ID NO: 3010864 - protein, 27 aa, Entamoeba invadens
NNTEDTIIIPKLLFPLEETSVSMKRVD

SEQ ID NO: 3010865 - protein, 37 aa, Entamoeba invadens
NNTEKFHFNPIPLTPATRKYFPKLQTLHLYSNTDFAF

SEQ ID NO: 3010866 - protein, 24 aa, Entamoeba invadens
NNTIGRLCEIGFPEGFISVSKTSF

SEQ ID NO: 3010867 - protein, 26 aa, Entamoeba invadens
NNTIIETLVFLIDLVLEMGYFVETTE

SEQ ID NO: 3010868 - protein, 17 aa, Entamoeba invadens
NNTLIYITQPMVNVIQI

SEQ ID NO: 3010869 - protein, 23 aa, Entamoeba invadens
NNTPYHLTLILIADALKQKAQIK

SEQ ID NO: 3010870 - protein, 26 aa, Entamoeba invadens
NNTSIRFYFQDILNSFNQMFQKKVFL

SEQ ID NO: 3010871 - protein, 21 aa, Entamoeba invadens
NNTTYQCTFSYLPRGKQNCTL

SEQ ID NO: 3010872 - protein, 18 aa, Entamoeba invadens
NNVDAFYLVFEKIMLNES

SEQ ID NO: 3010873 - protein, 25 aa, Entamoeba invadens
NNVEDAFMTLLKKIYDESAKVVVDE

SEQ ID NO: 3010874 - protein, 23 aa, Entamoeba invadens
NNVEIIFIPQNLEFFANPATTLI

SEQ ID NO: 3010875 - protein, 25 aa, Entamoeba invadens
NNVERIFLHFGKMSKPNIQMEINQL

SEQ ID NO: 3010876 - protein, 18 aa, Entamoeba invadens
NNVFTLKFRHHLKKANAF

SEQ ID NO: 3010877 - protein, 27 aa, Entamoeba invadens
NNVGGTDLFVLPPLKKKRSVLVSSDLL

SEQ ID NO: 3010878 - protein, 25 aa, Entamoeba invadens
NNVIGKYFYLVMEYCDFGNLESYLV

SEQ ID NO: 3010879 - protein, 23 aa, Entamoeba invadens
NNVKKNINELKNTDFKNIGGNVV

SEQ ID NO: 3010880 - protein, 25 aa, Entamoeba invadens
NNVKNYMFLVIDSKGNLFGTYVDEL

SEQ ID NO: 3010881 - protein, 29 aa, Entamoeba invadens
NNVKTELMRPIPFAISFTDNKINVFGDAM

SEQ ID NO: 3010882 - protein, 21 aa, Entamoeba invadens
NNVPLFTQKTIPLQKVEKTEK

SEQ ID NO: 3010883 - protein, 19 aa, Entamoeba invadens
NNVPLWKMRFRNLYNGVQP

SEQ ID NO: 3010884 - protein, 24 aa, Entamoeba invadens
NNVQAWINNIPEGLGLLEEDVPDF

SEQ ID NO: 3010885 - protein, 23 aa, Entamoeba invadens
NNVVKHFYGYFLLVDTVKFNGVE

SEQ ID NO: 3010886 - protein, 19 aa, Entamoeba invadens
NNVVNIPSKFFSGCSSLST

SEQ ID NO: 3010887 - protein, 25 aa, Entamoeba invadens
NNYAIHFRFLMRYAEEPCNSLKHNH

SEQ ID NO: 3010888 - protein, 19 aa, Entamoeba invadens
NNYFHCFINFEKITRCVRA

SEQ ID NO: 3010889 - protein, 22 aa, Entamoeba invadens
NNYFIWIHREPVDEIKSLLLML

SEQ ID NO: 3010890 - protein, 25 aa, Entamoeba invadens
NNYIVSFKAPIIFVVKRKETHNPNV

SEQ ID NO: 3010891 - protein, 17 aa, Entamoeba invadens
NNYKLLMNSSYGKTIQK

SEQ ID NO: 3010892 - protein, 24 aa, Entamoeba invadens
NNYLAQFMKGRLEKCGFVFYSKKT

SEQ ID NO: 3010893 - protein, 19 aa, Entamoeba invadens
NPAGYFYFKNNVSLTSVTF

SEQ ID NO: 3010894 - protein, 27 aa, Entamoeba invadens
NPDEELLVRWYQVGAFYPFFRAHAHLD

SEQ ID NO: 3010895 - protein, 29 aa, Entamoeba invadens
NPDGFFEKNLLFFQKYDYKHKLVGHSDSV

SEQ ID NO: 3010896 - protein, 24 aa, Entamoeba invadens
NPDHILFSSFNYSNELALFHFHSK

SEQ ID NO: 3010897 - protein, 25 aa, Entamoeba invadens
NPDSIYFFTEYFPHTLNSLFNLPIP

SEQ ID NO: 3010898 - protein, 35 aa, Entamoeba invadens
NPEDFLKSLKIPKPEDFIFVDYEGGLLSRDANGYL

SEQ ID NO: 3010899 - protein, 28 aa, Entamoeba invadens
NPEFYEETSFMWFVSKFEPKTLNFGNNN

SEQ ID NO: 3010900 - protein, 24 aa, Entamoeba invadens
NPEGWCYLTRNPKVKCRGSCLQLV

SEQ ID NO: 3010901 - protein, 19 aa, Entamoeba invadens
NPEIYRFLVGGLGVESVLG

SEQ ID NO: 3010902 - protein, 27 aa, Entamoeba invadens
NPELNKPRIILWNSTYIHLNKNITGRP

SEQ ID NO: 3010903 - protein, 24 aa, Entamoeba invadens
NPEYKDKVLAFNGIILGGDKIEVC

SEQ ID NO: 3010904 - protein, 30 aa, Entamoeba invadens
NPFDTKKFDRGLLLGFFRFMEVMKGMNEEG

SEQ ID NO: 3010905 - protein, 17 aa, Entamoeba invadens
NPFIYKYQMVETNPDFT

SEQ ID NO: 3010906 - protein, 20 aa, Entamoeba invadens
NPFNFSLLLFHTAGKDLSEL

SEQ ID NO: 3010907 - protein, 26 aa, Entamoeba invadens
NPFNLSAYPMSYPPPSRQAPPEFRPV

SEQ ID NO: 3010908 - protein, 25 aa, Entamoeba invadens
NPGLIHIKYFGIIGFNSTFFKKIIL

SEQ ID NO: 3010909 - protein, 20 aa, Entamoeba invadens
NPHGPWCLIPTDLETHFQTV

SEQ ID NO: 3010910 - protein, 25 aa, Entamoeba invadens
NPHINAFIKFVPRLAPLFGGLEISP

SEQ ID NO: 3010911 - protein, 36 aa, Entamoeba invadens
NPHYELMLKVFRKVLTFKPHMWSYGLDTFRGKDETA

SEQ ID NO: 3010912 - protein, 19 aa, Entamoeba invadens
NPICLHSHFNFFSNVETYH

SEQ ID NO: 3010913 - protein, 19 aa, Entamoeba invadens
NPIEVISHFLSGGGLKQFT

SEQ ID NO: 3010914 - protein, 21 aa, Entamoeba invadens
NPIKLYKKLYAGESYTFNLLD

SEQ ID NO: 3010915 - protein, 21 aa, Entamoeba invadens
NPILRFYQDADFVELEVKRIL

SEQ ID NO: 3010916 - protein, 41 aa, Entamoeba invadens
NPIQDVALLFVIYYLWMNDLKQFFPYLMFLDNKNISNCQFG

SEQ ID NO: 3010917 - protein, 25 aa, Entamoeba invadens
NPIRRKEFFISEHLYSLVNDTQYQT

SEQ ID NO: 3010918 - protein, 22 aa, Entamoeba invadens
NPISVSTLKLFPYIETQHLYTE

SEQ ID NO: 3010919 - protein, 29 aa, Entamoeba invadens
NPIVTNEPSLLWFTKHFTPDTMDLGFLDY

SEQ ID NO: 3010920 - protein, 21 aa, Entamoeba invadens
NPIYVFLYSVGSEKCDFIGRV

SEQ ID NO: 3010921 - protein, 23 aa, Entamoeba invadens
NPKALNIFLAQAIDWEDLHEVEE

SEQ ID NO: 3010922 - protein, 24 aa, Entamoeba invadens
NPKDFPFVVLINKMDEDPSKHTVN

SEQ ID NO: 3010923 - protein, 18 aa, Entamoeba invadens
NPKGWYRHALSSIALHDI

SEQ ID NO: 3010924 - protein, 20 aa, Entamoeba invadens
NPKLSLLFRDVKKLTVDPLA

SEQ ID NO: 3010925 - protein, 19 aa, Entamoeba invadens
NPKPWNGLKFVDSDGLFIV

SEQ ID NO: 3010926 - protein, 24 aa, Entamoeba invadens
NPKVMAQFLIDNNFNILFTLGGDG

SEQ ID NO: 3010927 - protein, 17 aa, Entamoeba invadens
NPKYVCSVFPKINTFRS

SEQ ID NO: 3010928 - protein, 33 aa, Entamoeba invadens
NPLEVFIDDGEKLFLHGLKLYYKKLDDKQKVAK

SEQ ID NO: 3010929 - protein, 21 aa, Entamoeba invadens
NPLLDLKFLSERPGFKIIGCG

SEQ ID NO: 3010930 - protein, 25 aa, Entamoeba invadens
NPLPKKFIPLPFPNKFQKIRSKIIS

SEQ ID NO: 3010931 - protein, 24 aa, Entamoeba invadens
NPLSKPTILLPNEITRLVPHVEHN

SEQ ID NO: 3010932 - protein, 23 aa, Entamoeba invadens
NPLTCLEYLVQLLAICEKKNKDV

SEQ ID NO: 3010933 - protein, 29 aa, Entamoeba invadens
NPLYQHGCSWAWKLMDGYAPLMFNENTIE

SEQ ID NO: 3010934 - protein, 24 aa, Entamoeba invadens
NPMLISFPVYVSYIAKDFIRKLIV

SEQ ID NO: 3010935 - protein, 27 aa, Entamoeba invadens
NPMRNVHFYLFNSYLRTSPENRNLFLE

SEQ ID NO: 3010936 - protein, 22 aa, Entamoeba invadens
NPMTFIPNYTVEIAKILPCLQF

SEQ ID NO: 3010937 - protein, 23 aa, Entamoeba invadens
NPNPYLLHTTLTKKVTFTPRHLN

SEQ ID NO: 3010938 - protein, 27 aa, Entamoeba invadens
NPNVQQQPLMFWTQPQNQNITGQNVWG

SEQ ID NO: 3010939 - protein, 25 aa, Entamoeba invadens
NPNYSAAMDLFFRLGADIEATNKNM

SEQ ID NO: 3010940 - protein, 26 aa, Entamoeba invadens
NPPEVPRFHPITVQTLETQLSTYSKP

SEQ ID NO: 3010941 - protein, 34 aa, Entamoeba invadens
NPPHQLIDIFRFHNFILLPQFNDIQFIDPRIYVW

SEQ ID NO: 3010942 - protein, 23 aa, Entamoeba invadens
NPPQEVALIFLSADLKLLLKNCF

SEQ ID NO: 3010943 - protein, 29 aa, Entamoeba invadens
NPPRNFFNDFVFLLDKTKYRIQLGEFVDT

SEQ ID NO: 3010944 - protein, 26 aa, Entamoeba invadens
NPQESYVMTLLLRYFDALPKNKKGYS

SEQ ID NO: 3010945 - protein, 26 aa, Entamoeba invadens
NPQFFPNIQDILYTTLLELFKQPIGI

SEQ ID NO: 3010946 - protein, 20 aa, Entamoeba invadens
NPQLAPFIDQMLSNPQLLRS

SEQ ID NO: 3010947 - protein, 19 aa, Entamoeba invadens
NPQLSQPLTFFDKTPSAFS

SEQ ID NO: 3010948 - protein, 22 aa, Entamoeba invadens
NPQMDEQLLRFQKLQRSSSINL

SEQ ID NO: 3010949 - protein, 19 aa, Entamoeba invadens
NPQQPFYSPFAPGAPQQYP

SEQ ID NO: 3010950 - protein, 23 aa, Entamoeba invadens
NPQTQLHYLLSFAFDGDLFPDVI

SEQ ID NO: 3010951 - protein, 19 aa, Entamoeba invadens
NPQVLYDKIEKKQALFMFK

SEQ ID NO: 3010952 - protein, 25 aa, Entamoeba invadens
NPRRQQFYQPYPPIPQAQMYQYSPY

SEQ ID NO: 3010953 - protein, 30 aa, Entamoeba invadens
NPRSIYLGYNFLFNFFPHLNTLTGNMNTII

SEQ ID NO: 3010954 - protein, 31 aa, Entamoeba invadens
NPRSIYLGYNFLFNFFPRLNTLTGNLNTMVR

SEQ ID NO: 3010955 - protein, 19 aa, Entamoeba invadens
NPRTLLFSEFQRCNYLKFE

SEQ ID NO: 3010956 - protein, 29 aa, Entamoeba invadens
NPSDLFPYFRSEFVFYAISRYVSMNDSSK

SEQ ID NO: 3010957 - protein, 23 aa, Entamoeba invadens
NPSFGEKFVPLLFAKQGDGDYRY

SEQ ID NO: 3010958 - protein, 29 aa, Entamoeba invadens
NPSGKEMLKMLFLLKGMLLNIKDTATLGD

SEQ ID NO: 3010959 - protein, 24 aa, Entamoeba invadens
NPSQSLYCYLFENKPLFVNDDFNN

SEQ ID NO: 3010960 - protein, 24 aa, Entamoeba invadens
NPSRFSLLKYSDLFNYSIYEDDAS

SEQ ID NO: 3010961 - protein, 18 aa, Entamoeba invadens
NPSVDCILPPSLEVYCGC

SEQ ID NO: 3010962 - protein, 23 aa, Entamoeba invadens
NPTAALYRIVSDEHPPFPPSVSP

SEQ ID NO: 3010963 - protein, 29 aa, Entamoeba invadens
NPTCGTALLFTSPLSDLKITLIFEDPLDA

SEQ ID NO: 3010964 - protein, 21 aa, Entamoeba invadens
NPTFCFDLINGIIGYCRSPSL

SEQ ID NO: 3010965 - protein, 26 aa, Entamoeba invadens
NPTIQMHMLENLNFALEILKSQVSNI

SEQ ID NO: 3010966 - protein, 27 aa, Entamoeba invadens
NPTPQIPNLRWALLRPSEFNGVSSLTK

SEQ ID NO: 3010967 - protein, 29 aa, Entamoeba invadens
NPVGSMNFLKLIKLNHYKYSVITKVIKDY

SEQ ID NO: 3010968 - protein, 20 aa, Entamoeba invadens
NPVIQKTLKFSLLSVGEVNR

SEQ ID NO: 3010969 - protein, 27 aa, Entamoeba invadens
NPVKSTKIIYKNLPLKYVIHGTESTPE

SEQ ID NO: 3010970 - protein, 18 aa, Entamoeba invadens
NPVVLNWLHSQHTFINIL

SEQ ID NO: 3010971 - protein, 18 aa, Entamoeba invadens
NPVVYCKAITKDVTRDLQ

SEQ ID NO: 3010972 - protein, 21 aa, Entamoeba invadens
NPYDFLVHLSDFLGKVQQVID

SEQ ID NO: 3010973 - protein, 17 aa, Entamoeba invadens
NPYHWVIDFNNFDTTTH

SEQ ID NO: 3010974 - protein, 17 aa, Entamoeba invadens
NPYLSQYPTSAAQQFDS

SEQ ID NO: 3010975 - protein, 20 aa, Entamoeba invadens
NPYVKFLKNLPKRPEFGPSL

SEQ ID NO: 3010976 - protein, 18 aa, Entamoeba invadens
NQCKSLEFIKLPEKLNEI

SEQ ID NO: 3010977 - protein, 34 aa, Entamoeba invadens
NQDLRKLYVNMIPYTRLRFLTSSIAPVASALEME

SEQ ID NO: 3010978 - protein, 23 aa, Entamoeba invadens
NQDTLFIICNLLNDIITNESQTK

SEQ ID NO: 3010979 - protein, 26 aa, Entamoeba invadens
NQDTLHQWITVANLLGNSYGLESVTP

SEQ ID NO: 3010980 - protein, 30 aa, Entamoeba invadens
NQDVVGLLLILQFLVYFNKNLNDDNVERMV

SEQ ID NO: 3010981 - protein, 19 aa, Entamoeba invadens
NQEVLRSEALVNHIKGIVT

SEQ ID NO: 3010982 - protein, 23 aa, Entamoeba invadens
NQEYLHVISVRFLQNCIGSCSEQ

SEQ ID NO: 3010983 - protein, 26 aa, Entamoeba invadens
NQFGQPMYFFVLNGVAQAMVPLVPVP

SEQ ID NO: 3010984 - protein, 21 aa, Entamoeba invadens
NQFILSSVFFGQTPVLVGGDN

SEQ ID NO: 3010985 - protein, 24 aa, Entamoeba invadens
NQFKNNFIYSNYPWGSAIVNESEI

SEQ ID NO: 3010986 - protein, 28 aa, Entamoeba invadens
NQFRACALAQLLFLFLNPSNTFKHITFS

SEQ ID NO: 3010987 - protein, 25 aa, Entamoeba invadens
NQFSLPFVAIQLPPLSLQLLQDQSG

SEQ ID NO: 3010988 - protein, 21 aa, Entamoeba invadens
NQFVTFLKTVEFANADLVVFC

SEQ ID NO: 3010989 - protein, 21 aa, Entamoeba invadens
NQGCLCLAQFNYIHIGVYLVS

SEQ ID NO: 3010990 - protein, 18 aa, Entamoeba invadens
NQHFLFAEQFMMAYKAKL

SEQ ID NO: 3010991 - protein, 25 aa, Entamoeba invadens
NQHISLELLKLFPNIQTLSCSVEDY

SEQ ID NO: 3010992 - protein, 26 aa, Entamoeba invadens
NQHSAFKPLPFFKDFITLVGSHKEDT

SEQ ID NO: 3010993 - protein, 26 aa, Entamoeba invadens
NQIFEACNNCLLVVALSKVFQNELKK

SEQ ID NO: 3010994 - protein, 20 aa, Entamoeba invadens
NQIHFFPQGMLPVTDFNGKT

SEQ ID NO: 3010995 - protein, 24 aa, Entamoeba invadens
NQIIERWITMLGGEVTLRPKNAHY

SEQ ID NO: 3010996 - protein, 35 aa, Entamoeba invadens
NQILNSKELFLLLLTFLKHAFDYKTLYDIFDYRKR

SEQ ID NO: 3010997 - protein, 17 aa, Entamoeba invadens
NQIVDLENEVAVLKDQN

SEQ ID NO: 3010998 - protein, 26 aa, Entamoeba invadens
NQKFAKNLIFIFTKTNFVAVGNTVST

SEQ ID NO: 3010999 - protein, 17 aa, Entamoeba invadens
NQKFYFTVLPHTTLSFK

SEQ ID NO: 3011000 - protein, 17 aa, Entamoeba invadens
NQKISFKVPKLKKAKVE

SEQ ID NO: 3011001 - protein, 27 aa, Entamoeba invadens
NQKMKELQGLYLSRQKLISQKNENEMV

SEQ ID NO: 3011002 - protein, 29 aa, Entamoeba invadens
NQKMLEENPWVKEMTRISIFGTQQEKEEA

SEQ ID NO: 3011003 - protein, 26 aa, Entamoeba invadens
NQKMTWNLLLRVIFTSLHSLDPTKEY

SEQ ID NO: 3011004 - protein, 26 aa, Entamoeba invadens
NQKNPTLIVPYLFLGAVNATKDPAFL

SEQ ID NO: 3011005 - protein, 25 aa, Entamoeba invadens
NQKPLQFHNILWISKTSFSIDADKV

SEQ ID NO: 3011006 - protein, 23 aa, Entamoeba invadens
NQKQILVTFSSSKGVLFVHYLCR

SEQ ID NO: 3011007 - protein, 23 aa, Entamoeba invadens
NQKQKMFWISDAFRINSEDKSYI

SEQ ID NO: 3011008 - protein, 22 aa, Entamoeba invadens
NQLAMLYHFNTMYNESVFSLFA

SEQ ID NO: 3011009 - protein, 21 aa, Entamoeba invadens
NQLFKWSGRSVGIPFVEIPLE

SEQ ID NO: 3011010 - protein, 20 aa, Entamoeba invadens
NQLHPIILSLLLNTDKEIVE

SEQ ID NO: 3011011 - protein, 25 aa, Entamoeba invadens
NQLKSKFLMLLSHASTEQLKRVVDH

SEQ ID NO: 3011012 - protein, 27 aa, Entamoeba invadens
NQMAASLPMFYFTPISVNLPKFKKEDI

SEQ ID NO: 3011013 - protein, 20 aa, Entamoeba invadens
NQMLLCQVLPGKSFKCKKRM

SEQ ID NO: 3011014 - protein, 26 aa, Entamoeba invadens
NQNDRQLLLINYFNHKIARDFPTEDL

SEQ ID NO: 3011015 - protein, 28 aa, Entamoeba invadens
NQNIELKIVFYRIVVWFNVDYTTVDTNS

SEQ ID NO: 3011016 - protein, 19 aa, Entamoeba invadens
NQNIVEFKNLCRTHKILVV

SEQ ID NO: 3011017 - protein, 24 aa, Entamoeba invadens
NQPEWFPKVQLLRLMKKDVQFTYS

SEQ ID NO: 3011018 - protein, 43 aa, Entamoeba invadens
NQPPKVLFQSLLINNLAVAVKFSLLLGIKAIGLLLFGNEEKEV

SEQ ID NO: 3011019 - protein, 31 aa, Entamoeba invadens
NQQAYQESYLLALLNQFFSITLERPGKQSKM

SEQ ID NO: 3011020 - protein, 22 aa, Entamoeba invadens
NQRAPYIRYALVVVNYILNVKN

SEQ ID NO: 3011021 - protein, 23 aa, Entamoeba invadens
NQREMYLKLLKSINMRDLGTTYM

SEQ ID NO: 3011022 - protein, 20 aa, Entamoeba invadens
NQRIEYITGLLLGSNFITDR

SEQ ID NO: 3011023 - protein, 26 aa, Entamoeba invadens
NQSERLIPADLVICAFGFGLVNNFVE

SEQ ID NO: 3011024 - protein, 27 aa, Entamoeba invadens
NQSGIDMMSFFEFLKKFNVNLTEVETR

SEQ ID NO: 3011025 - protein, 25 aa, Entamoeba invadens
NQSGILMPFFDADSSILYIGGKGDG

SEQ ID NO: 3011026 - protein, 20 aa, Entamoeba invadens
NQSIAILDRNMTTIVANLSK

SEQ ID NO: 3011027 - protein, 27 aa, Entamoeba invadens
NQSLFSNFIILPYFSPNEIPTIKKVFF

SEQ ID NO: 3011028 - protein, 26 aa, Entamoeba invadens
NQSPNPNPVFKIPEPFPSNYMNTKLV

SEQ ID NO: 3011029 - protein, 24 aa, Entamoeba invadens
NQSQRAYKMLEWENKTVVDDLFKE

SEQ ID NO: 3011030 - protein, 35 aa, Entamoeba invadens
NQSVVKLYYAFQDACSLFLVMEFCPGGDLACLLRE

SEQ ID NO: 3011031 - protein, 32 aa, Entamoeba invadens
NQTCPSLYLLIKVGYILFKYKTINKVLPKEIA

SEQ ID NO: 3011032 - protein, 22 aa, Entamoeba invadens
NQTITKLLITLLAQIKNKKSFD

SEQ ID NO: 3011033 - protein, 18 aa, Entamoeba invadens
NQTKCFIFRNLKYVVRKL

SEQ ID NO: 3011034 - protein, 29 aa, Entamoeba invadens
NQTKLIISRVTLMLHFMLTYTLENASELM

SEQ ID NO: 3011035 - protein, 24 aa, Entamoeba invadens
NQTYRSKFKDIDFAKPSATTARRV

SEQ ID NO: 3011036 - protein, 26 aa, Entamoeba invadens
NQVDLERFSFLLSVFGEFVTKKELFQ

SEQ ID NO: 3011037 - protein, 24 aa, Entamoeba invadens
NQVFEILGEFCQCKNWKTALEKVM

SEQ ID NO: 3011038 - protein, 33 aa, Entamoeba invadens
NQVLNGVFHHKSLRLLQYPVINCILAGHNVLVL

SEQ ID NO: 3011039 - protein, 28 aa, Entamoeba invadens
NQVMRFQTMLSYLFPNEIFSGNFFPWNT

SEQ ID NO: 3011040 - protein, 26 aa, Entamoeba invadens
NQVYEQMVLLWIINKRFSISLKCPNK

SEQ ID NO: 3011041 - protein, 23 aa, Entamoeba invadens
NQYPYGLRYLCKVINEGSVQANP

SEQ ID NO: 3011042 - protein, 19 aa, Entamoeba invadens
NRAALSFNSLLALAENFGY

SEQ ID NO: 3011043 - protein, 19 aa, Entamoeba invadens
NRAAYLEKWWNVVNWKFVE

SEQ ID NO: 3011044 - protein, 17 aa, Entamoeba invadens
NRAECNPFLLFCKDHRD

SEQ ID NO: 3011045 - protein, 29 aa, Entamoeba invadens
NRAQMAQRGLFLAGSIPTPASAGLLAASS

SEQ ID NO: 3011046 - protein, 17 aa, Entamoeba invadens
NRASFEGISFWIADVKE

SEQ ID NO: 3011047 - protein, 18 aa, Entamoeba invadens
NRCGSLNRFLFENSSQEC

SEQ ID NO: 3011048 - protein, 18 aa, Entamoeba invadens
NRCIKLKNVIIPSSVRSI

SEQ ID NO: 3011049 - protein, 30 aa, Entamoeba invadens
NRCSDLKRYTLLLTNLPHKRLRDVATRVKF

SEQ ID NO: 3011050 - protein, 29 aa, Entamoeba invadens
NRCTDVVVFYHFNPMYSLLCPTKCSDIHS

SEQ ID NO: 3011051 - protein, 20 aa, Entamoeba invadens
NRCVGSNKKVLVIVKTTKND

SEQ ID NO: 3011052 - protein, 17 aa, Entamoeba invadens
NRCYLKSVLALTQIVYD

SEQ ID NO: 3011053 - protein, 27 aa, Entamoeba invadens
NRDFVFVWKWFIKDGCYYLILESVNST

SEQ ID NO: 3011054 - protein, 24 aa, Entamoeba invadens
NRDIQFVPIKDSLFGITPLGRLET

SEQ ID NO: 3011055 - protein, 35 aa, Entamoeba invadens
NRDSFDYLQEWIDDVSMYCPQGVKIVLVGNKVDLE

SEQ ID NO: 3011056 - protein, 29 aa, Entamoeba invadens
NRDVLSFVVDHWYFFQNLEQFRAPQEQWV

SEQ ID NO: 3011057 - protein, 32 aa, Entamoeba invadens
NRDWMHYGRRPSGICGVALYLAGRLHNEPRTL

SEQ ID NO: 3011058 - protein, 26 aa, Entamoeba invadens
NRDWVNMRSWWFDEKKGIYIITNHSV

SEQ ID NO: 3011059 - protein, 24 aa, Entamoeba invadens
NREAAFASFLSYVLIQQNFKLTCQ

SEQ ID NO: 3011060 - protein, 19 aa, Entamoeba invadens
NREFIVRLEDLFSKTEIHD

SEQ ID NO: 3011061 - protein, 18 aa, Entamoeba invadens
NRENEAFHIPYKSVDIVI

SEQ ID NO: 3011062 - protein, 28 aa, Entamoeba invadens
NRENGIGDWGFITDGYWTMKDVYLGNVK

SEQ ID NO: 3011063 - protein, 27 aa, Entamoeba invadens
NREPDVFLFQNFPALSELFVPDVNLAE

SEQ ID NO: 3011064 - protein, 24 aa, Entamoeba invadens
NREVKINLLKIVKSLLQAHPEKKR

SEQ ID NO: 3011065 - protein, 21 aa, Entamoeba invadens
NRFFTIFNRVYSLTYMEPFQI

SEQ ID NO: 3011066 - protein, 28 aa, Entamoeba invadens
NRFKKFETRFFIFHDLELRVPGFDERVC

SEQ ID NO: 3011067 - protein, 34 aa, Entamoeba invadens
NRFMYKIVDEFPRYIWYPFLPQIITQMQSSSFKE

SEQ ID NO: 3011068 - protein, 19 aa, Entamoeba invadens
NRFPVCVRYYYATLSKELK

SEQ ID NO: 3011069 - protein, 29 aa, Entamoeba invadens
NRGKEKRHFFLFNDRLVVTKYADFKIKFD

SEQ ID NO: 3011070 - protein, 32 aa, Entamoeba invadens
NRGMRYRFYLRELPLMFRKIYASSMMPLKIKE

SEQ ID NO: 3011071 - protein, 19 aa, Entamoeba invadens
NRHTLEFFLCVSKSCCEAF

SEQ ID NO: 3011072 - protein, 30 aa, Entamoeba invadens
NRHVCVVFELLGLNLYDVLRINKNKGMGYS

SEQ ID NO: 3011073 - protein, 23 aa, Entamoeba invadens
NRIDVVWTWVNGTDPLWLSHLKQ

SEQ ID NO: 3011074 - protein, 22 aa, Entamoeba invadens
NRIFCLMISILYNVLDTPNYSL

SEQ ID NO: 3011075 - protein, 19 aa, Entamoeba invadens
NRIHGLFEVIPHKVYQFRG

SEQ ID NO: 3011076 - protein, 22 aa, Entamoeba invadens
NRINIFLEKVTSTSWSQWEKQK

SEQ ID NO: 3011077 - protein, 17 aa, Entamoeba invadens
NRISFYHKIVGGNSNKL

SEQ ID NO: 3011078 - protein, 25 aa, Entamoeba invadens
NRISSYLINSLLLRAVDELEFVRTT

SEQ ID NO: 3011079 - protein, 19 aa, Entamoeba invadens
NRIVLLHPSSCVGKREWIV

SEQ ID NO: 3011080 - protein, 25 aa, Entamoeba invadens
NRKDLIDPALLRPGRFDCLIEIPKP

SEQ ID NO: 3011081 - protein, 36 aa, Entamoeba invadens
NRKEMILVSVLNYLGYSFLFQKPKKFTVHTSLPFIN

SEQ ID NO: 3011082 - protein, 25 aa, Entamoeba invadens
NRKIENRMLYKDLLDFAFEEKYQLT

SEQ ID NO: 3011083 - protein, 27 aa, Entamoeba invadens
NRKITHSSFVFWFQSVFAKNVKDKHKQ

SEQ ID NO: 3011084 - protein, 21 aa, Entamoeba invadens
NRKKKFRIISIDGGGIKCIMQ

SEQ ID NO: 3011085 - protein, 22 aa, Entamoeba invadens
NRKNLRYCVKPKTKNVIDDIEK

SEQ ID NO: 3011086 - protein, 29 aa, Entamoeba invadens
NRKNVVVYFYHKRFLISDVFLGCVEFDLT

SEQ ID NO: 3011087 - protein, 19 aa, Entamoeba invadens
NRKVFLGNFLVDLAKQLGF

SEQ ID NO: 3011088 - protein, 17 aa, Entamoeba invadens
NRKYLAWAGASTLGGMT

SEQ ID NO: 3011089 - protein, 23 aa, Entamoeba invadens
NRKYSYLFWEGVLNGTLEGRNIS

SEQ ID NO: 3011090 - protein, 24 aa, Entamoeba invadens
NRLCYLQAILKQKQKHLLRLQKNV

SEQ ID NO: 3011091 - protein, 18 aa, Entamoeba invadens
NRLNLIHRDLKPTNFLLT

SEQ ID NO: 3011092 - protein, 23 aa, Entamoeba invadens
NRLSKIMWVGNVICAVAGVLVGD

SEQ ID NO: 3011093 - protein, 22 aa, Entamoeba invadens
NRLTPLHYCAMNGMVHLVNELL

SEQ ID NO: 3011094 - protein, 18 aa, Entamoeba invadens
NRMGLIVWKVNLLNNMAS

SEQ ID NO: 3011095 - protein, 20 aa, Entamoeba invadens
NRMILTLDSFNFTNKGQVVL

SEQ ID NO: 3011096 - protein, 18 aa, Entamoeba invadens
NRMPRPMCGPFKKTIIYT

SEQ ID NO: 3011097 - protein, 18 aa, Entamoeba invadens
NRMRIYISINDAPVFMNE

SEQ ID NO: 3011098 - protein, 23 aa, Entamoeba invadens
NRMVNHFIAKFKRKHKKDISGNA

SEQ ID NO: 3011099 - protein, 26 aa, Entamoeba invadens
NRNEIVLFVWLLNYNPHIIKHYLEHI

SEQ ID NO: 3011100 - protein, 23 aa, Entamoeba invadens
NRNIFGGVLYEKVVKEKEFVGSQ

SEQ ID NO: 3011101 - protein, 18 aa, Entamoeba invadens
NRNKLLERYKKYSFCLGF

SEQ ID NO: 3011102 - protein, 26 aa, Entamoeba invadens
NRNKTLFLPNGLFLGIAKIGLADLVE

SEQ ID NO: 3011103 - protein, 20 aa, Entamoeba invadens
NRNMISWRKSFFDFEHRETK

SEQ ID NO: 3011104 - protein, 23 aa, Entamoeba invadens
NRPASALPLKISAAKLEALTGKY

SEQ ID NO: 3011105 - protein, 24 aa, Entamoeba invadens
NRPAYYRQAMLEIAILQLLSERFD

SEQ ID NO: 3011106 - protein, 22 aa, Entamoeba invadens
NRPSLFRQGMLEIAMLTCASRG

SEQ ID NO: 3011107 - protein, 27 aa, Entamoeba invadens
NRPTSLLPLYIERIMYRLYYSKDVEGV

SEQ ID NO: 3011108 - protein, 21 aa, Entamoeba invadens
NRPVCVVGLCKLLSLPQFTPV

SEQ ID NO: 3011109 - protein, 26 aa, Entamoeba invadens
NRQIYPPINVLPSLSRLMKSAIGEGM

SEQ ID NO: 3011110 - protein, 26 aa, Entamoeba invadens
NRQLGTQWFQLLPPKVGVAKTGKILI

SEQ ID NO: 3011111 - protein, 22 aa, Entamoeba invadens
NRQSIILKTQFSLSLTTLDTTQ

SEQ ID NO: 3011112 - protein, 20 aa, Entamoeba invadens
NRRIICFKQNVYLGAIEMEP

SEQ ID NO: 3011113 - protein, 27 aa, Entamoeba invadens
NRRRIGHNFFWFLKAEIHDARVTARYG

SEQ ID NO: 3011114 - protein, 22 aa, Entamoeba invadens
NRSALGFSYLLRMAEGIGYNFK

SEQ ID NO: 3011115 - protein, 24 aa, Entamoeba invadens
NRSKSDHFLVKRAKKAKLLRAFSK

SEQ ID NO: 3011116 - protein, 24 aa, Entamoeba invadens
NRTEPFYEYLLQSNMYYTHKPTID

SEQ ID NO: 3011117 - protein, 22 aa, Entamoeba invadens
NRTHPTVLMDSLGGYIMYGIKV

SEQ ID NO: 3011118 - protein, 29 aa, Entamoeba invadens
NRTKRVRLPMLEPVFLFLNKQKGHDRPSP

SEQ ID NO: 3011119 - protein, 23 aa, Entamoeba invadens
NRTKYPIPKYASIIGISTYENET

SEQ ID NO: 3011120 - protein, 37 aa, Entamoeba invadens
NRTLEQLLIQPVQRLMRYPMLVDVLIKATYKRNPDYE

SEQ ID NO: 3011121 - protein, 38 aa, Entamoeba invadens
NRTLEQLLIQPVQRLMRYPMLVDVLIKATYKRNPDYEC

SEQ ID NO: 3011122 - protein, 39 aa, Entamoeba invadens
NRTLEQLLIQPVQRLMRYPMLVDVLIKATYKRNPDYECL

SEQ ID NO: 3011123 - protein, 22 aa, Entamoeba invadens
NRTTFRPEYIANLFAGLISILD

SEQ ID NO: 3011124 - protein, 47 aa, Entamoeba invadens
NRVCINNKYICLKKYMIGFDPLTELCRLITMPLTLDIVKMKEQVYPT

SEQ ID NO: 3011125 - protein, 28 aa, Entamoeba invadens
NRVCLKENIMFLVFTKEGHLFGSFNTKR

SEQ ID NO: 3011126 - protein, 26 aa, Entamoeba invadens
NRVFSIEALIPFFEGLRMDFGVESAL

SEQ ID NO: 3011127 - protein, 26 aa, Entamoeba invadens
NRVGNFPIVLKLPVKCQSNYICLHHW

SEQ ID NO: 3011128 - protein, 26 aa, Entamoeba invadens
NRVGVQAILMCAYQRGLRKFNNITDE

SEQ ID NO: 3011129 - protein, 20 aa, Entamoeba invadens
NRVLTVLQLSKDWFTKMVEK

SEQ ID NO: 3011130 - protein, 19 aa, Entamoeba invadens
NRVLVEKDGKQFLIQVKFS

SEQ ID NO: 3011131 - protein, 24 aa, Entamoeba invadens
NRVTIKISLYSLLQKRRSLIAQES

SEQ ID NO: 3011132 - protein, 18 aa, Entamoeba invadens
NRWVERGVTLFWKYFDTT

SEQ ID NO: 3011133 - protein, 20 aa, Entamoeba invadens
NRYEFPRELDLFKYSAEFLK

SEQ ID NO: 3011134 - protein, 24 aa, Entamoeba invadens
NRYIDFFMRCDISRTLIALFDSLP

SEQ ID NO: 3011135 - protein, 17 aa, Entamoeba invadens
NRYIPWITLSRIFYLSL

SEQ ID NO: 3011136 - protein, 19 aa, Entamoeba invadens
NRYLIYSRAAKKEGLDVIA

SEQ ID NO: 3011137 - protein, 23 aa, Entamoeba invadens
NRYNVTNVFGLKWGYEGLNPETS

SEQ ID NO: 3011138 - protein, 27 aa, Entamoeba invadens
NSADYTAWYYRRRILKSKPSFNTSDEY

SEQ ID NO: 3011139 - protein, 25 aa, Entamoeba invadens
NSAFKDFIQLFLTTSPKPSRTSPKM

SEQ ID NO: 3011140 - protein, 27 aa, Entamoeba invadens
NSAIGKILLTLLFRVPEDENATKKRFD

SEQ ID NO: 3011141 - protein, 22 aa, Entamoeba invadens
NSALPTILPSPNFPKIETNELS

SEQ ID NO: 3011142 - protein, 18 aa, Entamoeba invadens
NSATILVIVNYVETLITS

SEQ ID NO: 3011143 - protein, 22 aa, Entamoeba invadens
NSCLSCFRIPSTITSLDASQWK

SEQ ID NO: 3011144 - protein, 20 aa, Entamoeba invadens
NSCLYYCNISCITLPPNITS

SEQ ID NO: 3011145 - protein, 29 aa, Entamoeba invadens
NSCVVKGCFITFKKYADGPFAIFLDVIEK

SEQ ID NO: 3011146 - protein, 29 aa, Entamoeba invadens
NSCYILDCYSEMYMWVGGRLAKDRRQQYI

SEQ ID NO: 3011147 - protein, 26 aa, Entamoeba invadens
NSDAMAFILSKLSKKGLRPGVFAAIS

SEQ ID NO: 3011148 - protein, 18 aa, Entamoeba invadens
NSDESLLSWMFVEMRDTP

SEQ ID NO: 3011149 - protein, 26 aa, Entamoeba invadens
NSDIRHMTLLVVRQFLFGKELEKSSK

SEQ ID NO: 3011150 - protein, 25 aa, Entamoeba invadens
NSDKTLYETLFRLIDDDNSGTLETN

SEQ ID NO: 3011151 - protein, 27 aa, Entamoeba invadens
NSDLILESLALLRPLLKSPKHSTLECM

SEQ ID NO: 3011152 - protein, 67 aa, Entamoeba invadens
NSDLPPLPPGLAPPDGMLPPPGLAPPGGMLPPPGLAPPGGLMPPGMLPPPGLAPPGGMMPPPGGMPM

SEQ ID NO: 3011153 - protein, 27 aa, Entamoeba invadens
NSDTFDFFIRVGYKCLIYGDYNASFLV

SEQ ID NO: 3011154 - protein, 24 aa, Entamoeba invadens
NSDVFCPTIYGFKIGKKRANKVEK

SEQ ID NO: 3011155 - protein, 23 aa, Entamoeba invadens
NSDVFIKVVQWIVGGDGWAYDIG

SEQ ID NO: 3011156 - protein, 22 aa, Entamoeba invadens
NSDYIGILRFKNATCLVVCDGC

SEQ ID NO: 3011157 - protein, 20 aa, Entamoeba invadens
NSEDIFSRISRRAELSLSGF

SEQ ID NO: 3011158 - protein, 20 aa, Entamoeba invadens
NSEFFFEWVEKILVPDVKRK

SEQ ID NO: 3011159 - protein, 18 aa, Entamoeba invadens
NSEFLKEYLSFDKNLSVI

SEQ ID NO: 3011160 - protein, 24 aa, Entamoeba invadens
NSEKTRVIFSYRTKRFPPKHVPRS

SEQ ID NO: 3011161 - protein, 25 aa, Entamoeba invadens
NSEKWIELIRAVRKISVVKALFYCQ

SEQ ID NO: 3011162 - protein, 23 aa, Entamoeba invadens
NSELKRFVLLKNCNVLVQFDKEV

SEQ ID NO: 3011163 - protein, 19 aa, Entamoeba invadens
NSELYLFQILQVVNGIEQN

SEQ ID NO: 3011164 - protein, 25 aa, Entamoeba invadens
NSEMWKMCCELFDFLALSAVIDNHI

SEQ ID NO: 3011165 - protein, 20 aa, Entamoeba invadens
NSENFFIDFLRTKMGSLREV

SEQ ID NO: 3011166 - protein, 22 aa, Entamoeba invadens
NSESLILNCAFLSCSHLTSVSI

SEQ ID NO: 3011167 - protein, 24 aa, Entamoeba invadens
NSETMLFYFVRRLDEILPMTNDRV

SEQ ID NO: 3011168 - protein, 27 aa, Entamoeba invadens
NSETNFVFSVYSAFWILSDGTINIHPA

SEQ ID NO: 3011169 - protein, 24 aa, Entamoeba invadens
NSEYADYYIVYQLGFCYSTVDGRV

SEQ ID NO: 3011170 - protein, 30 aa, Entamoeba invadens
NSEYNMIYKFINMIGLPPTSLLNKGTKTTK

SEQ ID NO: 3011171 - protein, 23 aa, Entamoeba invadens
NSFDLLPPGVKLLARVFNEYAAQ

SEQ ID NO: 3011172 - protein, 17 aa, Entamoeba invadens
NSFGDYCFYCCSSLCSV

SEQ ID NO: 3011173 - protein, 17 aa, Entamoeba invadens
NSFIFKITQKSMKKFNL

SEQ ID NO: 3011174 - protein, 21 aa, Entamoeba invadens
NSFILPRPSQPIEFRKETHEC

SEQ ID NO: 3011175 - protein, 19 aa, Entamoeba invadens
NSFKWIPITNDLNPSPYST

SEQ ID NO: 3011176 - protein, 24 aa, Entamoeba invadens
NSFLHKLSAWLPLQSTDLVKAQTH

SEQ ID NO: 3011177 - protein, 18 aa, Entamoeba invadens
NSFSLVTPPFRPPEVVRP

SEQ ID NO: 3011178 - protein, 25 aa, Entamoeba invadens
NSGKCQLCLSGKYYNPNSKSCQSND

SEQ ID NO: 3011179 - protein, 29 aa, Entamoeba invadens
NSGNAAGRRIWLAKKPSNFSLPKAGDQTG

SEQ ID NO: 3011180 - protein, 25 aa, Entamoeba invadens
NSGNDWNYFLFYAAHGKVKEGVEWM

SEQ ID NO: 3011181 - protein, 26 aa, Entamoeba invadens
NSGRLYSYLIPSLLIAKKCHAEKTGP

SEQ ID NO: 3011182 - protein, 31 aa, Entamoeba invadens
NSHSIYLKYNLLFNFFPLLNTLTGNLNTMVH

SEQ ID NO: 3011183 - protein, 21 aa, Entamoeba invadens
NSHTQPIFFFGYGESIEDPIN

SEQ ID NO: 3011184 - protein, 19 aa, Entamoeba invadens
NSHVFLRGALIKLNCGIDD

SEQ ID NO: 3011185 - protein, 18 aa, Entamoeba invadens
NSHYKTCDFITGEASLFL

SEQ ID NO: 3011186 - protein, 24 aa, Entamoeba invadens
NSICQWITVEYPIQPILENGTQTT

SEQ ID NO: 3011187 - protein, 20 aa, Entamoeba invadens
NSIDWKAMKLPVKFGVQERG

SEQ ID NO: 3011188 - protein, 18 aa, Entamoeba invadens
NSIFDVFLALRTVENKRL

SEQ ID NO: 3011189 - protein, 26 aa, Entamoeba invadens
NSIFTRIIRVFLDNELKLFLKEIVAI

SEQ ID NO: 3011190 - protein, 24 aa, Entamoeba invadens
NSIGKALQLPSDIPAFPAPPQMVD

SEQ ID NO: 3011191 - protein, 25 aa, Entamoeba invadens
NSIIDPDFHKEWDPLVIEWNVVDTK

SEQ ID NO: 3011192 - protein, 20 aa, Entamoeba invadens
NSIIFPTKLEYIGKSCFNKC

SEQ ID NO: 3011193 - protein, 29 aa, Entamoeba invadens
NSILTEKYIRFQKLYFNDLYTFSKETLCS

SEQ ID NO: 3011194 - protein, 26 aa, Entamoeba invadens
NSINTINIVNTEKPSFSLSTEPYVVG

SEQ ID NO: 3011195 - protein, 17 aa, Entamoeba invadens
NSIPRWEQYRESCYTRD

SEQ ID NO: 3011196 - protein, 19 aa, Entamoeba invadens
NSIQHRKQIRILFKKEAED

SEQ ID NO: 3011197 - protein, 30 aa, Entamoeba invadens
NSIREEIEFNLLFTLEKRKQLFQLSKLMDN

SEQ ID NO: 3011198 - protein, 31 aa, Entamoeba invadens
NSIRILVMKKMFKWKLSKLTPRLLFQMGITE

SEQ ID NO: 3011199 - protein, 25 aa, Entamoeba invadens
NSITKKGIFIPSQNQKKTILVCVSN

SEQ ID NO: 3011200 - protein, 26 aa, Entamoeba invadens
NSIVCNFKFPLVSTSSSIVKWWTPQD

SEQ ID NO: 3011201 - protein, 33 aa, Entamoeba invadens
NSIVKCDVDIRKDLYKNIVFSSGTSMYSGINDR

SEQ ID NO: 3011202 - protein, 25 aa, Entamoeba invadens
NSIVTLFECAKLKNLFTLCLKSISE

SEQ ID NO: 3011203 - protein, 17 aa, Entamoeba invadens
NSKAMLFNNFESKYKLD

SEQ ID NO: 3011204 - protein, 29 aa, Entamoeba invadens
NSKHAFYIGAINSMAFFNVGKGDIRVSAN

SEQ ID NO: 3011205 - protein, 17 aa, Entamoeba invadens
NSKIICFKLKENNIYTN

SEQ ID NO: 3011206 - protein, 17 aa, Entamoeba invadens
NSKIKSLVFDSEKDDWA

SEQ ID NO: 3011207 - protein, 18 aa, Entamoeba invadens
NSKILFAKPQHKKSRVPG

SEQ ID NO: 3011208 - protein, 24 aa, Entamoeba invadens
NSKKLPLKSLYMESLENLKSIALP

SEQ ID NO: 3011209 - protein, 27 aa, Entamoeba invadens
NSKKLSFTPFVLAFLPEFVVSIITDYV

SEQ ID NO: 3011210 - protein, 22 aa, Entamoeba invadens
NSKKWVVAVLAFFGIKQDDSSY

SEQ ID NO: 3011211 - protein, 22 aa, Entamoeba invadens
NSKTFFYFYNVETGEVIYKHIV

SEQ ID NO: 3011212 - protein, 36 aa, Entamoeba invadens
NSKVLPKFLVLLYPSGLLTQIIPLAQTVFSIMIGLQ

SEQ ID NO: 3011213 - protein, 21 aa, Entamoeba invadens
NSKYYYVHSCLGYLAKKKKYS

SEQ ID NO: 3011214 - protein, 17 aa, Entamoeba invadens
NSLCAIFKIEEDENKVE

SEQ ID NO: 3011215 - protein, 30 aa, Entamoeba invadens
NSLFEVLQIKTLRKVYIIFTTTTLQTINKF

SEQ ID NO: 3011216 - protein, 18 aa, Entamoeba invadens
NSLKIYLTPIPKPKRDEM

SEQ ID NO: 3011217 - protein, 30 aa, Entamoeba invadens
NSLLPLDPIVLTKIFEYLPMEDLFSLMHTC

SEQ ID NO: 3011218 - protein, 21 aa, Entamoeba invadens
NSLNYYIMFNREMKYQLGIPK

SEQ ID NO: 3011219 - protein, 24 aa, Entamoeba invadens
NSLPKIPVECKHLRFVVEMDDFSS

SEQ ID NO: 3011220 - protein, 18 aa, Entamoeba invadens
NSLPKQFPSKKLLVELFT

SEQ ID NO: 3011221 - protein, 27 aa, Entamoeba invadens
NSLTYLKRYLELCGFKKEGLYNVGRFY

SEQ ID NO: 3011222 - protein, 23 aa, Entamoeba invadens
NSLVWHTITPYNGYRLTYLGYDY

SEQ ID NO: 3011223 - protein, 23 aa, Entamoeba invadens
NSLYQQAFMNCNFLCNIHLSDNI

SEQ ID NO: 3011224 - protein, 20 aa, Entamoeba invadens
NSMDMLTKIFRARCITFDYP

SEQ ID NO: 3011225 - protein, 25 aa, Entamoeba invadens
NSMFINKEFLFNVVFAAADAFRKQN

SEQ ID NO: 3011226 - protein, 21 aa, Entamoeba invadens
NSMFKIEGFGWFDENRKRGDL

SEQ ID NO: 3011227 - protein, 19 aa, Entamoeba invadens
NSMIQMAVLYANAFMHYGT

SEQ ID NO: 3011228 - protein, 25 aa, Entamoeba invadens
NSMNALTLISSFFEFLKKTELNNEM

SEQ ID NO: 3011229 - protein, 27 aa, Entamoeba invadens
NSMVVPYNPYLLKRFNAHINVECCSGL

SEQ ID NO: 3011230 - protein, 24 aa, Entamoeba invadens
NSNKCVRCLPTTLLGISNSETVCS

SEQ ID NO: 3011231 - protein, 40 aa, Entamoeba invadens
NSNKSLCVYSPKTKDFVLSCLGFFAIKQTGCKINSPEKIY

SEQ ID NO: 3011232 - protein, 29 aa, Entamoeba invadens
NSNLTKTMLFTLLLSVVFSFEIKMCKLQN

SEQ ID NO: 3011233 - protein, 23 aa, Entamoeba invadens
NSNMNLSFDVLKLCIENGVLIDE

SEQ ID NO: 3011234 - protein, 33 aa, Entamoeba invadens
NSNPFALNPMTPPSLIRIFQKESLERSPKKLLE

SEQ ID NO: 3011235 - protein, 25 aa, Entamoeba invadens
NSNSFYQVVVWFPVDYKTTQNLQET

SEQ ID NO: 3011236 - protein, 24 aa, Entamoeba invadens
NSNVPIIEQLIQRPQPVKKSNPEI

SEQ ID NO: 3011237 - protein, 27 aa, Entamoeba invadens
NSPDRENFVLYFYTNKKFVGGIDLPMW

SEQ ID NO: 3011238 - protein, 23 aa, Entamoeba invadens
NSPFVDRVFWKAPSQELVVYTKP

SEQ ID NO: 3011239 - protein, 20 aa, Entamoeba invadens
NSPIVLYVKVYRKGGDDISS

SEQ ID NO: 3011240 - protein, 20 aa, Entamoeba invadens
NSPIVVFVKVLRKGGDDVST

SEQ ID NO: 3011241 - protein, 21 aa, Entamoeba invadens
NSPLVLTFNILISSIPRETKI

SEQ ID NO: 3011242 - protein, 17 aa, Entamoeba invadens
NSPQLIPSITQTGIVSQ

SEQ ID NO: 3011243 - protein, 23 aa, Entamoeba invadens
NSPSIRDLILSDLKLDILSLHEF

SEQ ID NO: 3011244 - protein, 18 aa, Entamoeba invadens
NSPTMSFVVGKQAKYPKD

SEQ ID NO: 3011245 - protein, 24 aa, Entamoeba invadens
NSPTPFCVIAICLNSIFGAKENGI

SEQ ID NO: 3011246 - protein, 21 aa, Entamoeba invadens
NSPVFLQFLEVVVTLVKHRPS

SEQ ID NO: 3011247 - protein, 23 aa, Entamoeba invadens
NSQEEHVYIITSLHFSELIASKL

SEQ ID NO: 3011248 - protein, 19 aa, Entamoeba invadens
NSQFLDILGISILGQQLNF

SEQ ID NO: 3011249 - protein, 24 aa, Entamoeba invadens
NSQNKLFGRRWYSFSRLANRMQNE

SEQ ID NO: 3011250 - protein, 26 aa, Entamoeba invadens
NSQSAFLFTAFSAFWMSPDLTLNFHQ

SEQ ID NO: 3011251 - protein, 25 aa, Entamoeba invadens
NSQTGRLFLRDPNNSPTRKTEAYVK

SEQ ID NO: 3011252 - protein, 25 aa, Entamoeba invadens
NSQYKYYTYLLKRLVNIFHLCLLKK

SEQ ID NO: 3011253 - protein, 20 aa, Entamoeba invadens
NSRFFLTHKSPSTINPNLVN

SEQ ID NO: 3011254 - protein, 28 aa, Entamoeba invadens
NSRGSEMLLLLRPRVRPVRLAESALGAA

SEQ ID NO: 3011255 - protein, 19 aa, Entamoeba invadens
NSRLIIWSRNPPLSNAPGT

SEQ ID NO: 3011256 - protein, 24 aa, Entamoeba invadens
NSRNFFIKNCICTTLLIEQHIDFL

SEQ ID NO: 3011257 - protein, 26 aa, Entamoeba invadens
NSRQQRVTSWKAFLKNKGKTNGDCRG

SEQ ID NO: 3011258 - protein, 24 aa, Entamoeba invadens
NSRRRIMALLQLLSDELPNTPLFY

SEQ ID NO: 3011259 - protein, 24 aa, Entamoeba invadens
NSSGLHLKRIVIWSEQIGGVNTSE

SEQ ID NO: 3011260 - protein, 25 aa, Entamoeba invadens
NSSIKDYFHTLNFVAIKEPKKEEKV

SEQ ID NO: 3011261 - protein, 23 aa, Entamoeba invadens
NSSSCHFVMTPPFSPEKGADRVD

SEQ ID NO: 3011262 - protein, 24 aa, Entamoeba invadens
NSSSNFHIEFANWAIPMMTTDAVQ

SEQ ID NO: 3011263 - protein, 31 aa, Entamoeba invadens
NSSVFYKVEIPLLSFLEQFKILNNRDMELLK

SEQ ID NO: 3011264 - protein, 19 aa, Entamoeba invadens
NSSYFRTFKTHPFLNQIQS

SEQ ID NO: 3011265 - protein, 37 aa, Entamoeba invadens
NSSYVHPFNRTILLIKSAMIFIKTFQHQNIKGIQTIK

SEQ ID NO: 3011266 - protein, 23 aa, Entamoeba invadens
NSTEIAEFLKLPKSLERLNVVVD

SEQ ID NO: 3011267 - protein, 25 aa, Entamoeba invadens
NSTIHLVRSKVPMAAPPVAAQQVPS

SEQ ID NO: 3011268 - protein, 36 aa, Entamoeba invadens
NSTIYNEFIELFKTLPLCVLLSLSLGNFFLCHGGIS

SEQ ID NO: 3011269 - protein, 18 aa, Entamoeba invadens
NSTLIYLTLLEEDDIVVC

SEQ ID NO: 3011270 - protein, 29 aa, Entamoeba invadens
NSTLMSCLNLKCVFVDFPDLSLNDVAKKC

SEQ ID NO: 3011271 - protein, 22 aa, Entamoeba invadens
NSTNFTILYIHSCVNYLVSQCG

SEQ ID NO: 3011272 - protein, 26 aa, Entamoeba invadens
NSTNGILYFDYAFNINDFTLEEVCAA

SEQ ID NO: 3011273 - protein, 27 aa, Entamoeba invadens
NSTQQIYFYILEMPVNLMFKELGKVDV

SEQ ID NO: 3011274 - protein, 27 aa, Entamoeba invadens
NSTREGYLRCLLAMKLGVFYFQIGQDD

SEQ ID NO: 3011275 - protein, 32 aa, Entamoeba invadens
NSTVRQFFHHFLLYRFVLLRRSHMNWAKYDKV

SEQ ID NO: 3011276 - protein, 22 aa, Entamoeba invadens
NSTYCESNIIIQNCLTYGISSC

SEQ ID NO: 3011277 - protein, 26 aa, Entamoeba invadens
NSTYSFKRWFWISRNITEIINNYEDV

SEQ ID NO: 3011278 - protein, 26 aa, Entamoeba invadens
NSTYSFTRWFWISRNITEIINNYENV

SEQ ID NO: 3011279 - protein, 37 aa, Entamoeba invadens
NSVAPAMMTQALLPLLKLSLMTPYVIFVHAREGLFNV

SEQ ID NO: 3011280 - protein, 26 aa, Entamoeba invadens
NSVAQVTFSLLLELLNHTSKLSEYTT

SEQ ID NO: 3011281 - protein, 29 aa, Entamoeba invadens
NSVCMSQMKILFFIVYSFVTHTERATDVL

SEQ ID NO: 3011282 - protein, 21 aa, Entamoeba invadens
NSVEYFLIAFARAVGTVFPEV

SEQ ID NO: 3011283 - protein, 24 aa, Entamoeba invadens
NSVFGCVNAFWIDKNGCISFYPDI

SEQ ID NO: 3011284 - protein, 42 aa, Entamoeba invadens
NSVGDMVYLMDGSQVQFAYLRYEMDQTKKFLSVCWCGQGSQD

SEQ ID NO: 3011285 - protein, 20 aa, Entamoeba invadens
NSVGYPLVLPKNVTPMEICE

SEQ ID NO: 3011286 - protein, 29 aa, Entamoeba invadens
NSVIAVFSFLPPFLDIIGYKKTSEVLSKG

SEQ ID NO: 3011287 - protein, 20 aa, Entamoeba invadens
NSVLKKFPGLRVEEFLLSFA

SEQ ID NO: 3011288 - protein, 30 aa, Entamoeba invadens
NSVNIWNEKLLKEYFLFQRNQTIHNTVVFY

SEQ ID NO: 3011289 - protein, 20 aa, Entamoeba invadens
NSVPPIVPFGGIMTKDFLVT

SEQ ID NO: 3011290 - protein, 24 aa, Entamoeba invadens
NSVSLPFCKFLNKSIFIESSQNLC

SEQ ID NO: 3011291 - protein, 28 aa, Entamoeba invadens
NSVVLYNDKLYIIGFRTGNQTKSNSFVI

SEQ ID NO: 3011292 - protein, 27 aa, Entamoeba invadens
NSVVYFHNLKYDCCFLAKYGINTCIKK

SEQ ID NO: 3011293 - protein, 17 aa, Entamoeba invadens
NSWIMFSQALINNNERL

SEQ ID NO: 3011294 - protein, 32 aa, Entamoeba invadens
NSWNIPLMYNNFLHPFITLFDAGSVFFNQNET

SEQ ID NO: 3011295 - protein, 27 aa, Entamoeba invadens
NSYECFQFLNLLNSLHFKLPKITQFRA

SEQ ID NO: 3011296 - protein, 27 aa, Entamoeba invadens
NSYLEEYFSLNLFINQLLSTKVPKKED

SEQ ID NO: 3011297 - protein, 40 aa, Entamoeba invadens
NSYLFNHVFTANAHFALFLTDLMRFFRRNVVLECLDRYIS

SEQ ID NO: 3011298 - protein, 23 aa, Entamoeba invadens
NSYLLLTMKACCHCGLLCERTHG

SEQ ID NO: 3011299 - protein, 20 aa, Entamoeba invadens
NSYSPLFENDIKQKYHMLEK

SEQ ID NO: 3011300 - protein, 36 aa, Entamoeba invadens
NSYVDTILKIFPNLQTLYFSAVTRLIQKSSGSIPLI

SEQ ID NO: 3011301 - protein, 20 aa, Entamoeba invadens
NSYVLPHRLIKAAIAERARN

SEQ ID NO: 3011302 - protein, 25 aa, Entamoeba invadens
NTAARFHINPIPLTQKILKHFPRLE

SEQ ID NO: 3011303 - protein, 23 aa, Entamoeba invadens
NTAEDKWRLIPAFVKSRGLVRQH

SEQ ID NO: 3011304 - protein, 23 aa, Entamoeba invadens
NTAIERLQFSYPVTYNKFIEEKK

SEQ ID NO: 3011305 - protein, 26 aa, Entamoeba invadens
NTAMDIRVKLQPIVTCVNALPLHTDL

SEQ ID NO: 3011306 - protein, 21 aa, Entamoeba invadens
NTARLELFRADNGRVFGAFLK

SEQ ID NO: 3011307 - protein, 25 aa, Entamoeba invadens
NTCEEYINCLSLIKDKCLRCRDGFV

SEQ ID NO: 3011308 - protein, 25 aa, Entamoeba invadens
NTCKTTLFLLFALNGSSSIRNIVEQ

SEQ ID NO: 3011309 - protein, 18 aa, Entamoeba invadens
NTCLKCKNGFALNGTTCQ

SEQ ID NO: 3011310 - protein, 18 aa, Entamoeba invadens
NTCPLPEKAQLFVKFGKY

SEQ ID NO: 3011311 - protein, 26 aa, Entamoeba invadens
NTCRDMLYHIELVKVVQKLYELFSYH

SEQ ID NO: 3011312 - protein, 24 aa, Entamoeba invadens
NTDCTLFLLFPTIEVRVKDKVKLV

SEQ ID NO: 3011313 - protein, 28 aa, Entamoeba invadens
NTDFNIEGLMYMFYKPDEIINKFSDDTL

SEQ ID NO: 3011314 - protein, 24 aa, Entamoeba invadens
NTDNIQQVLTLKKENQHLSTSLEQ

SEQ ID NO: 3011315 - protein, 28 aa, Entamoeba invadens
NTDPKYDLLLYTMKAFFKMLCFGEHLLN

SEQ ID NO: 3011316 - protein, 17 aa, Entamoeba invadens
NTDQYISTLKPFVFDEC

SEQ ID NO: 3011317 - protein, 24 aa, Entamoeba invadens
NTDVKQWLLRKLNSFQAKKTDLDN

SEQ ID NO: 3011318 - protein, 22 aa, Entamoeba invadens
NTDVLIGLLSRIVKLRNKQNKP

SEQ ID NO: 3011319 - protein, 20 aa, Entamoeba invadens
NTEANLWNLPMNAWINERCG

SEQ ID NO: 3011320 - protein, 23 aa, Entamoeba invadens
NTEARLLLAKTYDQLAYQSECGS

SEQ ID NO: 3011321 - protein, 20 aa, Entamoeba invadens
NTECYSCRIGYYLQGNNTCL

SEQ ID NO: 3011322 - protein, 18 aa, Entamoeba invadens
NTEDVYYLLGKKDNTQQS

SEQ ID NO: 3011323 - protein, 31 aa, Entamoeba invadens
NTEELRMKKLEALPFFKPPTNNVFANKPTQQ

SEQ ID NO: 3011324 - protein, 20 aa, Entamoeba invadens
NTEFSILSPFINKITVFGGR

SEQ ID NO: 3011325 - protein, 27 aa, Entamoeba invadens
NTEGSPFYMQFLKLLGDVVSVKGYVGY

SEQ ID NO: 3011326 - protein, 25 aa, Entamoeba invadens
NTEKNLVFTCNGAFWITSENLVYFH

SEQ ID NO: 3011327 - protein, 25 aa, Entamoeba invadens
NTEVNLLINKWYTPLVSNYQKYIFK

SEQ ID NO: 3011328 - protein, 23 aa, Entamoeba invadens
NTEVVLLMFALDNKNSFINVSEW

SEQ ID NO: 3011329 - protein, 18 aa, Entamoeba invadens
NTEYFTVALYYFYKNVKQ

SEQ ID NO: 3011330 - protein, 22 aa, Entamoeba invadens
NTEYITELSDYSLYGCLSLSEY

SEQ ID NO: 3011331 - protein, 19 aa, Entamoeba invadens
NTFCVCLRKSDVDKGNLKC

SEQ ID NO: 3011332 - protein, 29 aa, Entamoeba invadens
NTFEKQFFSTFQFYTTPTVVLSKLVGMYF

SEQ ID NO: 3011333 - protein, 21 aa, Entamoeba invadens
NTFFHYGFTLSSPDRYHYRMT

SEQ ID NO: 3011334 - protein, 18 aa, Entamoeba invadens
NTFFKSYVLLISHRKNYV

SEQ ID NO: 3011335 - protein, 39 aa, Entamoeba invadens
NTFGRKRQFPLYRRVPYYDFRWGMTIDDFPELKEEDNKW

SEQ ID NO: 3011336 - protein, 30 aa, Entamoeba invadens
NTFKTFFFDSVIVDYKFYLQMNALGYTFHN

SEQ ID NO: 3011337 - protein, 25 aa, Entamoeba invadens
NTFPCKEIIVVKLVFKKDLGKSTVA

SEQ ID NO: 3011338 - protein, 32 aa, Entamoeba invadens
NTFQFTNGLFLPIQELFFPILVEIIVKPQSMV

SEQ ID NO: 3011339 - protein, 17 aa, Entamoeba invadens
NTFSKFIKYIVHSYPVI

SEQ ID NO: 3011340 - protein, 25 aa, Entamoeba invadens
NTGCCKVCTSRRLVFQQPGEKTADI

SEQ ID NO: 3011341 - protein, 22 aa, Entamoeba invadens
NTGILFDVFISQFLNIQTKEQK

SEQ ID NO: 3011342 - protein, 32 aa, Entamoeba invadens
NTGKQLIVLPNPSSVFGIAWDPLGIIIVAQCT

SEQ ID NO: 3011343 - protein, 17 aa, Entamoeba invadens
NTGKYLYNGKCLDCQFC

SEQ ID NO: 3011344 - protein, 18 aa, Entamoeba invadens
NTHFAFVSFPKMVDKNKI

SEQ ID NO: 3011345 - protein, 23 aa, Entamoeba invadens
NTHKELIFVGYSDSEILLKENKT

SEQ ID NO: 3011346 - protein, 26 aa, Entamoeba invadens
NTIDLFSKDKIIQLCFGCYTHKDSQP

SEQ ID NO: 3011347 - protein, 29 aa, Entamoeba invadens
NTIFKKEFFYMIVWFIVDFETVDRNKSRN

SEQ ID NO: 3011348 - protein, 30 aa, Entamoeba invadens
NTIGSDDFLGNCFWYVPQMRTSEKRKEILK

SEQ ID NO: 3011349 - protein, 20 aa, Entamoeba invadens
NTIIMLYTCGQIECIKFMNK

SEQ ID NO: 3011350 - protein, 23 aa, Entamoeba invadens
NTIKIIWLCLKNGIAARDKWVSE

SEQ ID NO: 3011351 - protein, 22 aa, Entamoeba invadens
NTILQRMMFLCKTGLTLHKSNM

SEQ ID NO: 3011352 - protein, 30 aa, Entamoeba invadens
NTILQTKILAQLYMPFFSRKIEVPEELKTQ

SEQ ID NO: 3011353 - protein, 19 aa, Entamoeba invadens
NTIPFAVCLPLMRLEGVKL

SEQ ID NO: 3011354 - protein, 19 aa, Entamoeba invadens
NTIPRPYLKKLGRNSFDVE

SEQ ID NO: 3011355 - protein, 39 aa, Entamoeba invadens
NTIRCFMELVQPFVWQHVYIPILPKKMTSYGDAPMPFII

SEQ ID NO: 3011356 - protein, 20 aa, Entamoeba invadens
NTISVIFKSATNAQDCGAKL

SEQ ID NO: 3011357 - protein, 24 aa, Entamoeba invadens
NTISYVWFTKHFTPDTINFGSRNV

SEQ ID NO: 3011358 - protein, 21 aa, Entamoeba invadens
NTKALVCDFLCKHQLNKEDQD

SEQ ID NO: 3011359 - protein, 18 aa, Entamoeba invadens
NTKATIFSLMRKNKFADA

SEQ ID NO: 3011360 - protein, 25 aa, Entamoeba invadens
NTKAVKYLLKKYTVPPPRSVRGSTP

SEQ ID NO: 3011361 - protein, 19 aa, Entamoeba invadens
NTKEKLIKKVNELIVQVDQ

SEQ ID NO: 3011362 - protein, 22 aa, Entamoeba invadens
NTKEVYIRLKSLVDRIKSECEI

SEQ ID NO: 3011363 - protein, 27 aa, Entamoeba invadens
NTKISCAVLYCWCVSILLERLNVSEKV

SEQ ID NO: 3011364 - protein, 23 aa, Entamoeba invadens
NTKIYSHLIGIIDPILEVKRLGE

SEQ ID NO: 3011365 - protein, 27 aa, Entamoeba invadens
NTKLFPYPYEFVAIITPPLNPLEFNPK

SEQ ID NO: 3011366 - protein, 24 aa, Entamoeba invadens
NTKNAFYFLFTSIFVNNLSHEQNN

SEQ ID NO: 3011367 - protein, 24 aa, Entamoeba invadens
NTKNQLGLANRFVSGPSFASYIVG

SEQ ID NO: 3011368 - protein, 25 aa, Entamoeba invadens
NTKSNYLIHLKIAFVSSSSAQSLQS

SEQ ID NO: 3011369 - protein, 17 aa, Entamoeba invadens
NTKTCEILENAFLAGNK

SEQ ID NO: 3011370 - protein, 33 aa, Entamoeba invadens
NTKTPLVLLEEYLKFILNTIGVVLPLQLYEYAD

SEQ ID NO: 3011371 - protein, 21 aa, Entamoeba invadens
NTKVFMLTPDFALLNSTPMEN

SEQ ID NO: 3011372 - protein, 18 aa, Entamoeba invadens
NTKWGIRNVDLYQKKQYN

SEQ ID NO: 3011373 - protein, 27 aa, Entamoeba invadens
NTLEKFLIGIFAQIDMPRSPEAFLEFC

SEQ ID NO: 3011374 - protein, 17 aa, Entamoeba invadens
NTLFKGYVERLKKELQL

SEQ ID NO: 3011375 - protein, 32 aa, Entamoeba invadens
NTLGNKLIVLNNIVLARTLGFPLGIQKVEIEE

SEQ ID NO: 3011376 - protein, 23 aa, Entamoeba invadens
NTLHFVLVLDHKNPHVIDLDMKA

SEQ ID NO: 3011377 - protein, 19 aa, Entamoeba invadens
NTLICKLERRYLGLSQAKK

SEQ ID NO: 3011378 - protein, 17 aa, Entamoeba invadens
NTLILRLTSTDFDGIEP

SEQ ID NO: 3011379 - protein, 20 aa, Entamoeba invadens
NTLITLKACGQIKVIKTLNE

SEQ ID NO: 3011380 - protein, 21 aa, Entamoeba invadens
NTLKTYLFMSPIREADTFLAS

SEQ ID NO: 3011381 - protein, 23 aa, Entamoeba invadens
NTLLIHLVFKISSKTQATVFCAK

SEQ ID NO: 3011382 - protein, 23 aa, Entamoeba invadens
NTLLLNVVVEYLPPTLKGHYLEL

SEQ ID NO: 3011383 - protein, 29 aa, Entamoeba invadens
NTLLVGNVNVPTPFEFLRIVEKGKKKENM

SEQ ID NO: 3011384 - protein, 24 aa, Entamoeba invadens
NTLQPYFSHLYPSIQKGLYCLMHI

SEQ ID NO: 3011385 - protein, 21 aa, Entamoeba invadens
NTLQTMWLSFIKISNVDYSKM

SEQ ID NO: 3011386 - protein, 21 aa, Entamoeba invadens
NTLRRPTLTPVITMITLQMQG

SEQ ID NO: 3011387 - protein, 21 aa, Entamoeba invadens
NTLRRQGFLPATVSPALLGER

SEQ ID NO: 3011388 - protein, 18 aa, Entamoeba invadens
NTLRWTGRYLGRGTEPCV

SEQ ID NO: 3011389 - protein, 22 aa, Entamoeba invadens
NTLSFPTVIFSKASLEGSEYSD

SEQ ID NO: 3011390 - protein, 19 aa, Entamoeba invadens
NTMCLMDKLFGLMSEISKK

SEQ ID NO: 3011391 - protein, 26 aa, Entamoeba invadens
NTMMAFSTFFSIFKTTNEKTKNCGYI

SEQ ID NO: 3011392 - protein, 25 aa, Entamoeba invadens
NTMNKQLRYIPFPETFDIPNPHERY

SEQ ID NO: 3011393 - protein, 20 aa, Entamoeba invadens
NTMNSLRKKAAFRLKVINEM

SEQ ID NO: 3011394 - protein, 24 aa, Entamoeba invadens
NTMNVLIYTLRQNALVALKAREEG

SEQ ID NO: 3011395 - protein, 24 aa, Entamoeba invadens
NTMTKQLRYIPFPDTFDIPNPHER

SEQ ID NO: 3011396 - protein, 28 aa, Entamoeba invadens
NTMVGSVFLKFTPFLKMYSDYCRVYNAV

SEQ ID NO: 3011397 - protein, 28 aa, Entamoeba invadens
NTNDILEYLTFMLKLFVSAPLTQDFLVS

SEQ ID NO: 3011398 - protein, 24 aa, Entamoeba invadens
NTNDLILMPPKSNMPLYFNSKMNV

SEQ ID NO: 3011399 - protein, 21 aa, Entamoeba invadens
NTNFRFFCSVMPLEGVSQDTA

SEQ ID NO: 3011400 - protein, 21 aa, Entamoeba invadens
NTNGFTFKDYLEKETLADLKE

SEQ ID NO: 3011401 - protein, 23 aa, Entamoeba invadens
NTNIVIPQTLFKPIDQPQYGIYQ

SEQ ID NO: 3011402 - protein, 33 aa, Entamoeba invadens
NTNKTNYFKKAFYRIVVWFGVDFETVDKNKGRN

SEQ ID NO: 3011403 - protein, 28 aa, Entamoeba invadens
NTNLHSTMFNVWFKKIIGREIDFSMEYP

SEQ ID NO: 3011404 - protein, 26 aa, Entamoeba invadens
NTNLNQILKFFPLLETIYISSIVNNV

SEQ ID NO: 3011405 - protein, 26 aa, Entamoeba invadens
NTNLREAILYHIFTFFASVNISDYAS

SEQ ID NO: 3011406 - protein, 22 aa, Entamoeba invadens
NTNNKLIYCTSATDYLSDDICN

SEQ ID NO: 3011407 - protein, 18 aa, Entamoeba invadens
NTNPKAINLLKGKTFAKT

SEQ ID NO: 3011408 - protein, 22 aa, Entamoeba invadens
NTNVKQLFETIAKELLKCNQTA

SEQ ID NO: 3011409 - protein, 17 aa, Entamoeba invadens
NTNWYEVFGRHTLLTSG

SEQ ID NO: 3011410 - protein, 19 aa, Entamoeba invadens
NTNYGVVVVLFVLRKKDNK

SEQ ID NO: 3011411 - protein, 18 aa, Entamoeba invadens
NTPDVQLLYNSIVTLFEC

SEQ ID NO: 3011412 - protein, 23 aa, Entamoeba invadens
NTPFAIPMFDMNYFNTIQPCYFN

SEQ ID NO: 3011413 - protein, 24 aa, Entamoeba invadens
NTPFAIPMFDMNYFNTIQPCYFNI

SEQ ID NO: 3011414 - protein, 23 aa, Entamoeba invadens
NTPFHFFCLNFSNPNYSAAMDLF

SEQ ID NO: 3011415 - protein, 29 aa, Entamoeba invadens
NTPFTQTRVPPPVPLKRSVIDQDIAMMDD

SEQ ID NO: 3011416 - protein, 20 aa, Entamoeba invadens
NTPIFTFSPQLFKALMNKIK

SEQ ID NO: 3011417 - protein, 18 aa, Entamoeba invadens
NTPIVGVPITPKEIQVKY

SEQ ID NO: 3011418 - protein, 26 aa, Entamoeba invadens
NTPKDALLFIYNKILIRLSRILGHYI

SEQ ID NO: 3011419 - protein, 22 aa, Entamoeba invadens
NTPKFNVTPLRFLVLDEADRIL

SEQ ID NO: 3011420 - protein, 18 aa, Entamoeba invadens
NTPLKKLMEAFCNKQGLN

SEQ ID NO: 3011421 - protein, 24 aa, Entamoeba invadens
NTPRNMMYFLTNTKITDGDVNLLS

SEQ ID NO: 3011422 - protein, 31 aa, Entamoeba invadens
NTPTKAFVATLWLKSIFELHLSYLMSVKEVH

SEQ ID NO: 3011423 - protein, 27 aa, Entamoeba invadens
NTPVESLIVLLIKQLNLRLQVIESTLP

SEQ ID NO: 3011424 - protein, 21 aa, Entamoeba invadens
NTQCFTCKTGYFLQGTNTCLQ

SEQ ID NO: 3011425 - protein, 20 aa, Entamoeba invadens
NTQMYWEYYQTILNPLVIEF

SEQ ID NO: 3011426 - protein, 24 aa, Entamoeba invadens
NTQTILYPCYTSITLPPGFSFGRY

SEQ ID NO: 3011427 - protein, 27 aa, Entamoeba invadens
NTQYIPLGYYQLCGVVIYVFHNERLKD

SEQ ID NO: 3011428 - protein, 17 aa, Entamoeba invadens
NTRFNFVASVSSVLFEC

SEQ ID NO: 3011429 - protein, 27 aa, Entamoeba invadens
NTRGLLNSFGLFDLYTKEFVRLFHGHT

SEQ ID NO: 3011430 - protein, 26 aa, Entamoeba invadens
NTRGTIVSFVSILYQMVDLKDNDRYI

SEQ ID NO: 3011431 - protein, 29 aa, Entamoeba invadens
NTRLYCFNNYFIFSIRILKFENVYILQNM

SEQ ID NO: 3011432 - protein, 20 aa, Entamoeba invadens
NTRMLFVTLQLLISKDRKDS

SEQ ID NO: 3011433 - protein, 17 aa, Entamoeba invadens
NTSLLILNYEGNKLKHI

SEQ ID NO: 3011434 - protein, 19 aa, Entamoeba invadens
NTSPLLAFLIHVLLERNTE

SEQ ID NO: 3011435 - protein, 27 aa, Entamoeba invadens
NTSSQIQFTFIPAFYIQGCGNYMKHNL

SEQ ID NO: 3011436 - protein, 24 aa, Entamoeba invadens
NTTAPPIPPIMPLRSFIVSLNIPV

SEQ ID NO: 3011437 - protein, 23 aa, Entamoeba invadens
NTTEIFFTTLWSLLDKTKKEETK

SEQ ID NO: 3011438 - protein, 24 aa, Entamoeba invadens
NTTEKLIEKLFKYQKRVLTNTKEL

SEQ ID NO: 3011439 - protein, 18 aa, Entamoeba invadens
NTTFALPMPIKIDCKFNL

SEQ ID NO: 3011440 - protein, 39 aa, Entamoeba invadens
NTTFKTCSMLDLLITPIQRLPRYELLLKDLLKHTEKSHV

SEQ ID NO: 3011441 - protein, 44 aa, Entamoeba invadens
NTTFVECNNNFLKRTYFVDKEATKLAFKEFFPIGKCVSQNCENT

SEQ ID NO: 3011442 - protein, 25 aa, Entamoeba invadens
NTTHEKAYAALKKTKGDLVNAFFEF

SEQ ID NO: 3011443 - protein, 24 aa, Entamoeba invadens
NTTKTIKLRIFKEIGGMNKDGVAL

SEQ ID NO: 3011444 - protein, 21 aa, Entamoeba invadens
NTTLKFEFWDEITFKIQVDEF

SEQ ID NO: 3011445 - protein, 27 aa, Entamoeba invadens
NTTQRLNAWYALQKLTKCYVKYLELRF

SEQ ID NO: 3011446 - protein, 43 aa, Entamoeba invadens
NTTTFKDWTDGTLLKSLLKSERPFELFNSLGICRVVEDNKLGI

SEQ ID NO: 3011447 - protein, 26 aa, Entamoeba invadens
NTTVIPNYFFKNCTALAKIVNFDKIT

SEQ ID NO: 3011448 - protein, 18 aa, Entamoeba invadens
NTTVLHHLALSKLTEAKK

SEQ ID NO: 3011449 - protein, 24 aa, Entamoeba invadens
NTTVQFLHYVFCNLEFIFNENSCD

SEQ ID NO: 3011450 - protein, 23 aa, Entamoeba invadens
NTTYPVCPSLVDKIAYLSTAIKE

SEQ ID NO: 3011451 - protein, 25 aa, Entamoeba invadens
NTVFTRVFFYYLNHYCSDFLTRTTR

SEQ ID NO: 3011452 - protein, 17 aa, Entamoeba invadens
NTVIFQKCLIGGDVVII

SEQ ID NO: 3011453 - protein, 22 aa, Entamoeba invadens
NTVKLWDVRMKKCGFTIPAHNN

SEQ ID NO: 3011454 - protein, 24 aa, Entamoeba invadens
NTVKTLKLKIFKEIGPLNKEGVDV

SEQ ID NO: 3011455 - protein, 17 aa, Entamoeba invadens
NTVRLVDHFLYHSHLCI

SEQ ID NO: 3011456 - protein, 23 aa, Entamoeba invadens
NTVRLVDHFLYHSHLCIVTELLG

SEQ ID NO: 3011457 - protein, 26 aa, Entamoeba invadens
NTVRMYLHYLMFESDTLPYQYKESGF

SEQ ID NO: 3011458 - protein, 32 aa, Entamoeba invadens
NTWEFQMLQPGKTYFYSLKTPITLKIYSINDD

SEQ ID NO: 3011459 - protein, 25 aa, Entamoeba invadens
NTWNFKTAFLYIKQKRPIVFPNPGF

SEQ ID NO: 3011460 - protein, 22 aa, Entamoeba invadens
NTWVPVMHTVLDLLYKAVENPN

SEQ ID NO: 3011461 - protein, 27 aa, Entamoeba invadens
NTYEKELTALNEQLDFKRTNAKQTKTK

SEQ ID NO: 3011462 - protein, 20 aa, Entamoeba invadens
NTYINSIYQLQKPGVLVSQN

SEQ ID NO: 3011463 - protein, 23 aa, Entamoeba invadens
NTYLDYFFRNNCVGVLMEINNDN

SEQ ID NO: 3011464 - protein, 25 aa, Entamoeba invadens
NTYMTFKAISLFRKIADTDPLYTPV

SEQ ID NO: 3011465 - protein, 18 aa, Entamoeba invadens
NTYRFIFDDCSGDYLLNS

SEQ ID NO: 3011466 - protein, 17 aa, Entamoeba invadens
NVALFLHNRHTLEFFLC

SEQ ID NO: 3011467 - protein, 25 aa, Entamoeba invadens
NVALFNIILELINVSSKQSGELYCL

SEQ ID NO: 3011468 - protein, 23 aa, Entamoeba invadens
NVALYLKKIAPPLGTLMSASKAF

SEQ ID NO: 3011469 - protein, 24 aa, Entamoeba invadens
NVALYVRDMLNERPKTPLLGETPD

SEQ ID NO: 3011470 - protein, 19 aa, Entamoeba invadens
NVAMYKTYCPEKFPPMSKI

SEQ ID NO: 3011471 - protein, 31 aa, Entamoeba invadens
NVANFFIAFCPLLKMYMDYVAKFNLKVKAKI

SEQ ID NO: 3011472 - protein, 22 aa, Entamoeba invadens
NVATFLPGGRFVAIGTLGGSIE

SEQ ID NO: 3011473 - protein, 20 aa, Entamoeba invadens
NVCDKYFDLYRLHKYSLLTN

SEQ ID NO: 3011474 - protein, 20 aa, Entamoeba invadens
NVCKPPCVPFLGSTLGDLVF

SEQ ID NO: 3011475 - protein, 24 aa, Entamoeba invadens
NVCTSCINGYYINNGVCEECWTID

SEQ ID NO: 3011476 - protein, 25 aa, Entamoeba invadens
NVCVAFWDGLVWLSKSLFNEVPDWD

SEQ ID NO: 3011477 - protein, 18 aa, Entamoeba invadens
NVDAIPSDTLFTGVAACC

SEQ ID NO: 3011478 - protein, 27 aa, Entamoeba invadens
NVDAKTYIRIALPFFNKTVSVNMSKVF

SEQ ID NO: 3011479 - protein, 23 aa, Entamoeba invadens
NVDAQFLYNCIVFLVSQNVNTTL

SEQ ID NO: 3011480 - protein, 22 aa, Entamoeba invadens
NVDEIVPIYYVPVIVSNIDNTP

SEQ ID NO: 3011481 - protein, 24 aa, Entamoeba invadens
NVDERSLLLMRRLEWISAEESNLE

SEQ ID NO: 3011482 - protein, 17 aa, Entamoeba invadens
NVDFFVAHNNGFFVVQN

SEQ ID NO: 3011483 - protein, 26 aa, Entamoeba invadens
NVDKALHIFLRKFPGNMMYGQFDNAF

SEQ ID NO: 3011484 - protein, 25 aa, Entamoeba invadens
NVDKSCTFQLMRLAKGFVDGKCSQK

SEQ ID NO: 3011485 - protein, 20 aa, Entamoeba invadens
NVDRPFVLSRSFFAGSQKFG

SEQ ID NO: 3011486 - protein, 20 aa, Entamoeba invadens
NVDWIIQYDCPEDTAQYIHR

SEQ ID NO: 3011487 - protein, 17 aa, Entamoeba invadens
NVDYMPTKPGKYNVSVC

SEQ ID NO: 3011488 - protein, 24 aa, Entamoeba invadens
NVDYRIYELLKTKYKFKGEIVLYY

SEQ ID NO: 3011489 - protein, 20 aa, Entamoeba invadens
NVECKLNVLSSQHEDMLFRI

SEQ ID NO: 3011490 - protein, 26 aa, Entamoeba invadens
NVECVECYPPYFWDSIGKTCKLCIDG

SEQ ID NO: 3011491 - protein, 33 aa, Entamoeba invadens; identical to SEQ ID NO: 2823611

SEQ ID NO: 3011492 - protein, 18 aa, Entamoeba invadens
NVELHLEWKRLACEVVNI

SEQ ID NO: 3011493 - protein, 22 aa, Entamoeba invadens
NVELKMIFHSFVNYIKDVLNHS

SEQ ID NO: 3011494 - protein, 23 aa, Entamoeba invadens
NVELKNWKLVVYAIEKHANVNVR

SEQ ID NO: 3011495 - protein, 19 aa, Entamoeba invadens
NVELPMRILGKLKKQERHD

SEQ ID NO: 3011496 - protein, 19 aa, Entamoeba invadens
NVELYVTKYYTFSSKDVAL

SEQ ID NO: 3011497 - protein, 33 aa, Entamoeba invadens
NVENIQVFGYHSFFGCTLLLDNKLVPVETIKGV

SEQ ID NO: 3011498 - protein, 26 aa, Entamoeba invadens
NVENNQLTRLPKLVSLSSLNISNNPI

SEQ ID NO: 3011499 - protein, 25 aa, Entamoeba invadens
NVEPIKNIFAIKKPKPSILQSPAVN

SEQ ID NO: 3011500 - protein, 30 aa, Entamoeba invadens
NVESTRICTKCLSGYYLQDGECLQIKNCVA

SEQ ID NO: 3011501 - protein, 26 aa, Entamoeba invadens
NVETDNFFLFSFKLTDSTPSVYSRKT

SEQ ID NO: 3011502 - protein, 29 aa, Entamoeba invadens
NVEVFVEKFKLLHWFDMDHIIYNDGSLKG

SEQ ID NO: 3011503 - protein, 30 aa, Entamoeba invadens
NVEVVALVFKKFLRNLPVRIFNREQTEMMM

SEQ ID NO: 3011504 - protein, 32 aa, Entamoeba invadens
NVFASKNSPILLPFQKMLLSGLGDVLRFACIH

SEQ ID NO: 3011505 - protein, 17 aa, Entamoeba invadens
NVFAVIYNYLIKLCSQI

SEQ ID NO: 3011506 - protein, 18 aa, Entamoeba invadens
NVFAYVIGIFPDEEHLGK

SEQ ID NO: 3011507 - protein, 29 aa, Entamoeba invadens
NVFCSYYNALLRTALLLISSMTAAPILNS

SEQ ID NO: 3011508 - protein, 25 aa, Entamoeba invadens
NVFDRRRLSLQQTSFFNLPHNESAY

SEQ ID NO: 3011509 - protein, 35 aa, Entamoeba invadens
NVFGACLLGFLKISGFLEVTKWTNNIWTLKRAQQA

SEQ ID NO: 3011510 - protein, 22 aa, Entamoeba invadens
NVFGVFVPMKIGYTNDWVIDGF

SEQ ID NO: 3011511 - protein, 20 aa, Entamoeba invadens
NVFLQFTAFSQLKCSSHYAK

SEQ ID NO: 3011512 - protein, 25 aa, Entamoeba invadens
NVFQKYEKYFLTFGARIEKWPDEAF

SEQ ID NO: 3011513 - protein, 26 aa, Entamoeba invadens
NVFSSIIVFSYKFIGYVTGTKIAFLK

SEQ ID NO: 3011514 - protein, 19 aa, Entamoeba invadens
NVFVELHTLKRIRIFVSDN

SEQ ID NO: 3011515 - protein, 22 aa, Entamoeba invadens
NVFVPKCVYTEPRVFLGCTSLV

SEQ ID NO: 3011516 - protein, 17 aa, Entamoeba invadens
NVGKTCLLVTYTTNSFP

SEQ ID NO: 3011517 - protein, 23 aa, Entamoeba invadens
NVGKTCMLMVYTSNEFPTEYVPT

SEQ ID NO: 3011518 - protein, 33 aa, Entamoeba invadens
NVGKTSLIIMLVSNHFVVIYDPGIEDIYFERFK

SEQ ID NO: 3011519 - protein, 20 aa, Entamoeba invadens
NVHFQFLRPNTEKSALTIGV

SEQ ID NO: 3011520 - protein, 23 aa, Entamoeba invadens
NVHFQKIIVWFQVTQKVVFNTLK

SEQ ID NO: 3011521 - protein, 25 aa, Entamoeba invadens
NVHIGDKVWNFMFIGMQKFCVNSCD

SEQ ID NO: 3011522 - protein, 24 aa, Entamoeba invadens
NVHYVFLSATIPNALEFAKWIAKI

SEQ ID NO: 3011523 - protein, 20 aa, Entamoeba invadens
NVIDWWGIGIMTFEMLHGQA

SEQ ID NO: 3011524 - protein, 25 aa, Entamoeba invadens
NVIEPYYLRNLIFEKNFDLYIFDCR

SEQ ID NO: 3011525 - protein, 28 aa, Entamoeba invadens
NVIIESPLIIGPYYFFSKNTYLKDYITS

SEQ ID NO: 3011526 - protein, 18 aa, Entamoeba invadens
NVIKAAIGSVLFPPKPTD

SEQ ID NO: 3011527 - protein, 24 aa, Entamoeba invadens
NVIKDVGYIIFFTGAGISAESGIN

SEQ ID NO: 3011528 - protein, 21 aa, Entamoeba invadens
NVIKVQFTILTNIDKFIFKAE

SEQ ID NO: 3011529 - protein, 18 aa, Entamoeba invadens
NVIMLKFEKIIMKNGLLV

SEQ ID NO: 3011530 - protein, 28 aa, Entamoeba invadens
NVINSQLLAYFMGRTYKFLTELGIPGEH

SEQ ID NO: 3011531 - protein, 33 aa, Entamoeba invadens
NVINTISLEHPVWKLVCLPGLIGAIGEKDVYVF

SEQ ID NO: 3011532 - protein, 19 aa, Entamoeba invadens
NVIPSCLIDLPSIDLEFGN

SEQ ID NO: 3011533 - protein, 38 aa, Entamoeba invadens
NVIQDTIHTWYQFRNWVWFRLFQKVRPTLKRRRVDEEL

SEQ ID NO: 3011534 - protein, 18 aa, Entamoeba invadens
NVISFYTLQPSEPFSDHS

SEQ ID NO: 3011535 - protein, 19 aa, Entamoeba invadens
NVITLKDTFPDQQVIKAYL

SEQ ID NO: 3011536 - protein, 20 aa, Entamoeba invadens
NVIYLGMATITFAATTPLLL

SEQ ID NO: 3011537 - protein, 21 aa, Entamoeba invadens
NVKCRSGIVQWIFSKSISSAI

SEQ ID NO: 3011538 - protein, 19 aa, Entamoeba invadens
NVKELFKNLNKKKGEKASQ

SEQ ID NO: 3011539 - protein, 34 aa, Entamoeba invadens
NVKHFYYSFSPFTKMPVIFVLLPGLSFQSFDETK

SEQ ID NO: 3011540 - protein, 23 aa, Entamoeba invadens
NVKILRFPNFLYDFSINIFDVKL

SEQ ID NO: 3011541 - protein, 27 aa, Entamoeba invadens
NVKIVVVPMYLGPLTEILLSRENDTTK

SEQ ID NO: 3011542 - protein, 18 aa, Entamoeba invadens
NVKIYSAIYTNFFDFIPI

SEQ ID NO: 3011543 - protein, 25 aa, Entamoeba invadens
NVKKFFKPEFINRLDDIVVFTPLRQ

SEQ ID NO: 3011544 - protein, 26 aa, Entamoeba invadens
NVKKFFKPEFINRLDDIVVFTPLRQE

SEQ ID NO: 3011545 - protein, 25 aa, Entamoeba invadens
NVKLYPRMFVDWVNLTSVILPNNVV

SEQ ID NO: 3011546 - protein, 24 aa, Entamoeba invadens
NVKNTVFDAKRLSFTVVNDGNDKP

SEQ ID NO: 3011547 - protein, 18 aa, Entamoeba invadens
NVKPSVTLPFVCISQIAF

SEQ ID NO: 3011548 - protein, 26 aa, Entamoeba invadens
NVKSIVFFFRQILTGLIYLHEHRIVH

SEQ ID NO: 3011549 - protein, 18 aa, Entamoeba invadens
NVKSQFQMYLGWYDNNPA

SEQ ID NO: 3011550 - protein, 25 aa, Entamoeba invadens
NVKSQYMMYLGWYDNNVAHLNELPP

SEQ ID NO: 3011551 - protein, 23 aa, Entamoeba invadens
NVKSVEVFLHKKDVVLNTGIVKA

SEQ ID NO: 3011552 - protein, 31 aa, Entamoeba invadens
NVKVYKLPEMQFYLSLYGHNLPVTSISISDD

SEQ ID NO: 3011553 - protein, 43 aa, Entamoeba invadens
NVKYGYSYIFPLIPIFLMNANTYDIFRIRYKKIWSFIQENFTV

SEQ ID NO: 3011554 - protein, 28 aa, Entamoeba invadens
NVLAITENIFYFPNLISSLLQEFITSKS

SEQ ID NO: 3011555 - protein, 17 aa, Entamoeba invadens
NVLAKSAFLCEIIDCDC

SEQ ID NO: 3011556 - protein, 17 aa, Entamoeba invadens
NVLFSFLKTHTNSKIIV

SEQ ID NO: 3011557 - protein, 24 aa, Entamoeba invadens
NVLGKGEWYLLSNGWFDTTEANAR

SEQ ID NO: 3011558 - protein, 19 aa, Entamoeba invadens
NVLILPQLALVVPKGIITI

SEQ ID NO: 3011559 - protein, 17 aa, Entamoeba invadens
NVLISIYTIARNYMITH

SEQ ID NO: 3011560 - protein, 20 aa, Entamoeba invadens
NVLKTVKWFHDYIAGYFTQE

SEQ ID NO: 3011561 - protein, 19 aa, Entamoeba invadens
NVLLRNQASQLFKKAKHIV

SEQ ID NO: 3011562 - protein, 18 aa, Entamoeba invadens
NVLLWVTSICKSMDQSNA

SEQ ID NO: 3011563 - protein, 26 aa, Entamoeba invadens
NVLNDAILWESQLPFQVTTMSLSTDE

SEQ ID NO: 3011564 - protein, 30 aa, Entamoeba invadens
NVLNIETRKLLFNYVALGVKLMNTQNTNKN

SEQ ID NO: 3011565 - protein, 18 aa, Entamoeba invadens
NVLRLRMYKMCDSLVQSL

SEQ ID NO: 3011566 - protein, 24 aa, Entamoeba invadens
NVLRNGVCVYFSKIQNCISSQFSI

SEQ ID NO: 3011567 - protein, 18 aa, Entamoeba invadens
NVLRYPRPVSATSEILFQ

SEQ ID NO: 3011568 - protein, 26 aa, Entamoeba invadens
NVLSGPIEALVRWLVNPNIDNNIKFI

SEQ ID NO: 3011569 - protein, 17 aa, Entamoeba invadens
NVLSLWTNYMNFEIIYN

SEQ ID NO: 3011570 - protein, 17 aa, Entamoeba invadens
NVLSVFIKKVRVLKMEK

SEQ ID NO: 3011571 - protein, 21 aa, Entamoeba invadens
NVLVDHIKIDAVAVAINRGEG

SEQ ID NO: 3011572 - protein, 19 aa, Entamoeba invadens
NVLVFDFGGGTLDVTLLRG

SEQ ID NO: 3011573 - protein, 23 aa, Entamoeba invadens
NVLYGIFQVFKKMYSVTFKQKEV

SEQ ID NO: 3011574 - protein, 20 aa, Entamoeba invadens
NVLYNVGVAHMILARQNFRT

SEQ ID NO: 3011575 - protein, 19 aa, Entamoeba invadens
NVMGEMKSIFMGALPNNEQ

SEQ ID NO: 3011576 - protein, 22 aa, Entamoeba invadens
NVMIDTKMKLLSIVRGLAEQYP

SEQ ID NO: 3011577 - protein, 22 aa, Entamoeba invadens
NVMLKILLCQQFVRIFNRKHEE

SEQ ID NO: 3011578 - protein, 28 aa, Entamoeba invadens
NVMVPIIRVCINHIMNLFGSFKECCFKL

SEQ ID NO: 3011579 - protein, 26 aa, Entamoeba invadens
NVNCKLFVACMFFTQIVLSKVKIIDD

SEQ ID NO: 3011580 - protein, 27 aa, Entamoeba invadens
NVNGAPPAFLALLKHPNKSKYDLSTLR

SEQ ID NO: 3011581 - protein, 25 aa, Entamoeba invadens
NVNKTPIKFITKTLSNIYLTLTSEG

SEQ ID NO: 3011582 - protein, 28 aa, Entamoeba invadens
NVNLEPYLHQLFPVILTLVVTKQIGTGA

SEQ ID NO: 3011583 - protein, 17 aa, Entamoeba invadens
NVNSRLIIWSRNPPLSN

SEQ ID NO: 3011584 - protein, 29 aa, Entamoeba invadens
NVNTYVGFFYRVTFYGNAFEALFITFDDD

SEQ ID NO: 3011585 - protein, 19 aa, Entamoeba invadens
NVNVCPFGADFNCGIYTKY

SEQ ID NO: 3011586 - protein, 27 aa, Entamoeba invadens
NVNVVDSGLWTPLLIAVAGAPSNTELD

SEQ ID NO: 3011587 - protein, 32 aa, Entamoeba invadens
NVNVYEPFTIEIYASLLFNVKKDFVVTLTGMK

SEQ ID NO: 3011588 - protein, 19 aa, Entamoeba invadens
NVPANYADNLFPPAQVSTA

SEQ ID NO: 3011589 - protein, 28 aa, Entamoeba invadens
NVPELFGVVIPLYPILHDVTIRMVNNKE

SEQ ID NO: 3011590 - protein, 17 aa, Entamoeba invadens
NVPFALCKDCSALTKVV

SEQ ID NO: 3011591 - protein, 19 aa, Entamoeba invadens
NVPGMYIAVQAVLAIVASW

SEQ ID NO: 3011592 - protein, 21 aa, Entamoeba invadens
NVPGYSKPIVFGNLTEFCYPL

SEQ ID NO: 3011593 - protein, 17 aa, Entamoeba invadens
NVPIQPDIFLALQNNWN

SEQ ID NO: 3011594 - protein, 18 aa, Entamoeba invadens
NVPKSIFEILNTPPLYDA

SEQ ID NO: 3011595 - protein, 23 aa, Entamoeba invadens
NVPLPHAFLISHRPEFIDFYLDE

SEQ ID NO: 3011596 - protein, 18 aa, Entamoeba invadens
NVPLQIVALINKCWAQDP

SEQ ID NO: 3011597 - protein, 30 aa, Entamoeba invadens
NVPMWKRGTFTLPFSYLNFPQKRVVQKTSP

SEQ ID NO: 3011598 - protein, 25 aa, Entamoeba invadens
NVPRSFLLNCINLKTIKFVNSVYTE

SEQ ID NO: 3011599 - protein, 17 aa, Entamoeba invadens
NVPSFKVFVFYSQDMNA

SEQ ID NO: 3011600 - protein, 24 aa, Entamoeba invadens
NVPVNIWGLDYNTSDADIKALCAK

SEQ ID NO: 3011601 - protein, 25 aa, Entamoeba invadens
NVQEYELLPFKKLSEKCPIYMCMGN

SEQ ID NO: 3011602 - protein, 26 aa, Entamoeba invadens
NVQKIQLFIISALKPFCEKTIFTGSP

SEQ ID NO: 3011603 - protein, 23 aa, Entamoeba invadens
NVQLKTFCTVFAQYVKLRAKGKN

SEQ ID NO: 3011604 - protein, 20 aa, Entamoeba invadens
NVQLLNVPLVPPLASIYLSK

SEQ ID NO: 3011605 - protein, 23 aa, Entamoeba invadens
NVQSCFLNVFYLDTVSLQVVSYA

SEQ ID NO: 3011606 - protein, 18 aa, Entamoeba invadens
NVQYRMHPAISSFPSKNF

SEQ ID NO: 3011607 - protein, 31 aa, Entamoeba invadens
NVREPKYREIFLLMFRLYTSPEVVMTHLIPH

SEQ ID NO: 3011608 - protein, 25 aa, Entamoeba invadens
NVRGKDIPYAPLAYAYGVITQSKSY

SEQ ID NO: 3011609 - protein, 25 aa, Entamoeba invadens
NVRIIAKYYHNITLSRFAELLGVTI

SEQ ID NO: 3011610 - protein, 20 aa, Entamoeba invadens
NVRLKLIQLLPTASQKALEE

SEQ ID NO: 3011611 - protein, 27 aa, Entamoeba invadens
NVRLNINKLRLLLLTEEYMSLSKFLFH

SEQ ID NO: 3011612 - protein, 18 aa, Entamoeba invadens
NVRPVLLVALGDKLLASN

SEQ ID NO: 3011613 - protein, 18 aa, Entamoeba invadens
NVRRVIVFHPNKRVRKFI

SEQ ID NO: 3011614 - protein, 27 aa, Entamoeba invadens
NVRSIGYQLLLGLKYLETLNIVHRDIK

SEQ ID NO: 3011615 - protein, 21 aa, Entamoeba invadens
NVRYKLLVYSSWKKHSGLQKD

SEQ ID NO: 3011616 - protein, 20 aa, Entamoeba invadens
NVSCMLLDMALTMACVHCKC

SEQ ID NO: 3011617 - protein, 31 aa, Entamoeba invadens
NVSGLTEYMSRLLRACGYIYTTSAQMELVRA

SEQ ID NO: 3011618 - protein, 17 aa, Entamoeba invadens
NVSGMPIALYYSFLVFG

SEQ ID NO: 3011619 - protein, 25 aa, Entamoeba invadens
NVSIPLKKVFLIPQTHDGAIICYMS

SEQ ID NO: 3011620 - protein, 27 aa, Entamoeba invadens
NVSKKLFYRIIVWFGVDFETVDKNKTQ

SEQ ID NO: 3011621 - protein, 25 aa, Entamoeba invadens
NVSTQFRQMFLNALSLYYDQEINTV

SEQ ID NO: 3011622 - protein, 24 aa, Entamoeba invadens
NVTATYINLLGFETPEMYKPSLIK

SEQ ID NO: 3011623 - protein, 22 aa, Entamoeba invadens
NVTGYYILEKKFFVAMRRLLKV

SEQ ID NO: 3011624 - protein, 22 aa, Entamoeba invadens
NVTIFTAYLKTLSLSLRSTIVN

SEQ ID NO: 3011625 - protein, 19 aa, Entamoeba invadens
NVTMYQNGFVVNDGPLREY

SEQ ID NO: 3011626 - protein, 17 aa, Entamoeba invadens
NVTPFLLLQMKNNNDYK

SEQ ID NO: 3011627 - protein, 20 aa, Entamoeba invadens
NVTTISDAFFYLSNFEEIDL

SEQ ID NO: 3011628 - protein, 27 aa, Entamoeba invadens
NVTVVPGHYLYCGMLIYLLQQNQSGFF

SEQ ID NO: 3011629 - protein, 19 aa, Entamoeba invadens
NVVALFFGDALPKPPAAGP

SEQ ID NO: 3011630 - protein, 28 aa, Entamoeba invadens
NVVATIIQKWIFWQLKSWDKTTESLNEG

SEQ ID NO: 3011631 - protein, 18 aa, Entamoeba invadens
NVVCLGRKVLTVNQVFEI

SEQ ID NO: 3011632 - protein, 21 aa, Entamoeba invadens
NVVEFWKYWMDSTPQPDALEP

SEQ ID NO: 3011633 - protein, 19 aa, Entamoeba invadens
NVVELFLDLPKESQKHIAE

SEQ ID NO: 3011634 - protein, 23 aa, Entamoeba invadens
NVVIPHFINVVIGNRCMFGYETL

SEQ ID NO: 3011635 - protein, 19 aa, Entamoeba invadens
NVVKHCYGYFLLVDTAKFN

SEQ ID NO: 3011636 - protein, 20 aa, Entamoeba invadens
NVVLIRVRLMIDKTGQIPLE

SEQ ID NO: 3011637 - protein, 17 aa, Entamoeba invadens
NVVLLLSNVIRIFVNNL

SEQ ID NO: 3011638 - protein, 19 aa, Entamoeba invadens
NVVLRWSDLAKPKEWLRCC

SEQ ID NO: 3011639 - protein, 17 aa, Entamoeba invadens
NVVLTIAADDLAPPPLD

SEQ ID NO: 3011640 - protein, 17 aa, Entamoeba invadens
NVVNIPSKFFSGCSSLS

SEQ ID NO: 3011641 - protein, 20 aa, Entamoeba invadens
NVVNMLIEILPYLNGAQRKV

SEQ ID NO: 3011642 - protein, 27 aa, Entamoeba invadens
NVVRRKTIHLVVFETLKKLIKEHEEIV

SEQ ID NO: 3011643 - protein, 34 aa, Entamoeba invadens
NVVTYIECYLINEMLWLVMEYMDGGCLTDIIDHH

SEQ ID NO: 3011644 - protein, 20 aa, Entamoeba invadens
NVWRMACYVLLIEKDEKLRA

SEQ ID NO: 3011645 - protein, 21 aa, Entamoeba invadens
NVYLRSSIMSGLLNDEVYNAN

SEQ ID NO: 3011646 - protein, 18 aa, Entamoeba invadens
NVYPALPFEYISVDDYFN

SEQ ID NO: 3011647 - protein, 23 aa, Entamoeba invadens
NVYRAVRTLYLPNYIDGISCCGF

SEQ ID NO: 3011648 - protein, 20 aa, Entamoeba invadens
NWDKMLLFDIGSQYSDGCTT

SEQ ID NO: 3011649 - protein, 19 aa, Entamoeba invadens
NWIFKYTIPHPQELKWFYS

SEQ ID NO: 3011650 - protein, 17 aa, Entamoeba invadens
NWKRRYAVLAKNVIALF

SEQ ID NO: 3011651 - protein, 21 aa, Entamoeba invadens
NWLSYGDRYIGGDYLKSLIVT

SEQ ID NO: 3011652 - protein, 17 aa, Entamoeba invadens
NWNIPKFQLKPQDLFNV

SEQ ID NO: 3011653 - protein, 26 aa, Entamoeba invadens
NWNTVHPLFQFKSLPVQVVLRLQTKH

SEQ ID NO: 3011654 - protein, 27 aa, Entamoeba invadens
NWQTFMFEYFMLWFCRKFPVELEVRVL

SEQ ID NO: 3011655 - protein, 21 aa, Entamoeba invadens
NWRFVEWLLEHGADATKRDLT

SEQ ID NO: 3011656 - protein, 25 aa, Entamoeba invadens
NWRRKEGDVFIPKHAESGNYEPREG

SEQ ID NO: 3011657 - protein, 25 aa, Entamoeba invadens
NWSAVFDVSFILLAIQTLLNQPNPD

SEQ ID NO: 3011658 - protein, 18 aa, Entamoeba invadens
NWSKTVSVHPLFTQSRPD

SEQ ID NO: 3011659 - protein, 17 aa, Entamoeba invadens
NWTRLRVKEILYDSYKE

SEQ ID NO: 3011660 - protein, 18 aa, Entamoeba invadens
NWVFCDGLTKSDVETPYV

SEQ ID NO: 3011661 - protein, 18 aa, Entamoeba invadens
NWVKSLGKVKEEIKREHV

SEQ ID NO: 3011662 - protein, 27 aa, Entamoeba invadens
NWYEGINLDLLYESPMLLFTPDKNNLA

SEQ ID NO: 3011663 - protein, 26 aa, Entamoeba invadens
NYACQFTFKHVYFDLGMNPSLEVVKR

SEQ ID NO: 3011664 - protein, 28 aa, Entamoeba invadens
NYACQFTFKHVYLDLGMNPTLVVVERKK

SEQ ID NO: 3011665 - protein, 19 aa, Entamoeba invadens
NYALQFLPESLRSLDASHS

SEQ ID NO: 3011666 - protein, 36 aa, Entamoeba invadens
NYAPPEILLKMSQYTHLCDIFSFGVTLFVSMCGYYP

SEQ ID NO: 3011667 - protein, 22 aa, Entamoeba invadens
NYCFAWCSYLTSVTLPDKVTSL

SEQ ID NO: 3011668 - protein, 31 aa, Entamoeba invadens
NYDFDFTLNIMTWFKFLWISTDKMDISSNSF

SEQ ID NO: 3011669 - protein, 24 aa, Entamoeba invadens
NYDFEGFGLPKEDQSGFGILRLVV

SEQ ID NO: 3011670 - protein, 23 aa, Entamoeba invadens
NYDFKNVIFTYNDKKKYGDMYIK

SEQ ID NO: 3011671 - protein, 23 aa, Entamoeba invadens
NYDIDQLLMYFGTEKWEAAAHAQ

SEQ ID NO: 3011672 - protein, 18 aa, Entamoeba invadens
NYDKFSAWELPISFFNIK

SEQ ID NO: 3011673 - protein, 30 aa, Entamoeba invadens
NYDKQSGFLKFPLIVLYPQDDQSDCLRDCS

SEQ ID NO: 3011674 - protein, 28 aa, Entamoeba invadens
NYDLPEFLEFIPNLLNAIALFSLKSRYE

SEQ ID NO: 3011675 - protein, 18 aa, Entamoeba invadens
NYDQNAFIFSMRIGGVET

SEQ ID NO: 3011676 - protein, 24 aa, Entamoeba invadens
NYDVDHYLFVLFRDGRNTEQKMFR

SEQ ID NO: 3011677 - protein, 17 aa, Entamoeba invadens
NYDVIEKLWTYAIETEI

SEQ ID NO: 3011678 - protein, 26 aa, Entamoeba invadens
NYEGDVMLSFIYTSAFFMSQEFTQLR

SEQ ID NO: 3011679 - protein, 20 aa, Entamoeba invadens
NYEIFMFYYNENKTNFREFL

SEQ ID NO: 3011680 - protein, 19 aa, Entamoeba invadens
NYEIQLGCRLAKKAKIVKF

SEQ ID NO: 3011681 - protein, 24 aa, Entamoeba invadens
NYEKALYSAFLKTDQEVLKRSEAE

SEQ ID NO: 3011682 - protein, 31 aa, Entamoeba invadens
NYEKLYDLINLLIFNFQLKQLKYRGVGDSGK

SEQ ID NO: 3011683 - protein, 25 aa, Entamoeba invadens
NYESIQQAFLLALLNDTFGFEIEMP

SEQ ID NO: 3011684 - protein, 24 aa, Entamoeba invadens
NYFDVMRKYLTFEKLKKAIPTQPL

SEQ ID NO: 3011685 - protein, 27 aa, Entamoeba invadens
NYFDYHRVLFLCPVSYTFYIQNSENQH

SEQ ID NO: 3011686 - protein, 18 aa, Entamoeba invadens
NYFGLCAIVFAFHKIGDF

SEQ ID NO: 3011687 - protein, 24 aa, Entamoeba invadens
NYFMKFKCYSPFIDLYKRLMSDFV

SEQ ID NO: 3011688 - protein, 24 aa, Entamoeba invadens
NYFNLDFGTIYDIIKKMCYVTQDV

SEQ ID NO: 3011689 - protein, 23 aa, Entamoeba invadens
NYFPVNSISFFNKDVFLTAGSDG

SEQ ID NO: 3011690 - protein, 26 aa, Entamoeba invadens
NYFSDVLMKTLFLSRSILSMTDGVAY

SEQ ID NO: 3011691 - protein, 26 aa, Entamoeba invadens
NYGFKTECIWKYSLDIYNKCITLFDS

SEQ ID NO: 3011692 - protein, 22 aa, Entamoeba invadens
NYGKKWVDNTIYNTLDKATTAM

SEQ ID NO: 3011693 - protein, 22 aa, Entamoeba invadens
NYGNKMITLLLPFISQKVSSPN

SEQ ID NO: 3011694 - protein, 24 aa, Entamoeba invadens
NYGSRVFNSFYFDTFKVPIHITNL

SEQ ID NO: 3011695 - protein, 19 aa, Entamoeba invadens
NYHAICGIVFSFVRINDIE

SEQ ID NO: 3011696 - protein, 27 aa, Entamoeba invadens
NYHNGPEWVWPYGYYVMAMLMYNPDNL

SEQ ID NO: 3011697 - protein, 32 aa, Entamoeba invadens
NYHNGPEWVWPYGYYVMAMLMYNPDNLGKEEL

SEQ ID NO: 3011698 - protein, 18 aa, Entamoeba invadens
NYIAIHNAYFKKEGDIFR

SEQ ID NO: 3011699 - protein, 28 aa, Entamoeba invadens
NYIASDVDKFALLLPVGGRLVPFHVNYI

SEQ ID NO: 3011700 - protein, 31 aa, Entamoeba invadens
NYIELGYYQLCGVLIYIFHKKALTHVIQNVG

SEQ ID NO: 3011701 - protein, 19 aa, Entamoeba invadens
NYIFAVTSAFGFWKTQLFD

SEQ ID NO: 3011702 - protein, 18 aa, Entamoeba invadens
NYIKELLMQNLTFSESPN

SEQ ID NO: 3011703 - protein, 20 aa, Entamoeba invadens
NYILTIVMKLSPEQQLFFIE

SEQ ID NO: 3011704 - protein, 24 aa, Entamoeba invadens
NYIRSFLRDISLGLRYLHFVKGLV

SEQ ID NO: 3011705 - protein, 30 aa, Entamoeba invadens
NYISTLKNDDLIWITLDESYLGCERIIRRR

SEQ ID NO: 3011706 - protein, 31 aa, Entamoeba invadens
NYISYSFPVPKFMIFEREKLSNYIDLLISIT

SEQ ID NO: 3011707 - protein, 18 aa, Entamoeba invadens
NYIVYQEGIFLSLLNKHC

SEQ ID NO: 3011708 - protein, 18 aa, Entamoeba invadens
NYIYHTYPQVFFNSLDHC

SEQ ID NO: 3011709 - protein, 18 aa, Entamoeba invadens
NYKELYIPSLLIASHFDS

SEQ ID NO: 3011710 - protein, 17 aa, Entamoeba invadens
NYKETINFPLCVSPTLA

SEQ ID NO: 3011711 - protein, 28 aa, Entamoeba invadens
NYKNEILETFPSYYYRDVYYGKNDCNIT

SEQ ID NO: 3011712 - protein, 17 aa, Entamoeba invadens
NYKNFFSFFAPPQQREN

SEQ ID NO: 3011713 - protein, 20 aa, Entamoeba invadens
NYKVAIENIVFKYAKIMTEL

SEQ ID NO: 3011714 - protein, 18 aa, Entamoeba invadens
NYKYSVIAILSFDEYIVG

SEQ ID NO: 3011715 - protein, 19 aa, Entamoeba invadens
NYLCAYYPVPFKSSRCTFA

SEQ ID NO: 3011716 - protein, 18 aa, Entamoeba invadens
NYLITFDERFLYTNPQAL

SEQ ID NO: 3011717 - protein, 20 aa, Entamoeba invadens
NYLIVAKFFESIQDFVNLES

SEQ ID NO: 3011718 - protein, 17 aa, Entamoeba invadens
NYLKVRNVWRMACYVLL

SEQ ID NO: 3011719 - protein, 21 aa, Entamoeba invadens
NYLPIDVIYDNIKLIRNLNLT

SEQ ID NO: 3011720 - protein, 18 aa, Entamoeba invadens
NYLVTLQSVLIGLLNKHF

SEQ ID NO: 3011721 - protein, 34 aa, Entamoeba invadens
NYMIKNHLIIIFYNLDHHLNLLKILKLNQDLNSV

SEQ ID NO: 3011722 - protein, 24 aa, Entamoeba invadens
NYMKKFLCNPIPLTYKTIEYFPNI

SEQ ID NO: 3011723 - protein, 17 aa, Entamoeba invadens
NYMPWLEHNFPCDCIIF

SEQ ID NO: 3011724 - protein, 30 aa, Entamoeba invadens
NYNAFLLTTNFLISFLKLHVFQILKSTFTC

SEQ ID NO: 3011725 - protein, 23 aa, Entamoeba invadens
NYNETWAFLAEKAYSILYGGYKN

SEQ ID NO: 3011726 - protein, 35 aa, Entamoeba invadens
NYNGKAFGIPLTISFTFEYPISAPEILCDIKEGME

SEQ ID NO: 3011727 - protein, 34 aa, Entamoeba invadens
NYNIPMMVMFPYDYPIKPPFFLTDPSPEMMIVPQ

SEQ ID NO: 3011728 - protein, 27 aa, Entamoeba invadens
NYNNNLILKLQGIINSLKPLLDKTLQN

SEQ ID NO: 3011729 - protein, 33 aa, Entamoeba invadens
NYNNNLILKLQTIVKTLQSLQLDFAQNSFVIES

SEQ ID NO: 3011730 - protein, 20 aa, Entamoeba invadens
NYNNYETIRFLLSNVRYYAE

SEQ ID NO: 3011731 - protein, 30 aa, Entamoeba invadens
NYNRVRIFFKFILSVLKLKSFPSLFAVFEL

SEQ ID NO: 3011732 - protein, 25 aa, Entamoeba invadens
NYNSGYIEDLPPKRLITTNTDFGDD

SEQ ID NO: 3011733 - protein, 17 aa, Entamoeba invadens
NYPAWGYGIRYQYGMFK

SEQ ID NO: 3011734 - protein, 22 aa, Entamoeba invadens
NYPQTKFMRLPNPPFYAKKYDF

SEQ ID NO: 3011735 - protein, 29 aa, Entamoeba invadens
NYQASQQAIFIALLSLTNNVSIGKPLKKS

SEQ ID NO: 3011736 - protein, 17 aa, Entamoeba invadens
NYQIEIPSTLKYLSVVE

SEQ ID NO: 3011737 - protein, 29 aa, Entamoeba invadens
NYQLRMDSLGHVLFYPQKPLVSTKGADYA

SEQ ID NO: 3011738 - protein, 19 aa, Entamoeba invadens
NYQNSLDSWTYLRDEMSVD

SEQ ID NO: 3011739 - protein, 30 aa, Entamoeba invadens
NYQSQQEGVFLYLLSQLFTFEVHTPNKRCM

SEQ ID NO: 3011740 - protein, 28 aa, Entamoeba invadens
NYQVFEQGMLLLLLNNVFTLKFRHHLKK

SEQ ID NO: 3011741 - protein, 18 aa, Entamoeba invadens
NYREGLFDLFKVFPSSER

SEQ ID NO: 3011742 - protein, 17 aa, Entamoeba invadens
NYREILLTNLKKMQDDF

SEQ ID NO: 3011743 - protein, 27 aa, Entamoeba invadens
NYRFTITLNLLVDLLSEFRYVLNTKPP

SEQ ID NO: 3011744 - protein, 17 aa, Entamoeba invadens
NYRLINKRALEAIRCLK

SEQ ID NO: 3011745 - protein, 25 aa, Entamoeba invadens
NYRQLKFQLAISFSLANGARRTRVI

SEQ ID NO: 3011746 - protein, 20 aa, Entamoeba invadens
NYRQVLMTPYEAFLAFGNPC

SEQ ID NO: 3011747 - protein, 19 aa, Entamoeba invadens
NYRTVFKRVLDGEILKLDL

SEQ ID NO: 3011748 - protein, 28 aa, Entamoeba invadens
NYRVYEQGVLLAILNRHFSITLVSPKKR

SEQ ID NO: 3011749 - protein, 25 aa, Entamoeba invadens
NYSAPQINLKYPRNVFWQQKSFARE

SEQ ID NO: 3011750 - protein, 21 aa, Entamoeba invadens
NYSEIFAFSLRTMQLTSQPIV

SEQ ID NO: 3011751 - protein, 28 aa, Entamoeba invadens
NYSEPVDWWGFGVLIFEMIHGHAPYVSP

SEQ ID NO: 3011752 - protein, 19 aa, Entamoeba invadens
NYSIIERMNFLVDTVREMG

SEQ ID NO: 3011753 - protein, 26 aa, Entamoeba invadens
NYSLDKLIVIYKTAYSYSLRSFYEMF

SEQ ID NO: 3011754 - protein, 20 aa, Entamoeba invadens
NYSLLLQTLSIQNGVSALRI

SEQ ID NO: 3011755 - protein, 21 aa, Entamoeba invadens
NYTINTLSKENLKMLNKITYE

SEQ ID NO: 3011756 - protein, 32 aa, Entamoeba invadens
NYTKIIIEVIYQLLDIYISKLGKSALFDDMFF

SEQ ID NO: 3011757 - protein, 22 aa, Entamoeba invadens
NYTVCEVSRFKNDFNFVCCGKF

SEQ ID NO: 3011758 - protein, 26 aa, Entamoeba invadens
NYVHLPLECFQYFKALKTVNVWSHKE

SEQ ID NO: 3011759 - protein, 37 aa, Entamoeba invadens
NYVIYRNLYSIAPTPKIPILPLWMGDIIHAQTLFSSS

SEQ ID NO: 3011760 - protein, 25 aa, Entamoeba invadens
NYVNFDLLALLITPVQRLPRYKLLL

SEQ ID NO: 3011761 - protein, 20 aa, Entamoeba invadens
NYVTKWDITFIPSAISNTFS

SEQ ID NO: 3011762 - protein, 19 aa, Entamoeba invadens
NYVWKYKGGHSILVNQLCS

SEQ ID NO: 3011763 - protein, 21 aa, Entamoeba invadens
NYYAFVQYNLHLQLKEASEYA

SEQ ID NO: 3011764 - protein, 17 aa, Entamoeba invadens
NYYIKTSGNYKCQSCSS

SEQ ID NO: 3011765 - protein, 22 aa, Entamoeba invadens
NYYIYKVIKNKYTFKGDVVLYY

SEQ ID NO: 3011766 - protein, 27 aa, Entamoeba invadens
NYYRGSDVVFLVFDLTNQSSLQSLPKW

SEQ ID NO: 3011767 - protein, 19 aa, Entamoeba invadens
PAALSFDSLPFLDSLKRIS

SEQ ID NO: 3011768 - protein, 30 aa, Entamoeba invadens
PAAPGLPIIIRCYPGFQAAIVYRVAHVIYT

SEQ ID NO: 3011769 - protein, 22 aa, Entamoeba invadens
PAAWTIFMDVFDYFSVSAVIDN

SEQ ID NO: 3011770 - protein, 20 aa, Entamoeba invadens
PACLFYLDKLQNPDFRKACE

SEQ ID NO: 3011771 - protein, 19 aa, Entamoeba invadens
PADLFSFAITMLECLLWDN

SEQ ID NO: 3011772 - protein, 18 aa, Entamoeba invadens
PAECQVDYFALDKNIPRE

SEQ ID NO: 3011773 - protein, 17 aa, Entamoeba invadens
PAEIFGTRPIIVREGSV

SEQ ID NO: 3011774 - protein, 41 aa, Entamoeba invadens
PAELMPPPADLLPPPGMAPPANLPPPPQFNASGAPKLNIPT

SEQ ID NO: 3011775 - protein, 20 aa, Entamoeba invadens
PAELQFLCEDSQNLFLELLK

SEQ ID NO: 3011776 - protein, 31 aa, Entamoeba invadens
PAFCCPYDGCPMAFEYPSFLYKHCAAQHQKS

SEQ ID NO: 3011777 - protein, 25 aa, Entamoeba invadens
PAFNELYDLQWFLKNFTVDTVDLNY

SEQ ID NO: 3011778 - protein, 17 aa, Entamoeba invadens
PAFQSRPPTPFNLIALG

SEQ ID NO: 3011779 - protein, 26 aa, Entamoeba invadens
PAFVMPSYRITIINLLTQLKYSSDLK

SEQ ID NO: 3011780 - protein, 24 aa, Entamoeba invadens
PAFVPVPDLPFTFETPNPLRNRAM

SEQ ID NO: 3011781 - protein, 22 aa, Entamoeba invadens
PAFVTVPIKESKFKGLSPLFTG

SEQ ID NO: 3011782 - protein, 19 aa, Entamoeba invadens
PAGLAPPPNIPPPPQSNKQ

SEQ ID NO: 3011783 - protein, 19 aa, Entamoeba invadens
PAHIKSIMLGCSLNIPIQN

SEQ ID NO: 3011784 - protein, 17 aa, Entamoeba invadens
PAIGEEIAFLKDKKRES

SEQ ID NO: 3011785 - protein, 24 aa, Entamoeba invadens
PAILVTRMIGLCFPFVTDLSPVVR

SEQ ID NO: 3011786 - protein, 25 aa, Entamoeba invadens
PAIRVCVERIYPTRYKFSDTKLMSE

SEQ ID NO: 3011787 - protein, 34 aa, Entamoeba invadens
PAKFSKIFRDYFAEAILPLIKLSFTSVIFDKYKN

SEQ ID NO: 3011788 - protein, 32 aa, Entamoeba invadens
PAKQLIIDCAQWFEFMEISPISKFADLWSSLK

SEQ ID NO: 3011789 - protein, 23 aa, Entamoeba invadens
PALELLDFRFPDEKVRLFALKCI

SEQ ID NO: 3011790 - protein, 30 aa, Entamoeba invadens
PALFVQNIIPFLKKSLITPFLIFQNGERGI

SEQ ID NO: 3011791 - protein, 21 aa, Entamoeba invadens
PALLRSGRFDRKIEFPTPNEE

SEQ ID NO: 3011792 - protein, 23 aa, Entamoeba invadens
PALNTIFEILTALTARVEKLESG

SEQ ID NO: 3011793 - protein, 20 aa, Entamoeba invadens
PALQMTPIGKNNPFLILTCD

SEQ ID NO: 3011794 - protein, 17 aa, Entamoeba invadens
PALRMFGNYPSSPYSQQ

SEQ ID NO: 3011795 - protein, 25 aa, Entamoeba invadens
PAMLACFPLQDILSLRLKYIEGRDP

SEQ ID NO: 3011796 - protein, 26 aa, Entamoeba invadens
PANACRFVIDLFLEYNALSKALVLDK

SEQ ID NO: 3011797 - protein, 19 aa, Entamoeba invadens
PANIPTNWVFCDGLTKSDV

SEQ ID NO: 3011798 - protein, 18 aa, Entamoeba invadens
PANLLLKKSNFQYPIVKI

SEQ ID NO: 3011799 - protein, 24 aa, Entamoeba invadens
PAQDDIVYFLINFSIHPMENDNIN

SEQ ID NO: 3011800 - protein, 26 aa, Entamoeba invadens
PAQITPLPFYSHFEAYIDKLAVILSE

SEQ ID NO: 3011801 - protein, 20 aa, Entamoeba invadens
PAQKVAPKAAPVAGPKFCPN

SEQ ID NO: 3011802 - protein, 29 aa, Entamoeba invadens
PASSRVLMKNECQTLLSLKGFTEQGKTLF

SEQ ID NO: 3011803 - protein, 18 aa, Entamoeba invadens
PASTLQILGAEKALFRAI

SEQ ID NO: 3011804 - protein, 22 aa, Entamoeba invadens
PATAAPPPVINLPNINISNTND

SEQ ID NO: 3011805 - protein, 25 aa, Entamoeba invadens
PATRKVILFMYAPFMGNKEKHHTTN

SEQ ID NO: 3011806 - protein, 26 aa, Entamoeba invadens
PATTTQPFAGFDFNKTNLADSANSTP

SEQ ID NO: 3011807 - protein, 26 aa, Entamoeba invadens
PAVLKNKAIILWKALMKHFDEVAEIL

SEQ ID NO: 3011808 - protein, 25 aa, Entamoeba invadens
PAVMGQLYNSLYLNNNPSIRKSALE

SEQ ID NO: 3011809 - protein, 18 aa, Entamoeba invadens
PAVSLICAFAGAVLAIHV

SEQ ID NO: 3011810 - protein, 28 aa, Entamoeba invadens
PAVTELFLQMFSLRALIPQAFSPIIQEI

SEQ ID NO: 3011811 - protein, 27 aa, Entamoeba invadens
PAVTQRRVFELALLSSNTILLERLRQA

SEQ ID NO: 3011812 - protein, 20 aa, Entamoeba invadens
PCAEYEIGKKLPPHLSPYGN

SEQ ID NO: 3011813 - protein, 22 aa, Entamoeba invadens
PCELLDCGTTYLLKFEVPGIDK

SEQ ID NO: 3011814 - protein, 19 aa, Entamoeba invadens
PCFISLLDLDVSFGMLNLI

SEQ ID NO: 3011815 - protein, 19 aa, Entamoeba invadens
PCFYMAMGNNQFPNAQLTS

SEQ ID NO: 3011816 - protein, 21 aa, Entamoeba invadens
PCGEHLIVTTFDRKCVWYDLQ

SEQ ID NO: 3011817 - protein, 19 aa, Entamoeba invadens
PCLIFEIATIMAKIMGIDL

SEQ ID NO: 3011818 - protein, 25 aa, Entamoeba invadens
PCNEGVFLNNLLYVATNKGIKVMNF

SEQ ID NO: 3011819 - protein, 18 aa, Entamoeba invadens
PCNIIPFRAKHCGAQVAF

SEQ ID NO: 3011820 - protein, 19 aa, Entamoeba invadens
PCSILLKDGLSFQDDIPKV

SEQ ID NO: 3011821 - protein, 17 aa, Entamoeba invadens
PCVLFERNEPRLQQRLN

SEQ ID NO: 3011822 - protein, 18 aa, Entamoeba invadens
PCVLFFDELDSIGKARGG

SEQ ID NO: 3011823 - protein, 18 aa, Entamoeba invadens
PCVPFLGSTLGDLVFTKE

SEQ ID NO: 3011824 - protein, 24 aa, Entamoeba invadens
PCVVLDIVKILKRNAPEKKLSSVE

SEQ ID NO: 3011825 - protein, 23 aa, Entamoeba invadens
PDAPPEKLILTSVPVPPLTIRPS

SEQ ID NO: 3011826 - protein, 25 aa, Entamoeba invadens
PDASVVLLRYFNPIGAHKSGLIGEN

SEQ ID NO: 3011827 - protein, 20 aa, Entamoeba invadens
PDAYSKFVEFTKSKFDAIDA

SEQ ID NO: 3011828 - protein, 21 aa, Entamoeba invadens
PDCHALPPLFVELVKIYIGRT

SEQ ID NO: 3011829 - protein, 22 aa, Entamoeba invadens
PDDEFNILRLLESISLYDKRND

SEQ ID NO: 3011830 - protein, 26 aa, Entamoeba invadens
PDDESFMTKLLRLNPLPTKATRQYED

SEQ ID NO: 3011831 - protein, 26 aa, Entamoeba invadens
PDDGYDYSKHFAERGWGVFVQQDGKI

SEQ ID NO: 3011832 - protein, 29 aa, Entamoeba invadens
PDDKYITAYFLMYLDIRFVKYIIKNQYDV

SEQ ID NO: 3011833 - protein, 27 aa, Entamoeba invadens
PDELNNFYEVVFTKEYYLMKNENGCVT

SEQ ID NO: 3011834 - protein, 31 aa, Entamoeba invadens
PDEPPIPSPLPMIFRLFLRKDYTFEVFSLVC

SEQ ID NO: 3011835 - protein, 29 aa, Entamoeba invadens
PDEQRILFLYILCFCKKLIELGEKLETIS

SEQ ID NO: 3011836 - protein, 25 aa, Entamoeba invadens
PDEYRRLFTYIVAFLKDLVSKGEDE

SEQ ID NO: 3011837 - protein, 17 aa, Entamoeba invadens
PDFMKRLEAAQTVTFMK

SEQ ID NO: 3011838 - protein, 29 aa, Entamoeba invadens
PDFQGILSGRPFYIFNLLEELDEEGEYYI

SEQ ID NO: 3011839 - protein, 17 aa, Entamoeba invadens
PDFSRKCVTCDSGYYPS

SEQ ID NO: 3011840 - protein, 17 aa, Entamoeba invadens
PDGCPCGKDFIEVLREC

SEQ ID NO: 3011841 - protein, 18 aa, Entamoeba invadens
PDGFALCTGSWDSTLRIW

SEQ ID NO: 3011842 - protein, 20 aa, Entamoeba invadens
PDGILCFFPSYVYMNLCISH

SEQ ID NO: 3011843 - protein, 27 aa, Entamoeba invadens
PDGLKTPLDAFLYFTLTSFYTSVGGDL

SEQ ID NO: 3011844 - protein, 24 aa, Entamoeba invadens
PDGYFSWEIGKFVHRHFCKNGYDF

SEQ ID NO: 3011845 - protein, 27 aa, Entamoeba invadens
PDIKTHIWKTFLAIPHILSEDNARGVV

SEQ ID NO: 3011846 - protein, 26 aa, Entamoeba invadens
PDILNVVFNPFKLLSKLLSTFETLKS

SEQ ID NO: 3011847 - protein, 28 aa, Entamoeba invadens
PDIREAYFMFNIYTDPIPFINRIITLKL

SEQ ID NO: 3011848 - protein, 25 aa, Entamoeba invadens
PDISLKQLIYLYIATYASVDEQEAI

SEQ ID NO: 3011849 - protein, 24 aa, Entamoeba invadens
PDITILRKFILDMAKEISFLHNNG

SEQ ID NO: 3011850 - protein, 19 aa, Entamoeba invadens
PDIVFFGENLPKRFFDSFK

SEQ ID NO: 3011851 - protein, 17 aa, Entamoeba invadens
PDKDMKYTPLPLSKVDA

SEQ ID NO: 3011852 - protein, 25 aa, Entamoeba invadens
PDKKIDFKYPFYSYKMSLIMYQNGI

SEQ ID NO: 3011853 - protein, 23 aa, Entamoeba invadens
PDKLRESSLLKRALDYSIKSGVT

SEQ ID NO: 3011854 - protein, 25 aa, Entamoeba invadens
PDKMDIDVFFFRGLEMREKYQSDRQ

SEQ ID NO: 3011855 - protein, 22 aa, Entamoeba invadens
PDKRSDTWYKLKKDYLSGLQDT

SEQ ID NO: 3011856 - protein, 17 aa, Entamoeba invadens
PDLIKTKIFFDCVSSNN

SEQ ID NO: 3011857 - protein, 18 aa, Entamoeba invadens
PDLIPILNRMRDTITREY

SEQ ID NO: 3011858 - protein, 24 aa, Entamoeba invadens
PDLKADFILLAQPAVTHILMTSFM

SEQ ID NO: 3011859 - protein, 18 aa, Entamoeba invadens
PDLLIRITCDKDNNQMII

SEQ ID NO: 3011860 - protein, 20 aa, Entamoeba invadens
PDLPIRRESSIRRSVLRFGE

SEQ ID NO: 3011861 - protein, 35 aa, Entamoeba invadens
PDLSKMFLVVSCLLELYELFFPLNETSKKMQLYAK

SEQ ID NO: 3011862 - protein, 17 aa, Entamoeba invadens
PDLVRPNMFVGVPVKMT

SEQ ID NO: 3011863 - protein, 22 aa, Entamoeba invadens
PDLVTVLIAMTQRLMLEKLTPS

SEQ ID NO: 3011864 - protein, 25 aa, Entamoeba invadens
PDMSDLYFAFFTALASNYSNLDESS

SEQ ID NO: 3011865 - protein, 18 aa, Entamoeba invadens
PDNIILFDTTTPLSYCII

SEQ ID NO: 3011866 - protein, 17 aa, Entamoeba invadens
PDNILIFSLDLNEKVNA

SEQ ID NO: 3011867 - protein, 28 aa, Entamoeba invadens
PDNLAKNCMLCNLPFSLVTRRHHCRKCG

SEQ ID NO: 3011868 - protein, 21 aa, Entamoeba invadens
PDNMFLFYDSFEKDDSLPRIL

SEQ ID NO: 3011869 - protein, 30 aa, Entamoeba invadens
PDNQENVIQLLFDYLKNPVLKITVGNFIEK

SEQ ID NO: 3011870 - protein, 24 aa, Entamoeba invadens
PDNTPTPFIVKLYELVNDEKSKDL

SEQ ID NO: 3011871 - protein, 22 aa, Entamoeba invadens
PDPSKCLMAGPGLKTGEVLVPQ

SEQ ID NO: 3011872 - protein, 23 aa, Entamoeba invadens
PDQEFFSFRFDVCNFVDLHSCVL

SEQ ID NO: 3011873 - protein, 26 aa, Entamoeba invadens
PDQQVIKAYLHPNIREEQLILTSQYS

SEQ ID NO: 3011874 - protein, 17 aa, Entamoeba invadens
PDQTMVLSLLAGIIKLI

SEQ ID NO: 3011875 - protein, 24 aa, Entamoeba invadens
PDQVRLIFMHWKGPAVKKMIMVRA

SEQ ID NO: 3011876 - protein, 25 aa, Entamoeba invadens
PDQYQKLMTMGIPQGPFSLEQTKKL

SEQ ID NO: 3011877 - protein, 25 aa, Entamoeba invadens
PDREKFGIYIAKRLKLGTAIESNCE

SEQ ID NO: 3011878 - protein, 17 aa, Entamoeba invadens
PDRLTKQPLLTQPNTPN

SEQ ID NO: 3011879 - protein, 25 aa, Entamoeba invadens
PDRVERRYDDFPVRGYRDRFDDRNE

SEQ ID NO: 3011880 - protein, 19 aa, Entamoeba invadens
PDRVIFKTIKRHYVEVLKY

SEQ ID NO: 3011881 - protein, 23 aa, Entamoeba invadens
PDSDLLKEKTWGNAVLAFSLNNK

SEQ ID NO: 3011882 - protein, 29 aa, Entamoeba invadens
PDSFCVKFIILMMYVYIIHVRPRVSHMVY

SEQ ID NO: 3011883 - protein, 20 aa, Entamoeba invadens
PDSFPLVFQRELISPQPIIE

SEQ ID NO: 3011884 - protein, 28 aa, Entamoeba invadens
PDSNRHVLWYFCDFLNDVIKNEKVNRMG

SEQ ID NO: 3011885 - protein, 30 aa, Entamoeba invadens
PDSTLLPYTMVGGFLFLRVICPAITTPESS

SEQ ID NO: 3011886 - protein, 25 aa, Entamoeba invadens
PDTGKLLLAFLALKKVRESIENQNK

SEQ ID NO: 3011887 - protein, 20 aa, Entamoeba invadens
PDTITFIPDDYFSSSKLENF

SEQ ID NO: 3011888 - protein, 35 aa, Entamoeba invadens
PDTKKFTIPDYKLDKFLFFGALTTGMLNLNLNKEA

SEQ ID NO: 3011889 - protein, 23 aa, Entamoeba invadens
PDTLNCNFLPISFDYLSKPIYIR

SEQ ID NO: 3011890 - protein, 22 aa, Entamoeba invadens
PDTLRPVQFFTQAPDVFQLYPK

SEQ ID NO: 3011891 - protein, 25 aa, Entamoeba invadens
PDTMYYIPGYLGFSSVPYLTLQTQI

SEQ ID NO: 3011892 - protein, 32 aa, Entamoeba invadens
PDTPQTLFSLWDFLFLNEDPSTFFFVLLAIVY

SEQ ID NO: 3011893 - protein, 26 aa, Entamoeba invadens
PDTRKKVYQYMRQSVYVKQAQAQLDQ

SEQ ID NO: 3011894 - protein, 27 aa, Entamoeba invadens
PDTTKYKIVVFIPMQFPRFSTMVGKLN

SEQ ID NO: 3011895 - protein, 19 aa, Entamoeba invadens
PDVERILSLVLFKMIDKDG

SEQ ID NO: 3011896 - protein, 22 aa, Entamoeba invadens
PDVFFKAPFFIENKTFVVLNGD

SEQ ID NO: 3011897 - protein, 24 aa, Entamoeba invadens
PDVINLLPLIYNKEYTRQLLFYSH

SEQ ID NO: 3011898 - protein, 21 aa, Entamoeba invadens
PDVLYCPYALGVTSPFPIHYT

SEQ ID NO: 3011899 - protein, 21 aa, Entamoeba invadens
PDVMFDQLWQQLKGAAVMTLT

SEQ ID NO: 3011900 - protein, 21 aa, Entamoeba invadens
PDVPVQVGILYSPKIEFIPFD

SEQ ID NO: 3011901 - protein, 26 aa, Entamoeba invadens
PDWFNKLIGQFWNGNDFYLVAADFTA

SEQ ID NO: 3011902 - protein, 22 aa, Entamoeba invadens
PDYFSVPIQNIQKILIASDGIA

SEQ ID NO: 3011903 - protein, 17 aa, Entamoeba invadens
PDYTFWRHIFEQCGRDN

SEQ ID NO: 3011904 - protein, 21 aa, Entamoeba invadens
PEAIYIFPRMFKLEVCQLYDK

SEQ ID NO: 3011905 - protein, 25 aa, Entamoeba invadens
PEAKAAMIWIIGEYSDRITNVADLL

SEQ ID NO: 3011906 - protein, 23 aa, Entamoeba invadens
PEARIHGVLIEKMCSFKYECIIG

SEQ ID NO: 3011907 - protein, 32 aa, Entamoeba invadens
PEDFLKSLKIPKPEDFIFVDYEGGLLSRDANG

SEQ ID NO: 3011908 - protein, 18 aa, Entamoeba invadens
PEDGKLISVIWPCVHYLL

SEQ ID NO: 3011909 - protein, 24 aa, Entamoeba invadens
PEDGLFCDLLWSDPLDDSLYEAYS

SEQ ID NO: 3011910 - protein, 32 aa, Entamoeba invadens
PEDKFTELKRYTLLLTNLPHKRLRDVAARVKY

SEQ ID NO: 3011911 - protein, 25 aa, Entamoeba invadens
PEDMARFYIAELFVALDSIHKLSYI

SEQ ID NO: 3011912 - protein, 26 aa, Entamoeba invadens
PEDNIALSPAPFPHWCIKEITEQPIA

SEQ ID NO: 3011913 - protein, 25 aa, Entamoeba invadens
PEDNQLLRLLRLVSMYEIHKSTRSQ

SEQ ID NO: 3011914 - protein, 18 aa, Entamoeba invadens
PEDPYAFLLALKDVFSLR

SEQ ID NO: 3011915 - protein, 20 aa, Entamoeba invadens
PEDVMFLFNSSRGCSYMYGY

SEQ ID NO: 3011916 - protein, 24 aa, Entamoeba invadens
PEEDLLIGLLRLRKPTEHKFMKEL

SEQ ID NO: 3011917 - protein, 51 aa, Entamoeba invadens
PEEEKYILKSWECYVYLYTYPYKNIFFKALIFWLGRSASLLHRGKAAALTV

SEQ ID NO: 3011918 - protein, 23 aa, Entamoeba invadens
PEEFFKPIAAFMKAWRDAVEQNR

SEQ ID NO: 3011919 - protein, 18 aa, Entamoeba invadens
PEEFVKLTLAPIAPEWKA

SEQ ID NO: 3011920 - protein, 23 aa, Entamoeba invadens
PEELKTQIFPFIQSDLGIQMENI

SEQ ID NO: 3011921 - protein, 25 aa, Entamoeba invadens
PEELTFYILNFFSHSLKLSNLNKFI

SEQ ID NO: 3011922 - protein, 18 aa, Entamoeba invadens
PEENTVMDFPKVPSSTQE

SEQ ID NO: 3011923 - protein, 30 aa, Entamoeba invadens
PEEPVAVPFKMFLQPLHLAPSSSVPVASFS

SEQ ID NO: 3011924 - protein, 26 aa, Entamoeba invadens
PEEQKIEFFMWKEFVGRFTPNMFPGF

SEQ ID NO: 3011925 - protein, 22 aa, Entamoeba invadens
PEERKMGGILGSRRGRRVAQKS

SEQ ID NO: 3011926 - protein, 20 aa, Entamoeba invadens
PEEYKLACPPPSKVPPQLFN

SEQ ID NO: 3011927 - protein, 19 aa, Entamoeba invadens
PEFLLQTYFIRITSTESDP

SEQ ID NO: 3011928 - protein, 19 aa, Entamoeba invadens
PEFTPIHDEALFNPPIQQV

SEQ ID NO: 3011929 - protein, 18 aa, Entamoeba invadens
PEFVKRGFQLGRNKPKNI

SEQ ID NO: 3011930 - protein, 17 aa, Entamoeba invadens
PEGFGFGWCDVFVVKRQ

SEQ ID NO: 3011931 - protein, 27 aa, Entamoeba invadens
PEGITRIPFGMFLSCSNLSEIKNLEKI

SEQ ID NO: 3011932 - protein, 25 aa, Entamoeba invadens
PEGKLEGFYPLRNTEFLVWNERVDV

SEQ ID NO: 3011933 - protein, 21 aa, Entamoeba invadens
PEGLLKNMRLLHIDFSVITKE

SEQ ID NO: 3011934 - protein, 20 aa, Entamoeba invadens
PEGLPLFNTQFSKQLSLLKM

SEQ ID NO: 3011935 - protein, 24 aa, Entamoeba invadens
PEGPKLLRFVIMNCSSKYRKTLVK

SEQ ID NO: 3011936 - protein, 19 aa, Entamoeba invadens
PEIEKMYSLKYLVIDERKK

SEQ ID NO: 3011937 - protein, 20 aa, Entamoeba invadens
PEIFLSSPLGSFFSPRSPRK

SEQ ID NO: 3011938 - protein, 18 aa, Entamoeba invadens
PEIITPMVLLVIDADYNV

SEQ ID NO: 3011939 - protein, 23 aa, Entamoeba invadens
PEIIVDNFALLLKFYTTTKNENN

SEQ ID NO: 3011940 - protein, 36 aa, Entamoeba invadens
PEIIYRQYQMLTDGFLKILFAVEPTFNLGSPLAGEL

SEQ ID NO: 3011941 - protein, 25 aa, Entamoeba invadens
PEIKDLPFLILLNKTDLKAHDKAID

SEQ ID NO: 3011942 - protein, 24 aa, Entamoeba invadens
PEIKMLKILCQWFCRKRSMSDYNQ

SEQ ID NO: 3011943 - protein, 17 aa, Entamoeba invadens
PEILKKDKYKKPADIYS

SEQ ID NO: 3011944 - protein, 19 aa, Entamoeba invadens
PEILKKNHYKKPADIYSFA

SEQ ID NO: 3011945 - protein, 18 aa, Entamoeba invadens
PEILLGEKYDSAVDWWSF

SEQ ID NO: 3011946 - protein, 17 aa, Entamoeba invadens
PEIPKVVCFLNPTIFKL

SEQ ID NO: 3011947 - protein, 25 aa, Entamoeba invadens
PEIRNILNDPLMRKVLDDFQNNPAA

SEQ ID NO: 3011948 - protein, 32 aa, Entamoeba invadens
PEKEQLVSIFLSSMSKLLKEEILYNIKKEQDA

SEQ ID NO: 3011949 - protein, 23 aa, Entamoeba invadens
PEKIKIFINFGVVPSVKTISNLN

SEQ ID NO: 3011950 - protein, 28 aa, Entamoeba invadens
PEKNGRPLFSLLMSSLMKLFSEIAEFDF

SEQ ID NO: 3011951 - protein, 23 aa, Entamoeba invadens
PEKQREFLLRRIKTLVTTYEKAR

SEQ ID NO: 3011952 - protein, 23 aa, Entamoeba invadens
PEKVEEIYIGNGITFVGESCFQG

SEQ ID NO: 3011953 - protein, 24 aa, Entamoeba invadens
PEKYNKPELVSKIRGLIIGQAVGD

SEQ ID NO: 3011954 - protein, 24 aa, Entamoeba invadens
PELDFTCETPFLLQYIKPHEVNEM

SEQ ID NO: 3011955 - protein, 17 aa, Entamoeba invadens
PELFSPTSTLNVSLCSK

SEQ ID NO: 3011956 - protein, 25 aa, Entamoeba invadens
PELFVFRWLTLLCCMEFPLSETLRY

SEQ ID NO: 3011957 - protein, 26 aa, Entamoeba invadens
PELGNKPWKELTAEQKQKFLEIEKKK

SEQ ID NO: 3011958 - protein, 21 aa, Entamoeba invadens
PELIEIFGKIFFDAFAKSEHT

SEQ ID NO: 3011959 - protein, 26 aa, Entamoeba invadens
PELKPVSFINQPPIKYKALQANEHSL

SEQ ID NO: 3011960 - protein, 24 aa, Entamoeba invadens
PELNKPRIILWNSTYIHLNKNING

SEQ ID NO: 3011961 - protein, 26 aa, Entamoeba invadens
PEMFHYNPIPLTRKTAKHFPNVETLH

SEQ ID NO: 3011962 - protein, 19 aa, Entamoeba invadens
PEMIFNSQILHELGKNIDP

SEQ ID NO: 3011963 - protein, 24 aa, Entamoeba invadens
PEMRNAFLDFIKRALQWDPEMRMR

SEQ ID NO: 3011964 - protein, 23 aa, Entamoeba invadens
PEMTQLTVNLFFNGNKKLEDFIH

SEQ ID NO: 3011965 - protein, 18 aa, Entamoeba invadens
PEMVWHNILKHLVPFYIR

SEQ ID NO: 3011966 - protein, 22 aa, Entamoeba invadens
PEMWKMCCDLFDMLSLSAVIDG

SEQ ID NO: 3011967 - protein, 20 aa, Entamoeba invadens
PENCFLLHDFLNIQSKKNYV

SEQ ID NO: 3011968 - protein, 25 aa, Entamoeba invadens
PENDIFNYVLQFKTACQIRQMSEEE

SEQ ID NO: 3011969 - protein, 34 aa, Entamoeba invadens
PENEAQVTFYFLLLSGFLEKQYHQFSGLLNYVHK

SEQ ID NO: 3011970 - protein, 27 aa, Entamoeba invadens
PENFEMEISIFSLIASGLKWVRFGAMC

SEQ ID NO: 3011971 - protein, 29 aa, Entamoeba invadens
PENFESLLNAKIVPFLVKLMSKCDSLDNP

SEQ ID NO: 3011972 - protein, 23 aa, Entamoeba invadens
PENFRQMPILQPIIVQSQMQFQN

SEQ ID NO: 3011973 - protein, 29 aa, Entamoeba invadens
PENGRLTKEMLFKAFFKLIDYDNDGVIEF

SEQ ID NO: 3011974 - protein, 28 aa, Entamoeba invadens
PENHFYYQKCHGAFLLFDLHSENSFKRI

SEQ ID NO: 3011975 - protein, 26 aa, Entamoeba invadens
PENRNLFLEPLPPTTRRWLTAFIEQR

SEQ ID NO: 3011976 - protein, 18 aa, Entamoeba invadens
PENTEVLKFLTFLNSEMP

SEQ ID NO: 3011977 - protein, 27 aa, Entamoeba invadens
PENYKNLVLFIVHFLKDFSKFSNETKM

SEQ ID NO: 3011978 - protein, 25 aa, Entamoeba invadens
PEPKRFVIDILPIVPPTIITQFFRF

SEQ ID NO: 3011979 - protein, 28 aa, Entamoeba invadens
PEQENPLYMYLLFKSKYPYVFSDAMFMA

SEQ ID NO: 3011980 - protein, 24 aa, Entamoeba invadens
PEQIPFVFSLHFIGSAAKFLVERN

SEQ ID NO: 3011981 - protein, 25 aa, Entamoeba invadens
PEQQDPTFGILVLKSIKTQFNYMKK

SEQ ID NO: 3011982 - protein, 24 aa, Entamoeba invadens
PEQTLLAVTPLIDLLDKYQDKGVM

SEQ ID NO: 3011983 - protein, 26 aa, Entamoeba invadens
PERLEPLKTYVFRQVQLREFRTRNMN

SEQ ID NO: 3011984 - protein, 24 aa, Entamoeba invadens
PERSLYSTILSSLFMDGSRLTIPQ

SEQ ID NO: 3011985 - protein, 18 aa, Entamoeba invadens
PERYLLYSNTDVYASTIF

SEQ ID NO: 3011986 - protein, 25 aa, Entamoeba invadens
PESATLGIFYQLANAICYLHSLTPP

SEQ ID NO: 3011987 - protein, 24 aa, Entamoeba invadens
PESDCVHFLPVILNGLLGVTSIIS

SEQ ID NO: 3011988 - protein, 29 aa, Entamoeba invadens
PESDIFSFGILLYEVFTLSVPYTSDDGKI

SEQ ID NO: 3011989 - protein, 21 aa, Entamoeba invadens
PESFKQTLFSKVAGIHVKNAT

SEQ ID NO: 3011990 - protein, 18 aa, Entamoeba invadens
PESFYKSFKLVISGLDNL

SEQ ID NO: 3011991 - protein, 30 aa, Entamoeba invadens
PESGLECYMLLYYCFNLTTVNILKSNKKCF

SEQ ID NO: 3011992 - protein, 25 aa, Entamoeba invadens
PESKSFSFKIVLLGSGSVGKSAIAT

SEQ ID NO: 3011993 - protein, 24 aa, Entamoeba invadens
PESYRYICYVLYNETKKLNIIKPI

SEQ ID NO: 3011994 - protein, 25 aa, Entamoeba invadens
PETAQGIFTMFKRNLEYNGGKVPFG

SEQ ID NO: 3011995 - protein, 25 aa, Entamoeba invadens
PETEAPANMMLYFSEFEALYGADNF

SEQ ID NO: 3011996 - protein, 24 aa, Entamoeba invadens
PETELLNNIFTKLALLGQNEFTEM

SEQ ID NO: 3011997 - protein, 27 aa, Entamoeba invadens
PETITSFGERAFYKCLALSTIDIPKCA

SEQ ID NO: 3011998 - protein, 22 aa, Entamoeba invadens
PETIYFPIFNYLTNSYDPSMQL

SEQ ID NO: 3011999 - protein, 28 aa, Entamoeba invadens
PETKGVFMSRLKTFKFLSKNKNIKTRLY

SEQ ID NO: 3012000 - protein, 18 aa, Entamoeba invadens
PETLKTIEKFAFKNCYSL

SEQ ID NO: 3012001 - protein, 34 aa, Entamoeba invadens
PETLVKKHPFCEFCNIPFIDLDSLYKHLNTQHET

SEQ ID NO: 3012002 - protein, 27 aa, Entamoeba invadens
PETNKNMLWYLCDFLVEILKHKDITQM

SEQ ID NO: 3012003 - protein, 27 aa, Entamoeba invadens
PETNPFYLDFFNNYVYMQMVVFQGTFF

SEQ ID NO: 3012004 - protein, 25 aa, Entamoeba invadens
PETQRRFALLLEAYLMVCGDQRVSI

SEQ ID NO: 3012005 - protein, 24 aa, Entamoeba invadens
PETTLFVPAMRFFGNLIIADEAVE

SEQ ID NO: 3012006 - protein, 18 aa, Entamoeba invadens
PETYKYRNRPEEFSLVNI

SEQ ID NO: 3012007 - protein, 32 aa, Entamoeba invadens
PEVDGVLALMKKIYAIFGFKTDIALSTRNEKK

SEQ ID NO: 3012008 - protein, 29 aa, Entamoeba invadens
PEVEARWILYQVVSALYYLHTHSIVHRDI

SEQ ID NO: 3012009 - protein, 30 aa, Entamoeba invadens
PEVLQNIGLLNKVLIFFKNCLTSKNPEVVA

SEQ ID NO: 3012010 - protein, 18 aa, Entamoeba invadens
PEYIYPGLKYQRPVSHMI

SEQ ID NO: 3012011 - protein, 19 aa, Entamoeba invadens
PEYLAPEILLGNGYGFAVD

SEQ ID NO: 3012012 - protein, 17 aa, Entamoeba invadens
PEYLEQLSTFQPKGDVV

SEQ ID NO: 3012013 - protein, 30 aa, Entamoeba invadens
PEYRSPEMVKVFDYLPIGTQADIWALGCLL

SEQ ID NO: 3012014 - protein, 38 aa, Entamoeba invadens
PEYSKKVFVYFRDGIVAFMTKLITLYEIHVVTLGQKDY

SEQ ID NO: 3012015 - protein, 17 aa, Entamoeba invadens
PEYVKELFLLKINPVVV

SEQ ID NO: 3012016 - protein, 20 aa, Entamoeba invadens
PFAFIGNRFEFRAVGSSQNP

SEQ ID NO: 3012017 - protein, 24 aa, Entamoeba invadens
PFAKLKVEMVRWFDKNKLRMGVEE

SEQ ID NO: 3012018 - protein, 18 aa, Entamoeba invadens
PFDDTFLQIPRSLNAFLQ

SEQ ID NO: 3012019 - protein, 17 aa, Entamoeba invadens
PFDFFGNVQPQQPQMAP

SEQ ID NO: 3012020 - protein, 22 aa, Entamoeba invadens
PFDFLLLVEKMTLKQFLNVFKQ

SEQ ID NO: 3012021 - protein, 17 aa, Entamoeba invadens
PFDLDDAVLRRLSRRIL

SEQ ID NO: 3012022 - protein, 20 aa, Entamoeba invadens
PFDLNFVPFKLKDVPDFAVD

SEQ ID NO: 3012023 - protein, 18 aa, Entamoeba invadens
PFDVLWLDIEHTDDKKYF

SEQ ID NO: 3012024 - protein, 25 aa, Entamoeba invadens
PFDVSFWLGAILNSCGIRTPNICLT

SEQ ID NO: 3012025 - protein, 23 aa, Entamoeba invadens
PFEDFLAVGRYKGVSTLPIPGSG

SEQ ID NO: 3012026 - protein, 26 aa, Entamoeba invadens
PFEGNILERGIALQKLVLRTQFSCLL

SEQ ID NO: 3012027 - protein, 32 aa, Entamoeba invadens
PFEYQNKFPVMYTPHFLTIQPGSILSIQNYNE

SEQ ID NO: 3012028 - protein, 19 aa, Entamoeba invadens
PFFTNLQTLYLYFPGDNAF

SEQ ID NO: 3012029 - protein, 25 aa, Entamoeba invadens
PFGCNQMCFPPPPPFGRFGGWERRR

SEQ ID NO: 3012030 - protein, 28 aa, Entamoeba invadens
PFGGITFRPFPLRGFVEIVFCAVDSTVQ

SEQ ID NO: 3012031 - protein, 19 aa, Entamoeba invadens
PFGISTLIGGFDPDGTPRL

SEQ ID NO: 3012032 - protein, 28 aa, Entamoeba invadens
PFGQYAPIFFQFLDCVHIMMNTFSNFFE

SEQ ID NO: 3012033 - protein, 17 aa, Entamoeba invadens
PFGTFLNCNHLTNITLP

SEQ ID NO: 3012034 - protein, 17 aa, Entamoeba invadens
PFGVSAIYPGCFYDCNF

SEQ ID NO: 3012035 - protein, 21 aa, Entamoeba invadens
PFIEMLPTDIPKPFITTTPYI

SEQ ID NO: 3012036 - protein, 23 aa, Entamoeba invadens
PFIIRSRVLLPKGKDEKQLIKKV

SEQ ID NO: 3012037 - protein, 26 aa, Entamoeba invadens
PFIKQRNLFLFKLYDDKHLSENNVNQ

SEQ ID NO: 3012038 - protein, 25 aa, Entamoeba invadens
PFINQKMHLQFARPGGQPEGVMQFQ

SEQ ID NO: 3012039 - protein, 29 aa, Entamoeba invadens
PFIPTNTFGIPMPFAMRLSVATPVNERNF

SEQ ID NO: 3012040 - protein, 28 aa, Entamoeba invadens
PFIQKYSHLVLYTFDSIIIWKWSCEDLD

SEQ ID NO: 3012041 - protein, 29 aa, Entamoeba invadens
PFKEVYLPTEITCLTSMDYLSNISSKSDT

SEQ ID NO: 3012042 - protein, 18 aa, Entamoeba invadens
PFKFTRIQIPVVPAFAMT

SEQ ID NO: 3012043 - protein, 18 aa, Entamoeba invadens
PFKKYYIEGLDLLQPQDK

SEQ ID NO: 3012044 - protein, 27 aa, Entamoeba invadens
PFKPKVALTLFSMFYPIIPLEMTQKQM

SEQ ID NO: 3012045 - protein, 19 aa, Entamoeba invadens
PFLLNVEFSGNITPIIMSK

SEQ ID NO: 3012046 - protein, 25 aa, Entamoeba invadens
PFLNRFADSLKFRPVPTRLSTAQTC

SEQ ID NO: 3012047 - protein, 19 aa, Entamoeba invadens
PFLTSPRSPPPTLSKSTNP

SEQ ID NO: 3012048 - protein, 22 aa, Entamoeba invadens
PFLTYFSVRLQKIAQFLSTQHE

SEQ ID NO: 3012049 - protein, 21 aa, Entamoeba invadens
PFMAPIPFRGKPSHSGMIPWI

SEQ ID NO: 3012050 - protein, 27 aa, Entamoeba invadens
PFNKHKQIMYFFIMTNTTKHGDPPDFT

SEQ ID NO: 3012051 - protein, 26 aa, Entamoeba invadens
PFNLPDFFDCFSFSLPTFMEVIVNIL

SEQ ID NO: 3012052 - protein, 24 aa, Entamoeba invadens
PFPEEKIVFFKINIWFRVGCSVAE

SEQ ID NO: 3012053 - protein, 23 aa, Entamoeba invadens
PFPIFRLKQTTSAQIYQPIVRAI

SEQ ID NO: 3012054 - protein, 26 aa, Entamoeba invadens
PFPLTRKTIFYFPNIETLHLWKLNHE

SEQ ID NO: 3012055 - protein, 18 aa, Entamoeba invadens
PFPNFNLYERLTDVERKK

SEQ ID NO: 3012056 - protein, 28 aa, Entamoeba invadens
PFPNTEANMWYLPMNDWISERCSEVKQF

SEQ ID NO: 3012057 - protein, 25 aa, Entamoeba invadens
PFQVKNHLFVFVRCLIENPAFDSQT

SEQ ID NO: 3012058 - protein, 17 aa, Entamoeba invadens
PFREYLASFKDSITLFA

SEQ ID NO: 3012059 - protein, 18 aa, Entamoeba invadens
PFRSMLFSATLSSSPRFF

SEQ ID NO: 3012060 - protein, 20 aa, Entamoeba invadens
PFSAKHFLEQLPASAKKIAV

SEQ ID NO: 3012061 - protein, 17 aa, Entamoeba invadens
PFSIHNLFLTKAILQGN

SEQ ID NO: 3012062 - protein, 26 aa, Entamoeba invadens
PFSLYSKLPFFQWCSETYKQTFVVPG

SEQ ID NO: 3012063 - protein, 18 aa, Entamoeba invadens
PFSMAFTQKFLGMLESKK

SEQ ID NO: 3012064 - protein, 21 aa, Entamoeba invadens
PFSNGLKYLRKLRTENRARLI

SEQ ID NO: 3012065 - protein, 21 aa, Entamoeba invadens
PFSNTFPVFPIRNDVIVELYE

SEQ ID NO: 3012066 - protein, 26 aa, Entamoeba invadens
PFSTPYVNEGFFLHGLWPQNDAHKNL

SEQ ID NO: 3012067 - protein, 27 aa, Entamoeba invadens
PFSVQRIYPMDIKSNLPRKAIPQVVYN

SEQ ID NO: 3012068 - protein, 30 aa, Entamoeba invadens
PFTEYPNPLPKKFIPLSFPKEFQNIRSKII

SEQ ID NO: 3012069 - protein, 38 aa, Entamoeba invadens
PFTNNTIVLLKIRIWRMSSNRRVLIKAASKIYSHLQNT

SEQ ID NO: 3012070 - protein, 18 aa, Entamoeba invadens
PFTVINRTPLEIKITCFK

SEQ ID NO: 3012071 - protein, 19 aa, Entamoeba invadens
PFVFSVGFDRTQSRQMGVF

SEQ ID NO: 3012072 - protein, 26 aa, Entamoeba invadens
PFVKQRNLSLFKIYDDKHLSENNVNQ

SEQ ID NO: 3012073 - protein, 17 aa, Entamoeba invadens
PFVLFMLDDSDKINEWK

SEQ ID NO: 3012074 - protein, 20 aa, Entamoeba invadens
PFVLNEPFPDFFIVGGFEEM

SEQ ID NO: 3012075 - protein, 19 aa, Entamoeba invadens
PFVLTRSMLFVFAGESGTA

SEQ ID NO: 3012076 - protein, 18 aa, Entamoeba invadens
PFVTTRFSIDGRLRYFID

SEQ ID NO: 3012077 - protein, 19 aa, Entamoeba invadens
PFWGSLLSFSYNKANVIKI

SEQ ID NO: 3012078 - protein, 19 aa, Entamoeba invadens
PFWVSRLLEKDGVKCSKVA

SEQ ID NO: 3012079 - protein, 24 aa, Entamoeba invadens
PFYSSKIGGIPYYPKGMIYPTNSN

SEQ ID NO: 3012080 - protein, 38 aa, Entamoeba invadens
PFYSSKIGGLPYYPIGMKYPTIPSGEYMYLLAQINFSE

SEQ ID NO: 3012081 - protein, 25 aa, Entamoeba invadens
PGAGNIILFGLESEKLFFEKLGEKR

SEQ ID NO: 3012082 - protein, 18 aa, Entamoeba invadens
PGCNGIIMIDGNRRSMMI

SEQ ID NO: 3012083 - protein, 22 aa, Entamoeba invadens
PGDEFAFRSYGWRVDLKDMIKD

SEQ ID NO: 3012084 - protein, 22 aa, Entamoeba invadens
PGDFLLLRNVCENVLFERKRGY

SEQ ID NO: 3012085 - protein, 28 aa, Entamoeba invadens
PGDPSFSYPPMYRGPGAYPPMGNYQQQQ

SEQ ID NO: 3012086 - protein, 18 aa, Entamoeba invadens
PGDRVCVTGILKALAGPN

SEQ ID NO: 3012087 - protein, 17 aa, Entamoeba invadens
PGEMWRILQANILSYLS

SEQ ID NO: 3012088 - protein, 24 aa, Entamoeba invadens
PGETPKIYRVVLTGGPGGGKTTSL

SEQ ID NO: 3012089 - protein, 20 aa, Entamoeba invadens
PGFIIQLYQYQLKMGIKDSN

SEQ ID NO: 3012090 - protein, 20 aa, Entamoeba invadens
PGGLAPPPGLEPPGGLAPPP

SEQ ID NO: 3012091 - protein, 19 aa, Entamoeba invadens
PGGMLPPPGLEPPGGLMPP

SEQ ID NO: 3012092 - protein, 25 aa, Entamoeba invadens
PGGMMPPGMLPPPGGLAPPGMMMPP

SEQ ID NO: 3012093 - protein, 22 aa, Entamoeba invadens
PGGMMPPPGLAPPGGLMPPGML

SEQ ID NO: 3012094 - protein, 43 aa, Entamoeba invadens
PGGMMPPPGLAPPGGLMPPGMMPPPGLAPPGAPPGGLMPPGML

SEQ ID NO: 3012095 - protein, 37 aa, Entamoeba invadens
PGGMMPPPGLAPPGGLMPPPGLAPPGGMMPPPGLAPP

SEQ ID NO: 3012096 - protein, 21 aa, Entamoeba invadens
PGGMMPPPGLAPPGGMMPPPG

SEQ ID NO: 3012097 - protein, 24 aa, Entamoeba invadens
PGHTAPIPHNTPFTRPNKAAPIPQ

SEQ ID NO: 3012098 - protein, 26 aa, Entamoeba invadens
PGHYDYPFIIQLPQGIPSSLCFQDRN

SEQ ID NO: 3012099 - protein, 20 aa, Entamoeba invadens
PGIEDIYFERFKIDSEMYEM

SEQ ID NO: 3012100 - protein, 19 aa, Entamoeba invadens
PGIRCAVSLALGTMSFTCP

SEQ ID NO: 3012101 - protein, 32 aa, Entamoeba invadens
PGISQVFFECEIPLTFPLMFVSDKVGLKYYGE

SEQ ID NO: 3012102 - protein, 31 aa, Entamoeba invadens
PGKFGDLYIHFKIQFPAYLTEKQRTDVKSAL

SEQ ID NO: 3012103 - protein, 26 aa, Entamoeba invadens
PGKTVLSDIFLIKSSTLPGKVWVHKK

SEQ ID NO: 3012104 - protein, 30 aa, Entamoeba invadens
PGLEPPGGLMPPPGLAPPGGMMPPPGLAPP

SEQ ID NO: 3012105 - protein, 17 aa, Entamoeba invadens
PGLRGSPFCYNFAMNHF

SEQ ID NO: 3012106 - protein, 25 aa, Entamoeba invadens
PGMAPGMYPPPMGAYPPPMGGAYPP

SEQ ID NO: 3012107 - protein, 25 aa, Entamoeba invadens
PGMNPYGMQQPGMNPYGGAYGGMGA

SEQ ID NO: 3012108 - protein, 21 aa, Entamoeba invadens
PGNLYIGFPDLIDKIFHSRKI

SEQ ID NO: 3012109 - protein, 33 aa, Entamoeba invadens
PGNSEYNMLYKWINFLGYPPKKLLDAGKKTEKY

SEQ ID NO: 3012110 - protein, 24 aa, Entamoeba invadens
PGRLKIMNFVRMWMKNAWKDFEGK

SEQ ID NO: 3012111 - protein, 17 aa, Entamoeba invadens
PGRTLCLGDLIDLKTFK

SEQ ID NO: 3012112 - protein, 25 aa, Entamoeba invadens
PGRYGIKFWTGMALNLQMYCGKCGG

SEQ ID NO: 3012113 - protein, 38 aa, Entamoeba invadens
PGSIPVHPCGRYRHNTVVFIMASLGLKTLRPVHRLDRM

SEQ ID NO: 3012114 - protein, 33 aa, Entamoeba invadens
PGSTIQILGAEKALFRAIKSKKKTPKYGLIYHA

SEQ ID NO: 3012115 - protein, 31 aa, Entamoeba invadens
PGSVNWNLIAKPRGNKPLNIFQRRTNCTVLI

SEQ ID NO: 3012116 - protein, 29 aa, Entamoeba invadens
PGTDNMTFLLAVFDKSDKWRKCCAGCDVI

SEQ ID NO: 3012117 - protein, 25 aa, Entamoeba invadens
PGTIKRNVFLFGKIGTKITQQNKDL

SEQ ID NO: 3012118 - protein, 17 aa, Entamoeba invadens
PGTKLMPGMIYLNKQAP

SEQ ID NO: 3012119 - protein, 24 aa, Entamoeba invadens
PGTTVLVKLEFFNPMSSVKDRIAL

SEQ ID NO: 3012120 - protein, 23 aa, Entamoeba invadens
PGYACEFEIFIKPLCTCSTKEDV

SEQ ID NO: 3012121 - protein, 17 aa, Entamoeba invadens
PHAGFRYSGPTAGFSVA

SEQ ID NO: 3012122 - protein, 18 aa, Entamoeba invadens
PHCKKPIKLNYKKTLEKF

SEQ ID NO: 3012123 - protein, 21 aa, Entamoeba invadens
PHEFQCDVWMFEIPQLKSGKD

SEQ ID NO: 3012124 - protein, 18 aa, Entamoeba invadens
PHFEDIYELIRIAENILL

SEQ ID NO: 3012125 - protein, 21 aa, Entamoeba invadens
PHFHISIVSLTLKLLTIPDIP

SEQ ID NO: 3012126 - protein, 19 aa, Entamoeba invadens
PHFTPIVLCFLQNAAKIGQ

SEQ ID NO: 3012127 - protein, 20 aa, Entamoeba invadens
PHIHYPCYLQFMKNHPHDAI

SEQ ID NO: 3012128 - protein, 19 aa, Entamoeba invadens
PHKHYAQALLTKIIVSFPE

SEQ ID NO: 3012129 - protein, 29 aa, Entamoeba invadens
PHKKQTLVTVPFFRILTIKDKDTIYFKEL

SEQ ID NO: 3012130 - protein, 17 aa, Entamoeba invadens
PHKNYLYYAKLSDIIMK

SEQ ID NO: 3012131 - protein, 17 aa, Entamoeba invadens
PHKTINIEIPFASKIPK

SEQ ID NO: 3012132 - protein, 17 aa, Entamoeba invadens
PHLFNYAGDMLGLTQFD

SEQ ID NO: 3012133 - protein, 17 aa, Entamoeba invadens
PHLIISRAEIDGVDVNE

SEQ ID NO: 3012134 - protein, 18 aa, Entamoeba invadens
PHLINATSSLLYLDKSPE

SEQ ID NO: 3012135 - protein, 27 aa, Entamoeba invadens
PHLNSSFKHFILFAANFNLLDKKEVAP

SEQ ID NO: 3012136 - protein, 19 aa, Entamoeba invadens
PHLVSTLQKIVFLSSFNNI

SEQ ID NO: 3012137 - protein, 17 aa, Entamoeba invadens
PHNGVIITITRLGNGNI

SEQ ID NO: 3012138 - protein, 20 aa, Entamoeba invadens
PHNLIDKNTLRYYNPSGRFV

SEQ ID NO: 3012139 - protein, 28 aa, Entamoeba invadens
PHPDLLNTLNYIVPYLHVSTVRNLLASP

SEQ ID NO: 3012140 - protein, 20 aa, Entamoeba invadens
PHRLIPSVSIHRPLPSLPNK

SEQ ID NO: 3012141 - protein, 19 aa, Entamoeba invadens
PHSFIDMLKGKKNIMFIIK

SEQ ID NO: 3012142 - protein, 23 aa, Entamoeba invadens
PHSLSNVRVWCEQLKRVCPDAKV

SEQ ID NO: 3012143 - protein, 26 aa, Entamoeba invadens
PHTKMSFHHHPVINCAYILQGTLHVT

SEQ ID NO: 3012144 - protein, 23 aa, Entamoeba invadens
PHTQPTTFLPSQIIQLIPHVEHN

SEQ ID NO: 3012145 - protein, 20 aa, Entamoeba invadens
PHTTFPLIRAIRALTRNAND

SEQ ID NO: 3012146 - protein, 38 aa, Entamoeba invadens
PHVDKWSIPQTTDFVFSLKNLFNKPPVIFKKNINGKLE

SEQ ID NO: 3012147 - protein, 56 aa, Entamoeba invadens
PHYIICQLRCNGVLEGIRITRLGYPNRIIYNEFLKRYFFLGTNINKKTSDAMPVVK

SEQ ID NO: 3012148 - protein, 24 aa, Entamoeba invadens
PHYIIYVLLNTQKRIRYFIDSTVL

SEQ ID NO: 3012149 - protein, 20 aa, Entamoeba invadens
PIAHIFFSINHVSQALLFNG

SEQ ID NO: 3012150 - protein, 18 aa, Entamoeba invadens
PIALFEVNKYYTFGFFTC

SEQ ID NO: 3012151 - protein, 25 aa, Entamoeba invadens
PIAPSYIAGFKWMPKCELVMEQNAL

SEQ ID NO: 3012152 - protein, 27 aa, Entamoeba invadens
PIAQGSFKMRKPFPLPWRGLRDEKMSE

SEQ ID NO: 3012153 - protein, 20 aa, Entamoeba invadens
PIASYFYKKLSEKGLKVSII

SEQ ID NO: 3012154 - protein, 26 aa, Entamoeba invadens
PIATPQKFFMKFINFFASVTTLPLEM

SEQ ID NO: 3012155 - protein, 17 aa, Entamoeba invadens
PIAVFDIGSYKTKIGFA

SEQ ID NO: 3012156 - protein, 20 aa, Entamoeba invadens
PICPIPTSYVESGYIWLPMY

SEQ ID NO: 3012157 - protein, 28 aa, Entamoeba invadens
PIDGTLGFLRREQYAVCLGFMVDGVLKI

SEQ ID NO: 3012158 - protein, 20 aa, Entamoeba invadens
PIDIISLTINAMVTLLETLS

SEQ ID NO: 3012159 - protein, 25 aa, Entamoeba invadens
PIDIITHIPSYMKSVGVAYIYVDSR

SEQ ID NO: 3012160 - protein, 25 aa, Entamoeba invadens
PIDKGGINSLIWKIDELNSPTSFEV

SEQ ID NO: 3012161 - protein, 19 aa, Entamoeba invadens
PIDKISPPPVFPSKTREIK

SEQ ID NO: 3012162 - protein, 20 aa, Entamoeba invadens
PIDKISPPPVFPSKTREIKN

SEQ ID NO: 3012163 - protein, 21 aa, Entamoeba invadens
PIDMRYGIFNTLKILKLAHFV

SEQ ID NO: 3012164 - protein, 27 aa, Entamoeba invadens
PIDNIGRHVILIYRALYQVHSSKCITW

SEQ ID NO: 3012165 - protein, 20 aa, Entamoeba invadens
PIDRLCRTIRDLYVKYYILN

SEQ ID NO: 3012166 - protein, 31 aa, Entamoeba invadens
PIDVNTLIAVAFYFRFIIFTQKDGTNEAQIL

SEQ ID NO: 3012167 - protein, 18 aa, Entamoeba invadens
PIDVYVYDEIPDALNCTA

SEQ ID NO: 3012168 - protein, 18 aa, Entamoeba invadens
PIDYLVAGSPMCCGNLWS

SEQ ID NO: 3012169 - protein, 21 aa, Entamoeba invadens
PIEDSMFVLAKGKSVLRFELV

SEQ ID NO: 3012170 - protein, 18 aa, Entamoeba invadens
PIEIFPKAAKAVLDFVKK

SEQ ID NO: 3012171 - protein, 18 aa, Entamoeba invadens
PIEIHKKEKMYIPELIFG

SEQ ID NO: 3012172 - protein, 17 aa, Entamoeba invadens
PIEIPIIGIKNFRSTCF

SEQ ID NO: 3012173 - protein, 20 aa, Entamoeba invadens
PIELYKKLYAGESYTFNLLE

SEQ ID NO: 3012174 - protein, 24 aa, Entamoeba invadens
PIEMHHSVLLLKKSSEPVKETGRT

SEQ ID NO: 3012175 - protein, 19 aa, Entamoeba invadens
PIEQFAHQLTLYEFEMFKA

SEQ ID NO: 3012176 - protein, 18 aa, Entamoeba invadens
PIETMSLRYDPWGGTIEF

SEQ ID NO: 3012177 - protein, 24 aa, Entamoeba invadens
PIEYLDCLIPLIQQDKLIFSIMNM

SEQ ID NO: 3012178 - protein, 18 aa, Entamoeba invadens
PIFCGMDYVKTYDRNTLV

SEQ ID NO: 3012179 - protein, 20 aa, Entamoeba invadens
PIFEFVLMAFNDGKLSAKKS

SEQ ID NO: 3012180 - protein, 19 aa, Entamoeba invadens
PIFSVPIMSFEKTVFAQNI

SEQ ID NO: 3012181 - protein, 19 aa, Entamoeba invadens
PIFVTNFVSKFVVRPNSQK

SEQ ID NO: 3012182 - protein, 19 aa, Entamoeba invadens
PIFYCIKCLKKKPDDFRKA

SEQ ID NO: 3012183 - protein, 18 aa, Entamoeba invadens
PIFYMRTKVEKAIKQKRA

SEQ ID NO: 3012184 - protein, 19 aa, Entamoeba invadens
PIFYNINSHTLLYNTQEII

SEQ ID NO: 3012185 - protein, 23 aa, Entamoeba invadens
PIGFVSSCRITRFVLRNLDQVFV

SEQ ID NO: 3012186 - protein, 18 aa, Entamoeba invadens
PIGIMKRAPQPWEHLVGL

SEQ ID NO: 3012187 - protein, 17 aa, Entamoeba invadens
PIGLFDFNKSGQLFAFC

SEQ ID NO: 3012188 - protein, 29 aa, Entamoeba invadens
PIHIARSQQYFKYILMYFTDGEIVCGESS

SEQ ID NO: 3012189 - protein, 20 aa, Entamoeba invadens
PIHTVKFLNVPVIAKGAFSQ

SEQ ID NO: 3012190 - protein, 21 aa, Entamoeba invadens
PIIEDILALKNPHFYDGFFSV

SEQ ID NO: 3012191 - protein, 18 aa, Entamoeba invadens
PIIEKVVMNYDFLTGDST

SEQ ID NO: 3012192 - protein, 18 aa, Entamoeba invadens
PIILSCFSSFWMEKSGIV

SEQ ID NO: 3012193 - protein, 17 aa, Entamoeba invadens
PIINVDYFSIKKSLQSD

SEQ ID NO: 3012194 - protein, 23 aa, Entamoeba invadens
PIITFEYVGFYQDSKFTPGNFLC

SEQ ID NO: 3012195 - protein, 32 aa, Entamoeba invadens
PIKFIADYAYKYFLLKNVHGAVTYFIRSFTGC

SEQ ID NO: 3012196 - protein, 17 aa, Entamoeba invadens
PIKILCFDFIKNRNLFV

SEQ ID NO: 3012197 - protein, 24 aa, Entamoeba invadens
PIKLVSGVELERVVPRKLGGVVQA

SEQ ID NO: 3012198 - protein, 18 aa, Entamoeba invadens
PIKRSIATLQFLNVKQIT

SEQ ID NO: 3012199 - protein, 23 aa, Entamoeba invadens
PIKSLPEGFLKLKSLRLISLCHS

SEQ ID NO: 3012200 - protein, 19 aa, Entamoeba invadens
PIKTFYQIEVLFTVDYETF

SEQ ID NO: 3012201 - protein, 26 aa, Entamoeba invadens
PIKTGMLMTELFFIDALAISSGLTSL

SEQ ID NO: 3012202 - protein, 19 aa, Entamoeba invadens
PIKTILKIFPRLETLFLPM

SEQ ID NO: 3012203 - protein, 38 aa, Entamoeba invadens
PILCQYDSVPSCKLDFVLRLLKSIHKLSKMKVAVLGMH

SEQ ID NO: 3012204 - protein, 17 aa, Entamoeba invadens
PILDPLFLSSKTFKTFL

SEQ ID NO: 3012205 - protein, 18 aa, Entamoeba invadens
PILIEKFQRKTIVKLTSC

SEQ ID NO: 3012206 - protein, 17 aa, Entamoeba invadens
PILPHRVLNTKNCPSDI

SEQ ID NO: 3012207 - protein, 19 aa, Entamoeba invadens
PILPQLFTFMENFLEYPSC

SEQ ID NO: 3012208 - protein, 26 aa, Entamoeba invadens
PILQSMLDGTIPLPNAIEPIPIESNS

SEQ ID NO: 3012209 - protein, 19 aa, Entamoeba invadens
PILQTLMTPKYSLAIAALG

SEQ ID NO: 3012210 - protein, 18 aa, Entamoeba invadens
PILSFVTVSERNMAFRKM

SEQ ID NO: 3012211 - protein, 17 aa, Entamoeba invadens
PILYCSTQLVMSIGGFG

SEQ ID NO: 3012212 - protein, 31 aa, Entamoeba invadens
PINDKQTFYLNRKKDFSLFSFKMTSDFGINK

SEQ ID NO: 3012213 - protein, 19 aa, Entamoeba invadens
PINFLPTYKFVIGTQEYHE

SEQ ID NO: 3012214 - protein, 20 aa, Entamoeba invadens
PINFPLVTQNFDYFASALLS

SEQ ID NO: 3012215 - protein, 23 aa, Entamoeba invadens
PINKEFIYTLFYTTFEFEHFQLS

SEQ ID NO: 3012216 - protein, 22 aa, Entamoeba invadens
PINLKRLFQVKGQRRPYVKQVE

SEQ ID NO: 3012217 - protein, 40 aa, Entamoeba invadens
PINNTIIKLRKLRLSSIYNFFVVNIWYPVDYSTSMCPQNK

SEQ ID NO: 3012218 - protein, 19 aa, Entamoeba invadens
PIPECGPLDALVRPLALAP

SEQ ID NO: 3012219 - protein, 30 aa, Entamoeba invadens
PIPETRLLPENFLYVDGKTPNLSLLRSHLV

SEQ ID NO: 3012220 - protein, 26 aa, Entamoeba invadens
PIPGSEFDIECDCLLLSVGLIPQPDL

SEQ ID NO: 3012221 - protein, 20 aa, Entamoeba invadens
PIPIHLGIREIIRFGLKPYT

SEQ ID NO: 3012222 - protein, 19 aa, Entamoeba invadens
PIPLNRKTIRYFPNIETLC

SEQ ID NO: 3012223 - protein, 19 aa, Entamoeba invadens
PIPRKRDFTHSSSKKWLEA

SEQ ID NO: 3012224 - protein, 19 aa, Entamoeba invadens
PIPSEDICLFFSSEFFEIG

SEQ ID NO: 3012225 - protein, 27 aa, Entamoeba invadens
PIQKQSVSPSVILPVAPQSRSESYQSI

SEQ ID NO: 3012226 - protein, 25 aa, Entamoeba invadens
PIQRTPRYVMLITDLLKNISMSFGD

SEQ ID NO: 3012227 - protein, 27 aa, Entamoeba invadens
PIQSEGSFYFWIAYCPIKPKSEKMGEI

SEQ ID NO: 3012228 - protein, 31 aa, Entamoeba invadens
PIRNVFYKSKKIFELLFIMCSSLQEDSLLLF

SEQ ID NO: 3012229 - protein, 28 aa, Entamoeba invadens
PIRQVLKGLQYLYVHGLFHGKITKNCVI

SEQ ID NO: 3012230 - protein, 30 aa, Entamoeba invadens
PIRRYADVLVHRFLAMAIGFDRIELTITKE

SEQ ID NO: 3012231 - protein, 25 aa, Entamoeba invadens
PIRVNFEIPYYTVSGLQVRYLKVVE

SEQ ID NO: 3012232 - protein, 43 aa, Entamoeba invadens
PISISQVFLQLFRTKIFPPLTLYLHYLFMIHGLHTKCDIIPKF

SEQ ID NO: 3012233 - protein, 22 aa, Entamoeba invadens
PISKPYYQSLLYYLSNDFESSQ

SEQ ID NO: 3012234 - protein, 20 aa, Entamoeba invadens
PISMYYPSLTFAMFGISLVK

SEQ ID NO: 3012235 - protein, 25 aa, Entamoeba invadens
PISVLDFSSLYPSIMISHNLCYSTL

SEQ ID NO: 3012236 - protein, 18 aa, Entamoeba invadens
PISVSDIKIFPFIETQHL

SEQ ID NO: 3012237 - protein, 25 aa, Entamoeba invadens
PISYTPGLFKIFDEILVNASDNFQR

SEQ ID NO: 3012238 - protein, 23 aa, Entamoeba invadens
PITIVVIQLLAFHYSLSKTTTPQ

SEQ ID NO: 3012239 - protein, 20 aa, Entamoeba invadens
PITPALFEWLRVCTGAHIMQ

SEQ ID NO: 3012240 - protein, 19 aa, Entamoeba invadens
PITPLLTQWTYQAMIHEFV

SEQ ID NO: 3012241 - protein, 25 aa, Entamoeba invadens
PITQFEDLLFDLSFDSIKKLFCSKE

SEQ ID NO: 3012242 - protein, 21 aa, Entamoeba invadens
PITRKFRNYLKKVFIGQPSFI

SEQ ID NO: 3012243 - protein, 29 aa, Entamoeba invadens
PITSADECVLFFSKISFVCEIQPRLATLE

SEQ ID NO: 3012244 - protein, 20 aa, Entamoeba invadens
PIVEFLLQNGKVGFLRLFLY

SEQ ID NO: 3012245 - protein, 25 aa, Entamoeba invadens
PIVEYFKDISFNLPYYVPKGKSKDE

SEQ ID NO: 3012246 - protein, 18 aa, Entamoeba invadens
PIVFGNLTEFCYPLINPE

SEQ ID NO: 3012247 - protein, 22 aa, Entamoeba invadens
PIVIPKNMLINDYLLNHLMDEQ

SEQ ID NO: 3012248 - protein, 33 aa, Entamoeba invadens
PIVLHKQLMSTLPQSLFTLTPPPPPSRKQAASY

SEQ ID NO: 3012249 - protein, 25 aa, Entamoeba invadens
PIVMEAVFNLILNFSRHTPKIELTL

SEQ ID NO: 3012250 - protein, 24 aa, Entamoeba invadens
PIVPKTHRPIFLVKYKLMEKTNDY

SEQ ID NO: 3012251 - protein, 20 aa, Entamoeba invadens
PIVVPDTPTSFNLGELGFFN

SEQ ID NO: 3012252 - protein, 24 aa, Entamoeba invadens
PIVVQMNMPPPPPPVVVTDVKVDD

SEQ ID NO: 3012253 - protein, 21 aa, Entamoeba invadens
PIVVRLIVCGMRQLSGEKSME

SEQ ID NO: 3012254 - protein, 17 aa, Entamoeba invadens
PIYEGFSLPHAILRIDL

SEQ ID NO: 3012255 - protein, 31 aa, Entamoeba invadens
PIYETLCMKTLKIFEFLYPSIRTTKIENVFV

SEQ ID NO: 3012256 - protein, 18 aa, Entamoeba invadens
PIYHDIFYNKRESIYFKR

SEQ ID NO: 3012257 - protein, 19 aa, Entamoeba invadens
PIYKERTLLISPRDLSREP

SEQ ID NO: 3012258 - protein, 17 aa, Entamoeba invadens
PIYLANVALYLEGFSTF

SEQ ID NO: 3012259 - protein, 25 aa, Entamoeba invadens
PIYYDVLDYFTIVKDPMDLYTVRKK

SEQ ID NO: 3012260 - protein, 35 aa, Entamoeba invadens
PKAAAYFYGVKKMKDGLFFAFDFGGGTLDTTVFEK

SEQ ID NO: 3012261 - protein, 23 aa, Entamoeba invadens
PKAINLLKGKTFAKTSSLYYDDG

SEQ ID NO: 3012262 - protein, 25 aa, Entamoeba invadens
PKAKKINFSKLRRRLNSNKKRTPKP

SEQ ID NO: 3012263 - protein, 39 aa, Entamoeba invadens
PKARDWWATLYDFSKYQYSSPYLMIWIDMNEPSVFNGPE

SEQ ID NO: 3012264 - protein, 22 aa, Entamoeba invadens
PKCEWYIRGFCSRGKKCHNLHP

SEQ ID NO: 3012265 - protein, 24 aa, Entamoeba invadens
PKCKKYIHLPPNAPDILPTSYKRI

SEQ ID NO: 3012266 - protein, 18 aa, Entamoeba invadens
PKCLKYIPNSCFFKCGNL

SEQ ID NO: 3012267 - protein, 28 aa, Entamoeba invadens
PKDDIVIEALLILRYLFAGNAMRAETLI

SEQ ID NO: 3012268 - protein, 17 aa, Entamoeba invadens
PKDEKAKIKPWTRLATS

SEQ ID NO: 3012269 - protein, 20 aa, Entamoeba invadens
PKDILSDKDLYPSLKGSVIP

SEQ ID NO: 3012270 - protein, 24 aa, Entamoeba invadens
PKDKEVLKLFKKTTYYYATCVSNM

SEQ ID NO: 3012271 - protein, 23 aa, Entamoeba invadens
PKDLAFVGYTYKGFLNVVNSPSK

SEQ ID NO: 3012272 - protein, 35 aa, Entamoeba invadens
PKDRDILKMYDIPLPGPIFPPLNAPTPTLLMPGHD

SEQ ID NO: 3012273 - protein, 20 aa, Entamoeba invadens
PKDWIAFDNKKWLIERINRM

SEQ ID NO: 3012274 - protein, 28 aa, Entamoeba invadens
PKEADVSQIPFIDPKSCKPMSSKKVQLT

SEQ ID NO: 3012275 - protein, 18 aa, Entamoeba invadens
PKEEEIFRMYKAKKAVAN

SEQ ID NO: 3012276 - protein, 29 aa, Entamoeba invadens
PKEEICALFLERLYLTKTTLPFLEVCFEN

SEQ ID NO: 3012277 - protein, 19 aa, Entamoeba invadens
PKEFITIFENLLDEQKKYS

SEQ ID NO: 3012278 - protein, 19 aa, Entamoeba invadens
PKEGLFCDLLWSDPVSVEY

SEQ ID NO: 3012279 - protein, 24 aa, Entamoeba invadens
PKEIKYIFARLRTAVEKKFAGSGT

SEQ ID NO: 3012280 - protein, 23 aa, Entamoeba invadens
PKEKLDIIFSHFDDVLSFNTALF

SEQ ID NO: 3012281 - protein, 25 aa, Entamoeba invadens
PKEKNFYTFFSFRDKAKVSGWRLDY

SEQ ID NO: 3012282 - protein, 22 aa, Entamoeba invadens
PKELKLIKMVKLLKSNFEKGNQ

SEQ ID NO: 3012283 - protein, 28 aa, Entamoeba invadens
PKELLKPYVMYFVNGLLVFCNAQAFDLK

SEQ ID NO: 3012284 - protein, 22 aa, Entamoeba invadens
PKELVILAIKVLTKLPFDEETM

SEQ ID NO: 3012285 - protein, 25 aa, Entamoeba invadens
PKEPIFSTSFFYRTIQRAISIYTGK

SEQ ID NO: 3012286 - protein, 22 aa, Entamoeba invadens
PKEPRVSLSAKKPSRRLSMRLK

SEQ ID NO: 3012287 - protein, 24 aa, Entamoeba invadens
PKEPSLLPLLSPFLDKMLLTTTVV

SEQ ID NO: 3012288 - protein, 35 aa, Entamoeba invadens
PKETIYELLSAYCMPFLLYKQTILVNRDLLMKHTS

SEQ ID NO: 3012289 - protein, 23 aa, Entamoeba invadens
PKETRVLLYTLFRNLASTSHNPD

SEQ ID NO: 3012290 - protein, 21 aa, Entamoeba invadens
PKEVRLLKKSTFFKCVSLEKV

SEQ ID NO: 3012291 - protein, 23 aa, Entamoeba invadens
PKEYGLFEHTGDKRYFDFSEIRD

SEQ ID NO: 3012292 - protein, 25 aa, Entamoeba invadens
PKEYIKRFFQFIRKIVRTKIEHLFK

SEQ ID NO: 3012293 - protein, 23 aa, Entamoeba invadens
PKEYSGFRFLSLANELVIFGVYV

SEQ ID NO: 3012294 - protein, 28 aa, Entamoeba invadens
PKFAKHLFSMLCHIGFVSGDDLFGEHLG

SEQ ID NO: 3012295 - protein, 19 aa, Entamoeba invadens
PKFFFEFVTKYEQSGGCIA

SEQ ID NO: 3012296 - protein, 23 aa, Entamoeba invadens
PKFNVLLTTFELVIKDQGLLNLY

SEQ ID NO: 3012297 - protein, 21 aa, Entamoeba invadens
PKGELHIQIIFGPNTIQQQSY

SEQ ID NO: 3012298 - protein, 23 aa, Entamoeba invadens
PKGFIENMFFVSANPWVSFTSFD

SEQ ID NO: 3012299 - protein, 25 aa, Entamoeba invadens
PKGKITNNLLLFSNIKIAKEHKTDD

SEQ ID NO: 3012300 - protein, 26 aa, Entamoeba invadens
PKGSFVGIFYPNRAEWVLVCQGLIRM

SEQ ID NO: 3012301 - protein, 25 aa, Entamoeba invadens
PKGSPIIVRFIIDSSGLFTVEAKME

SEQ ID NO: 3012302 - protein, 17 aa, Entamoeba invadens
PKGTYSPSPGSANCIEC

SEQ ID NO: 3012303 - protein, 24 aa, Entamoeba invadens
PKHAVESFVIFNESAFAFCVPYAF

SEQ ID NO: 3012304 - protein, 25 aa, Entamoeba invadens
PKHCFVFCQWLTHVELPNTLYALRA

SEQ ID NO: 3012305 - protein, 31 aa, Entamoeba invadens
PKHEYVMAPSVPYVPMSVPIPSPNSPRSCGS

SEQ ID NO: 3012306 - protein, 31 aa, Entamoeba invadens
PKHKENCRVALLDFSLMKEKMRPGVQLVLTD

SEQ ID NO: 3012307 - protein, 20 aa, Entamoeba invadens
PKIANLFTYYPQDYVKNIVE

SEQ ID NO: 3012308 - protein, 24 aa, Entamoeba invadens
PKIDSEIPPPPYSDNPPHKEEEFS

SEQ ID NO: 3012309 - protein, 18 aa, Entamoeba invadens
PKIFYQMYTINCMLKNGE

SEQ ID NO: 3012310 - protein, 17 aa, Entamoeba invadens
PKIISNFNNKQLRQIKL

SEQ ID NO: 3012311 - protein, 28 aa, Entamoeba invadens
PKINYPCYLSFMREYAPSIPPASLTSFQ

SEQ ID NO: 3012312 - protein, 28 aa, Entamoeba invadens
PKISTEVLQRWILELGASIKKTYKDADT

SEQ ID NO: 3012313 - protein, 27 aa, Entamoeba invadens
PKITNKQLALLLPQYISKVAQQKIETR

SEQ ID NO: 3012314 - protein, 20 aa, Entamoeba invadens
PKKIVIFDINGSLHSGREDI

SEQ ID NO: 3012315 - protein, 25 aa, Entamoeba invadens
PKKPASAYLLYCQEVRPSVKEKNPE

SEQ ID NO: 3012316 - protein, 17 aa, Entamoeba invadens
PKKRLLTKPMKIDWTFY

SEQ ID NO: 3012317 - protein, 29 aa, Entamoeba invadens
PKLFLPTITKIFKRLFRVYAHMFYSHEKH

SEQ ID NO: 3012318 - protein, 24 aa, Entamoeba invadens
PKLHCPLFVISFPRSGSTFLHNLL

SEQ ID NO: 3012319 - protein, 26 aa, Entamoeba invadens
PKLKKEIAVPIFLNNLKEKLNKGSEL

SEQ ID NO: 3012320 - protein, 21 aa, Entamoeba invadens
PKLTNLPPFESLTLLISCFGQ

SEQ ID NO: 3012321 - protein, 21 aa, Entamoeba invadens
PKLVEGMKRLSRSDPLCLCYT

SEQ ID NO: 3012322 - protein, 18 aa, Entamoeba invadens
PKMFGLSNIQKEIYPYKY

SEQ ID NO: 3012323 - protein, 26 aa, Entamoeba invadens
PKNDQPIPIPPVNPTIAPTVAPPAMF

SEQ ID NO: 3012324 - protein, 25 aa, Entamoeba invadens
PKNEKLLKFIFMHPPKHDDRKDEEG

SEQ ID NO: 3012325 - protein, 24 aa, Entamoeba invadens
PKNQKIRVPFKKQNNLKKNTAKSK

SEQ ID NO: 3012326 - protein, 25 aa, Entamoeba invadens
PKNTNFFLERTLKTKWFPSKVRKLK

SEQ ID NO: 3012327 - protein, 19 aa, Entamoeba invadens
PKNVVDVLGFLYFVVIEKM

SEQ ID NO: 3012328 - protein, 19 aa, Entamoeba invadens
PKNWLATHTKMVFDEGLPV

SEQ ID NO: 3012329 - protein, 22 aa, Entamoeba invadens
PKPDDAYALSLLPLVHVFSNGF

SEQ ID NO: 3012330 - protein, 31 aa, Entamoeba invadens
PKPFGGIQVILCGDFFQLPPVSSDGLKRFAF

SEQ ID NO: 3012331 - protein, 34 aa, Entamoeba invadens
PKPNTFRPKEIAALFFKTLMNQIKMEVPDLVRPN

SEQ ID NO: 3012332 - protein, 30 aa, Entamoeba invadens
PKPSAIEIYPPFVPFLDMGFNISFRVDDME

SEQ ID NO: 3012333 - protein, 26 aa, Entamoeba invadens
PKQEPKKWWKFAFEATRIKYTHTLFR

SEQ ID NO: 3012334 - protein, 27 aa, Entamoeba invadens
PKQNELPNYYYYSLSDQETFFVPDNKS

SEQ ID NO: 3012335 - protein, 25 aa, Entamoeba invadens
PKRDEFRPRSVLIGKVPPLSGKIDL

SEQ ID NO: 3012336 - protein, 46 aa, Entamoeba invadens
PKREEKILVKVLPKYFAFIQENPQTLIPRFYGMYRIKPKHGDEYRY

SEQ ID NO: 3012337 - protein, 23 aa, Entamoeba invadens
PKRPPTMQIGFKKEGKPKVGETK

SEQ ID NO: 3012338 - protein, 25 aa, Entamoeba invadens
PKRSPKKKALPKKRKLPAPKKPVQK

SEQ ID NO: 3012339 - protein, 17 aa, Entamoeba invadens
PKRWYKNIGLGFVTPDE

SEQ ID NO: 3012340 - protein, 23 aa, Entamoeba invadens
PKSASKYDLLIQIASETLTPQTP

SEQ ID NO: 3012341 - protein, 21 aa, Entamoeba invadens
PKSIEFFKIPNYKVVMERELR

SEQ ID NO: 3012342 - protein, 23 aa, Entamoeba invadens
PKSLKSVLLVLPSLFNVMVAGFL

SEQ ID NO: 3012343 - protein, 21 aa, Entamoeba invadens
PKSLKTIFISTIIPELINLQN

SEQ ID NO: 3012344 - protein, 19 aa, Entamoeba invadens
PKSLLPEGIYPYTTDPQKG

SEQ ID NO: 3012345 - protein, 20 aa, Entamoeba invadens
PKSLPTDFVFGCAVPLCTST

SEQ ID NO: 3012346 - protein, 29 aa, Entamoeba invadens
PKSNLKYKLYQMLFKLLREKNESLSVFDD

SEQ ID NO: 3012347 - protein, 23 aa, Entamoeba invadens
PKSPPITLYYPNKQIKTVKVSPP

SEQ ID NO: 3012348 - protein, 32 aa, Entamoeba invadens
PKSTPQNTFNLLFFMRTVFPVFHAPQHVMDTI

SEQ ID NO: 3012349 - protein, 26 aa, Entamoeba invadens
PKTDFLTRYLIVLHILFGALQNRETV

SEQ ID NO: 3012350 - protein, 25 aa, Entamoeba invadens
PKTKKLRLIDWGLAEFYKPGTQYNV

SEQ ID NO: 3012351 - protein, 18 aa, Entamoeba invadens
PKTLKRFALVGVYSDLPK

SEQ ID NO: 3012352 - protein, 17 aa, Entamoeba invadens
PKTPVIKRKSPKLSQST

SEQ ID NO: 3012353 - protein, 27 aa, Entamoeba invadens
PKTQKIKPLLDWFVLHSNHPYPTEEQK

SEQ ID NO: 3012354 - protein, 29 aa, Entamoeba invadens
PKTTRELLWKFLVTMKMTYLTKLVTMNNE

SEQ ID NO: 3012355 - protein, 17 aa, Entamoeba invadens
PKTVCYKEWLTCTWSKD

SEQ ID NO: 3012356 - protein, 25 aa, Entamoeba invadens
PKTVGCIDYQILYDAFFKNQKKEKM

SEQ ID NO: 3012357 - protein, 23 aa, Entamoeba invadens
PKVELLFVGFPRELERSTICECH

SEQ ID NO: 3012358 - protein, 24 aa, Entamoeba invadens
PKVWGKKQCPPPFPLPTDAKEFIE

SEQ ID NO: 3012359 - protein, 28 aa, Entamoeba invadens
PKYYKHTNFCGFTRQLTLYGFKKVCINN

SEQ ID NO: 3012360 - protein, 18 aa, Entamoeba invadens
PLAFWVFDIKGVEDAIAL

SEQ ID NO: 3012361 - protein, 19 aa, Entamoeba invadens
PLARSWTFWVDDFAIKNAS

SEQ ID NO: 3012362 - protein, 25 aa, Entamoeba invadens
PLASPLLKRIFLIASRPDRQNDREE

SEQ ID NO: 3012363 - protein, 20 aa, Entamoeba invadens
PLAVMRNIFTYLTQTDIEPF

SEQ ID NO: 3012364 - protein, 22 aa, Entamoeba invadens
PLAVYSFVPIAPLVYEELKGEL

SEQ ID NO: 3012365 - protein, 42 aa, Entamoeba invadens
PLCDKQQMLLQQPQPFQWLFIARVIMFSLKRKMGKQDFFTIN

SEQ ID NO: 3012366 - protein, 18 aa, Entamoeba invadens
PLDALRPAIVMFVGFYHK

SEQ ID NO: 3012367 - protein, 18 aa, Entamoeba invadens
PLDEHIVEQYKAPPNPPE

SEQ ID NO: 3012368 - protein, 27 aa, Entamoeba invadens
PLDGKLLFQELLLKNVFCVFICTRGNP

SEQ ID NO: 3012369 - protein, 28 aa, Entamoeba invadens
PLDLIQPPMLRIKAFEPLFVIGKEYYAQ

SEQ ID NO: 3012370 - protein, 37 aa, Entamoeba invadens
PLDMHKPLYQQFPIIHTYLLKPFTFVPMRISSDYLVN

SEQ ID NO: 3012371 - protein, 28 aa, Entamoeba invadens
PLDTIEKLRRWILCSSQMFSLFGGDWRR

SEQ ID NO: 3012372 - protein, 24 aa, Entamoeba invadens
PLDVSVLLFKAFGTSSLTLIERVK

SEQ ID NO: 3012373 - protein, 17 aa, Entamoeba invadens
PLDVYICLSHYKIIQKL

SEQ ID NO: 3012374 - protein, 25 aa, Entamoeba invadens
PLEEKRVLLFAPLSTTTGHIAMDGM

SEQ ID NO: 3012375 - protein, 24 aa, Entamoeba invadens
PLEHTFLIKQYMLLFRGDFATNLI

SEQ ID NO: 3012376 - protein, 17 aa, Entamoeba invadens
PLELFKEWKSGMPLAMV

SEQ ID NO: 3012377 - protein, 19 aa, Entamoeba invadens
PLELYKKLYDGESFNFNLL

SEQ ID NO: 3012378 - protein, 26 aa, Entamoeba invadens
PLEQMLPILKMFSQTPSYPILVKNNK

SEQ ID NO: 3012379 - protein, 22 aa, Entamoeba invadens
PLERLLALRKQSVIDYLFEEKE

SEQ ID NO: 3012380 - protein, 24 aa, Entamoeba invadens
PLEVTILPHPLTQTNFITLVGTLP

SEQ ID NO: 3012381 - protein, 20 aa, Entamoeba invadens
PLEVYLDFIYCGFITIKMPF

SEQ ID NO: 3012382 - protein, 19 aa, Entamoeba invadens
PLFDPALINIEGDGIPKSI

SEQ ID NO: 3012383 - protein, 20 aa, Entamoeba invadens
PLFMAKTKRNWLSDGQLNSI

SEQ ID NO: 3012384 - protein, 18 aa, Entamoeba invadens
PLFPIKNKINTEVVTKKN

SEQ ID NO: 3012385 - protein, 26 aa, Entamoeba invadens
PLFRKRRLLLLAEYLKDFTLSPEEKV

SEQ ID NO: 3012386 - protein, 30 aa, Entamoeba invadens
PLFSFTTSFFKNTNSIFLVYTKSSQKTADH

SEQ ID NO: 3012387 - protein, 18 aa, Entamoeba invadens
PLGGVRISFGFLSTFEEG

SEQ ID NO: 3012388 - protein, 19 aa, Entamoeba invadens
PLGITEKTFVFSTAAFAFV

SEQ ID NO: 3012389 - protein, 19 aa, Entamoeba invadens
PLGNFFLCHGGLSPSLHSV

SEQ ID NO: 3012390 - protein, 23 aa, Entamoeba invadens
PLGPQRITALGRNYHPEHFVCFN

SEQ ID NO: 3012391 - protein, 25 aa, Entamoeba invadens
PLGVFQVVMFYMKSSEIKIVAFAMI

SEQ ID NO: 3012392 - protein, 27 aa, Entamoeba invadens
PLHLLQTGWTYWFDPGTNQVFSTSGVT

SEQ ID NO: 3012393 - protein, 18 aa, Entamoeba invadens
PLHMRYGIEEMKGLQIPN

SEQ ID NO: 3012394 - protein, 21 aa, Entamoeba invadens
PLHTSIFFNKVEFIDNLIIDY

SEQ ID NO: 3012395 - protein, 20 aa, Entamoeba invadens
PLHVFSSFHVICYDLMEVII

SEQ ID NO: 3012396 - protein, 18 aa, Entamoeba invadens
PLIALQSALESNLIKVVR

SEQ ID NO: 3012397 - protein, 17 aa, Entamoeba invadens
PLIKISPLFVEPEKLSN

SEQ ID NO: 3012398 - protein, 24 aa, Entamoeba invadens
PLIKSDLIFFTPRKKINANSESAK

SEQ ID NO: 3012399 - protein, 19 aa, Entamoeba invadens
PLINLNCFDLFYKVKQIRN

SEQ ID NO: 3012400 - protein, 21 aa, Entamoeba invadens
PLIQELLITFITTYPLEKTQY

SEQ ID NO: 3012401 - protein, 20 aa, Entamoeba invadens
PLKGTFYAITLNGLAYCTRK

SEQ ID NO: 3012402 - protein, 17 aa, Entamoeba invadens
PLKIIGKSLLNDTLFVR

SEQ ID NO: 3012403 - protein, 22 aa, Entamoeba invadens
PLKKENVLSTLPKKVASPPTKV

SEQ ID NO: 3012404 - protein, 28 aa, Entamoeba invadens
PLKKSKLTIPFLKIIQFTSDDSQPVYFN

SEQ ID NO: 3012405 - protein, 47 aa, Entamoeba invadens
PLKNKKKFFPNIETLYLYNKSDKKIPGYFKYFYDYKVSYQQFLSFQT

SEQ ID NO: 3012406 - protein, 26 aa, Entamoeba invadens
PLKNKKRSLSFKKLSLFSFKKDEDSH

SEQ ID NO: 3012407 - protein, 17 aa, Entamoeba invadens
PLKPVFPELFKYKCIDI

SEQ ID NO: 3012408 - protein, 22 aa, Entamoeba invadens
PLKRREMFFKILLGVDTYESGE

SEQ ID NO: 3012409 - protein, 27 aa, Entamoeba invadens
PLKSCPLTLLLRYLETLTGFAITSESL

SEQ ID NO: 3012410 - protein, 31 aa, Entamoeba invadens
PLKSLLFSHKVYWLLRGATLLQMEAIESLAE

SEQ ID NO: 3012411 - protein, 21 aa, Entamoeba invadens
PLKVLNKLGILKLFSELNQIG

SEQ ID NO: 3012412 - protein, 24 aa, Entamoeba invadens
PLKVPPHTLPITPGKFQEISIGAG

SEQ ID NO: 3012413 - protein, 17 aa, Entamoeba invadens
PLLFNQVSLRAQVGFIF

SEQ ID NO: 3012414 - protein, 28 aa, Entamoeba invadens
PLLIKFENYFIATKYKFGVLYAAAGQTT

SEQ ID NO: 3012415 - protein, 17 aa, Entamoeba invadens
PLLLSYLSFGKEVAKNV

SEQ ID NO: 3012416 - protein, 17 aa, Entamoeba invadens
PLLNSLKMKFCPFCDIK

SEQ ID NO: 3012417 - protein, 17 aa, Entamoeba invadens
PLLTQTEKQLPIEQKIE

SEQ ID NO: 3012418 - protein, 17 aa, Entamoeba invadens
PLLVMEASGIHDTTHNS

SEQ ID NO: 3012419 - protein, 19 aa, Entamoeba invadens
PLMGDDFYKNLQFLKMEMA

SEQ ID NO: 3012420 - protein, 17 aa, Entamoeba invadens
PLMVKLILDIDNFEDVK

SEQ ID NO: 3012421 - protein, 17 aa, Entamoeba invadens
PLMYQRFSQFKDFVFYS

SEQ ID NO: 3012422 - protein, 19 aa, Entamoeba invadens
PLNERMIFSQIVKAVNKEN

SEQ ID NO: 3012423 - protein, 20 aa, Entamoeba invadens
PLNHAIIKYFDHLETLHLYN

SEQ ID NO: 3012424 - protein, 17 aa, Entamoeba invadens
PLNIRPNQPPKVLFQSL

SEQ ID NO: 3012425 - protein, 17 aa, Entamoeba invadens
PLNIWNFCFGDGLKVRR

SEQ ID NO: 3012426 - protein, 17 aa, Entamoeba invadens
PLNLPDPFGKKALKLEY

SEQ ID NO: 3012427 - protein, 25 aa, Entamoeba invadens
PLNLRDLFVLLSRYFNDVVPREGAG

SEQ ID NO: 3012428 - protein, 19 aa, Entamoeba invadens
PLPCFFQISELFAMDLLQY

SEQ ID NO: 3012429 - protein, 20 aa, Entamoeba invadens
PLPDRIWERRMKSDVYRHNN

SEQ ID NO: 3012430 - protein, 30 aa, Entamoeba invadens
PLPEYLVGFSLFMSITTYGIHLDKFCVRYS

SEQ ID NO: 3012431 - protein, 21 aa, Entamoeba invadens
PLPPKKPAPKPGLKKNHSALQ

SEQ ID NO: 3012432 - protein, 17 aa, Entamoeba invadens
PLPPKPKFKRQLPKTEV

SEQ ID NO: 3012433 - protein, 17 aa, Entamoeba invadens
PLPSLEYSQPKSPRKTV

SEQ ID NO: 3012434 - protein, 30 aa, Entamoeba invadens
PLPSLQELYNLFFRNVLSETFIVFHCEFST

SEQ ID NO: 3012435 - protein, 35 aa, Entamoeba invadens
PLQNTLHELWALLQFLLPGIFRISQLDGIFDSIES

SEQ ID NO: 3012436 - protein, 29 aa, Entamoeba invadens
PLQNTLKELWSLLHFLHPEQFPNFEDFEK

SEQ ID NO: 3012437 - protein, 27 aa, Entamoeba invadens
PLQQNYPVYYTPSPIPLYQQPSSPPYE

SEQ ID NO: 3012438 - protein, 19 aa, Entamoeba invadens
PLQSKKLVDLLAAAAIRGV

SEQ ID NO: 3012439 - protein, 25 aa, Entamoeba invadens
PLRAYLTSLPYFDKYVQSKLYDYKE

SEQ ID NO: 3012440 - protein, 27 aa, Entamoeba invadens
PLRKLGDYFVLKQLVCAMHHMSWEQMA

SEQ ID NO: 3012441 - protein, 31 aa, Entamoeba invadens
PLRLDFHSLPILPLLDLTPSLPLHILFENVN

SEQ ID NO: 3012442 - protein, 19 aa, Entamoeba invadens
PLRTLRESFFTDTDGNRPT

SEQ ID NO: 3012443 - protein, 17 aa, Entamoeba invadens
PLRWYYHCDQMGILVWQ

SEQ ID NO: 3012444 - protein, 19 aa, Entamoeba invadens
PLSIDVPRFKEDTPLGLVF

SEQ ID NO: 3012445 - protein, 19 aa, Entamoeba invadens
PLSKKALFFTSLKTVANCI

SEQ ID NO: 3012446 - protein, 19 aa, Entamoeba invadens
PLSKLYIIVERECTMLSHK

SEQ ID NO: 3012447 - protein, 20 aa, Entamoeba invadens
PLSKQLIEQINTAVPLEGKG

SEQ ID NO: 3012448 - protein, 26 aa, Entamoeba invadens
PLSLVDPLIHLLPRKEAPKFQTASQK

SEQ ID NO: 3012449 - protein, 20 aa, Entamoeba invadens
PLSMTIFSAIDYFQKNQGSC

SEQ ID NO: 3012450 - protein, 27 aa, Entamoeba invadens
PLSRCLFLRIVSLPQFVEMLSALFLQR

SEQ ID NO: 3012451 - protein, 33 aa, Entamoeba invadens
PLSRLIDMCIVLDKRFKVLTERRLDMDAAHDKF

SEQ ID NO: 3012452 - protein, 19 aa, Entamoeba invadens
PLSSLQNLKVLLLAGNLIS

SEQ ID NO: 3012453 - protein, 24 aa, Entamoeba invadens
PLSSPPHFHPFRKLTHSVTYSSDF

SEQ ID NO: 3012454 - protein, 19 aa, Entamoeba invadens
PLSYLLPRGQQVKVITQLY

SEQ ID NO: 3012455 - protein, 25 aa, Entamoeba invadens
PLTARDYSYFTIIPEISDELNSLSE

SEQ ID NO: 3012456 - protein, 18 aa, Entamoeba invadens
PLTHFQCFLGFVDNNILK

SEQ ID NO: 3012457 - protein, 24 aa, Entamoeba invadens
PLTNITIKYFPQIETLHIWNLEDE

SEQ ID NO: 3012458 - protein, 26 aa, Entamoeba invadens
PLTNSFNLVFLSLSLNKLQCIPREFS

SEQ ID NO: 3012459 - protein, 22 aa, Entamoeba invadens
PLTPDWKSYKLPISKKGTLVVE

SEQ ID NO: 3012460 - protein, 25 aa, Entamoeba invadens
PLTPQNLKIFAYIKTFNVYTTYYFK

SEQ ID NO: 3012461 - protein, 19 aa, Entamoeba invadens
PLTQITFSQKVFPKLREFN

SEQ ID NO: 3012462 - protein, 24 aa, Entamoeba invadens
PLTQKILKHFPRLESLNIWEECEE

SEQ ID NO: 3012463 - protein, 25 aa, Entamoeba invadens
PLTQQFYYNNSYINPPHLNCPVHLN

SEQ ID NO: 3012464 - protein, 32 aa, Entamoeba invadens
PLTSLKLKNYIPLLVAKKLNFLKSLFGQNVQH

SEQ ID NO: 3012465 - protein, 26 aa, Entamoeba invadens
PLTVDPTIQIAPPLRQVALSLNHSET

SEQ ID NO: 3012466 - protein, 20 aa, Entamoeba invadens
PLVFPCPSLTKYKTLNKSTI

SEQ ID NO: 3012467 - protein, 21 aa, Entamoeba invadens
PLVVFKYIEACARAGQFQELA

SEQ ID NO: 3012468 - protein, 19 aa, Entamoeba invadens
PLYMDKRSFYIFGTDQKNV

SEQ ID NO: 3012469 - protein, 18 aa, Entamoeba invadens
PLYQRTFTTFAKLWKLQQ

SEQ ID NO: 3012470 - protein, 19 aa, Entamoeba invadens
PLYSCISAFYEEKLDSVYF

SEQ ID NO: 3012471 - protein, 19 aa, Entamoeba invadens
PMCGPFKKTIIYTEAPFLI

SEQ ID NO: 3012472 - protein, 23 aa, Entamoeba invadens
PMDKEIMDIWNKATVKLVRRTSV

SEQ ID NO: 3012473 - protein, 19 aa, Entamoeba invadens
PMDLTKTVKRPLPKPPLST

SEQ ID NO: 3012474 - protein, 18 aa, Entamoeba invadens
PMETPYYHNLIPTNEKGL

SEQ ID NO: 3012475 - protein, 17 aa, Entamoeba invadens
PMEYTTVERILFEKEID

SEQ ID NO: 3012476 - protein, 18 aa, Entamoeba invadens
PMFQTIPIPQQQSQQVPQ

SEQ ID NO: 3012477 - protein, 18 aa, Entamoeba invadens
PMFTLCQIIFERYFINEN

SEQ ID NO: 3012478 - protein, 17 aa, Entamoeba invadens
PMGQAIVEGLRGLLTST

SEQ ID NO: 3012479 - protein, 23 aa, Entamoeba invadens
PMGRISLATLPPSSTIQLASLPP

SEQ ID NO: 3012480 - protein, 18 aa, Entamoeba invadens
PMGYKVIGGDQYRLPLYL

SEQ ID NO: 3012481 - protein, 19 aa, Entamoeba invadens
PMICTFNPEGFYITPNQNT

SEQ ID NO: 3012482 - protein, 32 aa, Entamoeba invadens
PMIQPSPQLLQKWYYPLIKSIKLEQYNKIFSW

SEQ ID NO: 3012483 - protein, 17 aa, Entamoeba invadens
PMKNAFKYFVPATGKFE

SEQ ID NO: 3012484 - protein, 25 aa, Entamoeba invadens
PMKNEEAFYLVFEKIIMSKSCESLR

SEQ ID NO: 3012485 - protein, 21 aa, Entamoeba invadens
PMKVVITNIIGLLATVNAVNL

SEQ ID NO: 3012486 - protein, 21 aa, Entamoeba invadens
PMLQSVVDTFWAVGTPASEIE

SEQ ID NO: 3012487 - protein, 25 aa, Entamoeba invadens
PMNIDAVPELVWKGSVTFTEQGQLC

SEQ ID NO: 3012488 - protein, 30 aa, Entamoeba invadens
PMNKELCPGLHIFPFCITLPEDLSPDISLF

SEQ ID NO: 3012489 - protein, 19 aa, Entamoeba invadens
PMRFKQMYTPHLLEEETRA

SEQ ID NO: 3012490 - protein, 18 aa, Entamoeba invadens
PMSLTELRKTWTETETAQ

SEQ ID NO: 3012491 - protein, 23 aa, Entamoeba invadens
PMTINNLLYTTAPVDLFGIVKEQ

SEQ ID NO: 3012492 - protein, 18 aa, Entamoeba invadens
PMTPPIEREVLFSTTKAP

SEQ ID NO: 3012493 - protein, 24 aa, Entamoeba invadens
PMTQSILLAGHLYQTVFKDELNSC

SEQ ID NO: 3012494 - protein, 25 aa, Entamoeba invadens
PMVKSDTFVPAFSVKKSREFLEESF

SEQ ID NO: 3012495 - protein, 17 aa, Entamoeba invadens
PMYAMGQPNPVVQQPQQ

SEQ ID NO: 3012496 - protein, 20 aa, Entamoeba invadens
PMYCGKLKQRAYNQPLNEMA

SEQ ID NO: 3012497 - protein, 25 aa, Entamoeba invadens
PMYNFVIPVYGILFKKILNVVKQLL

SEQ ID NO: 3012498 - protein, 18 aa, Entamoeba invadens
PNAARTLHQTKGKGFQKS

SEQ ID NO: 3012499 - protein, 22 aa, Entamoeba invadens
PNAFVKIQPLRIKLETPFVHHV

SEQ ID NO: 3012500 - protein, 25 aa, Entamoeba invadens
PNANTDFVITLFKKIGQVNNTIKIV

SEQ ID NO: 3012501 - protein, 22 aa, Entamoeba invadens
PNAPFPALVNEPFVPTPIGVSV

SEQ ID NO: 3012502 - protein, 17 aa, Entamoeba invadens
PNAVKNRFFGHLNKFHK

SEQ ID NO: 3012503 - protein, 26 aa, Entamoeba invadens
PNAVVNIFCPNPFFIRSIDKDGKDTT

SEQ ID NO: 3012504 - protein, 17 aa, Entamoeba invadens
PNCCFDDFLVYDKLLQN

SEQ ID NO: 3012505 - protein, 20 aa, Entamoeba invadens
PNCEYPPLRVGSPIVRENYR

SEQ ID NO: 3012506 - protein, 24 aa, Entamoeba invadens
PNDCKRWFWELVQNAKDSISQTGQ

SEQ ID NO: 3012507 - protein, 25 aa, Entamoeba invadens
PNDCKRWFWELVQNAKDSLSQTGQK

SEQ ID NO: 3012508 - protein, 29 aa, Entamoeba invadens
PNDDAVCFCILYGLARRLVKYQKIHLMTS

SEQ ID NO: 3012509 - protein, 26 aa, Entamoeba invadens
PNDGNVFKVLIVSSLRLKKDVTKYHD

SEQ ID NO: 3012510 - protein, 24 aa, Entamoeba invadens
PNDKALVYLTIWYNIITSRHSVEF

SEQ ID NO: 3012511 - protein, 17 aa, Entamoeba invadens
PNDKIIFEILTQQIVDG

SEQ ID NO: 3012512 - protein, 23 aa, Entamoeba invadens
PNDKLFDCLFDRFYDVNSFVRIK

SEQ ID NO: 3012513 - protein, 26 aa, Entamoeba invadens
PNDLNELLKLIWWYDDERSKKYIIKF

SEQ ID NO: 3012514 - protein, 20 aa, Entamoeba invadens
PNDMLIIMTDGFHDNFDPQF

SEQ ID NO: 3012515 - protein, 24 aa, Entamoeba invadens
PNDQRFLSRIYFIASLHYGTRILS

SEQ ID NO: 3012516 - protein, 33 aa, Entamoeba invadens
PNDTEGYKIFLTTFLLVLYSYNPDHARLGLIVS

SEQ ID NO: 3012517 - protein, 23 aa, Entamoeba invadens
PNEDDAFPFLKEQNGGVTIEINV

SEQ ID NO: 3012518 - protein, 38 aa, Entamoeba invadens
PNEFSLILFEQRMFFMTKYFRTMAFWVFKAILENDLRT

SEQ ID NO: 3012519 - protein, 17 aa, Entamoeba invadens
PNEFVFVSFVESLYKVN

SEQ ID NO: 3012520 - protein, 23 aa, Entamoeba invadens
PNEFYKIQFFDALMLKNEYNKIF

SEQ ID NO: 3012521 - protein, 29 aa, Entamoeba invadens
PNETVVDKVILRFLIKSEENERWIDCGTE

SEQ ID NO: 3012522 - protein, 23 aa, Entamoeba invadens
PNEYLFKLNVFSRDYTSLAYMVE

SEQ ID NO: 3012523 - protein, 28 aa, Entamoeba invadens
PNFCYICNDNYYLANRILPECVPCKNAI

SEQ ID NO: 3012524 - protein, 27 aa, Entamoeba invadens
PNFMFYSELIELFYFPDDIVNGIQPNY

SEQ ID NO: 3012525 - protein, 27 aa, Entamoeba invadens
PNFQEVILMYLVPLQLRRGKYVPRDLL

SEQ ID NO: 3012526 - protein, 26 aa, Entamoeba invadens
PNGGFNIPGLTFNFSMPLTTTTAPQP

SEQ ID NO: 3012527 - protein, 25 aa, Entamoeba invadens
PNGKIIFSAIKIMTQLILLSFPSQE

SEQ ID NO: 3012528 - protein, 19 aa, Entamoeba invadens
PNGMIELFSNVVFVANLPE

SEQ ID NO: 3012529 - protein, 24 aa, Entamoeba invadens
PNGTKLKMKFTNKQKEFRLEDYSV

SEQ ID NO: 3012530 - protein, 17 aa, Entamoeba invadens
PNGYYLNKNSCEKCVND

SEQ ID NO: 3012531 - protein, 17 aa, Entamoeba invadens
PNIALLKKVSYTKHILN

SEQ ID NO: 3012532 - protein, 21 aa, Entamoeba invadens
PNIEYFHYYLHFRNYQSDVEV

SEQ ID NO: 3012533 - protein, 23 aa, Entamoeba invadens
PNIKLFSFIGREVQLFGLKSGGD

SEQ ID NO: 3012534 - protein, 17 aa, Entamoeba invadens
PNIPEWIPGHILLTGHT

SEQ ID NO: 3012535 - protein, 24 aa, Entamoeba invadens
PNISGSIMHAILVKYKADKKTPVD

SEQ ID NO: 3012536 - protein, 30 aa, Entamoeba invadens
PNISLSLMEFIGYFESLKGIMPPVVGGEEW

SEQ ID NO: 3012537 - protein, 31 aa, Entamoeba invadens
PNISLSLMEFIGYFESLKGIMPPVVGGEEWP

SEQ ID NO: 3012538 - protein, 23 aa, Entamoeba invadens
PNISYICSRYYRAPELIFDCTHY

SEQ ID NO: 3012539 - protein, 20 aa, Entamoeba invadens
PNITNPMYAMGQPNPVVQQP

SEQ ID NO: 3012540 - protein, 25 aa, Entamoeba invadens
PNKCLLCAQNYFTKNKLCESCSTLN

SEQ ID NO: 3012541 - protein, 19 aa, Entamoeba invadens
PNKCLLCAQNYLTKNELCE

SEQ ID NO: 3012542 - protein, 28 aa, Entamoeba invadens
PNKKPAPPPPHKQLPPKLPHKEVNQQQQ

SEQ ID NO: 3012543 - protein, 27 aa, Entamoeba invadens
PNKLSSVRLLLLPSYNIKSNTFEMRKR

SEQ ID NO: 3012544 - protein, 31 aa, Entamoeba invadens
PNKPKKPQTAYMLYLNEHRAEIKEKFPDMKV

SEQ ID NO: 3012545 - protein, 24 aa, Entamoeba invadens
PNKPKYEILTKEDIYNLFLDEINT

SEQ ID NO: 3012546 - protein, 27 aa, Entamoeba invadens
PNKSMFGALFFEKVTQMALLKTSMNTT

SEQ ID NO: 3012547 - protein, 28 aa, Entamoeba invadens
PNKSVLYNKLPFWVPKEIYRLTDYIIKN

SEQ ID NO: 3012548 - protein, 23 aa, Entamoeba invadens
PNKTLLYFKTKLSKKRQAEISEN

SEQ ID NO: 3012549 - protein, 21 aa, Entamoeba invadens
PNLEQLTLLSMLDFSFNKIND

SEQ ID NO: 3012550 - protein, 21 aa, Entamoeba invadens
PNLFPKVLAIINTLKTSKSSI

SEQ ID NO: 3012551 - protein, 17 aa, Entamoeba invadens
PNLMKKDKRLTVQMLQE

SEQ ID NO: 3012552 - protein, 25 aa, Entamoeba invadens
PNLPVAMNGYIFKVIKLLKEKDLSG

SEQ ID NO: 3012553 - protein, 27 aa, Entamoeba invadens
PNLTMIPGGVFVTFKIKGELRGCIGCF

SEQ ID NO: 3012554 - protein, 23 aa, Entamoeba invadens
PNLYVDLLNHLLHLLPTANVNLK

SEQ ID NO: 3012555 - protein, 23 aa, Entamoeba invadens
PNMPFDFVFNEKIDFTIYKLLKN

SEQ ID NO: 3012556 - protein, 21 aa, Entamoeba invadens
PNMRYYCLHLIDSFQHRGLNG

SEQ ID NO: 3012557 - protein, 18 aa, Entamoeba invadens
PNNGLMFGLFQLVGSTLS

SEQ ID NO: 3012558 - protein, 23 aa, Entamoeba invadens
PNPANWLELVQNSFYVNPVEIKE

SEQ ID NO: 3012559 - protein, 23 aa, Entamoeba invadens
PNPGFIIQLYQFQIKMGIKDTTE

SEQ ID NO: 3012560 - protein, 20 aa, Entamoeba invadens
PNPLFPVMFVHCKGDEFYGV

SEQ ID NO: 3012561 - protein, 24 aa, Entamoeba invadens
PNPMKKDRMLTEVQFNLDEANNTK

SEQ ID NO: 3012562 - protein, 23 aa, Entamoeba invadens
PNQKICVVQFSKDVKILGDCTHN

SEQ ID NO: 3012563 - protein, 24 aa, Entamoeba invadens
PNQLCKIFLHLVETVALLHSSDSF

SEQ ID NO: 3012564 - protein, 27 aa, Entamoeba invadens
PNQLDTLYLHYCSFAISGEVCVKKLAL

SEQ ID NO: 3012565 - protein, 23 aa, Entamoeba invadens
PNQYFYCLHCDKWFKKSQTAKHT

SEQ ID NO: 3012566 - protein, 22 aa, Entamoeba invadens
PNRCVDLVLKILLGAHSIILKK

SEQ ID NO: 3012567 - protein, 33 aa, Entamoeba invadens
PNRDKIIQVLGIGKIMPLPRILEMMKVSEQSVV

SEQ ID NO: 3012568 - protein, 25 aa, Entamoeba invadens
PNRGKSYFREIKSVQYDGLGQLQRE

SEQ ID NO: 3012569 - protein, 25 aa, Entamoeba invadens
PNSAIQPFKLFITSPDVSFSNKIAI

SEQ ID NO: 3012570 - protein, 40 aa, Entamoeba invadens
PNSLFSLYCQYVLYRKSTLLKHRTFYKTFIQLVKQFVSVN

SEQ ID NO: 3012571 - protein, 26 aa, Entamoeba invadens
PNSVQAFHLIYLRLSALTDDKAILAE

SEQ ID NO: 3012572 - protein, 25 aa, Entamoeba invadens
PNSVQAFHLLYLRLSAITEDKEILA

SEQ ID NO: 3012573 - protein, 27 aa, Entamoeba invadens
PNSYFTRLKTVFAFARTKFVKAFENFD

SEQ ID NO: 3012574 - protein, 23 aa, Entamoeba invadens
PNTIPFIHCLYSSILTLTPDEAT

SEQ ID NO: 3012575 - protein, 19 aa, Entamoeba invadens
PNTPLFYALDRAAHFFKLS

SEQ ID NO: 3012576 - protein, 24 aa, Entamoeba invadens
PNTTSTVFLPTSLTSLIPHVEHTL

SEQ ID NO: 3012577 - protein, 25 aa, Entamoeba invadens
PNTVELLPILLKMSNLQTLVIDAGN

SEQ ID NO: 3012578 - protein, 26 aa, Entamoeba invadens
PNVCLFIKFDVFIPYSKCTSRAIADG

SEQ ID NO: 3012579 - protein, 26 aa, Entamoeba invadens
PNVTEHIFDFLPLESLLCVSASCKTL

SEQ ID NO: 3012580 - protein, 21 aa, Entamoeba invadens
PNVVLFIGMAMSQNLPMFVTE

SEQ ID NO: 3012581 - protein, 21 aa, Entamoeba invadens
PNWKNLYFQINFDKDTFVFYI

SEQ ID NO: 3012582 - protein, 25 aa, Entamoeba invadens
PNYKNKILFDVTFKEINTFQKFGYE

SEQ ID NO: 3012583 - protein, 21 aa, Entamoeba invadens
PNYRECPCRKPIILLYDENGT

SEQ ID NO: 3012584 - protein, 33 aa, Entamoeba invadens
PPALVKKRPIPKRVPIVIPPKFTMDYNNYSKDD

SEQ ID NO: 3012585 - protein, 36 aa, Entamoeba invadens
PPAPPPPRHGGAAVLPPPGLVPPPPGILPPSEANAP

SEQ ID NO: 3012586 - protein, 26 aa, Entamoeba invadens
PPAQYIKRFFQFIRKTVRTKGEYLFK

SEQ ID NO: 3012587 - protein, 17 aa, Entamoeba invadens
PPCIFGMRLESLNRLPR

SEQ ID NO: 3012588 - protein, 25 aa, Entamoeba invadens
PPDFFPGFLDVLKHFKQLGGLVVVV

SEQ ID NO: 3012589 - protein, 28 aa, Entamoeba invadens
PPDIAFESIFFQIFSKELLVQFLVVFSQ

SEQ ID NO: 3012590 - protein, 28 aa, Entamoeba invadens
PPDIAFESIFFQILSKDSLVQFLVVFSQ

SEQ ID NO: 3012591 - protein, 24 aa, Entamoeba invadens
PPEDRPLLLTAPPTTTSAYKNRMM

SEQ ID NO: 3012592 - protein, 21 aa, Entamoeba invadens
PPEFYQQFKMLRKQQAAAQQA

SEQ ID NO: 3012593 - protein, 26 aa, Entamoeba invadens
PPELGNFVEWIFWYINTKQEWRTVLK

SEQ ID NO: 3012594 - protein, 30 aa, Entamoeba invadens
PPGGLAPPGMLPPPGLAPPGGMMPPPGLAP

SEQ ID NO: 3012595 - protein, 27 aa, Entamoeba invadens
PPGGLMPPGMLPPPGGLAPPGGMMPPG

SEQ ID NO: 3012596 - protein, 27 aa, Entamoeba invadens
PPGGMLPPPGLAPPGGMLPPPGLEPPG

SEQ ID NO: 3012597 - protein, 27 aa, Entamoeba invadens
PPGGMMPPGMLPPPGGLAPPGMMMPPG

SEQ ID NO: 3012598 - protein, 24 aa, Entamoeba invadens
PPGGMMPPPGLAPPGGMMPPGMLP

SEQ ID NO: 3012599 - protein, 27 aa, Entamoeba invadens
PPGKHRLDFSFYLPQNFPTSYVTQCQS

SEQ ID NO: 3012600 - protein, 17 aa, Entamoeba invadens
PPGLAPPGGMMPPPGLA

SEQ ID NO: 3012601 - protein, 18 aa, Entamoeba invadens
PPGMMMPPGMMPPPGMGM

SEQ ID NO: 3012602 - protein, 27 aa, Entamoeba invadens
PPGTLAPPPGLAPPGGLAPPPGLEPPG

SEQ ID NO: 3012603 - protein, 22 aa, Entamoeba invadens
PPHEGIFCDLLWSDPLSDDYIE

SEQ ID NO: 3012604 - protein, 25 aa, Entamoeba invadens
PPHELLLKVGSIVILLRNIQPSMGL

SEQ ID NO: 3012605 - protein, 20 aa, Entamoeba invadens
PPHIMKSFRFLLEDDTNKNK

SEQ ID NO: 3012606 - protein, 23 aa, Entamoeba invadens
PPHPFAKAFPEKYAIELRNADIR

SEQ ID NO: 3012607 - protein, 19 aa, Entamoeba invadens
PPHPPIYEFLQPDEYFIRV

SEQ ID NO: 3012608 - protein, 19 aa, Entamoeba invadens
PPHRPPLPAIPPPLPPKTY

SEQ ID NO: 3012609 - protein, 19 aa, Entamoeba invadens
PPIKMLDIMNAKYGDKLRA

SEQ ID NO: 3012610 - protein, 19 aa, Entamoeba invadens
PPIQEVLAPIKVDRSECYK

SEQ ID NO: 3012611 - protein, 18 aa, Entamoeba invadens
PPIRPPVIIRQTPIPQQR

SEQ ID NO: 3012612 - protein, 34 aa, Entamoeba invadens
PPITSVTPMSLPLKLVSPLIIEPLNVLKKSEKVE

SEQ ID NO: 3012613 - protein, 36 aa, Entamoeba invadens
PPIVPPTFTSLFLRWEYFIIISIPPQKVQSSSIYVP

SEQ ID NO: 3012614 - protein, 17 aa, Entamoeba invadens
PPIVTSLGEWCFNNCIN

SEQ ID NO: 3012615 - protein, 17 aa, Entamoeba invadens
PPKAFFQCSDLSAINIP

SEQ ID NO: 3012616 - protein, 23 aa, Entamoeba invadens
PPKGVLLYGPPGTGKTLLARAVA

SEQ ID NO: 3012617 - protein, 24 aa, Entamoeba invadens
PPKGYLKTYKNIFNRLSRILAHFL

SEQ ID NO: 3012618 - protein, 23 aa, Entamoeba invadens
PPLKSDFMTKLKQIIVAIPNSEL

SEQ ID NO: 3012619 - protein, 19 aa, Entamoeba invadens
PPLLHNRKPFFLSKRKSKS

SEQ ID NO: 3012620 - protein, 17 aa, Entamoeba invadens
PPLLSLPKNTRKLFFME

SEQ ID NO: 3012621 - protein, 25 aa, Entamoeba invadens
PPLNQQFILPPLQLPEEPNPFESFN

SEQ ID NO: 3012622 - protein, 20 aa, Entamoeba invadens
PPLVTLKPNYACEFEISLKP

SEQ ID NO: 3012623 - protein, 18 aa, Entamoeba invadens
PPMKMITLGDSGVGKTCI

SEQ ID NO: 3012624 - protein, 26 aa, Entamoeba invadens
PPMTTNVIRFGDKLGFVENELTIGEC

SEQ ID NO: 3012625 - protein, 19 aa, Entamoeba invadens
PPNCYAPHFSFLQPQIEED

SEQ ID NO: 3012626 - protein, 31 aa, Entamoeba invadens
PPNSLIFRDMIYIVLSCCGRYKGKALTGPPI

SEQ ID NO: 3012627 - protein, 19 aa, Entamoeba invadens
PPNYGCEFSLFLTPLCNST

SEQ ID NO: 3012628 - protein, 27 aa, Entamoeba invadens
PPPANMPLPKMPPPPPTSAPGIAAAPA

SEQ ID NO: 3012629 - protein, 18 aa, Entamoeba invadens
PPPIILRAGIQQKLPEKC

SEQ ID NO: 3012630 - protein, 32 aa, Entamoeba invadens
PPPLRTDLLTKFKQMIIALPNTAIVLGDKFDD

SEQ ID NO: 3012631 - protein, 25 aa, Entamoeba invadens
PPPTLRAFLHIVFNNIEFIFCPEDS

SEQ ID NO: 3012632 - protein, 26 aa, Entamoeba invadens
PPQIENIYWNAFLNCRELSRINFPKS

SEQ ID NO: 3012633 - protein, 30 aa, Entamoeba invadens
PPQIINADVVLKNFLLAKAREDYSKQELSY

SEQ ID NO: 3012634 - protein, 27 aa, Entamoeba invadens
PPQIRYCHNFYYYLSVSPREVPFKPIP

SEQ ID NO: 3012635 - protein, 25 aa, Entamoeba invadens
PPQNIHLFLYPELPDTNFLPSYFIV

SEQ ID NO: 3012636 - protein, 17 aa, Entamoeba invadens
PPQTKSPSFKRPSPPPP

SEQ ID NO: 3012637 - protein, 31 aa, Entamoeba invadens
PPRDVVIDKPFYFAILGRYKLPLFFGKITHP

SEQ ID NO: 3012638 - protein, 26 aa, Entamoeba invadens
PPRPKLYPLSIPLSTSIKKTLDLNRI

SEQ ID NO: 3012639 - protein, 24 aa, Entamoeba invadens
PPRPRTIRYFYRRQQKDDLDSIYD

SEQ ID NO: 3012640 - protein, 23 aa, Entamoeba invadens
PPRYKLLMDAVVSALPEWWQNQK

SEQ ID NO: 3012641 - protein, 19 aa, Entamoeba invadens
PPSEVDISFLPSAITKEIG

SEQ ID NO: 3012642 - protein, 32 aa, Entamoeba invadens
PPSFSLSFQLLKYYFRALPSPLIQQTQDLFDV

SEQ ID NO: 3012643 - protein, 26 aa, Entamoeba invadens
PPSIRGTWWFPLLSSIGIDQYQRIYM

SEQ ID NO: 3012644 - protein, 24 aa, Entamoeba invadens
PPSPDRMPNLAQKVWVASKPKIEP

SEQ ID NO: 3012645 - protein, 30 aa, Entamoeba invadens
PPTDNTTLLIPYIAGYYFPLKEVMCANYPL

SEQ ID NO: 3012646 - protein, 24 aa, Entamoeba invadens
PPTDRLELILEYVKRYVSSLEGLK

SEQ ID NO: 3012647 - protein, 17 aa, Entamoeba invadens
PPTIKIFEQSIFYNCHK

SEQ ID NO: 3012648 - protein, 17 aa, Entamoeba invadens
PPTMNMCFSILKVIEVM

SEQ ID NO: 3012649 - protein, 19 aa, Entamoeba invadens
PPTRFFPNEVGKHTKSLCL

SEQ ID NO: 3012650 - protein, 18 aa, Entamoeba invadens
PPVCTNCGCRECNKINEC

SEQ ID NO: 3012651 - protein, 18 aa, Entamoeba invadens
PPVDLFFTQDMCSPTLFF

SEQ ID NO: 3012652 - protein, 24 aa, Entamoeba invadens
PPVHTPIYFSPPFSRSTSSRVITN

SEQ ID NO: 3012653 - protein, 25 aa, Entamoeba invadens
PPVNQNTLWYLMQFVHLVAQHTEEN

SEQ ID NO: 3012654 - protein, 21 aa, Entamoeba invadens
PPYGYAKFYTIMRDETHDRLL

SEQ ID NO: 3012655 - protein, 21 aa, Entamoeba invadens
PQACSYYYKNYFKLNEHNNYI

SEQ ID NO: 3012656 - protein, 25 aa, Entamoeba invadens
PQAKWNIWSWWSQPPKEYSDATKIQ

SEQ ID NO: 3012657 - protein, 21 aa, Entamoeba invadens
PQALYEIIQKSWNYIPQNRIE

SEQ ID NO: 3012658 - protein, 34 aa, Entamoeba invadens
PQDEGELFSLFSNTILIMKKGNPRGKCTSKIPGM

SEQ ID NO: 3012659 - protein, 21 aa, Entamoeba invadens
PQDHYFLLTEPPMNPPENREY

SEQ ID NO: 3012660 - protein, 21 aa, Entamoeba invadens
PQDLIRLLCLPLTIANKCIIQ

SEQ ID NO: 3012661 - protein, 22 aa, Entamoeba invadens
PQDPYDIIPEKCKFVDKMILKL

SEQ ID NO: 3012662 - protein, 18 aa, Entamoeba invadens
PQEIVREQKLNIGRSIRE

SEQ ID NO: 3012663 - protein, 23 aa, Entamoeba invadens
PQEKDIMLFEKQEPIDLAPENSV

SEQ ID NO: 3012664 - protein, 23 aa, Entamoeba invadens
PQERLWTCWFCMSSTSSFDDKLL

SEQ ID NO: 3012665 - protein, 24 aa, Entamoeba invadens
PQFAKILSGALFTPATPTLPLRVH

SEQ ID NO: 3012666 - protein, 31 aa, Entamoeba invadens
PQFFKHSNICSFVRQLNIYGFKKLETPTGFC

SEQ ID NO: 3012667 - protein, 19 aa, Entamoeba invadens
PQFLKMTNPALWTPQSVFA

SEQ ID NO: 3012668 - protein, 27 aa, Entamoeba invadens
PQFPVTVTAPYFVPPQKQNLFGVGEAV

SEQ ID NO: 3012669 - protein, 18 aa, Entamoeba invadens
PQFQLQPPRAQLSTSNIP

SEQ ID NO: 3012670 - protein, 26 aa, Entamoeba invadens
PQGAYPPQGYPPQQYQMQPGQSAPQQ

SEQ ID NO: 3012671 - protein, 21 aa, Entamoeba invadens
PQHTIQLAFNKDIELTVVGKC

SEQ ID NO: 3012672 - protein, 17 aa, Entamoeba invadens
PQIEFETLFLDLSTDFQ

SEQ ID NO: 3012673 - protein, 31 aa, Entamoeba invadens
PQIKETFLAAQGKFISELFSLHVAGGDDSGV

SEQ ID NO: 3012674 - protein, 18 aa, Entamoeba invadens
PQILKSYEKKMVGPFLKD

SEQ ID NO: 3012675 - protein, 28 aa, Entamoeba invadens
PQITKIDIIRYFGILLYMGAHHDIKNPF

SEQ ID NO: 3012676 - protein, 28 aa, Entamoeba invadens
PQITKIDIIRYFGILLYMGAHHDIKNPI

SEQ ID NO: 3012677 - protein, 22 aa, Entamoeba invadens
PQKARIVCQTYPGIFGLRLQKR

SEQ ID NO: 3012678 - protein, 18 aa, Entamoeba invadens
PQKARIVCQTYPGIFRSP

SEQ ID NO: 3012679 - protein, 21 aa, Entamoeba invadens
PQKEVLVKKELLKWKPHAVVI

SEQ ID NO: 3012680 - protein, 23 aa, Entamoeba invadens
PQKFRSELIKKLPAAYTPYIDGK

SEQ ID NO: 3012681 - protein, 18 aa, Entamoeba invadens
PQKFSNLKVCGSAIFLKL

SEQ ID NO: 3012682 - protein, 20 aa, Entamoeba invadens
PQKMFLTRKSKESNFFCCIC

SEQ ID NO: 3012683 - protein, 28 aa, Entamoeba invadens
PQKPQNLPCLVSVKYIYQPKSTKELSLV

SEQ ID NO: 3012684 - protein, 22 aa, Entamoeba invadens
PQKPRMAGILGGNRARKVEEVQ

SEQ ID NO: 3012685 - protein, 23 aa, Entamoeba invadens
PQKQSEVVPFKPTSFKSSEQVQG

SEQ ID NO: 3012686 - protein, 22 aa, Entamoeba invadens
PQKSPVKLQPTLPQRNASKDNT

SEQ ID NO: 3012687 - protein, 20 aa, Entamoeba invadens
PQLTAYLPYGQVIVRLNQIT

SEQ ID NO: 3012688 - protein, 22 aa, Entamoeba invadens
PQMRAVVQPNPLQPLSRNRPFS

SEQ ID NO: 3012689 - protein, 21 aa, Entamoeba invadens
PQMTQRFFISVQKASFSIKDE

SEQ ID NO: 3012690 - protein, 23 aa, Entamoeba invadens
PQNAFVYILAVEDLPKVLFFSYF

SEQ ID NO: 3012691 - protein, 27 aa, Entamoeba invadens
PQNGQPGFFPVPLPNIPNPPNQDDDNN

SEQ ID NO: 3012692 - protein, 29 aa, Entamoeba invadens
PQNNFLAFKHLTPYFYRVDYKTAMNMLDM

SEQ ID NO: 3012693 - protein, 23 aa, Entamoeba invadens
PQNRDYFKYTSLKDLILLNQVKI

SEQ ID NO: 3012694 - protein, 23 aa, Entamoeba invadens
PQNTPYIFGLLPTLAFADTNHNP

SEQ ID NO: 3012695 - protein, 17 aa, Entamoeba invadens
PQNVPYFSPVYLDENKE

SEQ ID NO: 3012696 - protein, 33 aa, Entamoeba invadens
PQNYTSPVPYLLKALNFLSMIYIRGGDIKTVNS

SEQ ID NO: 3012697 - protein, 33 aa, Entamoeba invadens
PQPEIKRLPLESLCLQILLFGETDPVKFLSGAI

SEQ ID NO: 3012698 - protein, 17 aa, Entamoeba invadens
PQPFDFFGNVQPQQPQM

SEQ ID NO: 3012699 - protein, 27 aa, Entamoeba invadens
PQPIYQPYQMYYQQQPPYYNTGYSVPQ

SEQ ID NO: 3012700 - protein, 26 aa, Entamoeba invadens
PQPKTQKPLPPPPPPKPNTKSTNPFD

SEQ ID NO: 3012701 - protein, 27 aa, Entamoeba invadens
PQPNYNTFSPNPYYPNIPLQQPQQMMQ

SEQ ID NO: 3012702 - protein, 20 aa, Entamoeba invadens
PQPPLVICRETLDMFIERTK

SEQ ID NO: 3012703 - protein, 20 aa, Entamoeba invadens
PQPPYDPQFGMYPQQMPGQY

SEQ ID NO: 3012704 - protein, 20 aa, Entamoeba invadens
PQPRAKLRHFRGRNYSVRIR

SEQ ID NO: 3012705 - protein, 34 aa, Entamoeba invadens
PQPREFPMQTIFPLYQPSMRMNISPKFGFSNLVS

SEQ ID NO: 3012706 - protein, 19 aa, Entamoeba invadens
PQPWSQFSTRPNEQGHCIS

SEQ ID NO: 3012707 - protein, 23 aa, Entamoeba invadens
PQQAYPPQGYPPQQGYPGYPPQG

SEQ ID NO: 3012708 - protein, 23 aa, Entamoeba invadens
PQQPYPQQAYPGYPQQPAQQPQQ

SEQ ID NO: 3012709 - protein, 18 aa, Entamoeba invadens
PQQQGQYPGYPPQQAYPP

SEQ ID NO: 3012710 - protein, 28 aa, Entamoeba invadens
PQQTFKSLRKIPPTLQPRLSASSPHVIS

SEQ ID NO: 3012711 - protein, 18 aa, Entamoeba invadens
PQRWIPELKHHCPDAPYI

SEQ ID NO: 3012712 - protein, 20 aa, Entamoeba invadens
PQRYGIKFWMCCDCESGMVI

SEQ ID NO: 3012713 - protein, 17 aa, Entamoeba invadens
PQSFWDKSGVAAYHRKV

SEQ ID NO: 3012714 - protein, 39 aa, Entamoeba invadens
PQSKVWGAFPKFPGDTFMSAYFPGYRFKPEFTKQRALEL

SEQ ID NO: 3012715 - protein, 26 aa, Entamoeba invadens
PQSLSKFIHFSIPKITFHILTNESTH

SEQ ID NO: 3012716 - protein, 26 aa, Entamoeba invadens
PQSMRTFAVYPLFKMFNKWLEALGDV

SEQ ID NO: 3012717 - protein, 17 aa, Entamoeba invadens
PQSPLYTTLGIMTKGSI

SEQ ID NO: 3012718 - protein, 24 aa, Entamoeba invadens
PQSTHLFRVIMFLCVLFSHLGEVP

SEQ ID NO: 3012719 - protein, 17 aa, Entamoeba invadens
PQSVLFVDDLSFVGCSN

SEQ ID NO: 3012720 - protein, 23 aa, Entamoeba invadens
PQSYLHLPITRLEEYLHFCKTTK

SEQ ID NO: 3012721 - protein, 17 aa, Entamoeba invadens
PQTIIHTPLLFLENAYC

SEQ ID NO: 3012722 - protein, 27 aa, Entamoeba invadens
PQTIVELFTCHLSILSSLKNCVQMSKN

SEQ ID NO: 3012723 - protein, 35 aa, Entamoeba invadens
PQTKGALVLRPLSVFAPLHYFELPELLMEAITSMT

SEQ ID NO: 3012724 - protein, 29 aa, Entamoeba invadens
PQTLPQLKESFWLHGLWPQFILNRNMFCC

SEQ ID NO: 3012725 - protein, 18 aa, Entamoeba invadens
PQTPGELAWYFVKVINYN

SEQ ID NO: 3012726 - protein, 25 aa, Entamoeba invadens
PQTQRIPQLLRFVSSLTPQESAVIH

SEQ ID NO: 3012727 - protein, 27 aa, Entamoeba invadens
PQVFSLFKKCDIIPIIYNSLRLYQDDR

SEQ ID NO: 3012728 - protein, 24 aa, Entamoeba invadens
PQYIEERHLLVIRSLLSVAQNDGE

SEQ ID NO: 3012729 - protein, 20 aa, Entamoeba invadens
PQYLRCSLSTPLFSQTSQTQ

SEQ ID NO: 3012730 - protein, 28 aa, Entamoeba invadens
PQYTKETCFLHLPKYRIIPGWSETLTNY

SEQ ID NO: 3012731 - protein, 21 aa, Entamoeba invadens
PRAHKHPIYALDSKGDMIVTG

SEQ ID NO: 3012732 - protein, 18 aa, Entamoeba invadens
PRAKMFLENLLQNKYKES

SEQ ID NO: 3012733 - protein, 19 aa, Entamoeba invadens
PRCAIRGYLFANLKGKMKS

SEQ ID NO: 3012734 - protein, 25 aa, Entamoeba invadens
PRCDMYTFALLVTKIWTDKLPYRSE

SEQ ID NO: 3012735 - protein, 28 aa, Entamoeba invadens
PRDEVILFSPYFLEYPFYIDNCQATMKI

SEQ ID NO: 3012736 - protein, 17 aa, Entamoeba invadens
PRDMFKFISSHIETYDV

SEQ ID NO: 3012737 - protein, 17 aa, Entamoeba invadens
PRDVIINKPYYFAIVEG

SEQ ID NO: 3012738 - protein, 24 aa, Entamoeba invadens
PREGPVVVVILDGFGIDKAGPGNC

SEQ ID NO: 3012739 - protein, 32 aa, Entamoeba invadens
PREVKVIPYHYPLLMLIKPDDPNLPTFYFDSI

SEQ ID NO: 3012740 - protein, 19 aa, Entamoeba invadens
PREYYETRLLIGCGVSTCQ

SEQ ID NO: 3012741 - protein, 19 aa, Entamoeba invadens
PRFKPFVDGIYLVDYSREF

SEQ ID NO: 3012742 - protein, 27 aa, Entamoeba invadens
PRFNELLRMYLPIRIEIQGGIRPSVPS

SEQ ID NO: 3012743 - protein, 30 aa, Entamoeba invadens
PRFVNIRIIRYLFKQILTALLYCHEHRVFH

SEQ ID NO: 3012744 - protein, 17 aa, Entamoeba invadens
PRFVSKDEEALFAQMIE

SEQ ID NO: 3012745 - protein, 23 aa, Entamoeba invadens
PRGIPINLVPIITKYLVGKISSL

SEQ ID NO: 3012746 - protein, 32 aa, Entamoeba invadens
PRGTNPYMKLLGRIYAFLAKRTQSKFAKTVHH

SEQ ID NO: 3012747 - protein, 27 aa, Entamoeba invadens
PRIDPFTCFSYYNPTLHLKLKCSIVPT

SEQ ID NO: 3012748 - protein, 17 aa, Entamoeba invadens
PRIDYVPGTEFLGEVHV

SEQ ID NO: 3012749 - protein, 18 aa, Entamoeba invadens
PRILENPTLLFEYVPSYY

SEQ ID NO: 3012750 - protein, 17 aa, Entamoeba invadens
PRIVERLGFIRRTIGIK

SEQ ID NO: 3012751 - protein, 17 aa, Entamoeba invadens
PRKVTRASLINLNMPEL

SEQ ID NO: 3012752 - protein, 19 aa, Entamoeba invadens
PRLIGAKCVGFHQLCLADL

SEQ ID NO: 3012753 - protein, 18 aa, Entamoeba invadens
PRLMCMYVDKVLNGAHAV

SEQ ID NO: 3012754 - protein, 25 aa, Entamoeba invadens
PRLSMGIMIHKGVFEFPFATMTGTT

SEQ ID NO: 3012755 - protein, 19 aa, Entamoeba invadens
PRNCKYFSELLTFDVEELS

SEQ ID NO: 3012756 - protein, 22 aa, Entamoeba invadens
PRPPHSLNMKMLLHLPPQTKQQ

SEQ ID NO: 3012757 - protein, 30 aa, Entamoeba invadens
PRPVVIDKPFYFSILGRYKLPLFFGKITNP

SEQ ID NO: 3012758 - protein, 19 aa, Entamoeba invadens
PRQDRFERKNLLRDESRTY

SEQ ID NO: 3012759 - protein, 25 aa, Entamoeba invadens
PRRNEFCRMVLSPDRRFLCYSEGDS

SEQ ID NO: 3012760 - protein, 23 aa, Entamoeba invadens
PRRQGSLWLPEEDAKLLEAVRKY

SEQ ID NO: 3012761 - protein, 32 aa, Entamoeba invadens
PRSIDIVVLIFCLKIKFPDRFFLLRGNHEVGN

SEQ ID NO: 3012762 - protein, 32 aa, Entamoeba invadens
PRSIDIVVLIFCLKIKFPDRFFLLRGNHEVQN

SEQ ID NO: 3012763 - protein, 29 aa, Entamoeba invadens
PRSIYYSYDFLFNFFPHLNTLTGNLETIQ

SEQ ID NO: 3012764 - protein, 29 aa, Entamoeba invadens
PRSIYYSYDFLFNFFPHLNTLTGNLETLQ

SEQ ID NO: 3012765 - protein, 17 aa, Entamoeba invadens
PRSLTMDILPFATQERI

SEQ ID NO: 3012766 - protein, 21 aa, Entamoeba invadens
PRSTRFVVPFNFALLTDAELS

SEQ ID NO: 3012767 - protein, 22 aa, Entamoeba invadens
PRSVFPTVVGVPKTLIKMIGCG

SEQ ID NO: 3012768 - protein, 25 aa, Entamoeba invadens
PRTIALGGQLLLSTPLPLPVKQNNL

SEQ ID NO: 3012769 - protein, 24 aa, Entamoeba invadens
PRTIPLGGALPPLSSCPPPPPAAP

SEQ ID NO: 3012770 - protein, 26 aa, Entamoeba invadens
PRTKSTLLLWDIWQLQLNGDGKPVDI

SEQ ID NO: 3012771 - protein, 30 aa, Entamoeba invadens
PRTSQLKTLYFVPTISPRLLKVLRGEIPSV

SEQ ID NO: 3012772 - protein, 24 aa, Entamoeba invadens
PRVIEPVYFAQWGTMWLAMRNEKV

SEQ ID NO: 3012773 - protein, 33 aa, Entamoeba invadens
PRVLKELSYSEYYYLKLYDGVIDDELFGKVRNF

SEQ ID NO: 3012774 - protein, 22 aa, Entamoeba invadens
PRVPTRWQFSNKKLWAFPNMEK

SEQ ID NO: 3012775 - protein, 25 aa, Entamoeba invadens
PRYEKENVLDFCKLLMKNKNSAKSL

SEQ ID NO: 3012776 - protein, 27 aa, Entamoeba invadens
PRYIRFLFDIPARVAIFPNSKRTKKLG

SEQ ID NO: 3012777 - protein, 21 aa, Entamoeba invadens
PRYLPHVVQLLLTASPQLIDI

SEQ ID NO: 3012778 - protein, 18 aa, Entamoeba invadens
PRYRVIMLFEADSLSYEA

SEQ ID NO: 3012779 - protein, 22 aa, Entamoeba invadens
PRYSLLINELYKNTLPADRSKN

SEQ ID NO: 3012780 - protein, 17 aa, Entamoeba invadens
PSAFFDIPQTCGFVFDF

SEQ ID NO: 3012781 - protein, 21 aa, Entamoeba invadens
PSAHLLFPNYILPTIEQTVAN

SEQ ID NO: 3012782 - protein, 18 aa, Entamoeba invadens
PSAIHRLKLATGKPILIA

SEQ ID NO: 3012783 - protein, 26 aa, Entamoeba invadens
PSAKNWRPIKYLVINEPKLTDVIKKL

SEQ ID NO: 3012784 - protein, 21 aa, Entamoeba invadens
PSALRMDIWKMFLQPKREFVE

SEQ ID NO: 3012785 - protein, 23 aa, Entamoeba invadens
PSATQYLPLVFDQENPPLFDDKQ

SEQ ID NO: 3012786 - protein, 34 aa, Entamoeba invadens
PSCKEILKLTLRKVINVPYISGYLGFREVEVYKE

SEQ ID NO: 3012787 - protein, 23 aa, Entamoeba invadens
PSCPSFYKVYFDLTVMGSAEISE

SEQ ID NO: 3012788 - protein, 25 aa, Entamoeba invadens
PSCVKYILADYLFYKEARDATMSEV

SEQ ID NO: 3012789 - protein, 24 aa, Entamoeba invadens
PSDDFLEAIAYFMLHGLPCPQLAP

SEQ ID NO: 3012790 - protein, 25 aa, Entamoeba invadens
PSDFNEVLPLIYLKKCFPVMNELVT

SEQ ID NO: 3012791 - protein, 23 aa, Entamoeba invadens
PSDIFLFAIIIHKHLLGKNHTQK

SEQ ID NO: 3012792 - protein, 30 aa, Entamoeba invadens
PSDIFSFAITMYETFAWRAAYSKEKFKFEW

SEQ ID NO: 3012793 - protein, 28 aa, Entamoeba invadens
PSDIKNLFVFFPLFLEKIKGILSLDSNE

SEQ ID NO: 3012794 - protein, 30 aa, Entamoeba invadens
PSEEAYIDFTYFTFIAVRFTMAGLIEDEET

SEQ ID NO: 3012795 - protein, 28 aa, Entamoeba invadens
PSEEEMRLIRVLTAQAMSPLKAPPLISA

SEQ ID NO: 3012796 - protein, 24 aa, Entamoeba invadens
PSEFFSFITFHLWSYGEYTINYNI

SEQ ID NO: 3012797 - protein, 29 aa, Entamoeba invadens
PSEHVSKLDLLIFFSEIRIFSNTIVDLLN

SEQ ID NO: 3012798 - protein, 17 aa, Entamoeba invadens
PSEIEARRYSLEGPITI

SEQ ID NO: 3012799 - protein, 21 aa, Entamoeba invadens
PSEIPLVSDDKFLLSVKIGKY

SEQ ID NO: 3012800 - protein, 22 aa, Entamoeba invadens
PSEKLFVNRNIAGVVKFDLQKT

SEQ ID NO: 3012801 - protein, 20 aa, Entamoeba invadens
PSEQVLIKMERALGVRLRGV

SEQ ID NO: 3012802 - protein, 18 aa, Entamoeba invadens
PSFEEWPQFLKMTNPALW

SEQ ID NO: 3012803 - protein, 18 aa, Entamoeba invadens
PSFFFPIHADLGASNLLN

SEQ ID NO: 3012804 - protein, 23 aa, Entamoeba invadens
PSFHHQNISAFYYTLTNLGSKGI

SEQ ID NO: 3012805 - protein, 20 aa, Entamoeba invadens
PSFKVFVFYSQDMNAPLTKS

SEQ ID NO: 3012806 - protein, 21 aa, Entamoeba invadens
PSFLVRALEVYNIYKSVYSTI

SEQ ID NO: 3012807 - protein, 20 aa, Entamoeba invadens
PSFNFFMKTLGEDRWCFLVI

SEQ ID NO: 3012808 - protein, 18 aa, Entamoeba invadens
PSFSLFTCHNEKRNSFNV

SEQ ID NO: 3012809 - protein, 27 aa, Entamoeba invadens
PSGEPIRALLRRLTHLKIIPESEEKGT

SEQ ID NO: 3012810 - protein, 17 aa, Entamoeba invadens
PSGFTLLQNGRLLRYGS

SEQ ID NO: 3012811 - protein, 18 aa, Entamoeba invadens
PSGIFRPVFNPVGVEGQF

SEQ ID NO: 3012812 - protein, 26 aa, Entamoeba invadens
PSGLKTLPYKVFYNVKSLRIIESPVN

SEQ ID NO: 3012813 - protein, 22 aa, Entamoeba invadens
PSGPFLNKCRYALSSTALLDNY

SEQ ID NO: 3012814 - protein, 22 aa, Entamoeba invadens
PSGTWCKVFKVTAPFMESTPPS

SEQ ID NO: 3012815 - protein, 17 aa, Entamoeba invadens
PSGVPIDYLVAGSPMCC

SEQ ID NO: 3012816 - protein, 22 aa, Entamoeba invadens
PSHHCYFMLTDTLNFMENTWKD

SEQ ID NO: 3012817 - protein, 32 aa, Entamoeba invadens
PSHHNDIMFYRGYKFVISLKVSGVALGPDDIF

SEQ ID NO: 3012818 - protein, 17 aa, Entamoeba invadens
PSHKLVLGLAHYARGWT

SEQ ID NO: 3012819 - protein, 26 aa, Entamoeba invadens
PSHSQPPVVAPPPPPKDILSDKDLYP

SEQ ID NO: 3012820 - protein, 22 aa, Entamoeba invadens
PSIEKMLFMYYHIAPKLLRYRV

SEQ ID NO: 3012821 - protein, 21 aa, Entamoeba invadens
PSIFFSGLNPLLNFSRKWKTS

SEQ ID NO: 3012822 - protein, 33 aa, Entamoeba invadens
PSILDSDVYIRILILYLPLLIKFDDETIDYKAR

SEQ ID NO: 3012823 - protein, 23 aa, Entamoeba invadens
PSITELINRLVYHPNPTLEDNSD

SEQ ID NO: 3012824 - protein, 24 aa, Entamoeba invadens
PSIVELILTIKSLYREEWKGDWQS

SEQ ID NO: 3012825 - protein, 24 aa, Entamoeba invadens
PSKARFSILDLYKTPEKEVIEIED

SEQ ID NO: 3012826 - protein, 22 aa, Entamoeba invadens
PSKIVHFGFFYLSECSNLKKLD

SEQ ID NO: 3012827 - protein, 25 aa, Entamoeba invadens
PSKLKAHLTKLFSPFGVVLTVQVRK

SEQ ID NO: 3012828 - protein, 26 aa, Entamoeba invadens
PSKRVILLGDYFVGKTTLFHHLTNSK

SEQ ID NO: 3012829 - protein, 24 aa, Entamoeba invadens
PSKRYDKLFFLTCSNYSDIKLLEE

SEQ ID NO: 3012830 - protein, 25 aa, Entamoeba invadens
PSKTKTLSMKLLTASIWSPDNREVF

SEQ ID NO: 3012831 - protein, 20 aa, Entamoeba invadens
PSKVGGPVASLLFSPTTAKD

SEQ ID NO: 3012832 - protein, 24 aa, Entamoeba invadens
PSLCTFGNLPFRKTAKRYGCDVTM

SEQ ID NO: 3012833 - protein, 19 aa, Entamoeba invadens
PSLFGFKMYTGEISKLPSN

SEQ ID NO: 3012834 - protein, 20 aa, Entamoeba invadens
PSLIMSKFFPALQGSQGKMS

SEQ ID NO: 3012835 - protein, 20 aa, Entamoeba invadens
PSLKEILKGALKYNPKERPT

SEQ ID NO: 3012836 - protein, 19 aa, Entamoeba invadens
PSLKFSVLKKLILKKRGKY

SEQ ID NO: 3012837 - protein, 17 aa, Entamoeba invadens
PSLLDLIKSFFLSPETT

SEQ ID NO: 3012838 - protein, 17 aa, Entamoeba invadens
PSLPIAENKFEFNNFVF

SEQ ID NO: 3012839 - protein, 24 aa, Entamoeba invadens
PSLTVTNMLPMPFVLKSESVEMPI

SEQ ID NO: 3012840 - protein, 18 aa, Entamoeba invadens
PSLVAYLKSLGMDPDYVP

SEQ ID NO: 3012841 - protein, 25 aa, Entamoeba invadens
PSLVEKWFDFMPSPLGEEFYIGRVK

SEQ ID NO: 3012842 - protein, 17 aa, Entamoeba invadens
PSLWRQCQLTRIHGLFE

SEQ ID NO: 3012843 - protein, 23 aa, Entamoeba invadens
PSLYCVFPLVGSEQLQLPFLLNS

SEQ ID NO: 3012844 - protein, 18 aa, Entamoeba invadens
PSNFEHIKGSPYTPEILA

SEQ ID NO: 3012845 - protein, 27 aa, Entamoeba invadens
PSNICDNLFNEKLFLDQPTRVWGYIPV

SEQ ID NO: 3012846 - protein, 26 aa, Entamoeba invadens
PSNLMRLGIYLFYGCSRVKEIHLPKL

SEQ ID NO: 3012847 - protein, 24 aa, Entamoeba invadens
PSNLTVIRQLILNKMPPSCPRVKD

SEQ ID NO: 3012848 - protein, 21 aa, Entamoeba invadens
PSNPIHYWRYRCHVDLDDILS

SEQ ID NO: 3012849 - protein, 22 aa, Entamoeba invadens
PSNYLNESFGYGQSKWVGEQII

SEQ ID NO: 3012850 - protein, 22 aa, Entamoeba invadens
PSPFSQQWLCNLSSQKYTVDYT

SEQ ID NO: 3012851 - protein, 20 aa, Entamoeba invadens
PSPFVFPRRGAKKPCLCLYP

SEQ ID NO: 3012852 - protein, 28 aa, Entamoeba invadens
PSPIDTLLTIFTPLPQLLKPFTTFTSDQ

SEQ ID NO: 3012853 - protein, 25 aa, Entamoeba invadens
PSPLLSRFDLIFVLVDNPDSESDRA

SEQ ID NO: 3012854 - protein, 27 aa, Entamoeba invadens
PSPQFLAAVVFLFKSLIRGNPDFNRKT

SEQ ID NO: 3012855 - protein, 32 aa, Entamoeba invadens
PSQALCHPFITQSQFFGSWSPPAGLSTPRQAE

SEQ ID NO: 3012856 - protein, 23 aa, Entamoeba invadens
PSQGLLMQNDKFRKYLIEMQYDT

SEQ ID NO: 3012857 - protein, 21 aa, Entamoeba invadens
PSQIAVLYFIHGFTEYGGFYH

SEQ ID NO: 3012858 - protein, 23 aa, Entamoeba invadens
PSQIKIFKKQRLIKSPPFCLSQQ

SEQ ID NO: 3012859 - protein, 25 aa, Entamoeba invadens
PSQKVFGVVAGIYQWKNSKYEEKTM

SEQ ID NO: 3012860 - protein, 22 aa, Entamoeba invadens
PSQVLRYKFGGKPVWIKTDTQL

SEQ ID NO: 3012861 - protein, 37 aa, Entamoeba invadens
PSQYNTIQPFNFELFWKLHEFFIQYFDYFDKNIGMLA

SEQ ID NO: 3012862 - protein, 27 aa, Entamoeba invadens
PSRESIKFPYLSYTALETIISSITHNS

SEQ ID NO: 3012863 - protein, 19 aa, Entamoeba invadens
PSRGVLFYGPPGCGKTMMA

SEQ ID NO: 3012864 - protein, 27 aa, Entamoeba invadens
PSRKTFVAQPFLPIVKIIFSQTDVVDF

SEQ ID NO: 3012865 - protein, 34 aa, Entamoeba invadens
PSRLKIITNIIKRAIMILSQYPLPILLDVENVVE

SEQ ID NO: 3012866 - protein, 17 aa, Entamoeba invadens
PSRNLQLLVNCSINLIS

SEQ ID NO: 3012867 - protein, 25 aa, Entamoeba invadens
PSRRTFIAHPFIPIEMVSFDSKDEI

SEQ ID NO: 3012868 - protein, 21 aa, Entamoeba invadens
PSRYTTIQYIFNGYTATVQAS

SEQ ID NO: 3012869 - protein, 25 aa, Entamoeba invadens
PSSAVHCVFWAKQLFQKLFSKSDEG

SEQ ID NO: 3012870 - protein, 18 aa, Entamoeba invadens
PSSDLELINPEKPMYTPP

SEQ ID NO: 3012871 - protein, 31 aa, Entamoeba invadens
PSSDLLMVLESLSISFGGSPPVRQSPKGARP

SEQ ID NO: 3012872 - protein, 26 aa, Entamoeba invadens
PSSDPIMELLKLKILLHAKDCMKAET

SEQ ID NO: 3012873 - protein, 21 aa, Entamoeba invadens
PSSFQQPRYDRFESQPLASEV

SEQ ID NO: 3012874 - protein, 24 aa, Entamoeba invadens
PSSHLFAGTAASWFIEESYLCAYA

SEQ ID NO: 3012875 - protein, 22 aa, Entamoeba invadens
PSSIEWCHMIGLNYVSCSSFRI

SEQ ID NO: 3012876 - protein, 26 aa, Entamoeba invadens
PSSKPTPPMRTPSPKTSSPTSSSPKA

SEQ ID NO: 3012877 - protein, 29 aa, Entamoeba invadens
PSSLFEILAKYIRLFAEELKQKWPDFIYT

SEQ ID NO: 3012878 - protein, 17 aa, Entamoeba invadens
PSSPRALSLLDRSPSAF

SEQ ID NO: 3012879 - protein, 31 aa, Entamoeba invadens
PSSTPFTHFYFKLKFGKLYNLNYFQVIIEDV

SEQ ID NO: 3012880 - protein, 22 aa, Entamoeba invadens
PSTACLLNSYAYGPGVDGKIGI

SEQ ID NO: 3012881 - protein, 21 aa, Entamoeba invadens
PSTFFCKSLDVLDPFEPVVFD

SEQ ID NO: 3012882 - protein, 18 aa, Entamoeba invadens
PSTFTLLCDLCEAAKSFE

SEQ ID NO: 3012883 - protein, 20 aa, Entamoeba invadens
PSTIFATAAILEGCPFVNGS

SEQ ID NO: 3012884 - protein, 26 aa, Entamoeba invadens
PSTPSTPYVPPPTLPSTPSVPSTPSE

SEQ ID NO: 3012885 - protein, 25 aa, Entamoeba invadens
PSTSFVPIVPRMWIATNKTPSKDDI

SEQ ID NO: 3012886 - protein, 25 aa, Entamoeba invadens
PSVEAFKAFYGLGVTYNFISNFVAI

SEQ ID NO: 3012887 - protein, 26 aa, Entamoeba invadens
PSVISLANSPLYLHRTICLNCISQII

SEQ ID NO: 3012888 - protein, 24 aa, Entamoeba invadens
PSVRISFCQIIANILLSFPEVLKN

SEQ ID NO: 3012889 - protein, 21 aa, Entamoeba invadens
PSVVFMLAALINKLNLRLEKV

SEQ ID NO: 3012890 - protein, 26 aa, Entamoeba invadens
PSVVLQVLMKLRFQFELRYFNCDQTI

SEQ ID NO: 3012891 - protein, 21 aa, Entamoeba invadens
PSWSCPVCRLQFSSPPKPSCY

SEQ ID NO: 3012892 - protein, 20 aa, Entamoeba invadens
PSWVSLCHELLNNSGVMVCT

SEQ ID NO: 3012893 - protein, 45 aa, Entamoeba invadens
PSYERCLNVFFKSKILTNTYAPTPFPLILSFIVSCKLQHTNPKNV

SEQ ID NO: 3012894 - protein, 22 aa, Entamoeba invadens
PSYGRYIFQLQNNLHALMNSQL

SEQ ID NO: 3012895 - protein, 21 aa, Entamoeba invadens
PSYLENFVCAMFKGASNLQKP

SEQ ID NO: 3012896 - protein, 18 aa, Entamoeba invadens
PSYMAPEILKKNHYKKPA

SEQ ID NO: 3012897 - protein, 26 aa, Entamoeba invadens
PSYPKFPSFPQPPEPNYFFIKTSVKL

SEQ ID NO: 3012898 - protein, 23 aa, Entamoeba invadens
PSYSVNLALYNTLFHALDITRTG

SEQ ID NO: 3012899 - protein, 17 aa, Entamoeba invadens
PTAAAIAYGLNKKTERE

SEQ ID NO: 3012900 - protein, 26 aa, Entamoeba invadens
PTADAIFLDWYPSDLENYVLTNSPRV

SEQ ID NO: 3012901 - protein, 25 aa, Entamoeba invadens
PTADAYCVWRCANFMVFCVCDGCGW

SEQ ID NO: 3012902 - protein, 26 aa, Entamoeba invadens
PTADQLLQFAFFDPHVVPASLPEDSL

SEQ ID NO: 3012903 - protein, 25 aa, Entamoeba invadens
PTAQAKINIYKPSQSKLHTSTSNNM

SEQ ID NO: 3012904 - protein, 26 aa, Entamoeba invadens
PTAQFLQMIAFTNYYERFLLVPQSKG

SEQ ID NO: 3012905 - protein, 19 aa, Entamoeba invadens
PTAVCTDSPMRCENPGFSN

SEQ ID NO: 3012906 - protein, 21 aa, Entamoeba invadens
PTCLKTIEKFTFYGCKNLVEV

SEQ ID NO: 3012907 - protein, 35 aa, Entamoeba invadens
PTDAPLLPPSDLLPPPGLAPPAGLAPPPNIPPPPQ

SEQ ID NO: 3012908 - protein, 21 aa, Entamoeba invadens
PTDIFRLKRIWVDPTQSVVQN

SEQ ID NO: 3012909 - protein, 20 aa, Entamoeba invadens
PTDLAKAFPGLKGTEAILQF

SEQ ID NO: 3012910 - protein, 25 aa, Entamoeba invadens
PTEDTPPVVPLLTLSNQFLDGSSET

SEQ ID NO: 3012911 - protein, 23 aa, Entamoeba invadens
PTEFRLQIWNMFLQPKKEFVETK

SEQ ID NO: 3012912 - protein, 28 aa, Entamoeba invadens
PTEIPEFEKFIFVILKKLMPSENVIKEI

SEQ ID NO: 3012913 - protein, 24 aa, Entamoeba invadens
PTELHPMLQFYMDNVPMVKSISEK

SEQ ID NO: 3012914 - protein, 33 aa, Entamoeba invadens
PTFASNVYALALIFWQTFSQKPLFEEYKTKGIE

SEQ ID NO: 3012915 - protein, 37 aa, Entamoeba invadens
PTFTDFLVSEIVHFQYVGNILVFARSVLSSSSSQIAK

SEQ ID NO: 3012916 - protein, 24 aa, Entamoeba invadens
PTGADLFLKRLLKRVSDEMNVPML

SEQ ID NO: 3012917 - protein, 25 aa, Entamoeba invadens
PTGDSDMMMLFALKDLIGVGSTDAE

SEQ ID NO: 3012918 - protein, 28 aa, Entamoeba invadens
PTGHTLRFLSLPSFLRDLMQKVMKLQET

SEQ ID NO: 3012919 - protein, 37 aa, Entamoeba invadens
PTGLEGIKMKCAMCRNLAAFLLKKIRRDRLSAKEVMK

SEQ ID NO: 3012920 - protein, 17 aa, Entamoeba invadens
PTHFVIVMSRLFKTVSK

SEQ ID NO: 3012921 - protein, 17 aa, Entamoeba invadens
PTHFVVTPVSIAVYKKC

SEQ ID NO: 3012922 - protein, 31 aa, Entamoeba invadens
PTHKILYDYTPPQMISLIFSDLAVFTPSAVA

SEQ ID NO: 3012923 - protein, 21 aa, Entamoeba invadens
PTHKWDQPLFQMKPGDELPCD

SEQ ID NO: 3012924 - protein, 19 aa, Entamoeba invadens
PTHQIQIQGYIPLIFFDSM

SEQ ID NO: 3012925 - protein, 18 aa, Entamoeba invadens
PTIIQTLDPFQLLNPAIQ

SEQ ID NO: 3012926 - protein, 24 aa, Entamoeba invadens
PTIPQDLFMMIQETISSSVEELPQ

SEQ ID NO: 3012927 - protein, 19 aa, Entamoeba invadens
PTIPSGKYMYLLAQINFSE

SEQ ID NO: 3012928 - protein, 20 aa, Entamoeba invadens
PTIPSGKYMYLLAQINFSEM

SEQ ID NO: 3012929 - protein, 23 aa, Entamoeba invadens
PTIRAVVFLFQNLLRGDPPIPES

SEQ ID NO: 3012930 - protein, 25 aa, Entamoeba invadens
PTIVPNIACLWLKVLSIAQSECLCF

SEQ ID NO: 3012931 - protein, 31 aa, Entamoeba invadens
PTKLKYGISLFDQYFPTLKPEGIIEIAGEAG

SEQ ID NO: 3012932 - protein, 26 aa, Entamoeba invadens
PTKLNLTRFVMYPMRAKFNIKIKSLE

SEQ ID NO: 3012933 - protein, 22 aa, Entamoeba invadens
PTKRISYIPFNLSSSENSEIAE

SEQ ID NO: 3012934 - protein, 29 aa, Entamoeba invadens
PTKRREVMRLLQDFISELGFLVVVENETV

SEQ ID NO: 3012935 - protein, 28 aa, Entamoeba invadens
PTKTHIAAIYRVAAYLYSLNPFEIESDK

SEQ ID NO: 3012936 - protein, 27 aa, Entamoeba invadens
PTKTKPLQTPPLLLPQSFDLNKSFSQL

SEQ ID NO: 3012937 - protein, 18 aa, Entamoeba invadens
PTKYAWYIDKYLLSFCNI

SEQ ID NO: 3012938 - protein, 18 aa, Entamoeba invadens
PTLFNIFVDALASKNKIV

SEQ ID NO: 3012939 - protein, 29 aa, Entamoeba invadens
PTLKALGYQAFFKCPLLKEVVIPQTVLCL

SEQ ID NO: 3012940 - protein, 24 aa, Entamoeba invadens
PTLKKCLNLLLPLSEYTLLFESQK

SEQ ID NO: 3012941 - protein, 23 aa, Entamoeba invadens
PTLKLICYPTLKKVMSTIPSNIN

SEQ ID NO: 3012942 - protein, 36 aa, Entamoeba invadens
PTLKYTYQLNFLFKENPYLLSPTCSLKISYKLGDVD

SEQ ID NO: 3012943 - protein, 17 aa, Entamoeba invadens
PTLLFVEQLLTLFIQTV

SEQ ID NO: 3012944 - protein, 20 aa, Entamoeba invadens
PTLQKLLIQTSIKAAPNRVM

SEQ ID NO: 3012945 - protein, 30 aa, Entamoeba invadens
PTLRELKLSSIPFLAFKKVKHITPYLKRLE

SEQ ID NO: 3012946 - protein, 28 aa, Entamoeba invadens
PTLTKYPTTVYSLFAYPALENFAGVKYP

SEQ ID NO: 3012947 - protein, 20 aa, Entamoeba invadens
PTLVFDILQLKFKGVQVSQR

SEQ ID NO: 3012948 - protein, 17 aa, Entamoeba invadens
PTMFDIVSEEIYPFALK

SEQ ID NO: 3012949 - protein, 20 aa, Entamoeba invadens
PTMLLYQSPDAPDLMKLSWS

SEQ ID NO: 3012950 - protein, 29 aa, Entamoeba invadens
PTMNVPGKKFFFSVLSRNQKGDRKFILFV

SEQ ID NO: 3012951 - protein, 19 aa, Entamoeba invadens
PTMSILCGEILHLEDRLSC

SEQ ID NO: 3012952 - protein, 25 aa, Entamoeba invadens
PTNARLLLVGWDGFSILESTWVLWE

SEQ ID NO: 3012953 - protein, 25 aa, Entamoeba invadens
PTNELLYSYYIGLNGEMRRLYRFYK

SEQ ID NO: 3012954 - protein, 18 aa, Entamoeba invadens
PTNHAFLIVGYDLDQPYS

SEQ ID NO: 3012955 - protein, 31 aa, Entamoeba invadens
PTNKTGRVRWQWFDGKLFIDYPDNQNIKIEE

SEQ ID NO: 3012956 - protein, 27 aa, Entamoeba invadens
PTNLVPFPRNHFAMMSYSPIVTAEKAQ

SEQ ID NO: 3012957 - protein, 33 aa, Entamoeba invadens
PTPEVYSQIVSLIWQLLIIDLQKRISKSSPGSV

SEQ ID NO: 3012958 - protein, 25 aa, Entamoeba invadens
PTPFDFLCLLWEAVGYPTFVYGKQN

SEQ ID NO: 3012959 - protein, 26 aa, Entamoeba invadens
PTPFPEDPVVFIFHLSVTGSSTEIKP

SEQ ID NO: 3012960 - protein, 18 aa, Entamoeba invadens
PTPPKPRTWTKDPNVRLF

SEQ ID NO: 3012961 - protein, 24 aa, Entamoeba invadens
PTQFYKMIVWCLVDYNLTQIWEYN

SEQ ID NO: 3012962 - protein, 21 aa, Entamoeba invadens
PTQKCYLFIDYLGKCLNTKID

SEQ ID NO: 3012963 - protein, 38 aa, Entamoeba invadens
PTQQMFDMSLFPQSFVQFLAWQRLLQIYSKLDAKNVEM

SEQ ID NO: 3012964 - protein, 23 aa, Entamoeba invadens
PTQSVVQNIIWIKHVLGIEDTFE

SEQ ID NO: 3012965 - protein, 25 aa, Entamoeba invadens
PTQTTYEFKYLISGLYDIRVCEYKY

SEQ ID NO: 3012966 - protein, 23 aa, Entamoeba invadens
PTRAIFFSQMLLPESVLTFQYTA

SEQ ID NO: 3012967 - protein, 20 aa, Entamoeba invadens
PTRKTEAYVKLKLKTVKGEE

SEQ ID NO: 3012968 - protein, 18 aa, Entamoeba invadens
PTRPKFPRTHPRFRTLRA

SEQ ID NO: 3012969 - protein, 34 aa, Entamoeba invadens
PTSFKLTPNFSIYPQFMFHLRRSHFLRVFNCTPD

SEQ ID NO: 3012970 - protein, 18 aa, Entamoeba invadens
PTSIFKICYGFRKNQYHV

SEQ ID NO: 3012971 - protein, 31 aa, Entamoeba invadens
PTSITKIGVHNIWYGVPRKYDVPSTVVEIGK

SEQ ID NO: 3012972 - protein, 21 aa, Entamoeba invadens
PTSLEYVGPLVFFDCKKMKEL

SEQ ID NO: 3012973 - protein, 27 aa, Entamoeba invadens
PTSLPFPVNFKYVLFSTLKPIERLTST

SEQ ID NO: 3012974 - protein, 24 aa, Entamoeba invadens
PTSNALLLDLLWADPITQDELDSK

SEQ ID NO: 3012975 - protein, 31 aa, Entamoeba invadens
PTSRQSVMYLLYYFCFSLKDKFSDFIGNGIY

SEQ ID NO: 3012976 - protein, 30 aa, Entamoeba invadens
PTSRWNVRILYDLLDIAALNAYKVYHHHHD

SEQ ID NO: 3012977 - protein, 29 aa, Entamoeba invadens
PTSSEDIVEIYKFWRDMILTGQVNELLET

SEQ ID NO: 3012978 - protein, 28 aa, Entamoeba invadens
PTSYQWSVEGLLISISEYDIYTTLKCGI

SEQ ID NO: 3012979 - protein, 21 aa, Entamoeba invadens
PTTFWRTLLGQQVLKKDNIII

SEQ ID NO: 3012980 - protein, 23 aa, Entamoeba invadens
PTTGILQIFIYPDNCYGLYGDNG

SEQ ID NO: 3012981 - protein, 24 aa, Entamoeba invadens
PTTKVVFFTYNGKLVYHQVFDIPS

SEQ ID NO: 3012982 - protein, 19 aa, Entamoeba invadens
PTTLVGNAFLLKRKVPKEP

SEQ ID NO: 3012983 - protein, 22 aa, Entamoeba invadens
PTTPKIVFKAVNVWFGVTYSTF

SEQ ID NO: 3012984 - protein, 28 aa, Entamoeba invadens
PTTPLRFTDIILFGVTLPSSGQLSFVGA

SEQ ID NO: 3012985 - protein, 37 aa, Entamoeba invadens
PTTSSLGLKLDLQPNELPGFKTPFLSGVTATEPIQQP

SEQ ID NO: 3012986 - protein, 18 aa, Entamoeba invadens
PTVNWFWGPTGSGKTRKA

SEQ ID NO: 3012987 - protein, 26 aa, Entamoeba invadens
PTVSLWINFFIMKDVKVISRAQKESL

SEQ ID NO: 3012988 - protein, 21 aa, Entamoeba invadens
PTVTENQMFSQKLRMLEKSSQ

SEQ ID NO: 3012989 - protein, 23 aa, Entamoeba invadens
PTWCPTRWLSQGKIVFFRLSEME

SEQ ID NO: 3012990 - protein, 19 aa, Entamoeba invadens
PTYKRNFFQVNIWFEVAFT

SEQ ID NO: 3012991 - protein, 24 aa, Entamoeba invadens
PTYQDILNFLLINKKSQIAVKSLR

SEQ ID NO: 3012992 - protein, 20 aa, Entamoeba invadens
PTYSLKTKMNSVLYVLMWTA

SEQ ID NO: 3012993 - protein, 18 aa, Entamoeba invadens
PVAFLQMINAVMSGIGCV

SEQ ID NO: 3012994 - protein, 18 aa, Entamoeba invadens
PVAKSILSMVITHLPSPL

SEQ ID NO: 3012995 - protein, 18 aa, Entamoeba invadens
PVALKRMRITKKSKRAIL

SEQ ID NO: 3012996 - protein, 27 aa, Entamoeba invadens
PVANLSMKSGFFRFKKLYQMGVKIGMG

SEQ ID NO: 3012997 - protein, 24 aa, Entamoeba invadens
PVCLKKFGYFLPDLLVIENAKGEE

SEQ ID NO: 3012998 - protein, 26 aa, Entamoeba invadens
PVDEFKSCFYLLLNARARFKGDLGED

SEQ ID NO: 3012999 - protein, 29 aa, Entamoeba invadens
PVDPDALQIPTYFSVIKSPMDLGTIKKNL

SEQ ID NO: 3013000 - protein, 30 aa, Entamoeba invadens
PVDTTQRYIFSFPSIFFQKNPTLIIGNLYL

SEQ ID NO: 3013001 - protein, 25 aa, Entamoeba invadens
PVDVIPFHNDGFPDKPRLIKSVGDS

SEQ ID NO: 3013002 - protein, 18 aa, Entamoeba invadens
PVDVLVFDELADALNCTA

SEQ ID NO: 3013003 - protein, 18 aa, Entamoeba invadens
PVDYSLFVQSWPGELCDR

SEQ ID NO: 3013004 - protein, 27 aa, Entamoeba invadens
PVEEDSHDFLSFTKLSGTTGNGDKSVF

SEQ ID NO: 3013005 - protein, 35 aa, Entamoeba invadens
PVEFSKVILPKFFKHSNICSFVRQLNIYGFRKLET

SEQ ID NO: 3013006 - protein, 20 aa, Entamoeba invadens
PVFAGHFYPIMFYPIVLETP

SEQ ID NO: 3013007 - protein, 26 aa, Entamoeba invadens
PVFEKKFYRIIVWFNVEFGTVDRNKQ

SEQ ID NO: 3013008 - protein, 25 aa, Entamoeba invadens
PVFKDPFYFDTFNYSLQAFFDQFQG

SEQ ID NO: 3013009 - protein, 25 aa, Entamoeba invadens
PVFLQFLEIVVMFLRKYPTDFEFKE

SEQ ID NO: 3013010 - protein, 17 aa, Entamoeba invadens
PVFPIRNDVIVELYENK

SEQ ID NO: 3013011 - protein, 18 aa, Entamoeba invadens
PVFPIRNDVIVELYENKK

SEQ ID NO: 3013012 - protein, 19 aa, Entamoeba invadens
PVGCFTFCDNLSNLIISFG

SEQ ID NO: 3013013 - protein, 21 aa, Entamoeba invadens
PVHIRFPFEKYANKGKNVLLV

SEQ ID NO: 3013014 - protein, 18 aa, Entamoeba invadens
PVIFPPSPSPLISPAFGV

SEQ ID NO: 3013015 - protein, 27 aa, Entamoeba invadens
PVIKNPVGLLKPPPSNGIPLISPVHRT

SEQ ID NO: 3013016 - protein, 21 aa, Entamoeba invadens
PVILQCLGVPEKMPFKLIKGD

SEQ ID NO: 3013017 - protein, 20 aa, Entamoeba invadens
PVINALCELMLAADGIVIGS

SEQ ID NO: 3013018 - protein, 18 aa, Entamoeba invadens
PVIPKNPSILFTNQHQKL

SEQ ID NO: 3013019 - protein, 18 aa, Entamoeba invadens
PVITEDAGNIILMKARHP

SEQ ID NO: 3013020 - protein, 25 aa, Entamoeba invadens
PVKDKRAFLFTLRTKDEIGETTEKV

SEQ ID NO: 3013021 - protein, 18 aa, Entamoeba invadens
PVKKLTLNTLFALMSQEE

SEQ ID NO: 3013022 - protein, 19 aa, Entamoeba invadens
PVKKLTLNTLFALMSQEEK

SEQ ID NO: 3013023 - protein, 32 aa, Entamoeba invadens
PVKNNYVALSFNFADLKFKLDSSFKALCEITE

SEQ ID NO: 3013024 - protein, 17 aa, Entamoeba invadens
PVKPFMCFDKTPFAINP

SEQ ID NO: 3013025 - protein, 36 aa, Entamoeba invadens
PVKQFYNDPVLLIDFKSLYPSIIMEFAVCFTNNTIG

SEQ ID NO: 3013026 - protein, 20 aa, Entamoeba invadens
PVKSGFADFAISVAVIHHFS

SEQ ID NO: 3013027 - protein, 22 aa, Entamoeba invadens
PVLALWKQNHVLKLLYEFVPNG

SEQ ID NO: 3013028 - protein, 21 aa, Entamoeba invadens
PVLCFEYPGFYPNTTFSKASL

SEQ ID NO: 3013029 - protein, 21 aa, Entamoeba invadens
PVLEEKIIPHLLIMLNDDVSN

SEQ ID NO: 3013030 - protein, 21 aa, Entamoeba invadens
PVLLIQDVTYMYIRHNNLYFM

SEQ ID NO: 3013031 - protein, 24 aa, Entamoeba invadens
PVLNPYYYEMPMKTILDKTSDKKL

SEQ ID NO: 3013032 - protein, 17 aa, Entamoeba invadens
PVLPFVRIVDDIAFLLL

SEQ ID NO: 3013033 - protein, 28 aa, Entamoeba invadens
PVLQAMNWKSYALKYPELYGKKVTRAPT

SEQ ID NO: 3013034 - protein, 18 aa, Entamoeba invadens
PVLRAVGINPVLKGKKTE

SEQ ID NO: 3013035 - protein, 17 aa, Entamoeba invadens
PVLVRQILKTVYENYLD

SEQ ID NO: 3013036 - protein, 21 aa, Entamoeba invadens
PVMLEIIRILNYDKPTPVQRQ

SEQ ID NO: 3013037 - protein, 21 aa, Entamoeba invadens
PVMPTMPTLPSFSPATTNVAA

SEQ ID NO: 3013038 - protein, 17 aa, Entamoeba invadens
PVMRLETSAFFGTKIEK

SEQ ID NO: 3013039 - protein, 25 aa, Entamoeba invadens
PVMSISWSSFPTVPLRCLYTTFTDT

SEQ ID NO: 3013040 - protein, 17 aa, Entamoeba invadens
PVNDYLEYYVPDLKITI

SEQ ID NO: 3013041 - protein, 28 aa, Entamoeba invadens
PVNIRVALCFTPLFTTAAHFQIDAIFAV

SEQ ID NO: 3013042 - protein, 30 aa, Entamoeba invadens
PVNTIPLHIFMTDIFWDGHAVDPLIVGDAL

SEQ ID NO: 3013043 - protein, 18 aa, Entamoeba invadens
PVNVLYYPYKEGEMYPYT

SEQ ID NO: 3013044 - protein, 19 aa, Entamoeba invadens
PVPAGTQKLYLLIEGKTEE

SEQ ID NO: 3013045 - protein, 20 aa, Entamoeba invadens
PVPDLPFTFETPNPLRNRAM

SEQ ID NO: 3013046 - protein, 28 aa, Entamoeba invadens
PVPERKLRIFHGLTFRVGYCGVTERTLI

SEQ ID NO: 3013047 - protein, 17 aa, Entamoeba invadens
PVPFFPGTKGMLESSKM

SEQ ID NO: 3013048 - protein, 19 aa, Entamoeba invadens
PVPFNLMFATDIGPVGDLK

SEQ ID NO: 3013049 - protein, 17 aa, Entamoeba invadens
PVQKATIPVILARRDLM

SEQ ID NO: 3013050 - protein, 18 aa, Entamoeba invadens
PVQLPDFSHVFSPTPFEV

SEQ ID NO: 3013051 - protein, 30 aa, Entamoeba invadens
PVQNPRANIHFFLYKPRLIGAKCVGFHQLC

SEQ ID NO: 3013052 - protein, 25 aa, Entamoeba invadens
PVQNTLLFDLLWADPISDEKTSQDG

SEQ ID NO: 3013053 - protein, 29 aa, Entamoeba invadens
PVQRLPRYKLLLTDLFRHYWDTHDDYASL

SEQ ID NO: 3013054 - protein, 17 aa, Entamoeba invadens
PVRCFYGCTNLKTITGL

SEQ ID NO: 3013055 - protein, 18 aa, Entamoeba invadens
PVRIPTKTLRITTRRTPC

SEQ ID NO: 3013056 - protein, 17 aa, Entamoeba invadens
PVRLIYGKGATAEIEKQ

SEQ ID NO: 3013057 - protein, 18 aa, Entamoeba invadens
PVRSVMFHPDRPIFVTGG

SEQ ID NO: 3013058 - protein, 25 aa, Entamoeba invadens
PVSKKGYLYICLKCTKGGVPFKRPI

SEQ ID NO: 3013059 - protein, 17 aa, Entamoeba invadens
PVSPTFEKKLEKRKLRK

SEQ ID NO: 3013060 - protein, 25 aa, Entamoeba invadens
PVSSGRKWQPPAKAAEPAAPVQQYE

SEQ ID NO: 3013061 - protein, 25 aa, Entamoeba invadens
PVSYGFFIRMKTLGNYDFKNVIFTY

SEQ ID NO: 3013062 - protein, 22 aa, Entamoeba invadens
PVTIDKKTMYYCPFCSRCFLYA

SEQ ID NO: 3013063 - protein, 27 aa, Entamoeba invadens
PVTKLQPCFGIFYTISKFKKFVPDTEI

SEQ ID NO: 3013064 - protein, 24 aa, Entamoeba invadens
PVTRRLFELFDRYDGNEQVQFVQF

SEQ ID NO: 3013065 - protein, 19 aa, Entamoeba invadens
PVTWIVPHEFMIEKSETVD

SEQ ID NO: 3013066 - protein, 20 aa, Entamoeba invadens
PVVILKMYDHFMYYNHICIV

SEQ ID NO: 3013067 - protein, 17 aa, Entamoeba invadens
PVVLEVCNDAIFFFGKN

SEQ ID NO: 3013068 - protein, 24 aa, Entamoeba invadens
PVVNSLSPTLLPNSTIKSLKEEDI

SEQ ID NO: 3013069 - protein, 30 aa, Entamoeba invadens
PVVVDALFIDKFNLLVAALLDNSMIDVYLY

SEQ ID NO: 3013070 - protein, 30 aa, Entamoeba invadens
PVVVPVEFLVFLARVWTIRISSRKKDETNK

SEQ ID NO: 3013071 - protein, 19 aa, Entamoeba invadens
PVYCLVDFDPCGLDIFASY

SEQ ID NO: 3013072 - protein, 25 aa, Entamoeba invadens
PVYDTYSNILLTYTIDHALIHIPSN

SEQ ID NO: 3013073 - protein, 19 aa, Entamoeba invadens
PVYKKLPMPKSKKVLHRFG

SEQ ID NO: 3013074 - protein, 24 aa, Entamoeba invadens
PVYMHYSEFSFFPHQSRIGNSHTQ

SEQ ID NO: 3013075 - protein, 25 aa, Entamoeba invadens
PVYMHYSEFSFFPHQSRIGNSHTQT

SEQ ID NO: 3013076 - protein, 25 aa, Entamoeba invadens
PVYSGYFFLLEFVGAPFESMPNPLG

SEQ ID NO: 3013077 - protein, 18 aa, Entamoeba invadens
PWDISFYINIIKEQDYKL

SEQ ID NO: 3013078 - protein, 26 aa, Entamoeba invadens
PWERLRLLREKIPNVMFQMLLRGRNA

SEQ ID NO: 3013079 - protein, 18 aa, Entamoeba invadens
PWNIQELPKMRAISNIKT

SEQ ID NO: 3013080 - protein, 28 aa, Entamoeba invadens
PWVEMPDHALLFIKRFIKAWSDCQKAEF

SEQ ID NO: 3013081 - protein, 20 aa, Entamoeba invadens
PYAPMLTLKFPDPEIRIVYD

SEQ ID NO: 3013082 - protein, 17 aa, Entamoeba invadens
PYCFRFCSALSSFSFPD

SEQ ID NO: 3013083 - protein, 31 aa, Entamoeba invadens
PYDIKNLAKYFYLNYLIIEQFNTIDLDKLKD

SEQ ID NO: 3013084 - protein, 28 aa, Entamoeba invadens
PYEEEVYLMYFRFELDQILTKKKVILFN

SEQ ID NO: 3013085 - protein, 36 aa, Entamoeba invadens
PYELGVIDVYPKFIRVFTPLLLGALTKKDLFKKETA

SEQ ID NO: 3013086 - protein, 23 aa, Entamoeba invadens
PYENLLSILPTLQQTLQDVSDKT

SEQ ID NO: 3013087 - protein, 23 aa, Entamoeba invadens
PYESLDMLSQIVKLPIVKLGGKG

SEQ ID NO: 3013088 - protein, 18 aa, Entamoeba invadens
PYEYYMIRPIVQASKYEA

SEQ ID NO: 3013089 - protein, 24 aa, Entamoeba invadens
PYFEQELYVFIPSEITPVAPSINL

SEQ ID NO: 3013090 - protein, 19 aa, Entamoeba invadens
PYGCFQRCKFLMKSRIFIK

SEQ ID NO: 3013091 - protein, 23 aa, Entamoeba invadens
PYGCRVIQRILEKIPTEKSYPLL

SEQ ID NO: 3013092 - protein, 24 aa, Entamoeba invadens
PYGGVDWFDWNVVIGNIEGIVEMW

SEQ ID NO: 3013093 - protein, 23 aa, Entamoeba invadens
PYGKTYRVLPLLSGGVIEMVGCT

SEQ ID NO: 3013094 - protein, 18 aa, Entamoeba invadens
PYGLVLAPTRELAKQIDD

SEQ ID NO: 3013095 - protein, 21 aa, Entamoeba invadens
PYHQPFYGYCPPPFPMMGQNP

SEQ ID NO: 3013096 - protein, 17 aa, Entamoeba invadens
PYIPRMDTMFYTLNTKY

SEQ ID NO: 3013097 - protein, 24 aa, Entamoeba invadens
PYIRQSQCFMIIYSINNKETFACA

SEQ ID NO: 3013098 - protein, 32 aa, Entamoeba invadens
PYKKELLNTLFILHLLWMQYEGDWLDLLEKLR

SEQ ID NO: 3013099 - protein, 18 aa, Entamoeba invadens
PYKSFICLLLVKQAATDE

SEQ ID NO: 3013100 - protein, 26 aa, Entamoeba invadens
PYMKKRHIAMWAPTLRNNMALLAIDP

SEQ ID NO: 3013101 - protein, 25 aa, Entamoeba invadens
PYMSVYKFLIGFTQKNYYAQFSSFY

SEQ ID NO: 3013102 - protein, 24 aa, Entamoeba invadens
PYNCTLSVHKLLDTAGITFCFDNE

SEQ ID NO: 3013103 - protein, 18 aa, Entamoeba invadens
PYNGYRLTYLGYDYLALR

SEQ ID NO: 3013104 - protein, 17 aa, Entamoeba invadens
PYNPLLGEFYRTSWEHS

SEQ ID NO: 3013105 - protein, 23 aa, Entamoeba invadens
PYNTKPLVFYKRKEYVVALRLYN

SEQ ID NO: 3013106 - protein, 18 aa, Entamoeba invadens
PYPSQRKFIGKTVLTLLC

SEQ ID NO: 3013107 - protein, 24 aa, Entamoeba invadens
PYQFYEAWDQLTVAVSLIINSDLP

SEQ ID NO: 3013108 - protein, 20 aa, Entamoeba invadens
PYRDRIYMKYPNLGNIIEIG

SEQ ID NO: 3013109 - protein, 21 aa, Entamoeba invadens
PYREDGIVKLLFRTVTNGAMG

SEQ ID NO: 3013110 - protein, 24 aa, Entamoeba invadens
PYSEAIIMAINPKLKTLTPTDTPT

SEQ ID NO: 3013111 - protein, 21 aa, Entamoeba invadens
PYSQQPMYPPKEQFNGISGLP

SEQ ID NO: 3013112 - protein, 17 aa, Entamoeba invadens
PYSYFHIKLFDGHFDSQ

SEQ ID NO: 3013113 - protein, 25 aa, Entamoeba invadens
PYVHANYSYTRYLQPPLFSCSNPGV

SEQ ID NO: 3013114 - protein, 20 aa, Entamoeba invadens
PYVRKTAVLCVLKLYCMNPQ

SEQ ID NO: 3013115 - protein, 21 aa, Entamoeba invadens
PYVYQNLYFYKRKEQIENKDS

SEQ ID NO: 3013116 - protein, 32 aa, Entamoeba invadens
PYYHELVPGSHFFPFSITIPIVSHPSIHFING

SEQ ID NO: 3013117 - protein, 20 aa, Entamoeba invadens
QAALLQYFSSYNTYSEFSSE

SEQ ID NO: 3013118 - protein, 24 aa, Entamoeba invadens
QACAAFDYKCVLVLGICDNPIIEK

SEQ ID NO: 3013119 - protein, 23 aa, Entamoeba invadens
QADKYTIFIGNLSKLQATQKQIE

SEQ ID NO: 3013120 - protein, 21 aa, Entamoeba invadens
QADLIVFCPKKHKYVGNGLKQ

SEQ ID NO: 3013121 - protein, 23 aa, Entamoeba invadens
QADLQAIYIALLARHCTITIGRP

SEQ ID NO: 3013122 - protein, 27 aa, Entamoeba invadens
QADLQNVLIMLLSKHADIYIGKTSKKA

SEQ ID NO: 3013123 - protein, 18 aa, Entamoeba invadens
QADLQSLLIALLTKHCKI

SEQ ID NO: 3013124 - protein, 19 aa, Entamoeba invadens
QADLTVAYILDLCSKDAIL

SEQ ID NO: 3013125 - protein, 23 aa, Entamoeba invadens
QAEKSIHSLIAQKADLQKELEKE

SEQ ID NO: 3013126 - protein, 19 aa, Entamoeba invadens
QAERIKRAVSERKDELRRK

SEQ ID NO: 3013127 - protein, 29 aa, Entamoeba invadens
QAFDIVRKTHFIYLPFKSHDLLKQIENFQ

SEQ ID NO: 3013128 - protein, 29 aa, Entamoeba invadens
QAFDMFQVGSVYFIYCRQFKEIKSSIHLR

SEQ ID NO: 3013129 - protein, 38 aa, Entamoeba invadens
QAFESRLTVPLKYPIKRGIIIDFDLMDSIWDAAVDPLQ

SEQ ID NO: 3013130 - protein, 23 aa, Entamoeba invadens
QAFKRLYCLKVIHLEGNPIAEDD

SEQ ID NO: 3013131 - protein, 18 aa, Entamoeba invadens
QAFLIESRYYWVENVEEI

SEQ ID NO: 3013132 - protein, 17 aa, Entamoeba invadens
QAFWKYNNTIDYANYLR

SEQ ID NO: 3013133 - protein, 20 aa, Entamoeba invadens
QAGRGWMEFVEVGNPVLNKK

SEQ ID NO: 3013134 - protein, 30 aa, Entamoeba invadens
QAHLKPLQCVGGFLILRLICPAIMQPNKSG

SEQ ID NO: 3013135 - protein, 25 aa, Entamoeba invadens
QAHRFFVMEGVLTKVCRKANKERYF

SEQ ID NO: 3013136 - protein, 25 aa, Entamoeba invadens
QAIEKVCCNLVRLFDITTAIVKDTP

SEQ ID NO: 3013137 - protein, 22 aa, Entamoeba invadens
QAIFSLFNIILSKLKPEHFIVL

SEQ ID NO: 3013138 - protein, 18 aa, Entamoeba invadens
QAIKRREAYHLLEDFLFM

SEQ ID NO: 3013139 - protein, 19 aa, Entamoeba invadens
QAILKFLKSALSINPDYFS

SEQ ID NO: 3013140 - protein, 23 aa, Entamoeba invadens
QAILPYDQYLHRFAAYFQQGDME

SEQ ID NO: 3013141 - protein, 17 aa, Entamoeba invadens
QAIWNTKHRQWLSTKMK

SEQ ID NO: 3013142 - protein, 17 aa, Entamoeba invadens
QAKDRMISLTKLAVQTG

SEQ ID NO: 3013143 - protein, 23 aa, Entamoeba invadens
QAKGFVKNSFFTGLNATEFFFHT

SEQ ID NO: 3013144 - protein, 37 aa, Entamoeba invadens
QAKNAFTTLIFLRYLFVPFMRFPNLLKNFQATVSTRL

SEQ ID NO: 3013145 - protein, 19 aa, Entamoeba invadens
QAKQFVITAISLAIARDGS

SEQ ID NO: 3013146 - protein, 25 aa, Entamoeba invadens
QAKQNFLLYFSTHGDSLVALKNTLI

SEQ ID NO: 3013147 - protein, 18 aa, Entamoeba invadens
QAKQYARKVEEAERKLAE

SEQ ID NO: 3013148 - protein, 26 aa, Entamoeba invadens
QAKSNELCLRLFKPTIYNDAAVERIA

SEQ ID NO: 3013149 - protein, 19 aa, Entamoeba invadens
QAKYFSSGYFPMNEYRHYG

SEQ ID NO: 3013150 - protein, 33 aa, Entamoeba invadens
QALKDDMEKTEKIWLLEFDAEDTNRKKDAQEKQ

SEQ ID NO: 3013151 - protein, 30 aa, Entamoeba invadens
QALLASETVLFLLSLVPGVFFTKPNLKEVD

SEQ ID NO: 3013152 - protein, 17 aa, Entamoeba invadens
QALLDWVNSKIAPKKIT

SEQ ID NO: 3013153 - protein, 34 aa, Entamoeba invadens
QALNPVINILTRRIVHIFERLFDVAIGAMENITA

SEQ ID NO: 3013154 - protein, 18 aa, Entamoeba invadens
QALPLYLAQKMDSAQILP

SEQ ID NO: 3013155 - protein, 17 aa, Entamoeba invadens
QALQFRFANPFQKSTQL

SEQ ID NO: 3013156 - protein, 35 aa, Entamoeba invadens
QALQSIRKFAFYYCINFSQIVLPISLVDIGSSAFS

SEQ ID NO: 3013157 - protein, 17 aa, Entamoeba invadens
QALRRTMEIHSKTTRFV

SEQ ID NO: 3013158 - protein, 31 aa, Entamoeba invadens
QALSRGCAQLAFYLKALAANSSVVLREKIIG

SEQ ID NO: 3013159 - protein, 17 aa, Entamoeba invadens
QALYLMTMGCRTAAFRN

SEQ ID NO: 3013160 - protein, 18 aa, Entamoeba invadens
QAMNFFQGQPQQPQQFQQ

SEQ ID NO: 3013161 - protein, 19 aa, Entamoeba invadens
QAMVLLAKIFIEKNTEDDK

SEQ ID NO: 3013162 - protein, 27 aa, Entamoeba invadens
QAQVVKHRWFPKLVKTRNPIVISVGWR

SEQ ID NO: 3013163 - protein, 26 aa, Entamoeba invadens
QASFGMIISLIKKVAFYSGAFLQKTC

SEQ ID NO: 3013164 - protein, 25 aa, Entamoeba invadens
QATAQLPSCYTLMKATEKTTPKVFE

SEQ ID NO: 3013165 - protein, 28 aa, Entamoeba invadens
QATKESQIMFLYEPPPGFSLEEKIEERM

SEQ ID NO: 3013166 - protein, 28 aa, Entamoeba invadens
QAVNDGVMTPLLHKFLKATVMKTDNKEM

SEQ ID NO: 3013167 - protein, 17 aa, Entamoeba invadens
QAYFRRFSAKNTMNSLR

SEQ ID NO: 3013168 - protein, 19 aa, Entamoeba invadens
QAYPGYPQQAGACAQQPQG

SEQ ID NO: 3013169 - protein, 23 aa, Entamoeba invadens
QAYSLFIISKLAADPKFVELFIT

SEQ ID NO: 3013170 - protein, 31 aa, Entamoeba invadens
QAYYPLSKFMEFLTIPYMIDNVILLLTGTQA

SEQ ID NO: 3013171 - protein, 21 aa, Entamoeba invadens
QCCHYGKVLLPKLLDIPKEKQ

SEQ ID NO: 3013172 - protein, 25 aa, Entamoeba invadens
QCDGLPLLLSLHKRNFIYKMLSVCY

SEQ ID NO: 3013173 - protein, 17 aa, Entamoeba invadens
QCDSCLIGYTYRDHTCT

SEQ ID NO: 3013174 - protein, 27 aa, Entamoeba invadens
QCDVQAYSLALLSPYCRITVTKPRRKT

SEQ ID NO: 3013175 - protein, 18 aa, Entamoeba invadens
QCEGFALDWSSVVEGRLI

SEQ ID NO: 3013176 - protein, 25 aa, Entamoeba invadens
QCFKKAKDVLGFPNLLDPKETANGS

SEQ ID NO: 3013177 - protein, 17 aa, Entamoeba invadens
QCFTEEWGWFSVTVHKL

SEQ ID NO: 3013178 - protein, 18 aa, Entamoeba invadens
QCGDITYLDNGKCMECGY

SEQ ID NO: 3013179 - protein, 20 aa, Entamoeba invadens
QCGFTDCYSLPISGFSGLNL

SEQ ID NO: 3013180 - protein, 28 aa, Entamoeba invadens
QCGQNEFLKLHNFLYNPTEFPITKFNIS

SEQ ID NO: 3013181 - protein, 18 aa, Entamoeba invadens
QCHYLTQIVFNETLKRIK

SEQ ID NO: 3013182 - protein, 18 aa, Entamoeba invadens
QCISCKNGYYLGENNKCI

SEQ ID NO: 3013183 - protein, 27 aa, Entamoeba invadens
QCIVHVMPLVKYFERGMWKNEVNTTNP

SEQ ID NO: 3013184 - protein, 20 aa, Entamoeba invadens
QCLLCQCLFLNKIPIKDLVI

SEQ ID NO: 3013185 - protein, 27 aa, Entamoeba invadens
QCLRCDGLYYFSELKCVVTTNCNTPST

SEQ ID NO: 3013186 - protein, 17 aa, Entamoeba invadens
QCLSHDFFSFDLHGLYS

SEQ ID NO: 3013187 - protein, 18 aa, Entamoeba invadens
QCMMYRIKPMTSPTMKYK

SEQ ID NO: 3013188 - protein, 27 aa, Entamoeba invadens
QCNKKVMNFPFMMGQGVWYGSKELKES

SEQ ID NO: 3013189 - protein, 24 aa, Entamoeba invadens
QCPLNQLTNLQLFRPKKVSAKEIN

SEQ ID NO: 3013190 - protein, 22 aa, Entamoeba invadens
QCPTSFRLLTRPKLVIQYTPSM

SEQ ID NO: 3013191 - protein, 22 aa, Entamoeba invadens
QCTKILTYLSLKSTLIEGKDNT

SEQ ID NO: 3013192 - protein, 18 aa, Entamoeba invadens
QCTKLTEIFFPKCVTEIC

SEQ ID NO: 3013193 - protein, 23 aa, Entamoeba invadens
QCVLQVHRILLRVLSIVDGDAYL

SEQ ID NO: 3013194 - protein, 21 aa, Entamoeba invadens
QCVPLFEGTPLHHAITTSPIG

SEQ ID NO: 3013195 - protein, 21 aa, Entamoeba invadens
QCVVLRLDKIIKECTIEFKTK

SEQ ID NO: 3013196 - protein, 18 aa, Entamoeba invadens
QCWKLFNKCVCEISPENF

SEQ ID NO: 3013197 - protein, 23 aa, Entamoeba invadens
QCYLNSLHLAFSLGCESIAFCCI

SEQ ID NO: 3013198 - protein, 33 aa, Entamoeba invadens
QDAIRRGLVFFWRSQSDLPFRIVIIGAGGCTLT

SEQ ID NO: 3013199 - protein, 30 aa, Entamoeba invadens
QDAKKAFSIPFWVSLRFYQSFMFDMSKLSR

SEQ ID NO: 3013200 - protein, 25 aa, Entamoeba invadens
QDAVVFRFIAFRNYITKHINEIVVI

SEQ ID NO: 3013201 - protein, 24 aa, Entamoeba invadens
QDDQPLVVYAFLDLIEELLDTFPH

SEQ ID NO: 3013202 - protein, 25 aa, Entamoeba invadens
QDDTNLYLILEYCPGGDLATLLEHI

SEQ ID NO: 3013203 - protein, 24 aa, Entamoeba invadens
QDDVNLYLIMEYCPGGDLATLLEQ

SEQ ID NO: 3013204 - protein, 22 aa, Entamoeba invadens
QDEAIKELLSLKEEALELQESV

SEQ ID NO: 3013205 - protein, 20 aa, Entamoeba invadens
QDEFPHVLNPLLQNPRTICN

SEQ ID NO: 3013206 - protein, 26 aa, Entamoeba invadens
QDEQPPFPYPSWRSVVLPQGFVMFYY

SEQ ID NO: 3013207 - protein, 23 aa, Entamoeba invadens
QDERVMQFFGLVNDLLASSPYTS

SEQ ID NO: 3013208 - protein, 26 aa, Entamoeba invadens
QDEVKRLKLLILKQEDSQTEIVSSYE

SEQ ID NO: 3013209 - protein, 24 aa, Entamoeba invadens
QDEWKYLLVLMKSVTSSGAFLKKN

SEQ ID NO: 3013210 - protein, 27 aa, Entamoeba invadens
QDGGEQFLVRIYQKAMLCAENAGRNYV

SEQ ID NO: 3013211 - protein, 26 aa, Entamoeba invadens
QDGIRYLSNLLLTDLGYTPITLKATS

SEQ ID NO: 3013212 - protein, 25 aa, Entamoeba invadens
QDHTAFPMQFDNPTPFNPRVMDRAQ

SEQ ID NO: 3013213 - protein, 22 aa, Entamoeba invadens
QDHWTGYRHSILTIDKILLFSQ

SEQ ID NO: 3013214 - protein, 18 aa, Entamoeba invadens
QDIAGPVIELLLLGKHDE

SEQ ID NO: 3013215 - protein, 24 aa, Entamoeba invadens
QDIKKFKVFNTNNIWMKMASVKSV

SEQ ID NO: 3013216 - protein, 22 aa, Entamoeba invadens
QDILRHGLFINESILNKMTPEG

SEQ ID NO: 3013217 - protein, 19 aa, Entamoeba invadens
QDIVLPPRPPMKQRASPQI

SEQ ID NO: 3013218 - protein, 27 aa, Entamoeba invadens
QDIWNCFPKVTILFAKKICKKVPLCEQ

SEQ ID NO: 3013219 - protein, 17 aa, Entamoeba invadens
QDKAFKYIERYTELMQR

SEQ ID NO: 3013220 - protein, 22 aa, Entamoeba invadens
QDKFKYAKGNLFNFVLQDKEGG

SEQ ID NO: 3013221 - protein, 24 aa, Entamoeba invadens
QDKIDFFRVKIWCPINYDLFQTLK

SEQ ID NO: 3013222 - protein, 25 aa, Entamoeba invadens
QDKLRPLWSYYYAGSNAIIYVLDSN

SEQ ID NO: 3013223 - protein, 22 aa, Entamoeba invadens
QDKPSCFPAFILNPEENSECID

SEQ ID NO: 3013224 - protein, 28 aa, Entamoeba invadens
QDKRAEELWNLVVLFSSLELENGKEGCD

SEQ ID NO: 3013225 - protein, 33 aa, Entamoeba invadens
QDLKKLMVNMVPFPRLHFFSSSIAPLSSALAIQ

SEQ ID NO: 3013226 - protein, 21 aa, Entamoeba invadens
QDLLAPIYREIVEKKVVCFDW

SEQ ID NO: 3013227 - protein, 22 aa, Entamoeba invadens
QDLLKQVFKFVWRIKDLEVEPN

SEQ ID NO: 3013228 - protein, 19 aa, Entamoeba invadens
QDLMVEWHLQKGKEKKSEI

SEQ ID NO: 3013229 - protein, 17 aa, Entamoeba invadens
QDLTAKAARFKKNASKY

SEQ ID NO: 3013230 - protein, 18 aa, Entamoeba invadens
QDMSVIALAVKYMREQMP

SEQ ID NO: 3013231 - protein, 24 aa, Entamoeba invadens
QDNATFLRNLDLPQQLHLQQNIIQ

SEQ ID NO: 3013232 - protein, 24 aa, Entamoeba invadens
QDNLDIFIFPSGHVLLHMKAKTLT

SEQ ID NO: 3013233 - protein, 24 aa, Entamoeba invadens
QDPDIYFQLNMNNVYKKKGDADKQ

SEQ ID NO: 3013234 - protein, 24 aa, Entamoeba invadens
QDPKLMAQFLIDNGFDILFTIGGD

SEQ ID NO: 3013235 - protein, 29 aa, Entamoeba invadens
QDPNTSTFKLSPQFTYSLITYDNKEVNGI

SEQ ID NO: 3013236 - protein, 17 aa, Entamoeba invadens
QDQMLFQPPPVPPKRPY

SEQ ID NO: 3013237 - protein, 17 aa, Entamoeba invadens
QDQSFDLTKTFETLHNE

SEQ ID NO: 3013238 - protein, 26 aa, Entamoeba invadens
QDRRLIGRLPEILNAVPKMIVVLQRV

SEQ ID NO: 3013239 - protein, 21 aa, Entamoeba invadens
QDRVFLVNNILIKAAGNPKEN

SEQ ID NO: 3013240 - protein, 23 aa, Entamoeba invadens
QDSFPLFETPWVEMPDCCIKFLK

SEQ ID NO: 3013241 - protein, 23 aa, Entamoeba invadens
QDTHGMLLSCFSAFWVETNGNVN

SEQ ID NO: 3013242 - protein, 27 aa, Entamoeba invadens
QDTKCPLSSLWKLLASTPMNTGPISVE

SEQ ID NO: 3013243 - protein, 43 aa, Entamoeba invadens
QDTRKVGWMLFVWRMQSAWKEGKMELAWMFFNKAKDLVKDSNE

SEQ ID NO: 3013244 - protein, 27 aa, Entamoeba invadens
QDTSYFRYEVIQDFLYRSLKNSLETQI

SEQ ID NO: 3013245 - protein, 20 aa, Entamoeba invadens
QDTVDLIPIGAWLGEGKRSG

SEQ ID NO: 3013246 - protein, 20 aa, Entamoeba invadens
QDVKPVVIMTPPQLKMFHQE

SEQ ID NO: 3013247 - protein, 25 aa, Entamoeba invadens
QDVKTVRLLLYGIQKVILVGDSYKE

SEQ ID NO: 3013248 - protein, 25 aa, Entamoeba invadens
QDVLTLQMLRLMNNIWKSAGLDLRM

SEQ ID NO: 3013249 - protein, 26 aa, Entamoeba invadens
QDVTPPSLLIATLPTSLEVFAVPPPR

SEQ ID NO: 3013250 - protein, 25 aa, Entamoeba invadens
QDVVVKICWLADKFGPDTKWKFDSI

SEQ ID NO: 3013251 - protein, 26 aa, Entamoeba invadens
QDVWNVWTTFICRITTAIFVKQVVMF

SEQ ID NO: 3013252 - protein, 19 aa, Entamoeba invadens
QDYLIVERTFQARNQNEMT

SEQ ID NO: 3013253 - protein, 26 aa, Entamoeba invadens
QEALCISLLIRHGVEFTLLKPRKTHT

SEQ ID NO: 3013254 - protein, 27 aa, Entamoeba invadens
QECKEWLTRPLSTYVICRCAYDTVCML

SEQ ID NO: 3013255 - protein, 24 aa, Entamoeba invadens
QEDDIYYAFLQFYDFILSQSEYMV

SEQ ID NO: 3013256 - protein, 18 aa, Entamoeba invadens
QEDFIYVNLKPKEKSRDG

SEQ ID NO: 3013257 - protein, 24 aa, Entamoeba invadens
QEDHCFLLQREALVKATEWISDAR

SEQ ID NO: 3013258 - protein, 28 aa, Entamoeba invadens
QEDHCQMLLTMIKSFWEEKPSLDMKMDN

SEQ ID NO: 3013259 - protein, 26 aa, Entamoeba invadens
QEDVEPLILLFKLTDKDEDGKLNFTE

SEQ ID NO: 3013260 - protein, 19 aa, Entamoeba invadens
QEEKKQFPCLFNLVKKMNA

SEQ ID NO: 3013261 - protein, 24 aa, Entamoeba invadens
QEEKNQFPCLFNLVKKMNAKSPTT

SEQ ID NO: 3013262 - protein, 33 aa, Entamoeba invadens
QEEKSFIFVFWERVQLFRMYLINVLNNVRKSDY

SEQ ID NO: 3013263 - protein, 29 aa, Entamoeba invadens
QEEPLRKSNFLNRRMSRAGSGKRFTTDST

SEQ ID NO: 3013264 - protein, 29 aa, Entamoeba invadens
QEEVLELHRLLQKWPLIEPSHALELLDFH

SEQ ID NO: 3013265 - protein, 24 aa, Entamoeba invadens
QEEYRDVKWKKMISNWTPTNVPRK

SEQ ID NO: 3013266 - protein, 24 aa, Entamoeba invadens
QEFRMNNKLYWTTFVESYSSIVST

SEQ ID NO: 3013267 - protein, 25 aa, Entamoeba invadens
QEGCMLFCEVALGKQWETLHDKYME

SEQ ID NO: 3013268 - protein, 27 aa, Entamoeba invadens
QEGPLNLEQFLLLSGTLKSVVAMIKAK

SEQ ID NO: 3013269 - protein, 31 aa, Entamoeba invadens
QEGQWVGYQLARTLYYLHSNGICHRDVKPEN

SEQ ID NO: 3013270 - protein, 20 aa, Entamoeba invadens
QEIALFVKYLVFQNNLNEPY

SEQ ID NO: 3013271 - protein, 26 aa, Entamoeba invadens
QEIDVYIPYIIILKNTKLRQDILENC

SEQ ID NO: 3013272 - protein, 26 aa, Entamoeba invadens
QEIHSSEILVFNLINDKIDSLEEQIK

SEQ ID NO: 3013273 - protein, 18 aa, Entamoeba invadens
QEIIIRYTRSENLQLVLY

SEQ ID NO: 3013274 - protein, 17 aa, Entamoeba invadens
QEIKLLGTVIKFDANLF

SEQ ID NO: 3013275 - protein, 24 aa, Entamoeba invadens
QEIPDMFHFNPISVTFKTQKYFPN

SEQ ID NO: 3013276 - protein, 28 aa, Entamoeba invadens
QEITPKIFQFIKPLYRKRLLVKIDGYDD

SEQ ID NO: 3013277 - protein, 23 aa, Entamoeba invadens
QEKKFLANRPLPETPREIAVKRA

SEQ ID NO: 3013278 - protein, 29 aa, Entamoeba invadens
QEKKFYPHYSGISDIFNLIKESPPDEATS

SEQ ID NO: 3013279 - protein, 25 aa, Entamoeba invadens
QEKKLEPVSPVLHFDFGMPDNETKN

SEQ ID NO: 3013280 - protein, 25 aa, Entamoeba invadens
QEKKNQFPCLFNLVKKMNAKIPLVQ

SEQ ID NO: 3013281 - protein, 24 aa, Entamoeba invadens
QEKKTILAPLKIFNQMDPMTAKWV

SEQ ID NO: 3013282 - protein, 19 aa, Entamoeba invadens
QEKKYRAETQLIKGKYEKD

SEQ ID NO: 3013283 - protein, 33 aa, Entamoeba invadens
QEKSELQLQLYLTPSLFDALFNIFRKLAKRKEY

SEQ ID NO: 3013284 - protein, 19 aa, Entamoeba invadens
QEKSLGTTPIIYVVGNKSD

SEQ ID NO: 3013285 - protein, 27 aa, Entamoeba invadens
QEKTEKTLLYKPLYPPSPDITKKVETK

SEQ ID NO: 3013286 - protein, 18 aa, Entamoeba invadens
QEKYFSRKCKVCANGFYP

SEQ ID NO: 3013287 - protein, 24 aa, Entamoeba invadens
QEKYIAMTRVYYNGAHGAIIMYDL

SEQ ID NO: 3013288 - protein, 24 aa, Entamoeba invadens
QEKYIAMTRVYYNGAHGAIIMYDV

SEQ ID NO: 3013289 - protein, 25 aa, Entamoeba invadens
QEKYRELMTKFVNISGENKKIKKEK

SEQ ID NO: 3013290 - protein, 37 aa, Entamoeba invadens
QELFKWFCNEINNLKFLFKYYLLVSNYVAAVGVLDDM

SEQ ID NO: 3013291 - protein, 20 aa, Entamoeba invadens
QELTINIKLLPELYTKFCDA

SEQ ID NO: 3013292 - protein, 23 aa, Entamoeba invadens
QELTKNYLFLKKTPIIKSADYLI

SEQ ID NO: 3013293 - protein, 23 aa, Entamoeba invadens
QEMFRSVVPMYFRNSSCVLLVFD

SEQ ID NO: 3013294 - protein, 41 aa, Entamoeba invadens
QEMKFSLKKLKFYDPFTTDALYFGYTYIINGITTLTFTTNQ

SEQ ID NO: 3013295 - protein, 42 aa, Entamoeba invadens
QEMRTHLRKIGVTQFKKISMINFLIFYYKYDTHEVVNAPQGA

SEQ ID NO: 3013296 - protein, 17 aa, Entamoeba invadens
QEMYLFFSELGEFVVQI

SEQ ID NO: 3013297 - protein, 21 aa, Entamoeba invadens
QENEWSILSSFFIVNPKLQEV

SEQ ID NO: 3013298 - protein, 23 aa, Entamoeba invadens
QENISRALFMLTDTNNNGTLEKK

SEQ ID NO: 3013299 - protein, 33 aa, Entamoeba invadens
QENKIIRPQPVKISLTLLPPPSPSPKARNLVRR

SEQ ID NO: 3013300 - protein, 26 aa, Entamoeba invadens
QENLPWPNYIQFLFALTQEQNIIQQC

SEQ ID NO: 3013301 - protein, 25 aa, Entamoeba invadens
QENNLKLLIMIFSEWTKTSEGKAIS

SEQ ID NO: 3013302 - protein, 24 aa, Entamoeba invadens
QENPQTLIPRFYGMYRIKPKHGDE

SEQ ID NO: 3013303 - protein, 36 aa, Entamoeba invadens
QENREKRSFKGAPVFCFFCGGEGHTFRDCPFKSHHN

SEQ ID NO: 3013304 - protein, 19 aa, Entamoeba invadens
QEPQIIPENFKPIDEKDLQ

SEQ ID NO: 3013305 - protein, 29 aa, Entamoeba invadens
QEQVLPALRWYFFLFFSQNVETLKLGLGT

SEQ ID NO: 3013306 - protein, 29 aa, Entamoeba invadens
QEQYFKQFPTPKELFLSVFRADFYTPLKP

SEQ ID NO: 3013307 - protein, 36 aa, Entamoeba invadens
QERFKSMTDLFFREARGCVIVFDLTDYSTFIGTQNW

SEQ ID NO: 3013308 - protein, 22 aa, Entamoeba invadens
QERFMNITAAYFRNTTAVLIVY

SEQ ID NO: 3013309 - protein, 25 aa, Entamoeba invadens
QERFRTIVTSYYRGVSGIILVYDVT

SEQ ID NO: 3013310 - protein, 33 aa, Entamoeba invadens
QERRQTRLNNLKMKRPWAIFEEARKKAVDMRDQ

SEQ ID NO: 3013311 - protein, 23 aa, Entamoeba invadens
QERYRAITNAYYRGAVGALIVYD

SEQ ID NO: 3013312 - protein, 29 aa, Entamoeba invadens
QESHLVPMYYDYFTNTIYPINFINSSQMQ

SEQ ID NO: 3013313 - protein, 17 aa, Entamoeba invadens
QESLRPYWRCYYSNTNA

SEQ ID NO: 3013314 - protein, 23 aa, Entamoeba invadens
QESPLKAAFFYGNVIAAAEIIRK

SEQ ID NO: 3013315 - protein, 25 aa, Entamoeba invadens
QESTLIKGIFGMCLCFASEGIEIIR

SEQ ID NO: 3013316 - protein, 41 aa, Entamoeba invadens
QESYDDVINFWLPEVRNAKEGLPIILCGTASETTVVAEKEV

SEQ ID NO: 3013317 - protein, 34 aa, Entamoeba invadens
QETFEKLFQHYHPTVVKLHHPHQKFFVRVSSPSE

SEQ ID NO: 3013318 - protein, 19 aa, Entamoeba invadens
QETFMPNPASFAFGFNMMG

SEQ ID NO: 3013319 - protein, 20 aa, Entamoeba invadens
QETHSYVPRFGKGSTKQMKK

SEQ ID NO: 3013320 - protein, 18 aa, Entamoeba invadens
QEVFMKFTLHKNAICAIS

SEQ ID NO: 3013321 - protein, 20 aa, Entamoeba invadens
QEVLPPPGTLAPPPGLAPPG

SEQ ID NO: 3013322 - protein, 31 aa, Entamoeba invadens
QEVMPSFSVDYLLLVFVLSTISPTKFMTTLK

SEQ ID NO: 3013323 - protein, 28 aa, Entamoeba invadens
QEVTRLFIPILVYRYLCSPTPYIMAATL

SEQ ID NO: 3013324 - protein, 26 aa, Entamoeba invadens
QEWVKKVEIWLYRGAWQEYEVYRADL

SEQ ID NO: 3013325 - protein, 21 aa, Entamoeba invadens
QEYLTVLIHAMTKDPTRLQLY

SEQ ID NO: 3013326 - protein, 22 aa, Entamoeba invadens
QEYQDIPQLLLKVSLKLDEVNK

SEQ ID NO: 3013327 - protein, 27 aa, Entamoeba invadens
QEYRVTAMPTFKFFKRGVLVAEFCGAN

SEQ ID NO: 3013328 - protein, 21 aa, Entamoeba invadens
QFADFTLDPVFSFLNQHDFSS

SEQ ID NO: 3013329 - protein, 22 aa, Entamoeba invadens
QFAFNPIDPRFAPPIQISQVSP

SEQ ID NO: 3013330 - protein, 19 aa, Entamoeba invadens
QFATIPVTIDKKTMYYCPF

SEQ ID NO: 3013331 - protein, 21 aa, Entamoeba invadens
QFATTKIPLYHAQKKEIYALD

SEQ ID NO: 3013332 - protein, 27 aa, Entamoeba invadens
QFATYTIHFKPPFPIEKYAVSCPPSST

SEQ ID NO: 3013333 - protein, 17 aa, Entamoeba invadens
QFAYYQISIPQFTSFET

SEQ ID NO: 3013334 - protein, 23 aa, Entamoeba invadens
QFCGKLLCKSCCSTIKISSEREV

SEQ ID NO: 3013335 - protein, 24 aa, Entamoeba invadens
QFCKYIATHHLIIDNLHCLIDLQF

SEQ ID NO: 3013336 - protein, 34 aa, Entamoeba invadens
QFCPLRELIALKKIYGFYLYIDEAHSIGALGETG

SEQ ID NO: 3013337 - protein, 22 aa, Entamoeba invadens
QFDARFDPRLEPRGYDRYDSRG

SEQ ID NO: 3013338 - protein, 17 aa, Entamoeba invadens
QFDENFLEKNLSEFVQP

SEQ ID NO: 3013339 - protein, 17 aa, Entamoeba invadens
QFDKFFLSVFTKIRMFS

SEQ ID NO: 3013340 - protein, 17 aa, Entamoeba invadens
QFDMTLIRETDLKQPKF

SEQ ID NO: 3013341 - protein, 20 aa, Entamoeba invadens
QFDPLMNIEALKLSWISGAS

SEQ ID NO: 3013342 - protein, 18 aa, Entamoeba invadens
QFDPVMLPQQNYFKDIQS

SEQ ID NO: 3013343 - protein, 28 aa, Entamoeba invadens
QFDTLPPTFRQYKLLEAFLSIMKDGRNE

SEQ ID NO: 3013344 - protein, 34 aa, Entamoeba invadens
QFDTVLVKTLIEQYLQYYYNYQQIIYELEKKGIS

SEQ ID NO: 3013345 - protein, 19 aa, Entamoeba invadens
QFEAPKLLNIRRNTISVSK

SEQ ID NO: 3013346 - protein, 29 aa, Entamoeba invadens
QFEGENPFKELLPLKIRAAYNQYMAKAKK

SEQ ID NO: 3013347 - protein, 22 aa, Entamoeba invadens
QFEIHIVAFLENGNFEKIEEMP

SEQ ID NO: 3013348 - protein, 32 aa, Entamoeba invadens
QFELNVMEPVMFYDILLSLEMLKNAFSTFRIN

SEQ ID NO: 3013349 - protein, 29 aa, Entamoeba invadens
QFELNVMEPVMFYDILTSLEILKNAFNTF

SEQ ID NO: 3013350 - protein, 23 aa, Entamoeba invadens
QFERYIILCVMLRSLHPIYQTLT

SEQ ID NO: 3013351 - protein, 25 aa, Entamoeba invadens
QFETQDFYLCAIWVLKNVNMQLLQK

SEQ ID NO: 3013352 - protein, 24 aa, Entamoeba invadens
QFFSMYTCFQSFRTGLSDLDKMTE

SEQ ID NO: 3013353 - protein, 18 aa, Entamoeba invadens
QFFTQALQHECTVKLNDG

SEQ ID NO: 3013354 - protein, 17 aa, Entamoeba invadens
QFGKRVFAGCGILTHAV

SEQ ID NO: 3013355 - protein, 17 aa, Entamoeba invadens
QFGLPVITLVDTPGAYP

SEQ ID NO: 3013356 - protein, 25 aa, Entamoeba invadens
QFGNYVIQHLLEFGSQPIRDEIISE

SEQ ID NO: 3013357 - protein, 26 aa, Entamoeba invadens
QFGQNRAFIVSVKDNHWLFVFGKNEA

SEQ ID NO: 3013358 - protein, 23 aa, Entamoeba invadens
QFHDKLFDLGYNLGMRMTELISY

SEQ ID NO: 3013359 - protein, 38 aa, Entamoeba invadens
QFHSRRIQQLGKLVPNCRFTDFWNGYGCGQVPDKVILY

SEQ ID NO: 3013360 - protein, 18 aa, Entamoeba invadens
QFIDFRTAEVFGFGHLKG

SEQ ID NO: 3013361 - protein, 18 aa, Entamoeba invadens
QFITIIDQKKRSSISTIS

SEQ ID NO: 3013362 - protein, 19 aa, Entamoeba invadens
QFITTMKYILSLFQNERIF

SEQ ID NO: 3013363 - protein, 23 aa, Entamoeba invadens
QFIVNEIFIRYFVLKGTNVSVTF

SEQ ID NO: 3013364 - protein, 18 aa, Entamoeba invadens
QFIYGVVVLMAQIDFELM

SEQ ID NO: 3013365 - protein, 19 aa, Entamoeba invadens
QFLAKKPFQQDPLKKEVKL

SEQ ID NO: 3013366 - protein, 18 aa, Entamoeba invadens
QFLALISHCLIVPILPLG

SEQ ID NO: 3013367 - protein, 25 aa, Entamoeba invadens
QFLDDFEYQMKWAEWFNSVVYCAIS

SEQ ID NO: 3013368 - protein, 21 aa, Entamoeba invadens
QFLFQETKTQIWILMLSIFGP

SEQ ID NO: 3013369 - protein, 17 aa, Entamoeba invadens
QFLIEGDCKYYEDVILL

SEQ ID NO: 3013370 - protein, 17 aa, Entamoeba invadens
QFLKMAATYISKYSVYL

SEQ ID NO: 3013371 - protein, 25 aa, Entamoeba invadens
QFLKMLDIIQAKWYNPALNKATAAG

SEQ ID NO: 3013372 - protein, 24 aa, Entamoeba invadens
QFLNGVLNLILKLFELPQIQPMVL

SEQ ID NO: 3013373 - protein, 21 aa, Entamoeba invadens
QFLQALLQHPSYTFHDLMIKF

SEQ ID NO: 3013374 - protein, 18 aa, Entamoeba invadens
QFLTFLDSGVFWGCSSLL

SEQ ID NO: 3013375 - protein, 27 aa, Entamoeba invadens
QFMLIYKNRIFQYCFPLDFVQVSLIVN

SEQ ID NO: 3013376 - protein, 20 aa, Entamoeba invadens
QFMPTIMEIVWARMQMDVVC

SEQ ID NO: 3013377 - protein, 19 aa, Entamoeba invadens
QFNELVGVYSKILLSFVGD

SEQ ID NO: 3013378 - protein, 23 aa, Entamoeba invadens
QFNKIKFVFLSLDYCFGDIEKIL

SEQ ID NO: 3013379 - protein, 27 aa, Entamoeba invadens
QFNLTKALIQSPLWHEDLLGEKWQETN

SEQ ID NO: 3013380 - protein, 19 aa, Entamoeba invadens
QFPCLFNLVKKMNAKSPTT

SEQ ID NO: 3013381 - protein, 20 aa, Entamoeba invadens
QFPELKRICLDIYSLPHFAD

SEQ ID NO: 3013382 - protein, 19 aa, Entamoeba invadens
QFPHAAYPNTFLLVGGYHM

SEQ ID NO: 3013383 - protein, 23 aa, Entamoeba invadens
QFPKSLATEHCCRGFYGNLKNNV

SEQ ID NO: 3013384 - protein, 23 aa, Entamoeba invadens
QFPLQFKFDLKGSLYGRKADENE

SEQ ID NO: 3013385 - protein, 27 aa, Entamoeba invadens
QFPYQDLVYRPFLRLRYKEGIEMLRAA

SEQ ID NO: 3013386 - protein, 17 aa, Entamoeba invadens
QFQIDGTWFYYGNNRID

SEQ ID NO: 3013387 - protein, 25 aa, Entamoeba invadens
QFQKQFKFYFEFIPNIETVQCSHSM

SEQ ID NO: 3013388 - protein, 26 aa, Entamoeba invadens
QFRAKLFLPMYIEGLKFLIPMNAETM

SEQ ID NO: 3013389 - protein, 19 aa, Entamoeba invadens
QFRICQMQRVIRGFLTRRV

SEQ ID NO: 3013390 - protein, 28 aa, Entamoeba invadens
QFRLNAKNLFCTWPQTALPKENAFKQLK

SEQ ID NO: 3013391 - protein, 26 aa, Entamoeba invadens
QFRNEEELFAYVQFLWGVVNEAETTM

SEQ ID NO: 3013392 - protein, 19 aa, Entamoeba invadens
QFRPLGIQVFHIQENSTMF

SEQ ID NO: 3013393 - protein, 20 aa, Entamoeba invadens
QFRRKVCLDAIRGLQYLHFN

SEQ ID NO: 3013394 - protein, 21 aa, Entamoeba invadens
QFSPLNPFRIMIAGAGRGPLV

SEQ ID NO: 3013395 - protein, 24 aa, Entamoeba invadens
QFSQPLMPAIPQPTLPMSNMNTSN

SEQ ID NO: 3013396 - protein, 20 aa, Entamoeba invadens
QFTLLNYFSTRGKLCLLFEN

SEQ ID NO: 3013397 - protein, 20 aa, Entamoeba invadens
QFTLYSKWMAKPRNLFKVSV

SEQ ID NO: 3013398 - protein, 22 aa, Entamoeba invadens
QFTRNEAILLSLQAIGMSIAEV

SEQ ID NO: 3013399 - protein, 17 aa, Entamoeba invadens
QFVLPRNFNENKAVVVF

SEQ ID NO: 3013400 - protein, 18 aa, Entamoeba invadens
QFVLQKTTKLLLEECGFY

SEQ ID NO: 3013401 - protein, 26 aa, Entamoeba invadens
QFVMNSMTSVLLRLLENFDGALFVTS

SEQ ID NO: 3013402 - protein, 27 aa, Entamoeba invadens
QFVMNSMTSVLLRLLENFDGALFVTSN

SEQ ID NO: 3013403 - protein, 19 aa, Entamoeba invadens
QFVPYQYQQQPPPPMYMSR

SEQ ID NO: 3013404 - protein, 18 aa, Entamoeba invadens
QFVQDQIMSFPIPTLDSP

SEQ ID NO: 3013405 - protein, 27 aa, Entamoeba invadens
QFYASAIRCVLLRMGIIGIKVNIMLNT

SEQ ID NO: 3013406 - protein, 25 aa, Entamoeba invadens
QFYEQLLPLFELLGRNIHSTYVSVS

SEQ ID NO: 3013407 - protein, 18 aa, Entamoeba invadens
QFYKNHSFVIKKLIPKYY

SEQ ID NO: 3013408 - protein, 28 aa, Entamoeba invadens
QFYMCSDSFKGFLKCPRGTKCGNVLNNP

SEQ ID NO: 3013409 - protein, 17 aa, Entamoeba invadens
QFYRKIVVHPNGTSLVY

SEQ ID NO: 3013410 - protein, 19 aa, Entamoeba invadens
QFYVEPGMSYVQRKSIFTK

SEQ ID NO: 3013411 - protein, 21 aa, Entamoeba invadens
QGAIWFMQREVTEKKKFMPVR

SEQ ID NO: 3013412 - protein, 23 aa, Entamoeba invadens
QGCKNEIALLSQTRRRVLYTDDK

SEQ ID NO: 3013413 - protein, 29 aa, Entamoeba invadens
QGCNFHGVVPYFFLVERKAVLQYQSVELV

SEQ ID NO: 3013414 - protein, 24 aa, Entamoeba invadens
QGCTDIFIMLYQITKDETKLFSLF

SEQ ID NO: 3013415 - protein, 18 aa, Entamoeba invadens
QGCTSLCKITLSTKIKVL

SEQ ID NO: 3013416 - protein, 20 aa, Entamoeba invadens
QGCVPLVHPFLKTNSPKLNS

SEQ ID NO: 3013417 - protein, 25 aa, Entamoeba invadens
QGDSHLILAYVLRPSDKSLFIEQSM

SEQ ID NO: 3013418 - protein, 22 aa, Entamoeba invadens
QGEKEIALAPAFKPIEKKKEEK

SEQ ID NO: 3013419 - protein, 19 aa, Entamoeba invadens
QGEKVVAFVLLKKGGNTID

SEQ ID NO: 3013420 - protein, 20 aa, Entamoeba invadens
QGFFASCYKKMDGFILMINA

SEQ ID NO: 3013421 - protein, 20 aa, Entamoeba invadens
QGFRVTRDMVLPMLCRRFKT

SEQ ID NO: 3013422 - protein, 20 aa, Entamoeba invadens
QGGIWINEGPLLYHYRESDS

SEQ ID NO: 3013423 - protein, 30 aa, Entamoeba invadens; identical to SEQ ID NO: 2962317

SEQ ID NO: 3013424 - protein, 20 aa, Entamoeba invadens
QGGYNPYYYETALFCARANI

SEQ ID NO: 3013425 - protein, 24 aa, Entamoeba invadens
QGIGEFIKYIYLNGTYRLDENCVD

SEQ ID NO: 3013426 - protein, 24 aa, Entamoeba invadens
QGILYNDVALLKKYNIALAGKANA

SEQ ID NO: 3013427 - protein, 20 aa, Entamoeba invadens
QGKFTVLRWGECKRHNSGST

SEQ ID NO: 3013428 - protein, 30 aa, Entamoeba invadens
QGKKIGKQGGKLWKWYKKNGKEKDKKDLKG

SEQ ID NO: 3013429 - protein, 23 aa, Entamoeba invadens
QGKSFKMFTKFVGSLTPPIQLKN

SEQ ID NO: 3013430 - protein, 22 aa, Entamoeba invadens
QGKTFFNFNLKTLVNMYSGNTI

SEQ ID NO: 3013431 - protein, 18 aa, Entamoeba invadens
QGLFFKTLHTFDIPNFTV

SEQ ID NO: 3013432 - protein, 21 aa, Entamoeba invadens
QGLFHGLMVFKDKFGSFPKSH

SEQ ID NO: 3013433 - protein, 23 aa, Entamoeba invadens
QGLIRMGLVPVPLYATLGVNSIN

SEQ ID NO: 3013434 - protein, 18 aa, Entamoeba invadens
QGLPQMMPPLPQYQQYPP

SEQ ID NO: 3013435 - protein, 28 aa, Entamoeba invadens
QGMDLFEPPTSFCKLAIRLEEILGEEDK

SEQ ID NO: 3013436 - protein, 17 aa, Entamoeba invadens
QGMLFDLSYVLPNLIAM

SEQ ID NO: 3013437 - protein, 20 aa, Entamoeba invadens
QGNPFSFSVLISPPKTTERG

SEQ ID NO: 3013438 - protein, 29 aa, Entamoeba invadens
QGNVLFEWIVTMRLALRCLIIGEVESHYQ

SEQ ID NO: 3013439 - protein, 28 aa, Entamoeba invadens
QGRDRKFQAILPLRGKILNVEKARYEKL

SEQ ID NO: 3013440 - protein, 23 aa, Entamoeba invadens
QGRPTPVRPVEISAIILSHVKKQ

SEQ ID NO: 3013441 - protein, 22 aa, Entamoeba invadens
QGRSIIAWLDKYLKKMKRADDD

SEQ ID NO: 3013442 - protein, 22 aa, Entamoeba invadens
QGSMAPLTRCKITFLKWVVPEV

SEQ ID NO: 3013443 - protein, 23 aa, Entamoeba invadens
QGSTALGPALLVSSVIAGKQKNG

SEQ ID NO: 3013444 - protein, 25 aa, Entamoeba invadens
QGTGKPLFYSGLKQAGNGGTDGSKI

SEQ ID NO: 3013445 - protein, 28 aa, Entamoeba invadens
QGTLFIFSDLLIFTRLERNQYYFEEAFG

SEQ ID NO: 3013446 - protein, 25 aa, Entamoeba invadens
QGTTSDLFVPNFAAHDERVQKKRER

SEQ ID NO: 3013447 - protein, 31 aa, Entamoeba invadens
QGTVDDYCLYVYLTFFIMKDTHFEDNEVMNE

SEQ ID NO: 3013448 - protein, 26 aa, Entamoeba invadens
QGTYAWNAGIFLWSSSGIISEMKKYA

SEQ ID NO: 3013449 - protein, 17 aa, Entamoeba invadens
QGVLIVFDMTDKFTFEK

SEQ ID NO: 3013450 - protein, 24 aa, Entamoeba invadens
QGVLQLDGWFCNNSEIRFSFQQWQ

SEQ ID NO: 3013451 - protein, 29 aa, Entamoeba invadens
QGVYLDPIPIHVLLALMIKKFAKRNVTMA

SEQ ID NO: 3013452 - protein, 21 aa, Entamoeba invadens
QGWLLVFNSITPESTNTANPA

SEQ ID NO: 3013453 - protein, 23 aa, Entamoeba invadens
QHALTLYISNILQRNVNIVDLGG

SEQ ID NO: 3013454 - protein, 18 aa, Entamoeba invadens
QHARFIEALLSADPVFAE

SEQ ID NO: 3013455 - protein, 25 aa, Entamoeba invadens
QHEFKTVAQFLPLTFGREKVKGLLD

SEQ ID NO: 3013456 - protein, 19 aa, Entamoeba invadens
QHEFLFGFGGGCDFEVSKK

SEQ ID NO: 3013457 - protein, 33 aa, Entamoeba invadens
QHEPELGSLFLILKILSEKTVSISPPLSKRLQT

SEQ ID NO: 3013458 - protein, 25 aa, Entamoeba invadens
QHFKGEFLFVFIEKCNTAKFDSADK

SEQ ID NO: 3013459 - protein, 19 aa, Entamoeba invadens
QHGGLGFFLFASDAISNEV

SEQ ID NO: 3013460 - protein, 18 aa, Entamoeba invadens
QHIRAFNSAISFASFGAH

SEQ ID NO: 3013461 - protein, 19 aa, Entamoeba invadens
QHIVPWIDIPRCPVCGALI

SEQ ID NO: 3013462 - protein, 25 aa, Entamoeba invadens
QHKFLKPERPVLPTPTLLRYPDLMV

SEQ ID NO: 3013463 - protein, 17 aa, Entamoeba invadens
QHKNLLVNPQIANALSS

SEQ ID NO: 3013464 - protein, 20 aa, Entamoeba invadens
QHKQPKPALSPRKAVEMRKK

SEQ ID NO: 3013465 - protein, 28 aa, Entamoeba invadens
QHKSELEIVIPSFKNLTSKKQVIKPYVI

SEQ ID NO: 3013466 - protein, 18 aa, Entamoeba invadens
QHKSPPPSVLSQSAKTTT

SEQ ID NO: 3013467 - protein, 17 aa, Entamoeba invadens
QHLGFTEFNPHSITLPK

SEQ ID NO: 3013468 - protein, 36 aa, Entamoeba invadens
QHLHLYPCNILLNRDPASIFPILKLSNFALCETLDG

SEQ ID NO: 3013469 - protein, 17 aa, Entamoeba invadens
QHLINLQHLALIDLSGN

SEQ ID NO: 3013470 - protein, 35 aa, Entamoeba invadens
QHNLEMILEEQLPLKFVLRCCVNLATALQYLSSEK

SEQ ID NO: 3013471 - protein, 17 aa, Entamoeba invadens
QHPFVVAGFKYIDKIMS

SEQ ID NO: 3013472 - protein, 27 aa, Entamoeba invadens
QHPIKGIFFRGYILDCIKTVLPDFTTE

SEQ ID NO: 3013473 - protein, 20 aa, Entamoeba invadens
QHPLHALFGQYIHFISMLPK

SEQ ID NO: 3013474 - protein, 34 aa, Entamoeba invadens
QHPSYTFHDLMIKFLTQPDFEIVKLKTKIVFGNE

SEQ ID NO: 3013475 - protein, 22 aa, Entamoeba invadens
QHQMYFTRKSLNLIFKQLEYGT

SEQ ID NO: 3013476 - protein, 25 aa, Entamoeba invadens
QHSTFFIPFYNQFVHYHFKNYLLDI

SEQ ID NO: 3013477 - protein, 17 aa, Entamoeba invadens
QHYIYSHFQFSVFPNTD

SEQ ID NO: 3013478 - protein, 31 aa, Entamoeba invadens
QIALYRQQLALNRYFSVLLDCPTTKEIPSYI

SEQ ID NO: 3013479 - protein, 26 aa, Entamoeba invadens
QIAQAFDVLIPLYQSFHTKLEKLRIT

SEQ ID NO: 3013480 - protein, 26 aa, Entamoeba invadens
QIAQHYGIQFVIIKTLMEQLERNEVI

SEQ ID NO: 3013481 - protein, 23 aa, Entamoeba invadens
QIAQLLLFVCTEIKLLHINNNTM

SEQ ID NO: 3013482 - protein, 23 aa, Entamoeba invadens
QIARMYVLMTNLDYSKRPLPEYL

SEQ ID NO: 3013483 - protein, 30 aa, Entamoeba invadens
QICDGNQYNYFKLINYIRKHKLSPQSVLSF

SEQ ID NO: 3013484 - protein, 18 aa, Entamoeba invadens
QICEVYFKEYSDLPLIVN

SEQ ID NO: 3013485 - protein, 20 aa, Entamoeba invadens
QICHDALNGLIYLHQHHKIH

SEQ ID NO: 3013486 - protein, 28 aa, Entamoeba invadens
QIDAMSKLISIILLMSNVPKKVVNTALS

SEQ ID NO: 3013487 - protein, 17 aa, Entamoeba invadens
QIDGTWFYYGNNRIDRV

SEQ ID NO: 3013488 - protein, 34 aa, Entamoeba invadens
QIDITLFKQFVINMALFFQIPNTASLEKAKQFTA

SEQ ID NO: 3013489 - protein, 18 aa, Entamoeba invadens
QIDPNYLNAFGTNLQNLL

SEQ ID NO: 3013490 - protein, 28 aa, Entamoeba invadens
QIDVFKQSWLPFELLRKSIKQIGADQNF

SEQ ID NO: 3013491 - protein, 20 aa, Entamoeba invadens
QIDYEYYLENQIFAPVSRIF

SEQ ID NO: 3013492 - protein, 22 aa, Entamoeba invadens
QIDYYDFIAPQDNLFCSAIVHF

SEQ ID NO: 3013493 - protein, 23 aa, Entamoeba invadens
QIEDMAFYGCRSLQYFVVPLTVK

SEQ ID NO: 3013494 - protein, 25 aa, Entamoeba invadens
QIEEISKQKISCETQIVALQAEKEN

SEQ ID NO: 3013495 - protein, 27 aa, Entamoeba invadens
QIEEMHLFLFKRLKTLELPTTVTKLIL

SEQ ID NO: 3013496 - protein, 20 aa, Entamoeba invadens
QIEENAFYNLKIEDIVLPKL

SEQ ID NO: 3013497 - protein, 18 aa, Entamoeba invadens
QIEESPFKSIVPPQLRNA

SEQ ID NO: 3013498 - protein, 25 aa, Entamoeba invadens
QIEFNIIRGYYWTGCKSNVFSNEIE

SEQ ID NO: 3013499 - protein, 25 aa, Entamoeba invadens
QIEFNIIRKYYWTGCKSNMFCNEIE

SEQ ID NO: 3013500 - protein, 19 aa, Entamoeba invadens
QIELKIISGIFIVNKCSPK

SEQ ID NO: 3013501 - protein, 33 aa, Entamoeba invadens
QIEPIQYRPNVSHNLFQPLTLQQKEYPNNQTIQ

SEQ ID NO: 3013502 - protein, 43 aa, Entamoeba invadens
QIEPSKLTIFPSESHWIFAVQDAFYISVFPNQSYIDKNIEQTF

SEQ ID NO: 3013503 - protein, 29 aa, Entamoeba invadens
QIEQNFLKYYLMELIIKKINFPSFANFEK

SEQ ID NO: 3013504 - protein, 25 aa, Entamoeba invadens
QIERGNAIVYPTGTLKQEVGKKLNT

SEQ ID NO: 3013505 - protein, 17 aa, Entamoeba invadens
QIFCFKDKNYLFYDSKN

SEQ ID NO: 3013506 - protein, 20 aa, Entamoeba invadens
QIFGVSLLEYHKKSGLLFPS

SEQ ID NO: 3013507 - protein, 19 aa, Entamoeba invadens
QIFNDIFKNKIFAFLKEMQ

SEQ ID NO: 3013508 - protein, 29 aa, Entamoeba invadens
QIFNSQAEVLYLYYTSYYTQLVSLLDSQS

SEQ ID NO: 3013509 - protein, 19 aa, Entamoeba invadens
QIFNYPFMSNPSVFYKPVA

SEQ ID NO: 3013510 - protein, 25 aa, Entamoeba invadens
QIGFQCFFRCFSLQSILIPDGVTLL

SEQ ID NO: 3013511 - protein, 23 aa, Entamoeba invadens
QIGLFTLSGKYIKIGLTLNTHNK

SEQ ID NO: 3013512 - protein, 17 aa, Entamoeba invadens
QIGNKIEMLIIKNTTIN

SEQ ID NO: 3013513 - protein, 18 aa, Entamoeba invadens
QIGTLKELLYQLKLREDT

SEQ ID NO: 3013514 - protein, 26 aa, Entamoeba invadens
QIHDLRLFVEFLKQNPQQLQNPELDF

SEQ ID NO: 3013515 - protein, 31 aa, Entamoeba invadens
QIIAILPNNSNYKFLFGRKLLRYGDSNNNRI

SEQ ID NO: 3013516 - protein, 25 aa, Entamoeba invadens
QIIEYRPLTALPTQIDPILEIFLPF

SEQ ID NO: 3013517 - protein, 21 aa, Entamoeba invadens
QIIFIIDYLIREKILSSDTVL

SEQ ID NO: 3013518 - protein, 17 aa, Entamoeba invadens
QIIFLDKARRFLKKVEI

SEQ ID NO: 3013519 - protein, 22 aa, Entamoeba invadens
QIIFLRTLIKNFIKRLIDSFLC

SEQ ID NO: 3013520 - protein, 27 aa, Entamoeba invadens
QIIGKEKLLFVFVSKMGDVFGFYQKSL

SEQ ID NO: 3013521 - protein, 18 aa, Entamoeba invadens
QIIHGYKSDLKRILEQAK

SEQ ID NO: 3013522 - protein, 23 aa, Entamoeba invadens
QIISLLEPLLKDPSDFVKQGACI

SEQ ID NO: 3013523 - protein, 18 aa, Entamoeba invadens
QIISRFEFLRVLDISKCD

SEQ ID NO: 3013524 - protein, 25 aa, Entamoeba invadens
QIITIPPNYGCEFSLFLTPLCNSNM

SEQ ID NO: 3013525 - protein, 23 aa, Entamoeba invadens
QIITLLIKQWRPEWDIHCYAIAP

SEQ ID NO: 3013526 - protein, 31 aa, Entamoeba invadens
QIKARRTQIRYLKIKALKDVLSKKLLAEQTI

SEQ ID NO: 3013527 - protein, 24 aa, Entamoeba invadens
QIKDFLQFYYVKFFGSVFGEMNKK

SEQ ID NO: 3013528 - protein, 26 aa, Entamoeba invadens
QIKDPKFYRELLLKSTPEKLSDRCLV

SEQ ID NO: 3013529 - protein, 19 aa, Entamoeba invadens
QIKDWISVLAEIFKANIIV

SEQ ID NO: 3013530 - protein, 29 aa, Entamoeba invadens
QIKENYFQELLPQYFQEVPKYLFGAKESW

SEQ ID NO: 3013531 - protein, 18 aa, Entamoeba invadens
QIKGETFINGKLSKTVKK

SEQ ID NO: 3013532 - protein, 18 aa, Entamoeba invadens
QIKHIMIKLDRYSMMIVS

SEQ ID NO: 3013533 - protein, 30 aa, Entamoeba invadens
QIKIVDFVFKIFLLFLPLDGCIKSSRAIVE

SEQ ID NO: 3013534 - protein, 28 aa, Entamoeba invadens
QIKKHQYVSLVQLILPHNYDNIDDNDAI

SEQ ID NO: 3013535 - protein, 25 aa, Entamoeba invadens
QIKNLRTMLMARVNVYNKSKIVRIA

SEQ ID NO: 3013536 - protein, 26 aa, Entamoeba invadens
QIKPKFTFSMFLFLERDTKAEKQILK

SEQ ID NO: 3013537 - protein, 18 aa, Entamoeba invadens
QIKSFTKEKFYKIKCIVK

SEQ ID NO: 3013538 - protein, 17 aa, Entamoeba invadens
QIKSILSSVWIFNSFSP

SEQ ID NO: 3013539 - protein, 33 aa, Entamoeba invadens
QIKTPMVYQFLSFVFTQFNKLFPQCQPNVRAEI

SEQ ID NO: 3013540 - protein, 19 aa, Entamoeba invadens
QILGAEKALFRAIKTRANT

SEQ ID NO: 3013541 - protein, 20 aa, Entamoeba invadens
QILIDVLRELGYTFHSVFTS

SEQ ID NO: 3013542 - protein, 17 aa, Entamoeba invadens
QILLKSQDLKKLTVEQL

SEQ ID NO: 3013543 - protein, 30 aa, Entamoeba invadens
QILNALISEDKLIFIVKSANEYKVSLISIE

SEQ ID NO: 3013544 - protein, 27 aa, Entamoeba invadens
QILNNYPMNYAFFNQMMNFMSQNMQPY

SEQ ID NO: 3013545 - protein, 20 aa, Entamoeba invadens
QILQLFYNANRSCLSITISH

SEQ ID NO: 3013546 - protein, 33 aa, Entamoeba invadens
QILREYLFHNVVSLLSLLPPPKSIYSIFTQSKP

SEQ ID NO: 3013547 - protein, 28 aa, Entamoeba invadens
QILSDALKLNALFLLPPASSISDLKLTP

SEQ ID NO: 3013548 - protein, 20 aa, Entamoeba invadens
QILYCEVGGIVITLGLHEND

SEQ ID NO: 3013549 - protein, 23 aa, Entamoeba invadens
QIMLRRLKNIITLSLDFTRVALS

SEQ ID NO: 3013550 - protein, 32 aa, Entamoeba invadens
QIMNSKKFLKLMELVLLIGNYLNHGTARAKCH

SEQ ID NO: 3013551 - protein, 17 aa, Entamoeba invadens
QIMNVRSQKLAKLTGRR

SEQ ID NO: 3013552 - protein, 31 aa, Entamoeba invadens; identical to SEQ ID NO: 2536910

SEQ ID NO: 3013553 - protein, 31 aa, Entamoeba invadens
QIMPKCTLCGFNWFNAYYTPGVSRISTNIRD

SEQ ID NO: 3013554 - protein, 24 aa, Entamoeba invadens
QIMRLCHHPNIIECFGFTELNVSI

SEQ ID NO: 3013555 - protein, 24 aa, Entamoeba invadens
QINEKGLFSYLVIDEVHCVSQWGH

SEQ ID NO: 3013556 - protein, 23 aa, Entamoeba invadens
QINKKPIDIIPYPEDTSSETTNI

SEQ ID NO: 3013557 - protein, 18 aa, Entamoeba invadens
QINKNAIPSAFVPVQCLP

SEQ ID NO: 3013558 - protein, 18 aa, Entamoeba invadens
QINLLNQMKNIYSYDGFA

SEQ ID NO: 3013559 - protein, 22 aa, Entamoeba invadens
QINLRCPLSFQMIQIPVRGCEC

SEQ ID NO: 3013560 - protein, 19 aa, Entamoeba invadens
QINMYLFRDNNMKGNHYFL

SEQ ID NO: 3013561 - protein, 31 aa, Entamoeba invadens
QINNFCSYYELIELPTLFRSNFIEICSAMQR

SEQ ID NO: 3013562 - protein, 19 aa, Entamoeba invadens
QINQAFKTIYKILLQVASI

SEQ ID NO: 3013563 - protein, 17 aa, Entamoeba invadens
QINQLLPFNTVHTKTFQ

SEQ ID NO: 3013564 - protein, 32 aa, Entamoeba invadens
QINSVLHTWVRRLFSIPFLPQSEIKSTFEKFF

SEQ ID NO: 3013565 - protein, 31 aa, Entamoeba invadens
QINSVLHTWVRRLFSIPFLPQSEINSTFEKY

SEQ ID NO: 3013566 - protein, 18 aa, Entamoeba invadens
QINTFKNPPLSQVDVRVI

SEQ ID NO: 3013567 - protein, 18 aa, Entamoeba invadens
QINYAAKDAWLGIAVGQK

SEQ ID NO: 3013568 - protein, 30 aa, Entamoeba invadens
QIPEDFVKFQIFLKIPTLSALISQKTDELL

SEQ ID NO: 3013569 - protein, 21 aa, Entamoeba invadens
QIPKINFPHLDNGLVEECIAQ

SEQ ID NO: 3013570 - protein, 18 aa, Entamoeba invadens
QIPLLVHCVGEMNALISL

SEQ ID NO: 3013571 - protein, 19 aa, Entamoeba invadens
QIPPMKIRVKMMIDGARGV

SEQ ID NO: 3013572 - protein, 18 aa, Entamoeba invadens
QIPQMQIIPEMQIQDCGC

SEQ ID NO: 3013573 - protein, 34 aa, Entamoeba invadens
QIQDLLCDKFGHICLLYFIRHVDDKALLKKFIMS

SEQ ID NO: 3013574 - protein, 33 aa, Entamoeba invadens
QIQLQLNEFLPRRLHFVLTETLNPLARTSVLID

SEQ ID NO: 3013575 - protein, 26 aa, Entamoeba invadens
QIQNVFKRYGIPLLTFEKLKEIGTVL

SEQ ID NO: 3013576 - protein, 29 aa, Entamoeba invadens
QIQSLKALYKRAVLLNSQFNTLLVTLSNT

SEQ ID NO: 3013577 - protein, 27 aa, Entamoeba invadens
QIRINLHKLIVLLKNELQKYRGRIAPP

SEQ ID NO: 3013578 - protein, 18 aa, Entamoeba invadens
QIRQRPQQRIAQRAPRPE

SEQ ID NO: 3013579 - protein, 23 aa, Entamoeba invadens
QIRRYICDILLLDERFGELFNKL

SEQ ID NO: 3013580 - protein, 21 aa, Entamoeba invadens
QIRTINRCILMSHAAFSRDTL

SEQ ID NO: 3013581 - protein, 32 aa, Entamoeba invadens
QISCEGLKRAVRLLQLIGLLDKKEDITDLGKI

SEQ ID NO: 3013582 - protein, 21 aa, Entamoeba invadens
QISDNWKVISGYVAPISLDKI

SEQ ID NO: 3013583 - protein, 24 aa, Entamoeba invadens
QISELFAMDLLQYVKSQYAPLINE

SEQ ID NO: 3013584 - protein, 33 aa, Entamoeba invadens
QISHEIMWRVKTMRKVRLFLAKLQCEQKTVFPF

SEQ ID NO: 3013585 - protein, 27 aa, Entamoeba invadens
QISIGLNTLLDFLKRKFGKIFEEDPFC

SEQ ID NO: 3013586 - protein, 37 aa, Entamoeba invadens
QISQYELPYHILKMFHFLFEVGYATTGIFRLAGRADT

SEQ ID NO: 3013587 - protein, 45 aa, Entamoeba invadens
QISSIFVCEYFFKRGTFTQNIKMFLLLLLFTFSQADFDLTKTDFE

SEQ ID NO: 3013588 - protein, 30 aa, Entamoeba invadens
QISVERCMWLYPVSFCKAMYFNPMVPDFLG

SEQ ID NO: 3013589 - protein, 26 aa, Entamoeba invadens
QISVLSPLICFLTSLVNLNMEHNLLE

SEQ ID NO: 3013590 - protein, 28 aa, Entamoeba invadens
QITDIGIYAFYKCGNLKEIVISKSIDNI

SEQ ID NO: 3013591 - protein, 20 aa, Entamoeba invadens
QITGFFFFSKNENGVLFVID

SEQ ID NO: 3013592 - protein, 24 aa, Entamoeba invadens
QITKLTLFNISNIKLSKLFATTIL

SEQ ID NO: 3013593 - protein, 26 aa, Entamoeba invadens
QITLMQNDLFRKIPYVEFLGNGWTKK

SEQ ID NO: 3013594 - protein, 18 aa, Entamoeba invadens
QITLSVASAIFWLAKDEV

SEQ ID NO: 3013595 - protein, 19 aa, Entamoeba invadens
QITRLRVPRVLYYSNKSYS

SEQ ID NO: 3013596 - protein, 24 aa, Entamoeba invadens
QITSQKFFDVWKSLLVPTTPTKVK

SEQ ID NO: 3013597 - protein, 25 aa, Entamoeba invadens
QITSRIKWCQFPPNSRPVWDEYCQN

SEQ ID NO: 3013598 - protein, 34 aa, Entamoeba invadens
QITTFSELFVMTVLKFIRLIQKSTPAYKGKYTEI

SEQ ID NO: 3013599 - protein, 19 aa, Entamoeba invadens
QITTPTDAPLLPPSDLLPP

SEQ ID NO: 3013600 - protein, 26 aa, Entamoeba invadens
QITVKSRFLFIKSESLKFFNLSTTNI

SEQ ID NO: 3013601 - protein, 20 aa, Entamoeba invadens
QIVDFLFFEKHQTDAAKEMC

SEQ ID NO: 3013602 - protein, 28 aa, Entamoeba invadens
QIVGKEKLIFLFVSKTGEIFGFYQNDLV

SEQ ID NO: 3013603 - protein, 28 aa, Entamoeba invadens
QIVGNEKLIFLFVSKTGEIFGFYQNDLV

SEQ ID NO: 3013604 - protein, 19 aa, Entamoeba invadens
QIVGRGGFSVVYKALHKAS

SEQ ID NO: 3013605 - protein, 24 aa, Entamoeba invadens
QIVGSIIGIIRYLVSYEPMQMEFV

SEQ ID NO: 3013606 - protein, 18 aa, Entamoeba invadens
QIVLTKKHYFVYGENADE

SEQ ID NO: 3013607 - protein, 18 aa, Entamoeba invadens
QIVNGYIINISCKSEFVM

SEQ ID NO: 3013608 - protein, 27 aa, Entamoeba invadens
QIVPTKMFYQIIVWFNVDYVTVDNNKG

SEQ ID NO: 3013609 - protein, 19 aa, Entamoeba invadens
QIVQYLYESGFGKKGIIGC

SEQ ID NO: 3013610 - protein, 26 aa, Entamoeba invadens
QIVRRDYTIYLLLADKYNNVIKDLNN

SEQ ID NO: 3013611 - protein, 33 aa, Entamoeba invadens
QIVSPSVCVSLYLWSYFPQIGEYILVLDVGESQ

SEQ ID NO: 3013612 - protein, 21 aa, Entamoeba invadens
QIWQIPMILSCDGNEVKYMFK

SEQ ID NO: 3013613 - protein, 29 aa, Entamoeba invadens
QIWSKAQIHLNFVWYDTYLVDDKKPVKYT

SEQ ID NO: 3013614 - protein, 20 aa, Entamoeba invadens
QIYQYLLRNIGDTNYTVSCT

SEQ ID NO: 3013615 - protein, 26 aa, Entamoeba invadens
QKAEKCALAFDLYINQLTKTIGGLMV

SEQ ID NO: 3013616 - protein, 21 aa, Entamoeba invadens
QKAFAFYRDVLKSPHVILAPM

SEQ ID NO: 3013617 - protein, 22 aa, Entamoeba invadens
QKAKPLTQPPIPSVPLQPTQIQ

SEQ ID NO: 3013618 - protein, 23 aa, Entamoeba invadens
QKALLWDLFPVESGGQPQMFQFQ

SEQ ID NO: 3013619 - protein, 22 aa, Entamoeba invadens
QKAMIIISALKFLQFVIQKTCP

SEQ ID NO: 3013620 - protein, 20 aa, Entamoeba invadens
QKAMLLIPFVGNEVERIAVW

SEQ ID NO: 3013621 - protein, 25 aa, Entamoeba invadens
QKASLQILLQILPKRNYTEFLTSTS

SEQ ID NO: 3013622 - protein, 23 aa, Entamoeba invadens
QKAVDEFLLVNKLDFVARAHQIV

SEQ ID NO: 3013623 - protein, 28 aa, Entamoeba invadens
QKCDLNSRKYFLSNIILAGGNTMFDGID

SEQ ID NO: 3013624 - protein, 19 aa, Entamoeba invadens
QKCFVVVGLLLKAVDFDFS

SEQ ID NO: 3013625 - protein, 18 aa, Entamoeba invadens
QKCPKGTYSPSPGSANCI

SEQ ID NO: 3013626 - protein, 26 aa, Entamoeba invadens
QKCWGHVLVPLLNAIEIRSVEWNQLV

SEQ ID NO: 3013627 - protein, 28 aa, Entamoeba invadens
QKDAIREKLILFKTFLVDVFAVVITKMS

SEQ ID NO: 3013628 - protein, 22 aa, Entamoeba invadens
QKDGVLLVCYKKKYVTCHCILF

SEQ ID NO: 3013629 - protein, 26 aa, Entamoeba invadens
QKDIASYIFMYPIFKGYKFYGRFDNH

SEQ ID NO: 3013630 - protein, 38 aa, Entamoeba invadens
QKDKILNLYIILRLNMIRGKVLIFVNSIQQAFFVKIFL

SEQ ID NO: 3013631 - protein, 28 aa, Entamoeba invadens
QKDLQNEIVKLKEIIHVLESDLTQTKDD

SEQ ID NO: 3013632 - protein, 17 aa, Entamoeba invadens
QKDMGIFSSYRNALHCP

SEQ ID NO: 3013633 - protein, 21 aa, Entamoeba invadens
QKDPIRVVLGDILIAELAQGQ

SEQ ID NO: 3013634 - protein, 23 aa, Entamoeba invadens
QKDVDELITKKIELKKAAHDIVP

SEQ ID NO: 3013635 - protein, 26 aa, Entamoeba invadens
QKEAKSMIYNQYLADIYDGLVKMIST

SEQ ID NO: 3013636 - protein, 31 aa, Entamoeba invadens
QKEFVPPCFFNVLLPLLLPPNPPAVSDAVCG

SEQ ID NO: 3013637 - protein, 32 aa, Entamoeba invadens
QKEGSLPFYMIIIWLLKSINLQLIKKYFTIEE

SEQ ID NO: 3013638 - protein, 20 aa, Entamoeba invadens
QKEIYPYKYFNKVNIENNIG

SEQ ID NO: 3013639 - protein, 18 aa, Entamoeba invadens
QKEIYPYNYFNKVNIENN

SEQ ID NO: 3013640 - protein, 20 aa, Entamoeba invadens
QKEIYPYNYFNKVNIENNIG

SEQ ID NO: 3013641 - protein, 33 aa, Entamoeba invadens
QKEKPMLFKNFNLLFKTSYIRFVLENNNFVTHP

SEQ ID NO: 3013642 - protein, 39 aa, Entamoeba invadens
QKELKCLQLLTTPFIVPAPLSHYLATALPLSPIEVAYIL

SEQ ID NO: 3013643 - protein, 26 aa, Entamoeba invadens
QKELNELPHRPLPLTPLEQSIKNAPL

SEQ ID NO: 3013644 - protein, 25 aa, Entamoeba invadens
QKETRGILALAIYDSVKLDLPRSPN

SEQ ID NO: 3013645 - protein, 24 aa, Entamoeba invadens
QKEVVLYAHYMKLKYFSVECSYAG

SEQ ID NO: 3013646 - protein, 23 aa, Entamoeba invadens
QKEYCFMKALYTKGMSVPVPIDY

SEQ ID NO: 3013647 - protein, 33 aa, Entamoeba invadens
QKEYYNGLMILTGLYLNVIRHYIRTEYIATYTK

SEQ ID NO: 3013648 - protein, 19 aa, Entamoeba invadens
QKFDCWEGLYYFLSQIVNN

SEQ ID NO: 3013649 - protein, 27 aa, Entamoeba invadens
QKFDDNSFFPQLPVQTLKKIGSLLPPQ

SEQ ID NO: 3013650 - protein, 20 aa, Entamoeba invadens
QKFIMLLKEFEGVQDTFVQH

SEQ ID NO: 3013651 - protein, 23 aa, Entamoeba invadens
QKFKIGIWPVVNTKVRGTMKHNN

SEQ ID NO: 3013652 - protein, 18 aa, Entamoeba invadens
QKFLKFVKFVENNEFQRL

SEQ ID NO: 3013653 - protein, 22 aa, Entamoeba invadens
QKFQDWYCAIIEKVEEIANRLE

SEQ ID NO: 3013654 - protein, 38 aa, Entamoeba invadens
QKFTEFKLSQQAQPFFPSQKLHRQPLKKDNNGLSCYSK

SEQ ID NO: 3013655 - protein, 22 aa, Entamoeba invadens
QKFYLTMEYMYETMPLHVTPLY

SEQ ID NO: 3013656 - protein, 27 aa, Entamoeba invadens
QKGCGLKWPKLWRGLYGSKLHSVAGNN

SEQ ID NO: 3013657 - protein, 24 aa, Entamoeba invadens
QKGLYCLMHILLQYHDPQLCYCLD

SEQ ID NO: 3013658 - protein, 28 aa, Entamoeba invadens
QKGTVFEDYFNFTFLSNSRDQYIKEIVD

SEQ ID NO: 3013659 - protein, 34 aa, Entamoeba invadens
QKHDFVTLVPARVLPFVIPKYFFLSQDVDRLVDL

SEQ ID NO: 3013660 - protein, 38 aa, Entamoeba invadens
QKHEGNYTITNWKSPKISTIAEGGVFFVSGKNAVKNMT

SEQ ID NO: 3013661 - protein, 26 aa, Entamoeba invadens
QKIEFKILEFSILLGKDKMVEVNNTQ

SEQ ID NO: 3013662 - protein, 20 aa, Entamoeba invadens
QKIEMWMRKTTSRQTHQFLE

SEQ ID NO: 3013663 - protein, 17 aa, Entamoeba invadens
QKIGLMTQLPREEPLVY

SEQ ID NO: 3013664 - protein, 26 aa, Entamoeba invadens
QKIRDLFDDAAKLAPSLLFIDEIDSI

SEQ ID NO: 3013665 - protein, 28 aa, Entamoeba invadens
QKITPKTFQFVRPFYKEKIIVQIDGYDD

SEQ ID NO: 3013666 - protein, 29 aa, Entamoeba invadens
QKKECVQILQLLNAHRRTIDWMNTTAEEI

SEQ ID NO: 3013667 - protein, 34 aa, Entamoeba invadens
QKKGNLVLRPLSVFAPLHYFELPELLMEAITSMT

SEQ ID NO: 3013668 - protein, 30 aa, Entamoeba invadens
QKKKTPPQLPKRKAPPPLPQRGSKPSGGKV

SEQ ID NO: 3013669 - protein, 25 aa, Entamoeba invadens
QKKKYEIRLLGDLIIKIAKNSDVKT

SEQ ID NO: 3013670 - protein, 20 aa, Entamoeba invadens
QKKLNKCKEACILKDKEGGE

SEQ ID NO: 3013671 - protein, 24 aa, Entamoeba invadens
QKKPDLLGMESLQVEPLSNPLKET

SEQ ID NO: 3013672 - protein, 24 aa, Entamoeba invadens
QKKQFTFMERPLKDLIQSLNTDNT

SEQ ID NO: 3013673 - protein, 28 aa, Entamoeba invadens
QKKQQIPKIFNFWEKQRSFSILFSNKLA

SEQ ID NO: 3013674 - protein, 24 aa, Entamoeba invadens
QKKSVIALSYFRVIRLKSPERNIE

SEQ ID NO: 3013675 - protein, 36 aa, Entamoeba invadens
QKLDLRDYLIMPVQRLPRYNLLLTDLLKNTPQDHVE

SEQ ID NO: 3013676 - protein, 20 aa, Entamoeba invadens
QKLIEAGYLALKEAVTKLEI

SEQ ID NO: 3013677 - protein, 22 aa, Entamoeba invadens
QKLLKIDNFRYIKKLSLTKQKT

SEQ ID NO: 3013678 - protein, 21 aa, Entamoeba invadens
QKLRIFPYDIKNLAKYFYLNY

SEQ ID NO: 3013679 - protein, 31 aa, Entamoeba invadens
QKLVERYEIMAMPTFILIKDKIEIGRFSGTN

SEQ ID NO: 3013680 - protein, 20 aa, Entamoeba invadens
QKLVIYLPKTQNISVHVILP

SEQ ID NO: 3013681 - protein, 19 aa, Entamoeba invadens
QKLVLKYFGKGDRLVFDTL

SEQ ID NO: 3013682 - protein, 26 aa, Entamoeba invadens
QKMAMLDPRDFVLKTIRYHNKDMTEF

SEQ ID NO: 3013683 - protein, 28 aa, Entamoeba invadens
QKMHKKMILRLYKGVPISVRQSLWRAML

SEQ ID NO: 3013684 - protein, 31 aa, Entamoeba invadens
QKMKIQIGMLYDLHSIFYKKISQRMKAVGNK

SEQ ID NO: 3013685 - protein, 33 aa, Entamoeba invadens
QKMKNSIFPLNFDYMNFFDKIEPPKIVVNHNIV

SEQ ID NO: 3013686 - protein, 17 aa, Entamoeba invadens
QKMLRYDPNRRVSCEKA

SEQ ID NO: 3013687 - protein, 18 aa, Entamoeba invadens
QKMLTRRLASILKKIEQN

SEQ ID NO: 3013688 - protein, 42 aa, Entamoeba invadens
QKMPQTILMFMNDPFARVILFRFVFCRLVLFSLKLPADAGST

SEQ ID NO: 3013689 - protein, 20 aa, Entamoeba invadens
QKMQSIPMNKNWKGKIVSKK

SEQ ID NO: 3013690 - protein, 30 aa, Entamoeba invadens
QKNGIDCGVFMLYFLDTIARKKPSSIKQCD

SEQ ID NO: 3013691 - protein, 22 aa, Entamoeba invadens
QKNIVSLVFSKFKYPTGMQQIQ

SEQ ID NO: 3013692 - protein, 30 aa, Entamoeba invadens
QKNKRIFIHNFLLDVLVEKGFFFNSKMSKK

SEQ ID NO: 3013693 - protein, 17 aa, Entamoeba invadens
QKNLFINKKLRKLLVGE

SEQ ID NO: 3013694 - protein, 24 aa, Entamoeba invadens
QKNLKLLFDQAITTALKTSFSTTK

SEQ ID NO: 3013695 - protein, 23 aa, Entamoeba invadens
QKNNFVIALLNSGASPTSLNKAT

SEQ ID NO: 3013696 - protein, 23 aa, Entamoeba invadens
QKNPTLIIGNLYLGAVNATKDTV

SEQ ID NO: 3013697 - protein, 33 aa, Entamoeba invadens
QKNSIVMVYKENFLLPCLSLSDVPDLISDKHPV

SEQ ID NO: 3013698 - protein, 21 aa, Entamoeba invadens
QKPAALFRKNVPLLTGVAKFE

SEQ ID NO: 3013699 - protein, 21 aa, Entamoeba invadens
QKPATLILNKDLMEKPLERVL

SEQ ID NO: 3013700 - protein, 22 aa, Entamoeba invadens
QKPFVCLEYVKKMLLQNLSFSV

SEQ ID NO: 3013701 - protein, 22 aa, Entamoeba invadens
QKPKKVVIKTTLYKKPNFGHIT

SEQ ID NO: 3013702 - protein, 24 aa, Entamoeba invadens
QKPTLNAVLAKMLGFFVIEHHVQQ

SEQ ID NO: 3013703 - protein, 24 aa, Entamoeba invadens
QKQESPILYTKYLGPILASISVKG

SEQ ID NO: 3013704 - protein, 31 aa, Entamoeba invadens
QKQFDEWKNVRKYLLFVFSCLDYCPHQRVNA

SEQ ID NO: 3013705 - protein, 28 aa, Entamoeba invadens
QKQGKKPYLGFTLTLHSPLVLVENGVRE

SEQ ID NO: 3013706 - protein, 27 aa, Entamoeba invadens
QKQKRLAWTTLCRLAFLSIAETQEKPT

SEQ ID NO: 3013707 - protein, 24 aa, Entamoeba invadens
QKQLTDFDLLMQNAKRITRDSFEQ

SEQ ID NO: 3013708 - protein, 18 aa, Entamoeba invadens
QKQMDWIFNIQTYTLDQK

SEQ ID NO: 3013709 - protein, 32 aa, Entamoeba invadens
QKQNYDLIFRNTQICLVVFDPHDPKSFEDVHT

SEQ ID NO: 3013710 - protein, 32 aa, Entamoeba invadens
QKQNYDLIFRNTQICLVVFDPHDPKSFEDVNT

SEQ ID NO: 3013711 - protein, 18 aa, Entamoeba invadens
QKQQNMAVLLKMTEMAYG

SEQ ID NO: 3013712 - protein, 27 aa, Entamoeba invadens
QKQRIAIARALIRNPKILLLDEATSAL

SEQ ID NO: 3013713 - protein, 31 aa, Entamoeba invadens
QKQTEYNCFFFPSQMLLVDYLSDSGSSAMTD

SEQ ID NO: 3013714 - protein, 21 aa, Entamoeba invadens
QKRIRYFIDSTVLKQLRCNGV

SEQ ID NO: 3013715 - protein, 22 aa, Entamoeba invadens
QKRKDLQMLLNSELEVVTALCD

SEQ ID NO: 3013716 - protein, 35 aa, Entamoeba invadens
QKRNLSFSIAYRRIIDLIIFLIDFKTQINDSEDDV

SEQ ID NO: 3013717 - protein, 35 aa, Entamoeba invadens
QKRNLSFSIAYRRIIDLIIFLIDFKTQINDSEDNA

SEQ ID NO: 3013718 - protein, 17 aa, Entamoeba invadens
QKRRRVMFKYGDDLRRD

SEQ ID NO: 3013719 - protein, 28 aa, Entamoeba invadens
QKRVYSALLWCCFVPTKICIVTEYADFG

SEQ ID NO: 3013720 - protein, 37 aa, Entamoeba invadens
QKRYSQFYFLDNYLQSKLPKKTLPSLPPKELLHSGSH

SEQ ID NO: 3013721 - protein, 23 aa, Entamoeba invadens
QKSFARELSLFPKLRVFDIYGNA

SEQ ID NO: 3013722 - protein, 18 aa, Entamoeba invadens
QKSIILLEYVKQCGKTHQ

SEQ ID NO: 3013723 - protein, 42 aa, Entamoeba invadens
QKSILEEIQKQLALLPTIMERISNFESTLLTIKKKQAEIEEK

SEQ ID NO: 3013724 - protein, 19 aa, Entamoeba invadens
QKSKMSQLAYQRALRRRRI

SEQ ID NO: 3013725 - protein, 26 aa, Entamoeba invadens
QKSTKYSHQFLKVSKLTLYQSEVWQL

SEQ ID NO: 3013726 - protein, 23 aa, Entamoeba invadens
QKSTLIGFFLKQLGSPYSDISSS

SEQ ID NO: 3013727 - protein, 23 aa, Entamoeba invadens
QKSVIFYFNTKCGASHLLKLISS

SEQ ID NO: 3013728 - protein, 24 aa, Entamoeba invadens
QKTAEFLGFSFKYATSFTNNVKKL

SEQ ID NO: 3013729 - protein, 17 aa, Entamoeba invadens
QKTFKNLQFYVEPEMSF

SEQ ID NO: 3013730 - protein, 23 aa, Entamoeba invadens
QKTFTFHQFLRKLPFPKFVSTYA

SEQ ID NO: 3013731 - protein, 25 aa, Entamoeba invadens
QKTIKYFPHIESLNIWSKLDELFGN

SEQ ID NO: 3013732 - protein, 26 aa, Entamoeba invadens
QKTIKYFPHIESLNIWSKLDELFGNE

SEQ ID NO: 3013733 - protein, 26 aa, Entamoeba invadens
QKTLEYHLKYIFLNGFYKVPQHEKIP

SEQ ID NO: 3013734 - protein, 17 aa, Entamoeba invadens
QKTLPEITLLVMQTRLK

SEQ ID NO: 3013735 - protein, 23 aa, Entamoeba invadens
QKTRFDVQVFVYNIKYGNNRYQT

SEQ ID NO: 3013736 - protein, 25 aa, Entamoeba invadens
QKTSFSIPPLPFNIAANNLLQESLH

SEQ ID NO: 3013737 - protein, 22 aa, Entamoeba invadens
QKTTLATLFRNPPNIRIDGKDF

SEQ ID NO: 3013738 - protein, 23 aa, Entamoeba invadens
QKVAEILVQIKLSLFVNEHPTAE

SEQ ID NO: 3013739 - protein, 20 aa, Entamoeba invadens
QKVCRVVTLTPKRLELVSPI

SEQ ID NO: 3013740 - protein, 17 aa, Entamoeba invadens
QKVIPVSKRKNKPSAVT

SEQ ID NO: 3013741 - protein, 17 aa, Entamoeba invadens
QKVLRSEALVNHIKGIA

SEQ ID NO: 3013742 - protein, 24 aa, Entamoeba invadens
QKVMYPFEFAPLKQYESFSGAFMR

SEQ ID NO: 3013743 - protein, 36 aa, Entamoeba invadens
QKVNVFIGNLPRGATVQSIFKHFEGYKVDKVRIIKH

SEQ ID NO: 3013744 - protein, 18 aa, Entamoeba invadens
QKVRRQGAYTPTKKTRDT

SEQ ID NO: 3013745 - protein, 17 aa, Entamoeba invadens
QKVVIRPSVLDNEEVCV

SEQ ID NO: 3013746 - protein, 31 aa, Entamoeba invadens
QKVYFDLQSCEFLKSIFLLNVNCEKLIAPKS

SEQ ID NO: 3013747 - protein, 24 aa, Entamoeba invadens
QKWAKITIFMKNWTELLPHDFVES

SEQ ID NO: 3013748 - protein, 24 aa, Entamoeba invadens
QKYDDAIIELKRLESFKFDVNQDE

SEQ ID NO: 3013749 - protein, 26 aa, Entamoeba invadens
QKYFIKQFVYILRQLPDFNKYILAFS

SEQ ID NO: 3013750 - protein, 23 aa, Entamoeba invadens
QKYGFPIVKLHNWEYKPKSNEKT

SEQ ID NO: 3013751 - protein, 24 aa, Entamoeba invadens
QKYGLRPYGVGLLVVGYDTKARLF

SEQ ID NO: 3013752 - protein, 26 aa, Entamoeba invadens
QKYIKDYRFFSFDFVTQTVCQSQSVV

SEQ ID NO: 3013753 - protein, 23 aa, Entamoeba invadens
QKYNCCFRLPNKSSKILFKFGEK

SEQ ID NO: 3013754 - protein, 25 aa, Entamoeba invadens
QKYNKISFTFVFQNKSQLLKKKQID

SEQ ID NO: 3013755 - protein, 21 aa, Entamoeba invadens
QKYQSLLDVIDIRSTVAFNVL

SEQ ID NO: 3013756 - protein, 25 aa, Entamoeba invadens
QKYSQPILFLVDNLLRKSPNERMTA

SEQ ID NO: 3013757 - protein, 21 aa, Entamoeba invadens
QLAFRIPPIYDQTASIPVVDA

SEQ ID NO: 3013758 - protein, 20 aa, Entamoeba invadens
QLALKLLCNVVYGYTGAGFT

SEQ ID NO: 3013759 - protein, 18 aa, Entamoeba invadens
QLAPITRKFRNYLKKVFI

SEQ ID NO: 3013760 - protein, 21 aa, Entamoeba invadens
QLATVFDILDVSKKGFLELSD

SEQ ID NO: 3013761 - protein, 22 aa, Entamoeba invadens
QLAVEFKQVFMRCREFVSWGFF

SEQ ID NO: 3013762 - protein, 19 aa, Entamoeba invadens
QLAYQCESALWVNSYNTAA

SEQ ID NO: 3013763 - protein, 18 aa, Entamoeba invadens
QLCFFKAIIQLVRGFEKY

SEQ ID NO: 3013764 - protein, 20 aa, Entamoeba invadens
QLCKSLILENTAFPPGATET

SEQ ID NO: 3013765 - protein, 18 aa, Entamoeba invadens
QLCTNNKFKPVRVVVYQM

SEQ ID NO: 3013766 - protein, 25 aa, Entamoeba invadens
QLDEILSILKIFVKNRVYDTDKYIQ

SEQ ID NO: 3013767 - protein, 22 aa, Entamoeba invadens
QLDEIQRIKNAIELFEKNHQQV

SEQ ID NO: 3013768 - protein, 19 aa, Entamoeba invadens
QLDFTPRAIYRPQVNMPPL

SEQ ID NO: 3013769 - protein, 24 aa, Entamoeba invadens
QLDGFHIMIVSKYFYSITDFKVLT

SEQ ID NO: 3013770 - protein, 24 aa, Entamoeba invadens
QLDHFVVLPDYFSMFCVPEYVLTE

SEQ ID NO: 3013771 - protein, 23 aa, Entamoeba invadens
QLDIESVGFNFVLKKLRGENFEV

SEQ ID NO: 3013772 - protein, 17 aa, Entamoeba invadens
QLDINKMKFPKMIFLRK

SEQ ID NO: 3013773 - protein, 28 aa, Entamoeba invadens
QLDKRIEYFTFMENKAKMRLEEAVKAIE

SEQ ID NO: 3013774 - protein, 20 aa, Entamoeba invadens
QLDKWIMFNDNKVCFSQKPP

SEQ ID NO: 3013775 - protein, 23 aa, Entamoeba invadens
QLDLEQARFVYNLLLCDKGRCAY

SEQ ID NO: 3013776 - protein, 32 aa, Entamoeba invadens
QLDLRSYLIMPIQRLPRYVLLFTDLMKHTPEN

SEQ ID NO: 3013777 - protein, 27 aa, Entamoeba invadens
QLDNSWVVPFNPYLLKRFRAHINVECC

SEQ ID NO: 3013778 - protein, 22 aa, Entamoeba invadens
QLDRPKVFPSLNYFGASVPICK

SEQ ID NO: 3013779 - protein, 21 aa, Entamoeba invadens
QLDYFLKRALKGGSLTITKKI

SEQ ID NO: 3013780 - protein, 18 aa, Entamoeba invadens
QLDYIKDIPLEALSLNGN

SEQ ID NO: 3013781 - protein, 26 aa, Entamoeba invadens
QLECAISAVFRSWMGRRAVDYRREFK

SEQ ID NO: 3013782 - protein, 39 aa, Entamoeba invadens
QLEDLLGKKFCFPGLILHDIILRFIPEQAEFFLTKGSKS

SEQ ID NO: 3013783 - protein, 25 aa, Entamoeba invadens
QLEEKQLEEVVPMEIEPLKESAEVT

SEQ ID NO: 3013784 - protein, 22 aa, Entamoeba invadens
QLEFIFVPVNFSRHWTLVLFCL

SEQ ID NO: 3013785 - protein, 18 aa, Entamoeba invadens
QLEIAFASESFASLKTQE

SEQ ID NO: 3013786 - protein, 17 aa, Entamoeba invadens
QLEIALLKQNEKIEKEK

SEQ ID NO: 3013787 - protein, 20 aa, Entamoeba invadens
QLEKAQLIFINKGKVEIVAT

SEQ ID NO: 3013788 - protein, 20 aa, Entamoeba invadens
QLEKYPMIEIYKYIMRDRQE

SEQ ID NO: 3013789 - protein, 20 aa, Entamoeba invadens
QLEMPLLSSESIFMMQAVDE

SEQ ID NO: 3013790 - protein, 21 aa, Entamoeba invadens
QLENVILPLSITELSPFCFDN

SEQ ID NO: 3013791 - protein, 19 aa, Entamoeba invadens
QLEQLSFFSFPKLKTRKYI

SEQ ID NO: 3013792 - protein, 24 aa, Entamoeba invadens
QLERISRIVLYDPPFDLTLMARIE

SEQ ID NO: 3013793 - protein, 25 aa, Entamoeba invadens
QLESCYLFEAFSFVITKLISNEYED

SEQ ID NO: 3013794 - protein, 25 aa, Entamoeba invadens
QLETQQIYAYKMFVNYVNSDNPFVD

SEQ ID NO: 3013795 - protein, 17 aa, Entamoeba invadens
QLFALIQEYEQEKTVAV

SEQ ID NO: 3013796 - protein, 19 aa, Entamoeba invadens
QLFDHIRVLKTSPITLFLL

SEQ ID NO: 3013797 - protein, 21 aa, Entamoeba invadens
QLFDLISYEKGCGLINMMINY

SEQ ID NO: 3013798 - protein, 20 aa, Entamoeba invadens
QLFLTILIEIVRNYEYIETN

SEQ ID NO: 3013799 - protein, 28 aa, Entamoeba invadens
QLFMQYLGPVITLMLKRLLLKEGGEVVD

SEQ ID NO: 3013800 - protein, 17 aa, Entamoeba invadens
QLFNINEILLFLRTFTS

SEQ ID NO: 3013801 - protein, 24 aa, Entamoeba invadens
QLGPKDGFIYLIGCNALHILNITS

SEQ ID NO: 3013802 - protein, 22 aa, Entamoeba invadens
QLGQVKTFFPTQAKTQPLQIKL

SEQ ID NO: 3013803 - protein, 19 aa, Entamoeba invadens
QLHEKENIIADLEKQVKKL

SEQ ID NO: 3013804 - protein, 18 aa, Entamoeba invadens
QLHFAQCSSTLAAALKTM

SEQ ID NO: 3013805 - protein, 20 aa, Entamoeba invadens
QLHRVIADIIYFNYIEEEIV

SEQ ID NO: 3013806 - protein, 24 aa, Entamoeba invadens
QLIALHKVIPLEYNLNFDAMCCTD

SEQ ID NO: 3013807 - protein, 20 aa, Entamoeba invadens
QLIDLGIHPSLVLQHLFRLC

SEQ ID NO: 3013808 - protein, 17 aa, Entamoeba invadens
QLIFINKGKVEIVATNK

SEQ ID NO: 3013809 - protein, 20 aa, Entamoeba invadens
QLIFSFVPREQLSVIYTKYA

SEQ ID NO: 3013810 - protein, 30 aa, Entamoeba invadens
QLIIDLMIALFDSSYFFIGNARIKLFVDTF

SEQ ID NO: 3013811 - protein, 19 aa, Entamoeba invadens
QLIINSKRLMVNKKQKEIS

SEQ ID NO: 3013812 - protein, 17 aa, Entamoeba invadens
QLIKGKYEKDIAEIIRF

SEQ ID NO: 3013813 - protein, 27 aa, Entamoeba invadens
QLIKSSGKLVLLDKLLPKLYEDKHKVL

SEQ ID NO: 3013814 - protein, 21 aa, Entamoeba invadens
QLIMGPMFSGKTTELIRLIKR

SEQ ID NO: 3013815 - protein, 17 aa, Entamoeba invadens
QLINSFFEFSRSMKTQF

SEQ ID NO: 3013816 - protein, 18 aa, Entamoeba invadens
QLIRLCVCGNKTFPADEC

SEQ ID NO: 3013817 - protein, 26 aa, Entamoeba invadens
QLISGNFVFFLELFSKADLSTTKEFS

SEQ ID NO: 3013818 - protein, 18 aa, Entamoeba invadens
QLKAFQLPAELLTKEIQK

SEQ ID NO: 3013819 - protein, 37 aa, Entamoeba invadens
QLKALCLVFPNRKDLWFFFNKIIVLSRRQTNPGLLKY

SEQ ID NO: 3013820 - protein, 29 aa, Entamoeba invadens
QLKATSKDFFLFGSPYVYQNLYFYKRKEQ

SEQ ID NO: 3013821 - protein, 25 aa, Entamoeba invadens
QLKEGQCYLPFLQGLTGFKQYKLLG

SEQ ID NO: 3013822 - protein, 27 aa, Entamoeba invadens
QLKEIVMPHIPTKLFYSCFEECTALTL

SEQ ID NO: 3013823 - protein, 21 aa, Entamoeba invadens
QLKFDVLRYNKIFLYDKYKVR

SEQ ID NO: 3013824 - protein, 20 aa, Entamoeba invadens
QLKFTPTLLNVLKLGMADTS

SEQ ID NO: 3013825 - protein, 19 aa, Entamoeba invadens
QLKGIASLLNGLLVATQPS

SEQ ID NO: 3013826 - protein, 30 aa, Entamoeba invadens
QLKGILQLNLYAFTLLLHLEDFISNSLHTL

SEQ ID NO: 3013827 - protein, 17 aa, Entamoeba invadens
QLKIRIIVNTRYSIQQF

SEQ ID NO: 3013828 - protein, 25 aa, Entamoeba invadens
QLKKVRVNVLRQIKNLRTMLMARVN

SEQ ID NO: 3013829 - protein, 21 aa, Entamoeba invadens
QLKLINFFRVRTYGSMLKEIV

SEQ ID NO: 3013830 - protein, 18 aa, Entamoeba invadens
QLKLVKLPSTLSEIQKFC

SEQ ID NO: 3013831 - protein, 23 aa, Entamoeba invadens
QLKMNWFTNILLIKEIVIQIDIL

SEQ ID NO: 3013832 - protein, 25 aa, Entamoeba invadens
QLKNHPWFEGINWNTLLSESREDIF

SEQ ID NO: 3013833 - protein, 32 aa, Entamoeba invadens
QLKPVLQLLPDVNRILLYNLVILCRVIGSHVD

SEQ ID NO: 3013834 - protein, 31 aa, Entamoeba invadens
QLKQENIKFAPIVRPTLPLHMEILDNETEPS

SEQ ID NO: 3013835 - protein, 25 aa, Entamoeba invadens
QLKSEFTIIPYYANPVDIADTTFNL

SEQ ID NO: 3013836 - protein, 19 aa, Entamoeba invadens
QLKTLNDYLFILTDLESVC

SEQ ID NO: 3013837 - protein, 23 aa, Entamoeba invadens
QLKYSVLFPKIFSAVPNLYTYLV

SEQ ID NO: 3013838 - protein, 19 aa, Entamoeba invadens
QLLDRLLSIIEYQNFKSLY

SEQ ID NO: 3013839 - protein, 32 aa, Entamoeba invadens
QLLEGIMKFPMTLYIAFKRIFDGIPSIYKRWA

SEQ ID NO: 3013840 - protein, 17 aa, Entamoeba invadens
QLLIQPDERARTVFVKK

SEQ ID NO: 3013841 - protein, 20 aa, Entamoeba invadens
QLLKDVVSLAFKKNGMDVCR

SEQ ID NO: 3013842 - protein, 23 aa, Entamoeba invadens
QLLKITEILGPIPDFLLQKGTKT

SEQ ID NO: 3013843 - protein, 18 aa, Entamoeba invadens
QLLKSLSLIFNFVNEIAK

SEQ ID NO: 3013844 - protein, 21 aa, Entamoeba invadens
QLLMEWVRRRLPKSQISDITV

SEQ ID NO: 3013845 - protein, 29 aa, Entamoeba invadens
QLLNKFLVIFSHTEILMSILIAIRVVQKD

SEQ ID NO: 3013846 - protein, 19 aa, Entamoeba invadens
QLLQRHPTLRERIKRIFTV

SEQ ID NO: 3013847 - protein, 30 aa, Entamoeba invadens
QLLSKAPKLSLPPLSTPLNLAPISLHSLDA

SEQ ID NO: 3013848 - protein, 33 aa, Entamoeba invadens
QLLSNTLYSHRFFPYYSFSILTGLSVKGEPLIY

SEQ ID NO: 3013849 - protein, 30 aa, Entamoeba invadens
QLMHDYRRRLPVVYIRLFSYELARSLAYIH

SEQ ID NO: 3013850 - protein, 20 aa, Entamoeba invadens
QLMKYIPQNGITKIIFIANE

SEQ ID NO: 3013851 - protein, 19 aa, Entamoeba invadens
QLMRHFIKNAKENGRLGLI

SEQ ID NO: 3013852 - protein, 19 aa, Entamoeba invadens
QLMRVYGALMWSLGKVMQT

SEQ ID NO: 3013853 - protein, 24 aa, Entamoeba invadens
QLNFMMYDMILIRNNKIWKEPFKT

SEQ ID NO: 3013854 - protein, 34 aa, Entamoeba invadens
QLNGYISSDILPLRLCIYLYSSISQILTLYTNIF

SEQ ID NO: 3013855 - protein, 25 aa, Entamoeba invadens
QLNIDSIPLFVCRHQNLLQVMVQKT

SEQ ID NO: 3013856 - protein, 17 aa, Entamoeba invadens
QLNKRKPLHKAKKTKQI

SEQ ID NO: 3013857 - protein, 19 aa, Entamoeba invadens
QLNLFGGVTTKKIKLDEFV

SEQ ID NO: 3013858 - protein, 30 aa, Entamoeba invadens
QLNPCRPVPFVLQNCLPTNNSYGWSPTTAY

SEQ ID NO: 3013859 - protein, 21 aa, Entamoeba invadens
QLNVAPMYCYSYTPAYYVPYN

SEQ ID NO: 3013860 - protein, 32 aa, Entamoeba invadens
QLPDKLKQKLWYSNIYCGIIRGALEMLKYKVE

SEQ ID NO: 3013861 - protein, 31 aa, Entamoeba invadens
QLPEDLVWNIFLQINFGLAYLHSVHILHRDL

SEQ ID NO: 3013862 - protein, 28 aa, Entamoeba invadens
QLPEELNTLFTHLLRLCFKIAQNEKINS

SEQ ID NO: 3013863 - protein, 18 aa, Entamoeba invadens
QLPEVWYNMGSLYVYHGQ

SEQ ID NO: 3013864 - protein, 21 aa, Entamoeba invadens
QLPINTFPLELIKRYTKQEYD

SEQ ID NO: 3013865 - protein, 19 aa, Entamoeba invadens
QLPLLEILSQLISKVYTHL

SEQ ID NO: 3013866 - protein, 22 aa, Entamoeba invadens
QLPPLLIGKHFFRQSHENNKII

SEQ ID NO: 3013867 - protein, 17 aa, Entamoeba invadens
QLPVMWHQGLLVFVQRY

SEQ ID NO: 3013868 - protein, 41 aa, Entamoeba invadens
QLQKKTFPCVKLNPTKALTIFHKQFYDERFKTLTTLAAWEL

SEQ ID NO: 3013869 - protein, 18 aa, Entamoeba invadens
QLQRLLDHYLKEKTLEDI

SEQ ID NO: 3013870 - protein, 18 aa, Entamoeba invadens
QLRCFGKAFFRPLLTPQC

SEQ ID NO: 3013871 - protein, 27 aa, Entamoeba invadens
QLRGCIGCFSPHKPFYELVQEYAIEAC

SEQ ID NO: 3013872 - protein, 23 aa, Entamoeba invadens
QLRHITNGYLFKDAGFAKWAEGS

SEQ ID NO: 3013873 - protein, 23 aa, Entamoeba invadens
QLRHKVWKVLLGQLPLDQNKQAS

SEQ ID NO: 3013874 - protein, 17 aa, Entamoeba invadens
QLRKLGLNLPFSCDANF

SEQ ID NO: 3013875 - protein, 26 aa, Entamoeba invadens
QLRNVVVLNLMFYSLRMKLVDVIPDS

SEQ ID NO: 3013876 - protein, 25 aa, Entamoeba invadens
QLRQDGFAGLRYRSVRKPGQHCWAL

SEQ ID NO: 3013877 - protein, 18 aa, Entamoeba invadens
QLRRQTVPVKPIEVSPNV

SEQ ID NO: 3013878 - protein, 25 aa, Entamoeba invadens
QLRSQLLVYLTTNAPRRLLVAYSNL

SEQ ID NO: 3013879 - protein, 20 aa, Entamoeba invadens
QLRSVFYFANDIIPNSLYFL

SEQ ID NO: 3013880 - protein, 22 aa, Entamoeba invadens
QLRSYEDRFQGRRLPRSFSGRL

SEQ ID NO: 3013881 - protein, 31 aa, Entamoeba invadens
QLRVTPLQLHFVPLTLFLAINTRDTRYDGVT

SEQ ID NO: 3013882 - protein, 20 aa, Entamoeba invadens
QLSDAYFKEILSTLPDEEES

SEQ ID NO: 3013883 - protein, 32 aa, Entamoeba invadens
QLSEATVLYNLRLRYMKDIIHTYSGLFCVVIN

SEQ ID NO: 3013884 - protein, 26 aa, Entamoeba invadens
QLSESAPWSLQRGGKYFYIKDLTTVC

SEQ ID NO: 3013885 - protein, 22 aa, Entamoeba invadens
QLSHEQLLFTNAILDKVIKTIQ

SEQ ID NO: 3013886 - protein, 31 aa, Entamoeba invadens
QLSITPPTLITPLLNYLMFHTFTKTENVIMP

SEQ ID NO: 3013887 - protein, 19 aa, Entamoeba invadens
QLSKKLWHYTRAVFREKYS

SEQ ID NO: 3013888 - protein, 27 aa, Entamoeba invadens
QLSKTKMIPLQCQTNYIFDTTTNQCVT

SEQ ID NO: 3013889 - protein, 18 aa, Entamoeba invadens
QLSNIHFLEKKYAELEQE

SEQ ID NO: 3013890 - protein, 25 aa, Entamoeba invadens
QLSPELTEIVFYRSLYRCCVPEFPH

SEQ ID NO: 3013891 - protein, 32 aa, Entamoeba invadens
QLSQLPLFQQILKNVKLWFKSVVIPVYVRESG

SEQ ID NO: 3013892 - protein, 17 aa, Entamoeba invadens
QLSSGAGLVLEILADSN

SEQ ID NO: 3013893 - protein, 27 aa, Entamoeba invadens
QLSTDIQHYFFNKPLPFPQHTSKVFTP

SEQ ID NO: 3013894 - protein, 30 aa, Entamoeba invadens
QLTHVITVTSLLVLLQSWKTRRGVKGNDIL

SEQ ID NO: 3013895 - protein, 24 aa, Entamoeba invadens
QLTKLHLILKDMRTVKKLKNLITL

SEQ ID NO: 3013896 - protein, 26 aa, Entamoeba invadens
QLTKRFRVTRLYNVYGELLFTEDKPT

SEQ ID NO: 3013897 - protein, 19 aa, Entamoeba invadens
QLTLLFVQKGGESLSCPFC

SEQ ID NO: 3013898 - protein, 17 aa, Entamoeba invadens
QLTMFCLQSNRLETFPV

SEQ ID NO: 3013899 - protein, 20 aa, Entamoeba invadens
QLTMFFPVDVDFDGWLADLR

SEQ ID NO: 3013900 - protein, 17 aa, Entamoeba invadens
QLTPNVTGYYILRKEIL

SEQ ID NO: 3013901 - protein, 20 aa, Entamoeba invadens
QLTQLTYYKMENKMIIGEDD

SEQ ID NO: 3013902 - protein, 20 aa, Entamoeba invadens
QLTSLIFPNTIERIGKMCCS

SEQ ID NO: 3013903 - protein, 22 aa, Entamoeba invadens
QLTTISFKMYKKLKIYDFFETG

SEQ ID NO: 3013904 - protein, 19 aa, Entamoeba invadens
QLTTLLSRVKPPLSSAVLA

SEQ ID NO: 3013905 - protein, 18 aa, Entamoeba invadens
QLVALMKGLEKNDMMKFV

SEQ ID NO: 3013906 - protein, 21 aa, Entamoeba invadens
QLVENDDIFQQCLPTCLHDYN

SEQ ID NO: 3013907 - protein, 17 aa, Entamoeba invadens
QLVFKPQQFQPMSAPVF

SEQ ID NO: 3013908 - protein, 19 aa, Entamoeba invadens
QLVFRKSRALKRATKVLGG

SEQ ID NO: 3013909 - protein, 27 aa, Entamoeba invadens
QLVKRQMNALPVWQNTSWRKEYVTEHM

SEQ ID NO: 3013910 - protein, 17 aa, Entamoeba invadens
QLVLPYLQAYERETLAM

SEQ ID NO: 3013911 - protein, 48 aa, Entamoeba invadens
QLVNEYFIGLSWVLKYYYQGCQCWDWYFPYLYAPFIADVATYLDNTLE

SEQ ID NO: 3013912 - protein, 19 aa, Entamoeba invadens
QLVNPTLVLFECTRDITFE

SEQ ID NO: 3013913 - protein, 25 aa, Entamoeba invadens
QLVSQKYFDTLPFNKKTNYFSTTMP

SEQ ID NO: 3013914 - protein, 28 aa, Entamoeba invadens
QLVSWIHIIRIILYSLNKLRPNTEYFTL

SEQ ID NO: 3013915 - protein, 20 aa, Entamoeba invadens
QLVTLFLSLVLNKRIALFSR

SEQ ID NO: 3013916 - protein, 17 aa, Entamoeba invadens
QLVYLRQGMLEITVLTI

SEQ ID NO: 3013917 - protein, 18 aa, Entamoeba invadens
QLVYLRQGMLEITVLTIL

SEQ ID NO: 3013918 - protein, 23 aa, Entamoeba invadens
QLYEALLNLHTECKLLITGTPLQ

SEQ ID NO: 3013919 - protein, 25 aa, Entamoeba invadens
QLYHLPIQIISICQTLFQKSKEKFP

SEQ ID NO: 3013920 - protein, 17 aa, Entamoeba invadens
QLYLRNCSEMKRKGTSS

SEQ ID NO: 3013921 - protein, 20 aa, Entamoeba invadens
QLYVELPFAAKEGDYIGIFN

SEQ ID NO: 3013922 - protein, 26 aa, Entamoeba invadens
QLYVSMYYIPTFPILYQKNSKFDVYV

SEQ ID NO: 3013923 - protein, 33 aa, Entamoeba invadens
QMCCDMSKLLVFPVSYLQFPKGTLLKRCTPHPL

SEQ ID NO: 3013924 - protein, 34 aa, Entamoeba invadens
QMCHKMSKLRMMLTKIPFFKEVTIFAFSCDNCGF

SEQ ID NO: 3013925 - protein, 23 aa, Entamoeba invadens
QMDFDYLLFISKMAKGMSTSQAA

SEQ ID NO: 3013926 - protein, 25 aa, Entamoeba invadens
QMDNKINIFEFDPTLQQIYEEHKDD

SEQ ID NO: 3013927 - protein, 18 aa, Entamoeba invadens
QMDNQLKRIQFEKEQIEN

SEQ ID NO: 3013928 - protein, 29 aa, Entamoeba invadens
QMEDTIFKPSLWMNLIERKFYEYNEIEDG

SEQ ID NO: 3013929 - protein, 20 aa, Entamoeba invadens
QMERKITVSPAFKKQEKKAE

SEQ ID NO: 3013930 - protein, 25 aa, Entamoeba invadens
QMFMNTFIFHQNTLIRTRAIKLLTN

SEQ ID NO: 3013931 - protein, 20 aa, Entamoeba invadens
QMFNELLPLAIEEAIKQLKA

SEQ ID NO: 3013932 - protein, 23 aa, Entamoeba invadens
QMFNPVFVECLPAKKFKMKGEPQ

SEQ ID NO: 3013933 - protein, 35 aa, Entamoeba invadens
QMFYNDQLLALPHYYLTLFKSFENLFSLGHSFFTD

SEQ ID NO: 3013934 - protein, 19 aa, Entamoeba invadens
QMGLFYPNRYLKLAAVRVE

SEQ ID NO: 3013935 - protein, 24 aa, Entamoeba invadens
QMGVGSCKLECLPIGQTVTKDVQL

SEQ ID NO: 3013936 - protein, 17 aa, Entamoeba invadens
QMILPQVIVTLDIAFRE

SEQ ID NO: 3013937 - protein, 23 aa, Entamoeba invadens
QMINRLLCQSVLQQKDRVFAHND

SEQ ID NO: 3013938 - protein, 18 aa, Entamoeba invadens
QMIPTVWDYIFNNGEFPK

SEQ ID NO: 3013939 - protein, 18 aa, Entamoeba invadens
QMISLMDRLLKKDLMDLK

SEQ ID NO: 3013940 - protein, 18 aa, Entamoeba invadens
QMKIIFQGLAGLQALKRV

SEQ ID NO: 3013941 - protein, 22 aa, Entamoeba invadens
QMKIKKDWRRFDPIEGGQRLVD

SEQ ID NO: 3013942 - protein, 37 aa, Entamoeba invadens
QMKKAGLENFKKFGLLHFLVFYYDQDWKKITNAPQGD

SEQ ID NO: 3013943 - protein, 26 aa, Entamoeba invadens
QMKLFEIPLICLNAIFINATHTDAKS

SEQ ID NO: 3013944 - protein, 22 aa, Entamoeba invadens
QMKLLKSEKWLEKVSIETKAKV

SEQ ID NO: 3013945 - protein, 29 aa, Entamoeba invadens
QMKLLRSENWLEKVLIKTKAKVLGVSPST

SEQ ID NO: 3013946 - protein, 17 aa, Entamoeba invadens
QMKLNSSWFAKLGMWHK

SEQ ID NO: 3013947 - protein, 17 aa, Entamoeba invadens
QMKMMNTRVLIVGLRGI

SEQ ID NO: 3013948 - protein, 23 aa, Entamoeba invadens
QMKRFGNFTVTCGAVLFGDPQTI

SEQ ID NO: 3013949 - protein, 20 aa, Entamoeba invadens
QMKYNLLKEELIKDMCLMVN

SEQ ID NO: 3013950 - protein, 17 aa, Entamoeba invadens
QMLIVPEPTKGMITSIV

SEQ ID NO: 3013951 - protein, 21 aa, Entamoeba invadens
QMLKRILIIYSIIHTNRGYFQ

SEQ ID NO: 3013952 - protein, 21 aa, Entamoeba invadens
QMLLNSLPRSLPLLLNIALNN

SEQ ID NO: 3013953 - protein, 18 aa, Entamoeba invadens
QMLPVIEEFILPTNLKEI

SEQ ID NO: 3013954 - protein, 21 aa, Entamoeba invadens
QMLQTIPTIPQSPKVQLKPIP

SEQ ID NO: 3013955 - protein, 19 aa, Entamoeba invadens
QMMHWNDYLIVCSDGIHDN

SEQ ID NO: 3013956 - protein, 33 aa, Entamoeba invadens
QMNGKYQIIALAPQILILMCYMEKVNWSVKELS

SEQ ID NO: 3013957 - protein, 23 aa, Entamoeba invadens
QMNKYMDIFVALDDLEKGYQDDI

SEQ ID NO: 3013958 - protein, 23 aa, Entamoeba invadens
QMNLVIETLKLFDSDDLKMVRSS

SEQ ID NO: 3013959 - protein, 24 aa, Entamoeba invadens
QMNNILTLKGLYDVTAELLYLPEN

SEQ ID NO: 3013960 - protein, 21 aa, Entamoeba invadens
QMNSILPLIIGVCNEDAAITR

SEQ ID NO: 3013961 - protein, 21 aa, Entamoeba invadens
QMNVYIFPKFVVSVVKTIMKI

SEQ ID NO: 3013962 - protein, 24 aa, Entamoeba invadens
QMPRSVIVVLYNTLVDKAKPGDRV

SEQ ID NO: 3013963 - protein, 21 aa, Entamoeba invadens
QMQFFMCDISYAFEYLTKNCS

SEQ ID NO: 3013964 - protein, 17 aa, Entamoeba invadens
QMQGKMGGVPWKVDVDP

SEQ ID NO: 3013965 - protein, 24 aa, Entamoeba invadens
QMQVVLYLPRLLDVFIFSQVNHTA

SEQ ID NO: 3013966 - protein, 25 aa, Entamoeba invadens
QMSNGVLYFLTHLGFLFMEKKTKKA

SEQ ID NO: 3013967 - protein, 23 aa, Entamoeba invadens
QMSRQSFQIASRPLQKLPSHLKK

SEQ ID NO: 3013968 - protein, 18 aa, Entamoeba invadens
QMSSTLLEFLPKKKMTFK

SEQ ID NO: 3013969 - protein, 24 aa, Entamoeba invadens
QMTERHFLYLINTEIKQNSLIELF

SEQ ID NO: 3013970 - protein, 19 aa, Entamoeba invadens
QMVCKEYFHLPEKYRYNPI

SEQ ID NO: 3013971 - protein, 25 aa, Entamoeba invadens
QMVKFPHHLSYIEKCCFARCSALKT

SEQ ID NO: 3013972 - protein, 20 aa, Entamoeba invadens
QMVRMLDILAEYMKKRGFSY

SEQ ID NO: 3013973 - protein, 19 aa, Entamoeba invadens
QMVRPIRHRLTGKTVYIGP

SEQ ID NO: 3013974 - protein, 17 aa, Entamoeba invadens
QMYLHLKYDGIHLVLFG

SEQ ID NO: 3013975 - protein, 18 aa, Entamoeba invadens
QMYVFMRSNEYQTSPQNT

SEQ ID NO: 3013976 - protein, 23 aa, Entamoeba invadens
QNAFEIIKGVQFFGLGFPVQERV

SEQ ID NO: 3013977 - protein, 27 aa, Entamoeba invadens
QNAIPSAFVPVQCLPSFFSVENNVSNT

SEQ ID NO: 3013978 - protein, 17 aa, Entamoeba invadens
QNANYLVQCQDKIIADA

SEQ ID NO: 3013979 - protein, 20 aa, Entamoeba invadens
QNCKEICDFAFYRCLSLSKI

SEQ ID NO: 3013980 - protein, 19 aa, Entamoeba invadens
QNCRSLTAIGLPNTLKSFG

SEQ ID NO: 3013981 - protein, 29 aa, Entamoeba invadens
QNCVCLEHFPFPKMLRTIGSFAFSGCINL

SEQ ID NO: 3013982 - protein, 30 aa, Entamoeba invadens
QNDFSGFEFTFFDVISPEQVYLKPRNDYKV

SEQ ID NO: 3013983 - protein, 27 aa, Entamoeba invadens
QNDNTIEYYLFQSLFKTKLINSKEDCK

SEQ ID NO: 3013984 - protein, 25 aa, Entamoeba invadens
QNEALFPQHYKLILKRIYVQTREVR

SEQ ID NO: 3013985 - protein, 24 aa, Entamoeba invadens
QNECHEWFMKNKIGELYLCPHSSH

SEQ ID NO: 3013986 - protein, 24 aa, Entamoeba invadens
QNEFRNFLVLMKDLQVLEIEEHSQ

SEQ ID NO: 3013987 - protein, 24 aa, Entamoeba invadens
QNEFRNFLVLVKDLQVLEIEEHSQ

SEQ ID NO: 3013988 - protein, 27 aa, Entamoeba invadens
QNEGIRKDVFFQKKLEKIGELKRMINE

SEQ ID NO: 3013989 - protein, 24 aa, Entamoeba invadens
QNEILSCMLYYLDFAKNTSIREEM

SEQ ID NO: 3013990 - protein, 28 aa, Entamoeba invadens
QNEKDILNLLIEVLDIVHDAQQDKPLQK

SEQ ID NO: 3013991 - protein, 23 aa, Entamoeba invadens
QNEKSVIWFFKHFSPETYDTPIY

SEQ ID NO: 3013992 - protein, 24 aa, Entamoeba invadens
QNELRTFRFINFFVKSTSRSFKSL

SEQ ID NO: 3013993 - protein, 20 aa, Entamoeba invadens
QNELTKLAPPKIKILCQSDP

SEQ ID NO: 3013994 - protein, 26 aa, Entamoeba invadens
QNELVGTLYFVFYKSFTMLQSEVGTL

SEQ ID NO: 3013995 - protein, 27 aa, Entamoeba invadens
QNENFLFNPLFFFSHLERQYMVTVSKY

SEQ ID NO: 3013996 - protein, 22 aa, Entamoeba invadens
QNERSILMNVQPETLATPIKPT

SEQ ID NO: 3013997 - protein, 24 aa, Entamoeba invadens
QNFEKHYLMELRLKDKKFINNIDV

SEQ ID NO: 3013998 - protein, 19 aa, Entamoeba invadens
QNFKPLYRERLIAKIGGYD

SEQ ID NO: 3013999 - protein, 19 aa, Entamoeba invadens
QNFKQHIRAFNSAISFASF

SEQ ID NO: 3014000 - protein, 30 aa, Entamoeba invadens
QNFKSLYDKKLVTFYNLLRGISIIKNEIKH

SEQ ID NO: 3014001 - protein, 23 aa, Entamoeba invadens
QNFPTVVMYIWSKQYQTFSNKIF

SEQ ID NO: 3014002 - protein, 26 aa, Entamoeba invadens
QNFSMKVAVPKWIDLALQPPSGNTIP

SEQ ID NO: 3014003 - protein, 35 aa, Entamoeba invadens
QNFSRRILFFGAMYTLKLQITIAPLGGASLSALSQ

SEQ ID NO: 3014004 - protein, 23 aa, Entamoeba invadens
QNFVEMAILYNAPPYLGCELLDI

SEQ ID NO: 3014005 - protein, 17 aa, Entamoeba invadens
QNGIFTCQNHLPCYEGG

SEQ ID NO: 3014006 - protein, 20 aa, Entamoeba invadens
QNGMFILEKDKCVYIVNNKC

SEQ ID NO: 3014007 - protein, 30 aa, Entamoeba invadens
QNGSGFFIYSNGTFWLDIGNHLGRICVTTP

SEQ ID NO: 3014008 - protein, 21 aa, Entamoeba invadens
QNICKTIVFSTLNVGKNQIIK

SEQ ID NO: 3014009 - protein, 17 aa, Entamoeba invadens
QNIFMNCEKLATIVGIG

SEQ ID NO: 3014010 - protein, 28 aa, Entamoeba invadens
QNIKDVLIYTLLIQFFERLISSKNLKTI

SEQ ID NO: 3014011 - protein, 23 aa, Entamoeba invadens
QNILDKRVFFDELLTENKVKVMS

SEQ ID NO: 3014012 - protein, 17 aa, Entamoeba invadens
QNISLATPPPRGTFVIN

SEQ ID NO: 3014013 - protein, 20 aa, Entamoeba invadens
QNIVSLRWKYNKSEGTFKKV

SEQ ID NO: 3014014 - protein, 27 aa, Entamoeba invadens
QNKCNPLLSMFTYYYDFQLEIPFAPSH

SEQ ID NO: 3014015 - protein, 18 aa, Entamoeba invadens
QNKFKIVLKAVGKYTLGA

SEQ ID NO: 3014016 - protein, 24 aa, Entamoeba invadens
QNKKLFAFGYGQINDYDICVFKKG

SEQ ID NO: 3014017 - protein, 24 aa, Entamoeba invadens
QNKKNILTLLQQIQMIFTPRRDSL

SEQ ID NO: 3014018 - protein, 25 aa, Entamoeba invadens
QNKKYDVICLPGGLPGANYLAKDTL

SEQ ID NO: 3014019 - protein, 26 aa, Entamoeba invadens
QNKNLGQYIPVLKLLLDFDNKSEESQ

SEQ ID NO: 3014020 - protein, 30 aa, Entamoeba invadens
QNKRIEYRLLWFRFDIRKLYLLRHGEPLEE

SEQ ID NO: 3014021 - protein, 22 aa, Entamoeba invadens
QNLDKAYYFVIETGLKEYKILY

SEQ ID NO: 3014022 - protein, 25 aa, Entamoeba invadens
QNLEKKYFVKLLVCFYELKGKRESE

SEQ ID NO: 3014023 - protein, 17 aa, Entamoeba invadens
QNLFDLIETVQLDFLNY

SEQ ID NO: 3014024 - protein, 21 aa, Entamoeba invadens
QNLHWLVMENTDIYCNVFSGS

SEQ ID NO: 3014025 - protein, 25 aa, Entamoeba invadens
QNLLSPPMTLLANQLYFSSSNIPLN

SEQ ID NO: 3014026 - protein, 17 aa, Entamoeba invadens
QNLMYSETFGLYIQQSE

SEQ ID NO: 3014027 - protein, 19 aa, Entamoeba invadens
QNLPYLIDLIVKTNTFEDF

SEQ ID NO: 3014028 - protein, 18 aa, Entamoeba invadens
QNLSHPFFEAFNTYLEDT

SEQ ID NO: 3014029 - protein, 26 aa, Entamoeba invadens
QNLSNFGFLPPQKKKVTLIFENENIL

SEQ ID NO: 3014030 - protein, 35 aa, Entamoeba invadens
QNLTKLHVRLIPRMIPIIKKFQGLKNLILDFGAQS

SEQ ID NO: 3014031 - protein, 24 aa, Entamoeba invadens
QNLVIDLLAECNVVLITDLARLSG

SEQ ID NO: 3014032 - protein, 25 aa, Entamoeba invadens
QNLVILKNVLMTYSFYNMRLNYGQG

SEQ ID NO: 3014033 - protein, 20 aa, Entamoeba invadens
QNLVSIILPLCDCSLDMELT

SEQ ID NO: 3014034 - protein, 22 aa, Entamoeba invadens
QNLYEWLSVNGFDFLDEIQLLY

SEQ ID NO: 3014035 - protein, 23 aa, Entamoeba invadens
QNMKTLIEQFNWIKSTIGVVSAN

SEQ ID NO: 3014036 - protein, 17 aa, Entamoeba invadens
QNMWKIPTPVQKTLQTL

SEQ ID NO: 3014037 - protein, 27 aa, Entamoeba invadens
QNNELMLRIESLKKEKVKRLILENNQT

SEQ ID NO: 3014038 - protein, 26 aa, Entamoeba invadens
QNNEPKMVFTCNGAFWVVSDSLVFFH

SEQ ID NO: 3014039 - protein, 19 aa, Entamoeba invadens
QNNFAGMGSFFNQQQGTNV

SEQ ID NO: 3014040 - protein, 23 aa, Entamoeba invadens
QNNKCLLCSSYCTTNKCDTIQGC

SEQ ID NO: 3014041 - protein, 28 aa, Entamoeba invadens
QNNKKIELLHLLIDLLEIRGGFDFESKY

SEQ ID NO: 3014042 - protein, 31 aa, Entamoeba invadens
QNNKKIELLHLLIDLLIVRGGYEFDSKYTEG

SEQ ID NO: 3014043 - protein, 21 aa, Entamoeba invadens
QNNLKKMWYISRATITMQPLE

SEQ ID NO: 3014044 - protein, 24 aa, Entamoeba invadens
QNNPGILDLPPLDSLQNLTRLVVR

SEQ ID NO: 3014045 - protein, 19 aa, Entamoeba invadens
QNNSFLYQNKEACKFVFEI

SEQ ID NO: 3014046 - protein, 24 aa, Entamoeba invadens
QNNSPFRLYYFDPLLDFENASKIG

SEQ ID NO: 3014047 - protein, 26 aa, Entamoeba invadens
QNNVFKRMLLLLRRKRVQIIRSIIAV

SEQ ID NO: 3014048 - protein, 17 aa, Entamoeba invadens
QNNVYLPYLANTSLMAY

SEQ ID NO: 3014049 - protein, 22 aa, Entamoeba invadens
QNPAWPMTVINTIFATAVNEMM

SEQ ID NO: 3014050 - protein, 20 aa, Entamoeba invadens
QNPFITKYNIISITPKETIL

SEQ ID NO: 3014051 - protein, 20 aa, Entamoeba invadens
QNPIWKLYSTQKHGLFLSGA

SEQ ID NO: 3014052 - protein, 25 aa, Entamoeba invadens
QNPTRKVTIPFELFWLFVDECNTSN

SEQ ID NO: 3014053 - protein, 24 aa, Entamoeba invadens
QNPYPQMYTTPYPSPYQTTSPHIY

SEQ ID NO: 3014054 - protein, 24 aa, Entamoeba invadens
QNQIPPAYQDAFWSSMPGLKDLVS

SEQ ID NO: 3014055 - protein, 24 aa, Entamoeba invadens
QNQPPVPLPVHTQPLPQQIEPIQY

SEQ ID NO: 3014056 - protein, 20 aa, Entamoeba invadens
QNQSICFVELLYTNYNIVDT

SEQ ID NO: 3014057 - protein, 17 aa, Entamoeba invadens
QNQTKFSLPPKLQSDMT

SEQ ID NO: 3014058 - protein, 20 aa, Entamoeba invadens
QNRAEYNPFLLFCKDHRENV

SEQ ID NO: 3014059 - protein, 24 aa, Entamoeba invadens
QNRAVEYFGKQLLKYGYNYYGSEP

SEQ ID NO: 3014060 - protein, 17 aa, Entamoeba invadens
QNRCNPHLLIYKSDYDT

SEQ ID NO: 3014061 - protein, 18 aa, Entamoeba invadens
QNRCNPHLLIYKSDYDTQ

SEQ ID NO: 3014062 - protein, 25 aa, Entamoeba invadens
QNRKYLAWVGASLLAGMSTLQDDET

SEQ ID NO: 3014063 - protein, 25 aa, Entamoeba invadens
QNRLKLHHIVPPNGLVIYCGSVYTE

SEQ ID NO: 3014064 - protein, 27 aa, Entamoeba invadens
QNSAQHILISGFYLRIFQTIELCVKNK

SEQ ID NO: 3014065 - protein, 24 aa, Entamoeba invadens
QNSHLFFTCLSTIFDIFENKVTKV

SEQ ID NO: 3014066 - protein, 31 aa, Entamoeba invadens
QNSKERESWLRTFETVRIVFQRNNPERLDEL

SEQ ID NO: 3014067 - protein, 24 aa, Entamoeba invadens
QNSLWFLTVFLREISEQNEINKMT

SEQ ID NO: 3014068 - protein, 19 aa, Entamoeba invadens
QNSNRKSLHSTLILVRHKP

SEQ ID NO: 3014069 - protein, 19 aa, Entamoeba invadens
QNSNRRSIQLKLKLVRHKP

SEQ ID NO: 3014070 - protein, 27 aa, Entamoeba invadens
QNSPQLIIGLPLDLPQKRQLQLNLRLS

SEQ ID NO: 3014071 - protein, 26 aa, Entamoeba invadens
QNSPQSKYPPPLRKLQEFPSRDQKLQ

SEQ ID NO: 3014072 - protein, 22 aa, Entamoeba invadens
QNSVPLLQLPGITIKEILKNFH

SEQ ID NO: 3014073 - protein, 24 aa, Entamoeba invadens
QNTEKFVQAYFYYDAHKSGGITVS

SEQ ID NO: 3014074 - protein, 24 aa, Entamoeba invadens
QNTEKYVQGYFYYDAHKSGGITVS

SEQ ID NO: 3014075 - protein, 17 aa, Entamoeba invadens
QNTILIANKRLQAILRD

SEQ ID NO: 3014076 - protein, 22 aa, Entamoeba invadens
QNTMSWYIPKRVVNFIFDEESQ

SEQ ID NO: 3014077 - protein, 22 aa, Entamoeba invadens
QNTNSPVFFLAATKTDLKESKY

SEQ ID NO: 3014078 - protein, 22 aa, Entamoeba invadens
QNVDFAKFPKLDMKLLAAVDEV

SEQ ID NO: 3014079 - protein, 25 aa, Entamoeba invadens
QNVFAALLATFLFHQEVKKDRDTWS

SEQ ID NO: 3014080 - protein, 24 aa, Entamoeba invadens
QNVFMKDLFRLSGSYLGKFVFAET

SEQ ID NO: 3014081 - protein, 18 aa, Entamoeba invadens
QNVFRKKALTVSDIRDVI

SEQ ID NO: 3014082 - protein, 23 aa, Entamoeba invadens
QNVIDMLFPKFGKVRIWLMKNKT

SEQ ID NO: 3014083 - protein, 17 aa, Entamoeba invadens
QNVIFCCNSVKRCPNNQ

SEQ ID NO: 3014084 - protein, 17 aa, Entamoeba invadens
QNVIFLEIYNTQNFYFC

SEQ ID NO: 3014085 - protein, 18 aa, Entamoeba invadens
QNVIPSVFGIRWIKMVFT

SEQ ID NO: 3014086 - protein, 20 aa, Entamoeba invadens
QNVLHYYNFVIFAPEDPDKV

SEQ ID NO: 3014087 - protein, 17 aa, Entamoeba invadens
QNVLINFLRIRSEIKED

SEQ ID NO: 3014088 - protein, 26 aa, Entamoeba invadens
QNVMLRPLVILVRYLLHQGGFTSVIS

SEQ ID NO: 3014089 - protein, 30 aa, Entamoeba invadens
QNVPVKTNPKLWWKYIYNVKLDEIKEKNKP

SEQ ID NO: 3014090 - protein, 23 aa, Entamoeba invadens
QNVRNLFFKVNVWYEVSYKKYVE

SEQ ID NO: 3014091 - protein, 26 aa, Entamoeba invadens
QNWTKFLQIFNLMLTKEKIGRDEYLK

SEQ ID NO: 3014092 - protein, 31 aa, Entamoeba invadens
QPALLLETIINHMSWLIKKHPKILKYKRSTS

SEQ ID NO: 3014093 - protein, 26 aa, Entamoeba invadens
QPAPPPPKILPQLPIHRATKPEQKPA

SEQ ID NO: 3014094 - protein, 20 aa, Entamoeba invadens
QPCFSIKRTFNSDVKKIDNN

SEQ ID NO: 3014095 - protein, 21 aa, Entamoeba invadens
QPDFKISNFLNYVVSLISGTP

SEQ ID NO: 3014096 - protein, 30 aa, Entamoeba invadens
QPDYDPTFIRALFESGPYKEYLKEHPEVEE

SEQ ID NO: 3014097 - protein, 20 aa, Entamoeba invadens
QPELIALLKYIRATENFEVS

SEQ ID NO: 3014098 - protein, 28 aa, Entamoeba invadens
QPENKAFIEKFISLLLRVINNKTSKMDY

SEQ ID NO: 3014099 - protein, 23 aa, Entamoeba invadens
QPETLARFAVLGLSGDMKDVKKS

SEQ ID NO: 3014100 - protein, 24 aa, Entamoeba invadens
QPETQPFIPYKYSETFLKRKAVFE

SEQ ID NO: 3014101 - protein, 28 aa, Entamoeba invadens
QPFEHTEFYFYFFKKMSSKLISFADTFP

SEQ ID NO: 3014102 - protein, 27 aa, Entamoeba invadens
QPFGGIQMIFSGDFFQLPPVSKNQNIK

SEQ ID NO: 3014103 - protein, 21 aa, Entamoeba invadens
QPFKKYYPFVAGYIALYSNDM

SEQ ID NO: 3014104 - protein, 17 aa, Entamoeba invadens
QPFKNKIALIKSFGKTL

SEQ ID NO: 3014105 - protein, 18 aa, Entamoeba invadens
QPFLPQMIEIINYCMSLK

SEQ ID NO: 3014106 - protein, 35 aa, Entamoeba invadens
QPHCDYFVLHIQKPLLSSFLSLLPSLGISYGLVLP

SEQ ID NO: 3014107 - protein, 25 aa, Entamoeba invadens
QPHSQLLYAYCNVFIRTNYNEKYTR

SEQ ID NO: 3014108 - protein, 22 aa, Entamoeba invadens
QPIDRWVSFALLMVSSSFTSQA

SEQ ID NO: 3014109 - protein, 21 aa, Entamoeba invadens
QPIEHLMSFRAMPNVVVLRPS

SEQ ID NO: 3014110 - protein, 24 aa, Entamoeba invadens
QPIITNVVDGADAYVLCCGFKNSG

SEQ ID NO: 3014111 - protein, 32 aa, Entamoeba invadens
QPIMSFIENTRPLLFVALLQNDVSLTEKYVNA

SEQ ID NO: 3014112 - protein, 17 aa, Entamoeba invadens
QPIQYTLSVKDCDTSFD

SEQ ID NO: 3014113 - protein, 27 aa, Entamoeba invadens
QPISTQLIRLFTLFQDVPAIVSKAFSV

SEQ ID NO: 3014114 - protein, 34 aa, Entamoeba invadens
QPITMIQVFPKSEILLFVTCLKLGVLTSELERIT

SEQ ID NO: 3014115 - protein, 19 aa, Entamoeba invadens
QPIVEVFIQNGLIFDVNVQ

SEQ ID NO: 3014116 - protein, 22 aa, Entamoeba invadens
QPKIEKPMINKILFIENVPKNY

SEQ ID NO: 3014117 - protein, 20 aa, Entamoeba invadens
QPKKMTGVVYLPNAIPKHIK

SEQ ID NO: 3014118 - protein, 22 aa, Entamoeba invadens
QPLDVVIFGAQKKLIRYKEVQN

SEQ ID NO: 3014119 - protein, 25 aa, Entamoeba invadens
QPNFQSFFQTWAIPTLLEVMQKPGQ

SEQ ID NO: 3014120 - protein, 27 aa, Entamoeba invadens
QPNHPVLINIFGSLFFNALKLEISPQS

SEQ ID NO: 3014121 - protein, 20 aa, Entamoeba invadens
QPNKVMIIVEGLYSMEGEFC

SEQ ID NO: 3014122 - protein, 25 aa, Entamoeba invadens
QPNRLHQFVLPIMELAVADLKQYVT

SEQ ID NO: 3014123 - protein, 27 aa, Entamoeba invadens
QPNSPFKFQYVVLKKGKRPSALLENTS

SEQ ID NO: 3014124 - protein, 27 aa, Entamoeba invadens
QPNVPTKQLPPLPPKQPAVQPQYQQPQ

SEQ ID NO: 3014125 - protein, 24 aa, Entamoeba invadens
QPNYGFLWTFYRGDDINAIVILKN

SEQ ID NO: 3014126 - protein, 20 aa, Entamoeba invadens
QPPVPVMRPSLPRITYSFTV

SEQ ID NO: 3014127 - protein, 24 aa, Entamoeba invadens
QPQDQFRFFSNKTAFKKIFECFIT

SEQ ID NO: 3014128 - protein, 19 aa, Entamoeba invadens
QPQFSLLNEYPYKDYNITL

SEQ ID NO: 3014129 - protein, 21 aa, Entamoeba invadens
QPQHSLNLTGTFNLTNPPNPN

SEQ ID NO: 3014130 - protein, 25 aa, Entamoeba invadens
QPQKVVQMPTVIPQKPFVQQSKPVI

SEQ ID NO: 3014131 - protein, 23 aa, Entamoeba invadens
QPQPNLFNMFGGMGMPQGGMPNV

SEQ ID NO: 3014132 - protein, 26 aa, Entamoeba invadens
QPQQQMYSPFGQLPFQENRTPLAQTQ

SEQ ID NO: 3014133 - protein, 20 aa, Entamoeba invadens
QPQQRFQQGGPWQNSAFAYY

SEQ ID NO: 3014134 - protein, 27 aa, Entamoeba invadens
QPQTNTMNPLFTQPATLTTTTNPLGVQ

SEQ ID NO: 3014135 - protein, 17 aa, Entamoeba invadens
QPSLFAPQPVYPQTPIK

SEQ ID NO: 3014136 - protein, 22 aa, Entamoeba invadens
QPSPHETVIWYPVEYDECNPKM

SEQ ID NO: 3014137 - protein, 26 aa, Entamoeba invadens
QPSSFPSLYEKLSLYYIGELLTYKKE

SEQ ID NO: 3014138 - protein, 22 aa, Entamoeba invadens
QPSVETLLKELFRIACGVITGY

SEQ ID NO: 3014139 - protein, 20 aa, Entamoeba invadens
QPSVLDYIRALVLIGNSNQT

SEQ ID NO: 3014140 - protein, 25 aa, Entamoeba invadens
QPTGNTLLGNLNFTNPMATTSTPSQ

SEQ ID NO: 3014141 - protein, 21 aa, Entamoeba invadens
QPTLLFIPRIVTKSERNFIQT

SEQ ID NO: 3014142 - protein, 24 aa, Entamoeba invadens
QPTQQYGVFSFDQKPVPQSVSAGV

SEQ ID NO: 3014143 - protein, 21 aa, Entamoeba invadens
QPTTCPLCHFGLVQVKNKTTT

SEQ ID NO: 3014144 - protein, 17 aa, Entamoeba invadens
QPTVNCLINITDAPYKV

SEQ ID NO: 3014145 - protein, 21 aa, Entamoeba invadens
QPTVVYPQKEAPKPNFASQIN

SEQ ID NO: 3014146 - protein, 25 aa, Entamoeba invadens
QPVKSNYLIFLITSQFFSKGVMDRL

SEQ ID NO: 3014147 - protein, 31 aa, Entamoeba invadens
QPVLFTDIHMVPFLWMQVTFSCDGCIGYYER

SEQ ID NO: 3014148 - protein, 27 aa, Entamoeba invadens
QPVQRIMRYPIILKQILKMTPKSHNDY

SEQ ID NO: 3014149 - protein, 28 aa, Entamoeba invadens
QPVQRVMRYPLLIDAIIKGTSYYNPDYG

SEQ ID NO: 3014150 - protein, 17 aa, Entamoeba invadens
QPYFRVKDYTVEDLPPY

SEQ ID NO: 3014151 - protein, 19 aa, Entamoeba invadens
QPYVVFMMSVFKRGDEAVW

SEQ ID NO: 3014152 - protein, 24 aa, Entamoeba invadens
QQAGKPLSFIVGRRIKRGRDWKWS

SEQ ID NO: 3014153 - protein, 37 aa, Entamoeba invadens
QQAKNGFYTLLFLRFLFIPFLQYPPVLKFFQSAVVQC

SEQ ID NO: 3014154 - protein, 27 aa, Entamoeba invadens
QQAKNQLFQFVPFRSQGHPNCVLIQNL

SEQ ID NO: 3014155 - protein, 17 aa, Entamoeba invadens
QQALGKLCLDWFTTSRD

SEQ ID NO: 3014156 - protein, 26 aa, Entamoeba invadens
QQALQLQHGLARQDHFLLGHFHVQLA

SEQ ID NO: 3014157 - protein, 22 aa, Entamoeba invadens
QQAQWVMYQVASAIYYLHSNGI

SEQ ID NO: 3014158 - protein, 23 aa, Entamoeba invadens
QQARYYYYLGRIQCINLKYSDAY

SEQ ID NO: 3014159 - protein, 35 aa, Entamoeba invadens
QQASLFKSMRPLFNQKPVILVLNKVDLAPIESLDA

SEQ ID NO: 3014160 - protein, 25 aa, Entamoeba invadens
QQCVKQWFFLQDTIFTSVKKACKYL

SEQ ID NO: 3014161 - protein, 18 aa, Entamoeba invadens
QQCWAAHLIGHEITTYYG

SEQ ID NO: 3014162 - protein, 17 aa, Entamoeba invadens
QQDLFSFDLIESEKNTE

SEQ ID NO: 3014163 - protein, 25 aa, Entamoeba invadens
QQDPHALLRFITTKAPSITSSFAQM

SEQ ID NO: 3014164 - protein, 24 aa, Entamoeba invadens
QQDTGLLSPRGVRIGVKRKQRTGN

SEQ ID NO: 3014165 - protein, 25 aa, Entamoeba invadens
QQEHQPMLVLKKEPSVKIKRLVPDT

SEQ ID NO: 3014166 - protein, 28 aa, Entamoeba invadens
QQEKENKECLWMVLSTEESRTVFLSAIA

SEQ ID NO: 3014167 - protein, 24 aa, Entamoeba invadens
QQEPIPPQPPLPEKTYQQPKPEVP

SEQ ID NO: 3014168 - protein, 34 aa, Entamoeba invadens
QQEQAKKSLFKIKWFLPHLFSRNRSKTEMKKAKK

SEQ ID NO: 3014169 - protein, 36 aa, Entamoeba invadens
QQERIFYMMNKMLMVFYRYPQAWIVCAQYFQRRGNI

SEQ ID NO: 3014170 - protein, 27 aa, Entamoeba invadens
QQEVRNTLHIYTFNKKGVDTEITTVKD

SEQ ID NO: 3014171 - protein, 25 aa, Entamoeba invadens
QQEYLNHALTFFSGLKALVVDSVTT

SEQ ID NO: 3014172 - protein, 18 aa, Entamoeba invadens
QQFGLNMIPILNALVKND

SEQ ID NO: 3014173 - protein, 39 aa, Entamoeba invadens
QQFPLRTHPQRRQFLPTVNRLYMRPSYVRRTDSDDDDDD

SEQ ID NO: 3014174 - protein, 27 aa, Entamoeba invadens
QQFQPVNNPYPPLPPKDVYYRAEHQPP

SEQ ID NO: 3014175 - protein, 26 aa, Entamoeba invadens
QQFVQRPMYTQQQPSLPFASHLSPDQ

SEQ ID NO: 3014176 - protein, 21 aa, Entamoeba invadens
QQGFHELLAIIYRAIDADLSE

SEQ ID NO: 3014177 - protein, 21 aa, Entamoeba invadens
QQGGFVIIDVFEKNVPKENVK

SEQ ID NO: 3014178 - protein, 24 aa, Entamoeba invadens
QQGPVPIDERLLKALLAISQGMFG

SEQ ID NO: 3014179 - protein, 17 aa, Entamoeba invadens
QQGVLIGVLNQFYDVVI

SEQ ID NO: 3014180 - protein, 18 aa, Entamoeba invadens
QQHFLQRWQFYGGEMQTA

SEQ ID NO: 3014181 - protein, 23 aa, Entamoeba invadens
QQIDDLYHRLSISSFEDFQPDLV

SEQ ID NO: 3014182 - protein, 21 aa, Entamoeba invadens
QQIEEGIFQLILMNNPNKKNK

SEQ ID NO: 3014183 - protein, 20 aa, Entamoeba invadens
QQIELKFLEKTPIVHLEVRT

SEQ ID NO: 3014184 - protein, 18 aa, Entamoeba invadens
QQIEMFAPMLYQMSQNFL

SEQ ID NO: 3014185 - protein, 26 aa, Entamoeba invadens
QQIEYKIIRGYYWTGNKSDLLSKEMA

SEQ ID NO: 3014186 - protein, 21 aa, Entamoeba invadens
QQIISMEQFFIEGRYNRVFEC

SEQ ID NO: 3014187 - protein, 18 aa, Entamoeba invadens
QQIKLPLALCNIGEEAFG

SEQ ID NO: 3014188 - protein, 19 aa, Entamoeba invadens
QQIKYQPSLFGFKMYTGEI

SEQ ID NO: 3014189 - protein, 22 aa, Entamoeba invadens
QQIQMIFTPRRDSLQQNTVSLL

SEQ ID NO: 3014190 - protein, 28 aa, Entamoeba invadens
QQIVSTKNFFLFTWKNKIFKTYERKENV

SEQ ID NO: 3014191 - protein, 19 aa, Entamoeba invadens
QQIYLSPKFDFFRINVWFE

SEQ ID NO: 3014192 - protein, 23 aa, Entamoeba invadens
QQKAWFTILSPFEKRMVIQNGYT

SEQ ID NO: 3014193 - protein, 18 aa, Entamoeba invadens
QQKAYIEHIPIVLCGNKS

SEQ ID NO: 3014194 - protein, 28 aa, Entamoeba invadens
QQKDISYFFCYKWNALLFKRFFKTEDLI

SEQ ID NO: 3014195 - protein, 17 aa, Entamoeba invadens
QQKEAFTVAPKNVWKFV

SEQ ID NO: 3014196 - protein, 27 aa, Entamoeba invadens
QQKIDFFKIVVWYPVNFRLANKHNKTY

SEQ ID NO: 3014197 - protein, 25 aa, Entamoeba invadens
QQKLKTPLCLLPPEKMPTANMFMKS

SEQ ID NO: 3014198 - protein, 20 aa, Entamoeba invadens
QQKRHVLERPSDVAFLSLDP

SEQ ID NO: 3014199 - protein, 19 aa, Entamoeba invadens
QQKSKFTPTPPLLSRPTVA

SEQ ID NO: 3014200 - protein, 35 aa, Entamoeba invadens
QQKTAAALAPPSSLPPPNAPPPVIKSGVENANAGI

SEQ ID NO: 3014201 - protein, 24 aa, Entamoeba invadens
QQLERKRHVGNDIVVLVFLEEGVK

SEQ ID NO: 3014202 - protein, 25 aa, Entamoeba invadens
QQLKQWMLTLRQLYKHINRIKNEED

SEQ ID NO: 3014203 - protein, 23 aa, Entamoeba invadens
QQLKTEFFGAKNATLLFAQKLEK

SEQ ID NO: 3014204 - protein, 24 aa, Entamoeba invadens
QQLLKNIELLKKNIYFKELFVRCN

SEQ ID NO: 3014205 - protein, 17 aa, Entamoeba invadens
QQLVVDLMMSSSFPADV

SEQ ID NO: 3014206 - protein, 18 aa, Entamoeba invadens
QQMDLMQNKCYLEALRKC

SEQ ID NO: 3014207 - protein, 17 aa, Entamoeba invadens
QQMFTLSSLCFVDNNIV

SEQ ID NO: 3014208 - protein, 17 aa, Entamoeba invadens
QQMIYFVNTKTPLVLLE

SEQ ID NO: 3014209 - protein, 22 aa, Entamoeba invadens
QQMLEKLGFICGKNGEKAGSAL

SEQ ID NO: 3014210 - protein, 23 aa, Entamoeba invadens
QQMVGPQFMPLNAPHLRQQNLVL

SEQ ID NO: 3014211 - protein, 20 aa, Entamoeba invadens
QQMYQDYPCANSSCLGFLQQ

SEQ ID NO: 3014212 - protein, 29 aa, Entamoeba invadens
QQNEIILKWLTELLYPYQLVLSSIDKMME

SEQ ID NO: 3014213 - protein, 20 aa, Entamoeba invadens
QQNIFIFAITKENAVFGCFQ

SEQ ID NO: 3014214 - protein, 23 aa, Entamoeba invadens
QQNIKVLTPPFSLPKTEPPKTQE

SEQ ID NO: 3014215 - protein, 17 aa, Entamoeba invadens
QQNINIPLEQYVKFRVD

SEQ ID NO: 3014216 - protein, 22 aa, Entamoeba invadens
QQNPLQNWLRPGQTVSVRIFEM

SEQ ID NO: 3014217 - protein, 24 aa, Entamoeba invadens
QQNVYIQPFFYNNPFVVQQQKYQK

SEQ ID NO: 3014218 - protein, 24 aa, Entamoeba invadens
QQNYPITNVPISTSLKTSFDTSQQ

SEQ ID NO: 3014219 - protein, 17 aa, Entamoeba invadens
QQPQPFDFFGNVQPQQP

SEQ ID NO: 3014220 - protein, 24 aa, Entamoeba invadens
QQPQQPICYLPYQQQPTVTQNIVP

SEQ ID NO: 3014221 - protein, 19 aa, Entamoeba invadens
QQPTSLLFLIDTTAPQQEL

SEQ ID NO: 3014222 - protein, 18 aa, Entamoeba invadens
QQPYLFTVSEYFTQQKLC

SEQ ID NO: 3014223 - protein, 26 aa, Entamoeba invadens
QQQEKQRLHLPRKSSTILIEKTKPAV

SEQ ID NO: 3014224 - protein, 28 aa, Entamoeba invadens
QQQMMTQSLPPNFISMPYVVQQQIDPLR

SEQ ID NO: 3014225 - protein, 23 aa, Entamoeba invadens
QQQQDFFSTLYTQPTQQQYQQPV

SEQ ID NO: 3014226 - protein, 17 aa, Entamoeba invadens
QQQYFLNPKSGDSELEL

SEQ ID NO: 3014227 - protein, 21 aa, Entamoeba invadens
QQRAYFKIAELYKTVLEEQKI

SEQ ID NO: 3014228 - protein, 17 aa, Entamoeba invadens
QQRLFTELSLNKFRKEQ

SEQ ID NO: 3014229 - protein, 25 aa, Entamoeba invadens
QQRMAYAPMRYEEEYYPPQQYVPIQ

SEQ ID NO: 3014230 - protein, 23 aa, Entamoeba invadens
QQRRMLSPLPRKVAVKLQPIPVR

SEQ ID NO: 3014231 - protein, 19 aa, Entamoeba invadens
QQRRPFVELILTRVKDSLK

SEQ ID NO: 3014232 - protein, 22 aa, Entamoeba invadens
QQRVVPPQGDLLPPDYHPGDPS

SEQ ID NO: 3014233 - protein, 27 aa, Entamoeba invadens
QQSVLPQSFKRFLVSKVAMLGFGDRSE

SEQ ID NO: 3014234 - protein, 18 aa, Entamoeba invadens
QQTFDRLKPLISDDHFVV

SEQ ID NO: 3014235 - protein, 25 aa, Entamoeba invadens
QQTIPEPLFILELQISAYHYEEDDV

SEQ ID NO: 3014236 - protein, 18 aa, Entamoeba invadens
QQTKPFETSFFSSKTALS

SEQ ID NO: 3014237 - protein, 18 aa, Entamoeba invadens
QQTPQPMFQTIPIPQQQS

SEQ ID NO: 3014238 - protein, 22 aa, Entamoeba invadens
QQTQFPLNWCQKSGCLGAEVQP

SEQ ID NO: 3014239 - protein, 25 aa, Entamoeba invadens
QQTSPVFTECLFTSSPNGQLVNGYC

SEQ ID NO: 3014240 - protein, 29 aa, Entamoeba invadens
QQTTTQIPLYPFFIKMNQIIGGSRDLHLS

SEQ ID NO: 3014241 - protein, 20 aa, Entamoeba invadens
QQTYQKLIKTPYPKAVDIPQ

SEQ ID NO: 3014242 - protein, 41 aa, Entamoeba invadens
QQVFQPYIQQPIIQQPFVQQPYIQQPFLQQQYIQPQLQQVQ

SEQ ID NO: 3014243 - protein, 32 aa, Entamoeba invadens
QQWDVFLSKIRSVSPSLLYFCQSRPLTKTLTS

SEQ ID NO: 3014244 - protein, 33 aa, Entamoeba invadens
QQYDTLILKEKAPFIPVFVLENRKLLLAEEIPT

SEQ ID NO: 3014245 - protein, 17 aa, Entamoeba invadens
QQYITALKFSNKEMLEN

SEQ ID NO: 3014246 - protein, 19 aa, Entamoeba invadens
QQYPGYPPQQGYGYPPQGQ

SEQ ID NO: 3014247 - protein, 24 aa, Entamoeba invadens
QRAESFVILRRKPIQGYDVSFLIT

SEQ ID NO: 3014248 - protein, 23 aa, Entamoeba invadens
QRAPYLFEIEYYTILNDVPHIVE

SEQ ID NO: 3014249 - protein, 24 aa, Entamoeba invadens
QRAYTEIINFTINYEKPIVTDLTK

SEQ ID NO: 3014250 - protein, 27 aa, Entamoeba invadens
QRDAELGEFIVLYLSFIRAGSGLSQTQ

SEQ ID NO: 3014251 - protein, 31 aa, Entamoeba invadens
QRDAKKYTYLKKPLMLSLMNVLKSKNSLVGK

SEQ ID NO: 3014252 - protein, 63 aa, Entamoeba invadens
QRDDKIMKSLEYHYFEAVWTALKMQVIEYGGSKSMLKRVAENPLFLFKKCYQENSFDRYNEWV

SEQ ID NO: 3014253 - protein, 27 aa, Entamoeba invadens
QRDKDGLLHMITQLKLDLMHKSDMDKL

SEQ ID NO: 3014254 - protein, 17 aa, Entamoeba invadens
QRDVYVEKRYKVVRTKR

SEQ ID NO: 3014255 - protein, 28 aa, Entamoeba invadens
QRDYEDFGIITSIVFDSSIWREADDLIQ

SEQ ID NO: 3014256 - protein, 28 aa, Entamoeba invadens
QREDATLFLLYAHALIDYTFYHSSYNYF

SEQ ID NO: 3014257 - protein, 30 aa, Entamoeba invadens
QREKLWRTCQFVIKMEKILYSLGVAFEFFD

SEQ ID NO: 3014258 - protein, 18 aa, Entamoeba invadens
QREKWSLVKIIDQKSYKV

SEQ ID NO: 3014259 - protein, 26 aa, Entamoeba invadens
QREMEQKIFDAELKTKSVLGDLEIVN

SEQ ID NO: 3014260 - protein, 25 aa, Entamoeba invadens
QRESRMAFLLFRKKYDTYPQSHMKR

SEQ ID NO: 3014261 - protein, 36 aa, Entamoeba invadens
QREYLWQADPKYWKRHSPVLFPIVGSLWGGKYTYEG

SEQ ID NO: 3014262 - protein, 37 aa, Entamoeba invadens
QRFQSYLIMPIQRIPRYVLLIKDMLKNAPPLSPDTDK

SEQ ID NO: 3014263 - protein, 27 aa, Entamoeba invadens
QRGGLKKRMTFVPLNKISPQVANPNQI

SEQ ID NO: 3014264 - protein, 27 aa, Entamoeba invadens
QRHIYANIFSRNILLLLSRSTMTAKYA

SEQ ID NO: 3014265 - protein, 33 aa, Entamoeba invadens
QRHMTILGHYFNRLVPVLILEIAEKFPRNLQLI

SEQ ID NO: 3014266 - protein, 18 aa, Entamoeba invadens
QRIESMAKLLFKSIESTI

SEQ ID NO: 3014267 - protein, 21 aa, Entamoeba invadens
QRIFGVDLEAILPIPKVKTYV

SEQ ID NO: 3014268 - protein, 23 aa, Entamoeba invadens
QRIPETILLWCEADIYYGFDMLM

SEQ ID NO: 3014269 - protein, 26 aa, Entamoeba invadens
QRIQKYLHMILSGVGYLHANFLLHRD

SEQ ID NO: 3014270 - protein, 41 aa, Entamoeba invadens
QRIQSYLIMPIQRIPRYVLLIKDMLKCAPPITQDTDTLVEC

SEQ ID NO: 3014271 - protein, 25 aa, Entamoeba invadens
QRIRNLVNFLLYRDWKDIIKPDYSI

SEQ ID NO: 3014272 - protein, 28 aa, Entamoeba invadens
QRIRNLVNFLLYRDWKNIIKPDYSIWEE

SEQ ID NO: 3014273 - protein, 22 aa, Entamoeba invadens
QRISFTANFLKTLPVSLAKCTD

SEQ ID NO: 3014274 - protein, 17 aa, Entamoeba invadens
QRIYDILEGLPAGNQEL

SEQ ID NO: 3014275 - protein, 29 aa, Entamoeba invadens
QRKALYTSIFLFLLKAFPKIETLQCVDYM

SEQ ID NO: 3014276 - protein, 23 aa, Entamoeba invadens
QRKELFDKYYYNERARRMVEQKY

SEQ ID NO: 3014277 - protein, 17 aa, Entamoeba invadens
QRKLKRQKALQNRLIQR

SEQ ID NO: 3014278 - protein, 24 aa, Entamoeba invadens
QRKPFDISLLYNSLTQTLLIFEGI

SEQ ID NO: 3014279 - protein, 28 aa, Entamoeba invadens
QRKPQHARLRIRKLYDRKTRHDNKVSKK

SEQ ID NO: 3014280 - protein, 20 aa, Entamoeba invadens
QRKTIYIVPYVSLGNEKAKY

SEQ ID NO: 3014281 - protein, 26 aa, Entamoeba invadens
QRKVNEKNVWTLPLIDYMNDCIEVDA

SEQ ID NO: 3014282 - protein, 20 aa, Entamoeba invadens
QRLASYFRKDPISTLQVAQE

SEQ ID NO: 3014283 - protein, 32 aa, Entamoeba invadens
QRLCHIRGQMQRKVWISVGDVVLVSLREYEED

SEQ ID NO: 3014284 - protein, 19 aa, Entamoeba invadens
QRLFICPEGYKLMTEISRG

SEQ ID NO: 3014285 - protein, 17 aa, Entamoeba invadens
QRLFKKKGKKLNKNSQK

SEQ ID NO: 3014286 - protein, 25 aa, Entamoeba invadens
QRLKWSEFFIHPFIQRCRDYKIDEI

SEQ ID NO: 3014287 - protein, 17 aa, Entamoeba invadens
QRLLFFQAAGRLLDTIS

SEQ ID NO: 3014288 - protein, 20 aa, Entamoeba invadens
QRLLPIKLTAKFVADCITYL

SEQ ID NO: 3014289 - protein, 21 aa, Entamoeba invadens
QRLVSCIKPHFSKEKTESVIK

SEQ ID NO: 3014290 - protein, 18 aa, Entamoeba invadens
QRMASVKAAFNKEKDELE

SEQ ID NO: 3014291 - protein, 20 aa, Entamoeba invadens
QRMFVFCLNLPHVNLPKPLF

SEQ ID NO: 3014292 - protein, 18 aa, Entamoeba invadens
QRMHGTLKIGLSRAGRRT

SEQ ID NO: 3014293 - protein, 19 aa, Entamoeba invadens
QRMRRGIIYGAFQSANPIL

SEQ ID NO: 3014294 - protein, 31 aa, Entamoeba invadens
QRMVYPDLSVPLLLVLLRDTLYTLNAQTVEG

SEQ ID NO: 3014295 - protein, 18 aa, Entamoeba invadens
QRMYDIVVSYITQEGLTD

SEQ ID NO: 3014296 - protein, 19 aa, Entamoeba invadens
QRNLFSLQTLQEVTLKHTI

SEQ ID NO: 3014297 - protein, 26 aa, Entamoeba invadens
QRNSLKVPILFLNFHSQLKKKASGKC

SEQ ID NO: 3014298 - protein, 23 aa, Entamoeba invadens
QRPDVFQLFIESFAPNIFGHENI

SEQ ID NO: 3014299 - protein, 24 aa, Entamoeba invadens
QRPSCAELLKMPFFDMAESSLLKK

SEQ ID NO: 3014300 - protein, 20 aa, Entamoeba invadens
QRQLMGILCANVNGGVLAVC

SEQ ID NO: 3014301 - protein, 24 aa, Entamoeba invadens
QRQLTSHKVYWRLEGRRLNVVIKW

SEQ ID NO: 3014302 - protein, 19 aa, Entamoeba invadens
QRRLEFFVMFDGTNCWYLD

SEQ ID NO: 3014303 - protein, 20 aa, Entamoeba invadens
QRRMYRRQPTQYSPQYQFPP

SEQ ID NO: 3014304 - protein, 21 aa, Entamoeba invadens
QRRQLPLLPSELSPHKRQGKT

SEQ ID NO: 3014305 - protein, 25 aa, Entamoeba invadens
QRSDPRLDHFFPVEHWPVVFIHHEG

SEQ ID NO: 3014306 - protein, 30 aa, Entamoeba invadens
QRSFLRAMCYLLSGLEKYFWTLKFEPESIE

SEQ ID NO: 3014307 - protein, 33 aa, Entamoeba invadens
QRSGQTEGFFPYRIPQQSLYARKDVNLAITESE

SEQ ID NO: 3014308 - protein, 26 aa, Entamoeba invadens
QRSSLIQICLMLSKKDVRNLRTTCKQ

SEQ ID NO: 3014309 - protein, 24 aa, Entamoeba invadens
QRTKCLFGGQRFFFYTPSNCGIEI

SEQ ID NO: 3014310 - protein, 19 aa, Entamoeba invadens
QRTKIADLLWALTSKIENP

SEQ ID NO: 3014311 - protein, 21 aa, Entamoeba invadens
QRTLQLYENKLKSLDFISPTK

SEQ ID NO: 3014312 - protein, 27 aa, Entamoeba invadens
QRTVGDNILFPFLKRKGIIEEIIPKNP

SEQ ID NO: 3014313 - protein, 21 aa, Entamoeba invadens
QRVFFTLNGNLIAGFRVYWKN

SEQ ID NO: 3014314 - protein, 29 aa, Entamoeba invadens
QRVISLMRNILLLFSIRHPASGYTQGMSD

SEQ ID NO: 3014315 - protein, 24 aa, Entamoeba invadens
QRVTRSVVKLSRSAFFLAYLVQNP

SEQ ID NO: 3014316 - protein, 21 aa, Entamoeba invadens
QRVYALLWRKYHGVEQICDEH

SEQ ID NO: 3014317 - protein, 22 aa, Entamoeba invadens
QRWEDWDVDMFLPMNYNDFHGE

SEQ ID NO: 3014318 - protein, 26 aa, Entamoeba invadens
QRWLPEVKHFCPNAPFLLAATKTDLR

SEQ ID NO: 3014319 - protein, 20 aa, Entamoeba invadens
QRYDNVWPLTLYNSGQLNIF

SEQ ID NO: 3014320 - protein, 25 aa, Entamoeba invadens
QRYNLRKKLLLLLSKADQHTLQTFL

SEQ ID NO: 3014321 - protein, 19 aa, Entamoeba invadens
QRYQDNLPPLSPPQQQSLP

SEQ ID NO: 3014322 - protein, 18 aa, Entamoeba invadens
QRYVVCDFLIDDPALRMY

SEQ ID NO: 3014323 - protein, 27 aa, Entamoeba invadens
QSAALQFIQLFTKLCNHPLLVRDYLVE

SEQ ID NO: 3014324 - protein, 25 aa, Entamoeba invadens
QSAETLYGLVHARYILTLDGMKKMR

SEQ ID NO: 3014325 - protein, 26 aa, Entamoeba invadens
QSAGRRQYIFITPQNLDGVNSTDTVK

SEQ ID NO: 3014326 - protein, 33 aa, Entamoeba invadens
QSALASTYLLMKLPFNYFFDLMAVSMEPIAVEN

SEQ ID NO: 3014327 - protein, 17 aa, Entamoeba invadens
QSAYIYPEPLSLCGNSN

SEQ ID NO: 3014328 - protein, 26 aa, Entamoeba invadens
QSCQQAVYIALLSSFFDITIKPPMKK

SEQ ID NO: 3014329 - protein, 28 aa, Entamoeba invadens
QSCVTSIKFIAPLGALITSSLDGTIMLT

SEQ ID NO: 3014330 - protein, 21 aa, Entamoeba invadens
QSDALRYLRRIRCWELRHLPR

SEQ ID NO: 3014331 - protein, 23 aa, Entamoeba invadens
QSDALYILGVMYFKGENVCEDKQ

SEQ ID NO: 3014332 - protein, 23 aa, Entamoeba invadens
QSDLECVLLALLSSKYKFTIAKP

SEQ ID NO: 3014333 - protein, 28 aa, Entamoeba invadens
QSDLQTIILIFFILKKLADITIYSCYRT

SEQ ID NO: 3014334 - protein, 26 aa, Entamoeba invadens
QSDLRLFIEKHIDFLKKSFQCVSLDL

SEQ ID NO: 3014335 - protein, 24 aa, Entamoeba invadens
QSDNLLSLLKPLSESFRGGSKMAN

SEQ ID NO: 3014336 - protein, 29 aa, Entamoeba invadens
QSDPSYYVYMYYFYSNITSLNLLRMAKGL

SEQ ID NO: 3014337 - protein, 33 aa, Entamoeba invadens
QSDVYSYGIILWELVYRLIYQKYQRPFQEFPEL

SEQ ID NO: 3014338 - protein, 26 aa, Entamoeba invadens
QSEDFSLTYVFRLLTNVINQSQIYAR

SEQ ID NO: 3014339 - protein, 25 aa, Entamoeba invadens
QSEEKIVGYFKRLELKRENVKENED

SEQ ID NO: 3014340 - protein, 40 aa, Entamoeba invadens
QSEKSSILYKAPISLKKYKLIKKYLRFDDGAYLREIARIE

SEQ ID NO: 3014341 - protein, 19 aa, Entamoeba invadens
QSELDMLCKWSNKQTLHVL

SEQ ID NO: 3014342 - protein, 27 aa, Entamoeba invadens
QSELKDLRRTSRWLDKVKTMRDYKTAS

SEQ ID NO: 3014343 - protein, 27 aa, Entamoeba invadens
QSELLIQWQTLFESALPKIRRYDCVFS

SEQ ID NO: 3014344 - protein, 24 aa, Entamoeba invadens
QSELYKQIGIDPPRGCLLYGPPGT

SEQ ID NO: 3014345 - protein, 25 aa, Entamoeba invadens
QSELYNMRFFKTFPENYVVKNIYSD

SEQ ID NO: 3014346 - protein, 25 aa, Entamoeba invadens
QSERKTFFATLPFLDKGKLCGDGEY

SEQ ID NO: 3014347 - protein, 24 aa, Entamoeba invadens
QSETRWLQTVLILNNMFENLPSLQ

SEQ ID NO: 3014348 - protein, 30 aa, Entamoeba invadens
QSETSDTFFFFPFINVLVQPITVAVESSFI

SEQ ID NO: 3014349 - protein, 21 aa, Entamoeba invadens
QSEVFKMTRIIRGEVVKCVQV

SEQ ID NO: 3014350 - protein, 24 aa, Entamoeba invadens
QSEVYEYFRVCSTNQGYYIQAGLN

SEQ ID NO: 3014351 - protein, 22 aa, Entamoeba invadens
QSFFDVNIYKDVLHVLLGKSQE

SEQ ID NO: 3014352 - protein, 25 aa, Entamoeba invadens
QSFGLPEYVLIDKFVYTAHALDVVE

SEQ ID NO: 3014353 - protein, 18 aa, Entamoeba invadens
QSFIFDAVIGKIEGFYPV

SEQ ID NO: 3014354 - protein, 33 aa, Entamoeba invadens
QSFLSLNDYIVTYPPLKLHTLTHKLTLATLPPN

SEQ ID NO: 3014355 - protein, 20 aa, Entamoeba invadens
QSFMPNNRLPKSAFNKLIED

SEQ ID NO: 3014356 - protein, 21 aa, Entamoeba invadens
QSFNCPICYKPLPVSEIVVDR

SEQ ID NO: 3014357 - protein, 23 aa, Entamoeba invadens
QSFNEAWLNILLGCMGESVDFTD

SEQ ID NO: 3014358 - protein, 23 aa, Entamoeba invadens
QSFQHFFFFCREFKMLSKDDIAP

SEQ ID NO: 3014359 - protein, 25 aa, Entamoeba invadens
QSFQKELFVFNWIDTIRGKVEFIMS

SEQ ID NO: 3014360 - protein, 25 aa, Entamoeba invadens
QSFYLKGSFKFFGYLEIEIKNGSKS

SEQ ID NO: 3014361 - protein, 25 aa, Entamoeba invadens
QSGCTIILTRGGFVVGYFDSPNTSE

SEQ ID NO: 3014362 - protein, 21 aa, Entamoeba invadens
QSGITTFYLPAISYSLTSAIQ

SEQ ID NO: 3014363 - protein, 19 aa, Entamoeba invadens
QSGLFHISTVDIPIIEKVV

SEQ ID NO: 3014364 - protein, 21 aa, Entamoeba invadens
QSGLFHVSTVDVPIIEKVVMN

SEQ ID NO: 3014365 - protein, 27 aa, Entamoeba invadens
QSGQPQKFLILPNQKLPLNLPDPFGKK

SEQ ID NO: 3014366 - protein, 29 aa, Entamoeba invadens
QSGSNFYEVFIRFFLERLKSGFQSSMEKM

SEQ ID NO: 3014367 - protein, 36 aa, Entamoeba invadens
QSHIPQQMPPFNPQMYPYPPMPLSVPTTQQTVTMMP

SEQ ID NO: 3014368 - protein, 25 aa, Entamoeba invadens
QSIDCTLPVFWSRATNFKEMLKILV

SEQ ID NO: 3014369 - protein, 22 aa, Entamoeba invadens
QSIFLIVKYDPDFKIRNAFFII

SEQ ID NO: 3014370 - protein, 18 aa, Entamoeba invadens
QSIGFAPFTDYYAVGGGQ

SEQ ID NO: 3014371 - protein, 22 aa, Entamoeba invadens
QSIKIISKLAFWEYNKIVEIDI

SEQ ID NO: 3014372 - protein, 22 aa, Entamoeba invadens
QSIKVVVTHPVFFDQKQRDLTE

SEQ ID NO: 3014373 - protein, 19 aa, Entamoeba invadens
QSILHEKYKKEMTLREAEV

SEQ ID NO: 3014374 - protein, 34 aa, Entamoeba invadens
QSIPIQKIVTLFPKLETLYLPYEVDYNLSFLENL

SEQ ID NO: 3014375 - protein, 26 aa, Entamoeba invadens
QSIPKSILLLTLKVAASLMAVASQSK

SEQ ID NO: 3014376 - protein, 21 aa, Entamoeba invadens
QSISLMMNIPTNSWKRLEVLK

SEQ ID NO: 3014377 - protein, 24 aa, Entamoeba invadens
QSITALAHLSCCVLYLMDVSANCG

SEQ ID NO: 3014378 - protein, 26 aa, Entamoeba invadens
QSKKTPLKVLYFDVAIQFSKTYQYRI

SEQ ID NO: 3014379 - protein, 25 aa, Entamoeba invadens
QSKPRPTVTVTLYLFPEVNPKQEKM

SEQ ID NO: 3014380 - protein, 22 aa, Entamoeba invadens
QSLAAFYFGFEYPPVSRLGATT

SEQ ID NO: 3014381 - protein, 23 aa, Entamoeba invadens
QSLDILLNCYLKPISRGKYAKIV

SEQ ID NO: 3014382 - protein, 21 aa, Entamoeba invadens
QSLGITFWLSMTNYADYSKDG

SEQ ID NO: 3014383 - protein, 19 aa, Entamoeba invadens
QSLIFGLQNDREWHSFCAH

SEQ ID NO: 3014384 - protein, 20 aa, Entamoeba invadens
QSLKLYDLNYKNFNFVAGCE

SEQ ID NO: 3014385 - protein, 20 aa, Entamoeba invadens
QSLLELLDTFDTNDVVGTTQ

SEQ ID NO: 3014386 - protein, 22 aa, Entamoeba invadens
QSLLEMIVMHLPSPVVAQKYRT

SEQ ID NO: 3014387 - protein, 18 aa, Entamoeba invadens
QSLLIALLTKHCKITIGR

SEQ ID NO: 3014388 - protein, 21 aa, Entamoeba invadens
QSLMPCLFAIEGVHHIIVCGG

SEQ ID NO: 3014389 - protein, 17 aa, Entamoeba invadens
QSLNEEIKRLMSSYQNE

SEQ ID NO: 3014390 - protein, 23 aa, Entamoeba invadens
QSLNSLFPGLKNLFCECVEKCTN

SEQ ID NO: 3014391 - protein, 33 aa, Entamoeba invadens
QSLNYENSYALYYKQFFLGIKYSMGAPDDTIPV

SEQ ID NO: 3014392 - protein, 17 aa, Entamoeba invadens
QSLPAYIRQSALYFINT

SEQ ID NO: 3014393 - protein, 22 aa, Entamoeba invadens
QSLQPSLFEAWAKKQGGSVKSW

SEQ ID NO: 3014394 - protein, 17 aa, Entamoeba invadens
QSLYFWKTDVWLNVTLD

SEQ ID NO: 3014395 - protein, 26 aa, Entamoeba invadens
QSMLHFIQGLLQYDPDLRWTARQALD

SEQ ID NO: 3014396 - protein, 21 aa, Entamoeba invadens
QSMLNRWKLMQSGTFVDNRQT

SEQ ID NO: 3014397 - protein, 21 aa, Entamoeba invadens
QSMLWKFEKRVPYTPLIPSVN

SEQ ID NO: 3014398 - protein, 20 aa, Entamoeba invadens
QSPLFKALPQNPSGLESKKP

SEQ ID NO: 3014399 - protein, 20 aa, Entamoeba invadens
QSPLLYSNLCFIRDFDKGIS

SEQ ID NO: 3014400 - protein, 22 aa, Entamoeba invadens
QSPSLLNEALSWHQRYVETGSM

SEQ ID NO: 3014401 - protein, 23 aa, Entamoeba invadens
QSQIPRFSGLIPFLDGNTQPPPN

SEQ ID NO: 3014402 - protein, 25 aa, Entamoeba invadens
QSQLFLHLIALFKNEPSVSVIRSVS

SEQ ID NO: 3014403 - protein, 17 aa, Entamoeba invadens
QSQYLKFGFHGLSYEFV

SEQ ID NO: 3014404 - protein, 20 aa, Entamoeba invadens
QSRDFVTIDLFIKTTKENIA

SEQ ID NO: 3014405 - protein, 25 aa, Entamoeba invadens
QSRITFYKINVWFAVDYTFTQTHKT

SEQ ID NO: 3014406 - protein, 22 aa, Entamoeba invadens
QSSFLVVIVSHTVSLESCSVDC

SEQ ID NO: 3014407 - protein, 24 aa, Entamoeba invadens
QSSIKWWMRFYSLLEHVNDLKSSE

SEQ ID NO: 3014408 - protein, 23 aa, Entamoeba invadens
QSSLDGYQTCIFAYGQTGSGKTY

SEQ ID NO: 3014409 - protein, 42 aa, Entamoeba invadens
QSSNGRVLLIGKEKHYFFMNYKPILIRNIPNHITKAAIDKTG

SEQ ID NO: 3014410 - protein, 20 aa, Entamoeba invadens
QSSQMLIQLLQNLEIVESIN

SEQ ID NO: 3014411 - protein, 20 aa, Entamoeba invadens
QSTALFAPIAVDAVMKVIDI

SEQ ID NO: 3014412 - protein, 28 aa, Entamoeba invadens
QSTHWKQTLFFLKYPLKMEMGDRIGGIY

SEQ ID NO: 3014413 - protein, 21 aa, Entamoeba invadens
QSTLQQPPPAPQPPQQLKQKA

SEQ ID NO: 3014414 - protein, 37 aa, Entamoeba invadens
QSTLQSILKNFFNLYKLLAYIPQFKDSIAGLKNAPLI

SEQ ID NO: 3014415 - protein, 26 aa, Entamoeba invadens
QSTSLRLRRRIVLSNLLMKDKTDLTK

SEQ ID NO: 3014416 - protein, 27 aa, Entamoeba invadens
QSTTNTFLLLQRLCGIYKSFCNTCTQY

SEQ ID NO: 3014417 - protein, 23 aa, Entamoeba invadens
QSTTPLFKYYRMNSLVTTQFPGI

SEQ ID NO: 3014418 - protein, 33 aa, Entamoeba invadens
QSVESDSILLLDTFFYLVVFRGEAVVDWMKQKL

SEQ ID NO: 3014419 - protein, 17 aa, Entamoeba invadens
QSVIRRNLFSRHFENVV

SEQ ID NO: 3014420 - protein, 21 aa, Entamoeba invadens
QSVKLVDHVLLIGGGAKNRIL

SEQ ID NO: 3014421 - protein, 24 aa, Entamoeba invadens
QSVKPIVMYWALRVTGVLLCSTAD

SEQ ID NO: 3014422 - protein, 25 aa, Entamoeba invadens
QSVNTIMFCFFNNPRLTFACLIKMS

SEQ ID NO: 3014423 - protein, 26 aa, Entamoeba invadens
QSVPIQLQVLNFLKSFFTLPNIAEEL

SEQ ID NO: 3014424 - protein, 21 aa, Entamoeba invadens
QSVVIAKDFLMKMSFSFDSDF

SEQ ID NO: 3014425 - protein, 20 aa, Entamoeba invadens
QSVYGLVRNGVAFGCKLGTY

SEQ ID NO: 3014426 - protein, 24 aa, Entamoeba invadens
QTAEKLKIVLLQKSFDSYIAEIHR

SEQ ID NO: 3014427 - protein, 24 aa, Entamoeba invadens
QTAFLHYLSILLYKNEYTFFEEDE

SEQ ID NO: 3014428 - protein, 26 aa, Entamoeba invadens
QTAIRSLLISPWYNQKLDVLFSKRET

SEQ ID NO: 3014429 - protein, 23 aa, Entamoeba invadens
QTALYPRLIYLNEFEKILTNEEC

SEQ ID NO: 3014430 - protein, 33 aa, Entamoeba invadens
QTANPPIFPPTLYKAIFLFFRDIVSVNEVFLQS

SEQ ID NO: 3014431 - protein, 19 aa, Entamoeba invadens
QTAWGVFFSRLEKSIKKCS

SEQ ID NO: 3014432 - protein, 17 aa, Entamoeba invadens
QTCFAGCEKLMKVSLAV

SEQ ID NO: 3014433 - protein, 19 aa, Entamoeba invadens
QTCKQVRFFFETFKQLRCG

SEQ ID NO: 3014434 - protein, 23 aa, Entamoeba invadens
QTCTVFSTQKFHLPPLASSHSTT

SEQ ID NO: 3014435 - protein, 26 aa, Entamoeba invadens
QTDIQNILGGYWIVLDELNLAPSEVL

SEQ ID NO: 3014436 - protein, 24 aa, Entamoeba invadens
QTDSLTDFIILQTALNYVSNTSKQ

SEQ ID NO: 3014437 - protein, 25 aa, Entamoeba invadens
QTDTHQQMLFEYPKYINTDNTVTRE

SEQ ID NO: 3014438 - protein, 30 aa, Entamoeba invadens
QTEDVICLGLLYGLIMRLIKYENIHKMSLK

SEQ ID NO: 3014439 - protein, 20 aa, Entamoeba invadens
QTEFKWIYNILDGVSEQENV

SEQ ID NO: 3014440 - protein, 38 aa, Entamoeba invadens
QTELRTPIALILLFPNPFVFIVQFIPKWFKALTDCGVP

SEQ ID NO: 3014441 - protein, 24 aa, Entamoeba invadens
QTENPIVVFLLMDTTAKVFSDVKK

SEQ ID NO: 3014442 - protein, 28 aa, Entamoeba invadens
QTEQQGVFIALLNMFYDVTIEHPRKKSK

SEQ ID NO: 3014443 - protein, 23 aa, Entamoeba invadens
QTEQQIHFGILLVEAICATTDNQ

SEQ ID NO: 3014444 - protein, 28 aa, Entamoeba invadens
QTESESEILIFFEGFVVLNVFVDGMKEQ

SEQ ID NO: 3014445 - protein, 22 aa, Entamoeba invadens
QTFAQVTNLLTDSLRLIEDVTD

SEQ ID NO: 3014446 - protein, 25 aa, Entamoeba invadens
QTFFAAFNMKLFPRIMIYFNQEDNE

SEQ ID NO: 3014447 - protein, 18 aa, Entamoeba invadens
QTFFLEYNTQLTPEEVSL

SEQ ID NO: 3014448 - protein, 24 aa, Entamoeba invadens
QTFGKKYIYLKRWDKPLLSEVKRS

SEQ ID NO: 3014449 - protein, 22 aa, Entamoeba invadens
QTFLQFVLKLLQAPETFITIRK

SEQ ID NO: 3014450 - protein, 20 aa, Entamoeba invadens
QTGEVLMRFMWEGDAPSTQP

SEQ ID NO: 3014451 - protein, 22 aa, Entamoeba invadens
QTGRLVIIPKIVFTPSDKTLSF

SEQ ID NO: 3014452 - protein, 17 aa, Entamoeba invadens
QTHNTFFSTFPCVKRNT

SEQ ID NO: 3014453 - protein, 29 aa, Entamoeba invadens
QTHPKELDEFLLFEKFKLFTAQLKQNEVD

SEQ ID NO: 3014454 - protein, 18 aa, Entamoeba invadens
QTHYKYFPFEPQVDDDKI

SEQ ID NO: 3014455 - protein, 22 aa, Entamoeba invadens
QTIAILSAYPELRPVLIVVPNI

SEQ ID NO: 3014456 - protein, 21 aa, Entamoeba invadens
QTICPFLSKREILHFIVFGKT

SEQ ID NO: 3014457 - protein, 20 aa, Entamoeba invadens
QTIEFVDLILQKLGQNVTKS

SEQ ID NO: 3014458 - protein, 20 aa, Entamoeba invadens
QTIFPKIQTLFISGLFAQLK

SEQ ID NO: 3014459 - protein, 21 aa, Entamoeba invadens
QTIFRHVPFTVEFSASPLWLS

SEQ ID NO: 3014460 - protein, 18 aa, Entamoeba invadens
QTIIKQFITIIDQKKRSS

SEQ ID NO: 3014461 - protein, 20 aa, Entamoeba invadens
QTIRNIAYKGGSKDNICVVV

SEQ ID NO: 3014462 - protein, 24 aa, Entamoeba invadens
QTIWKPIVTVVTTISLLLVEMHGE

SEQ ID NO: 3014463 - protein, 25 aa, Entamoeba invadens
QTKEPTPLPKRTGIKDRLAFFEKMS

SEQ ID NO: 3014464 - protein, 21 aa, Entamoeba invadens
QTKFERVFAPKSLIKIYTDFE

SEQ ID NO: 3014465 - protein, 22 aa, Entamoeba invadens
QTKIRVCIHFEISFATKLQLEK

SEQ ID NO: 3014466 - protein, 31 aa, Entamoeba invadens
QTKRVHLFISEMMIYLLLGQLRITTIEENER

SEQ ID NO: 3014467 - protein, 21 aa, Entamoeba invadens
QTKSPSFKRPSPPPPKQDQIK

SEQ ID NO: 3014468 - protein, 44 aa, Entamoeba invadens
QTLETFIEVILYFNTKSLPFIPQILAIYLKLFKTCLPGVRPALI

SEQ ID NO: 3014469 - protein, 17 aa, Entamoeba invadens
QTLFNVAYYFKRESLVN

SEQ ID NO: 3014470 - protein, 18 aa, Entamoeba invadens
QTLGDLSARCSVALPTGG

SEQ ID NO: 3014471 - protein, 17 aa, Entamoeba invadens
QTLIRPHIKGMSSSLCS

SEQ ID NO: 3014472 - protein, 32 aa, Entamoeba invadens
QTLKDVFLTSHRIWLWIVNMPQIIHALNVMPP

SEQ ID NO: 3014473 - protein, 25 aa, Entamoeba invadens
QTLKTKWFPPKVRKLRILWNEIDTV

SEQ ID NO: 3014474 - protein, 17 aa, Entamoeba invadens
QTLLDGALMCLHRLLLK

SEQ ID NO: 3014475 - protein, 24 aa, Entamoeba invadens
QTLNLFAAPIFTIEYPIVNICAKS

SEQ ID NO: 3014476 - protein, 19 aa, Entamoeba invadens
QTLPVVPFGSNAEIIDCCV

SEQ ID NO: 3014477 - protein, 17 aa, Entamoeba invadens
QTLSRFFIFSSCTQRHI

SEQ ID NO: 3014478 - protein, 27 aa, Entamoeba invadens
QTLVLSCEPKWIHLKRLTLKNCGITKI

SEQ ID NO: 3014479 - protein, 19 aa, Entamoeba invadens
QTLYIFCDVPIKQSIGNYY

SEQ ID NO: 3014480 - protein, 24 aa, Entamoeba invadens
QTMQQSILIGLLNRYCEITIAQPA

SEQ ID NO: 3014481 - protein, 21 aa, Entamoeba invadens
QTMRVLIRFYESQPEFRFAEF

SEQ ID NO: 3014482 - protein, 20 aa, Entamoeba invadens
QTMSFHYMWNSFFVDETKKG

SEQ ID NO: 3014483 - protein, 19 aa, Entamoeba invadens
QTMTSWLESLFNTIEELKK

SEQ ID NO: 3014484 - protein, 20 aa, Entamoeba invadens
QTNARLLMYGSQSMGLAMSS

SEQ ID NO: 3014485 - protein, 18 aa, Entamoeba invadens
QTNKYDGPIKFYVTLLDT

SEQ ID NO: 3014486 - protein, 17 aa, Entamoeba invadens
QTNPIHLKLQPGQMTVG

SEQ ID NO: 3014487 - protein, 24 aa, Entamoeba invadens
QTNVRYLPPTLLLLQPGREMVDST

SEQ ID NO: 3014488 - protein, 19 aa, Entamoeba invadens
QTPALPFDIETNCKPKEGL

SEQ ID NO: 3014489 - protein, 26 aa, Entamoeba invadens
QTPDYLQLRMLFWKIAKREGIQFDGQ

SEQ ID NO: 3014490 - protein, 26 aa, Entamoeba invadens
QTPDYLQLRMLFWKIAKREGIVFDGK

SEQ ID NO: 3014491 - protein, 27 aa, Entamoeba invadens
QTPDYLQLRMLFWKIAKREIIVFDGKF

SEQ ID NO: 3014492 - protein, 17 aa, Entamoeba invadens
QTPFRTHKRNASAIPKG

SEQ ID NO: 3014493 - protein, 21 aa, Entamoeba invadens
QTPTHLFYIIDYCSGGEFYFY

SEQ ID NO: 3014494 - protein, 24 aa, Entamoeba invadens
QTPTHLVFVLDYCAGGELFSYLQK

SEQ ID NO: 3014495 - protein, 26 aa, Entamoeba invadens
QTPTKKFFRVVIWFQVSYKTTQEIQD

SEQ ID NO: 3014496 - protein, 24 aa, Entamoeba invadens
QTQAPPTIIQVPGAPATAAPPPVI

SEQ ID NO: 3014497 - protein, 24 aa, Entamoeba invadens
QTQLLTLCFILSKQASITSNPFFK

SEQ ID NO: 3014498 - protein, 23 aa, Entamoeba invadens
QTRILRFSLAWLCNVDQTTNQLI

SEQ ID NO: 3014499 - protein, 19 aa, Entamoeba invadens
QTSFFNLPHNESAYMKIAV

SEQ ID NO: 3014500 - protein, 32 aa, Entamoeba invadens
QTSFPFHMEQLLFEYFNFGKVVLCNRPLMCLI

SEQ ID NO: 3014501 - protein, 17 aa, Entamoeba invadens
QTSLFLTGTLIDGSRID

SEQ ID NO: 3014502 - protein, 22 aa, Entamoeba invadens
QTSPLKRTVTLADLTRIDGNEQ

SEQ ID NO: 3014503 - protein, 26 aa, Entamoeba invadens
QTSVLYGPRGLLNFLNKNDLICVVRA

SEQ ID NO: 3014504 - protein, 27 aa, Entamoeba invadens
QTSVMFGLRGLLTFLNKNDLICLVRAH

SEQ ID NO: 3014505 - protein, 21 aa, Entamoeba invadens
QTTFNNYRNWMMRFVNGEINV

SEQ ID NO: 3014506 - protein, 25 aa, Entamoeba invadens
QTTKKQIFTLLTNSSGFLLLYTLQL

SEQ ID NO: 3014507 - protein, 29 aa, Entamoeba invadens
QTTKVILTLDIILAFLERTKYSYDKKGES

SEQ ID NO: 3014508 - protein, 25 aa, Entamoeba invadens
QTTPNTLSLLQKISSFKTLNKGAGV

SEQ ID NO: 3014509 - protein, 32 aa, Entamoeba invadens
QTTTSTLTIVLGFLWQFIDKVFEKSLKRAIGS

SEQ ID NO: 3014510 - protein, 27 aa, Entamoeba invadens
QTVAAFYQIRCIPTFYFFSNGIKMSQF

SEQ ID NO: 3014511 - protein, 23 aa, Entamoeba invadens
QTVDFIYFILIQNPIKEDVIHHL

SEQ ID NO: 3014512 - protein, 24 aa, Entamoeba invadens
QTVENIFYSSFLIKEGSATLKNKK

SEQ ID NO: 3014513 - protein, 20 aa, Entamoeba invadens
QTVFTPVTLPPQFANLSLQT

SEQ ID NO: 3014514 - protein, 22 aa, Entamoeba invadens
QTVKMYLPETVSLNGTIYDQNT

SEQ ID NO: 3014515 - protein, 18 aa, Entamoeba invadens
QTVRYVPPVAKAGPRRMP

SEQ ID NO: 3014516 - protein, 18 aa, Entamoeba invadens
QTVTLRGFKHFYAFSRQY

SEQ ID NO: 3014517 - protein, 20 aa, Entamoeba invadens
QTYCTSCQSGYYLDSTNKCQ

SEQ ID NO: 3014518 - protein, 22 aa, Entamoeba invadens
QTYQQPNYSLPLGTPQYQPPIY

SEQ ID NO: 3014519 - protein, 22 aa, Entamoeba invadens
QTYTYDYFLSKLESKYNLFNVS

SEQ ID NO: 3014520 - protein, 20 aa, Entamoeba invadens
QTYTYDYFLSKLESKYNMFN

SEQ ID NO: 3014521 - protein, 19 aa, Entamoeba invadens
QVASLIHRAPSADIPFQTV

SEQ ID NO: 3014522 - protein, 22 aa, Entamoeba invadens
QVAVKPFLFNNVHALTIFVKSN

SEQ ID NO: 3014523 - protein, 18 aa, Entamoeba invadens
QVCPICKKAIPINEMDKH

SEQ ID NO: 3014524 - protein, 23 aa, Entamoeba invadens
QVCQQSVFLLIISKYASVELNKP

SEQ ID NO: 3014525 - protein, 18 aa, Entamoeba invadens
QVDEIIFTIYDNEKPKTF

SEQ ID NO: 3014526 - protein, 24 aa, Entamoeba invadens
QVDELKSWKFRITKEFVFNLDVEL

SEQ ID NO: 3014527 - protein, 23 aa, Entamoeba invadens
QVDGHTVLFNIPPQFRPEECVVD

SEQ ID NO: 3014528 - protein, 17 aa, Entamoeba invadens
QVDKINPFWWTHQRHDG

SEQ ID NO: 3014529 - protein, 27 aa, Entamoeba invadens
QVDMWSVGVMLYVSLCGYLPFDGETLA

SEQ ID NO: 3014530 - protein, 25 aa, Entamoeba invadens
QVEDEYYFPATFKDFAFEKTKNESA

SEQ ID NO: 3014531 - protein, 22 aa, Entamoeba invadens
QVEDMIMMMAQQGQMTGQINEG

SEQ ID NO: 3014532 - protein, 19 aa, Entamoeba invadens
QVEFALTLIRLSSEEQKGV

SEQ ID NO: 3014533 - protein, 26 aa, Entamoeba invadens
QVEGKKFTFPFPTKALYDYTAETDDE

SEQ ID NO: 3014534 - protein, 28 aa, Entamoeba invadens
QVEIMLSEFYDLPLTRKGWIEEFNVFMG

SEQ ID NO: 3014535 - protein, 18 aa, Entamoeba invadens
QVEIQPYLLRRVKQNVEK

SEQ ID NO: 3014536 - protein, 24 aa, Entamoeba invadens
QVEKYPINPLKATKAFYLYENDYD

SEQ ID NO: 3014537 - protein, 25 aa, Entamoeba invadens
QVESKDMFLFVLSGRIVQPTSFRRN

SEQ ID NO: 3014538 - protein, 20 aa, Entamoeba invadens
QVESLFYDYFPVLCEILKST

SEQ ID NO: 3014539 - protein, 24 aa, Entamoeba invadens
QVFFNGTFFMSLSQMAQRGKALCN

SEQ ID NO: 3014540 - protein, 27 aa, Entamoeba invadens
QVFIDKVLTKQYYLRRIILTNDNGTKT

SEQ ID NO: 3014541 - protein, 17 aa, Entamoeba invadens
QVFSFYRCLKTLTQKTS

SEQ ID NO: 3014542 - protein, 18 aa, Entamoeba invadens
QVFVLYITKISATLRKDI

SEQ ID NO: 3014543 - protein, 19 aa, Entamoeba invadens
QVFWYKYFEYLFNSEDKPT

SEQ ID NO: 3014544 - protein, 22 aa, Entamoeba invadens
QVGGEWCFIPYNTIIEQIKKEV

SEQ ID NO: 3014545 - protein, 33 aa, Entamoeba invadens
QVGKKLMKMVDTIFPLLYITGVVEHFHLAKVFR

SEQ ID NO: 3014546 - protein, 21 aa, Entamoeba invadens
QVGVVFLNETGEKIKPCFICG

SEQ ID NO: 3014547 - protein, 25 aa, Entamoeba invadens
QVHANNIIFFLVKNSTLTSSVQSND

SEQ ID NO: 3014548 - protein, 34 aa, Entamoeba invadens
QVHGGTLLYSPAITVPINCTLFLKKKEGYDEKGM

SEQ ID NO: 3014549 - protein, 19 aa, Entamoeba invadens
QVIAFSLGKYRIFGETIDI

SEQ ID NO: 3014550 - protein, 20 aa, Entamoeba invadens
QVIDLLFKSMLGPHNENVIV

SEQ ID NO: 3014551 - protein, 25 aa, Entamoeba invadens
QVIDSPLSMNLFASLPPRDPKNLQE

SEQ ID NO: 3014552 - protein, 18 aa, Entamoeba invadens
QVILNDAFKCAHIQEIAI

SEQ ID NO: 3014553 - protein, 21 aa, Entamoeba invadens
QVILRESMTPKKSFKSAAAKA

SEQ ID NO: 3014554 - protein, 17 aa, Entamoeba invadens
QVITLFPAKGSFDEITT

SEQ ID NO: 3014555 - protein, 32 aa, Entamoeba invadens
QVKEQLSMATPDIPSILKLLDDTLDCADGEDS

SEQ ID NO: 3014556 - protein, 17 aa, Entamoeba invadens
QVKGNVSAFKNKFAQYA

SEQ ID NO: 3014557 - protein, 18 aa, Entamoeba invadens
QVKKITTPIIFISSTACN

SEQ ID NO: 3014558 - protein, 24 aa, Entamoeba invadens
QVKSWKKRWFVFSTNGNMSYYTNR

SEQ ID NO: 3014559 - protein, 23 aa, Entamoeba invadens
QVKYEFCQRIVSSKILETITQNM

SEQ ID NO: 3014560 - protein, 32 aa, Entamoeba invadens
QVLEQLLIQPVQRVMRYPILISELIKTTPNKH

SEQ ID NO: 3014561 - protein, 34 aa, Entamoeba invadens
QVLEVITLRTETAPIPMYAPISSVPEIEPAALIP

SEQ ID NO: 3014562 - protein, 28 aa, Entamoeba invadens
QVLKLRSEIQWYFRKYYHDNKFTEIQPP

SEQ ID NO: 3014563 - protein, 31 aa, Entamoeba invadens
QVLLPKSDVFMAFYFHYTKFIYFTVKESDEF

SEQ ID NO: 3014564 - protein, 25 aa, Entamoeba invadens
QVLNFDGFLFDRMLCDVPCSGDGTI

SEQ ID NO: 3014565 - protein, 21 aa, Entamoeba invadens
QVLTLKRVFKIKEEEKYVFDE

SEQ ID NO: 3014566 - protein, 28 aa, Entamoeba invadens
QVLYQETIAPVLAYFDITPDSIIVESGT

SEQ ID NO: 3014567 - protein, 25 aa, Entamoeba invadens
QVMVRALEQLYYLNALDSKTDLTDV

SEQ ID NO: 3014568 - protein, 31 aa, Entamoeba invadens
QVNLEHFGFLIRLFGKFYKKKTLFAKMLKMC

SEQ ID NO: 3014569 - protein, 17 aa, Entamoeba invadens
QVNLFQLNPPQIPAWEV

SEQ ID NO: 3014570 - protein, 20 aa, Entamoeba invadens
QVNPFLLFASDIEKYYQHFK

SEQ ID NO: 3014571 - protein, 21 aa, Entamoeba invadens
QVPDGFKQSLLPTNQKYTKEQ

SEQ ID NO: 3014572 - protein, 23 aa, Entamoeba invadens
QVPQMYPPMPDICGMDYSQQMQF

SEQ ID NO: 3014573 - protein, 17 aa, Entamoeba invadens
QVQAGIVSLPLYTTIAN

SEQ ID NO: 3014574 - protein, 18 aa, Entamoeba invadens
QVQFVQFVATLVTLSDKG

SEQ ID NO: 3014575 - protein, 28 aa, Entamoeba invadens
QVQQEATFYWVLPRILDKTQFQFVSNKL

SEQ ID NO: 3014576 - protein, 18 aa, Entamoeba invadens
QVQQPIINVAQPNTKSIP

SEQ ID NO: 3014577 - protein, 25 aa, Entamoeba invadens
QVQVLLKPIARFEAVLEIPSLIQKV

SEQ ID NO: 3014578 - protein, 20 aa, Entamoeba invadens
QVRFFFETFKQLRCGLELNL

SEQ ID NO: 3014579 - protein, 17 aa, Entamoeba invadens
QVRGYKKIGLCLYDDVI

SEQ ID NO: 3014580 - protein, 18 aa, Entamoeba invadens
QVRRAISIIVVLNANGEV

SEQ ID NO: 3014581 - protein, 21 aa, Entamoeba invadens
QVRVPYIQFVKNTSGVVIMIE

SEQ ID NO: 3014582 - protein, 18 aa, Entamoeba invadens
QVSEIFKQKVWEVNIKLS

SEQ ID NO: 3014583 - protein, 21 aa, Entamoeba invadens
QVSKYLSLEMKKALMNSSHFA

SEQ ID NO: 3014584 - protein, 18 aa, Entamoeba invadens
QVSPFLKEQFKQFVFFTV

SEQ ID NO: 3014585 - protein, 35 aa, Entamoeba invadens
QVSQPPLQPPIDMLPPPLAPPPLTTTTQTLPSSNA

SEQ ID NO: 3014586 - protein, 18 aa, Entamoeba invadens
QVSTADGFLIVYSITDRK

SEQ ID NO: 3014587 - protein, 17 aa, Entamoeba invadens
QVTFEVGYFKKGNGSCV

SEQ ID NO: 3014588 - protein, 25 aa, Entamoeba invadens
QVTLNRFVFLMSVFGKFYKKKEVLM

SEQ ID NO: 3014589 - protein, 18 aa, Entamoeba invadens
QVTQFRICQMQRVIRGFL

SEQ ID NO: 3014590 - protein, 25 aa, Entamoeba invadens
QVTSLPTFVFFQDQKVAKKAPGSPD

SEQ ID NO: 3014591 - protein, 24 aa, Entamoeba invadens
QVVDIPVILPLPVDVKRNSYSIIF

SEQ ID NO: 3014592 - protein, 28 aa, Entamoeba invadens
QVVERKKFIVILLSILFAIEDCSTNEIT

SEQ ID NO: 3014593 - protein, 23 aa, Entamoeba invadens
QVVHFFEDLLFEEGFLVMYKKFN

SEQ ID NO: 3014594 - protein, 25 aa, Entamoeba invadens
QVVLKEKNLLRKQKFVYLILDEAHS

SEQ ID NO: 3014595 - protein, 27 aa, Entamoeba invadens
QVVPLLQMCVKRKRPLIIIADTIDGDA

SEQ ID NO: 3014596 - protein, 30 aa, Entamoeba invadens
QVVREKVLPFGRRFYVAIPLRGKCVQCIVS

SEQ ID NO: 3014597 - protein, 24 aa, Entamoeba invadens
QVVRNIIVLLMRHLNERNLELRKL

SEQ ID NO: 3014598 - protein, 23 aa, Entamoeba invadens
QVVVKEFLIFILSQKNEDLSPII

SEQ ID NO: 3014599 - protein, 18 aa, Entamoeba invadens
QVYEAAVLLYLINKHFNI

SEQ ID NO: 3014600 - protein, 25 aa, Entamoeba invadens
QVYESMVLLFLINNHYNISLRFPNK

SEQ ID NO: 3014601 - protein, 18 aa, Entamoeba invadens
QVYGFYDESIRKYKSFNV

SEQ ID NO: 3014602 - protein, 21 aa, Entamoeba invadens
QVYGTKRFLKMKNSLYEVAPC

SEQ ID NO: 3014603 - protein, 20 aa, Entamoeba invadens
QVYNTFLLTIDIISKLQPTT

SEQ ID NO: 3014604 - protein, 21 aa, Entamoeba invadens
QWCDPYLIVKYTEGGVAKSFK

SEQ ID NO: 3014605 - protein, 37 aa, Entamoeba invadens
QWEVKTSFILEFVDATKIAFDLLLKNKDQASPNFLNV

SEQ ID NO: 3014606 - protein, 20 aa, Entamoeba invadens
QWFCEQSFITKLLNVFLETP

SEQ ID NO: 3014607 - protein, 22 aa, Entamoeba invadens
QWFVSHFRPDTFRFNNYPFIIL

SEQ ID NO: 3014608 - protein, 21 aa, Entamoeba invadens
QWILMQAAFSIMAVVLKSGGS

SEQ ID NO: 3014609 - protein, 28 aa, Entamoeba invadens
QWNDEITIYLMLTYKKWQLYDRKKIALN

SEQ ID NO: 3014610 - protein, 19 aa, Entamoeba invadens
QWPKGCYVGYWNGTKISPE

SEQ ID NO: 3014611 - protein, 33 aa, Entamoeba invadens
QWRFPNSFVQMVPLRNWIFYTKAENSMKVKRVA

SEQ ID NO: 3014612 - protein, 17 aa, Entamoeba invadens
QWTVPPMFNGDTQYFIS

SEQ ID NO: 3014613 - protein, 29 aa, Entamoeba invadens
QYACVMKNVPIAIFLIKNGASLFLRDSMG

SEQ ID NO: 3014614 - protein, 27 aa, Entamoeba invadens
QYAHKMWMTFLHLIGSPLMSNNSHVFD

SEQ ID NO: 3014615 - protein, 26 aa, Entamoeba invadens
QYATLYDMIEYLRTPVLGSSTFLIDK

SEQ ID NO: 3014616 - protein, 18 aa, Entamoeba invadens
QYATSIPISGETVKFELV

SEQ ID NO: 3014617 - protein, 30 aa, Entamoeba invadens
QYDEEGKHWMGKGTPILALADLNKEMQENV

SEQ ID NO: 3014618 - protein, 22 aa, Entamoeba invadens
QYDLIISKILTDPLYKVQRDWS

SEQ ID NO: 3014619 - protein, 19 aa, Entamoeba invadens
QYDLTMWESFKALHQKVNS

SEQ ID NO: 3014620 - protein, 28 aa, Entamoeba invadens
QYDTENFKYWHSWALVNFEVVSYIENDE

SEQ ID NO: 3014621 - protein, 32 aa, Entamoeba invadens
QYDTLILKEKAPFIPVFVLENRKLLLAEEIPT

SEQ ID NO: 3014622 - protein, 17 aa, Entamoeba invadens
QYDVPKGIFFSMPVVCC

SEQ ID NO: 3014623 - protein, 22 aa, Entamoeba invadens
QYELLVSFLESLLSLPESKQLY

SEQ ID NO: 3014624 - protein, 26 aa, Entamoeba invadens
QYEPEVFPVLVFRTTQPKVTLLVFST

SEQ ID NO: 3014625 - protein, 26 aa, Entamoeba invadens
QYFSKISGWLELLSSLLVCVKMAVGL

SEQ ID NO: 3014626 - protein, 26 aa, Entamoeba invadens
QYFSKTSGWLELLYTLLISTKMAVGL

SEQ ID NO: 3014627 - protein, 27 aa, Entamoeba invadens
QYGLELYVMLMCYKVLHPNRLTLLRGM

SEQ ID NO: 3014628 - protein, 22 aa, Entamoeba invadens
QYGVLTVLKIIRKCTEIDLFEF

SEQ ID NO: 3014629 - protein, 21 aa, Entamoeba invadens
QYHHDNVDFVFGKWSWCCPLL

SEQ ID NO: 3014630 - protein, 17 aa, Entamoeba invadens
QYHIVSFQAGHAHNAIP

SEQ ID NO: 3014631 - protein, 23 aa, Entamoeba invadens
QYHLVTVFILIVQTKSIPLLDEN

SEQ ID NO: 3014632 - protein, 20 aa, Entamoeba invadens
QYIDFLKCWSSLTLKHKGAA

SEQ ID NO: 3014633 - protein, 18 aa, Entamoeba invadens
QYIEMLTFIIKESDFIFG

SEQ ID NO: 3014634 - protein, 17 aa, Entamoeba invadens
QYIKCGSCFIIIYSIDS

SEQ ID NO: 3014635 - protein, 21 aa, Entamoeba invadens
QYITLYSIDVNGLTQKCQYSN

SEQ ID NO: 3014636 - protein, 21 aa, Entamoeba invadens
QYKIFHFNTGFIFFSKDEHNM

SEQ ID NO: 3014637 - protein, 24 aa, Entamoeba invadens
QYKKPAQWLVGKSVIRGRDWKWED

SEQ ID NO: 3014638 - protein, 23 aa, Entamoeba invadens
QYKSGVPCFWLHVLKNSEIFEDL

SEQ ID NO: 3014639 - protein, 23 aa, Entamoeba invadens
QYKVLEQRLLLLNKRHIDMDRFH

SEQ ID NO: 3014640 - protein, 29 aa, Entamoeba invadens
QYLDSYNASFYWKTPLRKTPRETPRQRAE

SEQ ID NO: 3014641 - protein, 18 aa, Entamoeba invadens
QYLHCDPSVKYDPLNPCQ

SEQ ID NO: 3014642 - protein, 23 aa, Entamoeba invadens
QYLTTLDLPYGPTKIGYGAFENI

SEQ ID NO: 3014643 - protein, 19 aa, Entamoeba invadens
QYMRTGDGYVIVYSITSIT

SEQ ID NO: 3014644 - protein, 22 aa, Entamoeba invadens
QYMTELATEFILFISSEVADVS

SEQ ID NO: 3014645 - protein, 31 aa, Entamoeba invadens
QYNLGTFFSAFPEPLAIIQRKSRHVKIAEDL

SEQ ID NO: 3014646 - protein, 19 aa, Entamoeba invadens
QYQAIRLLHILKRSDRISL

SEQ ID NO: 3014647 - protein, 27 aa, Entamoeba invadens
QYQQQLPFMQLYPYQPHFYNLPNQHIG

SEQ ID NO: 3014648 - protein, 20 aa, Entamoeba invadens
QYQQYYYIDPLSGQYTFFCL

SEQ ID NO: 3014649 - protein, 25 aa, Entamoeba invadens
QYQVLGHRQNGIPMGLRSIITDPQQ

SEQ ID NO: 3014650 - protein, 23 aa, Entamoeba invadens
QYQYYLGFYDGNPANLNPLSPVK

SEQ ID NO: 3014651 - protein, 35 aa, Entamoeba invadens
QYRNVKFYCTILTDLFDFDFIPTGVLQNSFYNVFV

SEQ ID NO: 3014652 - protein, 29 aa, Entamoeba invadens
QYSKIYSSRLTLLRPLLEVLIEKKYEGMS

SEQ ID NO: 3014653 - protein, 18 aa, Entamoeba invadens
QYSKLAGYNLRLTQRRDK

SEQ ID NO: 3014654 - protein, 18 aa, Entamoeba invadens
QYSPIFFQFLDCVHILMN

SEQ ID NO: 3014655 - protein, 18 aa, Entamoeba invadens
QYSSLLKMKVVVVRKIRE

SEQ ID NO: 3014656 - protein, 25 aa, Entamoeba invadens
QYTKNDILVFVYSVTEKYAFSRMKE

SEQ ID NO: 3014657 - protein, 26 aa, Entamoeba invadens
QYTKPVSWILLKRVAQGRDWSYSRKD

SEQ ID NO: 3014658 - protein, 18 aa, Entamoeba invadens
QYTKSFEFTARSDAKLSY

SEQ ID NO: 3014659 - protein, 18 aa, Entamoeba invadens
QYTLTRRREIWTDEEHSK

SEQ ID NO: 3014660 - protein, 18 aa, Entamoeba invadens
QYTTPFVSLGTFGGLGSV

SEQ ID NO: 3014661 - protein, 23 aa, Entamoeba invadens
QYVKKYDPKTPPIYNLYAVSNHS

SEQ ID NO: 3014662 - protein, 24 aa, Entamoeba invadens
RAAAIRSLYKMYLMSDKDVQPIIK

SEQ ID NO: 3014663 - protein, 20 aa, Entamoeba invadens
RAACYSYLENFELASRDCEK

SEQ ID NO: 3014664 - protein, 17 aa, Entamoeba invadens
RAAHFFKLSVPPRSIFV

SEQ ID NO: 3014665 - protein, 24 aa, Entamoeba invadens
RAANIVIPLIYNCNYYISLSQNKY

SEQ ID NO: 3014666 - protein, 29 aa, Entamoeba invadens
RACHEKLRKYLIDLLNTWTGSFPQEIVNG

SEQ ID NO: 3014667 - protein, 24 aa, Entamoeba invadens
RACMEYKLKLPRLSKIFLTSDDYS

SEQ ID NO: 3014668 - protein, 31 aa, Entamoeba invadens
RADILTVLFSPFKLLSLFAAQLAELNAFLVE

SEQ ID NO: 3014669 - protein, 26 aa, Entamoeba invadens
RADLLRGIVWKGYVAVVLVQCGINDM

SEQ ID NO: 3014670 - protein, 25 aa, Entamoeba invadens
RADNDFLIKLLQLIKKHPVLALWKQ

SEQ ID NO: 3014671 - protein, 25 aa, Entamoeba invadens
RAEEERLRQIELQKIREKEQLARYR

SEQ ID NO: 3014672 - protein, 21 aa, Entamoeba invadens
RAEFTILLLQQSDTQTTDKPI

SEQ ID NO: 3014673 - protein, 25 aa, Entamoeba invadens
RAEHERILLMKKKFTDLGALQTWLN

SEQ ID NO: 3014674 - protein, 24 aa, Entamoeba invadens
RAEKFSVFLGLRLLKTEDVLTEAF

SEQ ID NO: 3014675 - protein, 25 aa, Entamoeba invadens
RAELLKNWYIPPDKKLKVFYISKMR

SEQ ID NO: 3014676 - protein, 24 aa, Entamoeba invadens
RAELYHIIFALKHMAKTFPVPQWL

SEQ ID NO: 3014677 - protein, 17 aa, Entamoeba invadens
RAEMQIGLKKFLVENKY

SEQ ID NO: 3014678 - protein, 28 aa, Entamoeba invadens
RAESIANWFEIYSWWKNNIEAQEFTDVV

SEQ ID NO: 3014679 - protein, 24 aa, Entamoeba invadens
RAESMKFPWYSAVSYFKAAFVSEN

SEQ ID NO: 3014680 - protein, 21 aa, Entamoeba invadens
RAETQLIKGKYEKDIAEITVK

SEQ ID NO: 3014681 - protein, 18 aa, Entamoeba invadens
RAFDIIMTTPFGTSYNSF

SEQ ID NO: 3014682 - protein, 17 aa, Entamoeba invadens
RAFKFPTMGKKARLICI

SEQ ID NO: 3014683 - protein, 27 aa, Entamoeba invadens
RAFVCSKRGFLRCFIPNEVTKIKDYSE

SEQ ID NO: 3014684 - protein, 18 aa, Entamoeba invadens
RAHFNSLVPVEIARAYRT

SEQ ID NO: 3014685 - protein, 26 aa, Entamoeba invadens
RAHPDYHILYFQQKPPDPRLPKPLFA

SEQ ID NO: 3014686 - protein, 21 aa, Entamoeba invadens
RAIFFTFQYHGIDSESLVLCS

SEQ ID NO: 3014687 - protein, 17 aa, Entamoeba invadens
RAIFLKQGELETANKVL

SEQ ID NO: 3014688 - protein, 19 aa, Entamoeba invadens
RAIGEAGFGLYLRNVRNTI

SEQ ID NO: 3014689 - protein, 17 aa, Entamoeba invadens
RAIPFFESIGEELEIIT

SEQ ID NO: 3014690 - protein, 18 aa, Entamoeba invadens
RAIPYDREFLKDKYLLDA

SEQ ID NO: 3014691 - protein, 21 aa, Entamoeba invadens
RAIQIIKMFDTPEQFAKVMHV

SEQ ID NO: 3014692 - protein, 23 aa, Entamoeba invadens
RAIYRPQVNMPPLDFKKTTPLQT

SEQ ID NO: 3014693 - protein, 23 aa, Entamoeba invadens
RAKGRFPVLSWVGPKNQCLVRSS

SEQ ID NO: 3014694 - protein, 32 aa, Entamoeba invadens
RAKKYDDIILILQTTHLLLKMFEKFSGTENTI

SEQ ID NO: 3014695 - protein, 19 aa, Entamoeba invadens
RAKLLIHQTMRLSMPHVVI

SEQ ID NO: 3014696 - protein, 18 aa, Entamoeba invadens
RAKMDNKYYANIIKKFFL

SEQ ID NO: 3014697 - protein, 19 aa, Entamoeba invadens
RAKPPLVPFAGIMTKEFLV

SEQ ID NO: 3014698 - protein, 21 aa, Entamoeba invadens
RAKRFVLFSSVLKNPQFEILM

SEQ ID NO: 3014699 - protein, 20 aa, Entamoeba invadens
RAKRIRFISKFAVGVQTIPI

SEQ ID NO: 3014700 - protein, 18 aa, Entamoeba invadens
RAKRLAIRQNQLEAIASI

SEQ ID NO: 3014701 - protein, 31 aa, Entamoeba invadens
RAKVVDRDYKLLLPKDMAVLRVGPEADLPPV

SEQ ID NO: 3014702 - protein, 17 aa, Entamoeba invadens
RAKYFEELPAMSEYAQL

SEQ ID NO: 3014703 - protein, 17 aa, Entamoeba invadens
RALALDLRRKRDKLRFD

SEQ ID NO: 3014704 - protein, 24 aa, Entamoeba invadens
RALDSLFEGLFWVLLKNSQDNEIT

SEQ ID NO: 3014705 - protein, 22 aa, Entamoeba invadens
RALEFLIVFMKNLKDSVIPSCL

SEQ ID NO: 3014706 - protein, 18 aa, Entamoeba invadens
RALIRCFTTLNLQSHLLV

SEQ ID NO: 3014707 - protein, 25 aa, Entamoeba invadens
RALKPFDEDGLIPVFGFGAKKEGAN

SEQ ID NO: 3014708 - protein, 17 aa, Entamoeba invadens
RALRKTPHKFLPEEPAR

SEQ ID NO: 3014709 - protein, 31 aa, Entamoeba invadens
RALRTLVKTLTFLEKLPPSAHLLFPNYILPT

SEQ ID NO: 3014710 - protein, 17 aa, Entamoeba invadens
RAMSYSKEFSRLGLTAQ

SEQ ID NO: 3014711 - protein, 18 aa, Entamoeba invadens
RANFPEMANCELHMVFYL

SEQ ID NO: 3014712 - protein, 31 aa, Entamoeba invadens
RANPTTMLLGFNSLVFRKILDLLDVESKKAL

SEQ ID NO: 3014713 - protein, 17 aa, Entamoeba invadens
RAPALAEQLKRSGPFGG

SEQ ID NO: 3014714 - protein, 27 aa, Entamoeba invadens
RAPEIILGLPYTCAIDMWSFGCIIAEM

SEQ ID NO: 3014715 - protein, 21 aa, Entamoeba invadens
RAPHDPWRAFKCSCGGIIFPE

SEQ ID NO: 3014716 - protein, 25 aa, Entamoeba invadens
RAPSFKIVTKDLLTFQFCTLTESEK

SEQ ID NO: 3014717 - protein, 17 aa, Entamoeba invadens
RAQHIFEIALKLIPHAQ

SEQ ID NO: 3014718 - protein, 26 aa, Entamoeba invadens
RAQYQLYLGFYDGNPANLNPLTPVKL

SEQ ID NO: 3014719 - protein, 26 aa, Entamoeba invadens
RAQYQMYLGFYDGNPANLNPLTPVKL

SEQ ID NO: 3014720 - protein, 22 aa, Entamoeba invadens
RARDSMFEMFQKFTMKEKKEEK

SEQ ID NO: 3014721 - protein, 26 aa, Entamoeba invadens
RARDSVYEIFQRFLIKKEKKEEKLIN

SEQ ID NO: 3014722 - protein, 17 aa, Entamoeba invadens
RARIISAIKYWIENVWN

SEQ ID NO: 3014723 - protein, 23 aa, Entamoeba invadens
RARKPAMYRGTPPTFTSTLRCVQ

SEQ ID NO: 3014724 - protein, 20 aa, Entamoeba invadens
RARKYYYIVMECCQCSLMEY

SEQ ID NO: 3014725 - protein, 21 aa, Entamoeba invadens
RARSVFSLPAQLRNAAQNRDD

SEQ ID NO: 3014726 - protein, 17 aa, Entamoeba invadens
RARVVSALKYWIENIWN

SEQ ID NO: 3014727 - protein, 19 aa, Entamoeba invadens
RARVVSILSYWANTIFPLL

SEQ ID NO: 3014728 - protein, 30 aa, Entamoeba invadens
RASKELFIDILLPDEPLLFFIENDFTKANT

SEQ ID NO: 3014729 - protein, 22 aa, Entamoeba invadens
RASLRTDWFRGKKLTYRQTQLE

SEQ ID NO: 3014730 - protein, 17 aa, Entamoeba invadens
RATETARYIAAEQKQPF

SEQ ID NO: 3014731 - protein, 18 aa, Entamoeba invadens
RATLKRGGVFKFPEIGMS

SEQ ID NO: 3014732 - protein, 21 aa, Entamoeba invadens
RATMLDFGFNSTVSASIVNFT

SEQ ID NO: 3014733 - protein, 17 aa, Entamoeba invadens
RATRKRGRKPVKRTSGI

SEQ ID NO: 3014734 - protein, 23 aa, Entamoeba invadens
RATRNRYYSLVHKKKVVSCFTPV

SEQ ID NO: 3014735 - protein, 23 aa, Entamoeba invadens
RATTLFCATIFREFKDKNGRLYT

SEQ ID NO: 3014736 - protein, 24 aa, Entamoeba invadens
RAVDELLSKLSFPKKFLLEKDTQR

SEQ ID NO: 3014737 - protein, 17 aa, Entamoeba invadens
RAVGWFYSVVGGDETVE

SEQ ID NO: 3014738 - protein, 26 aa, Entamoeba invadens
RAVLDKKFFMKNGTYNLSLISASLEI

SEQ ID NO: 3014739 - protein, 24 aa, Entamoeba invadens
RAVSDLIPYIMQIALKKLCSEEID

SEQ ID NO: 3014740 - protein, 44 aa, Entamoeba invadens
RAVVQVDSLFIKKLIDFLPPLPKLDLKNFKPPKLFFAIDKSELE

SEQ ID NO: 3014741 - protein, 17 aa, Entamoeba invadens
RAVYEIAKTCDLLMVIL

SEQ ID NO: 3014742 - protein, 21 aa, Entamoeba invadens
RAVYIFGFHVMRCLFLDPHTV

SEQ ID NO: 3014743 - protein, 17 aa, Entamoeba invadens
RAYFEKLINVALEALMT

SEQ ID NO: 3014744 - protein, 18 aa, Entamoeba invadens
RAYFPIIDYTEYTSDYNS

SEQ ID NO: 3014745 - protein, 21 aa, Entamoeba invadens
RAYIAYFDGILRFSKDDTALD

SEQ ID NO: 3014746 - protein, 22 aa, Entamoeba invadens
RAYIAYFDGILRFSKDDTALDD

SEQ ID NO: 3014747 - protein, 26 aa, Entamoeba invadens
RAYKKVLTLLDLRSTLIEWKSYYINV

SEQ ID NO: 3014748 - protein, 18 aa, Entamoeba invadens
RCCAEAKALPWYNKLIGG

SEQ ID NO: 3014749 - protein, 18 aa, Entamoeba invadens
RCCKACFFNNFIPGYDCK

SEQ ID NO: 3014750 - protein, 26 aa, Entamoeba invadens
RCCKSLKRIVLPLNLREIPYCCFAGC

SEQ ID NO: 3014751 - protein, 18 aa, Entamoeba invadens
RCDELWTLFTTYLSSMPE

SEQ ID NO: 3014752 - protein, 19 aa, Entamoeba invadens
RCDKTHFSTTLPTLQCTEC

SEQ ID NO: 3014753 - protein, 25 aa, Entamoeba invadens
RCDSLLQIYFGGCVIKKVLFPPSVK

SEQ ID NO: 3014754 - protein, 18 aa, Entamoeba invadens
RCDTLTKVFIPNGITAVG

SEQ ID NO: 3014755 - protein, 24 aa, Entamoeba invadens
RCDYIVHFYGAVFFPNKICMVTEF

SEQ ID NO: 3014756 - protein, 29 aa, Entamoeba invadens
RCEAINDCMNVLINSWKKAGESAFVEKME

SEQ ID NO: 3014757 - protein, 18 aa, Entamoeba invadens
RCEICNIGLYSRSGVCFS

SEQ ID NO: 3014758 - protein, 34 aa, Entamoeba invadens
RCEIKLLQQIPFINFFGLIKFYDSMMSEQCYTQW

SEQ ID NO: 3014759 - protein, 18 aa, Entamoeba invadens
RCEKCASGLILKNWACKP

SEQ ID NO: 3014760 - protein, 23 aa, Entamoeba invadens
RCELCREGFVFDASNKCKENSIA

SEQ ID NO: 3014761 - protein, 22 aa, Entamoeba invadens
RCESVLTFLEYQRKVIAEEERI

SEQ ID NO: 3014762 - protein, 17 aa, Entamoeba invadens
RCFADETPLINRSVFIP

SEQ ID NO: 3014763 - protein, 17 aa, Entamoeba invadens
RCFNFIDAIFEDGGAVL

SEQ ID NO: 3014764 - protein, 18 aa, Entamoeba invadens
RCFVKYLKRLRDANENFM

SEQ ID NO: 3014765 - protein, 17 aa, Entamoeba invadens
RCGNLSSLAIPLSVISF

SEQ ID NO: 3014766 - protein, 21 aa, Entamoeba invadens
RCIGYRLFCGQVLEDYKWLSY

SEQ ID NO: 3014767 - protein, 19 aa, Entamoeba invadens
RCKITFLKWVVPEVALKEL

SEQ ID NO: 3014768 - protein, 17 aa, Entamoeba invadens
RCKLLSEKYLTEVKQVN

SEQ ID NO: 3014769 - protein, 18 aa, Entamoeba invadens
RCLKLSEKMLPLPDKTLF

SEQ ID NO: 3014770 - protein, 18 aa, Entamoeba invadens
RCLRARCHEGIVRDYRVN

SEQ ID NO: 3014771 - protein, 18 aa, Entamoeba invadens
RCLRRPDNDFFGYRRLEN

SEQ ID NO: 3014772 - protein, 40 aa, Entamoeba invadens
RCLTTLFELKQFPVIVLRDNPVIFLLRTHRDILRKEYEIA

SEQ ID NO: 3014773 - protein, 22 aa, Entamoeba invadens
RCMSCFDGYYRSSYSCFACTEG

SEQ ID NO: 3014774 - protein, 18 aa, Entamoeba invadens
RCNGTLAAFAIKKGVEVI

SEQ ID NO: 3014775 - protein, 17 aa, Entamoeba invadens
RCPEALFQPSFLVMEAS

SEQ ID NO: 3014776 - protein, 23 aa, Entamoeba invadens
RCPKALQNLTQLSKFKILREIAV

SEQ ID NO: 3014777 - protein, 20 aa, Entamoeba invadens
RCPQLRYEYNLYKILMENGE

SEQ ID NO: 3014778 - protein, 20 aa, Entamoeba invadens
RCPVLDSMDFFKNTTKAKFE

SEQ ID NO: 3014779 - protein, 17 aa, Entamoeba invadens
RCRLITLTSKENQIYDF

SEQ ID NO: 3014780 - protein, 20 aa, Entamoeba invadens
RCSFNCEYQIIVKPTIGENP

SEQ ID NO: 3014781 - protein, 45 aa, Entamoeba invadens
RCTKCELNYYTQPDPPYLCERDCPIGYLNIYGVCTKCVDNCLDCD

SEQ ID NO: 3014782 - protein, 18 aa, Entamoeba invadens
RCVNIIALQTFFNGLQNY

SEQ ID NO: 3014783 - protein, 25 aa, Entamoeba invadens
RDAAQQGFLISVLALNGFEVKMNKL

SEQ ID NO: 3014784 - protein, 32 aa, Entamoeba invadens
RDAAQQSFLIGWLGYLGYHVRVNRLYKKGKTT

SEQ ID NO: 3014785 - protein, 27 aa, Entamoeba invadens
RDAAQQSFLLALFVSHGFDIKLKKLYK

SEQ ID NO: 3014786 - protein, 24 aa, Entamoeba invadens
RDACWKYIEILSQIWSKAQIHLNF

SEQ ID NO: 3014787 - protein, 29 aa, Entamoeba invadens
RDAELGEFIVLYLSFMSAGSGLFQTQIED

SEQ ID NO: 3014788 - protein, 27 aa, Entamoeba invadens
RDAELGEFIVLYLSFMSAGSGLSQMQI

SEQ ID NO: 3014789 - protein, 30 aa, Entamoeba invadens
RDAISSRKYWHFIKLMGRSASHIALEASLQ

SEQ ID NO: 3014790 - protein, 31 aa, Entamoeba invadens
RDAQMCWINKTLFLVFSDFRKVMEIHNCFDK

SEQ ID NO: 3014791 - protein, 21 aa, Entamoeba invadens
RDAVFTFNYAYVYDPISENIV

SEQ ID NO: 3014792 - protein, 29 aa, Entamoeba invadens
RDAVSDLALHFLSKLKIMVVKDIEMKDVE

SEQ ID NO: 3014793 - protein, 25 aa, Entamoeba invadens
RDAWRQLYYAVYNMPTRHFDTPFMK

SEQ ID NO: 3014794 - protein, 18 aa, Entamoeba invadens
RDCLALKEFSIPNGVTKV

SEQ ID NO: 3014795 - protein, 25 aa, Entamoeba invadens
RDCSKLLYIVLSSSLLHIAANAFER

SEQ ID NO: 3014796 - protein, 20 aa, Entamoeba invadens
RDCSSLSNVVLPLILTSLGS

SEQ ID NO: 3014797 - protein, 27 aa, Entamoeba invadens
RDDADRFHIPMEQPVLLRLPEEEAAVL

SEQ ID NO: 3014798 - protein, 23 aa, Entamoeba invadens
RDDIDYLTNYIKFIVPALEDLED

SEQ ID NO: 3014799 - protein, 19 aa, Entamoeba invadens
RDDLAIVFALFSVDPENFK

SEQ ID NO: 3014800 - protein, 24 aa, Entamoeba invadens
RDDPKHFVFSLSSPFLETPTQFMG

SEQ ID NO: 3014801 - protein, 18 aa, Entamoeba invadens
RDEELRIVELEDISENLV

SEQ ID NO: 3014802 - protein, 24 aa, Entamoeba invadens
RDEIKEFYRPYTSPSVPHDSQRES

SEQ ID NO: 3014803 - protein, 24 aa, Entamoeba invadens
RDELMGGARYYIIQAKVGEIIELH

SEQ ID NO: 3014804 - protein, 24 aa, Entamoeba invadens
RDERKVYAIFHKTPKEIWITHSTS

SEQ ID NO: 3014805 - protein, 24 aa, Entamoeba invadens
RDERLLSCFSAFWVFKDGNVIINP

SEQ ID NO: 3014806 - protein, 17 aa, Entamoeba invadens
RDEVFAVGFVKWSDSII

SEQ ID NO: 3014807 - protein, 20 aa, Entamoeba invadens
RDFDSSFMKILDMSPRTSYN

SEQ ID NO: 3014808 - protein, 18 aa, Entamoeba invadens
RDFIINYVDHIVTVMDLK

SEQ ID NO: 3014809 - protein, 34 aa, Entamoeba invadens
RDFLQEFSIGEITLLEDVPLITIITPSYSESKKI

SEQ ID NO: 3014810 - protein, 22 aa, Entamoeba invadens
RDFTDYFKVFFSDEMKDIIIES

SEQ ID NO: 3014811 - protein, 18 aa, Entamoeba invadens
RDFVFRRVVICDNTVLSS

SEQ ID NO: 3014812 - protein, 17 aa, Entamoeba invadens
RDFVHFRRITGPEGLEK

SEQ ID NO: 3014813 - protein, 19 aa, Entamoeba invadens
RDFYNTIVLCGGSSLFPGM

SEQ ID NO: 3014814 - protein, 32 aa, Entamoeba invadens
RDGEPADCILFYSYRDKFVYERFLMEDQKKNN

SEQ ID NO: 3014815 - protein, 30 aa, Entamoeba invadens
RDGIPFCEKFTTLSLLPSFAPNPAHGDFSR

SEQ ID NO: 3014816 - protein, 19 aa, Entamoeba invadens
RDGKFLDFVGYVVSFATNF

SEQ ID NO: 3014817 - protein, 24 aa, Entamoeba invadens
RDGKGFVLCIDDKLKNRFGCVITE

SEQ ID NO: 3014818 - protein, 31 aa, Entamoeba invadens
RDGSLKLQLQDLYVSLFLKTVQYSMEKVNGM

SEQ ID NO: 3014819 - protein, 23 aa, Entamoeba invadens
RDGTGFILVYSIIDEKSFEEVAT

SEQ ID NO: 3014820 - protein, 20 aa, Entamoeba invadens
RDGWELRLYFGEKVSTGFSR

SEQ ID NO: 3014821 - protein, 23 aa, Entamoeba invadens
RDIEVIQPIPWLQSEDLNESLER

SEQ ID NO: 3014822 - protein, 18 aa, Entamoeba invadens
RDIKLDNFLVSQTDPFLF

SEQ ID NO: 3014823 - protein, 19 aa, Entamoeba invadens
RDIKLENFLIVDHTPYPLV

SEQ ID NO: 3014824 - protein, 24 aa, Entamoeba invadens
RDIKPDNFLVFSFDLNDKANAKLT

SEQ ID NO: 3014825 - protein, 22 aa, Entamoeba invadens
RDIKPDNILIFSFNVNEKANAK

SEQ ID NO: 3014826 - protein, 25 aa, Entamoeba invadens
RDIKPDNILVFRLNLNNKANAKLTD

SEQ ID NO: 3014827 - protein, 23 aa, Entamoeba invadens
RDIKPDNILVFSFNLNDKANAKL

SEQ ID NO: 3014828 - protein, 24 aa, Entamoeba invadens
RDIKPDNILVFSFNLNDKANAKLT

SEQ ID NO: 3014829 - protein, 19 aa, Entamoeba invadens
RDIKPDNILVFSLDLNNKA

SEQ ID NO: 3014830 - protein, 23 aa, Entamoeba invadens
RDIKPSNFLIKDNKLYLTDFGNA

SEQ ID NO: 3014831 - protein, 17 aa, Entamoeba invadens
RDIKPTNILFNNNKRTI

SEQ ID NO: 3014832 - protein, 25 aa, Entamoeba invadens
RDILEQVFPLFPRNAFTKYIDTELH

SEQ ID NO: 3014833 - protein, 20 aa, Entamoeba invadens
RDILETISSLRFATTVNKCS

SEQ ID NO: 3014834 - protein, 24 aa, Entamoeba invadens
RDILMYLHHQFLDRFTTMIPTNHV

SEQ ID NO: 3014835 - protein, 27 aa, Entamoeba invadens
RDINTDFLLLLVKKLVERNKRIKIIIM

SEQ ID NO: 3014836 - protein, 25 aa, Entamoeba invadens
RDIPHQMIKLYLQTLNTKTDNLKVD

SEQ ID NO: 3014837 - protein, 24 aa, Entamoeba invadens
RDITAKMDSLILLVNKQKTDMSEH

SEQ ID NO: 3014838 - protein, 26 aa, Entamoeba invadens
RDKDGRLFYCYTYLVKNKAGEEHEQK

SEQ ID NO: 3014839 - protein, 26 aa, Entamoeba invadens
RDKIQGMKGFQMSYLVSCMVNRVCIN

SEQ ID NO: 3014840 - protein, 19 aa, Entamoeba invadens
RDKSEFGNALFKAQDAAKE

SEQ ID NO: 3014841 - protein, 19 aa, Entamoeba invadens
RDKSVWLWKSYTGSDFECA

SEQ ID NO: 3014842 - protein, 19 aa, Entamoeba invadens
RDLIALVWDLMECDYNKNN

SEQ ID NO: 3014843 - protein, 26 aa, Entamoeba invadens
RDLIQILDHFLYLTYGKPEESDKDIV

SEQ ID NO: 3014844 - protein, 28 aa, Entamoeba invadens
RDLKRLIHVKGKKKPFARLVECSWMSLN

SEQ ID NO: 3014845 - protein, 22 aa, Entamoeba invadens
RDLRSLISYKQKLAFIVETQDN

SEQ ID NO: 3014846 - protein, 26 aa, Entamoeba invadens
RDLTRSCQLPLLPPRPNSMMTGKSVK

SEQ ID NO: 3014847 - protein, 24 aa, Entamoeba invadens
RDLYKYIHDQTLRFANKGYNSTEI

SEQ ID NO: 3014848 - protein, 19 aa, Entamoeba invadens
RDMNGILLRPIPRAKRILS

SEQ ID NO: 3014849 - protein, 20 aa, Entamoeba invadens
RDMNGILLRPIPRAKRLLSS

SEQ ID NO: 3014850 - protein, 18 aa, Entamoeba invadens
RDMYNIRPVLDECAVVEK

SEQ ID NO: 3014851 - protein, 24 aa, Entamoeba invadens
RDNLLSWLLDGFLGLAPDKYEQLF

SEQ ID NO: 3014852 - protein, 17 aa, Entamoeba invadens
RDNLVIAKPFLPESYCF

SEQ ID NO: 3014853 - protein, 18 aa, Entamoeba invadens
RDNNAFVFSLIRNDELNP

SEQ ID NO: 3014854 - protein, 20 aa, Entamoeba invadens
RDPIYKYLYSTEAIQSAMDK

SEQ ID NO: 3014855 - protein, 25 aa, Entamoeba invadens
RDPQFEKYELNKEQMLKCLKDISQN

SEQ ID NO: 3014856 - protein, 23 aa, Entamoeba invadens
RDQFICFGFMGVQDLILMTDEDI

SEQ ID NO: 3014857 - protein, 24 aa, Entamoeba invadens
RDQFKTILCDLKLYMTKGAAMITE

SEQ ID NO: 3014858 - protein, 26 aa, Entamoeba invadens
RDQIPKRFLYWVTNVFPQIPESLRLK

SEQ ID NO: 3014859 - protein, 27 aa, Entamoeba invadens
RDQVRYNLFCLLKSPILKMEKNYITAA

SEQ ID NO: 3014860 - protein, 37 aa, Entamoeba invadens
RDRDYLMSTMKLYLGRKILRICPLKLNYDIGCILEQK

SEQ ID NO: 3014861 - protein, 17 aa, Entamoeba invadens
RDRLVIYRIILELIGEF

SEQ ID NO: 3014862 - protein, 17 aa, Entamoeba invadens
RDRRYISEILKVGKRRS

SEQ ID NO: 3014863 - protein, 30 aa, Entamoeba invadens
RDSAQQGFLLGILMCYDFTIKIRRLYKKGH

SEQ ID NO: 3014864 - protein, 20 aa, Entamoeba invadens
RDSDFVISKLDFSNLEIDNL

SEQ ID NO: 3014865 - protein, 32 aa, Entamoeba invadens
RDSNETLEILIYFLRCLISSSHLLKTDPKTAF

SEQ ID NO: 3014866 - protein, 36 aa, Entamoeba invadens
RDSNETLEILTYFLRCLISSSHLLKMDPKTAFYSGF

SEQ ID NO: 3014867 - protein, 22 aa, Entamoeba invadens
RDSRWQNWSNFLLIFSTIFNTK

SEQ ID NO: 3014868 - protein, 22 aa, Entamoeba invadens
RDSVIYCLPLTFENKVESSESS

SEQ ID NO: 3014869 - protein, 25 aa, Entamoeba invadens
RDSVTFLRHLPLEKQRGVHFIFRKH

SEQ ID NO: 3014870 - protein, 17 aa, Entamoeba invadens
RDSWLPSVVLMNTQTQT

SEQ ID NO: 3014871 - protein, 25 aa, Entamoeba invadens
RDTKLRVIFSDKSGVPFCFSEISTG

SEQ ID NO: 3014872 - protein, 26 aa, Entamoeba invadens
RDTTTTYRVYFNNCLLSPDDSISDIL

SEQ ID NO: 3014873 - protein, 26 aa, Entamoeba invadens
RDVARHITVVQFELFRKIPVEELLSQ

SEQ ID NO: 3014874 - protein, 17 aa, Entamoeba invadens
RDVCKLIRMILEVAGVD

SEQ ID NO: 3014875 - protein, 17 aa, Entamoeba invadens
RDVDCFVVLFSYDSKES

SEQ ID NO: 3014876 - protein, 27 aa, Entamoeba invadens
RDVFEKLLEIMIFRENKNRKTGEMKQN

SEQ ID NO: 3014877 - protein, 18 aa, Entamoeba invadens
RDVFRQPLLFKIINEEKA

SEQ ID NO: 3014878 - protein, 17 aa, Entamoeba invadens
RDVIYPKAKEILSQTEN

SEQ ID NO: 3014879 - protein, 37 aa, Entamoeba invadens
RDVQTLTYAAMAYPREFVYVLVQYKSEGKYYEVSSSV

SEQ ID NO: 3014880 - protein, 45 aa, Entamoeba invadens
RDVVKILSIIERLKNFPKTDPFMRYLIVFHILFGELQNLETVAAN

SEQ ID NO: 3014881 - protein, 17 aa, Entamoeba invadens
RDWEVAIFNALSRTLSG

SEQ ID NO: 3014882 - protein, 21 aa, Entamoeba invadens
RDWVDLYDFRDLLIEYPFLKG

SEQ ID NO: 3014883 - protein, 29 aa, Entamoeba invadens
RDWVNRRSWWHNPEMTEFVIFNFSNKHPL

SEQ ID NO: 3014884 - protein, 17 aa, Entamoeba invadens
RDYEFKYGKFKLKRICA

SEQ ID NO: 3014885 - protein, 17 aa, Entamoeba invadens
RDYKAASEELMRTKTEL

SEQ ID NO: 3014886 - protein, 19 aa, Entamoeba invadens
RDYKTAIEKLMRTKTELDE

SEQ ID NO: 3014887 - protein, 19 aa, Entamoeba invadens
REAAFSNFLASVLIERGFT

SEQ ID NO: 3014888 - protein, 31 aa, Entamoeba invadens
READFTFFKQFFYTNPLSKYYVYKNSATILC

SEQ ID NO: 3014889 - protein, 25 aa, Entamoeba invadens
REAEERDKMFLAEKKKWEEEQQARM

SEQ ID NO: 3014890 - protein, 17 aa, Entamoeba invadens
REAFLHCTSLVKIGLPN

SEQ ID NO: 3014891 - protein, 31 aa, Entamoeba invadens
REAFTMFDQLFRYFGMKKAEFLKPGFQKLVD

SEQ ID NO: 3014892 - protein, 18 aa, Entamoeba invadens
REARLLFCVKTELENFVE

SEQ ID NO: 3014893 - protein, 25 aa, Entamoeba invadens
RECRALQEVVLPPTLKALGYQAFFK

SEQ ID NO: 3014894 - protein, 23 aa, Entamoeba invadens
RECRSHYLQYYLETPTHPLPDMT

SEQ ID NO: 3014895 - protein, 23 aa, Entamoeba invadens
REDKLFIDGIPEFPVVKQRPNVP

SEQ ID NO: 3014896 - protein, 19 aa, Entamoeba invadens
REDPFIFIQRSGSTEPKVG

SEQ ID NO: 3014897 - protein, 23 aa, Entamoeba invadens
REDPILLTQIPPTQLHTMFSKNI

SEQ ID NO: 3014898 - protein, 21 aa, Entamoeba invadens
REDSHFIFTVESVGIYQAKEI

SEQ ID NO: 3014899 - protein, 25 aa, Entamoeba invadens
REDTLSPHTFLPKLQSPHHEEAPKR

SEQ ID NO: 3014900 - protein, 17 aa, Entamoeba invadens
REEFVFKGNASYQHVMS

SEQ ID NO: 3014901 - protein, 25 aa, Entamoeba invadens
REEKYLKYFKWFERTDKTTFSEADV

SEQ ID NO: 3014902 - protein, 19 aa, Entamoeba invadens
REELLVYDTKRDGWNMEKF

SEQ ID NO: 3014903 - protein, 31 aa, Entamoeba invadens
REEMLEHFQSYEPLFFIYTKSNKESYHPVRE

SEQ ID NO: 3014904 - protein, 17 aa, Entamoeba invadens
REENEILDFIRGKIFNL

SEQ ID NO: 3014905 - protein, 31 aa, Entamoeba invadens
REENLGNTHLYFAPIPIPQSRKDPIKDDEKK

SEQ ID NO: 3014906 - protein, 23 aa, Entamoeba invadens
REERLLFLQSLISKKVELKRNRE

SEQ ID NO: 3014907 - protein, 29 aa, Entamoeba invadens
REESFFVTPKVFWRTFLDDTDKGTKFISG

SEQ ID NO: 3014908 - protein, 17 aa, Entamoeba invadens
REEYLREWKKRKRITKE

SEQ ID NO: 3014909 - protein, 18 aa, Entamoeba invadens
REFGDLVMMGIGGFSPLD

SEQ ID NO: 3014910 - protein, 23 aa, Entamoeba invadens
REFGGHVYLYTKSIERAHTPNKM

SEQ ID NO: 3014911 - protein, 28 aa, Entamoeba invadens
REFIQNVLSSYLWDGFYTSWDKVTMRAS

SEQ ID NO: 3014912 - protein, 18 aa, Entamoeba invadens
REFLKDKYLLDAYGYTKE

SEQ ID NO: 3014913 - protein, 20 aa, Entamoeba invadens
REFRCELPFQLFKSGFKLIP

SEQ ID NO: 3014914 - protein, 23 aa, Entamoeba invadens
REFRKIYDSFPKPFPTDKRQADK

SEQ ID NO: 3014915 - protein, 23 aa, Entamoeba invadens
REGFIYNINKLKSPLNLIVFHII

SEQ ID NO: 3014916 - protein, 18 aa, Entamoeba invadens
REHDLVFLKMLGKTGKCL

SEQ ID NO: 3014917 - protein, 33 aa, Entamoeba invadens
REHFKFNFTVLKYPFTALMINIFSTKPFLECHS

SEQ ID NO: 3014918 - protein, 23 aa, Entamoeba invadens
REHIVNLHKWAPYIKSGEGFGTE

SEQ ID NO: 3014919 - protein, 25 aa, Entamoeba invadens
REHLLQRLCTGLLLKNCYSPSVEDT

SEQ ID NO: 3014920 - protein, 18 aa, Entamoeba invadens
REHLLVLYQRLAKVLVGS

SEQ ID NO: 3014921 - protein, 22 aa, Entamoeba invadens
REHLWNVYFKFVYDGLMDEFKM

SEQ ID NO: 3014922 - protein, 37 aa, Entamoeba invadens
REIDFSMEYPRPDFWAKLFNYLKKGLIDISKFTDNSK

SEQ ID NO: 3014923 - protein, 25 aa, Entamoeba invadens
REIDLLSFLKLYNEELDNNKLSIDE

SEQ ID NO: 3014924 - protein, 18 aa, Entamoeba invadens
REIGNCLRYGTPNALYLL

SEQ ID NO: 3014925 - protein, 17 aa, Entamoeba invadens
REIIDTYHFNPIRLNKH

SEQ ID NO: 3014926 - protein, 17 aa, Entamoeba invadens
REIILEKGVLTKEQLDI

SEQ ID NO: 3014927 - protein, 18 aa, Entamoeba invadens
REIKWPMKIGVGVNSTTA

SEQ ID NO: 3014928 - protein, 22 aa, Entamoeba invadens
REINQIEMPLLLKTIRERQNTT

SEQ ID NO: 3014929 - protein, 17 aa, Entamoeba invadens
REIPTLEFTLLNPNYKL

SEQ ID NO: 3014930 - protein, 20 aa, Entamoeba invadens
REIQFWRPMKQLMKEDRTIL

SEQ ID NO: 3014931 - protein, 45 aa, Entamoeba invadens
REKATFECFFEMSQLYPFFIKNLPNALLHKDIVLFLTTISKDNME

SEQ ID NO: 3014932 - protein, 21 aa, Entamoeba invadens
REKELRKWHFSCGCSLCEEDK

SEQ ID NO: 3014933 - protein, 22 aa, Entamoeba invadens
REKGYKIGILRPAFITGNSKSG

SEQ ID NO: 3014934 - protein, 17 aa, Entamoeba invadens
REKITKYMGYINNFRDL

SEQ ID NO: 3014935 - protein, 18 aa, Entamoeba invadens
REKLLRRHLLKLKSRTSI

SEQ ID NO: 3014936 - protein, 23 aa, Entamoeba invadens
REKMAQLMFEKFQAPSVCIEKPA

SEQ ID NO: 3014937 - protein, 24 aa, Entamoeba invadens
REKMTQIMFKTFNVPAMYVELGRS

SEQ ID NO: 3014938 - protein, 17 aa, Entamoeba invadens
REKNTDVFCPWIPNNVQ

SEQ ID NO: 3014939 - protein, 20 aa, Entamoeba invadens
REKVFGFNGFIASAVDVYYL

SEQ ID NO: 3014940 - protein, 25 aa, Entamoeba invadens
REKVMKMFIMLLQKATNFKEKMVFD

SEQ ID NO: 3014941 - protein, 28 aa, Entamoeba invadens
RELAFQHHLYFLGYHDTSIFLSDVLYQL

SEQ ID NO: 3014942 - protein, 25 aa, Entamoeba invadens
RELDKTLFIMSRRPYRDIFEKYFIE

SEQ ID NO: 3014943 - protein, 17 aa, Entamoeba invadens
RELFKAMRKNNPKSSAG

SEQ ID NO: 3014944 - protein, 27 aa, Entamoeba invadens
RELIAGYLLHPAYLREWKGARPFNTSM

SEQ ID NO: 3014945 - protein, 24 aa, Entamoeba invadens
RELIAVWGTFYPCELSEYNVLYQK

SEQ ID NO: 3014946 - protein, 19 aa, Entamoeba invadens
RELIRQMKRSSRKVRIMRG

SEQ ID NO: 3014947 - protein, 19 aa, Entamoeba invadens
RELISSYSPVFQKNQKNWF

SEQ ID NO: 3014948 - protein, 33 aa, Entamoeba invadens
RELLDKFHYNPIPLKTLSLFPNLYTLHIYNQTD

SEQ ID NO: 3014949 - protein, 35 aa, Entamoeba invadens
RELLLHPTTIFDLWRRTKFPYSRVYEALLVLLHHG

SEQ ID NO: 3014950 - protein, 25 aa, Entamoeba invadens
RELLWKKRCIRFRKVANKKMDEEAR

SEQ ID NO: 3014951 - protein, 17 aa, Entamoeba invadens
RELMLSGKLYDSTVPEL

SEQ ID NO: 3014952 - protein, 33 aa, Entamoeba invadens
RELNAHICGLKNVLFLIFIPNEHPLGFYSKDII

SEQ ID NO: 3014953 - protein, 24 aa, Entamoeba invadens
RELNAVMLLVFYNENDKLAEILKF

SEQ ID NO: 3014954 - protein, 19 aa, Entamoeba invadens
RELNTWYFNGNACVLCDKS

SEQ ID NO: 3014955 - protein, 19 aa, Entamoeba invadens
RELVELLEVVKMQNSKIYE

SEQ ID NO: 3014956 - protein, 19 aa, Entamoeba invadens
RELVLWEEQLFKLKGDLDK

SEQ ID NO: 3014957 - protein, 18 aa, Entamoeba invadens
RELVPSTIIVVDGMLIRI

SEQ ID NO: 3014958 - protein, 26 aa, Entamoeba invadens
REMCGTFPQCFWAEPSKFFTDGPLMN

SEQ ID NO: 3014959 - protein, 21 aa, Entamoeba invadens
REMFRYPWEVVNFITGGRRLD

SEQ ID NO: 3014960 - protein, 17 aa, Entamoeba invadens
REMLSFVDRFSYTIVKL

SEQ ID NO: 3014961 - protein, 19 aa, Entamoeba invadens
REMNCIVLVFRGTLSLQDL

SEQ ID NO: 3014962 - protein, 17 aa, Entamoeba invadens
REMREKVFPYEVSRELL

SEQ ID NO: 3014963 - protein, 23 aa, Entamoeba invadens
REMYEQIMLPQIKKIPSSVTQWI

SEQ ID NO: 3014964 - protein, 26 aa, Entamoeba invadens
RENAKPMTTLFFARLGASMKEQVLKD

SEQ ID NO: 3014965 - protein, 31 aa, Entamoeba invadens
RENEKDFEKLQQLYNALMNERAQMIEKTEHV

SEQ ID NO: 3014966 - protein, 26 aa, Entamoeba invadens
RENLKVKRYFSMPKSRRQSRSSKKSK

SEQ ID NO: 3014967 - protein, 25 aa, Entamoeba invadens
RENLRTLIRTLFQDVNHRNIKAKTL

SEQ ID NO: 3014968 - protein, 28 aa, Entamoeba invadens
RENNIYNNIFYNCTFGYYGDARGPYRYH

SEQ ID NO: 3014969 - protein, 25 aa, Entamoeba invadens
REPGKIFVFDINRYDDTLLKKIEQL

SEQ ID NO: 3014970 - protein, 25 aa, Entamoeba invadens
REPIRFQMQFSKWDQKRAGYQDTQD

SEQ ID NO: 3014971 - protein, 22 aa, Entamoeba invadens
REPLQTTILPPIVDPNEKKFPN

SEQ ID NO: 3014972 - protein, 17 aa, Entamoeba invadens
REPTGMPITYHAKKVSF

SEQ ID NO: 3014973 - protein, 25 aa, Entamoeba invadens
REQEQLKTALLLGEKEELGGVKDNV

SEQ ID NO: 3014974 - protein, 18 aa, Entamoeba invadens
REQNDFIVYWVKSLQRYK

SEQ ID NO: 3014975 - protein, 18 aa, Entamoeba invadens
REQPPHTLYFITGSQVET

SEQ ID NO: 3014976 - protein, 25 aa, Entamoeba invadens
REQSIILTQILLKRSLDNVDAYADF

SEQ ID NO: 3014977 - protein, 19 aa, Entamoeba invadens
REQVFVERKLGSGGFSQVY

SEQ ID NO: 3014978 - protein, 25 aa, Entamoeba invadens
REQVRTLLFTAVFSKPVHARKLLLA

SEQ ID NO: 3014979 - protein, 19 aa, Entamoeba invadens
RERFLRLGEMNNSLSRSMV

SEQ ID NO: 3014980 - protein, 28 aa, Entamoeba invadens
RERGYMTFYNNIFILTKKEKLGNVLTIS

SEQ ID NO: 3014981 - protein, 18 aa, Entamoeba invadens
RERKGLVNLYAPLMATVS

SEQ ID NO: 3014982 - protein, 24 aa, Entamoeba invadens
RERKQFLQMFDDLDIQKFLDDVEN

SEQ ID NO: 3014983 - protein, 21 aa, Entamoeba invadens
RERKQQAYWIEPSRVMFGEFP

SEQ ID NO: 3014984 - protein, 27 aa, Entamoeba invadens
RERLHSLFSLYVTERLRRIEKIRWDIG

SEQ ID NO: 3014985 - protein, 23 aa, Entamoeba invadens
RERQFYMKYLKIMRSEIRRVDEE

SEQ ID NO: 3014986 - protein, 21 aa, Entamoeba invadens
RERRAWADKEKKYREEISQLK

SEQ ID NO: 3014987 - protein, 19 aa, Entamoeba invadens
RERSIALSELISDENLLDK

SEQ ID NO: 3014988 - protein, 27 aa, Entamoeba invadens
RERTDHLLIDFADVLHVSVRKLGRTFI

SEQ ID NO: 3014989 - protein, 24 aa, Entamoeba invadens
RERYLERRILGRSGLKRFVNKEAT

SEQ ID NO: 3014990 - protein, 27 aa, Entamoeba invadens
RESGYSKLLIVIYRIFTEDDSKLFLET

SEQ ID NO: 3014991 - protein, 17 aa, Entamoeba invadens
RESIIKMVLVGESGVGK

SEQ ID NO: 3014992 - protein, 27 aa, Entamoeba invadens
RESSIRRSVLRFGENLIDPVRQKQTGP

SEQ ID NO: 3014993 - protein, 23 aa, Entamoeba invadens
RESVKNILLMRKIYIGGKMCETM

SEQ ID NO: 3014994 - protein, 33 aa, Entamoeba invadens
RETGPIELLEICEPFLAYKIGGYVRVVSCTVGG

SEQ ID NO: 3014995 - protein, 24 aa, Entamoeba invadens
RETINQPIFSRKFSQAVMPSYRSN

SEQ ID NO: 3014996 - protein, 17 aa, Entamoeba invadens
REVLRTVLTIIMDDNPP

SEQ ID NO: 3014997 - protein, 36 aa, Entamoeba invadens
REVNTPKCFPLPPEFRVFPQVVYTPKRIRLHGIHRQ

SEQ ID NO: 3014998 - protein, 19 aa, Entamoeba invadens
REVQFPACLRRIGSAAFKR

SEQ ID NO: 3014999 - protein, 19 aa, Entamoeba invadens
REVSLIYKAYEYAKNVRLV

SEQ ID NO: 3015000 - protein, 18 aa, Entamoeba invadens
REVTEKKKFMPVRKGGIV

SEQ ID NO: 3015001 - protein, 18 aa, Entamoeba invadens
REVTEKKKFMPVSKGGLA

SEQ ID NO: 3015002 - protein, 20 aa, Entamoeba invadens
REVTKLWKRSFADCTTLTEI

SEQ ID NO: 3015003 - protein, 17 aa, Entamoeba invadens
REWIGLRQIQSLLVKAS

SEQ ID NO: 3015004 - protein, 26 aa, Entamoeba invadens
REYAFRIREFLGEQVCVVPVAFPGRR

SEQ ID NO: 3015005 - protein, 24 aa, Entamoeba invadens
REYDVIIISPPWGGPGAFRNKQSL

SEQ ID NO: 3015006 - protein, 38 aa, Entamoeba invadens
REYETWKANTIYLYSFLTTYETPFPAATTFDWGTVVSN

SEQ ID NO: 3015007 - protein, 27 aa, Entamoeba invadens
REYISGMCCLLIAVLTYSEMAKKKMVM

SEQ ID NO: 3015008 - protein, 32 aa, Entamoeba invadens
REYKRALNAAKLDRLFSKPFIKALEGNPDGVT

SEQ ID NO: 3015009 - protein, 17 aa, Entamoeba invadens
REYLASFKDSITLFANF

SEQ ID NO: 3015010 - protein, 26 aa, Entamoeba invadens
REYLRAFDIIGLILQSASNITRTMFE

SEQ ID NO: 3015011 - protein, 29 aa, Entamoeba invadens
REYQIEGLNWLVFNWCRGKGCILADEMGL

SEQ ID NO: 3015012 - protein, 23 aa, Entamoeba invadens
REYSIRDVVFYMFERDSTRFLMC

SEQ ID NO: 3015013 - protein, 25 aa, Entamoeba invadens
REYTQFMKIYSPKIVQLVLKCPHEE

SEQ ID NO: 3015014 - protein, 33 aa, Entamoeba invadens
RFAKKKEQIAQFFLPFLLDFIDNFDRLSSVWGV

SEQ ID NO: 3015015 - protein, 18 aa, Entamoeba invadens
RFCGEVADLLDKLRSSRK

SEQ ID NO: 3015016 - protein, 19 aa, Entamoeba invadens
RFCSHLSLFAQPIRQEKAR

SEQ ID NO: 3015017 - protein, 39 aa, Entamoeba invadens
RFDEFMNGLTEISFKLKEMYYLLTQGGVAELELVDTLNP

SEQ ID NO: 3015018 - protein, 22 aa, Entamoeba invadens
RFDFVYIRMEGFIDWEFLEHHS

SEQ ID NO: 3015019 - protein, 17 aa, Entamoeba invadens
RFDIAKKMIPYQTGFCC

SEQ ID NO: 3015020 - protein, 34 aa, Entamoeba invadens
RFDLKYLLRDSLSHTWCCDFVFFVIQIVKEARGV

SEQ ID NO: 3015021 - protein, 29 aa, Entamoeba invadens
RFDRSKVLPELLFFFDYYTENHVEKGLAM

SEQ ID NO: 3015022 - protein, 30 aa, Entamoeba invadens
RFDVRVWRCFCEAFRYLPVSALIEGKILCL

SEQ ID NO: 3015023 - protein, 19 aa, Entamoeba invadens
RFEEELQKNSFRKAQLQTI

SEQ ID NO: 3015024 - protein, 22 aa, Entamoeba invadens
RFEEFRNYFTFELKTQLPENRL

SEQ ID NO: 3015025 - protein, 23 aa, Entamoeba invadens
RFEGFRNYFTFELKTQLPEKRLR

SEQ ID NO: 3015026 - protein, 17 aa, Entamoeba invadens
RFEGFVTVLKQGFMTFI

SEQ ID NO: 3015027 - protein, 18 aa, Entamoeba invadens
RFEKGWFGDLKYLYNHNT

SEQ ID NO: 3015028 - protein, 19 aa, Entamoeba invadens
RFEPILIVTQKLVAEMDRA

SEQ ID NO: 3015029 - protein, 20 aa, Entamoeba invadens
RFEYTEQLFNPNKYGKDMNG

SEQ ID NO: 3015030 - protein, 38 aa, Entamoeba invadens
RFFESFFDVLRAYRKITASPFIIFTSLAAQAISNTVDK

SEQ ID NO: 3015031 - protein, 17 aa, Entamoeba invadens
RFFKHSNFSSFVRQLNI

SEQ ID NO: 3015032 - protein, 21 aa, Entamoeba invadens
RFFMPFTLRHEETMATLVIVD

SEQ ID NO: 3015033 - protein, 20 aa, Entamoeba invadens
RFFPNLNTLHLYIKDDLLFT

SEQ ID NO: 3015034 - protein, 18 aa, Entamoeba invadens
RFGALIIRITNPKTTALV

SEQ ID NO: 3015035 - protein, 31 aa, Entamoeba invadens
RFGDYAFINCKFDKMFFAKNLKVMGTGVFSK

SEQ ID NO: 3015036 - protein, 20 aa, Entamoeba invadens
RFGFCFFEKVGPDNLHVSDK

SEQ ID NO: 3015037 - protein, 17 aa, Entamoeba invadens
RFHFNPIPLNMNMIKYF

SEQ ID NO: 3015038 - protein, 19 aa, Entamoeba invadens
RFHYNPIEETFLFKKLETQ

SEQ ID NO: 3015039 - protein, 21 aa, Entamoeba invadens
RFIAEPGRYLASNAFHLVTSI

SEQ ID NO: 3015040 - protein, 27 aa, Entamoeba invadens
RFIEKTEVFVFVYSVDNYFSFKNVEKS

SEQ ID NO: 3015041 - protein, 19 aa, Entamoeba invadens
RFIHDKIALIPHLESLSFS

SEQ ID NO: 3015042 - protein, 18 aa, Entamoeba invadens
RFILSNKVWIKRLNVIIS

SEQ ID NO: 3015043 - protein, 18 aa, Entamoeba invadens
RFIPRTFPVYPHMDDILK

SEQ ID NO: 3015044 - protein, 33 aa, Entamoeba invadens
RFIQIADYLNKLNNFQLLYGIIQAFDQKSKIWS

SEQ ID NO: 3015045 - protein, 18 aa, Entamoeba invadens
RFKPKSIEFFKIPNYKVV

SEQ ID NO: 3015046 - protein, 33 aa, Entamoeba invadens
RFKREKHLKHFGKLQLVLFLKGMGLDMDGTKKY

SEQ ID NO: 3015047 - protein, 21 aa, Entamoeba invadens
RFKTIQPIRKLEVGLIPPLWE

SEQ ID NO: 3015048 - protein, 19 aa, Entamoeba invadens
RFLHVWNIADFISSGKRLA

SEQ ID NO: 3015049 - protein, 17 aa, Entamoeba invadens
RFLLKEIINSEGLEQFV

SEQ ID NO: 3015050 - protein, 17 aa, Entamoeba invadens
RFLLMDLVDERENRWVK

SEQ ID NO: 3015051 - protein, 18 aa, Entamoeba invadens
RFLNGRPFEYQNKFPVMY

SEQ ID NO: 3015052 - protein, 21 aa, Entamoeba invadens
RFLPHVQNMDGFFVCKLKLYV

SEQ ID NO: 3015053 - protein, 17 aa, Entamoeba invadens
RFLRRKKNSKRKKQTKK

SEQ ID NO: 3015054 - protein, 17 aa, Entamoeba invadens
RFLSTNPTYPTIPKTES

SEQ ID NO: 3015055 - protein, 29 aa, Entamoeba invadens
RFLVTIQMETLPWVVPIQVIQAETDVIPA

SEQ ID NO: 3015056 - protein, 20 aa, Entamoeba invadens
RFMIGWNEYIAVFTLAKMMV

SEQ ID NO: 3015057 - protein, 18 aa, Entamoeba invadens
RFMKVLKEWAGAKSVTKV

SEQ ID NO: 3015058 - protein, 23 aa, Entamoeba invadens
RFMKVTRDAVIPVSFCVPRKSEL

SEQ ID NO: 3015059 - protein, 18 aa, Entamoeba invadens
RFMNISSVYFRNTAGIIM

SEQ ID NO: 3015060 - protein, 26 aa, Entamoeba invadens
RFNAIKTFVVCLPLVTPNVIQTRIKP

SEQ ID NO: 3015061 - protein, 18 aa, Entamoeba invadens
RFNLMLSALLRDIPSFEC

SEQ ID NO: 3015062 - protein, 25 aa, Entamoeba invadens
RFNRRKYRVVYVAPELLDMSSNFIS

SEQ ID NO: 3015063 - protein, 17 aa, Entamoeba invadens
RFNTVFFVGKKLTPSNE

SEQ ID NO: 3015064 - protein, 21 aa, Entamoeba invadens
RFPKRNSEILKHVLALCGKII

SEQ ID NO: 3015065 - protein, 18 aa, Entamoeba invadens
RFPPMASPLDILLGKADC

SEQ ID NO: 3015066 - protein, 20 aa, Entamoeba invadens
RFPPVVFYTPKELGGLGMLS

SEQ ID NO: 3015067 - protein, 19 aa, Entamoeba invadens
RFPVLTWFNDKMGSALLRS

SEQ ID NO: 3015068 - protein, 19 aa, Entamoeba invadens
RFQFIPYVWVHHGLEVLDL

SEQ ID NO: 3015069 - protein, 19 aa, Entamoeba invadens
RFRCPEALFVPGYIGLECD

SEQ ID NO: 3015070 - protein, 27 aa, Entamoeba invadens
RFRGLVSSYYRNCNGLILTFDLENRNS

SEQ ID NO: 3015071 - protein, 27 aa, Entamoeba invadens
RFRILTSSFYRKCCGAFLVFDLNDRNS

SEQ ID NO: 3015072 - protein, 23 aa, Entamoeba invadens
RFRNICNAYLNINIKTIYRIVLC

SEQ ID NO: 3015073 - protein, 20 aa, Entamoeba invadens
RFRSITRSYYRGAVGVIMVY

SEQ ID NO: 3015074 - protein, 33 aa, Entamoeba invadens
RFRSLAANFFREAQGIIICYDVTSPKSLTSVPD

SEQ ID NO: 3015075 - protein, 17 aa, Entamoeba invadens
RFRVARYPNYEYTDTSH

SEQ ID NO: 3015076 - protein, 22 aa, Entamoeba invadens
RFSHYYIVELTRDFQNRNNPIS

SEQ ID NO: 3015077 - protein, 18 aa, Entamoeba invadens
RFSNFNVHTIRSCDIKFQ

SEQ ID NO: 3015078 - protein, 30 aa, Entamoeba invadens
RFSSPWKDKYPTLALLPKTNSELMQNTHWL

SEQ ID NO: 3015079 - protein, 19 aa, Entamoeba invadens
RFSYIPIRRMKSCLDFIAF

SEQ ID NO: 3015080 - protein, 24 aa, Entamoeba invadens
RFTKESHILPYYFQVIDGINSKNE

SEQ ID NO: 3015081 - protein, 23 aa, Entamoeba invadens
RFVDEALAVSAYYKKPSCIVVDI

SEQ ID NO: 3015082 - protein, 20 aa, Entamoeba invadens
RFVKLLWKQTTVFDKLCNFA

SEQ ID NO: 3015083 - protein, 20 aa, Entamoeba invadens
RFYATTLFIIPKKNCSKISV

SEQ ID NO: 3015084 - protein, 24 aa, Entamoeba invadens
RFYGYYMHNFPQFSLKVKNTRFLT

SEQ ID NO: 3015085 - protein, 19 aa, Entamoeba invadens
RFYHIEHVDIYLSYSLEEI

SEQ ID NO: 3015086 - protein, 17 aa, Entamoeba invadens
RFYLKKSLNTDNSCKQT

SEQ ID NO: 3015087 - protein, 21 aa, Entamoeba invadens
RFYSNLIFYLHRCKTQELFFC

SEQ ID NO: 3015088 - protein, 20 aa, Entamoeba invadens
RFYVFERVMEILKSVYIVPI

SEQ ID NO: 3015089 - protein, 27 aa, Entamoeba invadens
RFYYNKYLQRVYFPSTIVYFNLENINN

SEQ ID NO: 3015090 - protein, 24 aa, Entamoeba invadens
RGALMKPWIFTEIKEKRNWDITSS

SEQ ID NO: 3015091 - protein, 18 aa, Entamoeba invadens
RGASYLGVRNIWHAMLMP

SEQ ID NO: 3015092 - protein, 17 aa, Entamoeba invadens
RGCLLLSDTFNVLNLNC

SEQ ID NO: 3015093 - protein, 24 aa, Entamoeba invadens
RGCTQCVGGYYLSNGVCNICINNC

SEQ ID NO: 3015094 - protein, 36 aa, Entamoeba invadens
RGDENVFPMTFISPLQDFERFYVRLGEIKNNIRFVV

SEQ ID NO: 3015095 - protein, 22 aa, Entamoeba invadens
RGDIDNVFYSSNAKAFCGHVFP

SEQ ID NO: 3015096 - protein, 23 aa, Entamoeba invadens
RGDMKIMMYKRPFDGLSHLEHYI

SEQ ID NO: 3015097 - protein, 22 aa, Entamoeba invadens
RGDTHYNMFEGVKYERADERLR

SEQ ID NO: 3015098 - protein, 23 aa, Entamoeba invadens
RGDVVEFLLWRNVTGHRVWYEWM

SEQ ID NO: 3015099 - protein, 19 aa, Entamoeba invadens
RGESGKLQFTFRPSDLFSS

SEQ ID NO: 3015100 - protein, 32 aa, Entamoeba invadens
RGESSFEVFFLLCCLKLTFPNQFVLLRGNHET

SEQ ID NO: 3015101 - protein, 25 aa, Entamoeba invadens
RGETLDAFAFRYIEIYTSPYTKQEQ

SEQ ID NO: 3015102 - protein, 28 aa, Entamoeba invadens
RGEWIDDFRIFMFSYQQGTGKPLFYSGL

SEQ ID NO: 3015103 - protein, 17 aa, Entamoeba invadens
RGFACEFEIFIKPLCSC

SEQ ID NO: 3015104 - protein, 17 aa, Entamoeba invadens
RGFGFVEFPTHEDALKA

SEQ ID NO: 3015105 - protein, 17 aa, Entamoeba invadens
RGFPMYNALMNFEDFFI

SEQ ID NO: 3015106 - protein, 26 aa, Entamoeba invadens
RGFTPIQTPFFMRRELMARTAQLSDF

SEQ ID NO: 3015107 - protein, 41 aa, Entamoeba invadens
RGGDKLDVILPSYHMFFVECLPIPPSRFRPLNRFGNMISDN

SEQ ID NO: 3015108 - protein, 20 aa, Entamoeba invadens
RGGKCLIPVFSLGRAQEFEL

SEQ ID NO: 3015109 - protein, 17 aa, Entamoeba invadens
RGGLKYDLLTYLATPDC

SEQ ID NO: 3015110 - protein, 26 aa, Entamoeba invadens
RGHFVKKQRFFVKVKKLKMAVKEIYD

SEQ ID NO: 3015111 - protein, 18 aa, Entamoeba invadens
RGIFWCCNSLVKFDNFGD

SEQ ID NO: 3015112 - protein, 26 aa, Entamoeba invadens
RGIISWQHICRIILFSLTVKENPKKF

SEQ ID NO: 3015113 - protein, 41 aa, Entamoeba invadens
RGILYEGLVLKPIRLWGIWTERWMVLTRDKLYYFDSSRQRV

SEQ ID NO: 3015114 - protein, 17 aa, Entamoeba invadens
RGIQKGDYGLLVLSALQ

SEQ ID NO: 3015115 - protein, 18 aa, Entamoeba invadens
RGIVYLSSIPRGITMVML

SEQ ID NO: 3015116 - protein, 18 aa, Entamoeba invadens
RGIYYESERTKKLKVIDL

SEQ ID NO: 3015117 - protein, 29 aa, Entamoeba invadens
RGKDWVECFLFNDILVIAKIDVTEKYRCE

SEQ ID NO: 3015118 - protein, 19 aa, Entamoeba invadens
RGKFFGLCRRMGVDPLRSQ

SEQ ID NO: 3015119 - protein, 25 aa, Entamoeba invadens
RGKKLPDLDILFSKLDLAQKCTHEL

SEQ ID NO: 3015120 - protein, 17 aa, Entamoeba invadens
RGKKSFFYNPDDRILLL

SEQ ID NO: 3015121 - protein, 24 aa, Entamoeba invadens
RGKNERRYAFKAYSEIVKKIAKEK

SEQ ID NO: 3015122 - protein, 18 aa, Entamoeba invadens
RGKNYNDCDIEHVKSIQW

SEQ ID NO: 3015123 - protein, 22 aa, Entamoeba invadens
RGLDMVSYENQQRLITCLSLEH

SEQ ID NO: 3015124 - protein, 21 aa, Entamoeba invadens
RGLFRSMCFKTFLKDYKKGEE

SEQ ID NO: 3015125 - protein, 17 aa, Entamoeba invadens
RGLLLGQTYAGFIYSAL

SEQ ID NO: 3015126 - protein, 33 aa, Entamoeba invadens
RGLMSCEVITTLFFMKLFNPTRVFLLRGNHESR

SEQ ID NO: 3015127 - protein, 27 aa, Entamoeba invadens
RGLNQLFWKKIFVLKTIPYSPQCNAIE

SEQ ID NO: 3015128 - protein, 25 aa, Entamoeba invadens
RGLPHAHILIVLDFKSKLKTVDCID

SEQ ID NO: 3015129 - protein, 20 aa, Entamoeba invadens
RGLPLFFALDFTLQQRPNEY

SEQ ID NO: 3015130 - protein, 17 aa, Entamoeba invadens
RGLRKYFNVKNDVPLIG

SEQ ID NO: 3015131 - protein, 27 aa, Entamoeba invadens
RGLWEGVCVFLVSFLRRMKSSIFNVHN

SEQ ID NO: 3015132 - protein, 31 aa, Entamoeba invadens
RGLYSVHINPYLIPFFIGLQNRFTQFRLSET

SEQ ID NO: 3015133 - protein, 30 aa, Entamoeba invadens
RGMFSVPADAKWFKPIELLTAQGIAGTILC

SEQ ID NO: 3015134 - protein, 20 aa, Entamoeba invadens
RGMRFLIDYLIDRCKENFVL

SEQ ID NO: 3015135 - protein, 20 aa, Entamoeba invadens
RGNILLSELAKESTLYLGLF

SEQ ID NO: 3015136 - protein, 23 aa, Entamoeba invadens
RGNLTFVQFENLLTRFPNPENCG

SEQ ID NO: 3015137 - protein, 17 aa, Entamoeba invadens
RGNMEKFHFNPIPLNFK

SEQ ID NO: 3015138 - protein, 35 aa, Entamoeba invadens
RGNMLKFHFNPIPLTPEILPFFPNIETLNVWSLPA

SEQ ID NO: 3015139 - protein, 22 aa, Entamoeba invadens
RGNNHFINRLTRIYNLTLNYYS

SEQ ID NO: 3015140 - protein, 25 aa, Entamoeba invadens
RGNSQFPIPVLYTLDSFGGVKIVSL

SEQ ID NO: 3015141 - protein, 23 aa, Entamoeba invadens
RGNTVFTKFYGVYANTYCAAMLK

SEQ ID NO: 3015142 - protein, 19 aa, Entamoeba invadens
RGQNMFGAKYKLVCTQSSV

SEQ ID NO: 3015143 - protein, 26 aa, Entamoeba invadens
RGSDEDAVMYWLQRMVLAGEDPKNIA

SEQ ID NO: 3015144 - protein, 20 aa, Entamoeba invadens
RGSFITMMAALMMGACGLTN

SEQ ID NO: 3015145 - protein, 24 aa, Entamoeba invadens
RGSSLIWGMLNKKTVLTLRKIMRH

SEQ ID NO: 3015146 - protein, 27 aa, Entamoeba invadens
RGTKLPKKDLLSSDPYVIVSIGPDSQR

SEQ ID NO: 3015147 - protein, 18 aa, Entamoeba invadens
RGVKFQLIRNIPPPIVPQ

SEQ ID NO: 3015148 - protein, 17 aa, Entamoeba invadens
RGVKKIGSFAFWRCQQL

SEQ ID NO: 3015149 - protein, 22 aa, Entamoeba invadens
RGVLFSCRADYKVTIFLSRSCE

SEQ ID NO: 3015150 - protein, 32 aa, Entamoeba invadens
RGVLGNLTVLIPWSDLLNKPIQVLLSDIAGLV

SEQ ID NO: 3015151 - protein, 32 aa, Entamoeba invadens
RGVNGIEVFQLLLALKIRYPKRITLLRGNHET

SEQ ID NO: 3015152 - protein, 22 aa, Entamoeba invadens
RGVTYPLVRNYDLAKKAIEETL

SEQ ID NO: 3015153 - protein, 30 aa, Entamoeba invadens
RGWETMDPNYFLFKYIEKYGRVVSAVQNIN

SEQ ID NO: 3015154 - protein, 19 aa, Entamoeba invadens
RGYELFIINAVFTENNNAI

SEQ ID NO: 3015155 - protein, 19 aa, Entamoeba invadens
RGYKMRRFIPMSLESTVDH

SEQ ID NO: 3015156 - protein, 21 aa, Entamoeba invadens
RGYVIIDPKGIIRYMQINDNG

SEQ ID NO: 3015157 - protein, 24 aa, Entamoeba invadens
RHAFNTPCVPPYMPIRKNISVLNI

SEQ ID NO: 3015158 - protein, 22 aa, Entamoeba invadens
RHCSPIPDEEFHYTPKPLTSQS

SEQ ID NO: 3015159 - protein, 18 aa, Entamoeba invadens
RHCYTAIAHIFKAFPDVV

SEQ ID NO: 3015160 - protein, 24 aa, Entamoeba invadens
RHDQLITLLLNRSASPSFGKNRQF

SEQ ID NO: 3015161 - protein, 19 aa, Entamoeba invadens
RHEFSGVAIGSILSSKNEK

SEQ ID NO: 3015162 - protein, 26 aa, Entamoeba invadens
RHEKFDLIISSPFFRATETARYIAAE

SEQ ID NO: 3015163 - protein, 20 aa, Entamoeba invadens
RHEVQIVCKCGQRFCFQCGR

SEQ ID NO: 3015164 - protein, 23 aa, Entamoeba invadens
RHHRFIEFFDTRAAQKALTTLDK

SEQ ID NO: 3015165 - protein, 18 aa, Entamoeba invadens
RHIGNDVIVFIFKEAGND

SEQ ID NO: 3015166 - protein, 18 aa, Entamoeba invadens
RHIGNDVVVIAFLDRDRV

SEQ ID NO: 3015167 - protein, 24 aa, Entamoeba invadens
RHKAALAFLAAYTGPITVYYGDEV

SEQ ID NO: 3015168 - protein, 17 aa, Entamoeba invadens
RHLVFSTLIDEKALGWY

SEQ ID NO: 3015169 - protein, 17 aa, Entamoeba invadens
RHLVMTKVPRKMKSMCC

SEQ ID NO: 3015170 - protein, 17 aa, Entamoeba invadens
RHNQIVDLENEVAVLKD

SEQ ID NO: 3015171 - protein, 21 aa, Entamoeba invadens
RHPQFLNFCAGLLDLDPEKRL

SEQ ID NO: 3015172 - protein, 24 aa, Entamoeba invadens
RHRRDVCEFVYYTGEPKPESQGVI

SEQ ID NO: 3015173 - protein, 25 aa, Entamoeba invadens
RHRRDVCEFVYYTGEPKPESQGVIF

SEQ ID NO: 3015174 - protein, 25 aa, Entamoeba invadens
RHSELYGMDVFFPKMLVFTSLCSVV

SEQ ID NO: 3015175 - protein, 18 aa, Entamoeba invadens
RHSFRRDEKTGMIKEYST

SEQ ID NO: 3015176 - protein, 26 aa, Entamoeba invadens
RHSILTIDKILLFSQQKRQLKDTDRI

SEQ ID NO: 3015177 - protein, 25 aa, Entamoeba invadens
RHSSGYIVNFIYKGLDKSEEDVKEY

SEQ ID NO: 3015178 - protein, 28 aa, Entamoeba invadens
RHTMMKYMMVYVFALPFNDFIETAMKNA

SEQ ID NO: 3015179 - protein, 27 aa, Entamoeba invadens
RHTNCLFFIAIQIWRGIPAQIKSILST

SEQ ID NO: 3015180 - protein, 25 aa, Entamoeba invadens
RHTNKYYHIVIHTYFENGVFDFADK

SEQ ID NO: 3015181 - protein, 29 aa, Entamoeba invadens
RHVEDIEAIAWRYLPTTLKLKGTTQSDIN

SEQ ID NO: 3015182 - protein, 17 aa, Entamoeba invadens
RHVGNDIVVLVFKERNA

SEQ ID NO: 3015183 - protein, 23 aa, Entamoeba invadens
RHVNRRLLILPQQRTTQTQTTTR

SEQ ID NO: 3015184 - protein, 17 aa, Entamoeba invadens
RHYAQYSAIFYFSTIDT

SEQ ID NO: 3015185 - protein, 19 aa, Entamoeba invadens
RIAAIQLLEEIFSGYPMYL

SEQ ID NO: 3015186 - protein, 23 aa, Entamoeba invadens
RIAENILLGVFPKINCFDDDIIH

SEQ ID NO: 3015187 - protein, 24 aa, Entamoeba invadens
RIAGLFELIPGQLYQFRGFDVANM

SEQ ID NO: 3015188 - protein, 19 aa, Entamoeba invadens
RIAILNNVKIVKVFFNVKG

SEQ ID NO: 3015189 - protein, 27 aa, Entamoeba invadens
RIALANEYHWQYPLGEFVRYCIQNDID

SEQ ID NO: 3015190 - protein, 17 aa, Entamoeba invadens
RIALTCNYLLKLLCEDN

SEQ ID NO: 3015191 - protein, 20 aa, Entamoeba invadens
RIATQQMKIIFQGLAGLQAL

SEQ ID NO: 3015192 - protein, 17 aa, Entamoeba invadens
RIDGFFPMKNYEFMTWS

SEQ ID NO: 3015193 - protein, 19 aa, Entamoeba invadens
RIDKLLAATPVREAKLYPS

SEQ ID NO: 3015194 - protein, 32 aa, Entamoeba invadens
RIDLPVPIQYVNLFLEIYFRQLPQLNSVATNV

SEQ ID NO: 3015195 - protein, 18 aa, Entamoeba invadens
RIDMLPKPLTEIVCSITE

SEQ ID NO: 3015196 - protein, 27 aa, Entamoeba invadens
RIDPKNLGMWLDLSKRGGMDGGWFMIT

SEQ ID NO: 3015197 - protein, 27 aa, Entamoeba invadens
RIDREVAFLKILKSRFIIQLYQVYETS

SEQ ID NO: 3015198 - protein, 21 aa, Entamoeba invadens
RIDRILCVFFNGTFIFTQEEL

SEQ ID NO: 3015199 - protein, 24 aa, Entamoeba invadens
RIDSKLRLLEIWATSDLMGNWISV

SEQ ID NO: 3015200 - protein, 23 aa, Entamoeba invadens
RIDSPYIVKLYGISLEPVALIMD

SEQ ID NO: 3015201 - protein, 24 aa, Entamoeba invadens
RIDTVCRYILRKIDGEGLFNARDF

SEQ ID NO: 3015202 - protein, 24 aa, Entamoeba invadens
RIDWDQFYGHYYMKFLFSSFNENE

SEQ ID NO: 3015203 - protein, 18 aa, Entamoeba invadens
RIEASRIGLYLLKLKEYP

SEQ ID NO: 3015204 - protein, 31 aa, Entamoeba invadens
RIEEAFDVLILARSWLKYSYVHSFYLSENGG

SEQ ID NO: 3015205 - protein, 28 aa, Entamoeba invadens
RIEELNVLFLAYLVNKYPDQYKTLAPSK

SEQ ID NO: 3015206 - protein, 18 aa, Entamoeba invadens
RIEEMFYPYFSCLVGNSN

SEQ ID NO: 3015207 - protein, 19 aa, Entamoeba invadens
RIEEYIKTPLAPKTPNVVT

SEQ ID NO: 3015208 - protein, 17 aa, Entamoeba invadens
RIEFLEERVKFLERTNI

SEQ ID NO: 3015209 - protein, 19 aa, Entamoeba invadens
RIEFPTVRYAGLLEYDSDN

SEQ ID NO: 3015210 - protein, 24 aa, Entamoeba invadens
RIEGLFPNNEFPVMFVHCKGDEFY

SEQ ID NO: 3015211 - protein, 34 aa, Entamoeba invadens
RIEICSRNIIVLLFLKYKIIDTLIQFVCKTVALK

SEQ ID NO: 3015212 - protein, 19 aa, Entamoeba invadens
RIELEEQIIVFLNTEKFVT

SEQ ID NO: 3015213 - protein, 31 aa, Entamoeba invadens
RIEMFNKNYLGLLVKRILSFDPTLDASDQQS

SEQ ID NO: 3015214 - protein, 22 aa, Entamoeba invadens
RIENMFLVLLQQNKTKIGQVIK

SEQ ID NO: 3015215 - protein, 19 aa, Entamoeba invadens
RIETFLRRVLNKDKIIASD

SEQ ID NO: 3015216 - protein, 25 aa, Entamoeba invadens
RIFEMPTEFLQLPPAPRNVVSNVVQ

SEQ ID NO: 3015217 - protein, 17 aa, Entamoeba invadens
RIFLVRHAIRVDYMDLT

SEQ ID NO: 3015218 - protein, 19 aa, Entamoeba invadens
RIFNRRELRNLFLTTNNLD

SEQ ID NO: 3015219 - protein, 17 aa, Entamoeba invadens
RIFQRNGIPPDQQYLFL

SEQ ID NO: 3015220 - protein, 23 aa, Entamoeba invadens
RIGEYYWLSFNLSSVTIPSSITS

SEQ ID NO: 3015221 - protein, 17 aa, Entamoeba invadens
RIGFEDEGLQQYVLYYT

SEQ ID NO: 3015222 - protein, 29 aa, Entamoeba invadens
RIGIFCVDSLLFFFRKNSNIRFKPYKKRY

SEQ ID NO: 3015223 - protein, 17 aa, Entamoeba invadens
RIGLYLSTNETTKFRMN

SEQ ID NO: 3015224 - protein, 26 aa, Entamoeba invadens
RIGPNAFSLLDKLIHIKLSSKLTELP

SEQ ID NO: 3015225 - protein, 26 aa, Entamoeba invadens
RIGTLIIVKNLDFLSIGYLDDFVRII

SEQ ID NO: 3015226 - protein, 21 aa, Entamoeba invadens
RIICAAVYKFTGKKMEFLWTG

SEQ ID NO: 3015227 - protein, 19 aa, Entamoeba invadens
RIIGFVPPDGEFELMNYRL

SEQ ID NO: 3015228 - protein, 29 aa, Entamoeba invadens
RIIGSDFLVRNVLLQRIRGVLQSDEDEAA

SEQ ID NO: 3015229 - protein, 19 aa, Entamoeba invadens
RIIKLDFVPSIGETTFRND

SEQ ID NO: 3015230 - protein, 17 aa, Entamoeba invadens
RIILFDYVSEKLELVDK

SEQ ID NO: 3015231 - protein, 25 aa, Entamoeba invadens
RIIPKNLLWVIHGIYKVVLIKRNST

SEQ ID NO: 3015232 - protein, 17 aa, Entamoeba invadens
RIISIDGGGIKCIMQAI

SEQ ID NO: 3015233 - protein, 22 aa, Entamoeba invadens
RIKDVKCHFLVDSFLIDPETNP

SEQ ID NO: 3015234 - protein, 24 aa, Entamoeba invadens
RIKIHSFSIWGIPPTTIVSKNKTV

SEQ ID NO: 3015235 - protein, 30 aa, Entamoeba invadens
RIKKYERLLCQLIQKYLLYIANCGWDLDQI

SEQ ID NO: 3015236 - protein, 33 aa, Entamoeba invadens
RIKLVELPVMKIQWDDIIPFSVTMIHIEDKEMV

SEQ ID NO: 3015237 - protein, 17 aa, Entamoeba invadens
RIKTIISSFWRKKYYFY

SEQ ID NO: 3015238 - protein, 18 aa, Entamoeba invadens
RIKVIFKVIGLKQSIYES

SEQ ID NO: 3015239 - protein, 17 aa, Entamoeba invadens
RILAKIISTFQVESVNL

SEQ ID NO: 3015240 - protein, 17 aa, Entamoeba invadens
RILDEFYEVYLEKVDYS

SEQ ID NO: 3015241 - protein, 28 aa, Entamoeba invadens
RILDTNVIIFDFFATWCGPCKSIAPVFE

SEQ ID NO: 3015242 - protein, 17 aa, Entamoeba invadens
RILFCFNMDNEPFALSN

SEQ ID NO: 3015243 - protein, 18 aa, Entamoeba invadens
RILFHYNGHGVPLPTLNG

SEQ ID NO: 3015244 - protein, 19 aa, Entamoeba invadens
RILKILFVMTSTGAVQQII

SEQ ID NO: 3015245 - protein, 26 aa, Entamoeba invadens
RILKTCLFFNFAYQIKHIMIKLDRYS

SEQ ID NO: 3015246 - protein, 18 aa, Entamoeba invadens
RILLSTLHILFNKNTNTP

SEQ ID NO: 3015247 - protein, 28 aa, Entamoeba invadens
RILSKLHHPFLVNLYYSFQTPTHLFYII

SEQ ID NO: 3015248 - protein, 29 aa, Entamoeba invadens
RILSKLHHPFLVNLYYSFQTPTHLFYIID

SEQ ID NO: 3015249 - protein, 19 aa, Entamoeba invadens
RILSRRSIIPLINALQLTE

SEQ ID NO: 3015250 - protein, 19 aa, Entamoeba invadens
RILYEVCCLFIRAETKMCE

SEQ ID NO: 3015251 - protein, 27 aa, Entamoeba invadens
RIMEKKQKIVTLKELQFKQGSSIDVKR

SEQ ID NO: 3015252 - protein, 18 aa, Entamoeba invadens
RIMFKIKNEWDLLYVVGE

SEQ ID NO: 3015253 - protein, 19 aa, Entamoeba invadens
RIMKQLLMALEYLHARRFL

SEQ ID NO: 3015254 - protein, 20 aa, Entamoeba invadens
RIMNESFYVDKRIVNKLLIS

SEQ ID NO: 3015255 - protein, 30 aa, Entamoeba invadens
RIMPKCALCGFNWFNAYYTPGVSRISTNIR

SEQ ID NO: 3015256 - protein, 20 aa, Entamoeba invadens
RINFQGYLRTLEKLENFLLR

SEQ ID NO: 3015257 - protein, 26 aa, Entamoeba invadens
RINGMQKFTILPKYSQFAFNCFDDAH

SEQ ID NO: 3015258 - protein, 17 aa, Entamoeba invadens
RINIKNWVYCYSKENHI

SEQ ID NO: 3015259 - protein, 17 aa, Entamoeba invadens
RINPIRISPDSKRLFQN

SEQ ID NO: 3015260 - protein, 21 aa, Entamoeba invadens
RINVSLLRDEDMILIGETVQK

SEQ ID NO: 3015261 - protein, 17 aa, Entamoeba invadens
RINVWFQVTYYFSKTHE

SEQ ID NO: 3015262 - protein, 21 aa, Entamoeba invadens
RIPENLFLESRTCSLVNSVET

SEQ ID NO: 3015263 - protein, 27 aa, Entamoeba invadens
RIPENVDVIYTSPLKRALETANIISEG

SEQ ID NO: 3015264 - protein, 17 aa, Entamoeba invadens
RIPFFDVVDVGQSYFMD

SEQ ID NO: 3015265 - protein, 17 aa, Entamoeba invadens
RIPFPVCITQARSFLES

SEQ ID NO: 3015266 - protein, 19 aa, Entamoeba invadens
RIPMKSFGFVISSARLLPI

SEQ ID NO: 3015267 - protein, 31 aa, Entamoeba invadens
RIPQITDYKKSFTKFSWFTKKFPITRNFNNL

SEQ ID NO: 3015268 - protein, 23 aa, Entamoeba invadens
RIPVRTIPRNPPIRPPVIIRQTP

SEQ ID NO: 3015269 - protein, 23 aa, Entamoeba invadens
RIQGLMKRFEFPELPGSIVSVMT

SEQ ID NO: 3015270 - protein, 33 aa, Entamoeba invadens
RIQSYKRIETLHLLIDLLREFGYSFESRFVEGK

SEQ ID NO: 3015271 - protein, 18 aa, Entamoeba invadens
RIRKTALDFLKFCKLMNL

SEQ ID NO: 3015272 - protein, 17 aa, Entamoeba invadens
RIRLEKSLYDKLITIKE

SEQ ID NO: 3015273 - protein, 23 aa, Entamoeba invadens
RIRSVLLPVIANKVPITDKDWSI

SEQ ID NO: 3015274 - protein, 24 aa, Entamoeba invadens
RIRTDLTRLLALPTIDTKNFEVLA

SEQ ID NO: 3015275 - protein, 23 aa, Entamoeba invadens
RISLDEFFLHPFVEKCRKIKWGK

SEQ ID NO: 3015276 - protein, 30 aa, Entamoeba invadens
RISLDFIMNEYFLDLLCTLPDTPQTLFSLW

SEQ ID NO: 3015277 - protein, 19 aa, Entamoeba invadens
RISNSLGEKALIFAKKRTS

SEQ ID NO: 3015278 - protein, 25 aa, Entamoeba invadens
RISPTILEKFYKFTMPKPEDFLGDF

SEQ ID NO: 3015279 - protein, 25 aa, Entamoeba invadens
RISSITTCVPYLSKRTYIIKQIEKH

SEQ ID NO: 3015280 - protein, 21 aa, Entamoeba invadens
RITAAVFWKSMRGEYLIVGLA

SEQ ID NO: 3015281 - protein, 29 aa, Entamoeba invadens
RITKKRSCPFRPHFDQFGLAPDTLAKFEK

SEQ ID NO: 3015282 - protein, 17 aa, Entamoeba invadens
RITPAFLSTLLQNTPKL

SEQ ID NO: 3015283 - protein, 17 aa, Entamoeba invadens
RITPFFVQLNKTQKFKL

SEQ ID NO: 3015284 - protein, 17 aa, Entamoeba invadens
RITPRHIQLAVRSDLEL

SEQ ID NO: 3015285 - protein, 17 aa, Entamoeba invadens
RITQIILNKNTIGAQNL

SEQ ID NO: 3015286 - protein, 22 aa, Entamoeba invadens
RITRRRALMDRDPYSDFIVEED

SEQ ID NO: 3015287 - protein, 19 aa, Entamoeba invadens
RITSFTSSIQRRNNSRCSC

SEQ ID NO: 3015288 - protein, 25 aa, Entamoeba invadens
RITTILHMNPIYLKDFWTPFSQVIP

SEQ ID NO: 3015289 - protein, 19 aa, Entamoeba invadens
RITVTDFCTLVRPIYEFAQ

SEQ ID NO: 3015290 - protein, 17 aa, Entamoeba invadens
RITWKTMIDFSTQITLG

SEQ ID NO: 3015291 - protein, 18 aa, Entamoeba invadens
RIVCQTYPGIFRSPVAEE

SEQ ID NO: 3015292 - protein, 25 aa, Entamoeba invadens
RIVHEKIPRFDFYSRVMNLSKSVEA

SEQ ID NO: 3015293 - protein, 17 aa, Entamoeba invadens
RIVSVFNSFIESALKDV

SEQ ID NO: 3015294 - protein, 18 aa, Entamoeba invadens
RIWDSIFAFPSRRFHLFI

SEQ ID NO: 3015295 - protein, 18 aa, Entamoeba invadens
RIYQFYTQGKKCFISWKR

SEQ ID NO: 3015296 - protein, 26 aa, Entamoeba invadens
RIYTPVVVEPPIQPLPIQKKEKKKKE

SEQ ID NO: 3015297 - protein, 19 aa, Entamoeba invadens
RKALLDAFNHCTLIQSGKG

SEQ ID NO: 3015298 - protein, 31 aa, Entamoeba invadens
RKANKTLQFFYVMETFYYCNRLSFETKISTY

SEQ ID NO: 3015299 - protein, 26 aa, Entamoeba invadens
RKAPKPRYFVLCTDLLFYTAPKKREV

SEQ ID NO: 3015300 - protein, 19 aa, Entamoeba invadens
RKCALMRKHWRQSLYSEHT

SEQ ID NO: 3015301 - protein, 19 aa, Entamoeba invadens
RKCELCSNGKYPKPSDNYK

SEQ ID NO: 3015302 - protein, 18 aa, Entamoeba invadens
RKCFERCSWLKEINFPSS

SEQ ID NO: 3015303 - protein, 18 aa, Entamoeba invadens
RKCFICGNYGHSKDECPQ

SEQ ID NO: 3015304 - protein, 20 aa, Entamoeba invadens
RKCITACYFYNAAKIKGQSY

SEQ ID NO: 3015305 - protein, 25 aa, Entamoeba invadens
RKCLFVRKSIMPVNRYTCVAGFLEV

SEQ ID NO: 3015306 - protein, 18 aa, Entamoeba invadens
RKCLICESSFYTSANGSC

SEQ ID NO: 3015307 - protein, 17 aa, Entamoeba invadens
RKCLTCVNKYRPASNGT

SEQ ID NO: 3015308 - protein, 28 aa, Entamoeba invadens
RKCPVEERWFCCTFSNGKPVPERKLRIF

SEQ ID NO: 3015309 - protein, 21 aa, Entamoeba invadens
RKCTKCVTGKYPNPSSPFSCM

SEQ ID NO: 3015310 - protein, 19 aa, Entamoeba invadens
RKCVECITGYYPDLLGTCV

SEQ ID NO: 3015311 - protein, 33 aa, Entamoeba invadens
RKCVGRPYVVKPLTLLVLQKFVRYVLDQKFAIT

SEQ ID NO: 3015312 - protein, 18 aa, Entamoeba invadens
RKCVTCDSGYYPSNGICV

SEQ ID NO: 3015313 - protein, 25 aa, Entamoeba invadens
RKCVYKFIHIPIQSGSTQVLEAMKR

SEQ ID NO: 3015314 - protein, 20 aa, Entamoeba invadens
RKCYSMPIILNQYKGQTDAK

SEQ ID NO: 3015315 - protein, 23 aa, Entamoeba invadens
RKDNVFTTQWFPPKIRKLCVYPQ

SEQ ID NO: 3015316 - protein, 26 aa, Entamoeba invadens
RKDRIDYIQLPYKLKVRMLFDTSRGM

SEQ ID NO: 3015317 - protein, 29 aa, Entamoeba invadens
RKDRQDYLKLPYKLKIRMLFDTAKGMQFL

SEQ ID NO: 3015318 - protein, 29 aa, Entamoeba invadens
RKDSPIFTLEEWYKILWDVNTTQFFNDVL

SEQ ID NO: 3015319 - protein, 24 aa, Entamoeba invadens
RKDSPLLTVPWKYNDQNFQLSHPS

SEQ ID NO: 3015320 - protein, 20 aa, Entamoeba invadens
RKDVEILHPLKRVPLKDERV

SEQ ID NO: 3015321 - protein, 25 aa, Entamoeba invadens
RKECALLVILPKWLNNKLNSKRADF

SEQ ID NO: 3015322 - protein, 29 aa, Entamoeba invadens
RKEDDAIYNGFYLLGNKWSKIAKNLEGRT

SEQ ID NO: 3015323 - protein, 23 aa, Entamoeba invadens
RKEEYHPYLLFCKENREKVKEEG

SEQ ID NO: 3015324 - protein, 24 aa, Entamoeba invadens
RKEFDFMMLKQLKKLNIVYTNNCD

SEQ ID NO: 3015325 - protein, 24 aa, Entamoeba invadens
RKEIDFMMLKQLKKLNLEFTNNCD

SEQ ID NO: 3015326 - protein, 20 aa, Entamoeba invadens
RKEITPKVPPKIPAKPRPKE

SEQ ID NO: 3015327 - protein, 25 aa, Entamoeba invadens
RKEKKTIIFPYAAPTSQRDIRSAKK

SEQ ID NO: 3015328 - protein, 22 aa, Entamoeba invadens
RKEKMPIPLYDVIKMCWVQEQT

SEQ ID NO: 3015329 - protein, 22 aa, Entamoeba invadens
RKELIFVKKYGYRKEKCGEFVK

SEQ ID NO: 3015330 - protein, 20 aa, Entamoeba invadens
RKENELLKQQLLLEKQKEEE

SEQ ID NO: 3015331 - protein, 21 aa, Entamoeba invadens
RKEPNLLTVFAPVVILGDIHG

SEQ ID NO: 3015332 - protein, 38 aa, Entamoeba invadens
RKERREVYKLVNVIVDITDFLPTIPEAREISLNQSQRA

SEQ ID NO: 3015333 - protein, 18 aa, Entamoeba invadens
RKESVCFMALQVIERLRN

SEQ ID NO: 3015334 - protein, 25 aa, Entamoeba invadens
RKETLHFLEDLLFEFGIVVLNTRDE

SEQ ID NO: 3015335 - protein, 35 aa, Entamoeba invadens
RKEVAMLAKFVSPYLIRFYGACFIPNRICMVTELA

SEQ ID NO: 3015336 - protein, 27 aa, Entamoeba invadens
RKEVGRFITYMWTLDLKMTDAVIMLSY

SEQ ID NO: 3015337 - protein, 33 aa, Entamoeba invadens
RKEYIGWNIPDPLCLMCYLFPEIVKKTITVQTG

SEQ ID NO: 3015338 - protein, 20 aa, Entamoeba invadens
RKFGDLLANYQLVALMKGLE

SEQ ID NO: 3015339 - protein, 25 aa, Entamoeba invadens
RKFHKQCIFTWFRSTGRNDCPLCTR

SEQ ID NO: 3015340 - protein, 22 aa, Entamoeba invadens
RKFMENITKFHFNPIPLTPKTL

SEQ ID NO: 3015341 - protein, 19 aa, Entamoeba invadens
RKFMNIKQILFHKDQPFIF

SEQ ID NO: 3015342 - protein, 27 aa, Entamoeba invadens
RKFNKERYFYLFNDMLIYGIGDEKYMK

SEQ ID NO: 3015343 - protein, 24 aa, Entamoeba invadens
RKFQNYYYFSMTEFEFLYGTKSIK

SEQ ID NO: 3015344 - protein, 20 aa, Entamoeba invadens
RKFTLKTVLMLMDQCLRRIE

SEQ ID NO: 3015345 - protein, 19 aa, Entamoeba invadens
RKFVTVVCDNFFCSLRLAH

SEQ ID NO: 3015346 - protein, 21 aa, Entamoeba invadens
RKFVTVVCDNFFCSLRLAHYL

SEQ ID NO: 3015347 - protein, 25 aa, Entamoeba invadens
RKGHSHIMWDSNDNRRIIALNKNWM

SEQ ID NO: 3015348 - protein, 18 aa, Entamoeba invadens
RKGMSRKEQIERAKRLAA

SEQ ID NO: 3015349 - protein, 18 aa, Entamoeba invadens
RKGNVLVFDFGGGTLDVT

SEQ ID NO: 3015350 - protein, 23 aa, Entamoeba invadens
RKGRLRYIKKVEAIANGLKKKKR

SEQ ID NO: 3015351 - protein, 24 aa, Entamoeba invadens
RKGVEIVPIVYYPVTQRQSQFVVI

SEQ ID NO: 3015352 - protein, 26 aa, Entamoeba invadens
RKGVILFICQLFNIIIEYWGKDYDVT

SEQ ID NO: 3015353 - protein, 28 aa, Entamoeba invadens
RKHFPSVNWNISFSKYIKILEQYYNSKD

SEQ ID NO: 3015354 - protein, 25 aa, Entamoeba invadens
RKHSFSRHFFGIEASGIHETTYNSI

SEQ ID NO: 3015355 - protein, 22 aa, Entamoeba invadens
RKIEPKTDLYYPPIIKDLLDVN

SEQ ID NO: 3015356 - protein, 29 aa, Entamoeba invadens
RKIHEFMLYQYLWHIINLYQIRSTRHFRL

SEQ ID NO: 3015357 - protein, 22 aa, Entamoeba invadens
RKIHSVISKIVPRHLVFSTLID

SEQ ID NO: 3015358 - protein, 17 aa, Entamoeba invadens
RKILVETLAKYPDQVCW

SEQ ID NO: 3015359 - protein, 25 aa, Entamoeba invadens
RKIPEDVFTAVKFPKLKILDLSRNS

SEQ ID NO: 3015360 - protein, 18 aa, Entamoeba invadens
RKISVAVAFKRPEKPTEV

SEQ ID NO: 3015361 - protein, 26 aa, Entamoeba invadens
RKISVVKALFYCQTALRNIALDKTQD

SEQ ID NO: 3015362 - protein, 19 aa, Entamoeba invadens
RKIVFQFPTSNKEVFNNAW

SEQ ID NO: 3015363 - protein, 27 aa, Entamoeba invadens
RKKGMEHFLDMFFEYTKTIVPNIENST

SEQ ID NO: 3015364 - protein, 27 aa, Entamoeba invadens
RKKHKTQLLKLRNKLNSIPERLKRLRE

SEQ ID NO: 3015365 - protein, 25 aa, Entamoeba invadens
RKKHKTQLLKLRNKLNSKPERLKRL

SEQ ID NO: 3015366 - protein, 26 aa, Entamoeba invadens
RKKHKTQLLKLRNKLNSMPERLKRLR

SEQ ID NO: 3015367 - protein, 27 aa, Entamoeba invadens
RKKIKPRHFILFNDIFLYGMGDEAATK

SEQ ID NO: 3015368 - protein, 22 aa, Entamoeba invadens
RKKRCFINNLLIDYASMIGYSF

SEQ ID NO: 3015369 - protein, 25 aa, Entamoeba invadens
RKKSIVAKQFLTVKAFWARNDVIEF

SEQ ID NO: 3015370 - protein, 22 aa, Entamoeba invadens
RKKTKLNTVIWPSPELSSGIVE

SEQ ID NO: 3015371 - protein, 18 aa, Entamoeba invadens
RKLGEGSFGIVYKGTYRG

SEQ ID NO: 3015372 - protein, 19 aa, Entamoeba invadens
RKLGEGSFGIVYKGTYRGN

SEQ ID NO: 3015373 - protein, 32 aa, Entamoeba invadens
RKLIEQKRNERLPLLSFKTPSTLGTNSEIGRV

SEQ ID NO: 3015374 - protein, 18 aa, Entamoeba invadens
RKLIIKACGATLIETESS

SEQ ID NO: 3015375 - protein, 28 aa, Entamoeba invadens
RKLKEKFVLSKYFATSNLKIVILSGGMK

SEQ ID NO: 3015376 - protein, 20 aa, Entamoeba invadens
RKLLAICSVILFTRDFLPRC

SEQ ID NO: 3015377 - protein, 17 aa, Entamoeba invadens
RKLLRLLEATLHVSKYS

SEQ ID NO: 3015378 - protein, 18 aa, Entamoeba invadens
RKLNSTNGILYFDYAFNI

SEQ ID NO: 3015379 - protein, 21 aa, Entamoeba invadens
RKLREGSFGIVFKGTYRGNVV

SEQ ID NO: 3015380 - protein, 24 aa, Entamoeba invadens
RKLREGSFGIVFKGTYRGNVVAIK

SEQ ID NO: 3015381 - protein, 19 aa, Entamoeba invadens
RKLRHPNLVLFIGTVLIQN

SEQ ID NO: 3015382 - protein, 20 aa, Entamoeba invadens
RKLVFIKTRLKKIDLQSATT

SEQ ID NO: 3015383 - protein, 25 aa, Entamoeba invadens
RKLYLLRHGEPLEELLYSSFSYVTL

SEQ ID NO: 3015384 - protein, 25 aa, Entamoeba invadens
RKMIRNMKTRGFSIKEICILTDLTK

SEQ ID NO: 3015385 - protein, 25 aa, Entamoeba invadens
RKMKNEFMTLWDGLKSKNMEQIIVL

SEQ ID NO: 3015386 - protein, 22 aa, Entamoeba invadens
RKMNLFIPLQRLVEIQDFDFKS

SEQ ID NO: 3015387 - protein, 18 aa, Entamoeba invadens
RKMPKYFSDVTSVFSRHP

SEQ ID NO: 3015388 - protein, 17 aa, Entamoeba invadens
RKMQFKHFQYLHNLSKI

SEQ ID NO: 3015389 - protein, 30 aa, Entamoeba invadens
RKMQKRALRCYLRGLEYLDNDYRIPDDQKE

SEQ ID NO: 3015390 - protein, 28 aa, Entamoeba invadens
RKMTMRTLHFFVWKRYTLPNNKIVSSQT

SEQ ID NO: 3015391 - protein, 19 aa, Entamoeba invadens
RKMVSSLVLDPVITSTTLD

SEQ ID NO: 3015392 - protein, 25 aa, Entamoeba invadens
RKNDPIDFKMRVKITLDSAKGLEYL

SEQ ID NO: 3015393 - protein, 28 aa, Entamoeba invadens
RKNKDIIVLMKMRLKLMLDAARGIAYLH

SEQ ID NO: 3015394 - protein, 24 aa, Entamoeba invadens
RKNKIVYPVYIPRSKEIKERRNGL

SEQ ID NO: 3015395 - protein, 27 aa, Entamoeba invadens
RKNNKERYFYLFNDVLTYGIGDEKNMK

SEQ ID NO: 3015396 - protein, 18 aa, Entamoeba invadens
RKNPIIVRLFLMRNNEKL

SEQ ID NO: 3015397 - protein, 23 aa, Entamoeba invadens
RKNRPLFVFNLDTCPFSFGMDDQ

SEQ ID NO: 3015398 - protein, 18 aa, Entamoeba invadens
RKNVDIVLVVFDTNDIYS

SEQ ID NO: 3015399 - protein, 19 aa, Entamoeba invadens
RKNVGVWNCILGQSSYEYG

SEQ ID NO: 3015400 - protein, 25 aa, Entamoeba invadens
RKPPKYERFIRPAAMRFTKAHVTHP

SEQ ID NO: 3015401 - protein, 24 aa, Entamoeba invadens
RKQHRKEITLKNKAKNLPKAKKIN

SEQ ID NO: 3015402 - protein, 25 aa, Entamoeba invadens
RKQIDLLRFQKLERLSIIVCDMVKR

SEQ ID NO: 3015403 - protein, 19 aa, Entamoeba invadens
RKQIMWKYLHMEGNPYRDR

SEQ ID NO: 3015404 - protein, 25 aa, Entamoeba invadens
RKQSGIPFYIVYTPQYAPVQKIPTE

SEQ ID NO: 3015405 - protein, 20 aa, Entamoeba invadens
RKQVFLRRNVLVWNLKSDFT

SEQ ID NO: 3015406 - protein, 27 aa, Entamoeba invadens
RKQVLDIDFIMLLETIGQFKNKPTFTR

SEQ ID NO: 3015407 - protein, 23 aa, Entamoeba invadens
RKRDFFCIVVEPTRELAAQVIEV

SEQ ID NO: 3015408 - protein, 22 aa, Entamoeba invadens
RKREAMIHCDIGYFVGDVSIQG

SEQ ID NO: 3015409 - protein, 17 aa, Entamoeba invadens
RKRIAERSQKIIIDTEE

SEQ ID NO: 3015410 - protein, 19 aa, Entamoeba invadens
RKRKLCQPYVIAAAIRDCA

SEQ ID NO: 3015411 - protein, 17 aa, Entamoeba invadens
RKRLFYIETKDNQCFTF

SEQ ID NO: 3015412 - protein, 20 aa, Entamoeba invadens
RKRPKLAVLEEAELVRKAQE

SEQ ID NO: 3015413 - protein, 21 aa, Entamoeba invadens
RKRRNTKKKAYIKYIVELVTA

SEQ ID NO: 3015414 - protein, 22 aa, Entamoeba invadens
RKSAMFLMIAANQYFSADERLG

SEQ ID NO: 3015415 - protein, 24 aa, Entamoeba invadens
RKSAYLYYRRGLKFSWDYISQGES

SEQ ID NO: 3015416 - protein, 21 aa, Entamoeba invadens
RKSIHLIQKIDILNSVKIENY

SEQ ID NO: 3015417 - protein, 18 aa, Entamoeba invadens
RKSIQKSLILLTKNKETK

SEQ ID NO: 3015418 - protein, 17 aa, Entamoeba invadens
RKSLKRRLSATLGIGRR

SEQ ID NO: 3015419 - protein, 28 aa, Entamoeba invadens
RKSPKELKLIKMVKLLKSNFEKGNQYVK

SEQ ID NO: 3015420 - protein, 18 aa, Entamoeba invadens
RKSRPLIFTIKQSKQVSG

SEQ ID NO: 3015421 - protein, 30 aa, Entamoeba invadens
RKSSLHVLKKMLLTFMISSTFIDLNYSESQ

SEQ ID NO: 3015422 - protein, 17 aa, Entamoeba invadens
RKSVLKMAYIEVLGYEV

SEQ ID NO: 3015423 - protein, 21 aa, Entamoeba invadens
RKSWCCCLPPATTRMMLSQWR

SEQ ID NO: 3015424 - protein, 18 aa, Entamoeba invadens
RKTEFNLIPTAKQPLKEG

SEQ ID NO: 3015425 - protein, 24 aa, Entamoeba invadens
RKTKTFYSQFEILRQRSVEQKQLL

SEQ ID NO: 3015426 - protein, 23 aa, Entamoeba invadens
RKTLKLLKLRQINNAVFIRANAS

SEQ ID NO: 3015427 - protein, 18 aa, Entamoeba invadens
RKTPFYYSCMDLLTRIFV

SEQ ID NO: 3015428 - protein, 18 aa, Entamoeba invadens
RKTPNYALQFLPESLRSL

SEQ ID NO: 3015429 - protein, 27 aa, Entamoeba invadens
RKTTKSRYFFLFNDILIYGSGDQSHVS

SEQ ID NO: 3015430 - protein, 24 aa, Entamoeba invadens
RKVKLFTCVSLQTTIKKLKKLFKA

SEQ ID NO: 3015431 - protein, 17 aa, Entamoeba invadens
RKVLFDSTKDDYAVKTS

SEQ ID NO: 3015432 - protein, 24 aa, Entamoeba invadens
RKVLVFVEGKFYYEINERLEKTVR

SEQ ID NO: 3015433 - protein, 27 aa, Entamoeba invadens
RKVPKPRYFYLFNDIMMYGIESLGTVS

SEQ ID NO: 3015434 - protein, 21 aa, Entamoeba invadens
RKVQFLLFDVVQRLSPDELEV

SEQ ID NO: 3015435 - protein, 24 aa, Entamoeba invadens
RKVTIWNCTHISYLNTIWECISEV

SEQ ID NO: 3015436 - protein, 34 aa, Entamoeba invadens
RKVVQMIVSGLTKKYWLAIYRDSEAPYSNDEYLI

SEQ ID NO: 3015437 - protein, 24 aa, Entamoeba invadens
RKVYHSLFSLYDPNYLPLNEHDFL

SEQ ID NO: 3015438 - protein, 24 aa, Entamoeba invadens
RKWDPKVMFKPYPIYLLDAEKAPR

SEQ ID NO: 3015439 - protein, 26 aa, Entamoeba invadens
RKWSSTNALPSPLRQCLFVSDEDSLQ

SEQ ID NO: 3015440 - protein, 38 aa, Entamoeba invadens
RKYCEVLNKILKQLPLRYFIIPALMSQQPRLMKLSKTI

SEQ ID NO: 3015441 - protein, 26 aa, Entamoeba invadens
RKYFPNIETLLLYSPLDETFHEETFF

SEQ ID NO: 3015442 - protein, 20 aa, Entamoeba invadens
RKYTPYNNRPKSAVSSEVFS

SEQ ID NO: 3015443 - protein, 31 aa, Entamoeba invadens
RKYTTLDQFRLSFIYRLYADGISKDHINLSI

SEQ ID NO: 3015444 - protein, 31 aa, Entamoeba invadens
RLACDIFLCDRKYSYLFWEGRINQYFEGTDI

SEQ ID NO: 3015445 - protein, 18 aa, Entamoeba invadens
RLACYKFPGRQKLLVSNK

SEQ ID NO: 3015446 - protein, 22 aa, Entamoeba invadens
RLADPQLLMKMKMYMLEMDIPR

SEQ ID NO: 3015447 - protein, 25 aa, Entamoeba invadens
RLAEPKMVLLIFASGKIVFTGGKEV

SEQ ID NO: 3015448 - protein, 21 aa, Entamoeba invadens
RLALELIMEFYSCSDPPQFPI

SEQ ID NO: 3015449 - protein, 25 aa, Entamoeba invadens
RLAMDKHNIINPPSQIYTSAIKQNL

SEQ ID NO: 3015450 - protein, 17 aa, Entamoeba invadens
RLAMTIGNDVRFFETRM

SEQ ID NO: 3015451 - protein, 25 aa, Entamoeba invadens
RLCLQKWVELLKLLTDKNLLFACRD

SEQ ID NO: 3015452 - protein, 21 aa, Entamoeba invadens
RLDAEVIKFDFLEDDYSKLMY

SEQ ID NO: 3015453 - protein, 17 aa, Entamoeba invadens
RLDAKVVFTVILGTIHP

SEQ ID NO: 3015454 - protein, 19 aa, Entamoeba invadens
RLDIFRGDQIKIFPVTLSK

SEQ ID NO: 3015455 - protein, 18 aa, Entamoeba invadens
RLDRKIEFGLPDIDGRSE

SEQ ID NO: 3015456 - protein, 31 aa, Entamoeba invadens
RLDVEQVHYYPLPFAKLSIPSKVVYLDNGVL

SEQ ID NO: 3015457 - protein, 22 aa, Entamoeba invadens
RLDYFTLLVPRRFYIGGEIMTY

SEQ ID NO: 3015458 - protein, 26 aa, Entamoeba invadens
RLEKFGLYTFVFNALDMIYAKDLDGL

SEQ ID NO: 3015459 - protein, 23 aa, Entamoeba invadens
RLEKPIVFYEPIEEPKPRFLSRL

SEQ ID NO: 3015460 - protein, 32 aa, Entamoeba invadens
RLEMVYLMRVILELHYLVDMKSLLLVSKTTLS

SEQ ID NO: 3015461 - protein, 18 aa, Entamoeba invadens
RLEPFFDGILVTMKSFSL

SEQ ID NO: 3015462 - protein, 26 aa, Entamoeba invadens
RLEQDIIVPLKTYLDQFKTLEKRFET

SEQ ID NO: 3015463 - protein, 23 aa, Entamoeba invadens
RLESILRINCIVTTFVISDDKTT

SEQ ID NO: 3015464 - protein, 23 aa, Entamoeba invadens
RLESYVIDFAYLQKTKTVKVVEI

SEQ ID NO: 3015465 - protein, 34 aa, Entamoeba invadens
RLETLSTVLFRHILLFRYFPLQETIDVYEEIDRN

SEQ ID NO: 3015466 - protein, 19 aa, Entamoeba invadens
RLETLVCTYAFLRESKDDN

SEQ ID NO: 3015467 - protein, 22 aa, Entamoeba invadens
RLETVMLPLSITELSPFCFDNC

SEQ ID NO: 3015468 - protein, 19 aa, Entamoeba invadens
RLFDFKDKQWRYKWENWEK

SEQ ID NO: 3015469 - protein, 19 aa, Entamoeba invadens
RLFETSPSGLYYGYKAQAI

SEQ ID NO: 3015470 - protein, 22 aa, Entamoeba invadens
RLFGAGYIFSASAPPFTCRAAT

SEQ ID NO: 3015471 - protein, 28 aa, Entamoeba invadens
RLFHSDFKLKWNWLNLLGDEAYIVCGLS

SEQ ID NO: 3015472 - protein, 20 aa, Entamoeba invadens
RLFKSGPLDKFKGSLFQSLP

SEQ ID NO: 3015473 - protein, 18 aa, Entamoeba invadens
RLFTELSLNKFRKEQLTE

SEQ ID NO: 3015474 - protein, 26 aa, Entamoeba invadens
RLGDFKALIDCLLCKGKIVDALRLAK

SEQ ID NO: 3015475 - protein, 19 aa, Entamoeba invadens
RLHTTTCLLLRDVFRINPA

SEQ ID NO: 3015476 - protein, 20 aa, Entamoeba invadens
RLHVIKLKGIFVCFYPQNVE

SEQ ID NO: 3015477 - protein, 19 aa, Entamoeba invadens
RLIDHFIYHNHICIVTEML

SEQ ID NO: 3015478 - protein, 17 aa, Entamoeba invadens
RLIEKWSSSKVSKIVFD

SEQ ID NO: 3015479 - protein, 22 aa, Entamoeba invadens
RLIEYVHMYYVDPTTDKPHPVV

SEQ ID NO: 3015480 - protein, 18 aa, Entamoeba invadens
RLIHSAPLYQQPQQQIDE

SEQ ID NO: 3015481 - protein, 21 aa, Entamoeba invadens
RLIKELRKLYRKKKTLQRDIK

SEQ ID NO: 3015482 - protein, 23 aa, Entamoeba invadens
RLIKPYVEPLLEDLLPKLEESID

SEQ ID NO: 3015483 - protein, 17 aa, Entamoeba invadens
RLITGEHVIPYYSDEEN

SEQ ID NO: 3015484 - protein, 25 aa, Entamoeba invadens
RLKAKTTKLKRRRNIADLEQQVQDF

SEQ ID NO: 3015485 - protein, 29 aa, Entamoeba invadens
RLKEDIDNKFKQIKKYKDINYDLEQKAKD

SEQ ID NO: 3015486 - protein, 21 aa, Entamoeba invadens
RLKEFILFKATYTPESFVQRA

SEQ ID NO: 3015487 - protein, 29 aa, Entamoeba invadens
RLKEKSNVFLLLLTTIKNFYCCQLGTFPD

SEQ ID NO: 3015488 - protein, 20 aa, Entamoeba invadens
RLKEVVLPPNLNQVSSHCFE

SEQ ID NO: 3015489 - protein, 18 aa, Entamoeba invadens
RLKGFFTGVGDTFTYTLF

SEQ ID NO: 3015490 - protein, 31 aa, Entamoeba invadens
RLKGSNKHLAMAYYTLFVKPVFEIHQKSSKN

SEQ ID NO: 3015491 - protein, 26 aa, Entamoeba invadens
RLKNVKNLFIYYLGHTIRKGDTYYMI

SEQ ID NO: 3015492 - protein, 17 aa, Entamoeba invadens
RLKPEEYVLVTLSDNTT

SEQ ID NO: 3015493 - protein, 17 aa, Entamoeba invadens
RLKRINWSDITFAVGAS

SEQ ID NO: 3015494 - protein, 17 aa, Entamoeba invadens
RLKTLRRLRIMNHRLRH

SEQ ID NO: 3015495 - protein, 17 aa, Entamoeba invadens
RLKVFSNFATKCNFTSF

SEQ ID NO: 3015496 - protein, 20 aa, Entamoeba invadens
RLKVLVIGQPAVGKTSILRQ

SEQ ID NO: 3015497 - protein, 18 aa, Entamoeba invadens
RLKYVVEIFKKTPNDDAV

SEQ ID NO: 3015498 - protein, 17 aa, Entamoeba invadens
RLLDPSGFDLKTGNSKA

SEQ ID NO: 3015499 - protein, 20 aa, Entamoeba invadens
RLLDVFIFSQVNHTASVAVS

SEQ ID NO: 3015500 - protein, 19 aa, Entamoeba invadens
RLLELLNILFDPTVPEGMD

SEQ ID NO: 3015501 - protein, 18 aa, Entamoeba invadens
RLLFIKKERDMLIYGFNY

SEQ ID NO: 3015502 - protein, 22 aa, Entamoeba invadens
RLLPLILEKVKCDYLRLATYLA

SEQ ID NO: 3015503 - protein, 19 aa, Entamoeba invadens
RLLRIYQALVNLFGEARNN

SEQ ID NO: 3015504 - protein, 17 aa, Entamoeba invadens
RLLTKGHIVIVIAEGAC

SEQ ID NO: 3015505 - protein, 19 aa, Entamoeba invadens
RLLVIGGRPTINWYDLFKN

SEQ ID NO: 3015506 - protein, 19 aa, Entamoeba invadens
RLMLLHCARVVLGNGLRLL

SEQ ID NO: 3015507 - protein, 17 aa, Entamoeba invadens
RLMWYRTTNFPQRQFKN

SEQ ID NO: 3015508 - protein, 20 aa, Entamoeba invadens
RLNAALVQLVQSYALVGFTP

SEQ ID NO: 3015509 - protein, 27 aa, Entamoeba invadens
RLNDLFKLDIIFAQILCDSLIFERNSV

SEQ ID NO: 3015510 - protein, 18 aa, Entamoeba invadens
RLNFTHLNLEELCITPQP

SEQ ID NO: 3015511 - protein, 20 aa, Entamoeba invadens
RLNKIDLPTSLLKIGNECFM

SEQ ID NO: 3015512 - protein, 25 aa, Entamoeba invadens
RLNKSYAFFDFRKSGTIKELNIECV

SEQ ID NO: 3015513 - protein, 22 aa, Entamoeba invadens
RLNVEPFDSFNLLEKLVKYQKF

SEQ ID NO: 3015514 - protein, 23 aa, Entamoeba invadens
RLNYPIKVFLKRTSSTIVDLTGF

SEQ ID NO: 3015515 - protein, 17 aa, Entamoeba invadens
RLPAPTKWKIKADSPGV

SEQ ID NO: 3015516 - protein, 29 aa, Entamoeba invadens
RLPKEQQQFFIRPWRKFVLETQVDLLFKD

SEQ ID NO: 3015517 - protein, 18 aa, Entamoeba invadens
RLPRLDNMLNSHYTLICV

SEQ ID NO: 3015518 - protein, 17 aa, Entamoeba invadens
RLQARLDELTLKSKEET

SEQ ID NO: 3015519 - protein, 25 aa, Entamoeba invadens
RLQEIKKQMEYLKSIAPKSIQDTFV

SEQ ID NO: 3015520 - protein, 17 aa, Entamoeba invadens
RLQLWDSAGQERFKNIT

SEQ ID NO: 3015521 - protein, 18 aa, Entamoeba invadens
RLQMLQRKAKKEMKLKKS

SEQ ID NO: 3015522 - protein, 22 aa, Entamoeba invadens
RLQSVLMRGHRPFDGLISLDKM

SEQ ID NO: 3015523 - protein, 23 aa, Entamoeba invadens
RLREFPRALIFFSNLVNIKLQNN

SEQ ID NO: 3015524 - protein, 22 aa, Entamoeba invadens
RLREFQIILKKVGDLQGLMESF

SEQ ID NO: 3015525 - protein, 24 aa, Entamoeba invadens
RLREKIGYKILFSLNIEELSQFPP

SEQ ID NO: 3015526 - protein, 20 aa, Entamoeba invadens
RLRHFLMQKLINGDRTTLKY

SEQ ID NO: 3015527 - protein, 19 aa, Entamoeba invadens
RLRIMEEGLVLIPDITRIT

SEQ ID NO: 3015528 - protein, 25 aa, Entamoeba invadens
RLRLEKIGFVFQTYNLLATMSAYEN

SEQ ID NO: 3015529 - protein, 26 aa, Entamoeba invadens
RLRNLDVLLTLTTFYNTLSSWVGLNY

SEQ ID NO: 3015530 - protein, 21 aa, Entamoeba invadens
RLRPRFLLKYLDAEGDWVTLC

SEQ ID NO: 3015531 - protein, 32 aa, Entamoeba invadens
RLRQKKWVFHKGYQKWFRKVNDNGFTSNVSEN

SEQ ID NO: 3015532 - protein, 22 aa, Entamoeba invadens
RLRQSVFYWCDHLKSVSAPSEN

SEQ ID NO: 3015533 - protein, 20 aa, Entamoeba invadens
RLRRYSELPHRVGQSVFDTI

SEQ ID NO: 3015534 - protein, 19 aa, Entamoeba invadens
RLRSKLLEPLITFSEAQQQ

SEQ ID NO: 3015535 - protein, 26 aa, Entamoeba invadens
RLRVGYTLNFIFEENEWFPDIELSKK

SEQ ID NO: 3015536 - protein, 17 aa, Entamoeba invadens
RLSKVSFPPVIRVIGDS

SEQ ID NO: 3015537 - protein, 25 aa, Entamoeba invadens
RLSLNMSQFRRLCILKGIHPRVPPK

SEQ ID NO: 3015538 - protein, 17 aa, Entamoeba invadens
RLSSAHETILLAEEFKK

SEQ ID NO: 3015539 - protein, 31 aa, Entamoeba invadens
RLSTAKVFRYRPFSLILTMSSTWREKKGLSF

SEQ ID NO: 3015540 - protein, 18 aa, Entamoeba invadens
RLTDFFYKKFVKGGSLLS

SEQ ID NO: 3015541 - protein, 19 aa, Entamoeba invadens
RLTDVMYFGNIKKEAHILA

SEQ ID NO: 3015542 - protein, 19 aa, Entamoeba invadens
RLTEMQKSIENGENETIIS

SEQ ID NO: 3015543 - protein, 18 aa, Entamoeba invadens
RLTIDGENPLLFTESFIL

SEQ ID NO: 3015544 - protein, 19 aa, Entamoeba invadens
RLTSITIPLSVTLIGDWCF

SEQ ID NO: 3015545 - protein, 27 aa, Entamoeba invadens
RLTTQIIHFICYYIIEELISRDKIQGM

SEQ ID NO: 3015546 - protein, 18 aa, Entamoeba invadens
RLTYLGYDYLALRALSQR

SEQ ID NO: 3015547 - protein, 35 aa, Entamoeba invadens
RLVCHYNYITILPLSLLILPKLKLLGLNHNRLSQF

SEQ ID NO: 3015548 - protein, 19 aa, Entamoeba invadens
RLVDFAVFYELSASFEFFK

SEQ ID NO: 3015549 - protein, 20 aa, Entamoeba invadens
RLVDHFLYHSHLCIVTELLG

SEQ ID NO: 3015550 - protein, 18 aa, Entamoeba invadens
RLVFHFISIIDSKTSTAT

SEQ ID NO: 3015551 - protein, 31 aa, Entamoeba invadens
RLVIDATFSSPYFFHPLQLGADIVLHSASKY

SEQ ID NO: 3015552 - protein, 28 aa, Entamoeba invadens
RLVIPIVSGIFHKKLSWLKKFPKESEEL

SEQ ID NO: 3015553 - protein, 19 aa, Entamoeba invadens
RLVKKWIYSKGFSPYFNDE

SEQ ID NO: 3015554 - protein, 21 aa, Entamoeba invadens
RLVNIFHLCLLKKSDVKSQIW

SEQ ID NO: 3015555 - protein, 23 aa, Entamoeba invadens
RLVPFHVNYIKSVTTREGFFRVN

SEQ ID NO: 3015556 - protein, 22 aa, Entamoeba invadens
RLVQFTVSLIDLSLPFELDKMH

SEQ ID NO: 3015557 - protein, 18 aa, Entamoeba invadens
RLVQYRQHQAELLQKQKN

SEQ ID NO: 3015558 - protein, 19 aa, Entamoeba invadens
RLVSDFFVQTYDPTIEDSY

SEQ ID NO: 3015559 - protein, 18 aa, Entamoeba invadens
RLVSIKERKILERQFEVL

SEQ ID NO: 3015560 - protein, 17 aa, Entamoeba invadens
RLVTCMLGGEGYLTFMG

SEQ ID NO: 3015561 - protein, 21 aa, Entamoeba invadens
RLVVGLIFRKSDPLPTKYLNS

SEQ ID NO: 3015562 - protein, 28 aa, Entamoeba invadens
RLVVSPVLEYLYYLTQIGLAVSPLSNHN

SEQ ID NO: 3015563 - protein, 20 aa, Entamoeba invadens
RLVWTLLVVLFKITKNQESV

SEQ ID NO: 3015564 - protein, 26 aa, Entamoeba invadens
RLVWTNGMKYNYPGTLFYTYASNLLK

SEQ ID NO: 3015565 - protein, 17 aa, Entamoeba invadens
RLWLKYFDENGIRVLFY

SEQ ID NO: 3015566 - protein, 24 aa, Entamoeba invadens
RMAKIDLVIKDQLLQRLKSGVYGD

SEQ ID NO: 3015567 - protein, 17 aa, Entamoeba invadens
RMCFYCCVSLKKAVITK

SEQ ID NO: 3015568 - protein, 28 aa, Entamoeba invadens
RMCPSRFAHFLVTGFVPLFQSERPTGRT

SEQ ID NO: 3015569 - protein, 20 aa, Entamoeba invadens
RMDAVWNNNLTIYKLSVQIC

SEQ ID NO: 3015570 - protein, 22 aa, Entamoeba invadens
RMEAFHLLEDFVAEFGYIVINA

SEQ ID NO: 3015571 - protein, 18 aa, Entamoeba invadens
RMEFLANGLEKYLNEMVM

SEQ ID NO: 3015572 - protein, 25 aa, Entamoeba invadens
RMEPYQTLPLLKQETLLLTNIVNDI

SEQ ID NO: 3015573 - protein, 21 aa, Entamoeba invadens
RMFHFLIDDFAYNRENLKFEL

SEQ ID NO: 3015574 - protein, 29 aa, Entamoeba invadens
RMKELLEDKKDVFLLKELEVVASKEKGIV

SEQ ID NO: 3015575 - protein, 51 aa, Entamoeba invadens
RMKENMDSFRLDASDLKVLLDDKDRELKSLQLKYVALTDELKHREDVIADM

SEQ ID NO: 3015576 - protein, 18 aa, Entamoeba invadens
RMKGRYNCRLLTETPSDF

SEQ ID NO: 3015577 - protein, 17 aa, Entamoeba invadens
RMKIDVIISQRALREIY

SEQ ID NO: 3015578 - protein, 19 aa, Entamoeba invadens
RMKISDSIGFTSFMYPCCI

SEQ ID NO: 3015579 - protein, 19 aa, Entamoeba invadens
RMKLRVKMMLDCSKGILYL

SEQ ID NO: 3015580 - protein, 17 aa, Entamoeba invadens
RMKNFAFFIGRKCDNVV

SEQ ID NO: 3015581 - protein, 27 aa, Entamoeba invadens
RMLMTGGLMMELFKNALKKLTKYARNK

SEQ ID NO: 3015582 - protein, 17 aa, Entamoeba invadens
RMLQRFSELNVPCPKVL

SEQ ID NO: 3015583 - protein, 19 aa, Entamoeba invadens
RMMLSQWRPPSFVGGKQQV

SEQ ID NO: 3015584 - protein, 32 aa, Entamoeba invadens
RMMQIMFETFNVPSLFICPQAVLSLYTSGRLT

SEQ ID NO: 3015585 - protein, 18 aa, Entamoeba invadens
RMMSIISGLGRDVFLLFQ

SEQ ID NO: 3015586 - protein, 28 aa, Entamoeba invadens
RMNAVLKELWMKLFDIFTSHNTLPNNTI

SEQ ID NO: 3015587 - protein, 17 aa, Entamoeba invadens
RMNPIQITPKTKNLFKF

SEQ ID NO: 3015588 - protein, 21 aa, Entamoeba invadens
RMNTPLHYLCRVKNLKDYFSI

SEQ ID NO: 3015589 - protein, 23 aa, Entamoeba invadens
RMPTKQFFKRLVYRAPEVFSKFL

SEQ ID NO: 3015590 - protein, 17 aa, Entamoeba invadens
RMQVYLMNTLMEAITDD

SEQ ID NO: 3015591 - protein, 28 aa, Entamoeba invadens
RMSLLIETAFALTFFRDVVVARFADEPV

SEQ ID NO: 3015592 - protein, 22 aa, Entamoeba invadens
RMSWKFFESYSLYLSAQLPDVV

SEQ ID NO: 3015593 - protein, 18 aa, Entamoeba invadens
RMTILDYDFSKMNTLTYF

SEQ ID NO: 3015594 - protein, 21 aa, Entamoeba invadens
RMTLKLLSILSDFLRGRIVYR

SEQ ID NO: 3015595 - protein, 24 aa, Entamoeba invadens
RMTLNDVILLGKKIKYLQDIKQIT

SEQ ID NO: 3015596 - protein, 17 aa, Entamoeba invadens
RMTSGILILAKSADAAR

SEQ ID NO: 3015597 - protein, 20 aa, Entamoeba invadens
RMTSLLMKYSPNLNIKNKEE

SEQ ID NO: 3015598 - protein, 21 aa, Entamoeba invadens
RMVGDIFNLYIRVILDEKEKM

SEQ ID NO: 3015599 - protein, 23 aa, Entamoeba invadens
RMVHLEHLLSSIEKKMKRLEDIE

SEQ ID NO: 3015600 - protein, 18 aa, Entamoeba invadens
RMVKMPHGRPNNVGGTDL

SEQ ID NO: 3015601 - protein, 23 aa, Entamoeba invadens
RMVNHFIAKFKRKYKKDIPGNAR

SEQ ID NO: 3015602 - protein, 20 aa, Entamoeba invadens
RMYDAMQAQWFYPNYTRDEA

SEQ ID NO: 3015603 - protein, 19 aa, Entamoeba invadens
RMYPTMAPVRYIGNPQPEK

SEQ ID NO: 3015604 - protein, 21 aa, Entamoeba invadens
RNAEMLPPVPPKRKGPEKTNQ

SEQ ID NO: 3015605 - protein, 20 aa, Entamoeba invadens
RNAFTTFRHKYKPLLFDTFG

SEQ ID NO: 3015606 - protein, 20 aa, Entamoeba invadens
RNALNFVEKVYLYYTKFNID

SEQ ID NO: 3015607 - protein, 24 aa, Entamoeba invadens
RNASWKFKRFLVEKLAEGVLGCQH

SEQ ID NO: 3015608 - protein, 17 aa, Entamoeba invadens
RNCEFVFENSKMKFLKI

SEQ ID NO: 3015609 - protein, 20 aa, Entamoeba invadens
RNCKSLKEITLPKNLCYINE

SEQ ID NO: 3015610 - protein, 31 aa, Entamoeba invadens
RNCLIPLVVLQLRKGIYPPRSLILENNLEDV

SEQ ID NO: 3015611 - protein, 19 aa, Entamoeba invadens
RNCMSLVHISLPQTITLLG

SEQ ID NO: 3015612 - protein, 20 aa, Entamoeba invadens
RNCVQCLTNYYPVQQPNGEK

SEQ ID NO: 3015613 - protein, 28 aa, Entamoeba invadens
RNDCESIEWLFLAALSKKYVKGIPDRMV

SEQ ID NO: 3015614 - protein, 22 aa, Entamoeba invadens
RNDGCCFWFCRSKCHKSFKMKR

SEQ ID NO: 3015615 - protein, 17 aa, Entamoeba invadens
RNDIFGSPLFLSNVCFN

SEQ ID NO: 3015616 - protein, 22 aa, Entamoeba invadens
RNDLFVKLVMDTAMYYGDAEKI

SEQ ID NO: 3015617 - protein, 27 aa, Entamoeba invadens
RNDNFLGSVYFDLFPRKGKRSGGYHEI

SEQ ID NO: 3015618 - protein, 32 aa, Entamoeba invadens; identical to SEQ ID NO: 2965105

SEQ ID NO: 3015619 - protein, 31 aa, Entamoeba invadens
RNECLKCNINYYLKLGKCYPCNSFDANCVEC

SEQ ID NO: 3015620 - protein, 18 aa, Entamoeba invadens
RNEFQPIILPKNLHVNKL

SEQ ID NO: 3015621 - protein, 46 aa, Entamoeba invadens
RNENVRFEPFVYLQLALPQQPKVIKFIIFDRYLKHIKSFEIDVTYK

SEQ ID NO: 3015622 - protein, 25 aa, Entamoeba invadens
RNEYINRILEVVFKYGKNRKMFFSS

SEQ ID NO: 3015623 - protein, 17 aa, Entamoeba invadens
RNFCFFKCANLCYLTIP

SEQ ID NO: 3015624 - protein, 21 aa, Entamoeba invadens
RNFIYEKINIKNGTKILLVLC

SEQ ID NO: 3015625 - protein, 19 aa, Entamoeba invadens
RNFSRFLFGGRIVVVGGDF

SEQ ID NO: 3015626 - protein, 20 aa, Entamoeba invadens
RNGFFVVIQDKGGNLIGGFV

SEQ ID NO: 3015627 - protein, 22 aa, Entamoeba invadens
RNGFVLVISTKGFDTIFGCVVT

SEQ ID NO: 3015628 - protein, 20 aa, Entamoeba invadens
RNGILFIDPPDEGSLGDKIS

SEQ ID NO: 3015629 - protein, 24 aa, Entamoeba invadens
RNGKPLCFTVFSAPGYYDDNKAAV

SEQ ID NO: 3015630 - protein, 20 aa, Entamoeba invadens
RNGNPRWKWQRYMKHMKINY

SEQ ID NO: 3015631 - protein, 17 aa, Entamoeba invadens
RNGNWLCNTNENCYIYD

SEQ ID NO: 3015632 - protein, 21 aa, Entamoeba invadens
RNGVAFGCKLGTYLTNQNTCD

SEQ ID NO: 3015633 - protein, 20 aa, Entamoeba invadens
RNGYCTGCLSNYVFVSSTSM

SEQ ID NO: 3015634 - protein, 25 aa, Entamoeba invadens
RNHDSAELKVFFSQATFATRRRRER

SEQ ID NO: 3015635 - protein, 17 aa, Entamoeba invadens
RNHMRKVGVTSFKKISM

SEQ ID NO: 3015636 - protein, 40 aa, Entamoeba invadens
RNHMRKVGVTSFKKISMINFLIFHFGYDWKEVVNAPQGGN

SEQ ID NO: 3015637 - protein, 23 aa, Entamoeba invadens
RNIEFTYTFKNCQTLLMIFESHI

SEQ ID NO: 3015638 - protein, 27 aa, Entamoeba invadens
RNIGEMSFFCFYLLVSAFLTSNLQIDK

SEQ ID NO: 3015639 - protein, 20 aa, Entamoeba invadens
RNIIFKNMTFTRSDRILFGE

SEQ ID NO: 3015640 - protein, 20 aa, Entamoeba invadens
RNIQMMVRRNFKDITVITVA

SEQ ID NO: 3015641 - protein, 17 aa, Entamoeba invadens
RNITSSYYRGTHGCLIV

SEQ ID NO: 3015642 - protein, 27 aa, Entamoeba invadens
RNKEVNIMLMRFFSSVGIPFSQIRNPF

SEQ ID NO: 3015643 - protein, 22 aa, Entamoeba invadens
RNKFKLKLHPKVVFLKLERSCV

SEQ ID NO: 3015644 - protein, 20 aa, Entamoeba invadens
RNKFMTMITQCFFNFYDISH

SEQ ID NO: 3015645 - protein, 18 aa, Entamoeba invadens
RNKMKPTPLVPKNKKDDF

SEQ ID NO: 3015646 - protein, 30 aa, Entamoeba invadens
RNKMPNSHYNLFLYMIAFLKEIVKVNSNVT

SEQ ID NO: 3015647 - protein, 28 aa, Entamoeba invadens
RNKNVIGHQFFWFLKAEVHDPRVTERYG

SEQ ID NO: 3015648 - protein, 24 aa, Entamoeba invadens
RNKQKMVLYLRFNSQKLKCPKILN

SEQ ID NO: 3015649 - protein, 23 aa, Entamoeba invadens
RNKTYLFNPVIAEYFSVLNNQKV

SEQ ID NO: 3015650 - protein, 25 aa, Entamoeba invadens
RNKYIFFKIVVWYNVDYNTFVINKN

SEQ ID NO: 3015651 - protein, 17 aa, Entamoeba invadens
RNLFPSINTLLLEGGEV

SEQ ID NO: 3015652 - protein, 25 aa, Entamoeba invadens
RNLKTMTMAQLFKEFKLDTATVEFV

SEQ ID NO: 3015653 - protein, 29 aa, Entamoeba invadens
RNLNMFVSTYFKVERMLLGFTVAEPNFCA

SEQ ID NO: 3015654 - protein, 25 aa, Entamoeba invadens
RNLQTYLECTILAILSYNTEIQLIK

SEQ ID NO: 3015655 - protein, 20 aa, Entamoeba invadens
RNLTIWVESIPRTVINQEGG

SEQ ID NO: 3015656 - protein, 18 aa, Entamoeba invadens
RNMDGVPLVHVIIEHPIK

SEQ ID NO: 3015657 - protein, 23 aa, Entamoeba invadens
RNMDRGFLISVHLRKIIEIIEEK

SEQ ID NO: 3015658 - protein, 24 aa, Entamoeba invadens
RNMDRGLLISVHLRKIIEIIEEKT

SEQ ID NO: 3015659 - protein, 19 aa, Entamoeba invadens
RNMEEECSPAFFKFMALIG

SEQ ID NO: 3015660 - protein, 25 aa, Entamoeba invadens
RNMIEFLTIFDGFFLKKAPKMKSLE

SEQ ID NO: 3015661 - protein, 24 aa, Entamoeba invadens
RNMIEKYYPMLTLDFNTNKRVVDE

SEQ ID NO: 3015662 - protein, 25 aa, Entamoeba invadens
RNMITCLECCLIGLLSHKCSLHISK

SEQ ID NO: 3015663 - protein, 23 aa, Entamoeba invadens
RNNAFFHIGLLLATPNQNNLKKM

SEQ ID NO: 3015664 - protein, 21 aa, Entamoeba invadens
RNNFLMPCATLNPLLMNMNDK

SEQ ID NO: 3015665 - protein, 30 aa, Entamoeba invadens; identical to SEQ ID NO: 2985131

SEQ ID NO: 3015666 - protein, 26 aa, Entamoeba invadens
RNNNNTGYLFLTPKKDVKLARVVDGA

SEQ ID NO: 3015667 - protein, 22 aa, Entamoeba invadens
RNNWIVCVNTLVKPQGINLSCV

SEQ ID NO: 3015668 - protein, 19 aa, Entamoeba invadens
RNPIICGVKILRGTLKMGC

SEQ ID NO: 3015669 - protein, 21 aa, Entamoeba invadens
RNPRDLGVLTKSPLLDVPQSQ

SEQ ID NO: 3015670 - protein, 18 aa, Entamoeba invadens
RNQHNSIFGFFTQSDIVP

SEQ ID NO: 3015671 - protein, 33 aa, Entamoeba invadens; identical to SEQ ID NO: 2725565

SEQ ID NO: 3015672 - protein, 20 aa, Entamoeba invadens
RNQVLLFDDKLRIVADYAGR

SEQ ID NO: 3015673 - protein, 17 aa, Entamoeba invadens
RNRIELDEGERKKLQEE

SEQ ID NO: 3015674 - protein, 23 aa, Entamoeba invadens
RNRLDWVYCFQNDTFVKCGKEDI

SEQ ID NO: 3015675 - protein, 27 aa, Entamoeba invadens
RNRLFDRIACLILYEDALDKVKQAKIT

SEQ ID NO: 3015676 - protein, 18 aa, Entamoeba invadens
RNRNMIKLMTAAMKGTDH

SEQ ID NO: 3015677 - protein, 25 aa, Entamoeba invadens
RNRNNLTFTFQKKADLRLIASPDFE

SEQ ID NO: 3015678 - protein, 19 aa, Entamoeba invadens
RNRNYPTQKIILGGTDILN

SEQ ID NO: 3015679 - protein, 22 aa, Entamoeba invadens
RNRSAYFRQGMLEIAILELLND

SEQ ID NO: 3015680 - protein, 25 aa, Entamoeba invadens
RNRSAYFRQGMLEIAILELLNDKFD

SEQ ID NO: 3015681 - protein, 20 aa, Entamoeba invadens
RNRSCVLFMFDLTSSETLSH

SEQ ID NO: 3015682 - protein, 21 aa, Entamoeba invadens
RNRVMVVLAAENHFFGLYTSK

SEQ ID NO: 3015683 - protein, 18 aa, Entamoeba invadens
RNRYKVLAVNRKLSCFSV

SEQ ID NO: 3015684 - protein, 17 aa, Entamoeba invadens
RNRYRFLKYLHDNQHKF

SEQ ID NO: 3015685 - protein, 18 aa, Entamoeba invadens
RNSFYTHCKSIMDLNSFG

SEQ ID NO: 3015686 - protein, 21 aa, Entamoeba invadens
RNSLLEYGFPTRIKDGAWIGT

SEQ ID NO: 3015687 - protein, 25 aa, Entamoeba invadens
RNSMNRLLLLSFKTPSTLGTNSEIG

SEQ ID NO: 3015688 - protein, 19 aa, Entamoeba invadens
RNSSTEKVIFFVSKNKEIG

SEQ ID NO: 3015689 - protein, 19 aa, Entamoeba invadens
RNTAFFTFSFCESTKNEKT

SEQ ID NO: 3015690 - protein, 19 aa, Entamoeba invadens
RNTFFNREQFCQIVSDALY

SEQ ID NO: 3015691 - protein, 27 aa, Entamoeba invadens
RNTYDETLWQIFMKKTATLGKIVDGKD

SEQ ID NO: 3015692 - protein, 25 aa, Entamoeba invadens
RNVFVFTNNFLLDLCTEIGYVFNTR

SEQ ID NO: 3015693 - protein, 21 aa, Entamoeba invadens
RNVFWQQKSFARELSLFPKLR

SEQ ID NO: 3015694 - protein, 17 aa, Entamoeba invadens
RNVIPLVLFYKQSNNEL

SEQ ID NO: 3015695 - protein, 26 aa, Entamoeba invadens
RNVISWQYICRVIFYCLSVVHKKNGY

SEQ ID NO: 3015696 - protein, 17 aa, Entamoeba invadens
RNVLVKTLLKKVNNKMT

SEQ ID NO: 3015697 - protein, 17 aa, Entamoeba invadens
RNVSSFVRKLLISTKKT

SEQ ID NO: 3015698 - protein, 19 aa, Entamoeba invadens
RNVTLPNSLIWLKNSVFES

SEQ ID NO: 3015699 - protein, 21 aa, Entamoeba invadens
RNVVWKYLFNYIPSEVSRVDK

SEQ ID NO: 3015700 - protein, 29 aa, Entamoeba invadens
RNYLSCEQAFFLVLLNKKYDFVICKPTKR

SEQ ID NO: 3015701 - protein, 30 aa, Entamoeba invadens
RNYQVYQEAVFIALLSTFFEIVVRAPVKKS

SEQ ID NO: 3015702 - protein, 24 aa, Entamoeba invadens
RNYVDSQCLLYTLPMIEGGTMGTK

SEQ ID NO: 3015703 - protein, 23 aa, Entamoeba invadens
RNYYTEIIKKLPPSSLVITCGCG

SEQ ID NO: 3015704 - protein, 21 aa, Entamoeba invadens
RPAIVMFVGFYHKKFERTVLR

SEQ ID NO: 3015705 - protein, 18 aa, Entamoeba invadens
RPALLTRQRTFTRNGDMN

SEQ ID NO: 3015706 - protein, 19 aa, Entamoeba invadens
RPARKPVDISTLPKWSDLK

SEQ ID NO: 3015707 - protein, 23 aa, Entamoeba invadens
RPDDHSKLSYVNYFLSGITADNV

SEQ ID NO: 3015708 - protein, 29 aa, Entamoeba invadens
RPDDIFARILCKNLIFFDKIEKSEAWIFA

SEQ ID NO: 3015709 - protein, 25 aa, Entamoeba invadens
RPDEKLAQPILLLNGVVIPTRIGSQ

SEQ ID NO: 3015710 - protein, 22 aa, Entamoeba invadens
RPDGVLILMDAFNSINFKAISF

SEQ ID NO: 3015711 - protein, 25 aa, Entamoeba invadens
RPDKKLSFSFFRRKKETPKLTEDSV

SEQ ID NO: 3015712 - protein, 21 aa, Entamoeba invadens
RPDTPIPPYSFSQKIEWGDNC

SEQ ID NO: 3015713 - protein, 30 aa, Entamoeba invadens
RPEAFEIMEMPFFKSVNVLIASLKGLAEDE

SEQ ID NO: 3015714 - protein, 20 aa, Entamoeba invadens
RPEDILYAGLRTKVLKVRTT

SEQ ID NO: 3015715 - protein, 20 aa, Entamoeba invadens
RPEEWEIDFGESAFMYMVRL

SEQ ID NO: 3015716 - protein, 22 aa, Entamoeba invadens
RPEFELVALNDPFMNPKYMEYM

SEQ ID NO: 3015717 - protein, 25 aa, Entamoeba invadens
RPEKEIFSLFRLFLDEHPIPIHLGI

SEQ ID NO: 3015718 - protein, 17 aa, Entamoeba invadens
RPENPMLIAIREFCFKP

SEQ ID NO: 3015719 - protein, 24 aa, Entamoeba invadens
RPERHFQLILNDPDYSYLHSDLTQ

SEQ ID NO: 3015720 - protein, 24 aa, Entamoeba invadens
RPEWDIHCYAIAPAPIFGENLATN

SEQ ID NO: 3015721 - protein, 20 aa, Entamoeba invadens
RPEYRNFLSVIYKWVDEMLK

SEQ ID NO: 3015722 - protein, 24 aa, Entamoeba invadens
RPFALKLAKVPCFIMKSSGFVEKE

SEQ ID NO: 3015723 - protein, 19 aa, Entamoeba invadens
RPFVMELHNPRKVALSEEE

SEQ ID NO: 3015724 - protein, 25 aa, Entamoeba invadens
RPIERLWESYLGKYLPIVPVLQNIV

SEQ ID NO: 3015725 - protein, 18 aa, Entamoeba invadens
RPIERVYLYDAYAKDLTN

SEQ ID NO: 3015726 - protein, 18 aa, Entamoeba invadens
RPIIAGCYSGINAMISIG

SEQ ID NO: 3015727 - protein, 19 aa, Entamoeba invadens
RPILLITNRNHDISAGLLH

SEQ ID NO: 3015728 - protein, 19 aa, Entamoeba invadens
RPILRLEGLKHLDLSHNKL

SEQ ID NO: 3015729 - protein, 29 aa, Entamoeba invadens
RPKINELILPLHYYFKNLFDKMSTLQILK

SEQ ID NO: 3015730 - protein, 18 aa, Entamoeba invadens
RPKNVEFILTKAGDSKGI

SEQ ID NO: 3015731 - protein, 18 aa, Entamoeba invadens
RPKRIKYFQDNYGFTCDC

SEQ ID NO: 3015732 - protein, 17 aa, Entamoeba invadens
RPKTTFLGRGRPPIPLA

SEQ ID NO: 3015733 - protein, 17 aa, Entamoeba invadens
RPKWCLYTSQRILEELL

SEQ ID NO: 3015734 - protein, 20 aa, Entamoeba invadens
RPLDVPLKIDLFLQCCERIQ

SEQ ID NO: 3015735 - protein, 20 aa, Entamoeba invadens
RPLEVLVNYCLEKAVEESLT

SEQ ID NO: 3015736 - protein, 18 aa, Entamoeba invadens
RPLKKYVTVIPSSLETQL

SEQ ID NO: 3015737 - protein, 21 aa, Entamoeba invadens
RPLSYVSTDCFMICFSVDDSD

SEQ ID NO: 3015738 - protein, 27 aa, Entamoeba invadens
RPMFENLSSLFKIFCIPKSQVLDITTA

SEQ ID NO: 3015739 - protein, 19 aa, Entamoeba invadens
RPMLSQEIDFFFGNYSYFV

SEQ ID NO: 3015740 - protein, 27 aa, Entamoeba invadens
RPNEAFEFTLEFTPLCTCKVSEAIFLV

SEQ ID NO: 3015741 - protein, 34 aa, Entamoeba invadens
RPNFREPKFRDIFLLMFRLFTTPECFLAYLLPQS

SEQ ID NO: 3015742 - protein, 26 aa, Entamoeba invadens
RPNKEKPICDFFFKIGACRHGDSCKK

SEQ ID NO: 3015743 - protein, 20 aa, Entamoeba invadens
RPNLLFINYDDKGNVFGVFV

SEQ ID NO: 3015744 - protein, 17 aa, Entamoeba invadens
RPNYITRTIFVKYSKKE

SEQ ID NO: 3015745 - protein, 23 aa, Entamoeba invadens
RPRSLMSAFRFVNNRNYSVIPPF

SEQ ID NO: 3015746 - protein, 19 aa, Entamoeba invadens
RPTGSFMFLGPSGVGKTEL

SEQ ID NO: 3015747 - protein, 20 aa, Entamoeba invadens
RPTGSFMFLGPSGVGKTELA

SEQ ID NO: 3015748 - protein, 18 aa, Entamoeba invadens
RPTINWYDLFKNCKIGKA

SEQ ID NO: 3015749 - protein, 17 aa, Entamoeba invadens
RPTMISYGIKSIRSIFG

SEQ ID NO: 3015750 - protein, 21 aa, Entamoeba invadens
RPVCRRAETISFLFPTGGNAN

SEQ ID NO: 3015751 - protein, 32 aa, Entamoeba invadens
RPYDRLLMRMSEGIAIVPRRKPRRQFPHMKAG

SEQ ID NO: 3015752 - protein, 33 aa, Entamoeba invadens
RQAQNYDLIFRNTQICLVVFDPHDPKSFEDVNT

SEQ ID NO: 3015753 - protein, 25 aa, Entamoeba invadens
RQCLKQLENDHILYLFLADDCDEED

SEQ ID NO: 3015754 - protein, 18 aa, Entamoeba invadens
RQDATSVLYLFAKANYQV

SEQ ID NO: 3015755 - protein, 19 aa, Entamoeba invadens
RQEKSEIDLQRTETLSALE

SEQ ID NO: 3015756 - protein, 24 aa, Entamoeba invadens
RQELPPHIFALAEETYRAMKNEKS

SEQ ID NO: 3015757 - protein, 31 aa, Entamoeba invadens
RQFQTFEADILFVLRYMIDAGIVGCSWVKAP

SEQ ID NO: 3015758 - protein, 20 aa, Entamoeba invadens
RQFSLNHYIVAFDSMFSGEF

SEQ ID NO: 3015759 - protein, 26 aa, Entamoeba invadens
RQFYQIRVHFPVTYERSLLAKNSRFV

SEQ ID NO: 3015760 - protein, 23 aa, Entamoeba invadens
RQGDMFGLLANLGMDVNCVNEDG

SEQ ID NO: 3015761 - protein, 17 aa, Entamoeba invadens
RQGELFPEHTCPYVFVY

SEQ ID NO: 3015762 - protein, 17 aa, Entamoeba invadens
RQGMLEIAILELLNDKF

SEQ ID NO: 3015763 - protein, 18 aa, Entamoeba invadens
RQGMLEITVLTILNDFYN

SEQ ID NO: 3015764 - protein, 22 aa, Entamoeba invadens
RQHFEYQMLIVNELKIWRETVL

SEQ ID NO: 3015765 - protein, 25 aa, Entamoeba invadens
RQIKSVRAPILTMTYMKIDIDLNFA

SEQ ID NO: 3015766 - protein, 22 aa, Entamoeba invadens
RQILPVKTMYPPKLSLLMVRVS

SEQ ID NO: 3015767 - protein, 25 aa, Entamoeba invadens
RQILSKIYYIGLYIENDKYEPTCKF

SEQ ID NO: 3015768 - protein, 29 aa, Entamoeba invadens
RQKDKEFIYVLNKIRYGTVDEWCLNKLRE

SEQ ID NO: 3015769 - protein, 35 aa, Entamoeba invadens
RQKKKEWRLLAWSIYKDYYHSVALFNQKKLKESFT

SEQ ID NO: 3015770 - protein, 25 aa, Entamoeba invadens
RQKVESFFDLFYSPALPEDFNPEDE

SEQ ID NO: 3015771 - protein, 17 aa, Entamoeba invadens
RQKYPNVVDGAWASSAP

SEQ ID NO: 3015772 - protein, 22 aa, Entamoeba invadens
RQLDLIITDKFKLVVLLGMTVD

SEQ ID NO: 3015773 - protein, 26 aa, Entamoeba invadens
RQLGGFTFYQRFYAKWGWDMSTVPQH

SEQ ID NO: 3015774 - protein, 20 aa, Entamoeba invadens
RQLICNYFDKYMPFNIVMTS

SEQ ID NO: 3015775 - protein, 20 aa, Entamoeba invadens
RQMSILFQPVLNTINYPCFV

SEQ ID NO: 3015776 - protein, 31 aa, Entamoeba invadens
RQMTDMIGCPIFMIHFPSKMKAFYMSKVPGH

SEQ ID NO: 3015777 - protein, 26 aa, Entamoeba invadens
RQNNLCSKFLMTFSRSVARKFFKDTF

SEQ ID NO: 3015778 - protein, 21 aa, Entamoeba invadens
RQNPQMVFQLIENGMGQMDEE

SEQ ID NO: 3015779 - protein, 19 aa, Entamoeba invadens
RQNVFLGCLPYLPKESQLV

SEQ ID NO: 3015780 - protein, 18 aa, Entamoeba invadens
RQPKWMNRSCGCAFGFGG

SEQ ID NO: 3015781 - protein, 18 aa, Entamoeba invadens
RQPPKYQLKLNLFNGGEK

SEQ ID NO: 3015782 - protein, 27 aa, Entamoeba invadens
RQQEEEERIAFFNRVMQANPNADQEKI

SEQ ID NO: 3015783 - protein, 24 aa, Entamoeba invadens
RQQMKRLLFPIYSELGYNVQLGES

SEQ ID NO: 3015784 - protein, 19 aa, Entamoeba invadens
RQREFCQCDFDIAGEYDPM

SEQ ID NO: 3015785 - protein, 17 aa, Entamoeba invadens
RQRICQLSFETFNFSHF

SEQ ID NO: 3015786 - protein, 19 aa, Entamoeba invadens
RQSLLFFYSDTDEVVKTME

SEQ ID NO: 3015787 - protein, 23 aa, Entamoeba invadens
RQTALFVLGLINNVPQILFETLD

SEQ ID NO: 3015788 - protein, 18 aa, Entamoeba invadens
RQTALNVLDLRKGSPQEG

SEQ ID NO: 3015789 - protein, 25 aa, Entamoeba invadens
RQTKNIYHFPGTEAGFDSIKEYKLM

SEQ ID NO: 3015790 - protein, 25 aa, Entamoeba invadens
RQTNNSWLAWLWPHQNVQNEEEEYV

SEQ ID NO: 3015791 - protein, 25 aa, Entamoeba invadens
RQTTYKVTYPLAYLIDLCKANGFNV

SEQ ID NO: 3015792 - protein, 24 aa, Entamoeba invadens
RRAGFAYRAPFARFLQTYKKLSQK

SEQ ID NO: 3015793 - protein, 26 aa, Entamoeba invadens
RRATTDNIILAFNKCGFYNVASGKVL

SEQ ID NO: 3015794 - protein, 17 aa, Entamoeba invadens
RRCTKLNSPRKSKKSEN

SEQ ID NO: 3015795 - protein, 23 aa, Entamoeba invadens
RRCTKYMDMFINNAGQCVKIAKC

SEQ ID NO: 3015796 - protein, 26 aa, Entamoeba invadens
RRCTTLLSLLELLSIFHMVDLLQCCY

SEQ ID NO: 3015797 - protein, 19 aa, Entamoeba invadens
RRDAIFYFTPHGDISSAMN

SEQ ID NO: 3015798 - protein, 20 aa, Entamoeba invadens
RRDAYHLHRPLRFTVDKIVE

SEQ ID NO: 3015799 - protein, 24 aa, Entamoeba invadens
RRDGRFLFVQQALKILRQVSEIDR

SEQ ID NO: 3015800 - protein, 24 aa, Entamoeba invadens
RRDKTPMIFFVNPKSGNLLGEFLQ

SEQ ID NO: 3015801 - protein, 23 aa, Entamoeba invadens
RRDPKLLFKSFTSIGKGGFGEVF

SEQ ID NO: 3015802 - protein, 17 aa, Entamoeba invadens
RRDRREPKLWGERYEKY

SEQ ID NO: 3015803 - protein, 27 aa, Entamoeba invadens
RREAYHLLEDFLFMFGIVIVGGKDERD

SEQ ID NO: 3015804 - protein, 25 aa, Entamoeba invadens
RREDLECISILYGLIARLVKYAQIH

SEQ ID NO: 3015805 - protein, 26 aa, Entamoeba invadens
RREEMRFLQDILFEFGYYVEISSETI

SEQ ID NO: 3015806 - protein, 30 aa, Entamoeba invadens
RREKFYETYQQLSLIALLSKYCSFEIKPSK

SEQ ID NO: 3015807 - protein, 19 aa, Entamoeba invadens
RRELCVRHIQEFLGLRLQK

SEQ ID NO: 3015808 - protein, 19 aa, Entamoeba invadens
RREMIIFNGLFVLYNETSN

SEQ ID NO: 3015809 - protein, 18 aa, Entamoeba invadens
RREPFRYSKKYLNKLRDY

SEQ ID NO: 3015810 - protein, 25 aa, Entamoeba invadens
RREVVRLLMDILLEFGYVVIAENET

SEQ ID NO: 3015811 - protein, 19 aa, Entamoeba invadens
RRFKLKQNGFMSQTLCLGT

SEQ ID NO: 3015812 - protein, 33 aa, Entamoeba invadens
RRFKRKVKPMLANTVPYYLYSPGMTMGKLELEI

SEQ ID NO: 3015813 - protein, 20 aa, Entamoeba invadens
RRFKYRYILSRYRFSAYRQK

SEQ ID NO: 3015814 - protein, 25 aa, Entamoeba invadens
RRFPRYNNPLKLLKTRVGRCGEYAN

SEQ ID NO: 3015815 - protein, 18 aa, Entamoeba invadens
RRFSDPAIQEDMKHWSFT

SEQ ID NO: 3015816 - protein, 28 aa, Entamoeba invadens
RRGGDVYRQLLFLDYLNGVSIDFQQHVF

SEQ ID NO: 3015817 - protein, 20 aa, Entamoeba invadens
RRGMAPIDDQEFKPLCSMPK

SEQ ID NO: 3015818 - protein, 24 aa, Entamoeba invadens
RRGTLMQLYTWSGNSPCVFARIMF

SEQ ID NO: 3015819 - protein, 26 aa, Entamoeba invadens
RRIINPEFAAMYVYLLRPGEGMIYTA

SEQ ID NO: 3015820 - protein, 26 aa, Entamoeba invadens
RRIKRMYEHYYPNPGYFQGFGDIVTV

SEQ ID NO: 3015821 - protein, 18 aa, Entamoeba invadens
RRINDNVLPILYGDLFYS

SEQ ID NO: 3015822 - protein, 32 aa, Entamoeba invadens
RRINMIMQTVFFKLADILPFETAVKLLKEAVQ

SEQ ID NO: 3015823 - protein, 32 aa, Entamoeba invadens
RRINMIMQTVFFKLADILPFETAVKLLKEAVV

SEQ ID NO: 3015824 - protein, 19 aa, Entamoeba invadens
RRIPTLITVPAVCLSLGLG

SEQ ID NO: 3015825 - protein, 27 aa, Entamoeba invadens
RRISEWIDFKTTILLCPMRPNKADSNP

SEQ ID NO: 3015826 - protein, 31 aa, Entamoeba invadens
RRISRWNVRILYDLLDIAALNAYKVYHHHHD

SEQ ID NO: 3015827 - protein, 22 aa, Entamoeba invadens
RRIVCIVDSFFAKARPEIIKSF

SEQ ID NO: 3015828 - protein, 24 aa, Entamoeba invadens
RRKDGDVFVPKHANDAYTPPREQR

SEQ ID NO: 3015829 - protein, 26 aa, Entamoeba invadens
RRKEEWHPYLLFCKMNRESLSTEGIS

SEQ ID NO: 3015830 - protein, 28 aa, Entamoeba invadens
RRKHDYMPLALHVLLLMGKYGKLEQQVT

SEQ ID NO: 3015831 - protein, 24 aa, Entamoeba invadens
RRKNCVEAHNPGCAFSYVLGAEWV

SEQ ID NO: 3015832 - protein, 24 aa, Entamoeba invadens
RRKTVYAYYINYKVAIENIVFKYA

SEQ ID NO: 3015833 - protein, 25 aa, Entamoeba invadens
RRLAKKFPEIRRKIKTDPGVPHLCA

SEQ ID NO: 3015834 - protein, 25 aa, Entamoeba invadens
RRLALHLFEDLLLEDGFLITTHKEN

SEQ ID NO: 3015835 - protein, 22 aa, Entamoeba invadens
RRLDEEYTRELKIKRVEEVQKS

SEQ ID NO: 3015836 - protein, 25 aa, Entamoeba invadens
RRLGSEAFIVYRRSAKEMPATPNEV

SEQ ID NO: 3015837 - protein, 22 aa, Entamoeba invadens
RRLGVFFEINVYPLLSQPPLDE

SEQ ID NO: 3015838 - protein, 17 aa, Entamoeba invadens
RRLLHILDELREKRRII

SEQ ID NO: 3015839 - protein, 23 aa, Entamoeba invadens
RRLQTLIHYLKTTKDKKIVVFVL

SEQ ID NO: 3015840 - protein, 23 aa, Entamoeba invadens
RRLSLLKDTYKVFFNVRGAEKMS

SEQ ID NO: 3015841 - protein, 22 aa, Entamoeba invadens
RRLVQRLIPSTFENFIIYICEE

SEQ ID NO: 3015842 - protein, 25 aa, Entamoeba invadens
RRLYDTYLVILLAQILQVFLSTKFI

SEQ ID NO: 3015843 - protein, 19 aa, Entamoeba invadens
RRMGLRYVLMKVKGYTDLS

SEQ ID NO: 3015844 - protein, 19 aa, Entamoeba invadens
RRNIARLLTFMNTQRKNQL

SEQ ID NO: 3015845 - protein, 24 aa, Entamoeba invadens
RRNPLKNWAAMVKLNPYCKIASMR

SEQ ID NO: 3015846 - protein, 27 aa, Entamoeba invadens
RRQEAVYLLLDILHQYNTYFIFEKEES

SEQ ID NO: 3015847 - protein, 31 aa, Entamoeba invadens
RRQSLVVNTLKYVYFRVERLMTTTLSHLIDQ

SEQ ID NO: 3015848 - protein, 17 aa, Entamoeba invadens
RRRIWARKKVGKLELQE

SEQ ID NO: 3015849 - protein, 19 aa, Entamoeba invadens
RRRKKVKIHLFGDEETKKA

SEQ ID NO: 3015850 - protein, 24 aa, Entamoeba invadens
RRRKRHEFRMNPLLSIFGVTEQKT

SEQ ID NO: 3015851 - protein, 26 aa, Entamoeba invadens
RRRLVKRLYIPLPDLEARNVLVKTLL

SEQ ID NO: 3015852 - protein, 17 aa, Entamoeba invadens
RRRMWAAKHTEPFPEDD

SEQ ID NO: 3015853 - protein, 26 aa, Entamoeba invadens
RRRNNNWTDLYWRDVMNDEALVVKGT

SEQ ID NO: 3015854 - protein, 21 aa, Entamoeba invadens
RRRPTMIGDMPKYSNFSLLTQ

SEQ ID NO: 3015855 - protein, 21 aa, Entamoeba invadens
RRRQSFYPKETITHAKRLIGI

SEQ ID NO: 3015856 - protein, 23 aa, Entamoeba invadens
RRRRKFNMPMTPSSSSIVTTPTT

SEQ ID NO: 3015857 - protein, 20 aa, Entamoeba invadens
RRRVVGQLNKCIKIFEQKRK

SEQ ID NO: 3015858 - protein, 20 aa, Entamoeba invadens
RRSHGILPEDVIKCALAATC

SEQ ID NO: 3015859 - protein, 20 aa, Entamoeba invadens
RRSIVLYEEGGITDWFVEVF

SEQ ID NO: 3015860 - protein, 25 aa, Entamoeba invadens
RRSQKTLQLFLIEELKTPMDGAIPF

SEQ ID NO: 3015861 - protein, 37 aa, Entamoeba invadens
RRTADDMALSLQTLKNLSTQLKILCSVKAATVGNGDM

SEQ ID NO: 3015862 - protein, 18 aa, Entamoeba invadens
RRTGWNDVAYLLIRSQVL

SEQ ID NO: 3015863 - protein, 25 aa, Entamoeba invadens
RRTNRWNIWALYDMIDIAALNAYKT

SEQ ID NO: 3015864 - protein, 31 aa, Entamoeba invadens
RRTSRWNVRILYDLLDIAALNAYKVYHHHHN

SEQ ID NO: 3015865 - protein, 30 aa, Entamoeba invadens
RRTSRWNVRILYDLLDIAALNAYKVYHYHH

SEQ ID NO: 3015866 - protein, 30 aa, Entamoeba invadens
RRTSRWNVRILYDLLDIAALNVYKVYHHHH

SEQ ID NO: 3015867 - protein, 24 aa, Entamoeba invadens
RRTVRKSLMLNEKTRRMTVAIQNE

SEQ ID NO: 3015868 - protein, 18 aa, Entamoeba invadens
RRVCFVDCKDLKISSSDT

SEQ ID NO: 3015869 - protein, 21 aa, Entamoeba invadens
RRVISFVDFLKTSSDEIQRYF

SEQ ID NO: 3015870 - protein, 26 aa, Entamoeba invadens
RRVSFYTLKVPIYFMMKKVESIEPRQ

SEQ ID NO: 3015871 - protein, 21 aa, Entamoeba invadens
RRWDWRGNVIKYNYISNVIGW

SEQ ID NO: 3015872 - protein, 20 aa, Entamoeba invadens
RRYSDFLKLFELLCERYDED

SEQ ID NO: 3015873 - protein, 21 aa, Entamoeba invadens
RSAFFLAYLVQNPMKREQALL

SEQ ID NO: 3015874 - protein, 24 aa, Entamoeba invadens
RSASIVIAYLMKTFRWSYETALNH

SEQ ID NO: 3015875 - protein, 20 aa, Entamoeba invadens
RSATIVIAYLMKHKDMSFTK

SEQ ID NO: 3015876 - protein, 24 aa, Entamoeba invadens
RSATLIYDSLYYYQQQQTENQMKT

SEQ ID NO: 3015877 - protein, 20 aa, Entamoeba invadens
RSCFKVLPNTLVLHLKRFEF

SEQ ID NO: 3015878 - protein, 27 aa, Entamoeba invadens
RSCFSYCIHLLEIKIPLSVKSMADDCF

SEQ ID NO: 3015879 - protein, 30 aa, Entamoeba invadens
RSCRSALCGFNWFNAYYTPGVSRISTNIRD

SEQ ID NO: 3015880 - protein, 23 aa, Entamoeba invadens
RSCVTCIAGYYPGTSGQCISCDA

SEQ ID NO: 3015881 - protein, 26 aa, Entamoeba invadens
RSDAVKIMMDIRGKVFKGKALAVCGN

SEQ ID NO: 3015882 - protein, 17 aa, Entamoeba invadens
RSDGLKMTFVFSKNDFL

SEQ ID NO: 3015883 - protein, 25 aa, Entamoeba invadens
RSDRPLNFDSVLTNLPRFVAENEKF

SEQ ID NO: 3015884 - protein, 25 aa, Entamoeba invadens
RSDTFFFTEFPLTETERVVIDIFSR

SEQ ID NO: 3015885 - protein, 17 aa, Entamoeba invadens
RSDVVALRLTPKAPRNS

SEQ ID NO: 3015886 - protein, 23 aa, Entamoeba invadens
RSDVWITSKLWLDSKRKDQVIPA

SEQ ID NO: 3015887 - protein, 29 aa, Entamoeba invadens
RSDVWSFGILIYRLLVGRCPFQLLQMDTF

SEQ ID NO: 3015888 - protein, 30 aa, Entamoeba invadens
RSDVWSFGILIYRLLVGRCPFQLLQMDTFS

SEQ ID NO: 3015889 - protein, 20 aa, Entamoeba invadens
RSDYVSILAMKKSAIVMLEA

SEQ ID NO: 3015890 - protein, 18 aa, Entamoeba invadens
RSEALLQLSSLGMEASCI

SEQ ID NO: 3015891 - protein, 26 aa, Entamoeba invadens
RSEALYIFEDLLLEFGYIVFFEKINR

SEQ ID NO: 3015892 - protein, 21 aa, Entamoeba invadens
RSEAYYLTQLRDTKAMCIQIN

SEQ ID NO: 3015893 - protein, 20 aa, Entamoeba invadens
RSEDSWKYNWGTSEYKDVEV

SEQ ID NO: 3015894 - protein, 23 aa, Entamoeba invadens
RSEEKLFNMLYINKVKSTERVQF

SEQ ID NO: 3015895 - protein, 23 aa, Entamoeba invadens
RSEEKLFNMPYIHKVKSTERVQF

SEQ ID NO: 3015896 - protein, 23 aa, Entamoeba invadens
RSEEYLTILWKITTKGDDVPKDV

SEQ ID NO: 3015897 - protein, 27 aa, Entamoeba invadens
RSEFVRPWRKFVMKLNVKLNWGGKNTT

SEQ ID NO: 3015898 - protein, 25 aa, Entamoeba invadens
RSETRWLQTVLILDNMFENLPSLQE

SEQ ID NO: 3015899 - protein, 21 aa, Entamoeba invadens
RSEVDWLLVMSDGITDVVTEK

SEQ ID NO: 3015900 - protein, 29 aa, Entamoeba invadens
RSEWRLEAPDKYRLIYQNKTSPNEIMVDG

SEQ ID NO: 3015901 - protein, 23 aa, Entamoeba invadens
RSFAARPMMYIRNTIMRVMETDP

SEQ ID NO: 3015902 - protein, 28 aa, Entamoeba invadens
RSFEEKTWLIILNFFGQETLFEAPENLN

SEQ ID NO: 3015903 - protein, 20 aa, Entamoeba invadens
RSFELYGVLLELKDFTEKPK

SEQ ID NO: 3015904 - protein, 17 aa, Entamoeba invadens
RSFITLAVYNTKKGRFD

SEQ ID NO: 3015905 - protein, 18 aa, Entamoeba invadens
RSFMFKNCRSLTGVKLPN

SEQ ID NO: 3015906 - protein, 20 aa, Entamoeba invadens
RSFVLIESYILRGANYVIKM

SEQ ID NO: 3015907 - protein, 25 aa, Entamoeba invadens
RSFVVVKAIRVFFVWCGNYPCNTIQ

SEQ ID NO: 3015908 - protein, 25 aa, Entamoeba invadens
RSGDYNIWYNRYSGFEYKQSRGDRG

SEQ ID NO: 3015909 - protein, 24 aa, Entamoeba invadens
RSGKTTILNIWKGEGFDSVYSQTD

SEQ ID NO: 3015910 - protein, 27 aa, Entamoeba invadens
RSGNKNRFFYLFTDVMIYGVGNQHITV

SEQ ID NO: 3015911 - protein, 29 aa, Entamoeba invadens
RSGNRLPPSEWLISIIKMQGLEYKVDKER

SEQ ID NO: 3015912 - protein, 25 aa, Entamoeba invadens
RSGVLPYIETMKAMWSPKFERVFQL

SEQ ID NO: 3015913 - protein, 17 aa, Entamoeba invadens
RSHCVFTVFITKQNNSQ

SEQ ID NO: 3015914 - protein, 23 aa, Entamoeba invadens
RSHSIFILELCGENTEFNQRRLG

SEQ ID NO: 3015915 - protein, 22 aa, Entamoeba invadens
RSHSVFIMEIYGKNFSSNEQRF

SEQ ID NO: 3015916 - protein, 26 aa, Entamoeba invadens
RSIDGNMWEFLIKKPEIKTDSDNLQP

SEQ ID NO: 3015917 - protein, 30 aa, Entamoeba invadens
RSIEHAKVIQLLWQIWDLDTEYYEICEKKE

SEQ ID NO: 3015918 - protein, 21 aa, Entamoeba invadens
RSIMQLIKKTIFKGKLSLFAR

SEQ ID NO: 3015919 - protein, 22 aa, Entamoeba invadens
RSIPFAWVDPIGERKIFVNDVA

SEQ ID NO: 3015920 - protein, 24 aa, Entamoeba invadens
RSKDHLFVFMSKGPLQFCCASKTG

SEQ ID NO: 3015921 - protein, 28 aa, Entamoeba invadens
RSKGRIPAMSWWNYEKKMYLLRSAQPLV

SEQ ID NO: 3015922 - protein, 26 aa, Entamoeba invadens
RSKGRIPVISYLIPSLSVLCRSSQPG

SEQ ID NO: 3015923 - protein, 32 aa, Entamoeba invadens
RSKLRWVEFEYCLKYPLRLLKADMSQAPLFQF

SEQ ID NO: 3015924 - protein, 17 aa, Entamoeba invadens
RSKMIKWNLGKLPNSLT

SEQ ID NO: 3015925 - protein, 25 aa, Entamoeba invadens
RSKRKKYLAFIWAEQMKPLKMDNLV

SEQ ID NO: 3015926 - protein, 35 aa, Entamoeba invadens
RSLEILSYLMDLMDTLLVIPLPVIHSYGADITKLD

SEQ ID NO: 3015927 - protein, 24 aa, Entamoeba invadens
RSLGANFKRKFPTVIMSIVVDEYD

SEQ ID NO: 3015928 - protein, 18 aa, Entamoeba invadens
RSLLHQREVLGRQGLQRE

SEQ ID NO: 3015929 - protein, 18 aa, Entamoeba invadens
RSLMFNHFKYVKEDKWMG

SEQ ID NO: 3015930 - protein, 20 aa, Entamoeba invadens
RSLPLLLNIALNNTLDIPQR

SEQ ID NO: 3015931 - protein, 39 aa, Entamoeba invadens
RSLPSISLLFLKYVPSNKYDWYYFIPNKNLFNEKVTETD

SEQ ID NO: 3015932 - protein, 25 aa, Entamoeba invadens
RSLRQQHVPFLKKLKTEVLEFIHNT

SEQ ID NO: 3015933 - protein, 17 aa, Entamoeba invadens
RSLRRNFKTFSWGKSEF

SEQ ID NO: 3015934 - protein, 24 aa, Entamoeba invadens
RSLTKQLPPCPLQPPPDLKKYKAI

SEQ ID NO: 3015935 - protein, 20 aa, Entamoeba invadens
RSLTLFTLHIPFMSSTDVSS

SEQ ID NO: 3015936 - protein, 23 aa, Entamoeba invadens
RSLYEDHLSIISKAGILDLNGQV

SEQ ID NO: 3015937 - protein, 18 aa, Entamoeba invadens
RSMLNSRIEIWKKDAELD

SEQ ID NO: 3015938 - protein, 17 aa, Entamoeba invadens
RSMVNMYYRGSSGGVIV

SEQ ID NO: 3015939 - protein, 19 aa, Entamoeba invadens
RSMVSMYYRGSVGALIVYD

SEQ ID NO: 3015940 - protein, 26 aa, Entamoeba invadens
RSNTVFNNIFFNCKIGFSGNSKGVYR

SEQ ID NO: 3015941 - protein, 31 aa, Entamoeba invadens
RSPLKMTSSLPKYEFMWTFSTDDSDFIEIVY

SEQ ID NO: 3015942 - protein, 21 aa, Entamoeba invadens
RSPLRKFQDTVVLKQLVCAMG

SEQ ID NO: 3015943 - protein, 19 aa, Entamoeba invadens
RSPLRRFADLCVLRQIDAA

SEQ ID NO: 3015944 - protein, 23 aa, Entamoeba invadens
RSPNLKILFKKELLTIETFDLLI

SEQ ID NO: 3015945 - protein, 19 aa, Entamoeba invadens
RSQDYLRFIPQLEHSFYIV

SEQ ID NO: 3015946 - protein, 22 aa, Entamoeba invadens
RSQKRITLIAGIFANNTTLKPM

SEQ ID NO: 3015947 - protein, 17 aa, Entamoeba invadens
RSRIIAEQLYVYDLKML

SEQ ID NO: 3015948 - protein, 17 aa, Entamoeba invadens
RSRRDAIFYFTPHGDIS

SEQ ID NO: 3015949 - protein, 26 aa, Entamoeba invadens
RSRSLSFIRQITTKSFMFLGSSGIGK

SEQ ID NO: 3015950 - protein, 20 aa, Entamoeba invadens
RSRVWLQKSLEIKSNIQGKY

SEQ ID NO: 3015951 - protein, 22 aa, Entamoeba invadens
RSSAAVGYFPPYNGFADGGIFE

SEQ ID NO: 3015952 - protein, 20 aa, Entamoeba invadens
RSSLLYEQPLFFKKKEDDVV

SEQ ID NO: 3015953 - protein, 21 aa, Entamoeba invadens
RSSLPLFTSYDELFAAEFPKR

SEQ ID NO: 3015954 - protein, 36 aa, Entamoeba invadens
RSSSSPLRGLFHHKSQNLIQQTPLFLNGELNNEKSQ

SEQ ID NO: 3015955 - protein, 30 aa, Entamoeba invadens
RSSWECGVFVLFFIRIFVQFHPKTLPEYIA

SEQ ID NO: 3015956 - protein, 18 aa, Entamoeba invadens
RSTGLAKMPSVCGYIETV

SEQ ID NO: 3015957 - protein, 18 aa, Entamoeba invadens
RSTLCCHVLCQACLNTKH

SEQ ID NO: 3015958 - protein, 25 aa, Entamoeba invadens
RSTPSFSYDLLKAFRTKISFLDFSQ

SEQ ID NO: 3015959 - protein, 21 aa, Entamoeba invadens
RSTSKFILCGKGQRGILNLET

SEQ ID NO: 3015960 - protein, 33 aa, Entamoeba invadens
RSTTTSYFRNRHVILFCFDLSASGSLSSVESWL

SEQ ID NO: 3015961 - protein, 21 aa, Entamoeba invadens
RSTVLVPFKLGVFVDLFQDVV

SEQ ID NO: 3015962 - protein, 17 aa, Entamoeba invadens
RSTVVQSLFKNFCDDLA

SEQ ID NO: 3015963 - protein, 36 aa, Entamoeba invadens
RSVGIPFVEIPLETPMLKKQLLKLTTTRNGFFVVIQ

SEQ ID NO: 3015964 - protein, 18 aa, Entamoeba invadens
RSVIIPPSVTFISEMCFN

SEQ ID NO: 3015965 - protein, 31 aa, Entamoeba invadens
RSVKKLLRYAFAPKLTFLPSKLLRLQLDETL

SEQ ID NO: 3015966 - protein, 18 aa, Entamoeba invadens
RSVKSSVTLPFLCIAQIT

SEQ ID NO: 3015967 - protein, 24 aa, Entamoeba invadens
RSVQFSEIILPKTVRYILIRSVKG

SEQ ID NO: 3015968 - protein, 21 aa, Entamoeba invadens
RSVVSSFIYDDQFMFCGCSSG

SEQ ID NO: 3015969 - protein, 20 aa, Entamoeba invadens
RSYFPTVVGYSKLDNRCCVA

SEQ ID NO: 3015970 - protein, 26 aa, Entamoeba invadens
RTATFLEEIFYRLRMSHENILLITAM

SEQ ID NO: 3015971 - protein, 19 aa, Entamoeba invadens
RTCISCPSQYYSFENSSMC

SEQ ID NO: 3015972 - protein, 20 aa, Entamoeba invadens
RTCLGPKSMLKMLIDPTAGV

SEQ ID NO: 3015973 - protein, 23 aa, Entamoeba invadens
RTCPGRNVSPTPIRLRIVSPNVV

SEQ ID NO: 3015974 - protein, 25 aa, Entamoeba invadens
RTDDGEYIVLTRHSFRRDEKTGMIK

SEQ ID NO: 3015975 - protein, 28 aa, Entamoeba invadens
RTDILTVLFSPFKFLSESANFFLNLKTD

SEQ ID NO: 3015976 - protein, 21 aa, Entamoeba invadens
RTEPDLFLYNNNNNLDLNVIL

SEQ ID NO: 3015977 - protein, 19 aa, Entamoeba invadens
RTETIFRMLKSLEFKVAVL

SEQ ID NO: 3015978 - protein, 17 aa, Entamoeba invadens
RTETIIGILRSVGQIWF

SEQ ID NO: 3015979 - protein, 24 aa, Entamoeba invadens
RTEYKITYPYLYAQRPREVKVIPY

SEQ ID NO: 3015980 - protein, 23 aa, Entamoeba invadens
RTFCSYLVYKIVKGKTVIGEEKF

SEQ ID NO: 3015981 - protein, 18 aa, Entamoeba invadens
RTFDGFGILIEKEWCLIG

SEQ ID NO: 3015982 - protein, 23 aa, Entamoeba invadens
RTFEVPLWLARTLQRNGYVRIVV

SEQ ID NO: 3015983 - protein, 17 aa, Entamoeba invadens
RTFGYKQLKIREELFKL

SEQ ID NO: 3015984 - protein, 21 aa, Entamoeba invadens
RTFIQVLPLTVHSAASYLAAS

SEQ ID NO: 3015985 - protein, 24 aa, Entamoeba invadens
RTFLQETQIKFPWIVRSCVISNEQ

SEQ ID NO: 3015986 - protein, 17 aa, Entamoeba invadens
RTFLYYACEKSFVGLVE

SEQ ID NO: 3015987 - protein, 23 aa, Entamoeba invadens
RTFPSLFEPVHGSALDIAGKGIC

SEQ ID NO: 3015988 - protein, 20 aa, Entamoeba invadens
RTFRVFGNGSIYKVTKENAN

SEQ ID NO: 3015989 - protein, 22 aa, Entamoeba invadens
RTFTLFYQVFTSLLDNGLTAHL

SEQ ID NO: 3015990 - protein, 36 aa, Entamoeba invadens
RTGFICRPCLESLHFKRFRYFFQAALKKNEPTCVYI

SEQ ID NO: 3015991 - protein, 24 aa, Entamoeba invadens
RTGGDYEWVVYHVDARNGDLVKDD

SEQ ID NO: 3015992 - protein, 33 aa, Entamoeba invadens
RTGKTKRRFFYLFQFSRELVYYKTQQIRFNKQR

SEQ ID NO: 3015993 - protein, 35 aa, Entamoeba invadens
RTHFHRTPLSVLNYYLQFVFSFIASTEITSRKATR

SEQ ID NO: 3015994 - protein, 26 aa, Entamoeba invadens
RTHISKVEIPYAAKLLFQELMSMAIC

SEQ ID NO: 3015995 - protein, 18 aa, Entamoeba invadens
RTIAKQFDKFFLSVFTKI

SEQ ID NO: 3015996 - protein, 25 aa, Entamoeba invadens
RTIERRKSQIFDLNDIQKQMSDAKH

SEQ ID NO: 3015997 - protein, 27 aa, Entamoeba invadens
RTIKGFFDLIYQEWILAGHKFMTRLHT

SEQ ID NO: 3015998 - protein, 20 aa, Entamoeba invadens
RTIKIWKTRQNYSLAKTLSG

SEQ ID NO: 3015999 - protein, 19 aa, Entamoeba invadens
RTILKTNYYTYYVVIIQDA

SEQ ID NO: 3016000 - protein, 21 aa, Entamoeba invadens
RTIRDLYVKYYILNDDEYKNI

SEQ ID NO: 3016001 - protein, 17 aa, Entamoeba invadens
RTITSALYFLSAFLEQS

SEQ ID NO: 3016002 - protein, 22 aa, Entamoeba invadens
RTKFLVDLLREAGYFISTVETG

SEQ ID NO: 3016003 - protein, 29 aa, Entamoeba invadens
RTKIEHLFKTNLRFSFKLMKGIVLYCNSD

SEQ ID NO: 3016004 - protein, 24 aa, Entamoeba invadens
RTKLFPNLGLLYPVGMGNLAKATD

SEQ ID NO: 3016005 - protein, 19 aa, Entamoeba invadens
RTKPFRVSDKSLYQKRDFS

SEQ ID NO: 3016006 - protein, 23 aa, Entamoeba invadens
RTKSDHFLVKRAKKANFLKPFSK

SEQ ID NO: 3016007 - protein, 20 aa, Entamoeba invadens
RTKYLQTYRLGTNVLLVDCP

SEQ ID NO: 3016008 - protein, 21 aa, Entamoeba invadens
RTLALGVELIALLVKSQDPIC

SEQ ID NO: 3016009 - protein, 17 aa, Entamoeba invadens
RTLDEPIFPMEFNDKIK

SEQ ID NO: 3016010 - protein, 24 aa, Entamoeba invadens
RTLDSILFQYKKFVKPAYEEWVYP

SEQ ID NO: 3016011 - protein, 44 aa, Entamoeba invadens
RTLDYKFCEGKADGFIKFDKQKYGWYAVRLFLNSSKGDEYIPIK

SEQ ID NO: 3016012 - protein, 19 aa, Entamoeba invadens
RTLFNKTIISKQSLLFLVF

SEQ ID NO: 3016013 - protein, 20 aa, Entamoeba invadens
RTLISSYQRERDRFWVTAVH

SEQ ID NO: 3016014 - protein, 24 aa, Entamoeba invadens
RTLKQKPGYAALWGDNGNIYVYDM

SEQ ID NO: 3016015 - protein, 17 aa, Entamoeba invadens
RTLLDDYGIIYIVVCQE

SEQ ID NO: 3016016 - protein, 17 aa, Entamoeba invadens
RTLLIKNGLITNDILHL

SEQ ID NO: 3016017 - protein, 17 aa, Entamoeba invadens
RTLLLNELAIPQGKIYK

SEQ ID NO: 3016018 - protein, 18 aa, Entamoeba invadens
RTLSFVPMFTTTGHIVMD

SEQ ID NO: 3016019 - protein, 21 aa, Entamoeba invadens
RTMLAKFVLKCLYSQRLLSIM

SEQ ID NO: 3016020 - protein, 17 aa, Entamoeba invadens
RTMLELVNQLDGFEPTK

SEQ ID NO: 3016021 - protein, 18 aa, Entamoeba invadens
RTMSGNIVLPKLSSAYSI

SEQ ID NO: 3016022 - protein, 25 aa, Entamoeba invadens
RTNLSNTILLLKAIGIEKVIDFEML

SEQ ID NO: 3016023 - protein, 31 aa, Entamoeba invadens
RTNNERLMYWFLYHFTPDTVDFGFGFFSKAF

SEQ ID NO: 3016024 - protein, 24 aa, Entamoeba invadens
RTNRWNIRALYDMIDIAALNADKT

SEQ ID NO: 3016025 - protein, 24 aa, Entamoeba invadens
RTNRWNIRALYDMIDKAALNAYKT

SEQ ID NO: 3016026 - protein, 29 aa, Entamoeba invadens
RTNWYGRHQIRIFRLTETKFYRLDEACLV

SEQ ID NO: 3016027 - protein, 24 aa, Entamoeba invadens
RTPFRPLMMWYSEHLYRETYIQSH

SEQ ID NO: 3016028 - protein, 21 aa, Entamoeba invadens
RTPLELSMVIPLPELKKKIDT

SEQ ID NO: 3016029 - protein, 20 aa, Entamoeba invadens
RTPPGHFFIQRKNKSNSPVA

SEQ ID NO: 3016030 - protein, 31 aa, Entamoeba invadens
RTPQKSLWVFRMRVLRRLLAKYRAMGKIDKH

SEQ ID NO: 3016031 - protein, 32 aa, Entamoeba invadens
RTPQKSLWVFRMRVLRRLLAKYRAMGKIDKHV

SEQ ID NO: 3016032 - protein, 30 aa, Entamoeba invadens
RTPSPLHDLFLNETPLLMQVNDDYIFVFSA

SEQ ID NO: 3016033 - protein, 20 aa, Entamoeba invadens
RTPVQILEFSPKGTILVSIG

SEQ ID NO: 3016034 - protein, 32 aa, Entamoeba invadens
RTQCNLKKLRLERLKDILLIQRDFIENQEQVK

SEQ ID NO: 3016035 - protein, 17 aa, Entamoeba invadens
RTQCYRCGKLGHSLKNC

SEQ ID NO: 3016036 - protein, 17 aa, Entamoeba invadens
RTQKALPKTFEFIEYIP

SEQ ID NO: 3016037 - protein, 22 aa, Entamoeba invadens
RTQLSYLQCSLLAFISMNRRVV

SEQ ID NO: 3016038 - protein, 40 aa, Entamoeba invadens
RTQPGFCYIINNPIDWNTSYCLPLFVISFRNHAAVSWLPE

SEQ ID NO: 3016039 - protein, 21 aa, Entamoeba invadens
RTQRIIDGVTALHSKQLYINQ

SEQ ID NO: 3016040 - protein, 26 aa, Entamoeba invadens
RTQVCELSFVGLLQQVGKMKKLHNET

SEQ ID NO: 3016041 - protein, 34 aa, Entamoeba invadens
RTREAQICNGLLYLLRASGFTFSVKQTKKAKLTE

SEQ ID NO: 3016042 - protein, 23 aa, Entamoeba invadens
RTRLVHIYLKMTDLLEKSKRTEE

SEQ ID NO: 3016043 - protein, 26 aa, Entamoeba invadens
RTRTILNFFSSFLLQRAGIEYDLDFP

SEQ ID NO: 3016044 - protein, 20 aa, Entamoeba invadens
RTRVVLATMIRNGLIKELHG

SEQ ID NO: 3016045 - protein, 22 aa, Entamoeba invadens
RTSENIVFPTSLKYLDILGKRP

SEQ ID NO: 3016046 - protein, 20 aa, Entamoeba invadens
RTSGMYPSDSTYKCVSCDAT

SEQ ID NO: 3016047 - protein, 17 aa, Entamoeba invadens
RTSPFAFIGNRFEFRAV

SEQ ID NO: 3016048 - protein, 19 aa, Entamoeba invadens
RTSPKMYLPTTPEKSMSPM

SEQ ID NO: 3016049 - protein, 29 aa, Entamoeba invadens
RTSRWNVRILYDLLDIAALNAYKVYHYHH

SEQ ID NO: 3016050 - protein, 29 aa, Entamoeba invadens
RTSRWNVRILYDLLDIAALNAYNVYHHHH

SEQ ID NO: 3016051 - protein, 27 aa, Entamoeba invadens
RTTETFFNIVIWYQVDFKTTTIYRTNN

SEQ ID NO: 3016052 - protein, 26 aa, Entamoeba invadens
RTTGDRMFFFVNRRLIEHKKMQQIVT

SEQ ID NO: 3016053 - protein, 17 aa, Entamoeba invadens
RTTKVLFESLKNYIEKT

SEQ ID NO: 3016054 - protein, 29 aa, Entamoeba invadens
RTTNLNINFLFVFFPRLNTLTGNLNLICN

SEQ ID NO: 3016055 - protein, 31 aa, Entamoeba invadens
RTTRKPCMKSPKIPLLVIKGQQPGSGHKAVK

SEQ ID NO: 3016056 - protein, 17 aa, Entamoeba invadens
RTTVVIAHRLSTIQNAD

SEQ ID NO: 3016057 - protein, 19 aa, Entamoeba invadens
RTVALYLHTIEDLLNFTLM

SEQ ID NO: 3016058 - protein, 26 aa, Entamoeba invadens
RTVEAPRLFNRIVIKPVDHPKLLDYE

SEQ ID NO: 3016059 - protein, 20 aa, Entamoeba invadens
RTVIFLFSRISFVSVLNTTD

SEQ ID NO: 3016060 - protein, 28 aa, Entamoeba invadens
RTVKGFFDLIYQEWILAGHKFMTRLHLS

SEQ ID NO: 3016061 - protein, 17 aa, Entamoeba invadens
RTVQVPLKCNLEDLYNG

SEQ ID NO: 3016062 - protein, 26 aa, Entamoeba invadens
RTVSGIEPEWLFEASPQYFEKLETFK

SEQ ID NO: 3016063 - protein, 20 aa, Entamoeba invadens
RTYGTCVMMWKKNICDEMNV

SEQ ID NO: 3016064 - protein, 20 aa, Entamoeba invadens
RVAAGIPPIPQPPSKKEKKE

SEQ ID NO: 3016065 - protein, 18 aa, Entamoeba invadens
RVAFNIVYQALQDGRLRP

SEQ ID NO: 3016066 - protein, 17 aa, Entamoeba invadens
RVAIFPNSKRTKKLGLP

SEQ ID NO: 3016067 - protein, 30 aa, Entamoeba invadens
RVAISKSQWRFPLPLYRSLQYLENHKGDEL

SEQ ID NO: 3016068 - protein, 24 aa, Entamoeba invadens
RVAKFEDFFHKKIDLLNDELMNNV

SEQ ID NO: 3016069 - protein, 18 aa, Entamoeba invadens
RVAQFLDIHFFETSAKSN

SEQ ID NO: 3016070 - protein, 29 aa, Entamoeba invadens
RVARIVDSGLWPKLFSVAPSPLDIFKTVL

SEQ ID NO: 3016071 - protein, 18 aa, Entamoeba invadens
RVAYSAGACLYIICRRER

SEQ ID NO: 3016072 - protein, 23 aa, Entamoeba invadens
RVCAFVFAMILDFLKQSLVYAYS

SEQ ID NO: 3016073 - protein, 25 aa, Entamoeba invadens
RVCDKGFLKKTLPFTYGYILEHIVM

SEQ ID NO: 3016074 - protein, 17 aa, Entamoeba invadens
RVCGEGIENGWVTSLEK

SEQ ID NO: 3016075 - protein, 24 aa, Entamoeba invadens
RVCIFSVLTQTLPEFALKFLVSIA

SEQ ID NO: 3016076 - protein, 32 aa, Entamoeba invadens
RVDIKPTTLLHLPDEKIYSFLVTPQQNNNPQN

SEQ ID NO: 3016077 - protein, 25 aa, Entamoeba invadens
RVDKRALYSVLVLNKFGILTGISNI

SEQ ID NO: 3016078 - protein, 26 aa, Entamoeba invadens
RVDNRNYEYVFPSYALQQLHPNDLNI

SEQ ID NO: 3016079 - protein, 18 aa, Entamoeba invadens
RVDSTFDESLGFVKPILS

SEQ ID NO: 3016080 - protein, 18 aa, Entamoeba invadens
RVEFQSFIGCCMELNLIA

SEQ ID NO: 3016081 - protein, 29 aa, Entamoeba invadens
RVELTSSFKEFFFKKITFGTANCGGDNAF

SEQ ID NO: 3016082 - protein, 30 aa, Entamoeba invadens
RVEPLRRRYLFFLLNLYYSISKKSDVNKMT

SEQ ID NO: 3016083 - protein, 26 aa, Entamoeba invadens
RVERIEYGHLPLSALPRIVLEDQEKY

SEQ ID NO: 3016084 - protein, 25 aa, Entamoeba invadens
RVERWESGWDFGYQFRYNNGGNPMI

SEQ ID NO: 3016085 - protein, 24 aa, Entamoeba invadens
RVEYGILSPYHSFQAHILYSTKQY

SEQ ID NO: 3016086 - protein, 18 aa, Entamoeba invadens
RVFAGCGILTHAVFPQHF

SEQ ID NO: 3016087 - protein, 18 aa, Entamoeba invadens
RVFDGRRLFCAKDKKNNK

SEQ ID NO: 3016088 - protein, 29 aa, Entamoeba invadens
RVFELRPKRSFYRLLYNKDENYGLCHVCV

SEQ ID NO: 3016089 - protein, 18 aa, Entamoeba invadens
RVFFRGISIFDVANFLNI

SEQ ID NO: 3016090 - protein, 25 aa, Entamoeba invadens
RVFIMFAQILVICAESPFLQPEEMI

SEQ ID NO: 3016091 - protein, 18 aa, Entamoeba invadens
RVFLFQLITSVMDVQKEQ

SEQ ID NO: 3016092 - protein, 18 aa, Entamoeba invadens
RVFLPFQTRYHSTAQSDI

SEQ ID NO: 3016093 - protein, 17 aa, Entamoeba invadens
RVFNSFYFDTFKVPIHI

SEQ ID NO: 3016094 - protein, 26 aa, Entamoeba invadens
RVGALSFYIILAHMNVILTNKEGLPK

SEQ ID NO: 3016095 - protein, 27 aa, Entamoeba invadens
RVGEDKLLINWFKVRQIGNLIKEIMVK

SEQ ID NO: 3016096 - protein, 17 aa, Entamoeba invadens
RVGFAFTRLSTSLLRTQ

SEQ ID NO: 3016097 - protein, 23 aa, Entamoeba invadens
RVGKREEAFAHFLKVLKSPYDGE

SEQ ID NO: 3016098 - protein, 26 aa, Entamoeba invadens
RVGLCCECLLFFLANLHDAIVSIECG

SEQ ID NO: 3016099 - protein, 20 aa, Entamoeba invadens
RVGLYPVEFGTKTYYFEIRN

SEQ ID NO: 3016100 - protein, 23 aa, Entamoeba invadens
RVGNPIIFPRISPLYSLNKLQGS

SEQ ID NO: 3016101 - protein, 17 aa, Entamoeba invadens
RVGNVIGRLVFVHHVVH

SEQ ID NO: 3016102 - protein, 24 aa, Entamoeba invadens
RVGVKWMYELYKQGGGGIVGDEMG

SEQ ID NO: 3016103 - protein, 29 aa, Entamoeba invadens
RVHNPITRKYLMKLLISLFQKFDNEKTIP

SEQ ID NO: 3016104 - protein, 21 aa, Entamoeba invadens
RVIEPIIFGLLGTTQSFVAGN

SEQ ID NO: 3016105 - protein, 18 aa, Entamoeba invadens
RVIMKVQVTFSKWYVALQ

SEQ ID NO: 3016106 - protein, 20 aa, Entamoeba invadens
RVINTIAFDGFVYDKKAIKA

SEQ ID NO: 3016107 - protein, 22 aa, Entamoeba invadens
RVINVYNGCLYLYESTTKEIPL

SEQ ID NO: 3016108 - protein, 20 aa, Entamoeba invadens
RVIPKYLNKYTNKKLAKRMV

SEQ ID NO: 3016109 - protein, 20 aa, Entamoeba invadens
RVIQKYAFVYCEHLKHVILP

SEQ ID NO: 3016110 - protein, 20 aa, Entamoeba invadens
RVISLFTLSKLFSDNAALEC

SEQ ID NO: 3016111 - protein, 39 aa, Entamoeba invadens
RVKITALITKLPPYTFYMCFLLNKILMPKSLTNIEEFCF

SEQ ID NO: 3016112 - protein, 23 aa, Entamoeba invadens
RVKLQRIKVLLFGDQQGNYQTCR

SEQ ID NO: 3016113 - protein, 25 aa, Entamoeba invadens
RVKNEPIQIYWKLSKKEIASIEYTY

SEQ ID NO: 3016114 - protein, 17 aa, Entamoeba invadens
RVKNTILGQFKAFEKLK

SEQ ID NO: 3016115 - protein, 24 aa, Entamoeba invadens
RVKPSHSKYIYSDRPKFQRRSHRY

SEQ ID NO: 3016116 - protein, 23 aa, Entamoeba invadens
RVKQISLILTYMSGVFFAHNDSV

SEQ ID NO: 3016117 - protein, 20 aa, Entamoeba invadens
RVKRYIRQQMKRLLFPIYSE

SEQ ID NO: 3016118 - protein, 23 aa, Entamoeba invadens
RVKTVTIPKFTFQPVVDHYRDIL

SEQ ID NO: 3016119 - protein, 17 aa, Entamoeba invadens
RVLCIASNKIIEIPNFV

SEQ ID NO: 3016120 - protein, 17 aa, Entamoeba invadens
RVLDINFSYIKTLKNLS

SEQ ID NO: 3016121 - protein, 19 aa, Entamoeba invadens
RVLETMFELLVSPLLQVRI

SEQ ID NO: 3016122 - protein, 29 aa, Entamoeba invadens
RVLGYQEVIAPNIFLSDLWKTSGHWQHYK

SEQ ID NO: 3016123 - protein, 22 aa, Entamoeba invadens
RVLLKTFRYVTFTEIPAFFTAE

SEQ ID NO: 3016124 - protein, 17 aa, Entamoeba invadens
RVLLLDLPEAGVRGELK

SEQ ID NO: 3016125 - protein, 19 aa, Entamoeba invadens
RVLLLGHTFGCGPALHYCN

SEQ ID NO: 3016126 - protein, 32 aa, Entamoeba invadens
RVLRDTKTIYPCPLVLIFNPNAFKNFVYDFGD

SEQ ID NO: 3016127 - protein, 17 aa, Entamoeba invadens
RVMFKYGDDLRRDMAVQ

SEQ ID NO: 3016128 - protein, 17 aa, Entamoeba invadens
RVMIWEATQNRLFQSCL

SEQ ID NO: 3016129 - protein, 18 aa, Entamoeba invadens
RVMKLWITNKDRPMHMFS

SEQ ID NO: 3016130 - protein, 28 aa, Entamoeba invadens
RVMNKASTYFFFISVVTKLIEMNSFNMA

SEQ ID NO: 3016131 - protein, 19 aa, Entamoeba invadens
RVMQLFGLVNDLLAGNSET

SEQ ID NO: 3016132 - protein, 19 aa, Entamoeba invadens
RVMWIESCTLISLKGYTKT

SEQ ID NO: 3016133 - protein, 25 aa, Entamoeba invadens
RVNEMLFVLADFLTEYSFEFTTKVV

SEQ ID NO: 3016134 - protein, 17 aa, Entamoeba invadens
RVNFFMKFFEDHKCEGS

SEQ ID NO: 3016135 - protein, 20 aa, Entamoeba invadens
RVNLYLFKKQVKTLQTGFER

SEQ ID NO: 3016136 - protein, 23 aa, Entamoeba invadens
RVNNAIFPYFSFEKVNTNIQACQ

SEQ ID NO: 3016137 - protein, 25 aa, Entamoeba invadens
RVNNFGLISVCGLNFRYVTFFEDIV

SEQ ID NO: 3016138 - protein, 17 aa, Entamoeba invadens
RVPDELYNVMWSAKNFM

SEQ ID NO: 3016139 - protein, 23 aa, Entamoeba invadens
RVPDNTFLRCKNLAKIETYSGLT

SEQ ID NO: 3016140 - protein, 17 aa, Entamoeba invadens
RVPKIADLIFDKTQPIF

SEQ ID NO: 3016141 - protein, 20 aa, Entamoeba invadens
RVPYLGITLKDMTFIAEGHT

SEQ ID NO: 3016142 - protein, 34 aa, Entamoeba invadens
RVQASLLLSFSQYLNTMNLSWQQVPSVLSKMNSS

SEQ ID NO: 3016143 - protein, 29 aa, Entamoeba invadens
RVQDVFSLPTFLPINLPSLFSHPIIGVPQ

SEQ ID NO: 3016144 - protein, 18 aa, Entamoeba invadens
RVQKNFLHFFKSESLENN

SEQ ID NO: 3016145 - protein, 21 aa, Entamoeba invadens
RVQLKLLLTQNSETSPLFALN

SEQ ID NO: 3016146 - protein, 25 aa, Entamoeba invadens
RVQNCFVGTYMRTAYYGNAASRIVS

SEQ ID NO: 3016147 - protein, 18 aa, Entamoeba invadens
RVQPGFLQRTFYATKHHG

SEQ ID NO: 3016148 - protein, 40 aa, Entamoeba invadens
RVREIVKSGTFKLIGEMDGILAFERGVFGFKGEFEDKTRI

SEQ ID NO: 3016149 - protein, 17 aa, Entamoeba invadens
RVRLKEFLRTPSADLTL

SEQ ID NO: 3016150 - protein, 24 aa, Entamoeba invadens
RVRQFEHLFPRLSTFKAQNCMLFI

SEQ ID NO: 3016151 - protein, 20 aa, Entamoeba invadens
RVRVLKRLIAALPDSNRHVL

SEQ ID NO: 3016152 - protein, 20 aa, Entamoeba invadens
RVSAEVFRRTLKLLMSTNKS

SEQ ID NO: 3016153 - protein, 24 aa, Entamoeba invadens
RVSGKMYMKWRVIDKSPDALNSGD

SEQ ID NO: 3016154 - protein, 25 aa, Entamoeba invadens
RVSPGVCYRLYTKEAFIKELPAATP

SEQ ID NO: 3016155 - protein, 27 aa, Entamoeba invadens
RVSRKTLSWYFWSIKIGKYRDHVRNIK

SEQ ID NO: 3016156 - protein, 20 aa, Entamoeba invadens
RVSSGRWGCGVFNNDPALKF

SEQ ID NO: 3016157 - protein, 23 aa, Entamoeba invadens
RVTARYGVLLEAFLVGCGNYKVE

SEQ ID NO: 3016158 - protein, 23 aa, Entamoeba invadens
RVTKAMLYFAKKITLRNSIFNTN

SEQ ID NO: 3016159 - protein, 20 aa, Entamoeba invadens
RVTYFDVFPSCIFKTRHRHQ

SEQ ID NO: 3016160 - protein, 21 aa, Entamoeba invadens
RVVDMIYLIFSNCAAGNLACC

SEQ ID NO: 3016161 - protein, 18 aa, Entamoeba invadens
RVVILWTATTERYVELKA

SEQ ID NO: 3016162 - protein, 18 aa, Entamoeba invadens
RVVLFKKSRNDELGKVDF

SEQ ID NO: 3016163 - protein, 17 aa, Entamoeba invadens
RVVNIGFIPLLVQSLDK

SEQ ID NO: 3016164 - protein, 24 aa, Entamoeba invadens
RVVPIVLHFSYLFKETVLSIECEK

SEQ ID NO: 3016165 - protein, 20 aa, Entamoeba invadens
RVVPLLQMVNIKVSSLYSGM

SEQ ID NO: 3016166 - protein, 24 aa, Entamoeba invadens
RVVPVHKYIRIVQWVNSNDDSIVY

SEQ ID NO: 3016167 - protein, 17 aa, Entamoeba invadens
RVVRDMVLPMLCRGNKF

SEQ ID NO: 3016168 - protein, 19 aa, Entamoeba invadens
RVVRDMVLPMLCRGTKFTV

SEQ ID NO: 3016169 - protein, 26 aa, Entamoeba invadens
RVVTKKDVFALTSFSLYHSVNGVKQG

SEQ ID NO: 3016170 - protein, 22 aa, Entamoeba invadens
RVVTRCVTTWQLTPPYSLTDAL

SEQ ID NO: 3016171 - protein, 35 aa, Entamoeba invadens
RVYDESIWKLFNETFAYLPILAIIEKRIFCVHGGI

SEQ ID NO: 3016172 - protein, 20 aa, Entamoeba invadens
RVYDQFSGGMWKLTDEQKKE

SEQ ID NO: 3016173 - protein, 18 aa, Entamoeba invadens
RVYKLTKIDLGNCGISKV

SEQ ID NO: 3016174 - protein, 18 aa, Entamoeba invadens
RVYQIKKLTPKRNKTDKT

SEQ ID NO: 3016175 - protein, 18 aa, Entamoeba invadens
RVYQLGENIQKAPSNFFL

SEQ ID NO: 3016176 - protein, 22 aa, Entamoeba invadens
RVYRKMCSFYMRTSREENAMVL

SEQ ID NO: 3016177 - protein, 31 aa, Entamoeba invadens
RVYRYASPWKDQFPEWALLPKTSEELMKEEN

SEQ ID NO: 3016178 - protein, 18 aa, Entamoeba invadens
RVYSMPLLLQEYKGSTDA

SEQ ID NO: 3016179 - protein, 18 aa, Entamoeba invadens
RVYVPKRMFYQIVVWFDV

SEQ ID NO: 3016180 - protein, 20 aa, Entamoeba invadens
RVYVSSFWDQPLKDSMFVPL

SEQ ID NO: 3016181 - protein, 18 aa, Entamoeba invadens
RVYWCIDNINFGEWEIII

SEQ ID NO: 3016182 - protein, 17 aa, Entamoeba invadens
RWCGNLSSITIPSSVTS

SEQ ID NO: 3016183 - protein, 25 aa, Entamoeba invadens
RWDKPPILMDFVIPALTATGLQIRY

SEQ ID NO: 3016184 - protein, 20 aa, Entamoeba invadens
RWEEQLWEFISKTLFEVSWS

SEQ ID NO: 3016185 - protein, 27 aa, Entamoeba invadens
RWEFSHPYPFIRTREFLWQEGHTAYDN

SEQ ID NO: 3016186 - protein, 28 aa, Entamoeba invadens
RWEYAKESILVLFKPLDYAMANGASTTI

SEQ ID NO: 3016187 - protein, 27 aa, Entamoeba invadens
RWKAYKNHFFLPFYTKTDLCYTACNFG

SEQ ID NO: 3016188 - protein, 18 aa, Entamoeba invadens
RWKWQRYMKHMKINYYFL

SEQ ID NO: 3016189 - protein, 20 aa, Entamoeba invadens
RWSSVFYSRMSEESPLSSLY

SEQ ID NO: 3016190 - protein, 21 aa, Entamoeba invadens
RWTKGGLILKNSYGTKGHTLG

SEQ ID NO: 3016191 - protein, 17 aa, Entamoeba invadens
RWVGQTLKQLFTTEFKH

SEQ ID NO: 3016192 - protein, 20 aa, Entamoeba invadens
RWVVIYPAYMDSELKTSQGR

SEQ ID NO: 3016193 - protein, 17 aa, Entamoeba invadens
RWYMFNRWSFCDDLRLL

SEQ ID NO: 3016194 - protein, 19 aa, Entamoeba invadens
RYAAPICGPYECVTKYKYH

SEQ ID NO: 3016195 - protein, 22 aa, Entamoeba invadens
RYAFSGIVYSIANGLDPEWCKI

SEQ ID NO: 3016196 - protein, 29 aa, Entamoeba invadens
RYAIKPQRPLTMLPPSAPPPKAPKYKPQQ

SEQ ID NO: 3016197 - protein, 17 aa, Entamoeba invadens
RYAVRPFRKVQCPIVER

SEQ ID NO: 3016198 - protein, 23 aa, Entamoeba invadens
RYDHALGLYVYLRDELMGDMNNT

SEQ ID NO: 3016199 - protein, 20 aa, Entamoeba invadens
RYEFGIPDDLSSVDGIVLVK

SEQ ID NO: 3016200 - protein, 20 aa, Entamoeba invadens
RYEKMIMTWLDIMGNAIREQ

SEQ ID NO: 3016201 - protein, 21 aa, Entamoeba invadens
RYENMAAITHYKFGVLYCQKD

SEQ ID NO: 3016202 - protein, 23 aa, Entamoeba invadens
RYFDFRVIYDTGLDDFFLLHGFY

SEQ ID NO: 3016203 - protein, 20 aa, Entamoeba invadens
RYFEEELGDMSYLKGVLKIG

SEQ ID NO: 3016204 - protein, 19 aa, Entamoeba invadens
RYFFPKIETLVIYTTKDYC

SEQ ID NO: 3016205 - protein, 27 aa, Entamoeba invadens
RYFPSIVDLIFIQLVSKKYKSLLHDLK

SEQ ID NO: 3016206 - protein, 17 aa, Entamoeba invadens
RYGETIPFNLPVHHLED

SEQ ID NO: 3016207 - protein, 27 aa, Entamoeba invadens
RYGPNSFKLHRLPMPRPGQILGIVGTN

SEQ ID NO: 3016208 - protein, 27 aa, Entamoeba invadens
RYHANPIPLTLKTIKYFPKIETLNIWS

SEQ ID NO: 3016209 - protein, 20 aa, Entamoeba invadens
RYHSLTPMYYRGSNAALVVF

SEQ ID NO: 3016210 - protein, 18 aa, Entamoeba invadens
RYILGELCYRALSKIFTT

SEQ ID NO: 3016211 - protein, 29 aa, Entamoeba invadens
RYIYEVGVGMFYLYIQNSMLDVALQTFAF

SEQ ID NO: 3016212 - protein, 17 aa, Entamoeba invadens
RYIYMYTTDGNLVDKDD

SEQ ID NO: 3016213 - protein, 19 aa, Entamoeba invadens
RYIYTRLSTITRSLCIKED

SEQ ID NO: 3016214 - protein, 21 aa, Entamoeba invadens
RYKCIQTLFKLSLGLIRKKNI

SEQ ID NO: 3016215 - protein, 26 aa, Entamoeba invadens
RYKGNGIVLGTSKLFSTALTAAPAAE

SEQ ID NO: 3016216 - protein, 30 aa, Entamoeba invadens
RYKHVLFPSIAIIKLFTYLVELNVDLTTAL

SEQ ID NO: 3016217 - protein, 24 aa, Entamoeba invadens
RYKKSLVKILSKYPLDKLQNACQV

SEQ ID NO: 3016218 - protein, 19 aa, Entamoeba invadens
RYLKKNFTLVRSMYDISDN

SEQ ID NO: 3016219 - protein, 19 aa, Entamoeba invadens
RYLNNEVLLPVNPKAQKLI

SEQ ID NO: 3016220 - protein, 19 aa, Entamoeba invadens
RYMMADLFGLLPHAKKEAK

SEQ ID NO: 3016221 - protein, 32 aa, Entamoeba invadens
RYPSCITGINNIFSLLLLFHCPSLSLKVQSKR

SEQ ID NO: 3016222 - protein, 20 aa, Entamoeba invadens
RYQALPTDLKIIKYQQIFRS

SEQ ID NO: 3016223 - protein, 22 aa, Entamoeba invadens
RYQFVMMFQSEGMTRFVLPNNE

SEQ ID NO: 3016224 - protein, 18 aa, Entamoeba invadens
RYRELVGLIMINLDEPNK

SEQ ID NO: 3016225 - protein, 18 aa, Entamoeba invadens
RYRNFTMTLTMSEDWRRS

SEQ ID NO: 3016226 - protein, 19 aa, Entamoeba invadens
RYRYHLLCECGGSLFVDEI

SEQ ID NO: 3016227 - protein, 21 aa, Entamoeba invadens
RYSEPIRWFKKTEVESGIFIF

SEQ ID NO: 3016228 - protein, 37 aa, Entamoeba invadens
RYSESTLKYMYDPVLINGVLLGTLVIIKNCENLLLDI

SEQ ID NO: 3016229 - protein, 21 aa, Entamoeba invadens
RYSLDVSKLEKLGWKAETKFE

SEQ ID NO: 3016230 - protein, 21 aa, Entamoeba invadens
RYSLMIVSKYFKNIGDFIKII

SEQ ID NO: 3016231 - protein, 32 aa, Entamoeba invadens
RYTHFMELFHYNPIPLTWNTIKHFSYIETLHL

SEQ ID NO: 3016232 - protein, 20 aa, Entamoeba invadens
RYTMNIFVENYHQCVIVDYY

SEQ ID NO: 3016233 - protein, 22 aa, Entamoeba invadens
RYTWFKQKYEEFEKKFEGVFPE

SEQ ID NO: 3016234 - protein, 27 aa, Entamoeba invadens
RYVCDRKAFIFSLFSNGRSERPLKFDI

SEQ ID NO: 3016235 - protein, 20 aa, Entamoeba invadens
RYVLREFRCGVLLYNGENSV

SEQ ID NO: 3016236 - protein, 30 aa, Entamoeba invadens
RYWSSEEHILFLKAITWLNATSTKQLPVKL

SEQ ID NO: 3016237 - protein, 32 aa, Entamoeba invadens
RYYDSTFLQPFVPALLDKLQYCLGLKGTEKND

SEQ ID NO: 3016238 - protein, 20 aa, Entamoeba invadens
RYYFDYGVFNVFSNNKKEVL

SEQ ID NO: 3016239 - protein, 20 aa, Entamoeba invadens
RYYPHSHRYPIELVSVSTSK

SEQ ID NO: 3016240 - protein, 20 aa, Entamoeba invadens
RYYVIVQSQKYFIYNNKQCT

SEQ ID NO: 3016241 - protein, 30 aa, Entamoeba invadens
RYYYIHACMNYMALARNYQFIVLNQVKHQL

SEQ ID NO: 3016242 - protein, 25 aa, Entamoeba invadens
SAADNMLHFLHNLLTLRGAKVRSGK

SEQ ID NO: 3016243 - protein, 25 aa, Entamoeba invadens
SAAGKTYLLITYTTNEFPTNYTPTV

SEQ ID NO: 3016244 - protein, 23 aa, Entamoeba invadens
SAAKLNANYLKMMTEYRASVELE

SEQ ID NO: 3016245 - protein, 22 aa, Entamoeba invadens
SAALIKEAFLSRSMLENPNDFG

SEQ ID NO: 3016246 - protein, 23 aa, Entamoeba invadens
SAAMLMKQNLLKKGKEEGKQYAL

SEQ ID NO: 3016247 - protein, 19 aa, Entamoeba invadens
SAAVGYFPPYDGGYADGGI

SEQ ID NO: 3016248 - protein, 18 aa, Entamoeba invadens
SAAWFSPRGFFDSIIRSR

SEQ ID NO: 3016249 - protein, 20 aa, Entamoeba invadens
SACYGKSNTVWYIYMDKCTT

SEQ ID NO: 3016250 - protein, 31 aa, Entamoeba invadens
SADGIIVGSYFKVDGFWKNELSKDRILKLLS

SEQ ID NO: 3016251 - protein, 17 aa, Entamoeba invadens
SADIPQIKIRHLEFSQN

SEQ ID NO: 3016252 - protein, 24 aa, Entamoeba invadens
SADRSIQIWDPNAVTPTIEKIRNV

SEQ ID NO: 3016253 - protein, 18 aa, Entamoeba invadens
SADRTIKIWKTRQNYSLA

SEQ ID NO: 3016254 - protein, 25 aa, Entamoeba invadens
SADYYKAIVLIYASSALLTQQKING

SEQ ID NO: 3016255 - protein, 24 aa, Entamoeba invadens
SAEALLDREIAFNLSLIYAKAGNE

SEQ ID NO: 3016256 - protein, 20 aa, Entamoeba invadens
SAEEFNRCVGSNKKVLVIVK

SEQ ID NO: 3016257 - protein, 21 aa, Entamoeba invadens
SAEFWVEYLLLCRNSGDYKRG

SEQ ID NO: 3016258 - protein, 20 aa, Entamoeba invadens
SAELFDFMNTPEGLEHMRKY

SEQ ID NO: 3016259 - protein, 23 aa, Entamoeba invadens
SAERLLLVYIDPHYTVPDLASII

SEQ ID NO: 3016260 - protein, 35 aa, Entamoeba invadens
SAFEKCTSLRKFVIPRGLLYMCARVFCDCSNLEEL

SEQ ID NO: 3016261 - protein, 18 aa, Entamoeba invadens
SAFERRCVMCNTGYYPNE

SEQ ID NO: 3016262 - protein, 24 aa, Entamoeba invadens
SAFTRLFFYYLESSTQDFLEAVIG

SEQ ID NO: 3016263 - protein, 17 aa, Entamoeba invadens
SAFWMSPDLTLNFHQSL

SEQ ID NO: 3016264 - protein, 20 aa, Entamoeba invadens
SAGLLFSISLVPFCDLEDSE

SEQ ID NO: 3016265 - protein, 29 aa, Entamoeba invadens
SAGSFTELIFMFYVKWDVSDKYWELLRTR

SEQ ID NO: 3016266 - protein, 24 aa, Entamoeba invadens
SAGVGWIFVQWMSGNINQYRWGAE

SEQ ID NO: 3016267 - protein, 24 aa, Entamoeba invadens
SAHNFLRHRVVLYECLFSGNDIRA

SEQ ID NO: 3016268 - protein, 24 aa, Entamoeba invadens
SAIDPIYKELTKSSKHPLGGTAFL

SEQ ID NO: 3016269 - protein, 25 aa, Entamoeba invadens
SAIEKSILEVLSVLRAKPIGNSAEG

SEQ ID NO: 3016270 - protein, 21 aa, Entamoeba invadens
SAIFITHLHIDHMGGLLSFLF

SEQ ID NO: 3016271 - protein, 17 aa, Entamoeba invadens
SAIGEFGVRCFEGCISL

SEQ ID NO: 3016272 - protein, 21 aa, Entamoeba invadens
SAILMALRYNHPDVALLILNT

SEQ ID NO: 3016273 - protein, 20 aa, Entamoeba invadens
SAIPFINDPFQTLGLYQCDI

SEQ ID NO: 3016274 - protein, 25 aa, Entamoeba invadens
SAKDQCITPIIRKAFTNGEPMNIDA

SEQ ID NO: 3016275 - protein, 17 aa, Entamoeba invadens
SAKGFIELIPGTETKDV

SEQ ID NO: 3016276 - protein, 17 aa, Entamoeba invadens
SAKGFIELLPGTETRDV

SEQ ID NO: 3016277 - protein, 24 aa, Entamoeba invadens
SAKQSFWMKRVAYLAAQTCLHQDD

SEQ ID NO: 3016278 - protein, 41 aa, Entamoeba invadens
SAKVSLKKRVKNVLQRMLDCVKNVKVIWPNDDDETKPKEAK

SEQ ID NO: 3016279 - protein, 26 aa, Entamoeba invadens
SAKYHPEHAAILWRISRFNGMTQQTI

SEQ ID NO: 3016280 - protein, 17 aa, Entamoeba invadens
SAKYVYQILDGLSFIHE

SEQ ID NO: 3016281 - protein, 24 aa, Entamoeba invadens
SALAIYRTLIIKCPNRLSYYLKSS

SEQ ID NO: 3016282 - protein, 32 aa, Entamoeba invadens
SALEKTPLLSKLLLNSKPRPVPAQLSPALLCK

SEQ ID NO: 3016283 - protein, 31 aa, Entamoeba invadens
SALEKVKRRFVKIQKLFGLLKETRGSVYCKK

SEQ ID NO: 3016284 - protein, 27 aa, Entamoeba invadens
SALGQGAFGLVYKALWLGTTEVAMKGI

SEQ ID NO: 3016285 - protein, 21 aa, Entamoeba invadens
SALGYLPARYKTLKEAVYMAL

SEQ ID NO: 3016286 - protein, 30 aa, Entamoeba invadens
SALIEKVIYELFNIFWTRKGREGKFSFIAK

SEQ ID NO: 3016287 - protein, 23 aa, Entamoeba invadens
SALLKCPAEFKLEISKKAVAFES

SEQ ID NO: 3016288 - protein, 19 aa, Entamoeba invadens
SALLYEFLTDFARKMFQKV

SEQ ID NO: 3016289 - protein, 23 aa, Entamoeba invadens
SALNNIKVDFLFESIAKGSAKKR

SEQ ID NO: 3016290 - protein, 23 aa, Entamoeba invadens
SALPPPVLLHQDTSPFHTEVIPS

SEQ ID NO: 3016291 - protein, 32 aa, Entamoeba invadens
SALQVLYSIEPLRKYLLNGAYKDAINKTNKMG

SEQ ID NO: 3016292 - protein, 23 aa, Entamoeba invadens
SALRALVFVKLIGPALVSGLETK

SEQ ID NO: 3016293 - protein, 22 aa, Entamoeba invadens
SALSFNWLVKYVEQYGYILTRR

SEQ ID NO: 3016294 - protein, 24 aa, Entamoeba invadens
SALSLLKFPLKFSNLKNAKKAAEF

SEQ ID NO: 3016295 - protein, 17 aa, Entamoeba invadens
SALTLPNFNGKLTFAIN

SEQ ID NO: 3016296 - protein, 19 aa, Entamoeba invadens
SALTRLVLEKKTRTIKGFF

SEQ ID NO: 3016297 - protein, 17 aa, Entamoeba invadens
SALVARLTRKEIYLTQD

SEQ ID NO: 3016298 - protein, 17 aa, Entamoeba invadens
SALVDIYSLPQLKLVKI

SEQ ID NO: 3016299 - protein, 23 aa, Entamoeba invadens
SAMDAAKIIWLLYEHPEADFFNI

SEQ ID NO: 3016300 - protein, 28 aa, Entamoeba invadens
SAMGQKFHPEHFLCSFCINPLTEDSFKQ

SEQ ID NO: 3016301 - protein, 25 aa, Entamoeba invadens
SAMKNKNFKLARENLENLKKMLKEQ

SEQ ID NO: 3016302 - protein, 17 aa, Entamoeba invadens
SAMLIKVLLPPLDETKK

SEQ ID NO: 3016303 - protein, 18 aa, Entamoeba invadens
SAMNCCANFAFANRGMIT

SEQ ID NO: 3016304 - protein, 20 aa, Entamoeba invadens
SAMTENLLPSFLSTGSSTHK

SEQ ID NO: 3016305 - protein, 26 aa, Entamoeba invadens
SANEGIWRAMWRVVVYLDEHWSFDHT

SEQ ID NO: 3016306 - protein, 21 aa, Entamoeba invadens
SANFFLNLKTDFSPSTLESIL

SEQ ID NO: 3016307 - protein, 25 aa, Entamoeba invadens
SANQLLVLPNVRLALTNPSTPTHNN

SEQ ID NO: 3016308 - protein, 27 aa, Entamoeba invadens
SAPIEQCVDNWYWSLVGYCVASYVLGL

SEQ ID NO: 3016309 - protein, 27 aa, Entamoeba invadens
SAPINPIVPPMRFSSLLPTKPVPPPQS

SEQ ID NO: 3016310 - protein, 23 aa, Entamoeba invadens
SAPKLVFLTTLRNLKKVLLRCKS

SEQ ID NO: 3016311 - protein, 38 aa, Entamoeba invadens
SAPPPPGDLAPPPGLAPPPGMMPPPPGPPPPSNSKMPA

SEQ ID NO: 3016312 - protein, 32 aa, Entamoeba invadens
SAQKYIGALRVYCYFFPSLFSSSFHTSYFLAV

SEQ ID NO: 3016313 - protein, 24 aa, Entamoeba invadens
SAQMITYRFKNGCLATLRGSGTEP

SEQ ID NO: 3016314 - protein, 24 aa, Entamoeba invadens
SAQPNVFHLIINSIAPSIYGHDAS

SEQ ID NO: 3016315 - protein, 26 aa, Entamoeba invadens
SARFSDRIFGYLRSAGKSKTPFKIFA

SEQ ID NO: 3016316 - protein, 22 aa, Entamoeba invadens
SARIASYRFNGKVISKGFAFVE

SEQ ID NO: 3016317 - protein, 25 aa, Entamoeba invadens
SARKEIPLYLDLNDTGLLLTEAVVP

SEQ ID NO: 3016318 - protein, 35 aa, Entamoeba invadens
SARSVVKLFYAFQDVLNLYLVMEFCPGGDLRCLLS

SEQ ID NO: 3016319 - protein, 21 aa, Entamoeba invadens
SASALILKALKEPPKDRKKNK

SEQ ID NO: 3016320 - protein, 19 aa, Entamoeba invadens
SASAPPFTCRAATYAFQTF

SEQ ID NO: 3016321 - protein, 21 aa, Entamoeba invadens
SASLKELVLPCGLTKLGFGAF

SEQ ID NO: 3016322 - protein, 25 aa, Entamoeba invadens
SASQLPHPLPPLLASRLLQVVANNP

SEQ ID NO: 3016323 - protein, 34 aa, Entamoeba invadens
SASTLDSFKLFKDLYVTFANKLKLLDTPFCVFPI

SEQ ID NO: 3016324 - protein, 31 aa, Entamoeba invadens
SASVDWWTLGVLMYEFLYGCNPFVASSKQET

SEQ ID NO: 3016325 - protein, 21 aa, Entamoeba invadens
SATFIFCKNLTNVKLPDNLQH

SEQ ID NO: 3016326 - protein, 25 aa, Entamoeba invadens
SATIPQSLGVFLKKTLKRPEIIRLD

SEQ ID NO: 3016327 - protein, 31 aa, Entamoeba invadens
SATNKLLIKVLLYQFIICPILDDPTLIGYKQ

SEQ ID NO: 3016328 - protein, 32 aa, Entamoeba invadens
SATNNFMSEILLRLNYTLTYRKTRGTSIILKM

SEQ ID NO: 3016329 - protein, 24 aa, Entamoeba invadens
SATTRLIPTVPFLANNSANTHIAG

SEQ ID NO: 3016330 - protein, 28 aa, Entamoeba invadens
SATYREPTIYPFVVFHAQPLVKFDMTVE

SEQ ID NO: 3016331 - protein, 24 aa, Entamoeba invadens
SAVDAFFNYPLRLSNKKRPSKGVI

SEQ ID NO: 3016332 - protein, 27 aa, Entamoeba invadens
SAVDFDTVVNWFGPFFGEQAIFDEMLK

SEQ ID NO: 3016333 - protein, 28 aa, Entamoeba invadens
SAVDIFFTLIREFIPVFTPDLTEVILKT

SEQ ID NO: 3016334 - protein, 27 aa, Entamoeba invadens
SAVDYTLVKAFLRKVYEKLPTSLLKAQ

SEQ ID NO: 3016335 - protein, 25 aa, Entamoeba invadens
SAVKKCFEKVWSIEKMELAMPTVSL

SEQ ID NO: 3016336 - protein, 18 aa, Entamoeba invadens
SAVNPFKEFTRKTSVASF

SEQ ID NO: 3016337 - protein, 17 aa, Entamoeba invadens
SAVPPLPLFSIDQNSIL

SEQ ID NO: 3016338 - protein, 17 aa, Entamoeba invadens
SAVWFDLKDGPVTFTFQ

SEQ ID NO: 3016339 - protein, 21 aa, Entamoeba invadens
SAVWRNIYLTGAFEIMGEKAK

SEQ ID NO: 3016340 - protein, 21 aa, Entamoeba invadens
SAWANLQKYKLIFDSSKYETL

SEQ ID NO: 3016341 - protein, 17 aa, Entamoeba invadens
SAYISSYVPFSTKSKRS

SEQ ID NO: 3016342 - protein, 26 aa, Entamoeba invadens
SAYNLPLVDFCPCNFKYGVNNQPTTS

SEQ ID NO: 3016343 - protein, 33 aa, Entamoeba invadens
SCAIDVWSAGCICAELILGIPLFPGNSEYNELY

SEQ ID NO: 3016344 - protein, 25 aa, Entamoeba invadens
SCAPLLPIIFVVFQVNNFLQSAMFI

SEQ ID NO: 3016345 - protein, 20 aa, Entamoeba invadens
SCCEALTNIVLPYTLTSIGK

SEQ ID NO: 3016346 - protein, 17 aa, Entamoeba invadens
SCCHKKYHKACYDGSLC

SEQ ID NO: 3016347 - protein, 19 aa, Entamoeba invadens
SCCTFELARRLIKPIINIT

SEQ ID NO: 3016348 - protein, 29 aa, Entamoeba invadens
SCEAQMISSKWYSIPFKEIALATIDDIQP

SEQ ID NO: 3016349 - protein, 25 aa, Entamoeba invadens
SCEENQYLGFNLLKTFYKTNYYEDS

SEQ ID NO: 3016350 - protein, 19 aa, Entamoeba invadens
SCEVLITLIAMKCNNPNKV

SEQ ID NO: 3016351 - protein, 26 aa, Entamoeba invadens
SCEVMITLLCLKANYPKRVFLLRGNH

SEQ ID NO: 3016352 - protein, 24 aa, Entamoeba invadens
SCFAKLEELLLGINIIDRLPDTMS

SEQ ID NO: 3016353 - protein, 18 aa, Entamoeba invadens
SCFDLTMCMSCVDGYFLS

SEQ ID NO: 3016354 - protein, 22 aa, Entamoeba invadens
SCFKGCNLLKTLLPQCVLETPR

SEQ ID NO: 3016355 - protein, 18 aa, Entamoeba invadens
SCFSCKDPYYLLNQKCLS

SEQ ID NO: 3016356 - protein, 18 aa, Entamoeba invadens
SCGFDWCHQNPDLLCTWY

SEQ ID NO: 3016357 - protein, 19 aa, Entamoeba invadens
SCIRMLLDIPNATNLIVED

SEQ ID NO: 3016358 - protein, 22 aa, Entamoeba invadens
SCISCIIGYYYSGGLCPICDTS

SEQ ID NO: 3016359 - protein, 19 aa, Entamoeba invadens
SCISGFYLSNYSCYTCFSS

SEQ ID NO: 3016360 - protein, 26 aa, Entamoeba invadens
SCIVDAFNIIFKKGFDKKVALEFYDK

SEQ ID NO: 3016361 - protein, 18 aa, Entamoeba invadens
SCIYAMKNGSPLLIGVAE

SEQ ID NO: 3016362 - protein, 20 aa, Entamoeba invadens
SCKAAIDTLLLLKPKEKKAA

SEQ ID NO: 3016363 - protein, 22 aa, Entamoeba invadens
SCKSEFVLKLNMLCSQDTNCVN

SEQ ID NO: 3016364 - protein, 20 aa, Entamoeba invadens
SCKSGHFQNGIFTCQNHLPC

SEQ ID NO: 3016365 - protein, 22 aa, Entamoeba invadens
SCKTFEYFLNIETLHLWNVEDE

SEQ ID NO: 3016366 - protein, 23 aa, Entamoeba invadens
SCKYIPCIYVVNKIDQMNKEDVD

SEQ ID NO: 3016367 - protein, 24 aa, Entamoeba invadens
SCLAKLEELLLGINIIDRLPDTMS

SEQ ID NO: 3016368 - protein, 30 aa, Entamoeba invadens
SCLDDFLVAKLYRCFWPPSILALEKVDVFD

SEQ ID NO: 3016369 - protein, 28 aa, Entamoeba invadens
SCLDKNTMLFFSFYQRFVIEELFYVCQS

SEQ ID NO: 3016370 - protein, 26 aa, Entamoeba invadens
SCLERIRLFWMNYEDSQALSLLVITY

SEQ ID NO: 3016371 - protein, 20 aa, Entamoeba invadens
SCLGQWYPSPFDYNNQHFLF

SEQ ID NO: 3016372 - protein, 28 aa, Entamoeba invadens
SCLLNYVYVIREHLTQCVLSVKVVQKES

SEQ ID NO: 3016373 - protein, 25 aa, Entamoeba invadens
SCLLQGHNFHFIEELILSKYHYKAF

SEQ ID NO: 3016374 - protein, 17 aa, Entamoeba invadens
SCLPLCFGAIDVLSNVF

SEQ ID NO: 3016375 - protein, 17 aa, Entamoeba invadens
SCLSLKDIVLPKSLQNV

SEQ ID NO: 3016376 - protein, 36 aa, Entamoeba invadens
SCLTKIERMYLIQQLFHGLMIFKDKFGTFPKSHDTD

SEQ ID NO: 3016377 - protein, 27 aa, Entamoeba invadens
SCLYFEELDLLIAGDTLFRESYGKTEM

SEQ ID NO: 3016378 - protein, 26 aa, Entamoeba invadens
SCNLDNLKTLFIYQGNRLTFSKKLNS

SEQ ID NO: 3016379 - protein, 30 aa, Entamoeba invadens
SCNTIAGLFKLFLRELPTPAIPTQFYDNFV

SEQ ID NO: 3016380 - protein, 17 aa, Entamoeba invadens
SCPAFSLKFPKISDSQS

SEQ ID NO: 3016381 - protein, 24 aa, Entamoeba invadens
SCPHFKPKKLVTRNSYYKTETPSQ

SEQ ID NO: 3016382 - protein, 20 aa, Entamoeba invadens
SCQFQILTALKKVSNHPWLI

SEQ ID NO: 3016383 - protein, 17 aa, Entamoeba invadens
SCRELRRTLPEPVKKRR

SEQ ID NO: 3016384 - protein, 23 aa, Entamoeba invadens
SCRELRVPLLKLVSFEDFAKHNI

SEQ ID NO: 3016385 - protein, 23 aa, Entamoeba invadens
SCRTPTYVPVIDADGLIIKQEGA

SEQ ID NO: 3016386 - protein, 21 aa, Entamoeba invadens
SCSDGYYLDGNICKRCTTGCS

SEQ ID NO: 3016387 - protein, 26 aa, Entamoeba invadens
SCSQAHLIIYEYIKALNPPLIPSYVN

SEQ ID NO: 3016388 - protein, 23 aa, Entamoeba invadens
SCSRITHISLPSAVSFLNGSTFA

SEQ ID NO: 3016389 - protein, 17 aa, Entamoeba invadens
SCTFYRCHNLRSITLPQ

SEQ ID NO: 3016390 - protein, 18 aa, Entamoeba invadens
SCTKELMNVIYKQNYRQL

SEQ ID NO: 3016391 - protein, 24 aa, Entamoeba invadens
SCTSCVNNYFLLNTNYCMECDNNC

SEQ ID NO: 3016392 - protein, 23 aa, Entamoeba invadens
SCTVVIYIVGCLYVDKFGEGSAV

SEQ ID NO: 3016393 - protein, 23 aa, Entamoeba invadens
SCVDICMRACAVPGYFTEYQGYL

SEQ ID NO: 3016394 - protein, 27 aa, Entamoeba invadens
SCVDNLERKFWIFYNDIFHKVENSLVE

SEQ ID NO: 3016395 - protein, 25 aa, Entamoeba invadens
SCVKYDLQNPLSCAFLAITSIIAST

SEQ ID NO: 3016396 - protein, 23 aa, Entamoeba invadens
SCVPDYFTVKRGPTDRFLVLACD

SEQ ID NO: 3016397 - protein, 19 aa, Entamoeba invadens
SCVSAINKMWYPSGKLLQT

SEQ ID NO: 3016398 - protein, 24 aa, Entamoeba invadens
SCVSCEDGFALRNGMCLKIENREY

SEQ ID NO: 3016399 - protein, 17 aa, Entamoeba invadens
SCVSCISGFYLSNYSCY

SEQ ID NO: 3016400 - protein, 29 aa, Entamoeba invadens
SCYTMYCFHLKMQMKFVLGCRVGQTPNSN

SEQ ID NO: 3016401 - protein, 21 aa, Entamoeba invadens
SDAFVFKIDYTPKLTETLLPP

SEQ ID NO: 3016402 - protein, 32 aa, Entamoeba invadens
SDAMPVVKDLMKLFCEKYKKQAKSEHWQIQRG

SEQ ID NO: 3016403 - protein, 23 aa, Entamoeba invadens
SDARRRDFTINSLFYRVNDGVIE

SEQ ID NO: 3016404 - protein, 33 aa, Entamoeba invadens
SDAWQILTNLFDCLPLAAVIDQRYFCVHGGLSP

SEQ ID NO: 3016405 - protein, 19 aa, Entamoeba invadens
SDCKFMIGNDREFLLKIQF

SEQ ID NO: 3016406 - protein, 28 aa, Entamoeba invadens
SDCSPAFWNFLNLIGAKIELSKYSGYRG

SEQ ID NO: 3016407 - protein, 33 aa, Entamoeba invadens
SDDAKKLIAKFWPGALTIIFPRAKGVPDEVTAG

SEQ ID NO: 3016408 - protein, 25 aa, Entamoeba invadens
SDDCLTCNSGFFKYGLSNCLSCHNW

SEQ ID NO: 3016409 - protein, 24 aa, Entamoeba invadens
SDDFDVLKLLGYSQLKLNKKSDAI

SEQ ID NO: 3016410 - protein, 25 aa, Entamoeba invadens
SDDGKILFFDFFSSTFSFCAKRKYP

SEQ ID NO: 3016411 - protein, 24 aa, Entamoeba invadens
SDDHIPIMFTVFSSAGYNGTNRGG

SEQ ID NO: 3016412 - protein, 20 aa, Entamoeba invadens
SDDILLISVNLKIGVTGTNN

SEQ ID NO: 3016413 - protein, 17 aa, Entamoeba invadens
SDDLLEKMVWWCGRLFQ

SEQ ID NO: 3016414 - protein, 22 aa, Entamoeba invadens
SDDMPFLIIEKTNLYDYAYKIA

SEQ ID NO: 3016415 - protein, 19 aa, Entamoeba invadens
SDDNMFYIDKKKGFYVLNP

SEQ ID NO: 3016416 - protein, 18 aa, Entamoeba invadens
SDDPRYYNANLIKKPFTT

SEQ ID NO: 3016417 - protein, 23 aa, Entamoeba invadens
SDDQAIMTMLFNLGVEDANLISG

SEQ ID NO: 3016418 - protein, 23 aa, Entamoeba invadens
SDDQKHVISVLYLVLYGVDNILN

SEQ ID NO: 3016419 - protein, 24 aa, Entamoeba invadens
SDDYTSRFFFSSYLSTLHVEWLEK

SEQ ID NO: 3016420 - protein, 26 aa, Entamoeba invadens
SDEEHIFLLFHVIGQPSLEFYKKITK

SEQ ID NO: 3016421 - protein, 40 aa, Entamoeba invadens
SDEELEQAPIVFPKNKKKKRTLIMPWNPHQNDEVENEESD

SEQ ID NO: 3016422 - protein, 25 aa, Entamoeba invadens
SDEEYSLFRIGFKGGIRIGKPNTFN

SEQ ID NO: 3016423 - protein, 19 aa, Entamoeba invadens
SDEFLFELIRCEKLIREKA

SEQ ID NO: 3016424 - protein, 21 aa, Entamoeba invadens
SDEILQELPPLPPPRKRGKIQ

SEQ ID NO: 3016425 - protein, 18 aa, Entamoeba invadens
SDEKSEWLTLQNPVPQTG

SEQ ID NO: 3016426 - protein, 35 aa, Entamoeba invadens
SDENFTLEIILPFEVPYIFDLIQSLVLDKDEYAKG

SEQ ID NO: 3016427 - protein, 34 aa, Entamoeba invadens
SDENPSWIFGVGNSYLFDIGVCKYGLQANHCVQS

SEQ ID NO: 3016428 - protein, 25 aa, Entamoeba invadens
SDEQYMQFYLLDVYQKLTFSNVIAP

SEQ ID NO: 3016429 - protein, 22 aa, Entamoeba invadens
SDESWIEWFCGLDGNQYLCEVD

SEQ ID NO: 3016430 - protein, 33 aa, Entamoeba invadens
SDETRLKDIFNTIQYFLQHKAELNNLDKILSAM

SEQ ID NO: 3016431 - protein, 33 aa, Entamoeba invadens
SDEYTLYRNSWYVFYVLFVIDDMTIINRLFDLV

SEQ ID NO: 3016432 - protein, 18 aa, Entamoeba invadens
SDFGFTRAPSKFFETIHG

SEQ ID NO: 3016433 - protein, 35 aa, Entamoeba invadens
SDFINSVLINKKYRLLLDRFRYNPISVSDIKIFPF

SEQ ID NO: 3016434 - protein, 22 aa, Entamoeba invadens
SDFKQALLVAKLALANRVEKIY

SEQ ID NO: 3016435 - protein, 26 aa, Entamoeba invadens
SDFLNIIQICKKFRYVLDRFRENPIA

SEQ ID NO: 3016436 - protein, 21 aa, Entamoeba invadens
SDFMFKGALPQFDSAFRLEEM

SEQ ID NO: 3016437 - protein, 22 aa, Entamoeba invadens
SDFMFKSDILMYLGKLFEAGAK

SEQ ID NO: 3016438 - protein, 23 aa, Entamoeba invadens
SDFNRKYVVCNSGYYIVNGKCRQ

SEQ ID NO: 3016439 - protein, 20 aa, Entamoeba invadens
SDFPYELETIWMTAAKEVSH

SEQ ID NO: 3016440 - protein, 17 aa, Entamoeba invadens
SDFRYEELQNYIKKFEN

SEQ ID NO: 3016441 - protein, 26 aa, Entamoeba invadens
SDFSCTKFYIQTVFLYTNENKERVLR

SEQ ID NO: 3016442 - protein, 25 aa, Entamoeba invadens
SDFSYPYQRALLRYDGKTNVGYIRD

SEQ ID NO: 3016443 - protein, 20 aa, Entamoeba invadens
SDGEFDVICATIAFGMGINK

SEQ ID NO: 3016444 - protein, 24 aa, Entamoeba invadens
SDGFALFSATVKYLQKLRTKAPKT

SEQ ID NO: 3016445 - protein, 31 aa, Entamoeba invadens
SDGMPPYMDFPPMRALFLITTKGIPPMKNRD

SEQ ID NO: 3016446 - protein, 26 aa, Entamoeba invadens
SDGNRKLVKLLLHQGAVYTKKHDMII

SEQ ID NO: 3016447 - protein, 29 aa, Entamoeba invadens
SDGSLFTQLFLILFPSISPSFFNNIERPV

SEQ ID NO: 3016448 - protein, 25 aa, Entamoeba invadens
SDGTKLIRIVAKLSGKKALRYSLTA

SEQ ID NO: 3016449 - protein, 23 aa, Entamoeba invadens
SDGVAYIYSISSRKLVASLLGHH

SEQ ID NO: 3016450 - protein, 34 aa, Entamoeba invadens
SDHNTLYTIFRALTRSIRTLFKKDFLALDWRQKI

SEQ ID NO: 3016451 - protein, 26 aa, Entamoeba invadens
SDHPSALVRYSLLFTAKAKMQYQLVC

SEQ ID NO: 3016452 - protein, 18 aa, Entamoeba invadens
SDHVRFKRGLRGHISKIY

SEQ ID NO: 3016453 - protein, 24 aa, Entamoeba invadens
SDICKRLHRLPEDVKLFVLEELQT

SEQ ID NO: 3016454 - protein, 22 aa, Entamoeba invadens
SDIDIELLVKYIGLIKESVTLY

SEQ ID NO: 3016455 - protein, 28 aa, Entamoeba invadens
SDIDQHFDIWLRRNLTSIPYVHVDGLVS

SEQ ID NO: 3016456 - protein, 25 aa, Entamoeba invadens
SDIEKVYTLILRAADGVGLFDARDR

SEQ ID NO: 3016457 - protein, 30 aa, Entamoeba invadens
SDIFHSSLACLVLFNVLNELKFNSAPHSNT

SEQ ID NO: 3016458 - protein, 18 aa, Entamoeba invadens
SDIKKFRLIIEQMPTRCY

SEQ ID NO: 3016459 - protein, 19 aa, Entamoeba invadens
SDILKDRYTRCLELYVAPR

SEQ ID NO: 3016460 - protein, 22 aa, Entamoeba invadens
SDILRFFEGQVLDNSLKEFKEM

SEQ ID NO: 3016461 - protein, 25 aa, Entamoeba invadens
SDINISIIMELLPGGTLFSRVSKNE

SEQ ID NO: 3016462 - protein, 25 aa, Entamoeba invadens
SDINNYQLFIGYRKVVNGFSTSEDK

SEQ ID NO: 3016463 - protein, 17 aa, Entamoeba invadens
SDIPEISGVLSGSIWGM

SEQ ID NO: 3016464 - protein, 25 aa, Entamoeba invadens
SDIPKFVDPLHWLEYFPTCGVEDLK

SEQ ID NO: 3016465 - protein, 30 aa, Entamoeba invadens
SDIPMLFVIGCALPLRRHLFNKIVFKVVNP

SEQ ID NO: 3016466 - protein, 32 aa, Entamoeba invadens
SDIRDVILVGGPTRLCCFKKMIKNMFGKESLS

SEQ ID NO: 3016467 - protein, 35 aa, Entamoeba invadens
SDITMLDDLLWIRHLPIAFLMREHMMLLRQSEEIN

SEQ ID NO: 3016468 - protein, 35 aa, Entamoeba invadens
SDITMLDDLLWVRHLPIAYLMRQHLILLMKSEEIN

SEQ ID NO: 3016469 - protein, 32 aa, Entamoeba invadens
SDIVLKIIFSNQIFTKILILNATKVPSFDNVE

SEQ ID NO: 3016470 - protein, 27 aa, Entamoeba invadens
SDIVVFAFPVYWYDLPGEVKLFVDRTV

SEQ ID NO: 3016471 - protein, 23 aa, Entamoeba invadens
SDIYMKKFFEVFREFVQPNDLLG

SEQ ID NO: 3016472 - protein, 40 aa, Entamoeba invadens
SDKEGVVYYLLNGFLFGNASERWYIFNLPSQVDDLIDKLS

SEQ ID NO: 3016473 - protein, 33 aa, Entamoeba invadens
SDKIENLRRDNYDLYYTVFLNEQFKDQSVQLQI

SEQ ID NO: 3016474 - protein, 24 aa, Entamoeba invadens
SDKIGVLWFHYLVGLESTIAKFTN

SEQ ID NO: 3016475 - protein, 25 aa, Entamoeba invadens
SDKIKKYLALYSIENDIKKLDKICD

SEQ ID NO: 3016476 - protein, 25 aa, Entamoeba invadens
SDKKAIKFCIEISFAGLSRNALNRA

SEQ ID NO: 3016477 - protein, 18 aa, Entamoeba invadens
SDKKAYDLLIQAAAGLIS

SEQ ID NO: 3016478 - protein, 25 aa, Entamoeba invadens
SDKKIEAFVIIPYITQLIEIMEKEE

SEQ ID NO: 3016479 - protein, 25 aa, Entamoeba invadens
SDKKVVLKVLYMVHKMLRSPNFSFE

SEQ ID NO: 3016480 - protein, 25 aa, Entamoeba invadens
SDKLFKSEVFTKPVFSFGKREEEIV

SEQ ID NO: 3016481 - protein, 24 aa, Entamoeba invadens
SDKLSLCIMLNLAEAIIELKEYNS

SEQ ID NO: 3016482 - protein, 23 aa, Entamoeba invadens
SDKMPFPVKEIPQYTLSPYDMLS

SEQ ID NO: 3016483 - protein, 32 aa, Entamoeba invadens
SDKPNYTIDYLLQTQPLPFIKDPLKSIDDLKN

SEQ ID NO: 3016484 - protein, 23 aa, Entamoeba invadens
SDKRKRFYIVKLNQVMVEHFANR

SEQ ID NO: 3016485 - protein, 19 aa, Entamoeba invadens
SDLENLPIIALRLVNGIKS

SEQ ID NO: 3016486 - protein, 24 aa, Entamoeba invadens
SDLFDFRIMFKCTPPHQFQLEGFQ

SEQ ID NO: 3016487 - protein, 22 aa, Entamoeba invadens
SDLFSPLPFYYQEVAYSLMKTA

SEQ ID NO: 3016488 - protein, 22 aa, Entamoeba invadens
SDLHSGVALIKFLEKETGKPAK

SEQ ID NO: 3016489 - protein, 21 aa, Entamoeba invadens
SDLKQYIFPHGFQTRSKRISL

SEQ ID NO: 3016490 - protein, 24 aa, Entamoeba invadens
SDLKTLFEGFDIVSARIASYRFNG

SEQ ID NO: 3016491 - protein, 21 aa, Entamoeba invadens
SDLPQLVQPPQLNKLSMSTVS

SEQ ID NO: 3016492 - protein, 24 aa, Entamoeba invadens
SDLRLRQVLIYLFSQEYSDDDKNA

SEQ ID NO: 3016493 - protein, 33 aa, Entamoeba invadens
SDLSLLSYCEACIGYFQMVCRKAFEWNSVKNFW

SEQ ID NO: 3016494 - protein, 25 aa, Entamoeba invadens
SDLTVKRILKYFPKLELLQVDPVTA

SEQ ID NO: 3016495 - protein, 32 aa, Entamoeba invadens
SDLYSAGVVLYYLLYGKLPFLCETEKELLAKY

SEQ ID NO: 3016496 - protein, 26 aa, Entamoeba invadens
SDLYSLGVVLYFLLNGNYPFNPNNVE

SEQ ID NO: 3016497 - protein, 25 aa, Entamoeba invadens
SDLYTQFLTYKSVQGTLLMSNNYLK

SEQ ID NO: 3016498 - protein, 28 aa, Entamoeba invadens
SDMADCVKLINFLELLSGERVIGYIPKA

SEQ ID NO: 3016499 - protein, 35 aa, Entamoeba invadens
SDMDRYKAFIFVGPVWSWDLCAPLKTACKEIIKTI

SEQ ID NO: 3016500 - protein, 22 aa, Entamoeba invadens
SDMMIRGIALNKYFSSLTVNED

SEQ ID NO: 3016501 - protein, 19 aa, Entamoeba invadens
SDMVLAYYSDLLNSASVIS

SEQ ID NO: 3016502 - protein, 26 aa, Entamoeba invadens
SDNELPPITFLATKPRRKIEGEYFTF

SEQ ID NO: 3016503 - protein, 39 aa, Entamoeba invadens
SDNEQLKYFVPFISAYRGLLLNLLLYLPNEEFKIEEREI

SEQ ID NO: 3016504 - protein, 17 aa, Entamoeba invadens
SDNLKTPILFLFTEMSV

SEQ ID NO: 3016505 - protein, 33 aa, Entamoeba invadens
SDNLWERRISIVSTLYFIRKRKFKDALKLCRIL

SEQ ID NO: 3016506 - protein, 17 aa, Entamoeba invadens
SDNNAFTFVLRERGVDK

SEQ ID NO: 3016507 - protein, 23 aa, Entamoeba invadens
SDNPSFINLSKYTKAKSLSHRHA

SEQ ID NO: 3016508 - protein, 19 aa, Entamoeba invadens
SDPFGRLSFYGMKAVVSPN

SEQ ID NO: 3016509 - protein, 23 aa, Entamoeba invadens
SDPKDFFDTLYHRCLFETNRELQ

SEQ ID NO: 3016510 - protein, 19 aa, Entamoeba invadens
SDPSLLQCFKSPKERLCNT

SEQ ID NO: 3016511 - protein, 22 aa, Entamoeba invadens
SDQELLLVRIVYGGLLIEKGVY

SEQ ID NO: 3016512 - protein, 24 aa, Entamoeba invadens
SDQIESCLVKFFEKNFEGYKNVVG

SEQ ID NO: 3016513 - protein, 19 aa, Entamoeba invadens
SDQLFKFGTDLLQSGWRVA

SEQ ID NO: 3016514 - protein, 29 aa, Entamoeba invadens
SDQTLLHYEGLLNIPIIKFTYDQFEKAYP

SEQ ID NO: 3016515 - protein, 23 aa, Entamoeba invadens
SDQVDVLLFCESLKPRNMKRFTV

SEQ ID NO: 3016516 - protein, 26 aa, Entamoeba invadens
SDQYLTTLNLPYGLTKIGYGAFENIT

SEQ ID NO: 3016517 - protein, 21 aa, Entamoeba invadens
SDRINTFERSGSTSPKENSGE

SEQ ID NO: 3016518 - protein, 25 aa, Entamoeba invadens
SDRVDFFQICVWCEVSYALSNFHQS

SEQ ID NO: 3016519 - protein, 23 aa, Entamoeba invadens
SDSDIQFIMKLIYKLLKAQKCQE

SEQ ID NO: 3016520 - protein, 20 aa, Entamoeba invadens
SDSIDLTMLYALKDIIGVGE

SEQ ID NO: 3016521 - protein, 19 aa, Entamoeba invadens
SDSIGFTSFMYPCCIIEFN

SEQ ID NO: 3016522 - protein, 29 aa, Entamoeba invadens
SDSIHFLEDLLYIIGIDCFCQIGDKVGNT

SEQ ID NO: 3016523 - protein, 25 aa, Entamoeba invadens
SDSKIKFFFYKALPTRRKVVEVRAM

SEQ ID NO: 3016524 - protein, 30 aa, Entamoeba invadens
SDSPNIVVPNFIFFLYNTRSTNEPEVSIPK

SEQ ID NO: 3016525 - protein, 18 aa, Entamoeba invadens
SDSQIIAILPNNSNYKFL

SEQ ID NO: 3016526 - protein, 31 aa, Entamoeba invadens
SDSSRNCTKCESGYYPVLQSNESKMCEPCDS

SEQ ID NO: 3016527 - protein, 23 aa, Entamoeba invadens
SDTCLDTFRIFPFGNPRVVMLAN

SEQ ID NO: 3016528 - protein, 29 aa, Entamoeba invadens
SDTDGFYQIVIPLLLKYNTNNAWWNGYCE

SEQ ID NO: 3016529 - protein, 18 aa, Entamoeba invadens
SDTIADCLELLLIRQNDG

SEQ ID NO: 3016530 - protein, 24 aa, Entamoeba invadens
SDTKYYYVYSDIKKYHPSVGDVVV

SEQ ID NO: 3016531 - protein, 25 aa, Entamoeba invadens
SDTNTLPVLLFKLIDSDNSGVIEHS

SEQ ID NO: 3016532 - protein, 26 aa, Entamoeba invadens
SDTSAVWFSILPKKGVMFKFTICQEA

SEQ ID NO: 3016533 - protein, 19 aa, Entamoeba invadens
SDTYTIPSLKFSVLKKLIL

SEQ ID NO: 3016534 - protein, 25 aa, Entamoeba invadens
SDVAFFKCFALSKIEIPKSLTKIGV

SEQ ID NO: 3016535 - protein, 30 aa, Entamoeba invadens
SDVFQTKRIGYLALGLLLDETQETLTLVIN

SEQ ID NO: 3016536 - protein, 24 aa, Entamoeba invadens
SDVFVIVYAINYRESFDEITQIHQ

SEQ ID NO: 3016537 - protein, 20 aa, Entamoeba invadens
SDVFWILKSIMEFMGVFYRK

SEQ ID NO: 3016538 - protein, 25 aa, Entamoeba invadens
SDVIYNNIFYKCDIGYSGDSRGPRR

SEQ ID NO: 3016539 - protein, 35 aa, Entamoeba invadens
SDVNILLYVILIGDYLWMQYVTIPPSVTSINIGCF

SEQ ID NO: 3016540 - protein, 19 aa, Entamoeba invadens
SDVQPTIKILLQTGSPVVK

SEQ ID NO: 3016541 - protein, 30 aa, Entamoeba invadens
SDVVLFVETLFFVFGSYHKSLPADRKVLCE

SEQ ID NO: 3016542 - protein, 25 aa, Entamoeba invadens
SDVYSFGLLLWELKNNDIPFKEFTF

SEQ ID NO: 3016543 - protein, 28 aa, Entamoeba invadens
SDWEALKLLERMIALIDLRIEPSEYNVF

SEQ ID NO: 3016544 - protein, 18 aa, Entamoeba invadens
SDWHPILSFVTVSERNMA

SEQ ID NO: 3016545 - protein, 26 aa, Entamoeba invadens
SDWLQTDGLLFFMAYKRIELNIKNLF

SEQ ID NO: 3016546 - protein, 23 aa, Entamoeba invadens
SDWRSFLIFQQECTRNWAVCVLQ

SEQ ID NO: 3016547 - protein, 21 aa, Entamoeba invadens
SDWSACFSELFTTLPVVNEIT

SEQ ID NO: 3016548 - protein, 18 aa, Entamoeba invadens
SDYFEMQKLLLDHFLPVM

SEQ ID NO: 3016549 - protein, 20 aa, Entamoeba invadens
SDYKYLRALMSALYTINLSK

SEQ ID NO: 3016550 - protein, 17 aa, Entamoeba invadens
SDYQSYYEFFFKEKIRA

SEQ ID NO: 3016551 - protein, 23 aa, Entamoeba invadens
SDYSKLSYVNYFLSGITADNVCT

SEQ ID NO: 3016552 - protein, 21 aa, Entamoeba invadens
SDYTLIKYYAEFYNTSFSVAS

SEQ ID NO: 3016553 - protein, 23 aa, Entamoeba invadens
SDYVNMFVLFPEHIVKIIAMQFV

SEQ ID NO: 3016554 - protein, 28 aa, Entamoeba invadens
SEAHRFVPFFRVIVLHRALSSSGQDNLE

SEQ ID NO: 3016555 - protein, 30 aa, Entamoeba invadens
SEAKKQMLYFRLFDDAWLFAKVYNIGEEAK

SEQ ID NO: 3016556 - protein, 27 aa, Entamoeba invadens
SEAMKQVYFGQVVFSVLLINSDQCYTE

SEQ ID NO: 3016557 - protein, 18 aa, Entamoeba invadens
SEAMLKIEKKWKKAGSEV

SEQ ID NO: 3016558 - protein, 25 aa, Entamoeba invadens
SEAPTEMMMYFPKLKAICTAEEINR

SEQ ID NO: 3016559 - protein, 31 aa, Entamoeba invadens
SEAQQDFLVLYLDWVVKMILDGGFIAPRDYI

SEQ ID NO: 3016560 - protein, 28 aa, Entamoeba invadens
SECASLCTIPLVKSLKSFGKRCFYGMKN

SEQ ID NO: 3016561 - protein, 25 aa, Entamoeba invadens
SECEIPHFNIFISPADFLLVDITPE

SEQ ID NO: 3016562 - protein, 25 aa, Entamoeba invadens
SECESILFDFFKLMLSEFEFICEDM

SEQ ID NO: 3016563 - protein, 28 aa, Entamoeba invadens
SECNSLSEIYFPRALLSIGESGFSHCYN

SEQ ID NO: 3016564 - protein, 23 aa, Entamoeba invadens
SECNTLLNNLVVAAVTKIKGELV

SEQ ID NO: 3016565 - protein, 24 aa, Entamoeba invadens
SECSSLTYVYIPSNVKLIGDGCFY

SEQ ID NO: 3016566 - protein, 26 aa, Entamoeba invadens
SECYAFRWISIFFIDNFSFEDSLRIW

SEQ ID NO: 3016567 - protein, 20 aa, Entamoeba invadens
SECYSLSVVVIPLSVTFFGD

SEQ ID NO: 3016568 - protein, 17 aa, Entamoeba invadens
SEDCNVYIWSIPEGCPQ

SEQ ID NO: 3016569 - protein, 23 aa, Entamoeba invadens
SEDDVLFSLPFLNRVSLSERSGV

SEQ ID NO: 3016570 - protein, 24 aa, Entamoeba invadens
SEDHNIYFDAFPEIARKFVDMATD

SEQ ID NO: 3016571 - protein, 22 aa, Entamoeba invadens
SEDNALFSLPFLNCVSLSERSG

SEQ ID NO: 3016572 - protein, 23 aa, Entamoeba invadens
SEDNALFSLPFLNRVSLSERSGV

SEQ ID NO: 3016573 - protein, 18 aa, Entamoeba invadens
SEDSFGLFNMYCGNEKEE

SEQ ID NO: 3016574 - protein, 24 aa, Entamoeba invadens
SEDYMTLILVYIVKSLNAYKKEIC

SEQ ID NO: 3016575 - protein, 21 aa, Entamoeba invadens
SEECLKVYLGVGLDWAPVNSI

SEQ ID NO: 3016576 - protein, 31 aa, Entamoeba invadens
SEEEARHFYFYILWVLKNIEVKTLTNLLNKD

SEQ ID NO: 3016577 - protein, 19 aa, Entamoeba invadens
SEEFLRFDRSKVLPELLFF

SEQ ID NO: 3016578 - protein, 24 aa, Entamoeba invadens
SEEGILRPVWIPDNETKCCLICHD

SEQ ID NO: 3016579 - protein, 25 aa, Entamoeba invadens
SEEIDMLYGIDYDRVLQVLKTIYRD

SEQ ID NO: 3016580 - protein, 24 aa, Entamoeba invadens
SEEKKDVFLFLVGNKNDIGKREVT

SEQ ID NO: 3016581 - protein, 31 aa, Entamoeba invadens
SEELGFIELLQKYYCSIALLLSTQTANTLAK

SEQ ID NO: 3016582 - protein, 21 aa, Entamoeba invadens
SEELPLVYPVDVPSNGEVLEF

SEQ ID NO: 3016583 - protein, 26 aa, Entamoeba invadens
SEENKLRFMLYIAPLKNDSSKEGMLS

SEQ ID NO: 3016584 - protein, 23 aa, Entamoeba invadens
SEEQLMEYFTKLNIVTKKAGHGL

SEQ ID NO: 3016585 - protein, 17 aa, Entamoeba invadens
SEERNIKAIAHYPHLIS

SEQ ID NO: 3016586 - protein, 26 aa, Entamoeba invadens
SEESTFCINIPQKLFLLKAENEDNKL

SEQ ID NO: 3016587 - protein, 26 aa, Entamoeba invadens
SEETFLFFMKRELECPFLITKRDQKK

SEQ ID NO: 3016588 - protein, 24 aa, Entamoeba invadens
SEEVTLLIMKQVLEALVYLHAKGI

SEQ ID NO: 3016589 - protein, 23 aa, Entamoeba invadens
SEEVVIVTYYPQAIFRCRPISHS

SEQ ID NO: 3016590 - protein, 18 aa, Entamoeba invadens
SEEWKKCDFLTELENAKS

SEQ ID NO: 3016591 - protein, 32 aa, Entamoeba invadens
SEEYKAPLRVLLTQLWKDFGDYAQAMCLVAAF

SEQ ID NO: 3016592 - protein, 17 aa, Entamoeba invadens
SEEYRKRIAERSQKIII

SEQ ID NO: 3016593 - protein, 26 aa, Entamoeba invadens
SEEYVNIFMFLIVKAQVIDLFGILAM

SEQ ID NO: 3016594 - protein, 20 aa, Entamoeba invadens
SEFAVLFKTRDPVILKLSTE

SEQ ID NO: 3016595 - protein, 26 aa, Entamoeba invadens
SEFCSKFTTFILMESVEINPEIFSQI

SEQ ID NO: 3016596 - protein, 18 aa, Entamoeba invadens
SEFELLPSTMKITCEIAG

SEQ ID NO: 3016597 - protein, 24 aa, Entamoeba invadens
SEFFERYRWIMHDVVLMQKNGETK

SEQ ID NO: 3016598 - protein, 26 aa, Entamoeba invadens
SEFGDGTLFARFINSFRANAITANMF

SEQ ID NO: 3016599 - protein, 18 aa, Entamoeba invadens
SEFISLYIRRRCYICGGV

SEQ ID NO: 3016600 - protein, 24 aa, Entamoeba invadens
SEFKPNTFIVQQKKPQKPLPPLPT

SEQ ID NO: 3016601 - protein, 18 aa, Entamoeba invadens
SEFKYPWKKAEFVNSGNR

SEQ ID NO: 3016602 - protein, 19 aa, Entamoeba invadens
SEFLIECDMVVQAISQAVD

SEQ ID NO: 3016603 - protein, 21 aa, Entamoeba invadens
SEFRKRKGFEIGLRKKEVFGK

SEQ ID NO: 3016604 - protein, 19 aa, Entamoeba invadens
SEFYDLFRVFHVGEIPLKY

SEQ ID NO: 3016605 - protein, 18 aa, Entamoeba invadens
SEFYERSMCGTSPFLLAC

SEQ ID NO: 3016606 - protein, 26 aa, Entamoeba invadens
SEGKECFIPYRDSKLTQLMRDSLGGN

SEQ ID NO: 3016607 - protein, 26 aa, Entamoeba invadens
SEGKTDYFAKYFIAKSVRVIDDMVVD

SEQ ID NO: 3016608 - protein, 23 aa, Entamoeba invadens
SEGNLKAEYIGKKVQATLDLQQT

SEQ ID NO: 3016609 - protein, 24 aa, Entamoeba invadens
SEGQKKLFLVLRALANRDKEVGYV

SEQ ID NO: 3016610 - protein, 30 aa, Entamoeba invadens
SEHDGKFHLFSSFILYKFDNNSKTENTLKS

SEQ ID NO: 3016611 - protein, 29 aa, Entamoeba invadens
SEHLLVKLPFCHLFDFFAVSLDPNQVDGI

SEQ ID NO: 3016612 - protein, 24 aa, Entamoeba invadens
SEHPEVFKFLLRVGSFDMKGDESI

SEQ ID NO: 3016613 - protein, 24 aa, Entamoeba invadens
SEHVNSPYVLPYSKRQPIPEFVFK

SEQ ID NO: 3016614 - protein, 26 aa, Entamoeba invadens
SEICGKRSLLFVFQTKEYVFGFYQKD

SEQ ID NO: 3016615 - protein, 26 aa, Entamoeba invadens
SEICGLDIVVYLLSDPSNIQKVSETF

SEQ ID NO: 3016616 - protein, 25 aa, Entamoeba invadens
SEIDKLFKNIVNTPTFVAISFQSDE

SEQ ID NO: 3016617 - protein, 23 aa, Entamoeba invadens
SEIDRWIFHRMNVMVETLRKQIE

SEQ ID NO: 3016618 - protein, 22 aa, Entamoeba invadens
SEIEIFKKTLSRWTDKRMFKVI

SEQ ID NO: 3016619 - protein, 25 aa, Entamoeba invadens
SEIEKCMELFFKIPSPTIQSIPTLS

SEQ ID NO: 3016620 - protein, 29 aa, Entamoeba invadens
SEIEMISYYPRTFYRFGKISEFSSLYFIA

SEQ ID NO: 3016621 - protein, 22 aa, Entamoeba invadens
SEIFVDSIKKLIENKLLVDISP

SEQ ID NO: 3016622 - protein, 25 aa, Entamoeba invadens
SEIGPSFLLSIDKMKYIFNTPESFQ

SEQ ID NO: 3016623 - protein, 18 aa, Entamoeba invadens
SEIITFCMSLSMFPESDT

SEQ ID NO: 3016624 - protein, 18 aa, Entamoeba invadens
SEIKLLFLHVFAICAQET

SEQ ID NO: 3016625 - protein, 25 aa, Entamoeba invadens
SEIKNDVPWLLITYPNNIEAVGDRV

SEQ ID NO: 3016626 - protein, 24 aa, Entamoeba invadens
SEIKSLLPIVFNKSTQIGNSIEKK

SEQ ID NO: 3016627 - protein, 27 aa, Entamoeba invadens
SEIPDTIFRLEKLKKLNFFSNKIKTVP

SEQ ID NO: 3016628 - protein, 17 aa, Entamoeba invadens
SEIPDYDILRHLPQNVH

SEQ ID NO: 3016629 - protein, 22 aa, Entamoeba invadens
SEISFMLESLYPNGVEIAGCSA

SEQ ID NO: 3016630 - protein, 30 aa, Entamoeba invadens
SEISQTLMNLIFFWYQNYNEDFRSVFCENI

SEQ ID NO: 3016631 - protein, 28 aa, Entamoeba invadens
SEIVLKLKTLFLEEFCLHLPSNAFSVFA

SEQ ID NO: 3016632 - protein, 21 aa, Entamoeba invadens
SEIVNLLETLKLWLETDPFQF

SEQ ID NO: 3016633 - protein, 23 aa, Entamoeba invadens
SEIYGSLPFTLINIQPTDIKTPR

SEQ ID NO: 3016634 - protein, 22 aa, Entamoeba invadens
SEIYKALRQLLTSYLIEHKDPS

SEQ ID NO: 3016635 - protein, 27 aa, Entamoeba invadens
SEKDVLRKGFFINKILVKRIKDNASQD

SEQ ID NO: 3016636 - protein, 22 aa, Entamoeba invadens
SEKEALLPKLKWKTDEVDLNNE

SEQ ID NO: 3016637 - protein, 29 aa, Entamoeba invadens
SEKEHLSFDSFIEFVVHKYIENTQTEVQT

SEQ ID NO: 3016638 - protein, 23 aa, Entamoeba invadens
SEKETLLLHSLYDMLHDEERYHK

SEQ ID NO: 3016639 - protein, 25 aa, Entamoeba invadens
SEKFLDIPIGLIYQPLKGQITTNNQ

SEQ ID NO: 3016640 - protein, 17 aa, Entamoeba invadens
SEKFSNFLWEKAKINLN

SEQ ID NO: 3016641 - protein, 34 aa, Entamoeba invadens
SEKFWKTWNWTPCEEVIFFYFSRDSKNIQFVASR

SEQ ID NO: 3016642 - protein, 25 aa, Entamoeba invadens
SEKILDSFTKYFPTLQPKVIKSDTI

SEQ ID NO: 3016643 - protein, 24 aa, Entamoeba invadens
SEKKSILKKYFGKVLPNLSESLLN

SEQ ID NO: 3016644 - protein, 26 aa, Entamoeba invadens
SEKKTNVLYLFGTGFCWGVVEDNLTV

SEQ ID NO: 3016645 - protein, 24 aa, Entamoeba invadens
SEKLPSYLINLDPACNEPPYSADI

SEQ ID NO: 3016646 - protein, 19 aa, Entamoeba invadens
SEKRKLDSIKMSFSSFMAS

SEQ ID NO: 3016647 - protein, 19 aa, Entamoeba invadens
SEKSLLKRLVNQKRLVTSA

SEQ ID NO: 3016648 - protein, 25 aa, Entamoeba invadens
SEKVDAFFLQVFATLLKTTKRVDLA

SEQ ID NO: 3016649 - protein, 30 aa, Entamoeba invadens
SELADLKELFSLPSTLKKADKYLFSNNKKL

SEQ ID NO: 3016650 - protein, 21 aa, Entamoeba invadens
SELGIIYITLLSSFSTVIIGK

SEQ ID NO: 3016651 - protein, 30 aa, Entamoeba invadens
SELGTKRRIFVIPYLMYSTMERAVKPGEVV

SEQ ID NO: 3016652 - protein, 24 aa, Entamoeba invadens
SELGYRTYAAKVIVWIADAPPHGL

SEQ ID NO: 3016653 - protein, 18 aa, Entamoeba invadens
SELILNIRDNNGFKPYSL

SEQ ID NO: 3016654 - protein, 19 aa, Entamoeba invadens
SELILYIRDHNGFKSYSLS

SEQ ID NO: 3016655 - protein, 24 aa, Entamoeba invadens
SELITKWLMKCEVSKFIVNRKVIA

SEQ ID NO: 3016656 - protein, 21 aa, Entamoeba invadens
SELKSFQRWLADQPTKHTVMI

SEQ ID NO: 3016657 - protein, 19 aa, Entamoeba invadens
SELLKCRLLRKIDVRGCNV

SEQ ID NO: 3016658 - protein, 31 aa, Entamoeba invadens
SELLMVQLDYFTLLLTFNRFGYRESSVDQFY

SEQ ID NO: 3016659 - protein, 21 aa, Entamoeba invadens
SELLRLHCTRFLTLGTDIPKE

SEQ ID NO: 3016660 - protein, 18 aa, Entamoeba invadens
SELNKNLNLIILPHSSQN

SEQ ID NO: 3016661 - protein, 23 aa, Entamoeba invadens
SELQPLKMFFNSQSLKSVTSWFE

SEQ ID NO: 3016662 - protein, 18 aa, Entamoeba invadens
SELSGMYWGLQEVLEYER

SEQ ID NO: 3016663 - protein, 23 aa, Entamoeba invadens
SELYNMRFFVNFPENYVVKNIYS

SEQ ID NO: 3016664 - protein, 19 aa, Entamoeba invadens
SEMERTIGAKFLQSKNVWI

SEQ ID NO: 3016665 - protein, 30 aa, Entamoeba invadens
SEMFEELPEMLVFHLKRFVYNDVFEIVKYN

SEQ ID NO: 3016666 - protein, 20 aa, Entamoeba invadens
SEMKTELKALEQAAKTYKQS

SEQ ID NO: 3016667 - protein, 24 aa, Entamoeba invadens
SEMKTWYTAIQKYAEIQRNGLHVE

SEQ ID NO: 3016668 - protein, 24 aa, Entamoeba invadens
SEMPKLVNFPTSGMLQFFVDPEDQ

SEQ ID NO: 3016669 - protein, 21 aa, Entamoeba invadens
SEMSGLLFNILDLAQTSKVYL

SEQ ID NO: 3016670 - protein, 19 aa, Entamoeba invadens
SENCESVVLCIPLAYENDT

SEQ ID NO: 3016671 - protein, 23 aa, Entamoeba invadens
SENEPALRITFVNSFTNSDESEK

SEQ ID NO: 3016672 - protein, 23 aa, Entamoeba invadens
SENLMRIMFFEQMNLIIKTNECI

SEQ ID NO: 3016673 - protein, 19 aa, Entamoeba invadens
SENPLFDLHQFPPNLVDLS

SEQ ID NO: 3016674 - protein, 28 aa, Entamoeba invadens
SENRIIRNLLLVWSKYNKEYVLKAISFA

SEQ ID NO: 3016675 - protein, 22 aa, Entamoeba invadens
SENSFVINLFLKRASDAIRKKD

SEQ ID NO: 3016676 - protein, 28 aa, Entamoeba invadens
SENVSKILVFTIWLKDMIGIKQIPIWEE

SEQ ID NO: 3016677 - protein, 17 aa, Entamoeba invadens
SENVVELIEIPLSDEKS

SEQ ID NO: 3016678 - protein, 29 aa, Entamoeba invadens
SENVVHLLFTQFIRLLSNIPIENIFEDVQ

SEQ ID NO: 3016679 - protein, 23 aa, Entamoeba invadens
SENWLKWIVSVGEEFEFDFKKCS

SEQ ID NO: 3016680 - protein, 21 aa, Entamoeba invadens
SEPIVIDKSIILVGLVEEGGS

SEQ ID NO: 3016681 - protein, 18 aa, Entamoeba invadens
SEPIYRFVFVTHKEQEDK

SEQ ID NO: 3016682 - protein, 20 aa, Entamoeba invadens
SEPNFVLNLGYYQLRLICNP

SEQ ID NO: 3016683 - protein, 30 aa, Entamoeba invadens
SEPQLYTPIPVMLVPFPLTSEQSSHILQLP

SEQ ID NO: 3016684 - protein, 28 aa, Entamoeba invadens
SEPTKPIVFPVIKGIKFEPPQRPKGSEP

SEQ ID NO: 3016685 - protein, 30 aa, Entamoeba invadens
SEQILRFELLCSFCLKCYWKNTENNELKRK

SEQ ID NO: 3016686 - protein, 35 aa, Entamoeba invadens
SEQISDIVRLLPLSRQFLLFSATIPQSLGVFLKKT

SEQ ID NO: 3016687 - protein, 23 aa, Entamoeba invadens
SEQKTMHIIIPIDKDWVNKNFTF

SEQ ID NO: 3016688 - protein, 23 aa, Entamoeba invadens
SEQKVKWELLLEDELIVNVTKHV

SEQ ID NO: 3016689 - protein, 20 aa, Entamoeba invadens
SEQNYITRGFIQQFPNYRVP

SEQ ID NO: 3016690 - protein, 26 aa, Entamoeba invadens
SEQYANELKTQLVKRNDEFKELLENL

SEQ ID NO: 3016691 - protein, 23 aa, Entamoeba invadens
SERAFREIYLEPFRIAIEEGKPM

SEQ ID NO: 3016692 - protein, 24 aa, Entamoeba invadens
SERDLFFYSNLITQQLIAQKSEPI

SEQ ID NO: 3016693 - protein, 22 aa, Entamoeba invadens
SERFRSMISMYYRGAKSCMIVY

SEQ ID NO: 3016694 - protein, 25 aa, Entamoeba invadens
SERGKCLSCLLAQTKKSSKNRRNKK

SEQ ID NO: 3016695 - protein, 22 aa, Entamoeba invadens
SERKRNILDFYYLTGLEQVVTT

SEQ ID NO: 3016696 - protein, 22 aa, Entamoeba invadens
SERLFKWFTKYNDKLKKTHKKS

SEQ ID NO: 3016697 - protein, 24 aa, Entamoeba invadens
SERLLLFVSQFPTSPLFATNCIES

SEQ ID NO: 3016698 - protein, 29 aa, Entamoeba invadens
SERMSPEVWYFVFNEIFFKILESIGYVHH

SEQ ID NO: 3016699 - protein, 28 aa, Entamoeba invadens
SERPTLIMCKTLIGCGLPNKQGTCKAHG

SEQ ID NO: 3016700 - protein, 23 aa, Entamoeba invadens
SERYEEMVLYMKKVAALNTELSV

SEQ ID NO: 3016701 - protein, 18 aa, Entamoeba invadens
SESDAVLMLYKLSQEKNK

SEQ ID NO: 3016702 - protein, 26 aa, Entamoeba invadens
SESEFIQFFCLFEYYIDDDGQFDLDS

SEQ ID NO: 3016703 - protein, 28 aa, Entamoeba invadens
SESIENTLLWYKTFCRVCLSNYQNRLVG

SEQ ID NO: 3016704 - protein, 26 aa, Entamoeba invadens
SESLSVMLSSLKYLKFLNADSCVAFD

SEQ ID NO: 3016705 - protein, 29 aa, Entamoeba invadens
SESSIGGLFLKLAPFLKIYGEYCKNYPQA

SEQ ID NO: 3016706 - protein, 18 aa, Entamoeba invadens
SESSPPYRIINNSKLDVT

SEQ ID NO: 3016707 - protein, 27 aa, Entamoeba invadens
SESTNLPYETKWLLLQKHVPDASQSKM

SEQ ID NO: 3016708 - protein, 30 aa, Entamoeba invadens
SESVAKWLLDELLLLGIPLNKLHCITTDGC

SEQ ID NO: 3016709 - protein, 22 aa, Entamoeba invadens
SESVVKLLENLFEFCIRSESST

SEQ ID NO: 3016710 - protein, 21 aa, Entamoeba invadens
SESYLGYDYSSYLKTDNLANI

SEQ ID NO: 3016711 - protein, 17 aa, Entamoeba invadens
SESYLGYDYSSYLKTEN

SEQ ID NO: 3016712 - protein, 18 aa, Entamoeba invadens
SESYRTFLKSFKVTPKST

SEQ ID NO: 3016713 - protein, 38 aa, Entamoeba invadens
SESYSKMRPIRSNTLLLLDKNLFIFTIDQKKGELFTKV

SEQ ID NO: 3016714 - protein, 23 aa, Entamoeba invadens
SETKVNAFVGILYCLLEKYDHPP

SEQ ID NO: 3016715 - protein, 18 aa, Entamoeba invadens
SETLDKLHYNPIDFPSLF

SEQ ID NO: 3016716 - protein, 25 aa, Entamoeba invadens
SETLDYLTLLMQLNSWICKSHQKTF

SEQ ID NO: 3016717 - protein, 25 aa, Entamoeba invadens
SETLHFLMDVLSMYGYFFQTRTTTG

SEQ ID NO: 3016718 - protein, 31 aa, Entamoeba invadens
SETLKSFYRVRVFYPITYQDYLLNIKGVFMF

SEQ ID NO: 3016719 - protein, 17 aa, Entamoeba invadens
SETLNKLEKETFDAEVD

SEQ ID NO: 3016720 - protein, 26 aa, Entamoeba invadens
SETLRKNLTFSNSFNLYVDLQATKSK

SEQ ID NO: 3016721 - protein, 27 aa, Entamoeba invadens
SETNLFVKNLPFKLSDEEFKKLFEKYE

SEQ ID NO: 3016722 - protein, 22 aa, Entamoeba invadens
SETPTFIEKLTAPPTKLNLTRF

SEQ ID NO: 3016723 - protein, 26 aa, Entamoeba invadens
SETQFGYNLIFLARRISSVFDDNLYR

SEQ ID NO: 3016724 - protein, 32 aa, Entamoeba invadens
SETQIYPVTFYLESPLIWFKEKRLKMLEDLLD

SEQ ID NO: 3016725 - protein, 25 aa, Entamoeba invadens
SETRGIPLIIIFSKVDLPYNMTETE

SEQ ID NO: 3016726 - protein, 23 aa, Entamoeba invadens
SETRWLQTVLILDNMFEKLTSLQ

SEQ ID NO: 3016727 - protein, 21 aa, Entamoeba invadens
SETRWLQTVLILDNMFENLPS

SEQ ID NO: 3016728 - protein, 22 aa, Entamoeba invadens
SETRWLQTVLILDNMFENLPSL

SEQ ID NO: 3016729 - protein, 27 aa, Entamoeba invadens
SETRYKGWPKVESFLKSLPPHAVVLDV

SEQ ID NO: 3016730 - protein, 22 aa, Entamoeba invadens
SEVLSPLKCQIANKAVVEHIST

SEQ ID NO: 3016731 - protein, 22 aa, Entamoeba invadens
SEVMRLTLLIGEPPSAVSKNSV

SEQ ID NO: 3016732 - protein, 23 aa, Entamoeba invadens
SEVSPVITFLKAINQKIIASSTM

SEQ ID NO: 3016733 - protein, 18 aa, Entamoeba invadens
SEVVDFIATSFSVKKSSV

SEQ ID NO: 3016734 - protein, 27 aa, Entamoeba invadens
SEVVFDNLLFFFENTDPEFSVMLKKLK

SEQ ID NO: 3016735 - protein, 26 aa, Entamoeba invadens
SEVYEMVGISKLWDGCERDIFWKSQY

SEQ ID NO: 3016736 - protein, 17 aa, Entamoeba invadens
SEWLGVAQPTLLIKTPT

SEQ ID NO: 3016737 - protein, 20 aa, Entamoeba invadens
SEYAAMVWNIQPCPLKEGSV

SEQ ID NO: 3016738 - protein, 26 aa, Entamoeba invadens
SEYAKALLLLILREKKCVLANIDYEM

SEQ ID NO: 3016739 - protein, 23 aa, Entamoeba invadens
SEYGIPILLHKIYHNMICCVEDE

SEQ ID NO: 3016740 - protein, 23 aa, Entamoeba invadens
SEYHDIYLYFKQNEKYRSESDKN

SEQ ID NO: 3016741 - protein, 22 aa, Entamoeba invadens
SEYMMLYNIVFSLCTSLDDTLK

SEQ ID NO: 3016742 - protein, 24 aa, Entamoeba invadens
SEYNSFLHELSAWLPLQSTDLVKA

SEQ ID NO: 3016743 - protein, 30 aa, Entamoeba invadens
SEYVDSFAFSKLALQLYPNAPPTLQALISN

SEQ ID NO: 3016744 - protein, 24 aa, Entamoeba invadens
SFACDILILKKICDLGFGLESEYI

SEQ ID NO: 3016745 - protein, 27 aa, Entamoeba invadens
SFAERKSFITIFTLKLCSLKALDGYVM

SEQ ID NO: 3016746 - protein, 24 aa, Entamoeba invadens
SFAITMFECFGWQKAYSGMEFNFS

SEQ ID NO: 3016747 - protein, 30 aa, Entamoeba invadens
SFAITMFECFLWENAYPKNIYMHPWTIADD

SEQ ID NO: 3016748 - protein, 27 aa, Entamoeba invadens
SFAITMLECFLWSEAFPKSSYIFPWTI

SEQ ID NO: 3016749 - protein, 24 aa, Entamoeba invadens
SFAKQFYMPYIPVSKISNTKEINS

SEQ ID NO: 3016750 - protein, 18 aa, Entamoeba invadens
SFALFFAAFCDFQANARH

SEQ ID NO: 3016751 - protein, 17 aa, Entamoeba invadens
SFAMASISTYPIIEGVQ

SEQ ID NO: 3016752 - protein, 32 aa, Entamoeba invadens
SFAVTMFECFKWGEIYPKKDFQFAWSIADFVS

SEQ ID NO: 3016753 - protein, 17 aa, Entamoeba invadens
SFCAKIVVVGERRNIRV

SEQ ID NO: 3016754 - protein, 29 aa, Entamoeba invadens
SFCPTIRVLPTAILLPLIKSTIQDLRQDV

SEQ ID NO: 3016755 - protein, 25 aa, Entamoeba invadens
SFCSGIVVFRPPKQLFWDGNGYQDD

SEQ ID NO: 3016756 - protein, 19 aa, Entamoeba invadens
SFCSTFLKTNLFFNKTEIS

SEQ ID NO: 3016757 - protein, 31 aa, Entamoeba invadens
SFDADAHLSILQFILIRSKIQHPFSISAFVE

SEQ ID NO: 3016758 - protein, 32 aa, Entamoeba invadens
SFDDAYMFATFYNLFEPLKWSKALYHQCITSN

SEQ ID NO: 3016759 - protein, 18 aa, Entamoeba invadens
SFDDFYVPNLIGVQILSM

SEQ ID NO: 3016760 - protein, 32 aa, Entamoeba invadens
SFDDKLLISCGLYFYITYAKGPLIERCLNVVP

SEQ ID NO: 3016761 - protein, 18 aa, Entamoeba invadens
SFDEMMKWITLMDAIKND

SEQ ID NO: 3016762 - protein, 26 aa, Entamoeba invadens
SFDHFTLFERQSIVEILLMQQIIAQQ

SEQ ID NO: 3016763 - protein, 26 aa, Entamoeba invadens
SFDIKTFLYNFPQEEWFFVLNCTSLN

SEQ ID NO: 3016764 - protein, 19 aa, Entamoeba invadens
SFDSFLLNNGLTFGLYKNR

SEQ ID NO: 3016765 - protein, 31 aa, Entamoeba invadens
SFDSGSVVMELPYIPPIKGTDIFLGTIDKNL

SEQ ID NO: 3016766 - protein, 20 aa, Entamoeba invadens
SFDSLPFLDSLKRISVLNGK

SEQ ID NO: 3016767 - protein, 28 aa, Entamoeba invadens
SFEAMQQAFVLALLNINGVGFKVKRPER

SEQ ID NO: 3016768 - protein, 17 aa, Entamoeba invadens
SFECLSSLFIPSTVVLN

SEQ ID NO: 3016769 - protein, 28 aa, Entamoeba invadens
SFECMQSLYINPFINLEIKTFALFKEPC

SEQ ID NO: 3016770 - protein, 19 aa, Entamoeba invadens
SFEDFQRKLRKNRTMQQIV

SEQ ID NO: 3016771 - protein, 26 aa, Entamoeba invadens
SFEDLVNLISFPFPNIVSAFASYCFA

SEQ ID NO: 3016772 - protein, 24 aa, Entamoeba invadens
SFEFRRPERYALKTVQYLIINDVY

SEQ ID NO: 3016773 - protein, 18 aa, Entamoeba invadens
SFEIFYDKVYLFTCPSQS

SEQ ID NO: 3016774 - protein, 26 aa, Entamoeba invadens
SFEKNELIPFTYPPVISLCHTTKGKL

SEQ ID NO: 3016775 - protein, 33 aa, Entamoeba invadens
SFEPNSWKDGLAFCALIHKFHPEAIDFNALDKA

SEQ ID NO: 3016776 - protein, 21 aa, Entamoeba invadens
SFEQIPTLRNDILRVKTLLTN

SEQ ID NO: 3016777 - protein, 20 aa, Entamoeba invadens
SFEREAISVEGVWGMAGDLI

SEQ ID NO: 3016778 - protein, 23 aa, Entamoeba invadens
SFFDCINLKTIILPESLKQIKDE

SEQ ID NO: 3016779 - protein, 20 aa, Entamoeba invadens
SFFFNKALVMEPVPWALISV

SEQ ID NO: 3016780 - protein, 18 aa, Entamoeba invadens
SFFFTFPRNQMNSSCQKV

SEQ ID NO: 3016781 - protein, 25 aa, Entamoeba invadens
SFFNNAYVMILKDIDGYWNVQFEID

SEQ ID NO: 3016782 - protein, 19 aa, Entamoeba invadens
SFFNQFKNNFVYSPQEYYS

SEQ ID NO: 3016783 - protein, 18 aa, Entamoeba invadens
SFFPISHVLYTPKVPCRA

SEQ ID NO: 3016784 - protein, 22 aa, Entamoeba invadens
SFFSMFFNLASIPWENERFYIN

SEQ ID NO: 3016785 - protein, 30 aa, Entamoeba invadens
SFGCEKILCLWDIRMLKLPTITFDNRVEVL

SEQ ID NO: 3016786 - protein, 21 aa, Entamoeba invadens
SFGCLYIVMEYMESGSLLNIV

SEQ ID NO: 3016787 - protein, 24 aa, Entamoeba invadens
SFGDYLRCEIAKPSITLLDVKQKV

SEQ ID NO: 3016788 - protein, 33 aa, Entamoeba invadens
SFGEYDFIKKGEGFILFYAINSKKSYLQVQSKY

SEQ ID NO: 3016789 - protein, 17 aa, Entamoeba invadens
SFGIVFKGTYRGNVVAI

SEQ ID NO: 3016790 - protein, 28 aa, Entamoeba invadens
SFGKIKECHLITFRGYSKGFAFVEYENT

SEQ ID NO: 3016791 - protein, 29 aa, Entamoeba invadens
SFGKVKECRLMIYRGYSKGFGFVEYETEE

SEQ ID NO: 3016792 - protein, 20 aa, Entamoeba invadens
SFGLIVIEFLDGKASYYGNT

SEQ ID NO: 3016793 - protein, 28 aa, Entamoeba invadens
SFGMDEGWFFPGLFELYVLKKMQSGPDM

SEQ ID NO: 3016794 - protein, 28 aa, Entamoeba invadens
SFGVTMFEIFGWKEAYPKDIFKYPWRIA

SEQ ID NO: 3016795 - protein, 22 aa, Entamoeba invadens
SFGYQIDINKLYKKGKTTSQLF

SEQ ID NO: 3016796 - protein, 32 aa, Entamoeba invadens
SFHEPNYMRNFIYFIPFFLKHREAYEMMISYY

SEQ ID NO: 3016797 - protein, 20 aa, Entamoeba invadens
SFHMKEGCFPPNGVCSICNG

SEQ ID NO: 3016798 - protein, 25 aa, Entamoeba invadens
SFHNEIFLFSRSFQDFAFSVAKTST

SEQ ID NO: 3016799 - protein, 20 aa, Entamoeba invadens
SFHQKMILLNTHFRIPFMQM

SEQ ID NO: 3016800 - protein, 24 aa, Entamoeba invadens
SFHQRVYLVIWTTDEIFGCYIPHI

SEQ ID NO: 3016801 - protein, 20 aa, Entamoeba invadens
SFIAIGLYSAKLYQSGDANV

SEQ ID NO: 3016802 - protein, 19 aa, Entamoeba invadens
SFIHLPGFKEGWDTIYHKN

SEQ ID NO: 3016803 - protein, 17 aa, Entamoeba invadens
SFIKSYNYSYKYKSHFT

SEQ ID NO: 3016804 - protein, 23 aa, Entamoeba invadens
SFILPFGTYFNPPEVWKGVVPFL

SEQ ID NO: 3016805 - protein, 19 aa, Entamoeba invadens
SFINFDHFTITSSSLFPSF

SEQ ID NO: 3016806 - protein, 32 aa, Entamoeba invadens
SFISAIKNRKGLYFIVICRNGTVFGNYCDVPI

SEQ ID NO: 3016807 - protein, 25 aa, Entamoeba invadens
SFISEKLFYSCTMLQKINFPSDLRF

SEQ ID NO: 3016808 - protein, 18 aa, Entamoeba invadens
SFIYPEVFMDECEYWIPS

SEQ ID NO: 3016809 - protein, 35 aa, Entamoeba invadens
SFKEMEFVVLKKNIFWRIVKILKNGGMKYINDKTA

SEQ ID NO: 3016810 - protein, 23 aa, Entamoeba invadens
SFKFEGDVTLYWHNSNFLDENRV

SEQ ID NO: 3016811 - protein, 25 aa, Entamoeba invadens
SFKFNAVQFLFKKTLMGINLIIKNP

SEQ ID NO: 3016812 - protein, 29 aa, Entamoeba invadens
SFKGLCEIIEKLFLWDKVRVEGGAYGAWV

SEQ ID NO: 3016813 - protein, 29 aa, Entamoeba invadens
SFKIRDPAFLAFLGFFFDLLTEAKCPFDA

SEQ ID NO: 3016814 - protein, 23 aa, Entamoeba invadens
SFKKHSRQIFFFGKGGGQCRSSD

SEQ ID NO: 3016815 - protein, 19 aa, Entamoeba invadens
SFKMALTCYFKLSSGGVFL

SEQ ID NO: 3016816 - protein, 17 aa, Entamoeba invadens
SFKMTGKFDGELNFING

SEQ ID NO: 3016817 - protein, 27 aa, Entamoeba invadens
SFKNCTFLKKVVLSLFIHTLKSETFSG

SEQ ID NO: 3016818 - protein, 22 aa, Entamoeba invadens
SFKNIVNWFELIKKESPDCRVM

SEQ ID NO: 3016819 - protein, 20 aa, Entamoeba invadens
SFKQPEIFTQISTGLQTEYQ

SEQ ID NO: 3016820 - protein, 32 aa, Entamoeba invadens
SFKRGRTPLRERPLPPLPLTDRKQRSPTGVRN

SEQ ID NO: 3016821 - protein, 28 aa, Entamoeba invadens
SFKSWMDFGHILVIMLSIEKIDSKHTLL

SEQ ID NO: 3016822 - protein, 21 aa, Entamoeba invadens
SFLEDNFNLVVPDFDMYYFIK

SEQ ID NO: 3016823 - protein, 19 aa, Entamoeba invadens
SFLHELSAWLPLQSTNLVK

SEQ ID NO: 3016824 - protein, 19 aa, Entamoeba invadens
SFLIDLKGFKPPMPSDLLD

SEQ ID NO: 3016825 - protein, 18 aa, Entamoeba invadens
SFLNFKAKPKPKFEYSEI

SEQ ID NO: 3016826 - protein, 42 aa, Entamoeba invadens
SFLSYSCVAHPFWLPKFANAFYYTLPILLQNISQIANRVFSA

SEQ ID NO: 3016827 - protein, 32 aa, Entamoeba invadens
SFLSYTCVAHPFWLPKFANGFYYTLPMITENI

SEQ ID NO: 3016828 - protein, 18 aa, Entamoeba invadens
SFLTSLVMPNTLTKICDC

SEQ ID NO: 3016829 - protein, 28 aa, Entamoeba invadens
SFLTSNPVPIPPQYLSKFFPKATEINVW

SEQ ID NO: 3016830 - protein, 22 aa, Entamoeba invadens
SFLVMYKDFFFVGQSNLQTILK

SEQ ID NO: 3016831 - protein, 21 aa, Entamoeba invadens
SFLVRTGFNTFLWCGSKTSKN

SEQ ID NO: 3016832 - protein, 29 aa, Entamoeba invadens
SFMNSFSKLFPSRWYNYGFNDIVKIAEGD

SEQ ID NO: 3016833 - protein, 19 aa, Entamoeba invadens
SFMREIRLFSNIETISFST

SEQ ID NO: 3016834 - protein, 25 aa, Entamoeba invadens
SFMSKWVVVLFRRDFSHDKCARIWD

SEQ ID NO: 3016835 - protein, 27 aa, Entamoeba invadens
SFNDLSQYYIFPWVLKNYESESLDITD

SEQ ID NO: 3016836 - protein, 20 aa, Entamoeba invadens
SFNDLTIMPVQRLMRYPILI

SEQ ID NO: 3016837 - protein, 28 aa, Entamoeba invadens
SFNLIFYNLEHHLNLLKILKLNQDLNSV

SEQ ID NO: 3016838 - protein, 20 aa, Entamoeba invadens
SFNLYDLLMKKNASLGLTLV

SEQ ID NO: 3016839 - protein, 18 aa, Entamoeba invadens
SFNMFGQVALAPSSSTAT

SEQ ID NO: 3016840 - protein, 17 aa, Entamoeba invadens
SFNSQFLAIGGFGNLPG

SEQ ID NO: 3016841 - protein, 34 aa, Entamoeba invadens
SFNSYVILPVQRIPRYQLLLKELLKTIHPGHSEY

SEQ ID NO: 3016842 - protein, 24 aa, Entamoeba invadens
SFNYKFMTLGFFPTNIGMEKIMVF

SEQ ID NO: 3016843 - protein, 23 aa, Entamoeba invadens
SFNYNLLQLRRSFEFTKDFRIKS

SEQ ID NO: 3016844 - protein, 17 aa, Entamoeba invadens
SFPEYYFREVSSGSKDC

SEQ ID NO: 3016845 - protein, 20 aa, Entamoeba invadens
SFPHGIKPMFFPIGTSITIR

SEQ ID NO: 3016846 - protein, 22 aa, Entamoeba invadens
SFPKYHFSVWKIDQFSRDPFVE

SEQ ID NO: 3016847 - protein, 29 aa, Entamoeba invadens
SFQFCSNLEFLILPPKLVNFGRNCFKGCK

SEQ ID NO: 3016848 - protein, 19 aa, Entamoeba invadens
SFQIAHPSYLLGKFETQVM

SEQ ID NO: 3016849 - protein, 21 aa, Entamoeba invadens
SFQIVAKYFYLYEDYVNAVQI

SEQ ID NO: 3016850 - protein, 24 aa, Entamoeba invadens
SFQIVSKYFFYKEDYINSILICHK

SEQ ID NO: 3016851 - protein, 28 aa, Entamoeba invadens
SFQMLSACISCDFGLYLEGDGNCVECPI

SEQ ID NO: 3016852 - protein, 22 aa, Entamoeba invadens
SFQPAELFAQGNPLILPHSMVD

SEQ ID NO: 3016853 - protein, 18 aa, Entamoeba invadens
SFQVLSKNLPSVLTEDAM

SEQ ID NO: 3016854 - protein, 22 aa, Entamoeba invadens
SFRGDPFRMMAGRVFRGHYCGA

SEQ ID NO: 3016855 - protein, 17 aa, Entamoeba invadens
SFRRRFLETFTEFQKQN

SEQ ID NO: 3016856 - protein, 35 aa, Entamoeba invadens
SFRSQTLSYIRNVQTILFCFDISSKNSFNSIQYWV

SEQ ID NO: 3016857 - protein, 17 aa, Entamoeba invadens
SFRVIYDSTIDSFNSTT

SEQ ID NO: 3016858 - protein, 18 aa, Entamoeba invadens
SFSAYITFRNPDSSVQCI

SEQ ID NO: 3016859 - protein, 24 aa, Entamoeba invadens
SFSFGGMPGGFSFGGMPGGMPGGQ

SEQ ID NO: 3016860 - protein, 31 aa, Entamoeba invadens
SFSILHSHVKYPFAISLMLELFLNEEDFLTQ

SEQ ID NO: 3016861 - protein, 22 aa, Entamoeba invadens
SFSLNILLSLFYSVETAFAKST

SEQ ID NO: 3016862 - protein, 20 aa, Entamoeba invadens
SFSQLPKLFKLDLSKNRISN

SEQ ID NO: 3016863 - protein, 26 aa, Entamoeba invadens
SFSRLKPVLPVPLLRELHSTAFQSIP

SEQ ID NO: 3016864 - protein, 28 aa, Entamoeba invadens
SFSSQVICLCLIAVWFSQHRKASSVREA

SEQ ID NO: 3016865 - protein, 26 aa, Entamoeba invadens
SFSSTKFYRRVIWTPTDYTQCLMSEN

SEQ ID NO: 3016866 - protein, 23 aa, Entamoeba invadens
SFSTQTLQFLPLVPDTIKCFHLP

SEQ ID NO: 3016867 - protein, 20 aa, Entamoeba invadens
SFSVPVFNKVSLSTGLSAPL

SEQ ID NO: 3016868 - protein, 28 aa, Entamoeba invadens
SFTDEEVKNLLLFKETPASNGSTNATPN

SEQ ID NO: 3016869 - protein, 32 aa, Entamoeba invadens
SFTEVVRWFAERADMIILVFDAHKLDISDEFK

SEQ ID NO: 3016870 - protein, 18 aa, Entamoeba invadens
SFTFDRIFSSLSTQDDVF

SEQ ID NO: 3016871 - protein, 18 aa, Entamoeba invadens
SFTFPPTEIKKRGLEMEK

SEQ ID NO: 3016872 - protein, 20 aa, Entamoeba invadens
SFTHAFSASPLVRLEEWNKS

SEQ ID NO: 3016873 - protein, 17 aa, Entamoeba invadens
SFTKPINLFNGEKCCIG

SEQ ID NO: 3016874 - protein, 23 aa, Entamoeba invadens
SFTLQMIKSYFRDFPSVECIDLS

SEQ ID NO: 3016875 - protein, 25 aa, Entamoeba invadens
SFTNPIFVGIVYFVNMLMTEMKALS

SEQ ID NO: 3016876 - protein, 23 aa, Entamoeba invadens
SFTTINLPRLGIKYGICEGKREV

SEQ ID NO: 3016877 - protein, 17 aa, Entamoeba invadens
SFVAKIFVEGEHPHLYF

SEQ ID NO: 3016878 - protein, 23 aa, Entamoeba invadens
SFVEAFTWLIAHDVLIRVRKYLY

SEQ ID NO: 3016879 - protein, 23 aa, Entamoeba invadens
SFVENLPEYAAVSYAYIDAKDCK

SEQ ID NO: 3016880 - protein, 34 aa, Entamoeba invadens
SFVFSYFVRDYEQISKLFLFRQKKDIESVETLWN

SEQ ID NO: 3016881 - protein, 26 aa, Entamoeba invadens
SFVHQYSQIALIVKGALMFTKTFSQQ

SEQ ID NO: 3016882 - protein, 24 aa, Entamoeba invadens
SFVKIQKFVKPYRKEYTEGIAHIK

SEQ ID NO: 3016883 - protein, 17 aa, Entamoeba invadens
SFVPIINKAIEIVKETK

SEQ ID NO: 3016884 - protein, 17 aa, Entamoeba invadens
SFVPMFTTTGHIVMDGV

SEQ ID NO: 3016885 - protein, 25 aa, Entamoeba invadens
SFVSGGMIVLKWKDTMFNIFGNAGE

SEQ ID NO: 3016886 - protein, 20 aa, Entamoeba invadens
SFVVENEWVLADSGYRGVGQ

SEQ ID NO: 3016887 - protein, 17 aa, Entamoeba invadens
SFVYIMNALYEHNFIWI

SEQ ID NO: 3016888 - protein, 20 aa, Entamoeba invadens
SFYICKSLVGVTIPPSVKTI

SEQ ID NO: 3016889 - protein, 19 aa, Entamoeba invadens
SFYSGKYKRYCIIIEVVVN

SEQ ID NO: 3016890 - protein, 26 aa, Entamoeba invadens
SFYSTCFVLNFLFTEGFLRSSCQHFG

SEQ ID NO: 3016891 - protein, 24 aa, Entamoeba invadens
SFYTLFCEMVGPFLLYEIEKKQYQ

SEQ ID NO: 3016892 - protein, 26 aa, Entamoeba invadens
SFYTNCEMLIYVFNYTELNTLEHCLK

SEQ ID NO: 3016893 - protein, 30 aa, Entamoeba invadens
SFYVDKRIVNKLLISYITKPHQRTEIVELM

SEQ ID NO: 3016894 - protein, 18 aa, Entamoeba invadens
SGAFEQMLIVPEPTKGMI

SEQ ID NO: 3016895 - protein, 25 aa, Entamoeba invadens
SGAKYLDWIVVVMQPDMYRSEVTHE

SEQ ID NO: 3016896 - protein, 22 aa, Entamoeba invadens
SGALGHFCPVCFELLIKRYQCA

SEQ ID NO: 3016897 - protein, 28 aa, Entamoeba invadens
SGCARCGFGFYYNLITQRCETCDSNCET

SEQ ID NO: 3016898 - protein, 18 aa, Entamoeba invadens
SGCIAKYNEKFLLGYKEG

SEQ ID NO: 3016899 - protein, 18 aa, Entamoeba invadens
SGCKALHSVLLPKKMKEV

SEQ ID NO: 3016900 - protein, 19 aa, Entamoeba invadens
SGCKALHSVLLPKKMREVG

SEQ ID NO: 3016901 - protein, 20 aa, Entamoeba invadens
SGCVEELRRLAHTKKIIMSS

SEQ ID NO: 3016902 - protein, 24 aa, Entamoeba invadens
SGCYQCRNGYYRVNLDCIECLSNC

SEQ ID NO: 3016903 - protein, 25 aa, Entamoeba invadens
SGDALKLFSISRTNDILLLSTFNSQ

SEQ ID NO: 3016904 - protein, 23 aa, Entamoeba invadens
SGDFIPRLFVLDSGFYGIYTHYK

SEQ ID NO: 3016905 - protein, 23 aa, Entamoeba invadens
SGDGYIIVYSITSTSSFLDANVI

SEQ ID NO: 3016906 - protein, 25 aa, Entamoeba invadens
SGDHTVRLWDLNSCTPITTLKEHGD

SEQ ID NO: 3016907 - protein, 24 aa, Entamoeba invadens
SGDKSILLDEIYAKHYGKVDKAHD

SEQ ID NO: 3016908 - protein, 25 aa, Entamoeba invadens
SGDKSILLDEIYAKHYGKVDKKHDA

SEQ ID NO: 3016909 - protein, 25 aa, Entamoeba invadens
SGDLELVLLLMKYGANKSVESLNGL

SEQ ID NO: 3016910 - protein, 20 aa, Entamoeba invadens
SGDPLFRLWDIPEIIDVDRS

SEQ ID NO: 3016911 - protein, 27 aa, Entamoeba invadens
SGDSNNDMLYHIITIRGRIPQKMVRDG

SEQ ID NO: 3016912 - protein, 26 aa, Entamoeba invadens
SGDVFPMTTSVLFKTKRFAFCVATTK

SEQ ID NO: 3016913 - protein, 25 aa, Entamoeba invadens
SGEDEFPCWFEGPPFKFKKSMRDIH

SEQ ID NO: 3016914 - protein, 25 aa, Entamoeba invadens
SGEEHYNILSAFHKSLRGSDEDAVM

SEQ ID NO: 3016915 - protein, 24 aa, Entamoeba invadens
SGEIAGDDFLLSRMILFFKHCFKS

SEQ ID NO: 3016916 - protein, 33 aa, Entamoeba invadens
SGEKWNTLNKLKWFGKTILMILSTRGAEGKYTN

SEQ ID NO: 3016917 - protein, 23 aa, Entamoeba invadens
SGEKYGVFAFGRNIQEENTIEVY

SEQ ID NO: 3016918 - protein, 21 aa, Entamoeba invadens
SGEPWWASQWGNGRPGWHIEC

SEQ ID NO: 3016919 - protein, 24 aa, Entamoeba invadens
SGESNVFPLLLVKDKRYFDTIIYF

SEQ ID NO: 3016920 - protein, 24 aa, Entamoeba invadens
SGETSLIGTIFKKSKKLPTVLAQH

SEQ ID NO: 3016921 - protein, 24 aa, Entamoeba invadens
SGFGIIVGGFFRPFVTYKQTPLSS

SEQ ID NO: 3016922 - protein, 21 aa, Entamoeba invadens
SGFGNLIERKFYQVKSHVGGG

SEQ ID NO: 3016923 - protein, 17 aa, Entamoeba invadens
SGFIFISEPNSKPKKMI

SEQ ID NO: 3016924 - protein, 17 aa, Entamoeba invadens
SGFINFPVPLDLQEEYL

SEQ ID NO: 3016925 - protein, 29 aa, Entamoeba invadens
SGFLLITSVYINTTLLLNETIRQLLVSQK

SEQ ID NO: 3016926 - protein, 24 aa, Entamoeba invadens
SGFNFRLLNTLPSLERVYIIFQYT

SEQ ID NO: 3016927 - protein, 34 aa, Entamoeba invadens
SGFVPYKIVYTDGFLFFYKNSSEPNFVLNLGYYQ

SEQ ID NO: 3016928 - protein, 22 aa, Entamoeba invadens
SGFVTSFLSFGSRPLIIKAAES

SEQ ID NO: 3016929 - protein, 27 aa, Entamoeba invadens
SGFYIHHFFKKFLLKLKNKINQFKYSN

SEQ ID NO: 3016930 - protein, 27 aa, Entamoeba invadens
SGGCPKRLCFWLSTVLRVYAWTCMSKT

SEQ ID NO: 3016931 - protein, 41 aa, Entamoeba invadens
SGGEKTIAALALLFAIQSFYPSPFFILDEIDAALDVQNVLQ

SEQ ID NO: 3016932 - protein, 24 aa, Entamoeba invadens
SGGKLPSFFLEKKEPLWTTTDLEI

SEQ ID NO: 3016933 - protein, 22 aa, Entamoeba invadens
SGIFGFFQTLLPNLEDVDQEEE

SEQ ID NO: 3016934 - protein, 23 aa, Entamoeba invadens
SGIFPLYSAVLKKNTAALEVLLK

SEQ ID NO: 3016935 - protein, 18 aa, Entamoeba invadens
SGIKILAPLIRQLSAEDL

SEQ ID NO: 3016936 - protein, 17 aa, Entamoeba invadens
SGIMSKVKPLGDMILVQ

SEQ ID NO: 3016937 - protein, 24 aa, Entamoeba invadens
SGIRSDGFWVLGNERFSLFACVHL

SEQ ID NO: 3016938 - protein, 21 aa, Entamoeba invadens
SGKCLTCYAGYEFTGNANCEI

SEQ ID NO: 3016939 - protein, 25 aa, Entamoeba invadens
SGKGYLTEYIVLNSPLRAVGIEGNA

SEQ ID NO: 3016940 - protein, 23 aa, Entamoeba invadens
SGKITNWLSTKGFLVDLFQSNYC

SEQ ID NO: 3016941 - protein, 25 aa, Entamoeba invadens
SGKKKMMSRPFGVALLVAGVDETGP

SEQ ID NO: 3016942 - protein, 27 aa, Entamoeba invadens
SGKLILTNYKLFFKHPCVLLNISIPLT

SEQ ID NO: 3016943 - protein, 28 aa, Entamoeba invadens
SGKNDLMFYALALSQLKLLLFPGDSKTM

SEQ ID NO: 3016944 - protein, 23 aa, Entamoeba invadens
SGKNVIAIFRQLAADMVLKEEKV

SEQ ID NO: 3016945 - protein, 26 aa, Entamoeba invadens
SGKREKIIFYLWTPAACFIKEKMVYS

SEQ ID NO: 3016946 - protein, 23 aa, Entamoeba invadens
SGKRHLYVMLQTEKGRIIGLYVS

SEQ ID NO: 3016947 - protein, 29 aa, Entamoeba invadens
SGKSNVIDGLLFVFGRRGKQIRQSKLVDL

SEQ ID NO: 3016948 - protein, 25 aa, Entamoeba invadens
SGKSSFYEKYFKPNGYQWVNQDTLG

SEQ ID NO: 3016949 - protein, 22 aa, Entamoeba invadens
SGKSTFLGHLFAGLQIIDQRTI

SEQ ID NO: 3016950 - protein, 25 aa, Entamoeba invadens
SGKSVLFSFFVYHLAQYYNVTVTEM

SEQ ID NO: 3016951 - protein, 25 aa, Entamoeba invadens
SGKSYTPYFNTLVGIIVFRHDDRES

SEQ ID NO: 3016952 - protein, 25 aa, Entamoeba invadens
SGKTKGFAFVMYVVPQDAVKAFNEM

SEQ ID NO: 3016953 - protein, 26 aa, Entamoeba invadens
SGKTLAYLVPVLDLLNKIKFTSRNGT

SEQ ID NO: 3016954 - protein, 24 aa, Entamoeba invadens
SGKVDALVIAAKRYLEPKVKDKSI

SEQ ID NO: 3016955 - protein, 22 aa, Entamoeba invadens
SGKVMIIMLILMGNKFAKDVWI

SEQ ID NO: 3016956 - protein, 24 aa, Entamoeba invadens
SGKYTPYCQYTVFDCLEIIPDNFF

SEQ ID NO: 3016957 - protein, 22 aa, Entamoeba invadens
SGKYTPYCQYTVFDCLEVLPDN

SEQ ID NO: 3016958 - protein, 18 aa, Entamoeba invadens
SGLDKLVHIKLSSNLTKL

SEQ ID NO: 3016959 - protein, 25 aa, Entamoeba invadens
SGLDLHTFPLLNTIKSKIVSFSIHT

SEQ ID NO: 3016960 - protein, 22 aa, Entamoeba invadens
SGLFSYCHRLRRVVLPHTLKKI

SEQ ID NO: 3016961 - protein, 18 aa, Entamoeba invadens
SGLHYLHFNKRLVHRDLK

SEQ ID NO: 3016962 - protein, 27 aa, Entamoeba invadens
SGLINEKFFFFLLETLNRVRDFETNKQ

SEQ ID NO: 3016963 - protein, 20 aa, Entamoeba invadens
SGLIQSLYNLVGCNTLPSIQ

SEQ ID NO: 3016964 - protein, 36 aa, Entamoeba invadens
SGLKELFICQLLDFIPHTVEYLYVPCFNKKLSCPLL

SEQ ID NO: 3016965 - protein, 27 aa, Entamoeba invadens
SGLLYDEYVMMQIPSVLPLKSTQMEEE

SEQ ID NO: 3016966 - protein, 26 aa, Entamoeba invadens
SGLPERYDMELILKHFKHTFSCNGSL

SEQ ID NO: 3016967 - protein, 20 aa, Entamoeba invadens
SGLPHLNFFYEIVGSAFALP

SEQ ID NO: 3016968 - protein, 24 aa, Entamoeba invadens
SGLPKPDIVCFLELSLDEADRRRK

SEQ ID NO: 3016969 - protein, 18 aa, Entamoeba invadens
SGLSKKVGKQRLFQGVQP

SEQ ID NO: 3016970 - protein, 25 aa, Entamoeba invadens
SGLTRPKVVFFSNIMDRADISDFNN

SEQ ID NO: 3016971 - protein, 42 aa, Entamoeba invadens
SGLYFYKYKNLCEVVFPPTIKIFERVYFYNCHKLTKISFTEC

SEQ ID NO: 3016972 - protein, 21 aa, Entamoeba invadens
SGMLLDCYDVSYLWVGKNISE

SEQ ID NO: 3016973 - protein, 18 aa, Entamoeba invadens
SGMPFYIYNLVEELDEEG

SEQ ID NO: 3016974 - protein, 27 aa, Entamoeba invadens
SGMPIALYYSFLVFGAFSEYLKDFEND

SEQ ID NO: 3016975 - protein, 30 aa, Entamoeba invadens
SGNAMIAVPLLPITLRVLCIASNKIIEIPN

SEQ ID NO: 3016976 - protein, 26 aa, Entamoeba invadens
SGNDRSIKMWNIATMGLMDTFYGHLN

SEQ ID NO: 3016977 - protein, 30 aa, Entamoeba invadens
SGNIPHTLDLPSYTFPRIKTEALPSTQYTI

SEQ ID NO: 3016978 - protein, 26 aa, Entamoeba invadens
SGNKSGLFHLILRDYGLLDSAKMMAH

SEQ ID NO: 3016979 - protein, 19 aa, Entamoeba invadens
SGNMKCVNFLLKHTKTVLS

SEQ ID NO: 3016980 - protein, 24 aa, Entamoeba invadens
SGNTSKPLYAVYPLFNELEKDPIA

SEQ ID NO: 3016981 - protein, 21 aa, Entamoeba invadens
SGNVFLICEDAVYATGLVNFK

SEQ ID NO: 3016982 - protein, 24 aa, Entamoeba invadens
SGNVIKMYLVKWVLGREVFVSEET

SEQ ID NO: 3016983 - protein, 24 aa, Entamoeba invadens
SGPAGLSAAYFLRLKGHKVVVYEQ

SEQ ID NO: 3016984 - protein, 17 aa, Entamoeba invadens
SGPILHLKKLGSSLVAL

SEQ ID NO: 3016985 - protein, 22 aa, Entamoeba invadens
SGPQNCELLLSTKGSLTVTYTA

SEQ ID NO: 3016986 - protein, 25 aa, Entamoeba invadens
SGRIRETYWHIYPDEISPYTNQTIS

SEQ ID NO: 3016987 - protein, 21 aa, Entamoeba invadens
SGRIYLMTFRKEKGIQLLQRH

SEQ ID NO: 3016988 - protein, 17 aa, Entamoeba invadens
SGRSGGRVALFRLLDYN

SEQ ID NO: 3016989 - protein, 25 aa, Entamoeba invadens
SGRTDVYLRLPRDSKYQEKIWDHAA

SEQ ID NO: 3016990 - protein, 24 aa, Entamoeba invadens
SGRTRLIKNVLFLVETASGCVFGS

SEQ ID NO: 3016991 - protein, 25 aa, Entamoeba invadens
SGRTVEYIRMILGCCNTPILKEASY

SEQ ID NO: 3016992 - protein, 27 aa, Entamoeba invadens
SGSCEPWPPYNPKEKVTCPSNCVGDYI

SEQ ID NO: 3016993 - protein, 23 aa, Entamoeba invadens
SGSDIAILCKDAIYQPVRTLQAA

SEQ ID NO: 3016994 - protein, 18 aa, Entamoeba invadens
SGSFRLALTEQLNLLQLS

SEQ ID NO: 3016995 - protein, 26 aa, Entamoeba invadens
SGSIGFFEFLALYNFVKLCLDTFKNF

SEQ ID NO: 3016996 - protein, 26 aa, Entamoeba invadens
SGSIGFIEFLALYNFVKLCLDTFKHF

SEQ ID NO: 3016997 - protein, 23 aa, Entamoeba invadens
SGSILHNELVFLKSYFSCKHTRQ

SEQ ID NO: 3016998 - protein, 18 aa, Entamoeba invadens
SGSTPLHWAVRSTPEIVD

SEQ ID NO: 3016999 - protein, 31 aa, Entamoeba invadens
SGSVAKQPFYPKMKNSYPYPQHVSCSDSFNP

SEQ ID NO: 3017000 - protein, 31 aa, Entamoeba invadens
SGSVDWWTFGIFMYEVLYGRTPFFSRNRDTV

SEQ ID NO: 3017001 - protein, 23 aa, Entamoeba invadens
SGSWRKFVICVIAWKISSSNCLR

SEQ ID NO: 3017002 - protein, 26 aa, Entamoeba invadens
SGTQANFLWKILYDKIGSMGNDGKNI

SEQ ID NO: 3017003 - protein, 19 aa, Entamoeba invadens
SGTTAFPVFGPRSTNSAPF

SEQ ID NO: 3017004 - protein, 25 aa, Entamoeba invadens
SGVEYFSLFVRFVFSDGSFVDKRIK

SEQ ID NO: 3017005 - protein, 25 aa, Entamoeba invadens
SGVEYFSLFVRFVFSDGSFVEKRVK

SEQ ID NO: 3017006 - protein, 26 aa, Entamoeba invadens
SGVEYFSLFVRFVFSDGSFVEKRVKI

SEQ ID NO: 3017007 - protein, 24 aa, Entamoeba invadens
SGVGKTCLLLRYSENKFSENITTT

SEQ ID NO: 3017008 - protein, 17 aa, Entamoeba invadens
SGVHGVFLVYKFDDEMS

SEQ ID NO: 3017009 - protein, 24 aa, Entamoeba invadens
SGVKDFWTRVFYYSGFTKNVGYTE

SEQ ID NO: 3017010 - protein, 25 aa, Entamoeba invadens
SGVLMKEGYLLRRWKERFVVVKNTF

SEQ ID NO: 3017011 - protein, 21 aa, Entamoeba invadens
SGVPPLPMFVKRRTTTCLTQK

SEQ ID NO: 3017012 - protein, 31 aa, Entamoeba invadens
SGVSTQILSALFFHKIITPAIITPTKFCSSI

SEQ ID NO: 3017013 - protein, 18 aa, Entamoeba invadens
SGVTYKLTLGVIKNILPA

SEQ ID NO: 3017014 - protein, 18 aa, Entamoeba invadens
SGVVWMEATFFGCMSLSR

SEQ ID NO: 3017015 - protein, 31 aa, Entamoeba invadens
SGYFNSVVFKSWLYESVLKSIFMKRKETGYL

SEQ ID NO: 3017016 - protein, 22 aa, Entamoeba invadens
SGYHIMIVSIYFETIKDFINLE

SEQ ID NO: 3017017 - protein, 18 aa, Entamoeba invadens
SGYHIMIVSKYFETIKDF

SEQ ID NO: 3017018 - protein, 23 aa, Entamoeba invadens
SGYLKYYLYNWACPKVNPDKLDI

SEQ ID NO: 3017019 - protein, 17 aa, Entamoeba invadens
SHDFFSFDLHGLYSPSI

SEQ ID NO: 3017020 - protein, 24 aa, Entamoeba invadens
SHDMTTQAIPWVEKYRPKVLEDVV

SEQ ID NO: 3017021 - protein, 19 aa, Entamoeba invadens
SHDNALLAIANYDATIKIY

SEQ ID NO: 3017022 - protein, 34 aa, Entamoeba invadens
SHDPILVRGLYDKEMYIVYPPYFTETSFEPNCGS

SEQ ID NO: 3017023 - protein, 21 aa, Entamoeba invadens
SHDWSFILREGIFRVPGNYAV

SEQ ID NO: 3017024 - protein, 22 aa, Entamoeba invadens
SHEDFHWFVPGNRNTGLIGKEN

SEQ ID NO: 3017025 - protein, 25 aa, Entamoeba invadens
SHEMQLLCFFLENNGFVACVLSHDE

SEQ ID NO: 3017026 - protein, 17 aa, Entamoeba invadens
SHFAPVAPPPQSLFKKC

SEQ ID NO: 3017027 - protein, 22 aa, Entamoeba invadens
SHFAQFIQSINSILRSHRINKR

SEQ ID NO: 3017028 - protein, 20 aa, Entamoeba invadens
SHFDDVLSFNTALFMEMKKL

SEQ ID NO: 3017029 - protein, 24 aa, Entamoeba invadens
SHFEHFLELLGTKIKLQGFTGFSG

SEQ ID NO: 3017030 - protein, 21 aa, Entamoeba invadens
SHFFALPMYAEWAEKFLTTDW

SEQ ID NO: 3017031 - protein, 25 aa, Entamoeba invadens
SHFKKCIFQVIKPQSVKLVDHVLLI

SEQ ID NO: 3017032 - protein, 22 aa, Entamoeba invadens
SHGCLYIVMEFMESGSLLNIVK

SEQ ID NO: 3017033 - protein, 23 aa, Entamoeba invadens
SHGKYGLFPLAKGVTLPLEKDEQ

SEQ ID NO: 3017034 - protein, 31 aa, Entamoeba invadens
SHHFARSFHFLFPVKPFVLEKEPEVCFACGK

SEQ ID NO: 3017035 - protein, 19 aa, Entamoeba invadens
SHIFGTQRLLFTKSQNFEN

SEQ ID NO: 3017036 - protein, 18 aa, Entamoeba invadens
SHIHFVCGNWVFPNGFEN

SEQ ID NO: 3017037 - protein, 17 aa, Entamoeba invadens
SHIINAIYSLSISNKTS

SEQ ID NO: 3017038 - protein, 35 aa, Entamoeba invadens
SHIKDGARKWLFENKVALLLLCPHSSHLSQPLNVV

SEQ ID NO: 3017039 - protein, 25 aa, Entamoeba invadens
SHKEVHLIFPTDHDIFSLTHITPEN

SEQ ID NO: 3017040 - protein, 31 aa, Entamoeba invadens
SHKHATIRYDKQLSFYVFVNEGTNGSIVNGA

SEQ ID NO: 3017041 - protein, 30 aa, Entamoeba invadens
SHKQFLTLLLMTLDCFQLFFDPTIIEQKFT

SEQ ID NO: 3017042 - protein, 18 aa, Entamoeba invadens
SHKYGLHPDLFDLGGGFS

SEQ ID NO: 3017043 - protein, 24 aa, Entamoeba invadens
SHLFAVFLCPRYNADTNKVIETIS

SEQ ID NO: 3017044 - protein, 18 aa, Entamoeba invadens
SHLSVFIENPYYNPNYAA

SEQ ID NO: 3017045 - protein, 26 aa, Entamoeba invadens
SHLVREGLLHPDLLKRIITEATNILK

SEQ ID NO: 3017046 - protein, 24 aa, Entamoeba invadens
SHMKRFFKIYTEDFMKIVHNYYKN

SEQ ID NO: 3017047 - protein, 22 aa, Entamoeba invadens
SHPEVMMNVIRYALPSTDHEVK

SEQ ID NO: 3017048 - protein, 39 aa, Entamoeba invadens
SHPGMIPLAVLQIFKTIRDLEKIGWVYKVSVRHIEVYNN

SEQ ID NO: 3017049 - protein, 20 aa, Entamoeba invadens
SHPTLPISICLRDNGCLILD

SEQ ID NO: 3017050 - protein, 25 aa, Entamoeba invadens
SHQERIKFTFIITIFDDAHAEQVQE

SEQ ID NO: 3017051 - protein, 46 aa, Entamoeba invadens
SHQFQVSIPLFYCFAEETTQLWLPLGNYLFATFSSTGAMLAKSEIE

SEQ ID NO: 3017052 - protein, 24 aa, Entamoeba invadens
SHQKTLLYTPYLPSKENLGEYIYD

SEQ ID NO: 3017053 - protein, 22 aa, Entamoeba invadens
SHQLSLRPLLSWKDARVIELAE

SEQ ID NO: 3017054 - protein, 30 aa, Entamoeba invadens
SHQRHGIMIPIPQYPLYSATIATLGGTLVP

SEQ ID NO: 3017055 - protein, 17 aa, Entamoeba invadens
SHRDACWKYIEILSQIW

SEQ ID NO: 3017056 - protein, 20 aa, Entamoeba invadens
SHRKLFLYGNEGLPFITFEE

SEQ ID NO: 3017057 - protein, 18 aa, Entamoeba invadens
SHSEAMTPVFDLVGDTQK

SEQ ID NO: 3017058 - protein, 19 aa, Entamoeba invadens
SHSFYQCEQLEYIDVPSSL

SEQ ID NO: 3017059 - protein, 23 aa, Entamoeba invadens
SHSKHFFVYTIAGKPAFSRYGSD

SEQ ID NO: 3017060 - protein, 19 aa, Entamoeba invadens
SHSWILHKGTYKLELCKDA

SEQ ID NO: 3017061 - protein, 19 aa, Entamoeba invadens
SHTAVVLPQLRKENRYISF

SEQ ID NO: 3017062 - protein, 21 aa, Entamoeba invadens
SHTCNPVNLFIRDFDYKGDYV

SEQ ID NO: 3017063 - protein, 17 aa, Entamoeba invadens
SHTLLPTSKQHLFFQNY

SEQ ID NO: 3017064 - protein, 27 aa, Entamoeba invadens
SHTNTYDIMFHVAPLLPTLKGDEQGLE

SEQ ID NO: 3017065 - protein, 30 aa, Entamoeba invadens
SHVDSNFLFKQLNILLPSASELPFVTPSRK

SEQ ID NO: 3017066 - protein, 24 aa, Entamoeba invadens
SHVILLLFEYLAKGSYAVFSKFIV

SEQ ID NO: 3017067 - protein, 19 aa, Entamoeba invadens
SHVLPIFQTSTFCFDSTQQ

SEQ ID NO: 3017068 - protein, 30 aa, Entamoeba invadens
SHVMFETFQVPSLCFALQELFGLCITGRTR

SEQ ID NO: 3017069 - protein, 20 aa, Entamoeba invadens
SHVSLVSLLIQTDAFEEYNC

SEQ ID NO: 3017070 - protein, 26 aa, Entamoeba invadens
SHWIGTTILMFYDVDMRAKILNKFVS

SEQ ID NO: 3017071 - protein, 17 aa, Entamoeba invadens
SHWINSLSLSTDYVLRQ

SEQ ID NO: 3017072 - protein, 24 aa, Entamoeba invadens
SHYHFVLNIVWLRIDKKVHIENDQ

SEQ ID NO: 3017073 - protein, 29 aa, Entamoeba invadens
SIAALDFPKNFIFISEPGRYMASNSFHVV

SEQ ID NO: 3017074 - protein, 18 aa, Entamoeba invadens
SIADMTLPLANTTRVMRD

SEQ ID NO: 3017075 - protein, 25 aa, Entamoeba invadens
SIAEAMLVMFERCKIISEGAGATPV

SEQ ID NO: 3017076 - protein, 18 aa, Entamoeba invadens
SIAFVFCYSITSSASFEE

SEQ ID NO: 3017077 - protein, 24 aa, Entamoeba invadens
SIAHAMVMMLERCKIVSEGAGATP

SEQ ID NO: 3017078 - protein, 30 aa, Entamoeba invadens
SIARPKELPFMPIIFNFPPEFAGVPQEIQA

SEQ ID NO: 3017079 - protein, 32 aa, Entamoeba invadens
SIATPFMRPQMVDWLFRTCDYFKFSAKIEFQA

SEQ ID NO: 3017080 - protein, 20 aa, Entamoeba invadens
SIAVPFLCKGVTVSLDIISQ

SEQ ID NO: 3017081 - protein, 17 aa, Entamoeba invadens
SICINHLNPYLRGQLLK

SEQ ID NO: 3017082 - protein, 17 aa, Entamoeba invadens
SICKWITVEYPIQPILE

SEQ ID NO: 3017083 - protein, 18 aa, Entamoeba invadens
SICRIGGLAFCECKSLVD

SEQ ID NO: 3017084 - protein, 24 aa, Entamoeba invadens
SIDDACIVLFRSAHMIEECLQLAL

SEQ ID NO: 3017085 - protein, 26 aa, Entamoeba invadens
SIDEIKKLIYLPKYRNAEIEELYQLY

SEQ ID NO: 3017086 - protein, 17 aa, Entamoeba invadens
SIDFSATLPKKETKKRT

SEQ ID NO: 3017087 - protein, 18 aa, Entamoeba invadens
SIDLDKFISISALANYYF

SEQ ID NO: 3017088 - protein, 19 aa, Entamoeba invadens
SIDLDMFLHTIDTSSYNCK

SEQ ID NO: 3017089 - protein, 18 aa, Entamoeba invadens
SIDLLNCPSKPGKMPKED

SEQ ID NO: 3017090 - protein, 17 aa, Entamoeba invadens
SIDLQKGGELFNRLIKM

SEQ ID NO: 3017091 - protein, 24 aa, Entamoeba invadens
SIDPNWPISLATKAFHDLIKKFEK

SEQ ID NO: 3017092 - protein, 27 aa, Entamoeba invadens
SIDPVSRSLILAGFPNVGKSSLMNVFT

SEQ ID NO: 3017093 - protein, 31 aa, Entamoeba invadens
SIDSETKFNLFFSYHYYVDLLCESMADKSVS

SEQ ID NO: 3017094 - protein, 24 aa, Entamoeba invadens
SIDTKILPLVTDLSIEDSDTFIGN

SEQ ID NO: 3017095 - protein, 25 aa, Entamoeba invadens
SIEDILRFFPKLQTLYFSSFSNNLK

SEQ ID NO: 3017096 - protein, 22 aa, Entamoeba invadens
SIEIWNTYFFEKLEQEQNQAGL

SEQ ID NO: 3017097 - protein, 25 aa, Entamoeba invadens
SIENATPFQWSYSLAIEVLKYYFRS

SEQ ID NO: 3017098 - protein, 29 aa, Entamoeba invadens
SIENNACYKFDGFGLPKCDGVGCGDLYVT

SEQ ID NO: 3017099 - protein, 31 aa, Entamoeba invadens
SIERAHTPNKMWAKLLLDEDYMKALQQVTET

SEQ ID NO: 3017100 - protein, 25 aa, Entamoeba invadens
SIERAMLSVFKLTPNKNWLDSVVFY

SEQ ID NO: 3017101 - protein, 23 aa, Entamoeba invadens
SIERRPLNLLYRSKTFNPHTTGV

SEQ ID NO: 3017102 - protein, 19 aa, Entamoeba invadens
SIESTALHYLLMTPTNALI

SEQ ID NO: 3017103 - protein, 29 aa, Entamoeba invadens
SIFCFNGDIFILKLLPGKILVVNGFITYS

SEQ ID NO: 3017104 - protein, 20 aa, Entamoeba invadens
SIFDIFKSLKLSTPIRNEIN

SEQ ID NO: 3017105 - protein, 18 aa, Entamoeba invadens
SIFDRGFLATSKVIRDVK

SEQ ID NO: 3017106 - protein, 23 aa, Entamoeba invadens
SIFEIPSKFTIRSYYECYRNDIC

SEQ ID NO: 3017107 - protein, 24 aa, Entamoeba invadens
SIFETDFFLNIENITIITAPIFVG

SEQ ID NO: 3017108 - protein, 21 aa, Entamoeba invadens
SIFFSTPKVTLLYLDNTDHPL

SEQ ID NO: 3017109 - protein, 17 aa, Entamoeba invadens
SIFIVNAPPHVYSHFQS

SEQ ID NO: 3017110 - protein, 19 aa, Entamoeba invadens
SIFVVIKKQATFPVEEYRE

SEQ ID NO: 3017111 - protein, 28 aa, Entamoeba invadens
SIGDFCFYKCSSLKFVHLPETISEIGES

SEQ ID NO: 3017112 - protein, 20 aa, Entamoeba invadens
SIGDWMLLFKQYYNTIECYI

SEQ ID NO: 3017113 - protein, 42 aa, Entamoeba invadens
SIGFEMNYFVTWFADLFIDVFPPLLTIRVWDCYLYEGKDVLY

SEQ ID NO: 3017114 - protein, 21 aa, Entamoeba invadens
SIGFYEYLALMKYVELATNVF

SEQ ID NO: 3017115 - protein, 23 aa, Entamoeba invadens
SIGFYEYLALMKYVELTTAIFKQ

SEQ ID NO: 3017116 - protein, 18 aa, Entamoeba invadens
SIGHGFRTTYSDTRWCYI

SEQ ID NO: 3017117 - protein, 29 aa, Entamoeba invadens
SIGKIFQNYIPYFRVYYQYLGNTGPSQQA

SEQ ID NO: 3017118 - protein, 26 aa, Entamoeba invadens
SIGKYCFFHCFAIQKLVIPKSVKSIG

SEQ ID NO: 3017119 - protein, 24 aa, Entamoeba invadens
SIGNLCYGGYKWLTKIDIPTRVTS

SEQ ID NO: 3017120 - protein, 17 aa, Entamoeba invadens
SIGYACFYKCSSLSSIT

SEQ ID NO: 3017121 - protein, 27 aa, Entamoeba invadens
SIHDDTHIIFLAISLLYSHTGLQKNTM

SEQ ID NO: 3017122 - protein, 30 aa, Entamoeba invadens
SIHLALRSGIIDLIFFYQMLGHSTCNSRLM

SEQ ID NO: 3017123 - protein, 17 aa, Entamoeba invadens
SIHMNGWIRKPNILERI

SEQ ID NO: 3017124 - protein, 18 aa, Entamoeba invadens
SIHNLFLTKAILQGNING

SEQ ID NO: 3017125 - protein, 31 aa, Entamoeba invadens
SIIDKTFQATIPPLYRYSLIADIMSHCVESL

SEQ ID NO: 3017126 - protein, 26 aa, Entamoeba invadens
SIIDSLFGHHILALTVAKLANDDYKT

SEQ ID NO: 3017127 - protein, 26 aa, Entamoeba invadens
SIIEPVSSLLYVKGMYIIGGTVSGKV

SEQ ID NO: 3017128 - protein, 20 aa, Entamoeba invadens
SIIEVPWYEKVIVILRNRYG

SEQ ID NO: 3017129 - protein, 20 aa, Entamoeba invadens
SIIFINMRPIEVDVQPGKLV

SEQ ID NO: 3017130 - protein, 19 aa, Entamoeba invadens
SIIIPISYLRQYTTCVIHL

SEQ ID NO: 3017131 - protein, 17 aa, Entamoeba invadens
SIIIPPTVYRIGSNTFA

SEQ ID NO: 3017132 - protein, 28 aa, Entamoeba invadens
SIIKDNMLQILDFLPRRIGDDLLKIVGG

SEQ ID NO: 3017133 - protein, 18 aa, Entamoeba invadens
SIILFFMEKETETVFTIV

SEQ ID NO: 3017134 - protein, 18 aa, Entamoeba invadens
SIILTCGCGKYKFFKEDL

SEQ ID NO: 3017135 - protein, 17 aa, Entamoeba invadens
SIINTKYSLTLHLPNKK

SEQ ID NO: 3017136 - protein, 21 aa, Entamoeba invadens
SIINYINTCPLPEKAQLFVKF

SEQ ID NO: 3017137 - protein, 29 aa, Entamoeba invadens
SIIQKLSDFMLLHPKGPLGLSTHMIVFMK

SEQ ID NO: 3017138 - protein, 32 aa, Entamoeba invadens
SIIQPQTIELLIKLYECDILPLTPKHTQNTIS

SEQ ID NO: 3017139 - protein, 26 aa, Entamoeba invadens
SIIRFDLPHLDHILHFIYTSPQQNTQ

SEQ ID NO: 3017140 - protein, 22 aa, Entamoeba invadens
SIIRQIIIDSKFGLLRKIKDAF

SEQ ID NO: 3017141 - protein, 25 aa, Entamoeba invadens
SIISKDFFVIMSDKRFMFLDTIEDA

SEQ ID NO: 3017142 - protein, 23 aa, Entamoeba invadens
SIISKITQFCTNDPPNQVKPTQV

SEQ ID NO: 3017143 - protein, 24 aa, Entamoeba invadens
SIISRLMFNQFSAGGATVAAVFHH

SEQ ID NO: 3017144 - protein, 36 aa, Entamoeba invadens
SIIVLTKSFDYCFPRFLVLLFPNELTSTFWQRCNAS

SEQ ID NO: 3017145 - protein, 18 aa, Entamoeba invadens
SIIVVKIIKKVFENTPFL

SEQ ID NO: 3017146 - protein, 24 aa, Entamoeba invadens
SIKAKLKIAIINKGWEYSDTFDEK

SEQ ID NO: 3017147 - protein, 17 aa, Entamoeba invadens
SIKCNLRYPLFATSCSV

SEQ ID NO: 3017148 - protein, 27 aa, Entamoeba invadens
SIKDFQNLMFMKLYKKHLFTVQICHCN

SEQ ID NO: 3017149 - protein, 24 aa, Entamoeba invadens
SIKDQLLGILYRNGVNSEQGVKDI

SEQ ID NO: 3017150 - protein, 22 aa, Entamoeba invadens
SIKDYTKLFDLFFSVTSHETPN

SEQ ID NO: 3017151 - protein, 17 aa, Entamoeba invadens
SIKIIELLVQNDTVTYF

SEQ ID NO: 3017152 - protein, 18 aa, Entamoeba invadens
SIKNRFFSYLAKSKKKTA

SEQ ID NO: 3017153 - protein, 29 aa, Entamoeba invadens
SIKQCYELLQYHFLNFNKIIESVTKQFAE

SEQ ID NO: 3017154 - protein, 25 aa, Entamoeba invadens
SIKQDLVMKLLSPAVKIGEKMQYNE

SEQ ID NO: 3017155 - protein, 31 aa, Entamoeba invadens
SIKSHPWFKGYDWDGLFQKKITPPYVPVVKD

SEQ ID NO: 3017156 - protein, 24 aa, Entamoeba invadens
SIKSQFLDNFLTTKLHFIDFEFGN

SEQ ID NO: 3017157 - protein, 17 aa, Entamoeba invadens
SIKTFKYNKLLNSITLS

SEQ ID NO: 3017158 - protein, 23 aa, Entamoeba invadens
SIKTMDEFYRESLKNVENKEKLL

SEQ ID NO: 3017159 - protein, 22 aa, Entamoeba invadens
SIKTRNPIVFSFHPSALKCSIA

SEQ ID NO: 3017160 - protein, 19 aa, Entamoeba invadens
SIKTTKNGFLFVFNGEQEK

SEQ ID NO: 3017161 - protein, 27 aa, Entamoeba invadens
SIKTWKKRLFILKDNRLWYFEGKNDQC

SEQ ID NO: 3017162 - protein, 32 aa, Entamoeba invadens
SIKTWKKRYFVLKDKMIWYYASRHDLIAKGCV

SEQ ID NO: 3017163 - protein, 35 aa, Entamoeba invadens
SIKYQAPQYFFDLTDWYIGYLIRSYRSGDTTIPSV

SEQ ID NO: 3017164 - protein, 30 aa, Entamoeba invadens
SILDGFVKYALLKRPLLHQKLWNVLVDYSE

SEQ ID NO: 3017165 - protein, 21 aa, Entamoeba invadens
SILFTLIVFGKEKYFEMVREF

SEQ ID NO: 3017166 - protein, 19 aa, Entamoeba invadens
SILGDIFHPIFAIKEGYTL

SEQ ID NO: 3017167 - protein, 32 aa, Entamoeba invadens
SILKEKVCKWEYLKSLLTPSLTFIFSCIKNEV

SEQ ID NO: 3017168 - protein, 18 aa, Entamoeba invadens
SILKLNYLSNFTSYLLPL

SEQ ID NO: 3017169 - protein, 17 aa, Entamoeba invadens
SILLGYDLNFIEKLMEV

SEQ ID NO: 3017170 - protein, 18 aa, Entamoeba invadens
SILLRQFGKTHLKKLLGV

SEQ ID NO: 3017171 - protein, 20 aa, Entamoeba invadens
SILPCIIGCTRGTYGAFVME

SEQ ID NO: 3017172 - protein, 18 aa, Entamoeba invadens
SILPVPRIKFYATEILLA

SEQ ID NO: 3017173 - protein, 19 aa, Entamoeba invadens
SILQIEISLLKDPVPRIAS

SEQ ID NO: 3017174 - protein, 29 aa, Entamoeba invadens
SILRLPQMGMAFYKLYQTASLLALKNNEY

SEQ ID NO: 3017175 - protein, 19 aa, Entamoeba invadens
SILSFKLFNCRFGIREPFG

SEQ ID NO: 3017176 - protein, 20 aa, Entamoeba invadens
SILSPYAFKSKFKIFTDLEC

SEQ ID NO: 3017177 - protein, 24 aa, Entamoeba invadens
SILVCGFYEFGIIDSTLIFDTVLK

SEQ ID NO: 3017178 - protein, 23 aa, Entamoeba invadens
SINDLYHYVLIDTPLGNYLSGCM

SEQ ID NO: 3017179 - protein, 30 aa, Entamoeba invadens
SINEVANLIKLWFRELPTLCLNPLSSTQIQ

SEQ ID NO: 3017180 - protein, 18 aa, Entamoeba invadens
SINGKYKFNDKFSVNGNA

SEQ ID NO: 3017181 - protein, 20 aa, Entamoeba invadens
SINHFYFKKISFYTKTLPDE

SEQ ID NO: 3017182 - protein, 23 aa, Entamoeba invadens
SINHMYYLQRLSVDKDFAFDFSK

SEQ ID NO: 3017183 - protein, 36 aa, Entamoeba invadens
SINKKSHLLYFIFSRDTIFGMWMGFPVVHGKSCLGP

SEQ ID NO: 3017184 - protein, 26 aa, Entamoeba invadens
SINKVFKRMFPFFVSSALIDGIPVFL

SEQ ID NO: 3017185 - protein, 25 aa, Entamoeba invadens
SINLPKVVYVPFKPSLKFTKIVSLK

SEQ ID NO: 3017186 - protein, 18 aa, Entamoeba invadens
SINLPPYLRELGSKAFYK

SEQ ID NO: 3017187 - protein, 22 aa, Entamoeba invadens
SINTLENLKYLFTKKTQEWTVQ

SEQ ID NO: 3017188 - protein, 20 aa, Entamoeba invadens
SINYIIDLTGMSLIFVSSET

SEQ ID NO: 3017189 - protein, 24 aa, Entamoeba invadens
SIPEQFILDNFFRKVEQEKYYSEY

SEQ ID NO: 3017190 - protein, 32 aa, Entamoeba invadens
SIPIQKIVTLFPKLETLYLPYEVDYNLSFLEN

SEQ ID NO: 3017191 - protein, 18 aa, Entamoeba invadens
SIPLFGFVGRICEQKGVF

SEQ ID NO: 3017192 - protein, 22 aa, Entamoeba invadens
SIPLRHRIFYSKKDRATYYSTT

SEQ ID NO: 3017193 - protein, 23 aa, Entamoeba invadens
SIPNFFEFVILLFEIDDSSFILR

SEQ ID NO: 3017194 - protein, 31 aa, Entamoeba invadens
SIQDLKCKYLDLYLMHWPVAVKENSSFPPKT

SEQ ID NO: 3017195 - protein, 19 aa, Entamoeba invadens
SIQIAYICSRAEIFPNMVL

SEQ ID NO: 3017196 - protein, 18 aa, Entamoeba invadens
SIQNLYRDIHHPDILGMV

SEQ ID NO: 3017197 - protein, 25 aa, Entamoeba invadens
SIQNYRFNVIKYLNKSLFEPVTGID

SEQ ID NO: 3017198 - protein, 25 aa, Entamoeba invadens
SIQQLLKIVFMFRTDFEINTKLIPT

SEQ ID NO: 3017199 - protein, 21 aa, Entamoeba invadens
SIQQYLITPIQRTPRYVMLIT

SEQ ID NO: 3017200 - protein, 26 aa, Entamoeba invadens
SIQTAFLNFVIQLAETFYQSKNYFGL

SEQ ID NO: 3017201 - protein, 21 aa, Entamoeba invadens
SIRDQQPVLSWLDVSIGEIVA

SEQ ID NO: 3017202 - protein, 22 aa, Entamoeba invadens
SIRGELFVSPSLKRNKKIFSLS

SEQ ID NO: 3017203 - protein, 31 aa, Entamoeba invadens
SIRKFAFYYCINFSQIVLPISLVDIGSSAFS

SEQ ID NO: 3017204 - protein, 25 aa, Entamoeba invadens
SIRKLDSLCFCWCRNLRNVDISYGI

SEQ ID NO: 3017205 - protein, 20 aa, Entamoeba invadens
SIRLLLIPSYNIKISNFELK

SEQ ID NO: 3017206 - protein, 26 aa, Entamoeba invadens
SIRNRPTLIFPFTPTHTFFMRAHPTV

SEQ ID NO: 3017207 - protein, 24 aa, Entamoeba invadens
SIRRSVLRFGENLIDPVRQKQTGP

SEQ ID NO: 3017208 - protein, 47 aa, Entamoeba invadens
SIRVLYGFRKVWPCPTVILFNPDSFRNFIIRFGDLDWLIANVEIYPS

SEQ ID NO: 3017209 - protein, 26 aa, Entamoeba invadens
SISIEKPMSLFPFLNDMWVGCANCSI

SEQ ID NO: 3017210 - protein, 25 aa, Entamoeba invadens
SISMEQFLYPIKDIKLNNLLVFSNN

SEQ ID NO: 3017211 - protein, 20 aa, Entamoeba invadens
SISMTLLSYGMLNFDDLYAV

SEQ ID NO: 3017212 - protein, 24 aa, Entamoeba invadens
SITEYLNYFIAHRTPLTFQIKATR

SEQ ID NO: 3017213 - protein, 17 aa, Entamoeba invadens
SITIAIDMLRTNPIYIT

SEQ ID NO: 3017214 - protein, 23 aa, Entamoeba invadens
SITLPLERNTFFFIPKILTPKQE

SEQ ID NO: 3017215 - protein, 19 aa, Entamoeba invadens
SITLPQFLTFLDSGVFWGC

SEQ ID NO: 3017216 - protein, 20 aa, Entamoeba invadens
SITLTRILPQILLAIQAKNL

SEQ ID NO: 3017217 - protein, 21 aa, Entamoeba invadens
SITPAWLRFISDTRNSPTMSF

SEQ ID NO: 3017218 - protein, 26 aa, Entamoeba invadens
SITPKIVSSFRLLRSLPLSCYIDKVI

SEQ ID NO: 3017219 - protein, 21 aa, Entamoeba invadens
SITPPYCDLSMFPSAISLVIQ

SEQ ID NO: 3017220 - protein, 29 aa, Entamoeba invadens
SITQQTFLIACFLKLGYTAKLHRTTKKTG

SEQ ID NO: 3017221 - protein, 24 aa, Entamoeba invadens
SITSVHKFLNLPILDFQKQILEKM

SEQ ID NO: 3017222 - protein, 17 aa, Entamoeba invadens
SITTSCGCYITSSSFWF

SEQ ID NO: 3017223 - protein, 23 aa, Entamoeba invadens
SIVDFPELKPEYLEQLSTFQPKG

SEQ ID NO: 3017224 - protein, 30 aa, Entamoeba invadens
SIVDSKSFLFSLESLGRLPKQMRFAIRSDK

SEQ ID NO: 3017225 - protein, 19 aa, Entamoeba invadens
SIVFHDHFTPLRIYQTRTS

SEQ ID NO: 3017226 - protein, 17 aa, Entamoeba invadens
SIVGNNLVLIFNGCVYT

SEQ ID NO: 3017227 - protein, 23 aa, Entamoeba invadens
SIVKRYCEGVFEDSMMSTVGIDF

SEQ ID NO: 3017228 - protein, 17 aa, Entamoeba invadens
SIVLHDLVLNQSAQVLS

SEQ ID NO: 3017229 - protein, 22 aa, Entamoeba invadens
SIVQHILFYREKIEIQRIEMNT

SEQ ID NO: 3017230 - protein, 18 aa, Entamoeba invadens
SIVSLKPGYACEFEIFIK

SEQ ID NO: 3017231 - protein, 27 aa, Entamoeba invadens
SIVSLQDALFRMAPISFFEDLIDSIVL

SEQ ID NO: 3017232 - protein, 19 aa, Entamoeba invadens
SIVVYLIKNDITKEADKLI

SEQ ID NO: 3017233 - protein, 20 aa, Entamoeba invadens
SIVYMNIYYHNSKYLELKTD

SEQ ID NO: 3017234 - protein, 25 aa, Entamoeba invadens
SIWANFHHLYFQTVGFKKISYHTPH

SEQ ID NO: 3017235 - protein, 24 aa, Entamoeba invadens
SIWAVYTNQIFVLDIDNATIKKTI

SEQ ID NO: 3017236 - protein, 24 aa, Entamoeba invadens
SIYEEWFVKLQYVPPILEETRAHY

SEQ ID NO: 3017237 - protein, 21 aa, Entamoeba invadens
SIYLQQKTLRYVSNKQRMSIA

SEQ ID NO: 3017238 - protein, 38 aa, Entamoeba invadens
SIYNCSEYFCLFKKIKFPITPLYQVISLVLRGMSEVEY

SEQ ID NO: 3017239 - protein, 19 aa, Entamoeba invadens
SIYQFKYALRREEDIKVFG

SEQ ID NO: 3017240 - protein, 29 aa, Entamoeba invadens
SIYRNSMPLDMFKFISSHIKTYDMGQPDD

SEQ ID NO: 3017241 - protein, 19 aa, Entamoeba invadens
SIYTKIPVMSILLGAISNV

SEQ ID NO: 3017242 - protein, 20 aa, Entamoeba invadens
SIYVPNAYLPKSLDSKVKAV

SEQ ID NO: 3017243 - protein, 21 aa, Entamoeba invadens
SKACGFVKFRRVADAMKCVSD

SEQ ID NO: 3017244 - protein, 27 aa, Entamoeba invadens
SKAEWNEWILFPIQYKDLSEDAIIVLR

SEQ ID NO: 3017245 - protein, 21 aa, Entamoeba invadens
SKALSLLKILITVTYEADNDF

SEQ ID NO: 3017246 - protein, 26 aa, Entamoeba invadens
SKAMYRQWFNQLTELTIDKVSSQMAL

SEQ ID NO: 3017247 - protein, 25 aa, Entamoeba invadens
SKANSLYFVQFLTDLNIPECVSKIA

SEQ ID NO: 3017248 - protein, 19 aa, Entamoeba invadens
SKAPKPPVLVAGSEKPKEV

SEQ ID NO: 3017249 - protein, 25 aa, Entamoeba invadens
SKASPLIRTTKIPIIPKIPSKVDNN

SEQ ID NO: 3017250 - protein, 24 aa, Entamoeba invadens
SKAVTDIAWINNGFVSCGLDKTLK

SEQ ID NO: 3017251 - protein, 26 aa, Entamoeba invadens
SKAYIELLHHFISKTNIEVLRQSDLT

SEQ ID NO: 3017252 - protein, 27 aa, Entamoeba invadens
SKCEIPFYQVVFWFIVDFGITQLPHNR

SEQ ID NO: 3017253 - protein, 27 aa, Entamoeba invadens
SKCFSKCYSLLPFQIPTSVKSIGEECF

SEQ ID NO: 3017254 - protein, 17 aa, Entamoeba invadens
SKCFSLSQIAFPKSIKK

SEQ ID NO: 3017255 - protein, 18 aa, Entamoeba invadens
SKCHWRLMKLFEERLSTA

SEQ ID NO: 3017256 - protein, 28 aa, Entamoeba invadens
SKCILQSLILARLVKKFPELIESTNLFC

SEQ ID NO: 3017257 - protein, 25 aa, Entamoeba invadens
SKCNEPCIPLLPVVLKDLEKIHDNE

SEQ ID NO: 3017258 - protein, 19 aa, Entamoeba invadens
SKCQLLVHIIKRQHFSIKC

SEQ ID NO: 3017259 - protein, 23 aa, Entamoeba invadens
SKCSSCTFWYSPSDDGTHCSKTA

SEQ ID NO: 3017260 - protein, 19 aa, Entamoeba invadens
SKCVVCKDGYYLYNNICVQ

SEQ ID NO: 3017261 - protein, 27 aa, Entamoeba invadens
SKDCVKPFPPFLRPTRTHPILPVLPHD

SEQ ID NO: 3017262 - protein, 24 aa, Entamoeba invadens
SKDEHNMWNLQFYFDMIQKDSNEL

SEQ ID NO: 3017263 - protein, 56 aa, Entamoeba invadens
SKDIVVKDKTVKLQLWDTAGQERFATLSSNYFRSALGGVIVFDVSNRQSFENVETW

SEQ ID NO: 3017264 - protein, 24 aa, Entamoeba invadens
SKDKHLIFIFPDKETMLKWVDVFN

SEQ ID NO: 3017265 - protein, 25 aa, Entamoeba invadens
SKDKSIFVLFEESVPLSLFVKTYLL

SEQ ID NO: 3017266 - protein, 36 aa, Entamoeba invadens
SKDPDVMYCSLYTRLLVLLLPHLKVLNTSILNMSVK

SEQ ID NO: 3017267 - protein, 24 aa, Entamoeba invadens
SKDSYIPVLLSYYSSRDKLYNVIA

SEQ ID NO: 3017268 - protein, 26 aa, Entamoeba invadens
SKDTKKKILLLLKKWTTEVPQNIIQA

SEQ ID NO: 3017269 - protein, 23 aa, Entamoeba invadens
SKDTVDCLLALFLNTSPLCKDLL

SEQ ID NO: 3017270 - protein, 24 aa, Entamoeba invadens
SKDVDMVINKPWVRGYKQTAWSIR

SEQ ID NO: 3017271 - protein, 32 aa, Entamoeba invadens
SKEAQYVVTTFRPELIGPAKKWYEIKHQNKVS

SEQ ID NO: 3017272 - protein, 23 aa, Entamoeba invadens
SKEDLISMFISNSKIDIIEVSQN

SEQ ID NO: 3017273 - protein, 23 aa, Entamoeba invadens
SKEDWFDWVKQTAITFLKESPIH

SEQ ID NO: 3017274 - protein, 22 aa, Entamoeba invadens
SKEEIPIFIKFYDKFDCDTYND

SEQ ID NO: 3017275 - protein, 24 aa, Entamoeba invadens
SKEFATILFGWLDQNKDGYLEGRE

SEQ ID NO: 3017276 - protein, 23 aa, Entamoeba invadens
SKEFKEPPLIKKTKIKKNKKDSE

SEQ ID NO: 3017277 - protein, 19 aa, Entamoeba invadens
SKEFLYYPEQWKLKLYQSI

SEQ ID NO: 3017278 - protein, 24 aa, Entamoeba invadens
SKEKGDVILFIVGNKLDLGKREVT

SEQ ID NO: 3017279 - protein, 18 aa, Entamoeba invadens
SKEKLGVVWLEEVKKELI

SEQ ID NO: 3017280 - protein, 25 aa, Entamoeba invadens
SKELPEVLMYYFPSTKAMCVNLLNS

SEQ ID NO: 3017281 - protein, 17 aa, Entamoeba invadens
SKELPIPTSFPKRQHFD

SEQ ID NO: 3017282 - protein, 26 aa, Entamoeba invadens
SKEMMPLTHVLATKLVLRLQECREKG

SEQ ID NO: 3017283 - protein, 27 aa, Entamoeba invadens
SKETNLFNFLLNTLLIVFNMNVAFRKG

SEQ ID NO: 3017284 - protein, 25 aa, Entamoeba invadens
SKEWYTQNYFLPLREVMKNAPIVEG

SEQ ID NO: 3017285 - protein, 22 aa, Entamoeba invadens
SKEYIREYILSSLINGQISSYQ

SEQ ID NO: 3017286 - protein, 28 aa, Entamoeba invadens
SKEYPSLSIPLIYVLMHDTLQNMQCETH

SEQ ID NO: 3017287 - protein, 19 aa, Entamoeba invadens
SKEYPVLYSCLLMNDDKDF

SEQ ID NO: 3017288 - protein, 26 aa, Entamoeba invadens
SKEYSKDMLLEMYEYAYDYKIMDFEK

SEQ ID NO: 3017289 - protein, 29 aa, Entamoeba invadens
SKFHYNPIPLNLFTLKFFPHIETFHLYTE

SEQ ID NO: 3017290 - protein, 21 aa, Entamoeba invadens
SKFHYNPLPLTTRTLKYFENV

SEQ ID NO: 3017291 - protein, 20 aa, Entamoeba invadens
SKFKNYTYYYADFEASTQGN

SEQ ID NO: 3017292 - protein, 31 aa, Entamoeba invadens
SKFLIHALLCQTQFIDPMPLTKTLLVPINPN

SEQ ID NO: 3017293 - protein, 21 aa, Entamoeba invadens
SKFQFPSLFMKEPTFFALPVT

SEQ ID NO: 3017294 - protein, 28 aa, Entamoeba invadens
SKFQYNEELLLLLFDNLFQRNDVSSLEG

SEQ ID NO: 3017295 - protein, 21 aa, Entamoeba invadens
SKFTKDFQKSPPSAFIPIKDN

SEQ ID NO: 3017296 - protein, 22 aa, Entamoeba invadens
SKFVATFFAHKGCKIAVASSSF

SEQ ID NO: 3017297 - protein, 23 aa, Entamoeba invadens
SKGCGFVKFVYRDDAVSCYNYHK

SEQ ID NO: 3017298 - protein, 28 aa, Entamoeba invadens
SKGFKDQMYTILKTLPATVQVGMFSATM

SEQ ID NO: 3017299 - protein, 23 aa, Entamoeba invadens
SKGLFCDLLWSDPFVPEPGQKNK

SEQ ID NO: 3017300 - protein, 25 aa, Entamoeba invadens
SKGNKQLIFPIFTLNMLNVTDSLDP

SEQ ID NO: 3017301 - protein, 26 aa, Entamoeba invadens
SKGSISHFLSLVFFIAKKTDTRVEKK

SEQ ID NO: 3017302 - protein, 25 aa, Entamoeba invadens
SKGTEVVVLVILDKGIKEGEVIEID

SEQ ID NO: 3017303 - protein, 23 aa, Entamoeba invadens
SKGVKIVLLGESATGKTCIVHRY

SEQ ID NO: 3017304 - protein, 28 aa, Entamoeba invadens
SKGVLFVHYLCRNGFITTSKIVCISNAT

SEQ ID NO: 3017305 - protein, 19 aa, Entamoeba invadens
SKHYVGDSLFIKYKPRDQF

SEQ ID NO: 3017306 - protein, 23 aa, Entamoeba invadens
SKIAEVFKALDGKNVWEVIEQGK

SEQ ID NO: 3017307 - protein, 25 aa, Entamoeba invadens
SKIDDRGIAFITYYDIRAAEKAHND

SEQ ID NO: 3017308 - protein, 23 aa, Entamoeba invadens
SKIDPIVQTFEKEFNRIKDRIEE

SEQ ID NO: 3017309 - protein, 24 aa, Entamoeba invadens
SKIEKPVYQKPLPSTQNQLEQTTQ

SEQ ID NO: 3017310 - protein, 18 aa, Entamoeba invadens
SKIIPFGDFIHTTNFRAS

SEQ ID NO: 3017311 - protein, 24 aa, Entamoeba invadens
SKIKKCFICGNYGHKTSMCPQREE

SEQ ID NO: 3017312 - protein, 20 aa, Entamoeba invadens
SKILLNLIKSFREVTKKTMN

SEQ ID NO: 3017313 - protein, 21 aa, Entamoeba invadens
SKINDLIFIVLRDLRGEGVIA

SEQ ID NO: 3017314 - protein, 25 aa, Entamoeba invadens
SKIQEFAIPILLKGKDLVMQSQSGS

SEQ ID NO: 3017315 - protein, 21 aa, Entamoeba invadens
SKITNKVLLPAIKNGKVTLTN

SEQ ID NO: 3017316 - protein, 21 aa, Entamoeba invadens
SKITNKVLLPAIKNGKVTLTT

SEQ ID NO: 3017317 - protein, 25 aa, Entamoeba invadens
SKIVSGLFCAAISMIQFDVAINEEM

SEQ ID NO: 3017318 - protein, 19 aa, Entamoeba invadens
SKIWMGLFDHQTPNEILMF

SEQ ID NO: 3017319 - protein, 17 aa, Entamoeba invadens
SKIWYFIGKVIFKEKKC

SEQ ID NO: 3017320 - protein, 25 aa, Entamoeba invadens
SKKCQEVLLILKVNPIFPRKNTPST

SEQ ID NO: 3017321 - protein, 26 aa, Entamoeba invadens
SKKDVKFVIVIFFYINVTRNDTNPLD

SEQ ID NO: 3017322 - protein, 17 aa, Entamoeba invadens
SKKFAGTTIAIKSFHGK

SEQ ID NO: 3017323 - protein, 20 aa, Entamoeba invadens
SKKFAVIKKAAFELKVGEMV

SEQ ID NO: 3017324 - protein, 30 aa, Entamoeba invadens
SKKFQKVLEIVLILLNYIQKINKKKQSSGF

SEQ ID NO: 3017325 - protein, 25 aa, Entamoeba invadens
SKKGKLYIEYKWVRGISGMYHAITH

SEQ ID NO: 3017326 - protein, 40 aa, Entamoeba invadens
SKKIPQQIILEKFGNAKLVFESILSLKYISNTICDKKDAQ

SEQ ID NO: 3017327 - protein, 26 aa, Entamoeba invadens
SKKKKVIWCGDLNVALRWIDVAKPAT

SEQ ID NO: 3017328 - protein, 17 aa, Entamoeba invadens
SKKLKEKLHKMDEAVLK

SEQ ID NO: 3017329 - protein, 37 aa, Entamoeba invadens
SKKNFDFMKKIYLYVRPNTRFPALPVVYIEKLQNSFA

SEQ ID NO: 3017330 - protein, 24 aa, Entamoeba invadens
SKKPEYLSLINSLGETPLFVAVSS

SEQ ID NO: 3017331 - protein, 23 aa, Entamoeba invadens
SKKSNLLAYWSDTFTTVLCGHFD

SEQ ID NO: 3017332 - protein, 23 aa, Entamoeba invadens
SKKTFPLLTINFVHKYTKDGIVD

SEQ ID NO: 3017333 - protein, 25 aa, Entamoeba invadens
SKKVKIVLQHKMDWLRQSKATLQDE

SEQ ID NO: 3017334 - protein, 20 aa, Entamoeba invadens
SKKWILGSKFGFTTSQKLLK

SEQ ID NO: 3017335 - protein, 28 aa, Entamoeba invadens
SKKYFEKKISLLPLSTPLYVLDAMLSDE

SEQ ID NO: 3017336 - protein, 30 aa, Entamoeba invadens
SKLHQFDVVFIVLLFYTTASENYLYRTLMI

SEQ ID NO: 3017337 - protein, 21 aa, Entamoeba invadens
SKLINTLLQLETHIPFDFIVN

SEQ ID NO: 3017338 - protein, 24 aa, Entamoeba invadens
SKLQHVTIRLIYCSSFTISNSNDI

SEQ ID NO: 3017339 - protein, 20 aa, Entamoeba invadens
SKLRGINYEMFQVCLKKLKE

SEQ ID NO: 3017340 - protein, 20 aa, Entamoeba invadens
SKLRNPFIANYMGSVTYLKQ

SEQ ID NO: 3017341 - protein, 20 aa, Entamoeba invadens
SKLSLYPLTDCEHATMTVDV

SEQ ID NO: 3017342 - protein, 23 aa, Entamoeba invadens
SKMGMIRFITGIGRHSEKGYSVI

SEQ ID NO: 3017343 - protein, 25 aa, Entamoeba invadens
SKMYIGAWYINPAIDTAINIVDTNR

SEQ ID NO: 3017344 - protein, 26 aa, Entamoeba invadens
SKNALLKDWALFFLRCIHHMSVQKMQ

SEQ ID NO: 3017345 - protein, 24 aa, Entamoeba invadens
SKNCPKLKALPIYAALPTDQQKQI

SEQ ID NO: 3017346 - protein, 25 aa, Entamoeba invadens
SKNFAFSLLAPHLESPRKYPLLPGK

SEQ ID NO: 3017347 - protein, 25 aa, Entamoeba invadens
SKNGQLTLPKFHPDSMMKSKLEHRN

SEQ ID NO: 3017348 - protein, 24 aa, Entamoeba invadens
SKNIISAFYICGFVKTQIASDKET

SEQ ID NO: 3017349 - protein, 24 aa, Entamoeba invadens
SKNILVDKILALKINQWYANQTKI

SEQ ID NO: 3017350 - protein, 26 aa, Entamoeba invadens
SKNKKACFLNILLSLFCGDIDVKKKW

SEQ ID NO: 3017351 - protein, 18 aa, Entamoeba invadens
SKNKLYVAHVGDSPVFLI

SEQ ID NO: 3017352 - protein, 24 aa, Entamoeba invadens
SKNKSAYLLFYRKVSESVEIPILD

SEQ ID NO: 3017353 - protein, 24 aa, Entamoeba invadens
SKNNLIFETGPRFSFNDLTLVFMT

SEQ ID NO: 3017354 - protein, 28 aa, Entamoeba invadens
SKNPNEYFRFLWELRMTFSRDLTQLEGL

SEQ ID NO: 3017355 - protein, 28 aa, Entamoeba invadens
SKNSPFIHQILCLINFLLSVKNNTFESC

SEQ ID NO: 3017356 - protein, 31 aa, Entamoeba invadens
SKNSVISLCFQPLIEWKIGTEPNYYPISAPP

SEQ ID NO: 3017357 - protein, 23 aa, Entamoeba invadens
SKNYLPKMSQFAEIMQHNTIYVL

SEQ ID NO: 3017358 - protein, 17 aa, Entamoeba invadens
SKPIILYVLEQLSSLEG

SEQ ID NO: 3017359 - protein, 21 aa, Entamoeba invadens
SKPKKMISKLSLYKCGMSEYD

SEQ ID NO: 3017360 - protein, 24 aa, Entamoeba invadens
SKPLWKFHIFTNVAGKWKFVAQIS

SEQ ID NO: 3017361 - protein, 23 aa, Entamoeba invadens
SKPVNFCRSIYPISVWESFSKYC

SEQ ID NO: 3017362 - protein, 34 aa, Entamoeba invadens
SKQAIELVFVVCAYDGFFSFMCAAKSYAKTKAEP

SEQ ID NO: 3017363 - protein, 26 aa, Entamoeba invadens
SKQCFVVVLLYKNGIEPCRILETRLA

SEQ ID NO: 3017364 - protein, 17 aa, Entamoeba invadens
SKQDKFKYAKGNLFNFV

SEQ ID NO: 3017365 - protein, 24 aa, Entamoeba invadens
SKQNYFHLGCKLLRMGVGEILNYS

SEQ ID NO: 3017366 - protein, 19 aa, Entamoeba invadens
SKQPPKRRKKRTVLFPSLA

SEQ ID NO: 3017367 - protein, 24 aa, Entamoeba invadens
SKQTAKVYLIRVRGKMSEMVTVEG

SEQ ID NO: 3017368 - protein, 24 aa, Entamoeba invadens
SKRAHPLPNWNKRTEILLNTELKM

SEQ ID NO: 3017369 - protein, 25 aa, Entamoeba invadens
SKRAILLHYFLVVADEMRKLNNFEG

SEQ ID NO: 3017370 - protein, 24 aa, Entamoeba invadens
SKRGDYMITYFYITDSDDGCRAVG

SEQ ID NO: 3017371 - protein, 20 aa, Entamoeba invadens
SKRGVVAFTGRLAFDVDKVV

SEQ ID NO: 3017372 - protein, 27 aa, Entamoeba invadens
SKRLQLPKLSVFWDKHRAFLSSANSKL

SEQ ID NO: 3017373 - protein, 20 aa, Entamoeba invadens
SKRLYLFKQIEKCKTIVEIK

SEQ ID NO: 3017374 - protein, 28 aa, Entamoeba invadens
SKRNKMFFKIIVWYPVTFKVSKTLENTN

SEQ ID NO: 3017375 - protein, 25 aa, Entamoeba invadens
SKRPKTIQSLTPRFSLTARKPEMLS

SEQ ID NO: 3017376 - protein, 19 aa, Entamoeba invadens
SKRRLSYIADTTLTTPSRT

SEQ ID NO: 3017377 - protein, 26 aa, Entamoeba invadens
SKRTTTTFQFLYIKEIKFNNYSINVV

SEQ ID NO: 3017378 - protein, 26 aa, Entamoeba invadens
SKRTTTTLQFLFIKELRFDGYVVDVS

SEQ ID NO: 3017379 - protein, 26 aa, Entamoeba invadens
SKRYNNFLELFKENPIRKITLFPNIE

SEQ ID NO: 3017380 - protein, 22 aa, Entamoeba invadens
SKSAFEFCRFKTFKIPAGIKEV

SEQ ID NO: 3017381 - protein, 29 aa, Entamoeba invadens
SKSDVWSFGILIFKLLVGCTPFETIQMDP

SEQ ID NO: 3017382 - protein, 21 aa, Entamoeba invadens
SKSFLVVQLPPVVSVLMSMKT

SEQ ID NO: 3017383 - protein, 24 aa, Entamoeba invadens
SKSHAFFPIPDVLYFDRRTLKSKE

SEQ ID NO: 3017384 - protein, 22 aa, Entamoeba invadens
SKSKNYIYYYADFEASTQGIHK

SEQ ID NO: 3017385 - protein, 22 aa, Entamoeba invadens
SKSLPEEVFEFAKKKSMKYKEK

SEQ ID NO: 3017386 - protein, 32 aa, Entamoeba invadens
SKSNLHRYIMRLTLFEYVLGIPDENFRVKVEE

SEQ ID NO: 3017387 - protein, 23 aa, Entamoeba invadens
SKSPLFEFLQILVDVQNGFEPST

SEQ ID NO: 3017388 - protein, 28 aa, Entamoeba invadens
SKSPQQCKARWYSWLDPSIKKTEWTSTE

SEQ ID NO: 3017389 - protein, 29 aa, Entamoeba invadens
SKSQLKILKIYRLFSTRYLDNEFLNRTMT

SEQ ID NO: 3017390 - protein, 31 aa, Entamoeba invadens
SKSTTIKFRFVVPWMVVLFKRDFNREEILRV

SEQ ID NO: 3017391 - protein, 23 aa, Entamoeba invadens
SKSVSVIILLLSVGDCRVDLCDN

SEQ ID NO: 3017392 - protein, 27 aa, Entamoeba invadens
SKSVYLLGELLHLAGVLFPTKNVSLQK

SEQ ID NO: 3017393 - protein, 27 aa, Entamoeba invadens
SKTETTYICLLLLSHFLGSLDFEYYQQ

SEQ ID NO: 3017394 - protein, 19 aa, Entamoeba invadens
SKTFFQRITQCFSGFVVVV

SEQ ID NO: 3017395 - protein, 18 aa, Entamoeba invadens
SKTFKYFPNIETLHLWDI

SEQ ID NO: 3017396 - protein, 26 aa, Entamoeba invadens
SKTINPVISFILPTNDYIYAVGVNRC

SEQ ID NO: 3017397 - protein, 32 aa, Entamoeba invadens
SKTIYDSSIIPPSAEILFHIMTSHEMQLLCFF

SEQ ID NO: 3017398 - protein, 23 aa, Entamoeba invadens
SKTKNLFKFIQTQQFFSPFDIKL

SEQ ID NO: 3017399 - protein, 23 aa, Entamoeba invadens
SKTKTLSMKLLTASIWSPDNREV

SEQ ID NO: 3017400 - protein, 20 aa, Entamoeba invadens
SKTNLFVGGGPLLVGVSGYF

SEQ ID NO: 3017401 - protein, 26 aa, Entamoeba invadens
SKTSILRYLGIIIYMGARRDVINPVE

SEQ ID NO: 3017402 - protein, 23 aa, Entamoeba invadens
SKTSILRYLGILLNMGDHHDVIN

SEQ ID NO: 3017403 - protein, 22 aa, Entamoeba invadens
SKTVYPVVFGRAKDTQQSDNPS

SEQ ID NO: 3017404 - protein, 22 aa, Entamoeba invadens
SKTWYFVFLHFEQKIGGQSVHV

SEQ ID NO: 3017405 - protein, 32 aa, Entamoeba invadens
SKTYMLEYFMLWFSRCFPLEVELKILDLILME

SEQ ID NO: 3017406 - protein, 17 aa, Entamoeba invadens
SKVCFLLSKDDFHHGKT

SEQ ID NO: 3017407 - protein, 23 aa, Entamoeba invadens
SKVDEMYSLYLAKNNVTICVDKY

SEQ ID NO: 3017408 - protein, 30 aa, Entamoeba invadens
SKVIPSLEDPFWTALASLFSKAFVGKQNTI

SEQ ID NO: 3017409 - protein, 20 aa, Entamoeba invadens
SKVKPLGDMILVQGYNTSSI

SEQ ID NO: 3017410 - protein, 19 aa, Entamoeba invadens
SKVLFHRNVFALKSECFSA

SEQ ID NO: 3017411 - protein, 36 aa, Entamoeba invadens
SKVLKVNLDWSLQNVYSLIAHESGLTTFHLRAQNRV

SEQ ID NO: 3017412 - protein, 26 aa, Entamoeba invadens
SKVLSTLLDFVSLLKSVKKQCDSEFT

SEQ ID NO: 3017413 - protein, 18 aa, Entamoeba invadens
SKVMKVLPSFWCVFIQSG

SEQ ID NO: 3017414 - protein, 26 aa, Entamoeba invadens
SKVNGYIFWHDLLTHWFVYEIVRQKT

SEQ ID NO: 3017415 - protein, 19 aa, Entamoeba invadens
SKVQWLNNGQIASLLECAV

SEQ ID NO: 3017416 - protein, 21 aa, Entamoeba invadens
SKVRMKMLYSSTKAIFRQTLG

SEQ ID NO: 3017417 - protein, 25 aa, Entamoeba invadens
SKWEPEVRHYIPTAKTILVGLKIDL

SEQ ID NO: 3017418 - protein, 25 aa, Entamoeba invadens
SKYFAELIQKFFIKNLRKVVVLCTP

SEQ ID NO: 3017419 - protein, 20 aa, Entamoeba invadens
SKYFALIRNSGVKQSHHVIL

SEQ ID NO: 3017420 - protein, 22 aa, Entamoeba invadens
SKYILKVIPKREEKILVKVLPK

SEQ ID NO: 3017421 - protein, 17 aa, Entamoeba invadens
SKYKVFLPHTAGRYAVR

SEQ ID NO: 3017422 - protein, 23 aa, Entamoeba invadens
SKYLFGPHLFSQMNTLKIPEDLE

SEQ ID NO: 3017423 - protein, 22 aa, Entamoeba invadens
SKYRNVYLLASLRRICFIICYT

SEQ ID NO: 3017424 - protein, 25 aa, Entamoeba invadens
SKYRNYFGIPLKKLIDDENRKNTQI

SEQ ID NO: 3017425 - protein, 24 aa, Entamoeba invadens
SKYSQLFYFDSFMLNQKAIDDYNA

SEQ ID NO: 3017426 - protein, 24 aa, Entamoeba invadens
SKYTSVINIKLIFELSVAVSLVCP

SEQ ID NO: 3017427 - protein, 20 aa, Entamoeba invadens
SKYYTKIRPDIILVEGPLNI

SEQ ID NO: 3017428 - protein, 23 aa, Entamoeba invadens
SLAIFKITQYCYVFLGNQSCNTF

SEQ ID NO: 3017429 - protein, 19 aa, Entamoeba invadens
SLAIIIVEAFQKRPAYSTL

SEQ ID NO: 3017430 - protein, 26 aa, Entamoeba invadens
SLAISNLFISHLFMVYKHFCVVMNVS

SEQ ID NO: 3017431 - protein, 24 aa, Entamoeba invadens
SLAITINTFLWDVLLDIFNHVFFD

SEQ ID NO: 3017432 - protein, 27 aa, Entamoeba invadens
SLAIYNEVMIGLLGCDMLYAEQLEEVR

SEQ ID NO: 3017433 - protein, 20 aa, Entamoeba invadens
SLAKTMCGTPLYVAPEILSG

SEQ ID NO: 3017434 - protein, 25 aa, Entamoeba invadens
SLALSKHVPLPFDILDPPASQELVT

SEQ ID NO: 3017435 - protein, 34 aa, Entamoeba invadens
SLAMLFSHLFSSNAIEWNLFRFVIITEDETTSSS

SEQ ID NO: 3017436 - protein, 23 aa, Entamoeba invadens
SLASFLYCLNINPVVRAITKQPN

SEQ ID NO: 3017437 - protein, 37 aa, Entamoeba invadens
SLATFELAKKLKPKMFKLKLPIKGSLIQSGCICGKYF

SEQ ID NO: 3017438 - protein, 33 aa, Entamoeba invadens
SLAVTFYEALIWNEIYPKNLFQYPWTIADFVSG

SEQ ID NO: 3017439 - protein, 28 aa, Entamoeba invadens
SLCFCKGEMFFLSGFQLFSKKLNKKIDL

SEQ ID NO: 3017440 - protein, 33 aa, Entamoeba invadens
SLCFVHPEFFIVNKSSLFLNRCGEWLQLIGPSE

SEQ ID NO: 3017441 - protein, 19 aa, Entamoeba invadens
SLCGLMLFHILIQTESGKI

SEQ ID NO: 3017442 - protein, 17 aa, Entamoeba invadens
SLCKYCEFIFSTVTDEI

SEQ ID NO: 3017443 - protein, 18 aa, Entamoeba invadens
SLCMNSLTTLPDFVNKSL

SEQ ID NO: 3017444 - protein, 24 aa, Entamoeba invadens
SLCSKLFCKKAQLGKKIFEMEREW

SEQ ID NO: 3017445 - protein, 20 aa, Entamoeba invadens
SLCVVPLLETVIFPTFDEMD

SEQ ID NO: 3017446 - protein, 19 aa, Entamoeba invadens
SLCYQLASALMTGITVVIS

SEQ ID NO: 3017447 - protein, 25 aa, Entamoeba invadens
SLDDEVLTMYLVFCISKDEKLQEVD

SEQ ID NO: 3017448 - protein, 18 aa, Entamoeba invadens
SLDEYIHLKCEEKEMELI

SEQ ID NO: 3017449 - protein, 22 aa, Entamoeba invadens
SLDEYMCYFMQLDQVKLDDTEE

SEQ ID NO: 3017450 - protein, 22 aa, Entamoeba invadens
SLDFAPRLLLTISTLVTKFPSL

SEQ ID NO: 3017451 - protein, 27 aa, Entamoeba invadens
SLDGIDARMYLLFKEEFSTYSYYYNTS

SEQ ID NO: 3017452 - protein, 22 aa, Entamoeba invadens
SLDHSFIVWMRGKEQVFVEEEE

SEQ ID NO: 3017453 - protein, 29 aa, Entamoeba invadens
SLDPALLRPGRLDRKIEFPLPDRRQKRLI

SEQ ID NO: 3017454 - protein, 19 aa, Entamoeba invadens
SLDTIRLPVNLKSIGHEAF

SEQ ID NO: 3017455 - protein, 17 aa, Entamoeba invadens
SLDTWKKEFLNGANVTN

SEQ ID NO: 3017456 - protein, 23 aa, Entamoeba invadens
SLDVAMQLYYPTSVTLSAFTTEK

SEQ ID NO: 3017457 - protein, 23 aa, Entamoeba invadens
SLDVLQFFFQSLNVQLNTTTSSA

SEQ ID NO: 3017458 - protein, 30 aa, Entamoeba invadens
SLDYIIKLVSFFHPVVRPKWCLYTSQRILE

SEQ ID NO: 3017459 - protein, 25 aa, Entamoeba invadens
SLDYQVFMDLLEYFDTRQQQTGDLC

SEQ ID NO: 3017460 - protein, 29 aa, Entamoeba invadens
SLECVHWLEEYLQLPLKIISYKTEYGMTM

SEQ ID NO: 3017461 - protein, 27 aa, Entamoeba invadens
SLEDFEQYFRDVVTFFLRAKANFKSGT

SEQ ID NO: 3017462 - protein, 20 aa, Entamoeba invadens
SLEEIIAKKYKKLGTIGTFE

SEQ ID NO: 3017463 - protein, 20 aa, Entamoeba invadens
SLEFYFDFLVKTDDIRQLFQ

SEQ ID NO: 3017464 - protein, 18 aa, Entamoeba invadens
SLELPSRLISLGAEAFMG

SEQ ID NO: 3017465 - protein, 18 aa, Entamoeba invadens
SLEMFCFYNCMSLESVTL

SEQ ID NO: 3017466 - protein, 34 aa, Entamoeba invadens
SLEPSLLCVKLFAESLFSPLKHFPTSIPQAEMAD

SEQ ID NO: 3017467 - protein, 24 aa, Entamoeba invadens
SLEQCVYWIATVSSVIEHIRKFKG

SEQ ID NO: 3017468 - protein, 30 aa, Entamoeba invadens
SLEQIKQRLLIEKVFFYPYSRDEAVTARIN

SEQ ID NO: 3017469 - protein, 24 aa, Entamoeba invadens
SLEQLGFNQIVLNSLTSLFIPSTV

SEQ ID NO: 3017470 - protein, 31 aa, Entamoeba invadens
SLERLIIRNCKLLTKIILGPNIKTVHLQNLP

SEQ ID NO: 3017471 - protein, 31 aa, Entamoeba invadens
SLERLRKDILLVRPTFFGATPSFWNSLYSEF

SEQ ID NO: 3017472 - protein, 18 aa, Entamoeba invadens
SLERPFVPPLDLNKLNII

SEQ ID NO: 3017473 - protein, 24 aa, Entamoeba invadens
SLESHPHSLPFRKSKLRGKKTEDS

SEQ ID NO: 3017474 - protein, 27 aa, Entamoeba invadens
SLETTKFYTGDWDLLPTSDYDFVIGAD

SEQ ID NO: 3017475 - protein, 20 aa, Entamoeba invadens
SLEVFLPALNKQANCLLEQL

SEQ ID NO: 3017476 - protein, 21 aa, Entamoeba invadens
SLEVFYTLCLVEYLVVNVNHF

SEQ ID NO: 3017477 - protein, 27 aa, Entamoeba invadens
SLFECAIWKDPYLDKQFKFAWDIVDCV

SEQ ID NO: 3017478 - protein, 18 aa, Entamoeba invadens
SLFKNLQTQFLYKKKTKA

SEQ ID NO: 3017479 - protein, 18 aa, Entamoeba invadens
SLFLIGDLTNDGLTKLIL

SEQ ID NO: 3017480 - protein, 17 aa, Entamoeba invadens
SLFLQNEKVKFEKIDFS

SEQ ID NO: 3017481 - protein, 26 aa, Entamoeba invadens
SLFQTTVVPMGKVVFGLKGVKTGIKE

SEQ ID NO: 3017482 - protein, 28 aa, Entamoeba invadens
SLFQVISYLYFAPFRQQNLRIISKLDQS

SEQ ID NO: 3017483 - protein, 18 aa, Entamoeba invadens
SLFRMNVLCPYKPLEVYF

SEQ ID NO: 3017484 - protein, 18 aa, Entamoeba invadens
SLFSAYAALYKQPSCIED

SEQ ID NO: 3017485 - protein, 19 aa, Entamoeba invadens
SLFTCDYVYVITSLVIRGT

SEQ ID NO: 3017486 - protein, 17 aa, Entamoeba invadens
SLGADPPPPLAGGEPHP

SEQ ID NO: 3017487 - protein, 30 aa, Entamoeba invadens
SLGAPAAAICRVHFPFYDHKIDSSRWGQTD

SEQ ID NO: 3017488 - protein, 21 aa, Entamoeba invadens
SLGCMIYEMLVGIPPFNDKTV

SEQ ID NO: 3017489 - protein, 21 aa, Entamoeba invadens
SLGCMVFEMIVGVPPFSCHDP

SEQ ID NO: 3017490 - protein, 21 aa, Entamoeba invadens
SLGCMVYEFVVGIPPFHDETP

SEQ ID NO: 3017491 - protein, 24 aa, Entamoeba invadens
SLGGYFLQFPPDVIFPIISDALTN

SEQ ID NO: 3017492 - protein, 19 aa, Entamoeba invadens
SLGHSFFTDTPFTSTISSN

SEQ ID NO: 3017493 - protein, 22 aa, Entamoeba invadens
SLGITFFEAFTWKDAFENVKYF

SEQ ID NO: 3017494 - protein, 30 aa, Entamoeba invadens
SLGITMWELFYMKFPFFEHPEIVTTYQLLP

SEQ ID NO: 3017495 - protein, 19 aa, Entamoeba invadens
SLGLNTIRVICERCPLVMN

SEQ ID NO: 3017496 - protein, 17 aa, Entamoeba invadens
SLGLTLVKRFAFDILRS

SEQ ID NO: 3017497 - protein, 26 aa, Entamoeba invadens
SLGMMKKLEFLKLRQFPVLEMSEFMQ

SEQ ID NO: 3017498 - protein, 19 aa, Entamoeba invadens
SLGMTMYHLFSCKKPYEEM

SEQ ID NO: 3017499 - protein, 23 aa, Entamoeba invadens
SLGNFFLCHGGISPNLVVLDDLN

SEQ ID NO: 3017500 - protein, 31 aa, Entamoeba invadens
SLGNSCFSKCYSLEFVVLPSLLLEIGNYCFE

SEQ ID NO: 3017501 - protein, 23 aa, Entamoeba invadens
SLGQSSMHWAAHSGYPNTIQTLY

SEQ ID NO: 3017502 - protein, 25 aa, Entamoeba invadens
SLGSLEALLRFLKESKIPVAGIGLG

SEQ ID NO: 3017503 - protein, 24 aa, Entamoeba invadens
SLGTTIIGVIYDGGVILGADSRTS

SEQ ID NO: 3017504 - protein, 22 aa, Entamoeba invadens
SLGVAFEFFDLKYSDLPKVLQD

SEQ ID NO: 3017505 - protein, 17 aa, Entamoeba invadens
SLGVILYQMATLDFPFT

SEQ ID NO: 3017506 - protein, 23 aa, Entamoeba invadens
SLGWIHYDWFKPEPNVLLFRRPR

SEQ ID NO: 3017507 - protein, 28 aa, Entamoeba invadens
SLHKVVPEYFWKCVLRISPLLRNQDKHE

SEQ ID NO: 3017508 - protein, 31 aa, Entamoeba invadens
SLHMYTDFIFLVMELITDGCLFDYVYRHVLE

SEQ ID NO: 3017509 - protein, 19 aa, Entamoeba invadens
SLHTPGMKIHPLSLSLKRC

SEQ ID NO: 3017510 - protein, 26 aa, Entamoeba invadens
SLHVLKKMLLTFMISSTFIDLNYSES

SEQ ID NO: 3017511 - protein, 20 aa, Entamoeba invadens
SLIAVLRKYKTFGLKHKGCL

SEQ ID NO: 3017512 - protein, 25 aa, Entamoeba invadens
SLIDKTLIALTFFINKESGIELLVQ

SEQ ID NO: 3017513 - protein, 25 aa, Entamoeba invadens
SLIEFEWIMLGHRFQFRLRNNLKEN

SEQ ID NO: 3017514 - protein, 20 aa, Entamoeba invadens
SLIELPFLSEVGLKVLVFVV

SEQ ID NO: 3017515 - protein, 26 aa, Entamoeba invadens
SLIFPKNNFRLFFSEKRLPQFSMVKT

SEQ ID NO: 3017516 - protein, 28 aa, Entamoeba invadens
SLIGDSPVYVLFEGKLKRIGKDHNPEDP

SEQ ID NO: 3017517 - protein, 31 aa, Entamoeba invadens
SLIHAERKWLKEIKASLTDPLVIFVMTKQDL

SEQ ID NO: 3017518 - protein, 20 aa, Entamoeba invadens
SLIIEWLKDGKSYKSIENQL

SEQ ID NO: 3017519 - protein, 26 aa, Entamoeba invadens
SLIIPTTLRCIGTYCFNYFTALKRIE

SEQ ID NO: 3017520 - protein, 28 aa, Entamoeba invadens
SLIKRCFQILYLNHCFAGKMYKTAIVTD

SEQ ID NO: 3017521 - protein, 21 aa, Entamoeba invadens
SLINVIPTLVTILHKNFKGTF

SEQ ID NO: 3017522 - protein, 19 aa, Entamoeba invadens
SLINYCMFNYYAGVTMLIK

SEQ ID NO: 3017523 - protein, 21 aa, Entamoeba invadens
SLIQYEPFFVEFAIYEVIDQT

SEQ ID NO: 3017524 - protein, 24 aa, Entamoeba invadens
SLISGTFPLTIKTLSRDKSIDYEF

SEQ ID NO: 3017525 - protein, 17 aa, Entamoeba invadens
SLKCSFIIRYSVKIDLT

SEQ ID NO: 3017526 - protein, 24 aa, Entamoeba invadens
SLKCYNFCFKLCQLFCSYGRQIEI

SEQ ID NO: 3017527 - protein, 17 aa, Entamoeba invadens
SLKDEKLLFMAFEWMKQ

SEQ ID NO: 3017528 - protein, 24 aa, Entamoeba invadens
SLKDLLKRMLVYDPAQRLKWSEFF

SEQ ID NO: 3017529 - protein, 21 aa, Entamoeba invadens
SLKDNFKFLTKFVVYFIDEVE

SEQ ID NO: 3017530 - protein, 26 aa, Entamoeba invadens
SLKEPVPFLLLMTRHDIYPFTTLENF

SEQ ID NO: 3017531 - protein, 22 aa, Entamoeba invadens
SLKEVFVPSLVIPNANFFRNYL

SEQ ID NO: 3017532 - protein, 17 aa, Entamoeba invadens
SLKIFQEILYSEVVGEK

SEQ ID NO: 3017533 - protein, 34 aa, Entamoeba invadens
SLKITPKFINIPSYRWFFTHFTPDTLDCHCVDAS

SEQ ID NO: 3017534 - protein, 20 aa, Entamoeba invadens
SLKIVTIPPSMKSFGKCCFH

SEQ ID NO: 3017535 - protein, 25 aa, Entamoeba invadens
SLKKHGIIIYCEPEDFITPKPDTKS

SEQ ID NO: 3017536 - protein, 23 aa, Entamoeba invadens
SLKKMNLFIPLQRLVDIQDFDFK

SEQ ID NO: 3017537 - protein, 26 aa, Entamoeba invadens
SLKLIKSLYLMYKYDDKNPQIDVFKQ

SEQ ID NO: 3017538 - protein, 19 aa, Entamoeba invadens
SLKLKKFFDIKSLQKVTAL

SEQ ID NO: 3017539 - protein, 21 aa, Entamoeba invadens
SLKLLPKYVFLNGVYIDYSTN

SEQ ID NO: 3017540 - protein, 20 aa, Entamoeba invadens
SLKRLNCPLVYLSTITFNNQ

SEQ ID NO: 3017541 - protein, 41 aa, Entamoeba invadens
SLKYKTFEWLFWDVSGAPKFRGLWKSYYPNVKAIAYVFDAC

SEQ ID NO: 3017542 - protein, 21 aa, Entamoeba invadens
SLKYVGMNLYALTDVLLTTEC

SEQ ID NO: 3017543 - protein, 17 aa, Entamoeba invadens
SLLCCIKEIPFLCRCSK

SEQ ID NO: 3017544 - protein, 18 aa, Entamoeba invadens
SLLFARNVQEILEEFRAI

SEQ ID NO: 3017545 - protein, 20 aa, Entamoeba invadens
SLLFELKGIKIPPSSISISF

SEQ ID NO: 3017546 - protein, 21 aa, Entamoeba invadens
SLLGFQKIIAVFPALKSLDFR

SEQ ID NO: 3017547 - protein, 31 aa, Entamoeba invadens
SLLGYSKFFEDFVFLSFKKFAVVISKDLPNS

SEQ ID NO: 3017548 - protein, 27 aa, Entamoeba invadens
SLLHQQPLKYPTPLKRKPLTPSHDGKK

SEQ ID NO: 3017549 - protein, 20 aa, Entamoeba invadens
SLLIVSTYFKTPSDYLNVIQ

SEQ ID NO: 3017550 - protein, 17 aa, Entamoeba invadens
SLLLCDVGGQYPDGATT

SEQ ID NO: 3017551 - protein, 17 aa, Entamoeba invadens
SLLLKRTRPITIICPHT

SEQ ID NO: 3017552 - protein, 18 aa, Entamoeba invadens
SLLLRDRLIALIRSLLKV

SEQ ID NO: 3017553 - protein, 21 aa, Entamoeba invadens
SLLMDFINIFNSFIINTKTDF

SEQ ID NO: 3017554 - protein, 18 aa, Entamoeba invadens
SLLNFYYNTMQTPQLFSI

SEQ ID NO: 3017555 - protein, 26 aa, Entamoeba invadens
SLLQSKMRAFLKRLVLKREMYFVLKL

SEQ ID NO: 3017556 - protein, 31 aa, Entamoeba invadens
SLLTKTRRNGLVYYFSLLLGTSYTQQTLEKY

SEQ ID NO: 3017557 - protein, 24 aa, Entamoeba invadens
SLLTVTPIPLPPKQVLKFFPNVTV

SEQ ID NO: 3017558 - protein, 20 aa, Entamoeba invadens
SLLVLNRVIMGLSKGDKYIP

SEQ ID NO: 3017559 - protein, 20 aa, Entamoeba invadens
SLMDRLLKKDLMDLKLTPYH

SEQ ID NO: 3017560 - protein, 19 aa, Entamoeba invadens
SLMELIIGFYDKFALMEKD

SEQ ID NO: 3017561 - protein, 20 aa, Entamoeba invadens
SLMIISKYFKNIGDFIRLIQ

SEQ ID NO: 3017562 - protein, 20 aa, Entamoeba invadens
SLMIVSKYFKNIGDFIRLIQ

SEQ ID NO: 3017563 - protein, 21 aa, Entamoeba invadens
SLMIVSKYFKTMNDFINMVHV

SEQ ID NO: 3017564 - protein, 21 aa, Entamoeba invadens
SLMIVSKYFRTIYDFINAEFV

SEQ ID NO: 3017565 - protein, 26 aa, Entamoeba invadens
SLMKHPWVHPESRNLATLRGAALHPT

SEQ ID NO: 3017566 - protein, 24 aa, Entamoeba invadens
SLMLNRWLFSKKHCPLYMEANANA

SEQ ID NO: 3017567 - protein, 23 aa, Entamoeba invadens
SLMNIMIELKKLCNHPLLINQSI

SEQ ID NO: 3017568 - protein, 19 aa, Entamoeba invadens
SLMSFLTGKPREKVVEKST

SEQ ID NO: 3017569 - protein, 34 aa, Entamoeba invadens
SLMSPMDAFLCVRGMKTLPLRMKVHHENGLKVAQ

SEQ ID NO: 3017570 - protein, 29 aa, Entamoeba invadens
SLMSPMDAFLCVRGMKTLPLRMQVHHENG

SEQ ID NO: 3017571 - protein, 26 aa, Entamoeba invadens
SLNATKFIMLKYRHWQLAHRRVISFV

SEQ ID NO: 3017572 - protein, 25 aa, Entamoeba invadens
SLNERLVVQETLIKKLVDGCKESDK

SEQ ID NO: 3017573 - protein, 17 aa, Entamoeba invadens
SLNIPYLSMHYLQNLEL

SEQ ID NO: 3017574 - protein, 30 aa, Entamoeba invadens
SLNITNTLYLFRWVTLLFSQEFTIENVLLI

SEQ ID NO: 3017575 - protein, 25 aa, Entamoeba invadens
SLNKIEYLFQLQFLRVVHCPNLMDF

SEQ ID NO: 3017576 - protein, 25 aa, Entamoeba invadens
SLNLKTVWLIGPFYSNYFNTLLFDE

SEQ ID NO: 3017577 - protein, 32 aa, Entamoeba invadens
SLNQTVFYFENPLLRIVFYEQCILLCKTLNCL

SEQ ID NO: 3017578 - protein, 33 aa, Entamoeba invadens
SLNSHTILLNHIISYFFHIQTTPQAMSYLTVHE

SEQ ID NO: 3017579 - protein, 25 aa, Entamoeba invadens
SLNSLVVFQMKPFGNFLRVKAFNNA

SEQ ID NO: 3017580 - protein, 24 aa, Entamoeba invadens
SLNTDILFGVLKRVLRERSDIRLV

SEQ ID NO: 3017581 - protein, 18 aa, Entamoeba invadens
SLNVLYEMLFNFKESKKI

SEQ ID NO: 3017582 - protein, 19 aa, Entamoeba invadens
SLPDTFALLSSLTFLQISN

SEQ ID NO: 3017583 - protein, 25 aa, Entamoeba invadens
SLPEENQNVLWYIFSFLDEVVQKKH

SEQ ID NO: 3017584 - protein, 26 aa, Entamoeba invadens
SLPKSLSYLPFCCFFKCVHLQMVKFP

SEQ ID NO: 3017585 - protein, 18 aa, Entamoeba invadens
SLPNSFLFQSIAVTEINL

SEQ ID NO: 3017586 - protein, 18 aa, Entamoeba invadens
SLPQFTPVVVGQNLVLFL

SEQ ID NO: 3017587 - protein, 17 aa, Entamoeba invadens
SLPSFPLKVPPHTLPIT

SEQ ID NO: 3017588 - protein, 22 aa, Entamoeba invadens
SLPSNQKFLPLKKIQTITFSFG

SEQ ID NO: 3017589 - protein, 17 aa, Entamoeba invadens
SLQFLKMASVYIGNYET

SEQ ID NO: 3017590 - protein, 17 aa, Entamoeba invadens
SLQFWIIMESCTQRDLS

SEQ ID NO: 3017591 - protein, 22 aa, Entamoeba invadens
SLQIVAKYFLLVEDYINVIQVN

SEQ ID NO: 3017592 - protein, 22 aa, Entamoeba invadens
SLQKVILPKYITSLKSHTFISC

SEQ ID NO: 3017593 - protein, 17 aa, Entamoeba invadens
SLQNWAGELKRYGPDKG

SEQ ID NO: 3017594 - protein, 22 aa, Entamoeba invadens
SLQQITFIGREAFLKCQMLSVI

SEQ ID NO: 3017595 - protein, 24 aa, Entamoeba invadens
SLQRKSIIPFIRPKKATFEELSEI

SEQ ID NO: 3017596 - protein, 23 aa, Entamoeba invadens
SLQSGLEFLQKWSNKKSGEIIFD

SEQ ID NO: 3017597 - protein, 22 aa, Entamoeba invadens
SLQSILIPPLVKKIGRNCFCGC

SEQ ID NO: 3017598 - protein, 24 aa, Entamoeba invadens
SLQTIIIPYKVIEIPLRCFYECNS

SEQ ID NO: 3017599 - protein, 28 aa, Entamoeba invadens
SLRAELGIPIIPIIHRKFQDGESYYRIN

SEQ ID NO: 3017600 - protein, 25 aa, Entamoeba invadens
SLRGYPFVYTYSIIHYTTLFPPQTE

SEQ ID NO: 3017601 - protein, 20 aa, Entamoeba invadens
SLRKKHNTNFWIYHGFHGSE

SEQ ID NO: 3017602 - protein, 32 aa, Entamoeba invadens
SLRKLHLDYLDLYLIHLPISIKLGATFPLKKD

SEQ ID NO: 3017603 - protein, 18 aa, Entamoeba invadens
SLRKLQLDYLDLYLIHWP

SEQ ID NO: 3017604 - protein, 21 aa, Entamoeba invadens
SLRLRALRIVLQSLNLYNSYD

SEQ ID NO: 3017605 - protein, 21 aa, Entamoeba invadens
SLRNVIIPPSVISIGEACFCR

SEQ ID NO: 3017606 - protein, 17 aa, Entamoeba invadens
SLRSVIIPPSVTFISEM

SEQ ID NO: 3017607 - protein, 32 aa, Entamoeba invadens
SLRVYAKYILKCPYFLDVFPVFSQSQKLTDSL

SEQ ID NO: 3017608 - protein, 17 aa, Entamoeba invadens
SLSALHKLDNSDVLLIC

SEQ ID NO: 3017609 - protein, 23 aa, Entamoeba invadens
SLSDDLFHCKPTYLAVVPRVLQR

SEQ ID NO: 3017610 - protein, 18 aa, Entamoeba invadens
SLSDKLAAFELSLKDFDM

SEQ ID NO: 3017611 - protein, 23 aa, Entamoeba invadens
SLSFALFIITKLSKNKLFTALFI

SEQ ID NO: 3017612 - protein, 32 aa, Entamoeba invadens
SLSFLRDVIHAPLFRQFRDLLGYPSQPYQSVY

SEQ ID NO: 3017613 - protein, 30 aa, Entamoeba invadens
SLSFSCNDLLFIPQWHLTHMTSLTFLDISE

SEQ ID NO: 3017614 - protein, 18 aa, Entamoeba invadens
SLSIFKSKYFQDLKKMAQ

SEQ ID NO: 3017615 - protein, 23 aa, Entamoeba invadens
SLSKAEFFLTIPLQLEVQNSHDV

SEQ ID NO: 3017616 - protein, 32 aa, Entamoeba invadens
SLSKNLVSILKYILLYLLNQLTIEDIGNKAKT

SEQ ID NO: 3017617 - protein, 18 aa, Entamoeba invadens
SLSLAYRAAIKKVNLEGR

SEQ ID NO: 3017618 - protein, 25 aa, Entamoeba invadens
SLSLKKLFIRLSMKTSADLIKLNNL

SEQ ID NO: 3017619 - protein, 26 aa, Entamoeba invadens
SLSNVRTFIHLFKQLNGYACAYYSYK

SEQ ID NO: 3017620 - protein, 24 aa, Entamoeba invadens
SLSPLIHSIGYFGYPLSVAVEKSG

SEQ ID NO: 3017621 - protein, 25 aa, Entamoeba invadens
SLSQFNKLLRFVRNDEFLQITKFQG

SEQ ID NO: 3017622 - protein, 24 aa, Entamoeba invadens
SLSQIYIPPTMLSIGWNCFYYCTS

SEQ ID NO: 3017623 - protein, 24 aa, Entamoeba invadens
SLSSITIPLSVTYIGYYCFSSNTI

SEQ ID NO: 3017624 - protein, 17 aa, Entamoeba invadens
SLSSVFYNRGYYGTVSH

SEQ ID NO: 3017625 - protein, 25 aa, Entamoeba invadens
SLSTLKLPVKLLIIPQMCFGECQKL

SEQ ID NO: 3017626 - protein, 27 aa, Entamoeba invadens
SLSVRFGLPFVFVATRKDLVKPQVANA

SEQ ID NO: 3017627 - protein, 33 aa, Entamoeba invadens
SLTDKTALPKSLPFLPLVLDIPPELATLPQDVY

SEQ ID NO: 3017628 - protein, 25 aa, Entamoeba invadens
SLTDSFEYDLLERTFRVFGNGSIYK

SEQ ID NO: 3017629 - protein, 22 aa, Entamoeba invadens
SLTDVLHLFRLLVHLENYKALL

SEQ ID NO: 3017630 - protein, 33 aa, Entamoeba invadens
SLTELLPENFTMFKQLVRLLSKITAYEDINLMN

SEQ ID NO: 3017631 - protein, 18 aa, Entamoeba invadens
SLTFIFSCIKNEVSKKWP

SEQ ID NO: 3017632 - protein, 25 aa, Entamoeba invadens
SLTIINNFFTYCLKLHDIIIPSSVV

SEQ ID NO: 3017633 - protein, 24 aa, Entamoeba invadens
SLTKVPYCMKLIMTELLSTEEKKW

SEQ ID NO: 3017634 - protein, 21 aa, Entamoeba invadens
SLTLDTLFMKSFKVYIEYLTH

SEQ ID NO: 3017635 - protein, 22 aa, Entamoeba invadens
SLTLITLPCSLKTLGKYCFKNC

SEQ ID NO: 3017636 - protein, 35 aa, Entamoeba invadens
SLTNNIVILDSKLDFVTTLLNQMASKFSDLLIQNV

SEQ ID NO: 3017637 - protein, 25 aa, Entamoeba invadens
SLTNTSPLLLIEYPDVMINTTGVVN

SEQ ID NO: 3017638 - protein, 22 aa, Entamoeba invadens
SLTPTWRIRFCRRCWTPHVFSK

SEQ ID NO: 3017639 - protein, 19 aa, Entamoeba invadens
SLTQIPKAAFSKCFSLSQI

SEQ ID NO: 3017640 - protein, 28 aa, Entamoeba invadens
SLTQKTLHLFVRLQTLYLYTKLDDFLQG

SEQ ID NO: 3017641 - protein, 23 aa, Entamoeba invadens
SLTRLRCFIGYFHVIHNNMKNQH

SEQ ID NO: 3017642 - protein, 32 aa, Entamoeba invadens
SLTSALKYTPPHQLALRSFLITGASGSGKSVL

SEQ ID NO: 3017643 - protein, 19 aa, Entamoeba invadens
SLTSIKILKGVTSLGKCCF

SEQ ID NO: 3017644 - protein, 20 aa, Entamoeba invadens
SLTSKRIITFNTIYIQFDWL

SEQ ID NO: 3017645 - protein, 27 aa, Entamoeba invadens
SLTSSYPTHIFPSAFGPFKAVITIPAN

SEQ ID NO: 3017646 - protein, 21 aa, Entamoeba invadens
SLTSVILPPNLEKISKWAFKN

SEQ ID NO: 3017647 - protein, 27 aa, Entamoeba invadens
SLTYCTGIPILFVGTGQHYTDLKLLNV

SEQ ID NO: 3017648 - protein, 19 aa, Entamoeba invadens
SLVELLDSIKLVLGNPKGP

SEQ ID NO: 3017649 - protein, 17 aa, Entamoeba invadens
SLVEYFESLFPPNEKQL

SEQ ID NO: 3017650 - protein, 24 aa, Entamoeba invadens
SLVGGFVFLRLFCPAMAAPEGMNL

SEQ ID NO: 3017651 - protein, 18 aa, Entamoeba invadens
SLVIVDNMRFLPIDILKE

SEQ ID NO: 3017652 - protein, 34 aa, Entamoeba invadens
SLVKETFYNYLIKISPQLITDLFIENFHTAETLD

SEQ ID NO: 3017653 - protein, 21 aa, Entamoeba invadens
SLVPCLFPMKPALGPNTLERT

SEQ ID NO: 3017654 - protein, 19 aa, Entamoeba invadens
SLVQPYLTKFLSSPDLSTK

SEQ ID NO: 3017655 - protein, 25 aa, Entamoeba invadens
SLVQQLYMNPYFRNKLLNVKGNENS

SEQ ID NO: 3017656 - protein, 22 aa, Entamoeba invadens
SLVRNFMGLPFLDEVVPFDDRF

SEQ ID NO: 3017657 - protein, 20 aa, Entamoeba invadens
SLVRVTTIQELIYKSGQCGV

SEQ ID NO: 3017658 - protein, 19 aa, Entamoeba invadens
SLVSITLPQTLKIIGKHAF

SEQ ID NO: 3017659 - protein, 24 aa, Entamoeba invadens
SLWTNYMNFEIIYNSLISGLDPKI

SEQ ID NO: 3017660 - protein, 20 aa, Entamoeba invadens
SLYDIPLPYCVVNCLSMQVA

SEQ ID NO: 3017661 - protein, 22 aa, Entamoeba invadens
SLYIFGVEFFVVDSSLNTISKT

SEQ ID NO: 3017662 - protein, 24 aa, Entamoeba invadens
SLYKDVPPFTLPIISNKTLKHLVV

SEQ ID NO: 3017663 - protein, 20 aa, Entamoeba invadens
SLYMPAMMCSGIVCYDNLPE

SEQ ID NO: 3017664 - protein, 21 aa, Entamoeba invadens
SLYPIAMHILKLATGKPILIP

SEQ ID NO: 3017665 - protein, 20 aa, Entamoeba invadens
SLYPSAINRLKLATGSPIVI

SEQ ID NO: 3017666 - protein, 19 aa, Entamoeba invadens
SLYQANKFCKMLNECGYVE

SEQ ID NO: 3017667 - protein, 29 aa, Entamoeba invadens
SLYQQTCDILLFSVLILLATNGHPTPIAE

SEQ ID NO: 3017668 - protein, 18 aa, Entamoeba invadens
SMACRYCFMPIGGNEPCS

SEQ ID NO: 3017669 - protein, 25 aa, Entamoeba invadens
SMAESEIVLVLLIVAIDAVMKQNFS

SEQ ID NO: 3017670 - protein, 17 aa, Entamoeba invadens
SMATYRLAVLILTSMKQ

SEQ ID NO: 3017671 - protein, 23 aa, Entamoeba invadens
SMCTSCINGYYINNGVCEECSTI

SEQ ID NO: 3017672 - protein, 18 aa, Entamoeba invadens
SMDALSFSVLLEVAAENS

SEQ ID NO: 3017673 - protein, 17 aa, Entamoeba invadens
SMDSAVFVIFSIVECSE

SEQ ID NO: 3017674 - protein, 23 aa, Entamoeba invadens
SMDSTMLTFYRNTRFPLFTFEKQ

SEQ ID NO: 3017675 - protein, 24 aa, Entamoeba invadens
SMEDLIVNGFLSDWRFKKVLNETL

SEQ ID NO: 3017676 - protein, 23 aa, Entamoeba invadens
SMEHQMLILSNKVRFIKMVIEGK

SEQ ID NO: 3017677 - protein, 25 aa, Entamoeba invadens
SMERHKIFKIIFSSSATVYGDPETV

SEQ ID NO: 3017678 - protein, 19 aa, Entamoeba invadens
SMERHKIFKIIFSSSSTVY

SEQ ID NO: 3017679 - protein, 38 aa, Entamoeba invadens
SMERVTLFLNLANHPTIERIITPRLALTTAEYFAYTCD

SEQ ID NO: 3017680 - protein, 22 aa, Entamoeba invadens
SMFHYNPIPLTTISKKLFSKME

SEQ ID NO: 3017681 - protein, 35 aa, Entamoeba invadens
SMFKEQHKALYTSIFLFLLKAFPKIETLQCVDYML

SEQ ID NO: 3017682 - protein, 17 aa, Entamoeba invadens
SMFKEQRKALYTSIFLF

SEQ ID NO: 3017683 - protein, 19 aa, Entamoeba invadens
SMFKIEGFGWFDENHKRGD

SEQ ID NO: 3017684 - protein, 18 aa, Entamoeba invadens
SMFLMKHCPMKVGERSRR

SEQ ID NO: 3017685 - protein, 23 aa, Entamoeba invadens
SMGFQIINYAVSGLKFKHLDCNQ

SEQ ID NO: 3017686 - protein, 17 aa, Entamoeba invadens
SMGIIHRDIKPDNILID

SEQ ID NO: 3017687 - protein, 21 aa, Entamoeba invadens
SMGLSKCEYAFIPESQQTERS

SEQ ID NO: 3017688 - protein, 18 aa, Entamoeba invadens
SMGSFRVFDNRQIAPLFG

SEQ ID NO: 3017689 - protein, 19 aa, Entamoeba invadens
SMIHNEDAFLLCYTDLLKE

SEQ ID NO: 3017690 - protein, 23 aa, Entamoeba invadens
SMIREYYNFPDKLFNPFGERSLN

SEQ ID NO: 3017691 - protein, 19 aa, Entamoeba invadens
SMITGGNFIPLASADSLGD

SEQ ID NO: 3017692 - protein, 24 aa, Entamoeba invadens
SMKCSNLFYGCYSCDYKQLNLTID

SEQ ID NO: 3017693 - protein, 26 aa, Entamoeba invadens
SMKDACFFSCYYLESIHLPKTLTFIG

SEQ ID NO: 3017694 - protein, 20 aa, Entamoeba invadens
SMKEKILIKRLKKFETIKNE

SEQ ID NO: 3017695 - protein, 31 aa, Entamoeba invadens
SMLEALAEWMSYPLNFAHYGGAAPARSGLTH

SEQ ID NO: 3017696 - protein, 21 aa, Entamoeba invadens
SMLIVSKYFSYIFDYINMVFV

SEQ ID NO: 3017697 - protein, 17 aa, Entamoeba invadens
SMLKFYLKGILYEEVIF

SEQ ID NO: 3017698 - protein, 20 aa, Entamoeba invadens
SMLLTDSFLPSLFPQYRQKV

SEQ ID NO: 3017699 - protein, 20 aa, Entamoeba invadens
SMLMLLNTFSTVRRINALQQ

SEQ ID NO: 3017700 - protein, 17 aa, Entamoeba invadens
SMLPEQLINVELMFLSK

SEQ ID NO: 3017701 - protein, 28 aa, Entamoeba invadens
SMLRDDHILACDTLVYVFSLTDHASFIK

SEQ ID NO: 3017702 - protein, 21 aa, Entamoeba invadens
SMMIISKYFISINDYYNLINV

SEQ ID NO: 3017703 - protein, 19 aa, Entamoeba invadens
SMMIISKYFTDMSDYKNMV

SEQ ID NO: 3017704 - protein, 20 aa, Entamoeba invadens
SMMIVSKYFDSINDFLTLIK

SEQ ID NO: 3017705 - protein, 25 aa, Entamoeba invadens
SMMIVSKYFICISNFKNMVLICKKF

SEQ ID NO: 3017706 - protein, 23 aa, Entamoeba invadens
SMMIVSKYFMYLNDFKKLVLVCK

SEQ ID NO: 3017707 - protein, 19 aa, Entamoeba invadens
SMMIVSKYFNYISDYINMV

SEQ ID NO: 3017708 - protein, 22 aa, Entamoeba invadens
SMMIVSKYFRSIIDYKNMMFIC

SEQ ID NO: 3017709 - protein, 19 aa, Entamoeba invadens
SMMIVSKYFSNISDYINMV

SEQ ID NO: 3017710 - protein, 18 aa, Entamoeba invadens
SMMIVSKYFSSIIDYKNM

SEQ ID NO: 3017711 - protein, 20 aa, Entamoeba invadens
SMMIVSKYFTTLKDFIIIER

SEQ ID NO: 3017712 - protein, 21 aa, Entamoeba invadens
SMMVLDPYYRTIEGLLVLIEK

SEQ ID NO: 3017713 - protein, 25 aa, Entamoeba invadens
SMNLEYHAWLMVFLKHDSSVDEYAI

SEQ ID NO: 3017714 - protein, 18 aa, Entamoeba invadens
SMNNLYWEKSKEYDYKSN

SEQ ID NO: 3017715 - protein, 22 aa, Entamoeba invadens
SMNWLGDWGSQFGLLAIGFEKY

SEQ ID NO: 3017716 - protein, 19 aa, Entamoeba invadens
SMPWITRFCSMPGHEYFVE

SEQ ID NO: 3017717 - protein, 22 aa, Entamoeba invadens
SMQIILFYFNEPADFLSLIQVC

SEQ ID NO: 3017718 - protein, 22 aa, Entamoeba invadens
SMQTKFYEPNGLSKSKNQLSAL

SEQ ID NO: 3017719 - protein, 18 aa, Entamoeba invadens
SMRTILFSNYLPAQTQQL

SEQ ID NO: 3017720 - protein, 29 aa, Entamoeba invadens
SMSCEVVTTLFFMKLIDPNKVYLLRGNHE

SEQ ID NO: 3017721 - protein, 18 aa, Entamoeba invadens
SMSVLTDLLPKAVDMSIK

SEQ ID NO: 3017722 - protein, 24 aa, Entamoeba invadens
SMVESLLFCDSLKSAILEVDTYIE

SEQ ID NO: 3017723 - protein, 20 aa, Entamoeba invadens
SMVFILKNGILSRVGKDHKP

SEQ ID NO: 3017724 - protein, 18 aa, Entamoeba invadens
SMVSLNQIPVILVIGQSG

SEQ ID NO: 3017725 - protein, 35 aa, Entamoeba invadens
SMYYTPNSVVWEIVNKLKLLAFYKQSEIEKRFYEI

SEQ ID NO: 3017726 - protein, 27 aa, Entamoeba invadens
SNADTLHFGIFLIVVNYLLYEKDKSDE

SEQ ID NO: 3017727 - protein, 25 aa, Entamoeba invadens
SNAPAVIRVLIVNKMKAYCTGFIPI

SEQ ID NO: 3017728 - protein, 31 aa, Entamoeba invadens
SNAPAVLHYILDLPILALLQTLCYPGSADNE

SEQ ID NO: 3017729 - protein, 23 aa, Entamoeba invadens
SNCINRILRTKLNHLKIRLNENK

SEQ ID NO: 3017730 - protein, 32 aa, Entamoeba invadens
SNCKDVITFVLCYVFYPNIVIPKALEGKTASD

SEQ ID NO: 3017731 - protein, 26 aa, Entamoeba invadens
SNCLQKLPIDLTKLSNLVMCDIGDNQ

SEQ ID NO: 3017732 - protein, 17 aa, Entamoeba invadens
SNCLTCVITPTYCLSCP

SEQ ID NO: 3017733 - protein, 18 aa, Entamoeba invadens
SNCNKLCQFQVPQKVRFV

SEQ ID NO: 3017734 - protein, 26 aa, Entamoeba invadens
SNCSFDVFLLCFSVVQRSSFKNIKNK

SEQ ID NO: 3017735 - protein, 27 aa, Entamoeba invadens
SNDAIQIFQIFYQLSLTPRSKFYNEDF

SEQ ID NO: 3017736 - protein, 26 aa, Entamoeba invadens
SNDDYLKYMIYKLPDDYRDQKLKLVP

SEQ ID NO: 3017737 - protein, 26 aa, Entamoeba invadens
SNDDYLKYMIYKLPDDYRGVTTGWVW

SEQ ID NO: 3017738 - protein, 24 aa, Entamoeba invadens
SNDGQFNIFVPLTKIADLKKVNTK

SEQ ID NO: 3017739 - protein, 27 aa, Entamoeba invadens
SNDKGIPIDFLFGRRDHPPLPEVATLS

SEQ ID NO: 3017740 - protein, 18 aa, Entamoeba invadens
SNDKSLERLYEQNSMYRN

SEQ ID NO: 3017741 - protein, 19 aa, Entamoeba invadens
SNDLFAFNLTPQTSTIIAT

SEQ ID NO: 3017742 - protein, 18 aa, Entamoeba invadens
SNDLLFVFSNVVNKVFGS

SEQ ID NO: 3017743 - protein, 25 aa, Entamoeba invadens
SNDMTGARKFLCSGPLFIVEKVMEP

SEQ ID NO: 3017744 - protein, 29 aa, Entamoeba invadens
SNDPKHFIFSLCNPAHTEPKAFYLQDNSN

SEQ ID NO: 3017745 - protein, 17 aa, Entamoeba invadens
SNDPLATPLPWQQVQQR

SEQ ID NO: 3017746 - protein, 24 aa, Entamoeba invadens
SNDQKIRLFINRPLISINQNEDSN

SEQ ID NO: 3017747 - protein, 24 aa, Entamoeba invadens
SNDRKVLDFFFVAEGPSLLVKKNS

SEQ ID NO: 3017748 - protein, 27 aa, Entamoeba invadens
SNEEKNFLFTCYAAFWITSNAKIYPHN

SEQ ID NO: 3017749 - protein, 28 aa, Entamoeba invadens
SNEGSVRILFLFLKRMIDLSHAKYRLDI

SEQ ID NO: 3017750 - protein, 27 aa, Entamoeba invadens
SNEKFRALFSYSIRLMITLVKSISSTL

SEQ ID NO: 3017751 - protein, 26 aa, Entamoeba invadens
SNEKSFERLLFWKDEFLRNACTSLGD

SEQ ID NO: 3017752 - protein, 38 aa, Entamoeba invadens
SNELFVALALLRFGVRIPDIFTYILPLNEEFLTQQIIQ

SEQ ID NO: 3017753 - protein, 32 aa, Entamoeba invadens
SNELMSVEKLRHETQIREDTLIAELQKTKEEK

SEQ ID NO: 3017754 - protein, 25 aa, Entamoeba invadens
SNELNYTIFLTFLDNMRHAFATSPD

SEQ ID NO: 3017755 - protein, 23 aa, Entamoeba invadens
SNELVCTLFLLAQVFLDGNVINN

SEQ ID NO: 3017756 - protein, 24 aa, Entamoeba invadens
SNETTTYRSFTAQTAEPLKSPQDN

SEQ ID NO: 3017757 - protein, 23 aa, Entamoeba invadens
SNEVIYPNLLKQVGLLCLEKRYF

SEQ ID NO: 3017758 - protein, 19 aa, Entamoeba invadens
SNEVKWKYTCGGLITCFDE

SEQ ID NO: 3017759 - protein, 29 aa, Entamoeba invadens
SNFDKGPIQLFCDGLLTFLSALHHPLSFY

SEQ ID NO: 3017760 - protein, 26 aa, Entamoeba invadens
SNFEKSLIITPFASYSTHLPHSQIAT

SEQ ID NO: 3017761 - protein, 27 aa, Entamoeba invadens
SNFKIYNSTRWAILVSGLHILVSHNYA

SEQ ID NO: 3017762 - protein, 28 aa, Entamoeba invadens
SNFRHTTELLPLIKYPHKFSIFYSEMQR

SEQ ID NO: 3017763 - protein, 30 aa, Entamoeba invadens
SNFVLHTDALLYLLLKRGWTVKIVKQKTAK

SEQ ID NO: 3017764 - protein, 24 aa, Entamoeba invadens
SNFYIEVRMPYHILAQANEQKNEI

SEQ ID NO: 3017765 - protein, 33 aa, Entamoeba invadens
SNFYRNVKYIIPPVKRLITGKITLLRIGKDEET

SEQ ID NO: 3017766 - protein, 19 aa, Entamoeba invadens
SNFYRTFILTMDGKIINEQ

SEQ ID NO: 3017767 - protein, 18 aa, Entamoeba invadens
SNGFLDELISFLESARYE

SEQ ID NO: 3017768 - protein, 22 aa, Entamoeba invadens
SNGLLVRHYLQQYLPNIHVTLP

SEQ ID NO: 3017769 - protein, 19 aa, Entamoeba invadens
SNGMCMLCIDNHVVISLIS

SEQ ID NO: 3017770 - protein, 40 aa, Entamoeba invadens
SNGMLLVVHPSLIKRCKSHISFFNCGVKFICGMNGFIFIT

SEQ ID NO: 3017771 - protein, 31 aa, Entamoeba invadens
SNGVTFQLNSPIRFAPIAMQLFVVNDVIIDG

SEQ ID NO: 3017772 - protein, 24 aa, Entamoeba invadens
SNHLVRIVCHGNMTEFVKCDYTTP

SEQ ID NO: 3017773 - protein, 27 aa, Entamoeba invadens
SNIENPKNVIPRRTIERRKSQIFDLND

SEQ ID NO: 3017774 - protein, 19 aa, Entamoeba invadens
SNIGLIYSLLPSISTVFSS

SEQ ID NO: 3017775 - protein, 17 aa, Entamoeba invadens
SNIGLRSIILQKYYQFV

SEQ ID NO: 3017776 - protein, 19 aa, Entamoeba invadens
SNIIFVPPHRNAFSDQFKN

SEQ ID NO: 3017777 - protein, 22 aa, Entamoeba invadens
SNIIYNNIFYNCKTGYSGDSRG

SEQ ID NO: 3017778 - protein, 25 aa, Entamoeba invadens
SNIKLSELILYIRDNNGFKPYSLSD

SEQ ID NO: 3017779 - protein, 19 aa, Entamoeba invadens
SNIKTFVLHIKRLKKVTTA

SEQ ID NO: 3017780 - protein, 23 aa, Entamoeba invadens
SNIKVYLKWSALVSNWVAFALIN

SEQ ID NO: 3017781 - protein, 22 aa, Entamoeba invadens
SNILDEWLMNFKKSSRLLVTGC

SEQ ID NO: 3017782 - protein, 24 aa, Entamoeba invadens
SNINTLLAMKVFSSVFYGVRGKMD

SEQ ID NO: 3017783 - protein, 21 aa, Entamoeba invadens
SNIPDFVEKIKQFYIVVCQEI

SEQ ID NO: 3017784 - protein, 29 aa, Entamoeba invadens
SNISCKDRLIFIFRVNGDIFGFYQDGFVQ

SEQ ID NO: 3017785 - protein, 23 aa, Entamoeba invadens
SNIVPFRDSQFLYQCFIFEQVSS

SEQ ID NO: 3017786 - protein, 23 aa, Entamoeba invadens
SNKEVFNNAWLNILLACLGESMT

SEQ ID NO: 3017787 - protein, 20 aa, Entamoeba invadens
SNKHAALLCYIASGNVPKIM

SEQ ID NO: 3017788 - protein, 25 aa, Entamoeba invadens
SNKKIISELWKADFEMKNTKLLQLN

SEQ ID NO: 3017789 - protein, 25 aa, Entamoeba invadens
SNKLGLTKSLTFLKPSEELDNLNAQ

SEQ ID NO: 3017790 - protein, 17 aa, Entamoeba invadens
SNKLYVNVIVDPIGKWM

SEQ ID NO: 3017791 - protein, 25 aa, Entamoeba invadens
SNKMIISVFSAFWMDKKGTISFNPC

SEQ ID NO: 3017792 - protein, 24 aa, Entamoeba invadens
SNKNKYVYYLLTSKKERVTRKSLM

SEQ ID NO: 3017793 - protein, 23 aa, Entamoeba invadens
SNKPLVVKLLRYLVSNNEVVRVC

SEQ ID NO: 3017794 - protein, 23 aa, Entamoeba invadens
SNKRLMRFCPKNVIFDRKTVCTM

SEQ ID NO: 3017795 - protein, 26 aa, Entamoeba invadens
SNKTITLLSLRLLSKTWSNLRITNNL

SEQ ID NO: 3017796 - protein, 18 aa, Entamoeba invadens
SNKVMTITLYFESTFDVI

SEQ ID NO: 3017797 - protein, 23 aa, Entamoeba invadens
SNKVWIKRLNVIISVLRDMRLIE

SEQ ID NO: 3017798 - protein, 18 aa, Entamoeba invadens
SNKYLLPELPESAFGPIY

SEQ ID NO: 3017799 - protein, 19 aa, Entamoeba invadens
SNLFSLLQVLYQATKTSSD

SEQ ID NO: 3017800 - protein, 27 aa, Entamoeba invadens
SNLINQRRIVFVVPPAFFETHEITPEI

SEQ ID NO: 3017801 - protein, 18 aa, Entamoeba invadens
SNLIVRQGTLDVSTLMVG

SEQ ID NO: 3017802 - protein, 18 aa, Entamoeba invadens
SNLKLVKLQPRKVKIHKK

SEQ ID NO: 3017803 - protein, 23 aa, Entamoeba invadens
SNLKNIVFPSSVKSIGYCCFCGC

SEQ ID NO: 3017804 - protein, 25 aa, Entamoeba invadens
SNLLSLIRLYHYRGIPLDITKEISK

SEQ ID NO: 3017805 - protein, 18 aa, Entamoeba invadens
SNLMVWGNTVGYISLGSL

SEQ ID NO: 3017806 - protein, 20 aa, Entamoeba invadens
SNLPLAELSLFMLDGMKSVE

SEQ ID NO: 3017807 - protein, 40 aa, Entamoeba invadens
SNLPRKAIPQVVYNLCWWIYTYGYLIEGIFRVTSNLEFAK

SEQ ID NO: 3017808 - protein, 22 aa, Entamoeba invadens
SNLRSFQMYLTMSSCGLTDEPT

SEQ ID NO: 3017809 - protein, 26 aa, Entamoeba invadens
SNLSPRLYYDLYLLLQQCLSVLDMYL

SEQ ID NO: 3017810 - protein, 17 aa, Entamoeba invadens
SNLTFLRAEEFLDKVKL

SEQ ID NO: 3017811 - protein, 25 aa, Entamoeba invadens
SNMEQPPLYLFLGEDAFENALKQIE

SEQ ID NO: 3017812 - protein, 25 aa, Entamoeba invadens
SNMKALCSIFYFETSAFENIKVDFL

SEQ ID NO: 3017813 - protein, 24 aa, Entamoeba invadens
SNNDFIPEISWVKFVANCKYLKTV

SEQ ID NO: 3017814 - protein, 24 aa, Entamoeba invadens
SNNEMNLFCLRVMTGCIILNDRIS

SEQ ID NO: 3017815 - protein, 24 aa, Entamoeba invadens
SNNFCLSCPNGFYLNSQKTCISCG

SEQ ID NO: 3017816 - protein, 23 aa, Entamoeba invadens
SNNFPGAMPVNFGRTSFEIIQKS

SEQ ID NO: 3017817 - protein, 23 aa, Entamoeba invadens
SNNFPRLEQLKLFVPKNFGLPDY

SEQ ID NO: 3017818 - protein, 20 aa, Entamoeba invadens
SNNHHTSVDLGFRSSRTTYS

SEQ ID NO: 3017819 - protein, 24 aa, Entamoeba invadens
SNNQYAFYLYCKSHECLFGFGGGH

SEQ ID NO: 3017820 - protein, 26 aa, Entamoeba invadens
SNNRSHLLCLLLEYKYKTKSGDFVSF

SEQ ID NO: 3017821 - protein, 23 aa, Entamoeba invadens
SNNYHHFILTKTDSKLTPQAFFE

SEQ ID NO: 3017822 - protein, 26 aa, Entamoeba invadens
SNNYRGYVSFIFLSNEKTVFGIDCLA

SEQ ID NO: 3017823 - protein, 17 aa, Entamoeba invadens
SNPFNNFFAVGLNVSLS

SEQ ID NO: 3017824 - protein, 24 aa, Entamoeba invadens
SNPFYIKSLLQFYSSRGKLTDLLI

SEQ ID NO: 3017825 - protein, 19 aa, Entamoeba invadens
SNPIHYWRYRCHVDLDDIL

SEQ ID NO: 3017826 - protein, 25 aa, Entamoeba invadens
SNPKETINCLLERVGSNLGIDQSDN

SEQ ID NO: 3017827 - protein, 23 aa, Entamoeba invadens
SNQMLKICDTVIEYPPTKVQFSP

SEQ ID NO: 3017828 - protein, 21 aa, Entamoeba invadens
SNQTCLICTSGTYKNTETSCE

SEQ ID NO: 3017829 - protein, 23 aa, Entamoeba invadens
SNRASPIVFQKTADRENSKQKLL

SEQ ID NO: 3017830 - protein, 27 aa, Entamoeba invadens
SNRDWVNMRSWWFDEEKGIYIIINHSV

SEQ ID NO: 3017831 - protein, 27 aa, Entamoeba invadens
SNREFGGDIFWWLRKLDFDNNVINFFA

SEQ ID NO: 3017832 - protein, 29 aa, Entamoeba invadens
SNRLETFPVPILFIQNLKYLSLANNMITN

SEQ ID NO: 3017833 - protein, 26 aa, Entamoeba invadens
SNRLRRFRMIFGFDKFVLVSKIEEME

SEQ ID NO: 3017834 - protein, 24 aa, Entamoeba invadens
SNRNLFTITLPESLCVLSEGCFSD

SEQ ID NO: 3017835 - protein, 24 aa, Entamoeba invadens
SNSDIPPPLPPPRTTRRKAHEQTM

SEQ ID NO: 3017836 - protein, 24 aa, Entamoeba invadens
SNSHIKYLAFLKGVTESKCQIRDN

SEQ ID NO: 3017837 - protein, 32 aa, Entamoeba invadens
SNSIKTFCMSAPKLLYLNLSNNPIQKLDISMC

SEQ ID NO: 3017838 - protein, 30 aa, Entamoeba invadens
SNSPLLPNFERCYFPKNVFLYFIELNGVRI

SEQ ID NO: 3017839 - protein, 24 aa, Entamoeba invadens
SNSQPVNGLLDLPVEQPQHVEVEK

SEQ ID NO: 3017840 - protein, 27 aa, Entamoeba invadens
SNSSFEIFAKMFYLKESDAFLEYVANQ

SEQ ID NO: 3017841 - protein, 30 aa, Entamoeba invadens
SNSVCTSCQSGYYLFNGICNYCGDHCVNST

SEQ ID NO: 3017842 - protein, 17 aa, Entamoeba invadens
SNSYFMAELVKFFTKYL

SEQ ID NO: 3017843 - protein, 27 aa, Entamoeba invadens
SNTFCSRVMTYYARISCRSFLRQTLKN

SEQ ID NO: 3017844 - protein, 24 aa, Entamoeba invadens
SNTFQTIRIPKVFSILAIQCVGQW

SEQ ID NO: 3017845 - protein, 38 aa, Entamoeba invadens
SNTGINRMILKRAIPLYKKFVDHLKKYSYKNIQMVGRG

SEQ ID NO: 3017846 - protein, 25 aa, Entamoeba invadens
SNTINVECKLAVLSSQHEDLLFRVH

SEQ ID NO: 3017847 - protein, 31 aa, Entamoeba invadens
SNTKACPVVLNLIRTWLDKNRDWNGVVMFCC

SEQ ID NO: 3017848 - protein, 26 aa, Entamoeba invadens
SNTKVCQKSGFKGKTYLGIREIYEKD

SEQ ID NO: 3017849 - protein, 22 aa, Entamoeba invadens
SNTLTKLWKPVDALFNTDFSLV

SEQ ID NO: 3017850 - protein, 23 aa, Entamoeba invadens
SNTNEYCFFVLSTLLEDNTPVKT

SEQ ID NO: 3017851 - protein, 32 aa, Entamoeba invadens
SNTPLQKLTITSPLRSLFLDKVPMKELKLNIK

SEQ ID NO: 3017852 - protein, 26 aa, Entamoeba invadens
SNTPYSFTPFQISPHQSPLSATRCQN

SEQ ID NO: 3017853 - protein, 19 aa, Entamoeba invadens
SNVFILEYFVYINKDNFKD

SEQ ID NO: 3017854 - protein, 36 aa, Entamoeba invadens
SNVKTHRRIINLLKAKYPDEILLQTDLFMETQSKIP

SEQ ID NO: 3017855 - protein, 22 aa, Entamoeba invadens
SNVLSFLDNGTTKTFEIVYTSK

SEQ ID NO: 3017856 - protein, 22 aa, Entamoeba invadens
SNVRLSLFLCISDGFFASPQGK

SEQ ID NO: 3017857 - protein, 29 aa, Entamoeba invadens
SNVSIFFEFWSHLLYICNYGVLNSTMDIV

SEQ ID NO: 3017858 - protein, 17 aa, Entamoeba invadens
SNVTAMMRMCGGKIEVV

SEQ ID NO: 3017859 - protein, 19 aa, Entamoeba invadens
SNYCFIPSVAIVDPEFTIT

SEQ ID NO: 3017860 - protein, 25 aa, Entamoeba invadens
SNYEKIIATLLKLRHYNISLKENIQ

SEQ ID NO: 3017861 - protein, 34 aa, Entamoeba invadens
SNYKNNYYFRGDLPLFFYMNPFFGDQNTPFKKLI

SEQ ID NO: 3017862 - protein, 34 aa, Entamoeba invadens
SNYKNNYYFRGDLPLFFYMNPFFGDQNTPLKKLI

SEQ ID NO: 3017863 - protein, 24 aa, Entamoeba invadens
SNYNQLYFNMFSPNLKKEADEIVT

SEQ ID NO: 3017864 - protein, 23 aa, Entamoeba invadens
SNYPKGIIFALEATIGFVHELKD

SEQ ID NO: 3017865 - protein, 17 aa, Entamoeba invadens
SNYSVFARYLWAQFRYS

SEQ ID NO: 3017866 - protein, 26 aa, Entamoeba invadens
SNYTNLKNILLYINFEKYKVEEIVIP

SEQ ID NO: 3017867 - protein, 25 aa, Entamoeba invadens
SNYYRRIRVDYARPVIKIITGTQIE

SEQ ID NO: 3017868 - protein, 18 aa, Entamoeba invadens
SPALLIPNQLRKSISPHQ

SEQ ID NO: 3017869 - protein, 24 aa, Entamoeba invadens
SPCRRNLILITKILQNIANNISTF

SEQ ID NO: 3017870 - protein, 24 aa, Entamoeba invadens
SPDFTRKCVTCVSGYFVFENKCKK

SEQ ID NO: 3017871 - protein, 34 aa, Entamoeba invadens
SPDLKKFYDKELRLGFVLISFYDLRVSKKMFKAV

SEQ ID NO: 3017872 - protein, 33 aa, Entamoeba invadens
SPDTSFMCIVGNKTDLFAIRKVPIDEVLDFVNK

SEQ ID NO: 3017873 - protein, 25 aa, Entamoeba invadens
SPEKVLHPIPLLKVRMTNGNVSEMN

SEQ ID NO: 3017874 - protein, 23 aa, Entamoeba invadens
SPELLDGTLFVVNGRKFRMKVVH

SEQ ID NO: 3017875 - protein, 19 aa, Entamoeba invadens
SPEMILQNGWTYATDLWSV

SEQ ID NO: 3017876 - protein, 23 aa, Entamoeba invadens
SPEQVSAVILYKIKVEIQRSFGF

SEQ ID NO: 3017877 - protein, 26 aa, Entamoeba invadens
SPEYIQKICFWILSNISAGSFEGMTE

SEQ ID NO: 3017878 - protein, 20 aa, Entamoeba invadens
SPFAFIGNRFEFRAVGSEQN

SEQ ID NO: 3017879 - protein, 23 aa, Entamoeba invadens
SPFDIKTFLWKDHPFQLPEFGDG

SEQ ID NO: 3017880 - protein, 17 aa, Entamoeba invadens
SPFNQNMVYITASLISC

SEQ ID NO: 3017881 - protein, 21 aa, Entamoeba invadens
SPHCFAFSTSTKYINIEFIPF

SEQ ID NO: 3017882 - protein, 24 aa, Entamoeba invadens
SPHSFDLVFLTKEDPKGFIVMRSN

SEQ ID NO: 3017883 - protein, 24 aa, Entamoeba invadens
SPHSFFTQVEFISLIPPSPQSNDS

SEQ ID NO: 3017884 - protein, 25 aa, Entamoeba invadens
SPHTAKIFHLVNKTCYLALHSLRTN

SEQ ID NO: 3017885 - protein, 17 aa, Entamoeba invadens
SPIFPVEYEFAVSLPQP

SEQ ID NO: 3017886 - protein, 20 aa, Entamoeba invadens
SPINSCVGGIPYFPKNMKYP

SEQ ID NO: 3017887 - protein, 29 aa, Entamoeba invadens
SPIPKQSYQPFLDDLKRFTEKETCTVIYD

SEQ ID NO: 3017888 - protein, 18 aa, Entamoeba invadens
SPITRNAEMLPPVPPKRK

SEQ ID NO: 3017889 - protein, 22 aa, Entamoeba invadens
SPKELLIVFATLAAVIESYIVK

SEQ ID NO: 3017890 - protein, 37 aa, Entamoeba invadens
SPKFDVTWNLLPFLCSRWQMPIPSVPFEKLAAAGNML

SEQ ID NO: 3017891 - protein, 21 aa, Entamoeba invadens
SPKFTFYFEPQVNIISSRTSK

SEQ ID NO: 3017892 - protein, 17 aa, Entamoeba invadens
SPKNLLKSERLLRRLMV

SEQ ID NO: 3017893 - protein, 23 aa, Entamoeba invadens
SPKQTPHLFPFQATPYNFEGKTV

SEQ ID NO: 3017894 - protein, 31 aa, Entamoeba invadens
SPLERSLLEKWSGLKFRKVLFDSTKDDYAVK

SEQ ID NO: 3017895 - protein, 23 aa, Entamoeba invadens
SPLGCEALPPSPFLSDKLGEQNC

SEQ ID NO: 3017896 - protein, 22 aa, Entamoeba invadens
SPLLLAIKYNHLSTINILLPLS

SEQ ID NO: 3017897 - protein, 21 aa, Entamoeba invadens
SPLLVVTPMHTPMVLEEQENE

SEQ ID NO: 3017898 - protein, 19 aa, Entamoeba invadens
SPLNFSLARAFNALSYTNC

SEQ ID NO: 3017899 - protein, 19 aa, Entamoeba invadens
SPLNFVIPTVVSGLHIGVF

SEQ ID NO: 3017900 - protein, 31 aa, Entamoeba invadens
SPLNLIVFHIISTQQFMLCKSVKEQILFFLC

SEQ ID NO: 3017901 - protein, 24 aa, Entamoeba invadens
SPLSFSPGLSFKTGFMKFFGGKED

SEQ ID NO: 3017902 - protein, 18 aa, Entamoeba invadens
SPLVRFIHATHLVVIDNV

SEQ ID NO: 3017903 - protein, 23 aa, Entamoeba invadens
SPLVRFIYATHLVVIVGVKGEDG

SEQ ID NO: 3017904 - protein, 29 aa, Entamoeba invadens
SPLVRSAVVYLLMYSIPTPLADKSKKMLD

SEQ ID NO: 3017905 - protein, 26 aa, Entamoeba invadens
SPLVRSAVVYLLMYSISPPSVEQSKR

SEQ ID NO: 3017906 - protein, 17 aa, Entamoeba invadens
SPLYVERLNLLCNTSIK

SEQ ID NO: 3017907 - protein, 25 aa, Entamoeba invadens
SPMDDLMLLVARRVVDEYPLFVNRK

SEQ ID NO: 3017908 - protein, 19 aa, Entamoeba invadens
SPMIVFDKKVEETIQREIE

SEQ ID NO: 3017909 - protein, 23 aa, Entamoeba invadens
SPMMKEIIARYRALYNFDENFDT

SEQ ID NO: 3017910 - protein, 22 aa, Entamoeba invadens
SPMRVLLKFYEQCCPHPIDEEK

SEQ ID NO: 3017911 - protein, 20 aa, Entamoeba invadens
SPMVLFQQSLYFWKTDVWLN

SEQ ID NO: 3017912 - protein, 25 aa, Entamoeba invadens
SPNAVKNRFFGHLNKFYKTNQRNET

SEQ ID NO: 3017913 - protein, 35 aa, Entamoeba invadens
SPNGQYLLLHIYEQLIKFVKLPQRPSDKIFATNSK

SEQ ID NO: 3017914 - protein, 18 aa, Entamoeba invadens
SPNIKIISSATFIFCKNL

SEQ ID NO: 3017915 - protein, 23 aa, Entamoeba invadens
SPNLFPKVLAIINTLKTSKSSIG

SEQ ID NO: 3017916 - protein, 23 aa, Entamoeba invadens
SPNLLKYHNVLADVINFNSKFGK

SEQ ID NO: 3017917 - protein, 20 aa, Entamoeba invadens
SPNMMLKYKTIVDPTAPLAH

SEQ ID NO: 3017918 - protein, 24 aa, Entamoeba invadens
SPNSKTKNLKYSATYKPTDNLKLS

SEQ ID NO: 3017919 - protein, 22 aa, Entamoeba invadens
SPNYKDFLLRNLPSIEFGQDLY

SEQ ID NO: 3017920 - protein, 26 aa, Entamoeba invadens
SPPADQTWVKCGFYLSIYNGNLYSEK

SEQ ID NO: 3017921 - protein, 20 aa, Entamoeba invadens
SPPLAVFDEYTYVMGLKSVR

SEQ ID NO: 3017922 - protein, 23 aa, Entamoeba invadens
SPPLIPFGGILTKDLLVVDEMYA

SEQ ID NO: 3017923 - protein, 22 aa, Entamoeba invadens
SPPPHNFIDIFKMAILNLANSD

SEQ ID NO: 3017924 - protein, 19 aa, Entamoeba invadens
SPPPLNKLEKLKVLCFDRK

SEQ ID NO: 3017925 - protein, 25 aa, Entamoeba invadens
SPPPYPFDLCFYTVSPELSISNTKT

SEQ ID NO: 3017926 - protein, 24 aa, Entamoeba invadens
SPQFSFIHFFMISVLLTKQSQIMT

SEQ ID NO: 3017927 - protein, 27 aa, Entamoeba invadens
SPQIEKLLVFYYNNLSKTALYCLLALS

SEQ ID NO: 3017928 - protein, 17 aa, Entamoeba invadens
SPQIFDTLVLDFSLFYQ

SEQ ID NO: 3017929 - protein, 29 aa, Entamoeba invadens
SPQPPRKELNLLWASTKMILERDGLLQED

SEQ ID NO: 3017930 - protein, 20 aa, Entamoeba invadens
SPQQLLQIQSICAFGLTTES

SEQ ID NO: 3017931 - protein, 17 aa, Entamoeba invadens
SPRGFFDSIIRSRSNST

SEQ ID NO: 3017932 - protein, 28 aa, Entamoeba invadens
SPRGINAWYVWKILPNINGNDKCFICKK

SEQ ID NO: 3017933 - protein, 22 aa, Entamoeba invadens
SPRNREMYLPSTKPPFERDRDT

SEQ ID NO: 3017934 - protein, 23 aa, Entamoeba invadens
SPRVWTLFTDVFNYLPVTAVINE

SEQ ID NO: 3017935 - protein, 23 aa, Entamoeba invadens
SPSEAVYWLCRCGDFYQSIENGN

SEQ ID NO: 3017936 - protein, 18 aa, Entamoeba invadens
SPSFRQPQPPQYAQPIHI

SEQ ID NO: 3017937 - protein, 23 aa, Entamoeba invadens
SPSFYKPTLPKIPRTKKKWTVQH

SEQ ID NO: 3017938 - protein, 19 aa, Entamoeba invadens
SPTFRAKRLAIRQNQLEAI

SEQ ID NO: 3017939 - protein, 24 aa, Entamoeba invadens
SPTGDYFFYEMLYEFVDILNANKG

SEQ ID NO: 3017940 - protein, 30 aa, Entamoeba invadens
SPTIPYLPRTFLVYFLLQHTFPKPSIQMDF

SEQ ID NO: 3017941 - protein, 20 aa, Entamoeba invadens
SPTLDVHPPLLLHKGQHLCT

SEQ ID NO: 3017942 - protein, 21 aa, Entamoeba invadens
SPTPDILMDPYFKSIKEVPEC

SEQ ID NO: 3017943 - protein, 18 aa, Entamoeba invadens
SPTYFIDGLHSFGPDFSP

SEQ ID NO: 3017944 - protein, 21 aa, Entamoeba invadens
SPTYQLMFKPVDNDPFFQPPV

SEQ ID NO: 3017945 - protein, 26 aa, Entamoeba invadens
SPVEKKPMFHFLPGTQTYSLATIGCN

SEQ ID NO: 3017946 - protein, 30 aa, Entamoeba invadens
SPVFHQFIECVFILLTNYPTMFQFNEEFLL

SEQ ID NO: 3017947 - protein, 43 aa, Entamoeba invadens
SPVFLCSKYKKMFVRYLWEIFTTELFEYIWPPLIERNEQNIVF

SEQ ID NO: 3017948 - protein, 20 aa, Entamoeba invadens
SPVFMKPLDLGADISLHSCT

SEQ ID NO: 3017949 - protein, 20 aa, Entamoeba invadens
SPVHSPFPVFYTEAINSLTS

SEQ ID NO: 3017950 - protein, 24 aa, Entamoeba invadens
SPVQRIPRYILLMREYIKATDKDH

SEQ ID NO: 3017951 - protein, 25 aa, Entamoeba invadens
SPVRETPLCDLKLETPDKPQRSKVP

SEQ ID NO: 3017952 - protein, 18 aa, Entamoeba invadens
SPVYILSEHKIKRIGKDH

SEQ ID NO: 3017953 - protein, 26 aa, Entamoeba invadens
SQAAEQAVFIALLSRHYSIEIKHPIK

SEQ ID NO: 3017954 - protein, 24 aa, Entamoeba invadens
SQAGIYFHVADILLLELTVAFYKI

SEQ ID NO: 3017955 - protein, 28 aa, Entamoeba invadens
SQAIEVFSLLMLYKVMYPTRISLMRGNH

SEQ ID NO: 3017956 - protein, 25 aa, Entamoeba invadens
SQAKKRYFFLFSDLLVYGRMQMGLF

SEQ ID NO: 3017957 - protein, 28 aa, Entamoeba invadens
SQALNTYRPFQAKKYYLMLFEEQIQQKE

SEQ ID NO: 3017958 - protein, 17 aa, Entamoeba invadens
SQCDVVFDSLIHPMSIS

SEQ ID NO: 3017959 - protein, 18 aa, Entamoeba invadens
SQCFRWCDSLRNVTIPLS

SEQ ID NO: 3017960 - protein, 24 aa, Entamoeba invadens
SQCLVNYTITFPISKVCVKCSEFD

SEQ ID NO: 3017961 - protein, 29 aa, Entamoeba invadens
SQCNEVITLWYRPPELIFGQTKYGAEIDV

SEQ ID NO: 3017962 - protein, 25 aa, Entamoeba invadens
SQDGLNFGVVLIPEGLLEFIPEVKV

SEQ ID NO: 3017963 - protein, 28 aa, Entamoeba invadens
SQDKLKTKFVYYSRDWEDFLKKNQHSIS

SEQ ID NO: 3017964 - protein, 25 aa, Entamoeba invadens
SQDRKFSVLLLMKMDHMKSAQENYN

SEQ ID NO: 3017965 - protein, 33 aa, Entamoeba invadens
SQDSQGLHYIPTSPFLFLLKVEATVFGYFVNTN

SEQ ID NO: 3017966 - protein, 32 aa, Entamoeba invadens
SQDVTTYVLQILIAQNREYFIAYEIRVTLNDQ

SEQ ID NO: 3017967 - protein, 35 aa, Entamoeba invadens
SQEGASRAFWVWPANNWCLLQFGFCGDDISIAKKS

SEQ ID NO: 3017968 - protein, 23 aa, Entamoeba invadens
SQEIAWLCEFVCLKTLEMKDVSF

SEQ ID NO: 3017969 - protein, 22 aa, Entamoeba invadens
SQEIFGTSYLFTFPVNKEQQNI

SEQ ID NO: 3017970 - protein, 26 aa, Entamoeba invadens
SQEKEFMLRVITYTSYFINTASYEWA

SEQ ID NO: 3017971 - protein, 23 aa, Entamoeba invadens
SQEMIVLVLISRFGNTIHFSKPK

SEQ ID NO: 3017972 - protein, 25 aa, Entamoeba invadens
SQEQMLTLIIWILHYNSEDIFSYLN

SEQ ID NO: 3017973 - protein, 23 aa, Entamoeba invadens
SQERQLELLFDSFNTITMKQRQV

SEQ ID NO: 3017974 - protein, 25 aa, Entamoeba invadens
SQEYRSIDFVSLDKIIPIIKDPMAD

SEQ ID NO: 3017975 - protein, 25 aa, Entamoeba invadens
SQFDLFFHVGPLIGTFVDCVNQMND

SEQ ID NO: 3017976 - protein, 24 aa, Entamoeba invadens
SQFHQDYIILVLKDETIGGDFVCF

SEQ ID NO: 3017977 - protein, 17 aa, Entamoeba invadens
SQFLLEEKGIVGSAYIP

SEQ ID NO: 3017978 - protein, 20 aa, Entamoeba invadens
SQFLLSNYAFFDEVTEFSRN

SEQ ID NO: 3017979 - protein, 26 aa, Entamoeba invadens
SQFNNAHIIVYPLNGMYRIEMFYKAG

SEQ ID NO: 3017980 - protein, 23 aa, Entamoeba invadens
SQFTLYAILNGTKPDFHKSMKAD

SEQ ID NO: 3017981 - protein, 28 aa, Entamoeba invadens
SQFTYMEAFIFYQIRPSEFFGQAWAKVK

SEQ ID NO: 3017982 - protein, 19 aa, Entamoeba invadens
SQFVLNNSYLFALTPEGAL

SEQ ID NO: 3017983 - protein, 24 aa, Entamoeba invadens
SQGEMHFYLVGFYGNIFGSNNEKV

SEQ ID NO: 3017984 - protein, 27 aa, Entamoeba invadens
SQGQTMFSCSLWYLVETVLDKMKNVDI

SEQ ID NO: 3017985 - protein, 25 aa, Entamoeba invadens
SQHEDMLFKVLFKITSKTGEVLGNL

SEQ ID NO: 3017986 - protein, 22 aa, Entamoeba invadens
SQHIFPLINTQFLYHKNEKQFP

SEQ ID NO: 3017987 - protein, 17 aa, Entamoeba invadens
SQHKPVICSASLYLQEF

SEQ ID NO: 3017988 - protein, 24 aa, Entamoeba invadens
SQHKRPLYALTLDLITTLKVQQRP

SEQ ID NO: 3017989 - protein, 18 aa, Entamoeba invadens
SQHLLVIRLRKLESVTKD

SEQ ID NO: 3017990 - protein, 34 aa, Entamoeba invadens
SQIDENVLHIFKKYKVKISPILPVALVNQIDVNL

SEQ ID NO: 3017991 - protein, 33 aa, Entamoeba invadens
SQIGTKCPIFLNTKIRLTIYRNIASALMKLHSE

SEQ ID NO: 3017992 - protein, 22 aa, Entamoeba invadens
SQIGVMDLSLKRIKSFPVNFTP

SEQ ID NO: 3017993 - protein, 22 aa, Entamoeba invadens
SQIHAMFRSLAKSGFSLIQGPP

SEQ ID NO: 3017994 - protein, 20 aa, Entamoeba invadens
SQIYAIRQAIARALIAYQQK

SEQ ID NO: 3017995 - protein, 17 aa, Entamoeba invadens
SQKAIINCALSGHNTLV

SEQ ID NO: 3017996 - protein, 20 aa, Entamoeba invadens
SQKRITLIAGIFANNTTLKP

SEQ ID NO: 3017997 - protein, 20 aa, Entamoeba invadens
SQKRITLIAGIFTNNTTLKP

SEQ ID NO: 3017998 - protein, 28 aa, Entamoeba invadens
SQKRTTFPNLVLPLSFFKSKNSKSVETV

SEQ ID NO: 3017999 - protein, 25 aa, Entamoeba invadens
SQKTNLVYLLWGSFAQKKASCVDAK

SEQ ID NO: 3018000 - protein, 18 aa, Entamoeba invadens
SQLKLFEMTNTKQSEMEK

SEQ ID NO: 3018001 - protein, 20 aa, Entamoeba invadens
SQLKVLLPTKLPKLSVEYCE

SEQ ID NO: 3018002 - protein, 17 aa, Entamoeba invadens
SQLLSVQRMFVFNLAQS

SEQ ID NO: 3018003 - protein, 21 aa, Entamoeba invadens
SQLLTFIHKVAPRGMYTSGRG

SEQ ID NO: 3018004 - protein, 22 aa, Entamoeba invadens
SQLPQIYVFLHGKPKTLPQKYS

SEQ ID NO: 3018005 - protein, 17 aa, Entamoeba invadens
SQLPTNCSAHLLYVQSQ

SEQ ID NO: 3018006 - protein, 18 aa, Entamoeba invadens
SQLQLLRENSELLMSYYD

SEQ ID NO: 3018007 - protein, 21 aa, Entamoeba invadens
SQLQNIFLPLNLNSIGMRCFS

SEQ ID NO: 3018008 - protein, 18 aa, Entamoeba invadens
SQLQRQLMGILCANVNGG

SEQ ID NO: 3018009 - protein, 17 aa, Entamoeba invadens
SQLTRPIIAGCYSGINA

SEQ ID NO: 3018010 - protein, 18 aa, Entamoeba invadens
SQLYMESPRFDSNTSLIA

SEQ ID NO: 3018011 - protein, 25 aa, Entamoeba invadens
SQMFSLFGGDWRRSIVLYEEGGITD

SEQ ID NO: 3018012 - protein, 24 aa, Entamoeba invadens
SQNENLLFEIYKEKFTKEDVEKCL

SEQ ID NO: 3018013 - protein, 23 aa, Entamoeba invadens
SQNIVRLLVSKFLETIRSELPDE

SEQ ID NO: 3018014 - protein, 18 aa, Entamoeba invadens
SQNKYFLRQYSKSLFVDE

SEQ ID NO: 3018015 - protein, 22 aa, Entamoeba invadens
SQNPLSRLRKLFESLFGCMKRG

SEQ ID NO: 3018016 - protein, 20 aa, Entamoeba invadens
SQNTFFLTVPITVGSTEDIS

SEQ ID NO: 3018017 - protein, 29 aa, Entamoeba invadens
SQPEESQTLFYPSAIKSSVSFSTPGTPVK

SEQ ID NO: 3018018 - protein, 19 aa, Entamoeba invadens
SQPGLGAKPPGLGQPGLGG

SEQ ID NO: 3018019 - protein, 26 aa, Entamoeba invadens
SQPHSLFFPHNTYSLGYHLFTKQTSL

SEQ ID NO: 3018020 - protein, 27 aa, Entamoeba invadens
SQQLLPYHSIFLFKTSKEWISCLTNSD

SEQ ID NO: 3018021 - protein, 31 aa, Entamoeba invadens
SQQNLHFKQLFKILELLGYSWAKNCYHISFG

SEQ ID NO: 3018022 - protein, 19 aa, Entamoeba invadens
SQQNLLDYSFKLSNDIYKS

SEQ ID NO: 3018023 - protein, 26 aa, Entamoeba invadens
SQQSDVLAFWIATLCALIHKTNLLNP

SEQ ID NO: 3018024 - protein, 44 aa, Entamoeba invadens
SQREKLWRTCQFVIKMEKILYSLGVAFEFFDLKYSDLPKVLQDE

SEQ ID NO: 3018025 - protein, 38 aa, Entamoeba invadens
SQREKLWRTCQFVIKMEKILYSLGVAFEFFDLKYSELP

SEQ ID NO: 3018026 - protein, 22 aa, Entamoeba invadens
SQRKRVYSPRRRVSIMKVDQDE

SEQ ID NO: 3018027 - protein, 24 aa, Entamoeba invadens
SQRKYTFEVYYKNFTYIFATNNNN

SEQ ID NO: 3018028 - protein, 22 aa, Entamoeba invadens
SQRPRFKDLYKDLKSILDVLPD

SEQ ID NO: 3018029 - protein, 24 aa, Entamoeba invadens
SQSDFLIRILDDPTFDGLPIEKMK

SEQ ID NO: 3018030 - protein, 28 aa, Entamoeba invadens
SQSFSRMAVLFSSIYNLLNNPRIVLSQE

SEQ ID NO: 3018031 - protein, 17 aa, Entamoeba invadens
SQSIADMTLPLANTTRV

SEQ ID NO: 3018032 - protein, 18 aa, Entamoeba invadens
SQSKLFYTKKFECLTSVY

SEQ ID NO: 3018033 - protein, 33 aa, Entamoeba invadens
SQSLVKCNKKWVGVPWTGVGKIALWPADKPGKM

SEQ ID NO: 3018034 - protein, 33 aa, Entamoeba invadens
SQSQLMKGKWTVDYYHFAFNIARKCNVINRLMY

SEQ ID NO: 3018035 - protein, 27 aa, Entamoeba invadens
SQTHTNFFLRPCWSPEATQMLLVGAVQ

SEQ ID NO: 3018036 - protein, 19 aa, Entamoeba invadens
SQTILTIKSTILPKISNMK

SEQ ID NO: 3018037 - protein, 24 aa, Entamoeba invadens
SQTIPYFFSEFIFNQFRTSELEEI

SEQ ID NO: 3018038 - protein, 18 aa, Entamoeba invadens
SQTKIFEYQFAGCKNLKT

SEQ ID NO: 3018039 - protein, 32 aa, Entamoeba invadens
SQTNKEIFLMTSALLKLYFSKEYVIELTKRND

SEQ ID NO: 3018040 - protein, 23 aa, Entamoeba invadens
SQVAVIIIPLLKENALRSVASNL

SEQ ID NO: 3018041 - protein, 25 aa, Entamoeba invadens
SQVDVKKIIWLKSGGKPENIEKVVE

SEQ ID NO: 3018042 - protein, 21 aa, Entamoeba invadens
SQVKLFTAPLLQNPIPQFFVN

SEQ ID NO: 3018043 - protein, 22 aa, Entamoeba invadens
SQVLLLNILYMNSLGQGLVDFS

SEQ ID NO: 3018044 - protein, 29 aa, Entamoeba invadens
SQWSENTIKMPWWHSDLMGEECMIFANGY

SEQ ID NO: 3018045 - protein, 18 aa, Entamoeba invadens
SQYFHSFLDFVHIELVCK

SEQ ID NO: 3018046 - protein, 22 aa, Entamoeba invadens
SQYIRMFFTHIPFQKVLSKGNI

SEQ ID NO: 3018047 - protein, 21 aa, Entamoeba invadens
SQYLALMEFIIKESDEIFKRK

SEQ ID NO: 3018048 - protein, 20 aa, Entamoeba invadens
SQYLSLFVDPVTNGLVFASF

SEQ ID NO: 3018049 - protein, 32 aa, Entamoeba invadens
SQYMPPSIYKCMYTLYFTPRPLEGVFRCCAEA

SEQ ID NO: 3018050 - protein, 25 aa, Entamoeba invadens
SQYPNALAFVFCYSITSSASFEEVK

SEQ ID NO: 3018051 - protein, 23 aa, Entamoeba invadens
SQYSLPKRQIALTFKNLANYGKC

SEQ ID NO: 3018052 - protein, 21 aa, Entamoeba invadens
SQYTPFKFAPTSGCYLRVIDS

SEQ ID NO: 3018053 - protein, 19 aa, Entamoeba invadens
SQYTTLNWFLLSLEDGRHF

SEQ ID NO: 3018054 - protein, 30 aa, Entamoeba invadens
SQYVGVISLLDMFFEYGMSTKYLKYRPQNV

SEQ ID NO: 3018055 - protein, 26 aa, Entamoeba invadens
SQYVLIYELLDEILDFGYPQFCTKDE

SEQ ID NO: 3018056 - protein, 17 aa, Entamoeba invadens
SQYVPKPALMPLGEQKE

SEQ ID NO: 3018057 - protein, 24 aa, Entamoeba invadens
SRAAAFHDLPLFAFADMMSVCINP

SEQ ID NO: 3018058 - protein, 23 aa, Entamoeba invadens
SRARILLEKPLKYSKVSITTPRL

SEQ ID NO: 3018059 - protein, 25 aa, Entamoeba invadens
SRCFGDLFILLPDDLETLYIENTKR

SEQ ID NO: 3018060 - protein, 19 aa, Entamoeba invadens
SRCILVRVPYPNKKSFKSL

SEQ ID NO: 3018061 - protein, 17 aa, Entamoeba invadens
SRCLLNYTITSPISKVC

SEQ ID NO: 3018062 - protein, 24 aa, Entamoeba invadens
SRCNLLQTIVLPKSLRTIDDAAFD

SEQ ID NO: 3018063 - protein, 35 aa, Entamoeba invadens
SRDANGYLNGELYFIGIIDILMDYTTRKKLETVMK

SEQ ID NO: 3018064 - protein, 28 aa, Entamoeba invadens
SRDCIKNLYFVLPLPQKRKMPVLAPHEN

SEQ ID NO: 3018065 - protein, 32 aa, Entamoeba invadens; identical to SEQ ID NO: 2540222

SEQ ID NO: 3018066 - protein, 45 aa, Entamoeba invadens
SRDITTIRQIPLVEFDLLKTKGIDYVWMMGVWQLGNYGLEIDKKV

SEQ ID NO: 3018067 - protein, 24 aa, Entamoeba invadens
SRDSVYEIFQRFLIKKEKKEEKLI

SEQ ID NO: 3018068 - protein, 27 aa, Entamoeba invadens
SRDYYDNLILFLTFSLDVSLYNFSVVK

SEQ ID NO: 3018069 - protein, 26 aa, Entamoeba invadens
SREDEYHSRWRKRNVSPVKEIKSYKE

SEQ ID NO: 3018070 - protein, 18 aa, Entamoeba invadens
SREEYLKQKALIDEIREQ

SEQ ID NO: 3018071 - protein, 22 aa, Entamoeba invadens
SREIYEMFVKRTLISGGMTESE

SEQ ID NO: 3018072 - protein, 27 aa, Entamoeba invadens
SRELVKVFQFHFFSSEDICFFTFDKCA

SEQ ID NO: 3018073 - protein, 26 aa, Entamoeba invadens
SREQNDFIVYWVKTLVKYKKIGITVC

SEQ ID NO: 3018074 - protein, 18 aa, Entamoeba invadens
SRERAFYSKQLISAPRNS

SEQ ID NO: 3018075 - protein, 26 aa, Entamoeba invadens
SRESNVINALIFFDSLESVRTAELMT

SEQ ID NO: 3018076 - protein, 27 aa, Entamoeba invadens
SRESNVINALIFFDSLESVRTAELMTG

SEQ ID NO: 3018077 - protein, 24 aa, Entamoeba invadens
SREVYDWMRVCFDVIICNGYGSTE

SEQ ID NO: 3018078 - protein, 23 aa, Entamoeba invadens
SREYFIPAELRSDVYDYVLPEVE

SEQ ID NO: 3018079 - protein, 19 aa, Entamoeba invadens
SRFFIFSSCTQRHIASKSE

SEQ ID NO: 3018080 - protein, 21 aa, Entamoeba invadens
SRFKKSFLQAFYTAFSDTLRQ

SEQ ID NO: 3018081 - protein, 17 aa, Entamoeba invadens
SRFLRKSGLDTKKESVK

SEQ ID NO: 3018082 - protein, 27 aa, Entamoeba invadens
SRFLTFEQVFTLGFNFAQKSYFEPTIE

SEQ ID NO: 3018083 - protein, 19 aa, Entamoeba invadens
SRFQLLMERTDLSKLGLYF

SEQ ID NO: 3018084 - protein, 28 aa, Entamoeba invadens
SRFRKIKKTIIPWTKEEDFILLKGVQVY

SEQ ID NO: 3018085 - protein, 17 aa, Entamoeba invadens
SRGDGMYLTFDLLETIV

SEQ ID NO: 3018086 - protein, 24 aa, Entamoeba invadens
SRGDIGQLFYWLIVGENEKTKISL

SEQ ID NO: 3018087 - protein, 20 aa, Entamoeba invadens
SRGFMEALYSNKFLIEAATA

SEQ ID NO: 3018088 - protein, 18 aa, Entamoeba invadens
SRGILYLHENGILHRDIK

SEQ ID NO: 3018089 - protein, 23 aa, Entamoeba invadens
SRGTINFYALTELMIKHSNIIVL

SEQ ID NO: 3018090 - protein, 23 aa, Entamoeba invadens
SRGTSLCDIAVLVVDLMHGLEPQ

SEQ ID NO: 3018091 - protein, 17 aa, Entamoeba invadens
SRHFWTIKTGTFRETIR

SEQ ID NO: 3018092 - protein, 31 aa, Entamoeba invadens
SRHNCTKRKTTLLIWSVKNLQNTIADVNAQK

SEQ ID NO: 3018093 - protein, 23 aa, Entamoeba invadens
SRHPNIVTLFKFMKSKQSIKGTL

SEQ ID NO: 3018094 - protein, 26 aa, Entamoeba invadens
SRHTPKIELTLFKPYLDFIEQNCSKD

SEQ ID NO: 3018095 - protein, 21 aa, Entamoeba invadens
SRHVTVFPSALILAPTRELGQ

SEQ ID NO: 3018096 - protein, 19 aa, Entamoeba invadens
SRIIKLTIINFMKNKRMLR

SEQ ID NO: 3018097 - protein, 25 aa, Entamoeba invadens
SRIIRDMFALAKSKAPAIIFIDEID

SEQ ID NO: 3018098 - protein, 20 aa, Entamoeba invadens
SRIKWDVDKGIFLCDKRSTM

SEQ ID NO: 3018099 - protein, 18 aa, Entamoeba invadens
SRILSREKVFGFNGFIAS

SEQ ID NO: 3018100 - protein, 17 aa, Entamoeba invadens
SRILYNVAEPKTLDERQ

SEQ ID NO: 3018101 - protein, 18 aa, Entamoeba invadens
SRILYWSLSGATREIISI

SEQ ID NO: 3018102 - protein, 24 aa, Entamoeba invadens
SRINTFMHISLTFPPSLRSLSLSV

SEQ ID NO: 3018103 - protein, 23 aa, Entamoeba invadens
SRITNRLFFPKNSKYRNVYLLAS

SEQ ID NO: 3018104 - protein, 37 aa, Entamoeba invadens
SRKCDVWALGCLLFELATGVPPFSLPITLSQFKNFSL

SEQ ID NO: 3018105 - protein, 26 aa, Entamoeba invadens
SRKDRKLVWFGGIRLSSKEYKGKEWR

SEQ ID NO: 3018106 - protein, 22 aa, Entamoeba invadens
SRKEWEMLRLLASRVIMQMVSS

SEQ ID NO: 3018107 - protein, 19 aa, Entamoeba invadens
SRKFICCGPLIALDNMNDP

SEQ ID NO: 3018108 - protein, 20 aa, Entamoeba invadens
SRKLTWRPGHIWVGSATIQR

SEQ ID NO: 3018109 - protein, 23 aa, Entamoeba invadens
SRKQMEMFLRFTKFSRYFDCGDA

SEQ ID NO: 3018110 - protein, 43 aa, Entamoeba invadens
SRLDPDTLSFWTQKSADKNEEFLKKFILEKKWMELEENDSEEN

SEQ ID NO: 3018111 - protein, 23 aa, Entamoeba invadens
SRLKIRMTNPSVLRPYYADKSVF

SEQ ID NO: 3018112 - protein, 28 aa, Entamoeba invadens
SRLKSLKQLILYGNKLKNLPLLDKSGLT

SEQ ID NO: 3018113 - protein, 18 aa, Entamoeba invadens
SRLSFCSTFLKTNLFFNK

SEQ ID NO: 3018114 - protein, 23 aa, Entamoeba invadens
SRLSWREFFAHQFVYRAMQHHAA

SEQ ID NO: 3018115 - protein, 31 aa, Entamoeba invadens
SRLTSKQQLTLSGFLPINYNGKAFGIPLTIS

SEQ ID NO: 3018116 - protein, 25 aa, Entamoeba invadens
SRLVPKYLCLLASSLSSERLFSECF

SEQ ID NO: 3018117 - protein, 18 aa, Entamoeba invadens
SRLVSLVKMFPDYSIKVM

SEQ ID NO: 3018118 - protein, 23 aa, Entamoeba invadens
SRLYSSVMTCHLSDYLRFQLVTI

SEQ ID NO: 3018119 - protein, 24 aa, Entamoeba invadens
SRMDYLGVMNQIVTLSLQKEKTKK

SEQ ID NO: 3018120 - protein, 25 aa, Entamoeba invadens
SRMIVREMLFLFDDIKLLVNLIKTD

SEQ ID NO: 3018121 - protein, 20 aa, Entamoeba invadens
SRMVLGLDELGYQCVIGGSL

SEQ ID NO: 3018122 - protein, 20 aa, Entamoeba invadens
SRNCLLPFVDGYKYIPTDSK

SEQ ID NO: 3018123 - protein, 23 aa, Entamoeba invadens
SRPEFELVALNDPFMDPKYMEYM

SEQ ID NO: 3018124 - protein, 22 aa, Entamoeba invadens
SRPLNPFDVPINKTPSAFGKIN

SEQ ID NO: 3018125 - protein, 23 aa, Entamoeba invadens
SRQHILTYNWWFNQGGNGQSEQA

SEQ ID NO: 3018126 - protein, 42 aa, Entamoeba invadens
SRQKICQLSIETFNFSHFCLISQPVLSLLSTGKSTGFCVESG

SEQ ID NO: 3018127 - protein, 17 aa, Entamoeba invadens
SRQTFQTPFSPIKKARS

SEQ ID NO: 3018128 - protein, 19 aa, Entamoeba invadens
SRRCIICNTGFYPNDSGKC

SEQ ID NO: 3018129 - protein, 33 aa, Entamoeba invadens
SRREQMQAQILKRYLPVSLDSDKLKGVVLPILT

SEQ ID NO: 3018130 - protein, 26 aa, Entamoeba invadens
SRSFGYIQLKCREEMFTLHKLLNNSI

SEQ ID NO: 3018131 - protein, 21 aa, Entamoeba invadens
SRSRRGLQRSVLFVIDMSYPM

SEQ ID NO: 3018132 - protein, 28 aa, Entamoeba invadens
SRSSKTVFLFYDFKPDYWEYYCLVCQRE

SEQ ID NO: 3018133 - protein, 25 aa, Entamoeba invadens
SRSSQPFFFFSIKNPHNKIFSFKIE

SEQ ID NO: 3018134 - protein, 25 aa, Entamoeba invadens
SRSSTLIPHKFQYKVWYSVTYQETY

SEQ ID NO: 3018135 - protein, 24 aa, Entamoeba invadens
SRSVPLLGITQFVPTKPLTLSLGT

SEQ ID NO: 3018136 - protein, 24 aa, Entamoeba invadens
SRTNTLFCLSKFKPPQSPLPQKLT

SEQ ID NO: 3018137 - protein, 25 aa, Entamoeba invadens
SRTPSQLYRSETPTFYSAKRSSQQQ

SEQ ID NO: 3018138 - protein, 27 aa, Entamoeba invadens
SRVFFNDIKGIFIVFSLDSMETLNHCK

SEQ ID NO: 3018139 - protein, 18 aa, Entamoeba invadens
SRVGSLYLSKFLRESCEE

SEQ ID NO: 3018140 - protein, 27 aa, Entamoeba invadens
SRVLQRGGVLIWLSFGENKTNFIQENP

SEQ ID NO: 3018141 - protein, 23 aa, Entamoeba invadens
SRVYEALLVLLHHGILRYSKDEP

SEQ ID NO: 3018142 - protein, 31 aa, Entamoeba invadens
SRYDGWFVLTSIKLFVDTIQFPRQLIELKNI

SEQ ID NO: 3018143 - protein, 24 aa, Entamoeba invadens
SSAALMFIDLFDSQTKLQVMLNMS

SEQ ID NO: 3018144 - protein, 18 aa, Entamoeba invadens
SSAFLKKNGLKYIVRSHE

SEQ ID NO: 3018145 - protein, 22 aa, Entamoeba invadens
SSAMNFVCMLNQVVFKNCKAEQ

SEQ ID NO: 3018146 - protein, 18 aa, Entamoeba invadens
SSCFLDCGFLKQIEIPSS

SEQ ID NO: 3018147 - protein, 20 aa, Entamoeba invadens
SSCITCEPNYYLLNNNACIQ

SEQ ID NO: 3018148 - protein, 23 aa, Entamoeba invadens
SSCRYLTTLSLPTSLVTIAHRCF

SEQ ID NO: 3018149 - protein, 28 aa, Entamoeba invadens
SSCTDLKRVILPPYLKSLPKNTFNMCYS

SEQ ID NO: 3018150 - protein, 26 aa, Entamoeba invadens
SSDCYQMCFWLLDNAIYNTGVFELVQ

SEQ ID NO: 3018151 - protein, 27 aa, Entamoeba invadens
SSDITTLPEYLFYLSGKGKYEVPNTIT

SEQ ID NO: 3018152 - protein, 25 aa, Entamoeba invadens
SSDKRLRVFLSILTAPFTPDEVFAF

SEQ ID NO: 3018153 - protein, 30 aa, Entamoeba invadens
SSDLKPYVKYLMPAVEISGLLVVDMASPEF

SEQ ID NO: 3018154 - protein, 18 aa, Entamoeba invadens
SSDLLVSIFDIQGKAKSK

SEQ ID NO: 3018155 - protein, 27 aa, Entamoeba invadens
SSDLSFLYLTAFVQKLAKAFGSQAIKK

SEQ ID NO: 3018156 - protein, 26 aa, Entamoeba invadens
SSDQQDWLLMYVYKGLGASENKDATY

SEQ ID NO: 3018157 - protein, 25 aa, Entamoeba invadens
SSDSISLSGLLWAKSNIRNSAVFTT

SEQ ID NO: 3018158 - protein, 26 aa, Entamoeba invadens
SSEAERITFLFLTSALLKAVDDHYDL

SEQ ID NO: 3018159 - protein, 21 aa, Entamoeba invadens
SSECALFLLTSTIDNMLGATT

SEQ ID NO: 3018160 - protein, 17 aa, Entamoeba invadens
SSEDFYIRSIYTSTYDC

SEQ ID NO: 3018161 - protein, 25 aa, Entamoeba invadens
SSEECYLFLEPLYYDYRPLKVRTGA

SEQ ID NO: 3018162 - protein, 19 aa, Entamoeba invadens
SSEFEMMCYFNKKIFECVL

SEQ ID NO: 3018163 - protein, 22 aa, Entamoeba invadens
SSEKFFLYGYNNNTENPIYPLK

SEQ ID NO: 3018164 - protein, 25 aa, Entamoeba invadens
SSEKKGMYVLLKFSAITPEQKESWK

SEQ ID NO: 3018165 - protein, 24 aa, Entamoeba invadens
SSELKILLCQISRALIWRVSNLML

SEQ ID NO: 3018166 - protein, 17 aa, Entamoeba invadens
SSELTLLTGRRYRQSEL

SEQ ID NO: 3018167 - protein, 19 aa, Entamoeba invadens
SSEVLPYHFKHSNIASFVR

SEQ ID NO: 3018168 - protein, 19 aa, Entamoeba invadens
SSFALFQRWNDQYALFQSL

SEQ ID NO: 3018169 - protein, 20 aa, Entamoeba invadens
SSFDADVITLLRKKQQKYPV

SEQ ID NO: 3018170 - protein, 26 aa, Entamoeba invadens
SSFEIPLLYVNFFNSFYNFGTTVDVY

SEQ ID NO: 3018171 - protein, 23 aa, Entamoeba invadens
SSFEYLPHLRTLFKSIGSSYKAV

SEQ ID NO: 3018172 - protein, 19 aa, Entamoeba invadens
SSFFSSYSPVTCKVNEVDV

SEQ ID NO: 3018173 - protein, 20 aa, Entamoeba invadens
SSFHTSYFLAVRLHHSFIFI

SEQ ID NO: 3018174 - protein, 19 aa, Entamoeba invadens
SSFKKELPATLLFSKFVVS

SEQ ID NO: 3018175 - protein, 28 aa, Entamoeba invadens
SSFKSHFNNIFMVIKKIPTGMVGDGSAQ

SEQ ID NO: 3018176 - protein, 24 aa, Entamoeba invadens
SSFNPRTMLFHPTLPLLVVAGNKG

SEQ ID NO: 3018177 - protein, 24 aa, Entamoeba invadens
SSFRREFEFEYFNNAELNVMDLKF

SEQ ID NO: 3018178 - protein, 26 aa, Entamoeba invadens
SSFVQFLEALFFYEKRKFTEAQYALS

SEQ ID NO: 3018179 - protein, 29 aa, Entamoeba invadens
SSGKGQLKHFIPLIWAKGGLFLDKILYLR

SEQ ID NO: 3018180 - protein, 26 aa, Entamoeba invadens
SSGKPILNYDLFPLFSIILSSEIGKV

SEQ ID NO: 3018181 - protein, 21 aa, Entamoeba invadens
SSGLFCDLLWSDPYVPEIDNT

SEQ ID NO: 3018182 - protein, 23 aa, Entamoeba invadens
SSGNGALAFRLIMNYKIDPKSVD

SEQ ID NO: 3018183 - protein, 23 aa, Entamoeba invadens
SSGSHFIPNTYPITYTDFSDTKD

SEQ ID NO: 3018184 - protein, 31 aa, Entamoeba invadens
SSGVEFTIFFCMWWDMFYIKSLDESYDKIQN

SEQ ID NO: 3018185 - protein, 30 aa, Entamoeba invadens
SSGVSRFLLALVKIGLIKSPTLLLGTERMR

SEQ ID NO: 3018186 - protein, 18 aa, Entamoeba invadens
SSGYFPMNEYRHYGLACD

SEQ ID NO: 3018187 - protein, 27 aa, Entamoeba invadens
SSHISNFVSILYFTLRALRLATSMTFL

SEQ ID NO: 3018188 - protein, 18 aa, Entamoeba invadens
SSHLAYYGESSMYATDCS

SEQ ID NO: 3018189 - protein, 23 aa, Entamoeba invadens
SSHLVLQRRIVALGFPIAEQSSL

SEQ ID NO: 3018190 - protein, 34 aa, Entamoeba invadens
SSHPLYYKRTPICIIVYFFVYCYSVNTNGILKVI

SEQ ID NO: 3018191 - protein, 24 aa, Entamoeba invadens
SSIELFLVLLDYYEDQEESKNKFA

SEQ ID NO: 3018192 - protein, 24 aa, Entamoeba invadens
SSIELMWTIYRRWDEYVKYLISLQ

SEQ ID NO: 3018193 - protein, 29 aa, Entamoeba invadens
SSIGCALYLSLLLEPKWRKSQIDVNHKKH

SEQ ID NO: 3018194 - protein, 18 aa, Entamoeba invadens
SSIIIRLVSDFFVRDYDP

SEQ ID NO: 3018195 - protein, 24 aa, Entamoeba invadens
SSIIPAWLKLFNNANQTKISYIVG

SEQ ID NO: 3018196 - protein, 25 aa, Entamoeba invadens
SSIKLSELILYIRDNNGFKPYSLSD

SEQ ID NO: 3018197 - protein, 28 aa, Entamoeba invadens
SSIKMTDVMAFLPLVIQRYLNIANDKNY

SEQ ID NO: 3018198 - protein, 20 aa, Entamoeba invadens
SSILFVYDLGTSTSDCRWID

SEQ ID NO: 3018199 - protein, 21 aa, Entamoeba invadens
SSINDFLYLQLVTKKYENILS

SEQ ID NO: 3018200 - protein, 27 aa, Entamoeba invadens
SSISDLPFRLVLYPPTANTLTLLSNLH

SEQ ID NO: 3018201 - protein, 17 aa, Entamoeba invadens
SSITIPTSITSIGEGCF

SEQ ID NO: 3018202 - protein, 18 aa, Entamoeba invadens
SSITLNFQIGNIIEMLII

SEQ ID NO: 3018203 - protein, 20 aa, Entamoeba invadens
SSITLNFQIGNKIEMLIIKN

SEQ ID NO: 3018204 - protein, 34 aa, Entamoeba invadens
SSIYPIPNLMLLCDFSLPILFASLPVNLILDVFE

SEQ ID NO: 3018205 - protein, 32 aa, Entamoeba invadens
SSKASKRYFVKELPWVLAIQIKRFGWDERKIN

SEQ ID NO: 3018206 - protein, 24 aa, Entamoeba invadens
SSKCLSCSILNRCTLCDNTTPNKC

SEQ ID NO: 3018207 - protein, 35 aa, Entamoeba invadens
SSKETLECIIVQQFNKFVPFMKAYKQFVSNNENAF

SEQ ID NO: 3018208 - protein, 48 aa, Entamoeba invadens
SSKFNFDAISLRWPNLTKLIIRKCGVPSIPPFIFTKENFPHLKILDLQ

SEQ ID NO: 3018209 - protein, 27 aa, Entamoeba invadens
SSKIFCLGDFFLFYKTHEIFDKSVCEK

SEQ ID NO: 3018210 - protein, 24 aa, Entamoeba invadens
SSKKLIRSIIRQQLNKYDLLDAVK

SEQ ID NO: 3018211 - protein, 24 aa, Entamoeba invadens
SSKKYEYPILQNCLKLTSVDLGDL

SEQ ID NO: 3018212 - protein, 29 aa, Entamoeba invadens
SSKKYKEQAIWFLNAYWAENGEAVAEKVW

SEQ ID NO: 3018213 - protein, 35 aa, Entamoeba invadens
SSKNKLFTLNAVSQFLLSNYAFFDEVTEFSRNVNA

SEQ ID NO: 3018214 - protein, 22 aa, Entamoeba invadens
SSKNVFCFLEFARHSSALNAMK

SEQ ID NO: 3018215 - protein, 24 aa, Entamoeba invadens
SSKTQVMVKLYFQICGYEGVSATY

SEQ ID NO: 3018216 - protein, 23 aa, Entamoeba invadens
SSKVVLDFFAFWSNPINTVERIQ

SEQ ID NO: 3018217 - protein, 21 aa, Entamoeba invadens
SSLCYKKFLGVVISLGNYMNG

SEQ ID NO: 3018218 - protein, 45 aa, Entamoeba invadens
SSLDINEMFYHRYSKYYYIDWKTKQLFYHIGPIENTPRVLKELSY

SEQ ID NO: 3018219 - protein, 24 aa, Entamoeba invadens
SSLESSIVLPYLEKGKSLEMTLTR

SEQ ID NO: 3018220 - protein, 25 aa, Entamoeba invadens
SSLFVPKIDRVLLDLVIKEKKKTRK

SEQ ID NO: 3018221 - protein, 25 aa, Entamoeba invadens
SSLHKDVLPHFIKLLRGRFGQDIYN

SEQ ID NO: 3018222 - protein, 36 aa, Entamoeba invadens
SSLHLLANILGNEITLAYLIPALDKYLYDYDDIKQV

SEQ ID NO: 3018223 - protein, 25 aa, Entamoeba invadens
SSLILPNTPILFMKDCFHNLVSLTS

SEQ ID NO: 3018224 - protein, 20 aa, Entamoeba invadens
SSLISNLLPVIRKLYVSENE

SEQ ID NO: 3018225 - protein, 26 aa, Entamoeba invadens
SSLKVRPMFDCIVTDPPYGIREGARK

SEQ ID NO: 3018226 - protein, 29 aa, Entamoeba invadens
SSLKYLTALVFFFANYTYMKFIITTPIDV

SEQ ID NO: 3018227 - protein, 29 aa, Entamoeba invadens
SSLLKIVTPLLTRRPLLITNATIYDINEM

SEQ ID NO: 3018228 - protein, 21 aa, Entamoeba invadens
SSLLKTIWEVIQANSFCLTNG

SEQ ID NO: 3018229 - protein, 18 aa, Entamoeba invadens
SSLPLFKIVHIKNDEFLF

SEQ ID NO: 3018230 - protein, 33 aa, Entamoeba invadens
SSLPYQTLSTIFFLYLYSLNIPLLPIDDIDKLA

SEQ ID NO: 3018231 - protein, 23 aa, Entamoeba invadens
SSLQQFNALMKMYEQMKNEKETM

SEQ ID NO: 3018232 - protein, 18 aa, Entamoeba invadens
SSLSLDFADLYTYVTNLK

SEQ ID NO: 3018233 - protein, 21 aa, Entamoeba invadens
SSLTAIALPTTLTKVRNFMFK

SEQ ID NO: 3018234 - protein, 25 aa, Entamoeba invadens
SSLTKLYLFECTKLTFLQNSSTMES

SEQ ID NO: 3018235 - protein, 19 aa, Entamoeba invadens
SSLVFLYKNIEEEDVFSSV

SEQ ID NO: 3018236 - protein, 19 aa, Entamoeba invadens
SSLWGFKMPMNMLDLSLSE

SEQ ID NO: 3018237 - protein, 26 aa, Entamoeba invadens
SSLYLKGNFMDLLHFKFNEKITSFQM

SEQ ID NO: 3018238 - protein, 17 aa, Entamoeba invadens
SSLYYSLRGNFVGVVSD

SEQ ID NO: 3018239 - protein, 23 aa, Entamoeba invadens
SSMEFLEKITLLENLYDTKEKSF

SEQ ID NO: 3018240 - protein, 17 aa, Entamoeba invadens
SSMIIPSSVTYIGDGCF

SEQ ID NO: 3018241 - protein, 17 aa, Entamoeba invadens
SSMQFRAKLFLPMYIEG

SEQ ID NO: 3018242 - protein, 24 aa, Entamoeba invadens
SSMTYGQHDFSWTSPSLPSTEKKD

SEQ ID NO: 3018243 - protein, 28 aa, Entamoeba invadens
SSNAWTSFSIALWYYGFTKIQGHHRLLA

SEQ ID NO: 3018244 - protein, 21 aa, Entamoeba invadens
SSNCLKCKMPYTLNGENCFDC

SEQ ID NO: 3018245 - protein, 27 aa, Entamoeba invadens
SSNEPAMYRALFNYTATDRMELSFKKG

SEQ ID NO: 3018246 - protein, 20 aa, Entamoeba invadens
SSNFIIFTRVTKGNFKEIVP

SEQ ID NO: 3018247 - protein, 23 aa, Entamoeba invadens
SSNGQWWEGELNGTVGIFPANYV

SEQ ID NO: 3018248 - protein, 26 aa, Entamoeba invadens
SSNLSFKGLFRFTPYADSKEIDQVTR

SEQ ID NO: 3018249 - protein, 17 aa, Entamoeba invadens
SSNNLCLTFLQNILITF

SEQ ID NO: 3018250 - protein, 20 aa, Entamoeba invadens
SSNPFNTFFAVGLNVSLSTD

SEQ ID NO: 3018251 - protein, 26 aa, Entamoeba invadens
SSNSETLIFPFLKDVGMYSSKFESKA

SEQ ID NO: 3018252 - protein, 17 aa, Entamoeba invadens
SSNWYLIHTNDPCAIFD

SEQ ID NO: 3018253 - protein, 18 aa, Entamoeba invadens
SSNYVACHFARILKKHLL

SEQ ID NO: 3018254 - protein, 25 aa, Entamoeba invadens
SSNYVACHFARILKKHLLTENNLGV

SEQ ID NO: 3018255 - protein, 24 aa, Entamoeba invadens
SSPEPLVVPLYRGARFNCFEDIMA

SEQ ID NO: 3018256 - protein, 30 aa, Entamoeba invadens
SSPFPQLCISPVTLLIPYVSQLYGIEVPDF

SEQ ID NO: 3018257 - protein, 31 aa, Entamoeba invadens
SSPIKRVVLSPLTLVLPFLSNFSVFKCFPER

SEQ ID NO: 3018258 - protein, 24 aa, Entamoeba invadens
SSQFGHFWMKFTCTGKSAHASEPE

SEQ ID NO: 3018259 - protein, 24 aa, Entamoeba invadens
SSQIAKIFISLDSVLTAALAQDIL

SEQ ID NO: 3018260 - protein, 26 aa, Entamoeba invadens
SSQLKSIRRFCYPRLLTTVNPVAFLQ

SEQ ID NO: 3018261 - protein, 19 aa, Entamoeba invadens
SSQNFFLFSMNKNCSYKLK

SEQ ID NO: 3018262 - protein, 26 aa, Entamoeba invadens
SSQSLYDTFYKHTWKVNTVIFIVADN

SEQ ID NO: 3018263 - protein, 17 aa, Entamoeba invadens
SSQTIFRHVPFTVEFSA

SEQ ID NO: 3018264 - protein, 24 aa, Entamoeba invadens
SSQVILRMLLMEGTTSRYKKSLVK

SEQ ID NO: 3018265 - protein, 23 aa, Entamoeba invadens
SSQYFDRIYDCAIELIKRGKAYV

SEQ ID NO: 3018266 - protein, 20 aa, Entamoeba invadens
SSRCTFALFKNMLEVGMTNV

SEQ ID NO: 3018267 - protein, 21 aa, Entamoeba invadens
SSRFYIVEIITLLCDPNSSQN

SEQ ID NO: 3018268 - protein, 24 aa, Entamoeba invadens
SSRGKLTDLLINLAFEEIEKTNCH

SEQ ID NO: 3018269 - protein, 24 aa, Entamoeba invadens
SSRTYFTTFVKTHSPNLLKYHNVL

SEQ ID NO: 3018270 - protein, 20 aa, Entamoeba invadens
SSSAPIFFDSYEGYLDGALF

SEQ ID NO: 3018271 - protein, 23 aa, Entamoeba invadens
SSSDEYTIFSKTLIRFVDVHSCV

SEQ ID NO: 3018272 - protein, 25 aa, Entamoeba invadens
SSSDKKPIFLFEKDIRQILNELSLS

SEQ ID NO: 3018273 - protein, 27 aa, Entamoeba invadens
SSSEKDMLFIVTSAFWMKTDGKVTFNN

SEQ ID NO: 3018274 - protein, 18 aa, Entamoeba invadens
SSSHLLKTDPKTAFYSGF

SEQ ID NO: 3018275 - protein, 17 aa, Entamoeba invadens
SSSIIFSILFSMRLTRE

SEQ ID NO: 3018276 - protein, 24 aa, Entamoeba invadens
SSSPNFLFDIVPKDQLEKPQSIKN

SEQ ID NO: 3018277 - protein, 24 aa, Entamoeba invadens
SSSTLLVFPPLPNPFGYNIKNLAN

SEQ ID NO: 3018278 - protein, 20 aa, Entamoeba invadens
SSTCISCDFGLYLEDDGNCV

SEQ ID NO: 3018279 - protein, 24 aa, Entamoeba invadens
SSTCNNLFLLPPYESKEELKEKLT

SEQ ID NO: 3018280 - protein, 23 aa, Entamoeba invadens
SSTELLMLQTLTQLSITPPTLIT

SEQ ID NO: 3018281 - protein, 23 aa, Entamoeba invadens
SSTGQLLTVLPYSSITANELNKI

SEQ ID NO: 3018282 - protein, 35 aa, Entamoeba invadens
SSTGRYLFCGYDDLGCLWWDVLKGDYITRLTGHEN

SEQ ID NO: 3018283 - protein, 26 aa, Entamoeba invadens
SSTPDQINFLKLKFLATSYSNEDPHL

SEQ ID NO: 3018284 - protein, 27 aa, Entamoeba invadens
SSTPLFNNLLGGKLYRAYLNSNNVDTS

SEQ ID NO: 3018285 - protein, 27 aa, Entamoeba invadens
SSTTEYMIFACVFEALRFTTRGWETMD

SEQ ID NO: 3018286 - protein, 23 aa, Entamoeba invadens
SSTTFPFILTQPTTPLSITISSQ

SEQ ID NO: 3018287 - protein, 19 aa, Entamoeba invadens
SSTVPLFLSQCFEIFNMYN

SEQ ID NO: 3018288 - protein, 19 aa, Entamoeba invadens
SSVALMEKALYELYAIFLI

SEQ ID NO: 3018289 - protein, 27 aa, Entamoeba invadens
SSVEFLRRRAIFIFNSRLVNSFNSNTS

SEQ ID NO: 3018290 - protein, 20 aa, Entamoeba invadens
SSVFLMLGIFEGCEKLKNIS

SEQ ID NO: 3018291 - protein, 24 aa, Entamoeba invadens
SSVGTRFMLLLLGLKVIQLSQKEK

SEQ ID NO: 3018292 - protein, 18 aa, Entamoeba invadens
SSVIIPLSVISIGNFCFC

SEQ ID NO: 3018293 - protein, 23 aa, Entamoeba invadens
SSVIIPLSVISIGQWCFCGCGNL

SEQ ID NO: 3018294 - protein, 17 aa, Entamoeba invadens
SSVIIPPSVISIGKACF

SEQ ID NO: 3018295 - protein, 18 aa, Entamoeba invadens
SSVIIPPSVLSIGKACFC

SEQ ID NO: 3018296 - protein, 17 aa, Entamoeba invadens
SSVIIPSSVLSLGNRCF

SEQ ID NO: 3018297 - protein, 23 aa, Entamoeba invadens
SSVIVPKLLKISSPKFGPILPVT

SEQ ID NO: 3018298 - protein, 22 aa, Entamoeba invadens
SSVKFPLHLLSIENSAFYCCKE

SEQ ID NO: 3018299 - protein, 25 aa, Entamoeba invadens
SSVKLPPLKVIPNGTFYDCGFEEFV

SEQ ID NO: 3018300 - protein, 24 aa, Entamoeba invadens
SSVKRVLPKFNSSKILLETKPRKN

SEQ ID NO: 3018301 - protein, 26 aa, Entamoeba invadens
SSVKRYLPQGIWYDYKTYEVSKSGFV

SEQ ID NO: 3018302 - protein, 24 aa, Entamoeba invadens
SSVLKRFFRNLPQKIFNKQLTDRA

SEQ ID NO: 3018303 - protein, 24 aa, Entamoeba invadens
SSVNIPLNETSIGYFCFRGCSNLT

SEQ ID NO: 3018304 - protein, 23 aa, Entamoeba invadens
SSVNMLVYLWENVTNKEVILASL

SEQ ID NO: 3018305 - protein, 18 aa, Entamoeba invadens
SSVTIPLSVISIGNFCFC

SEQ ID NO: 3018306 - protein, 17 aa, Entamoeba invadens
SSVTIPLSVTSIGYYCF

SEQ ID NO: 3018307 - protein, 18 aa, Entamoeba invadens
SSVTIPPSVISIGCQCFY

SEQ ID NO: 3018308 - protein, 22 aa, Entamoeba invadens
SSVTLPLLIKEIKEWTFNHCFS

SEQ ID NO: 3018309 - protein, 24 aa, Entamoeba invadens
SSVVNTDWLLETYCGFIISGNEVM

SEQ ID NO: 3018310 - protein, 25 aa, Entamoeba invadens
SSVYNKLCITVGLGFDSFVVMRHGD

SEQ ID NO: 3018311 - protein, 20 aa, Entamoeba invadens
SSVYQYLLTQLMQLQKQTVD

SEQ ID NO: 3018312 - protein, 24 aa, Entamoeba invadens
SSWCNPFCVFLDKGMEIKTTHDNN

SEQ ID NO: 3018313 - protein, 27 aa, Entamoeba invadens
SSWISATEWLLRVLTGGLFSPLMAKPV

SEQ ID NO: 3018314 - protein, 21 aa, Entamoeba invadens
SSYGLEMGISFLPSLPVDTTS

SEQ ID NO: 3018315 - protein, 26 aa, Entamoeba invadens
SSYTPKFLMQPPPSKGIPLFTPNSKS

SEQ ID NO: 3018316 - protein, 30 aa, Entamoeba invadens
STADSELDRLFLDKYKPLKFLGKGSYATVR

SEQ ID NO: 3018317 - protein, 23 aa, Entamoeba invadens
STAFRPEILNGFVKGDMPSGEEK

SEQ ID NO: 3018318 - protein, 20 aa, Entamoeba invadens
STALEILGHIKCEFEVAMTK

SEQ ID NO: 3018319 - protein, 25 aa, Entamoeba invadens
STARSPIACLASLVKNAWAKDVGLA

SEQ ID NO: 3018320 - protein, 19 aa, Entamoeba invadens
STAVVFLAFDLKTGRKYAI

SEQ ID NO: 3018321 - protein, 20 aa, Entamoeba invadens
STCFMNCRALSTIKLPSKFV

SEQ ID NO: 3018322 - protein, 20 aa, Entamoeba invadens
STCILCSTGFLLDENNNCVA

SEQ ID NO: 3018323 - protein, 20 aa, Entamoeba invadens
STCLKCLDSFVKYTDTWCVS

SEQ ID NO: 3018324 - protein, 20 aa, Entamoeba invadens
STCLLCNSNYFLANGVCQQT

SEQ ID NO: 3018325 - protein, 23 aa, Entamoeba invadens
STCVRLGPFIPRLMTYLKQVEFY

SEQ ID NO: 3018326 - protein, 24 aa, Entamoeba invadens
STDELLRQLFFSTPSPLLNAYCDG

SEQ ID NO: 3018327 - protein, 26 aa, Entamoeba invadens
STDFCFDDVLNGRYYLQCFTEEWGWF

SEQ ID NO: 3018328 - protein, 26 aa, Entamoeba invadens
STDFIQLILFAILNCKKTPKMCTKLL

SEQ ID NO: 3018329 - protein, 18 aa, Entamoeba invadens
STDFSVVLVNKKTKAWLM

SEQ ID NO: 3018330 - protein, 19 aa, Entamoeba invadens
STDFVLYGTCPYYVDVPKV

SEQ ID NO: 3018331 - protein, 30 aa, Entamoeba invadens
STDHPPLARDLFNFAFFASWEESPENTKKL

SEQ ID NO: 3018332 - protein, 26 aa, Entamoeba invadens
STDHSPLARDLFNYAFLASWQDSTEN

SEQ ID NO: 3018333 - protein, 18 aa, Entamoeba invadens
STDIVNSLHMKKLDKEKK

SEQ ID NO: 3018334 - protein, 25 aa, Entamoeba invadens
STDLHYFLIGLLSRKKIFKQWGCED

SEQ ID NO: 3018335 - protein, 26 aa, Entamoeba invadens
STDLLDLFAFLLSLLSNEAIALSITC

SEQ ID NO: 3018336 - protein, 21 aa, Entamoeba invadens
STDRIYVLPPTDNTTLLIPYI

SEQ ID NO: 3018337 - protein, 23 aa, Entamoeba invadens
STDSFLFSFKEGNREPIVMDRVE

SEQ ID NO: 3018338 - protein, 29 aa, Entamoeba invadens
STDVSSYPVIIFNIGFYLPDDFVNYRHVV

SEQ ID NO: 3018339 - protein, 28 aa, Entamoeba invadens
STEDFPVVFLPYTLSNDLLKPLSARVTL

SEQ ID NO: 3018340 - protein, 27 aa, Entamoeba invadens
STEEKKWINTYNKLILRDILPHVESAK

SEQ ID NO: 3018341 - protein, 31 aa, Entamoeba invadens
STEELFRKAFFYSNTLLYAYSDALLKHDVVE

SEQ ID NO: 3018342 - protein, 25 aa, Entamoeba invadens
STEFSACMPFLFRYNTFLSQHASQF

SEQ ID NO: 3018343 - protein, 21 aa, Entamoeba invadens
STEHLLPPEVKLYTTLHLKVD

SEQ ID NO: 3018344 - protein, 20 aa, Entamoeba invadens
STEISEKLFFNCIDLEIVKN

SEQ ID NO: 3018345 - protein, 37 aa, Entamoeba invadens
STEKVQININFKLPYFLKTWLRFIHLCGSPAQLQDAA

SEQ ID NO: 3018346 - protein, 25 aa, Entamoeba invadens
STELFYQTYPTDKVLYLVQWQNFSL

SEQ ID NO: 3018347 - protein, 23 aa, Entamoeba invadens
STEPEIVSLKRSEVDWLLVMSDG

SEQ ID NO: 3018348 - protein, 26 aa, Entamoeba invadens
STEVQSVYRMLLWKTFLNAMNDNATH

SEQ ID NO: 3018349 - protein, 32 aa, Entamoeba invadens
STFADLYRATFQRICSYLSYTDLKNLSCSSKQ

SEQ ID NO: 3018350 - protein, 26 aa, Entamoeba invadens
STFALRNFMKLILPNNIHEIHENCFS

SEQ ID NO: 3018351 - protein, 23 aa, Entamoeba invadens
STFDYLLMELANSGKRSGEDPEE

SEQ ID NO: 3018352 - protein, 23 aa, Entamoeba invadens
STFKTQFNHVFLVVGFDLDQSNI

SEQ ID NO: 3018353 - protein, 20 aa, Entamoeba invadens
STFNVFPFTASVNNKIFCVH

SEQ ID NO: 3018354 - protein, 33 aa, Entamoeba invadens
STFTKYLTYYTTYMNIYLPLKTFYESDSNKSIV

SEQ ID NO: 3018355 - protein, 24 aa, Entamoeba invadens
STGAFLLFEYFKHCILEMYPELPV

SEQ ID NO: 3018356 - protein, 25 aa, Entamoeba invadens
STGDPDLFVMNLLKEFSEKTGEVQT

SEQ ID NO: 3018357 - protein, 21 aa, Entamoeba invadens
STGFHVIDCGVPLLAMHSIRE

SEQ ID NO: 3018358 - protein, 25 aa, Entamoeba invadens
STGLDVLHNLTYLRYVDLSYTAVDD

SEQ ID NO: 3018359 - protein, 28 aa, Entamoeba invadens
STGLFIMNQFYIQAFMYPEKYGICTAET

SEQ ID NO: 3018360 - protein, 33 aa, Entamoeba invadens
STGPLAIKRRKLVYFGLLIPIGDVFGAEKSIPR

SEQ ID NO: 3018361 - protein, 25 aa, Entamoeba invadens
STGSLGLQFPSLSGSTLGSLNNGMS

SEQ ID NO: 3018362 - protein, 22 aa, Entamoeba invadens
STGVVQFQWLKRPMQVTCRFYQ

SEQ ID NO: 3018363 - protein, 40 aa, Entamoeba invadens
STHLDLRSYLIMPVQRLPRYQLLLVDLFKNTPKDHEDYPS

SEQ ID NO: 3018364 - protein, 25 aa, Entamoeba invadens
STHNFNLLCDLLTSVFITFIPQVKK

SEQ ID NO: 3018365 - protein, 23 aa, Entamoeba invadens
STHQKFLYMFEKAKILFEKGEFP

SEQ ID NO: 3018366 - protein, 20 aa, Entamoeba invadens
STHQTLPTTLILKSSDSQKH

SEQ ID NO: 3018367 - protein, 27 aa, Entamoeba invadens
STIAKLIEKLTPPPPPPPPVAPIDPEK

SEQ ID NO: 3018368 - protein, 21 aa, Entamoeba invadens
STIDSTFVVSYLFTTSDGTSC

SEQ ID NO: 3018369 - protein, 24 aa, Entamoeba invadens
STIKKYCHGVFDQLYRATIGVDFA

SEQ ID NO: 3018370 - protein, 31 aa, Entamoeba invadens
STILYESQGLVPLLRLAWNRFDANYIATFSA

SEQ ID NO: 3018371 - protein, 24 aa, Entamoeba invadens
STINIMKTLSWIEKLKTILETVKK

SEQ ID NO: 3018372 - protein, 27 aa, Entamoeba invadens
STIQIQMFSIFFDKDLKVPKLSFYTSP

SEQ ID NO: 3018373 - protein, 25 aa, Entamoeba invadens
STIRKYCHGVFDQLYRPTIGVDFAV

SEQ ID NO: 3018374 - protein, 21 aa, Entamoeba invadens
STIVGHGFSFGLSSFNNYPVF

SEQ ID NO: 3018375 - protein, 17 aa, Entamoeba invadens
STIWCNDTFYIKGESCN

SEQ ID NO: 3018376 - protein, 25 aa, Entamoeba invadens
STKCKSVLGAVLLSAGLTTDVAINN

SEQ ID NO: 3018377 - protein, 26 aa, Entamoeba invadens
STKESLFTLIKHKVGTFTPPKRTPCI

SEQ ID NO: 3018378 - protein, 17 aa, Entamoeba invadens
STKFFDVGKGDIKIWRN

SEQ ID NO: 3018379 - protein, 17 aa, Entamoeba invadens
STKPLLVIDFKDVSDLK

SEQ ID NO: 3018380 - protein, 30 aa, Entamoeba invadens
STKQQNEATLAEKILQFANIENAQKELQDA

SEQ ID NO: 3018381 - protein, 24 aa, Entamoeba invadens
STKSNFFIFGRDKIIRPYKSDFNA

SEQ ID NO: 3018382 - protein, 30 aa, Entamoeba invadens
STKTVKLVELFFKYIRILNSIRPKEDQEKM

SEQ ID NO: 3018383 - protein, 25 aa, Entamoeba invadens
STKTYLKVKLSLFSTIYPTSSETYK

SEQ ID NO: 3018384 - protein, 18 aa, Entamoeba invadens
STLDPVWNKSFDFQVTPG

SEQ ID NO: 3018385 - protein, 22 aa, Entamoeba invadens
STLDWYNALEKCAIELNKKVDE

SEQ ID NO: 3018386 - protein, 36 aa, Entamoeba invadens
STLFKQKCILSYGPCQFPVLFSCYKDFTNDANAILQ

SEQ ID NO: 3018387 - protein, 33 aa, Entamoeba invadens
STLIFQKVKHMLPFSLEIFLSQTALLHTVKCGE

SEQ ID NO: 3018388 - protein, 23 aa, Entamoeba invadens
STLKHLLKELPVPLIPKNMNDKI

SEQ ID NO: 3018389 - protein, 19 aa, Entamoeba invadens
STLKHVLLGNLGVGKTCIA

SEQ ID NO: 3018390 - protein, 28 aa, Entamoeba invadens
STLKKADKYLFFYNKKLTKIETNGVDRD

SEQ ID NO: 3018391 - protein, 17 aa, Entamoeba invadens
STLKRFVRELPGMLFCN

SEQ ID NO: 3018392 - protein, 17 aa, Entamoeba invadens
STLLPLFEQIHTEMSEY

SEQ ID NO: 3018393 - protein, 31 aa, Entamoeba invadens
STLLQLIVNDIYLKFFKINIPEGSKPVDSPL

SEQ ID NO: 3018394 - protein, 24 aa, Entamoeba invadens
STLLTCYGAFWIEKSGVINFNFVM

SEQ ID NO: 3018395 - protein, 17 aa, Entamoeba invadens
STLLTIKKKQAEIEEKV

SEQ ID NO: 3018396 - protein, 21 aa, Entamoeba invadens
STLMKLQAKTKEKILRNAGHQ

SEQ ID NO: 3018397 - protein, 23 aa, Entamoeba invadens
STLNLPKITNKTPQLDIIQMIRN

SEQ ID NO: 3018398 - protein, 24 aa, Entamoeba invadens
STLPSFMLPILLEITKKYAHDEAI

SEQ ID NO: 3018399 - protein, 27 aa, Entamoeba invadens
STLQTILPSLSLTRLAFCFLNEVSTQI

SEQ ID NO: 3018400 - protein, 18 aa, Entamoeba invadens
STLQWDRTLLINEQSFSA

SEQ ID NO: 3018401 - protein, 31 aa, Entamoeba invadens
STLRIMEIVQHTKPYHAVVKTDLFRGENVFV

SEQ ID NO: 3018402 - protein, 20 aa, Entamoeba invadens
STLYIVFELVDGGDLFHLLE

SEQ ID NO: 3018403 - protein, 21 aa, Entamoeba invadens
STMELIIKNINFINLLKTEYG

SEQ ID NO: 3018404 - protein, 23 aa, Entamoeba invadens
STMKLITHRFKFDDFDAAMKLFM

SEQ ID NO: 3018405 - protein, 18 aa, Entamoeba invadens
STMTGFRDKCFFGCVSLK

SEQ ID NO: 3018406 - protein, 23 aa, Entamoeba invadens
STMYRVKWPGTIDVFVSDEVYNF

SEQ ID NO: 3018407 - protein, 26 aa, Entamoeba invadens
STNDGFCFFWDLKMLKCSKVRVDKVN

SEQ ID NO: 3018408 - protein, 33 aa, Entamoeba invadens
STNEGFLYPMTDCFIFLYKRIKIAPFKEINSVD

SEQ ID NO: 3018409 - protein, 22 aa, Entamoeba invadens
STNEILVIHLKRFGSVGGSVRD

SEQ ID NO: 3018410 - protein, 23 aa, Entamoeba invadens
STNEYFIRQLLIKHFGLTHHNMI

SEQ ID NO: 3018411 - protein, 20 aa, Entamoeba invadens
STNLELIFYSSFDGFDPRDF

SEQ ID NO: 3018412 - protein, 23 aa, Entamoeba invadens
STNLYYCLSVMLHAFKNEMVPYH

SEQ ID NO: 3018413 - protein, 30 aa, Entamoeba invadens
STNQGYYIQAGLNWFFTGASQLQYPQNYEK

SEQ ID NO: 3018414 - protein, 26 aa, Entamoeba invadens
STNTFIQDILLLHNKKFFDGFFEFSD

SEQ ID NO: 3018415 - protein, 18 aa, Entamoeba invadens
STNTLPHLIISRAEIDGV

SEQ ID NO: 3018416 - protein, 30 aa, Entamoeba invadens
STPAATTTTPLFTLNLDTNTAAAPASTTTT

SEQ ID NO: 3018417 - protein, 22 aa, Entamoeba invadens
STPCIPFIGTYLTDYTFLDDGN

SEQ ID NO: 3018418 - protein, 33 aa, Entamoeba invadens
STPDVIFICVKYYSLPQIIPFINRIAKEDTIVI

SEQ ID NO: 3018419 - protein, 32 aa, Entamoeba invadens
STPIQKIVILFPKLETLYLPYEVDYDLSFLEN

SEQ ID NO: 3018420 - protein, 23 aa, Entamoeba invadens
STPITILFDMLLSTLPKETRLII

SEQ ID NO: 3018421 - protein, 31 aa, Entamoeba invadens
STPPSVFVRFVGLHPIIALSPNLIFAICHYF

SEQ ID NO: 3018422 - protein, 26 aa, Entamoeba invadens
STPQMRTTVIVNPLLRESTATRKLQN

SEQ ID NO: 3018423 - protein, 23 aa, Entamoeba invadens
STQDRLMVLKDLTTNYLQKFDKN

SEQ ID NO: 3018424 - protein, 28 aa, Entamoeba invadens
STQIAPITPFELPILKKGKSYKYNKRSA

SEQ ID NO: 3018425 - protein, 19 aa, Entamoeba invadens
STQLLRMISFVATRSHYFT

SEQ ID NO: 3018426 - protein, 22 aa, Entamoeba invadens
STQRELFNMRKAEEIKREIVKQ

SEQ ID NO: 3018427 - protein, 27 aa, Entamoeba invadens
STQSVLQWKNEFLRWSTVKAESLKLCI

SEQ ID NO: 3018428 - protein, 22 aa, Entamoeba invadens
STRAYFATFMKKVAPHLHVYHN

SEQ ID NO: 3018429 - protein, 21 aa, Entamoeba invadens
STRFVITPRKRGRLELMYGKE

SEQ ID NO: 3018430 - protein, 22 aa, Entamoeba invadens
STRLNPDLLIKEKKIRKGKFGV

SEQ ID NO: 3018431 - protein, 22 aa, Entamoeba invadens
STRPWLYELSQKYSRDITTIRQ

SEQ ID NO: 3018432 - protein, 24 aa, Entamoeba invadens
STRRRYILTPPYYTYDYGSVTIDM

SEQ ID NO: 3018433 - protein, 29 aa, Entamoeba invadens
STSAIGYLVLDYIIAQLYGKFRDNRVKAI

SEQ ID NO: 3018434 - protein, 22 aa, Entamoeba invadens
STSFEKLFWNEEKRYFVQVIWQ

SEQ ID NO: 3018435 - protein, 19 aa, Entamoeba invadens
STSFIPIKKISLDKDEIDF

SEQ ID NO: 3018436 - protein, 43 aa, Entamoeba invadens
STSIGLLLLNIKRYNQKFLSDIALIFLFLYSTKVRPSAKYFVR

SEQ ID NO: 3018437 - protein, 19 aa, Entamoeba invadens
STSIILFGVGAGCEPTLFL

SEQ ID NO: 3018438 - protein, 25 aa, Entamoeba invadens
STSKFSILLNRDLLNSLAVIATADT

SEQ ID NO: 3018439 - protein, 26 aa, Entamoeba invadens
STSKQRFFVLCDYLFNKYETMEKLRD

SEQ ID NO: 3018440 - protein, 27 aa, Entamoeba invadens
STSMFYNSDFFFGLRGKLRNSNNKPTR

SEQ ID NO: 3018441 - protein, 17 aa, Entamoeba invadens
STSPLGCEALPPSPFLS

SEQ ID NO: 3018442 - protein, 25 aa, Entamoeba invadens
STSPLKYSFYFDFVSNCLGIKALGQ

SEQ ID NO: 3018443 - protein, 29 aa, Entamoeba invadens
STSTKYINIEFIPFLIASIQQQSVQPPQT

SEQ ID NO: 3018444 - protein, 23 aa, Entamoeba invadens
STSTLNFYALTELMIKHSNIIVL

SEQ ID NO: 3018445 - protein, 24 aa, Entamoeba invadens
STTEIIYKYFLSQDGWKSYMLNTK

SEQ ID NO: 3018446 - protein, 24 aa, Entamoeba invadens
STTENLIEFCESKRFYLNNGMCQQ

SEQ ID NO: 3018447 - protein, 28 aa, Entamoeba invadens
STTKPKLFYKVMFTFPITFKQTKKSLQP

SEQ ID NO: 3018448 - protein, 25 aa, Entamoeba invadens
STTMLFVYSYLSRMEFTPISYQPIR

SEQ ID NO: 3018449 - protein, 39 aa, Entamoeba invadens
STTNLHTLKQFYNPKYLQFLPYHFLLAIDSIRDQQPVLS

SEQ ID NO: 3018450 - protein, 25 aa, Entamoeba invadens
STTSFLEANGFREQLYRVLDKDMAT

SEQ ID NO: 3018451 - protein, 23 aa, Entamoeba invadens
STTSLEVFLTKLKVVFADFVNDK

SEQ ID NO: 3018452 - protein, 26 aa, Entamoeba invadens
STTTAAIPSIDFTSLNLGNPASSTTT

SEQ ID NO: 3018453 - protein, 35 aa, Entamoeba invadens
STTTYFVTNPAFEQFFIPLVDFLRTENIVVLFIDS

SEQ ID NO: 3018454 - protein, 39 aa, Entamoeba invadens
STTYLSHFCRCAFADIPIKYLPRHVLIPAFLMDSNTQTN

SEQ ID NO: 3018455 - protein, 22 aa, Entamoeba invadens
STVDAVVQIQITLSPHATRESL

SEQ ID NO: 3018456 - protein, 24 aa, Entamoeba invadens
STVDLREIITPLALFLGGSGGGHA

SEQ ID NO: 3018457 - protein, 18 aa, Entamoeba invadens
STVIFIINFLQTVSRNES

SEQ ID NO: 3018458 - protein, 24 aa, Entamoeba invadens
STVRALRFIDCIIQMLQSTPFTQS

SEQ ID NO: 3018459 - protein, 22 aa, Entamoeba invadens
STWGSLWRYIGIERHATYGYYY

SEQ ID NO: 3018460 - protein, 22 aa, Entamoeba invadens
STWMYSTLPYAEGNLLERCNLE

SEQ ID NO: 3018461 - protein, 25 aa, Entamoeba invadens
STWQDDVIAAFWWDDFCDGDLEDLE

SEQ ID NO: 3018462 - protein, 21 aa, Entamoeba invadens
STYALVVPRRAIWKSEMSAHE

SEQ ID NO: 3018463 - protein, 19 aa, Entamoeba invadens
STYCESNIIIQNCLTYGIS

SEQ ID NO: 3018464 - protein, 28 aa, Entamoeba invadens
STYNYNTFYYIISFLRELLFHSEKNGLT

SEQ ID NO: 3018465 - protein, 25 aa, Entamoeba invadens
SVAAEPLGFSYLRTLMRAVSELTHG

SEQ ID NO: 3018466 - protein, 24 aa, Entamoeba invadens
SVADIFIDFFQLKEVYTVYARYLV

SEQ ID NO: 3018467 - protein, 24 aa, Entamoeba invadens
SVAKDIRYDLLARLTPNATGADIQ

SEQ ID NO: 3018468 - protein, 20 aa, Entamoeba invadens
SVCFMALQVIERLRNQIDER

SEQ ID NO: 3018469 - protein, 19 aa, Entamoeba invadens
SVCLKDFFDLRGIQFSFSS

SEQ ID NO: 3018470 - protein, 18 aa, Entamoeba invadens
SVCRKMSGPLMKCTKCTL

SEQ ID NO: 3018471 - protein, 18 aa, Entamoeba invadens
SVCSSCYDGLYLNNEFEC

SEQ ID NO: 3018472 - protein, 18 aa, Entamoeba invadens
SVCVLFAPPLDDERKKEL

SEQ ID NO: 3018473 - protein, 25 aa, Entamoeba invadens
SVCYNRRIFAYPSAQMGRIIVHDLD

SEQ ID NO: 3018474 - protein, 20 aa, Entamoeba invadens
SVCYNYFLRYQQLKSKALNY

SEQ ID NO: 3018475 - protein, 27 aa, Entamoeba invadens
SVDDEFTKLYKGLFLFVKDELKEEEVV

SEQ ID NO: 3018476 - protein, 22 aa, Entamoeba invadens
SVDEFISAIDDLLRECKATPEE

SEQ ID NO: 3018477 - protein, 24 aa, Entamoeba invadens
SVDFDTVCSLPIDKPSRDLLCVGN

SEQ ID NO: 3018478 - protein, 25 aa, Entamoeba invadens
SVDGPFLFSFAQMIKMRLVINTITG

SEQ ID NO: 3018479 - protein, 32 aa, Entamoeba invadens
SVDIKIQRKLFKTVFLYFQPCKSYAIYMGDQD

SEQ ID NO: 3018480 - protein, 34 aa, Entamoeba invadens
SVDIKVQHKLFKTAFLFFQPFKSYTTYMGDRDET

SEQ ID NO: 3018481 - protein, 22 aa, Entamoeba invadens
SVDIRYFALQTLIIALSRVTEI

SEQ ID NO: 3018482 - protein, 17 aa, Entamoeba invadens
SVDKLHRDCLRGCTALT

SEQ ID NO: 3018483 - protein, 23 aa, Entamoeba invadens
SVDKLIPLFTNMMKFSFKSNSFQ

SEQ ID NO: 3018484 - protein, 22 aa, Entamoeba invadens
SVDLLFSAVFVFSTAFPTQQES

SEQ ID NO: 3018485 - protein, 30 aa, Entamoeba invadens
SVDNIKSYSPHHPIDPKAVKVTTVVEVEDE

SEQ ID NO: 3018486 - protein, 25 aa, Entamoeba invadens
SVDQNPYLLPITSQILIKSSNQAIT

SEQ ID NO: 3018487 - protein, 19 aa, Entamoeba invadens
SVDVITLMAVTKKFYRFTE

SEQ ID NO: 3018488 - protein, 35 aa, Entamoeba invadens
SVDVLEERLVLKTPFFLSLKLFGGKLIPVMQETTE

SEQ ID NO: 3018489 - protein, 25 aa, Entamoeba invadens
SVDYFEFLVFCWMKILVVDEKKTFH

SEQ ID NO: 3018490 - protein, 24 aa, Entamoeba invadens
SVDYYIFKVIKNKYTFKGDVVLYC

SEQ ID NO: 3018491 - protein, 25 aa, Entamoeba invadens
SVEANLFFQVLLAVVFYVGMCGIDH

SEQ ID NO: 3018492 - protein, 17 aa, Entamoeba invadens
SVEGLMVRLWNLSGGEK

SEQ ID NO: 3018493 - protein, 29 aa, Entamoeba invadens
SVEGQIEFTAILFVPQRAPFDMFDAKKKS

SEQ ID NO: 3018494 - protein, 18 aa, Entamoeba invadens
SVEGTLFRVWDTLRGDKI

SEQ ID NO: 3018495 - protein, 25 aa, Entamoeba invadens
SVEIKAPQLLFLSGGKFSVDVHGTV

SEQ ID NO: 3018496 - protein, 25 aa, Entamoeba invadens
SVEILNLILNWVHFKKYKCLFQRNK

SEQ ID NO: 3018497 - protein, 23 aa, Entamoeba invadens
SVEKAWNYIIRKITNEPLVTAQV

SEQ ID NO: 3018498 - protein, 31 aa, Entamoeba invadens
SVEKEKEKIIEKLKLTINEKVELEKTIENQN

SEQ ID NO: 3018499 - protein, 24 aa, Entamoeba invadens
SVEKSLILFPNRDITNIFAVSNCY

SEQ ID NO: 3018500 - protein, 22 aa, Entamoeba invadens
SVELFELWEGLWFMLQETCVEP

SEQ ID NO: 3018501 - protein, 20 aa, Entamoeba invadens
SVELPLIKTFGSYCFYKCIS

SEQ ID NO: 3018502 - protein, 22 aa, Entamoeba invadens
SVENLVYLSKKKGNKSKKEKKE

SEQ ID NO: 3018503 - protein, 20 aa, Entamoeba invadens
SVEPMIFFINKKSGGHFGSD

SEQ ID NO: 3018504 - protein, 28 aa, Entamoeba invadens
SVERIGQFAFFWCRSLLIFNGGDSLENV

SEQ ID NO: 3018505 - protein, 20 aa, Entamoeba invadens
SVERLISKKGTLMRSYLHVV

SEQ ID NO: 3018506 - protein, 37 aa, Entamoeba invadens
SVEVVPISRLDLVFLPKVVVAMLGGVGPLMVCTQVAG

SEQ ID NO: 3018507 - protein, 18 aa, Entamoeba invadens
SVEWNQLVLPSTVKELLV

SEQ ID NO: 3018508 - protein, 19 aa, Entamoeba invadens
SVEWNQLVLPSTVKELLVA

SEQ ID NO: 3018509 - protein, 27 aa, Entamoeba invadens
SVFALIERKVFIVDKLLSHVFKAPSFE

SEQ ID NO: 3018510 - protein, 19 aa, Entamoeba invadens
SVFGRRKRKFYCKKCLNFV

SEQ ID NO: 3018511 - protein, 25 aa, Entamoeba invadens
SVFHLAWGVLFDVTLFVEKSSDFKF

SEQ ID NO: 3018512 - protein, 19 aa, Entamoeba invadens
SVFITFIPQVKKIENIKLD

SEQ ID NO: 3018513 - protein, 18 aa, Entamoeba invadens
SVFLMNALFYLPDVETVE

SEQ ID NO: 3018514 - protein, 26 aa, Entamoeba invadens
SVFLRISEFLFPPLPTVFAFCARQSS

SEQ ID NO: 3018515 - protein, 27 aa, Entamoeba invadens
SVFNEFCTWLQYFVMNKTIPQELFAKL

SEQ ID NO: 3018516 - protein, 24 aa, Entamoeba invadens
SVFNKFFCLIDIGLKKIQSTEELV

SEQ ID NO: 3018517 - protein, 24 aa, Entamoeba invadens
SVFQIMDILAKELNLPNPYANLVG

SEQ ID NO: 3018518 - protein, 18 aa, Entamoeba invadens
SVFQIRSTVVQSLFKNFC

SEQ ID NO: 3018519 - protein, 30 aa, Entamoeba invadens
SVFSQFFPALYALPFPKCPISVVTLSLWIC

SEQ ID NO: 3018520 - protein, 27 aa, Entamoeba invadens
SVFTRIIIHRVFPYIWTPSICLLENSK

SEQ ID NO: 3018521 - protein, 21 aa, Entamoeba invadens
SVFTVPQFQAFLFDCLCVETE

SEQ ID NO: 3018522 - protein, 17 aa, Entamoeba invadens
SVFVLELTPLEAYAATK

SEQ ID NO: 3018523 - protein, 27 aa, Entamoeba invadens
SVGAEPLSVPYFRTLMRATSQLTGGQY

SEQ ID NO: 3018524 - protein, 26 aa, Entamoeba invadens
SVGCIIAEMFLGVPLFPASSEYDLIA

SEQ ID NO: 3018525 - protein, 23 aa, Entamoeba invadens
SVGCILFEMLAGYPPFVSDDSVQ

SEQ ID NO: 3018526 - protein, 19 aa, Entamoeba invadens
SVGCVLWCVLNGREMKEYR

SEQ ID NO: 3018527 - protein, 22 aa, Entamoeba invadens
SVGFYFNYIKGMTFLNQPYTCS

SEQ ID NO: 3018528 - protein, 26 aa, Entamoeba invadens
SVGILCFHHFYKLNKIVFSSNLSSIR

SEQ ID NO: 3018529 - protein, 23 aa, Entamoeba invadens
SVGKTCIIGRFTSKNFDMSYDAT

SEQ ID NO: 3018530 - protein, 23 aa, Entamoeba invadens
SVGTIYIVPLIIGTTYCVTSLNV

SEQ ID NO: 3018531 - protein, 24 aa, Entamoeba invadens
SVGWEHFDIFKPEPNVLLFRRKRN

SEQ ID NO: 3018532 - protein, 25 aa, Entamoeba invadens
SVHFEHFLTLIGQKTKLYGYNGFVG

SEQ ID NO: 3018533 - protein, 28 aa, Entamoeba invadens
SVHNYVFYSFYYPKYQIFCFKDKNYLFY

SEQ ID NO: 3018534 - protein, 27 aa, Entamoeba invadens
SVIASFGGLLFMVYASQSLVSGINMDD

SEQ ID NO: 3018535 - protein, 30 aa, Entamoeba invadens
SVIGKVLFDFGFDLKKVYLAFLEQSRYNPE

SEQ ID NO: 3018536 - protein, 18 aa, Entamoeba invadens
SVIIPINIDILSENYNVP

SEQ ID NO: 3018537 - protein, 18 aa, Entamoeba invadens
SVIKIYKKAMNIPTFIRF

SEQ ID NO: 3018538 - protein, 26 aa, Entamoeba invadens
SVILDAIFGFSFKAPIRGIFKEVIDK

SEQ ID NO: 3018539 - protein, 22 aa, Entamoeba invadens
SVINCPSIVIIPSLFADLAMIV

SEQ ID NO: 3018540 - protein, 23 aa, Entamoeba invadens
SVIQNVVLSLLGAFPPLTLVHGV

SEQ ID NO: 3018541 - protein, 23 aa, Entamoeba invadens
SVIQTMFINTYNLSLHSSIDDIL

SEQ ID NO: 3018542 - protein, 19 aa, Entamoeba invadens
SVIRVVLYSFFVCYSLRED

SEQ ID NO: 3018543 - protein, 23 aa, Entamoeba invadens
SVITAYLRIRGNFAGDLGFDDFK

SEQ ID NO: 3018544 - protein, 23 aa, Entamoeba invadens
SVITLLRFKVVISMDFVINTING

SEQ ID NO: 3018545 - protein, 20 aa, Entamoeba invadens
SVITLPKCLKYIPNSCFFKC

SEQ ID NO: 3018546 - protein, 17 aa, Entamoeba invadens
SVIVTVLSRATKSPSDE

SEQ ID NO: 3018547 - protein, 30 aa, Entamoeba invadens
SVKAFYTAFINFMSFFMAIRSTENFVNAFN

SEQ ID NO: 3018548 - protein, 24 aa, Entamoeba invadens
SVKELTMLSLYSPSSPFSKISSPE

SEQ ID NO: 3018549 - protein, 24 aa, Entamoeba invadens
SVKEQILFFLCNYPTLVKFFKSEK

SEQ ID NO: 3018550 - protein, 18 aa, Entamoeba invadens
SVKIKRLVPDTKDEAIPL

SEQ ID NO: 3018551 - protein, 17 aa, Entamoeba invadens
SVKKFAEAFQMVPRVLA

SEQ ID NO: 3018552 - protein, 24 aa, Entamoeba invadens
SVKLPKGFKKLPYKAFYGAKDLTE

SEQ ID NO: 3018553 - protein, 17 aa, Entamoeba invadens
SVKMYFLSMPEMQKVLE

SEQ ID NO: 3018554 - protein, 23 aa, Entamoeba invadens
SVKRRADFKKGIQGNMFYFGDNK

SEQ ID NO: 3018555 - protein, 26 aa, Entamoeba invadens
SVKRYDFLVQFLPKWGSGWEKLSSDH

SEQ ID NO: 3018556 - protein, 17 aa, Entamoeba invadens
SVKSMYVNSYKLSLKSP

SEQ ID NO: 3018557 - protein, 27 aa, Entamoeba invadens
SVKSWKKRFFVLKNKNLWYFESETSSS

SEQ ID NO: 3018558 - protein, 25 aa, Entamoeba invadens
SVKVGFEKYLLIDGMIDCVFAYYSD

SEQ ID NO: 3018559 - protein, 32 aa, Entamoeba invadens
SVKVRRPKDFNPVLPFISSLSQLMEVGTTKPR

SEQ ID NO: 3018560 - protein, 25 aa, Entamoeba invadens
SVKWSIPDGFSFGYKELENETCVGG

SEQ ID NO: 3018561 - protein, 17 aa, Entamoeba invadens
SVLAEWVPFTKTPKIVA

SEQ ID NO: 3018562 - protein, 23 aa, Entamoeba invadens
SVLEGCDYYEIRTVPSLVTLKRG

SEQ ID NO: 3018563 - protein, 18 aa, Entamoeba invadens
SVLFKNPQKCVFSVNYNL

SEQ ID NO: 3018564 - protein, 19 aa, Entamoeba invadens
SVLFKYIFNVSITQELYLP

SEQ ID NO: 3018565 - protein, 18 aa, Entamoeba invadens
SVLGFILPYVIDSMKHLD

SEQ ID NO: 3018566 - protein, 17 aa, Entamoeba invadens
SVLGPCAFSLCTKLQTV

SEQ ID NO: 3018567 - protein, 27 aa, Entamoeba invadens
SVLGTLFRTDLIHFLPSVLTKCVEIIG

SEQ ID NO: 3018568 - protein, 29 aa, Entamoeba invadens
SVLIGNLLYCMSMKLCFGFPKYVIDEVVD

SEQ ID NO: 3018569 - protein, 27 aa, Entamoeba invadens
SVLKKEFYRIIVWFSVDFETFDRNKSR

SEQ ID NO: 3018570 - protein, 19 aa, Entamoeba invadens
SVLKLNLLVLNKDTNIFFR

SEQ ID NO: 3018571 - protein, 18 aa, Entamoeba invadens
SVLLDVCLRLCETYLLFL

SEQ ID NO: 3018572 - protein, 20 aa, Entamoeba invadens
SVLPLFAISNIRKPKKDMKD

SEQ ID NO: 3018573 - protein, 18 aa, Entamoeba invadens
SVLPMFEMLGIDGVVAIV

SEQ ID NO: 3018574 - protein, 30 aa, Entamoeba invadens
SVLQNMRYFPIIEKTPFLKALVKFYQPSKK

SEQ ID NO: 3018575 - protein, 32 aa, Entamoeba invadens
SVLQNNPIHILRYIPFLFEYSSNIKTLSGSII

SEQ ID NO: 3018576 - protein, 19 aa, Entamoeba invadens
SVLRTYRRLGVATKLLRSA

SEQ ID NO: 3018577 - protein, 20 aa, Entamoeba invadens
SVLSIPFAEGGGCNIIVDAI

SEQ ID NO: 3018578 - protein, 25 aa, Entamoeba invadens
SVLTLRFHMVGVIPIIHTKDVIYAE

SEQ ID NO: 3018579 - protein, 22 aa, Entamoeba invadens
SVMFAFAQKFPSPRLGLIEVVK

SEQ ID NO: 3018580 - protein, 27 aa, Entamoeba invadens
SVMLASLIKFVLGWIRDIPQSLEGAFY

SEQ ID NO: 3018581 - protein, 27 aa, Entamoeba invadens
SVMSKSFSFFVVSLSFDQAYIDKRNAH

SEQ ID NO: 3018582 - protein, 25 aa, Entamoeba invadens
SVNCRYLVVKFPPLLKQNDWFALFK

SEQ ID NO: 3018583 - protein, 34 aa, Entamoeba invadens
SVNFGTNTLAIPNYLFLGCTFLKTVEGIEKITSF

SEQ ID NO: 3018584 - protein, 23 aa, Entamoeba invadens
SVNFKCFITGSLYYGVNLLAKEE

SEQ ID NO: 3018585 - protein, 25 aa, Entamoeba invadens
SVNGKYYYLYKNDSNYWTLSTRFDC

SEQ ID NO: 3018586 - protein, 24 aa, Entamoeba invadens
SVNILLLSKTFSLGIKIFFVSVCF

SEQ ID NO: 3018587 - protein, 23 aa, Entamoeba invadens
SVNNLCSALLLVWDYFEDDYSLP

SEQ ID NO: 3018588 - protein, 19 aa, Entamoeba invadens
SVNPFPPFMTSAYFKHEPA

SEQ ID NO: 3018589 - protein, 35 aa, Entamoeba invadens
SVNSNKFIVFPFKTKFLKILTLTCLQLLVLVRQSN

SEQ ID NO: 3018590 - protein, 21 aa, Entamoeba invadens
SVNYNLVIEVMKNIIDNGKNV

SEQ ID NO: 3018591 - protein, 24 aa, Entamoeba invadens
SVPHFKNYLGLPKHLQRALITFQI

SEQ ID NO: 3018592 - protein, 25 aa, Entamoeba invadens
SVPISTIFKYFVPSTELFYQTYPTD

SEQ ID NO: 3018593 - protein, 21 aa, Entamoeba invadens
SVPKVVWGTEYWMKNFKFEDD

SEQ ID NO: 3018594 - protein, 27 aa, Entamoeba invadens
SVPSTNFLNFVFMPVCLQSLVYTLESL

SEQ ID NO: 3018595 - protein, 23 aa, Entamoeba invadens
SVPTDIELTLRLALDGSKVAEAI

SEQ ID NO: 3018596 - protein, 25 aa, Entamoeba invadens
SVQDKWKWISVLRAVSINSAREKLY

SEQ ID NO: 3018597 - protein, 20 aa, Entamoeba invadens
SVQFGYLWETILDVVAGSTS

SEQ ID NO: 3018598 - protein, 24 aa, Entamoeba invadens
SVQKTFLMRILSKVFVEEGKFKPS

SEQ ID NO: 3018599 - protein, 21 aa, Entamoeba invadens
SVQKTFLMRVLKSVYVDEGTS

SEQ ID NO: 3018600 - protein, 17 aa, Entamoeba invadens
SVQPLYTLPPTISKTQE

SEQ ID NO: 3018601 - protein, 19 aa, Entamoeba invadens
SVQSVYYNGIIELLKRRGN

SEQ ID NO: 3018602 - protein, 37 aa, Entamoeba invadens
SVQVQFPFFVNILQTSVWPFFPQNFQFTLPQALQETH

SEQ ID NO: 3018603 - protein, 23 aa, Entamoeba invadens
SVQVRVFNLPLTKRIRGLSPSDI

SEQ ID NO: 3018604 - protein, 21 aa, Entamoeba invadens
SVQYLDSALIFFRKHIKKICA

SEQ ID NO: 3018605 - protein, 20 aa, Entamoeba invadens
SVRFPQPFPTAPNVVVCVLF

SEQ ID NO: 3018606 - protein, 21 aa, Entamoeba invadens
SVRSHFMEMLLDPKYVIDDND

SEQ ID NO: 3018607 - protein, 30 aa, Entamoeba invadens
SVSADYLLLNHFYTLDSSLNYFLKLVEDTS

SEQ ID NO: 3018608 - protein, 25 aa, Entamoeba invadens
SVSEKEIIMYKLSKVSSKRIEAIYD

SEQ ID NO: 3018609 - protein, 25 aa, Entamoeba invadens
SVSESLLALKFWKLDFGKEWCDKNM

SEQ ID NO: 3018610 - protein, 28 aa, Entamoeba invadens
SVSESPFKSIVPFALRGAMTRYQTNSGK

SEQ ID NO: 3018611 - protein, 24 aa, Entamoeba invadens
SVSFSQMNLLAQVKTPLPTISPKS

SEQ ID NO: 3018612 - protein, 31 aa, Entamoeba invadens
SVSGQRFYYNKYLQTVYFPSTIVDFNLENIS

SEQ ID NO: 3018613 - protein, 18 aa, Entamoeba invadens
SVSIHRPLPSLPNKSNNS

SEQ ID NO: 3018614 - protein, 17 aa, Entamoeba invadens
SVSLAIRDDADRFHIPM

SEQ ID NO: 3018615 - protein, 25 aa, Entamoeba invadens
SVSLKELALISLFSLKTVTFPTSIT

SEQ ID NO: 3018616 - protein, 17 aa, Entamoeba invadens
SVSLQQIMKFSTSFSNA

SEQ ID NO: 3018617 - protein, 25 aa, Entamoeba invadens
SVSNMNVMLLSQKLLEKFKEVVSNK

SEQ ID NO: 3018618 - protein, 23 aa, Entamoeba invadens
SVSRDFPVLYIRGDLVVIVSPEQ

SEQ ID NO: 3018619 - protein, 26 aa, Entamoeba invadens
SVSSNTVFDFFGSQKSAPEEKKEKNV

SEQ ID NO: 3018620 - protein, 21 aa, Entamoeba invadens
SVSVFRLSIGEKVYFAKTLRP

SEQ ID NO: 3018621 - protein, 26 aa, Entamoeba invadens
SVSVPTLVYPFLYDGFVNEILCDKSF

SEQ ID NO: 3018622 - protein, 25 aa, Entamoeba invadens
SVSYAFYLQMKAFGYIFNNVNLTSK

SEQ ID NO: 3018623 - protein, 18 aa, Entamoeba invadens
SVTALQFWLREVQRYCDP

SEQ ID NO: 3018624 - protein, 26 aa, Entamoeba invadens
SVTDGHCNYFLLKKKKKDAKNALIRK

SEQ ID NO: 3018625 - protein, 31 aa, Entamoeba invadens
SVTEMELYHLIYTISIAPGEMWRILQANILS

SEQ ID NO: 3018626 - protein, 18 aa, Entamoeba invadens
SVTFISWNFTYCDNLKKI

SEQ ID NO: 3018627 - protein, 17 aa, Entamoeba invadens
SVTFPYDDWMIPVSDPT

SEQ ID NO: 3018628 - protein, 20 aa, Entamoeba invadens
SVTFTVPHFTKYAFIEEEEE

SEQ ID NO: 3018629 - protein, 23 aa, Entamoeba invadens
SVTIDNFVFYGAKWNFAGDDSFQ

SEQ ID NO: 3018630 - protein, 22 aa, Entamoeba invadens
SVTIFINIDILKENYNVPVVVP

SEQ ID NO: 3018631 - protein, 18 aa, Entamoeba invadens
SVTIPSSVTFIGYGGFFN

SEQ ID NO: 3018632 - protein, 23 aa, Entamoeba invadens
SVTKICYTFFKKYKNLREIVFST

SEQ ID NO: 3018633 - protein, 23 aa, Entamoeba invadens
SVTKIGAFAFRKCLSLTTFEIPE

SEQ ID NO: 3018634 - protein, 25 aa, Entamoeba invadens
SVTKLNWFTYKFPIPTLNNTNNTIS

SEQ ID NO: 3018635 - protein, 18 aa, Entamoeba invadens
SVTKLSEFSFYGCVSLTS

SEQ ID NO: 3018636 - protein, 26 aa, Entamoeba invadens
SVTLSKILSLFSFDPSLKSILLKPRV

SEQ ID NO: 3018637 - protein, 25 aa, Entamoeba invadens
SVTPLAFIVPLVFGNLTFDPYNVVI

SEQ ID NO: 3018638 - protein, 24 aa, Entamoeba invadens
SVTPRKFLVLAGIEDVFTQSNGHT

SEQ ID NO: 3018639 - protein, 25 aa, Entamoeba invadens
SVTQLLDCLCPLKYSHFSRAPAEYS

SEQ ID NO: 3018640 - protein, 24 aa, Entamoeba invadens
SVTRQNVVLYFYTKKKFGGKKYIG

SEQ ID NO: 3018641 - protein, 24 aa, Entamoeba invadens
SVTSLGYLCFCACRRLSSVDIPSS

SEQ ID NO: 3018642 - protein, 17 aa, Entamoeba invadens
SVTVKLLSQRRKRISRG

SEQ ID NO: 3018643 - protein, 25 aa, Entamoeba invadens
SVVADELLFTLPKNSERSKSTIFDV

SEQ ID NO: 3018644 - protein, 24 aa, Entamoeba invadens
SVVCHAYFLLQLPDKLLQQKETQV

SEQ ID NO: 3018645 - protein, 29 aa, Entamoeba invadens
SVVCYEIALYKIRYFSEPLLRPPKHVVFT

SEQ ID NO: 3018646 - protein, 24 aa, Entamoeba invadens
SVVFKMTPIYYFEVTLRDISNPQT

SEQ ID NO: 3018647 - protein, 23 aa, Entamoeba invadens
SVVGMYFFTLQYESGYAVIQKRY

SEQ ID NO: 3018648 - protein, 26 aa, Entamoeba invadens
SVVHKQFVVFILLMCKDKKYISRAEY

SEQ ID NO: 3018649 - protein, 29 aa, Entamoeba invadens
SVVIPFCVPLFGYHCFCWCSSLSSITIPT

SEQ ID NO: 3018650 - protein, 17 aa, Entamoeba invadens
SVVISNYIAVLLTAHSD

SEQ ID NO: 3018651 - protein, 20 aa, Entamoeba invadens
SVVLDRLYLFVLNSQISTSQ

SEQ ID NO: 3018652 - protein, 19 aa, Entamoeba invadens
SVVLIQGCAFKKCRFLEKF

SEQ ID NO: 3018653 - protein, 28 aa, Entamoeba invadens
SVVLPQGFVMFYYMNEWCFINLSNNQVS

SEQ ID NO: 3018654 - protein, 25 aa, Entamoeba invadens
SVVLQVLMKLKFQFELRYFNCDQTI

SEQ ID NO: 3018655 - protein, 17 aa, Entamoeba invadens
SVVMGTTPVATPTKRRG

SEQ ID NO: 3018656 - protein, 21 aa, Entamoeba invadens
SVVMKLADVGLPLKLISIMEA

SEQ ID NO: 3018657 - protein, 24 aa, Entamoeba invadens
SVVPKIMVCTLFPKVNKINANNIT

SEQ ID NO: 3018658 - protein, 38 aa, Entamoeba invadens
SVVQDGLFNFYYFTTNLLFTLVPTDVFLKRISQLTHHK

SEQ ID NO: 3018659 - protein, 24 aa, Entamoeba invadens
SVVQNLIQSPLRPTQDFMKKFIEV

SEQ ID NO: 3018660 - protein, 18 aa, Entamoeba invadens
SVVVIPLSVTFFGDNCFP

SEQ ID NO: 3018661 - protein, 18 aa, Entamoeba invadens
SVWEYFVYTLSEPDYIDS

SEQ ID NO: 3018662 - protein, 17 aa, Entamoeba invadens
SVYFLEFPQRTNLPILL

SEQ ID NO: 3018663 - protein, 22 aa, Entamoeba invadens
SVYKKPYISLKLLDSDAPFYSS

SEQ ID NO: 3018664 - protein, 22 aa, Entamoeba invadens
SVYLGRLKSLIRQRAYKMTRSA

SEQ ID NO: 3018665 - protein, 19 aa, Entamoeba invadens
SVYLRFKTIQPIRKLEVGL

SEQ ID NO: 3018666 - protein, 20 aa, Entamoeba invadens
SVYLRQVGMNVYLGLLGCGI

SEQ ID NO: 3018667 - protein, 19 aa, Entamoeba invadens
SVYLTPLYSTTISSDVMII

SEQ ID NO: 3018668 - protein, 17 aa, Entamoeba invadens
SVYPTIRKLVLKYKSEA

SEQ ID NO: 3018669 - protein, 17 aa, Entamoeba invadens
SVYRFYRQHIFTGITEL

SEQ ID NO: 3018670 - protein, 19 aa, Entamoeba invadens
SVYVPPCCGIVQYPRSCDG

SEQ ID NO: 3018671 - protein, 25 aa, Entamoeba invadens
SWADMSKLLTLPSCGDGGIILKSDG

SEQ ID NO: 3018672 - protein, 26 aa, Entamoeba invadens
SWADMSKLLTLPSCGNGGIILKSDGA

SEQ ID NO: 3018673 - protein, 18 aa, Entamoeba invadens
SWCFACCGSLKRVVIMAQ

SEQ ID NO: 3018674 - protein, 24 aa, Entamoeba invadens
SWDNKGILYLLYIGNSESIHWKRK

SEQ ID NO: 3018675 - protein, 28 aa, Entamoeba invadens
SWEAIQQSLLIYLLIENGYSITIERPDK

SEQ ID NO: 3018676 - protein, 19 aa, Entamoeba invadens
SWEIGKFIHRHFCKNGYDF

SEQ ID NO: 3018677 - protein, 19 aa, Entamoeba invadens
SWEIRKFVHHHFCKNGYDF

SEQ ID NO: 3018678 - protein, 18 aa, Entamoeba invadens
SWGFKYMHAESFVIAKNN

SEQ ID NO: 3018679 - protein, 30 aa, Entamoeba invadens
SWIKKSQFKAFKKLFLLRDKIAREEDESPH

SEQ ID NO: 3018680 - protein, 20 aa, Entamoeba invadens
SWKFCFGLSNSPVSISKMTE

SEQ ID NO: 3018681 - protein, 23 aa, Entamoeba invadens
SWKQFYEHPYVVKALLISRRVKP

SEQ ID NO: 3018682 - protein, 21 aa, Entamoeba invadens
SWKSWKKRMFRLNTQKLEYFK

SEQ ID NO: 3018683 - protein, 27 aa, Entamoeba invadens
SWKSWKRRWFVIKDKKMWYFSGKNDTE

SEQ ID NO: 3018684 - protein, 19 aa, Entamoeba invadens
SWMDSVGFYFNYIKGMTFL

SEQ ID NO: 3018685 - protein, 18 aa, Entamoeba invadens
SWRCCLFYGLALVNSPTN

SEQ ID NO: 3018686 - protein, 24 aa, Entamoeba invadens
SWVKLSLNLKYLGTLAFDNCEELV

SEQ ID NO: 3018687 - protein, 17 aa, Entamoeba invadens
SWVSLSQFKSKGVSLVG

SEQ ID NO: 3018688 - protein, 28 aa, Entamoeba invadens
SYADTIFPKVVSLSLLYPVYEKDDPCNN

SEQ ID NO: 3018689 - protein, 23 aa, Entamoeba invadens
SYAFIEFRTFDQAVKALSLDGLT

SEQ ID NO: 3018690 - protein, 25 aa, Entamoeba invadens
SYAGTFLAGYIRGASYDKCCKAASL

SEQ ID NO: 3018691 - protein, 23 aa, Entamoeba invadens
SYALRSEAFYLTHLRDTKDMKKK

SEQ ID NO: 3018692 - protein, 22 aa, Entamoeba invadens
SYAQSVSLLWVKYDVMGDSVTM

SEQ ID NO: 3018693 - protein, 19 aa, Entamoeba invadens
SYCFGMCKSLVIIKLPESV

SEQ ID NO: 3018694 - protein, 20 aa, Entamoeba invadens
SYCFSHCVLLSSVTFNSKEI

SEQ ID NO: 3018695 - protein, 25 aa, Entamoeba invadens
SYCQSLKTIYLPRCLEKISRSAFYY

SEQ ID NO: 3018696 - protein, 26 aa, Entamoeba invadens
SYCTPRVMEILSKRLGIPMTSVSKSI

SEQ ID NO: 3018697 - protein, 18 aa, Entamoeba invadens
SYDEFPPSFYKKSSERDD

SEQ ID NO: 3018698 - protein, 20 aa, Entamoeba invadens
SYDFRRLLLSEYDQLKFFIH

SEQ ID NO: 3018699 - protein, 32 aa, Entamoeba invadens
SYDNLFRRLAWQIHLEILPLPVSPLWVNIIEA

SEQ ID NO: 3018700 - protein, 19 aa, Entamoeba invadens
SYDRKIFGIAIPECVNSLG

SEQ ID NO: 3018701 - protein, 24 aa, Entamoeba invadens
SYDSLRFKTTRFFMPFTLRHEETM

SEQ ID NO: 3018702 - protein, 24 aa, Entamoeba invadens
SYDSVWIRAKWLIFSQEQSAKGKI

SEQ ID NO: 3018703 - protein, 18 aa, Entamoeba invadens
SYEFYLQMKAFGYTFHNV

SEQ ID NO: 3018704 - protein, 22 aa, Entamoeba invadens
SYEFYLQMKAFGYTFHNVNYII

SEQ ID NO: 3018705 - protein, 20 aa, Entamoeba invadens
SYEKVVFAIFKTHIAALKSY

SEQ ID NO: 3018706 - protein, 30 aa, Entamoeba invadens
SYESQIQGVLLRLLIMRGYRVVVKKPKIAK

SEQ ID NO: 3018707 - protein, 23 aa, Entamoeba invadens
SYEVLSVHGNYIKATTRPMSQER

SEQ ID NO: 3018708 - protein, 17 aa, Entamoeba invadens
SYEVSPYLYLELHTLDD

SEQ ID NO: 3018709 - protein, 19 aa, Entamoeba invadens
SYFEHFLSNLGQKVELFGY

SEQ ID NO: 3018710 - protein, 18 aa, Entamoeba invadens
SYFGTIFNSTDLILADVC

SEQ ID NO: 3018711 - protein, 21 aa, Entamoeba invadens
SYFRLQFPEFEGIRAPMRINS

SEQ ID NO: 3018712 - protein, 21 aa, Entamoeba invadens
SYFTSIVKCWKMISKVAFNNK

SEQ ID NO: 3018713 - protein, 23 aa, Entamoeba invadens
SYGSFYNWVLRVPADNVIFVFGN

SEQ ID NO: 3018714 - protein, 25 aa, Entamoeba invadens
SYGSRVFNSFYFDTFKVPINITNLE

SEQ ID NO: 3018715 - protein, 23 aa, Entamoeba invadens
SYHKLYMPIIDRAMEVFQPGAVV

SEQ ID NO: 3018716 - protein, 19 aa, Entamoeba invadens
SYIFPWTIADYVSTGKRPV

SEQ ID NO: 3018717 - protein, 19 aa, Entamoeba invadens
SYIHRIGRSARFGRKGVAI

SEQ ID NO: 3018718 - protein, 36 aa, Entamoeba invadens
SYILRGANYVIKMQELLLLFGKIGYLLLNTTYSPRY

SEQ ID NO: 3018719 - protein, 20 aa, Entamoeba invadens
SYIRGGLPYRRPVGYMRYAI

SEQ ID NO: 3018720 - protein, 23 aa, Entamoeba invadens
SYISIYCPLPVVSRFLFVSKKCK

SEQ ID NO: 3018721 - protein, 27 aa, Entamoeba invadens
SYISVTPLNFFYIVDQVVYVTGVLDYK

SEQ ID NO: 3018722 - protein, 22 aa, Entamoeba invadens
SYIVKLFYTFQNETSLFYVLEL

SEQ ID NO: 3018723 - protein, 26 aa, Entamoeba invadens
SYKGNLDMMFIFICGLNSNAEKKEVS

SEQ ID NO: 3018724 - protein, 17 aa, Entamoeba invadens
SYKLEILDTVDLDIYNT

SEQ ID NO: 3018725 - protein, 17 aa, Entamoeba invadens
SYKLLNEFLRRIHPIVR

SEQ ID NO: 3018726 - protein, 20 aa, Entamoeba invadens
SYKRCAIPCIIIPMDSTVTI

SEQ ID NO: 3018727 - protein, 18 aa, Entamoeba invadens
SYKSSVLKRRTVRKSLML

SEQ ID NO: 3018728 - protein, 23 aa, Entamoeba invadens
SYLEMMTFIIQEARPIFNDLKIG

SEQ ID NO: 3018729 - protein, 20 aa, Entamoeba invadens
SYLFLLESLELPTTIPILEE

SEQ ID NO: 3018730 - protein, 20 aa, Entamoeba invadens
SYLILQYLQSQTNKEIFLMT

SEQ ID NO: 3018731 - protein, 17 aa, Entamoeba invadens
SYLNRMMYQKRTDMKPL

SEQ ID NO: 3018732 - protein, 29 aa, Entamoeba invadens
SYLQNNIFRKIPYYEFLGNGWTKKDKETL

SEQ ID NO: 3018733 - protein, 21 aa, Entamoeba invadens
SYLSNPVWVETLMDTVRLAVK

SEQ ID NO: 3018734 - protein, 19 aa, Entamoeba invadens
SYLSSYKYHYFYDRKTHTK

SEQ ID NO: 3018735 - protein, 18 aa, Entamoeba invadens
SYLTIRCGPTSFLKGEIF

SEQ ID NO: 3018736 - protein, 19 aa, Entamoeba invadens
SYLTVHFPPLIHTDSFFYE

SEQ ID NO: 3018737 - protein, 21 aa, Entamoeba invadens
SYMMEPIGFLPLVIDENYRVT

SEQ ID NO: 3018738 - protein, 36 aa, Entamoeba invadens
SYMPSLYDFIRIIVTTYRVFIFTKPNKLSMSLLKNL

SEQ ID NO: 3018739 - protein, 26 aa, Entamoeba invadens
SYNNEIFQLEPLSMKLRSIGKVVGFD

SEQ ID NO: 3018740 - protein, 28 aa, Entamoeba invadens
SYNSVPHPFWLPKFQNGVSFSLPVLGET

SEQ ID NO: 3018741 - protein, 18 aa, Entamoeba invadens
SYPEFRKCFVKHFGKFEV

SEQ ID NO: 3018742 - protein, 33 aa, Entamoeba invadens
SYPNRIRLFLNEYVMIPILISAYERLELSYYRR

SEQ ID NO: 3018743 - protein, 28 aa, Entamoeba invadens
SYPQKEFPFPWVIAQFVTSGKRLPHVSK

SEQ ID NO: 3018744 - protein, 31 aa, Entamoeba invadens
SYPRGVSLHDLPLSALMEFLTVCVDPKILGE

SEQ ID NO: 3018745 - protein, 28 aa, Entamoeba invadens
SYQFTPPQQFFQFDYGKLVYDSQGNCID

SEQ ID NO: 3018746 - protein, 32 aa, Entamoeba invadens
SYQKLSVLTQRYPGVPLMMLTATATERVQNDI

SEQ ID NO: 3018747 - protein, 18 aa, Entamoeba invadens
SYRDWKNIIKPDYSIWEE

SEQ ID NO: 3018748 - protein, 19 aa, Entamoeba invadens
SYRITQLVKLNIKYMEVAY

SEQ ID NO: 3018749 - protein, 27 aa, Entamoeba invadens
SYRSNGIVPMIRPNMRNSAYGYDQSQR

SEQ ID NO: 3018750 - protein, 19 aa, Entamoeba invadens
SYRVIRECAPRAFIIGNIG

SEQ ID NO: 3018751 - protein, 37 aa, Entamoeba invadens
SYSEFKRLALLLTNLPTKRLRDVSLRLQFMKAFDENK

SEQ ID NO: 3018752 - protein, 32 aa, Entamoeba invadens
SYSEPSFQYWIYFLRMNISVLNNLRKSLGLNT

SEQ ID NO: 3018753 - protein, 32 aa, Entamoeba invadens
SYSISLPTPTILKPTMLWTGKQVVSAILLHVG

SEQ ID NO: 3018754 - protein, 19 aa, Entamoeba invadens
SYSLRSFYEMFQSIRKETD

SEQ ID NO: 3018755 - protein, 22 aa, Entamoeba invadens
SYSVFIEKFYRIQKIGELQSVA

SEQ ID NO: 3018756 - protein, 29 aa, Entamoeba invadens
SYSVLPDALVPTLDRIFGDYKKLTKQNGR

SEQ ID NO: 3018757 - protein, 44 aa, Entamoeba invadens
SYTEFKRLALLLTNLPTKRLRDVSLRLQYMKLIEEKKITTWEDF

SEQ ID NO: 3018758 - protein, 18 aa, Entamoeba invadens
SYTIVKLSELSSLRLKNV

SEQ ID NO: 3018759 - protein, 26 aa, Entamoeba invadens
SYTLDIYNFFIYTFSVAPEGATQINF

SEQ ID NO: 3018760 - protein, 27 aa, Entamoeba invadens
SYTLINWDTLLFNKVKAMFGGKLEIIL

SEQ ID NO: 3018761 - protein, 23 aa, Entamoeba invadens
SYTLLVQLIYSIFQPQQERIGWE

SEQ ID NO: 3018762 - protein, 24 aa, Entamoeba invadens
SYTSKLPHLITIKTPVLKKDIPAL

SEQ ID NO: 3018763 - protein, 25 aa, Entamoeba invadens
SYTSNSLLLCCWCFFVYNELSKCFQ

SEQ ID NO: 3018764 - protein, 23 aa, Entamoeba invadens
SYTTYRVPLVFPRSVQLDAVDDA

SEQ ID NO: 3018765 - protein, 34 aa, Entamoeba invadens
SYVDDLFDFHAYIFQKPCICTYIDTLKACKQYVN

SEQ ID NO: 3018766 - protein, 26 aa, Entamoeba invadens
SYVDKRFFWNQNMVAALPSEWVTIFV

SEQ ID NO: 3018767 - protein, 25 aa, Entamoeba invadens
SYVQGLKLCLKYYYDPLMQNNVIPK

SEQ ID NO: 3018768 - protein, 21 aa, Entamoeba invadens
SYYESHPFYSLFFQQNDENVE

SEQ ID NO: 3018769 - protein, 31 aa, Entamoeba invadens
SYYEVVNEKPYFYLLNVFRGEKPQSGLNIIP

SEQ ID NO: 3018770 - protein, 23 aa, Entamoeba invadens
SYYGICFSLSYKCAKSFGLTKQF

SEQ ID NO: 3018771 - protein, 24 aa, Entamoeba invadens
SYYNSVITSLYVPLFATATDTDAN

SEQ ID NO: 3018772 - protein, 18 aa, Entamoeba invadens
SYYQPPLVKVNIPETTLR

SEQ ID NO: 3018773 - protein, 32 aa, Entamoeba invadens
TTNNLPKLLIRNTSLVLMPRTQIKGKMLKRNN

SEQ ID NO: 3018774 - protein, 21 aa, Entamoeba invadens
TAACPPYHLAFVIGGTSAEKN

SEQ ID NO: 3018775 - protein, 26 aa, Entamoeba invadens
TAAKNFFMQFKLFPNLETVVCNRYYF

SEQ ID NO: 3018776 - protein, 23 aa, Entamoeba invadens
TAAVYKKFLREIPGHIFNTSQTT

SEQ ID NO: 3018777 - protein, 32 aa, Entamoeba invadens
TACSDMPIFELFPNLVLITLISQLLPSTDFPR

SEQ ID NO: 3018778 - protein, 24 aa, Entamoeba invadens
TADERLTIWRAIQSHIVELSADLF

SEQ ID NO: 3018779 - protein, 35 aa, Entamoeba invadens
TADFKFFNRFIKGNPLSIHFILKDEPVVFSVIPGQ

SEQ ID NO: 3018780 - protein, 27 aa, Entamoeba invadens
TADPQAFAFVLKTKGKIKGASKFKILE

SEQ ID NO: 3018781 - protein, 28 aa, Entamoeba invadens
TADTLAVWLVHKLYKLGVLCCRVVNITT

SEQ ID NO: 3018782 - protein, 22 aa, Entamoeba invadens
TAEELALKALLLGGTPSALSKP

SEQ ID NO: 3018783 - protein, 23 aa, Entamoeba invadens
TAEFIHLQAFNPSPRILSRRSII

SEQ ID NO: 3018784 - protein, 25 aa, Entamoeba invadens
TAEHLHNCAPFIAKLYSLVNTIEYK

SEQ ID NO: 3018785 - protein, 36 aa, Entamoeba invadens
TAEKNFIVSIKSVLLKFAMAYLSLVSSTAKFVESTR

SEQ ID NO: 3018786 - protein, 29 aa, Entamoeba invadens
TAELVFTEFMFCARLQIFQKHFEVYIRNE

SEQ ID NO: 3018787 - protein, 31 aa, Entamoeba invadens
TAEVGDIFYVERFVGSWALVYVNEEKYVFPS

SEQ ID NO: 3018788 - protein, 31 aa, Entamoeba invadens
TAEVKRIYCFVFNEFLVFTKCLKLTKPKKKK

SEQ ID NO: 3018789 - protein, 30 aa, Entamoeba invadens
TAFEFKGDLLIFLLDSLYDCQFANYLEYPN

SEQ ID NO: 3018790 - protein, 22 aa, Entamoeba invadens
TAFIAKGYNFAEKISATVFLET

SEQ ID NO: 3018791 - protein, 17 aa, Entamoeba invadens
TAFIVEHDFIMATYLAD

SEQ ID NO: 3018792 - protein, 23 aa, Entamoeba invadens
TAFKNLLIEIYKQNVSNLDENAQ

SEQ ID NO: 3018793 - protein, 17 aa, Entamoeba invadens
TAFLTLDTVIKITNRRV

SEQ ID NO: 3018794 - protein, 32 aa, Entamoeba invadens
TAFLTLVDYYRYNPLLWYRLASCVIMANYNMK

SEQ ID NO: 3018795 - protein, 28 aa, Entamoeba invadens
TAFNFEEIFRYVFTKKAIKLGSFVGDVL

SEQ ID NO: 3018796 - protein, 25 aa, Entamoeba invadens
TAGGKDYHIACFKCKTCGLKLNTSN

SEQ ID NO: 3018797 - protein, 19 aa, Entamoeba invadens
TAGIKPIEPAPFGMEPFGV

SEQ ID NO: 3018798 - protein, 30 aa, Entamoeba invadens
TAGQEKYNCLFPLLYKNSSIVIIVYDPNDS

SEQ ID NO: 3018799 - protein, 17 aa, Entamoeba invadens
TAGQERFMNITAAYFRN

SEQ ID NO: 3018800 - protein, 31 aa, Entamoeba invadens
TAGQERYRAITGAYYRGSLGAVMVYDVTKKS

SEQ ID NO: 3018801 - protein, 21 aa, Entamoeba invadens
TAHFDNMIFSFSFGVLTNGVY

SEQ ID NO: 3018802 - protein, 31 aa, Entamoeba invadens
TAHLLFSKRFNPYYMSPIIIGFDDNGKTYCS

SEQ ID NO: 3018803 - protein, 20 aa, Entamoeba invadens
TAIIKKTIPCMAACPVNAIS

SEQ ID NO: 3018804 - protein, 24 aa, Entamoeba invadens
TAIPVLRQTIVSLNGKVIEIKKDI

SEQ ID NO: 3018805 - protein, 17 aa, Entamoeba invadens
TAIRTFKSINRKILIFL

SEQ ID NO: 3018806 - protein, 19 aa, Entamoeba invadens
TAKAKKQAKQYARKVEEAE

SEQ ID NO: 3018807 - protein, 26 aa, Entamoeba invadens
TAKDKHARIIWLRNFFIGTLINSIIN

SEQ ID NO: 3018808 - protein, 23 aa, Entamoeba invadens
TAKLFCSHIYPDTFEPLRVFAIQ

SEQ ID NO: 3018809 - protein, 37 aa, Entamoeba invadens
TAKNIRLAFNGKKIGRLIFRVILYDKNGKIINVCCVC

SEQ ID NO: 3018810 - protein, 17 aa, Entamoeba invadens
TAKNLLNWAIKQQPGMA

SEQ ID NO: 3018811 - protein, 28 aa, Entamoeba invadens
TAKNYIALRLLFELKVQRNFINSFSQRY

SEQ ID NO: 3018812 - protein, 22 aa, Entamoeba invadens
TAKQFGLDFFFDKFVNFDILRD

SEQ ID NO: 3018813 - protein, 23 aa, Entamoeba invadens
TAKSQILKFVKMVSPIGVYTSGK

SEQ ID NO: 3018814 - protein, 24 aa, Entamoeba invadens
TAKSQLLKYSQKLAPRAVFTTGRG

SEQ ID NO: 3018815 - protein, 25 aa, Entamoeba invadens
TAKSQLLRYVMNIAPLSVSTNGRGA

SEQ ID NO: 3018816 - protein, 25 aa, Entamoeba invadens
TAKTWLIPYCVYRTLVKSVDTPLPP

SEQ ID NO: 3018817 - protein, 25 aa, Entamoeba invadens
TAKVYLEPYHRPLTLGVSSVTLTSS

SEQ ID NO: 3018818 - protein, 25 aa, Entamoeba invadens
TAKYALAVLMKRIMLLDTDTRLQTP

SEQ ID NO: 3018819 - protein, 17 aa, Entamoeba invadens
TAKYTGIPVFWGRIVKA

SEQ ID NO: 3018820 - protein, 17 aa, Entamoeba invadens
TALAEGTALIKCVYVES

SEQ ID NO: 3018821 - protein, 31 aa, Entamoeba invadens
TALAFFINDQPIKWCWPIGVIFDALHNGSLP

SEQ ID NO: 3018822 - protein, 28 aa, Entamoeba invadens
TALEKLELLGRWNARGALICVTEYGAIF

SEQ ID NO: 3018823 - protein, 24 aa, Entamoeba invadens
TALELLPFYPKLYESIFMRIIRED

SEQ ID NO: 3018824 - protein, 19 aa, Entamoeba invadens
TALHYLLMTPTNALISFND

SEQ ID NO: 3018825 - protein, 21 aa, Entamoeba invadens
TALKYLAEYCPNKVWVKPEAE

SEQ ID NO: 3018826 - protein, 19 aa, Entamoeba invadens
TALLQQLDIMVDGTALFGI

SEQ ID NO: 3018827 - protein, 21 aa, Entamoeba invadens
TALQNFVLPKLLVKYTEVIPY

SEQ ID NO: 3018828 - protein, 23 aa, Entamoeba invadens
TALRKLPDAFLKVGAVAAADKLS

SEQ ID NO: 3018829 - protein, 19 aa, Entamoeba invadens
TALSLTLISHYLLWNDVFG

SEQ ID NO: 3018830 - protein, 20 aa, Entamoeba invadens
TALYLATFLKRRVEAFLKGK

SEQ ID NO: 3018831 - protein, 24 aa, Entamoeba invadens
TAMIPFVEPLLGQLIQALMAPSMD

SEQ ID NO: 3018832 - protein, 24 aa, Entamoeba invadens
TAMKIKYPVFISLLGRDFIDKLTK

SEQ ID NO: 3018833 - protein, 21 aa, Entamoeba invadens
TAMKVIPKYTLTTDLYQNNHN

SEQ ID NO: 3018834 - protein, 24 aa, Entamoeba invadens
TAMRDLYMKTGQGFVLVYSIIAQS

SEQ ID NO: 3018835 - protein, 24 aa, Entamoeba invadens
TAMSTLVCQCSCYKPELYGDLKVK

SEQ ID NO: 3018836 - protein, 17 aa, Entamoeba invadens
TAMVERVLSVSKYLIYI

SEQ ID NO: 3018837 - protein, 46 aa, Entamoeba invadens
TANEKRPYWKELVEGIITILMKGRCFNSYALNAALRKTLKSTSKVV

SEQ ID NO: 3018838 - protein, 19 aa, Entamoeba invadens
TANFFIWSEIYTPDNTVIG

SEQ ID NO: 3018839 - protein, 24 aa, Entamoeba invadens
TANTHLLMEAPWENLTRWENDTLA

SEQ ID NO: 3018840 - protein, 27 aa, Entamoeba invadens
TAPELADRFWYFLKKEFVEMQGNVFCP

SEQ ID NO: 3018841 - protein, 29 aa, Entamoeba invadens
TAPKAPTALPTPLFPSQPSSFQPVSAPLP

SEQ ID NO: 3018842 - protein, 29 aa, Entamoeba invadens
TAPNKPYALLFLYIPINSFSIRVIQGKAS

SEQ ID NO: 3018843 - protein, 22 aa, Entamoeba invadens
TAQRELLIEKLKRQKSIRLIGK

SEQ ID NO: 3018844 - protein, 24 aa, Entamoeba invadens
TAQRLLYVSRSCKIAILMIRTNPN

SEQ ID NO: 3018845 - protein, 20 aa, Entamoeba invadens
TAQYFLSDGLIVTGTSTGVK

SEQ ID NO: 3018846 - protein, 27 aa, Entamoeba invadens
TARCPNLMILVITTEGLSFGCFSHKIF

SEQ ID NO: 3018847 - protein, 19 aa, Entamoeba invadens
TARKLLFSSTFDYVKTMVC

SEQ ID NO: 3018848 - protein, 25 aa, Entamoeba invadens
TARSPIGCLAALIKRGWANDVKIDP

SEQ ID NO: 3018849 - protein, 17 aa, Entamoeba invadens
TASLRFEGTLNVDLNEF

SEQ ID NO: 3018850 - protein, 26 aa, Entamoeba invadens
TASLVVALKVRYPHRVFLLRGNHESR

SEQ ID NO: 3018851 - protein, 24 aa, Entamoeba invadens
TASMYWNIFIQNASTWFNESEFVS

SEQ ID NO: 3018852 - protein, 24 aa, Entamoeba invadens
TASQKPLHRLVGHSSQVMSCKFSP

SEQ ID NO: 3018853 - protein, 22 aa, Entamoeba invadens
TASVTLAGLFNALELVHKRLED

SEQ ID NO: 3018854 - protein, 21 aa, Entamoeba invadens
TASWMPCICNSFQLVCYQMTF

SEQ ID NO: 3018855 - protein, 17 aa, Entamoeba invadens
TASWQYFDQNWVDFGSE

SEQ ID NO: 3018856 - protein, 30 aa, Entamoeba invadens
TATELTILCKMAIPIFSHETSLLFINAPLH

SEQ ID NO: 3018857 - protein, 17 aa, Entamoeba invadens
TATFFNNANMVAAVCSY

SEQ ID NO: 3018858 - protein, 25 aa, Entamoeba invadens
TATFYNEVLFTDKVHFGGSSVFEGN

SEQ ID NO: 3018859 - protein, 23 aa, Entamoeba invadens
TATKTMITPNMSMLAALEITVKN

SEQ ID NO: 3018860 - protein, 25 aa, Entamoeba invadens
TATPEADLIFLKNVLRANVAATSEA

SEQ ID NO: 3018861 - protein, 23 aa, Entamoeba invadens
TAVEAIGGNGLFYCLVDTDETAM

SEQ ID NO: 3018862 - protein, 25 aa, Entamoeba invadens
TAVFPALFEFFKTKQVQVLTLLNAP

SEQ ID NO: 3018863 - protein, 28 aa, Entamoeba invadens
TAVFPFGVSLWFSKYFEKAGKFEKIILT

SEQ ID NO: 3018864 - protein, 24 aa, Entamoeba invadens
TAVFRRDPWSSVPLPSEIWTNCKV

SEQ ID NO: 3018865 - protein, 18 aa, Entamoeba invadens
TAVKPFVKSGLNLVTKLI

SEQ ID NO: 3018866 - protein, 30 aa, Entamoeba invadens
TAVREILKKDFNVAILMLRQQNVEVFDCEE

SEQ ID NO: 3018867 - protein, 26 aa, Entamoeba invadens
TAVSSILIHLIFNSIVKVFGGDRGKF

SEQ ID NO: 3018868 - protein, 25 aa, Entamoeba invadens
TAVYKTFIILFTNGVSKEMANTIFT

SEQ ID NO: 3018869 - protein, 32 aa, Entamoeba invadens
TAYICTRHYRAPELIFGCINYTTAIDIWSVGC

SEQ ID NO: 3018870 - protein, 24 aa, Entamoeba invadens
TAYVFYCVGACPFVIKDQFHTFKD

SEQ ID NO: 3018871 - protein, 27 aa, Entamoeba invadens
TCALGYFLHKAPWPLSNRDFVFVWKWF

SEQ ID NO: 3018872 - protein, 19 aa, Entamoeba invadens
TCCRIIIASFYNYDQNRAF

SEQ ID NO: 3018873 - protein, 18 aa, Entamoeba invadens
TCDADSKFYLKYLDVWVH

SEQ ID NO: 3018874 - protein, 25 aa, Entamoeba invadens
TCDLAKFVIHAIKPNGEPCALDKVP

SEQ ID NO: 3018875 - protein, 21 aa, Entamoeba invadens
TCDSVLVDCGKPTKEAGKKAR

SEQ ID NO: 3018876 - protein, 32 aa, Entamoeba invadens
TCENKQTNALLYLVLKEGYKLIFPKTKKENSY

SEQ ID NO: 3018877 - protein, 25 aa, Entamoeba invadens
TCEPLGNLFTKCELTLPTGGGCAIC

SEQ ID NO: 3018878 - protein, 18 aa, Entamoeba invadens
TCFQLFMPYVKAMDSRNF

SEQ ID NO: 3018879 - protein, 29 aa, Entamoeba invadens
TCFTLEMVYDFFDISFEDLPAILKEEIEV

SEQ ID NO: 3018880 - protein, 22 aa, Entamoeba invadens
TCFTLISHFGLPIGVFGTSGGQ

SEQ ID NO: 3018881 - protein, 25 aa, Entamoeba invadens
TCGLDVIVFLDPKLGFQINDKQNAV

SEQ ID NO: 3018882 - protein, 25 aa, Entamoeba invadens
TCGNPILFCRSVGYTGVFYLKNVNG

SEQ ID NO: 3018883 - protein, 36 aa, Entamoeba invadens
TCGWATLSIYRHKGIKDLFDFIAYGVSIPCFSPTRK

SEQ ID NO: 3018884 - protein, 17 aa, Entamoeba invadens
TCHCILFSDICVFAKYS

SEQ ID NO: 3018885 - protein, 26 aa, Entamoeba invadens
TCIGDTFLTFIPFLKVYSEYCSNFRH

SEQ ID NO: 3018886 - protein, 18 aa, Entamoeba invadens
TCIGIFNVFFSSFSNRNS

SEQ ID NO: 3018887 - protein, 18 aa, Entamoeba invadens
TCIPFSFLTLETPHLGVK

SEQ ID NO: 3018888 - protein, 31 aa, Entamoeba invadens
TCIRKQGSLFIYLFRLMLATGIPELQKEKDI

SEQ ID NO: 3018889 - protein, 18 aa, Entamoeba invadens
TCKRFYLIVKNEDEIWHG

SEQ ID NO: 3018890 - protein, 31 aa, Entamoeba invadens
TCLNIAKELLNIPPLLIPQYVSDIDDNTLVL

SEQ ID NO: 3018891 - protein, 19 aa, Entamoeba invadens
TCLNYIITFMASLSRSEKS

SEQ ID NO: 3018892 - protein, 32 aa, Entamoeba invadens
TCLSFMEEYLTFQLFMDKLLSMDVPREKDVQK

SEQ ID NO: 3018893 - protein, 17 aa, Entamoeba invadens
TCLSFQGMLFDLSYVLP

SEQ ID NO: 3018894 - protein, 23 aa, Entamoeba invadens
TCPCYFDCTKFFQTISQYAPCHC

SEQ ID NO: 3018895 - protein, 25 aa, Entamoeba invadens
TCPNPLQLPPMTPVTFRKTFENMHK

SEQ ID NO: 3018896 - protein, 22 aa, Entamoeba invadens
TCPRVLFSFVGSAFETDEQFKM

SEQ ID NO: 3018897 - protein, 18 aa, Entamoeba invadens
TCPSCGMKFLRKHDCNVH

SEQ ID NO: 3018898 - protein, 19 aa, Entamoeba invadens
TCPVIDYFQSIGKLLRVEG

SEQ ID NO: 3018899 - protein, 17 aa, Entamoeba invadens
TCQECEPGFLLISGQCQ

SEQ ID NO: 3018900 - protein, 17 aa, Entamoeba invadens
TCQICKVNYLMYSTNRC

SEQ ID NO: 3018901 - protein, 25 aa, Entamoeba invadens
TCQLCSNGFSLVNGSCVLLLNCLVS

SEQ ID NO: 3018902 - protein, 19 aa, Entamoeba invadens
TCQYNKALTLLFDVYDNQK

SEQ ID NO: 3018903 - protein, 25 aa, Entamoeba invadens
TCRDGALLVYLLVRSDLDEKRVYVR

SEQ ID NO: 3018904 - protein, 18 aa, Entamoeba invadens
TCRECIDGAYLDNGHCFK

SEQ ID NO: 3018905 - protein, 23 aa, Entamoeba invadens
TCSKLLELISEKLFVNPNLTLNE

SEQ ID NO: 3018906 - protein, 22 aa, Entamoeba invadens
TCSKVPSAFLFRLYNTTEEKIV

SEQ ID NO: 3018907 - protein, 27 aa, Entamoeba invadens
TCSLSEAFLLYIRAMGGIIPIELANET

SEQ ID NO: 3018908 - protein, 28 aa, Entamoeba invadens
TCSMCKKLFVVPITLNCGHTFCYTCDLQ

SEQ ID NO: 3018909 - protein, 17 aa, Entamoeba invadens
TCSMTFTDAAYINRMNE

SEQ ID NO: 3018910 - protein, 23 aa, Entamoeba invadens
TCSPNYVVTSPLSYKCDNCSVFD

SEQ ID NO: 3018911 - protein, 25 aa, Entamoeba invadens
TCSQGLMLMIPNMIKIAGEHLPCVF

SEQ ID NO: 3018912 - protein, 35 aa, Entamoeba invadens
TCTACITNYAFTDPPGLYCIPCKEFDQNCKQCGQT

SEQ ID NO: 3018913 - protein, 26 aa, Entamoeba invadens
TCTMGKELCKLYYNAVSNNVLCYQCY

SEQ ID NO: 3018914 - protein, 20 aa, Entamoeba invadens
TCTTHKYDSLLFNNIHDPQA

SEQ ID NO: 3018915 - protein, 20 aa, Entamoeba invadens
TCVKMAPVWRRFEKLELREN

SEQ ID NO: 3018916 - protein, 30 aa, Entamoeba invadens
TCVPQNLSFLLQFPLPKLKLVSLSTTENLN

SEQ ID NO: 3018917 - protein, 26 aa, Entamoeba invadens
TCVRHFVYSIFKTLKPMFFMDNVTMI

SEQ ID NO: 3018918 - protein, 29 aa, Entamoeba invadens
TCVTQQKTKYPRILFGRSDRTRQSGVKGE

SEQ ID NO: 3018919 - protein, 19 aa, Entamoeba invadens
TCYINVVIQLLYNMTTFRE

SEQ ID NO: 3018920 - protein, 17 aa, Entamoeba invadens
TCYKCRDSYIKNKNECV

SEQ ID NO: 3018921 - protein, 20 aa, Entamoeba invadens
TCYKFAVFNLGCNESVNIAN

SEQ ID NO: 3018922 - protein, 24 aa, Entamoeba invadens
TCYKGMLRLHGRMNLLLTQIEKKE

SEQ ID NO: 3018923 - protein, 28 aa, Entamoeba invadens
TCYKKDIVYIWFRAIKDIGDFCFCECNF

SEQ ID NO: 3018924 - protein, 19 aa, Entamoeba invadens
TCYTYWIGATLKTLGCEAL

SEQ ID NO: 3018925 - protein, 25 aa, Entamoeba invadens
TCYYNSTFCMSCRSGTFLSEHDCIT

SEQ ID NO: 3018926 - protein, 26 aa, Entamoeba invadens
TDAAGWLGWIMKMLELMDVDLIKCIG

SEQ ID NO: 3018927 - protein, 27 aa, Entamoeba invadens
TDAAGWLSWIMKILELMDADFIKCIGA

SEQ ID NO: 3018928 - protein, 28 aa, Entamoeba invadens
TDAAGWLSWIMKILELMDADLIKCIGAC

SEQ ID NO: 3018929 - protein, 24 aa, Entamoeba invadens
TDAFYAWTVINSLLKILSTNTLVS

SEQ ID NO: 3018930 - protein, 21 aa, Entamoeba invadens
TDAMRFALLAYMTQGRDINLD

SEQ ID NO: 3018931 - protein, 34 aa, Entamoeba invadens
TDARELFLLLREVFFVFTPPKIFGASLDDILEKE

SEQ ID NO: 3018932 - protein, 28 aa, Entamoeba invadens
TDARKRALRLFGNLLGNSLYDVNYTRNI

SEQ ID NO: 3018933 - protein, 30 aa, Entamoeba invadens
TDCEVGEDLLYLFKKYILFGSVPENAHLTG

SEQ ID NO: 3018934 - protein, 26 aa, Entamoeba invadens
TDCFYEKFLCVWDYAAASLIVEEAGG

SEQ ID NO: 3018935 - protein, 19 aa, Entamoeba invadens
TDDCPVFDGLYPFVQTVVG

SEQ ID NO: 3018936 - protein, 23 aa, Entamoeba invadens
TDDFIWKYIRVLVKNGITVDSQT

SEQ ID NO: 3018937 - protein, 31 aa, Entamoeba invadens
TDDGIFGTLIAWVYVIEFQKRGLPHSHILVV

SEQ ID NO: 3018938 - protein, 23 aa, Entamoeba invadens
TDDGVYYVATKLYRNGNYQQAIE

SEQ ID NO: 3018939 - protein, 24 aa, Entamoeba invadens
TDDIFKTKFIAKSPVDLFEKNEIV

SEQ ID NO: 3018940 - protein, 27 aa, Entamoeba invadens
TDDISQVFRMLLKYPLTPLEIKNVVWA

SEQ ID NO: 3018941 - protein, 23 aa, Entamoeba invadens
TDDKFLAVYEILKTALKTEEEMK

SEQ ID NO: 3018942 - protein, 31 aa, Entamoeba invadens
TDDNPIFWDNFLKLIYDRGILCGILGDQLSE

SEQ ID NO: 3018943 - protein, 17 aa, Entamoeba invadens
TDDQLIEIFKEFKPLFV

SEQ ID NO: 3018944 - protein, 17 aa, Entamoeba invadens
TDDWCLYGLDIGGEGEN

SEQ ID NO: 3018945 - protein, 23 aa, Entamoeba invadens
TDDYEALFYICNGGIHVFKKDQG

SEQ ID NO: 3018946 - protein, 24 aa, Entamoeba invadens
TDDYINILAFLLTESHLTNIFGIL

SEQ ID NO: 3018947 - protein, 30 aa, Entamoeba invadens
TDEAGRVKPQWFWYLIEEHFRENGLVKQQL

SEQ ID NO: 3018948 - protein, 26 aa, Entamoeba invadens
TDECASDINWVQWKIYEENGRYFLRK

SEQ ID NO: 3018949 - protein, 23 aa, Entamoeba invadens
TDEEIVLLLLTYSQKVKTLQEEL

SEQ ID NO: 3018950 - protein, 31 aa, Entamoeba invadens
TDEFYALTVFSLLFEILRDNSLYIGHSQTVE

SEQ ID NO: 3018951 - protein, 22 aa, Entamoeba invadens
TDEFYVSTPFYTATKVIIKPKY

SEQ ID NO: 3018952 - protein, 25 aa, Entamoeba invadens
TDEKLKKILTLIFSTEEFQSEDMFT

SEQ ID NO: 3018953 - protein, 24 aa, Entamoeba invadens
TDEKVLNTFRKMKYVYFVCTDAMC

SEQ ID NO: 3018954 - protein, 18 aa, Entamoeba invadens
TDELIGVPLLVFANKHDL

SEQ ID NO: 3018955 - protein, 25 aa, Entamoeba invadens
TDEMRVVVTCPAYFKDLQKELTSEA

SEQ ID NO: 3018956 - protein, 29 aa, Entamoeba invadens
TDEPRMFSLFVNIMFLVAPMWEKDGKNSV

SEQ ID NO: 3018957 - protein, 20 aa, Entamoeba invadens
TDEVYCCSTFYAQNRGGEAN

SEQ ID NO: 3018958 - protein, 35 aa, Entamoeba invadens
TDEYFGRELTKLKEKLHLLWGENKRLKTILECSEA

SEQ ID NO: 3018959 - protein, 28 aa, Entamoeba invadens
TDFCSFFVVFFISRIELVDKNGWGNFAS

SEQ ID NO: 3018960 - protein, 21 aa, Entamoeba invadens
TDFCTLVRPIYEFAQDSITHK

SEQ ID NO: 3018961 - protein, 27 aa, Entamoeba invadens
TDFEKLKMACLPKIPYFVEMHSMEIIN

SEQ ID NO: 3018962 - protein, 36 aa, Entamoeba invadens
TDFEKWKIWGYDQSLHNWLIYTRKLDYLNPVFESCT

SEQ ID NO: 3018963 - protein, 20 aa, Entamoeba invadens
TDFELILADLVYQTDYNGFT

SEQ ID NO: 3018964 - protein, 23 aa, Entamoeba invadens
TDFKAYLRSFKFSDRQSVIIGTM

SEQ ID NO: 3018965 - protein, 20 aa, Entamoeba invadens
TDFKNSLIAVLRKYKTFGLK

SEQ ID NO: 3018966 - protein, 29 aa, Entamoeba invadens
TDFNIEGLMYMFYKPDEIINKLLMTHLKK

SEQ ID NO: 3018967 - protein, 31 aa, Entamoeba invadens
TDFPHDHLVIQNLPPFPIPISEKQKVILEHA

SEQ ID NO: 3018968 - protein, 23 aa, Entamoeba invadens
TDFPWEMFFVVFGELLEKKVAGM

SEQ ID NO: 3018969 - protein, 20 aa, Entamoeba invadens
TDFQYLSRNRFLCAIEGFDN

SEQ ID NO: 3018970 - protein, 21 aa, Entamoeba invadens
TDFRCSVILRSTLPPAKIVEV

SEQ ID NO: 3018971 - protein, 24 aa, Entamoeba invadens
TDFTRSYVECNTNYYPINGRCVAC

SEQ ID NO: 3018972 - protein, 25 aa, Entamoeba invadens
TDGDTLKLFFPTTKKIKTPLKVHAV

SEQ ID NO: 3018973 - protein, 34 aa, Entamoeba invadens
TDGIVYFHGTATFLDYSSLWKWVSCLDFGAENGP

SEQ ID NO: 3018974 - protein, 20 aa, Entamoeba invadens
TDGKCYVEMDIALGVLEEKG

SEQ ID NO: 3018975 - protein, 27 aa, Entamoeba invadens
TDHEVKRLFLFYLSTVQRVDEAGKLLP

SEQ ID NO: 3018976 - protein, 25 aa, Entamoeba invadens
TDIDKVLVMLSKLFRARAFTFDYPG

SEQ ID NO: 3018977 - protein, 24 aa, Entamoeba invadens
TDIEMLGLIFSWVLKNMDKNVLKE

SEQ ID NO: 3018978 - protein, 17 aa, Entamoeba invadens
TDIFSFKLPTELNILVY

SEQ ID NO: 3018979 - protein, 30 aa, Entamoeba invadens
TDIHKFDLYYYYIKLCMVSYGKWVFIQGNK

SEQ ID NO: 3018980 - protein, 21 aa, Entamoeba invadens
TDIILAVMYINSEYKIIFAED

SEQ ID NO: 3018981 - protein, 24 aa, Entamoeba invadens
TDIIVLEDFMRILEETRAKAFYVK

SEQ ID NO: 3018982 - protein, 22 aa, Entamoeba invadens
TDIKNCLRDLLTKALAPRVEPM

SEQ ID NO: 3018983 - protein, 38 aa, Entamoeba invadens
TDIKRLCFVQCHLLELIILPSYMKIINNCTFYGCSALK

SEQ ID NO: 3018984 - protein, 17 aa, Entamoeba invadens
TDILKLLTFVQNKEFIK

SEQ ID NO: 3018985 - protein, 17 aa, Entamoeba invadens
TDILNRFKKFETRFFIF

SEQ ID NO: 3018986 - protein, 28 aa, Entamoeba invadens
TDILRRAFMSRMFPPETIKKLGIKHVRG

SEQ ID NO: 3018987 - protein, 18 aa, Entamoeba invadens
TDIPITLLSGESISLNIS

SEQ ID NO: 3018988 - protein, 25 aa, Entamoeba invadens
TDIPNILYAVQPFGKVLGAEDVGDF

SEQ ID NO: 3018989 - protein, 39 aa, Entamoeba invadens
TDISIPLPDFLINKFLGIAIGWYIRLMKKSAINDGIKQY

SEQ ID NO: 3018990 - protein, 20 aa, Entamoeba invadens
TDITPPPIPPSPRSGPKPNG

SEQ ID NO: 3018991 - protein, 24 aa, Entamoeba invadens
TDIYLFDYRKLMISGNYNLAVMLP

SEQ ID NO: 3018992 - protein, 29 aa, Entamoeba invadens
TDIYNFITDHWNLLGKLKLFQSVNWKKNI

SEQ ID NO: 3018993 - protein, 33 aa, Entamoeba invadens
TDKADNRHLLGLLYLLFRKYRLDTIKNDEGTEK

SEQ ID NO: 3018994 - protein, 28 aa, Entamoeba invadens
TDKDTLLHLPVYLSKIFDIKKKVQKKAN

SEQ ID NO: 3018995 - protein, 31 aa, Entamoeba invadens
TDKEMWLKTNMLNNLPYYATAKRIKVLMCTW

SEQ ID NO: 3018996 - protein, 20 aa, Entamoeba invadens
TDKILTVPPVRKPLGRINRA

SEQ ID NO: 3018997 - protein, 25 aa, Entamoeba invadens
TDKKNDFFLFCFNPETKSKITKKVN

SEQ ID NO: 3018998 - protein, 17 aa, Entamoeba invadens
TDKLVQFGYLNINDIVY

SEQ ID NO: 3018999 - protein, 31 aa, Entamoeba invadens
TDKPKTFLPEQISALVLKYLYSIVQDNLVTK

SEQ ID NO: 3019000 - protein, 19 aa, Entamoeba invadens
TDKPWVNTVPTMKSLQQLL

SEQ ID NO: 3019001 - protein, 34 aa, Entamoeba invadens
TDLALFMNDKVVTALYLSWNNQRFSSLLYDSKEN

SEQ ID NO: 3019002 - protein, 20 aa, Entamoeba invadens
TDLFDEILDLKFVRPQKTET

SEQ ID NO: 3019003 - protein, 23 aa, Entamoeba invadens
TDLFDGILLLEMLYRHGKMWCHT

SEQ ID NO: 3019004 - protein, 17 aa, Entamoeba invadens
TDLFISYGYCEIEYILE

SEQ ID NO: 3019005 - protein, 22 aa, Entamoeba invadens
TDLKEYAFLVSSIAKLQCITPT

SEQ ID NO: 3019006 - protein, 25 aa, Entamoeba invadens
TDLKNGVTMFRFTQALTGKGNAIKY

SEQ ID NO: 3019007 - protein, 22 aa, Entamoeba invadens
TDLPDFLFDSTTPSYGKYALPA

SEQ ID NO: 3019008 - protein, 25 aa, Entamoeba invadens
TDLSTMYVMLKYRKWQIKERKSTSL

SEQ ID NO: 3019009 - protein, 18 aa, Entamoeba invadens
TDLTTHEFYTFPFSYCLC

SEQ ID NO: 3019010 - protein, 24 aa, Entamoeba invadens
TDLTVKEFLLKCAVNMINMARTTE

SEQ ID NO: 3019011 - protein, 19 aa, Entamoeba invadens
TDLVFNSTKIYQFSEGAFK

SEQ ID NO: 3019012 - protein, 27 aa, Entamoeba invadens
TDMSPYQSFTPYVPQNVMFKTEPPQFP

SEQ ID NO: 3019013 - protein, 17 aa, Entamoeba invadens
TDNAIHALFKKYSPISC

SEQ ID NO: 3019014 - protein, 25 aa, Entamoeba invadens
TDNELDLFIELFKSLHPTTITPSGM

SEQ ID NO: 3019015 - protein, 27 aa, Entamoeba invadens
TDNIETKLTFILLSLHSLKVEEVPKKY

SEQ ID NO: 3019016 - protein, 19 aa, Entamoeba invadens
TDNLFISLIKIFQSENAQI

SEQ ID NO: 3019017 - protein, 24 aa, Entamoeba invadens
TDNNEKILDFLLQTEFQSKIVDLE

SEQ ID NO: 3019018 - protein, 25 aa, Entamoeba invadens
TDNPPYVLLPTDRVFYAYRICVVKM

SEQ ID NO: 3019019 - protein, 29 aa, Entamoeba invadens
TDNQRESFFKKFILPYLDALKKNTHAKHL

SEQ ID NO: 3019020 - protein, 24 aa, Entamoeba invadens
TDNTILTHLIFNTLTTDKFTATSA

SEQ ID NO: 3019021 - protein, 23 aa, Entamoeba invadens
TDPHHDFFLTIKTTPALLETTHI

SEQ ID NO: 3019022 - protein, 22 aa, Entamoeba invadens
TDPIPFINRIITLKLDKVRLEG

SEQ ID NO: 3019023 - protein, 22 aa, Entamoeba invadens
TDPLLGKHLAFYGIDMSKLVKT

SEQ ID NO: 3019024 - protein, 23 aa, Entamoeba invadens
TDPNWLESLKKYVTDFDPYRYRN

SEQ ID NO: 3019025 - protein, 25 aa, Entamoeba invadens
TDPREGMKPTWQFVIGSEVCGLDVN

SEQ ID NO: 3019026 - protein, 24 aa, Entamoeba invadens
TDPTELFFYKLSSIKGVHERLESW

SEQ ID NO: 3019027 - protein, 26 aa, Entamoeba invadens
TDQKDWDLFFQKIVIVYDSTFFVKDI

SEQ ID NO: 3019028 - protein, 25 aa, Entamoeba invadens
TDQMTYAVLYISLGDCRGLLVHRSS

SEQ ID NO: 3019029 - protein, 20 aa, Entamoeba invadens
TDQNAVDWGWQILECSKLAV

SEQ ID NO: 3019030 - protein, 25 aa, Entamoeba invadens
TDRDVQLLIEQFKAPSSNFNNSRLE

SEQ ID NO: 3019031 - protein, 37 aa, Entamoeba invadens
TDRIKTIMFNDLNVPFLKIVNPALMALYAEGQETGIV

SEQ ID NO: 3019032 - protein, 24 aa, Entamoeba invadens
TDRKALIWDLYPIESGKPPMVLQY

SEQ ID NO: 3019033 - protein, 25 aa, Entamoeba invadens
TDRVDQLVLLLQKFKEHTVTQKLRL

SEQ ID NO: 3019034 - protein, 29 aa, Entamoeba invadens
TDSEFRKKMWKMLFIYAYEHQSMNYQQGF

SEQ ID NO: 3019035 - protein, 26 aa, Entamoeba invadens
TDSGRTFSIFFSKPQKKILFITHNEK

SEQ ID NO: 3019036 - protein, 24 aa, Entamoeba invadens
TDSKYFYIHSCLSYLAMKKKYSFI

SEQ ID NO: 3019037 - protein, 23 aa, Entamoeba invadens
TDSLPTAVFPTLVGYTKTKEAFP

SEQ ID NO: 3019038 - protein, 26 aa, Entamoeba invadens
TDSNFPTFFPSFLITEVFGRSEWVVI

SEQ ID NO: 3019039 - protein, 17 aa, Entamoeba invadens
TDSPFPRGIVDLIAECW

SEQ ID NO: 3019040 - protein, 25 aa, Entamoeba invadens
TDSTQLFRLYVWTNQSNGNVITRSF

SEQ ID NO: 3019041 - protein, 19 aa, Entamoeba invadens
TDTLFLKLFEEKNEKRILL

SEQ ID NO: 3019042 - protein, 25 aa, Entamoeba invadens
TDTLKKIFHPNIILIMGVCVEKSVT

SEQ ID NO: 3019043 - protein, 22 aa, Entamoeba invadens
TDTNNLFTMPLFGDQSTTNLST

SEQ ID NO: 3019044 - protein, 33 aa, Entamoeba invadens
TDTPQRFEVCAIALYWILFQQNYRISEELALTI

SEQ ID NO: 3019045 - protein, 27 aa, Entamoeba invadens
TDTRSSWFYHYFTPELKLMDKETRKAL

SEQ ID NO: 3019046 - protein, 23 aa, Entamoeba invadens
TDTSKKIVIFGFHGLNKTEKEVR

SEQ ID NO: 3019047 - protein, 31 aa, Entamoeba invadens
TDTTKIPYFNFVRYLVIYAPFQTLPNGFLEV

SEQ ID NO: 3019048 - protein, 23 aa, Entamoeba invadens
TDTTKMFRDVKLNYLQKTKDQLQ

SEQ ID NO: 3019049 - protein, 30 aa, Entamoeba invadens
TDTTQLRRVLSLLPFLRYARTITMTCGEND

SEQ ID NO: 3019050 - protein, 25 aa, Entamoeba invadens
TDTYKFHYFQTPTNLRFVLFTDNCL

SEQ ID NO: 3019051 - protein, 20 aa, Entamoeba invadens
TDVELHCKYYSLNTTKCIEC

SEQ ID NO: 3019052 - protein, 24 aa, Entamoeba invadens
TDVFLICFSVISKVSYKNACTKWV

SEQ ID NO: 3019053 - protein, 30 aa, Entamoeba invadens
TDVGQQRLPYVPLLLKYIESMTFYSNDFKE

SEQ ID NO: 3019054 - protein, 17 aa, Entamoeba invadens
TDVIVIYQPLEIALGCV

SEQ ID NO: 3019055 - protein, 31 aa, Entamoeba invadens
TDVKYRMRYSWIIFSLLIKGIIGYYNDYKVF

SEQ ID NO: 3019056 - protein, 18 aa, Entamoeba invadens
TDVLIHFIIRRSNRFFDD

SEQ ID NO: 3019057 - protein, 26 aa, Entamoeba invadens
TDVMKEYWGYFPLKDDFVAAQCVDVT

SEQ ID NO: 3019058 - protein, 20 aa, Entamoeba invadens
TDVVPISLGILSYGVLFEKI

SEQ ID NO: 3019059 - protein, 26 aa, Entamoeba invadens
TDVYSLGLVIWFTLESQGSAPFIATT

SEQ ID NO: 3019060 - protein, 31 aa, Entamoeba invadens
TDYLARPARLPFLSLLLDLPPDVSDIQQFIP

SEQ ID NO: 3019061 - protein, 22 aa, Entamoeba invadens
TDYLVQHIYYIIPALEETDDYY

SEQ ID NO: 3019062 - protein, 27 aa, Entamoeba invadens
TDYNAAMLFIQSWLNVSSQSFSRMAVL

SEQ ID NO: 3019063 - protein, 28 aa, Entamoeba invadens
TDYPIAEAFMKNIWIPNSGIYIIVYSID

SEQ ID NO: 3019064 - protein, 22 aa, Entamoeba invadens
TDYTAFSLRRYIFEKGSGVTIM

SEQ ID NO: 3019065 - protein, 24 aa, Entamoeba invadens
TDYVNNVYIYPLEFAVPSKERKRC

SEQ ID NO: 3019066 - protein, 30 aa, Entamoeba invadens
TDYVRSTYFHPTKPWILSCSDDRTIRIWNY

SEQ ID NO: 3019067 - protein, 18 aa, Entamoeba invadens
TDYYFYTQHDWCEAGFFV

SEQ ID NO: 3019068 - protein, 29 aa, Entamoeba invadens
TEAALCDSLAFLLKIMDDPKFENIPLDDK

SEQ ID NO: 3019069 - protein, 24 aa, Entamoeba invadens
TEADKNIQIFKFQIDEFQMKIKEL

SEQ ID NO: 3019070 - protein, 17 aa, Entamoeba invadens
TEAFLNCPELEKVILNG

SEQ ID NO: 3019071 - protein, 18 aa, Entamoeba invadens
TEAPINFLPTYKFVIGTQ

SEQ ID NO: 3019072 - protein, 22 aa, Entamoeba invadens
TECKDGFYLKDSTCLPCTVTNC

SEQ ID NO: 3019073 - protein, 25 aa, Entamoeba invadens
TECLHLLIDILTELGYFFNTSKSQG

SEQ ID NO: 3019074 - protein, 27 aa, Entamoeba invadens
TECQIYLTINSILIIDLVSVRDIDLSS

SEQ ID NO: 3019075 - protein, 20 aa, Entamoeba invadens
TECTLFKYIFERKNTMWKNQ

SEQ ID NO: 3019076 - protein, 24 aa, Entamoeba invadens
TEDCAFSDLLWSDPLQYEVYDEKY

SEQ ID NO: 3019077 - protein, 28 aa, Entamoeba invadens
TEDDFANFLVRPLYLMKTSRGMNKILDT

SEQ ID NO: 3019078 - protein, 22 aa, Entamoeba invadens
TEDERLMWLATLMFHSEMSSVY

SEQ ID NO: 3019079 - protein, 22 aa, Entamoeba invadens
TEDGFVIPSMRTKLGERIFLFH

SEQ ID NO: 3019080 - protein, 24 aa, Entamoeba invadens
TEDIPRKFIALKKTKPDGTTLANL

SEQ ID NO: 3019081 - protein, 17 aa, Entamoeba invadens
TEDKVVEWLTGSVTVKY

SEQ ID NO: 3019082 - protein, 34 aa, Entamoeba invadens
TEDLKHFVFTLRNPVMIPPTPIYPRIDNRNILLI

SEQ ID NO: 3019083 - protein, 17 aa, Entamoeba invadens
TEDLSLDSILMECEKHN

SEQ ID NO: 3019084 - protein, 33 aa, Entamoeba invadens
TEDRSLIGIFETTLRFNFWDKITFKFEVDAIGK

SEQ ID NO: 3019085 - protein, 25 aa, Entamoeba invadens
TEDSFISLFSFFKNILEDLYLKKGE

SEQ ID NO: 3019086 - protein, 28 aa, Entamoeba invadens
TEEAAWRAIIPQVQLINSFFEFSRSMKT

SEQ ID NO: 3019087 - protein, 26 aa, Entamoeba invadens
TEEDIQYFNFVIGHYIRSHNFQNYTY

SEQ ID NO: 3019088 - protein, 27 aa, Entamoeba invadens
TEEEKLLHLVKIFPSQWQTISKSVGRT

SEQ ID NO: 3019089 - protein, 23 aa, Entamoeba invadens
TEEIIWTLSVCIPVLGVSLFGRN

SEQ ID NO: 3019090 - protein, 31 aa, Entamoeba invadens
TEEIVQYLTRLFYIKRIVSEGDFRLIVTTKG

SEQ ID NO: 3019091 - protein, 33 aa, Entamoeba invadens
TEEKLKNLFDPFGVVLKFYVIENGGKKTWIGSD

SEQ ID NO: 3019092 - protein, 29 aa, Entamoeba invadens
TEELAKSKLIRIYFICHSQQTTRIRFNEF

SEQ ID NO: 3019093 - protein, 28 aa, Entamoeba invadens
TEELVLYYLFSVFKLPYNQMLTFVCGDF

SEQ ID NO: 3019094 - protein, 25 aa, Entamoeba invadens
TEENEIVLKVGALLIKMATARMEAN

SEQ ID NO: 3019095 - protein, 18 aa, Entamoeba invadens
TEENEPLYYCPFCGSSMG

SEQ ID NO: 3019096 - protein, 27 aa, Entamoeba invadens
TEENHLYTPFLPSVDFLPNSTILQINS

SEQ ID NO: 3019097 - protein, 37 aa, Entamoeba invadens
TEENVLMLPWNHLEFDWMLLHHKMVPFVTTRFSIDGR

SEQ ID NO: 3019098 - protein, 21 aa, Entamoeba invadens
TEEQIQLIGKLFSEVGSVSFV

SEQ ID NO: 3019099 - protein, 25 aa, Entamoeba invadens
TEERAIFNDLMIKKLMLAINSTREG

SEQ ID NO: 3019100 - protein, 23 aa, Entamoeba invadens
TEESALRALQLDGANLAGRVVRV

SEQ ID NO: 3019101 - protein, 26 aa, Entamoeba invadens
TEEVKAVVFLLTEISKNVECVHWDIG

SEQ ID NO: 3019102 - protein, 20 aa, Entamoeba invadens
TEEYKCFSKYLKIAQIFDSL

SEQ ID NO: 3019103 - protein, 23 aa, Entamoeba invadens
TEEYKCFSKYLKIAQIFDSLSVE

SEQ ID NO: 3019104 - protein, 24 aa, Entamoeba invadens
TEEYKCFSKYLKIAQIFDSLSVEN

SEQ ID NO: 3019105 - protein, 29 aa, Entamoeba invadens
TEFAFHRQGIILVPLYSTLTTEQLCHVID

SEQ ID NO: 3019106 - protein, 23 aa, Entamoeba invadens
TEFDNLLRDVLAPLIEQIENVQH

SEQ ID NO: 3019107 - protein, 26 aa, Entamoeba invadens
TEFECLGCQTVFYLNDNKLCNSCSEF

SEQ ID NO: 3019108 - protein, 20 aa, Entamoeba invadens
TEFFNGIVLVVVMKTINKKD

SEQ ID NO: 3019109 - protein, 26 aa, Entamoeba invadens
TEFHSKIIVLDFLKKRFDFPMDMFKE

SEQ ID NO: 3019110 - protein, 17 aa, Entamoeba invadens
TEFIWNAIKRNCEMMGA

SEQ ID NO: 3019111 - protein, 33 aa, Entamoeba invadens
TEFPEPPLLEIPQFPEFLLIDKQLFCEKLEGKT

SEQ ID NO: 3019112 - protein, 25 aa, Entamoeba invadens
TEFVRKIFPKVVRLSLLFPNPDDDE

SEQ ID NO: 3019113 - protein, 29 aa, Entamoeba invadens
TEGGYVEWLYAFTNLYDKILPESACPYAE

SEQ ID NO: 3019114 - protein, 29 aa, Entamoeba invadens
TEGMFSQYVFLAFTNILTAALDIFPQIQL

SEQ ID NO: 3019115 - protein, 28 aa, Entamoeba invadens
TEHYAKLFLRFIRRLLCSKANYIFKENI

SEQ ID NO: 3019116 - protein, 31 aa, Entamoeba invadens
TEHYKSFIFIGPVWWWGINGPLKNACKEILK

SEQ ID NO: 3019117 - protein, 24 aa, Entamoeba invadens
TEIAKFAKFLKLRTTAVFGGMGIS

SEQ ID NO: 3019118 - protein, 26 aa, Entamoeba invadens
TEIDKYRTLLLFPKMPNFIQEQIAMI

SEQ ID NO: 3019119 - protein, 25 aa, Entamoeba invadens
TEIDSLLCKLQRDYDKYNANKNSNP

SEQ ID NO: 3019120 - protein, 27 aa, Entamoeba invadens
TEIEKTFYRIIVWFSVDYNTFNKNKNR

SEQ ID NO: 3019121 - protein, 20 aa, Entamoeba invadens
TEIISSLCEVLILLKERKEA

SEQ ID NO: 3019122 - protein, 26 aa, Entamoeba invadens
TEIKPLVTLHYKPLKERLTDPGEIAF

SEQ ID NO: 3019123 - protein, 24 aa, Entamoeba invadens
TEILGPWLRREVLLFESVSLCESI

SEQ ID NO: 3019124 - protein, 19 aa, Entamoeba invadens
TEIPEFFEKIDLIAGLSAS

SEQ ID NO: 3019125 - protein, 31 aa, Entamoeba invadens
TEIPENPVPPKIPQKAPPKLPQRIPELYDFT

SEQ ID NO: 3019126 - protein, 17 aa, Entamoeba invadens
TEIPKIPDNTFILDQEG

SEQ ID NO: 3019127 - protein, 22 aa, Entamoeba invadens
TEIPKRRPPPPPPQKMKSVDHT

SEQ ID NO: 3019128 - protein, 26 aa, Entamoeba invadens
TEIPRSEAFIFIGYDEDTINTYTNTQ

SEQ ID NO: 3019129 - protein, 22 aa, Entamoeba invadens
TEIQIISPIHPLSSRPWTGTRL

SEQ ID NO: 3019130 - protein, 28 aa, Entamoeba invadens
TEIVDLFYETFLLPNIQTFKIKSSQINE

SEQ ID NO: 3019131 - protein, 21 aa, Entamoeba invadens
TEIVYKYLLSQDGWKTYMLNT

SEQ ID NO: 3019132 - protein, 19 aa, Entamoeba invadens
TEIWMGKNLNKIELFTFCD

SEQ ID NO: 3019133 - protein, 19 aa, Entamoeba invadens
TEIYFSFGKILTFDYVVKT

SEQ ID NO: 3019134 - protein, 28 aa, Entamoeba invadens
TEKARLHKLMLRLKKLKIESSSSGVILL

SEQ ID NO: 3019135 - protein, 23 aa, Entamoeba invadens
TEKDFKRIFKSLSFPDLLSCRLV

SEQ ID NO: 3019136 - protein, 25 aa, Entamoeba invadens
TEKEQLTFLITKRDTLMSLTNSKGS

SEQ ID NO: 3019137 - protein, 18 aa, Entamoeba invadens
TEKFEFGEILSLFEEMKY

SEQ ID NO: 3019138 - protein, 24 aa, Entamoeba invadens
TEKFHFNPIPLAKKTRALFPKLET

SEQ ID NO: 3019139 - protein, 20 aa, Entamoeba invadens
TEKIGKLENQLLTYEKNTQE

SEQ ID NO: 3019140 - protein, 25 aa, Entamoeba invadens
TEKKLDEELRLLNLKEDGNGKEESD

SEQ ID NO: 3019141 - protein, 19 aa, Entamoeba invadens
TEKLLKVWSSYHRMERDET

SEQ ID NO: 3019142 - protein, 24 aa, Entamoeba invadens
TEKMFSLLFPHSKVIRITATDVLN

SEQ ID NO: 3019143 - protein, 26 aa, Entamoeba invadens
TEKNRPLFKELYPLPLRKEKNKRRTP

SEQ ID NO: 3019144 - protein, 19 aa, Entamoeba invadens
TEKNTIMDFLLIGETFNEK

SEQ ID NO: 3019145 - protein, 24 aa, Entamoeba invadens
TEKRDYLICYLSSYGPDVCCFENY

SEQ ID NO: 3019146 - protein, 27 aa, Entamoeba invadens
TEKRGFDLIKTVWVDKQFVGQSVTIFI

SEQ ID NO: 3019147 - protein, 24 aa, Entamoeba invadens
TEKSPAEYLYKKAVALLQSTDKTL

SEQ ID NO: 3019148 - protein, 24 aa, Entamoeba invadens
TEKTALMRPLFYNYPEDQNCDQVE

SEQ ID NO: 3019149 - protein, 23 aa, Entamoeba invadens
TEKVFLLIGDILRQAAKYALAQK

SEQ ID NO: 3019150 - protein, 23 aa, Entamoeba invadens
TEKYNLIIDLYSNGNICLTDADY

SEQ ID NO: 3019151 - protein, 19 aa, Entamoeba invadens
TELDQLQQNIDYLKKYADT

SEQ ID NO: 3019152 - protein, 19 aa, Entamoeba invadens
TELDSFASFFALFGEDMSV

SEQ ID NO: 3019153 - protein, 26 aa, Entamoeba invadens
TELERKIGFLIRANTYYESLDEDLQN

SEQ ID NO: 3019154 - protein, 23 aa, Entamoeba invadens
TELIPFYEVPKFDMSDGSSFVLC

SEQ ID NO: 3019155 - protein, 19 aa, Entamoeba invadens
TELLFSFLSSMEGRKLFLE

SEQ ID NO: 3019156 - protein, 17 aa, Entamoeba invadens
TELLQPCLGDESKTLMF

SEQ ID NO: 3019157 - protein, 18 aa, Entamoeba invadens
TELPRNISTLSRLTYIGL

SEQ ID NO: 3019158 - protein, 26 aa, Entamoeba invadens
TELSCVFWIAYLPTKVKPKFMELSNF

SEQ ID NO: 3019159 - protein, 26 aa, Entamoeba invadens
TEMDKSLMFMLLNSGAIRVYVVGSDD

SEQ ID NO: 3019160 - protein, 25 aa, Entamoeba invadens
TEMFPSLVKGLDRPIQKKDTSNWSQ

SEQ ID NO: 3019161 - protein, 19 aa, Entamoeba invadens
TEMKILLKSVSSFFRKFCN

SEQ ID NO: 3019162 - protein, 22 aa, Entamoeba invadens
TEMRTIIEKLTQMPPDQLEKIK

SEQ ID NO: 3019163 - protein, 24 aa, Entamoeba invadens
TEMVMHLVGITTFKFLSEPVAALL

SEQ ID NO: 3019164 - protein, 18 aa, Entamoeba invadens
TEMYDESGKYLWMDAIRG

SEQ ID NO: 3019165 - protein, 38 aa, Entamoeba invadens
TENELKTYFTKFGEVAYIKLKVGYCFVTFKNEEDTKKV

SEQ ID NO: 3019166 - protein, 23 aa, Entamoeba invadens
TENFAYWHSWALVNFEVVNFIEN

SEQ ID NO: 3019167 - protein, 34 aa, Entamoeba invadens
TENFILQKVDKKYYPKFFYLIDSQPLEEKDFIYL

SEQ ID NO: 3019168 - protein, 20 aa, Entamoeba invadens
TENFLKSLIFRFSDPLNKVT

SEQ ID NO: 3019169 - protein, 21 aa, Entamoeba invadens
TENLIEVCESKRFYLEDGVCQ

SEQ ID NO: 3019170 - protein, 24 aa, Entamoeba invadens
TENNEIFWMFIEDDVRADVVDASV

SEQ ID NO: 3019171 - protein, 27 aa, Entamoeba invadens
TENTFAKMFVFMFKQDFETTIDGIKKE

SEQ ID NO: 3019172 - protein, 18 aa, Entamoeba invadens
TENWIQVFDSDAMYMIFT

SEQ ID NO: 3019173 - protein, 18 aa, Entamoeba invadens
TEPKRWFHKKEHDGGIRL

SEQ ID NO: 3019174 - protein, 25 aa, Entamoeba invadens
TEPPKLPHKSLPPKLPQKQSEVVPF

SEQ ID NO: 3019175 - protein, 23 aa, Entamoeba invadens
TEPSIPQLFQRISKFSFSAPSRK

SEQ ID NO: 3019176 - protein, 29 aa, Entamoeba invadens
TEPVQLLCDLLREFGYYLEIEKKRGRKDT

SEQ ID NO: 3019177 - protein, 24 aa, Entamoeba invadens
TEPYLPEWLHFACDYIIANGLCSE

SEQ ID NO: 3019178 - protein, 26 aa, Entamoeba invadens
TEQFHTFFFKTKFVHFMLGVLPDKGE

SEQ ID NO: 3019179 - protein, 26 aa, Entamoeba invadens
TEQGLCDLPFRKISGGSNIFGKTGGV

SEQ ID NO: 3019180 - protein, 28 aa, Entamoeba invadens
TEQHTNYLLYLPLLMRHIVIQPRSEYKI

SEQ ID NO: 3019181 - protein, 30 aa, Entamoeba invadens
TEQKLEFLNIHKIDDWVWKIVKMPDETGDI

SEQ ID NO: 3019182 - protein, 26 aa, Entamoeba invadens
TEQNGLFMLFSFFDTNKNNFLSEKEY

SEQ ID NO: 3019183 - protein, 24 aa, Entamoeba invadens
TEQQFSNMCLEFDPLMACFVSTVE

SEQ ID NO: 3019184 - protein, 24 aa, Entamoeba invadens
TEQSKLFKLSKFNEAVLASEEDIK

SEQ ID NO: 3019185 - protein, 17 aa, Entamoeba invadens
TERKLFMSLTGFEKKKS

SEQ ID NO: 3019186 - protein, 17 aa, Entamoeba invadens
TERLLWEHKISANVKAV

SEQ ID NO: 3019187 - protein, 22 aa, Entamoeba invadens
TERRRVLFALEKRISGFSGKLV

SEQ ID NO: 3019188 - protein, 23 aa, Entamoeba invadens
TERYPPHEFDKVDDLTFSTINTK

SEQ ID NO: 3019189 - protein, 28 aa, Entamoeba invadens
TESDVKVFGYTLLIYMGTTEKSHYIAVV

SEQ ID NO: 3019190 - protein, 25 aa, Entamoeba invadens
TESKGIFSYFFGKTDEYEQAPKYDI

SEQ ID NO: 3019191 - protein, 27 aa, Entamoeba invadens
TESLILSLLYVIFNSMRHPVFKLFKDA

SEQ ID NO: 3019192 - protein, 36 aa, Entamoeba invadens
TESQKMNQFATKSPLPKIVSPLPLFEMETEPQQQKL

SEQ ID NO: 3019193 - protein, 44 aa, Entamoeba invadens
TESRQRICQIAIKTFNFPLFCLVSQPVLSLLSTGKSTGFCVESG

SEQ ID NO: 3019194 - protein, 26 aa, Entamoeba invadens
TESTMRRILDAIYFSKSKEITNNCRC

SEQ ID NO: 3019195 - protein, 27 aa, Entamoeba invadens
TESVEIKAPLLLFLSGGKFSVDVHGTV

SEQ ID NO: 3019196 - protein, 27 aa, Entamoeba invadens
TETALIQFIYRSPRLRVLFLNGTSAVT

SEQ ID NO: 3019197 - protein, 22 aa, Entamoeba invadens
TETEYFSLLKRFNSDPPTNVKS

SEQ ID NO: 3019198 - protein, 33 aa, Entamoeba invadens
TETIRPISVLVVKVLSLFFSFTKNPAPQGFSDL

SEQ ID NO: 3019199 - protein, 28 aa, Entamoeba invadens
TETLDGGKILKIGVIKNNAKKFVVLTDR

SEQ ID NO: 3019200 - protein, 19 aa, Entamoeba invadens
TETLLPFLDNSFFDGFCDE

SEQ ID NO: 3019201 - protein, 25 aa, Entamoeba invadens
TETMKWSLPSLLPKLEFISKIKTTH

SEQ ID NO: 3019202 - protein, 35 aa, Entamoeba invadens
TETPPSLFGFEHNFKPFLALMTQLQKKTFPCVKLN

SEQ ID NO: 3019203 - protein, 32 aa, Entamoeba invadens
TETPQKWTKLKKMTFLKNWKIAGKMGSQEYLY

SEQ ID NO: 3019204 - protein, 30 aa, Entamoeba invadens
TETQINGMRSVLLVALKLLAEKGGKGLSIS

SEQ ID NO: 3019205 - protein, 24 aa, Entamoeba invadens
TETTHFLSIFSKFVVRLGKDPVAK

SEQ ID NO: 3019206 - protein, 29 aa, Entamoeba invadens
TEVALLTHQITILTLFNISNIKLSKLFAT

SEQ ID NO: 3019207 - protein, 31 aa, Entamoeba invadens
TEVAQNFAQSFLLLDLVKLLRDVTTNNREVK

SEQ ID NO: 3019208 - protein, 25 aa, Entamoeba invadens
TEVDPLLHNLIYKCGRHNCGTSQTI

SEQ ID NO: 3019209 - protein, 26 aa, Entamoeba invadens
TEVECFRYLGILLYMGAHHDVINPVE

SEQ ID NO: 3019210 - protein, 18 aa, Entamoeba invadens
TEVTLLHPMDKHALSYCF

SEQ ID NO: 3019211 - protein, 25 aa, Entamoeba invadens
TEWDGVKVIIYFDKTDPSRSTANFL

SEQ ID NO: 3019212 - protein, 19 aa, Entamoeba invadens
TEYADILIKLVMQGVKKVE

SEQ ID NO: 3019213 - protein, 19 aa, Entamoeba invadens
TEYFVKWKGYGCRENTWET

SEQ ID NO: 3019214 - protein, 27 aa, Entamoeba invadens
TEYSYTSFFALINYMYKGITKQAFLDQ

SEQ ID NO: 3019215 - protein, 19 aa, Entamoeba invadens
TEYYYTKIDLVDEKMNDVA

SEQ ID NO: 3019216 - protein, 20 aa, Entamoeba invadens
TFAFIKSLCLSYAPINDVFF

SEQ ID NO: 3019217 - protein, 18 aa, Entamoeba invadens
TFAPKGKFYPTIYQGICI

SEQ ID NO: 3019218 - protein, 25 aa, Entamoeba invadens
TFARLKKIIIFQLAESLELVDLSNY

SEQ ID NO: 3019219 - protein, 19 aa, Entamoeba invadens
TFCENQKLFFFETSALDGT

SEQ ID NO: 3019220 - protein, 19 aa, Entamoeba invadens
TFCMDTFMCLTRLLTSIQT

SEQ ID NO: 3019221 - protein, 32 aa, Entamoeba invadens
TFCSDWIFHYFTPEVLTLFFSRNYQISNVIFK

SEQ ID NO: 3019222 - protein, 29 aa, Entamoeba invadens
TFDCHELLDMDWFGLFLASEKSQKKPLCT

SEQ ID NO: 3019223 - protein, 24 aa, Entamoeba invadens
TFDGTLSWAIYAYSLEKDLYFQLH

SEQ ID NO: 3019224 - protein, 20 aa, Entamoeba invadens
TFDISIKMYSDLLTNASKII

SEQ ID NO: 3019225 - protein, 25 aa, Entamoeba invadens
TFDVDHFFCFGITSLVKLLQELHDS

SEQ ID NO: 3019226 - protein, 19 aa, Entamoeba invadens
TFDYAPPEMLLHQEKYTHL

SEQ ID NO: 3019227 - protein, 18 aa, Entamoeba invadens
TFEAANNELITFKAKSTQ

SEQ ID NO: 3019228 - protein, 17 aa, Entamoeba invadens
TFEDGAFLVYNRIDYKE

SEQ ID NO: 3019229 - protein, 30 aa, Entamoeba invadens
TFELVIKDQGLLNLYHWGYLAVDEAHRLKN

SEQ ID NO: 3019230 - protein, 20 aa, Entamoeba invadens
TFETLQTITWLFSNICRTRL

SEQ ID NO: 3019231 - protein, 25 aa, Entamoeba invadens
TFEVFRKMYCLEELYLSGNPMTFIP

SEQ ID NO: 3019232 - protein, 25 aa, Entamoeba invadens
TFEVGHLWFDELIKKAIEKYGEVFL

SEQ ID NO: 3019233 - protein, 27 aa, Entamoeba invadens
TFEYYSELLLILKLNFLRMSAIFEVSK

SEQ ID NO: 3019234 - protein, 26 aa, Entamoeba invadens
TFFATYPFFLFFLDDCLSFFSDFQVR

SEQ ID NO: 3019235 - protein, 17 aa, Entamoeba invadens
TFFDIYPSVKKVSLENF

SEQ ID NO: 3019236 - protein, 19 aa, Entamoeba invadens
TFFGHYYSLVRVSNQWYCC

SEQ ID NO: 3019237 - protein, 17 aa, Entamoeba invadens
TFFICHGGLSPDLNSCE

SEQ ID NO: 3019238 - protein, 17 aa, Entamoeba invadens
TFFIGVEDGKVVSLLVV

SEQ ID NO: 3019239 - protein, 22 aa, Entamoeba invadens
TFFKLFELCLPNDNGKVIEDSF

SEQ ID NO: 3019240 - protein, 20 aa, Entamoeba invadens
TFFNATTKAFIALSKTFVKI

SEQ ID NO: 3019241 - protein, 17 aa, Entamoeba invadens
TFFNEILKTSKTASFFK

SEQ ID NO: 3019242 - protein, 17 aa, Entamoeba invadens
TFFTYFYDKFQALDNGI

SEQ ID NO: 3019243 - protein, 19 aa, Entamoeba invadens
TFGDIMGHYDLVYGNDPID

SEQ ID NO: 3019244 - protein, 18 aa, Entamoeba invadens
TFGGLIALKANCTTLQCV

SEQ ID NO: 3019245 - protein, 32 aa, Entamoeba invadens
TFGLDALDFIIKKLQVKFLFCSPVNKGVELVQ

SEQ ID NO: 3019246 - protein, 18 aa, Entamoeba invadens
TFGNSILLYVEPYEYTEQ

SEQ ID NO: 3019247 - protein, 25 aa, Entamoeba invadens
TFGPDILTRFLIDNNLKYLVRSHEV

SEQ ID NO: 3019248 - protein, 17 aa, Entamoeba invadens
TFGRYSMRGTGLTKISL

SEQ ID NO: 3019249 - protein, 25 aa, Entamoeba invadens
TFHDNNFFIFTLINADNIPQEKFFK

SEQ ID NO: 3019250 - protein, 19 aa, Entamoeba invadens
TFHFYNKTSFFQTKIRVCI

SEQ ID NO: 3019251 - protein, 18 aa, Entamoeba invadens
TFHQFVHRQLPFGGNSSI

SEQ ID NO: 3019252 - protein, 22 aa, Entamoeba invadens
TFHTKFPPIIFYEQATSILYQL

SEQ ID NO: 3019253 - protein, 25 aa, Entamoeba invadens
TFIDDFAFYRCRKLRSVKFNNSQIE

SEQ ID NO: 3019254 - protein, 29 aa, Entamoeba invadens
TFIEQNVDIAYFPKFIYISNVLDTADEDF

SEQ ID NO: 3019255 - protein, 20 aa, Entamoeba invadens
TFIERAVMSAWSFLSTFLDE

SEQ ID NO: 3019256 - protein, 24 aa, Entamoeba invadens
TFIESPFWQAEFVKAFTLIPEVTI

SEQ ID NO: 3019257 - protein, 18 aa, Entamoeba invadens
TFIFCKNLTNVKLPENLQ

SEQ ID NO: 3019258 - protein, 25 aa, Entamoeba invadens
TFIKKNMVVVFTFGGPAGLVNETNF

SEQ ID NO: 3019259 - protein, 22 aa, Entamoeba invadens
TFINVVNWYISPSEVEWGPLYQ

SEQ ID NO: 3019260 - protein, 19 aa, Entamoeba invadens
TFINYLLNYDYPGSNIGPE

SEQ ID NO: 3019261 - protein, 20 aa, Entamoeba invadens
TFIPFLKGKIEYLEMLYKLC

SEQ ID NO: 3019262 - protein, 26 aa, Entamoeba invadens
TFIVNSKMFFSFNSLPLYTCVFKIFK

SEQ ID NO: 3019263 - protein, 25 aa, Entamoeba invadens
TFKDSLALITAPLSAFPKMFGLSNI

SEQ ID NO: 3019264 - protein, 18 aa, Entamoeba invadens
TFKFILIGEARTGKSSIM

SEQ ID NO: 3019265 - protein, 31 aa, Entamoeba invadens
TFKISRINVLFIVYWKKIHGIPKINSGTFRG

SEQ ID NO: 3019266 - protein, 24 aa, Entamoeba invadens
TFKMMRNVWKLPLNKYGSYSIVAH

SEQ ID NO: 3019267 - protein, 27 aa, Entamoeba invadens
TFKNINRKILIFLYTEKLVVERLPVQV

SEQ ID NO: 3019268 - protein, 20 aa, Entamoeba invadens
TFKNMYWLDEISVPQNVVLI

SEQ ID NO: 3019269 - protein, 36 aa, Entamoeba invadens
TFKSINRKILIFLYTERLFIERLPIQVLESIEAYFW

SEQ ID NO: 3019270 - protein, 27 aa, Entamoeba invadens
TFKSYEELRLIILTDFFKHAFDGSGAD

SEQ ID NO: 3019271 - protein, 18 aa, Entamoeba invadens
TFKTFLKLDLSKNGIKTL

SEQ ID NO: 3019272 - protein, 25 aa, Entamoeba invadens
TFKTHPFLNQIQSLKLYDLNYKNFN

SEQ ID NO: 3019273 - protein, 25 aa, Entamoeba invadens
TFKTSYFVSLLRKMFELYPKTRDDF

SEQ ID NO: 3019274 - protein, 22 aa, Entamoeba invadens
TFKTTFGHKFECYESELKTVGK

SEQ ID NO: 3019275 - protein, 38 aa, Entamoeba invadens
TFLDPVVITFFKVPTMLLYLYLPRPVNYFGQYKTILEQ

SEQ ID NO: 3019276 - protein, 19 aa, Entamoeba invadens
TFLEHFVALCLQICKNPTS

SEQ ID NO: 3019277 - protein, 30 aa, Entamoeba invadens
TFLEHLHSYQKLHGPFLIVMPLGMVEHWHR

SEQ ID NO: 3019278 - protein, 18 aa, Entamoeba invadens
TFLGHLFAGLQIIDQRTI

SEQ ID NO: 3019279 - protein, 32 aa, Entamoeba invadens
TFLGTLRFYQQYFNSLLKKPVPFVFNQKTTKA

SEQ ID NO: 3019280 - protein, 20 aa, Entamoeba invadens
TFLIVVPRVLQKLYDVFNSE

SEQ ID NO: 3019281 - protein, 21 aa, Entamoeba invadens
TFLKCFDLFVENCQKLRELAW

SEQ ID NO: 3019282 - protein, 20 aa, Entamoeba invadens
TFLKGKILFIAAVDTKKKSG

SEQ ID NO: 3019283 - protein, 19 aa, Entamoeba invadens
TFLSLSCPSPPPLNKLEKL

SEQ ID NO: 3019284 - protein, 29 aa, Entamoeba invadens
TFLTPLIKDYFAKCLQWILPSNGDDIYYF

SEQ ID NO: 3019285 - protein, 28 aa, Entamoeba invadens
TFMANMTYACSILYKSRLPLIVVFTKTD

SEQ ID NO: 3019286 - protein, 21 aa, Entamoeba invadens
TFMVMNKDILISFKSIGTAQY

SEQ ID NO: 3019287 - protein, 25 aa, Entamoeba invadens
TFNDRRQYIFITPHNLDGVQSSDSV

SEQ ID NO: 3019288 - protein, 22 aa, Entamoeba invadens
TFNFFKINVWFEVDYKMYKTSE

SEQ ID NO: 3019289 - protein, 27 aa, Entamoeba invadens
TFNHPKRKPLYFSFASQDFTQFFDTTT

SEQ ID NO: 3019290 - protein, 27 aa, Entamoeba invadens
TFNLHLPNVTFYVSFLSSLAFDNNIDF

SEQ ID NO: 3019291 - protein, 36 aa, Entamoeba invadens
TFNSYVILPVQRIPRYRLLLTELLKTMTPQHGEYIA

SEQ ID NO: 3019292 - protein, 20 aa, Entamoeba invadens
TFNVLPFSAVIDSKILCIHG

SEQ ID NO: 3019293 - protein, 17 aa, Entamoeba invadens
TFNYVFNKKYDKMGLSF

SEQ ID NO: 3019294 - protein, 31 aa, Entamoeba invadens
TFPADFTFTFKQDILFTQMKFVFNREAEAFG

SEQ ID NO: 3019295 - protein, 25 aa, Entamoeba invadens
TFPAKLCSLQLRFLDVSFNKLSSLD

SEQ ID NO: 3019296 - protein, 22 aa, Entamoeba invadens
TFPATYLFNFSETAKFNSIQFK

SEQ ID NO: 3019297 - protein, 29 aa, Entamoeba invadens
TFPDETFYRRIIWYPTAYLNISNLTTFEY

SEQ ID NO: 3019298 - protein, 26 aa, Entamoeba invadens
TFPKLTELYVRWSKLLVFRGKFDEHM

SEQ ID NO: 3019299 - protein, 17 aa, Entamoeba invadens
TFPLYYAVKAKNTNVMQ

SEQ ID NO: 3019300 - protein, 26 aa, Entamoeba invadens
TFPSKFNLLSLLIKDVTWRSNQLQLP

SEQ ID NO: 3019301 - protein, 19 aa, Entamoeba invadens
TFPWKMCLGVFKNFPKSFD

SEQ ID NO: 3019302 - protein, 26 aa, Entamoeba invadens
TFRDVLFARLSVCLALIKTGRVTTSA

SEQ ID NO: 3019303 - protein, 18 aa, Entamoeba invadens
TFRMEKITDILLNDKIII

SEQ ID NO: 3019304 - protein, 22 aa, Entamoeba invadens
TFRRCVNTAQYLNVFFDCMDAV

SEQ ID NO: 3019305 - protein, 24 aa, Entamoeba invadens
TFSDFHFVCYLKGKGSKQFVNGEV

SEQ ID NO: 3019306 - protein, 17 aa, Entamoeba invadens
TFSFLHVSVIKPDELEN

SEQ ID NO: 3019307 - protein, 18 aa, Entamoeba invadens
TFSGGKFLYLVENGRITQ

SEQ ID NO: 3019308 - protein, 17 aa, Entamoeba invadens
TFSLLGKMNESEKFIEC

SEQ ID NO: 3019309 - protein, 17 aa, Entamoeba invadens
TFSLLPPGDSVTADVLL

SEQ ID NO: 3019310 - protein, 19 aa, Entamoeba invadens
TFSQPPPQFQLQPPRAQLS

SEQ ID NO: 3019311 - protein, 30 aa, Entamoeba invadens
TFSQVFKPYRDLIMAYALGVRLTIVDSVNE

SEQ ID NO: 3019312 - protein, 21 aa, Entamoeba invadens
TFSRIFIGNICRFGADVRYWP

SEQ ID NO: 3019313 - protein, 27 aa, Entamoeba invadens
TFSWCATLERIVLPQSLTTLGRKVFEH

SEQ ID NO: 3019314 - protein, 20 aa, Entamoeba invadens
TFTCRPWAYPNYQRYRINRI

SEQ ID NO: 3019315 - protein, 24 aa, Entamoeba invadens
TFTETLVWVYVLRLQSNISLKGKI

SEQ ID NO: 3019316 - protein, 25 aa, Entamoeba invadens
TFTHEKFSKLFEPYNPVSLSFEEKH

SEQ ID NO: 3019317 - protein, 19 aa, Entamoeba invadens
TFTHIINETPIEIAIEAGT

SEQ ID NO: 3019318 - protein, 18 aa, Entamoeba invadens
TFTILLKGFKGKTPDEVC

SEQ ID NO: 3019319 - protein, 31 aa, Entamoeba invadens
TFTKKYLLNDIQKLFLKDPLKYIRIVVPCLA

SEQ ID NO: 3019320 - protein, 30 aa, Entamoeba invadens
TFTQFIGKQKTLFVNFSLTKKEGSLLDTLQ

SEQ ID NO: 3019321 - protein, 17 aa, Entamoeba invadens
TFTQNYRHFISVKCIIQ

SEQ ID NO: 3019322 - protein, 25 aa, Entamoeba invadens
TFTRLGYLALMRMLSHFGHYSQQIK

SEQ ID NO: 3019323 - protein, 23 aa, Entamoeba invadens
TFTRQIMEFLNGVDNLVVAIGIK

SEQ ID NO: 3019324 - protein, 24 aa, Entamoeba invadens
TFTRRPLKMKSTEIKYGRLSSILN

SEQ ID NO: 3019325 - protein, 26 aa, Entamoeba invadens
TFTVEIIKATGLPILGWGFPDPYACV

SEQ ID NO: 3019326 - protein, 24 aa, Entamoeba invadens
TFVDEEFLRTFLWVCGNIVACTQE

SEQ ID NO: 3019327 - protein, 19 aa, Entamoeba invadens
TFVFFQNQKVIIKRLAALS

SEQ ID NO: 3019328 - protein, 18 aa, Entamoeba invadens
TFVFYIPNNSQFINMLTV

SEQ ID NO: 3019329 - protein, 28 aa, Entamoeba invadens
TFVGKRGPLLVVLFLNDVELRNLEKPMN

SEQ ID NO: 3019330 - protein, 21 aa, Entamoeba invadens
TFVGVVLYLNKKSLPFIPQIL

SEQ ID NO: 3019331 - protein, 24 aa, Entamoeba invadens
TFVNRAKRYFSGGYLKVLDDYTAI

SEQ ID NO: 3019332 - protein, 17 aa, Entamoeba invadens
TFVPAFSIGIVGNYMKH

SEQ ID NO: 3019333 - protein, 18 aa, Entamoeba invadens
TFVQFLMEKPFTVPLDSA

SEQ ID NO: 3019334 - protein, 25 aa, Entamoeba invadens
TFVQPNVFVSPIRYAPLSSVVSDPR

SEQ ID NO: 3019335 - protein, 21 aa, Entamoeba invadens
TFVRALKVLKPFLINVKIVHC

SEQ ID NO: 3019336 - protein, 18 aa, Entamoeba invadens
TFVSSKFLPTKYIPLHRN

SEQ ID NO: 3019337 - protein, 24 aa, Entamoeba invadens
TFVYNYIIKLVDLKELSLPSTLKK

SEQ ID NO: 3019338 - protein, 17 aa, Entamoeba invadens
TFWVFLNKAVSVMRDFH

SEQ ID NO: 3019339 - protein, 26 aa, Entamoeba invadens
TFYGCLVKKFLYKLTGANVRMNWESY

SEQ ID NO: 3019340 - protein, 18 aa, Entamoeba invadens
TFYGMLLRRTTCSCGYHS

SEQ ID NO: 3019341 - protein, 26 aa, Entamoeba invadens
TFYLISLLAKHCCVRFIVTHPLQSTL

SEQ ID NO: 3019342 - protein, 19 aa, Entamoeba invadens
TFYPTVLSTLPNLRVLDFS

SEQ ID NO: 3019343 - protein, 21 aa, Entamoeba invadens
TFYTTALNGFIPQVIEGYNCT

SEQ ID NO: 3019344 - protein, 29 aa, Entamoeba invadens
TGAFDYTTRLIFGKWYLSLSNNEIVWCNE

SEQ ID NO: 3019345 - protein, 32 aa, Entamoeba invadens
TGAGKTSLILYYLLHVFPLEYIPSVIKNVIIE

SEQ ID NO: 3019346 - protein, 22 aa, Entamoeba invadens
TGALFLVFEYMPHDLQSLLYSP

SEQ ID NO: 3019347 - protein, 30 aa, Entamoeba invadens
TGAQFWEVFISMMWRFYRNKSISYNTKRKV

SEQ ID NO: 3019348 - protein, 27 aa, Entamoeba invadens
TGAQTIFLKKKIYITIMSCYNFEECVH

SEQ ID NO: 3019349 - protein, 20 aa, Entamoeba invadens
TGAVVPYLGLILSDLLFTTD

SEQ ID NO: 3019350 - protein, 23 aa, Entamoeba invadens
TGCHFQTIILPPSVIRIEDYCFY

SEQ ID NO: 3019351 - protein, 19 aa, Entamoeba invadens
TGCKTFWVFLNKAVSVMRD

SEQ ID NO: 3019352 - protein, 20 aa, Entamoeba invadens
TGCLLLSPVYLTNCNLNDTP

SEQ ID NO: 3019353 - protein, 18 aa, Entamoeba invadens
TGCYTCRTNYYLSGPYTC

SEQ ID NO: 3019354 - protein, 22 aa, Entamoeba invadens
TGDFFNHTIPLLAGGRACENMC

SEQ ID NO: 3019355 - protein, 24 aa, Entamoeba invadens
TGDHFYCYNPFNISQKIIPFLQTG

SEQ ID NO: 3019356 - protein, 27 aa, Entamoeba invadens
TGDHFYYDALYLVADFAALLCIGQEGF

SEQ ID NO: 3019357 - protein, 22 aa, Entamoeba invadens
TGDHHFFVFSCKNSFGLPGAKY

SEQ ID NO: 3019358 - protein, 17 aa, Entamoeba invadens
TGDKLSVNGALSSGKNG

SEQ ID NO: 3019359 - protein, 23 aa, Entamoeba invadens
TGDKLYFILDFVNGGELFSHLQR

SEQ ID NO: 3019360 - protein, 27 aa, Entamoeba invadens
TGDLFETFIRPYFGDAFRPVKKGDHFL

SEQ ID NO: 3019361 - protein, 18 aa, Entamoeba invadens
TGDLFLTKVLKRLQIQIH

SEQ ID NO: 3019362 - protein, 27 aa, Entamoeba invadens
TGDVQTTLLNGLRIIDLGKSCKQSNER

SEQ ID NO: 3019363 - protein, 18 aa, Entamoeba invadens
TGEALLTVTILKEKKKLK

SEQ ID NO: 3019364 - protein, 17 aa, Entamoeba invadens
TGEDGMINVFNLDKKEV

SEQ ID NO: 3019365 - protein, 25 aa, Entamoeba invadens
TGEDKLYMILALAKGDVLKLVKKVK

SEQ ID NO: 3019366 - protein, 24 aa, Entamoeba invadens
TGEEKFVVFPKNDLILQKFMEVAT

SEQ ID NO: 3019367 - protein, 25 aa, Entamoeba invadens
TGEFKLEFFGQFGLPKNSVFEDFHT

SEQ ID NO: 3019368 - protein, 17 aa, Entamoeba invadens
TGEIFAMKILDKGKVMS

SEQ ID NO: 3019369 - protein, 30 aa, Entamoeba invadens
TGEKVYYITISLLVKLLKLAKESNPDDPMT

SEQ ID NO: 3019370 - protein, 26 aa, Entamoeba invadens
TGELMKSIFFCPPFWMRTSNDVFEEY

SEQ ID NO: 3019371 - protein, 21 aa, Entamoeba invadens
TGFRDKCFFGCVSLKTLSLPP

SEQ ID NO: 3019372 - protein, 17 aa, Entamoeba invadens
TGGFFLRIKKEEKDNEE

SEQ ID NO: 3019373 - protein, 22 aa, Entamoeba invadens
TGGFYKCNLYDKSEAKKLDMKA

SEQ ID NO: 3019374 - protein, 18 aa, Entamoeba invadens
TGGLREKLAIYKKYGVEM

SEQ ID NO: 3019375 - protein, 18 aa, Entamoeba invadens
TGGLYFKLKEKYPEFSDD

SEQ ID NO: 3019376 - protein, 22 aa, Entamoeba invadens
TGHAYFALYNDIMESLWAEFVS

SEQ ID NO: 3019377 - protein, 20 aa, Entamoeba invadens
TGHERLFGPDIYVLQDEKKS

SEQ ID NO: 3019378 - protein, 26 aa, Entamoeba invadens
TGHRVWYEWMVVTPLITKIFNSSGKH

SEQ ID NO: 3019379 - protein, 25 aa, Entamoeba invadens
TGIKRRFPMAVDRRPPNGKGMYPID

SEQ ID NO: 3019380 - protein, 18 aa, Entamoeba invadens
TGILKSTAFKDLLLKEII

SEQ ID NO: 3019381 - protein, 24 aa, Entamoeba invadens
TGINRMILKRAIPLYEKFVYHLAE

SEQ ID NO: 3019382 - protein, 26 aa, Entamoeba invadens
TGIQSFNFILEWEFNVSFKGSHAQED

SEQ ID NO: 3019383 - protein, 23 aa, Entamoeba invadens
TGIREFIKTIFVNKTYYSEETTK

SEQ ID NO: 3019384 - protein, 34 aa, Entamoeba invadens
TGIVDYYTSKLIPFLENKDIIKFWHFFRDLKDTN

SEQ ID NO: 3019385 - protein, 32 aa, Entamoeba invadens
TGKAHHFIGIIPYNGILLMLDGLSEDPIVIGG

SEQ ID NO: 3019386 - protein, 23 aa, Entamoeba invadens
TGKCLLISFNSFMNGKLSYVELG

SEQ ID NO: 3019387 - protein, 37 aa, Entamoeba invadens
TGKDSFRDGRASLALLCSLTNDHKLYDKMAIESSTKI

SEQ ID NO: 3019388 - protein, 23 aa, Entamoeba invadens
TGKFGEIQKLISDHNYGEVPNGQ

SEQ ID NO: 3019389 - protein, 17 aa, Entamoeba invadens
TGKISKKKVSPVRETPL

SEQ ID NO: 3019390 - protein, 17 aa, Entamoeba invadens
TGKLCIFVFGDYVTICV

SEQ ID NO: 3019391 - protein, 24 aa, Entamoeba invadens
TGKNLGKFFLRCNKTTIGSGVVTE

SEQ ID NO: 3019392 - protein, 24 aa, Entamoeba invadens
TGKNNKWLVLLDTAAFLSTSELDL

SEQ ID NO: 3019393 - protein, 25 aa, Entamoeba invadens
TGKSQLLNFASKLGPRHVQTTGGGT

SEQ ID NO: 3019394 - protein, 19 aa, Entamoeba invadens
TGKSTFLGHLFAGLQIIDQ

SEQ ID NO: 3019395 - protein, 22 aa, Entamoeba invadens
TGKSTFLGHLFAGLQIIDQRTI

SEQ ID NO: 3019396 - protein, 22 aa, Entamoeba invadens
TGKVFRLVLYGLTSQNLLSPPM

SEQ ID NO: 3019397 - protein, 26 aa, Entamoeba invadens
TGKYGNLIVHFKVQNPVYLSEDQKKG

SEQ ID NO: 3019398 - protein, 21 aa, Entamoeba invadens
TGLCDGFFDVRYFPSLDNNAN

SEQ ID NO: 3019399 - protein, 36 aa, Entamoeba invadens
TGLEVIKHCRFLLNPLQVFNMFEGWDKVFTFVSEYK

SEQ ID NO: 3019400 - protein, 24 aa, Entamoeba invadens
TGLLRLHTLLQWIKEMLQLIKDKK

SEQ ID NO: 3019401 - protein, 23 aa, Entamoeba invadens
TGLNRGFGFPVFYTVIEANMIEK

SEQ ID NO: 3019402 - protein, 33 aa, Entamoeba invadens
TGLYEFLYDIQVGCIIYQLVFAENPEHYTLIAA

SEQ ID NO: 3019403 - protein, 31 aa, Entamoeba invadens
TGLYEFLYDIQVGCIIYQLVFAENPEHYTLL

SEQ ID NO: 3019404 - protein, 19 aa, Entamoeba invadens
TGMCLLVEAFWDETLTLSV

SEQ ID NO: 3019405 - protein, 23 aa, Entamoeba invadens
TGMFDFFPEIKLSERHIAYVVRE

SEQ ID NO: 3019406 - protein, 28 aa, Entamoeba invadens
TGMSQVWAPSFIISRGIALHKMIRLVTC

SEQ ID NO: 3019407 - protein, 37 aa, Entamoeba invadens
TGNCKLVPFFFMPHEKFYTLLFPIKDIEYAHLITSDY

SEQ ID NO: 3019408 - protein, 25 aa, Entamoeba invadens
TGNIIKMNLFKPPKYGYQMDYRIWS

SEQ ID NO: 3019409 - protein, 23 aa, Entamoeba invadens
TGNKYKVYPLYDFGVSIIDSTEG

SEQ ID NO: 3019410 - protein, 22 aa, Entamoeba invadens
TGNPLKPFGMLVVHIVIDKDNL

SEQ ID NO: 3019411 - protein, 29 aa, Entamoeba invadens
TGNVVTQLLPISTYLIAPLSHFSVYPELM

SEQ ID NO: 3019412 - protein, 23 aa, Entamoeba invadens
TGNYLPITTATCGLFFMISGTTY

SEQ ID NO: 3019413 - protein, 30 aa, Entamoeba invadens; identical to SEQ ID NO: 2970335

SEQ ID NO: 3019414 - protein, 17 aa, Entamoeba invadens
TGPMPRIGYGSDKKTRF

SEQ ID NO: 3019415 - protein, 25 aa, Entamoeba invadens
TGQCDDLLYYFVHIYKKVQGFYNQH

SEQ ID NO: 3019416 - protein, 25 aa, Entamoeba invadens
TGQEYFIARNTWGTWWGENGGFGKI

SEQ ID NO: 3019417 - protein, 32 aa, Entamoeba invadens
TGQNQIVVLPGANFSLLPAFLKERESSIFKEG

SEQ ID NO: 3019418 - protein, 24 aa, Entamoeba invadens
TGQVQFHLKKKALMGGEIVSRALR

SEQ ID NO: 3019419 - protein, 34 aa, Entamoeba invadens
TGSFMIRGKKNYLPPAPLVFGLGIVFAVEKTEKE

SEQ ID NO: 3019420 - protein, 46 aa, Entamoeba invadens
TGSGKTLAYVLPLLKHVLSQPALLPGDGPIAIVFVPIRELAEQINT

SEQ ID NO: 3019421 - protein, 25 aa, Entamoeba invadens
TGSGKTLSFLIPLVQRFIEKGTFDT

SEQ ID NO: 3019422 - protein, 31 aa, Entamoeba invadens
TGSIGFFEFVALYNWVKLCFATFNRFDKDNS

SEQ ID NO: 3019423 - protein, 25 aa, Entamoeba invadens
TGSTKTAVLTLAKNASDKKISLLDS

SEQ ID NO: 3019424 - protein, 18 aa, Entamoeba invadens
TGSYYPHLINATSSLLYL

SEQ ID NO: 3019425 - protein, 30 aa, Entamoeba invadens
TGTGKTAAYVIPLVSFISKLPRLTRETACR

SEQ ID NO: 3019426 - protein, 24 aa, Entamoeba invadens
TGTKHNFEILREVSLFLIEISTNF

SEQ ID NO: 3019427 - protein, 26 aa, Entamoeba invadens
TGTLKSFIKMLPKNHIPIVRELFGLF

SEQ ID NO: 3019428 - protein, 24 aa, Entamoeba invadens
TGTLYDIFDFKFVTNSPLILNEVK

SEQ ID NO: 3019429 - protein, 23 aa, Entamoeba invadens
TGTNLAMWKMKFRALYNSVPTEN

SEQ ID NO: 3019430 - protein, 17 aa, Entamoeba invadens
TGVFGYPLQSITTKKKC

SEQ ID NO: 3019431 - protein, 20 aa, Entamoeba invadens
TGVFLVLINGPEIMSKMAGE

SEQ ID NO: 3019432 - protein, 26 aa, Entamoeba invadens
TGVLPKAIDLYFYPHPQMSGKVMSDN

SEQ ID NO: 3019433 - protein, 24 aa, Entamoeba invadens
TGVLTQEQILHDLKMIEAIVRKDT

SEQ ID NO: 3019434 - protein, 24 aa, Entamoeba invadens
TGVRRSQYVIYIDKLTKTKNNGQT

SEQ ID NO: 3019435 - protein, 26 aa, Entamoeba invadens
TGVVLLRYVLAFRDFELVRTFDLAVL

SEQ ID NO: 3019436 - protein, 27 aa, Entamoeba invadens
TGYPLRLSLLNIYNILESLNLVNLMSV

SEQ ID NO: 3019437 - protein, 26 aa, Entamoeba invadens
THAEAFFVCDKLQWEEGIIIEAVNKF

SEQ ID NO: 3019438 - protein, 17 aa, Entamoeba invadens
THAMQRELADKYDLFLM

SEQ ID NO: 3019439 - protein, 23 aa, Entamoeba invadens
THASLRVWWGTQFLNLEKNKRSG

SEQ ID NO: 3019440 - protein, 21 aa, Entamoeba invadens
THCFLICFSIISRASFENVEY

SEQ ID NO: 3019441 - protein, 17 aa, Entamoeba invadens
THCIACKNGFVNLGDNC

SEQ ID NO: 3019442 - protein, 23 aa, Entamoeba invadens
THCNLGNIFFIKCSHMTLDKTNK

SEQ ID NO: 3019443 - protein, 29 aa, Entamoeba invadens
THDMDTLVPPFRYVALKPEEIKFEPLKCT

SEQ ID NO: 3019444 - protein, 41 aa, Entamoeba invadens
THDVVKVLSLPVQKLKLIGKFVWILLRNGSVKVYDSQTLEL

SEQ ID NO: 3019445 - protein, 17 aa, Entamoeba invadens
THEFEGAVYAIKKFKQH

SEQ ID NO: 3019446 - protein, 20 aa, Entamoeba invadens
THEGFLFFKHVFPQIQIYTQ

SEQ ID NO: 3019447 - protein, 32 aa, Entamoeba invadens
THESAKFFPGFIPLLKAFKARGGILVVVSFSS

SEQ ID NO: 3019448 - protein, 23 aa, Entamoeba invadens
THFHGVMRITKKNALLNKIATKP

SEQ ID NO: 3019449 - protein, 27 aa, Entamoeba invadens
THFKKNTYFDYQPELCKDYYETGYCGY

SEQ ID NO: 3019450 - protein, 17 aa, Entamoeba invadens
THFTISKAGLNQLDLPS

SEQ ID NO: 3019451 - protein, 26 aa, Entamoeba invadens
THGDLYIHFTVVLPTKESLAQNVEKL

SEQ ID NO: 3019452 - protein, 27 aa, Entamoeba invadens
THGDSIPRHPLFAEGIWQLVNSCCAFD

SEQ ID NO: 3019453 - protein, 18 aa, Entamoeba invadens
THHLLMDLLMEKGYFCEI

SEQ ID NO: 3019454 - protein, 18 aa, Entamoeba invadens
THHNGFINTIAFSPDGSI

SEQ ID NO: 3019455 - protein, 18 aa, Entamoeba invadens
THIFGNSIPRWEQYRESC

SEQ ID NO: 3019456 - protein, 21 aa, Entamoeba invadens
THIFKMLLDYELFEELAYIIQ

SEQ ID NO: 3019457 - protein, 22 aa, Entamoeba invadens
THIIIMVYTILRRTNVIKVDLD

SEQ ID NO: 3019458 - protein, 25 aa, Entamoeba invadens
THIIKIGMLSKCFEPFMVDIVNAEA

SEQ ID NO: 3019459 - protein, 21 aa, Entamoeba invadens
THKEFTSLNGFLLVIGKMNRA

SEQ ID NO: 3019460 - protein, 22 aa, Entamoeba invadens
THKKTELLPMKQYPIFNGITKN

SEQ ID NO: 3019461 - protein, 23 aa, Entamoeba invadens
THKYGHVTYFWNGNKTGYFDDKL

SEQ ID NO: 3019462 - protein, 36 aa, Entamoeba invadens
THLDLRSYLIMPVQRLPRYQLLLQDLLKHTEKTEED

SEQ ID NO: 3019463 - protein, 25 aa, Entamoeba invadens
THLEGNMFLLGYLPKENKVVVSDVK

SEQ ID NO: 3019464 - protein, 20 aa, Entamoeba invadens
THLEIIQMFAFENCTSLSHL

SEQ ID NO: 3019465 - protein, 25 aa, Entamoeba invadens
THLNHSHILPIFQTSTFCFDSTKHG

SEQ ID NO: 3019466 - protein, 25 aa, Entamoeba invadens
THLSQLILRNTKLQYIDARYPPEFA

SEQ ID NO: 3019467 - protein, 64 aa, Entamoeba invadens
THLTTLSEFCPIYRGLKFRRLPIPPQDDIFEYVVYGLLFNNDIIVRIWCNGLAVFQKTINQINN

SEQ ID NO: 3019468 - protein, 20 aa, Entamoeba invadens
THMKWIFDNFGMNSNKRNYE

SEQ ID NO: 3019469 - protein, 17 aa, Entamoeba invadens
THNHKIWILNDSVYRRL

SEQ ID NO: 3019470 - protein, 37 aa, Entamoeba invadens
THNKFRITVFFQYERMMYRAFDLFAKGVNLVQSLTTN

SEQ ID NO: 3019471 - protein, 23 aa, Entamoeba invadens
THNVEVPDVKRTEYPLLDVVDGY

SEQ ID NO: 3019472 - protein, 25 aa, Entamoeba invadens
THPETFTRRFPPPNMLKFTRLNNYP

SEQ ID NO: 3019473 - protein, 24 aa, Entamoeba invadens
THPLPDVFQLLKLLSKTPSNASNG

SEQ ID NO: 3019474 - protein, 25 aa, Entamoeba invadens
THPMVSMSFLPLGHVFAIVLEMTIY

SEQ ID NO: 3019475 - protein, 27 aa, Entamoeba invadens
THPVIHKFLEKLLSFQKIINLKYIAYE

SEQ ID NO: 3019476 - protein, 17 aa, Entamoeba invadens
THQFVKIKTISFNFEDF

SEQ ID NO: 3019477 - protein, 19 aa, Entamoeba invadens
THQLFSIKSLVIKDEFIAL

SEQ ID NO: 3019478 - protein, 25 aa, Entamoeba invadens
THQSIMKFLKAMPVDSLRVFDVNLR

SEQ ID NO: 3019479 - protein, 27 aa, Entamoeba invadens
THTDSVIDLCWLPGDKFLISVSADCTA

SEQ ID NO: 3019480 - protein, 25 aa, Entamoeba invadens
THTSTIPMLFLIEVESSKIDVIALA

SEQ ID NO: 3019481 - protein, 19 aa, Entamoeba invadens
THTTIDKVPFPKDKNYRPP

SEQ ID NO: 3019482 - protein, 22 aa, Entamoeba invadens
THTVIKSFFPTLSKELSRMYTG

SEQ ID NO: 3019483 - protein, 20 aa, Entamoeba invadens
THVALPSSLKYIPPLTFNRC

SEQ ID NO: 3019484 - protein, 20 aa, Entamoeba invadens
THVSHSHVLPIFQTSTFCFD

SEQ ID NO: 3019485 - protein, 37 aa, Entamoeba invadens
THYHVDHVGMLPWLCKFLSIPIFMAQPTLSVLPMILS

SEQ ID NO: 3019486 - protein, 28 aa, Entamoeba invadens
TIAELNDEKTRLLKISEVKDARVSELEE

SEQ ID NO: 3019487 - protein, 29 aa, Entamoeba invadens
TIAFFDHFHKYLLSRYPSCITGINNIFSL

SEQ ID NO: 3019488 - protein, 35 aa, Entamoeba invadens
TIAFNYVHGIFHLKLWRLLTVVLFAIQDALLLSTC

SEQ ID NO: 3019489 - protein, 21 aa, Entamoeba invadens
TIAIDMLRTNPIYITRNPKYV

SEQ ID NO: 3019490 - protein, 22 aa, Entamoeba invadens
TIAKCKYLVEIKRRIIKDDVVK

SEQ ID NO: 3019491 - protein, 21 aa, Entamoeba invadens
TIAKTYFKGYPILRCDDDTYN

SEQ ID NO: 3019492 - protein, 24 aa, Entamoeba invadens
TIANKTSMFYLKKKTELSKEYFEI

SEQ ID NO: 3019493 - protein, 18 aa, Entamoeba invadens
TIANRVLTVLQLSKDWFT

SEQ ID NO: 3019494 - protein, 20 aa, Entamoeba invadens
TIANSLRREGLIKKIAKPMD

SEQ ID NO: 3019495 - protein, 17 aa, Entamoeba invadens
TIAPLTFSVLSVKKNRS

SEQ ID NO: 3019496 - protein, 26 aa, Entamoeba invadens
TIAREFVQPQWIFDCVNENFLLPCAE

SEQ ID NO: 3019497 - protein, 26 aa, Entamoeba invadens
TIASIGISVFFPPAAPHVLAVANVML

SEQ ID NO: 3019498 - protein, 19 aa, Entamoeba invadens
TIASLKDINFLLTETKRQC

SEQ ID NO: 3019499 - protein, 17 aa, Entamoeba invadens
TICLDHPIFGIPLTEVV

SEQ ID NO: 3019500 - protein, 35 aa, Entamoeba invadens
TICLITRMRQKPINAILGIILTQLKVLASMLKYTY

SEQ ID NO: 3019501 - protein, 28 aa, Entamoeba invadens
TICMCMYVYNYYLYPSPLKGVAPLDCVN

SEQ ID NO: 3019502 - protein, 36 aa, Entamoeba invadens
TIDDMLIMLKRYLDYIIDIVRPRKLVYMAVDGVAPR

SEQ ID NO: 3019503 - protein, 23 aa, Entamoeba invadens
TIDGLVFLMRTACVTNYCIFTES

SEQ ID NO: 3019504 - protein, 25 aa, Entamoeba invadens
TIDKAKFVTLLKNIGKPLTPDEINE

SEQ ID NO: 3019505 - protein, 29 aa, Entamoeba invadens
TIDKDLIIPCLLFLGNLASIPVHGAVEVL

SEQ ID NO: 3019506 - protein, 24 aa, Entamoeba invadens
TIDKSIIKLTFQKYSYDVLRTVNE

SEQ ID NO: 3019507 - protein, 20 aa, Entamoeba invadens
TIDLPEFTKFHQAIAGVDMA

SEQ ID NO: 3019508 - protein, 25 aa, Entamoeba invadens
TIDQVCRLGLIEALFKTLQSHPSLD

SEQ ID NO: 3019509 - protein, 20 aa, Entamoeba invadens
TIDRFLFTMIMRDSERFSVQ

SEQ ID NO: 3019510 - protein, 25 aa, Entamoeba invadens
TIDTRPTFISAYLLKMPVLEFKDKT

SEQ ID NO: 3019511 - protein, 17 aa, Entamoeba invadens
TIEGFWNLFGTLPSIEL

SEQ ID NO: 3019512 - protein, 19 aa, Entamoeba invadens
TIEGLFLMYLDLVGMEQIY

SEQ ID NO: 3019513 - protein, 20 aa, Entamoeba invadens
TIEGLSYIKKSFWIDGDEVN

SEQ ID NO: 3019514 - protein, 28 aa, Entamoeba invadens
TIEINGGRWIIADKIQLFGASSIQFIKS

SEQ ID NO: 3019515 - protein, 18 aa, Entamoeba invadens
TIEISAIFFDWDSEYQKC

SEQ ID NO: 3019516 - protein, 18 aa, Entamoeba invadens
TIEKFLRYMYRHRSKWNE

SEQ ID NO: 3019517 - protein, 25 aa, Entamoeba invadens
TIEKLHFNPIPLTTKTRKYFTRLET

SEQ ID NO: 3019518 - protein, 24 aa, Entamoeba invadens
TIELPQYRLQFAPIGPYVPYSYVY

SEQ ID NO: 3019519 - protein, 24 aa, Entamoeba invadens
TIEMTDLIFFRHQREVHKLTAIVQ

SEQ ID NO: 3019520 - protein, 28 aa, Entamoeba invadens
TIENGEYEYLFWESLFDVKLEGFDVKVN

SEQ ID NO: 3019521 - protein, 27 aa, Entamoeba invadens
TIENSEFEYLLWESLFDVKLEGVDVKV

SEQ ID NO: 3019522 - protein, 22 aa, Entamoeba invadens
TIFEYIPMPLMDLLATRTRDII

SEQ ID NO: 3019523 - protein, 17 aa, Entamoeba invadens
TIFKIIYSEVLRQCKPE

SEQ ID NO: 3019524 - protein, 17 aa, Entamoeba invadens
TIFKRSLDIIASFTHKM

SEQ ID NO: 3019525 - protein, 18 aa, Entamoeba invadens
TIFNSTVSCLLYIVDLTK

SEQ ID NO: 3019526 - protein, 28 aa, Entamoeba invadens
TIFTSSSTFKFVFPKRLFSAAPRVVVSI

SEQ ID NO: 3019527 - protein, 17 aa, Entamoeba invadens
TIFTTAFTTAPLSCFSS

SEQ ID NO: 3019528 - protein, 18 aa, Entamoeba invadens
TIGADWSKKEFKLKEAQF

SEQ ID NO: 3019529 - protein, 25 aa, Entamoeba invadens
TIGDKDFNLFLDGKEIIVKDAKLQK

SEQ ID NO: 3019530 - protein, 17 aa, Entamoeba invadens
TIGEPSHKPAPPLPHKA

SEQ ID NO: 3019531 - protein, 19 aa, Entamoeba invadens
TIGFFLNIETLHLWHKNDE

SEQ ID NO: 3019532 - protein, 35 aa, Entamoeba invadens
TIGIRGFALNLDQFPFLRKVHFTAIIAQKLENFFG

SEQ ID NO: 3019533 - protein, 26 aa, Entamoeba invadens
TIGKERYLCTQPLFDPALINIEGDGI

SEQ ID NO: 3019534 - protein, 18 aa, Entamoeba invadens
TIGNKRFRRSEALLQLSS

SEQ ID NO: 3019535 - protein, 27 aa, Entamoeba invadens
TIGSLYAMYQEEDGYLYFIVYRESVFG

SEQ ID NO: 3019536 - protein, 26 aa, Entamoeba invadens
TIGTGLSEIIWIKGNVIGNVIGKIFA

SEQ ID NO: 3019537 - protein, 31 aa, Entamoeba invadens
TIGVMAEALYPLFPLNFLSKSVLEMATELTT

SEQ ID NO: 3019538 - protein, 34 aa, Entamoeba invadens
TIGYNQFKRIDTLLYLLYYPQVPMVRTKTIDMIN

SEQ ID NO: 3019539 - protein, 17 aa, Entamoeba invadens
TIHFFPNLETFNIWSRE

SEQ ID NO: 3019540 - protein, 29 aa, Entamoeba invadens
TIHHLESFMFFYFIKLKEVTLPRGVVVHN

SEQ ID NO: 3019541 - protein, 34 aa, Entamoeba invadens
TIHLYSPCDDFFPEKAFFQKIVHYKVIHSSLPNA

SEQ ID NO: 3019542 - protein, 24 aa, Entamoeba invadens
TIHPYIQKFFKFKKHYINPLVSGE

SEQ ID NO: 3019543 - protein, 33 aa, Entamoeba invadens
TIHTANLTQEKYIFLALLLGSDFTEGVGKVGPK

SEQ ID NO: 3019544 - protein, 18 aa, Entamoeba invadens
TIHVLRYLSFLGSKNANS

SEQ ID NO: 3019545 - protein, 22 aa, Entamoeba invadens
TIIALLNVPSVFYRPKDQKEKE

SEQ ID NO: 3019546 - protein, 32 aa, Entamoeba invadens
TIILNPHFCKLIAWYDNEWGYSTRLVDLIQII

SEQ ID NO: 3019547 - protein, 21 aa, Entamoeba invadens
TIIMTIIREIIYRNGMRVALI

SEQ ID NO: 3019548 - protein, 19 aa, Entamoeba invadens
TIINLLKTKGMVEGVFRLC

SEQ ID NO: 3019549 - protein, 20 aa, Entamoeba invadens
TIIPCIIGCTNGTYGAYIMD

SEQ ID NO: 3019550 - protein, 42 aa, Entamoeba invadens
TIIPYEDVTLIFERYEEILGVNKRFFLALRRLKENNQMTTSI

SEQ ID NO: 3019551 - protein, 20 aa, Entamoeba invadens
TIIQIEILDTPGVSVKESIQ

SEQ ID NO: 3019552 - protein, 28 aa, Entamoeba invadens
TIISKQSLLFLVFCSDIAISFFIDSQIV

SEQ ID NO: 3019553 - protein, 19 aa, Entamoeba invadens
TIIVELFKENLVRGRGLLV

SEQ ID NO: 3019554 - protein, 18 aa, Entamoeba invadens
TIIYYQFSMPVVSNRDYV

SEQ ID NO: 3019555 - protein, 18 aa, Entamoeba invadens
TIKAISSAFPLVFISKCF

SEQ ID NO: 3019556 - protein, 28 aa, Entamoeba invadens
TIKAMMGICRGCWILNEEWIEESLLRKC

SEQ ID NO: 3019557 - protein, 30 aa, Entamoeba invadens
TIKDFINIEFFHFNPIPLTKLTIKYFPNIE

SEQ ID NO: 3019558 - protein, 22 aa, Entamoeba invadens
TIKDFIPISFIETKKVYLFNMN

SEQ ID NO: 3019559 - protein, 29 aa, Entamoeba invadens
TIKDNDFEYLFWESLFDVKLEGFDVKVND

SEQ ID NO: 3019560 - protein, 28 aa, Entamoeba invadens
TIKDSEFEYLFWESLFDVKLEGVDVKVN

SEQ ID NO: 3019561 - protein, 17 aa, Entamoeba invadens
TIKFRIPYSMELNGITL

SEQ ID NO: 3019562 - protein, 21 aa, Entamoeba invadens
TIKFSFDPLPTLRELFYSKVE

SEQ ID NO: 3019563 - protein, 19 aa, Entamoeba invadens
TIKGRVRVRWLTSNEDEQP

SEQ ID NO: 3019564 - protein, 17 aa, Entamoeba invadens
TIKKFMRDLPEPILPKE

SEQ ID NO: 3019565 - protein, 17 aa, Entamoeba invadens
TIKKIRRKDEASEDMRK

SEQ ID NO: 3019566 - protein, 25 aa, Entamoeba invadens
TIKKKKIEMLVAKYAKRVLTEERCN

SEQ ID NO: 3019567 - protein, 22 aa, Entamoeba invadens
TIKLIDFGLADFYVVGLKYTTR

SEQ ID NO: 3019568 - protein, 19 aa, Entamoeba invadens
TIKLMTSGVKPIYVFDGKP

SEQ ID NO: 3019569 - protein, 18 aa, Entamoeba invadens
TIKMYRVKKITTPTQVVI

SEQ ID NO: 3019570 - protein, 20 aa, Entamoeba invadens
TIKNDPVLVRQILKTVYENY

SEQ ID NO: 3019571 - protein, 27 aa, Entamoeba invadens
TIKNGEFEYLLWESLFDVKLEGVDVKV

SEQ ID NO: 3019572 - protein, 17 aa, Entamoeba invadens
TIKNNFIWGCSNGVSYW

SEQ ID NO: 3019573 - protein, 28 aa, Entamoeba invadens
TIKRHYVEVLKYTSFDLFVSQHKPVICS

SEQ ID NO: 3019574 - protein, 22 aa, Entamoeba invadens
TIKRRNIYILKNEIKRSTDLFS

SEQ ID NO: 3019575 - protein, 28 aa, Entamoeba invadens
TIKTKDGHFYWYKLNDKWLIDNVDIYIT

SEQ ID NO: 3019576 - protein, 26 aa, Entamoeba invadens
TIKTLKIDTIFKEQLPKVPKCFLEAT

SEQ ID NO: 3019577 - protein, 24 aa, Entamoeba invadens
TIKVTLLFHQYATMGLTGQVQFHL

SEQ ID NO: 3019578 - protein, 23 aa, Entamoeba invadens
TIKYMHHKLIQKYLVMCLNGFES

SEQ ID NO: 3019579 - protein, 23 aa, Entamoeba invadens
TIKYTPHKLIQKYLAMCLNGFES

SEQ ID NO: 3019580 - protein, 19 aa, Entamoeba invadens
TILECSEANLKDLKTIQEN

SEQ ID NO: 3019581 - protein, 21 aa, Entamoeba invadens
TILEEIFKIKTGFKGTIISTA

SEQ ID NO: 3019582 - protein, 19 aa, Entamoeba invadens
TILEMFTAIFYVLDKEYRG

SEQ ID NO: 3019583 - protein, 19 aa, Entamoeba invadens
TILFTRFHYNPIEETFLFK

SEQ ID NO: 3019584 - protein, 19 aa, Entamoeba invadens
TILFVRLVNCLVEKVLGGV

SEQ ID NO: 3019585 - protein, 23 aa, Entamoeba invadens
TILHKNGLILYDQKNRSFAPTEL

SEQ ID NO: 3019586 - protein, 27 aa, Entamoeba invadens
TILIANKRLQAILRDRRTEIKDLQSQL

SEQ ID NO: 3019587 - protein, 19 aa, Entamoeba invadens
TILIGNFLKFYLNSMIEPV

SEQ ID NO: 3019588 - protein, 17 aa, Entamoeba invadens
TILKSDGFIIVYSITSI

SEQ ID NO: 3019589 - protein, 18 aa, Entamoeba invadens
TILLVKPQTKMTANHHIL

SEQ ID NO: 3019590 - protein, 22 aa, Entamoeba invadens
TILMDAILLERVGIENFSSFQL

SEQ ID NO: 3019591 - protein, 25 aa, Entamoeba invadens
TILNKQFYPRMLPKIYNDAVQQLSE

SEQ ID NO: 3019592 - protein, 17 aa, Entamoeba invadens
TILSLFQKKTSYDFRRL

SEQ ID NO: 3019593 - protein, 20 aa, Entamoeba invadens
TILSLKDEILRINPNLAEFV

SEQ ID NO: 3019594 - protein, 22 aa, Entamoeba invadens
TILSPCMHMLPSKHYGLGDEET

SEQ ID NO: 3019595 - protein, 20 aa, Entamoeba invadens
TILTNIDKFIFKAEPEVVLI

SEQ ID NO: 3019596 - protein, 28 aa, Entamoeba invadens
TILYETTNLVPLLRLSYNKFDSHFIATF

SEQ ID NO: 3019597 - protein, 19 aa, Entamoeba invadens
TILYRLQCGKVIPSMPTIG

SEQ ID NO: 3019598 - protein, 27 aa, Entamoeba invadens
TIMPVQRLMRYPILIKELIKATPQTHP

SEQ ID NO: 3019599 - protein, 25 aa, Entamoeba invadens
TINAFNSNFLFPHSPPNKTQPNSQL

SEQ ID NO: 3019600 - protein, 22 aa, Entamoeba invadens
TINCCGLLIPPTILVTAKVVTN

SEQ ID NO: 3019601 - protein, 17 aa, Entamoeba invadens
TINIQPPEQFQIVSFVD

SEQ ID NO: 3019602 - protein, 29 aa, Entamoeba invadens
TINKVEGMMFFFSDVLIFSKVINPKDKDY

SEQ ID NO: 3019603 - protein, 19 aa, Entamoeba invadens
TINLSKIINIPPIQQNYSF

SEQ ID NO: 3019604 - protein, 19 aa, Entamoeba invadens
TINNMEVISAFAGLRPAIV

SEQ ID NO: 3019605 - protein, 24 aa, Entamoeba invadens
TINNNIFKSCWFLEKVVIGGNITK

SEQ ID NO: 3019606 - protein, 34 aa, Entamoeba invadens
TINTFQPKPLLFNPTIYFPPSKPSNLVMAPQINM

SEQ ID NO: 3019607 - protein, 18 aa, Entamoeba invadens
TINTLSFANFPKLIHLTI

SEQ ID NO: 3019608 - protein, 41 aa, Entamoeba invadens
TIPIVYRGNRFCLPLCIMFPFDYPLTPPLFFTDPTAEMEVV

SEQ ID NO: 3019609 - protein, 25 aa, Entamoeba invadens
TIPKSKFSLFFHSTGDYKSDSIFVQ

SEQ ID NO: 3019610 - protein, 17 aa, Entamoeba invadens
TIPPNYGCEFSLFLTPL

SEQ ID NO: 3019611 - protein, 19 aa, Entamoeba invadens
TIPPSTPILLVSLIKHCVI

SEQ ID NO: 3019612 - protein, 19 aa, Entamoeba invadens
TIPQAIRFTDYSSSIKILN

SEQ ID NO: 3019613 - protein, 35 aa, Entamoeba invadens
TIPQMMPGMTMGNMQPFQFVQQLPQAQIRQMMQKM

SEQ ID NO: 3019614 - protein, 20 aa, Entamoeba invadens
TIPSLLPIVLDNINFVKFTS

SEQ ID NO: 3019615 - protein, 26 aa, Entamoeba invadens
TIPTPTKPIIKMRALYDYEATDDTEL

SEQ ID NO: 3019616 - protein, 17 aa, Entamoeba invadens
TIPYTSCSYLRNALTPF

SEQ ID NO: 3019617 - protein, 26 aa, Entamoeba invadens
TIQAVSLMFTLLKQGINGEPTCKKVM

SEQ ID NO: 3019618 - protein, 23 aa, Entamoeba invadens
TIQHYPKLFYLGKGTSVSYFELS

SEQ ID NO: 3019619 - protein, 21 aa, Entamoeba invadens
TIQKIPFKTPGYVEIFVQCLD

SEQ ID NO: 3019620 - protein, 17 aa, Entamoeba invadens
TIQLLPEKGKEGQLTMF

SEQ ID NO: 3019621 - protein, 17 aa, Entamoeba invadens
TIQLNIPENGKLDSIKT

SEQ ID NO: 3019622 - protein, 26 aa, Entamoeba invadens
TIQPNKSFPFAWTNPTLKHLIQMHDK

SEQ ID NO: 3019623 - protein, 25 aa, Entamoeba invadens
TIQVIRAFITLSVNKTLFPKDYKPS

SEQ ID NO: 3019624 - protein, 17 aa, Entamoeba invadens
TIQYDMSPLLKILNDQF

SEQ ID NO: 3019625 - protein, 23 aa, Entamoeba invadens
TIRDFIRLEFVCKKYYCNMEKFH

SEQ ID NO: 3019626 - protein, 26 aa, Entamoeba invadens
TIREHARFPGIFIASGKEEQLLTINR

SEQ ID NO: 3019627 - protein, 18 aa, Entamoeba invadens
TIRFLLSNVRYYAEEFQF

SEQ ID NO: 3019628 - protein, 25 aa, Entamoeba invadens
TIRGKSAILIIYSLRDVGTLNEVDN

SEQ ID NO: 3019629 - protein, 28 aa, Entamoeba invadens
TIRMPMKGMLWWISYFGFDGICQELSQM

SEQ ID NO: 3019630 - protein, 23 aa, Entamoeba invadens
TIRNALLEYGFPTRIKDGAWIGT

SEQ ID NO: 3019631 - protein, 24 aa, Entamoeba invadens
TIRSTYIPHSLYFPSANILELSLV

SEQ ID NO: 3019632 - protein, 21 aa, Entamoeba invadens
TIRVVTSCYVYIQCIGDQFRG

SEQ ID NO: 3019633 - protein, 21 aa, Entamoeba invadens
TISAIHLAITPEFTPECTYKI

SEQ ID NO: 3019634 - protein, 24 aa, Entamoeba invadens
TISDHCYMFLLNKGGASVNDVYEY

SEQ ID NO: 3019635 - protein, 18 aa, Entamoeba invadens
TISFWLMDKEMYTGMSQV

SEQ ID NO: 3019636 - protein, 20 aa, Entamoeba invadens
TISHFCCCSLLIPPEVRDSC

SEQ ID NO: 3019637 - protein, 23 aa, Entamoeba invadens
TISHLHAKILYDAKQRAYTFLSI

SEQ ID NO: 3019638 - protein, 24 aa, Entamoeba invadens
TISLKAFVVLLVDKENNKFGGVVS

SEQ ID NO: 3019639 - protein, 17 aa, Entamoeba invadens
TISLLKQNKMLLDENEE

SEQ ID NO: 3019640 - protein, 22 aa, Entamoeba invadens
TISLMDMIKYKIDIPNTWSEGP

SEQ ID NO: 3019641 - protein, 23 aa, Entamoeba invadens
TISRGLFFGCEKLSVLQLPSTFE

SEQ ID NO: 3019642 - protein, 17 aa, Entamoeba invadens
TISTFKPLVGTFSAFRK

SEQ ID NO: 3019643 - protein, 20 aa, Entamoeba invadens
TISTKMCCGYLLGAAMEFKA

SEQ ID NO: 3019644 - protein, 24 aa, Entamoeba invadens
TISWREAYIKNEFKFPWKIAEFVN

SEQ ID NO: 3019645 - protein, 26 aa, Entamoeba invadens
TISYALVKILNYCYIEFRAPYIHLIP

SEQ ID NO: 3019646 - protein, 17 aa, Entamoeba invadens
TITFLAPSKTYNIPGLN

SEQ ID NO: 3019647 - protein, 29 aa, Entamoeba invadens
TITGTGEQACRFLRTLRKGKKYFMRENND

SEQ ID NO: 3019648 - protein, 21 aa, Entamoeba invadens
TITIDKPMFNGKPLYPFMCRT

SEQ ID NO: 3019649 - protein, 29 aa, Entamoeba invadens
TITISTKISFLRWVGPLLLTCAENPNSTD

SEQ ID NO: 3019650 - protein, 26 aa, Entamoeba invadens
TITNAKFLEMLAFPPNLTGLILHECH

SEQ ID NO: 3019651 - protein, 24 aa, Entamoeba invadens
TITNAMCCFCFSAPFHAQFMTRGQ

SEQ ID NO: 3019652 - protein, 24 aa, Entamoeba invadens
TITQKTIKLFPNLETLHIWNKSDE

SEQ ID NO: 3019653 - protein, 30 aa, Entamoeba invadens
TITWVLDEFLRHELHPKCFIIPLGTGNSLS

SEQ ID NO: 3019654 - protein, 28 aa, Entamoeba invadens
TIVGGDVMILFLHFQQIISVNSVLVEKL

SEQ ID NO: 3019655 - protein, 23 aa, Entamoeba invadens
TIVLPKFCVSLGLSKCLCDVKLG

SEQ ID NO: 3019656 - protein, 18 aa, Entamoeba invadens
TIVLRFKNIIFPKQDDEI

SEQ ID NO: 3019657 - protein, 20 aa, Entamoeba invadens
TIVMRHANIPFRESSLTLSL

SEQ ID NO: 3019658 - protein, 24 aa, Entamoeba invadens
TIVNTKLNYLKLKNFAVAIDRMYI

SEQ ID NO: 3019659 - protein, 21 aa, Entamoeba invadens
TIVTFFGECGCGKTSLIKRYV

SEQ ID NO: 3019660 - protein, 29 aa, Entamoeba invadens
TIVTPIKSPLDYMTTPKLKKEIAVPIFLN

SEQ ID NO: 3019661 - protein, 34 aa, Entamoeba invadens
TIYDDTSFVFVLQKQFVKNFQKFGIKSDCTKNVF

SEQ ID NO: 3019662 - protein, 17 aa, Entamoeba invadens
TIYFFEDILFEKRKCII

SEQ ID NO: 3019663 - protein, 21 aa, Entamoeba invadens
TIYFQWEWEEEKGFLFSSSWT

SEQ ID NO: 3019664 - protein, 22 aa, Entamoeba invadens
TIYKSKRIFYSWCFDVVFVTIE

SEQ ID NO: 3019665 - protein, 27 aa, Entamoeba invadens
TKAFASYINYTLGYQEPLVNSLCPDLE

SEQ ID NO: 3019666 - protein, 21 aa, Entamoeba invadens
TKAIMMLNGYQLNGGCLNCMW

SEQ ID NO: 3019667 - protein, 21 aa, Entamoeba invadens
TKAMKLFTYISNATSLPCISS

SEQ ID NO: 3019668 - protein, 19 aa, Entamoeba invadens
TKARRFLYKLQTADMVIIP

SEQ ID NO: 3019669 - protein, 26 aa, Entamoeba invadens
TKATDKYKFFLQATQLESVIDNYKLA

SEQ ID NO: 3019670 - protein, 18 aa, Entamoeba invadens
TKAYIWKGKLTNTAELTY

SEQ ID NO: 3019671 - protein, 25 aa, Entamoeba invadens
TKCGASHLLKLISSPALEKKEEKTE

SEQ ID NO: 3019672 - protein, 31 aa, Entamoeba invadens
TKCPVIPALTRFFMYLPVQSVMQIIDFCVQL

SEQ ID NO: 3019673 - protein, 26 aa, Entamoeba invadens
TKCRYILDRFRINPIPITDSSKRLFQ

SEQ ID NO: 3019674 - protein, 19 aa, Entamoeba invadens
TKCTACEIGYVLTNINTCK

SEQ ID NO: 3019675 - protein, 18 aa, Entamoeba invadens
TKCTTCCRIIIASGYNYD

SEQ ID NO: 3019676 - protein, 29 aa, Entamoeba invadens
TKDAVFYYKKFWDFDIGTKYPLSKRSNNF

SEQ ID NO: 3019677 - protein, 22 aa, Entamoeba invadens
TKDEVTAFFKKVGCEQAVEQVM

SEQ ID NO: 3019678 - protein, 23 aa, Entamoeba invadens
TKDLIDKLILLMERKIQDDENVT

SEQ ID NO: 3019679 - protein, 25 aa, Entamoeba invadens
TKDLKKDIALLRNSFDQKKKERETV

SEQ ID NO: 3019680 - protein, 18 aa, Entamoeba invadens
TKDPAFLKTIGIAAILSL

SEQ ID NO: 3019681 - protein, 26 aa, Entamoeba invadens
TKDTLRFFDNYPLSLALNAVLHLQHE

SEQ ID NO: 3019682 - protein, 17 aa, Entamoeba invadens
TKDVVIDHLNFVLRNCV

SEQ ID NO: 3019683 - protein, 18 aa, Entamoeba invadens
TKDYFAFDITREIAQSWL

SEQ ID NO: 3019684 - protein, 27 aa, Entamoeba invadens
TKDYKKMLILGAKFLELKNYDATFSVY

SEQ ID NO: 3019685 - protein, 17 aa, Entamoeba invadens
TKEDEMMHLLAKKLLEE

SEQ ID NO: 3019686 - protein, 25 aa, Entamoeba invadens
TKEDMIIAMIFTCVSLICVKKKIGE

SEQ ID NO: 3019687 - protein, 23 aa, Entamoeba invadens
TKEDQIYFKNKIPDFVRKISEQS

SEQ ID NO: 3019688 - protein, 24 aa, Entamoeba invadens
TKEDQIYFKNKIPHFVRKISEQSF

SEQ ID NO: 3019689 - protein, 23 aa, Entamoeba invadens
TKEDVKLRKHQMAYCALVLNDLI

SEQ ID NO: 3019690 - protein, 21 aa, Entamoeba invadens
TKEEIPLLNQILLNNAKRTTL

SEQ ID NO: 3019691 - protein, 24 aa, Entamoeba invadens
TKEEIVKAYRKLALKLHPDKQENK

SEQ ID NO: 3019692 - protein, 24 aa, Entamoeba invadens
TKEEYLQLGLTPLETKMRLKSQME

SEQ ID NO: 3019693 - protein, 20 aa, Entamoeba invadens
TKEFRFDFKKMPATKIQDPE

SEQ ID NO: 3019694 - protein, 17 aa, Entamoeba invadens
TKEIELKKRMSLSFIPE

SEQ ID NO: 3019695 - protein, 25 aa, Entamoeba invadens
TKEIFKEYIIGRLLGIGCFGKVFVA

SEQ ID NO: 3019696 - protein, 22 aa, Entamoeba invadens
TKEIPKYKNILMLYAHADRGQD

SEQ ID NO: 3019697 - protein, 38 aa, Entamoeba invadens
TKEMAVACYQFYTKGFTKVGILFSGYKGYHKFFNEGAA

SEQ ID NO: 3019698 - protein, 18 aa, Entamoeba invadens
TKEPWMIDSLNFVISRGP

SEQ ID NO: 3019699 - protein, 38 aa, Entamoeba invadens
TKETLDKLLDFLTPYTKANLILRKYFNVLSSNLFATST

SEQ ID NO: 3019700 - protein, 24 aa, Entamoeba invadens
TKEVKLQFIMFFDEKPSDCERIIN

SEQ ID NO: 3019701 - protein, 21 aa, Entamoeba invadens
TKEVLIRVLFGIRKEIPVSVD

SEQ ID NO: 3019702 - protein, 25 aa, Entamoeba invadens
TKFEPSEYFFFPSPSCYVKCGESTV

SEQ ID NO: 3019703 - protein, 19 aa, Entamoeba invadens
TKFHFNPIPLTRKTLKFFP

SEQ ID NO: 3019704 - protein, 21 aa, Entamoeba invadens
TKFKDWKTHLYPKFIGNEKEL

SEQ ID NO: 3019705 - protein, 39 aa, Entamoeba invadens
TKFVKILSHLAIPNYPDKLLPTLIVYRNTNHVKQFIGLA

SEQ ID NO: 3019706 - protein, 20 aa, Entamoeba invadens
TKGLFEKLAFYLQGKDDKTI

SEQ ID NO: 3019707 - protein, 19 aa, Entamoeba invadens
TKGMEWWSCVIQGDEEIDT

SEQ ID NO: 3019708 - protein, 23 aa, Entamoeba invadens
TKGQLLKIFITFPDPHFKNAVKR

SEQ ID NO: 3019709 - protein, 21 aa, Entamoeba invadens
TKGVLLFPPKPLPFPETQKQN

SEQ ID NO: 3019710 - protein, 25 aa, Entamoeba invadens
TKGYLSQNYIFYSGNYKLGPNCKTC

SEQ ID NO: 3019711 - protein, 32 aa, Entamoeba invadens
TKHFTTITLPVIFDLAILSLKYIQSPIPQLKM

SEQ ID NO: 3019712 - protein, 24 aa, Entamoeba invadens
TKHIMMGCIKYLMGKDVDALQLYL

SEQ ID NO: 3019713 - protein, 20 aa, Entamoeba invadens
TKHLDFFKITFKNGFDEVFL

SEQ ID NO: 3019714 - protein, 25 aa, Entamoeba invadens
TKIEDYEPQIKALEAQKKMALDDKA

SEQ ID NO: 3019715 - protein, 21 aa, Entamoeba invadens
TKIEICLWVLNHFSGLQRVAK

SEQ ID NO: 3019716 - protein, 18 aa, Entamoeba invadens
TKIFIEKISTMLGDLLNH

SEQ ID NO: 3019717 - protein, 18 aa, Entamoeba invadens
TKIFPFTIVDYPGTNSCG

SEQ ID NO: 3019718 - protein, 17 aa, Entamoeba invadens
TKIFVKVNVRIVSTIYP

SEQ ID NO: 3019719 - protein, 19 aa, Entamoeba invadens
TKIIFYIELCLFVWVYQSP

SEQ ID NO: 3019720 - protein, 24 aa, Entamoeba invadens
TKILWDEIPNPFLSYGYSSSQVPF

SEQ ID NO: 3019721 - protein, 17 aa, Entamoeba invadens
TKIPDCTFFKCFSLSVI

SEQ ID NO: 3019722 - protein, 21 aa, Entamoeba invadens
TKIRNMKIPYTVWHSKSKKTL

SEQ ID NO: 3019723 - protein, 20 aa, Entamoeba invadens
TKIVEKLEKKVFELTEEQKR

SEQ ID NO: 3019724 - protein, 23 aa, Entamoeba invadens
TKIVLDDVLINKVLLSKSNVQSL

SEQ ID NO: 3019725 - protein, 17 aa, Entamoeba invadens
TKIVLPQKLLEIQEQAF

SEQ ID NO: 3019726 - protein, 20 aa, Entamoeba invadens
TKIVVFGFGSVGKSSIIIRL

SEQ ID NO: 3019727 - protein, 20 aa, Entamoeba invadens
TKIVVFGFGSVGKSSITVRL

SEQ ID NO: 3019728 - protein, 18 aa, Entamoeba invadens
TKKCFLGVKCQGEYFVTE

SEQ ID NO: 3019729 - protein, 23 aa, Entamoeba invadens
TKKCLACKDPFIQKSGGCESCPI

SEQ ID NO: 3019730 - protein, 25 aa, Entamoeba invadens
TKKDYFIVRNTWGSWWGENGGFARV

SEQ ID NO: 3019731 - protein, 25 aa, Entamoeba invadens
TKKGPLAKVWIAAHWEGKLTKQQIL

SEQ ID NO: 3019732 - protein, 18 aa, Entamoeba invadens
TKKICEFLDDIKGTQIGL

SEQ ID NO: 3019733 - protein, 20 aa, Entamoeba invadens
TKKIPIGANPLQAALAAEAM

SEQ ID NO: 3019734 - protein, 17 aa, Entamoeba invadens
TKKKSVFDMSPGSTLLD

SEQ ID NO: 3019735 - protein, 19 aa, Entamoeba invadens
TKKLIVFDEAKRLSWEQFY

SEQ ID NO: 3019736 - protein, 26 aa, Entamoeba invadens
TKKLLGGIFYDFFPRKGKRSGACKET

SEQ ID NO: 3019737 - protein, 32 aa, Entamoeba invadens
TKKLNIIKPIQSIGGFLILRLICPAIVQPHKT

SEQ ID NO: 3019738 - protein, 24 aa, Entamoeba invadens
TKKMFYQIVVWFNVDYTTITKNSE

SEQ ID NO: 3019739 - protein, 28 aa, Entamoeba invadens
TKKNHQRKGAWTGGKFGDLSGVGENIDR

SEQ ID NO: 3019740 - protein, 25 aa, Entamoeba invadens
TKKNTLIMIPSYFDYLRVKNYFKEE

SEQ ID NO: 3019741 - protein, 24 aa, Entamoeba invadens
TKKQLRVLVLRFVALLVRSHVGVK

SEQ ID NO: 3019742 - protein, 24 aa, Entamoeba invadens
TKKRSYLSFVATSGKPQLMMPKVR

SEQ ID NO: 3019743 - protein, 22 aa, Entamoeba invadens
TKKRVLYLFVTSDGYVFGTTHR

SEQ ID NO: 3019744 - protein, 18 aa, Entamoeba invadens
TKKSKGCGFVKFVYRDDA

SEQ ID NO: 3019745 - protein, 25 aa, Entamoeba invadens
TKKVNFFKIIVWYQVTYNKLCPPNK

SEQ ID NO: 3019746 - protein, 23 aa, Entamoeba invadens
TKKYNFKFITKTGEHLKQCFICG

SEQ ID NO: 3019747 - protein, 23 aa, Entamoeba invadens
TKKYRFGFITKTGDLTENCFICG

SEQ ID NO: 3019748 - protein, 23 aa, Entamoeba invadens
TKKYYWEEMNKRIDAYDKLYAEM

SEQ ID NO: 3019749 - protein, 23 aa, Entamoeba invadens
TKLAEIMLNFFKIIEPPQEEKDE

SEQ ID NO: 3019750 - protein, 20 aa, Entamoeba invadens
TKLCQYLDAFTFAYGSITTA

SEQ ID NO: 3019751 - protein, 29 aa, Entamoeba invadens
TKLDDNVLRLLWHEYWINSLSATAIISSR

SEQ ID NO: 3019752 - protein, 37 aa, Entamoeba invadens
TKLDEELLHNFKLVRLFFFTRFYQTTQEKFYNFVEEN

SEQ ID NO: 3019753 - protein, 19 aa, Entamoeba invadens
TKLFKMIAQFWDNKILSAT

SEQ ID NO: 3019754 - protein, 23 aa, Entamoeba invadens
TKLIPTDYLMFLKGISDLLSEQK

SEQ ID NO: 3019755 - protein, 24 aa, Entamoeba invadens
TKLKEMIRLFLFDGKKYEVEKIKI

SEQ ID NO: 3019756 - protein, 19 aa, Entamoeba invadens
TKLLKDKVSFRPQIIQWIL

SEQ ID NO: 3019757 - protein, 23 aa, Entamoeba invadens
TKLLLTQFQVRLSSLLGVIQKEI

SEQ ID NO: 3019758 - protein, 20 aa, Entamoeba invadens
TKLMPGMIYLNKQAPNNTTR

SEQ ID NO: 3019759 - protein, 19 aa, Entamoeba invadens
TKLNKLWDMADFHTVKVAS

SEQ ID NO: 3019760 - protein, 22 aa, Entamoeba invadens
TKLPHRTFFNCFKLRGVTVSTD

SEQ ID NO: 3019761 - protein, 18 aa, Entamoeba invadens
TKLPYKANGYIQTKWMSE

SEQ ID NO: 3019762 - protein, 32 aa, Entamoeba invadens
TKLTTTKGWDKLRWDDFLALKEEMQDDFPMTD

SEQ ID NO: 3019763 - protein, 20 aa, Entamoeba invadens
TKLVAPPKCNPLKNSVLTTG

SEQ ID NO: 3019764 - protein, 20 aa, Entamoeba invadens
TKLYMYINTPIRFKVHHVVM

SEQ ID NO: 3019765 - protein, 29 aa, Entamoeba invadens
TKMVLIRKRKAVLPFTRKHDFDIYVEIID

SEQ ID NO: 3019766 - protein, 26 aa, Entamoeba invadens
TKMVRFEMVYLMQISLYLPTMSDVLN

SEQ ID NO: 3019767 - protein, 25 aa, Entamoeba invadens
TKNEIDFMFCWRSIALLFKREFKKE

SEQ ID NO: 3019768 - protein, 30 aa, Entamoeba invadens
TKNGFISTDIFLAWFRDVVLTYIIKKCNEL

SEQ ID NO: 3019769 - protein, 31 aa, Entamoeba invadens
TKNGFISTDIFLAWFRDVVLTYIIKKRNELL

SEQ ID NO: 3019770 - protein, 31 aa, Entamoeba invadens
TKNGFISTDIFLAWFRDVVLTYIIKKRNELR

SEQ ID NO: 3019771 - protein, 24 aa, Entamoeba invadens
TKNIVITHFSVINEISFTKKKNAI

SEQ ID NO: 3019772 - protein, 36 aa, Entamoeba invadens
TKNNLRIFFGFFAGSDKLFELLYWVVEREITDASDR

SEQ ID NO: 3019773 - protein, 24 aa, Entamoeba invadens
TKNRLSFFSFFKKRSDELTSVPTS

SEQ ID NO: 3019774 - protein, 22 aa, Entamoeba invadens
TKNSLFLKLYDKYTQVFLMDYL

SEQ ID NO: 3019775 - protein, 24 aa, Entamoeba invadens
TKNVYDFMCAYFDPLSSVSLDLVE

SEQ ID NO: 3019776 - protein, 21 aa, Entamoeba invadens
TKNYNFGFSSDITKFVIPSQI

SEQ ID NO: 3019777 - protein, 23 aa, Entamoeba invadens
TKPEFAPVLNVSTASQGPLPATF

SEQ ID NO: 3019778 - protein, 27 aa, Entamoeba invadens
TKPLLKAFKYLLYTKIPPFFNQQNTTQ

SEQ ID NO: 3019779 - protein, 19 aa, Entamoeba invadens
TKPMVITFRLQLDGNVLIN

SEQ ID NO: 3019780 - protein, 27 aa, Entamoeba invadens
TKPQNGFVSIPLLFGTTRVLSYKMHKE

SEQ ID NO: 3019781 - protein, 22 aa, Entamoeba invadens
TKPTFLDIPPVTFAKQITLISS

SEQ ID NO: 3019782 - protein, 28 aa, Entamoeba invadens
TKQCQIIMTNLQFARYYNFMTKSTEDFL

SEQ ID NO: 3019783 - protein, 24 aa, Entamoeba invadens
TKQGFIKKMFNLLTNFKDNLNNQT

SEQ ID NO: 3019784 - protein, 30 aa, Entamoeba invadens
TKQGFQLLHLFNWSLFVLLNKQTYREVFAN

SEQ ID NO: 3019785 - protein, 20 aa, Entamoeba invadens
TKQGNYAYLLFAMSKNDGLK

SEQ ID NO: 3019786 - protein, 22 aa, Entamoeba invadens
TKQITIGYSLLLRKCNHTASKV

SEQ ID NO: 3019787 - protein, 23 aa, Entamoeba invadens
TKQKYQYITNFFIIYGRTILYSD

SEQ ID NO: 3019788 - protein, 27 aa, Entamoeba invadens
TKQLLEYMRGFPFLKTLRETITENRIS

SEQ ID NO: 3019789 - protein, 21 aa, Entamoeba invadens
TKQMLNILQKVLEYNKYIFLR

SEQ ID NO: 3019790 - protein, 18 aa, Entamoeba invadens
TKQPALGIEPFLSKSKKA

SEQ ID NO: 3019791 - protein, 25 aa, Entamoeba invadens
TKQRDVLLLFFDSKNDVLGQFRLVN

SEQ ID NO: 3019792 - protein, 23 aa, Entamoeba invadens
TKQTLIFTMEPTETIGDLRKNIA

SEQ ID NO: 3019793 - protein, 26 aa, Entamoeba invadens
TKRDIEPHKVRLADALFKKVPSGVGT

SEQ ID NO: 3019794 - protein, 25 aa, Entamoeba invadens
TKRFSAYILFYQKVIPIVEKVDVVY

SEQ ID NO: 3019795 - protein, 20 aa, Entamoeba invadens
TKRFVLIKDIVRPIFIKCVE

SEQ ID NO: 3019796 - protein, 17 aa, Entamoeba invadens
TKRTPVMMLSTPSVYTK

SEQ ID NO: 3019797 - protein, 43 aa, Entamoeba invadens
TKSDIYSLGIVFWEIFRRVVFGAYTKPWFTEYNIPAANDFAIF

SEQ ID NO: 3019798 - protein, 41 aa, Entamoeba invadens
TKSDTPSWNLWSDVFAKRTTFFELFRIPEFTAEYKEKMLSS

SEQ ID NO: 3019799 - protein, 27 aa, Entamoeba invadens
TKSDVRDWWYYPWLTEIVEDLTELKKQ

SEQ ID NO: 3019800 - protein, 26 aa, Entamoeba invadens
TKSETELYVLIKALWACDSSLSTEAH

SEQ ID NO: 3019801 - protein, 23 aa, Entamoeba invadens
TKSIPILQNINIEMVQPGKVMCV

SEQ ID NO: 3019802 - protein, 25 aa, Entamoeba invadens
TKSLEVKLFGFEYLSEFSGIANSPF

SEQ ID NO: 3019803 - protein, 23 aa, Entamoeba invadens
TKSNFWKWLRKDWIEAHGGLQAV

SEQ ID NO: 3019804 - protein, 25 aa, Entamoeba invadens
TKSPISFHFIPFSPIFGRLSGKGKE

SEQ ID NO: 3019805 - protein, 24 aa, Entamoeba invadens
TKSQSTMLFGLIDHIVFARRKNPE

SEQ ID NO: 3019806 - protein, 19 aa, Entamoeba invadens
TKSSFALLLKKEKQGNIAW

SEQ ID NO: 3019807 - protein, 25 aa, Entamoeba invadens
TKSTLSKFPFYFEAGIAIAKEIGDV

SEQ ID NO: 3019808 - protein, 23 aa, Entamoeba invadens
TKSYDGRYILRMTSSSLIKKLPS

SEQ ID NO: 3019809 - protein, 23 aa, Entamoeba invadens
TKTDVFWRIVSVNFYIPHVIKTD

SEQ ID NO: 3019810 - protein, 21 aa, Entamoeba invadens
TKTFFEKLAKYIGRNIKQLIS

SEQ ID NO: 3019811 - protein, 22 aa, Entamoeba invadens
TKTIKFFPHIETLNLWDGDDEV

SEQ ID NO: 3019812 - protein, 25 aa, Entamoeba invadens
TKTIQLFEQYLKKKPGCSGRVRLDH

SEQ ID NO: 3019813 - protein, 17 aa, Entamoeba invadens
TKTLPSFGDYFGNDPVC

SEQ ID NO: 3019814 - protein, 17 aa, Entamoeba invadens
TKTLSLFYSYASLVNYT

SEQ ID NO: 3019815 - protein, 20 aa, Entamoeba invadens
TKTQLIKGKYKKDIAEITVR

SEQ ID NO: 3019816 - protein, 25 aa, Entamoeba invadens
TKTRKQVFFLLLDSICINAFKCSEW

SEQ ID NO: 3019817 - protein, 26 aa, Entamoeba invadens
TKTTPPIYMWYAQFVEALKGFARAIG

SEQ ID NO: 3019818 - protein, 21 aa, Entamoeba invadens
TKTYPPLSSILFLDEKEETLD

SEQ ID NO: 3019819 - protein, 34 aa, Entamoeba invadens
TKVCLKLPYYGINKYKLLGLLYEYLPAFPTDSRV

SEQ ID NO: 3019820 - protein, 20 aa, Entamoeba invadens
TKVDAYKTLLVSALETNKIG

SEQ ID NO: 3019821 - protein, 24 aa, Entamoeba invadens
TKVLDLFDTISFPASVNQSVFGLA

SEQ ID NO: 3019822 - protein, 25 aa, Entamoeba invadens
TKVLWPVEAQLFSSSLDGSIALWDA

SEQ ID NO: 3019823 - protein, 29 aa, Entamoeba invadens
TKVNTFIRSLFALPFLRPQEIVETVQELF

SEQ ID NO: 3019824 - protein, 27 aa, Entamoeba invadens
TKVNTMYWVKWGNNFITAIDLTDNIFG

SEQ ID NO: 3019825 - protein, 21 aa, Entamoeba invadens
TKVSFPFGYGLSYTTFEYNNL

SEQ ID NO: 3019826 - protein, 23 aa, Entamoeba invadens
TKVSLQRILFSGFEGTCEFIGED

SEQ ID NO: 3019827 - protein, 21 aa, Entamoeba invadens
TKVVLPTTLVLIESKAFDCCE

SEQ ID NO: 3019828 - protein, 19 aa, Entamoeba invadens
TKVVLSKKLLIIKNGAFDN

SEQ ID NO: 3019829 - protein, 26 aa, Entamoeba invadens
TKYAKQVEWFGKGLFSVLAVDKVKMF

SEQ ID NO: 3019830 - protein, 21 aa, Entamoeba invadens
TKYIADLLFVPGSGYLKYYLY

SEQ ID NO: 3019831 - protein, 18 aa, Entamoeba invadens
TKYLSWPIEFGLVMSPYF

SEQ ID NO: 3019832 - protein, 23 aa, Entamoeba invadens
TKYPAFCLNKENGKLFSQRIVEK

SEQ ID NO: 3019833 - protein, 34 aa, Entamoeba invadens
TKYRDILITILNQFIEIFTLLGTAGAHFCIVSLS

SEQ ID NO: 3019834 - protein, 28 aa, Entamoeba invadens
TKYRQYYIHFQFPLNKYLQINNKGRRVI

SEQ ID NO: 3019835 - protein, 19 aa, Entamoeba invadens
TKYTIPFGIKSIRKYCFYK

SEQ ID NO: 3019836 - protein, 19 aa, Entamoeba invadens
TLADFLLRRALRNKNVIGH

SEQ ID NO: 3019837 - protein, 20 aa, Entamoeba invadens
TLADGTFWPIPITMSVSEED

SEQ ID NO: 3019838 - protein, 18 aa, Entamoeba invadens
TLAIAYKCGTVKYIPIME

SEQ ID NO: 3019839 - protein, 25 aa, Entamoeba invadens
TLAIELCKHFPPAIGEFRKLIPNML

SEQ ID NO: 3019840 - protein, 22 aa, Entamoeba invadens
TLAKWIVEKIQKLGLNTYRIVN

SEQ ID NO: 3019841 - protein, 21 aa, Entamoeba invadens
TLALFFGYVSTIDKFKTLFQK

SEQ ID NO: 3019842 - protein, 29 aa, Entamoeba invadens
TLASCQQLTYLNLGFNKLVNIPPTIQEMP

SEQ ID NO: 3019843 - protein, 20 aa, Entamoeba invadens
TLAVITPTFVRIFSLDSYYI

SEQ ID NO: 3019844 - protein, 25 aa, Entamoeba invadens
TLAYRAPEMINLYDYKPIGRKADVW

SEQ ID NO: 3019845 - protein, 21 aa, Entamoeba invadens
TLCDELRHIGRGCFSFCKSLS

SEQ ID NO: 3019846 - protein, 25 aa, Entamoeba invadens
TLCDYIETIPMLCFSECLHLIEVVI

SEQ ID NO: 3019847 - protein, 19 aa, Entamoeba invadens
TLCGWLKTTRPSKVIYDSS

SEQ ID NO: 3019848 - protein, 20 aa, Entamoeba invadens
TLCNEDQTFFLEYNTQLTPE

SEQ ID NO: 3019849 - protein, 21 aa, Entamoeba invadens
TLCQRGRVYQIKKLTPKRNKT

SEQ ID NO: 3019850 - protein, 29 aa, Entamoeba invadens
TLCVSPVVFILPLLLQQMALTGTQSIAPE

SEQ ID NO: 3019851 - protein, 19 aa, Entamoeba invadens
TLDAFLEVYPTNFPHQNTQ

SEQ ID NO: 3019852 - protein, 26 aa, Entamoeba invadens
TLDDQNMLQYLFILAQIGISCCPIYD

SEQ ID NO: 3019853 - protein, 26 aa, Entamoeba invadens
TLDDQNMLQYLFILAQIGITCCPIYD

SEQ ID NO: 3019854 - protein, 23 aa, Entamoeba invadens
TLDFFLRNIQKWDNLLGVTIVVP

SEQ ID NO: 3019855 - protein, 18 aa, Entamoeba invadens
TLDFWQKEITRYLDIATP

SEQ ID NO: 3019856 - protein, 22 aa, Entamoeba invadens
TLDHIQIFFTQSFVDFVMKHND

SEQ ID NO: 3019857 - protein, 32 aa, Entamoeba invadens
TLDIQTALLPFKAIEFLFYQPSFFSSQTRKCG

SEQ ID NO: 3019858 - protein, 20 aa, Entamoeba invadens
TLDKGVLVPFYDKLTTTTSY

SEQ ID NO: 3019859 - protein, 23 aa, Entamoeba invadens
TLDKKVMVWVIKPTNQNENSLLE

SEQ ID NO: 3019860 - protein, 20 aa, Entamoeba invadens
TLDKQNALTLFKVLDHIKPE

SEQ ID NO: 3019861 - protein, 25 aa, Entamoeba invadens
TLDNTLIQPPLNKVLPARELMPEKI

SEQ ID NO: 3019862 - protein, 28 aa, Entamoeba invadens
TLDNVPVIYHDLWMQIKTTDFLGNPQVL

SEQ ID NO: 3019863 - protein, 25 aa, Entamoeba invadens
TLDPALVRPGRLDRKIEFGLPDIDG

SEQ ID NO: 3019864 - protein, 26 aa, Entamoeba invadens
TLDQMNTFTLFRQLELLNIDDINSKT

SEQ ID NO: 3019865 - protein, 27 aa, Entamoeba invadens
TLDSLQQKIFVQSKKQTRFGYEKDDEF

SEQ ID NO: 3019866 - protein, 22 aa, Entamoeba invadens
TLEDSFKLPLPNDPTFGVNADT

SEQ ID NO: 3019867 - protein, 34 aa, Entamoeba invadens
TLEDYNLNILFKTAIFFKTIASIGLTLAGRGNES

SEQ ID NO: 3019868 - protein, 18 aa, Entamoeba invadens
TLEELMNSFDIQPALLGY

SEQ ID NO: 3019869 - protein, 25 aa, Entamoeba invadens
TLEFFDAALRYLATLGFDKLNIPKQ

SEQ ID NO: 3019870 - protein, 23 aa, Entamoeba invadens
TLEFKRVSPPPKVTKKLLGVNVS

SEQ ID NO: 3019871 - protein, 19 aa, Entamoeba invadens
TLEFVKIKTIIRTDEPDFA

SEQ ID NO: 3019872 - protein, 27 aa, Entamoeba invadens
TLEHIDCPYLFPYRNWKYTPPEVDFQG

SEQ ID NO: 3019873 - protein, 36 aa, Entamoeba invadens
TLELFSEPLHSLLKLLWALNMKLTRLYTTPSRDECF

SEQ ID NO: 3019874 - protein, 18 aa, Entamoeba invadens
TLELYKKLYDGESFNYNL

SEQ ID NO: 3019875 - protein, 30 aa, Entamoeba invadens
TLESLLIQPVQRVMRYPMLIKEIIKLTKRS

SEQ ID NO: 3019876 - protein, 27 aa, Entamoeba invadens
TLESLMKDLFLMKTEFLKQLSAAEDKI

SEQ ID NO: 3019877 - protein, 27 aa, Entamoeba invadens
TLESSTTWILYWTLNSLRLLKANVTDL

SEQ ID NO: 3019878 - protein, 26 aa, Entamoeba invadens
TLEYLHNCAPFVAKLYSLINSPETNA

SEQ ID NO: 3019879 - protein, 18 aa, Entamoeba invadens
TLFAPPTEFSLASPIQTK

SEQ ID NO: 3019880 - protein, 18 aa, Entamoeba invadens
TLFDFEKKTLLRVKVRSV

SEQ ID NO: 3019881 - protein, 21 aa, Entamoeba invadens
TLFDILHRTHTLSAYISSYVP

SEQ ID NO: 3019882 - protein, 20 aa, Entamoeba invadens
TLFEYEAVFGWCQSLTSFDV

SEQ ID NO: 3019883 - protein, 28 aa, Entamoeba invadens
TLFGCKKLEIYPKFIPTKTATFCDGYLV

SEQ ID NO: 3019884 - protein, 27 aa, Entamoeba invadens
TLFGNRFLRVDPILPGSILLDNVDQID

SEQ ID NO: 3019885 - protein, 18 aa, Entamoeba invadens
TLFGSTPLTQQFYYNNSY

SEQ ID NO: 3019886 - protein, 17 aa, Entamoeba invadens
TLFIIQGGCYFYGSVSI

SEQ ID NO: 3019887 - protein, 27 aa, Entamoeba invadens
TLFLEKGIWWDGNPCLWTLDNVEGPCR

SEQ ID NO: 3019888 - protein, 17 aa, Entamoeba invadens
TLFNITKQTICNLFCTR

SEQ ID NO: 3019889 - protein, 26 aa, Entamoeba invadens
TLFRSNPYFFLFKLEKNTVKPRLFPF

SEQ ID NO: 3019890 - protein, 21 aa, Entamoeba invadens
TLFVTLFKETVASYSAKINKN

SEQ ID NO: 3019891 - protein, 17 aa, Entamoeba invadens
TLFYIIVDHICELVKKE

SEQ ID NO: 3019892 - protein, 25 aa, Entamoeba invadens
TLGENMLFFNAIITVCWDPVPQNRP

SEQ ID NO: 3019893 - protein, 24 aa, Entamoeba invadens
TLGIFKYLLSEQFGIEQDLIVLSV

SEQ ID NO: 3019894 - protein, 30 aa, Entamoeba invadens
TLGKAKSFAYFFDNLFPMNNPYFVNISKFR

SEQ ID NO: 3019895 - protein, 24 aa, Entamoeba invadens
TLGPQPMECVPLPSLDKAQQPQDH

SEQ ID NO: 3019896 - protein, 17 aa, Entamoeba invadens
TLGQVNPIPYIPTQGSN

SEQ ID NO: 3019897 - protein, 25 aa, Entamoeba invadens
TLGSNFFQNCKWLMDVNLGAINSLP

SEQ ID NO: 3019898 - protein, 25 aa, Entamoeba invadens
TLGSNIFQNCKWLMDVNLGTIKSLS

SEQ ID NO: 3019899 - protein, 17 aa, Entamoeba invadens
TLGVWPFSNETVPSEIL

SEQ ID NO: 3019900 - protein, 34 aa, Entamoeba invadens
TLHLYSPCDDFFPEKAFFQKIVHYKVIHSSLPNA

SEQ ID NO: 3019901 - protein, 26 aa, Entamoeba invadens
TLHQTKGKGFQKSKTKLKKSDFKGTI

SEQ ID NO: 3019902 - protein, 18 aa, Entamoeba invadens
TLICYDFTELMIKHSNII

SEQ ID NO: 3019903 - protein, 25 aa, Entamoeba invadens
TLIDEIRKYFLKLQPKNTKDSYIPS

SEQ ID NO: 3019904 - protein, 18 aa, Entamoeba invadens
TLIDLGMMRGEAVQLLFC

SEQ ID NO: 3019905 - protein, 22 aa, Entamoeba invadens
TLIDLPAYFLQQELPMLMIVRT

SEQ ID NO: 3019906 - protein, 17 aa, Entamoeba invadens
TLIDLYQVISVNQSVIF

SEQ ID NO: 3019907 - protein, 20 aa, Entamoeba invadens
TLIDTLVYLEQKKAQQEKQI

SEQ ID NO: 3019908 - protein, 24 aa, Entamoeba invadens
TLIEIKKFTLPLFDNLKKLTVKKC

SEQ ID NO: 3019909 - protein, 21 aa, Entamoeba invadens
TLIFHYYQLFEEFISLAPVVK

SEQ ID NO: 3019910 - protein, 17 aa, Entamoeba invadens
TLILRHVHSLPTTLQIM

SEQ ID NO: 3019911 - protein, 26 aa, Entamoeba invadens
TLINEGPYSLHLAGYTVIDASEAAAG

SEQ ID NO: 3019912 - protein, 19 aa, Entamoeba invadens
TLIPLKLTNNEHMEIRLEQ

SEQ ID NO: 3019913 - protein, 23 aa, Entamoeba invadens
TLIRPIPQILQPPQIHGTPVVRR

SEQ ID NO: 3019914 - protein, 20 aa, Entamoeba invadens
TLITVPAVCLSLGLGYFDTD

SEQ ID NO: 3019915 - protein, 38 aa, Entamoeba invadens
TLIYHFDGNKYFLQLPRRILQMYPLNVPFHLNYVVMVF

SEQ ID NO: 3019916 - protein, 17 aa, Entamoeba invadens
TLKATVVFQRKLKFAAE

SEQ ID NO: 3019917 - protein, 17 aa, Entamoeba invadens
TLKCEMLTLIAKLIDVT

SEQ ID NO: 3019918 - protein, 24 aa, Entamoeba invadens
TLKDAMAANNWQYYRIYIGMVKND

SEQ ID NO: 3019919 - protein, 29 aa, Entamoeba invadens
TLKDYKVDKFLFFGALTTGLLNLTNPKAK

SEQ ID NO: 3019920 - protein, 17 aa, Entamoeba invadens
TLKEISSMALTKMKETA

SEQ ID NO: 3019921 - protein, 30 aa, Entamoeba invadens
TLKFFPHIETLFLYSIKDPILRDGNIQRYF

SEQ ID NO: 3019922 - protein, 31 aa, Entamoeba invadens
TLKIAEWCHYYTFPVFNKYNGKYIYKQALLY

SEQ ID NO: 3019923 - protein, 18 aa, Entamoeba invadens
TLKIANYGWFEKESKIRG

SEQ ID NO: 3019924 - protein, 18 aa, Entamoeba invadens
TLKIITFIEVNFDNEFLC

SEQ ID NO: 3019925 - protein, 24 aa, Entamoeba invadens
TLKIPSNAFLKPAWLSFIEENNFV

SEQ ID NO: 3019926 - protein, 24 aa, Entamoeba invadens
TLKKIKYYCFSLCSLTSISIPDSV

SEQ ID NO: 3019927 - protein, 26 aa, Entamoeba invadens
TLKKPNFWKLRRRDCPWVKTKKTELT

SEQ ID NO: 3019928 - protein, 20 aa, Entamoeba invadens
TLKKYHVIIPAITVILSSDV

SEQ ID NO: 3019929 - protein, 17 aa, Entamoeba invadens
TLKLFEVDNFIFSTNFE

SEQ ID NO: 3019930 - protein, 17 aa, Entamoeba invadens
TLKLKIYKEIGPLNKNG

SEQ ID NO: 3019931 - protein, 19 aa, Entamoeba invadens
TLKLLEDLIWINSSGQYNK

SEQ ID NO: 3019932 - protein, 23 aa, Entamoeba invadens
TLKMETIKKIYWNGRLFLDKDDI

SEQ ID NO: 3019933 - protein, 18 aa, Entamoeba invadens
TLKMFLQEIEKCGCVAVM

SEQ ID NO: 3019934 - protein, 26 aa, Entamoeba invadens
TLKMTTFNPTYFLRNTRVEYLTLESI

SEQ ID NO: 3019935 - protein, 25 aa, Entamoeba invadens
TLKNGIGIKYFLQATLTVLTLKKDD

SEQ ID NO: 3019936 - protein, 23 aa, Entamoeba invadens
TLKPRPIVWRTNHSFMVADRVED

SEQ ID NO: 3019937 - protein, 18 aa, Entamoeba invadens
TLKQGAKIRKLSFSTGVQ

SEQ ID NO: 3019938 - protein, 33 aa, Entamoeba invadens
TLKQKQIVTPQIKWLNPMTGMGKLAFKYNSMTH

SEQ ID NO: 3019939 - protein, 17 aa, Entamoeba invadens
TLKQSFLFCKAKRSVVC

SEQ ID NO: 3019940 - protein, 24 aa, Entamoeba invadens
TLKTFLEEVSPFYTLYTLLKEKVS

SEQ ID NO: 3019941 - protein, 23 aa, Entamoeba invadens
TLKTKWFPPKVRKMRILWNEIDS

SEQ ID NO: 3019942 - protein, 24 aa, Entamoeba invadens
TLKTLPSYCFANCSNLALPAFPES

SEQ ID NO: 3019943 - protein, 18 aa, Entamoeba invadens
TLKTLQTYFFSGLQCLME

SEQ ID NO: 3019944 - protein, 17 aa, Entamoeba invadens
TLKTRRLFPNLETLHLS

SEQ ID NO: 3019945 - protein, 30 aa, Entamoeba invadens
TLKTVIVKKPIFIIGLPRTGSTTLFNLMSS

SEQ ID NO: 3019946 - protein, 24 aa, Entamoeba invadens
TLKVDFFQIVVWYQVTATLEDSKK

SEQ ID NO: 3019947 - protein, 21 aa, Entamoeba invadens
TLKYFPRIETLNIWSKDEEAF

SEQ ID NO: 3019948 - protein, 21 aa, Entamoeba invadens
TLKYFPRIETLNIWSKNEEAF

SEQ ID NO: 3019949 - protein, 19 aa, Entamoeba invadens
TLLDWLFDLMIEVSHNREV

SEQ ID NO: 3019950 - protein, 26 aa, Entamoeba invadens
TLLEKKVFILSPYRDLVSSTLSFLIQ

SEQ ID NO: 3019951 - protein, 18 aa, Entamoeba invadens
TLLGEMVGARLIAHTGSL

SEQ ID NO: 3019952 - protein, 24 aa, Entamoeba invadens
TLLIEQHIDFLPNIKLENFIGKFP

SEQ ID NO: 3019953 - protein, 26 aa, Entamoeba invadens
TLLIKLQKEFGNKWTKISACLKGRSP

SEQ ID NO: 3019954 - protein, 22 aa, Entamoeba invadens
TLLKTPAITNYIPTPPTIQTRN

SEQ ID NO: 3019955 - protein, 19 aa, Entamoeba invadens
TLLLFENNEPVFKVLACCV

SEQ ID NO: 3019956 - protein, 17 aa, Entamoeba invadens
TLLLNLTNDIPTGVIKH

SEQ ID NO: 3019957 - protein, 24 aa, Entamoeba invadens
TLLLNRFIEIIKTKDIKVVQVQVQ

SEQ ID NO: 3019958 - protein, 23 aa, Entamoeba invadens
TLLLPSYQCLVPKISLSNLSYIK

SEQ ID NO: 3019959 - protein, 37 aa, Entamoeba invadens
TLLLTNSLTKLLLPTSPHPLFALRIVSRFLTPTTMPA

SEQ ID NO: 3019960 - protein, 20 aa, Entamoeba invadens
TLLMQYPRQEMFQIELLKMV

SEQ ID NO: 3019961 - protein, 24 aa, Entamoeba invadens
TLLNEKFNIEPFYKYNMSGSYREV

SEQ ID NO: 3019962 - protein, 23 aa, Entamoeba invadens
TLLNRTIRFGPYHKDQNKYLDKK

SEQ ID NO: 3019963 - protein, 21 aa, Entamoeba invadens
TLLNSKLLNIQNLQSSAQLNS

SEQ ID NO: 3019964 - protein, 23 aa, Entamoeba invadens
TLLRNQLRFTFPPLVVHARDNQP

SEQ ID NO: 3019965 - protein, 18 aa, Entamoeba invadens
TLLRSIFSLFDKMIHGKS

SEQ ID NO: 3019966 - protein, 33 aa, Entamoeba invadens
TLLSGMLKCLYFNKAYMMPIKLFEVGDTVILKE

SEQ ID NO: 3019967 - protein, 17 aa, Entamoeba invadens
TLLSLPIGIFEECRSLK

SEQ ID NO: 3019968 - protein, 18 aa, Entamoeba invadens
TLLSMLDFSFNKINDISI

SEQ ID NO: 3019969 - protein, 28 aa, Entamoeba invadens
TLLSNLQCSLLAFLAMKCDITVGKQKKN

SEQ ID NO: 3019970 - protein, 17 aa, Entamoeba invadens
TLMAVTKKFYRFTEAYK

SEQ ID NO: 3019971 - protein, 24 aa, Entamoeba invadens
TLMERGYILRRSGVYARASISRNP

SEQ ID NO: 3019972 - protein, 29 aa, Entamoeba invadens
TLMGIYAPFLHVLLFSYLFNFNNGMSHNE

SEQ ID NO: 3019973 - protein, 23 aa, Entamoeba invadens
TLMLDVSLLPIILEALVEMGCKN

SEQ ID NO: 3019974 - protein, 18 aa, Entamoeba invadens
TLMQLYYPMNYEGTVLDF

SEQ ID NO: 3019975 - protein, 20 aa, Entamoeba invadens
TLMSMLIRSPEGSVIRVVLY

SEQ ID NO: 3019976 - protein, 20 aa, Entamoeba invadens
TLMTPKYSLAIAALGELLWQ

SEQ ID NO: 3019977 - protein, 25 aa, Entamoeba invadens
TLNCNFLPITIDYFLKPIHIRNCVL

SEQ ID NO: 3019978 - protein, 23 aa, Entamoeba invadens
TLNDFYTMLFEQNVSVVVMLTKF

SEQ ID NO: 3019979 - protein, 25 aa, Entamoeba invadens
TLNDLIRLCWGVMTVSDFTSRRKII

SEQ ID NO: 3019980 - protein, 25 aa, Entamoeba invadens
TLNFHIQPFLHWPDTMMTVIQEMKV

SEQ ID NO: 3019981 - protein, 40 aa, Entamoeba invadens
TLNFPPEMCWTLLTIFLKKLPVPLLYPLDKFVTEKETPKH

SEQ ID NO: 3019982 - protein, 22 aa, Entamoeba invadens
TLNIGVFGFPLSVGIKKSGWYI

SEQ ID NO: 3019983 - protein, 52 aa, Entamoeba invadens
TLNITGPIFSYCKTKMFDALKNTKLIPPQTSVLSILFYVQKQIQNRLPIGDI

SEQ ID NO: 3019984 - protein, 20 aa, Entamoeba invadens
TLNKLPFNDGPTLLPKLNVN

SEQ ID NO: 3019985 - protein, 21 aa, Entamoeba invadens
TLNLEFMTHFDFFCNERYKEK

SEQ ID NO: 3019986 - protein, 20 aa, Entamoeba invadens
TLNLILKFTRSYGSICKLLA

SEQ ID NO: 3019987 - protein, 23 aa, Entamoeba invadens
TLNLLVVFIYVQKQFHNENLLNR

SEQ ID NO: 3019988 - protein, 24 aa, Entamoeba invadens
TLNQMLMQHIMNSLPSLRITITEM

SEQ ID NO: 3019989 - protein, 26 aa, Entamoeba invadens
TLNSLKFFYFVIKIKIRVIGLKPNDA

SEQ ID NO: 3019990 - protein, 26 aa, Entamoeba invadens
TLNTRAWQCFFNYIAIHNAYFKKEGD

SEQ ID NO: 3019991 - protein, 18 aa, Entamoeba invadens
TLPDSVIPSRYLLDFINL

SEQ ID NO: 3019992 - protein, 19 aa, Entamoeba invadens
TLPGLKYKQGISTWKVFDK

SEQ ID NO: 3019993 - protein, 18 aa, Entamoeba invadens
TLPGVAVRTSGDPILCDC

SEQ ID NO: 3019994 - protein, 17 aa, Entamoeba invadens
TLPHLIISRAEIDGVDV

SEQ ID NO: 3019995 - protein, 18 aa, Entamoeba invadens
TLPKIYPMDVHKNDPHNA

SEQ ID NO: 3019996 - protein, 17 aa, Entamoeba invadens
TLPPQSYYQLSPLTSFL

SEQ ID NO: 3019997 - protein, 18 aa, Entamoeba invadens
TLPQWLTEKQRRQLRKDE

SEQ ID NO: 3019998 - protein, 23 aa, Entamoeba invadens
TLPSISCLFKRQNKNDGGIALIY

SEQ ID NO: 3019999 - protein, 53 aa, Entamoeba invadens
TLPSLGYKILVSAKAQFLLFLDVRMSLHVYRILRPFRLLEIDSIPNTYNFVFT

SEQ ID NO: 3020000 - protein, 19 aa, Entamoeba invadens
TLPSLVSLIGKYCFFECGS

SEQ ID NO: 3020001 - protein, 18 aa, Entamoeba invadens
TLPTYHKTFFPLVQISMD

SEQ ID NO: 3020002 - protein, 29 aa, Entamoeba invadens
TLPVYKKRDEFLKLLRSHQIIIIAGETGS

SEQ ID NO: 3020003 - protein, 21 aa, Entamoeba invadens
TLQFEYFTALLQQLDIMVDGT

SEQ ID NO: 3020004 - protein, 17 aa, Entamoeba invadens
TLQILGAEKALFRAIKT

SEQ ID NO: 3020005 - protein, 21 aa, Entamoeba invadens
TLQKSFDFSLFTQLVSLDLSA

SEQ ID NO: 3020006 - protein, 24 aa, Entamoeba invadens
TLQKWYLMLWESDFGTYQHEVMGL

SEQ ID NO: 3020007 - protein, 20 aa, Entamoeba invadens
TLQMFKLMDGMWKKEGLDFR

SEQ ID NO: 3020008 - protein, 23 aa, Entamoeba invadens
TLQMRLYQLQPMTSPRFSDSKKV

SEQ ID NO: 3020009 - protein, 18 aa, Entamoeba invadens
TLQNLAIVVAPNLYEANS

SEQ ID NO: 3020010 - protein, 19 aa, Entamoeba invadens
TLQQLYSIIAEELLDSKNG

SEQ ID NO: 3020011 - protein, 17 aa, Entamoeba invadens
TLQQRNQKLYRMAGGTV

SEQ ID NO: 3020012 - protein, 18 aa, Entamoeba invadens
TLQRILTVLYSYADLFSG

SEQ ID NO: 3020013 - protein, 31 aa, Entamoeba invadens
TLQVMAGMSLVYPLLFWVQKYRDNTNVTHCG

SEQ ID NO: 3020014 - protein, 20 aa, Entamoeba invadens
TLQVPYTINKPLPKPKPIED

SEQ ID NO: 3020015 - protein, 20 aa, Entamoeba invadens
TLQVTTPISSLYFPIVIDQL

SEQ ID NO: 3020016 - protein, 19 aa, Entamoeba invadens
TLQYLYILGQIGISSSPIQ

SEQ ID NO: 3020017 - protein, 26 aa, Entamoeba invadens
TLRFHARFLLVCLLTDKLKQGENVLS

SEQ ID NO: 3020018 - protein, 25 aa, Entamoeba invadens
TLRGFKHFYAFSRQYKMLSKDDVAP

SEQ ID NO: 3020019 - protein, 20 aa, Entamoeba invadens
TLRGVFEVIFDLIDKDHSGD

SEQ ID NO: 3020020 - protein, 19 aa, Entamoeba invadens
TLRHNCIFVNFMKMVYDEK

SEQ ID NO: 3020021 - protein, 17 aa, Entamoeba invadens
TLRILGHQKFEVIFPSK

SEQ ID NO: 3020022 - protein, 19 aa, Entamoeba invadens
TLRLFNRNVFVFTNNFLLD

SEQ ID NO: 3020023 - protein, 38 aa, Entamoeba invadens
TLRNDIFDCLLLPIQMKSLRKVVFLLSSNKKECVKRNE

SEQ ID NO: 3020024 - protein, 18 aa, Entamoeba invadens
TLSCLDPLKVYKSFVTLH

SEQ ID NO: 3020025 - protein, 23 aa, Entamoeba invadens
TLSDVLFYIEQKYTNLFKPTDSG

SEQ ID NO: 3020026 - protein, 27 aa, Entamoeba invadens
TLSDVVLGQVYFKTVRLPLASMELQIL

SEQ ID NO: 3020027 - protein, 26 aa, Entamoeba invadens
TLSINHFIYFIDFFEQYETRENFKKV

SEQ ID NO: 3020028 - protein, 22 aa, Entamoeba invadens
TLSKIGEIARSLYAATFGCINE

SEQ ID NO: 3020029 - protein, 18 aa, Entamoeba invadens
TLSLIYDFDFKSSRLQEK

SEQ ID NO: 3020030 - protein, 25 aa, Entamoeba invadens
TLSLKNCNFLLRFAEINLIGPKGEI

SEQ ID NO: 3020031 - protein, 17 aa, Entamoeba invadens
TLSLPPKLSLIGVQCFR

SEQ ID NO: 3020032 - protein, 35 aa, Entamoeba invadens
TLSLTRSGSFLPTLIPYILHPFSEKKLIPPELDFS

SEQ ID NO: 3020033 - protein, 22 aa, Entamoeba invadens
TLSMRQICRIPSKKSSRKTKIV

SEQ ID NO: 3020034 - protein, 22 aa, Entamoeba invadens
TLSNIIIPLQVLNIGNCCFSKC

SEQ ID NO: 3020035 - protein, 29 aa, Entamoeba invadens
TLSPTDYSLFLYYAKRRINPFIKPKSIFL

SEQ ID NO: 3020036 - protein, 33 aa, Entamoeba invadens
TLSQDLQSLYLTLFGRVGLMKNTLLVGNVNVPT

SEQ ID NO: 3020037 - protein, 26 aa, Entamoeba invadens
TLSQSILKQFMLLSASLLVKPEMTQN

SEQ ID NO: 3020038 - protein, 30 aa, Entamoeba invadens
TLSSDPLWSLYLQFFIDHNVLVHGNINNLK

SEQ ID NO: 3020039 - protein, 25 aa, Entamoeba invadens
TLSSNLEIICKRAFFNCQKLENFEV

SEQ ID NO: 3020040 - protein, 26 aa, Entamoeba invadens
TLSSNLEIICKRAFFNCQKLENFEVP

SEQ ID NO: 3020041 - protein, 32 aa, Entamoeba invadens
TLSVGLFAGCKYLNKITLPNSITSLPAYFFKN

SEQ ID NO: 3020042 - protein, 19 aa, Entamoeba invadens
TLSYGFLEISMRCTTLKTI

SEQ ID NO: 3020043 - protein, 29 aa, Entamoeba invadens
TLSYIMDLMDYLLVVPLPIIHNYSSDRTK

SEQ ID NO: 3020044 - protein, 19 aa, Entamoeba invadens
TLTALFVEIVKKYNKLTRN

SEQ ID NO: 3020045 - protein, 23 aa, Entamoeba invadens
TLTDSLIISISIYINKQKKANTG

SEQ ID NO: 3020046 - protein, 30 aa, Entamoeba invadens
TLTFGDRWLNVFEWVLRGFVDYSKTVGEKP

SEQ ID NO: 3020047 - protein, 18 aa, Entamoeba invadens
TLTGTLLKYIKMIDNIPL

SEQ ID NO: 3020048 - protein, 24 aa, Entamoeba invadens
TLTHPSPFLDLLPPTPEDPRITTS

SEQ ID NO: 3020049 - protein, 37 aa, Entamoeba invadens
TLTKDTYGHFLVKKMFKYLAPNFTKIFIEKISTMLGD

SEQ ID NO: 3020050 - protein, 19 aa, Entamoeba invadens
TLTKKLFKTQTKKNDMVKK

SEQ ID NO: 3020051 - protein, 17 aa, Entamoeba invadens
TLTLEYPDYKILCTGHS

SEQ ID NO: 3020052 - protein, 26 aa, Entamoeba invadens
TLTLKKPNFWKLRRKDCPWTKQKKCN

SEQ ID NO: 3020053 - protein, 24 aa, Entamoeba invadens
TLTLSFTFSTLKDKIKTVALCIGD

SEQ ID NO: 3020054 - protein, 28 aa, Entamoeba invadens
TLTPDLFALRLKKFFDNVLPENPKDVLT

SEQ ID NO: 3020055 - protein, 17 aa, Entamoeba invadens
TLTPIHLEQLVFLHEYG

SEQ ID NO: 3020056 - protein, 19 aa, Entamoeba invadens
TLTTAFYNFTTKSSFEIPL

SEQ ID NO: 3020057 - protein, 26 aa, Entamoeba invadens
TLTYSLFDKMIYPHILPAFISATATT

SEQ ID NO: 3020058 - protein, 18 aa, Entamoeba invadens
TLVCKKFIATIAKFHFNP

SEQ ID NO: 3020059 - protein, 24 aa, Entamoeba invadens
TLVECYQVILDVAAWINETKLYEE

SEQ ID NO: 3020060 - protein, 19 aa, Entamoeba invadens
TLVGERWCYSLQSVTFPSH

SEQ ID NO: 3020061 - protein, 17 aa, Entamoeba invadens
TLVGLHYKELQKALNKC

SEQ ID NO: 3020062 - protein, 27 aa, Entamoeba invadens
TLVGQDIIEALKRLGFDAYCPSLRKHL

SEQ ID NO: 3020063 - protein, 18 aa, Entamoeba invadens
TLVHVYNQWKKHEGDKRW

SEQ ID NO: 3020064 - protein, 20 aa, Entamoeba invadens
TLVIDMGSLHFLMQDSAKYK

SEQ ID NO: 3020065 - protein, 26 aa, Entamoeba invadens
TLVIVPKDLFKLTISEALLAGVAMER

SEQ ID NO: 3020066 - protein, 18 aa, Entamoeba invadens
TLVMQRGGLKKRMTFVPL

SEQ ID NO: 3020067 - protein, 21 aa, Entamoeba invadens
TLVRRALHLPASQNDIVLGCG

SEQ ID NO: 3020068 - protein, 18 aa, Entamoeba invadens
TLVSMYEAFKPKMARFMR

SEQ ID NO: 3020069 - protein, 27 aa, Entamoeba invadens
TLVSSKPVLAFFKKVLERIGDVTRGTP

SEQ ID NO: 3020070 - protein, 30 aa, Entamoeba invadens
TLVVDVVEIPFMPHIVLEVVKTIFAKRGIT

SEQ ID NO: 3020071 - protein, 17 aa, Entamoeba invadens
TLYDIFIFDEGVHEIKM

SEQ ID NO: 3020072 - protein, 20 aa, Entamoeba invadens
TLYLSPLDFLFGVKATARSV

SEQ ID NO: 3020073 - protein, 19 aa, Entamoeba invadens
TLYLVFEYCDDDLQKFIKR

SEQ ID NO: 3020074 - protein, 34 aa, Entamoeba invadens
TLYNKLNAKYILKLTLAILEWIPSVQNVHFGRSQ

SEQ ID NO: 3020075 - protein, 20 aa, Entamoeba invadens
TLYVDKFEYPLDPQTLLSSN

SEQ ID NO: 3020076 - protein, 32 aa, Entamoeba invadens
TMAYRAPEMISLYQYMPIGCKSDVWALGCLIY

SEQ ID NO: 3020077 - protein, 18 aa, Entamoeba invadens
TMCEILVKDGYTFTTKQS

SEQ ID NO: 3020078 - protein, 18 aa, Entamoeba invadens
TMCTTCTNGYYLNNRVCE

SEQ ID NO: 3020079 - protein, 28 aa, Entamoeba invadens
TMDEGVQWLSLTYYYICCLRSPKMYSVD

SEQ ID NO: 3020080 - protein, 27 aa, Entamoeba invadens
TMDEYKSRTILLHFRTKLASKNFMYEC

SEQ ID NO: 3020081 - protein, 25 aa, Entamoeba invadens
TMDGTLIVLFDYDGSLKLVTSLTSK

SEQ ID NO: 3020082 - protein, 17 aa, Entamoeba invadens
TMDIFVENYYQCICEDY

SEQ ID NO: 3020083 - protein, 18 aa, Entamoeba invadens
TMDYLLMTKKSQLKGFIS

SEQ ID NO: 3020084 - protein, 20 aa, Entamoeba invadens
TMEIGSSVCRFILFCTNVCN

SEQ ID NO: 3020085 - protein, 25 aa, Entamoeba invadens
TMEKDGVLFVLILNRNKTVFARGRK

SEQ ID NO: 3020086 - protein, 28 aa, Entamoeba invadens
TMEQLPPNTFLYKKEQIPPKLKKIFELQ

SEQ ID NO: 3020087 - protein, 17 aa, Entamoeba invadens
TMERYLYSILSEVLRDW

SEQ ID NO: 3020088 - protein, 34 aa, Entamoeba invadens
TMFECFGWCEAYTKDLFKFPWKIAEYVIAGNRPI

SEQ ID NO: 3020089 - protein, 23 aa, Entamoeba invadens
TMFELLVSPLLQVRIIVADTILA

SEQ ID NO: 3020090 - protein, 53 aa, Entamoeba invadens
TMFFGNGYREYSIRDVIFYMFERDSTRFLTCTLSFHLTYISGLEIIKKGRGTY

SEQ ID NO: 3020091 - protein, 31 aa, Entamoeba invadens
TMFFGNGYREYSIRDVVFYMFERDSTRFLMC

SEQ ID NO: 3020092 - protein, 18 aa, Entamoeba invadens
TMFIGMSNSLTRILMKQN

SEQ ID NO: 3020093 - protein, 25 aa, Entamoeba invadens
TMFKRHLFQYGGHLGVYLVLGGYDC

SEQ ID NO: 3020094 - protein, 37 aa, Entamoeba invadens
TMFSLRFKIRLLAEMLQMPAYCRLPLGIYVTTHRYDE

SEQ ID NO: 3020095 - protein, 21 aa, Entamoeba invadens
TMGFPMMAYKYRSDSKLLLLH

SEQ ID NO: 3020096 - protein, 20 aa, Entamoeba invadens
TMHPTLMGDFYFRGKDLYPN

SEQ ID NO: 3020097 - protein, 19 aa, Entamoeba invadens
TMIFIVGNKCDLADQRLVK

SEQ ID NO: 3020098 - protein, 22 aa, Entamoeba invadens
TMINTIKYFPYLETLNIRCNED

SEQ ID NO: 3020099 - protein, 22 aa, Entamoeba invadens
TMKFDMFIPTQQLISESVINCP

SEQ ID NO: 3020100 - protein, 30 aa, Entamoeba invadens
TMKKFKIYDKFAFPTLLNLTTYSSLFLDKQ

SEQ ID NO: 3020101 - protein, 23 aa, Entamoeba invadens
TMKMFNSFFEHISAPTSPVLQDS

SEQ ID NO: 3020102 - protein, 32 aa, Entamoeba invadens
TMKSIHKGSEKAILIHKVLYGSIGSEATRRTD

SEQ ID NO: 3020103 - protein, 23 aa, Entamoeba invadens
TMKTKPYFPTSLLPVLTEVLDNM

SEQ ID NO: 3020104 - protein, 21 aa, Entamoeba invadens
TMKTMLYLHCPTDVLQNRHVA

SEQ ID NO: 3020105 - protein, 17 aa, Entamoeba invadens
TMKVIPHNLIDKNTLRY

SEQ ID NO: 3020106 - protein, 26 aa, Entamoeba invadens
TMKVKMLLLVVPTFQFAKGNTNILSM

SEQ ID NO: 3020107 - protein, 25 aa, Entamoeba invadens
TMKYKEYISMVLYLLDDIDRVNYLS

SEQ ID NO: 3020108 - protein, 26 aa, Entamoeba invadens
TMLDNKLIINIIAYLAKHNPTTRVII

SEQ ID NO: 3020109 - protein, 19 aa, Entamoeba invadens
TMMEYGLSFVIACNSRTRQ

SEQ ID NO: 3020110 - protein, 35 aa, Entamoeba invadens
TMMSTINFIFTFLKPSIIFNIRFYFEYAVPTQSEH

SEQ ID NO: 3020111 - protein, 20 aa, Entamoeba invadens
TMNIGSLIDLPPNAPFPALV

SEQ ID NO: 3020112 - protein, 25 aa, Entamoeba invadens
TMNSLRYYFPILFACFGRVEKLFNL

SEQ ID NO: 3020113 - protein, 24 aa, Entamoeba invadens
TMNTLLLDFCIEIGYFFDYKKKKG

SEQ ID NO: 3020114 - protein, 18 aa, Entamoeba invadens
TMPFLKIEKLSKGNTTID

SEQ ID NO: 3020115 - protein, 25 aa, Entamoeba invadens
TMQLDSSILPFYTKPIETPSNKTSQ

SEQ ID NO: 3020116 - protein, 20 aa, Entamoeba invadens
TMQLQCYKPKRFSDRLLGEV

SEQ ID NO: 3020117 - protein, 37 aa, Entamoeba invadens
TMQPINWMKGMVQAALYAPFDLIFKTLMKVMTQNYEL

SEQ ID NO: 3020118 - protein, 17 aa, Entamoeba invadens
TMQRRFMLISKKTRYDL

SEQ ID NO: 3020119 - protein, 19 aa, Entamoeba invadens
TMQVVKDLYLLLGSADFLG

SEQ ID NO: 3020120 - protein, 26 aa, Entamoeba invadens
TMRIKEWYSWHFPELYNILSHDNAMF

SEQ ID NO: 3020121 - protein, 40 aa, Entamoeba invadens
TMSIDYFINFIDFFEQFFPKTFLFIITNNKTFKTTNEAIN

SEQ ID NO: 3020122 - protein, 18 aa, Entamoeba invadens
TMSLLHTLSLKKDNAFVE

SEQ ID NO: 3020123 - protein, 23 aa, Entamoeba invadens
TMSPMYPIPPPQDQMLFQPPPVP

SEQ ID NO: 3020124 - protein, 24 aa, Entamoeba invadens
TMSQELIFLMLQVSPKKRITAQQI

SEQ ID NO: 3020125 - protein, 27 aa, Entamoeba invadens
TMSRSQMGLPLPNKNFLQNFNVTPDPS

SEQ ID NO: 3020126 - protein, 27 aa, Entamoeba invadens
TMTEEDDFMLAYSRMQKNKIGGDGVID

SEQ ID NO: 3020127 - protein, 18 aa, Entamoeba invadens
TMTGLWLMGVIFSGLNRS

SEQ ID NO: 3020128 - protein, 18 aa, Entamoeba invadens
TMTKIGLPVPQGFVITTE

SEQ ID NO: 3020129 - protein, 25 aa, Entamoeba invadens
TMTLCGIIGVILYGNSSSVFSKSSE

SEQ ID NO: 3020130 - protein, 29 aa, Entamoeba invadens
TMTPDFFDKFPAFFIEKEYEDVLAALRDK

SEQ ID NO: 3020131 - protein, 20 aa, Entamoeba invadens
TMVLLPKLKNVRCHAFEAVL

SEQ ID NO: 3020132 - protein, 24 aa, Entamoeba invadens
TMVNNLVFLMTLNDRVIYVVKKLT

SEQ ID NO: 3020133 - protein, 25 aa, Entamoeba invadens
TMVQLKAMNFIQLMQMYPTNDSYSR

SEQ ID NO: 3020134 - protein, 19 aa, Entamoeba invadens
TMWEVFYESAPFFEYQEIK

SEQ ID NO: 3020135 - protein, 31 aa, Entamoeba invadens
TMYECFGWSYAFSKEKFKFPWKIVDFVSKGN

SEQ ID NO: 3020136 - protein, 18 aa, Entamoeba invadens
TMYEFFAGCFDPESVIFK

SEQ ID NO: 3020137 - protein, 35 aa, Entamoeba invadens
TMYETFAWKEAYPTNKFKFPWKIAEFVMSGKRVEK

SEQ ID NO: 3020138 - protein, 17 aa, Entamoeba invadens
TMYHIFTNEVPYKDLSN

SEQ ID NO: 3020139 - protein, 17 aa, Entamoeba invadens
TMYHMFTNEIPYKDLSN

SEQ ID NO: 3020140 - protein, 20 aa, Entamoeba invadens
TMYYCPFCSRCFLYACNKNH

SEQ ID NO: 3020141 - protein, 17 aa, Entamoeba invadens
TNALFSLSNFALKNLHL

SEQ ID NO: 3020142 - protein, 19 aa, Entamoeba invadens
TNANHNCITLLPNCITLYP

SEQ ID NO: 3020143 - protein, 24 aa, Entamoeba invadens
TNAPRRLLVAYSNLIYDLFVIDNE

SEQ ID NO: 3020144 - protein, 20 aa, Entamoeba invadens
TNARRDCCFINFATKEIAEK

SEQ ID NO: 3020145 - protein, 26 aa, Entamoeba invadens
TNCKSLKELVFPLHLKFVGKKCFQKC

SEQ ID NO: 3020146 - protein, 29 aa, Entamoeba invadens
TNCLTFSKSIKRTLATFSDLLHVFLSAEE

SEQ ID NO: 3020147 - protein, 23 aa, Entamoeba invadens
TNCSDLEINLEKPVRRVCFVDCK

SEQ ID NO: 3020148 - protein, 31 aa, Entamoeba invadens
TNDAFYQFSFNPEQQVYVLFVIDSIVKNDVS

SEQ ID NO: 3020149 - protein, 20 aa, Entamoeba invadens
TNDCYFIVFSKEPVVSLSDI

SEQ ID NO: 3020150 - protein, 25 aa, Entamoeba invadens
TNDDFRLKLLLSHLCKFFSFHTRQK

SEQ ID NO: 3020151 - protein, 25 aa, Entamoeba invadens
TNDDPVLIHFLSDKNLLVVGSCSVS

SEQ ID NO: 3020152 - protein, 26 aa, Entamoeba invadens
TNDEKIQLLLPKLPDLLVSKDLSLRK

SEQ ID NO: 3020153 - protein, 21 aa, Entamoeba invadens
TNDILNLFKDLQFLSVGVSPE

SEQ ID NO: 3020154 - protein, 25 aa, Entamoeba invadens
TNDLAKFFGKWSLYYQLTPTSLEDT

SEQ ID NO: 3020155 - protein, 25 aa, Entamoeba invadens
TNDNFPIVIATKQDILVFGSKIAYA

SEQ ID NO: 3020156 - protein, 27 aa, Entamoeba invadens
TNDQGVFKYLKYLLSNTCKFCSKEFET

SEQ ID NO: 3020157 - protein, 24 aa, Entamoeba invadens
TNDQLEFVVPFYYLDMNVSENQTF

SEQ ID NO: 3020158 - protein, 18 aa, Entamoeba invadens
TNDSRLAPWLGGSIIASI

SEQ ID NO: 3020159 - protein, 32 aa, Entamoeba invadens
TNDVTSTYLLMKLSFNYLFDLMAVSMDPSIVE

SEQ ID NO: 3020160 - protein, 27 aa, Entamoeba invadens
TNECTIKIIWLCLKNGIAARDKWVSED

SEQ ID NO: 3020161 - protein, 21 aa, Entamoeba invadens
TNEELKLTIQKLEETQQQKVG

SEQ ID NO: 3020162 - protein, 25 aa, Entamoeba invadens
TNEENLGVWKYLRKHKIVSLEKVML

SEQ ID NO: 3020163 - protein, 31 aa, Entamoeba invadens
TNEFLKNAVKLIFLNKMDLFEEKLTKTALNV

SEQ ID NO: 3020164 - protein, 20 aa, Entamoeba invadens
TNEIWAKVPNLISAIAVVDL

SEQ ID NO: 3020165 - protein, 23 aa, Entamoeba invadens
TNEKCFHFPYINTLPTTFSCPLS

SEQ ID NO: 3020166 - protein, 21 aa, Entamoeba invadens
TNEWTFMQPLHYNKSSGFLEK

SEQ ID NO: 3020167 - protein, 23 aa, Entamoeba invadens
TNFDFSEMYLMGKYDLCDKFYRQ

SEQ ID NO: 3020168 - protein, 25 aa, Entamoeba invadens
TNFKKFPSLLNLTKLTYVKVERNAF

SEQ ID NO: 3020169 - protein, 25 aa, Entamoeba invadens
TNFNKFYTSFSFKKKLTILPHFSTC

SEQ ID NO: 3020170 - protein, 24 aa, Entamoeba invadens
TNFPSADVIIFGPGLMGCMHQPNE

SEQ ID NO: 3020171 - protein, 24 aa, Entamoeba invadens
TNFTQKRRPFIKEEVIPKEKPKDK

SEQ ID NO: 3020172 - protein, 23 aa, Entamoeba invadens
TNFVLVDEFIKPIVKTFRLKEDD

SEQ ID NO: 3020173 - protein, 24 aa, Entamoeba invadens
TNGEKKDWRKVGFTPAAAKHTPPN

SEQ ID NO: 3020174 - protein, 30 aa, Entamoeba invadens
TNGIGTPIYIYIYIYIYMAPEVLNKQHYKK

SEQ ID NO: 3020175 - protein, 23 aa, Entamoeba invadens
TNGILYFELRFDTPDFTKDQIVI

SEQ ID NO: 3020176 - protein, 21 aa, Entamoeba invadens
TNGIVYFTYSFDISSLKLDEI

SEQ ID NO: 3020177 - protein, 29 aa, Entamoeba invadens
TNGKLLGAPVYYLIAILQTIKELDEYQQV

SEQ ID NO: 3020178 - protein, 17 aa, Entamoeba invadens
TNGLFTLVKPTPRGLML

SEQ ID NO: 3020179 - protein, 18 aa, Entamoeba invadens
TNGLKGVSSKFLNDAYPG

SEQ ID NO: 3020180 - protein, 34 aa, Entamoeba invadens
TNHFPYYLEASYPYWILRLVWKRKDHTFTVIRKD

SEQ ID NO: 3020181 - protein, 24 aa, Entamoeba invadens
TNHILTFMIKNFTQIFTIPRRCCV

SEQ ID NO: 3020182 - protein, 28 aa, Entamoeba invadens
TNHLQIDSLNFFVLPTKITKLTAEMFRS

SEQ ID NO: 3020183 - protein, 22 aa, Entamoeba invadens
TNIAVSLIYQLLADGTTRREAY

SEQ ID NO: 3020184 - protein, 23 aa, Entamoeba invadens
TNIEIFKPKKRITRDPRFVLDDN

SEQ ID NO: 3020185 - protein, 17 aa, Entamoeba invadens
TNIFYKCYSLSSVVIIE

SEQ ID NO: 3020186 - protein, 17 aa, Entamoeba invadens
TNILIICFSIDSRSSFG

SEQ ID NO: 3020187 - protein, 25 aa, Entamoeba invadens
TNIPLLGCLTTFKPKTFKNCIELKV

SEQ ID NO: 3020188 - protein, 21 aa, Entamoeba invadens
TNIPLNFVFEGSVDYYIFKVI

SEQ ID NO: 3020189 - protein, 19 aa, Entamoeba invadens
TNITIITKESHLSLLVLPK

SEQ ID NO: 3020190 - protein, 24 aa, Entamoeba invadens
TNIVYNFLFNTLEKNKLHVQSKIK

SEQ ID NO: 3020191 - protein, 25 aa, Entamoeba invadens
TNKDPIVIVLPLNGGGYLICEEILM

SEQ ID NO: 3020192 - protein, 23 aa, Entamoeba invadens
TNKEVLFPLRKFIGSTQDGALAN

SEQ ID NO: 3020193 - protein, 17 aa, Entamoeba invadens
TNKHICLLVRYAEKRDA

SEQ ID NO: 3020194 - protein, 17 aa, Entamoeba invadens
TNKIFGSTNTYLLCFDD

SEQ ID NO: 3020195 - protein, 25 aa, Entamoeba invadens
TNKKFYIFNTFLMNKIRRHRVISAP

SEQ ID NO: 3020196 - protein, 27 aa, Entamoeba invadens
TNKKIDFFKIVVWFTVSYNTSLNTLNG

SEQ ID NO: 3020197 - protein, 25 aa, Entamoeba invadens
TNKNLRKFVFPKTLIYSSVSHIIHS

SEQ ID NO: 3020198 - protein, 17 aa, Entamoeba invadens
TNKPLPMKGDTPNFDVL

SEQ ID NO: 3020199 - protein, 24 aa, Entamoeba invadens
TNKTFKYFPKMKILHLWKKEDENF

SEQ ID NO: 3020200 - protein, 24 aa, Entamoeba invadens
TNKTIIQRTLVYVTNIPYCIIEGL

SEQ ID NO: 3020201 - protein, 17 aa, Entamoeba invadens
TNKYYDKDMRTKCAMCT

SEQ ID NO: 3020202 - protein, 24 aa, Entamoeba invadens
TNLDKLFDYFATGVSQPFSNETDP

SEQ ID NO: 3020203 - protein, 24 aa, Entamoeba invadens
TNLDYRIYKFLIKNYKIEGEVVLY

SEQ ID NO: 3020204 - protein, 24 aa, Entamoeba invadens
TNLECSLLAFISTKADVVLSRPKK

SEQ ID NO: 3020205 - protein, 17 aa, Entamoeba invadens
TNLETLFLACNHLSSLE

SEQ ID NO: 3020206 - protein, 18 aa, Entamoeba invadens
TNLFKHSLTLKTNTNNTL

SEQ ID NO: 3020207 - protein, 27 aa, Entamoeba invadens
TNLMCEMYCQIITGMFVFLEQQQTSSS

SEQ ID NO: 3020208 - protein, 21 aa, Entamoeba invadens
TNLTKVVLPKTLKEIRELCFD

SEQ ID NO: 3020209 - protein, 21 aa, Entamoeba invadens
TNMEVVIGKFKSIPCKESKTF

SEQ ID NO: 3020210 - protein, 26 aa, Entamoeba invadens
TNMVDWDYWVFGTIKALLGGRIQLVC

SEQ ID NO: 3020211 - protein, 28 aa, Entamoeba invadens
TNNAKMFLKKSFFAVIEKKIEAKFNYTE

SEQ ID NO: 3020212 - protein, 17 aa, Entamoeba invadens
TNNKFNYIKLKPKISRL

SEQ ID NO: 3020213 - protein, 24 aa, Entamoeba invadens
TNNKLNEVPLYIDSFHKLRTLNVS

SEQ ID NO: 3020214 - protein, 17 aa, Entamoeba invadens
TNNLLLFSNKKIAKEHK

SEQ ID NO: 3020215 - protein, 18 aa, Entamoeba invadens
TNNLLLFSNKKIAKEHKT

SEQ ID NO: 3020216 - protein, 25 aa, Entamoeba invadens
TNNMKKFHFNPIPLNCKTIEYFPCV

SEQ ID NO: 3020217 - protein, 28 aa, Entamoeba invadens
TNPIEAPTLFFFFKGNLLNIVPPHEITQ

SEQ ID NO: 3020218 - protein, 29 aa, Entamoeba invadens
TNPTYAMYPNLAPFINPVGMINPVGNGPT

SEQ ID NO: 3020219 - protein, 25 aa, Entamoeba invadens
TNPVISREFYLLAQKIYTQYKKLFD

SEQ ID NO: 3020220 - protein, 19 aa, Entamoeba invadens
TNPYSQFVLNNSYLFALTP

SEQ ID NO: 3020221 - protein, 22 aa, Entamoeba invadens
TNQHPLYVTSAPGIVIELNKNT

SEQ ID NO: 3020222 - protein, 18 aa, Entamoeba invadens
TNQMGMMPAFGFQPMGIN

SEQ ID NO: 3020223 - protein, 22 aa, Entamoeba invadens
TNQRFIYVHPYVDSFYTSSFEN

SEQ ID NO: 3020224 - protein, 28 aa, Entamoeba invadens
TNQSKTFLNTLLLFKITGSLKKEVLQRV

SEQ ID NO: 3020225 - protein, 17 aa, Entamoeba invadens
TNRARKYYYIVMECCQC

SEQ ID NO: 3020226 - protein, 27 aa, Entamoeba invadens
TNRIDILDPALLRPGRIDRKIEFPNPK

SEQ ID NO: 3020227 - protein, 25 aa, Entamoeba invadens
TNRSKKYYYLVMELCDFTLAEYTEN

SEQ ID NO: 3020228 - protein, 23 aa, Entamoeba invadens
TNRSTRLIDFGCGDLCLMSVGRF

SEQ ID NO: 3020229 - protein, 31 aa, Entamoeba invadens
TNRVSLQTVWKYFFLFSDVLVVTEITSLDGK

SEQ ID NO: 3020230 - protein, 25 aa, Entamoeba invadens
TNRVTYFIVKYDALFYEGCPLTLYD

SEQ ID NO: 3020231 - protein, 23 aa, Entamoeba invadens
TNRWDIRDLYDMIDIAALNAYKT

SEQ ID NO: 3020232 - protein, 24 aa, Entamoeba invadens
TNSEYYTFKFLSDYTKLALVSDPK

SEQ ID NO: 3020233 - protein, 22 aa, Entamoeba invadens
TNSKIIVFFQTCKQVRFFFETF

SEQ ID NO: 3020234 - protein, 17 aa, Entamoeba invadens
TNSLERIIAREPINFTN

SEQ ID NO: 3020235 - protein, 23 aa, Entamoeba invadens
TNSLVYFIVNCGFDITIRKTKQA

SEQ ID NO: 3020236 - protein, 19 aa, Entamoeba invadens
TNSLYYVMSFKANGLHRFV

SEQ ID NO: 3020237 - protein, 29 aa, Entamoeba invadens
TNSSFNCTQTFHFPLPSLLTSEYDQAPIP

SEQ ID NO: 3020238 - protein, 28 aa, Entamoeba invadens
TNSSGFLLLYTLQLLDKVLFPENDNELS

SEQ ID NO: 3020239 - protein, 20 aa, Entamoeba invadens
TNSYEILYSNAHSCVTQYLE

SEQ ID NO: 3020240 - protein, 25 aa, Entamoeba invadens
TNTDPIVVFLPMNGGGYIDAENYLY

SEQ ID NO: 3020241 - protein, 30 aa, Entamoeba invadens
TNTEREFLLTCYSAFWLTSSRKVYLHQLFK

SEQ ID NO: 3020242 - protein, 24 aa, Entamoeba invadens
TNTFLLSHIIYISPNFQFVSLNGI

SEQ ID NO: 3020243 - protein, 17 aa, Entamoeba invadens
TNTLLPDIFMYLTQHIE

SEQ ID NO: 3020244 - protein, 24 aa, Entamoeba invadens
TNTNIERLEFFYPVSYDKFLEEKK

SEQ ID NO: 3020245 - protein, 25 aa, Entamoeba invadens
TNTNTIIIGLFVSSLVKLVLKGEKV

SEQ ID NO: 3020246 - protein, 36 aa, Entamoeba invadens
TNTNYLWKQNCFLITSYTSFIKFEKTIKKEIIDNTN

SEQ ID NO: 3020247 - protein, 27 aa, Entamoeba invadens
TNTRFVPEGFLIHGFWPQSNEGFINCC

SEQ ID NO: 3020248 - protein, 26 aa, Entamoeba invadens
TNTRPFPINLFIAPWKNPQTQLHYLL

SEQ ID NO: 3020249 - protein, 28 aa, Entamoeba invadens
TNTTDLARLFYIYLLNTQDVSALKKVVE

SEQ ID NO: 3020250 - protein, 29 aa, Entamoeba invadens
TNTTDLKLFYFPEKFVFLKGGRPIHPVVI

SEQ ID NO: 3020251 - protein, 23 aa, Entamoeba invadens
TNTVFSLMVLFPNEFMGIKDNLI

SEQ ID NO: 3020252 - protein, 20 aa, Entamoeba invadens
TNVEHPLLPTSERPLEKKME

SEQ ID NO: 3020253 - protein, 18 aa, Entamoeba invadens
TNVFIINIDENGHFFGVF

SEQ ID NO: 3020254 - protein, 24 aa, Entamoeba invadens
TNVLKTLEIISKQLLLMSSKHSKS

SEQ ID NO: 3020255 - protein, 20 aa, Entamoeba invadens
TNVNQTPRFLAQTPKYTVST

SEQ ID NO: 3020256 - protein, 25 aa, Entamoeba invadens
TNVQEAFVFIITEVLKRLETEGANE

SEQ ID NO: 3020257 - protein, 23 aa, Entamoeba invadens
TNVQIFICQLLDLQLVKYQLNAL

SEQ ID NO: 3020258 - protein, 23 aa, Entamoeba invadens
TNVQLVLTHYLNLQARYPNLSDL

SEQ ID NO: 3020259 - protein, 21 aa, Entamoeba invadens
TNWKKYLNIMIEHLSLIFTQR

SEQ ID NO: 3020260 - protein, 40 aa, Entamoeba invadens
TNYDLFKLAIKVSAKRLFPNFVFLDAPFNKKYYKKGDYRT

SEQ ID NO: 3020261 - protein, 17 aa, Entamoeba invadens
TNYDVIIVVFDITDLKS

SEQ ID NO: 3020262 - protein, 22 aa, Entamoeba invadens
TNYEKYVPYKYPPISIPESTVF

SEQ ID NO: 3020263 - protein, 23 aa, Entamoeba invadens
TNYIKWFCKMMELMVKYFEECHS

SEQ ID NO: 3020264 - protein, 20 aa, Entamoeba invadens
TNYLFLITVESSETYVVCNK

SEQ ID NO: 3020265 - protein, 24 aa, Entamoeba invadens
TNYPPTRFAPLPTNGDLLFVYGDN

SEQ ID NO: 3020266 - protein, 21 aa, Entamoeba invadens
TNYQDIEKFYRIYSPPTINCN

SEQ ID NO: 3020267 - protein, 27 aa, Entamoeba invadens
TPAKSQLPKWFPTQASEFSFTSNKIDD

SEQ ID NO: 3020268 - protein, 17 aa, Entamoeba invadens
TPALISPANYNSCLITP

SEQ ID NO: 3020269 - protein, 18 aa, Entamoeba invadens
TPAPFKITARNRINEPLK

SEQ ID NO: 3020270 - protein, 24 aa, Entamoeba invadens
TPCERRWNSIVLPLDMDAGNRLSI

SEQ ID NO: 3020271 - protein, 26 aa, Entamoeba invadens
TPDNLPMCIKTFNNVLLKWSGLTKNE

SEQ ID NO: 3020272 - protein, 24 aa, Entamoeba invadens
TPDNLVLIGVTRKYVLQAAQALGM

SEQ ID NO: 3020273 - protein, 23 aa, Entamoeba invadens
TPEDFYIRKIYSTSYDCFNRPIC

SEQ ID NO: 3020274 - protein, 30 aa, Entamoeba invadens
TPEERFVKLVQFFLSGFYVNPKTCKKPYNP

SEQ ID NO: 3020275 - protein, 32 aa, Entamoeba invadens
TPELQSYIVYTKIHFFPEITEEAKLVIQEYYN

SEQ ID NO: 3020276 - protein, 24 aa, Entamoeba invadens
TPEPIKNFRYGFLNKWYSSEYSFE

SEQ ID NO: 3020277 - protein, 24 aa, Entamoeba invadens
TPEQGQLLFWAYLEQQNGQLPHQQ

SEQ ID NO: 3020278 - protein, 23 aa, Entamoeba invadens
TPEQYFVNYSKYFANICFSTYPV

SEQ ID NO: 3020279 - protein, 23 aa, Entamoeba invadens
TPERIVSVFVTKVPYTFTEKTFA

SEQ ID NO: 3020280 - protein, 26 aa, Entamoeba invadens
TPESFLIFNCFDWDNALKFSADDFLG

SEQ ID NO: 3020281 - protein, 19 aa, Entamoeba invadens
TPFAFDFTNKIFYSSQVQV

SEQ ID NO: 3020282 - protein, 31 aa, Entamoeba invadens
TPFIAMYASLPLMDMFGFEIDVRFFTRGQAF

SEQ ID NO: 3020283 - protein, 20 aa, Entamoeba invadens
TPFMQLFCFNLDELVPLVFK

SEQ ID NO: 3020284 - protein, 21 aa, Entamoeba invadens
TPFPTTYKFNYTEIAKFDSIE

SEQ ID NO: 3020285 - protein, 20 aa, Entamoeba invadens
TPFQVTIDQISIITDEKKDG

SEQ ID NO: 3020286 - protein, 17 aa, Entamoeba invadens
TPFTPLADLQKFFWRCV

SEQ ID NO: 3020287 - protein, 25 aa, Entamoeba invadens
TPFVKEGFFLHGYWPQSTGNNNMLC

SEQ ID NO: 3020288 - protein, 31 aa, Entamoeba invadens
TPGCLSVFIVNNRIFYIYDDGVYYTDSNTLE

SEQ ID NO: 3020289 - protein, 28 aa, Entamoeba invadens
TPGGLILLGAPNVIFKKCTDLGFMLDSA

SEQ ID NO: 3020290 - protein, 18 aa, Entamoeba invadens
TPGLRMSITQKLSVEDQQ

SEQ ID NO: 3020291 - protein, 24 aa, Entamoeba invadens
TPHEIALSWILRHPSHIQVVTGTT

SEQ ID NO: 3020292 - protein, 34 aa, Entamoeba invadens
TPHKTIFLGDYVDRGIYSCELLFMLMSMKYNSPT

SEQ ID NO: 3020293 - protein, 25 aa, Entamoeba invadens
TPHNLGVVWGPNLVWRSWLEASEVD

SEQ ID NO: 3020294 - protein, 18 aa, Entamoeba invadens
TPIGVVHQTPFNLETNLD

SEQ ID NO: 3020295 - protein, 26 aa, Entamoeba invadens
TPIKKSFVDLIKPTTLKKVETPKTSF

SEQ ID NO: 3020296 - protein, 24 aa, Entamoeba invadens
TPIQRAIIPHCLIGRDVIGAAKTG

SEQ ID NO: 3020297 - protein, 24 aa, Entamoeba invadens
TPIYRYKHEWLYGSFKKTLFFKSE

SEQ ID NO: 3020298 - protein, 26 aa, Entamoeba invadens
TPKCIKCFTSYYIENGKCVLAYSKTE

SEQ ID NO: 3020299 - protein, 18 aa, Entamoeba invadens
TPKEFHSIFAERLNEKLK

SEQ ID NO: 3020300 - protein, 25 aa, Entamoeba invadens
TPKGIVRVVFPPGIDYEKTEKVWGS

SEQ ID NO: 3020301 - protein, 22 aa, Entamoeba invadens
TPKITYLLSLATQYFVRPFPTL

SEQ ID NO: 3020302 - protein, 31 aa, Entamoeba invadens
TPKLSSAIDLSWFLSHFYLDTVDFDEVQIPV

SEQ ID NO: 3020303 - protein, 19 aa, Entamoeba invadens
TPKLYVVPDYFSASVKKVI

SEQ ID NO: 3020304 - protein, 24 aa, Entamoeba invadens
TPKSSIVPTIPTYSNPMSQPSTTI

SEQ ID NO: 3020305 - protein, 24 aa, Entamoeba invadens
TPKTKNLFKFIQTQQFFSPFDMKL

SEQ ID NO: 3020306 - protein, 25 aa, Entamoeba invadens
TPKTRKYFPHLQTIFLYTPDDEIFD

SEQ ID NO: 3020307 - protein, 18 aa, Entamoeba invadens
TPLGISPEVRQFDESLLD

SEQ ID NO: 3020308 - protein, 24 aa, Entamoeba invadens
TPLHIAAKFGLLQSAQWLLDHNAD

SEQ ID NO: 3020309 - protein, 17 aa, Entamoeba invadens
TPLHIFCNRFQNVQSYK

SEQ ID NO: 3020310 - protein, 22 aa, Entamoeba invadens
TPLHLACLCGYKGIIESLTFAL

SEQ ID NO: 3020311 - protein, 26 aa, Entamoeba invadens
TPLHLVVYFHRHDLLRYTLSIMTIDT

SEQ ID NO: 3020312 - protein, 21 aa, Entamoeba invadens
TPLHYAFVFKNTEVVLYLLKN

SEQ ID NO: 3020313 - protein, 19 aa, Entamoeba invadens
TPLLGFFEKGRFKGFLEYL

SEQ ID NO: 3020314 - protein, 17 aa, Entamoeba invadens
TPLQKILYKLCAEWYTT

SEQ ID NO: 3020315 - protein, 28 aa, Entamoeba invadens
TPLRKFQSFKVFFNWAKNISGFRFVIII

SEQ ID NO: 3020316 - protein, 19 aa, Entamoeba invadens
TPLSLVSKKIAFLSATLIV

SEQ ID NO: 3020317 - protein, 38 aa, Entamoeba invadens
TPLVQTYFVIAFLKMRYSNMKIVWRLLVEKAEKYIASN

SEQ ID NO: 3020318 - protein, 31 aa, Entamoeba invadens
TPNKAVFEKVFYRIIVWFNVDFETVDKNKCR

SEQ ID NO: 3020319 - protein, 23 aa, Entamoeba invadens
TPNLNFPTLPIKGCLKELEFQDY

SEQ ID NO: 3020320 - protein, 24 aa, Entamoeba invadens
TPNNMKLFPNIQTLNLFSPFDIQL

SEQ ID NO: 3020321 - protein, 29 aa, Entamoeba invadens
TPNNMKLFPNIQTLNLFSPFDIQLTNTTI

SEQ ID NO: 3020322 - protein, 24 aa, Entamoeba invadens
TPNPSWASIPYGIFICIQCSGQHR

SEQ ID NO: 3020323 - protein, 38 aa, Entamoeba invadens
TPNTKSIDYLKLLLAHPPYPRFSLFFTQTGTITDDILM

SEQ ID NO: 3020324 - protein, 30 aa, Entamoeba invadens
TPPETLIHHFPYIMQTLFTAFQEFKESTNV

SEQ ID NO: 3020325 - protein, 25 aa, Entamoeba invadens
TPPKHPDFIPLIKTLINFEQFCEEA

SEQ ID NO: 3020326 - protein, 25 aa, Entamoeba invadens
TPPNKMLLDYIYLNSLLDESKIKSA

SEQ ID NO: 3020327 - protein, 27 aa, Entamoeba invadens
TPQEKALCSVSFFPPKPSYNTCHFCTI

SEQ ID NO: 3020328 - protein, 17 aa, Entamoeba invadens
TPQELCEFFFEVPDEVG

SEQ ID NO: 3020329 - protein, 23 aa, Entamoeba invadens
TPQKIEIKVLWKLENDTLIPAVL

SEQ ID NO: 3020330 - protein, 23 aa, Entamoeba invadens
TPQLFEKWVIAPFEEFCVAKFVD

SEQ ID NO: 3020331 - protein, 23 aa, Entamoeba invadens
TPQMTFVVHYLKHQFLSRRGDDL

SEQ ID NO: 3020332 - protein, 27 aa, Entamoeba invadens
TPQNAFMEVFPIFAKLFSRIGEIPEMY

SEQ ID NO: 3020333 - protein, 24 aa, Entamoeba invadens
TPQPEPCYPPAVPWVESSADLPYI

SEQ ID NO: 3020334 - protein, 26 aa, Entamoeba invadens
TPQSHPDYFWLKDALKKYEYFCTLSN

SEQ ID NO: 3020335 - protein, 33 aa, Entamoeba invadens
TPRGTNPYMKLLGRIYAFLAKRTQSKFAKTVHH

SEQ ID NO: 3020336 - protein, 18 aa, Entamoeba invadens
TPRHIQLAVRSDLELNDL

SEQ ID NO: 3020337 - protein, 24 aa, Entamoeba invadens
TPRIRDVWAYAPPKSKRSPMMPLP

SEQ ID NO: 3020338 - protein, 20 aa, Entamoeba invadens
TPRLKLIDFSTLETPINKDL

SEQ ID NO: 3020339 - protein, 26 aa, Entamoeba invadens
TPRTASRFRPIYALTLDITRTFKFEN

SEQ ID NO: 3020340 - protein, 19 aa, Entamoeba invadens
TPRYPLLLNTIIKATQRNI

SEQ ID NO: 3020341 - protein, 20 aa, Entamoeba invadens
TPSFPRRRIYNNILETVGGT

SEQ ID NO: 3020342 - protein, 18 aa, Entamoeba invadens
TPSRYILTLTGKKYDRVV

SEQ ID NO: 3020343 - protein, 26 aa, Entamoeba invadens
TPSSTPLLPQFFDENEWYLTQEIKPL

SEQ ID NO: 3020344 - protein, 21 aa, Entamoeba invadens
TPSVPLYPSLIPEIVRPNKRF

SEQ ID NO: 3020345 - protein, 18 aa, Entamoeba invadens
TPTKLFENFKKPSTKRKS

SEQ ID NO: 3020346 - protein, 30 aa, Entamoeba invadens
TPTLNITSLTLKLTIRWLVSGRANGITGYE

SEQ ID NO: 3020347 - protein, 30 aa, Entamoeba invadens
TPTRPPINVGPLIHFLYETYPEGKMKTVFV

SEQ ID NO: 3020348 - protein, 27 aa, Entamoeba invadens
TPVDANAWFVALAYTIQLAPRLNESKS

SEQ ID NO: 3020349 - protein, 25 aa, Entamoeba invadens
TPVQRLPRYKLLLSDLFEHTKFKDV

SEQ ID NO: 3020350 - protein, 20 aa, Entamoeba invadens
TPVYMAPEILRREKYKKPAD

SEQ ID NO: 3020351 - protein, 23 aa, Entamoeba invadens
TPYLHIQNFLIGKEDSPSISKVC

SEQ ID NO: 3020352 - protein, 26 aa, Entamoeba invadens
TQAETKLFFYILKLTQICVTPMREQI

SEQ ID NO: 3020353 - protein, 19 aa, Entamoeba invadens
TQAKRKILYEKLKKAEKEM

SEQ ID NO: 3020354 - protein, 18 aa, Entamoeba invadens
TQALGLWGPMSELYQKEM

SEQ ID NO: 3020355 - protein, 20 aa, Entamoeba invadens
TQALPFLQVKTIFFSQYDSI

SEQ ID NO: 3020356 - protein, 29 aa, Entamoeba invadens
TQARSFLESFTDYFKHWTYLSQAANEDDP

SEQ ID NO: 3020357 - protein, 32 aa, Entamoeba invadens
TQAVELNLQLMKWQLFKSLDLEMLKQTKCLLI

SEQ ID NO: 3020358 - protein, 22 aa, Entamoeba invadens
TQCILYWCFANLYLIALEMKAD

SEQ ID NO: 3020359 - protein, 20 aa, Entamoeba invadens
TQCLLLDPTFDVKKLEMYCD

SEQ ID NO: 3020360 - protein, 19 aa, Entamoeba invadens
TQCQLEMAVLLINNAQNIR

SEQ ID NO: 3020361 - protein, 23 aa, Entamoeba invadens
TQDKVFELLLCDISVKRNEASGM

SEQ ID NO: 3020362 - protein, 22 aa, Entamoeba invadens
TQDMWLSFIKLSNVEYSIIEPY

SEQ ID NO: 3020363 - protein, 27 aa, Entamoeba invadens
TQDSTEVFFKIKKNTPLKKLMEAFCNK

SEQ ID NO: 3020364 - protein, 22 aa, Entamoeba invadens
TQDTLCYLLKFLREVAQCSQKN

SEQ ID NO: 3020365 - protein, 24 aa, Entamoeba invadens
TQDVCLFAFGLIKSTNTIFTTAFT

SEQ ID NO: 3020366 - protein, 26 aa, Entamoeba invadens
TQEEKNQFPCLFNLVKKMNAKSPTTC

SEQ ID NO: 3020367 - protein, 26 aa, Entamoeba invadens
TQEKKNFVFSTFHKLGFEDLIVSVHR

SEQ ID NO: 3020368 - protein, 21 aa, Entamoeba invadens
TQFAQFFSTSKFSILLNKELL

SEQ ID NO: 3020369 - protein, 18 aa, Entamoeba invadens
TQFCKELAKAQPICKDRR

SEQ ID NO: 3020370 - protein, 24 aa, Entamoeba invadens
TQFGKPLMEWLEASAFPAERKCKE

SEQ ID NO: 3020371 - protein, 24 aa, Entamoeba invadens
TQFNTLLCMCEIFRYYDSTFLQPF

SEQ ID NO: 3020372 - protein, 34 aa, Entamoeba invadens
TQFPGVLGKLYSIKTLWLCYNYLSELNGIGGMRN

SEQ ID NO: 3020373 - protein, 25 aa, Entamoeba invadens
TQFSQFFFKPILPAVSENLLQICTS

SEQ ID NO: 3020374 - protein, 17 aa, Entamoeba invadens
TQHNVRIIAKYYHNITL

SEQ ID NO: 3020375 - protein, 30 aa, Entamoeba invadens
TQHPQYYIDKILYCKPFLSPLNKARTEINI

SEQ ID NO: 3020376 - protein, 21 aa, Entamoeba invadens
TQICIDWTNGLSYLKNLILTQ

SEQ ID NO: 3020377 - protein, 17 aa, Entamoeba invadens
TQIIKKKGELKGDYITV

SEQ ID NO: 3020378 - protein, 23 aa, Entamoeba invadens
TQIITYDLLKKIGPDVLFLSDTA

SEQ ID NO: 3020379 - protein, 18 aa, Entamoeba invadens
TQIKLRFCQGIFVENYNP

SEQ ID NO: 3020380 - protein, 20 aa, Entamoeba invadens
TQILPYLKATPTRQKHSLSL

SEQ ID NO: 3020381 - protein, 21 aa, Entamoeba invadens
TQILYQTFDPIFDDLFHYHFS

SEQ ID NO: 3020382 - protein, 20 aa, Entamoeba invadens
TQIMYYIRYTEYNKRLDEWT

SEQ ID NO: 3020383 - protein, 18 aa, Entamoeba invadens
TQIPFEDALHPGIVDFFC

SEQ ID NO: 3020384 - protein, 25 aa, Entamoeba invadens
TQIVDTLKLMKFVAPKKIVPTLRDR

SEQ ID NO: 3020385 - protein, 18 aa, Entamoeba invadens
TQIVFNETLKRIKKYAFE

SEQ ID NO: 3020386 - protein, 17 aa, Entamoeba invadens
TQIVLPISLVDIGSSAF

SEQ ID NO: 3020387 - protein, 36 aa, Entamoeba invadens
TQIVRTEGELKGDYITVVVKDFKTLNEMSKDLDGKV

SEQ ID NO: 3020388 - protein, 23 aa, Entamoeba invadens
TQIWILMLSIFGPAQRKRRMGKL

SEQ ID NO: 3020389 - protein, 31 aa, Entamoeba invadens
TQKAFSVLNLRWFNMRLIRAEYFPENKVPVI

SEQ ID NO: 3020390 - protein, 26 aa, Entamoeba invadens
TQKEEKPVRFSITKAPKSSVVIEQSV

SEQ ID NO: 3020391 - protein, 26 aa, Entamoeba invadens
TQKEYVKYLEKRLKAISARYGGKVDD

SEQ ID NO: 3020392 - protein, 27 aa, Entamoeba invadens
TQKHQLRALLYFLQIERRNAILNLFEF

SEQ ID NO: 3020393 - protein, 18 aa, Entamoeba invadens
TQKLCMLLCSYVLPQYGS

SEQ ID NO: 3020394 - protein, 17 aa, Entamoeba invadens
TQKPYVQVYKPQTAYEP

SEQ ID NO: 3020395 - protein, 23 aa, Entamoeba invadens
TQKSRKFFPKMQTQYLYTANDEI

SEQ ID NO: 3020396 - protein, 29 aa, Entamoeba invadens
TQKTLENFALWLFDPLSPCAGDIISFSKK

SEQ ID NO: 3020397 - protein, 33 aa, Entamoeba invadens
TQLEPIRETISVPLIYFMTGGQFQIKSGQEYYV

SEQ ID NO: 3020398 - protein, 23 aa, Entamoeba invadens
TQLFDILIRMNVFPRLVEILDEQ

SEQ ID NO: 3020399 - protein, 35 aa, Entamoeba invadens
TQLFESLKVLSIHSLYFPLFLEKFEQLDINKMKFP

SEQ ID NO: 3020400 - protein, 26 aa, Entamoeba invadens
TQLKPPYHLKDFSAAFYTLCVMEKLK

SEQ ID NO: 3020401 - protein, 27 aa, Entamoeba invadens
TQLKVRSLRILFMQLTELRRLELIDCD

SEQ ID NO: 3020402 - protein, 23 aa, Entamoeba invadens
TQLMTLPLCIYTKKYADEKYLKV

SEQ ID NO: 3020403 - protein, 22 aa, Entamoeba invadens
TQLNLIISLILPVQLSNWSVLS

SEQ ID NO: 3020404 - protein, 20 aa, Entamoeba invadens
TQLNLPNFHFINFTTLKEQY

SEQ ID NO: 3020405 - protein, 27 aa, Entamoeba invadens
TQLPLDILKCILAYLPTGRYQTVCQII

SEQ ID NO: 3020406 - protein, 20 aa, Entamoeba invadens
TQLRKVQRKLKFMNKAQMKA

SEQ ID NO: 3020407 - protein, 62 aa, Entamoeba invadens
TQLSEATVLYNLRLRYMKDIIHTYSGLFCVVINPYQFFPIYTPFMINKYTGRRKEEVAPHVY

SEQ ID NO: 3020408 - protein, 25 aa, Entamoeba invadens
TQLSIYNVLDRLSGGSWKLSNEQKK

SEQ ID NO: 3020409 - protein, 23 aa, Entamoeba invadens
TQLSKFKILREIAVGLAFVQTVA

SEQ ID NO: 3020410 - protein, 21 aa, Entamoeba invadens
TQLSVWGRRSVKDIVFDSEKD

SEQ ID NO: 3020411 - protein, 23 aa, Entamoeba invadens
TQMEYMIDWMYSDSSLKRQITEG

SEQ ID NO: 3020412 - protein, 33 aa, Entamoeba invadens
TQMFYDTVYFKSKTMIVVFADDCAFGYYSESGS

SEQ ID NO: 3020413 - protein, 26 aa, Entamoeba invadens
TQMIISKVYFILNNTIIFVQSASGQP

SEQ ID NO: 3020414 - protein, 25 aa, Entamoeba invadens
TQNEFCYLVNDGFYTTLNINGETIS

SEQ ID NO: 3020415 - protein, 20 aa, Entamoeba invadens
TQNFYFCDTFWHLETLIINR

SEQ ID NO: 3020416 - protein, 29 aa, Entamoeba invadens
TQNHEFRYEILAKRLRELSFLNNGVRIRL

SEQ ID NO: 3020417 - protein, 27 aa, Entamoeba invadens
TQNIEIRQLRTINLKVLQLQKKLDEVN

SEQ ID NO: 3020418 - protein, 26 aa, Entamoeba invadens
TQNIYNFYDPILPSAKRVLFWAQIGN

SEQ ID NO: 3020419 - protein, 23 aa, Entamoeba invadens
TQNLIQKRLSLAPAKPKPMYADD

SEQ ID NO: 3020420 - protein, 24 aa, Entamoeba invadens
TQNPETLLFVLKIIEKQASDRLKD

SEQ ID NO: 3020421 - protein, 25 aa, Entamoeba invadens
TQNRKSILLCFGRMIKKLIDPRSVP

SEQ ID NO: 3020422 - protein, 24 aa, Entamoeba invadens
TQNYELNILLVFSDAFRALSNSVM

SEQ ID NO: 3020423 - protein, 20 aa, Entamoeba invadens
TQNYILPLREVMKNAPIVEG

SEQ ID NO: 3020424 - protein, 27 aa, Entamoeba invadens
TQPDKRLLVLYVIDMIVKLDVTRIYMQ

SEQ ID NO: 3020425 - protein, 18 aa, Entamoeba invadens
TQPFRLKCLNWNEKTYVV

SEQ ID NO: 3020426 - protein, 21 aa, Entamoeba invadens
TQPRGYRRFNNERRPVYNRRR

SEQ ID NO: 3020427 - protein, 24 aa, Entamoeba invadens
TQQEAVPVLFRPAKREIATRDLLA

SEQ ID NO: 3020428 - protein, 26 aa, Entamoeba invadens
TQQEYQDIPQLLLKVSLKLDEVNKIE

SEQ ID NO: 3020429 - protein, 22 aa, Entamoeba invadens
TQQFQQPFQFSFHYAPEIPNDS

SEQ ID NO: 3020430 - protein, 33 aa, Entamoeba invadens
TQQHNAMKFSICFQWMSIPFKRKKTALQMFGES

SEQ ID NO: 3020431 - protein, 21 aa, Entamoeba invadens
TQQIPLLLPGQITNNKKLAVA

SEQ ID NO: 3020432 - protein, 27 aa, Entamoeba invadens
TQQKTKYPRILFRRSDRTRQSEDKIEK

SEQ ID NO: 3020433 - protein, 21 aa, Entamoeba invadens
TQQMKIIFQGLAGLQALKTVP

SEQ ID NO: 3020434 - protein, 19 aa, Entamoeba invadens
TQQMKIIFQGSAGLQALKT

SEQ ID NO: 3020435 - protein, 22 aa, Entamoeba invadens
TQQQLVMVFQLISGNFVFFLEL

SEQ ID NO: 3020436 - protein, 24 aa, Entamoeba invadens
TQQYFLPTQYQLPPYQRYQDNLPP

SEQ ID NO: 3020437 - protein, 24 aa, Entamoeba invadens
TQQYKAALNEKIELEKTIENQNKT

SEQ ID NO: 3020438 - protein, 23 aa, Entamoeba invadens
TQQYLYENVVLSGAANLFAGFEN

SEQ ID NO: 3020439 - protein, 23 aa, Entamoeba invadens
TQRKDSINVLKWCPIEPHQNQEA

SEQ ID NO: 3020440 - protein, 23 aa, Entamoeba invadens
TQRLTTIQERLQKEILLRQQREE

SEQ ID NO: 3020441 - protein, 17 aa, Entamoeba invadens
TQRNIEFSIPMFSDIVG

SEQ ID NO: 3020442 - protein, 29 aa, Entamoeba invadens
TQRPDAVTLLWHPFITSPATPVAQPLIDL

SEQ ID NO: 3020443 - protein, 22 aa, Entamoeba invadens
TQRSLRFGFVTYNTTEEAKKAV

SEQ ID NO: 3020444 - protein, 24 aa, Entamoeba invadens
TQRVGFDQFVKYLSKYSGLKIFVV

SEQ ID NO: 3020445 - protein, 25 aa, Entamoeba invadens
TQSEKTLYLSLLKRDGESLEALTIL

SEQ ID NO: 3020446 - protein, 25 aa, Entamoeba invadens
TQSEQTLRLLFPYQERFDSKNEVAT

SEQ ID NO: 3020447 - protein, 25 aa, Entamoeba invadens
TQSHSINFILFVQGSLQVMREELVK

SEQ ID NO: 3020448 - protein, 25 aa, Entamoeba invadens
TQSQPNFFNTYKPDYALFQQSYAQQ

SEQ ID NO: 3020449 - protein, 20 aa, Entamoeba invadens
TQSRLVCRCSRELEKSLMGS

SEQ ID NO: 3020450 - protein, 30 aa, Entamoeba invadens
TQSYEYIEDILPPFFKALVKYVNQGKYSWH

SEQ ID NO: 3020451 - protein, 26 aa, Entamoeba invadens
TQTEIFLYLQEVLNIATAFLADMTEY

SEQ ID NO: 3020452 - protein, 22 aa, Entamoeba invadens
TQTHKILVVSKFNILEFYQINT

SEQ ID NO: 3020453 - protein, 27 aa, Entamoeba invadens
TQTPSTPGQILFLKHLQSELDCLKIRN

SEQ ID NO: 3020454 - protein, 26 aa, Entamoeba invadens
TQTQNSIQRIILPKISLLLQELEKIN

SEQ ID NO: 3020455 - protein, 26 aa, Entamoeba invadens
TQTTCSLCQVGYYWDGFSCMNNKGFV

SEQ ID NO: 3020456 - protein, 22 aa, Entamoeba invadens
TQTTYKYVFKKISIYKNLQIVS

SEQ ID NO: 3020457 - protein, 20 aa, Entamoeba invadens
TQVDNAFYALSLSSQCPSQF

SEQ ID NO: 3020458 - protein, 28 aa, Entamoeba invadens
TQVGKIFLQLIPYLKMYSEYCKCNTAVS

SEQ ID NO: 3020459 - protein, 29 aa, Entamoeba invadens
TQVQVISYFIFLPLLYHPDSSPLLQLVSK

SEQ ID NO: 3020460 - protein, 26 aa, Entamoeba invadens
TQVVAYSCWLLLEVLFDFISELTDLN

SEQ ID NO: 3020461 - protein, 19 aa, Entamoeba invadens
TQYDLLIQQLYSILKKQKV

SEQ ID NO: 3020462 - protein, 17 aa, Entamoeba invadens
TQYFLGTLNHQVALLSY

SEQ ID NO: 3020463 - protein, 17 aa, Entamoeba invadens
TQYLIFDSKRMIGRKLS

SEQ ID NO: 3020464 - protein, 17 aa, Entamoeba invadens
TQYTINIQPPEQFQIVS

SEQ ID NO: 3020465 - protein, 23 aa, Entamoeba invadens
TQYTNFINFFVKNLSFEDKNGRL

SEQ ID NO: 3020466 - protein, 26 aa, Entamoeba invadens
TRAEDKYKFFLQATQLENIRDQYTLA

SEQ ID NO: 3020467 - protein, 28 aa, Entamoeba invadens
TRAFPPNHPVLPEDYKMIGQPAIIGGSM

SEQ ID NO: 3020468 - protein, 23 aa, Entamoeba invadens
TRAKYGLVIIGDAYTLMINPIFK

SEQ ID NO: 3020469 - protein, 29 aa, Entamoeba invadens
TRAVLNKSTLLPFLVNKMATLGTAACPPY

SEQ ID NO: 3020470 - protein, 19 aa, Entamoeba invadens
TRAVLVLQALLKAKGDKLR

SEQ ID NO: 3020471 - protein, 25 aa, Entamoeba invadens
TRCPDSPFYLPVEPINFKAVALPEK

SEQ ID NO: 3020472 - protein, 25 aa, Entamoeba invadens
TRDDFTFIIPQLSVLFKYNYYYEEI

SEQ ID NO: 3020473 - protein, 25 aa, Entamoeba invadens
TRDEDVCFYCHKKGHWTRDCPEKRG

SEQ ID NO: 3020474 - protein, 23 aa, Entamoeba invadens
TRDETPIYLGKCFRRSKVDGSEI

SEQ ID NO: 3020475 - protein, 21 aa, Entamoeba invadens
TRDLNMEGVPLCLVEILKYIE

SEQ ID NO: 3020476 - protein, 25 aa, Entamoeba invadens
TRDPSSPIPLLKLSNIFSLTTDLEE

SEQ ID NO: 3020477 - protein, 27 aa, Entamoeba invadens
TRDQMRRILLNLTTLNKPWHCPHGRQT

SEQ ID NO: 3020478 - protein, 24 aa, Entamoeba invadens
TREDYLILKVMRTAMEQQLSLMVP

SEQ ID NO: 3020479 - protein, 20 aa, Entamoeba invadens
TREDYLILKVVRTAIEQQLS

SEQ ID NO: 3020480 - protein, 18 aa, Entamoeba invadens
TREELVDVFLPSLSILNE

SEQ ID NO: 3020481 - protein, 32 aa, Entamoeba invadens
TREEWVLNMTTLNKFKYLLSIDEYIGVLQHFK

SEQ ID NO: 3020482 - protein, 25 aa, Entamoeba invadens
TREHLELFVLPFRPTYLVKSEEESL

SEQ ID NO: 3020483 - protein, 25 aa, Entamoeba invadens
TREHLELFVLPPRPTNLVKPEEKSL

SEQ ID NO: 3020484 - protein, 24 aa, Entamoeba invadens
TREHLELFVLPPRPTYLVKSEEES

SEQ ID NO: 3020485 - protein, 25 aa, Entamoeba invadens
TREQFLKALPFPKCVFQTLGTCDKD

SEQ ID NO: 3020486 - protein, 17 aa, Entamoeba invadens
TRFHFNPISLTTSTRRF

SEQ ID NO: 3020487 - protein, 30 aa, Entamoeba invadens
TRFLSLECVFRWVYNNYDNITIFLKCSIHD

SEQ ID NO: 3020488 - protein, 29 aa, Entamoeba invadens
TRFLSLECVFRWVYNNYDNITIFLKCSIN

SEQ ID NO: 3020489 - protein, 19 aa, Entamoeba invadens
TRFVLRNLDQVFVDLGTPG

SEQ ID NO: 3020490 - protein, 26 aa, Entamoeba invadens
TRGDLFIKFTVIFPKIEEIQKNLEEL

SEQ ID NO: 3020491 - protein, 25 aa, Entamoeba invadens
TRGDLLFWNVDYQEKMNMVKVFNVD

SEQ ID NO: 3020492 - protein, 30 aa, Entamoeba invadens
TRGTAACGMYFLFGLLLSAGFKQVGTIPQS

SEQ ID NO: 3020493 - protein, 33 aa, Entamoeba invadens
TRGTLYTNLGGAFIKFIPFLKSYTQFASNQDNC

SEQ ID NO: 3020494 - protein, 24 aa, Entamoeba invadens
TRGVLSLDLLTYLDTKKATEKVQF

SEQ ID NO: 3020495 - protein, 27 aa, Entamoeba invadens
TRHHNFPQIYLFFPQMQTFYVETTLQY

SEQ ID NO: 3020496 - protein, 18 aa, Entamoeba invadens
TRHLFQDAVVFRFIAFRN

SEQ ID NO: 3020497 - protein, 19 aa, Entamoeba invadens
TRHRFMSHTAHFFKKSISY

SEQ ID NO: 3020498 - protein, 28 aa, Entamoeba invadens
TRHTNCLFFIAIQIWRGIPAQIKSILSS

SEQ ID NO: 3020499 - protein, 20 aa, Entamoeba invadens
TRITAWICGFHYVIQAEKMR

SEQ ID NO: 3020500 - protein, 26 aa, Entamoeba invadens
TRKCLVCLDGFYLDATNHTCEPCNSI

SEQ ID NO: 3020501 - protein, 21 aa, Entamoeba invadens
TRKFFKAPVLEDLVGAYDFWP

SEQ ID NO: 3020502 - protein, 18 aa, Entamoeba invadens
TRKFLVSNNYFYAKDSEK

SEQ ID NO: 3020503 - protein, 17 aa, Entamoeba invadens
TRKIILNQHFVASIIDE

SEQ ID NO: 3020504 - protein, 28 aa, Entamoeba invadens
TRKNTYFYVKTFALFDDHIPKNVIIESP

SEQ ID NO: 3020505 - protein, 23 aa, Entamoeba invadens
TRKPPYIMVCMKSDLPDPEEDQE

SEQ ID NO: 3020506 - protein, 26 aa, Entamoeba invadens
TRKQFTHFLYFMMRTIFTKYAETVFS

SEQ ID NO: 3020507 - protein, 22 aa, Entamoeba invadens
TRKRHKFMFKTSKYKHIQCQNY

SEQ ID NO: 3020508 - protein, 26 aa, Entamoeba invadens
TRKTDLVRRIFYNGGFLFSKKQINTI

SEQ ID NO: 3020509 - protein, 27 aa, Entamoeba invadens
TRKTVPVSLFVGLYNYVDSHTAFLDET

SEQ ID NO: 3020510 - protein, 26 aa, Entamoeba invadens
TRLDNTIFIDILRQTKPQMYTKYLIS

SEQ ID NO: 3020511 - protein, 18 aa, Entamoeba invadens
TRLFFADCKYLKLLDGMS

SEQ ID NO: 3020512 - protein, 36 aa, Entamoeba invadens
TRLGYPNRIIYNEFLKRYFFLGTNINKKSSGAMPVV

SEQ ID NO: 3020513 - protein, 24 aa, Entamoeba invadens
TRLLKKLLMILTPCSMVLNSLATK

SEQ ID NO: 3020514 - protein, 28 aa, Entamoeba invadens
TRLVISQMVFTNFKSYYGRTELGPFHHS

SEQ ID NO: 3020515 - protein, 17 aa, Entamoeba invadens
TRLYLKKGKGESRICKV

SEQ ID NO: 3020516 - protein, 29 aa, Entamoeba invadens
TRMEEIVEKKPLELIKDDAKIIAKEEAKD

SEQ ID NO: 3020517 - protein, 22 aa, Entamoeba invadens
TRMNHIYGEDLFRSGSALITLN

SEQ ID NO: 3020518 - protein, 33 aa, Entamoeba invadens
TRNECLKCNINYYLKLGKCYPCNSFDPNCVECN

SEQ ID NO: 3020519 - protein, 21 aa, Entamoeba invadens
TRNFIDHPVIVIGGSYSGNLA

SEQ ID NO: 3020520 - protein, 27 aa, Entamoeba invadens
TRNGKIEDILNFVITPLRPNCDEQIEF

SEQ ID NO: 3020521 - protein, 38 aa, Entamoeba invadens
TRNHLTTFESIFLITCVKFSPKFPLLAVGYEGKIEIWR

SEQ ID NO: 3020522 - protein, 21 aa, Entamoeba invadens
TRNKIILRYAQGFSNDIFDEA

SEQ ID NO: 3020523 - protein, 19 aa, Entamoeba invadens
TRNNSIVPVAKLIDNETEI

SEQ ID NO: 3020524 - protein, 28 aa, Entamoeba invadens
TRNVISWQYICKVIFYCLSYIHKDNIFF

SEQ ID NO: 3020525 - protein, 26 aa, Entamoeba invadens
TRNVRRFYYRLLDEGKPFGVTDDMAE

SEQ ID NO: 3020526 - protein, 24 aa, Entamoeba invadens
TRPEFDLVALNDPFMDPKYMEYML

SEQ ID NO: 3020527 - protein, 21 aa, Entamoeba invadens
TRPIPLNYLYHNKKVNIYITG

SEQ ID NO: 3020528 - protein, 27 aa, Entamoeba invadens
TRPTRRVMLEVARKRWDYLQRMNMLPS

SEQ ID NO: 3020529 - protein, 23 aa, Entamoeba invadens
TRQNPWLVKILMTLRAVYDAMPP

SEQ ID NO: 3020530 - protein, 34 aa, Entamoeba invadens
TRQYEDFFGFKFFNPPQTQFFFKCFHTDSNIIVG

SEQ ID NO: 3020531 - protein, 27 aa, Entamoeba invadens
TRRKTVLACILILLKSVLKTNFFCLSK

SEQ ID NO: 3020532 - protein, 26 aa, Entamoeba invadens
TRRLNTFQVFMFGKPVWVAENLVENP

SEQ ID NO: 3020533 - protein, 26 aa, Entamoeba invadens
TRRLYSLLKHKIGLKEFPGLPQELIQ

SEQ ID NO: 3020534 - protein, 24 aa, Entamoeba invadens
TRRMFAWREWLYPRRHLYDRVFIS

SEQ ID NO: 3020535 - protein, 23 aa, Entamoeba invadens
TRSCEAFYEMFAKSYLKCFHDQL

SEQ ID NO: 3020536 - protein, 26 aa, Entamoeba invadens
TRSHRKILQMLPIKEFSRTPIGAIDD

SEQ ID NO: 3020537 - protein, 17 aa, Entamoeba invadens
TRSKLIFFENLETLILW

SEQ ID NO: 3020538 - protein, 18 aa, Entamoeba invadens
TRSKLIFFENLETLILWP

SEQ ID NO: 3020539 - protein, 22 aa, Entamoeba invadens
TRSTKYTVKLKKIAKITGNNIT

SEQ ID NO: 3020540 - protein, 43 aa, Entamoeba invadens
TRTGIPKIRAFFLFQTPKMLSLLQRELEMRGTWGLPLLNASGM

SEQ ID NO: 3020541 - protein, 26 aa, Entamoeba invadens
TRVDTLLFVYLENIGYIYKTFGYFFK

SEQ ID NO: 3020542 - protein, 30 aa, Entamoeba invadens
TRVEIYSFMMFLCKLLFQKIPPSLQEMSAL

SEQ ID NO: 3020543 - protein, 21 aa, Entamoeba invadens
TRVFYRHRKCDKYNIAGLLKL

SEQ ID NO: 3020544 - protein, 20 aa, Entamoeba invadens
TRVKLYFPSIQTIRLPCFSL

SEQ ID NO: 3020545 - protein, 26 aa, Entamoeba invadens
TRVLKIDFSCIKTFKILSYIEVKFDN

SEQ ID NO: 3020546 - protein, 25 aa, Entamoeba invadens
TRVPYPSIKGWWCSTHRFHLVGESC

SEQ ID NO: 3020547 - protein, 19 aa, Entamoeba invadens
TRVVLPDNLIPIKTQAFCD

SEQ ID NO: 3020548 - protein, 22 aa, Entamoeba invadens
TRVVLPFNLKTIKAYAFYNCKS

SEQ ID NO: 3020549 - protein, 19 aa, Entamoeba invadens
TRVYLFNDMIMICIKNKNK

SEQ ID NO: 3020550 - protein, 18 aa, Entamoeba invadens
TRYALSAQWYNVTFKRAI

SEQ ID NO: 3020551 - protein, 20 aa, Entamoeba invadens
TRYFFGICPTLRAPSALQPT

SEQ ID NO: 3020552 - protein, 32 aa, Entamoeba invadens
TRYMQQKRIMMMWYLEPLFVLQDNNLDIVFVN

SEQ ID NO: 3020553 - protein, 21 aa, Entamoeba invadens
TRYRRFCTRRLKRLRQKVGLV

SEQ ID NO: 3020554 - protein, 24 aa, Entamoeba invadens
TSAAEFCCFKLYNEVIRCKEFPVD

SEQ ID NO: 3020555 - protein, 25 aa, Entamoeba invadens
TSAALTFKFVGILLKDEKTLDNYTV

SEQ ID NO: 3020556 - protein, 21 aa, Entamoeba invadens
TSAEYFIRVAFKLEKQRMFNS

SEQ ID NO: 3020557 - protein, 29 aa, Entamoeba invadens
TSAKDIRNQRWLLRKVLNIDLREKMEKEI

SEQ ID NO: 3020558 - protein, 23 aa, Entamoeba invadens
TSAPNFGLLLRFTHNTKTTQVIK

SEQ ID NO: 3020559 - protein, 32 aa, Entamoeba invadens
TSAQIDVFKHCWLPFSLLLASIKQVGADQNFW

SEQ ID NO: 3020560 - protein, 27 aa, Entamoeba invadens
TSCAKKAVWWVIFIGKIDIPDVVVNIN

SEQ ID NO: 3020561 - protein, 24 aa, Entamoeba invadens
TSCCPAWIELLEKDYPDLIPKTST

SEQ ID NO: 3020562 - protein, 22 aa, Entamoeba invadens
TSCFLNCQNLRQIILPDGLKEV

SEQ ID NO: 3020563 - protein, 29 aa, Entamoeba invadens
TSCGCYITSSSFWFLDKFDIDKDSKCIYC

SEQ ID NO: 3020564 - protein, 26 aa, Entamoeba invadens
TSCISCNSKFFLNNKTCEKCMENCDV

SEQ ID NO: 3020565 - protein, 29 aa, Entamoeba invadens
TSCLMFAHNELFSYNLPVPLHSLVKSEEL

SEQ ID NO: 3020566 - protein, 27 aa, Entamoeba invadens
TSCLTTPLRVAVLFYIQNSLLMNWDPQ

SEQ ID NO: 3020567 - protein, 25 aa, Entamoeba invadens
TSCSIDMSLLFYTKNRLCNYTKNLL

SEQ ID NO: 3020568 - protein, 28 aa, Entamoeba invadens
TSCSYLRNALTPFLNSRAAFMEDSKLAN

SEQ ID NO: 3020569 - protein, 18 aa, Entamoeba invadens
TSCTNLTKVVLPKTLKEI

SEQ ID NO: 3020570 - protein, 22 aa, Entamoeba invadens
TSCYLFCFETANVLYNVGVAHM

SEQ ID NO: 3020571 - protein, 18 aa, Entamoeba invadens
TSDANHFTFVATDTDIKL

SEQ ID NO: 3020572 - protein, 25 aa, Entamoeba invadens
TSDEFPKWMEEFPIFIHISEEENHM

SEQ ID NO: 3020573 - protein, 17 aa, Entamoeba invadens
TSDEINIKHRVKMMLDG

SEQ ID NO: 3020574 - protein, 27 aa, Entamoeba invadens
TSDHFTMCQDGYFIDTIDYKCNSCKMI

SEQ ID NO: 3020575 - protein, 25 aa, Entamoeba invadens
TSDLHGVIVPILFNAEDYESHLVKK

SEQ ID NO: 3020576 - protein, 22 aa, Entamoeba invadens
TSDYFDMLMEYGDKILKMGKAY

SEQ ID NO: 3020577 - protein, 25 aa, Entamoeba invadens
TSEAPVFGFWSPAVGKYAPFVCLEP

SEQ ID NO: 3020578 - protein, 32 aa, Entamoeba invadens
TSEEIRVKLYEAAAPFLIRRVNSYVQVYGMLA

SEQ ID NO: 3020579 - protein, 29 aa, Entamoeba invadens
TSEETVSFIQWLYSLGVCMITLHGRKHGQ

SEQ ID NO: 3020580 - protein, 25 aa, Entamoeba invadens
TSEGGRFYVWKLNEFLKTNTGIKRR

SEQ ID NO: 3020581 - protein, 23 aa, Entamoeba invadens
TSEGLVFGWVKKGKSFELVFTVY

SEQ ID NO: 3020582 - protein, 23 aa, Entamoeba invadens
TSEHTLFLFNEKKEFLGKRNFVQ

SEQ ID NO: 3020583 - protein, 17 aa, Entamoeba invadens
TSEKRQLYSLLEETQKK

SEQ ID NO: 3020584 - protein, 20 aa, Entamoeba invadens
TSELLVLFESIQFCQKTNRD

SEQ ID NO: 3020585 - protein, 32 aa, Entamoeba invadens
TSESFSRMPAKLSLTSFAIRKSSTKMRIIGAM

SEQ ID NO: 3020586 - protein, 22 aa, Entamoeba invadens
TSEVETQIWLLYDDIRKMEDSN

SEQ ID NO: 3020587 - protein, 25 aa, Entamoeba invadens
TSEYNLLFKMIDMLGMPPVSMLDKG

SEQ ID NO: 3020588 - protein, 24 aa, Entamoeba invadens
TSFDVSYVTILHELQKTFQWKRVY

SEQ ID NO: 3020589 - protein, 21 aa, Entamoeba invadens
TSFEFPKFVNHIGRSCFEGCS

SEQ ID NO: 3020590 - protein, 33 aa, Entamoeba invadens
TSFEGYPLQYYYFHYLSWPYIMYVAEDDKKSIV

SEQ ID NO: 3020591 - protein, 19 aa, Entamoeba invadens
TSFELVKHPWLSTAQVRLD

SEQ ID NO: 3020592 - protein, 19 aa, Entamoeba invadens
TSFIQRYFGDYTGTEKVVG

SEQ ID NO: 3020593 - protein, 21 aa, Entamoeba invadens
TSFMYPCCIIEFNNQKFSSSP

SEQ ID NO: 3020594 - protein, 37 aa, Entamoeba invadens
TSFNEKINLFFMDTFMVPFYLHDSLWRGQQLSHLGKA

SEQ ID NO: 3020595 - protein, 19 aa, Entamoeba invadens
TSFNLGELGFFNKETQKRG

SEQ ID NO: 3020596 - protein, 18 aa, Entamoeba invadens
TSFSRVGSLKKISRLILP

SEQ ID NO: 3020597 - protein, 23 aa, Entamoeba invadens
TSFVQIRGNIPLLWKTNEEDTFA

SEQ ID NO: 3020598 - protein, 29 aa, Entamoeba invadens
TSGCARCGFGFYYNLITQRCETCDSNCET

SEQ ID NO: 3020599 - protein, 25 aa, Entamoeba invadens
TSGKDFLRRRACLMMYPMCKEYPDA

SEQ ID NO: 3020600 - protein, 24 aa, Entamoeba invadens
TSGLLCDLVWSDPLLTPDIAPNLP

SEQ ID NO: 3020601 - protein, 22 aa, Entamoeba invadens
TSGSINGKYKFNDKFSVNGNAQ

SEQ ID NO: 3020602 - protein, 24 aa, Entamoeba invadens
TSGVPIVSVDWVEASLKSGNCEDY

SEQ ID NO: 3020603 - protein, 19 aa, Entamoeba invadens
TSGYFLINPLSTSSNKDKQ

SEQ ID NO: 3020604 - protein, 25 aa, Entamoeba invadens
TSHLLQPLDVGIFCYCKNEMRRSFE

SEQ ID NO: 3020605 - protein, 19 aa, Entamoeba invadens
TSHLVFYPKDKKAIYVSTY

SEQ ID NO: 3020606 - protein, 22 aa, Entamoeba invadens
TSHLVLPTNIDALDIDTAILKL

SEQ ID NO: 3020607 - protein, 17 aa, Entamoeba invadens
TSHLYILQYVVQSDTIT

SEQ ID NO: 3020608 - protein, 21 aa, Entamoeba invadens
TSHMLSWLITSLEQQGITTDY

SEQ ID NO: 3020609 - protein, 18 aa, Entamoeba invadens
TSHNFFLVGQKNKWESPS

SEQ ID NO: 3020610 - protein, 18 aa, Entamoeba invadens
TSIACELVYGRGLDWKIS

SEQ ID NO: 3020611 - protein, 24 aa, Entamoeba invadens
TSIANLMYFIYPDKPKVTSKSQIL

SEQ ID NO: 3020612 - protein, 17 aa, Entamoeba invadens
TSIENYSFFKCLSLTKI

SEQ ID NO: 3020613 - protein, 22 aa, Entamoeba invadens
TSIERLQFSYPVTYNKFIEEKK

SEQ ID NO: 3020614 - protein, 18 aa, Entamoeba invadens
TSIFVVLGNTLNVFDRRR

SEQ ID NO: 3020615 - protein, 40 aa, Entamoeba invadens
TSIGDDFIFYKTRFDFFLTWLFCRLYFINFCVTENGLSAF

SEQ ID NO: 3020616 - protein, 20 aa, Entamoeba invadens
TSIGFFNLPTKCTVRQVRSE

SEQ ID NO: 3020617 - protein, 23 aa, Entamoeba invadens
TSIGSLCFYTFKTFYQKLIGAFQ

SEQ ID NO: 3020618 - protein, 25 aa, Entamoeba invadens
TSIILRYSLGVFKNYYLPTVLETTC

SEQ ID NO: 3020619 - protein, 22 aa, Entamoeba invadens
TSIINFIFTAIEKLDYFITNVS

SEQ ID NO: 3020620 - protein, 17 aa, Entamoeba invadens
TSIIYCHLIAPNIYLEP

SEQ ID NO: 3020621 - protein, 17 aa, Entamoeba invadens
TSILMYIESIKDAKRFV

SEQ ID NO: 3020622 - protein, 18 aa, Entamoeba invadens
TSILSTRLISIKRPTFSG

SEQ ID NO: 3020623 - protein, 22 aa, Entamoeba invadens
TSILSYFQKKLFEREIQIVLND

SEQ ID NO: 3020624 - protein, 22 aa, Entamoeba invadens
TSILTNPFISILNDAIFDDNFT

SEQ ID NO: 3020625 - protein, 22 aa, Entamoeba invadens
TSILYQLQSFVYDLLYTQLDVD

SEQ ID NO: 3020626 - protein, 18 aa, Entamoeba invadens
TSIMQRYCDLDFSSDYIS

SEQ ID NO: 3020627 - protein, 19 aa, Entamoeba invadens
TSINPFLSIQFVKSASALK

SEQ ID NO: 3020628 - protein, 17 aa, Entamoeba invadens
TSIVRRLVKYDFTPDNT

SEQ ID NO: 3020629 - protein, 25 aa, Entamoeba invadens
TSIYGQIPLLVYSKGIEPFQPDYSK

SEQ ID NO: 3020630 - protein, 17 aa, Entamoeba invadens
TSKDMKGYLKLKNYIKT

SEQ ID NO: 3020631 - protein, 19 aa, Entamoeba invadens
TSKERIVFLLIFKSEKQVD

SEQ ID NO: 3020632 - protein, 34 aa, Entamoeba invadens
TSKGNSELFLLDKYLVIYKIVSDLIISIITDATE

SEQ ID NO: 3020633 - protein, 18 aa, Entamoeba invadens
TSKKPKFNVLLTTFELVI

SEQ ID NO: 3020634 - protein, 24 aa, Entamoeba invadens
TSKMNRCVVLGNAFRPFPIKETVS

SEQ ID NO: 3020635 - protein, 22 aa, Entamoeba invadens
TSKNFAMILGPLVSHPKGGVNA

SEQ ID NO: 3020636 - protein, 31 aa, Entamoeba invadens
TSKNGEEYFRFLWELRLLFNKEMTQLQDLQM

SEQ ID NO: 3020637 - protein, 17 aa, Entamoeba invadens
TSKQHLFFQNYQYQQNK

SEQ ID NO: 3020638 - protein, 24 aa, Entamoeba invadens
TSKQRFFVLCDYLFNKYETMEKLR

SEQ ID NO: 3020639 - protein, 26 aa, Entamoeba invadens
TSKTFFQVIIWYSVSCYTALTYSSFR

SEQ ID NO: 3020640 - protein, 17 aa, Entamoeba invadens
TSKTLSLFPNLSTLNVW

SEQ ID NO: 3020641 - protein, 25 aa, Entamoeba invadens
TSKTPIKLVYTPIAPEKWILDGKEP

SEQ ID NO: 3020642 - protein, 32 aa, Entamoeba invadens
TSKTPRYLFRRVYKFIPINQRKRYWEIELKVE

SEQ ID NO: 3020643 - protein, 32 aa, Entamoeba invadens
TSKTSLKLSCLHLAILFDAFDFFEDLKDQKEE

SEQ ID NO: 3020644 - protein, 22 aa, Entamoeba invadens
TSKYLFLVMELMEGGELFDYIA

SEQ ID NO: 3020645 - protein, 23 aa, Entamoeba invadens
TSLADIVLAFKHCGYVGVPVGKN

SEQ ID NO: 3020646 - protein, 28 aa, Entamoeba invadens
TSLFDRLLQCPWINRTLLNIEKEITPFA

SEQ ID NO: 3020647 - protein, 27 aa, Entamoeba invadens
TSLFETEWFPPRVRYIHIFKKEIPTFA

SEQ ID NO: 3020648 - protein, 17 aa, Entamoeba invadens
TSLGDNCFIHNSSNLWF

SEQ ID NO: 3020649 - protein, 22 aa, Entamoeba invadens
TSLGDNCFIHNSSNLWFNANDN

SEQ ID NO: 3020650 - protein, 23 aa, Entamoeba invadens
TSLHFSELIASKLLIDCSALPES

SEQ ID NO: 3020651 - protein, 20 aa, Entamoeba invadens
TSLHRKFQRKKVVEVDEDSA

SEQ ID NO: 3020652 - protein, 18 aa, Entamoeba invadens
TSLILDFLVRYAKTKDIA

SEQ ID NO: 3020653 - protein, 26 aa, Entamoeba invadens
TSLINKLYVIPFLKPQNIKLEFGELK

SEQ ID NO: 3020654 - protein, 21 aa, Entamoeba invadens
TSLKILEFINFIFEKAKSQND

SEQ ID NO: 3020655 - protein, 21 aa, Entamoeba invadens
TSLLHHISVLIKRMFVSIKEA

SEQ ID NO: 3020656 - protein, 32 aa, Entamoeba invadens
TSLLHPFVWHHVLVPILPLQLSSYPTAPMPYL

SEQ ID NO: 3020657 - protein, 20 aa, Entamoeba invadens
TSLLVLNKFYDPKKLIVEMY

SEQ ID NO: 3020658 - protein, 26 aa, Entamoeba invadens
TSLNFLQRRIKLLDLFCCVGGDSIQH

SEQ ID NO: 3020659 - protein, 17 aa, Entamoeba invadens
TSLNYKVMIAACDTFRA

SEQ ID NO: 3020660 - protein, 17 aa, Entamoeba invadens
TSLPYAQRAVLEKVFLM

SEQ ID NO: 3020661 - protein, 30 aa, Entamoeba invadens
TSLQHEYPDIHWHFIGRLQSNKVHLLVSTP

SEQ ID NO: 3020662 - protein, 23 aa, Entamoeba invadens
TSLSKMACWLTSLNYKVMIAACD

SEQ ID NO: 3020663 - protein, 21 aa, Entamoeba invadens
TSLSLLFIMSSIPGTFFQTKG

SEQ ID NO: 3020664 - protein, 21 aa, Entamoeba invadens
TSLSLLQSLALLTKQEKVVPV

SEQ ID NO: 3020665 - protein, 20 aa, Entamoeba invadens
TSLSPIWNDAFVLNNVTPES

SEQ ID NO: 3020666 - protein, 23 aa, Entamoeba invadens
TSLSVFAPLKALCNELVFQNTEL

SEQ ID NO: 3020667 - protein, 25 aa, Entamoeba invadens
TSLSVPLRYYGFTQIQGHHRLLATA

SEQ ID NO: 3020668 - protein, 31 aa, Entamoeba invadens
TSLTFFHHKKQIYIFTPAGKPVFCRYGNVLL

SEQ ID NO: 3020669 - protein, 25 aa, Entamoeba invadens
TSLTKLFQFSLFANRIRTFPNGFCY

SEQ ID NO: 3020670 - protein, 22 aa, Entamoeba invadens
TSLYASMFGAAVMRKLRAFTTV

SEQ ID NO: 3020671 - protein, 25 aa, Entamoeba invadens
TSNAKIYPHNAAFKTFPKLPEVFSS

SEQ ID NO: 3020672 - protein, 29 aa, Entamoeba invadens
TSNDGTAKIWFLASSRLRHSLTGHNGKVT

SEQ ID NO: 3020673 - protein, 31 aa, Entamoeba invadens
TSNEDLIFQPVLGNILWYSTGKLMEFLEDGL

SEQ ID NO: 3020674 - protein, 23 aa, Entamoeba invadens
TSNFEIVYYLEPATNLLTIVLQP

SEQ ID NO: 3020675 - protein, 17 aa, Entamoeba invadens
TSNFVFPTSITKIGVHN

SEQ ID NO: 3020676 - protein, 26 aa, Entamoeba invadens
TSNHPLWKMWDYVIELAIPKLVNSTK

SEQ ID NO: 3020677 - protein, 20 aa, Entamoeba invadens
TSNIDLCIYIGKTLPPELQD

SEQ ID NO: 3020678 - protein, 31 aa, Entamoeba invadens
TSNKIDDEFLMFLFYYTQGTPLQAQAAERLR

SEQ ID NO: 3020679 - protein, 27 aa, Entamoeba invadens
TSNLLGLKVLILLSPQIEHLVCPSSLV

SEQ ID NO: 3020680 - protein, 22 aa, Entamoeba invadens
TSNLYQMFDLPLQTLISTNMGK

SEQ ID NO: 3020681 - protein, 22 aa, Entamoeba invadens
TSNMIMSRKLDGLKFDLSVLDE

SEQ ID NO: 3020682 - protein, 26 aa, Entamoeba invadens
TSNMRCVLLDWLFEVISFHFECTIET

SEQ ID NO: 3020683 - protein, 17 aa, Entamoeba invadens
TSNNIVCLCGQKFCFKC

SEQ ID NO: 3020684 - protein, 25 aa, Entamoeba invadens
TSNNQLLYDLFPWSAEQEAAKTGQK

SEQ ID NO: 3020685 - protein, 23 aa, Entamoeba invadens
TSNRYFYGNIIPTNIRSLGDECY

SEQ ID NO: 3020686 - protein, 26 aa, Entamoeba invadens
TSNSRFVGDLFNIFTHPFISSEEETQ

SEQ ID NO: 3020687 - protein, 23 aa, Entamoeba invadens
TSNTPLIPFCVDEFCEALNGDCL

SEQ ID NO: 3020688 - protein, 21 aa, Entamoeba invadens
TSNVKVFVLFDSKVQKLDVPA

SEQ ID NO: 3020689 - protein, 30 aa, Entamoeba invadens
TSNVLYDPKRLFGLVLDYIPKDEKKSFTFD

SEQ ID NO: 3020690 - protein, 27 aa, Entamoeba invadens
TSPAYPQSLPCYFQAPTLAMPNRLETP

SEQ ID NO: 3020691 - protein, 24 aa, Entamoeba invadens
TSPFFVGKFRIKFFQTFFLEKYFY

SEQ ID NO: 3020692 - protein, 22 aa, Entamoeba invadens
TSPILTIPLKRTVVSLLTSMGD

SEQ ID NO: 3020693 - protein, 17 aa, Entamoeba invadens
TSPLGCVYVNQKPVRKG

SEQ ID NO: 3020694 - protein, 21 aa, Entamoeba invadens
TSPLILMMRPEELELVICGTK

SEQ ID NO: 3020695 - protein, 34 aa, Entamoeba invadens
TSPNFIPTVVIALVFYYLYPEESVEFRLGAVFSF

SEQ ID NO: 3020696 - protein, 23 aa, Entamoeba invadens
TSPPQIRYSFYFSYILQVLRETQ

SEQ ID NO: 3020697 - protein, 25 aa, Entamoeba invadens
TSPQVIFKSWYKRIGINATLSSLTQ

SEQ ID NO: 3020698 - protein, 22 aa, Entamoeba invadens
TSQEWMTFTQHLPVCTKNVTLC

SEQ ID NO: 3020699 - protein, 17 aa, Entamoeba invadens
TSQMIIQFVFQALQNVQ

SEQ ID NO: 3020700 - protein, 22 aa, Entamoeba invadens
TSQSPLFFDKVSSNLSYTLRPD

SEQ ID NO: 3020701 - protein, 21 aa, Entamoeba invadens
TSQTFQYFIQTYPKRFHHVFE

SEQ ID NO: 3020702 - protein, 19 aa, Entamoeba invadens
TSRMKYLKLLGTTTIFLSP

SEQ ID NO: 3020703 - protein, 28 aa, Entamoeba invadens
TSRWNVRILYDLLDIAALNAYKLYRHHH

SEQ ID NO: 3020704 - protein, 21 aa, Entamoeba invadens
TSRYQIYVKKPFDIVMKAYEN

SEQ ID NO: 3020705 - protein, 21 aa, Entamoeba invadens
TSSFFKIFSEFVRDLSAVLDS

SEQ ID NO: 3020706 - protein, 25 aa, Entamoeba invadens
TSSFILERFIVAYEYLFKDIGTITN

SEQ ID NO: 3020707 - protein, 24 aa, Entamoeba invadens
TSSFVDLILVLFVKWERSPDDWIM

SEQ ID NO: 3020708 - protein, 30 aa, Entamoeba invadens
TSSINYRPLPTFFVDLLVIDKNSGALVFQQ

SEQ ID NO: 3020709 - protein, 22 aa, Entamoeba invadens
TSSQLQFTFVPAFSIEGCGNYM

SEQ ID NO: 3020710 - protein, 28 aa, Entamoeba invadens
TSSQPFSQSIRPSLLMARSQLEQRQKEK

SEQ ID NO: 3020711 - protein, 26 aa, Entamoeba invadens
TSSQSAFIFSLLRNGKLNPKKFRIRD

SEQ ID NO: 3020712 - protein, 30 aa, Entamoeba invadens
TSSSFITQEFLFPILLSLVAQQPSAFVDYL

SEQ ID NO: 3020713 - protein, 33 aa, Entamoeba invadens
TSSWNWCSMIEKYIYYPLFMLCDFEGFDGPYKM

SEQ ID NO: 3020714 - protein, 23 aa, Entamoeba invadens
TSTDKILALLETPGEELPITNDE

SEQ ID NO: 3020715 - protein, 22 aa, Entamoeba invadens
TSTFAYFHALKTRNKQIKLSFD

SEQ ID NO: 3020716 - protein, 31 aa, Entamoeba invadens
TSTFEKRWRAYKYHFFLPFNTAKDLCYESCI

SEQ ID NO: 3020717 - protein, 19 aa, Entamoeba invadens
TSTIFFYSGYGTLSSVLGY

SEQ ID NO: 3020718 - protein, 22 aa, Entamoeba invadens
TSTIPLLTFIEVEASRVDVYGL

SEQ ID NO: 3020719 - protein, 30 aa, Entamoeba invadens
TSTKKKSGWRFPIPLYRSIEYIKKKEGLKE

SEQ ID NO: 3020720 - protein, 20 aa, Entamoeba invadens
TSTLFIAVHMKTIKVDYCER

SEQ ID NO: 3020721 - protein, 24 aa, Entamoeba invadens
TSTNLFLVMDYMPGGELYDLICTR

SEQ ID NO: 3020722 - protein, 28 aa, Entamoeba invadens
TSTQQFVLSVFSAFWVLKTGEVYVHQNI

SEQ ID NO: 3020723 - protein, 20 aa, Entamoeba invadens
TSTRRFFPHLQTICLYTPDD

SEQ ID NO: 3020724 - protein, 31 aa, Entamoeba invadens
TSTTSFFEANTFRELLYKVLDKDFSEHIPIA

SEQ ID NO: 3020725 - protein, 23 aa, Entamoeba invadens
TSTYLECTLLALLSNECSVHFSR

SEQ ID NO: 3020726 - protein, 28 aa, Entamoeba invadens
TSVDPTRSFFMLNKLNITIQPLQHIHIP

SEQ ID NO: 3020727 - protein, 31 aa, Entamoeba invadens
TSVELSFAAYFYSDFLVYVPELENYIKLPET

SEQ ID NO: 3020728 - protein, 25 aa, Entamoeba invadens
TSVFNCKIMFKNNLVFLIEDDKQNI

SEQ ID NO: 3020729 - protein, 29 aa, Entamoeba invadens
TSVHFFRELKNRKFYFSLLDIYTTNRQYI

SEQ ID NO: 3020730 - protein, 25 aa, Entamoeba invadens
TSVKDVFWMNQYPAVLLSTGEIYVL

SEQ ID NO: 3020731 - protein, 30 aa, Entamoeba invadens
TSVLTFWRICQTFDYFFVKTVVREYTDDNP

SEQ ID NO: 3020732 - protein, 18 aa, Entamoeba invadens
TSVTKFKMIQLANLGLFV

SEQ ID NO: 3020733 - protein, 25 aa, Entamoeba invadens
TSVTNLFEHFLLLDVVPQTTEVVLN

SEQ ID NO: 3020734 - protein, 22 aa, Entamoeba invadens
TSVTRIGVFAFRKCISLSDLSF

SEQ ID NO: 3020735 - protein, 18 aa, Entamoeba invadens
TSVVILCGEVLQVAEPWI

SEQ ID NO: 3020736 - protein, 24 aa, Entamoeba invadens
TSVVSFIAKLFELVNNKDTQKYIC

SEQ ID NO: 3020737 - protein, 26 aa, Entamoeba invadens
TSVYGIQVYLFYTKLDNLLQGVPPEF

SEQ ID NO: 3020738 - protein, 25 aa, Entamoeba invadens
TSYFAKLCFPIIKDTIKSLLQKGRL

SEQ ID NO: 3020739 - protein, 24 aa, Entamoeba invadens
TSYIIRVPAVQLHFTKDPSIEPAL

SEQ ID NO: 3020740 - protein, 21 aa, Entamoeba invadens
TSYLELLRTITPTLVFNELCS

SEQ ID NO: 3020741 - protein, 32 aa, Entamoeba invadens
TSYVESGYIWLPMYPVICGPMYIIPQQQTQLN

SEQ ID NO: 3020742 - protein, 23 aa, Entamoeba invadens
TSYYMAPELYRKEPYGFKVDIWA

SEQ ID NO: 3020743 - protein, 17 aa, Entamoeba invadens
TTAAIAYGLDKKTEREK

SEQ ID NO: 3020744 - protein, 27 aa, Entamoeba invadens
TTAAKLPTLLFSPLQNKNTIKLPKAPV

SEQ ID NO: 3020745 - protein, 26 aa, Entamoeba invadens
TTAAVYSFTIPLTKIANFKKINTSDK

SEQ ID NO: 3020746 - protein, 24 aa, Entamoeba invadens
TTARFHFNPIRLNSKTRKWFSRLE

SEQ ID NO: 3020747 - protein, 22 aa, Entamoeba invadens
TTARRVFNILVSSVCKIKKTAK

SEQ ID NO: 3020748 - protein, 19 aa, Entamoeba invadens
TTCCEVKMNVLWNLGLIDI

SEQ ID NO: 3020749 - protein, 23 aa, Entamoeba invadens
TTCEFYMAYADYNDLMTMTEELL

SEQ ID NO: 3020750 - protein, 18 aa, Entamoeba invadens
TTCFVLCFSLVDQTSFDE

SEQ ID NO: 3020751 - protein, 17 aa, Entamoeba invadens
TTCFVLCFSLVNLNSFN

SEQ ID NO: 3020752 - protein, 19 aa, Entamoeba invadens
TTCILCSTGFLLDVNNSCV

SEQ ID NO: 3020753 - protein, 20 aa, Entamoeba invadens
TTCILCSTGFVLDVNNKCVA

SEQ ID NO: 3020754 - protein, 30 aa, Entamoeba invadens
TTCQLVSLVLIMVDPYYRTIEGFLVLIQRE

SEQ ID NO: 3020755 - protein, 23 aa, Entamoeba invadens
TTCSIIGLFKAKMKVLAVDYDWK

SEQ ID NO: 3020756 - protein, 22 aa, Entamoeba invadens
TTCTLILSSLLSGVCYNDIINT

SEQ ID NO: 3020757 - protein, 26 aa, Entamoeba invadens
TTDEIHTFYTWLSKQPAKYIIQVLGN

SEQ ID NO: 3020758 - protein, 25 aa, Entamoeba invadens
TTDFELILADLVFKTDFVEFTNTSF

SEQ ID NO: 3020759 - protein, 29 aa, Entamoeba invadens
TTDIGLANWLLYLLKNYNTDIQPIVEVFI

SEQ ID NO: 3020760 - protein, 24 aa, Entamoeba invadens
TTDILNELNILLPASSEQPFVSTS

SEQ ID NO: 3020761 - protein, 25 aa, Entamoeba invadens
TTDIPQCLFFKCNSLMKISIPNSVT

SEQ ID NO: 3020762 - protein, 31 aa, Entamoeba invadens
TTDKGTMFYYFGWNSWNGWIPAWCVNKATKT

SEQ ID NO: 3020763 - protein, 24 aa, Entamoeba invadens
TTDKPHLTGFLGFKAGMTHVIREV

SEQ ID NO: 3020764 - protein, 24 aa, Entamoeba invadens
TTDKSIFMLSFFTNQTPINAKSEV

SEQ ID NO: 3020765 - protein, 20 aa, Entamoeba invadens
TTDLIYRMLNPTSQDHWTGY

SEQ ID NO: 3020766 - protein, 25 aa, Entamoeba invadens
TTDPQLILEKFYRFAMDYVSAPQLH

SEQ ID NO: 3020767 - protein, 27 aa, Entamoeba invadens
TTDTFKPNFQFTPTIKPSVVEKKGEPK

SEQ ID NO: 3020768 - protein, 24 aa, Entamoeba invadens
TTDTIYQLFANIPVLYSTELSNRR

SEQ ID NO: 3020769 - protein, 20 aa, Entamoeba invadens
TTDYQIALSTWKRLKKEPKV

SEQ ID NO: 3020770 - protein, 24 aa, Entamoeba invadens
TTEEIRMLWTYRAMVMKTKPRALS

SEQ ID NO: 3020771 - protein, 28 aa, Entamoeba invadens
TTEEKKIKKVFMPPPMTKKDSKIEKPVY

SEQ ID NO: 3020772 - protein, 17 aa, Entamoeba invadens
TTEFFKKAAHTQLPFHI

SEQ ID NO: 3020773 - protein, 24 aa, Entamoeba invadens
TTEFPRVKIVWTYSPQMTANIFDT

SEQ ID NO: 3020774 - protein, 30 aa, Entamoeba invadens
TTEHRVLSVFPITFPRVLLEKVDAQEIIDF

SEQ ID NO: 3020775 - protein, 17 aa, Entamoeba invadens
TTEIIVEDLKRVFQLIF

SEQ ID NO: 3020776 - protein, 31 aa, Entamoeba invadens
TTEKEKQFVFFYTLANYALPNAMRWFDDSVL

SEQ ID NO: 3020777 - protein, 24 aa, Entamoeba invadens
TTEKVEYFPLPHENLNPKYVTQHV

SEQ ID NO: 3020778 - protein, 54 aa, Entamoeba invadens
TTELEPFKYLIQLSSFFSDKFFYKPFKKNLPFELYMKFYLENKTNKIPIFLPFL

SEQ ID NO: 3020779 - protein, 22 aa, Entamoeba invadens
TTENLIEFCESKRFYLNNGMCQ

SEQ ID NO: 3020780 - protein, 17 aa, Entamoeba invadens
TTENQFRMSMAKNLPIV

SEQ ID NO: 3020781 - protein, 24 aa, Entamoeba invadens
TTEPLSKLFDLSFTRYSPLMAEII

SEQ ID NO: 3020782 - protein, 34 aa, Entamoeba invadens
TTEQSSKYAFLMKEKCQLTISLEQMKTQMSQLVG

SEQ ID NO: 3020783 - protein, 25 aa, Entamoeba invadens
TTEQTFFGIIEILEILSKCELLTEP

SEQ ID NO: 3020784 - protein, 26 aa, Entamoeba invadens
TTETPYTFALKKMLKPLLESKTPGII

SEQ ID NO: 3020785 - protein, 28 aa, Entamoeba invadens
TTFEVFGWFQAYPLDIFKFPSKIAEFVM

SEQ ID NO: 3020786 - protein, 28 aa, Entamoeba invadens
TTFFRNTSVIFLVYLFDDLKTTECLDFW

SEQ ID NO: 3020787 - protein, 24 aa, Entamoeba invadens
TTFGDIMGHYDFVYGNDPIDGSLE

SEQ ID NO: 3020788 - protein, 25 aa, Entamoeba invadens
TTFGDIMGHYDFVYGNDPIDGSLET

SEQ ID NO: 3020789 - protein, 20 aa, Entamoeba invadens
TTFIKWLCNSTKLKEYYTFC

SEQ ID NO: 3020790 - protein, 21 aa, Entamoeba invadens
TTFKCVVVHIITMQLDLQTKF

SEQ ID NO: 3020791 - protein, 19 aa, Entamoeba invadens
TTFLKTKRDLYKYIHDQTL

SEQ ID NO: 3020792 - protein, 20 aa, Entamoeba invadens
TTFTFPVYSTKLNVSDAFKI

SEQ ID NO: 3020793 - protein, 21 aa, Entamoeba invadens
TTFVELFRVFKKLEAETLSIL

SEQ ID NO: 3020794 - protein, 57 aa, Entamoeba invadens
TTGEKMITWPKRVTFFLQLLLLRKINMVLVNHNVNWWNSLWVHLGHYSATSLIIFGK

SEQ ID NO: 3020795 - protein, 24 aa, Entamoeba invadens
TTGEYFYFTVMDNYLYEIVYHVAP

SEQ ID NO: 3020796 - protein, 26 aa, Entamoeba invadens
TTGEYTWLRKFVTTSPLCEIIYQRLG

SEQ ID NO: 3020797 - protein, 25 aa, Entamoeba invadens
TTGILQIFIFPDDCYGLYGANGEYD

SEQ ID NO: 3020798 - protein, 27 aa, Entamoeba invadens
TTGILQIFMFPNYCYGLYGANGEYDHT

SEQ ID NO: 3020799 - protein, 22 aa, Entamoeba invadens
TTGINYLFGVLPNINTLTSSIE

SEQ ID NO: 3020800 - protein, 29 aa, Entamoeba invadens
TTHEFYTFPFSYCLCLGNDFIKKLSIGKH

SEQ ID NO: 3020801 - protein, 25 aa, Entamoeba invadens
TTHLIVKGYVRTKKVILAMCTGCWV

SEQ ID NO: 3020802 - protein, 29 aa, Entamoeba invadens
TTIANGLIYMIIKLGFNIKIKRTKKTVHT

SEQ ID NO: 3020803 - protein, 26 aa, Entamoeba invadens
TTIAPTLIMGIMDPTPEYVKIVLCKK

SEQ ID NO: 3020804 - protein, 30 aa, Entamoeba invadens
TTIDNKYEILLFLYYLKHLTIEKNTTNLKT

SEQ ID NO: 3020805 - protein, 26 aa, Entamoeba invadens
TTIEKILKIFPNLDTLYINSIMSPIC

SEQ ID NO: 3020806 - protein, 22 aa, Entamoeba invadens
TTIIVPVLAVVRYFCELGRTDV

SEQ ID NO: 3020807 - protein, 34 aa, Entamoeba invadens
TTIKEINFSYSLLKTLPKSFMSLIGLKKLTLQHT

SEQ ID NO: 3020808 - protein, 20 aa, Entamoeba invadens
TTIKKLKKLFKAEIIFENYD

SEQ ID NO: 3020809 - protein, 17 aa, Entamoeba invadens
TTILEKTQKIKNLENII

SEQ ID NO: 3020810 - protein, 17 aa, Entamoeba invadens
TTILPSVLALPKSPRIN

SEQ ID NO: 3020811 - protein, 30 aa, Entamoeba invadens
TTILTHLQALFFPDFFLRKTERNLRHTSAY

SEQ ID NO: 3020812 - protein, 20 aa, Entamoeba invadens
TTIPDIPLELNYLRAIDVSF

SEQ ID NO: 3020813 - protein, 24 aa, Entamoeba invadens
TTIPRFHTHFPYVNSLGKTECPIL

SEQ ID NO: 3020814 - protein, 26 aa, Entamoeba invadens
TTIQFKIIETPGLWFSQKFLSANLTN

SEQ ID NO: 3020815 - protein, 23 aa, Entamoeba invadens
TTITIPFDEYVALRLADQKLEFM

SEQ ID NO: 3020816 - protein, 27 aa, Entamoeba invadens
TTITSIGYGSFWNCDFLTAIEIPEACE

SEQ ID NO: 3020817 - protein, 24 aa, Entamoeba invadens
TTIVGFRYLFAYYRQPDVKMCEIN

SEQ ID NO: 3020818 - protein, 24 aa, Entamoeba invadens
TTIYENLFVNLLVPLLDDVDKFIS

SEQ ID NO: 3020819 - protein, 20 aa, Entamoeba invadens
TTIYFSQFYQTNIQSRKLEA

SEQ ID NO: 3020820 - protein, 21 aa, Entamoeba invadens
TTIYLNPLFDNVVSSWCFGDC

SEQ ID NO: 3020821 - protein, 24 aa, Entamoeba invadens
TTKDIYFIDMPFLEEKWTTLQQKD

SEQ ID NO: 3020822 - protein, 20 aa, Entamoeba invadens
TTKEFPLPSNLKIYDGYNVE

SEQ ID NO: 3020823 - protein, 24 aa, Entamoeba invadens
TTKEVMWFKDDLLPQALLQQCENA

SEQ ID NO: 3020824 - protein, 26 aa, Entamoeba invadens
TTKGVIKFRKFYVSSIDVNCTIFTTE

SEQ ID NO: 3020825 - protein, 35 aa, Entamoeba invadens
TTKKKCGWRFPLPIYRSIQFLKQKDRFVTEGIFRV

SEQ ID NO: 3020826 - protein, 21 aa, Entamoeba invadens
TTKKLYVWRGKKTSLIMKGKC

SEQ ID NO: 3020827 - protein, 19 aa, Entamoeba invadens
TTKLEFSYAVRPEQVFDVF

SEQ ID NO: 3020828 - protein, 25 aa, Entamoeba invadens
TTKLLVHGLLCQLHFIDPIPKNQPV

SEQ ID NO: 3020829 - protein, 21 aa, Entamoeba invadens
TTKNLLKMPQNPKLSKSENPS

SEQ ID NO: 3020830 - protein, 30 aa, Entamoeba invadens
TTKQQIIVILYRIYYIKSSGVYFLYQMNCY

SEQ ID NO: 3020831 - protein, 25 aa, Entamoeba invadens
TTKSSILFHRLLLVNKFGDDVIKEM

SEQ ID NO: 3020832 - protein, 24 aa, Entamoeba invadens
TTKTAKQLLPKKVVFVLDFCSDNP

SEQ ID NO: 3020833 - protein, 23 aa, Entamoeba invadens
TTKYLRPHLDTLKAFHAMLPFGE

SEQ ID NO: 3020834 - protein, 22 aa, Entamoeba invadens
TTLCIVVVLQTVKGPYMVFLSI

SEQ ID NO: 3020835 - protein, 24 aa, Entamoeba invadens
TTLELGLRFCGMKRVIGGQLISYD

SEQ ID NO: 3020836 - protein, 44 aa, Entamoeba invadens
TTLENNIIKFVSKYEKTLFPSEFALLIDTLYECNNTSLDILKRN

SEQ ID NO: 3020837 - protein, 20 aa, Entamoeba invadens
TTLEVISITRFGGKLSIPDS

SEQ ID NO: 3020838 - protein, 25 aa, Entamoeba invadens
TTLGPRGMDKLFLDNGKILVTNDGA

SEQ ID NO: 3020839 - protein, 18 aa, Entamoeba invadens
TTLKEHGDWVLNVDWHYS

SEQ ID NO: 3020840 - protein, 18 aa, Entamoeba invadens
TTLKLSLIDLLKAKYPSS

SEQ ID NO: 3020841 - protein, 37 aa, Entamoeba invadens
TTLLILHRSFDCATPLLIQWTYQAMINEFLGINNNLI

SEQ ID NO: 3020842 - protein, 38 aa, Entamoeba invadens
TTLNYHITLMKLYSTFPGYPFYITQLLKNVNEYTVALF

SEQ ID NO: 3020843 - protein, 20 aa, Entamoeba invadens
TTLPSQFLRLEAFGITETEK

SEQ ID NO: 3020844 - protein, 30 aa, Entamoeba invadens
TTLRISDFVYSFPLLTELTVRKILKKCATF

SEQ ID NO: 3020845 - protein, 24 aa, Entamoeba invadens
TTLSKMACFFGEKNPKFLPKRSRE

SEQ ID NO: 3020846 - protein, 18 aa, Entamoeba invadens
TTLVLIESKAFDCCENLE

SEQ ID NO: 3020847 - protein, 25 aa, Entamoeba invadens
TTLVNWDAIIFDKIKDMLGGKLDVV

SEQ ID NO: 3020848 - protein, 18 aa, Entamoeba invadens
TTLYIVGIPDSATEQTIR

SEQ ID NO: 3020849 - protein, 21 aa, Entamoeba invadens
TTLYVYCIVGYLIYLKDDFLD

SEQ ID NO: 3020850 - protein, 22 aa, Entamoeba invadens
TTMAEKVALLMTTEKTVQEFNN

SEQ ID NO: 3020851 - protein, 24 aa, Entamoeba invadens
TTMRTYFDIIRSSGKNYWIIGESP

SEQ ID NO: 3020852 - protein, 37 aa, Entamoeba invadens
TTNFTMTPTFSQNLPYFYYTLMINNLLKDVKSYLDDK

SEQ ID NO: 3020853 - protein, 26 aa, Entamoeba invadens
TTNFYPKPHVVKTPFDKLQNLNCVFD

SEQ ID NO: 3020854 - protein, 31 aa, Entamoeba invadens
TTNIPFTSFPFFLPKKNMFLRTIYITELEQN

SEQ ID NO: 3020855 - protein, 17 aa, Entamoeba invadens
TTNKRIKHFFDVDQIEI

SEQ ID NO: 3020856 - protein, 17 aa, Entamoeba invadens
TTNSYFIPTFGSYYLDS

SEQ ID NO: 3020857 - protein, 25 aa, Entamoeba invadens
TTNTFICPLTKRRFVEPYKSKVCGH

SEQ ID NO: 3020858 - protein, 17 aa, Entamoeba invadens
TTPAFVPVPDLPFTFET

SEQ ID NO: 3020859 - protein, 38 aa, Entamoeba invadens
TTPATFSWAVNALFSILFEKRLYPQMKMIGLGSRLTTL

SEQ ID NO: 3020860 - protein, 29 aa, Entamoeba invadens
TTPAYPAALILFQLLVNATLTQLVKGKLP

SEQ ID NO: 3020861 - protein, 22 aa, Entamoeba invadens
TTPEKFFLKLMERLDVPEDFEP

SEQ ID NO: 3020862 - protein, 23 aa, Entamoeba invadens
TTPFKVLLEGHLLRYGTSDKIYC

SEQ ID NO: 3020863 - protein, 27 aa, Entamoeba invadens
TTPFVKEGFMLNGFWPQIRVNAKLRCC

SEQ ID NO: 3020864 - protein, 23 aa, Entamoeba invadens
TTPKGFFVLDQTTFTLTLRCSGN

SEQ ID NO: 3020865 - protein, 28 aa, Entamoeba invadens
TTPKPRPKLPKRAQPPIPPLVTKNKEYS

SEQ ID NO: 3020866 - protein, 28 aa, Entamoeba invadens
TTPLKNSSWLRWIACRLVMLEKREHDLV

SEQ ID NO: 3020867 - protein, 23 aa, Entamoeba invadens
TTPRPGTPILQMESIAGPSSVQS

SEQ ID NO: 3020868 - protein, 25 aa, Entamoeba invadens
TTPYEIYSLFFTKELKDFVILQSNN

SEQ ID NO: 3020869 - protein, 21 aa, Entamoeba invadens
TTQFFYHTKLDWVEAGLQIAR

SEQ ID NO: 3020870 - protein, 22 aa, Entamoeba invadens
TTQFLQKHLAIHLLDVFTADHK

SEQ ID NO: 3020871 - protein, 23 aa, Entamoeba invadens
TTQFPMYTLMISSVYGDVGEIVS

SEQ ID NO: 3020872 - protein, 25 aa, Entamoeba invadens
TTQKELENIIETNKIKQLTSARRIE

SEQ ID NO: 3020873 - protein, 20 aa, Entamoeba invadens
TTQLQIIPKLRMYGVEEEIA

SEQ ID NO: 3020874 - protein, 30 aa, Entamoeba invadens
TTQMLVIDNNLWTYYPDVSKLNVYNEKLQL

SEQ ID NO: 3020875 - protein, 23 aa, Entamoeba invadens
TTQNNIFFGQQKIDEIRNLDHHV

SEQ ID NO: 3020876 - protein, 23 aa, Entamoeba invadens
TTQPLDTVLLPNAPPQQALESFS

SEQ ID NO: 3020877 - protein, 25 aa, Entamoeba invadens
TTQQFISKLCNINYLLRSSYFEMVP

SEQ ID NO: 3020878 - protein, 23 aa, Entamoeba invadens
TTQQKTIKSPPPPSSTTITTTGE

SEQ ID NO: 3020879 - protein, 38 aa, Entamoeba invadens
TTQRKNIRSLLKTLQDILWEGQKWKKLGMTDLCDYDGV

SEQ ID NO: 3020880 - protein, 44 aa, Entamoeba invadens
TTQYDKFELRILPEVVMLKPFYACEFSIYLTPKCTCQINNKICI

SEQ ID NO: 3020881 - protein, 19 aa, Entamoeba invadens
TTRAEFFGFIAKKIKEFVD

SEQ ID NO: 3020882 - protein, 24 aa, Entamoeba invadens
TTREFMCHHLTFMSRYVPVHCLVD

SEQ ID NO: 3020883 - protein, 21 aa, Entamoeba invadens
TTRITCTICDNFDLCLECFSQ

SEQ ID NO: 3020884 - protein, 45 aa, Entamoeba invadens
TTRKFMCCGPMYWIPNLQEPPKELFYYFLFNDILIQTKPKKFHGE

SEQ ID NO: 3020885 - protein, 30 aa, Entamoeba invadens
TTRKFVTNVFELWVVMVCELNNKLTQILSN

SEQ ID NO: 3020886 - protein, 17 aa, Entamoeba invadens
TTRKYLVGPLGMKTLDP

SEQ ID NO: 3020887 - protein, 32 aa, Entamoeba invadens
TTRLLFYVEMVYSFFDLKFTDLPVFIQEKIKL

SEQ ID NO: 3020888 - protein, 30 aa, Entamoeba invadens
TTRLMNIIYLNQGIGFLYHCLTPLFNEILE

SEQ ID NO: 3020889 - protein, 21 aa, Entamoeba invadens
TTRPLLYERVVKWLNCDAAPV

SEQ ID NO: 3020890 - protein, 25 aa, Entamoeba invadens
TTRRKSWCCCLPPATTRMMLSQWRP

SEQ ID NO: 3020891 - protein, 23 aa, Entamoeba invadens
TTSFLEANGFREQLYRVLDKDMA

SEQ ID NO: 3020892 - protein, 29 aa, Entamoeba invadens
TTSFLEANSFREQLFRVLDKDFSEHIPIA

SEQ ID NO: 3020893 - protein, 17 aa, Entamoeba invadens
TTSFNWLSELLSKLINT

SEQ ID NO: 3020894 - protein, 24 aa, Entamoeba invadens
  misc_feature (24)..(24): Xaa can be any naturally occurring amino acid
TTSGKYFIPSTTRHLFLIRLTIIX

SEQ ID NO: 3020895 - protein, 22 aa, Entamoeba invadens
TTSHHYLLLQKVIQMIPEPPNG

SEQ ID NO: 3020896 - protein, 23 aa, Entamoeba invadens
TTSIEVQNWWKVLTTIFASSIKM

SEQ ID NO: 3020897 - protein, 34 aa, Entamoeba invadens
TTSIGQTFKLYLPFFKCYFFYISHYDSVNKLLSK

SEQ ID NO: 3020898 - protein, 26 aa, Entamoeba invadens
TTSLKPVYVLYLQNKNMEILERLCYE

SEQ ID NO: 3020899 - protein, 24 aa, Entamoeba invadens
TTSNITQWLLFLESFCSREDIGSI

SEQ ID NO: 3020900 - protein, 32 aa, Entamoeba invadens
TTSNTPYICDFAPFKPFYLPDDNPYDLNFFFN

SEQ ID NO: 3020901 - protein, 23 aa, Entamoeba invadens
TTSPEMLFIFCSPSFKKTKAFYN

SEQ ID NO: 3020902 - protein, 33 aa, Entamoeba invadens
TTSPLREKCCLIKRYFGRLKTVFAFARTKFVKE

SEQ ID NO: 3020903 - protein, 31 aa, Entamoeba invadens
TTSPYRLRNWLRIKAVIPLIKTVSDLSIYLS

SEQ ID NO: 3020904 - protein, 24 aa, Entamoeba invadens
TTSRLLKELAFPNDVLYIKEMCCM

SEQ ID NO: 3020905 - protein, 36 aa, Entamoeba invadens
TTTAKIKSLFSKYNPISYDIPRYKTDTPISSCIIKT

SEQ ID NO: 3020906 - protein, 22 aa, Entamoeba invadens
TTTFRNFLNVSEKCRLAVSMLH

SEQ ID NO: 3020907 - protein, 19 aa, Entamoeba invadens
TTTFTFRVYTQPTIVLIPI

SEQ ID NO: 3020908 - protein, 28 aa, Entamoeba invadens
TTTKHNFFQIIVWFKVSLSTFLTNNTKN

SEQ ID NO: 3020909 - protein, 26 aa, Entamoeba invadens
TTTKIDFFQINVWFVVTYDCTQTHLH

SEQ ID NO: 3020910 - protein, 18 aa, Entamoeba invadens
TTTLFKMSCSNITFIPIG

SEQ ID NO: 3020911 - protein, 22 aa, Entamoeba invadens
TTTLIIFNIYDETIKTNLLIMW

SEQ ID NO: 3020912 - protein, 26 aa, Entamoeba invadens
TTTLYIKMMISGILSKGILISGDNVL

SEQ ID NO: 3020913 - protein, 26 aa, Entamoeba invadens
TTTNNYILDLLPTFGYSITISTCGGF

SEQ ID NO: 3020914 - protein, 17 aa, Entamoeba invadens
TTTPPLPEKKKVKFSIT

SEQ ID NO: 3020915 - protein, 23 aa, Entamoeba invadens
TTTPQFFEDLLFENMPVPGLSGR

SEQ ID NO: 3020916 - protein, 28 aa, Entamoeba invadens
TTTQPIQQPLPIQSIPSIKIAQTLQPQC

SEQ ID NO: 3020917 - protein, 26 aa, Entamoeba invadens
TTTYFRNRHCILFTYDITKRETLEHV

SEQ ID NO: 3020918 - protein, 18 aa, Entamoeba invadens
TTVAQSVLLIFPKESHNK

SEQ ID NO: 3020919 - protein, 20 aa, Entamoeba invadens
TTVCYSSCNCLMMGGMGNLM

SEQ ID NO: 3020920 - protein, 20 aa, Entamoeba invadens
TTVLYLGKITTKCVFCKALH

SEQ ID NO: 3020921 - protein, 21 aa, Entamoeba invadens
TTVRLIIMSAMMDVDLFRLHF

SEQ ID NO: 3020922 - protein, 26 aa, Entamoeba invadens
TTVSQFLPLLINYFIKTIDDHDLKLE

SEQ ID NO: 3020923 - protein, 26 aa, Entamoeba invadens
TTVTYTRLLKKLQKTFKNLQFYVEPE

SEQ ID NO: 3020924 - protein, 18 aa, Entamoeba invadens
TTVVILAAELLKYGNELI

SEQ ID NO: 3020925 - protein, 22 aa, Entamoeba invadens
TTWNFRVKCLVINSASFLRRFE

SEQ ID NO: 3020926 - protein, 19 aa, Entamoeba invadens
TTWSLIPPKSLTDALTQLS

SEQ ID NO: 3020927 - protein, 18 aa, Entamoeba invadens
TTYFIQGKNIGSCTLCGG

SEQ ID NO: 3020928 - protein, 18 aa, Entamoeba invadens
TTYFLNYNLECLEQLELA

SEQ ID NO: 3020929 - protein, 26 aa, Entamoeba invadens
TTYQEMMHILQDAILYNPSFIGKNFE

SEQ ID NO: 3020930 - protein, 21 aa, Entamoeba invadens
TTYVEWFTIVQMANNIFGEDG

SEQ ID NO: 3020931 - protein, 19 aa, Entamoeba invadens
TTYYFENNYRRVQPYYYNF

SEQ ID NO: 3020932 - protein, 35 aa, Entamoeba invadens
TVAEDGQLILWRIDTLTPFLYFTRDDYHDKNLRSL

SEQ ID NO: 3020933 - protein, 32 aa, Entamoeba invadens
TVAFNNIVKCKLTHFLYTNSYTKGYSYGFDYP

SEQ ID NO: 3020934 - protein, 19 aa, Entamoeba invadens
TVAFYKINFYSSALANSIL

SEQ ID NO: 3020935 - protein, 37 aa, Entamoeba invadens
TVAIEDIIYFFPNLQTLYFNALSYCPRKFSSDDIPLI

SEQ ID NO: 3020936 - protein, 27 aa, Entamoeba invadens
TVAIEDIIYIFLNLQTLYFNSFSSCPK

SEQ ID NO: 3020937 - protein, 18 aa, Entamoeba invadens
TVAQMKYNLLKEELIKDM

SEQ ID NO: 3020938 - protein, 25 aa, Entamoeba invadens
TVATDILFGLLKDVARFREDLKIII

SEQ ID NO: 3020939 - protein, 17 aa, Entamoeba invadens
TVATDLLFGILKGLVQK

SEQ ID NO: 3020940 - protein, 37 aa, Entamoeba invadens
TVAVESSFIARLYDLFKSIPFHLFSTTTPETPKGIPP

SEQ ID NO: 3020941 - protein, 24 aa, Entamoeba invadens
TVCDSIFKILTLQTLHKVTFEIDI

SEQ ID NO: 3020942 - protein, 31 aa, Entamoeba invadens
TVCKMGIELLWVHPFFKRRGFGKSLVELSLV

SEQ ID NO: 3020943 - protein, 17 aa, Entamoeba invadens
TVCLAVKTVFDLYDSIF

SEQ ID NO: 3020944 - protein, 20 aa, Entamoeba invadens
TVCRGIAFVTYFDSQDAVRA

SEQ ID NO: 3020945 - protein, 27 aa, Entamoeba invadens
TVCSARTILECLDLGMYPSWDADNVVS

SEQ ID NO: 3020946 - protein, 17 aa, Entamoeba invadens
TVDAIVCYKILTMLFQC

SEQ ID NO: 3020947 - protein, 22 aa, Entamoeba invadens
TVDDLISFFSFTGCIEEIHISQ

SEQ ID NO: 3020948 - protein, 26 aa, Entamoeba invadens
TVDSKTVLLCTLSLAVPQHTIQLAFN

SEQ ID NO: 3020949 - protein, 38 aa, Entamoeba invadens
TVDTLRQEYLFIPFKYRDGYLMAILQKVGAQSAIIFTM

SEQ ID NO: 3020950 - protein, 29 aa, Entamoeba invadens
TVDTPKPLDNLFDFGFEPTPRNTDGTATD

SEQ ID NO: 3020951 - protein, 19 aa, Entamoeba invadens
TVDVLYFRDCESFVGAYRT

SEQ ID NO: 3020952 - protein, 27 aa, Entamoeba invadens
TVDVYPPYLLLLKLLTKNGKFSHGKVL

SEQ ID NO: 3020953 - protein, 22 aa, Entamoeba invadens
TVDYFLHYKVSPSTTYISHPAS

SEQ ID NO: 3020954 - protein, 17 aa, Entamoeba invadens
TVDYTQDLLFNKVKTFF

SEQ ID NO: 3020955 - protein, 18 aa, Entamoeba invadens
TVECPFGYQWSVVDEILK

SEQ ID NO: 3020956 - protein, 19 aa, Entamoeba invadens
TVEDEDCYFVYSYELKHSR

SEQ ID NO: 3020957 - protein, 24 aa, Entamoeba invadens
TVEDQLMEFALVNAKTKENAVAIF

SEQ ID NO: 3020958 - protein, 27 aa, Entamoeba invadens
TVEDSSDLLIYLYSSVPKKQLDNIKKR

SEQ ID NO: 3020959 - protein, 25 aa, Entamoeba invadens
TVEKNIPYFYTTLSKDLLPDRLNIK

SEQ ID NO: 3020960 - protein, 28 aa, Entamoeba invadens
TVENPFIFNPTVFLPESGSLNSKPVEEK

SEQ ID NO: 3020961 - protein, 18 aa, Entamoeba invadens
TVERFLKGPVQNADLEYL

SEQ ID NO: 3020962 - protein, 30 aa, Entamoeba invadens
TVETDKEIPFLFKITPPLKLQIESLISQDK

SEQ ID NO: 3020963 - protein, 26 aa, Entamoeba invadens
TVETRGDLLMYLYSSNPQKQLQNIAK

SEQ ID NO: 3020964 - protein, 20 aa, Entamoeba invadens
TVEVYKKLPPMTAEQKEFAK

SEQ ID NO: 3020965 - protein, 24 aa, Entamoeba invadens
TVFDAKRLIGRRFSDPAIQEDMKH

SEQ ID NO: 3020966 - protein, 19 aa, Entamoeba invadens
TVFDYIPKFVAKYSDLNIK

SEQ ID NO: 3020967 - protein, 26 aa, Entamoeba invadens
TVFERPFDLVVQVYLSRYPTTEDFPR

SEQ ID NO: 3020968 - protein, 18 aa, Entamoeba invadens
TVFFAVINEFMNTRMLKC

SEQ ID NO: 3020969 - protein, 17 aa, Entamoeba invadens
TVFLATLQTLVTLNLLQ

SEQ ID NO: 3020970 - protein, 18 aa, Entamoeba invadens
TVFMSMGTSIYQCDIKDE

SEQ ID NO: 3020971 - protein, 30 aa, Entamoeba invadens
TVFNDFKLSHKFRYVIFTMNDKMTEIVVEK

SEQ ID NO: 3020972 - protein, 18 aa, Entamoeba invadens
TVFPFISRNWCDNLFEDK

SEQ ID NO: 3020973 - protein, 27 aa, Entamoeba invadens
TVFQIPEHLAILLKIVFLKVQESYGNN

SEQ ID NO: 3020974 - protein, 17 aa, Entamoeba invadens
TVFSRHFLAAYVQRMLL

SEQ ID NO: 3020975 - protein, 23 aa, Entamoeba invadens
TVFTSELFRKIKLIEFLKSTSNS

SEQ ID NO: 3020976 - protein, 19 aa, Entamoeba invadens
TVGGFGYGYFTICKTNVCL

SEQ ID NO: 3020977 - protein, 38 aa, Entamoeba invadens
TVGHALNLRAYLITPVQRLPRYKLLLEDLINHTPEDHL

SEQ ID NO: 3020978 - protein, 23 aa, Entamoeba invadens
TVGKTCLLISYIKNSFPRTYLPT

SEQ ID NO: 3020979 - protein, 20 aa, Entamoeba invadens
TVGNIIWEYFRDKLNKKQEY

SEQ ID NO: 3020980 - protein, 28 aa, Entamoeba invadens
TVGQFPYPSYNCALLPPGWSMGMDYGEP

SEQ ID NO: 3020981 - protein, 35 aa, Entamoeba invadens
TVGSLPPVFVELQIRFYLLTRLLGVKTSEGEATVK

SEQ ID NO: 3020982 - protein, 43 aa, Entamoeba invadens
TVHASFCDLFNTLPLCVLLRRKMGNFFLCHGGISPDLGLISEI

SEQ ID NO: 3020983 - protein, 22 aa, Entamoeba invadens
TVHDLIAHIKFEITKSGKPMYC

SEQ ID NO: 3020984 - protein, 17 aa, Entamoeba invadens
TVHFGVNAFYGCTSLTQ

SEQ ID NO: 3020985 - protein, 25 aa, Entamoeba invadens
TVHYGGFQISLWDIGGTSSFRSVWN

SEQ ID NO: 3020986 - protein, 20 aa, Entamoeba invadens
TVIAIWVQVLNLILQDTPLS

SEQ ID NO: 3020987 - protein, 27 aa, Entamoeba invadens
TVIASHEFVRLYYALFQSRVDELVKMY

SEQ ID NO: 3020988 - protein, 19 aa, Entamoeba invadens
TVIFDLDETLIHTHSLLPE

SEQ ID NO: 3020989 - protein, 24 aa, Entamoeba invadens
TVIGRTVFVLLGKNATQKLNEHFA

SEQ ID NO: 3020990 - protein, 17 aa, Entamoeba invadens
TVIGWNFQNIKGKILAN

SEQ ID NO: 3020991 - protein, 18 aa, Entamoeba invadens
TVIIFGPGDEQVIHKVNE

SEQ ID NO: 3020992 - protein, 20 aa, Entamoeba invadens
TVIIGKPRHLATKTLQFMRV

SEQ ID NO: 3020993 - protein, 17 aa, Entamoeba invadens
TVIIIENIPLTLTKEEL

SEQ ID NO: 3020994 - protein, 17 aa, Entamoeba invadens
TVILPRCIKIIRPDCFK

SEQ ID NO: 3020995 - protein, 30 aa, Entamoeba invadens
TVIPKYCYAYRILFDKVRIPPIITSIEEGA

SEQ ID NO: 3020996 - protein, 38 aa, Entamoeba invadens
TVIQDTIHTWYQFRNWVWFRLFQKVRPTLKRRRVDEEL

SEQ ID NO: 3020997 - protein, 21 aa, Entamoeba invadens
TVISSLLENALIASQGILPLC

SEQ ID NO: 3020998 - protein, 19 aa, Entamoeba invadens
TVITHPFSVLKNKPLQTTN

SEQ ID NO: 3020999 - protein, 19 aa, Entamoeba invadens
TVIWSANPVMYCVCTVVSH

SEQ ID NO: 3021000 - protein, 26 aa, Entamoeba invadens
TVKDCSHLPYLLNIDDPYINVSHPFF

SEQ ID NO: 3021001 - protein, 27 aa, Entamoeba invadens
TVKDKTPFFWVNRKFLPLIAGEQSVKG

SEQ ID NO: 3021002 - protein, 21 aa, Entamoeba invadens
TVKEFVLPLLDDKTTPRLSMG

SEQ ID NO: 3021003 - protein, 21 aa, Entamoeba invadens
TVKFIVQFSEFLDKNEKWSIP

SEQ ID NO: 3021004 - protein, 17 aa, Entamoeba invadens
TVKFLGHLVKLFGHFFS

SEQ ID NO: 3021005 - protein, 18 aa, Entamoeba invadens
TVKFSITLKRQMPLVGFC

SEQ ID NO: 3021006 - protein, 17 aa, Entamoeba invadens
TVKFVIENPPFTPLEEY

SEQ ID NO: 3021007 - protein, 17 aa, Entamoeba invadens
TVKKHWDDLPKLDLKKL

SEQ ID NO: 3021008 - protein, 28 aa, Entamoeba invadens
TVKKLKNLITLFHWNFAYESCYENLFSE

SEQ ID NO: 3021009 - protein, 21 aa, Entamoeba invadens
TVKLFLKRENGFFMKEALVFV

SEQ ID NO: 3021010 - protein, 25 aa, Entamoeba invadens
TVKNRFFSYLSKLKEKRRSPSNVGT

SEQ ID NO: 3021011 - protein, 23 aa, Entamoeba invadens
TVKNVIRYFLEDLNIRNSQYLGF

SEQ ID NO: 3021012 - protein, 26 aa, Entamoeba invadens
TVLEKTFYQIIVWFGVNYGTVEKNKD

SEQ ID NO: 3021013 - protein, 18 aa, Entamoeba invadens
TVLEMFTYENELLPYFEI

SEQ ID NO: 3021014 - protein, 35 aa, Entamoeba invadens
TVLIAYLMFKNMWTYRQALTFVKSKRPIICPNSGF

SEQ ID NO: 3021015 - protein, 27 aa, Entamoeba invadens
TVLKIEFFRIIVWFNVDFETVDRNKSR

SEQ ID NO: 3021016 - protein, 28 aa, Entamoeba invadens
TVLKKEFYRIIVWFNVVFETVNRNKNRN

SEQ ID NO: 3021017 - protein, 27 aa, Entamoeba invadens
TVLKKTFYKIIVWYCVDFKTVCRNKSR

SEQ ID NO: 3021018 - protein, 22 aa, Entamoeba invadens
TVLLKKEGDGWKWFCGGRVVKV

SEQ ID NO: 3021019 - protein, 31 aa, Entamoeba invadens
TVLMQISHPFIVKLYYAFQTADKLYMILEFV

SEQ ID NO: 3021020 - protein, 25 aa, Entamoeba invadens
TVLNKSMMFDPRLQAIVLNIVDVSY

SEQ ID NO: 3021021 - protein, 27 aa, Entamoeba invadens
TVLNRKFFRIIVWFNVNFETVDRNKNR

SEQ ID NO: 3021022 - protein, 17 aa, Entamoeba invadens
TVLPLRIKRVFLDGVTV

SEQ ID NO: 3021023 - protein, 22 aa, Entamoeba invadens
TVLQQLRVLISKKFLDIAIVNS

SEQ ID NO: 3021024 - protein, 21 aa, Entamoeba invadens
TVLSPPFTVLDGILDFALKNK

SEQ ID NO: 3021025 - protein, 35 aa, Entamoeba invadens
TVLSSILKKFIRDLPQPIWPEEFLQPLVKVMESED

SEQ ID NO: 3021026 - protein, 20 aa, Entamoeba invadens
TVLTFKTKFLTYFPPQDFET

SEQ ID NO: 3021027 - protein, 26 aa, Entamoeba invadens
TVLTNKPVTLPLDLPIGKICGFGNVV

SEQ ID NO: 3021028 - protein, 28 aa, Entamoeba invadens
TVLYAIHRAILLKDPVFVQLRGAMINII

SEQ ID NO: 3021029 - protein, 17 aa, Entamoeba invadens
TVLYLRSDIDIAKAILV

SEQ ID NO: 3021030 - protein, 21 aa, Entamoeba invadens
TVMACEDYLFPTFLPFYDWFH

SEQ ID NO: 3021031 - protein, 21 aa, Entamoeba invadens
TVMLVSHGTWIKCALVGILEF

SEQ ID NO: 3021032 - protein, 34 aa, Entamoeba invadens
TVMSFIDVFINFLKSDDILLYSQIKLFTEDLEKC

SEQ ID NO: 3021033 - protein, 20 aa, Entamoeba invadens
TVMSIEFLENLFVKSLIDYE

SEQ ID NO: 3021034 - protein, 26 aa, Entamoeba invadens
TVMTRKITPEDLFYVGIRSIDPGERS

SEQ ID NO: 3021035 - protein, 20 aa, Entamoeba invadens
TVNAKLICLGESGTGKSSII

SEQ ID NO: 3021036 - protein, 20 aa, Entamoeba invadens
TVNCLINITDAPYKVIELET

SEQ ID NO: 3021037 - protein, 24 aa, Entamoeba invadens
TVNDCRRWFWELMQNAKDSIAGIK

SEQ ID NO: 3021038 - protein, 17 aa, Entamoeba invadens
TVNFIYNERIWSVWSDE

SEQ ID NO: 3021039 - protein, 32 aa, Entamoeba invadens
TVNKLNKMKILFTVYPITTWAYMRPSAQFSYL

SEQ ID NO: 3021040 - protein, 32 aa, Entamoeba invadens
TVNKMIDPTFYLFRWLSLLGALELPMEVTMQM

SEQ ID NO: 3021041 - protein, 28 aa, Entamoeba invadens
TVNLLPRKILFFEANTSAVFLYQICLAL

SEQ ID NO: 3021042 - protein, 23 aa, Entamoeba invadens
TVNLMIDMIIGNQFIFNSEEGPV

SEQ ID NO: 3021043 - protein, 21 aa, Entamoeba invadens
TVNPSLWRQSQLVRIAGLFEL

SEQ ID NO: 3021044 - protein, 28 aa, Entamoeba invadens
TVNPTMNALWCLFVMLLIGVSSEKCEAG

SEQ ID NO: 3021045 - protein, 21 aa, Entamoeba invadens
TVNQLLKKKKYRLAYDCLEFI

SEQ ID NO: 3021046 - protein, 19 aa, Entamoeba invadens
TVNSWMLTRGFTVGLGDIV

SEQ ID NO: 3021047 - protein, 17 aa, Entamoeba invadens
TVNTIFLKLTALNHVDA

SEQ ID NO: 3021048 - protein, 22 aa, Entamoeba invadens
TVNTIFTSFFHSKKLGKYVCTH

SEQ ID NO: 3021049 - protein, 17 aa, Entamoeba invadens
TVPEIVLNFPKISRLYI

SEQ ID NO: 3021050 - protein, 29 aa, Entamoeba invadens
TVPLNILRKKICILPQEATLFSGTIRENL

SEQ ID NO: 3021051 - protein, 19 aa, Entamoeba invadens
TVPLRLFLKIAGVIVSFSK

SEQ ID NO: 3021052 - protein, 17 aa, Entamoeba invadens
TVPPMFNGDTQYFISKV

SEQ ID NO: 3021053 - protein, 28 aa, Entamoeba invadens
TVQINVLDEYWIFNKKFESTKNLSNIAP

SEQ ID NO: 3021054 - protein, 18 aa, Entamoeba invadens
TVQIPEFIKYAKSSKLKS

SEQ ID NO: 3021055 - protein, 22 aa, Entamoeba invadens
TVQYQLMTWTALSNYHITYTTD

SEQ ID NO: 3021056 - protein, 23 aa, Entamoeba invadens
TVQYYLQLWNTKENPLFISVFSQ

SEQ ID NO: 3021057 - protein, 24 aa, Entamoeba invadens
TVRIPHNLSYLGGGAFLSCCSLKG

SEQ ID NO: 3021058 - protein, 21 aa, Entamoeba invadens
TVRLPLASMELQILRKETTGY

SEQ ID NO: 3021059 - protein, 31 aa, Entamoeba invadens
TVRMLDHFLYCNHLCIVFELLGSNIYQMLQE

SEQ ID NO: 3021060 - protein, 42 aa, Entamoeba invadens
TVRTVLQMMFPPIQASVARLHQFRRAMLFSYDEKTGLIDLRH

SEQ ID NO: 3021061 - protein, 33 aa, Entamoeba invadens
TVRYNTYKTVFFLRYLFIALNNAKQYVPVQLAH

SEQ ID NO: 3021062 - protein, 37 aa, Entamoeba invadens
TVSDHCLTINKILLEGLRKLWWKAMDYLSAKTMNKRK

SEQ ID NO: 3021063 - protein, 37 aa, Entamoeba invadens
TVSEMIMAFMSLITPFQWQHVFIPVLPVSLVTYCSAP

SEQ ID NO: 3021064 - protein, 34 aa, Entamoeba invadens
TVSFMLELKILKDGLLLTWLSKAVHQTFFSDVSN

SEQ ID NO: 3021065 - protein, 30 aa, Entamoeba invadens
TVSGWKRRWVVLCRGFLFYYNNPKDEIPIG

SEQ ID NO: 3021066 - protein, 25 aa, Entamoeba invadens
TVSKYIDWFNLMTYDLHGAWDNITG

SEQ ID NO: 3021067 - protein, 20 aa, Entamoeba invadens
TVSPAIHDLPFTPTAAHFTP

SEQ ID NO: 3021068 - protein, 17 aa, Entamoeba invadens
TVSPQFVRLSSLTFENG

SEQ ID NO: 3021069 - protein, 25 aa, Entamoeba invadens
TVSQKVHYKIPRKPQPVVLIEEDPK

SEQ ID NO: 3021070 - protein, 31 aa, Entamoeba invadens
TVSSLSLFYSFFMKDITLPKLYQNLRKVANC

SEQ ID NO: 3021071 - protein, 18 aa, Entamoeba invadens
TVSSRVGSLYLSKFLRES

SEQ ID NO: 3021072 - protein, 26 aa, Entamoeba invadens
TVSYELLICIMLRKIKEMTNTVFAVM

SEQ ID NO: 3021073 - protein, 24 aa, Entamoeba invadens
TVTEDIFILKAVNQYGRKWSVICT

SEQ ID NO: 3021074 - protein, 20 aa, Entamoeba invadens
TVTFNQYKEKGLSYVNTHTL

SEQ ID NO: 3021075 - protein, 20 aa, Entamoeba invadens
TVTKILIEQIKKSPYQKVFG

SEQ ID NO: 3021076 - protein, 20 aa, Entamoeba invadens
TVTLIPFERRWVLFDVSQHG

SEQ ID NO: 3021077 - protein, 25 aa, Entamoeba invadens
TVTPSQHVFLALSFRGKMNPGDKGS

SEQ ID NO: 3021078 - protein, 22 aa, Entamoeba invadens
TVTPYYCVPLNRPPDTLNEGLR

SEQ ID NO: 3021079 - protein, 28 aa, Entamoeba invadens
TVTQNEQFLIWLSKHQISPILTEALEVS

SEQ ID NO: 3021080 - protein, 23 aa, Entamoeba invadens
TVTVINIRYLSTLIFSKHFSEIT

SEQ ID NO: 3021081 - protein, 24 aa, Entamoeba invadens
TVTYKVLNCFFGYSPQYTSALVTR

SEQ ID NO: 3021082 - protein, 19 aa, Entamoeba invadens
TVVAIMLNFIKTKTNFEIA

SEQ ID NO: 3021083 - protein, 31 aa, Entamoeba invadens
TVVCDNFFCSLRFAHYLAQYGSTLLGTVRKN

SEQ ID NO: 3021084 - protein, 31 aa, Entamoeba invadens
TVVDDLFKEWATRRNGFMDKCPMNPVEEDSH

SEQ ID NO: 3021085 - protein, 26 aa, Entamoeba invadens
TVVEPYNCMLSLHSLLESAGVSFCFD

SEQ ID NO: 3021086 - protein, 24 aa, Entamoeba invadens
TVVFKLVLICNNFIKDINHIQPVH

SEQ ID NO: 3021087 - protein, 20 aa, Entamoeba invadens
TVVFPKILRLRLSKTTKQKT

SEQ ID NO: 3021088 - protein, 24 aa, Entamoeba invadens
TVVFRKWDLTLLKAPSFLRREVSK

SEQ ID NO: 3021089 - protein, 22 aa, Entamoeba invadens
TVVGTPYWMAPELIRGHDYGVK

SEQ ID NO: 3021090 - protein, 21 aa, Entamoeba invadens
TVVIEIFSRGLGHNTLICKLE

SEQ ID NO: 3021091 - protein, 18 aa, Entamoeba invadens
TVVKYFVCFNDFVHLQMS

SEQ ID NO: 3021092 - protein, 25 aa, Entamoeba invadens
TVVLDVLCVLPNGKQAWINVTKDDN

SEQ ID NO: 3021093 - protein, 21 aa, Entamoeba invadens
TVVPTGVFNTKGKFNILDCVR

SEQ ID NO: 3021094 - protein, 33 aa, Entamoeba invadens
TVVQIVHFFPVIMQNLFCLFSEKKKIETTQTPP

SEQ ID NO: 3021095 - protein, 26 aa, Entamoeba invadens
TVVSTIISFYFPLVTSFHTLNSKRDD

SEQ ID NO: 3021096 - protein, 19 aa, Entamoeba invadens
TVVSYIKHFLFHASTQWSS

SEQ ID NO: 3021097 - protein, 21 aa, Entamoeba invadens
TVVVLLYNILPTVSKYPMSLV

SEQ ID NO: 3021098 - protein, 17 aa, Entamoeba invadens
TVWFATISSNSISGRKC

SEQ ID NO: 3021099 - protein, 37 aa, Entamoeba invadens
TVWSIYERSILKFTYPIAGKLWMKYFDDFVSKYGETK

SEQ ID NO: 3021100 - protein, 25 aa, Entamoeba invadens
TVYDFQLFPHMETQYIYSVWDVKLP

SEQ ID NO: 3021101 - protein, 19 aa, Entamoeba invadens
TVYELLNFNPEIIYRKFYS

SEQ ID NO: 3021102 - protein, 25 aa, Entamoeba invadens
TVYIKSGYYPLINNSLKFTKWSFKN

SEQ ID NO: 3021103 - protein, 27 aa, Entamoeba invadens
TVYIYTESFFQVKLYSLFIRQNLQLTN

SEQ ID NO: 3021104 - protein, 28 aa, Entamoeba invadens
TVYKSVDLLRLFRKYNPKQAFVATFLNG

SEQ ID NO: 3021105 - protein, 20 aa, Entamoeba invadens
TVYLADRRIDMLPKPLTEIV

SEQ ID NO: 3021106 - protein, 21 aa, Entamoeba invadens
TVYLVKTLILFIEKTKELIKD

SEQ ID NO: 3021107 - protein, 25 aa, Entamoeba invadens
TVYTRRLLKQVPLPHPPPGNRDYLN

SEQ ID NO: 3021108 - protein, 17 aa, Entamoeba invadens
TVYVMHMVDFFTYTLVD

SEQ ID NO: 3021109 - protein, 23 aa, Entamoeba invadens
TWEPRTCSTFRDISFMSPCNCIA

SEQ ID NO: 3021110 - protein, 19 aa, Entamoeba invadens
TWGLKLPHLFNYAGDMLGL

SEQ ID NO: 3021111 - protein, 19 aa, Entamoeba invadens
TWGRIILRHFYQHAFDGSG

SEQ ID NO: 3021112 - protein, 17 aa, Entamoeba invadens
TWGYLYSNENWVLVLST

SEQ ID NO: 3021113 - protein, 17 aa, Entamoeba invadens
TWIKCALVGILEFPDRM

SEQ ID NO: 3021114 - protein, 28 aa, Entamoeba invadens
TWIKPEISHRIILNDLLLIKIDEKTVDA

SEQ ID NO: 3021115 - protein, 29 aa, Entamoeba invadens
TWKDPFDEKLFPYSWDITNLISRGERPAI

SEQ ID NO: 3021116 - protein, 20 aa, Entamoeba invadens
TWKMILRVVFCSLQSIFPEK

SEQ ID NO: 3021117 - protein, 19 aa, Entamoeba invadens
TWKTMIDFSTQITLGLEYL

SEQ ID NO: 3021118 - protein, 19 aa, Entamoeba invadens
TWMMQNFIINNHPLLEYEE

SEQ ID NO: 3021119 - protein, 25 aa, Entamoeba invadens
TWRLRIGQFITFPNYQRKKLGRYLL

SEQ ID NO: 3021120 - protein, 17 aa, Entamoeba invadens
TWSQFLINNENPLYSCI

SEQ ID NO: 3021121 - protein, 24 aa, Entamoeba invadens
TWTDFLISSFMFFDKPQILPNGVS

SEQ ID NO: 3021122 - protein, 21 aa, Entamoeba invadens
TWTELFQNDYVKRVLGCVFED

SEQ ID NO: 3021123 - protein, 25 aa, Entamoeba invadens
TWTVPMFQGLLPRHMEIVYEINYRF

SEQ ID NO: 3021124 - protein, 18 aa, Entamoeba invadens
TWVVPKFAFLKDDANFFP

SEQ ID NO: 3021125 - protein, 33 aa, Entamoeba invadens
TYAKEIIDMLLKMKYPVVILHAVRLLGKISKIV

SEQ ID NO: 3021126 - protein, 22 aa, Entamoeba invadens
TYDIISILNSILLLLDDPNPNS

SEQ ID NO: 3021127 - protein, 20 aa, Entamoeba invadens
TYDIKHISLAHASKFFLVCP

SEQ ID NO: 3021128 - protein, 24 aa, Entamoeba invadens
TYDLLITIFCYLFKDFKDLYIPYV

SEQ ID NO: 3021129 - protein, 18 aa, Entamoeba invadens
TYDLLTKFKKQYGEQTQI

SEQ ID NO: 3021130 - protein, 25 aa, Entamoeba invadens
TYDLQALRWHFSYGGVLTIPSVEKI

SEQ ID NO: 3021131 - protein, 25 aa, Entamoeba invadens
TYDMTQKCILIYDTDKFYNEIMPKF

SEQ ID NO: 3021132 - protein, 26 aa, Entamoeba invadens
TYDNVWDYVFFFFDILCECFVESCVC

SEQ ID NO: 3021133 - protein, 29 aa, Entamoeba invadens
TYDVFAYDDYIIMIMEYARGGSLGDIIKA

SEQ ID NO: 3021134 - protein, 23 aa, Entamoeba invadens
TYDVRIFYCREYAFRIREFLGEQ

SEQ ID NO: 3021135 - protein, 27 aa, Entamoeba invadens
TYECVICMSPIFKFQRIWPCPRCYTVV

SEQ ID NO: 3021136 - protein, 17 aa, Entamoeba invadens
TYEMTYIPLVPGKHKVE

SEQ ID NO: 3021137 - protein, 30 aa, Entamoeba invadens
TYEQLLEVWIGLYFWYWHSDGRPYQQTVRN

SEQ ID NO: 3021138 - protein, 23 aa, Entamoeba invadens
TYFKTALPLVKTCGRMIKDAYCK

SEQ ID NO: 3021139 - protein, 17 aa, Entamoeba invadens
TYFLFNRNVIQTIEISG

SEQ ID NO: 3021140 - protein, 17 aa, Entamoeba invadens
TYFPNELSEYVVLRQKY

SEQ ID NO: 3021141 - protein, 19 aa, Entamoeba invadens
TYFPRMDAVWNNNLTIYKL

SEQ ID NO: 3021142 - protein, 18 aa, Entamoeba invadens
TYFSSMLELLQMPNLIQQ

SEQ ID NO: 3021143 - protein, 17 aa, Entamoeba invadens
TYGCKYAPEFPGDYKID

SEQ ID NO: 3021144 - protein, 18 aa, Entamoeba invadens
TYGIVFLGAIKQNYKCVI

SEQ ID NO: 3021145 - protein, 21 aa, Entamoeba invadens
TYICPLQIQKLLEFSNFAQDS

SEQ ID NO: 3021146 - protein, 33 aa, Entamoeba invadens
TYIFATTSNHCKFMWLYMLRNAFYKNCKMHMDL

SEQ ID NO: 3021147 - protein, 25 aa, Entamoeba invadens
TYIKIIVMEYTDILVKLLPSGELQK

SEQ ID NO: 3021148 - protein, 32 aa, Entamoeba invadens
TYINEELLGLHFKISPLTFFQTNSLGAEVLYS

SEQ ID NO: 3021149 - protein, 25 aa, Entamoeba invadens
TYIPASPQILFKWFSVVQSVAGDGC

SEQ ID NO: 3021150 - protein, 19 aa, Entamoeba invadens
TYIYGDFFKHGFDGSGSDG

SEQ ID NO: 3021151 - protein, 17 aa, Entamoeba invadens
TYIYLNCDNPLGDHLRE

SEQ ID NO: 3021152 - protein, 18 aa, Entamoeba invadens
TYKFIQLINRYTKLENVS

SEQ ID NO: 3021153 - protein, 17 aa, Entamoeba invadens
TYKLNKTAAYLEMENYE

SEQ ID NO: 3021154 - protein, 17 aa, Entamoeba invadens
TYLEIYKEKENCVCIVH

SEQ ID NO: 3021155 - protein, 17 aa, Entamoeba invadens
TYLNQQNASFFSSNIPD

SEQ ID NO: 3021156 - protein, 20 aa, Entamoeba invadens
TYLRDEQILYRLPHSKLVAL

SEQ ID NO: 3021157 - protein, 22 aa, Entamoeba invadens
TYLYNTIIDWAIENGKFVKIYA

SEQ ID NO: 3021158 - protein, 23 aa, Entamoeba invadens
TYMPKMLSLILTELNKYVFDQNS

SEQ ID NO: 3021159 - protein, 23 aa, Entamoeba invadens
TYNPLEAIIIQTALNMPSGTYES

SEQ ID NO: 3021160 - protein, 25 aa, Entamoeba invadens
TYPKPENYFFCSLFLFSVEIAQIRR

SEQ ID NO: 3021161 - protein, 22 aa, Entamoeba invadens
TYPLDHLLSVFHLKYLMLEKTT

SEQ ID NO: 3021162 - protein, 20 aa, Entamoeba invadens
TYPSPLHQFKKYSFKEKKKL

SEQ ID NO: 3021163 - protein, 19 aa, Entamoeba invadens
TYQCKEPVSLPSRPSAMDR

SEQ ID NO: 3021164 - protein, 32 aa, Entamoeba invadens
TYQKMVCPTLSIPLLLLQIRDSLLKFGGDKTE

SEQ ID NO: 3021165 - protein, 27 aa, Entamoeba invadens
TYQTEKYLYMILELASGGELFQQIIAE

SEQ ID NO: 3021166 - protein, 17 aa, Entamoeba invadens
TYRNGFTYHLPHCSLTT

SEQ ID NO: 3021167 - protein, 18 aa, Entamoeba invadens
TYRWNIRVLYDMIDIAAL

SEQ ID NO: 3021168 - protein, 23 aa, Entamoeba invadens
TYSDLSRLFKSFLSREVDNNKNT

SEQ ID NO: 3021169 - protein, 19 aa, Entamoeba invadens
TYSDWRPNNTERQKVRELH

SEQ ID NO: 3021170 - protein, 19 aa, Entamoeba invadens
TYSLVLSPHSFFTQVEFIS

SEQ ID NO: 3021171 - protein, 22 aa, Entamoeba invadens
TYSNAMDFFRKSLKLEILESTD

SEQ ID NO: 3021172 - protein, 23 aa, Entamoeba invadens
TYTDDLYYLPKEFYIEAVVGEKI

SEQ ID NO: 3021173 - protein, 35 aa, Entamoeba invadens
TYTQEQFVDLFKPFKTTSVLLDPPKHKAGQSAGNA

SEQ ID NO: 3021174 - protein, 19 aa, Entamoeba invadens
TYVDLLHKPLEAKKMRESF

SEQ ID NO: 3021175 - protein, 26 aa, Entamoeba invadens
TYVKTQFRRLAIWAPQNDIWNRMDAA

SEQ ID NO: 3021176 - protein, 37 aa, Entamoeba invadens
TYVSLFYEKTFLLDLTLVQFLLPIVGVKFFISTCVTM

SEQ ID NO: 3021177 - protein, 23 aa, Entamoeba invadens
TYYEKNIYIVGGLRYETIIDTID

SEQ ID NO: 3021178 - protein, 41 aa, Entamoeba invadens
TYYINKLVEAGLIKKFPILKNSWKLVLSLLCTDPTVSVGNS

SEQ ID NO: 3021179 - protein, 17 aa, Entamoeba invadens
TYYLYYRNVIQTVEISG

SEQ ID NO: 3021180 - protein, 21 aa, Entamoeba invadens
TYYRNSQVLPFLLRQLQTQNG

SEQ ID NO: 3021181 - protein, 21 aa, Entamoeba invadens
TYYTKLRTFNLRPKMSDEDVD

SEQ ID NO: 3021182 - protein, 17 aa, Entamoeba invadens
VAAALRIVRKCPDLGEQ

SEQ ID NO: 3021183 - protein, 24 aa, Entamoeba invadens
VAAFDLILREGVIGETYNIGTDRE

SEQ ID NO: 3021184 - protein, 27 aa, Entamoeba invadens
VAAVIKTWIDLYAIYYETDEKKALVRL

SEQ ID NO: 3021185 - protein, 29 aa, Entamoeba invadens
VACEEAIMLYLLNKYFTVTISKPTKRNSI

SEQ ID NO: 3021186 - protein, 26 aa, Entamoeba invadens
VACHSKMIFLFVTKQQDIFGFYQEDV

SEQ ID NO: 3021187 - protein, 19 aa, Entamoeba invadens
VADENAFVFVLERNGEKDE

SEQ ID NO: 3021188 - protein, 24 aa, Entamoeba invadens
VADLAIITTVLKYLEKGELVAGCI

SEQ ID NO: 3021189 - protein, 26 aa, Entamoeba invadens
VADYEALEKLWKYTYEQLKTDPKEHN

SEQ ID NO: 3021190 - protein, 17 aa, Entamoeba invadens
VAEHWYIFSTLKQFVTS

SEQ ID NO: 3021191 - protein, 39 aa, Entamoeba invadens
VAELFKFPQYVQFWGYVKKYIMVFKLRDDAQKYQTIIKD

SEQ ID NO: 3021192 - protein, 25 aa, Entamoeba invadens
VAELRLYSTLFTVPKPETDDWEKLI

SEQ ID NO: 3021193 - protein, 34 aa, Entamoeba invadens
VAENLHMVLDLLFEFDYLFVIKTTHGKNGANKLD

SEQ ID NO: 3021194 - protein, 27 aa, Entamoeba invadens
VAESIFNILVLLYPSLPALEIPQTTFT

SEQ ID NO: 3021195 - protein, 20 aa, Entamoeba invadens
VAEVKKLGRFSKLFIPKGLV

SEQ ID NO: 3021196 - protein, 31 aa, Entamoeba invadens
VAEYFMMIREIIYKPLFKASTLFLTKKKDLE

SEQ ID NO: 3021197 - protein, 17 aa, Entamoeba invadens
VAFCKHLDFIFHKEHLK

SEQ ID NO: 3021198 - protein, 33 aa, Entamoeba invadens
VAFCVIKEFLRRLPLPVFHPLLEFLNPDNMKVD

SEQ ID NO: 3021199 - protein, 26 aa, Entamoeba invadens
VAFLKTEILMQMKTCFAPLLQSFDLS

SEQ ID NO: 3021200 - protein, 25 aa, Entamoeba invadens
VAFLTTPTHFSLFIGLSVATYPSSK

SEQ ID NO: 3021201 - protein, 28 aa, Entamoeba invadens
VAFSNSYIRVFYKGVDFSFCLQHHCWIL

SEQ ID NO: 3021202 - protein, 17 aa, Entamoeba invadens
VAFSVRQHCKISVWVEA

SEQ ID NO: 3021203 - protein, 22 aa, Entamoeba invadens
VAFTHFKLVQTQFPPVDCVPLS

SEQ ID NO: 3021204 - protein, 28 aa, Entamoeba invadens
VAFYFDQGYLYLCLCALYANPHDPIQNE

SEQ ID NO: 3021205 - protein, 22 aa, Entamoeba invadens
VAFYNIIVWHQVDYQVVIDNKD

SEQ ID NO: 3021206 - protein, 27 aa, Entamoeba invadens
VAGAEKIWIYPYIKEADFVYTTFMAYE

SEQ ID NO: 3021207 - protein, 23 aa, Entamoeba invadens
VAGNPAKFIRKVDEHPGWTPEDR

SEQ ID NO: 3021208 - protein, 22 aa, Entamoeba invadens
VAHDSHIPFRDCKLTTVLENAM

SEQ ID NO: 3021209 - protein, 20 aa, Entamoeba invadens
VAHLAAMEASLPFLHFFDGF

SEQ ID NO: 3021210 - protein, 22 aa, Entamoeba invadens
VAICDYLLTISPSVVVLNVTEK

SEQ ID NO: 3021211 - protein, 25 aa, Entamoeba invadens
VAIFRQLFLCLKDERFDIWNCSLQT

SEQ ID NO: 3021212 - protein, 19 aa, Entamoeba invadens
VAIIALLQRNNEIVGKIQL

SEQ ID NO: 3021213 - protein, 20 aa, Entamoeba invadens
VAIKILRSKLAFFRQGMLEI

SEQ ID NO: 3021214 - protein, 28 aa, Entamoeba invadens
VAITNKPIKFLFPRLVDRNKFILCGNGF

SEQ ID NO: 3021215 - protein, 43 aa, Entamoeba invadens
VAIYLACDEVVTYTLFIGGLPPKFDVAALKKLFANYDASNFRV

SEQ ID NO: 3021216 - protein, 24 aa, Entamoeba invadens
VAIYNQHIPLVDLILSLYQKTNQL

SEQ ID NO: 3021217 - protein, 19 aa, Entamoeba invadens
VAKAKKQAKQYARKVEEAE

SEQ ID NO: 3021218 - protein, 29 aa, Entamoeba invadens
VAKEHQNEKLLIDQLKETKNEKDKIVEQI

SEQ ID NO: 3021219 - protein, 25 aa, Entamoeba invadens
VAKERLMNVLAFCGLEQANQTAFDK

SEQ ID NO: 3021220 - protein, 26 aa, Entamoeba invadens
VAKEYSPMAFAIIRRFFGVSDREMMR

SEQ ID NO: 3021221 - protein, 20 aa, Entamoeba invadens
VAKFGYFERLKEFATFHSCP

SEQ ID NO: 3021222 - protein, 19 aa, Entamoeba invadens
VAKKPNYSILLPGAENKEQ

SEQ ID NO: 3021223 - protein, 26 aa, Entamoeba invadens
VAKKVFVHIIVWFSVDFETVDKNKSR

SEQ ID NO: 3021224 - protein, 35 aa, Entamoeba invadens
VAKKVIVNIAKKLIPKFKPIRKHCECIPTDIPCKE

SEQ ID NO: 3021225 - protein, 19 aa, Entamoeba invadens
VAKSMEAKKLLYIPSDNLE

SEQ ID NO: 3021226 - protein, 17 aa, Entamoeba invadens
VAKYLYTFGYQNSTFEN

SEQ ID NO: 3021227 - protein, 23 aa, Entamoeba invadens
VALAWVDITLKLQKAFLTAVENK

SEQ ID NO: 3021228 - protein, 18 aa, Entamoeba invadens
VALCIGDSKLYHYNSKNK

SEQ ID NO: 3021229 - protein, 18 aa, Entamoeba invadens
VALKILKNQLVYLRQGML

SEQ ID NO: 3021230 - protein, 19 aa, Entamoeba invadens
VALKRRNPLKNWAAMVKLN

SEQ ID NO: 3021231 - protein, 28 aa, Entamoeba invadens
VALKRRNPLKNWAAMVKLNPYCKIASMR

SEQ ID NO: 3021232 - protein, 18 aa, Entamoeba invadens
VALLFGNARVGRRAIRER

SEQ ID NO: 3021233 - protein, 18 aa, Entamoeba invadens
VALLHTVQVYSALSDIFV

SEQ ID NO: 3021234 - protein, 19 aa, Entamoeba invadens
VALLTSRLIRLESEYRVIH

SEQ ID NO: 3021235 - protein, 20 aa, Entamoeba invadens
VALSFIPIKTIAFSETDIID

SEQ ID NO: 3021236 - protein, 23 aa, Entamoeba invadens
VAMERRCVYMFGSNLEKSPKGWV

SEQ ID NO: 3021237 - protein, 17 aa, Entamoeba invadens
VAMLLHYGVPPETLLLP

SEQ ID NO: 3021238 - protein, 19 aa, Entamoeba invadens
VAMSLYQNLLFVNKGKSDS

SEQ ID NO: 3021239 - protein, 19 aa, Entamoeba invadens
VANLPVTCIMLTHSHGDHI

SEQ ID NO: 3021240 - protein, 26 aa, Entamoeba invadens
VANNIFFNISMLALGFQTACVVKNKT

SEQ ID NO: 3021241 - protein, 26 aa, Entamoeba invadens
VANPEIPIALRISGHLLLGICRIYTR

SEQ ID NO: 3021242 - protein, 17 aa, Entamoeba invadens
VAPIEVVPPTPPKPQRL

SEQ ID NO: 3021243 - protein, 19 aa, Entamoeba invadens
VAPLPKPPKQKVVPSTPVV

SEQ ID NO: 3021244 - protein, 20 aa, Entamoeba invadens
VAPMYMLQRAPFPIVGSVQQ

SEQ ID NO: 3021245 - protein, 26 aa, Entamoeba invadens
VAPNEFKDFALLLKTIPDSVNVKLDN

SEQ ID NO: 3021246 - protein, 24 aa, Entamoeba invadens
VAPQKKEYPPPLSINPLSLQQNVQ

SEQ ID NO: 3021247 - protein, 25 aa, Entamoeba invadens
VAQEIYQQLPHYLQVKLQNTVAHLT

SEQ ID NO: 3021248 - protein, 31 aa, Entamoeba invadens
VAQMFMKNLLKCNKIFFVKSDIQKYLKIVEN

SEQ ID NO: 3021249 - protein, 22 aa, Entamoeba invadens
VAQRMTCMMLRYGLEKKNWPKG

SEQ ID NO: 3021250 - protein, 27 aa, Entamoeba invadens
VAQTPINFFEQYTLFSFTASSDKKWEY

SEQ ID NO: 3021251 - protein, 37 aa, Entamoeba invadens
VARECIIRMYCKCLYFGIKPVFVFDGNTNTFLKESTL

SEQ ID NO: 3021252 - protein, 22 aa, Entamoeba invadens
VARLYHWRHPNIVGFEGCWIFD

SEQ ID NO: 3021253 - protein, 17 aa, Entamoeba invadens
VARNFFKQLLSGVKYCH

SEQ ID NO: 3021254 - protein, 32 aa, Entamoeba invadens
VARNLNMFVSTYFKVERMLLGFTIAEPNFCAL

SEQ ID NO: 3021255 - protein, 24 aa, Entamoeba invadens
VARQVVEPVPILHAPPKKATKEEM

SEQ ID NO: 3021256 - protein, 42 aa, Entamoeba invadens
VARSVLYSIIQLYLRSGFYGRVLDYHIELIMLDNLESVKVFE

SEQ ID NO: 3021257 - protein, 34 aa, Entamoeba invadens
VASIVIFPFEQSLHLLPSKYLYGLNLSHVKHFPL

SEQ ID NO: 3021258 - protein, 23 aa, Entamoeba invadens
VASYFFTTNIIGVPIISVVQNLI

SEQ ID NO: 3021259 - protein, 25 aa, Entamoeba invadens
VATIQLDFQLPLRFELEYMSEDPKQ

SEQ ID NO: 3021260 - protein, 23 aa, Entamoeba invadens
VATNLRELYLAKNNLFYDGISAE

SEQ ID NO: 3021261 - protein, 24 aa, Entamoeba invadens
VATPISTYKAIYTYNSYEKRININ

SEQ ID NO: 3021262 - protein, 24 aa, Entamoeba invadens
VATSTYLALNWQSAGAGSIGCIPL

SEQ ID NO: 3021263 - protein, 19 aa, Entamoeba invadens
VATSYMRKGQEIKLALWDT

SEQ ID NO: 3021264 - protein, 23 aa, Entamoeba invadens
VATTFGNQYFTQVNNRLPLANTI

SEQ ID NO: 3021265 - protein, 29 aa, Entamoeba invadens
VATVVDVQLVHGLFLLGVVGGHAQGAGLH

SEQ ID NO: 3021266 - protein, 24 aa, Entamoeba invadens
VAVGPHAFYFIYKGKVGKGKNRTY

SEQ ID NO: 3021267 - protein, 23 aa, Entamoeba invadens
VAVLESCNGLIIGSILRAVTDNL

SEQ ID NO: 3021268 - protein, 20 aa, Entamoeba invadens
VAVLLLLEVIEPFEWVHLLI

SEQ ID NO: 3021269 - protein, 22 aa, Entamoeba invadens
VAVLPAFMFFAKLTFGKTKECD

SEQ ID NO: 3021270 - protein, 23 aa, Entamoeba invadens
VAVQAVLVLYAQGISTGVVVDSG

SEQ ID NO: 3021271 - protein, 23 aa, Entamoeba invadens
VAVVKILPDKLAYIEDITLCEKL

SEQ ID NO: 3021272 - protein, 21 aa, Entamoeba invadens
VAVVLPDNFFKSAVSNYKLTI

SEQ ID NO: 3021273 - protein, 17 aa, Entamoeba invadens
VAYERVVRYIKYLFGVL

SEQ ID NO: 3021274 - protein, 25 aa, Entamoeba invadens
VCAFCPDRFFGFTFNDTITDHKVDT

SEQ ID NO: 3021275 - protein, 22 aa, Entamoeba invadens
VCAHNMLRFEKILISFLEEDEW

SEQ ID NO: 3021276 - protein, 29 aa, Entamoeba invadens
VCANKLHTFGLTLPIKRLDLSANFFTTIT

SEQ ID NO: 3021277 - protein, 28 aa, Entamoeba invadens
VCCEVTRSGLFLLYSNDTKCVLFKLADS

SEQ ID NO: 3021278 - protein, 30 aa, Entamoeba invadens
VCCKSAVQAFLPRFPPEKLFKRDEVFKEWL

SEQ ID NO: 3021279 - protein, 22 aa, Entamoeba invadens
VCDIIEWAVLHNIQRVKSVCWE

SEQ ID NO: 3021280 - protein, 40 aa, Entamoeba invadens
VCDKKPFVCISVGGWIGVAKIPDFIASCLKITTLNPELKK

SEQ ID NO: 3021281 - protein, 22 aa, Entamoeba invadens
VCDNLYVKIGRRCIKTQTETTE

SEQ ID NO: 3021282 - protein, 18 aa, Entamoeba invadens
VCDRFYCKECVLGKFLFS

SEQ ID NO: 3021283 - protein, 35 aa, Entamoeba invadens
VCDTTPTLSLLLSPIFHFLLPFLTSQNEVPDLPKS

SEQ ID NO: 3021284 - protein, 18 aa, Entamoeba invadens
VCDVPPKGLNLSGTFIGN

SEQ ID NO: 3021285 - protein, 25 aa, Entamoeba invadens
VCECNPIFVGIEFIEELYLLGCNCD

SEQ ID NO: 3021286 - protein, 17 aa, Entamoeba invadens
VCEYICEELVRLGLLVP

SEQ ID NO: 3021287 - protein, 18 aa, Entamoeba invadens
VCFGNSPYYMYKFGEDKD

SEQ ID NO: 3021288 - protein, 18 aa, Entamoeba invadens
VCFGVVMKALLSLDSVKM

SEQ ID NO: 3021289 - protein, 18 aa, Entamoeba invadens
VCFLLSKDDFHHGKTVDF

SEQ ID NO: 3021290 - protein, 46 aa, Entamoeba invadens
VCGKENIMIIVITTEGYSFGVFSKKPLPKAPKKGYKYVKDDKDFFV

SEQ ID NO: 3021291 - protein, 33 aa, Entamoeba invadens
VCGKVNLKFDSYIFWSLTIPNKTKLVKFTVFDK

SEQ ID NO: 3021292 - protein, 19 aa, Entamoeba invadens
VCGRDVFLDCPNLVKFNVI

SEQ ID NO: 3021293 - protein, 26 aa, Entamoeba invadens
VCGSAIFLKLCEISVGFLVIPNFVKE

SEQ ID NO: 3021294 - protein, 19 aa, Entamoeba invadens
VCGTHCGFYIGSVRNSFIS

SEQ ID NO: 3021295 - protein, 22 aa, Entamoeba invadens
VCGYIIVIVTKDEIKFVTTEGS

SEQ ID NO: 3021296 - protein, 28 aa, Entamoeba invadens
VCHVNMGFVWMRITRVYQAPSCWGNATK

SEQ ID NO: 3021297 - protein, 17 aa, Entamoeba invadens
VCIKREFFLSQKTRRIV

SEQ ID NO: 3021298 - protein, 19 aa, Entamoeba invadens
VCIWANNCRAYSFTVKRFI

SEQ ID NO: 3021299 - protein, 19 aa, Entamoeba invadens
VCKGTVKPFPPFLEDKWYT

SEQ ID NO: 3021300 - protein, 31 aa, Entamoeba invadens
VCKHVNLRFDPYVFISLQLPNKMSTVSFNVY

SEQ ID NO: 3021301 - protein, 20 aa, Entamoeba invadens
VCKKAPSLIILNGCEHDLVC

SEQ ID NO: 3021302 - protein, 29 aa, Entamoeba invadens
VCKKFACILDRFRYNPIPVTSTRLFPCME

SEQ ID NO: 3021303 - protein, 26 aa, Entamoeba invadens
VCKKFKEIPLMFHFNPIQWNPKMVNY

SEQ ID NO: 3021304 - protein, 27 aa, Entamoeba invadens
VCKKYSTLLFKFHYNPIPLTSTTRKFF

SEQ ID NO: 3021305 - protein, 17 aa, Entamoeba invadens
VCKLYIDLGKLEEAMVV

SEQ ID NO: 3021306 - protein, 26 aa, Entamoeba invadens
VCKNFTLADGTFWPIPITMSVSEEDA

SEQ ID NO: 3021307 - protein, 20 aa, Entamoeba invadens
VCKPILKLFEIIGNLICCTY

SEQ ID NO: 3021308 - protein, 28 aa, Entamoeba invadens
VCKTKIVVFVGILGKTVFFVGIKMGCVP

SEQ ID NO: 3021309 - protein, 18 aa, Entamoeba invadens
VCLAPTLFSFEDIDTLSL

SEQ ID NO: 3021310 - protein, 18 aa, Entamoeba invadens
VCLDVFIVIFSSLKKQEA

SEQ ID NO: 3021311 - protein, 18 aa, Entamoeba invadens
VCLGFMVDGVLKIGVLGC

SEQ ID NO: 3021312 - protein, 25 aa, Entamoeba invadens
VCLKRIYVPIVRYLRAYFSKNTALD

SEQ ID NO: 3021313 - protein, 40 aa, Entamoeba invadens
VCLSASDNRWILVIHPEYGIGYVPLLYVTCDKSFLTMEIH

SEQ ID NO: 3021314 - protein, 25 aa, Entamoeba invadens
VCLSDNLLFFFVKDAKSSKPHFVID

SEQ ID NO: 3021315 - protein, 20 aa, Entamoeba invadens
VCLSILRPFATTEAPLFHDK

SEQ ID NO: 3021316 - protein, 21 aa, Entamoeba invadens
VCLVYQLLQYYEGLIGDEELA

SEQ ID NO: 3021317 - protein, 19 aa, Entamoeba invadens
VCNFGALKPLDPFDAIMEA

SEQ ID NO: 3021318 - protein, 21 aa, Entamoeba invadens
VCNRYYFTGFIKEQVVSVVMK

SEQ ID NO: 3021319 - protein, 26 aa, Entamoeba invadens
VCPEPALILLDFLVATLKENIKPMFN

SEQ ID NO: 3021320 - protein, 23 aa, Entamoeba invadens
VCPGDTFVLRWTSDEQLAMRFGP

SEQ ID NO: 3021321 - protein, 36 aa, Entamoeba invadens
VCPYHYSKWVVTKVRLVLCPYNFITNPSIRSTSSIF

SEQ ID NO: 3021322 - protein, 19 aa, Entamoeba invadens
VCPYMGCGKTYLSEESLTR

SEQ ID NO: 3021323 - protein, 22 aa, Entamoeba invadens
VCQTLCDILDKTDFWGDGVFFD

SEQ ID NO: 3021324 - protein, 20 aa, Entamoeba invadens
VCREGFFPEKTCKSCRMIYG

SEQ ID NO: 3021325 - protein, 17 aa, Entamoeba invadens
VCRKFMENITKFHFNPI

SEQ ID NO: 3021326 - protein, 22 aa, Entamoeba invadens
VCRLVNELLLVEVTPVKFIQLM

SEQ ID NO: 3021327 - protein, 33 aa, Entamoeba invadens
VCSLNNPFYECISLDKFYTLTLSQPFVSDPSVF

SEQ ID NO: 3021328 - protein, 26 aa, Entamoeba invadens
VCSVCQEGYYLSLDNLCYLGDVNNCK

SEQ ID NO: 3021329 - protein, 30 aa, Entamoeba invadens
VCTECKDGFYLKDNTCLPCTLIGCFKCTKF

SEQ ID NO: 3021330 - protein, 20 aa, Entamoeba invadens
VCTHFFENTIFLLHPDRKVS

SEQ ID NO: 3021331 - protein, 24 aa, Entamoeba invadens
VCTLKAMLLANDLIKKTGALPVPM

SEQ ID NO: 3021332 - protein, 18 aa, Entamoeba invadens
VCVESFMFPFSFQKCEFD

SEQ ID NO: 3021333 - protein, 35 aa, Entamoeba invadens
VCVLLGGLTRILKFLLPFVVDKLPIVFGKFIKVTD

SEQ ID NO: 3021334 - protein, 18 aa, Entamoeba invadens
VCVNAFDVLYLDGVDLMR

SEQ ID NO: 3021335 - protein, 25 aa, Entamoeba invadens
VCVNGVLTMCYGVDGVPAYVDFTKN

SEQ ID NO: 3021336 - protein, 19 aa, Entamoeba invadens
VCVYISYLSDIILEPLYKT

SEQ ID NO: 3021337 - protein, 20 aa, Entamoeba invadens
VCWHLFPSLKCSFIIRYSVK

SEQ ID NO: 3021338 - protein, 18 aa, Entamoeba invadens
VCYAIWDLNLLISNLQRE

SEQ ID NO: 3021339 - protein, 18 aa, Entamoeba invadens
VCYLLNDWSFVDKTKLFD

SEQ ID NO: 3021340 - protein, 28 aa, Entamoeba invadens
VCYPKMVMLTPSYWFPNASVAFYNIIVW

SEQ ID NO: 3021341 - protein, 17 aa, Entamoeba invadens
VCYSCCFRNRVLYQDNN

SEQ ID NO: 3021342 - protein, 25 aa, Entamoeba invadens
VDAATLRLTLFDFLNRCLAYRPDER

SEQ ID NO: 3021343 - protein, 31 aa, Entamoeba invadens
VDAEEFISRLILPLTRLLPNPILRDTTMDVF

SEQ ID NO: 3021344 - protein, 18 aa, Entamoeba invadens
VDAEPCYILFRTEEKDDL

SEQ ID NO: 3021345 - protein, 25 aa, Entamoeba invadens
VDAIAKYITLWPKSFGLSFDQLKAS

SEQ ID NO: 3021346 - protein, 17 aa, Entamoeba invadens
VDAIREFLLQCGLHPHI

SEQ ID NO: 3021347 - protein, 26 aa, Entamoeba invadens
VDALCNIILTCPITVDCVSFIFDVLS

SEQ ID NO: 3021348 - protein, 18 aa, Entamoeba invadens
VDALYKLKEQKIADYVKR

SEQ ID NO: 3021349 - protein, 18 aa, Entamoeba invadens
VDAQKPFVCLEYVKKMLL

SEQ ID NO: 3021350 - protein, 28 aa, Entamoeba invadens
VDARNFKDLFFSGKYLDLIGYVVRVTEI

SEQ ID NO: 3021351 - protein, 29 aa, Entamoeba invadens
VDAVELVPIIYYPISKKPTSLIFIREFRV

SEQ ID NO: 3021352 - protein, 22 aa, Entamoeba invadens
VDAYGDVETIPNAARTLHQTKG

SEQ ID NO: 3021353 - protein, 25 aa, Entamoeba invadens
VDAYVEMYNLFLTSLLHSSVDISDK

SEQ ID NO: 3021354 - protein, 21 aa, Entamoeba invadens
VDCILPPSLEVYCGCAMYNTL

SEQ ID NO: 3021355 - protein, 23 aa, Entamoeba invadens
VDCIRSVFYHINPLLINTFNTKE

SEQ ID NO: 3021356 - protein, 24 aa, Entamoeba invadens
VDCKLFIADITLPDGIYPVSHLRH

SEQ ID NO: 3021357 - protein, 26 aa, Entamoeba invadens
VDCRRTMVLRYFGENFDPKWCNKTCD

SEQ ID NO: 3021358 - protein, 22 aa, Entamoeba invadens
VDCRSTFLRNIVVSGGSSLLPN

SEQ ID NO: 3021359 - protein, 17 aa, Entamoeba invadens
VDDFCFCGCYALTSIHL

SEQ ID NO: 3021360 - protein, 26 aa, Entamoeba invadens
VDDIINAWAILIKVKDSMQVGSYDRA

SEQ ID NO: 3021361 - protein, 22 aa, Entamoeba invadens
VDDKRFRVARYPNYEYTDTSHQ

SEQ ID NO: 3021362 - protein, 19 aa, Entamoeba invadens
VDDKWFDKMTIDSGEVALK

SEQ ID NO: 3021363 - protein, 17 aa, Entamoeba invadens
VDDLVLSPALKESLKES

SEQ ID NO: 3021364 - protein, 26 aa, Entamoeba invadens
VDDNQYMLMEWSFIAIIYSMKGSKDN

SEQ ID NO: 3021365 - protein, 23 aa, Entamoeba invadens
VDDPPLGFYLKSGGTYFYRCKHG

SEQ ID NO: 3021366 - protein, 26 aa, Entamoeba invadens
VDDQNAFVFSLFSNGRMKEPQKFELK

SEQ ID NO: 3021367 - protein, 23 aa, Entamoeba invadens
VDEAVLLGIIKRDSFSKSSETEQ

SEQ ID NO: 3021368 - protein, 25 aa, Entamoeba invadens
VDEDDLFVFYQLLELGCLVTSKTLE

SEQ ID NO: 3021369 - protein, 29 aa, Entamoeba invadens
VDEELQPRTKKLKPSRRNLLKKLQNEKRE

SEQ ID NO: 3021370 - protein, 25 aa, Entamoeba invadens
VDEFLRWRTLCWKSFEWKDLTFFMA

SEQ ID NO: 3021371 - protein, 31 aa, Entamoeba invadens
VDEFTHKNKKLLKPMKSLKQSRKTNLQKKRR

SEQ ID NO: 3021372 - protein, 18 aa, Entamoeba invadens
VDEFVFGMKKMMGVDTFA

SEQ ID NO: 3021373 - protein, 23 aa, Entamoeba invadens
VDEGTLFIGRKRVGMMKGSRTFG

SEQ ID NO: 3021374 - protein, 18 aa, Entamoeba invadens
VDEKFYFPDPPQNFLCCD

SEQ ID NO: 3021375 - protein, 25 aa, Entamoeba invadens
VDEKLHLTEYLALGTVMVWSCFTAA

SEQ ID NO: 3021376 - protein, 27 aa, Entamoeba invadens
VDELCKTILLLIDSYNPHVRYGAALAL

SEQ ID NO: 3021377 - protein, 25 aa, Entamoeba invadens
VDELRFKSFWNFKKIDVTLLEQAES

SEQ ID NO: 3021378 - protein, 26 aa, Entamoeba invadens
VDELSEPIVYKELPTFKPTSFSNEPK

SEQ ID NO: 3021379 - protein, 21 aa, Entamoeba invadens
VDEMFDFIDLFKSVVSICEDE

SEQ ID NO: 3021380 - protein, 34 aa, Entamoeba invadens
VDENFSKIPLIDLIHFLPLIMKSYLESSVVKNRS

SEQ ID NO: 3021381 - protein, 24 aa, Entamoeba invadens
VDEQAFWFCIQNADDWYLHLNGEL

SEQ ID NO: 3021382 - protein, 23 aa, Entamoeba invadens
VDEQLQMVRSEKEKLLGDLANGS

SEQ ID NO: 3021383 - protein, 25 aa, Entamoeba invadens
VDEQYHITEYLALGATMAVSYASGI

SEQ ID NO: 3021384 - protein, 24 aa, Entamoeba invadens
VDETIIQLWLVNHLIPHIEMTRRL

SEQ ID NO: 3021385 - protein, 24 aa, Entamoeba invadens
VDEVEKFMKLYSSTYPFPAVEPFS

SEQ ID NO: 3021386 - protein, 29 aa, Entamoeba invadens
VDEVVLKALLFKLLGKEGLALRIYFQLDY

SEQ ID NO: 3021387 - protein, 20 aa, Entamoeba invadens
VDFALAKYLQETFGVKVVVQ

SEQ ID NO: 3021388 - protein, 27 aa, Entamoeba invadens
VDFGDKLLHLFLKPTPINMDKVEGTTI

SEQ ID NO: 3021389 - protein, 29 aa, Entamoeba invadens
VDFGESFVSMFPFYNSTYLFNASDKQAFG

SEQ ID NO: 3021390 - protein, 19 aa, Entamoeba invadens
VDFHLTVVGLTKPIKIAQG

SEQ ID NO: 3021391 - protein, 21 aa, Entamoeba invadens
VDFIFVMFYDECSLVRTSVES

SEQ ID NO: 3021392 - protein, 17 aa, Entamoeba invadens
VDFIPILGQARSVSILT

SEQ ID NO: 3021393 - protein, 26 aa, Entamoeba invadens
VDFNEVLPFHRRALKTLLESEELAKK

SEQ ID NO: 3021394 - protein, 19 aa, Entamoeba invadens
VDFNYMETIALVIGLLILL

SEQ ID NO: 3021395 - protein, 20 aa, Entamoeba invadens
VDFPIELKGIKYSISVKFGS

SEQ ID NO: 3021396 - protein, 18 aa, Entamoeba invadens
VDFPLTYERGWGKKLEYC

SEQ ID NO: 3021397 - protein, 23 aa, Entamoeba invadens
VDFSFCHKPYVSHSFYFVDDITN

SEQ ID NO: 3021398 - protein, 19 aa, Entamoeba invadens
VDFSNAKVFLFDLSNPTSL

SEQ ID NO: 3021399 - protein, 18 aa, Entamoeba invadens
VDFVHRFGRDMGDQPPYN

SEQ ID NO: 3021400 - protein, 22 aa, Entamoeba invadens
VDFVHYIRPFLVEGLSFKTDSP

SEQ ID NO: 3021401 - protein, 46 aa, Entamoeba invadens
VDGAHIRTLLLTFFYRQMPDLVERGHIYIAQPPLYKVKNGKEELYI

SEQ ID NO: 3021402 - protein, 22 aa, Entamoeba invadens
VDGDVLQTYYIQQTAIHKRRNS

SEQ ID NO: 3021403 - protein, 23 aa, Entamoeba invadens
VDGEVPLFQVAYEDFFASLGAVT

SEQ ID NO: 3021404 - protein, 21 aa, Entamoeba invadens
VDGIPLFCTYSELISKKPKVA

SEQ ID NO: 3021405 - protein, 23 aa, Entamoeba invadens
VDGKCVLTDSIICKEFVGNVCTQ

SEQ ID NO: 3021406 - protein, 25 aa, Entamoeba invadens
VDGKVYRIPVLYAPQFDRVNRKEEM

SEQ ID NO: 3021407 - protein, 23 aa, Entamoeba invadens
VDGKYYYLYKNDSNYWTLSTRSD

SEQ ID NO: 3021408 - protein, 22 aa, Entamoeba invadens
VDGLHAWFDMYDAFEKSNGVVL

SEQ ID NO: 3021409 - protein, 22 aa, Entamoeba invadens
VDGRLLFVHTKRNLFTKIKEVL

SEQ ID NO: 3021410 - protein, 18 aa, Entamoeba invadens
VDGSFLINQPFAAAKAFY

SEQ ID NO: 3021411 - protein, 31 aa, Entamoeba invadens
VDGSVLVNNPFFLSYPLIIGEYGMAIPKAQL

SEQ ID NO: 3021412 - protein, 24 aa, Entamoeba invadens
VDGYSYILEILDTVDLDIYNTIRD

SEQ ID NO: 3021413 - protein, 23 aa, Entamoeba invadens
VDHDIIFWMGDLNYRIDEEDATI

SEQ ID NO: 3021414 - protein, 25 aa, Entamoeba invadens
VDHNILELFLFKICDLLVLKARTIV

SEQ ID NO: 3021415 - protein, 24 aa, Entamoeba invadens
VDHNLYNLIYPIHDGVITNFDEME

SEQ ID NO: 3021416 - protein, 30 aa, Entamoeba invadens
VDICGDYRPFIVIPKNFKYETFVLKNALEE

SEQ ID NO: 3021417 - protein, 26 aa, Entamoeba invadens
VDIEERYLIELKASLKTQRDFIIQLQ

SEQ ID NO: 3021418 - protein, 19 aa, Entamoeba invadens
VDIFFKIMLEERYVFVTNS

SEQ ID NO: 3021419 - protein, 27 aa, Entamoeba invadens
VDIFNLGCLFYFIALKRYTFEVLIDRL

SEQ ID NO: 3021420 - protein, 21 aa, Entamoeba invadens
VDIHFLGCIKILENSAFENCE

SEQ ID NO: 3021421 - protein, 37 aa, Entamoeba invadens
VDIKEVITPTPPLSPLVQLVLVLPPKSSRFLPLPLQT

SEQ ID NO: 3021422 - protein, 30 aa, Entamoeba invadens
VDIKIQRKLFKTVFLYFQPCKSYAIYMGDR

SEQ ID NO: 3021423 - protein, 25 aa, Entamoeba invadens
VDIKPTTLLHLPDEKIYSFLVTPQQ

SEQ ID NO: 3021424 - protein, 25 aa, Entamoeba invadens
VDILRLTRLRLGNGYVFVYLSAQGS

SEQ ID NO: 3021425 - protein, 18 aa, Entamoeba invadens
VDINLLTKPLFDDYAQSP

SEQ ID NO: 3021426 - protein, 39 aa, Entamoeba invadens
VDINRACNLSLFTALRRVTIYNFQWAIPIESIFPNKSQR

SEQ ID NO: 3021427 - protein, 25 aa, Entamoeba invadens
VDISNAMLKFVDPENDIFNYVLQFK

SEQ ID NO: 3021428 - protein, 33 aa, Entamoeba invadens
VDKCTVETFYLLRKIVPPYKGLASACEQYYKSQ

SEQ ID NO: 3021429 - protein, 23 aa, Entamoeba invadens
VDKDGHLLLTDFGLSVVGICSES

SEQ ID NO: 3021430 - protein, 26 aa, Entamoeba invadens
VDKERPYIPGFLPELPDPRTYKSTAI

SEQ ID NO: 3021431 - protein, 24 aa, Entamoeba invadens
VDKIDQSLFLQIAAQKLQDPDTEA

SEQ ID NO: 3021432 - protein, 34 aa, Entamoeba invadens
VDKKSPLDPPNFLWRILYEKIYDFGLEGTHICVY

SEQ ID NO: 3021433 - protein, 24 aa, Entamoeba invadens
VDKLSYFITFIARTLLDDSLDLEQ

SEQ ID NO: 3021434 - protein, 27 aa, Entamoeba invadens
VDKSLCFEIVYDKQFVFLCQNDAIYKE

SEQ ID NO: 3021435 - protein, 19 aa, Entamoeba invadens
VDKSYFERYSKLKNLSRSR

SEQ ID NO: 3021436 - protein, 20 aa, Entamoeba invadens
VDKTTWFRISQNLYQNVFSN

SEQ ID NO: 3021437 - protein, 19 aa, Entamoeba invadens
VDKVFAILGITMESEIDLP

SEQ ID NO: 3021438 - protein, 25 aa, Entamoeba invadens
VDKYATLIQLLKTDFLKCVGSFVYF

SEQ ID NO: 3021439 - protein, 21 aa, Entamoeba invadens
VDLCYTPMVLSKLFNESKTYR

SEQ ID NO: 3021440 - protein, 23 aa, Entamoeba invadens
VDLEDVILLTFARAITDVLVTYQ

SEQ ID NO: 3021441 - protein, 30 aa, Entamoeba invadens
VDLFDRIYKQFVAMFTRKAFVYLYTEEGME

SEQ ID NO: 3021442 - protein, 17 aa, Entamoeba invadens
VDLFKKCAVENLIIQVG

SEQ ID NO: 3021443 - protein, 17 aa, Entamoeba invadens
VDLFNTILTLKSSTSAG

SEQ ID NO: 3021444 - protein, 17 aa, Entamoeba invadens
VDLFYICNQVRNVNFCQ

SEQ ID NO: 3021445 - protein, 25 aa, Entamoeba invadens
VDLGNIFVLPPRCFFGCKALKEIDL

SEQ ID NO: 3021446 - protein, 26 aa, Entamoeba invadens
VDLIFGFHQNFMRLLVMTRYLKFDHP

SEQ ID NO: 3021447 - protein, 17 aa, Entamoeba invadens
VDLIKQYSLYVSQETLQ

SEQ ID NO: 3021448 - protein, 23 aa, Entamoeba invadens
VDLKKCGVLGIFLLAMEMVFTDE

SEQ ID NO: 3021449 - protein, 23 aa, Entamoeba invadens
VDLKLSHIPFPSLVEKWFDFMPS

SEQ ID NO: 3021450 - protein, 25 aa, Entamoeba invadens
VDLLSMVLVPFKFLSKMYKNSTQLK

SEQ ID NO: 3021451 - protein, 35 aa, Entamoeba invadens
VDLNIKRTIVLTKSFFNIIVWFNVDYKTIFINKNK

SEQ ID NO: 3021452 - protein, 17 aa, Entamoeba invadens
VDLPGLVKVSVVGQAKE

SEQ ID NO: 3021453 - protein, 24 aa, Entamoeba invadens
VDLQRFEYLLNTYGKFFTDKTAFT

SEQ ID NO: 3021454 - protein, 18 aa, Entamoeba invadens
VDLRKKANRFLAGKVTLA

SEQ ID NO: 3021455 - protein, 20 aa, Entamoeba invadens
VDLTPFSVSLKDQLDYMELE

SEQ ID NO: 3021456 - protein, 18 aa, Entamoeba invadens
VDLTRIPFPVCITQARSF

SEQ ID NO: 3021457 - protein, 19 aa, Entamoeba invadens
VDLVLPLHTTLQDLVDRLT

SEQ ID NO: 3021458 - protein, 17 aa, Entamoeba invadens
VDLYQRYCRVYGLSYEE

SEQ ID NO: 3021459 - protein, 24 aa, Entamoeba invadens
VDMFRNYIYRVLEKDLSEHIPIVL

SEQ ID NO: 3021460 - protein, 20 aa, Entamoeba invadens
VDMKIRIKFMIDAAKGILYL

SEQ ID NO: 3021461 - protein, 18 aa, Entamoeba invadens
VDMKMRVKILLKASNVIS

SEQ ID NO: 3021462 - protein, 20 aa, Entamoeba invadens
VDMKMRVKILLNAANGFSYL

SEQ ID NO: 3021463 - protein, 28 aa, Entamoeba invadens
VDMQCNASMLMILNTPLIQYIVEHLLAQ

SEQ ID NO: 3021464 - protein, 20 aa, Entamoeba invadens
VDNACFYGCLSLQSVEFANT

SEQ ID NO: 3021465 - protein, 32 aa, Entamoeba invadens
VDNFVLLKKKEGFLPNVLYIVESTVPLVNRTP

SEQ ID NO: 3021466 - protein, 23 aa, Entamoeba invadens
VDNYVPPIDLICKILAKTNEEQP

SEQ ID NO: 3021467 - protein, 39 aa, Entamoeba invadens
VDPIAKSRAKTISRNRMTITGYEFKRKLTTESDQSLNRE

SEQ ID NO: 3021468 - protein, 24 aa, Entamoeba invadens
VDPKSVYFFHSKLREIHPIMQHAN

SEQ ID NO: 3021469 - protein, 22 aa, Entamoeba invadens
VDPMIDLLLTYDQFIDTAGNID

SEQ ID NO: 3021470 - protein, 24 aa, Entamoeba invadens
VDPNMPWHISAFHPDYLMDNIPPT

SEQ ID NO: 3021471 - protein, 17 aa, Entamoeba invadens
VDPNVYQAYTWIEQNRN

SEQ ID NO: 3021472 - protein, 22 aa, Entamoeba invadens
VDPSGAFWTWKATALGKNMTTV

SEQ ID NO: 3021473 - protein, 33 aa, Entamoeba invadens
VDPSKIIWVVNCGIVPLLFDLFLSTEDSQIMSC

SEQ ID NO: 3021474 - protein, 24 aa, Entamoeba invadens
VDPSVIEGLLRTMEGFKQQHEMVR

SEQ ID NO: 3021475 - protein, 22 aa, Entamoeba invadens
VDPVVALAARPARRARHAAAAV

SEQ ID NO: 3021476 - protein, 17 aa, Entamoeba invadens
VDQFAYYQISIPQFTSF

SEQ ID NO: 3021477 - protein, 29 aa, Entamoeba invadens
VDQKNFPRCPWAVTLLYSLSAYKDRLVDT

SEQ ID NO: 3021478 - protein, 28 aa, Entamoeba invadens
VDQLIGAYYVAPLPFLQTVQTSQTSIGL

SEQ ID NO: 3021479 - protein, 26 aa, Entamoeba invadens
VDRDLVVERLKQLEIALLKQNEKIEK

SEQ ID NO: 3021480 - protein, 26 aa, Entamoeba invadens
VDREHGVVLLLIKEMDKLPLEFGWCS

SEQ ID NO: 3021481 - protein, 23 aa, Entamoeba invadens
VDRERLSNACVIGLYVCAGNAMT

SEQ ID NO: 3021482 - protein, 26 aa, Entamoeba invadens
VDRFDLCLKIVLRMICLHALLCAKME

SEQ ID NO: 3021483 - protein, 34 aa, Entamoeba invadens
VDRGDFGCEVLFYLLALKLTYPEKFHLLRGNHES

SEQ ID NO: 3021484 - protein, 31 aa, Entamoeba invadens
VDRGFNSVETFLLLIALKVKYTDHIYLIRGN

SEQ ID NO: 3021485 - protein, 26 aa, Entamoeba invadens
VDRGRYEIKMALPPKIDPSVSVMQVE

SEQ ID NO: 3021486 - protein, 33 aa, Entamoeba invadens
VDRGYYCLETVLLLLSLKVKFPERIIMLRGNHE

SEQ ID NO: 3021487 - protein, 24 aa, Entamoeba invadens
VDRIPVKLWQQKYLNKSFSQTTFW

SEQ ID NO: 3021488 - protein, 26 aa, Entamoeba invadens
VDRLLSILTIFPFNKHKQIMYFFIMT

SEQ ID NO: 3021489 - protein, 24 aa, Entamoeba invadens
VDRPLDELIIANNKINKIRSRNGG

SEQ ID NO: 3021490 - protein, 26 aa, Entamoeba invadens
VDRYSPPWSVQFPEWSKLPLTSDELI

SEQ ID NO: 3021491 - protein, 27 aa, Entamoeba invadens
VDRYSPPWSVQFPEWSKLPLTSDELME

SEQ ID NO: 3021492 - protein, 30 aa, Entamoeba invadens
VDRYTSPWKDQFPEWALLPKTSEELMKEEN

SEQ ID NO: 3021493 - protein, 24 aa, Entamoeba invadens
VDSGWYQLCGVVLFTFVKKSIKSL

SEQ ID NO: 3021494 - protein, 31 aa, Entamoeba invadens
VDSHKPVEIEFFKPLTLIQGPNGAGKTTLIE

SEQ ID NO: 3021495 - protein, 33 aa, Entamoeba invadens
VDSKAIFPVTFIAKFFSYLPKKYFDNFHKLYVF

SEQ ID NO: 3021496 - protein, 18 aa, Entamoeba invadens
VDSKLTHFTISKAGLNQL

SEQ ID NO: 3021497 - protein, 18 aa, Entamoeba invadens
VDSLIAEYVDYGAKYPLA

SEQ ID NO: 3021498 - protein, 19 aa, Entamoeba invadens
VDSLMVNVIILMKVKDFEK

SEQ ID NO: 3021499 - protein, 22 aa, Entamoeba invadens
VDSSRVCTTCRSGLRPNTTSGK

SEQ ID NO: 3021500 - protein, 22 aa, Entamoeba invadens
VDTAAILRFIENANAMIVQSKI

SEQ ID NO: 3021501 - protein, 23 aa, Entamoeba invadens
VDTDCFILCFAMNDQNSFDKIQS

SEQ ID NO: 3021502 - protein, 23 aa, Entamoeba invadens
VDTDFTLTLLHQEKLNKPIAPNK

SEQ ID NO: 3021503 - protein, 28 aa, Entamoeba invadens
VDTFVDKWFYTLFCHWNFYVRQAFQHIV

SEQ ID NO: 3021504 - protein, 34 aa, Entamoeba invadens
VDTKKQIGFITYFSLKTLRRLLASKSRWNVRVTT

SEQ ID NO: 3021505 - protein, 25 aa, Entamoeba invadens
VDTMSYLHFLYIQFERPYSQLFEPE

SEQ ID NO: 3021506 - protein, 30 aa, Entamoeba invadens
VDTNNRYIGYFYLVSFYGKFHCAGKQFVYR

SEQ ID NO: 3021507 - protein, 33 aa, Entamoeba invadens
VDTPTFSLSFYPKKLQICPNSQKFFAVILHPTC

SEQ ID NO: 3021508 - protein, 27 aa, Entamoeba invadens
VDTQPLFVIHLLWLRVYHKVVLEKDKK

SEQ ID NO: 3021509 - protein, 29 aa, Entamoeba invadens
VDTRRFPSYILVCPFPIDLMTILRRVEKG

SEQ ID NO: 3021510 - protein, 24 aa, Entamoeba invadens
VDTSVFVYDFRNLNLRQTFKTCPN

SEQ ID NO: 3021511 - protein, 17 aa, Entamoeba invadens
VDTYLLMDALTNEIEYI

SEQ ID NO: 3021512 - protein, 18 aa, Entamoeba invadens
VDTYPFDVSFWLGAILNS

SEQ ID NO: 3021513 - protein, 20 aa, Entamoeba invadens
VDVAIKWFIPQKYGNVYGQY

SEQ ID NO: 3021514 - protein, 18 aa, Entamoeba invadens
VDVAQFFRTILKGSDQTF

SEQ ID NO: 3021515 - protein, 26 aa, Entamoeba invadens
VDVCNDFFKTFKMPETPILYQQQVVV

SEQ ID NO: 3021516 - protein, 19 aa, Entamoeba invadens
VDVFGRRVTDYIISQNKSR

SEQ ID NO: 3021517 - protein, 22 aa, Entamoeba invadens
VDVLLTLCDFIPKGKQHELVET

SEQ ID NO: 3021518 - protein, 24 aa, Entamoeba invadens
VDVLQFWNVFVKPKFFAHPDISSL

SEQ ID NO: 3021519 - protein, 24 aa, Entamoeba invadens
VDVMHQSWALIMMVICSENVSKLR

SEQ ID NO: 3021520 - protein, 17 aa, Entamoeba invadens
VDVMILPATVKSIEQAA

SEQ ID NO: 3021521 - protein, 25 aa, Entamoeba invadens
VDVRLLYQPIVVKPNKKYVIVKDMK

SEQ ID NO: 3021522 - protein, 18 aa, Entamoeba invadens
VDVYGDLAITWCFQVIAF

SEQ ID NO: 3021523 - protein, 19 aa, Entamoeba invadens
VDYFELVKVLLLNNTQNQK

SEQ ID NO: 3021524 - protein, 27 aa, Entamoeba invadens
VDYHQELFYIIMLMLKTTQLHDKIPLM

SEQ ID NO: 3021525 - protein, 18 aa, Entamoeba invadens
VDYLTTRIVVWTINQVLD

SEQ ID NO: 3021526 - protein, 19 aa, Entamoeba invadens
VDYRFAPNVFAPDMKEMFQ

SEQ ID NO: 3021527 - protein, 28 aa, Entamoeba invadens
VDYSFCFRWIVLLFKRDFETKLCLQVWD

SEQ ID NO: 3021528 - protein, 17 aa, Entamoeba invadens
VDYTLPPTNEPLRTFPP

SEQ ID NO: 3021529 - protein, 30 aa, Entamoeba invadens
VEADARPFVWKLVLEYYPFSSTSLQRAEID

SEQ ID NO: 3021530 - protein, 19 aa, Entamoeba invadens
VEAHLFLCEAKTIIPQASI

SEQ ID NO: 3021531 - protein, 19 aa, Entamoeba invadens
VEAIRTILKTNYYTYYVVI

SEQ ID NO: 3021532 - protein, 27 aa, Entamoeba invadens
VEAKVRELIYKWGTYFPNELSEYVVLR

SEQ ID NO: 3021533 - protein, 23 aa, Entamoeba invadens
VEAKYLVEFLKYDKDYPAIVYFK

SEQ ID NO: 3021534 - protein, 35 aa, Entamoeba invadens
VEALKIVGAFVFLRLLNPVLLTPQKFSTKLTKPSP

SEQ ID NO: 3021535 - protein, 18 aa, Entamoeba invadens
VEAMEVTEYPITCIDEMQ

SEQ ID NO: 3021536 - protein, 25 aa, Entamoeba invadens
VEAMSYVQKERYLREKWDKKAEKTT

SEQ ID NO: 3021537 - protein, 24 aa, Entamoeba invadens
VEASVEIILQKPLVLEIGATGKNL

SEQ ID NO: 3021538 - protein, 18 aa, Entamoeba invadens
VEATYPLVTYEEMLLRFK

SEQ ID NO: 3021539 - protein, 25 aa, Entamoeba invadens
VECFQLFLSVEIFYNILTFSNKKIA

SEQ ID NO: 3021540 - protein, 28 aa, Entamoeba invadens
VECFRLFFEEITNNFLLFSNKKIAKEQK

SEQ ID NO: 3021541 - protein, 30 aa, Entamoeba invadens
VECFSIWMENPLIKFLVEKMGLESENDKMN

SEQ ID NO: 3021542 - protein, 37 aa, Entamoeba invadens
VECFSVTIYYLIFYIDESFIKFLWSGFLNIINVNTEI

SEQ ID NO: 3021543 - protein, 23 aa, Entamoeba invadens
VECIICHQKVLASTLFEHVKNHG

SEQ ID NO: 3021544 - protein, 28 aa, Entamoeba invadens
VECIPHCTFMKCYNLKEIILPENLKTIE

SEQ ID NO: 3021545 - protein, 25 aa, Entamoeba invadens
VECVHWDIGIITPYRKQVLDVKKAI

SEQ ID NO: 3021546 - protein, 18 aa, Entamoeba invadens
VECYKHLCLTLGTPQQFI

SEQ ID NO: 3021547 - protein, 23 aa, Entamoeba invadens
VEDHFALFIELLGPLPKEMIDKS

SEQ ID NO: 3021548 - protein, 25 aa, Entamoeba invadens
VEDHVFPVVFFLLPNEKTDTFTFAF

SEQ ID NO: 3021549 - protein, 26 aa, Entamoeba invadens
VEDHVFPVVFFLLPNEKTDTFTFAFS

SEQ ID NO: 3021550 - protein, 28 aa, Entamoeba invadens
VEDIIVEYAMLMLSYANLRNLKRDEYQL

SEQ ID NO: 3021551 - protein, 22 aa, Entamoeba invadens
VEDLYYIFISVFECAVLLKGKN

SEQ ID NO: 3021552 - protein, 18 aa, Entamoeba invadens
VEDQHYYFFVYYSERQFV

SEQ ID NO: 3021553 - protein, 34 aa, Entamoeba invadens
VEDQVKVLNAQVSSLKVLVTNDLTFQVDQLTDEE

SEQ ID NO: 3021554 - protein, 18 aa, Entamoeba invadens
VEDTLWGISFACDDQRCI

SEQ ID NO: 3021555 - protein, 29 aa, Entamoeba invadens
VEDTTVGWIYYIYILQKNSEGYYTAVRSL

SEQ ID NO: 3021556 - protein, 27 aa, Entamoeba invadens
VEDVEPLKLFFGLLDTDDDGELCFADF

SEQ ID NO: 3021557 - protein, 29 aa, Entamoeba invadens
VEEEIKLLRFLKNDYIVRYIASTQSFGCL

SEQ ID NO: 3021558 - protein, 18 aa, Entamoeba invadens
VEEEKPPRPLWQDTSRTE

SEQ ID NO: 3021559 - protein, 22 aa, Entamoeba invadens
VEEKAKLVVWSGRQHMKAVFDS

SEQ ID NO: 3021560 - protein, 26 aa, Entamoeba invadens
VEEKNDWRMCFLFNDVFIVANAMVPN

SEQ ID NO: 3021561 - protein, 23 aa, Entamoeba invadens
VEELFMYYFNYADGKGLFNKADG

SEQ ID NO: 3021562 - protein, 21 aa, Entamoeba invadens
VEEMLQIKFLSSEKSKWILLK

SEQ ID NO: 3021563 - protein, 26 aa, Entamoeba invadens
VEENAKLFVLILNYFVIHFTTNKMLT

SEQ ID NO: 3021564 - protein, 32 aa, Entamoeba invadens
VEEQPVVGHARSSTFLATNRKATFGEKVKQEE

SEQ ID NO: 3021565 - protein, 23 aa, Entamoeba invadens
VEEQRAWRKDHPPGFIARPVREG

SEQ ID NO: 3021566 - protein, 23 aa, Entamoeba invadens
VEERPAFILVYTIATNTLSTENF

SEQ ID NO: 3021567 - protein, 29 aa, Entamoeba invadens
VEFENYIVQLIYMIELIFTTTSDLETRFS

SEQ ID NO: 3021568 - protein, 18 aa, Entamoeba invadens
VEFLYQKYPEVPKVFDVE

SEQ ID NO: 3021569 - protein, 25 aa, Entamoeba invadens
VEFMKLKHLIILQNKIDLVKTKEDA

SEQ ID NO: 3021570 - protein, 21 aa, Entamoeba invadens
VEFNSACFIPYYPPTENMVKQ

SEQ ID NO: 3021571 - protein, 27 aa, Entamoeba invadens
VEFSRLKCLKLKWTTYFLNYNLECLEQ

SEQ ID NO: 3021572 - protein, 25 aa, Entamoeba invadens
VEGDTGILMLWRKIIILFENTPEKG

SEQ ID NO: 3021573 - protein, 20 aa, Entamoeba invadens
VEGFWPVVMAKALSKANVED

SEQ ID NO: 3021574 - protein, 27 aa, Entamoeba invadens
VEGGFTFIIIDFYALGQLSDYVNMFVL

SEQ ID NO: 3021575 - protein, 31 aa, Entamoeba invadens
VEGKAMIRIGMVNPPYIIKYFDEIVEVFKRK

SEQ ID NO: 3021576 - protein, 24 aa, Entamoeba invadens
VEGKKLFPVGYKSDNPIIITQLGP

SEQ ID NO: 3021577 - protein, 24 aa, Entamoeba invadens
VEGKSKIHMILVPADANMENFNEE

SEQ ID NO: 3021578 - protein, 18 aa, Entamoeba invadens
VEGKWVVSKNWVLEGMRK

SEQ ID NO: 3021579 - protein, 25 aa, Entamoeba invadens
VEGNSSIILFVHSGPYIFGSYTSTA

SEQ ID NO: 3021580 - protein, 18 aa, Entamoeba invadens
VEGSHFIPNLYGKEYNDT

SEQ ID NO: 3021581 - protein, 18 aa, Entamoeba invadens
VEGSKKPHKVIAEDGPKK

SEQ ID NO: 3021582 - protein, 46 aa, Entamoeba invadens
VEGTEKRGFDLIKTVWVEKQYVGQSVTIPINIDILSENYNVPIVVP

SEQ ID NO: 3021583 - protein, 34 aa, Entamoeba invadens
VEGVLTHPWLCGNSVYTNPLFTSLLEQLSNQTME

SEQ ID NO: 3021584 - protein, 36 aa, Entamoeba invadens
VEGWRDRTVLSPFTDYAWFLYDNTEMLVLRQNNIIF

SEQ ID NO: 3021585 - protein, 22 aa, Entamoeba invadens
VEGWVFREWAPNFKEMYLFGDY

SEQ ID NO: 3021586 - protein, 19 aa, Entamoeba invadens
VEGYRGTIGVEFYPYTLEI

SEQ ID NO: 3021587 - protein, 18 aa, Entamoeba invadens
VEHDFIMATYLADKVIVY

SEQ ID NO: 3021588 - protein, 20 aa, Entamoeba invadens
VEHKKLPLLSLKCKADKPKP

SEQ ID NO: 3021589 - protein, 25 aa, Entamoeba invadens
VEHVTSQPLLFPDNINKLSLNDQIT

SEQ ID NO: 3021590 - protein, 24 aa, Entamoeba invadens
VEIFVRYHPTLSKYVWVDSGVVSF

SEQ ID NO: 3021591 - protein, 19 aa, Entamoeba invadens
VEIGFLIQNFQKVMKCCSG

SEQ ID NO: 3021592 - protein, 25 aa, Entamoeba invadens
VEIGIYLHPAVYINDSIQSEQPSRR

SEQ ID NO: 3021593 - protein, 30 aa, Entamoeba invadens
VEIKHFFADICGGLWYLHFNKHVLHRDLKL

SEQ ID NO: 3021594 - protein, 26 aa, Entamoeba invadens
VEILCLLFALKLKYPDNIYLIRGNHE

SEQ ID NO: 3021595 - protein, 18 aa, Entamoeba invadens
VEILQLIDKIIGRGIGVL

SEQ ID NO: 3021596 - protein, 30 aa, Entamoeba invadens
VEIPAVMTINQLIKYLYLGSDIYMKKFFEV

SEQ ID NO: 3021597 - protein, 26 aa, Entamoeba invadens
VEIPNSLSKLVKLKALVLNKSFISCL

SEQ ID NO: 3021598 - protein, 17 aa, Entamoeba invadens
VEIPQQVFSLIHLTYLN

SEQ ID NO: 3021599 - protein, 29 aa, Entamoeba invadens
VEISSKFQIHFIDFTGLGISIFGCKQTKS

SEQ ID NO: 3021600 - protein, 19 aa, Entamoeba invadens
VEITIPNYRECPCRKPIIL

SEQ ID NO: 3021601 - protein, 24 aa, Entamoeba invadens
VEIYDLFVVQLFEMFLAIFLVDEE

SEQ ID NO: 3021602 - protein, 23 aa, Entamoeba invadens
VEKAHKFYRRKIQIMPKCTLCGF

SEQ ID NO: 3021603 - protein, 26 aa, Entamoeba invadens
VEKCLLEWCRGVTLELLYDSKVDGDK

SEQ ID NO: 3021604 - protein, 25 aa, Entamoeba invadens
VEKEPELLKPFIPELISSLQRLVNH

SEQ ID NO: 3021605 - protein, 31 aa, Entamoeba invadens
VEKFEHPIRAIPYIPLFGQPLKVVMVCHRPL

SEQ ID NO: 3021606 - protein, 37 aa, Entamoeba invadens
VEKFPEIPFGIFFVFTRNFFGFHVRFRDLARGGLRTV

SEQ ID NO: 3021607 - protein, 27 aa, Entamoeba invadens
VEKGITVEMYLFNDIILFAKKSKGIFN

SEQ ID NO: 3021608 - protein, 38 aa, Entamoeba invadens
VEKIKILFNALRYITTKKKMLPFPESDLKFWDCSCDLA

SEQ ID NO: 3021609 - protein, 38 aa, Entamoeba invadens
VEKKEASLAKLSYADLIEVCRVLCLAGASKEKTKEKYA

SEQ ID NO: 3021610 - protein, 27 aa, Entamoeba invadens
VEKKKQLKLLDPTFKKAYLDNADIFFE

SEQ ID NO: 3021611 - protein, 23 aa, Entamoeba invadens
VEKLAIHFLSKMPSKKLIQFFIE

SEQ ID NO: 3021612 - protein, 17 aa, Entamoeba invadens
VEKLGITTTLLKKACRS

SEQ ID NO: 3021613 - protein, 24 aa, Entamoeba invadens
VEKNAFYFMHLLSSITIPNSVTKL

SEQ ID NO: 3021614 - protein, 23 aa, Entamoeba invadens
VEKPNIVLVGLKSDIRLSQNSIA

SEQ ID NO: 3021615 - protein, 24 aa, Entamoeba invadens
VEKSISIEFKYRKSFYTLSDVVLG

SEQ ID NO: 3021616 - protein, 18 aa, Entamoeba invadens
VEKSLYKGVTLGGVSGAL

SEQ ID NO: 3021617 - protein, 20 aa, Entamoeba invadens
VEKSSPLLSIIVCSNGIIEQ

SEQ ID NO: 3021618 - protein, 18 aa, Entamoeba invadens
VEKVLLPPNLESFKLIGC

SEQ ID NO: 3021619 - protein, 25 aa, Entamoeba invadens
VEKVRPICMGAVLRGINFTDASYKS

SEQ ID NO: 3021620 - protein, 26 aa, Entamoeba invadens
VEKVYLYYTKFNIDQLEKIVLASKKT

SEQ ID NO: 3021621 - protein, 25 aa, Entamoeba invadens
VEKWLLGYKSLQVDVANLWMSLDKC

SEQ ID NO: 3021622 - protein, 26 aa, Entamoeba invadens
VELCTLQYLIKSNLFFLLVAEKCNTP

SEQ ID NO: 3021623 - protein, 23 aa, Entamoeba invadens
VELDVGWYVVFGCTYQPNIRRKF

SEQ ID NO: 3021624 - protein, 32 aa, Entamoeba invadens
VELEVRVLDIIFLEGWEIVFSFFSTILHFSKE

SEQ ID NO: 3021625 - protein, 17 aa, Entamoeba invadens
VELKEDETFLGCFDTQV

SEQ ID NO: 3021626 - protein, 17 aa, Entamoeba invadens
VELLLSKGADRLVKNER

SEQ ID NO: 3021627 - protein, 17 aa, Entamoeba invadens
VELLVLQMIFDGSLKAK

SEQ ID NO: 3021628 - protein, 27 aa, Entamoeba invadens
VELPKSLSKYHCCRGLYGNVGFNVKSQ

SEQ ID NO: 3021629 - protein, 24 aa, Entamoeba invadens
VELSALKNLIFLRTINSALVHSQS

SEQ ID NO: 3021630 - protein, 26 aa, Entamoeba invadens
VELSQILMIFMEYLPDPLISQASQQI

SEQ ID NO: 3021631 - protein, 23 aa, Entamoeba invadens
VELWQVLSEKYFVLLRCEEYHLT

SEQ ID NO: 3021632 - protein, 17 aa, Entamoeba invadens
VEMCNDFFDISPLGDII

SEQ ID NO: 3021633 - protein, 18 aa, Entamoeba invadens
VEMFDFLDDVKRFEGVYK

SEQ ID NO: 3021634 - protein, 24 aa, Entamoeba invadens
VEMGTILKHFITPILKSAVASKDR

SEQ ID NO: 3021635 - protein, 26 aa, Entamoeba invadens
VEMIFNFLVTYIGDAIWFTQKGAVTT

SEQ ID NO: 3021636 - protein, 24 aa, Entamoeba invadens
VEMTNQWLITIESALKRFGRDVNN

SEQ ID NO: 3021637 - protein, 23 aa, Entamoeba invadens
VEMYPFLETIFAQIMIVINGKDK

SEQ ID NO: 3021638 - protein, 33 aa, Entamoeba invadens
VENCLKALQYSYVKMFFLPRDDVASDLFLYRQE

SEQ ID NO: 3021639 - protein, 28 aa, Entamoeba invadens
VENHFGRLIILFKLMRNKYGLLKRDYES

SEQ ID NO: 3021640 - protein, 26 aa, Entamoeba invadens
VENHFGRLILSFKLMRNKYGLLKRDY

SEQ ID NO: 3021641 - protein, 28 aa, Entamoeba invadens
VENHFSRLIILFKLMRNKYGLLKRDYES

SEQ ID NO: 3021642 - protein, 21 aa, Entamoeba invadens
VENIFRLCLLQLPDVDIVERY

SEQ ID NO: 3021643 - protein, 17 aa, Entamoeba invadens
VENIHILLDILVELGYH

SEQ ID NO: 3021644 - protein, 17 aa, Entamoeba invadens
VENIPIIPQDALELEHS

SEQ ID NO: 3021645 - protein, 25 aa, Entamoeba invadens
VENITYLVMNYAKKILFDPTLALCG

SEQ ID NO: 3021646 - protein, 25 aa, Entamoeba invadens
VENKGDLLIYLYSSNPQKQLQNIEK

SEQ ID NO: 3021647 - protein, 28 aa, Entamoeba invadens
VENLPSAWVAFFKKAGVKKSDLADKETR

SEQ ID NO: 3021648 - protein, 17 aa, Entamoeba invadens
VENSKILFAKPQHKKSR

SEQ ID NO: 3021649 - protein, 25 aa, Entamoeba invadens
VENSSDLLVYLYSSNPQKQLQNIAK

SEQ ID NO: 3021650 - protein, 27 aa, Entamoeba invadens
VEPEIEQPGYYRKIKFDTKKYTRDETP

SEQ ID NO: 3021651 - protein, 25 aa, Entamoeba invadens
VEPGVYFIPFLLESGLKDEKVKKFL

SEQ ID NO: 3021652 - protein, 17 aa, Entamoeba invadens
VEPNDMLIIMTDGFHDN

SEQ ID NO: 3021653 - protein, 23 aa, Entamoeba invadens
VEPRVLMWRNRLFEMSSKTGVFG

SEQ ID NO: 3021654 - protein, 18 aa, Entamoeba invadens
VEQEVPFFLAPHAMVIFQ

SEQ ID NO: 3021655 - protein, 25 aa, Entamoeba invadens
VEQIQKWSFLKIESVIFDSNLDDWS

SEQ ID NO: 3021656 - protein, 23 aa, Entamoeba invadens
VEQKSIFIEADYHRIILSSNIAE

SEQ ID NO: 3021657 - protein, 25 aa, Entamoeba invadens
VEQSLLTFHICHPLLVFIPKDVNKL

SEQ ID NO: 3021658 - protein, 24 aa, Entamoeba invadens
VEQTFPFVFTLVDVGYLFNPSTLA

SEQ ID NO: 3021659 - protein, 26 aa, Entamoeba invadens
VEQVRYFGYELAKRNIPVFLPPGGHA

SEQ ID NO: 3021660 - protein, 32 aa, Entamoeba invadens
VERENKELIAKIEELNVLLSNAQKLNEEYTKE

SEQ ID NO: 3021661 - protein, 25 aa, Entamoeba invadens
VERIEYLTKLFANDNWMAKEKITYF

SEQ ID NO: 3021662 - protein, 17 aa, Entamoeba invadens
VERILREWLTSIDSYTS

SEQ ID NO: 3021663 - protein, 26 aa, Entamoeba invadens
VERKRAYQGLPFALSLKLKRMRDEVE

SEQ ID NO: 3021664 - protein, 18 aa, Entamoeba invadens
VERLIVWENLKSIRTELI

SEQ ID NO: 3021665 - protein, 18 aa, Entamoeba invadens
VERLKFVMKHFQTLMLDV

SEQ ID NO: 3021666 - protein, 35 aa, Entamoeba invadens
VERSYERMYLFVDNMGHLALYKRGLCAASNPNTTV

SEQ ID NO: 3021667 - protein, 26 aa, Entamoeba invadens
VERVLSRLKVLYASELIFTSYDIQII

SEQ ID NO: 3021668 - protein, 19 aa, Entamoeba invadens
VESAMNWLVSFLKVADRSA

SEQ ID NO: 3021669 - protein, 31 aa, Entamoeba invadens
VESAPPLITNPFPIALIHSSLSPHQDNPLQT

SEQ ID NO: 3021670 - protein, 22 aa, Entamoeba invadens
VESAWTIATLAPVLSYLDEIET

SEQ ID NO: 3021671 - protein, 21 aa, Entamoeba invadens
VESCYNLNFTFLQRKSLNEDH

SEQ ID NO: 3021672 - protein, 18 aa, Entamoeba invadens
VESFKMFFSLADSDENGA

SEQ ID NO: 3021673 - protein, 27 aa, Entamoeba invadens
VESGEDVLRILPFYQSTPDIHNSYYNT

SEQ ID NO: 3021674 - protein, 28 aa, Entamoeba invadens
VESGIMLYLISLIEFPFKNGVNGDTVSI

SEQ ID NO: 3021675 - protein, 20 aa, Entamoeba invadens
VESLEIPRFVLGPNLKELEI

SEQ ID NO: 3021676 - protein, 23 aa, Entamoeba invadens
VESLFYYFPKDSVPFDFLLLVEK

SEQ ID NO: 3021677 - protein, 22 aa, Entamoeba invadens
VESLYITNLCKVLFTYSNKAFI

SEQ ID NO: 3021678 - protein, 20 aa, Entamoeba invadens
VESLYVYAMTDKYSASALVA

SEQ ID NO: 3021679 - protein, 20 aa, Entamoeba invadens
VESPIMFQPTYKFIPNTQEY

SEQ ID NO: 3021680 - protein, 27 aa, Entamoeba invadens
VESRPWVVAYLQLHKFEVFLSGLYCLL

SEQ ID NO: 3021681 - protein, 19 aa, Entamoeba invadens
VESSFWNFDSLYQPQQHPA

SEQ ID NO: 3021682 - protein, 26 aa, Entamoeba invadens
VESVFYTPRFLYGALFPTGETIGDIL

SEQ ID NO: 3021683 - protein, 26 aa, Entamoeba invadens
VETAQRLMPFVPANSRFTYHIEKKLL

SEQ ID NO: 3021684 - protein, 33 aa, Entamoeba invadens
VETFAQTGIFVPTVLLLPIQHPLRYVLHLEQIV

SEQ ID NO: 3021685 - protein, 21 aa, Entamoeba invadens
VETIHLLVDLVREIGFFVETR

SEQ ID NO: 3021686 - protein, 24 aa, Entamoeba invadens
VETKARNVYLLIKTYAATLDQQIK

SEQ ID NO: 3021687 - protein, 19 aa, Entamoeba invadens
VETKGPSLYCVFPLVGSEQ

SEQ ID NO: 3021688 - protein, 25 aa, Entamoeba invadens
VETKNQIVTLLIQKEKMQFEEELKK

SEQ ID NO: 3021689 - protein, 27 aa, Entamoeba invadens
VETLHLLIDTLFLLGVDFNTYTTDGKN

SEQ ID NO: 3021690 - protein, 29 aa, Entamoeba invadens
VETLNVWSLFDYFYNFYDLVKDSLHPDII

SEQ ID NO: 3021691 - protein, 24 aa, Entamoeba invadens
VETLRMFSLIQIGTKVKRKAMIVT

SEQ ID NO: 3021692 - protein, 28 aa, Entamoeba invadens
VETPIEAIFVMHTPLNWGEAIQIICDIL

SEQ ID NO: 3021693 - protein, 24 aa, Entamoeba invadens
VETPYVFPEIKYPRKIYNLNYKMY

SEQ ID NO: 3021694 - protein, 25 aa, Entamoeba invadens
VETQKVIPVIGEKLPMEIEPPQEVV

SEQ ID NO: 3021695 - protein, 31 aa, Entamoeba invadens
VETSFDVWTGRWKYLIYRYDKPKPNHISVCV

SEQ ID NO: 3021696 - protein, 32 aa, Entamoeba invadens
VETVIPSFWVNDFINMPLGAPLPFNFVNSLPK

SEQ ID NO: 3021697 - protein, 21 aa, Entamoeba invadens
VEVAIIKKYLYKLTTDNLKSI

SEQ ID NO: 3021698 - protein, 26 aa, Entamoeba invadens
VEVCYYIPEGMLTSGSWVGLFDAHET

SEQ ID NO: 3021699 - protein, 34 aa, Entamoeba invadens
VEVFRREKGLRFVKRIFSLLPDDLKAQVAGTVVG

SEQ ID NO: 3021700 - protein, 23 aa, Entamoeba invadens
VEVHPNINLFPPNLKTSPQNSSN

SEQ ID NO: 3021701 - protein, 27 aa, Entamoeba invadens
VEVKQRLHLIEKWKPSPTLEIVFDSDR

SEQ ID NO: 3021702 - protein, 30 aa, Entamoeba invadens
VEVKRIGFSRLLFFMFSEYFNELFERKQRE

SEQ ID NO: 3021703 - protein, 18 aa, Entamoeba invadens
VEVLDLRWFGHCVAIANL

SEQ ID NO: 3021704 - protein, 23 aa, Entamoeba invadens
VEVPILFCIADMVNYPVKESCSR

SEQ ID NO: 3021705 - protein, 23 aa, Entamoeba invadens
VEVPIVVFYKDKGTWVLENNQYS

SEQ ID NO: 3021706 - protein, 28 aa, Entamoeba invadens
VEVSHKVIWYPLYYTDLMILKKTDNTIL

SEQ ID NO: 3021707 - protein, 19 aa, Entamoeba invadens
VEWGPLYQMKLASFRDRIR

SEQ ID NO: 3021708 - protein, 21 aa, Entamoeba invadens
VEYFSLFVRFVFSDGSFEEKR

SEQ ID NO: 3021709 - protein, 27 aa, Entamoeba invadens
VEYHGLDLLLFLLKRQQLKVETNLMEY

SEQ ID NO: 3021710 - protein, 18 aa, Entamoeba invadens
VEYIRMKARILIMYLERK

SEQ ID NO: 3021711 - protein, 24 aa, Entamoeba invadens
VEYKGELAYLFKYDKTIPDMDKTF

SEQ ID NO: 3021712 - protein, 23 aa, Entamoeba invadens
VFAETSLFKLEAFMIDAICEGRD

SEQ ID NO: 3021713 - protein, 29 aa, Entamoeba invadens
VFAPEKLLQTLFEWYVPKEQVLMPISTFD

SEQ ID NO: 3021714 - protein, 23 aa, Entamoeba invadens
VFARYLWAQFRYSNQKEKPIEQK

SEQ ID NO: 3021715 - protein, 26 aa, Entamoeba invadens
VFCEDTTEPYFRAPASFLPIRERREE

SEQ ID NO: 3021716 - protein, 35 aa, Entamoeba invadens
VFCSAIFTRKIVQARGFVIVIIAEENVFGVVVTGR

SEQ ID NO: 3021717 - protein, 19 aa, Entamoeba invadens
VFCTSISPDFKWIVSGSED

SEQ ID NO: 3021718 - protein, 19 aa, Entamoeba invadens
VFCVAWPLGEIDSELSFSL

SEQ ID NO: 3021719 - protein, 22 aa, Entamoeba invadens
VFDAKRLIGRRFSDPAIQEDMK

SEQ ID NO: 3021720 - protein, 25 aa, Entamoeba invadens
VFDEEIKLLLIRKMGFIIKMSADMS

SEQ ID NO: 3021721 - protein, 20 aa, Entamoeba invadens
VFDGLYPFVQTVVGSSLGCA

SEQ ID NO: 3021722 - protein, 17 aa, Entamoeba invadens
VFDIKRVLLNKFDNLEE

SEQ ID NO: 3021723 - protein, 18 aa, Entamoeba invadens
VFDLIHRCIRRIITEGQP

SEQ ID NO: 3021724 - protein, 26 aa, Entamoeba invadens
VFDNCPLLSSIFLSNSLLSNFKTLLS

SEQ ID NO: 3021725 - protein, 25 aa, Entamoeba invadens
VFDNKHYFLVSTFFEIFISNMRSYT

SEQ ID NO: 3021726 - protein, 19 aa, Entamoeba invadens
VFDNLTRIPFHLRCVLRSI

SEQ ID NO: 3021727 - protein, 17 aa, Entamoeba invadens
VFDPPNCYAPHFSFLQP

SEQ ID NO: 3021728 - protein, 40 aa, Entamoeba invadens
VFDRCDFTHPFSVITFPRITPYDIFPYQRTIKGIFVKIPE

SEQ ID NO: 3021729 - protein, 18 aa, Entamoeba invadens
VFDRPTFIYLDETTTADS

SEQ ID NO: 3021730 - protein, 28 aa, Entamoeba invadens
VFDRYDIKDGYYLIVYKASSSLNKDAYI

SEQ ID NO: 3021731 - protein, 26 aa, Entamoeba invadens
VFDTIPENLPVLRITWNRGDSNGTTM

SEQ ID NO: 3021732 - protein, 24 aa, Entamoeba invadens
VFDTKIGIFEVIGSSLKVLLNDIK

SEQ ID NO: 3021733 - protein, 18 aa, Entamoeba invadens
VFDTTWNFRVKCLVINSA

SEQ ID NO: 3021734 - protein, 17 aa, Entamoeba invadens
VFEDGSRIIFRLSGTGS

SEQ ID NO: 3021735 - protein, 19 aa, Entamoeba invadens
VFEKIVKTIFRRYKSEMNA

SEQ ID NO: 3021736 - protein, 24 aa, Entamoeba invadens
VFEKLFVIVKSFSGAMSLFMTVGN

SEQ ID NO: 3021737 - protein, 27 aa, Entamoeba invadens
VFEKSVPFKRYYLEGLNLLQPVDKVTC

SEQ ID NO: 3021738 - protein, 32 aa, Entamoeba invadens
VFELMYKERHDLMFIATYDKDVYYPFISENWR

SEQ ID NO: 3021739 - protein, 27 aa, Entamoeba invadens
VFENFQKSAYFKPLINRITPLGENVEN

SEQ ID NO: 3021740 - protein, 19 aa, Entamoeba invadens
VFENLQVPIKLVKNVPNPE

SEQ ID NO: 3021741 - protein, 26 aa, Entamoeba invadens
VFESIPLIEYGVIILEFYDEDNQRII

SEQ ID NO: 3021742 - protein, 25 aa, Entamoeba invadens
VFETRLPHFYATEQIKYPPSDCDKI

SEQ ID NO: 3021743 - protein, 29 aa, Entamoeba invadens
VFETRMYVYIVMEYIGGGNLFQAIILSHK

SEQ ID NO: 3021744 - protein, 18 aa, Entamoeba invadens
VFEVLKPKPRRKETALDL

SEQ ID NO: 3021745 - protein, 19 aa, Entamoeba invadens
VFEVSLYTIPYKDDKAMFM

SEQ ID NO: 3021746 - protein, 17 aa, Entamoeba invadens
VFFDRTGIFSLNSGILR

SEQ ID NO: 3021747 - protein, 28 aa, Entamoeba invadens
VFFKAKEVFRILFTLVSSLQEDDCLLFE

SEQ ID NO: 3021748 - protein, 17 aa, Entamoeba invadens
VFFNGEFPYCALDISPD

SEQ ID NO: 3021749 - protein, 18 aa, Entamoeba invadens
VFGAALPGCKYISKLYSE

SEQ ID NO: 3021750 - protein, 26 aa, Entamoeba invadens
VFGCFQQSLIPPPPKFQSLRTKTENF

SEQ ID NO: 3021751 - protein, 19 aa, Entamoeba invadens
VFGCYVPTPPKPRTWTKDP

SEQ ID NO: 3021752 - protein, 29 aa, Entamoeba invadens
VFGDVGNKFLIPNLFINCGGLSIISQILS

SEQ ID NO: 3021753 - protein, 17 aa, Entamoeba invadens
VFGFHRTVKDEEVNQVF

SEQ ID NO: 3021754 - protein, 25 aa, Entamoeba invadens
VFGIANFFSVFKTRQGYIHPTFKKY

SEQ ID NO: 3021755 - protein, 25 aa, Entamoeba invadens
VFGKINKSFDLMFGKRAFVHHFVGQ

SEQ ID NO: 3021756 - protein, 20 aa, Entamoeba invadens
VFGKLYKFPEELNIHLTIYN

SEQ ID NO: 3021757 - protein, 17 aa, Entamoeba invadens
VFGNCYFVTKITLSDKL

SEQ ID NO: 3021758 - protein, 21 aa, Entamoeba invadens
VFGNHFNLKVKLLIGGVENSK

SEQ ID NO: 3021759 - protein, 19 aa, Entamoeba invadens
VFGNSPMLESFNEKTKMNE

SEQ ID NO: 3021760 - protein, 32 aa, Entamoeba invadens
VFGPHQFPEKLIPKFITLLDRGLNCSIHGNGN

SEQ ID NO: 3021761 - protein, 23 aa, Entamoeba invadens
VFGSFHGIIPPPDKLISSKDDPK

SEQ ID NO: 3021762 - protein, 26 aa, Entamoeba invadens
VFGVCVSLKEVAYSYPFVTFRCFDGC

SEQ ID NO: 3021763 - protein, 18 aa, Entamoeba invadens
VFGVCVSLKEVSYSYPFV

SEQ ID NO: 3021764 - protein, 25 aa, Entamoeba invadens
VFGWSNTYPIETFKFPWKIAEFVMS

SEQ ID NO: 3021765 - protein, 26 aa, Entamoeba invadens
VFGWTNAYPLDAFKFPWKIAEFVMSG

SEQ ID NO: 3021766 - protein, 23 aa, Entamoeba invadens
VFHAPPPCHCCCNYNRCLQYLHC

SEQ ID NO: 3021767 - protein, 29 aa, Entamoeba invadens
VFHGCDFDMVWLSYNFGLYVVNNFDSGQA

SEQ ID NO: 3021768 - protein, 17 aa, Entamoeba invadens
VFHIGVVFSLQGFVAAE

SEQ ID NO: 3021769 - protein, 22 aa, Entamoeba invadens
VFHLKMNYLLKHITDDGIFGTV

SEQ ID NO: 3021770 - protein, 25 aa, Entamoeba invadens
VFHNFAFNRPFMDYSMCAIAVGAIM

SEQ ID NO: 3021771 - protein, 25 aa, Entamoeba invadens
VFHRENGIALFIFDDEKNIFGCVVT

SEQ ID NO: 3021772 - protein, 20 aa, Entamoeba invadens
VFHYFEVLVPQIVSILSKID

SEQ ID NO: 3021773 - protein, 18 aa, Entamoeba invadens
VFIEHYYKQIMNQAILLF

SEQ ID NO: 3021774 - protein, 26 aa, Entamoeba invadens
VFIIQRQLEFLFHAMCSIVPFPTIQS

SEQ ID NO: 3021775 - protein, 21 aa, Entamoeba invadens
VFIKITQWIIGGDGWAYDIGY

SEQ ID NO: 3021776 - protein, 29 aa, Entamoeba invadens
VFINTTLKQLIYFSPNPSWYESAVQNGFY

SEQ ID NO: 3021777 - protein, 17 aa, Entamoeba invadens
VFISPVVSQLIVLMKDF

SEQ ID NO: 3021778 - protein, 17 aa, Entamoeba invadens
VFKAILENDLRTNENYT

SEQ ID NO: 3021779 - protein, 27 aa, Entamoeba invadens
VFKCLETRWTIYRALYAKLQENSIGII

SEQ ID NO: 3021780 - protein, 22 aa, Entamoeba invadens
VFKEDFILPTPYGEKVPVTVKG

SEQ ID NO: 3021781 - protein, 18 aa, Entamoeba invadens
VFKFLIQAECTGLFYTSQ

SEQ ID NO: 3021782 - protein, 26 aa, Entamoeba invadens
VFKKEFFCIIVWFDVDFETFDRNKSL

SEQ ID NO: 3021783 - protein, 25 aa, Entamoeba invadens
VFKKEFFRIIVWFNVDFETVDKYNN

SEQ ID NO: 3021784 - protein, 26 aa, Entamoeba invadens
VFKKEFFRIIVWFNVDFETVDKYNNG

SEQ ID NO: 3021785 - protein, 17 aa, Entamoeba invadens
VFKLYQALEFERSNIDD

SEQ ID NO: 3021786 - protein, 19 aa, Entamoeba invadens
VFKNCKLLKPILIAKKKTV

SEQ ID NO: 3021787 - protein, 21 aa, Entamoeba invadens
VFKSLFCKKKLFRVVVWFNID

SEQ ID NO: 3021788 - protein, 37 aa, Entamoeba invadens
VFLHEGFKVYLFSTIVPTPYTAFAVSLLQTACGVMVT

SEQ ID NO: 3021789 - protein, 18 aa, Entamoeba invadens
VFLIAGTLRPETMYGQTN

SEQ ID NO: 3021790 - protein, 24 aa, Entamoeba invadens
VFLKNVLFYLPTLVDISCFEEVCK

SEQ ID NO: 3021791 - protein, 32 aa, Entamoeba invadens
VFLKQLQFDSAYYPLPMLFHPIAQLQSPPSQV

SEQ ID NO: 3021792 - protein, 18 aa, Entamoeba invadens
VFLLTPNTKSIDYLKLLL

SEQ ID NO: 3021793 - protein, 28 aa, Entamoeba invadens
VFLNEQKYFALPLVKVPFYEAGKFFRTR

SEQ ID NO: 3021794 - protein, 18 aa, Entamoeba invadens
VFLQFIEVVVMLVKHRPS

SEQ ID NO: 3021795 - protein, 20 aa, Entamoeba invadens
VFLTHEMLLREIGMLEGWKS

SEQ ID NO: 3021796 - protein, 27 aa, Entamoeba invadens
VFMEGMNILKWPIPKTLLVPQKMTIQK

SEQ ID NO: 3021797 - protein, 17 aa, Entamoeba invadens
VFMKIYADYMRKADDVW

SEQ ID NO: 3021798 - protein, 18 aa, Entamoeba invadens
VFMKPLDLGADISLHSCT

SEQ ID NO: 3021799 - protein, 26 aa, Entamoeba invadens
VFMRCREFVSWGFFVDLETQIKSFSI

SEQ ID NO: 3021800 - protein, 19 aa, Entamoeba invadens
VFMVSQYFQTPNDFIFLEM

SEQ ID NO: 3021801 - protein, 24 aa, Entamoeba invadens
VFNDIWAYGVTIWELFSGGNLPYS

SEQ ID NO: 3021802 - protein, 29 aa, Entamoeba invadens
VFNDKICDLPNLVFFIETAEKDLFGGYIE

SEQ ID NO: 3021803 - protein, 25 aa, Entamoeba invadens
VFNDYTYITLGKLLDTLLKKFDINY

SEQ ID NO: 3021804 - protein, 20 aa, Entamoeba invadens
VFNFSEQFIIKTVGTRAGEC

SEQ ID NO: 3021805 - protein, 18 aa, Entamoeba invadens
VFNILVEPILKPNFDEKY

SEQ ID NO: 3021806 - protein, 25 aa, Entamoeba invadens
VFNKAKFILLVIKTYQPTPVDIQKL

SEQ ID NO: 3021807 - protein, 17 aa, Entamoeba invadens
VFNLRYRTGENAFICQH

SEQ ID NO: 3021808 - protein, 25 aa, Entamoeba invadens
VFNPDKPFTEWLESKNKEMYGENWK

SEQ ID NO: 3021809 - protein, 19 aa, Entamoeba invadens
VFNPLNKFSALLKNKYPLG

SEQ ID NO: 3021810 - protein, 35 aa, Entamoeba invadens
VFNPNDVITIPIFFNLALKDHLNIGFKQYQINIDC

SEQ ID NO: 3021811 - protein, 18 aa, Entamoeba invadens
VFNTKGKFNILDCVRALK

SEQ ID NO: 3021812 - protein, 18 aa, Entamoeba invadens
VFPSIIPDQLKRLVSNGI

SEQ ID NO: 3021813 - protein, 21 aa, Entamoeba invadens
VFQCIVMLMPDLFNIAYDIPS

SEQ ID NO: 3021814 - protein, 17 aa, Entamoeba invadens
VFQFCRTFVMVTSPQIM

SEQ ID NO: 3021815 - protein, 18 aa, Entamoeba invadens
VFQFILINNKCLSSVKSM

SEQ ID NO: 3021816 - protein, 23 aa, Entamoeba invadens
VFQMRKLMVLTPYLHIKKHKFYI

SEQ ID NO: 3021817 - protein, 18 aa, Entamoeba invadens
VFQNLQISAGRYKNKILN

SEQ ID NO: 3021818 - protein, 17 aa, Entamoeba invadens
VFQSKNPNLFGAEGICV

SEQ ID NO: 3021819 - protein, 19 aa, Entamoeba invadens
VFQVRFTPLVGFENSAPLK

SEQ ID NO: 3021820 - protein, 18 aa, Entamoeba invadens
VFREVLYTRDFDGLLQAN

SEQ ID NO: 3021821 - protein, 20 aa, Entamoeba invadens
VFRTEQIIAMLLVQVKKFTE

SEQ ID NO: 3021822 - protein, 17 aa, Entamoeba invadens
VFRVIFMKVLEMTDFTK

SEQ ID NO: 3021823 - protein, 20 aa, Entamoeba invadens
VFRWKYPLPGDGDFSYVCCN

SEQ ID NO: 3021824 - protein, 18 aa, Entamoeba invadens
VFSFVNLKRFTIVGKRFK

SEQ ID NO: 3021825 - protein, 17 aa, Entamoeba invadens
VFSIGRVKALLACGNSD

SEQ ID NO: 3021826 - protein, 46 aa, Entamoeba invadens
VFSISQITTILYKFGIFSLIPEELKFLGIHRVVAPTLVYPEEYRKI

SEQ ID NO: 3021827 - protein, 18 aa, Entamoeba invadens
VFSKSLNSSLFLTTFPGD

SEQ ID NO: 3021828 - protein, 25 aa, Entamoeba invadens
VFSLGCVLVYLFTENALFDVSNILD

SEQ ID NO: 3021829 - protein, 18 aa, Entamoeba invadens
VFSLIRNDELNPKKFEFV

SEQ ID NO: 3021830 - protein, 17 aa, Entamoeba invadens
VFSLLKYAEVDNDIYYK

SEQ ID NO: 3021831 - protein, 17 aa, Entamoeba invadens
VFSLMRNGEKCAKKFMI

SEQ ID NO: 3021832 - protein, 24 aa, Entamoeba invadens
VFSPNGHLFQVEYALEAVSKGLVS

SEQ ID NO: 3021833 - protein, 28 aa, Entamoeba invadens
VFSRHPNILRLLLQKPREFFKVRVLYDF

SEQ ID NO: 3021834 - protein, 27 aa, Entamoeba invadens
VFSTMPPLTYAFLRELLDLLKILSDNQ

SEQ ID NO: 3021835 - protein, 17 aa, Entamoeba invadens
VFSVFSAFWILQDQTIH

SEQ ID NO: 3021836 - protein, 18 aa, Entamoeba invadens
VFSYFKYVCSENGLVTYK

SEQ ID NO: 3021837 - protein, 22 aa, Entamoeba invadens
VFSYLNDYFRKKHIFNIKEKSP

SEQ ID NO: 3021838 - protein, 27 aa, Entamoeba invadens
VFTASKTPFIFLVDAFRYNVEYVKTQK

SEQ ID NO: 3021839 - protein, 27 aa, Entamoeba invadens
VFTDYERYFMLFGTRFDLWPDSAFPYQ

SEQ ID NO: 3021840 - protein, 18 aa, Entamoeba invadens
VFTNLLMAKPFVGMDIAK

SEQ ID NO: 3021841 - protein, 22 aa, Entamoeba invadens
VFTPAVLFHIFSAQSIPKSILL

SEQ ID NO: 3021842 - protein, 24 aa, Entamoeba invadens
VFTQKYFPHFVKCSHVVEIHSAQN

SEQ ID NO: 3021843 - protein, 18 aa, Entamoeba invadens
VFTRVRAIDLLREIMESA

SEQ ID NO: 3021844 - protein, 28 aa, Entamoeba invadens
VFTSNKLKPLIGIPLEPKFNVLQSEKFV

SEQ ID NO: 3021845 - protein, 17 aa, Entamoeba invadens
VFTTFLTYEVNVLTTFS

SEQ ID NO: 3021846 - protein, 18 aa, Entamoeba invadens
VFVAVKILKNRPAYYRQA

SEQ ID NO: 3021847 - protein, 24 aa, Entamoeba invadens
VFVCALQWLDYLINKNGGITTAVV

SEQ ID NO: 3021848 - protein, 17 aa, Entamoeba invadens
VFVDPLKGAKDGGISGF

SEQ ID NO: 3021849 - protein, 19 aa, Entamoeba invadens
VFVIYKNTVQIYSSELEKV

SEQ ID NO: 3021850 - protein, 27 aa, Entamoeba invadens
VFVLERTQYFVPVLKDIKKNGILVISE

SEQ ID NO: 3021851 - protein, 17 aa, Entamoeba invadens
VFVNYYNNHIFLGDYVD

SEQ ID NO: 3021852 - protein, 24 aa, Entamoeba invadens
VFVPSSRLLAVKFPATHPGDFLLL

SEQ ID NO: 3021853 - protein, 18 aa, Entamoeba invadens
VFVTESHGLLKSQMKFKI

SEQ ID NO: 3021854 - protein, 20 aa, Entamoeba invadens
VFVYDFRNLNLRQTYKTCPN

SEQ ID NO: 3021855 - protein, 17 aa, Entamoeba invadens
VFVYDNGKGIFSGCQIK

SEQ ID NO: 3021856 - protein, 32 aa, Entamoeba invadens
VFYEVAPGKHLFPFSIPIKNFPISVGDPSNCQ

SEQ ID NO: 3021857 - protein, 17 aa, Entamoeba invadens
VFYHIRVNSLYIVALAR

SEQ ID NO: 3021858 - protein, 17 aa, Entamoeba invadens
VFYLLPEIIVEYFGSML

SEQ ID NO: 3021859 - protein, 17 aa, Entamoeba invadens
VFYLYNPVVEKESDCSL

SEQ ID NO: 3021860 - protein, 25 aa, Entamoeba invadens
VFYQEKYLMGIEEIYTVGFKVNDYL

SEQ ID NO: 3021861 - protein, 26 aa, Entamoeba invadens
VGAGCEPTLFLAYKNRKDLPIAGVVL

SEQ ID NO: 3021862 - protein, 34 aa, Entamoeba invadens
VGAPGRIRDLLRQMYLVLGQCYYCVLDEADKMID

SEQ ID NO: 3021863 - protein, 32 aa, Entamoeba invadens
VGAPYVKILSEASLVFPLIVAKTFAVTKRNMG

SEQ ID NO: 3021864 - protein, 25 aa, Entamoeba invadens
VGARSFISATMRTTLLASIEKAIQA

SEQ ID NO: 3021865 - protein, 24 aa, Entamoeba invadens
VGASLPYIPPTFGGVTCLLISVES

SEQ ID NO: 3021866 - protein, 25 aa, Entamoeba invadens
VGCAKFDVLIYDIGGNSLTSKSATV

SEQ ID NO: 3021867 - protein, 17 aa, Entamoeba invadens
VGCFFNCTALALPFPSP

SEQ ID NO: 3021868 - protein, 20 aa, Entamoeba invadens
VGCGLGILSLFAARAGAKHV

SEQ ID NO: 3021869 - protein, 26 aa, Entamoeba invadens
VGCMIATMFLLKDPLFKGANNNDQLV

SEQ ID NO: 3021870 - protein, 23 aa, Entamoeba invadens
VGCSAIIYMYSATNHRTYVDMKE

SEQ ID NO: 3021871 - protein, 19 aa, Entamoeba invadens
VGDCKAYFVDRSLPKHNCV

SEQ ID NO: 3021872 - protein, 18 aa, Entamoeba invadens
VGDCSVFLLGKDGITRIT

SEQ ID NO: 3021873 - protein, 28 aa, Entamoeba invadens
VGDEDFQDLFDQLKLKTKEMEKRLKVIE

SEQ ID NO: 3021874 - protein, 17 aa, Entamoeba invadens
VGDFRAAPATKTIQRIC

SEQ ID NO: 3021875 - protein, 17 aa, Entamoeba invadens
VGDIILPTLCRGNKFTV

SEQ ID NO: 3021876 - protein, 17 aa, Entamoeba invadens
VGDIYLDKRGRKSFFNN

SEQ ID NO: 3021877 - protein, 24 aa, Entamoeba invadens
VGDKAIYLTFTYPTYEVPIIMDAF

SEQ ID NO: 3021878 - protein, 21 aa, Entamoeba invadens
VGDLFIDGHFNRSIFTNKDSD

SEQ ID NO: 3021879 - protein, 21 aa, Entamoeba invadens
VGDLRGIAYAVYHTRELAENA

SEQ ID NO: 3021880 - protein, 18 aa, Entamoeba invadens
VGDPIFYNINSHTLLYNT

SEQ ID NO: 3021881 - protein, 25 aa, Entamoeba invadens
VGDVKKLLKIMARPIIHLNAIDVSG

SEQ ID NO: 3021882 - protein, 27 aa, Entamoeba invadens
VGEAMRFWVNYFDLCSIERIRPFYNNQ

SEQ ID NO: 3021883 - protein, 31 aa, Entamoeba invadens
VGECFQRFIPFLKVYKLFIGNNEVCLGSIAK

SEQ ID NO: 3021884 - protein, 24 aa, Entamoeba invadens
VGECLFSLEASFKFSERKALLNTL

SEQ ID NO: 3021885 - protein, 28 aa, Entamoeba invadens
VGEEATLQHIFLYVGQKNFPYAGSFIQR

SEQ ID NO: 3021886 - protein, 30 aa, Entamoeba invadens
VGEEIIRDNAVLWSWWREQLRDERTSEIRK

SEQ ID NO: 3021887 - protein, 25 aa, Entamoeba invadens
VGEERYIRFAFSEKTRILIALSNLC

SEQ ID NO: 3021888 - protein, 23 aa, Entamoeba invadens
VGEFVFDKLPPQKAGDVIFILTV

SEQ ID NO: 3021889 - protein, 18 aa, Entamoeba invadens
VGEIFKNKPLSRDFDEED

SEQ ID NO: 3021890 - protein, 24 aa, Entamoeba invadens
VGEIKKGLLLYFGINEADDEKDID

SEQ ID NO: 3021891 - protein, 20 aa, Entamoeba invadens
VGELAEKCKLFLLSGVDCAA

SEQ ID NO: 3021892 - protein, 26 aa, Entamoeba invadens
VGELFQKFKMLCARIGLKPLPSMLKQ

SEQ ID NO: 3021893 - protein, 20 aa, Entamoeba invadens
VGFAFTRLSTSLLTTQFSTL

SEQ ID NO: 3021894 - protein, 29 aa, Entamoeba invadens
VGFALEKSDMFWKFKINAAVEHIKKEVVE

SEQ ID NO: 3021895 - protein, 27 aa, Entamoeba invadens
VGFDEKHFIFTLSPTKTLAKRFKTTGG

SEQ ID NO: 3021896 - protein, 21 aa, Entamoeba invadens
VGFDQCYNLLLEAVAHQHSQN

SEQ ID NO: 3021897 - protein, 21 aa, Entamoeba invadens
VGFIFTKGDLHALKDKLAELK

SEQ ID NO: 3021898 - protein, 24 aa, Entamoeba invadens
VGGEYLPFHIAHKKVPFIDADGKL

SEQ ID NO: 3021899 - protein, 22 aa, Entamoeba invadens
VGGRTAGLSGLLLAVVLAGRKH

SEQ ID NO: 3021900 - protein, 28 aa, Entamoeba invadens
VGGSNLLDLIKYYKYHGIPLPSAKYISK

SEQ ID NO: 3021901 - protein, 25 aa, Entamoeba invadens
VGHSSDILCLKYNLNGTVLASASAD

SEQ ID NO: 3021902 - protein, 23 aa, Entamoeba invadens
VGIDLLVQFPEISTPLVDVSLNQ

SEQ ID NO: 3021903 - protein, 19 aa, Entamoeba invadens
VGIEKLPFIKVSTLKKCIA

SEQ ID NO: 3021904 - protein, 19 aa, Entamoeba invadens
VGIGMFFIEPDKLKNLDFS

SEQ ID NO: 3021905 - protein, 28 aa, Entamoeba invadens
VGIKKAFPYNFYYKIYIKLSYKKNMQNF

SEQ ID NO: 3021906 - protein, 26 aa, Entamoeba invadens
VGIKKDFYELLYQWKIPNIEMPLNLF

SEQ ID NO: 3021907 - protein, 22 aa, Entamoeba invadens
VGIKNMTMVRVLLLNDLEKSVK

SEQ ID NO: 3021908 - protein, 18 aa, Entamoeba invadens
VGILNKRPERILVLGKGV

SEQ ID NO: 3021909 - protein, 17 aa, Entamoeba invadens
VGIPIFPGNCEYNMLYK

SEQ ID NO: 3021910 - protein, 20 aa, Entamoeba invadens
VGIQLLRVRLSLASETIKAI

SEQ ID NO: 3021911 - protein, 25 aa, Entamoeba invadens
VGISMFEVYNDIFFDLMKDGEKCDV

SEQ ID NO: 3021912 - protein, 20 aa, Entamoeba invadens
VGIVLFELIDGEPPHYECRG

SEQ ID NO: 3021913 - protein, 24 aa, Entamoeba invadens
VGKKGLLSFKWRKCKLQPIETSNE

SEQ ID NO: 3021914 - protein, 19 aa, Entamoeba invadens
VGKKVQLFNLIDGASYPSE

SEQ ID NO: 3021915 - protein, 19 aa, Entamoeba invadens
VGKMLIRKNVGVWNCILGQ

SEQ ID NO: 3021916 - protein, 18 aa, Entamoeba invadens
VGKMRGVQIIAKNCPFLL

SEQ ID NO: 3021917 - protein, 19 aa, Entamoeba invadens
VGKTKFIITSLIGVFPYEY

SEQ ID NO: 3021918 - protein, 28 aa, Entamoeba invadens
VGKVKSPLFLLVIALNQILSSVSPRTVL

SEQ ID NO: 3021919 - protein, 25 aa, Entamoeba invadens
VGKVYIAMFIYNAIKDSIHPLNIDL

SEQ ID NO: 3021920 - protein, 23 aa, Entamoeba invadens
VGKYEIFTVKKILLGVSLQCWNG

SEQ ID NO: 3021921 - protein, 27 aa, Entamoeba invadens
VGLDINAMPIYRKFINFLSQTEYGRVL

SEQ ID NO: 3021922 - protein, 24 aa, Entamoeba invadens
VGLERIMIILEEKLSKTAKLFEAQ

SEQ ID NO: 3021923 - protein, 17 aa, Entamoeba invadens
VGLHYKELQKALNKCGI

SEQ ID NO: 3021924 - protein, 22 aa, Entamoeba invadens
VGLKVFKLFGERPMYFVSGKNV

SEQ ID NO: 3021925 - protein, 18 aa, Entamoeba invadens
VGLLEKESFILLLVVIAC

SEQ ID NO: 3021926 - protein, 18 aa, Entamoeba invadens
VGLNIQVFSYGCAILYVS

SEQ ID NO: 3021927 - protein, 18 aa, Entamoeba invadens
VGMFMECFYLSKIELCEG

SEQ ID NO: 3021928 - protein, 17 aa, Entamoeba invadens
VGMKYLNIMWRMTKDLN

SEQ ID NO: 3021929 - protein, 19 aa, Entamoeba invadens
VGMKYLVRVLPQLNTVFFS

SEQ ID NO: 3021930 - protein, 26 aa, Entamoeba invadens
VGMLNVANMFSMWKNNLIEIADQFKQ

SEQ ID NO: 3021931 - protein, 23 aa, Entamoeba invadens
VGMTVFTFFGIKIGFCYQDGFVV

SEQ ID NO: 3021932 - protein, 19 aa, Entamoeba invadens
VGMWCVEAMEVTEYPITCI

SEQ ID NO: 3021933 - protein, 26 aa, Entamoeba invadens
VGMYKKKAMDILRKRQKKREKKEMQK

SEQ ID NO: 3021934 - protein, 26 aa, Entamoeba invadens
VGNEKRWWMYAVDALKKKKQDDDNKK

SEQ ID NO: 3021935 - protein, 17 aa, Entamoeba invadens
VGNIFVINLKKESMITY

SEQ ID NO: 3021936 - protein, 22 aa, Entamoeba invadens
VGNKWTLISEKLVNRSPNAVKN

SEQ ID NO: 3021937 - protein, 24 aa, Entamoeba invadens
VGNRLTFNYVFNKKYDKMGLSFDH

SEQ ID NO: 3021938 - protein, 25 aa, Entamoeba invadens
VGNRLTFNYVFNKKYDKMGLSFDHG

SEQ ID NO: 3021939 - protein, 34 aa, Entamoeba invadens
VGPEIKFLLRILKGVFRIGFSERSLPNALAIALC

SEQ ID NO: 3021940 - protein, 18 aa, Entamoeba invadens
VGPRFKPYIDLDASECVL

SEQ ID NO: 3021941 - protein, 19 aa, Entamoeba invadens
VGQIEWKNVDITGVNFDCE

SEQ ID NO: 3021942 - protein, 17 aa, Entamoeba invadens
VGQMYIADYVCGYCSLL

SEQ ID NO: 3021943 - protein, 26 aa, Entamoeba invadens
VGQPQAKLLFLSLISRVYKREPIILH

SEQ ID NO: 3021944 - protein, 25 aa, Entamoeba invadens
VGQRLETRTLRRPTKTDRQILAMPM

SEQ ID NO: 3021945 - protein, 24 aa, Entamoeba invadens
VGQSRLCMFYLEKAHIGEIQASVW

SEQ ID NO: 3021946 - protein, 26 aa, Entamoeba invadens
VGQTKIRLGFIVLSLLLSNYSVIYTL

SEQ ID NO: 3021947 - protein, 24 aa, Entamoeba invadens
VGRAWQWKSFSSKSAFCFASTKDN

SEQ ID NO: 3021948 - protein, 18 aa, Entamoeba invadens
VGRIFQEKLITGVGYISC

SEQ ID NO: 3021949 - protein, 26 aa, Entamoeba invadens
VGRKCQICKLNYLMYSANRCVNKEQV

SEQ ID NO: 3021950 - protein, 20 aa, Entamoeba invadens
VGRLKDVVLALLPSSRSSKN

SEQ ID NO: 3021951 - protein, 21 aa, Entamoeba invadens
VGRYIGMFLEMRYGEYAMVQR

SEQ ID NO: 3021952 - protein, 20 aa, Entamoeba invadens
VGSFLKLGGKKKPPMWSREY

SEQ ID NO: 3021953 - protein, 17 aa, Entamoeba invadens
VGSIWYKAIKEIGDFCF

SEQ ID NO: 3021954 - protein, 17 aa, Entamoeba invadens
VGSLKKISRLILPHTLS

SEQ ID NO: 3021955 - protein, 25 aa, Entamoeba invadens
VGSQRFFVFSLERNGIVNPRKYELK

SEQ ID NO: 3021956 - protein, 21 aa, Entamoeba invadens
VGSRFWPISREDKPKQFIDIM

SEQ ID NO: 3021957 - protein, 18 aa, Entamoeba invadens
VGTIVILLRNLNVSLGLC

SEQ ID NO: 3021958 - protein, 24 aa, Entamoeba invadens
VGTTLPYAVVNPMMNCTALPTQQF

SEQ ID NO: 3021959 - protein, 30 aa, Entamoeba invadens
VGVKQPLPLQSICWPLLLSAKNVFATSDIN

SEQ ID NO: 3021960 - protein, 18 aa, Entamoeba invadens
VGVLKRNWKPVPGYIKKE

SEQ ID NO: 3021961 - protein, 23 aa, Entamoeba invadens
VGVNSVLMCAYQRAYRKYYKLSD

SEQ ID NO: 3021962 - protein, 21 aa, Entamoeba invadens
VGVQAIMMCAFQRGLRKYFNV

SEQ ID NO: 3021963 - protein, 17 aa, Entamoeba invadens
VGVQWLHNRLNLIHRDI

SEQ ID NO: 3021964 - protein, 25 aa, Entamoeba invadens
VGVTPFIMPTILPQTIMYSDITTRV

SEQ ID NO: 3021965 - protein, 18 aa, Entamoeba invadens
VGVVLIGLPKTGKTALAC

SEQ ID NO: 3021966 - protein, 25 aa, Entamoeba invadens
VGYEQFLAPELFFNPEIFSSDFTTP

SEQ ID NO: 3021967 - protein, 26 aa, Entamoeba invadens
VGYGTETYYYCFLHDKWLTKSGMSDH

SEQ ID NO: 3021968 - protein, 18 aa, Entamoeba invadens
VGYLKTNFLGTVPIRKHT

SEQ ID NO: 3021969 - protein, 24 aa, Entamoeba invadens
VHAQRLGIPLYEKGYDTDPSAIAR

SEQ ID NO: 3021970 - protein, 30 aa, Entamoeba invadens
VHEVYINYNTNLLLKLKGIVVALKDQIPKD

SEQ ID NO: 3021971 - protein, 25 aa, Entamoeba invadens
VHFDFLKMELPTSLRRFLVTTTDGN

SEQ ID NO: 3021972 - protein, 19 aa, Entamoeba invadens
VHFDVFYSKMKLPIPQNYL

SEQ ID NO: 3021973 - protein, 17 aa, Entamoeba invadens
VHFIDLFCHLHKKIATE

SEQ ID NO: 3021974 - protein, 19 aa, Entamoeba invadens
VHFINLIDLRKMEIIDKVR

SEQ ID NO: 3021975 - protein, 18 aa, Entamoeba invadens
VHFYGAVFFPNKICMVTA

SEQ ID NO: 3021976 - protein, 27 aa, Entamoeba invadens
VHGAVTYFIRSFTGCPYYSVPIKVEDT

SEQ ID NO: 3021977 - protein, 33 aa, Entamoeba invadens
VHGGVLLYSPAVSIPINCTLFLKKNGYEEKGLE

SEQ ID NO: 3021978 - protein, 24 aa, Entamoeba invadens
VHGYPLTRAVMIDHPLRILTSSVE

SEQ ID NO: 3021979 - protein, 18 aa, Entamoeba invadens
VHHENGLKVARYLEKHPK

SEQ ID NO: 3021980 - protein, 22 aa, Entamoeba invadens
VHHRLILGIGKLVDGLLKTVLS

SEQ ID NO: 3021981 - protein, 18 aa, Entamoeba invadens
VHIEIIKYIRRLCSQTTP

SEQ ID NO: 3021982 - protein, 19 aa, Entamoeba invadens
VHIFRLSLHTKDEALQKIF

SEQ ID NO: 3021983 - protein, 17 aa, Entamoeba invadens
VHIRLSNKLTELPKNAF

SEQ ID NO: 3021984 - protein, 17 aa, Entamoeba invadens
VHISLPQTITLLGDSCF

SEQ ID NO: 3021985 - protein, 19 aa, Entamoeba invadens
VHKELIGMSIFVQGTKKEL

SEQ ID NO: 3021986 - protein, 28 aa, Entamoeba invadens
VHKKITKTLIIALLRGICILPVAAVIGS

SEQ ID NO: 3021987 - protein, 33 aa, Entamoeba invadens
VHKTFSQKIEIPKTKTPPLEKQEECRKTASEII

SEQ ID NO: 3021988 - protein, 18 aa, Entamoeba invadens
VHLKMCNKYYFEVQLRHI

SEQ ID NO: 3021989 - protein, 19 aa, Entamoeba invadens
VHLSFVRRKFRENMDKFHY

SEQ ID NO: 3021990 - protein, 27 aa, Entamoeba invadens
VHLTKEILNYYFNWRKDMKLTVEVHWY

SEQ ID NO: 3021991 - protein, 24 aa, Entamoeba invadens
VHLTPVKLIYSQNYLSLFKDKNKN

SEQ ID NO: 3021992 - protein, 19 aa, Entamoeba invadens
VHLVAAHHGWIFGGDPFFD

SEQ ID NO: 3021993 - protein, 20 aa, Entamoeba invadens
VHLVAAHHGWIFGGDPFFDF

SEQ ID NO: 3021994 - protein, 39 aa, Entamoeba invadens
VHLWDEFITFPDTTLYIYCIVGYLIFIREDFLAVKNTEK

SEQ ID NO: 3021995 - protein, 19 aa, Entamoeba invadens
VHLYGIFQAVYTSGTDLPN

SEQ ID NO: 3021996 - protein, 17 aa, Entamoeba invadens
VHNIFTKIYDPSNDNPF

SEQ ID NO: 3021997 - protein, 19 aa, Entamoeba invadens
VHNLSGIGPIGLAFDESLL

SEQ ID NO: 3021998 - protein, 17 aa, Entamoeba invadens
VHPFLKTNSPKLNSELL

SEQ ID NO: 3021999 - protein, 19 aa, Entamoeba invadens
VHPTLPYILTCSDDKTIKC

SEQ ID NO: 3022000 - protein, 20 aa, Entamoeba invadens
VHPTVPLMRERGGKKCICVL

SEQ ID NO: 3022001 - protein, 29 aa, Entamoeba invadens
VHPVDKMCKFIILLKVLQVPYRLSCSTES

SEQ ID NO: 3022002 - protein, 23 aa, Entamoeba invadens
VHRAKIPTICSLGIQWEIVPMDD

SEQ ID NO: 3022003 - protein, 24 aa, Entamoeba invadens
VHRDIKLENILLTRSNRIEEVKLS

SEQ ID NO: 3022004 - protein, 26 aa, Entamoeba invadens
VHRDLKPANLLLKKSNFKFPIVKIAD

SEQ ID NO: 3022005 - protein, 19 aa, Entamoeba invadens
VHRDLKPANLLLKKSNFQY

SEQ ID NO: 3022006 - protein, 18 aa, Entamoeba invadens
VHRLDRMTSGILILAKSA

SEQ ID NO: 3022007 - protein, 25 aa, Entamoeba invadens
VHRSMMLGRKYYFSMRLKTMVRGLD

SEQ ID NO: 3022008 - protein, 26 aa, Entamoeba invadens
VHRSMMLGRKYYFSMRLKTMVRGLDE

SEQ ID NO: 3022009 - protein, 20 aa, Entamoeba invadens
VHRYVLVSRCDFFKQYFSMP

SEQ ID NO: 3022010 - protein, 25 aa, Entamoeba invadens
VHSATKRLILTCLIKMAKELPDIRP

SEQ ID NO: 3022011 - protein, 26 aa, Entamoeba invadens
VHTPMPYFVFCFTNVFSVGQIVGDAV

SEQ ID NO: 3022012 - protein, 26 aa, Entamoeba invadens
VHVDTPYFKFIFSQEDIADIEKIPIT

SEQ ID NO: 3022013 - protein, 26 aa, Entamoeba invadens
VHYAAPEVILPKKGGLRYSKECDVWA

SEQ ID NO: 3022014 - protein, 29 aa, Entamoeba invadens
VHYFEIINVVYYNEKLKYIKTIDLAIQNN

SEQ ID NO: 3022015 - protein, 26 aa, Entamoeba invadens
VIACVLKCFLQNLKKHVFPTMASLEM

SEQ ID NO: 3022016 - protein, 26 aa, Entamoeba invadens
VIAHSPILFLTNDLLLKIFCFLSSDE

SEQ ID NO: 3022017 - protein, 27 aa, Entamoeba invadens
VIAIPPLVMTPFTLSVCLKDFFDLRGI

SEQ ID NO: 3022018 - protein, 31 aa, Entamoeba invadens
VIAIQLCNEPFLITKLQIWLELRNITDDIDK

SEQ ID NO: 3022019 - protein, 17 aa, Entamoeba invadens
VIALFDLPKLSTFECDN

SEQ ID NO: 3022020 - protein, 19 aa, Entamoeba invadens
VIAPLGKFAVKLPLDYRLS

SEQ ID NO: 3022021 - protein, 18 aa, Entamoeba invadens
VIARHLQTLKPRPIVWRT

SEQ ID NO: 3022022 - protein, 33 aa, Entamoeba invadens
VIASQRICPLELKAACGAILYASPYFPDHTEMM

SEQ ID NO: 3022023 - protein, 36 aa, Entamoeba invadens
VIATGRPLKTALWFTDSLDILPITILTSNGNLTVRK

SEQ ID NO: 3022024 - protein, 17 aa, Entamoeba invadens
VIAYLMKHKDMSFTKAY

SEQ ID NO: 3022025 - protein, 17 aa, Entamoeba invadens
VICLLYALKIRSPKQIF

SEQ ID NO: 3022026 - protein, 17 aa, Entamoeba invadens
VICPTRELALQTVKVFN

SEQ ID NO: 3022027 - protein, 18 aa, Entamoeba invadens
VIDALLIFSGVVSPQFMT

SEQ ID NO: 3022028 - protein, 18 aa, Entamoeba invadens
VIDGNVVELFLDLPKESQ

SEQ ID NO: 3022029 - protein, 24 aa, Entamoeba invadens
VIDKIKAIPHYDKEVKYLLKVFPG

SEQ ID NO: 3022030 - protein, 20 aa, Entamoeba invadens
VIDQIAFKLLNLKEVLMGAN

SEQ ID NO: 3022031 - protein, 19 aa, Entamoeba invadens
VIDRKPLRIAEGTGNVVFS

SEQ ID NO: 3022032 - protein, 25 aa, Entamoeba invadens
VIDSDFFHKLFSYYLEGYPNLSPDL

SEQ ID NO: 3022033 - protein, 23 aa, Entamoeba invadens
VIDYLSIFSLFDYFLPPSVKKQH

SEQ ID NO: 3022034 - protein, 30 aa, Entamoeba invadens
VIEFDLTLLKYYTCVKKWYYLHSPEHQRTE

SEQ ID NO: 3022035 - protein, 20 aa, Entamoeba invadens
VIEFNAKLLIIFHTLCSSDI

SEQ ID NO: 3022036 - protein, 29 aa, Entamoeba invadens
VIEIPHPPPGLYPELFINTSLIADTEEMR

SEQ ID NO: 3022037 - protein, 17 aa, Entamoeba invadens
VIEIPILAFDRCINLKK

SEQ ID NO: 3022038 - protein, 19 aa, Entamoeba invadens
VIELPPTLQRIGKYCFKLC

SEQ ID NO: 3022039 - protein, 20 aa, Entamoeba invadens
VIEMEWFKDIDFDKLLKKEV

SEQ ID NO: 3022040 - protein, 26 aa, Entamoeba invadens
VIEPVTIYIKSGYYPLINNSLKFTTW

SEQ ID NO: 3022041 - protein, 24 aa, Entamoeba invadens
VIERNIEIIPKVLPQRLDAKGVIC

SEQ ID NO: 3022042 - protein, 17 aa, Entamoeba invadens
VIESGLFSYCHRLRRVV

SEQ ID NO: 3022043 - protein, 32 aa, Entamoeba invadens
VIETLKSFRSSKQFPHLLLCGQPGIGKTTSIH

SEQ ID NO: 3022044 - protein, 28 aa, Entamoeba invadens
VIEYSIFPLRVYFYSHEFCPGISQVFFE

SEQ ID NO: 3022045 - protein, 19 aa, Entamoeba invadens
VIFDWPNFSMELVAPQKEV

SEQ ID NO: 3022046 - protein, 17 aa, Entamoeba invadens
VIFKLYNVLDKMMKMDV

SEQ ID NO: 3022047 - protein, 26 aa, Entamoeba invadens
VIFNRPYIGIDFLDVGRYRQMCGRAG

SEQ ID NO: 3022048 - protein, 23 aa, Entamoeba invadens
VIGEVKRFIGLNYDDFAIKTICK

SEQ ID NO: 3022049 - protein, 27 aa, Entamoeba invadens
VIGGDQYRLPLYLTQIIIPNGVSQINS

SEQ ID NO: 3022050 - protein, 18 aa, Entamoeba invadens
VIGGPKFEPLYRDNLDDA

SEQ ID NO: 3022051 - protein, 26 aa, Entamoeba invadens
VIGKENLVFLMLTSSKEVFGCYVSDS

SEQ ID NO: 3022052 - protein, 20 aa, Entamoeba invadens
VIGLVSLSVVWRIGFCKSVT

SEQ ID NO: 3022053 - protein, 23 aa, Entamoeba invadens
VIGPNAFSYCRKLMQFDVPHKVR

SEQ ID NO: 3022054 - protein, 20 aa, Entamoeba invadens
VIGRRLGVEGFVPRGFVKIQ

SEQ ID NO: 3022055 - protein, 26 aa, Entamoeba invadens
VIGSFYGFITFRPSSALLFATFDGRE

SEQ ID NO: 3022056 - protein, 25 aa, Entamoeba invadens
VIGVLNSFFFTKLSDTWKLKGNEIN

SEQ ID NO: 3022057 - protein, 20 aa, Entamoeba invadens
VIGYPVLIPIMLKRSQFKVQ

SEQ ID NO: 3022058 - protein, 18 aa, Entamoeba invadens
VIHFKGISDFLILADETL

SEQ ID NO: 3022059 - protein, 18 aa, Entamoeba invadens
VIHLYTESQILFFSERKK

SEQ ID NO: 3022060 - protein, 25 aa, Entamoeba invadens
VIHNYVKNIFLWKLFEVHHLSTNMR

SEQ ID NO: 3022061 - protein, 23 aa, Entamoeba invadens
VIIDFRDVLFFADFFRTFGANEV

SEQ ID NO: 3022062 - protein, 22 aa, Entamoeba invadens
VIIIDNYKGWIDTKLVNIFKEN

SEQ ID NO: 3022063 - protein, 19 aa, Entamoeba invadens
VIIIGESCFKLCISLSVIN

SEQ ID NO: 3022064 - protein, 23 aa, Entamoeba invadens
VIIKDVVEPYIFHKLRQTRKKGI

SEQ ID NO: 3022065 - protein, 27 aa, Entamoeba invadens
VIILRRLCVEFPDLLTKCNLFCGVSAS

SEQ ID NO: 3022066 - protein, 17 aa, Entamoeba invadens
VIINKYEHVKYLALKNT

SEQ ID NO: 3022067 - protein, 17 aa, Entamoeba invadens
VIIPFQMANQRALEQAA

SEQ ID NO: 3022068 - protein, 20 aa, Entamoeba invadens
VIIQNKLFVLKSTFMYIVDL

SEQ ID NO: 3022069 - protein, 26 aa, Entamoeba invadens
VIIVVDLRGWSLGYVNDLFIQEQLTP

SEQ ID NO: 3022070 - protein, 18 aa, Entamoeba invadens
VIKCICTLFEGDEQCAKI

SEQ ID NO: 3022071 - protein, 19 aa, Entamoeba invadens
VIKIHRDFIINYVDHIVTV

SEQ ID NO: 3022072 - protein, 17 aa, Entamoeba invadens
VIKKAFLCDFLCSVSGV

SEQ ID NO: 3022073 - protein, 25 aa, Entamoeba invadens
VIKLNGVEYVVKYLKHPFLSRRGDD

SEQ ID NO: 3022074 - protein, 23 aa, Entamoeba invadens
VIKNDLFQFYLVSHVPKKGMVKP

SEQ ID NO: 3022075 - protein, 20 aa, Entamoeba invadens
VIKNERLLLRYPDWRVMEEF

SEQ ID NO: 3022076 - protein, 27 aa, Entamoeba invadens
VIKNNAKKFVVLTDRGLREFECQNSKE

SEQ ID NO: 3022077 - protein, 33 aa, Entamoeba invadens
VIKNQKIKIIPLEVPMAIFHFGGTFTHIINETP

SEQ ID NO: 3022078 - protein, 23 aa, Entamoeba invadens
VIKQFDCYLDLPNPIKVQGINNQ

SEQ ID NO: 3022079 - protein, 23 aa, Entamoeba invadens
VIKQIPGMKAFMKNINSLAKTLQ

SEQ ID NO: 3022080 - protein, 21 aa, Entamoeba invadens
VIKRDNQIADLEKAVAALKDQ

SEQ ID NO: 3022081 - protein, 23 aa, Entamoeba invadens
VIKRDNQIADLEKAVAALKEQNT

SEQ ID NO: 3022082 - protein, 23 aa, Entamoeba invadens
VIKRDNQIADLEKAVLALKEQNT

SEQ ID NO: 3022083 - protein, 23 aa, Entamoeba invadens
VIKRDNQIVDLEKAVAALKDQNT

SEQ ID NO: 3022084 - protein, 18 aa, Entamoeba invadens
VIKRVYVDVLLPTIKEKQ

SEQ ID NO: 3022085 - protein, 23 aa, Entamoeba invadens
VIKSRVIVALKYFCDDALDECNQ

SEQ ID NO: 3022086 - protein, 23 aa, Entamoeba invadens
VIKSSAFFNCRNLENLKIPKSVL

SEQ ID NO: 3022087 - protein, 23 aa, Entamoeba invadens
VIKTDLLMLKDNYINDVKLLRMA

SEQ ID NO: 3022088 - protein, 18 aa, Entamoeba invadens
VILGLPYSTAIDMWSFGC

SEQ ID NO: 3022089 - protein, 24 aa, Entamoeba invadens
VILKSNMKILQFMKIHTFDNKCEN

SEQ ID NO: 3022090 - protein, 25 aa, Entamoeba invadens
VILNTLFHKYPKSLQTQFLPISKSS

SEQ ID NO: 3022091 - protein, 18 aa, Entamoeba invadens
VILPFIQSWVAVFRNEYQ

SEQ ID NO: 3022092 - protein, 18 aa, Entamoeba invadens
VILSFHHRVLSKEKLNKR

SEQ ID NO: 3022093 - protein, 25 aa, Entamoeba invadens
VIMDKDLYPRKWGLGPFAQQKKKLV

SEQ ID NO: 3022094 - protein, 28 aa, Entamoeba invadens
VIMKKDITLLLRKNALRFYPIVPMADSD

SEQ ID NO: 3022095 - protein, 26 aa, Entamoeba invadens
VINAQPIFLVLPCLIASVVDTRKKDI

SEQ ID NO: 3022096 - protein, 27 aa, Entamoeba invadens
VINENAFSYLLVGVPLKVIKGTVGKMS

SEQ ID NO: 3022097 - protein, 25 aa, Entamoeba invadens
VINISFIISYIKKSFWIDGNKVSII

SEQ ID NO: 3022098 - protein, 31 aa, Entamoeba invadens
VINLEFYSSYLLIVTPMRILLIQNGDVIDDI

SEQ ID NO: 3022099 - protein, 21 aa, Entamoeba invadens
VINLFTPEEFSFYFSTRKNNF

SEQ ID NO: 3022100 - protein, 27 aa, Entamoeba invadens
VINSPTIRWFFKHFSPDTFDSAFLDFE

SEQ ID NO: 3022101 - protein, 17 aa, Entamoeba invadens
VINSSYFRTFKTHPFLN

SEQ ID NO: 3022102 - protein, 18 aa, Entamoeba invadens
VINSYFAYMSFIQLGQVV

SEQ ID NO: 3022103 - protein, 23 aa, Entamoeba invadens
VINTILTIISPLLTYCTEYDNIV

SEQ ID NO: 3022104 - protein, 19 aa, Entamoeba invadens
VIPCGLLVLRGDEIILIGA

SEQ ID NO: 3022105 - protein, 20 aa, Entamoeba invadens
VIPENMLINDYLLNHLMDEQ

SEQ ID NO: 3022106 - protein, 20 aa, Entamoeba invadens
VIPKFCFEKCYLLTTVVFAE

SEQ ID NO: 3022107 - protein, 21 aa, Entamoeba invadens
VIPLVLFFKQRIRNLVNFLLY

SEQ ID NO: 3022108 - protein, 17 aa, Entamoeba invadens
VIPLVLFYKQSNNELEI

SEQ ID NO: 3022109 - protein, 19 aa, Entamoeba invadens
VIPNKLLCIGARAFYNCSN

SEQ ID NO: 3022110 - protein, 18 aa, Entamoeba invadens
VIPNKLLCINARAFYNCS

SEQ ID NO: 3022111 - protein, 19 aa, Entamoeba invadens
VIPNSFYQLFLNESVILHN

SEQ ID NO: 3022112 - protein, 21 aa, Entamoeba invadens
VIPPDWVVTSLLPLQSTIRSY

SEQ ID NO: 3022113 - protein, 18 aa, Entamoeba invadens
VIPRGVKKIGSFAFWRCQ

SEQ ID NO: 3022114 - protein, 34 aa, Entamoeba invadens
VIPRGVKKIGSFAFWRCQQLKEIILPESLEEIGE

SEQ ID NO: 3022115 - protein, 19 aa, Entamoeba invadens
VIPSRYLLDFINLPKQRMI

SEQ ID NO: 3022116 - protein, 26 aa, Entamoeba invadens
VIPTDYPFRPPSLLMYTPSGRFAVDT

SEQ ID NO: 3022117 - protein, 35 aa, Entamoeba invadens
VIQDTIHTWYQFRNWVWFRLFQKVRPTLKRRRVDE

SEQ ID NO: 3022118 - protein, 35 aa, Entamoeba invadens
VIQDTIHTWYQFRNWVWFRLLQKVQPTLKRRRKLV

SEQ ID NO: 3022119 - protein, 17 aa, Entamoeba invadens
VIQFFVLGSLSEYLRKD

SEQ ID NO: 3022120 - protein, 19 aa, Entamoeba invadens
VIQFNLYNSFGWSLLNEVE

SEQ ID NO: 3022121 - protein, 23 aa, Entamoeba invadens
VIQQTFLVMQIVMSDTAETLCDN

SEQ ID NO: 3022122 - protein, 31 aa, Entamoeba invadens
VIQVCCFRRFPQFLTDFLQNKEISKLGVGVH

SEQ ID NO: 3022123 - protein, 18 aa, Entamoeba invadens
VIREISFPALDHVSVFPF

SEQ ID NO: 3022124 - protein, 33 aa, Entamoeba invadens
VIRGWSFVAIFNGTLCTPLFTLTAHTLPVTHII

SEQ ID NO: 3022125 - protein, 19 aa, Entamoeba invadens
VIRKKYEILLGENIGEEGE

SEQ ID NO: 3022126 - protein, 24 aa, Entamoeba invadens
VIRKLEFWLDVRQKYRTYCSRIRS

SEQ ID NO: 3022127 - protein, 18 aa, Entamoeba invadens
VIRLEKVLCFLRDSFRCQ

SEQ ID NO: 3022128 - protein, 28 aa, Entamoeba invadens
VIRNSLLEYGFPITIKDGAWIGANAIIM

SEQ ID NO: 3022129 - protein, 36 aa, Entamoeba invadens
VIRNTLLQYSEKDNPWVRLFEQCKTDLAAAETAKTL

SEQ ID NO: 3022130 - protein, 22 aa, Entamoeba invadens
VIRRFHLSFVTHVYASLLTDRN

SEQ ID NO: 3022131 - protein, 18 aa, Entamoeba invadens
VISDPRYRKVSVGFVVYN

SEQ ID NO: 3022132 - protein, 18 aa, Entamoeba invadens
VISENKMHFFGIKGSWTA

SEQ ID NO: 3022133 - protein, 26 aa, Entamoeba invadens
VISIHKLNTLFLNKLHNIYSGVFTLG

SEQ ID NO: 3022134 - protein, 17 aa, Entamoeba invadens
VISIIEVPWYEKVIVIL

SEQ ID NO: 3022135 - protein, 25 aa, Entamoeba invadens
VISKKRIPWTTICKIVLVALENIEK

SEQ ID NO: 3022136 - protein, 27 aa, Entamoeba invadens
VISMCIPLTMLLLHQKLHTALVAIFTQ

SEQ ID NO: 3022137 - protein, 28 aa, Entamoeba invadens
VISPDQFKILLIFLKTFFSEESSGENNK

SEQ ID NO: 3022138 - protein, 30 aa, Entamoeba invadens
VISPPYFFTLYFFTPTFHFYFNKQLKFCNF

SEQ ID NO: 3022139 - protein, 25 aa, Entamoeba invadens
VISVARTCDCIMLLIDGTKSLDLKE

SEQ ID NO: 3022140 - protein, 23 aa, Entamoeba invadens
VITDKRVGLLKKATFLVKSTVPK

SEQ ID NO: 3022141 - protein, 25 aa, Entamoeba invadens
VITEPIATVLYYLDANRESAAKNFI

SEQ ID NO: 3022142 - protein, 25 aa, Entamoeba invadens
VITGLTQFLIDKKINYVRIDGSTKA

SEQ ID NO: 3022143 - protein, 17 aa, Entamoeba invadens
VITGRFKMLRKKGRWMV

SEQ ID NO: 3022144 - protein, 26 aa, Entamoeba invadens
VITKPQIVLFFSEGDFYKYVIKQAYL

SEQ ID NO: 3022145 - protein, 17 aa, Entamoeba invadens
VITLLTPDQTMVLSLLA

SEQ ID NO: 3022146 - protein, 32 aa, Entamoeba invadens
VITLPYVHTHLLKDLLIVKLYKKQKKENVVIA

SEQ ID NO: 3022147 - protein, 18 aa, Entamoeba invadens
VITNNVFGLLKKLDSSKD

SEQ ID NO: 3022148 - protein, 17 aa, Entamoeba invadens
VITQELLQLSPELTEIV

SEQ ID NO: 3022149 - protein, 18 aa, Entamoeba invadens
VITTMKRMPLFNPDHFMV

SEQ ID NO: 3022150 - protein, 29 aa, Entamoeba invadens
VITTQREMFFYMSLLSQQLPIESQFVNKL

SEQ ID NO: 3022151 - protein, 22 aa, Entamoeba invadens
VITYKQHFLIEKAKLFMVGKQI

SEQ ID NO: 3022152 - protein, 18 aa, Entamoeba invadens
VIVALLKIASRHSELVRN

SEQ ID NO: 3022153 - protein, 17 aa, Entamoeba invadens
VIVAYLMMAYQINIKTA

SEQ ID NO: 3022154 - protein, 20 aa, Entamoeba invadens
VIVEKFIEPLIKSYKLKIDS

SEQ ID NO: 3022155 - protein, 34 aa, Entamoeba invadens
VIVFFSCIPSVNYHYALFSELKFLNDTTLFQDTN

SEQ ID NO: 3022156 - protein, 17 aa, Entamoeba invadens
VIVGDGAVGKTCILCSY

SEQ ID NO: 3022157 - protein, 18 aa, Entamoeba invadens
VIVKQAVMFTKTFNFPNE

SEQ ID NO: 3022158 - protein, 25 aa, Entamoeba invadens
VIVPRRRFLPVKSCSDLFVVQSTVF

SEQ ID NO: 3022159 - protein, 29 aa, Entamoeba invadens
VIVRSRLTKFPKFLRKLPNLYDIMITDSM

SEQ ID NO: 3022160 - protein, 20 aa, Entamoeba invadens
VIVTQPWLNVLQELPEPFKF

SEQ ID NO: 3022161 - protein, 17 aa, Entamoeba invadens
VIWLLRSLGSDDGADDF

SEQ ID NO: 3022162 - protein, 18 aa, Entamoeba invadens
VIYKIAYSLYRSENYYGA

SEQ ID NO: 3022163 - protein, 17 aa, Entamoeba invadens
VKACSVLFKGTFRDNIV

SEQ ID NO: 3022164 - protein, 41 aa, Entamoeba invadens
VKADIWALGCTILELITGNPPYWDLNPTAALYRICTDDHPP

SEQ ID NO: 3022165 - protein, 19 aa, Entamoeba invadens
VKAFLRRAVILSHNKSFVE

SEQ ID NO: 3022166 - protein, 22 aa, Entamoeba invadens
VKAFYRIGVVLNKKKSYPLALN

SEQ ID NO: 3022167 - protein, 24 aa, Entamoeba invadens
VKAREYYLLAQKIYIQNKKLFDEA

SEQ ID NO: 3022168 - protein, 18 aa, Entamoeba invadens
VKATCVGILLVLKKDLLG

SEQ ID NO: 3022169 - protein, 26 aa, Entamoeba invadens
VKATNQHHILFIITPGIITDLTRTNN

SEQ ID NO: 3022170 - protein, 25 aa, Entamoeba invadens
VKCDVPFGWITFETNFSASALNFTN

SEQ ID NO: 3022171 - protein, 25 aa, Entamoeba invadens
VKCILDRDVLYLASLFASAKKKKTN

SEQ ID NO: 3022172 - protein, 26 aa, Entamoeba invadens
VKCMKRGYWLLMENVNFCNPTVLDRL

SEQ ID NO: 3022173 - protein, 31 aa, Entamoeba invadens
VKCSYCDGFLALFIRPLMWSTGKMTEFDLKV

SEQ ID NO: 3022174 - protein, 31 aa, Entamoeba invadens
VKDDMILEDQLTLLLTYMTQPLDVPIIQQEN

SEQ ID NO: 3022175 - protein, 26 aa, Entamoeba invadens
VKDFDALSALWKYIFEEKLRIDSSEK

SEQ ID NO: 3022176 - protein, 23 aa, Entamoeba invadens
VKDGVEFTLKCNYDTFIEASNVG

SEQ ID NO: 3022177 - protein, 28 aa, Entamoeba invadens
VKDIDVLYPYVGPFWFDRMGWEPVEEEE

SEQ ID NO: 3022178 - protein, 29 aa, Entamoeba invadens
VKDIIQRTKLVRGFFLLNSKGSPFTRSLK

SEQ ID NO: 3022179 - protein, 19 aa, Entamoeba invadens
VKDKKCFLCGKTGHISLVC

SEQ ID NO: 3022180 - protein, 24 aa, Entamoeba invadens
VKDKPAVSFVWQYDKTKPKTERVM

SEQ ID NO: 3022181 - protein, 29 aa, Entamoeba invadens
VKDKPWKNQFFYYFYKTKPDLDVVLFGVG

SEQ ID NO: 3022182 - protein, 28 aa, Entamoeba invadens
VKDLIKSFLVNAPLLKFPEGKIPPVVSL

SEQ ID NO: 3022183 - protein, 30 aa, Entamoeba invadens
VKDQKTLHHLFLYMKYQLKSSIMAYCITHE

SEQ ID NO: 3022184 - protein, 25 aa, Entamoeba invadens
VKDSFVLRVLYRLKCQLSLRFTQIS

SEQ ID NO: 3022185 - protein, 24 aa, Entamoeba invadens
VKDTQIFLYNFNTEKTLFTFTFSE

SEQ ID NO: 3022186 - protein, 28 aa, Entamoeba invadens
VKDVDIAIFYNAPPPFKKSYEVTFAQPV

SEQ ID NO: 3022187 - protein, 23 aa, Entamoeba invadens
VKEELSRQIPVLDNVLLSSRKSE

SEQ ID NO: 3022188 - protein, 24 aa, Entamoeba invadens
VKEIGCSAFWRCDIKKLCIPDSVT

SEQ ID NO: 3022189 - protein, 24 aa, Entamoeba invadens
VKEKDLTLTLFLKSDPKVCGSAVV

SEQ ID NO: 3022190 - protein, 24 aa, Entamoeba invadens
VKELFFAFKLTKMANPFLPFSTQA

SEQ ID NO: 3022191 - protein, 25 aa, Entamoeba invadens
VKELYHLNFGLVNLEKLVIPETTKI

SEQ ID NO: 3022192 - protein, 23 aa, Entamoeba invadens
VKEMRIYIPYITSRFIYRSEVVE

SEQ ID NO: 3022193 - protein, 23 aa, Entamoeba invadens
VKEMVPLIVQCRTALIALLADLH

SEQ ID NO: 3022194 - protein, 31 aa, Entamoeba invadens
VKENPVFEYIRYIILPFLGKAKLCGKEYTFQ

SEQ ID NO: 3022195 - protein, 25 aa, Entamoeba invadens
VKENVLLEFTIFDSGFLITISRNIL

SEQ ID NO: 3022196 - protein, 33 aa, Entamoeba invadens
VKEPKFACQFKLIRYIFPLALLNMIVSCSLETK

SEQ ID NO: 3022197 - protein, 24 aa, Entamoeba invadens
VKEQYNNFPGLYTALAKFSNPLNE

SEQ ID NO: 3022198 - protein, 29 aa, Entamoeba invadens
VKERLETAIYLQFHQSTTLRISDFVYSFP

SEQ ID NO: 3022199 - protein, 30 aa, Entamoeba invadens
VKERNDFIVYWLKKMKKFQKMFVRIVDKKQ

SEQ ID NO: 3022200 - protein, 26 aa, Entamoeba invadens
VKESKNPIILFIDKIHTVLGAGANKE

SEQ ID NO: 3022201 - protein, 27 aa, Entamoeba invadens
VKESKNPIILFIDKIHTVLGAGATGEG

SEQ ID NO: 3022202 - protein, 24 aa, Entamoeba invadens
VKEVIPQLFKISMESKLAFPCADE

SEQ ID NO: 3022203 - protein, 28 aa, Entamoeba invadens
VKEYPLHPRLGKLLHLLNKEELGEVALS

SEQ ID NO: 3022204 - protein, 31 aa, Entamoeba invadens
VKFGPRHNQLLPIDKIKPFTPGTVPLATVQV

SEQ ID NO: 3022205 - protein, 20 aa, Entamoeba invadens
VKFHFNPIPLTRETLKFFPH

SEQ ID NO: 3022206 - protein, 29 aa, Entamoeba invadens
VKFICGMNGFIFITFGKEPEKTNAHFEKL

SEQ ID NO: 3022207 - protein, 17 aa, Entamoeba invadens
VKFWEVKGHIIKMLIYR

SEQ ID NO: 3022208 - protein, 18 aa, Entamoeba invadens
VKGFDKVVYFGKSSFGYT

SEQ ID NO: 3022209 - protein, 19 aa, Entamoeba invadens
VKGFSGIGGILRYKLDMEQ

SEQ ID NO: 3022210 - protein, 25 aa, Entamoeba invadens
VKGHIIKMLIYRIRPEKDIVKEIGL

SEQ ID NO: 3022211 - protein, 18 aa, Entamoeba invadens
VKGKIFLFSIEDSELLVT

SEQ ID NO: 3022212 - protein, 31 aa, Entamoeba invadens
VKGKKMDRLLLGIVYHICKIDNIGLTIKEIS

SEQ ID NO: 3022213 - protein, 25 aa, Entamoeba invadens
VKGKNTIIFGYYNNTAKPVTAGQNH

SEQ ID NO: 3022214 - protein, 19 aa, Entamoeba invadens
VKGLLDFTFDFIDKNKNGS

SEQ ID NO: 3022215 - protein, 24 aa, Entamoeba invadens
VKGRKCYSLPLILNQYKGQTDAKT

SEQ ID NO: 3022216 - protein, 37 aa, Entamoeba invadens
VKHEFEFFLNETKELLIYYKTFLIDNILICVNKMSCV

SEQ ID NO: 3022217 - protein, 62 aa, Entamoeba invadens
VKHEVINIFAIKWIKMMFAREFLLNDVVIIWDSLFAFGKKLKLLDGFFLAMLHFVRNDIIEN

SEQ ID NO: 3022218 - protein, 18 aa, Entamoeba invadens
VKHFSMVWDVAGGGAFAT

SEQ ID NO: 3022219 - protein, 30 aa, Entamoeba invadens
VKHLGEGKYFISYTLPAVKGKYFINCKLNR

SEQ ID NO: 3022220 - protein, 36 aa, Entamoeba invadens
VKHNKNRIFVATQNDFFVFSHKITALEKLELLGRWN

SEQ ID NO: 3022221 - protein, 29 aa, Entamoeba invadens
VKICSFKMEGLLDYLVDSPSFDSQKSTYE

SEQ ID NO: 3022222 - protein, 27 aa, Entamoeba invadens
VKIINDWLQTANLLYPVAYQRVKDLIL

SEQ ID NO: 3022223 - protein, 33 aa, Entamoeba invadens
VKITDWVVMINTNKAFLFTLTAKKKKQIEIFRT

SEQ ID NO: 3022224 - protein, 18 aa, Entamoeba invadens
VKITPMFDRKVLVSALEK

SEQ ID NO: 3022225 - protein, 28 aa, Entamoeba invadens
VKITRYELLFFFALSFFHIEWNDYYDEN

SEQ ID NO: 3022226 - protein, 20 aa, Entamoeba invadens
VKKCEVCMFYNTSPFDDDHI

SEQ ID NO: 3022227 - protein, 17 aa, Entamoeba invadens
VKKCIANIFLIPEKCFG

SEQ ID NO: 3022228 - protein, 23 aa, Entamoeba invadens
VKKCNWRFPIPVFRSIEYLEKNG

SEQ ID NO: 3022229 - protein, 25 aa, Entamoeba invadens
VKKDKPFLYVPLELPKVPQTPLTTT

SEQ ID NO: 3022230 - protein, 22 aa, Entamoeba invadens
VKKELLKIQPEMIYAAGDLTDP

SEQ ID NO: 3022231 - protein, 22 aa, Entamoeba invadens
VKKENIFRFVQCNFMTGENVKE

SEQ ID NO: 3022232 - protein, 28 aa, Entamoeba invadens
VKKIGSFAFWRCQQLKEIILPESLEEIG

SEQ ID NO: 3022233 - protein, 25 aa, Entamoeba invadens
VKKINVSEWFYLKHVYIEPDQRYQN

SEQ ID NO: 3022234 - protein, 17 aa, Entamoeba invadens
VKKIRVVVPPSISLLNL

SEQ ID NO: 3022235 - protein, 17 aa, Entamoeba invadens
VKKKWITALFFEKDVEV

SEQ ID NO: 3022236 - protein, 25 aa, Entamoeba invadens
VKKLILLMTFTTFKRTIPSPYKYTT

SEQ ID NO: 3022237 - protein, 32 aa, Entamoeba invadens
VKKLRPEETLFLQPFFARTYFSVACAPEGEVP

SEQ ID NO: 3022238 - protein, 17 aa, Entamoeba invadens
VKKMFQTIYDSLKLPEV

SEQ ID NO: 3022239 - protein, 26 aa, Entamoeba invadens
VKKMNAKIPLVQLKDLLIKLDNLIEQ

SEQ ID NO: 3022240 - protein, 31 aa, Entamoeba invadens
VKKNFDSYALYISRVLKSVFPDIGITLPSIS

SEQ ID NO: 3022241 - protein, 33 aa, Entamoeba invadens
VKKNFDSYALYISRVLRSVFPDIGITLPSVSVM

SEQ ID NO: 3022242 - protein, 25 aa, Entamoeba invadens
VKKNTWTYYKFLFSELNITNNSFWG

SEQ ID NO: 3022243 - protein, 24 aa, Entamoeba invadens
VKKSKIPIILFTQDTYTVLGAGAT

SEQ ID NO: 3022244 - protein, 23 aa, Entamoeba invadens
VKKSLLTQLFKISGLVTSMIYVN

SEQ ID NO: 3022245 - protein, 38 aa, Entamoeba invadens
VKKSPMENLFFPESLLSRFDLIFIVLDSTTEEIDRSVA

SEQ ID NO: 3022246 - protein, 28 aa, Entamoeba invadens
VKKTFEQLAFIECSLIGDLAVMKKKRKA

SEQ ID NO: 3022247 - protein, 24 aa, Entamoeba invadens
VKKTVFEFYPIGTIFHELSKKEEN

SEQ ID NO: 3022248 - protein, 25 aa, Entamoeba invadens
VKKVSENILYFAHLVLFVARNNTSS

SEQ ID NO: 3022249 - protein, 18 aa, Entamoeba invadens
VKKVVLFKSKFVNDLSLC

SEQ ID NO: 3022250 - protein, 26 aa, Entamoeba invadens
VKLESVQTALLFDKGVIESNFVKIRR

SEQ ID NO: 3022251 - protein, 26 aa, Entamoeba invadens
VKLETMAVWINRPRSRIDKLLAATPV

SEQ ID NO: 3022252 - protein, 19 aa, Entamoeba invadens
VKLFFLTNEKLQPVLEGLH

SEQ ID NO: 3022253 - protein, 26 aa, Entamoeba invadens
VKLICELYKMKVVVEALPIFCMQQLV

SEQ ID NO: 3022254 - protein, 29 aa, Entamoeba invadens
VKLILEPTAAFYFYGIRNHGFNIENDVTK

SEQ ID NO: 3022255 - protein, 20 aa, Entamoeba invadens
VKLIQQVHPKPLKPTPIVKK

SEQ ID NO: 3022256 - protein, 19 aa, Entamoeba invadens
VKLLLDRTVSLFNWSDFSP

SEQ ID NO: 3022257 - protein, 20 aa, Entamoeba invadens
VKLMKYHRYSLIKLITNTDN

SEQ ID NO: 3022258 - protein, 36 aa, Entamoeba invadens
VKLPNWSIVWAKQKGYPWWPAKLVLVDSLPEDQKKP

SEQ ID NO: 3022259 - protein, 25 aa, Entamoeba invadens
VKLQYPLMKCVLEPLVKDLVIKFDT

SEQ ID NO: 3022260 - protein, 22 aa, Entamoeba invadens
VKLRDFRKKFPSVQTIMFTATA

SEQ ID NO: 3022261 - protein, 17 aa, Entamoeba invadens
VKLTLAPIAPEWKATLK

SEQ ID NO: 3022262 - protein, 25 aa, Entamoeba invadens
VKMAYNYRVLLINTNYSIVNYLLCK

SEQ ID NO: 3022263 - protein, 23 aa, Entamoeba invadens
VKMAYNYRVLLTNTNYSIVNYLL

SEQ ID NO: 3022264 - protein, 26 aa, Entamoeba invadens
VKMFEDFLMKLLTFNESHNLPKSAFE

SEQ ID NO: 3022265 - protein, 27 aa, Entamoeba invadens
VKMMRELHPVFPILARYVYTIGELDKI

SEQ ID NO: 3022266 - protein, 18 aa, Entamoeba invadens
VKMNVLWNLGLIDIKGTT

SEQ ID NO: 3022267 - protein, 27 aa, Entamoeba invadens
VKMVDSCMLTLLFNFSQYDSPFTREVH

SEQ ID NO: 3022268 - protein, 24 aa, Entamoeba invadens
VKMYDHFMFCDHLCIVFELLDKNL

SEQ ID NO: 3022269 - protein, 18 aa, Entamoeba invadens
VKMYIIDRVMIKAQFWDL

SEQ ID NO: 3022270 - protein, 22 aa, Entamoeba invadens
VKNAIIFCGKTIPLCVISTIGA

SEQ ID NO: 3022271 - protein, 18 aa, Entamoeba invadens
VKNFIFMKNLEIGEALQT

SEQ ID NO: 3022272 - protein, 19 aa, Entamoeba invadens
VKNKSFFNQFKNNFVYSPQ

SEQ ID NO: 3022273 - protein, 25 aa, Entamoeba invadens
VKNLRELDDVAPYLKDLTGGDATIE

SEQ ID NO: 3022274 - protein, 23 aa, Entamoeba invadens
VKNNIDDFPLWMDDYPVFANIFK

SEQ ID NO: 3022275 - protein, 24 aa, Entamoeba invadens
VKNRFCSHILRVIKRANSKTKEVK

SEQ ID NO: 3022276 - protein, 24 aa, Entamoeba invadens
VKNTIICFIGIGMYNDVFPSEIVF

SEQ ID NO: 3022277 - protein, 23 aa, Entamoeba invadens
VKNWKKRWFDFMSDGVLNYYTNR

SEQ ID NO: 3022278 - protein, 20 aa, Entamoeba invadens
VKPFPPFLEDKWYTHGFEFK

SEQ ID NO: 3022279 - protein, 17 aa, Entamoeba invadens
VKPKSSPPAQRPPIKII

SEQ ID NO: 3022280 - protein, 18 aa, Entamoeba invadens
VKQALLALRESLTTTNDK

SEQ ID NO: 3022281 - protein, 27 aa, Entamoeba invadens
VKQENIKFPPIIRPTSNVHMELVDNEN

SEQ ID NO: 3022282 - protein, 24 aa, Entamoeba invadens
VKQKVVDVFLHRQPPETYQPSQIL

SEQ ID NO: 3022283 - protein, 24 aa, Entamoeba invadens
VKQKYVTFKLMDFGFGKEAAELTT

SEQ ID NO: 3022284 - protein, 25 aa, Entamoeba invadens
VKQNDLILVCKLCKGGYAFKENTGM

SEQ ID NO: 3022285 - protein, 23 aa, Entamoeba invadens
VKQSQFNSFLTFLMNHNQTVIDD

SEQ ID NO: 3022286 - protein, 26 aa, Entamoeba invadens
VKRFPQQYFYVYFLFETNETSGNGCS

SEQ ID NO: 3022287 - protein, 17 aa, Entamoeba invadens
VKRGFQLGRNKPKNIRD

SEQ ID NO: 3022288 - protein, 17 aa, Entamoeba invadens
VKRIDGCYANIVGFPTP

SEQ ID NO: 3022289 - protein, 25 aa, Entamoeba invadens
VKRIKSELKLFPNLQTYQFSSGMFS

SEQ ID NO: 3022290 - protein, 27 aa, Entamoeba invadens
VKRIQAALLYVWSITLILKNAFTEDAE

SEQ ID NO: 3022291 - protein, 30 aa, Entamoeba invadens
VKRISEISWPMIYQVLVNKIEKFSCEGHKI

SEQ ID NO: 3022292 - protein, 22 aa, Entamoeba invadens
VKRKQLNKRKPLRKAKKAKGGE

SEQ ID NO: 3022293 - protein, 17 aa, Entamoeba invadens
VKRLIGCQYSDPAVLEE

SEQ ID NO: 3022294 - protein, 23 aa, Entamoeba invadens
VKRLLLLMLNCDASIALDLRTVM

SEQ ID NO: 3022295 - protein, 24 aa, Entamoeba invadens
VKRMTRTLYAEEYEFIVLKRDEPL

SEQ ID NO: 3022296 - protein, 23 aa, Entamoeba invadens
VKRNYLFVLNDIDTPFLLSHRQF

SEQ ID NO: 3022297 - protein, 17 aa, Entamoeba invadens
VKRRIYIRVVEDELNES

SEQ ID NO: 3022298 - protein, 22 aa, Entamoeba invadens
VKRYLTYMMLESHKNLYVFLVK

SEQ ID NO: 3022299 - protein, 24 aa, Entamoeba invadens
VKRYVPFALALTSIGKPKVPLLEQ

SEQ ID NO: 3022300 - protein, 27 aa, Entamoeba invadens
VKSFAMCCLLNYFLMLRDRHADNYLLQ

SEQ ID NO: 3022301 - protein, 17 aa, Entamoeba invadens
VKSFNEVIKLLLKEHEA

SEQ ID NO: 3022302 - protein, 27 aa, Entamoeba invadens
VKSGQYFFDTILTNLRIPFLREAGMET

SEQ ID NO: 3022303 - protein, 24 aa, Entamoeba invadens
VKSLDRLRVCREEFLSVFNELKLL

SEQ ID NO: 3022304 - protein, 19 aa, Entamoeba invadens
VKSLFGKEALPFLNDIFPG

SEQ ID NO: 3022305 - protein, 17 aa, Entamoeba invadens
VKSLMCLAFLPVEDVSG

SEQ ID NO: 3022306 - protein, 26 aa, Entamoeba invadens
VKSPLQLFKEWKSGMPLPMVFVSTSN

SEQ ID NO: 3022307 - protein, 25 aa, Entamoeba invadens
VKSQDPICILVFLPGMAEIEEMRAQ

SEQ ID NO: 3022308 - protein, 27 aa, Entamoeba invadens
VKSQKDLIRIPLTSPLLLVDDLINRMC

SEQ ID NO: 3022309 - protein, 23 aa, Entamoeba invadens
VKSQYQLYLGWYDNNPAHLNELP

SEQ ID NO: 3022310 - protein, 26 aa, Entamoeba invadens
VKSVMSMWGTWKDMTQLEKALIGGIT

SEQ ID NO: 3022311 - protein, 18 aa, Entamoeba invadens
VKSVRPFNFFDRISYITS

SEQ ID NO: 3022312 - protein, 19 aa, Entamoeba invadens
VKSVTFPRKIWVHRRLLGA

SEQ ID NO: 3022313 - protein, 25 aa, Entamoeba invadens
VKSWKKRWFVFRKSGALDYYADKKE

SEQ ID NO: 3022314 - protein, 21 aa, Entamoeba invadens
VKTGRHWCLCLPSSLVVLTIK

SEQ ID NO: 3022315 - protein, 18 aa, Entamoeba invadens
VKTIVFFIENYDKIFISN

SEQ ID NO: 3022316 - protein, 23 aa, Entamoeba invadens
VKTKMPIFLPRFKRYEISQKELG

SEQ ID NO: 3022317 - protein, 23 aa, Entamoeba invadens
VKTQTPEDLFDFGFEATPRMQET

SEQ ID NO: 3022318 - protein, 17 aa, Entamoeba invadens
VKTSLSAVPPLPLFSID

SEQ ID NO: 3022319 - protein, 24 aa, Entamoeba invadens
VKTTALCVLILKSLKELKPEKEFY

SEQ ID NO: 3022320 - protein, 31 aa, Entamoeba invadens
VKTTFDVEAYYNFLFTSRSKLRWVEFEYCLK

SEQ ID NO: 3022321 - protein, 25 aa, Entamoeba invadens
VKTTKKRYFVLKANKLFYYESENTS

SEQ ID NO: 3022322 - protein, 19 aa, Entamoeba invadens
VKTYFTCQLHFIVRDKKNV

SEQ ID NO: 3022323 - protein, 19 aa, Entamoeba invadens
VKVIMKYAQRYGYTDIVIC

SEQ ID NO: 3022324 - protein, 24 aa, Entamoeba invadens
VKVKISYIKRCDIMFALGNNDGYF

SEQ ID NO: 3022325 - protein, 25 aa, Entamoeba invadens
VKVLKTDILYYKRTIEELSAKLQTS

SEQ ID NO: 3022326 - protein, 22 aa, Entamoeba invadens
VKVMVLELLGLYDIINCWIGIS

SEQ ID NO: 3022327 - protein, 20 aa, Entamoeba invadens
VKVPSLYSPPSYVGEYIIKC

SEQ ID NO: 3022328 - protein, 26 aa, Entamoeba invadens
VKVVECIFLFVTECFKQYDIKPFPEV

SEQ ID NO: 3022329 - protein, 21 aa, Entamoeba invadens
VKVVFYSLQTLFPNKEFFSLK

SEQ ID NO: 3022330 - protein, 19 aa, Entamoeba invadens
VKVVPLDKILLETDAPFMA

SEQ ID NO: 3022331 - protein, 28 aa, Entamoeba invadens
VKVVQKLYELFSYHQVEFYKAIHRAFEI

SEQ ID NO: 3022332 - protein, 25 aa, Entamoeba invadens
VKVYKKTFYPKISSKNLRNYKKPEI

SEQ ID NO: 3022333 - protein, 19 aa, Entamoeba invadens
VKYDFIRRKNKWEKVDQND

SEQ ID NO: 3022334 - protein, 24 aa, Entamoeba invadens
VKYLLNVDHYFKIDKITHQNAMFL

SEQ ID NO: 3022335 - protein, 26 aa, Entamoeba invadens
VKYTTLVQCYYLIANLVFLDYDDIME

SEQ ID NO: 3022336 - protein, 24 aa, Entamoeba invadens
VKYVQIHSLLFQRDTQAILDELIK

SEQ ID NO: 3022337 - protein, 22 aa, Entamoeba invadens
VLADLLEKMLIYDEFKRATAKE

SEQ ID NO: 3022338 - protein, 24 aa, Entamoeba invadens
VLAEKTPLNFNFLDSVKKNAVFVP

SEQ ID NO: 3022339 - protein, 20 aa, Entamoeba invadens
VLAFYAVHLSEALRFEEGLT

SEQ ID NO: 3022340 - protein, 24 aa, Entamoeba invadens
VLAKKYDIPLFFDAARFAENAYFI

SEQ ID NO: 3022341 - protein, 17 aa, Entamoeba invadens
VLALRNKYMYIGDKEVY

SEQ ID NO: 3022342 - protein, 17 aa, Entamoeba invadens
VLALVFSKDPSAGLLKL

SEQ ID NO: 3022343 - protein, 24 aa, Entamoeba invadens
VLAMNREITLFPTVKYTKSDKMIE

SEQ ID NO: 3022344 - protein, 26 aa, Entamoeba invadens
VLAMYDLVTLLNPTTALAVSFLYLDM

SEQ ID NO: 3022345 - protein, 18 aa, Entamoeba invadens
VLAYKRAWETKAPASKFS

SEQ ID NO: 3022346 - protein, 19 aa, Entamoeba invadens
VLCCPPLNRLDLLFEEHFC

SEQ ID NO: 3022347 - protein, 28 aa, Entamoeba invadens
VLCGEENKLFQVGTPFPFHDWCVIENQS

SEQ ID NO: 3022348 - protein, 29 aa, Entamoeba invadens
VLCYFNSSFDLVARWYGLSHIKITCNLHY

SEQ ID NO: 3022349 - protein, 20 aa, Entamoeba invadens
VLDALFNISGDCSSLVVIFA

SEQ ID NO: 3022350 - protein, 19 aa, Entamoeba invadens
VLDDVLLYSYSDYLANDSL

SEQ ID NO: 3022351 - protein, 27 aa, Entamoeba invadens
VLDFKNEALLLSFLQSIDIDEFCQTKL

SEQ ID NO: 3022352 - protein, 22 aa, Entamoeba invadens
VLDFPETLFKWINETVIKEKKT

SEQ ID NO: 3022353 - protein, 20 aa, Entamoeba invadens
VLDILRLKGLEFLWKLMKCD

SEQ ID NO: 3022354 - protein, 30 aa, Entamoeba invadens
VLDKKGMNAKFYQEFYGFDTTVLTGFGLEE

SEQ ID NO: 3022355 - protein, 27 aa, Entamoeba invadens
VLDKTNFIFASHFFEVFLDSVPTDLAD

SEQ ID NO: 3022356 - protein, 20 aa, Entamoeba invadens
VLDKVMWRKKMKEVKPISQI

SEQ ID NO: 3022357 - protein, 17 aa, Entamoeba invadens
VLDLIFYELQQSANRVV

SEQ ID NO: 3022358 - protein, 17 aa, Entamoeba invadens
VLDPALLRSGRFDRKIE

SEQ ID NO: 3022359 - protein, 18 aa, Entamoeba invadens
VLDSLLFELKGIKIPPSS

SEQ ID NO: 3022360 - protein, 24 aa, Entamoeba invadens
VLDYLPISIQFYLLKDIKNISFSS

SEQ ID NO: 3022361 - protein, 27 aa, Entamoeba invadens
VLEDPKKPFTPIWTKSGLKALKEYKKR

SEQ ID NO: 3022362 - protein, 43 aa, Entamoeba invadens
VLEGIRITRLGYPNRIIYNEFLKRYFFLGTNINKKTSDAMPVV

SEQ ID NO: 3022363 - protein, 22 aa, Entamoeba invadens
VLEKMFYQIVVWFGVNYGTVDK

SEQ ID NO: 3022364 - protein, 26 aa, Entamoeba invadens
VLEKNHTFLFGFGGGHDICVYKDGQM

SEQ ID NO: 3022365 - protein, 26 aa, Entamoeba invadens
VLEKYKQWMLTYPTLQELSKAPLKDV

SEQ ID NO: 3022366 - protein, 29 aa, Entamoeba invadens
VLELITGNPPYYDLPPAAALHKIVSDEIP

SEQ ID NO: 3022367 - protein, 34 aa, Entamoeba invadens
VLENQIGTALFKFAGVLNIYKLFVSNSDTSFKVL

SEQ ID NO: 3022368 - protein, 27 aa, Entamoeba invadens
VLEQNPTLIFHIMLVYFEHISKEIEKT

SEQ ID NO: 3022369 - protein, 25 aa, Entamoeba invadens
VLEQYEEKWFLISFNENVKVSLQKR

SEQ ID NO: 3022370 - protein, 26 aa, Entamoeba invadens
VLERHLPPPLMSHISVLLLSLSKVPN

SEQ ID NO: 3022371 - protein, 27 aa, Entamoeba invadens
VLETYRGKMEWFIGIKFEQIFPDMEDK

SEQ ID NO: 3022372 - protein, 21 aa, Entamoeba invadens
VLFELGECKVTLKKDIKAVCK

SEQ ID NO: 3022373 - protein, 19 aa, Entamoeba invadens
VLFIFCSNEFKKKRSFYDF

SEQ ID NO: 3022374 - protein, 18 aa, Entamoeba invadens
VLFLGCLLGVRKNLVKDD

SEQ ID NO: 3022375 - protein, 17 aa, Entamoeba invadens
VLFMTKQSFDYAKAVKC

SEQ ID NO: 3022376 - protein, 19 aa, Entamoeba invadens
VLFNIVKHFKNTAASRQDA

SEQ ID NO: 3022377 - protein, 19 aa, Entamoeba invadens
VLFNLKRYSEALEAVLKCM

SEQ ID NO: 3022378 - protein, 21 aa, Entamoeba invadens
VLFPKNPLEPVPPLTVESVGT

SEQ ID NO: 3022379 - protein, 17 aa, Entamoeba invadens
VLFPNLETLHLYSPCDD

SEQ ID NO: 3022380 - protein, 17 aa, Entamoeba invadens
VLFSIDPNWIDSKGILI

SEQ ID NO: 3022381 - protein, 18 aa, Entamoeba invadens
VLFTYAEHLRKINGVKPF

SEQ ID NO: 3022382 - protein, 17 aa, Entamoeba invadens
VLFWAQIGNKRRKMLLK

SEQ ID NO: 3022383 - protein, 19 aa, Entamoeba invadens
VLGDLEIVNQQLADMTEKK

SEQ ID NO: 3022384 - protein, 17 aa, Entamoeba invadens
VLGLPYSCAIDMWSVGC

SEQ ID NO: 3022385 - protein, 29 aa, Entamoeba invadens
VLGSGKRLRPLGLLSFYIGGGGQLTDPET

SEQ ID NO: 3022386 - protein, 20 aa, Entamoeba invadens
VLHHLALSKLTEAKKTLLFS

SEQ ID NO: 3022387 - protein, 18 aa, Entamoeba invadens
VLHLNMVISLFKVPVEDS

SEQ ID NO: 3022388 - protein, 26 aa, Entamoeba invadens
VLHPEDLMPFLRKPILLIIDSDVQNS

SEQ ID NO: 3022389 - protein, 34 aa, Entamoeba invadens
VLHYKRSLCYHLLRNGCYFVLTTKDSLNSSVLIL

SEQ ID NO: 3022390 - protein, 25 aa, Entamoeba invadens
VLIASEVVIGIYLHPAVCIDMEQNS

SEQ ID NO: 3022391 - protein, 25 aa, Entamoeba invadens
VLIDCNYDKNACAELLFVAQENGTF

SEQ ID NO: 3022392 - protein, 18 aa, Entamoeba invadens
VLIEKEWINFGHRFKFRS

SEQ ID NO: 3022393 - protein, 18 aa, Entamoeba invadens
VLIGLPKTGKTALACQFC

SEQ ID NO: 3022394 - protein, 19 aa, Entamoeba invadens
VLINFLRIRSEIKEDIVAA

SEQ ID NO: 3022395 - protein, 19 aa, Entamoeba invadens
VLIPIMLKRSQFKVQLFDE

SEQ ID NO: 3022396 - protein, 17 aa, Entamoeba invadens
VLIPQSDFRWTRQTEVG

SEQ ID NO: 3022397 - protein, 19 aa, Entamoeba invadens
VLIVFDMTDKFTFEKVITW

SEQ ID NO: 3022398 - protein, 32 aa, Entamoeba invadens
VLKELANFLKMDRIPLYLKAYSKSANLAETLG

SEQ ID NO: 3022399 - protein, 24 aa, Entamoeba invadens
VLKIGVLGCPNFEGGIIVAAQIGC

SEQ ID NO: 3022400 - protein, 17 aa, Entamoeba invadens
VLKIRPEPNNQFYRKIV

SEQ ID NO: 3022401 - protein, 17 aa, Entamoeba invadens
VLKIWENEEKGKKSDWV

SEQ ID NO: 3022402 - protein, 23 aa, Entamoeba invadens
VLKKDIPALWFRSSIKTSVSKIE

SEQ ID NO: 3022403 - protein, 26 aa, Entamoeba invadens
VLKKEFFKIIVWFNVDFETVDRNKSR

SEQ ID NO: 3022404 - protein, 25 aa, Entamoeba invadens
VLKKEFYRIIVWFNVDFETVDINKS

SEQ ID NO: 3022405 - protein, 26 aa, Entamoeba invadens
VLKKEFYRIIVWFNVDFETVENNKSQ

SEQ ID NO: 3022406 - protein, 25 aa, Entamoeba invadens
VLKKEFYRIIVWYCVDFETVNRNKS

SEQ ID NO: 3022407 - protein, 26 aa, Entamoeba invadens
VLKKELYRIIVWFNVDFETVDRNKSR

SEQ ID NO: 3022408 - protein, 25 aa, Entamoeba invadens
VLKKKFFRIIVWSSVDFKIVNRNKS

SEQ ID NO: 3022409 - protein, 24 aa, Entamoeba invadens
VLKKKRMLLKRCWNDFTWNGDFHS

SEQ ID NO: 3022410 - protein, 24 aa, Entamoeba invadens
VLKMYTEPLPIFPKSKLFCTDKDM

SEQ ID NO: 3022411 - protein, 25 aa, Entamoeba invadens
VLKNALKEDLPFKGAFRLTGKIGET

SEQ ID NO: 3022412 - protein, 26 aa, Entamoeba invadens
VLKNKFYRIIVWFSVNFVIVDRNKNR

SEQ ID NO: 3022413 - protein, 21 aa, Entamoeba invadens
VLKNRPAYFKQSLIELTVLHF

SEQ ID NO: 3022414 - protein, 24 aa, Entamoeba invadens
VLKPFENDLIFITSKLLEVIHHFE

SEQ ID NO: 3022415 - protein, 17 aa, Entamoeba invadens
VLKQFLEQVIRDSVTYT

SEQ ID NO: 3022416 - protein, 26 aa, Entamoeba invadens
VLKREFFQIIVWFNVDFETVDRNKSR

SEQ ID NO: 3022417 - protein, 26 aa, Entamoeba invadens
VLKREFFRIIVWFNVDFETVDRNINR

SEQ ID NO: 3022418 - protein, 26 aa, Entamoeba invadens
VLKREFFRIIVWFNVDFETVDRNKSR

SEQ ID NO: 3022419 - protein, 26 aa, Entamoeba invadens
VLKREFYQIIVWFNVDFETVDRNISR

SEQ ID NO: 3022420 - protein, 26 aa, Entamoeba invadens
VLKREFYRIIVWFDVNFETVDRNINR

SEQ ID NO: 3022421 - protein, 25 aa, Entamoeba invadens
VLKREFYRIIVWFNVNFETVDRNKS

SEQ ID NO: 3022422 - protein, 27 aa, Entamoeba invadens
VLKREFYRIIVWFYVGFEIVDRNKSRN

SEQ ID NO: 3022423 - protein, 26 aa, Entamoeba invadens
VLKRELYRIIVWFDVDFETVDKNNSR

SEQ ID NO: 3022424 - protein, 18 aa, Entamoeba invadens
VLKRVLPTKVYFIGKNGG

SEQ ID NO: 3022425 - protein, 29 aa, Entamoeba invadens
VLKSFPPQFEMIDILYLLLNTPSEKLTVA

SEQ ID NO: 3022426 - protein, 25 aa, Entamoeba invadens
VLKSTGVAKFYFWKRDLEMGIKHTC

SEQ ID NO: 3022427 - protein, 29 aa, Entamoeba invadens
VLKSTIKYPFHKLIQKYLAMCLNEFESVQ

SEQ ID NO: 3022428 - protein, 18 aa, Entamoeba invadens
VLKTLLSFYYNDPQFFAN

SEQ ID NO: 3022429 - protein, 17 aa, Entamoeba invadens
VLKTVFDFVVMKKKRRA

SEQ ID NO: 3022430 - protein, 19 aa, Entamoeba invadens
VLKVFPDKAKWEKDRKRVF

SEQ ID NO: 3022431 - protein, 19 aa, Entamoeba invadens
VLKYLKFIEESYSLTYGYM

SEQ ID NO: 3022432 - protein, 20 aa, Entamoeba invadens
VLKYQLFSLYFDGAGSFELF

SEQ ID NO: 3022433 - protein, 17 aa, Entamoeba invadens
VLLDRIKLKYDNIKRVE

SEQ ID NO: 3022434 - protein, 19 aa, Entamoeba invadens
VLLGMLLSKVMRNGRKTMT

SEQ ID NO: 3022435 - protein, 17 aa, Entamoeba invadens
VLLHHGILRYSKDEPMV

SEQ ID NO: 3022436 - protein, 17 aa, Entamoeba invadens
VLLHLFTAKAEGFDLSP

SEQ ID NO: 3022437 - protein, 18 aa, Entamoeba invadens
VLLIFPKESHNKLERLVN

SEQ ID NO: 3022438 - protein, 20 aa, Entamoeba invadens
VLLKCHSPLLFISKHLQHVF

SEQ ID NO: 3022439 - protein, 25 aa, Entamoeba invadens
VLLNVVVVALTKWILHGKVEAKIQL

SEQ ID NO: 3022440 - protein, 17 aa, Entamoeba invadens
VLLPKLLDIPKEKQYEM

SEQ ID NO: 3022441 - protein, 18 aa, Entamoeba invadens
VLLPYTEVTLLHPMDKHA

SEQ ID NO: 3022442 - protein, 19 aa, Entamoeba invadens
VLLQQFGIGPLYVKKIFIT

SEQ ID NO: 3022443 - protein, 27 aa, Entamoeba invadens
VLLQQTHVLWVFNFDASILASIPIDPC

SEQ ID NO: 3022444 - protein, 27 aa, Entamoeba invadens
VLLSTPIYFNMLYETDILFNTIRYIAM

SEQ ID NO: 3022445 - protein, 17 aa, Entamoeba invadens
VLLVQKSILRDAVSDLA

SEQ ID NO: 3022446 - protein, 17 aa, Entamoeba invadens
VLLYLEKSPNFQNIMTL

SEQ ID NO: 3022447 - protein, 30 aa, Entamoeba invadens
VLMKELSYKIIAVLIFLVLDKDFSGTLELK

SEQ ID NO: 3022448 - protein, 19 aa, Entamoeba invadens
VLMMLFKMFGKNVSDYFVQ

SEQ ID NO: 3022449 - protein, 17 aa, Entamoeba invadens
VLMNFTRTLLIKNGLIT

SEQ ID NO: 3022450 - protein, 26 aa, Entamoeba invadens
VLMNMSKAFVFVFDCSWFNGNDLPQN

SEQ ID NO: 3022451 - protein, 25 aa, Entamoeba invadens
VLNCNKFITLPFTSVTDLTLIEIKK

SEQ ID NO: 3022452 - protein, 39 aa, Entamoeba invadens
VLNEGMYRYTPLWIFKIMMWLRKLLYPRSYLSGLFVDNH

SEQ ID NO: 3022453 - protein, 24 aa, Entamoeba invadens
VLNETITLPLVRPELFFSKLTQGA

SEQ ID NO: 3022454 - protein, 17 aa, Entamoeba invadens
VLNFPKISRLYISGNPI

SEQ ID NO: 3022455 - protein, 18 aa, Entamoeba invadens
VLNKEEDVAIKKNGKLIL

SEQ ID NO: 3022456 - protein, 29 aa, Entamoeba invadens
VLNKKKSYPLALNYLKKALNLAKGDGLIQ

SEQ ID NO: 3022457 - protein, 28 aa, Entamoeba invadens
VLNRAISTRVFPYIWPPSIEVMEGKQMK

SEQ ID NO: 3022458 - protein, 26 aa, Entamoeba invadens
VLNREFFRIIVWFNVDFETFDRNKSR

SEQ ID NO: 3022459 - protein, 24 aa, Entamoeba invadens
VLNTEPMIVPISPPAFVIGDLSGS

SEQ ID NO: 3022460 - protein, 17 aa, Entamoeba invadens
VLNTMMAFSTFFSIFKT

SEQ ID NO: 3022461 - protein, 24 aa, Entamoeba invadens
VLNVPLKVVQLVKRQMNALPVWQN

SEQ ID NO: 3022462 - protein, 22 aa, Entamoeba invadens
VLNWLVKLAWSMSKIYEMNLSH

SEQ ID NO: 3022463 - protein, 18 aa, Entamoeba invadens
VLPDAIFSGCKLLDKINI

SEQ ID NO: 3022464 - protein, 18 aa, Entamoeba invadens
VLPFIHISKIIDPSGAIV

SEQ ID NO: 3022465 - protein, 21 aa, Entamoeba invadens
VLPFINALQQKSKLAFPHLES

SEQ ID NO: 3022466 - protein, 34 aa, Entamoeba invadens
VLPKIKSVFIDPFNFFRLRVDQLTNLKIVSLCAW

SEQ ID NO: 3022467 - protein, 35 aa, Entamoeba invadens
VLPKIKSVFIDPFNFFRLRVDQLTNLKIVSLCAWK

SEQ ID NO: 3022468 - protein, 25 aa, Entamoeba invadens
VLPKSPFLGINRRPPPPFPSSIVNG

SEQ ID NO: 3022469 - protein, 17 aa, Entamoeba invadens
VLPNSLFSLYCQYVIRR

SEQ ID NO: 3022470 - protein, 23 aa, Entamoeba invadens
VLPNSVVYIGEQLFADCFNLTRV

SEQ ID NO: 3022471 - protein, 26 aa, Entamoeba invadens
VLPQNIIIDLVKNFKIPISLVIDILP

SEQ ID NO: 3022472 - protein, 18 aa, Entamoeba invadens
VLPSFWCVFIQSGKTNVC

SEQ ID NO: 3022473 - protein, 27 aa, Entamoeba invadens
VLPSKLTEICNFAFFKCYSLNKIVLPT

SEQ ID NO: 3022474 - protein, 27 aa, Entamoeba invadens
VLPTNTKMLDVFKGYNSWVYGIEKGFW

SEQ ID NO: 3022475 - protein, 26 aa, Entamoeba invadens
VLQCDDIILPLTIRYKILLDATKGVN

SEQ ID NO: 3022476 - protein, 25 aa, Entamoeba invadens
VLQCLHSLSNIKGRLPTKAFTTLIK

SEQ ID NO: 3022477 - protein, 26 aa, Entamoeba invadens
VLQCLHSLSNIKGRLPTKAFTTLIKE

SEQ ID NO: 3022478 - protein, 18 aa, Entamoeba invadens
VLQFIRRCKNSNIKTYIH

SEQ ID NO: 3022479 - protein, 30 aa, Entamoeba invadens
VLQFNTLTITPLMINPIRSLKVLVNDLGEF

SEQ ID NO: 3022480 - protein, 17 aa, Entamoeba invadens
VLQGILHKGFKVPTPIQ

SEQ ID NO: 3022481 - protein, 26 aa, Entamoeba invadens
VLQKDDLLTLVKLLSILIMSGENTEV

SEQ ID NO: 3022482 - protein, 22 aa, Entamoeba invadens
VLQKKVKFIGDFAFSGCINLEE

SEQ ID NO: 3022483 - protein, 30 aa, Entamoeba invadens
VLQLHGYENVAFLVLPKGTTGLFQPMCQGI

SEQ ID NO: 3022484 - protein, 17 aa, Entamoeba invadens
VLQLRPTIAKKNSLKKT

SEQ ID NO: 3022485 - protein, 27 aa, Entamoeba invadens
VLQMTELFDRWALLKVAREKLVNGVIE

SEQ ID NO: 3022486 - protein, 28 aa, Entamoeba invadens
VLQRSTELLLRKAPFQHLVRDIAQNNKS

SEQ ID NO: 3022487 - protein, 28 aa, Entamoeba invadens
VLQRSTELLLRRAPFQHLVRDIATASKT

SEQ ID NO: 3022488 - protein, 19 aa, Entamoeba invadens
VLQSFTDLAFSPMGDMLLA

SEQ ID NO: 3022489 - protein, 35 aa, Entamoeba invadens
VLQVAEPWIQKGIHPTIIISGFLDALEDALKSLQE

SEQ ID NO: 3022490 - protein, 17 aa, Entamoeba invadens
VLQWDDFPLNSQSVVPP

SEQ ID NO: 3022491 - protein, 22 aa, Entamoeba invadens
VLRCFYVQFPLNSVNIETLVST

SEQ ID NO: 3022492 - protein, 31 aa, Entamoeba invadens
VLRDTKQIYPVPLVLLFNTKEFRNFVYSFGS

SEQ ID NO: 3022493 - protein, 23 aa, Entamoeba invadens
VLRELRLFPKIQILQFRNELQME

SEQ ID NO: 3022494 - protein, 24 aa, Entamoeba invadens
VLREVRDLMFMWEEYANKFIQNGI

SEQ ID NO: 3022495 - protein, 20 aa, Entamoeba invadens
VLRFVEITPILFSLTYEDIV

SEQ ID NO: 3022496 - protein, 20 aa, Entamoeba invadens
VLRNGFGYALKDPITNQYWM

SEQ ID NO: 3022497 - protein, 18 aa, Entamoeba invadens
VLRNLVLVNLPNFARKSL

SEQ ID NO: 3022498 - protein, 21 aa, Entamoeba invadens
VLRNTLLQRSFLRAMCYLLSG

SEQ ID NO: 3022499 - protein, 20 aa, Entamoeba invadens
VLRVIVAALRRNGKNVFVTA

SEQ ID NO: 3022500 - protein, 17 aa, Entamoeba invadens
VLSATYREPTIYPFVVF

SEQ ID NO: 3022501 - protein, 25 aa, Entamoeba invadens
VLSDQLRLLTNSLVPFLSSGFEESN

SEQ ID NO: 3022502 - protein, 26 aa, Entamoeba invadens
VLSDYHDHILKMTNLIDLASLQHNDT

SEQ ID NO: 3022503 - protein, 17 aa, Entamoeba invadens
VLSGVYLHDGKEKIYSS

SEQ ID NO: 3022504 - protein, 17 aa, Entamoeba invadens
VLSKFSKFLKCYTTYVN

SEQ ID NO: 3022505 - protein, 30 aa, Entamoeba invadens
VLSNYIYGKRNIAFLLMTETNCFGFFTSSG

SEQ ID NO: 3022506 - protein, 26 aa, Entamoeba invadens
VLSSLSAFTFIIDCSWFSFQQIENEQ

SEQ ID NO: 3022507 - protein, 18 aa, Entamoeba invadens
VLSTKIPYNVAMKGKRQN

SEQ ID NO: 3022508 - protein, 26 aa, Entamoeba invadens
VLSVLQHALPTLPLKNKMLIPDFTIP

SEQ ID NO: 3022509 - protein, 29 aa, Entamoeba invadens
VLSVRDNILFWLFDVFLGLVPDKYKHLFN

SEQ ID NO: 3022510 - protein, 21 aa, Entamoeba invadens
VLSVVLKYYSFVNGLGTINLS

SEQ ID NO: 3022511 - protein, 20 aa, Entamoeba invadens
VLSVVWHIIHLKPKDEKNLI

SEQ ID NO: 3022512 - protein, 20 aa, Entamoeba invadens
VLSYPLILDIQLPGIEMLIP

SEQ ID NO: 3022513 - protein, 18 aa, Entamoeba invadens
VLSYYSFNPTVRTLSTGL

SEQ ID NO: 3022514 - protein, 17 aa, Entamoeba invadens
VLTDRKKALIVVSMIDI

SEQ ID NO: 3022515 - protein, 31 aa, Entamoeba invadens
VLTFLTDMINSYIHFGWLTEVLNNYLDSLKC

SEQ ID NO: 3022516 - protein, 20 aa, Entamoeba invadens
VLTIKPNFVLPFQSDGEPFL

SEQ ID NO: 3022517 - protein, 20 aa, Entamoeba invadens
VLTKDRIMYLKTKDLSVFNY

SEQ ID NO: 3022518 - protein, 25 aa, Entamoeba invadens
VLTKNGFFIFSLSKIIDALFEFDEF

SEQ ID NO: 3022519 - protein, 19 aa, Entamoeba invadens
VLTLCDDLFTLGKLGVLSS

SEQ ID NO: 3022520 - protein, 17 aa, Entamoeba invadens
VLTPSNFVIVNNGIAKM

SEQ ID NO: 3022521 - protein, 23 aa, Entamoeba invadens
VLTRRLCDALFDLGVIDLKEQGL

SEQ ID NO: 3022522 - protein, 26 aa, Entamoeba invadens
VLTSTKLRFKKFYSVLYVVMGGIDTS

SEQ ID NO: 3022523 - protein, 34 aa, Entamoeba invadens
VLTVIEKSVRIGWLYCLRGYETGYIPQNFTSTVK

SEQ ID NO: 3022524 - protein, 17 aa, Entamoeba invadens
VLVCYPKINSICCGAIA

SEQ ID NO: 3022525 - protein, 21 aa, Entamoeba invadens
VLVEMSVRMEKAPLKRGRGYV

SEQ ID NO: 3022526 - protein, 17 aa, Entamoeba invadens
VLVFRGTLSLQDLLTDL

SEQ ID NO: 3022527 - protein, 26 aa, Entamoeba invadens
VLVGMLYLYLSTLDKPLFGVLSGDFL

SEQ ID NO: 3022528 - protein, 19 aa, Entamoeba invadens
VLVHVVVAYVPTVLLKVSQ

SEQ ID NO: 3022529 - protein, 19 aa, Entamoeba invadens
VLVIFYSPECAKCEASAPM

SEQ ID NO: 3022530 - protein, 17 aa, Entamoeba invadens
VLVIPVIGQLQNLTQDN

SEQ ID NO: 3022531 - protein, 17 aa, Entamoeba invadens
VLVKICLDISKALKYLH

SEQ ID NO: 3022532 - protein, 22 aa, Entamoeba invadens
VLVKIISIIERLKNFPKDRPSH

SEQ ID NO: 3022533 - protein, 17 aa, Entamoeba invadens
VLVMKKKYTAIIYLMLR

SEQ ID NO: 3022534 - protein, 25 aa, Entamoeba invadens
VLVNAIYFKGIWREKFDILNDKHVF

SEQ ID NO: 3022535 - protein, 23 aa, Entamoeba invadens
VLVNNVFMFTSITLIPETLNANL

SEQ ID NO: 3022536 - protein, 17 aa, Entamoeba invadens
VLVTFAISFYDTPHLQQ

SEQ ID NO: 3022537 - protein, 29 aa, Entamoeba invadens
VLVWLSILPLQYFADGCVYQLFVLVAKGM

SEQ ID NO: 3022538 - protein, 18 aa, Entamoeba invadens
VLYDRDHYKLALAQLSVA

SEQ ID NO: 3022539 - protein, 17 aa, Entamoeba invadens
VLYENYLHLLKDKHKLV

SEQ ID NO: 3022540 - protein, 20 aa, Entamoeba invadens
VLYIPAVFCSIFGLSLDTKT

SEQ ID NO: 3022541 - protein, 27 aa, Entamoeba invadens
VLYKTQCFMNCFNLKFISKVKHLKGGV

SEQ ID NO: 3022542 - protein, 18 aa, Entamoeba invadens
VLYLRTTRPFAVCFKNIN

SEQ ID NO: 3022543 - protein, 21 aa, Entamoeba invadens
VLYQKYLELGVINPLSKPTIL

SEQ ID NO: 3022544 - protein, 18 aa, Entamoeba invadens
VLYSFEDIFFLQRMVHHL

SEQ ID NO: 3022545 - protein, 24 aa, Entamoeba invadens
VLYSSIFEFIIKAFSKIETLQCYD

SEQ ID NO: 3022546 - protein, 17 aa, Entamoeba invadens
VLYVLMWTANSSCVVAR

SEQ ID NO: 3022547 - protein, 19 aa, Entamoeba invadens
VLYYYMFVLMSYSVKTAKL

SEQ ID NO: 3022548 - protein, 18 aa, Entamoeba invadens
VMAHIVEGIFRIPGERKL

SEQ ID NO: 3022549 - protein, 24 aa, Entamoeba invadens
VMCLVRYVYFRNPDVYVRFSYSAP

SEQ ID NO: 3022550 - protein, 17 aa, Entamoeba invadens
VMCSLCELLKEVHPIMS

SEQ ID NO: 3022551 - protein, 17 aa, Entamoeba invadens
VMDILKEKPILVPIACC

SEQ ID NO: 3022552 - protein, 29 aa, Entamoeba invadens
VMDLGGQSKIRPLWRHYYEDAKAVVFVVD

SEQ ID NO: 3022553 - protein, 17 aa, Entamoeba invadens
VMDYFRANNRLQDLFIW

SEQ ID NO: 3022554 - protein, 17 aa, Entamoeba invadens
VMDYIQGGELFHKLEIE

SEQ ID NO: 3022555 - protein, 18 aa, Entamoeba invadens
VMEDPYFVDLPVDKNMTA

SEQ ID NO: 3022556 - protein, 28 aa, Entamoeba invadens
VMEPPKKWMYFFLFNDRLVETIPELYEG

SEQ ID NO: 3022557 - protein, 26 aa, Entamoeba invadens
VMFKSNLLFVFVNTTNEIFGCYSAEP

SEQ ID NO: 3022558 - protein, 23 aa, Entamoeba invadens
VMFQNALTFWDVQSNKIMCCIPC

SEQ ID NO: 3022559 - protein, 17 aa, Entamoeba invadens
VMFYVLQAMVIEGARKK

SEQ ID NO: 3022560 - protein, 24 aa, Entamoeba invadens
VMGLFSSKSLIWVKSNDHTRVMGN

SEQ ID NO: 3022561 - protein, 19 aa, Entamoeba invadens
VMIAACDTFRAGAVDQLAV

SEQ ID NO: 3022562 - protein, 31 aa, Entamoeba invadens
VMINAKELKIIHQWFGNLIGQPIRSTKDWGN

SEQ ID NO: 3022563 - protein, 18 aa, Entamoeba invadens
VMIPFRVKSINQYSFCGC

SEQ ID NO: 3022564 - protein, 26 aa, Entamoeba invadens
VMISEHSHHYWLDSIKKLKQEFPNKI

SEQ ID NO: 3022565 - protein, 21 aa, Entamoeba invadens
VMIVSKYFRYFQDFVSLESVC

SEQ ID NO: 3022566 - protein, 21 aa, Entamoeba invadens
VMIVSKYLIAITDFIKLEFVC

SEQ ID NO: 3022567 - protein, 19 aa, Entamoeba invadens
VMIVSRYFKIIKDFVNLEF

SEQ ID NO: 3022568 - protein, 25 aa, Entamoeba invadens
VMKDLLTKEWVLEGGALVLADEGIC

SEQ ID NO: 3022569 - protein, 27 aa, Entamoeba invadens
VMKFKKWLESWKNVIPDRQAVLLAGSP

SEQ ID NO: 3022570 - protein, 41 aa, Entamoeba invadens
VMKIQAANLHQILLMLPTSHAVLLLGWVNTWLAENKRVLTC

SEQ ID NO: 3022571 - protein, 21 aa, Entamoeba invadens
VMKKKYRQSFTLTTLAIGNVE

SEQ ID NO: 3022572 - protein, 27 aa, Entamoeba invadens
VMKKNFLLKMDYFRLKLGCMIHLAKFL

SEQ ID NO: 3022573 - protein, 29 aa, Entamoeba invadens
VMKSFEIMVDYFRTLLIPDKSIVNGSFGE

SEQ ID NO: 3022574 - protein, 18 aa, Entamoeba invadens
VMKTMPLLVDMETLPLGS

SEQ ID NO: 3022575 - protein, 19 aa, Entamoeba invadens
VMKVSFFGFVLPHIINSVK

SEQ ID NO: 3022576 - protein, 43 aa, Entamoeba invadens
VMKWGQSCIILPNFLILPVQRLPRYILLLETLIKHTPEVAQEE

SEQ ID NO: 3022577 - protein, 20 aa, Entamoeba invadens
VMLKSMMSTYKPVTRMYVVE

SEQ ID NO: 3022578 - protein, 18 aa, Entamoeba invadens
VMLPNKCHLFICGIEGNE

SEQ ID NO: 3022579 - protein, 24 aa, Entamoeba invadens
VMLSQMRDGLPKVLYYYMFVLMSY

SEQ ID NO: 3022580 - protein, 19 aa, Entamoeba invadens
VMMTSMYMVYDNKIKVGVN

SEQ ID NO: 3022581 - protein, 17 aa, Entamoeba invadens
VMNGCDYYEIRTVPSIV

SEQ ID NO: 3022582 - protein, 25 aa, Entamoeba invadens
VMNKMCTVLIPILKIGRINPQYEEV

SEQ ID NO: 3022583 - protein, 19 aa, Entamoeba invadens
VMNNAMWETQKKCMLFGGI

SEQ ID NO: 3022584 - protein, 19 aa, Entamoeba invadens
VMPCRMATVISALLDPENR

SEQ ID NO: 3022585 - protein, 26 aa, Entamoeba invadens
VMPELDSFFMLKKMILEMIPTYFGNE

SEQ ID NO: 3022586 - protein, 30 aa, Entamoeba invadens
VMPNCTSFMQKLFSMIFIVNPDDRADIFQV

SEQ ID NO: 3022587 - protein, 18 aa, Entamoeba invadens
VMPVQRVPRYRMLLEDLL

SEQ ID NO: 3022588 - protein, 26 aa, Entamoeba invadens
VMQKNIQIWPIIQFNINETLMAHLAS

SEQ ID NO: 3022589 - protein, 17 aa, Entamoeba invadens
VMRAMSRFLNESAQVME

SEQ ID NO: 3022590 - protein, 19 aa, Entamoeba invadens
VMSTQLLSAISLFAKTSAV

SEQ ID NO: 3022591 - protein, 18 aa, Entamoeba invadens
VMSYTNDRRFDLVKGIVG

SEQ ID NO: 3022592 - protein, 21 aa, Entamoeba invadens
VMTALIPRNSTIPAKKSQIFS

SEQ ID NO: 3022593 - protein, 23 aa, Entamoeba invadens
VMTCVFGLLKPGVDPRIGCCMNG

SEQ ID NO: 3022594 - protein, 39 aa, Entamoeba invadens
VMTKLKALYLQSNNLLHFPRSVFALASLKTLFMSNNQIT

SEQ ID NO: 3022595 - protein, 18 aa, Entamoeba invadens
VMTQKKTFTKWANVQLSG

SEQ ID NO: 3022596 - protein, 33 aa, Entamoeba invadens
VMVCHRPLDGLNVPYFLFTAIRFIENSSTEVEG

SEQ ID NO: 3022597 - protein, 18 aa, Entamoeba invadens
VMVTVYLSSLVKTVLSIH

SEQ ID NO: 3022598 - protein, 19 aa, Entamoeba invadens
VMWHQGLLVFVQRYGKDLK

SEQ ID NO: 3022599 - protein, 19 aa, Entamoeba invadens
VMYLVRWEKFSYLEATWIL

SEQ ID NO: 3022600 - protein, 42 aa, Entamoeba invadens
VMYSLSVLNAPRLYFSLKKDVYWFISDHWYCFGKMAQFTTSP

SEQ ID NO: 3022601 - protein, 34 aa, Entamoeba invadens
VNAIRRCRVQKFPKYILIKLQRDIPISFEDMRKV

SEQ ID NO: 3022602 - protein, 25 aa, Entamoeba invadens
VNALKPLVKIAYKYALCKPSQFPVG

SEQ ID NO: 3022603 - protein, 24 aa, Entamoeba invadens
VNANFTLYILKWNLEEILDRILLS

SEQ ID NO: 3022604 - protein, 26 aa, Entamoeba invadens
VNANKNTFFVFLDTKQKNLPFDFHEI

SEQ ID NO: 3022605 - protein, 25 aa, Entamoeba invadens
VNAREIAVLFDKPLLNKGDCVKMKK

SEQ ID NO: 3022606 - protein, 25 aa, Entamoeba invadens
VNASFPPILISVLKTIFEKVNTLVQ

SEQ ID NO: 3022607 - protein, 19 aa, Entamoeba invadens
VNATILFNETIRRSLHTPG

SEQ ID NO: 3022608 - protein, 25 aa, Entamoeba invadens
VNCKLFVACMFFTQIVLSKLKIIND

SEQ ID NO: 3022609 - protein, 24 aa, Entamoeba invadens
VNCKLFVACMFFTQIVLSKVKIIN

SEQ ID NO: 3022610 - protein, 18 aa, Entamoeba invadens
VNCPYDLTSLLHNTIYEE

SEQ ID NO: 3022611 - protein, 24 aa, Entamoeba invadens
VNCTTTLFFARLGNVRKDELKCYC

SEQ ID NO: 3022612 - protein, 17 aa, Entamoeba invadens
VNDCSLNFDFTATFSVN

SEQ ID NO: 3022613 - protein, 25 aa, Entamoeba invadens
VNDEPLANFLLSYGYFDKEIICSMT

SEQ ID NO: 3022614 - protein, 18 aa, Entamoeba invadens
VNDIFRNAYVATIGADWS

SEQ ID NO: 3022615 - protein, 26 aa, Entamoeba invadens
VNDINEFCFLLEKLGLDIRERNDFIV

SEQ ID NO: 3022616 - protein, 18 aa, Entamoeba invadens
VNDKFIIRLFENPVQCLT

SEQ ID NO: 3022617 - protein, 32 aa, Entamoeba invadens
VNDKRSIIYWASRNNIPIFCPALTDGLIGTCL

SEQ ID NO: 3022618 - protein, 23 aa, Entamoeba invadens
VNDNPYHWIVSYKNFNSTWDIYS

SEQ ID NO: 3022619 - protein, 24 aa, Entamoeba invadens
VNDRKLLSVFFDLSDYLLTARHTA

SEQ ID NO: 3022620 - protein, 28 aa, Entamoeba invadens
VNDRKPPHDLLMFATKRLSEKNTLNLAE

SEQ ID NO: 3022621 - protein, 29 aa, Entamoeba invadens
VNEGDRWWSYPLFKFYLDDLDITQIKNDK

SEQ ID NO: 3022622 - protein, 25 aa, Entamoeba invadens
VNELMFHLPLTIYVGNVLPPELQDP

SEQ ID NO: 3022623 - protein, 23 aa, Entamoeba invadens
VNENFLKLLLNIRCDDYANVLIG

SEQ ID NO: 3022624 - protein, 26 aa, Entamoeba invadens
VNERMKFGLIYTWNSWHANEKGRMVM

SEQ ID NO: 3022625 - protein, 19 aa, Entamoeba invadens
VNFAYYKLITPTNFPKLKY

SEQ ID NO: 3022626 - protein, 26 aa, Entamoeba invadens
VNFKTSAIVFLKINDIVFAIRDGKDE

SEQ ID NO: 3022627 - protein, 18 aa, Entamoeba invadens
VNFLIQHIELLTSTKWEM

SEQ ID NO: 3022628 - protein, 22 aa, Entamoeba invadens
VNFLLGFQHIQIIELIKFCVEK

SEQ ID NO: 3022629 - protein, 18 aa, Entamoeba invadens
VNFLLKHTKTVLSQNSML

SEQ ID NO: 3022630 - protein, 18 aa, Entamoeba invadens
VNFLLSWAEKQPPGIAMK

SEQ ID NO: 3022631 - protein, 27 aa, Entamoeba invadens
VNFQKIKYLRLYKTNPYYFMSGTSKLI

SEQ ID NO: 3022632 - protein, 27 aa, Entamoeba invadens
VNFQLFPTQFYLINIVGFAGHLINASK

SEQ ID NO: 3022633 - protein, 22 aa, Entamoeba invadens
VNFSFCLHHHKWLLSENEKDHS

SEQ ID NO: 3022634 - protein, 25 aa, Entamoeba invadens
VNGIVDGKYHFVFISGDGEMKSFAS

SEQ ID NO: 3022635 - protein, 28 aa, Entamoeba invadens
VNGKNVAIKLLEKGFFTLENSRDEMYQS

SEQ ID NO: 3022636 - protein, 23 aa, Entamoeba invadens
VNGKYYYLYKNDSNYWTLSTHFD

SEQ ID NO: 3022637 - protein, 19 aa, Entamoeba invadens
VNGLKAWKLAKPLAEKGKE

SEQ ID NO: 3022638 - protein, 25 aa, Entamoeba invadens
VNGLLNYYFEWFDEKEMFLAIVDNL

SEQ ID NO: 3022639 - protein, 28 aa, Entamoeba invadens
VNGLVGLTFLNIPLYAAGAKPWGAPTES

SEQ ID NO: 3022640 - protein, 26 aa, Entamoeba invadens
VNGNRLKLDLAQITHPTNLTTSGSIN

SEQ ID NO: 3022641 - protein, 24 aa, Entamoeba invadens
VNGNVIDWFLWSTGEKNKDNLPPH

SEQ ID NO: 3022642 - protein, 23 aa, Entamoeba invadens
VNGPRPVLKVVEDFAALSKKFIC

SEQ ID NO: 3022643 - protein, 27 aa, Entamoeba invadens
VNGRFAKQFQLLFQKTLHALGRKEVIT

SEQ ID NO: 3022644 - protein, 18 aa, Entamoeba invadens
VNGRVQKSIILLEYVKQC

SEQ ID NO: 3022645 - protein, 20 aa, Entamoeba invadens
VNHIFLSKTSLLCICKDSVE

SEQ ID NO: 3022646 - protein, 18 aa, Entamoeba invadens
VNHPDTFILLRGNHEERL

SEQ ID NO: 3022647 - protein, 27 aa, Entamoeba invadens
VNIDFEVQWLPWHNEHLLEKFVMSVSK

SEQ ID NO: 3022648 - protein, 19 aa, Entamoeba invadens
VNIFLLDYLNVYGDPFSRD

SEQ ID NO: 3022649 - protein, 26 aa, Entamoeba invadens
VNIHLKVTRTLLLFDETFRGMKAYAD

SEQ ID NO: 3022650 - protein, 35 aa, Entamoeba invadens
VNIHPSSLILAPKFIRSLIAISLVFFDGKEIEIVN

SEQ ID NO: 3022651 - protein, 23 aa, Entamoeba invadens
VNIKLIRIGPINLDDVRPLFFVV

SEQ ID NO: 3022652 - protein, 31 aa, Entamoeba invadens
VNINCPIDFPLFFDFLRITNSRLKHIVGKEK

SEQ ID NO: 3022653 - protein, 18 aa, Entamoeba invadens
VNIPPTIQEMPQLKGLVL

SEQ ID NO: 3022654 - protein, 18 aa, Entamoeba invadens
VNIPVFCVVLAKVGDLEE

SEQ ID NO: 3022655 - protein, 26 aa, Entamoeba invadens
VNISFDKYLFVKYNTSRPFGVICLFN

SEQ ID NO: 3022656 - protein, 27 aa, Entamoeba invadens
VNKATMHHLCLLRAKLVKYKKELAPVQ

SEQ ID NO: 3022657 - protein, 26 aa, Entamoeba invadens
VNKCGQTPLYLFVKGDTPRELEEGEK

SEQ ID NO: 3022658 - protein, 25 aa, Entamoeba invadens
VNKEKRKSRQFSPSKNIVSSKSNIE

SEQ ID NO: 3022659 - protein, 22 aa, Entamoeba invadens
VNKEMVIYIISFLQELSAHFEE

SEQ ID NO: 3022660 - protein, 24 aa, Entamoeba invadens
VNKETFFKVVVWYEVNYKTSQKNT

SEQ ID NO: 3022661 - protein, 23 aa, Entamoeba invadens
VNKHLHFPIITKKDKKVIIIVDN

SEQ ID NO: 3022662 - protein, 32 aa, Entamoeba invadens
VNKKFRFNLDKFHFNPIRLTKKTLKYFSHIET

SEQ ID NO: 3022663 - protein, 17 aa, Entamoeba invadens
VNKKLHFPLIVKKDKTG

SEQ ID NO: 3022664 - protein, 17 aa, Entamoeba invadens
VNKKLHFPLIVKKTKQG

SEQ ID NO: 3022665 - protein, 25 aa, Entamoeba invadens
VNKNDFVVILLKETNGWTLVRHDNK

SEQ ID NO: 3022666 - protein, 26 aa, Entamoeba invadens
VNKNFNMMYQVFTYIAVMFTDHLIYD

SEQ ID NO: 3022667 - protein, 26 aa, Entamoeba invadens
VNKPYTKTILDILRSLLPSANNPIVS

SEQ ID NO: 3022668 - protein, 17 aa, Entamoeba invadens
VNKRVVPLNPSDKFKIL

SEQ ID NO: 3022669 - protein, 33 aa, Entamoeba invadens
VNKTIRKLYIIKKPIKIDPILKPSELKRVVMET

SEQ ID NO: 3022670 - protein, 27 aa, Entamoeba invadens
VNKYVGFFYRVTFYGNAFEALFITFED

SEQ ID NO: 3022671 - protein, 18 aa, Entamoeba invadens
VNLDFLTPAPNGFKKDLI

SEQ ID NO: 3022672 - protein, 23 aa, Entamoeba invadens
VNLESFLPSTWDFVVRRVICITF

SEQ ID NO: 3022673 - protein, 26 aa, Entamoeba invadens
VNLGRESVFPILKYTMNITNKDKTKT

SEQ ID NO: 3022674 - protein, 25 aa, Entamoeba invadens
VNLIRKYLEPYVINLIFDINGNHVI

SEQ ID NO: 3022675 - protein, 18 aa, Entamoeba invadens
VNLKELVYNRLPPSLPSL

SEQ ID NO: 3022676 - protein, 25 aa, Entamoeba invadens
VNLNIYMMMVVTYRLSYLIKTIDHF

SEQ ID NO: 3022677 - protein, 20 aa, Entamoeba invadens
VNLPPPLEYYPPNGYNKSDY

SEQ ID NO: 3022678 - protein, 25 aa, Entamoeba invadens
VNLRIVHLNAWRRNIPLIVDIIDLP

SEQ ID NO: 3022679 - protein, 23 aa, Entamoeba invadens
VNLRVLPVIISPRPMEWIYDRNN

SEQ ID NO: 3022680 - protein, 18 aa, Entamoeba invadens
VNLSACFQFKRGIHFLKS

SEQ ID NO: 3022681 - protein, 30 aa, Entamoeba invadens
VNLYDIYLEDKFLYLVFEYCDQDLYQFIAN

SEQ ID NO: 3022682 - protein, 17 aa, Entamoeba invadens
VNMAKYFDFQNLKAGFG

SEQ ID NO: 3022683 - protein, 21 aa, Entamoeba invadens
VNMFNIMRKSAMRLFSICDFF

SEQ ID NO: 3022684 - protein, 20 aa, Entamoeba invadens
VNMHRVFEKLGAQQTFQEMR

SEQ ID NO: 3022685 - protein, 26 aa, Entamoeba invadens
VNNELIVDLLVYIVRNKPVGCVLIFL

SEQ ID NO: 3022686 - protein, 33 aa, Entamoeba invadens
VNNFTKPDFFKYAPAYPLVLFKCEYKEVDFVCD

SEQ ID NO: 3022687 - protein, 24 aa, Entamoeba invadens
VNNLDILLHCYLDPISEGKYSNVV

SEQ ID NO: 3022688 - protein, 26 aa, Entamoeba invadens
VNNNSEVFQFLFGRLEKIYKSLQMMY

SEQ ID NO: 3022689 - protein, 25 aa, Entamoeba invadens
VNNSLEKVLLPPKKLSAAQPTNLRT

SEQ ID NO: 3022690 - protein, 27 aa, Entamoeba invadens
VNNTFYMCTSLRSVILFSSLYSIGDNC

SEQ ID NO: 3022691 - protein, 26 aa, Entamoeba invadens
VNNTPYAIPLFDMNYFNTIQPCYFNM

SEQ ID NO: 3022692 - protein, 21 aa, Entamoeba invadens
VNNWDIDFAQFVPLTKQKMQQ

SEQ ID NO: 3022693 - protein, 18 aa, Entamoeba invadens
VNNWYVPMEIDTLRFFPF

SEQ ID NO: 3022694 - protein, 24 aa, Entamoeba invadens
VNPAKLFGLYPQKGALCVGSDADF

SEQ ID NO: 3022695 - protein, 22 aa, Entamoeba invadens
VNPDLVATWYLNNTTSVWSVEQ

SEQ ID NO: 3022696 - protein, 19 aa, Entamoeba invadens
VNPFFLSISDIFRFEKHFH

SEQ ID NO: 3022697 - protein, 30 aa, Entamoeba invadens
VNPKGLRVVNKYFPTIFASSNTGLTQPPPP

SEQ ID NO: 3022698 - protein, 63 aa, Entamoeba invadens
VNPQNILDANFYYYLSDAYSYLSLNNLLGFFTKTNGKRLFSKFLYIFIQMCKTTQIGNSKNVV

SEQ ID NO: 3022699 - protein, 32 aa, Entamoeba invadens
VNPWLNNAIDIELFYTLFAPFTLNCNNFPIDV

SEQ ID NO: 3022700 - protein, 21 aa, Entamoeba invadens
VNRANLVHAVLSGIYVFVYKS

SEQ ID NO: 3022701 - protein, 29 aa, Entamoeba invadens
VNRLLQITRMFLWFFTLPNVHSARRVLQC

SEQ ID NO: 3022702 - protein, 22 aa, Entamoeba invadens
VNRRAPIFTSPLRSVVIPFTPI

SEQ ID NO: 3022703 - protein, 31 aa, Entamoeba invadens
VNRYANRTFLLLYQYPIYPWVTSEFSNNFRV

SEQ ID NO: 3022704 - protein, 26 aa, Entamoeba invadens
VNRYSSEIGYWLAEEYWGHGIMPRAV

SEQ ID NO: 3022705 - protein, 25 aa, Entamoeba invadens
VNSETVIITWGFIKGEFQASPSFAY

SEQ ID NO: 3022706 - protein, 24 aa, Entamoeba invadens
VNSIFCALIMKYMVYNKKEIKVVL

SEQ ID NO: 3022707 - protein, 29 aa, Entamoeba invadens
VNSLPLFPTRISPLFSTLGIDGVLCVFLA

SEQ ID NO: 3022708 - protein, 30 aa, Entamoeba invadens
VNSPVLIKQFLSCLPLIITIVLQSQKYFEA

SEQ ID NO: 3022709 - protein, 20 aa, Entamoeba invadens
VNSRYNARDATWFCMSAIVD

SEQ ID NO: 3022710 - protein, 23 aa, Entamoeba invadens
VNSTIEHLILLSVKSMDIGEVPL

SEQ ID NO: 3022711 - protein, 25 aa, Entamoeba invadens
VNTIELVNYKFLLTSVIFGNPNRQP

SEQ ID NO: 3022712 - protein, 24 aa, Entamoeba invadens
VNTLCFKYEMSYSDVVKINGIQTI

SEQ ID NO: 3022713 - protein, 17 aa, Entamoeba invadens
VNTLLLYNIGRSSIPAN

SEQ ID NO: 3022714 - protein, 19 aa, Entamoeba invadens
VNTPRKIFIGRNRAKTYLG

SEQ ID NO: 3022715 - protein, 22 aa, Entamoeba invadens
VNTTFIYCKSLKEIIIPNDITK

SEQ ID NO: 3022716 - protein, 22 aa, Entamoeba invadens
VNTVNAVKQFQKKYNLMVDGEI

SEQ ID NO: 3022717 - protein, 29 aa, Entamoeba invadens
VNVEKLKISFLPLKCSLEKLKHLKFLNLK

SEQ ID NO: 3022718 - protein, 27 aa, Entamoeba invadens
VNVENKFYEILYKWKIPNIEMSLKLFS

SEQ ID NO: 3022719 - protein, 27 aa, Entamoeba invadens
VNVGIPDLPFVDITAVFKPFVCKVSKA

SEQ ID NO: 3022720 - protein, 23 aa, Entamoeba invadens
VNVLYLVLCQLFGRTLGVWDSKN

SEQ ID NO: 3022721 - protein, 28 aa, Entamoeba invadens
VNVNIEKYYLACVIPYLGHWKDLLHFGF

SEQ ID NO: 3022722 - protein, 18 aa, Entamoeba invadens
VNVTKLLCRYTESVKPIG

SEQ ID NO: 3022723 - protein, 18 aa, Entamoeba invadens
VNYLLCKNWSSQYEYNIL

SEQ ID NO: 3022724 - protein, 26 aa, Entamoeba invadens
VNYMKIKFLAITYSNEDPYLVANVVK

SEQ ID NO: 3022725 - protein, 25 aa, Entamoeba invadens
VNYNCDPTFFLKFLKDIHANGLSEK

SEQ ID NO: 3022726 - protein, 20 aa, Entamoeba invadens
VNYVVKYIEHPYLSRRGDDL

SEQ ID NO: 3022727 - protein, 24 aa, Entamoeba invadens
VPAQLRGYILGDTCGPFFQVKLLK

SEQ ID NO: 3022728 - protein, 22 aa, Entamoeba invadens
VPCEAVHAVSLLFEGAKKDGVV

SEQ ID NO: 3022729 - protein, 24 aa, Entamoeba invadens
VPDIHVIGMWLKAETYVCTYRPVE

SEQ ID NO: 3022730 - protein, 18 aa, Entamoeba invadens
VPDLVRPNMFVGVPVKMT

SEQ ID NO: 3022731 - protein, 23 aa, Entamoeba invadens
VPDLYMTDYIIGGVLNLSGMREP

SEQ ID NO: 3022732 - protein, 28 aa, Entamoeba invadens
VPDLYTTHYLMFYTFISESSVYSSPLSG

SEQ ID NO: 3022733 - protein, 26 aa, Entamoeba invadens
VPDQARGIFIDWKGPKARAMLKAKMT

SEQ ID NO: 3022734 - protein, 23 aa, Entamoeba invadens
VPDSGYYTLFVKCDDYGKLEVNM

SEQ ID NO: 3022735 - protein, 22 aa, Entamoeba invadens
VPEDISVIAWGFGLERPTMISY

SEQ ID NO: 3022736 - protein, 28 aa, Entamoeba invadens
VPELGELHWIRTPPKIFFEPHAIRYLAE

SEQ ID NO: 3022737 - protein, 25 aa, Entamoeba invadens
VPEQRPLIFFEYYETHPVKADEYKA

SEQ ID NO: 3022738 - protein, 27 aa, Entamoeba invadens
VPFPPKVLKFRFYNYCKKYQNIKKVLS

SEQ ID NO: 3022739 - protein, 22 aa, Entamoeba invadens
VPFVEDYGCGMLSIHGRTRKQR

SEQ ID NO: 3022740 - protein, 20 aa, Entamoeba invadens
VPGDETVGYLKGLLSAKYHK

SEQ ID NO: 3022741 - protein, 20 aa, Entamoeba invadens
VPGYFKYVYEYPVSYSFYLS

SEQ ID NO: 3022742 - protein, 21 aa, Entamoeba invadens
VPHIVECVLTFLNLFNDLRST

SEQ ID NO: 3022743 - protein, 26 aa, Entamoeba invadens
VPHNFQRAMYALYFTPRSLEGVFRQC

SEQ ID NO: 3022744 - protein, 25 aa, Entamoeba invadens
VPHTITFLFDEIKNFAFVRVYISHS

SEQ ID NO: 3022745 - protein, 29 aa, Entamoeba invadens
VPIIFSSHFPDFFPFPCFQLERLERVSIA

SEQ ID NO: 3022746 - protein, 17 aa, Entamoeba invadens
VPILLVGNKVDLLNTEQ

SEQ ID NO: 3022747 - protein, 29 aa, Entamoeba invadens
VPINKLRYDQIKKLKPIVLDHIYYEKRAK

SEQ ID NO: 3022748 - protein, 22 aa, Entamoeba invadens
VPIPDFKVLLKSVLITGFSPVI

SEQ ID NO: 3022749 - protein, 18 aa, Entamoeba invadens
VPIRTKIVNFIRTWAKWR

SEQ ID NO: 3022750 - protein, 28 aa, Entamoeba invadens
VPISSASVLRLAFGLDFCYFEVCANQSN

SEQ ID NO: 3022751 - protein, 18 aa, Entamoeba invadens
VPITCHAKVLGAMESKAT

SEQ ID NO: 3022752 - protein, 17 aa, Entamoeba invadens
VPIVLCGGDFFFGMFVR

SEQ ID NO: 3022753 - protein, 26 aa, Entamoeba invadens
VPKANGYGFNAFLKSVNRTAMLSNED

SEQ ID NO: 3022754 - protein, 24 aa, Entamoeba invadens
VPKEIYRLVDWIYKKYSVGCFERG

SEQ ID NO: 3022755 - protein, 17 aa, Entamoeba invadens
VPKFPGFELFKMDIFRL

SEQ ID NO: 3022756 - protein, 18 aa, Entamoeba invadens
VPKIKYFEKIGTPGYSLT

SEQ ID NO: 3022757 - protein, 24 aa, Entamoeba invadens
VPKIRADITFTQQKYFLANQKVQK

SEQ ID NO: 3022758 - protein, 22 aa, Entamoeba invadens
VPKKYVPFFKEVQQTLLSFREL

SEQ ID NO: 3022759 - protein, 17 aa, Entamoeba invadens
VPKMIVVLQRVDEFFQT

SEQ ID NO: 3022760 - protein, 19 aa, Entamoeba invadens
VPKNFGLPDYQLGIAAKKF

SEQ ID NO: 3022761 - protein, 23 aa, Entamoeba invadens
VPKYSLAYHQCRWNYMSQNEAEE

SEQ ID NO: 3022762 - protein, 46 aa, Entamoeba invadens
VPLCFTNLMKLKNIYLSFNQISKLPSNFFIFSNLRALNFTHNQLTS

SEQ ID NO: 3022763 - protein, 19 aa, Entamoeba invadens
VPLDAQRPEYFFGKGFFGN

SEQ ID NO: 3022764 - protein, 20 aa, Entamoeba invadens
VPLLRGFLTRQETSGTKGWN

SEQ ID NO: 3022765 - protein, 17 aa, Entamoeba invadens
VPLNLFNEVIYMLGVDL

SEQ ID NO: 3022766 - protein, 32 aa, Entamoeba invadens
VPLTTTMTQLYILKNRVYFMSHLVYCEDGSKT

SEQ ID NO: 3022767 - protein, 21 aa, Entamoeba invadens
VPMLFIKVIGRLTIDGENPLL

SEQ ID NO: 3022768 - protein, 23 aa, Entamoeba invadens
VPNFEIWVPKPYSSFSNLFETKW

SEQ ID NO: 3022769 - protein, 17 aa, Entamoeba invadens
VPNILQNSLRYLENFFA

SEQ ID NO: 3022770 - protein, 17 aa, Entamoeba invadens
VPNKCFLNCPRLRFVYL

SEQ ID NO: 3022771 - protein, 19 aa, Entamoeba invadens
VPNKDFFFDFKKVLDDDEG

SEQ ID NO: 3022772 - protein, 25 aa, Entamoeba invadens
VPNKFVEGNFLKIIDFKKVQFDAKS

SEQ ID NO: 3022773 - protein, 25 aa, Entamoeba invadens
VPNKRNFISKVYNLKKMSGFGNLIE

SEQ ID NO: 3022774 - protein, 18 aa, Entamoeba invadens
VPNLIGVQILSMSKRIMN

SEQ ID NO: 3022775 - protein, 19 aa, Entamoeba invadens
VPNLKGCFLKLLEVKEGDI

SEQ ID NO: 3022776 - protein, 24 aa, Entamoeba invadens
VPNLKRQFPIARYFKIHTKQLDFD

SEQ ID NO: 3022777 - protein, 26 aa, Entamoeba invadens
VPNQKDLITDPFIFCGSIKLQMVVFI

SEQ ID NO: 3022778 - protein, 21 aa, Entamoeba invadens
VPNQNIWYGADSRYPITCPLV

SEQ ID NO: 3022779 - protein, 36 aa, Entamoeba invadens
VPNSLFYIEKYSEVPWILSPILRTVRWLNKMNTLNK

SEQ ID NO: 3022780 - protein, 25 aa, Entamoeba invadens
VPNVNRIVFIHWKGPNVRGMKMVKS

SEQ ID NO: 3022781 - protein, 20 aa, Entamoeba invadens
VPPEFAFEFYKENTALICTL

SEQ ID NO: 3022782 - protein, 23 aa, Entamoeba invadens
VPPHTLPITPGKFQKISIGAGRL

SEQ ID NO: 3022783 - protein, 23 aa, Entamoeba invadens
VPPSYIYRLLAQLYNPEDTFFTT

SEQ ID NO: 3022784 - protein, 28 aa, Entamoeba invadens
VPQEIPENIFWCKYFRLLFTVQDRESDY

SEQ ID NO: 3022785 - protein, 18 aa, Entamoeba invadens
VPQHSMSIPFMTEEVEFS

SEQ ID NO: 3022786 - protein, 20 aa, Entamoeba invadens
VPQNILAIKYFCFNRCGNLT

SEQ ID NO: 3022787 - protein, 18 aa, Entamoeba invadens
VPRRSGNRLPPSEWLISI

SEQ ID NO: 3022788 - protein, 20 aa, Entamoeba invadens
VPRYRLLLEDLLKNTPDGTE

SEQ ID NO: 3022789 - protein, 20 aa, Entamoeba invadens
VPSIFLTCENLKQLRTEMVK

SEQ ID NO: 3022790 - protein, 25 aa, Entamoeba invadens
VPSVGYFHYTFPGLAVVRPVDFTDD

SEQ ID NO: 3022791 - protein, 19 aa, Entamoeba invadens
VPSVHLSWYKMLETSQQNK

SEQ ID NO: 3022792 - protein, 23 aa, Entamoeba invadens
VPSVLIVYSKPDKVYIPLMINPS

SEQ ID NO: 3022793 - protein, 24 aa, Entamoeba invadens
VPTICGDIAIHFKELAKNAANANK

SEQ ID NO: 3022794 - protein, 31 aa, Entamoeba invadens
VPVKHLKLFPNMDVLLLYNPTDFPIISNQVS

SEQ ID NO: 3022795 - protein, 29 aa, Entamoeba invadens
VPVLADDMFYFWIASCPILPSSEKISDVV

SEQ ID NO: 3022796 - protein, 20 aa, Entamoeba invadens
VPVNAFVTCKVYQLAAGLID

SEQ ID NO: 3022797 - protein, 30 aa, Entamoeba invadens
VPVPKPPTKWELFAKRKGIVKPKRSQKVWN

SEQ ID NO: 3022798 - protein, 17 aa, Entamoeba invadens
VPVQCLPSFFSVENNVS

SEQ ID NO: 3022799 - protein, 18 aa, Entamoeba invadens
VPVSLIYYSLEQLLMPLP

SEQ ID NO: 3022800 - protein, 28 aa, Entamoeba invadens
VPVVAKDAFITPGVYLIGDVEIHSKANI

SEQ ID NO: 3022801 - protein, 19 aa, Entamoeba invadens
VPYLGRLMKELLTGSLKKM

SEQ ID NO: 3022802 - protein, 25 aa, Entamoeba invadens
VPYVRGYYSFDFPHINIPLSCHQFL

SEQ ID NO: 3022803 - protein, 23 aa, Entamoeba invadens
VQAKRLFIFSFDCNIEYGQKRIG

SEQ ID NO: 3022804 - protein, 19 aa, Entamoeba invadens
VQALYLPKEIGEKALAMYQ

SEQ ID NO: 3022805 - protein, 28 aa, Entamoeba invadens
VQAPPQQTPFGMVPPVMPYGGAAPQYGM

SEQ ID NO: 3022806 - protein, 28 aa, Entamoeba invadens
VQARQIFNEMKYPYKRPADYFAEMFKDD

SEQ ID NO: 3022807 - protein, 33 aa, Entamoeba invadens
VQCNFFEFLCFEWYYLASWYQNKKQIEYLSEDR

SEQ ID NO: 3022808 - protein, 24 aa, Entamoeba invadens
VQDDKYFCIFPKKELVESYITSSL

SEQ ID NO: 3022809 - protein, 25 aa, Entamoeba invadens
VQDKLVKVCDLDKSLRVILENVMTN

SEQ ID NO: 3022810 - protein, 23 aa, Entamoeba invadens
VQDLRLSDFLLTANPGGIPFVKM

SEQ ID NO: 3022811 - protein, 27 aa, Entamoeba invadens
VQDVQWHPLSPYLFASAAFDYSIKVWD

SEQ ID NO: 3022812 - protein, 23 aa, Entamoeba invadens
VQEGYIKQFLRYLIVREIEDNFR

SEQ ID NO: 3022813 - protein, 24 aa, Entamoeba invadens
VQEKALSLLLNWGSVHGSSCPEYK

SEQ ID NO: 3022814 - protein, 18 aa, Entamoeba invadens
VQEPLCVLLKGMVIWDDM

SEQ ID NO: 3022815 - protein, 26 aa, Entamoeba invadens
VQETMPIIITLLKPIIFDKPYVPDAI

SEQ ID NO: 3022816 - protein, 21 aa, Entamoeba invadens
VQFFEKYPFDIIIQFVNVGIL

SEQ ID NO: 3022817 - protein, 18 aa, Entamoeba invadens
VQFGYLNINDIVYIEQFD

SEQ ID NO: 3022818 - protein, 24 aa, Entamoeba invadens
VQFRDICLGLLNSLLQALSVRFTL

SEQ ID NO: 3022819 - protein, 33 aa, Entamoeba invadens
VQFRDICLGLLYRLLQTLSVRFTLPTKKLKPSQ

SEQ ID NO: 3022820 - protein, 18 aa, Entamoeba invadens
VQFSKMIMDFPEISEVDI

SEQ ID NO: 3022821 - protein, 24 aa, Entamoeba invadens
VQFTKHLVQIFPFDYDLLVGFEDS

SEQ ID NO: 3022822 - protein, 26 aa, Entamoeba invadens
VQFVSLAVKPLFTTPLVLFTDQDAKK

SEQ ID NO: 3022823 - protein, 34 aa, Entamoeba invadens
VQGVMEFVTFFKTQGIIPLFVFDGATLPAKMKTE

SEQ ID NO: 3022824 - protein, 20 aa, Entamoeba invadens
VQGVVLWGIGRMIVQTEKHS

SEQ ID NO: 3022825 - protein, 19 aa, Entamoeba invadens
VQHCLKAFISSMYPPVTVS

SEQ ID NO: 3022826 - protein, 32 aa, Entamoeba invadens
VQHIEEFMIMFVVDLNLYLKWKREGKYTIKHG

SEQ ID NO: 3022827 - protein, 19 aa, Entamoeba invadens
VQHKPVLELLIDSFLTQQS

SEQ ID NO: 3022828 - protein, 23 aa, Entamoeba invadens
VQILKVPRSLFPVALSKSGINEN

SEQ ID NO: 3022829 - protein, 17 aa, Entamoeba invadens
VQILWDYYLACGCYNVV

SEQ ID NO: 3022830 - protein, 18 aa, Entamoeba invadens
VQITYLRKVHSLCYYCLI

SEQ ID NO: 3022831 - protein, 25 aa, Entamoeba invadens
VQIYIQLQYAWMYQDRNMLLKKVVF

SEQ ID NO: 3022832 - protein, 27 aa, Entamoeba invadens
VQIYNTDFIVKYIKHQCFSRHGDDLVV

SEQ ID NO: 3022833 - protein, 17 aa, Entamoeba invadens
VQKGVFYLLPEIIVEYF

SEQ ID NO: 3022834 - protein, 24 aa, Entamoeba invadens
VQKILWVFINVHMLLKRSSNEGRS

SEQ ID NO: 3022835 - protein, 30 aa, Entamoeba invadens
VQKIVLENVFKVQFFTLKMLLFEQEKEIKE

SEQ ID NO: 3022836 - protein, 18 aa, Entamoeba invadens
VQKKEGFLLEYHSSQLFP

SEQ ID NO: 3022837 - protein, 26 aa, Entamoeba invadens
VQKKLRVSYLVLRYAQMKKYEINSTI

SEQ ID NO: 3022838 - protein, 26 aa, Entamoeba invadens
VQKTFTLFVTPLMPLSSSFLLPTTLY

SEQ ID NO: 3022839 - protein, 18 aa, Entamoeba invadens
VQKTYFLFKVLKEDMVLE

SEQ ID NO: 3022840 - protein, 35 aa, Entamoeba invadens
VQKVPRGCVFFKNKSRAFGFFFDTNKKKHISNTVF

SEQ ID NO: 3022841 - protein, 24 aa, Entamoeba invadens
VQKYYLEHYTPTNSLTVLYSPDDL

SEQ ID NO: 3022842 - protein, 21 aa, Entamoeba invadens
VQLAAFFHILVQNPDAVFKLD

SEQ ID NO: 3022843 - protein, 17 aa, Entamoeba invadens
VQLEMNPLLFNQVSLRA

SEQ ID NO: 3022844 - protein, 18 aa, Entamoeba invadens
VQLGMKRAVLFFEKNRKT

SEQ ID NO: 3022845 - protein, 25 aa, Entamoeba invadens
VQLLPLCVDGFLWSRKSMADEVGKG

SEQ ID NO: 3022846 - protein, 24 aa, Entamoeba invadens
VQLVKIIDYIYRKGLDTPCLMLTR

SEQ ID NO: 3022847 - protein, 26 aa, Entamoeba invadens
VQMHFERLLIANYRKSTNDLTVQFDQ

SEQ ID NO: 3022848 - protein, 27 aa, Entamoeba invadens
VQMLQEKLLRANYKKLTKKANDLTVQV

SEQ ID NO: 3022849 - protein, 24 aa, Entamoeba invadens
VQMQQLFSMLLSLTPNMNYSTLSS

SEQ ID NO: 3022850 - protein, 22 aa, Entamoeba invadens
VQNPLNGMCGYIGTIQYRKSGI

SEQ ID NO: 3022851 - protein, 25 aa, Entamoeba invadens
VQNVCQILLQFLRTDDERIQRTALQ

SEQ ID NO: 3022852 - protein, 26 aa, Entamoeba invadens
VQNVELFDPLFVHLIKKRFSVEKASQ

SEQ ID NO: 3022853 - protein, 18 aa, Entamoeba invadens
VQPIFKEMKVQFVVELLG

SEQ ID NO: 3022854 - protein, 27 aa, Entamoeba invadens
VQPQIKPIVRIPYQTNLQPFFSIQDAC

SEQ ID NO: 3022855 - protein, 23 aa, Entamoeba invadens
VQPSQIFPMKKRCFTFGVDDAPS

SEQ ID NO: 3022856 - protein, 23 aa, Entamoeba invadens
VQPYYDYPELLGILLDLASNERT

SEQ ID NO: 3022857 - protein, 23 aa, Entamoeba invadens
VQPYYDYPELLGLLLELANSERN

SEQ ID NO: 3022858 - protein, 27 aa, Entamoeba invadens
VQQKLLVITRLVRQLGLYSYNNDNKVI

SEQ ID NO: 3022859 - protein, 21 aa, Entamoeba invadens
VQQLIFKFKLAPEDVKVLFGI

SEQ ID NO: 3022860 - protein, 24 aa, Entamoeba invadens
VQQLLSHIFVIDPEKRYSIEQIEE

SEQ ID NO: 3022861 - protein, 21 aa, Entamoeba invadens
VQQMLDFTAEITKPLELPCTI

SEQ ID NO: 3022862 - protein, 23 aa, Entamoeba invadens
VQQQALLIALLNQNYTITLKMPR

SEQ ID NO: 3022863 - protein, 43 aa, Entamoeba invadens
VQQQLDLIDYFIMPIQRLPRYKLLLEQLIKFTPPTHCDFDNIT

SEQ ID NO: 3022864 - protein, 28 aa, Entamoeba invadens
VQQTIPEPLFILELKISPYLYTEDLIHQ

SEQ ID NO: 3022865 - protein, 36 aa, Entamoeba invadens
VQQTLLVPRRLFDKLMRLLNILFNYIDMRYKDDFNK

SEQ ID NO: 3022866 - protein, 20 aa, Entamoeba invadens
VQRCGLSMYYTPNSVVWEIV

SEQ ID NO: 3022867 - protein, 19 aa, Entamoeba invadens
VQRIFRNLSFHDLLMCRSV

SEQ ID NO: 3022868 - protein, 32 aa, Entamoeba invadens
VQRISPMIDLTFLTRGFYPEGLLKNMRLLHID

SEQ ID NO: 3022869 - protein, 20 aa, Entamoeba invadens
VQRKLYLTEEPFPIILCVTK

SEQ ID NO: 3022870 - protein, 22 aa, Entamoeba invadens
VQRLRKKLGFKYSTLRKSRFLT

SEQ ID NO: 3022871 - protein, 28 aa, Entamoeba invadens
VQRMKYTNFILSLWKLQIAPSCDSDEWK

SEQ ID NO: 3022872 - protein, 19 aa, Entamoeba invadens
VQRTMLELINQLDGFDKRG

SEQ ID NO: 3022873 - protein, 31 aa, Entamoeba invadens
VQSGGMEIILKYYWPLFKEGKRLTNGININL

SEQ ID NO: 3022874 - protein, 24 aa, Entamoeba invadens
VQSKNYTPLPKKQPPAEPEWKRKQ

SEQ ID NO: 3022875 - protein, 19 aa, Entamoeba invadens
VQSTKLVYWEHIYDEILLT

SEQ ID NO: 3022876 - protein, 29 aa, Entamoeba invadens
VQSTNRYYYSIYTNWWGGEFKWRDKVNQV

SEQ ID NO: 3022877 - protein, 26 aa, Entamoeba invadens
VQSVIEQLLTFYFSYEEIVADLESKG

SEQ ID NO: 3022878 - protein, 19 aa, Entamoeba invadens
VQSYLRFLYEKDTCKEELD

SEQ ID NO: 3022879 - protein, 26 aa, Entamoeba invadens
VQTAYYFNVMFPDIFYEVLKKPITIE

SEQ ID NO: 3022880 - protein, 25 aa, Entamoeba invadens
VQTKDFIISKLFPKPTRAIFFSQML

SEQ ID NO: 3022881 - protein, 25 aa, Entamoeba invadens
VQTKDVFFIKTVLGVPGINVYIGDN

SEQ ID NO: 3022882 - protein, 17 aa, Entamoeba invadens
VQTLLTNKTLFVTHPGM

SEQ ID NO: 3022883 - protein, 33 aa, Entamoeba invadens
VQTRSYIPSVNIWSQFLAFDCKHDDQVKIDIFG

SEQ ID NO: 3022884 - protein, 17 aa, Entamoeba invadens
VQTSLFYKDENLTKLFA

SEQ ID NO: 3022885 - protein, 25 aa, Entamoeba invadens
VQTTLVFNKFGLMPFQTVCPSKKNV

SEQ ID NO: 3022886 - protein, 26 aa, Entamoeba invadens
VQTTSGLIFGIYNQTKAPQFSTRKAT

SEQ ID NO: 3022887 - protein, 24 aa, Entamoeba invadens
VQTVVVWCPCLHSFTVDALKRGIT

SEQ ID NO: 3022888 - protein, 18 aa, Entamoeba invadens
VQVIHYYSDLEELCWKFR

SEQ ID NO: 3022889 - protein, 26 aa, Entamoeba invadens
VQVMFNVFNVLWLKESFLAHPTDFDK

SEQ ID NO: 3022890 - protein, 20 aa, Entamoeba invadens
VQVPLKCNLEDLYNGKTFKR

SEQ ID NO: 3022891 - protein, 25 aa, Entamoeba invadens
VQVRIMNALRYVLLECWSAISNKNE

SEQ ID NO: 3022892 - protein, 17 aa, Entamoeba invadens
VQVRLLVLPEKAKNISL

SEQ ID NO: 3022893 - protein, 24 aa, Entamoeba invadens
VQYGYYRGTYLPQVATEQGWDTKT

SEQ ID NO: 3022894 - protein, 18 aa, Entamoeba invadens
VQYQDKLFLSMNCYNDKN

SEQ ID NO: 3022895 - protein, 23 aa, Entamoeba invadens
VQYSQPQLPPPINTIPPVAKTEI

SEQ ID NO: 3022896 - protein, 24 aa, Entamoeba invadens
VRALTLKFILTVREKEFLQPLAHA

SEQ ID NO: 3022897 - protein, 25 aa, Entamoeba invadens
VRANAFWNICRLDNYHIVSCLIRHC

SEQ ID NO: 3022898 - protein, 20 aa, Entamoeba invadens
VRAYLPVCESFGFTADLRSH

SEQ ID NO: 3022899 - protein, 27 aa, Entamoeba invadens
VRCELYGGGNWPSWFDRDLGVCGRVIT

SEQ ID NO: 3022900 - protein, 17 aa, Entamoeba invadens
VRCNACGEYMYKGKKFN

SEQ ID NO: 3022901 - protein, 26 aa, Entamoeba invadens
VRDEDAFIFMLKYKLSQGLKPIEITM

SEQ ID NO: 3022902 - protein, 24 aa, Entamoeba invadens
VRDISTALLLPKFIEFKKNGDATK

SEQ ID NO: 3022903 - protein, 29 aa, Entamoeba invadens
VRDKRGTFLMNRLISMLSAFQAATTRQNV

SEQ ID NO: 3022904 - protein, 29 aa, Entamoeba invadens
VRDNDQLWRALLLDFLKKILEYDPAKRLT

SEQ ID NO: 3022905 - protein, 21 aa, Entamoeba invadens
VRDRACFYGIYLDTPVIETKV

SEQ ID NO: 3022906 - protein, 22 aa, Entamoeba invadens
VRDVFRRPLLFKIVNEEKDSRQ

SEQ ID NO: 3022907 - protein, 21 aa, Entamoeba invadens
VREIDSYFYKIRPSDLVSERL

SEQ ID NO: 3022908 - protein, 27 aa, Entamoeba invadens
VREKRGICLVNRLISMLSAFQAATNRQ

SEQ ID NO: 3022909 - protein, 26 aa, Entamoeba invadens
VREKRGICLVNRLISMLSAFQAATTR

SEQ ID NO: 3022910 - protein, 29 aa, Entamoeba invadens
VREKSGVFLVNRLISMLSAFQAATTRQNV

SEQ ID NO: 3022911 - protein, 25 aa, Entamoeba invadens
VRELYCGTIQLFADLFEKEKNSLEQ

SEQ ID NO: 3022912 - protein, 26 aa, Entamoeba invadens
VRERAKIICEMLNDKEFLKQERATAK

SEQ ID NO: 3022913 - protein, 42 aa, Entamoeba invadens
VREYIDFVFKRIDELTWSEFEYLINLLFIHESCPAFSLKFPK

SEQ ID NO: 3022914 - protein, 30 aa, Entamoeba invadens
VREYTLEIITLWYRPLEILLGKEVYTSAVD

SEQ ID NO: 3022915 - protein, 17 aa, Entamoeba invadens
VRFFLGRTEVVVGIKCE

SEQ ID NO: 3022916 - protein, 26 aa, Entamoeba invadens
VRFYIFNDTLFMTTQPKRSIFSVITH

SEQ ID NO: 3022917 - protein, 18 aa, Entamoeba invadens
VRGAIHLAPPPSKGQPLR

SEQ ID NO: 3022918 - protein, 26 aa, Entamoeba invadens
VRGKGGICFLFLRKGIYTCQAVATVS

SEQ ID NO: 3022919 - protein, 25 aa, Entamoeba invadens
VRGTTLFCATIFREYLENGVYETTY

SEQ ID NO: 3022920 - protein, 17 aa, Entamoeba invadens
VRGYKKSGLKMLPKGDH

SEQ ID NO: 3022921 - protein, 31 aa, Entamoeba invadens
VRHGICAMAAIRYFIEMIRAGKGELPFCLEM

SEQ ID NO: 3022922 - protein, 22 aa, Entamoeba invadens
VRHGLELISFFSVSKGYYGECG

SEQ ID NO: 3022923 - protein, 32 aa, Entamoeba invadens
VRHPDFHGELFKKAYDTLLSLKGFTDSGKTVF

SEQ ID NO: 3022924 - protein, 25 aa, Entamoeba invadens
VRHYYRKFGYILDGPYMAKLLVEGQ

SEQ ID NO: 3022925 - protein, 20 aa, Entamoeba invadens
VRICLFQFINVMLQRYRNYV

SEQ ID NO: 3022926 - protein, 19 aa, Entamoeba invadens
VRIEDVTDCTIVLTKNVKN

SEQ ID NO: 3022927 - protein, 33 aa, Entamoeba invadens
VRIGPSPPAYLSPNVFKYLADNLGLKMITTVDN

SEQ ID NO: 3022928 - protein, 21 aa, Entamoeba invadens
VRIHFDKWHLGTNSPRPVEDI

SEQ ID NO: 3022929 - protein, 25 aa, Entamoeba invadens
VRINTVVCIGKIACYFKAEKKGKLI

SEQ ID NO: 3022930 - protein, 26 aa, Entamoeba invadens
VRIQEKLYMSWMNEVLEKRNMEVTNL

SEQ ID NO: 3022931 - protein, 18 aa, Entamoeba invadens
VRIQPIDRTIADEKIHAL

SEQ ID NO: 3022932 - protein, 17 aa, Entamoeba invadens
VRKKLMNGAYKNRKEFA

SEQ ID NO: 3022933 - protein, 44 aa, Entamoeba invadens
VRKLGRTFIHFCKELKLDLPFVDPCLYLQRFGEDLAFEKTADVV

SEQ ID NO: 3022934 - protein, 19 aa, Entamoeba invadens
VRLLLIPSYNIEKSDFELK

SEQ ID NO: 3022935 - protein, 34 aa, Entamoeba invadens
VRLRDKYGIYTGIKFILHIKGRLNYYASHDREMY

SEQ ID NO: 3022936 - protein, 18 aa, Entamoeba invadens
VRMAFVDTALHTKVPKFD

SEQ ID NO: 3022937 - protein, 20 aa, Entamoeba invadens
VRMHGLYEIIPNKVYQFRGF

SEQ ID NO: 3022938 - protein, 27 aa, Entamoeba invadens
VRMSDHFLTLLYVIKFARKTFATLIEY

SEQ ID NO: 3022939 - protein, 20 aa, Entamoeba invadens
VRNAFYKLLRAILSVPHTSY

SEQ ID NO: 3022940 - protein, 26 aa, Entamoeba invadens
VRNGFTEFIIFFALSMILTVTGKYNT

SEQ ID NO: 3022941 - protein, 19 aa, Entamoeba invadens
VRNKYGIIGPIPFSEFSVK

SEQ ID NO: 3022942 - protein, 17 aa, Entamoeba invadens
VRNLPITHIPGLTSLKM

SEQ ID NO: 3022943 - protein, 29 aa, Entamoeba invadens
VRNNFIWGSMFGIAYWGWSTEAYYKDITI

SEQ ID NO: 3022944 - protein, 18 aa, Entamoeba invadens
VRNYVIPPSPRDGIPFCE

SEQ ID NO: 3022945 - protein, 19 aa, Entamoeba invadens
VRPFNFFDRISYITSTNFC

SEQ ID NO: 3022946 - protein, 30 aa, Entamoeba invadens
VRPGIPFEEILSQFYRLGKNEIIVDWLRNN

SEQ ID NO: 3022947 - protein, 17 aa, Entamoeba invadens
VRQKLVKTLPVTSAFHG

SEQ ID NO: 3022948 - protein, 17 aa, Entamoeba invadens
VRQLNIYGFRKLETQSG

SEQ ID NO: 3022949 - protein, 25 aa, Entamoeba invadens
VRQRSIYIVMRVLNSLPDNFTLPED

SEQ ID NO: 3022950 - protein, 29 aa, Entamoeba invadens
VRQSYAFQTKDLWRAPVNQLSPMDRFAKF

SEQ ID NO: 3022951 - protein, 19 aa, Entamoeba invadens
VRREWCLFSKEIGNYCINL

SEQ ID NO: 3022952 - protein, 17 aa, Entamoeba invadens
VRRMPLESVVLTLKGMG

SEQ ID NO: 3022953 - protein, 28 aa, Entamoeba invadens
VRRVFVAGPRIFYLSDETAFFSSAESPA

SEQ ID NO: 3022954 - protein, 23 aa, Entamoeba invadens
VRRVIVFWKYKGTNTCTNCFFYY

SEQ ID NO: 3022955 - protein, 28 aa, Entamoeba invadens
VRSDLALKRLFLENPPPFHVPDSVEYLQ

SEQ ID NO: 3022956 - protein, 25 aa, Entamoeba invadens
VRSDVYKMMNWWFEKGIDGFRMDVI

SEQ ID NO: 3022957 - protein, 22 aa, Entamoeba invadens
VRSFLFVEISPLLDKYFDLIDS

SEQ ID NO: 3022958 - protein, 21 aa, Entamoeba invadens
VRSFRPERIVLFTINNFNETS

SEQ ID NO: 3022959 - protein, 25 aa, Entamoeba invadens
VRSKCYIEYIFAYSVVDMNLMAKMF

SEQ ID NO: 3022960 - protein, 17 aa, Entamoeba invadens
VRSLLQVQIGDAIEADR

SEQ ID NO: 3022961 - protein, 27 aa, Entamoeba invadens
VRSMNYFKRNILFESINKIKTFEKVLG

SEQ ID NO: 3022962 - protein, 26 aa, Entamoeba invadens
VRSNLSAVILLLKTLGIDDIVHFDFM

SEQ ID NO: 3022963 - protein, 25 aa, Entamoeba invadens
VRSQKFVEYLFKSAQYFSSEIIVIS

SEQ ID NO: 3022964 - protein, 33 aa, Entamoeba invadens
VRSSTSSTYFLLKLPFNYLFDYLAVCMEPTAVE

SEQ ID NO: 3022965 - protein, 26 aa, Entamoeba invadens
VRTFKDYFTFFTDIPTQVIDVCKSTT

SEQ ID NO: 3022966 - protein, 23 aa, Entamoeba invadens
VRTFYNFLLYIKESVDIKVQRKL

SEQ ID NO: 3022967 - protein, 17 aa, Entamoeba invadens
VRTMQYLDNLYFKTGEL

SEQ ID NO: 3022968 - protein, 17 aa, Entamoeba invadens
VRVLKIGGKAIITVWAK

SEQ ID NO: 3022969 - protein, 17 aa, Entamoeba invadens
VRVVTVLFPTPEVFTEK

SEQ ID NO: 3022970 - protein, 21 aa, Entamoeba invadens
VRYHRMLGDTTLWVPGVDHAG

SEQ ID NO: 3022971 - protein, 20 aa, Entamoeba invadens
VRYLALDTFVLLGQANYKKV

SEQ ID NO: 3022972 - protein, 27 aa, Entamoeba invadens
VSADLLFPLCLYITLKSALPNIDSTIF

SEQ ID NO: 3022973 - protein, 28 aa, Entamoeba invadens
VSADLLLPTIIFAIIHSAPLHLVSTIEY

SEQ ID NO: 3022974 - protein, 20 aa, Entamoeba invadens
VSAFFYVQPILKNSSRKQVI

SEQ ID NO: 3022975 - protein, 25 aa, Entamoeba invadens
VSAFVLLREIFGDEGIFNLLYMKKK

SEQ ID NO: 3022976 - protein, 35 aa, Entamoeba invadens
VSAFVQNFVFDTCLEMGFFFNSKLSKKSKKSLQIE

SEQ ID NO: 3022977 - protein, 18 aa, Entamoeba invadens
VSAIKPLYDAFNDKTVDK

SEQ ID NO: 3022978 - protein, 18 aa, Entamoeba invadens
VSAKDWILLHQKIEILLL

SEQ ID NO: 3022979 - protein, 24 aa, Entamoeba invadens
VSAKMMFEMIYLFCGISSAVDAEI

SEQ ID NO: 3022980 - protein, 21 aa, Entamoeba invadens
VSALLCVNYPPGIPTIMPGEI

SEQ ID NO: 3022981 - protein, 22 aa, Entamoeba invadens
VSAPFNLLVLTTDHLHLFDSRL

SEQ ID NO: 3022982 - protein, 17 aa, Entamoeba invadens
VSATWRVVKFTPVDICV

SEQ ID NO: 3022983 - protein, 20 aa, Entamoeba invadens
VSCVCKILCVPGCPFQPQAI

SEQ ID NO: 3022984 - protein, 25 aa, Entamoeba invadens
VSCVNALSIWLKLSVRRDGEVYEID

SEQ ID NO: 3022985 - protein, 20 aa, Entamoeba invadens
VSDALKRTLRLFGNNLGNHF

SEQ ID NO: 3022986 - protein, 28 aa, Entamoeba invadens
VSDARKRALRLFGNYLGNSLYDTDYVRQ

SEQ ID NO: 3022987 - protein, 17 aa, Entamoeba invadens
VSDGLFFTKVNIGMREV

SEQ ID NO: 3022988 - protein, 25 aa, Entamoeba invadens
VSDLSIYLSSLLTSASFFSKGTLSV

SEQ ID NO: 3022989 - protein, 19 aa, Entamoeba invadens
VSDMFRLFNIVFAEEVTHG

SEQ ID NO: 3022990 - protein, 25 aa, Entamoeba invadens
VSDNRFGVILKFNQLKEELSRLLEN

SEQ ID NO: 3022991 - protein, 17 aa, Entamoeba invadens
VSDPRLLQPQEKVTRYS

SEQ ID NO: 3022992 - protein, 23 aa, Entamoeba invadens
VSEGLLYELMIQAGPVMSVSIPR

SEQ ID NO: 3022993 - protein, 19 aa, Entamoeba invadens
VSEKLLFAGGTTLLPGVSE

SEQ ID NO: 3022994 - protein, 25 aa, Entamoeba invadens
VSELIKYGMSLLFSYNIDLRSKQEK

SEQ ID NO: 3022995 - protein, 24 aa, Entamoeba invadens
VSELLWMVCYRFIHTQDNKEWGFL

SEQ ID NO: 3022996 - protein, 26 aa, Entamoeba invadens
VSENRSWLLPYIVFKTVGMECAPTLE

SEQ ID NO: 3022997 - protein, 23 aa, Entamoeba invadens
VSEPFTLCFGKKRVFLLIIEKEA

SEQ ID NO: 3022998 - protein, 29 aa, Entamoeba invadens
VSEPNPEFSWFEGYNWQIIVCVQCGTHVG

SEQ ID NO: 3022999 - protein, 23 aa, Entamoeba invadens
VSESGILDEYLLPGPTPMQQEKQ

SEQ ID NO: 3023000 - protein, 25 aa, Entamoeba invadens
VSESLYINPFNLPQSIPIQKIVTLF

SEQ ID NO: 3023001 - protein, 25 aa, Entamoeba invadens
VSESVKFFLQIVSALEYIHRWQICH

SEQ ID NO: 3023002 - protein, 17 aa, Entamoeba invadens
VSEWFYLRTVRVEVDTR

SEQ ID NO: 3023003 - protein, 26 aa, Entamoeba invadens
VSEWMGYNLLFEGMLSSVLTARRFLK

SEQ ID NO: 3023004 - protein, 26 aa, Entamoeba invadens
VSFAVPTHIFVLEKMPLTSFGKVYAP

SEQ ID NO: 3023005 - protein, 24 aa, Entamoeba invadens
VSFDDWLCTYLKHKILLPLTRAFI

SEQ ID NO: 3023006 - protein, 17 aa, Entamoeba invadens
VSFIRLMKTHPVDPSSP

SEQ ID NO: 3023007 - protein, 18 aa, Entamoeba invadens
VSFLIITGGVGVGKSTLI

SEQ ID NO: 3023008 - protein, 27 aa, Entamoeba invadens
VSFQADLQNVLIFLLCQRCELTVRKPS

SEQ ID NO: 3023009 - protein, 19 aa, Entamoeba invadens
VSFQLPHKNVFVNDFPFIL

SEQ ID NO: 3023010 - protein, 17 aa, Entamoeba invadens
VSFQYSRCSDYFSLGCM

SEQ ID NO: 3023011 - protein, 18 aa, Entamoeba invadens
VSFRPFGNVYYVERSYER

SEQ ID NO: 3023012 - protein, 28 aa, Entamoeba invadens
VSGDTFVPILIYALLKANLPHLASTISF

SEQ ID NO: 3023013 - protein, 21 aa, Entamoeba invadens
VSGFQTAYDKLQRKDSKRRER

SEQ ID NO: 3023014 - protein, 29 aa, Entamoeba invadens
VSGLQCIELYKILLKKPFSCYHNSFLNLA

SEQ ID NO: 3023015 - protein, 23 aa, Entamoeba invadens
VSGMITWISLHKCQTRFEGIRKD

SEQ ID NO: 3023016 - protein, 23 aa, Entamoeba invadens
VSGRTPFHYAVLGGHLGVVKQAR

SEQ ID NO: 3023017 - protein, 19 aa, Entamoeba invadens
VSGTPGRLLTLIKKRVLAV

SEQ ID NO: 3023018 - protein, 17 aa, Entamoeba invadens
VSHFPEMNKLEKLYPQV

SEQ ID NO: 3023019 - protein, 29 aa, Entamoeba invadens
VSHFSLLRFTVIFAEQFFVTIDPKNLKQL

SEQ ID NO: 3023020 - protein, 17 aa, Entamoeba invadens
VSHIAGCVFCHASGFLA

SEQ ID NO: 3023021 - protein, 25 aa, Entamoeba invadens
VSHRFREFIWAWDGKGVRCQAKNTK

SEQ ID NO: 3023022 - protein, 19 aa, Entamoeba invadens
VSIIGWFKVSLGDYKIFAI

SEQ ID NO: 3023023 - protein, 19 aa, Entamoeba invadens
VSILSYWANTIFPLLPEEE

SEQ ID NO: 3023024 - protein, 20 aa, Entamoeba invadens
VSILYMLEDNPDGFFEKNLL

SEQ ID NO: 3023025 - protein, 30 aa, Entamoeba invadens
VSIPKSIYNFFVVNIWYPVDYSTSMCPQNK

SEQ ID NO: 3023026 - protein, 25 aa, Entamoeba invadens
VSIQYEEVFPINRCIPFTTEDGTSI

SEQ ID NO: 3023027 - protein, 31 aa, Entamoeba invadens
VSIRKIIELFPKLETLYLPFELDYDLSFLET

SEQ ID NO: 3023028 - protein, 34 aa, Entamoeba invadens
VSIVNGVLRCLLLYNYSFLFAFETTPNVLRKENL

SEQ ID NO: 3023029 - protein, 25 aa, Entamoeba invadens
VSIVNISKMKLLKRLKIDLNKQECN

SEQ ID NO: 3023030 - protein, 30 aa, Entamoeba invadens
VSIVQHLKLYKRIFTSYLDSPILVTGSSNN

SEQ ID NO: 3023031 - protein, 21 aa, Entamoeba invadens
VSKEFIGKYITIPVTVLDYQD

SEQ ID NO: 3023032 - protein, 30 aa, Entamoeba invadens
VSKGFSEIFTKLVPLGKASLVMLKKPIEEL

SEQ ID NO: 3023033 - protein, 27 aa, Entamoeba invadens
VSKGFYEMMYLLGENFPLKGFTGYNGG

SEQ ID NO: 3023034 - protein, 22 aa, Entamoeba invadens
VSKKFLNAPLRYTKLSNFDKVK

SEQ ID NO: 3023035 - protein, 30 aa, Entamoeba invadens
VSKKHNLVIRIPSSKPLLIASPKPTQTSRT

SEQ ID NO: 3023036 - protein, 25 aa, Entamoeba invadens
VSKKKLCLIVWFEVDFETIDRIQSR

SEQ ID NO: 3023037 - protein, 25 aa, Entamoeba invadens
VSKKTALLKTFRRAFFGYDCFFTEL

SEQ ID NO: 3023038 - protein, 27 aa, Entamoeba invadens
VSKKTTAHWKFLHSYLSHRDCVFDIAC

SEQ ID NO: 3023039 - protein, 25 aa, Entamoeba invadens
VSKRMHLYVMNSLDLWQTFYDLYFN

SEQ ID NO: 3023040 - protein, 20 aa, Entamoeba invadens
VSKVMYWYAAIGLADQYVTL

SEQ ID NO: 3023041 - protein, 17 aa, Entamoeba invadens
VSLFKKGIKPIWEDDMN

SEQ ID NO: 3023042 - protein, 17 aa, Entamoeba invadens
VSLIINSSSLPYTFLLD

SEQ ID NO: 3023043 - protein, 23 aa, Entamoeba invadens
VSLIQMYNTYYLYYRNVIQTVEI

SEQ ID NO: 3023044 - protein, 19 aa, Entamoeba invadens
VSLKEVSYSYPFVTFRCFD

SEQ ID NO: 3023045 - protein, 20 aa, Entamoeba invadens
VSLLVSTRLFQILKENCFQT

SEQ ID NO: 3023046 - protein, 18 aa, Entamoeba invadens
VSLMELIFRSMTENRTFS

SEQ ID NO: 3023047 - protein, 17 aa, Entamoeba invadens
VSLNNLWMRGNSAIVAK

SEQ ID NO: 3023048 - protein, 25 aa, Entamoeba invadens
VSLQEMMIELIILDILITSTEYHPD

SEQ ID NO: 3023049 - protein, 18 aa, Entamoeba invadens
VSLSAFSFLFGEYIHHEF

SEQ ID NO: 3023050 - protein, 22 aa, Entamoeba invadens
VSLSIPKYLYRDNITYTGRYEK

SEQ ID NO: 3023051 - protein, 17 aa, Entamoeba invadens
VSLSKFALPQNVSCEGS

SEQ ID NO: 3023052 - protein, 23 aa, Entamoeba invadens
VSLSKFLIICNALEWVIERTQHL

SEQ ID NO: 3023053 - protein, 20 aa, Entamoeba invadens
VSLTLKLLTIPDIPPQQILY

SEQ ID NO: 3023054 - protein, 18 aa, Entamoeba invadens
VSMFPNDFNLICVGTTDG

SEQ ID NO: 3023055 - protein, 24 aa, Entamoeba invadens
VSMIGQFGVGFYSSYLVAEKVTVI

SEQ ID NO: 3023056 - protein, 19 aa, Entamoeba invadens
VSMIILEQMKIKKDWRRFD

SEQ ID NO: 3023057 - protein, 31 aa, Entamoeba invadens
VSMLDKFRSDYIIYFYGAVFIPSKVCMATEF

SEQ ID NO: 3023058 - protein, 20 aa, Entamoeba invadens
VSMLHLFRLLKNEQPLVFVI

SEQ ID NO: 3023059 - protein, 20 aa, Entamoeba invadens
VSMLYKFRCDYIVHFYGAVF

SEQ ID NO: 3023060 - protein, 22 aa, Entamoeba invadens
VSMVCKFFTVFPGDFYVSERGG

SEQ ID NO: 3023061 - protein, 17 aa, Entamoeba invadens
VSMVWYIEEFVGEESKK

SEQ ID NO: 3023062 - protein, 28 aa, Entamoeba invadens
VSMWEIPKAFFLVDAHRRYFDAAFRRVS

SEQ ID NO: 3023063 - protein, 23 aa, Entamoeba invadens
VSNDGVIVDAGAWKNIHVSFKKV

SEQ ID NO: 3023064 - protein, 23 aa, Entamoeba invadens
VSNEFGPLKLILGTSHILIIAHP

SEQ ID NO: 3023065 - protein, 32 aa, Entamoeba invadens
VSNKNVGYLFVFPSRVWDYFKEKMRMEIKVKG

SEQ ID NO: 3023066 - protein, 19 aa, Entamoeba invadens
VSNLKQWIEKYNPIKVESV

SEQ ID NO: 3023067 - protein, 36 aa, Entamoeba invadens
VSNNPFFRQILGSPLGIQALLYCIKYGLTLVVPLNP

SEQ ID NO: 3023068 - protein, 28 aa, Entamoeba invadens
VSNTVSHVFLVNGNIWVVKKTEGGKSTI

SEQ ID NO: 3023069 - protein, 22 aa, Entamoeba invadens
VSPEYIVFPIDDADFTLRNDTK

SEQ ID NO: 3023070 - protein, 22 aa, Entamoeba invadens
VSPKVFLIKNVMERGMSLVSSF

SEQ ID NO: 3023071 - protein, 18 aa, Entamoeba invadens
VSPLFTHSKLWKLYFEIA

SEQ ID NO: 3023072 - protein, 26 aa, Entamoeba invadens
VSPQKKFVIPFTAQPSEQIPQPTEQK

SEQ ID NO: 3023073 - protein, 22 aa, Entamoeba invadens
VSPQNVFLRDPSSFFPTICTNK

SEQ ID NO: 3023074 - protein, 18 aa, Entamoeba invadens
VSPQQIVDFLFFEKHQTD

SEQ ID NO: 3023075 - protein, 17 aa, Entamoeba invadens
VSPSFRGVVTLPGHNFE

SEQ ID NO: 3023076 - protein, 25 aa, Entamoeba invadens
VSPTSQKRLCLYKLPYFFSEMNQQI

SEQ ID NO: 3023077 - protein, 19 aa, Entamoeba invadens
VSPYLGNYFTLYSIICLLH

SEQ ID NO: 3023078 - protein, 24 aa, Entamoeba invadens
VSQADLCILTLPLNIPEEKKSSIK

SEQ ID NO: 3023079 - protein, 29 aa, Entamoeba invadens
VSQAVLLQKLKINPFRYGAVIDTIYDNGV

SEQ ID NO: 3023080 - protein, 17 aa, Entamoeba invadens
VSQISLRRLGQVIQWGF

SEQ ID NO: 3023081 - protein, 17 aa, Entamoeba invadens
VSQLPLSIHVPALIDVG

SEQ ID NO: 3023082 - protein, 28 aa, Entamoeba invadens
VSQLYHRQWELFEFIVNSYRDEWILRDD

SEQ ID NO: 3023083 - protein, 25 aa, Entamoeba invadens
VSQSLTLWWNVMQNMPHLWEITDAE

SEQ ID NO: 3023084 - protein, 17 aa, Entamoeba invadens
VSQWAYNCKIPANYLIQ

SEQ ID NO: 3023085 - protein, 22 aa, Entamoeba invadens
VSQYFLTIIDFINLEFVSKKYE

SEQ ID NO: 3023086 - protein, 24 aa, Entamoeba invadens
VSRCASMFETLNRWLYSPNSLTKT

SEQ ID NO: 3023087 - protein, 33 aa, Entamoeba invadens
VSRCVKAMPEAREPRYVISIKEYARFVAGKSAK

SEQ ID NO: 3023088 - protein, 25 aa, Entamoeba invadens
VSRGASYFPFKGVSLAVVVFNSQDD

SEQ ID NO: 3023089 - protein, 27 aa, Entamoeba invadens
VSRLEEFIRHVWPSSRFYIVEIITLLC

SEQ ID NO: 3023090 - protein, 20 aa, Entamoeba invadens
VSRLRVLLISGKLDPHSKLR

SEQ ID NO: 3023091 - protein, 19 aa, Entamoeba invadens
VSRNWYKTPSLWVGEEVDS

SEQ ID NO: 3023092 - protein, 26 aa, Entamoeba invadens
VSRPTAQNFFFLFTDRLIGCNVKKMK

SEQ ID NO: 3023093 - protein, 26 aa, Entamoeba invadens
VSRQYKTLLIMFKSNPVPLTSKTLSL

SEQ ID NO: 3023094 - protein, 22 aa, Entamoeba invadens
VSRRHPYLFSAGDDRDVRCWDL

SEQ ID NO: 3023095 - protein, 17 aa, Entamoeba invadens
VSRTYHFKVPSERMKRV

SEQ ID NO: 3023096 - protein, 25 aa, Entamoeba invadens
VSRTYVQMFCPKLVDMFVGAYRACH

SEQ ID NO: 3023097 - protein, 22 aa, Entamoeba invadens
VSRVLMGWGVQYITFVDNGTIS

SEQ ID NO: 3023098 - protein, 24 aa, Entamoeba invadens
VSSCLICSMGYYPLSGTCVACSAT

SEQ ID NO: 3023099 - protein, 25 aa, Entamoeba invadens
VSSCLICSMGYYPLSGTCVACSATC

SEQ ID NO: 3023100 - protein, 26 aa, Entamoeba invadens
VSSCVLLRSLLLNILFDKSGGNAMQQ

SEQ ID NO: 3023101 - protein, 45 aa, Entamoeba invadens
VSSIIEIYVVVDIRGWALGYVFDRFAFAQVLPYVNLKVSIESQLP

SEQ ID NO: 3023102 - protein, 25 aa, Entamoeba invadens
VSSLEEDGQGWYYFKTDADYPGNNK

SEQ ID NO: 3023103 - protein, 23 aa, Entamoeba invadens
VSSLFYPLLTLREQESDNFKVVF

SEQ ID NO: 3023104 - protein, 17 aa, Entamoeba invadens
VSSNATIKLLKKTKQKA

SEQ ID NO: 3023105 - protein, 29 aa, Entamoeba invadens
VSSNKDGLLLLFPLIGKPIPTTLDKIETK

SEQ ID NO: 3023106 - protein, 25 aa, Entamoeba invadens
VSSVLPTLLSLMPPAAQMVGNYKNI

SEQ ID NO: 3023107 - protein, 28 aa, Entamoeba invadens
VSTAKSPIACLAAFVKRAWAKDVKLEPE

SEQ ID NO: 3023108 - protein, 22 aa, Entamoeba invadens
VSTFESFIFDRPAPVIYEILKQ

SEQ ID NO: 3023109 - protein, 17 aa, Entamoeba invadens
VSTKLINFLPSSVDEMK

SEQ ID NO: 3023110 - protein, 31 aa, Entamoeba invadens
VSTPLRTDVAFWFIVHSCLIKIPPANSPFIL

SEQ ID NO: 3023111 - protein, 17 aa, Entamoeba invadens
VSTPLYSPPECSLMSTL

SEQ ID NO: 3023112 - protein, 17 aa, Entamoeba invadens
VSVDDIDWLVKNTTIYP

SEQ ID NO: 3023113 - protein, 24 aa, Entamoeba invadens
VSVDDWMLICFKYCTKIIVENALK

SEQ ID NO: 3023114 - protein, 25 aa, Entamoeba invadens
VSVDSSHFLFTFSNKFNTGHVKFPV

SEQ ID NO: 3023115 - protein, 24 aa, Entamoeba invadens
VSVEDSVFGVCLYEKVLRTSTNVD

SEQ ID NO: 3023116 - protein, 26 aa, Entamoeba invadens
VSVEFLKAIVLPGIGFIGVADDKVVD

SEQ ID NO: 3023117 - protein, 26 aa, Entamoeba invadens
VSVEQYFLDLIYTVTQTTPLLLTRKN

SEQ ID NO: 3023118 - protein, 24 aa, Entamoeba invadens
VSVERYFDLIKQLMKLNMPIGNVF

SEQ ID NO: 3023119 - protein, 17 aa, Entamoeba invadens
VSVKVRLLLKESGVFHE

SEQ ID NO: 3023120 - protein, 24 aa, Entamoeba invadens
VSVQSMKMFPDKAGLVYGGNDGRA

SEQ ID NO: 3023121 - protein, 24 aa, Entamoeba invadens
VSVRIFSTALFTVLADGAGWGMPS

SEQ ID NO: 3023122 - protein, 19 aa, Entamoeba invadens
VSVSFKYFNRKISAFVSDC

SEQ ID NO: 3023123 - protein, 25 aa, Entamoeba invadens
VSVSPLLRFEILGLSGKYVLGNLPE

SEQ ID NO: 3023124 - protein, 20 aa, Entamoeba invadens
VSVTFSAFYTLAVVFSPEGV

SEQ ID NO: 3023125 - protein, 26 aa, Entamoeba invadens
VSVTQRVIGKCYLIFHRPSHITTVRT

SEQ ID NO: 3023126 - protein, 19 aa, Entamoeba invadens
VSVTSLHVNPWFSDRNDIT

SEQ ID NO: 3023127 - protein, 24 aa, Entamoeba invadens
VSVVSSVVLFLIDSHYRTIKGVVE

SEQ ID NO: 3023128 - protein, 24 aa, Entamoeba invadens
VSVVVRPFLYDVTNVYIPFLKIPK

SEQ ID NO: 3023129 - protein, 30 aa, Entamoeba invadens
VSYAFYLQMKAFGYTFYNVNYYTIDYDLYG

SEQ ID NO: 3023130 - protein, 29 aa, Entamoeba invadens
VSYAFYLQMKAFGYTFYNVNYYTSDYDLY

SEQ ID NO: 3023131 - protein, 25 aa, Entamoeba invadens
VSYKKVLSGLLWKPNGIVKGPLDVG

SEQ ID NO: 3023132 - protein, 17 aa, Entamoeba invadens
VSYTPKGILVGEAARRR

SEQ ID NO: 3023133 - protein, 18 aa, Entamoeba invadens
VSYVWFKAVKEIGDFCFA

SEQ ID NO: 3023134 - protein, 23 aa, Entamoeba invadens
VTAEFKFLFEVFQMEVDGRKGIN

SEQ ID NO: 3023135 - protein, 17 aa, Entamoeba invadens
VTAFLTHPAVSTPFLTI

SEQ ID NO: 3023136 - protein, 26 aa, Entamoeba invadens
VTAFMQTYLFDFCEQLGFVFDSKRSK

SEQ ID NO: 3023137 - protein, 25 aa, Entamoeba invadens
VTAKEIIHEVFALQQKKALVEMDNS

SEQ ID NO: 3023138 - protein, 20 aa, Entamoeba invadens
VTAKLLSMRAFKKKLQRLEN

SEQ ID NO: 3023139 - protein, 21 aa, Entamoeba invadens
VTAKMILRPQGFILTAEISDM

SEQ ID NO: 3023140 - protein, 24 aa, Entamoeba invadens
VTALSQFHSILKFEDLLKTYPVEE

SEQ ID NO: 3023141 - protein, 31 aa, Entamoeba invadens
VTALTIPVNLYFNSLIFFNNLNRISAVGGTV

SEQ ID NO: 3023142 - protein, 18 aa, Entamoeba invadens
VTALYFKDNFFDEKFFEH

SEQ ID NO: 3023143 - protein, 34 aa, Entamoeba invadens
VTAMVERVLSVSKYLIYIPEKDARMAVLLANCRL

SEQ ID NO: 3023144 - protein, 22 aa, Entamoeba invadens
VTAPKRVLLSGKSIFYRCVSLK

SEQ ID NO: 3023145 - protein, 24 aa, Entamoeba invadens
VTARGHHIAGVSQIPLVLNSKSIS

SEQ ID NO: 3023146 - protein, 23 aa, Entamoeba invadens
VTATPVYVFSYQISKFQALNDCV

SEQ ID NO: 3023147 - protein, 18 aa, Entamoeba invadens
VTCECGRHFCNGKVSNMS

SEQ ID NO: 3023148 - protein, 18 aa, Entamoeba invadens
VTCGCVMDKTLYIGTFTG

SEQ ID NO: 3023149 - protein, 17 aa, Entamoeba invadens
VTCMLGGEGYLTFMGNE

SEQ ID NO: 3023150 - protein, 17 aa, Entamoeba invadens
VTCPSNCVGDYICKDME

SEQ ID NO: 3023151 - protein, 33 aa, Entamoeba invadens
VTDEGIPFWHAPKKFPHVIPFNRNEKTCVDFIE

SEQ ID NO: 3023152 - protein, 38 aa, Entamoeba invadens
VTDHKVYQFWLQSKKWFCYPLSGILDYKITESGIFFLT

SEQ ID NO: 3023153 - protein, 26 aa, Entamoeba invadens
VTDKDFMKFGQLLGIKGHSLYTEKSK

SEQ ID NO: 3023154 - protein, 17 aa, Entamoeba invadens
VTDKMMRIVQTWGVLFP

SEQ ID NO: 3023155 - protein, 23 aa, Entamoeba invadens
VTDNLHVYAIRFSKEQYNLVPIV

SEQ ID NO: 3023156 - protein, 17 aa, Entamoeba invadens
VTDSIAWNVLPRSLFYK

SEQ ID NO: 3023157 - protein, 17 aa, Entamoeba invadens
VTDSIHVNPWFSNADDI

SEQ ID NO: 3023158 - protein, 26 aa, Entamoeba invadens
VTDTHYFIFTLQHKGVIKQKRYFPEK

SEQ ID NO: 3023159 - protein, 17 aa, Entamoeba invadens
VTDTSFNLTKILEKNKK

SEQ ID NO: 3023160 - protein, 26 aa, Entamoeba invadens
VTDVDDKIIFKARKNLLIAKYCKEHS

SEQ ID NO: 3023161 - protein, 23 aa, Entamoeba invadens
VTEEMLCSFFSAYPSVQKVKVIK

SEQ ID NO: 3023162 - protein, 38 aa, Entamoeba invadens
VTEEVRERFIELLAYYKRFWIEKIGTKRWSQFFVENRT

SEQ ID NO: 3023163 - protein, 27 aa, Entamoeba invadens
VTEFKTAFPSILLTLLSGLQVIVYSSK

SEQ ID NO: 3023164 - protein, 19 aa, Entamoeba invadens
VTEFSWFFAQVLQAANDQG

SEQ ID NO: 3023165 - protein, 17 aa, Entamoeba invadens
VTEGIFRVSPVFEWLKR

SEQ ID NO: 3023166 - protein, 25 aa, Entamoeba invadens
VTEKRAILQPPPKKTPQSNSQYKQT

SEQ ID NO: 3023167 - protein, 25 aa, Entamoeba invadens
VTEKSVKLLLTLPNIRKIDAKNCGI

SEQ ID NO: 3023168 - protein, 25 aa, Entamoeba invadens
VTENKLISHLLVPILFAVCGREKIS

SEQ ID NO: 3023169 - protein, 17 aa, Entamoeba invadens
VTENLTVALIGEIENIK

SEQ ID NO: 3023170 - protein, 24 aa, Entamoeba invadens
VTEPIATVLYYLDANKESAAKNFI

SEQ ID NO: 3023171 - protein, 18 aa, Entamoeba invadens
VTETPDCNLAPLTTPSLP

SEQ ID NO: 3023172 - protein, 20 aa, Entamoeba invadens
VTEYFDSYFPYKNMVGKTCQ

SEQ ID NO: 3023173 - protein, 23 aa, Entamoeba invadens
VTEYLQFLYPELDKISYAAIEAI

SEQ ID NO: 3023174 - protein, 18 aa, Entamoeba invadens
VTFDVVCTCYFMDTAFDA

SEQ ID NO: 3023175 - protein, 18 aa, Entamoeba invadens
VTFFAFVTKIMKINAVTG

SEQ ID NO: 3023176 - protein, 19 aa, Entamoeba invadens
VTFFGTVSLFLEKISLFTK

SEQ ID NO: 3023177 - protein, 18 aa, Entamoeba invadens
VTFHGQYQIYYYRLLFGC

SEQ ID NO: 3023178 - protein, 36 aa, Entamoeba invadens
VTFKRAIPKTLAMGDGFLLYLAKWENGKINTTIQET

SEQ ID NO: 3023179 - protein, 19 aa, Entamoeba invadens
VTFLHFYADFEEDSFVVTW

SEQ ID NO: 3023180 - protein, 23 aa, Entamoeba invadens
VTFLPDFHEKFCAFNRHEVLSDK

SEQ ID NO: 3023181 - protein, 18 aa, Entamoeba invadens
VTFLPSYTFSYCEKLKVV

SEQ ID NO: 3023182 - protein, 24 aa, Entamoeba invadens
VTFVLFQHYTLLQISLDTIKGFHG

SEQ ID NO: 3023183 - protein, 22 aa, Entamoeba invadens
VTGCLQCDLPIKKLSDIKAVFP

SEQ ID NO: 3023184 - protein, 30 aa, Entamoeba invadens
VTGLQNLIHMLFLYHDPLLSLHLDMYRIEP

SEQ ID NO: 3023185 - protein, 27 aa, Entamoeba invadens
VTGLREFNMFMVNGLLYVFGGEIPLTQ

SEQ ID NO: 3023186 - protein, 25 aa, Entamoeba invadens
VTGPILFLELLKIVVKELFKMVSSD

SEQ ID NO: 3023187 - protein, 19 aa, Entamoeba invadens
VTGQRVLDALFPCVQGGTC

SEQ ID NO: 3023188 - protein, 19 aa, Entamoeba invadens
VTGQSFIAIGLYSAKLYQS

SEQ ID NO: 3023189 - protein, 24 aa, Entamoeba invadens
VTHIPLKLFVSFFELVQVSDQDNL

SEQ ID NO: 3023190 - protein, 18 aa, Entamoeba invadens
VTHLKFLFDGYTISMEDT

SEQ ID NO: 3023191 - protein, 19 aa, Entamoeba invadens
VTHPSEVSSLLLSLRWKLF

SEQ ID NO: 3023192 - protein, 24 aa, Entamoeba invadens
VTHRDPHIWLRRGLFFCHRDINPI

SEQ ID NO: 3023193 - protein, 27 aa, Entamoeba invadens
VTIKKELCYLTLLPFIIPKRHQDNMVQ

SEQ ID NO: 3023194 - protein, 22 aa, Entamoeba invadens
VTIKVLLYNSPFFHDVAESGKK

SEQ ID NO: 3023195 - protein, 27 aa, Entamoeba invadens
VTINKYNGIRWIFSSRTKHLEITNSSG

SEQ ID NO: 3023196 - protein, 23 aa, Entamoeba invadens
VTIPSSVIFIGNSCFFRCSSLSI

SEQ ID NO: 3023197 - protein, 19 aa, Entamoeba invadens
VTIQIIKGGIYTLNLGASG

SEQ ID NO: 3023198 - protein, 22 aa, Entamoeba invadens
VTIRLQCITSFKTGLLKGESNS

SEQ ID NO: 3023199 - protein, 27 aa, Entamoeba invadens
VTISCNRLLEFVQRLGFTFIQRGTRST

SEQ ID NO: 3023200 - protein, 32 aa, Entamoeba invadens
VTISYDFFGFIPHILLFVRGISPFFNQTPKAQ

SEQ ID NO: 3023201 - protein, 18 aa, Entamoeba invadens
VTIWLYENTAMKIEGRIT

SEQ ID NO: 3023202 - protein, 19 aa, Entamoeba invadens
VTIWNCTHINYLNTICDCI

SEQ ID NO: 3023203 - protein, 18 aa, Entamoeba invadens
VTIWNCTHISYLNTICDC

SEQ ID NO: 3023204 - protein, 18 aa, Entamoeba invadens
VTKIGAFAFRKCASLRHV

SEQ ID NO: 3023205 - protein, 24 aa, Entamoeba invadens
VTKIGVFSFRKCVTLREIEIPKSV

SEQ ID NO: 3023206 - protein, 24 aa, Entamoeba invadens
VTKITPLLRQLSNSPPMPFDRWSL

SEQ ID NO: 3023207 - protein, 17 aa, Entamoeba invadens
VTKIYMDRLQLGQQHFA

SEQ ID NO: 3023208 - protein, 32 aa, Entamoeba invadens
VTKKEFVSRLFLFVKALLFIPDEALFDELYNL

SEQ ID NO: 3023209 - protein, 37 aa, Entamoeba invadens
VTKKKVFMKFINIGQIYKIKMIYKPFHLEIGIDDFKR

SEQ ID NO: 3023210 - protein, 17 aa, Entamoeba invadens
VTKKLDPSLLITHRFEG

SEQ ID NO: 3023211 - protein, 17 aa, Entamoeba invadens
VTKLGIFSFLRCSNLTS

SEQ ID NO: 3023212 - protein, 17 aa, Entamoeba invadens
VTKLLKTIHRLPEPKTV

SEQ ID NO: 3023213 - protein, 18 aa, Entamoeba invadens
VTKLLRSCCKCLPLSEIT

SEQ ID NO: 3023214 - protein, 44 aa, Entamoeba invadens
VTKTNFEEFIMTWGCILLLKGDFNLLPKFCLIVRKFLEEKVKNG

SEQ ID NO: 3023215 - protein, 33 aa, Entamoeba invadens
VTKTVEGIIYITFRRFVFVLWNEEKKNVVYDFP

SEQ ID NO: 3023216 - protein, 23 aa, Entamoeba invadens
VTKVKIRLRIKANTFIQFSNEGK

SEQ ID NO: 3023217 - protein, 19 aa, Entamoeba invadens
VTKYLMNPTDFINIVCVCK

SEQ ID NO: 3023218 - protein, 19 aa, Entamoeba invadens
VTLCTLSGKCPQYATSIPI

SEQ ID NO: 3023219 - protein, 25 aa, Entamoeba invadens
VTLEESEIFWLLKLVMDIMEKFYVH

SEQ ID NO: 3023220 - protein, 17 aa, Entamoeba invadens
VTLIQSFRHINIMSIIG

SEQ ID NO: 3023221 - protein, 29 aa, Entamoeba invadens
VTLITAEILFTLSKYYKQIKKFRLQMLQP

SEQ ID NO: 3023222 - protein, 22 aa, Entamoeba invadens
VTLKFLCHVSERGILQPLVNAV

SEQ ID NO: 3023223 - protein, 18 aa, Entamoeba invadens
VTLMKKYFNFCYNGNYTF

SEQ ID NO: 3023224 - protein, 17 aa, Entamoeba invadens
VTLPASVTLPSFSQREL

SEQ ID NO: 3023225 - protein, 21 aa, Entamoeba invadens
VTLPESLYQLGDYFFNYCTSL

SEQ ID NO: 3023226 - protein, 18 aa, Entamoeba invadens
VTLPFFTVKSVIFNQTDR

SEQ ID NO: 3023227 - protein, 22 aa, Entamoeba invadens
VTLPSFQPFKTFFPLVTTVNIS

SEQ ID NO: 3023228 - protein, 17 aa, Entamoeba invadens
VTLPTSIYFIKNSAFAD

SEQ ID NO: 3023229 - protein, 17 aa, Entamoeba invadens
VTLPTSLTQIPKAAFSK

SEQ ID NO: 3023230 - protein, 18 aa, Entamoeba invadens
VTLRLIKETIRMNDLKTV

SEQ ID NO: 3023231 - protein, 19 aa, Entamoeba invadens
VTLSLFLSQTAFETLVKQQ

SEQ ID NO: 3023232 - protein, 23 aa, Entamoeba invadens
VTLYYLIRCEPFSHFGIELQGGR

SEQ ID NO: 3023233 - protein, 27 aa, Entamoeba invadens
VTMASLRVPIITLFVGEGGSGGALGIA

SEQ ID NO: 3023234 - protein, 17 aa, Entamoeba invadens
VTMYNFFKHISDEISQE

SEQ ID NO: 3023235 - protein, 24 aa, Entamoeba invadens
VTNNQFVVILLQREKWSLVKIIDQ

SEQ ID NO: 3023236 - protein, 22 aa, Entamoeba invadens
VTNPFHVVLLENEPLLNHIEDE

SEQ ID NO: 3023237 - protein, 24 aa, Entamoeba invadens
VTNSKLLIHPLENCSYKSQNQRVK

SEQ ID NO: 3023238 - protein, 22 aa, Entamoeba invadens
VTNSVLYVLVNKVNAQISFRKT

SEQ ID NO: 3023239 - protein, 26 aa, Entamoeba invadens
VTNWESTWAIIQRGYKMRHTSATLSN

SEQ ID NO: 3023240 - protein, 28 aa, Entamoeba invadens
VTPLRLKIMNFVRTWLKNAWKDFEGKDE

SEQ ID NO: 3023241 - protein, 21 aa, Entamoeba invadens
VTPSVPLSLPLELTRHKKGTT

SEQ ID NO: 3023242 - protein, 20 aa, Entamoeba invadens
VTPTLIIITSLHQTLHTLNI

SEQ ID NO: 3023243 - protein, 22 aa, Entamoeba invadens
VTQGQAWIVVKIIDENWVIGRR

SEQ ID NO: 3023244 - protein, 19 aa, Entamoeba invadens
VTQKKSMQIKKKKTLKTNS

SEQ ID NO: 3023245 - protein, 24 aa, Entamoeba invadens
VTQTTYKYVFKKISIYKNLQIVSL

SEQ ID NO: 3023246 - protein, 18 aa, Entamoeba invadens
VTQYRRYQILAIKQRFPE

SEQ ID NO: 3023247 - protein, 24 aa, Entamoeba invadens
VTRINHKTFYYCKIEEIELPNGVK

SEQ ID NO: 3023248 - protein, 20 aa, Entamoeba invadens
VTRPLMTYNNQIPLQCVDYR

SEQ ID NO: 3023249 - protein, 25 aa, Entamoeba invadens
VTRVTPIYPQLIAVKYICAVCQARL

SEQ ID NO: 3023250 - protein, 20 aa, Entamoeba invadens
VTRVWEKVKFLGSGGFGTVF

SEQ ID NO: 3023251 - protein, 30 aa, Entamoeba invadens
VTSDMKYIVLACDGLWDGINAEKVKEVLET

SEQ ID NO: 3023252 - protein, 22 aa, Entamoeba invadens
VTSFTTRRPATLTLGICLCDVE

SEQ ID NO: 3023253 - protein, 17 aa, Entamoeba invadens
VTSGMVVRPLLLVEGAL

SEQ ID NO: 3023254 - protein, 26 aa, Entamoeba invadens
VTSIDKFAFMGCPLTSIVLSKNLHSL

SEQ ID NO: 3023255 - protein, 24 aa, Entamoeba invadens
VTSIDSFCFFKCANLSYLTTPSNV

SEQ ID NO: 3023256 - protein, 24 aa, Entamoeba invadens
VTSKVLNFIRLLSSAKDILSKLPT

SEQ ID NO: 3023257 - protein, 29 aa, Entamoeba invadens
VTSLWGLQEMYIFLPSILAPKDYQDLLLS

SEQ ID NO: 3023258 - protein, 27 aa, Entamoeba invadens
VTSPFPIHYTMRRWLCGVLSNKLSRSE

SEQ ID NO: 3023259 - protein, 25 aa, Entamoeba invadens
VTTALDAFPVYRLQKLFLQLDENDI

SEQ ID NO: 3023260 - protein, 27 aa, Entamoeba invadens
VTTATLNIVQVFWGLDKKLAQRKHFPS

SEQ ID NO: 3023261 - protein, 30 aa, Entamoeba invadens
VTTCITVDGKPFRLAIWAGQEKYRSMVSMY

SEQ ID NO: 3023262 - protein, 20 aa, Entamoeba invadens
VTTFLINQIFTRVVSRPEES

SEQ ID NO: 3023263 - protein, 39 aa, Entamoeba invadens
VTTKTQKLLKFKWIDPFNELGFYLFGAGVISIIQNLPKE

SEQ ID NO: 3023264 - protein, 29 aa, Entamoeba invadens
VTTLCSLITTFLVSFLPKTLPTQPIVNDP

SEQ ID NO: 3023265 - protein, 19 aa, Entamoeba invadens
VTTLDGCFEPLMSALHAYE

SEQ ID NO: 3023266 - protein, 17 aa, Entamoeba invadens
VTTLMIGTLFPTSFATD

SEQ ID NO: 3023267 - protein, 25 aa, Entamoeba invadens
VTTNTFLWDVFLDSLNLIFFEFQVT

SEQ ID NO: 3023268 - protein, 24 aa, Entamoeba invadens
VTTPDKLLELLGVLFDPNVPEGMQ

SEQ ID NO: 3023269 - protein, 26 aa, Entamoeba invadens
VTTPERLLDLIGILFDPVIPEGMDWD

SEQ ID NO: 3023270 - protein, 26 aa, Entamoeba invadens
VTVETLTSFFSFTGKVVEVRLSKVDE

SEQ ID NO: 3023271 - protein, 19 aa, Entamoeba invadens
VTVFAFPQQITKKTKHPSN

SEQ ID NO: 3023272 - protein, 25 aa, Entamoeba invadens
VTVLKQGFMTFIDKLKIECTNKLVD

SEQ ID NO: 3023273 - protein, 27 aa, Entamoeba invadens
VTVPLDTPLLWLALNMSGSDMFLHIVV

SEQ ID NO: 3023274 - protein, 26 aa, Entamoeba invadens
VTVSYIQYLMIHLMSLKEGKGSEYTV

SEQ ID NO: 3023275 - protein, 19 aa, Entamoeba invadens
VTVTYPEEKWLTAVNPDKV

SEQ ID NO: 3023276 - protein, 20 aa, Entamoeba invadens
VTVYIKSGYYPLINNSIEIT

SEQ ID NO: 3023277 - protein, 27 aa, Entamoeba invadens
VTVYIKSGYYPLINNSLKFTKWSFKNS

SEQ ID NO: 3023278 - protein, 19 aa, Entamoeba invadens
VTVYYNCSIYKAKVLLVFP

SEQ ID NO: 3023279 - protein, 23 aa, Entamoeba invadens
VTWSILTEKIRWKKDVKFPVRHV

SEQ ID NO: 3023280 - protein, 25 aa, Entamoeba invadens
VTYHVPQSFMKMSSWIGLYDKYEMD

SEQ ID NO: 3023281 - protein, 19 aa, Entamoeba invadens
VTYPYQRYAVWYGGSVMAE

SEQ ID NO: 3023282 - protein, 19 aa, Entamoeba invadens
VTYSFPPSGIYKIALKDSE

SEQ ID NO: 3023283 - protein, 18 aa, Entamoeba invadens
VTYYRKGEWVFGMKDGII

SEQ ID NO: 3023284 - protein, 25 aa, Entamoeba invadens
VVAEYFGMNWGYYDDFALLESKPCR

SEQ ID NO: 3023285 - protein, 47 aa, Entamoeba invadens
VVASFIRKMLILSLEMKPPVICKILAIVNNWINVYPPLKSMFTASNY

SEQ ID NO: 3023286 - protein, 23 aa, Entamoeba invadens
VVASLLKNYLKLIPNKLISDDER

SEQ ID NO: 3023287 - protein, 24 aa, Entamoeba invadens
VVCDDLYIKIGRRCIKTQTETTKN

SEQ ID NO: 3023288 - protein, 22 aa, Entamoeba invadens
VVCFDWNVYFSTEVAIIPIDFV

SEQ ID NO: 3023289 - protein, 31 aa, Entamoeba invadens
VVCFGTSIYDDTLYFAWSSITYSLIPMINEV

SEQ ID NO: 3023290 - protein, 19 aa, Entamoeba invadens
VVCLSQRATKYLDWVVGLK

SEQ ID NO: 3023291 - protein, 30 aa, Entamoeba invadens
VVCNNTSVPLFWWWVYQDSSIPIEISPYSA

SEQ ID NO: 3023292 - protein, 23 aa, Entamoeba invadens
VVCPHIPIQFLVNILTTLKQKDE

SEQ ID NO: 3023293 - protein, 26 aa, Entamoeba invadens
VVDCMGPVFLQYATWMKMRKLDKELS

SEQ ID NO: 3023294 - protein, 25 aa, Entamoeba invadens
VVDDAVWCLVFLCEWEKYSQFLFTE

SEQ ID NO: 3023295 - protein, 17 aa, Entamoeba invadens
VVDHCSFLDNLRYVGDV

SEQ ID NO: 3023296 - protein, 23 aa, Entamoeba invadens
VVDIKPQFFTFTSPQKKTPKKQK

SEQ ID NO: 3023297 - protein, 17 aa, Entamoeba invadens
VVDIPKDKYYGYKNSCV

SEQ ID NO: 3023298 - protein, 27 aa, Entamoeba invadens
VVDISQMFLLFLFDSFTTNNNVASNVH

SEQ ID NO: 3023299 - protein, 17 aa, Entamoeba invadens
VVDLLNTLIIPERNQLD

SEQ ID NO: 3023300 - protein, 27 aa, Entamoeba invadens
VVDNLVDALLVDEQFVPKSGFDDLPKE

SEQ ID NO: 3023301 - protein, 17 aa, Entamoeba invadens
VVDPILGLKLRPHQKAG

SEQ ID NO: 3023302 - protein, 23 aa, Entamoeba invadens
VVDQPFSPPYFKTLKIKELIDST

SEQ ID NO: 3023303 - protein, 27 aa, Entamoeba invadens
VVEANAWFVAMAYTIKLAPRINESKII

SEQ ID NO: 3023304 - protein, 24 aa, Entamoeba invadens
VVEFWDGVRRELVPSTIIVVDGML

SEQ ID NO: 3023305 - protein, 19 aa, Entamoeba invadens
VVEFWKYWMDSTPQPDALE

SEQ ID NO: 3023306 - protein, 20 aa, Entamoeba invadens
VVEFWKYWMDSTPQPDALEP

SEQ ID NO: 3023307 - protein, 18 aa, Entamoeba invadens
VVEGMVLDQGYLSRYFTT

SEQ ID NO: 3023308 - protein, 26 aa, Entamoeba invadens
VVEGSFLTLFDIQLVYRLNKMDDVRL

SEQ ID NO: 3023309 - protein, 18 aa, Entamoeba invadens
VVEIFKKTPNDDAVCFCI

SEQ ID NO: 3023310 - protein, 17 aa, Entamoeba invadens
VVEIIQASGLKLADNTE

SEQ ID NO: 3023311 - protein, 30 aa, Entamoeba invadens
VVEIYSTTRYTLLQRYPLSPIKGSCKSSCW

SEQ ID NO: 3023312 - protein, 27 aa, Entamoeba invadens
VVELLFQEGLLKCLFATETFAMGLNMP

SEQ ID NO: 3023313 - protein, 19 aa, Entamoeba invadens
VVELYIRQCKNFRIGLMSK

SEQ ID NO: 3023314 - protein, 18 aa, Entamoeba invadens
VVEMKVPLIVSVETGKKW

SEQ ID NO: 3023315 - protein, 23 aa, Entamoeba invadens
VVENPPQFETTPLAPVDVPQQPV

SEQ ID NO: 3023316 - protein, 24 aa, Entamoeba invadens
VVEREEFNYNLPLKLTAFQVINKI

SEQ ID NO: 3023317 - protein, 28 aa, Entamoeba invadens
VVERVKIVKILPPNFFVIVRGGKWKEKR

SEQ ID NO: 3023318 - protein, 20 aa, Entamoeba invadens
VVESLILRVFGKNTFEVVSE

SEQ ID NO: 3023319 - protein, 29 aa, Entamoeba invadens
VVETLRHALKYDLTLRVGVDKPDFSIDVN

SEQ ID NO: 3023320 - protein, 17 aa, Entamoeba invadens
VVEVNLSFLFDSTVGYV

SEQ ID NO: 3023321 - protein, 28 aa, Entamoeba invadens
VVEWLNFHNEHPLMYPDFVIGDRDKNAD

SEQ ID NO: 3023322 - protein, 31 aa, Entamoeba invadens
VVEWLNFHNEHPLMYPDFVIGDRDKNADLHP

SEQ ID NO: 3023323 - protein, 25 aa, Entamoeba invadens
VVFDSTRTPLFSNIIFSLVTGREKV

SEQ ID NO: 3023324 - protein, 28 aa, Entamoeba invadens
VVFEKEFFRIIIWFNVDFETVDRNKSRN

SEQ ID NO: 3023325 - protein, 20 aa, Entamoeba invadens
VVFERYFCQPSTPYNRLSEI

SEQ ID NO: 3023326 - protein, 30 aa, Entamoeba invadens
VVFESSVFGIFFTLQSFAVKYIPKKCQPTL

SEQ ID NO: 3023327 - protein, 25 aa, Entamoeba invadens
VVFGKIILHPLFIDTQFVYTFDIDK

SEQ ID NO: 3023328 - protein, 18 aa, Entamoeba invadens
VVFIGDSSVGKTCIIGRF

SEQ ID NO: 3023329 - protein, 18 aa, Entamoeba invadens
VVFKNSKLYKEVFLVWTD

SEQ ID NO: 3023330 - protein, 20 aa, Entamoeba invadens
VVFKQLLKRECSVGLLKRFS

SEQ ID NO: 3023331 - protein, 20 aa, Entamoeba invadens
VVFMKWRRGSTRNSGNLKRI

SEQ ID NO: 3023332 - protein, 29 aa, Entamoeba invadens
VVFTSNKLKPLIGIPLEPKFNVLQSEKFV

SEQ ID NO: 3023333 - protein, 23 aa, Entamoeba invadens
VVFTVILGTIHPTKISVSFNNAT

SEQ ID NO: 3023334 - protein, 28 aa, Entamoeba invadens
VVFVLERTQYFVPVLKDIKKNGILVISE

SEQ ID NO: 3023335 - protein, 24 aa, Entamoeba invadens
VVGGKIEGFLPLTKTAFVSWGEKV

SEQ ID NO: 3023336 - protein, 23 aa, Entamoeba invadens
VVGKPMLVPMNQSLYMNGTIDSY

SEQ ID NO: 3023337 - protein, 27 aa, Entamoeba invadens
VVGLNFERFVFRGLSCQFDEAGLLDAT

SEQ ID NO: 3023338 - protein, 18 aa, Entamoeba invadens
VVGLWSCDVLILSLTGCI

SEQ ID NO: 3023339 - protein, 31 aa, Entamoeba invadens
VVGMKRVYKYLIYWLLNGTVCIGNFFATEKR

SEQ ID NO: 3023340 - protein, 19 aa, Entamoeba invadens
VVGSLYHIAPEQLLDHCYR

SEQ ID NO: 3023341 - protein, 18 aa, Entamoeba invadens
VVGVPKTLIKMIGCGTRE

SEQ ID NO: 3023342 - protein, 18 aa, Entamoeba invadens
VVGYLRNKGLPEVALQCV

SEQ ID NO: 3023343 - protein, 24 aa, Entamoeba invadens
VVGYRNFCNKLWNAFKFASMNFSE

SEQ ID NO: 3023344 - protein, 27 aa, Entamoeba invadens
VVHEDGIYVVYFESIQFNELVGVYSKI

SEQ ID NO: 3023345 - protein, 35 aa, Entamoeba invadens
VVHQQVVLLSLLNSQFSFLLRLPNKKSLVYDQNFS

SEQ ID NO: 3023346 - protein, 25 aa, Entamoeba invadens
VVHSTYPDLYAFFRTEMTAAIQSNN

SEQ ID NO: 3023347 - protein, 18 aa, Entamoeba invadens
VVHTYRVIINSLLIGHLS

SEQ ID NO: 3023348 - protein, 33 aa, Entamoeba invadens
VVIGHVDINWGVRSVLFLDNYLVIGGGSGSVSF

SEQ ID NO: 3023349 - protein, 19 aa, Entamoeba invadens
VVIIDFRDVLFFADFFRTS

SEQ ID NO: 3023350 - protein, 25 aa, Entamoeba invadens
VVINKEIPFINFLNGGVVTIEIEDC

SEQ ID NO: 3023351 - protein, 26 aa, Entamoeba invadens
VVINREAFMNYFIFDDLKDEFVFTKT

SEQ ID NO: 3023352 - protein, 19 aa, Entamoeba invadens
VVIPHFIKVIIGNRCLFGY

SEQ ID NO: 3023353 - protein, 18 aa, Entamoeba invadens
VVIPHFINVIIGNRCLFG

SEQ ID NO: 3023354 - protein, 23 aa, Entamoeba invadens
VVIPKLIFYNDPTVINMCHPTIE

SEQ ID NO: 3023355 - protein, 18 aa, Entamoeba invadens
VVIRPTITVPQKLPSLEE

SEQ ID NO: 3023356 - protein, 25 aa, Entamoeba invadens
VVITQQEALLWTDGRYYIQATAQLP

SEQ ID NO: 3023357 - protein, 29 aa, Entamoeba invadens
VVIVETFDTFYPEELLALVLNYLCKAAMS

SEQ ID NO: 3023358 - protein, 27 aa, Entamoeba invadens
VVIVMTQFPVYKPLYKVENFLVNGYSI

SEQ ID NO: 3023359 - protein, 25 aa, Entamoeba invadens
VVKCLVPMLEAHGIKYVIKRFRGNT

SEQ ID NO: 3023360 - protein, 28 aa, Entamoeba invadens
VVKDKEKLRFVLIVRLLIEMVEKETDLP

SEQ ID NO: 3023361 - protein, 24 aa, Entamoeba invadens
VVKDPNHFVFTLKNPFNGGVNASQ

SEQ ID NO: 3023362 - protein, 28 aa, Entamoeba invadens
VVKKTFQIPTLQVDLTPALDLIETDDEV

SEQ ID NO: 3023363 - protein, 18 aa, Entamoeba invadens
VVKLFAFFDDETRYFLVM

SEQ ID NO: 3023364 - protein, 17 aa, Entamoeba invadens
VVKLYDVFEDDKTILMV

SEQ ID NO: 3023365 - protein, 17 aa, Entamoeba invadens
VVKPEWIKSMGTKPIVF

SEQ ID NO: 3023366 - protein, 23 aa, Entamoeba invadens
VVKPHPQFMLFATQNPPNTYGGR

SEQ ID NO: 3023367 - protein, 25 aa, Entamoeba invadens
VVKPSEKMRPLYWNRVIIDMDTDKS

SEQ ID NO: 3023368 - protein, 18 aa, Entamoeba invadens
VVKQCNFVLTISSTTLVL

SEQ ID NO: 3023369 - protein, 24 aa, Entamoeba invadens
VVKVIFDMHLYAPAMLACFPMQDV

SEQ ID NO: 3023370 - protein, 22 aa, Entamoeba invadens
VVKVVLTPLLELKKIYNVLGLR

SEQ ID NO: 3023371 - protein, 28 aa, Entamoeba invadens
VVKYSLDDFIWYYLTVLSNDIERRKTFM

SEQ ID NO: 3023372 - protein, 23 aa, Entamoeba invadens
VVKYVDPISYIFGDLREEERTGL

SEQ ID NO: 3023373 - protein, 25 aa, Entamoeba invadens
VVLATTFGIVIFASYPTLKEKFTIQ

SEQ ID NO: 3023374 - protein, 20 aa, Entamoeba invadens
VVLDTGVLVYVWYGKDATPT

SEQ ID NO: 3023375 - protein, 26 aa, Entamoeba invadens
VVLEKNPLFAFILSKTLSQNIESVFD

SEQ ID NO: 3023376 - protein, 22 aa, Entamoeba invadens
VVLERVYLLNVVLFFENTEVLL

SEQ ID NO: 3023377 - protein, 33 aa, Entamoeba invadens
VVLESTLYFAPQFLMLRNLCYGKYHAADVVDQS

SEQ ID NO: 3023378 - protein, 19 aa, Entamoeba invadens
VVLFKSKFVNDLSLCAETV

SEQ ID NO: 3023379 - protein, 25 aa, Entamoeba invadens
VVLIQQWTHYITLPILIRCNHESDS

SEQ ID NO: 3023380 - protein, 36 aa, Entamoeba invadens
VVLKDISALKRLFLLFGCFFMQIPFPKETETDRTVL

SEQ ID NO: 3023381 - protein, 19 aa, Entamoeba invadens
VVLKEMVTLAYSLSQITRF

SEQ ID NO: 3023382 - protein, 28 aa, Entamoeba invadens
VVLKKEFFRIIVWFNVDFEIVDRNKSRN

SEQ ID NO: 3023383 - protein, 27 aa, Entamoeba invadens
VVLKKEFFRIIVWFNVDFETFDRNKNR

SEQ ID NO: 3023384 - protein, 27 aa, Entamoeba invadens
VVLKKEFFRIIVWFNVDFETVDRNNSR

SEQ ID NO: 3023385 - protein, 26 aa, Entamoeba invadens
VVLKKEFFRIIVWFSVNFKTVDRNKF

SEQ ID NO: 3023386 - protein, 28 aa, Entamoeba invadens
VVLKKEFYRIIVWFTVDFETVYINKSQN

SEQ ID NO: 3023387 - protein, 20 aa, Entamoeba invadens
VVLKRREGCKVEISIKPLCS

SEQ ID NO: 3023388 - protein, 19 aa, Entamoeba invadens
VVLLQLNGYISSDILPLRL

SEQ ID NO: 3023389 - protein, 27 aa, Entamoeba invadens
VVLPQISSLRKVPYAKHILVLLQNYGV

SEQ ID NO: 3023390 - protein, 18 aa, Entamoeba invadens
VVLPQLRKENRYISFMQY

SEQ ID NO: 3023391 - protein, 25 aa, Entamoeba invadens
VVLSALRVEQNFWKAKDAFRTYTKI

SEQ ID NO: 3023392 - protein, 23 aa, Entamoeba invadens
VVLSENLRVLPPSTFSRCLSLKT

SEQ ID NO: 3023393 - protein, 27 aa, Entamoeba invadens
VVLSGTYYIFLLAAETRRIIAISEALL

SEQ ID NO: 3023394 - protein, 17 aa, Entamoeba invadens
VVLTGWQISTLKKFVSI

SEQ ID NO: 3023395 - protein, 23 aa, Entamoeba invadens
VVLTLKGMGIEKVVNFPFPSQIS

SEQ ID NO: 3023396 - protein, 18 aa, Entamoeba invadens
VVLVNKKTKAWLMMNSGT

SEQ ID NO: 3023397 - protein, 24 aa, Entamoeba invadens
VVLYFSYKFLVHLLDFDYSTRKDV

SEQ ID NO: 3023398 - protein, 17 aa, Entamoeba invadens
VVMFSLTDKNSFDRIAY

SEQ ID NO: 3023399 - protein, 18 aa, Entamoeba invadens
VVMKIGFCSRNVISLLLI

SEQ ID NO: 3023400 - protein, 18 aa, Entamoeba invadens
VVMLLDYCPVSTINVLER

SEQ ID NO: 3023401 - protein, 23 aa, Entamoeba invadens
VVMNHPTILTPVYRMNVVKAEMK

SEQ ID NO: 3023402 - protein, 24 aa, Entamoeba invadens
VVMTTMFYKILPEAQFDIAIVDTN

SEQ ID NO: 3023403 - protein, 26 aa, Entamoeba invadens
VVNCVQIVRYYTIWFDIKRSNVSNKI

SEQ ID NO: 3023404 - protein, 25 aa, Entamoeba invadens
VVNDIPLTITCEVAVFICQLNTILT

SEQ ID NO: 3023405 - protein, 25 aa, Entamoeba invadens
VVNDTKHFVFWLPEGKTPMKIEPKP

SEQ ID NO: 3023406 - protein, 24 aa, Entamoeba invadens
VVNFRIKVFDYGNPIEKIIIPENA

SEQ ID NO: 3023407 - protein, 17 aa, Entamoeba invadens
VVNKALCRLYKVQMTKQ

SEQ ID NO: 3023408 - protein, 24 aa, Entamoeba invadens
VVNKQGCVILNVGTTRKPTEFCLR

SEQ ID NO: 3023409 - protein, 28 aa, Entamoeba invadens
VVNNPFNWEYSYCLPLLAITFGNKQPVN

SEQ ID NO: 3023410 - protein, 30 aa, Entamoeba invadens
VVNQFQLATNLLWAIWGFVDAALSTIEWDY

SEQ ID NO: 3023411 - protein, 29 aa, Entamoeba invadens
VVNTYVQWGRLFSLWIAYQIVREKDEERR

SEQ ID NO: 3023412 - protein, 25 aa, Entamoeba invadens
VVPHIVIYDMLFKYTDYSTYRVPFA

SEQ ID NO: 3023413 - protein, 33 aa, Entamoeba invadens
VVPHRNIIKFLDALLPIVEVFKDGLRLSIIHQI

SEQ ID NO: 3023414 - protein, 26 aa, Entamoeba invadens
VVPIEKWTMNYPLGWEKKCLVDTTSI

SEQ ID NO: 3023415 - protein, 17 aa, Entamoeba invadens
VVPIRQMDRYSLVPVSV

SEQ ID NO: 3023416 - protein, 17 aa, Entamoeba invadens
VVPISALGQGAFGLVYK

SEQ ID NO: 3023417 - protein, 21 aa, Entamoeba invadens
VVPISGLFYAIGHAPNVQFLN

SEQ ID NO: 3023418 - protein, 19 aa, Entamoeba invadens
VVPKLENMFLFGNSFGNYL

SEQ ID NO: 3023419 - protein, 18 aa, Entamoeba invadens
VVPLNPSDKFKILLSNLD

SEQ ID NO: 3023420 - protein, 22 aa, Entamoeba invadens
VVPPALPPPRKSTISIVPNTSI

SEQ ID NO: 3023421 - protein, 25 aa, Entamoeba invadens
VVPVLPPKPRRLSQNKGKTIPKMEE

SEQ ID NO: 3023422 - protein, 26 aa, Entamoeba invadens
VVQGDMGGYLPFRPNTFDGCISISAI

SEQ ID NO: 3023423 - protein, 24 aa, Entamoeba invadens
VVQHPYVFKSKLPITLVLELDDIN

SEQ ID NO: 3023424 - protein, 17 aa, Entamoeba invadens
VVQMEEELPRIEKVETV

SEQ ID NO: 3023425 - protein, 27 aa, Entamoeba invadens
VVQNTLHFTRYTGAHDPLLIANGSKVV

SEQ ID NO: 3023426 - protein, 17 aa, Entamoeba invadens
VVQRLFLENLNYELPDF

SEQ ID NO: 3023427 - protein, 17 aa, Entamoeba invadens
VVQRRIVPLLGQFTEAP

SEQ ID NO: 3023428 - protein, 25 aa, Entamoeba invadens
VVQRYPISMVVGKKYKRMMLYICND

SEQ ID NO: 3023429 - protein, 17 aa, Entamoeba invadens
VVQSHRYAPLPQDEDMC

SEQ ID NO: 3023430 - protein, 17 aa, Entamoeba invadens
VVQTMYNTAYYFKNWAV

SEQ ID NO: 3023431 - protein, 25 aa, Entamoeba invadens
VVQVSLTEFALKLTLIFNILVLHSN

SEQ ID NO: 3023432 - protein, 29 aa, Entamoeba invadens
VVRDFYHHLIIYRITLAWVRDIYNKTIPK

SEQ ID NO: 3023433 - protein, 21 aa, Entamoeba invadens
VVRGLNSIWAVYTNQIFVLDI

SEQ ID NO: 3023434 - protein, 29 aa, Entamoeba invadens
VVRGRKCVGLPLLFRQYKKETTADTLAVW

SEQ ID NO: 3023435 - protein, 21 aa, Entamoeba invadens
VVRQYIFLFEDPTASTPQKKD

SEQ ID NO: 3023436 - protein, 26 aa, Entamoeba invadens
VVRSLMFLCRVIWKKEYLESASKQSK

SEQ ID NO: 3023437 - protein, 24 aa, Entamoeba invadens
VVRTKRDLRRKLKKLRMRKAQIEK

SEQ ID NO: 3023438 - protein, 31 aa, Entamoeba invadens
VVRTLSEAHVTIFPCFWDKEEQIAIVEEKPE

SEQ ID NO: 3023439 - protein, 28 aa, Entamoeba invadens
VVSCKNKLIFIFRVNGDIFGFYQDELVQ

SEQ ID NO: 3023440 - protein, 25 aa, Entamoeba invadens
VVSDSLVFFHPAIKSLFGGSTKIGN

SEQ ID NO: 3023441 - protein, 24 aa, Entamoeba invadens
VVSFDFMTIHFTASPMRVLNKSGE

SEQ ID NO: 3023442 - protein, 31 aa, Entamoeba invadens
VVSGLQCIELYKILLKKPFSCYHNSFLNLAI

SEQ ID NO: 3023443 - protein, 28 aa, Entamoeba invadens
VVSGLQCIELYKILLKKPLESYHNSFLN

SEQ ID NO: 3023444 - protein, 29 aa, Entamoeba invadens
VVSIAFGLFPIIFIGKGYGLYRLDVLSGK

SEQ ID NO: 3023445 - protein, 17 aa, Entamoeba invadens
VVSIWIHDIISINQMPL

SEQ ID NO: 3023446 - protein, 33 aa, Entamoeba invadens
VVSKFNILEFYQINTEGLLFLVSKRYPSKIEVL

SEQ ID NO: 3023447 - protein, 17 aa, Entamoeba invadens
VVSKYFQTRRDFFSYVL

SEQ ID NO: 3023448 - protein, 18 aa, Entamoeba invadens
VVSPIIVFNSPKVFKRCC

SEQ ID NO: 3023449 - protein, 25 aa, Entamoeba invadens
VVSPKIALDKLTYGRGLTLPQAKSR

SEQ ID NO: 3023450 - protein, 31 aa, Entamoeba invadens
VVSPSEILLLHPKLFLPFMRTKFGGEILVRG

SEQ ID NO: 3023451 - protein, 24 aa, Entamoeba invadens
VVSQHPPPYFIRLGTRSAKDAFSP

SEQ ID NO: 3023452 - protein, 17 aa, Entamoeba invadens
VVSQYFSSLYDFIVFEN

SEQ ID NO: 3023453 - protein, 25 aa, Entamoeba invadens
VVSRPTLFLLLEKCKTLFRSEKNMI

SEQ ID NO: 3023454 - protein, 27 aa, Entamoeba invadens
VVSVKGNGWVKVLWNPDGQPNRYRWGV

SEQ ID NO: 3023455 - protein, 26 aa, Entamoeba invadens
VVSYEFYLQMKAFGFTFHNVNLTYKD

SEQ ID NO: 3023456 - protein, 20 aa, Entamoeba invadens
VVTHIILILEKCYSLFNFDA

SEQ ID NO: 3023457 - protein, 19 aa, Entamoeba invadens
VVTIVPYLPSFEDVITLKL

SEQ ID NO: 3023458 - protein, 27 aa, Entamoeba invadens
VVTKIPAKIPFIKKVAKPIYKTAKGCE

SEQ ID NO: 3023459 - protein, 24 aa, Entamoeba invadens
VVTKMFYRIVVWVNVDYTTSKNNY

SEQ ID NO: 3023460 - protein, 27 aa, Entamoeba invadens
VVTKSFYQIVVWFHVYYPTVDQYKNLN

SEQ ID NO: 3023461 - protein, 20 aa, Entamoeba invadens
VVTLLLPKKEFFIGEDIDFH

SEQ ID NO: 3023462 - protein, 19 aa, Entamoeba invadens
VVTLPVVRNLLIGFNDVVN

SEQ ID NO: 3023463 - protein, 20 aa, Entamoeba invadens
VVTVLFPTPEVFTEKLNEEL

SEQ ID NO: 3023464 - protein, 20 aa, Entamoeba invadens
VVVFTNFLCKASLICKMKFS

SEQ ID NO: 3023465 - protein, 27 aa, Entamoeba invadens
VVVGLLDKFLAIPSETMLSFLFQFINS

SEQ ID NO: 3023466 - protein, 21 aa, Entamoeba invadens
VVVHPNWILDSIKFGTKQSTD

SEQ ID NO: 3023467 - protein, 24 aa, Entamoeba invadens
VVVKALFFLVGCKCQFIFNDTVIS

SEQ ID NO: 3023468 - protein, 23 aa, Entamoeba invadens
VVVKQSIFTLTITSPHRIDGTIE

SEQ ID NO: 3023469 - protein, 25 aa, Entamoeba invadens
VVVKTKQVIIVASYADYMTQDQCSL

SEQ ID NO: 3023470 - protein, 26 aa, Entamoeba invadens
VVVSCDCFCDTTVTLIPFERRWVLFD

SEQ ID NO: 3023471 - protein, 18 aa, Entamoeba invadens
VVVSGYFSFLKHVKEVLQ

SEQ ID NO: 3023472 - protein, 24 aa, Entamoeba invadens
VVVSNRKHLLFFESVLSGSCLPLC

SEQ ID NO: 3023473 - protein, 17 aa, Entamoeba invadens
VVVVKEAKPKELKDKHK

SEQ ID NO: 3023474 - protein, 20 aa, Entamoeba invadens
VVVYMQLLVELLSEKGTNFK

SEQ ID NO: 3023475 - protein, 24 aa, Entamoeba invadens
VVWEESIILLPNNVHYVFLSATIP

SEQ ID NO: 3023476 - protein, 27 aa, Entamoeba invadens
VVWGIEVVTFLLCEYSHLFPTEVDENV

SEQ ID NO: 3023477 - protein, 21 aa, Entamoeba invadens
VVYELSQMYVFMRSNEYQTSP

SEQ ID NO: 3023478 - protein, 17 aa, Entamoeba invadens
VVYKNYLKRRSANDIVA

SEQ ID NO: 3023479 - protein, 18 aa, Entamoeba invadens
VVYLYDKRSLLSDELIGS

SEQ ID NO: 3023480 - protein, 17 aa, Entamoeba invadens
VVYNKQTLFYNTSSGVV

SEQ ID NO: 3023481 - protein, 23 aa, Entamoeba invadens
VVYNYIIDTYQFIRKYFTPDFEG

SEQ ID NO: 3023482 - protein, 23 aa, Entamoeba invadens
VVYPLRDVALKQYLSEVIALEGA

SEQ ID NO: 3023483 - protein, 27 aa, Entamoeba invadens
VVYSTHSMFICFAMLYLGSDANTKKQL

SEQ ID NO: 3023484 - protein, 27 aa, Entamoeba invadens
VVYVNEERYIFPSSYLSLLSESDKKIK

SEQ ID NO: 3023485 - protein, 20 aa, Entamoeba invadens
VWEPALIKLNAVAAATEAAG

SEQ ID NO: 3023486 - protein, 27 aa, Entamoeba invadens
VWGAGIVFATLIFRQSKALPLWRGATN

SEQ ID NO: 3023487 - protein, 19 aa, Entamoeba invadens
VWHPNCFVCSKCGTPLEGD

SEQ ID NO: 3023488 - protein, 17 aa, Entamoeba invadens
VWIGENIGLFGAKTKSH

SEQ ID NO: 3023489 - protein, 18 aa, Entamoeba invadens
VWIVMDDDCQVKLTDFGI

SEQ ID NO: 3023490 - protein, 21 aa, Entamoeba invadens
VWNVTLNYLQLGRQNYFILRF

SEQ ID NO: 3023491 - protein, 19 aa, Entamoeba invadens
VWPSSLLQNLLTITKKYEK

SEQ ID NO: 3023492 - protein, 23 aa, Entamoeba invadens
VWSGQLMIVNTYFIGAKTVCMTK

SEQ ID NO: 3023493 - protein, 25 aa, Entamoeba invadens
VWSIGVIYYMLIFGKHPLDDGRSDL

SEQ ID NO: 3023494 - protein, 20 aa, Entamoeba invadens
VWVDGCFDMFHWGHANVVRQ

SEQ ID NO: 3023495 - protein, 26 aa, Entamoeba invadens
VWVTDPRHFVFSLRNLQDVPGKYDAE

SEQ ID NO: 3023496 - protein, 36 aa, Entamoeba invadens
VYAELTTSFPIWIGKSVRSCVLLFKAIEMGYLTLVE

SEQ ID NO: 3023497 - protein, 25 aa, Entamoeba invadens
VYALSYIMWQTFTQKDLYPEYDDFD

SEQ ID NO: 3023498 - protein, 20 aa, Entamoeba invadens
VYAQPKMTPIPPVEPEKRVP

SEQ ID NO: 3023499 - protein, 18 aa, Entamoeba invadens
VYDFGDLAWLEKNCMVYP

SEQ ID NO: 3023500 - protein, 19 aa, Entamoeba invadens
VYDIMYTFMNTRYKHYDFI

SEQ ID NO: 3023501 - protein, 20 aa, Entamoeba invadens
VYDLSLLHLPKCVKSLLLKN

SEQ ID NO: 3023502 - protein, 19 aa, Entamoeba invadens
VYDPLPYIKIESAAPPVVT

SEQ ID NO: 3023503 - protein, 26 aa, Entamoeba invadens
VYDVKYHFFAYLEQTHKYYSVWMGFE

SEQ ID NO: 3023504 - protein, 19 aa, Entamoeba invadens
VYEETFLKIFKIICVKESS

SEQ ID NO: 3023505 - protein, 27 aa, Entamoeba invadens
VYEHLPVDFLFPRLVDSTFFVGTSEGR

SEQ ID NO: 3023506 - protein, 17 aa, Entamoeba invadens
VYEIAKTCDLLMVILDA

SEQ ID NO: 3023507 - protein, 28 aa, Entamoeba invadens
VYENSSHIFLILDYVPGGELYELIRDKG

SEQ ID NO: 3023508 - protein, 17 aa, Entamoeba invadens
VYFLATTIIFLSTETHN

SEQ ID NO: 3023509 - protein, 17 aa, Entamoeba invadens
VYFPKYPCIIPHQKVPF

SEQ ID NO: 3023510 - protein, 20 aa, Entamoeba invadens
VYGKICPQAYLLKLADEERH

SEQ ID NO: 3023511 - protein, 18 aa, Entamoeba invadens
VYGLFNKRNVVSCPNAFF

SEQ ID NO: 3023512 - protein, 19 aa, Entamoeba invadens
VYHIAPYLPFMETNDQQLD

SEQ ID NO: 3023513 - protein, 24 aa, Entamoeba invadens
VYHTDLYPRPIKEVLDYLKKHATK

SEQ ID NO: 3023514 - protein, 30 aa, Entamoeba invadens
VYHWSRQETGLFYLALRKYGANMELIARDM

SEQ ID NO: 3023515 - protein, 23 aa, Entamoeba invadens
VYIANYRIKLYRDFLIKNNFKYN

SEQ ID NO: 3023516 - protein, 17 aa, Entamoeba invadens
VYIKSGYYPLINNTLKF

SEQ ID NO: 3023517 - protein, 23 aa, Entamoeba invadens
VYIPKIVNYLSGWHYTHNVKEVI

SEQ ID NO: 3023518 - protein, 34 aa, Entamoeba invadens
VYIRNEMALLKHQDYLLFEPLDGLVGSISGMCLE

SEQ ID NO: 3023519 - protein, 18 aa, Entamoeba invadens
VYKDHHAYWSKFSDTWLL

SEQ ID NO: 3023520 - protein, 17 aa, Entamoeba invadens
VYKKLFIRIKQVELLYY

SEQ ID NO: 3023521 - protein, 28 aa, Entamoeba invadens
VYKKNCLYGLFRILQILHKESLGYTTAI

SEQ ID NO: 3023522 - protein, 24 aa, Entamoeba invadens
VYKMFPDTTCYIAQYGKPCDPEAD

SEQ ID NO: 3023523 - protein, 26 aa, Entamoeba invadens
VYKRPCGYMRYALNVIGKFDNGNDTW

SEQ ID NO: 3023524 - protein, 32 aa, Entamoeba invadens
VYKSACLIIKGIPKILFFEPKPDNKAEDVVGE

SEQ ID NO: 3023525 - protein, 31 aa, Entamoeba invadens
VYKTMENYMFLSPFNSFVYLWMNQTESVQSI

SEQ ID NO: 3023526 - protein, 19 aa, Entamoeba invadens
VYLGEFRGYKVAIKKMKEG

SEQ ID NO: 3023527 - protein, 17 aa, Entamoeba invadens
VYLLRPGEGMIYTASDV

SEQ ID NO: 3023528 - protein, 19 aa, Entamoeba invadens
VYLVVPQNVVFFGLDCFQD

SEQ ID NO: 3023529 - protein, 21 aa, Entamoeba invadens
VYMDCQLQYWNMNSFFSKEEM

SEQ ID NO: 3023530 - protein, 19 aa, Entamoeba invadens
VYMKFLPENGYLTDSGTLN

SEQ ID NO: 3023531 - protein, 28 aa, Entamoeba invadens
VYMSKMPTIWKNYIEWLYTNCEITQMRR

SEQ ID NO: 3023532 - protein, 23 aa, Entamoeba invadens
VYNNFRNYLKLDPNKTPSLFTEA

SEQ ID NO: 3023533 - protein, 25 aa, Entamoeba invadens
VYNPKLGMDQLLITPISQACASQRS

SEQ ID NO: 3023534 - protein, 18 aa, Entamoeba invadens
VYPELLNILPYTLRHEAH

SEQ ID NO: 3023535 - protein, 22 aa, Entamoeba invadens
VYPKEIVPFVNLLEKSKSIVTK

SEQ ID NO: 3023536 - protein, 25 aa, Entamoeba invadens
VYQNLDSFTYFIYLREFVNCQNFID

SEQ ID NO: 3023537 - protein, 27 aa, Entamoeba invadens
VYRAVEDVYIILITSLNSNIISDLSVL

SEQ ID NO: 3023538 - protein, 22 aa, Entamoeba invadens
VYRIARVLVPKRMRGKGFGQKL

SEQ ID NO: 3023539 - protein, 18 aa, Entamoeba invadens
VYRKTVTIGYMPIMLQSK

SEQ ID NO: 3023540 - protein, 24 aa, Entamoeba invadens
VYSFAMTMYTLFSGKKPFGGMSVS

SEQ ID NO: 3023541 - protein, 27 aa, Entamoeba invadens
VYSIRSVYKYLPYVKNYFIVTDDQVPS

SEQ ID NO: 3023542 - protein, 24 aa, Entamoeba invadens
VYSKYLRLLEKKGFFKTTSEEERA

SEQ ID NO: 3023543 - protein, 19 aa, Entamoeba invadens
VYSLGIILFEMCLSPATRS

SEQ ID NO: 3023544 - protein, 17 aa, Entamoeba invadens
VYSLNLLKEVNLGRESV

SEQ ID NO: 3023545 - protein, 28 aa, Entamoeba invadens
VYSLTYMEPFQIASLNKFLFEKQLFSKL

SEQ ID NO: 3023546 - protein, 28 aa, Entamoeba invadens
VYSMRGVYKYLPYVKNYFIVTANQVPDF

SEQ ID NO: 3023547 - protein, 24 aa, Entamoeba invadens
VYSSLPLDVFTMSNGLPPIVSNEL

SEQ ID NO: 3023548 - protein, 25 aa, Entamoeba invadens
VYSYGIVLWELVTNKVPFSECKFFT

SEQ ID NO: 3023549 - protein, 19 aa, Entamoeba invadens
VYTKKWLEDFGKKTSTMRF

SEQ ID NO: 3023550 - protein, 26 aa, Entamoeba invadens
VYTQSAKLYMRIGNAFYKQSKFTEAL

SEQ ID NO: 3023551 - protein, 22 aa, Entamoeba invadens
VYTSPFPEFKMTPFGVLNSKLS

SEQ ID NO: 3023552 - protein, 24 aa, Entamoeba invadens
VYVDGVFDLLHLGHYRLLKHARES

SEQ ID NO: 3023553 - protein, 20 aa, Entamoeba invadens
VYVDSLFDIQIHCGVVSSVV

SEQ ID NO: 3023554 - protein, 29 aa, Entamoeba invadens
VYVENLLFDICLELGFWFDSKPSRKSQKS

SEQ ID NO: 3023555 - protein, 22 aa, Entamoeba invadens
VYVGGFPTDFTCDALKSIFSVC

SEQ ID NO: 3023556 - protein, 31 aa, Entamoeba invadens
VYVISRIFEKNLEHGSFLRKLGKSLCEEHIA

SEQ ID NO: 3023557 - protein, 30 aa, Entamoeba invadens
VYVKRLNDFQTLYLPLALSLLQNDKVMKTC

SEQ ID NO: 3023558 - protein, 27 aa, Entamoeba invadens
VYVNEEKYVFPSNFLSLLTESDKKIKQ

SEQ ID NO: 3023559 - protein, 18 aa, Entamoeba invadens
VYVPLSVTFIYAYCFPKK

SEQ ID NO: 3023560 - protein, 29 aa, Entamoeba invadens
VYVPSKSGALFFPFITRDTPKKRVKEIPG

SEQ ID NO: 3023561 - protein, 20 aa, Entamoeba invadens
VYWAFNMIINGTKYNLREMC

SEQ ID NO: 3023562 - protein, 27 aa, Entamoeba invadens
VYYAEERFFYCFFQGNEYKYDIKEDAI

SEQ ID NO: 3023563 - protein, 23 aa, Entamoeba invadens
VYYFSAHWNYNCSLQIFYKCTIC

SEQ ID NO: 3023564 - protein, 17 aa, Entamoeba invadens
VYYKVSWGREYCMKGQL

SEQ ID NO: 3023565 - protein, 20 aa, Entamoeba invadens
VYYRKLLFGLGVAFATQMIQ

SEQ ID NO: 3023566 - protein, 19 aa, Entamoeba invadens
WAATVLNHLVFFNYNNEKA

SEQ ID NO: 3023567 - protein, 19 aa, Entamoeba invadens
WAEFNEEFKQLEKAKQAKL

SEQ ID NO: 3023568 - protein, 18 aa, Entamoeba invadens
WAFGVMVYFLKYGDVPYI

SEQ ID NO: 3023569 - protein, 27 aa, Entamoeba invadens
WAFRNCKALKEITLPESLKSVNEKKAF

SEQ ID NO: 3023570 - protein, 22 aa, Entamoeba invadens
WAKQVEIIFLKESPIHSLSFCH

SEQ ID NO: 3023571 - protein, 19 aa, Entamoeba invadens
WAKRIVKDYGLNVTGKDSF

SEQ ID NO: 3023572 - protein, 20 aa, Entamoeba invadens
WALGCTVLELITGNPPYYDL

SEQ ID NO: 3023573 - protein, 25 aa, Entamoeba invadens
WAPTKTIYDVILTFRTMLGDLKTEH

SEQ ID NO: 3023574 - protein, 17 aa, Entamoeba invadens
WARDRFEGLFKNDIDQI

SEQ ID NO: 3023575 - protein, 19 aa, Entamoeba invadens
WATMKKFKCFLVSAKDATN

SEQ ID NO: 3023576 - protein, 18 aa, Entamoeba invadens
WCDLNNFPHFLVSAKDAT

SEQ ID NO: 3023577 - protein, 17 aa, Entamoeba invadens
WCEAFGKEKFPLLLEYC

SEQ ID NO: 3023578 - protein, 17 aa, Entamoeba invadens
WCEAYPKDEFKFPWKIA

SEQ ID NO: 3023579 - protein, 17 aa, Entamoeba invadens
WCFGPDNNGPNIFVDVT

SEQ ID NO: 3023580 - protein, 17 aa, Entamoeba invadens
WCFNFKEIVLKEKVNYV

SEQ ID NO: 3023581 - protein, 17 aa, Entamoeba invadens
WCFVNILSILDEEEITR

SEQ ID NO: 3023582 - protein, 18 aa, Entamoeba invadens
WCGGLKYMYQHQSPITSI

SEQ ID NO: 3023583 - protein, 19 aa, Entamoeba invadens
WCKFCKKFIQNKAVTRQQH

SEQ ID NO: 3023584 - protein, 17 aa, Entamoeba invadens
WCKIPDSGLPKPDIVCF

SEQ ID NO: 3023585 - protein, 17 aa, Entamoeba invadens
WCLRCSDGDYIMNSFCV

SEQ ID NO: 3023586 - protein, 17 aa, Entamoeba invadens
WCLSLEKLRRNKMKPFT

SEQ ID NO: 3023587 - protein, 19 aa, Entamoeba invadens
WDADMLFNQFIRTATTKDK

SEQ ID NO: 3023588 - protein, 26 aa, Entamoeba invadens
WDDMEKIWHHTFYNELRIAPEEHSVL

SEQ ID NO: 3023589 - protein, 25 aa, Entamoeba invadens
WDDMEKLWYHAFYNELKTPPEDRPL

SEQ ID NO: 3023590 - protein, 35 aa, Entamoeba invadens
WDEDYTWNFPMALVTGIFIPPLTMEIGGLLNFECK

SEQ ID NO: 3023591 - protein, 24 aa, Entamoeba invadens
WDENDIMLMTPTFERAKPVERVEK

SEQ ID NO: 3023592 - protein, 26 aa, Entamoeba invadens
WDEYVKYLISLQRITPVRLIVFKEQN

SEQ ID NO: 3023593 - protein, 23 aa, Entamoeba invadens
WDGKSNMPFVLEQKKLNGDVLCS

SEQ ID NO: 3023594 - protein, 25 aa, Entamoeba invadens
WDKDLEEFILKWKNVHVVNEIVLKT

SEQ ID NO: 3023595 - protein, 20 aa, Entamoeba invadens
WDMMYAVFAAIVDRLNYGVR

SEQ ID NO: 3023596 - protein, 23 aa, Entamoeba invadens
WDQKFTRIPDRIVYGCVNISRIE

SEQ ID NO: 3023597 - protein, 17 aa, Entamoeba invadens
WDSIGKTCKLCIDGNYY

SEQ ID NO: 3023598 - protein, 23 aa, Entamoeba invadens
WDTDINMMKFFHINYVVHGDDIS

SEQ ID NO: 3023599 - protein, 19 aa, Entamoeba invadens
WDTLAVQVILEALGGKVCD

SEQ ID NO: 3023600 - protein, 29 aa, Entamoeba invadens
WDVKRIREMWLLIFKFLDHPLQVGNVETV

SEQ ID NO: 3023601 - protein, 23 aa, Entamoeba invadens
WDVQYCPLEYYMISSSYDKTARL

SEQ ID NO: 3023602 - protein, 23 aa, Entamoeba invadens
WDVSAGWWIVSIKGSSAVPYPIN

SEQ ID NO: 3023603 - protein, 17 aa, Entamoeba invadens
WDVVQRKKKEKASQGTT

SEQ ID NO: 3023604 - protein, 19 aa, Entamoeba invadens
WEAFTQHLHLPVVTGFDQF

SEQ ID NO: 3023605 - protein, 18 aa, Entamoeba invadens
WEDYFMSTIFEVKEISET

SEQ ID NO: 3023606 - protein, 19 aa, Entamoeba invadens
WEELLDIYLQKNKIHRIKE

SEQ ID NO: 3023607 - protein, 20 aa, Entamoeba invadens
WEKFSYLEATWILEKEVCAE

SEQ ID NO: 3023608 - protein, 35 aa, Entamoeba invadens
WENERLFVNKLFSYIITFLIRELSTTFYRLCCYIV

SEQ ID NO: 3023609 - protein, 36 aa, Entamoeba invadens
WENSIYQLPIVISRLALFGIPIPDILNWAGIDVTTQ

SEQ ID NO: 3023610 - protein, 25 aa, Entamoeba invadens
WEQQKVLSFVPPEGKFSLFNYRVRG

SEQ ID NO: 3023611 - protein, 19 aa, Entamoeba invadens
WESMKYKLRKISEKAKVEL

SEQ ID NO: 3023612 - protein, 25 aa, Entamoeba invadens
WESSLVKKVFIGLLANGFDINFKEK

SEQ ID NO: 3023613 - protein, 20 aa, Entamoeba invadens
WFEAGVDFNSIDWSKCGPKI

SEQ ID NO: 3023614 - protein, 25 aa, Entamoeba invadens
WFEVSPRFCRCGGQLTLRGSSEALG

SEQ ID NO: 3023615 - protein, 24 aa, Entamoeba invadens
WFKDFDWEGLYQKKLTPSYIPVLK

SEQ ID NO: 3023616 - protein, 17 aa, Entamoeba invadens
WFLRNLFVIDDVGMYQL

SEQ ID NO: 3023617 - protein, 17 aa, Entamoeba invadens
WFNEHYAYPYPSDEEKE

SEQ ID NO: 3023618 - protein, 26 aa, Entamoeba invadens
WFNENNPWELLIFPDGLNESNRDDIA

SEQ ID NO: 3023619 - protein, 17 aa, Entamoeba invadens
WFNKLTEITIDKVASEM

SEQ ID NO: 3023620 - protein, 18 aa, Entamoeba invadens
WFPPKVRKIRLFTNEVLI

SEQ ID NO: 3023621 - protein, 17 aa, Entamoeba invadens
WFRISQNLYQNVFSNYQ

SEQ ID NO: 3023622 - protein, 17 aa, Entamoeba invadens
WFSPRGFFDSIIRSRSN

SEQ ID NO: 3023623 - protein, 17 aa, Entamoeba invadens
WFVTQIVALFAKAQIIN

SEQ ID NO: 3023624 - protein, 19 aa, Entamoeba invadens
WGADFWVYALNENGVIPEK

SEQ ID NO: 3023625 - protein, 18 aa, Entamoeba invadens
WGCGVFNNDPALKFIQQV

SEQ ID NO: 3023626 - protein, 27 aa, Entamoeba invadens
WGCTIRSVQMLFLNSLIRIQEPDPGFD

SEQ ID NO: 3023627 - protein, 25 aa, Entamoeba invadens
WGDRDDSFRLMRNGNIFWVGAPNNK

SEQ ID NO: 3023628 - protein, 26 aa, Entamoeba invadens
WGIDDYQFLPFLFGSAQLIKHPFLKP

SEQ ID NO: 3023629 - protein, 28 aa, Entamoeba invadens
WGKSYITPLIILFYTHPNYKIRQSTLAA

SEQ ID NO: 3023630 - protein, 17 aa, Entamoeba invadens
WGQKKFRFQFNNLPDYL

SEQ ID NO: 3023631 - protein, 31 aa, Entamoeba invadens
WGRDLGTIENFWLFISDSKYSQLFYFDSFML

SEQ ID NO: 3023632 - protein, 27 aa, Entamoeba invadens
WGRDTFISLRGLLLRNGRFKEAENTIR

SEQ ID NO: 3023633 - protein, 29 aa, Entamoeba invadens
WGRTTQPDLEFWLVQTSNFEKKIEIEGLE

SEQ ID NO: 3023634 - protein, 25 aa, Entamoeba invadens
WGVNELFQIYLYSTVKVINNIKFNC

SEQ ID NO: 3023635 - protein, 24 aa, Entamoeba invadens
WGVPVLTHQWLFDCMSERRLLSIN

SEQ ID NO: 3023636 - protein, 25 aa, Entamoeba invadens
WGVPVLTHQWLFDCMSERRLLSINP

SEQ ID NO: 3023637 - protein, 20 aa, Entamoeba invadens
WGWFSVTVHKLYRPTDVAIG

SEQ ID NO: 3023638 - protein, 26 aa, Entamoeba invadens
WHHSSPNIFLALYAKGSITFYDTNTG

SEQ ID NO: 3023639 - protein, 17 aa, Entamoeba invadens
WHKNLPTVKPCFAVKCN

SEQ ID NO: 3023640 - protein, 26 aa, Entamoeba invadens
WHQDPNFTIFQFMINGEQCKYTWKSK

SEQ ID NO: 3023641 - protein, 26 aa, Entamoeba invadens
WHSKNHFHTLFFFPEKLNKDFVTEMK

SEQ ID NO: 3023642 - protein, 19 aa, Entamoeba invadens
WICMDNVVFLWHHFSEKYE

SEQ ID NO: 3023643 - protein, 22 aa, Entamoeba invadens
WIDDVLPFKVFADRVGVNFVSY

SEQ ID NO: 3023644 - protein, 22 aa, Entamoeba invadens
WIDQMFDLVPLNNYVTEIEDSK

SEQ ID NO: 3023645 - protein, 19 aa, Entamoeba invadens
WIDSEVMKNYKWISRVLKK

SEQ ID NO: 3023646 - protein, 30 aa, Entamoeba invadens
WIDTKLVNIFKENSVFFHFIEPHSSSYIQP

SEQ ID NO: 3023647 - protein, 18 aa, Entamoeba invadens
WIEDCDVGHWFTNVFYKT

SEQ ID NO: 3023648 - protein, 19 aa, Entamoeba invadens
WIEESLLRKCPVEERWFCC

SEQ ID NO: 3023649 - protein, 17 aa, Entamoeba invadens
WIEKPIPECGPLDALVR

SEQ ID NO: 3023650 - protein, 20 aa, Entamoeba invadens
WIFWDVCGQQKFRNLWRSYY

SEQ ID NO: 3023651 - protein, 18 aa, Entamoeba invadens
WIGGQMIELLKAQGFEVV

SEQ ID NO: 3023652 - protein, 17 aa, Entamoeba invadens
WIGLNKYIAISEKDTVH

SEQ ID NO: 3023653 - protein, 17 aa, Entamoeba invadens
WIGLRQIQSLLVKASGE

SEQ ID NO: 3023654 - protein, 26 aa, Entamoeba invadens
WIGNSDFGLAIFKPSLCGSYSRKLSL

SEQ ID NO: 3023655 - protein, 24 aa, Entamoeba invadens
WIKDSFKLFTVVVLNFEFPSDIKN

SEQ ID NO: 3023656 - protein, 20 aa, Entamoeba invadens
WIKLEEFDVLQLPRVLEVLP

SEQ ID NO: 3023657 - protein, 25 aa, Entamoeba invadens
WIKYSDRYLLEDHFSIIVGVKSDSQ

SEQ ID NO: 3023658 - protein, 17 aa, Entamoeba invadens
WILYNQDGGYQQGMSDL

SEQ ID NO: 3023659 - protein, 19 aa, Entamoeba invadens
WINEFKRFAPNKGQLPQIV

SEQ ID NO: 3023660 - protein, 29 aa, Entamoeba invadens
WIQVFDSDAMYMIFTHKKCLPHTSISSFD

SEQ ID NO: 3023661 - protein, 18 aa, Entamoeba invadens
WISKFKAEKTGKNNKWLV

SEQ ID NO: 3023662 - protein, 28 aa, Entamoeba invadens
WISQSLSPIFRIQFIDSVTIENLIFEYS

SEQ ID NO: 3023663 - protein, 19 aa, Entamoeba invadens
WITALFFEKDVEVGRAIVP

SEQ ID NO: 3023664 - protein, 20 aa, Entamoeba invadens
WITPIGMTFALHLLELITSN

SEQ ID NO: 3023665 - protein, 19 aa, Entamoeba invadens
WITTCVFGMFESFFKFFHK

SEQ ID NO: 3023666 - protein, 17 aa, Entamoeba invadens
WIVVYNAINFNQIHKTP

SEQ ID NO: 3023667 - protein, 17 aa, Entamoeba invadens
WKAMVVTLFAWLKKNSD

SEQ ID NO: 3023668 - protein, 20 aa, Entamoeba invadens
WKDPYPKSDFKYAWSIADFV

SEQ ID NO: 3023669 - protein, 25 aa, Entamoeba invadens
WKEETLFETIIYTISLTFVGIVDFL

SEQ ID NO: 3023670 - protein, 17 aa, Entamoeba invadens
WKEIAVLKDVEQSKTVK

SEQ ID NO: 3023671 - protein, 18 aa, Entamoeba invadens
WKEKYRITSFTSSIQRRN

SEQ ID NO: 3023672 - protein, 19 aa, Entamoeba invadens
WKERHVLLVFFHEAMNMKA

SEQ ID NO: 3023673 - protein, 19 aa, Entamoeba invadens
WKIAEILSLKFDEGSNGLI

SEQ ID NO: 3023674 - protein, 17 aa, Entamoeba invadens
WKLPKYVLRDVYESNSV

SEQ ID NO: 3023675 - protein, 18 aa, Entamoeba invadens
WKNALINSKIMCGILEGV

SEQ ID NO: 3023676 - protein, 24 aa, Entamoeba invadens
WKNSLNALFEYPISHIESKAFFNK

SEQ ID NO: 3023677 - protein, 28 aa, Entamoeba invadens
WKNVDLEYFMYKIAYICRLRDIGIYKTQ

SEQ ID NO: 3023678 - protein, 19 aa, Entamoeba invadens
WKPDMESFMFQLGDNMASS

SEQ ID NO: 3023679 - protein, 20 aa, Entamoeba invadens
WKPLKDVTVLKWAILQEDTG

SEQ ID NO: 3023680 - protein, 23 aa, Entamoeba invadens
WKRRERKFLGERLGGAGAQSTLV

SEQ ID NO: 3023681 - protein, 26 aa, Entamoeba invadens
WKSLMDFEWNIYKLNLLRNPIKDDQF

SEQ ID NO: 3023682 - protein, 24 aa, Entamoeba invadens
WKSWKKRFFVLDGATLTYYKDDTK

SEQ ID NO: 3023683 - protein, 18 aa, Entamoeba invadens
WKTAMPHVKPCFAVKCCP

SEQ ID NO: 3023684 - protein, 26 aa, Entamoeba invadens
WKTANLLEHLNYYGRVRPIKVSCITW

SEQ ID NO: 3023685 - protein, 23 aa, Entamoeba invadens
WKTKRENMLNSRIAEIQTQLDEE

SEQ ID NO: 3023686 - protein, 20 aa, Entamoeba invadens
WKTKRFVILPKHINNGQESG

SEQ ID NO: 3023687 - protein, 36 aa, Entamoeba invadens
WKYNELIYTALLEVFQALPLAILLDTSCGTFFICHG

SEQ ID NO: 3023688 - protein, 28 aa, Entamoeba invadens
WKYSDSIYDLFISLFQALPIAAKLHTNF

SEQ ID NO: 3023689 - protein, 17 aa, Entamoeba invadens
WLAHDGNPIFCIDSHPS

SEQ ID NO: 3023690 - protein, 44 aa, Entamoeba invadens
WLDKLNVTVPIPAILKPKPLWTGKQVFTLILPPINYENGDYSIG

SEQ ID NO: 3023691 - protein, 27 aa, Entamoeba invadens
WLEGMQFQPIPFPPSNYKYDTKILVLA

SEQ ID NO: 3023692 - protein, 22 aa, Entamoeba invadens
WLEKSVLDQLPFYGVPKELKVL

SEQ ID NO: 3023693 - protein, 17 aa, Entamoeba invadens
WLFSELNLLISNFPFER

SEQ ID NO: 3023694 - protein, 32 aa, Entamoeba invadens
WLKRPMQVTCRFYQIGILMLFNENPQIKLNEV

SEQ ID NO: 3023695 - protein, 23 aa, Entamoeba invadens
WLKYVQGYIPNPFKYAIVATCSD

SEQ ID NO: 3023696 - protein, 18 aa, Entamoeba invadens
WLNFHNEHPLMYPDFVIG

SEQ ID NO: 3023697 - protein, 27 aa, Entamoeba invadens
WLQTLSDALILRFVIPSRKMTKKDLFD

SEQ ID NO: 3023698 - protein, 24 aa, Entamoeba invadens
WLSDQLMGYLIRKQAKEYPVVVPV

SEQ ID NO: 3023699 - protein, 30 aa, Entamoeba invadens
WLTFHSGYDFGYFLKLLTCEKLPSNIDLFL

SEQ ID NO: 3023700 - protein, 21 aa, Entamoeba invadens
WLYDCISEMKLLSPETYLVDG

SEQ ID NO: 3023701 - protein, 18 aa, Entamoeba invadens
WMAFGFCEKLTNIEFPPS

SEQ ID NO: 3023702 - protein, 27 aa, Entamoeba invadens
WMDDLGQLKWVVIGKLFGLRAVGNAQD

SEQ ID NO: 3023703 - protein, 19 aa, Entamoeba invadens
WMDDYIDYDFTRKLLKRYQ

SEQ ID NO: 3023704 - protein, 26 aa, Entamoeba invadens
WMDTRYPIIMWCQYLQNIRTNNFSES

SEQ ID NO: 3023705 - protein, 18 aa, Entamoeba invadens
WMECYPLDFLNIKSGEQS

SEQ ID NO: 3023706 - protein, 18 aa, Entamoeba invadens
WMEFVEVGNPVLNKKEEK

SEQ ID NO: 3023707 - protein, 20 aa, Entamoeba invadens
WMFSFGCSFIPRHQSSTKRG

SEQ ID NO: 3023708 - protein, 23 aa, Entamoeba invadens
WMGGAMFASLTTFESACVIKENY

SEQ ID NO: 3023709 - protein, 19 aa, Entamoeba invadens
WMHTKARRLRITSDQIDAL

SEQ ID NO: 3023710 - protein, 35 aa, Entamoeba invadens
WMKKKLEKRVLYKKRLFEVVQSLNATIPLIESEFT

SEQ ID NO: 3023711 - protein, 19 aa, Entamoeba invadens
WMNYVDRFITSDKLWFICQ

SEQ ID NO: 3023712 - protein, 17 aa, Entamoeba invadens
WMSCYKCQSFFCWVCMQ

SEQ ID NO: 3023713 - protein, 26 aa, Entamoeba invadens
WNDEITIFVMLKYRKWQMTGRKAQNL

SEQ ID NO: 3023714 - protein, 25 aa, Entamoeba invadens
WNDREHIRFLVCIDFLNAKKCRGLP

SEQ ID NO: 3023715 - protein, 26 aa, Entamoeba invadens
WNEKDFSKFLLQKEKPMLFKNFNLLF

SEQ ID NO: 3023716 - protein, 26 aa, Entamoeba invadens
WNESYDFPYVIPGSEAKFVVMDYDKN

SEQ ID NO: 3023717 - protein, 17 aa, Entamoeba invadens
WNGLKFVDSDGLFIVPE

SEQ ID NO: 3023718 - protein, 26 aa, Entamoeba invadens
WNGWIPSFIFNTFGPSFCPSVLNKMA

SEQ ID NO: 3023719 - protein, 18 aa, Entamoeba invadens
WNIDFQRLIGNLPKIEIP

SEQ ID NO: 3023720 - protein, 17 aa, Entamoeba invadens
WNIFCELKDVVLEEKAQ

SEQ ID NO: 3023721 - protein, 25 aa, Entamoeba invadens
WNIQFNIKVFARTSLQRLNQKAALN

SEQ ID NO: 3023722 - protein, 21 aa, Entamoeba invadens
WNIQYHDYTPGWYTFQGMPGN

SEQ ID NO: 3023723 - protein, 20 aa, Entamoeba invadens
WNIQYHDYTPGWYTFQGMTG

SEQ ID NO: 3023724 - protein, 24 aa, Entamoeba invadens
WNQVKGIFQYSPFRNIQLITSEEK

SEQ ID NO: 3023725 - protein, 22 aa, Entamoeba invadens
WNRDTVYFNKKLVEYVKESADD

SEQ ID NO: 3023726 - protein, 21 aa, Entamoeba invadens
WNSFKTVRRTVLIRATLAQMN

SEQ ID NO: 3023727 - protein, 20 aa, Entamoeba invadens
WNSSYLLFKGFKMEFLELKD

SEQ ID NO: 3023728 - protein, 24 aa, Entamoeba invadens
WNTDPRAFLFTLKSNGRTEGMEKY

SEQ ID NO: 3023729 - protein, 28 aa, Entamoeba invadens
WNTFPSFLRKHLSSLRSLWASLLMGESI

SEQ ID NO: 3023730 - protein, 17 aa, Entamoeba invadens
WNTIRKVIGYNTNIRPL

SEQ ID NO: 3023731 - protein, 24 aa, Entamoeba invadens
WNTTLIGLMMYFREATIHTPELLD

SEQ ID NO: 3023732 - protein, 23 aa, Entamoeba invadens
WNVKVPHIIALTLSSGSIVIFDC

SEQ ID NO: 3023733 - protein, 25 aa, Entamoeba invadens
WPAFTKPIHPLSLYEKTDESHGMRR

SEQ ID NO: 3023734 - protein, 31 aa, Entamoeba invadens
WPKVTHIIAMRLLHFSFANTFIRQYAVRCLM

SEQ ID NO: 3023735 - protein, 29 aa, Entamoeba invadens
WPMLHKERFQLLNIRPSRGVLLYGPSGCA

SEQ ID NO: 3023736 - protein, 17 aa, Entamoeba invadens
WQAVQFPFLSKFNRPEE

SEQ ID NO: 3023737 - protein, 19 aa, Entamoeba invadens
WQNPYKLTTLVIPSTVQII

SEQ ID NO: 3023738 - protein, 29 aa, Entamoeba invadens
WQSHKELWAYSIFFFSSIAKKCMTYFEKY

SEQ ID NO: 3023739 - protein, 33 aa, Entamoeba invadens
WQSKFLIPRTFVGKILRLLKILNEFPLFKNDDQ

SEQ ID NO: 3023740 - protein, 19 aa, Entamoeba invadens
WQVAFVFKEMVMGLAYLHG

SEQ ID NO: 3023741 - protein, 17 aa, Entamoeba invadens
WREVATPAGSIQALLPP

SEQ ID NO: 3023742 - protein, 18 aa, Entamoeba invadens
WRFVTKTLKQSPSRVILY

SEQ ID NO: 3023743 - protein, 34 aa, Entamoeba invadens
WRGVRFLLSICFDIKFPVFLRNTKLEYDVILNAS

SEQ ID NO: 3023744 - protein, 21 aa, Entamoeba invadens
WRMKTTEFGGIKLIRDDDILY

SEQ ID NO: 3023745 - protein, 18 aa, Entamoeba invadens
WRMRACCVIYVNFANTEE

SEQ ID NO: 3023746 - protein, 17 aa, Entamoeba invadens
WRQLIHGGVFHAGSKRL

SEQ ID NO: 3023747 - protein, 27 aa, Entamoeba invadens
WSAGVMMYALLTFKFPFEGGTIETVKG

SEQ ID NO: 3023748 - protein, 26 aa, Entamoeba invadens
WSAKNFMAGYYYMRQLSFGKMDLEIH

SEQ ID NO: 3023749 - protein, 25 aa, Entamoeba invadens
WSDGDTIFLIPIRELKNGLGELDYD

SEQ ID NO: 3023750 - protein, 17 aa, Entamoeba invadens
WSEKRSFRVIYDSTIDS

SEQ ID NO: 3023751 - protein, 17 aa, Entamoeba invadens
WSFGCIAAELILGIPIF

SEQ ID NO: 3023752 - protein, 26 aa, Entamoeba invadens
WSKETNDWRTFFSQSAWEYNATRQEY

SEQ ID NO: 3023753 - protein, 19 aa, Entamoeba invadens
WSKLLVFRGKFDEHMLTFA

SEQ ID NO: 3023754 - protein, 17 aa, Entamoeba invadens
WSLGCIAAEFFIGIPLF

SEQ ID NO: 3023755 - protein, 24 aa, Entamoeba invadens
WSNFNYIHFISLTHNLTNATPKKI

SEQ ID NO: 3023756 - protein, 23 aa, Entamoeba invadens
WSNRMFLFSMKKSNPIPVIFMKN

SEQ ID NO: 3023757 - protein, 25 aa, Entamoeba invadens
WSSLTLKHKGAASTFLRLFGLIDDE

SEQ ID NO: 3023758 - protein, 34 aa, Entamoeba invadens
WSTSDFGSMILMKIMDFLGGLFTGIAVGKRLPLQ

SEQ ID NO: 3023759 - protein, 25 aa, Entamoeba invadens
WSVGCIIFECLFKRPPFTGSSELEI

SEQ ID NO: 3023760 - protein, 17 aa, Entamoeba invadens
WSVSLSPTPLLKTKSCD

SEQ ID NO: 3023761 - protein, 26 aa, Entamoeba invadens
WSYCSRGFYYGYVPTNLLQKIVKEPQ

SEQ ID NO: 3023762 - protein, 22 aa, Entamoeba invadens
WTCHTVLIKFKAIDMKIVESLK

SEQ ID NO: 3023763 - protein, 24 aa, Entamoeba invadens
WTDYTADEWLLADAIKKVDVMKTF

SEQ ID NO: 3023764 - protein, 32 aa, Entamoeba invadens
WTEKATKYVLLKYFYWRYTEPSVMSLHETYKT

SEQ ID NO: 3023765 - protein, 31 aa, Entamoeba invadens
WTEKTTKYVLLKYFYWKFTEPSVMSLHEMYK

SEQ ID NO: 3023766 - protein, 22 aa, Entamoeba invadens
WTFKNSTIPLPLTLTKYPNEDP

SEQ ID NO: 3023767 - protein, 18 aa, Entamoeba invadens
WTGLRHKVLVFDSAVNDW

SEQ ID NO: 3023768 - protein, 17 aa, Entamoeba invadens
WTGYSHCKLIFDTAQEH

SEQ ID NO: 3023769 - protein, 26 aa, Entamoeba invadens
WTKDRDNIIYVLRFDKRFALFCSGTK

SEQ ID NO: 3023770 - protein, 19 aa, Entamoeba invadens
WTKISACLKGRSPNSVKNR

SEQ ID NO: 3023771 - protein, 22 aa, Entamoeba invadens
WTSLSVLLQYYGFTQIQGHHRL

SEQ ID NO: 3023772 - protein, 17 aa, Entamoeba invadens
WTYINWDYWVLSKVQEV

SEQ ID NO: 3023773 - protein, 17 aa, Entamoeba invadens
WVAFFCSQLKEKKNKMK

SEQ ID NO: 3023774 - protein, 23 aa, Entamoeba invadens
WVAGKKWIEAIQRCKERTPLKEK

SEQ ID NO: 3023775 - protein, 30 aa, Entamoeba invadens
WVDEVVDGITWWCTPYDFVKSFNIDYVVHG

SEQ ID NO: 3023776 - protein, 26 aa, Entamoeba invadens
WVEQTSPTLLLVWEVLESRMKEDSFF

SEQ ID NO: 3023777 - protein, 17 aa, Entamoeba invadens
WVFLNKAVSVMRDFHDN

SEQ ID NO: 3023778 - protein, 20 aa, Entamoeba invadens
WVFWFDGFSNKTQGSYGANI

SEQ ID NO: 3023779 - protein, 17 aa, Entamoeba invadens
WVGFYNFEILYDTDISS

SEQ ID NO: 3023780 - protein, 18 aa, Entamoeba invadens
WVLEGRWFNLYSENKTFQ

SEQ ID NO: 3023781 - protein, 20 aa, Entamoeba invadens
WVLVCQGLIRMGLVPVPLYA

SEQ ID NO: 3023782 - protein, 17 aa, Entamoeba invadens
WVPIGLFDFNKSGQLFA

SEQ ID NO: 3023783 - protein, 24 aa, Entamoeba invadens
WVPPEREFPFKIYGHSVSSFPTDM

SEQ ID NO: 3023784 - protein, 24 aa, Entamoeba invadens
WVQVNYQFFRFFNGTNNFSFKNVV

SEQ ID NO: 3023785 - protein, 30 aa, Entamoeba invadens
WVQVQEAVYTSWLNSLLPQDTPKIMNVKTD

SEQ ID NO: 3023786 - protein, 18 aa, Entamoeba invadens
WVTIMKGRNENSILKTLI

SEQ ID NO: 3023787 - protein, 25 aa, Entamoeba invadens
WVTSIMMDTLLFTLNSPLHKKYLGS

SEQ ID NO: 3023788 - protein, 25 aa, Entamoeba invadens
WVTVAQLPIKLLSPNCVYMPDQKLG

SEQ ID NO: 3023789 - protein, 17 aa, Entamoeba invadens
WVVDLYEEIIYVKLPQN

SEQ ID NO: 3023790 - protein, 18 aa, Entamoeba invadens
WVVIFSLIYEIFSVKFSE

SEQ ID NO: 3023791 - protein, 18 aa, Entamoeba invadens
WVVPFDLIEICEIPELGK

SEQ ID NO: 3023792 - protein, 20 aa, Entamoeba invadens
WYCRVCSYRLQLNKLTIPKT

SEQ ID NO: 3023793 - protein, 25 aa, Entamoeba invadens
WYHSHPGFGCWLSSIDISTQQSFER

SEQ ID NO: 3023794 - protein, 27 aa, Entamoeba invadens
WYKGINKNIIIYWKPNVIYMTEDGVTE

SEQ ID NO: 3023795 - protein, 24 aa, Entamoeba invadens
WYRANVVVVAPKANILKCVDTGVF

SEQ ID NO: 3023796 - protein, 25 aa, Entamoeba invadens
WYTQHETLPLGWEKNSLVLPEVLSN

SEQ ID NO: 3023797 - protein, 18 aa, Entamoeba invadens
WYVKYVVWKLTKNNRLLL

SEQ ID NO: 3023798 - protein, 32 aa, Entamoeba invadens
WYVPMEIDTLRFFPFVNYHMYFEKRKLLSDFT

SEQ ID NO: 3023799 - protein, 17 aa, Entamoeba invadens
  misc_feature (1)..(2): Xaa can be any naturally occurring amino acid
XXLPRRTLLDAISRRLS

SEQ ID NO: 3023800 - protein, 30 aa, Entamoeba invadens
YAAEYSIASLPTFVFFQNKKVVKKAPGSSE

SEQ ID NO: 3023801 - protein, 28 aa, Entamoeba invadens
YAAEYSIASLPTFVFFQNQNVMKKAPGS

SEQ ID NO: 3023802 - protein, 27 aa, Entamoeba invadens
YAAHDISFVQVILAPQKNVDLFGKSAI

SEQ ID NO: 3023803 - protein, 17 aa, Entamoeba invadens
YAAIMDGAAIKSPICTS

SEQ ID NO: 3023804 - protein, 18 aa, Entamoeba invadens
YACAILSVPLQSFSVRII

SEQ ID NO: 3023805 - protein, 26 aa, Entamoeba invadens
YACECNHYMILTLNALIQAKKEAFTI

SEQ ID NO: 3023806 - protein, 18 aa, Entamoeba invadens
YACISCAVGYYLSNARCY

SEQ ID NO: 3023807 - protein, 31 aa, Entamoeba invadens
YADIYSCGILLHVMLYGYMPVVHEFSDNGGS

SEQ ID NO: 3023808 - protein, 28 aa, Entamoeba invadens
YADKRIGYLALMLLLDETQEVLTLVTNH

SEQ ID NO: 3023809 - protein, 17 aa, Entamoeba invadens
YADLRCGFREKLRRIQL

SEQ ID NO: 3023810 - protein, 19 aa, Entamoeba invadens
YADYLTPFIRDNSLTFQTK

SEQ ID NO: 3023811 - protein, 26 aa, Entamoeba invadens
YAELLFEKFETPGLLFELTGNCALVP

SEQ ID NO: 3023812 - protein, 17 aa, Entamoeba invadens
YAERVGYPLVFCSSNTG

SEQ ID NO: 3023813 - protein, 27 aa, Entamoeba invadens
YAETVDWWGFGILIFEMIHGHAPFVSE

SEQ ID NO: 3023814 - protein, 27 aa, Entamoeba invadens
YAFAITMFETIFWKEAFSKSEFKYPWK

SEQ ID NO: 3023815 - protein, 17 aa, Entamoeba invadens
YAFLRCYSLQNVELPKS

SEQ ID NO: 3023816 - protein, 28 aa, Entamoeba invadens
YAFRNCKNLLFFRAPINLIKIGDGCFSE

SEQ ID NO: 3023817 - protein, 24 aa, Entamoeba invadens
YAFTSVCTLLPLTQKPYFKLERID

SEQ ID NO: 3023818 - protein, 24 aa, Entamoeba invadens
YAGERVVHLNGVKPSLLINMDESD

SEQ ID NO: 3023819 - protein, 24 aa, Entamoeba invadens
YAGERVVHLNGVKPSLLINMDESG

SEQ ID NO: 3023820 - protein, 18 aa, Entamoeba invadens
YAGLIQSCWKQEGSERPT

SEQ ID NO: 3023821 - protein, 25 aa, Entamoeba invadens
YAHDFVVSYIIFFSKLININDILIM

SEQ ID NO: 3023822 - protein, 17 aa, Entamoeba invadens
YAIFVALWCKDTRSSMA

SEQ ID NO: 3023823 - protein, 22 aa, Entamoeba invadens
YAIHNALISFTLRKSGTASCDI

SEQ ID NO: 3023824 - protein, 17 aa, Entamoeba invadens
YAILFTQIEMIGVDKKS

SEQ ID NO: 3023825 - protein, 17 aa, Entamoeba invadens
YAINVLQTFCKCGMSIG

SEQ ID NO: 3023826 - protein, 21 aa, Entamoeba invadens
YAIPEPFQSQYLKFGFHGLSY

SEQ ID NO: 3023827 - protein, 26 aa, Entamoeba invadens
YAIVLLTATFLKFYPQHSLGRALVEF

SEQ ID NO: 3023828 - protein, 34 aa, Entamoeba invadens
YAKDLNRFFSYTKKRPNFKVVYSSTLYGFDRKKL

SEQ ID NO: 3023829 - protein, 17 aa, Entamoeba invadens
YAKPILCSPTLATSGLS

SEQ ID NO: 3023830 - protein, 34 aa, Entamoeba invadens
YAKQNYLLDVLRRCGFFFESTFPFKTRFTIQQER

SEQ ID NO: 3023831 - protein, 29 aa, Entamoeba invadens
YAKYYKFENMFLPAFFRKHGSDYTISAID

SEQ ID NO: 3023832 - protein, 20 aa, Entamoeba invadens
YALGITMWELFYEQYPFSEH

SEQ ID NO: 3023833 - protein, 19 aa, Entamoeba invadens
YALQQKKLLLEQKLAEVNA

SEQ ID NO: 3023834 - protein, 25 aa, Entamoeba invadens
YAMSDVSFIFPITPSSPMAENADVW

SEQ ID NO: 3023835 - protein, 33 aa, Entamoeba invadens
YANDEKILIFTANIIYHLFDQFTAHMQKLEEAK

SEQ ID NO: 3023836 - protein, 17 aa, Entamoeba invadens
YAPFKITILSDVKDITI

SEQ ID NO: 3023837 - protein, 23 aa, Entamoeba invadens
YAQIDIFKRAIRAVAMGNSVVLP

SEQ ID NO: 3023838 - protein, 34 aa, Entamoeba invadens
YAQTLNLGFSYLPFLNAFLFPLVIDDFSDQFPRC

SEQ ID NO: 3023839 - protein, 25 aa, Entamoeba invadens
YAQVEWEFFKLVRNAVNFNLCDSVI

SEQ ID NO: 3023840 - protein, 25 aa, Entamoeba invadens
YARQKAVLSNFTPFIPVAPQCVPLK

SEQ ID NO: 3023841 - protein, 23 aa, Entamoeba invadens
YASCTKIYFDKDYFLRLIVTDQV

SEQ ID NO: 3023842 - protein, 25 aa, Entamoeba invadens
YASTQLKLPPPTPPKPRATLQKCRS

SEQ ID NO: 3023843 - protein, 20 aa, Entamoeba invadens
YATYYCLPKQFYDDLYCVVE

SEQ ID NO: 3023844 - protein, 30 aa, Entamoeba invadens
YAVDIWAIGVMLYYLKFGMTPFGSTSRDHV

SEQ ID NO: 3023845 - protein, 18 aa, Entamoeba invadens
YAVLAKNVIALFKTAKDL

SEQ ID NO: 3023846 - protein, 17 aa, Entamoeba invadens
  misc_feature (15)..(16): Xaa can be any naturally occurring amino acid
YAYTSLDLVIPYIRXXE

SEQ ID NO: 3023847 - protein, 23 aa, Entamoeba invadens
YCASHLFLTLLPSNFNLKEFMSN

SEQ ID NO: 3023848 - protein, 23 aa, Entamoeba invadens
YCCHLRLLNYRYHFNNIELIISD

SEQ ID NO: 3023849 - protein, 19 aa, Entamoeba invadens
YCDKLTSIVLPSSVLHLGS

SEQ ID NO: 3023850 - protein, 24 aa, Entamoeba invadens
YCDLCGCPLFIQIDLLDSQLQIPI

SEQ ID NO: 3023851 - protein, 23 aa, Entamoeba invadens
YCEILNQTFDYLTIPELKELKND

SEQ ID NO: 3023852 - protein, 21 aa, Entamoeba invadens
YCESCIKNCAFFDCGNLTSIT

SEQ ID NO: 3023853 - protein, 17 aa, Entamoeba invadens
YCFFKCLSLEEINFPQS

SEQ ID NO: 3023854 - protein, 17 aa, Entamoeba invadens
YCFSFPNVIFNEKFLSI

SEQ ID NO: 3023855 - protein, 20 aa, Entamoeba invadens
YCGNKFCYNCREKTWHEEFT

SEQ ID NO: 3023856 - protein, 18 aa, Entamoeba invadens
YCHLIAPNIYLEPYCPFN

SEQ ID NO: 3023857 - protein, 19 aa, Entamoeba invadens
YCHPTFSKYYLDEEMCGAS

SEQ ID NO: 3023858 - protein, 20 aa, Entamoeba invadens
YCHTNFISDIQWKPQVYGDD

SEQ ID NO: 3023859 - protein, 20 aa, Entamoeba invadens
YCIFYERVVNLLPKARKEIP

SEQ ID NO: 3023860 - protein, 17 aa, Entamoeba invadens
YCIQWCLNKFKNIRIDT

SEQ ID NO: 3023861 - protein, 18 aa, Entamoeba invadens
YCITFPFKNKRLVSADVI

SEQ ID NO: 3023862 - protein, 23 aa, Entamoeba invadens
YCKGRFGMFSQIYEIPEYVDVQG

SEQ ID NO: 3023863 - protein, 18 aa, Entamoeba invadens
YCKTIILNVNRFNKTIGF

SEQ ID NO: 3023864 - protein, 17 aa, Entamoeba invadens
YCLKCKKGFYNTGKMCE

SEQ ID NO: 3023865 - protein, 17 aa, Entamoeba invadens
YCLSCDSQYYLSSSFTC

SEQ ID NO: 3023866 - protein, 18 aa, Entamoeba invadens
YCLVKWGGGLSYTEATWE

SEQ ID NO: 3023867 - protein, 18 aa, Entamoeba invadens
YCMNPQLIEQRGFVETIK

SEQ ID NO: 3023868 - protein, 23 aa, Entamoeba invadens
YCNSLTRVILPLNLVAIKMNAFH

SEQ ID NO: 3023869 - protein, 19 aa, Entamoeba invadens
YCPHAAIRPFLLNDAETKN

SEQ ID NO: 3023870 - protein, 18 aa, Entamoeba invadens
YCPSALIYSVGLKTDLRT

SEQ ID NO: 3023871 - protein, 31 aa, Entamoeba invadens
YCQDSEIINFYDFKILLILQGQLGCAFSFVV

SEQ ID NO: 3023872 - protein, 17 aa, Entamoeba invadens
YCQNEAFYLQRAEQQTQ

SEQ ID NO: 3023873 - protein, 20 aa, Entamoeba invadens
YCQNGSHLILTYVLNGNQVR

SEQ ID NO: 3023874 - protein, 20 aa, Entamoeba invadens
YCQVVLAAGVLLYQTGKKEQ

SEQ ID NO: 3023875 - protein, 24 aa, Entamoeba invadens
YCRFILFCSNVCGMLQPIRSRCIL

SEQ ID NO: 3023876 - protein, 23 aa, Entamoeba invadens
YCSFDRFELFLDHLKVVHKMSEE

SEQ ID NO: 3023877 - protein, 17 aa, Entamoeba invadens
YCTEAFDYLGLAAIIDQ

SEQ ID NO: 3023878 - protein, 25 aa, Entamoeba invadens
YCTKSDLILLVLRKMTNMEFEAKIQ

SEQ ID NO: 3023879 - protein, 18 aa, Entamoeba invadens
YCVRLSKIVLPNSIKKIG

SEQ ID NO: 3023880 - protein, 17 aa, Entamoeba invadens
YCYHLSEITIPGSVTFI

SEQ ID NO: 3023881 - protein, 17 aa, Entamoeba invadens
YCYLANEYHYTSIENGR

SEQ ID NO: 3023882 - protein, 17 aa, Entamoeba invadens
YCYMKMKKIGYSFVYKW

SEQ ID NO: 3023883 - protein, 24 aa, Entamoeba invadens
YCYSCTVFLPPHIEMLVLNSAMIT

SEQ ID NO: 3023884 - protein, 17 aa, Entamoeba invadens
YCYSYTPAYYVPYNQQQ

SEQ ID NO: 3023885 - protein, 18 aa, Entamoeba invadens
YDADFSALTCLTKFTLKG

SEQ ID NO: 3023886 - protein, 24 aa, Entamoeba invadens
YDATAFLIGTFFQGTPSLPYEEVS

SEQ ID NO: 3023887 - protein, 19 aa, Entamoeba invadens
YDCDVLERFGYTFKLIRLI

SEQ ID NO: 3023888 - protein, 18 aa, Entamoeba invadens
YDCNFINKVTIPPSVRYI

SEQ ID NO: 3023889 - protein, 25 aa, Entamoeba invadens
YDCSVKRLILPKTILFVRLVNCLVE

SEQ ID NO: 3023890 - protein, 19 aa, Entamoeba invadens
YDDFLNVILVCKKYEYILD

SEQ ID NO: 3023891 - protein, 18 aa, Entamoeba invadens
YDDKTGCGSNLFVLKDGC

SEQ ID NO: 3023892 - protein, 25 aa, Entamoeba invadens
YDDLRSIWHHTFYNELRVNPEERSV

SEQ ID NO: 3023893 - protein, 27 aa, Entamoeba invadens
YDDLTKARFLLLQKMSETRLKMAEVER

SEQ ID NO: 3023894 - protein, 18 aa, Entamoeba invadens
YDDPSCGMGIIFGTGTNG

SEQ ID NO: 3023895 - protein, 19 aa, Entamoeba invadens
YDDPSCGMGLIFGTGTNGC

SEQ ID NO: 3023896 - protein, 18 aa, Entamoeba invadens
YDDVYYIMNIGDSRCVVV

SEQ ID NO: 3023897 - protein, 23 aa, Entamoeba invadens
YDEDIYVGYRYYTSFEKRCSFPF

SEQ ID NO: 3023898 - protein, 25 aa, Entamoeba invadens
YDEEFKLLRAPFDLEIKKLEDAKNR

SEQ ID NO: 3023899 - protein, 22 aa, Entamoeba invadens
YDEIYHQYVYFQNELGQIKAKI

SEQ ID NO: 3023900 - protein, 21 aa, Entamoeba invadens
YDEPIYIKLEKLEIMLMLVNE

SEQ ID NO: 3023901 - protein, 23 aa, Entamoeba invadens
YDERRFFEFLKKGRITPKEIRKW

SEQ ID NO: 3023902 - protein, 22 aa, Entamoeba invadens
YDESGKYLWMDAIRGDDFGPNK

SEQ ID NO: 3023903 - protein, 29 aa, Entamoeba invadens
YDESQMPYRELLEIYFLSIDPTDGDGQFA

SEQ ID NO: 3023904 - protein, 39 aa, Entamoeba invadens
YDFDFSTRYNPFSIFPNFIRLTQPLTYSPTYFIDGLHSF

SEQ ID NO: 3023905 - protein, 32 aa, Entamoeba invadens
YDFEYQPPTPKLLQTIILIDTSLTFAQSNDYL

SEQ ID NO: 3023906 - protein, 24 aa, Entamoeba invadens
YDFFNKTHFSQADAVAICFAIDPK

SEQ ID NO: 3023907 - protein, 25 aa, Entamoeba invadens
YDFFNKTHFSQADAVAICFAIDSKE

SEQ ID NO: 3023908 - protein, 27 aa, Entamoeba invadens
YDFLKCFILHYFISFSSNLFIDNNKFV

SEQ ID NO: 3023909 - protein, 27 aa, Entamoeba invadens
YDFMEVVRWFAERVDMIVLVFDANKLD

SEQ ID NO: 3023910 - protein, 24 aa, Entamoeba invadens
YDGESFNFNLLQLRASFEFTKDFK

SEQ ID NO: 3023911 - protein, 25 aa, Entamoeba invadens
YDGESFNFNLLQLRPSFEFTKDFRI

SEQ ID NO: 3023912 - protein, 34 aa, Entamoeba invadens
YDGFESLFEFLKLKPLVFLALQPIVGDIYLDKRG

SEQ ID NO: 3023913 - protein, 18 aa, Entamoeba invadens
YDGFFGHRINPVINMAIS

SEQ ID NO: 3023914 - protein, 50 aa, Entamoeba invadens
YDGLVKMISTLAQYSKALPTMGLVPRSLELEIRTVVYLSDRLDEVKELSE

SEQ ID NO: 3023915 - protein, 47 aa, Entamoeba invadens
YDGSHIKGLLINYFNVFWPSLLKIKNFLVEFITPIVKVKKGKEEISF

SEQ ID NO: 3023916 - protein, 18 aa, Entamoeba invadens
YDHIVVHTLIRYCSTTSN

SEQ ID NO: 3023917 - protein, 25 aa, Entamoeba invadens
YDHKEWIPDYVLLSFGMNDFWDVVA

SEQ ID NO: 3023918 - protein, 17 aa, Entamoeba invadens
YDIARKYLSFQPTSIDS

SEQ ID NO: 3023919 - protein, 22 aa, Entamoeba invadens
YDIIHLFISLKIKNFVKAFGQV

SEQ ID NO: 3023920 - protein, 27 aa, Entamoeba invadens
YDIIICDWMGINLYYDSLLSEMLIAKT

SEQ ID NO: 3023921 - protein, 26 aa, Entamoeba invadens
YDINRRLYVIKLSKTDLKEFIVIESG

SEQ ID NO: 3023922 - protein, 23 aa, Entamoeba invadens
YDISGCYILRPAAYGLWENIQQF

SEQ ID NO: 3023923 - protein, 28 aa, Entamoeba invadens
YDIVAIPQIICYINNYYFSDGILTDEKL

SEQ ID NO: 3023924 - protein, 22 aa, Entamoeba invadens
YDKEKMLLPSQLHNGLGLTREV

SEQ ID NO: 3023925 - protein, 24 aa, Entamoeba invadens
YDKENVIVLYFGDPIPKQPSAGPA

SEQ ID NO: 3023926 - protein, 17 aa, Entamoeba invadens
YDKEVETNAFRKARLKE

SEQ ID NO: 3023927 - protein, 25 aa, Entamoeba invadens
YDKILEEVLLFEDQFKKKAPIKIVD

SEQ ID NO: 3023928 - protein, 24 aa, Entamoeba invadens
YDKLNQFINVLPLNYNGAKVNVDG

SEQ ID NO: 3023929 - protein, 24 aa, Entamoeba invadens
YDKLRRLSFINATVFFVCYSADSK

SEQ ID NO: 3023930 - protein, 19 aa, Entamoeba invadens
YDKMPSYDTNIPLLGCLTT

SEQ ID NO: 3023931 - protein, 24 aa, Entamoeba invadens
YDKSFPVFAVKCRPGYETDIAMRV

SEQ ID NO: 3023932 - protein, 31 aa, Entamoeba invadens
YDKSIVLTIFKSFQYLPFCCLVSKTMLCLHG

SEQ ID NO: 3023933 - protein, 31 aa, Entamoeba invadens
YDKVTCRVILPLLLLMITSKELLGYVLDNKI

SEQ ID NO: 3023934 - protein, 19 aa, Entamoeba invadens
YDLLTIFDITKPVEKNRYV

SEQ ID NO: 3023935 - protein, 22 aa, Entamoeba invadens
YDLLYSKVVIFSPPLPSPLTSV

SEQ ID NO: 3023936 - protein, 20 aa, Entamoeba invadens
YDLQLIFKQCDYYTLMADSA

SEQ ID NO: 3023937 - protein, 18 aa, Entamoeba invadens
YDLVLKKSKIIRQKRLLE

SEQ ID NO: 3023938 - protein, 25 aa, Entamoeba invadens
YDLYDLYIKAILLQKLPVMERTPSA

SEQ ID NO: 3023939 - protein, 28 aa, Entamoeba invadens
YDNDACSLYLSAINRLKLATGSPIVITE

SEQ ID NO: 3023940 - protein, 22 aa, Entamoeba invadens
YDNFVLLDPYLTARQMIYYNRE

SEQ ID NO: 3023941 - protein, 25 aa, Entamoeba invadens
YDNSGDWWLAELNGKRGLVPANFID

SEQ ID NO: 3023942 - protein, 28 aa, Entamoeba invadens
YDNVTDFEWYLKLLSRLSTQKLEQSVFN

SEQ ID NO: 3023943 - protein, 25 aa, Entamoeba invadens
YDNYHNLFMNCSGAFWIENNGTVFF

SEQ ID NO: 3023944 - protein, 21 aa, Entamoeba invadens
YDPITIYVKSGYYPFINKTLS

SEQ ID NO: 3023945 - protein, 20 aa, Entamoeba invadens
YDPIYPIISSAQHYAFTSFS

SEQ ID NO: 3023946 - protein, 24 aa, Entamoeba invadens
YDPRHPYQRIPVGVTTYYSPTMLQ

SEQ ID NO: 3023947 - protein, 17 aa, Entamoeba invadens
YDQLINLVSGHEDETNN

SEQ ID NO: 3023948 - protein, 17 aa, Entamoeba invadens
YDQMLDMIYKKCNVTQS

SEQ ID NO: 3023949 - protein, 20 aa, Entamoeba invadens
YDQMRPLSYPGTHCFLICFS

SEQ ID NO: 3023950 - protein, 20 aa, Entamoeba invadens
YDQVTPFMRQGYTIIKGPNN

SEQ ID NO: 3023951 - protein, 17 aa, Entamoeba invadens
YDRIFSMLVVKVNKALQ

SEQ ID NO: 3023952 - protein, 19 aa, Entamoeba invadens
YDRPIIIRAALNSKVIFET

SEQ ID NO: 3023953 - protein, 18 aa, Entamoeba invadens
YDRPIKVQLVQAKPFYRA

SEQ ID NO: 3023954 - protein, 21 aa, Entamoeba invadens
YDSLLMMVYALVTITPQSECI

SEQ ID NO: 3023955 - protein, 25 aa, Entamoeba invadens
YDSQCFMNCFNLKFISKVKHLKSGV

SEQ ID NO: 3023956 - protein, 26 aa, Entamoeba invadens
YDSVEHPFVKYFMRGMRVTLATDAPM

SEQ ID NO: 3023957 - protein, 24 aa, Entamoeba invadens
YDSVWMRGYWLIFSQDQAVKGKID

SEQ ID NO: 3023958 - protein, 28 aa, Entamoeba invadens
YDTFSFIGGLVFPVPADHLLLQQRQREE

SEQ ID NO: 3023959 - protein, 18 aa, Entamoeba invadens
YDTKARLFETSPSGLYYG

SEQ ID NO: 3023960 - protein, 21 aa, Entamoeba invadens
YDVIIISPPWGGPGAFRNKQS

SEQ ID NO: 3023961 - protein, 20 aa, Entamoeba invadens
YDVIITSPPWGRPGAFRNKQ

SEQ ID NO: 3023962 - protein, 19 aa, Entamoeba invadens
YDVIMWFNVDYETYLKNKN

SEQ ID NO: 3023963 - protein, 30 aa, Entamoeba invadens
YDVLFNQLPGWQILVFPLLEKFTSIKAEDF

SEQ ID NO: 3023964 - protein, 20 aa, Entamoeba invadens
YDVRIFYCREYAFRIREFLG

SEQ ID NO: 3023965 - protein, 21 aa, Entamoeba invadens
YDVRIFYCREYAFRIREFLGE

SEQ ID NO: 3023966 - protein, 17 aa, Entamoeba invadens
YDYDACSLYPIAMHILK

SEQ ID NO: 3023967 - protein, 22 aa, Entamoeba invadens
YECFGWCEAYSKDAFKFPWKIA

SEQ ID NO: 3023968 - protein, 17 aa, Entamoeba invadens
YECFSTFLKGKILFIAA

SEQ ID NO: 3023969 - protein, 23 aa, Entamoeba invadens
YECHLRLKALGFLFNNIKMTEKD

SEQ ID NO: 3023970 - protein, 32 aa, Entamoeba invadens
YECIGWCQAYTKHQFRFPWKIAEFVINGKRVE

SEQ ID NO: 3023971 - protein, 32 aa, Entamoeba invadens
YECIGWCQAYTKHQFRFPWKIAEFVINGKRVK

SEQ ID NO: 3023972 - protein, 17 aa, Entamoeba invadens
YECNSLHNVFIPSSVTL

SEQ ID NO: 3023973 - protein, 22 aa, Entamoeba invadens
YECSSLIVITIPSSVRLINDWC

SEQ ID NO: 3023974 - protein, 19 aa, Entamoeba invadens
YECVCVLLGITYKGKPFMG

SEQ ID NO: 3023975 - protein, 17 aa, Entamoeba invadens
YEDAELKLITKLKKYVP

SEQ ID NO: 3023976 - protein, 25 aa, Entamoeba invadens
YEDKIICNSFYVLGKKWSKIAESLS

SEQ ID NO: 3023977 - protein, 24 aa, Entamoeba invadens
YEDKKLFIYLKENAAKIWITQSTF

SEQ ID NO: 3023978 - protein, 26 aa, Entamoeba invadens
YEDNIPAAILLDIIRRFVAVDKLGIK

SEQ ID NO: 3023979 - protein, 32 aa, Entamoeba invadens
YEDNNNLVLSCYSSFWITKNGQIGFNLCAKEH

SEQ ID NO: 3023980 - protein, 26 aa, Entamoeba invadens
YEDQNKLIIAAQNVLQMQIKREKEKY

SEQ ID NO: 3023981 - protein, 24 aa, Entamoeba invadens
YEDRKLFIYLKENAAKIWITQSTS

SEQ ID NO: 3023982 - protein, 27 aa, Entamoeba invadens
YEDTALEIFHFYSLKSFILQFKSSTER

SEQ ID NO: 3023983 - protein, 19 aa, Entamoeba invadens
YEDVSPLAQPKAKTARMEE

SEQ ID NO: 3023984 - protein, 39 aa, Entamoeba invadens
YEEAKLICKIGLKYAPKYIHLLVLLIRSTCRIYDEKTNK

SEQ ID NO: 3023985 - protein, 20 aa, Entamoeba invadens
YEEALTENLKFRNTLKQQAG

SEQ ID NO: 3023986 - protein, 26 aa, Entamoeba invadens
YEEGGITDWFVEVFVDYVRSAKIPLI

SEQ ID NO: 3023987 - protein, 30 aa, Entamoeba invadens
YEEGIYYTKFEILTKYFITPLRNAQLAFES

SEQ ID NO: 3023988 - protein, 18 aa, Entamoeba invadens
YEEIIYVKLPQNASLENP

SEQ ID NO: 3023989 - protein, 27 aa, Entamoeba invadens
YEELKVVCEVFKEVLTYKEFCRSNVGK

SEQ ID NO: 3023990 - protein, 18 aa, Entamoeba invadens
YEEPLLIGILDNVSKMVG

SEQ ID NO: 3023991 - protein, 17 aa, Entamoeba invadens
YEERRCIGYRLFCGQVL

SEQ ID NO: 3023992 - protein, 26 aa, Entamoeba invadens
YEEVATIFLVLLSKMDELPPMYQAVA

SEQ ID NO: 3023993 - protein, 25 aa, Entamoeba invadens
YEEVLRGFLLLHKVMREGNFKVFSF

SEQ ID NO: 3023994 - protein, 20 aa, Entamoeba invadens
YEFIVLKRDEPLHPEVIVTQ

SEQ ID NO: 3023995 - protein, 30 aa, Entamoeba invadens
YEFKYGKFKLKRICAIPSFIVTFVAEIDTQ

SEQ ID NO: 3023996 - protein, 22 aa, Entamoeba invadens
YEFQEKYNLNLTISGLRKEKGE

SEQ ID NO: 3023997 - protein, 24 aa, Entamoeba invadens
YEFSKILLVNYRVYCKSVELLQLV

SEQ ID NO: 3023998 - protein, 26 aa, Entamoeba invadens
YEGDWLDLLEKLRPYFDVDVLTVIQN

SEQ ID NO: 3023999 - protein, 32 aa, Entamoeba invadens
YEGGKFQLDIFLPAEFPYKPPMIKFATRVYHP

SEQ ID NO: 3024000 - protein, 28 aa, Entamoeba invadens
YEGKDVLYLIAINYLKLLKPDLMKANTA

SEQ ID NO: 3024001 - protein, 19 aa, Entamoeba invadens
YEGKIKENESWDWKNEKFS

SEQ ID NO: 3024002 - protein, 18 aa, Entamoeba invadens
YEHLGIFAMIPQFNVKRP

SEQ ID NO: 3024003 - protein, 20 aa, Entamoeba invadens
YEIDFPISFGVFQKFLKNGV

SEQ ID NO: 3024004 - protein, 20 aa, Entamoeba invadens
YEIDFPVSFGVFQKFLKNGV

SEQ ID NO: 3024005 - protein, 26 aa, Entamoeba invadens
YEIDSHFLFNLGIENALLPYITNPKC

SEQ ID NO: 3024006 - protein, 27 aa, Entamoeba invadens
YEIFEPYHAFFIPPNYPHGYISGECVE

SEQ ID NO: 3024007 - protein, 19 aa, Entamoeba invadens
YEIGIFDGCKIYLVLLLKK

SEQ ID NO: 3024008 - protein, 17 aa, Entamoeba invadens
YEILKFADLCSQNLNLI

SEQ ID NO: 3024009 - protein, 18 aa, Entamoeba invadens
YEILKKRPIFIGISFEKF

SEQ ID NO: 3024010 - protein, 17 aa, Entamoeba invadens
YEIPYAEAIYEKLNFNK

SEQ ID NO: 3024011 - protein, 18 aa, Entamoeba invadens
YEIQLGCRLSKKANIVKF

SEQ ID NO: 3024012 - protein, 26 aa, Entamoeba invadens
YEISCKKMIFKEKVVFIYTINNTLPD

SEQ ID NO: 3024013 - protein, 25 aa, Entamoeba invadens
YEKCYETFLWIFGKVIQKEETDLIK

SEQ ID NO: 3024014 - protein, 18 aa, Entamoeba invadens
YEKELETNSFRKARLQTT

SEQ ID NO: 3024015 - protein, 33 aa, Entamoeba invadens
YEKFEILIRFLRLKKIIISLLKKGIDGTKRNRI

SEQ ID NO: 3024016 - protein, 20 aa, Entamoeba invadens
YEKFLGLLAQKIELKGFPKF

SEQ ID NO: 3024017 - protein, 27 aa, Entamoeba invadens
YEKKKRIFINNFLVDVALELGFVFDSK

SEQ ID NO: 3024018 - protein, 27 aa, Entamoeba invadens
YEKKLTELNEQLDLERITAQQAKAQKK

SEQ ID NO: 3024019 - protein, 22 aa, Entamoeba invadens
YEKKLTELNEQLDLERTTAQQT

SEQ ID NO: 3024020 - protein, 27 aa, Entamoeba invadens
YEKLISGIYLGWLSRLVIRELMQKKVC

SEQ ID NO: 3024021 - protein, 37 aa, Entamoeba invadens
YEKLISGIYMGWLARLCIRELIKKKVIFPNHLNAEAF

SEQ ID NO: 3024022 - protein, 31 aa, Entamoeba invadens
YEKNKRIFIHNLLFDIALELGFFFDSKLSRK

SEQ ID NO: 3024023 - protein, 28 aa, Entamoeba invadens
YEKNKRIFVHNLLFDIALELGFFFESKL

SEQ ID NO: 3024024 - protein, 18 aa, Entamoeba invadens
YEKTRKRENEKTRKRENE

SEQ ID NO: 3024025 - protein, 25 aa, Entamoeba invadens
YEKVQYFSHVIPRLYLMCTVGSACI

SEQ ID NO: 3024026 - protein, 27 aa, Entamoeba invadens
YEKYNHVPLFNEMLLVALKYGCTLLLP

SEQ ID NO: 3024027 - protein, 18 aa, Entamoeba invadens
YELILFTSADQRYADQIL

SEQ ID NO: 3024028 - protein, 24 aa, Entamoeba invadens
YELKRVLQLLTKLNKLWDMADFHT

SEQ ID NO: 3024029 - protein, 18 aa, Entamoeba invadens
YELLWNKLAYKANVPLDV

SEQ ID NO: 3024030 - protein, 22 aa, Entamoeba invadens
YELNGDFYSVPLILKEYEEKKT

SEQ ID NO: 3024031 - protein, 20 aa, Entamoeba invadens
YELTHATLLMQYPRQEMFQI

SEQ ID NO: 3024032 - protein, 24 aa, Entamoeba invadens
YENHKYFGIVRMYGDVQLSQTKIT

SEQ ID NO: 3024033 - protein, 22 aa, Entamoeba invadens
YENIGGFYKHLSEWSGLTRPKV

SEQ ID NO: 3024034 - protein, 30 aa, Entamoeba invadens
YENKKWKKRYLLWKGMTLYLFDKKGTKEPS

SEQ ID NO: 3024035 - protein, 24 aa, Entamoeba invadens
YENQIFCGITAVVPLMMYCKAVGC

SEQ ID NO: 3024036 - protein, 19 aa, Entamoeba invadens
YENSPFWMKETVLGVIGGY

SEQ ID NO: 3024037 - protein, 17 aa, Entamoeba invadens
YEPLIPRTSTTLVRFLT

SEQ ID NO: 3024038 - protein, 24 aa, Entamoeba invadens
YEQARDFFFYLRNEMIDDMKKMND

SEQ ID NO: 3024039 - protein, 24 aa, Entamoeba invadens
YEQFQLKHQLAFSRRQLKQTLEVK

SEQ ID NO: 3024040 - protein, 26 aa, Entamoeba invadens
YERDMDLKSLPLAALMDFLCVHVDPK

SEQ ID NO: 3024041 - protein, 25 aa, Entamoeba invadens
YERELVFYRQALTSVVQARQIFNEM

SEQ ID NO: 3024042 - protein, 21 aa, Entamoeba invadens
YERRCVTCDTGYYPGSNGTCV

SEQ ID NO: 3024043 - protein, 23 aa, Entamoeba invadens
YERSMCGTSPFLLACAYGQLEMA

SEQ ID NO: 3024044 - protein, 19 aa, Entamoeba invadens
YERVVRYIKYLFGVLEQLK

SEQ ID NO: 3024045 - protein, 23 aa, Entamoeba invadens
YESALCGTFKKIPIFVVCSCGKE

SEQ ID NO: 3024046 - protein, 31 aa, Entamoeba invadens
YESDQKFQLPLMYGKNLIFKTGGVDATHCDD

SEQ ID NO: 3024047 - protein, 20 aa, Entamoeba invadens
YESLKIPYRVVNIVSGALNN

SEQ ID NO: 3024048 - protein, 19 aa, Entamoeba invadens
YESQIKAFEAQKKMALDDK

SEQ ID NO: 3024049 - protein, 24 aa, Entamoeba invadens
YESQNYYLLSLSLPNILTSTLQVK

SEQ ID NO: 3024050 - protein, 22 aa, Entamoeba invadens
YESYDRKIFGIAIPECVNSLGE

SEQ ID NO: 3024051 - protein, 29 aa, Entamoeba invadens
YETFNWGDAYPKNKFQYAWSIADFVTSGK

SEQ ID NO: 3024052 - protein, 18 aa, Entamoeba invadens
YETIQYVELNWLIHFELH

SEQ ID NO: 3024053 - protein, 18 aa, Entamoeba invadens
YETKYTFVLSKKNSQSGA

SEQ ID NO: 3024054 - protein, 18 aa, Entamoeba invadens
YETLDLYDGLIEYLENFN

SEQ ID NO: 3024055 - protein, 19 aa, Entamoeba invadens
YETLLFQTETHRLPSFFFP

SEQ ID NO: 3024056 - protein, 17 aa, Entamoeba invadens
YETLLSEKIAEIERMSG

SEQ ID NO: 3024057 - protein, 25 aa, Entamoeba invadens
YETYMKTFNFFLDYDEPVLKDESVA

SEQ ID NO: 3024058 - protein, 20 aa, Entamoeba invadens
YEVCNTYLGFSSWTNEIVYV

SEQ ID NO: 3024059 - protein, 29 aa, Entamoeba invadens
YEVKYQFNFFYLFQTLEDMLLLLCSCDYA

SEQ ID NO: 3024060 - protein, 23 aa, Entamoeba invadens
YEVLYHRWVPHNSKVLEIAFNKE

SEQ ID NO: 3024061 - protein, 24 aa, Entamoeba invadens
YEVNFFGLKPPVVAMQLVLFDQNA

SEQ ID NO: 3024062 - protein, 28 aa, Entamoeba invadens
YEVVGWCKAYPTETFKFPWKIAEFVMSG

SEQ ID NO: 3024063 - protein, 18 aa, Entamoeba invadens
YEVYKRRCRRFKDTMKKL

SEQ ID NO: 3024064 - protein, 20 aa, Entamoeba invadens
YEWILTEFAFHRQGIILVPL

SEQ ID NO: 3024065 - protein, 18 aa, Entamoeba invadens
YEWYVSQFAAQKYGIIPV

SEQ ID NO: 3024066 - protein, 18 aa, Entamoeba invadens
YEYAIKQSFNLLFKIQVC

SEQ ID NO: 3024067 - protein, 18 aa, Entamoeba invadens
YEYGIDDVLLIIQVLDCN

SEQ ID NO: 3024068 - protein, 26 aa, Entamoeba invadens
YEYSGMVLEVFLRRTKSSEIEKRKVA

SEQ ID NO: 3024069 - protein, 18 aa, Entamoeba invadens
YEYSIMYPAFIKEAELEH

SEQ ID NO: 3024070 - protein, 27 aa, Entamoeba invadens
YFAKYTNLCEIVLPTTLQIIKNSIFDK

SEQ ID NO: 3024071 - protein, 22 aa, Entamoeba invadens
YFCAKWCGPCCAFQPIFDEIVS

SEQ ID NO: 3024072 - protein, 17 aa, Entamoeba invadens
YFCLHPYASGVFSFRDR

SEQ ID NO: 3024073 - protein, 28 aa, Entamoeba invadens
YFCNGKIEGLLLSHIMFHLSSTGHKNVK

SEQ ID NO: 3024074 - protein, 19 aa, Entamoeba invadens
YFCSCADKELFAFKTSIKE

SEQ ID NO: 3024075 - protein, 17 aa, Entamoeba invadens
YFDDELDFENMKKSPLF

SEQ ID NO: 3024076 - protein, 17 aa, Entamoeba invadens
YFDDVYPSVIAVFGGCN

SEQ ID NO: 3024077 - protein, 27 aa, Entamoeba invadens
YFDFQNLKAGFGNYFFYITRNVENIQK

SEQ ID NO: 3024078 - protein, 22 aa, Entamoeba invadens
YFDFSKFFFVEDFDVLFDKTHI

SEQ ID NO: 3024079 - protein, 18 aa, Entamoeba invadens
YFDLYRLHKYSLLTNVEV

SEQ ID NO: 3024080 - protein, 22 aa, Entamoeba invadens
YFDNAIGCAINLFFKNCNDVIS

SEQ ID NO: 3024081 - protein, 20 aa, Entamoeba invadens
YFDNVYPSVIAAFGGCTFGF

SEQ ID NO: 3024082 - protein, 20 aa, Entamoeba invadens
YFEATTVISLYPTVNPPRRN

SEQ ID NO: 3024083 - protein, 19 aa, Entamoeba invadens
YFEFVNLLIEFLNEAARTG

SEQ ID NO: 3024084 - protein, 19 aa, Entamoeba invadens
YFEIDEFHFFVRNYDKIKN

SEQ ID NO: 3024085 - protein, 17 aa, Entamoeba invadens
YFEIFDTDRDKMIARAD

SEQ ID NO: 3024086 - protein, 44 aa, Entamoeba invadens
YFEKGNARFPIEKFTTQDLDMDTLNAFLIAMKTATRTRDQDLIN

SEQ ID NO: 3024087 - protein, 17 aa, Entamoeba invadens
YFEKLINVALEALMTRV

SEQ ID NO: 3024088 - protein, 21 aa, Entamoeba invadens
YFESPFLFKKSTKSKFEKDKI

SEQ ID NO: 3024089 - protein, 19 aa, Entamoeba invadens
YFETCFYFHRQRPFATLVH

SEQ ID NO: 3024090 - protein, 17 aa, Entamoeba invadens
YFFDCRLIVGQKKVSVN

SEQ ID NO: 3024091 - protein, 28 aa, Entamoeba invadens
YFFQHKSDVFVPTLYLAMSYPEMMTKVQ

SEQ ID NO: 3024092 - protein, 18 aa, Entamoeba invadens
YFFSDIATLLTITDPLSY

SEQ ID NO: 3024093 - protein, 27 aa, Entamoeba invadens
YFGEFEFFHFLVQNLVALVYYNTDKRN

SEQ ID NO: 3024094 - protein, 26 aa, Entamoeba invadens
YFGELLSRQILFVGRTILVDSIKFGP

SEQ ID NO: 3024095 - protein, 24 aa, Entamoeba invadens
YFGELSCPLIYSSYIFAAQVAMTS

SEQ ID NO: 3024096 - protein, 18 aa, Entamoeba invadens
YFGVDKLKAIVLPDTISA

SEQ ID NO: 3024097 - protein, 38 aa, Entamoeba invadens
YFHGQIKPLMIRVKTCFIELWEYIFKKGSPMVEYEGQP

SEQ ID NO: 3024098 - protein, 20 aa, Entamoeba invadens
YFHMFVGNNYWGKTEKISLF

SEQ ID NO: 3024099 - protein, 18 aa, Entamoeba invadens
YFIAGYRFKCKIGEVIEF

SEQ ID NO: 3024100 - protein, 17 aa, Entamoeba invadens
YFIHSQPAPIYLSPIDL

SEQ ID NO: 3024101 - protein, 18 aa, Entamoeba invadens
YFIPTFGSYYLDSTGKGA

SEQ ID NO: 3024102 - protein, 26 aa, Entamoeba invadens
YFKHTKKVFLTYLLSNVESVTALQFW

SEQ ID NO: 3024103 - protein, 17 aa, Entamoeba invadens
YFKRCGVDYSFCFRWIV

SEQ ID NO: 3024104 - protein, 20 aa, Entamoeba invadens
YFKRYPITRDFRTIEKRELT

SEQ ID NO: 3024105 - protein, 21 aa, Entamoeba invadens
YFKYIGVVDFDLIDGVLACAL

SEQ ID NO: 3024106 - protein, 21 aa, Entamoeba invadens
YFLILNIEIVTTRVLLDECLN

SEQ ID NO: 3024107 - protein, 18 aa, Entamoeba invadens
YFLSFDFFNIQGDKKNYM

SEQ ID NO: 3024108 - protein, 17 aa, Entamoeba invadens
YFLVKKAYIDVLTNDKQ

SEQ ID NO: 3024109 - protein, 18 aa, Entamoeba invadens
YFMTLAKDVCWHVRYVCA

SEQ ID NO: 3024110 - protein, 17 aa, Entamoeba invadens
YFNAIHLDVIIFLTSVQ

SEQ ID NO: 3024111 - protein, 30 aa, Entamoeba invadens
YFNAYRIDHILGFFRIWSIPAQHRTGLLGR

SEQ ID NO: 3024112 - protein, 17 aa, Entamoeba invadens
YFNDLYTFSKETLCSIG

SEQ ID NO: 3024113 - protein, 18 aa, Entamoeba invadens
YFNGKWVVSRSVTWEINE

SEQ ID NO: 3024114 - protein, 17 aa, Entamoeba invadens
YFNMCVLGRQNIGIIII

SEQ ID NO: 3024115 - protein, 21 aa, Entamoeba invadens
YFNNFILINQKAGEGQISFTL

SEQ ID NO: 3024116 - protein, 18 aa, Entamoeba invadens
YFNPLPESDFKSVLAGFY

SEQ ID NO: 3024117 - protein, 21 aa, Entamoeba invadens
YFNPMTKLMIYPNYKELIDNV

SEQ ID NO: 3024118 - protein, 26 aa, Entamoeba invadens
YFPEDALRLFPLIVNKFWGDKSVHIH

SEQ ID NO: 3024119 - protein, 17 aa, Entamoeba invadens
YFPNIETLNIWSDSAET

SEQ ID NO: 3024120 - protein, 17 aa, Entamoeba invadens
YFPNIETLNIWSVDDEC

SEQ ID NO: 3024121 - protein, 17 aa, Entamoeba invadens
YFPNIETLNLWSDKADT

SEQ ID NO: 3024122 - protein, 17 aa, Entamoeba invadens
YFPNVETFYLWNEGDEK

SEQ ID NO: 3024123 - protein, 35 aa, Entamoeba invadens
YFPSIQTIRLPCFSLFFLPTIFPAILNIEVLYDVQ

SEQ ID NO: 3024124 - protein, 25 aa, Entamoeba invadens
YFPSLETMYLHTPKTAILRSVGKEV

SEQ ID NO: 3024125 - protein, 18 aa, Entamoeba invadens
YFQNIKTLNLWYEKDENF

SEQ ID NO: 3024126 - protein, 24 aa, Entamoeba invadens
YFQNRRYEFFLSNPSQSRSGACWF

SEQ ID NO: 3024127 - protein, 18 aa, Entamoeba invadens
YFQTLYTNPIEAPTLFFF

SEQ ID NO: 3024128 - protein, 26 aa, Entamoeba invadens
YFQVGNGDLIVFLRTTDSKLVCKYKM

SEQ ID NO: 3024129 - protein, 17 aa, Entamoeba invadens
YFRHCGIIKKISPDEFD

SEQ ID NO: 3024130 - protein, 21 aa, Entamoeba invadens
YFRRFKLEREDWSKNVKILYI

SEQ ID NO: 3024131 - protein, 25 aa, Entamoeba invadens
YFSATPFEGYFPKELLSKIFAMSES

SEQ ID NO: 3024132 - protein, 31 aa, Entamoeba invadens
YFSAYRIDHILGFFRIWSIPAGHRTGLLGRF

SEQ ID NO: 3024133 - protein, 32 aa, Entamoeba invadens
YFSESVANFLFPTRKVFWEIQKKIYYSNNFRK

SEQ ID NO: 3024134 - protein, 17 aa, Entamoeba invadens
YFSLFVRFVFSDGSFEE

SEQ ID NO: 3024135 - protein, 26 aa, Entamoeba invadens
YFSLKTDIFVFIKSHWDVLNKFKQFK

SEQ ID NO: 3024136 - protein, 28 aa, Entamoeba invadens
YFSLKVDIFPFVTTHWRILSVFKQLRGS

SEQ ID NO: 3024137 - protein, 32 aa, Entamoeba invadens
YFSLKYDVHWFIVDHWYLFSQLEQFRTNPNKW

SEQ ID NO: 3024138 - protein, 41 aa, Entamoeba invadens
YFSSEIIVISRLLLLTLTPFKLIEILWKVYTTSHLMTRSTC

SEQ ID NO: 3024139 - protein, 25 aa, Entamoeba invadens
YFTQYLCYEIMFHVSTLLPEQPGDL

SEQ ID NO: 3024140 - protein, 21 aa, Entamoeba invadens
YFTYFYCIHNKLLTNIYNHLS

SEQ ID NO: 3024141 - protein, 17 aa, Entamoeba invadens
YFTYTKHETLCSTYLIG

SEQ ID NO: 3024142 - protein, 18 aa, Entamoeba invadens
YFVMTSYPSKRLADVMNK

SEQ ID NO: 3024143 - protein, 25 aa, Entamoeba invadens
YFVNQVMFHVAPLLPPTIGEQQLER

SEQ ID NO: 3024144 - protein, 19 aa, Entamoeba invadens
YFVRPKMIKGIDNLEIYNN

SEQ ID NO: 3024145 - protein, 19 aa, Entamoeba invadens
YFYRHKFSVFLVDLPGHGK

SEQ ID NO: 3024146 - protein, 26 aa, Entamoeba invadens
YFYSADTVLLLPEQFLKTLPIDQKAK

SEQ ID NO: 3024147 - protein, 17 aa, Entamoeba invadens
YFYVLGKQYFTLGNYEA

SEQ ID NO: 3024148 - protein, 17 aa, Entamoeba invadens
YGAIKDTTPNWTCKRCS

SEQ ID NO: 3024149 - protein, 25 aa, Entamoeba invadens
YGALEPLDLFSIKNTLLLNVVVEYL

SEQ ID NO: 3024150 - protein, 17 aa, Entamoeba invadens
YGALFPTGETIGDILIL

SEQ ID NO: 3024151 - protein, 22 aa, Entamoeba invadens
YGCATCHDGYYKNKYYKCSKCN

SEQ ID NO: 3024152 - protein, 22 aa, Entamoeba invadens
YGCAVCHDGYYKNKYYKCTKCN

SEQ ID NO: 3024153 - protein, 23 aa, Entamoeba invadens
YGCAVCLDGYYQNKYLKCPKCVK

SEQ ID NO: 3024154 - protein, 28 aa, Entamoeba invadens
YGCGQVPDKVILYYAYEKEGDSYKEDLD

SEQ ID NO: 3024155 - protein, 23 aa, Entamoeba invadens
YGCIVKKFLYKLTGANVRMNWES

SEQ ID NO: 3024156 - protein, 21 aa, Entamoeba invadens
YGCLICGDRYHLRSELNGCTD

SEQ ID NO: 3024157 - protein, 25 aa, Entamoeba invadens
YGCNQMCFPPPPPFFGRFGGWERGR

SEQ ID NO: 3024158 - protein, 25 aa, Entamoeba invadens
YGCNQMCFPPPPPPFFGRFGGWERG

SEQ ID NO: 3024159 - protein, 20 aa, Entamoeba invadens
YGCQKLINLVIPPTKFTCEE

SEQ ID NO: 3024160 - protein, 26 aa, Entamoeba invadens
YGCTVSLFEHWLPRFGIEVDLVDTSD

SEQ ID NO: 3024161 - protein, 27 aa, Entamoeba invadens
YGCTVSLFNHWLPRFGIQVDFVDTSDV

SEQ ID NO: 3024162 - protein, 26 aa, Entamoeba invadens
YGCTVSLFTHWLPRFGVEVDLVDTSD

SEQ ID NO: 3024163 - protein, 25 aa, Entamoeba invadens
YGDGGYVFGIYLQEPVVVLDKWVTD

SEQ ID NO: 3024164 - protein, 18 aa, Entamoeba invadens
YGDILPQSCAFLSLSESC

SEQ ID NO: 3024165 - protein, 24 aa, Entamoeba invadens
YGDLPVLLISRPFNLEGCSWGVKF

SEQ ID NO: 3024166 - protein, 22 aa, Entamoeba invadens
YGDMYIKRYLKSPIQIFDIYKE

SEQ ID NO: 3024167 - protein, 25 aa, Entamoeba invadens
YGDVYTRIFWLHRAGGICVCSDPVF

SEQ ID NO: 3024168 - protein, 35 aa, Entamoeba invadens
YGEFEKVFSKMFNLRWINFIGNPIDDKGFLKRLQK

SEQ ID NO: 3024169 - protein, 26 aa, Entamoeba invadens
YGEGKDTMLFVLRKNTRKDLSCEQIV

SEQ ID NO: 3024170 - protein, 27 aa, Entamoeba invadens
YGEHQCKFIFALKKLSLTDLAHGMCLI

SEQ ID NO: 3024171 - protein, 21 aa, Entamoeba invadens
YGEMYLDCLLRDIRLMFGEFE

SEQ ID NO: 3024172 - protein, 25 aa, Entamoeba invadens
YGETKLISFVLPLKALQINGKALTE

SEQ ID NO: 3024173 - protein, 27 aa, Entamoeba invadens
YGEYSHLCLLPYLRAVTKDIIQVLMSE

SEQ ID NO: 3024174 - protein, 26 aa, Entamoeba invadens
YGEYSHLCLLPYLRAVTRDIIQSLMS

SEQ ID NO: 3024175 - protein, 25 aa, Entamoeba invadens
YGFAQSYLRLLSYYVTLDSADVSKN

SEQ ID NO: 3024176 - protein, 34 aa, Entamoeba invadens; identical to SEQ ID NO: 2730820

SEQ ID NO: 3024177 - protein, 19 aa, Entamoeba invadens
YGFFVLVFEKEEDMFWAGV

SEQ ID NO: 3024178 - protein, 28 aa, Entamoeba invadens
YGFIPTEPLFVILANPTYLPIVGNNQTE

SEQ ID NO: 3024179 - protein, 22 aa, Entamoeba invadens
YGFNVVMACRNLVKVILNDYLE

SEQ ID NO: 3024180 - protein, 19 aa, Entamoeba invadens
YGFSAVRRFLVKNDMVCIV

SEQ ID NO: 3024181 - protein, 17 aa, Entamoeba invadens
YGFVSFANPTEFLSALR

SEQ ID NO: 3024182 - protein, 24 aa, Entamoeba invadens
YGGKVGDRYPKFDKALLPTKAELD

SEQ ID NO: 3024183 - protein, 33 aa, Entamoeba invadens
YGGLEPLFTFLGLNPLVFLMIRPVVSDLYVDKR

SEQ ID NO: 3024184 - protein, 21 aa, Entamoeba invadens
YGIEIFLQFLCNGWKNPTPQI

SEQ ID NO: 3024185 - protein, 17 aa, Entamoeba invadens
YGIILDKVGEGFTVYYF

SEQ ID NO: 3024186 - protein, 23 aa, Entamoeba invadens
YGITAWELFYQEEPYHELRSVFD

SEQ ID NO: 3024187 - protein, 24 aa, Entamoeba invadens
YGKDIQIHFAGHGPALFGNERINK

SEQ ID NO: 3024188 - protein, 17 aa, Entamoeba invadens
YGKKYTDLNELRYGCVM

SEQ ID NO: 3024189 - protein, 30 aa, Entamoeba invadens
YGKLLAFDLEKYIKAFYIPALMDKNGNGAL

SEQ ID NO: 3024190 - protein, 31 aa, Entamoeba invadens
YGKLLAFDLEKYIKAFYIPALMDKNGNGALI

SEQ ID NO: 3024191 - protein, 22 aa, Entamoeba invadens
YGKMLKMDKFDYGYRGELAPID

SEQ ID NO: 3024192 - protein, 28 aa, Entamoeba invadens
YGKNKTYYYYTYRGTTFYVKVFEDGNKP

SEQ ID NO: 3024193 - protein, 23 aa, Entamoeba invadens
YGKRTAALGYMFHAFKKSRCNKA

SEQ ID NO: 3024194 - protein, 20 aa, Entamoeba invadens
YGKYDLFPKCLGKYTNTVLL

SEQ ID NO: 3024195 - protein, 19 aa, Entamoeba invadens
YGKYYLYFTNCLDPSQIAL

SEQ ID NO: 3024196 - protein, 24 aa, Entamoeba invadens
YGLGNMMFPIGVTVPIVLDIFANL

SEQ ID NO: 3024197 - protein, 25 aa, Entamoeba invadens
YGLHPLFYAICNALYYNPNFFNDTF

SEQ ID NO: 3024198 - protein, 18 aa, Entamoeba invadens
YGLVLPTYSLKEAALTLY

SEQ ID NO: 3024199 - protein, 25 aa, Entamoeba invadens
YGMIVWEIILRLITGEHVIPYYSDE

SEQ ID NO: 3024200 - protein, 24 aa, Entamoeba invadens
YGNAGFLKWAPRTLDLFQYSRRDM

SEQ ID NO: 3024201 - protein, 19 aa, Entamoeba invadens
YGNDLIFGFDEIKRIGKEL

SEQ ID NO: 3024202 - protein, 24 aa, Entamoeba invadens
YGNGQFLMKFITDGSIESNDFFNS

SEQ ID NO: 3024203 - protein, 24 aa, Entamoeba invadens
YGNKEIMAILPKKNNITVVHSEKD

SEQ ID NO: 3024204 - protein, 17 aa, Entamoeba invadens
YGQNTFGRKRQFPLYRR

SEQ ID NO: 3024205 - protein, 35 aa, Entamoeba invadens
YGQYAPIFFQFLDCVHILIAQFPNLFEFNEQFLIE

SEQ ID NO: 3024206 - protein, 24 aa, Entamoeba invadens
YGRGICAIFDNYFMKFKCYSPFID

SEQ ID NO: 3024207 - protein, 23 aa, Entamoeba invadens
YGRITPFSIKTVCNIYIEGIDGN

SEQ ID NO: 3024208 - protein, 28 aa, Entamoeba invadens
YGRKKLDVWWMKQAFLDVLKGLEYLHTN

SEQ ID NO: 3024209 - protein, 17 aa, Entamoeba invadens
YGRMQMGLFYPNRYLKL

SEQ ID NO: 3024210 - protein, 28 aa, Entamoeba invadens
YGRVGWKVMKPVILLYDSTPVKEVTTRV

SEQ ID NO: 3024211 - protein, 17 aa, Entamoeba invadens
YGSAPYMSPEAVLKSMK

SEQ ID NO: 3024212 - protein, 18 aa, Entamoeba invadens
YGSFKKTLFFKSETAKLE

SEQ ID NO: 3024213 - protein, 26 aa, Entamoeba invadens
YGTGEAFLFTLVPKVKKYKATMSNTF

SEQ ID NO: 3024214 - protein, 24 aa, Entamoeba invadens
YGTGKTCMLIRLSQNFFDTQHNAT

SEQ ID NO: 3024215 - protein, 28 aa, Entamoeba invadens
YGTIKIDEKTLWILMDLCAVGSVKDLMK

SEQ ID NO: 3024216 - protein, 27 aa, Entamoeba invadens
YGTPNALYLLPKYAEKLMFLGAPKVTL

SEQ ID NO: 3024217 - protein, 25 aa, Entamoeba invadens
YGVTHILFKGMFSNTLESIALPKSL

SEQ ID NO: 3024218 - protein, 31 aa, Entamoeba invadens
YGVVSQMPVFLIFFPHINTLYYNISNAQIEL

SEQ ID NO: 3024219 - protein, 24 aa, Entamoeba invadens
YGYDYQLNLIIYDSVYRTDNINNE

SEQ ID NO: 3024220 - protein, 25 aa, Entamoeba invadens
YGYVTAFFILFRKEVCYYYGCPTCK

SEQ ID NO: 3024221 - protein, 29 aa, Entamoeba invadens
YHADCECLTPLKILFDGKGFKTVNVETMR

SEQ ID NO: 3024222 - protein, 18 aa, Entamoeba invadens
YHAICGIVFAFIRIKEMD

SEQ ID NO: 3024223 - protein, 25 aa, Entamoeba invadens
YHAQKKEIYALDRVIPIALGSPNVE

SEQ ID NO: 3024224 - protein, 20 aa, Entamoeba invadens
YHDIMKKKYYITFAMQKLVT

SEQ ID NO: 3024225 - protein, 18 aa, Entamoeba invadens
YHFKHSNIASFVRQLNIY

SEQ ID NO: 3024226 - protein, 31 aa, Entamoeba invadens
YHFNKVVSSQLLLRRVPPIITSLESLKPAAV

SEQ ID NO: 3024227 - protein, 28 aa, Entamoeba invadens
YHFRCPQFQFLPLPIRKRKLTILMDAIL

SEQ ID NO: 3024228 - protein, 17 aa, Entamoeba invadens
YHIFTNEVPYKDLSNAQ

SEQ ID NO: 3024229 - protein, 25 aa, Entamoeba invadens
YHIHHGKIAGILLPYVVRFNGSFVE

SEQ ID NO: 3024230 - protein, 19 aa, Entamoeba invadens
YHINPLLINTFNTKESPKF

SEQ ID NO: 3024231 - protein, 24 aa, Entamoeba invadens
YHKDVSKICLVYKGEKLANEMVLS

SEQ ID NO: 3024232 - protein, 17 aa, Entamoeba invadens
YHKLFNPIIDRAMEVFQ

SEQ ID NO: 3024233 - protein, 17 aa, Entamoeba invadens
YHLYNMFSLFGSISKVN

SEQ ID NO: 3024234 - protein, 17 aa, Entamoeba invadens
YHMFTNEIPYKDLSNAQ

SEQ ID NO: 3024235 - protein, 21 aa, Entamoeba invadens
YHNQPFWMVVARLEKAMKREG

SEQ ID NO: 3024236 - protein, 17 aa, Entamoeba invadens
YHPTIPTCLVFNFTSQT

SEQ ID NO: 3024237 - protein, 18 aa, Entamoeba invadens
YHSLIPSYIRESRVAVVV

SEQ ID NO: 3024238 - protein, 20 aa, Entamoeba invadens
YHSLMYTQIFSPTISVFINQ

SEQ ID NO: 3024239 - protein, 25 aa, Entamoeba invadens
YHSSRCYHALGFYKYEIATENGKHY

SEQ ID NO: 3024240 - protein, 25 aa, Entamoeba invadens
YHTIKMVDYFLYYGHVCIVTELLSV

SEQ ID NO: 3024241 - protein, 26 aa, Entamoeba invadens
YHTNLHRLYLVLQPSIRFKVTTTFFS

SEQ ID NO: 3024242 - protein, 21 aa, Entamoeba invadens
YHVLSLRMLFAVVGTIENLQF

SEQ ID NO: 3024243 - protein, 24 aa, Entamoeba invadens
YHVNIHFGKFFEFFDHVARLIPSM

SEQ ID NO: 3024244 - protein, 18 aa, Entamoeba invadens
YHWVIDFNNFDTTTHIGR

SEQ ID NO: 3024245 - protein, 24 aa, Entamoeba invadens
YHYKTVRVYLKNSTILVLMSSNIS

SEQ ID NO: 3024246 - protein, 23 aa, Entamoeba invadens
YHYKTVRVYLKNTTILVLMSSNI

SEQ ID NO: 3024247 - protein, 19 aa, Entamoeba invadens
YHYQAVFSLLLVDLKKRVS

SEQ ID NO: 3024248 - protein, 19 aa, Entamoeba invadens
YIAEISYAVKYLHSLHIIH

SEQ ID NO: 3024249 - protein, 17 aa, Entamoeba invadens
YIALHNYGLDNAKHELI

SEQ ID NO: 3024250 - protein, 19 aa, Entamoeba invadens
YIALLKTVFKQCTAQLRIS

SEQ ID NO: 3024251 - protein, 20 aa, Entamoeba invadens
YIALREGLPDTFTTLRNKDF

SEQ ID NO: 3024252 - protein, 21 aa, Entamoeba invadens
YIATNDVIKYAFPMNRIVLLP

SEQ ID NO: 3024253 - protein, 21 aa, Entamoeba invadens
YIAVVIPYLNSLKTAQRLLYV

SEQ ID NO: 3024254 - protein, 20 aa, Entamoeba invadens
YICLKAMMKSLRVFEEVIVW

SEQ ID NO: 3024255 - protein, 19 aa, Entamoeba invadens
YICRLRDIGIYKTQFGMSG

SEQ ID NO: 3024256 - protein, 23 aa, Entamoeba invadens
YICTCSPSITLYFCPACEKCLEK

SEQ ID NO: 3024257 - protein, 18 aa, Entamoeba invadens
YIDLSVIIDKALQTKEEA

SEQ ID NO: 3024258 - protein, 27 aa, Entamoeba invadens
YIDLYDYVKRNYILYRKEAFDAACEDM

SEQ ID NO: 3024259 - protein, 20 aa, Entamoeba invadens
YIEAFLVCEETRFSRSFSGE

SEQ ID NO: 3024260 - protein, 21 aa, Entamoeba invadens
YIECSALTQFNLKELFMEAAK

SEQ ID NO: 3024261 - protein, 23 aa, Entamoeba invadens
YIEDKMYLFLMVAVLVINREFIL

SEQ ID NO: 3024262 - protein, 27 aa, Entamoeba invadens
YIEDTDAFIFSLIRKGKFNPKKFELKS

SEQ ID NO: 3024263 - protein, 17 aa, Entamoeba invadens
YIEKSEVMWVIDKNGGV

SEQ ID NO: 3024264 - protein, 30 aa, Entamoeba invadens
YIENAKLHLWVRRLFGLPFLPKEEIHDAFE

SEQ ID NO: 3024265 - protein, 18 aa, Entamoeba invadens
YIENPIIRLTLAVAYRFL

SEQ ID NO: 3024266 - protein, 17 aa, Entamoeba invadens
YIENTFKSVYPIDQISL

SEQ ID NO: 3024267 - protein, 18 aa, Entamoeba invadens
YIERHGTTVFYNKPILAT

SEQ ID NO: 3024268 - protein, 18 aa, Entamoeba invadens
YIERIEKIFRIYLCFMMS

SEQ ID NO: 3024269 - protein, 22 aa, Entamoeba invadens
YIESFRFGGWPHAGCGIGLERI

SEQ ID NO: 3024270 - protein, 18 aa, Entamoeba invadens
YIESIKDAKRFVLRAREF

SEQ ID NO: 3024271 - protein, 20 aa, Entamoeba invadens
YIEYPVLTYVPDLLLQFCCL

SEQ ID NO: 3024272 - protein, 24 aa, Entamoeba invadens
YIFQCLKSRMFYERFPIERKIANA

SEQ ID NO: 3024273 - protein, 20 aa, Entamoeba invadens
YIFQENHLDLVWSASQTNFS

SEQ ID NO: 3024274 - protein, 17 aa, Entamoeba invadens
YIFQQIIQLFQGQQIQQ

SEQ ID NO: 3024275 - protein, 22 aa, Entamoeba invadens
YIGEYRVPDWNTEWNKIVAQNE

SEQ ID NO: 3024276 - protein, 26 aa, Entamoeba invadens
YIGGIKVVWLRHEFDFIGGSLGCAEG

SEQ ID NO: 3024277 - protein, 22 aa, Entamoeba invadens
YIGKGCFGCVYKASLKGVTVAV

SEQ ID NO: 3024278 - protein, 30 aa, Entamoeba invadens
YIGKVITVSAPLTGAPLALRALITGLSEVV

SEQ ID NO: 3024279 - protein, 19 aa, Entamoeba invadens
YIHLNQLIAQSMSLITASL

SEQ ID NO: 3024280 - protein, 26 aa, Entamoeba invadens
YIIASPFRRTTWSGLPLAPLPKRIEV

SEQ ID NO: 3024281 - protein, 26 aa, Entamoeba invadens
YIIDNDKFMCVLAYSNTTHFNSETLK

SEQ ID NO: 3024282 - protein, 20 aa, Entamoeba invadens
YIIDRVMIKAQFWDLSGQER

SEQ ID NO: 3024283 - protein, 19 aa, Entamoeba invadens
YIIDWIQCTKYPYPFGCNT

SEQ ID NO: 3024284 - protein, 19 aa, Entamoeba invadens
YIIEIKFWGDTSTLPDKLE

SEQ ID NO: 3024285 - protein, 20 aa, Entamoeba invadens
YIIHFYGAVFIPNKICMVTE

SEQ ID NO: 3024286 - protein, 28 aa, Entamoeba invadens
YIIRRKRRFLFTFVKPKKVYLFINKFEK

SEQ ID NO: 3024287 - protein, 19 aa, Entamoeba invadens
YIISLGYQCFCNCNTLSSI

SEQ ID NO: 3024288 - protein, 29 aa, Entamoeba invadens
YIISSTPMPLLRYSLPQLPLTLTQFFKEN

SEQ ID NO: 3024289 - protein, 25 aa, Entamoeba invadens
YIISYIPDAISFLNLLTVSKRYFAH

SEQ ID NO: 3024290 - protein, 18 aa, Entamoeba invadens
YIKAIPKAQITPIIRDGY

SEQ ID NO: 3024291 - protein, 26 aa, Entamoeba invadens
YIKALDSLVRLASLQTAFLTLDTVIK

SEQ ID NO: 3024292 - protein, 19 aa, Entamoeba invadens
YIKFVLKSVSLQPSYLLCA

SEQ ID NO: 3024293 - protein, 19 aa, Entamoeba invadens
YIKIIVMEYTDILVKLLPS

SEQ ID NO: 3024294 - protein, 22 aa, Entamoeba invadens
YIKKVIVHPLVLLSISDHQTRA

SEQ ID NO: 3024295 - protein, 27 aa, Entamoeba invadens
YIKLSKYLCCFGPVTSWHDGNNKVPYL

SEQ ID NO: 3024296 - protein, 24 aa, Entamoeba invadens
YIKSGWFINEGFVSSIFSILKNKK

SEQ ID NO: 3024297 - protein, 29 aa, Entamoeba invadens
YIKSSAIFFLLSVIFPFKYESPVISELCE

SEQ ID NO: 3024298 - protein, 17 aa, Entamoeba invadens
YIKYLFGVLEQLKNDGN

SEQ ID NO: 3024299 - protein, 35 aa, Entamoeba invadens
YILDTFPERLNFQDLYGKSVLFYAVEKQQWDVVEY

SEQ ID NO: 3024300 - protein, 24 aa, Entamoeba invadens
YILHGPLGADLLRTMNLEALARVA

SEQ ID NO: 3024301 - protein, 17 aa, Entamoeba invadens
YILLDMAARETLLKLLF

SEQ ID NO: 3024302 - protein, 26 aa, Entamoeba invadens
YILPEQFLDYHVAKYMKLLGSSEESE

SEQ ID NO: 3024303 - protein, 18 aa, Entamoeba invadens
YILPGGLQIVLGTVTRVL

SEQ ID NO: 3024304 - protein, 22 aa, Entamoeba invadens
YILSMQCCIDFFYTTLKDDRKS

SEQ ID NO: 3024305 - protein, 51 aa, Entamoeba invadens
YIMAKVYGDPLKFFLVFTPTKFPWFNQEMMNFFLSKYLPDYPQMTVTRRLE

SEQ ID NO: 3024306 - protein, 39 aa, Entamoeba invadens
YIMCHNMSYYIERLFALYLPMMVGYQVYIAPDVLYREGL

SEQ ID NO: 3024307 - protein, 28 aa, Entamoeba invadens
YIMNALYEHNFIWIDSIWKWKEVCVSTP

SEQ ID NO: 3024308 - protein, 26 aa, Entamoeba invadens
YIMRFYGGIQHVPAWMIDALKKAEVS

SEQ ID NO: 3024309 - protein, 29 aa, Entamoeba invadens
YIMTTTFDQMLILFLFNTESKLKIKEIAE

SEQ ID NO: 3024310 - protein, 18 aa, Entamoeba invadens
YINLPKRSIDPKLFIESL

SEQ ID NO: 3024311 - protein, 42 aa, Entamoeba invadens
YINPFNLPQIIPIQKIVTLFPKLETLYLPYKVDYDLSFLENL

SEQ ID NO: 3024312 - protein, 33 aa, Entamoeba invadens
YINPTPGGLILLGAPNVIFKKCTDLGFMLDSAN

SEQ ID NO: 3024313 - protein, 35 aa, Entamoeba invadens
YINPYSLPVNVLIQKIVKLFPKLETLYIPYTIYEN

SEQ ID NO: 3024314 - protein, 35 aa, Entamoeba invadens
YINQHAVILTLNYSTLLLNIFKNQYAKGTDFKVIV

SEQ ID NO: 3024315 - protein, 24 aa, Entamoeba invadens
YINRINFSLFAMKQLRCLDLTGNA

SEQ ID NO: 3024316 - protein, 26 aa, Entamoeba invadens
YINSIVPVLYTFLKTKLVYTDQAYAR

SEQ ID NO: 3024317 - protein, 27 aa, Entamoeba invadens
YINSYLVQIKFFLMTKFLMSGVRLELY

SEQ ID NO: 3024318 - protein, 18 aa, Entamoeba invadens
YINWDYWVLSKVQEVFGG

SEQ ID NO: 3024319 - protein, 18 aa, Entamoeba invadens
YIPAVKIFVEIMSSPILH

SEQ ID NO: 3024320 - protein, 24 aa, Entamoeba invadens
YIPKNSFCVILPKNIKNITKITGE

SEQ ID NO: 3024321 - protein, 21 aa, Entamoeba invadens
YIPLQIYELLQTLGAPSIYIF

SEQ ID NO: 3024322 - protein, 17 aa, Entamoeba invadens
YIPPLYIEVYTYTSAEF

SEQ ID NO: 3024323 - protein, 30 aa, Entamoeba invadens
YIPQKPNFGNPYPPIRPLTRHPASNPRTTK

SEQ ID NO: 3024324 - protein, 20 aa, Entamoeba invadens
YIPQVSMVIQFFVLGSLSEY

SEQ ID NO: 3024325 - protein, 18 aa, Entamoeba invadens
YIPRHCSVTHTLIAPDDH

SEQ ID NO: 3024326 - protein, 24 aa, Entamoeba invadens
YIPRPRKPFLPQATFLAKSGVSPL

SEQ ID NO: 3024327 - protein, 25 aa, Entamoeba invadens
YIPWITLSRIFYLSLMHKYPSQEYF

SEQ ID NO: 3024328 - protein, 20 aa, Entamoeba invadens
YIQATNLFSNEKELLLDDMQ

SEQ ID NO: 3024329 - protein, 19 aa, Entamoeba invadens
YIQFTPYIADFPTTFESFV

SEQ ID NO: 3024330 - protein, 24 aa, Entamoeba invadens
YIQGRLKRFQLMDLNYMDDAQIDE

SEQ ID NO: 3024331 - protein, 19 aa, Entamoeba invadens
YIQLRSYVAPAFSFGTQAV

SEQ ID NO: 3024332 - protein, 19 aa, Entamoeba invadens
YIREPILKSLQYSTTMMFF

SEQ ID NO: 3024333 - protein, 18 aa, Entamoeba invadens
YIRFPSFITDFLNGTLTK

SEQ ID NO: 3024334 - protein, 25 aa, Entamoeba invadens
YIRHNNLYFMAFTDQNINSLLVVSF

SEQ ID NO: 3024335 - protein, 20 aa, Entamoeba invadens
YIRNNAFETLLYLKEIKLPN

SEQ ID NO: 3024336 - protein, 18 aa, Entamoeba invadens
YIRQCKNFRIGLMSKTKI

SEQ ID NO: 3024337 - protein, 17 aa, Entamoeba invadens
YIRSFIPAIEETDDYYF

SEQ ID NO: 3024338 - protein, 37 aa, Entamoeba invadens
YIRSKLSMYGLIERVTIPRGEQVYAFVKFANTESASM

SEQ ID NO: 3024339 - protein, 17 aa, Entamoeba invadens
YISAFIVYIEITKVNKH

SEQ ID NO: 3024340 - protein, 30 aa, Entamoeba invadens
YISLREQYYIKGDGFVMVYSIDNKNSFHAL

SEQ ID NO: 3024341 - protein, 31 aa, Entamoeba invadens
YISLREQYYLKGDAFVLVYSIDNKNSFHALK

SEQ ID NO: 3024342 - protein, 24 aa, Entamoeba invadens
YISLSIVLKYMFDNCWPKAIELLT

SEQ ID NO: 3024343 - protein, 24 aa, Entamoeba invadens
YISRIVFDPVYHESLLLIAAKDNK

SEQ ID NO: 3024344 - protein, 18 aa, Entamoeba invadens
YISTIIPCIIGCTNGTYG

SEQ ID NO: 3024345 - protein, 18 aa, Entamoeba invadens
YITALKFSNKEMLENQVQ

SEQ ID NO: 3024346 - protein, 26 aa, Entamoeba invadens
YITDENAFVFLLRDNGKEKMRNFYQR

SEQ ID NO: 3024347 - protein, 17 aa, Entamoeba invadens
YITKFLTTKIFDVFFHC

SEQ ID NO: 3024348 - protein, 19 aa, Entamoeba invadens
YITNLHSAVLFLLDLKQVN

SEQ ID NO: 3024349 - protein, 19 aa, Entamoeba invadens
YIVEHLLAQNIQEIFIACS

SEQ ID NO: 3024350 - protein, 18 aa, Entamoeba invadens
YIVHFYGAVFARNKVCMV

SEQ ID NO: 3024351 - protein, 19 aa, Entamoeba invadens
YIVHFYGAVFIPKKECMVT

SEQ ID NO: 3024352 - protein, 19 aa, Entamoeba invadens
YIVHFYGAVFIPNKICMVT

SEQ ID NO: 3024353 - protein, 17 aa, Entamoeba invadens
YIVHFYGAVFIPNKVCM

SEQ ID NO: 3024354 - protein, 19 aa, Entamoeba invadens
YIVHFYGAVFIPTKYSMVT

SEQ ID NO: 3024355 - protein, 19 aa, Entamoeba invadens
YIVHFYGAVFVPNKICMVT

SEQ ID NO: 3024356 - protein, 33 aa, Entamoeba invadens
YIVPLVCFHIDFYVRMFIIVKSSVSLSGELPLH

SEQ ID NO: 3024357 - protein, 20 aa, Entamoeba invadens
YIVRYIASTQSHGCLYIVME

SEQ ID NO: 3024358 - protein, 18 aa, Entamoeba invadens
YIVSYLREQMPTFGKDKK

SEQ ID NO: 3024359 - protein, 17 aa, Entamoeba invadens
YIWVKASLLGNGIIKME

SEQ ID NO: 3024360 - protein, 19 aa, Entamoeba invadens
YKAADLPLSPFGSNVSLFL

SEQ ID NO: 3024361 - protein, 18 aa, Entamoeba invadens
YKAIPEVNLTPKRTILLL

SEQ ID NO: 3024362 - protein, 18 aa, Entamoeba invadens
YKCCRLNIVTISFGVKSI

SEQ ID NO: 3024363 - protein, 26 aa, Entamoeba invadens
YKCKAFRDIVQLILRSVSPCLNSVYV

SEQ ID NO: 3024364 - protein, 27 aa, Entamoeba invadens
YKCKAFRDIVQLILRSVSPCLNSVYVK

SEQ ID NO: 3024365 - protein, 29 aa, Entamoeba invadens
YKDEFMTLQHLLLKYFTKIRVVFNPAKVV

SEQ ID NO: 3024366 - protein, 17 aa, Entamoeba invadens
YKDSKKLYFNAACEMLG

SEQ ID NO: 3024367 - protein, 25 aa, Entamoeba invadens
YKDSTLIMQLLRDNLTLWTSDGGDA

SEQ ID NO: 3024368 - protein, 26 aa, Entamoeba invadens
YKDSTLIMQLLRDNLTLWTTDNAQDD

SEQ ID NO: 3024369 - protein, 25 aa, Entamoeba invadens
YKDSTLIMQLLRDNMTLWTSDMEND

SEQ ID NO: 3024370 - protein, 31 aa, Entamoeba invadens
YKDVAQQIMLMQYDLFRRIPVEELLSQGWMK

SEQ ID NO: 3024371 - protein, 34 aa, Entamoeba invadens
YKDYGTLRFGFRSIVAYAPWIKRIFLVTDGEVPD

SEQ ID NO: 3024372 - protein, 24 aa, Entamoeba invadens
YKEAINYDFLLFTQYWPGQICHEK

SEQ ID NO: 3024373 - protein, 26 aa, Entamoeba invadens
YKEDFAHILFEWIPYGIKTSTNTQQL

SEQ ID NO: 3024374 - protein, 22 aa, Entamoeba invadens
YKEFIQLIGNIIPLKGHKGYKA

SEQ ID NO: 3024375 - protein, 27 aa, Entamoeba invadens
YKEFSRLWPCSLQPPTLPTPPIQKSDF

SEQ ID NO: 3024376 - protein, 19 aa, Entamoeba invadens
YKEKEFCRVGYYVNNEFEG

SEQ ID NO: 3024377 - protein, 27 aa, Entamoeba invadens
YKEKFVDFFSISLTRQPTPPLPQNDIS

SEQ ID NO: 3024378 - protein, 28 aa, Entamoeba invadens
YKEMYYMIEDIPILYTVFSAPNYFCGRY

SEQ ID NO: 3024379 - protein, 20 aa, Entamoeba invadens
YKEPKYDLVLKKSKIIRQKR

SEQ ID NO: 3024380 - protein, 21 aa, Entamoeba invadens
YKESHLRFFKKQPSGAFEQML

SEQ ID NO: 3024381 - protein, 26 aa, Entamoeba invadens
YKESPKLQLMFKDFQKYLSFANNKLY

SEQ ID NO: 3024382 - protein, 26 aa, Entamoeba invadens
YKETAKYFIKLPLQLLESTLPNNLSL

SEQ ID NO: 3024383 - protein, 18 aa, Entamoeba invadens
YKFGWSIADLISIGKRPS

SEQ ID NO: 3024384 - protein, 21 aa, Entamoeba invadens
YKFPSFSGLDFRFLELGDYQK

SEQ ID NO: 3024385 - protein, 21 aa, Entamoeba invadens
YKFTGKKMEFLWTGDMKMNTV

SEQ ID NO: 3024386 - protein, 23 aa, Entamoeba invadens
YKGHFCLPALHDPYNKGLPHFTD

SEQ ID NO: 3024387 - protein, 27 aa, Entamoeba invadens
YKGHMWAKVFIKSKPRRYGIKFWMCAD

SEQ ID NO: 3024388 - protein, 28 aa, Entamoeba invadens
YKGKCLFMSVLFLTKLQGYFSDLEKALQ

SEQ ID NO: 3024389 - protein, 26 aa, Entamoeba invadens
YKGKEWRLCVLFNDIFVIGKVDIRDD

SEQ ID NO: 3024390 - protein, 19 aa, Entamoeba invadens
YKGPLPFYALSLINGKLNV

SEQ ID NO: 3024391 - protein, 27 aa, Entamoeba invadens
YKGTPPSNIFIFDIFDYRMKACGEHDG

SEQ ID NO: 3024392 - protein, 23 aa, Entamoeba invadens
YKGVRIFLAICYDIQYPAFIRRT

SEQ ID NO: 3024393 - protein, 18 aa, Entamoeba invadens
YKGYHKFFNEGAAGFEIE

SEQ ID NO: 3024394 - protein, 20 aa, Entamoeba invadens
YKHLLWVVDHSKWLQHESLL

SEQ ID NO: 3024395 - protein, 27 aa, Entamoeba invadens
YKIDPSTTILLKLEFFNPLSSVKDRVA

SEQ ID NO: 3024396 - protein, 21 aa, Entamoeba invadens
YKIKLITQKEYVKYLEKRLKA

SEQ ID NO: 3024397 - protein, 18 aa, Entamoeba invadens
YKILFDTINTFLETVWGH

SEQ ID NO: 3024398 - protein, 17 aa, Entamoeba invadens
YKIPKQMPGPTKDFWVV

SEQ ID NO: 3024399 - protein, 25 aa, Entamoeba invadens
YKISVNYIITFFKLADTDILKAKRN

SEQ ID NO: 3024400 - protein, 18 aa, Entamoeba invadens
YKKCKSVFLVQPKKQQKW

SEQ ID NO: 3024401 - protein, 28 aa, Entamoeba invadens
YKKDSPVIQWFWEVVFDLDIEQKKQLLV

SEQ ID NO: 3024402 - protein, 28 aa, Entamoeba invadens
YKKKIKDAFFLIDSYFASATYCYNVLAF

SEQ ID NO: 3024403 - protein, 28 aa, Entamoeba invadens
YKKTSGMYYYSTFRSPLRRFADLCVLRQ

SEQ ID NO: 3024404 - protein, 19 aa, Entamoeba invadens
YKKYFIKYSYDDLVNKKFQ

SEQ ID NO: 3024405 - protein, 28 aa, Entamoeba invadens
YKLFTGIKTMEWFFRVEKLCEMMTHTAA

SEQ ID NO: 3024406 - protein, 21 aa, Entamoeba invadens
YKLKIICHNVNFENYNFNEIK

SEQ ID NO: 3024407 - protein, 30 aa, Entamoeba invadens
YKLKKTEEFLFILESKLKLKKAEDLYTSSV

SEQ ID NO: 3024408 - protein, 20 aa, Entamoeba invadens
YKLLLNLRGYADMFVFHRMN

SEQ ID NO: 3024409 - protein, 23 aa, Entamoeba invadens
YKMFIEVSAFVLSNLKKQLIHKT

SEQ ID NO: 3024410 - protein, 26 aa, Entamoeba invadens
YKMKEGTLFVFDFGGGTLDISIVTFK

SEQ ID NO: 3024411 - protein, 20 aa, Entamoeba invadens
YKMLRLSVLNHIGFGGVSLP

SEQ ID NO: 3024412 - protein, 32 aa, Entamoeba invadens
YKMPCDIYSLAISFFEIIGWAEPFPKKRFEHP

SEQ ID NO: 3024413 - protein, 23 aa, Entamoeba invadens
YKMPPSFVVLKRVVQGRDWHYGR

SEQ ID NO: 3024414 - protein, 24 aa, Entamoeba invadens
YKMSLIMYQNGIIPLLQHGSFEIV

SEQ ID NO: 3024415 - protein, 29 aa, Entamoeba invadens
YKMYKIKAENFDWAFSVGVKCSTKFFDVG

SEQ ID NO: 3024416 - protein, 26 aa, Entamoeba invadens
YKNFSAIFEMFLLKELEREYPHKTIN

SEQ ID NO: 3024417 - protein, 24 aa, Entamoeba invadens
YKNMAAWLRTLYENGMEFIRNTPN

SEQ ID NO: 3024418 - protein, 42 aa, Entamoeba invadens
YKNNFPLVDILLLELTILYVQTNMWFVMLVNAIDRMTETQIR

SEQ ID NO: 3024419 - protein, 20 aa, Entamoeba invadens
YKNSIFVDAISHFVPYRLAD

SEQ ID NO: 3024420 - protein, 17 aa, Entamoeba invadens
YKNSKFKFPWKIAEFVV

SEQ ID NO: 3024421 - protein, 17 aa, Entamoeba invadens
YKNVVGSRRASWRIISS

SEQ ID NO: 3024422 - protein, 25 aa, Entamoeba invadens
YKNYDFFCVGIRPPTNLVSKIEKFG

SEQ ID NO: 3024423 - protein, 21 aa, Entamoeba invadens
YKNYHYFVLGAYQTKTRFYAT

SEQ ID NO: 3024424 - protein, 32 aa, Entamoeba invadens
YKNYQVFQESILIKLLLPYCDIVFCKPSKRTT

SEQ ID NO: 3024425 - protein, 18 aa, Entamoeba invadens
YKPGFPVVSLELKDGKLY

SEQ ID NO: 3024426 - protein, 20 aa, Entamoeba invadens
YKPLKLFCKNVEKVYSISMN

SEQ ID NO: 3024427 - protein, 25 aa, Entamoeba invadens
YKQFGPPLQTPLFTLLEQFTSIDIM

SEQ ID NO: 3024428 - protein, 19 aa, Entamoeba invadens
YKQILLKTWVMFDECQVCR

SEQ ID NO: 3024429 - protein, 18 aa, Entamoeba invadens
YKQIMNQAILLFANSSFL

SEQ ID NO: 3024430 - protein, 27 aa, Entamoeba invadens
YKQLVKELYAFERKNDMLTKRKEKRTR

SEQ ID NO: 3024431 - protein, 20 aa, Entamoeba invadens
YKQNIVVLRCCCSVFANVGP

SEQ ID NO: 3024432 - protein, 26 aa, Entamoeba invadens
YKQTVERIILTPLMEIKRVYNELDSR

SEQ ID NO: 3024433 - protein, 22 aa, Entamoeba invadens
YKREPIILHNFNLLINTDDFEN

SEQ ID NO: 3024434 - protein, 23 aa, Entamoeba invadens
YKRHMWAKVFIKSKPGRYGIKFW

SEQ ID NO: 3024435 - protein, 21 aa, Entamoeba invadens
YKRLMLRLRQETERVKIELST

SEQ ID NO: 3024436 - protein, 20 aa, Entamoeba invadens
YKRTRKILLPTSLVSLCSNC

SEQ ID NO: 3024437 - protein, 27 aa, Entamoeba invadens
YKSGIMRLKEDLSQLEIAFASESFASL

SEQ ID NO: 3024438 - protein, 25 aa, Entamoeba invadens
YKSHTLIKHLITKVYKMWRQCNLCD

SEQ ID NO: 3024439 - protein, 23 aa, Entamoeba invadens
YKSKKIFELLFIMCSSLQEDSLL

SEQ ID NO: 3024440 - protein, 19 aa, Entamoeba invadens
YKSYKYFTEKLLCKSILTI

SEQ ID NO: 3024441 - protein, 23 aa, Entamoeba invadens
YKTALLNLKLKGTLRSIIHTLYD

SEQ ID NO: 3024442 - protein, 21 aa, Entamoeba invadens
YKTFIQLVKQFVSVNTTIWEC

SEQ ID NO: 3024443 - protein, 17 aa, Entamoeba invadens
YKTKEMCSFPEHLCVVP

SEQ ID NO: 3024444 - protein, 23 aa, Entamoeba invadens
YKTKNITYLPFLSEKELYRTVTK

SEQ ID NO: 3024445 - protein, 21 aa, Entamoeba invadens
YKTMQLLVKYFKRPLETMAYT

SEQ ID NO: 3024446 - protein, 17 aa, Entamoeba invadens
YKTQICIDWTNGLSYLK

SEQ ID NO: 3024447 - protein, 20 aa, Entamoeba invadens
YKTYCPEKFPPMSKISKIRK

SEQ ID NO: 3024448 - protein, 25 aa, Entamoeba invadens
YKVIDQLLLPQNISSLLRFAVKTKT

SEQ ID NO: 3024449 - protein, 18 aa, Entamoeba invadens
YKVKYTDVLNLFKKRDYY

SEQ ID NO: 3024450 - protein, 20 aa, Entamoeba invadens
YKVQTTILSLSKLKHRIFAV

SEQ ID NO: 3024451 - protein, 26 aa, Entamoeba invadens
YKYHDDLIVIGLKGLKLFVYQLNTSV

SEQ ID NO: 3024452 - protein, 24 aa, Entamoeba invadens
YKYTPSYVLSPDDIYLRVMVDYAQ

SEQ ID NO: 3024453 - protein, 23 aa, Entamoeba invadens
YLAASGMYPPLIKMFELDQLSEK

SEQ ID NO: 3024454 - protein, 25 aa, Entamoeba invadens
YLAQCRTIYQLTFDTPAVDLDKVEF

SEQ ID NO: 3024455 - protein, 19 aa, Entamoeba invadens
YLAYQQAVFIALINKQFRV

SEQ ID NO: 3024456 - protein, 17 aa, Entamoeba invadens
YLCACIDVLIKKLDWNF

SEQ ID NO: 3024457 - protein, 23 aa, Entamoeba invadens
YLCCILQGYFIISDLYLEHCDAS

SEQ ID NO: 3024458 - protein, 17 aa, Entamoeba invadens
YLCEKLGAVLWVLVEEE

SEQ ID NO: 3024459 - protein, 20 aa, Entamoeba invadens
YLCRLVPNFTRRARWNDDFD

SEQ ID NO: 3024460 - protein, 30 aa, Entamoeba invadens
YLCSQFTPDFQWYCSSVCRILLLNSSDQFE

SEQ ID NO: 3024461 - protein, 17 aa, Entamoeba invadens
YLCTSLTKVVLPKTLKE

SEQ ID NO: 3024462 - protein, 23 aa, Entamoeba invadens
YLDGVIAEQMAFEQMLLNVETEL

SEQ ID NO: 3024463 - protein, 25 aa, Entamoeba invadens
YLDHDGLILKIYLIGRKVVLQEWED

SEQ ID NO: 3024464 - protein, 18 aa, Entamoeba invadens
YLDKLQNPDFRKACENPI

SEQ ID NO: 3024465 - protein, 18 aa, Entamoeba invadens
YLDKRLTILPFKCFSECK

SEQ ID NO: 3024466 - protein, 23 aa, Entamoeba invadens
YLDQIDPVFPLFGQIHREALMKA

SEQ ID NO: 3024467 - protein, 21 aa, Entamoeba invadens
YLDSFYPVIYKAYVKLQQQNN

SEQ ID NO: 3024468 - protein, 18 aa, Entamoeba invadens
YLDSLWRKRNIAQVNYSL

SEQ ID NO: 3024469 - protein, 18 aa, Entamoeba invadens
YLDTASWMPCICNSFQLV

SEQ ID NO: 3024470 - protein, 17 aa, Entamoeba invadens
YLDYLDSEDNRFGVETM

SEQ ID NO: 3024471 - protein, 21 aa, Entamoeba invadens
YLEEKLLIESALKKIRQIASQ

SEQ ID NO: 3024472 - protein, 27 aa, Entamoeba invadens
YLEFRRYQEYLIYCKESQLRHITNGYL

SEQ ID NO: 3024473 - protein, 23 aa, Entamoeba invadens
YLEKHPKIIRVNHPGLETFPNHE

SEQ ID NO: 3024474 - protein, 17 aa, Entamoeba invadens
YLEKLLELCDYKEVMET

SEQ ID NO: 3024475 - protein, 18 aa, Entamoeba invadens
YLENTYFPILAVDGKIDK

SEQ ID NO: 3024476 - protein, 18 aa, Entamoeba invadens
YLEVHAALAIIACCMSKV

SEQ ID NO: 3024477 - protein, 21 aa, Entamoeba invadens
YLEVIPYRLGQLRSFVLTATP

SEQ ID NO: 3024478 - protein, 20 aa, Entamoeba invadens
YLFAPKRVFVSSFERPKLVD

SEQ ID NO: 3024479 - protein, 21 aa, Entamoeba invadens
YLFDIFYCPETIIKEGKFTAG

SEQ ID NO: 3024480 - protein, 26 aa, Entamoeba invadens
YLFKTNLDFTYNLLRGIISYCNVNDI

SEQ ID NO: 3024481 - protein, 33 aa, Entamoeba invadens
YLGCERIIRRRFGGVKFEQKVVIRPSVLDNEEV

SEQ ID NO: 3024482 - protein, 19 aa, Entamoeba invadens
YLGYGHRTHHTKMSPRKNK

SEQ ID NO: 3024483 - protein, 23 aa, Entamoeba invadens
YLHANFLLHRDLKPANILVSNND

SEQ ID NO: 3024484 - protein, 17 aa, Entamoeba invadens
YLHCCAVELVRQLNWTI

SEQ ID NO: 3024485 - protein, 18 aa, Entamoeba invadens
YLHCGLFVNCTELTKLEF

SEQ ID NO: 3024486 - protein, 22 aa, Entamoeba invadens
YLHEKTSPILPSILLVVSCEEE

SEQ ID NO: 3024487 - protein, 18 aa, Entamoeba invadens
YLHGCGLKKDLFKALQCF

SEQ ID NO: 3024488 - protein, 36 aa, Entamoeba invadens
YLHLKYDGIHLVLFGTRWLRLLFDREFLVNDVLNIW

SEQ ID NO: 3024489 - protein, 18 aa, Entamoeba invadens
YLIFHRPSHITTVRTIDG

SEQ ID NO: 3024490 - protein, 17 aa, Entamoeba invadens
YLIGCNALHILNITSSN

SEQ ID NO: 3024491 - protein, 19 aa, Entamoeba invadens
YLIRHRHIPLRPSYRLVGV

SEQ ID NO: 3024492 - protein, 26 aa, Entamoeba invadens
YLISNKKLLRFFPNNILLNKDVICTL

SEQ ID NO: 3024493 - protein, 30 aa, Entamoeba invadens
YLITPVQRIPRYILLIKDIIKNIPAISEEA

SEQ ID NO: 3024494 - protein, 22 aa, Entamoeba invadens
YLKCYNQYFLIELTLCDPTESG

SEQ ID NO: 3024495 - protein, 18 aa, Entamoeba invadens
YLKFYVESFGIVKVHLGQ

SEQ ID NO: 3024496 - protein, 21 aa, Entamoeba invadens
YLKIQQIERLYPNSVIKKVSG

SEQ ID NO: 3024497 - protein, 22 aa, Entamoeba invadens
YLKKNSLLVKSFYDVAENIRCF

SEQ ID NO: 3024498 - protein, 25 aa, Entamoeba invadens
YLKKSDGFVLVYSLDNYFTFCSLES

SEQ ID NO: 3024499 - protein, 17 aa, Entamoeba invadens
YLKNRVEMNKWALDHNK

SEQ ID NO: 3024500 - protein, 19 aa, Entamoeba invadens
YLKPYLRRSTLIKEIIEKN

SEQ ID NO: 3024501 - protein, 32 aa, Entamoeba invadens
YLKQKIWQSYAPYYYDVFINMATPTVSMAFDW

SEQ ID NO: 3024502 - protein, 17 aa, Entamoeba invadens
YLKSFIPGADECFVTLK

SEQ ID NO: 3024503 - protein, 17 aa, Entamoeba invadens
YLKTQLDKLCDLVASPP

SEQ ID NO: 3024504 - protein, 20 aa, Entamoeba invadens
YLKVIKVISSRNVWISQFLP

SEQ ID NO: 3024505 - protein, 20 aa, Entamoeba invadens
YLLFVFQTSSRSVEISDYEN

SEQ ID NO: 3024506 - protein, 21 aa, Entamoeba invadens
YLLGKFETQVMYLDEIAKMNM

SEQ ID NO: 3024507 - protein, 17 aa, Entamoeba invadens
YLLIDKKPRIDLSFALV

SEQ ID NO: 3024508 - protein, 18 aa, Entamoeba invadens
YLLIPPKISARDLKNIFY

SEQ ID NO: 3024509 - protein, 20 aa, Entamoeba invadens
YLLKFLLIGDSSVGKTSLLL

SEQ ID NO: 3024510 - protein, 17 aa, Entamoeba invadens
YLLKKKNPLLKVLVLNI

SEQ ID NO: 3024511 - protein, 22 aa, Entamoeba invadens
YLLKVVFYFDTKEQLQRFICVN

SEQ ID NO: 3024512 - protein, 22 aa, Entamoeba invadens
YLLKVVMKFLTKEDLLTFMSVN

SEQ ID NO: 3024513 - protein, 21 aa, Entamoeba invadens
YLLNVFLYIEPKMIPLFEQVS

SEQ ID NO: 3024514 - protein, 18 aa, Entamoeba invadens
YLLSIDIPSSVSKIGRTC

SEQ ID NO: 3024515 - protein, 17 aa, Entamoeba invadens
YLLSVVLHFEYKEDLQT

SEQ ID NO: 3024516 - protein, 20 aa, Entamoeba invadens
YLLTAALLDDYLSKVRDTPK

SEQ ID NO: 3024517 - protein, 20 aa, Entamoeba invadens
YLLTFHPDITDNFSALVASM

SEQ ID NO: 3024518 - protein, 24 aa, Entamoeba invadens
YLLTFTPDIDERFTLLKQAMKTHV

SEQ ID NO: 3024519 - protein, 17 aa, Entamoeba invadens
YLLVLFKDSWSTVLTHW

SEQ ID NO: 3024520 - protein, 20 aa, Entamoeba invadens
YLMDNIPPTPVSTLRMAYDI

SEQ ID NO: 3024521 - protein, 21 aa, Entamoeba invadens
YLMESLLNHLFKTKTPIREFV

SEQ ID NO: 3024522 - protein, 20 aa, Entamoeba invadens
YLMHLIILECTRLGLKTVWL

SEQ ID NO: 3024523 - protein, 17 aa, Entamoeba invadens
YLMKVVMGLFTKGDLFN

SEQ ID NO: 3024524 - protein, 21 aa, Entamoeba invadens
YLMNVILYFESTKTLFTFVRV

SEQ ID NO: 3024525 - protein, 19 aa, Entamoeba invadens
YLMNVVLYINTFNSLFTFS

SEQ ID NO: 3024526 - protein, 22 aa, Entamoeba invadens
YLMNVVLYMNTFNSLSTFSCIN

SEQ ID NO: 3024527 - protein, 18 aa, Entamoeba invadens
YLNFPSNFHFNPIPLTRH

SEQ ID NO: 3024528 - protein, 23 aa, Entamoeba invadens
YLNIDLDYFVRFLQNYTDNGKEK

SEQ ID NO: 3024529 - protein, 21 aa, Entamoeba invadens
YLNNIFVFDFTTGCLHRVIGG

SEQ ID NO: 3024530 - protein, 25 aa, Entamoeba invadens
YLNSSLQCLLHIPSFVNYFQNVTWQ

SEQ ID NO: 3024531 - protein, 17 aa, Entamoeba invadens
YLPIVDYMAKFFCNVPM

SEQ ID NO: 3024532 - protein, 25 aa, Entamoeba invadens
YLPIVPVLQNIVHKTIFALNPALLS

SEQ ID NO: 3024533 - protein, 25 aa, Entamoeba invadens
YLPSKPFAFPIPHYPLHLESKESKK

SEQ ID NO: 3024534 - protein, 29 aa, Entamoeba invadens
YLQDHDIFDDWYLKLLAKRLLSHEVQDLK

SEQ ID NO: 3024535 - protein, 22 aa, Entamoeba invadens
YLQDMMLVPMALAKGKSRITCG

SEQ ID NO: 3024536 - protein, 33 aa, Entamoeba invadens
YLQIPLSVLSIPLFFILIDISPPKVQILLDNLA

SEQ ID NO: 3024537 - protein, 24 aa, Entamoeba invadens
YLQKISFSLFDSFLRFVLAERKNS

SEQ ID NO: 3024538 - protein, 20 aa, Entamoeba invadens
YLQLLIHVIRTVLSSNEMLL

SEQ ID NO: 3024539 - protein, 20 aa, Entamoeba invadens
YLQQFLFESQPIDDPILTVF

SEQ ID NO: 3024540 - protein, 22 aa, Entamoeba invadens
YLQQRLVGFFKLDLHRQKMVLL

SEQ ID NO: 3024541 - protein, 24 aa, Entamoeba invadens
YLQQVVLPLTITSIPFLCFEGCTC

SEQ ID NO: 3024542 - protein, 18 aa, Entamoeba invadens
YLQRCIIKMMESLHVEYD

SEQ ID NO: 3024543 - protein, 22 aa, Entamoeba invadens
YLQVSYAIVALAKSIAKLPKTD

SEQ ID NO: 3024544 - protein, 19 aa, Entamoeba invadens
YLRFAQAKREEIKAGLKEG

SEQ ID NO: 3024545 - protein, 18 aa, Entamoeba invadens
YLRFLPKLQNVYANGGIK

SEQ ID NO: 3024546 - protein, 23 aa, Entamoeba invadens
YLRGLMNMPCVWELIPLLLAGNG

SEQ ID NO: 3024547 - protein, 23 aa, Entamoeba invadens
YLRKMVTYFDGFTTHPLPCEGVY

SEQ ID NO: 3024548 - protein, 20 aa, Entamoeba invadens
YLRNVLLYLKSLSDITNFVC

SEQ ID NO: 3024549 - protein, 17 aa, Entamoeba invadens
YLRQAIPLLVKRGVFNS

SEQ ID NO: 3024550 - protein, 17 aa, Entamoeba invadens
YLRRIILTNDNGTKTIK

SEQ ID NO: 3024551 - protein, 17 aa, Entamoeba invadens
YLSLYLDSLWRKRNIAQ

SEQ ID NO: 3024552 - protein, 23 aa, Entamoeba invadens
YLSPLEHYLDYLKQIKTYLVSFL

SEQ ID NO: 3024553 - protein, 26 aa, Entamoeba invadens
YLSQPNLIYSINFLHSIAELCGKFFE

SEQ ID NO: 3024554 - protein, 21 aa, Entamoeba invadens
YLSRNLLSFCTLIIGPPISLN

SEQ ID NO: 3024555 - protein, 17 aa, Entamoeba invadens
YLSVCIPDKLLYIAVEG

SEQ ID NO: 3024556 - protein, 19 aa, Entamoeba invadens
YLSVTTLPLVIVFAETKTK

SEQ ID NO: 3024557 - protein, 26 aa, Entamoeba invadens
YLTDKTLFQVFDHKLSLCYSFSPTLQ

SEQ ID NO: 3024558 - protein, 24 aa, Entamoeba invadens
YLTEKYKALRIINEDKRKLLENLK

SEQ ID NO: 3024559 - protein, 20 aa, Entamoeba invadens
YLTELVEILRYGLSAYNEED

SEQ ID NO: 3024560 - protein, 23 aa, Entamoeba invadens
YLTFVLICDDLYQRDFPLPGESV

SEQ ID NO: 3024561 - protein, 21 aa, Entamoeba invadens
YLTHDIFRKTVLGPRVLLYLE

SEQ ID NO: 3024562 - protein, 20 aa, Entamoeba invadens
YLTHRQKCPYHFPPGLLIYK

SEQ ID NO: 3024563 - protein, 19 aa, Entamoeba invadens
YLTHTPVLYFIYNSTEERA

SEQ ID NO: 3024564 - protein, 23 aa, Entamoeba invadens
YLTLNEFTMLVRVLGVVNETSVI

SEQ ID NO: 3024565 - protein, 17 aa, Entamoeba invadens
YLTQIVFNETLKRIKKY

SEQ ID NO: 3024566 - protein, 21 aa, Entamoeba invadens
YLTQIYITKYTFIPNLCFLDC

SEQ ID NO: 3024567 - protein, 19 aa, Entamoeba invadens
YLTSVLLLNEKMKTIDTLT

SEQ ID NO: 3024568 - protein, 17 aa, Entamoeba invadens
YLTWKLEGEKSEYKEIG

SEQ ID NO: 3024569 - protein, 22 aa, Entamoeba invadens
YLVCKLGEFFQFKGECKKELCE

SEQ ID NO: 3024570 - protein, 20 aa, Entamoeba invadens
YLVHFYGAVMIPNRICMVNE

SEQ ID NO: 3024571 - protein, 17 aa, Entamoeba invadens
YLVKHVHYIIPALEETD

SEQ ID NO: 3024572 - protein, 17 aa, Entamoeba invadens
YLVLIIDVNSSVIVYDL

SEQ ID NO: 3024573 - protein, 17 aa, Entamoeba invadens
YLVLPSPSSVDLSVCSG

SEQ ID NO: 3024574 - protein, 18 aa, Entamoeba invadens
YLVSLFQDSQQIAAHSKR

SEQ ID NO: 3024575 - protein, 24 aa, Entamoeba invadens
YLVSMATLVFLQFPNYRTLVLKKE

SEQ ID NO: 3024576 - protein, 19 aa, Entamoeba invadens
YLWYRKIVEMPWSNKTLLH

SEQ ID NO: 3024577 - protein, 24 aa, Entamoeba invadens
YLYIELHMPFFKSIKHFQSKPQIW

SEQ ID NO: 3024578 - protein, 18 aa, Entamoeba invadens
YLYMMSQLLDGKDDLLVL

SEQ ID NO: 3024579 - protein, 17 aa, Entamoeba invadens
YLYSILSEVLRDWDNKQ

SEQ ID NO: 3024580 - protein, 18 aa, Entamoeba invadens
YLYSNENWVLVLSTGTID

SEQ ID NO: 3024581 - protein, 25 aa, Entamoeba invadens
YMALNFQFNLLLADSSKESKKCFLV

SEQ ID NO: 3024582 - protein, 18 aa, Entamoeba invadens
YMCNIVELELLDVQKDII

SEQ ID NO: 3024583 - protein, 35 aa, Entamoeba invadens
YMDDNGFVSVVILSKMLGFPPESFPQAVEVCKRFN

SEQ ID NO: 3024584 - protein, 27 aa, Entamoeba invadens
YMDDTSNFFIPFGKYVLYAFDTLGNNS

SEQ ID NO: 3024585 - protein, 17 aa, Entamoeba invadens
YMEDFIKIITHKTLRTV

SEQ ID NO: 3024586 - protein, 31 aa, Entamoeba invadens
YMEHTFLVTDRPLPLCFTIFSAPNYCDQYNN

SEQ ID NO: 3024587 - protein, 18 aa, Entamoeba invadens
YMESPRFDSNTSLIAKIA

SEQ ID NO: 3024588 - protein, 27 aa, Entamoeba invadens
YMEYLSNLMILFYQPQFPNGLRIHGWS

SEQ ID NO: 3024589 - protein, 20 aa, Entamoeba invadens
YMFEIELFRSNQPPVNCIIT

SEQ ID NO: 3024590 - protein, 17 aa, Entamoeba invadens
YMFERASMKLGLDQAIL

SEQ ID NO: 3024591 - protein, 24 aa, Entamoeba invadens
YMGDLFGVNTLFPEWNMESSNVVE

SEQ ID NO: 3024592 - protein, 23 aa, Entamoeba invadens
YMGKNKALLFDLYSLVRDTPEGV

SEQ ID NO: 3024593 - protein, 28 aa, Entamoeba invadens
YMIKEVYGVRVPIIYRQGCYELLNKHFC

SEQ ID NO: 3024594 - protein, 25 aa, Entamoeba invadens
YMKHMKINYYFLSGLLKALSDSMSD

SEQ ID NO: 3024595 - protein, 17 aa, Entamoeba invadens
YMKLLMPESQDLIALIQ

SEQ ID NO: 3024596 - protein, 19 aa, Entamoeba invadens
YMKSVLFSKVPGYADFFTH

SEQ ID NO: 3024597 - protein, 21 aa, Entamoeba invadens
YMLASFGMDSRIRLWDVRAEH

SEQ ID NO: 3024598 - protein, 18 aa, Entamoeba invadens
YMLFYQKIHTDETPQTDN

SEQ ID NO: 3024599 - protein, 20 aa, Entamoeba invadens
YMMCLKLSHVFSYLDRFFVK

SEQ ID NO: 3024600 - protein, 21 aa, Entamoeba invadens
YMMLVCKYFQSFDDFIRVMSV

SEQ ID NO: 3024601 - protein, 18 aa, Entamoeba invadens
YMMNVILYIQPSDIKSFE

SEQ ID NO: 3024602 - protein, 17 aa, Entamoeba invadens
YMMWLERCIKPELELRR

SEQ ID NO: 3024603 - protein, 22 aa, Entamoeba invadens
YMNRLPMLYNGIDLFVVCYSVV

SEQ ID NO: 3024604 - protein, 17 aa, Entamoeba invadens
YMPITGHSQAVTKVLWP

SEQ ID NO: 3024605 - protein, 18 aa, Entamoeba invadens
YMPLYINYDKQSGFLKFP

SEQ ID NO: 3024606 - protein, 18 aa, Entamoeba invadens
YMPNFPKRTHKSISGLLF

SEQ ID NO: 3024607 - protein, 22 aa, Entamoeba invadens
YMQLDPEILIQKPPLSRSPPSR

SEQ ID NO: 3024608 - protein, 22 aa, Entamoeba invadens
YMSRLLRTCGYIYRTSQEMELV

SEQ ID NO: 3024609 - protein, 24 aa, Entamoeba invadens
YMSTRPSYIIYVTAAELLLNAEAC

SEQ ID NO: 3024610 - protein, 24 aa, Entamoeba invadens
YMTFKAIQLYRKLADTDPLYTPVD

SEQ ID NO: 3024611 - protein, 17 aa, Entamoeba invadens
YMVCRSIYSLTIEHTSL

SEQ ID NO: 3024612 - protein, 23 aa, Entamoeba invadens
YNAFRDCAFIDFSIEKKVLINEL

SEQ ID NO: 3024613 - protein, 30 aa, Entamoeba invadens
YNALIRFENFFTYNRYKFGVLYAAPGQTKE

SEQ ID NO: 3024614 - protein, 28 aa, Entamoeba invadens
YNCINLKEIKLPKLLKFIPDSCFNRCTS

SEQ ID NO: 3024615 - protein, 37 aa, Entamoeba invadens
YNCKIPANYLIQPVQRFPRYVLLLDSLIKATPNFTNE

SEQ ID NO: 3024616 - protein, 18 aa, Entamoeba invadens
YNCLNLKEVILPTTIVGI

SEQ ID NO: 3024617 - protein, 18 aa, Entamoeba invadens
YNCSLQIFYKCTICSYSW

SEQ ID NO: 3024618 - protein, 20 aa, Entamoeba invadens
YNCTQEFFDLMRVEDLDMIK

SEQ ID NO: 3024619 - protein, 25 aa, Entamoeba invadens
YNDERSVLLIYRKLKQFDECFKCIR

SEQ ID NO: 3024620 - protein, 25 aa, Entamoeba invadens
YNDIILDISFPHILYKKLLGEPITF

SEQ ID NO: 3024621 - protein, 26 aa, Entamoeba invadens
YNDMCNVLFSIYLSGVLKMGKMLLTS

SEQ ID NO: 3024622 - protein, 22 aa, Entamoeba invadens
YNECLTLFDSLPLCAVIEGNVN

SEQ ID NO: 3024623 - protein, 17 aa, Entamoeba invadens
YNEFLNESIETLKNIMS

SEQ ID NO: 3024624 - protein, 18 aa, Entamoeba invadens
YNEGILYVKLMKVSESTW

SEQ ID NO: 3024625 - protein, 22 aa, Entamoeba invadens
YNEIMPKFFGVMRQDSFVRQMN

SEQ ID NO: 3024626 - protein, 25 aa, Entamoeba invadens
YNEKLQLLHEFSFDEVVFIVECGTN

SEQ ID NO: 3024627 - protein, 23 aa, Entamoeba invadens
YNEKLYEMYELRVSLIEQWATFK

SEQ ID NO: 3024628 - protein, 25 aa, Entamoeba invadens
YNEKRQVTQFGDGYWRIAAREVRHN

SEQ ID NO: 3024629 - protein, 27 aa, Entamoeba invadens
YNEKSDCIWLLTKKTFIKITLLNDNDI

SEQ ID NO: 3024630 - protein, 25 aa, Entamoeba invadens
YNFDTILAVSLLRRTRDFAKSEIRF

SEQ ID NO: 3024631 - protein, 32 aa, Entamoeba invadens
YNFHPKTLLNFFFDIFLYLGRHDNFIAAICED

SEQ ID NO: 3024632 - protein, 22 aa, Entamoeba invadens
YNFNPIPLTCKTFRFFRNIETL

SEQ ID NO: 3024633 - protein, 32 aa, Entamoeba invadens
YNGAYVRLRYLLRVVILAKSPIFPVEYEFAVS

SEQ ID NO: 3024634 - protein, 28 aa, Entamoeba invadens
YNGKQYSFYPEEISAFVFSNLKKQLIHK

SEQ ID NO: 3024635 - protein, 35 aa, Entamoeba invadens
YNIDIRGDKMLLGLLYLLFKKYRMAVAKIVDQSGR

SEQ ID NO: 3024636 - protein, 28 aa, Entamoeba invadens
YNIDVTLSHFFFFLQNETKVYAVGSISG

SEQ ID NO: 3024637 - protein, 26 aa, Entamoeba invadens
YNKEYFRTKLATFGIIVGVACFDFDC

SEQ ID NO: 3024638 - protein, 23 aa, Entamoeba invadens
YNKGYQYPPMFEGPLEQTYLPDK

SEQ ID NO: 3024639 - protein, 27 aa, Entamoeba invadens
YNKSLFERLLECGLNVTLLTQQYRMES

SEQ ID NO: 3024640 - protein, 27 aa, Entamoeba invadens
YNKTGIPIFYMTLFKESTKKTFDPIQP

SEQ ID NO: 3024641 - protein, 24 aa, Entamoeba invadens
YNKTHFIFTSWYDEKRTDQLFIGR

SEQ ID NO: 3024642 - protein, 27 aa, Entamoeba invadens
YNKTKSMIISFFKFIKNSDTVINTIQD

SEQ ID NO: 3024643 - protein, 18 aa, Entamoeba invadens
YNLGLYKKEFDFSKYVEK

SEQ ID NO: 3024644 - protein, 27 aa, Entamoeba invadens
YNLGSVTCWHLYALILKLEKNYEESCK

SEQ ID NO: 3024645 - protein, 34 aa, Entamoeba invadens
YNLGYAKAQDYINWPMYYLGLKDQKPPLTGESSE

SEQ ID NO: 3024646 - protein, 29 aa, Entamoeba invadens
YNLLYESMLGSVLYARDKWLVKGGLILPE

SEQ ID NO: 3024647 - protein, 25 aa, Entamoeba invadens
YNMDYAQLDILLMNVKQQKLKVSQV

SEQ ID NO: 3024648 - protein, 20 aa, Entamoeba invadens
YNMMYRPMLSQEIDFFFGNY

SEQ ID NO: 3024649 - protein, 19 aa, Entamoeba invadens
YNNAFLLFTSINSLILKFA

SEQ ID NO: 3024650 - protein, 25 aa, Entamoeba invadens
YNNIIHIFFQLDFVPTVYNIIDNVV

SEQ ID NO: 3024651 - protein, 24 aa, Entamoeba invadens
YNNNLILKLQGIINSLKPLLDKTL

SEQ ID NO: 3024652 - protein, 23 aa, Entamoeba invadens
YNNTPLVNTMKFTQTVNLCSCVE

SEQ ID NO: 3024653 - protein, 29 aa, Entamoeba invadens
YNNTYTLTLFEWNTIIISLQKSYTLTSNS

SEQ ID NO: 3024654 - protein, 23 aa, Entamoeba invadens
YNNVLYNFFVSRTMADDLKVVFD

SEQ ID NO: 3024655 - protein, 21 aa, Entamoeba invadens
YNNWRQPIALLIRKGHTYKLI

SEQ ID NO: 3024656 - protein, 23 aa, Entamoeba invadens
YNNYFIWIHREPVDEIKSLLLML

SEQ ID NO: 3024657 - protein, 32 aa, Entamoeba invadens
YNNYHVRILLKYFKSRGYLTELLTLLAENEIR

SEQ ID NO: 3024658 - protein, 18 aa, Entamoeba invadens
YNPHYFVEYLYSPTNTRL

SEQ ID NO: 3024659 - protein, 24 aa, Entamoeba invadens
YNPIDFPSLFKKLETLHVYTERSM

SEQ ID NO: 3024660 - protein, 17 aa, Entamoeba invadens
YNPIPLTKKTIAYFPNI

SEQ ID NO: 3024661 - protein, 24 aa, Entamoeba invadens
YNPIQEELFTALRGRGAFMNGKRI

SEQ ID NO: 3024662 - protein, 27 aa, Entamoeba invadens
YNPISISSLKLFPFIETLHLYTRKDAV

SEQ ID NO: 3024663 - protein, 18 aa, Entamoeba invadens
YNPISLTLKTRRLFPNLE

SEQ ID NO: 3024664 - protein, 26 aa, Entamoeba invadens
YNPPRNMVHVFAKTLLKYFDDKIKEL

SEQ ID NO: 3024665 - protein, 22 aa, Entamoeba invadens
YNQLFSAMRRISYAHVSMTEGM

SEQ ID NO: 3024666 - protein, 19 aa, Entamoeba invadens
YNQQLQAVKTKTAALTSAK

SEQ ID NO: 3024667 - protein, 23 aa, Entamoeba invadens
YNQTICSVCKPSYYPEISCHECT

SEQ ID NO: 3024668 - protein, 23 aa, Entamoeba invadens
YNRAINLLHLYIKTITPEKLFEK

SEQ ID NO: 3024669 - protein, 29 aa, Entamoeba invadens
YNRHNYPFCLPYPLKLPKRNFTKGFEKMR

SEQ ID NO: 3024670 - protein, 19 aa, Entamoeba invadens
YNRLKVLIFMKPDSNIGLI

SEQ ID NO: 3024671 - protein, 26 aa, Entamoeba invadens
YNRSKSDHFLVKRAKKAKLLRPFSKG

SEQ ID NO: 3024672 - protein, 21 aa, Entamoeba invadens
YNSHLLFIIESDKDFFGFYQR

SEQ ID NO: 3024673 - protein, 20 aa, Entamoeba invadens
YNSIKRPLFQLLENRYGEAH

SEQ ID NO: 3024674 - protein, 18 aa, Entamoeba invadens
YNSITPMYYRGSKCVIIV

SEQ ID NO: 3024675 - protein, 22 aa, Entamoeba invadens
YNSPAMYPPQRGGFPSGGYQQP

SEQ ID NO: 3024676 - protein, 23 aa, Entamoeba invadens
YNSPVFPLFLNFVKDVKKRLSIS

SEQ ID NO: 3024677 - protein, 30 aa, Entamoeba invadens
YNSSELLKLLFTLFDSFPIAVRVGTTELGD

SEQ ID NO: 3024678 - protein, 27 aa, Entamoeba invadens
YNSTQYLFLKTLLDKKYSLPYAALDAV

SEQ ID NO: 3024679 - protein, 18 aa, Entamoeba invadens
YNSVNDWFTCWRKHCVET

SEQ ID NO: 3024680 - protein, 17 aa, Entamoeba invadens
YNTAYYFKNWAVDTNTT

SEQ ID NO: 3024681 - protein, 31 aa, Entamoeba invadens
YNTHNPIPANLPFLLKFLSIQDPLSLQIHPD

SEQ ID NO: 3024682 - protein, 28 aa, Entamoeba invadens
YNTIDIDLDFPFYKTFFKGKKTTKYYMD

SEQ ID NO: 3024683 - protein, 31 aa, Entamoeba invadens
YNTIKSMLKAPLTELLLQIAPHQVKIGFTTG

SEQ ID NO: 3024684 - protein, 18 aa, Entamoeba invadens
YNTIRDIQISTADGFLIV

SEQ ID NO: 3024685 - protein, 31 aa, Entamoeba invadens
YNTPPYHFDLHQLTILMPQLSKYLSIEYAPT

SEQ ID NO: 3024686 - protein, 23 aa, Entamoeba invadens
YNTPSYMLFGLPSVYARTETKEE

SEQ ID NO: 3024687 - protein, 24 aa, Entamoeba invadens
YNVESYLFNRRLMRIIYQVSQGKS

SEQ ID NO: 3024688 - protein, 25 aa, Entamoeba invadens
YNVIIINKRKMIINSPIVFVSETNS

SEQ ID NO: 3024689 - protein, 19 aa, Entamoeba invadens
YNVIPHFHDLRVRLSQLDE

SEQ ID NO: 3024690 - protein, 23 aa, Entamoeba invadens
YNVRVASRFYKGPELLVDFQEYD

SEQ ID NO: 3024691 - protein, 18 aa, Entamoeba invadens
YNYALETFTKFKSINTKA

SEQ ID NO: 3024692 - protein, 31 aa, Entamoeba invadens
YNYQYQHNALYWKVWLYRSETKRVYKVLSAF

SEQ ID NO: 3024693 - protein, 23 aa, Entamoeba invadens
YPCDDDLIPESVWMLCFTEGMRV

SEQ ID NO: 3024694 - protein, 28 aa, Entamoeba invadens
YPCTHCSNLTYCTKCDAYLYTKNGKCFE

SEQ ID NO: 3024695 - protein, 22 aa, Entamoeba invadens
YPELTVFDLYQKYLNNYLKIET

SEQ ID NO: 3024696 - protein, 26 aa, Entamoeba invadens
YPELWYPDIYVLNGGYRLFREIYPEC

SEQ ID NO: 3024697 - protein, 21 aa, Entamoeba invadens
YPERYIDGPLILDRDSPDDYD

SEQ ID NO: 3024698 - protein, 20 aa, Entamoeba invadens
YPFCRPTPLTLPKHNYNIIF

SEQ ID NO: 3024699 - protein, 18 aa, Entamoeba invadens
YPFVAGYIALYSNDMAEY

SEQ ID NO: 3024700 - protein, 28 aa, Entamoeba invadens
YPFVPQQFYAPFTMPQFSPLRAIPQQRQ

SEQ ID NO: 3024701 - protein, 18 aa, Entamoeba invadens
YPGFYPNTTFSKASLLCA

SEQ ID NO: 3024702 - protein, 18 aa, Entamoeba invadens
YPGLGDGYLFLRNKTREK

SEQ ID NO: 3024703 - protein, 23 aa, Entamoeba invadens
YPGQQTPVGVLPPPGMPYGGMPN

SEQ ID NO: 3024704 - protein, 26 aa, Entamoeba invadens
YPGSCALMCIIDKFGDKRTIYMSNAG

SEQ ID NO: 3024705 - protein, 17 aa, Entamoeba invadens
YPGYPQQQPGTAAGQYG

SEQ ID NO: 3024706 - protein, 21 aa, Entamoeba invadens
YPHKILPKRSTAFTYKCSMCS

SEQ ID NO: 3024707 - protein, 18 aa, Entamoeba invadens
YPHPFAKNFPDKYMVESE

SEQ ID NO: 3024708 - protein, 18 aa, Entamoeba invadens
YPHQLACKLFRPNEENIL

SEQ ID NO: 3024709 - protein, 23 aa, Entamoeba invadens
YPIDLKKKFLFFATGSDRSPPGG

SEQ ID NO: 3024710 - protein, 19 aa, Entamoeba invadens
YPKIRVNGKVLERLKTIQK

SEQ ID NO: 3024711 - protein, 17 aa, Entamoeba invadens
YPKLVEIVNILLPTFST

SEQ ID NO: 3024712 - protein, 24 aa, Entamoeba invadens
YPKNKYLYELLEKLSKKTEMKSID

SEQ ID NO: 3024713 - protein, 26 aa, Entamoeba invadens
YPKRTKINTVIWPSPKLSSGVVEPYN

SEQ ID NO: 3024714 - protein, 17 aa, Entamoeba invadens
YPKYTFVVIDTPKPTSL

SEQ ID NO: 3024715 - protein, 19 aa, Entamoeba invadens
YPLFCDIISFDTNPVNWKR

SEQ ID NO: 3024716 - protein, 17 aa, Entamoeba invadens
YPLIFRDTCENNGLLYP

SEQ ID NO: 3024717 - protein, 21 aa, Entamoeba invadens
YPLIGAVQRKSLYLVLSCVEN

SEQ ID NO: 3024718 - protein, 18 aa, Entamoeba invadens
YPLLPYQATMKDVEWDNY

SEQ ID NO: 3024719 - protein, 19 aa, Entamoeba invadens
YPLVLQYYRCDFEPVLEAC

SEQ ID NO: 3024720 - protein, 20 aa, Entamoeba invadens
YPLYNSLRIVVYRNLLDFVF

SEQ ID NO: 3024721 - protein, 20 aa, Entamoeba invadens
YPNQTFVIPQADKTIFISTL

SEQ ID NO: 3024722 - protein, 29 aa, Entamoeba invadens
YPPGIFKLPFTFNLPQNFQPTLIVPDLFI

SEQ ID NO: 3024723 - protein, 18 aa, Entamoeba invadens
YPPIQHRKVVHKKTRKAV

SEQ ID NO: 3024724 - protein, 18 aa, Entamoeba invadens
YPPMGCAPGMAPMGAYPP

SEQ ID NO: 3024725 - protein, 29 aa, Entamoeba invadens
YPPYDPKFVDEFPLLFRMVEDEYINALKI

SEQ ID NO: 3024726 - protein, 18 aa, Entamoeba invadens
YPQKLFLAMIHTMPNKIQ

SEQ ID NO: 3024727 - protein, 25 aa, Entamoeba invadens
YPQNIKKLFFKVNVWYEVSYKKYTE

SEQ ID NO: 3024728 - protein, 24 aa, Entamoeba invadens
YPQQRRFGGMLGNKQPRRIESSQD

SEQ ID NO: 3024729 - protein, 19 aa, Entamoeba invadens
YPRHEHITKLLAFTAQSIH

SEQ ID NO: 3024730 - protein, 18 aa, Entamoeba invadens
YPRLKQDQFMLLWNNVTT

SEQ ID NO: 3024731 - protein, 18 aa, Entamoeba invadens
YPSLLEFWSSVPLEEYLS

SEQ ID NO: 3024732 - protein, 25 aa, Entamoeba invadens
YPSQNLRFVAFLSGASIVRAGLERY

SEQ ID NO: 3024733 - protein, 20 aa, Entamoeba invadens
YPSQVIVKLLQKYSFKTLKL

SEQ ID NO: 3024734 - protein, 21 aa, Entamoeba invadens
YPTAPMPYLIGVQKNLWGSVK

SEQ ID NO: 3024735 - protein, 17 aa, Entamoeba invadens
YPTIFIVANKIDTKSRT

SEQ ID NO: 3024736 - protein, 22 aa, Entamoeba invadens
YPVCDICAPGYNLNSNNEFCYP

SEQ ID NO: 3024737 - protein, 21 aa, Entamoeba invadens
YPVSALYRMNQSEKLLVSGST

SEQ ID NO: 3024738 - protein, 27 aa, Entamoeba invadens
YPVTCKSAFRRSAETGALVAPKFAQTA

SEQ ID NO: 3024739 - protein, 17 aa, Entamoeba invadens
YPYDPLQMQMYGYQPMP

SEQ ID NO: 3024740 - protein, 26 aa, Entamoeba invadens
YQAEQQAILLALINKTYSITVEHPLK

SEQ ID NO: 3024741 - protein, 26 aa, Entamoeba invadens
YQCCSFKLIILPRYLKEIKTSGFCSC

SEQ ID NO: 3024742 - protein, 17 aa, Entamoeba invadens
YQCFGGCIQLTHVDIPI

SEQ ID NO: 3024743 - protein, 26 aa, Entamoeba invadens
YQCMSINKLIFPLKLKVIPSETAYLC

SEQ ID NO: 3024744 - protein, 24 aa, Entamoeba invadens
YQDDRDFWCKCAHFTTICLLQLKT

SEQ ID NO: 3024745 - protein, 22 aa, Entamoeba invadens
YQDFCRRVIDMKCPVWKKYLKE

SEQ ID NO: 3024746 - protein, 24 aa, Entamoeba invadens
YQDPLDVYCLKGCTVKPVLDKGPN

SEQ ID NO: 3024747 - protein, 18 aa, Entamoeba invadens
YQDRNMLLKKITIVFGTN

SEQ ID NO: 3024748 - protein, 23 aa, Entamoeba invadens
YQDSDNFFYFSKTDIIRSGCRCY

SEQ ID NO: 3024749 - protein, 24 aa, Entamoeba invadens
YQEPRFKQPFQADAFYLSLETFVD

SEQ ID NO: 3024750 - protein, 25 aa, Entamoeba invadens
YQGEGSLMVLRLIAETKVKMIELEK

SEQ ID NO: 3024751 - protein, 33 aa, Entamoeba invadens
YQGIRMLIVICYDLRFPAFIRYSETNDYDIIIN

SEQ ID NO: 3024752 - protein, 20 aa, Entamoeba invadens
YQIALPNIPITDFAKHKIDR

SEQ ID NO: 3024753 - protein, 32 aa, Entamoeba invadens
YQISSVMHRLMKLPHLLLPTTTIIVLNKPKNE

SEQ ID NO: 3024754 - protein, 24 aa, Entamoeba invadens
YQKCYLQELSDKLLLMVFEYLCLE

SEQ ID NO: 3024755 - protein, 25 aa, Entamoeba invadens
YQKDDVRFKFAWGIADFITSGKRLE

SEQ ID NO: 3024756 - protein, 25 aa, Entamoeba invadens
YQKDGILLVCFKKKYVPCHCILFSD

SEQ ID NO: 3024757 - protein, 22 aa, Entamoeba invadens
YQKDRFKYPWKIAEFVMSGKRL

SEQ ID NO: 3024758 - protein, 17 aa, Entamoeba invadens
YQKFKYQEVGLNKLYQL

SEQ ID NO: 3024759 - protein, 17 aa, Entamoeba invadens
YQKILKSQPHFPKNISY

SEQ ID NO: 3024760 - protein, 17 aa, Entamoeba invadens
YQKILKSQPQFPKNLSY

SEQ ID NO: 3024761 - protein, 30 aa, Entamoeba invadens
YQKKLTGDGYIYLLSHQQLEDLLGKKFCFP

SEQ ID NO: 3024762 - protein, 19 aa, Entamoeba invadens
YQKQFETYPSPFQYQQGPP

SEQ ID NO: 3024763 - protein, 37 aa, Entamoeba invadens
YQKTNQLPLALQFTQLFGPEHYPFSLFIEKVEPEKVE

SEQ ID NO: 3024764 - protein, 20 aa, Entamoeba invadens
YQLPLYLTQIIIPNGVSQIN

SEQ ID NO: 3024765 - protein, 18 aa, Entamoeba invadens
YQLVDILGLVYHENVDSS

SEQ ID NO: 3024766 - protein, 17 aa, Entamoeba invadens
YQLVFAENPEHYTLLAA

SEQ ID NO: 3024767 - protein, 26 aa, Entamoeba invadens
YQMDVLKRKIFNLNAFLKCAPILEKA

SEQ ID NO: 3024768 - protein, 33 aa, Entamoeba invadens
YQMGNAFPLNYMTPLFQMFGAQMGAFFQQQQQQ

SEQ ID NO: 3024769 - protein, 17 aa, Entamoeba invadens
YQMYPGKLYIKTSAKTS

SEQ ID NO: 3024770 - protein, 23 aa, Entamoeba invadens
YQNEKYLFGIDEIYDVGFKINEV

SEQ ID NO: 3024771 - protein, 17 aa, Entamoeba invadens
YQNGFVVNDGPLREYNT

SEQ ID NO: 3024772 - protein, 38 aa, Entamoeba invadens
YQNLMKVYLDAVFFPRVRKDIFPFYQEGWRWEKNEQGE

SEQ ID NO: 3024773 - protein, 31 aa, Entamoeba invadens
YQNTRFTLFGAAWCFRPAERMIKSLKINPTI

SEQ ID NO: 3024774 - protein, 20 aa, Entamoeba invadens
YQPKHPQNVPYFSPVYLDEN

SEQ ID NO: 3024775 - protein, 22 aa, Entamoeba invadens
YQQGFHELMAILYHTFDTDNTT

SEQ ID NO: 3024776 - protein, 19 aa, Entamoeba invadens
YQQMFLLGLLNTRCSFTLK

SEQ ID NO: 3024777 - protein, 17 aa, Entamoeba invadens
YQQSLAEENWIRATVVK

SEQ ID NO: 3024778 - protein, 26 aa, Entamoeba invadens
YQRCYSQLFQILRPNWKLHMRSNLVI

SEQ ID NO: 3024779 - protein, 17 aa, Entamoeba invadens
YQRGLLLGQTYAGFIYS

SEQ ID NO: 3024780 - protein, 50 aa, Entamoeba invadens
YQRKATIRDLNIAGLLIPPINFFIPDEPIFPIEFFISCDPKEIARQMTVI

SEQ ID NO: 3024781 - protein, 30 aa, Entamoeba invadens
YQRKKLGRYLLTQVYLFILKSKCYDLTVED

SEQ ID NO: 3024782 - protein, 18 aa, Entamoeba invadens
YQRVIDIIGRTMEPFDDD

SEQ ID NO: 3024783 - protein, 25 aa, Entamoeba invadens
YQSEQECVLLALLNQFYAITFTAHK

SEQ ID NO: 3024784 - protein, 24 aa, Entamoeba invadens
YQSEQECVLLALLNQFYGLTFTPH

SEQ ID NO: 3024785 - protein, 33 aa, Entamoeba invadens
YQSKILRVKEASNFPIVFVANKVDLVKDRDVTE

SEQ ID NO: 3024786 - protein, 32 aa, Entamoeba invadens
YQSKILRVKETPTFPIVFVANKVDLVKDRDVS

SEQ ID NO: 3024787 - protein, 26 aa, Entamoeba invadens
YQSYHLLTNFFYLASYFVSYRELSDK

SEQ ID NO: 3024788 - protein, 31 aa, Entamoeba invadens
YQTAEKYNVVLFRLYVLRSDNLIFCPIPNCN

SEQ ID NO: 3024789 - protein, 32 aa, Entamoeba invadens
YQTCQQGIFIGLLNKFCDITIIKPPKKAVITH

SEQ ID NO: 3024790 - protein, 17 aa, Entamoeba invadens
YQTIFYSHRLDLKEYEQ

SEQ ID NO: 3024791 - protein, 37 aa, Entamoeba invadens
YQTNVFSQQVYFPLPQQPPEPVLIPHNYQTLFDNATL

SEQ ID NO: 3024792 - protein, 23 aa, Entamoeba invadens
YQTPLFDQFIDYELHRHKQTLKE

SEQ ID NO: 3024793 - protein, 18 aa, Entamoeba invadens
YQTPQETLDLLLGKTRIA

SEQ ID NO: 3024794 - protein, 24 aa, Entamoeba invadens
YQTSFIEDFLKTVKEFVLPLLDDK

SEQ ID NO: 3024795 - protein, 25 aa, Entamoeba invadens
YQVAQQCILIALINQYYDVTFSVTR

SEQ ID NO: 3024796 - protein, 26 aa, Entamoeba invadens
YQVCEQCFMLLLLNKYAEIEFMRKKK

SEQ ID NO: 3024797 - protein, 18 aa, Entamoeba invadens
YQVKLSIELPKKRLFRNY

SEQ ID NO: 3024798 - protein, 17 aa, Entamoeba invadens
YQVSQQAILLALINKHF

SEQ ID NO: 3024799 - protein, 25 aa, Entamoeba invadens
YQVTSLPTFVLFQDQKVVKKAPGST

SEQ ID NO: 3024800 - protein, 21 aa, Entamoeba invadens
YQVYIAPDVLYREGLKGYIEI

SEQ ID NO: 3024801 - protein, 18 aa, Entamoeba invadens
YQYFKTHPIIPQSKYLVI

SEQ ID NO: 3024802 - protein, 17 aa, Entamoeba invadens
YQYLRRSIPGLPEQEPS

SEQ ID NO: 3024803 - protein, 27 aa, Entamoeba invadens
YRCGKLGHSLKNCPLNKGKDAEQVCFN

SEQ ID NO: 3024804 - protein, 20 aa, Entamoeba invadens
YRCHNYFAAFTIYSQLQKNL

SEQ ID NO: 3024805 - protein, 25 aa, Entamoeba invadens
YRCPKCLIPFCSVPCFKKHKEHCKE

SEQ ID NO: 3024806 - protein, 28 aa, Entamoeba invadens
YRDFRLTDTLKYKIFQDVSMGLAACHKV

SEQ ID NO: 3024807 - protein, 19 aa, Entamoeba invadens
YRDPALFKINLIKKIEETK

SEQ ID NO: 3024808 - protein, 20 aa, Entamoeba invadens
YREKWYKTNILNELPYYAKV

SEQ ID NO: 3024809 - protein, 19 aa, Entamoeba invadens
YRELILESIEVLNSGAKDV

SEQ ID NO: 3024810 - protein, 23 aa, Entamoeba invadens
YREQIKGWLQTEIKNKRTLEEAK

SEQ ID NO: 3024811 - protein, 25 aa, Entamoeba invadens
YRETQGALIVYDITNRDSFDYLQEW

SEQ ID NO: 3024812 - protein, 18 aa, Entamoeba invadens
YREWLFAQEKRKKFCIYR

SEQ ID NO: 3024813 - protein, 18 aa, Entamoeba invadens
YRFKPEFTKQRALELNQF

SEQ ID NO: 3024814 - protein, 17 aa, Entamoeba invadens
YRGNMWTAYAPDRYGRT

SEQ ID NO: 3024815 - protein, 20 aa, Entamoeba invadens
YRGYLRALVDYLSGLSNQNL

SEQ ID NO: 3024816 - protein, 26 aa, Entamoeba invadens
YRICDKDMLFLVLNKTDLPNAFQKDD

SEQ ID NO: 3024817 - protein, 17 aa, Entamoeba invadens
YRIGEVQKTYFLFKVLK

SEQ ID NO: 3024818 - protein, 23 aa, Entamoeba invadens
YRINVWLYSDVIYTPLKVLTKKV

SEQ ID NO: 3024819 - protein, 19 aa, Entamoeba invadens
YRIPTTMVFVRSRKGLSHC

SEQ ID NO: 3024820 - protein, 24 aa, Entamoeba invadens
YRKEMLPFYINQIDKLLSLLETMN

SEQ ID NO: 3024821 - protein, 20 aa, Entamoeba invadens
YRKLLLRNSLDKLLCDSDFI

SEQ ID NO: 3024822 - protein, 19 aa, Entamoeba invadens
YRKLTWKAGHIWVGNVTIQ

SEQ ID NO: 3024823 - protein, 33 aa, Entamoeba invadens
YRKVFGSIPVYGTLLPKLFPPMTERYKPSDLVP

SEQ ID NO: 3024824 - protein, 30 aa, Entamoeba invadens
YRLKLQVLGNLAYLVNMQKSATFLKAHSRF

SEQ ID NO: 3024825 - protein, 17 aa, Entamoeba invadens
YRLMTHKIPYGENETEI

SEQ ID NO: 3024826 - protein, 21 aa, Entamoeba invadens
YRMAVMAMILAPPTIDRSHAV

SEQ ID NO: 3024827 - protein, 19 aa, Entamoeba invadens
YRMSISSYFIIAYAINNRE

SEQ ID NO: 3024828 - protein, 18 aa, Entamoeba invadens
YRNPFPDVMNFLDTFHGG

SEQ ID NO: 3024829 - protein, 21 aa, Entamoeba invadens
YRNTRFPLFTFEKQIMKFCPP

SEQ ID NO: 3024830 - protein, 44 aa, Entamoeba invadens
YRNVLYEVQFSFGLTKSGFSMWCQNVYYPYLNQQRQLIEKRVAD

SEQ ID NO: 3024831 - protein, 25 aa, Entamoeba invadens
YRNVMPIYFRDCDGAIVVFDLSNRE

SEQ ID NO: 3024832 - protein, 25 aa, Entamoeba invadens
YRPIEITCYSFAFLAGKIPPQPTDR

SEQ ID NO: 3024833 - protein, 25 aa, Entamoeba invadens
YRPIRKDFVIVLQTRLDKIESMQTQ

SEQ ID NO: 3024834 - protein, 27 aa, Entamoeba invadens
YRQEVLKQLLIFSAAKNPLLQILRGFL

SEQ ID NO: 3024835 - protein, 25 aa, Entamoeba invadens
YRQGLIDLIIPLFTLLRVEDVEENP

SEQ ID NO: 3024836 - protein, 19 aa, Entamoeba invadens
YRQGMLEIAILQLLSEKFD

SEQ ID NO: 3024837 - protein, 19 aa, Entamoeba invadens
YRSVIKMVAYLLQTVDVTS

SEQ ID NO: 3024838 - protein, 26 aa, Entamoeba invadens
YRTNLDYRIFKFLIKNYKIEGEVVLY

SEQ ID NO: 3024839 - protein, 27 aa, Entamoeba invadens
YRTNLDYRIFKFLIKNYKIEGEVVLYD

SEQ ID NO: 3024840 - protein, 25 aa, Entamoeba invadens
YRTVTSSYYRGCSGIFLVYSQNDES

SEQ ID NO: 3024841 - protein, 27 aa, Entamoeba invadens
YRVAEQLHILMDLLRDVGFDLDTKTTT

SEQ ID NO: 3024842 - protein, 20 aa, Entamoeba invadens
YRVDVWSVGCVCQELLEGNP

SEQ ID NO: 3024843 - protein, 17 aa, Entamoeba invadens
YRVLLINTNYSIVNYLL

SEQ ID NO: 3024844 - protein, 19 aa, Entamoeba invadens
YRYKPEFEIFGQYLAKAQI

SEQ ID NO: 3024845 - protein, 25 aa, Entamoeba invadens
YRYRSPQTLLFKQLQFYSSGALNER

SEQ ID NO: 3024846 - protein, 39 aa, Entamoeba invadens
YSAHDVTLFMVLKFLGFKVDKWVPLASYIILEIFEDGDG

SEQ ID NO: 3024847 - protein, 28 aa, Entamoeba invadens
YSAIYTNFFDFDFIPIGVLQNSFYNVFV

SEQ ID NO: 3024848 - protein, 28 aa, Entamoeba invadens
YSAIYTNFFDFIPIGVLQNSFYNVFVTH

SEQ ID NO: 3024849 - protein, 25 aa, Entamoeba invadens
YSALQFQYMKTGDGYVIVYSITSTT

SEQ ID NO: 3024850 - protein, 20 aa, Entamoeba invadens
YSALRFQYMRTGDGYVIVYS

SEQ ID NO: 3024851 - protein, 24 aa, Entamoeba invadens
YSARRPPPPPPPTYPTRRVQTILS

SEQ ID NO: 3024852 - protein, 28 aa, Entamoeba invadens
YSCDERPKYRIKKRIEWCQNKSTALEIL

SEQ ID NO: 3024853 - protein, 22 aa, Entamoeba invadens
YSCYTCFSSCKTCFNDTSYGCS

SEQ ID NO: 3024854 - protein, 25 aa, Entamoeba invadens
YSDINVIFNTFWKLKGCALQFLEEP

SEQ ID NO: 3024855 - protein, 21 aa, Entamoeba invadens
YSDRLYLFAQGYLETPRLYIK

SEQ ID NO: 3024856 - protein, 22 aa, Entamoeba invadens
YSDSFDLFLTTYSSIPTLSIPS

SEQ ID NO: 3024857 - protein, 34 aa, Entamoeba invadens
YSEDFDIFIFSLKSPYLLKPTKYTKLRSFADLCH

SEQ ID NO: 3024858 - protein, 28 aa, Entamoeba invadens
YSEHEYHVIYWYMSVLFAMMGEHYSEFR

SEQ ID NO: 3024859 - protein, 22 aa, Entamoeba invadens
YSEIFDWAMKRITSFTHNIIYH

SEQ ID NO: 3024860 - protein, 21 aa, Entamoeba invadens
YSEIKWALRFDTEAASRVNQI

SEQ ID NO: 3024861 - protein, 23 aa, Entamoeba invadens
YSEIVNFLIHSSLKYVGMNLYAL

SEQ ID NO: 3024862 - protein, 31 aa, Entamoeba invadens
YSESLYIKFALLFQTLPLASLLHTKSGVYFL

SEQ ID NO: 3024863 - protein, 23 aa, Entamoeba invadens
YSETPLIKFYDDMSPMSPLPTNE

SEQ ID NO: 3024864 - protein, 22 aa, Entamoeba invadens
YSEVISSKRTLYDLYGFEKGTH

SEQ ID NO: 3024865 - protein, 28 aa, Entamoeba invadens
YSEYNTKQFLTYMRSLIPSPYSDKGYKN

SEQ ID NO: 3024866 - protein, 33 aa, Entamoeba invadens
YSFAITLLEVLTWVEPFPKEIYKFGWSIADLIS

SEQ ID NO: 3024867 - protein, 34 aa, Entamoeba invadens
YSFAITMLECFLWDNAFPKNVYVFSWTIADDVAS

SEQ ID NO: 3024868 - protein, 39 aa, Entamoeba invadens
YSFAITMLECFLWSEAFPKSTYIFPWTFADDVASGKRLM

SEQ ID NO: 3024869 - protein, 31 aa, Entamoeba invadens
YSFAITMLWCITWTDPFPQTVYHYAWSIADD

SEQ ID NO: 3024870 - protein, 29 aa, Entamoeba invadens
YSFAITMYECFIWGESYPKTQFKYPWEVA

SEQ ID NO: 3024871 - protein, 22 aa, Entamoeba invadens
YSFALIIIEFLEGKATFYGDQN

SEQ ID NO: 3024872 - protein, 26 aa, Entamoeba invadens
YSFAVTMYQTFKWKEPYPINVFEHSW

SEQ ID NO: 3024873 - protein, 19 aa, Entamoeba invadens
YSFGITMYETFAWKEAYPT

SEQ ID NO: 3024874 - protein, 18 aa, Entamoeba invadens
YSFGVTLYETLKWEEAYD

SEQ ID NO: 3024875 - protein, 17 aa, Entamoeba invadens
YSFMPTGMVQTNCTIIG

SEQ ID NO: 3024876 - protein, 18 aa, Entamoeba invadens
YSGIFLKKCCIDNYGFGE

SEQ ID NO: 3024877 - protein, 22 aa, Entamoeba invadens
YSGIKNTYLTKLNINLKARNED

SEQ ID NO: 3024878 - protein, 23 aa, Entamoeba invadens
YSGKRYYLYKNDSNYWSLSSRFD

SEQ ID NO: 3024879 - protein, 23 aa, Entamoeba invadens
YSGMDSLIFRMCPSRFAHFLVTG

SEQ ID NO: 3024880 - protein, 25 aa, Entamoeba invadens
YSGMPALKNQFLVIPGAFSLGKFGE

SEQ ID NO: 3024881 - protein, 24 aa, Entamoeba invadens
YSGSVGLLTITWPSELQIDSNNSY

SEQ ID NO: 3024882 - protein, 27 aa, Entamoeba invadens
YSGVEYFSLFVRFVFSDGSFEEKRVKI

SEQ ID NO: 3024883 - protein, 27 aa, Entamoeba invadens
YSGVEYFSLFVRFVFSDGSFEERRVKI

SEQ ID NO: 3024884 - protein, 27 aa, Entamoeba invadens
YSGVEYFSLFVRFVFSDGSFVEKRVKI

SEQ ID NO: 3024885 - protein, 18 aa, Entamoeba invadens
YSHDVSVCYLFTYGHFAI

SEQ ID NO: 3024886 - protein, 24 aa, Entamoeba invadens
YSHPIDMWSLGCILPELLTTEPLF

SEQ ID NO: 3024887 - protein, 19 aa, Entamoeba invadens
YSIASLPTFVFFQNQKVII

SEQ ID NO: 3024888 - protein, 25 aa, Entamoeba invadens
YSIDDYKLLNKLIFSKKRVPIVLCG

SEQ ID NO: 3024889 - protein, 28 aa, Entamoeba invadens
YSIFNLGVLAFKGLPGLIPVNIKTSIDL

SEQ ID NO: 3024890 - protein, 24 aa, Entamoeba invadens
YSIGVCLFRLCTCQFPFGSTEAEF

SEQ ID NO: 3024891 - protein, 26 aa, Entamoeba invadens
YSIQQFQMFFTNITLVTSLISNIFST

SEQ ID NO: 3024892 - protein, 24 aa, Entamoeba invadens
YSITLMYQHRFINAPTFSSELYNS

SEQ ID NO: 3024893 - protein, 21 aa, Entamoeba invadens
YSIVTPLQQALGKLCLDWFTT

SEQ ID NO: 3024894 - protein, 20 aa, Entamoeba invadens
YSKILVLPKDFDEKKKWLPL

SEQ ID NO: 3024895 - protein, 17 aa, Entamoeba invadens
YSKLLYRCIQEYIVVIF

SEQ ID NO: 3024896 - protein, 31 aa, Entamoeba invadens
YSLAISFFEIIGWAEPFPKKRFKYAWDIADF

SEQ ID NO: 3024897 - protein, 26 aa, Entamoeba invadens
YSLFDVEAFLPVITRVEYSKLLEGAA

SEQ ID NO: 3024898 - protein, 27 aa, Entamoeba invadens
YSLGMVMYELFYEKIPFFDHTHLQSAE

SEQ ID NO: 3024899 - protein, 23 aa, Entamoeba invadens
YSLGVILFQMATTYFPFSDDPQI

SEQ ID NO: 3024900 - protein, 18 aa, Entamoeba invadens
YSLKNIPNGMTFFFDFGG

SEQ ID NO: 3024901 - protein, 20 aa, Entamoeba invadens
YSLNKFCFYNCYALSSVVIS

SEQ ID NO: 3024902 - protein, 26 aa, Entamoeba invadens
YSLSFVIWEIFTQKRPFGDIQFMAGI

SEQ ID NO: 3024903 - protein, 21 aa, Entamoeba invadens
YSLSIRWVDRKPTGVAYLCYT

SEQ ID NO: 3024904 - protein, 26 aa, Entamoeba invadens
YSLTLQFDLPRFIGIGLFTDVGYSQG

SEQ ID NO: 3024905 - protein, 21 aa, Entamoeba invadens
YSLTYRDYLERMPLASFVSFS

SEQ ID NO: 3024906 - protein, 17 aa, Entamoeba invadens
YSLVTSPTITVSQFIVQ

SEQ ID NO: 3024907 - protein, 22 aa, Entamoeba invadens
YSMRRFVPMTDGVEVENGIITE

SEQ ID NO: 3024908 - protein, 38 aa, Entamoeba invadens
YSNDTKCVLFKLADSVPYPPFPISPNVSGMVSKLAFFP

SEQ ID NO: 3024909 - protein, 24 aa, Entamoeba invadens
YSNIPKELLPQIKEFVFAKIVEFK

SEQ ID NO: 3024910 - protein, 27 aa, Entamoeba invadens
YSNITVIFNTFWKIEKAALQFTNDCVV

SEQ ID NO: 3024911 - protein, 17 aa, Entamoeba invadens
YSNLNRQFLFRRKDVGR

SEQ ID NO: 3024912 - protein, 24 aa, Entamoeba invadens
YSNTRFLFNALISNTLFECFPVFS

SEQ ID NO: 3024913 - protein, 21 aa, Entamoeba invadens
YSNTRFLYIATIFNMVFDNLN

SEQ ID NO: 3024914 - protein, 24 aa, Entamoeba invadens
YSNTRFLYIATISNMLFDCYSEMK

SEQ ID NO: 3024915 - protein, 23 aa, Entamoeba invadens
YSPEKILFRDLNFALTMESRVAL

SEQ ID NO: 3024916 - protein, 26 aa, Entamoeba invadens
YSPNAYGLTFFVNKLRDIDWKEEKKC

SEQ ID NO: 3024917 - protein, 21 aa, Entamoeba invadens
YSPQVTVYPKLASPTPINPYT

SEQ ID NO: 3024918 - protein, 19 aa, Entamoeba invadens
YSPTMLQGMGKLCEVPWKT

SEQ ID NO: 3024919 - protein, 21 aa, Entamoeba invadens
YSPYTNLLMAIVLRSCKDQFQ

SEQ ID NO: 3024920 - protein, 24 aa, Entamoeba invadens
YSQTLIKVFFNMLPKRIIDITRDI

SEQ ID NO: 3024921 - protein, 23 aa, Entamoeba invadens
YSQWSCLFSRWISYEIVRVKDLE

SEQ ID NO: 3024922 - protein, 25 aa, Entamoeba invadens
YSRFEEWEILYHIIEYSKTQNAVFE

SEQ ID NO: 3024923 - protein, 17 aa, Entamoeba invadens
YSRFGFVQSIDYDVHSF

SEQ ID NO: 3024924 - protein, 30 aa, Entamoeba invadens
YSRHHFITKMFIFSYKFVRYNTTFSAIIIL

SEQ ID NO: 3024925 - protein, 21 aa, Entamoeba invadens
YSRKCVKCLNGYYPDSNGKCV

SEQ ID NO: 3024926 - protein, 22 aa, Entamoeba invadens
YSRLFHLFSEKIVKPLLVKFSE

SEQ ID NO: 3024927 - protein, 27 aa, Entamoeba invadens
YSRPSKYLLYQILKVTFYDYPLENSLA

SEQ ID NO: 3024928 - protein, 27 aa, Entamoeba invadens
YSSFSNLFETKWLPPKIKKLRVSYPDF

SEQ ID NO: 3024929 - protein, 20 aa, Entamoeba invadens
YSTEDLLFDIISELAAGSYT

SEQ ID NO: 3024930 - protein, 23 aa, Entamoeba invadens
YSTETMITLLCLKINSPEGVILL

SEQ ID NO: 3024931 - protein, 24 aa, Entamoeba invadens
YSTTMMFFMKYPDTSDVRDIIVIA

SEQ ID NO: 3024932 - protein, 31 aa, Entamoeba invadens
YSTTQVIAIPTKPIYPLYKKVGMGGTFDRLH

SEQ ID NO: 3024933 - protein, 18 aa, Entamoeba invadens
YSTYLTICSALITSQSPA

SEQ ID NO: 3024934 - protein, 29 aa, Entamoeba invadens
YSVGAEPLSVPYFRTLMRATSQLTGGQYA

SEQ ID NO: 3024935 - protein, 30 aa, Entamoeba invadens
YSVVAKYLIPYNLVIFTEIFVKKGFTSPQL

SEQ ID NO: 3024936 - protein, 33 aa, Entamoeba invadens
YSVWDVKLPCKAYKFCFLLNISETKKLKEQLGD

SEQ ID NO: 3024937 - protein, 17 aa, Entamoeba invadens
YSYIPQKCFPEAWRGLR

SEQ ID NO: 3024938 - protein, 19 aa, Entamoeba invadens
YSYLDSLIPVLKPKDVNLK

SEQ ID NO: 3024939 - protein, 17 aa, Entamoeba invadens
YSYYIRAVDKDLKIHTR

SEQ ID NO: 3024940 - protein, 25 aa, Entamoeba invadens
YTANELIGFIPLHNVTLCVLATSFP

SEQ ID NO: 3024941 - protein, 27 aa, Entamoeba invadens
YTAYKDDFFVKITLRIPKYVPMLRHLL

SEQ ID NO: 3024942 - protein, 19 aa, Entamoeba invadens
YTCDMHVLVILTDMSSYAD

SEQ ID NO: 3024943 - protein, 17 aa, Entamoeba invadens
YTCRRRTNRWNIWALYD

SEQ ID NO: 3024944 - protein, 27 aa, Entamoeba invadens
YTCSQGLMLMIPNMIKIAGEHLPCVFH

SEQ ID NO: 3024945 - protein, 27 aa, Entamoeba invadens
YTDGIYPTLTLLFYLFQETEKDSEKVL

SEQ ID NO: 3024946 - protein, 25 aa, Entamoeba invadens
YTDRGCLFDLLQGPKLDWDMMNQIC

SEQ ID NO: 3024947 - protein, 17 aa, Entamoeba invadens
YTDWLKEYFDSCYVVAV

SEQ ID NO: 3024948 - protein, 17 aa, Entamoeba invadens
YTEIPLYYTWTKGEWKK

SEQ ID NO: 3024949 - protein, 29 aa, Entamoeba invadens
YTEKDTLIPFVKRYVVWFTVSLTDSYSLF

SEQ ID NO: 3024950 - protein, 27 aa, Entamoeba invadens
YTEKNGKPLPFKTGLRNGFEVLSIYSI

SEQ ID NO: 3024951 - protein, 26 aa, Entamoeba invadens
YTEKVIPYLLQVDLIRSPNLKILFKK

SEQ ID NO: 3024952 - protein, 23 aa, Entamoeba invadens
YTELTHTLSYLQEFMYSGIGLTD

SEQ ID NO: 3024953 - protein, 20 aa, Entamoeba invadens
YTESLWLYYKVNLECPNVVY

SEQ ID NO: 3024954 - protein, 31 aa, Entamoeba invadens
YTFFKKYKNLCEIVFPITIKKFESLILDECN

SEQ ID NO: 3024955 - protein, 18 aa, Entamoeba invadens
YTFFQIPEFRLELLQLVR

SEQ ID NO: 3024956 - protein, 20 aa, Entamoeba invadens
YTFNSFAEPLTPRGSTQPSL

SEQ ID NO: 3024957 - protein, 19 aa, Entamoeba invadens
YTFPDPPQNFLCCDGGIEK

SEQ ID NO: 3024958 - protein, 26 aa, Entamoeba invadens
YTFTEFLTKYLPTSILLKPNSFVVSD

SEQ ID NO: 3024959 - protein, 18 aa, Entamoeba invadens
YTFYFDPQVLYLRPRLSS

SEQ ID NO: 3024960 - protein, 28 aa, Entamoeba invadens
YTGKTLTLFNVIWISKRMSLVLSKNREI

SEQ ID NO: 3024961 - protein, 19 aa, Entamoeba invadens
YTHLCDIWSLGVTVFVSMC

SEQ ID NO: 3024962 - protein, 17 aa, Entamoeba invadens
YTHLFNEHLIQMKDNIN

SEQ ID NO: 3024963 - protein, 19 aa, Entamoeba invadens
YTHLYSLELSITDSIVILP

SEQ ID NO: 3024964 - protein, 18 aa, Entamoeba invadens
YTHNLIAFIAPKVKKNVA

SEQ ID NO: 3024965 - protein, 21 aa, Entamoeba invadens
YTIDPTFAGALDPLVRLGLPD

SEQ ID NO: 3024966 - protein, 17 aa, Entamoeba invadens
YTILKSKPQALARLLNS

SEQ ID NO: 3024967 - protein, 21 aa, Entamoeba invadens
YTILTHHMLISCILHHFNVEF

SEQ ID NO: 3024968 - protein, 22 aa, Entamoeba invadens
YTILTHHMLISCILRHFGKEFD

SEQ ID NO: 3024969 - protein, 19 aa, Entamoeba invadens
YTIVFHKPSKTKTLSMKLL

SEQ ID NO: 3024970 - protein, 19 aa, Entamoeba invadens
YTIVNWNILFKVEDNNWNI

SEQ ID NO: 3024971 - protein, 18 aa, Entamoeba invadens
YTIYKALKNKYSFEGDVV

SEQ ID NO: 3024972 - protein, 25 aa, Entamoeba invadens
YTKDILKLFPNIKTLHIPSYRIQIQ

SEQ ID NO: 3024973 - protein, 30 aa, Entamoeba invadens
YTKFYGIFQILIFIFSFKKITTKNLVFLKA

SEQ ID NO: 3024974 - protein, 25 aa, Entamoeba invadens
YTKSRVFFVMELVTGGDLFSYLFGD

SEQ ID NO: 3024975 - protein, 18 aa, Entamoeba invadens
YTLFKPITDSYITKYTEE

SEQ ID NO: 3024976 - protein, 26 aa, Entamoeba invadens
YTLKRLMKFPPVFSLRPIIEMAISIS

SEQ ID NO: 3024977 - protein, 17 aa, Entamoeba invadens
YTLLLKLEQDLALKYKA

SEQ ID NO: 3024978 - protein, 17 aa, Entamoeba invadens
YTLPPTNEPLRTFPPGT

SEQ ID NO: 3024979 - protein, 20 aa, Entamoeba invadens
YTMLSLFSIGSRRGKSATLI

SEQ ID NO: 3024980 - protein, 32 aa, Entamoeba invadens
YTMVKKICIVLGPSPLFMPKKLGQRINIDVEK

SEQ ID NO: 3024981 - protein, 23 aa, Entamoeba invadens
YTNDWVIDGFHFVLSLESNGRYS

SEQ ID NO: 3024982 - protein, 18 aa, Entamoeba invadens
YTNFCGFEIAFHVAPLLP

SEQ ID NO: 3024983 - protein, 31 aa, Entamoeba invadens
YTNHAYQFYIMFHVAPLLPLLEEDEQALERK

SEQ ID NO: 3024984 - protein, 18 aa, Entamoeba invadens
YTNNDFNILMGTETPVKK

SEQ ID NO: 3024985 - protein, 27 aa, Entamoeba invadens
YTNNVFFKRFVLNKVNILIPLKRCLKL

SEQ ID NO: 3024986 - protein, 23 aa, Entamoeba invadens
YTNTLSIILPIIEPLGLANDELA

SEQ ID NO: 3024987 - protein, 25 aa, Entamoeba invadens
YTPETQPLSFWIFDIKGVEDAINRW

SEQ ID NO: 3024988 - protein, 32 aa, Entamoeba invadens
YTPKNYCEITLNTPFQKLISFGLVDNPNYTNK

SEQ ID NO: 3024989 - protein, 17 aa, Entamoeba invadens
YTPPPPLQQRPGGRQRL

SEQ ID NO: 3024990 - protein, 18 aa, Entamoeba invadens
YTPQPIEGIFRKSPVNKT

SEQ ID NO: 3024991 - protein, 33 aa, Entamoeba invadens
YTPYDFSCPFPKTCWMLRNIVHFYNEAFRVLSV

SEQ ID NO: 3024992 - protein, 21 aa, Entamoeba invadens
YTQDLLFNKVKTFFTLSQNVE

SEQ ID NO: 3024993 - protein, 19 aa, Entamoeba invadens
YTQFFISSNFPPLAEQWNS

SEQ ID NO: 3024994 - protein, 19 aa, Entamoeba invadens
YTQILVYLHNVPRLINLDE

SEQ ID NO: 3024995 - protein, 19 aa, Entamoeba invadens
YTQKFKIMKSFMKVDRMVI

SEQ ID NO: 3024996 - protein, 18 aa, Entamoeba invadens
YTQMGYAVFYSWLKLKEQ

SEQ ID NO: 3024997 - protein, 23 aa, Entamoeba invadens
YTQNVLEILKLWLKQDPLQFNEV

SEQ ID NO: 3024998 - protein, 22 aa, Entamoeba invadens
YTRAMLFLQNIYGKGVYNIESG

SEQ ID NO: 3024999 - protein, 28 aa, Entamoeba invadens
YTRGVDHFGIFFAPLRQGITPETPRDIW

SEQ ID NO: 3025000 - protein, 32 aa, Entamoeba invadens
YTRNKQVDLFLEFLKFGLTLKEALSYTQVTSE

SEQ ID NO: 3025001 - protein, 30 aa, Entamoeba invadens
YTRRDLYNTLLTFPLIYPISLEPELLKENR

SEQ ID NO: 3025002 - protein, 20 aa, Entamoeba invadens
YTRVLLFLREIYGNDVLNIS

SEQ ID NO: 3025003 - protein, 18 aa, Entamoeba invadens
YTRYVDKFYMVLRLTREE

SEQ ID NO: 3025004 - protein, 27 aa, Entamoeba invadens
YTSEDLITLFSLFPKLHTLYCDASVFP

SEQ ID NO: 3025005 - protein, 26 aa, Entamoeba invadens
YTSELKFVEKFLAKTQLKDLDDKFAL

SEQ ID NO: 3025006 - protein, 17 aa, Entamoeba invadens
YTSFVYPKRVHDIRGGA

SEQ ID NO: 3025007 - protein, 27 aa, Entamoeba invadens
YTSKKHPWEILLQKLVIYLPKTQNISV

SEQ ID NO: 3025008 - protein, 22 aa, Entamoeba invadens
YTSSSFSIFKLLDSITSLGISS

SEQ ID NO: 3025009 - protein, 25 aa, Entamoeba invadens
YTTDSAIYSLYTPTIYPSFEKKLQD

SEQ ID NO: 3025010 - protein, 33 aa, Entamoeba invadens
YTTIGNTFKLFIPFFKDYFYYISHYDTSSKIIS

SEQ ID NO: 3025011 - protein, 17 aa, Entamoeba invadens
YTTILSLFQKKTSYDFR

SEQ ID NO: 3025012 - protein, 24 aa, Entamoeba invadens
YTTNNKIIPLLKLLISTEVEKCQH

SEQ ID NO: 3025013 - protein, 24 aa, Entamoeba invadens
YTTQYLVMLNLYLILKHQTDAVNV

SEQ ID NO: 3025014 - protein, 20 aa, Entamoeba invadens
YTTQYMITSNRLQDLVANLN

SEQ ID NO: 3025015 - protein, 32 aa, Entamoeba invadens
YTTSIRPGAIQFLRQLSKTCEVVLFTASKQVY

SEQ ID NO: 3025016 - protein, 17 aa, Entamoeba invadens
YTTYPIILTNFEKRYDN

SEQ ID NO: 3025017 - protein, 21 aa, Entamoeba invadens
YTVALFLQFFTNNPAFVLHPH

SEQ ID NO: 3025018 - protein, 22 aa, Entamoeba invadens
YTVDLRWACWYVWKVENRRYSD

SEQ ID NO: 3025019 - protein, 29 aa, Entamoeba invadens
YTVTFTSTYLLTFYLKFLHITGNLCNVEN

SEQ ID NO: 3025020 - protein, 25 aa, Entamoeba invadens
YTVVKQCNFLIVLNSNLTALDTSDV

SEQ ID NO: 3025021 - protein, 22 aa, Entamoeba invadens
YVACHFARILKKHLLTENNLGV

SEQ ID NO: 3025022 - protein, 20 aa, Entamoeba invadens
YVAPKNWRRSYSSLFVSVNS

SEQ ID NO: 3025023 - protein, 25 aa, Entamoeba invadens
YVAQQPEIPVLFTRSLIIAIGKYAR

SEQ ID NO: 3025024 - protein, 20 aa, Entamoeba invadens
YVAWTPDIIIVTAPALPETM

SEQ ID NO: 3025025 - protein, 24 aa, Entamoeba invadens
YVDCPQIFIPWYQMIADQQNSRNF

SEQ ID NO: 3025026 - protein, 19 aa, Entamoeba invadens
YVDDLRFLSTLSLILTQHN

SEQ ID NO: 3025027 - protein, 29 aa, Entamoeba invadens
YVDDVVNAFDLILRKGVVGQIYNIGTTRE

SEQ ID NO: 3025028 - protein, 18 aa, Entamoeba invadens
YVDLKNELNYYKDLLNET

SEQ ID NO: 3025029 - protein, 18 aa, Entamoeba invadens
YVDNIKTLVYYFDELRAQ

SEQ ID NO: 3025030 - protein, 23 aa, Entamoeba invadens
YVDNSLLTFCDCASRIMSSSVSG

SEQ ID NO: 3025031 - protein, 19 aa, Entamoeba invadens
YVDWGIPHYLKTGAVTPEN

SEQ ID NO: 3025032 - protein, 19 aa, Entamoeba invadens
YVEDVWYEHGEGFKIFFLH

SEQ ID NO: 3025033 - protein, 22 aa, Entamoeba invadens
YVEFCDLKTIHKNFQSLPTDYK

SEQ ID NO: 3025034 - protein, 26 aa, Entamoeba invadens
YVEGHDLFHLIFTNKLMNEKYIRNIA

SEQ ID NO: 3025035 - protein, 37 aa, Entamoeba invadens
YVELNWLIHFELHTPFVLSYYKYWTELVPKDDVPKFP

SEQ ID NO: 3025036 - protein, 27 aa, Entamoeba invadens
YVENFLNLPNCLFTRFLRAEVSLDETN

SEQ ID NO: 3025037 - protein, 17 aa, Entamoeba invadens
YVEWKFYCEYCFKELKE

SEQ ID NO: 3025038 - protein, 20 aa, Entamoeba invadens
YVEYSYLKKGFGHNVFLEGQ

SEQ ID NO: 3025039 - protein, 19 aa, Entamoeba invadens
YVFPNERLPIGKYNPSDNQ

SEQ ID NO: 3025040 - protein, 26 aa, Entamoeba invadens
YVFTETFPTIFEIPSAFHLVNMRTDV

SEQ ID NO: 3025041 - protein, 29 aa, Entamoeba invadens
YVGDEAVAKLPWKLLRHPVNHGLIKNFED

SEQ ID NO: 3025042 - protein, 20 aa, Entamoeba invadens
YVGELPLLNSLKMKFCPFCD

SEQ ID NO: 3025043 - protein, 24 aa, Entamoeba invadens
YVGLIEMYIGCYLKIMDLLKVFEG

SEQ ID NO: 3025044 - protein, 26 aa, Entamoeba invadens
YVGNADLFFFEIKSFDLRQPEFSNYT

SEQ ID NO: 3025045 - protein, 19 aa, Entamoeba invadens
YVGTLFGVSTLFPEWRMEA

SEQ ID NO: 3025046 - protein, 34 aa, Entamoeba invadens
YVHIDSIANFYKSKGILKLFPWQVECLEKSEVLA

SEQ ID NO: 3025047 - protein, 30 aa, Entamoeba invadens
YVIHNRMYILLPPAILLKDIPITNTFLLSH

SEQ ID NO: 3025048 - protein, 20 aa, Entamoeba invadens
YVIKCCGGFFASPYNNLEFW

SEQ ID NO: 3025049 - protein, 17 aa, Entamoeba invadens
YVIKTFKSYEELRLIIL

SEQ ID NO: 3025050 - protein, 25 aa, Entamoeba invadens
YVIQKLFEFGTVWQKSQLTKRLTGC

SEQ ID NO: 3025051 - protein, 23 aa, Entamoeba invadens
YVIQTLLKIFSDNDVDFFYNGMQ

SEQ ID NO: 3025052 - protein, 18 aa, Entamoeba invadens
YVITLEEIDMTLGGVLTS

SEQ ID NO: 3025053 - protein, 27 aa, Entamoeba invadens
YVKDDKDFFVFSLKSPSGSEATMVKRK

SEQ ID NO: 3025054 - protein, 17 aa, Entamoeba invadens
YVKFVKDKLKRCEKMLK

SEQ ID NO: 3025055 - protein, 27 aa, Entamoeba invadens
YVKHQGLLRKCFISTKGFFYTASVCGI

SEQ ID NO: 3025056 - protein, 18 aa, Entamoeba invadens
YVKIVLCKKCYLATRRKS

SEQ ID NO: 3025057 - protein, 33 aa, Entamoeba invadens
YVKKKSSFFYWKKLYMVYKDTTLYFFDTPTSPS

SEQ ID NO: 3025058 - protein, 25 aa, Entamoeba invadens
YVKQRRNFYFNWWTGNHTQNSYTMN

SEQ ID NO: 3025059 - protein, 18 aa, Entamoeba invadens
YVKRLMKCILTVLSDKGN

SEQ ID NO: 3025060 - protein, 29 aa, Entamoeba invadens
YVKWNTDFHILYFWQGRNCPTLDKGACAR

SEQ ID NO: 3025061 - protein, 21 aa, Entamoeba invadens
YVKYLNVIDIRRLGSGLLSGI

SEQ ID NO: 3025062 - protein, 18 aa, Entamoeba invadens
YVKYVFGVLTRNSTGNIR

SEQ ID NO: 3025063 - protein, 24 aa, Entamoeba invadens
YVLDSVVIPHSCPLFVSIPVCRTT

SEQ ID NO: 3025064 - protein, 39 aa, Entamoeba invadens
YVLFEKIIQFIFENPVLGYYAFPHYIKLTDTTKIPYFNF

SEQ ID NO: 3025065 - protein, 27 aa, Entamoeba invadens
YVLKISNFLFNIKTVFSFGIVEVLRDE

SEQ ID NO: 3025066 - protein, 17 aa, Entamoeba invadens
YVLNLQLLDEVYMEHQG

SEQ ID NO: 3025067 - protein, 33 aa, Entamoeba invadens
YVLVESKDRFRLLYTFLRKYKGKKMIVFMSSCN

SEQ ID NO: 3025068 - protein, 22 aa, Entamoeba invadens
YVLYETIKELLLHNTVLCISTK

SEQ ID NO: 3025069 - protein, 23 aa, Entamoeba invadens
YVLYFIRKMACSPSRRLYDLKPI

SEQ ID NO: 3025070 - protein, 17 aa, Entamoeba invadens
YVLYNDKCVYLEATPTQ

SEQ ID NO: 3025071 - protein, 18 aa, Entamoeba invadens
YVMCLFDGTWMKKTSLAN

SEQ ID NO: 3025072 - protein, 18 aa, Entamoeba invadens
YVMHGIVFKFVEDKSNDK

SEQ ID NO: 3025073 - protein, 18 aa, Entamoeba invadens
YVMIISKYLKDVGDFIKL

SEQ ID NO: 3025074 - protein, 18 aa, Entamoeba invadens
YVMIVSKYFKDIGDFIKL

SEQ ID NO: 3025075 - protein, 25 aa, Entamoeba invadens
YVMLRRMFDFLKVKNNNILDEKCLL

SEQ ID NO: 3025076 - protein, 18 aa, Entamoeba invadens
YVMLSFSPHTLEIRVRGL

SEQ ID NO: 3025077 - protein, 27 aa, Entamoeba invadens
YVNEPFFGLVLFYLKSSTDSGLFEYLA

SEQ ID NO: 3025078 - protein, 18 aa, Entamoeba invadens
YVNISPSPNPFLFTNQKE

SEQ ID NO: 3025079 - protein, 17 aa, Entamoeba invadens
YVNLKPKEKSRDGLKKI

SEQ ID NO: 3025080 - protein, 17 aa, Entamoeba invadens
YVNLPYTMFLSGTKYKV

SEQ ID NO: 3025081 - protein, 25 aa, Entamoeba invadens
YVNLRPVFQIQGIWLSLQNLIDITT

SEQ ID NO: 3025082 - protein, 27 aa, Entamoeba invadens
YVNNTPYAIPLFDMNYFNTIQPCYFNM

SEQ ID NO: 3025083 - protein, 25 aa, Entamoeba invadens
YVNNYMIDVLSELGFFFNTKLSKKS

SEQ ID NO: 3025084 - protein, 19 aa, Entamoeba invadens
YVNSYPQSVCGSQSPVYCV

SEQ ID NO: 3025085 - protein, 23 aa, Entamoeba invadens
YVNYAMCINFDKINFFDKIDENW

SEQ ID NO: 3025086 - protein, 31 aa, Entamoeba invadens
YVNYILKKKDWVKEPFIKPFDVVVDVELPNC

SEQ ID NO: 3025087 - protein, 19 aa, Entamoeba invadens
YVPLKDLMSPEELAIAFNC

SEQ ID NO: 3025088 - protein, 17 aa, Entamoeba invadens
YVPNLIGVQILSMSKRI

SEQ ID NO: 3025089 - protein, 25 aa, Entamoeba invadens
YVPSNTNLSLCILCQAFDSNCESCV

SEQ ID NO: 3025090 - protein, 24 aa, Entamoeba invadens
YVPSNTNLSMCILCQAFDSNCESC

SEQ ID NO: 3025091 - protein, 17 aa, Entamoeba invadens
YVPTPQSFWDKSGVAAY

SEQ ID NO: 3025092 - protein, 26 aa, Entamoeba invadens
YVQKNDLPMFLKLFTTLSKNVSSVED

SEQ ID NO: 3025093 - protein, 23 aa, Entamoeba invadens
YVQPPTYIQPTPVYFQPTLVQPQ

SEQ ID NO: 3025094 - protein, 27 aa, Entamoeba invadens
YVQQPLPQIPTLTHPKIVPAPLVKPQQ

SEQ ID NO: 3025095 - protein, 26 aa, Entamoeba invadens
YVQTTMNMIPVFLKMIEKSLVLYLEG

SEQ ID NO: 3025096 - protein, 31 aa, Entamoeba invadens
YVRALKELPMSYKLWHTFLLSSERDARGTPL

SEQ ID NO: 3025097 - protein, 17 aa, Entamoeba invadens
YVRFSYSAPPEYFTEYF

SEQ ID NO: 3025098 - protein, 18 aa, Entamoeba invadens
YVRHNILPEIGIAGQEKL

SEQ ID NO: 3025099 - protein, 25 aa, Entamoeba invadens
YVRMSNLLWMTYRSGYEKLPNSSLN

SEQ ID NO: 3025100 - protein, 26 aa, Entamoeba invadens
YVRNAVLTFCLYIIDGKEKYITMLLE

SEQ ID NO: 3025101 - protein, 18 aa, Entamoeba invadens
YVRPIVTPRFAVSCSLEL

SEQ ID NO: 3025102 - protein, 22 aa, Entamoeba invadens
YVSAVLCCLSVMSSLEIPHINV

SEQ ID NO: 3025103 - protein, 20 aa, Entamoeba invadens
YVSENCYFPRMFMKIEDDCV

SEQ ID NO: 3025104 - protein, 26 aa, Entamoeba invadens
YVSKADGFLMMYSIDDYKLLNKLIFS

SEQ ID NO: 3025105 - protein, 34 aa, Entamoeba invadens
YVSLRDQFYVKGDAFILVYSIDNLNSFHSLNIHY

SEQ ID NO: 3025106 - protein, 29 aa, Entamoeba invadens
YVSRLKQFLEFYLAKALQIFPGDSILKKC

SEQ ID NO: 3025107 - protein, 27 aa, Entamoeba invadens
YVSVKRQLIMIFMRLGDLYNKTGELSK

SEQ ID NO: 3025108 - protein, 21 aa, Entamoeba invadens
YVSVLSQLFLPILNVRSIALV

SEQ ID NO: 3025109 - protein, 19 aa, Entamoeba invadens
YVTAALFHGPRQLGKQFTT

SEQ ID NO: 3025110 - protein, 30 aa, Entamoeba invadens
YVTIADFDLPVWYFSPYPGKYGNVERLYVC

SEQ ID NO: 3025111 - protein, 20 aa, Entamoeba invadens
YVTNLFKWLDKNEDGFLEGT

SEQ ID NO: 3025112 - protein, 22 aa, Entamoeba invadens
YVTPIVFQIRYFRQHSTRYDKK

SEQ ID NO: 3025113 - protein, 25 aa, Entamoeba invadens
YVTQEIFEMWVLNFVLKTISATKTQ

SEQ ID NO: 3025114 - protein, 25 aa, Entamoeba invadens
YVVHIRYSYFPGMTKKRSGPSMFEP

SEQ ID NO: 3025115 - protein, 25 aa, Entamoeba invadens
YVVKKLTSYTLVFADLSKGLNSPSL

SEQ ID NO: 3025116 - protein, 18 aa, Entamoeba invadens
YVVLQDFNMFLSQSYKNL

SEQ ID NO: 3025117 - protein, 19 aa, Entamoeba invadens
YVVNNPIDWSYSYCLPVLV

SEQ ID NO: 3025118 - protein, 28 aa, Entamoeba invadens
YVVNNPLNWEYSYCLPLLVITFGDGHPV

SEQ ID NO: 3025119 - protein, 25 aa, Entamoeba invadens
YVVYNKNVLFLLLQIVDTISKMNTS

SEQ ID NO: 3025120 - protein, 18 aa, Entamoeba invadens
YVWQVMIVGPPDTYYDGG

SEQ ID NO: 3025121 - protein, 18 aa, Entamoeba invadens
YVYEYPVSYSFYLSNKST

SEQ ID NO: 3025122 - protein, 18 aa, Entamoeba invadens
YVYFQNELGQIKAKIQKY

SEQ ID NO: 3025123 - protein, 19 aa, Entamoeba invadens
YVYVPLQSFLESLAVNPAY

SEQ ID NO: 3025124 - protein, 25 aa, Entamoeba invadens
YWDNVVYPYVKYPKKKDYDDLLVLM

SEQ ID NO: 3025125 - protein, 17 aa, Entamoeba invadens
YWKGNVTLFPVVFSSPV

SEQ ID NO: 3025126 - protein, 20 aa, Entamoeba invadens
YWKLWMKQNSQDLLKQVFKF

SEQ ID NO: 3025127 - protein, 20 aa, Entamoeba invadens
YWMDQQLLLLHIDNILFYQT

SEQ ID NO: 3025128 - protein, 23 aa, Entamoeba invadens
YWMSNENLKWFDGYNGQKVAILD

SEQ ID NO: 3025129 - protein, 24 aa, Entamoeba invadens
YWNHARVLICVISLDNLDIINNSK

SEQ ID NO: 3025130 - protein, 26 aa, Entamoeba invadens
YWSSKMFATYLIYNKVPKPQSFMIST

SEQ ID NO: 3025131 - protein, 17 aa, Entamoeba invadens
YWTCIYGSKKKTEVFYN

SEQ ID NO: 3025132 - protein, 21 aa, Entamoeba invadens
YWVCQRLQLEILMNVIDLDNL

SEQ ID NO: 3025133 - protein, 21 aa, Entamoeba invadens
YYADRKVEWALLEEKAMKYLA

SEQ ID NO: 3025134 - protein, 21 aa, Entamoeba invadens
YYAKLCGYFVPYRPGAFPSVP

SEQ ID NO: 3025135 - protein, 20 aa, Entamoeba invadens
YYANIIKKFFLDNKNCVYVK

SEQ ID NO: 3025136 - protein, 18 aa, Entamoeba invadens
YYARRKMIFQDKDKYRTP

SEQ ID NO: 3025137 - protein, 18 aa, Entamoeba invadens
YYASNSVGYPLVLPKNVT

SEQ ID NO: 3025138 - protein, 18 aa, Entamoeba invadens
YYCSKLSNVVLPLSLTVI

SEQ ID NO: 3025139 - protein, 23 aa, Entamoeba invadens
YYDNAAFKLLTLLSQNMLAEFHT

SEQ ID NO: 3025140 - protein, 31 aa, Entamoeba invadens
YYDQFNSLINYKGGLLLPFRSELYIECNSLE

SEQ ID NO: 3025141 - protein, 17 aa, Entamoeba invadens
YYEFFFKEKIRAVETNH

SEQ ID NO: 3025142 - protein, 24 aa, Entamoeba invadens
YYEGGKWSFLFECPRDYPNNPPKV

SEQ ID NO: 3025143 - protein, 18 aa, Entamoeba invadens
YYEIQADLFEYKHTLTTF

SEQ ID NO: 3025144 - protein, 18 aa, Entamoeba invadens
YYEVIIKHKSEMSIGIFD

SEQ ID NO: 3025145 - protein, 19 aa, Entamoeba invadens
YYEVMIEKIVYYYSDTFDT

SEQ ID NO: 3025146 - protein, 28 aa, Entamoeba invadens
YYFGEFEFLHFLVQNLVAIVFYNTNKSN

SEQ ID NO: 3025147 - protein, 28 aa, Entamoeba invadens
YYFGEFKIFHFLVQNLVALVFYNNTKYD

SEQ ID NO: 3025148 - protein, 37 aa, Entamoeba invadens
YYFIRENMLIAFIAKHFDITLPLGPYSFLMSISNKIG

SEQ ID NO: 3025149 - protein, 21 aa, Entamoeba invadens
YYFNTIDDPLFINFLNQRLLY

SEQ ID NO: 3025150 - protein, 24 aa, Entamoeba invadens
YYGRTELGPFHHSFTTIVGANGSG

SEQ ID NO: 3025151 - protein, 30 aa, Entamoeba invadens
YYGTIEQMYTFYTQLFPCITMFIERASCVN

SEQ ID NO: 3025152 - protein, 23 aa, Entamoeba invadens
YYGYNPAVPLYYQRLHSNHEMFV

SEQ ID NO: 3025153 - protein, 17 aa, Entamoeba invadens
YYICRGAVRLFEFAGKK

SEQ ID NO: 3025154 - protein, 22 aa, Entamoeba invadens
YYIQNGTVMYLMPAKDIVSKTS

SEQ ID NO: 3025155 - protein, 17 aa, Entamoeba invadens
YYISYTNCDVKITMISC

SEQ ID NO: 3025156 - protein, 19 aa, Entamoeba invadens
YYIVMDLQGIDLSTFTRKL

SEQ ID NO: 3025157 - protein, 19 aa, Entamoeba invadens
YYKGFYNCCLLEELVLDDY

SEQ ID NO: 3025158 - protein, 27 aa, Entamoeba invadens
YYKQIKKFRLQMLQPLSTIVLEKVFPS

SEQ ID NO: 3025159 - protein, 25 aa, Entamoeba invadens
YYKTPEVRPQYFRVADPSTGKPEAM

SEQ ID NO: 3025160 - protein, 20 aa, Entamoeba invadens
YYKVRQFSKTFSKNGKLLLR

SEQ ID NO: 3025161 - protein, 19 aa, Entamoeba invadens
YYLENQIFAPVSRIFEVFS

SEQ ID NO: 3025162 - protein, 18 aa, Entamoeba invadens
YYLLGKKDNTQQSKTPSK

SEQ ID NO: 3025163 - protein, 17 aa, Entamoeba invadens
YYLLNQKCLSCEAGTYK

SEQ ID NO: 3025164 - protein, 33 aa, Entamoeba invadens
YYLNNGFSIPYDIFSMLLPHQRVAIKWLWEHHN

SEQ ID NO: 3025165 - protein, 20 aa, Entamoeba invadens
YYLQKLTQYEEARQKRFLDF

SEQ ID NO: 3025166 - protein, 25 aa, Entamoeba invadens
YYMSDTQFIFPISPATSIGDTCEEM

SEQ ID NO: 3025167 - protein, 25 aa, Entamoeba invadens
YYMSDTQFIFPISPATSIGETCEEM

SEQ ID NO: 3025168 - protein, 23 aa, Entamoeba invadens
YYNSLKLQLIVPPSLIQQIEKRT

SEQ ID NO: 3025169 - protein, 17 aa, Entamoeba invadens
YYPLINNSLKFTTWTFK

SEQ ID NO: 3025170 - protein, 17 aa, Entamoeba invadens
YYPMLTLDFNTNKRVVD

SEQ ID NO: 3025171 - protein, 17 aa, Entamoeba invadens
YYPPIIKDLLDVNNNYH

SEQ ID NO: 3025172 - protein, 23 aa, Entamoeba invadens
YYPSHTFMRMVDLIEPEKYFWMK

SEQ ID NO: 3025173 - protein, 17 aa, Entamoeba invadens
YYQQVHLVLYIIDDDGC

SEQ ID NO: 3025174 - protein, 19 aa, Entamoeba invadens
YYRDELFMKIIEIIKKDNY

SEQ ID NO: 3025175 - protein, 26 aa, Entamoeba invadens
YYRSTNGVILVFDMTQRESFNKVVEW

SEQ ID NO: 3025176 - protein, 24 aa, Entamoeba invadens
YYRTIEGFLVLIQREWVAMGHRFT

SEQ ID NO: 3025177 - protein, 18 aa, Entamoeba invadens
YYRVLVTIACCFIKQTSR

SEQ ID NO: 3025178 - protein, 21 aa, Entamoeba invadens
YYSIGIDALIALTFHTKRNAN

SEQ ID NO: 3025179 - protein, 17 aa, Entamoeba invadens
YYSLCHQCPPLIGMAQP

SEQ ID NO: 3025180 - protein, 25 aa, Entamoeba invadens
YYSNVLIDVWYFIGNIVYYADMDYT

SEQ ID NO: 3025181 - protein, 25 aa, Entamoeba invadens
YYTDQLQFLFPGRNVTYINSLPTSS

SEQ ID NO: 3025182 - protein, 30 aa, Entamoeba invadens
YYTETFHFPFYFEYLAKWPNLCYTAKNCNG

SEQ ID NO: 3025183 - protein, 24 aa, Entamoeba invadens
YYTNSFHVPVYFKITAADKIRKEA

SEQ ID NO: 3025184 - protein, 17 aa, Entamoeba invadens
YYVIISSADFKAAQFSN

SEQ ID NO: 3025185 - protein, 17 aa, Entamoeba invadens
YYVMSFKANGLHRFVLS

SEQ ID NO: 3025186 - protein, 24 aa, Entamoeba invadens
YYVSGHFYWYKLDDKWLIDNVDLY

SEQ ID NO: 3025187 - protein, 24 aa, Entamoeba invadens
YYYDFQLEIPFAPSHKVFMMQAVD

SEQ ID NO: 3025188 - protein, 17 aa, Entamoeba invadens
YYYSCQPNLFVEGQNVI

SEQ ID NO: 3025189 - protein, 17 aa, Entamoeba invadens
YYYTHADSGLGFNYALC

SEQ ID NO: 3025190 - protein, 18 aa, Entamoeba invadens
KIWHHTFYNELRIAPEEH

SEQ ID NO: 3025191 - protein, 22 aa, Entamoeba invadens
YKGIKVILIGYFKDASVSAGQN

SEQ ID NO: 3025192 - protein, 24 aa, Entamoeba invadens
ISKKPLRKFPFYLFKRMADGDYST

SEQ ID NO: 3025193 - protein, 20 aa, Entamoeba invadens
AIIEKLILLKAFLVDLVAVI

SEQ ID NO: 3025194 - protein, 22 aa, Entamoeba invadens
EKKRYNAILKRYTLLKAHGVKV

SEQ ID NO: 3025195 - protein, 25 aa, Entamoeba invadens
KVRGKFVVLLFYPLDWTFVCPTEML

SEQ ID NO: 3025196 - protein, 24 aa, Entamoeba invadens
LGDIHLKFIIQPFLHWPDTMMTVI

SEQ ID NO: 3025197 - protein, 17 aa, Entamoeba invadens
LIILFKLMRNKYGLLKR

SEQ ID NO: 3025198 - protein, 21 aa, Entamoeba invadens
TNPRKVFWTAIYRQLNKKGLQ

SEQ ID NO: 3025199 - protein, 25 aa, Entamoeba invadens
VKTWKKRWFVLKENRLWYFASKTAT

SEQ ID NO: 3025200 - protein, 25 aa, Entamoeba invadens
VLKKEFFRIIVWFNVDFETVDRNKN

SEQ ID NO: 3025201 - protein, 24 aa, Entamoeba invadens
YDRLRPLSYPQTDVFLICFSVVSP

SEQ ID NO: 3025202 - protein, 18 aa, Entamoeba invadens
YFDCIFGPFKPYVLKGIN

SEQ ID NO: 3025203 - protein, 19 aa, Entamoeba invadens
AYRRIIDLIIFLIDFKTQI

SEQ ID NO: 3025204 - protein, 17 aa, Entamoeba invadens
CLKIKFPDRFFLLRGNH

SEQ ID NO: 3025205 - protein, 18 aa, Entamoeba invadens
CSLRLAHYLAQCGSTLLV

SEQ ID NO: 3025206 - protein, 18 aa, Entamoeba invadens
DGQKFILNVLPKSPSDHL

SEQ ID NO: 3025207 - protein, 24 aa, Entamoeba invadens
DVCPLEMVLFMPYLCKKLEVPYCI

SEQ ID NO: 3025208 - protein, 23 aa, Entamoeba invadens
DVWRKFCWVFGYLPVAALIDSSI

SEQ ID NO: 3025209 - protein, 25 aa, Entamoeba invadens
EELRALIFYLMDRPYVMVSSDVKSV

SEQ ID NO: 3025210 - protein, 25 aa, Entamoeba invadens
ERRTNLQWFRVPPKIFFEPHAIRYL

SEQ ID NO: 3025211 - protein, 26 aa, Entamoeba invadens
EVDASPFRLWFLKRFGKDIASKDYIK

SEQ ID NO: 3025212 - protein, 18 aa, Entamoeba invadens
EYKIIRGYYWTGNKSDLL

SEQ ID NO: 3025213 - protein, 20 aa, Entamoeba invadens
EYKIIRGYYWTGNKSDLLSN

SEQ ID NO: 3025214 - protein, 22 aa, Entamoeba invadens
FGAPLHCLLIPSPQIDDPELDH

SEQ ID NO: 3025215 - protein, 17 aa, Entamoeba invadens
FHFNPIPLTHKTNMLFP

SEQ ID NO: 3025216 - protein, 26 aa, Entamoeba invadens
GISREPILIALFYNYGLSLLNNMTRR

SEQ ID NO: 3025217 - protein, 19 aa, Entamoeba invadens
GSEKMQFPFLLNSPDFEPE

SEQ ID NO: 3025218 - protein, 21 aa, Entamoeba invadens
GWCQAYTKHQFRFPWKIAEFV

SEQ ID NO: 3025219 - protein, 23 aa, Entamoeba invadens
IEFNIIRRYYWTGCKSNVFSNEI

SEQ ID NO: 3025220 - protein, 25 aa, Entamoeba invadens
IIKNICKFFWNVSLIKMIVSNNDYI

SEQ ID NO: 3025221 - protein, 17 aa, Entamoeba invadens
ILTYFLRCLISSSHLLK

SEQ ID NO: 3025222 - protein, 24 aa, Entamoeba invadens
IPNPYIIWVYCFVLFPKQISEEPL

SEQ ID NO: 3025223 - protein, 19 aa, Entamoeba invadens
ITSLKSALQLFLRQLPTDS

SEQ ID NO: 3025224 - protein, 22 aa, Entamoeba invadens
KQLYPYIKDWVPLPSIYYKSYI

SEQ ID NO: 3025225 - protein, 22 aa, Entamoeba invadens
KREKIIFYLWTPAACSIKEKMV

SEQ ID NO: 3025226 - protein, 18 aa, Entamoeba invadens
LADKKMIFFTKNGHFLLA

SEQ ID NO: 3025227 - protein, 25 aa, Entamoeba invadens
LIARQIVLDIFLPQSLYVKDEFSNE

SEQ ID NO: 3025228 - protein, 23 aa, Entamoeba invadens
LIARQIVLDVFLPQSLYVKDEFS

SEQ ID NO: 3025229 - protein, 24 aa, Entamoeba invadens
LKREFFRIIVWFNVDFETVDRNKS

SEQ ID NO: 3025230 - protein, 27 aa, Entamoeba invadens
LLPATTWPWYKLISAIKLFTFPPGVNR

SEQ ID NO: 3025231 - protein, 18 aa, Entamoeba invadens
LMVFHSLKLTTDKLRSIV

SEQ ID NO: 3025232 - protein, 24 aa, Entamoeba invadens
LNPHFCKLIAWYDNEWGYSTRLVD

SEQ ID NO: 3025233 - protein, 17 aa, Entamoeba invadens
LVFSFPSDEPFPYCLDC

SEQ ID NO: 3025234 - protein, 17 aa, Entamoeba invadens
MIFFTKNGHFLLAVSYD

SEQ ID NO: 3025235 - protein, 25 aa, Entamoeba invadens
NDKLLYLMNFMNYKINFFFPSEKQS

SEQ ID NO: 3025236 - protein, 27 aa, Entamoeba invadens
PDDRILLLYLFFKYDKLRIIRDLCLPF

SEQ ID NO: 3025237 - protein, 24 aa, Entamoeba invadens
PGGLMPPGMLPPPGLAPPGGMMPP

SEQ ID NO: 3025238 - protein, 20 aa, Entamoeba invadens
PINNIPNIFFHKLLIYVYIC

SEQ ID NO: 3025239 - protein, 23 aa, Entamoeba invadens
PLNPDWMYIRAAAIARQVYLNQG

SEQ ID NO: 3025240 - protein, 17 aa, Entamoeba invadens
QIIVWFTVDFDTFNTNK

SEQ ID NO: 3025241 - protein, 24 aa, Entamoeba invadens
RGTNPYMKLLGRIYAFLAKRTQSK

SEQ ID NO: 3025242 - protein, 18 aa, Entamoeba invadens
SALLLFVNSNWKVFGAFI

SEQ ID NO: 3025243 - protein, 26 aa, Entamoeba invadens
SEYKGKFIVLLFYPLDWTFVCPTEMM

SEQ ID NO: 3025244 - protein, 27 aa, Entamoeba invadens
SEYKGKFIVLLFYPLDWTFVCPTEMMG

SEQ ID NO: 3025245 - protein, 22 aa, Entamoeba invadens
SINYFIYFIDFFEQYETRDNFK

SEQ ID NO: 3025246 - protein, 18 aa, Entamoeba invadens
SKFRLPLGIRHLPESLFA

SEQ ID NO: 3025247 - protein, 18 aa, Entamoeba invadens
SPWKDQFPEWALLPKTSE

SEQ ID NO: 3025248 - protein, 24 aa, Entamoeba invadens
TKGYRYKMRVVYAHFPVNLVIADD

SEQ ID NO: 3025249 - protein, 24 aa, Entamoeba invadens
TNVGKTCLLLTYTTNAFPETYVPT

SEQ ID NO: 3025250 - protein, 24 aa, Entamoeba invadens
VAKSKFWMMLKKQQKIKKADASLL

SEQ ID NO: 3025251 - protein, 25 aa, Entamoeba invadens
VTKEFFQIVIWFNVNYRTVVKNRGK

SEQ ID NO: 3025252 - protein, 17 aa, Entamoeba invadens
YKIIRGYYWTGNKSDLL

SEQ ID NO: 3025253 - protein, 21 aa, Entamoeba invadens
YYSYDFLFNFFPHLNTLTGNL

SEQ ID NO: 3025254 - protein, 17 aa, Entamoeba invadens
AAEFFIGIPLFPGSSEY

SEQ ID NO: 3025255 - protein, 17 aa, Entamoeba invadens
AAIPSIDFTSLNLGNPA

SEQ ID NO: 3025256 - protein, 23 aa, Entamoeba invadens
AANTFHFLLLSMPPKNLKVLAFY

SEQ ID NO: 3025257 - protein, 25 aa, Entamoeba invadens
AAQQSFLIGWLGYLGYHVRVNRLYK

SEQ ID NO: 3025258 - protein, 17 aa, Entamoeba invadens
AARIKRQLIFKGVLKGD

SEQ ID NO: 3025259 - protein, 21 aa, Entamoeba invadens
AATPFLLYDVPSNYGWLFLSA

SEQ ID NO: 3025260 - protein, 18 aa, Entamoeba invadens
AAVLPPPGLVPPPPGILP

SEQ ID NO: 3025261 - protein, 18 aa, Entamoeba invadens
AAYFYSDFLVYVPELENY

SEQ ID NO: 3025262 - protein, 19 aa, Entamoeba invadens
AAYVIPLVSFISKLPRLTR

SEQ ID NO: 3025263 - protein, 26 aa, Entamoeba invadens
ACCGYFFWDLMHFIPYPLVEKLFDFV

SEQ ID NO: 3025264 - protein, 17 aa, Entamoeba invadens
ACELSFVKLLQQIGKMK

SEQ ID NO: 3025265 - protein, 17 aa, Entamoeba invadens
ACFFLLISNINNAQKSM

SEQ ID NO: 3025266 - protein, 21 aa, Entamoeba invadens
ACGMYFLFGLLLSAGFKQVGT

SEQ ID NO: 3025267 - protein, 17 aa, Entamoeba invadens
ACILILLKSVLKTNFFC

SEQ ID NO: 3025268 - protein, 17 aa, Entamoeba invadens
ACLAAFVKRAWAKDVKL

SEQ ID NO: 3025269 - protein, 17 aa, Entamoeba invadens
ACLVLFNVLNELKFNSA

SEQ ID NO: 3025270 - protein, 17 aa, Entamoeba invadens
ACMNYMALARNYQFIVL

SEQ ID NO: 3025271 - protein, 28 aa, Entamoeba invadens
ADDKVDDFCLFFYLSFCVMKETKLDDNL

SEQ ID NO: 3025272 - protein, 22 aa, Entamoeba invadens
ADGYLYILIREFGYSVKLKQTK

SEQ ID NO: 3025273 - protein, 26 aa, Entamoeba invadens
ADKNEEFLKKFILEKKWMELEENDSE

SEQ ID NO: 3025274 - protein, 27 aa, Entamoeba invadens
ADNRNLLGLLYLLFRRYRLDVIKNEEG

SEQ ID NO: 3025275 - protein, 24 aa, Entamoeba invadens
ADPQAFAFVLKTKGKIKGASKFKI

SEQ ID NO: 3025276 - protein, 23 aa, Entamoeba invadens
ADQPKLIELLTLPFTNLNNLHPF

SEQ ID NO: 3025277 - protein, 17 aa, Entamoeba invadens
ADSLIYVFLNNTNLHFI

SEQ ID NO: 3025278 - protein, 27 aa, Entamoeba invadens
ADSVSSLVLMLVALQEKNKPPKPEMQA

SEQ ID NO: 3025279 - protein, 25 aa, Entamoeba invadens
ADTQLFPSQFYLLSLFGFISDQLLV

SEQ ID NO: 3025280 - protein, 20 aa, Entamoeba invadens
ADVFSFGITLFETFKWGEAY

SEQ ID NO: 3025281 - protein, 23 aa, Entamoeba invadens
AEERFFYCFFQGNEYKYDIKEDA

SEQ ID NO: 3025282 - protein, 19 aa, Entamoeba invadens
AEFYWPKLLILLEILKMFE

SEQ ID NO: 3025283 - protein, 22 aa, Entamoeba invadens
AEKIWIYPYIKEADFVYTTFMA

SEQ ID NO: 3025284 - protein, 19 aa, Entamoeba invadens
AEKVPLKEWNLWLVRRLHG

SEQ ID NO: 3025285 - protein, 19 aa, Entamoeba invadens
AEQILVHRLLYQRQGSQKE

SEQ ID NO: 3025286 - protein, 21 aa, Entamoeba invadens
AEQLHILMDLLRDVGFDLDTK

SEQ ID NO: 3025287 - protein, 17 aa, Entamoeba invadens
AESLFSPLKHFPTSIPQ

SEQ ID NO: 3025288 - protein, 24 aa, Entamoeba invadens
AETNRALEVLRLTSEFLATIEQTE

SEQ ID NO: 3025289 - protein, 25 aa, Entamoeba invadens
AEVISFYNFWYGFKTWREMAPEEMY

SEQ ID NO: 3025290 - protein, 18 aa, Entamoeba invadens
AEWMSYPLNFAHYGGAAP

SEQ ID NO: 3025291 - protein, 19 aa, Entamoeba invadens
AFEPYLYFISTKTFPNPPT

SEQ ID NO: 3025292 - protein, 27 aa, Entamoeba invadens
AFETYNFPLFCLISQPVLSLLSTGKST

SEQ ID NO: 3025293 - protein, 20 aa, Entamoeba invadens
AFFFHTFDGNLLYYLDPHTT

SEQ ID NO: 3025294 - protein, 21 aa, Entamoeba invadens
AFGLFPIIFIGKGYGLYRLDV

SEQ ID NO: 3025295 - protein, 23 aa, Entamoeba invadens
AFLDTIFALLVLSFLSVGFQETL

SEQ ID NO: 3025296 - protein, 21 aa, Entamoeba invadens
AFLLPAFPQKPFVFGSEIVIT

SEQ ID NO: 3025297 - protein, 18 aa, Entamoeba invadens
AFNGKKIGRLIFRVILYD

SEQ ID NO: 3025298 - protein, 19 aa, Entamoeba invadens
AFSIPFWVSLRFYQSFMFD

SEQ ID NO: 3025299 - protein, 21 aa, Entamoeba invadens
AFSLVIYQIFTQRLIFTNCTT

SEQ ID NO: 3025300 - protein, 29 aa, Entamoeba invadens
AFTTLIFLRYLFVPFMRFPNLLKNFQATV

SEQ ID NO: 3025301 - protein, 20 aa, Entamoeba invadens
AFVIKIFQVLRIYPLCQGVV

SEQ ID NO: 3025302 - protein, 18 aa, Entamoeba invadens
AFYKFWFEVTFIKKCFCI

SEQ ID NO: 3025303 - protein, 17 aa, Entamoeba invadens
AFYLPAKKLMWMSMEFM

SEQ ID NO: 3025304 - protein, 19 aa, Entamoeba invadens
AGARKRFGRFRRRSADNEK

SEQ ID NO: 3025305 - protein, 30 aa, Entamoeba invadens
AGECLILPNFLILPVQRFPRYVMLLESLLK

SEQ ID NO: 3025306 - protein, 24 aa, Entamoeba invadens
AGHDIVPIRIFLKKLPLSPSMKNV

SEQ ID NO: 3025307 - protein, 26 aa, Entamoeba invadens
AGKTSLILYYLLHVFPLEYIPSVIKN

SEQ ID NO: 3025308 - protein, 20 aa, Entamoeba invadens
AGLFKLFLRELPTPAIPTQF

SEQ ID NO: 3025309 - protein, 19 aa, Entamoeba invadens
AGLFKLFLRELPTPIIPTN

SEQ ID NO: 3025310 - protein, 22 aa, Entamoeba invadens
AGNIILWDYFVNVPLITFTNTH

SEQ ID NO: 3025311 - protein, 19 aa, Entamoeba invadens
AGRRIWLAKKPSNFSLPKA

SEQ ID NO: 3025312 - protein, 25 aa, Entamoeba invadens
AGRVKPQWFWYLIEEHFRENGLVKQ

SEQ ID NO: 3025313 - protein, 19 aa, Entamoeba invadens
AGYKWFPLWKQTNSIMTEF

SEQ ID NO: 3025314 - protein, 21 aa, Entamoeba invadens
AHAEEIWNFVNLFSSLEQENG

SEQ ID NO: 3025315 - protein, 17 aa, Entamoeba invadens
AHFLVTGFVPLFQSERP

SEQ ID NO: 3025316 - protein, 18 aa, Entamoeba invadens
AHGFYRKPTFHLTGPYGV

SEQ ID NO: 3025317 - protein, 23 aa, Entamoeba invadens
AHGVTCFVSRQLIYPLPEQFFSA

SEQ ID NO: 3025318 - protein, 23 aa, Entamoeba invadens
AHKMWMTFLHLIGSPLMSNNSHV

SEQ ID NO: 3025319 - protein, 17 aa, Entamoeba invadens
AIFVMHTPLNWGEAIQI

SEQ ID NO: 3025320 - protein, 20 aa, Entamoeba invadens
AIGIILYQVFTGKLPFTPTD

SEQ ID NO: 3025321 - protein, 18 aa, Entamoeba invadens
AIGKILLTLLFRVPEDEN

SEQ ID NO: 3025322 - protein, 19 aa, Entamoeba invadens
AIGVMLYYLKFGMTPFGST

SEQ ID NO: 3025323 - protein, 19 aa, Entamoeba invadens
AIKIILTWGQLYPDELCEY

SEQ ID NO: 3025324 - protein, 17 aa, Entamoeba invadens
AILIRIIPNLSFEIIEV

SEQ ID NO: 3025325 - protein, 17 aa, Entamoeba invadens
AILKPKPLWTGKQVFTL

SEQ ID NO: 3025326 - protein, 20 aa, Entamoeba invadens
AINLEEFISVLKGGVDLFSD

SEQ ID NO: 3025327 - protein, 21 aa, Entamoeba invadens
AIREKLILFKTFLVDVFAVVI

SEQ ID NO: 3025328 - protein, 24 aa, Entamoeba invadens
AIRTKLIRVLPYRIKVDIYLTEGT

SEQ ID NO: 3025329 - protein, 20 aa, Entamoeba invadens
AIRWSLYERVEFFRSVIDSM

SEQ ID NO: 3025330 - protein, 24 aa, Entamoeba invadens
AISHFTFIIIYDKKTIYIIEPDAL

SEQ ID NO: 3025331 - protein, 21 aa, Entamoeba invadens
AITMLECLLWDNAYPKSIYLY

SEQ ID NO: 3025332 - protein, 18 aa, Entamoeba invadens
AIVLTYQEYCLRPFEVGN

SEQ ID NO: 3025333 - protein, 22 aa, Entamoeba invadens
AKAKPLMNKALAKAFKTAHKVG

SEQ ID NO: 3025334 - protein, 20 aa, Entamoeba invadens
AKAQFLLFLDVRMSLHVYRI

SEQ ID NO: 3025335 - protein, 27 aa, Entamoeba invadens
AKILTHMILYIWLYYNNNVESEWDELY

SEQ ID NO: 3025336 - protein, 21 aa, Entamoeba invadens
AKKLGIKYFEVSAKSGFGLEE

SEQ ID NO: 3025337 - protein, 26 aa, Entamoeba invadens
AKKLKPKMFKLKLPIKGSLIQSGCIC

SEQ ID NO: 3025338 - protein, 24 aa, Entamoeba invadens
AKKQMLYFRLFDDAWLFAKVYNIG

SEQ ID NO: 3025339 - protein, 18 aa, Entamoeba invadens
AKKRILKILFLETISSFL

SEQ ID NO: 3025340 - protein, 24 aa, Entamoeba invadens
AKLELYFSEYLRTNFRWIYNGKGK

SEQ ID NO: 3025341 - protein, 22 aa, Entamoeba invadens
AKNDIVFLKGWIPVKINKFYNP

SEQ ID NO: 3025342 - protein, 23 aa, Entamoeba invadens
AKNQLFQFVPFRSQGHPNCVLIQ

SEQ ID NO: 3025343 - protein, 25 aa, Entamoeba invadens
AKPSRLPFMPLTLNVPPSLIGQRPG

SEQ ID NO: 3025344 - protein, 18 aa, Entamoeba invadens
AKTVLYLQLIYKDVLRYG

SEQ ID NO: 3025345 - protein, 26 aa, Entamoeba invadens
ALASTYLLMKLPFNYFFDLMAVSMEP

SEQ ID NO: 3025346 - protein, 22 aa, Entamoeba invadens
ALCGFNWFNAYYTPGVSRISTN

SEQ ID NO: 3025347 - protein, 23 aa, Entamoeba invadens
ALEHFFNIWTYYIPKQLPMISDK

SEQ ID NO: 3025348 - protein, 20 aa, Entamoeba invadens
ALEIFHFYSLKSFILQFKSS

SEQ ID NO: 3025349 - protein, 18 aa, Entamoeba invadens
ALFMFKYAENKIIGSFHE

SEQ ID NO: 3025350 - protein, 18 aa, Entamoeba invadens
ALFTVISYLLIHAQKEIF

SEQ ID NO: 3025351 - protein, 18 aa, Entamoeba invadens
ALGYMFVYFMKGSLPWQG

SEQ ID NO: 3025352 - protein, 19 aa, Entamoeba invadens
ALGYMFVYFMKGSLPWQGI

SEQ ID NO: 3025353 - protein, 19 aa, Entamoeba invadens
ALKALYLHKVSDLVLNSAG

SEQ ID NO: 3025354 - protein, 19 aa, Entamoeba invadens
ALKYDLTLRVGVDKPDFSI

SEQ ID NO: 3025355 - protein, 23 aa, Entamoeba invadens
ALLFVIYYLWMNDLKQFFPYLMF

SEQ ID NO: 3025356 - protein, 19 aa, Entamoeba invadens
ALLIVLYNSYIAPVTCFVS

SEQ ID NO: 3025357 - protein, 24 aa, Entamoeba invadens
ALLPFKAIEFLFYQPSFFSSQTRK

SEQ ID NO: 3025358 - protein, 23 aa, Entamoeba invadens
ALLYKFHPFFKYLYPTIVTGLQN

SEQ ID NO: 3025359 - protein, 18 aa, Entamoeba invadens
ALPFGFQPTTFKPLSQTM

SEQ ID NO: 3025360 - protein, 23 aa, Entamoeba invadens
ALPVFHIGFFRPIIQVLQCVCKN

SEQ ID NO: 3025361 - protein, 19 aa, Entamoeba invadens
ALQLFLRQLPTDSTFDIIS

SEQ ID NO: 3025362 - protein, 17 aa, Entamoeba invadens
ALRVLKLRKIRQRQLTE

SEQ ID NO: 3025363 - protein, 18 aa, Entamoeba invadens
ALSPAPFPHWCIKEITEQ

SEQ ID NO: 3025364 - protein, 17 aa, Entamoeba invadens
ALTIPVNLYFNSLIFFN

SEQ ID NO: 3025365 - protein, 22 aa, Entamoeba invadens
ALTVFSLLFEILRDNSLYIGHS

SEQ ID NO: 3025366 - protein, 24 aa, Entamoeba invadens
ALYASIFLFILKAFPKIETLQCVD

SEQ ID NO: 3025367 - protein, 17 aa, Entamoeba invadens
ALYEFIHFLIQIYDVLF

SEQ ID NO: 3025368 - protein, 18 aa, Entamoeba invadens
ALYLNLAICFIKVSKFNK

SEQ ID NO: 3025369 - protein, 19 aa, Entamoeba invadens
ALYPLFPLNFLSKSVLEMA

SEQ ID NO: 3025370 - protein, 26 aa, Entamoeba invadens
AMEYFKFPLFCLISQPVLSLLSTGKS

SEQ ID NO: 3025371 - protein, 19 aa, Entamoeba invadens
AMLLQRQKVLFLSNELLAQ

SEQ ID NO: 3025372 - protein, 19 aa, Entamoeba invadens
AMSKLISIILLMSNVPKKV

SEQ ID NO: 3025373 - protein, 19 aa, Entamoeba invadens
AMYRQWFNQLTELTIDKVS

SEQ ID NO: 3025374 - protein, 25 aa, Entamoeba invadens
ANFVLKQVYPFTALPSFTVAPLNVY

SEQ ID NO: 3025375 - protein, 24 aa, Entamoeba invadens
ANHAQLLMHIVINARLHLTEIKKC

SEQ ID NO: 3025376 - protein, 32 aa, Entamoeba invadens
ANLHQILLMLPTSHAVLLLGWVNTWLAENKRV

SEQ ID NO: 3025377 - protein, 19 aa, Entamoeba invadens
ANLIKLWFRELPTLCLNPL

SEQ ID NO: 3025378 - protein, 18 aa, Entamoeba invadens
APGLPIIIRCYPGFQAAI

SEQ ID NO: 3025379 - protein, 19 aa, Entamoeba invadens
APPKGILLFGPPGTGKTLI

SEQ ID NO: 3025380 - protein, 20 aa, Entamoeba invadens
APTLFFFFKGNLLNIVPPHE

SEQ ID NO: 3025381 - protein, 20 aa, Entamoeba invadens
AQERPIFIGGVPLVMNVTLP

SEQ ID NO: 3025382 - protein, 23 aa, Entamoeba invadens
AQFWEVFISMMWRFYRNKSISYN

SEQ ID NO: 3025383 - protein, 18 aa, Entamoeba invadens
AQICNGLLYLLRASGFTF

SEQ ID NO: 3025384 - protein, 17 aa, Entamoeba invadens
AQNIKLGMYPPLYPAVC

SEQ ID NO: 3025385 - protein, 24 aa, Entamoeba invadens
AQQDFLVLYLDWVVKMILDGGFIA

SEQ ID NO: 3025386 - protein, 20 aa, Entamoeba invadens
AQRGLFLAGSIPTPASAGLL

SEQ ID NO: 3025387 - protein, 21 aa, Entamoeba invadens
ARKRYGFPEALFNLAVIDITA

SEQ ID NO: 3025388 - protein, 24 aa, Entamoeba invadens
ARNFKDLFFSGKYLDLIGYVVRVT

SEQ ID NO: 3025389 - protein, 25 aa, Entamoeba invadens
ARPKELPFMPIIFNFPPEFAGVPQE

SEQ ID NO: 3025390 - protein, 17 aa, Entamoeba invadens
ARSFLESFTDYFKHWTY

SEQ ID NO: 3025391 - protein, 20 aa, Entamoeba invadens
ARWILYQVVSALYYLHTHSI

SEQ ID NO: 3025392 - protein, 28 aa, Entamoeba invadens
ASDRAHLELAYLPRFFLGAFKAFVNLSA

SEQ ID NO: 3025393 - protein, 29 aa, Entamoeba invadens
ASFAYRLMLLQKYPYPLFLFLHGMSCLLQ

SEQ ID NO: 3025394 - protein, 26 aa, Entamoeba invadens
ASNVYALALIFWQTFSQKPLFEEYKT

SEQ ID NO: 3025395 - protein, 24 aa, Entamoeba invadens
ATDYIDWSLYYLGLKDQKPPLKGE

SEQ ID NO: 3025396 - protein, 23 aa, Entamoeba invadens
ATERLKVMMFNDLNVPFLKIVNP

SEQ ID NO: 3025397 - protein, 25 aa, Entamoeba invadens
ATHGIYVFPFIQFPISKKTEIIGFK

SEQ ID NO: 3025398 - protein, 21 aa, Entamoeba invadens
ATIIQKWIFWQLKSWDKTTES

SEQ ID NO: 3025399 - protein, 26 aa, Entamoeba invadens
ATLQNILPEIIAQIRKVVISNLENGR

SEQ ID NO: 3025400 - protein, 24 aa, Entamoeba invadens
ATMEVFLISLLLGLPLLAPHRKIV

SEQ ID NO: 3025401 - protein, 17 aa, Entamoeba invadens
ATMLYLLSLQEQTFCPF

SEQ ID NO: 3025402 - protein, 23 aa, Entamoeba invadens
ATRVQIPLQLAWAISIHKSQGMT

SEQ ID NO: 3025403 - protein, 18 aa, Entamoeba invadens
ATTIFPLVLALPKSPRIN

SEQ ID NO: 3025404 - protein, 19 aa, Entamoeba invadens
ATTILPFVLALPKSPRINP

SEQ ID NO: 3025405 - protein, 25 aa, Entamoeba invadens
ATTTTPLFTLNLDTNTAAAPASTTT

SEQ ID NO: 3025406 - protein, 25 aa, Entamoeba invadens
AVDALKYLLLMKLMQKKPGEIDVVL

SEQ ID NO: 3025407 - protein, 19 aa, Entamoeba invadens
AVILPIKFPQLFTDKRKPW

SEQ ID NO: 3025408 - protein, 17 aa, Entamoeba invadens
AVKFSLLLGIKAIGLLL

SEQ ID NO: 3025409 - protein, 17 aa, Entamoeba invadens
AVKGALFTVISYLLIHA

SEQ ID NO: 3025410 - protein, 22 aa, Entamoeba invadens
AVLDLFARYRYLKEITSLVLDT

SEQ ID NO: 3025411 - protein, 17 aa, Entamoeba invadens
AVLITYFLWIKQNSDFS

SEQ ID NO: 3025412 - protein, 18 aa, Entamoeba invadens
AVLKNKAIILWKALMKHF

SEQ ID NO: 3025413 - protein, 24 aa, Entamoeba invadens
AVLRKFFFERIVEWKLLEKKALNY

SEQ ID NO: 3025414 - protein, 27 aa, Entamoeba invadens
AVLRYCYLWFNFMPLTRGTAACGMYFL

SEQ ID NO: 3025415 - protein, 21 aa, Entamoeba invadens
AWTRYIEFWVLYARFEEKHNN

SEQ ID NO: 3025416 - protein, 28 aa, Entamoeba invadens
AWVPAPPFTIFLWAYLPKGNYTILDVVS

SEQ ID NO: 3025417 - protein, 18 aa, Entamoeba invadens
AYCFDYFLASKPFKDLTG

SEQ ID NO: 3025418 - protein, 22 aa, Entamoeba invadens
AYDDYIIMIMEYARGGSLGDII

SEQ ID NO: 3025419 - protein, 26 aa, Entamoeba invadens
AYGFKGNPFVFPLQNENQNLPFSTMF

SEQ ID NO: 3025420 - protein, 22 aa, Entamoeba invadens
AYHEQFVLMLTFFHTKTRHVEL

SEQ ID NO: 3025421 - protein, 23 aa, Entamoeba invadens
AYIDFTYFTFIAVRFTMAGLIED

SEQ ID NO: 3025422 - protein, 17 aa, Entamoeba invadens
AYKFVAIPNTYMFDILY

SEQ ID NO: 3025423 - protein, 18 aa, Entamoeba invadens
AYNLPLVDFCPCNFKYGV

SEQ ID NO: 3025424 - protein, 19 aa, Entamoeba invadens
AYQGLPFALSLKLKRMRDE

SEQ ID NO: 3025425 - protein, 19 aa, Entamoeba invadens
AYRGLLLNLLLYLPNEEFK

SEQ ID NO: 3025426 - protein, 23 aa, Entamoeba invadens
CACETLWKILYIPLVKEGLYNPL

SEQ ID NO: 3025427 - protein, 18 aa, Entamoeba invadens
CAKKAVWWVIFIGKIDIP

SEQ ID NO: 3025428 - protein, 22 aa, Entamoeba invadens
CALCGFNWFNAYYTPGVSRIST

SEQ ID NO: 3025429 - protein, 17 aa, Entamoeba invadens
CARGISILPKTPALWLE

SEQ ID NO: 3025430 - protein, 24 aa, Entamoeba invadens
CDERPKYRIKKRIEWCQNKSTALE

SEQ ID NO: 3025431 - protein, 27 aa, Entamoeba invadens
CDGNLKLILGLLWTLILKYQISKNKMD

SEQ ID NO: 3025432 - protein, 24 aa, Entamoeba invadens
CDVSTIFTLIFSDNKKYFIPKCVA

SEQ ID NO: 3025433 - protein, 17 aa, Entamoeba invadens
CEKCIFVWWEFQHKCVC

SEQ ID NO: 3025434 - protein, 22 aa, Entamoeba invadens
CEKVYVDVLLKSPAFKAGDYKK

SEQ ID NO: 3025435 - protein, 26 aa, Entamoeba invadens
CEVITTLFFMKLFNPTRVFLLRGNHE

SEQ ID NO: 3025436 - protein, 24 aa, Entamoeba invadens
CEVLFYLLALKLTYPEKFHLLRGN

SEQ ID NO: 3025437 - protein, 17 aa, Entamoeba invadens
CFINVLIFFSQKMSIKE

SEQ ID NO: 3025438 - protein, 24 aa, Entamoeba invadens
CFPGLILHDIILRFIPEQAEFFLT

SEQ ID NO: 3025439 - protein, 17 aa, Entamoeba invadens
CFQPLIEWKIGTEPNYY

SEQ ID NO: 3025440 - protein, 26 aa, Entamoeba invadens
CFSMCVRLQFLYIPKGITTIGENAFE

SEQ ID NO: 3025441 - protein, 24 aa, Entamoeba invadens
CFVLKYMMLFDLLRRNRVVGNVRL

SEQ ID NO: 3025442 - protein, 18 aa, Entamoeba invadens
CFYYTPLRQVDLSRIAIL

SEQ ID NO: 3025443 - protein, 20 aa, Entamoeba invadens
CGKLKRFLMPKSKALAIAEF

SEQ ID NO: 3025444 - protein, 21 aa, Entamoeba invadens
CGKTTFLKLLINSLSPVEGTV

SEQ ID NO: 3025445 - protein, 19 aa, Entamoeba invadens
CGLMKCWSTLRLTVEHQFG

SEQ ID NO: 3025446 - protein, 20 aa, Entamoeba invadens
CGLQFFLNCFKNLQIKRKTR

SEQ ID NO: 3025447 - protein, 18 aa, Entamoeba invadens
CGPFFQVKLLKLLRVMNP

SEQ ID NO: 3025448 - protein, 26 aa, Entamoeba invadens
CGTNCIKLLQIVYGASFKKLANEQEN

SEQ ID NO: 3025449 - protein, 25 aa, Entamoeba invadens
CHMKKLLMFYMWNSNNIKFLNKNVA

SEQ ID NO: 3025450 - protein, 17 aa, Entamoeba invadens
CIDGYYPSNANLSCIPC

SEQ ID NO: 3025451 - protein, 25 aa, Entamoeba invadens
CIDLLAPLFTFVGYQLDLPMNIKAK

SEQ ID NO: 3025452 - protein, 18 aa, Entamoeba invadens
CIELYKILLKKPFSCYHN

SEQ ID NO: 3025453 - protein, 17 aa, Entamoeba invadens
CIKNLYFVLPLPQKRKM

SEQ ID NO: 3025454 - protein, 25 aa, Entamoeba invadens
CINNKYICLKKYMIGFDPLTELCRL

SEQ ID NO: 3025455 - protein, 19 aa, Entamoeba invadens
CIPSVNYHYALFSELKFLN

SEQ ID NO: 3025456 - protein, 20 aa, Entamoeba invadens
CISRQLWWGHRIPAYLVNVK

SEQ ID NO: 3025457 - protein, 25 aa, Entamoeba invadens
CITCDIGYYFLFAKCYHVLKIAQVV

SEQ ID NO: 3025458 - protein, 24 aa, Entamoeba invadens
CITGINNIFSLLLLFHCPSLSLKV

SEQ ID NO: 3025459 - protein, 19 aa, Entamoeba invadens
CKFIFALKKLSLTDLAHGM

SEQ ID NO: 3025460 - protein, 18 aa, Entamoeba invadens
CKGEMFFLSGFQLFSKKL

SEQ ID NO: 3025461 - protein, 18 aa, Entamoeba invadens
CKLIAWYDNEWGYSTRLV

SEQ ID NO: 3025462 - protein, 24 aa, Entamoeba invadens
CKPKLKLVFLTPERIQLDSFLEAL

SEQ ID NO: 3025463 - protein, 24 aa, Entamoeba invadens
CKRWKEILFFFPLKHTLFTKNSIG

SEQ ID NO: 3025464 - protein, 17 aa, Entamoeba invadens
CKSAVQAFLPRFPPEKL

SEQ ID NO: 3025465 - protein, 17 aa, Entamoeba invadens
CKSCRMIYGCELCVNLL

SEQ ID NO: 3025466 - protein, 17 aa, Entamoeba invadens
CLECLMKQRFLKRNFWC

SEQ ID NO: 3025467 - protein, 17 aa, Entamoeba invadens
CLECQVSLFPPAKTFPM

SEQ ID NO: 3025468 - protein, 18 aa, Entamoeba invadens
CLGLLYGLIMRLIKYENI

SEQ ID NO: 3025469 - protein, 18 aa, Entamoeba invadens
CLLSPFCKITLKKPSRRS

SEQ ID NO: 3025470 - protein, 17 aa, Entamoeba invadens
CLLTLYSSSEFPTDYIP

SEQ ID NO: 3025471 - protein, 19 aa, Entamoeba invadens
CLNCFIGDIWFLTSNSKIE

SEQ ID NO: 3025472 - protein, 17 aa, Entamoeba invadens
CLQFLIHLYLSKFPTQF

SEQ ID NO: 3025473 - protein, 24 aa, Entamoeba invadens
CMCMYVYNYYLYPSPLKGVAPLDC

SEQ ID NO: 3025474 - protein, 17 aa, Entamoeba invadens
CMKRGYWLLMENVNFCN

SEQ ID NO: 3025475 - protein, 24 aa, Entamoeba invadens
CNKKNLMVFFYLKRNTIIGTFNSE

SEQ ID NO: 3025476 - protein, 23 aa, Entamoeba invadens
CNKKWVGVPWTGVGKIALWPADK

SEQ ID NO: 3025477 - protein, 24 aa, Entamoeba invadens
CNLELFPCDILKLSNLRFLNLSAN

SEQ ID NO: 3025478 - protein, 27 aa, Entamoeba invadens
CNNTSVPLFWWWVYQDSSIPIEISPYS

SEQ ID NO: 3025479 - protein, 17 aa, Entamoeba invadens
CNQMCFPPPPPFFGRFG

SEQ ID NO: 3025480 - protein, 18 aa, Entamoeba invadens
CPKQVILTLLFRLADTNN

SEQ ID NO: 3025481 - protein, 18 aa, Entamoeba invadens
CPKYFLVGRPITSMALVL

SEQ ID NO: 3025482 - protein, 20 aa, Entamoeba invadens
CPLTLLLRYLETLTGFAITS

SEQ ID NO: 3025483 - protein, 29 aa, Entamoeba invadens
CPYPFFIFEWQYLWFIHAFNIETSLRVFD

SEQ ID NO: 3025484 - protein, 29 aa, Entamoeba invadens
CQYDSVPSCKLDFVLRLLKSIHKLSKMKV

SEQ ID NO: 3025485 - protein, 17 aa, Entamoeba invadens
CRVALLDFSLMKEKMRP

SEQ ID NO: 3025486 - protein, 24 aa, Entamoeba invadens
CSAKTNFFIRLVLLTISKIIKMEK

SEQ ID NO: 3025487 - protein, 21 aa, Entamoeba invadens
CSDLKRYTLLLTNLPHKRLRD

SEQ ID NO: 3025488 - protein, 18 aa, Entamoeba invadens
CSDWIFHYFTPEVLTLFF

SEQ ID NO: 3025489 - protein, 22 aa, Entamoeba invadens
CSDYLFKILLIGDSGVGKSCLL

SEQ ID NO: 3025490 - protein, 17 aa, Entamoeba invadens
CSLRFAHYLAQYGSTLL

SEQ ID NO: 3025491 - protein, 17 aa, Entamoeba invadens
CSLRLAHYLAQCGSTLL

SEQ ID NO: 3025492 - protein, 22 aa, Entamoeba invadens
CSPAFWNFLNLIGAKIELSKYS

SEQ ID NO: 3025493 - protein, 22 aa, Entamoeba invadens
CSQFEIVILYCLLKLNEEERNI

SEQ ID NO: 3025494 - protein, 24 aa, Entamoeba invadens
CSTENWRFFYLNMFVYNLKNSFAE

SEQ ID NO: 3025495 - protein, 23 aa, Entamoeba invadens
CTIRSVQMLFLNSLIRIQEPDPG

SEQ ID NO: 3025496 - protein, 22 aa, Entamoeba invadens
CTLKKVLSCQPHYFLKNNRCVG

SEQ ID NO: 3025497 - protein, 25 aa, Entamoeba invadens
CTMKWRKGLFPWNRGKEFVTGAVTE

SEQ ID NO: 3025498 - protein, 22 aa, Entamoeba invadens
CTVSLFEHWLPRFGIEVDLVDT

SEQ ID NO: 3025499 - protein, 19 aa, Entamoeba invadens
CTWEFFHIDFGYLFNSRPN

SEQ ID NO: 3025500 - protein, 24 aa, Entamoeba invadens
CVAHPFWLPKFANAFYYTLPILLQ

SEQ ID NO: 3025501 - protein, 23 aa, Entamoeba invadens
CVAHPFWLPKFANGFYYTLPMIT

SEQ ID NO: 3025502 - protein, 20 aa, Entamoeba invadens
CVHWLEEYLQLPLKIISYKT

SEQ ID NO: 3025503 - protein, 17 aa, Entamoeba invadens
CVLILKSLKMLHPELEC

SEQ ID NO: 3025504 - protein, 19 aa, Entamoeba invadens
CVMLLILFNDNASYQEFKN

SEQ ID NO: 3025505 - protein, 19 aa, Entamoeba invadens
CVTGYFLNRFSCVQCSVGC

SEQ ID NO: 3025506 - protein, 17 aa, Entamoeba invadens
CWSYKLYVYQCKCSYFN

SEQ ID NO: 3025507 - protein, 17 aa, Entamoeba invadens
CWWIYTFGNRTEGIFRV

SEQ ID NO: 3025508 - protein, 17 aa, Entamoeba invadens
CYPPYFWDSIGKTCKLC

SEQ ID NO: 3025509 - protein, 19 aa, Entamoeba invadens
CYRLNKFIVTLFPEYKDVF

SEQ ID NO: 3025510 - protein, 18 aa, Entamoeba invadens
CYTLFADIIFFLFPSHHL

SEQ ID NO: 3025511 - protein, 17 aa, Entamoeba invadens
DAELGEFIVLYLSFIRA

SEQ ID NO: 3025512 - protein, 20 aa, Entamoeba invadens
DAFHVLLLYRMTLGRCTKLD

SEQ ID NO: 3025513 - protein, 25 aa, Entamoeba invadens
DAHLSILQFILIRSKIQHPFSISAF

SEQ ID NO: 3025514 - protein, 17 aa, Entamoeba invadens
DAKLFYERAFKHSIPGI

SEQ ID NO: 3025515 - protein, 23 aa, Entamoeba invadens
DAKPVLRRLLLAYSIYNYNIGYV

SEQ ID NO: 3025516 - protein, 22 aa, Entamoeba invadens
DALQLWYYFYSLFQDVNTHPDD

SEQ ID NO: 3025517 - protein, 18 aa, Entamoeba invadens
DALQLYLQKNWKLIEKGE

SEQ ID NO: 3025518 - protein, 23 aa, Entamoeba invadens
DAMNYWKYWLESLPSKHSNPPLY

SEQ ID NO: 3025519 - protein, 23 aa, Entamoeba invadens
DANAWFVALAYTISLSPSLNESK

SEQ ID NO: 3025520 - protein, 21 aa, Entamoeba invadens
DANGIFRIWDLRTKKTTKAYQ

SEQ ID NO: 3025521 - protein, 23 aa, Entamoeba invadens
DARAEELWKFVGLFSSLEQENGK

SEQ ID NO: 3025522 - protein, 22 aa, Entamoeba invadens
DATLFLLYAHALIDYTFYHSSY

SEQ ID NO: 3025523 - protein, 19 aa, Entamoeba invadens
DAVFFPRVRKDIFPFYQEG

SEQ ID NO: 3025524 - protein, 18 aa, Entamoeba invadens
DCFHFNPFPLSATTRKFF

SEQ ID NO: 3025525 - protein, 17 aa, Entamoeba invadens
DCRRNFVSLGDKVKIVG

SEQ ID NO: 3025526 - protein, 18 aa, Entamoeba invadens
DCYPLWIYKSGNALFCVQ

SEQ ID NO: 3025527 - protein, 24 aa, Entamoeba invadens
DDGEKLFLHGLKLYYKKLDDKQKV

SEQ ID NO: 3025528 - protein, 19 aa, Entamoeba invadens
DDGFYLMKLLVVLGTAVFK

SEQ ID NO: 3025529 - protein, 17 aa, Entamoeba invadens
DDIFFFTHFISIAGKKT

SEQ ID NO: 3025530 - protein, 30 aa, Entamoeba invadens
DDKIMKSLEYHYFEAVWTALKMQVIEYGGS

SEQ ID NO: 3025531 - protein, 24 aa, Entamoeba invadens
DDLDSFVILLKKWWADGKSHAELD

SEQ ID NO: 3025532 - protein, 22 aa, Entamoeba invadens
DDQNMLQYLFILAQIGISCCPI

SEQ ID NO: 3025533 - protein, 22 aa, Entamoeba invadens
DDQNMLQYLFILAQIGITCCPI

SEQ ID NO: 3025534 - protein, 23 aa, Entamoeba invadens
DDTSFVFVLQKQFVKNFQKFGIK

SEQ ID NO: 3025535 - protein, 21 aa, Entamoeba invadens
DEDYVLYYDLVARRNFNADNG

SEQ ID NO: 3025536 - protein, 17 aa, Entamoeba invadens
DEFFRKPLLSLAEQKVV

SEQ ID NO: 3025537 - protein, 17 aa, Entamoeba invadens
DEFLKLYVILYKSTIDV

SEQ ID NO: 3025538 - protein, 24 aa, Entamoeba invadens
DEFPRYIWYPFLPQIITQMQSSSF

SEQ ID NO: 3025539 - protein, 20 aa, Entamoeba invadens
DEFTKLYKGLFLFVKDELKE

SEQ ID NO: 3025540 - protein, 23 aa, Entamoeba invadens
DEIINLFYFVYRNNFQPLPNTTL

SEQ ID NO: 3025541 - protein, 18 aa, Entamoeba invadens
DEKCLLVVLFRLLDKNSS

SEQ ID NO: 3025542 - protein, 20 aa, Entamoeba invadens
DEKFTFMFQIVDGVGAWNAK

SEQ ID NO: 3025543 - protein, 17 aa, Entamoeba invadens
DEKHFIFSLDSKGLFPA

SEQ ID NO: 3025544 - protein, 19 aa, Entamoeba invadens
DEKLFPYSWDITNLISRGE

SEQ ID NO: 3025545 - protein, 24 aa, Entamoeba invadens
DELKHYLCFIFLDEFTVWAPKSSD

SEQ ID NO: 3025546 - protein, 23 aa, Entamoeba invadens
DELLAYLDKLLPLGNLLLINQSY

SEQ ID NO: 3025547 - protein, 23 aa, Entamoeba invadens
DENAILFKFYQYIRSLLVYSRSF

SEQ ID NO: 3025548 - protein, 22 aa, Entamoeba invadens
DENFFVFSLLRGGVPVYGFYKK

SEQ ID NO: 3025549 - protein, 27 aa, Entamoeba invadens
DENLTKLFAFLKRIIPTITLSPTNFSQ

SEQ ID NO: 3025550 - protein, 25 aa, Entamoeba invadens
DEQLKFFFLYLITRLEPISNTNFSI

SEQ ID NO: 3025551 - protein, 23 aa, Entamoeba invadens
DEQNRLIALWRYIAKRYNNEEGV

SEQ ID NO: 3025552 - protein, 20 aa, Entamoeba invadens
DERILKRKDEVFRKACVLKR

SEQ ID NO: 3025553 - protein, 24 aa, Entamoeba invadens
DESDKTLIFEYRPLEKNEDDVKEF

SEQ ID NO: 3025554 - protein, 22 aa, Entamoeba invadens
DEYFKYLLNPLLPVILKTVSSS

SEQ ID NO: 3025555 - protein, 18 aa, Entamoeba invadens
DEYLPTVGTLLLSTASLA

SEQ ID NO: 3025556 - protein, 17 aa, Entamoeba invadens
DEYVMMQIPSVLPLKST

SEQ ID NO: 3025557 - protein, 23 aa, Entamoeba invadens
DFALKLFDVILLDGFYALFNIGD

SEQ ID NO: 3025558 - protein, 18 aa, Entamoeba invadens
DFDIICSLPIDQPSRDLL

SEQ ID NO: 3025559 - protein, 17 aa, Entamoeba invadens
DFDTICSLPIDKPSRDL

SEQ ID NO: 3025560 - protein, 20 aa, Entamoeba invadens
DFEYLFWESLFDVKLEGFDV

SEQ ID NO: 3025561 - protein, 20 aa, Entamoeba invadens
DFFEIIFAFALPLKPNAREV

SEQ ID NO: 3025562 - protein, 17 aa, Entamoeba invadens
DFFNAFTSFFTLGSSFF

SEQ ID NO: 3025563 - protein, 20 aa, Entamoeba invadens
DFFSKIFWYQVDYQTYKIFM

SEQ ID NO: 3025564 - protein, 17 aa, Entamoeba invadens
DFFVFSHKITALEKLEL

SEQ ID NO: 3025565 - protein, 26 aa, Entamoeba invadens
DFGSMILMKIMDFLGGLFTGIAVGKR

SEQ ID NO: 3025566 - protein, 20 aa, Entamoeba invadens
DFHILYFWQGRNCPTLDKGA

SEQ ID NO: 3025567 - protein, 20 aa, Entamoeba invadens
DFIVYWLKELIKYKKIGVLL

SEQ ID NO: 3025568 - protein, 25 aa, Entamoeba invadens
DFKGKFVVLLFYPLDWTFVCPTEML

SEQ ID NO: 3025569 - protein, 17 aa, Entamoeba invadens
DFKYPFYSYKMSLIMYQ

SEQ ID NO: 3025570 - protein, 18 aa, Entamoeba invadens
DFLVLVLLVLFCKTTMTE

SEQ ID NO: 3025571 - protein, 23 aa, Entamoeba invadens
DFMKKIYLYVRPNTRFPALPVVY

SEQ ID NO: 3025572 - protein, 17 aa, Entamoeba invadens
DFNLLPKFCLIVRKFLE

SEQ ID NO: 3025573 - protein, 23 aa, Entamoeba invadens
DFQNLMFMKLYKKHLFTVQICHC

SEQ ID NO: 3025574 - protein, 17 aa, Entamoeba invadens
DFRQAMQWLLHEAERTT

SEQ ID NO: 3025575 - protein, 17 aa, Entamoeba invadens
DFRTVVWCLDPARRKLF

SEQ ID NO: 3025576 - protein, 28 aa, Entamoeba invadens
DFSILVGIRDRKLLLCKIRTVRKNLRKI

SEQ ID NO: 3025577 - protein, 23 aa, Entamoeba invadens
DFTPDFFCFLKYGTSKQLNMATM

SEQ ID NO: 3025578 - protein, 25 aa, Entamoeba invadens
DFVFLFKHFPLLLSFSFRLSQIDTI

SEQ ID NO: 3025579 - protein, 17 aa, Entamoeba invadens
DFVLGWINEKVAPYGLR

SEQ ID NO: 3025580 - protein, 20 aa, Entamoeba invadens
DFVLSCLGFFAIKQTGCKIN

SEQ ID NO: 3025581 - protein, 17 aa, Entamoeba invadens
DFVYIDFLDLFLKDFET

SEQ ID NO: 3025582 - protein, 20 aa, Entamoeba invadens
DGFCFFWDLKMLKCSKVRVD

SEQ ID NO: 3025583 - protein, 30 aa, Entamoeba invadens
DGFIKFDKQKYGWYAVRLFLNSSKGDEYIP

SEQ ID NO: 3025584 - protein, 18 aa, Entamoeba invadens
DGFLLYLAKWENGKINTT

SEQ ID NO: 3025585 - protein, 24 aa, Entamoeba invadens
DGFYQIVIPLLLKYNTNNAWWNGY

SEQ ID NO: 3025586 - protein, 24 aa, Entamoeba invadens
DGGEQFLVRIYQKAMLCAENAGRN

SEQ ID NO: 3025587 - protein, 22 aa, Entamoeba invadens
DGIPVFLHRFRIKFVECARFVE

SEQ ID NO: 3025588 - protein, 25 aa, Entamoeba invadens
DGKCSVVFALFWKGGLFGVFNRELL

SEQ ID NO: 3025589 - protein, 22 aa, Entamoeba invadens
DGKLLFQELLLKNVFCVFICTR

SEQ ID NO: 3025590 - protein, 21 aa, Entamoeba invadens
DGKPINMFWALKDFKQRTDTQ

SEQ ID NO: 3025591 - protein, 22 aa, Entamoeba invadens
DGLEHCFWLAFFFKYATVGEGE

SEQ ID NO: 3025592 - protein, 25 aa, Entamoeba invadens
DGNIFKLVVWFKVNYLSTLAFEKYN

SEQ ID NO: 3025593 - protein, 22 aa, Entamoeba invadens
DGRLLQLRWDRGFRAKVVDRDY

SEQ ID NO: 3025594 - protein, 18 aa, Entamoeba invadens
DGSVLYEITLIVGLILLM

SEQ ID NO: 3025595 - protein, 24 aa, Entamoeba invadens
DGTAKIWFLASSRLRHSLTGHNGK

SEQ ID NO: 3025596 - protein, 18 aa, Entamoeba invadens
DGTRFLYRLCEDVYIVVI

SEQ ID NO: 3025597 - protein, 24 aa, Entamoeba invadens
DGTYFATPYFLLVKAFNNCVIKQH

SEQ ID NO: 3025598 - protein, 17 aa, Entamoeba invadens
DGVDYFFNAFFRPNDRN

SEQ ID NO: 3025599 - protein, 23 aa, Entamoeba invadens
DGVERKILRFCGAKELRSLKEKT

SEQ ID NO: 3025600 - protein, 30 aa, Entamoeba invadens
DGVIIRQIILKYYPTYKMDVKFGQSGLIMK

SEQ ID NO: 3025601 - protein, 17 aa, Entamoeba invadens
DGYFYWVYKNYVVFKTL

SEQ ID NO: 3025602 - protein, 19 aa, Entamoeba invadens
DGYYIFNSLCVKCEYPCTH

SEQ ID NO: 3025603 - protein, 23 aa, Entamoeba invadens
DHDIFDDWYLKLLAKRLLSHEVQ

SEQ ID NO: 3025604 - protein, 24 aa, Entamoeba invadens
DHEVKRLFLFYLSTVQRVDEAGKL

SEQ ID NO: 3025605 - protein, 22 aa, Entamoeba invadens
DHLITLFRKDKYIVTKKLLREF

SEQ ID NO: 3025606 - protein, 22 aa, Entamoeba invadens
DIALFRLNYVIYLFSIVESSMK

SEQ ID NO: 3025607 - protein, 22 aa, Entamoeba invadens
DIEAIAWRYLPTTLKLKGTTQS

SEQ ID NO: 3025608 - protein, 18 aa, Entamoeba invadens
DIEKFFRVVIWYQVDAQT

SEQ ID NO: 3025609 - protein, 21 aa, Entamoeba invadens
DIEWLIHFFDVLKRNALTKFN

SEQ ID NO: 3025610 - protein, 17 aa, Entamoeba invadens
DIFILKLLPGKILVVNG

SEQ ID NO: 3025611 - protein, 25 aa, Entamoeba invadens
DIFKYKFIFLPLHTSSHFSLIVLCF

SEQ ID NO: 3025612 - protein, 18 aa, Entamoeba invadens
DIFLLCFNVIQPSSLTNI

SEQ ID NO: 3025613 - protein, 17 aa, Entamoeba invadens
DIFPYLLVNIGSGVSIL

SEQ ID NO: 3025614 - protein, 17 aa, Entamoeba invadens
DIFVLCFSVIYKSSYTN

SEQ ID NO: 3025615 - protein, 18 aa, Entamoeba invadens
DIILILQTTHLLLKMFEK

SEQ ID NO: 3025616 - protein, 26 aa, Entamoeba invadens
DIKRLCFVQCHLLELIILPSYMKIIN

SEQ ID NO: 3025617 - protein, 22 aa, Entamoeba invadens
DIKSLYVVFFFIIKNLREETIQ

SEQ ID NO: 3025618 - protein, 24 aa, Entamoeba invadens
DILESVFLWFVGKDKKFMSLEKLD

SEQ ID NO: 3025619 - protein, 20 aa, Entamoeba invadens
DILFLRQFNALAFPILRLLI

SEQ ID NO: 3025620 - protein, 21 aa, Entamoeba invadens
DILPLRLCIYLYSSISQILTL

SEQ ID NO: 3025621 - protein, 17 aa, Entamoeba invadens
DILTLFITTKLPPVTLE

SEQ ID NO: 3025622 - protein, 22 aa, Entamoeba invadens
DIMRIFCDILYQTVVYKDHRTF

SEQ ID NO: 3025623 - protein, 23 aa, Entamoeba invadens
DINFYRRVYWRPVSYRIYLQPHD

SEQ ID NO: 3025624 - protein, 26 aa, Entamoeba invadens
DIPTIFHMAWLAFLFYKSLKEGCAKE

SEQ ID NO: 3025625 - protein, 25 aa, Entamoeba invadens
DIPVFKKAFYKIIVWFNVNFETVDQ

SEQ ID NO: 3025626 - protein, 25 aa, Entamoeba invadens
DIVPIKSCFYLYSTLSRLIVLYDSL

SEQ ID NO: 3025627 - protein, 24 aa, Entamoeba invadens
DIVRKTHFIYLPFKSHDLLKQIEN

SEQ ID NO: 3025628 - protein, 22 aa, Entamoeba invadens
DKDGLLHMITQLKLDLMHKSDM

SEQ ID NO: 3025629 - protein, 21 aa, Entamoeba invadens
DKECFWLCPYIENVNLPASLT

SEQ ID NO: 3025630 - protein, 23 aa, Entamoeba invadens
DKEIPFLFKITPPLKLQIESLIS

SEQ ID NO: 3025631 - protein, 23 aa, Entamoeba invadens
DKELFCVMMRLVKGRFVYTLPLA

SEQ ID NO: 3025632 - protein, 25 aa, Entamoeba invadens
DKETVILIHLFLDPPVIIQNKAYSH

SEQ ID NO: 3025633 - protein, 24 aa, Entamoeba invadens
DKFRSDYIIYFYGAVFIPSKVCMA

SEQ ID NO: 3025634 - protein, 24 aa, Entamoeba invadens
DKFRSEFIVHFYGAVFIPNKVCMV

SEQ ID NO: 3025635 - protein, 18 aa, Entamoeba invadens
DKFYKLFSVVIFGGIHSP

SEQ ID NO: 3025636 - protein, 21 aa, Entamoeba invadens
DKIDFGLKLTKSYALIVDMAK

SEQ ID NO: 3025637 - protein, 24 aa, Entamoeba invadens
DKILNLYIILRLNMIRGKVLIFVN

SEQ ID NO: 3025638 - protein, 17 aa, Entamoeba invadens
DKKVVFNGLALAIKIVL

SEQ ID NO: 3025639 - protein, 21 aa, Entamoeba invadens
DKMLMVWDIRKPEVPFKTIQN

SEQ ID NO: 3025640 - protein, 23 aa, Entamoeba invadens
DKMTKIMRLLYQVTLELPFHLVP

SEQ ID NO: 3025641 - protein, 27 aa, Entamoeba invadens
DKNISMYFVYQWLALLFKRDFGGEIYE

SEQ ID NO: 3025642 - protein, 22 aa, Entamoeba invadens
DKRKPWTGILLFGPPGTGKSFL

SEQ ID NO: 3025643 - protein, 21 aa, Entamoeba invadens
DKTLIFIFSFLSLEAIIAVKH

SEQ ID NO: 3025644 - protein, 17 aa, Entamoeba invadens
DKTYRIRYLKHPYLSRK

SEQ ID NO: 3025645 - protein, 18 aa, Entamoeba invadens
DKVIKITGALRSPFTLTV

SEQ ID NO: 3025646 - protein, 20 aa, Entamoeba invadens
DKYIPYRSSALTRILADALG

SEQ ID NO: 3025647 - protein, 17 aa, Entamoeba invadens
DKYLFFYNKKLTKIETN

SEQ ID NO: 3025648 - protein, 21 aa, Entamoeba invadens
DLALHFLSKLKIMVVKDIEMK

SEQ ID NO: 3025649 - protein, 18 aa, Entamoeba invadens
DLFVMNLLKEFSEKTGEV

SEQ ID NO: 3025650 - protein, 24 aa, Entamoeba invadens
DLGTIENFWLFISDSKYSQLFYFD

SEQ ID NO: 3025651 - protein, 19 aa, Entamoeba invadens
DLICQAFGGHPKFRKPRVA

SEQ ID NO: 3025652 - protein, 19 aa, Entamoeba invadens
DLIDLLSAFIPLPPEMIQV

SEQ ID NO: 3025653 - protein, 21 aa, Entamoeba invadens
DLINLLIFNFQLKQLKYRGVG

SEQ ID NO: 3025654 - protein, 30 aa, Entamoeba invadens
DLKKMRRRFWFEKFHWFISSENFVIISGKD

SEQ ID NO: 3025655 - protein, 22 aa, Entamoeba invadens
DLKPDFILFSSLLHLHDPEGAS

SEQ ID NO: 3025656 - protein, 20 aa, Entamoeba invadens
DLLLILCLIICSMNNKKMCC

SEQ ID NO: 3025657 - protein, 21 aa, Entamoeba invadens
DLLQKELPFKLWFNQIQFSVV

SEQ ID NO: 3025658 - protein, 22 aa, Entamoeba invadens
DLMKLFCEKYKKQAKSEHWQIQ

SEQ ID NO: 3025659 - protein, 19 aa, Entamoeba invadens
DLPNIEKFSYSPQGRYLVF

SEQ ID NO: 3025660 - protein, 22 aa, Entamoeba invadens
DLQSQLCELLDFFFKRTVQVCV

SEQ ID NO: 3025661 - protein, 26 aa, Entamoeba invadens
DLRDRGLFYWRLLAHDPDLAKEMVCS

SEQ ID NO: 3025662 - protein, 23 aa, Entamoeba invadens
DLRQLLFLFIAELLRFQDTLPKK

SEQ ID NO: 3025663 - protein, 32 aa, Entamoeba invadens
DLRSYLIMPVQRLPRYRLLLTDLIKHTDDAFP

SEQ ID NO: 3025664 - protein, 21 aa, Entamoeba invadens
DLSQYYIFPWVLKNYESESLD

SEQ ID NO: 3025665 - protein, 21 aa, Entamoeba invadens
DLSVPLLLVLLRDTLYTLNAQ

SEQ ID NO: 3025666 - protein, 19 aa, Entamoeba invadens
DLVTMKWWDDIWLNEGFAS

SEQ ID NO: 3025667 - protein, 21 aa, Entamoeba invadens
DLYNTLLTFPLIYPISLEPEL

SEQ ID NO: 3025668 - protein, 17 aa, Entamoeba invadens
DLYYYYIKLCMVSYGKW

SEQ ID NO: 3025669 - protein, 30 aa, Entamoeba invadens
DMALSLQTLKNLSTQLKILCSVKAATVGNG

SEQ ID NO: 3025670 - protein, 21 aa, Entamoeba invadens
DMEKIWHHTFYNELRIAPEEH

SEQ ID NO: 3025671 - protein, 18 aa, Entamoeba invadens
DMIVPKRVLAAILTAIKQ

SEQ ID NO: 3025672 - protein, 23 aa, Entamoeba invadens
DMKEYFYPWALKTLDIMVKNLSD

SEQ ID NO: 3025673 - protein, 18 aa, Entamoeba invadens
DMKPLIVKLYMNGKRVKL

SEQ ID NO: 3025674 - protein, 24 aa, Entamoeba invadens
DMKRMDDAIWSEIYLHELDKCEYL

SEQ ID NO: 3025675 - protein, 19 aa, Entamoeba invadens
DMLNAELLALQNQDAIEKE

SEQ ID NO: 3025676 - protein, 18 aa, Entamoeba invadens
DMYRSVILLLFQPQKKSV

SEQ ID NO: 3025677 - protein, 19 aa, Entamoeba invadens
DNFCIFKLFAKGKNCWNMW

SEQ ID NO: 3025678 - protein, 18 aa, Entamoeba invadens
DNIGRHVILIYRALYQVH

SEQ ID NO: 3025679 - protein, 22 aa, Entamoeba invadens
DNILFWLFDVFLGLVPDKYKHL

SEQ ID NO: 3025680 - protein, 17 aa, Entamoeba invadens
DNKLIINIIAYLAKHNP

SEQ ID NO: 3025681 - protein, 24 aa, Entamoeba invadens
DNKLLFYVMDFYKALKSVEKKFPF

SEQ ID NO: 3025682 - protein, 23 aa, Entamoeba invadens
DNKPFCKNCFVLKFAKLCATCGK

SEQ ID NO: 3025683 - protein, 24 aa, Entamoeba invadens
DNLLYLMNFMNYKINFFFPSEKQN

SEQ ID NO: 3025684 - protein, 17 aa, Entamoeba invadens
DNNLWTYYPDVSKLNVY

SEQ ID NO: 3025685 - protein, 17 aa, Entamoeba invadens
DNPIFWDNFLKLIYDRG

SEQ ID NO: 3025686 - protein, 22 aa, Entamoeba invadens
DNSWVVPFNPYLLKRFRAHINV

SEQ ID NO: 3025687 - protein, 24 aa, Entamoeba invadens
DNVLRLLWHEYWINSLSATAIISS

SEQ ID NO: 3025688 - protein, 29 aa, Entamoeba invadens
DPFVSLYPHKVAFYTFFPYVDIKKLSGMR

SEQ ID NO: 3025689 - protein, 17 aa, Entamoeba invadens
DPILLEKAKQTNTVEIN

SEQ ID NO: 3025690 - protein, 17 aa, Entamoeba invadens
DPKKPFTPIWTKSGLKA

SEQ ID NO: 3025691 - protein, 20 aa, Entamoeba invadens
DPKLQFQWWFPLVESVTAVE

SEQ ID NO: 3025692 - protein, 21 aa, Entamoeba invadens
DPLEHLIWLHAWKYSIEGKTW

SEQ ID NO: 3025693 - protein, 25 aa, Entamoeba invadens
DPPVKTVFVFLFNDLLIVTKVKKFN

SEQ ID NO: 3025694 - protein, 23 aa, Entamoeba invadens
DPPYMELPPLRALFLITTKGIPP

SEQ ID NO: 3025695 - protein, 22 aa, Entamoeba invadens
DPRLQFQWWFPLVESISAVEFH

SEQ ID NO: 3025696 - protein, 20 aa, Entamoeba invadens
DQEIFCVMLRLVKGRKCYSL

SEQ ID NO: 3025697 - protein, 20 aa, Entamoeba invadens
DQPIKWCWPIGVIFDALHNG

SEQ ID NO: 3025698 - protein, 24 aa, Entamoeba invadens
DQPTASPFGGFNPAAAKLKKTTKK

SEQ ID NO: 3025699 - protein, 21 aa, Entamoeba invadens
DRCFSKCYSLRWAVLPTIHGE

SEQ ID NO: 3025700 - protein, 25 aa, Entamoeba invadens
DRDILKMYDIPLPGPIFPPLNAPTP

SEQ ID NO: 3025701 - protein, 22 aa, Entamoeba invadens
DRGHYGLECLLLLAALKLRFPT

SEQ ID NO: 3025702 - protein, 17 aa, Entamoeba invadens
DRIDYIQLPYKLKVRML

SEQ ID NO: 3025703 - protein, 18 aa, Entamoeba invadens
DRKFSVLLLMKMDHMKSA

SEQ ID NO: 3025704 - protein, 22 aa, Entamoeba invadens
DRKILMYSLYFTMDMKFGNRIG

SEQ ID NO: 3025705 - protein, 21 aa, Entamoeba invadens
DRLLQCPWINRTLLNIEKEIT

SEQ ID NO: 3025706 - protein, 22 aa, Entamoeba invadens
DRLPVFFPILFNNKDDWKVFYR

SEQ ID NO: 3025707 - protein, 17 aa, Entamoeba invadens
DRLRPLSYPMTDVFLIC

SEQ ID NO: 3025708 - protein, 19 aa, Entamoeba invadens
DRPFYLVHRNTFLESNLSL

SEQ ID NO: 3025709 - protein, 27 aa, Entamoeba invadens
DRYKAFIFVGPVWSWDLCAPLKTACKE

SEQ ID NO: 3025710 - protein, 26 aa, Entamoeba invadens
DSDVYIRILILYLPLLIKFDDETIDY

SEQ ID NO: 3025711 - protein, 25 aa, Entamoeba invadens
DSELDRLFLDKYKPLKFLGKGSYAT

SEQ ID NO: 3025712 - protein, 18 aa, Entamoeba invadens
DSHRPFLLPIIKSKPVRT

SEQ ID NO: 3025713 - protein, 19 aa, Entamoeba invadens
DSIFNYFDYGFNKPSYSNY

SEQ ID NO: 3025714 - protein, 20 aa, Entamoeba invadens
DSIFYYYQKLLKLRKENSIM

SEQ ID NO: 3025715 - protein, 19 aa, Entamoeba invadens
DSLAQPMKLPFLQLVLAVP

SEQ ID NO: 3025716 - protein, 17 aa, Entamoeba invadens
DSPPYLAWFVNVWKMVD

SEQ ID NO: 3025717 - protein, 17 aa, Entamoeba invadens
DSQMMLYNFTSGVLREL

SEQ ID NO: 3025718 - protein, 23 aa, Entamoeba invadens
DSTEVFFKIKKNTPLKKLMEAFC

SEQ ID NO: 3025719 - protein, 25 aa, Entamoeba invadens
DSTRFLTCTLSFHLTYISGLEIIKK

SEQ ID NO: 3025720 - protein, 19 aa, Entamoeba invadens
DSVWMRRYWFIFSQDQAVK

SEQ ID NO: 3025721 - protein, 24 aa, Entamoeba invadens
DTFVPILIYALLKANLPHLASTIS

SEQ ID NO: 3025722 - protein, 25 aa, Entamoeba invadens
DTHQTFFHFGILLTIPNLSAISKVL

SEQ ID NO: 3025723 - protein, 25 aa, Entamoeba invadens
DTIQDMMMLLKIKPIPDLKMCDVAQ

SEQ ID NO: 3025724 - protein, 23 aa, Entamoeba invadens
DTKKKILLLLKKWTTEVPQNIIQ

SEQ ID NO: 3025725 - protein, 23 aa, Entamoeba invadens
DTKQSFFVFSNRIPSPTQQCKRS

SEQ ID NO: 3025726 - protein, 21 aa, Entamoeba invadens
DTLLHLPVYLSKIFDIKKKVQ

SEQ ID NO: 3025727 - protein, 20 aa, Entamoeba invadens
DTNTLFLIYYLSATIVESET

SEQ ID NO: 3025728 - protein, 24 aa, Entamoeba invadens
DTQPLFVIHLLWLRVYHKVVLEKD

SEQ ID NO: 3025729 - protein, 25 aa, Entamoeba invadens
DTRSSWFYHYFTPELKLMDKETRKA

SEQ ID NO: 3025730 - protein, 22 aa, Entamoeba invadens
DTRYPIIMWCQYLQNIRTNNFS

SEQ ID NO: 3025731 - protein, 22 aa, Entamoeba invadens
DTSFYRTFLLRNYSYMTTEREV

SEQ ID NO: 3025732 - protein, 24 aa, Entamoeba invadens
DTSYYLNYLLYSAFLISLGNDGKR

SEQ ID NO: 3025733 - protein, 22 aa, Entamoeba invadens
DTYGHFLVKKMFKYLAPNFTKI

SEQ ID NO: 3025734 - protein, 24 aa, Entamoeba invadens
DTYVQYLPFIWKFNYLDHRDVFDF

SEQ ID NO: 3025735 - protein, 27 aa, Entamoeba invadens
DVEEMAQALYIYWKSRDIARSGECDYE

SEQ ID NO: 3025736 - protein, 17 aa, Entamoeba invadens
DVFYLRRNGFHYKVRIV

SEQ ID NO: 3025737 - protein, 24 aa, Entamoeba invadens
DVGLQTYVYIPYKPNYKMLMSGYY

SEQ ID NO: 3025738 - protein, 22 aa, Entamoeba invadens
DVIRVCFVFEKLFLVSKIKTFQ

SEQ ID NO: 3025739 - protein, 20 aa, Entamoeba invadens
DVLAFWIATLCALIHKTNLL

SEQ ID NO: 3025740 - protein, 18 aa, Entamoeba invadens
DVLDTWFSSGLFPFSVMG

SEQ ID NO: 3025741 - protein, 21 aa, Entamoeba invadens
DVLFFLMILFDLISQKKAIKL

SEQ ID NO: 3025742 - protein, 18 aa, Entamoeba invadens
DVLKIVFILRNCPVPEIV

SEQ ID NO: 3025743 - protein, 17 aa, Entamoeba invadens
DVLVHRFLAMAIGFDRI

SEQ ID NO: 3025744 - protein, 20 aa, Entamoeba invadens
DVLYPYVGPFWFDRMGWEPV

SEQ ID NO: 3025745 - protein, 18 aa, Entamoeba invadens
DVPLIMMLAFLALPSLRK

SEQ ID NO: 3025746 - protein, 18 aa, Entamoeba invadens
DVQLLFPLYYFIQIAHDK

SEQ ID NO: 3025747 - protein, 18 aa, Entamoeba invadens
DVSFWLGAILNSCGIRTP

SEQ ID NO: 3025748 - protein, 23 aa, Entamoeba invadens
DVSGIIQLFLFTGQYTRLSQQLL

SEQ ID NO: 3025749 - protein, 22 aa, Entamoeba invadens
DVTRIYMQCLTPFISNVFLTIY

SEQ ID NO: 3025750 - protein, 22 aa, Entamoeba invadens
DVWSFGILIFKLLVGCTPFETI

SEQ ID NO: 3025751 - protein, 23 aa, Entamoeba invadens
DVWSLGVLFYALLFGTMPFPGDT

SEQ ID NO: 3025752 - protein, 23 aa, Entamoeba invadens
DVYPPYLLLLKLLTKNGKFSHGK

SEQ ID NO: 3025753 - protein, 25 aa, Entamoeba invadens
DVYSLGVLILYLLSVATTHNTTEKL

SEQ ID NO: 3025754 - protein, 24 aa, Entamoeba invadens
DVYSYGIILWELVYRLIYQKYQRP

SEQ ID NO: 3025755 - protein, 17 aa, Entamoeba invadens
DVYYGDGYWGDDGFYYV

SEQ ID NO: 3025756 - protein, 25 aa, Entamoeba invadens
DWADGFLMKFLFASETPFEKFQQFG

SEQ ID NO: 3025757 - protein, 17 aa, Entamoeba invadens
DWFNLMTYDLHGAWDNI

SEQ ID NO: 3025758 - protein, 20 aa, Entamoeba invadens
DWITKRLLILLGKRNFWCLV

SEQ ID NO: 3025759 - protein, 17 aa, Entamoeba invadens
DWNTSYCLPLFVISFRN

SEQ ID NO: 3025760 - protein, 25 aa, Entamoeba invadens
DYDKLRPLSYPQTDVFLICFSVVSP

SEQ ID NO: 3025761 - protein, 18 aa, Entamoeba invadens
DYEQISKLFLFRQKKDIE

SEQ ID NO: 3025762 - protein, 27 aa, Entamoeba invadens
DYHGTLSPWLQIKLFRLLAGVQLDEQQ

SEQ ID NO: 3025763 - protein, 17 aa, Entamoeba invadens
DYINWLTKNRLILEFDD

SEQ ID NO: 3025764 - protein, 24 aa, Entamoeba invadens
DYIQYILCIMWFKTVTPQDRVFLV

SEQ ID NO: 3025765 - protein, 17 aa, Entamoeba invadens
DYLFDIFYCPETIIMEG

SEQ ID NO: 3025766 - protein, 23 aa, Entamoeba invadens
DYLLCFQFFEYSKIEVLYQLFCN

SEQ ID NO: 3025767 - protein, 21 aa, Entamoeba invadens
DYMPLALHVLLLMGKYGKLEQ

SEQ ID NO: 3025768 - protein, 33 aa, Entamoeba invadens
DYNPYLPEIPPKTPPVYLFFKDFQLQPMKFVLT

SEQ ID NO: 3025769 - protein, 24 aa, Entamoeba invadens
DYNTIVFPIFLQLCTWTLTPKLSW

SEQ ID NO: 3025770 - protein, 18 aa, Entamoeba invadens
DYVEKLMIISLLMIIVIG

SEQ ID NO: 3025771 - protein, 20 aa, Entamoeba invadens
DYVIYYDRFPKKIDLNEDYY

SEQ ID NO: 3025772 - protein, 23 aa, Entamoeba invadens
EAAAKVFLPFTPSFITLFCETKE

SEQ ID NO: 3025773 - protein, 18 aa, Entamoeba invadens
EADKLLVYLIFYISSLLL

SEQ ID NO: 3025774 - protein, 22 aa, Entamoeba invadens
EAFDVLILARSWLKYSYVHSFY

SEQ ID NO: 3025775 - protein, 19 aa, Entamoeba invadens
EAFKKMTSLLLWTAKGFVS

SEQ ID NO: 3025776 - protein, 24 aa, Entamoeba invadens
EAIQQSLLIYLLIENGYSITIERP

SEQ ID NO: 3025777 - protein, 21 aa, Entamoeba invadens
EALFILDEYLQWGFTEKLATN

SEQ ID NO: 3025778 - protein, 19 aa, Entamoeba invadens
EALQWFQYTYLYVCLKRSE

SEQ ID NO: 3025779 - protein, 17 aa, Entamoeba invadens
EANLFFQVLLAVVFYVG

SEQ ID NO: 3025780 - protein, 17 aa, Entamoeba invadens
EANNQMYILCEGVLRQC

SEQ ID NO: 3025781 - protein, 22 aa, Entamoeba invadens
EASGFIMMPFNPLFKAEQLAHF

SEQ ID NO: 3025782 - protein, 23 aa, Entamoeba invadens
EAVIWPMLRPDIFTGLRAPPKGI

SEQ ID NO: 3025783 - protein, 22 aa, Entamoeba invadens
ECFGWSYAFSKEKFKFPWKIVD

SEQ ID NO: 3025784 - protein, 25 aa, Entamoeba invadens
ECFQRFIPFLKVYKLFIGNNEVCLG

SEQ ID NO: 3025785 - protein, 24 aa, Entamoeba invadens
ECIIRMYCKCLYFGIKPVFVFDGN

SEQ ID NO: 3025786 - protein, 19 aa, Entamoeba invadens
ECIITFAFPIIQLVAPFVS

SEQ ID NO: 3025787 - protein, 23 aa, Entamoeba invadens
ECIITFAFPIIQLVAPFVSFRVV

SEQ ID NO: 3025788 - protein, 17 aa, Entamoeba invadens
ECIWKYSLDIYNKCITL

SEQ ID NO: 3025789 - protein, 17 aa, Entamoeba invadens
ECKKLTMLSFPDGVTKI

SEQ ID NO: 3025790 - protein, 17 aa, Entamoeba invadens
ECLHALTDLLFLSGYLF

SEQ ID NO: 3025791 - protein, 17 aa, Entamoeba invadens
ECLKCNINYYLKLGKCY

SEQ ID NO: 3025792 - protein, 24 aa, Entamoeba invadens
ECLNWVHAYPKQKFKFPWTIAEYV

SEQ ID NO: 3025793 - protein, 21 aa, Entamoeba invadens
ECNFLYEPFIKIPLTMNALLN

SEQ ID NO: 3025794 - protein, 19 aa, Entamoeba invadens
ECPFRINLNFKAKLGKWKI

SEQ ID NO: 3025795 - protein, 17 aa, Entamoeba invadens
ECSKLSCIVIPSSVTFI

SEQ ID NO: 3025796 - protein, 17 aa, Entamoeba invadens
EDACFFLLISNINNAQK

SEQ ID NO: 3025797 - protein, 22 aa, Entamoeba invadens
EDALNAMYYILQALAFVCGQKE

SEQ ID NO: 3025798 - protein, 24 aa, Entamoeba invadens
EDELQILVIQQYTLLDDMVLSTHY

SEQ ID NO: 3025799 - protein, 23 aa, Entamoeba invadens
EDEQLWYWSYNGTKLYMYINTPI

SEQ ID NO: 3025800 - protein, 21 aa, Entamoeba invadens
EDFLNFKALILPVLMKNTLLC

SEQ ID NO: 3025801 - protein, 24 aa, Entamoeba invadens
EDFVKFQIFLKIPTLSALISQKTD

SEQ ID NO: 3025802 - protein, 26 aa, Entamoeba invadens
EDGKPIPVWLYKFRGLGTMYYCEICG

SEQ ID NO: 3025803 - protein, 25 aa, Entamoeba invadens
EDGQLILWRIDTLTPFLYFTRDDYH

SEQ ID NO: 3025804 - protein, 17 aa, Entamoeba invadens
EDILRFFPKLQTLYFSS

SEQ ID NO: 3025805 - protein, 20 aa, Entamoeba invadens
EDKMQFVAPPVIVGLSEKEV

SEQ ID NO: 3025806 - protein, 20 aa, Entamoeba invadens
EDLLYLFKKYILFGSVPENA

SEQ ID NO: 3025807 - protein, 18 aa, Entamoeba invadens
EDMTQYFFKLRDPLMWGL

SEQ ID NO: 3025808 - protein, 18 aa, Entamoeba invadens
EDNAFKTLVLLVFIIATM

SEQ ID NO: 3025809 - protein, 17 aa, Entamoeba invadens
EDPMKLDLWLKKQPKKP

SEQ ID NO: 3025810 - protein, 18 aa, Entamoeba invadens
EDQRLRDWFTEDQLLIMK

SEQ ID NO: 3025811 - protein, 19 aa, Entamoeba invadens
EDRIPIMFTVFSSAGYNGN

SEQ ID NO: 3025812 - protein, 24 aa, Entamoeba invadens
EDRNYHIFYQCWLNKTSPNEIMVD

SEQ ID NO: 3025813 - protein, 20 aa, Entamoeba invadens
EDSHDFLSFTKLSGTTGNGD

SEQ ID NO: 3025814 - protein, 22 aa, Entamoeba invadens
EDSSDLLIYLYSSVPKKQLDNI

SEQ ID NO: 3025815 - protein, 24 aa, Entamoeba invadens
EDTDAFIFSLIRKGKFNPKKFELK

SEQ ID NO: 3025816 - protein, 23 aa, Entamoeba invadens
EDYLLYYLFQFTLSLVHDIYGGN

SEQ ID NO: 3025817 - protein, 27 aa, Entamoeba invadens
EEARHFYFYILWVLKNIEVKTLTNLLN

SEQ ID NO: 3025818 - protein, 21 aa, Entamoeba invadens
EEEIFFMEMLGHTLIYSSCLP

SEQ ID NO: 3025819 - protein, 18 aa, Entamoeba invadens
EEFSLAMYFSYFKSFIKS

SEQ ID NO: 3025820 - protein, 22 aa, Entamoeba invadens
EEHILFLKAITWLNATSTKQLP

SEQ ID NO: 3025821 - protein, 17 aa, Entamoeba invadens
EEIFFMEMLGHTLIYSS

SEQ ID NO: 3025822 - protein, 19 aa, Entamoeba invadens
EEIQKQLALLPTIMERISN

SEQ ID NO: 3025823 - protein, 17 aa, Entamoeba invadens
EEKKWINTYNKLILRDI

SEQ ID NO: 3025824 - protein, 17 aa, Entamoeba invadens
EEKNQFPCLFNLVKKMN

SEQ ID NO: 3025825 - protein, 17 aa, Entamoeba invadens
EEKRYFVQVIWQDNKKQ

SEQ ID NO: 3025826 - protein, 18 aa, Entamoeba invadens
EEKWKFRKIPLPTDDRLI

SEQ ID NO: 3025827 - protein, 29 aa, Entamoeba invadens
EELLHNFKLVRLFFFTRFYQTTQEKFYNF

SEQ ID NO: 3025828 - protein, 23 aa, Entamoeba invadens
EELRYLVGLVFLYEKVKKEIGEM

SEQ ID NO: 3025829 - protein, 18 aa, Entamoeba invadens
EEMRFLQDILFEFGYYVE

SEQ ID NO: 3025830 - protein, 24 aa, Entamoeba invadens
EERFVKLVQFFLSGFYVNPKTCKK

SEQ ID NO: 3025831 - protein, 22 aa, Entamoeba invadens
EESLWFRLYGNPEALKGLSQEL

SEQ ID NO: 3025832 - protein, 24 aa, Entamoeba invadens
EETTQLWLPLGNYLFATFSSTGAM

SEQ ID NO: 3025833 - protein, 26 aa, Entamoeba invadens
EEVKGLFWIWGDLWRRVYSALLDYDD

SEQ ID NO: 3025834 - protein, 34 aa, Entamoeba invadens
EEVRERFIELLAYYKRFWIEKIGTKRWSQFFVEN

SEQ ID NO: 3025835 - protein, 17 aa, Entamoeba invadens
EEYSLFRIGFKGGIRIG

SEQ ID NO: 3025836 - protein, 17 aa, Entamoeba invadens
EFEFFHFLVQNLVALVY

SEQ ID NO: 3025837 - protein, 17 aa, Entamoeba invadens
EFFHFLVQNLVALVYYN

SEQ ID NO: 3025838 - protein, 17 aa, Entamoeba invadens
EFFVFPPNTNYVGMSFN

SEQ ID NO: 3025839 - protein, 28 aa, Entamoeba invadens
EFIELFKTLPLCVLLSLSLGNFFLCHGG

SEQ ID NO: 3025840 - protein, 20 aa, Entamoeba invadens
EFIQFFCLFEYYIDDDGQFD

SEQ ID NO: 3025841 - protein, 17 aa, Entamoeba invadens
EFIVLYLSFIRAGSGLS

SEQ ID NO: 3025842 - protein, 24 aa, Entamoeba invadens
EFLLTIIPIMWRFYRNPTISVDTK

SEQ ID NO: 3025843 - protein, 24 aa, Entamoeba invadens
EFLPRRLHFVLTETLNPLARTSVL

SEQ ID NO: 3025844 - protein, 22 aa, Entamoeba invadens
EFNIIRGYYWTGCKSNIINLRS

SEQ ID NO: 3025845 - protein, 20 aa, Entamoeba invadens
EFNIIRGYYWTGCKSNVFSN

SEQ ID NO: 3025846 - protein, 20 aa, Entamoeba invadens
EFNILFWRYLTQVQPFSSRD

SEQ ID NO: 3025847 - protein, 24 aa, Entamoeba invadens
EFNPPLLPFIQKILFHWFKHEEKV

SEQ ID NO: 3025848 - protein, 20 aa, Entamoeba invadens
EFPVLYNHALISSLPLTVSG

SEQ ID NO: 3025849 - protein, 19 aa, Entamoeba invadens
EFPVTLPPPIIIPPQKRNL

SEQ ID NO: 3025850 - protein, 22 aa, Entamoeba invadens
EFRAPYIHLIPQNIFLGRNPTS

SEQ ID NO: 3025851 - protein, 20 aa, Entamoeba invadens
EFRFGKIKIFFKVGVLAEIE

SEQ ID NO: 3025852 - protein, 18 aa, Entamoeba invadens
EFRIRMLLRKLFAGKKLE

SEQ ID NO: 3025853 - protein, 23 aa, Entamoeba invadens
EFSRLWPCSLQPPTLPTPPIQKS

SEQ ID NO: 3025854 - protein, 17 aa, Entamoeba invadens
EFTYLCSQILFVTQKVG

SEQ ID NO: 3025855 - protein, 24 aa, Entamoeba invadens
EGASRAFWVWPANNWCLLQFGFCG

SEQ ID NO: 3025856 - protein, 24 aa, Entamoeba invadens
EGDPPYMEFPPLRALFLITTKGIP

SEQ ID NO: 3025857 - protein, 24 aa, Entamoeba invadens
EGKPVKRMSFLGRRQQTNGPKKEH

SEQ ID NO: 3025858 - protein, 22 aa, Entamoeba invadens
EGLHLLIDILLELGYFFTSKVS

SEQ ID NO: 3025859 - protein, 22 aa, Entamoeba invadens
EGLNWLVFNWCRGKGCILADEM

SEQ ID NO: 3025860 - protein, 18 aa, Entamoeba invadens
EGLRPFLLFNYLENNCGN

SEQ ID NO: 3025861 - protein, 27 aa, Entamoeba invadens
EGNMPYLDIFPKCRGYQLPSLFDTQRG

SEQ ID NO: 3025862 - protein, 20 aa, Entamoeba invadens
EGPITISSYNKLLLDMKTDQ

SEQ ID NO: 3025863 - protein, 26 aa, Entamoeba invadens
EGSKVYWKWFLALSEVPRRSGNRLPP

SEQ ID NO: 3025864 - protein, 18 aa, Entamoeba invadens
EGVCVFLVSFLRRMKSSI

SEQ ID NO: 3025865 - protein, 19 aa, Entamoeba invadens
EGVFLYLLSQLFTFEVHTP

SEQ ID NO: 3025866 - protein, 25 aa, Entamoeba invadens
EGYEYLRLLFGPVKIPFPPGTYVEN

SEQ ID NO: 3025867 - protein, 17 aa, Entamoeba invadens
EHFVLVELYLQLGPPLK

SEQ ID NO: 3025868 - protein, 25 aa, Entamoeba invadens
EHFVVIYLNLWRLFYSKPHMHGHRI

SEQ ID NO: 3025869 - protein, 25 aa, Entamoeba invadens
EHKGIAFLWYFLDNDQEGLFGFADD

SEQ ID NO: 3025870 - protein, 24 aa, Entamoeba invadens
EHVSKLDLLIFFSEIRIFSNTIVD

SEQ ID NO: 3025871 - protein, 36 aa, Entamoeba invadens
EHVTFVYLNLFIQQIYSWLLDLLHICSVRVFPSNTP

SEQ ID NO: 3025872 - protein, 26 aa, Entamoeba invadens
EHYKSFIFIGPVWWWGINGPLKNACK

SEQ ID NO: 3025873 - protein, 20 aa, Entamoeba invadens
EIALYKIRYFSEPLLRPPKH

SEQ ID NO: 3025874 - protein, 24 aa, Entamoeba invadens
EICALFLERLYLTKTTLPFLEVCF

SEQ ID NO: 3025875 - protein, 28 aa, Entamoeba invadens
EICSRNIIVLLFLKYKIIDTLIQFVCKT

SEQ ID NO: 3025876 - protein, 23 aa, Entamoeba invadens
EIDKALFVAFAQEECKLYKKPWY

SEQ ID NO: 3025877 - protein, 24 aa, Entamoeba invadens
EIEKTFYRIIVWFSVDYNTFNKNK

SEQ ID NO: 3025878 - protein, 25 aa, Entamoeba invadens
EIEVQKYVFIFTNFKDLIGELQKLM

SEQ ID NO: 3025879 - protein, 18 aa, Entamoeba invadens
EIEWLKKKIAVREKLDEK

SEQ ID NO: 3025880 - protein, 26 aa, Entamoeba invadens
EIGFYFTKVYIFTLFFLDTPVQKVIE

SEQ ID NO: 3025881 - protein, 17 aa, Entamoeba invadens
EIIVWFNVNYDTVVKND

SEQ ID NO: 3025882 - protein, 25 aa, Entamoeba invadens
EIKDDLFVFCKALLYLHDDKISEAL

SEQ ID NO: 3025883 - protein, 21 aa, Entamoeba invadens
EIKWFNILPTNKVKTLFIIGH

SEQ ID NO: 3025884 - protein, 18 aa, Entamoeba invadens
EILGGRRLVLYPAILNED

SEQ ID NO: 3025885 - protein, 17 aa, Entamoeba invadens
EILIFFEGFVVLNVFVD

SEQ ID NO: 3025886 - protein, 18 aa, Entamoeba invadens
EILIYFLRCLISSSHLLK

SEQ ID NO: 3025887 - protein, 24 aa, Entamoeba invadens
EINGGRWIIADKIQLFGASSIQFI

SEQ ID NO: 3025888 - protein, 21 aa, Entamoeba invadens
EIQQIYFFQSITWFSVMSVSH

SEQ ID NO: 3025889 - protein, 21 aa, Entamoeba invadens
EIRVKLYEAAAPFLIRRVNSY

SEQ ID NO: 3025890 - protein, 19 aa, Entamoeba invadens
EIRVVLQRLLLKAKVLTKD

SEQ ID NO: 3025891 - protein, 17 aa, Entamoeba invadens
EITLLEDVPLITIITPS

SEQ ID NO: 3025892 - protein, 27 aa, Entamoeba invadens
EITRLEIPMAMFHFGGTFTHIIGEKPV

SEQ ID NO: 3025893 - protein, 23 aa, Entamoeba invadens
EIVIPLLVKYLKSQKRLTLFHAE

SEQ ID NO: 3025894 - protein, 24 aa, Entamoeba invadens
EIYSFMMFLCKLLFQKIPPSLQEM

SEQ ID NO: 3025895 - protein, 18 aa, Entamoeba invadens
EIYSWWKNNIEAQEFTDV

SEQ ID NO: 3025896 - protein, 25 aa, Entamoeba invadens
EKCTSLRKFVIPRGLLYMCARVFCD

SEQ ID NO: 3025897 - protein, 17 aa, Entamoeba invadens
EKDGHLLWLLLEKIPKE

SEQ ID NO: 3025898 - protein, 24 aa, Entamoeba invadens
EKDTLIPFVKRYVVWFTVSLTDSY

SEQ ID NO: 3025899 - protein, 24 aa, Entamoeba invadens
EKENKECLWMVLSTEESRTVFLSA

SEQ ID NO: 3025900 - protein, 21 aa, Entamoeba invadens
EKFVILIGLLLFKVENYNTDF

SEQ ID NO: 3025901 - protein, 19 aa, Entamoeba invadens
EKIIFYLWTPAACSIKEKM

SEQ ID NO: 3025902 - protein, 22 aa, Entamoeba invadens
EKILHKILTFLPLEDLVVLLAV

SEQ ID NO: 3025903 - protein, 30 aa, Entamoeba invadens
EKINLFFMDTFMVPFYLHDSLWRGQQLSHL

SEQ ID NO: 3025904 - protein, 22 aa, Entamoeba invadens
EKIVFYLWTPDGCKIKEKMLFS

SEQ ID NO: 3025905 - protein, 18 aa, Entamoeba invadens
EKIYEKCILVLDKLKSIT

SEQ ID NO: 3025906 - protein, 22 aa, Entamoeba invadens
EKKLSESLLLPPFNSLMVQNGS

SEQ ID NO: 3025907 - protein, 23 aa, Entamoeba invadens
EKKRKFFGVFYFYKMAEVDIEDV

SEQ ID NO: 3025908 - protein, 17 aa, Entamoeba invadens
EKKYGEPLLLFYNGIIV

SEQ ID NO: 3025909 - protein, 18 aa, Entamoeba invadens
EKLFFIPERTKVGIVTCG

SEQ ID NO: 3025910 - protein, 26 aa, Entamoeba invadens
EKLKYLIHLFDYSFYKNLLLSFPTLS

SEQ ID NO: 3025911 - protein, 20 aa, Entamoeba invadens
EKLLFFWKQMFLLVSNASCV

SEQ ID NO: 3025912 - protein, 20 aa, Entamoeba invadens
EKLLVFYYNNLSKTALYCLL

SEQ ID NO: 3025913 - protein, 22 aa, Entamoeba invadens
EKNHLLFKQGDIYYCMICEFRG

SEQ ID NO: 3025914 - protein, 19 aa, Entamoeba invadens
EKPLPQFVIWFPVTHDYAK

SEQ ID NO: 3025915 - protein, 23 aa, Entamoeba invadens
EKSDCIWLLTKKTFIKITLLNDN

SEQ ID NO: 3025916 - protein, 23 aa, Entamoeba invadens
EKTEKIWLLEFDAEDTNRKKDAQ

SEQ ID NO: 3025917 - protein, 21 aa, Entamoeba invadens
EKTFFLYPGAPFFMNYDEYNE

SEQ ID NO: 3025918 - protein, 25 aa, Entamoeba invadens
EKTKMVFWYFWFLSFAFEQPDKPKE

SEQ ID NO: 3025919 - protein, 26 aa, Entamoeba invadens
EKTTKYVLLKYFYWKFTEPSVMSLHE

SEQ ID NO: 3025920 - protein, 24 aa, Entamoeba invadens
EKVAYLFTFPFSTLKNFDWKSYQN

SEQ ID NO: 3025921 - protein, 21 aa, Entamoeba invadens
EKYDILFTLFKALERRYNTEI

SEQ ID NO: 3025922 - protein, 26 aa, Entamoeba invadens
EKYMIPMHFWLYYVINVEKHKVLYTH

SEQ ID NO: 3025923 - protein, 23 aa, Entamoeba invadens
EKYNVVLFRLYVLRSDNLIFCPI

SEQ ID NO: 3025924 - protein, 21 aa, Entamoeba invadens
EKYYCLFPVFYRNSSIVIIVY

SEQ ID NO: 3025925 - protein, 22 aa, Entamoeba invadens
ELADRFWYFLKKEFVEMQGNVF

SEQ ID NO: 3025926 - protein, 17 aa, Entamoeba invadens
ELCLFNAYCRMDWLLCT

SEQ ID NO: 3025927 - protein, 20 aa, Entamoeba invadens
ELEEKMLLRQLFLSKEHKDV

SEQ ID NO: 3025928 - protein, 20 aa, Entamoeba invadens
ELFALLSANLPPTGKLLSVG

SEQ ID NO: 3025929 - protein, 21 aa, Entamoeba invadens
ELFITFKFSPTFLYFMSRALV

SEQ ID NO: 3025930 - protein, 17 aa, Entamoeba invadens
ELFPYVDADTIKSVLID

SEQ ID NO: 3025931 - protein, 18 aa, Entamoeba invadens
ELHRLLQKWPLIEPSHAL

SEQ ID NO: 3025932 - protein, 22 aa, Entamoeba invadens
ELIDFIHACSERIRILKQKNSE

SEQ ID NO: 3025933 - protein, 18 aa, Entamoeba invadens
ELIILPSYMKIINNCTFY

SEQ ID NO: 3025934 - protein, 21 aa, Entamoeba invadens
ELISWIMFRLFNLLEKTAAFK

SEQ ID NO: 3025935 - protein, 23 aa, Entamoeba invadens
ELKEFIYMFYFIQLDGDFEKKKE

SEQ ID NO: 3025936 - protein, 25 aa, Entamoeba invadens
ELKGNIRVFCRVRPIIFAPSATMYV

SEQ ID NO: 3025937 - protein, 24 aa, Entamoeba invadens
ELKKEHFIVLLTLMYVLVWDKVEN

SEQ ID NO: 3025938 - protein, 20 aa, Entamoeba invadens
ELLHLLIDLLVVRCGYEFES

SEQ ID NO: 3025939 - protein, 19 aa, Entamoeba invadens
ELLIVLPKNTLFGEKHYLT

SEQ ID NO: 3025940 - protein, 18 aa, Entamoeba invadens
ELLIYYKRFWLEKIDCSN

SEQ ID NO: 3025941 - protein, 24 aa, Entamoeba invadens
ELLKQLIATPFYYRYNPFIQKFNV

SEQ ID NO: 3025942 - protein, 19 aa, Entamoeba invadens
ELLVLYKIPDTYIKDVLRL

SEQ ID NO: 3025943 - protein, 18 aa, Entamoeba invadens
ELLWRWYITRGRTDEGVL

SEQ ID NO: 3025944 - protein, 34 aa, Entamoeba invadens
ELMLLHTQAPYSQILKIYLTFNISPEPTIPQDLF

SEQ ID NO: 3025945 - protein, 18 aa, Entamoeba invadens
ELMLRIESLKKEKVKRLI

SEQ ID NO: 3025946 - protein, 27 aa, Entamoeba invadens
ELNIPFKHLLPFYYNLKTPLIPTTLSD

SEQ ID NO: 3025947 - protein, 23 aa, Entamoeba invadens
ELNNFYEVVFTKEYYLMKNENGC

SEQ ID NO: 3025948 - protein, 20 aa, Entamoeba invadens
ELVPIIYYPISKKPTSLIFI

SEQ ID NO: 3025949 - protein, 25 aa, Entamoeba invadens
ELVTRFFIVLSLYRLFIAQKQNPQE

SEQ ID NO: 3025950 - protein, 21 aa, Entamoeba invadens
EMAQALFIYWKSKELLRTNEY

SEQ ID NO: 3025951 - protein, 19 aa, Entamoeba invadens
EMCRTYDFYLLRLMMRHST

SEQ ID NO: 3025952 - protein, 23 aa, Entamoeba invadens
EMDKMTMKIEWTKKSKWKNIKLI

SEQ ID NO: 3025953 - protein, 24 aa, Entamoeba invadens
EMDKSLMFMLLNSGAIRVYVVGSD

SEQ ID NO: 3025954 - protein, 22 aa, Entamoeba invadens
EMIKFLWNFLWGNAPRVRFFEK

SEQ ID NO: 3025955 - protein, 21 aa, Entamoeba invadens
EMNGLPLMWYDSLVLEKIIMK

SEQ ID NO: 3025956 - protein, 21 aa, Entamoeba invadens
EMNGLPLMWYDSLVLEKITMK

SEQ ID NO: 3025957 - protein, 25 aa, Entamoeba invadens
ENAQQYFLVTPKLLSDLPFGENMTV

SEQ ID NO: 3025958 - protein, 22 aa, Entamoeba invadens
ENATRIWLAKWTTAEFPIPESG

SEQ ID NO: 3025959 - protein, 24 aa, Entamoeba invadens
ENCSWFDFVFPFHSLLELTMNGCE

SEQ ID NO: 3025960 - protein, 25 aa, Entamoeba invadens
ENFKKFYELLKLYGYKMPLFDKLKS

SEQ ID NO: 3025961 - protein, 18 aa, Entamoeba invadens
ENFLLPCLSLSDVPDLIS

SEQ ID NO: 3025962 - protein, 23 aa, Entamoeba invadens
ENFLNLPNCLFTRFLRAEVSLDE

SEQ ID NO: 3025963 - protein, 23 aa, Entamoeba invadens
ENKAFIEKFISLLLRVINNKTSK

SEQ ID NO: 3025964 - protein, 22 aa, Entamoeba invadens
ENKNIRGYYWTGNKSDLLSNEM

SEQ ID NO: 3025965 - protein, 17 aa, Entamoeba invadens
ENKVALLLLCPHSSHLS

SEQ ID NO: 3025966 - protein, 23 aa, Entamoeba invadens
ENNFYQIMMFNFSQYFGEKNFDE

SEQ ID NO: 3025967 - protein, 22 aa, Entamoeba invadens
ENNKNRIIKNVNFKQLGQEIAQ

SEQ ID NO: 3025968 - protein, 24 aa, Entamoeba invadens
ENNVKKYFKVWHDELRVFDESGKT

SEQ ID NO: 3025969 - protein, 17 aa, Entamoeba invadens
ENQLFLEDLKAQKKKRE

SEQ ID NO: 3025970 - protein, 25 aa, Entamoeba invadens
ENSKPIFLLVVDLIDLLSAFIPLPP

SEQ ID NO: 3025971 - protein, 21 aa, Entamoeba invadens
ENTIKMPWWHSDLMGEECMIF

SEQ ID NO: 3025972 - protein, 24 aa, Entamoeba invadens
ENTTFFQRVIWYPVPYFVFSEHPQ

SEQ ID NO: 3025973 - protein, 24 aa, Entamoeba invadens
ENVIQLLFDYLKNPVLKITVGNFI

SEQ ID NO: 3025974 - protein, 23 aa, Entamoeba invadens
ENYLYRTLMIFLEYAWSHGQTEF

SEQ ID NO: 3025975 - protein, 24 aa, Entamoeba invadens
EPAKRLMFLVFDRTHTLLPKCEEF

SEQ ID NO: 3025976 - protein, 22 aa, Entamoeba invadens
EPAMYRALFNYTATDRMELSFK

SEQ ID NO: 3025977 - protein, 22 aa, Entamoeba invadens
EPCNLIKYHPLANYIKTGNDGR

SEQ ID NO: 3025978 - protein, 20 aa, Entamoeba invadens
EPFLVVFVKFLTILFMRDDL

SEQ ID NO: 3025979 - protein, 19 aa, Entamoeba invadens
EPKYYVPIIPMVLVNGAEG

SEQ ID NO: 3025980 - protein, 24 aa, Entamoeba invadens
EPLHSLLKLLWALNMKLTRLYTTP

SEQ ID NO: 3025981 - protein, 18 aa, Entamoeba invadens
EPLSVPYFRTLMRATSQL

SEQ ID NO: 3025982 - protein, 24 aa, Entamoeba invadens
EPNKDIFVIFINRLSVLISEVITF

SEQ ID NO: 3025983 - protein, 24 aa, Entamoeba invadens
EPPKKWMYFFLFNDRLVETIPELY

SEQ ID NO: 3025984 - protein, 20 aa, Entamoeba invadens
EPTAAFYFYGIQKHAFNIEN

SEQ ID NO: 3025985 - protein, 22 aa, Entamoeba invadens
EPYISIFFRVFTPLITTTDSSL

SEQ ID NO: 3025986 - protein, 23 aa, Entamoeba invadens
EQEKYNLLLRKMKFDYLDEISKV

SEQ ID NO: 3025987 - protein, 26 aa, Entamoeba invadens
EQENPLYMYLLFKSKYPYVFSDAMFM

SEQ ID NO: 3025988 - protein, 18 aa, Entamoeba invadens
EQEQYWIFQLVAAVLHMG

SEQ ID NO: 3025989 - protein, 18 aa, Entamoeba invadens
EQFVDLFKPFKTTSVLLD

SEQ ID NO: 3025990 - protein, 26 aa, Entamoeba invadens
EQLLEVWIGLYFWYWHSDGRPYQQTV

SEQ ID NO: 3025991 - protein, 21 aa, Entamoeba invadens
EQLSFVYLPLNINLLQKKAFA

SEQ ID NO: 3025992 - protein, 23 aa, Entamoeba invadens
EQQAVLMWILLQGDVTSFTVQCP

SEQ ID NO: 3025993 - protein, 24 aa, Entamoeba invadens
EQRILFLYILCFCKKLIELGEKLE

SEQ ID NO: 3025994 - protein, 19 aa, Entamoeba invadens
EQYIWYFPKNTGSAQPKGI

SEQ ID NO: 3025995 - protein, 24 aa, Entamoeba invadens
ERALMLYLTLFNRNDKMEQSERMK

SEQ ID NO: 3025996 - protein, 24 aa, Entamoeba invadens
ERIFLKMRILNFNEFLLKIGDIEK

SEQ ID NO: 3025997 - protein, 24 aa, Entamoeba invadens
ERKWKLKMFNFKKNFGYLKEGAEV

SEQ ID NO: 3025998 - protein, 20 aa, Entamoeba invadens
ERLLCQLIQKYLLYIANCGW

SEQ ID NO: 3025999 - protein, 25 aa, Entamoeba invadens
ERLMYWFLYHFTPDTVDFGFGFFSK

SEQ ID NO: 3026000 - protein, 22 aa, Entamoeba invadens
ERPKLLFELFTPLFQYKDLAVT

SEQ ID NO: 3026001 - protein, 18 aa, Entamoeba invadens
ERRISIVSTLYFIRKRKF

SEQ ID NO: 3026002 - protein, 25 aa, Entamoeba invadens
ERRNNLQWFRVPPKIFFEPHAIRYL

SEQ ID NO: 3026003 - protein, 17 aa, Entamoeba invadens
ERWLLEGNMPYLDIFPK

SEQ ID NO: 3026004 - protein, 24 aa, Entamoeba invadens
ESEGILLFFDLSIGPSFVSLDEYF

SEQ ID NO: 3026005 - protein, 21 aa, Entamoeba invadens
ESFVSMFPFYNSTYLFNASDK

SEQ ID NO: 3026006 - protein, 22 aa, Entamoeba invadens
ESFYPEEIFAIIIRGLLNKFME

SEQ ID NO: 3026007 - protein, 22 aa, Entamoeba invadens
ESGEGWFFGCWQPRDILSGKND

SEQ ID NO: 3026008 - protein, 23 aa, Entamoeba invadens
ESGYIWLPMYPVICGPMYIIPQQ

SEQ ID NO: 3026009 - protein, 23 aa, Entamoeba invadens
ESHRVKFVLICWAGEGIKKPKLR

SEQ ID NO: 3026010 - protein, 22 aa, Entamoeba invadens
ESIYLLMNYLVKYPFLKLEEKL

SEQ ID NO: 3026011 - protein, 20 aa, Entamoeba invadens
ESKIFMMSYPLPLSLQNEVT

SEQ ID NO: 3026012 - protein, 23 aa, Entamoeba invadens
ESLAYLFVYLLKGSLPWQDLPST

SEQ ID NO: 3026013 - protein, 25 aa, Entamoeba invadens
ESLAYMFIYFLQGKLPWQGFSRQNN

SEQ ID NO: 3026014 - protein, 20 aa, Entamoeba invadens
ESLFALCRNLYIIENLDDVE

SEQ ID NO: 3026015 - protein, 22 aa, Entamoeba invadens
ESLMKDLFLMKTEFLKQLSAAE

SEQ ID NO: 3026016 - protein, 23 aa, Entamoeba invadens
ESLYIKFALLFQTLPLASLLHTK

SEQ ID NO: 3026017 - protein, 21 aa, Entamoeba invadens
ESQFYFCKSLRKISLPKNLLF

SEQ ID NO: 3026018 - protein, 24 aa, Entamoeba invadens
ESSFEVFFLLCCLKLTFPNQFVLL

SEQ ID NO: 3026019 - protein, 22 aa, Entamoeba invadens
ESSTTWILYWTLNSLRLLKANV

SEQ ID NO: 3026020 - protein, 24 aa, Entamoeba invadens
ESTDLLPSLFVLALPRSGSTFLHT

SEQ ID NO: 3026021 - protein, 23 aa, Entamoeba invadens
ESTKDWLLPYCIYRTLIKSVDTP

SEQ ID NO: 3026022 - protein, 24 aa, Entamoeba invadens
ESTLYFAPQFLMLRNLCYGKYHAA

SEQ ID NO: 3026023 - protein, 23 aa, Entamoeba invadens
ESVTYFIYNFFKNEFKFVGDVVF

SEQ ID NO: 3026024 - protein, 17 aa, Entamoeba invadens
ESYVMTLLLRYFDALPK

SEQ ID NO: 3026025 - protein, 22 aa, Entamoeba invadens
ETDNFFLFSFKLTDSTPSVYSR

SEQ ID NO: 3026026 - protein, 25 aa, Entamoeba invadens
ETIVLLRRRRLVILKSIEQLAKSLK

SEQ ID NO: 3026027 - protein, 25 aa, Entamoeba invadens
ETIVLLRRRRLVILKSVEQLAKSLK

SEQ ID NO: 3026028 - protein, 19 aa, Entamoeba invadens
ETIVLRFLENFRLWIGLRR

SEQ ID NO: 3026029 - protein, 22 aa, Entamoeba invadens
ETIYKPLRIFKDKSYKSADVEI

SEQ ID NO: 3026030 - protein, 24 aa, Entamoeba invadens
ETPKNWKYFFLFNDRLVMSEVVSY

SEQ ID NO: 3026031 - protein, 25 aa, Entamoeba invadens
ETPRHFFCIIVWYKVSYEDAQINTT

SEQ ID NO: 3026032 - protein, 20 aa, Entamoeba invadens
ETRFFIFHDLELRVPGFDER

SEQ ID NO: 3026033 - protein, 24 aa, Entamoeba invadens
ETRNRLVILLPWLEQRLSEGSPDV

SEQ ID NO: 3026034 - protein, 24 aa, Entamoeba invadens
ETSHLPIVAIFLKDFVVLNELKTI

SEQ ID NO: 3026035 - protein, 23 aa, Entamoeba invadens
ETSLRVFDYILMDGIVALMSVTN

SEQ ID NO: 3026036 - protein, 22 aa, Entamoeba invadens
ETTNLVPLLRLSYNKFDSHFIA

SEQ ID NO: 3026037 - protein, 18 aa, Entamoeba invadens
ETVLFLLSLVPGVFFTKP

SEQ ID NO: 3026038 - protein, 22 aa, Entamoeba invadens
ETYFHYYLKYFSVRTKVRARKI

SEQ ID NO: 3026039 - protein, 18 aa, Entamoeba invadens
EVATIFLVLLSKMDELPP

SEQ ID NO: 3026040 - protein, 21 aa, Entamoeba invadens
EVDWFLNKWYYFFFVSIDGED

SEQ ID NO: 3026041 - protein, 17 aa, Entamoeba invadens
EVEILLLIRCTLKIKSE

SEQ ID NO: 3026042 - protein, 23 aa, Entamoeba invadens
EVENFFIAFVWVLKNINRNVLSY

SEQ ID NO: 3026043 - protein, 24 aa, Entamoeba invadens
EVEPFWLNIYHTMLLHGLLYWKHR

SEQ ID NO: 3026044 - protein, 18 aa, Entamoeba invadens
EVFAMIAAMKILCSKNFV

SEQ ID NO: 3026045 - protein, 25 aa, Entamoeba invadens
EVFKKLLLNYPFFDYKLRMLDQIAL

SEQ ID NO: 3026046 - protein, 23 aa, Entamoeba invadens
EVFQLLLALKIRYPKRITLLRGN

SEQ ID NO: 3026047 - protein, 18 aa, Entamoeba invadens
EVFVFVYSVDNYFSFKNV

SEQ ID NO: 3026048 - protein, 23 aa, Entamoeba invadens
EVGDIFYVERFVGSWALVYVNEE

SEQ ID NO: 3026049 - protein, 20 aa, Entamoeba invadens
EVIILLFCLKLQFPDRVSLL

SEQ ID NO: 3026050 - protein, 25 aa, Entamoeba invadens
EVKATTLCLWILKSLKQLNPDQEFF

SEQ ID NO: 3026051 - protein, 17 aa, Entamoeba invadens
EVKKMITVAPWFFVEIT

SEQ ID NO: 3026052 - protein, 17 aa, Entamoeba invadens
EVLGYLRVLLFPVDFKE

SEQ ID NO: 3026053 - protein, 18 aa, Entamoeba invadens
EVLKYYFRSLPTPLIHPH

SEQ ID NO: 3026054 - protein, 25 aa, Entamoeba invadens
EVLSFEGMWWYGRKENSFGYFPGEY

SEQ ID NO: 3026055 - protein, 29 aa, Entamoeba invadens
EVLTTLIFLRFLFVPFLATPSLLKCFQRA

SEQ ID NO: 3026056 - protein, 17 aa, Entamoeba invadens
EVLTWVEPFPKEIYKFG

SEQ ID NO: 3026057 - protein, 18 aa, Entamoeba invadens
EVMRLLQDFISELGFLVV

SEQ ID NO: 3026058 - protein, 17 aa, Entamoeba invadens
EVPEGCMLNLLHFAYEG

SEQ ID NO: 3026059 - protein, 18 aa, Entamoeba invadens
EVQWLPWHNEHLLEKFVM

SEQ ID NO: 3026060 - protein, 25 aa, Entamoeba invadens
EVSHKVIWYPLYYTDLMILKKTDNT

SEQ ID NO: 3026061 - protein, 22 aa, Entamoeba invadens
EVVCLPFYTFIVRYLYPRHEHI

SEQ ID NO: 3026062 - protein, 19 aa, Entamoeba invadens
EVVLGVPFIYLTKVQQILA

SEQ ID NO: 3026063 - protein, 18 aa, Entamoeba invadens
EVVMLKPFYACEFSIYLT

SEQ ID NO: 3026064 - protein, 24 aa, Entamoeba invadens
EVVTLLFLLKMKYPKHVYLIRGNH

SEQ ID NO: 3026065 - protein, 19 aa, Entamoeba invadens
EVVVPLLGILFNFSQTDSM

SEQ ID NO: 3026066 - protein, 18 aa, Entamoeba invadens
EVYLIKYLPLFTSLAASA

SEQ ID NO: 3026067 - protein, 28 aa, Entamoeba invadens
EVYSQIVSLIWQLLIIDLQKRISKSSPG

SEQ ID NO: 3026068 - protein, 18 aa, Entamoeba invadens
EWATRRNGFMDKCPMNPV

SEQ ID NO: 3026069 - protein, 20 aa, Entamoeba invadens
EWQHDFLELLPKLSKGEKVD

SEQ ID NO: 3026070 - protein, 17 aa, Entamoeba invadens
EWSFPEIYLLDGGFKCI

SEQ ID NO: 3026071 - protein, 17 aa, Entamoeba invadens
EWSLNMLVLLWFHICRN

SEQ ID NO: 3026072 - protein, 25 aa, Entamoeba invadens
EWVLQFLLSFFIPGLLDFFGGNEYN

SEQ ID NO: 3026073 - protein, 19 aa, Entamoeba invadens
EWVYKYFFELLKKSSEFKD

SEQ ID NO: 3026074 - protein, 26 aa, Entamoeba invadens
EYESFRPLSYPSTDIFLLCFNVIQPS

SEQ ID NO: 3026075 - protein, 19 aa, Entamoeba invadens
EYHVIYWYMSVLFAMMGEH

SEQ ID NO: 3026076 - protein, 18 aa, Entamoeba invadens
EYISRFFKPIFEATLHPE

SEQ ID NO: 3026077 - protein, 18 aa, Entamoeba invadens
EYIVHFYGAVFIPNKVCL

SEQ ID NO: 3026078 - protein, 19 aa, Entamoeba invadens
EYKIIRGYYWTGNKSDLLS

SEQ ID NO: 3026079 - protein, 21 aa, Entamoeba invadens
EYKIPLMWRLTQLAMQNDGKS

SEQ ID NO: 3026080 - protein, 20 aa, Entamoeba invadens
EYMIFACVFEALRFTTRGWE

SEQ ID NO: 3026081 - protein, 27 aa, Entamoeba invadens
EYNMLYKWINFLGYPPKKLLDAGKKTE

SEQ ID NO: 3026082 - protein, 27 aa, Entamoeba invadens
EYPRPDFWAKLFNYLKKGLIDISKFTD

SEQ ID NO: 3026083 - protein, 24 aa, Entamoeba invadens
EYTDKPLFFFIGLSLKQDTHFLST

SEQ ID NO: 3026084 - protein, 24 aa, Entamoeba invadens
EYTQLRPLSYPGTDLFIVCYSTIQ

SEQ ID NO: 3026085 - protein, 19 aa, Entamoeba invadens
EYTSLRPLSYPQTDIFVLC

SEQ ID NO: 3026086 - protein, 22 aa, Entamoeba invadens
EYVNIFMFLIVKAQVIDLFGIL

SEQ ID NO: 3026087 - protein, 22 aa, Entamoeba invadens
EYYSELLLILKLNFLRMSAIFE

SEQ ID NO: 3026088 - protein, 27 aa, Entamoeba invadens
FACQFKLIRYIFPLALLNMIVSCSLET

SEQ ID NO: 3026089 - protein, 27 aa, Entamoeba invadens
FAITMLECFLWDNAFPKNVYVFSWTIA

SEQ ID NO: 3026090 - protein, 23 aa, Entamoeba invadens
FAITMLWCITWTDPFPQTVYHYA

SEQ ID NO: 3026091 - protein, 25 aa, Entamoeba invadens
FAITMVECFLWSNAYPKTIYMYPWT

SEQ ID NO: 3026092 - protein, 21 aa, Entamoeba invadens
FAIVRAIKRIPRLSWLSFQCC

SEQ ID NO: 3026093 - protein, 22 aa, Entamoeba invadens
FAKDLDVVFLPFALRSFEVILP

SEQ ID NO: 3026094 - protein, 18 aa, Entamoeba invadens
FALNLKVLVIYSTLTLNG

SEQ ID NO: 3026095 - protein, 18 aa, Entamoeba invadens
FANFLVRPLYLMKTSRGM

SEQ ID NO: 3026096 - protein, 17 aa, Entamoeba invadens
FAVAFTIALQKEGTLLI

SEQ ID NO: 3026097 - protein, 25 aa, Entamoeba invadens
FAVEYSQILVLWRLKNDLFGYEKEI

SEQ ID NO: 3026098 - protein, 21 aa, Entamoeba invadens
FAYLKYILLFSRNPILPNAVL

SEQ ID NO: 3026099 - protein, 17 aa, Entamoeba invadens
FCEEIANNLLLFSNKKI

SEQ ID NO: 3026100 - protein, 18 aa, Entamoeba invadens
FCINIPQKLFLLKAENED

SEQ ID NO: 3026101 - protein, 18 aa, Entamoeba invadens
FCSRVMTYYARISCRSFL

SEQ ID NO: 3026102 - protein, 23 aa, Entamoeba invadens
FCVIKEFLRRLPLPVFHPLLEFL

SEQ ID NO: 3026103 - protein, 27 aa, Entamoeba invadens
FCVVINPYQFFPIYTHFMINKYTGRRK

SEQ ID NO: 3026104 - protein, 17 aa, Entamoeba invadens
FDANLFFDLNHDEEKLE

SEQ ID NO: 3026105 - protein, 17 aa, Entamoeba invadens
FDFFIRVGYKCLIYGDY

SEQ ID NO: 3026106 - protein, 25 aa, Entamoeba invadens
FDHLETLILWLFIPNNNNYLNFSKM

SEQ ID NO: 3026107 - protein, 25 aa, Entamoeba invadens
FDLQLTLKLLLYELIDWMRDHPSYT

SEQ ID NO: 3026108 - protein, 17 aa, Entamoeba invadens
FDLVARWYGLSHIKITC

SEQ ID NO: 3026109 - protein, 21 aa, Entamoeba invadens
FDNIIMIHPLSFYLITPIQRI

SEQ ID NO: 3026110 - protein, 24 aa, Entamoeba invadens
FDSLRPLSYPGTDIFLLCYAVNSS

SEQ ID NO: 3026111 - protein, 26 aa, Entamoeba invadens
FDYCFPRFLVLLFPNELTSTFWQRCN

SEQ ID NO: 3026112 - protein, 18 aa, Entamoeba invadens
FEANTFRELLYKVLDKDF

SEQ ID NO: 3026113 - protein, 24 aa, Entamoeba invadens
FECFGWCQAYPKTQFKYPWVIAKF

SEQ ID NO: 3026114 - protein, 24 aa, Entamoeba invadens
FECVTWKEPYPKIRFKFAWDIVDF

SEQ ID NO: 3026115 - protein, 28 aa, Entamoeba invadens
FEEFIMTWGCILLLKGDFNLLPKFCLIV

SEQ ID NO: 3026116 - protein, 17 aa, Entamoeba invadens
FEEIFRYVFTKKAIKLG

SEQ ID NO: 3026117 - protein, 24 aa, Entamoeba invadens
FEEKTWLIILNFFGQETLFEAPEN

SEQ ID NO: 3026118 - protein, 25 aa, Entamoeba invadens
FEFIARWLLMLFKREFKRNLVLRLW

SEQ ID NO: 3026119 - protein, 30 aa, Entamoeba invadens
FEGDLKLILGLLWVLILKYQIAANKMDAST

SEQ ID NO: 3026120 - protein, 18 aa, Entamoeba invadens
FEIIPYKVYQFRGFDLAN

SEQ ID NO: 3026121 - protein, 17 aa, Entamoeba invadens
FEIPFVVQLYYSATPTQ

SEQ ID NO: 3026122 - protein, 24 aa, Entamoeba invadens
FEKEFFRIIIWFNVDFETVDRNKS

SEQ ID NO: 3026123 - protein, 18 aa, Entamoeba invadens
FEKLLEIMIFRENKNRKT

SEQ ID NO: 3026124 - protein, 20 aa, Entamoeba invadens
FEKNLLFFQKYDYKHKLVGH

SEQ ID NO: 3026125 - protein, 26 aa, Entamoeba invadens
FEKSEINFVWLYEAYFIHTSFQTTKE

SEQ ID NO: 3026126 - protein, 24 aa, Entamoeba invadens
FELGKYYIIMILPKFMKETHVTLS

SEQ ID NO: 3026127 - protein, 18 aa, Entamoeba invadens
FELLNLFIYKKAKLMSTD

SEQ ID NO: 3026128 - protein, 19 aa, Entamoeba invadens
FELRILPEVVMLKPFYACE

SEQ ID NO: 3026129 - protein, 22 aa, Entamoeba invadens
FEMNYFVTWFADLFIDVFPPLL

SEQ ID NO: 3026130 - protein, 17 aa, Entamoeba invadens
FENIFYKGKLVMSVFDI

SEQ ID NO: 3026131 - protein, 19 aa, Entamoeba invadens
FEQFYNLRILFLPDSVVGI

SEQ ID NO: 3026132 - protein, 24 aa, Entamoeba invadens
FEQKNIIHLLLLKVNDYRTTRLWK

SEQ ID NO: 3026133 - protein, 20 aa, Entamoeba invadens
FERSLDLYYYLRNELIEDMR

SEQ ID NO: 3026134 - protein, 25 aa, Entamoeba invadens
FESLKVLSIHSLYFPLFLEKFEQLD

SEQ ID NO: 3026135 - protein, 17 aa, Entamoeba invadens
FESLLQCRLLQKIYIVV

SEQ ID NO: 3026136 - protein, 18 aa, Entamoeba invadens
FESLYYIFDLFPYEHIPI

SEQ ID NO: 3026137 - protein, 17 aa, Entamoeba invadens
FEVLNPKLQPWWIVRTC

SEQ ID NO: 3026138 - protein, 19 aa, Entamoeba invadens
FEVVFFWKFIDDNTLYFYD

SEQ ID NO: 3026139 - protein, 25 aa, Entamoeba invadens
FEWHYLWFIHALPFDFALKLFDVIL

SEQ ID NO: 3026140 - protein, 17 aa, Entamoeba invadens
FFAIFQTLNNIPFPEHS

SEQ ID NO: 3026141 - protein, 18 aa, Entamoeba invadens
FFDAFYLAEKIILLGIQR

SEQ ID NO: 3026142 - protein, 24 aa, Entamoeba invadens
FFDLTDWYIGYLIRSYRSGDTTIP

SEQ ID NO: 3026143 - protein, 19 aa, Entamoeba invadens
FFDVLRAYRKITASPFIIF

SEQ ID NO: 3026144 - protein, 19 aa, Entamoeba invadens
FFEANTFRELLYRVLDKDF

SEQ ID NO: 3026145 - protein, 26 aa, Entamoeba invadens
FFEMSQLYPFFIKNLPNALLHKDIVL

SEQ ID NO: 3026146 - protein, 21 aa, Entamoeba invadens
FFEQFFPKTFLFIITNNKTFK

SEQ ID NO: 3026147 - protein, 17 aa, Entamoeba invadens
FFGLVLFYLKSSTDSGL

SEQ ID NO: 3026148 - protein, 18 aa, Entamoeba invadens
FFHFIFNFLCNFDQLIQN

SEQ ID NO: 3026149 - protein, 21 aa, Entamoeba invadens
FFIAFCPLLKMYMDYVAKFNL

SEQ ID NO: 3026150 - protein, 18 aa, Entamoeba invadens
FFKQFFYTNPLSKYYVYK

SEQ ID NO: 3026151 - protein, 18 aa, Entamoeba invadens
FFKVEFFERVWSKTTPED

SEQ ID NO: 3026152 - protein, 17 aa, Entamoeba invadens
FFLELRISPYHYEEDLI

SEQ ID NO: 3026153 - protein, 19 aa, Entamoeba invadens
FFLPKAPKYFSKIETFVVV

SEQ ID NO: 3026154 - protein, 17 aa, Entamoeba invadens
FFNFPMLLILTQFKEFL

SEQ ID NO: 3026155 - protein, 24 aa, Entamoeba invadens
FFQKKLSLIRWIESILKVPIDSDL

SEQ ID NO: 3026156 - protein, 17 aa, Entamoeba invadens
FFQVKLLKLLRVMNPTN

SEQ ID NO: 3026157 - protein, 17 aa, Entamoeba invadens
FFQVLLAVVFYVGMCGI

SEQ ID NO: 3026158 - protein, 18 aa, Entamoeba invadens
FFVKIFLDRFSIPSVVLN

SEQ ID NO: 3026159 - protein, 17 aa, Entamoeba invadens
FFVLLAIVYLRQHDFGD

SEQ ID NO: 3026160 - protein, 17 aa, Entamoeba invadens
FFYILKLTQICVTPMRE

SEQ ID NO: 3026161 - protein, 17 aa, Entamoeba invadens
FGDIYFWFDVCAPNITY

SEQ ID NO: 3026162 - protein, 22 aa, Entamoeba invadens
FGDKLLHLFLKPTPINMDKVEG

SEQ ID NO: 3026163 - protein, 20 aa, Entamoeba invadens
FGDLWVEFLLRESGSLDSGT

SEQ ID NO: 3026164 - protein, 24 aa, Entamoeba invadens
FGEFEFLHFLVQNLVAIVFYNTNK

SEQ ID NO: 3026165 - protein, 23 aa, Entamoeba invadens
FGEFKIFHFLVQNLVALVFYNNT

SEQ ID NO: 3026166 - protein, 20 aa, Entamoeba invadens
FGGFGVLVVHFWALGKGGMD

SEQ ID NO: 3026167 - protein, 17 aa, Entamoeba invadens
FGIFMYEVLYGRTPFFS

SEQ ID NO: 3026168 - protein, 17 aa, Entamoeba invadens
FGITLFETFKWGEAYDK

SEQ ID NO: 3026169 - protein, 18 aa, Entamoeba invadens
FGITLWEIFYRAQPFREY

SEQ ID NO: 3026170 - protein, 20 aa, Entamoeba invadens
FGLMYFLKLYSTAFKSECLH

SEQ ID NO: 3026171 - protein, 20 aa, Entamoeba invadens
FGLPFDRPFYLVHRNTFLES

SEQ ID NO: 3026172 - protein, 25 aa, Entamoeba invadens
FGPRHNQLLPIDKIKPFTPGTVPLA

SEQ ID NO: 3026173 - protein, 19 aa, Entamoeba invadens
FGRKLVFANLPFLMNINLP

SEQ ID NO: 3026174 - protein, 32 aa, Entamoeba invadens
FGRKRQFPLYRRVPYYDFRWGMTIDDFPELKE

SEQ ID NO: 3026175 - protein, 24 aa, Entamoeba invadens
FGVLNMFKSFFKKKFFQVVVWFTV

SEQ ID NO: 3026176 - protein, 17 aa, Entamoeba invadens
FGYFFKSADFDLFCKTM

SEQ ID NO: 3026177 - protein, 17 aa, Entamoeba invadens
FGYYFMMSRIIPKCFQL

SEQ ID NO: 3026178 - protein, 17 aa, Entamoeba invadens
FHDLMIKFLTQPDFEIV

SEQ ID NO: 3026179 - protein, 17 aa, Entamoeba invadens
FHFNPIPLTELTLKYFP

SEQ ID NO: 3026180 - protein, 18 aa, Entamoeba invadens
FHFQIVMKYFLYEQNFIN

SEQ ID NO: 3026181 - protein, 22 aa, Entamoeba invadens
FHIDFYVRMFIIVKSSVSLSGE

SEQ ID NO: 3026182 - protein, 19 aa, Entamoeba invadens
FHRQGIILVPLYSTLTTEQ

SEQ ID NO: 3026183 - protein, 30 aa, Entamoeba invadens
FHRTPLSVLNYYLQFVFSFIASTEITSRKA

SEQ ID NO: 3026184 - protein, 21 aa, Entamoeba invadens
FHSCRIIVHYFLISLSKNTNN

SEQ ID NO: 3026185 - protein, 17 aa, Entamoeba invadens
FHSLIDYLISLSDVFVI

SEQ ID NO: 3026186 - protein, 17 aa, Entamoeba invadens
FHYFTPEVLTLFFSRNY

SEQ ID NO: 3026187 - protein, 21 aa, Entamoeba invadens
FHYLLEFLVFPFEVGVDKFSV

SEQ ID NO: 3026188 - protein, 18 aa, Entamoeba invadens
FHYNPISILFKTQKYFPN

SEQ ID NO: 3026189 - protein, 26 aa, Entamoeba invadens
FIELFRTLPLCVYLSLPLGNFFLCHG

SEQ ID NO: 3026190 - protein, 17 aa, Entamoeba invadens
FIEMLPTDIPKPFITTT

SEQ ID NO: 3026191 - protein, 18 aa, Entamoeba invadens
FIERPKLLKYLRPIEDAF

SEQ ID NO: 3026192 - protein, 17 aa, Entamoeba invadens
FIFISEPGRYMASNSFH

SEQ ID NO: 3026193 - protein, 18 aa, Entamoeba invadens
FIFLPLLYHPDSSPLLQL

SEQ ID NO: 3026194 - protein, 25 aa, Entamoeba invadens
FIFQALFVDWIIPKTSTKLPPAPSV

SEQ ID NO: 3026195 - protein, 17 aa, Entamoeba invadens
FIIEKLDKKKKLEIQNE

SEQ ID NO: 3026196 - protein, 24 aa, Entamoeba invadens
FIKKGEGFILFYAINSKKSYLQVQ

SEQ ID NO: 3026197 - protein, 17 aa, Entamoeba invadens
FIKWLCNSTKLKEYYTF

SEQ ID NO: 3026198 - protein, 17 aa, Entamoeba invadens
FILKLLPGKILVVNGFI

SEQ ID NO: 3026199 - protein, 19 aa, Entamoeba invadens
FIMVQIVPDYLYILEPIYL

SEQ ID NO: 3026200 - protein, 20 aa, Entamoeba invadens
FINFIDFFEQFFPKTFLFII

SEQ ID NO: 3026201 - protein, 19 aa, Entamoeba invadens
FIQFLPLIIFYITSQERGQ

SEQ ID NO: 3026202 - protein, 18 aa, Entamoeba invadens
FIREGFRILKTGGLMFIA

SEQ ID NO: 3026203 - protein, 18 aa, Entamoeba invadens
FISYWRLFRNGRWKPVKE

SEQ ID NO: 3026204 - protein, 17 aa, Entamoeba invadens
FIVLYLSFMSAGSGLFQ

SEQ ID NO: 3026205 - protein, 19 aa, Entamoeba invadens
FIVYWLKKMKKFQKMFVRI

SEQ ID NO: 3026206 - protein, 20 aa, Entamoeba invadens
FIYVLNKIRYGTVDEWCLNK

SEQ ID NO: 3026207 - protein, 18 aa, Entamoeba invadens
FKAFKKLFLLRDKIAREE

SEQ ID NO: 3026208 - protein, 24 aa, Entamoeba invadens
FKDNQLFILLPNRVMYRVIENNLI

SEQ ID NO: 3026209 - protein, 24 aa, Entamoeba invadens
FKDQAIWMLNAVWPAYKDTLAEEM

SEQ ID NO: 3026210 - protein, 28 aa, Entamoeba invadens
FKEKYMIPMQFWLYYVIDVEKHKLAYIQ

SEQ ID NO: 3026211 - protein, 18 aa, Entamoeba invadens
FKIFLLFLPLDGCIKSSR

SEQ ID NO: 3026212 - protein, 19 aa, Entamoeba invadens
FKKAFYKIIVWFNVDFETV

SEQ ID NO: 3026213 - protein, 24 aa, Entamoeba invadens
FKKEFFCIIVWFDVDFETFDRNKS

SEQ ID NO: 3026214 - protein, 23 aa, Entamoeba invadens
FKKEFFRIIVWFNVDFKTVDRNK

SEQ ID NO: 3026215 - protein, 24 aa, Entamoeba invadens
FKKEFFRIIVWFNVDFKTVDRNKN

SEQ ID NO: 3026216 - protein, 24 aa, Entamoeba invadens
FKKEFFYMIVWFIVDFETVDRNKS

SEQ ID NO: 3026217 - protein, 26 aa, Entamoeba invadens
FKKFGLLHFLVFYYDQDWKKITNAPQ

SEQ ID NO: 3026218 - protein, 27 aa, Entamoeba invadens
FKKISMINFLIFYYKYDTHEVVNAPQG

SEQ ID NO: 3026219 - protein, 17 aa, Entamoeba invadens
FKKLFFKTVAVSYAFYL

SEQ ID NO: 3026220 - protein, 19 aa, Entamoeba invadens
FKKLPLYKYLNELTNHKEM

SEQ ID NO: 3026221 - protein, 20 aa, Entamoeba invadens
FKLIILPRYLKEIKTSGFCS

SEQ ID NO: 3026222 - protein, 17 aa, Entamoeba invadens
FKLLLIGDSGVGKSCLL

SEQ ID NO: 3026223 - protein, 18 aa, Entamoeba invadens
FKQFVINMALFFQIPNTA

SEQ ID NO: 3026224 - protein, 17 aa, Entamoeba invadens
FKRDEVFKEWLLCKAIN

SEQ ID NO: 3026225 - protein, 27 aa, Entamoeba invadens
FKRIDTLLYLLYYPQVPMVRTKTIDMI

SEQ ID NO: 3026226 - protein, 17 aa, Entamoeba invadens
FLAGSIPTPASAGLLAA

SEQ ID NO: 3026227 - protein, 17 aa, Entamoeba invadens
FLAHVYKWVLILLAEVN

SEQ ID NO: 3026228 - protein, 25 aa, Entamoeba invadens
FLARPARLPFLSLLLDLPPDVNDGT

SEQ ID NO: 3026229 - protein, 18 aa, Entamoeba invadens
FLCAVPYNRKTIIPTFCM

SEQ ID NO: 3026230 - protein, 18 aa, Entamoeba invadens
FLDFLRKYNTKEFRFDFK

SEQ ID NO: 3026231 - protein, 17 aa, Entamoeba invadens
FLFLVRQNVDISLTHLC

SEQ ID NO: 3026232 - protein, 20 aa, Entamoeba invadens
FLFNPLFFFSHLERQYMVTV

SEQ ID NO: 3026233 - protein, 18 aa, Entamoeba invadens
FLGEIGSGLWYLHFIKKL

SEQ ID NO: 3026234 - protein, 20 aa, Entamoeba invadens
FLHNYNYFPMAYPPFSAEDH

SEQ ID NO: 3026235 - protein, 20 aa, Entamoeba invadens
FLIAILIRNGFYIKIKRLYK

SEQ ID NO: 3026236 - protein, 17 aa, Entamoeba invadens
FLIEMFFTIYSKASKRN

SEQ ID NO: 3026237 - protein, 17 aa, Entamoeba invadens
FLIYLRALGQLFTMSIF

SEQ ID NO: 3026238 - protein, 25 aa, Entamoeba invadens
FLKKKFFRIIVWFNVDFETVDRNKS

SEQ ID NO: 3026239 - protein, 19 aa, Entamoeba invadens
FLLLLVKKLVERNKRIKII

SEQ ID NO: 3026240 - protein, 18 aa, Entamoeba invadens
FLLSLKQISSIFVCEYFF

SEQ ID NO: 3026241 - protein, 18 aa, Entamoeba invadens
FLLVIALNQILSSVSPRT

SEQ ID NO: 3026242 - protein, 18 aa, Entamoeba invadens
FLPEFFKFLREAFELVKE

SEQ ID NO: 3026243 - protein, 17 aa, Entamoeba invadens
FLPRRESYFWLLDALDM

SEQ ID NO: 3026244 - protein, 19 aa, Entamoeba invadens
FLQKKMMLVRWIESMVGVG

SEQ ID NO: 3026245 - protein, 18 aa, Entamoeba invadens
FLQLFRTKIFPPLTLYLH

SEQ ID NO: 3026246 - protein, 19 aa, Entamoeba invadens
FLRCLISSSHLLKMDPKTA

SEQ ID NO: 3026247 - protein, 18 aa, Entamoeba invadens
FLRCLISSSHLLKTDPKT

SEQ ID NO: 3026248 - protein, 19 aa, Entamoeba invadens
FLTLFDIQLVYRLNKMDDV

SEQ ID NO: 3026249 - protein, 22 aa, Entamoeba invadens
FLTYTYYFRRLLKNPNYYGYDG

SEQ ID NO: 3026250 - protein, 17 aa, Entamoeba invadens
FLVFQDLNLFLTQKYKN

SEQ ID NO: 3026251 - protein, 17 aa, Entamoeba invadens
FLVIFQFFPTLVNISIF

SEQ ID NO: 3026252 - protein, 20 aa, Entamoeba invadens
FLVLFIFQDFFPDLYERFLH

SEQ ID NO: 3026253 - protein, 17 aa, Entamoeba invadens
FLVLLSKMDELPPMYQA

SEQ ID NO: 3026254 - protein, 21 aa, Entamoeba invadens
FLVTIQMETLPWVVPRQVIQA

SEQ ID NO: 3026255 - protein, 25 aa, Entamoeba invadens
FLYPMTDCFIFLYKRIKIAPFKEIN

SEQ ID NO: 3026256 - protein, 17 aa, Entamoeba invadens
FMKLILPNNIHEIHENC

SEQ ID NO: 3026257 - protein, 17 aa, Entamoeba invadens
FMKWWRGSKKKSGTLKM

SEQ ID NO: 3026258 - protein, 19 aa, Entamoeba invadens
FMRALYQKALFLDKSKIKA

SEQ ID NO: 3026259 - protein, 19 aa, Entamoeba invadens
FMYMVRLNTFPFPKKVTAF

SEQ ID NO: 3026260 - protein, 22 aa, Entamoeba invadens
FNCDTFPEFWKFFIASAALHTS

SEQ ID NO: 3026261 - protein, 17 aa, Entamoeba invadens
FNGLALAIKIVLPKEVL

SEQ ID NO: 3026262 - protein, 22 aa, Entamoeba invadens
FNKAFIPLLKTLTSKSLINTSK

SEQ ID NO: 3026263 - protein, 23 aa, Entamoeba invadens
FNKERYFYLFNDMLIYGIGDEKY

SEQ ID NO: 3026264 - protein, 24 aa, Entamoeba invadens
FNLDKFHFNPIRLTKKTLKYFSHI

SEQ ID NO: 3026265 - protein, 19 aa, Entamoeba invadens
FNLTTLSDDKFRLVKDAVM

SEQ ID NO: 3026266 - protein, 19 aa, Entamoeba invadens
FNPIPLNFKTLGYLPNIET

SEQ ID NO: 3026267 - protein, 17 aa, Entamoeba invadens
FNQEMMNFFLSKYLPDY

SEQ ID NO: 3026268 - protein, 18 aa, Entamoeba invadens
FNSLALAIKIVMPKQIVL

SEQ ID NO: 3026269 - protein, 25 aa, Entamoeba invadens
FNSLKRFWFVQNRPMMFVATAGKES

SEQ ID NO: 3026270 - protein, 23 aa, Entamoeba invadens
FNTLPLCVLLRRKMGNFFLCHGG

SEQ ID NO: 3026271 - protein, 18 aa, Entamoeba invadens
FPDLDVLPLFLTKKKVLS

SEQ ID NO: 3026272 - protein, 24 aa, Entamoeba invadens
FPEIPFGIFFVFTRNFFGFHVRFR

SEQ ID NO: 3026273 - protein, 24 aa, Entamoeba invadens
FPEPPLLEIPQFPEFLLIDKQLFC

SEQ ID NO: 3026274 - protein, 26 aa, Entamoeba invadens
FPFHMEQLLFEYFNFGKVVLCNRPLM

SEQ ID NO: 3026275 - protein, 17 aa, Entamoeba invadens
FPFLLNSPDFEPESERQ

SEQ ID NO: 3026276 - protein, 18 aa, Entamoeba invadens
FPFSYCLCLGNDFIKKLS

SEQ ID NO: 3026277 - protein, 18 aa, Entamoeba invadens
FPFVLRIRSAYGMNQFSM

SEQ ID NO: 3026278 - protein, 25 aa, Entamoeba invadens
FPGVLGKLYSIKTLWLCYNYLSELN

SEQ ID NO: 3026279 - protein, 20 aa, Entamoeba invadens
FPKMIFLRKCDANMWSNQPI

SEQ ID NO: 3026280 - protein, 17 aa, Entamoeba invadens
FPKNFIFISEPGRYMAS

SEQ ID NO: 3026281 - protein, 28 aa, Entamoeba invadens
FPKTDPFMRYLIVFHILFGELQNLETVA

SEQ ID NO: 3026282 - protein, 17 aa, Entamoeba invadens
FPKVFAVYKLETQKRGR

SEQ ID NO: 3026283 - protein, 17 aa, Entamoeba invadens
FPLWKQTNSIMTEFLAD

SEQ ID NO: 3026284 - protein, 17 aa, Entamoeba invadens
FPNAKRLVLLLPGEENK

SEQ ID NO: 3026285 - protein, 23 aa, Entamoeba invadens
FPPQMQIYFGYRFLALHSPEEKR

SEQ ID NO: 3026286 - protein, 26 aa, Entamoeba invadens
FPRSGLLQFFLFPNRTLGLFNDDGEF

SEQ ID NO: 3026287 - protein, 18 aa, Entamoeba invadens
FPSDEAFPWCFDAATSIS

SEQ ID NO: 3026288 - protein, 23 aa, Entamoeba invadens
FPSFLRKHLSSLRSLWASLLMGE

SEQ ID NO: 3026289 - protein, 18 aa, Entamoeba invadens
FPSLQFIHPINNGFLCVC

SEQ ID NO: 3026290 - protein, 22 aa, Entamoeba invadens
FPTAFHIAGLWKIDRLVAEMKL

SEQ ID NO: 3026291 - protein, 23 aa, Entamoeba invadens
FPTAFHIAGLWKIDRLVAEMKTV

SEQ ID NO: 3026292 - protein, 20 aa, Entamoeba invadens
FPTFFPSFLITEVFGRSEWV

SEQ ID NO: 3026293 - protein, 17 aa, Entamoeba invadens
FPVLFSCYKDFTNDATS

SEQ ID NO: 3026294 - protein, 17 aa, Entamoeba invadens
FPVPQWLPLLFAIELSK

SEQ ID NO: 3026295 - protein, 18 aa, Entamoeba invadens
FPVTFLIRGFVLLVNESK

SEQ ID NO: 3026296 - protein, 20 aa, Entamoeba invadens
FQCIGLSDYTWRLLKPAPLP

SEQ ID NO: 3026297 - protein, 17 aa, Entamoeba invadens
FQDLFDQLKLKTKEMEK

SEQ ID NO: 3026298 - protein, 24 aa, Entamoeba invadens
FQDMTILMRIYLNALRPFCDYRSC

SEQ ID NO: 3026299 - protein, 20 aa, Entamoeba invadens
FQFAFRWINCFLLRELSPEQ

SEQ ID NO: 3026300 - protein, 20 aa, Entamoeba invadens
FQILTKLFISPLRTLALAHL

SEQ ID NO: 3026301 - protein, 22 aa, Entamoeba invadens
FQLNSPIRFAPIAMQLFVVNDV

SEQ ID NO: 3026302 - protein, 18 aa, Entamoeba invadens
FQQILKNVKLWFKSVVIP

SEQ ID NO: 3026303 - protein, 20 aa, Entamoeba invadens
FRCYKGVKIAPFIKFLKNIF

SEQ ID NO: 3026304 - protein, 18 aa, Entamoeba invadens
FRDIFLLMFRLFTTPECF

SEQ ID NO: 3026305 - protein, 19 aa, Entamoeba invadens
FRDLFQIVFGFVYDQIVMG

SEQ ID NO: 3026306 - protein, 18 aa, Entamoeba invadens
FRFDFKQIFGWYPDFFQF

SEQ ID NO: 3026307 - protein, 24 aa, Entamoeba invadens
FRHTTELLPLIKYPHKFSIFYSEM

SEQ ID NO: 3026308 - protein, 21 aa, Entamoeba invadens
FRKRRLLLLAEYLKDFTLSPE

SEQ ID NO: 3026309 - protein, 35 aa, Entamoeba invadens
FRLGSETWEWLFWMGFRDIFIWKKGSEYENFCEQQ

SEQ ID NO: 3026310 - protein, 20 aa, Entamoeba invadens
FRLLYTFLRKYKGKKMIVFM

SEQ ID NO: 3026311 - protein, 19 aa, Entamoeba invadens
FRNRHCILFTYDITKRETL

SEQ ID NO: 3026312 - protein, 23 aa, Entamoeba invadens
FRNTSVIFLVYLFDDLKTTECLD

SEQ ID NO: 3026313 - protein, 18 aa, Entamoeba invadens
FRQDLLIASLYRNFFLAQ

SEQ ID NO: 3026314 - protein, 25 aa, Entamoeba invadens
FRQTNWVNLIQFLETLRFDEYCAER

SEQ ID NO: 3026315 - protein, 25 aa, Entamoeba invadens
FRSIFEILLLKRWAQPALKALEISI

SEQ ID NO: 3026316 - protein, 18 aa, Entamoeba invadens
FRVFFYKIFHNYFDFFIR

SEQ ID NO: 3026317 - protein, 17 aa, Entamoeba invadens
FRVFGNGLLYKVTMENA

SEQ ID NO: 3026318 - protein, 17 aa, Entamoeba invadens
FRYCIFLQDIKLLGLKE

SEQ ID NO: 3026319 - protein, 18 aa, Entamoeba invadens
FSEIFTKLVPLGKASLVM

SEQ ID NO: 3026320 - protein, 24 aa, Entamoeba invadens
FSELFVMTVLKFIRLIQKSTPAYK

SEQ ID NO: 3026321 - protein, 25 aa, Entamoeba invadens
FSEQFMKSLPLLWKNIYRNNLGLCE

SEQ ID NO: 3026322 - protein, 17 aa, Entamoeba invadens
FSEYLRTNFRWIYNGKD

SEQ ID NO: 3026323 - protein, 31 aa, Entamoeba invadens
FSIADYQLYLPYLYILCYYLKIDVPKIKQHT

SEQ ID NO: 3026324 - protein, 21 aa, Entamoeba invadens
FSILPQFMYHLRRSHFLQVFN

SEQ ID NO: 3026325 - protein, 25 aa, Entamoeba invadens
FSKIPLIDLIHFLPLIMKSYLESSV

SEQ ID NO: 3026326 - protein, 17 aa, Entamoeba invadens
FSKTLRLLKNLFIPFDR

SEQ ID NO: 3026327 - protein, 19 aa, Entamoeba invadens
FSLLPIPTYPDDILQSLFT

SEQ ID NO: 3026328 - protein, 22 aa, Entamoeba invadens
FSLLRFTVIFAEQFFVTIDPKN

SEQ ID NO: 3026329 - protein, 19 aa, Entamoeba invadens
FSLPTFLPINLPSLFSHPI

SEQ ID NO: 3026330 - protein, 17 aa, Entamoeba invadens
FSNLMVLIYRYSDQDAT

SEQ ID NO: 3026331 - protein, 17 aa, Entamoeba invadens
FSRAYPPPPPPPPGGAV

SEQ ID NO: 3026332 - protein, 24 aa, Entamoeba invadens
FSRVMWCSLVFYPIDWREDKLFEC

SEQ ID NO: 3026333 - protein, 24 aa, Entamoeba invadens
FSSFRGFNFFGLKEGITSPNSIFV

SEQ ID NO: 3026334 - protein, 27 aa, Entamoeba invadens
FTEISNIPLILYFISSDLYTQFLTYKS

SEQ ID NO: 3026335 - protein, 21 aa, Entamoeba invadens
FTELIFMFYVKWDVSDKYWEL

SEQ ID NO: 3026336 - protein, 26 aa, Entamoeba invadens
FTELKRYTLLLTNLPHKRLRDVAARV

SEQ ID NO: 3026337 - protein, 19 aa, Entamoeba invadens
FTGFLLDKSFVGMTAPATI

SEQ ID NO: 3026338 - protein, 22 aa, Entamoeba invadens
FTLFGAAWCFRPAERMIKSLKI

SEQ ID NO: 3026339 - protein, 24 aa, Entamoeba invadens
FTLNIMTWFKFLWISTDKMDISSN

SEQ ID NO: 3026340 - protein, 21 aa, Entamoeba invadens
FTMFSAFWLKSDGKLAFHAMW

SEQ ID NO: 3026341 - protein, 28 aa, Entamoeba invadens
FTPKRIYPYIFYIIITDCLFNISRQLNI

SEQ ID NO: 3026342 - protein, 28 aa, Entamoeba invadens
FTQNIKMFLLLLLFTFSQADFDLTKTDF

SEQ ID NO: 3026343 - protein, 24 aa, Entamoeba invadens
FTRLQTTFLKEKFPRMGDALVSFG

SEQ ID NO: 3026344 - protein, 23 aa, Entamoeba invadens
FVAIFNGTLCTPLFTLTAHTLPV

SEQ ID NO: 3026345 - protein, 17 aa, Entamoeba invadens
FVALQFVWEMIRKYEDM

SEQ ID NO: 3026346 - protein, 17 aa, Entamoeba invadens
FVALYNWVKLCFATFNR

SEQ ID NO: 3026347 - protein, 20 aa, Entamoeba invadens
FVDILNRYICLFKYGQTDLK

SEQ ID NO: 3026348 - protein, 17 aa, Entamoeba invadens
FVDLIKPTTLKKVETPK

SEQ ID NO: 3026349 - protein, 17 aa, Entamoeba invadens
FVDSLLIWIKNSGTRRG

SEQ ID NO: 3026350 - protein, 27 aa, Entamoeba invadens
FVFTFSTLLMYFYMKSIRTVLRRTVLL

SEQ ID NO: 3026351 - protein, 18 aa, Entamoeba invadens
FVFYQLLELGCLVTSKTL

SEQ ID NO: 3026352 - protein, 18 aa, Entamoeba invadens
FVIAFLKMRYSNMKIVWR

SEQ ID NO: 3026353 - protein, 17 aa, Entamoeba invadens
FVIALLYEQNVFGVVVT

SEQ ID NO: 3026354 - protein, 17 aa, Entamoeba invadens
FVIERYIVALDYLFRRT

SEQ ID NO: 3026355 - protein, 18 aa, Entamoeba invadens
FVIHILWQRVLQKVVLKD

SEQ ID NO: 3026356 - protein, 17 aa, Entamoeba invadens
FVILANPTYLPIVGNNQ

SEQ ID NO: 3026357 - protein, 23 aa, Entamoeba invadens
FVKGMFSFLSLMGRTPLIVNLDP

SEQ ID NO: 3026358 - protein, 17 aa, Entamoeba invadens
FVLALPKSPRINPPEEN

SEQ ID NO: 3026359 - protein, 17 aa, Entamoeba invadens
FVLIFSITSRKSFEQIP

SEQ ID NO: 3026360 - protein, 18 aa, Entamoeba invadens
FVLMFMNPTQPLENWMVK

SEQ ID NO: 3026361 - protein, 17 aa, Entamoeba invadens
FVLPPLKKKRSVLVSSD

SEQ ID NO: 3026362 - protein, 22 aa, Entamoeba invadens
FVNNFCYIKRIIGLPYERIRYP

SEQ ID NO: 3026363 - protein, 18 aa, Entamoeba invadens
FVPFFRVIVLHRALSSSG

SEQ ID NO: 3026364 - protein, 17 aa, Entamoeba invadens
FVRINQIVIVLSGLTPY

SEQ ID NO: 3026365 - protein, 18 aa, Entamoeba invadens
FVRMFFTKFFKIMREGEV

SEQ ID NO: 3026366 - protein, 18 aa, Entamoeba invadens
FVTPKVFWRTFLDDTDKG

SEQ ID NO: 3026367 - protein, 17 aa, Entamoeba invadens
FVVCFSLIDPKSFLNVV

SEQ ID NO: 3026368 - protein, 18 aa, Entamoeba invadens
FVVDHWYFFQNLEQFRAP

SEQ ID NO: 3026369 - protein, 18 aa, Entamoeba invadens
FVVYWMRDIYKFKSIGVR

SEQ ID NO: 3026370 - protein, 17 aa, Entamoeba invadens
FVYQLILANDVRAAIHL

SEQ ID NO: 3026371 - protein, 19 aa, Entamoeba invadens
FWERYIVFYVNSTLWNSVF

SEQ ID NO: 3026372 - protein, 30 aa, Entamoeba invadens
FWGPMWRVWVFLLRGIIPILERWLGNLLAR

SEQ ID NO: 3026373 - protein, 20 aa, Entamoeba invadens
FWHFHVHFCSIYSPLFKSAN

SEQ ID NO: 3026374 - protein, 19 aa, Entamoeba invadens
FYEALIWNEIYPKNLFQYP

SEQ ID NO: 3026375 - protein, 17 aa, Entamoeba invadens
FYERAFKHSIPGILSVI

SEQ ID NO: 3026376 - protein, 17 aa, Entamoeba invadens
FYESAFTVSLLYSSKSG

SEQ ID NO: 3026377 - protein, 25 aa, Entamoeba invadens
FYESSPYHRAILSLLFDPIVHYSPL

SEQ ID NO: 3026378 - protein, 22 aa, Entamoeba invadens
FYFHSIFLFHHIPEFVNTIIES

SEQ ID NO: 3026379 - protein, 18 aa, Entamoeba invadens
FYFLIFETNILFINCIKP

SEQ ID NO: 3026380 - protein, 17 aa, Entamoeba invadens
FYFWIASCPILPSSEKI

SEQ ID NO: 3026381 - protein, 17 aa, Entamoeba invadens
FYIHHFFKKFLLKLKNK

SEQ ID NO: 3026382 - protein, 26 aa, Entamoeba invadens
FYKTRFDFFLTWLFCRLYFINFCVTE

SEQ ID NO: 3026383 - protein, 17 aa, Entamoeba invadens
FYQQYFNSLLKKPVPFV

SEQ ID NO: 3026384 - protein, 17 aa, Entamoeba invadens
FYQVVFWFIVDFGITQL

SEQ ID NO: 3026385 - protein, 19 aa, Entamoeba invadens
FYRGYKFVISLKVSGVALG

SEQ ID NO: 3026386 - protein, 17 aa, Entamoeba invadens
FYRIIVWFNVDFETINR

SEQ ID NO: 3026387 - protein, 17 aa, Entamoeba invadens
FYRIIVWFNVDFETVDI

SEQ ID NO: 3026388 - protein, 18 aa, Entamoeba invadens
FYRIIVWYCVDFETVNRN

SEQ ID NO: 3026389 - protein, 19 aa, Entamoeba invadens
FYRRIIWYPTAYLNISNLT

SEQ ID NO: 3026390 - protein, 18 aa, Entamoeba invadens
FYYDALYLVADFAALLCI

SEQ ID NO: 3026391 - protein, 17 aa, Entamoeba invadens
GAEPLSVPYFRTLMRAT

SEQ ID NO: 3026392 - protein, 26 aa, Entamoeba invadens
GAHIRTLLLTFFYRQMPDLVERGHIY

SEQ ID NO: 3026393 - protein, 24 aa, Entamoeba invadens
GALDFPEFLKLMTALDAMPDNSDK

SEQ ID NO: 3026394 - protein, 19 aa, Entamoeba invadens
GAVTYFIRSFTGCPYYSVP

SEQ ID NO: 3026395 - protein, 22 aa, Entamoeba invadens
GCAQLAFYLKALAANSSVVLRE

SEQ ID NO: 3026396 - protein, 18 aa, Entamoeba invadens
GCFITFKKYADGPFAIFL

SEQ ID NO: 3026397 - protein, 27 aa, Entamoeba invadens
GCGCGYTLLLLFQAGYTRLYGVDYCEG

SEQ ID NO: 3026398 - protein, 17 aa, Entamoeba invadens
GCLVCKVGYYKKGADCV

SEQ ID NO: 3026399 - protein, 18 aa, Entamoeba invadens
GCLVCKVGYYKKGADCVL

SEQ ID NO: 3026400 - protein, 25 aa, Entamoeba invadens
GCQCWDWYFPYLYAPFIADVATYLD

SEQ ID NO: 3026401 - protein, 18 aa, Entamoeba invadens
GCVSLKEIVLPNSLCIIK

SEQ ID NO: 3026402 - protein, 23 aa, Entamoeba invadens
GDAKHFIFTLLNSKFEKKRFDLK

SEQ ID NO: 3026403 - protein, 21 aa, Entamoeba invadens
GDEYFIPRLTFIKALSPSTFI

SEQ ID NO: 3026404 - protein, 23 aa, Entamoeba invadens
GDFKFTPPQHLVWSYVVRDVNNH

SEQ ID NO: 3026405 - protein, 28 aa, Entamoeba invadens
GDGYWGDDGFYYVYDYETKRYYQGEPPE

SEQ ID NO: 3026406 - protein, 24 aa, Entamoeba invadens
GDLFETFIRPYFGDAFRPVKKGDH

SEQ ID NO: 3026407 - protein, 17 aa, Entamoeba invadens
GDRFVFLLCTRAGGIGI

SEQ ID NO: 3026408 - protein, 22 aa, Entamoeba invadens
GDSIPRHPLFAEGIWQLVNSCC

SEQ ID NO: 3026409 - protein, 22 aa, Entamoeba invadens
GDTLLHMLIILGYTNLVEMVIA

SEQ ID NO: 3026410 - protein, 24 aa, Entamoeba invadens
GDTNIFDLLFRLGDPKFYCSDCLK

SEQ ID NO: 3026411 - protein, 22 aa, Entamoeba invadens
GDVYRQLLFLDYLNGVSIDFQQ

SEQ ID NO: 3026412 - protein, 24 aa, Entamoeba invadens
GEEDGWVFCKIGTRFGFVPKKYIE

SEQ ID NO: 3026413 - protein, 24 aa, Entamoeba invadens
GEENKLFQVGTPFPFHDWCVIENQ

SEQ ID NO: 3026414 - protein, 29 aa, Entamoeba invadens
GEFKPTITLLFYIMYRYRLNDVPVRIIDF

SEQ ID NO: 3026415 - protein, 24 aa, Entamoeba invadens
GEGKDTMLFVLRKNTRKDLSCEQI

SEQ ID NO: 3026416 - protein, 24 aa, Entamoeba invadens
GEIKFLLGLLFQVFMMFHKSDLLA

SEQ ID NO: 3026417 - protein, 20 aa, Entamoeba invadens
GELCFADFYKLLTILNHMPD

SEQ ID NO: 3026418 - protein, 18 aa, Entamoeba invadens
GENFFFVEPLLSGEFLKF

SEQ ID NO: 3026419 - protein, 17 aa, Entamoeba invadens
GEPADCILFYSYRDKFV

SEQ ID NO: 3026420 - protein, 18 aa, Entamoeba invadens
GEPLLLFYNGIIVSDKPS

SEQ ID NO: 3026421 - protein, 17 aa, Entamoeba invadens
GEVRILYPIVPYKVVEN

SEQ ID NO: 3026422 - protein, 25 aa, Entamoeba invadens
GFAQSYLRLLSFYLPMDSVGFAPNS

SEQ ID NO: 3026423 - protein, 18 aa, Entamoeba invadens
GFEHNFKPFLALMTQLQK

SEQ ID NO: 3026424 - protein, 25 aa, Entamoeba invadens
GFESLFEFLKLKPLVFLALQPIVGD

SEQ ID NO: 3026425 - protein, 17 aa, Entamoeba invadens
GFFPKVFAVYKLETQKR

SEQ ID NO: 3026426 - protein, 20 aa, Entamoeba invadens
GFFSGLYQMIFHPIDFFTPE

SEQ ID NO: 3026427 - protein, 23 aa, Entamoeba invadens
GFIELLQKYYCSIALLLSTQTAN

SEQ ID NO: 3026428 - protein, 19 aa, Entamoeba invadens
GFIFKYLMFFLTKVVEKSD

SEQ ID NO: 3026429 - protein, 20 aa, Entamoeba invadens
GFIPIKEMFYTLSLAGDLFD

SEQ ID NO: 3026430 - protein, 19 aa, Entamoeba invadens
GFIRVLFMFEIPFVNVLVL

SEQ ID NO: 3026431 - protein, 17 aa, Entamoeba invadens
GFKKLPYKAFYGAKDLT

SEQ ID NO: 3026432 - protein, 20 aa, Entamoeba invadens
GFLKFPLIVLYPQDDQSDCL

SEQ ID NO: 3026433 - protein, 21 aa, Entamoeba invadens
GFLLLYTLQLLDKVLFPENDN

SEQ ID NO: 3026434 - protein, 20 aa, Entamoeba invadens
GFPDYISIFALKKFNWDINE

SEQ ID NO: 3026435 - protein, 23 aa, Entamoeba invadens
GFVFSCIGAFWIMQDWKLYIQQN

SEQ ID NO: 3026436 - protein, 18 aa, Entamoeba invadens
GFVWKKIIYMLFMEKNLM

SEQ ID NO: 3026437 - protein, 27 aa, Entamoeba invadens
GGFTFIYQWLLLLFKREFDSKTVFRIW

SEQ ID NO: 3026438 - protein, 25 aa, Entamoeba invadens
GGQKNVLLLIFSKKGYLFGSFHSSV

SEQ ID NO: 3026439 - protein, 17 aa, Entamoeba invadens
GGTLLYSPAITVPINCT

SEQ ID NO: 3026440 - protein, 20 aa, Entamoeba invadens
GGWFSSWWKSESDELNMMKK

SEQ ID NO: 3026441 - protein, 20 aa, Entamoeba invadens
GHFYWYKLDDKWLIDNVDIY

SEQ ID NO: 3026442 - protein, 18 aa, Entamoeba invadens
GHLNDLLKFFFFVEQEDV

SEQ ID NO: 3026443 - protein, 24 aa, Entamoeba invadens
GHLNLRGFFPSHFIVKIIRQLLDD

SEQ ID NO: 3026444 - protein, 24 aa, Entamoeba invadens
GHYDYPFIIQLPQGIPSSLCFQDR

SEQ ID NO: 3026445 - protein, 20 aa, Entamoeba invadens
GIAKMVFPLQRIKLLLCNQH

SEQ ID NO: 3026446 - protein, 19 aa, Entamoeba invadens
GICYEITPIIYALKNKKIT

SEQ ID NO: 3026447 - protein, 23 aa, Entamoeba invadens
GIDLQFHPILPWIYSVGADGTMQ

SEQ ID NO: 3026448 - protein, 22 aa, Entamoeba invadens
GIDYVWMMGVWQLGNYGLEIDK

SEQ ID NO: 3026449 - protein, 24 aa, Entamoeba invadens
GIFETTLRFNFWDKITFKFEVEII

SEQ ID NO: 3026450 - protein, 20 aa, Entamoeba invadens
GIIITLWSYPVSVDCKVQLS

SEQ ID NO: 3026451 - protein, 18 aa, Entamoeba invadens
GIPCFWGRLFVIEKLSED

SEQ ID NO: 3026452 - protein, 21 aa, Entamoeba invadens
GIPIDFLFGRRDHPPLPEVAT

SEQ ID NO: 3026453 - protein, 25 aa, Entamoeba invadens
GIPMDLLDRLLIIPTKPYDSTQLYK

SEQ ID NO: 3026454 - protein, 17 aa, Entamoeba invadens
GIRLVVPILGKENIIIT

SEQ ID NO: 3026455 - protein, 18 aa, Entamoeba invadens
GIRNFRFVNNLYGVVNRL

SEQ ID NO: 3026456 - protein, 26 aa, Entamoeba invadens
GISREPILVALFYNYGLSLLNNMTRR

SEQ ID NO: 3026457 - protein, 22 aa, Entamoeba invadens
GITFRPFPLRGFVEIVFCAVDS

SEQ ID NO: 3026458 - protein, 24 aa, Entamoeba invadens
GITKLMLTEIPYFRTILLAHFSCP

SEQ ID NO: 3026459 - protein, 23 aa, Entamoeba invadens
GITMWELFYMKFPFFEHPEIVTT

SEQ ID NO: 3026460 - protein, 22 aa, Entamoeba invadens
GIYDHALLVLPEFFKSFLEGDT

SEQ ID NO: 3026461 - protein, 18 aa, Entamoeba invadens
GIYPTLTLLFYLFQETEK

SEQ ID NO: 3026462 - protein, 18 aa, Entamoeba invadens
GKEKHYFFMNYKPILIRN

SEQ ID NO: 3026463 - protein, 23 aa, Entamoeba invadens
GKEKLIFLFVSKTGEIFGFYQND

SEQ ID NO: 3026464 - protein, 19 aa, Entamoeba invadens
GKEMLKMLFLLKGMLLNIK

SEQ ID NO: 3026465 - protein, 21 aa, Entamoeba invadens
GKFIRLFTQKGIIKLNIQKVL

SEQ ID NO: 3026466 - protein, 17 aa, Entamoeba invadens
GKINKSFDLMFGKRAFV

SEQ ID NO: 3026467 - protein, 23 aa, Entamoeba invadens
GKKDIAELILLIVKFRVPRNNIS

SEQ ID NO: 3026468 - protein, 25 aa, Entamoeba invadens
GKKNYLPPAPLVFGLGIVFAVEKTE

SEQ ID NO: 3026469 - protein, 23 aa, Entamoeba invadens
GKRDKYFSMLLPFVLFMLDDSDK

SEQ ID NO: 3026470 - protein, 23 aa, Entamoeba invadens
GKTKIFFRLVFLLKLKKLERTES

SEQ ID NO: 3026471 - protein, 26 aa, Entamoeba invadens
GKTKRRFFYLFQFSRELVYYKTQQIR

SEQ ID NO: 3026472 - protein, 19 aa, Entamoeba invadens
GKWKIPLPMYRAIQYLLMS

SEQ ID NO: 3026473 - protein, 23 aa, Entamoeba invadens
GKYDYPFVFQLPQGLPSSQFFTG

SEQ ID NO: 3026474 - protein, 19 aa, Entamoeba invadens
GLCYFDCSQGWFGNYRTLY

SEQ ID NO: 3026475 - protein, 22 aa, Entamoeba invadens
GLDYFMMQIITLQLNLFSFSKE

SEQ ID NO: 3026476 - protein, 23 aa, Entamoeba invadens
GLEKSMFERLLLNKVPYVLLNTQ

SEQ ID NO: 3026477 - protein, 19 aa, Entamoeba invadens
GLENFKKFGLLHFLVFYYD

SEQ ID NO: 3026478 - protein, 30 aa, Entamoeba invadens
GLFCVVINPYQFFPIYTPFMINKYTGRRKE

SEQ ID NO: 3026479 - protein, 21 aa, Entamoeba invadens
GLFFTRPFNTLRLKFYCTELT

SEQ ID NO: 3026480 - protein, 18 aa, Entamoeba invadens
GLFKNFFAKHQGVKIEKE

SEQ ID NO: 3026481 - protein, 25 aa, Entamoeba invadens
GLGLPYPHWLLTFGRDYFASNLTQR

SEQ ID NO: 3026482 - protein, 20 aa, Entamoeba invadens
GLLFYLIFPVQHPARYNLLL

SEQ ID NO: 3026483 - protein, 18 aa, Entamoeba invadens
GLLIPPINFFIPDEPIFP

SEQ ID NO: 3026484 - protein, 18 aa, Entamoeba invadens
GLLLQRSLYLLQCLYNKP

SEQ ID NO: 3026485 - protein, 28 aa, Entamoeba invadens
GLVLFNQYWYWYPFTLALSLSFAPTTII

SEQ ID NO: 3026486 - protein, 18 aa, Entamoeba invadens
GMIPLAVLQIFKTIRDLE

SEQ ID NO: 3026487 - protein, 17 aa, Entamoeba invadens
GMLPPPGLAPPGGMLPP

SEQ ID NO: 3026488 - protein, 18 aa, Entamoeba invadens
GMNAKFYQEFYGFDTTVL

SEQ ID NO: 3026489 - protein, 20 aa, Entamoeba invadens
GMYKIRIWRKPNVRLFGPLM

SEQ ID NO: 3026490 - protein, 22 aa, Entamoeba invadens
GNEKLIFLFVSKTGEIFGFYQN

SEQ ID NO: 3026491 - protein, 24 aa, Entamoeba invadens
GNHYMAINFMPQFKGKSIIEIRYE

SEQ ID NO: 3026492 - protein, 24 aa, Entamoeba invadens
GNKFCEFIKFQLNFPNPGCFPENI

SEQ ID NO: 3026493 - protein, 36 aa, Entamoeba invadens
GNKKSTLALIFQLILRYRLFNIKFKMTDFSHWIYSL

SEQ ID NO: 3026494 - protein, 24 aa, Entamoeba invadens
GNKLDAFNLWLCSIPLAVNLVDEE

SEQ ID NO: 3026495 - protein, 23 aa, Entamoeba invadens
GNKNRFFYLFTDVMIYGVGNQHI

SEQ ID NO: 3026496 - protein, 30 aa, Entamoeba invadens
GNRFCLPLCIMFPFDYPLTPPLFFTDPTAE

SEQ ID NO: 3026497 - protein, 18 aa, Entamoeba invadens
GNRKLVKLLLHQGAVYTK

SEQ ID NO: 3026498 - protein, 24 aa, Entamoeba invadens
GPEIKFLLRILKGVFRIGFSERSL

SEQ ID NO: 3026499 - protein, 23 aa, Entamoeba invadens
GPLNLEQFLLLSGTLKSVVAMIK

SEQ ID NO: 3026500 - protein, 24 aa, Entamoeba invadens
GQEKYNCLFPLLYKNSSIVIIVYD

SEQ ID NO: 3026501 - protein, 31 aa, Entamoeba invadens
GQKSLLALSLILAILVYKPSPLYILDEVDAA

SEQ ID NO: 3026502 - protein, 23 aa, Entamoeba invadens
GQNPPLFLYFATILEGGSLNALE

SEQ ID NO: 3026503 - protein, 18 aa, Entamoeba invadens
GQTVGQYLRSTFGKAMNQ

SEQ ID NO: 3026504 - protein, 25 aa, Entamoeba invadens
GREATLIHIFQFSKVFLTCPGVLEN

SEQ ID NO: 3026505 - protein, 19 aa, Entamoeba invadens
GRKILRICPLKLNYDIGCI

SEQ ID NO: 3026506 - protein, 24 aa, Entamoeba invadens
GRVLLSFWYIYKKCGNYSMFDIQY

SEQ ID NO: 3026507 - protein, 19 aa, Entamoeba invadens
GRYLLTQVYLFILKSKCYD

SEQ ID NO: 3026508 - protein, 23 aa, Entamoeba invadens
GSAKSIIVFWALKVIVTLLNPKV

SEQ ID NO: 3026509 - protein, 22 aa, Entamoeba invadens
GSCALMCIIDKFGDKRTIYMSN

SEQ ID NO: 3026510 - protein, 20 aa, Entamoeba invadens
GSDDFLGNCFWYVPQMRTSE

SEQ ID NO: 3026511 - protein, 23 aa, Entamoeba invadens
GSDFLVRNVLLQRIRGVLQSDED

SEQ ID NO: 3026512 - protein, 24 aa, Entamoeba invadens
GSEQLQLPFLLNSPDFEPDSEREA

SEQ ID NO: 3026513 - protein, 24 aa, Entamoeba invadens
GSGLWYLHFIKKLIHRDLKPANLL

SEQ ID NO: 3026514 - protein, 30 aa, Entamoeba invadens
GSHIKGLLINYFNVFWPSLLKIKNFLVEFI

SEQ ID NO: 3026515 - protein, 22 aa, Entamoeba invadens
GSLFIYLFRLMLATGIPELQKE

SEQ ID NO: 3026516 - protein, 22 aa, Entamoeba invadens
GSLFIYLFRLMLATGIPELQSE

SEQ ID NO: 3026517 - protein, 21 aa, Entamoeba invadens
GSLFIYLFRLMLATGIPELRS

SEQ ID NO: 3026518 - protein, 25 aa, Entamoeba invadens
GSLFTQLFLILFPSISPSFFNNIER

SEQ ID NO: 3026519 - protein, 17 aa, Entamoeba invadens
GSLGLQFPSLSGSTLGS

SEQ ID NO: 3026520 - protein, 19 aa, Entamoeba invadens
GSLLFEKFIPYFTKDQINA

SEQ ID NO: 3026521 - protein, 22 aa, Entamoeba invadens
GSVVMELPYIPPIKGTDIFLGT

SEQ ID NO: 3026522 - protein, 19 aa, Entamoeba invadens
GTGFRIPAFPKLLPCMHLI

SEQ ID NO: 3026523 - protein, 21 aa, Entamoeba invadens
GTLVTPLYLPALFKEMCFDET

SEQ ID NO: 3026524 - protein, 23 aa, Entamoeba invadens
GTPIYIYIYIYIYMAPEVLNKQH

SEQ ID NO: 3026525 - protein, 28 aa, Entamoeba invadens
GTTFKMFTPFFKVYFLYISHYNSTVEIL

SEQ ID NO: 3026526 - protein, 26 aa, Entamoeba invadens
GVDKKFLKYLAIAAPVKGLTAEVYDK

SEQ ID NO: 3026527 - protein, 23 aa, Entamoeba invadens
GVDKWYVQLKLWEKKTFIKKNMV

SEQ ID NO: 3026528 - protein, 24 aa, Entamoeba invadens
GVEFTIFFCMWWDMFYIKSLDESY

SEQ ID NO: 3026529 - protein, 24 aa, Entamoeba invadens
GVEHELCYGCLPLEFLKKEEYLNL

SEQ ID NO: 3026530 - protein, 23 aa, Entamoeba invadens
GVHNIWYGLLPKKYEVPSTVVAI

SEQ ID NO: 3026531 - protein, 17 aa, Entamoeba invadens
GVIVYWKLLNSFFYIEH

SEQ ID NO: 3026532 - protein, 17 aa, Entamoeba invadens
GVKWDIDILPLISSYYP

SEQ ID NO: 3026533 - protein, 19 aa, Entamoeba invadens
GVLRCLLLYNYSFLFAFET

SEQ ID NO: 3026534 - protein, 19 aa, Entamoeba invadens
GVQIIQLFKFLPGKDMFEQ

SEQ ID NO: 3026535 - protein, 17 aa, Entamoeba invadens
GVSFLYAGWDKYFGYQL

SEQ ID NO: 3026536 - protein, 19 aa, Entamoeba invadens
GVSSLLIIALLKNEILQLN

SEQ ID NO: 3026537 - protein, 30 aa, Entamoeba invadens
GVTSFKKISMINFLIFHFGYDWKEVVEAPQ

SEQ ID NO: 3026538 - protein, 20 aa, Entamoeba invadens
GVVPFLKLLPMKIRIIQLVK

SEQ ID NO: 3026539 - protein, 18 aa, Entamoeba invadens
GWCQGKVKLLFLSDERKI

SEQ ID NO: 3026540 - protein, 17 aa, Entamoeba invadens
GWFQAYPLDIFKFPSKI

SEQ ID NO: 3026541 - protein, 17 aa, Entamoeba invadens
GWNWIPGISWYFYRGFL

SEQ ID NO: 3026542 - protein, 19 aa, Entamoeba invadens
GWQILVFPLLEKFTSIKAE

SEQ ID NO: 3026543 - protein, 25 aa, Entamoeba invadens
GYDQNWWFEAYLKTLTFLLLQNDTD

SEQ ID NO: 3026544 - protein, 23 aa, Entamoeba invadens
GYDYLLSMKIWTLTYERAKKLME

SEQ ID NO: 3026545 - protein, 23 aa, Entamoeba invadens
GYGSYLILTLVLEGPAVSTFSFG

SEQ ID NO: 3026546 - protein, 19 aa, Entamoeba invadens
GYKIFLTTFLLVLYSYNPD

SEQ ID NO: 3026547 - protein, 19 aa, Entamoeba invadens
GYLFVFPSRVWDYFKEKMR

SEQ ID NO: 3026548 - protein, 27 aa, Entamoeba invadens
GYPNRIIYNEFLKRYFFLGTNINKKTS

SEQ ID NO: 3026549 - protein, 17 aa, Entamoeba invadens
GYSFGVFSKKPLPKAPK

SEQ ID NO: 3026550 - protein, 25 aa, Entamoeba invadens
GYSKFFEDFVFLSFKKFAVVISKDL

SEQ ID NO: 3026551 - protein, 18 aa, Entamoeba invadens
GYVRFYMTTLPYFTTQKT

SEQ ID NO: 3026552 - protein, 19 aa, Entamoeba invadens
GYVRFYMTTLPYFTTQKTV

SEQ ID NO: 3026553 - protein, 20 aa, Entamoeba invadens
GYYIQAGLNWFFTGASQLQY

SEQ ID NO: 3026554 - protein, 25 aa, Entamoeba invadens
HADLSEYNLLWWKGLVYVIDVGQAI

SEQ ID NO: 3026555 - protein, 18 aa, Entamoeba invadens
HCNYFLLKKKKKDAKNAL

SEQ ID NO: 3026556 - protein, 22 aa, Entamoeba invadens
HDDTHIIFLAISLLYSHTGLQK

SEQ ID NO: 3026557 - protein, 21 aa, Entamoeba invadens
HDLLIGILKYGFGGGVLMEED

SEQ ID NO: 3026558 - protein, 33 aa, Entamoeba invadens
HDLRSLLIMPIQRIPRYVLLLKELKKNTTQEHP

SEQ ID NO: 3026559 - protein, 18 aa, Entamoeba invadens
HDMYGFYIGLNAPQVKYF

SEQ ID NO: 3026560 - protein, 27 aa, Entamoeba invadens
HDVTKALLYLVLIFQLTIFTDQQADYQ

SEQ ID NO: 3026561 - protein, 27 aa, Entamoeba invadens
HEDPITDVFFLYEILVMMSIKFSNSVT

SEQ ID NO: 3026562 - protein, 23 aa, Entamoeba invadens
HEEPKVCFLFKNIFVVCKVKNYQ

SEQ ID NO: 3026563 - protein, 25 aa, Entamoeba invadens
HFARSFHFLFPVKPFVLEKEPEVCF

SEQ ID NO: 3026564 - protein, 19 aa, Entamoeba invadens
HFDIWLRRNLTSIPYVHVD

SEQ ID NO: 3026565 - protein, 19 aa, Entamoeba invadens
HFGFLIRLFGKFYKKKTLF

SEQ ID NO: 3026566 - protein, 19 aa, Entamoeba invadens
HFIFSLCNPAHTEPKAFYL

SEQ ID NO: 3026567 - protein, 20 aa, Entamoeba invadens
HFIFSLDSKGLFPAPTRWNS

SEQ ID NO: 3026568 - protein, 18 aa, Entamoeba invadens
HFIPYPLVEKLFDFVYKK

SEQ ID NO: 3026569 - protein, 23 aa, Entamoeba invadens
HFKQLFKILELLGYSWAKNCYHI

SEQ ID NO: 3026570 - protein, 22 aa, Entamoeba invadens
HFNILNYLALKCFLLSGFKSKR

SEQ ID NO: 3026571 - protein, 18 aa, Entamoeba invadens
HFQIVMKYFLYKQDYINS

SEQ ID NO: 3026572 - protein, 18 aa, Entamoeba invadens
HFQSYEPLFFIYTKSNKE

SEQ ID NO: 3026573 - protein, 17 aa, Entamoeba invadens
HFRFLMRYAEEPCNSLK

SEQ ID NO: 3026574 - protein, 18 aa, Entamoeba invadens
HFYWYKLDDKWLIDNVDI

SEQ ID NO: 3026575 - protein, 19 aa, Entamoeba invadens
HFYWYKLDDKWLIDNVDIY

SEQ ID NO: 3026576 - protein, 19 aa, Entamoeba invadens
HFYWYKLNDKWLIDNVDIY

SEQ ID NO: 3026577 - protein, 18 aa, Entamoeba invadens
HGCGKTCLLTLYSSSEFP

SEQ ID NO: 3026578 - protein, 22 aa, Entamoeba invadens
HGLDLLLFLLKRQQLKVETNLM

SEQ ID NO: 3026579 - protein, 25 aa, Entamoeba invadens
HICGLKNVLFLIFIPNEHPLGFYSK

SEQ ID NO: 3026580 - protein, 17 aa, Entamoeba invadens
HILIAQFPNLFEFNEQF

SEQ ID NO: 3026581 - protein, 17 aa, Entamoeba invadens
HILYFQQKPPDPRLPKP

SEQ ID NO: 3026582 - protein, 18 aa, Entamoeba invadens
HINIMMPYGKPPIKMLDI

SEQ ID NO: 3026583 - protein, 18 aa, Entamoeba invadens
HIPKEYCEFGPNAKKCKK

SEQ ID NO: 3026584 - protein, 22 aa, Entamoeba invadens
HITPLINCLPVFKLNFSENEIV

SEQ ID NO: 3026585 - protein, 22 aa, Entamoeba invadens
HKEFRIFMIMGYYTETLNQITF

SEQ ID NO: 3026586 - protein, 22 aa, Entamoeba invadens
HKELWAYSIFFFSSIAKKCMTY

SEQ ID NO: 3026587 - protein, 25 aa, Entamoeba invadens
HKGKWYMYVYGVIDLLLGKSTVPAQ

SEQ ID NO: 3026588 - protein, 23 aa, Entamoeba invadens
HKIFYVFELLVNRLGFIHRLIDD

SEQ ID NO: 3026589 - protein, 22 aa, Entamoeba invadens
HKRVMFALGTVLYCVANKGGVK

SEQ ID NO: 3026590 - protein, 18 aa, Entamoeba invadens
HLFISEMMIYLLLGQLRI

SEQ ID NO: 3026591 - protein, 23 aa, Entamoeba invadens
HLKPLQCVGGFLILRLICPAIMQ

SEQ ID NO: 3026592 - protein, 25 aa, Entamoeba invadens
HLKTENMMFLYLMRWAKYVGKNGES

SEQ ID NO: 3026593 - protein, 21 aa, Entamoeba invadens
HLLFTQFIRLLSNIPIENIFE

SEQ ID NO: 3026594 - protein, 20 aa, Entamoeba invadens
HLLSVLCILLSSLNYRVLVC

SEQ ID NO: 3026595 - protein, 23 aa, Entamoeba invadens
HLPESLFALCRNLYIIENLDDVE

SEQ ID NO: 3026596 - protein, 18 aa, Entamoeba invadens
HLTTFESIFLITCVKFSP

SEQ ID NO: 3026597 - protein, 18 aa, Entamoeba invadens
HLVEVLLSYVFPVFADNA

SEQ ID NO: 3026598 - protein, 22 aa, Entamoeba invadens
HLVPMYYDYFTNTIYPINFINS

SEQ ID NO: 3026599 - protein, 17 aa, Entamoeba invadens
HLYVKFFVKVRTAMAQV

SEQ ID NO: 3026600 - protein, 19 aa, Entamoeba invadens
HMVPFLWMQVTFSCDGCIG

SEQ ID NO: 3026601 - protein, 19 aa, Entamoeba invadens
HMWFGDLVTMKWWDDIWLN

SEQ ID NO: 3026602 - protein, 25 aa, Entamoeba invadens
HMWFGDLVTMKWWNDLWLNEGFASY

SEQ ID NO: 3026603 - protein, 19 aa, Entamoeba invadens
HNDNIIFYFRFVPENVIRK

SEQ ID NO: 3026604 - protein, 22 aa, Entamoeba invadens
HNFDTVLCIMLLFGTSAIHRLK

SEQ ID NO: 3026605 - protein, 23 aa, Entamoeba invadens
HNIRKMLLYFKLINKLASPEQKT

SEQ ID NO: 3026606 - protein, 20 aa, Entamoeba invadens
HNYPFCLPYPLKLPKRNFTK

SEQ ID NO: 3026607 - protein, 25 aa, Entamoeba invadens
HPKELDEFLLFEKFKLFTAQLKQNE

SEQ ID NO: 3026608 - protein, 19 aa, Entamoeba invadens
HPKRKPLYFSFASQDFTQF

SEQ ID NO: 3026609 - protein, 18 aa, Entamoeba invadens
HPVFEGELLIPKKSQTKQ

SEQ ID NO: 3026610 - protein, 23 aa, Entamoeba invadens
HQDSMFIACSLLQFGVSIPNSLN

SEQ ID NO: 3026611 - protein, 19 aa, Entamoeba invadens
HQFDVVFIVLLFYTTASEN

SEQ ID NO: 3026612 - protein, 25 aa, Entamoeba invadens
HQHVPFPIILIFALNKWRQEHNTTG

SEQ ID NO: 3026613 - protein, 19 aa, Entamoeba invadens
HRDLALRNVLWYEDASGLR

SEQ ID NO: 3026614 - protein, 24 aa, Entamoeba invadens
HRLMKLPHLLLPTTTIIVLNKPKN

SEQ ID NO: 3026615 - protein, 17 aa, Entamoeba invadens
HSHPGFGCWLSSIDIST

SEQ ID NO: 3026616 - protein, 20 aa, Entamoeba invadens
HSHVKYPFAISLMLELFLNE

SEQ ID NO: 3026617 - protein, 17 aa, Entamoeba invadens
HSLFFPHNTYSLGYHLF

SEQ ID NO: 3026618 - protein, 27 aa, Entamoeba invadens
HSSIDDILFFFPKLETLYFCAVSTRLR

SEQ ID NO: 3026619 - protein, 26 aa, Entamoeba invadens
HSSIDDILFFFPKLETLYFRAVSTRL

SEQ ID NO: 3026620 - protein, 22 aa, Entamoeba invadens
HTEFYFYFFKKMSSKLISFADT

SEQ ID NO: 3026621 - protein, 22 aa, Entamoeba invadens
HTLDLPSYTFPRIKTEALPSTQ

SEQ ID NO: 3026622 - protein, 25 aa, Entamoeba invadens
HTSAPHCWSFMLSGLVYLKELGDSI

SEQ ID NO: 3026623 - protein, 24 aa, Entamoeba invadens
HTWKKRWFVMKDHYIYYFTKNSPN

SEQ ID NO: 3026624 - protein, 25 aa, Entamoeba invadens
HTWKKRWFVMKEQYIWYFPKNTGSA

SEQ ID NO: 3026625 - protein, 18 aa, Entamoeba invadens
HTYGLPKFVLWEKYYFAN

SEQ ID NO: 3026626 - protein, 26 aa, Entamoeba invadens
HVDNPYFPQIPFFKLKNQDKKTNNSL

SEQ ID NO: 3026627 - protein, 25 aa, Entamoeba invadens
HVETVFLIWVFLREVKRVPDLRAEQ

SEQ ID NO: 3026628 - protein, 23 aa, Entamoeba invadens
HVIRYNGIIPRKLSMWPKYNTYV

SEQ ID NO: 3026629 - protein, 25 aa, Entamoeba invadens
HVKFWELMQWVIQSKLPLIGSPYVD

SEQ ID NO: 3026630 - protein, 22 aa, Entamoeba invadens
HVLKKMLLTFMISSTFIDLNYS

SEQ ID NO: 3026631 - protein, 24 aa, Entamoeba invadens
HYAKLFLRFIRRLLCSKANYIFKE

SEQ ID NO: 3026632 - protein, 24 aa, Entamoeba invadens
HYKRSLCYHLLRNGCYFVLTTKDS

SEQ ID NO: 3026633 - protein, 22 aa, Entamoeba invadens
HYRFNTTWYILDPLHLVTVNFQ

SEQ ID NO: 3026634 - protein, 18 aa, Entamoeba invadens
IADINYPTGFYLYQNKEK

SEQ ID NO: 3026635 - protein, 24 aa, Entamoeba invadens
IAIGGFLFLRFINPALVSPQRFGA

SEQ ID NO: 3026636 - protein, 22 aa, Entamoeba invadens
IAKELLNIPPLLIPQYVSDIDD

SEQ ID NO: 3026637 - protein, 17 aa, Entamoeba invadens
IAKLFFFFERSAELCNV

SEQ ID NO: 3026638 - protein, 26 aa, Entamoeba invadens
IALQKEGTLLILQKDIKHANKDEQVF

SEQ ID NO: 3026639 - protein, 18 aa, Entamoeba invadens
IANWFEIYSWWKNNIEAQ

SEQ ID NO: 3026640 - protein, 17 aa, Entamoeba invadens
IAPTLIMGIMDPTPEYV

SEQ ID NO: 3026641 - protein, 20 aa, Entamoeba invadens
IARLFFFLRTIDDAINLVLV

SEQ ID NO: 3026642 - protein, 27 aa, Entamoeba invadens
IARPIMSSLLLCYTLYLDTVNDKWLQI

SEQ ID NO: 3026643 - protein, 18 aa, Entamoeba invadens
IASYIFMYPIFKGYKFYG

SEQ ID NO: 3026644 - protein, 20 aa, Entamoeba invadens
ICDFIAYKIIKYIDAGLEYC

SEQ ID NO: 3026645 - protein, 19 aa, Entamoeba invadens
ICDFVQLRFLFVSLTSSYS

SEQ ID NO: 3026646 - protein, 24 aa, Entamoeba invadens
ICFDIKFPVFLRNTKLEYDVILNA

SEQ ID NO: 3026647 - protein, 18 aa, Entamoeba invadens
ICGKYFCVGTVFGALRTS

SEQ ID NO: 3026648 - protein, 18 aa, Entamoeba invadens
ICGMNGFIFITFGKEPEK

SEQ ID NO: 3026649 - protein, 21 aa, Entamoeba invadens
ICLECRYLPYLIYLEQITEVQ

SEQ ID NO: 3026650 - protein, 18 aa, Entamoeba invadens
ICLRSHFKFFPNVETYYI

SEQ ID NO: 3026651 - protein, 25 aa, Entamoeba invadens
ICNNFLCAFLLIRIRLEGISPALPF

SEQ ID NO: 3026652 - protein, 18 aa, Entamoeba invadens
ICNSFLASLYKDAVFQKA

SEQ ID NO: 3026653 - protein, 19 aa, Entamoeba invadens
IDCGVFMLYFLDTIARKKP

SEQ ID NO: 3026654 - protein, 24 aa, Entamoeba invadens
IDCSGYLYRMTLWEVPILAIVSEL

SEQ ID NO: 3026655 - protein, 22 aa, Entamoeba invadens
IDFKFKYRRGLPMKLKGINAKI

SEQ ID NO: 3026656 - protein, 22 aa, Entamoeba invadens
IDKYRTLLLFPKMPNFIQEQIA

SEQ ID NO: 3026657 - protein, 18 aa, Entamoeba invadens
IDLLIVRGGYEFDSKYTE

SEQ ID NO: 3026658 - protein, 18 aa, Entamoeba invadens
IDSIILRRFPFGRTNSAV

SEQ ID NO: 3026659 - protein, 23 aa, Entamoeba invadens
IDSRKNIPLPKNRTPRTTNTTLT

SEQ ID NO: 3026660 - protein, 21 aa, Entamoeba invadens
IDVLSRILALVPPWVRIHRIQ

SEQ ID NO: 3026661 - protein, 25 aa, Entamoeba invadens
IDVTLSHFFFFLQNETKVYAVGSIS

SEQ ID NO: 3026662 - protein, 23 aa, Entamoeba invadens
IDVYPKFIRVFTPLLLGALTKKD

SEQ ID NO: 3026663 - protein, 17 aa, Entamoeba invadens
IDYFLYQGHVCIVSELL

SEQ ID NO: 3026664 - protein, 17 aa, Entamoeba invadens
IEDFLVYFAVDLNLFEK

SEQ ID NO: 3026665 - protein, 18 aa, Entamoeba invadens
IEERYLIELKASLKTQRD

SEQ ID NO: 3026666 - protein, 24 aa, Entamoeba invadens
IEFNIIRIYYWTGCKSSVFSNEIE

SEQ ID NO: 3026667 - protein, 21 aa, Entamoeba invadens
IEFNLLFTLEKRKQLFQLSKL

SEQ ID NO: 3026668 - protein, 26 aa, Entamoeba invadens
IEGDKIMNLFLFSFRFWDDEKVVLEW

SEQ ID NO: 3026669 - protein, 24 aa, Entamoeba invadens
IEGLFWVFQYYTVGVPSWRWFYPE

SEQ ID NO: 3026670 - protein, 18 aa, Entamoeba invadens
IEILPLNLLEIQGSPLKI

SEQ ID NO: 3026671 - protein, 20 aa, Entamoeba invadens
IEIRGKCPIIGKKNMKYIIP

SEQ ID NO: 3026672 - protein, 18 aa, Entamoeba invadens
IEIYPPFVPFLDMGFNIS

SEQ ID NO: 3026673 - protein, 23 aa, Entamoeba invadens
IEKYNIPFLFPVPYREDRNYSVT

SEQ ID NO: 3026674 - protein, 21 aa, Entamoeba invadens
IELHRLLERWPLLEPTPALEL

SEQ ID NO: 3026675 - protein, 22 aa, Entamoeba invadens
IELLHLLIDLLIVRGGYEFDSK

SEQ ID NO: 3026676 - protein, 23 aa, Entamoeba invadens
IEQLKYFLIPKTTLPIPPPIPKQ

SEQ ID NO: 3026677 - protein, 18 aa, Entamoeba invadens
IEQPGYYRKIKFDTKKYT

SEQ ID NO: 3026678 - protein, 17 aa, Entamoeba invadens
IERVAFIGFFKRCRPVT

SEQ ID NO: 3026679 - protein, 18 aa, Entamoeba invadens
IESNTICNLLWTLVTLKY

SEQ ID NO: 3026680 - protein, 18 aa, Entamoeba invadens
IESPLIIGPYYFFSKNTY

SEQ ID NO: 3026681 - protein, 23 aa, Entamoeba invadens
IETPSFHILWFDTIFQKQKERKK

SEQ ID NO: 3026682 - protein, 23 aa, Entamoeba invadens
IEVIHLMEDLLLELGFELITKTL

SEQ ID NO: 3026683 - protein, 30 aa, Entamoeba invadens
IEVIIYFHRLFLFPPYVLCQLLPPVKYIQE

SEQ ID NO: 3026684 - protein, 17 aa, Entamoeba invadens
IEVSFFKGLEMRSTFQT

SEQ ID NO: 3026685 - protein, 18 aa, Entamoeba invadens
IFDFLPLESLLCVSASCK

SEQ ID NO: 3026686 - protein, 18 aa, Entamoeba invadens
IFDYINRLYIYPIDIVYG

SEQ ID NO: 3026687 - protein, 31 aa, Entamoeba invadens
IFEGDLKLILGLLWVLILKYQIAANKMDAST

SEQ ID NO: 3026688 - protein, 23 aa, Entamoeba invadens
IFETTLRFNFWDKITFKFEVDAI

SEQ ID NO: 3026689 - protein, 17 aa, Entamoeba invadens
IFFCPPFWMRTSNDVFE

SEQ ID NO: 3026690 - protein, 17 aa, Entamoeba invadens
IFFMEMLGHTLIYSSCL

SEQ ID NO: 3026691 - protein, 19 aa, Entamoeba invadens
IFGNYLWFVNAMSTNLEIA

SEQ ID NO: 3026692 - protein, 22 aa, Entamoeba invadens
IFIHNFLLDVLVEKGFFFNSKM

SEQ ID NO: 3026693 - protein, 23 aa, Entamoeba invadens
IFIQNFFIDTLLEKGFFFNSKLS

SEQ ID NO: 3026694 - protein, 23 aa, Entamoeba invadens
IFIRNIHIILQQYFLLKITENDA

SEQ ID NO: 3026695 - protein, 18 aa, Entamoeba invadens
IFKHVIWYEVFYHNTFPQ

SEQ ID NO: 3026696 - protein, 26 aa, Entamoeba invadens
IFKTTEPILILYFLEQIPLVGKVYGT

SEQ ID NO: 3026697 - protein, 25 aa, Entamoeba invadens
IFLCSSLTFFIFPLSLRRICDKSFA

SEQ ID NO: 3026698 - protein, 23 aa, Entamoeba invadens
IFNNLLFMSKPTLRMVYRPPLKT

SEQ ID NO: 3026699 - protein, 17 aa, Entamoeba invadens
IFPFLKDVGMYSSKFES

SEQ ID NO: 3026700 - protein, 25 aa, Entamoeba invadens
IFPRGLYILVIPFYQDYLTINYGDK

SEQ ID NO: 3026701 - protein, 19 aa, Entamoeba invadens
IFQCIQIPVLLVFATQDQY

SEQ ID NO: 3026702 - protein, 25 aa, Entamoeba invadens
IFSLAITMWVLFFEDIPFSTYAQSV

SEQ ID NO: 3026703 - protein, 17 aa, Entamoeba invadens
IFVFWERVQLFRMYLIN

SEQ ID NO: 3026704 - protein, 17 aa, Entamoeba invadens
IFWHDLLTHWFVYEIVR

SEQ ID NO: 3026705 - protein, 23 aa, Entamoeba invadens
IGALRVYCYFFPSLFSSSFHTSY

SEQ ID NO: 3026706 - protein, 21 aa, Entamoeba invadens
IGEITLLEDVPLITIITPSYS

SEQ ID NO: 3026707 - protein, 23 aa, Entamoeba invadens
IGEMSFFCFYLLVSAFLTSNLQI

SEQ ID NO: 3026708 - protein, 27 aa, Entamoeba invadens
IGFYFQEPYIFRFYYYDGDNACQYPEE

SEQ ID NO: 3026709 - protein, 24 aa, Entamoeba invadens
IGGTKNLIYITLYNLPDGTTTEQV

SEQ ID NO: 3026710 - protein, 25 aa, Entamoeba invadens
IGKTCFRYCIFLHDIKLPIGLKEIP

SEQ ID NO: 3026711 - protein, 24 aa, Entamoeba invadens
IGLANWLLYLLKNYNTDIQPIVEV

SEQ ID NO: 3026712 - protein, 25 aa, Entamoeba invadens
IGLLFKYVYLFYLKSPLAMMSYKDA

SEQ ID NO: 3026713 - protein, 17 aa, Entamoeba invadens
IGSTLRFVLPYGSFPFD

SEQ ID NO: 3026714 - protein, 20 aa, Entamoeba invadens
IGVHNIWYGVPRKYDVPSTV

SEQ ID NO: 3026715 - protein, 17 aa, Entamoeba invadens
IHGLFEIIPYKVYQFRG

SEQ ID NO: 3026716 - protein, 27 aa, Entamoeba invadens
IHHLESFMFFYFIKLKEVTLPRGVVVH

SEQ ID NO: 3026717 - protein, 25 aa, Entamoeba invadens
IHHQSFLAFFLLRRALRNKNIIGHQ

SEQ ID NO: 3026718 - protein, 17 aa, Entamoeba invadens
IHLLVTKFYLLEITTIR

SEQ ID NO: 3026719 - protein, 17 aa, Entamoeba invadens
IHPMLVLVGKYSLPYIM

SEQ ID NO: 3026720 - protein, 17 aa, Entamoeba invadens
IHPSILPKIYPSTSIVF

SEQ ID NO: 3026721 - protein, 29 aa, Entamoeba invadens
IHTWYQFRNWVWFRLFQKVRPTLKRRRVD

SEQ ID NO: 3026722 - protein, 17 aa, Entamoeba invadens
IIASPFRRTTWSGLPLA

SEQ ID NO: 3026723 - protein, 18 aa, Entamoeba invadens
IICFGMVYMVFPPDHATN

SEQ ID NO: 3026724 - protein, 19 aa, Entamoeba invadens
IICFGMVYMVFPPDHATNY

SEQ ID NO: 3026725 - protein, 25 aa, Entamoeba invadens
IICNNLSWIIMLVSSWKAMGPINKE

SEQ ID NO: 3026726 - protein, 18 aa, Entamoeba invadens
IIFFTKNGHFLLAVSYDR

SEQ ID NO: 3026727 - protein, 19 aa, Entamoeba invadens
IIFYDFWTHNLYKDLIQVN

SEQ ID NO: 3026728 - protein, 18 aa, Entamoeba invadens
IIFYFRFVPENVIRKTDN

SEQ ID NO: 3026729 - protein, 17 aa, Entamoeba invadens
IIIFLKQCTAYGLKFEI

SEQ ID NO: 3026730 - protein, 19 aa, Entamoeba invadens
IIIFYNLDHHLNLLKILKL

SEQ ID NO: 3026731 - protein, 17 aa, Entamoeba invadens
IIIGFSDGVIRLYKYSD

SEQ ID NO: 3026732 - protein, 21 aa, Entamoeba invadens
IIIKNPLFIVALPRSGSTFTH

SEQ ID NO: 3026733 - protein, 17 aa, Entamoeba invadens
IIIRCYPGFQAAIVYRV

SEQ ID NO: 3026734 - protein, 23 aa, Entamoeba invadens
IIKRAIMILSQYPLPILLDVENV

SEQ ID NO: 3026735 - protein, 18 aa, Entamoeba invadens
IILISKMPRPLELHHKKQ

SEQ ID NO: 3026736 - protein, 17 aa, Entamoeba invadens
IILISLFEALTKKKVSF

SEQ ID NO: 3026737 - protein, 26 aa, Entamoeba invadens
IILPFEVPYIFDLIQSLVLDKDEYAK

SEQ ID NO: 3026738 - protein, 18 aa, Entamoeba invadens
IILPIIFDFLKKSPVNEF

SEQ ID NO: 3026739 - protein, 25 aa, Entamoeba invadens
IINRSKYFLITANKYIWYTDHDYNV

SEQ ID NO: 3026740 - protein, 18 aa, Entamoeba invadens
IIPFKFMARLYDLSVQYR

SEQ ID NO: 3026741 - protein, 27 aa, Entamoeba invadens
IIPQLKGKKFFFSRIFQLKPLNREVKM

SEQ ID NO: 3026742 - protein, 24 aa, Entamoeba invadens
IIQCGDLYFNKWLALISTLGSMSE

SEQ ID NO: 3026743 - protein, 22 aa, Entamoeba invadens
IISFLLKYKYADLALLFVRDTH

SEQ ID NO: 3026744 - protein, 18 aa, Entamoeba invadens
IISFYFPLVTSFHTLNSK

SEQ ID NO: 3026745 - protein, 17 aa, Entamoeba invadens
IISLLKWINDDFVPTMD

SEQ ID NO: 3026746 - protein, 19 aa, Entamoeba invadens
IISVLYKKGFLIKGIFRES

SEQ ID NO: 3026747 - protein, 18 aa, Entamoeba invadens
IITLWYRPLEILLGKEVY

SEQ ID NO: 3026748 - protein, 26 aa, Entamoeba invadens
IIVKGFYFYNLPFLTVIRLFQKYANA

SEQ ID NO: 3026749 - protein, 18 aa, Entamoeba invadens
IIYFFPNLQTLYFNALSY

SEQ ID NO: 3026750 - protein, 18 aa, Entamoeba invadens
IIYIVYEKGIKEVQLDTS

SEQ ID NO: 3026751 - protein, 20 aa, Entamoeba invadens
IIYNIFIILIRIKCTSCSDT

SEQ ID NO: 3026752 - protein, 17 aa, Entamoeba invadens
IIYRQALFLSSLSYEDF

SEQ ID NO: 3026753 - protein, 24 aa, Entamoeba invadens
IKAYQKRLWGLRFIQIVNNVRGST

SEQ ID NO: 3026754 - protein, 20 aa, Entamoeba invadens
IKCKLLQKTIFPITLKRLTL

SEQ ID NO: 3026755 - protein, 20 aa, Entamoeba invadens
IKFRFVVPWMVVLFKRDFNR

SEQ ID NO: 3026756 - protein, 17 aa, Entamoeba invadens
IKHLGEGKYFISYTLPA

SEQ ID NO: 3026757 - protein, 22 aa, Entamoeba invadens
IKHTLMQQVLLPKSLFEILEKL

SEQ ID NO: 3026758 - protein, 18 aa, Entamoeba invadens
IKKAFPYNFYYKIYIKLS

SEQ ID NO: 3026759 - protein, 21 aa, Entamoeba invadens
IKKYYRIIVWFNVDFTIVDKN

SEQ ID NO: 3026760 - protein, 18 aa, Entamoeba invadens
IKLFLFDGVKYRVAALPY

SEQ ID NO: 3026761 - protein, 21 aa, Entamoeba invadens
IKLMNETLFSYLLLKSSDSDI

SEQ ID NO: 3026762 - protein, 19 aa, Entamoeba invadens
IKLNRLHREPFLKLTKRYK

SEQ ID NO: 3026763 - protein, 17 aa, Entamoeba invadens
IKMLPKNHIPIVRELFG

SEQ ID NO: 3026764 - protein, 19 aa, Entamoeba invadens
IKNPLFIVALPRSGSTFTH

SEQ ID NO: 3026765 - protein, 21 aa, Entamoeba invadens
IKPTTLLHLPDEKIYSFLVTP

SEQ ID NO: 3026766 - protein, 21 aa, Entamoeba invadens
IKRIIGLPYERIRYPEFFPFQ

SEQ ID NO: 3026767 - protein, 25 aa, Entamoeba invadens
IKTWKKRLFILKDNRLWYFEGKNDQ

SEQ ID NO: 3026768 - protein, 22 aa, Entamoeba invadens
IKYDQLFIYKYLQNVHLTLDKS

SEQ ID NO: 3026769 - protein, 31 aa, Entamoeba invadens
ILDFLYAQLTRYLPMKWLPNAPIATIDSVID

SEQ ID NO: 3026770 - protein, 24 aa, Entamoeba invadens
ILEKKIDIILFRTDLIMKELRTIP

SEQ ID NO: 3026771 - protein, 19 aa, Entamoeba invadens
ILFNGWLRLFDTKIVFENV

SEQ ID NO: 3026772 - protein, 18 aa, Entamoeba invadens
ILFPPLKLLELPPNVTEH

SEQ ID NO: 3026773 - protein, 18 aa, Entamoeba invadens
ILGEYLYLMTFIAANQRI

SEQ ID NO: 3026774 - protein, 17 aa, Entamoeba invadens
ILIIARPFVFGKKTTRE

SEQ ID NO: 3026775 - protein, 19 aa, Entamoeba invadens
ILKIYRLFSTRYLDNEFLN

SEQ ID NO: 3026776 - protein, 17 aa, Entamoeba invadens
ILKNTQLLTRKPSAPIR

SEQ ID NO: 3026777 - protein, 17 aa, Entamoeba invadens
ILLHCYLDPISEGKYSN

SEQ ID NO: 3026778 - protein, 20 aa, Entamoeba invadens
ILLNDLRFFTALKYLAINKY

SEQ ID NO: 3026779 - protein, 29 aa, Entamoeba invadens
ILNSKELFLLLLTFLKHAFDYKTLYDIFD

SEQ ID NO: 3026780 - protein, 18 aa, Entamoeba invadens
ILPRILLEYITSPFPYIL

SEQ ID NO: 3026781 - protein, 19 aa, Entamoeba invadens
ILQHLFLYGYPFAVKLVVT

SEQ ID NO: 3026782 - protein, 19 aa, Entamoeba invadens
ILSFLPPVYYSTLKMLLHY

SEQ ID NO: 3026783 - protein, 23 aa, Entamoeba invadens
ILSHQFPILYFLLGEMHFALFHR

SEQ ID NO: 3026784 - protein, 17 aa, Entamoeba invadens
ILTLVLEGPAVSTFSFG

SEQ ID NO: 3026785 - protein, 17 aa, Entamoeba invadens
ILTTLFTLFFYQSNVSI

SEQ ID NO: 3026786 - protein, 24 aa, Entamoeba invadens
ILVKVLTRFILLFRNFPVQESLDV

SEQ ID NO: 3026787 - protein, 19 aa, Entamoeba invadens
ILVYPLFFDLYRNPSLSIL

SEQ ID NO: 3026788 - protein, 17 aa, Entamoeba invadens
ILYRNIKHFITLKKELF

SEQ ID NO: 3026789 - protein, 23 aa, Entamoeba invadens
IMETSFTLVKWRSLVPTAPPYGL

SEQ ID NO: 3026790 - protein, 23 aa, Entamoeba invadens
IMGQMMLIRLFSLFVRDILVQKM

SEQ ID NO: 3026791 - protein, 19 aa, Entamoeba invadens
IMHYLEDVLFLYHFDTKLE

SEQ ID NO: 3026792 - protein, 17 aa, Entamoeba invadens
IMIFMRLGDLYNKTGEL

SEQ ID NO: 3026793 - protein, 18 aa, Entamoeba invadens
IMIPIPQYPLYSATIATL

SEQ ID NO: 3026794 - protein, 21 aa, Entamoeba invadens
IMKFPMTLYIAFKRIFDGIPS

SEQ ID NO: 3026795 - protein, 17 aa, Entamoeba invadens
IMKLLNAKFIAVTAANQ

SEQ ID NO: 3026796 - protein, 18 aa, Entamoeba invadens
IMTIPYKCFSMCVRLQFL

SEQ ID NO: 3026797 - protein, 23 aa, Entamoeba invadens
IMTLFINNFSTLFPRFADPTLAF

SEQ ID NO: 3026798 - protein, 17 aa, Entamoeba invadens
INAWYVWKILPNINGND

SEQ ID NO: 3026799 - protein, 17 aa, Entamoeba invadens
INCYLWEIQIDKKYVHQ

SEQ ID NO: 3026800 - protein, 30 aa, Entamoeba invadens
INFLLTCTSPYKFFQLLFSHLIMAEAAFKA

SEQ ID NO: 3026801 - protein, 19 aa, Entamoeba invadens
INFLNFFYLIVSHPKYISA

SEQ ID NO: 3026802 - protein, 24 aa, Entamoeba invadens
INIQLSRDYLLTEKYKYLPISLEG

SEQ ID NO: 3026803 - protein, 25 aa, Entamoeba invadens
INIQVYFINFIALKFELVMKLNELR

SEQ ID NO: 3026804 - protein, 19 aa, Entamoeba invadens
INIVYLLYTLFDVDDVRGV

SEQ ID NO: 3026805 - protein, 28 aa, Entamoeba invadens
INKEMQAEKLFLVPNPIPVPFPQNNEET

SEQ ID NO: 3026806 - protein, 23 aa, Entamoeba invadens
INKLFCVQPIPRLPRKFCSTIQI

SEQ ID NO: 3026807 - protein, 27 aa, Entamoeba invadens
INNIFYPGWLLSQMLLYGSLNVVHIFN

SEQ ID NO: 3026808 - protein, 17 aa, Entamoeba invadens
INNLAVAVKFSLLLGIK

SEQ ID NO: 3026809 - protein, 17 aa, Entamoeba invadens
INPYLIPFFIGLQNRFT

SEQ ID NO: 3026810 - protein, 21 aa, Entamoeba invadens
INQRRIVFVVPPAFFETHEIT

SEQ ID NO: 3026811 - protein, 17 aa, Entamoeba invadens
INRACNLSLFTALRRVT

SEQ ID NO: 3026812 - protein, 23 aa, Entamoeba invadens
INSCPRDWLLCQTHFVENAEKLD

SEQ ID NO: 3026813 - protein, 22 aa, Entamoeba invadens
INTILAMKVFSSVFYGVRGKID

SEQ ID NO: 3026814 - protein, 19 aa, Entamoeba invadens
INTLPREWKICKPDFIRLL

SEQ ID NO: 3026815 - protein, 18 aa, Entamoeba invadens
INVGPLIHFLYETYPEGK

SEQ ID NO: 3026816 - protein, 21 aa, Entamoeba invadens
INVIPYGFFFNAVNLYEINGL

SEQ ID NO: 3026817 - protein, 20 aa, Entamoeba invadens
INYYITLYLKVRLSKVLQMA

SEQ ID NO: 3026818 - protein, 28 aa, Entamoeba invadens
IPAELRCYIWYALLLRPTDPWEIRALYS

SEQ ID NO: 3026819 - protein, 17 aa, Entamoeba invadens
IPDPLLIKFIGEKYVIA

SEQ ID NO: 3026820 - protein, 18 aa, Entamoeba invadens
IPEPLFILELKISPYHYT

SEQ ID NO: 3026821 - protein, 19 aa, Entamoeba invadens
IPILPLWMGDIIHAQTLFS

SEQ ID NO: 3026822 - protein, 19 aa, Entamoeba invadens
IPKIFNFWEKQRSFSILFS

SEQ ID NO: 3026823 - protein, 18 aa, Entamoeba invadens
IPLLGCLTTFKPKTFKNC

SEQ ID NO: 3026824 - protein, 19 aa, Entamoeba invadens
IPLPDFLINKFLGIAIGWY

SEQ ID NO: 3026825 - protein, 21 aa, Entamoeba invadens
IPLVVLQLRKGIYPPRSLILE

SEQ ID NO: 3026826 - protein, 17 aa, Entamoeba invadens
IPMADLTKWVKMRTNST

SEQ ID NO: 3026827 - protein, 25 aa, Entamoeba invadens
IPMIADLLRYFFHFVKSTCPYIVEY

SEQ ID NO: 3026828 - protein, 21 aa, Entamoeba invadens
IPNILYAVQPFGKVLGAEDVG

SEQ ID NO: 3026829 - protein, 17 aa, Entamoeba invadens
IPNLFRYILPWETEFKD

SEQ ID NO: 3026830 - protein, 18 aa, Entamoeba invadens
IPNTYMFDILYFSDKDKR

SEQ ID NO: 3026831 - protein, 23 aa, Entamoeba invadens
IPQVVFNLCWWIYTFGNRTEGIF

SEQ ID NO: 3026832 - protein, 26 aa, Entamoeba invadens
IPQVVFNMCWWIYTYGHSIEGIFRIS

SEQ ID NO: 3026833 - protein, 31 aa, Entamoeba invadens
IPQVVYNLCWWIYTYGYLIEGIFRVTSNLEF

SEQ ID NO: 3026834 - protein, 18 aa, Entamoeba invadens
IPSAFVPVQCLPSFFSVE

SEQ ID NO: 3026835 - protein, 20 aa, Entamoeba invadens
IPYFNFVRYLVIYAPFQTLP

SEQ ID NO: 3026836 - protein, 34 aa, Entamoeba invadens
IQDTIHTWYQFRNWVWFRLFQKVRPTLKRRRVDE

SEQ ID NO: 3026837 - protein, 19 aa, Entamoeba invadens
IQPPMLRIKAFEPLFVIGK

SEQ ID NO: 3026838 - protein, 17 aa, Entamoeba invadens
IQPRLRKAKNCGSGMIV

SEQ ID NO: 3026839 - protein, 25 aa, Entamoeba invadens
IQQLGKLVPNCRFTDFWNGYGCGQV

SEQ ID NO: 3026840 - protein, 20 aa, Entamoeba invadens
IQRIPRYKLLLNDLLKHTPH

SEQ ID NO: 3026841 - protein, 23 aa, Entamoeba invadens
IQRIPRYVLLLETLLKCLPDYLE

SEQ ID NO: 3026842 - protein, 21 aa, Entamoeba invadens
IQRLPRYRLLLKDLLKHLSDK

SEQ ID NO: 3026843 - protein, 21 aa, Entamoeba invadens
IQRLPRYVLLLKELIKATPEL

SEQ ID NO: 3026844 - protein, 18 aa, Entamoeba invadens
IQSFNFILEWEFNVSFKG

SEQ ID NO: 3026845 - protein, 25 aa, Entamoeba invadens
IQTHKLAVPLLLFHNGGNFNIDIDN

SEQ ID NO: 3026846 - protein, 17 aa, Entamoeba invadens
IQVYLFYTKLDNLLQGV

SEQ ID NO: 3026847 - protein, 18 aa, Entamoeba invadens
IQWSILYLRDEDLVNMLQ

SEQ ID NO: 3026848 - protein, 20 aa, Entamoeba invadens
IQYALSIATVWLFCYEMELN

SEQ ID NO: 3026849 - protein, 18 aa, Entamoeba invadens
IRDNAVLWSWWREQLRDE

SEQ ID NO: 3026850 - protein, 25 aa, Entamoeba invadens
IREAMKFILKYYNIEGVIIDGFTDE

SEQ ID NO: 3026851 - protein, 26 aa, Entamoeba invadens
IRETISVPLIYFMTGGQFQIKSGQEY

SEQ ID NO: 3026852 - protein, 29 aa, Entamoeba invadens
IRGDKMLLGLLYLLFKKYRMAVAKIVDQS

SEQ ID NO: 3026853 - protein, 25 aa, Entamoeba invadens
IRGRKSLYFIIFDSNLNVFGVYVNT

SEQ ID NO: 3026854 - protein, 18 aa, Entamoeba invadens
IRKAYYLYSLPIVVNDNV

SEQ ID NO: 3026855 - protein, 25 aa, Entamoeba invadens
IRLDPPHLLWVIPHLTSISVLQRFH

SEQ ID NO: 3026856 - protein, 23 aa, Entamoeba invadens
IRNWLQRWFVLTSDILYYFDAEK

SEQ ID NO: 3026857 - protein, 17 aa, Entamoeba invadens
IRRMYFWEGKRTNELYY

SEQ ID NO: 3026858 - protein, 18 aa, Entamoeba invadens
IRSLIAISLVFFDGKEIE

SEQ ID NO: 3026859 - protein, 17 aa, Entamoeba invadens
IRVALCFTPLFTTAAHF

SEQ ID NO: 3026860 - protein, 19 aa, Entamoeba invadens
IRVWIRMTCYSVKYDSTIH

SEQ ID NO: 3026861 - protein, 19 aa, Entamoeba invadens
ISCGLYFYITYAKGPLIER

SEQ ID NO: 3026862 - protein, 18 aa, Entamoeba invadens
ISCNPACGALYLFPKIDL

SEQ ID NO: 3026863 - protein, 24 aa, Entamoeba invadens
ISELPYFVILLPYFGYLNVAKADD

SEQ ID NO: 3026864 - protein, 17 aa, Entamoeba invadens
ISFILPTNDYIYAVGVN

SEQ ID NO: 3026865 - protein, 17 aa, Entamoeba invadens
ISFLLLLKVKYPERIHL

SEQ ID NO: 3026866 - protein, 24 aa, Entamoeba invadens
ISGTKFLLYCWSRPDLRGYLNSQG

SEQ ID NO: 3026867 - protein, 24 aa, Entamoeba invadens
ISIEKPLFIEYLGIGLPVLGQPDK

SEQ ID NO: 3026868 - protein, 21 aa, Entamoeba invadens
ISIGIDFIWDKEYFKALTQLE

SEQ ID NO: 3026869 - protein, 24 aa, Entamoeba invadens
ISKELPSFIFFRWDHTHEDKEFKS

SEQ ID NO: 3026870 - protein, 17 aa, Entamoeba invadens
ISKKRIPWTTICKIVLV

SEQ ID NO: 3026871 - protein, 23 aa, Entamoeba invadens
ISLSLMEFIGYFESLKGIMPPVV

SEQ ID NO: 3026872 - protein, 24 aa, Entamoeba invadens
ISLSLMEFIGYFESLKGIMPPVVG

SEQ ID NO: 3026873 - protein, 18 aa, Entamoeba invadens
ISMFFAFAAPMVLCLSET

SEQ ID NO: 3026874 - protein, 21 aa, Entamoeba invadens
ISMMRMRFNLFWKPAQDLLAA

SEQ ID NO: 3026875 - protein, 18 aa, Entamoeba invadens
ISMYLFRDVSMKGISYLT

SEQ ID NO: 3026876 - protein, 22 aa, Entamoeba invadens
ISNIPLILYIISSDLYTQFLTY

SEQ ID NO: 3026877 - protein, 24 aa, Entamoeba invadens
ISNKDLFALMYWKNLFSKLTGAKI

SEQ ID NO: 3026878 - protein, 21 aa, Entamoeba invadens
ISQMFLLFLFDSFTTNNNVAS

SEQ ID NO: 3026879 - protein, 27 aa, Entamoeba invadens
ISQTLMNLIFFWYQNYNEDFRSVFCEN

SEQ ID NO: 3026880 - protein, 24 aa, Entamoeba invadens
ISREPILVSLFYNYGVLPLNNLSR

SEQ ID NO: 3026881 - protein, 26 aa, Entamoeba invadens
ISRINVLFIVYWKKIHGIPKINSGTF

SEQ ID NO: 3026882 - protein, 23 aa, Entamoeba invadens
ISTDIFLAWFRDVVLTYIIKKRN

SEQ ID NO: 3026883 - protein, 24 aa, Entamoeba invadens
ISTKISFLRWVGPLLLTCAENPNS

SEQ ID NO: 3026884 - protein, 19 aa, Entamoeba invadens
ISVLVVKVLSLFFSFTKNP

SEQ ID NO: 3026885 - protein, 18 aa, Entamoeba invadens
ITCEDGCKRCFIKNDVTK

SEQ ID NO: 3026886 - protein, 17 aa, Entamoeba invadens
ITCENGCKKCFIKDNLT

SEQ ID NO: 3026887 - protein, 23 aa, Entamoeba invadens
ITDKQHIPFIKKVFLYFSENNIG

SEQ ID NO: 3026888 - protein, 22 aa, Entamoeba invadens
ITDYKKSFTKFSWFTKKFPITR

SEQ ID NO: 3026889 - protein, 24 aa, Entamoeba invadens
ITEIYIIFDFLRHILIYKAITKRN

SEQ ID NO: 3026890 - protein, 24 aa, Entamoeba invadens
ITFDSFCLFVRLLEYLPPSTLSAH

SEQ ID NO: 3026891 - protein, 27 aa, Entamoeba invadens
ITILKKKFFRIIVWFSVDFGTVDRNKS

SEQ ID NO: 3026892 - protein, 17 aa, Entamoeba invadens
ITKILMERLLVSKPLQV

SEQ ID NO: 3026893 - protein, 19 aa, Entamoeba invadens
ITKLALYYKNRGYKPSVVC

SEQ ID NO: 3026894 - protein, 27 aa, Entamoeba invadens
ITKLPPYTFYMCFLLNKILMPKSLTNI

SEQ ID NO: 3026895 - protein, 17 aa, Entamoeba invadens
ITKTSLRLQLAQLNADN

SEQ ID NO: 3026896 - protein, 18 aa, Entamoeba invadens
ITLPVIFDLAILSLKYIQ

SEQ ID NO: 3026897 - protein, 23 aa, Entamoeba invadens
ITLQSPLVFWKWANEHILAIVTA

SEQ ID NO: 3026898 - protein, 24 aa, Entamoeba invadens
ITNKPIKFLFPRLVDRNKFILCGN

SEQ ID NO: 3026899 - protein, 23 aa, Entamoeba invadens
ITPKIFQFIKPLYRKRLLVKIDG

SEQ ID NO: 3026900 - protein, 22 aa, Entamoeba invadens
ITQEFLFPILLSLVAQQPSAFV

SEQ ID NO: 3026901 - protein, 21 aa, Entamoeba invadens
ITQNFFCYVPIFVKGNISIRI

SEQ ID NO: 3026902 - protein, 18 aa, Entamoeba invadens
ITRIPFGMFLSCSNLSEI

SEQ ID NO: 3026903 - protein, 19 aa, Entamoeba invadens
ITRKYLMKLLISLFQKFDN

SEQ ID NO: 3026904 - protein, 36 aa, Entamoeba invadens
ITRLGYPNRIIYNEFLKRYFFLGTNINKKTSDAMPV

SEQ ID NO: 3026905 - protein, 20 aa, Entamoeba invadens
ITSLWRKKLPVKYPTSFVIL

SEQ ID NO: 3026906 - protein, 23 aa, Entamoeba invadens
ITSYVDLLFVLFLNWNRGAEDWE

SEQ ID NO: 3026907 - protein, 18 aa, Entamoeba invadens
ITTEDACFFLLISNINNA

SEQ ID NO: 3026908 - protein, 18 aa, Entamoeba invadens
ITTILYKFGIFSLIPEEL

SEQ ID NO: 3026909 - protein, 20 aa, Entamoeba invadens
ITTLCPFGVFLQLRTISFKN

SEQ ID NO: 3026910 - protein, 23 aa, Entamoeba invadens
ITTLPQIPLLMKISCSSLSNLKK

SEQ ID NO: 3026911 - protein, 23 aa, Entamoeba invadens
IVDEKTRRLFEQLQRDMAEKQAA

SEQ ID NO: 3026912 - protein, 22 aa, Entamoeba invadens
IVELFTCHLSILSSLKNCVQMS

SEQ ID NO: 3026913 - protein, 19 aa, Entamoeba invadens
IVFELCPFCHIPKEYCEFG

SEQ ID NO: 3026914 - protein, 18 aa, Entamoeba invadens
IVFIHWKGPNVRGMKMVK

SEQ ID NO: 3026915 - protein, 19 aa, Entamoeba invadens
IVGYLPYFKLKKSLDVVVE

SEQ ID NO: 3026916 - protein, 21 aa, Entamoeba invadens
IVIEALLILRYLFAGNAMRAE

SEQ ID NO: 3026917 - protein, 37 aa, Entamoeba invadens
IVIQDTIHIWYHFRNWVWFRLFQKVRPILKKRRVDEE

SEQ ID NO: 3026918 - protein, 17 aa, Entamoeba invadens
IVKCKLTHFLYTNSYTK

SEQ ID NO: 3026919 - protein, 22 aa, Entamoeba invadens
IVLCCEPIFWMYANYLKESFIR

SEQ ID NO: 3026920 - protein, 17 aa, Entamoeba invadens
IVLFFSEGDFYKYVIKQ

SEQ ID NO: 3026921 - protein, 17 aa, Entamoeba invadens
IVLLFKRDFEPAECLRV

SEQ ID NO: 3026922 - protein, 17 aa, Entamoeba invadens
IVLLFQNLTPKSFLRTL

SEQ ID NO: 3026923 - protein, 17 aa, Entamoeba invadens
IVLSRYPLFQSRYNIPI

SEQ ID NO: 3026924 - protein, 17 aa, Entamoeba invadens
IVPMIRPNMRNSAYGYD

SEQ ID NO: 3026925 - protein, 22 aa, Entamoeba invadens
IVPRRRFLPVKSCSDLFVVQST

SEQ ID NO: 3026926 - protein, 17 aa, Entamoeba invadens
IVSFFYNDLKPSNPALL

SEQ ID NO: 3026927 - protein, 27 aa, Entamoeba invadens
IVSPSVCVSLYLWSYFPQIGEYILVLD

SEQ ID NO: 3026928 - protein, 17 aa, Entamoeba invadens
IVYTSFFSQLLELSKKL

SEQ ID NO: 3026929 - protein, 21 aa, Entamoeba invadens
IWACGVVMYSLLFGKFPFDGE

SEQ ID NO: 3026930 - protein, 18 aa, Entamoeba invadens
IWEKYRLFMNVLGREEFE

SEQ ID NO: 3026931 - protein, 23 aa, Entamoeba invadens
IWFQIPIRLKKTRKRENEKTRKR

SEQ ID NO: 3026932 - protein, 17 aa, Entamoeba invadens
IWFRARMQIVNVMLPDG

SEQ ID NO: 3026933 - protein, 18 aa, Entamoeba invadens
IWVVNCGIVPLLFDLFLS

SEQ ID NO: 3026934 - protein, 22 aa, Entamoeba invadens
IYAFDFYLLRKMTISDFLHTTM

SEQ ID NO: 3026935 - protein, 18 aa, Entamoeba invadens
IYCFVFNEFLVFTKCLKL

SEQ ID NO: 3026936 - protein, 18 aa, Entamoeba invadens
IYDKFAFPTLLNLTTYSS

SEQ ID NO: 3026937 - protein, 18 aa, Entamoeba invadens
IYEDILLYNAIDIDHLIT

SEQ ID NO: 3026938 - protein, 17 aa, Entamoeba invadens
IYFTALLLQFHASNLLK

SEQ ID NO: 3026939 - protein, 18 aa, Entamoeba invadens
IYHLFDQFTAHMQKLEEA

SEQ ID NO: 3026940 - protein, 17 aa, Entamoeba invadens
IYITYVYGVYSFGEQGK

SEQ ID NO: 3026941 - protein, 23 aa, Entamoeba invadens
IYKGIKVILIGYFKDASVSAGQN

SEQ ID NO: 3026942 - protein, 20 aa, Entamoeba invadens
IYLPILRLMKQSASPYYLIC

SEQ ID NO: 3026943 - protein, 17 aa, Entamoeba invadens
IYQYIKVDSLPLLRERV

SEQ ID NO: 3026944 - protein, 27 aa, Entamoeba invadens
IYRKQEFFIPIILLLRVYTGMSDREIF

SEQ ID NO: 3026945 - protein, 17 aa, Entamoeba invadens
IYTFPFSFKVPLDTPPS

SEQ ID NO: 3026946 - protein, 25 aa, Entamoeba invadens
IYTGIKFILHIKGRLNYYASHDREM

SEQ ID NO: 3026947 - protein, 17 aa, Entamoeba invadens
IYVFLNNTNLHFINQKT

SEQ ID NO: 3026948 - protein, 17 aa, Entamoeba invadens
IYYEFIEETTNLRDLSE

SEQ ID NO: 3026949 - protein, 23 aa, Entamoeba invadens
KAAQLLLIIKEKHPEYLDAFSSY

SEQ ID NO: 3026950 - protein, 22 aa, Entamoeba invadens
KADLSVAFIFVSVNIMCFRKGM

SEQ ID NO: 3026951 - protein, 29 aa, Entamoeba invadens
KADNRHLLGLLYLLFRKYRLDTIKNDEGT

SEQ ID NO: 3026952 - protein, 24 aa, Entamoeba invadens
KAHQNFPCIPFFGVYLQDLTFIHE

SEQ ID NO: 3026953 - protein, 22 aa, Entamoeba invadens
KAKEVFRILFTLVSSLQEDDCL

SEQ ID NO: 3026954 - protein, 24 aa, Entamoeba invadens
KAKVFFEQLFRMPFYLPANGDVVT

SEQ ID NO: 3026955 - protein, 25 aa, Entamoeba invadens
KALASLIIRIALAKTFCTKCAVLAL

SEQ ID NO: 3026956 - protein, 27 aa, Entamoeba invadens
KAQDYINWPMYYLGLKDQKPPLTGESS

SEQ ID NO: 3026957 - protein, 22 aa, Entamoeba invadens
KATMHHLCLLRAKLVKYKKELA

SEQ ID NO: 3026958 - protein, 20 aa, Entamoeba invadens
KAVWWVIFIGKIDIPDVVVN

SEQ ID NO: 3026959 - protein, 25 aa, Entamoeba invadens
KCGVPFFWVRLLYKLGLFMSYTPSD

SEQ ID NO: 3026960 - protein, 18 aa, Entamoeba invadens
KCHNLHPKKLLCPLYFMG

SEQ ID NO: 3026961 - protein, 18 aa, Entamoeba invadens
KCPIIGKKNMKYIIPNNV

SEQ ID NO: 3026962 - protein, 18 aa, Entamoeba invadens
KCPLSSLWKLLASTPMNT

SEQ ID NO: 3026963 - protein, 17 aa, Entamoeba invadens
KCPSRKNVPLPKGRKRM

SEQ ID NO: 3026964 - protein, 29 aa, Entamoeba invadens
KCSTIPERVYWKWFLRLSEIPRPSYHCLP

SEQ ID NO: 3026965 - protein, 25 aa, Entamoeba invadens
KCTLCGFNWFNAYYTPGVSRISTNI

SEQ ID NO: 3026966 - protein, 17 aa, Entamoeba invadens
KCVECESGFYPNAKWRL

SEQ ID NO: 3026967 - protein, 24 aa, Entamoeba invadens
KDDKMLLPPLPPITPIKRMADEKE

SEQ ID NO: 3026968 - protein, 20 aa, Entamoeba invadens
KDDLLEIPLPDKSLAKVSSK

SEQ ID NO: 3026969 - protein, 17 aa, Entamoeba invadens
KDDLVVSPLFKMSPLPP

SEQ ID NO: 3026970 - protein, 23 aa, Entamoeba invadens
KDDLWVVLPQEYPYKLSSRFYVV

SEQ ID NO: 3026971 - protein, 18 aa, Entamoeba invadens
KDGNMFYCYTYLVKNKSG

SEQ ID NO: 3026972 - protein, 23 aa, Entamoeba invadens
KDGRLFYCYTYLVKNKAGEEHEQ

SEQ ID NO: 3026973 - protein, 21 aa, Entamoeba invadens
KDGVKFVYFLLSKKFQQSATY

SEQ ID NO: 3026974 - protein, 20 aa, Entamoeba invadens
KDHWGLLIKLKLFQSVQYKK

SEQ ID NO: 3026975 - protein, 20 aa, Entamoeba invadens
KDIKLPLLPPLRPKTPKPTE

SEQ ID NO: 3026976 - protein, 24 aa, Entamoeba invadens
KDIRNQRWLLRKVLNIDLREKMEK

SEQ ID NO: 3026977 - protein, 24 aa, Entamoeba invadens
KDISYFFCYKWNALLFKRFFKTED

SEQ ID NO: 3026978 - protein, 21 aa, Entamoeba invadens
KDIVYIWFRAIKDIGDFCFCE

SEQ ID NO: 3026979 - protein, 25 aa, Entamoeba invadens
KDKEKLRFVLIVRLLIEMVEKETDL

SEQ ID NO: 3026980 - protein, 22 aa, Entamoeba invadens
KDKMFRTMFFYKLIQQVVSVYT

SEQ ID NO: 3026981 - protein, 23 aa, Entamoeba invadens
KDKNVSFLLATPQSKFLFEAEDR

SEQ ID NO: 3026982 - protein, 21 aa, Entamoeba invadens
KDLDGKVFRTTKIKLVCIDDC

SEQ ID NO: 3026983 - protein, 20 aa, Entamoeba invadens
KDMFKDFDLIQTLWKMTCEI

SEQ ID NO: 3026984 - protein, 21 aa, Entamoeba invadens
KDMLFIVTSAFWMKTDGKVTF

SEQ ID NO: 3026985 - protein, 23 aa, Entamoeba invadens
KDNNFFCFVLKSPVIKEPIKVMR

SEQ ID NO: 3026986 - protein, 18 aa, Entamoeba invadens
KDPYLDKQFKFAWDIVDF

SEQ ID NO: 3026987 - protein, 23 aa, Entamoeba invadens
KDQLRLFLVKFPIKNYKSLEKKV

SEQ ID NO: 3026988 - protein, 20 aa, Entamoeba invadens
KDRDNIIYVLRFDKRFALFC

SEQ ID NO: 3026989 - protein, 18 aa, Entamoeba invadens
KDRKLVWFGGIRLSSKEY

SEQ ID NO: 3026990 - protein, 24 aa, Entamoeba invadens
KDRQDYLKLPYKLKIRMLFDTAKG

SEQ ID NO: 3026991 - protein, 19 aa, Entamoeba invadens
KDYPAVVGLLFELLDRLEK

SEQ ID NO: 3026992 - protein, 25 aa, Entamoeba invadens
KEDDAIYNGFYLLGNKWSKIAKNLE

SEQ ID NO: 3026993 - protein, 22 aa, Entamoeba invadens
KEEFSMILQIKLIYEKFNEINE

SEQ ID NO: 3026994 - protein, 25 aa, Entamoeba invadens
KEERDILLFLPLYTTILARGSTQPL

SEQ ID NO: 3026995 - protein, 24 aa, Entamoeba invadens
KEFKPLFVTKLKFPGQFDIAFPVE

SEQ ID NO: 3026996 - protein, 28 aa, Entamoeba invadens
KEGSLPFYMIIIWLLKSINLQLIKKYFT

SEQ ID NO: 3026997 - protein, 25 aa, Entamoeba invadens
KEKDEEFCCFLLPDYLFMAKIRRDE

SEQ ID NO: 3026998 - protein, 24 aa, Entamoeba invadens
KEKEDFVILPYKLKVRMLFDTARG

SEQ ID NO: 3026999 - protein, 18 aa, Entamoeba invadens
KEKTEVTNFFYLSKQLYY

SEQ ID NO: 3027000 - protein, 21 aa, Entamoeba invadens
KELFIDILLPDEPLLFFIEND

SEQ ID NO: 3027001 - protein, 22 aa, Entamoeba invadens
KELLYELRFYLMTQSALRNDLI

SEQ ID NO: 3027002 - protein, 17 aa, Entamoeba invadens
KEMRFVHRWLQSKLPDK

SEQ ID NO: 3027003 - protein, 20 aa, Entamoeba invadens
KEMRYIHRWLVTKFPDKTVF

SEQ ID NO: 3027004 - protein, 23 aa, Entamoeba invadens
KENLALINLYMSYPTEFITLKEQ

SEQ ID NO: 3027005 - protein, 18 aa, Entamoeba invadens
KENPPPLLFLSFHTEVYD

SEQ ID NO: 3027006 - protein, 20 aa, Entamoeba invadens
KEQAIWFLNAYWAENGEAVA

SEQ ID NO: 3027007 - protein, 21 aa, Entamoeba invadens
KEQAIWMLNAMWPSTKSAKAE

SEQ ID NO: 3027008 - protein, 28 aa, Entamoeba invadens
KEQQKFFEWMKYAFHATNFFELYLECRP

SEQ ID NO: 3027009 - protein, 23 aa, Entamoeba invadens
KEQQQFFIRPWRKFVLETQVDLL

SEQ ID NO: 3027010 - protein, 20 aa, Entamoeba invadens
KERFLACEAYFQPSLLNLEC

SEQ ID NO: 3027011 - protein, 19 aa, Entamoeba invadens
KERHDLMFIATYDKDVYYP

SEQ ID NO: 3027012 - protein, 23 aa, Entamoeba invadens
KERKWVDVYWLKAKIFGGVCSLE

SEQ ID NO: 3027013 - protein, 19 aa, Entamoeba invadens
KEVTLLGCWFHFKQAIFKK

SEQ ID NO: 3027014 - protein, 30 aa, Entamoeba invadens
KEYVNLFFSFLDKQLFVYLLRTCPKITQDM

SEQ ID NO: 3027015 - protein, 20 aa, Entamoeba invadens
KFDRGLLLGFFRFMEVMKGM

SEQ ID NO: 3027016 - protein, 17 aa, Entamoeba invadens
KFDSYIFWSLTIPNKTK

SEQ ID NO: 3027017 - protein, 19 aa, Entamoeba invadens
KFECVMPNSIWPYPSYEEI

SEQ ID NO: 3027018 - protein, 24 aa, Entamoeba invadens
KFEHPIRAIPYIPLFGQPLKVVMV

SEQ ID NO: 3027019 - protein, 20 aa, Entamoeba invadens
KFENYFIATKYKFGVLYAAA

SEQ ID NO: 3027020 - protein, 17 aa, Entamoeba invadens
KFFPKYTKTEFLVNRMK

SEQ ID NO: 3027021 - protein, 24 aa, Entamoeba invadens
KFHFNPIPLIFKTLGYFSNIETLH

SEQ ID NO: 3027022 - protein, 20 aa, Entamoeba invadens
KFIILLKKGKNKNAFFVMSN

SEQ ID NO: 3027023 - protein, 20 aa, Entamoeba invadens
KFILPFLFKHNNLEYLVRMR

SEQ ID NO: 3027024 - protein, 20 aa, Entamoeba invadens
KFLEMLAFPPNLTGLILHEC

SEQ ID NO: 3027025 - protein, 18 aa, Entamoeba invadens
KFLERYLGFYVRLDSKEW

SEQ ID NO: 3027026 - protein, 26 aa, Entamoeba invadens
KFLSDIALIFLFLYSTKVRPSAKYFV

SEQ ID NO: 3027027 - protein, 17 aa, Entamoeba invadens
KFLYKVLVLRIFETEEN

SEQ ID NO: 3027028 - protein, 18 aa, Entamoeba invadens
KFMEFLTIPYMIDNVILL

SEQ ID NO: 3027029 - protein, 20 aa, Entamoeba invadens
KFPINKLIPLTYHCTQIVVV

SEQ ID NO: 3027030 - protein, 25 aa, Entamoeba invadens
KFQDQAVWMLNALWLKEKDAHAEEI

SEQ ID NO: 3027031 - protein, 26 aa, Entamoeba invadens
KFQDQAVWMLNAMWLKEKDARAEELW

SEQ ID NO: 3027032 - protein, 21 aa, Entamoeba invadens
KFQIHFIDFTGLGISIFGCKQ

SEQ ID NO: 3027033 - protein, 17 aa, Entamoeba invadens
KFRVYKIPLPPPSNEHP

SEQ ID NO: 3027034 - protein, 20 aa, Entamoeba invadens
KFTKVAALFALIENKMRNRI

SEQ ID NO: 3027035 - protein, 20 aa, Entamoeba invadens
KFVSKYEKTLFPSEFALLID

SEQ ID NO: 3027036 - protein, 27 aa, Entamoeba invadens
KFYDSFVQWQFWRLKNLGKILFGKRYT

SEQ ID NO: 3027037 - protein, 23 aa, Entamoeba invadens
KGAMIFWFAYMPLQGTRKEFTEM

SEQ ID NO: 3027038 - protein, 23 aa, Entamoeba invadens
KGDHPPITPLTYPQFALGDGEMR

SEQ ID NO: 3027039 - protein, 18 aa, Entamoeba invadens
KGILSWLIHNVWITKKLN

SEQ ID NO: 3027040 - protein, 20 aa, Entamoeba invadens
KGIPAFWFCVLRNSMLFDSA

SEQ ID NO: 3027041 - protein, 19 aa, Entamoeba invadens
KGKILANLYLIVCYDFCVK

SEQ ID NO: 3027042 - protein, 21 aa, Entamoeba invadens
KGLNYKTWFPFYNLYSNSYDG

SEQ ID NO: 3027043 - protein, 22 aa, Entamoeba invadens
KGMEHFLDMFFEYTKTIVPNIE

SEQ ID NO: 3027044 - protein, 17 aa, Entamoeba invadens
KGMLWWISYFGFDGICQ

SEQ ID NO: 3027045 - protein, 17 aa, Entamoeba invadens
KGPNDFFYAFVEYGKEE

SEQ ID NO: 3027046 - protein, 24 aa, Entamoeba invadens
KGQLKHFIPLIWAKGGLFLDKILY

SEQ ID NO: 3027047 - protein, 26 aa, Entamoeba invadens
KGVDLWKIIFFIAVKYIEINGKPKDF

SEQ ID NO: 3027048 - protein, 20 aa, Entamoeba invadens
KGVKIGWLYCLRGYDCGYVP

SEQ ID NO: 3027049 - protein, 19 aa, Entamoeba invadens
KGWDKLRWDDFLALKEEMQ

SEQ ID NO: 3027050 - protein, 19 aa, Entamoeba invadens
KGWEWFIIEKSPEKKMYTI

SEQ ID NO: 3027051 - protein, 18 aa, Entamoeba invadens
KGWKLLPLETQLIMTLRI

SEQ ID NO: 3027052 - protein, 17 aa, Entamoeba invadens
KGYDWDGLFQKKITPPY

SEQ ID NO: 3027053 - protein, 23 aa, Entamoeba invadens
KHHLFISIFIPKNSNFDWIISQA

SEQ ID NO: 3027054 - protein, 20 aa, Entamoeba invadens
KHIFYFAVIAYLMQIRDDIM

SEQ ID NO: 3027055 - protein, 18 aa, Entamoeba invadens
KHKAILIRIIPNLSFEII

SEQ ID NO: 3027056 - protein, 19 aa, Entamoeba invadens
KHLAALPLDKFQIALDMHV

SEQ ID NO: 3027057 - protein, 24 aa, Entamoeba invadens
KHPDLAIPLWYSFGTVVILLEEVV

SEQ ID NO: 3027058 - protein, 23 aa, Entamoeba invadens
KHQLRALLYFLQIERRNAILNLF

SEQ ID NO: 3027059 - protein, 20 aa, Entamoeba invadens
KHSLFIILFDKKGNIFGAYL

SEQ ID NO: 3027060 - protein, 18 aa, Entamoeba invadens
KHWMGKGTPILALADLNK

SEQ ID NO: 3027061 - protein, 20 aa, Entamoeba invadens
KHYFDCIFGPYKSFVLKGIE

SEQ ID NO: 3027062 - protein, 23 aa, Entamoeba invadens
KHYVAIPFIKFAPFKTALIKLAT

SEQ ID NO: 3027063 - protein, 18 aa, Entamoeba invadens
KIDEKTLWILMDLCAVGS

SEQ ID NO: 3027064 - protein, 21 aa, Entamoeba invadens
KIDFFKIVVWFTVSYNTSLNT

SEQ ID NO: 3027065 - protein, 23 aa, Entamoeba invadens
KIDHSFIPYAISQPFFLLTKTSS

SEQ ID NO: 3027066 - protein, 19 aa, Entamoeba invadens
KIEEQLNLVKIERDKTSGE

SEQ ID NO: 3027067 - protein, 19 aa, Entamoeba invadens
KIFVQNTLPFFAKKLEIPS

SEQ ID NO: 3027068 - protein, 20 aa, Entamoeba invadens
KIGVRGGFPHGFNPADIKLK

SEQ ID NO: 3027069 - protein, 26 aa, Entamoeba invadens
KIHINFCFKIFRVLPNALYLNKTKPI

SEQ ID NO: 3027070 - protein, 22 aa, Entamoeba invadens
KIIFNYNIYLYDHLLFSGCVSL

SEQ ID NO: 3027071 - protein, 19 aa, Entamoeba invadens
KIIFYLWSPSKCSLKEKVI

SEQ ID NO: 3027072 - protein, 20 aa, Entamoeba invadens
KIIFYLWSPSKCSLKEKVIF

SEQ ID NO: 3027073 - protein, 17 aa, Entamoeba invadens
KIIKLMLLPFRTVLYSQ

SEQ ID NO: 3027074 - protein, 22 aa, Entamoeba invadens
KIKADLIVVLFIEIFRAIDSDM

SEQ ID NO: 3027075 - protein, 22 aa, Entamoeba invadens
KIKECHLITFRGYSKGFAFVEY

SEQ ID NO: 3027076 - protein, 21 aa, Entamoeba invadens
KILCLWDIRMLKLPTITFDNR

SEQ ID NO: 3027077 - protein, 37 aa, Entamoeba invadens
KILILQNNFIPLGLFTKLLRFLRLLLKFNQFKDNEGL

SEQ ID NO: 3027078 - protein, 26 aa, Entamoeba invadens
KILKQLPLRYFIIPALMSQQPRLMKL

SEQ ID NO: 3027079 - protein, 17 aa, Entamoeba invadens
KILMERLLVSKPLQVGV

SEQ ID NO: 3027080 - protein, 17 aa, Entamoeba invadens
KIMIYLINLSDIKSLEY

SEQ ID NO: 3027081 - protein, 18 aa, Entamoeba invadens
KIMVFKNRKLQLLIYDIE

SEQ ID NO: 3027082 - protein, 22 aa, Entamoeba invadens
KINELILPLHYYFKNLFDKMST

SEQ ID NO: 3027083 - protein, 17 aa, Entamoeba invadens
KINIYKPSQSKLHTSTS

SEQ ID NO: 3027084 - protein, 18 aa, Entamoeba invadens
KIPEDFFYLTDKGGRYKT

SEQ ID NO: 3027085 - protein, 17 aa, Entamoeba invadens
KIPFIKKVAKPIYKTAK

SEQ ID NO: 3027086 - protein, 17 aa, Entamoeba invadens
KIPLFCILITKDVFFRV

SEQ ID NO: 3027087 - protein, 28 aa, Entamoeba invadens
KIPNLFAYYYYYTISYSKAFFLLSKSLT

SEQ ID NO: 3027088 - protein, 22 aa, Entamoeba invadens
KIRADFMVVLFIEFFRAIDTNM

SEQ ID NO: 3027089 - protein, 22 aa, Entamoeba invadens
KIRSKKILSLEEQLALVESVVS

SEQ ID NO: 3027090 - protein, 22 aa, Entamoeba invadens
KISEELPDLLMRHCTLLAFNGG

SEQ ID NO: 3027091 - protein, 23 aa, Entamoeba invadens
KISFFEILIWYKVSYTFTQHKKS

SEQ ID NO: 3027092 - protein, 24 aa, Entamoeba invadens
KISFFEILIWYKVSYTFTQHKKST

SEQ ID NO: 3027093 - protein, 18 aa, Entamoeba invadens
KITALITKLPPYTFYMCF

SEQ ID NO: 3027094 - protein, 28 aa, Entamoeba invadens
KITPPLVKAPLLFVTLRKWLANVPLEYV

SEQ ID NO: 3027095 - protein, 19 aa, Entamoeba invadens
KIVAFFLFYHENCEFQWDT

SEQ ID NO: 3027096 - protein, 19 aa, Entamoeba invadens
KIVCLSSVRFLIFDEADRM

SEQ ID NO: 3027097 - protein, 22 aa, Entamoeba invadens
KIVYTDGFLFFYKNSSEPNFVL

SEQ ID NO: 3027098 - protein, 19 aa, Entamoeba invadens
KIYGFYLYIDEAHSIGALG

SEQ ID NO: 3027099 - protein, 20 aa, Entamoeba invadens
KIYSSRLTLLRPLLEVLIEK

SEQ ID NO: 3027100 - protein, 17 aa, Entamoeba invadens
KIYVYDALTEVYVWVGP

SEQ ID NO: 3027101 - protein, 27 aa, Entamoeba invadens
KKCDVWPRLVHLYHYFGEKYTTFLDVQ

SEQ ID NO: 3027102 - protein, 21 aa, Entamoeba invadens
KKCGWRFPLPIYRSIQFLKQK

SEQ ID NO: 3027103 - protein, 20 aa, Entamoeba invadens
KKDITVIPLPKQSFGKSILE

SEQ ID NO: 3027104 - protein, 20 aa, Entamoeba invadens
KKEFFRIIVWFNVDFETVDK

SEQ ID NO: 3027105 - protein, 18 aa, Entamoeba invadens
KKEFYQIIVWFTVDFDTF

SEQ ID NO: 3027106 - protein, 19 aa, Entamoeba invadens
KKEFYQIIVWFTVDFDTFN

SEQ ID NO: 3027107 - protein, 18 aa, Entamoeba invadens
KKEFYRIIVWFNVDFETV

SEQ ID NO: 3027108 - protein, 20 aa, Entamoeba invadens
KKEFYRIIVWFNVDFETVDR

SEQ ID NO: 3027109 - protein, 18 aa, Entamoeba invadens
KKEFYRIIVWYCVDFETV

SEQ ID NO: 3027110 - protein, 24 aa, Entamoeba invadens
KKFCSLELKFPQNLVGRFAELWAM

SEQ ID NO: 3027111 - protein, 22 aa, Entamoeba invadens
KKFIRDLPQPIWPEEFLQPLVK

SEQ ID NO: 3027112 - protein, 20 aa, Entamoeba invadens
KKGILLLLFGGVHKTTKEGI

SEQ ID NO: 3027113 - protein, 24 aa, Entamoeba invadens
KKHNLVIRIPSSKPLLIASPKPTQ

SEQ ID NO: 3027114 - protein, 19 aa, Entamoeba invadens
KKHPWFEGIDWDKLLAKQL

SEQ ID NO: 3027115 - protein, 20 aa, Entamoeba invadens
KKIELLHLLIDLLEIRGGFD

SEQ ID NO: 3027116 - protein, 20 aa, Entamoeba invadens
KKIYGFYLYIDEAHSIGALG

SEQ ID NO: 3027117 - protein, 19 aa, Entamoeba invadens
KKIYVNAGVDKKFLKYLAI

SEQ ID NO: 3027118 - protein, 17 aa, Entamoeba invadens
KKKMLPFPESDLKFWDC

SEQ ID NO: 3027119 - protein, 20 aa, Entamoeba invadens
KKKRTLIMPWNPHQNDEVEN

SEQ ID NO: 3027120 - protein, 19 aa, Entamoeba invadens
KKLPYFWYYVVVNSSWAER

SEQ ID NO: 3027121 - protein, 20 aa, Entamoeba invadens
KKMMYAFNDFKMYLPLGPEK

SEQ ID NO: 3027122 - protein, 19 aa, Entamoeba invadens
KKNRLCPEKYLYMFETHIE

SEQ ID NO: 3027123 - protein, 20 aa, Entamoeba invadens
KKNYLAQKKLLKFLKQQVVK

SEQ ID NO: 3027124 - protein, 20 aa, Entamoeba invadens
KKPRAPPKRKRVYFFVEDLD

SEQ ID NO: 3027125 - protein, 19 aa, Entamoeba invadens
KKPSRLFEIMLVYGLKNIK

SEQ ID NO: 3027126 - protein, 18 aa, Entamoeba invadens
KKQKRLFYIPPVSQTDQS

SEQ ID NO: 3027127 - protein, 24 aa, Entamoeba invadens
KKQWKFLQKYYHIGSFFLDGSDWD

SEQ ID NO: 3027128 - protein, 17 aa, Entamoeba invadens
KKRFWRETYGGAKLFMM

SEQ ID NO: 3027129 - protein, 18 aa, Entamoeba invadens
KKRIFINNFLVDVALELG

SEQ ID NO: 3027130 - protein, 24 aa, Entamoeba invadens
KKRLDLVLLLLKYGANINIKNVSG

SEQ ID NO: 3027131 - protein, 17 aa, Entamoeba invadens
KKRLPKVLGLLEAYRIL

SEQ ID NO: 3027132 - protein, 23 aa, Entamoeba invadens
KKRVMLELLLDNKIFRLAFDSDA

SEQ ID NO: 3027133 - protein, 24 aa, Entamoeba invadens
KKSDYLWTLFFNDLSLFDARRIQS

SEQ ID NO: 3027134 - protein, 23 aa, Entamoeba invadens
KKSYGVPYCLKLLELFYKTNVID

SEQ ID NO: 3027135 - protein, 21 aa, Entamoeba invadens
KKSYPLALNYLKKALNLAKGD

SEQ ID NO: 3027136 - protein, 25 aa, Entamoeba invadens
KKTEEFLFILESKLKLKKAEDLYTS

SEQ ID NO: 3027137 - protein, 17 aa, Entamoeba invadens
KKTVPFLLEKLLADAWN

SEQ ID NO: 3027138 - protein, 29 aa, Entamoeba invadens
KKTVVDLIYFWFFQAFSKLLNKLKIKTLK

SEQ ID NO: 3027139 - protein, 22 aa, Entamoeba invadens
KKWKKRYLLWKGMTLYLFDKKG

SEQ ID NO: 3027140 - protein, 17 aa, Entamoeba invadens
KKYDDIILILQTTHLLL

SEQ ID NO: 3027141 - protein, 23 aa, Entamoeba invadens
KLAQFQIFLITHDQDFVKKMKDF

SEQ ID NO: 3027142 - protein, 18 aa, Entamoeba invadens
KLAQNLFFDVFFKVGKMS

SEQ ID NO: 3027143 - protein, 19 aa, Entamoeba invadens
KLCLIVWFEVDFETIDRIQ

SEQ ID NO: 3027144 - protein, 20 aa, Entamoeba invadens
KLCLYVFWELLRKSDDKTLL

SEQ ID NO: 3027145 - protein, 23 aa, Entamoeba invadens
KLCYYNFFLEFYYNLGTSAENKE

SEQ ID NO: 3027146 - protein, 18 aa, Entamoeba invadens
KLDKFLFFGALTTGMLNL

SEQ ID NO: 3027147 - protein, 26 aa, Entamoeba invadens
KLDPFLPIFLELFFDVSFVVFNDKTK

SEQ ID NO: 3027148 - protein, 26 aa, Entamoeba invadens
KLEHLKFDVGLLLRLVLCLTSALSYD

SEQ ID NO: 3027149 - protein, 17 aa, Entamoeba invadens
KLELYFSEYLRTNFRWI

SEQ ID NO: 3027150 - protein, 23 aa, Entamoeba invadens
KLELYGNLFFLLQTEPVYLARLI

SEQ ID NO: 3027151 - protein, 17 aa, Entamoeba invadens
KLFLVMQGLLEHCKEGL

SEQ ID NO: 3027152 - protein, 18 aa, Entamoeba invadens
KLFYFPEKFVFLKGGRPI

SEQ ID NO: 3027153 - protein, 20 aa, Entamoeba invadens
KLGMYPPLYPAVCPTGAVSD

SEQ ID NO: 3027154 - protein, 17 aa, Entamoeba invadens
KLHFLPTYLFMPSPLSD

SEQ ID NO: 3027155 - protein, 19 aa, Entamoeba invadens
KLIGEMDGILAFERGVFGF

SEQ ID NO: 3027156 - protein, 19 aa, Entamoeba invadens
KLIIYIPDRDVRMSVLLAN

SEQ ID NO: 3027157 - protein, 18 aa, Entamoeba invadens
KLIMAFFEIFVLRKVTVM

SEQ ID NO: 3027158 - protein, 23 aa, Entamoeba invadens
KLISGIYMGWLARLCIRELIKKK

SEQ ID NO: 3027159 - protein, 22 aa, Entamoeba invadens
KLKDIWWMLLVTSQMTDLNFMN

SEQ ID NO: 3027160 - protein, 27 aa, Entamoeba invadens
KLKELKVPVLFEIPFRELRFNGTIKRN

SEQ ID NO: 3027161 - protein, 17 aa, Entamoeba invadens
KLKLCFCPFCQVGIKAL

SEQ ID NO: 3027162 - protein, 23 aa, Entamoeba invadens
KLKNLFDPFGVVLKFYVIENGGK

SEQ ID NO: 3027163 - protein, 21 aa, Entamoeba invadens
KLKTKFVYYSRDWEDFLKKNQ

SEQ ID NO: 3027164 - protein, 22 aa, Entamoeba invadens
KLLLLEVVILCALAFKCEEECF

SEQ ID NO: 3027165 - protein, 25 aa, Entamoeba invadens
KLLNQLYQLFPLFYRNLGFVLSTQE

SEQ ID NO: 3027166 - protein, 26 aa, Entamoeba invadens
KLMVNMVPFPRLHFFSSSIAPLSSAL

SEQ ID NO: 3027167 - protein, 23 aa, Entamoeba invadens
KLNGWFLNIKRKENYKPFICFNC

SEQ ID NO: 3027168 - protein, 28 aa, Entamoeba invadens
KLPPLFCRYKLLPFYLDLFRSNMPEASS

SEQ ID NO: 3027169 - protein, 17 aa, Entamoeba invadens
KLQPWWIVRTCLTDQEG

SEQ ID NO: 3027170 - protein, 22 aa, Entamoeba invadens
KLRRYFEVLYIPDEAVLGAPVG

SEQ ID NO: 3027171 - protein, 25 aa, Entamoeba invadens
KLSYADLIEVCRVLCLAGASKEKTK

SEQ ID NO: 3027172 - protein, 19 aa, Entamoeba invadens
KLTIRALSGPIYDIAWTGD

SEQ ID NO: 3027173 - protein, 20 aa, Entamoeba invadens
KLVFFGLYFGIFTECAKAAA

SEQ ID NO: 3027174 - protein, 17 aa, Entamoeba invadens
KLVSWYDNEWGYSTRLV

SEQ ID NO: 3027175 - protein, 17 aa, Entamoeba invadens
KLWFRELPKPILNVLSS

SEQ ID NO: 3027176 - protein, 18 aa, Entamoeba invadens
KLYIIKKPIKIDPILKPS

SEQ ID NO: 3027177 - protein, 17 aa, Entamoeba invadens
KMFLQPLHLAPSSSVPV

SEQ ID NO: 3027178 - protein, 27 aa, Entamoeba invadens
KMIDPTFYLFRWLSLLGALELPMEVTM

SEQ ID NO: 3027179 - protein, 23 aa, Entamoeba invadens
KMKDLPVVILRPSIIYGQGDVTG

SEQ ID NO: 3027180 - protein, 18 aa, Entamoeba invadens
KMKKMFKLLLEYSVFAKN

SEQ ID NO: 3027181 - protein, 17 aa, Entamoeba invadens
KMLCWTGKELWAFKEQN

SEQ ID NO: 3027182 - protein, 18 aa, Entamoeba invadens
KMLPFPESDLKFWDCSCD

SEQ ID NO: 3027183 - protein, 25 aa, Entamoeba invadens
KMSHWYIQLLLLSPKSRRLQVLRRL

SEQ ID NO: 3027184 - protein, 20 aa, Entamoeba invadens
KNCLYGLFRILQILHKESLG

SEQ ID NO: 3027185 - protein, 17 aa, Entamoeba invadens
KNELIPFTYPPVISLCH

SEQ ID NO: 3027186 - protein, 20 aa, Entamoeba invadens
KNFKTKMLCWTGKELWAFKE

SEQ ID NO: 3027187 - protein, 25 aa, Entamoeba invadens
KNGEEYFRFLWELRLLFNKEMTQLQ

SEQ ID NO: 3027188 - protein, 24 aa, Entamoeba invadens
KNGIIASYLPLLQEWTKKKKYNVI

SEQ ID NO: 3027189 - protein, 23 aa, Entamoeba invadens
KNGRPLFSLLMSSLMKLFSEIAE

SEQ ID NO: 3027190 - protein, 21 aa, Entamoeba invadens
KNIVVYLRFGANYNKFVSGKM

SEQ ID NO: 3027191 - protein, 20 aa, Entamoeba invadens
KNKAIILWKALMKHFDEVAE

SEQ ID NO: 3027192 - protein, 22 aa, Entamoeba invadens
KNKCHTLWNPAPAPRTFDIEMI

SEQ ID NO: 3027193 - protein, 20 aa, Entamoeba invadens
KNKFYRIIVWFSVNFVIVDR

SEQ ID NO: 3027194 - protein, 25 aa, Entamoeba invadens
KNKKIFVHNFLFDIALELGFTFDSK

SEQ ID NO: 3027195 - protein, 24 aa, Entamoeba invadens
KNKRIFIHNLLFDIALELGFFFDS

SEQ ID NO: 3027196 - protein, 23 aa, Entamoeba invadens
KNKRIFVHNLLFDIALELGFFFE

SEQ ID NO: 3027197 - protein, 23 aa, Entamoeba invadens
KNKTYYYYTYRGTTFYVKVFEDG

SEQ ID NO: 3027198 - protein, 17 aa, Entamoeba invadens
KNLCEIVFPITIKKFES

SEQ ID NO: 3027199 - protein, 18 aa, Entamoeba invadens
KNLCEIVFPTTIKKFESL

SEQ ID NO: 3027200 - protein, 19 aa, Entamoeba invadens
KNLLGLTDFLARPARLPFL

SEQ ID NO: 3027201 - protein, 24 aa, Entamoeba invadens
KNNAKKFVVLTDRGLREFECQNSK

SEQ ID NO: 3027202 - protein, 19 aa, Entamoeba invadens
KNSMNILPLLSFKTPFTLG

SEQ ID NO: 3027203 - protein, 26 aa, Entamoeba invadens
KNVLQRMLDCVKNVKVIWPNDDDETK

SEQ ID NO: 3027204 - protein, 17 aa, Entamoeba invadens
KNYIALRLLFELKVQRN

SEQ ID NO: 3027205 - protein, 27 aa, Entamoeba invadens
KNYSFYKIVIWFRVFYELTFKKSKVDI

SEQ ID NO: 3027206 - protein, 19 aa, Entamoeba invadens
KPFTPIWTKSGLKALKEYK

SEQ ID NO: 3027207 - protein, 19 aa, Entamoeba invadens
KPFYACEFSIYLTPKCTCQ

SEQ ID NO: 3027208 - protein, 24 aa, Entamoeba invadens
KPHNLILHFFYNIFITLKFLWKYF

SEQ ID NO: 3027209 - protein, 18 aa, Entamoeba invadens
KPIEGIVLLFEYDKRALT

SEQ ID NO: 3027210 - protein, 17 aa, Entamoeba invadens
KPIFIIGLPRTGSTTLF

SEQ ID NO: 3027211 - protein, 17 aa, Entamoeba invadens
KPIQSIGGFLILRLICP

SEQ ID NO: 3027212 - protein, 20 aa, Entamoeba invadens
KPLHQFLRRGFYYSEIDFEE

SEQ ID NO: 3027213 - protein, 20 aa, Entamoeba invadens
KPNCFFISFDKKGSIFGGYL

SEQ ID NO: 3027214 - protein, 20 aa, Entamoeba invadens
KPPHDLLMFATKRLSEKNTL

SEQ ID NO: 3027215 - protein, 24 aa, Entamoeba invadens
KPQNLPCLVSVKYIYQPKSTKELS

SEQ ID NO: 3027216 - protein, 17 aa, Entamoeba invadens
KPTQLCYIFLFNDMLVQ

SEQ ID NO: 3027217 - protein, 24 aa, Entamoeba invadens
KPWKNQFFYYFYKTKPDLDVVLFG

SEQ ID NO: 3027218 - protein, 21 aa, Entamoeba invadens
KPYVKYLMPAVEISGLLVVDM

SEQ ID NO: 3027219 - protein, 17 aa, Entamoeba invadens
KQALFMFKYAENKIIGS

SEQ ID NO: 3027220 - protein, 22 aa, Entamoeba invadens
KQEMWFFKNIFLVFGLQLGNNK

SEQ ID NO: 3027221 - protein, 20 aa, Entamoeba invadens
KQFEYIIKFIFSFIAKDKQH

SEQ ID NO: 3027222 - protein, 19 aa, Entamoeba invadens
KQFYTVFPLFQNNAIQVQA

SEQ ID NO: 3027223 - protein, 24 aa, Entamoeba invadens
KQIGFITYFSLKTLRRLLASKSRW

SEQ ID NO: 3027224 - protein, 24 aa, Entamoeba invadens
KQIYPVPLVLLFNTKEFRNFVYSF

SEQ ID NO: 3027225 - protein, 22 aa, Entamoeba invadens
KQLLLFLSFLHSKGIIHCDIKP

SEQ ID NO: 3027226 - protein, 24 aa, Entamoeba invadens
KQNKPLRLIIMSATLRVSEFLDNT

SEQ ID NO: 3027227 - protein, 20 aa, Entamoeba invadens
KQRLLIEKVFFYPYSRDEAV

SEQ ID NO: 3027228 - protein, 23 aa, Entamoeba invadens
KQTPKFKLIGNLFYFVAEHLTED

SEQ ID NO: 3027229 - protein, 20 aa, Entamoeba invadens
KQVLLYFITSEEIRLFLMVN

SEQ ID NO: 3027230 - protein, 20 aa, Entamoeba invadens
KQYSFYPEEISAFVFSNLKK

SEQ ID NO: 3027231 - protein, 17 aa, Entamoeba invadens
KRDEFLKLLRSHQIIII

SEQ ID NO: 3027232 - protein, 20 aa, Entamoeba invadens
KRDMSFVIAFLLYKGVIVRE

SEQ ID NO: 3027233 - protein, 23 aa, Entamoeba invadens
KREFYQIIVWFNVDFETVDRNIS

SEQ ID NO: 3027234 - protein, 22 aa, Entamoeba invadens
KREFYRIIVWFYVGFEIVDRNK

SEQ ID NO: 3027235 - protein, 23 aa, Entamoeba invadens
KREKIIFYLWTPAACFIKEKMVY

SEQ ID NO: 3027236 - protein, 17 aa, Entamoeba invadens
KREKIIFYLWTPAACSI

SEQ ID NO: 3027237 - protein, 19 aa, Entamoeba invadens
KREPFMCPALYLISPSQES

SEQ ID NO: 3027238 - protein, 19 aa, Entamoeba invadens
KRFFLFTLIEIFQANVYLS

SEQ ID NO: 3027239 - protein, 17 aa, Entamoeba invadens
KRGFLRCFIPNEVTKIK

SEQ ID NO: 3027240 - protein, 21 aa, Entamoeba invadens
KRIGYLALMLLLDETQEVLTL

SEQ ID NO: 3027241 - protein, 30 aa, Entamoeba invadens
KRKYDKILAYIFLFMTFIPDSLKSPDELSS

SEQ ID NO: 3027242 - protein, 22 aa, Entamoeba invadens
KRLFSKFLYIFIQMCKTTQIGN

SEQ ID NO: 3027243 - protein, 20 aa, Entamoeba invadens
KRLFSLSFKKRIFSLEVVII

SEQ ID NO: 3027244 - protein, 25 aa, Entamoeba invadens
KRLNELYGPLLQEKNEKDKQIEFGN

SEQ ID NO: 3027245 - protein, 25 aa, Entamoeba invadens
KRNERLPLLSFKTPSTLGTNSEIGR

SEQ ID NO: 3027246 - protein, 28 aa, Entamoeba invadens
KRQTFIEKLIFYNILQWLDKLNVTVPIP

SEQ ID NO: 3027247 - protein, 22 aa, Entamoeba invadens
KRRIFVIPYLMYSTMERAVKPG

SEQ ID NO: 3027248 - protein, 19 aa, Entamoeba invadens
KRSFKGAPVFCFFCGGEGH

SEQ ID NO: 3027249 - protein, 20 aa, Entamoeba invadens
KRVLFLLSDCLLLTKREDRL

SEQ ID NO: 3027250 - protein, 21 aa, Entamoeba invadens
KRWRAYKYHFFLPFNTAKDLC

SEQ ID NO: 3027251 - protein, 17 aa, Entamoeba invadens
KRYIKLFLFDGVKYRVA

SEQ ID NO: 3027252 - protein, 21 aa, Entamoeba invadens
KSAIWLYLRLIFEENKDYKKL

SEQ ID NO: 3027253 - protein, 22 aa, Entamoeba invadens
KSALQLFLRQLPTDSTFDIVSF

SEQ ID NO: 3027254 - protein, 34 aa, Entamoeba invadens
KSDDEIFVSIEYLFFDALWVPLKMEILEEEIEED

SEQ ID NO: 3027255 - protein, 25 aa, Entamoeba invadens
KSDIYSLGIVFWEIFRRVVFGAYTK

SEQ ID NO: 3027256 - protein, 21 aa, Entamoeba invadens
KSDRSLYTLLFHLIDDDNSGT

SEQ ID NO: 3027257 - protein, 18 aa, Entamoeba invadens
KSDSVYCIVYINSIYRPV

SEQ ID NO: 3027258 - protein, 23 aa, Entamoeba invadens
KSENFFNVVVWYPVPYKVYHETQ

SEQ ID NO: 3027259 - protein, 21 aa, Entamoeba invadens
KSFHPVLTTIPLYFDSHNKAI

SEQ ID NO: 3027260 - protein, 22 aa, Entamoeba invadens
KSFLEKYPKIMFFKTSLQNPDE

SEQ ID NO: 3027261 - protein, 20 aa, Entamoeba invadens
KSGLFHLILRDYGLLDSAKM

SEQ ID NO: 3027262 - protein, 24 aa, Entamoeba invadens
KSGLLILEMFWRNEMYILKFAPFC

SEQ ID NO: 3027263 - protein, 23 aa, Entamoeba invadens
KSHLLYFIFSRDTIFGMWMGFPV

SEQ ID NO: 3027264 - protein, 17 aa, Entamoeba invadens
KSIFFCPPFWMRTSNDV

SEQ ID NO: 3027265 - protein, 26 aa, Entamoeba invadens
KSILDSAFFIISYLRDFPFMRMNKEL

SEQ ID NO: 3027266 - protein, 25 aa, Entamoeba invadens
KSINNVLYFKAIILGVKLALLDKES

SEQ ID NO: 3027267 - protein, 24 aa, Entamoeba invadens
KSIYNFFVVNIWYPVDYSTSMCPQ

SEQ ID NO: 3027268 - protein, 22 aa, Entamoeba invadens
KSKRMVLPLIKSYLDNFPPELV

SEQ ID NO: 3027269 - protein, 20 aa, Entamoeba invadens
KSKWILLKPFIQCFGIPPSF

SEQ ID NO: 3027270 - protein, 25 aa, Entamoeba invadens
KSLNNIIFYILFKRKSSITFKTNMS

SEQ ID NO: 3027271 - protein, 18 aa, Entamoeba invadens
KSMRPLFNQKPVILVLNK

SEQ ID NO: 3027272 - protein, 22 aa, Entamoeba invadens
KSNVFLLLLTTIKNFYCCQLGT

SEQ ID NO: 3027273 - protein, 25 aa, Entamoeba invadens
KSNYNFERPFLWIARKLTGNPNLQF

SEQ ID NO: 3027274 - protein, 25 aa, Entamoeba invadens
KSQKDLIRIPLTSPLLLVDDLINRM

SEQ ID NO: 3027275 - protein, 21 aa, Entamoeba invadens
KSSWRFPIPLFRSIQYLIEND

SEQ ID NO: 3027276 - protein, 22 aa, Entamoeba invadens
KSTKIIYKNLPLKYVIHGTEST

SEQ ID NO: 3027277 - protein, 21 aa, Entamoeba invadens
KTAIFFKAIASIGLYLAGRSE

SEQ ID NO: 3027278 - protein, 18 aa, Entamoeba invadens
KTALWFTDSLDILPITIL

SEQ ID NO: 3027279 - protein, 26 aa, Entamoeba invadens
KTDRQRFFCVIFWYPVSYSTTRKYTN

SEQ ID NO: 3027280 - protein, 20 aa, Entamoeba invadens
KTFLNTLLLFKITGSLKKEV

SEQ ID NO: 3027281 - protein, 22 aa, Entamoeba invadens
KTFNFPLFCLVSQPVLSLLSTG

SEQ ID NO: 3027282 - protein, 20 aa, Entamoeba invadens
KTFVFSLKRNGIFNTKIFNV

SEQ ID NO: 3027283 - protein, 24 aa, Entamoeba invadens
KTHRRIINLLKAKYPDEILLQTDL

SEQ ID NO: 3027284 - protein, 31 aa, Entamoeba invadens
KTIAALALLFAIQSFYPSPFFILDEIDAALD

SEQ ID NO: 3027285 - protein, 24 aa, Entamoeba invadens
KTIYLRFKWFFLVSDILSPTDTVT

SEQ ID NO: 3027286 - protein, 17 aa, Entamoeba invadens
KTKWLEMFYLKTMPIEK

SEQ ID NO: 3027287 - protein, 21 aa, Entamoeba invadens
KTLFDTPKWVPPEKLVLFKAI

SEQ ID NO: 3027288 - protein, 23 aa, Entamoeba invadens
KTLHHLFLYMKYQLKSSIMAYCI

SEQ ID NO: 3027289 - protein, 18 aa, Entamoeba invadens
KTLKIFEFLYPSIRTTKI

SEQ ID NO: 3027290 - protein, 25 aa, Entamoeba invadens
KTMENYMFLSPFNSFVYLWMNQTES

SEQ ID NO: 3027291 - protein, 17 aa, Entamoeba invadens
KTNFEEFIMTWGCILLL

SEQ ID NO: 3027292 - protein, 25 aa, Entamoeba invadens
KTNKLRYFYLFNDLMIYGIGNQRII

SEQ ID NO: 3027293 - protein, 26 aa, Entamoeba invadens
KTNKSRYFYLFNDLLLYGPGVKKINV

SEQ ID NO: 3027294 - protein, 27 aa, Entamoeba invadens
KTNYFKKAFYRIVVWFGVDFETVDKNK

SEQ ID NO: 3027295 - protein, 19 aa, Entamoeba invadens
KTNYNFFLSRNYPPLAEQL

SEQ ID NO: 3027296 - protein, 17 aa, Entamoeba invadens
KTPFFWVNRKFLPLIAG

SEQ ID NO: 3027297 - protein, 18 aa, Entamoeba invadens
KTPFIFLVDAFRYNVEYV

SEQ ID NO: 3027298 - protein, 17 aa, Entamoeba invadens
KTQGIIPLFVFDGATLP

SEQ ID NO: 3027299 - protein, 23 aa, Entamoeba invadens
KTSGMYYYSTFRSPLRRFADLCV

SEQ ID NO: 3027300 - protein, 18 aa, Entamoeba invadens
KTTKLCVLILKSLKMLHP

SEQ ID NO: 3027301 - protein, 18 aa, Entamoeba invadens
KTTKLCVLILLSLQDLYN

SEQ ID NO: 3027302 - protein, 24 aa, Entamoeba invadens
KTWKKRYFVLKDKMIWYYASRHDL

SEQ ID NO: 3027303 - protein, 24 aa, Entamoeba invadens
KVDDTLYPHLLRFGQGLLARNGIL

SEQ ID NO: 3027304 - protein, 20 aa, Entamoeba invadens
KVFLLRDFFSLILKTASSEP

SEQ ID NO: 3027305 - protein, 35 aa, Entamoeba invadens
KVGVTSFKKISMINFLIFYFGYDWKEVVNAPQGGN

SEQ ID NO: 3027306 - protein, 26 aa, Entamoeba invadens
KVHKTEGFFPYRIPPRTIYGGQNIDD

SEQ ID NO: 3027307 - protein, 26 aa, Entamoeba invadens
KVIPYHYPLLMLIKPDDPNLPTFYFD

SEQ ID NO: 3027308 - protein, 21 aa, Entamoeba invadens
KVIYELFNIFWTRKGREGKFS

SEQ ID NO: 3027309 - protein, 24 aa, Entamoeba invadens
KVKECRLMIYRGYSKGFGFVEYET

SEQ ID NO: 3027310 - protein, 20 aa, Entamoeba invadens
KVKRLILHPIPFDTKRDLIT

SEQ ID NO: 3027311 - protein, 24 aa, Entamoeba invadens
KVKYPLWMLVLLESVGKLGKTFES

SEQ ID NO: 3027312 - protein, 18 aa, Entamoeba invadens
KVLPKEPRVWIYSAVIEE

SEQ ID NO: 3027313 - protein, 24 aa, Entamoeba invadens
KVLPKFLVLLYPSGLLTQIIPLAQ

SEQ ID NO: 3027314 - protein, 32 aa, Entamoeba invadens
KVNIVAPLMLFPPYNFYMCFTLSAVTLPSTLK

SEQ ID NO: 3027315 - protein, 17 aa, Entamoeba invadens
KVNRLFFFVGRTIQFLS

SEQ ID NO: 3027316 - protein, 18 aa, Entamoeba invadens
KVNSFIPWYLLNTSDKTP

SEQ ID NO: 3027317 - protein, 17 aa, Entamoeba invadens
KVPEGWFQGFLIPILTG

SEQ ID NO: 3027318 - protein, 20 aa, Entamoeba invadens
KVQWEYNFPLRLLNKDTKEE

SEQ ID NO: 3027319 - protein, 23 aa, Entamoeba invadens
KVRKYIHLFLLKKMGKVQDLNLK

SEQ ID NO: 3027320 - protein, 19 aa, Entamoeba invadens
KVVPEYFWKCVLRISPLLR

SEQ ID NO: 3027321 - protein, 19 aa, Entamoeba invadens
KVVPVIIPPVRPHLRPQVK

SEQ ID NO: 3027322 - protein, 19 aa, Entamoeba invadens
KWDIDILPLISSYYPAPIK

SEQ ID NO: 3027323 - protein, 17 aa, Entamoeba invadens
KWLEMFYLKTMPIEKSF

SEQ ID NO: 3027324 - protein, 23 aa, Entamoeba invadens
KWLENQLRHVIWKHLGYYFHNRT

SEQ ID NO: 3027325 - protein, 20 aa, Entamoeba invadens
KWNCLLMKLQRRDKRPNLVR

SEQ ID NO: 3027326 - protein, 25 aa, Entamoeba invadens
KWVPPEKLVLFKAICIMCHIIASHS

SEQ ID NO: 3027327 - protein, 19 aa, Entamoeba invadens
KWWCGNLIVVEFSETIESK

SEQ ID NO: 3027328 - protein, 21 aa, Entamoeba invadens
KYDVHWFIVDHWYLFSQLEQF

SEQ ID NO: 3027329 - protein, 24 aa, Entamoeba invadens
KYEEKRVIVLAGNKIDLGEGRVVT

SEQ ID NO: 3027330 - protein, 24 aa, Entamoeba invadens
KYEKDIAEIIRFICSANVCLPNCI

SEQ ID NO: 3027331 - protein, 20 aa, Entamoeba invadens
KYFCVGTVFGALRTSYPPTS

SEQ ID NO: 3027332 - protein, 17 aa, Entamoeba invadens
KYFIISASPLLQKSLKM

SEQ ID NO: 3027333 - protein, 18 aa, Entamoeba invadens
KYFPSLITLRFPIDKIRL

SEQ ID NO: 3027334 - protein, 22 aa, Entamoeba invadens
KYFRLGYYQLCGVVLYVFFHER

SEQ ID NO: 3027335 - protein, 22 aa, Entamoeba invadens
KYIALYIDLLLRRVGPGKEALD

SEQ ID NO: 3027336 - protein, 21 aa, Entamoeba invadens
KYIDTYIWMKGEQRKIYNKMT

SEQ ID NO: 3027337 - protein, 19 aa, Entamoeba invadens
KYILERNFYVNRIGILFGE

SEQ ID NO: 3027338 - protein, 19 aa, Entamoeba invadens
KYILLIEIIKSILSIPESH

SEQ ID NO: 3027339 - protein, 19 aa, Entamoeba invadens
KYIQRYLQKYLGKVPQKIS

SEQ ID NO: 3027340 - protein, 23 aa, Entamoeba invadens
KYISNFFHPLFEATLHTEKYKEL

SEQ ID NO: 3027341 - protein, 21 aa, Entamoeba invadens
KYIYYPIFLLADFEGFDGPFK

SEQ ID NO: 3027342 - protein, 20 aa, Entamoeba invadens
KYIYYPLFMLCDFEGFDGPY

SEQ ID NO: 3027343 - protein, 24 aa, Entamoeba invadens
KYKFANCHYLLNDYCYLANEYHYT

SEQ ID NO: 3027344 - protein, 22 aa, Entamoeba invadens
KYKNLCEIVFPTTIKKFESLIF

SEQ ID NO: 3027345 - protein, 22 aa, Entamoeba invadens
KYKNLCEIVFPTTIKKFESLIL

SEQ ID NO: 3027346 - protein, 17 aa, Entamoeba invadens
KYKYLLRQTSTKTIQLF

SEQ ID NO: 3027347 - protein, 19 aa, Entamoeba invadens
KYLPPNCYIFFLAINKKYC

SEQ ID NO: 3027348 - protein, 19 aa, Entamoeba invadens
KYLYMILELASGGELFQQI

SEQ ID NO: 3027349 - protein, 23 aa, Entamoeba invadens
KYQFNFFYLFQTLEDMLLLLCSC

SEQ ID NO: 3027350 - protein, 27 aa, Entamoeba invadens
KYRMRYSWIIFSLLIKGIIGYYNDYKV

SEQ ID NO: 3027351 - protein, 17 aa, Entamoeba invadens
KYSFYSSSLLFVYDWNT

SEQ ID NO: 3027352 - protein, 17 aa, Entamoeba invadens
KYTYQLNFLFKENPYLL

SEQ ID NO: 3027353 - protein, 26 aa, Entamoeba invadens
KYVKLYVQFFIYIRSLMQRDPQKVAF

SEQ ID NO: 3027354 - protein, 23 aa, Entamoeba invadens
LACDEVVTYTLFIGGLPPKFDVA

SEQ ID NO: 3027355 - protein, 18 aa, Entamoeba invadens
LADKKIIFFTKNGHFLLA

SEQ ID NO: 3027356 - protein, 17 aa, Entamoeba invadens
LADKKLIFFTKNGHFLL

SEQ ID NO: 3027357 - protein, 17 aa, Entamoeba invadens
LADKKMIFFTKNGHFLL

SEQ ID NO: 3027358 - protein, 18 aa, Entamoeba invadens
LAEAIRFVKIIRGQSPVC

SEQ ID NO: 3027359 - protein, 19 aa, Entamoeba invadens
LAHEYVLLMLLIYTSFKEE

SEQ ID NO: 3027360 - protein, 17 aa, Entamoeba invadens
LAIFFSHFEYRVLKIAH

SEQ ID NO: 3027361 - protein, 20 aa, Entamoeba invadens
LAKAIYMKWKGREYLREAPT

SEQ ID NO: 3027362 - protein, 19 aa, Entamoeba invadens
LAKYFYLNYLIIEQFNTID

SEQ ID NO: 3027363 - protein, 20 aa, Entamoeba invadens
LAKYFYLNYLIIEQFNTIDL

SEQ ID NO: 3027364 - protein, 25 aa, Entamoeba invadens
LALNRLQVLFWYGSPFNFDMIENVV

SEQ ID NO: 3027365 - protein, 23 aa, Entamoeba invadens
LAMCTGCWVLNSLWIDKCIEKGK

SEQ ID NO: 3027366 - protein, 19 aa, Entamoeba invadens
LAPTKIPPPPLKLPPQRLK

SEQ ID NO: 3027367 - protein, 26 aa, Entamoeba invadens
LAQRHTQMFILLRQFFLLIMSQDKSI

SEQ ID NO: 3027368 - protein, 17 aa, Entamoeba invadens
LAVALKLYNLILDKQFD

SEQ ID NO: 3027369 - protein, 25 aa, Entamoeba invadens
LAVHFFVVLFFKHYVAIPFIKFAPF

SEQ ID NO: 3027370 - protein, 21 aa, Entamoeba invadens
LAYVLPLLKHVLSQPALLPGD

SEQ ID NO: 3027371 - protein, 23 aa, Entamoeba invadens
LCDKFGHICLLYFIRHVDDKALL

SEQ ID NO: 3027372 - protein, 18 aa, Entamoeba invadens
LCDLLREFGYYLEIEKKR

SEQ ID NO: 3027373 - protein, 17 aa, Entamoeba invadens
LCDRKYSYLFWEGRINQ

SEQ ID NO: 3027374 - protein, 25 aa, Entamoeba invadens
LCNNFIPLFVIFDQLYHGLLFYCRY

SEQ ID NO: 3027375 - protein, 18 aa, Entamoeba invadens
LCVKLFAESLFSPLKHFP

SEQ ID NO: 3027376 - protein, 21 aa, Entamoeba invadens
LDAMKITPFNEVPFGLPPKYS

SEQ ID NO: 3027377 - protein, 19 aa, Entamoeba invadens
LDAVFLPKMKYEILPLAQE

SEQ ID NO: 3027378 - protein, 17 aa, Entamoeba invadens
LDDLLWIRHLPIAFLMR

SEQ ID NO: 3027379 - protein, 17 aa, Entamoeba invadens
LDDLQLLLIRDVQKVKT

SEQ ID NO: 3027380 - protein, 17 aa, Entamoeba invadens
LDEELLHNFKLVRLFFF

SEQ ID NO: 3027381 - protein, 17 aa, Entamoeba invadens
LDFLTPYTKANLILRKY

SEQ ID NO: 3027382 - protein, 18 aa, Entamoeba invadens
LDIFLPAEFPYKPPMIKF

SEQ ID NO: 3027383 - protein, 33 aa, Entamoeba invadens
LDINEMFYHRYSKYYYIDWKTKQLFYHIGPIEN

SEQ ID NO: 3027384 - protein, 22 aa, Entamoeba invadens
LDIQMYMRIAPELYLKELVVGG

SEQ ID NO: 3027385 - protein, 19 aa, Entamoeba invadens
LDIYNFFIYTFSVAPEGAT

SEQ ID NO: 3027386 - protein, 30 aa, Entamoeba invadens
LDKCEYLGLYYNTFHQWTGMTAPRVIFECR

SEQ ID NO: 3027387 - protein, 25 aa, Entamoeba invadens
LDKVCDKFYWYSLSEYTYQQELMLC

SEQ ID NO: 3027388 - protein, 36 aa, Entamoeba invadens
LDLIDYFIMPIQRLPRYKLLLEQLIKFTPPTHCDFD

SEQ ID NO: 3027389 - protein, 24 aa, Entamoeba invadens
LDLRDYLIMPVQRLPRYNLLLTDL

SEQ ID NO: 3027390 - protein, 25 aa, Entamoeba invadens
LDLRDYLIMPVQRLPRYNLLLTDLL

SEQ ID NO: 3027391 - protein, 20 aa, Entamoeba invadens
LDLYLIHLPISIKLGATFPL

SEQ ID NO: 3027392 - protein, 22 aa, Entamoeba invadens
LDNGLILIALFEALRKMKVNFK

SEQ ID NO: 3027393 - protein, 23 aa, Entamoeba invadens
LDRSLPPFFIGRCCVNLVTALQY

SEQ ID NO: 3027394 - protein, 24 aa, Entamoeba invadens
LDTETEMFLWLGNNGELRCEEHVR

SEQ ID NO: 3027395 - protein, 25 aa, Entamoeba invadens
LDVEKGHLLFWRQEYFYLRDELIAD

SEQ ID NO: 3027396 - protein, 18 aa, Entamoeba invadens
LDVLPSRRFLCCGPLYLV

SEQ ID NO: 3027397 - protein, 29 aa, Entamoeba invadens
LDVRMSLHVYRILRPFRLLEIDSIPNTYN

SEQ ID NO: 3027398 - protein, 19 aa, Entamoeba invadens
LDYEMLISFYFWDKMGYTQ

SEQ ID NO: 3027399 - protein, 21 aa, Entamoeba invadens
LDYKVFCILTYKLGQVTILKN

SEQ ID NO: 3027400 - protein, 23 aa, Entamoeba invadens
LDYLDLYLIHWPVSIKVGATFPM

SEQ ID NO: 3027401 - protein, 17 aa, Entamoeba invadens
LEDGLFFTFDFGGGTLD

SEQ ID NO: 3027402 - protein, 29 aa, Entamoeba invadens
LEERLVLKTPFFLSLKLFGGKLIPVMQET

SEQ ID NO: 3027403 - protein, 24 aa, Entamoeba invadens
LEFEKVFWPYLLISKKRYAGVFWC

SEQ ID NO: 3027404 - protein, 17 aa, Entamoeba invadens
LEFFSGIGGLRASLERS

SEQ ID NO: 3027405 - protein, 18 aa, Entamoeba invadens
LEFLTRYLTDLIGDVVVF

SEQ ID NO: 3027406 - protein, 23 aa, Entamoeba invadens
LEGLVFVFVYFMDVAHAEECVSM

SEQ ID NO: 3027407 - protein, 18 aa, Entamoeba invadens
LEILLVMCLWKIVCPEYI

SEQ ID NO: 3027408 - protein, 31 aa, Entamoeba invadens
LEKALILYRYTYIDLFAKLKMMFVAKLEGDM

SEQ ID NO: 3027409 - protein, 24 aa, Entamoeba invadens
LEKKFFSEFLTFPNVFNLLKSYCE

SEQ ID NO: 3027410 - protein, 24 aa, Entamoeba invadens
LEKLELLGRWNARGALICVTEYGA

SEQ ID NO: 3027411 - protein, 24 aa, Entamoeba invadens
LEKVKRRFVKIQKLFGLLKETRGS

SEQ ID NO: 3027412 - protein, 23 aa, Entamoeba invadens
LENFEKMHYWLNAIKWQQCFIEE

SEQ ID NO: 3027413 - protein, 22 aa, Entamoeba invadens
LENFRLWIGLRRFNVLFDESIL

SEQ ID NO: 3027414 - protein, 17 aa, Entamoeba invadens
LENIIETNKIKQLTSAR

SEQ ID NO: 3027415 - protein, 20 aa, Entamoeba invadens
LEPFYLMNVVLYIDSFNTLQ

SEQ ID NO: 3027416 - protein, 19 aa, Entamoeba invadens
LEQIKSLIPLLLGAQGRFE

SEQ ID NO: 3027417 - protein, 17 aa, Entamoeba invadens
LEQLPFYAKARRVKVLM

SEQ ID NO: 3027418 - protein, 17 aa, Entamoeba invadens
LEQWMVKDLLESIDVKP

SEQ ID NO: 3027419 - protein, 25 aa, Entamoeba invadens
LERLMKILKLVGFKVAILSGGFTYF

SEQ ID NO: 3027420 - protein, 25 aa, Entamoeba invadens
LERWEVFYDLVESLWPFVVSMRYEE

SEQ ID NO: 3027421 - protein, 23 aa, Entamoeba invadens
LETDTHFQIILLFTLEVLKDGVD

SEQ ID NO: 3027422 - protein, 19 aa, Entamoeba invadens
LETTLRFNFWDKITFKFEV

SEQ ID NO: 3027423 - protein, 17 aa, Entamoeba invadens
LFCEVALGKQWETLHDK

SEQ ID NO: 3027424 - protein, 19 aa, Entamoeba invadens
LFDRIACLILYEDALDKVK

SEQ ID NO: 3027425 - protein, 21 aa, Entamoeba invadens
LFENFVYFITNVRCRRLLTFD

SEQ ID NO: 3027426 - protein, 20 aa, Entamoeba invadens
LFEPFMWQLFSQRPTFEQCY

SEQ ID NO: 3027427 - protein, 17 aa, Entamoeba invadens
LFEPPTSFCKLAIRLEE

SEQ ID NO: 3027428 - protein, 19 aa, Entamoeba invadens
LFEYGYLFETYFTSGKNNT

SEQ ID NO: 3027429 - protein, 17 aa, Entamoeba invadens
LFFLKYPLKMEMGDRIG

SEQ ID NO: 3027430 - protein, 21 aa, Entamoeba invadens
LFFMRYLLIPFMKMPNLFKYI

SEQ ID NO: 3027431 - protein, 18 aa, Entamoeba invadens
LFFVLCDYLFNKYETMEK

SEQ ID NO: 3027432 - protein, 23 aa, Entamoeba invadens
LFGKLLGCLFIKKYIDLSVIIDK

SEQ ID NO: 3027433 - protein, 22 aa, Entamoeba invadens
LFHLVEALLSYIFPLFAEASKY

SEQ ID NO: 3027434 - protein, 25 aa, Entamoeba invadens
LFIKKLIDFLPPLPKLDLKNFKPPK

SEQ ID NO: 3027435 - protein, 20 aa, Entamoeba invadens
LFLEPLPPTTRRWLTAFIEQ

SEQ ID NO: 3027436 - protein, 19 aa, Entamoeba invadens
LFLGDILHKLTFICYGNSV

SEQ ID NO: 3027437 - protein, 17 aa, Entamoeba invadens
LFLRVICAFIATPDANN

SEQ ID NO: 3027438 - protein, 25 aa, Entamoeba invadens
LFNDTLYRRAFMFSFPVFTTAKKVI

SEQ ID NO: 3027439 - protein, 18 aa, Entamoeba invadens
LFNFTYQLAHLYFNGTNS

SEQ ID NO: 3027440 - protein, 20 aa, Entamoeba invadens
LFPLLEVILSWTYPSFAKKV

SEQ ID NO: 3027441 - protein, 26 aa, Entamoeba invadens
LFPQSFVQFLAWQRLLQIYSKLDAKN

SEQ ID NO: 3027442 - protein, 18 aa, Entamoeba invadens
LFQEFFLKKLINAERMMM

SEQ ID NO: 3027443 - protein, 17 aa, Entamoeba invadens
LFQFYNPKLSQEDFLYS

SEQ ID NO: 3027444 - protein, 24 aa, Entamoeba invadens
LFQGKLMLVWKWTTEVLMNIPCYE

SEQ ID NO: 3027445 - protein, 19 aa, Entamoeba invadens
LFRIDLFGSIVYSILIEKS

SEQ ID NO: 3027446 - protein, 17 aa, Entamoeba invadens
LFRIGFKGGIRIGKPNT

SEQ ID NO: 3027447 - protein, 17 aa, Entamoeba invadens
LFRLFLRKDYTVEVFSM

SEQ ID NO: 3027448 - protein, 17 aa, Entamoeba invadens
LFTVISYLLIHAQKEIF

SEQ ID NO: 3027449 - protein, 20 aa, Entamoeba invadens
LFVDNMGHLALYKRGLCAAS

SEQ ID NO: 3027450 - protein, 17 aa, Entamoeba invadens
LFVIGCALPLRRHLFNK

SEQ ID NO: 3027451 - protein, 24 aa, Entamoeba invadens
LFVIRRLEATLWYKAISAFYTLEN

SEQ ID NO: 3027452 - protein, 18 aa, Entamoeba invadens
LFVPFFGKVEMDVTCFVF

SEQ ID NO: 3027453 - protein, 20 aa, Entamoeba invadens
LFYETFLLPNIQTFKIKSSQ

SEQ ID NO: 3027454 - protein, 18 aa, Entamoeba invadens
LFYKLFRQDLLIASLYRN

SEQ ID NO: 3027455 - protein, 18 aa, Entamoeba invadens
LFYPSAIKSSVSFSTPGT

SEQ ID NO: 3027456 - protein, 19 aa, Entamoeba invadens
LFYTLPSCYPSEGSPLFMA

SEQ ID NO: 3027457 - protein, 24 aa, Entamoeba invadens
LGCERIIRRRFGGVKFEQKVVIRP

SEQ ID NO: 3027458 - protein, 18 aa, Entamoeba invadens
LGCKSLCKLKIPQNVEKL

SEQ ID NO: 3027459 - protein, 18 aa, Entamoeba invadens
LGCWFHFKQAIFKKVSKL

SEQ ID NO: 3027460 - protein, 18 aa, Entamoeba invadens
LGFKVDKWVPLASYIILE

SEQ ID NO: 3027461 - protein, 20 aa, Entamoeba invadens
LGFVWGLLDKFQEKKIKDLM

SEQ ID NO: 3027462 - protein, 21 aa, Entamoeba invadens
LGHVRLFTYQLCRGLCYLHSM

SEQ ID NO: 3027463 - protein, 22 aa, Entamoeba invadens
LGIGYFWNCSMLSKIVIPLGIT

SEQ ID NO: 3027464 - protein, 17 aa, Entamoeba invadens
LGLFTPFGPISRHNFHV

SEQ ID NO: 3027465 - protein, 28 aa, Entamoeba invadens
LGLLTLFYPFYWPGIFIPYVPDILFEFF

SEQ ID NO: 3027466 - protein, 17 aa, Entamoeba invadens
LGNLNFTNPMATTSTPS

SEQ ID NO: 3027467 - protein, 31 aa, Entamoeba invadens
LGQNNYMFINISNIPLILYIINSDLYTQFLT

SEQ ID NO: 3027468 - protein, 24 aa, Entamoeba invadens
LGRQNYFILRFPPDFFTDIKIYRV

SEQ ID NO: 3027469 - protein, 29 aa, Entamoeba invadens
LGSEFFYNLYLFPYLVFIGFTRCQLPVSG

SEQ ID NO: 3027470 - protein, 24 aa, Entamoeba invadens
LGSYLILPIQRLPRYQMLLIQIVN

SEQ ID NO: 3027471 - protein, 19 aa, Entamoeba invadens
LGVNKRFFLALRRLKENNQ

SEQ ID NO: 3027472 - protein, 17 aa, Entamoeba invadens
LGYFLHKAPWPLSNRDF

SEQ ID NO: 3027473 - protein, 19 aa, Entamoeba invadens
LGYNFLFNFFPHLNTLTGN

SEQ ID NO: 3027474 - protein, 21 aa, Entamoeba invadens
LHEFLNFYVILMKFVCFKLYN

SEQ ID NO: 3027475 - protein, 18 aa, Entamoeba invadens
LHFFVWKRYTLPNNKIVS

SEQ ID NO: 3027476 - protein, 17 aa, Entamoeba invadens
LHHPFLVNLYYSFQTPT

SEQ ID NO: 3027477 - protein, 19 aa, Entamoeba invadens
LHIFNTFCLIFQNSQEYKY

SEQ ID NO: 3027478 - protein, 25 aa, Entamoeba invadens
LHIVAKLILYDFQRGRLPYFIAPPT

SEQ ID NO: 3027479 - protein, 23 aa, Entamoeba invadens
LHPFVWHHVLVPILPLQLSSYPT

SEQ ID NO: 3027480 - protein, 23 aa, Entamoeba invadens
LHPTRFFDPFKFKLFPRVMTYLN

SEQ ID NO: 3027481 - protein, 18 aa, Entamoeba invadens
LHQLFPVILTLVVTKQIG

SEQ ID NO: 3027482 - protein, 27 aa, Entamoeba invadens
LHRSFDCATPLLIQWTYQAMINEFLGI

SEQ ID NO: 3027483 - protein, 24 aa, Entamoeba invadens
LHRVSLFLLFVWIKINPPFQNEIG

SEQ ID NO: 3027484 - protein, 33 aa, Entamoeba invadens
LHTLKQFYNPKYLQFLPYHFLLAIDSIRDQQPV

SEQ ID NO: 3027485 - protein, 17 aa, Entamoeba invadens
LIAAPRRTLRKSQHSAS

SEQ ID NO: 3027486 - protein, 17 aa, Entamoeba invadens
LIAGYLLHPAYLREWKG

SEQ ID NO: 3027487 - protein, 18 aa, Entamoeba invadens
LIAVAFYFRFIIFTQKDG

SEQ ID NO: 3027488 - protein, 18 aa, Entamoeba invadens
LICIYLANLFNKLNASPN

SEQ ID NO: 3027489 - protein, 24 aa, Entamoeba invadens
LIDKQFPFLFTKKDPQFGVFCKKN

SEQ ID NO: 3027490 - protein, 20 aa, Entamoeba invadens
LIDSIHFLPLILTSFLDSNI

SEQ ID NO: 3027491 - protein, 24 aa, Entamoeba invadens
LIEHLKMILKLDTKLKFVEFLNEA

SEQ ID NO: 3027492 - protein, 17 aa, Entamoeba invadens
LIELKASLKTQRDFIIQ

SEQ ID NO: 3027493 - protein, 21 aa, Entamoeba invadens
LIFQPVLGNILWYSTGKLMEF

SEQ ID NO: 3027494 - protein, 20 aa, Entamoeba invadens
LIHHFPYIMQTLFTAFQEFK

SEQ ID NO: 3027495 - protein, 17 aa, Entamoeba invadens
LIIALLKNEILQLNGEH

SEQ ID NO: 3027496 - protein, 24 aa, Entamoeba invadens
LIIKFKCISFKKLLFKFSTTAVKS

SEQ ID NO: 3027497 - protein, 19 aa, Entamoeba invadens
LIIKFPIENQIFIRRLLLL

SEQ ID NO: 3027498 - protein, 18 aa, Entamoeba invadens
LIIKGIPKILFFEPKPDN

SEQ ID NO: 3027499 - protein, 20 aa, Entamoeba invadens
LIIPCLLFLGNLASIPVHGA

SEQ ID NO: 3027500 - protein, 21 aa, Entamoeba invadens
LIKKLDWNFLIGNSKRRPKKM

SEQ ID NO: 3027501 - protein, 18 aa, Entamoeba invadens
LIKMILIGDSGVGKSCLM

SEQ ID NO: 3027502 - protein, 17 aa, Entamoeba invadens
LILFLTFSLDVSLYNFS

SEQ ID NO: 3027503 - protein, 17 aa, Entamoeba invadens
LILMFLQDKVMDAIIQY

SEQ ID NO: 3027504 - protein, 17 aa, Entamoeba invadens
LILPPKLVNFGRNCFKG

SEQ ID NO: 3027505 - protein, 17 aa, Entamoeba invadens
LIMGILGSIIPFPDHNQ

SEQ ID NO: 3027506 - protein, 18 aa, Entamoeba invadens
LIMQLLRDNLTLWTTDNA

SEQ ID NO: 3027507 - protein, 24 aa, Entamoeba invadens
LINEKFFFFLLETLNRVRDFETNK

SEQ ID NO: 3027508 - protein, 25 aa, Entamoeba invadens
LINKFLGIAIGWYIRLMKKSAINDG

SEQ ID NO: 3027509 - protein, 22 aa, Entamoeba invadens
LINKLYVIPFLKPQNIKLEFGE

SEQ ID NO: 3027510 - protein, 21 aa, Entamoeba invadens
LIPEFFYLPQFLINFNQINFA

SEQ ID NO: 3027511 - protein, 17 aa, Entamoeba invadens
LIPFFIGLQNRFTQFRL

SEQ ID NO: 3027512 - protein, 25 aa, Entamoeba invadens
LIPKEAIPMFFLWDDALDAKGDDEK

SEQ ID NO: 3027513 - protein, 17 aa, Entamoeba invadens
LIPYSLLDYLTSPMTYL

SEQ ID NO: 3027514 - protein, 24 aa, Entamoeba invadens
LIQPPMLRIKAFEPLFVIGKEYYA

SEQ ID NO: 3027515 - protein, 19 aa, Entamoeba invadens
LIQRPWFFQALEELEYFET

SEQ ID NO: 3027516 - protein, 19 aa, Entamoeba invadens
LIQYKLWRKEGYQSLEEGR

SEQ ID NO: 3027517 - protein, 17 aa, Entamoeba invadens
LIRIIPNLSFEIIEVMK

SEQ ID NO: 3027518 - protein, 22 aa, Entamoeba invadens
LISGIYLGWLSRLVIRELMQKK

SEQ ID NO: 3027519 - protein, 17 aa, Entamoeba invadens
LITLFHWNFAYESCYEN

SEQ ID NO: 3027520 - protein, 19 aa, Entamoeba invadens
LITNPFPIALIHSSLSPHQ

SEQ ID NO: 3027521 - protein, 24 aa, Entamoeba invadens
LITPIQRLPRYKLFLIDLVKCTPA

SEQ ID NO: 3027522 - protein, 18 aa, Entamoeba invadens
LIVPYLFLGAVNATKDPA

SEQ ID NO: 3027523 - protein, 17 aa, Entamoeba invadens
LIYMIIKLGFNIKIKRT

SEQ ID NO: 3027524 - protein, 17 aa, Entamoeba invadens
LIYTLLIQFFERLISSK

SEQ ID NO: 3027525 - protein, 18 aa, Entamoeba invadens
LKALLFYESAFTVSLLYS

SEQ ID NO: 3027526 - protein, 19 aa, Entamoeba invadens
LKCEVILPKKYYNTVFTRS

SEQ ID NO: 3027527 - protein, 21 aa, Entamoeba invadens
LKCNINYYLKLGKCYPCNSFD

SEQ ID NO: 3027528 - protein, 20 aa, Entamoeba invadens
LKDKTAFTLLLFPNKIKINN

SEQ ID NO: 3027529 - protein, 24 aa, Entamoeba invadens
LKDNFLCYTVLPFYIKIFESELIE

SEQ ID NO: 3027530 - protein, 18 aa, Entamoeba invadens
LKDTEVLLQKLQIMNVRS

SEQ ID NO: 3027531 - protein, 18 aa, Entamoeba invadens
LKEMYYLLTQGGVAELEL

SEQ ID NO: 3027532 - protein, 18 aa, Entamoeba invadens
LKFFLDVVSQRKLTLTSK

SEQ ID NO: 3027533 - protein, 17 aa, Entamoeba invadens
LKFKWIDPFNELGFYLF

SEQ ID NO: 3027534 - protein, 17 aa, Entamoeba invadens
LKFSIIIDLYVLSGVYP

SEQ ID NO: 3027535 - protein, 21 aa, Entamoeba invadens
LKHKRRWLWTTKRRPRRLPRT

SEQ ID NO: 3027536 - protein, 24 aa, Entamoeba invadens
LKIEFFRIIVWFNVDFETVDRNKS

SEQ ID NO: 3027537 - protein, 23 aa, Entamoeba invadens
LKIEFFRIIVWFNVDFETVNRNK

SEQ ID NO: 3027538 - protein, 17 aa, Entamoeba invadens
LKIRKRGFVSQNVYIFR

SEQ ID NO: 3027539 - protein, 24 aa, Entamoeba invadens
LKKEFFRIIVWFDVDFETVDRNKS

SEQ ID NO: 3027540 - protein, 23 aa, Entamoeba invadens
LKKEFFRIIVWFNVDFETFDRNK

SEQ ID NO: 3027541 - protein, 24 aa, Entamoeba invadens
LKKEFFRIIVWFNVDFETVDRNNS

SEQ ID NO: 3027542 - protein, 23 aa, Entamoeba invadens
LKKEFFRIIVWFNVDFKTVDRNK

SEQ ID NO: 3027543 - protein, 23 aa, Entamoeba invadens
LKKEFFRIIVWFSVNFKTVDRNK

SEQ ID NO: 3027544 - protein, 23 aa, Entamoeba invadens
LKKEFYRIIVWFNVDFETVDRNK

SEQ ID NO: 3027545 - protein, 24 aa, Entamoeba invadens
LKKEFYRIIVWFNVDFETVDRNKS

SEQ ID NO: 3027546 - protein, 23 aa, Entamoeba invadens
LKKEFYRIIVWFNVDFETVENNK

SEQ ID NO: 3027547 - protein, 24 aa, Entamoeba invadens
LKKEFYRIIVWFNVVFETVNRNKN

SEQ ID NO: 3027548 - protein, 23 aa, Entamoeba invadens
LKKEFYRIIVWFSVDFETFDRNK

SEQ ID NO: 3027549 - protein, 24 aa, Entamoeba invadens
LKKEFYRIIVWFTVDFETVYINKS

SEQ ID NO: 3027550 - protein, 24 aa, Entamoeba invadens
LKKELYRIIVWFNVDFETVDRNKS

SEQ ID NO: 3027551 - protein, 17 aa, Entamoeba invadens
LKKLMVNMVPFPRLHFF

SEQ ID NO: 3027552 - protein, 17 aa, Entamoeba invadens
LKKRMSLSFIPEDLLVS

SEQ ID NO: 3027553 - protein, 23 aa, Entamoeba invadens
LKKTFFQIIVWFDVDFETVDKNK

SEQ ID NO: 3027554 - protein, 23 aa, Entamoeba invadens
LKKTFYKIIVWYCVDFKTVCRNK

SEQ ID NO: 3027555 - protein, 19 aa, Entamoeba invadens
LKKVLSCQPHYFLKNNRCV

SEQ ID NO: 3027556 - protein, 17 aa, Entamoeba invadens
LKKYSIHLLLKLGDAMI

SEQ ID NO: 3027557 - protein, 18 aa, Entamoeba invadens
LKLFFPTTKKIKTPLKVH

SEQ ID NO: 3027558 - protein, 25 aa, Entamoeba invadens
LKLKNYIPLLVAKKLNFLKSLFGQN

SEQ ID NO: 3027559 - protein, 20 aa, Entamoeba invadens
LKLLFTLFDSFPIAVRVGTT

SEQ ID NO: 3027560 - protein, 22 aa, Entamoeba invadens
LKLYIDIFYVVKLLESAEIERL

SEQ ID NO: 3027561 - protein, 21 aa, Entamoeba invadens
LKLYLDQWGVLYKRIAVLKNR

SEQ ID NO: 3027562 - protein, 22 aa, Entamoeba invadens
LKNDDLIWITLDESYLGCERII

SEQ ID NO: 3027563 - protein, 22 aa, Entamoeba invadens
LKNSWFFYELIVKSLTMDVEAN

SEQ ID NO: 3027564 - protein, 20 aa, Entamoeba invadens
LKNYKFPVTFLIRGFVLLVN

SEQ ID NO: 3027565 - protein, 18 aa, Entamoeba invadens
LKPSWLFDSIILGKIQPR

SEQ ID NO: 3027566 - protein, 24 aa, Entamoeba invadens
LKREFFQIIVWFNVDFETVDRNKS

SEQ ID NO: 3027567 - protein, 24 aa, Entamoeba invadens
LKREFFRIIVWFNVDFETVDRNIN

SEQ ID NO: 3027568 - protein, 24 aa, Entamoeba invadens
LKREFFRIIVWFNVDFETVDRNKN

SEQ ID NO: 3027569 - protein, 23 aa, Entamoeba invadens
LKREFYRIIVWFDVNFETVDRNI

SEQ ID NO: 3027570 - protein, 24 aa, Entamoeba invadens
LKRELYRIIVWFDVDFETVDKNNS

SEQ ID NO: 3027571 - protein, 17 aa, Entamoeba invadens
LKRIVLPLNLREIPYCC

SEQ ID NO: 3027572 - protein, 24 aa, Entamoeba invadens
LKRKFFCVIVWFNVDFETVDRNKS

SEQ ID NO: 3027573 - protein, 20 aa, Entamoeba invadens
LKRVILNMKILFPLSTLFPN

SEQ ID NO: 3027574 - protein, 17 aa, Entamoeba invadens
LKSKRLTNFFWSKDNGE

SEQ ID NO: 3027575 - protein, 33 aa, Entamoeba invadens
LKSYLNLHLVPFSIPTFIFPLQEFPRTSFGKLY

SEQ ID NO: 3027576 - protein, 18 aa, Entamoeba invadens
LKTCLFFNFAYQIKHIMI

SEQ ID NO: 3027577 - protein, 20 aa, Entamoeba invadens
LKTIPKIQFLKRGIFWCCNS

SEQ ID NO: 3027578 - protein, 26 aa, Entamoeba invadens
LKVWDFRTFDFPIATFDWHKKAITSV

SEQ ID NO: 3027579 - protein, 19 aa, Entamoeba invadens
LKYNLLFNFFPLLNTLTGN

SEQ ID NO: 3027580 - protein, 18 aa, Entamoeba invadens
LKYYYYHNMSWPTLTFLA

SEQ ID NO: 3027581 - protein, 23 aa, Entamoeba invadens
LLAHPPYPRFSLFFTQTGTITDD

SEQ ID NO: 3027582 - protein, 18 aa, Entamoeba invadens
LLAPLFTFVGYQLDLLMN

SEQ ID NO: 3027583 - protein, 19 aa, Entamoeba invadens
LLAVSYYRRRFRPSIVCDG

SEQ ID NO: 3027584 - protein, 17 aa, Entamoeba invadens
LLCKIRTVRKNLRKISL

SEQ ID NO: 3027585 - protein, 20 aa, Entamoeba invadens
LLCPLYFMGFCPYGKQCKYS

SEQ ID NO: 3027586 - protein, 20 aa, Entamoeba invadens
LLCYIDFLRYWFFLREDQKW

SEQ ID NO: 3027587 - protein, 18 aa, Entamoeba invadens
LLDKLSAKKSVYLKLIIE

SEQ ID NO: 3027588 - protein, 17 aa, Entamoeba invadens
LLDLQKTFEAANNELIT

SEQ ID NO: 3027589 - protein, 19 aa, Entamoeba invadens
LLEGLRKLWWKAMDYLSAK

SEQ ID NO: 3027590 - protein, 25 aa, Entamoeba invadens
LLEICEPFLAYKIGGYVRVVSCTVG

SEQ ID NO: 3027591 - protein, 17 aa, Entamoeba invadens
LLELIILPSYMKIINNC

SEQ ID NO: 3027592 - protein, 23 aa, Entamoeba invadens
LLESKIVLFLFKVLFRCDSVYSS

SEQ ID NO: 3027593 - protein, 17 aa, Entamoeba invadens
LLFKLKYPDKIHLIRGN

SEQ ID NO: 3027594 - protein, 17 aa, Entamoeba invadens
LLFLFQKGKYTYGAFVA

SEQ ID NO: 3027595 - protein, 19 aa, Entamoeba invadens
LLFPLCLYITLKSALPNID

SEQ ID NO: 3027596 - protein, 18 aa, Entamoeba invadens
LLFSIQQYFPFLGITKNG

SEQ ID NO: 3027597 - protein, 17 aa, Entamoeba invadens
LLGAPNVIFKKCTDLGF

SEQ ID NO: 3027598 - protein, 17 aa, Entamoeba invadens
LLGRTLFYLNKGEDLLF

SEQ ID NO: 3027599 - protein, 20 aa, Entamoeba invadens
LLIKVLLYQFIICPILDDPT

SEQ ID NO: 3027600 - protein, 20 aa, Entamoeba invadens
LLILQFLVYFNKNLNDDNVE

SEQ ID NO: 3027601 - protein, 19 aa, Entamoeba invadens
LLIVAKYFLYRCDFINVIC

SEQ ID NO: 3027602 - protein, 27 aa, Entamoeba invadens
LLKDISSLFWFFKYFSPETFDNNFSEI

SEQ ID NO: 3027603 - protein, 17 aa, Entamoeba invadens
LLLFVKKVKPEYLTKIK

SEQ ID NO: 3027604 - protein, 18 aa, Entamoeba invadens
LLLGIVYHICKIDNIGLT

SEQ ID NO: 3027605 - protein, 18 aa, Entamoeba invadens
LLLLSWYSTNHMSFSKVE

SEQ ID NO: 3027606 - protein, 19 aa, Entamoeba invadens
LLLPYLQRFLRKQDDKSLQ

SEQ ID NO: 3027607 - protein, 25 aa, Entamoeba invadens
LLLREVFFVFTPPKIFGASLDDILE

SEQ ID NO: 3027608 - protein, 17 aa, Entamoeba invadens
LLLRYFFSHSRGVDLLM

SEQ ID NO: 3027609 - protein, 18 aa, Entamoeba invadens
LLMARRLLQKLNLDKTFV

SEQ ID NO: 3027610 - protein, 17 aa, Entamoeba invadens
LLMFRLYTSPEVVMTHL

SEQ ID NO: 3027611 - protein, 19 aa, Entamoeba invadens
LLNFFFDIFLYLGRHDNFI

SEQ ID NO: 3027612 - protein, 26 aa, Entamoeba invadens
LLPATTWPWYKLISAIKLFTFPPGVN

SEQ ID NO: 3027613 - protein, 25 aa, Entamoeba invadens
LLPLEKKRILFLKRWLVQLQGEDDG

SEQ ID NO: 3027614 - protein, 22 aa, Entamoeba invadens
LLPQFVHAMFDRLFIDAPKTEG

SEQ ID NO: 3027615 - protein, 21 aa, Entamoeba invadens
LLPRKILFFEANTSAVFLYQI

SEQ ID NO: 3027616 - protein, 22 aa, Entamoeba invadens
LLPYHSIFLFKTSKEWISCLTN

SEQ ID NO: 3027617 - protein, 17 aa, Entamoeba invadens
LLQILRGFLLDKSKWTV

SEQ ID NO: 3027618 - protein, 28 aa, Entamoeba invadens
LLRHSLPVIFRIFIFGSLPPNFGITLYN

SEQ ID NO: 3027619 - protein, 20 aa, Entamoeba invadens
LLSAFIPLPPEMIQVKTFIV

SEQ ID NO: 3027620 - protein, 25 aa, Entamoeba invadens
LLSAYCMPFLLYKQTILVNRDLLMK

SEQ ID NO: 3027621 - protein, 17 aa, Entamoeba invadens
LLSFSQYLNTMNLSWQQ

SEQ ID NO: 3027622 - protein, 17 aa, Entamoeba invadens
LLSTMLYVLHKDKVEKF

SEQ ID NO: 3027623 - protein, 18 aa, Entamoeba invadens
LLTRYRTNTFPTDYVPTV

SEQ ID NO: 3027624 - protein, 21 aa, Entamoeba invadens
LLVHRAIYFTALLLQFHASNL

SEQ ID NO: 3027625 - protein, 17 aa, Entamoeba invadens
LLVYPRPFLDTGNANFV

SEQ ID NO: 3027626 - protein, 19 aa, Entamoeba invadens
LLWVRHLPIAYLMRQHLIL

SEQ ID NO: 3027627 - protein, 17 aa, Entamoeba invadens
LLYLLRASGFTFSVKQT

SEQ ID NO: 3027628 - protein, 17 aa, Entamoeba invadens
LLYMDSLVFYNCYNLEE

SEQ ID NO: 3027629 - protein, 17 aa, Entamoeba invadens
LLYVGVLKWIAMSFPKQ

SEQ ID NO: 3027630 - protein, 23 aa, Entamoeba invadens
LMDIRYLQLLGVMKQLLETKRGF

SEQ ID NO: 3027631 - protein, 18 aa, Entamoeba invadens
LMEFFLQSVRKILTIGNI

SEQ ID NO: 3027632 - protein, 17 aa, Entamoeba invadens
LMGIKLLYQLLIQPDER

SEQ ID NO: 3027633 - protein, 17 aa, Entamoeba invadens
LMKLRFQFELRYFNCDQ

SEQ ID NO: 3027634 - protein, 20 aa, Entamoeba invadens
LMLFGNWFVGKSSLQLRFIF

SEQ ID NO: 3027635 - protein, 19 aa, Entamoeba invadens
LMLRLKKLKIESSSSGVIL

SEQ ID NO: 3027636 - protein, 18 aa, Entamoeba invadens
LMMWKGQTVGQYLRSTFG

SEQ ID NO: 3027637 - protein, 20 aa, Entamoeba invadens
LMQDKILNFYYSKGRQLPWR

SEQ ID NO: 3027638 - protein, 28 aa, Entamoeba invadens
LMRPGRLDQLLFIPLPDRDSRLSILKAK

SEQ ID NO: 3027639 - protein, 17 aa, Entamoeba invadens
LMVFHSLKLTTDKLRSI

SEQ ID NO: 3027640 - protein, 17 aa, Entamoeba invadens
LMYLAFDRKTILPSDCE

SEQ ID NO: 3027641 - protein, 22 aa, Entamoeba invadens
LNAAKLDRLFSKPFIKALEGNP

SEQ ID NO: 3027642 - protein, 19 aa, Entamoeba invadens
LNCNFLPISFDYLLKPIYI

SEQ ID NO: 3027643 - protein, 24 aa, Entamoeba invadens
LNCNFLPISFDYLLKPIYIRNYII

SEQ ID NO: 3027644 - protein, 26 aa, Entamoeba invadens
LNCNFLPISFDYLLKPIYIRNYILEG

SEQ ID NO: 3027645 - protein, 18 aa, Entamoeba invadens
LNCPRLRFVYLSKKVRKV

SEQ ID NO: 3027646 - protein, 25 aa, Entamoeba invadens
LNEFDVLLTFVTCNWLYGWNLPTIT

SEQ ID NO: 3027647 - protein, 22 aa, Entamoeba invadens
LNENFFCRVIWYEVDFAHYCNT

SEQ ID NO: 3027648 - protein, 19 aa, Entamoeba invadens
LNFDYMNFFDKIEPPKIVV

SEQ ID NO: 3027649 - protein, 24 aa, Entamoeba invadens
LNFERFLMCILKSLNFQCVRAVYE

SEQ ID NO: 3027650 - protein, 18 aa, Entamoeba invadens
LNFLLFNEPLDFLSISPF

SEQ ID NO: 3027651 - protein, 19 aa, Entamoeba invadens
LNFSLAIFSPLKALLMRLF

SEQ ID NO: 3027652 - protein, 17 aa, Entamoeba invadens
LNFYRVIVWCKVTYSFY

SEQ ID NO: 3027653 - protein, 24 aa, Entamoeba invadens
LNKFFENYLFLTFKTYAIVLSVDS

SEQ ID NO: 3027654 - protein, 20 aa, Entamoeba invadens
LNLQLMKWQLFKSLDLEMLK

SEQ ID NO: 3027655 - protein, 18 aa, Entamoeba invadens
LNLRFSLTFLRMLLGKRT

SEQ ID NO: 3027656 - protein, 24 aa, Entamoeba invadens
LNPHFCKLISWYDNEWGYSTRLVD

SEQ ID NO: 3027657 - protein, 23 aa, Entamoeba invadens
LNRKFFRIIVWFNVNFETVDRNK

SEQ ID NO: 3027658 - protein, 22 aa, Entamoeba invadens
LNRNLLNRLLLLSFKTPSTLST

SEQ ID NO: 3027659 - protein, 23 aa, Entamoeba invadens
LNSSFKHFILFAANFNLLDKKEV

SEQ ID NO: 3027660 - protein, 22 aa, Entamoeba invadens
LNTLFILHLLWMQYEGDWLDLL

SEQ ID NO: 3027661 - protein, 25 aa, Entamoeba invadens
LPATTWPWYKLISAIKLFTFPPGVN

SEQ ID NO: 3027662 - protein, 17 aa, Entamoeba invadens
LPESLFALCRNLYIIEN

SEQ ID NO: 3027663 - protein, 23 aa, Entamoeba invadens
LPFLKVMNILIFVFATNSIDSYN

SEQ ID NO: 3027664 - protein, 19 aa, Entamoeba invadens
LPISFDYLLKPIYIRNYII

SEQ ID NO: 3027665 - protein, 19 aa, Entamoeba invadens
LPKSLPFLPLVLDIPPELA

SEQ ID NO: 3027666 - protein, 18 aa, Entamoeba invadens
LPLQSICWPLLLSAKNVF

SEQ ID NO: 3027667 - protein, 19 aa, Entamoeba invadens
LPLVDFCPCNFKYGVNNQP

SEQ ID NO: 3027668 - protein, 20 aa, Entamoeba invadens
LPMSYKLWHTFLLSSERDAR

SEQ ID NO: 3027669 - protein, 22 aa, Entamoeba invadens
LPNFERCYFPKNVFLYFIELNG

SEQ ID NO: 3027670 - protein, 18 aa, Entamoeba invadens
LPPKGIPFLILGQEENPA

SEQ ID NO: 3027671 - protein, 21 aa, Entamoeba invadens
LPPVYTYFYLCVIVSSDGFVK

SEQ ID NO: 3027672 - protein, 22 aa, Entamoeba invadens
LPPVYTYFYLCVIVSSDGFVKI

SEQ ID NO: 3027673 - protein, 17 aa, Entamoeba invadens
LPVQRLPRYILLLETLI

SEQ ID NO: 3027674 - protein, 21 aa, Entamoeba invadens
LQCIELYKILLKKPFSCYHNS

SEQ ID NO: 3027675 - protein, 17 aa, Entamoeba invadens
LQHFDYVFGNDTQIVHI

SEQ ID NO: 3027676 - protein, 25 aa, Entamoeba invadens
LQIAVYPIICRLLVLPGASSLFFRE

SEQ ID NO: 3027677 - protein, 18 aa, Entamoeba invadens
LQIPTYFSVIKSPMDLGT

SEQ ID NO: 3027678 - protein, 17 aa, Entamoeba invadens
LQISPIRKYILSFLLNE

SEQ ID NO: 3027679 - protein, 20 aa, Entamoeba invadens
LQITRMFLWFFTLPNVHSAR

SEQ ID NO: 3027680 - protein, 26 aa, Entamoeba invadens
LQLMASLVKFFLYKNTNLHSTMFNVW

SEQ ID NO: 3027681 - protein, 23 aa, Entamoeba invadens
LQSKNVWICPPAEYFDKIINEGC

SEQ ID NO: 3027682 - protein, 17 aa, Entamoeba invadens
LQTDGLLFFMAYKRIEL

SEQ ID NO: 3027683 - protein, 20 aa, Entamoeba invadens
LQTIALIWTLYKQCNVKKTV

SEQ ID NO: 3027684 - protein, 21 aa, Entamoeba invadens
LQTLRRVVLYIPLSALDHFLS

SEQ ID NO: 3027685 - protein, 30 aa, Entamoeba invadens
LQTPLEPPQGLLPPPPGMAPPIVESTSPIP

SEQ ID NO: 3027686 - protein, 22 aa, Entamoeba invadens
LQTVVLLAHLLYEVSKTWVFEK

SEQ ID NO: 3027687 - protein, 21 aa, Entamoeba invadens
LQTVWKYFFLFSDVLVVTEIT

SEQ ID NO: 3027688 - protein, 23 aa, Entamoeba invadens
LQYYYFHYLSWPYIMYVAEDDKK

SEQ ID NO: 3027689 - protein, 18 aa, Entamoeba invadens
LRFDPYVFISLQLPNKMS

SEQ ID NO: 3027690 - protein, 17 aa, Entamoeba invadens
LRIKAFEPLFVIGKEYY

SEQ ID NO: 3027691 - protein, 24 aa, Entamoeba invadens
LRKDILLVRPTFFGATPSFWNSLY

SEQ ID NO: 3027692 - protein, 25 aa, Entamoeba invadens
LRLCETYLLFLLFGRAMNENTNLSC

SEQ ID NO: 3027693 - protein, 20 aa, Entamoeba invadens
LRLKIMNFIRIWMKNAWKDF

SEQ ID NO: 3027694 - protein, 18 aa, Entamoeba invadens
LRLYYFFFQKVANHFIFK

SEQ ID NO: 3027695 - protein, 26 aa, Entamoeba invadens
LRMKKLEALPFFKPPTNNVFANKPTQ

SEQ ID NO: 3027696 - protein, 24 aa, Entamoeba invadens
LRNKLVHHLIMEYGIYQRLNIYKP

SEQ ID NO: 3027697 - protein, 19 aa, Entamoeba invadens
LRPLAWRIFLGVLPSEFGE

SEQ ID NO: 3027698 - protein, 19 aa, Entamoeba invadens
LRRAFMSRMFPPETIKKLG

SEQ ID NO: 3027699 - protein, 21 aa, Entamoeba invadens
LRRFRMIFGFDKFVLVSKIEE

SEQ ID NO: 3027700 - protein, 19 aa, Entamoeba invadens
LRRFVIPQGLLYMDSLVFY

SEQ ID NO: 3027701 - protein, 17 aa, Entamoeba invadens
LRSENWLEKVLIKTKAK

SEQ ID NO: 3027702 - protein, 22 aa, Entamoeba invadens
LRTPIALILLFPNPFVFIVQFI

SEQ ID NO: 3027703 - protein, 24 aa, Entamoeba invadens
LRVWDFFFAYPKRKLYLFFTSAII

SEQ ID NO: 3027704 - protein, 19 aa, Entamoeba invadens
LRYLDAISILYIKYNLQIK

SEQ ID NO: 3027705 - protein, 20 aa, Entamoeba invadens
LSACISCDFGLYLEGDGNCV

SEQ ID NO: 3027706 - protein, 24 aa, Entamoeba invadens
LSASDNRWILVIHPEYGIGYVPLL

SEQ ID NO: 3027707 - protein, 25 aa, Entamoeba invadens
LSASGHFLLVSIFEVTANGVTSDAM

SEQ ID NO: 3027708 - protein, 18 aa, Entamoeba invadens
LSCYSSFWITKNGQIGFN

SEQ ID NO: 3027709 - protein, 24 aa, Entamoeba invadens
LSDYTWRLLKPAPLPHPPPGNKDY

SEQ ID NO: 3027710 - protein, 19 aa, Entamoeba invadens
LSFFSWNCWNGHIPALFVN

SEQ ID NO: 3027711 - protein, 17 aa, Entamoeba invadens
LSFINATVFFVCYSADS

SEQ ID NO: 3027712 - protein, 23 aa, Entamoeba invadens
LSGTYYIFLLAAETRRIIAISEA

SEQ ID NO: 3027713 - protein, 17 aa, Entamoeba invadens
LSGYYLQDGECLQIKNC

SEQ ID NO: 3027714 - protein, 17 aa, Entamoeba invadens
LSHSFYFLIFETNILFI

SEQ ID NO: 3027715 - protein, 20 aa, Entamoeba invadens
LSIPLFFILIDISPPKVQIL

SEQ ID NO: 3027716 - protein, 33 aa, Entamoeba invadens
LSLPVQKLKLIGKFVWILLRNGSVKVYDSQTLE

SEQ ID NO: 3027717 - protein, 17 aa, Entamoeba invadens
LSMFTYYYDFQLEIPFA

SEQ ID NO: 3027718 - protein, 20 aa, Entamoeba invadens
LSNIKLLLLSWYSTNHMSFS

SEQ ID NO: 3027719 - protein, 18 aa, Entamoeba invadens
LSPELTEIVFYRSLYRCC

SEQ ID NO: 3027720 - protein, 23 aa, Entamoeba invadens
LSSFLFQFLLTFKSVLCVPIHVV

SEQ ID NO: 3027721 - protein, 23 aa, Entamoeba invadens
LSSLALIFALHHYRPTPIYVMDE

SEQ ID NO: 3027722 - protein, 20 aa, Entamoeba invadens
LSYKIIAVLIFLVLDKDFSG

SEQ ID NO: 3027723 - protein, 20 aa, Entamoeba invadens
LSYLRCELMLLHTQAPYSQI

SEQ ID NO: 3027724 - protein, 25 aa, Entamoeba invadens
LTAIDLIPIFFALKSNMWFTDVSVE

SEQ ID NO: 3027725 - protein, 19 aa, Entamoeba invadens
LTELCRLITMPLTLDIVKM

SEQ ID NO: 3027726 - protein, 17 aa, Entamoeba invadens
LTFKLGSASLELLPYNA

SEQ ID NO: 3027727 - protein, 18 aa, Entamoeba invadens
LTGLIPWNKELFKETQKP

SEQ ID NO: 3027728 - protein, 18 aa, Entamoeba invadens
LTGPLLYQQSWTKLIKDG

SEQ ID NO: 3027729 - protein, 18 aa, Entamoeba invadens
LTHQITILTLFNISNIKL

SEQ ID NO: 3027730 - protein, 24 aa, Entamoeba invadens
LTKEFFCIIVWFAVDFKTVNTNKS

SEQ ID NO: 3027731 - protein, 22 aa, Entamoeba invadens
LTKELFCFSFIDFFSTIDINTI

SEQ ID NO: 3027732 - protein, 19 aa, Entamoeba invadens
LTKEMLFKAFFKLIDYDND

SEQ ID NO: 3027733 - protein, 17 aa, Entamoeba invadens
LTKKYITIPPIKKIPKI

SEQ ID NO: 3027734 - protein, 18 aa, Entamoeba invadens
LTLFFRKMVLLKNGAELS

SEQ ID NO: 3027735 - protein, 20 aa, Entamoeba invadens
LTLFNVIWISKRMSLVLSKN

SEQ ID NO: 3027736 - protein, 17 aa, Entamoeba invadens
LTNMLFDFALEYGYFFN

SEQ ID NO: 3027737 - protein, 23 aa, Entamoeba invadens
LTNSLTKLLLPTSPHPLFALRIV

SEQ ID NO: 3027738 - protein, 17 aa, Entamoeba invadens
LTPFVWQQILIPVLPMF

SEQ ID NO: 3027739 - protein, 25 aa, Entamoeba invadens
LTSRRPLLQHIVLAGGSTLFEGLPE

SEQ ID NO: 3027740 - protein, 24 aa, Entamoeba invadens
LTSSFKEFFFKKITFGTANCGGDN

SEQ ID NO: 3027741 - protein, 30 aa, Entamoeba invadens
LTTLSEFCPIYRGLKFRRLPIPPQDDIFEY

SEQ ID NO: 3027742 - protein, 24 aa, Entamoeba invadens
LTTQLRLQPIRPLVYPLPFQQVVG

SEQ ID NO: 3027743 - protein, 18 aa, Entamoeba invadens
LVAKLYRCFWPPSILALE

SEQ ID NO: 3027744 - protein, 20 aa, Entamoeba invadens
LVALLNIKFKIVLKSPLKKA

SEQ ID NO: 3027745 - protein, 26 aa, Entamoeba invadens
LVEAGLIKKFPILKNSWKLVLSLLCT

SEQ ID NO: 3027746 - protein, 19 aa, Entamoeba invadens
LVELFFKYIRILNSIRPKE

SEQ ID NO: 3027747 - protein, 24 aa, Entamoeba invadens
LVFGSLYVLLKCGYVLDLQKPSKK

SEQ ID NO: 3027748 - protein, 19 aa, Entamoeba invadens
LVFKKFLRNLPVRIFNREQ

SEQ ID NO: 3027749 - protein, 17 aa, Entamoeba invadens
LVFYYLYPEESVEFRLG

SEQ ID NO: 3027750 - protein, 29 aa, Entamoeba invadens
LVKMTKPWYLRFEYWKLILPLTRSIGEMV

SEQ ID NO: 3027751 - protein, 17 aa, Entamoeba invadens
LVLFPFKTAALIFIKTL

SEQ ID NO: 3027752 - protein, 17 aa, Entamoeba invadens
LVLIYYIGRKRDFDVSL

SEQ ID NO: 3027753 - protein, 18 aa, Entamoeba invadens
LVLMLFSLKISSPKRFIF

SEQ ID NO: 3027754 - protein, 18 aa, Entamoeba invadens
LVLPILQLLCYKFPKDMS

SEQ ID NO: 3027755 - protein, 19 aa, Entamoeba invadens
LVLRPLSVFAPLHYFELPE

SEQ ID NO: 3027756 - protein, 18 aa, Entamoeba invadens
LVLSLRKIGFDYVFDADY

SEQ ID NO: 3027757 - protein, 20 aa, Entamoeba invadens
LVLTLWKQNIAVFTNPSPLV

SEQ ID NO: 3027758 - protein, 23 aa, Entamoeba invadens
LVLYYLFSVFKLPYNQMLTFVCG

SEQ ID NO: 3027759 - protein, 22 aa, Entamoeba invadens
LVNALVFLIVKLGFNVKIKKTK

SEQ ID NO: 3027760 - protein, 19 aa, Entamoeba invadens
LVNNPFFLSYPLIIGEYGM

SEQ ID NO: 3027761 - protein, 28 aa, Entamoeba invadens
LVPEFFYNLYLFPHLEFIGFIKCTLPVS

SEQ ID NO: 3027762 - protein, 19 aa, Entamoeba invadens
LVPFFFMPHEKFYTLLFPI

SEQ ID NO: 3027763 - protein, 23 aa, Entamoeba invadens
LVPKSALPLFKKWDAKIVSSQSS

SEQ ID NO: 3027764 - protein, 23 aa, Entamoeba invadens
LVPPITFFIPLEATSPSNFVLMS

SEQ ID NO: 3027765 - protein, 17 aa, Entamoeba invadens
LVQIKFFLMTKFLMSGV

SEQ ID NO: 3027766 - protein, 19 aa, Entamoeba invadens
LVQNGYWNLFRYDPSKKGT

SEQ ID NO: 3027767 - protein, 19 aa, Entamoeba invadens
LVQNGYWNLFRYDPSKKGV

SEQ ID NO: 3027768 - protein, 17 aa, Entamoeba invadens
LVRSSYTVTLKRLDKTA

SEQ ID NO: 3027769 - protein, 24 aa, Entamoeba invadens
LVSSKPVLAFFKKVLERIGDVTRG

SEQ ID NO: 3027770 - protein, 23 aa, Entamoeba invadens
LVVCDGLLYLFWSESGILCCSPV

SEQ ID NO: 3027771 - protein, 26 aa, Entamoeba invadens
LVVKIPAFPFQKIPFTLAITGTSQLS

SEQ ID NO: 3027772 - protein, 19 aa, Entamoeba invadens
LVYLIFYISSLLLKFNGHT

SEQ ID NO: 3027773 - protein, 20 aa, Entamoeba invadens
LWLKNLVIKFMLSKLGYTDE

SEQ ID NO: 3027774 - protein, 21 aa, Entamoeba invadens
LWWNIMRQMPFLWIMTDRDFL

SEQ ID NO: 3027775 - protein, 18 aa, Entamoeba invadens
LWYLLYLCNEIAQNASEN

SEQ ID NO: 3027776 - protein, 18 aa, Entamoeba invadens
LWYSNIYCGIIRGALEML

SEQ ID NO: 3027777 - protein, 18 aa, Entamoeba invadens
LYALSFLLDSRSLQVSIQ

SEQ ID NO: 3027778 - protein, 25 aa, Entamoeba invadens
LYESQGLVPLLRLAWNRFDANYIAT

SEQ ID NO: 3027779 - protein, 17 aa, Entamoeba invadens
LYESVLKSIFMKRKETG

SEQ ID NO: 3027780 - protein, 19 aa, Entamoeba invadens
LYEVAPCDAVFTLKKRHFI

SEQ ID NO: 3027781 - protein, 17 aa, Entamoeba invadens
LYFYITYAKGPLIERCL

SEQ ID NO: 3027782 - protein, 17 aa, Entamoeba invadens
LYFYNTDKMVYLKKVPI

SEQ ID NO: 3027783 - protein, 18 aa, Entamoeba invadens
LYGFRKVWPCPTVILFNP

SEQ ID NO: 3027784 - protein, 21 aa, Entamoeba invadens
LYIHFKIQFPAYLTEKQRTDV

SEQ ID NO: 3027785 - protein, 19 aa, Entamoeba invadens
LYIRLALPILLRRGIFNNP

SEQ ID NO: 3027786 - protein, 17 aa, Entamoeba invadens
LYLECRPQNVFIVCKTI

SEQ ID NO: 3027787 - protein, 23 aa, Entamoeba invadens
LYLLSSLTRLYLMLLKEAEKSRS

SEQ ID NO: 3027788 - protein, 18 aa, Entamoeba invadens
LYNLRLRYMKDIIHTYSG

SEQ ID NO: 3027789 - protein, 17 aa, Entamoeba invadens
LYSLGLVLYFLMTGKYP

SEQ ID NO: 3027790 - protein, 19 aa, Entamoeba invadens
LYVNVLTLGVWPFSNETVP

SEQ ID NO: 3027791 - protein, 18 aa, Entamoeba invadens
MAAIRYFIEMIRAGKGEL

SEQ ID NO: 3027792 - protein, 18 aa, Entamoeba invadens
MADLTKWVKMRTNSTDVD

SEQ ID NO: 3027793 - protein, 23 aa, Entamoeba invadens
MAESFLFYANWIEPIRYISRRVV

SEQ ID NO: 3027794 - protein, 17 aa, Entamoeba invadens
MAFLKSFSRIETTKKKI

SEQ ID NO: 3027795 - protein, 24 aa, Entamoeba invadens
MAGMSLVYPLLFWVQKYRDNTNVT

SEQ ID NO: 3027796 - protein, 18 aa, Entamoeba invadens
MAQIYLLKYNILDCLLNN

SEQ ID NO: 3027797 - protein, 17 aa, Entamoeba invadens
MATPDIPSILKLLDDTL

SEQ ID NO: 3027798 - protein, 17 aa, Entamoeba invadens
MCKFIILLKVLQVPYRL

SEQ ID NO: 3027799 - protein, 17 aa, Entamoeba invadens
MCMSCVDGYFLSDYTCK

SEQ ID NO: 3027800 - protein, 19 aa, Entamoeba invadens
MCPKNILILMFLQDKVMDA

SEQ ID NO: 3027801 - protein, 21 aa, Entamoeba invadens
MDAFLCVRGMKTLPLRMKVHH

SEQ ID NO: 3027802 - protein, 21 aa, Entamoeba invadens
MDAFLCVRGMKTLPLRMQVHH

SEQ ID NO: 3027803 - protein, 21 aa, Entamoeba invadens
MDGGWFFPVDIALGTAKSAGD

SEQ ID NO: 3027804 - protein, 18 aa, Entamoeba invadens
MDLPPMKALFKITTSGIP

SEQ ID NO: 3027805 - protein, 21 aa, Entamoeba invadens
MDNSYLYPFGLGAYHSGVCAY

SEQ ID NO: 3027806 - protein, 18 aa, Entamoeba invadens
MDTLLVIPLPVIHSYGAD

SEQ ID NO: 3027807 - protein, 22 aa, Entamoeba invadens
MEEYLTFQLFMDKLLSMDVPRE

SEQ ID NO: 3027808 - protein, 24 aa, Entamoeba invadens
MEIILKYYWPLFKEGKRLTNGINI

SEQ ID NO: 3027809 - protein, 22 aa, Entamoeba invadens
MEKYKLVFKKLPKIIAEFVEEL

SEQ ID NO: 3027810 - protein, 17 aa, Entamoeba invadens
MELLKLKILLHAKDCMK

SEQ ID NO: 3027811 - protein, 26 aa, Entamoeba invadens
MEPPKKWMYFFLFNDRLVETIPELYE

SEQ ID NO: 3027812 - protein, 18 aa, Entamoeba invadens
MERGIWGLYFAMIAQRLA

SEQ ID NO: 3027813 - protein, 17 aa, Entamoeba invadens
MEVVRVFDLRKMQTLAL

SEQ ID NO: 3027814 - protein, 26 aa, Entamoeba invadens
MFCEMKYFMMLLKGISTKRIVDVKMR

SEQ ID NO: 3027815 - protein, 29 aa, Entamoeba invadens
MFERFKTPLLYFSMQPILSLFAAEKIDGL

SEQ ID NO: 3027816 - protein, 17 aa, Entamoeba invadens
MFGALFFEKVTQMALLK

SEQ ID NO: 3027817 - protein, 19 aa, Entamoeba invadens
MFGIKMMIMLFTWTSSKTD

SEQ ID NO: 3027818 - protein, 19 aa, Entamoeba invadens
MFGTPFGWNWIPGISWYFY

SEQ ID NO: 3027819 - protein, 18 aa, Entamoeba invadens
MFILEFFVSKVDFINFLC

SEQ ID NO: 3027820 - protein, 22 aa, Entamoeba invadens
MFKKPHLSIKRFKFSAPTAKTK

SEQ ID NO: 3027821 - protein, 17 aa, Entamoeba invadens
MFLTKRELLWKKRCIRF

SEQ ID NO: 3027822 - protein, 18 aa, Entamoeba invadens
MFMCATLIPYADLLYEFV

SEQ ID NO: 3027823 - protein, 20 aa, Entamoeba invadens
MFNLRWINFIGNPIDDKGFL

SEQ ID NO: 3027824 - protein, 17 aa, Entamoeba invadens
MFNVFNVLWLKESFLAH

SEQ ID NO: 3027825 - protein, 19 aa, Entamoeba invadens
MGELLPYCLFVIKDKLQFP

SEQ ID NO: 3027826 - protein, 24 aa, Entamoeba invadens
MGGVLIYHPFVLHALLKAVHSSLP

SEQ ID NO: 3027827 - protein, 25 aa, Entamoeba invadens
MGIYAPFLHVLLFSYLFNFNNGMSH

SEQ ID NO: 3027828 - protein, 22 aa, Entamoeba invadens
MGLATLPRFFYINTMKGITRKL

SEQ ID NO: 3027829 - protein, 22 aa, Entamoeba invadens
MHFELRIFPPYPCSKIILENRL

SEQ ID NO: 3027830 - protein, 19 aa, Entamoeba invadens
MHGHRICFVWTFTGLDETQ

SEQ ID NO: 3027831 - protein, 25 aa, Entamoeba invadens
MHTETWILMVLWYGGDPSKFTDYEN

SEQ ID NO: 3027832 - protein, 18 aa, Entamoeba invadens
MIATPFDLFFLALHFLTI

SEQ ID NO: 3027833 - protein, 18 aa, Entamoeba invadens
MIDLTFLTRGFYPEGLLK

SEQ ID NO: 3027834 - protein, 24 aa, Entamoeba invadens
MIEKYLFYPLFLTSDFEGFCGPYK

SEQ ID NO: 3027835 - protein, 18 aa, Entamoeba invadens
MIIARKRYGFPEALFNLA

SEQ ID NO: 3027836 - protein, 18 aa, Entamoeba invadens
MIIKYNYLHHALGFSYSN

SEQ ID NO: 3027837 - protein, 18 aa, Entamoeba invadens
MILAVRWAFYIREKSGSI

SEQ ID NO: 3027838 - protein, 19 aa, Entamoeba invadens
MINPIFKNLMKFLYDKNCF

SEQ ID NO: 3027839 - protein, 17 aa, Entamoeba invadens
MIRNMKTRGFSIKEICI

SEQ ID NO: 3027840 - protein, 18 aa, Entamoeba invadens
MISLYQYMPIGCKSDVWA

SEQ ID NO: 3027841 - protein, 19 aa, Entamoeba invadens
MITVAPWFFVEITLLKRTA

SEQ ID NO: 3027842 - protein, 17 aa, Entamoeba invadens
MIYLINLSDIKSLEYAQ

SEQ ID NO: 3027843 - protein, 17 aa, Entamoeba invadens
MKALCSIFYFETSAFEN

SEQ ID NO: 3027844 - protein, 17 aa, Entamoeba invadens
MKDACFFSCYYLESIHL

SEQ ID NO: 3027845 - protein, 17 aa, Entamoeba invadens
MKDFSILVGIRDRKLLL

SEQ ID NO: 3027846 - protein, 24 aa, Entamoeba invadens
MKKDITLLLRKNALRFYPIVPMAD

SEQ ID NO: 3027847 - protein, 19 aa, Entamoeba invadens
MKMFYGIKPLTYLLPQLLC

SEQ ID NO: 3027848 - protein, 20 aa, Entamoeba invadens
MKMVDTIFPLLYITGVVEHF

SEQ ID NO: 3027849 - protein, 26 aa, Entamoeba invadens
MKNNQNNIFFALRGALDIQKEVTAKE

SEQ ID NO: 3027850 - protein, 28 aa, Entamoeba invadens
MKRADAKFVIHSPAVFKLPGSEQYVVYG

SEQ ID NO: 3027851 - protein, 26 aa, Entamoeba invadens
MKRVYKYLIYWLLNGTVCIGNFFATE

SEQ ID NO: 3027852 - protein, 26 aa, Entamoeba invadens
MKSQFYVTYWMLLNWLTSGSDDVSEK

SEQ ID NO: 3027853 - protein, 22 aa, Entamoeba invadens
MKVKHPFLVNLYYSFQTTTHLH

SEQ ID NO: 3027854 - protein, 23 aa, Entamoeba invadens
MKYTNFILSLWKLQIAPSCDSDE

SEQ ID NO: 3027855 - protein, 25 aa, Entamoeba invadens
MLEESWWYYIDVYRLLYPELPPSEF

SEQ ID NO: 3027856 - protein, 17 aa, Entamoeba invadens
MLKPFYACEFSIYLTPK

SEQ ID NO: 3027857 - protein, 18 aa, Entamoeba invadens
MLLETYLYIRDLYNEYGT

SEQ ID NO: 3027858 - protein, 27 aa, Entamoeba invadens
MLLQQPQPFQWLFIARVIMFSLKRKMG

SEQ ID NO: 3027859 - protein, 18 aa, Entamoeba invadens
MLPPPGLAPPGLEPPGGL

SEQ ID NO: 3027860 - protein, 34 aa, Entamoeba invadens
MLRINPPLFFFRLPFIFNFFPNLSTLRGNLIEFQ

SEQ ID NO: 3027861 - protein, 25 aa, Entamoeba invadens
MLSKGQVYPFRYLLQSFPRNQHIAQ

SEQ ID NO: 3027862 - protein, 19 aa, Entamoeba invadens
MLTIPLWTGYYLKYSHPDI

SEQ ID NO: 3027863 - protein, 18 aa, Entamoeba invadens
MLVDCKVPYVILGHSERR

SEQ ID NO: 3027864 - protein, 18 aa, Entamoeba invadens
MLYNFTSGVLRELSSKWS

SEQ ID NO: 3027865 - protein, 24 aa, Entamoeba invadens
MMIREIIYKPLFKASTLFLTKKKD

SEQ ID NO: 3027866 - protein, 23 aa, Entamoeba invadens
MMKIFNYLLLNYTTLVYVLDNEK

SEQ ID NO: 3027867 - protein, 22 aa, Entamoeba invadens
MMKYMMVYVFALPFNDFIETAM

SEQ ID NO: 3027868 - protein, 17 aa, Entamoeba invadens
MMLHGAALCLFLSEEEA

SEQ ID NO: 3027869 - protein, 23 aa, Entamoeba invadens
MMNKMLMVFYRYPQAWIVCAQYF

SEQ ID NO: 3027870 - protein, 20 aa, Entamoeba invadens
MMRGFAHGFYRKPTFHLTGP

SEQ ID NO: 3027871 - protein, 26 aa, Entamoeba invadens
MMSTINFIFTFLKPSIIFNIRFYFEY

SEQ ID NO: 3027872 - protein, 19 aa, Entamoeba invadens
MNCESLEYVILPKTIMTIP

SEQ ID NO: 3027873 - protein, 23 aa, Entamoeba invadens
MNSKKFLKLMELVLLIGNYLNHG

SEQ ID NO: 3027874 - protein, 17 aa, Entamoeba invadens
MNYIPLIFSISVPLLLQ

SEQ ID NO: 3027875 - protein, 20 aa, Entamoeba invadens
MPEIPKIYFLAQTFKELVDV

SEQ ID NO: 3027876 - protein, 18 aa, Entamoeba invadens
MPMKGMLWWISYFGFDGI

SEQ ID NO: 3027877 - protein, 25 aa, Entamoeba invadens
MPNLQQFYAPFNKLAFLPNGLFKSK

SEQ ID NO: 3027878 - protein, 23 aa, Entamoeba invadens
MQISHPFIVKLYYAFQTADKLYM

SEQ ID NO: 3027879 - protein, 17 aa, Entamoeba invadens
MQLYPYQPHFYNLPNQH

SEQ ID NO: 3027880 - protein, 18 aa, Entamoeba invadens
MQVPYPYRQYAPMGRFSR

SEQ ID NO: 3027881 - protein, 19 aa, Entamoeba invadens
MRLCKLAVMLVALGGVPHL

SEQ ID NO: 3027882 - protein, 22 aa, Entamoeba invadens
MRRGYFFLFNDVLIRSRITKYD

SEQ ID NO: 3027883 - protein, 29 aa, Entamoeba invadens
MRTLIVFPTYFYYVKFIGSAFDFPESKPT

SEQ ID NO: 3027884 - protein, 26 aa, Entamoeba invadens
MSDSRFNFTFSHFKPISSVLAKSDKG

SEQ ID NO: 3027885 - protein, 18 aa, Entamoeba invadens
MSIKPLLREPSRDLLKDQ

SEQ ID NO: 3027886 - protein, 23 aa, Entamoeba invadens
MSINYFIYFIDFFEQYETRDNFK

SEQ ID NO: 3027887 - protein, 18 aa, Entamoeba invadens
MSTLPILMKVYGTYKYPL

SEQ ID NO: 3027888 - protein, 17 aa, Entamoeba invadens
MTAPRVIFECRNLKNLD

SEQ ID NO: 3027889 - protein, 20 aa, Entamoeba invadens
MTCHKVLPPSYQSDLIRQDP

SEQ ID NO: 3027890 - protein, 20 aa, Entamoeba invadens
MTERFELFILKREIANAYTE

SEQ ID NO: 3027891 - protein, 22 aa, Entamoeba invadens
MTFLLAVFDKSDKWRKCCAGCD

SEQ ID NO: 3027892 - protein, 23 aa, Entamoeba invadens
MTQALLPLLKLSLMTPYVIFVHA

SEQ ID NO: 3027893 - protein, 17 aa, Entamoeba invadens
MTQFPVYKPLYKVENFL

SEQ ID NO: 3027894 - protein, 24 aa, Entamoeba invadens
MTTKLTQILLWFSSLYLSPDVLLV

SEQ ID NO: 3027895 - protein, 26 aa, Entamoeba invadens
MVADLMRYFFHFVKATCPYIVEYNAN

SEQ ID NO: 3027896 - protein, 23 aa, Entamoeba invadens
MVCPTLSIPLLLLQIRDSLLKFG

SEQ ID NO: 3027897 - protein, 18 aa, Entamoeba invadens
MVLIYRYSDQDATCQLLR

SEQ ID NO: 3027898 - protein, 19 aa, Entamoeba invadens
MVNFLPINKEMQAEKLFLV

SEQ ID NO: 3027899 - protein, 23 aa, Entamoeba invadens
MWAKGFFMFQWADNSLPIASIDK

SEQ ID NO: 3027900 - protein, 18 aa, Entamoeba invadens
MWFQFMTNLKIEVALIPN

SEQ ID NO: 3027901 - protein, 27 aa, Entamoeba invadens
MYCSLYTRLLVLLLPHLKVLNTSILNM

SEQ ID NO: 3027902 - protein, 18 aa, Entamoeba invadens
MYFSYFKSFIKSAPKKRI

SEQ ID NO: 3027903 - protein, 17 aa, Entamoeba invadens
MYGKFFLPSFNLRSFLT

SEQ ID NO: 3027904 - protein, 19 aa, Entamoeba invadens
MYYCLCLMDYLVENCPEFR

SEQ ID NO: 3027905 - protein, 22 aa, Entamoeba invadens
NAFVTLLFLRYLYTPFMKNVQI

SEQ ID NO: 3027906 - protein, 17 aa, Entamoeba invadens
NAQKYFQFQFPTRDPPP

SEQ ID NO: 3027907 - protein, 22 aa, Entamoeba invadens
NAQVSLLKFQVSAPASVAQEEE

SEQ ID NO: 3027908 - protein, 18 aa, Entamoeba invadens
NASFYWKTPLRKTPRETP

SEQ ID NO: 3027909 - protein, 17 aa, Entamoeba invadens
NATFVFLLEKILDFAMY

SEQ ID NO: 3027910 - protein, 22 aa, Entamoeba invadens
NATVLHFIYLPILRLMKQSASP

SEQ ID NO: 3027911 - protein, 24 aa, Entamoeba invadens
NAVSTLFFLRFLLTPFTAHSEILK

SEQ ID NO: 3027912 - protein, 24 aa, Entamoeba invadens
NAWTSFSIALWYYGFTKIQGHHRL

SEQ ID NO: 3027913 - protein, 25 aa, Entamoeba invadens
NCAQPIRFPILLPVLLELVFKQICP

SEQ ID NO: 3027914 - protein, 17 aa, Entamoeba invadens
NCDKLIKLILPSSLSKI

SEQ ID NO: 3027915 - protein, 17 aa, Entamoeba invadens
NCELHMVFYLISVLKIE

SEQ ID NO: 3027916 - protein, 27 aa, Entamoeba invadens
NCKALKEIILPPKLMYVDEKLAFEGCD

SEQ ID NO: 3027917 - protein, 17 aa, Entamoeba invadens
NCKYAVSYLEKLKLFIK

SEQ ID NO: 3027918 - protein, 21 aa, Entamoeba invadens
NCLFFIAIQIWRGIPAQIKSI

SEQ ID NO: 3027919 - protein, 26 aa, Entamoeba invadens
NCPIDFPLFFDFLRITNSRLKHIVGK

SEQ ID NO: 3027920 - protein, 25 aa, Entamoeba invadens
NCTLLAKVILPKYLTRLGLLCFEKC

SEQ ID NO: 3027921 - protein, 17 aa, Entamoeba invadens
NCTSLRRFVIPQGLLYM

SEQ ID NO: 3027922 - protein, 24 aa, Entamoeba invadens
NDDKNFFFTVFSAFWILSEGVGYI

SEQ ID NO: 3027923 - protein, 23 aa, Entamoeba invadens
NDEQNRLIALWRYIAKRYCNEEG

SEQ ID NO: 3027924 - protein, 21 aa, Entamoeba invadens
NDFLFLFVNELQRSLMACHGR

SEQ ID NO: 3027925 - protein, 21 aa, Entamoeba invadens
NDFVITVVLYKNGISVNNGGL

SEQ ID NO: 3027926 - protein, 23 aa, Entamoeba invadens
NDGKLFLVLFSRKSFIFFDSDMK

SEQ ID NO: 3027927 - protein, 18 aa, Entamoeba invadens
NDIFKFLWRVKCLRISIN

SEQ ID NO: 3027928 - protein, 25 aa, Entamoeba invadens
NDIIDGMLIAKWKKPGFGHLCCLKC

SEQ ID NO: 3027929 - protein, 23 aa, Entamoeba invadens
NDINEFCFLLEKLGLDIRERNDF

SEQ ID NO: 3027930 - protein, 23 aa, Entamoeba invadens
NDKDKIFIFTLNSPTKPLRKFQE

SEQ ID NO: 3027931 - protein, 24 aa, Entamoeba invadens
NDLNELLKLIWWYDDERSKKYIIK

SEQ ID NO: 3027932 - protein, 24 aa, Entamoeba invadens
NDPKHFFFVLKRKGVSDVKKYTRK

SEQ ID NO: 3027933 - protein, 21 aa, Entamoeba invadens
NDRILLKLPIAYLFDVFAVSL

SEQ ID NO: 3027934 - protein, 27 aa, Entamoeba invadens
NDTTLLYLIRRYLILRYAQMHDYVEGK

SEQ ID NO: 3027935 - protein, 32 aa, Entamoeba invadens
NDVPVRIIDFSRWFRFVLKITNPLFDLKSEFG

SEQ ID NO: 3027936 - protein, 24 aa, Entamoeba invadens
NDYRKFIFPFSYLTWLNEDDFKIE

SEQ ID NO: 3027937 - protein, 23 aa, Entamoeba invadens
NEAQVTFYFLLLSGFLEKQYHQF

SEQ ID NO: 3027938 - protein, 20 aa, Entamoeba invadens
NEATLAEKILQFANIENAQK

SEQ ID NO: 3027939 - protein, 17 aa, Entamoeba invadens
NEFLKLHNFLYNPTEFP

SEQ ID NO: 3027940 - protein, 31 aa, Entamoeba invadens
NEHDQPFMYILYGWLIHLFVMNPSVNETFHV

SEQ ID NO: 3027941 - protein, 30 aa, Entamoeba invadens
NEHQAHSMGYFFPVLPFQDPNTSTFKLSPQ

SEQ ID NO: 3027942 - protein, 18 aa, Entamoeba invadens
NEKLFLTRSKVSDILYIT

SEQ ID NO: 3027943 - protein, 23 aa, Entamoeba invadens
NEKRWWMYAVDALKKKKQDDDNK

SEQ ID NO: 3027944 - protein, 24 aa, Entamoeba invadens
NEKSFERLLFWKDEFLRNACTSLG

SEQ ID NO: 3027945 - protein, 23 aa, Entamoeba invadens
NENKFVFFLTLNGKIVFKTGFRS

SEQ ID NO: 3027946 - protein, 24 aa, Entamoeba invadens
NEPKRLIIPPHLLQGPVLYQGYSY

SEQ ID NO: 3027947 - protein, 24 aa, Entamoeba invadens
NEQEIFCVLLRLVKGRKCYSMPLI

SEQ ID NO: 3027948 - protein, 23 aa, Entamoeba invadens
NERALYVYAYFLARVAAGMVAEE

SEQ ID NO: 3027949 - protein, 25 aa, Entamoeba invadens
NERKKTHYLPLFPSKPHPKQQKAST

SEQ ID NO: 3027950 - protein, 27 aa, Entamoeba invadens
NESVYFLKWHILLPDYAINLVQMEKTP

SEQ ID NO: 3027951 - protein, 26 aa, Entamoeba invadens
NEVKKPIFLFLLKIVKKLILHFKSPT

SEQ ID NO: 3027952 - protein, 25 aa, Entamoeba invadens
NFDAFLFVVSLWLLSAPPSPSTAIF

SEQ ID NO: 3027953 - protein, 20 aa, Entamoeba invadens
NFDVLKIRRILFAMLERIEE

SEQ ID NO: 3027954 - protein, 21 aa, Entamoeba invadens
NFEDFFIYNRYKFGVLYAGIG

SEQ ID NO: 3027955 - protein, 28 aa, Entamoeba invadens
NFFEFLCFEWYYLASWYQNKKQIEYLSE

SEQ ID NO: 3027956 - protein, 17 aa, Entamoeba invadens
NFFIYLINDPELGSEEE

SEQ ID NO: 3027957 - protein, 17 aa, Entamoeba invadens
NFFYLIVSHPKYISALS

SEQ ID NO: 3027958 - protein, 18 aa, Entamoeba invadens
NFILEWEFNVSFKGSHAQ

SEQ ID NO: 3027959 - protein, 28 aa, Entamoeba invadens
NFKRVSLLHFLVYYFGQDWQKVANAPQG

SEQ ID NO: 3027960 - protein, 23 aa, Entamoeba invadens
NFKYKFFIFYKSCFYPFNFIHFR

SEQ ID NO: 3027961 - protein, 20 aa, Entamoeba invadens
NFLKYYLMELIIKKINFPSF

SEQ ID NO: 3027962 - protein, 17 aa, Entamoeba invadens
NFMTCDDLEWALSRVGA

SEQ ID NO: 3027963 - protein, 27 aa, Entamoeba invadens
NFNFFAIHWYYQTRRFFFKVIFNRLTI

SEQ ID NO: 3027964 - protein, 19 aa, Entamoeba invadens
NFPEVYLLEGGFKYFYENV

SEQ ID NO: 3027965 - protein, 17 aa, Entamoeba invadens
NFQIVVQYFYFEKDFIN

SEQ ID NO: 3027966 - protein, 17 aa, Entamoeba invadens
NFQIVVQYLFFSDDFVN

SEQ ID NO: 3027967 - protein, 17 aa, Entamoeba invadens
NFRLLFSSDLFPVKADV

SEQ ID NO: 3027968 - protein, 22 aa, Entamoeba invadens
NFRTEFLRYCPLYENIYQTLSE

SEQ ID NO: 3027969 - protein, 18 aa, Entamoeba invadens
NFRVFGNGLLYKVTMENA

SEQ ID NO: 3027970 - protein, 22 aa, Entamoeba invadens
NFSIYPQFMFHLRRSHFLRVFN

SEQ ID NO: 3027971 - protein, 24 aa, Entamoeba invadens
NFTKPDFFKYAPAYPLVLFKCEYK

SEQ ID NO: 3027972 - protein, 18 aa, Entamoeba invadens
NFVFSTFHKLGFEDLIVS

SEQ ID NO: 3027973 - protein, 18 aa, Entamoeba invadens
NFVLGNWFYWYLTVECGC

SEQ ID NO: 3027974 - protein, 18 aa, Entamoeba invadens
NFVSLGDKVKIVGGNYKG

SEQ ID NO: 3027975 - protein, 18 aa, Entamoeba invadens
NFYCANFIPPTLKNSGRD

SEQ ID NO: 3027976 - protein, 24 aa, Entamoeba invadens
NGAKSVYLYSLFLARVAAGLVCEE

SEQ ID NO: 3027977 - protein, 22 aa, Entamoeba invadens
NGELYFIGIIDILMDYTTRKKL

SEQ ID NO: 3027978 - protein, 25 aa, Entamoeba invadens
NGFKFEMFIFDAFRLAKKMGALEVR

SEQ ID NO: 3027979 - protein, 23 aa, Entamoeba invadens
NGFLNSPFYRKSTPKARYLIVTK

SEQ ID NO: 3027980 - protein, 26 aa, Entamoeba invadens
NGFRSYLLTFSFLAKLLQPPSNFSST

SEQ ID NO: 3027981 - protein, 22 aa, Entamoeba invadens
NGKLHLVLLLQCPLNISVGNYY

SEQ ID NO: 3027982 - protein, 25 aa, Entamoeba invadens
NGLDKSFLAFIERLFRLLKLIADNS

SEQ ID NO: 3027983 - protein, 25 aa, Entamoeba invadens
NGMRLFSKFLYIFIQMCKMNKIEDP

SEQ ID NO: 3027984 - protein, 20 aa, Entamoeba invadens
NGMRSVLLVALKLLAEKGGK

SEQ ID NO: 3027985 - protein, 30 aa, Entamoeba invadens
NGNKKAILSLLYQLMYKFRLGNCSVRMVDF

SEQ ID NO: 3027986 - protein, 17 aa, Entamoeba invadens
NGNLLCLITILKAFPTV

SEQ ID NO: 3027987 - protein, 21 aa, Entamoeba invadens
NGPEWVWPYGYYVMAMLMYNP

SEQ ID NO: 3027988 - protein, 17 aa, Entamoeba invadens
NGPIPIAFFLDDMDDED

SEQ ID NO: 3027989 - protein, 21 aa, Entamoeba invadens
NGRIAQFKSLQTSPLQLVKKD

SEQ ID NO: 3027990 - protein, 28 aa, Entamoeba invadens
NGSVDDFCLYLYLTYFVINGNNQENDEQ

SEQ ID NO: 3027991 - protein, 27 aa, Entamoeba invadens
NGVKVLPRVLLKDFAELGFPFFGYEEI

SEQ ID NO: 3027992 - protein, 17 aa, Entamoeba invadens
NGVLTMCYGVDGVPAYV

SEQ ID NO: 3027993 - protein, 20 aa, Entamoeba invadens
NGVVFVFDVSNRASFEGISF

SEQ ID NO: 3027994 - protein, 22 aa, Entamoeba invadens
NGYKWLLLSYIPDKSKVRMKML

SEQ ID NO: 3027995 - protein, 26 aa, Entamoeba invadens
NHAYQFYIMFHVAPLLPLLEEDEQAL

SEQ ID NO: 3027996 - protein, 25 aa, Entamoeba invadens
NHNTLWYFFSFLRRVIEKEKINKMN

SEQ ID NO: 3027997 - protein, 23 aa, Entamoeba invadens
NHYVRMFFCELLLYRSTMSPSWN

SEQ ID NO: 3027998 - protein, 19 aa, Entamoeba invadens
NIAKLPVLLLYKVKVKVED

SEQ ID NO: 3027999 - protein, 22 aa, Entamoeba invadens
NIDFRVFYFYFDFLMNAFKNKS

SEQ ID NO: 3028000 - protein, 24 aa, Entamoeba invadens
NIENPKNVIPRRTIERRKSQIFDL

SEQ ID NO: 3028001 - protein, 26 aa, Entamoeba invadens
NIETRKLLFNYVALGVKLMNTQNTNK

SEQ ID NO: 3028002 - protein, 21 aa, Entamoeba invadens
NIFDVKLLPDILPKITSFYFG

SEQ ID NO: 3028003 - protein, 18 aa, Entamoeba invadens
NIFILFINNRYVEFPALK

SEQ ID NO: 3028004 - protein, 18 aa, Entamoeba invadens
NIFWRIVKILKNGGMKYI

SEQ ID NO: 3028005 - protein, 17 aa, Entamoeba invadens
NIIGHQFFWFLKAEMHD

SEQ ID NO: 3028006 - protein, 17 aa, Entamoeba invadens
NIIVWFNVDYKTIFINK

SEQ ID NO: 3028007 - protein, 23 aa, Entamoeba invadens
NIKFAPIVRPTLPLHMEILDNET

SEQ ID NO: 3028008 - protein, 21 aa, Entamoeba invadens
NIKFLYVLKNVFYMFAKNGNN

SEQ ID NO: 3028009 - protein, 17 aa, Entamoeba invadens
NIKLLGNIFTKPTFIPP

SEQ ID NO: 3028010 - protein, 22 aa, Entamoeba invadens
NILFNIFYLRLIIVKCFCSTRT

SEQ ID NO: 3028011 - protein, 17 aa, Entamoeba invadens
NILRKKICILPQEATLF

SEQ ID NO: 3028012 - protein, 18 aa, Entamoeba invadens
NIMIVIVAKDGSVFGSYN

SEQ ID NO: 3028013 - protein, 23 aa, Entamoeba invadens
NIPDPLCLMCYLFPEIVKKTITV

SEQ ID NO: 3028014 - protein, 25 aa, Entamoeba invadens
NIPFTSFPFFLPKKNMFLRTIYITE

SEQ ID NO: 3028015 - protein, 19 aa, Entamoeba invadens
NIPLKDWNCWLVERLSKEV

SEQ ID NO: 3028016 - protein, 17 aa, Entamoeba invadens
NIPLPIKALIDYLKIHA

SEQ ID NO: 3028017 - protein, 23 aa, Entamoeba invadens
NIPMMVMFPYDYPIKPPFFLTDP

SEQ ID NO: 3028018 - protein, 24 aa, Entamoeba invadens
NIPSPLFSFPFNATVPTLLAIFFS

SEQ ID NO: 3028019 - protein, 28 aa, Entamoeba invadens
NIQVILSFLPILYYNTLKLLIHYLSLVV

SEQ ID NO: 3028020 - protein, 20 aa, Entamoeba invadens
NIRFCGLKLLGFMMTKHPKA

SEQ ID NO: 3028021 - protein, 25 aa, Entamoeba invadens
NIRNRAFFICYYLTKVVLNYGLCSI

SEQ ID NO: 3028022 - protein, 20 aa, Entamoeba invadens
NIRPIYTHPCKLRFLANLSQ

SEQ ID NO: 3028023 - protein, 23 aa, Entamoeba invadens
NIVTLFILIWIKLKCLGFKTTLG

SEQ ID NO: 3028024 - protein, 19 aa, Entamoeba invadens
NIWANFYCANFIPPTLKNS

SEQ ID NO: 3028025 - protein, 23 aa, Entamoeba invadens
NKDIIVLMKMRLKLMLDAARGIA

SEQ ID NO: 3028026 - protein, 20 aa, Entamoeba invadens
NKFQDLLLDIPEPQPILTCN

SEQ ID NO: 3028027 - protein, 20 aa, Entamoeba invadens
NKFYEILYKWKIPNIEMSLK

SEQ ID NO: 3028028 - protein, 17 aa, Entamoeba invadens
NKGDLLIYLYSSNPQKQ

SEQ ID NO: 3028029 - protein, 28 aa, Entamoeba invadens
NKIDDEFLMFLFYYTQGTPLQAQAAERL

SEQ ID NO: 3028030 - protein, 23 aa, Entamoeba invadens
NKIKFVFLLLDYWFEDYQKKICD

SEQ ID NO: 3028031 - protein, 27 aa, Entamoeba invadens
NKITEETWWFIINKIYFKILEEVGYYH

SEQ ID NO: 3028032 - protein, 24 aa, Entamoeba invadens
NKKLPMKVRVSESFIACNALSEES

SEQ ID NO: 3028033 - protein, 23 aa, Entamoeba invadens
NKNYLNFIILIKIKYTYNNRDKL

SEQ ID NO: 3028034 - protein, 23 aa, Entamoeba invadens
NKQSFLEYMWLTQLEFVRTVRGQ

SEQ ID NO: 3028035 - protein, 25 aa, Entamoeba invadens
NKRIEYRLLWFRFDIRKLYLLRHGE

SEQ ID NO: 3028036 - protein, 21 aa, Entamoeba invadens
NKRKLRLRSRSIHPLIDTVDE

SEQ ID NO: 3028037 - protein, 22 aa, Entamoeba invadens
NKRVFVHNLLFDLALEHGFFFN

SEQ ID NO: 3028038 - protein, 22 aa, Entamoeba invadens
NKSTLLPFLVNKMATLGTAACP

SEQ ID NO: 3028039 - protein, 22 aa, Entamoeba invadens
NKTLQFFYVMETFYYCNRLSFE

SEQ ID NO: 3028040 - protein, 23 aa, Entamoeba invadens
NKTNFLFHWGYKQEFLHTENTYE

SEQ ID NO: 3028041 - protein, 26 aa, Entamoeba invadens
NKTNKIPIFLPFLTSLREFFQNYMEK

SEQ ID NO: 3028042 - protein, 23 aa, Entamoeba invadens
NLEHIIMSKTLRWIFVGGKGGVG

SEQ ID NO: 3028043 - protein, 26 aa, Entamoeba invadens
NLESKIIYIRRYFDYIVDLFDLDKKR

SEQ ID NO: 3028044 - protein, 17 aa, Entamoeba invadens
NLFCLLKSPILKMEKNY

SEQ ID NO: 3028045 - protein, 24 aa, Entamoeba invadens
NLFGIFYGFWLKKTMGFIIDGEIG

SEQ ID NO: 3028046 - protein, 20 aa, Entamoeba invadens
NLFVFFPLFLEKIKGILSLD

SEQ ID NO: 3028047 - protein, 22 aa, Entamoeba invadens
NLGEMFMPLLYPLLSSADMDVV

SEQ ID NO: 3028048 - protein, 26 aa, Entamoeba invadens
NLGFSYLPFLNAFLFPLVIDDFSDQF

SEQ ID NO: 3028049 - protein, 23 aa, Entamoeba invadens
NLGGAFIKFIPFLKSYTQFASNQ

SEQ ID NO: 3028050 - protein, 17 aa, Entamoeba invadens
NLGMWLDLSKRGGMDGG

SEQ ID NO: 3028051 - protein, 18 aa, Entamoeba invadens
NLIHMLLLYHDPILSIHL

SEQ ID NO: 3028052 - protein, 18 aa, Entamoeba invadens
NLIKLWFRELPKPILNVL

SEQ ID NO: 3028053 - protein, 20 aa, Entamoeba invadens
NLLETLVLIYYIGRKRDFDV

SEQ ID NO: 3028054 - protein, 17 aa, Entamoeba invadens
NLLFLPTNKSYPPIRIK

SEQ ID NO: 3028055 - protein, 17 aa, Entamoeba invadens
NLMVLIYRYSDQDATCQ

SEQ ID NO: 3028056 - protein, 19 aa, Entamoeba invadens
NLNILFKTAIFFKTIASIG

SEQ ID NO: 3028057 - protein, 25 aa, Entamoeba invadens
NLNINFLFVFFPRLNTLTGNLNLIC

SEQ ID NO: 3028058 - protein, 22 aa, Entamoeba invadens
NLNQILKFFPLLETIYISSIVN

SEQ ID NO: 3028059 - protein, 19 aa, Entamoeba invadens
NLNYLEFSKTLRLLKNLFI

SEQ ID NO: 3028060 - protein, 22 aa, Entamoeba invadens
NLSFLLQFPLPKLKLVSLSTTE

SEQ ID NO: 3028061 - protein, 18 aa, Entamoeba invadens
NLSLFTALRRVTIYNFQW

SEQ ID NO: 3028062 - protein, 24 aa, Entamoeba invadens
NLTKTMLFTLLLSVVFSFEIKMCK

SEQ ID NO: 3028063 - protein, 20 aa, Entamoeba invadens
NLTVLIPWSDLLNKPIQVLL

SEQ ID NO: 3028064 - protein, 24 aa, Entamoeba invadens
NLVSILKYILLYLLNQLTIEDIGN

SEQ ID NO: 3028065 - protein, 17 aa, Entamoeba invadens
NLYLIVCYDFCVKLAQN

SEQ ID NO: 3028066 - protein, 22 aa, Entamoeba invadens
NMIKVFWLFFFKRVFNELLTTI

SEQ ID NO: 3028067 - protein, 19 aa, Entamoeba invadens
NMKILFPLSTLFPNKTQHF

SEQ ID NO: 3028068 - protein, 23 aa, Entamoeba invadens
NMLDKFRYKYIVYFYGAVLYQTR

SEQ ID NO: 3028069 - protein, 17 aa, Entamoeba invadens
NMLLPVVLVLLKSVKPS

SEQ ID NO: 3028070 - protein, 24 aa, Entamoeba invadens
NMSYYIERLFALYLPMMVGYQVYI

SEQ ID NO: 3028071 - protein, 22 aa, Entamoeba invadens
NNCKFVWLSLLRNSFYTHCKSI

SEQ ID NO: 3028072 - protein, 24 aa, Entamoeba invadens
NNCNILSLLFWGIVSNDSTCLRCE

SEQ ID NO: 3028073 - protein, 28 aa, Entamoeba invadens
NNEPIFVYGLLDQGYWPDGLYTAPTDEA

SEQ ID NO: 3028074 - protein, 18 aa, Entamoeba invadens
NNFLTFQKASYWLDEIRS

SEQ ID NO: 3028075 - protein, 24 aa, Entamoeba invadens
NNFPLVDILLLELTILYVQTNMWF

SEQ ID NO: 3028076 - protein, 24 aa, Entamoeba invadens
NNFVLERYIVALNYMFKRASDITN

SEQ ID NO: 3028077 - protein, 24 aa, Entamoeba invadens
NNHQELFLQFLLQDTPITEWKDIL

SEQ ID NO: 3028078 - protein, 20 aa, Entamoeba invadens
NNHVLTLNKEYFFLRKPLER

SEQ ID NO: 3028079 - protein, 23 aa, Entamoeba invadens
NNKERYFYLFNDVLTYGIGDEKN

SEQ ID NO: 3028080 - protein, 24 aa, Entamoeba invadens
NNKLYQCYLYCTPYLKNLFVDCND

SEQ ID NO: 3028081 - protein, 24 aa, Entamoeba invadens
NNKTDYILVVTLYTILILTTDYSI

SEQ ID NO: 3028082 - protein, 17 aa, Entamoeba invadens
NNLILKLQGIINSLKPL

SEQ ID NO: 3028083 - protein, 24 aa, Entamoeba invadens
NNLKFLFKYYLLVSNYVAAVGVLD

SEQ ID NO: 3028084 - protein, 25 aa, Entamoeba invadens
NNNFLKRTYFVDKEATKLAFKEFFP

SEQ ID NO: 3028085 - protein, 25 aa, Entamoeba invadens
NNRYIGYFYLVSFYGKFHCAGKQFV

SEQ ID NO: 3028086 - protein, 17 aa, Entamoeba invadens
NNSFFIRLNKLYLGLLN

SEQ ID NO: 3028087 - protein, 17 aa, Entamoeba invadens
NPAFEQFFIPLVDFLRT

SEQ ID NO: 3028088 - protein, 29 aa, Entamoeba invadens
NPFPVSFALRLFGRFYPIIPLKFIQKEFE

SEQ ID NO: 3028089 - protein, 17 aa, Entamoeba invadens
NPHFCKLIAWYDNEWGY

SEQ ID NO: 3028090 - protein, 18 aa, Entamoeba invadens
NPILRFYQDADFVELEVK

SEQ ID NO: 3028091 - protein, 25 aa, Entamoeba invadens
NPIRGLFLRTYLLDTLKPVLPDINS

SEQ ID NO: 3028092 - protein, 17 aa, Entamoeba invadens
NPITCAFPLIFGERGLG

SEQ ID NO: 3028093 - protein, 25 aa, Entamoeba invadens
NPLMFDQLILLLRSICLECFTLKAS

SEQ ID NO: 3028094 - protein, 17 aa, Entamoeba invadens
NPLVFSFPSDEPFPYCL

SEQ ID NO: 3028095 - protein, 18 aa, Entamoeba invadens
NPRPWWMRRMRGHMFEPF

SEQ ID NO: 3028096 - protein, 17 aa, Entamoeba invadens
NPTLIVPYLFLGAVNAT

SEQ ID NO: 3028097 - protein, 24 aa, Entamoeba invadens
NPVFEYIRYIILPFLGKAKLCGKE

SEQ ID NO: 3028098 - protein, 20 aa, Entamoeba invadens
NPVPIPPQYLSKFFPKATEI

SEQ ID NO: 3028099 - protein, 23 aa, Entamoeba invadens
NQKKIIVPFILLKGVNDLETVYM

SEQ ID NO: 3028100 - protein, 19 aa, Entamoeba invadens
NQLPGWQILVFPLLEKFTS

SEQ ID NO: 3028101 - protein, 17 aa, Entamoeba invadens
NQLTYEDLLLLLLTQLH

SEQ ID NO: 3028102 - protein, 23 aa, Entamoeba invadens
NQLTYEDLLLLLLTQLHGDYRYK

SEQ ID NO: 3028103 - protein, 25 aa, Entamoeba invadens
NQMQQPQLVLPPTTPLKIVEKEPKV

SEQ ID NO: 3028104 - protein, 19 aa, Entamoeba invadens
NQMYILCEGVLRQCENVYQ

SEQ ID NO: 3028105 - protein, 23 aa, Entamoeba invadens
NQRIPFGFYKRTLPHYWKEDYGF

SEQ ID NO: 3028106 - protein, 20 aa, Entamoeba invadens
NQTLILLDSFSYFCMCVRDK

SEQ ID NO: 3028107 - protein, 20 aa, Entamoeba invadens
NRCVLCAPSGYYDLCTDETS

SEQ ID NO: 3028108 - protein, 22 aa, Entamoeba invadens
NREFFRIIVWFNVDFETFDRNK

SEQ ID NO: 3028109 - protein, 22 aa, Entamoeba invadens
NRIGHQFFWFLKAELHDNRVTE

SEQ ID NO: 3028110 - protein, 23 aa, Entamoeba invadens
NRIRLFLNEYVMIPILISAYERL

SEQ ID NO: 3028111 - protein, 23 aa, Entamoeba invadens
NRIRRSFLKLLQQNLLTLDNNGG

SEQ ID NO: 3028112 - protein, 17 aa, Entamoeba invadens
NRKGLYFIVICRNGTVF

SEQ ID NO: 3028113 - protein, 22 aa, Entamoeba invadens
NRKYLLFLLNMYYTLCANDTSG

SEQ ID NO: 3028114 - protein, 26 aa, Entamoeba invadens
NRLETFPVPILFIQNLKYLSLANNMI

SEQ ID NO: 3028115 - protein, 18 aa, Entamoeba invadens
NRPLFKELYPLPLRKEKN

SEQ ID NO: 3028116 - protein, 23 aa, Entamoeba invadens
NRRNPFMEKIYALAIKPIEEQYI

SEQ ID NO: 3028117 - protein, 24 aa, Entamoeba invadens
NRVVLFFLSYKYYITNKPYLGVII

SEQ ID NO: 3028118 - protein, 20 aa, Entamoeba invadens
NRYCPIFSMWCMCHRLNLCV

SEQ ID NO: 3028119 - protein, 21 aa, Entamoeba invadens
NRYCPIFSMWCMCHRLNLCVE

SEQ ID NO: 3028120 - protein, 23 aa, Entamoeba invadens
NSAWSHRFYTLKVLGFLNDSEKL

SEQ ID NO: 3028121 - protein, 25 aa, Entamoeba invadens
NSCVKFLREFKLFPGIKTLVINSSY

SEQ ID NO: 3028122 - protein, 17 aa, Entamoeba invadens
NSDLLYLNLLNARVFLS

SEQ ID NO: 3028123 - protein, 20 aa, Entamoeba invadens
NSFLHKLSAWLPLQSTDLVK

SEQ ID NO: 3028124 - protein, 22 aa, Entamoeba invadens
NSFSKLFPSRWYNYGFNDIVKI

SEQ ID NO: 3028125 - protein, 19 aa, Entamoeba invadens
NSHYNLFLYMIAFLKEIVK

SEQ ID NO: 3028126 - protein, 32 aa, Entamoeba invadens
NSIYQLPIVISRLALFGIPIPDILNWAGIDVT

SEQ ID NO: 3028127 - protein, 23 aa, Entamoeba invadens
NSNPFYLQPMTPPSLIRLNQFEE

SEQ ID NO: 3028128 - protein, 24 aa, Entamoeba invadens
NSPFKFQYVVLKKGKRPSALLENT

SEQ ID NO: 3028129 - protein, 20 aa, Entamoeba invadens
NSPILLPFQKMLLSGLGDVL

SEQ ID NO: 3028130 - protein, 20 aa, Entamoeba invadens
NSQPFYLFPSNLRGKKVIFK

SEQ ID NO: 3028131 - protein, 22 aa, Entamoeba invadens
NSSDLLVYLYSSNPQKQLQNIA

SEQ ID NO: 3028132 - protein, 25 aa, Entamoeba invadens
NSSNDIHFTFLWVKDMFTFLDLKPY

SEQ ID NO: 3028133 - protein, 21 aa, Entamoeba invadens
NSVLGWFGLSTDNFAVNQDPK

SEQ ID NO: 3028134 - protein, 19 aa, Entamoeba invadens
NSYALYYKQFFLGIKYSMG

SEQ ID NO: 3028135 - protein, 24 aa, Entamoeba invadens
NSYKELLEYLLSFPQMKPLINVKN

SEQ ID NO: 3028136 - protein, 18 aa, Entamoeba invadens
NTDFLLLLVKKLVERNKR

SEQ ID NO: 3028137 - protein, 23 aa, Entamoeba invadens
NTHLYFAPIPIPQSRKDPIKDDE

SEQ ID NO: 3028138 - protein, 18 aa, Entamoeba invadens
NTLLLKKGLLLENTRIDK

SEQ ID NO: 3028139 - protein, 23 aa, Entamoeba invadens
NTLTNLFCLRVMTGSIILNDIIS

SEQ ID NO: 3028140 - protein, 23 aa, Entamoeba invadens
NTLYSHRFFPYYSFSILTGLSVK

SEQ ID NO: 3028141 - protein, 18 aa, Entamoeba invadens
NTRFLPPTIIDPLKDKGT

SEQ ID NO: 3028142 - protein, 21 aa, Entamoeba invadens
NTRPLLFVALLQNDVSLTEKY

SEQ ID NO: 3028143 - protein, 26 aa, Entamoeba invadens
NTTAEALMWVFLLRQSFIGFYDPNEI

SEQ ID NO: 3028144 - protein, 21 aa, Entamoeba invadens
NTVFNNIFFNCKIGFSGNSKG

SEQ ID NO: 3028145 - protein, 20 aa, Entamoeba invadens
NVALFNIILELINVSSKQSG

SEQ ID NO: 3028146 - protein, 22 aa, Entamoeba invadens
NVDVIYTSPLKRALETANIISE

SEQ ID NO: 3028147 - protein, 24 aa, Entamoeba invadens
NVEPLLCTLLLKLFKTDLVDNENV

SEQ ID NO: 3028148 - protein, 21 aa, Entamoeba invadens
NVFYNNFLLQRATVPLILLNS

SEQ ID NO: 3028149 - protein, 22 aa, Entamoeba invadens
NVKFYCTILTDLFDFDFIPTGV

SEQ ID NO: 3028150 - protein, 24 aa, Entamoeba invadens
NVLHIFKKYKVKISPILPVALVNQ

SEQ ID NO: 3028151 - protein, 21 aa, Entamoeba invadens
NVMKLIYLDLLGYNTQFAQIE

SEQ ID NO: 3028152 - protein, 23 aa, Entamoeba invadens
NVNFYTILFTWKQKKIWKTTPKR

SEQ ID NO: 3028153 - protein, 22 aa, Entamoeba invadens
NVQQQPLMFWTQPQNQNITGQN

SEQ ID NO: 3028154 - protein, 20 aa, Entamoeba invadens
NVRRFYYRLLDEGKPFGVTD

SEQ ID NO: 3028155 - protein, 23 aa, Entamoeba invadens
NVSKILVFTIWLKDMIGIKQIPI

SEQ ID NO: 3028156 - protein, 26 aa, Entamoeba invadens
NVSYYIYLYYFYSNIVSLNILRTMKG

SEQ ID NO: 3028157 - protein, 19 aa, Entamoeba invadens
NVTLPIYYVPVAISYVNNT

SEQ ID NO: 3028158 - protein, 23 aa, Entamoeba invadens
NVYPVPFVLLFNPEEFRNFVHEF

SEQ ID NO: 3028159 - protein, 26 aa, Entamoeba invadens
NWKKVFVILKHTFLFVFKSAEDPTLI

SEQ ID NO: 3028160 - protein, 17 aa, Entamoeba invadens
NWNISFSKYIKILEQYY

SEQ ID NO: 3028161 - protein, 25 aa, Entamoeba invadens
NWREIYKSLLVLDNVLKNGSEEAVE

SEQ ID NO: 3028162 - protein, 21 aa, Entamoeba invadens
NYAFKFCWNIKTLSFPNLLSK

SEQ ID NO: 3028163 - protein, 22 aa, Entamoeba invadens
NYCEWIYRFLLIAQEPLDSTIS

SEQ ID NO: 3028164 - protein, 18 aa, Entamoeba invadens
NYGLLKTPFHLIADSQTC

SEQ ID NO: 3028165 - protein, 18 aa, Entamoeba invadens
NYHYALFSELKFLNDTTL

SEQ ID NO: 3028166 - protein, 17 aa, Entamoeba invadens
NYKFLFGRKLLRYGDSN

SEQ ID NO: 3028167 - protein, 22 aa, Entamoeba invadens
NYKIYLRFLTFNMQSLRVESDT

SEQ ID NO: 3028168 - protein, 18 aa, Entamoeba invadens
NYLLFTNIEYIRGFSSSI

SEQ ID NO: 3028169 - protein, 24 aa, Entamoeba invadens
NYLSGLLVALYYNASFLSKCSISN

SEQ ID NO: 3028170 - protein, 26 aa, Entamoeba invadens
NYLWKQNCFLITSYTSFIKFEKTIKK

SEQ ID NO: 3028171 - protein, 21 aa, Entamoeba invadens
NYPNLFLFYSPVMRNNFMKEI

SEQ ID NO: 3028172 - protein, 29 aa, Entamoeba invadens
NYRVLFEMRPFPKIPILSLWMHDVVNINE

SEQ ID NO: 3028173 - protein, 19 aa, Entamoeba invadens
NYTIDYLLQTQPLPFIKDP

SEQ ID NO: 3028174 - protein, 17 aa, Entamoeba invadens
NYWVVRPVLRKHQKCFG

SEQ ID NO: 3028175 - protein, 20 aa, Entamoeba invadens
PAAAPAMNPFGGFNPAAVKL

SEQ ID NO: 3028176 - protein, 21 aa, Entamoeba invadens
PADCILFYSYRDKFVYERFLM

SEQ ID NO: 3028177 - protein, 17 aa, Entamoeba invadens
PADFLVMSFYKIVGYPT

SEQ ID NO: 3028178 - protein, 17 aa, Entamoeba invadens
PAEFPYKPPMIKFATRV

SEQ ID NO: 3028179 - protein, 22 aa, Entamoeba invadens
PAHILFIKHFYLNVLQLPPDET

SEQ ID NO: 3028180 - protein, 23 aa, Entamoeba invadens
PALTRFFMYLPVQSVMQIIDFCV

SEQ ID NO: 3028181 - protein, 23 aa, Entamoeba invadens
PATFLDQVIPLVQALFSVVTGLQ

SEQ ID NO: 3028182 - protein, 19 aa, Entamoeba invadens
PCKAYKFCFLLNISETKKL

SEQ ID NO: 3028183 - protein, 18 aa, Entamoeba invadens
PCPVYILSLPFYKEQLEK

SEQ ID NO: 3028184 - protein, 18 aa, Entamoeba invadens
PCQFPVLFSCYKDFTNDA

SEQ ID NO: 3028185 - protein, 24 aa, Entamoeba invadens
PDAVTLLWHPFITSPATPVAQPLI

SEQ ID NO: 3028186 - protein, 18 aa, Entamoeba invadens
PDDLIIDPKIILQQAERM

SEQ ID NO: 3028187 - protein, 26 aa, Entamoeba invadens
PDENKNILWLLIRFLRKVTDNTELTQ

SEQ ID NO: 3028188 - protein, 25 aa, Entamoeba invadens
PDFNWKYLFLLYDSYTQMSNFFNKT

SEQ ID NO: 3028189 - protein, 24 aa, Entamoeba invadens
PDGMLPPPGLAPPGGMLPPPGLAP

SEQ ID NO: 3028190 - protein, 19 aa, Entamoeba invadens
PDLLPPPPGLAPPPANMPL

SEQ ID NO: 3028191 - protein, 26 aa, Entamoeba invadens
PDMFSWFPFFFPIQPPIDLKRGDVVE

SEQ ID NO: 3028192 - protein, 26 aa, Entamoeba invadens
PDPRLPKPLFAWNLPKGYEAVLKKAY

SEQ ID NO: 3028193 - protein, 22 aa, Entamoeba invadens
PDRENFVLYFYTNKKFVGGIDL

SEQ ID NO: 3028194 - protein, 23 aa, Entamoeba invadens
PDYLQLRMLFWKIAKREGIQFDG

SEQ ID NO: 3028195 - protein, 23 aa, Entamoeba invadens
PDYLQLRMLFWKIAKREGIVFDG

SEQ ID NO: 3028196 - protein, 21 aa, Entamoeba invadens
PDYLQLRMLFWKIAKREIIVF

SEQ ID NO: 3028197 - protein, 18 aa, Entamoeba invadens
PEDVSAIILLKIKQIVLS

SEQ ID NO: 3028198 - protein, 17 aa, Entamoeba invadens
PEELFKGYFDFVVFGHE

SEQ ID NO: 3028199 - protein, 24 aa, Entamoeba invadens
PEETLFLQPFFARTYFSVACAPEG

SEQ ID NO: 3028200 - protein, 23 aa, Entamoeba invadens
PEFPRRFYLFVLKFFSKIFKTDF

SEQ ID NO: 3028201 - protein, 18 aa, Entamoeba invadens
PEGCMLNLLHFAYEGNEP

SEQ ID NO: 3028202 - protein, 21 aa, Entamoeba invadens
PEGWFQGFLIPILTGTTFWLE

SEQ ID NO: 3028203 - protein, 24 aa, Entamoeba invadens
PEKDPFFLYILLRCNSIPTSKAIE

SEQ ID NO: 3028204 - protein, 18 aa, Entamoeba invadens
PELAPPGGLAPPPGLEPP

SEQ ID NO: 3028205 - protein, 21 aa, Entamoeba invadens
PELWKFVNPFFPYINSVDREK

SEQ ID NO: 3028206 - protein, 23 aa, Entamoeba invadens
PENTMELRLYPHIKYVLGLECVK

SEQ ID NO: 3028207 - protein, 18 aa, Entamoeba invadens
PEPLFILELKISPYLYTE

SEQ ID NO: 3028208 - protein, 21 aa, Entamoeba invadens
PEPTAAFYFYSIRNHAFNIEN

SEQ ID NO: 3028209 - protein, 24 aa, Entamoeba invadens
PERKLRIFHGLTFRVGYCGVTERT

SEQ ID NO: 3028210 - protein, 21 aa, Entamoeba invadens
PFDEKLFPYSWDITNLISKGE

SEQ ID NO: 3028211 - protein, 19 aa, Entamoeba invadens
PFDEKLFPYSWDITNLISS

SEQ ID NO: 3028212 - protein, 24 aa, Entamoeba invadens
PFIQILYIIVLKRPDLFTTKTAQK

SEQ ID NO: 3028213 - protein, 18 aa, Entamoeba invadens
PFKLLLKFFGYIVDKLRH

SEQ ID NO: 3028214 - protein, 25 aa, Entamoeba invadens
PFLDTYFPILLSRCKLSLPPTSTHG

SEQ ID NO: 3028215 - protein, 18 aa, Entamoeba invadens
PFLLEKLLADAWNSDPFQ

SEQ ID NO: 3028216 - protein, 18 aa, Entamoeba invadens
PFPIFRLKQTTSAQIYQP

SEQ ID NO: 3028217 - protein, 17 aa, Entamoeba invadens
PFPLNASPLLKVLLLDC

SEQ ID NO: 3028218 - protein, 17 aa, Entamoeba invadens
PFPYPSWRSVVLPQGFV

SEQ ID NO: 3028219 - protein, 25 aa, Entamoeba invadens
PFSERELFFALLKQSIHDGTSIFKM

SEQ ID NO: 3028220 - protein, 20 aa, Entamoeba invadens
PFVFIVQFIPKWFKALTDCG

SEQ ID NO: 3028221 - protein, 17 aa, Entamoeba invadens
PFVLQNCLPTNNSYGWS

SEQ ID NO: 3028222 - protein, 19 aa, Entamoeba invadens
PFVVQLKAFLEKHDMDVKV

SEQ ID NO: 3028223 - protein, 17 aa, Entamoeba invadens
PFVWKLVLEYYPFSSTS

SEQ ID NO: 3028224 - protein, 25 aa, Entamoeba invadens
PFWLNVYHIMLLHGLMYWKHRPNVE

SEQ ID NO: 3028225 - protein, 20 aa, Entamoeba invadens
PGCNCFLMCFSLISQGSLDN

SEQ ID NO: 3028226 - protein, 24 aa, Entamoeba invadens
PGLAPPPGMMPPPPGPPPPSNSKM

SEQ ID NO: 3028227 - protein, 17 aa, Entamoeba invadens
PGVYFIPFLLESGLKDE

SEQ ID NO: 3028228 - protein, 19 aa, Entamoeba invadens
PHPFWLPKFQNGVSFSLPV

SEQ ID NO: 3028229 - protein, 19 aa, Entamoeba invadens
PHYIICQLRCNGVLEGIRI

SEQ ID NO: 3028230 - protein, 21 aa, Entamoeba invadens
PHYIIYVLLNTQKRIRYFIDS

SEQ ID NO: 3028231 - protein, 18 aa, Entamoeba invadens
PIEKWTMNYPLGWEKKCL

SEQ ID NO: 3028232 - protein, 21 aa, Entamoeba invadens
PIELKKFLSFAFTYNLEKSKQ

SEQ ID NO: 3028233 - protein, 19 aa, Entamoeba invadens
PIIFFEFKKVNNLLLVVDG

SEQ ID NO: 3028234 - protein, 21 aa, Entamoeba invadens
PIKVMFIKFLANCFVTTPPEI

SEQ ID NO: 3028235 - protein, 19 aa, Entamoeba invadens
PIKYLPRHVLIPAFLMDSN

SEQ ID NO: 3028236 - protein, 17 aa, Entamoeba invadens
PILLKRVSSFIQGALST

SEQ ID NO: 3028237 - protein, 22 aa, Entamoeba invadens
PIQKIVILFPKLETLYLPYEVD

SEQ ID NO: 3028238 - protein, 19 aa, Entamoeba invadens
PIQRIPRYVLLIKDMLKCA

SEQ ID NO: 3028239 - protein, 24 aa, Entamoeba invadens
PIRMKVMGFVRSWVKWRFIDFEDV

SEQ ID NO: 3028240 - protein, 24 aa, Entamoeba invadens
PISDDLLFAAFFPEKQRFPASIEL

SEQ ID NO: 3028241 - protein, 18 aa, Entamoeba invadens
PISLFGVIAARLLCLQKL

SEQ ID NO: 3028242 - protein, 21 aa, Entamoeba invadens
PISLPVYLERVKKLALGCSTT

SEQ ID NO: 3028243 - protein, 24 aa, Entamoeba invadens
PKEEYILAAFFFPITRDGDLFETQ

SEQ ID NO: 3028244 - protein, 17 aa, Entamoeba invadens
PKKLLCPLYFMGFCPYG

SEQ ID NO: 3028245 - protein, 17 aa, Entamoeba invadens
PKKPQTAYMLYLNEHRA

SEQ ID NO: 3028246 - protein, 21 aa, Entamoeba invadens
PKLLFELFAPLFRFKDQALTL

SEQ ID NO: 3028247 - protein, 21 aa, Entamoeba invadens
PKRILLLWKRGEALIWTEEVC

SEQ ID NO: 3028248 - protein, 21 aa, Entamoeba invadens
PKRLCFWLSTVLRVYAWTCMS

SEQ ID NO: 3028249 - protein, 23 aa, Entamoeba invadens
PKTFLPEQISALVLKYLYSIVQD

SEQ ID NO: 3028250 - protein, 21 aa, Entamoeba invadens
PKTQFKYPWVIAKFVIEGKRL

SEQ ID NO: 3028251 - protein, 21 aa, Entamoeba invadens
PKYREIFLLMFRLYTSPEVVM

SEQ ID NO: 3028252 - protein, 21 aa, Entamoeba invadens
PLAVLQIFKTIRDLEKIGWVY

SEQ ID NO: 3028253 - protein, 24 aa, Entamoeba invadens
PLDCPWFICYFSGRPHINFSCKSQ

SEQ ID NO: 3028254 - protein, 18 aa, Entamoeba invadens
PLDGLNVPYFLFTAIRFI

SEQ ID NO: 3028255 - protein, 22 aa, Entamoeba invadens
PLDILKCILAYLPTGRYQTVCQ

SEQ ID NO: 3028256 - protein, 19 aa, Entamoeba invadens
PLFAAIFRVLRAYCASHVD

SEQ ID NO: 3028257 - protein, 20 aa, Entamoeba invadens
PLFCILITKDVFFRVDIKYI

SEQ ID NO: 3028258 - protein, 17 aa, Entamoeba invadens
PLFLLVIALNQILSSVS

SEQ ID NO: 3028259 - protein, 17 aa, Entamoeba invadens
PLFVILANPTYLPIVGN

SEQ ID NO: 3028260 - protein, 22 aa, Entamoeba invadens
PLHKLPHPLQILEQRRPGKDVR

SEQ ID NO: 3028261 - protein, 20 aa, Entamoeba invadens
PLKPFHFYALKTTSGKRPWM

SEQ ID NO: 3028262 - protein, 19 aa, Entamoeba invadens
PLKVLYFDVAIQFSKTYQY

SEQ ID NO: 3028263 - protein, 18 aa, Entamoeba invadens
PLLPPFIESLLKRIDEII

SEQ ID NO: 3028264 - protein, 28 aa, Entamoeba invadens
PLLPPSDLLPPPGLAPPAGLAPPPNIPP

SEQ ID NO: 3028265 - protein, 20 aa, Entamoeba invadens
PLLVFYSFFVKSLARHEIFE

SEQ ID NO: 3028266 - protein, 21 aa, Entamoeba invadens
PLNIIGKCVLLIYKDLHQVPT

SEQ ID NO: 3028267 - protein, 18 aa, Entamoeba invadens
PLPKAPKKGYKYVKDDKD

SEQ ID NO: 3028268 - protein, 22 aa, Entamoeba invadens
PLPLPQIVLDFLKALGPFCKKV

SEQ ID NO: 3028269 - protein, 17 aa, Entamoeba invadens
PLPMYRAIQYLLMSDNI

SEQ ID NO: 3028270 - protein, 18 aa, Entamoeba invadens
PLPPLPFLKELDLSHNVL

SEQ ID NO: 3028271 - protein, 21 aa, Entamoeba invadens
PLQLHFVPLTLFLAINTRDTR

SEQ ID NO: 3028272 - protein, 18 aa, Entamoeba invadens
PLQLVKKDGIFQIKVREN

SEQ ID NO: 3028273 - protein, 24 aa, Entamoeba invadens
PLRNKLVHHLIMSYGVYQRLNIYK

SEQ ID NO: 3028274 - protein, 18 aa, Entamoeba invadens
PLRSYLILPIQRVPRYSL

SEQ ID NO: 3028275 - protein, 18 aa, Entamoeba invadens
PLSFCSFVFVFRTALDKN

SEQ ID NO: 3028276 - protein, 26 aa, Entamoeba invadens
PLTDVHFLPKWFSLDSLICAGDGLSV

SEQ ID NO: 3028277 - protein, 17 aa, Entamoeba invadens
PLYDWVVDIFGMRKPII

SEQ ID NO: 3028278 - protein, 18 aa, Entamoeba invadens
PMEESYMRLLPSKGIEKG

SEQ ID NO: 3028279 - protein, 20 aa, Entamoeba invadens
PMENLFFPESLLSRFDLIFI

SEQ ID NO: 3028280 - protein, 17 aa, Entamoeba invadens
PMKLPFLQLVLAVPPSM

SEQ ID NO: 3028281 - protein, 25 aa, Entamoeba invadens
PMLFKNFNLLFKTSYIRFVLENNNF

SEQ ID NO: 3028282 - protein, 19 aa, Entamoeba invadens
PMMKWMNLKYLFKLLPNLV

SEQ ID NO: 3028283 - protein, 25 aa, Entamoeba invadens
PMMTEVMFYVLLKFKAFEGNEEVLM

SEQ ID NO: 3028284 - protein, 19 aa, Entamoeba invadens
PNCLMLFVLSRWSNKEFFE

SEQ ID NO: 3028285 - protein, 18 aa, Entamoeba invadens
PNDRFFYNKAIKYALIAG

SEQ ID NO: 3028286 - protein, 20 aa, Entamoeba invadens
PNEFLKLLSLVFFVIKKDTK

SEQ ID NO: 3028287 - protein, 20 aa, Entamoeba invadens
PNFFIFFLKTPSGLPVPAKF

SEQ ID NO: 3028288 - protein, 17 aa, Entamoeba invadens
PNFFKPISPYNVNIPIL

SEQ ID NO: 3028289 - protein, 24 aa, Entamoeba invadens
PNIDTNPPLCQIIPFVISEPIISV

SEQ ID NO: 3028290 - protein, 22 aa, Entamoeba invadens
PNKKMLVLLPVPMKLEKDEYYV

SEQ ID NO: 3028291 - protein, 17 aa, Entamoeba invadens
PNKSFPFAWTNPTLKHL

SEQ ID NO: 3028292 - protein, 18 aa, Entamoeba invadens
PNLMILVITTEGLSFGCF

SEQ ID NO: 3028293 - protein, 21 aa, Entamoeba invadens
PNPFALPLMTPPSLLQLNVLA

SEQ ID NO: 3028294 - protein, 26 aa, Entamoeba invadens
PNQVPGWPALIYPFVRQLLNLKLVKN

SEQ ID NO: 3028295 - protein, 23 aa, Entamoeba invadens
PNRILMFVSIYYLELFRGERFGF

SEQ ID NO: 3028296 - protein, 21 aa, Entamoeba invadens
PNTQFPLQFKFDLKGSLYGRK

SEQ ID NO: 3028297 - protein, 24 aa, Entamoeba invadens
PPCFFNVLLPLLLPPNPPAVSDAV

SEQ ID NO: 3028298 - protein, 34 aa, Entamoeba invadens
PPEMCWTLLTIFLKKLPVPLLYPLDKFVTEKETP

SEQ ID NO: 3028299 - protein, 18 aa, Entamoeba invadens
PPGLAPPGGMLPPPGLEP

SEQ ID NO: 3028300 - protein, 17 aa, Entamoeba invadens
PPGLEPPGGMLPPPGLA

SEQ ID NO: 3028301 - protein, 20 aa, Entamoeba invadens
PPGMLPPPGLEPPGGMLPPP

SEQ ID NO: 3028302 - protein, 24 aa, Entamoeba invadens
PPGMMPPPGLAPPGAPPGGLMPPG

SEQ ID NO: 3028303 - protein, 20 aa, Entamoeba invadens
PPHVFALKNHFFFGCVKLTK

SEQ ID NO: 3028304 - protein, 23 aa, Entamoeba invadens
PPIFPPTLYKAIFLFFRDIVSVN

SEQ ID NO: 3028305 - protein, 17 aa, Entamoeba invadens
PPKIPQKAPPKLPQRIP

SEQ ID NO: 3028306 - protein, 21 aa, Entamoeba invadens
PPKKPLPLAPTKIPPPPLKLP

SEQ ID NO: 3028307 - protein, 18 aa, Entamoeba invadens
PPRHGGAAVLPPPGLVPP

SEQ ID NO: 3028308 - protein, 21 aa, Entamoeba invadens
PPRNMVHVFAKTLLKYFDDKI

SEQ ID NO: 3028309 - protein, 24 aa, Entamoeba invadens
PPTIKIFERVYFYNCHKLTKISFT

SEQ ID NO: 3028310 - protein, 19 aa, Entamoeba invadens
PPTPLAVPPPLPPQSIHMA

SEQ ID NO: 3028311 - protein, 27 aa, Entamoeba invadens
PPVFVELQIRFYLLTRLLGVKTSEGEA

SEQ ID NO: 3028312 - protein, 20 aa, Entamoeba invadens
PPVYTYFYLCVIVSSDGFVK

SEQ ID NO: 3028313 - protein, 20 aa, Entamoeba invadens
PPYEYYLYYIYANMTVLNGI

SEQ ID NO: 3028314 - protein, 18 aa, Entamoeba invadens
PQELYFFGFLRVVDVDKV

SEQ ID NO: 3028315 - protein, 17 aa, Entamoeba invadens
PQIVLFFSEGDFYKYVI

SEQ ID NO: 3028316 - protein, 20 aa, Entamoeba invadens
PQKKFVIPFTAQPSEQIPQP

SEQ ID NO: 3028317 - protein, 25 aa, Entamoeba invadens
PQKSLWVFRMRVLRRLLAKYRAMGK

SEQ ID NO: 3028318 - protein, 18 aa, Entamoeba invadens
PQPQAYAPLIIPKEIWRL

SEQ ID NO: 3028319 - protein, 21 aa, Entamoeba invadens
PQSYKPTYFRPMSIKYERMLR

SEQ ID NO: 3028320 - protein, 25 aa, Entamoeba invadens
PQYYIDKILYCKPFLSPLNKARTEI

SEQ ID NO: 3028321 - protein, 19 aa, Entamoeba invadens
PRCPWAVTLLYSLSAYKDR

SEQ ID NO: 3028322 - protein, 20 aa, Entamoeba invadens
PRHFILFNDIFLYGMGDEAA

SEQ ID NO: 3028323 - protein, 19 aa, Entamoeba invadens
PRISWIRLQVLDLSFNELS

SEQ ID NO: 3028324 - protein, 19 aa, Entamoeba invadens
PRVFTLFYQIYPNLLENGI

SEQ ID NO: 3028325 - protein, 20 aa, Entamoeba invadens
PRVLRYIPFLRKYIPNLETY

SEQ ID NO: 3028326 - protein, 18 aa, Entamoeba invadens
PRWILFYELVMTTKEYVR

SEQ ID NO: 3028327 - protein, 20 aa, Entamoeba invadens
PRYVLLIKDMLKCAPPITQD

SEQ ID NO: 3028328 - protein, 17 aa, Entamoeba invadens
PSAFVPVQCLPSFFSVE

SEQ ID NO: 3028329 - protein, 26 aa, Entamoeba invadens
PSEPPFQYWIFFLRMNISVLNNLRKS

SEQ ID NO: 3028330 - protein, 27 aa, Entamoeba invadens
PSESHWIFAVQDAFYISVFPNQSYIDK

SEQ ID NO: 3028331 - protein, 23 aa, Entamoeba invadens
PSFQYWIYFLRMNISVLNNLRKS

SEQ ID NO: 3028332 - protein, 20 aa, Entamoeba invadens
PSGMFLEFYAKATGAGTEAA

SEQ ID NO: 3028333 - protein, 18 aa, Entamoeba invadens
PSHLFIQTPFFEYKPNQQ

SEQ ID NO: 3028334 - protein, 24 aa, Entamoeba invadens
PSHLPLSVRFYWDSKVPKGYYNKE

SEQ ID NO: 3028335 - protein, 21 aa, Entamoeba invadens
PSIYRLLLPFYGKISEWLTLP

SEQ ID NO: 3028336 - protein, 27 aa, Entamoeba invadens
PSKKDFNLWINNIPLFCNFTGVFGYPL

SEQ ID NO: 3028337 - protein, 21 aa, Entamoeba invadens
PSKPFFAVIVWYPCDYSYIKT

SEQ ID NO: 3028338 - protein, 20 aa, Entamoeba invadens
PSPVLQGMWFYPLVKSIRSE

SEQ ID NO: 3028339 - protein, 29 aa, Entamoeba invadens
PSQVPYPLNKYLLFSLLKLHLPPNRMLIQ

SEQ ID NO: 3028340 - protein, 18 aa, Entamoeba invadens
PSRPLPPPPLKKSQQLRQ

SEQ ID NO: 3028341 - protein, 24 aa, Entamoeba invadens
PSSPLPHLLLSPLAFFLKSDKMTK

SEQ ID NO: 3028342 - protein, 20 aa, Entamoeba invadens
PSTNFLNFVFMPVCLQSLVY

SEQ ID NO: 3028343 - protein, 17 aa, Entamoeba invadens
PTEGFWLNYVIKAYGDS

SEQ ID NO: 3028344 - protein, 18 aa, Entamoeba invadens
PTEPLFVILANPTYLPIV

SEQ ID NO: 3028345 - protein, 23 aa, Entamoeba invadens
PTKAFVATLWLKSIFELHLSYLM

SEQ ID NO: 3028346 - protein, 24 aa, Entamoeba invadens
PTKGKLVFLMMLLKTPKGVEVLLD

SEQ ID NO: 3028347 - protein, 22 aa, Entamoeba invadens
PTKKFFRVVIWFQVSYKTTQEI

SEQ ID NO: 3028348 - protein, 20 aa, Entamoeba invadens
PTLIMGIMDPTPEYVKIVLC

SEQ ID NO: 3028349 - protein, 21 aa, Entamoeba invadens
PTLSLLLSPIFHFLLPFLTSQ

SEQ ID NO: 3028350 - protein, 24 aa, Entamoeba invadens
PTMNALWCLFVMLLIGVSSEKCEA

SEQ ID NO: 3028351 - protein, 18 aa, Entamoeba invadens
PTPFTWKLTQSKQSLVTC

SEQ ID NO: 3028352 - protein, 22 aa, Entamoeba invadens
PTPTKPIIKMRALYDYEATDDT

SEQ ID NO: 3028353 - protein, 18 aa, Entamoeba invadens
PTTLFTKLARFLRILIRY

SEQ ID NO: 3028354 - protein, 28 aa, Entamoeba invadens
PVAIEYCWFFLDIIIKSLTLYLDKMSIF

SEQ ID NO: 3028355 - protein, 18 aa, Entamoeba invadens
PVCFKLFPHIHTLNFYKK

SEQ ID NO: 3028356 - protein, 18 aa, Entamoeba invadens
PVCLGVTGGFFLRIKKEE

SEQ ID NO: 3028357 - protein, 20 aa, Entamoeba invadens
PVEIEFFKPLTLIQGPNGAG

SEQ ID NO: 3028358 - protein, 23 aa, Entamoeba invadens
PVESLIVLLIKQLNLRLQVIEST

SEQ ID NO: 3028359 - protein, 19 aa, Entamoeba invadens
PVFFVKLLEVYLFPILVVK

SEQ ID NO: 3028360 - protein, 20 aa, Entamoeba invadens
PVICKILAIVNNWINVYPPL

SEQ ID NO: 3028361 - protein, 19 aa, Entamoeba invadens
PVIHKFLEKLLSFQKIINL

SEQ ID NO: 3028362 - protein, 18 aa, Entamoeba invadens
PVIYHDLWMQIKTTDFLG

SEQ ID NO: 3028363 - protein, 20 aa, Entamoeba invadens
PVQRIPRYQLLLKELLKTIH

SEQ ID NO: 3028364 - protein, 25 aa, Entamoeba invadens
PVQRIPRYRLLLTELLKTMTPQHGE

SEQ ID NO: 3028365 - protein, 23 aa, Entamoeba invadens
PVQRLPRYQLLLVDLFKNTPKDH

SEQ ID NO: 3028366 - protein, 23 aa, Entamoeba invadens
PVQTDMLLFLKLVDYFQDDNDTD

SEQ ID NO: 3028367 - protein, 19 aa, Entamoeba invadens
PVREEFLLFLSKRVKLQTL

SEQ ID NO: 3028368 - protein, 19 aa, Entamoeba invadens
PVSWILICRVIIYSLMELH

SEQ ID NO: 3028369 - protein, 18 aa, Entamoeba invadens
PVTLPFLFHVLITTFFGV

SEQ ID NO: 3028370 - protein, 17 aa, Entamoeba invadens
PVVFLPYTLSNDLLKPL

SEQ ID NO: 3028371 - protein, 19 aa, Entamoeba invadens
PVYGTLLPKLFPPMTERYK

SEQ ID NO: 3028372 - protein, 19 aa, Entamoeba invadens
PWILSPILRTVRWLNKMNT

SEQ ID NO: 3028373 - protein, 17 aa, Entamoeba invadens
PWLFYINNVIFTKKCWE

SEQ ID NO: 3028374 - protein, 23 aa, Entamoeba invadens
PYADLLYEFVLSYLAKNVSNKDC

SEQ ID NO: 3028375 - protein, 18 aa, Entamoeba invadens
PYEIFSLFFTKELKDFVI

SEQ ID NO: 3028376 - protein, 23 aa, Entamoeba invadens
PYERIRYPEFFPFQINSKGTDEP

SEQ ID NO: 3028377 - protein, 24 aa, Entamoeba invadens
PYKRMKLITLWYLTGFSNAMKLVR

SEQ ID NO: 3028378 - protein, 29 aa, Entamoeba invadens
PYKSSHFNVLFFKLLFRRIDGFIGDNPTP

SEQ ID NO: 3028379 - protein, 17 aa, Entamoeba invadens
PYNCMLSLHSLLESAGV

SEQ ID NO: 3028380 - protein, 27 aa, Entamoeba invadens
PYQTLSTIFFLYLYSLNIPLLPIDDID

SEQ ID NO: 3028381 - protein, 22 aa, Entamoeba invadens
PYSIIRFFIERLPLEKNYGIEL

SEQ ID NO: 3028382 - protein, 24 aa, Entamoeba invadens
PYSTQLWNIKYIPDLVWTKIFEDT

SEQ ID NO: 3028383 - protein, 27 aa, Entamoeba invadens
PYYLEASYPYWILRLVWKRKDHTFTVI

SEQ ID NO: 3028384 - protein, 31 aa, Entamoeba invadens
QADIWALGCLLYKVLFFVTPFEGSPMKIMRG

SEQ ID NO: 3028385 - protein, 21 aa, Entamoeba invadens
QAETKLFFYILKLTQICVTPM

SEQ ID NO: 3028386 - protein, 20 aa, Entamoeba invadens
QAFFLVLLNKKYDFVICKPT

SEQ ID NO: 3028387 - protein, 17 aa, Entamoeba invadens
QAKINIYKPSQSKLHTS

SEQ ID NO: 3028388 - protein, 34 aa, Entamoeba invadens
QAKNGFYTLLFLRFLFIPFLQYPPVLKFFQSAVV

SEQ ID NO: 3028389 - protein, 32 aa, Entamoeba invadens
QAKSGTEEFKFGKIKIFFKVADNQRLQNGITE

SEQ ID NO: 3028390 - protein, 33 aa, Entamoeba invadens
QAKSGTEEFKFGKIKIFFKVGVLAEIEERRRVD

SEQ ID NO: 3028391 - protein, 21 aa, Entamoeba invadens
QANFFFHFFAFVRKLNKQEHM

SEQ ID NO: 3028392 - protein, 19 aa, Entamoeba invadens
QAQILKRYLPVSLDSDKLK

SEQ ID NO: 3028393 - protein, 17 aa, Entamoeba invadens
QASLLLSFSQYLNTMNL

SEQ ID NO: 3028394 - protein, 23 aa, Entamoeba invadens
QATYFQFLPIFKKQTIKHTKNKQ

SEQ ID NO: 3028395 - protein, 18 aa, Entamoeba invadens
QAVSLMFTLLKQGINGEP

SEQ ID NO: 3028396 - protein, 17 aa, Entamoeba invadens
QCFVFSLLNPTNTIQRY

SEQ ID NO: 3028397 - protein, 18 aa, Entamoeba invadens
QCMIILFYTLPSCYPSEG

SEQ ID NO: 3028398 - protein, 17 aa, Entamoeba invadens
QCNASMLMILNTPLIQY

SEQ ID NO: 3028399 - protein, 22 aa, Entamoeba invadens
QDGYQWFFKNLLVTVWSAPKYC

SEQ ID NO: 3028400 - protein, 26 aa, Entamoeba invadens
QDLQSLYLTLFGRVGLMKNTLLVGNV

SEQ ID NO: 3028401 - protein, 26 aa, Entamoeba invadens
QDLRKLYVNMIPYTRLRFLTSSIAPV

SEQ ID NO: 3028402 - protein, 23 aa, Entamoeba invadens
QDQAVWMLNAMWFKEKDARAEEL

SEQ ID NO: 3028403 - protein, 18 aa, Entamoeba invadens
QDQAVWMLNAMWPKEQDK

SEQ ID NO: 3028404 - protein, 32 aa, Entamoeba invadens
QDTIHTWYQFRNWVWFRLLQKVQPTLKRRRKL

SEQ ID NO: 3028405 - protein, 24 aa, Entamoeba invadens
QDTLRLLTLLFKFGKFREVEHAVT

SEQ ID NO: 3028406 - protein, 27 aa, Entamoeba invadens
QEDYYHMFQVISYLYFAPFRQQSNVRI

SEQ ID NO: 3028407 - protein, 23 aa, Entamoeba invadens
QEECKLYKKPWYSYFVRVVDEDL

SEQ ID NO: 3028408 - protein, 24 aa, Entamoeba invadens
QEIPENIFWCKYFRLLFTVQDRES

SEQ ID NO: 3028409 - protein, 26 aa, Entamoeba invadens
QEKVAYFFFNKAYIMLLKDTDGYWNV

SEQ ID NO: 3028410 - protein, 17 aa, Entamoeba invadens
QEPLLFDIPTQSGKVRL

SEQ ID NO: 3028411 - protein, 26 aa, Entamoeba invadens
QEPPKELFYYFLFNDILIQTKPKKFH

SEQ ID NO: 3028412 - protein, 31 aa, Entamoeba invadens
QEQAKKSLFKIKWFLPHLFSRNRSKTEMKKA

SEQ ID NO: 3028413 - protein, 22 aa, Entamoeba invadens
QFEILMMDCAIMLKLAACNNYI

SEQ ID NO: 3028414 - protein, 18 aa, Entamoeba invadens
QFFLPFLLDFIDNFDRLS

SEQ ID NO: 3028415 - protein, 20 aa, Entamoeba invadens
QFHMNFLPYMSLIKQPKPVG

SEQ ID NO: 3028416 - protein, 19 aa, Entamoeba invadens
QFKGLIPVLIEYFNNAKKG

SEQ ID NO: 3028417 - protein, 20 aa, Entamoeba invadens
QFKKLFFKTVAVSYAFYLQM

SEQ ID NO: 3028418 - protein, 17 aa, Entamoeba invadens
QFLIHLYLSKFPTQFLA

SEQ ID NO: 3028419 - protein, 19 aa, Entamoeba invadens
QFMDFDSIFWMSIHFHPNI

SEQ ID NO: 3028420 - protein, 20 aa, Entamoeba invadens
QFPLQFKFDLKGSLYGRKAD

SEQ ID NO: 3028421 - protein, 22 aa, Entamoeba invadens
QFPVIVLRDNPVIFLLRTHRDI

SEQ ID NO: 3028422 - protein, 19 aa, Entamoeba invadens
QFQLATNLLWAIWGFVDAA

SEQ ID NO: 3028423 - protein, 19 aa, Entamoeba invadens
QFVFFYTLANYALPNAMRW

SEQ ID NO: 3028424 - protein, 19 aa, Entamoeba invadens
QFYVKGDAFILVYSIDNLN

SEQ ID NO: 3028425 - protein, 19 aa, Entamoeba invadens
QGMGKLCEVPWKTNTPKVD

SEQ ID NO: 3028426 - protein, 17 aa, Entamoeba invadens
QGSFKMRKPFPLPWRGL

SEQ ID NO: 3028427 - protein, 21 aa, Entamoeba invadens
QGVHNLLIQYLLQGPKEIFNN

SEQ ID NO: 3028428 - protein, 22 aa, Entamoeba invadens
QGVLFKISLGNFFLFEKDGVEY

SEQ ID NO: 3028429 - protein, 19 aa, Entamoeba invadens
QGYLYLCLCALYANPHDPI

SEQ ID NO: 3028430 - protein, 28 aa, Entamoeba invadens
QHKALYTSIFLFLLKAFPKIETLQCVDY

SEQ ID NO: 3028431 - protein, 31 aa, Entamoeba invadens
QHRNQGLLLEIKTMVECNALFKQRSEEGMRN

SEQ ID NO: 3028432 - protein, 23 aa, Entamoeba invadens
QHTNYLLYLPLLMRHIVIQPRSE

SEQ ID NO: 3028433 - protein, 18 aa, Entamoeba invadens
QIEFNIIRGYYWTGNPLQ

SEQ ID NO: 3028434 - protein, 20 aa, Entamoeba invadens
QIEFTAILFVPQRAPFDMFD

SEQ ID NO: 3028435 - protein, 23 aa, Entamoeba invadens
QIEYVVHFSIFKKSGQLLDDLFV

SEQ ID NO: 3028436 - protein, 18 aa, Entamoeba invadens
QIIAKYFLVFSDYFSIIQ

SEQ ID NO: 3028437 - protein, 17 aa, Entamoeba invadens
QIILSHQLIAFSSLANA

SEQ ID NO: 3028438 - protein, 24 aa, Entamoeba invadens
QIINADVVLKNFLLAKAREDYSKQ

SEQ ID NO: 3028439 - protein, 23 aa, Entamoeba invadens
QILDIPQILLKKSNLLFIVVDTS

SEQ ID NO: 3028440 - protein, 23 aa, Entamoeba invadens
QILSALFFHKIITPAIITPTKFC

SEQ ID NO: 3028441 - protein, 23 aa, Entamoeba invadens
QIPQLPLNFLPFAPTPLKAPTQQ

SEQ ID NO: 3028442 - protein, 21 aa, Entamoeba invadens
QIQDLAFFKNKFQDLLLDIPE

SEQ ID NO: 3028443 - protein, 26 aa, Entamoeba invadens
QISDIVRLLPLSRQFLLFSATIPQSL

SEQ ID NO: 3028444 - protein, 24 aa, Entamoeba invadens
QISKLPSNFFIFSNLRALNFTHNQ

SEQ ID NO: 3028445 - protein, 26 aa, Entamoeba invadens
QIVSTKNFFLFTWKNKIFKTYERKEN

SEQ ID NO: 3028446 - protein, 22 aa, Entamoeba invadens
QKCFNWYTPPLPLYGIAERPIV

SEQ ID NO: 3028447 - protein, 19 aa, Entamoeba invadens
QKCYFNHLIPISFPQNMTS

SEQ ID NO: 3028448 - protein, 24 aa, Entamoeba invadens
QKIDFFKIVVWYPVNFRLANKHNK

SEQ ID NO: 3028449 - protein, 17 aa, Entamoeba invadens
QKIILISKMPRPLELHH

SEQ ID NO: 3028450 - protein, 22 aa, Entamoeba invadens
QKKEFFRVVFWYNVSYSITQKF

SEQ ID NO: 3028451 - protein, 17 aa, Entamoeba invadens
QKKPSIPIINTTKPTPL

SEQ ID NO: 3028452 - protein, 22 aa, Entamoeba invadens
QKKPVYVFLQKLPSKEFSLSDY

SEQ ID NO: 3028453 - protein, 22 aa, Entamoeba invadens
QKLIQFFEKCGNIRLLESSAPE

SEQ ID NO: 3028454 - protein, 20 aa, Entamoeba invadens
QKLMLIFMCVIRRVYLRFDT

SEQ ID NO: 3028455 - protein, 25 aa, Entamoeba invadens
QKMGAMWWFVLVERNVWRCAQWFTD

SEQ ID NO: 3028456 - protein, 21 aa, Entamoeba invadens
QKMQLLYWMDLLSDYTNLKYE

SEQ ID NO: 3028457 - protein, 24 aa, Entamoeba invadens
QKTKYPRILFRRSDRTRQSEDKIE

SEQ ID NO: 3028458 - protein, 22 aa, Entamoeba invadens
QKTNYQYILLFNDILICGKGDE

SEQ ID NO: 3028459 - protein, 24 aa, Entamoeba invadens
QLELLVRCVFKIPEAFVSELDFLK

SEQ ID NO: 3028460 - protein, 19 aa, Entamoeba invadens
QLFGYVFLSWRRFASGRLI

SEQ ID NO: 3028461 - protein, 20 aa, Entamoeba invadens
QLFQFIPYRNQAHPSCFLIQ

SEQ ID NO: 3028462 - protein, 21 aa, Entamoeba invadens
QLGMPLYRILKMLAKPSATTL

SEQ ID NO: 3028463 - protein, 23 aa, Entamoeba invadens
QLHEYIIRLKKLNGLITITVEMH

SEQ ID NO: 3028464 - protein, 17 aa, Entamoeba invadens
QLKKYQEIPWISEIRKK

SEQ ID NO: 3028465 - protein, 18 aa, Entamoeba invadens
QLKPFFAAFIDKFYDVFP

SEQ ID NO: 3028466 - protein, 23 aa, Entamoeba invadens
QLLALPHYYLTLFKSFENLFSLG

SEQ ID NO: 3028467 - protein, 17 aa, Entamoeba invadens
QLLEFFEIYIKAIKCVN

SEQ ID NO: 3028468 - protein, 17 aa, Entamoeba invadens
QLLILKRIVEKFPHFLD

SEQ ID NO: 3028469 - protein, 18 aa, Entamoeba invadens
QLLMPLPLPKRYGTILRL

SEQ ID NO: 3028470 - protein, 18 aa, Entamoeba invadens
QLLTRKPSAPIRKKSSRV

SEQ ID NO: 3028471 - protein, 21 aa, Entamoeba invadens
QLLVCLPITYFLNVNKWDLNT

SEQ ID NO: 3028472 - protein, 18 aa, Entamoeba invadens
QLPIYNVLDRFSDGMWKL

SEQ ID NO: 3028473 - protein, 22 aa, Entamoeba invadens
QLVVLELPRPLLTPGYEAVIHI

SEQ ID NO: 3028474 - protein, 19 aa, Entamoeba invadens
QLWRALLLDFLKKILEYDP

SEQ ID NO: 3028475 - protein, 20 aa, Entamoeba invadens
QLYAPVYNPVYVKYILKVLK

SEQ ID NO: 3028476 - protein, 17 aa, Entamoeba invadens
QLYVKFFVKVRNAMLVV

SEQ ID NO: 3028477 - protein, 23 aa, Entamoeba invadens
QMKAIKIVFPFSKLFHCVRHIHR

SEQ ID NO: 3028478 - protein, 18 aa, Entamoeba invadens
QMVPLRNWIFYTKAENSM

SEQ ID NO: 3028479 - protein, 20 aa, Entamoeba invadens
QNADLEYLVLTNYSFRRDEK

SEQ ID NO: 3028480 - protein, 23 aa, Entamoeba invadens
QNEQFLIWLSKHQISPILTEALE

SEQ ID NO: 3028481 - protein, 20 aa, Entamoeba invadens
QNFLLKCPDLFRLASHFVNL

SEQ ID NO: 3028482 - protein, 20 aa, Entamoeba invadens
QNFLVFQDLNLFLTQKYKNL

SEQ ID NO: 3028483 - protein, 21 aa, Entamoeba invadens
QNGFVSIPLLFGTTRVLSYKM

SEQ ID NO: 3028484 - protein, 24 aa, Entamoeba invadens
QNHTIERWVGMLGGYSVVRPKDAD

SEQ ID NO: 3028485 - protein, 23 aa, Entamoeba invadens
QNIDCQFLYNAFLFLVRQNVDIS

SEQ ID NO: 3028486 - protein, 18 aa, Entamoeba invadens
QNKDGLLFYLIFPVQHPA

SEQ ID NO: 3028487 - protein, 24 aa, Entamoeba invadens
QNKDPLANVPPFPKGFADITQTPT

SEQ ID NO: 3028488 - protein, 21 aa, Entamoeba invadens
QNLIHMLFLYHDPLLSLHLDM

SEQ ID NO: 3028489 - protein, 25 aa, Entamoeba invadens
QNPRANIHFFLYKPRLIGAKCVGFH

SEQ ID NO: 3028490 - protein, 22 aa, Entamoeba invadens
QNTLWYFCEFLHQIILKKDINK

SEQ ID NO: 3028491 - protein, 23 aa, Entamoeba invadens
QNVAMMLTLPFITQNRFLAILNT

SEQ ID NO: 3028492 - protein, 31 aa, Entamoeba invadens
QNVKLCLDAGYQLLNIPRLLDENYVADDKVD

SEQ ID NO: 3028493 - protein, 24 aa, Entamoeba invadens
QNVSPIPHLLLSPLSLILPVVNKQ

SEQ ID NO: 3028494 - protein, 19 aa, Entamoeba invadens
QPGFFPVPLPNIPNPPNQD

SEQ ID NO: 3028495 - protein, 20 aa, Entamoeba invadens
QPHFMDFLNGYFDLLKKLPI

SEQ ID NO: 3028496 - protein, 23 aa, Entamoeba invadens
QPKFYLTGAFLFSLMYAGSNIKE

SEQ ID NO: 3028497 - protein, 22 aa, Entamoeba invadens
QPKPLLFNPTIYFPPSKPSNLV

SEQ ID NO: 3028498 - protein, 24 aa, Entamoeba invadens
QPKQPLFIRRIGTVLSPLREFIAL

SEQ ID NO: 3028499 - protein, 19 aa, Entamoeba invadens
QPMKFVLTFKLGSASLELL

SEQ ID NO: 3028500 - protein, 20 aa, Entamoeba invadens
QPNELPGFKTPFLSGVTATE

SEQ ID NO: 3028501 - protein, 27 aa, Entamoeba invadens
QPPLQPPIDMLPPPLAPPPLTTTTQTL

SEQ ID NO: 3028502 - protein, 22 aa, Entamoeba invadens
QQDFFCDLPMVLVKRSTCTAIP

SEQ ID NO: 3028503 - protein, 23 aa, Entamoeba invadens
QQELFFFHTLSPGSCFWLPHGTR

SEQ ID NO: 3028504 - protein, 23 aa, Entamoeba invadens
QQEYLNHALTFFSGLKALVVDSV

SEQ ID NO: 3028505 - protein, 19 aa, Entamoeba invadens
QQIYFYILEMPVNLMFKEL

SEQ ID NO: 3028506 - protein, 23 aa, Entamoeba invadens
QQRLPYVPLLLKYIESMTFYSND

SEQ ID NO: 3028507 - protein, 17 aa, Entamoeba invadens
QQSFLIAILIRNGFYIK

SEQ ID NO: 3028508 - protein, 22 aa, Entamoeba invadens
QQTHVLWVFNFDASILASIPID

SEQ ID NO: 3028509 - protein, 22 aa, Entamoeba invadens
QQWRTFMYVLTQKLVDMLYSSV

SEQ ID NO: 3028510 - protein, 21 aa, Entamoeba invadens
QREMFFYMSLLSQQLPIESQF

SEQ ID NO: 3028511 - protein, 22 aa, Entamoeba invadens
QREVLPLLYLFIANSNAPAVLH

SEQ ID NO: 3028512 - protein, 29 aa, Entamoeba invadens
QRKALYTSIFLFLLKAFPKIETLQCVDFM

SEQ ID NO: 3028513 - protein, 17 aa, Entamoeba invadens
QRLFICPEGYKLMTEIS

SEQ ID NO: 3028514 - protein, 18 aa, Entamoeba invadens
QRLPRYQLLLQDLLKHTE

SEQ ID NO: 3028515 - protein, 29 aa, Entamoeba invadens
QRLVWAHQVFWSRAFLVIYPDPIGDVASL

SEQ ID NO: 3028516 - protein, 24 aa, Entamoeba invadens
QRQGIVPIFLYPTLGLESLDYIVK

SEQ ID NO: 3028517 - protein, 23 aa, Entamoeba invadens
QRSKRGILFLSEAMRWIVDETCF

SEQ ID NO: 3028518 - protein, 21 aa, Entamoeba invadens
QRSNLMCLLSLILSTFNVKDQ

SEQ ID NO: 3028519 - protein, 21 aa, Entamoeba invadens
QRWIPEEKITFFKALCLMCHH

SEQ ID NO: 3028520 - protein, 25 aa, Entamoeba invadens
QSCIILPNFLILPVQRLPRYILLLE

SEQ ID NO: 3028521 - protein, 17 aa, Entamoeba invadens
QSDVLAFWIATLCALIH

SEQ ID NO: 3028522 - protein, 23 aa, Entamoeba invadens
QSFYSLLKVLFFGDKRSYTFVLD

SEQ ID NO: 3028523 - protein, 21 aa, Entamoeba invadens
QSIIYWDIPFAEYKLGRTLDF

SEQ ID NO: 3028524 - protein, 25 aa, Entamoeba invadens
QSILKNFFNLYKLLAYIPQFKDSIA

SEQ ID NO: 3028525 - protein, 17 aa, Entamoeba invadens
QSILKQFMLLSASLLVK

SEQ ID NO: 3028526 - protein, 20 aa, Entamoeba invadens
QSKALPEFDWILGNTTHLEE

SEQ ID NO: 3028527 - protein, 22 aa, Entamoeba invadens
QSLDVLFKCYLVPLSYSKYSPI

SEQ ID NO: 3028528 - protein, 18 aa, Entamoeba invadens
QSLTLWWNIMRQMPFLWI

SEQ ID NO: 3028529 - protein, 25 aa, Entamoeba invadens
QSSKYAFLMKEKCQLTISLEQMKTQ

SEQ ID NO: 3028530 - protein, 22 aa, Entamoeba invadens
QSYLKMEIPNVVELPQKVIPME

SEQ ID NO: 3028531 - protein, 23 aa, Entamoeba invadens
QTDPFLFVKMIDFGWSRSIAEEM

SEQ ID NO: 3028532 - protein, 19 aa, Entamoeba invadens
QTDPLYALSFLLDSRSLQV

SEQ ID NO: 3028533 - protein, 21 aa, Entamoeba invadens
QTEGFFPYRIPQQSLYARKDV

SEQ ID NO: 3028534 - protein, 23 aa, Entamoeba invadens
QTFMFEYFMLWFCRKFPVELEVR

SEQ ID NO: 3028535 - protein, 25 aa, Entamoeba invadens
QTIEPLILIPLLRFTPKVLVCVGDP

SEQ ID NO: 3028536 - protein, 17 aa, Entamoeba invadens
QTIILIFFILKKLADIT

SEQ ID NO: 3028537 - protein, 20 aa, Entamoeba invadens
QTIKMLLPENVVIDNVVYDQ

SEQ ID NO: 3028538 - protein, 18 aa, Entamoeba invadens
QTLHLLAFDLLVDSAKPG

SEQ ID NO: 3028539 - protein, 22 aa, Entamoeba invadens
QTLVCTFLIKYYPLIFRDTCEN

SEQ ID NO: 3028540 - protein, 21 aa, Entamoeba invadens
QTMIPTELLVLYKIPDTYIKD

SEQ ID NO: 3028541 - protein, 21 aa, Entamoeba invadens
QTPFFLISYLMATVPLSFEDA

SEQ ID NO: 3028542 - protein, 24 aa, Entamoeba invadens
QTPLFFLDYFTIFTSLYQVGSTYL

SEQ ID NO: 3028543 - protein, 20 aa, Entamoeba invadens
QTYRWFVCLFSREFHYHMTF

SEQ ID NO: 3028544 - protein, 17 aa, Entamoeba invadens
QVILCGDFFQLPPVSSD

SEQ ID NO: 3028545 - protein, 17 aa, Entamoeba invadens
QVLMKLRFQFELRYFNC

SEQ ID NO: 3028546 - protein, 20 aa, Entamoeba invadens
QVPDKVILYYAYEKEGDSYK

SEQ ID NO: 3028547 - protein, 23 aa, Entamoeba invadens
QVQFPFFVNILQTSVWPFFPQNF

SEQ ID NO: 3028548 - protein, 19 aa, Entamoeba invadens
QYDCIWIQWSILYLRDEDL

SEQ ID NO: 3028549 - protein, 24 aa, Entamoeba invadens
QYELPYHILKMFHFLFEVGYATTG

SEQ ID NO: 3028550 - protein, 25 aa, Entamoeba invadens
QYHATRLFFFIKQQDPHALLRFITT

SEQ ID NO: 3028551 - protein, 17 aa, Entamoeba invadens
QYPMQYWPYMYMQGNQG

SEQ ID NO: 3028552 - protein, 25 aa, Entamoeba invadens
QYTLIHLYFVLPFKHFRPLLDLFDL

SEQ ID NO: 3028553 - protein, 20 aa, Entamoeba invadens
QYWIFQLVAAVLHMGNIYFT

SEQ ID NO: 3028554 - protein, 19 aa, Entamoeba invadens
QYYLKGDAFVLVYSIDNKN

SEQ ID NO: 3028555 - protein, 19 aa, Entamoeba invadens
RACFFLAILRQFETLREQH

SEQ ID NO: 3028556 - protein, 18 aa, Entamoeba invadens
RACSLLNDIQFPSSLLSV

SEQ ID NO: 3028557 - protein, 24 aa, Entamoeba invadens
RAEELWNLVVLFSSLELENGKEGC

SEQ ID NO: 3028558 - protein, 19 aa, Entamoeba invadens
RAEELWSLVSLFASLEQEN

SEQ ID NO: 3028559 - protein, 24 aa, Entamoeba invadens
RAIAIIIFHRLITPALISPANYNS

SEQ ID NO: 3028560 - protein, 20 aa, Entamoeba invadens
RAKIICEMLNDKEFLKQERA

SEQ ID NO: 3028561 - protein, 17 aa, Entamoeba invadens
RAPLYDWVVDIFGMRKP

SEQ ID NO: 3028562 - protein, 20 aa, Entamoeba invadens
RASIKPIMYEGFLAGGIAAG

SEQ ID NO: 3028563 - protein, 18 aa, Entamoeba invadens
RAYPDTDIFLLCFSIDDT

SEQ ID NO: 3028564 - protein, 26 aa, Entamoeba invadens
RDICLGLLYRLLQTLSVRFTLPTKKL

SEQ ID NO: 3028565 - protein, 23 aa, Entamoeba invadens
RDKDAIPVFLWMANNYFTVQGSD

SEQ ID NO: 3028566 - protein, 24 aa, Entamoeba invadens
RDKRGTFLMNRLISMLSAFQAATT

SEQ ID NO: 3028567 - protein, 23 aa, Entamoeba invadens
RDNLLMFFQFFYQKALALPPTDE

SEQ ID NO: 3028568 - protein, 24 aa, Entamoeba invadens
RDNLLSWLLDGFLGLAPDKYEQLF

SEQ ID NO: 3028569 - protein, 19 aa, Entamoeba invadens
RDNYDLYYTVFLNEQFKDQ

SEQ ID NO: 3028570 - protein, 20 aa, Entamoeba invadens
RDPAFLAFLGFFFDLLTEAK

SEQ ID NO: 3028571 - protein, 18 aa, Entamoeba invadens
RDPKKWWKFAFTATRDYL

SEQ ID NO: 3028572 - protein, 24 aa, Entamoeba invadens
RDSTRFLMCTLSFHLTNISGMEIV

SEQ ID NO: 3028573 - protein, 25 aa, Entamoeba invadens
RDSTRFLMCTLSFHLTYISGIEIVK

SEQ ID NO: 3028574 - protein, 25 aa, Entamoeba invadens
RDSTRFLMCTLSFHLTYISGMEIVK

SEQ ID NO: 3028575 - protein, 22 aa, Entamoeba invadens
RDTKTIYPCPLVLIFNPNAFKN

SEQ ID NO: 3028576 - protein, 18 aa, Entamoeba invadens
REARNPVFYFLQKNHPNY

SEQ ID NO: 3028577 - protein, 18 aa, Entamoeba invadens
REDRLKAIQSAREKARKD

SEQ ID NO: 3028578 - protein, 24 aa, Entamoeba invadens
REEKILVKVLPKYFAFIQENPQTL

SEQ ID NO: 3028579 - protein, 24 aa, Entamoeba invadens
REFGGDIFWWLRKLDFDNNVINFF

SEQ ID NO: 3028580 - protein, 17 aa, Entamoeba invadens
REFYRIIVWFNVDFETI

SEQ ID NO: 3028581 - protein, 21 aa, Entamoeba invadens
REIDLLSFLKLYNEELDNNKL

SEQ ID NO: 3028582 - protein, 17 aa, Entamoeba invadens
RELWLDYFVLLCGQNND

SEQ ID NO: 3028583 - protein, 18 aa, Entamoeba invadens
RENALRVLKLRKIRQRQL

SEQ ID NO: 3028584 - protein, 19 aa, Entamoeba invadens
RENKLEQLPFYAKARRVKV

SEQ ID NO: 3028585 - protein, 24 aa, Entamoeba invadens
REQNDMLFQLPYLQFLRTAYCNTM

SEQ ID NO: 3028586 - protein, 23 aa, Entamoeba invadens
REQYRAIRNLDLRFRFSLGTELD

SEQ ID NO: 3028587 - protein, 23 aa, Entamoeba invadens
RERPGTYLYLLLDYYEAGNINDF

SEQ ID NO: 3028588 - protein, 18 aa, Entamoeba invadens
RERPLPPLPLTDRKQRSP

SEQ ID NO: 3028589 - protein, 19 aa, Entamoeba invadens
RESNVINALIFFDSLESVR

SEQ ID NO: 3028590 - protein, 20 aa, Entamoeba invadens
RESWLRTFETVRIVFQRNNP

SEQ ID NO: 3028591 - protein, 18 aa, Entamoeba invadens
REWKICKPDFIRLLKTME

SEQ ID NO: 3028592 - protein, 21 aa, Entamoeba invadens
REYQWRVFSAWDLTTNAMAAM

SEQ ID NO: 3028593 - protein, 24 aa, Entamoeba invadens
RFEALILCFLRFVEVFKIYAFFIN

SEQ ID NO: 3028594 - protein, 22 aa, Entamoeba invadens
RFEERFMYFGAAKLLPEAKSEN

SEQ ID NO: 3028595 - protein, 27 aa, Entamoeba invadens
RFEVCAIALYWILFQQNYRISEELALT

SEQ ID NO: 3028596 - protein, 18 aa, Entamoeba invadens
RFFCLHWFITKCHSFMII

SEQ ID NO: 3028597 - protein, 19 aa, Entamoeba invadens
RFGFRSIVAYAPWIKRIFL

SEQ ID NO: 3028598 - protein, 20 aa, Entamoeba invadens
RFHIPMEQPVLLRLPEEEAA

SEQ ID NO: 3028599 - protein, 22 aa, Entamoeba invadens
RFHYNPIPLDKKFRKLFPAIET

SEQ ID NO: 3028600 - protein, 22 aa, Entamoeba invadens
RFHYNPIPLTLKTRQFFPNLKI

SEQ ID NO: 3028601 - protein, 18 aa, Entamoeba invadens
RFLFLLELAHWYYMDNWI

SEQ ID NO: 3028602 - protein, 17 aa, Entamoeba invadens
RFLRLKKIIISLLKKGI

SEQ ID NO: 3028603 - protein, 17 aa, Entamoeba invadens
RFLYRLCEDVYIVVITT

SEQ ID NO: 3028604 - protein, 19 aa, Entamoeba invadens
RFMNPPFTAVLMLIKVMQY

SEQ ID NO: 3028605 - protein, 17 aa, Entamoeba invadens
RFRLLIVDSVTSLFRVD

SEQ ID NO: 3028606 - protein, 17 aa, Entamoeba invadens
RFVLTNYSYLSASGVLG

SEQ ID NO: 3028607 - protein, 18 aa, Entamoeba invadens
RFVSLFGRIALGVEDAVY

SEQ ID NO: 3028608 - protein, 20 aa, Entamoeba invadens
RFYYNKYLQTVYFPSTIVDF

SEQ ID NO: 3028609 - protein, 20 aa, Entamoeba invadens
RGDLPLFFYMNPFFGDQNTP

SEQ ID NO: 3028610 - protein, 20 aa, Entamoeba invadens
RGICLVNRLISMLSAFQAAT

SEQ ID NO: 3028611 - protein, 26 aa, Entamoeba invadens
RGILYEGLVLKPIRLWGIWTERWMVL

SEQ ID NO: 3028612 - protein, 21 aa, Entamoeba invadens
RGISILPKTPALWLEAIELER

SEQ ID NO: 3028613 - protein, 24 aa, Entamoeba invadens
RGKGGICFLFLRKGIYTCQAVATV

SEQ ID NO: 3028614 - protein, 23 aa, Entamoeba invadens
RGKVDAFYLFVAPPSMEVLEQRL

SEQ ID NO: 3028615 - protein, 20 aa, Entamoeba invadens
RGLNQLFWKKIFVLKTIPYS

SEQ ID NO: 3028616 - protein, 18 aa, Entamoeba invadens
RGYQQPPLPPPQFPCVYH

SEQ ID NO: 3028617 - protein, 18 aa, Entamoeba invadens
RHCTLLAFNGGVFKLCNL

SEQ ID NO: 3028618 - protein, 27 aa, Entamoeba invadens
RHRFSFIDYMMFQYNKTLKDLFEKKAG

SEQ ID NO: 3028619 - protein, 19 aa, Entamoeba invadens
RHVILIYRALYQVHSSKCI

SEQ ID NO: 3028620 - protein, 21 aa, Entamoeba invadens
RHVLWYFCDFLNDVIKNEKVN

SEQ ID NO: 3028621 - protein, 20 aa, Entamoeba invadens
RICTKCLSGYYLQDGECLQI

SEQ ID NO: 3028622 - protein, 19 aa, Entamoeba invadens
RIEEILIPLGLTRLFFADC

SEQ ID NO: 3028623 - protein, 19 aa, Entamoeba invadens
RIEFLQHTMQMVYVSYHEI

SEQ ID NO: 3028624 - protein, 23 aa, Entamoeba invadens
RIFFKFILSVLKLKSFPSLFAVF

SEQ ID NO: 3028625 - protein, 21 aa, Entamoeba invadens
RIGQFAFFWCRSLLIFNGGDS

SEQ ID NO: 3028626 - protein, 18 aa, Entamoeba invadens
RIGYLALGLLLDETQETL

SEQ ID NO: 3028627 - protein, 24 aa, Entamoeba invadens
RIIDDFIFFCFFVGNDFLPHSPSL

SEQ ID NO: 3028628 - protein, 24 aa, Entamoeba invadens
RIIDDFIFLCFFIGNDFLPHSPSL

SEQ ID NO: 3028629 - protein, 17 aa, Entamoeba invadens
RIIVWFNVDFETINRNK

SEQ ID NO: 3028630 - protein, 17 aa, Entamoeba invadens
RIIVWFNVDFETVDRNK

SEQ ID NO: 3028631 - protein, 17 aa, Entamoeba invadens
RIIVWFSVNFVIVDRNK

SEQ ID NO: 3028632 - protein, 18 aa, Entamoeba invadens
RIKIVEWLFKQKKELLEE

SEQ ID NO: 3028633 - protein, 19 aa, Entamoeba invadens
RIKRQLIFKGVLKGDETSQ

SEQ ID NO: 3028634 - protein, 22 aa, Entamoeba invadens
RIKYPFPLRRAPLLNKLAYMAV

SEQ ID NO: 3028635 - protein, 17 aa, Entamoeba invadens
RILEFFSGIGGLRASLE

SEQ ID NO: 3028636 - protein, 17 aa, Entamoeba invadens
RILFITHSHIDHVGGIV

SEQ ID NO: 3028637 - protein, 21 aa, Entamoeba invadens
RILKFLLPFVVDKLPIVFGKF

SEQ ID NO: 3028638 - protein, 17 aa, Entamoeba invadens
RIPRYKLLLNDLLKHTP

SEQ ID NO: 3028639 - protein, 19 aa, Entamoeba invadens
RIRWPLLQILKLKYCQLTE

SEQ ID NO: 3028640 - protein, 26 aa, Entamoeba invadens
RITINDTLMFFLPLKGKSVEVNEIHT

SEQ ID NO: 3028641 - protein, 17 aa, Entamoeba invadens
RIVQTWGVLFPKQLFDY

SEQ ID NO: 3028642 - protein, 17 aa, Entamoeba invadens
RIWRKPNVRLFGPLMDG

SEQ ID NO: 3028643 - protein, 22 aa, Entamoeba invadens
RIYNCFFCYFGGSLQFWIIMES

SEQ ID NO: 3028644 - protein, 24 aa, Entamoeba invadens
RKCFKCLDGFYLLSGQCALCNKTT

SEQ ID NO: 3028645 - protein, 19 aa, Entamoeba invadens
RKCKVCVIGFYPDDVFGKC

SEQ ID NO: 3028646 - protein, 21 aa, Entamoeba invadens
RKDLWFFFNKIIVLSRRQTNP

SEQ ID NO: 3028647 - protein, 24 aa, Entamoeba invadens
RKDNKVFGWLFIRVLSLSDHFPYN

SEQ ID NO: 3028648 - protein, 21 aa, Entamoeba invadens
RKELNLLWASTKMILERDGLL

SEQ ID NO: 3028649 - protein, 19 aa, Entamoeba invadens
RKFAFYYCINFSQIVLPIS

SEQ ID NO: 3028650 - protein, 24 aa, Entamoeba invadens
RKFAFYYCINFSQIVLPISLVDIG

SEQ ID NO: 3028651 - protein, 23 aa, Entamoeba invadens
RKFHVKILPHKFCWRVKNDLYIC

SEQ ID NO: 3028652 - protein, 19 aa, Entamoeba invadens
RKFPYNPIQFLQLQNSYYP

SEQ ID NO: 3028653 - protein, 20 aa, Entamoeba invadens
RKIPVRMLLGCKSDLAKNRQ

SEQ ID NO: 3028654 - protein, 18 aa, Entamoeba invadens
RKITASPFIIFTSLAAQA

SEQ ID NO: 3028655 - protein, 23 aa, Entamoeba invadens
RKKDTFLVLVFYCRDFSVVCPKE

SEQ ID NO: 3028656 - protein, 24 aa, Entamoeba invadens
RKKLDVWWMKQAFLDVLKGLEYLH

SEQ ID NO: 3028657 - protein, 21 aa, Entamoeba invadens
RKLQILYFDDNGTNIRKCFVC

SEQ ID NO: 3028658 - protein, 26 aa, Entamoeba invadens
RKMNKPRFIYLFNDLFLYGTGDENKN

SEQ ID NO: 3028659 - protein, 25 aa, Entamoeba invadens
RKMTGIFFPPLLFSTYVVYANLEGM

SEQ ID NO: 3028660 - protein, 23 aa, Entamoeba invadens
RKRRFLFTFVKPKKVYLFINKFE

SEQ ID NO: 3028661 - protein, 23 aa, Entamoeba invadens
RKSLFISIALAIKLVLISKTSNE

SEQ ID NO: 3028662 - protein, 22 aa, Entamoeba invadens
RKSMLFFPPIAPLPQESSKAIS

SEQ ID NO: 3028663 - protein, 25 aa, Entamoeba invadens
RKVLQWYHFIYNAPVLLKFIGQMFF

SEQ ID NO: 3028664 - protein, 19 aa, Entamoeba invadens
RKVSYFPRDLYDFAFEVID

SEQ ID NO: 3028665 - protein, 20 aa, Entamoeba invadens
RLASLPLPPLPFLKELDLSH

SEQ ID NO: 3028666 - protein, 19 aa, Entamoeba invadens
RLCCYIVVYLSFLSKGLSS

SEQ ID NO: 3028667 - protein, 25 aa, Entamoeba invadens
RLDYLDLYLIHWPVSLRVGATWPLK

SEQ ID NO: 3028668 - protein, 17 aa, Entamoeba invadens
RLEEFIRHVWPSSRFYI

SEQ ID NO: 3028669 - protein, 18 aa, Entamoeba invadens
RLEEMLLNAVLFNDIRQL

SEQ ID NO: 3028670 - protein, 24 aa, Entamoeba invadens
RLFDKLMRLLNILFNYIDMRYKDD

SEQ ID NO: 3028671 - protein, 18 aa, Entamoeba invadens
RLFEIMLVYGLKNIKENC

SEQ ID NO: 3028672 - protein, 17 aa, Entamoeba invadens
RLFIEKHIDFLKKSFQC

SEQ ID NO: 3028673 - protein, 22 aa, Entamoeba invadens
RLFLLFGCFFMQIPFPKETETD

SEQ ID NO: 3028674 - protein, 28 aa, Entamoeba invadens
RLGSEQWEWLFWVGFRDIFVWKKGSEYE

SEQ ID NO: 3028675 - protein, 30 aa, Entamoeba invadens
RLGYPNRIIYNEFLKRYFFLGTNINKKTSD

SEQ ID NO: 3028676 - protein, 19 aa, Entamoeba invadens
RLIYLMKIFGEFFYKKDYL

SEQ ID NO: 3028677 - protein, 20 aa, Entamoeba invadens
RLKIMNFVRTWLKNAWKDFE

SEQ ID NO: 3028678 - protein, 23 aa, Entamoeba invadens
RLKMTRKILFIVFQTEVKIYKFA

SEQ ID NO: 3028679 - protein, 24 aa, Entamoeba invadens
RLLEKFFHAYATWDWARNPVMLGV

SEQ ID NO: 3028680 - protein, 20 aa, Entamoeba invadens
RLLQKWPLIEPSHALELLDF

SEQ ID NO: 3028681 - protein, 19 aa, Entamoeba invadens
RLLQTLKLEYLIDGSIELS

SEQ ID NO: 3028682 - protein, 19 aa, Entamoeba invadens
RLMFHSIFTKCKRVLNPLY

SEQ ID NO: 3028683 - protein, 18 aa, Entamoeba invadens
RLNTFQVFMFGKPVWVAE

SEQ ID NO: 3028684 - protein, 30 aa, Entamoeba invadens
RLPKVLGLLEAYRILYLLATRAKTLRFNKN

SEQ ID NO: 3028685 - protein, 17 aa, Entamoeba invadens
RLPRYNLLLTDLLKNTP

SEQ ID NO: 3028686 - protein, 18 aa, Entamoeba invadens
RLRNWLRIKAVIPLIKTV

SEQ ID NO: 3028687 - protein, 19 aa, Entamoeba invadens
RLRPLGLLSFYIGGGGQLT

SEQ ID NO: 3028688 - protein, 20 aa, Entamoeba invadens
RLRPLSILAFYKAAGGRMEQ

SEQ ID NO: 3028689 - protein, 18 aa, Entamoeba invadens
RLSYFNNIVFLKSLAVLV

SEQ ID NO: 3028690 - protein, 28 aa, Entamoeba invadens
RLTAETMLIHPWLYGPTVYVNPYFQKLL

SEQ ID NO: 3028691 - protein, 17 aa, Entamoeba invadens
RLTLLRPLLEVLIEKKY

SEQ ID NO: 3028692 - protein, 21 aa, Entamoeba invadens
RLVFELFDVLEKKGLKYVMKV

SEQ ID NO: 3028693 - protein, 17 aa, Entamoeba invadens
RLVFGEFGDLFLKETAE

SEQ ID NO: 3028694 - protein, 18 aa, Entamoeba invadens
RMDSLGHVLFYPQKPLVS

SEQ ID NO: 3028695 - protein, 23 aa, Entamoeba invadens
RMKKIKEVLFEEIGFMKAAFSQG

SEQ ID NO: 3028696 - protein, 17 aa, Entamoeba invadens
RMLFWKIAKREIIVFDG

SEQ ID NO: 3028697 - protein, 17 aa, Entamoeba invadens
RMMLTKIPFFKEVTIFA

SEQ ID NO: 3028698 - protein, 22 aa, Entamoeba invadens
RNALWQLFLTWSGVFPLETLNQ

SEQ ID NO: 3028699 - protein, 29 aa, Entamoeba invadens
RNCTSLRRFVIPQGLLYIDSLVFCNCSSL

SEQ ID NO: 3028700 - protein, 23 aa, Entamoeba invadens
RNEQLIILLHYFNNKVMNIFGKE

SEQ ID NO: 3028701 - protein, 24 aa, Entamoeba invadens
RNFFNDFVFLLDKTKYRIQLGEFV

SEQ ID NO: 3028702 - protein, 24 aa, Entamoeba invadens
RNKMFFKIIVWYPVTFKVSKTLEN

SEQ ID NO: 3028703 - protein, 23 aa, Entamoeba invadens
RNKPVGCVLIFLPGIFEITNLQR

SEQ ID NO: 3028704 - protein, 19 aa, Entamoeba invadens
RNPVFYFLQKNHPNYQYFA

SEQ ID NO: 3028705 - protein, 23 aa, Entamoeba invadens
RNRMTITGYEFKRKLTTESDQSL

SEQ ID NO: 3028706 - protein, 19 aa, Entamoeba invadens
RNVLPYVVIFLTDSILDVR

SEQ ID NO: 3028707 - protein, 21 aa, Entamoeba invadens
RNYHIFYQLLAGATPQQRSEW

SEQ ID NO: 3028708 - protein, 19 aa, Entamoeba invadens
RPIFCPFFQTHPVTIKITQ

SEQ ID NO: 3028709 - protein, 19 aa, Entamoeba invadens
RPKDFNPVLPFISSLSQLM

SEQ ID NO: 3028710 - protein, 17 aa, Entamoeba invadens
RPKLYPLSIPLSTSIKK

SEQ ID NO: 3028711 - protein, 23 aa, Entamoeba invadens
RPSKYLLYQILKVTFYDYPLENS

SEQ ID NO: 3028712 - protein, 19 aa, Entamoeba invadens
RPVLIVVPNILKLQWRMQL

SEQ ID NO: 3028713 - protein, 18 aa, Entamoeba invadens
RPYVIKSGYFSPFVICIC

SEQ ID NO: 3028714 - protein, 26 aa, Entamoeba invadens
RQHGPLFIYLFRLMLATGIPELQKVN

SEQ ID NO: 3028715 - protein, 17 aa, Entamoeba invadens
RQLICIYLANLFNKLNA

SEQ ID NO: 3028716 - protein, 20 aa, Entamoeba invadens
RQLICLARALLKNSKILIMD

SEQ ID NO: 3028717 - protein, 18 aa, Entamoeba invadens
RQLNWTIIIAPKQRKTSK

SEQ ID NO: 3028718 - protein, 19 aa, Entamoeba invadens
RQMYLVLGQCYYCVLDEAD

SEQ ID NO: 3028719 - protein, 20 aa, Entamoeba invadens
RREISFFILMKLFAILFEEK

SEQ ID NO: 3028720 - protein, 24 aa, Entamoeba invadens
RRFPSYILVCPFPIDLMTILRRVE

SEQ ID NO: 3028721 - protein, 22 aa, Entamoeba invadens
RRGLVFFWRSQSDLPFRIVIIG

SEQ ID NO: 3028722 - protein, 25 aa, Entamoeba invadens
RRIDPFPREPPLPQLDRHPLQPTLQ

SEQ ID NO: 3028723 - protein, 19 aa, Entamoeba invadens
RRKTVLACILILLKSVLKT

SEQ ID NO: 3028724 - protein, 20 aa, Entamoeba invadens
RRLEKILLYFLSIEETFDDD

SEQ ID NO: 3028725 - protein, 27 aa, Entamoeba invadens
RRLRIMNHILRHLKHKRRWLWTTKRRP

SEQ ID NO: 3028726 - protein, 23 aa, Entamoeba invadens
RRNNLQWFRCPPKIFFEPHAIRY

SEQ ID NO: 3028727 - protein, 24 aa, Entamoeba invadens
RRPKDLVLLAWYYAPNLVVGYYNR

SEQ ID NO: 3028728 - protein, 18 aa, Entamoeba invadens
RRPSGICGVALYLAGRLH

SEQ ID NO: 3028729 - protein, 21 aa, Entamoeba invadens
RRRYLFFLLNLYYSISKKSDV

SEQ ID NO: 3028730 - protein, 23 aa, Entamoeba invadens
RRTQIRYLKIKALKDVLSKKLLA

SEQ ID NO: 3028731 - protein, 19 aa, Entamoeba invadens
RRVFVIPYLMYSTMERAVK

SEQ ID NO: 3028732 - protein, 17 aa, Entamoeba invadens
RRYVHLYVKFFVKVRTA

SEQ ID NO: 3028733 - protein, 18 aa, Entamoeba invadens
RSATYPLYYFLALTVLLI

SEQ ID NO: 3028734 - protein, 24 aa, Entamoeba invadens
RSFYTLIYNTLLPKETPKTALCRL

SEQ ID NO: 3028735 - protein, 23 aa, Entamoeba invadens
RSGSFLPTLIPYILHPFSEKKLI

SEQ ID NO: 3028736 - protein, 18 aa, Entamoeba invadens
RSILKFTYPIAGKLWMKY

SEQ ID NO: 3028737 - protein, 24 aa, Entamoeba invadens
RSKSPDMFVPWIPNNMQLAVCDVP

SEQ ID NO: 3028738 - protein, 26 aa, Entamoeba invadens
RSQIQSKALILVFRKTMHEAHRDDPP

SEQ ID NO: 3028739 - protein, 22 aa, Entamoeba invadens
RSQKYYIFIAPLTQINIDEYNF

SEQ ID NO: 3028740 - protein, 31 aa, Entamoeba invadens
RSQTLSYIRNVQTILFCFDISSKNSFNSIQY

SEQ ID NO: 3028741 - protein, 20 aa, Entamoeba invadens
RSQVWKLLLGYYTPLKNDWQ

SEQ ID NO: 3028742 - protein, 19 aa, Entamoeba invadens
RSRALILPLLFFEGSVPPP

SEQ ID NO: 3028743 - protein, 24 aa, Entamoeba invadens
RSSSAFIFSLIRKGILKPKKFVIR

SEQ ID NO: 3028744 - protein, 24 aa, Entamoeba invadens
RTDVAFWFIVHSCLIKIPPANSPF

SEQ ID NO: 3028745 - protein, 19 aa, Entamoeba invadens
RTFQKLPGPFLIVTPLSTL

SEQ ID NO: 3028746 - protein, 20 aa, Entamoeba invadens
RTITFGCPYYFKNMSRGFVK

SEQ ID NO: 3028747 - protein, 17 aa, Entamoeba invadens
RTKIFPPLTLYLHYLFM

SEQ ID NO: 3028748 - protein, 19 aa, Entamoeba invadens
RTPLYLLVPPHIPMFRTIV

SEQ ID NO: 3028749 - protein, 19 aa, Entamoeba invadens
RTTRLWKLALRQPPFFLQK

SEQ ID NO: 3028750 - protein, 23 aa, Entamoeba invadens
RTVIPIIKNFRKALNRKASRRTT

SEQ ID NO: 3028751 - protein, 19 aa, Entamoeba invadens
RVFFFRRAFVFFSSEGKGI

SEQ ID NO: 3028752 - protein, 20 aa, Entamoeba invadens
RVILFRFVFCRLVLFSLKLP

SEQ ID NO: 3028753 - protein, 23 aa, Entamoeba invadens
RVIRYNCVVPRKLVMWLKYSIYV

SEQ ID NO: 3028754 - protein, 17 aa, Entamoeba invadens
RVLKLRKIRQRQLTEVT

SEQ ID NO: 3028755 - protein, 18 aa, Entamoeba invadens
RVLPKFLILLHPATFLDQ

SEQ ID NO: 3028756 - protein, 26 aa, Entamoeba invadens
RVYAKYILKCPYFLDVFPVFSQSQKL

SEQ ID NO: 3028757 - protein, 18 aa, Entamoeba invadens
RVYTVEFRFGKIKIFFKV

SEQ ID NO: 3028758 - protein, 24 aa, Entamoeba invadens
RYANRTFLLLYQYPIYPWVTSEFS

SEQ ID NO: 3028759 - protein, 21 aa, Entamoeba invadens
RYELLFFFALSFFHIEWNDYY

SEQ ID NO: 3028760 - protein, 19 aa, Entamoeba invadens
RYFPIIEKTPFLKALVKFY

SEQ ID NO: 3028761 - protein, 18 aa, Entamoeba invadens
RYFVLKANKLFYYESENT

SEQ ID NO: 3028762 - protein, 17 aa, Entamoeba invadens
RYILFKMNDKMTEIVVD

SEQ ID NO: 3028763 - protein, 17 aa, Entamoeba invadens
RYLDAISILYIKYNLQI

SEQ ID NO: 3028764 - protein, 17 aa, Entamoeba invadens
RYLIELKASLKTQRDFI

SEQ ID NO: 3028765 - protein, 23 aa, Entamoeba invadens
RYLYDAYNYLSLKNLLGLFNGMR

SEQ ID NO: 3028766 - protein, 22 aa, Entamoeba invadens
RYSPPWSVQFPEWSKLPLTSDE

SEQ ID NO: 3028767 - protein, 30 aa, Entamoeba invadens
RYTPLWIFKIMMWLRKLLYPRSYLSGLFVD

SEQ ID NO: 3028768 - protein, 18 aa, Entamoeba invadens
SACRYLYFEKGIIHRDIK

SEQ ID NO: 3028769 - protein, 21 aa, Entamoeba invadens
SAFKPLPFFKDFITLVGSHKE

SEQ ID NO: 3028770 - protein, 24 aa, Entamoeba invadens
SAKFFPGFIPLLKAFKARGGILVV

SEQ ID NO: 3028771 - protein, 24 aa, Entamoeba invadens
SAKKSVYLKLIIELEFQNIDLKSA

SEQ ID NO: 3028772 - protein, 20 aa, Entamoeba invadens
SALQLFLRQLPTDSTFDIIS

SEQ ID NO: 3028773 - protein, 21 aa, Entamoeba invadens
SALQLFLRQLPTDSTFDIVSF

SEQ ID NO: 3028774 - protein, 29 aa, Entamoeba invadens
SAQIDVFKHCWLPFSLLLASIKQVGADQN

SEQ ID NO: 3028775 - protein, 19 aa, Entamoeba invadens
SAYLYYRRGLKFSWDYISQ

SEQ ID NO: 3028776 - protein, 24 aa, Entamoeba invadens
SCDLHVFFALHRLFIEAKTAYKVT

SEQ ID NO: 3028777 - protein, 23 aa, Entamoeba invadens
SCENVIQGLYFFDPTNPLIPFMK

SEQ ID NO: 3028778 - protein, 24 aa, Entamoeba invadens
SCKDRLIFIFRVNGDIFGFYQDGF

SEQ ID NO: 3028779 - protein, 24 aa, Entamoeba invadens
SCKNKLIFIFRVNGDIFGFYQDEL

SEQ ID NO: 3028780 - protein, 20 aa, Entamoeba invadens
SCRMIYGCELCVNLLVGNVE

SEQ ID NO: 3028781 - protein, 17 aa, Entamoeba invadens
SCSICKSNYYPIQGRCV

SEQ ID NO: 3028782 - protein, 32 aa, Entamoeba invadens
SCSRQIVFNPLVINFLRSLLMYVQEAKGGALP

SEQ ID NO: 3028783 - protein, 21 aa, Entamoeba invadens
SCVFWIAYLPTKVKPKFMELS

SEQ ID NO: 3028784 - protein, 17 aa, Entamoeba invadens
SCYLFEAFSFVITKLIS

SEQ ID NO: 3028785 - protein, 19 aa, Entamoeba invadens
SDCSIAWFTAIKSALAHLS

SEQ ID NO: 3028786 - protein, 21 aa, Entamoeba invadens
SDDFLFQITPFISVSKDFNDC

SEQ ID NO: 3028787 - protein, 23 aa, Entamoeba invadens
SDDGTLYMWMPTASQKPLHRLVG

SEQ ID NO: 3028788 - protein, 20 aa, Entamoeba invadens
SDEDLMFILEFFVSKVDFIN

SEQ ID NO: 3028789 - protein, 24 aa, Entamoeba invadens
SDEIPILMYLTILKSIIEKAQEGL

SEQ ID NO: 3028790 - protein, 22 aa, Entamoeba invadens
SDFEFKCTVSFPRFAPETPQLK

SEQ ID NO: 3028791 - protein, 19 aa, Entamoeba invadens
SDFMLLHPKGPLGLSTHMI

SEQ ID NO: 3028792 - protein, 18 aa, Entamoeba invadens
SDFVYSFPLLTELTVRKI

SEQ ID NO: 3028793 - protein, 25 aa, Entamoeba invadens
SDGVLLYHLVLKFYPEYPINFQPKY

SEQ ID NO: 3028794 - protein, 24 aa, Entamoeba invadens
SDINFYRRVYWRPVSYRIYLQPHD

SEQ ID NO: 3028795 - protein, 23 aa, Entamoeba invadens
SDIYSFGIVFWEVIYKVYTKKYA

SEQ ID NO: 3028796 - protein, 24 aa, Entamoeba invadens
SDKELNQIIGFRKLATYSDWRPNN

SEQ ID NO: 3028797 - protein, 24 aa, Entamoeba invadens
SDKFFYKPFKKNLPFELYMKFYLE

SEQ ID NO: 3028798 - protein, 20 aa, Entamoeba invadens
SDKFLSFKITFSSAYVPDKE

SEQ ID NO: 3028799 - protein, 18 aa, Entamoeba invadens
SDLALFPLLLDYSQKVEA

SEQ ID NO: 3028800 - protein, 22 aa, Entamoeba invadens
SDLLDILNLISLTFASKTNVVL

SEQ ID NO: 3028801 - protein, 23 aa, Entamoeba invadens
SDMLMPLLLRLIDEDDYFITWAN

SEQ ID NO: 3028802 - protein, 23 aa, Entamoeba invadens
SDVRDWWYYPWLTEIVEDLTELK

SEQ ID NO: 3028803 - protein, 22 aa, Entamoeba invadens
SDVWALGCLIYKCLMLETPFEE

SEQ ID NO: 3028804 - protein, 25 aa, Entamoeba invadens
SECYQLGFLIFLLVQHNREVVVQNT

SEQ ID NO: 3028805 - protein, 17 aa, Entamoeba invadens
SEFEYLINLLFIHESCP

SEQ ID NO: 3028806 - protein, 19 aa, Entamoeba invadens
SEFIVYFYGAVFIPSKICM

SEQ ID NO: 3028807 - protein, 26 aa, Entamoeba invadens
SEFKRLTLLLTKLPRKRLRDVSSRLE

SEQ ID NO: 3028808 - protein, 17 aa, Entamoeba invadens
SEHSHHYWLDSIKKLKQ

SEQ ID NO: 3028809 - protein, 23 aa, Entamoeba invadens
SEILLRLNYTLTYRKTRGTSIIL

SEQ ID NO: 3028810 - protein, 25 aa, Entamoeba invadens
SEKDNPWVRLFEQCKTDLAAAETAK

SEQ ID NO: 3028811 - protein, 17 aa, Entamoeba invadens
SEKFKIVFCGTLIVCHV

SEQ ID NO: 3028812 - protein, 25 aa, Entamoeba invadens
SEKPLPKFVIWFPVTYDYAKEFEGQ

SEQ ID NO: 3028813 - protein, 26 aa, Entamoeba invadens
SEKSKWVVPLPLYRFIPYLEEKNFYV

SEQ ID NO: 3028814 - protein, 21 aa, Entamoeba invadens
SELFLLDKYLVIYKIVSDLII

SEQ ID NO: 3028815 - protein, 18 aa, Entamoeba invadens
SELKFVEKFLAKTQLKDL

SEQ ID NO: 3028816 - protein, 23 aa, Entamoeba invadens
SENKLYIYLPPNSTDVWITQSTD

SEQ ID NO: 3028817 - protein, 24 aa, Entamoeba invadens
SENMPYIQLMWALMKIRLENDKIA

SEQ ID NO: 3028818 - protein, 24 aa, Entamoeba invadens
SENPPYFYYMYYTYANIAVLNSYR

SEQ ID NO: 3028819 - protein, 26 aa, Entamoeba invadens
SETSDTFFFFPFINVLVQPITVAVES

SEQ ID NO: 3028820 - protein, 20 aa, Entamoeba invadens
SEYYYLKLYDGVIDDELFGK

SEQ ID NO: 3028821 - protein, 25 aa, Entamoeba invadens
SFAISLCYFIIPYFSANHNFRKLAD

SEQ ID NO: 3028822 - protein, 19 aa, Entamoeba invadens
SFCYKWIVLLFKRDFEPAE

SEQ ID NO: 3028823 - protein, 20 aa, Entamoeba invadens
SFDYRGFKYALCGDKRFVPM

SEQ ID NO: 3028824 - protein, 18 aa, Entamoeba invadens
SFEYPIPPPLPVVEITTL

SEQ ID NO: 3028825 - protein, 20 aa, Entamoeba invadens
SFFFWLFPIQRKVDNKKHFI

SEQ ID NO: 3028826 - protein, 25 aa, Entamoeba invadens
SFFYWKKLYMVYKDTTLYFFDTPTS

SEQ ID NO: 3028827 - protein, 21 aa, Entamoeba invadens
SFGILIYRLLVGRCPFQLLQM

SEQ ID NO: 3028828 - protein, 19 aa, Entamoeba invadens
SFGILLYEVFTLSVPYTSD

SEQ ID NO: 3028829 - protein, 23 aa, Entamoeba invadens
SFGVFSKKPLPKAPKKGYKYVKD

SEQ ID NO: 3028830 - protein, 21 aa, Entamoeba invadens
SFIFDVLSRWLLSYGKNLFSV

SEQ ID NO: 3028831 - protein, 22 aa, Entamoeba invadens
SFINFFGLIKFYDSMMSEQCYT

SEQ ID NO: 3028832 - protein, 25 aa, Entamoeba invadens
SFKGKFIVLLFYPLDWTFVCPTEML

SEQ ID NO: 3028833 - protein, 19 aa, Entamoeba invadens
SFKGWVISVKYDKTDDKNK

SEQ ID NO: 3028834 - protein, 18 aa, Entamoeba invadens
SFKLHRLPMPRPGQILGI

SEQ ID NO: 3028835 - protein, 23 aa, Entamoeba invadens
SFKSIMIYIYWYPQVKNSLAQKL

SEQ ID NO: 3028836 - protein, 21 aa, Entamoeba invadens
SFLESFTDYFKHWTYLSQAAN

SEQ ID NO: 3028837 - protein, 17 aa, Entamoeba invadens
SFLPPFLDIIGYKKTSE

SEQ ID NO: 3028838 - protein, 17 aa, Entamoeba invadens
SFLVLLHKLLFQKNPAV

SEQ ID NO: 3028839 - protein, 24 aa, Entamoeba invadens
SFQLLKYYFRALPSPLIQQTQDLF

SEQ ID NO: 3028840 - protein, 17 aa, Entamoeba invadens
SFRSVRKFAPYIKNYFL

SEQ ID NO: 3028841 - protein, 17 aa, Entamoeba invadens
SFTPVFHLILRLLNPTT

SEQ ID NO: 3028842 - protein, 23 aa, Entamoeba invadens
SFVFGSVWFFFEVMTRIVVSILD

SEQ ID NO: 3028843 - protein, 20 aa, Entamoeba invadens
SFVIQYYGLVLDILLLGPKR

SEQ ID NO: 3028844 - protein, 29 aa, Entamoeba invadens
SFVPVLKVVLPLKKLRRLTLPQFAPWRQT

SEQ ID NO: 3028845 - protein, 19 aa, Entamoeba invadens
SGALFFPFITRDTPKKRVK

SEQ ID NO: 3028846 - protein, 31 aa, Entamoeba invadens
SGCYLVVPYPLMLPIWRRLVWHGGYSIEIEE

SEQ ID NO: 3028847 - protein, 26 aa, Entamoeba invadens
SGEKTPVLATKRRTPRLQRAESSMSL

SEQ ID NO: 3028848 - protein, 17 aa, Entamoeba invadens
SGIAYVAKTFKPSIRVI

SEQ ID NO: 3028849 - protein, 17 aa, Entamoeba invadens
SGILMPFFDADSSILYI

SEQ ID NO: 3028850 - protein, 22 aa, Entamoeba invadens
SGKTFLYNVLIDKALTLSKSVK

SEQ ID NO: 3028851 - protein, 18 aa, Entamoeba invadens
SGKTLAYVLPLLKHVLSQ

SEQ ID NO: 3028852 - protein, 17 aa, Entamoeba invadens
SGRIKIVEWLFKQKKEL

SEQ ID NO: 3028853 - protein, 25 aa, Entamoeba invadens
SGSDSILIILFFKPQHFMSTILFYI

SEQ ID NO: 3028854 - protein, 18 aa, Entamoeba invadens
SGSHFFYHFLDMYKDECS

SEQ ID NO: 3028855 - protein, 21 aa, Entamoeba invadens
SGVFLVNRLISMLSAFQAATT

SEQ ID NO: 3028856 - protein, 22 aa, Entamoeba invadens
SGVMIIVFPTLYEPFGCFIDNE

SEQ ID NO: 3028857 - protein, 20 aa, Entamoeba invadens
SGWRFPIPLYRSIEYIKKKE

SEQ ID NO: 3028858 - protein, 21 aa, Entamoeba invadens
SHDFITHVLPFFDVINRSSKI

SEQ ID NO: 3028859 - protein, 17 aa, Entamoeba invadens
SHDITLYMFLALLGYET

SEQ ID NO: 3028860 - protein, 17 aa, Entamoeba invadens
SHFFPFSITIPIVSHPS

SEQ ID NO: 3028861 - protein, 20 aa, Entamoeba invadens
SHIFLILDYVPGGELYELIR

SEQ ID NO: 3028862 - protein, 23 aa, Entamoeba invadens
SHKNLYVFLVKFISNLILKGVDK

SEQ ID NO: 3028863 - protein, 25 aa, Entamoeba invadens
SHKPAPPLPHKAAPPPPPAKKAPPP

SEQ ID NO: 3028864 - protein, 22 aa, Entamoeba invadens
SHPKFMVFEVFPVAPPAVRPQA

SEQ ID NO: 3028865 - protein, 18 aa, Entamoeba invadens
SHRIILNDLLLIKIDEKT

SEQ ID NO: 3028866 - protein, 23 aa, Entamoeba invadens
SHRRAIVIFLSWTLQIPYNKAMS

SEQ ID NO: 3028867 - protein, 23 aa, Entamoeba invadens
SIEALIFINLPIYGGGIVFYDEV

SEQ ID NO: 3028868 - protein, 19 aa, Entamoeba invadens
SIFEIAMLFPNKSLQQLTM

SEQ ID NO: 3028869 - protein, 25 aa, Entamoeba invadens
SIGCALYLSLLLEPKWRKSQIDVNH

SEQ ID NO: 3028870 - protein, 21 aa, Entamoeba invadens
SIGLNTLLDFLKRKFGKIFEE

SEQ ID NO: 3028871 - protein, 30 aa, Entamoeba invadens
SIGQTFKLYLPFFKCYFFYISHYDSVNKLL

SEQ ID NO: 3028872 - protein, 24 aa, Entamoeba invadens
SIIENLIPLKIFLVELVAVIVTKM

SEQ ID NO: 3028873 - protein, 25 aa, Entamoeba invadens
SIKPDQILLLDTYFYLIVFRGNVVA

SEQ ID NO: 3028874 - protein, 17 aa, Entamoeba invadens
SIPIINTTKPTPLAPKN

SEQ ID NO: 3028875 - protein, 22 aa, Entamoeba invadens
SIQIFQLSDLWLSTLRLGGVGE

SEQ ID NO: 3028876 - protein, 18 aa, Entamoeba invadens
SIRFVWNTPILILEKIIL

SEQ ID NO: 3028877 - protein, 26 aa, Entamoeba invadens
SISKIFLRFCPFFAIYQHFLINHDNA

SEQ ID NO: 3028878 - protein, 18 aa, Entamoeba invadens
SITILLVDQIVMQKPAGG

SEQ ID NO: 3028879 - protein, 23 aa, Entamoeba invadens
SIYLGYNFLFNFFPHLNTLTGNM

SEQ ID NO: 3028880 - protein, 25 aa, Entamoeba invadens
SIYLGYNFLFNFFPRLNTLTGNLNT

SEQ ID NO: 3028881 - protein, 19 aa, Entamoeba invadens
SIYTYRYFLRNWPNLCFLA

SEQ ID NO: 3028882 - protein, 18 aa, Entamoeba invadens
SKALLPCIVLFPDVYKTV

SEQ ID NO: 3028883 - protein, 19 aa, Entamoeba invadens
SKAQEYFFNWFRTVLKDTE

SEQ ID NO: 3028884 - protein, 23 aa, Entamoeba invadens
SKAQIHLNFVWYDTYLVDDKKPV

SEQ ID NO: 3028885 - protein, 24 aa, Entamoeba invadens
SKHLPLLAMLFTPTPVLPLYNKAQ

SEQ ID NO: 3028886 - protein, 23 aa, Entamoeba invadens
SKKHPWEILLQKLVIYLPKTQNI

SEQ ID NO: 3028887 - protein, 22 aa, Entamoeba invadens
SKKIQLILYSNVSAMYLHLKQY

SEQ ID NO: 3028888 - protein, 24 aa, Entamoeba invadens
SKKKFYRIIVWFNVDFETVDRNKN

SEQ ID NO: 3028889 - protein, 17 aa, Entamoeba invadens
SKKKLCLIVWFEVDFET

SEQ ID NO: 3028890 - protein, 18 aa, Entamoeba invadens
SKKTPLKVLYFDVAIQFS

SEQ ID NO: 3028891 - protein, 23 aa, Entamoeba invadens
SKKYIVIVPFLFNKEKKMFDKMS

SEQ ID NO: 3028892 - protein, 19 aa, Entamoeba invadens
SKLLRYFFHFSKGTCPYIV

SEQ ID NO: 3028893 - protein, 20 aa, Entamoeba invadens
SKLPESWKILLREAGVKKRD

SEQ ID NO: 3028894 - protein, 18 aa, Entamoeba invadens
SKQQLTLSGFLPINYNGK

SEQ ID NO: 3028895 - protein, 19 aa, Entamoeba invadens
SKRYFVKELPWVLAIQIKR

SEQ ID NO: 3028896 - protein, 17 aa, Entamoeba invadens
SKYIDWFNLMTYDLHGA

SEQ ID NO: 3028897 - protein, 25 aa, Entamoeba invadens
SKYSDAFYFYVYPEELHVLTYDQKF

SEQ ID NO: 3028898 - protein, 24 aa, Entamoeba invadens
SLAITLWELLYEKVPFCEYEKKCE

SEQ ID NO: 3028899 - protein, 20 aa, Entamoeba invadens
SLALLCSLTNDHKLYDKMAI

SEQ ID NO: 3028900 - protein, 20 aa, Entamoeba invadens
SLCQSLLLRLVFLSSTIDLP

SEQ ID NO: 3028901 - protein, 23 aa, Entamoeba invadens
SLDLAWSLLRTFPRDMLKRISNE

SEQ ID NO: 3028902 - protein, 19 aa, Entamoeba invadens
SLEIIPFIRFIDLSSTEVK

SEQ ID NO: 3028903 - protein, 20 aa, Entamoeba invadens
SLEYVILPKTIMTIPYKCFS

SEQ ID NO: 3028904 - protein, 23 aa, Entamoeba invadens
SLFEPYLKPYFNNGYLPVTQGDC

SEQ ID NO: 3028905 - protein, 18 aa, Entamoeba invadens
SLFVTKLFKILGFQKEER

SEQ ID NO: 3028906 - protein, 20 aa, Entamoeba invadens
SLGILIYEMLVGIPPFYDED

SEQ ID NO: 3028907 - protein, 18 aa, Entamoeba invadens
SLGNFFLFEKDGVEYQVS

SEQ ID NO: 3028908 - protein, 20 aa, Entamoeba invadens
SLIDTTLSPIPQLVPPKPVV

SEQ ID NO: 3028909 - protein, 21 aa, Entamoeba invadens
SLILAPKFIRSLIAISLVFFD

SEQ ID NO: 3028910 - protein, 21 aa, Entamoeba invadens
SLITPFQWQHVFIPVLPVSLV

SEQ ID NO: 3028911 - protein, 19 aa, Entamoeba invadens
SLKEFVFPGNFFMIGKRCF

SEQ ID NO: 3028912 - protein, 20 aa, Entamoeba invadens
SLKMLHINPWYISVDNIRSF

SEQ ID NO: 3028913 - protein, 24 aa, Entamoeba invadens
SLLSRFDLIYLILDRPDLERDKRL

SEQ ID NO: 3028914 - protein, 18 aa, Entamoeba invadens
SLLYVTFPLTLKVIGRSF

SEQ ID NO: 3028915 - protein, 21 aa, Entamoeba invadens
SLPILPLLDLTPSLPLHILFE

SEQ ID NO: 3028916 - protein, 19 aa, Entamoeba invadens
SLPLVFPIPVRRDLHYFVA

SEQ ID NO: 3028917 - protein, 17 aa, Entamoeba invadens
SLPMFYFTPISVNLPKF

SEQ ID NO: 3028918 - protein, 17 aa, Entamoeba invadens
SLRVIFPAFGGDAKTIQ

SEQ ID NO: 3028919 - protein, 22 aa, Entamoeba invadens
SLRVYLSYILNCPYFVSRFPVF

SEQ ID NO: 3028920 - protein, 21 aa, Entamoeba invadens
SLSEAFLLYIRAMGGIIPIEL

SEQ ID NO: 3028921 - protein, 29 aa, Entamoeba invadens
SLSHEFFYNLYLFPKLFTLKLNKCILPLS

SEQ ID NO: 3028922 - protein, 23 aa, Entamoeba invadens
SLSKFIHFSIPKITFHILTNEST

SEQ ID NO: 3028923 - protein, 24 aa, Entamoeba invadens
SLSKFLFHMITLYTSSLVLRNEST

SEQ ID NO: 3028924 - protein, 24 aa, Entamoeba invadens
SLSTFLVLAFPYKSQDKPLPEKVE

SEQ ID NO: 3028925 - protein, 19 aa, Entamoeba invadens
SLTLYFTFCDLFDTFPLAA

SEQ ID NO: 3028926 - protein, 27 aa, Entamoeba invadens
SMEFIARFLQYWALKKIEVDYLIVCGD

SEQ ID NO: 3028927 - protein, 17 aa, Entamoeba invadens
SMFICFAMLYLGSDANT

SEQ ID NO: 3028928 - protein, 19 aa, Entamoeba invadens
SMKMGLTKSLTFLKPSEEL

SEQ ID NO: 3028929 - protein, 27 aa, Entamoeba invadens
SMLKRVAENPLFLFKKCYQENSFDRYN

SEQ ID NO: 3028930 - protein, 25 aa, Entamoeba invadens
SMNSTWLHKVYWKVLIRCWITEQLL

SEQ ID NO: 3028931 - protein, 25 aa, Entamoeba invadens
SNDDYLKYMIYKLPDDYRGVTTGWV

SEQ ID NO: 3028932 - protein, 17 aa, Entamoeba invadens
SNETLEILIYFLRCLIS

SEQ ID NO: 3028933 - protein, 17 aa, Entamoeba invadens
SNFLFNIKTVFSFGIVE

SEQ ID NO: 3028934 - protein, 21 aa, Entamoeba invadens
SNFYEVFIRFFLERLKSGFQS

SEQ ID NO: 3028935 - protein, 24 aa, Entamoeba invadens
SNHCKFMWLYMLRNAFYKNCKMHM

SEQ ID NO: 3028936 - protein, 26 aa, Entamoeba invadens
SNKDGLLLLFPLIGKPIPTTLDKIET

SEQ ID NO: 3028937 - protein, 22 aa, Entamoeba invadens
SNKFIVFPFKTKFLKILTLTCL

SEQ ID NO: 3028938 - protein, 25 aa, Entamoeba invadens
SNKINFFRIIIWFEVDYSFSLKHKN

SEQ ID NO: 3028939 - protein, 17 aa, Entamoeba invadens
SNLFRWLENLKYLNIAA

SEQ ID NO: 3028940 - protein, 23 aa, Entamoeba invadens
SNLIKLWFRELPKPILNVLSSDQ

SEQ ID NO: 3028941 - protein, 23 aa, Entamoeba invadens
SNLKYKLYQMLFKLLREKNESLS

SEQ ID NO: 3028942 - protein, 17 aa, Entamoeba invadens
SNLVLHPFVINRGIFQC

SEQ ID NO: 3028943 - protein, 21 aa, Entamoeba invadens
SNQILLLHLFNFTLKNREIIA

SEQ ID NO: 3028944 - protein, 22 aa, Entamoeba invadens
SNQPIMLAFYTHLLHVLIESNF

SEQ ID NO: 3028945 - protein, 24 aa, Entamoeba invadens
SNTPYICDFAPFKPFYLPDDNPYD

SEQ ID NO: 3028946 - protein, 20 aa, Entamoeba invadens
SNTVFDFFGSQKSAPEEKKE

SEQ ID NO: 3028947 - protein, 22 aa, Entamoeba invadens
SNTVFNNIFFKCKIGFSGNSKG

SEQ ID NO: 3028948 - protein, 24 aa, Entamoeba invadens
SNVIDGLLFVFGRRGKQIRQSKLV

SEQ ID NO: 3028949 - protein, 27 aa, Entamoeba invadens
SNYFRSALGGVIVFDVSNRQSFENVET

SEQ ID NO: 3028950 - protein, 19 aa, Entamoeba invadens
SPCDDFFPEKAFFQKIVHY

SEQ ID NO: 3028951 - protein, 23 aa, Entamoeba invadens
SPDQFKILLIFLKTFFSEESSGE

SEQ ID NO: 3028952 - protein, 20 aa, Entamoeba invadens
SPFIFFMQEFAQNKFYVCYR

SEQ ID NO: 3028953 - protein, 22 aa, Entamoeba invadens
SPFIHQILCLINFLLSVKNNTF

SEQ ID NO: 3028954 - protein, 24 aa, Entamoeba invadens
SPIEKILLFFPNIETLYFNSYSTR

SEQ ID NO: 3028955 - protein, 27 aa, Entamoeba invadens
SPLDPPNFLWRILYEKIYDFGLEGTHI

SEQ ID NO: 3028956 - protein, 19 aa, Entamoeba invadens
SPLLVVTPMHTPMVLEEQE

SEQ ID NO: 3028957 - protein, 23 aa, Entamoeba invadens
SPLSFGALFYFLEKTMSIVLKLL

SEQ ID NO: 3028958 - protein, 18 aa, Entamoeba invadens
SPLTYFLPLIFDIPQNYP

SEQ ID NO: 3028959 - protein, 17 aa, Entamoeba invadens
SPLVQLVLVLPPKSSRF

SEQ ID NO: 3028960 - protein, 20 aa, Entamoeba invadens
SPLVRFIYATHLVVIVGVKG

SEQ ID NO: 3028961 - protein, 22 aa, Entamoeba invadens
SPNIVVPNFIFFLYNTRSTNEP

SEQ ID NO: 3028962 - protein, 24 aa, Entamoeba invadens
SPPYFFTLYFFTPTFHFYFNKQLK

SEQ ID NO: 3028963 - protein, 25 aa, Entamoeba invadens
SPQGRYLVFWQLIPLQYVQGENGPQ

SEQ ID NO: 3028964 - protein, 22 aa, Entamoeba invadens
SPQLLQKWYYPLIKSIKLEQYN

SEQ ID NO: 3028965 - protein, 18 aa, Entamoeba invadens
SPTKLIIYIPDRDVRMSV

SEQ ID NO: 3028966 - protein, 19 aa, Entamoeba invadens
SPWKDQFPEWALLPKTSEE

SEQ ID NO: 3028967 - protein, 24 aa, Entamoeba invadens
SQFFPALYALPFPKCPISVVTLSL

SEQ ID NO: 3028968 - protein, 24 aa, Entamoeba invadens
SQINMLWLLRFLVSSEVFKNSLYS

SEQ ID NO: 3028969 - protein, 30 aa, Entamoeba invadens
SQKGMMWLDQIYLVLFPFSHTTKSIIRQII

SEQ ID NO: 3028970 - protein, 18 aa, Entamoeba invadens
SQLPLFQQILKNVKLWFK

SEQ ID NO: 3028971 - protein, 17 aa, Entamoeba invadens
SQMVFTNFKSYYGRTEL

SEQ ID NO: 3028972 - protein, 24 aa, Entamoeba invadens
SQNRLRELFYWAYKQEFLPNTRNQ

SEQ ID NO: 3028973 - protein, 24 aa, Entamoeba invadens
SQQVFLTQYPTRLAWRPFDLSQVD

SEQ ID NO: 3028974 - protein, 23 aa, Entamoeba invadens
SQRICPLELKAACGAILYASPYF

SEQ ID NO: 3028975 - protein, 17 aa, Entamoeba invadens
SQSAFIFSLLRNGKLNP

SEQ ID NO: 3028976 - protein, 19 aa, Entamoeba invadens
SQSLSPIFRIQFIDSVTIE

SEQ ID NO: 3028977 - protein, 25 aa, Entamoeba invadens
SQSLSPIFRIQFINGVSLENLIFEY

SEQ ID NO: 3028978 - protein, 17 aa, Entamoeba invadens
SQVCITCEDGCKRCFIK

SEQ ID NO: 3028979 - protein, 17 aa, Entamoeba invadens
SRFDLWLSKYYPFGEAI

SEQ ID NO: 3028980 - protein, 17 aa, Entamoeba invadens
SRFFKPIFEATLHPEQH

SEQ ID NO: 3028981 - protein, 24 aa, Entamoeba invadens
SRFPKFLIPKYFAAFIKKLFASLV

SEQ ID NO: 3028982 - protein, 24 aa, Entamoeba invadens
SRLKQFLEFYLAKALQIFPGDSIL

SEQ ID NO: 3028983 - protein, 25 aa, Entamoeba invadens
SRMAYLDIFPKCRGYQLPSLFNYQP

SEQ ID NO: 3028984 - protein, 25 aa, Entamoeba invadens
SRMLEPFCYALIYPKGQMGWQQEAK

SEQ ID NO: 3028985 - protein, 20 aa, Entamoeba invadens
SRNDGFISYWRLFRNGRWKP

SEQ ID NO: 3028986 - protein, 17 aa, Entamoeba invadens
SRSFVVWVPLTVVGKYV

SEQ ID NO: 3028987 - protein, 28 aa, Entamoeba invadens
SRSLGYYIVPLLLILPFSKTSTEVHLTG

SEQ ID NO: 3028988 - protein, 23 aa, Entamoeba invadens
SSAYLEYLFRPTGFKEFVGPEDK

SEQ ID NO: 3028989 - protein, 24 aa, Entamoeba invadens
SSDPLPPRLFRKYLAYAKANVHPI

SEQ ID NO: 3028990 - protein, 33 aa, Entamoeba invadens
SSEIIVISRLLLLTLTPFKLIEILWKVYTTSHL

SEQ ID NO: 3028991 - protein, 23 aa, Entamoeba invadens
SSFLHLEWLCNFKGLYGYVLITH

SEQ ID NO: 3028992 - protein, 24 aa, Entamoeba invadens
SSIYNFFVVNIWYPVDYSTSMCPQ

SEQ ID NO: 3028993 - protein, 26 aa, Entamoeba invadens
SSPIIDRLIYLRVLIERTKPIEKKLR

SEQ ID NO: 3028994 - protein, 19 aa, Entamoeba invadens
SSQLFPERWFDLVVVLRTD

SEQ ID NO: 3028995 - protein, 23 aa, Entamoeba invadens
SSQVICLCLIAVWFSQHRKASSV

SEQ ID NO: 3028996 - protein, 22 aa, Entamoeba invadens
SSVDGIVLVKFLEKHFYCGQLL

SEQ ID NO: 3028997 - protein, 20 aa, Entamoeba invadens
SSWCMGFLFTDIFILARSTI

SEQ ID NO: 3028998 - protein, 20 aa, Entamoeba invadens
SSYLLIVTPMRILLIQNGDV

SEQ ID NO: 3028999 - protein, 27 aa, Entamoeba invadens
STCMETLLFLRFFLPPLASTPSVLKNI

SEQ ID NO: 3029000 - protein, 22 aa, Entamoeba invadens
STDIFLAWFRDVVLTYIIKKCN

SEQ ID NO: 3029001 - protein, 21 aa, Entamoeba invadens
STDIFLAWFRDVVLTYIIKKR

SEQ ID NO: 3029002 - protein, 21 aa, Entamoeba invadens
STDIFLAWFRDVVLTYIIKKT

SEQ ID NO: 3029003 - protein, 22 aa, Entamoeba invadens
STDLLPSLFVLALPRSGSTFLH

SEQ ID NO: 3029004 - protein, 41 aa, Entamoeba invadens
STDVDFVLKKSLCDGVVLAKLMNYLRPNTVDVSKFTEKHVQ

SEQ ID NO: 3029005 - protein, 21 aa, Entamoeba invadens
STELLLRRAPFQHLVRDIATA

SEQ ID NO: 3029006 - protein, 17 aa, Entamoeba invadens
STFTFKLFQKGIFYRQF

SEQ ID NO: 3029007 - protein, 24 aa, Entamoeba invadens
STILLVTYFYINTQIYLLSLSIGD

SEQ ID NO: 3029008 - protein, 17 aa, Entamoeba invadens
STLTRRAIFKLFCTFGA

SEQ ID NO: 3029009 - protein, 25 aa, Entamoeba invadens
STMKLYLGRKILRICPLKLNYDIGC

SEQ ID NO: 3029010 - protein, 18 aa, Entamoeba invadens
STNLPYETKWLLLQKHVP

SEQ ID NO: 3029011 - protein, 23 aa, Entamoeba invadens
STPFTHFYFKLKFGKLYNLNYFQ

SEQ ID NO: 3029012 - protein, 25 aa, Entamoeba invadens
STPQNTFNLLFFIRTVFPVFHAPQH

SEQ ID NO: 3029013 - protein, 26 aa, Entamoeba invadens
STPQNTFNLLFFMRTVFPVFHAPQHV

SEQ ID NO: 3029014 - protein, 29 aa, Entamoeba invadens
STQAMLKFIYHRLFVFIVEQVNRVMRKDG

SEQ ID NO: 3029015 - protein, 25 aa, Entamoeba invadens
STRYRQKALLLLRQKKQVDQHRDMS

SEQ ID NO: 3029016 - protein, 21 aa, Entamoeba invadens
STSQFLFLKYLFKVNERFEGE

SEQ ID NO: 3029017 - protein, 27 aa, Entamoeba invadens
STSSTYFLLKLPFNYLFDYLAVCMEPT

SEQ ID NO: 3029018 - protein, 20 aa, Entamoeba invadens
STTRYTLLQRYPLSPIKGSC

SEQ ID NO: 3029019 - protein, 23 aa, Entamoeba invadens
STVKPIFGTLLFTSARIIFLKQN

SEQ ID NO: 3029020 - protein, 19 aa, Entamoeba invadens
STYLVLLYKMLLRRNGNQL

SEQ ID NO: 3029021 - protein, 23 aa, Entamoeba invadens
SVAKQPFYPKMKNSYPYPQHVSC

SEQ ID NO: 3029022 - protein, 22 aa, Entamoeba invadens
SVAKWLLDELLLLGIPLNKLHC

SEQ ID NO: 3029023 - protein, 23 aa, Entamoeba invadens
SVEIKAPLLLFLSGGKFSVDVHG

SEQ ID NO: 3029024 - protein, 22 aa, Entamoeba invadens
SVFRFFLLNNTFNKAFIPLLKT

SEQ ID NO: 3029025 - protein, 24 aa, Entamoeba invadens
SVKMLHINPWFISIQNIKTFFYHF

SEQ ID NO: 3029026 - protein, 20 aa, Entamoeba invadens
SVKRQLIMIFMRLGDLYNKT

SEQ ID NO: 3029027 - protein, 28 aa, Entamoeba invadens
SVKSWKKRWFVLKPNKLWYFTSKSATTA

SEQ ID NO: 3029028 - protein, 25 aa, Entamoeba invadens
SVLKQIYMMIPFWKENYTLLRSIFS

SEQ ID NO: 3029029 - protein, 19 aa, Entamoeba invadens
SVLLFRLKFPQLKFEMTHS

SEQ ID NO: 3029030 - protein, 23 aa, Entamoeba invadens
SVLNLRWFNMRLIRAEYFPENKV

SEQ ID NO: 3029031 - protein, 24 aa, Entamoeba invadens
SVLNYLGYSFLFQKPKKFTVHTSL

SEQ ID NO: 3029032 - protein, 18 aa, Entamoeba invadens
SVLSFLFFYTQKSTLVDC

SEQ ID NO: 3029033 - protein, 24 aa, Entamoeba invadens
SVLYSIIQLYLRSGFYGRVLDYHI

SEQ ID NO: 3029034 - protein, 20 aa, Entamoeba invadens
SVMYLLYYFCFSLKDKFSDF

SEQ ID NO: 3029035 - protein, 23 aa, Entamoeba invadens
SVNIWSQFLAFDCKHDDQVKIDI

SEQ ID NO: 3029036 - protein, 24 aa, Entamoeba invadens
SVSLLPLHFHQLLRFISVEVGNKK

SEQ ID NO: 3029037 - protein, 25 aa, Entamoeba invadens
SVSSKPFCFYYNGSKLTFFEDAKTK

SEQ ID NO: 3029038 - protein, 28 aa, Entamoeba invadens
SVTIYYLIFYIDESFIKFLWSGFLNIIN

SEQ ID NO: 3029039 - protein, 26 aa, Entamoeba invadens
SVTPMSLPLKLVSPLIIEPLNVLKKS

SEQ ID NO: 3029040 - protein, 17 aa, Entamoeba invadens
SVVFFYCTQIQFINVIG

SEQ ID NO: 3029041 - protein, 21 aa, Entamoeba invadens
SVVFKSWLYESVLKSIFMKRK

SEQ ID NO: 3029042 - protein, 18 aa, Entamoeba invadens
SVVKLFWAFQDDVNLYLI

SEQ ID NO: 3029043 - protein, 20 aa, Entamoeba invadens
SVVKLYYAFQDACSLFLVME

SEQ ID NO: 3029044 - protein, 20 aa, Entamoeba invadens
SVYCIVYINSIYRPVCAEEQ

SEQ ID NO: 3029045 - protein, 23 aa, Entamoeba invadens
SYCDGFLALFIRPLMWSTGKMTE

SEQ ID NO: 3029046 - protein, 20 aa, Entamoeba invadens
SYDFPYVIPGSEAKFVVMDY

SEQ ID NO: 3029047 - protein, 23 aa, Entamoeba invadens
SYGLPIADFCPCPFKCGINNQPP

SEQ ID NO: 3029048 - protein, 25 aa, Entamoeba invadens
SYKRIETLHLLIDLLREFGYSFESR

SEQ ID NO: 3029049 - protein, 17 aa, Entamoeba invadens
SYLVQIKFFLMTKFLMS

SEQ ID NO: 3029050 - protein, 20 aa, Entamoeba invadens
SYLYFAPFRQQNLRIISKLD

SEQ ID NO: 3029051 - protein, 21 aa, Entamoeba invadens
SYSPHHPIDPKAVKVTTVVEV

SEQ ID NO: 3029052 - protein, 22 aa, Entamoeba invadens
SYTLFTLKFPRKLFVLTNSIIT

SEQ ID NO: 3029053 - protein, 24 aa, Entamoeba invadens
SYTPKFLMQPPPSKGIPLFTPNSK

SEQ ID NO: 3029054 - protein, 21 aa, Entamoeba invadens
SYTVNWLIALLDAKASLMITD

SEQ ID NO: 3029055 - protein, 18 aa, Entamoeba invadens
SYTWRLLKPAPLPHPLPG

SEQ ID NO: 3029056 - protein, 24 aa, Entamoeba invadens
TACKLTKIVLWPKIWPVFASQVNA

SEQ ID NO: 3029057 - protein, 29 aa, Entamoeba invadens
TAERQKQIYTPVYPKYLISKLAEHKDEIL

SEQ ID NO: 3029058 - protein, 20 aa, Entamoeba invadens
TAFFILFRKEVCYYYGCPTC

SEQ ID NO: 3029059 - protein, 17 aa, Entamoeba invadens
TAHCFMRALYQKALFLD

SEQ ID NO: 3029060 - protein, 17 aa, Entamoeba invadens
TAIFFKTIASIGLTLAG

SEQ ID NO: 3029061 - protein, 30 aa, Entamoeba invadens
TAKETNPLFVKHATLPLNIGKSIKSEGIIR

SEQ ID NO: 3029062 - protein, 24 aa, Entamoeba invadens
TAKSDLIILPLYSALQKEKQKKVF

SEQ ID NO: 3029063 - protein, 24 aa, Entamoeba invadens
TALKVALQLFLRQLPENSTFDVVS

SEQ ID NO: 3029064 - protein, 19 aa, Entamoeba invadens
TALLWFSLLPIPTYPDDIL

SEQ ID NO: 3029065 - protein, 18 aa, Entamoeba invadens
TALTIPVNLYFNSLIFLN

SEQ ID NO: 3029066 - protein, 28 aa, Entamoeba invadens
TANLTQEKYIFLALLLGSDFTEGVGKVG

SEQ ID NO: 3029067 - protein, 19 aa, Entamoeba invadens
TAPLLPNEFLKLLSLVFFV

SEQ ID NO: 3029068 - protein, 26 aa, Entamoeba invadens
TAQPKFYLTGAFYFALLYSGSNFKEI

SEQ ID NO: 3029069 - protein, 23 aa, Entamoeba invadens
TAVELLICDILIEAYPYVPILKS

SEQ ID NO: 3029070 - protein, 18 aa, Entamoeba invadens
TAVVLYKLKMSSLVGLPP

SEQ ID NO: 3029071 - protein, 24 aa, Entamoeba invadens
TCAIRFVKLFRMFVNFLGGDIVDI

SEQ ID NO: 3029072 - protein, 18 aa, Entamoeba invadens
TCFIELWEYIFKKGSPMV

SEQ ID NO: 3029073 - protein, 24 aa, Entamoeba invadens
TCFLNDLYLPYGLTKIGYGAFENF

SEQ ID NO: 3029074 - protein, 24 aa, Entamoeba invadens
TCIPDTFILPLNQIQRILIATDGI

SEQ ID NO: 3029075 - protein, 23 aa, Entamoeba invadens
TDDGFRIYSLEELGLDKNKKGGN

SEQ ID NO: 3029076 - protein, 22 aa, Entamoeba invadens
TDDMILWGLFSLANALHFLNVS

SEQ ID NO: 3029077 - protein, 20 aa, Entamoeba invadens
TDFIFLVMELITDGCLFDYV

SEQ ID NO: 3029078 - protein, 23 aa, Entamoeba invadens
TDFPLFNLLKMLEAMRLQIANSV

SEQ ID NO: 3029079 - protein, 23 aa, Entamoeba invadens
TDKIGSSNFFWAFPSASIVERRT

SEQ ID NO: 3029080 - protein, 21 aa, Entamoeba invadens
TDLKRVILPPYLKSLPKNTFN

SEQ ID NO: 3029081 - protein, 18 aa, Entamoeba invadens
TDNPFIVPYLEKFLSFEP

SEQ ID NO: 3029082 - protein, 19 aa, Entamoeba invadens
TDPIWREPIFSIILNSGVV

SEQ ID NO: 3029083 - protein, 17 aa, Entamoeba invadens
TDPLWSNILKLMKNFWY

SEQ ID NO: 3029084 - protein, 17 aa, Entamoeba invadens
TDPSGMFLEFYAKATGA

SEQ ID NO: 3029085 - protein, 23 aa, Entamoeba invadens
TDYERYFMLFGTRFDLWPDSAFP

SEQ ID NO: 3029086 - protein, 21 aa, Entamoeba invadens
TDYRPTPLCHYLFPINGNGIH

SEQ ID NO: 3029087 - protein, 19 aa, Entamoeba invadens
TEAFLLRLALHKTFPSTRM

SEQ ID NO: 3029088 - protein, 30 aa, Entamoeba invadens
TECYNLMNYLFLYPFALLKLSVYKTHTLEN

SEQ ID NO: 3029089 - protein, 18 aa, Entamoeba invadens
TEIVFYRSLYRCCVPEFP

SEQ ID NO: 3029090 - protein, 27 aa, Entamoeba invadens
TEKATKYVLLKYFYWRYTEPSVMSLHE

SEQ ID NO: 3029091 - protein, 17 aa, Entamoeba invadens
TEKILMLNIYFSEIEPK

SEQ ID NO: 3029092 - protein, 24 aa, Entamoeba invadens
TEKPLFPIFICDAGLIIISKYPIV

SEQ ID NO: 3029093 - protein, 22 aa, Entamoeba invadens
TEKRGFDLIKTVWVEKQYVGQS

SEQ ID NO: 3029094 - protein, 20 aa, Entamoeba invadens
TEKTLLYKPLYPPSPDITKK

SEQ ID NO: 3029095 - protein, 18 aa, Entamoeba invadens
TENIFYFPNLISSLLQEF

SEQ ID NO: 3029096 - protein, 27 aa, Entamoeba invadens
TERKTLFNCLALSITVLAKKKLTTGTI

SEQ ID NO: 3029097 - protein, 21 aa, Entamoeba invadens
TESHLFGFFFSGGVTATERYF

SEQ ID NO: 3029098 - protein, 22 aa, Entamoeba invadens
TESLTFVYQFLLELNPKYSTTQ

SEQ ID NO: 3029099 - protein, 17 aa, Entamoeba invadens
TFCLLMIKAEVLQGLLT

SEQ ID NO: 3029100 - protein, 24 aa, Entamoeba invadens
TFESPYLFRLRKFISLSYMLYIEN

SEQ ID NO: 3029101 - protein, 17 aa, Entamoeba invadens
TFFFVLLAIVYLRQHDF

SEQ ID NO: 3029102 - protein, 17 aa, Entamoeba invadens
TFFGFGASGSTPFFNFQ

SEQ ID NO: 3029103 - protein, 18 aa, Entamoeba invadens
TFFKQFFYDSPKASYVLF

SEQ ID NO: 3029104 - protein, 20 aa, Entamoeba invadens
TFGHFVLLRTPIFYYEIEVL

SEQ ID NO: 3029105 - protein, 20 aa, Entamoeba invadens
TFIRSLFALPFLRPQEIVET

SEQ ID NO: 3029106 - protein, 18 aa, Entamoeba invadens
TFISLRGLLLRNGRFKEA

SEQ ID NO: 3029107 - protein, 28 aa, Entamoeba invadens
TFKAYPMVRWFWMVEYSGGYFGFQTIFS

SEQ ID NO: 3029108 - protein, 17 aa, Entamoeba invadens
TFLQHKFPRIDADTLLP

SEQ ID NO: 3029109 - protein, 17 aa, Entamoeba invadens
TFNFSHFCLISQPVLSL

SEQ ID NO: 3029110 - protein, 19 aa, Entamoeba invadens
TFPCVKLNPTKALTIFHKQ

SEQ ID NO: 3029111 - protein, 21 aa, Entamoeba invadens
TFPSYLLTIWDRCFEFCMSLK

SEQ ID NO: 3029112 - protein, 23 aa, Entamoeba invadens
TFQKSLIVFQKWKKNLPTKRKLF

SEQ ID NO: 3029113 - protein, 19 aa, Entamoeba invadens
TFQVFMFGKPVWVAENLVE

SEQ ID NO: 3029114 - protein, 25 aa, Entamoeba invadens
TFTSLFLRWEYFIIISIPPQKVQSS

SEQ ID NO: 3029115 - protein, 17 aa, Entamoeba invadens
TFTYTLFAWIKQGVPIP

SEQ ID NO: 3029116 - protein, 21 aa, Entamoeba invadens
TFVLCYVFYPNIVIPKALEGK

SEQ ID NO: 3029117 - protein, 21 aa, Entamoeba invadens
TGAIDLYFPRLLKWSYTVCCN

SEQ ID NO: 3029118 - protein, 25 aa, Entamoeba invadens
TGIPKIRAFFLFQTPKMLSLLQREL

SEQ ID NO: 3029119 - protein, 33 aa, Entamoeba invadens
TGKHSYYIPKGWFQSFIIPLYVGQPVTAKLYFR

SEQ ID NO: 3029120 - protein, 17 aa, Entamoeba invadens
TGTIERLFRDAEKYEIP

SEQ ID NO: 3029121 - protein, 25 aa, Entamoeba invadens
THFRGKIFFWPPYDDSPLVSYNLNG

SEQ ID NO: 3029122 - protein, 22 aa, Entamoeba invadens
THFTEYCVLCYILALSKAEDLN

SEQ ID NO: 3029123 - protein, 22 aa, Entamoeba invadens
THFTEYCVLCYILALSKSEDIY

SEQ ID NO: 3029124 - protein, 20 aa, Entamoeba invadens
THMALLYFSPSSTIHVDKLK

SEQ ID NO: 3029125 - protein, 19 aa, Entamoeba invadens
THSITLNTPPKFPVVSMVP

SEQ ID NO: 3029126 - protein, 20 aa, Entamoeba invadens
THSMFLAFSLLYLGSQGATQ

SEQ ID NO: 3029127 - protein, 23 aa, Entamoeba invadens
THTFKYYNIPKDSLLYIGHVKQR

SEQ ID NO: 3029128 - protein, 20 aa, Entamoeba invadens
THYFIFTLQHKGVIKQKRYF

SEQ ID NO: 3029129 - protein, 23 aa, Entamoeba invadens
TIADFDLPVWYFSPYPGKYGNVE

SEQ ID NO: 3029130 - protein, 23 aa, Entamoeba invadens
TIDGLFELLFRVVKRIWKLDIYG

SEQ ID NO: 3029131 - protein, 27 aa, Entamoeba invadens
TIDNKYEILLFLYYLKHLTIEKNTTNL

SEQ ID NO: 3029132 - protein, 23 aa, Entamoeba invadens
TIECFLCRCRNPFVLGYIVLRNN

SEQ ID NO: 3029133 - protein, 32 aa, Entamoeba invadens
TIENFKLLLYPLHWVYVCVPILPRILLEYITS

SEQ ID NO: 3029134 - protein, 23 aa, Entamoeba invadens
TIFIQNFLFDVLLEKGYFFNTKL

SEQ ID NO: 3029135 - protein, 26 aa, Entamoeba invadens
TIFLGKYYYIFILKAMVWICDENGVL

SEQ ID NO: 3029136 - protein, 17 aa, Entamoeba invadens
TIFLVLLSKMDELPPMY

SEQ ID NO: 3029137 - protein, 28 aa, Entamoeba invadens
TIGNTFKLFIPFFKDYFYYISHYDTSSK

SEQ ID NO: 3029138 - protein, 20 aa, Entamoeba invadens
TIKYPFHKLIQKYLAMCLNE

SEQ ID NO: 3029139 - protein, 25 aa, Entamoeba invadens
TILKKKFFRIIVWFSVDFGTVDRNK

SEQ ID NO: 3029140 - protein, 25 aa, Entamoeba invadens
TIMELFVVWLLPNPSKLPALKTFAK

SEQ ID NO: 3029141 - protein, 18 aa, Entamoeba invadens
TINPVISFILPTNDYIYA

SEQ ID NO: 3029142 - protein, 21 aa, Entamoeba invadens
TIPEPLFFLELRISPYHYEED

SEQ ID NO: 3029143 - protein, 20 aa, Entamoeba invadens
TIPEPLFILELKISPYHYTE

SEQ ID NO: 3029144 - protein, 21 aa, Entamoeba invadens
TIPVNLYFNSLIFFNNLNRIS

SEQ ID NO: 3029145 - protein, 26 aa, Entamoeba invadens
TIPVNLYFNSLIFLNNLKRISAVGGT

SEQ ID NO: 3029146 - protein, 18 aa, Entamoeba invadens
TIQPFNFELFWKLHEFFI

SEQ ID NO: 3029147 - protein, 25 aa, Entamoeba invadens
TIRLPCFSLFFLPTIFPAILNIEVL

SEQ ID NO: 3029148 - protein, 23 aa, Entamoeba invadens
TIRNELLTGMKIYVGGKTKIQNH

SEQ ID NO: 3029149 - protein, 18 aa, Entamoeba invadens
TISIYVASFYKLVKTRRG

SEQ ID NO: 3029150 - protein, 25 aa, Entamoeba invadens
TISLEHPVWKLVCLPGLIGAIGEKD

SEQ ID NO: 3029151 - protein, 20 aa, Entamoeba invadens
TITLLSLRLLSKTWSNLRIT

SEQ ID NO: 3029152 - protein, 19 aa, Entamoeba invadens
TITLPVIFDLAILSLKYIQ

SEQ ID NO: 3029153 - protein, 28 aa, Entamoeba invadens
TITPDNFFFFRLPRFTPFDGKLLEPYKN

SEQ ID NO: 3029154 - protein, 17 aa, Entamoeba invadens
TITPLMINPIRSLKVLV

SEQ ID NO: 3029155 - protein, 17 aa, Entamoeba invadens
TIYKLMNFLNTSGIFVL

SEQ ID NO: 3029156 - protein, 19 aa, Entamoeba invadens
TIYLYSFLTTYETPFPAAT

SEQ ID NO: 3029157 - protein, 22 aa, Entamoeba invadens
TKAIFLHPYAKEMLLKKTVLEL

SEQ ID NO: 3029158 - protein, 24 aa, Entamoeba invadens
TKELLIYYKTFLIDNILICVNKMS

SEQ ID NO: 3029159 - protein, 17 aa, Entamoeba invadens
TKERPRWNFSNKGPYLD

SEQ ID NO: 3029160 - protein, 23 aa, Entamoeba invadens
TKESQIMFLYEPPPGFSLEEKIE

SEQ ID NO: 3029161 - protein, 21 aa, Entamoeba invadens
TKFLLFYNFFPQLSRIFQPMV

SEQ ID NO: 3029162 - protein, 17 aa, Entamoeba invadens
TKFLQIFNLMLTKEKIG

SEQ ID NO: 3029163 - protein, 21 aa, Entamoeba invadens
TKFNLFFSYHYYVDLLCESMA

SEQ ID NO: 3029164 - protein, 21 aa, Entamoeba invadens
TKIRLGFIVLSLLLSNYSVIY

SEQ ID NO: 3029165 - protein, 25 aa, Entamoeba invadens
TKIVNDLVFLFTFGKVAISLFDNSS

SEQ ID NO: 3029166 - protein, 26 aa, Entamoeba invadens
TKKEFVSRLFLFVKALLFIPDEALFD

SEQ ID NO: 3029167 - protein, 26 aa, Entamoeba invadens
TKKTIAWYPIFFFKTMKSPNITFKNV

SEQ ID NO: 3029168 - protein, 18 aa, Entamoeba invadens
TKKYVKRWVAMSGPFLGA

SEQ ID NO: 3029169 - protein, 20 aa, Entamoeba invadens
TKLARFLRILIRYQSFKRTE

SEQ ID NO: 3029170 - protein, 18 aa, Entamoeba invadens
TKLATLHRLIFDTSLKEN

SEQ ID NO: 3029171 - protein, 25 aa, Entamoeba invadens
TKLDRRLLFLFLTQLPLADLVAFMA

SEQ ID NO: 3029172 - protein, 21 aa, Entamoeba invadens
TKLHVRLIPRMIPIIKKFQGL

SEQ ID NO: 3029173 - protein, 24 aa, Entamoeba invadens
TKLKEKLHLLWGENKRLKTILECS

SEQ ID NO: 3029174 - protein, 22 aa, Entamoeba invadens
TKLQPCFGIFYTISKFKKFVPD

SEQ ID NO: 3029175 - protein, 23 aa, Entamoeba invadens
TKNKRDIWLLSETGEIVTYKPSK

SEQ ID NO: 3029176 - protein, 23 aa, Entamoeba invadens
TKQIFPPFLLLVKTPEKYSENEP

SEQ ID NO: 3029177 - protein, 23 aa, Entamoeba invadens
TKQTPFYPYLLLSINRSRLSSAH

SEQ ID NO: 3029178 - protein, 24 aa, Entamoeba invadens
TKRYQVIFRFLFDLEYHRYLLART

SEQ ID NO: 3029179 - protein, 20 aa, Entamoeba invadens
TKSFFNIIVWFNVDYKTIFI

SEQ ID NO: 3029180 - protein, 19 aa, Entamoeba invadens
TKSLLYKFQPFYKYLDSVI

SEQ ID NO: 3029181 - protein, 17 aa, Entamoeba invadens
TKTLIIALLRGICILPV

SEQ ID NO: 3029182 - protein, 22 aa, Entamoeba invadens
TLAGFNWFNAYYTPGVSRISTN

SEQ ID NO: 3029183 - protein, 21 aa, Entamoeba invadens
TLAPAVLFFPYMQAVRFLADY

SEQ ID NO: 3029184 - protein, 22 aa, Entamoeba invadens
TLCGFNWFNAYYTPGVSRISTN

SEQ ID NO: 3029185 - protein, 23 aa, Entamoeba invadens
TLCPQMFLFTMLLHVLLMCVGRE

SEQ ID NO: 3029186 - protein, 20 aa, Entamoeba invadens
TLDKLLDFLTPYTKANLILR

SEQ ID NO: 3029187 - protein, 23 aa, Entamoeba invadens
TLDQFRLSFIYRLYADGISKDHI

SEQ ID NO: 3029188 - protein, 26 aa, Entamoeba invadens
TLENQIHSWWRLGGWYYFYLQFEEDG

SEQ ID NO: 3029189 - protein, 19 aa, Entamoeba invadens
TLFLFNDVLLFTSKVDKLL

SEQ ID NO: 3029190 - protein, 24 aa, Entamoeba invadens
TLFSLWDFLFLNEDPSTFFFVLLA

SEQ ID NO: 3029191 - protein, 23 aa, Entamoeba invadens
TLFWLLKLVMDFLQPFYFCGNDV

SEQ ID NO: 3029192 - protein, 21 aa, Entamoeba invadens
TLGNTYLKFVRINQIVIVLSG

SEQ ID NO: 3029193 - protein, 27 aa, Entamoeba invadens
TLHELWALLQFLLPGIFRISQLDGIFD

SEQ ID NO: 3029194 - protein, 25 aa, Entamoeba invadens
TLHFKRFPFFFAYLKEAAGSELVWK

SEQ ID NO: 3029195 - protein, 20 aa, Entamoeba invadens
TLIEQYLQYYYNYQQIIYEL

SEQ ID NO: 3029196 - protein, 25 aa, Entamoeba invadens
TLKCYTLEMAVFLFGIKFVDFPDSI

SEQ ID NO: 3029197 - protein, 22 aa, Entamoeba invadens
TLKELWSLLHFLHPEQFPNFED

SEQ ID NO: 3029198 - protein, 25 aa, Entamoeba invadens
TLKFVPLTYVPFSQALIDVSVMEKS

SEQ ID NO: 3029199 - protein, 18 aa, Entamoeba invadens
TLKQLIYFSPNPSWYESA

SEQ ID NO: 3029200 - protein, 18 aa, Entamoeba invadens
TLKTVILTEQKKSKQFED

SEQ ID NO: 3029201 - protein, 23 aa, Entamoeba invadens
TLQFGPIILFLLSDTILIGMTKT

SEQ ID NO: 3029202 - protein, 20 aa, Entamoeba invadens
TLQKWYLMLWESDFGTYQHE

SEQ ID NO: 3029203 - protein, 21 aa, Entamoeba invadens
TLSDLFLIFSLFKKINTLSFP

SEQ ID NO: 3029204 - protein, 18 aa, Entamoeba invadens
TLSFFYKVGKLYAGLVEG

SEQ ID NO: 3029205 - protein, 29 aa, Entamoeba invadens
TLSTVLFRHILLFRYFPLQETIDVYEEID

SEQ ID NO: 3029206 - protein, 25 aa, Entamoeba invadens
TLVSDILILIKKIPPVWARAVVEAA

SEQ ID NO: 3029207 - protein, 19 aa, Entamoeba invadens
TLVSLFVEAIKKFKGLSKF

SEQ ID NO: 3029208 - protein, 27 aa, Entamoeba invadens
TLYPHFLEFYALWFCRVFNGDLSMWVL

SEQ ID NO: 3029209 - protein, 20 aa, Entamoeba invadens
TLYSFWLYDFCDVFLEASKP

SEQ ID NO: 3029210 - protein, 24 aa, Entamoeba invadens
TMETDRLFFFWHKMFLLICDASCI

SEQ ID NO: 3029211 - protein, 22 aa, Entamoeba invadens
TMFYYFGWNSWNGWIPAWCVNK

SEQ ID NO: 3029212 - protein, 25 aa, Entamoeba invadens
TMLHLLLSYIRKPVPPNKRLYIIAT

SEQ ID NO: 3029213 - protein, 18 aa, Entamoeba invadens
TMNYPLGWEKKCLVDTTS

SEQ ID NO: 3029214 - protein, 18 aa, Entamoeba invadens
TMVLLPKLKNVRCHAFEA

SEQ ID NO: 3029215 - protein, 18 aa, Entamoeba invadens
TNAKFLEMLAFPPNLTGL

SEQ ID NO: 3029216 - protein, 23 aa, Entamoeba invadens
TNALLYLVLKEGYKLIFPKTKKE

SEQ ID NO: 3029217 - protein, 23 aa, Entamoeba invadens
TNFKGWEWFIIEKSPEKKMYTIK

SEQ ID NO: 3029218 - protein, 22 aa, Entamoeba invadens
TNGKLMNELYSLKAKNEKQETE

SEQ ID NO: 3029219 - protein, 24 aa, Entamoeba invadens
TNKNMLWYLCDFLVEILKHKDITQ

SEQ ID NO: 3029220 - protein, 24 aa, Entamoeba invadens
TNNELIIPLMFGKKDKNKKKMVIE

SEQ ID NO: 3029221 - protein, 17 aa, Entamoeba invadens
TNNLLLFSNIKIAKEHK

SEQ ID NO: 3029222 - protein, 19 aa, Entamoeba invadens
TNNSWLAWLWPHQNVQNEE

SEQ ID NO: 3029223 - protein, 18 aa, Entamoeba invadens
TNPIFVGIVYFVNMLMTE

SEQ ID NO: 3029224 - protein, 17 aa, Entamoeba invadens
TNQLFQFIPYRNQAHPS

SEQ ID NO: 3029225 - protein, 21 aa, Entamoeba invadens
TNRYYYSIYTNWWGGEFKWRD

SEQ ID NO: 3029226 - protein, 21 aa, Entamoeba invadens
TNTFLWDVFLDSLNLIFFEFQ

SEQ ID NO: 3029227 - protein, 26 aa, Entamoeba invadens
TNTLAIPNYLFLGCTFLKTVEGIEKI

SEQ ID NO: 3029228 - protein, 21 aa, Entamoeba invadens
TNTLPPQWRFWESMTQDFCAT

SEQ ID NO: 3029229 - protein, 17 aa, Entamoeba invadens
TNVKTVWLMTKKFHSLL

SEQ ID NO: 3029230 - protein, 22 aa, Entamoeba invadens
TNYKNYLWKLLKALFDDYTDFA

SEQ ID NO: 3029231 - protein, 20 aa, Entamoeba invadens
TPCAIPLFDMNYFNTIQPCY

SEQ ID NO: 3029232 - protein, 24 aa, Entamoeba invadens
TPDVIFICVKYYSLPQIIPFINRI

SEQ ID NO: 3029233 - protein, 23 aa, Entamoeba invadens
TPKFINIPSYRWFFTHFTPDTLD

SEQ ID NO: 3029234 - protein, 21 aa, Entamoeba invadens
TPKFKRIGNLFYFVAEHLTED

SEQ ID NO: 3029235 - protein, 22 aa, Entamoeba invadens
TPKPLDNLFDFGFEPTPRNTDG

SEQ ID NO: 3029236 - protein, 22 aa, Entamoeba invadens
TPLFNNLLGGKLYRAYLNSNNV

SEQ ID NO: 3029237 - protein, 19 aa, Entamoeba invadens
TPMLFLDMFRIFNSHYLLG

SEQ ID NO: 3029238 - protein, 20 aa, Entamoeba invadens
TPMPLLRYSLPQLPLTLTQF

SEQ ID NO: 3029239 - protein, 25 aa, Entamoeba invadens
TPPNKMVFLFLFNDVLLETIPTKID

SEQ ID NO: 3029240 - protein, 26 aa, Entamoeba invadens
TPQKSLWVFRMRVLRRLLAKYRAMGK

SEQ ID NO: 3029241 - protein, 19 aa, Entamoeba invadens
TPRSVIIPRSPRLSQFSYY

SEQ ID NO: 3029242 - protein, 20 aa, Entamoeba invadens
TPRVMEILSKRLGIPMTSVS

SEQ ID NO: 3029243 - protein, 28 aa, Entamoeba invadens
TPTFSQNLPYFYYTLMINNLLKDVKSYL

SEQ ID NO: 3029244 - protein, 27 aa, Entamoeba invadens
TQAMLKFIYHRLFVFIVEQVNRVMRKD

SEQ ID NO: 3029245 - protein, 23 aa, Entamoeba invadens
TQKTLHLFVRLQTLYLYTKLDDF

SEQ ID NO: 3029246 - protein, 25 aa, Entamoeba invadens
TQLKATFVVLFNLFDKGPKGGLNIV

SEQ ID NO: 3029247 - protein, 24 aa, Entamoeba invadens
TQLLLIEKVIPYSYDYFTGVLPPF

SEQ ID NO: 3029248 - protein, 21 aa, Entamoeba invadens
TQLRRVLSLLPFLRYARTITM

SEQ ID NO: 3029249 - protein, 18 aa, Entamoeba invadens
TQPIYYEFIEETTNLRDL

SEQ ID NO: 3029250 - protein, 23 aa, Entamoeba invadens
TQQTFLIACFLKLGYTAKLHRTT

SEQ ID NO: 3029251 - protein, 28 aa, Entamoeba invadens
TQRRLNMSELRLFKACCKQTTFNNYRNW

SEQ ID NO: 3029252 - protein, 26 aa, Entamoeba invadens
TQTRSYFQLIFFLFEKSKTIKQLVAP

SEQ ID NO: 3029253 - protein, 21 aa, Entamoeba invadens
TQYFFKLRDPLMWGLQRVFLE

SEQ ID NO: 3029254 - protein, 22 aa, Entamoeba invadens
TQYSLLLFKLIERIKTHAIELS

SEQ ID NO: 3029255 - protein, 21 aa, Entamoeba invadens
TRALLIVLYNSYIAPVTCFVS

SEQ ID NO: 3029256 - protein, 24 aa, Entamoeba invadens
TRCVLQFYIPSFRKLGFGGIKKRI

SEQ ID NO: 3029257 - protein, 23 aa, Entamoeba invadens
TREGYLRCLLAMKLGVFYFQIGQ

SEQ ID NO: 3029258 - protein, 24 aa, Entamoeba invadens
TREKLEVYIWYDAELKRLNLEKER

SEQ ID NO: 3029259 - protein, 22 aa, Entamoeba invadens
TRGDLLMYLYSSNPQKQLQNIA

SEQ ID NO: 3029260 - protein, 27 aa, Entamoeba invadens
TRGKMTHNLLYPWKIYVYDALTEVYVW

SEQ ID NO: 3029261 - protein, 27 aa, Entamoeba invadens
TRKFLKFSWVIFLLIVKSINTYQITLR

SEQ ID NO: 3029262 - protein, 24 aa, Entamoeba invadens
TRKVGWMLFVWRMQSAWKEGKMEL

SEQ ID NO: 3029263 - protein, 23 aa, Entamoeba invadens
TRLFIPILVYRYLCSPTPYIMAA

SEQ ID NO: 3029264 - protein, 17 aa, Entamoeba invadens
TRNYIFCHVLFVQIPHT

SEQ ID NO: 3029265 - protein, 24 aa, Entamoeba invadens
TRVARYWPMFPRTFALFKKLFTEQ

SEQ ID NO: 3029266 - protein, 25 aa, Entamoeba invadens
TSAFFIYFENLLGTLPWSGLDESNT

SEQ ID NO: 3029267 - protein, 18 aa, Entamoeba invadens
TSARRIEFLQHTMQMVYV

SEQ ID NO: 3029268 - protein, 23 aa, Entamoeba invadens
TSDFPLLGLMRKWLKALYEVKVE

SEQ ID NO: 3029269 - protein, 19 aa, Entamoeba invadens
TSEFILKMKKILYSLGVAF

SEQ ID NO: 3029270 - protein, 17 aa, Entamoeba invadens
TSFFSFTGKVVEVRLSK

SEQ ID NO: 3029271 - protein, 19 aa, Entamoeba invadens
TSGLPNLLFFGPPGSGKTT

SEQ ID NO: 3029272 - protein, 20 aa, Entamoeba invadens
TSILPLLRPPEVFLSILLTK

SEQ ID NO: 3029273 - protein, 24 aa, Entamoeba invadens
TSKLKRCFLLIKRSDWTYQTCYGH

SEQ ID NO: 3029274 - protein, 17 aa, Entamoeba invadens
TSLLRMLSSFVLKLNTF

SEQ ID NO: 3029275 - protein, 25 aa, Entamoeba invadens
TSLSIVQLFFRFLEKYGFDATALTN

SEQ ID NO: 3029276 - protein, 20 aa, Entamoeba invadens
TSPWKDQFPEWALLPKTSEE

SEQ ID NO: 3029277 - protein, 21 aa, Entamoeba invadens
TSRRPLLQHIVLAGGSTLFPG

SEQ ID NO: 3029278 - protein, 17 aa, Entamoeba invadens
TSTFIYKPLGDLFTKCE

SEQ ID NO: 3029279 - protein, 24 aa, Entamoeba invadens
TSVLTFWRICQTFDYFFVKTVVRE

SEQ ID NO: 3029280 - protein, 26 aa, Entamoeba invadens
TSYFRNRHVILFCFDLSASGSLSSVE

SEQ ID NO: 3029281 - protein, 24 aa, Entamoeba invadens
TSYQIRLLLTYKNILKKQPTIQDE

SEQ ID NO: 3029282 - protein, 20 aa, Entamoeba invadens
TTCISCYFGFILNVQTSHCD

SEQ ID NO: 3029283 - protein, 20 aa, Entamoeba invadens
TTCTLILSSLLSGVCYNDII

SEQ ID NO: 3029284 - protein, 25 aa, Entamoeba invadens
TTDLARLFYIYLLNTQDVSALKKVV

SEQ ID NO: 3029285 - protein, 23 aa, Entamoeba invadens
TTFETNFLLFVQGNFLILKEEVT

SEQ ID NO: 3029286 - protein, 18 aa, Entamoeba invadens
TTFPSVLLTLSTLAKLYI

SEQ ID NO: 3029287 - protein, 19 aa, Entamoeba invadens
TTGTFLFPKEPWWKVHFGS

SEQ ID NO: 3029288 - protein, 20 aa, Entamoeba invadens
TTGWVWYNNPAPRPKIEIGA

SEQ ID NO: 3029289 - protein, 25 aa, Entamoeba invadens
TTKHNFFQIIVWFKVSLSTFLTNNT

SEQ ID NO: 3029290 - protein, 17 aa, Entamoeba invadens
TTKKRYFVLKANKLFYY

SEQ ID NO: 3029291 - protein, 23 aa, Entamoeba invadens
TTKSRYFFLFNDILIYGSGDQSH

SEQ ID NO: 3029292 - protein, 20 aa, Entamoeba invadens
TTMLLGFNSLVFRKILDLLD

SEQ ID NO: 3029293 - protein, 19 aa, Entamoeba invadens
TTMYIMLKYRKWQLKERRT

SEQ ID NO: 3029294 - protein, 22 aa, Entamoeba invadens
TTNTFLLLQRLCGIYKSFCNTC

SEQ ID NO: 3029295 - protein, 19 aa, Entamoeba invadens
TTPHFIRCILPNTQKRRHY

SEQ ID NO: 3029296 - protein, 24 aa, Entamoeba invadens
TTQIPLYPFFIKMNQIIGGSRDLH

SEQ ID NO: 3029297 - protein, 24 aa, Entamoeba invadens
TTQLFYIYFCPLTSQYLSLFVDPV

SEQ ID NO: 3029298 - protein, 21 aa, Entamoeba invadens
TTRIRNALLFYYRTGKTLSSQ

SEQ ID NO: 3029299 - protein, 18 aa, Entamoeba invadens
TTSLLFEFIWPPAYGDRI

SEQ ID NO: 3029300 - protein, 24 aa, Entamoeba invadens
TTTIGDFSFVNLNFDKPASTTAPT

SEQ ID NO: 3029301 - protein, 28 aa, Entamoeba invadens
TTTSTLTIVLGFLWQFIDKVFEKSLKRA

SEQ ID NO: 3029302 - protein, 24 aa, Entamoeba invadens
TTTTLLFLRFLLTPFSAVPNVLIE

SEQ ID NO: 3029303 - protein, 24 aa, Entamoeba invadens
TTVGWIYYIYILQKNSEGYYTAVR

SEQ ID NO: 3029304 - protein, 25 aa, Entamoeba invadens
TVDDYCLYVYLTFFIMKDTHFEDNE

SEQ ID NO: 3029305 - protein, 29 aa, Entamoeba invadens
TVEHRQYMFLFYTTLPLGPFTYSAQIVIL

SEQ ID NO: 3029306 - protein, 19 aa, Entamoeba invadens
TVEILLAKYIEFFYLTNTS

SEQ ID NO: 3029307 - protein, 26 aa, Entamoeba invadens
TVETFYLLRKIVPPYKGLASACEQYY

SEQ ID NO: 3029308 - protein, 22 aa, Entamoeba invadens
TVFDFLSLLWQAAGYPPYAQDR

SEQ ID NO: 3029309 - protein, 20 aa, Entamoeba invadens
TVKLQLWDTAGQERFATLSS

SEQ ID NO: 3029310 - protein, 19 aa, Entamoeba invadens
TVLSFFAFQLPVVGQIFSK

SEQ ID NO: 3029311 - protein, 26 aa, Entamoeba invadens
TVRKNLRKISLLKVRLIAQMRRGLDM

SEQ ID NO: 3029312 - protein, 24 aa, Entamoeba invadens
TVRQFFHHFLLYRFVLLRRSHMNW

SEQ ID NO: 3029313 - protein, 24 aa, Entamoeba invadens
TVSDLQLLYFFFKELQKIGGETNY

SEQ ID NO: 3029314 - protein, 21 aa, Entamoeba invadens
TVSLFNHWLPRFGIQVDFVDT

SEQ ID NO: 3029315 - protein, 18 aa, Entamoeba invadens
TVTYFKGLQLKFFFSILD

SEQ ID NO: 3029316 - protein, 20 aa, Entamoeba invadens
TVVFTMFYLLYAVGHLEHFC

SEQ ID NO: 3029317 - protein, 21 aa, Entamoeba invadens
TVVNYIFWRYVDPLSNVRDED

SEQ ID NO: 3029318 - protein, 22 aa, Entamoeba invadens
TVYPLWKSVLLPPGITFGKHKN

SEQ ID NO: 3029319 - protein, 24 aa, Entamoeba invadens
TYDETLWQIFMKKTATLGKIVDGK

SEQ ID NO: 3029320 - protein, 19 aa, Entamoeba invadens
TYDFYLLRLMMRHSTSTVP

SEQ ID NO: 3029321 - protein, 18 aa, Entamoeba invadens
TYEELLKRPTYLDKTKLE

SEQ ID NO: 3029322 - protein, 25 aa, Entamoeba invadens
TYKTVFFLRYLFIALNNAKQYVPVQ

SEQ ID NO: 3029323 - protein, 22 aa, Entamoeba invadens
TYLLPMVYNLWYKYVKLEETVG

SEQ ID NO: 3029324 - protein, 25 aa, Entamoeba invadens
TYMLEYFMLWFSRCFPLEVELKILD

SEQ ID NO: 3029325 - protein, 26 aa, Entamoeba invadens
TYMNSDIPFFCLFPLFITQNSFILRQ

SEQ ID NO: 3029326 - protein, 25 aa, Entamoeba invadens
TYNGKYMFYAPIKEKVLPTFAMLQK

SEQ ID NO: 3029327 - protein, 20 aa, Entamoeba invadens
TYRIRYLKHPYLSRKNDDLV

SEQ ID NO: 3029328 - protein, 22 aa, Entamoeba invadens
TYSFSFMFTLPPSFPPSLIVPN

SEQ ID NO: 3029329 - protein, 17 aa, Entamoeba invadens
TYVLQILIAQNREYFIA

SEQ ID NO: 3029330 - protein, 18 aa, Entamoeba invadens
VAAHLPIALMPIALQMLQ

SEQ ID NO: 3029331 - protein, 30 aa, Entamoeba invadens
VAANPRLQFQWWFPLVLTLTGNDYRELQAW

SEQ ID NO: 3029332 - protein, 17 aa, Entamoeba invadens
VAFPSDEAFPWCFDAAT

SEQ ID NO: 3029333 - protein, 26 aa, Entamoeba invadens
VAIEYGWFFFSIITKSLVLYLEENKI

SEQ ID NO: 3029334 - protein, 22 aa, Entamoeba invadens
VAKLIYIQLLGYPTQYGQMECL

SEQ ID NO: 3029335 - protein, 21 aa, Entamoeba invadens
VALCFKLIIKQCIFLCQMLRT

SEQ ID NO: 3029336 - protein, 23 aa, Entamoeba invadens
VALKYGCTLLLPQNIHPTVDFFL

SEQ ID NO: 3029337 - protein, 27 aa, Entamoeba invadens
VAQNFAQSFLLLDLVKLLRDVTTNNRE

SEQ ID NO: 3029338 - protein, 26 aa, Entamoeba invadens
VASDAFACAKLILVFRVDSTFDESLG

SEQ ID NO: 3029339 - protein, 24 aa, Entamoeba invadens
VCEHQNFDFFNFNEIFLKRKSERE

SEQ ID NO: 3029340 - protein, 19 aa, Entamoeba invadens
VCFRWIVLLFKREFRREEC

SEQ ID NO: 3029341 - protein, 30 aa, Entamoeba invadens
VCHYNYITILPLSLLILPKLKLLGLNHNRL

SEQ ID NO: 3029342 - protein, 17 aa, Entamoeba invadens
VCILLTVIYLGLKNVFY

SEQ ID NO: 3029343 - protein, 22 aa, Entamoeba invadens
VCKKYEFLLDRFRINPIRISPE

SEQ ID NO: 3029344 - protein, 23 aa, Entamoeba invadens
VCKWEYLKSLLTPSLTFIFSCIK

SEQ ID NO: 3029345 - protein, 23 aa, Entamoeba invadens
VCLDDCLLSYFLVGFNLNLFLTL

SEQ ID NO: 3029346 - protein, 24 aa, Entamoeba invadens
VCLKENIMFLVFTKEGHLFGSFNT

SEQ ID NO: 3029347 - protein, 24 aa, Entamoeba invadens
VCLKLPYYGINKYKLLGLLYEYLP

SEQ ID NO: 3029348 - protein, 17 aa, Entamoeba invadens
VCLLLLMKVKYPDRIHL

SEQ ID NO: 3029349 - protein, 24 aa, Entamoeba invadens
VCMIIVWPFKLFIYIRLKTIYIRH

SEQ ID NO: 3029350 - protein, 18 aa, Entamoeba invadens
VCTSCQSGYYLFNGICNY

SEQ ID NO: 3029351 - protein, 23 aa, Entamoeba invadens
VDANAWFVALAYTIQLAPRLNES

SEQ ID NO: 3029352 - protein, 24 aa, Entamoeba invadens
VDANQFFFIVKFWGSFFTNLSLND

SEQ ID NO: 3029353 - protein, 24 aa, Entamoeba invadens
VDATKIAFDLLLKNKDQASPNFLN

SEQ ID NO: 3029354 - protein, 24 aa, Entamoeba invadens
VDDKNAFLFSLRSNGRLGSPMKFD

SEQ ID NO: 3029355 - protein, 24 aa, Entamoeba invadens
VDHSTWLYLFPYFDNDKFDLTQMD

SEQ ID NO: 3029356 - protein, 18 aa, Entamoeba invadens
VDKFLFFGALTTGLLNLT

SEQ ID NO: 3029357 - protein, 20 aa, Entamoeba invadens
VDKKHFLFISKKSGVFFTTL

SEQ ID NO: 3029358 - protein, 23 aa, Entamoeba invadens
VDKKYYPKFFYLIDSQPLEEKDF

SEQ ID NO: 3029359 - protein, 23 aa, Entamoeba invadens
VDLAFWKFLEYVFVLLRNEVIEV

SEQ ID NO: 3029360 - protein, 20 aa, Entamoeba invadens
VDLFLEFLKFGLTLKEALSY

SEQ ID NO: 3029361 - protein, 17 aa, Entamoeba invadens
VDNRCVLCAPSGYYDLC

SEQ ID NO: 3029362 - protein, 20 aa, Entamoeba invadens
VDPISGLYYYYSCQPNLFVE

SEQ ID NO: 3029363 - protein, 22 aa, Entamoeba invadens
VDPLLHNLIYKCGRHNCGTSQT

SEQ ID NO: 3029364 - protein, 23 aa, Entamoeba invadens
VDQLMVHCVRFVSIKIIELLVQN

SEQ ID NO: 3029365 - protein, 27 aa, Entamoeba invadens
VDSCPWGFLLRLLDRYKLRVPVKGGYV

SEQ ID NO: 3029366 - protein, 27 aa, Entamoeba invadens
VDTLRQEYLFIPFKYRDGYLMAILQKV

SEQ ID NO: 3029367 - protein, 23 aa, Entamoeba invadens
VDTLYFYLCPSFITRTIRIIASN

SEQ ID NO: 3029368 - protein, 20 aa, Entamoeba invadens
VDVLLDVLPLIIKTASEELS

SEQ ID NO: 3029369 - protein, 20 aa, Entamoeba invadens
VDYFSALNLLFYPSSKKFID

SEQ ID NO: 3029370 - protein, 24 aa, Entamoeba invadens
VEANAWFVAMAYTIKLAPRINESK

SEQ ID NO: 3029371 - protein, 19 aa, Entamoeba invadens
VECYLINDMLWLVTELMDF

SEQ ID NO: 3029372 - protein, 18 aa, Entamoeba invadens
VECYLINDMLWLVTELMN

SEQ ID NO: 3029373 - protein, 23 aa, Entamoeba invadens
VEDLKRVFQLIFDRVPESFTHHL

SEQ ID NO: 3029374 - protein, 24 aa, Entamoeba invadens
VEGKKFTFPFPTKALYDYTAETDD

SEQ ID NO: 3029375 - protein, 21 aa, Entamoeba invadens
VEHPFVKYFMRGMRVTLATDA

SEQ ID NO: 3029376 - protein, 23 aa, Entamoeba invadens
VEKKPMFHFLPGTQTYSLATIGC

SEQ ID NO: 3029377 - protein, 17 aa, Entamoeba invadens
VEPLLFKRFVYNFAHGR

SEQ ID NO: 3029378 - protein, 17 aa, Entamoeba invadens
VEPYNCMLSLHSLLESA

SEQ ID NO: 3029379 - protein, 18 aa, Entamoeba invadens
VERKLSFTFAKKEKKDKT

SEQ ID NO: 3029380 - protein, 17 aa, Entamoeba invadens
VERQLICIYLANLFNKL

SEQ ID NO: 3029381 - protein, 25 aa, Entamoeba invadens
VESDSILLLDTFFYLVVFRGEAVVD

SEQ ID NO: 3029382 - protein, 24 aa, Entamoeba invadens
VETLYFVYKLFDSKSPLFEFLQIL

SEQ ID NO: 3029383 - protein, 19 aa, Entamoeba invadens
VEYFSLFVRFVFSDGSFVE

SEQ ID NO: 3029384 - protein, 17 aa, Entamoeba invadens
VEYIISKWKAEFPTEMA

SEQ ID NO: 3029385 - protein, 25 aa, Entamoeba invadens
VFAKRTTFFELFRIPEFTAEYKEKM

SEQ ID NO: 3029386 - protein, 23 aa, Entamoeba invadens
VFALFDVFFFKIPTQFWFELNDA

SEQ ID NO: 3029387 - protein, 19 aa, Entamoeba invadens
VFEDYFNFTFLSNSRDQYI

SEQ ID NO: 3029388 - protein, 25 aa, Entamoeba invadens
VFEKVFYRIIVWFNVDFETVDKNKC

SEQ ID NO: 3029389 - protein, 17 aa, Entamoeba invadens
VFFKIICFVCAFINENQ

SEQ ID NO: 3029390 - protein, 17 aa, Entamoeba invadens
VFFKLADILPFETAVKL

SEQ ID NO: 3029391 - protein, 19 aa, Entamoeba invadens
VFHSNLLYFFLIRYKLKLY

SEQ ID NO: 3029392 - protein, 25 aa, Entamoeba invadens
VFKKKFYRIIVWFNLDFETVDKNKS

SEQ ID NO: 3029393 - protein, 21 aa, Entamoeba invadens
VFKPYRDLIMAYALGVRLTIV

SEQ ID NO: 3029394 - protein, 19 aa, Entamoeba invadens
VFKTFKLLSFCEVPFVASI

SEQ ID NO: 3029395 - protein, 17 aa, Entamoeba invadens
VFLFRNILLLTKPGSEI

SEQ ID NO: 3029396 - protein, 17 aa, Entamoeba invadens
VFMLYFLDTIARKKPSS

SEQ ID NO: 3029397 - protein, 19 aa, Entamoeba invadens
VFPNRKDLWFFFNKIIVLS

SEQ ID NO: 3029398 - protein, 17 aa, Entamoeba invadens
VFQIRRFILSTYNITLS

SEQ ID NO: 3029399 - protein, 17 aa, Entamoeba invadens
VFRILFTLVSSLQEDDC

SEQ ID NO: 3029400 - protein, 17 aa, Entamoeba invadens
VFRILLTLVFFYCKKMT

SEQ ID NO: 3029401 - protein, 17 aa, Entamoeba invadens
VFTNFKSYYGRTELGPF

SEQ ID NO: 3029402 - protein, 35 aa, Entamoeba invadens
VFTRQMYLQLYFQSFLMLRKSLVNEFLLKDLKKKG

SEQ ID NO: 3029403 - protein, 19 aa, Entamoeba invadens
VFVYFRDGIVAFMTKLITL

SEQ ID NO: 3029404 - protein, 17 aa, Entamoeba invadens
VFYTPFDYSLPGLNLHV

SEQ ID NO: 3029405 - protein, 17 aa, Entamoeba invadens
VGAEFYKFKYTFKDKEV

SEQ ID NO: 3029406 - protein, 22 aa, Entamoeba invadens
VGAFVFLRLLNPVLLTPQKFST

SEQ ID NO: 3029407 - protein, 24 aa, Entamoeba invadens
VGFNRVLLYLFSRYFEKLLEKEQN

SEQ ID NO: 3029408 - protein, 17 aa, Entamoeba invadens
VGHLWFDELIKKAIEKY

SEQ ID NO: 3029409 - protein, 22 aa, Entamoeba invadens
VGKDWKMCLLFTDVMIVARPFV

SEQ ID NO: 3029410 - protein, 25 aa, Entamoeba invadens
VGKRGPLLVVLFLNDVELRNLEKPM

SEQ ID NO: 3029411 - protein, 22 aa, Entamoeba invadens
VGLTFLNIPLYAAGAKPWGAPT

SEQ ID NO: 3029412 - protein, 23 aa, Entamoeba invadens
VGMLPWLCKFLSIPIFMAQPTLS

SEQ ID NO: 3029413 - protein, 18 aa, Entamoeba invadens
VGMLYLYLSTLDKPLFGV

SEQ ID NO: 3029414 - protein, 24 aa, Entamoeba invadens
VGRPYVVKPLTLLVLQKFVRYVLD

SEQ ID NO: 3029415 - protein, 23 aa, Entamoeba invadens
VGSDLMYFQIRPNGKKGRYPISK

SEQ ID NO: 3029416 - protein, 23 aa, Entamoeba invadens
VGVQAILMCAYQRGLRKFNNITD

SEQ ID NO: 3029417 - protein, 32 aa, Entamoeba invadens
VGVTSFKKISMINFLIFHFGYDWKEVVNAPQG

SEQ ID NO: 3029418 - protein, 34 aa, Entamoeba invadens
VGVTSFKKISMINFLIFYFKQDFAEVVHAPQGGN

SEQ ID NO: 3029419 - protein, 20 aa, Entamoeba invadens
VHFFLSTNWFLSINKQSARI

SEQ ID NO: 3029420 - protein, 18 aa, Entamoeba invadens
VHPQVSAYFLIIYETSDS

SEQ ID NO: 3029421 - protein, 24 aa, Entamoeba invadens
VHSKYFQYYFFSQPTLMVRMSISE

SEQ ID NO: 3029422 - protein, 22 aa, Entamoeba invadens
VHYYPLPFAKLSIPSKVVYLDN

SEQ ID NO: 3029423 - protein, 28 aa, Entamoeba invadens
VIEKSVRIGWLYCLRGYETGYIPQNFTS

SEQ ID NO: 3029424 - protein, 19 aa, Entamoeba invadens
VIERYIVALDYLFGRASNI

SEQ ID NO: 3029425 - protein, 25 aa, Entamoeba invadens
VIIMNLLLRYIFGLIGFVPTVSFGN

SEQ ID NO: 3029426 - protein, 23 aa, Entamoeba invadens
VIKHCRFLLNPLQVFNMFEGWDK

SEQ ID NO: 3029427 - protein, 23 aa, Entamoeba invadens
VIKRWVLRYVIVKHNFLIYFVSE

SEQ ID NO: 3029428 - protein, 29 aa, Entamoeba invadens
VILPSYHMFFVECLPIPPSRFRPLNRFGN

SEQ ID NO: 3029429 - protein, 17 aa, Entamoeba invadens
VILTLLFRLADTNNSGK

SEQ ID NO: 3029430 - protein, 19 aa, Entamoeba invadens
VILYRIYYIKSSGVYFLYQ

SEQ ID NO: 3029431 - protein, 19 aa, Entamoeba invadens
VINALIFFDSLESVRTAEL

SEQ ID NO: 3029432 - protein, 19 aa, Entamoeba invadens
VINLFALTMYWADDTHFTL

SEQ ID NO: 3029433 - protein, 17 aa, Entamoeba invadens
VINVPYISGYLGFREVE

SEQ ID NO: 3029434 - protein, 17 aa, Entamoeba invadens
VIPKLIFYNDPTVINMC

SEQ ID NO: 3029435 - protein, 18 aa, Entamoeba invadens
VIQCLNCIILNALPLEKK

SEQ ID NO: 3029436 - protein, 35 aa, Entamoeba invadens
VIQDTIHIWYQFRNWFRLFKRTKKLKLLKKKLAVE

SEQ ID NO: 3029437 - protein, 35 aa, Entamoeba invadens; identical to SEQ ID NO: 3022117

SEQ ID NO: 3029438 - protein, 23 aa, Entamoeba invadens
VIRNTLLQYSEKDNPWVRLFEQC

SEQ ID NO: 3029439 - protein, 17 aa, Entamoeba invadens
VIRYAWISANLGKLAKK

SEQ ID NO: 3029440 - protein, 18 aa, Entamoeba invadens
VISLRYRVPFKQVYFFDT

SEQ ID NO: 3029441 - protein, 22 aa, Entamoeba invadens
VITIPIFFNLALKDHLNIGFKQ

SEQ ID NO: 3029442 - protein, 19 aa, Entamoeba invadens
VIYLPIFDLIMSKLTVDPP

SEQ ID NO: 3029443 - protein, 17 aa, Entamoeba invadens
VIYLTFFDALYSKEIRG

SEQ ID NO: 3029444 - protein, 17 aa, Entamoeba invadens
VIYNNIFYKCDIGYSGD

SEQ ID NO: 3029445 - protein, 17 aa, Entamoeba invadens
VKAFLRKVYEKLPTSLL

SEQ ID NO: 3029446 - protein, 24 aa, Entamoeba invadens
VKESKIPIILFIDEIHTVLGAGAT

SEQ ID NO: 3029447 - protein, 25 aa, Entamoeba invadens
VKESKIPIILFIDEIHTVLGAGATG

SEQ ID NO: 3029448 - protein, 24 aa, Entamoeba invadens
VKIEFITPLFPFIKMMLRSIVVSL

SEQ ID NO: 3029449 - protein, 21 aa, Entamoeba invadens
VKIVLQHKMDWLRQSKATLQD

SEQ ID NO: 3029450 - protein, 25 aa, Entamoeba invadens
VKKKFFQIFVWFKVNYRTVVKNKNS

SEQ ID NO: 3029451 - protein, 19 aa, Entamoeba invadens
VKLEGLFLKLWTTAFGATK

SEQ ID NO: 3029452 - protein, 22 aa, Entamoeba invadens
VKLYEMLLWANGEKDRCVNIIA

SEQ ID NO: 3029453 - protein, 26 aa, Entamoeba invadens
VKMNIGVLHRFLIFKYPHFKEELNTI

SEQ ID NO: 3029454 - protein, 23 aa, Entamoeba invadens
VKQRLHLIEKWKPSPTLEIVFDS

SEQ ID NO: 3029455 - protein, 24 aa, Entamoeba invadens
VKRIREMWLLIFKFLDHPLQVGNV

SEQ ID NO: 3029456 - protein, 24 aa, Entamoeba invadens
VKRKFDGYVIFRPKYRRFEVYEDS

SEQ ID NO: 3029457 - protein, 25 aa, Entamoeba invadens
VKSWKKRFFVLKNKNLWYFESETSS

SEQ ID NO: 3029458 - protein, 25 aa, Entamoeba invadens
VKTNPKLWWKYIYNVKLDEIKEKNK

SEQ ID NO: 3029459 - protein, 17 aa, Entamoeba invadens
VKTVWLMTKKFHSLLEL

SEQ ID NO: 3029460 - protein, 19 aa, Entamoeba invadens
VKYASYLRFLMERRLYKEK

SEQ ID NO: 3029461 - protein, 27 aa, Entamoeba invadens
VKYGESDFVLMFWNPNQPLEQWMVKDL

SEQ ID NO: 3029462 - protein, 20 aa, Entamoeba invadens
VLEDKLLQWTKQSDTLILEL

SEQ ID NO: 3029463 - protein, 18 aa, Entamoeba invadens
VLEFFLKSPFALVTHKLL

SEQ ID NO: 3029464 - protein, 26 aa, Entamoeba invadens
VLEHGSFYFWMAYCPMIPKSEKLTQI

SEQ ID NO: 3029465 - protein, 27 aa, Entamoeba invadens
VLEKYLPTCFLLRQYLLLIQKPSDFSK

SEQ ID NO: 3029466 - protein, 23 aa, Entamoeba invadens
VLENVFKVQFFTLKMLLFEQEKE

SEQ ID NO: 3029467 - protein, 19 aa, Entamoeba invadens
VLEYLYYLTQIGLAVSPLS

SEQ ID NO: 3029468 - protein, 25 aa, Entamoeba invadens
VLKKEFFRIIVWFNVDFEIVDRNKS

SEQ ID NO: 3029469 - protein, 24 aa, Entamoeba invadens
VLKKEFFRTIVWFNVDFETVDRNK

SEQ ID NO: 3029470 - protein, 25 aa, Entamoeba invadens
VLKREFFRIIVWFNVDFETVDRNKN

SEQ ID NO: 3029471 - protein, 26 aa, Entamoeba invadens
VLKREFFRIIVWFSVNFEIVNRNKNR

SEQ ID NO: 3029472 - protein, 21 aa, Entamoeba invadens
VLKVNLDWSLQNVYSLIAHES

SEQ ID NO: 3029473 - protein, 18 aa, Entamoeba invadens
VLLKWREFVLRKIKIAQN

SEQ ID NO: 3029474 - protein, 18 aa, Entamoeba invadens
VLMALLLKVGVESFTLMC

SEQ ID NO: 3029475 - protein, 25 aa, Entamoeba invadens
VLNAPRLYFSLKKDVYWFISDHWYC

SEQ ID NO: 3029476 - protein, 18 aa, Entamoeba invadens
VLPFHRRALKTLLESEEL

SEQ ID NO: 3029477 - protein, 17 aa, Entamoeba invadens
VLPVPLLRELHSTAFQS

SEQ ID NO: 3029478 - protein, 17 aa, Entamoeba invadens
VLQLFNAISEHQLKLRI

SEQ ID NO: 3029479 - protein, 25 aa, Entamoeba invadens
VLQPFVWQHIFVPILPMFLNAYLSS

SEQ ID NO: 3029480 - protein, 17 aa, Entamoeba invadens
VLQVLMKLRFQFELRYF

SEQ ID NO: 3029481 - protein, 17 aa, Entamoeba invadens
VLRLAFGLDFCYFEVCA

SEQ ID NO: 3029482 - protein, 22 aa, Entamoeba invadens
VLRYIPFLLHYIPNLETYEGNL

SEQ ID NO: 3029483 - protein, 17 aa, Entamoeba invadens
VLSVVFFYCTQIQFINV

SEQ ID NO: 3029484 - protein, 23 aa, Entamoeba invadens
VLYNLRLRYMKDIIHTYSGLFCV

SEQ ID NO: 3029485 - protein, 18 aa, Entamoeba invadens
VLYYLYNWKVYNGVYYIP

SEQ ID NO: 3029486 - protein, 17 aa, Entamoeba invadens
VMAYFFENFQTIAPFIN

SEQ ID NO: 3029487 - protein, 24 aa, Entamoeba invadens
VMELIPEFFYFPEFLRNFDKFDLK

SEQ ID NO: 3029488 - protein, 23 aa, Entamoeba invadens
VMELYIDFMPINADLFISSSPNF

SEQ ID NO: 3029489 - protein, 18 aa, Entamoeba invadens
VMRFQTMLSYLFPNEIFS

SEQ ID NO: 3029490 - protein, 18 aa, Entamoeba invadens
VMVSRWFGGILLGPDRFK

SEQ ID NO: 3029491 - protein, 19 aa, Entamoeba invadens
VNAFDLILRKGVVGQIYNI

SEQ ID NO: 3029492 - protein, 23 aa, Entamoeba invadens
VNEKPYFYLLNVFRGEKPQSGLN

SEQ ID NO: 3029493 - protein, 23 aa, Entamoeba invadens
VNERLLHQMLWFGDYSYYSHRLI

SEQ ID NO: 3029494 - protein, 22 aa, Entamoeba invadens
VNFGCFGISKLSLRKNVCLNLS

SEQ ID NO: 3029495 - protein, 18 aa, Entamoeba invadens
VNGFIYFEYIPLIAEPIF

SEQ ID NO: 3029496 - protein, 21 aa, Entamoeba invadens
VNGVLTMCYGVDGVPAYVDFT

SEQ ID NO: 3029497 - protein, 23 aa, Entamoeba invadens
VNNLLFTVFDLQLTLKLLLYELI

SEQ ID NO: 3029498 - protein, 28 aa, Entamoeba invadens
VNNLSMTLLWVFFLRQACLKNWPNSPLN

SEQ ID NO: 3029499 - protein, 17 aa, Entamoeba invadens
VNSFYSTFLRIINKFLS

SEQ ID NO: 3029500 - protein, 19 aa, Entamoeba invadens
VPDLPFTFETPNLLRNRAM

SEQ ID NO: 3029501 - protein, 24 aa, Entamoeba invadens
VPIQYVNLFLEIYFRQLPQLNSVA

SEQ ID NO: 3029502 - protein, 22 aa, Entamoeba invadens
VPKHLFEIFKIPFVPLAIDSNK

SEQ ID NO: 3029503 - protein, 21 aa, Entamoeba invadens
VPKIPIDPILLEKAKQTNTVE

SEQ ID NO: 3029504 - protein, 18 aa, Entamoeba invadens
VPKLTLFFRKMVLLKNGA

SEQ ID NO: 3029505 - protein, 23 aa, Entamoeba invadens
VPKPRYFYLFNDIMMYGIESLGT

SEQ ID NO: 3029506 - protein, 25 aa, Entamoeba invadens
VPLDRYMPFMKPLQLKFLNISGNRF

SEQ ID NO: 3029507 - protein, 20 aa, Entamoeba invadens
VPLLQFLFMSKPPFKFNRRA

SEQ ID NO: 3029508 - protein, 21 aa, Entamoeba invadens
VPRYELFIKGFLKYLPRSHVE

SEQ ID NO: 3029509 - protein, 23 aa, Entamoeba invadens
VPTAPPYGLFLERCNFDVYNNDI

SEQ ID NO: 3029510 - protein, 24 aa, Entamoeba invadens
VPTMLLYLYLPRPVNYFGQYKTIL

SEQ ID NO: 3029511 - protein, 18 aa, Entamoeba invadens
VPVFFFYQVGFYGRDFFG

SEQ ID NO: 3029512 - protein, 17 aa, Entamoeba invadens
VPVFKYVPRSHRKEYYS

SEQ ID NO: 3029513 - protein, 31 aa, Entamoeba invadens
VPYETLQFVFFYFDVVYLRLPRLPLASKWNV

SEQ ID NO: 3029514 - protein, 17 aa, Entamoeba invadens
VPYGNGCLVCKVGYYKK

SEQ ID NO: 3029515 - protein, 18 aa, Entamoeba invadens
VQCSTLVLFPFKTAALIF

SEQ ID NO: 3029516 - protein, 23 aa, Entamoeba invadens
VQDGLFNFYYFTTNLLFTLVPTD

SEQ ID NO: 3029517 - protein, 24 aa, Entamoeba invadens
VQDIYGVWALLISKLKLLITDVFA

SEQ ID NO: 3029518 - protein, 25 aa, Entamoeba invadens
VQFAYLRYEMDQTKKFLSVCWCGQG

SEQ ID NO: 3029519 - protein, 27 aa, Entamoeba invadens
VQHKLFKTAFLFFQPFKSYTTYMGDRD

SEQ ID NO: 3029520 - protein, 27 aa, Entamoeba invadens
VQININFKLPYFLKTWLRFIHLCGSPA

SEQ ID NO: 3029521 - protein, 19 aa, Entamoeba invadens
VQIVIAFLIFVIDNYPTLF

SEQ ID NO: 3029522 - protein, 25 aa, Entamoeba invadens
VQKFPKYILIKLQRDIPISFEDMRK

SEQ ID NO: 3029523 - protein, 17 aa, Entamoeba invadens
VQLLLFKGTIAKVKNIE

SEQ ID NO: 3029524 - protein, 20 aa, Entamoeba invadens
VQMDFLVLPILQLLCYKFPK

SEQ ID NO: 3029525 - protein, 18 aa, Entamoeba invadens
VQMHFERLLIANYRKSTN

SEQ ID NO: 3029526 - protein, 22 aa, Entamoeba invadens
VQMLQEKLLRANYKKLTKKAND

SEQ ID NO: 3029527 - protein, 27 aa, Entamoeba invadens
VQSMFWRYLRMFLYLKYNIKTIVSKKT

SEQ ID NO: 3029528 - protein, 19 aa, Entamoeba invadens
VQTYFVIAFLKMRYSNMKI

SEQ ID NO: 3029529 - protein, 20 aa, Entamoeba invadens
VQVRYIVYQLLKALKYLHSA

SEQ ID NO: 3029530 - protein, 22 aa, Entamoeba invadens
VQWGRLFSLWIAYQIVREKDEE

SEQ ID NO: 3029531 - protein, 23 aa, Entamoeba invadens
VREIFCVIMTKFAFLYSDFGKEK

SEQ ID NO: 3029532 - protein, 20 aa, Entamoeba invadens
VRFEPFVYLQLALPQQPKVI

SEQ ID NO: 3029533 - protein, 18 aa, Entamoeba invadens
VRFVGLHPIIALSPNLIF

SEQ ID NO: 3029534 - protein, 17 aa, Entamoeba invadens
VRILYPIVPYKVVENNE

SEQ ID NO: 3029535 - protein, 18 aa, Entamoeba invadens
VRLPMLEPVFLFLNKQKG

SEQ ID NO: 3029536 - protein, 18 aa, Entamoeba invadens
VRNTYWVALKFVNGINTC

SEQ ID NO: 3029537 - protein, 22 aa, Entamoeba invadens
VRQFNTLTYGFYLFCILKCFLD

SEQ ID NO: 3029538 - protein, 32 aa, Entamoeba invadens
VRTAFILLKLFFLFLPTPILPPEFLKKLSKMY

SEQ ID NO: 3029539 - protein, 18 aa, Entamoeba invadens
VRYNLFCLLKSPILKMEK

SEQ ID NO: 3029540 - protein, 25 aa, Entamoeba invadens
VSAKRLFPNFVFLDAPFNKKYYKKG

SEQ ID NO: 3029541 - protein, 23 aa, Entamoeba invadens
VSCLLELYELFFPLNETSKKMQL

SEQ ID NO: 3029542 - protein, 22 aa, Entamoeba invadens
VSDLFIKLNILLNNELNKLSPN

SEQ ID NO: 3029543 - protein, 24 aa, Entamoeba invadens
VSFSIPTFIFTLPEFPRTSFGKVY

SEQ ID NO: 3029544 - protein, 17 aa, Entamoeba invadens
VSGIEPEWLFEASPQYF

SEQ ID NO: 3029545 - protein, 17 aa, Entamoeba invadens
VSIGRCVILVYKSLYEV

SEQ ID NO: 3029546 - protein, 20 aa, Entamoeba invadens
VSITILLVDQIVMQKPAGGP

SEQ ID NO: 3029547 - protein, 24 aa, Entamoeba invadens
VSKEWKMCILFNDILIIARPFVFG

SEQ ID NO: 3029548 - protein, 25 aa, Entamoeba invadens
VSKKLFYRIIVWFGVDFETVDKNKT

SEQ ID NO: 3029549 - protein, 22 aa, Entamoeba invadens
VSKWVGLFDIFVSKWKTVEILL

SEQ ID NO: 3029550 - protein, 20 aa, Entamoeba invadens
VSKYLIYIPEKDARMAVLLA

SEQ ID NO: 3029551 - protein, 19 aa, Entamoeba invadens
VSLLLLFKLKYPDKIHLIR

SEQ ID NO: 3029552 - protein, 24 aa, Entamoeba invadens
VSPVVFILPLLLQQMALTGTQSIA

SEQ ID NO: 3029553 - protein, 19 aa, Entamoeba invadens
VSQIPFIDPKSCKPMSSKK

SEQ ID NO: 3029554 - protein, 22 aa, Entamoeba invadens
VSSILIHLIFNSIVKVFGGDRG

SEQ ID NO: 3029555 - protein, 18 aa, Entamoeba invadens
VSTIISFYFPLVTSFHTL

SEQ ID NO: 3029556 - protein, 17 aa, Entamoeba invadens
VSTLYFIRKRKFKDALK

SEQ ID NO: 3029557 - protein, 24 aa, Entamoeba invadens
VSYELLICIMLRKIKEMTNTVFAV

SEQ ID NO: 3029558 - protein, 21 aa, Entamoeba invadens
VSYLKLPLQPLLSLLIDTESV

SEQ ID NO: 3029559 - protein, 22 aa, Entamoeba invadens
VTCHSYFLLQFPDLLMNEENIK

SEQ ID NO: 3029560 - protein, 18 aa, Entamoeba invadens
VTCKSAFRRSAETGALVA

SEQ ID NO: 3029561 - protein, 22 aa, Entamoeba invadens
VTDFEWYLKLLSRLSTQKLEQS

SEQ ID NO: 3029562 - protein, 18 aa, Entamoeba invadens
VTEHIFDFLPLESLLCVS

SEQ ID NO: 3029563 - protein, 20 aa, Entamoeba invadens
VTELFLQMFSLRALIPQAFS

SEQ ID NO: 3029564 - protein, 25 aa, Entamoeba invadens
VTFTSTYLLTFYLKFLHITGNLCNV

SEQ ID NO: 3029565 - protein, 17 aa, Entamoeba invadens
VTGDLTGLIPWNKELFK

SEQ ID NO: 3029566 - protein, 23 aa, Entamoeba invadens
VTSLYYFLSVFSKWGLRASECEE

SEQ ID NO: 3029567 - protein, 24 aa, Entamoeba invadens
VTSTYLLMKLSFNYLFDLMAVSMD

SEQ ID NO: 3029568 - protein, 24 aa, Entamoeba invadens
VTTFRPELIGPAKKWYEIKHQNKV

SEQ ID NO: 3029569 - protein, 21 aa, Entamoeba invadens
VTTLLFLRFILTPFTSTPVIL

SEQ ID NO: 3029570 - protein, 24 aa, Entamoeba invadens
VVDEELFLFTFKKGPFSYCKKWVP

SEQ ID NO: 3029571 - protein, 24 aa, Entamoeba invadens
VVDIRGWALGYVFDRFAFAQVLPY

SEQ ID NO: 3029572 - protein, 24 aa, Entamoeba invadens
VVERKKFIVILLSILFAIEDCSTN

SEQ ID NO: 3029573 - protein, 24 aa, Entamoeba invadens
VVFQRKLKFAAEGVAWIGLNKYIA

SEQ ID NO: 3029574 - protein, 17 aa, Entamoeba invadens
VVFYHFNPMYSLLCPTK

SEQ ID NO: 3029575 - protein, 20 aa, Entamoeba invadens
VVITLLFMKLITPNKVYLLR

SEQ ID NO: 3029576 - protein, 17 aa, Entamoeba invadens
VVLFMKVNPFALSRQKA

SEQ ID NO: 3029577 - protein, 19 aa, Entamoeba invadens
VVLKLLTLFPFENLDVSER

SEQ ID NO: 3029578 - protein, 17 aa, Entamoeba invadens
VVLLPFIERPKLLKYLR

SEQ ID NO: 3029579 - protein, 21 aa, Entamoeba invadens
VVLNLIRTWLDKNRDWNGVVM

SEQ ID NO: 3029580 - protein, 17 aa, Entamoeba invadens
VVLSPLTLVLPFLSNFS

SEQ ID NO: 3029581 - protein, 27 aa, Entamoeba invadens
VVMQNKYLILYLYNHQIKIISLPQGDE

SEQ ID NO: 3029582 - protein, 18 aa, Entamoeba invadens
VVPFIFKNVKTPLMFINC

SEQ ID NO: 3029583 - protein, 24 aa, Entamoeba invadens
VVQRLLLVPVGFYQKILRLLRCLL

SEQ ID NO: 3029584 - protein, 23 aa, Entamoeba invadens
VVSGILFITTFRIIFCPFDEVQV

SEQ ID NO: 3029585 - protein, 26 aa, Entamoeba invadens
VVSQMPVFLIFFPHINTLYYNISNAQ

SEQ ID NO: 3029586 - protein, 17 aa, Entamoeba invadens
VVVILERYLVSGLSAGQ

SEQ ID NO: 3029587 - protein, 17 aa, Entamoeba invadens
VVVLLFNYLHKLYDDNS

SEQ ID NO: 3029588 - protein, 19 aa, Entamoeba invadens
VVYFYHKRFLISDVFLGCV

SEQ ID NO: 3029589 - protein, 26 aa, Entamoeba invadens
VWAKQKGYPWWPAKLVLVDSLPEDQK

SEQ ID NO: 3029590 - protein, 18 aa, Entamoeba invadens
VWGNAYPKEKFNFPWKIA

SEQ ID NO: 3029591 - protein, 19 aa, Entamoeba invadens
VWIHREPLEQIKSLIPLLL

SEQ ID NO: 3029592 - protein, 18 aa, Entamoeba invadens
VWTGRWKYLIYRYDKPKP

SEQ ID NO: 3029593 - protein, 22 aa, Entamoeba invadens
VYAIGLFLYYLLAGTLPRCCSN

SEQ ID NO: 3029594 - protein, 18 aa, Entamoeba invadens
VYEDLVYLIAYLDEKRQA

SEQ ID NO: 3029595 - protein, 26 aa, Entamoeba invadens
VYEHKRFFFHFFLSPENTEVLKFLTF

SEQ ID NO: 3029596 - protein, 17 aa, Entamoeba invadens
VYFYHKRFLISDVFLGC

SEQ ID NO: 3029597 - protein, 19 aa, Entamoeba invadens
VYGVRVPIIYRQGCYELLN

SEQ ID NO: 3029598 - protein, 17 aa, Entamoeba invadens
VYIPYIIILKNTKLRQD

SEQ ID NO: 3029599 - protein, 23 aa, Entamoeba invadens
VYKKVLFLVPFKKITDKNIVAIK

SEQ ID NO: 3029600 - protein, 19 aa, Entamoeba invadens
VYLQLALPQQPKVIKFIIF

SEQ ID NO: 3029601 - protein, 18 aa, Entamoeba invadens
VYLQSLFIKKLTFDEKEG

SEQ ID NO: 3029602 - protein, 31 aa, Entamoeba invadens
VYLYTYPYKNIFFKALIFWLGRSASLLHRGK

SEQ ID NO: 3029603 - protein, 25 aa, Entamoeba invadens
VYMFDWYMVWFSRILPCDFLYAVFD

SEQ ID NO: 3029604 - protein, 17 aa, Entamoeba invadens
VYPFIKDADFVFTTFLT

SEQ ID NO: 3029605 - protein, 19 aa, Entamoeba invadens
VYRLIWLNFPERKLRLVRH

SEQ ID NO: 3029606 - protein, 17 aa, Entamoeba invadens
VYSIIKRPTLSSSLTCE

SEQ ID NO: 3029607 - protein, 23 aa, Entamoeba invadens
VYSKYLRLLEKKGFFKTTSEEER

SEQ ID NO: 3029608 - protein, 21 aa, Entamoeba invadens
VYYITISLLVKLLKLAKESNP

SEQ ID NO: 3029609 - protein, 22 aa, Entamoeba invadens
WACLKIYKFILPFLFKHNNLEY

SEQ ID NO: 3029610 - protein, 25 aa, Entamoeba invadens
WAVKLDKMFDGFWKLAFDDKKVVVE

SEQ ID NO: 3029611 - protein, 20 aa, Entamoeba invadens
WCKAYLIGLLILCETRNSLC

SEQ ID NO: 3029612 - protein, 19 aa, Entamoeba invadens
WCKAYPTETFKFPWKIAEF

SEQ ID NO: 3029613 - protein, 19 aa, Entamoeba invadens
WCMGFLFSDLFLLAKPSVP

SEQ ID NO: 3029614 - protein, 24 aa, Entamoeba invadens
WDAEPLFFPIRVLRKVQSKVEPVE

SEQ ID NO: 3029615 - protein, 18 aa, Entamoeba invadens
WDNFLKLIYDRGILCGIL

SEQ ID NO: 3029616 - protein, 28 aa, Entamoeba invadens
WDTAGQERFATLSSNYFRSALGGVIVFD

SEQ ID NO: 3029617 - protein, 23 aa, Entamoeba invadens
WECGVFVLFFIRIFVQFHPKTLP

SEQ ID NO: 3029618 - protein, 18 aa, Entamoeba invadens
WECYVYLYTYPYKNIFFK

SEQ ID NO: 3029619 - protein, 18 aa, Entamoeba invadens
WEIRQALRRLGLKTVGTL

SEQ ID NO: 3029620 - protein, 18 aa, Entamoeba invadens
WEKFYMMLHGAALCLFLS

SEQ ID NO: 3029621 - protein, 17 aa, Entamoeba invadens
WELYFRIYKRIHKSINS

SEQ ID NO: 3029622 - protein, 21 aa, Entamoeba invadens
WESHCRVYFLLIPSKKFEVSP

SEQ ID NO: 3029623 - protein, 18 aa, Entamoeba invadens
WFCNEINNLKFLFKYYLL

SEQ ID NO: 3029624 - protein, 18 aa, Entamoeba invadens
WFKTEFFHWVEDYCLECG

SEQ ID NO: 3029625 - protein, 17 aa, Entamoeba invadens
WFYFTEVLPIKTTFITW

SEQ ID NO: 3029626 - protein, 17 aa, Entamoeba invadens
WGLYFAMIAQRLALVKL

SEQ ID NO: 3029627 - protein, 19 aa, Entamoeba invadens
WHILSFIKPFTSQKWRKAI

SEQ ID NO: 3029628 - protein, 24 aa, Entamoeba invadens
WHNALQYLKLDPPFKFLNPAFEGI

SEQ ID NO: 3029629 - protein, 17 aa, Entamoeba invadens
WIHIIRIILYSLNKLRP

SEQ ID NO: 3029630 - protein, 19 aa, Entamoeba invadens
WINTYNKLILRDILPHVES

SEQ ID NO: 3029631 - protein, 17 aa, Entamoeba invadens
WIRHLPIAFLMREHMML

SEQ ID NO: 3029632 - protein, 18 aa, Entamoeba invadens
WKELVEGIITILMKGRCF

SEQ ID NO: 3029633 - protein, 20 aa, Entamoeba invadens
WKIPLPLYRFIPFLEDMGYY

SEQ ID NO: 3029634 - protein, 19 aa, Entamoeba invadens
WKQTLFFLKYPLKMEMGDR

SEQ ID NO: 3029635 - protein, 25 aa, Entamoeba invadens
WKSWKRRWFVIKDKKMWYFSGKNDT

SEQ ID NO: 3029636 - protein, 25 aa, Entamoeba invadens
WKTWKRRFFVLKDRKLWYFEAPDSL

SEQ ID NO: 3029637 - protein, 24 aa, Entamoeba invadens
WLQSKKWFCYPLSGILDYKITESG

SEQ ID NO: 3029638 - protein, 21 aa, Entamoeba invadens
WMDFGHILVIMLSIEKIDSKH

SEQ ID NO: 3029639 - protein, 23 aa, Entamoeba invadens
WMENPLIKFLVEKMGLESENDKM

SEQ ID NO: 3029640 - protein, 18 aa, Entamoeba invadens
WMNDLKQFFPYLMFLDNK

SEQ ID NO: 3029641 - protein, 17 aa, Entamoeba invadens
WNFLIGNSKRRPKKMLE

SEQ ID NO: 3029642 - protein, 19 aa, Entamoeba invadens
WNLLFKKRHCFCGYYIFVE

SEQ ID NO: 3029643 - protein, 20 aa, Entamoeba invadens
WNLLLRVIFTSLHSLDPTKE

SEQ ID NO: 3029644 - protein, 25 aa, Entamoeba invadens
WNTLNKLKWFGKTILMILSTRGAEG

SEQ ID NO: 3029645 - protein, 27 aa, Entamoeba invadens
WPKRVTFFLQLLLLRKINMVLVNHNVN

SEQ ID NO: 3029646 - protein, 18 aa, Entamoeba invadens
WPYAYMDKSIKYRGFFDV

SEQ ID NO: 3029647 - protein, 24 aa, Entamoeba invadens
WQLGCVFLQMLLRSPPFKGHSLSS

SEQ ID NO: 3029648 - protein, 33 aa, Entamoeba invadens
WQSKFLIPRTFLGKILRLLKILNKFPLFKNDDQ

SEQ ID NO: 3029649 - protein, 17 aa, Entamoeba invadens
WQYICKVIFYCLSYIHK

SEQ ID NO: 3029650 - protein, 19 aa, Entamoeba invadens
WRCFCEAFRYLPVSALIEG

SEQ ID NO: 3029651 - protein, 19 aa, Entamoeba invadens
WRFCLFLRKLCENIRVGRI

SEQ ID NO: 3029652 - protein, 18 aa, Entamoeba invadens
WRRFFNYIAKNDSYYVWE

SEQ ID NO: 3029653 - protein, 22 aa, Entamoeba invadens
WSFGILIYRLLVGRCPFQLLQM

SEQ ID NO: 3029654 - protein, 23 aa, Entamoeba invadens
WTFGILMYEILYGRTPFFNRNRD

SEQ ID NO: 3029655 - protein, 21 aa, Entamoeba invadens
WVNRRSWWHNPEMTEFVIFNF

SEQ ID NO: 3029656 - protein, 17 aa, Entamoeba invadens
WVRRLFGLPFLPKEEIH

SEQ ID NO: 3029657 - protein, 19 aa, Entamoeba invadens
WVYIVRRWFALKDNLCYKC

SEQ ID NO: 3029658 - protein, 17 aa, Entamoeba invadens
WVYLYYTGHPISWEFGY

SEQ ID NO: 3029659 - protein, 25 aa, Entamoeba invadens
YAEQLFAFVRKLLLNHYNYIFTRRV

SEQ ID NO: 3029660 - protein, 19 aa, Entamoeba invadens
YALTCLTLSTLYQALLCVS

SEQ ID NO: 3029661 - protein, 21 aa, Entamoeba invadens
YAMHMLYAGIPLKVLQSLMGH

SEQ ID NO: 3029662 - protein, 26 aa, Entamoeba invadens
YAMKLKLYIPFVLLKDKILFECSSEI

SEQ ID NO: 3029663 - protein, 23 aa, Entamoeba invadens
YAPTPFPLILSFIVSCKLQHTNP

SEQ ID NO: 3029664 - protein, 25 aa, Entamoeba invadens
YAQYQEIWLRGYWLIFAHDQIVRGK

SEQ ID NO: 3029665 - protein, 26 aa, Entamoeba invadens
YAQYQEIWLRGYWLIFAHDQIVRGKV

SEQ ID NO: 3029666 - protein, 21 aa, Entamoeba invadens
YASLLCQFGWKSFVPPSEKIQ

SEQ ID NO: 3029667 - protein, 18 aa, Entamoeba invadens
YCDLIQYKLFADEKMFLQ

SEQ ID NO: 3029668 - protein, 20 aa, Entamoeba invadens
YCFQYMFDYGGLKNALCGRQ

SEQ ID NO: 3029669 - protein, 17 aa, Entamoeba invadens
YCINFTQIVLPISLVDI

SEQ ID NO: 3029670 - protein, 20 aa, Entamoeba invadens
YCLPRLIFISLRWKLEMWDC

SEQ ID NO: 3029671 - protein, 17 aa, Entamoeba invadens
YCTGIPILFVGTGQHYT

SEQ ID NO: 3029672 - protein, 21 aa, Entamoeba invadens
YCYAYRILFDKVRIPPIITSI

SEQ ID NO: 3029673 - protein, 25 aa, Entamoeba invadens
YDFFGFIPHILLFVRGISPFFNQTP

SEQ ID NO: 3029674 - protein, 26 aa, Entamoeba invadens
YDIYFDITLQIVIYFLQIAGIDINVT

SEQ ID NO: 3029675 - protein, 23 aa, Entamoeba invadens
YDKERFRFPWKIAEFIMSGNRLE

SEQ ID NO: 3029676 - protein, 24 aa, Entamoeba invadens
YDQLRALSFPQTDIFLICFSVVSP

SEQ ID NO: 3029677 - protein, 24 aa, Entamoeba invadens
YDQLRALSYPQTDIFLICFSVVSP

SEQ ID NO: 3029678 - protein, 24 aa, Entamoeba invadens
YDRLRPLSYPGTSVFLLCFSVISP

SEQ ID NO: 3029679 - protein, 24 aa, Entamoeba invadens
YDRLRPLSYPQTDVFLICFSVVLP

SEQ ID NO: 3029680 - protein, 24 aa, Entamoeba invadens
YDRLRPLSYPSTDVFLLCFSVIAP

SEQ ID NO: 3029681 - protein, 23 aa, Entamoeba invadens
YDRNTLVAAYKLLNMSYQILLEM

SEQ ID NO: 3029682 - protein, 21 aa, Entamoeba invadens
YEDFFGFKFFNPPQTQFFFKC

SEQ ID NO: 3029683 - protein, 20 aa, Entamoeba invadens
YEFVGIYRFLEICYALFTEI

SEQ ID NO: 3029684 - protein, 23 aa, Entamoeba invadens
YEGDVMLSFIYTSAFFMSQEFTQ

SEQ ID NO: 3029685 - protein, 18 aa, Entamoeba invadens
YEKILKHAFYWFVPDDEE

SEQ ID NO: 3029686 - protein, 28 aa, Entamoeba invadens
YEKNWILGWPVLLWCQFNQMIRTVNLSE

SEQ ID NO: 3029687 - protein, 24 aa, Entamoeba invadens
YEKYSQELFKYIFGDTDVSTLNLP

SEQ ID NO: 3029688 - protein, 18 aa, Entamoeba invadens
YELIELPTLFRSNFIEIC

SEQ ID NO: 3029689 - protein, 21 aa, Entamoeba invadens
YELLQYHFLNFNKIIESVTKQ

SEQ ID NO: 3029690 - protein, 18 aa, Entamoeba invadens
YENFQILTKLFISPLRTL

SEQ ID NO: 3029691 - protein, 23 aa, Entamoeba invadens
YEQLRPLSYPNTDLFLLCFSVIS

SEQ ID NO: 3029692 - protein, 24 aa, Entamoeba invadens
YEQLRPLSYPNTDLFLLCFSVISR

SEQ ID NO: 3029693 - protein, 25 aa, Entamoeba invadens
YESEYLIEIFFWRLVKYKIDQQKNP

SEQ ID NO: 3029694 - protein, 24 aa, Entamoeba invadens
YESIRPLSYPSTDIFLLCFSVVQP

SEQ ID NO: 3029695 - protein, 24 aa, Entamoeba invadens
YEVGVGMFYLYIQNSMLDVALQTF

SEQ ID NO: 3029696 - protein, 22 aa, Entamoeba invadens
YFCLFKKIKFPITPLYQVISLV

SEQ ID NO: 3029697 - protein, 23 aa, Entamoeba invadens
YFEKKISLLPLSTPLYVLDAMLS

SEQ ID NO: 3029698 - protein, 17 aa, Entamoeba invadens
YFFDTILTNLRIPFLRE

SEQ ID NO: 3029699 - protein, 17 aa, Entamoeba invadens
YFINDVSIIWFVAHFSP

SEQ ID NO: 3029700 - protein, 19 aa, Entamoeba invadens
YFLQLPRRILQMYPLNVPF

SEQ ID NO: 3029701 - protein, 24 aa, Entamoeba invadens
YFQGNLRYLFLESLLDLGSFERKA

SEQ ID NO: 3029702 - protein, 17 aa, Entamoeba invadens
YFVIKNNFIFYFPSSQP

SEQ ID NO: 3029703 - protein, 24 aa, Entamoeba invadens
YGDPLKFFLVFTPTKFPWFNQEMM

SEQ ID NO: 3029704 - protein, 18 aa, Entamoeba invadens
YGESFLYYTLSNLVLHNF

SEQ ID NO: 3029705 - protein, 22 aa, Entamoeba invadens
YGKEVVIFLIVGPRLSGTDLET

SEQ ID NO: 3029706 - protein, 23 aa, Entamoeba invadens
YGRHQIRIFRLTETKFYRLDEAC

SEQ ID NO: 3029707 - protein, 20 aa, Entamoeba invadens
YGSYLILTLVLEGPAVSTFS

SEQ ID NO: 3029708 - protein, 17 aa, Entamoeba invadens
YGTKIMIYLINLSDIKS

SEQ ID NO: 3029709 - protein, 18 aa, Entamoeba invadens
YGTLIYEMLLGLPPFFDN

SEQ ID NO: 3029710 - protein, 24 aa, Entamoeba invadens
YGYSYIFPLIPIFLMNANTYDIFR

SEQ ID NO: 3029711 - protein, 22 aa, Entamoeba invadens
YHDFRIFGLYEWDQYIREGELF

SEQ ID NO: 3029712 - protein, 19 aa, Entamoeba invadens
YHPMFRSNLFRWLENLKYL

SEQ ID NO: 3029713 - protein, 18 aa, Entamoeba invadens
YHSRWRKRNVSPVKEIKS

SEQ ID NO: 3029714 - protein, 18 aa, Entamoeba invadens
YICLLLLSHFLGSLDFEY

SEQ ID NO: 3029715 - protein, 17 aa, Entamoeba invadens
YICNDNYYLANRILPEC

SEQ ID NO: 3029716 - protein, 24 aa, Entamoeba invadens
YIDVTPDFWLVFGDTTIAFVGRRL

SEQ ID NO: 3029717 - protein, 18 aa, Entamoeba invadens
YIFDLFPYEHIPIVLCGN

SEQ ID NO: 3029718 - protein, 17 aa, Entamoeba invadens
YIFQKPCICTYIDTLKA

SEQ ID NO: 3029719 - protein, 18 aa, Entamoeba invadens
YIHFTVVLPTKESLAQNV

SEQ ID NO: 3029720 - protein, 18 aa, Entamoeba invadens
YIIHFYGAVFIPKKICLV

SEQ ID NO: 3029721 - protein, 26 aa, Entamoeba invadens
YIIPKPLYFSVTPLFWNIARNSTFVC

SEQ ID NO: 3029722 - protein, 22 aa, Entamoeba invadens
YILGMVWMMILKYKINNVPKSD

SEQ ID NO: 3029723 - protein, 18 aa, Entamoeba invadens
YILLTNHFLIFDTMLQFS

SEQ ID NO: 3029724 - protein, 17 aa, Entamoeba invadens
YILPFTFYVDTKPVCAF

SEQ ID NO: 3029725 - protein, 24 aa, Entamoeba invadens
YIMDLMDYLLVVPLPIIHNYSSDR

SEQ ID NO: 3029726 - protein, 17 aa, Entamoeba invadens
YINIEFIPFLIASIQQQ

SEQ ID NO: 3029727 - protein, 18 aa, Entamoeba invadens
YIQLPYKLKVRMLFDTSR

SEQ ID NO: 3029728 - protein, 19 aa, Entamoeba invadens
YIRVLPVRNIAFVRYRMRG

SEQ ID NO: 3029729 - protein, 21 aa, Entamoeba invadens
YISPWKDQFPEWALLPKTSEE

SEQ ID NO: 3029730 - protein, 18 aa, Entamoeba invadens
YITIPPIKKIPKISEIKC

SEQ ID NO: 3029731 - protein, 28 aa, Entamoeba invadens
YITKLRLYIPFILLKDRLLIELSGEIER

SEQ ID NO: 3029732 - protein, 21 aa, Entamoeba invadens
YITLQEFLKFFLPPQDKNTVP

SEQ ID NO: 3029733 - protein, 17 aa, Entamoeba invadens
YITLWPKSFGLSFDQLK

SEQ ID NO: 3029734 - protein, 17 aa, Entamoeba invadens
YKFLAHVYKWVLILLAE

SEQ ID NO: 3029735 - protein, 21 aa, Entamoeba invadens
YKGIKVILIGYFKDASVSAGQ

SEQ ID NO: 3029736 - protein, 17 aa, Entamoeba invadens
YKKIMVFKNRKLQLLIY

SEQ ID NO: 3029737 - protein, 19 aa, Entamoeba invadens
YKLMELFITFKFSPTFLYF

SEQ ID NO: 3029738 - protein, 25 aa, Entamoeba invadens
YKRTPICIIVYFFVYCYSVNTNGIL

SEQ ID NO: 3029739 - protein, 22 aa, Entamoeba invadens
YKSGLFFRFHNSNLRAFCHCSQ

SEQ ID NO: 3029740 - protein, 26 aa, Entamoeba invadens
YKSIPMQLFYTISFKEKVEVIKFSPD

SEQ ID NO: 3029741 - protein, 20 aa, Entamoeba invadens
YKTRAFLFKNGVCKGFGFVD

SEQ ID NO: 3029742 - protein, 26 aa, Entamoeba invadens
YKYNKEVLLIYFFKMIQTVSQADLCI

SEQ ID NO: 3029743 - protein, 24 aa, Entamoeba invadens
YLADKKMIFFTKNGYYLLAVSYER

SEQ ID NO: 3029744 - protein, 26 aa, Entamoeba invadens
YLARPARLPFLSLLLDLPPDVSDIQQ

SEQ ID NO: 3029745 - protein, 24 aa, Entamoeba invadens
YLDPIPIHVLLALMIKKFAKRNVT

SEQ ID NO: 3029746 - protein, 19 aa, Entamoeba invadens
YLERLLLIPVDEERLRMVK

SEQ ID NO: 3029747 - protein, 17 aa, Entamoeba invadens
YLFPYRNWKYTPPEVDF

SEQ ID NO: 3029748 - protein, 17 aa, Entamoeba invadens
YLFSVPNFFVFKKKECK

SEQ ID NO: 3029749 - protein, 19 aa, Entamoeba invadens
YLGTFFPINAIFKSALLTK

SEQ ID NO: 3029750 - protein, 20 aa, Entamoeba invadens
YLGYNFLFNFFPHLNTLTGN

SEQ ID NO: 3029751 - protein, 19 aa, Entamoeba invadens
YLIKYPFMISNMLPRVVNV

SEQ ID NO: 3029752 - protein, 20 aa, Entamoeba invadens
YLLDILRICGFFFESTYPKK

SEQ ID NO: 3029753 - protein, 18 aa, Entamoeba invadens
YLLFVFQTSSRSVEISDY

SEQ ID NO: 3029754 - protein, 18 aa, Entamoeba invadens
YLLHPAYLREWKGARPFN

SEQ ID NO: 3029755 - protein, 17 aa, Entamoeba invadens
YLLLNHFYTLDSSLNYF

SEQ ID NO: 3029756 - protein, 24 aa, Entamoeba invadens
YLMRQREFFIFTKTAYYIKNIKPD

SEQ ID NO: 3029757 - protein, 25 aa, Entamoeba invadens
YLNGELYFIGIIDILMDYTTRKKLE

SEQ ID NO: 3029758 - protein, 17 aa, Entamoeba invadens
YLPPTYIEFLKGLKFDP

SEQ ID NO: 3029759 - protein, 24 aa, Entamoeba invadens
YLPRTFLVYFLLQHTFPKPSIQMD

SEQ ID NO: 3029760 - protein, 20 aa, Entamoeba invadens
YLQDLGVTIVWLNPIYASPD

SEQ ID NO: 3029761 - protein, 20 aa, Entamoeba invadens
YLRQFLLACFDRDINLRKTA

SEQ ID NO: 3029762 - protein, 17 aa, Entamoeba invadens
YLSAINRLKLATGSPIV

SEQ ID NO: 3029763 - protein, 18 aa, Entamoeba invadens
YLTLFKSFENLFSLGHSF

SEQ ID NO: 3029764 - protein, 20 aa, Entamoeba invadens
YLVIWNPLFLPKLGKKSHPP

SEQ ID NO: 3029765 - protein, 18 aa, Entamoeba invadens
YMDFPPMRALFLITTKGI

SEQ ID NO: 3029766 - protein, 18 aa, Entamoeba invadens
YMENLPKFFPKYTKTEFL

SEQ ID NO: 3029767 - protein, 17 aa, Entamoeba invadens
YMKITFSSMLLFLCQRA

SEQ ID NO: 3029768 - protein, 17 aa, Entamoeba invadens
YMKWKGREYLREAPTLT

SEQ ID NO: 3029769 - protein, 26 aa, Entamoeba invadens
YMQQKRIMMMWYLEPLFVLQDNNLDI

SEQ ID NO: 3029770 - protein, 19 aa, Entamoeba invadens
YMRNFIYFIPFFLKHREAY

SEQ ID NO: 3029771 - protein, 22 aa, Entamoeba invadens
YMVYDFLYSYCFPFLVYKQRIL

SEQ ID NO: 3029772 - protein, 17 aa, Entamoeba invadens
YNDRAYTLLKRISTPIS

SEQ ID NO: 3029773 - protein, 18 aa, Entamoeba invadens
YNINPFLFAFKNPKTHFR

SEQ ID NO: 3029774 - protein, 20 aa, Entamoeba invadens
YNNIFYNCTFGYYGDARGPY

SEQ ID NO: 3029775 - protein, 17 aa, Entamoeba invadens
YNPIQFLQLQNSYYPKL

SEQ ID NO: 3029776 - protein, 23 aa, Entamoeba invadens
YNSLRPLSYPQTDIFLLCFSVVY

SEQ ID NO: 3029777 - protein, 19 aa, Entamoeba invadens
YNTIWEHYFMLFCFERGFE

SEQ ID NO: 3029778 - protein, 24 aa, Entamoeba invadens
YNYNTFYYIISFLRELLFHSEKNG

SEQ ID NO: 3029779 - protein, 22 aa, Entamoeba invadens
YPAALILFQLLVNATLTQLVKG

SEQ ID NO: 3029780 - protein, 25 aa, Entamoeba invadens
YPELYKKFGIYTPAGILLYGPPGCG

SEQ ID NO: 3029781 - protein, 18 aa, Entamoeba invadens
YPFCRPTPLTLPKHNYNI

SEQ ID NO: 3029782 - protein, 19 aa, Entamoeba invadens
YPFMYNPIQQPPPPPVALP

SEQ ID NO: 3029783 - protein, 24 aa, Entamoeba invadens
YPIDVLKCLPVFKIKRVPYGEIVW

SEQ ID NO: 3029784 - protein, 24 aa, Entamoeba invadens
YPNRIIYNEFLKRYFFLGTNINKK

SEQ ID NO: 3029785 - protein, 17 aa, Entamoeba invadens
YPTLPYEYAMRALNKFK

SEQ ID NO: 3029786 - protein, 18 aa, Entamoeba invadens
YPVIIFNIGFYLPDDFVN

SEQ ID NO: 3029787 - protein, 24 aa, Entamoeba invadens
YPVTFYLESPLIWFKEKRLKMLED

SEQ ID NO: 3029788 - protein, 18 aa, Entamoeba invadens
YQHHNFLKFLLQVRYAFP

SEQ ID NO: 3029789 - protein, 25 aa, Entamoeba invadens
YQHNALYWKVWLYRSETKRVYKVLS

SEQ ID NO: 3029790 - protein, 22 aa, Entamoeba invadens
YQKMFFMYKFTVYSVSFGQWES

SEQ ID NO: 3029791 - protein, 17 aa, Entamoeba invadens
YQLCGVLIYIFHKKALT

SEQ ID NO: 3029792 - protein, 18 aa, Entamoeba invadens
YQLKFNVLVRLLDNFYQF

SEQ ID NO: 3029793 - protein, 22 aa, Entamoeba invadens
YQPFANPGLFKWKYMTHWTIDY

SEQ ID NO: 3029794 - protein, 19 aa, Entamoeba invadens
YQVFEQGMLLLLLNNVFTL

SEQ ID NO: 3029795 - protein, 22 aa, Entamoeba invadens
YRDMTQCLLFPSPYFQITPSQV

SEQ ID NO: 3029796 - protein, 19 aa, Entamoeba invadens
YRDTIRVWIRMTCYSVKYD

SEQ ID NO: 3029797 - protein, 20 aa, Entamoeba invadens
YRDTPTFRRSVIGFFVKVVS

SEQ ID NO: 3029798 - protein, 18 aa, Entamoeba invadens
YRELGMLKGLFKVATVGA

SEQ ID NO: 3029799 - protein, 19 aa, Entamoeba invadens
YRIDHILGFFRIWSIPAGH

SEQ ID NO: 3029800 - protein, 22 aa, Entamoeba invadens
YRKIWLDWYVYYCGKLGSVPND

SEQ ID NO: 3029801 - protein, 21 aa, Entamoeba invadens
YRKVLVTTPWYFDCHIRISYH

SEQ ID NO: 3029802 - protein, 29 aa, Entamoeba invadens
YRLHGKLPQLFWWAFRRQIMINDKGELLF

SEQ ID NO: 3029803 - protein, 23 aa, Entamoeba invadens
YRNFDTLLCILLLFGTSAIHRLK

SEQ ID NO: 3029804 - protein, 24 aa, Entamoeba invadens
YRNPEILAFIRKLNVRYLAIGEKE

SEQ ID NO: 3029805 - protein, 24 aa, Entamoeba invadens
YRNSWYVFYVLFVIDDMTIINRLF

SEQ ID NO: 3029806 - protein, 21 aa, Entamoeba invadens
YRQYQMLTDGFLKILFAVEPT

SEQ ID NO: 3029807 - protein, 17 aa, Entamoeba invadens
YRTTFRSPLRKLFDICV

SEQ ID NO: 3029808 - protein, 19 aa, Entamoeba invadens
YRVPFKQVYFFDTFNCFVS

SEQ ID NO: 3029809 - protein, 17 aa, Entamoeba invadens
YRVRSVFGMYLVASSDG

SEQ ID NO: 3029810 - protein, 21 aa, Entamoeba invadens
YRWMLPVLEQPLTFVYPKSTP

SEQ ID NO: 3029811 - protein, 26 aa, Entamoeba invadens
YSAGVVLYYLLYGKLPFLCETEKELL

SEQ ID NO: 3029812 - protein, 25 aa, Entamoeba invadens
YSATQLRLLFLLQSWDTVINFSDTA

SEQ ID NO: 3029813 - protein, 24 aa, Entamoeba invadens
YSFCFRWIVLLFKRDFETKLCLQV

SEQ ID NO: 3029814 - protein, 17 aa, Entamoeba invadens
YSFTRWFWISRNITEII

SEQ ID NO: 3029815 - protein, 25 aa, Entamoeba invadens
YSFVYKWIVLLFRRDFTPKKCKRIW

SEQ ID NO: 3029816 - protein, 20 aa, Entamoeba invadens
YSGIKFILQIKGRPYYYASH

SEQ ID NO: 3029817 - protein, 18 aa, Entamoeba invadens
YSHTFGHFVLLRTPIFYY

SEQ ID NO: 3029818 - protein, 24 aa, Entamoeba invadens
YSLEKLMSLITFSGAIFQSVKKPF

SEQ ID NO: 3029819 - protein, 17 aa, Entamoeba invadens
YSLFLYYAKRRINPFIK

SEQ ID NO: 3029820 - protein, 26 aa, Entamoeba invadens
YSMQLYYYHLILWPTTTFVAVNKEGK

SEQ ID NO: 3029821 - protein, 21 aa, Entamoeba invadens
YSPCDDFFPEKAFFQKIVHYK

SEQ ID NO: 3029822 - protein, 20 aa, Entamoeba invadens
YSPPWSVQFPEWSKLPLTSD

SEQ ID NO: 3029823 - protein, 20 aa, Entamoeba invadens
YSQFLFTEQIFKLVFSVIVE

SEQ ID NO: 3029824 - protein, 26 aa, Entamoeba invadens
YSSDYLYIVLSTFLLEIYKNGELLKK

SEQ ID NO: 3029825 - protein, 17 aa, Entamoeba invadens
YSTFLRIINKFLSTYED

SEQ ID NO: 3029826 - protein, 18 aa, Entamoeba invadens
YTFKLIRLIFDDLVDIHK

SEQ ID NO: 3029827 - protein, 19 aa, Entamoeba invadens
YTKIHFFPEITEEAKLVIQ

SEQ ID NO: 3029828 - protein, 21 aa, Entamoeba invadens
YTLFIGGLPPKFDVAALKKLF

SEQ ID NO: 3029829 - protein, 17 aa, Entamoeba invadens
YTLLLTNLPHKRLRDVA

SEQ ID NO: 3029830 - protein, 17 aa, Entamoeba invadens
YTLYFKKLKLFLNNIKI

SEQ ID NO: 3029831 - protein, 20 aa, Entamoeba invadens
YTRVLTRTMFALGFKDFDAL

SEQ ID NO: 3029832 - protein, 25 aa, Entamoeba invadens
YTYEKVIFDFWQSKRLYLFKQIEKC

SEQ ID NO: 3029833 - protein, 30 aa, Entamoeba invadens
YVDFKNYLLPLFPLKYLKTGSLLRGYIADV

SEQ ID NO: 3029834 - protein, 18 aa, Entamoeba invadens
YVEMVYSFFDLKFTDLPV

SEQ ID NO: 3029835 - protein, 26 aa, Entamoeba invadens
YVHGIFHLKLWRLLTVVLFAIQDALL

SEQ ID NO: 3029836 - protein, 20 aa, Entamoeba invadens
YVILMKFVCFKLYNTAGLVY

SEQ ID NO: 3029837 - protein, 18 aa, Entamoeba invadens
YVIRFYGASFIPNRICMV

SEQ ID NO: 3029838 - protein, 18 aa, Entamoeba invadens
YVIYHELLLTSNSYMRCV

SEQ ID NO: 3029839 - protein, 20 aa, Entamoeba invadens
YVKRWVAMSGPFLGAAKTIA

SEQ ID NO: 3029840 - protein, 30 aa, Entamoeba invadens
YVKYLELRFVFIIKFPFFDGALKIAKKVPE

SEQ ID NO: 3029841 - protein, 18 aa, Entamoeba invadens
YVMYFVNGLLVFCNAQAF

SEQ ID NO: 3029842 - protein, 17 aa, Entamoeba invadens
YVPFMKRVIPVLFRIAS

SEQ ID NO: 3029843 - protein, 20 aa, Entamoeba invadens
YVQLYVKFFVKVRNAMLVVD

SEQ ID NO: 3029844 - protein, 25 aa, Entamoeba invadens
YVRLRYLLRVVILAKSPIFPVEYEF

SEQ ID NO: 3029845 - protein, 21 aa, Entamoeba invadens
YVTAYIILYIDIRYVKYIIKK

SEQ ID NO: 3029846 - protein, 20 aa, Entamoeba invadens
YVVYFFFPQPLSTTQIKFFE

SEQ ID NO: 3029847 - protein, 18 aa, Entamoeba invadens
YVYLLTKYVPLIKESIRG

SEQ ID NO: 3029848 - protein, 23 aa, Entamoeba invadens
YWEQQLRVLQPSESLLRVASKPA

SEQ ID NO: 3029849 - protein, 18 aa, Entamoeba invadens
YYCINFSQIVLPISLVDI

SEQ ID NO: 3029850 - protein, 20 aa, Entamoeba invadens
YYDLYRSFSLYFFKDKTLDK

SEQ ID NO: 3029851 - protein, 18 aa, Entamoeba invadens
YYDNLILFLTFSLDVSLY

SEQ ID NO: 3029852 - protein, 24 aa, Entamoeba invadens
YYEDVILLILIIEKLTNHMDIHFM

SEQ ID NO: 3029853 - protein, 17 aa, Entamoeba invadens
YYFMMSRIIPKCFQLKG

SEQ ID NO: 3029854 - protein, 18 aa, Entamoeba invadens
YYFRGDLPLFFYMNPFFG

SEQ ID NO: 3029855 - protein, 24 aa, Entamoeba invadens
YYFRGDLPLFFYMNPFFGDQNTPL

SEQ ID NO: 3029856 - protein, 22 aa, Entamoeba invadens
YYQRLVFLYKSRKFRKGVNKSF

SEQ ID NO: 3029857 - protein, 19 aa, Entamoeba invadens
YYSLEQLLMPLPLPKRYGT

SEQ ID NO: 3029858 - protein, 25 aa, Entamoeba invadens
YYTIQLPYLFPGVQLTYIVKLPTSE

SEQ ID NO: 3029859 - protein, 17 aa, Entamoeba invadens
YYTTYMNIYLPLKTFYE

SEQ ID NO: 3029860 - protein, 14 aa, Entamoeba invadens
ANLPSNYQKGQKGG

SEQ ID NO: 3029861 - protein, 9 aa, Entamoeba invadens
GVASDSEVY

SEQ ID NO: 3029862 - protein, 8 aa, Entamoeba invadens
KETLPTED

SEQ ID NO: 3029863 - protein, 6 aa, Entamoeba invadens
KNKNMK

SEQ ID NO: 3029864 - protein, 8 aa, Entamoeba invadens
TGDSTTSV

SEQ ID NO: 3029865 - protein, 7 aa, Entamoeba invadens
TSPKTYN

SEQ ID NO: 3029866 - protein, 5 aa, Entamoeba invadens
VNPKY

SEQ ID NO: 3029867 - protein, 7 aa, Entamoeba invadens
AENNVAN

SEQ ID NO: 3029868 - protein, 6 aa, Entamoeba invadens
AKQHNL

SEQ ID NO: 3029869 - protein, 42 aa, Entamoeba invadens
CSDSKSQENLKNAANNAGHSEWGHNPTNAGQYNYKPPTSTGF

SEQ ID NO: 3029870 - protein, 4 aa, Entamoeba invadens
DGTA

SEQ ID NO: 3029871 - protein, 5 aa, Entamoeba invadens
DGTLN

SEQ ID NO: 3029872 - protein, 6 aa, Entamoeba invadens
DQPQDN

SEQ ID NO: 3029873 - protein, 9 aa, Entamoeba invadens
GAGASGIRM

SEQ ID NO: 3029874 - protein, 7 aa, Entamoeba invadens
GCNTNGF

SEQ ID NO: 3029875 - protein, 7 aa, Entamoeba invadens
GGNVGDS

SEQ ID NO: 3029876 - protein, 11 aa, Entamoeba invadens
GNGNDNYQSEY

SEQ ID NO: 3029877 - protein, 16 aa, Entamoeba invadens
IKTSETTSTKTEIKDG

SEQ ID NO: 3029878 - protein, 8 aa, Entamoeba invadens
IQDKDRSH

SEQ ID NO: 3029879 - protein, 8 aa, Entamoeba invadens
KIKSAGVA

SEQ ID NO: 3029880 - protein, 15 aa, Entamoeba invadens
LNAASSVGIGKCGEN

SEQ ID NO: 3029881 - protein, 5 aa, Entamoeba invadens
LPEYS

SEQ ID NO: 3029882 - protein, 8 aa, Entamoeba invadens
NAGASNDA

SEQ ID NO: 3029883 - protein, 6 aa, Entamoeba invadens
NDDLNN

SEQ ID NO: 3029884 - protein, 14 aa, Entamoeba invadens
NSNGVNNQGQLQND

SEQ ID NO: 3029885 - protein, 11 aa, Entamoeba invadens
PCGETRYPSYP

SEQ ID NO: 3029886 - protein, 6 aa, Entamoeba invadens
SGGGND

SEQ ID NO: 3029887 - protein, 14 aa, Entamoeba invadens
SGTDSNCGSQPANL

SEQ ID NO: 3029888 - protein, 7 aa, Entamoeba invadens
SHAAEMT

SEQ ID NO: 3029889 - protein, 9 aa, Entamoeba invadens
SRMGTRAQY

SEQ ID NO: 3029890 - protein, 4 aa, Entamoeba invadens
TDRN

SEQ ID NO: 3029891 - protein, 10 aa, Entamoeba invadens
YTSTARTAAT

SEQ ID NO: 3029892 - protein, 18 aa, Entamoeba invadens
YYNSNGNDAYKTLSNTFK

SEQ ID NO: 3029893 - protein, 6 aa, Entamoeba invadens
ASGGYG

SEQ ID NO: 3029894 - protein, 5 aa, Entamoeba invadens
ASRAS

SEQ ID NO: 3029895 - protein, 4 aa, Entamoeba invadens
ATYG

SEQ ID NO: 3029896 - protein, 27 aa, Entamoeba invadens
CEDGSESCDSTIPPPFPPKDGSDVPFG

SEQ ID NO: 3029897 - protein, 7 aa, Entamoeba invadens
DATGYTV

SEQ ID NO: 3029898 - protein, 12 aa, Entamoeba invadens
DESETCTGTPTN

SEQ ID NO: 3029899 - protein, 4 aa, Entamoeba invadens
FDTS

SEQ ID NO: 3029900 - protein, 7 aa, Entamoeba invadens
FGSTTKK

SEQ ID NO: 3029901 - protein, 4 aa, Entamoeba invadens
FYHT

SEQ ID NO: 3029902 - protein, 7 aa, Entamoeba invadens
GIGTPKY

SEQ ID NO: 3029903 - protein, 19 aa, Entamoeba invadens
GTDKYTGKINTAEYPGSAY

SEQ ID NO: 3029904 - protein, 6 aa, Entamoeba invadens
GTSWGD

SEQ ID NO: 3029905 - protein, 6 aa, Entamoeba invadens
KDSAVT

SEQ ID NO: 3029906 - protein, 11 aa, Entamoeba invadens
KIKESEARPIE

SEQ ID NO: 3029907 - protein, 9 aa, Entamoeba invadens
KLTDFGSAR

SEQ ID NO: 3029908 - protein, 18 aa, Entamoeba invadens
KNDYDASNSCTGTPSNII

SEQ ID NO: 3029909 - protein, 8 aa, Entamoeba invadens
KSIPKRDA

SEQ ID NO: 3029910 - protein, 7 aa, Entamoeba invadens
KVDGSNK

SEQ ID NO: 3029911 - protein, 8 aa, Entamoeba invadens
LATENDYV

SEQ ID NO: 3029912 - protein, 6 aa, Entamoeba invadens
NEETEY

SEQ ID NO: 3029913 - protein, 7 aa, Entamoeba invadens
NSIDPNC

SEQ ID NO: 3029914 - protein, 9 aa, Entamoeba invadens
NTCSSTERK

SEQ ID NO: 3029915 - protein, 14 aa, Entamoeba invadens
QDGLNGNDGFPDGL

SEQ ID NO: 3029916 - protein, 11 aa, Entamoeba invadens
QVSTRNQDRNY

SEQ ID NO: 3029917 - protein, 11 aa, Entamoeba invadens
RGSDYTRTHRD

SEQ ID NO: 3029918 - protein, 4 aa, Entamoeba invadens
RVNK

SEQ ID NO: 3029919 - protein, 7 aa, Entamoeba invadens
SQTCEGL

SEQ ID NO: 3029920 - protein, 21 aa, Entamoeba invadens
SRKEASKEAKKAIKKPLRKSM

SEQ ID NO: 3029921 - protein, 9 aa, Entamoeba invadens
TGGNTYTKY

SEQ ID NO: 3029922 - protein, 5 aa, Entamoeba invadens
TIYND

SEQ ID NO: 3029923 - protein, 15 aa, Entamoeba invadens
TKCTSGMYPSTTSPF

SEQ ID NO: 3029924 - protein, 4 aa, Entamoeba invadens
TTTN

SEQ ID NO: 3029925 - protein, 8 aa, Entamoeba invadens
VENTANTE

SEQ ID NO: 3029926 - protein, 7 aa, Entamoeba invadens
VKDDGSY

SEQ ID NO: 3029927 - protein, 13 aa, Entamoeba invadens
VKTSETSSSKSEF

SEQ ID NO: 3029928 - protein, 6 aa, Entamoeba invadens
YPPQDG

SEQ ID NO: 3029929 - protein, 16 aa, Entamoeba invadens
YTTPDCTGTPKTSSNC

SEQ ID NO: 3029930 - protein, 9 aa, Entamoeba invadens
YYSSGGTSL

SEQ ID NO: 3029931 - protein, 15 aa, Entamoeba invadens
AASYSKDKIDDEGNK

SEQ ID NO: 3029932 - protein, 14 aa, Entamoeba invadens
AEEIAKREAAEKAL

SEQ ID NO: 3029933 - protein, 9 aa, Entamoeba invadens
AEKLSGGRS

SEQ ID NO: 3029934 - protein, 9 aa, Entamoeba invadens
AEKQTSRAA

SEQ ID NO: 3029935 - protein, 6 aa, Entamoeba invadens
AENRTI

SEQ ID NO: 3029936 - protein, 12 aa, Entamoeba invadens
AGTATNKDTNTC

SEQ ID NO: 3029937 - protein, 9 aa, Entamoeba invadens
AKAFKGATK

SEQ ID NO: 3029938 - protein, 8 aa, Entamoeba invadens
AKGCSKCD

SEQ ID NO: 3029939 - protein, 7 aa, Entamoeba invadens
AKTNTIL

SEQ ID NO: 3029940 - protein, 16 aa, Entamoeba invadens
AKYSSKKPNRKAQNVV

SEQ ID NO: 3029941 - protein, 8 aa, Entamoeba invadens
ANKRNEKQ

SEQ ID NO: 3029942 - protein, 10 aa, Entamoeba invadens
ANPGHRPLTN

SEQ ID NO: 3029943 - protein, 14 aa, Entamoeba invadens
ANVAVRTNNKLTTQ

SEQ ID NO: 3029944 - protein, 9 aa, Entamoeba invadens
APAGPKNIE

SEQ ID NO: 3029945 - protein, 5 aa, Entamoeba invadens
APLGE

SEQ ID NO: 3029946 - protein, 7 aa, Entamoeba invadens
ARGEGST

SEQ ID NO: 3029947 - protein, 11 aa, Entamoeba invadens
ATNHKAYANKA

SEQ ID NO: 3029948 - protein, 11 aa, Entamoeba invadens
AYSGSSCTKCE

SEQ ID NO: 3029949 - protein, 14 aa, Entamoeba invadens
CDAQTGECTSCQPG

SEQ ID NO: 3029950 - protein, 13 aa, Entamoeba invadens
CEESGKGGYDASN

SEQ ID NO: 3029951 - protein, 13 aa, Entamoeba invadens
CGRGTYSSSGSAY

SEQ ID NO: 3029952 - protein, 11 aa, Entamoeba invadens
CHESDEDDGGI

SEQ ID NO: 3029953 - protein, 12 aa, Entamoeba invadens
CKGEQEKPYDTD

SEQ ID NO: 3029954 - protein, 12 aa, Entamoeba invadens
CKIKESDARPIE

SEQ ID NO: 3029955 - protein, 5 aa, Entamoeba invadens
CKQCP

SEQ ID NO: 3029956 - protein, 6 aa, Entamoeba invadens
CNGENG

SEQ ID NO: 3029957 - protein, 36 aa, Entamoeba invadens
CPSGTYSYGENKSSCTPCPEGTYSVGGSGTCTQCTN

SEQ ID NO: 3029958 - protein, 11 aa, Entamoeba invadens
CPYTSKSPDIN

SEQ ID NO: 3029959 - protein, 4 aa, Entamoeba invadens
CSKG

SEQ ID NO: 3029960 - protein, 5 aa, Entamoeba invadens
CTECP

SEQ ID NO: 3029961 - protein, 9 aa, Entamoeba invadens
DANTCTGCN

SEQ ID NO: 3029962 - protein, 8 aa, Entamoeba invadens
DDVTGSHT

SEQ ID NO: 3029963 - protein, 5 aa, Entamoeba invadens
DEIEE

SEQ ID NO: 3029964 - protein, 4 aa, Entamoeba invadens
DGNA

SEQ ID NO: 3029965 - protein, 9 aa, Entamoeba invadens
DGNLDGPFQ

SEQ ID NO: 3029966 - protein, 8 aa, Entamoeba invadens
DKDKKSVS

SEQ ID NO: 3029967 - protein, 8 aa, Entamoeba invadens
DKKYSRCG

SEQ ID NO: 3029968 - protein, 9 aa, Entamoeba invadens
DKNKGCELG

SEQ ID NO: 3029969 - protein, 9 aa, Entamoeba invadens
DLESTRQVP

SEQ ID NO: 3029970 - protein, 11 aa, Entamoeba invadens
DPIELDSDQSF

SEQ ID NO: 3029971 - protein, 11 aa, Entamoeba invadens
DQTNGKCTSCY

SEQ ID NO: 3029972 - protein, 5 aa, Entamoeba invadens
DQVPS

SEQ ID NO: 3029973 - protein, 8 aa, Entamoeba invadens
DRSPAGCH

SEQ ID NO: 3029974 - protein, 5 aa, Entamoeba invadens
DTESC

SEQ ID NO: 3029975 - protein, 16 aa, Entamoeba invadens
DTKGTETDSYENSASS

SEQ ID NO: 3029976 - protein, 15 aa, Entamoeba invadens
DTTDNGCSGGHPDNS

SEQ ID NO: 3029977 - protein, 10 aa, Entamoeba invadens
DTTGRCNECN

SEQ ID NO: 3029978 - protein, 4 aa, Entamoeba invadens
DVNQ

SEQ ID NO: 3029979 - protein, 14 aa, Entamoeba invadens
DYKYTATETTCAYD

SEQ ID NO: 3029980 - protein, 10 aa, Entamoeba invadens
EAGKPYPIAT

SEQ ID NO: 3029981 - protein, 11 aa, Entamoeba invadens
EARSNKRKEIR

SEQ ID NO: 3029982 - protein, 16 aa, Entamoeba invadens
ECGSSCEKCEKTNGNC

SEQ ID NO: 3029983 - protein, 7 aa, Entamoeba invadens
ECYQGED

SEQ ID NO: 3029984 - protein, 7 aa, Entamoeba invadens
EDDQTPV

SEQ ID NO: 3029985 - protein, 4 aa, Entamoeba invadens
EDTT

SEQ ID NO: 3029986 - protein, 12 aa, Entamoeba invadens
EEATADGVETKD

SEQ ID NO: 3029987 - protein, 14 aa, Entamoeba invadens
EEENKNKNDEIEKM

SEQ ID NO: 3029988 - protein, 7 aa, Entamoeba invadens
EGKIEKG

SEQ ID NO: 3029989 - protein, 12 aa, Entamoeba invadens
EGKYTSNSGSTI

SEQ ID NO: 3029990 - protein, 7 aa, Entamoeba invadens
EKCSPGY

SEQ ID NO: 3029991 - protein, 5 aa, Entamoeba invadens
EKNEN

SEQ ID NO: 3029992 - protein, 21 aa, Entamoeba invadens
EKSKEKSEIKSTDKGEIPDCK

SEQ ID NO: 3029993 - protein, 27 aa, Entamoeba invadens
EKTTESSKAKSVEKPVVSEENELKCKE

SEQ ID NO: 3029994 - protein, 4 aa, Entamoeba invadens
EKVN

SEQ ID NO: 3029995 - protein, 7 aa, Entamoeba invadens
ELKVEPN

SEQ ID NO: 3029996 - protein, 15 aa, Entamoeba invadens
ELNSVNQEKEKLGAE

SEQ ID NO: 3029997 - protein, 5 aa, Entamoeba invadens
ELTTD

SEQ ID NO: 3029998 - protein, 6 aa, Entamoeba invadens
ENENIT

SEQ ID NO: 3029999 - protein, 7 aa, Entamoeba invadens
ENREGIR

SEQ ID NO: 3030000 - protein, 9 aa, Entamoeba invadens
ENRTKEDNL

SEQ ID NO: 3030001 - protein, 10 aa, Entamoeba invadens
EPAHKKLSTS

SEQ ID NO: 3030002 - protein, 8 aa, Entamoeba invadens
EQPATRLR

SEQ ID NO: 3030003 - protein, 17 aa, Entamoeba invadens
EQTLPTVQQPQTQQPGI

SEQ ID NO: 3030004 - protein, 4 aa, Entamoeba invadens
ERNG

SEQ ID NO: 3030005 - protein, 4 aa, Entamoeba invadens
ESEI

SEQ ID NO: 3030006 - protein, 6 aa, Entamoeba invadens
ESKERK

SEQ ID NO: 3030007 - protein, 10 aa, Entamoeba invadens
ETCDGTTTCL

SEQ ID NO: 3030008 - protein, 10 aa, Entamoeba invadens
EVTYSSSNDN

SEQ ID NO: 3030009 - protein, 22 aa, Entamoeba invadens
EYNKQHPKPIANTTKNNKNEYY

SEQ ID NO: 3030010 - protein, 6 aa, Entamoeba invadens
EYPPKS

SEQ ID NO: 3030011 - protein, 7 aa, Entamoeba invadens
FEDNPYG

SEQ ID NO: 3030012 - protein, 10 aa, Entamoeba invadens
FGESSFTKTA

SEQ ID NO: 3030013 - protein, 23 aa, Entamoeba invadens
FQDGDPNKGYGTGYGPSSHKGDL

SEQ ID NO: 3030014 - protein, 4 aa, Entamoeba invadens
FSEV

SEQ ID NO: 3030015 - protein, 9 aa, Entamoeba invadens
FSGGDGPVD

SEQ ID NO: 3030016 - protein, 9 aa, Entamoeba invadens
FSKCPPGTI

SEQ ID NO: 3030017 - protein, 10 aa, Entamoeba invadens
FSSTKGETTC

SEQ ID NO: 3030018 - protein, 8 aa, Entamoeba invadens
FTSGGKRL

SEQ ID NO: 3030019 - protein, 7 aa, Entamoeba invadens
FTSPDKI

SEQ ID NO: 3030020 - protein, 7 aa, Entamoeba invadens
GAVGKSA

SEQ ID NO: 3030021 - protein, 5 aa, Entamoeba invadens
GDEQL

SEQ ID NO: 3030022 - protein, 9 aa, Entamoeba invadens
GEAKPGETR

SEQ ID NO: 3030023 - protein, 6 aa, Entamoeba invadens
GECEEC

SEQ ID NO: 3030024 - protein, 22 aa, Entamoeba invadens
GGCKTTGPKHFKADGKVSESVT

SEQ ID NO: 3030025 - protein, 6 aa, Entamoeba invadens
GGNVGD

SEQ ID NO: 3030026 - protein, 9 aa, Entamoeba invadens
GKASGVRRR

SEQ ID NO: 3030027 - protein, 5 aa, Entamoeba invadens
GKGKF

SEQ ID NO: 3030028 - protein, 4 aa, Entamoeba invadens
GKHD

SEQ ID NO: 3030029 - protein, 6 aa, Entamoeba invadens
GKLNGE

SEQ ID NO: 3030030 - protein, 7 aa, Entamoeba invadens
GKNTDGE

SEQ ID NO: 3030031 - protein, 7 aa, Entamoeba invadens
GPPVSKG

SEQ ID NO: 3030032 - protein, 14 aa, Entamoeba invadens
GQKSIAQGDEAALT

SEQ ID NO: 3030033 - protein, 21 aa, Entamoeba invadens
GQPGTPDKPKHAKEKDEQHFP

SEQ ID NO: 3030034 - protein, 6 aa, Entamoeba invadens
GQPRDL

SEQ ID NO: 3030035 - protein, 4 aa, Entamoeba invadens
GTES

SEQ ID NO: 3030036 - protein, 9 aa, Entamoeba invadens
GVNEGTSTL

SEQ ID NO: 3030037 - protein, 7 aa, Entamoeba invadens
GVQDGSD

SEQ ID NO: 3030038 - protein, 8 aa, Entamoeba invadens
GYYSTGGK

SEQ ID NO: 3030039 - protein, 14 aa, Entamoeba invadens
HDDGSFDLKNGQSF

SEQ ID NO: 3030040 - protein, 6 aa, Entamoeba invadens
HDTTLT

SEQ ID NO: 3030041 - protein, 4 aa, Entamoeba invadens
HKDA

SEQ ID NO: 3030042 - protein, 12 aa, Entamoeba invadens
HKFKKAAKHAYN

SEQ ID NO: 3030043 - protein, 27 aa, Entamoeba invadens
HKGGNVAASPSGKYPSGGSDPVSYPGS

SEQ ID NO: 3030044 - protein, 4 aa, Entamoeba invadens
HNDQ

SEQ ID NO: 3030045 - protein, 6 aa, Entamoeba invadens
HNKNHE

SEQ ID NO: 3030046 - protein, 20 aa, Entamoeba invadens
HNTNQSKYSHAKQHKESVED

SEQ ID NO: 3030047 - protein, 24 aa, Entamoeba invadens
HPHDDNSTAPFEGSMDSRVPAPFP

SEQ ID NO: 3030048 - protein, 7 aa, Entamoeba invadens
IAGPQTI

SEQ ID NO: 3030049 - protein, 5 aa, Entamoeba invadens
IDTNA

SEQ ID NO: 3030050 - protein, 5 aa, Entamoeba invadens
IEDTE

SEQ ID NO: 3030051 - protein, 16 aa, Entamoeba invadens
IESTCDSRKGQGKTWG

SEQ ID NO: 3030052 - protein, 11 aa, Entamoeba invadens
IGENKSESENI

SEQ ID NO: 3030053 - protein, 5 aa, Entamoeba invadens
IKEST

SEQ ID NO: 3030054 - protein, 8 aa, Entamoeba invadens
IKGSGPYP

SEQ ID NO: 3030055 - protein, 11 aa, Entamoeba invadens
IPEKADNWGHD

SEQ ID NO: 3030056 - protein, 16 aa, Entamoeba invadens
IRTGDGSKKVTYDGVS

SEQ ID NO: 3030057 - protein, 4 aa, Entamoeba invadens
ITPY

SEQ ID NO: 3030058 - protein, 5 aa, Entamoeba invadens
IVKQP

SEQ ID NO: 3030059 - protein, 6 aa, Entamoeba invadens
KALSSQ

SEQ ID NO: 3030060 - protein, 9 aa, Entamoeba invadens
KALYTRGTG

SEQ ID NO: 3030061 - protein, 18 aa, Entamoeba invadens
KASAEDSRWQTPPRGSAD

SEQ ID NO: 3030062 - protein, 4 aa, Entamoeba invadens
KCET

SEQ ID NO: 3030063 - protein, 7 aa, Entamoeba invadens
KCSTTQK

SEQ ID NO: 3030064 - protein, 11 aa, Entamoeba invadens
KDGKKEATSIT

SEQ ID NO: 3030065 - protein, 7 aa, Entamoeba invadens
KDINKHR

SEQ ID NO: 3030066 - protein, 6 aa, Entamoeba invadens
KDINRH

SEQ ID NO: 3030067 - protein, 5 aa, Entamoeba invadens
KDTFE

SEQ ID NO: 3030068 - protein, 9 aa, Entamoeba invadens
KDTTDTNGV

SEQ ID NO: 3030069 - protein, 7 aa, Entamoeba invadens
KESGTCK

SEQ ID NO: 3030070 - protein, 4 aa, Entamoeba invadens
KGKY

SEQ ID NO: 3030071 - protein, 7 aa, Entamoeba invadens
KGSGPYP

SEQ ID NO: 3030072 - protein, 12 aa, Entamoeba invadens
KGSRQNQNASGA

SEQ ID NO: 3030073 - protein, 5 aa, Entamoeba invadens
KHDNE

SEQ ID NO: 3030074 - protein, 7 aa, Entamoeba invadens
KKDDERF

SEQ ID NO: 3030075 - protein, 7 aa, Entamoeba invadens
KKNNPRD

SEQ ID NO: 3030076 - protein, 6 aa, Entamoeba invadens
KKNSNI

SEQ ID NO: 3030077 - protein, 7 aa, Entamoeba invadens
KKSDEVD

SEQ ID NO: 3030078 - protein, 4 aa, Entamoeba invadens
KKSI

SEQ ID NO: 3030079 - protein, 13 aa, Entamoeba invadens
KNIEDKEGEISDL

SEQ ID NO: 3030080 - protein, 8 aa, Entamoeba invadens
KPAERERT

SEQ ID NO: 3030081 - protein, 4 aa, Entamoeba invadens
KREQ

SEQ ID NO: 3030082 - protein, 7 aa, Entamoeba invadens
KSATKDC

SEQ ID NO: 3030083 - protein, 7 aa, Entamoeba invadens
KSLGDEA

SEQ ID NO: 3030084 - protein, 4 aa, Entamoeba invadens
KSRV

SEQ ID NO: 3030085 - protein, 4 aa, Entamoeba invadens
KTAY

SEQ ID NO: 3030086 - protein, 8 aa, Entamoeba invadens
KTNGYCTS

SEQ ID NO: 3030087 - protein, 15 aa, Entamoeba invadens
KTSETTSTKTEIKDG

SEQ ID NO: 3030088 - protein, 9 aa, Entamoeba invadens
KVASPERDR

SEQ ID NO: 3030089 - protein, 10 aa, Entamoeba invadens
KYKPDYDSAR

SEQ ID NO: 3030090 - protein, 6 aa, Entamoeba invadens
KYSYSK

SEQ ID NO: 3030091 - protein, 6 aa, Entamoeba invadens
LDNTEP

SEQ ID NO: 3030092 - protein, 4 aa, Entamoeba invadens
LEGV

SEQ ID NO: 3030093 - protein, 5 aa, Entamoeba invadens
LPSNS

SEQ ID NO: 3030094 - protein, 9 aa, Entamoeba invadens
LSHSNETKP

SEQ ID NO: 3030095 - protein, 7 aa, Entamoeba invadens
LSKDTQH

SEQ ID NO: 3030096 - protein, 37 aa, Entamoeba invadens
LSKSFEKKAVKAAAQTAPAKKDVKDVKAPQKTQEPAK

SEQ ID NO: 3030097 - protein, 11 aa, Entamoeba invadens
LSPKTKAKNNY

SEQ ID NO: 3030098 - protein, 7 aa, Entamoeba invadens
LSSSGAQ

SEQ ID NO: 3030099 - protein, 4 aa, Entamoeba invadens
LSVD

SEQ ID NO: 3030100 - protein, 10 aa, Entamoeba invadens
NAKTENSTHL

SEQ ID NO: 3030101 - protein, 18 aa, Entamoeba invadens
NCETCPGGNEKKCTTCKT

SEQ ID NO: 3030102 - protein, 10 aa, Entamoeba invadens
NCLKQNKERC

SEQ ID NO: 3030103 - protein, 19 aa, Entamoeba invadens
NDDHDQQKPGSSSRDMHDA

SEQ ID NO: 3030104 - protein, 18 aa, Entamoeba invadens
NDDHDQQKPGSSSRDMQD

SEQ ID NO: 3030105 - protein, 17 aa, Entamoeba invadens
NDSVSTTVQDKDKTYKT

SEQ ID NO: 3030106 - protein, 10 aa, Entamoeba invadens
NDYPSNERYS

SEQ ID NO: 3030107 - protein, 15 aa, Entamoeba invadens
NEGKVNGISAGSANV

SEQ ID NO: 3030108 - protein, 7 aa, Entamoeba invadens
NENEIKE

SEQ ID NO: 3030109 - protein, 10 aa, Entamoeba invadens
NENSCRTTIG

SEQ ID NO: 3030110 - protein, 17 aa, Entamoeba invadens
NGEGKVTGVKDGSATIS

SEQ ID NO: 3030111 - protein, 6 aa, Entamoeba invadens
NGETEY

SEQ ID NO: 3030112 - protein, 7 aa, Entamoeba invadens
NGNCSIK

SEQ ID NO: 3030113 - protein, 13 aa, Entamoeba invadens
NGYDNDPEAGDKE

SEQ ID NO: 3030114 - protein, 11 aa, Entamoeba invadens
NKELTKAGLSF

SEQ ID NO: 3030115 - protein, 8 aa, Entamoeba invadens
NKNNQCGI

SEQ ID NO: 3030116 - protein, 5 aa, Entamoeba invadens
NNGYG

SEQ ID NO: 3030117 - protein, 12 aa, Entamoeba invadens
NNNEYDTQCGSG

SEQ ID NO: 3030118 - protein, 5 aa, Entamoeba invadens
NNRER

SEQ ID NO: 3030119 - protein, 14 aa, Entamoeba invadens
NNTLNNNKCVERDG

SEQ ID NO: 3030120 - protein, 8 aa, Entamoeba invadens
NNTNGNCT

SEQ ID NO: 3030121 - protein, 9 aa, Entamoeba invadens
NPAKDQAQC

SEQ ID NO: 3030122 - protein, 8 aa, Entamoeba invadens
NPETAPFV

SEQ ID NO: 3030123 - protein, 5 aa, Entamoeba invadens
NPPST

SEQ ID NO: 3030124 - protein, 30 aa, Entamoeba invadens
NSIENPQKSTEKSVGTPSVDKNEDIPTCTE

SEQ ID NO: 3030125 - protein, 6 aa, Entamoeba invadens
NSKGEW

SEQ ID NO: 3030126 - protein, 4 aa, Entamoeba invadens
NSNN

SEQ ID NO: 3030127 - protein, 8 aa, Entamoeba invadens
NSSSTGCY

SEQ ID NO: 3030128 - protein, 6 aa, Entamoeba invadens
NVTNGA

SEQ ID NO: 3030129 - protein, 7 aa, Entamoeba invadens
PCAPGTE

SEQ ID NO: 3030130 - protein, 28 aa, Entamoeba invadens
PGDCGAYNDNAARSDGHISGFNSQQQDL

SEQ ID NO: 3030131 - protein, 8 aa, Entamoeba invadens
PKFGTNDE

SEQ ID NO: 3030132 - protein, 10 aa, Entamoeba invadens
PKQSFSNSPY

SEQ ID NO: 3030133 - protein, 4 aa, Entamoeba invadens
PNEP

SEQ ID NO: 3030134 - protein, 5 aa, Entamoeba invadens
PNGNV

SEQ ID NO: 3030135 - protein, 5 aa, Entamoeba invadens
PNNIG

SEQ ID NO: 3030136 - protein, 8 aa, Entamoeba invadens
PNTNFPKK

SEQ ID NO: 3030137 - protein, 5 aa, Entamoeba invadens
PPLAN

SEQ ID NO: 3030138 - protein, 9 aa, Entamoeba invadens
PSSDAKNNY

SEQ ID NO: 3030139 - protein, 8 aa, Entamoeba invadens
PSSLEDPG

SEQ ID NO: 3030140 - protein, 16 aa, Entamoeba invadens
PTGTKCAGASTKPYTL

SEQ ID NO: 3030141 - protein, 7 aa, Entamoeba invadens
QHPEAQK

SEQ ID NO: 3030142 - protein, 12 aa, Entamoeba invadens
QKLQEDANQLNE

SEQ ID NO: 3030143 - protein, 9 aa, Entamoeba invadens
QKNGLSESD

SEQ ID NO: 3030144 - protein, 4 aa, Entamoeba invadens
QNKT

SEQ ID NO: 3030145 - protein, 19 aa, Entamoeba invadens
QNNRCGIGRDSTYPTSVSL

SEQ ID NO: 3030146 - protein, 4 aa, Entamoeba invadens
QNWK

SEQ ID NO: 3030147 - protein, 7 aa, Entamoeba invadens
QQQQQQQ

SEQ ID NO: 3030148 - protein, 9 aa, Entamoeba invadens
QTDKNHITG

SEQ ID NO: 3030149 - protein, 7 aa, Entamoeba invadens
RAKQSNY

SEQ ID NO: 3030150 - protein, 4 aa, Entamoeba invadens
REQK

SEQ ID NO: 3030151 - protein, 13 aa, Entamoeba invadens
RNGKESWLFTKLR

SEQ ID NO: 3030152 - protein, 5 aa, Entamoeba invadens
RQNSI

SEQ ID NO: 3030153 - protein, 7 aa, Entamoeba invadens
RYAGKKA

SEQ ID NO: 3030154 - protein, 7 aa, Entamoeba invadens
SAKSNIN

SEQ ID NO: 3030155 - protein, 26 aa, Entamoeba invadens
SANKHDMGSPASGASTSGKCTGENGY

SEQ ID NO: 3030156 - protein, 12 aa, Entamoeba invadens
SCSSNNGQFACS

SEQ ID NO: 3030157 - protein, 5 aa, Entamoeba invadens
SEEKW

SEQ ID NO: 3030158 - protein, 20 aa, Entamoeba invadens
SEIAAEEAARGVDKKGGDIL

SEQ ID NO: 3030159 - protein, 8 aa, Entamoeba invadens
SETTSIKV

SEQ ID NO: 3030160 - protein, 14 aa, Entamoeba invadens
SFNETTINNTAGYT

SEQ ID NO: 3030161 - protein, 6 aa, Entamoeba invadens
SGLGET

SEQ ID NO: 3030162 - protein, 6 aa, Entamoeba invadens
SGMGIT

SEQ ID NO: 3030163 - protein, 5 aa, Entamoeba invadens
SGRPE

SEQ ID NO: 3030164 - protein, 6 aa, Entamoeba invadens
SHAAEL

SEQ ID NO: 3030165 - protein, 6 aa, Entamoeba invadens
SKSETE

SEQ ID NO: 3030166 - protein, 8 aa, Entamoeba invadens
SNCNGYRK

SEQ ID NO: 3030167 - protein, 9 aa, Entamoeba invadens
SNDKNEYVR

SEQ ID NO: 3030168 - protein, 11 aa, Entamoeba invadens
SNGGSQLDSTG

SEQ ID NO: 3030169 - protein, 13 aa, Entamoeba invadens
SNGTVSSDIDGDG

SEQ ID NO: 3030170 - protein, 13 aa, Entamoeba invadens
SNVTALKTGNDLT

SEQ ID NO: 3030171 - protein, 7 aa, Entamoeba invadens
SNWSTEK

SEQ ID NO: 3030172 - protein, 4 aa, Entamoeba invadens
SPSY

SEQ ID NO: 3030173 - protein, 7 aa, Entamoeba invadens
SQGVPPA

SEQ ID NO: 3030174 - protein, 11 aa, Entamoeba invadens
SQHQNSTSVAN

SEQ ID NO: 3030175 - protein, 7 aa, Entamoeba invadens
SRLNYGN

SEQ ID NO: 3030176 - protein, 12 aa, Entamoeba invadens
SSCSSCDANGYC

SEQ ID NO: 3030177 - protein, 8 aa, Entamoeba invadens
SSNTCSTS

SEQ ID NO: 3030178 - protein, 8 aa, Entamoeba invadens
STDDVGPE

SEQ ID NO: 3030179 - protein, 27 aa, Entamoeba invadens
STECKKCDRKSGACTSCEVGNKRVDNS

SEQ ID NO: 3030180 - protein, 6 aa, Entamoeba invadens
STYSQC

SEQ ID NO: 3030181 - protein, 22 aa, Entamoeba invadens
SVKRMSSGTAFKATEATASYTS

SEQ ID NO: 3030182 - protein, 4 aa, Entamoeba invadens
SYQP

SEQ ID NO: 3030183 - protein, 4 aa, Entamoeba invadens
SYRK

SEQ ID NO: 3030184 - protein, 7 aa, Entamoeba invadens
SYTENGK

SEQ ID NO: 3030185 - protein, 12 aa, Entamoeba invadens
SYTENGKVITQT

SEQ ID NO: 3030186 - protein, 12 aa, Entamoeba invadens
SYTENGNTFSAE

SEQ ID NO: 3030187 - protein, 4 aa, Entamoeba invadens
TADL

SEQ ID NO: 3030188 - protein, 14 aa, Entamoeba invadens
TAHKHTGDSCTTLT

SEQ ID NO: 3030189 - protein, 6 aa, Entamoeba invadens
TAPTTV

SEQ ID NO: 3030190 - protein, 9 aa, Entamoeba invadens
TATVDGEIN

SEQ ID NO: 3030191 - protein, 14 aa, Entamoeba invadens
TCASTGCNTQTGAC

SEQ ID NO: 3030192 - protein, 4 aa, Entamoeba invadens
TCSE

SEQ ID NO: 3030193 - protein, 4 aa, Entamoeba invadens
TDGK

SEQ ID NO: 3030194 - protein, 7 aa, Entamoeba invadens
TDNNGIT

SEQ ID NO: 3030195 - protein, 7 aa, Entamoeba invadens
TDTNGLG

SEQ ID NO: 3030196 - protein, 4 aa, Entamoeba invadens
TEDP

SEQ ID NO: 3030197 - protein, 14 aa, Entamoeba invadens
TELPNEIPKTPKST

SEQ ID NO: 3030198 - protein, 9 aa, Entamoeba invadens
TGDEKHTKE

SEQ ID NO: 3030199 - protein, 5 aa, Entamoeba invadens
TGIPS

SEQ ID NO: 3030200 - protein, 4 aa, Entamoeba invadens
TGKC

SEQ ID NO: 3030201 - protein, 8 aa, Entamoeba invadens
TGNSYSGT

SEQ ID NO: 3030202 - protein, 7 aa, Entamoeba invadens
TGPSQKS

SEQ ID NO: 3030203 - protein, 14 aa, Entamoeba invadens
TGWGDRDDSFRSLN

SEQ ID NO: 3030204 - protein, 6 aa, Entamoeba invadens
TKYSKQ

SEQ ID NO: 3030205 - protein, 13 aa, Entamoeba invadens
TLESDSTSIKVGE

SEQ ID NO: 3030206 - protein, 18 aa, Entamoeba invadens
TNDSVSTTVQDKDKTYKT

SEQ ID NO: 3030207 - protein, 5 aa, Entamoeba invadens
TNEVE

SEQ ID NO: 3030208 - protein, 6 aa, Entamoeba invadens
TNSTHT

SEQ ID NO: 3030209 - protein, 13 aa, Entamoeba invadens
TPNMYPDDTSRTC

SEQ ID NO: 3030210 - protein, 4 aa, Entamoeba invadens
TPSQ

SEQ ID NO: 3030211 - protein, 8 aa, Entamoeba invadens
TQNTKCQS

SEQ ID NO: 3030212 - protein, 10 aa, Entamoeba invadens
TRKDNDALKS

SEQ ID NO: 3030213 - protein, 4 aa, Entamoeba invadens
TSEY

SEQ ID NO: 3030214 - protein, 11 aa, Entamoeba invadens
TSSDEKVATID

SEQ ID NO: 3030215 - protein, 11 aa, Entamoeba invadens
TSVTTSSKSEF

SEQ ID NO: 3030216 - protein, 12 aa, Entamoeba invadens
TTCGGSCDATNG

SEQ ID NO: 3030217 - protein, 17 aa, Entamoeba invadens
TTCGGSCNQTDGHCTSC

SEQ ID NO: 3030218 - protein, 10 aa, Entamoeba invadens
TTEANCPAGN

SEQ ID NO: 3030219 - protein, 7 aa, Entamoeba invadens
TTTPRNT

SEQ ID NO: 3030220 - protein, 22 aa, Entamoeba invadens
TYNGYSKCPAGTKCGAKGHYPY

SEQ ID NO: 3030221 - protein, 6 aa, Entamoeba invadens
TYSEGG

SEQ ID NO: 3030222 - protein, 12 aa, Entamoeba invadens
TYTEKGVTFEDS

SEQ ID NO: 3030223 - protein, 10 aa, Entamoeba invadens
VDGDAGPETI

SEQ ID NO: 3030224 - protein, 8 aa, Entamoeba invadens
VGDPYTNG

SEQ ID NO: 3030225 - protein, 19 aa, Entamoeba invadens
VREDKKAKGYTSTTGCGDW

SEQ ID NO: 3030226 - protein, 9 aa, Entamoeba invadens
VSAPAGGYE

SEQ ID NO: 3030227 - protein, 8 aa, Entamoeba invadens
VSKRRNKF

SEQ ID NO: 3030228 - protein, 4 aa, Entamoeba invadens
VTDE

SEQ ID NO: 3030229 - protein, 6 aa, Entamoeba invadens
VVTDNG

SEQ ID NO: 3030230 - protein, 13 aa, Entamoeba invadens
VYDEAKCSSTQLD

SEQ ID NO: 3030231 - protein, 9 aa, Entamoeba invadens
WTQETTQRM

SEQ ID NO: 3030232 - protein, 10 aa, Entamoeba invadens
YATAMNAEGR

SEQ ID NO: 3030233 - protein, 14 aa, Entamoeba invadens
YMRSPDGKQCEKCD

SEQ ID NO: 3030234 - protein, 7 aa, Entamoeba invadens
YNESTGK

SEQ ID NO: 3030235 - protein, 5 aa, Entamoeba invadens
YNNGN

SEQ ID NO: 3030236 - protein, 8 aa, Entamoeba invadens
YNNHRDKD

SEQ ID NO: 3030237 - protein, 4 aa, Entamoeba invadens
YPSS

SEQ ID NO: 3030238 - protein, 21 aa, Entamoeba invadens
YSGGNTYTKYVKEGNKAKVYG

SEQ ID NO: 3030239 - protein, 9 aa, Entamoeba invadens
YSNTTSSIS

SEQ ID NO: 3030240 - protein, 11 aa, Entamoeba invadens
YSYDSSNKNCS

SEQ ID NO: 3030241 - protein, 23 aa, Entamoeba invadens
YTGSNKYTKYVKDGKKARIYTSN

SEQ ID NO: 3030242 - protein, 25 aa, Entamoeba invadens
YTGSNTYTKYSKDGKKARSYTSTTC

SEQ ID NO: 3030243 - protein, 8 aa, Entamoeba invadens
YTPDNIDP

SEQ ID NO: 3030244 - protein, 7 aa, Entamoeba invadens
YTPPLEN

SEQ ID NO: 3030245 - protein, 4 aa, Entamoeba invadens
YTQE

SEQ ID NO: 3030246 - protein, 11 aa, Entamoeba invadens
YYSNGTASLGP

SEQ ID NO: 3030247 - protein, 17 aa, Entamoeba invadens
YYTTVDRKGQTQSCTNS

SEQ ID NO: 3030248 - protein, 4 aa, Entamoeba invadens
AAAA

SEQ ID NO: 3030249 - protein, 26 aa, Entamoeba invadens
AAAAASKEAPKEVPKEEAKQAPESIK

SEQ ID NO: 3030250 - protein, 6 aa, Entamoeba invadens
AAASAG

SEQ ID NO: 3030251 - protein, 43 aa, Entamoeba invadens
AAATAAGHSEWGSASPSNAGTYNSRPPSSTGFFGSGSDNYASA

SEQ ID NO: 3030252 - protein, 12 aa, Entamoeba invadens
AACSKTETKLRK

SEQ ID NO: 3030253 - protein, 8 aa, Entamoeba invadens
AAEADGTY

SEQ ID NO: 3030254 - protein, 20 aa, Entamoeba invadens
AAEAVGIDEETSDKLAEGTT

SEQ ID NO: 3030255 - protein, 13 aa, Entamoeba invadens
AAEEYDLEDTSAE

SEQ ID NO: 3030256 - protein, 5 aa, Entamoeba invadens
AAEQI

SEQ ID NO: 3030257 - protein, 13 aa, Entamoeba invadens
AAERVESAAITKS

SEQ ID NO: 3030258 - protein, 8 aa, Entamoeba invadens
AAGKEVYT

SEQ ID NO: 3030259 - protein, 12 aa, Entamoeba invadens
AAGKNDLYTYSQ

SEQ ID NO: 3030260 - protein, 9 aa, Entamoeba invadens
AAGKPMPAK

SEQ ID NO: 3030261 - protein, 7 aa, Entamoeba invadens
AAGVGKT

SEQ ID NO: 3030262 - protein, 6 aa, Entamoeba invadens
AAIPRK

SEQ ID NO: 3030263 - protein, 10 aa, Entamoeba invadens
AAKAAGHEEW

SEQ ID NO: 3030264 - protein, 25 aa, Entamoeba invadens
AAKCESCTDNTCESFTTEESCGQCG

SEQ ID NO: 3030265 - protein, 8 aa, Entamoeba invadens
AAKDEKTV

SEQ ID NO: 3030266 - protein, 8 aa, Entamoeba invadens
AAKEVNGK

SEQ ID NO: 3030267 - protein, 20 aa, Entamoeba invadens
AAKKEKSPETKTIAQDIERT

SEQ ID NO: 3030268 - protein, 10 aa, Entamoeba invadens
AAKKGKKALT

SEQ ID NO: 3030269 - protein, 4 aa, Entamoeba invadens
AAKR

SEQ ID NO: 3030270 - protein, 8 aa, Entamoeba invadens
AAKSPLES

SEQ ID NO: 3030271 - protein, 8 aa, Entamoeba invadens
AALEAAED

SEQ ID NO: 3030272 - protein, 10 aa, Entamoeba invadens
AALEESKHGI

SEQ ID NO: 3030273 - protein, 14 aa, Entamoeba invadens
AALKPKGKKCMKQT

SEQ ID NO: 3030274 - protein, 7 aa, Entamoeba invadens
AANDDGS

SEQ ID NO: 3030275 - protein, 8 aa, Entamoeba invadens
AANPNTEL

SEQ ID NO: 3030276 - protein, 6 aa, Entamoeba invadens
AANQDK

SEQ ID NO: 3030277 - protein, 11 aa, Entamoeba invadens
AAPATLPNDLN

SEQ ID NO: 3030278 - protein, 22 aa, Entamoeba invadens
AAPKPNKEAKAQKKAVTQYKKT

SEQ ID NO: 3030279 - protein, 15 aa, Entamoeba invadens
AAQEERKEVSERLDR

SEQ ID NO: 3030280 - protein, 9 aa, Entamoeba invadens
AAQNKIQRE

SEQ ID NO: 3030281 - protein, 7 aa, Entamoeba invadens
AAQRRGV

SEQ ID NO: 3030282 - protein, 8 aa, Entamoeba invadens
AASGSGIR

SEQ ID NO: 3030283 - protein, 14 aa, Entamoeba invadens
AASKPVKEVQKTQA

SEQ ID NO: 3030284 - protein, 7 aa, Entamoeba invadens
AASLGKT

SEQ ID NO: 3030285 - protein, 10 aa, Entamoeba invadens
AATGYSVPST

SEQ ID NO: 3030286 - protein, 10 aa, Entamoeba invadens
AATSSSKEFY

SEQ ID NO: 3030287 - protein, 10 aa, Entamoeba invadens
AAVDSYSSTP

SEQ ID NO: 3030288 - protein, 6 aa, Entamoeba invadens
ACNGGW

SEQ ID NO: 3030289 - protein, 8 aa, Entamoeba invadens
ACSGSLTK

SEQ ID NO: 3030290 - protein, 13 aa, Entamoeba invadens
ACTKQTSATGKVE

SEQ ID NO: 3030291 - protein, 7 aa, Entamoeba invadens
ADATPSN

SEQ ID NO: 3030292 - protein, 6 aa, Entamoeba invadens
ADDGTT

SEQ ID NO: 3030293 - protein, 10 aa, Entamoeba invadens
ADEEVGGTGC

SEQ ID NO: 3030294 - protein, 10 aa, Entamoeba invadens
ADEKESRSAT

SEQ ID NO: 3030295 - protein, 8 aa, Entamoeba invadens
ADEKKPLN

SEQ ID NO: 3030296 - protein, 31 aa, Entamoeba invadens
ADETSKRPPFEEATKTLQKLKSEVAKDLLPI

SEQ ID NO: 3030297 - protein, 9 aa, Entamoeba invadens
ADFKNNYRQ

SEQ ID NO: 3030298 - protein, 10 aa, Entamoeba invadens
ADHRKKDARI

SEQ ID NO: 3030299 - protein, 12 aa, Entamoeba invadens
ADIKKEKDECQR

SEQ ID NO: 3030300 - protein, 33 aa, Entamoeba invadens
ADKLSENTISSVQESSSLGHTTSLQKANKVVEP

SEQ ID NO: 3030301 - protein, 6 aa, Entamoeba invadens
ADKPFS

SEQ ID NO: 3030302 - protein, 10 aa, Entamoeba invadens
ADLERDEEKA

SEQ ID NO: 3030303 - protein, 8 aa, Entamoeba invadens
ADLGPYQN

SEQ ID NO: 3030304 - protein, 10 aa, Entamoeba invadens
ADLPSTYYEA

SEQ ID NO: 3030305 - protein, 7 aa, Entamoeba invadens
ADNCPSV

SEQ ID NO: 3030306 - protein, 5 aa, Entamoeba invadens
ADNGV

SEQ ID NO: 3030307 - protein, 4 aa, Entamoeba invadens
ADNK

SEQ ID NO: 3030308 - protein, 10 aa, Entamoeba invadens
ADPQTFKDGF

SEQ ID NO: 3030309 - protein, 8 aa, Entamoeba invadens
ADPVTEDT

SEQ ID NO: 3030310 - protein, 6 aa, Entamoeba invadens
ADRISD

SEQ ID NO: 3030311 - protein, 7 aa, Entamoeba invadens
ADRQKEC

SEQ ID NO: 3030312 - protein, 7 aa, Entamoeba invadens
ADRSNTL

SEQ ID NO: 3030313 - protein, 9 aa, Entamoeba invadens
ADSFRTTPK

SEQ ID NO: 3030314 - protein, 6 aa, Entamoeba invadens
ADSTNY

SEQ ID NO: 3030315 - protein, 37 aa, Entamoeba invadens
ADTPENTMQTTTPRITHNDPSTPLSTPDVSQIPQGNT

SEQ ID NO: 3030316 - protein, 7 aa, Entamoeba invadens
ADTTDLK

SEQ ID NO: 3030317 - protein, 17 aa, Entamoeba invadens
AEAKTDCPNADKKMTGM

SEQ ID NO: 3030318 - protein, 29 aa, Entamoeba invadens
AEAQPQASPTTEPPRPPSPTRESPKTCTI

SEQ ID NO: 3030319 - protein, 6 aa, Entamoeba invadens
AECTDA

SEQ ID NO: 3030320 - protein, 6 aa, Entamoeba invadens
AEDISE

SEQ ID NO: 3030321 - protein, 9 aa, Entamoeba invadens
AEDKCGDCS

SEQ ID NO: 3030322 - protein, 15 aa, Entamoeba invadens
AEDKCGDCSQVHGCK

SEQ ID NO: 3030323 - protein, 14 aa, Entamoeba invadens
AEDKCNTTKGCEAC

SEQ ID NO: 3030324 - protein, 9 aa, Entamoeba invadens
AEDRRRGFN

SEQ ID NO: 3030325 - protein, 5 aa, Entamoeba invadens
AEDSY

SEQ ID NO: 3030326 - protein, 11 aa, Entamoeba invadens
AEEDGEGIRAY

SEQ ID NO: 3030327 - protein, 8 aa, Entamoeba invadens
AEEGENFE

SEQ ID NO: 3030328 - protein, 7 aa, Entamoeba invadens
AEETREC

SEQ ID NO: 3030329 - protein, 11 aa, Entamoeba invadens
AEHARNKTKYL

SEQ ID NO: 3030330 - protein, 6 aa, Entamoeba invadens
AEIEED

SEQ ID NO: 3030331 - protein, 17 aa, Entamoeba invadens
AEKNISSQNTSNTQTNT

SEQ ID NO: 3030332 - protein, 15 aa, Entamoeba invadens
AEKNKYNAKRFQKQT

SEQ ID NO: 3030333 - protein, 9 aa, Entamoeba invadens
AEKQTSRAT

SEQ ID NO: 3030334 - protein, 7 aa, Entamoeba invadens
AEKQTTL

SEQ ID NO: 3030335 - protein, 12 aa, Entamoeba invadens
AEKSNNLRSAST

SEQ ID NO: 3030336 - protein, 18 aa, Entamoeba invadens
AEKTLQISKSPSVSQSGV

SEQ ID NO: 3030337 - protein, 8 aa, Entamoeba invadens
AEKTNKDI

SEQ ID NO: 3030338 - protein, 12 aa, Entamoeba invadens
AELNQKQSELNR

SEQ ID NO: 3030339 - protein, 9 aa, Entamoeba invadens
AEMSANEAL

SEQ ID NO: 3030340 - protein, 48 aa, Entamoeba invadens
AENEYELEENADTEVAENEEEDEFDDDEEEEADVEMEDDDEEEDDMKD

SEQ ID NO: 3030341 - protein, 9 aa, Entamoeba invadens
AENGEKVTN

SEQ ID NO: 3030342 - protein, 7 aa, Entamoeba invadens
AENKEEL

SEQ ID NO: 3030343 - protein, 22 aa, Entamoeba invadens
AEPAEKQEKGKGKKKEKNPKPK

SEQ ID NO: 3030344 - protein, 4 aa, Entamoeba invadens
AEPI

SEQ ID NO: 3030345 - protein, 6 aa, Entamoeba invadens
AEPTNR

SEQ ID NO: 3030346 - protein, 7 aa, Entamoeba invadens
AEPTNRG

SEQ ID NO: 3030347 - protein, 14 aa, Entamoeba invadens
AEQAKTETNPFDQI

SEQ ID NO: 3030348 - protein, 35 aa, Entamoeba invadens
AEQPPASSPTTTPSSTNSTETTMTDEQLKKKYNED

SEQ ID NO: 3030349 - protein, 9 aa, Entamoeba invadens
AERKESKIE

SEQ ID NO: 3030350 - protein, 9 aa, Entamoeba invadens
AERTKDSDA

SEQ ID NO: 3030351 - protein, 7 aa, Entamoeba invadens
AESALNG

SEQ ID NO: 3030352 - protein, 18 aa, Entamoeba invadens
AESDKGYGIGDSRVNYGD

SEQ ID NO: 3030353 - protein, 14 aa, Entamoeba invadens
AESKKKKCTKPKCN

SEQ ID NO: 3030354 - protein, 11 aa, Entamoeba invadens
AESSKTAKRYR

SEQ ID NO: 3030355 - protein, 13 aa, Entamoeba invadens
AESSKVAATGDEY

SEQ ID NO: 3030356 - protein, 7 aa, Entamoeba invadens
AETARAA

SEQ ID NO: 3030357 - protein, 19 aa, Entamoeba invadens
AETSGGVVDPNPTEEQRGK

SEQ ID NO: 3030358 - protein, 4 aa, Entamoeba invadens
AETY

SEQ ID NO: 3030359 - protein, 8 aa, Entamoeba invadens
AEVTSKCS

SEQ ID NO: 3030360 - protein, 5 aa, Entamoeba invadens
AEYIN

SEQ ID NO: 3030361 - protein, 4 aa, Entamoeba invadens
AEYR

SEQ ID NO: 3030362 - protein, 5 aa, Entamoeba invadens
AFAQT

SEQ ID NO: 3030363 - protein, 5 aa, Entamoeba invadens
AFEGA

SEQ ID NO: 3030364 - protein, 9 aa, Entamoeba invadens
AFETEGQIP

SEQ ID NO: 3030365 - protein, 4 aa, Entamoeba invadens
AFKT

SEQ ID NO: 3030366 - protein, 6 aa, Entamoeba invadens
AFSGTK

SEQ ID NO: 3030367 - protein, 6 aa, Entamoeba invadens
AGANVG

SEQ ID NO: 3030368 - protein, 10 aa, Entamoeba invadens
AGASEFSDKT

SEQ ID NO: 3030369 - protein, 8 aa, Entamoeba invadens
AGDAPKDQ

SEQ ID NO: 3030370 - protein, 5 aa, Entamoeba invadens
AGDWH

SEQ ID NO: 3030371 - protein, 10 aa, Entamoeba invadens
AGDYTTRCES

SEQ ID NO: 3030372 - protein, 10 aa, Entamoeba invadens
AGETSSGSMN

SEQ ID NO: 3030373 - protein, 10 aa, Entamoeba invadens
AGETSTGSMN

SEQ ID NO: 3030374 - protein, 9 aa, Entamoeba invadens
AGETTSASM

SEQ ID NO: 3030375 - protein, 5 aa, Entamoeba invadens
AGFDP

SEQ ID NO: 3030376 - protein, 8 aa, Entamoeba invadens
AGGRKNLC

SEQ ID NO: 3030377 - protein, 6 aa, Entamoeba invadens
AGIVGS

SEQ ID NO: 3030378 - protein, 14 aa, Entamoeba invadens
AGKCTVSGGCSECE

SEQ ID NO: 3030379 - protein, 10 aa, Entamoeba invadens
AGKDSNTHAP

SEQ ID NO: 3030380 - protein, 5 aa, Entamoeba invadens
AGKGI

SEQ ID NO: 3030381 - protein, 4 aa, Entamoeba invadens
AGKK

SEQ ID NO: 3030382 - protein, 6 aa, Entamoeba invadens
AGLGRG

SEQ ID NO: 3030383 - protein, 10 aa, Entamoeba invadens
AGLKNGTKLR

SEQ ID NO: 3030384 - protein, 8 aa, Entamoeba invadens
AGNEKEMK

SEQ ID NO: 3030385 - protein, 7 aa, Entamoeba invadens
AGNERFQ

SEQ ID NO: 3030386 - protein, 18 aa, Entamoeba invadens
AGPSASGKTTFSKKLGAQ

SEQ ID NO: 3030387 - protein, 9 aa, Entamoeba invadens
AGPTHDDQE

SEQ ID NO: 3030388 - protein, 7 aa, Entamoeba invadens
AGQEAFR

SEQ ID NO: 3030389 - protein, 12 aa, Entamoeba invadens
AGQEPNEEKTGC

SEQ ID NO: 3030390 - protein, 7 aa, Entamoeba invadens
AGQWTTG

SEQ ID NO: 3030391 - protein, 65 aa, Entamoeba invadens
AGRNIKSATTQTAVANQNKEDSNDVAQQETKQEDPQSALDENVPKDNQQEGTQGNQKQQESMSQY

SEQ ID NO: 3030392 - protein, 7 aa, Entamoeba invadens
AGRVEKK

SEQ ID NO: 3030393 - protein, 10 aa, Entamoeba invadens
AGRYPEVDPG

SEQ ID NO: 3030394 - protein, 6 aa, Entamoeba invadens
AGSAKY

SEQ ID NO: 3030395 - protein, 6 aa, Entamoeba invadens
AGSDCY

SEQ ID NO: 3030396 - protein, 5 aa, Entamoeba invadens
AGSGY

SEQ ID NO: 3030397 - protein, 10 aa, Entamoeba invadens
AGSPQARDGN

SEQ ID NO: 3030398 - protein, 6 aa, Entamoeba invadens
AGSSYP

SEQ ID NO: 3030399 - protein, 8 aa, Entamoeba invadens
AGSTTCKS

SEQ ID NO: 3030400 - protein, 11 aa, Entamoeba invadens
AGSTTCKSCSS

SEQ ID NO: 3030401 - protein, 31 aa, Entamoeba invadens
AGSYSSGGTTTSCTSCSSGSYSGSGASSCTK

SEQ ID NO: 3030402 - protein, 12 aa, Entamoeba invadens
AGSYSSSTGAAS

SEQ ID NO: 3030403 - protein, 10 aa, Entamoeba invadens
AGSYSTNTSR

SEQ ID NO: 3030404 - protein, 6 aa, Entamoeba invadens
AGTFGR

SEQ ID NO: 3030405 - protein, 9 aa, Entamoeba invadens
AGTNIQNGP

SEQ ID NO: 3030406 - protein, 8 aa, Entamoeba invadens
AGTRTLTA

SEQ ID NO: 3030407 - protein, 10 aa, Entamoeba invadens
AGTSGSYDSK

SEQ ID NO: 3030408 - protein, 5 aa, Entamoeba invadens
AGTTT

SEQ ID NO: 3030409 - protein, 40 aa, Entamoeba invadens
AGTVDPTPDPKPEPEPEPKPEHSEASEHSSDGHNGEINNK

SEQ ID NO: 3030410 - protein, 8 aa, Entamoeba invadens
AGTVSGPA

SEQ ID NO: 3030411 - protein, 16 aa, Entamoeba invadens
AGTYADEQGSSSCKTC

SEQ ID NO: 3030412 - protein, 7 aa, Entamoeba invadens
AGTYGDG

SEQ ID NO: 3030413 - protein, 10 aa, Entamoeba invadens
AGTYNNKNKQ

SEQ ID NO: 3030414 - protein, 10 aa, Entamoeba invadens
AGTYSHNQST

SEQ ID NO: 3030415 - protein, 14 aa, Entamoeba invadens
AGTYSLGGTNTCTD

SEQ ID NO: 3030416 - protein, 12 aa, Entamoeba invadens
AGTYSNSASSEC

SEQ ID NO: 3030417 - protein, 13 aa, Entamoeba invadens
AGTYSNSASSECY

SEQ ID NO: 3030418 - protein, 95 aa, Entamoeba invadens
AGTYSSGGTTTSCTSCSSGSYSGSGASSCTKCSPGYYASSSGSSSCTKCNPGKCASNYGSTSCSNCAAGTYSAGGASSCTKCSAGHYSTSGASTC

SEQ ID NO: 3030419 - protein, 23 aa, Entamoeba invadens
AGTYSSSIDSSTCTTCKNGTFSL

SEQ ID NO: 3030420 - protein, 6 aa, Entamoeba invadens
AGVDGF

SEQ ID NO: 3030421 - protein, 29 aa, Entamoeba invadens
AGYNPNDKFGIEGNAKFGKENGKKINSYG

SEQ ID NO: 3030422 - protein, 10 aa, Entamoeba invadens
AGYVTYSDNS

SEQ ID NO: 3030423 - protein, 32 aa, Entamoeba invadens
AHCSNKEKINTTSGKCEPCSGTGSGNDGVTDS

SEQ ID NO: 3030424 - protein, 6 aa, Entamoeba invadens
AHGDAS

SEQ ID NO: 3030425 - protein, 8 aa, Entamoeba invadens
AHGNEPSH

SEQ ID NO: 3030426 - protein, 11 aa, Entamoeba invadens
AIDGVSGEPVL

SEQ ID NO: 3030427 - protein, 11 aa, Entamoeba invadens
AIDNGKCRKCD

SEQ ID NO: 3030428 - protein, 5 aa, Entamoeba invadens
AIDRE

SEQ ID NO: 3030429 - protein, 5 aa, Entamoeba invadens
AIEEV

SEQ ID NO: 3030430 - protein, 6 aa, Entamoeba invadens
AIGEDK

SEQ ID NO: 3030431 - protein, 19 aa, Entamoeba invadens
AIGKEEKQVCGDNEYPAWE

SEQ ID NO: 3030432 - protein, 9 aa, Entamoeba invadens
AIKKHNKKV

SEQ ID NO: 3030433 - protein, 13 aa, Entamoeba invadens
AIPENCQSADTTE

SEQ ID NO: 3030434 - protein, 22 aa, Entamoeba invadens
AIPSKPENTKWKAAEGFFLPAL

SEQ ID NO: 3030435 - protein, 13 aa, Entamoeba invadens
AIPSSNVQYDPES

SEQ ID NO: 3030436 - protein, 4 aa, Entamoeba invadens
AIQS

SEQ ID NO: 3030437 - protein, 20 aa, Entamoeba invadens
AISANNAATSATSSSLSSGL

SEQ ID NO: 3030438 - protein, 16 aa, Entamoeba invadens
AITKTDADITNDEDIE

SEQ ID NO: 3030439 - protein, 30 aa, Entamoeba invadens
AKAQTKKAVKKAEKKAQKAAAKAKKEAAKV

SEQ ID NO: 3030440 - protein, 20 aa, Entamoeba invadens
AKAVASKVKKAAKVTEKHMK

SEQ ID NO: 3030441 - protein, 6 aa, Entamoeba invadens
AKCDSS

SEQ ID NO: 3030442 - protein, 6 aa, Entamoeba invadens
AKDAGL

SEQ ID NO: 3030443 - protein, 9 aa, Entamoeba invadens
AKEARTISP

SEQ ID NO: 3030444 - protein, 8 aa, Entamoeba invadens
AKEEEELN

SEQ ID NO: 3030445 - protein, 16 aa, Entamoeba invadens
AKEENAPNKSEAFEKY

SEQ ID NO: 3030446 - protein, 11 aa, Entamoeba invadens
AKEKEEIQKQF

SEQ ID NO: 3030447 - protein, 7 aa, Entamoeba invadens
AKENGPY

SEQ ID NO: 3030448 - protein, 5 aa, Entamoeba invadens
AKESF

SEQ ID NO: 3030449 - protein, 13 aa, Entamoeba invadens
AKEVGDKNDKAAR

SEQ ID NO: 3030450 - protein, 8 aa, Entamoeba invadens
AKEYQTAN

SEQ ID NO: 3030451 - protein, 11 aa, Entamoeba invadens
AKFSPNTTKFE

SEQ ID NO: 3030452 - protein, 8 aa, Entamoeba invadens
AKGATGWD

SEQ ID NO: 3030453 - protein, 8 aa, Entamoeba invadens
AKGNADLS

SEQ ID NO: 3030454 - protein, 8 aa, Entamoeba invadens
AKGNSKYP

SEQ ID NO: 3030455 - protein, 8 aa, Entamoeba invadens
AKGPLDNP

SEQ ID NO: 3030456 - protein, 13 aa, Entamoeba invadens
AKGVFSGSERSDL

SEQ ID NO: 3030457 - protein, 25 aa, Entamoeba invadens
AKIEKKVKTQKAKAQKDKKKLKALK

SEQ ID NO: 3030458 - protein, 8 aa, Entamoeba invadens
AKIKEGKP

SEQ ID NO: 3030459 - protein, 22 aa, Entamoeba invadens
AKISKEAHQAAKEGKDAKHSTA

SEQ ID NO: 3030460 - protein, 6 aa, Entamoeba invadens
AKITRN

SEQ ID NO: 3030461 - protein, 8 aa, Entamoeba invadens
AKKAGKMI

SEQ ID NO: 3030462 - protein, 4 aa, Entamoeba invadens
AKKD

SEQ ID NO: 3030463 - protein, 8 aa, Entamoeba invadens
AKKGVDIA

SEQ ID NO: 3030464 - protein, 5 aa, Entamoeba invadens
AKKNE

SEQ ID NO: 3030465 - protein, 15 aa, Entamoeba invadens
AKKQAKKQAKKVEQL

SEQ ID NO: 3030466 - protein, 9 aa, Entamoeba invadens
AKKSSRRVI

SEQ ID NO: 3030467 - protein, 8 aa, Entamoeba invadens
AKKTHKVD

SEQ ID NO: 3030468 - protein, 8 aa, Entamoeba invadens
AKKTVDVA

SEQ ID NO: 3030469 - protein, 5 aa, Entamoeba invadens
AKKYG

SEQ ID NO: 3030470 - protein, 14 aa, Entamoeba invadens
AKLAKTEQKQKKVV

SEQ ID NO: 3030471 - protein, 10 aa, Entamoeba invadens
AKLKDGSSNY

SEQ ID NO: 3030472 - protein, 9 aa, Entamoeba invadens
AKLTDFGSA

SEQ ID NO: 3030473 - protein, 5 aa, Entamoeba invadens
AKMNK

SEQ ID NO: 3030474 - protein, 9 aa, Entamoeba invadens
AKNCNKQVE

SEQ ID NO: 3030475 - protein, 8 aa, Entamoeba invadens
AKNDAKGV

SEQ ID NO: 3030476 - protein, 6 aa, Entamoeba invadens
AKNEIK

SEQ ID NO: 3030477 - protein, 9 aa, Entamoeba invadens
AKNENAPSA

SEQ ID NO: 3030478 - protein, 12 aa, Entamoeba invadens
AKNGEKISSGLD

SEQ ID NO: 3030479 - protein, 4 aa, Entamoeba invadens
AKNK

SEQ ID NO: 3030480 - protein, 22 aa, Entamoeba invadens
AKNQNIKQIQKAGKKAEKKAEI

SEQ ID NO: 3030481 - protein, 17 aa, Entamoeba invadens
AKNREFDRKKAKISKKL

SEQ ID NO: 3030482 - protein, 10 aa, Entamoeba invadens
AKPKKVAKKA

SEQ ID NO: 3030483 - protein, 49 aa, Entamoeba invadens
AKPLGTPGKVVPPKKEEVKKEVKKTAKKEVKKEAKKEVKKAIKKETKKI

SEQ ID NO: 3030484 - protein, 6 aa, Entamoeba invadens
AKPNLD

SEQ ID NO: 3030485 - protein, 7 aa, Entamoeba invadens
AKQGTNI

SEQ ID NO: 3030486 - protein, 8 aa, Entamoeba invadens
AKQHSKAD

SEQ ID NO: 3030487 - protein, 5 aa, Entamoeba invadens
AKQME

SEQ ID NO: 3030488 - protein, 29 aa, Entamoeba invadens
AKQNATAVNGTGVEEIDKNENTLKKIEES

SEQ ID NO: 3030489 - protein, 9 aa, Entamoeba invadens
AKQNCETSH

SEQ ID NO: 3030490 - protein, 8 aa, Entamoeba invadens
AKQQQQKR

SEQ ID NO: 3030491 - protein, 10 aa, Entamoeba invadens
AKREAAEKAL

SEQ ID NO: 3030492 - protein, 18 aa, Entamoeba invadens
AKREGLKIEAPKSDIKRP

SEQ ID NO: 3030493 - protein, 22 aa, Entamoeba invadens
AKRGLKAQKQNLKQNKKELKEM

SEQ ID NO: 3030494 - protein, 21 aa, Entamoeba invadens
AKRKGEKKKRPGSTPIPETEH

SEQ ID NO: 3030495 - protein, 8 aa, Entamoeba invadens
AKRKGVRD

SEQ ID NO: 3030496 - protein, 11 aa, Entamoeba invadens
AKRKTREARDS

SEQ ID NO: 3030497 - protein, 10 aa, Entamoeba invadens
AKRNEKFKED

SEQ ID NO: 3030498 - protein, 10 aa, Entamoeba invadens
AKRRREEEDV

SEQ ID NO: 3030499 - protein, 5 aa, Entamoeba invadens
AKRTF

SEQ ID NO: 3030500 - protein, 6 aa, Entamoeba invadens
AKRTLQ

SEQ ID NO: 3030501 - protein, 5 aa, Entamoeba invadens
AKSGT

SEQ ID NO: 3030502 - protein, 4 aa, Entamoeba invadens
AKSK

SEQ ID NO: 3030503 - protein, 9 aa, Entamoeba invadens
AKSKSTVGG

SEQ ID NO: 3030504 - protein, 7 aa, Entamoeba invadens
AKSSDDD

SEQ ID NO: 3030505 - protein, 8 aa, Entamoeba invadens
AKSSLSQV

SEQ ID NO: 3030506 - protein, 6 aa, Entamoeba invadens
AKTEEM

SEQ ID NO: 3030507 - protein, 8 aa, Entamoeba invadens
AKTETDQI

SEQ ID NO: 3030508 - protein, 6 aa, Entamoeba invadens
AKTNTI

SEQ ID NO: 3030509 - protein, 23 aa, Entamoeba invadens
AKTPTERRSTWDGNAKLTTVGSS

SEQ ID NO: 3030510 - protein, 8 aa, Entamoeba invadens
AKTRPVAK

SEQ ID NO: 3030511 - protein, 9 aa, Entamoeba invadens
AKVESTLNQ

SEQ ID NO: 3030512 - protein, 12 aa, Entamoeba invadens
AKVTAKQTNDLQ

SEQ ID NO: 3030513 - protein, 6 aa, Entamoeba invadens
AKYETE

SEQ ID NO: 3030514 - protein, 4 aa, Entamoeba invadens
AKYG

SEQ ID NO: 3030515 - protein, 6 aa, Entamoeba invadens
AKYQDQ

SEQ ID NO: 3030516 - protein, 5 aa, Entamoeba invadens
AKYTK

SEQ ID NO: 3030517 - protein, 13 aa, Entamoeba invadens
ALAEERKVNEKRT

SEQ ID NO: 3030518 - protein, 26 aa, Entamoeba invadens
ALEDKAEAEKTAADQSNRRKKMEDQV

SEQ ID NO: 3030519 - protein, 11 aa, Entamoeba invadens
ALETAKKAAKI

SEQ ID NO: 3030520 - protein, 11 aa, Entamoeba invadens
ALETKAPVGDS

SEQ ID NO: 3030521 - protein, 7 aa, Entamoeba invadens
ALKTNPI

SEQ ID NO: 3030522 - protein, 9 aa, Entamoeba invadens
ALNPVTDET

SEQ ID NO: 3030523 - protein, 9 aa, Entamoeba invadens
ALPDNKRST

SEQ ID NO: 3030524 - protein, 8 aa, Entamoeba invadens
ALSENKLS

SEQ ID NO: 3030525 - protein, 10 aa, Entamoeba invadens
ALSGRKGEKI

SEQ ID NO: 3030526 - protein, 9 aa, Entamoeba invadens
ALSKDKKKC

SEQ ID NO: 3030527 - protein, 13 aa, Entamoeba invadens
ALSSDNSRRRITN

SEQ ID NO: 3030528 - protein, 4 aa, Entamoeba invadens
ALST

SEQ ID NO: 3030529 - protein, 10 aa, Entamoeba invadens
ALSTKNSDTH

SEQ ID NO: 3030530 - protein, 63 aa, Entamoeba invadens
ALTGKKVEEKKSTPAATKKTVKKAEKKLAKVKAQTKNIKKQEKKAEKKVEKKMKKAGQDKKQI

SEQ ID NO: 3030531 - protein, 17 aa, Entamoeba invadens
AMDSGEAISTASRYTSI

SEQ ID NO: 3030532 - protein, 11 aa, Entamoeba invadens
AMENNKEKHKQ

SEQ ID NO: 3030533 - protein, 14 aa, Entamoeba invadens
AMGSRTKYQEKQTA

SEQ ID NO: 3030534 - protein, 16 aa, Entamoeba invadens
AMPPVKESNKEEIEEL

SEQ ID NO: 3030535 - protein, 4 aa, Entamoeba invadens
AMSS

SEQ ID NO: 3030536 - protein, 21 aa, Entamoeba invadens
AMSSLPSGTSPSVNPSLPGVG

SEQ ID NO: 3030537 - protein, 5 aa, Entamoeba invadens
ANAEQ

SEQ ID NO: 3030538 - protein, 10 aa, Entamoeba invadens
ANAQAASNSK

SEQ ID NO: 3030539 - protein, 12 aa, Entamoeba invadens
ANDPTKEFTEDE

SEQ ID NO: 3030540 - protein, 10 aa, Entamoeba invadens
ANDPTSSFTA

SEQ ID NO: 3030541 - protein, 6 aa, Entamoeba invadens
ANDQLS

SEQ ID NO: 3030542 - protein, 11 aa, Entamoeba invadens
ANEEVKNHKAE

SEQ ID NO: 3030543 - protein, 21 aa, Entamoeba invadens
ANGKYQKTTTRKLSYKPNSKV

SEQ ID NO: 3030544 - protein, 17 aa, Entamoeba invadens
ANGNTSPTEKLEKPDLL

SEQ ID NO: 3030545 - protein, 6 aa, Entamoeba invadens
ANGVGY

SEQ ID NO: 3030546 - protein, 10 aa, Entamoeba invadens
ANGYAYTQTE

SEQ ID NO: 3030547 - protein, 6 aa, Entamoeba invadens
ANKEFG

SEQ ID NO: 3030548 - protein, 9 aa, Entamoeba invadens
ANKGETNVT

SEQ ID NO: 3030549 - protein, 7 aa, Entamoeba invadens
ANKKGVA

SEQ ID NO: 3030550 - protein, 10 aa, Entamoeba invadens
ANKRTTEYKT

SEQ ID NO: 3030551 - protein, 12 aa, Entamoeba invadens
ANKVRSATGDWE

SEQ ID NO: 3030552 - protein, 6 aa, Entamoeba invadens
ANLNGL

SEQ ID NO: 3030553 - protein, 4 aa, Entamoeba invadens
ANNA

SEQ ID NO: 3030554 - protein, 6 aa, Entamoeba invadens
ANNDEE

SEQ ID NO: 3030555 - protein, 7 aa, Entamoeba invadens
ANNENYV

SEQ ID NO: 3030556 - protein, 5 aa, Entamoeba invadens
ANNKT

SEQ ID NO: 3030557 - protein, 9 aa, Entamoeba invadens
ANNNYGHPT

SEQ ID NO: 3030558 - protein, 9 aa, Entamoeba invadens
ANNQYGHPS

SEQ ID NO: 3030559 - protein, 10 aa, Entamoeba invadens
ANNVGSLKEL

SEQ ID NO: 3030560 - protein, 17 aa, Entamoeba invadens
ANPALYKGSRQSQDISG

SEQ ID NO: 3030561 - protein, 7 aa, Entamoeba invadens
ANPGETR

SEQ ID NO: 3030562 - protein, 10 aa, Entamoeba invadens
ANPGHRPLNN

SEQ ID NO: 3030563 - protein, 6 aa, Entamoeba invadens
ANPSFQ

SEQ ID NO: 3030564 - protein, 9 aa, Entamoeba invadens
ANPTPISPK

SEQ ID NO: 3030565 - protein, 9 aa, Entamoeba invadens
ANPTTRAQL

SEQ ID NO: 3030566 - protein, 6 aa, Entamoeba invadens
ANQGGY

SEQ ID NO: 3030567 - protein, 9 aa, Entamoeba invadens
ANRDPAKGC

SEQ ID NO: 3030568 - protein, 9 aa, Entamoeba invadens
ANRYETQNI

SEQ ID NO: 3030569 - protein, 5 aa, Entamoeba invadens
ANSGV

SEQ ID NO: 3030570 - protein, 7 aa, Entamoeba invadens
ANSKIDE

SEQ ID NO: 3030571 - protein, 15 aa, Entamoeba invadens
ANSKKNLEESGNKMN

SEQ ID NO: 3030572 - protein, 9 aa, Entamoeba invadens
ANSKLSEKK

SEQ ID NO: 3030573 - protein, 7 aa, Entamoeba invadens
ANSLEDV

SEQ ID NO: 3030574 - protein, 10 aa, Entamoeba invadens
ANSNVNSGAT

SEQ ID NO: 3030575 - protein, 13 aa, Entamoeba invadens
ANSTTENGTNHYS

SEQ ID NO: 3030576 - protein, 6 aa, Entamoeba invadens
ANTCTG

SEQ ID NO: 3030577 - protein, 9 aa, Entamoeba invadens
ANTDQSLKI

SEQ ID NO: 3030578 - protein, 6 aa, Entamoeba invadens
ANTENY

SEQ ID NO: 3030579 - protein, 4 aa, Entamoeba invadens
ANTY

SEQ ID NO: 3030580 - protein, 13 aa, Entamoeba invadens
ANVAKSRNTDSAM

SEQ ID NO: 3030581 - protein, 4 aa, Entamoeba invadens
ANYF

SEQ ID NO: 3030582 - protein, 5 aa, Entamoeba invadens
ANYGQ

SEQ ID NO: 3030583 - protein, 9 aa, Entamoeba invadens
ANYKPNDKW

SEQ ID NO: 3030584 - protein, 7 aa, Entamoeba invadens
APAGPKN

SEQ ID NO: 3030585 - protein, 4 aa, Entamoeba invadens
APCR

SEQ ID NO: 3030586 - protein, 21 aa, Entamoeba invadens
APIAAASKTIETGAKAVKTVA

SEQ ID NO: 3030587 - protein, 14 aa, Entamoeba invadens
APIAAGAKTVEKAA

SEQ ID NO: 3030588 - protein, 8 aa, Entamoeba invadens
APKDESDR

SEQ ID NO: 3030589 - protein, 18 aa, Entamoeba invadens
APKKAVTKAVKKALDAVL

SEQ ID NO: 3030590 - protein, 21 aa, Entamoeba invadens
APKPAPKRVAPKPVKASIKKR

SEQ ID NO: 3030591 - protein, 7 aa, Entamoeba invadens
APKTPKV

SEQ ID NO: 3030592 - protein, 55 aa, Entamoeba invadens
APLPEEKKEEKKEEKEESDTEEEEDDEEEEDVDEDEDAVNDEEVHTEEKKEEKTE

SEQ ID NO: 3030593 - protein, 5 aa, Entamoeba invadens
APLSD

SEQ ID NO: 3030594 - protein, 6 aa, Entamoeba invadens
APNGMY

SEQ ID NO: 3030595 - protein, 11 aa, Entamoeba invadens
APNTCDPSTGY

SEQ ID NO: 3030596 - protein, 11 aa, Entamoeba invadens
APNVPGKSTDY

SEQ ID NO: 3030597 - protein, 6 aa, Entamoeba invadens
APQERT

SEQ ID NO: 3030598 - protein, 5 aa, Entamoeba invadens
APQVD

SEQ ID NO: 3030599 - protein, 9 aa, Entamoeba invadens
APSHEDNQP

SEQ ID NO: 3030600 - protein, 28 aa, Entamoeba invadens
APSPLKSSPEIGKRPKREKIEKNKFKVV

SEQ ID NO: 3030601 - protein, 6 aa, Entamoeba invadens
APTYEE

SEQ ID NO: 3030602 - protein, 5 aa, Entamoeba invadens
APYPD

SEQ ID NO: 3030603 - protein, 8 aa, Entamoeba invadens
APYTIDKN

SEQ ID NO: 3030604 - protein, 5 aa, Entamoeba invadens
APYYE

SEQ ID NO: 3030605 - protein, 16 aa, Entamoeba invadens
AQANKAEAYFKSSNPS

SEQ ID NO: 3030606 - protein, 8 aa, Entamoeba invadens
AQARQKIR

SEQ ID NO: 3030607 - protein, 4 aa, Entamoeba invadens
AQDS

SEQ ID NO: 3030608 - protein, 5 aa, Entamoeba invadens
AQFTS

SEQ ID NO: 3030609 - protein, 4 aa, Entamoeba invadens
AQGH

SEQ ID NO: 3030610 - protein, 14 aa, Entamoeba invadens
AQGKVPAVRDQAQC

SEQ ID NO: 3030611 - protein, 6 aa, Entamoeba invadens
AQKAAE

SEQ ID NO: 3030612 - protein, 6 aa, Entamoeba invadens
AQKANE

SEQ ID NO: 3030613 - protein, 9 aa, Entamoeba invadens
AQKENEEAV

SEQ ID NO: 3030614 - protein, 22 aa, Entamoeba invadens
AQKKKKDQQYSKVEQNNYNQVP

SEQ ID NO: 3030615 - protein, 7 aa, Entamoeba invadens
AQKNQDL

SEQ ID NO: 3030616 - protein, 20 aa, Entamoeba invadens
AQKTHSKRTPKDYNGPREAK

SEQ ID NO: 3030617 - protein, 7 aa, Entamoeba invadens
AQLAKGD

SEQ ID NO: 3030618 - protein, 10 aa, Entamoeba invadens
AQLEKQAAQA

SEQ ID NO: 3030619 - protein, 8 aa, Entamoeba invadens
AQNIPVNS

SEQ ID NO: 3030620 - protein, 17 aa, Entamoeba invadens
AQNSDQQTALDKQKTDI

SEQ ID NO: 3030621 - protein, 5 aa, Entamoeba invadens
AQNTL

SEQ ID NO: 3030622 - protein, 8 aa, Entamoeba invadens
AQNYGSVN

SEQ ID NO: 3030623 - protein, 16 aa, Entamoeba invadens
AQPDKSSEDQKTFPSL

SEQ ID NO: 3030624 - protein, 8 aa, Entamoeba invadens
AQPKNTDQ

SEQ ID NO: 3030625 - protein, 6 aa, Entamoeba invadens
AQPNYA

SEQ ID NO: 3030626 - protein, 19 aa, Entamoeba invadens
AQQANPSPIIQKARSDLAD

SEQ ID NO: 3030627 - protein, 12 aa, Entamoeba invadens
AQQQYEQLGARP

SEQ ID NO: 3030628 - protein, 17 aa, Entamoeba invadens
AQQVEENNTALRKRRAA

SEQ ID NO: 3030629 - protein, 6 aa, Entamoeba invadens
AQSSGF

SEQ ID NO: 3030630 - protein, 10 aa, Entamoeba invadens
AQTEFEGART

SEQ ID NO: 3030631 - protein, 6 aa, Entamoeba invadens
AQTEGE

SEQ ID NO: 3030632 - protein, 7 aa, Entamoeba invadens
AQTPLCE

SEQ ID NO: 3030633 - protein, 26 aa, Entamoeba invadens
AQVPQYSECGNTLSQRPISRKGWYTR

SEQ ID NO: 3030634 - protein, 28 aa, Entamoeba invadens
ARGVKYEGNPLTGDHRNETYAPSENDYS

SEQ ID NO: 3030635 - protein, 7 aa, Entamoeba invadens
ARKGEEY

SEQ ID NO: 3030636 - protein, 6 aa, Entamoeba invadens
ARKSQD

SEQ ID NO: 3030637 - protein, 16 aa, Entamoeba invadens
ARLSDAKTQEDKKIDA

SEQ ID NO: 3030638 - protein, 9 aa, Entamoeba invadens
ARNGSTKRQ

SEQ ID NO: 3030639 - protein, 12 aa, Entamoeba invadens
ARNQITENPRNT

SEQ ID NO: 3030640 - protein, 13 aa, Entamoeba invadens
ARPITFPSSPGFL

SEQ ID NO: 3030641 - protein, 9 aa, Entamoeba invadens
ARPPTEQEV

SEQ ID NO: 3030642 - protein, 7 aa, Entamoeba invadens
ARSASKK

SEQ ID NO: 3030643 - protein, 8 aa, Entamoeba invadens
ARTDVPKE

SEQ ID NO: 3030644 - protein, 8 aa, Entamoeba invadens
ARTKYGDE

SEQ ID NO: 3030645 - protein, 5 aa, Entamoeba invadens
ARTNR

SEQ ID NO: 3030646 - protein, 6 aa, Entamoeba invadens
ARTPQK

SEQ ID NO: 3030647 - protein, 4 aa, Entamoeba invadens
ARVD

SEQ ID NO: 3030648 - protein, 11 aa, Entamoeba invadens
ARVDNTNEAVT

SEQ ID NO: 3030649 - protein, 9 aa, Entamoeba invadens
ASAEQCTKC

SEQ ID NO: 3030650 - protein, 9 aa, Entamoeba invadens
ASALPKTYK

SEQ ID NO: 3030651 - protein, 8 aa, Entamoeba invadens
ASATIKDQ

SEQ ID NO: 3030652 - protein, 12 aa, Entamoeba invadens
ASCDKTNGKCTT

SEQ ID NO: 3030653 - protein, 9 aa, Entamoeba invadens
ASCNATNGK

SEQ ID NO: 3030654 - protein, 15 aa, Entamoeba invadens
ASCPDGSYADPTNAN

SEQ ID NO: 3030655 - protein, 11 aa, Entamoeba invadens
ASCPTQADTHP

SEQ ID NO: 3030656 - protein, 18 aa, Entamoeba invadens
ASDKKQERNNAVGRDGGD

SEQ ID NO: 3030657 - protein, 10 aa, Entamoeba invadens
ASDQSRACEE

SEQ ID NO: 3030658 - protein, 7 aa, Entamoeba invadens
ASDSPRL

SEQ ID NO: 3030659 - protein, 10 aa, Entamoeba invadens
ASEDNTGRSD

SEQ ID NO: 3030660 - protein, 4 aa, Entamoeba invadens
ASFD

SEQ ID NO: 3030661 - protein, 63 aa, Entamoeba invadens
ASFSSSGSGSYKTSVPSFTPPPPPRTPPVPAPRQRIPQQQLPESPRLSQTRTALHTPPTQRRP

SEQ ID NO: 3030662 - protein, 8 aa, Entamoeba invadens
ASGEERAI

SEQ ID NO: 3030663 - protein, 7 aa, Entamoeba invadens
ASGKPIQ

SEQ ID NO: 3030664 - protein, 9 aa, Entamoeba invadens
ASHYTTSPM

SEQ ID NO: 3030665 - protein, 19 aa, Entamoeba invadens
ASISNDGGSTWTAASRTAY

SEQ ID NO: 3030666 - protein, 14 aa, Entamoeba invadens
ASKDCSGTPTVQDA

SEQ ID NO: 3030667 - protein, 5 aa, Entamoeba invadens
ASKEC

SEQ ID NO: 3030668 - protein, 8 aa, Entamoeba invadens
ASKGTSIY

SEQ ID NO: 3030669 - protein, 7 aa, Entamoeba invadens
ASKNGWT

SEQ ID NO: 3030670 - protein, 5 aa, Entamoeba invadens
ASKSE

SEQ ID NO: 3030671 - protein, 17 aa, Entamoeba invadens
ASKTATGYKEGGGKEAI

SEQ ID NO: 3030672 - protein, 5 aa, Entamoeba invadens
ASKTL

SEQ ID NO: 3030673 - protein, 10 aa, Entamoeba invadens
ASLAVTPTQR

SEQ ID NO: 3030674 - protein, 4 aa, Entamoeba invadens
ASLT

SEQ ID NO: 3030675 - protein, 10 aa, Entamoeba invadens
ASNALGLTSA

SEQ ID NO: 3030676 - protein, 6 aa, Entamoeba invadens
ASNGER

SEQ ID NO: 3030677 - protein, 7 aa, Entamoeba invadens
ASNGERK

SEQ ID NO: 3030678 - protein, 11 aa, Entamoeba invadens
ASNHKAYANKA

SEQ ID NO: 3030679 - protein, 9 aa, Entamoeba invadens
ASNTGFTSY

SEQ ID NO: 3030680 - protein, 22 aa, Entamoeba invadens
ASPCEDSTRVGTGGNAKRQAVD

SEQ ID NO: 3030681 - protein, 7 aa, Entamoeba invadens
ASPIATS

SEQ ID NO: 3030682 - protein, 5 aa, Entamoeba invadens
ASPKD

SEQ ID NO: 3030683 - protein, 5 aa, Entamoeba invadens
ASPKH

SEQ ID NO: 3030684 - protein, 5 aa, Entamoeba invadens
ASPNE

SEQ ID NO: 3030685 - protein, 6 aa, Entamoeba invadens
ASPSDQ

SEQ ID NO: 3030686 - protein, 8 aa, Entamoeba invadens
ASPSSYCN

SEQ ID NO: 3030687 - protein, 8 aa, Entamoeba invadens
ASQQQVVR

SEQ ID NO: 3030688 - protein, 7 aa, Entamoeba invadens
ASQRGLC

SEQ ID NO: 3030689 - protein, 5 aa, Entamoeba invadens
ASRAV

SEQ ID NO: 3030690 - protein, 4 aa, Entamoeba invadens
ASRN

SEQ ID NO: 3030691 - protein, 8 aa, Entamoeba invadens
ASSCTDDT

SEQ ID NO: 3030692 - protein, 8 aa, Entamoeba invadens
ASSRMDTN

SEQ ID NO: 3030693 - protein, 4 aa, Entamoeba invadens
ASTD

SEQ ID NO: 3030694 - protein, 9 aa, Entamoeba invadens
ASTENFGTD

SEQ ID NO: 3030695 - protein, 8 aa, Entamoeba invadens
ASTKRTLK

SEQ ID NO: 3030696 - protein, 10 aa, Entamoeba invadens
ASWGKAYPGV

SEQ ID NO: 3030697 - protein, 4 aa, Entamoeba invadens
ASYE

SEQ ID NO: 3030698 - protein, 6 aa, Entamoeba invadens
ASYTQT

SEQ ID NO: 3030699 - protein, 7 aa, Entamoeba invadens
ASYTVET

SEQ ID NO: 3030700 - protein, 9 aa, Entamoeba invadens
ASYTYKDAA

SEQ ID NO: 3030701 - protein, 7 aa, Entamoeba invadens
ASYYPQT

SEQ ID NO: 3030702 - protein, 8 aa, Entamoeba invadens
ATAAAFPG

SEQ ID NO: 3030703 - protein, 10 aa, Entamoeba invadens
ATAEGVETEK

SEQ ID NO: 3030704 - protein, 8 aa, Entamoeba invadens
ATAQVNGL

SEQ ID NO: 3030705 - protein, 4 aa, Entamoeba invadens
ATAS

SEQ ID NO: 3030706 - protein, 15 aa, Entamoeba invadens
ATATQANSKMENEQR

SEQ ID NO: 3030707 - protein, 14 aa, Entamoeba invadens
ATCKTGKADKKSLR

SEQ ID NO: 3030708 - protein, 10 aa, Entamoeba invadens
ATCSGSSSTC

SEQ ID NO: 3030709 - protein, 25 aa, Entamoeba invadens
ATDKKSGKKEEITITSEKGRLSQDQ

SEQ ID NO: 3030710 - protein, 16 aa, Entamoeba invadens
ATDKLTGKLSDKIGDK

SEQ ID NO: 3030711 - protein, 6 aa, Entamoeba invadens
ATEEEI

SEQ ID NO: 3030712 - protein, 10 aa, Entamoeba invadens
ATEKVEEMNK

SEQ ID NO: 3030713 - protein, 4 aa, Entamoeba invadens
ATEM

SEQ ID NO: 3030714 - protein, 6 aa, Entamoeba invadens
ATENGK

SEQ ID NO: 3030715 - protein, 14 aa, Entamoeba invadens
ATENTPNNMDPKGL

SEQ ID NO: 3030716 - protein, 6 aa, Entamoeba invadens
ATETVD

SEQ ID NO: 3030717 - protein, 10 aa, Entamoeba invadens
ATGGGATDHS

SEQ ID NO: 3030718 - protein, 14 aa, Entamoeba invadens
ATGGPHNTAAPMPV

SEQ ID NO: 3030719 - protein, 10 aa, Entamoeba invadens
ATGSAQTQLT

SEQ ID NO: 3030720 - protein, 7 aa, Entamoeba invadens
ATIAKRN

SEQ ID NO: 3030721 - protein, 4 aa, Entamoeba invadens
ATID

SEQ ID NO: 3030722 - protein, 9 aa, Entamoeba invadens
ATIERRPQR

SEQ ID NO: 3030723 - protein, 17 aa, Entamoeba invadens
ATKDEKGSTKSKKIATT

SEQ ID NO: 3030724 - protein, 7 aa, Entamoeba invadens
ATKERDG

SEQ ID NO: 3030725 - protein, 9 aa, Entamoeba invadens
ATKKSCTKC

SEQ ID NO: 3030726 - protein, 7 aa, Entamoeba invadens
ATKPLRN

SEQ ID NO: 3030727 - protein, 19 aa, Entamoeba invadens
ATKQRKEMTSQKEEAEQKL

SEQ ID NO: 3030728 - protein, 7 aa, Entamoeba invadens
ATLRPQF

SEQ ID NO: 3030729 - protein, 4 aa, Entamoeba invadens
ATLS

SEQ ID NO: 3030730 - protein, 9 aa, Entamoeba invadens
ATMAYTSTH

SEQ ID NO: 3030731 - protein, 9 aa, Entamoeba invadens
ATNEQYYRP

SEQ ID NO: 3030732 - protein, 8 aa, Entamoeba invadens
ATNERLNN

SEQ ID NO: 3030733 - protein, 7 aa, Entamoeba invadens
ATNQERI

SEQ ID NO: 3030734 - protein, 12 aa, Entamoeba invadens
ATNSGNSETLKS

SEQ ID NO: 3030735 - protein, 8 aa, Entamoeba invadens
ATPRRRYN

SEQ ID NO: 3030736 - protein, 13 aa, Entamoeba invadens
ATQKEKEKQMNHE

SEQ ID NO: 3030737 - protein, 8 aa, Entamoeba invadens
ATQPGEFD

SEQ ID NO: 3030738 - protein, 13 aa, Entamoeba invadens
ATQQLTRSNTSGV

SEQ ID NO: 3030739 - protein, 8 aa, Entamoeba invadens
ATQQTTRI

SEQ ID NO: 3030740 - protein, 5 aa, Entamoeba invadens
ATRSP

SEQ ID NO: 3030741 - protein, 8 aa, Entamoeba invadens
ATSCTPCN

SEQ ID NO: 3030742 - protein, 7 aa, Entamoeba invadens
ATSINSS

SEQ ID NO: 3030743 - protein, 5 aa, Entamoeba invadens
ATTLA

SEQ ID NO: 3030744 - protein, 21 aa, Entamoeba invadens
ATTLEDNTEEFELEDKPKHAH

SEQ ID NO: 3030745 - protein, 4 aa, Entamoeba invadens
ATTR

SEQ ID NO: 3030746 - protein, 4 aa, Entamoeba invadens
ATVD

SEQ ID NO: 3030747 - protein, 6 aa, Entamoeba invadens
ATVSGY

SEQ ID NO: 3030748 - protein, 13 aa, Entamoeba invadens
ATYPQNNARTTTL

SEQ ID NO: 3030749 - protein, 6 aa, Entamoeba invadens
AVDDGY

SEQ ID NO: 3030750 - protein, 8 aa, Entamoeba invadens
AVDEEEAR

SEQ ID NO: 3030751 - protein, 8 aa, Entamoeba invadens
AVDPESNN

SEQ ID NO: 3030752 - protein, 41 aa, Entamoeba invadens
AVDPVEPSKPVEPSQPETPEKPLEPEKPVEPSKPIDPLVTS

SEQ ID NO: 3030753 - protein, 40 aa, Entamoeba invadens
AVEDDFEEDYDDDEYDDDEEEFDDDENEYDLGQNPAPYDD

SEQ ID NO: 3030754 - protein, 11 aa, Entamoeba invadens
AVESGNGTYIR

SEQ ID NO: 3030755 - protein, 12 aa, Entamoeba invadens
AVGAGKKVLTGQ

SEQ ID NO: 3030756 - protein, 6 aa, Entamoeba invadens
AVGDYR

SEQ ID NO: 3030757 - protein, 4 aa, Entamoeba invadens
AVGK

SEQ ID NO: 3030758 - protein, 4 aa, Entamoeba invadens
AVGS

SEQ ID NO: 3030759 - protein, 13 aa, Entamoeba invadens
AVGSQSGKTSQKV

SEQ ID NO: 3030760 - protein, 7 aa, Entamoeba invadens
AVNATKY

SEQ ID NO: 3030761 - protein, 10 aa, Entamoeba invadens
AVNGGFGYGG

SEQ ID NO: 3030762 - protein, 11 aa, Entamoeba invadens
AVNPTKNSEVA

SEQ ID NO: 3030763 - protein, 59 aa, Entamoeba invadens
AVQAKPSATPVQTKQEKKAAKKATKKQSKKQIKQMKEEKKALKAQKSQTKEAEKKAVAE

SEQ ID NO: 3030764 - protein, 5 aa, Entamoeba invadens
AVTPD

SEQ ID NO: 3030765 - protein, 9 aa, Entamoeba invadens
AYAAGYTKS

SEQ ID NO: 3030766 - protein, 8 aa, Entamoeba invadens
AYDKASEY

SEQ ID NO: 3030767 - protein, 7 aa, Entamoeba invadens
AYDNTSS

SEQ ID NO: 3030768 - protein, 5 aa, Entamoeba invadens
AYEDP

SEQ ID NO: 3030769 - protein, 7 aa, Entamoeba invadens
AYENDDV

SEQ ID NO: 3030770 - protein, 7 aa, Entamoeba invadens
AYGNPRT

SEQ ID NO: 3030771 - protein, 9 aa, Entamoeba invadens
AYGTRKMKS

SEQ ID NO: 3030772 - protein, 15 aa, Entamoeba invadens
AYKGAQSAGVARCGE

SEQ ID NO: 3030773 - protein, 10 aa, Entamoeba invadens
AYPTETTPFG

SEQ ID NO: 3030774 - protein, 10 aa, Entamoeba invadens
AYRSTSCPAG

SEQ ID NO: 3030775 - protein, 14 aa, Entamoeba invadens
CAAGTRSESTVSST

SEQ ID NO: 3030776 - protein, 16 aa, Entamoeba invadens
CADGTYANTTGSTSCK

SEQ ID NO: 3030777 - protein, 14 aa, Entamoeba invadens
CADGYYSTTGSSSC

SEQ ID NO: 3030778 - protein, 6 aa, Entamoeba invadens
CADNGV

SEQ ID NO: 3030779 - protein, 7 aa, Entamoeba invadens
CAGEDSC

SEQ ID NO: 3030780 - protein, 5 aa, Entamoeba invadens
CAPGT

SEQ ID NO: 3030781 - protein, 16 aa, Entamoeba invadens
CAPNTRCAKEGRTPFG

SEQ ID NO: 3030782 - protein, 5 aa, Entamoeba invadens
CAPSG

SEQ ID NO: 3030783 - protein, 6 aa, Entamoeba invadens
CARQRD

SEQ ID NO: 3030784 - protein, 7 aa, Entamoeba invadens
CATEKSW

SEQ ID NO: 3030785 - protein, 30 aa, Entamoeba invadens
CATGDYSLGGSSGCTACSTSCKTCDQTNGN

SEQ ID NO: 3030786 - protein, 13 aa, Entamoeba invadens
CATGKCSSTGCTQ

SEQ ID NO: 3030787 - protein, 8 aa, Entamoeba invadens
CATNGSRA

SEQ ID NO: 3030788 - protein, 6 aa, Entamoeba invadens
CATQTD

SEQ ID NO: 3030789 - protein, 15 aa, Entamoeba invadens
CATTGSTSSRVRRDG

SEQ ID NO: 3030790 - protein, 6 aa, Entamoeba invadens
CDANGQ

SEQ ID NO: 3030791 - protein, 20 aa, Entamoeba invadens
CDATNTNITKESVNTYPDCQ

SEQ ID NO: 3030792 - protein, 9 aa, Entamoeba invadens
CDDGTDERY

SEQ ID NO: 3030793 - protein, 5 aa, Entamoeba invadens
CDDQK

SEQ ID NO: 3030794 - protein, 11 aa, Entamoeba invadens
CDDRTAQDTPY

SEQ ID NO: 3030795 - protein, 7 aa, Entamoeba invadens
CDDSTNL

SEQ ID NO: 3030796 - protein, 140 aa, Entamoeba invadens
CDEKSGGHCHSEESYERSEEKSHEKSHECSYEKSTESSEVKSEESKQCSHECSKEKSTESSEEKSHECSYEKSEEHSKSSSEVKSEEKSKEKSEESKQSSETKSEEKSKECSNEKSKEKSEEKSEEKSKEKSCNEKSEST

SEQ ID NO: 3030797 - protein, 17 aa, Entamoeba invadens
CDEKSKELTEKADEYKE

SEQ ID NO: 3030798 - protein, 8 aa, Entamoeba invadens
CDENGNCN

SEQ ID NO: 3030799 - protein, 12 aa, Entamoeba invadens
CDEPNDKLCEKE

SEQ ID NO: 3030800 - protein, 14 aa, Entamoeba invadens
CDGASQYQMFIPLY

SEQ ID NO: 3030801 - protein, 5 aa, Entamoeba invadens
CDGRE

SEQ ID NO: 3030802 - protein, 11 aa, Entamoeba invadens
CDKDDKCTKCK

SEQ ID NO: 3030803 - protein, 10 aa, Entamoeba invadens
CDKKTGQCTS

SEQ ID NO: 3030804 - protein, 16 aa, Entamoeba invadens
CDKTCKTGKANKDTMK

SEQ ID NO: 3030805 - protein, 7 aa, Entamoeba invadens
CDNSNNL

SEQ ID NO: 3030806 - protein, 15 aa, Entamoeba invadens
CDPTDNKCKGGHPSN

SEQ ID NO: 3030807 - protein, 14 aa, Entamoeba invadens
CDPYEPRQMFVPVF

SEQ ID NO: 3030808 - protein, 18 aa, Entamoeba invadens
CDQEGGSAPIDPPTPTCK

SEQ ID NO: 3030809 - protein, 10 aa, Entamoeba invadens
CDRCENNATS

SEQ ID NO: 3030810 - protein, 6 aa, Entamoeba invadens
CDRNKD

SEQ ID NO: 3030811 - protein, 7 aa, Entamoeba invadens
CDSPTRL

SEQ ID NO: 3030812 - protein, 7 aa, Entamoeba invadens
CDSSDYS

SEQ ID NO: 3030813 - protein, 5 aa, Entamoeba invadens
CDSTC

SEQ ID NO: 3030814 - protein, 7 aa, Entamoeba invadens
CDTKTDL

SEQ ID NO: 3030815 - protein, 14 aa, Entamoeba invadens
CEAGTRANQTTNTC

SEQ ID NO: 3030816 - protein, 10 aa, Entamoeba invadens
CEDAADKCNT

SEQ ID NO: 3030817 - protein, 28 aa, Entamoeba invadens
CEDGSESCDSTIPPPFPPKDGSDVPLGS

SEQ ID NO: 3030818 - protein, 5 aa, Entamoeba invadens
CEDVG

SEQ ID NO: 3030819 - protein, 7 aa, Entamoeba invadens
CEECEND

SEQ ID NO: 3030820 - protein, 5 aa, Entamoeba invadens
CEEGK

SEQ ID NO: 3030821 - protein, 8 aa, Entamoeba invadens
CEGEKSPL

SEQ ID NO: 3030822 - protein, 9 aa, Entamoeba invadens
CEGGGSRSC

SEQ ID NO: 3030823 - protein, 12 aa, Entamoeba invadens
CEGQSTGQGDVN

SEQ ID NO: 3030824 - protein, 6 aa, Entamoeba invadens
CEGTNV

SEQ ID NO: 3030825 - protein, 21 aa, Entamoeba invadens
CEKCDDKCKNGCVNKGSECSL

SEQ ID NO: 3030826 - protein, 9 aa, Entamoeba invadens
CEKCDETKC

SEQ ID NO: 3030827 - protein, 5 aa, Entamoeba invadens
CEKCE

SEQ ID NO: 3030828 - protein, 12 aa, Entamoeba invadens
CELSDKDGHPQE

SEQ ID NO: 3030829 - protein, 9 aa, Entamoeba invadens
CENGEYPNN

SEQ ID NO: 3030830 - protein, 17 aa, Entamoeba invadens
CENRDNCTKYNTAGECT

SEQ ID NO: 3030831 - protein, 10 aa, Entamoeba invadens
CEPGQLTPEG

SEQ ID NO: 3030832 - protein, 7 aa, Entamoeba invadens
CEQCETG

SEQ ID NO: 3030833 - protein, 12 aa, Entamoeba invadens
CEQNKNTENTNQ

SEQ ID NO: 3030834 - protein, 9 aa, Entamoeba invadens
CESCTSSTK

SEQ ID NO: 3030835 - protein, 5 aa, Entamoeba invadens
CESDT

SEQ ID NO: 3030836 - protein, 4 aa, Entamoeba invadens
CESE

SEQ ID NO: 3030837 - protein, 15 aa, Entamoeba invadens
CESNGCNTVTGECQT

SEQ ID NO: 3030838 - protein, 10 aa, Entamoeba invadens
CESSQLTPEG

SEQ ID NO: 3030839 - protein, 26 aa, Entamoeba invadens
CETCPGGNEKKCTTCKTTNTYPSLDT

SEQ ID NO: 3030840 - protein, 7 aa, Entamoeba invadens
CETKHPN

SEQ ID NO: 3030841 - protein, 24 aa, Entamoeba invadens
CETVDSDESKCASKSACKSTNNGK

SEQ ID NO: 3030842 - protein, 13 aa, Entamoeba invadens
CETVGKGEQCTKC

SEQ ID NO: 3030843 - protein, 13 aa, Entamoeba invadens
CETVGTAEQCTKC

SEQ ID NO: 3030844 - protein, 4 aa, Entamoeba invadens
CEVK

SEQ ID NO: 3030845 - protein, 9 aa, Entamoeba invadens
CEYGTTSNC

SEQ ID NO: 3030846 - protein, 12 aa, Entamoeba invadens
CFESDGKECTSC

SEQ ID NO: 3030847 - protein, 10 aa, Entamoeba invadens
CFETSKQPTL

SEQ ID NO: 3030848 - protein, 5 aa, Entamoeba invadens
CGAGT

SEQ ID NO: 3030849 - protein, 8 aa, Entamoeba invadens
CGEKNGIH

SEQ ID NO: 3030850 - protein, 9 aa, Entamoeba invadens
CGETSGNYN

SEQ ID NO: 3030851 - protein, 10 aa, Entamoeba invadens
CGGSCNTQNG

SEQ ID NO: 3030852 - protein, 14 aa, Entamoeba invadens
CGPTGADGFDGTQT

SEQ ID NO: 3030853 - protein, 11 aa, Entamoeba invadens
CGRKEYCSEEG

SEQ ID NO: 3030854 - protein, 10 aa, Entamoeba invadens
CGRVTKPSPL

SEQ ID NO: 3030855 - protein, 18 aa, Entamoeba invadens
CGSNGADGQMGPSTKAAI

SEQ ID NO: 3030856 - protein, 11 aa, Entamoeba invadens
CGSNGCSNKTN

SEQ ID NO: 3030857 - protein, 15 aa, Entamoeba invadens
CGSSGADGFNGPSTV

SEQ ID NO: 3030858 - protein, 6 aa, Entamoeba invadens
CGSSKR

SEQ ID NO: 3030859 - protein, 7 aa, Entamoeba invadens
CGSSSFN

SEQ ID NO: 3030860 - protein, 12 aa, Entamoeba invadens
CGSTTGKCTSCS

SEQ ID NO: 3030861 - protein, 5 aa, Entamoeba invadens
CGSVS

SEQ ID NO: 3030862 - protein, 14 aa, Entamoeba invadens
CGTGCGTCSSASAC

SEQ ID NO: 3030863 - protein, 12 aa, Entamoeba invadens
CGYHSDDGSIYK

SEQ ID NO: 3030864 - protein, 13 aa, Entamoeba invadens
CGYKGKVPNEESP

SEQ ID NO: 3030865 - protein, 13 aa, Entamoeba invadens
CGYTDGYYRVTAN

SEQ ID NO: 3030866 - protein, 9 aa, Entamoeba invadens
CHGSGGEME

SEQ ID NO: 3030867 - protein, 10 aa, Entamoeba invadens
CHNTNNQDFS

SEQ ID NO: 3030868 - protein, 13 aa, Entamoeba invadens
CIGNGQKEYGYNP

SEQ ID NO: 3030869 - protein, 8 aa, Entamoeba invadens
CIPSPTNP

SEQ ID NO: 3030870 - protein, 7 aa, Entamoeba invadens
CKADQTT

SEQ ID NO: 3030871 - protein, 16 aa, Entamoeba invadens
CKAGSCQSTGKCDTCA

SEQ ID NO: 3030872 - protein, 12 aa, Entamoeba invadens
CKANTCDSTSGY

SEQ ID NO: 3030873 - protein, 5 aa, Entamoeba invadens
CKCTR

SEQ ID NO: 3030874 - protein, 11 aa, Entamoeba invadens
CKDGIKMDTNS

SEQ ID NO: 3030875 - protein, 7 aa, Entamoeba invadens
CKDGQYT

SEQ ID NO: 3030876 - protein, 21 aa, Entamoeba invadens
CKECSSATTCTSCSDGYYLNG

SEQ ID NO: 3030877 - protein, 11 aa, Entamoeba invadens
CKEETQGHIDE

SEQ ID NO: 3030878 - protein, 5 aa, Entamoeba invadens
CKEFS

SEQ ID NO: 3030879 - protein, 13 aa, Entamoeba invadens
CKGCTHNSTTCTS

SEQ ID NO: 3030880 - protein, 12 aa, Entamoeba invadens
CKGEQDKPYETN

SEQ ID NO: 3030881 - protein, 8 aa, Entamoeba invadens
CKGPGANN

SEQ ID NO: 3030882 - protein, 10 aa, Entamoeba invadens
CKHSTTHTAN

SEQ ID NO: 3030883 - protein, 10 aa, Entamoeba invadens
CKIKESEARP

SEQ ID NO: 3030884 - protein, 12 aa, Entamoeba invadens
CKISEKGGHPLE

SEQ ID NO: 3030885 - protein, 23 aa, Entamoeba invadens
CKKATKAQKAKKQMFGGKKETEK

SEQ ID NO: 3030886 - protein, 17 aa, Entamoeba invadens
CKKCGDKCQKCHNKTSC

SEQ ID NO: 3030887 - protein, 7 aa, Entamoeba invadens
CKNEGNY

SEQ ID NO: 3030888 - protein, 11 aa, Entamoeba invadens
CKNERIPDSPV

SEQ ID NO: 3030889 - protein, 12 aa, Entamoeba invadens
CKRCATKKDCEE

SEQ ID NO: 3030890 - protein, 16 aa, Entamoeba invadens
CKSCPNGKSSKDGVTD

SEQ ID NO: 3030891 - protein, 8 aa, Entamoeba invadens
CKSCTNEG

SEQ ID NO: 3030892 - protein, 7 aa, Entamoeba invadens
CKSGEQV

SEQ ID NO: 3030893 - protein, 5 aa, Entamoeba invadens
CKSKY

SEQ ID NO: 3030894 - protein, 10 aa, Entamoeba invadens
CKSNDERDTK

SEQ ID NO: 3030895 - protein, 10 aa, Entamoeba invadens
CKSNPEARDD

SEQ ID NO: 3030896 - protein, 4 aa, Entamoeba invadens
CKTC

SEQ ID NO: 3030897 - protein, 11 aa, Entamoeba invadens
CKTCDSKTGSC

SEQ ID NO: 3030898 - protein, 11 aa, Entamoeba invadens
CKTCNGPNANN

SEQ ID NO: 3030899 - protein, 7 aa, Entamoeba invadens
CKTCNSK

SEQ ID NO: 3030900 - protein, 14 aa, Entamoeba invadens
CKTCSDGTTCNACD

SEQ ID NO: 3030901 - protein, 11 aa, Entamoeba invadens
CKTCTSETECT

SEQ ID NO: 3030902 - protein, 7 aa, Entamoeba invadens
CKTINSE

SEQ ID NO: 3030903 - protein, 14 aa, Entamoeba invadens
CKTPSAAMTKHNSK

SEQ ID NO: 3030904 - protein, 4 aa, Entamoeba invadens
CKTS

SEQ ID NO: 3030905 - protein, 8 aa, Entamoeba invadens
CKTYSEDG

SEQ ID NO: 3030906 - protein, 5 aa, Entamoeba invadens
CLPTC

SEQ ID NO: 3030907 - protein, 14 aa, Entamoeba invadens
CMTAPSNNIRDSTD

SEQ ID NO: 3030908 - protein, 6 aa, Entamoeba invadens
CNAAAG

SEQ ID NO: 3030909 - protein, 11 aa, Entamoeba invadens
CNAEKGFGRCD

SEQ ID NO: 3030910 - protein, 7 aa, Entamoeba invadens
CNATNGK

SEQ ID NO: 3030911 - protein, 16 aa, Entamoeba invadens
CNDKCKTCNPTNTNNC

SEQ ID NO: 3030912 - protein, 22 aa, Entamoeba invadens
CNDNQTKKDDRCKESSDSESWG

SEQ ID NO: 3030913 - protein, 11 aa, Entamoeba invadens
CNECNGAESTN

SEQ ID NO: 3030914 - protein, 8 aa, Entamoeba invadens
CNENRKYD

SEQ ID NO: 3030915 - protein, 10 aa, Entamoeba invadens
CNGCASGYSL

SEQ ID NO: 3030916 - protein, 11 aa, Entamoeba invadens
CNGSCNTRNGY

SEQ ID NO: 3030917 - protein, 8 aa, Entamoeba invadens
CNGTEPNN

SEQ ID NO: 3030918 - protein, 9 aa, Entamoeba invadens
CNKGTSREL

SEQ ID NO: 3030919 - protein, 7 aa, Entamoeba invadens
CNKTQNC

SEQ ID NO: 3030920 - protein, 7 aa, Entamoeba invadens
CNNPSSI

SEQ ID NO: 3030921 - protein, 5 aa, Entamoeba invadens
CNPEN

SEQ ID NO: 3030922 - protein, 6 aa, Entamoeba invadens
CNPKNG

SEQ ID NO: 3030923 - protein, 13 aa, Entamoeba invadens
CNPTSSETCTKCR

SEQ ID NO: 3030924 - protein, 6 aa, Entamoeba invadens
CNPTVT

SEQ ID NO: 3030925 - protein, 7 aa, Entamoeba invadens
CNPTVTD

SEQ ID NO: 3030926 - protein, 8 aa, Entamoeba invadens
CNPTVTDK

SEQ ID NO: 3030927 - protein, 14 aa, Entamoeba invadens
CNQDTHKGACNTNE

SEQ ID NO: 3030928 - protein, 5 aa, Entamoeba invadens
CNRCS

SEQ ID NO: 3030929 - protein, 28 aa, Entamoeba invadens
CNSCDESTGACSSCSTNNVFSESDNKTC

SEQ ID NO: 3030930 - protein, 7 aa, Entamoeba invadens
CNSCSSN

SEQ ID NO: 3030931 - protein, 16 aa, Entamoeba invadens
CNSYDEASISLTKNDQ

SEQ ID NO: 3030932 - protein, 5 aa, Entamoeba invadens
CNTCG

SEQ ID NO: 3030933 - protein, 11 aa, Entamoeba invadens
CNTCTGPNNGS

SEQ ID NO: 3030934 - protein, 13 aa, Entamoeba invadens
CNTNNSLKDGKCE

SEQ ID NO: 3030935 - protein, 6 aa, Entamoeba invadens
CNTQTG

SEQ ID NO: 3030936 - protein, 7 aa, Entamoeba invadens
CNTQTGY

SEQ ID NO: 3030937 - protein, 5 aa, Entamoeba invadens
CNTTA

SEQ ID NO: 3030938 - protein, 5 aa, Entamoeba invadens
CNTTD

SEQ ID NO: 3030939 - protein, 10 aa, Entamoeba invadens
CNYGPRTDPV

SEQ ID NO: 3030940 - protein, 30 aa, Entamoeba invadens
CPAGQTSNVRSSACTNCTDGYYSNSGDQTC

SEQ ID NO: 3030941 - protein, 13 aa, Entamoeba invadens
CPAGQYADTTNNN

SEQ ID NO: 3030942 - protein, 5 aa, Entamoeba invadens
CPAGT

SEQ ID NO: 3030943 - protein, 11 aa, Entamoeba invadens
CPANEANPGCH

SEQ ID NO: 3030944 - protein, 12 aa, Entamoeba invadens
CPEGYKTDKINE

SEQ ID NO: 3030945 - protein, 13 aa, Entamoeba invadens
CPEGYNTDKTNKK

SEQ ID NO: 3030946 - protein, 13 aa, Entamoeba invadens
CPPNMERKEGRKC

SEQ ID NO: 3030947 - protein, 15 aa, Entamoeba invadens
CPPNTINDDGLSNEC

SEQ ID NO: 3030948 - protein, 7 aa, Entamoeba invadens
CPSDPTT

SEQ ID NO: 3030949 - protein, 133 aa, Entamoeba invadens
CPSGSYSNSGSSSCTKCSPGSYALSSGSSSCTQCSTGKYASSTGSTSCSTCSAGTYSSTGASKCTKCSAGSYSSSGASSCSTCSAGTYSSSGSSKCTSCNAGSYSSLGSPSCTQCTAGTHSNSTGASSCNPCN

SEQ ID NO: 3030950 - protein, 11 aa, Entamoeba invadens
CPSPLYSDNST

SEQ ID NO: 3030951 - protein, 4 aa, Entamoeba invadens
CPTE

SEQ ID NO: 3030952 - protein, 11 aa, Entamoeba invadens
CPTGQATNGNN

SEQ ID NO: 3030953 - protein, 9 aa, Entamoeba invadens
CQDPKDGSF

SEQ ID NO: 3030954 - protein, 4 aa, Entamoeba invadens
CQEG

SEQ ID NO: 3030955 - protein, 11 aa, Entamoeba invadens
CQENDPENVTK

SEQ ID NO: 3030956 - protein, 7 aa, Entamoeba invadens
CQGDASP

SEQ ID NO: 3030957 - protein, 22 aa, Entamoeba invadens
CQGTETIENYNEGECTQKTENH

SEQ ID NO: 3030958 - protein, 8 aa, Entamoeba invadens
CQKQEPSL

SEQ ID NO: 3030959 - protein, 5 aa, Entamoeba invadens
CQKST

SEQ ID NO: 3030960 - protein, 4 aa, Entamoeba invadens
CQPA

SEQ ID NO: 3030961 - protein, 4 aa, Entamoeba invadens
CQQC

SEQ ID NO: 3030962 - protein, 10 aa, Entamoeba invadens
CQQNECNAAN

SEQ ID NO: 3030963 - protein, 6 aa, Entamoeba invadens
CQSPTL

SEQ ID NO: 3030964 - protein, 6 aa, Entamoeba invadens
CQTCDE

SEQ ID NO: 3030965 - protein, 4 aa, Entamoeba invadens
CQTS

SEQ ID NO: 3030966 - protein, 8 aa, Entamoeba invadens
CRGSTCRR

SEQ ID NO: 3030967 - protein, 6 aa, Entamoeba invadens
CRNREA

SEQ ID NO: 3030968 - protein, 7 aa, Entamoeba invadens
CRNSTCP

SEQ ID NO: 3030969 - protein, 11 aa, Entamoeba invadens
CRSCNGPNSNN

SEQ ID NO: 3030970 - protein, 11 aa, Entamoeba invadens
CRSTQSSFEGL

SEQ ID NO: 3030971 - protein, 11 aa, Entamoeba invadens
CRTCNGTGSDN

SEQ ID NO: 3030972 - protein, 12 aa, Entamoeba invadens
CSAGTYQSGGSC

SEQ ID NO: 3030973 - protein, 11 aa, Entamoeba invadens
CSAGTYSPGGI

SEQ ID NO: 3030974 - protein, 6 aa, Entamoeba invadens
CSDKAS

SEQ ID NO: 3030975 - protein, 55 aa, Entamoeba invadens
CSDSNSLSQLQSAATAAGHSEWGKASPSNAGTYNSKPPSSTGFFGSGSDNYKSEY

SEQ ID NO: 3030976 - protein, 16 aa, Entamoeba invadens
CSDTQYVNKENKECFE

SEQ ID NO: 3030977 - protein, 8 aa, Entamoeba invadens
CSEEPINN

SEQ ID NO: 3030978 - protein, 12 aa, Entamoeba invadens
CSEGGKTAEGKC

SEQ ID NO: 3030979 - protein, 6 aa, Entamoeba invadens
CSEGYY

SEQ ID NO: 3030980 - protein, 11 aa, Entamoeba invadens
CSENNGCNGGF

SEQ ID NO: 3030981 - protein, 5 aa, Entamoeba invadens
CSFGG

SEQ ID NO: 3030982 - protein, 33 aa, Entamoeba invadens
CSGDKACHNNTCQDTKCGDGVCEGKESCSTCPG

SEQ ID NO: 3030983 - protein, 15 aa, Entamoeba invadens
CSGVSTTSTVQNEGI

SEQ ID NO: 3030984 - protein, 14 aa, Entamoeba invadens
CSIPNDQNGRCSSP

SEQ ID NO: 3030985 - protein, 22 aa, Entamoeba invadens
CSKCTPMDTSSSSILPADQRYD

SEQ ID NO: 3030986 - protein, 7 aa, Entamoeba invadens
CSKSDTC

SEQ ID NO: 3030987 - protein, 8 aa, Entamoeba invadens
CSKTTKTC

SEQ ID NO: 3030988 - protein, 87 aa, Entamoeba invadens
CSLKPGDYFESSETPDLPDESSSAAPPKPESSEEPTPESSSKPPEPPEESSSEPQKPESSEEPKPEESSEKPQSSSEQEESSEENIE

SEQ ID NO: 3030989 - protein, 11 aa, Entamoeba invadens
CSNANTCSGCT

SEQ ID NO: 3030990 - protein, 5 aa, Entamoeba invadens
CSNCK

SEQ ID NO: 3030991 - protein, 6 aa, Entamoeba invadens
CSNDSE

SEQ ID NO: 3030992 - protein, 6 aa, Entamoeba invadens
CSNESY

SEQ ID NO: 3030993 - protein, 15 aa, Entamoeba invadens
CSNGYSSNEGSSSCY

SEQ ID NO: 3030994 - protein, 14 aa, Entamoeba invadens
CSNNAATQYFVPIF

SEQ ID NO: 3030995 - protein, 36 aa, Entamoeba invadens
CSNTKCKTCASNPTSGCDSCPTGKVLQSDKKDCIDK

SEQ ID NO: 3030996 - protein, 10 aa, Entamoeba invadens
CSNVTLENND

SEQ ID NO: 3030997 - protein, 5 aa, Entamoeba invadens
CSPDF

SEQ ID NO: 3030998 - protein, 4 aa, Entamoeba invadens
CSPL

SEQ ID NO: 3030999 - protein, 16 aa, Entamoeba invadens
CSPQSELTSCANKTTA

SEQ ID NO: 3031000 - protein, 6 aa, Entamoeba invadens
CSPSSY

SEQ ID NO: 3031001 - protein, 5 aa, Entamoeba invadens
CSQPQ

SEQ ID NO: 3031002 - protein, 5 aa, Entamoeba invadens
CSQTG

SEQ ID NO: 3031003 - protein, 7 aa, Entamoeba invadens
CSQVEPG

SEQ ID NO: 3031004 - protein, 5 aa, Entamoeba invadens
CSRCN

SEQ ID NO: 3031005 - protein, 8 aa, Entamoeba invadens
CSRQNGEK

SEQ ID NO: 3031006 - protein, 5 aa, Entamoeba invadens
CSSAF

SEQ ID NO: 3031007 - protein, 17 aa, Entamoeba invadens
CSSCKTTCKTCDSTNGD

SEQ ID NO: 3031008 - protein, 12 aa, Entamoeba invadens
CSSCSNLDTDTC

SEQ ID NO: 3031009 - protein, 4 aa, Entamoeba invadens
CSSD

SEQ ID NO: 3031010 - protein, 23 aa, Entamoeba invadens
CSSDQYTINSETPTKCQKCTDYD

SEQ ID NO: 3031011 - protein, 6 aa, Entamoeba invadens
CSSKDK

SEQ ID NO: 3031012 - protein, 6 aa, Entamoeba invadens
CSSNGN

SEQ ID NO: 3031013 - protein, 36 aa, Entamoeba invadens
CSSNNGQFSCSSNDISMKASAEESRWQTPPRGSPDW

SEQ ID NO: 3031014 - protein, 4 aa, Entamoeba invadens
CSSP

SEQ ID NO: 3031015 - protein, 5 aa, Entamoeba invadens
CSSQK

SEQ ID NO: 3031016 - protein, 10 aa, Entamoeba invadens
CSSQSYQSEL

SEQ ID NO: 3031017 - protein, 14 aa, Entamoeba invadens
CSSQYTPAITQPSK

SEQ ID NO: 3031018 - protein, 9 aa, Entamoeba invadens
CSSQYTPVI

SEQ ID NO: 3031019 - protein, 7 aa, Entamoeba invadens
CSSSIQN

SEQ ID NO: 3031020 - protein, 6 aa, Entamoeba invadens
CSSTTG

SEQ ID NO: 3031021 - protein, 7 aa, Entamoeba invadens
CSTCGTD

SEQ ID NO: 3031022 - protein, 8 aa, Entamoeba invadens
CSTENDRN

SEQ ID NO: 3031023 - protein, 4 aa, Entamoeba invadens
CSTK

SEQ ID NO: 3031024 - protein, 6 aa, Entamoeba invadens
CSTPPT

SEQ ID NO: 3031025 - protein, 6 aa, Entamoeba invadens
CSTSQQ

SEQ ID NO: 3031026 - protein, 5 aa, Entamoeba invadens
CSTTS

SEQ ID NO: 3031027 - protein, 10 aa, Entamoeba invadens
CSTYTKKDQC

SEQ ID NO: 3031028 - protein, 10 aa, Entamoeba invadens
CSYTENSKVI

SEQ ID NO: 3031029 - protein, 17 aa, Entamoeba invadens
CTACTNGCSKCTDAKTC

SEQ ID NO: 3031030 - protein, 5 aa, Entamoeba invadens
CTALP

SEQ ID NO: 3031031 - protein, 16 aa, Entamoeba invadens
CTATNKCTIPKGSSYI

SEQ ID NO: 3031032 - protein, 4 aa, Entamoeba invadens
CTDG

SEQ ID NO: 3031033 - protein, 18 aa, Entamoeba invadens
CTDKCKNGFYKNGSTCEK

SEQ ID NO: 3031034 - protein, 8 aa, Entamoeba invadens
CTEAACSE

SEQ ID NO: 3031035 - protein, 28 aa, Entamoeba invadens
CTEKSCESSQDTSDDRSAAIEDKSTDLK

SEQ ID NO: 3031036 - protein, 6 aa, Entamoeba invadens
CTEQQN

SEQ ID NO: 3031037 - protein, 6 aa, Entamoeba invadens
CTESDN

SEQ ID NO: 3031038 - protein, 11 aa, Entamoeba invadens
CTGDAKTSLTF

SEQ ID NO: 3031039 - protein, 6 aa, Entamoeba invadens
CTKCTT

SEQ ID NO: 3031040 - protein, 17 aa, Entamoeba invadens
CTKCTTGCSKCSDATKC

SEQ ID NO: 3031041 - protein, 21 aa, Entamoeba invadens
CTKDDECDPTNSTIDSEDGKI

SEQ ID NO: 3031042 - protein, 6 aa, Entamoeba invadens
CTNCKD

SEQ ID NO: 3031043 - protein, 17 aa, Entamoeba invadens
CTNCTDGYYSNSGDKKC

SEQ ID NO: 3031044 - protein, 5 aa, Entamoeba invadens
CTNSE

SEQ ID NO: 3031045 - protein, 14 aa, Entamoeba invadens
CTNTTNAPNVNWGL

SEQ ID NO: 3031046 - protein, 10 aa, Entamoeba invadens
CTPAGTDDAA

SEQ ID NO: 3031047 - protein, 10 aa, Entamoeba invadens
CTPNSSYLDG

SEQ ID NO: 3031048 - protein, 20 aa, Entamoeba invadens
CTQTKNKYCDAVNSNSGSPE

SEQ ID NO: 3031049 - protein, 4 aa, Entamoeba invadens
CTRS

SEQ ID NO: 3031050 - protein, 10 aa, Entamoeba invadens
CTSCEKGTNR

SEQ ID NO: 3031051 - protein, 11 aa, Entamoeba invadens
CTSCNADYTKC

SEQ ID NO: 3031052 - protein, 11 aa, Entamoeba invadens
CTSCNSKYSNN

SEQ ID NO: 3031053 - protein, 8 aa, Entamoeba invadens
CTSGPNKC

SEQ ID NO: 3031054 - protein, 6 aa, Entamoeba invadens
CTSKER

SEQ ID NO: 3031055 - protein, 6 aa, Entamoeba invadens
CTSNGN

SEQ ID NO: 3031056 - protein, 18 aa, Entamoeba invadens
CTSPYTDAEVQKTIDNDA

SEQ ID NO: 3031057 - protein, 8 aa, Entamoeba invadens
CTSTCTSD

SEQ ID NO: 3031058 - protein, 8 aa, Entamoeba invadens
CTTCSSDF

SEQ ID NO: 3031059 - protein, 10 aa, Entamoeba invadens
CTTGCNGQTG

SEQ ID NO: 3031060 - protein, 11 aa, Entamoeba invadens
CTTGKSVDTPI

SEQ ID NO: 3031061 - protein, 10 aa, Entamoeba invadens
CTTIDQSLPE

SEQ ID NO: 3031062 - protein, 5 aa, Entamoeba invadens
CTTKG

SEQ ID NO: 3031063 - protein, 10 aa, Entamoeba invadens
CTTNNKDNVR

SEQ ID NO: 3031064 - protein, 21 aa, Entamoeba invadens
CTTNSNQVTKSATTSSVDGSY

SEQ ID NO: 3031065 - protein, 10 aa, Entamoeba invadens
CTTPDKYDKP

SEQ ID NO: 3031066 - protein, 20 aa, Entamoeba invadens
CTTQTKTFNDYGDESSDEKR

SEQ ID NO: 3031067 - protein, 4 aa, Entamoeba invadens
CTTR

SEQ ID NO: 3031068 - protein, 10 aa, Entamoeba invadens
CTVDGNSIDV

SEQ ID NO: 3031069 - protein, 13 aa, Entamoeba invadens
CTVNENSCKYKDD

SEQ ID NO: 3031070 - protein, 8 aa, Entamoeba invadens
CVDASKDR

SEQ ID NO: 3031071 - protein, 8 aa, Entamoeba invadens
CVKNETNK

SEQ ID NO: 3031072 - protein, 11 aa, Entamoeba invadens
CVNKEEQDRLK

SEQ ID NO: 3031073 - protein, 4 aa, Entamoeba invadens
CVSN

SEQ ID NO: 3031074 - protein, 7 aa, Entamoeba invadens
CVTRNDE

SEQ ID NO: 3031075 - protein, 9 aa, Entamoeba invadens
CYDPKTDKI

SEQ ID NO: 3031076 - protein, 9 aa, Entamoeba invadens
CYYDGDNTY

SEQ ID NO: 3031077 - protein, 9 aa, Entamoeba invadens
DAAEVTSKS

SEQ ID NO: 3031078 - protein, 7 aa, Entamoeba invadens
DAAGQVS

SEQ ID NO: 3031079 - protein, 6 aa, Entamoeba invadens
DADEQK

SEQ ID NO: 3031080 - protein, 7 aa, Entamoeba invadens
DADKGRV

SEQ ID NO: 3031081 - protein, 7 aa, Entamoeba invadens
DADNQDL

SEQ ID NO: 3031082 - protein, 10 aa, Entamoeba invadens
DADNRSTIQT

SEQ ID NO: 3031083 - protein, 5 aa, Entamoeba invadens
DAEDL

SEQ ID NO: 3031084 - protein, 10 aa, Entamoeba invadens
DAEEKKPKTF

SEQ ID NO: 3031085 - protein, 4 aa, Entamoeba invadens
DAGA

SEQ ID NO: 3031086 - protein, 13 aa, Entamoeba invadens
DAGYEVTAANGKT

SEQ ID NO: 3031087 - protein, 6 aa, Entamoeba invadens
DAGYNT

SEQ ID NO: 3031088 - protein, 8 aa, Entamoeba invadens
DAKSCEEC

SEQ ID NO: 3031089 - protein, 14 aa, Entamoeba invadens
DALDELSEYTDDDF

SEQ ID NO: 3031090 - protein, 5 aa, Entamoeba invadens
DAMKN

SEQ ID NO: 3031091 - protein, 5 aa, Entamoeba invadens
DANEN

SEQ ID NO: 3031092 - protein, 13 aa, Entamoeba invadens
DANRQYKLGSPFG

SEQ ID NO: 3031093 - protein, 4 aa, Entamoeba invadens
DANV

SEQ ID NO: 3031094 - protein, 9 aa, Entamoeba invadens
DAPGYSVEG

SEQ ID NO: 3031095 - protein, 9 aa, Entamoeba invadens
DAPNIKDYE

SEQ ID NO: 3031096 - protein, 6 aa, Entamoeba invadens
DAPNNT

SEQ ID NO: 3031097 - protein, 13 aa, Entamoeba invadens
DAPPGYDLRPTRQ

SEQ ID NO: 3031098 - protein, 18 aa, Entamoeba invadens
DAPSYEQIAEQQRKELSD

SEQ ID NO: 3031099 - protein, 9 aa, Entamoeba invadens
DAQNPQPMR

SEQ ID NO: 3031100 - protein, 14 aa, Entamoeba invadens
DAQNQNKRSENRTY

SEQ ID NO: 3031101 - protein, 14 aa, Entamoeba invadens
DAQRQATKDAGTIA

SEQ ID NO: 3031102 - protein, 7 aa, Entamoeba invadens
DARHYDG

SEQ ID NO: 3031103 - protein, 8 aa, Entamoeba invadens
DARNNSDI

SEQ ID NO: 3031104 - protein, 8 aa, Entamoeba invadens
DARSKKVT

SEQ ID NO: 3031105 - protein, 9 aa, Entamoeba invadens
DASGYTVEG

SEQ ID NO: 3031106 - protein, 5 aa, Entamoeba invadens
DASNE

SEQ ID NO: 3031107 - protein, 8 aa, Entamoeba invadens
DASNPSFQ

SEQ ID NO: 3031108 - protein, 6 aa, Entamoeba invadens
DASRAS

SEQ ID NO: 3031109 - protein, 8 aa, Entamoeba invadens
DASRNIEA

SEQ ID NO: 3031110 - protein, 12 aa, Entamoeba invadens
DASSIQSQTQTV

SEQ ID NO: 3031111 - protein, 5 aa, Entamoeba invadens
DASSP

SEQ ID NO: 3031112 - protein, 11 aa, Entamoeba invadens
DASTCSSCSDG

SEQ ID NO: 3031113 - protein, 7 aa, Entamoeba invadens
DATDDGS

SEQ ID NO: 3031114 - protein, 10 aa, Entamoeba invadens
DATECSSCSD

SEQ ID NO: 3031115 - protein, 4 aa, Entamoeba invadens
DAVS

SEQ ID NO: 3031116 - protein, 5 aa, Entamoeba invadens
DAYPG

SEQ ID NO: 3031117 - protein, 7 aa, Entamoeba invadens
DAYRPYN

SEQ ID NO: 3031118 - protein, 6 aa, Entamoeba invadens
DCDGNI

SEQ ID NO: 3031119 - protein, 4 aa, Entamoeba invadens
DCES

SEQ ID NO: 3031120 - protein, 8 aa, Entamoeba invadens
DCGNSGQR

SEQ ID NO: 3031121 - protein, 13 aa, Entamoeba invadens
DCIQSNNNCQVGN

SEQ ID NO: 3031122 - protein, 7 aa, Entamoeba invadens
DCKPPQD

SEQ ID NO: 3031123 - protein, 11 aa, Entamoeba invadens
DCKTAGTTDVE

SEQ ID NO: 3031124 - protein, 37 aa, Entamoeba invadens
DCNGEPGDFGGDQKPAESSEKPEESSKPAEDPDDDYC

SEQ ID NO: 3031125 - protein, 9 aa, Entamoeba invadens
DCNGTAPNN

SEQ ID NO: 3031126 - protein, 7 aa, Entamoeba invadens
DCNKCNE

SEQ ID NO: 3031127 - protein, 6 aa, Entamoeba invadens
DCNPPL

SEQ ID NO: 3031128 - protein, 8 aa, Entamoeba invadens
DCSNCTQC

SEQ ID NO: 3031129 - protein, 14 aa, Entamoeba invadens
DCSTLTPTEDQTIT

SEQ ID NO: 3031130 - protein, 10 aa, Entamoeba invadens
DCSTRGCTTC

SEQ ID NO: 3031131 - protein, 5 aa, Entamoeba invadens
DCSVA

SEQ ID NO: 3031132 - protein, 8 aa, Entamoeba invadens
DCTGVKGT

SEQ ID NO: 3031133 - protein, 16 aa, Entamoeba invadens
DCTQTADGYSVDENGN

SEQ ID NO: 3031134 - protein, 4 aa, Entamoeba invadens
DDAD

SEQ ID NO: 3031135 - protein, 50 aa, Entamoeba invadens
DDAEKKLDQQVAPNKNVSDDRDGYNQQLQAEKTKTTALTSARMQMIRIFL

SEQ ID NO: 3031136 - protein, 9 aa, Entamoeba invadens
DDASTAGGK

SEQ ID NO: 3031137 - protein, 13 aa, Entamoeba invadens
DDCEGKPGSYLNE

SEQ ID NO: 3031138 - protein, 7 aa, Entamoeba invadens
DDDDNDY

SEQ ID NO: 3031139 - protein, 6 aa, Entamoeba invadens
DDDERK

SEQ ID NO: 3031140 - protein, 58 aa, Entamoeba invadens
DDDLDNAEEGDIDDDDDFDFDDEEFDDEGDDDDFEEGDLYEEEEDNEDEEDDEEEYEL

SEQ ID NO: 3031141 - protein, 24 aa, Entamoeba invadens
DDDYDNDYNEEYQLDDDEEEFDYD

SEQ ID NO: 3031142 - protein, 5 aa, Entamoeba invadens
DDEDN

SEQ ID NO: 3031143 - protein, 6 aa, Entamoeba invadens
DDEDTN

SEQ ID NO: 3031144 - protein, 6 aa, Entamoeba invadens
DDEEDI

SEQ ID NO: 3031145 - protein, 49 aa, Entamoeba invadens
DDEIKEKEELTGINEEKKTSQTLADESGNPFVEPSDNYATEKTGTTEAA

SEQ ID NO: 3031146 - protein, 4 aa, Entamoeba invadens
DDEK

SEQ ID NO: 3031147 - protein, 12 aa, Entamoeba invadens
DDEYENEEDEFE

SEQ ID NO: 3031148 - protein, 9 aa, Entamoeba invadens
DDEYMTEKN

SEQ ID NO: 3031149 - protein, 24 aa, Entamoeba invadens
DDGEEEDDKKGKIDFDDANEKSVE

SEQ ID NO: 3031150 - protein, 7 aa, Entamoeba invadens
DDGKCRD

SEQ ID NO: 3031151 - protein, 7 aa, Entamoeba invadens
DDGNATT

SEQ ID NO: 3031152 - protein, 5 aa, Entamoeba invadens
DDGTI

SEQ ID NO: 3031153 - protein, 6 aa, Entamoeba invadens
DDGTVT

SEQ ID NO: 3031154 - protein, 6 aa, Entamoeba invadens
DDIEDF

SEQ ID NO: 3031155 - protein, 9 aa, Entamoeba invadens
DDIEPPKVH

SEQ ID NO: 3031156 - protein, 4 aa, Entamoeba invadens
DDIS

SEQ ID NO: 3031157 - protein, 5 aa, Entamoeba invadens
DDKGN

SEQ ID NO: 3031158 - protein, 6 aa, Entamoeba invadens
DDKRYE

SEQ ID NO: 3031159 - protein, 98 aa, Entamoeba invadens
DDKSRRSSRKSDKPKRKESKKTAKKEKKIQKKSVQHYKEEKKVNKEKAKAKRAEKKAAKQAKKAEKAERKANKEKAKNKKAERKVKKEERKNKKEEYK

SEQ ID NO: 3031160 - protein, 5 aa, Entamoeba invadens
DDKYL

SEQ ID NO: 3031161 - protein, 4 aa, Entamoeba invadens
DDLE

SEQ ID NO: 3031162 - protein, 4 aa, Entamoeba invadens
DDLP

SEQ ID NO: 3031163 - protein, 4 aa, Entamoeba invadens
DDNC

SEQ ID NO: 3031164 - protein, 6 aa, Entamoeba invadens
DDNREI

SEQ ID NO: 3031165 - protein, 6 aa, Entamoeba invadens
DDNSPY

SEQ ID NO: 3031166 - protein, 10 aa, Entamoeba invadens
DDPEPPNEND

SEQ ID NO: 3031167 - protein, 5 aa, Entamoeba invadens
DDPNY

SEQ ID NO: 3031168 - protein, 6 aa, Entamoeba invadens
DDQTKM

SEQ ID NO: 3031169 - protein, 11 aa, Entamoeba invadens
DDQTYAPNTFS

SEQ ID NO: 3031170 - protein, 7 aa, Entamoeba invadens
DDQTYEK

SEQ ID NO: 3031171 - protein, 8 aa, Entamoeba invadens
DDQTYESY

SEQ ID NO: 3031172 - protein, 10 aa, Entamoeba invadens
DDRSYPADTI

SEQ ID NO: 3031173 - protein, 22 aa, Entamoeba invadens
DDSCDTSTQSAVETTSDSSFTI

SEQ ID NO: 3031174 - protein, 8 aa, Entamoeba invadens
DDSTEKLS

SEQ ID NO: 3031175 - protein, 5 aa, Entamoeba invadens
DDTEM

SEQ ID NO: 3031176 - protein, 4 aa, Entamoeba invadens
DDTF

SEQ ID NO: 3031177 - protein, 11 aa, Entamoeba invadens
DDTKVSTYQTF

SEQ ID NO: 3031178 - protein, 7 aa, Entamoeba invadens
DDTKYTQ

SEQ ID NO: 3031179 - protein, 7 aa, Entamoeba invadens
DDTTKKV

SEQ ID NO: 3031180 - protein, 9 aa, Entamoeba invadens
DDTTNCRTN

SEQ ID NO: 3031181 - protein, 11 aa, Entamoeba invadens
DDTVELHEGPN

SEQ ID NO: 3031182 - protein, 6 aa, Entamoeba invadens
DDTVTR

SEQ ID NO: 3031183 - protein, 5 aa, Entamoeba invadens
DDVNA

SEQ ID NO: 3031184 - protein, 4 aa, Entamoeba invadens
DDVR

SEQ ID NO: 3031185 - protein, 30 aa, Entamoeba invadens
DDWKNSIEERYRKEKEEIQKSKEKEFQNGE

SEQ ID NO: 3031186 - protein, 5 aa, Entamoeba invadens
DDYEH

SEQ ID NO: 3031187 - protein, 7 aa, Entamoeba invadens
DDYKNGI

SEQ ID NO: 3031188 - protein, 8 aa, Entamoeba invadens
DDYKTDRG

SEQ ID NO: 3031189 - protein, 13 aa, Entamoeba invadens
DEASNEGAIAGEA

SEQ ID NO: 3031190 - protein, 6 aa, Entamoeba invadens
DECVPK

SEQ ID NO: 3031191 - protein, 13 aa, Entamoeba invadens
DEECKSSPISTNT

SEQ ID NO: 3031192 - protein, 12 aa, Entamoeba invadens
DEEDEQKELKEV

SEQ ID NO: 3031193 - protein, 7 aa, Entamoeba invadens
DEEEEHT

SEQ ID NO: 3031194 - protein, 7 aa, Entamoeba invadens
DEEEMKE

SEQ ID NO: 3031195 - protein, 12 aa, Entamoeba invadens
DEEFGNENKTTV

SEQ ID NO: 3031196 - protein, 5 aa, Entamoeba invadens
DEELK

SEQ ID NO: 3031197 - protein, 6 aa, Entamoeba invadens
DEETLD

SEQ ID NO: 3031198 - protein, 16 aa, Entamoeba invadens
DEGATSSTVKSDPLYK

SEQ ID NO: 3031199 - protein, 4 aa, Entamoeba invadens
DEGS

SEQ ID NO: 3031200 - protein, 12 aa, Entamoeba invadens
DEGSFDLENGQS

SEQ ID NO: 3031201 - protein, 13 aa, Entamoeba invadens
DEGSFDLKNGQSF

SEQ ID NO: 3031202 - protein, 4 aa, Entamoeba invadens
DEHY

SEQ ID NO: 3031203 - protein, 11 aa, Entamoeba invadens
DEIKKKQIENK

SEQ ID NO: 3031204 - protein, 4 aa, Entamoeba invadens
DEIN

SEQ ID NO: 3031205 - protein, 6 aa, Entamoeba invadens
DEIPDF

SEQ ID NO: 3031206 - protein, 14 aa, Entamoeba invadens
DEKAARKEKKLSKM

SEQ ID NO: 3031207 - protein, 6 aa, Entamoeba invadens
DEKDEQ

SEQ ID NO: 3031208 - protein, 10 aa, Entamoeba invadens
DEKSKNCVQG

SEQ ID NO: 3031209 - protein, 7 aa, Entamoeba invadens
DEKTIRT

SEQ ID NO: 3031210 - protein, 8 aa, Entamoeba invadens
DEKVENKV

SEQ ID NO: 3031211 - protein, 7 aa, Entamoeba invadens
DEKYQSI

SEQ ID NO: 3031212 - protein, 7 aa, Entamoeba invadens
DELPESY

SEQ ID NO: 3031213 - protein, 6 aa, Entamoeba invadens
DEMQSL

SEQ ID NO: 3031214 - protein, 7 aa, Entamoeba invadens
DENGAMG

SEQ ID NO: 3031215 - protein, 16 aa, Entamoeba invadens
DENGYFQQKTTCKKCS

SEQ ID NO: 3031216 - protein, 10 aa, Entamoeba invadens
DENKENKTSF

SEQ ID NO: 3031217 - protein, 7 aa, Entamoeba invadens
DENMTED

SEQ ID NO: 3031218 - protein, 6 aa, Entamoeba invadens
DEPYKT

SEQ ID NO: 3031219 - protein, 5 aa, Entamoeba invadens
DEQCS

SEQ ID NO: 3031220 - protein, 7 aa, Entamoeba invadens
DEQQERN

SEQ ID NO: 3031221 - protein, 9 aa, Entamoeba invadens
DEQRDTYSC

SEQ ID NO: 3031222 - protein, 10 aa, Entamoeba invadens
DEQTVKDIDN

SEQ ID NO: 3031223 - protein, 15 aa, Entamoeba invadens
DERREKYNEDTRKKY

SEQ ID NO: 3031224 - protein, 9 aa, Entamoeba invadens
DERRTKDDE

SEQ ID NO: 3031225 - protein, 19 aa, Entamoeba invadens
DESCGGKCDTTSGHCTGCD

SEQ ID NO: 3031226 - protein, 9 aa, Entamoeba invadens
DESETVQKE

SEQ ID NO: 3031227 - protein, 5 aa, Entamoeba invadens
DESLP

SEQ ID NO: 3031228 - protein, 7 aa, Entamoeba invadens
DESSDVD

SEQ ID NO: 3031229 - protein, 4 aa, Entamoeba invadens
DESV

SEQ ID NO: 3031230 - protein, 9 aa, Entamoeba invadens
DESVPLNNT

SEQ ID NO: 3031231 - protein, 11 aa, Entamoeba invadens
DETAINPTLER

SEQ ID NO: 3031232 - protein, 11 aa, Entamoeba invadens
DETDPSYNMSP

SEQ ID NO: 3031233 - protein, 7 aa, Entamoeba invadens
DETGKEV

SEQ ID NO: 3031234 - protein, 6 aa, Entamoeba invadens
DETNTN

SEQ ID NO: 3031235 - protein, 6 aa, Entamoeba invadens
DETQAL

SEQ ID NO: 3031236 - protein, 7 aa, Entamoeba invadens
DETTQKC

SEQ ID NO: 3031237 - protein, 7 aa, Entamoeba invadens
DETVKQR

SEQ ID NO: 3031238 - protein, 7 aa, Entamoeba invadens
DEVEQKA

SEQ ID NO: 3031239 - protein, 17 aa, Entamoeba invadens
DEVNGKLTDFGASRNVN

SEQ ID NO: 3031240 - protein, 4 aa, Entamoeba invadens
DEVQ

SEQ ID NO: 3031241 - protein, 5 aa, Entamoeba invadens
DEVSE

SEQ ID NO: 3031242 - protein, 19 aa, Entamoeba invadens
DEVTDKDKLAEKLSEKEKE

SEQ ID NO: 3031243 - protein, 6 aa, Entamoeba invadens
DEYHSV

SEQ ID NO: 3031244 - protein, 6 aa, Entamoeba invadens
DEYSNS

SEQ ID NO: 3031245 - protein, 8 aa, Entamoeba invadens
DEYTNAGD

SEQ ID NO: 3031246 - protein, 11 aa, Entamoeba invadens
DFAPKLKGENV

SEQ ID NO: 3031247 - protein, 27 aa, Entamoeba invadens
DFDDDDFIGGQKSYDYDKAKSALNTLG

SEQ ID NO: 3031248 - protein, 12 aa, Entamoeba invadens
DFEKEKQKKKYD

SEQ ID NO: 3031249 - protein, 12 aa, Entamoeba invadens
DFEQPGASGEWK

SEQ ID NO: 3031250 - protein, 5 aa, Entamoeba invadens
DFFSD

SEQ ID NO: 3031251 - protein, 12 aa, Entamoeba invadens
DFGQSSFEKTGL

SEQ ID NO: 3031252 - protein, 7 aa, Entamoeba invadens
DFKPSEP

SEQ ID NO: 3031253 - protein, 11 aa, Entamoeba invadens
DFNPNDEKSIK

SEQ ID NO: 3031254 - protein, 6 aa, Entamoeba invadens
DFNPSY

SEQ ID NO: 3031255 - protein, 5 aa, Entamoeba invadens
DFPNQ

SEQ ID NO: 3031256 - protein, 20 aa, Entamoeba invadens
DFQPGTDYSSQRDWPGEEQM

SEQ ID NO: 3031257 - protein, 26 aa, Entamoeba invadens
DFSKGYQKGGVKEGLKQGGKTALNNA

SEQ ID NO: 3031258 - protein, 6 aa, Entamoeba invadens
DFTDTQ

SEQ ID NO: 3031259 - protein, 7 aa, Entamoeba invadens
DFTNASP

SEQ ID NO: 3031260 - protein, 10 aa, Entamoeba invadens
DFTPQGNTTI

SEQ ID NO: 3031261 - protein, 4 aa, Entamoeba invadens
DGAK

SEQ ID NO: 3031262 - protein, 13 aa, Entamoeba invadens
DGAKGAAKNIISG

SEQ ID NO: 3031263 - protein, 8 aa, Entamoeba invadens
DGATGVKD

SEQ ID NO: 3031264 - protein, 8 aa, Entamoeba invadens
DGCDATNG

SEQ ID NO: 3031265 - protein, 7 aa, Entamoeba invadens
DGCKRCD

SEQ ID NO: 3031266 - protein, 9 aa, Entamoeba invadens
DGCNGGTLQ

SEQ ID NO: 3031267 - protein, 8 aa, Entamoeba invadens
DGDDPCKG

SEQ ID NO: 3031268 - protein, 9 aa, Entamoeba invadens
DGDKIKVNR

SEQ ID NO: 3031269 - protein, 5 aa, Entamoeba invadens
DGDKL

SEQ ID NO: 3031270 - protein, 4 aa, Entamoeba invadens
DGDL

SEQ ID NO: 3031271 - protein, 7 aa, Entamoeba invadens
DGDLGDL

SEQ ID NO: 3031272 - protein, 22 aa, Entamoeba invadens
DGDNSKHNTEQKSTIKDCKGKS

SEQ ID NO: 3031273 - protein, 4 aa, Entamoeba invadens
DGEF

SEQ ID NO: 3031274 - protein, 6 aa, Entamoeba invadens
DGEHTT

SEQ ID NO: 3031275 - protein, 6 aa, Entamoeba invadens
DGEKPY

SEQ ID NO: 3031276 - protein, 71 aa, Entamoeba invadens
DGEPGKYFGDTPVEPESSEEPTPPQESSDTPIPPIPESSETPLPPTPESSDNPILPDSSNEEPYDPDWPDV

SEQ ID NO: 3031277 - protein, 5 aa, Entamoeba invadens
DGGGD

SEQ ID NO: 3031278 - protein, 7 aa, Entamoeba invadens
DGGIGSL

SEQ ID NO: 3031279 - protein, 5 aa, Entamoeba invadens
DGHEK

SEQ ID NO: 3031280 - protein, 6 aa, Entamoeba invadens
DGHKYD

SEQ ID NO: 3031281 - protein, 6 aa, Entamoeba invadens
DGIDRK

SEQ ID NO: 3031282 - protein, 8 aa, Entamoeba invadens
DGKCTSSV

SEQ ID NO: 3031283 - protein, 8 aa, Entamoeba invadens
DGKHDTQY

SEQ ID NO: 3031284 - protein, 7 aa, Entamoeba invadens
DGKPIEM

SEQ ID NO: 3031285 - protein, 5 aa, Entamoeba invadens
DGKTY

SEQ ID NO: 3031286 - protein, 5 aa, Entamoeba invadens
DGMDD

SEQ ID NO: 3031287 - protein, 7 aa, Entamoeba invadens
DGNCQKC

SEQ ID NO: 3031288 - protein, 10 aa, Entamoeba invadens
DGNQTTQYPL

SEQ ID NO: 3031289 - protein, 6 aa, Entamoeba invadens
DGNVLE

SEQ ID NO: 3031290 - protein, 12 aa, Entamoeba invadens
DGPYATLTNEEY

SEQ ID NO: 3031291 - protein, 4 aa, Entamoeba invadens
DGQT

SEQ ID NO: 3031292 - protein, 6 aa, Entamoeba invadens
DGQVRN

SEQ ID NO: 3031293 - protein, 6 aa, Entamoeba invadens
DGRCTS

SEQ ID NO: 3031294 - protein, 8 aa, Entamoeba invadens
DGRDNSDV

SEQ ID NO: 3031295 - protein, 9 aa, Entamoeba invadens
DGSDEAQGV

SEQ ID NO: 3031296 - protein, 5 aa, Entamoeba invadens
DGSFY

SEQ ID NO: 3031297 - protein, 6 aa, Entamoeba invadens
DGTLEL

SEQ ID NO: 3031298 - protein, 5 aa, Entamoeba invadens
DGTNC

SEQ ID NO: 3031299 - protein, 5 aa, Entamoeba invadens
DGTTI

SEQ ID NO: 3031300 - protein, 5 aa, Entamoeba invadens
DGTTL

SEQ ID NO: 3031301 - protein, 7 aa, Entamoeba invadens
DGTTYTA

SEQ ID NO: 3031302 - protein, 5 aa, Entamoeba invadens
DGVGL

SEQ ID NO: 3031303 - protein, 6 aa, Entamoeba invadens
DGYDGE

SEQ ID NO: 3031304 - protein, 5 aa, Entamoeba invadens
DGYFP

SEQ ID NO: 3031305 - protein, 4 aa, Entamoeba invadens
DGYG

SEQ ID NO: 3031306 - protein, 9 aa, Entamoeba invadens
DGYGGHSTD

SEQ ID NO: 3031307 - protein, 10 aa, Entamoeba invadens
DGYGGHTTDI

SEQ ID NO: 3031308 - protein, 7 aa, Entamoeba invadens
DGYPSTE

SEQ ID NO: 3031309 - protein, 9 aa, Entamoeba invadens
DGYPTTATY

SEQ ID NO: 3031310 - protein, 4 aa, Entamoeba invadens
DGYY

SEQ ID NO: 3031311 - protein, 23 aa, Entamoeba invadens
DGYYKEDSSCTTCENKSIKGNEC

SEQ ID NO: 3031312 - protein, 7 aa, Entamoeba invadens
DGYYSTT

SEQ ID NO: 3031313 - protein, 9 aa, Entamoeba invadens
DGYYSTTTT

SEQ ID NO: 3031314 - protein, 14 aa, Entamoeba invadens
DHHTESAPPSENDY

SEQ ID NO: 3031315 - protein, 14 aa, Entamoeba invadens
DHNCKNDKTTSKLD

SEQ ID NO: 3031316 - protein, 5 aa, Entamoeba invadens
DHNEK

SEQ ID NO: 3031317 - protein, 6 aa, Entamoeba invadens
DHPTTV

SEQ ID NO: 3031318 - protein, 6 aa, Entamoeba invadens
DHQKKF

SEQ ID NO: 3031319 - protein, 6 aa, Entamoeba invadens
DHSPTV

SEQ ID NO: 3031320 - protein, 5 aa, Entamoeba invadens
DHTCN

SEQ ID NO: 3031321 - protein, 8 aa, Entamoeba invadens
DIAENKEY

SEQ ID NO: 3031322 - protein, 9 aa, Entamoeba invadens
DIDDDYEDM

SEQ ID NO: 3031323 - protein, 8 aa, Entamoeba invadens
DIGYPTKG

SEQ ID NO: 3031324 - protein, 4 aa, Entamoeba invadens
DIID

SEQ ID NO: 3031325 - protein, 17 aa, Entamoeba invadens
DIKEGKNVKKHSRQKDE

SEQ ID NO: 3031326 - protein, 11 aa, Entamoeba invadens
DIKSQEDQEHI

SEQ ID NO: 3031327 - protein, 19 aa, Entamoeba invadens
DINSVTPDGIKDSGAAIGA

SEQ ID NO: 3031328 - protein, 4 aa, Entamoeba invadens
DIPK

SEQ ID NO: 3031329 - protein, 15 aa, Entamoeba invadens
DIPKEPESSSETPNN

SEQ ID NO: 3031330 - protein, 7 aa, Entamoeba invadens
DIPQTEI

SEQ ID NO: 3031331 - protein, 11 aa, Entamoeba invadens
DIQEKEKHLKE

SEQ ID NO: 3031332 - protein, 6 aa, Entamoeba invadens
DIQPDD

SEQ ID NO: 3031333 - protein, 7 aa, Entamoeba invadens
DISSRKC

SEQ ID NO: 3031334 - protein, 13 aa, Entamoeba invadens
DIVSASKSCTGVG

SEQ ID NO: 3031335 - protein, 16 aa, Entamoeba invadens
DKAIGPSKPGAYTQEE

SEQ ID NO: 3031336 - protein, 9 aa, Entamoeba invadens
DKASPLTEF

SEQ ID NO: 3031337 - protein, 8 aa, Entamoeba invadens
DKATSVVN

SEQ ID NO: 3031338 - protein, 16 aa, Entamoeba invadens
DKCASNQVIQSDKKKC

SEQ ID NO: 3031339 - protein, 8 aa, Entamoeba invadens
DKCKSSMY

SEQ ID NO: 3031340 - protein, 13 aa, Entamoeba invadens
DKCTGATACTSCK

SEQ ID NO: 3031341 - protein, 9 aa, Entamoeba invadens
DKDNKCSKC

SEQ ID NO: 3031342 - protein, 10 aa, Entamoeba invadens
DKDNSTDCDP

SEQ ID NO: 3031343 - protein, 7 aa, Entamoeba invadens
DKDPDHP

SEQ ID NO: 3031344 - protein, 5 aa, Entamoeba invadens
DKDRL

SEQ ID NO: 3031345 - protein, 6 aa, Entamoeba invadens
DKDRSH

SEQ ID NO: 3031346 - protein, 9 aa, Entamoeba invadens
DKDSDIDQV

SEQ ID NO: 3031347 - protein, 8 aa, Entamoeba invadens
DKDSNMTV

SEQ ID NO: 3031348 - protein, 7 aa, Entamoeba invadens
DKECTPC

SEQ ID NO: 3031349 - protein, 9 aa, Entamoeba invadens
DKEDSATAR

SEQ ID NO: 3031350 - protein, 18 aa, Entamoeba invadens
DKEEAPSRCMRCKKMRVS

SEQ ID NO: 3031351 - protein, 8 aa, Entamoeba invadens
DKEGEQKC

SEQ ID NO: 3031352 - protein, 5 aa, Entamoeba invadens
DKERV

SEQ ID NO: 3031353 - protein, 6 aa, Entamoeba invadens
DKEVQR

SEQ ID NO: 3031354 - protein, 14 aa, Entamoeba invadens
DKEYKEKKVEEGMY

SEQ ID NO: 3031355 - protein, 12 aa, Entamoeba invadens
DKFHPKPRSCQR

SEQ ID NO: 3031356 - protein, 5 aa, Entamoeba invadens
DKFNP

SEQ ID NO: 3031357 - protein, 5 aa, Entamoeba invadens
DKGNC

SEQ ID NO: 3031358 - protein, 8 aa, Entamoeba invadens
DKHSKNEF

SEQ ID NO: 3031359 - protein, 21 aa, Entamoeba invadens
DKIKNKKEDKKAEKKAKKASK

SEQ ID NO: 3031360 - protein, 7 aa, Entamoeba invadens
DKKDPYD

SEQ ID NO: 3031361 - protein, 10 aa, Entamoeba invadens
DKKECGQGYY

SEQ ID NO: 3031362 - protein, 15 aa, Entamoeba invadens
DKKEECEKCKDGYGK

SEQ ID NO: 3031363 - protein, 8 aa, Entamoeba invadens
DKKGIDSL

SEQ ID NO: 3031364 - protein, 8 aa, Entamoeba invadens
DKKPDDVV

SEQ ID NO: 3031365 - protein, 9 aa, Entamoeba invadens
DKKSAAMNQ

SEQ ID NO: 3031366 - protein, 11 aa, Entamoeba invadens
DKLDDEKNNAV

SEQ ID NO: 3031367 - protein, 4 aa, Entamoeba invadens
DKNC

SEQ ID NO: 3031368 - protein, 12 aa, Entamoeba invadens
DKNKGCEDGETI

SEQ ID NO: 3031369 - protein, 15 aa, Entamoeba invadens
DKNKGCELGDKNGMY

SEQ ID NO: 3031370 - protein, 12 aa, Entamoeba invadens
DKNKNSCKKSGW

SEQ ID NO: 3031371 - protein, 8 aa, Entamoeba invadens
DKNTTYYY

SEQ ID NO: 3031372 - protein, 16 aa, Entamoeba invadens
DKPQSFIGKNAPVVFA

SEQ ID NO: 3031373 - protein, 6 aa, Entamoeba invadens
DKPRCD

SEQ ID NO: 3031374 - protein, 6 aa, Entamoeba invadens
DKPSFG

SEQ ID NO: 3031375 - protein, 21 aa, Entamoeba invadens
DKQIRTKSGTTCKEMEDDPSF

SEQ ID NO: 3031376 - protein, 7 aa, Entamoeba invadens
DKQITKV

SEQ ID NO: 3031377 - protein, 8 aa, Entamoeba invadens
DKQSGGLL

SEQ ID NO: 3031378 - protein, 5 aa, Entamoeba invadens
DKRDE

SEQ ID NO: 3031379 - protein, 27 aa, Entamoeba invadens
DKRQREIYDAGGEEALKNGGQSHTNAE

SEQ ID NO: 3031380 - protein, 6 aa, Entamoeba invadens
DKRSAL

SEQ ID NO: 3031381 - protein, 6 aa, Entamoeba invadens
DKRTHG

SEQ ID NO: 3031382 - protein, 5 aa, Entamoeba invadens
DKSEA

SEQ ID NO: 3031383 - protein, 14 aa, Entamoeba invadens
DKSNIDTSTNTDHI

SEQ ID NO: 3031384 - protein, 14 aa, Entamoeba invadens
DKSQFREKQKEKRI

SEQ ID NO: 3031385 - protein, 5 aa, Entamoeba invadens
DKTCQ

SEQ ID NO: 3031386 - protein, 7 aa, Entamoeba invadens
DKTCQGP

SEQ ID NO: 3031387 - protein, 9 aa, Entamoeba invadens
DKTNGNCTS

SEQ ID NO: 3031388 - protein, 6 aa, Entamoeba invadens
DKTNGY

SEQ ID NO: 3031389 - protein, 6 aa, Entamoeba invadens
DKTNRR

SEQ ID NO: 3031390 - protein, 27 aa, Entamoeba invadens
DKTQQEKIKNEEELKNLQKDKERVESD

SEQ ID NO: 3031391 - protein, 4 aa, Entamoeba invadens
DKTT

SEQ ID NO: 3031392 - protein, 11 aa, Entamoeba invadens
DKVMASGKTPV

SEQ ID NO: 3031393 - protein, 7 aa, Entamoeba invadens
DKVTTGA

SEQ ID NO: 3031394 - protein, 8 aa, Entamoeba invadens
DKYKSNDN

SEQ ID NO: 3031395 - protein, 6 aa, Entamoeba invadens
DLDDTG

SEQ ID NO: 3031396 - protein, 13 aa, Entamoeba invadens
DLDGEDSKSSYKY

SEQ ID NO: 3031397 - protein, 9 aa, Entamoeba invadens
DLDSATQDK

SEQ ID NO: 3031398 - protein, 17 aa, Entamoeba invadens
DLENERQVSLKQGNDLA

SEQ ID NO: 3031399 - protein, 7 aa, Entamoeba invadens
DLGSNNV

SEQ ID NO: 3031400 - protein, 13 aa, Entamoeba invadens
DLKNQNSTIKKEF

SEQ ID NO: 3031401 - protein, 9 aa, Entamoeba invadens
DLKRDKDQL

SEQ ID NO: 3031402 - protein, 9 aa, Entamoeba invadens
DLNENESNR

SEQ ID NO: 3031403 - protein, 7 aa, Entamoeba invadens
DLNPKKN

SEQ ID NO: 3031404 - protein, 11 aa, Entamoeba invadens
DLPALESSTSA

SEQ ID NO: 3031405 - protein, 16 aa, Entamoeba invadens
DLPTVSSKYSHGYGDN

SEQ ID NO: 3031406 - protein, 6 aa, Entamoeba invadens
DLREST

SEQ ID NO: 3031407 - protein, 8 aa, Entamoeba invadens
DLRNGNPR

SEQ ID NO: 3031408 - protein, 7 aa, Entamoeba invadens
DLSENTM

SEQ ID NO: 3031409 - protein, 5 aa, Entamoeba invadens
DLSNK

SEQ ID NO: 3031410 - protein, 29 aa, Entamoeba invadens
DLYPATPSTPSQLLSGDQKEQQKNVPIKY

SEQ ID NO: 3031411 - protein, 24 aa, Entamoeba invadens
DMAKRDKEQIKARDTYRKKANEWS

SEQ ID NO: 3031412 - protein, 13 aa, Entamoeba invadens
DMEPAKKTDLKTR

SEQ ID NO: 3031413 - protein, 13 aa, Entamoeba invadens
DMESDRQVNTAEV

SEQ ID NO: 3031414 - protein, 6 aa, Entamoeba invadens
DMGPQC

SEQ ID NO: 3031415 - protein, 8 aa, Entamoeba invadens
DMKKELKP

SEQ ID NO: 3031416 - protein, 14 aa, Entamoeba invadens
DMNGEGRDPSKKCD

SEQ ID NO: 3031417 - protein, 31 aa, Entamoeba invadens
DMNNDKAKMSSNKVDAAKSSQKISEEKEQLN

SEQ ID NO: 3031418 - protein, 8 aa, Entamoeba invadens
DMPSEENT

SEQ ID NO: 3031419 - protein, 13 aa, Entamoeba invadens
DNAARKLKYTIII

SEQ ID NO: 3031420 - protein, 8 aa, Entamoeba invadens
DNAPYQYK

SEQ ID NO: 3031421 - protein, 9 aa, Entamoeba invadens
DNAPYTLGQ

SEQ ID NO: 3031422 - protein, 8 aa, Entamoeba invadens
DNCKGNTE

SEQ ID NO: 3031423 - protein, 13 aa, Entamoeba invadens
DNCPEGTYVSKTE

SEQ ID NO: 3031424 - protein, 6 aa, Entamoeba invadens
DNDDLK

SEQ ID NO: 3031425 - protein, 7 aa, Entamoeba invadens
DNDDLKN

SEQ ID NO: 3031426 - protein, 31 aa, Entamoeba invadens; identical to SEQ ID NO: 2548610

SEQ ID NO: 3031427 - protein, 6 aa, Entamoeba invadens
DNDRAF

SEQ ID NO: 3031428 - protein, 5 aa, Entamoeba invadens
DNEGI

SEQ ID NO: 3031429 - protein, 6 aa, Entamoeba invadens
DNEKEV

SEQ ID NO: 3031430 - protein, 7 aa, Entamoeba invadens
DNEKSDL

SEQ ID NO: 3031431 - protein, 13 aa, Entamoeba invadens
DNENYLDSNKKCR

SEQ ID NO: 3031432 - protein, 5 aa, Entamoeba invadens
DNESR

SEQ ID NO: 3031433 - protein, 10 aa, Entamoeba invadens
DNETEAEEQA

SEQ ID NO: 3031434 - protein, 15 aa, Entamoeba invadens
DNETTFSKHRQFFMI

SEQ ID NO: 3031435 - protein, 5 aa, Entamoeba invadens
DNFKE

SEQ ID NO: 3031436 - protein, 7 aa, Entamoeba invadens
DNGACGY

SEQ ID NO: 3031437 - protein, 6 aa, Entamoeba invadens
DNGDLK

SEQ ID NO: 3031438 - protein, 5 aa, Entamoeba invadens
DNGSC

SEQ ID NO: 3031439 - protein, 8 aa, Entamoeba invadens
DNGTFEDG

SEQ ID NO: 3031440 - protein, 6 aa, Entamoeba invadens
DNGTYK

SEQ ID NO: 3031441 - protein, 14 aa, Entamoeba invadens
DNIKQKKAEEVKQK

SEQ ID NO: 3031442 - protein, 25 aa, Entamoeba invadens
DNKAPQHKEEVKTEEVPNQTPIKEE

SEQ ID NO: 3031443 - protein, 8 aa, Entamoeba invadens
DNKDHKDL

SEQ ID NO: 3031444 - protein, 7 aa, Entamoeba invadens
DNKKQKV

SEQ ID NO: 3031445 - protein, 7 aa, Entamoeba invadens
DNKLESE

SEQ ID NO: 3031446 - protein, 23 aa, Entamoeba invadens
DNNCPSANNLPERATEIDGIESA

SEQ ID NO: 3031447 - protein, 10 aa, Entamoeba invadens
DNNNGTTNIM

SEQ ID NO: 3031448 - protein, 8 aa, Entamoeba invadens
DNNNKCTK

SEQ ID NO: 3031449 - protein, 6 aa, Entamoeba invadens
DNNPYK

SEQ ID NO: 3031450 - protein, 7 aa, Entamoeba invadens
DNNTEYE

SEQ ID NO: 3031451 - protein, 5 aa, Entamoeba invadens
DNNTM

SEQ ID NO: 3031452 - protein, 9 aa, Entamoeba invadens
DNNTSKDKR

SEQ ID NO: 3031453 - protein, 8 aa, Entamoeba invadens
DNPSNPQG

SEQ ID NO: 3031454 - protein, 9 aa, Entamoeba invadens
DNPTINTNE

SEQ ID NO: 3031455 - protein, 7 aa, Entamoeba invadens
DNQPSPL

SEQ ID NO: 3031456 - protein, 5 aa, Entamoeba invadens
DNQQQ

SEQ ID NO: 3031457 - protein, 9 aa, Entamoeba invadens
DNSHITEDT

SEQ ID NO: 3031458 - protein, 7 aa, Entamoeba invadens
DNSVAPE

SEQ ID NO: 3031459 - protein, 31 aa, Entamoeba invadens
  misc_feature (14)..(15): Xaa can be any naturally occurring amino acid
DNSVYSDSACVKLXXDVYTRKTKKLERQQNN

SEQ ID NO: 3031460 - protein, 6 aa, Entamoeba invadens
DNSYEE

SEQ ID NO: 3031461 - protein, 7 aa, Entamoeba invadens
DNSYKNN

SEQ ID NO: 3031462 - protein, 7 aa, Entamoeba invadens
DNSYTEK

SEQ ID NO: 3031463 - protein, 9 aa, Entamoeba invadens
DNTKYTAKN

SEQ ID NO: 3031464 - protein, 6 aa, Entamoeba invadens
DNTSVS

SEQ ID NO: 3031465 - protein, 17 aa, Entamoeba invadens
DNTTQGFCGDEDNGQMS

SEQ ID NO: 3031466 - protein, 6 aa, Entamoeba invadens
DNTTYI

SEQ ID NO: 3031467 - protein, 6 aa, Entamoeba invadens
DNWQEQ

SEQ ID NO: 3031468 - protein, 11 aa, Entamoeba invadens
DNYKEEPENGD

SEQ ID NO: 3031469 - protein, 19 aa, Entamoeba invadens
DNYKGSTCEKALETDKEAC

SEQ ID NO: 3031470 - protein, 8 aa, Entamoeba invadens
DNYTDGDK

SEQ ID NO: 3031471 - protein, 9 aa, Entamoeba invadens
DPATNKVGS

SEQ ID NO: 3031472 - protein, 7 aa, Entamoeba invadens
DPDHGNV

SEQ ID NO: 3031473 - protein, 11 aa, Entamoeba invadens
DPFNPGPAECP

SEQ ID NO: 3031474 - protein, 4 aa, Entamoeba invadens
DPKG

SEQ ID NO: 3031475 - protein, 12 aa, Entamoeba invadens
DPKTLDLSEEQA

SEQ ID NO: 3031476 - protein, 6 aa, Entamoeba invadens
DPKTTN

SEQ ID NO: 3031477 - protein, 8 aa, Entamoeba invadens
DPPKANNR

SEQ ID NO: 3031478 - protein, 14 aa, Entamoeba invadens
DPPKPNTPPPKEEM

SEQ ID NO: 3031479 - protein, 22 aa, Entamoeba invadens
DPPKQKDEKQKTEEEKKTKKDE

SEQ ID NO: 3031480 - protein, 9 aa, Entamoeba invadens
DPPTIPPGL

SEQ ID NO: 3031481 - protein, 13 aa, Entamoeba invadens
DPSKKRLNPEPIN

SEQ ID NO: 3031482 - protein, 12 aa, Entamoeba invadens
DPSKNKYNPESI

SEQ ID NO: 3031483 - protein, 6 aa, Entamoeba invadens
DPSLLE

SEQ ID NO: 3031484 - protein, 11 aa, Entamoeba invadens
DPSSDRFNPKP

SEQ ID NO: 3031485 - protein, 7 aa, Entamoeba invadens
DPSSEKG

SEQ ID NO: 3031486 - protein, 5 aa, Entamoeba invadens
DPSTL

SEQ ID NO: 3031487 - protein, 7 aa, Entamoeba invadens
DPSYENL

SEQ ID NO: 3031488 - protein, 14 aa, Entamoeba invadens
DPTACKTCSNSTHC

SEQ ID NO: 3031489 - protein, 14 aa, Entamoeba invadens
DPTDNGCYGGHPDK

SEQ ID NO: 3031490 - protein, 4 aa, Entamoeba invadens
DPTQ

SEQ ID NO: 3031491 - protein, 8 aa, Entamoeba invadens
DPTTGTVD

SEQ ID NO: 3031492 - protein, 4 aa, Entamoeba invadens
DPVE

SEQ ID NO: 3031493 - protein, 4 aa, Entamoeba invadens
DPVF

SEQ ID NO: 3031494 - protein, 10 aa, Entamoeba invadens
DPYGVSSSTF

SEQ ID NO: 3031495 - protein, 5 aa, Entamoeba invadens
DPYQT

SEQ ID NO: 3031496 - protein, 20 aa, Entamoeba invadens
DQASVDGKKAVRDQDRAQIG

SEQ ID NO: 3031497 - protein, 5 aa, Entamoeba invadens
DQDED

SEQ ID NO: 3031498 - protein, 8 aa, Entamoeba invadens
DQDGTCKR

SEQ ID NO: 3031499 - protein, 16 aa, Entamoeba invadens
DQEAPRTYANAKSLGI

SEQ ID NO: 3031500 - protein, 22 aa, Entamoeba invadens
DQKFEAPTEEEAPNKEEKAPEV

SEQ ID NO: 3031501 - protein, 15 aa, Entamoeba invadens
DQKTKNERDRVSNNE

SEQ ID NO: 3031502 - protein, 21 aa, Entamoeba invadens
DQMGTKAKNLAKSNLNKGIGT

SEQ ID NO: 3031503 - protein, 7 aa, Entamoeba invadens
DQNKQLF

SEQ ID NO: 3031504 - protein, 24 aa, Entamoeba invadens
DQNTQLDAAKNDMKKQSIKALEAQ

SEQ ID NO: 3031505 - protein, 29 aa, Entamoeba invadens
DQPENIKAKEVRTKITPSQPVTSTRLPRK

SEQ ID NO: 3031506 - protein, 52 aa, Entamoeba invadens
DQPIDSSSSESPPNPTNLARRKSLSTGDVSKETKKKIDEQKTMGGSTGQMSK

SEQ ID NO: 3031507 - protein, 7 aa, Entamoeba invadens
DQPQDGY

SEQ ID NO: 3031508 - protein, 16 aa, Entamoeba invadens
DQPTRRPIEPGSSVSE

SEQ ID NO: 3031509 - protein, 13 aa, Entamoeba invadens
DQSYAKNKANYPQ

SEQ ID NO: 3031510 - protein, 8 aa, Entamoeba invadens
DQSYEKNA

SEQ ID NO: 3031511 - protein, 15 aa, Entamoeba invadens
DQTNGHCTSCKNGCD

SEQ ID NO: 3031512 - protein, 15 aa, Entamoeba invadens
DQTNGHCTSCKNGQF

SEQ ID NO: 3031513 - protein, 4 aa, Entamoeba invadens
DQTY

SEQ ID NO: 3031514 - protein, 9 aa, Entamoeba invadens
DQVKGCTEC

SEQ ID NO: 3031515 - protein, 11 aa, Entamoeba invadens
DQYKDGKQVAT

SEQ ID NO: 3031516 - protein, 10 aa, Entamoeba invadens
DQYKNNGSLN

SEQ ID NO: 3031517 - protein, 8 aa, Entamoeba invadens
DQYKTYPV

SEQ ID NO: 3031518 - protein, 6 aa, Entamoeba invadens
DRAEDE

SEQ ID NO: 3031519 - protein, 10 aa, Entamoeba invadens
DRCKTDNPTH

SEQ ID NO: 3031520 - protein, 17 aa, Entamoeba invadens
DRDSGAMKAGKTECSVE

SEQ ID NO: 3031521 - protein, 14 aa, Entamoeba invadens
DRERKNKVEKKERT

SEQ ID NO: 3031522 - protein, 10 aa, Entamoeba invadens
DRFPSSKRTE

SEQ ID NO: 3031523 - protein, 6 aa, Entamoeba invadens
DRGGGV

SEQ ID NO: 3031524 - protein, 10 aa, Entamoeba invadens
DRGNLRDNGR

SEQ ID NO: 3031525 - protein, 7 aa, Entamoeba invadens
DRKNSKD

SEQ ID NO: 3031526 - protein, 4 aa, Entamoeba invadens
DRLM

SEQ ID NO: 3031527 - protein, 12 aa, Entamoeba invadens
DRNSGCKKCENG

SEQ ID NO: 3031528 - protein, 6 aa, Entamoeba invadens
DRSECD

SEQ ID NO: 3031529 - protein, 5 aa, Entamoeba invadens
DRSPW

SEQ ID NO: 3031530 - protein, 9 aa, Entamoeba invadens
DRSVTPATL

SEQ ID NO: 3031531 - protein, 7 aa, Entamoeba invadens
DRSVTPV

SEQ ID NO: 3031532 - protein, 8 aa, Entamoeba invadens
DRVGTPDA

SEQ ID NO: 3031533 - protein, 5 aa, Entamoeba invadens
DSAAT

SEQ ID NO: 3031534 - protein, 5 aa, Entamoeba invadens
DSAKG

SEQ ID NO: 3031535 - protein, 8 aa, Entamoeba invadens
DSAPGEEV

SEQ ID NO: 3031536 - protein, 8 aa, Entamoeba invadens
DSAPNEEI

SEQ ID NO: 3031537 - protein, 4 aa, Entamoeba invadens
DSAV

SEQ ID NO: 3031538 - protein, 6 aa, Entamoeba invadens
DSAVGK

SEQ ID NO: 3031539 - protein, 14 aa, Entamoeba invadens
DSCGEDDKSSVDGS

SEQ ID NO: 3031540 - protein, 16 aa, Entamoeba invadens
DSCKTCDERPSKCESC

SEQ ID NO: 3031541 - protein, 10 aa, Entamoeba invadens
DSDDGCGAVG

SEQ ID NO: 3031542 - protein, 7 aa, Entamoeba invadens
DSDNGYK

SEQ ID NO: 3031543 - protein, 14 aa, Entamoeba invadens
DSDQDTIQEGQSTT

SEQ ID NO: 3031544 - protein, 8 aa, Entamoeba invadens
DSEKISDE

SEQ ID NO: 3031545 - protein, 4 aa, Entamoeba invadens
DSEQ

SEQ ID NO: 3031546 - protein, 7 aa, Entamoeba invadens
DSESTSH

SEQ ID NO: 3031547 - protein, 15 aa, Entamoeba invadens
DSFNETTINNTAGYT

SEQ ID NO: 3031548 - protein, 5 aa, Entamoeba invadens
DSFNV

SEQ ID NO: 3031549 - protein, 6 aa, Entamoeba invadens
DSFPNA

SEQ ID NO: 3031550 - protein, 6 aa, Entamoeba invadens
DSFSGT

SEQ ID NO: 3031551 - protein, 6 aa, Entamoeba invadens
DSFSTA

SEQ ID NO: 3031552 - protein, 5 aa, Entamoeba invadens
DSGDV

SEQ ID NO: 3031553 - protein, 4 aa, Entamoeba invadens
DSGG

SEQ ID NO: 3031554 - protein, 7 aa, Entamoeba invadens
DSGVGKT

SEQ ID NO: 3031555 - protein, 8 aa, Entamoeba invadens
DSGVGKTS

SEQ ID NO: 3031556 - protein, 5 aa, Entamoeba invadens
DSHEK

SEQ ID NO: 3031557 - protein, 5 aa, Entamoeba invadens
DSHLH

SEQ ID NO: 3031558 - protein, 38 aa, Entamoeba invadens
DSISSVSGEKESYTESIPKIPPPKPQRKSLSEPKDEQH

SEQ ID NO: 3031559 - protein, 5 aa, Entamoeba invadens
DSITS

SEQ ID NO: 3031560 - protein, 5 aa, Entamoeba invadens
DSITT

SEQ ID NO: 3031561 - protein, 15 aa, Entamoeba invadens
DSKKCLETCPDGTYL

SEQ ID NO: 3031562 - protein, 6 aa, Entamoeba invadens
DSKKPH

SEQ ID NO: 3031563 - protein, 7 aa, Entamoeba invadens
DSKKQKV

SEQ ID NO: 3031564 - protein, 4 aa, Entamoeba invadens
DSKL

SEQ ID NO: 3031565 - protein, 5 aa, Entamoeba invadens
DSKNK

SEQ ID NO: 3031566 - protein, 7 aa, Entamoeba invadens
DSKQQGF

SEQ ID NO: 3031567 - protein, 6 aa, Entamoeba invadens
DSLPTT

SEQ ID NO: 3031568 - protein, 8 aa, Entamoeba invadens
DSMPKDTN

SEQ ID NO: 3031569 - protein, 15 aa, Entamoeba invadens
DSNCKAAGCNQETGV

SEQ ID NO: 3031570 - protein, 9 aa, Entamoeba invadens
DSNPEGIND

SEQ ID NO: 3031571 - protein, 8 aa, Entamoeba invadens
DSNPNCPS

SEQ ID NO: 3031572 - protein, 7 aa, Entamoeba invadens
DSNPSFS

SEQ ID NO: 3031573 - protein, 5 aa, Entamoeba invadens
DSNRI

SEQ ID NO: 3031574 - protein, 9 aa, Entamoeba invadens
DSNRKEGYD

SEQ ID NO: 3031575 - protein, 6 aa, Entamoeba invadens
DSNSRD

SEQ ID NO: 3031576 - protein, 8 aa, Entamoeba invadens
DSNTCNQC

SEQ ID NO: 3031577 - protein, 7 aa, Entamoeba invadens
DSNTGKF

SEQ ID NO: 3031578 - protein, 5 aa, Entamoeba invadens
DSNYS

SEQ ID NO: 3031579 - protein, 10 aa, Entamoeba invadens
DSQNAKELPE

SEQ ID NO: 3031580 - protein, 16 aa, Entamoeba invadens
DSQSALDDAGSAPEKL

SEQ ID NO: 3031581 - protein, 13 aa, Entamoeba invadens
DSRFAAAGNFDEV

SEQ ID NO: 3031582 - protein, 9 aa, Entamoeba invadens
DSSATMKDQ

SEQ ID NO: 3031583 - protein, 4 aa, Entamoeba invadens
DSSD

SEQ ID NO: 3031584 - protein, 11 aa, Entamoeba invadens
DSSEKGSIDQT

SEQ ID NO: 3031585 - protein, 8 aa, Entamoeba invadens
DSSNKMKP

SEQ ID NO: 3031586 - protein, 7 aa, Entamoeba invadens
DSSNKRK

SEQ ID NO: 3031587 - protein, 6 aa, Entamoeba invadens
DSSNSV

SEQ ID NO: 3031588 - protein, 8 aa, Entamoeba invadens
DSTNEGCT

SEQ ID NO: 3031589 - protein, 5 aa, Entamoeba invadens
DSTRV

SEQ ID NO: 3031590 - protein, 466 aa, Entamoeba invadens
DSVKKDVKKDNKKSIKKAASKAKTVAKKQAGKAEKKMAKDVKKAEKKLKASEKKTAKDLKAKVKSAEKKSAEAKKSAKKSGKKAEKSAKKAAKDAKKDMKKQEKKAEKVAKSAKKAAKSAAKDAKKQVKKAEKKVSSTKKGLKKQLKKTEKATKKVKEAEKKQKSQLKKMKKDVKKGKKSAKDLKKLKSTVKSTKKAEKKLEKKEKQLKKDLKKKIAKNATKAKKEAKKQAKKAAGKAEKKAEKKSIKAAKKYTKKQTKKVEKKEEKKIKKAQKKLNKKVKKVQKQEKKDKKKLEKKEKKNAEKAKKATQKALTKAKKEAKKQAKKAEKKVKKAEKKNLKKLEKKNKKAVKKLEKKENKKISKAKAAAKQAKKANDKLKKKTSKISKKVTKKITKKVAKTNKKAAKKANKKAAKKAAKKSAKKNAKLSKKSTKKSIKKSEKKLNKKLSKKMSAKFGKKNAKKAMAK

SEQ ID NO: 3031591 - protein, 20 aa, Entamoeba invadens
DSVKSEIDRERFDDKKEQEV

SEQ ID NO: 3031592 - protein, 8 aa, Entamoeba invadens
DSVPGKPD

SEQ ID NO: 3031593 - protein, 14 aa, Entamoeba invadens
DSVPKNGDTTTAGF

SEQ ID NO: 3031594 - protein, 14 aa, Entamoeba invadens
DSVTNTYDCSNDTD

SEQ ID NO: 3031595 - protein, 8 aa, Entamoeba invadens
DTAEPSGN

SEQ ID NO: 3031596 - protein, 11 aa, Entamoeba invadens
DTAGQEEYTSL

SEQ ID NO: 3031597 - protein, 9 aa, Entamoeba invadens
DTATAQSEE

SEQ ID NO: 3031598 - protein, 5 aa, Entamoeba invadens
DTCAT

SEQ ID NO: 3031599 - protein, 13 aa, Entamoeba invadens
DTCESKGSCTKCS

SEQ ID NO: 3031600 - protein, 8 aa, Entamoeba invadens
DTCGQEQY

SEQ ID NO: 3031601 - protein, 8 aa, Entamoeba invadens
DTCGTDQF

SEQ ID NO: 3031602 - protein, 13 aa, Entamoeba invadens
DTCNARKKAGKKF

SEQ ID NO: 3031603 - protein, 7 aa, Entamoeba invadens
DTCPQGQ

SEQ ID NO: 3031604 - protein, 4 aa, Entamoeba invadens
DTCQ

SEQ ID NO: 3031605 - protein, 5 aa, Entamoeba invadens
DTDDF

SEQ ID NO: 3031606 - protein, 8 aa, Entamoeba invadens
DTDEDEFN

SEQ ID NO: 3031607 - protein, 4 aa, Entamoeba invadens
DTDN

SEQ ID NO: 3031608 - protein, 14 aa, Entamoeba invadens
DTEGIEDFKEDNTH

SEQ ID NO: 3031609 - protein, 7 aa, Entamoeba invadens
DTETQGK

SEQ ID NO: 3031610 - protein, 6 aa, Entamoeba invadens
DTEVEY

SEQ ID NO: 3031611 - protein, 15 aa, Entamoeba invadens
DTGEDTPTKTSGTPK

SEQ ID NO: 3031612 - protein, 15 aa, Entamoeba invadens
DTGPDKVKTKFSNVG

SEQ ID NO: 3031613 - protein, 4 aa, Entamoeba invadens
DTHD

SEQ ID NO: 3031614 - protein, 33 aa, Entamoeba invadens
DTIADGAVRSAAGEHTPDSSESIRNSGFDGGYT

SEQ ID NO: 3031615 - protein, 9 aa, Entamoeba invadens
DTIRSQSNA

SEQ ID NO: 3031616 - protein, 11 aa, Entamoeba invadens
DTITEDYKGEF

SEQ ID NO: 3031617 - protein, 8 aa, Entamoeba invadens
DTKCSSAI

SEQ ID NO: 3031618 - protein, 8 aa, Entamoeba invadens
DTKDATGW

SEQ ID NO: 3031619 - protein, 16 aa, Entamoeba invadens
DTKDTETDSYENSASS

SEQ ID NO: 3031620 - protein, 17 aa, Entamoeba invadens
DTKDTETDSYENSASSL

SEQ ID NO: 3031621 - protein, 9 aa, Entamoeba invadens
DTKGKVEKA

SEQ ID NO: 3031622 - protein, 8 aa, Entamoeba invadens
DTKGRELS

SEQ ID NO: 3031623 - protein, 16 aa, Entamoeba invadens
DTKNSQNEEYETENGV

SEQ ID NO: 3031624 - protein, 20 aa, Entamoeba invadens
DTKTNQITSVKGNSCPRGDA

SEQ ID NO: 3031625 - protein, 9 aa, Entamoeba invadens
DTKTQKAVE

SEQ ID NO: 3031626 - protein, 6 aa, Entamoeba invadens
DTMQYT

SEQ ID NO: 3031627 - protein, 4 aa, Entamoeba invadens
DTNC

SEQ ID NO: 3031628 - protein, 6 aa, Entamoeba invadens
DTNDNM

SEQ ID NO: 3031629 - protein, 14 aa, Entamoeba invadens
DTNETSQNKTKIEI

SEQ ID NO: 3031630 - protein, 6 aa, Entamoeba invadens
DTNGLG

SEQ ID NO: 3031631 - protein, 10 aa, Entamoeba invadens
DTNYCNNQSG

SEQ ID NO: 3031632 - protein, 13 aa, Entamoeba invadens
DTQNGCVKTKDTC

SEQ ID NO: 3031633 - protein, 8 aa, Entamoeba invadens
DTRITNAQ

SEQ ID NO: 3031634 - protein, 5 aa, Entamoeba invadens
DTSFD

SEQ ID NO: 3031635 - protein, 10 aa, Entamoeba invadens
DTSGRSEYAS

SEQ ID NO: 3031636 - protein, 7 aa, Entamoeba invadens
DTSRSVC

SEQ ID NO: 3031637 - protein, 15 aa, Entamoeba invadens
DTSSDVISDTGKAIG

SEQ ID NO: 3031638 - protein, 5 aa, Entamoeba invadens
DTTKK

SEQ ID NO: 3031639 - protein, 16 aa, Entamoeba invadens
DTTKNKIDKMRGKAKS

SEQ ID NO: 3031640 - protein, 6 aa, Entamoeba invadens
DTTTEN

SEQ ID NO: 3031641 - protein, 10 aa, Entamoeba invadens
DTTTKNNWWP

SEQ ID NO: 3031642 - protein, 6 aa, Entamoeba invadens
DTTTNK

SEQ ID NO: 3031643 - protein, 10 aa, Entamoeba invadens
DTVKETTKNL

SEQ ID NO: 3031644 - protein, 8 aa, Entamoeba invadens
DTVNEREE

SEQ ID NO: 3031645 - protein, 7 aa, Entamoeba invadens
DTYAKDD

SEQ ID NO: 3031646 - protein, 8 aa, Entamoeba invadens
DTYPPTKY

SEQ ID NO: 3031647 - protein, 11 aa, Entamoeba invadens
DTYPVNVTGES

SEQ ID NO: 3031648 - protein, 11 aa, Entamoeba invadens
DTYQDGNQVAT

SEQ ID NO: 3031649 - protein, 5 aa, Entamoeba invadens
DVAES

SEQ ID NO: 3031650 - protein, 6 aa, Entamoeba invadens
DVAGDQ

SEQ ID NO: 3031651 - protein, 7 aa, Entamoeba invadens
DVAGTVG

SEQ ID NO: 3031652 - protein, 7 aa, Entamoeba invadens
DVDTESK

SEQ ID NO: 3031653 - protein, 19 aa, Entamoeba invadens
DVEDCSSQANAKLKNVTEQ

SEQ ID NO: 3031654 - protein, 7 aa, Entamoeba invadens
DVEGQTT

SEQ ID NO: 3031655 - protein, 8 aa, Entamoeba invadens
DVEITNKE

SEQ ID NO: 3031656 - protein, 8 aa, Entamoeba invadens
DVENTNDE

SEQ ID NO: 3031657 - protein, 45 aa, Entamoeba invadens
DVGAKVSQAATDVSKSYQAGGAKQVAKDLGKKALGAAKDYAIGKA

SEQ ID NO: 3031658 - protein, 6 aa, Entamoeba invadens
DVGSNR

SEQ ID NO: 3031659 - protein, 8 aa, Entamoeba invadens
DVKDANSY

SEQ ID NO: 3031660 - protein, 19 aa, Entamoeba invadens
DVKDGRTYTRGGKKYSRPC

SEQ ID NO: 3031661 - protein, 18 aa, Entamoeba invadens
DVKDGRTYTRGGKNYSRP

SEQ ID NO: 3031662 - protein, 8 aa, Entamoeba invadens
DVNEYGDD

SEQ ID NO: 3031663 - protein, 22 aa, Entamoeba invadens
DVNGQWSGKNFGSETRDNFGER

SEQ ID NO: 3031664 - protein, 9 aa, Entamoeba invadens
DVNHRTNTR

SEQ ID NO: 3031665 - protein, 7 aa, Entamoeba invadens
DVPNRGR

SEQ ID NO: 3031666 - protein, 6 aa, Entamoeba invadens
DVPSKS

SEQ ID NO: 3031667 - protein, 15 aa, Entamoeba invadens
DVQASGKRENVTEPT

SEQ ID NO: 3031668 - protein, 16 aa, Entamoeba invadens
DVSAHSPGDAFKDTMQ

SEQ ID NO: 3031669 - protein, 7 aa, Entamoeba invadens
DVSNNQI

SEQ ID NO: 3031670 - protein, 8 aa, Entamoeba invadens
DVSPKAVE

SEQ ID NO: 3031671 - protein, 4 aa, Entamoeba invadens
DVTE

SEQ ID NO: 3031672 - protein, 7 aa, Entamoeba invadens
DWNPENE

SEQ ID NO: 3031673 - protein, 19 aa, Entamoeba invadens
DWREEGKVTAIKDQKNCGS

SEQ ID NO: 3031674 - protein, 15 aa, Entamoeba invadens
DYADIGSSESNTPLS

SEQ ID NO: 3031675 - protein, 9 aa, Entamoeba invadens
DYATNDPAG

SEQ ID NO: 3031676 - protein, 5 aa, Entamoeba invadens
DYEPS

SEQ ID NO: 3031677 - protein, 12 aa, Entamoeba invadens
DYKKRDENGYSC

SEQ ID NO: 3031678 - protein, 9 aa, Entamoeba invadens
DYKNKQPKW

SEQ ID NO: 3031679 - protein, 6 aa, Entamoeba invadens
DYKQQV

SEQ ID NO: 3031680 - protein, 21 aa, Entamoeba invadens
DYMDDEDDDFSDDEDDEDEYD

SEQ ID NO: 3031681 - protein, 13 aa, Entamoeba invadens
DYPFTATDGECKV

SEQ ID NO: 3031682 - protein, 9 aa, Entamoeba invadens
DYPPQQEAT

SEQ ID NO: 3031683 - protein, 6 aa, Entamoeba invadens
DYPPTS

SEQ ID NO: 3031684 - protein, 5 aa, Entamoeba invadens
DYQYD

SEQ ID NO: 3031685 - protein, 4 aa, Entamoeba invadens
DYSK

SEQ ID NO: 3031686 - protein, 8 aa, Entamoeba invadens
DYSSWPPY

SEQ ID NO: 3031687 - protein, 6 aa, Entamoeba invadens
DYTHKD

SEQ ID NO: 3031688 - protein, 38 aa, Entamoeba invadens
DYTTDKNEDNANEEKEDKDDESNKDEEDVGMTNTDFGY

SEQ ID NO: 3031689 - protein, 4 aa, Entamoeba invadens
DYVS

SEQ ID NO: 3031690 - protein, 10 aa, Entamoeba invadens
DYYTVNTDDN

SEQ ID NO: 3031691 - protein, 8 aa, Entamoeba invadens
EAADDKSL

SEQ ID NO: 3031692 - protein, 5 aa, Entamoeba invadens
EAAKG

SEQ ID NO: 3031693 - protein, 5 aa, Entamoeba invadens
EACSS

SEQ ID NO: 3031694 - protein, 4 aa, Entamoeba invadens
EADA

SEQ ID NO: 3031695 - protein, 8 aa, Entamoeba invadens
EADAVDQQ

SEQ ID NO: 3031696 - protein, 8 aa, Entamoeba invadens
EADDPIRK

SEQ ID NO: 3031697 - protein, 24 aa, Entamoeba invadens
EAEEDNSKDLETQLHEKEDDIADL

SEQ ID NO: 3031698 - protein, 13 aa, Entamoeba invadens
EAERDDSKEAQKR

SEQ ID NO: 3031699 - protein, 6 aa, Entamoeba invadens
EAGNTI

SEQ ID NO: 3031700 - protein, 11 aa, Entamoeba invadens
EAIAEEKRQRL

SEQ ID NO: 3031701 - protein, 5 aa, Entamoeba invadens
EAIDS

SEQ ID NO: 3031702 - protein, 9 aa, Entamoeba invadens
EAKEGETRV

SEQ ID NO: 3031703 - protein, 8 aa, Entamoeba invadens
EAKPGETR

SEQ ID NO: 3031704 - protein, 8 aa, Entamoeba invadens
EAKQGIAA

SEQ ID NO: 3031705 - protein, 9 aa, Entamoeba invadens
EAKSYDEWK

SEQ ID NO: 3031706 - protein, 6 aa, Entamoeba invadens
EAKYTK

SEQ ID NO: 3031707 - protein, 6 aa, Entamoeba invadens
EALENS

SEQ ID NO: 3031708 - protein, 6 aa, Entamoeba invadens
EALERG

SEQ ID NO: 3031709 - protein, 12 aa, Entamoeba invadens
EALPPSEEEDGF

SEQ ID NO: 3031710 - protein, 7 aa, Entamoeba invadens
EAMNKTE

SEQ ID NO: 3031711 - protein, 6 aa, Entamoeba invadens
EAQATQ

SEQ ID NO: 3031712 - protein, 15 aa, Entamoeba invadens
EAQEEKTATSDIYHH

SEQ ID NO: 3031713 - protein, 10 aa, Entamoeba invadens
EARPSPKSID

SEQ ID NO: 3031714 - protein, 17 aa, Entamoeba invadens
EASCTSTDFSNVDGTKF

SEQ ID NO: 3031715 - protein, 14 aa, Entamoeba invadens
EATHGGQLSKKENK

SEQ ID NO: 3031716 - protein, 16 aa, Entamoeba invadens
EATKGGVSVGPSAANT

SEQ ID NO: 3031717 - protein, 5 aa, Entamoeba invadens
EATTG

SEQ ID NO: 3031718 - protein, 14 aa, Entamoeba invadens
EAVEAEKVDKNRRE

SEQ ID NO: 3031719 - protein, 13 aa, Entamoeba invadens
EAVGDAYANNKTL

SEQ ID NO: 3031720 - protein, 6 aa, Entamoeba invadens
EAYDKN

SEQ ID NO: 3031721 - protein, 7 aa, Entamoeba invadens
EAYQTSS

SEQ ID NO: 3031722 - protein, 4 aa, Entamoeba invadens
ECDD

SEQ ID NO: 3031723 - protein, 6 aa, Entamoeba invadens
ECDGNA

SEQ ID NO: 3031724 - protein, 19 aa, Entamoeba invadens
ECDNKMQKDIKEVIHQFET

SEQ ID NO: 3031725 - protein, 7 aa, Entamoeba invadens
ECDTCGT

SEQ ID NO: 3031726 - protein, 13 aa, Entamoeba invadens
ECKAEYDNDRSCN

SEQ ID NO: 3031727 - protein, 7 aa, Entamoeba invadens
ECKEYTT

SEQ ID NO: 3031728 - protein, 7 aa, Entamoeba invadens
ECKPPVE

SEQ ID NO: 3031729 - protein, 10 aa, Entamoeba invadens
ECKSCSTNNA

SEQ ID NO: 3031730 - protein, 9 aa, Entamoeba invadens
ECLDESDYE

SEQ ID NO: 3031731 - protein, 24 aa, Entamoeba invadens
ECLTESQENLKVKQEDLSSKRGDN

SEQ ID NO: 3031732 - protein, 9 aa, Entamoeba invadens
ECNNAEKAY

SEQ ID NO: 3031733 - protein, 5 aa, Entamoeba invadens
ECNQK

SEQ ID NO: 3031734 - protein, 14 aa, Entamoeba invadens
ECPAGSNSEHCSGD

SEQ ID NO: 3031735 - protein, 9 aa, Entamoeba invadens
ECPQATNSL

SEQ ID NO: 3031736 - protein, 22 aa, Entamoeba invadens
ECQNGSMCNTTELNKNVSDLRK

SEQ ID NO: 3031737 - protein, 6 aa, Entamoeba invadens
ECSERK

SEQ ID NO: 3031738 - protein, 8 aa, Entamoeba invadens
ECSGNSFN

SEQ ID NO: 3031739 - protein, 6 aa, Entamoeba invadens
ECSTTN

SEQ ID NO: 3031740 - protein, 11 aa, Entamoeba invadens
ECTDTEEYKEL

SEQ ID NO: 3031741 - protein, 12 aa, Entamoeba invadens
ECTNATSCTQCT

SEQ ID NO: 3031742 - protein, 21 aa, Entamoeba invadens
ECTQTGDSSSEKASKADGKVS

SEQ ID NO: 3031743 - protein, 7 aa, Entamoeba invadens
ECTYTKA

SEQ ID NO: 3031744 - protein, 4 aa, Entamoeba invadens
ECVS

SEQ ID NO: 3031745 - protein, 4 aa, Entamoeba invadens
EDAA

SEQ ID NO: 3031746 - protein, 7 aa, Entamoeba invadens
EDAERHI

SEQ ID NO: 3031747 - protein, 9 aa, Entamoeba invadens
EDASPNSIK

SEQ ID NO: 3031748 - protein, 9 aa, Entamoeba invadens
EDATLKENY

SEQ ID NO: 3031749 - protein, 8 aa, Entamoeba invadens
EDDDKQDI

SEQ ID NO: 3031750 - protein, 6 aa, Entamoeba invadens
EDDHEV

SEQ ID NO: 3031751 - protein, 4 aa, Entamoeba invadens
EDDN

SEQ ID NO: 3031752 - protein, 16 aa, Entamoeba invadens
EDDNSITDLTTDTPIS

SEQ ID NO: 3031753 - protein, 7 aa, Entamoeba invadens
EDDRPDG

SEQ ID NO: 3031754 - protein, 6 aa, Entamoeba invadens
EDDTQC

SEQ ID NO: 3031755 - protein, 6 aa, Entamoeba invadens
EDDYYK

SEQ ID NO: 3031756 - protein, 6 aa, Entamoeba invadens
EDEKTY

SEQ ID NO: 3031757 - protein, 9 aa, Entamoeba invadens
EDETEGTLD

SEQ ID NO: 3031758 - protein, 8 aa, Entamoeba invadens
EDGIPEKT

SEQ ID NO: 3031759 - protein, 4 aa, Entamoeba invadens
EDGK

SEQ ID NO: 3031760 - protein, 7 aa, Entamoeba invadens
EDGSDIV

SEQ ID NO: 3031761 - protein, 22 aa, Entamoeba invadens
EDIEDFEEDNEEEQNESDNEEK

SEQ ID NO: 3031762 - protein, 14 aa, Entamoeba invadens
EDIEHAKTQHEERL

SEQ ID NO: 3031763 - protein, 4 aa, Entamoeba invadens
EDKG

SEQ ID NO: 3031764 - protein, 11 aa, Entamoeba invadens
EDKKDAQKDKV

SEQ ID NO: 3031765 - protein, 20 aa, Entamoeba invadens
EDKNTVSINKYSDEKCTVAE

SEQ ID NO: 3031766 - protein, 4 aa, Entamoeba invadens
EDKT

SEQ ID NO: 3031767 - protein, 16 aa, Entamoeba invadens
EDLKETSYLGNNAQIG

SEQ ID NO: 3031768 - protein, 6 aa, Entamoeba invadens
EDNIAD

SEQ ID NO: 3031769 - protein, 8 aa, Entamoeba invadens
EDNKADIG

SEQ ID NO: 3031770 - protein, 13 aa, Entamoeba invadens
EDNLNNSTLLKIK

SEQ ID NO: 3031771 - protein, 8 aa, Entamoeba invadens
EDNYGRVS

SEQ ID NO: 3031772 - protein, 5 aa, Entamoeba invadens
EDQKS

SEQ ID NO: 3031773 - protein, 8 aa, Entamoeba invadens
EDQYENEM

SEQ ID NO: 3031774 - protein, 13 aa, Entamoeba invadens
EDRESASKRRDEV

SEQ ID NO: 3031775 - protein, 4 aa, Entamoeba invadens
EDRL

SEQ ID NO: 3031776 - protein, 7 aa, Entamoeba invadens
EDSGNFV

SEQ ID NO: 3031777 - protein, 15 aa, Entamoeba invadens
EDSKPRQDAEEAGRC

SEQ ID NO: 3031778 - protein, 4 aa, Entamoeba invadens
EDSL

SEQ ID NO: 3031779 - protein, 4 aa, Entamoeba invadens
EDSM

SEQ ID NO: 3031780 - protein, 7 aa, Entamoeba invadens
EDSNGSL

SEQ ID NO: 3031781 - protein, 16 aa, Entamoeba invadens
EDSPKPSEIQEETHPI

SEQ ID NO: 3031782 - protein, 21 aa, Entamoeba invadens
EDSRPRKNTENEVAGRCGNTN

SEQ ID NO: 3031783 - protein, 6 aa, Entamoeba invadens
EDSTSF

SEQ ID NO: 3031784 - protein, 9 aa, Entamoeba invadens
EDTAKRLPK

SEQ ID NO: 3031785 - protein, 7 aa, Entamoeba invadens
EDTGNYV

SEQ ID NO: 3031786 - protein, 11 aa, Entamoeba invadens
EDTKMATKRKD

SEQ ID NO: 3031787 - protein, 9 aa, Entamoeba invadens
EDTKSDYYP

SEQ ID NO: 3031788 - protein, 11 aa, Entamoeba invadens
EDTNNYRPQGD

SEQ ID NO: 3031789 - protein, 8 aa, Entamoeba invadens
EDTPIKPN

SEQ ID NO: 3031790 - protein, 9 aa, Entamoeba invadens
EDTTDTNGV

SEQ ID NO: 3031791 - protein, 9 aa, Entamoeba invadens
EDTTQPIPY

SEQ ID NO: 3031792 - protein, 4 aa, Entamoeba invadens
EDWP

SEQ ID NO: 3031793 - protein, 8 aa, Entamoeba invadens
EDYHPPKP

SEQ ID NO: 3031794 - protein, 13 aa, Entamoeba invadens
EDYSTTEINESDL

SEQ ID NO: 3031795 - protein, 7 aa, Entamoeba invadens
EEAASNV

SEQ ID NO: 3031796 - protein, 4 aa, Entamoeba invadens
EEAD

SEQ ID NO: 3031797 - protein, 9 aa, Entamoeba invadens
EEAHSKEEL

SEQ ID NO: 3031798 - protein, 23 aa, Entamoeba invadens
EEAKSATGKLETLKESAKKNHDL

SEQ ID NO: 3031799 - protein, 9 aa, Entamoeba invadens
EEAKTNIET

SEQ ID NO: 3031800 - protein, 14 aa, Entamoeba invadens
EEARLNKSKTEKIK

SEQ ID NO: 3031801 - protein, 6 aa, Entamoeba invadens
EEASLN

SEQ ID NO: 3031802 - protein, 19 aa, Entamoeba invadens
EEATADGVESKDIKTECRS

SEQ ID NO: 3031803 - protein, 9 aa, Entamoeba invadens
EEAYNKNQQ

SEQ ID NO: 3031804 - protein, 14 aa, Entamoeba invadens
EEDDDEKEDGDKDE

SEQ ID NO: 3031805 - protein, 6 aa, Entamoeba invadens
EEDDIP

SEQ ID NO: 3031806 - protein, 5 aa, Entamoeba invadens
EEDDV

SEQ ID NO: 3031807 - protein, 18 aa, Entamoeba invadens
EEDEDDFELEEAEEEENF

SEQ ID NO: 3031808 - protein, 10 aa, Entamoeba invadens
EEDERQLQTA

SEQ ID NO: 3031809 - protein, 8 aa, Entamoeba invadens
EEDGTAID

SEQ ID NO: 3031810 - protein, 7 aa, Entamoeba invadens
EEDIKKN

SEQ ID NO: 3031811 - protein, 10 aa, Entamoeba invadens
EEEAPIETQG

SEQ ID NO: 3031812 - protein, 6 aa, Entamoeba invadens
EEEEIR

SEQ ID NO: 3031813 - protein, 13 aa, Entamoeba invadens
EEEKKASRDDIDE

SEQ ID NO: 3031814 - protein, 5 aa, Entamoeba invadens
EEERR

SEQ ID NO: 3031815 - protein, 22 aa, Entamoeba invadens
EEESSNTNKPTTQSTEKKPSAA

SEQ ID NO: 3031816 - protein, 5 aa, Entamoeba invadens
EEETN

SEQ ID NO: 3031817 - protein, 34 aa, Entamoeba invadens
EEEVEDTDAMRKEATEKAKAKIEAGEKEKTEEEL

SEQ ID NO: 3031818 - protein, 7 aa, Entamoeba invadens
EEGCAEA

SEQ ID NO: 3031819 - protein, 6 aa, Entamoeba invadens
EEGDNA

SEQ ID NO: 3031820 - protein, 6 aa, Entamoeba invadens
EEGDRE

SEQ ID NO: 3031821 - protein, 5 aa, Entamoeba invadens
EEGIH

SEQ ID NO: 3031822 - protein, 11 aa, Entamoeba invadens
EEGKCKECEPT

SEQ ID NO: 3031823 - protein, 21 aa, Entamoeba invadens
EEGMPIKRKETKGDMLVEVII

SEQ ID NO: 3031824 - protein, 7 aa, Entamoeba invadens
EEGSSLE

SEQ ID NO: 3031825 - protein, 6 aa, Entamoeba invadens
EEIKES

SEQ ID NO: 3031826 - protein, 16 aa, Entamoeba invadens
EEIKQTKKTEKKTNAV

SEQ ID NO: 3031827 - protein, 6 aa, Entamoeba invadens
EEITRN

SEQ ID NO: 3031828 - protein, 6 aa, Entamoeba invadens
EEKAHP

SEQ ID NO: 3031829 - protein, 9 aa, Entamoeba invadens
EEKKANRQR

SEQ ID NO: 3031830 - protein, 7 aa, Entamoeba invadens
EEKKRCA

SEQ ID NO: 3031831 - protein, 6 aa, Entamoeba invadens
EEKNKN

SEQ ID NO: 3031832 - protein, 10 aa, Entamoeba invadens
EEKTKELNKA

SEQ ID NO: 3031833 - protein, 8 aa, Entamoeba invadens
EELSEGKS

SEQ ID NO: 3031834 - protein, 15 aa, Entamoeba invadens
EELSTTEIEDNDSGS

SEQ ID NO: 3031835 - protein, 20 aa, Entamoeba invadens
EEMDDDEDLLDEDDDCPCNK

SEQ ID NO: 3031836 - protein, 5 aa, Entamoeba invadens
EEMKE

SEQ ID NO: 3031837 - protein, 7 aa, Entamoeba invadens
EENEFSD

SEQ ID NO: 3031838 - protein, 12 aa, Entamoeba invadens
EENEGGMSNKEK

SEQ ID NO: 3031839 - protein, 4 aa, Entamoeba invadens
EENV

SEQ ID NO: 3031840 - protein, 9 aa, Entamoeba invadens
EEPAENSSD

SEQ ID NO: 3031841 - protein, 19 aa, Entamoeba invadens
EEPMYSRDQEIKNAQDTVE

SEQ ID NO: 3031842 - protein, 6 aa, Entamoeba invadens
EEPYKD

SEQ ID NO: 3031843 - protein, 24 aa, Entamoeba invadens
EERRKYEDRQRTRSVKKKQVRVTM

SEQ ID NO: 3031844 - protein, 33 aa, Entamoeba invadens
EERSIDANIKSAKLSLSQGESSLKKLTEKQKSL

SEQ ID NO: 3031845 - protein, 69 aa, Entamoeba invadens
EERTKHEGDVVRPKEQPKESQSDETKPTDEPTKQIQQSQDVRPKTKTSEDKPISRRKHRRSTYAVSEYQ

SEQ ID NO: 3031846 - protein, 5 aa, Entamoeba invadens
EERTT

SEQ ID NO: 3031847 - protein, 11 aa, Entamoeba invadens
EESAAKFEELE

SEQ ID NO: 3031848 - protein, 11 aa, Entamoeba invadens
EESGAGGYDAS

SEQ ID NO: 3031849 - protein, 12 aa, Entamoeba invadens
EESGDRLPTSST

SEQ ID NO: 3031850 - protein, 6 aa, Entamoeba invadens
EESGKG

SEQ ID NO: 3031851 - protein, 7 aa, Entamoeba invadens
EETATKE

SEQ ID NO: 3031852 - protein, 10 aa, Entamoeba invadens
EETEITEESV

SEQ ID NO: 3031853 - protein, 7 aa, Entamoeba invadens
EETKRYK

SEQ ID NO: 3031854 - protein, 11 aa, Entamoeba invadens
EETKYVKKDNT

SEQ ID NO: 3031855 - protein, 4 aa, Entamoeba invadens
EETP

SEQ ID NO: 3031856 - protein, 10 aa, Entamoeba invadens
EETSTRGGGY

SEQ ID NO: 3031857 - protein, 8 aa, Entamoeba invadens
EETTQPIQ

SEQ ID NO: 3031858 - protein, 4 aa, Entamoeba invadens
EEVE

SEQ ID NO: 3031859 - protein, 8 aa, Entamoeba invadens
EEVEPSVN

SEQ ID NO: 3031860 - protein, 4 aa, Entamoeba invadens
EEVG

SEQ ID NO: 3031861 - protein, 14 aa, Entamoeba invadens
EEVTKSTEKNGDLG

SEQ ID NO: 3031862 - protein, 5 aa, Entamoeba invadens
EEVTR

SEQ ID NO: 3031863 - protein, 17 aa, Entamoeba invadens
EEWGEKFKESAKAIADK

SEQ ID NO: 3031864 - protein, 7 aa, Entamoeba invadens
EEYKSLE

SEQ ID NO: 3031865 - protein, 8 aa, Entamoeba invadens
EEYNTEGF

SEQ ID NO: 3031866 - protein, 24 aa, Entamoeba invadens
EEYQLQQNNENAIGMGETGISRVE

SEQ ID NO: 3031867 - protein, 13 aa, Entamoeba invadens
EFDDTKDSNEFQL

SEQ ID NO: 3031868 - protein, 4 aa, Entamoeba invadens
EFED

SEQ ID NO: 3031869 - protein, 6 aa, Entamoeba invadens
EFESKD

SEQ ID NO: 3031870 - protein, 4 aa, Entamoeba invadens
EFNS

SEQ ID NO: 3031871 - protein, 10 aa, Entamoeba invadens
EFQEKGEKRI

SEQ ID NO: 3031872 - protein, 7 aa, Entamoeba invadens
EFQSNGK

SEQ ID NO: 3031873 - protein, 6 aa, Entamoeba invadens
EFSKVE

SEQ ID NO: 3031874 - protein, 10 aa, Entamoeba invadens
EFSPSTEALP

SEQ ID NO: 3031875 - protein, 4 aa, Entamoeba invadens
EFTG

SEQ ID NO: 3031876 - protein, 9 aa, Entamoeba invadens
EGAAKNNQF

SEQ ID NO: 3031877 - protein, 11 aa, Entamoeba invadens
EGACSENSEGY

SEQ ID NO: 3031878 - protein, 4 aa, Entamoeba invadens
EGAQ

SEQ ID NO: 3031879 - protein, 6 aa, Entamoeba invadens
EGASQV

SEQ ID NO: 3031880 - protein, 23 aa, Entamoeba invadens
EGAYKSRKEGHKKSIKKEARESV

SEQ ID NO: 3031881 - protein, 15 aa, Entamoeba invadens
EGCTDCDENGCSHCT

SEQ ID NO: 3031882 - protein, 14 aa, Entamoeba invadens
EGDLKKEEVNGCGR

SEQ ID NO: 3031883 - protein, 15 aa, Entamoeba invadens
EGDNIQSYKSSTCSN

SEQ ID NO: 3031884 - protein, 11 aa, Entamoeba invadens
EGDNTDSASTV

SEQ ID NO: 3031885 - protein, 8 aa, Entamoeba invadens
EGDVSSYD

SEQ ID NO: 3031886 - protein, 5 aa, Entamoeba invadens
EGEDI

SEQ ID NO: 3031887 - protein, 14 aa, Entamoeba invadens
EGEENSESSNTTSQ

SEQ ID NO: 3031888 - protein, 28 aa, Entamoeba invadens
EGFAETPTTSPRRKQLQVPSSFESTEDG

SEQ ID NO: 3031889 - protein, 15 aa, Entamoeba invadens
EGFSTIGDKAVGGAN

SEQ ID NO: 3031890 - protein, 7 aa, Entamoeba invadens
EGFYPNK

SEQ ID NO: 3031891 - protein, 10 aa, Entamoeba invadens
EGGKCNGDNA

SEQ ID NO: 3031892 - protein, 9 aa, Entamoeba invadens
EGGRCNGAD

SEQ ID NO: 3031893 - protein, 4 aa, Entamoeba invadens
EGGW

SEQ ID NO: 3031894 - protein, 10 aa, Entamoeba invadens
EGHESSTEKK

SEQ ID NO: 3031895 - protein, 13 aa, Entamoeba invadens
EGISDAVDKGTKW

SEQ ID NO: 3031896 - protein, 9 aa, Entamoeba invadens
EGKCQSGEI

SEQ ID NO: 3031897 - protein, 7 aa, Entamoeba invadens
EGKCSAC

SEQ ID NO: 3031898 - protein, 5 aa, Entamoeba invadens
EGKER

SEQ ID NO: 3031899 - protein, 21 aa, Entamoeba invadens
EGLKGYDKSAFKPTIKQALIT

SEQ ID NO: 3031900 - protein, 10 aa, Entamoeba invadens
EGLNEARKIG

SEQ ID NO: 3031901 - protein, 7 aa, Entamoeba invadens
EGNIYQS

SEQ ID NO: 3031902 - protein, 10 aa, Entamoeba invadens
EGNKNTGKKA

SEQ ID NO: 3031903 - protein, 4 aa, Entamoeba invadens
EGNS

SEQ ID NO: 3031904 - protein, 8 aa, Entamoeba invadens
EGQTTQTC

SEQ ID NO: 3031905 - protein, 12 aa, Entamoeba invadens
EGQTYAKENGYP

SEQ ID NO: 3031906 - protein, 5 aa, Entamoeba invadens
EGRAA

SEQ ID NO: 3031907 - protein, 11 aa, Entamoeba invadens
EGSGDVPSSIP

SEQ ID NO: 3031908 - protein, 25 aa, Entamoeba invadens
EGSTKCTSCSPSCKNCSSTTGNCTS

SEQ ID NO: 3031909 - protein, 10 aa, Entamoeba invadens
EGSTTQCKTC

SEQ ID NO: 3031910 - protein, 5 aa, Entamoeba invadens
EGTCR

SEQ ID NO: 3031911 - protein, 9 aa, Entamoeba invadens
EGTKCSGKS

SEQ ID NO: 3031912 - protein, 7 aa, Entamoeba invadens
EGTLTGN

SEQ ID NO: 3031913 - protein, 5 aa, Entamoeba invadens
EGVDQ

SEQ ID NO: 3031914 - protein, 5 aa, Entamoeba invadens
EGVPP

SEQ ID NO: 3031915 - protein, 5 aa, Entamoeba invadens
EGVSN

SEQ ID NO: 3031916 - protein, 4 aa, Entamoeba invadens
EGVT

SEQ ID NO: 3031917 - protein, 12 aa, Entamoeba invadens
EGVVADGKTKFD

SEQ ID NO: 3031918 - protein, 5 aa, Entamoeba invadens
EGYPG

SEQ ID NO: 3031919 - protein, 11 aa, Entamoeba invadens
EGYSPNDGDTA

SEQ ID NO: 3031920 - protein, 4 aa, Entamoeba invadens
EGYT

SEQ ID NO: 3031921 - protein, 15 aa, Entamoeba invadens
EGYYPGYPHVYHKLS

SEQ ID NO: 3031922 - protein, 5 aa, Entamoeba invadens
EHDPR

SEQ ID NO: 3031923 - protein, 10 aa, Entamoeba invadens
EHEKYKNDRN

SEQ ID NO: 3031924 - protein, 8 aa, Entamoeba invadens
EHTRTSLP

SEQ ID NO: 3031925 - protein, 11 aa, Entamoeba invadens
EIAGGKSYVEA

SEQ ID NO: 3031926 - protein, 93 aa, Entamoeba invadens
EIASDEDDEVDIDDEEEEDNEEEEDEEDDDDDFELSDDDDDEDRRRRRHGRSWRGRRRHHRRGGRRHHRRYSRHNKRRHNRKCPKGRRGKKCR

SEQ ID NO: 3031927 - protein, 10 aa, Entamoeba invadens
EIDDSGNVLE

SEQ ID NO: 3031928 - protein, 9 aa, Entamoeba invadens
EIEEKRNSI

SEQ ID NO: 3031929 - protein, 9 aa, Entamoeba invadens
EIEQPQQSD

SEQ ID NO: 3031930 - protein, 8 aa, Entamoeba invadens
EIKPTAPI

SEQ ID NO: 3031931 - protein, 13 aa, Entamoeba invadens
EINDRDQLDNKEE

SEQ ID NO: 3031932 - protein, 29 aa, Entamoeba invadens
EINEESKAQKLLEKEKKDKKRKMKSLDGK

SEQ ID NO: 3031933 - protein, 5 aa, Entamoeba invadens
EINEK

SEQ ID NO: 3031934 - protein, 6 aa, Entamoeba invadens
EIPEDQ

SEQ ID NO: 3031935 - protein, 13 aa, Entamoeba invadens
EIQRNKEQEESTH

SEQ ID NO: 3031936 - protein, 5 aa, Entamoeba invadens
EIRED

SEQ ID NO: 3031937 - protein, 18 aa, Entamoeba invadens
EISAGNRPIAADSIDKKY

SEQ ID NO: 3031938 - protein, 10 aa, Entamoeba invadens
EISSSTINLT

SEQ ID NO: 3031939 - protein, 7 aa, Entamoeba invadens
EITDQTS

SEQ ID NO: 3031940 - protein, 7 aa, Entamoeba invadens
EITEGVN

SEQ ID NO: 3031941 - protein, 11 aa, Entamoeba invadens
EITESGSCESI

SEQ ID NO: 3031942 - protein, 13 aa, Entamoeba invadens
EIVGSTKSEIKDG

SEQ ID NO: 3031943 - protein, 7 aa, Entamoeba invadens
EKADGSY

SEQ ID NO: 3031944 - protein, 6 aa, Entamoeba invadens
EKAGNF

SEQ ID NO: 3031945 - protein, 9 aa, Entamoeba invadens
EKAGSQDGA

SEQ ID NO: 3031946 - protein, 21 aa, Entamoeba invadens
EKAKELKKSLKIKKDTARSKY

SEQ ID NO: 3031947 - protein, 25 aa, Entamoeba invadens
EKAKNENDELKTTLNTQEEKLKEAE

SEQ ID NO: 3031948 - protein, 46 aa, Entamoeba invadens
EKAQAEKDAKAEKEEKAAQKAATVQTRPASPTTQPQQVTKPQSPKK

SEQ ID NO: 3031949 - protein, 73 aa, Entamoeba invadens
EKAQTETKKTQEKAEKKAKKAAEQAKKDAKKAAKQAKKDVKTATKEVKQAAKDTKAEVKDANKQIKKDNKEVV

SEQ ID NO: 3031950 - protein, 12 aa, Entamoeba invadens
EKAVEKAEKIAK

SEQ ID NO: 3031951 - protein, 11 aa, Entamoeba invadens
EKCAGTSARRE

SEQ ID NO: 3031952 - protein, 8 aa, Entamoeba invadens
EKCNENTL

SEQ ID NO: 3031953 - protein, 9 aa, Entamoeba invadens
EKCPSGTQT

SEQ ID NO: 3031954 - protein, 7 aa, Entamoeba invadens
EKCSNSY

SEQ ID NO: 3031955 - protein, 11 aa, Entamoeba invadens
EKCTKCSPNAF

SEQ ID NO: 3031956 - protein, 6 aa, Entamoeba invadens
EKCTPE

SEQ ID NO: 3031957 - protein, 14 aa, Entamoeba invadens
EKCTTLDADPYTTH

SEQ ID NO: 3031958 - protein, 9 aa, Entamoeba invadens
EKDANPIEY

SEQ ID NO: 3031959 - protein, 7 aa, Entamoeba invadens
EKDAREL

SEQ ID NO: 3031960 - protein, 4 aa, Entamoeba invadens
EKDG

SEQ ID NO: 3031961 - protein, 9 aa, Entamoeba invadens
EKDGETKTL

SEQ ID NO: 3031962 - protein, 6 aa, Entamoeba invadens
EKDGKT

SEQ ID NO: 3031963 - protein, 7 aa, Entamoeba invadens
EKDGTNF

SEQ ID NO: 3031964 - protein, 7 aa, Entamoeba invadens
EKDIQTF

SEQ ID NO: 3031965 - protein, 9 aa, Entamoeba invadens
EKDKPEIKN

SEQ ID NO: 3031966 - protein, 9 aa, Entamoeba invadens
EKDPSNKKY

SEQ ID NO: 3031967 - protein, 21 aa, Entamoeba invadens
EKDQNIEEMKKQDKDQKSEMV

SEQ ID NO: 3031968 - protein, 11 aa, Entamoeba invadens
EKDWKRENDTV

SEQ ID NO: 3031969 - protein, 30 aa, Entamoeba invadens
EKEEKGVKPGIEEDKDKAAKKLAKKMAKKL

SEQ ID NO: 3031970 - protein, 5 aa, Entamoeba invadens
EKEHC

SEQ ID NO: 3031971 - protein, 26 aa, Entamoeba invadens
EKEIKEKQEERTENKVKIDKGVNGKL

SEQ ID NO: 3031972 - protein, 18 aa, Entamoeba invadens
EKEKTYRTSKTAEQNEKL

SEQ ID NO: 3031973 - protein, 10 aa, Entamoeba invadens
EKELQNGPSE

SEQ ID NO: 3031974 - protein, 30 aa, Entamoeba invadens
EKELQTSINQKEAQENEIKSVSKSVEDITE

SEQ ID NO: 3031975 - protein, 16 aa, Entamoeba invadens
EKENAKQMIQNKLIKN

SEQ ID NO: 3031976 - protein, 6 aa, Entamoeba invadens
EKEREE

SEQ ID NO: 3031977 - protein, 14 aa, Entamoeba invadens
EKESGPSKGREAIR

SEQ ID NO: 3031978 - protein, 4 aa, Entamoeba invadens
EKFE

SEQ ID NO: 3031979 - protein, 7 aa, Entamoeba invadens
EKFEDKL

SEQ ID NO: 3031980 - protein, 6 aa, Entamoeba invadens
EKFETE

SEQ ID NO: 3031981 - protein, 4 aa, Entamoeba invadens
EKFQ

SEQ ID NO: 3031982 - protein, 9 aa, Entamoeba invadens
EKFSTNFEN

SEQ ID NO: 3031983 - protein, 8 aa, Entamoeba invadens
EKGDRNSE

SEQ ID NO: 3031984 - protein, 14 aa, Entamoeba invadens
EKGEGYIKTEKERI

SEQ ID NO: 3031985 - protein, 8 aa, Entamoeba invadens
EKGKSIKA

SEQ ID NO: 3031986 - protein, 17 aa, Entamoeba invadens
EKGYNDTDLTINPSVSR

SEQ ID NO: 3031987 - protein, 6 aa, Entamoeba invadens
EKHPDE

SEQ ID NO: 3031988 - protein, 14 aa, Entamoeba invadens
EKIEATVSNAGVKT

SEQ ID NO: 3031989 - protein, 12 aa, Entamoeba invadens
EKIEKTTESITK

SEQ ID NO: 3031990 - protein, 4 aa, Entamoeba invadens
EKII

SEQ ID NO: 3031991 - protein, 9 aa, Entamoeba invadens
EKIKRNAAE

SEQ ID NO: 3031992 - protein, 12 aa, Entamoeba invadens
EKISNQTSEQTI

SEQ ID NO: 3031993 - protein, 16 aa, Entamoeba invadens
EKITKKVKGKIETIED

SEQ ID NO: 3031994 - protein, 9 aa, Entamoeba invadens
EKKADSTLS

SEQ ID NO: 3031995 - protein, 9 aa, Entamoeba invadens
EKKAEAAYK

SEQ ID NO: 3031996 - protein, 36 aa, Entamoeba invadens
EKKEVKTEEKTEEKKKEKKKEEKKEESPVEKQTKEV

SEQ ID NO: 3031997 - protein, 11 aa, Entamoeba invadens
EKKGERLKKRV

SEQ ID NO: 3031998 - protein, 8 aa, Entamoeba invadens
EKKGYKQK

SEQ ID NO: 3031999 - protein, 29 aa, Entamoeba invadens
EKKKAQERAEKAEKLAKEKAKQKKAIKEL

SEQ ID NO: 3032000 - protein, 137 aa, Entamoeba invadens
EKKKEQKKLAKQERKLQKEEHKKTIDEKKAEKKLAKETRKEKKEERKVKIDKKKAEKKIKKEERKAKKEERKKVIEKKRSEKKIKKEERKAKKEEKKIKKDLAKQKAKETKEKRKLLKEEKRLEKEKKKASKKSLKK

SEQ ID NO: 3032001 - protein, 9 aa, Entamoeba invadens
EKKKNDLRQ

SEQ ID NO: 3032002 - protein, 9 aa, Entamoeba invadens
EKKKVTKSA

SEQ ID NO: 3032003 - protein, 8 aa, Entamoeba invadens
EKKRTETL

SEQ ID NO: 3032004 - protein, 17 aa, Entamoeba invadens
EKKSAITATYSGLPTST

SEQ ID NO: 3032005 - protein, 7 aa, Entamoeba invadens
EKKYDDY

SEQ ID NO: 3032006 - protein, 9 aa, Entamoeba invadens
EKLAENNQL

SEQ ID NO: 3032007 - protein, 16 aa, Entamoeba invadens
EKLEEDEKAKKERDER

SEQ ID NO: 3032008 - protein, 8 aa, Entamoeba invadens
EKLEEYDD

SEQ ID NO: 3032009 - protein, 19 aa, Entamoeba invadens
EKLEGKAEKKAEKKEEQKS

SEQ ID NO: 3032010 - protein, 14 aa, Entamoeba invadens
EKLNSGALGHTGKK

SEQ ID NO: 3032011 - protein, 7 aa, Entamoeba invadens
EKLPESY

SEQ ID NO: 3032012 - protein, 5 aa, Entamoeba invadens
EKLPR

SEQ ID NO: 3032013 - protein, 6 aa, Entamoeba invadens
EKLSTE

SEQ ID NO: 3032014 - protein, 7 aa, Entamoeba invadens
EKLTGNR

SEQ ID NO: 3032015 - protein, 7 aa, Entamoeba invadens
EKMNNNS

SEQ ID NO: 3032016 - protein, 4 aa, Entamoeba invadens
EKMR

SEQ ID NO: 3032017 - protein, 15 aa, Entamoeba invadens
EKNCRTEIGDNQRPT

SEQ ID NO: 3032018 - protein, 15 aa, Entamoeba invadens
EKNCVTDPRDQGNCG

SEQ ID NO: 3032019 - protein, 13 aa, Entamoeba invadens
EKNGKVEKLEKNG

SEQ ID NO: 3032020 - protein, 7 aa, Entamoeba invadens
EKNGNNL

SEQ ID NO: 3032021 - protein, 11 aa, Entamoeba invadens
EKNGPAVTETI

SEQ ID NO: 3032022 - protein, 7 aa, Entamoeba invadens
EKNITIP

SEQ ID NO: 3032023 - protein, 30 aa, Entamoeba invadens
EKNNLNEEFKEEHDKAKEQLKQSQSENEKL

SEQ ID NO: 3032024 - protein, 38 aa, Entamoeba invadens
EKNNTQNKTEDVKEEIEHSGDQLETNKTTEKEKTEEEL

SEQ ID NO: 3032025 - protein, 6 aa, Entamoeba invadens
EKNQDK

SEQ ID NO: 3032026 - protein, 6 aa, Entamoeba invadens
EKNRLN

SEQ ID NO: 3032027 - protein, 4 aa, Entamoeba invadens
EKPA

SEQ ID NO: 3032028 - protein, 8 aa, Entamoeba invadens
EKQERKLQ

SEQ ID NO: 3032029 - protein, 8 aa, Entamoeba invadens
EKQIEKRH

SEQ ID NO: 3032030 - protein, 9 aa, Entamoeba invadens
EKQKSHVGI

SEQ ID NO: 3032031 - protein, 5 aa, Entamoeba invadens
EKQTF

SEQ ID NO: 3032032 - protein, 7 aa, Entamoeba invadens
EKQVKNT

SEQ ID NO: 3032033 - protein, 8 aa, Entamoeba invadens
EKRIDRSW

SEQ ID NO: 3032034 - protein, 12 aa, Entamoeba invadens
EKRSVKSAPESV

SEQ ID NO: 3032035 - protein, 12 aa, Entamoeba invadens
EKRSVKSVPESV

SEQ ID NO: 3032036 - protein, 8 aa, Entamoeba invadens
EKRTNQYK

SEQ ID NO: 3032037 - protein, 6 aa, Entamoeba invadens
EKSADK

SEQ ID NO: 3032038 - protein, 15 aa, Entamoeba invadens
EKSDCIKQNGFEKSS

SEQ ID NO: 3032039 - protein, 9 aa, Entamoeba invadens
EKSEHHKGK

SEQ ID NO: 3032040 - protein, 10 aa, Entamoeba invadens
EKSEQNNRSV

SEQ ID NO: 3032041 - protein, 30 aa, Entamoeba invadens
EKSFDCDNTECTVDNNSLDVGTRKWKSGCE

SEQ ID NO: 3032042 - protein, 16 aa, Entamoeba invadens
EKSFNEKVSFKKLIEK

SEQ ID NO: 3032043 - protein, 7 aa, Entamoeba invadens
EKSLQRR

SEQ ID NO: 3032044 - protein, 28 aa, Entamoeba invadens
EKSLSAEPQVDEDSLSVQTPSAFKPIES

SEQ ID NO: 3032045 - protein, 6 aa, Entamoeba invadens
EKTATY

SEQ ID NO: 3032046 - protein, 74 aa, Entamoeba invadens
EKTIEKQNETTKQLQNELKNKNDNLEKVNQQLEETTKQKEDAEKKINQQEEQLNKTKQEKDELENKLKEEKENF

SEQ ID NO: 3032047 - protein, 5 aa, Entamoeba invadens
EKTKQ

SEQ ID NO: 3032048 - protein, 6 aa, Entamoeba invadens
EKTPGG

SEQ ID NO: 3032049 - protein, 8 aa, Entamoeba invadens
EKTQPKVA

SEQ ID NO: 3032050 - protein, 7 aa, Entamoeba invadens
EKTRQTW

SEQ ID NO: 3032051 - protein, 11 aa, Entamoeba invadens
EKTTSDFPKSI

SEQ ID NO: 3032052 - protein, 11 aa, Entamoeba invadens
EKTTSERKLEE

SEQ ID NO: 3032053 - protein, 19 aa, Entamoeba invadens
EKVEDAKGFATKATQKVTE

SEQ ID NO: 3032054 - protein, 14 aa, Entamoeba invadens
EKVTDYTPQGNNTI

SEQ ID NO: 3032055 - protein, 4 aa, Entamoeba invadens
EKYA

SEQ ID NO: 3032056 - protein, 11 aa, Entamoeba invadens
EKYASQSSDVC

SEQ ID NO: 3032057 - protein, 9 aa, Entamoeba invadens
EKYGYTTIT

SEQ ID NO: 3032058 - protein, 4 aa, Entamoeba invadens
EKYH

SEQ ID NO: 3032059 - protein, 7 aa, Entamoeba invadens
EKYKKGE

SEQ ID NO: 3032060 - protein, 13 aa, Entamoeba invadens
EKYKNKNTRAPTL

SEQ ID NO: 3032061 - protein, 7 aa, Entamoeba invadens
EKYSLQN

SEQ ID NO: 3032062 - protein, 12 aa, Entamoeba invadens
ELAEQSDKGEKT

SEQ ID NO: 3032063 - protein, 14 aa, Entamoeba invadens
ELDKDDSINSNNGE

SEQ ID NO: 3032064 - protein, 7 aa, Entamoeba invadens
ELDKETG

SEQ ID NO: 3032065 - protein, 5 aa, Entamoeba invadens
ELERD

SEQ ID NO: 3032066 - protein, 12 aa, Entamoeba invadens
ELETRGYRQYYK

SEQ ID NO: 3032067 - protein, 16 aa, Entamoeba invadens
ELFNDGEYNEDDEFTL

SEQ ID NO: 3032068 - protein, 13 aa, Entamoeba invadens
ELKVEAGKYYERK

SEQ ID NO: 3032069 - protein, 6 aa, Entamoeba invadens
ELKVET

SEQ ID NO: 3032070 - protein, 14 aa, Entamoeba invadens
ELKVETNKMYEKET

SEQ ID NO: 3032071 - protein, 6 aa, Entamoeba invadens
ELNNNS

SEQ ID NO: 3032072 - protein, 27 aa, Entamoeba invadens
ELNSQTKKCTSQTGECSEGTFGTPGNC

SEQ ID NO: 3032073 - protein, 7 aa, Entamoeba invadens
ELNSREK

SEQ ID NO: 3032074 - protein, 9 aa, Entamoeba invadens
ELPKPPVIA

SEQ ID NO: 3032075 - protein, 7 aa, Entamoeba invadens
ELQEQAK

SEQ ID NO: 3032076 - protein, 9 aa, Entamoeba invadens
ELQQTKEKN

SEQ ID NO: 3032077 - protein, 7 aa, Entamoeba invadens
ELQSESR

SEQ ID NO: 3032078 - protein, 5 aa, Entamoeba invadens
ELRDG

SEQ ID NO: 3032079 - protein, 4 aa, Entamoeba invadens
ELRN

SEQ ID NO: 3032080 - protein, 11 aa, Entamoeba invadens
ELSEKKSKLND

SEQ ID NO: 3032081 - protein, 10 aa, Entamoeba invadens
ELSGEGKHTY

SEQ ID NO: 3032082 - protein, 7 aa, Entamoeba invadens
ELTEGKS

SEQ ID NO: 3032083 - protein, 41 aa, Entamoeba invadens
ELTSGKPSSGSGSPAIQPVGGNVNSNNQNSSPYPPCQSQTR

SEQ ID NO: 3032084 - protein, 8 aa, Entamoeba invadens
EMKESEEE

SEQ ID NO: 3032085 - protein, 7 aa, Entamoeba invadens
EMKKRPN

SEQ ID NO: 3032086 - protein, 6 aa, Entamoeba invadens
EMQKAY

SEQ ID NO: 3032087 - protein, 6 aa, Entamoeba invadens
EMRRSK

SEQ ID NO: 3032088 - protein, 11 aa, Entamoeba invadens
EMSDTDMSSSK

SEQ ID NO: 3032089 - protein, 6 aa, Entamoeba invadens
EMTQCG

SEQ ID NO: 3032090 - protein, 14 aa, Entamoeba invadens
EMTYSTAGSPSCQQ

SEQ ID NO: 3032091 - protein, 4 aa, Entamoeba invadens
ENAK

SEQ ID NO: 3032092 - protein, 19 aa, Entamoeba invadens
ENAKKNVKKAVQAQKKEMK

SEQ ID NO: 3032093 - protein, 5 aa, Entamoeba invadens
ENAKR

SEQ ID NO: 3032094 - protein, 19 aa, Entamoeba invadens
ENALEKRKRSIGESSEDFG

SEQ ID NO: 3032095 - protein, 13 aa, Entamoeba invadens
ENCEEAETQSTCS

SEQ ID NO: 3032096 - protein, 15 aa, Entamoeba invadens
ENCTGNVKSVGSISY

SEQ ID NO: 3032097 - protein, 18 aa, Entamoeba invadens
ENDESCKEKCDKGLYTDD

SEQ ID NO: 3032098 - protein, 8 aa, Entamoeba invadens
ENDGTTIP

SEQ ID NO: 3032099 - protein, 8 aa, Entamoeba invadens
ENDKFRSE

SEQ ID NO: 3032100 - protein, 11 aa, Entamoeba invadens
ENDSLKRGAMT

SEQ ID NO: 3032101 - protein, 14 aa, Entamoeba invadens
ENEECTFPKTTEEI

SEQ ID NO: 3032102 - protein, 8 aa, Entamoeba invadens
ENERPTCY

SEQ ID NO: 3032103 - protein, 6 aa, Entamoeba invadens
ENESIT

SEQ ID NO: 3032104 - protein, 7 aa, Entamoeba invadens
ENETEEV

SEQ ID NO: 3032105 - protein, 13 aa, Entamoeba invadens
ENFEDEYDLEDDE

SEQ ID NO: 3032106 - protein, 18 aa, Entamoeba invadens
ENFSTDETDKNEKKTKTE

SEQ ID NO: 3032107 - protein, 5 aa, Entamoeba invadens
ENGEA

SEQ ID NO: 3032108 - protein, 7 aa, Entamoeba invadens
ENGGACQ

SEQ ID NO: 3032109 - protein, 8 aa, Entamoeba invadens
ENGHPTKC

SEQ ID NO: 3032110 - protein, 4 aa, Entamoeba invadens
ENGK

SEQ ID NO: 3032111 - protein, 10 aa, Entamoeba invadens
ENGKKIGRLP

SEQ ID NO: 3032112 - protein, 5 aa, Entamoeba invadens
ENGLL

SEQ ID NO: 3032113 - protein, 6 aa, Entamoeba invadens
ENGNTF

SEQ ID NO: 3032114 - protein, 9 aa, Entamoeba invadens
ENGSCAKCS

SEQ ID NO: 3032115 - protein, 9 aa, Entamoeba invadens
ENGSFAPNK

SEQ ID NO: 3032116 - protein, 9 aa, Entamoeba invadens
ENGSQSVRV

SEQ ID NO: 3032117 - protein, 7 aa, Entamoeba invadens
ENGSTTL

SEQ ID NO: 3032118 - protein, 14 aa, Entamoeba invadens
ENGVVADGSTKYDR

SEQ ID NO: 3032119 - protein, 4 aa, Entamoeba invadens
ENGY

SEQ ID NO: 3032120 - protein, 4 aa, Entamoeba invadens
ENHP

SEQ ID NO: 3032121 - protein, 40 aa, Entamoeba invadens
ENIEEDDNKLKEKAYCETGKKLEVEKTKRRHKKTKYNNQK

SEQ ID NO: 3032122 - protein, 7 aa, Entamoeba invadens
ENIKEGY

SEQ ID NO: 3032123 - protein, 12 aa, Entamoeba invadens
ENKCNSCGNNDV

SEQ ID NO: 3032124 - protein, 7 aa, Entamoeba invadens
ENKEGLK

SEQ ID NO: 3032125 - protein, 9 aa, Entamoeba invadens
ENKKKDEID

SEQ ID NO: 3032126 - protein, 11 aa, Entamoeba invadens
ENKLDEVSNGN

SEQ ID NO: 3032127 - protein, 15 aa, Entamoeba invadens
ENKNLTKQKESLEEN

SEQ ID NO: 3032128 - protein, 18 aa, Entamoeba invadens
ENKNNDLEKENGNDIKTE

SEQ ID NO: 3032129 - protein, 5 aa, Entamoeba invadens
ENKPY

SEQ ID NO: 3032130 - protein, 8 aa, Entamoeba invadens
ENKQMSSR

SEQ ID NO: 3032131 - protein, 46 aa, Entamoeba invadens
ENLKKEQQQNSDNNTRNKEKIDKMQQQIDNEKANNETLKKQNAELE

SEQ ID NO: 3032132 - protein, 11 aa, Entamoeba invadens
ENLQEKEREVR

SEQ ID NO: 3032133 - protein, 14 aa, Entamoeba invadens
ENNASVKKYSAEIT

SEQ ID NO: 3032134 - protein, 9 aa, Entamoeba invadens
ENNDSNPLS

SEQ ID NO: 3032135 - protein, 11 aa, Entamoeba invadens
ENNEITKSWGE

SEQ ID NO: 3032136 - protein, 6 aa, Entamoeba invadens
ENNEKM

SEQ ID NO: 3032137 - protein, 7 aa, Entamoeba invadens
ENNENTI

SEQ ID NO: 3032138 - protein, 6 aa, Entamoeba invadens
ENNKPM

SEQ ID NO: 3032139 - protein, 8 aa, Entamoeba invadens
ENNNESCS

SEQ ID NO: 3032140 - protein, 6 aa, Entamoeba invadens
ENNTCS

SEQ ID NO: 3032141 - protein, 8 aa, Entamoeba invadens
ENNTDYEL

SEQ ID NO: 3032142 - protein, 5 aa, Entamoeba invadens
ENNTE

SEQ ID NO: 3032143 - protein, 12 aa, Entamoeba invadens
ENNYKINYNEKS

SEQ ID NO: 3032144 - protein, 8 aa, Entamoeba invadens
ENPEKIRT

SEQ ID NO: 3032145 - protein, 7 aa, Entamoeba invadens
ENPELNN

SEQ ID NO: 3032146 - protein, 7 aa, Entamoeba invadens
ENPPNRF

SEQ ID NO: 3032147 - protein, 6 aa, Entamoeba invadens
ENQKGF

SEQ ID NO: 3032148 - protein, 9 aa, Entamoeba invadens
ENRREGEVG

SEQ ID NO: 3032149 - protein, 11 aa, Entamoeba invadens
ENSAQEKKAAL

SEQ ID NO: 3032150 - protein, 6 aa, Entamoeba invadens
ENSRKM

SEQ ID NO: 3032151 - protein, 4 aa, Entamoeba invadens
ENTE

SEQ ID NO: 3032152 - protein, 4 aa, Entamoeba invadens
ENTH

SEQ ID NO: 3032153 - protein, 11 aa, Entamoeba invadens
ENTIPSAKAEI

SEQ ID NO: 3032154 - protein, 7 aa, Entamoeba invadens
ENTKEVV

SEQ ID NO: 3032155 - protein, 9 aa, Entamoeba invadens
ENTKNATHY

SEQ ID NO: 3032156 - protein, 9 aa, Entamoeba invadens
ENTKYPSDP

SEQ ID NO: 3032157 - protein, 5 aa, Entamoeba invadens
ENTTT

SEQ ID NO: 3032158 - protein, 9 aa, Entamoeba invadens
ENVANGEYH

SEQ ID NO: 3032159 - protein, 7 aa, Entamoeba invadens
ENWYENT

SEQ ID NO: 3032160 - protein, 6 aa, Entamoeba invadens
ENYGSG

SEQ ID NO: 3032161 - protein, 25 aa, Entamoeba invadens
ENYKAGSDPSTVCREGTGNARPIGD

SEQ ID NO: 3032162 - protein, 4 aa, Entamoeba invadens
ENYL

SEQ ID NO: 3032163 - protein, 4 aa, Entamoeba invadens
ENYV

SEQ ID NO: 3032164 - protein, 4 aa, Entamoeba invadens
EPAH

SEQ ID NO: 3032165 - protein, 44 aa, Entamoeba invadens
EPEIPSEEPSKEPESSGNDDSFSENIPSEEPEGSDSYNPEWPDV

SEQ ID NO: 3032166 - protein, 11 aa, Entamoeba invadens
EPELSGKQQSL

SEQ ID NO: 3032167 - protein, 5 aa, Entamoeba invadens
EPHSK

SEQ ID NO: 3032168 - protein, 4 aa, Entamoeba invadens
EPLD

SEQ ID NO: 3032169 - protein, 6 aa, Entamoeba invadens
EPLKKS

SEQ ID NO: 3032170 - protein, 4 aa, Entamoeba invadens
EPNF

SEQ ID NO: 3032171 - protein, 6 aa, Entamoeba invadens
EPNPIE

SEQ ID NO: 3032172 - protein, 12 aa, Entamoeba invadens
EPPKGHNGKDQK

SEQ ID NO: 3032173 - protein, 5 aa, Entamoeba invadens
EPPLE

SEQ ID NO: 3032174 - protein, 21 aa, Entamoeba invadens
EPPTNIQSDTFQAQKKNIPDS

SEQ ID NO: 3032175 - protein, 6 aa, Entamoeba invadens
EPTAAS

SEQ ID NO: 3032176 - protein, 5 aa, Entamoeba invadens
EPTSH

SEQ ID NO: 3032177 - protein, 12 aa, Entamoeba invadens
EPYGGTKPSEPF

SEQ ID NO: 3032178 - protein, 4 aa, Entamoeba invadens
EQCN

SEQ ID NO: 3032179 - protein, 6 aa, Entamoeba invadens
EQEGRL

SEQ ID NO: 3032180 - protein, 6 aa, Entamoeba invadens
EQESFR

SEQ ID NO: 3032181 - protein, 10 aa, Entamoeba invadens
EQFNGTRHCP

SEQ ID NO: 3032182 - protein, 20 aa, Entamoeba invadens
EQHTETRQKEKEKEKEEQHF

SEQ ID NO: 3032183 - protein, 4 aa, Entamoeba invadens
EQKE

SEQ ID NO: 3032184 - protein, 8 aa, Entamoeba invadens
EQKVTGEI

SEQ ID NO: 3032185 - protein, 16 aa, Entamoeba invadens
EQLKHTEDEVERYEAE

SEQ ID NO: 3032186 - protein, 12 aa, Entamoeba invadens
EQLKKSQKECET

SEQ ID NO: 3032187 - protein, 4 aa, Entamoeba invadens
EQMK

SEQ ID NO: 3032188 - protein, 11 aa, Entamoeba invadens
EQNGYKNEQIE

SEQ ID NO: 3032189 - protein, 12 aa, Entamoeba invadens
EQNQIKTQTSVK

SEQ ID NO: 3032190 - protein, 7 aa, Entamoeba invadens
EQNTQLD

SEQ ID NO: 3032191 - protein, 8 aa, Entamoeba invadens
EQNTTTCK

SEQ ID NO: 3032192 - protein, 26 aa, Entamoeba invadens
EQPDEHDTVSKTDVNTLTEETTHQES

SEQ ID NO: 3032193 - protein, 114 aa, Entamoeba invadens
EQPGEPRRHGSHRERSHKRSHHTSSRPSTSHHRTQERPTTSTSSQPSTSTTSGKHTHKRKHTTHEDTSSQSKHESKRQKLESSSEQPSTSKQTAQTSSTREHKDETPKQIPYPP

SEQ ID NO: 3032194 - protein, 5 aa, Entamoeba invadens
EQPNF

SEQ ID NO: 3032195 - protein, 23 aa, Entamoeba invadens
EQRVKADSRNKSLAWDDSKFIKK

SEQ ID NO: 3032196 - protein, 5 aa, Entamoeba invadens
EQSDS

SEQ ID NO: 3032197 - protein, 5 aa, Entamoeba invadens
EQSKR

SEQ ID NO: 3032198 - protein, 8 aa, Entamoeba invadens
EQSSCTGD

SEQ ID NO: 3032199 - protein, 4 aa, Entamoeba invadens
EQST

SEQ ID NO: 3032200 - protein, 9 aa, Entamoeba invadens
EQTERTHSN

SEQ ID NO: 3032201 - protein, 5 aa, Entamoeba invadens
EQTGC

SEQ ID NO: 3032202 - protein, 11 aa, Entamoeba invadens
EQTNVQKSNAD

SEQ ID NO: 3032203 - protein, 12 aa, Entamoeba invadens
EQTVKDYPLQNS

SEQ ID NO: 3032204 - protein, 6 aa, Entamoeba invadens
EQTVKY

SEQ ID NO: 3032205 - protein, 12 aa, Entamoeba invadens
EQVDGENKKNEI

SEQ ID NO: 3032206 - protein, 17 aa, Entamoeba invadens
EQVEIEKKKVEDTLRET

SEQ ID NO: 3032207 - protein, 8 aa, Entamoeba invadens
EQYKNVTE

SEQ ID NO: 3032208 - protein, 18 aa, Entamoeba invadens
ERADGTLTQQREKQIEEA

SEQ ID NO: 3032209 - protein, 5 aa, Entamoeba invadens
ERAGE

SEQ ID NO: 3032210 - protein, 10 aa, Entamoeba invadens
ERAKQNNAKR

SEQ ID NO: 3032211 - protein, 16 aa, Entamoeba invadens
ERCSPTDPKQMFVPVF

SEQ ID NO: 3032212 - protein, 14 aa, Entamoeba invadens
ERDIEKGYSITSTP

SEQ ID NO: 3032213 - protein, 19 aa, Entamoeba invadens
ERDKTSGELSNEKETNGKL

SEQ ID NO: 3032214 - protein, 7 aa, Entamoeba invadens
ERDRCSR

SEQ ID NO: 3032215 - protein, 5 aa, Entamoeba invadens
ERDTQ

SEQ ID NO: 3032216 - protein, 4 aa, Entamoeba invadens
EREF

SEQ ID NO: 3032217 - protein, 6 aa, Entamoeba invadens
ERGKYT

SEQ ID NO: 3032218 - protein, 7 aa, Entamoeba invadens
ERGSRYT

SEQ ID NO: 3032219 - protein, 5 aa, Entamoeba invadens
ERKCA

SEQ ID NO: 3032220 - protein, 16 aa, Entamoeba invadens
ERKNRRKQETQKAVEE

SEQ ID NO: 3032221 - protein, 8 aa, Entamoeba invadens
ERNGEDAL

SEQ ID NO: 3032222 - protein, 10 aa, Entamoeba invadens
ERNKNENKRC

SEQ ID NO: 3032223 - protein, 7 aa, Entamoeba invadens
ERNNKKV

SEQ ID NO: 3032224 - protein, 9 aa, Entamoeba invadens
ERNNNTNKR

SEQ ID NO: 3032225 - protein, 7 aa, Entamoeba invadens
ERNPKNL

SEQ ID NO: 3032226 - protein, 4 aa, Entamoeba invadens
ERPN

SEQ ID NO: 3032227 - protein, 6 aa, Entamoeba invadens
ERRGSN

SEQ ID NO: 3032228 - protein, 4 aa, Entamoeba invadens
ERRQ

SEQ ID NO: 3032229 - protein, 8 aa, Entamoeba invadens
ERRSHPPL

SEQ ID NO: 3032230 - protein, 5 aa, Entamoeba invadens
ERRSI

SEQ ID NO: 3032231 - protein, 6 aa, Entamoeba invadens
ERSDTI

SEQ ID NO: 3032232 - protein, 8 aa, Entamoeba invadens
ERSLTKDN

SEQ ID NO: 3032233 - protein, 10 aa, Entamoeba invadens
ERTNQYDYSS

SEQ ID NO: 3032234 - protein, 6 aa, Entamoeba invadens
ERVPDY

SEQ ID NO: 3032235 - protein, 9 aa, Entamoeba invadens
ESAEERSKL

SEQ ID NO: 3032236 - protein, 5 aa, Entamoeba invadens
ESAFG

SEQ ID NO: 3032237 - protein, 16 aa, Entamoeba invadens
ESANNKCSKCDDNYKW

SEQ ID NO: 3032238 - protein, 7 aa, Entamoeba invadens
ESAPENV

SEQ ID NO: 3032239 - protein, 8 aa, Entamoeba invadens
ESCNTETL

SEQ ID NO: 3032240 - protein, 10 aa, Entamoeba invadens
ESDCDTNKYT

SEQ ID NO: 3032241 - protein, 8 aa, Entamoeba invadens
ESDKNGRV

SEQ ID NO: 3032242 - protein, 13 aa, Entamoeba invadens
ESDTTSLKTGEST

SEQ ID NO: 3032243 - protein, 9 aa, Entamoeba invadens
ESEADKNYL

SEQ ID NO: 3032244 - protein, 7 aa, Entamoeba invadens
ESEESNR

SEQ ID NO: 3032245 - protein, 8 aa, Entamoeba invadens
ESESDGVK

SEQ ID NO: 3032246 - protein, 8 aa, Entamoeba invadens
ESESEGVK

SEQ ID NO: 3032247 - protein, 6 aa, Entamoeba invadens
ESGDDK

SEQ ID NO: 3032248 - protein, 10 aa, Entamoeba invadens
ESGEYTTCQS

SEQ ID NO: 3032249 - protein, 8 aa, Entamoeba invadens
ESGLSGKE

SEQ ID NO: 3032250 - protein, 7 aa, Entamoeba invadens
ESGRKQL

SEQ ID NO: 3032251 - protein, 6 aa, Entamoeba invadens
ESGVTD

SEQ ID NO: 3032252 - protein, 4 aa, Entamoeba invadens
ESIK

SEQ ID NO: 3032253 - protein, 11 aa, Entamoeba invadens
ESISKTTQIDA

SEQ ID NO: 3032254 - protein, 5 aa, Entamoeba invadens
ESKEV

SEQ ID NO: 3032255 - protein, 6 aa, Entamoeba invadens
ESKGTK

SEQ ID NO: 3032256 - protein, 8 aa, Entamoeba invadens
ESKLGEGS

SEQ ID NO: 3032257 - protein, 7 aa, Entamoeba invadens
ESKNDRK

SEQ ID NO: 3032258 - protein, 8 aa, Entamoeba invadens
ESKSGSFA

SEQ ID NO: 3032259 - protein, 12 aa, Entamoeba invadens
ESLAQKSLAAQK

SEQ ID NO: 3032260 - protein, 9 aa, Entamoeba invadens
ESLSLESET

SEQ ID NO: 3032261 - protein, 4 aa, Entamoeba invadens
ESMK

SEQ ID NO: 3032262 - protein, 4 aa, Entamoeba invadens
ESMT

SEQ ID NO: 3032263 - protein, 6 aa, Entamoeba invadens
ESNCTV

SEQ ID NO: 3032264 - protein, 19 aa, Entamoeba invadens
ESNRQCEKCKDKNTYKTPC

SEQ ID NO: 3032265 - protein, 5 aa, Entamoeba invadens
ESNSC

SEQ ID NO: 3032266 - protein, 6 aa, Entamoeba invadens
ESNSLK

SEQ ID NO: 3032267 - protein, 8 aa, Entamoeba invadens
ESPKNKPY

SEQ ID NO: 3032268 - protein, 4 aa, Entamoeba invadens
ESRY

SEQ ID NO: 3032269 - protein, 11 aa, Entamoeba invadens
ESSDGWGGYGL

SEQ ID NO: 3032270 - protein, 8 aa, Entamoeba invadens
ESSDGWTS

SEQ ID NO: 3032271 - protein, 41 aa, Entamoeba invadens
ESSKQKSEEKSTSKSSEKSKEPDTPSVDTPSEEDICKDKSG

SEQ ID NO: 3032272 - protein, 5 aa, Entamoeba invadens
ESSVS

SEQ ID NO: 3032273 - protein, 26 aa, Entamoeba invadens
ESTGLYGKSSIRKVDKKSGDVITKTK

SEQ ID NO: 3032274 - protein, 13 aa, Entamoeba invadens
ESTITDDPPKPED

SEQ ID NO: 3032275 - protein, 8 aa, Entamoeba invadens
ESTKVKTT

SEQ ID NO: 3032276 - protein, 24 aa, Entamoeba invadens
ESTPQKQSNTDTSKTKKVTLKTAS

SEQ ID NO: 3032277 - protein, 4 aa, Entamoeba invadens
ESTR

SEQ ID NO: 3032278 - protein, 25 aa, Entamoeba invadens
ESTSHTNVQPSHQQQTYYQQHSQQQ

SEQ ID NO: 3032279 - protein, 7 aa, Entamoeba invadens
ESTTEDC

SEQ ID NO: 3032280 - protein, 10 aa, Entamoeba invadens
ESVDSDADKY

SEQ ID NO: 3032281 - protein, 30 aa, Entamoeba invadens
ESVDTSLPLGPERKTKEEPMDEPPMQEGER

SEQ ID NO: 3032282 - protein, 7 aa, Entamoeba invadens
ESVNYQE

SEQ ID NO: 3032283 - protein, 6 aa, Entamoeba invadens
ESVPNT

SEQ ID NO: 3032284 - protein, 15 aa, Entamoeba invadens
ESYGPWPKDCDRTKD

SEQ ID NO: 3032285 - protein, 8 aa, Entamoeba invadens
ETAKNSDG

SEQ ID NO: 3032286 - protein, 11 aa, Entamoeba invadens
ETAPSQITSTL

SEQ ID NO: 3032287 - protein, 12 aa, Entamoeba invadens
ETCGNKCDQEYG

SEQ ID NO: 3032288 - protein, 11 aa, Entamoeba invadens
ETCSSSGVCST

SEQ ID NO: 3032289 - protein, 5 aa, Entamoeba invadens
ETCST

SEQ ID NO: 3032290 - protein, 4 aa, Entamoeba invadens
ETDN

SEQ ID NO: 3032291 - protein, 7 aa, Entamoeba invadens
ETDSTKC

SEQ ID NO: 3032292 - protein, 4 aa, Entamoeba invadens
ETED

SEQ ID NO: 3032293 - protein, 8 aa, Entamoeba invadens
ETEDNDYN

SEQ ID NO: 3032294 - protein, 6 aa, Entamoeba invadens
ETEGAK

SEQ ID NO: 3032295 - protein, 19 aa, Entamoeba invadens
ETEGTFTDKLKAGKQAAID

SEQ ID NO: 3032296 - protein, 5 aa, Entamoeba invadens
ETENN

SEQ ID NO: 3032297 - protein, 4 aa, Entamoeba invadens
ETEP

SEQ ID NO: 3032298 - protein, 5 aa, Entamoeba invadens
ETEPY

SEQ ID NO: 3032299 - protein, 11 aa, Entamoeba invadens
ETETKKTIKKR

SEQ ID NO: 3032300 - protein, 4 aa, Entamoeba invadens
ETEV

SEQ ID NO: 3032301 - protein, 12 aa, Entamoeba invadens
ETFPTYKASGKT

SEQ ID NO: 3032302 - protein, 14 aa, Entamoeba invadens
ETGESHSKCENCAN

SEQ ID NO: 3032303 - protein, 6 aa, Entamoeba invadens
ETGGMA

SEQ ID NO: 3032304 - protein, 7 aa, Entamoeba invadens
ETGGMST

SEQ ID NO: 3032305 - protein, 5 aa, Entamoeba invadens
ETHTY

SEQ ID NO: 3032306 - protein, 4 aa, Entamoeba invadens
ETIN

SEQ ID NO: 3032307 - protein, 4 aa, Entamoeba invadens
ETIP

SEQ ID NO: 3032308 - protein, 7 aa, Entamoeba invadens
ETIPKDK

SEQ ID NO: 3032309 - protein, 4 aa, Entamoeba invadens
ETIS

SEQ ID NO: 3032310 - protein, 4 aa, Entamoeba invadens
ETIT

SEQ ID NO: 3032311 - protein, 8 aa, Entamoeba invadens
ETKIESGV

SEQ ID NO: 3032312 - protein, 5 aa, Entamoeba invadens
ETKIH

SEQ ID NO: 3032313 - protein, 11 aa, Entamoeba invadens
ETKKPKSDSYR

SEQ ID NO: 3032314 - protein, 10 aa, Entamoeba invadens
ETKTFGERMN

SEQ ID NO: 3032315 - protein, 10 aa, Entamoeba invadens
ETLPHPEEEH

SEQ ID NO: 3032316 - protein, 5 aa, Entamoeba invadens
ETMAE

SEQ ID NO: 3032317 - protein, 4 aa, Entamoeba invadens
ETNA

SEQ ID NO: 3032318 - protein, 4 aa, Entamoeba invadens
ETNK

SEQ ID NO: 3032319 - protein, 6 aa, Entamoeba invadens
ETNNER

SEQ ID NO: 3032320 - protein, 9 aa, Entamoeba invadens
ETNYKKSEK

SEQ ID NO: 3032321 - protein, 4 aa, Entamoeba invadens
ETPL

SEQ ID NO: 3032322 - protein, 9 aa, Entamoeba invadens
ETPSECSGD

SEQ ID NO: 3032323 - protein, 6 aa, Entamoeba invadens
ETPVDG

SEQ ID NO: 3032324 - protein, 10 aa, Entamoeba invadens
ETPYKDNVGQ

SEQ ID NO: 3032325 - protein, 6 aa, Entamoeba invadens
ETQAKQ

SEQ ID NO: 3032326 - protein, 5 aa, Entamoeba invadens
ETQID

SEQ ID NO: 3032327 - protein, 7 aa, Entamoeba invadens
ETQPFDQ

SEQ ID NO: 3032328 - protein, 14 aa, Entamoeba invadens
ETQSEYGVTGWDTQ

SEQ ID NO: 3032329 - protein, 5 aa, Entamoeba invadens
ETRDK

SEQ ID NO: 3032330 - protein, 8 aa, Entamoeba invadens
ETSAKNKI

SEQ ID NO: 3032331 - protein, 10 aa, Entamoeba invadens
ETSDSTDTYP

SEQ ID NO: 3032332 - protein, 8 aa, Entamoeba invadens
ETSDYDGN

SEQ ID NO: 3032333 - protein, 16 aa, Entamoeba invadens
ETSETHTETSSTKQIR

SEQ ID NO: 3032334 - protein, 5 aa, Entamoeba invadens
ETSGL

SEQ ID NO: 3032335 - protein, 10 aa, Entamoeba invadens
ETSQQPDKPL

SEQ ID NO: 3032336 - protein, 6 aa, Entamoeba invadens
ETSQYT

SEQ ID NO: 3032337 - protein, 9 aa, Entamoeba invadens
ETSTRGGGV

SEQ ID NO: 3032338 - protein, 8 aa, Entamoeba invadens
ETSTRTQT

SEQ ID NO: 3032339 - protein, 5 aa, Entamoeba invadens
ETTCD

SEQ ID NO: 3032340 - protein, 4 aa, Entamoeba invadens
ETTE

SEQ ID NO: 3032341 - protein, 5 aa, Entamoeba invadens
ETVEK

SEQ ID NO: 3032342 - protein, 5 aa, Entamoeba invadens
ETVGS

SEQ ID NO: 3032343 - protein, 6 aa, Entamoeba invadens
ETYGAE

SEQ ID NO: 3032344 - protein, 19 aa, Entamoeba invadens
EVAGSSTTKCTKCTKTTDY

SEQ ID NO: 3032345 - protein, 5 aa, Entamoeba invadens
EVCNK

SEQ ID NO: 3032346 - protein, 4 aa, Entamoeba invadens
EVDE

SEQ ID NO: 3032347 - protein, 29 aa, Entamoeba invadens
EVEKKEEKIKTIKRSAALSKKEVKKTEKF

SEQ ID NO: 3032348 - protein, 6 aa, Entamoeba invadens
EVEKKQ

SEQ ID NO: 3032349 - protein, 64 aa, Entamoeba invadens
EVEKQKLEQLAKEKAAIEAEEKRKKAEIERNAQLKKQKEEDERKRAAIQQQELQDKKRIEEEKK

SEQ ID NO: 3032350 - protein, 6 aa, Entamoeba invadens
EVEKTT

SEQ ID NO: 3032351 - protein, 6 aa, Entamoeba invadens
EVFSKE

SEQ ID NO: 3032352 - protein, 11 aa, Entamoeba invadens
EVGGTGTCEET

SEQ ID NO: 3032353 - protein, 18 aa, Entamoeba invadens
EVKEDQNSKVRNKNREAA

SEQ ID NO: 3032354 - protein, 26 aa, Entamoeba invadens
EVLSERSKKLYKRTKKAKRCHVPCVI

SEQ ID NO: 3032355 - protein, 8 aa, Entamoeba invadens
EVNHTKKG

SEQ ID NO: 3032356 - protein, 9 aa, Entamoeba invadens
EVPYTSSPC

SEQ ID NO: 3032357 - protein, 5 aa, Entamoeba invadens
EVQGS

SEQ ID NO: 3032358 - protein, 7 aa, Entamoeba invadens
EVRAKKD

SEQ ID NO: 3032359 - protein, 13 aa, Entamoeba invadens
EVRGTYKGTPVKK

SEQ ID NO: 3032360 - protein, 7 aa, Entamoeba invadens
EVSEQTI

SEQ ID NO: 3032361 - protein, 8 aa, Entamoeba invadens
EVSGNSET

SEQ ID NO: 3032362 - protein, 19 aa, Entamoeba invadens
EVSQITNEHTSVDKTQTLY

SEQ ID NO: 3032363 - protein, 8 aa, Entamoeba invadens
EVTDGNTA

SEQ ID NO: 3032364 - protein, 7 aa, Entamoeba invadens
EVTGSHT

SEQ ID NO: 3032365 - protein, 11 aa, Entamoeba invadens
EWDGKKMENVP

SEQ ID NO: 3032366 - protein, 7 aa, Entamoeba invadens
EWEGRDD

SEQ ID NO: 3032367 - protein, 9 aa, Entamoeba invadens
EWEGRENAT

SEQ ID NO: 3032368 - protein, 7 aa, Entamoeba invadens
EWNPEND

SEQ ID NO: 3032369 - protein, 10 aa, Entamoeba invadens
EWSPETGELT

SEQ ID NO: 3032370 - protein, 7 aa, Entamoeba invadens
EWTPENE

SEQ ID NO: 3032371 - protein, 7 aa, Entamoeba invadens
EWTPENG

SEQ ID NO: 3032372 - protein, 5 aa, Entamoeba invadens
EYDGA

SEQ ID NO: 3032373 - protein, 21 aa, Entamoeba invadens
EYDGEKKDVKKYNKSLLSGTK

SEQ ID NO: 3032374 - protein, 4 aa, Entamoeba invadens
EYDT

SEQ ID NO: 3032375 - protein, 11 aa, Entamoeba invadens
EYENGEIPVNE

SEQ ID NO: 3032376 - protein, 4 aa, Entamoeba invadens
EYEP

SEQ ID NO: 3032377 - protein, 6 aa, Entamoeba invadens
EYEQYK

SEQ ID NO: 3032378 - protein, 6 aa, Entamoeba invadens
EYERTR

SEQ ID NO: 3032379 - protein, 13 aa, Entamoeba invadens
EYKGDKKPEACGN

SEQ ID NO: 3032380 - protein, 5 aa, Entamoeba invadens
EYNGA

SEQ ID NO: 3032381 - protein, 8 aa, Entamoeba invadens
EYNGKVPH

SEQ ID NO: 3032382 - protein, 11 aa, Entamoeba invadens
EYNIGTDGKTV

SEQ ID NO: 3032383 - protein, 8 aa, Entamoeba invadens
EYPCPKGY

SEQ ID NO: 3032384 - protein, 5 aa, Entamoeba invadens
EYPDA

SEQ ID NO: 3032385 - protein, 15 aa, Entamoeba invadens
EYPNLSAKGAYDQNK

SEQ ID NO: 3032386 - protein, 5 aa, Entamoeba invadens
EYPTT

SEQ ID NO: 3032387 - protein, 9 aa, Entamoeba invadens
EYRTEEEKT

SEQ ID NO: 3032388 - protein, 6 aa, Entamoeba invadens
EYSLNN

SEQ ID NO: 3032389 - protein, 7 aa, Entamoeba invadens
EYTDRSN

SEQ ID NO: 3032390 - protein, 8 aa, Entamoeba invadens
EYTPEPNP

SEQ ID NO: 3032391 - protein, 10 aa, Entamoeba invadens
FAEDDDDDLE

SEQ ID NO: 3032392 - protein, 7 aa, Entamoeba invadens
FAEGGYS

SEQ ID NO: 3032393 - protein, 11 aa, Entamoeba invadens
FAENNSQINEF

SEQ ID NO: 3032394 - protein, 7 aa, Entamoeba invadens
FAHDPTT

SEQ ID NO: 3032395 - protein, 8 aa, Entamoeba invadens
FAKTEKKD

SEQ ID NO: 3032396 - protein, 19 aa, Entamoeba invadens
FATTPEGAQAAPAAAQGPV

SEQ ID NO: 3032397 - protein, 35 aa, Entamoeba invadens
FDDEFEDDDIEDEEDEIEEEEDEEAENEDDEEYEL

SEQ ID NO: 3032398 - protein, 14 aa, Entamoeba invadens
FDDKRSVRQYEDSW

SEQ ID NO: 3032399 - protein, 9 aa, Entamoeba invadens
FDEATDSTV

SEQ ID NO: 3032400 - protein, 41 aa, Entamoeba invadens
FDEDYADYDEEEDFDEDDEYEDDEDDADDFELEEDGEDDME

SEQ ID NO: 3032401 - protein, 16 aa, Entamoeba invadens
FDEEKEKNKNKNRFSK

SEQ ID NO: 3032402 - protein, 5 aa, Entamoeba invadens
FDEPE

SEQ ID NO: 3032403 - protein, 6 aa, Entamoeba invadens
FDESTD

SEQ ID NO: 3032404 - protein, 5 aa, Entamoeba invadens
FDGEN

SEQ ID NO: 3032405 - protein, 6 aa, Entamoeba invadens
FDKEKA

SEQ ID NO: 3032406 - protein, 8 aa, Entamoeba invadens
FDKENYAP

SEQ ID NO: 3032407 - protein, 18 aa, Entamoeba invadens
FDNGNDTWLGSSNSPGEW

SEQ ID NO: 3032408 - protein, 5 aa, Entamoeba invadens
FDNTQ

SEQ ID NO: 3032409 - protein, 8 aa, Entamoeba invadens
FDNTTNST

SEQ ID NO: 3032410 - protein, 14 aa, Entamoeba invadens
FDNWTNDDAKQMEK

SEQ ID NO: 3032411 - protein, 8 aa, Entamoeba invadens
FDQKRSNV

SEQ ID NO: 3032412 - protein, 10 aa, Entamoeba invadens
FDSDTTAESV

SEQ ID NO: 3032413 - protein, 6 aa, Entamoeba invadens
FDSEST

SEQ ID NO: 3032414 - protein, 5 aa, Entamoeba invadens
FDSPN

SEQ ID NO: 3032415 - protein, 9 aa, Entamoeba invadens
FDTSTNTFS

SEQ ID NO: 3032416 - protein, 9 aa, Entamoeba invadens
FEADNQRLQ

SEQ ID NO: 3032417 - protein, 6 aa, Entamoeba invadens
FEDESY

SEQ ID NO: 3032418 - protein, 8 aa, Entamoeba invadens
FEDGSHEG

SEQ ID NO: 3032419 - protein, 7 aa, Entamoeba invadens
FEDTESS

SEQ ID NO: 3032420 - protein, 17 aa, Entamoeba invadens
FEDTKSSVCGDGERNPF

SEQ ID NO: 3032421 - protein, 9 aa, Entamoeba invadens
FEDYKEKKR

SEQ ID NO: 3032422 - protein, 11 aa, Entamoeba invadens
FEEKKYATTQV

SEQ ID NO: 3032423 - protein, 9 aa, Entamoeba invadens
FEEKTCGKR

SEQ ID NO: 3032424 - protein, 6 aa, Entamoeba invadens
FEGAQN

SEQ ID NO: 3032425 - protein, 6 aa, Entamoeba invadens
FEGNLN

SEQ ID NO: 3032426 - protein, 6 aa, Entamoeba invadens
FEGRTP

SEQ ID NO: 3032427 - protein, 7 aa, Entamoeba invadens
FEGTNED

SEQ ID NO: 3032428 - protein, 11 aa, Entamoeba invadens
FEKTKQGYEAT

SEQ ID NO: 3032429 - protein, 9 aa, Entamoeba invadens
FENSVRDAK

SEQ ID NO: 3032430 - protein, 15 aa, Entamoeba invadens
FENTAKAMKGATDGV

SEQ ID NO: 3032431 - protein, 9 aa, Entamoeba invadens
FEQKPTNVE

SEQ ID NO: 3032432 - protein, 5 aa, Entamoeba invadens
FESES

SEQ ID NO: 3032433 - protein, 13 aa, Entamoeba invadens
FETPQQNYNPTYQ

SEQ ID NO: 3032434 - protein, 12 aa, Entamoeba invadens
FEYNNTSCKSGY

SEQ ID NO: 3032435 - protein, 4 aa, Entamoeba invadens
FGET

SEQ ID NO: 3032436 - protein, 10 aa, Entamoeba invadens
FGGDKYKDES

SEQ ID NO: 3032437 - protein, 9 aa, Entamoeba invadens
FGGDSNQGF

SEQ ID NO: 3032438 - protein, 11 aa, Entamoeba invadens
FGGLDSKTINY

SEQ ID NO: 3032439 - protein, 17 aa, Entamoeba invadens
FGGNTYDLTRDESNQWQ

SEQ ID NO: 3032440 - protein, 4 aa, Entamoeba invadens
FGGT

SEQ ID NO: 3032441 - protein, 7 aa, Entamoeba invadens
FGKKGKM

SEQ ID NO: 3032442 - protein, 19 aa, Entamoeba invadens
FGQPDKKKEEDKQQEEFPS

SEQ ID NO: 3032443 - protein, 6 aa, Entamoeba invadens
FGSARN

SEQ ID NO: 3032444 - protein, 10 aa, Entamoeba invadens
FGSATVTAKV

SEQ ID NO: 3032445 - protein, 6 aa, Entamoeba invadens
FGSDNE

SEQ ID NO: 3032446 - protein, 24 aa, Entamoeba invadens
FGSGKNVQQPLPLTDSTNTDTEFE

SEQ ID NO: 3032447 - protein, 5 aa, Entamoeba invadens
FGTSG

SEQ ID NO: 3032448 - protein, 7 aa, Entamoeba invadens
FHRTGKP

SEQ ID NO: 3032449 - protein, 9 aa, Entamoeba invadens
FHSDDGRVF

SEQ ID NO: 3032450 - protein, 6 aa, Entamoeba invadens
FHTNNN

SEQ ID NO: 3032451 - protein, 4 aa, Entamoeba invadens
FKGD

SEQ ID NO: 3032452 - protein, 5 aa, Entamoeba invadens
FKGEK

SEQ ID NO: 3032453 - protein, 6 aa, Entamoeba invadens
FKKGDK

SEQ ID NO: 3032454 - protein, 31 aa, Entamoeba invadens
FKKQPSQPRVDPKPQLKQDPKVVKKETEKKI

SEQ ID NO: 3032455 - protein, 13 aa, Entamoeba invadens
FKNANSKKKNNCE

SEQ ID NO: 3032456 - protein, 16 aa, Entamoeba invadens
FKNREDSPVDKDGNYD

SEQ ID NO: 3032457 - protein, 11 aa, Entamoeba invadens
FKPKTVEAANA

SEQ ID NO: 3032458 - protein, 9 aa, Entamoeba invadens
FKSKYGDVD

SEQ ID NO: 3032459 - protein, 11 aa, Entamoeba invadens
FKTPKTCEKCT

SEQ ID NO: 3032460 - protein, 7 aa, Entamoeba invadens
FKTRRSV

SEQ ID NO: 3032461 - protein, 28 aa, Entamoeba invadens
FKTSKGDGKRQNEFGIGGSYKANENTNF

SEQ ID NO: 3032462 - protein, 4 aa, Entamoeba invadens
FNAS

SEQ ID NO: 3032463 - protein, 5 aa, Entamoeba invadens
FNDGN

SEQ ID NO: 3032464 - protein, 4 aa, Entamoeba invadens
FNEA

SEQ ID NO: 3032465 - protein, 22 aa, Entamoeba invadens
FNEAKEAVVSTAKKAGEAIKTG

SEQ ID NO: 3032466 - protein, 11 aa, Entamoeba invadens
FNEGENDYENK

SEQ ID NO: 3032467 - protein, 5 aa, Entamoeba invadens
FNETN

SEQ ID NO: 3032468 - protein, 5 aa, Entamoeba invadens
FNGAE

SEQ ID NO: 3032469 - protein, 12 aa, Entamoeba invadens
FNKDNPETKSKI

SEQ ID NO: 3032470 - protein, 4 aa, Entamoeba invadens
FNKG

SEQ ID NO: 3032471 - protein, 9 aa, Entamoeba invadens
FNNNTQNTL

SEQ ID NO: 3032472 - protein, 16 aa, Entamoeba invadens
FNPAGKEVGEASPPWG

SEQ ID NO: 3032473 - protein, 5 aa, Entamoeba invadens
FNPED

SEQ ID NO: 3032474 - protein, 4 aa, Entamoeba invadens
FNPP

SEQ ID NO: 3032475 - protein, 5 aa, Entamoeba invadens
FNPRN

SEQ ID NO: 3032476 - protein, 6 aa, Entamoeba invadens
FNSESV

SEQ ID NO: 3032477 - protein, 11 aa, Entamoeba invadens
FNTGGTNNLNN

SEQ ID NO: 3032478 - protein, 5 aa, Entamoeba invadens
FNTTG

SEQ ID NO: 3032479 - protein, 8 aa, Entamoeba invadens
FPADKGGN

SEQ ID NO: 3032480 - protein, 8 aa, Entamoeba invadens
FPARADQY

SEQ ID NO: 3032481 - protein, 4 aa, Entamoeba invadens
FPDV

SEQ ID NO: 3032482 - protein, 29 aa, Entamoeba invadens
FPEGDPSAPFAPLTKQEPTPIDFPTESGL

SEQ ID NO: 3032483 - protein, 9 aa, Entamoeba invadens
FPENTEVKE

SEQ ID NO: 3032484 - protein, 12 aa, Entamoeba invadens
FPFKNDDKKFSP

SEQ ID NO: 3032485 - protein, 22 aa, Entamoeba invadens
FPGDAKTVKLTQTPQQKAQEKV

SEQ ID NO: 3032486 - protein, 12 aa, Entamoeba invadens
FPGDSVKDIEER

SEQ ID NO: 3032487 - protein, 5 aa, Entamoeba invadens
FPNPK

SEQ ID NO: 3032488 - protein, 38 aa, Entamoeba invadens
FPPRPLTPPPAGAEGGEEQPSTSTTSPAGAEGGEQQQP

SEQ ID NO: 3032489 - protein, 6 aa, Entamoeba invadens
FPPTED

SEQ ID NO: 3032490 - protein, 16 aa, Entamoeba invadens
FPPVTKSRKERSTFNQ

SEQ ID NO: 3032491 - protein, 4 aa, Entamoeba invadens
FPQI

SEQ ID NO: 3032492 - protein, 9 aa, Entamoeba invadens
FPSQTNRVS

SEQ ID NO: 3032493 - protein, 9 aa, Entamoeba invadens
FPTKGKKEF

SEQ ID NO: 3032494 - protein, 6 aa, Entamoeba invadens
FPYEEN

SEQ ID NO: 3032495 - protein, 23 aa, Entamoeba invadens
FQDGDSSKGYGTGYGPSSHKGDL

SEQ ID NO: 3032496 - protein, 4 aa, Entamoeba invadens
FQKY

SEQ ID NO: 3032497 - protein, 6 aa, Entamoeba invadens
FQLTTK

SEQ ID NO: 3032498 - protein, 23 aa, Entamoeba invadens
FQNGDPKTGYGIGYGPSAHKGDL

SEQ ID NO: 3032499 - protein, 9 aa, Entamoeba invadens
FQNKNKSEF

SEQ ID NO: 3032500 - protein, 32 aa, Entamoeba invadens
FQNTPQEKISKNRGKNSDSNLENQDTKETTKR

SEQ ID NO: 3032501 - protein, 7 aa, Entamoeba invadens
FQSSNKL

SEQ ID NO: 3032502 - protein, 4 aa, Entamoeba invadens
FRGN

SEQ ID NO: 3032503 - protein, 12 aa, Entamoeba invadens
FRGSDYTRTHRD

SEQ ID NO: 3032504 - protein, 6 aa, Entamoeba invadens
FRNSKT

SEQ ID NO: 3032505 - protein, 14 aa, Entamoeba invadens
FRPKKDRCKGRPDH

SEQ ID NO: 3032506 - protein, 9 aa, Entamoeba invadens
FRPSGGKTL

SEQ ID NO: 3032507 - protein, 8 aa, Entamoeba invadens
FRSSDEAK

SEQ ID NO: 3032508 - protein, 11 aa, Entamoeba invadens
FSASNGSSSCT

SEQ ID NO: 3032509 - protein, 9 aa, Entamoeba invadens
FSDCDKDTI

SEQ ID NO: 3032510 - protein, 10 aa, Entamoeba invadens
FSDDRELPTK

SEQ ID NO: 3032511 - protein, 4 aa, Entamoeba invadens
FSDN

SEQ ID NO: 3032512 - protein, 10 aa, Entamoeba invadens
FSDQTNEEFQ

SEQ ID NO: 3032513 - protein, 6 aa, Entamoeba invadens
FSEGEI

SEQ ID NO: 3032514 - protein, 6 aa, Entamoeba invadens
FSFNGS

SEQ ID NO: 3032515 - protein, 9 aa, Entamoeba invadens
FSGDDGMEK

SEQ ID NO: 3032516 - protein, 10 aa, Entamoeba invadens
FSGGSPSQVS

SEQ ID NO: 3032517 - protein, 36 aa, Entamoeba invadens
FSGSSSIGGGIGAPSTSTTQPKESVHGKDPIGSFSS

SEQ ID NO: 3032518 - protein, 10 aa, Entamoeba invadens
FSGSVSKTLD

SEQ ID NO: 3032519 - protein, 15 aa, Entamoeba invadens
FSKCPSGTVCKGNGR

SEQ ID NO: 3032520 - protein, 23 aa, Entamoeba invadens
FSKGYQKGGIKEGLKQGGKTALN

SEQ ID NO: 3032521 - protein, 9 aa, Entamoeba invadens
FSKKDKKEF

SEQ ID NO: 3032522 - protein, 7 aa, Entamoeba invadens
FSKKGDR

SEQ ID NO: 3032523 - protein, 15 aa, Entamoeba invadens
FSKNTKKAKKALEKF

SEQ ID NO: 3032524 - protein, 9 aa, Entamoeba invadens
FSKSGNATC

SEQ ID NO: 3032525 - protein, 11 aa, Entamoeba invadens
FSLGNTLDGTV

SEQ ID NO: 3032526 - protein, 10 aa, Entamoeba invadens
FSNDNATTIV

SEQ ID NO: 3032527 - protein, 9 aa, Entamoeba invadens
FSNEKDFTE

SEQ ID NO: 3032528 - protein, 16 aa, Entamoeba invadens
FSNSKFEETSFKSTQL

SEQ ID NO: 3032529 - protein, 6 aa, Entamoeba invadens
FSPGGI

SEQ ID NO: 3032530 - protein, 6 aa, Entamoeba invadens
FSPTKV

SEQ ID NO: 3032531 - protein, 12 aa, Entamoeba invadens
FSQDDKVSALTP

SEQ ID NO: 3032532 - protein, 11 aa, Entamoeba invadens
FSQRNEKLSQR

SEQ ID NO: 3032533 - protein, 26 aa, Entamoeba invadens
FSQTQTQKFGPQGMQPTGIHPTTEEA

SEQ ID NO: 3032534 - protein, 12 aa, Entamoeba invadens
FSRRKRKLADTN

SEQ ID NO: 3032535 - protein, 10 aa, Entamoeba invadens
FSSDRSIEEY

SEQ ID NO: 3032536 - protein, 23 aa, Entamoeba invadens
FSTGGDATCTACPAGSYSGKGYS

SEQ ID NO: 3032537 - protein, 13 aa, Entamoeba invadens
FSTMSTDENPSQS

SEQ ID NO: 3032538 - protein, 6 aa, Entamoeba invadens
FSTSEE

SEQ ID NO: 3032539 - protein, 7 aa, Entamoeba invadens
FSVNENK

SEQ ID NO: 3032540 - protein, 4 aa, Entamoeba invadens
FTDE

SEQ ID NO: 3032541 - protein, 5 aa, Entamoeba invadens
FTDGK

SEQ ID NO: 3032542 - protein, 6 aa, Entamoeba invadens
FTDKQV

SEQ ID NO: 3032543 - protein, 10 aa, Entamoeba invadens
FTDTGKLPQK

SEQ ID NO: 3032544 - protein, 15 aa, Entamoeba invadens
FTGKSEVPKSVPESV

SEQ ID NO: 3032545 - protein, 5 aa, Entamoeba invadens
FTGSS

SEQ ID NO: 3032546 - protein, 5 aa, Entamoeba invadens
FTHPT

SEQ ID NO: 3032547 - protein, 11 aa, Entamoeba invadens
FTKGKKPKPGM

SEQ ID NO: 3032548 - protein, 10 aa, Entamoeba invadens
FTKRSSSDGW

SEQ ID NO: 3032549 - protein, 5 aa, Entamoeba invadens
FTPEG

SEQ ID NO: 3032550 - protein, 5 aa, Entamoeba invadens
FTPEK

SEQ ID NO: 3032551 - protein, 9 aa, Entamoeba invadens
FTPIPGSEF

SEQ ID NO: 3032552 - protein, 27 aa, Entamoeba invadens
FTPPASNKRCCGGNSGLALDGQPTYSL

SEQ ID NO: 3032553 - protein, 7 aa, Entamoeba invadens
FTQNEKT

SEQ ID NO: 3032554 - protein, 100 aa, Entamoeba invadens
FTQPEESKRSHEDQSKSKSSRSSSSSHSSYHKTGEHTSRARSTHGGKHTHKRKHTTTEESTSKGASKYEEKYKRRRTDSSDEEPSTSKGISHQKTSESVP

SEQ ID NO: 3032555 - protein, 6 aa, Entamoeba invadens
FTSGDD

SEQ ID NO: 3032556 - protein, 74 aa, Entamoeba invadens
FVDEQQAKQKSHPKTDEVTAPKKEAKPETKKEEKKVEAKKSEPKEGTHVPKPKGDEPVIEDRPNGKKEVVSGDK

SEQ ID NO: 3032557 - protein, 4 aa, Entamoeba invadens
FVKQ

SEQ ID NO: 3032558 - protein, 8 aa, Entamoeba invadens
FVSNGGGC

SEQ ID NO: 3032559 - protein, 9 aa, Entamoeba invadens
FYKDSNNKC

SEQ ID NO: 3032560 - protein, 10 aa, Entamoeba invadens
FYSDGGTKKC

SEQ ID NO: 3032561 - protein, 10 aa, Entamoeba invadens
FYSTSGSSTC

SEQ ID NO: 3032562 - protein, 10 aa, Entamoeba invadens
FYSTTKSSTC

SEQ ID NO: 3032563 - protein, 7 aa, Entamoeba invadens
FYTSSES

SEQ ID NO: 3032564 - protein, 6 aa, Entamoeba invadens
GAADSY

SEQ ID NO: 3032565 - protein, 5 aa, Entamoeba invadens
GACTK

SEQ ID NO: 3032566 - protein, 13 aa, Entamoeba invadens
GACTKGDDNCDAP

SEQ ID NO: 3032567 - protein, 12 aa, Entamoeba invadens
GADLSRTQKLRS

SEQ ID NO: 3032568 - protein, 6 aa, Entamoeba invadens
GADQLP

SEQ ID NO: 3032569 - protein, 6 aa, Entamoeba invadens
GADYER

SEQ ID NO: 3032570 - protein, 4 aa, Entamoeba invadens
GAFN

SEQ ID NO: 3032571 - protein, 8 aa, Entamoeba invadens
GAGASGIR

SEQ ID NO: 3032572 - protein, 10 aa, Entamoeba invadens
GAGNGPDKEE

SEQ ID NO: 3032573 - protein, 13 aa, Entamoeba invadens
GAGNSYGHPTQKA

SEQ ID NO: 3032574 - protein, 8 aa, Entamoeba invadens
GAKAVNSS

SEQ ID NO: 3032575 - protein, 43 aa, Entamoeba invadens
GAKMKSLDDLPPEEVTIPEEPPEGSGLTVKPDACSADAGCDVK

SEQ ID NO: 3032576 - protein, 8 aa, Entamoeba invadens
GAKNPQVT

SEQ ID NO: 3032577 - protein, 7 aa, Entamoeba invadens
GAMDNKT

SEQ ID NO: 3032578 - protein, 4 aa, Entamoeba invadens
GANC

SEQ ID NO: 3032579 - protein, 5 aa, Entamoeba invadens
GAPHL

SEQ ID NO: 3032580 - protein, 6 aa, Entamoeba invadens
GAPPAF

SEQ ID NO: 3032581 - protein, 11 aa, Entamoeba invadens
GAPTEDDNDRL

SEQ ID NO: 3032582 - protein, 13 aa, Entamoeba invadens
GAQVGKELKDTFE

SEQ ID NO: 3032583 - protein, 11 aa, Entamoeba invadens
GARYPTEKNTL

SEQ ID NO: 3032584 - protein, 7 aa, Entamoeba invadens
GASENCE

SEQ ID NO: 3032585 - protein, 11 aa, Entamoeba invadens
GASGCDGAPLN

SEQ ID NO: 3032586 - protein, 12 aa, Entamoeba invadens
GASVKPDDASCP

SEQ ID NO: 3032587 - protein, 5 aa, Entamoeba invadens
GASVS

SEQ ID NO: 3032588 - protein, 10 aa, Entamoeba invadens
GATAGTISGV

SEQ ID NO: 3032589 - protein, 15 aa, Entamoeba invadens
GATHESVKSSVGGNM

SEQ ID NO: 3032590 - protein, 5 aa, Entamoeba invadens
GATNL

SEQ ID NO: 3032591 - protein, 12 aa, Entamoeba invadens
GAVADGKTAINK

SEQ ID NO: 3032592 - protein, 8 aa, Entamoeba invadens
GAVGKSSL

SEQ ID NO: 3032593 - protein, 10 aa, Entamoeba invadens
GAYDKTSNVI

SEQ ID NO: 3032594 - protein, 7 aa, Entamoeba invadens
GCDGGSL

SEQ ID NO: 3032595 - protein, 45 aa, Entamoeba invadens
GCDKPEKVDKNEKVGNTTESNETRPSGEHPLEEKIEDSNEKKCEE

SEQ ID NO: 3032596 - protein, 8 aa, Entamoeba invadens
GCDTNGKC

SEQ ID NO: 3032597 - protein, 7 aa, Entamoeba invadens
GCETLEG

SEQ ID NO: 3032598 - protein, 7 aa, Entamoeba invadens
GCKREVK

SEQ ID NO: 3032599 - protein, 13 aa, Entamoeba invadens
GCNLRGDQNSKVP

SEQ ID NO: 3032600 - protein, 4 aa, Entamoeba invadens
GCNT

SEQ ID NO: 3032601 - protein, 6 aa, Entamoeba invadens
GCNTSG

SEQ ID NO: 3032602 - protein, 7 aa, Entamoeba invadens
GCNTSGF

SEQ ID NO: 3032603 - protein, 11 aa, Entamoeba invadens
GCPTKLGPNQM

SEQ ID NO: 3032604 - protein, 11 aa, Entamoeba invadens
GCSKCKADQTT

SEQ ID NO: 3032605 - protein, 10 aa, Entamoeba invadens
GCSKCSSSDI

SEQ ID NO: 3032606 - protein, 10 aa, Entamoeba invadens
GCSSCEENYY

SEQ ID NO: 3032607 - protein, 10 aa, Entamoeba invadens
GCSTKGPKQM

SEQ ID NO: 3032608 - protein, 5 aa, Entamoeba invadens
GCYGS

SEQ ID NO: 3032609 - protein, 7 aa, Entamoeba invadens
GDAAGQV

SEQ ID NO: 3032610 - protein, 8 aa, Entamoeba invadens
GDAAGQVS

SEQ ID NO: 3032611 - protein, 10 aa, Entamoeba invadens
GDEKPDFDTG

SEQ ID NO: 3032612 - protein, 25 aa, Entamoeba invadens
GDGKRKKKSTTKNKKAKRINKSKND

SEQ ID NO: 3032613 - protein, 5 aa, Entamoeba invadens
GDGTI

SEQ ID NO: 3032614 - protein, 24 aa, Entamoeba invadens
GDIDRTEAYAEGEIPSPGFEPNPD

SEQ ID NO: 3032615 - protein, 17 aa, Entamoeba invadens
GDIKKGKEDLSKLTTEY

SEQ ID NO: 3032616 - protein, 13 aa, Entamoeba invadens
GDIKRGKEDLSKL

SEQ ID NO: 3032617 - protein, 13 aa, Entamoeba invadens
GDITQANGYGGES

SEQ ID NO: 3032618 - protein, 7 aa, Entamoeba invadens
GDKCSKE

SEQ ID NO: 3032619 - protein, 4 aa, Entamoeba invadens
GDNA

SEQ ID NO: 3032620 - protein, 9 aa, Entamoeba invadens
GDNADLPKE

SEQ ID NO: 3032621 - protein, 10 aa, Entamoeba invadens
GDNPKPMNYT

SEQ ID NO: 3032622 - protein, 21 aa, Entamoeba invadens
GDNSQNRENESNEYRFDASSN

SEQ ID NO: 3032623 - protein, 8 aa, Entamoeba invadens
GDNSTLSN

SEQ ID NO: 3032624 - protein, 6 aa, Entamoeba invadens
GDPFTK

SEQ ID NO: 3032625 - protein, 5 aa, Entamoeba invadens
GDPIQ

SEQ ID NO: 3032626 - protein, 5 aa, Entamoeba invadens
GDQGV

SEQ ID NO: 3032627 - protein, 6 aa, Entamoeba invadens
GDQNEK

SEQ ID NO: 3032628 - protein, 6 aa, Entamoeba invadens
GDRTQE

SEQ ID NO: 3032629 - protein, 9 aa, Entamoeba invadens
GDSCQEPLY

SEQ ID NO: 3032630 - protein, 7 aa, Entamoeba invadens
GDSDATF

SEQ ID NO: 3032631 - protein, 7 aa, Entamoeba invadens
GDSGCTA

SEQ ID NO: 3032632 - protein, 8 aa, Entamoeba invadens
GDSVTFPK

SEQ ID NO: 3032633 - protein, 9 aa, Entamoeba invadens
GDTAGQLSG

SEQ ID NO: 3032634 - protein, 14 aa, Entamoeba invadens
GDTCTTGKPVETPV

SEQ ID NO: 3032635 - protein, 8 aa, Entamoeba invadens
GDTGCTKC

SEQ ID NO: 3032636 - protein, 6 aa, Entamoeba invadens
GDTKES

SEQ ID NO: 3032637 - protein, 4 aa, Entamoeba invadens
GDTS

SEQ ID NO: 3032638 - protein, 7 aa, Entamoeba invadens
GDTSEKL

SEQ ID NO: 3032639 - protein, 9 aa, Entamoeba invadens
GDTTCTQCS

SEQ ID NO: 3032640 - protein, 11 aa, Entamoeba invadens
GDVEVGKSEIE

SEQ ID NO: 3032641 - protein, 13 aa, Entamoeba invadens
GDVLSQSKEINKN

SEQ ID NO: 3032642 - protein, 8 aa, Entamoeba invadens
GDVTKKNT

SEQ ID NO: 3032643 - protein, 4 aa, Entamoeba invadens
GDVV

SEQ ID NO: 3032644 - protein, 6 aa, Entamoeba invadens
GDYKNY

SEQ ID NO: 3032645 - protein, 10 aa, Entamoeba invadens
GDYYQGEDLT

SEQ ID NO: 3032646 - protein, 15 aa, Entamoeba invadens
GEAEPVKYQGPRTLE

SEQ ID NO: 3032647 - protein, 6 aa, Entamoeba invadens
GECAPC

SEQ ID NO: 3032648 - protein, 4 aa, Entamoeba invadens
GECE

SEQ ID NO: 3032649 - protein, 6 aa, Entamoeba invadens
GECSTE

SEQ ID NO: 3032650 - protein, 7 aa, Entamoeba invadens
GEDCSPP

SEQ ID NO: 3032651 - protein, 10 aa, Entamoeba invadens
GEDSEQSQIE

SEQ ID NO: 3032652 - protein, 8 aa, Entamoeba invadens
GEDTPYNG

SEQ ID NO: 3032653 - protein, 8 aa, Entamoeba invadens
GEEAKAAG

SEQ ID NO: 3032654 - protein, 10 aa, Entamoeba invadens
GEENKDFENI

SEQ ID NO: 3032655 - protein, 6 aa, Entamoeba invadens
GEEPPV

SEQ ID NO: 3032656 - protein, 11 aa, Entamoeba invadens
GEGAASAGAIG

SEQ ID NO: 3032657 - protein, 4 aa, Entamoeba invadens
GEGI

SEQ ID NO: 3032658 - protein, 11 aa, Entamoeba invadens
GEGNAPESKDF

SEQ ID NO: 3032659 - protein, 9 aa, Entamoeba invadens
GEGPETEKV

SEQ ID NO: 3032660 - protein, 6 aa, Entamoeba invadens
GEGTYE

SEQ ID NO: 3032661 - protein, 19 aa, Entamoeba invadens
GEGYQSSCASCTDNYTSNG

SEQ ID NO: 3032662 - protein, 9 aa, Entamoeba invadens
GEKCKNDND

SEQ ID NO: 3032663 - protein, 15 aa, Entamoeba invadens
GEKGLGKSGKPLSYK

SEQ ID NO: 3032664 - protein, 10 aa, Entamoeba invadens
GEKGLSSTGL

SEQ ID NO: 3032665 - protein, 18 aa, Entamoeba invadens
GELPRKREHALQQEKKKN

SEQ ID NO: 3032666 - protein, 12 aa, Entamoeba invadens
GEMTGSARSQAH

SEQ ID NO: 3032667 - protein, 6 aa, Entamoeba invadens
GENTEF

SEQ ID NO: 3032668 - protein, 8 aa, Entamoeba invadens
GEQTTGVP

SEQ ID NO: 3032669 - protein, 8 aa, Entamoeba invadens
GEQVENKR

SEQ ID NO: 3032670 - protein, 7 aa, Entamoeba invadens
GEREGER

SEQ ID NO: 3032671 - protein, 7 aa, Entamoeba invadens
GESCDDQ

SEQ ID NO: 3032672 - protein, 31 aa, Entamoeba invadens
GESGACSSCSSGFKKVGGECTSCASNGNCNS

SEQ ID NO: 3032673 - protein, 6 aa, Entamoeba invadens
GESPTV

SEQ ID NO: 3032674 - protein, 8 aa, Entamoeba invadens
GESSGTSD

SEQ ID NO: 3032675 - protein, 6 aa, Entamoeba invadens
GESWGD

SEQ ID NO: 3032676 - protein, 7 aa, Entamoeba invadens
GETGIEK

SEQ ID NO: 3032677 - protein, 8 aa, Entamoeba invadens
GETKHTVQ

SEQ ID NO: 3032678 - protein, 5 aa, Entamoeba invadens
GEVDL

SEQ ID NO: 3032679 - protein, 8 aa, Entamoeba invadens
GEVKTGSM

SEQ ID NO: 3032680 - protein, 8 aa, Entamoeba invadens
GEYEDLSE

SEQ ID NO: 3032681 - protein, 33 aa, Entamoeba invadens
GEYVKDQAKTGLKNQIKNGLAPVKDGAIKTVNG

SEQ ID NO: 3032682 - protein, 15 aa, Entamoeba invadens
GFDKSTGKPEESEMD

SEQ ID NO: 3032683 - protein, 13 aa, Entamoeba invadens
GFETPRRLEGSDV

SEQ ID NO: 3032684 - protein, 5 aa, Entamoeba invadens
GFKTA

SEQ ID NO: 3032685 - protein, 10 aa, Entamoeba invadens
GFNTSNDTKI

SEQ ID NO: 3032686 - protein, 6 aa, Entamoeba invadens
GFQTPP

SEQ ID NO: 3032687 - protein, 5 aa, Entamoeba invadens
GFREK

SEQ ID NO: 3032688 - protein, 8 aa, Entamoeba invadens
GFRKTGQR

SEQ ID NO: 3032689 - protein, 8 aa, Entamoeba invadens
GFSSDAPY

SEQ ID NO: 3032690 - protein, 4 aa, Entamoeba invadens
GFST

SEQ ID NO: 3032691 - protein, 5 aa, Entamoeba invadens
GFTDQ

SEQ ID NO: 3032692 - protein, 5 aa, Entamoeba invadens
GFTPS

SEQ ID NO: 3032693 - protein, 10 aa, Entamoeba invadens
GFTREDKKEF

SEQ ID NO: 3032694 - protein, 5 aa, Entamoeba invadens
GFYPY

SEQ ID NO: 3032695 - protein, 4 aa, Entamoeba invadens
GFYS

SEQ ID NO: 3032696 - protein, 5 aa, Entamoeba invadens
GGASY

SEQ ID NO: 3032697 - protein, 8 aa, Entamoeba invadens
GGDEVNQN

SEQ ID NO: 3032698 - protein, 4 aa, Entamoeba invadens
GGES

SEQ ID NO: 3032699 - protein, 6 aa, Entamoeba invadens
GGFAKK

SEQ ID NO: 3032700 - protein, 4 aa, Entamoeba invadens
GGFE

SEQ ID NO: 3032701 - protein, 19 aa, Entamoeba invadens
GGFHNSKTGTGASAGLSWT

SEQ ID NO: 3032702 - protein, 4 aa, Entamoeba invadens
GGKC

SEQ ID NO: 3032703 - protein, 8 aa, Entamoeba invadens
GGKGKIYG

SEQ ID NO: 3032704 - protein, 7 aa, Entamoeba invadens
GGKNDEQ

SEQ ID NO: 3032705 - protein, 10 aa, Entamoeba invadens
GGLEEAKRRE

SEQ ID NO: 3032706 - protein, 10 aa, Entamoeba invadens
GGNKEKRIES

SEQ ID NO: 3032707 - protein, 13 aa, Entamoeba invadens
GGNQMSPKVTKTG

SEQ ID NO: 3032708 - protein, 8 aa, Entamoeba invadens
GGPESPWT

SEQ ID NO: 3032709 - protein, 6 aa, Entamoeba invadens
GGPFDN

SEQ ID NO: 3032710 - protein, 12 aa, Entamoeba invadens
GGPNPNNNIDNQ

SEQ ID NO: 3032711 - protein, 18 aa, Entamoeba invadens
GGPSGLAAAKAALDTNKS

SEQ ID NO: 3032712 - protein, 5 aa, Entamoeba invadens
GGSDY

SEQ ID NO: 3032713 - protein, 9 aa, Entamoeba invadens
GGSEETEKK

SEQ ID NO: 3032714 - protein, 12 aa, Entamoeba invadens
GGSGSSGHHASL

SEQ ID NO: 3032715 - protein, 5 aa, Entamoeba invadens
GGSIT

SEQ ID NO: 3032716 - protein, 5 aa, Entamoeba invadens
GGSLT

SEQ ID NO: 3032717 - protein, 9 aa, Entamoeba invadens
GGTASGKTT

SEQ ID NO: 3032718 - protein, 14 aa, Entamoeba invadens
GGTCTQEAECKDSL

SEQ ID NO: 3032719 - protein, 7 aa, Entamoeba invadens
GGTDSTH

SEQ ID NO: 3032720 - protein, 6 aa, Entamoeba invadens
GGTHGL

SEQ ID NO: 3032721 - protein, 6 aa, Entamoeba invadens
GGTHGM

SEQ ID NO: 3032722 - protein, 8 aa, Entamoeba invadens
GGTKNSAV

SEQ ID NO: 3032723 - protein, 6 aa, Entamoeba invadens
GGTNGM

SEQ ID NO: 3032724 - protein, 6 aa, Entamoeba invadens
GGWKNS

SEQ ID NO: 3032725 - protein, 5 aa, Entamoeba invadens
GGYIG

SEQ ID NO: 3032726 - protein, 6 aa, Entamoeba invadens
GGYKRG

SEQ ID NO: 3032727 - protein, 16 aa, Entamoeba invadens
GGYSGGELGGVAENGD

SEQ ID NO: 3032728 - protein, 15 aa, Entamoeba invadens
GGYSGGELGGVVENG

SEQ ID NO: 3032729 - protein, 5 aa, Entamoeba invadens
GHEDG

SEQ ID NO: 3032730 - protein, 14 aa, Entamoeba invadens
GHKRVTDGDEAGLQ

SEQ ID NO: 3032731 - protein, 5 aa, Entamoeba invadens
GHNVS

SEQ ID NO: 3032732 - protein, 5 aa, Entamoeba invadens
GHTNK

SEQ ID NO: 3032733 - protein, 14 aa, Entamoeba invadens
GHYSPGGTSSCSSC

SEQ ID NO: 3032734 - protein, 9 aa, Entamoeba invadens
GIADATGDL

SEQ ID NO: 3032735 - protein, 31 aa, Entamoeba invadens
GIDESKKGSDFINEDSQNEKKDDDIQKEKDE

SEQ ID NO: 3032736 - protein, 10 aa, Entamoeba invadens
GIDGKTYDTT

SEQ ID NO: 3032737 - protein, 20 aa, Entamoeba invadens
GIEIPPPKHPDEKREVEPGW

SEQ ID NO: 3032738 - protein, 6 aa, Entamoeba invadens
GIENGK

SEQ ID NO: 3032739 - protein, 11 aa, Entamoeba invadens
GIFPPSYGKTT

SEQ ID NO: 3032740 - protein, 6 aa, Entamoeba invadens
GIFPSG

SEQ ID NO: 3032741 - protein, 6 aa, Entamoeba invadens
GIGLET

SEQ ID NO: 3032742 - protein, 4 aa, Entamoeba invadens
GIGT

SEQ ID NO: 3032743 - protein, 6 aa, Entamoeba invadens
GIGTPK

SEQ ID NO: 3032744 - protein, 14 aa, Entamoeba invadens
GIGTPKYMAPEKAA

SEQ ID NO: 3032745 - protein, 7 aa, Entamoeba invadens
GIGTPTY

SEQ ID NO: 3032746 - protein, 7 aa, Entamoeba invadens
GIKQLGT

SEQ ID NO: 3032747 - protein, 20 aa, Entamoeba invadens
GIMEEKDEKYIAQSKTCQED

SEQ ID NO: 3032748 - protein, 12 aa, Entamoeba invadens
GINPSEDETYYP

SEQ ID NO: 3032749 - protein, 8 aa, Entamoeba invadens
GINTYEGK

SEQ ID NO: 3032750 - protein, 15 aa, Entamoeba invadens
GIPDKNKVVTSLSTN

SEQ ID NO: 3032751 - protein, 7 aa, Entamoeba invadens
GIPPQSL

SEQ ID NO: 3032752 - protein, 8 aa, Entamoeba invadens
GISEPTYR

SEQ ID NO: 3032753 - protein, 10 aa, Entamoeba invadens
GISVDNSNGY

SEQ ID NO: 3032754 - protein, 5 aa, Entamoeba invadens
GITTT

SEQ ID NO: 3032755 - protein, 4 aa, Entamoeba invadens
GIVQ

SEQ ID NO: 3032756 - protein, 27 aa, Entamoeba invadens
GKAEKGESRIRRTASGKDELIDRPDQG

SEQ ID NO: 3032757 - protein, 7 aa, Entamoeba invadens
GKAKCSG

SEQ ID NO: 3032758 - protein, 7 aa, Entamoeba invadens
GKALGSK

SEQ ID NO: 3032759 - protein, 9 aa, Entamoeba invadens
GKALTKGKL

SEQ ID NO: 3032760 - protein, 11 aa, Entamoeba invadens
GKAQPTSGEGL

SEQ ID NO: 3032761 - protein, 6 aa, Entamoeba invadens
GKATAF

SEQ ID NO: 3032762 - protein, 9 aa, Entamoeba invadens
GKCDGLTGC

SEQ ID NO: 3032763 - protein, 14 aa, Entamoeba invadens
GKCEFGRDKNCESP

SEQ ID NO: 3032764 - protein, 8 aa, Entamoeba invadens
GKCGNGKI

SEQ ID NO: 3032765 - protein, 5 aa, Entamoeba invadens
GKCND

SEQ ID NO: 3032766 - protein, 8 aa, Entamoeba invadens
GKCTQEVN

SEQ ID NO: 3032767 - protein, 31 aa, Entamoeba invadens; identical to SEQ ID NO: 2756471

SEQ ID NO: 3032768 - protein, 9 aa, Entamoeba invadens
GKDAPSDFA

SEQ ID NO: 3032769 - protein, 8 aa, Entamoeba invadens
GKDDDNSP

SEQ ID NO: 3032770 - protein, 9 aa, Entamoeba invadens
GKDKKRSKV

SEQ ID NO: 3032771 - protein, 9 aa, Entamoeba invadens
GKDKKRTKV

SEQ ID NO: 3032772 - protein, 4 aa, Entamoeba invadens
GKEE

SEQ ID NO: 3032773 - protein, 8 aa, Entamoeba invadens
GKEENGYK

SEQ ID NO: 3032774 - protein, 8 aa, Entamoeba invadens
GKEEQKKL

SEQ ID NO: 3032775 - protein, 16 aa, Entamoeba invadens
GKEPIPFQGQRTEETL

SEQ ID NO: 3032776 - protein, 14 aa, Entamoeba invadens
GKEPNTEVNPDEAV

SEQ ID NO: 3032777 - protein, 6 aa, Entamoeba invadens
GKEPRE

SEQ ID NO: 3032778 - protein, 7 aa, Entamoeba invadens
GKEPREV

SEQ ID NO: 3032779 - protein, 11 aa, Entamoeba invadens
GKEPRTDNPNC

SEQ ID NO: 3032780 - protein, 6 aa, Entamoeba invadens
GKFPTK

SEQ ID NO: 3032781 - protein, 24 aa, Entamoeba invadens
GKGDEALKKAKEEKQRTKQTLPVT

SEQ ID NO: 3032782 - protein, 5 aa, Entamoeba invadens
GKGLT

SEQ ID NO: 3032783 - protein, 6 aa, Entamoeba invadens
GKHDSQ

SEQ ID NO: 3032784 - protein, 7 aa, Entamoeba invadens
GKHLKSS

SEQ ID NO: 3032785 - protein, 10 aa, Entamoeba invadens
GKIDKTEEKV

SEQ ID NO: 3032786 - protein, 11 aa, Entamoeba invadens
GKIKSKSQVTE

SEQ ID NO: 3032787 - protein, 6 aa, Entamoeba invadens
GKIPQG

SEQ ID NO: 3032788 - protein, 6 aa, Entamoeba invadens
GKKCDA

SEQ ID NO: 3032789 - protein, 7 aa, Entamoeba invadens
GKKEESV

SEQ ID NO: 3032790 - protein, 20 aa, Entamoeba invadens
GKKITANGIKQTAKAVGKGV

SEQ ID NO: 3032791 - protein, 4 aa, Entamoeba invadens
GKKL

SEQ ID NO: 3032792 - protein, 17 aa, Entamoeba invadens
GKKRDEEKRMKKSARNF

SEQ ID NO: 3032793 - protein, 4 aa, Entamoeba invadens
GKKV

SEQ ID NO: 3032794 - protein, 9 aa, Entamoeba invadens
GKKYTAQQV

SEQ ID NO: 3032795 - protein, 8 aa, Entamoeba invadens
GKLEKRKQ

SEQ ID NO: 3032796 - protein, 9 aa, Entamoeba invadens
GKLGPPRQL

SEQ ID NO: 3032797 - protein, 13 aa, Entamoeba invadens
GKLQKGLTELRQQ

SEQ ID NO: 3032798 - protein, 7 aa, Entamoeba invadens
GKLTTKK

SEQ ID NO: 3032799 - protein, 16 aa, Entamoeba invadens
GKNHNHNNATQSNQTI

SEQ ID NO: 3032800 - protein, 9 aa, Entamoeba invadens
GKNKKRTNV

SEQ ID NO: 3032801 - protein, 4 aa, Entamoeba invadens
GKNT

SEQ ID NO: 3032802 - protein, 9 aa, Entamoeba invadens
GKNVPKKLR

SEQ ID NO: 3032803 - protein, 4 aa, Entamoeba invadens
GKQF

SEQ ID NO: 3032804 - protein, 7 aa, Entamoeba invadens
GKRCAVD

SEQ ID NO: 3032805 - protein, 9 aa, Entamoeba invadens
GKRGQSVSQ

SEQ ID NO: 3032806 - protein, 7 aa, Entamoeba invadens
GKRPEIQ

SEQ ID NO: 3032807 - protein, 9 aa, Entamoeba invadens
GKSKEENVT

SEQ ID NO: 3032808 - protein, 8 aa, Entamoeba invadens
GKSKEESI

SEQ ID NO: 3032809 - protein, 10 aa, Entamoeba invadens
GKSKEESVTF

SEQ ID NO: 3032810 - protein, 9 aa, Entamoeba invadens
GKSKNNQFK

SEQ ID NO: 3032811 - protein, 7 aa, Entamoeba invadens
GKSWGDE

SEQ ID NO: 3032812 - protein, 7 aa, Entamoeba invadens
GKSYNNP

SEQ ID NO: 3032813 - protein, 9 aa, Entamoeba invadens
GKTAQGFEK

SEQ ID NO: 3032814 - protein, 10 aa, Entamoeba invadens
GKTKQGYETQ

SEQ ID NO: 3032815 - protein, 9 aa, Entamoeba invadens
GKTPAALSE

SEQ ID NO: 3032816 - protein, 5 aa, Entamoeba invadens
GKTVD

SEQ ID NO: 3032817 - protein, 8 aa, Entamoeba invadens
GKTYNNQF

SEQ ID NO: 3032818 - protein, 5 aa, Entamoeba invadens
GKVEE

SEQ ID NO: 3032819 - protein, 43 aa, Entamoeba invadens
GKVKGTVKTSIKNKVKSSVKSIKKSASKVKSTVKSVKKTMNKL

SEQ ID NO: 3032820 - protein, 9 aa, Entamoeba invadens
GKVKTDVKK

SEQ ID NO: 3032821 - protein, 32 aa, Entamoeba invadens
GKVNGKVAGAVGKIGGKVGKVAGKVGKIGAGK

SEQ ID NO: 3032822 - protein, 7 aa, Entamoeba invadens
GKVSTTP

SEQ ID NO: 3032823 - protein, 9 aa, Entamoeba invadens
GKYGNCTNE

SEQ ID NO: 3032824 - protein, 9 aa, Entamoeba invadens
GKYNSGTYN

SEQ ID NO: 3032825 - protein, 14 aa, Entamoeba invadens
GKYQPNEKSEIHTN

SEQ ID NO: 3032826 - protein, 9 aa, Entamoeba invadens
GKYTEKVER

SEQ ID NO: 3032827 - protein, 15 aa, Entamoeba invadens
GKYYNPNSKNCQNND

SEQ ID NO: 3032828 - protein, 10 aa, Entamoeba invadens
GLDDKNVTAM

SEQ ID NO: 3032829 - protein, 8 aa, Entamoeba invadens
GLDNNGKC

SEQ ID NO: 3032830 - protein, 8 aa, Entamoeba invadens
GLETSGKI

SEQ ID NO: 3032831 - protein, 4 aa, Entamoeba invadens
GLGS

SEQ ID NO: 3032832 - protein, 14 aa, Entamoeba invadens
GLKPTGTADKKTLS

SEQ ID NO: 3032833 - protein, 10 aa, Entamoeba invadens
GLNPRTRGPL

SEQ ID NO: 3032834 - protein, 14 aa, Entamoeba invadens
GLPDKYDFGWILAK

SEQ ID NO: 3032835 - protein, 18 aa, Entamoeba invadens
GLPKNTQSVDTSRLYTGY

SEQ ID NO: 3032836 - protein, 20 aa, Entamoeba invadens
GLPSQVGAGTRVDNQVQKSN

SEQ ID NO: 3032837 - protein, 4 aa, Entamoeba invadens
GLPT

SEQ ID NO: 3032838 - protein, 18 aa, Entamoeba invadens
GLSPQTRSPFSHSPGAGD

SEQ ID NO: 3032839 - protein, 8 aa, Entamoeba invadens
GLVDTSTQ

SEQ ID NO: 3032840 - protein, 11 aa, Entamoeba invadens
GMEPGKKPTLM

SEQ ID NO: 3032841 - protein, 5 aa, Entamoeba invadens
GMKDG

SEQ ID NO: 3032842 - protein, 9 aa, Entamoeba invadens
GMKNDNEGT

SEQ ID NO: 3032843 - protein, 16 aa, Entamoeba invadens
GMKQNKKRCKNETKKL

SEQ ID NO: 3032844 - protein, 26 aa, Entamoeba invadens
GMNPGDKSTKDEEGAKGTTDKDVVDD

SEQ ID NO: 3032845 - protein, 10 aa, Entamoeba invadens
GMRKGHPCKP

SEQ ID NO: 3032846 - protein, 9 aa, Entamoeba invadens
GMRTETRQF

SEQ ID NO: 3032847 - protein, 14 aa, Entamoeba invadens
GNAQSLQHHVETEH

SEQ ID NO: 3032848 - protein, 17 aa, Entamoeba invadens
GNCSSCDSNEDESKRKC

SEQ ID NO: 3032849 - protein, 15 aa, Entamoeba invadens
GNDANECSSTQTGLE

SEQ ID NO: 3032850 - protein, 11 aa, Entamoeba invadens
GNDTKPTEIRD

SEQ ID NO: 3032851 - protein, 13 aa, Entamoeba invadens
GNDVEATTNTEEC

SEQ ID NO: 3032852 - protein, 4 aa, Entamoeba invadens
GNDY

SEQ ID NO: 3032853 - protein, 6 aa, Entamoeba invadens
GNEETA

SEQ ID NO: 3032854 - protein, 4 aa, Entamoeba invadens
GNES

SEQ ID NO: 3032855 - protein, 7 aa, Entamoeba invadens
GNGGEDS

SEQ ID NO: 3032856 - protein, 7 aa, Entamoeba invadens
GNGGQVE

SEQ ID NO: 3032857 - protein, 8 aa, Entamoeba invadens
GNGKEYYA

SEQ ID NO: 3032858 - protein, 4 aa, Entamoeba invadens
GNGN

SEQ ID NO: 3032859 - protein, 4 aa, Entamoeba invadens
GNGY

SEQ ID NO: 3032860 - protein, 9 aa, Entamoeba invadens
GNHQIASKS

SEQ ID NO: 3032861 - protein, 12 aa, Entamoeba invadens
GNKVQQKVPEGY

SEQ ID NO: 3032862 - protein, 4 aa, Entamoeba invadens
GNLD

SEQ ID NO: 3032863 - protein, 22 aa, Entamoeba invadens
GNLDAGNKKKAVETEKKAYNTA

SEQ ID NO: 3032864 - protein, 10 aa, Entamoeba invadens
GNLSSATSTV

SEQ ID NO: 3032865 - protein, 7 aa, Entamoeba invadens
GNNNSNI

SEQ ID NO: 3032866 - protein, 9 aa, Entamoeba invadens
GNNVTSDQL

SEQ ID NO: 3032867 - protein, 6 aa, Entamoeba invadens
GNPEGQ

SEQ ID NO: 3032868 - protein, 7 aa, Entamoeba invadens
GNPEGQV

SEQ ID NO: 3032869 - protein, 6 aa, Entamoeba invadens
GNPETQ

SEQ ID NO: 3032870 - protein, 4 aa, Entamoeba invadens
GNPM

SEQ ID NO: 3032871 - protein, 12 aa, Entamoeba invadens
GNPNDKLDTMAK

SEQ ID NO: 3032872 - protein, 8 aa, Entamoeba invadens
GNPSGQLS

SEQ ID NO: 3032873 - protein, 20 aa, Entamoeba invadens
GNQGGNRRREPKPKKTPNIE

SEQ ID NO: 3032874 - protein, 8 aa, Entamoeba invadens
GNRATNLK

SEQ ID NO: 3032875 - protein, 10 aa, Entamoeba invadens
GNRNSCEQCE

SEQ ID NO: 3032876 - protein, 7 aa, Entamoeba invadens
GNRTQEE

SEQ ID NO: 3032877 - protein, 4 aa, Entamoeba invadens
GNSC

SEQ ID NO: 3032878 - protein, 8 aa, Entamoeba invadens
GNSCKPEC

SEQ ID NO: 3032879 - protein, 4 aa, Entamoeba invadens
GNSD

SEQ ID NO: 3032880 - protein, 8 aa, Entamoeba invadens
GNSEKTHF

SEQ ID NO: 3032881 - protein, 5 aa, Entamoeba invadens
GNSNE

SEQ ID NO: 3032882 - protein, 5 aa, Entamoeba invadens
GNSPG

SEQ ID NO: 3032883 - protein, 4 aa, Entamoeba invadens
GNSV

SEQ ID NO: 3032884 - protein, 14 aa, Entamoeba invadens
GNSWGEKGYGRLST

SEQ ID NO: 3032885 - protein, 18 aa, Entamoeba invadens
GNTCGVTTDPLYPTGVKF

SEQ ID NO: 3032886 - protein, 6 aa, Entamoeba invadens
GNTEVQ

SEQ ID NO: 3032887 - protein, 9 aa, Entamoeba invadens
GNTNASKVE

SEQ ID NO: 3032888 - protein, 4 aa, Entamoeba invadens
GNTT

SEQ ID NO: 3032889 - protein, 6 aa, Entamoeba invadens
GNTYTK

SEQ ID NO: 3032890 - protein, 7 aa, Entamoeba invadens
GNVGDSV

SEQ ID NO: 3032891 - protein, 4 aa, Entamoeba invadens
GNVN

SEQ ID NO: 3032892 - protein, 6 aa, Entamoeba invadens
GNVNGT

SEQ ID NO: 3032893 - protein, 11 aa, Entamoeba invadens
GPCGETRYPAY

SEQ ID NO: 3032894 - protein, 4 aa, Entamoeba invadens
GPDD

SEQ ID NO: 3032895 - protein, 6 aa, Entamoeba invadens
GPDFIP

SEQ ID NO: 3032896 - protein, 5 aa, Entamoeba invadens
GPDNA

SEQ ID NO: 3032897 - protein, 13 aa, Entamoeba invadens
GPEPFSEPPKGDK

SEQ ID NO: 3032898 - protein, 4 aa, Entamoeba invadens
GPFE

SEQ ID NO: 3032899 - protein, 12 aa, Entamoeba invadens
GPGLDEPKKGYL

SEQ ID NO: 3032900 - protein, 10 aa, Entamoeba invadens
GPKESFTSAP

SEQ ID NO: 3032901 - protein, 9 aa, Entamoeba invadens
GPKGPTDYM

SEQ ID NO: 3032902 - protein, 8 aa, Entamoeba invadens
GPKKSKMK

SEQ ID NO: 3032903 - protein, 5 aa, Entamoeba invadens
GPKSH

SEQ ID NO: 3032904 - protein, 7 aa, Entamoeba invadens
GPNGPID

SEQ ID NO: 3032905 - protein, 8 aa, Entamoeba invadens
GPPVSKGY

SEQ ID NO: 3032906 - protein, 10 aa, Entamoeba invadens
GPSEEVQKDY

SEQ ID NO: 3032907 - protein, 5 aa, Entamoeba invadens
GPSEL

SEQ ID NO: 3032908 - protein, 9 aa, Entamoeba invadens
GPSEQTETD

SEQ ID NO: 3032909 - protein, 5 aa, Entamoeba invadens
GPSGS

SEQ ID NO: 3032910 - protein, 5 aa, Entamoeba invadens
GPSMK

SEQ ID NO: 3032911 - protein, 4 aa, Entamoeba invadens
GPSQ

SEQ ID NO: 3032912 - protein, 6 aa, Entamoeba invadens
GPSQQP

SEQ ID NO: 3032913 - protein, 6 aa, Entamoeba invadens
GPSTKP

SEQ ID NO: 3032914 - protein, 10 aa, Entamoeba invadens
GPTKEGGLPP

SEQ ID NO: 3032915 - protein, 4 aa, Entamoeba invadens
GPYA

SEQ ID NO: 3032916 - protein, 5 aa, Entamoeba invadens
GPYEL

SEQ ID NO: 3032917 - protein, 6 aa, Entamoeba invadens
GPYSTL

SEQ ID NO: 3032918 - protein, 5 aa, Entamoeba invadens
GQADS

SEQ ID NO: 3032919 - protein, 11 aa, Entamoeba invadens
GQCNSCDTKHT

SEQ ID NO: 3032920 - protein, 11 aa, Entamoeba invadens
GQCSEKGPKQM

SEQ ID NO: 3032921 - protein, 14 aa, Entamoeba invadens
GQCTKNKDCKATNG

SEQ ID NO: 3032922 - protein, 11 aa, Entamoeba invadens
GQIGTESARSE

SEQ ID NO: 3032923 - protein, 6 aa, Entamoeba invadens
GQKTEL

SEQ ID NO: 3032924 - protein, 6 aa, Entamoeba invadens
GQNITR

SEQ ID NO: 3032925 - protein, 9 aa, Entamoeba invadens
GQNKTKTAT

SEQ ID NO: 3032926 - protein, 24 aa, Entamoeba invadens
GQNNETSEEHCEEKSEEKSEECNK

SEQ ID NO: 3032927 - protein, 7 aa, Entamoeba invadens
GQNTQYG

SEQ ID NO: 3032928 - protein, 19 aa, Entamoeba invadens
GQPDKKKTEDNYEDEFPSL

SEQ ID NO: 3032929 - protein, 12 aa, Entamoeba invadens
GQPDKPPKQIPA

SEQ ID NO: 3032930 - protein, 19 aa, Entamoeba invadens
GQPDSQDEDSENPNDFPSL

SEQ ID NO: 3032931 - protein, 14 aa, Entamoeba invadens
GQPEKPTKKQEFPA

SEQ ID NO: 3032932 - protein, 43 aa, Entamoeba invadens
GQPERQDEHDQKSKQKKQRKGRKNRKEKLEETDYSTVPKDSFE

SEQ ID NO: 3032933 - protein, 7 aa, Entamoeba invadens
GQPTTFK

SEQ ID NO: 3032934 - protein, 5 aa, Entamoeba invadens
GQQDI

SEQ ID NO: 3032935 - protein, 7 aa, Entamoeba invadens
GQRNVNN

SEQ ID NO: 3032936 - protein, 13 aa, Entamoeba invadens
GQRVDPTKLVPKF

SEQ ID NO: 3032937 - protein, 6 aa, Entamoeba invadens
GQVKQI

SEQ ID NO: 3032938 - protein, 11 aa, Entamoeba invadens
GQYNNSAFSKY

SEQ ID NO: 3032939 - protein, 4 aa, Entamoeba invadens
GQYS

SEQ ID NO: 3032940 - protein, 17 aa, Entamoeba invadens
GRDEGRGNFVGIGGSIS

SEQ ID NO: 3032941 - protein, 5 aa, Entamoeba invadens
GRDVS

SEQ ID NO: 3032942 - protein, 19 aa, Entamoeba invadens
GRGCTVGNSTLRDSATTYT

SEQ ID NO: 3032943 - protein, 33 aa, Entamoeba invadens
GRHEKPIEDSQVPEGSIAPPEFPHDDHNHGPHF

SEQ ID NO: 3032944 - protein, 33 aa, Entamoeba invadens
GRHEKPIEDSQVPEGSMAPPEFPHNDHNHGPHF

SEQ ID NO: 3032945 - protein, 33 aa, Entamoeba invadens
GRHEKPVEDSQVPEGSMAPPEFPHDDHNHGPHF

SEQ ID NO: 3032946 - protein, 10 aa, Entamoeba invadens
GRIPDTENPC

SEQ ID NO: 3032947 - protein, 10 aa, Entamoeba invadens
GRKKSASTIY

SEQ ID NO: 3032948 - protein, 8 aa, Entamoeba invadens
GRKNSTTC

SEQ ID NO: 3032949 - protein, 16 aa, Entamoeba invadens
GRKTVSKKYKAKIRKY

SEQ ID NO: 3032950 - protein, 7 aa, Entamoeba invadens
GRNSGKK

SEQ ID NO: 3032951 - protein, 7 aa, Entamoeba invadens
GRREDIE

SEQ ID NO: 3032952 - protein, 5 aa, Entamoeba invadens
GRSVR

SEQ ID NO: 3032953 - protein, 6 aa, Entamoeba invadens
GRSWGD

SEQ ID NO: 3032954 - protein, 8 aa, Entamoeba invadens
GRTAQAEW

SEQ ID NO: 3032955 - protein, 5 aa, Entamoeba invadens
GRTTY

SEQ ID NO: 3032956 - protein, 18 aa, Entamoeba invadens
GRVPTNPGNPNDKPTQEG

SEQ ID NO: 3032957 - protein, 6 aa, Entamoeba invadens
GRYKDV

SEQ ID NO: 3032958 - protein, 7 aa, Entamoeba invadens
GRYTQNE

SEQ ID NO: 3032959 - protein, 5 aa, Entamoeba invadens
GSAEA

SEQ ID NO: 3032960 - protein, 7 aa, Entamoeba invadens
GSALPTE

SEQ ID NO: 3032961 - protein, 28 aa, Entamoeba invadens
GSCDGPERTNCTSCENGKRLDVEPGENY

SEQ ID NO: 3032962 - protein, 12 aa, Entamoeba invadens
GSCPDKDAFTKA

SEQ ID NO: 3032963 - protein, 4 aa, Entamoeba invadens
GSCT

SEQ ID NO: 3032964 - protein, 5 aa, Entamoeba invadens
GSDKM

SEQ ID NO: 3032965 - protein, 7 aa, Entamoeba invadens
GSDQLTS

SEQ ID NO: 3032966 - protein, 18 aa, Entamoeba invadens
GSDSGLSTSYQNGDNKVS

SEQ ID NO: 3032967 - protein, 9 aa, Entamoeba invadens
GSEAKSGLY

SEQ ID NO: 3032968 - protein, 5 aa, Entamoeba invadens
GSEGV

SEQ ID NO: 3032969 - protein, 8 aa, Entamoeba invadens
GSFEDKSN

SEQ ID NO: 3032970 - protein, 5 aa, Entamoeba invadens
GSFGS

SEQ ID NO: 3032971 - protein, 9 aa, Entamoeba invadens
GSFPASSKF

SEQ ID NO: 3032972 - protein, 4 aa, Entamoeba invadens
GSGA

SEQ ID NO: 3032973 - protein, 4 aa, Entamoeba invadens
GSGN

SEQ ID NO: 3032974 - protein, 5 aa, Entamoeba invadens
GSGNK

SEQ ID NO: 3032975 - protein, 8 aa, Entamoeba invadens
GSGVQEPH

SEQ ID NO: 3032976 - protein, 6 aa, Entamoeba invadens
GSIEES

SEQ ID NO: 3032977 - protein, 17 aa, Entamoeba invadens
GSKFTTSDTVNPNLNRD

SEQ ID NO: 3032978 - protein, 5 aa, Entamoeba invadens
GSKMT

SEQ ID NO: 3032979 - protein, 10 aa, Entamoeba invadens
GSLGCKGGGT

SEQ ID NO: 3032980 - protein, 5 aa, Entamoeba invadens
GSLGT

SEQ ID NO: 3032981 - protein, 8 aa, Entamoeba invadens
GSLPSKDE

SEQ ID NO: 3032982 - protein, 10 aa, Entamoeba invadens
GSLTAMDSSR

SEQ ID NO: 3032983 - protein, 10 aa, Entamoeba invadens
GSNGATTSVT

SEQ ID NO: 3032984 - protein, 6 aa, Entamoeba invadens
GSNLDT

SEQ ID NO: 3032985 - protein, 12 aa, Entamoeba invadens
GSNSITSEIPPL

SEQ ID NO: 3032986 - protein, 6 aa, Entamoeba invadens
GSNTEC

SEQ ID NO: 3032987 - protein, 4 aa, Entamoeba invadens
GSNY

SEQ ID NO: 3032988 - protein, 5 aa, Entamoeba invadens
GSPIS

SEQ ID NO: 3032989 - protein, 13 aa, Entamoeba invadens
GSPKSRDDLTADI

SEQ ID NO: 3032990 - protein, 11 aa, Entamoeba invadens
GSPNATQTWTD

SEQ ID NO: 3032991 - protein, 27 aa, Entamoeba invadens
GSQSGPGVRHGETSPKRTGRQSPPTIS

SEQ ID NO: 3032992 - protein, 7 aa, Entamoeba invadens
GSRSPMI

SEQ ID NO: 3032993 - protein, 5 aa, Entamoeba invadens
GSSDE

SEQ ID NO: 3032994 - protein, 13 aa, Entamoeba invadens
GSSGADGYMGPST

SEQ ID NO: 3032995 - protein, 15 aa, Entamoeba invadens
GSSGLTNSAQLKNDF

SEQ ID NO: 3032996 - protein, 26 aa, Entamoeba invadens
GSSKCSNCSSGTYSFSGSSSCTPCSD

SEQ ID NO: 3032997 - protein, 9 aa, Entamoeba invadens
GSSQVDESR

SEQ ID NO: 3032998 - protein, 7 aa, Entamoeba invadens
GSSSSTA

SEQ ID NO: 3032999 - protein, 9 aa, Entamoeba invadens
GSSTTNQIR

SEQ ID NO: 3033000 - protein, 10 aa, Entamoeba invadens
GSSYNPTKSG

SEQ ID NO: 3033001 - protein, 11 aa, Entamoeba invadens
GSTCSDIDKNG

SEQ ID NO: 3033002 - protein, 11 aa, Entamoeba invadens
GSTGCRQTQTL

SEQ ID NO: 3033003 - protein, 7 aa, Entamoeba invadens
GSTNTNC

SEQ ID NO: 3033004 - protein, 9 aa, Entamoeba invadens
GSTSKTTNC

SEQ ID NO: 3033005 - protein, 4 aa, Entamoeba invadens
GSTY

SEQ ID NO: 3033006 - protein, 4 aa, Entamoeba invadens
GSVC

SEQ ID NO: 3033007 - protein, 10 aa, Entamoeba invadens
GSVNNETAPD

SEQ ID NO: 3033008 - protein, 9 aa, Entamoeba invadens
GSVSDSTVN

SEQ ID NO: 3033009 - protein, 7 aa, Entamoeba invadens
GSWDPNA

SEQ ID NO: 3033010 - protein, 6 aa, Entamoeba invadens
GSYPKV

SEQ ID NO: 3033011 - protein, 4 aa, Entamoeba invadens
GSYQ

SEQ ID NO: 3033012 - protein, 8 aa, Entamoeba invadens
GSYSFGGA

SEQ ID NO: 3033013 - protein, 6 aa, Entamoeba invadens
GSYSGN

SEQ ID NO: 3033014 - protein, 16 aa, Entamoeba invadens
GTCDSTCKIGKANKDI

SEQ ID NO: 3033015 - protein, 11 aa, Entamoeba invadens
GTCNANSLTTC

SEQ ID NO: 3033016 - protein, 19 aa, Entamoeba invadens
GTDKYTGKINTAEYPGAAY

SEQ ID NO: 3033017 - protein, 5 aa, Entamoeba invadens
GTDLN

SEQ ID NO: 3033018 - protein, 5 aa, Entamoeba invadens
GTDYP

SEQ ID NO: 3033019 - protein, 4 aa, Entamoeba invadens
GTEM

SEQ ID NO: 3033020 - protein, 8 aa, Entamoeba invadens
GTENCDSN

SEQ ID NO: 3033021 - protein, 6 aa, Entamoeba invadens
GTEPNN

SEQ ID NO: 3033022 - protein, 12 aa, Entamoeba invadens
GTFADEQGISSC

SEQ ID NO: 3033023 - protein, 11 aa, Entamoeba invadens
GTGGDTADDVK

SEQ ID NO: 3033024 - protein, 6 aa, Entamoeba invadens
GTHSDY

SEQ ID NO: 3033025 - protein, 10 aa, Entamoeba invadens
GTHVPTKKSQ

SEQ ID NO: 3033026 - protein, 4 aa, Entamoeba invadens
GTIG

SEQ ID NO: 3033027 - protein, 5 aa, Entamoeba invadens
GTISS

SEQ ID NO: 3033028 - protein, 14 aa, Entamoeba invadens
GTISTKIEDKDKYY

SEQ ID NO: 3033029 - protein, 6 aa, Entamoeba invadens
GTKIED

SEQ ID NO: 3033030 - protein, 32 aa, Entamoeba invadens
GTMANQTTNKCDTCKAGTYAGEGSSECKSCGE

SEQ ID NO: 3033031 - protein, 25 aa, Entamoeba invadens
GTMANQTTNNCDTCKAGTYAGEGSF

SEQ ID NO: 3033032 - protein, 11 aa, Entamoeba invadens
GTMANQTTNTC

SEQ ID NO: 3033033 - protein, 7 aa, Entamoeba invadens
GTNLSNT

SEQ ID NO: 3033034 - protein, 8 aa, Entamoeba invadens
GTNRGIGY

SEQ ID NO: 3033035 - protein, 4 aa, Entamoeba invadens
GTPM

SEQ ID NO: 3033036 - protein, 8 aa, Entamoeba invadens
GTPWPPVS

SEQ ID NO: 3033037 - protein, 5 aa, Entamoeba invadens
GTQNV

SEQ ID NO: 3033038 - protein, 9 aa, Entamoeba invadens
GTSGCRTSV

SEQ ID NO: 3033039 - protein, 14 aa, Entamoeba invadens
GTSGYTSDTLDLSE

SEQ ID NO: 3033040 - protein, 4 aa, Entamoeba invadens
GTSN

SEQ ID NO: 3033041 - protein, 5 aa, Entamoeba invadens
GTSNY

SEQ ID NO: 3033042 - protein, 7 aa, Entamoeba invadens
GTSPSIR

SEQ ID NO: 3033043 - protein, 28 aa, Entamoeba invadens
GTSRFTKKTIKNKEDKGLGTPAYAAPET

SEQ ID NO: 3033044 - protein, 23 aa, Entamoeba invadens
GTSRFTKKTLKKNNEDKGLGTPI

SEQ ID NO: 3033045 - protein, 8 aa, Entamoeba invadens
GTSTPSLE

SEQ ID NO: 3033046 - protein, 5 aa, Entamoeba invadens
GTSVT

SEQ ID NO: 3033047 - protein, 9 aa, Entamoeba invadens
GTTEPFPAR

SEQ ID NO: 3033048 - protein, 39 aa, Entamoeba invadens
  misc_feature (15)..(16): Xaa can be any naturally occurring amino acid
GTTLSNDNLCVTPAXXYHFYINGSVNLEPGKSSKYNMSP

SEQ ID NO: 3033049 - protein, 7 aa, Entamoeba invadens
GTTNKDF

SEQ ID NO: 3033050 - protein, 8 aa, Entamoeba invadens
GTTNQTST

SEQ ID NO: 3033051 - protein, 6 aa, Entamoeba invadens
GTTPVT

SEQ ID NO: 3033052 - protein, 6 aa, Entamoeba invadens
GTTSLT

SEQ ID NO: 3033053 - protein, 15 aa, Entamoeba invadens
GTVSMSTEHNTGTRS

SEQ ID NO: 3033054 - protein, 4 aa, Entamoeba invadens
GTVV

SEQ ID NO: 3033055 - protein, 16 aa, Entamoeba invadens
GTYCGYDGKAPDNQSP

SEQ ID NO: 3033056 - protein, 6 aa, Entamoeba invadens
GTYGDG

SEQ ID NO: 3033057 - protein, 8 aa, Entamoeba invadens
GTYHNKAS

SEQ ID NO: 3033058 - protein, 10 aa, Entamoeba invadens
GTYHNKASNR

SEQ ID NO: 3033059 - protein, 10 aa, Entamoeba invadens
GTYKKTETTC

SEQ ID NO: 3033060 - protein, 8 aa, Entamoeba invadens
GTYSHNQS

SEQ ID NO: 3033061 - protein, 5 aa, Entamoeba invadens
GTYSI

SEQ ID NO: 3033062 - protein, 25 aa, Entamoeba invadens
GTYSNAGASGCSNCGQGSYSNEGSS

SEQ ID NO: 3033063 - protein, 27 aa, Entamoeba invadens
GTYSNQNSTSCTSCGDGTYSKEGATRC

SEQ ID NO: 3033064 - protein, 10 aa, Entamoeba invadens
GTYSPGSDDS

SEQ ID NO: 3033065 - protein, 11 aa, Entamoeba invadens
GTYSSGGTTTS

SEQ ID NO: 3033066 - protein, 62 aa, Entamoeba invadens
GTYSSSGSSKCTNCNSGTYSSSSGSSTCSTCNSGYYSSSGSSSCTPCDAGTYSINSGSASCR

SEQ ID NO: 3033067 - protein, 5 aa, Entamoeba invadens
GTYSV

SEQ ID NO: 3033068 - protein, 6 aa, Entamoeba invadens
GTYSYG

SEQ ID NO: 3033069 - protein, 8 aa, Entamoeba invadens
GVDDNGQC

SEQ ID NO: 3033070 - protein, 11 aa, Entamoeba invadens
GVEGPKQYGRA

SEQ ID NO: 3033071 - protein, 11 aa, Entamoeba invadens
GVEKQKGSFAD

SEQ ID NO: 3033072 - protein, 10 aa, Entamoeba invadens
GVEKQSEDVP

SEQ ID NO: 3033073 - protein, 6 aa, Entamoeba invadens
GVERWG

SEQ ID NO: 3033074 - protein, 6 aa, Entamoeba invadens
GVGHSN

SEQ ID NO: 3033075 - protein, 5 aa, Entamoeba invadens
GVGSP

SEQ ID NO: 3033076 - protein, 5 aa, Entamoeba invadens
GVGTP

SEQ ID NO: 3033077 - protein, 9 aa, Entamoeba invadens
GVKPIYRDG

SEQ ID NO: 3033078 - protein, 43 aa, Entamoeba invadens
GVKSNEPTTPSVTKSEEKSIDKKSEESKIPITPPIDKSGENAI

SEQ ID NO: 3033079 - protein, 4 aa, Entamoeba invadens
GVLD

SEQ ID NO: 3033080 - protein, 12 aa, Entamoeba invadens
GVLPDGSTGYSK

SEQ ID NO: 3033081 - protein, 7 aa, Entamoeba invadens
GVNHSHR

SEQ ID NO: 3033082 - protein, 9 aa, Entamoeba invadens
GVNHSHRDL

SEQ ID NO: 3033083 - protein, 6 aa, Entamoeba invadens
GVPVPK

SEQ ID NO: 3033084 - protein, 8 aa, Entamoeba invadens
GVRSPKLE

SEQ ID NO: 3033085 - protein, 13 aa, Entamoeba invadens
GVSIENAKRPFTS

SEQ ID NO: 3033086 - protein, 5 aa, Entamoeba invadens
GVSYL

SEQ ID NO: 3033087 - protein, 8 aa, Entamoeba invadens
GVTESLEG

SEQ ID NO: 3033088 - protein, 4 aa, Entamoeba invadens
GVTK

SEQ ID NO: 3033089 - protein, 10 aa, Entamoeba invadens
GVTKQSTRLD

SEQ ID NO: 3033090 - protein, 19 aa, Entamoeba invadens
GVTSPSSFTIKGKPKKCQL

SEQ ID NO: 3033091 - protein, 10 aa, Entamoeba invadens
GVVPDSENKG

SEQ ID NO: 3033092 - protein, 10 aa, Entamoeba invadens
GVYSSTEECE

SEQ ID NO: 3033093 - protein, 7 aa, Entamoeba invadens
GWNNKTK

SEQ ID NO: 3033094 - protein, 4 aa, Entamoeba invadens
GWSS

SEQ ID NO: 3033095 - protein, 26 aa, Entamoeba invadens
GWSSPSMKQYRGDVSTCSAGVDYNYK

SEQ ID NO: 3033096 - protein, 7 aa, Entamoeba invadens
GYANPRT

SEQ ID NO: 3033097 - protein, 5 aa, Entamoeba invadens
GYDDP

SEQ ID NO: 3033098 - protein, 6 aa, Entamoeba invadens
GYDSGS

SEQ ID NO: 3033099 - protein, 9 aa, Entamoeba invadens
GYESGGACG

SEQ ID NO: 3033100 - protein, 5 aa, Entamoeba invadens
GYGCE

SEQ ID NO: 3033101 - protein, 5 aa, Entamoeba invadens
GYGGQ

SEQ ID NO: 3033102 - protein, 4 aa, Entamoeba invadens
GYGR

SEQ ID NO: 3033103 - protein, 4 aa, Entamoeba invadens
GYGY

SEQ ID NO: 3033104 - protein, 14 aa, Entamoeba invadens
GYHSTTDETDTEQV

SEQ ID NO: 3033105 - protein, 6 aa, Entamoeba invadens
GYIGNS

SEQ ID NO: 3033106 - protein, 34 aa, Entamoeba invadens
GYKEETTKSEEKSKETSKVPVTPPVDKSEEKEIC

SEQ ID NO: 3033107 - protein, 34 aa, Entamoeba invadens
GYKEETTKSEEKSKETSKVPVTPSVDKSEEKEIC

SEQ ID NO: 3033108 - protein, 4 aa, Entamoeba invadens
GYKT

SEQ ID NO: 3033109 - protein, 7 aa, Entamoeba invadens
GYKTGME

SEQ ID NO: 3033110 - protein, 4 aa, Entamoeba invadens
GYPA

SEQ ID NO: 3033111 - protein, 4 aa, Entamoeba invadens
GYPS

SEQ ID NO: 3033112 - protein, 10 aa, Entamoeba invadens
GYPTTATYAQ

SEQ ID NO: 3033113 - protein, 9 aa, Entamoeba invadens
GYPVTNSNE

SEQ ID NO: 3033114 - protein, 5 aa, Entamoeba invadens
GYQRS

SEQ ID NO: 3033115 - protein, 6 aa, Entamoeba invadens
GYSNER

SEQ ID NO: 3033116 - protein, 9 aa, Entamoeba invadens
GYTGTSGKG

SEQ ID NO: 3033117 - protein, 5 aa, Entamoeba invadens
GYTPT

SEQ ID NO: 3033118 - protein, 4 aa, Entamoeba invadens
GYWP

SEQ ID NO: 3033119 - protein, 5 aa, Entamoeba invadens
GYYND

SEQ ID NO: 3033120 - protein, 13 aa, Entamoeba invadens
GYYNTNSQDAYSN

SEQ ID NO: 3033121 - protein, 10 aa, Entamoeba invadens
GYYPDPSTGK

SEQ ID NO: 3033122 - protein, 8 aa, Entamoeba invadens
GYYPESGN

SEQ ID NO: 3033123 - protein, 11 aa, Entamoeba invadens
GYYPSSTNSNC

SEQ ID NO: 3033124 - protein, 17 aa, Entamoeba invadens
GYYSNKGASTCTSCEGG

SEQ ID NO: 3033125 - protein, 10 aa, Entamoeba invadens
GYYSPGGTIS

SEQ ID NO: 3033126 - protein, 7 aa, Entamoeba invadens
HAAGFTT

SEQ ID NO: 3033127 - protein, 18 aa, Entamoeba invadens
HAEEEEREKKEKAHEELE

SEQ ID NO: 3033128 - protein, 7 aa, Entamoeba invadens
HAGEMTA

SEQ ID NO: 3033129 - protein, 5 aa, Entamoeba invadens
HAKKA

SEQ ID NO: 3033130 - protein, 12 aa, Entamoeba invadens
HANMSGGKLQHS

SEQ ID NO: 3033131 - protein, 17 aa, Entamoeba invadens
HAPTTEIDKKIGETKQT

SEQ ID NO: 3033132 - protein, 9 aa, Entamoeba invadens
HAQTPKDKF

SEQ ID NO: 3033133 - protein, 12 aa, Entamoeba invadens
HARRGRKSTSAF

SEQ ID NO: 3033134 - protein, 12 aa, Entamoeba invadens
HASIPPNRTESK

SEQ ID NO: 3033135 - protein, 13 aa, Entamoeba invadens
HATANKKDLGFET

SEQ ID NO: 3033136 - protein, 5 aa, Entamoeba invadens
HATSL

SEQ ID NO: 3033137 - protein, 4 aa, Entamoeba invadens
HCKS

SEQ ID NO: 3033138 - protein, 6 aa, Entamoeba invadens
HDENRA

SEQ ID NO: 3033139 - protein, 4 aa, Entamoeba invadens
HDGE

SEQ ID NO: 3033140 - protein, 4 aa, Entamoeba invadens
HDGY

SEQ ID NO: 3033141 - protein, 24 aa, Entamoeba invadens
HDHHPQHHHEDDNNNIQNNNETQQ

SEQ ID NO: 3033142 - protein, 7 aa, Entamoeba invadens
HDKEQYS

SEQ ID NO: 3033143 - protein, 6 aa, Entamoeba invadens
HDNEEV

SEQ ID NO: 3033144 - protein, 9 aa, Entamoeba invadens
HDNNQENSE

SEQ ID NO: 3033145 - protein, 27 aa, Entamoeba invadens
HDSDDDRVNSHTPLKSLNSGSESIETT

SEQ ID NO: 3033146 - protein, 4 aa, Entamoeba invadens
HDSL

SEQ ID NO: 3033147 - protein, 4 aa, Entamoeba invadens
HDSS

SEQ ID NO: 3033148 - protein, 4 aa, Entamoeba invadens
HDTE

SEQ ID NO: 3033149 - protein, 4 aa, Entamoeba invadens
HDTT

SEQ ID NO: 3033150 - protein, 6 aa, Entamoeba invadens
HEEQES

SEQ ID NO: 3033151 - protein, 6 aa, Entamoeba invadens
HENSGY

SEQ ID NO: 3033152 - protein, 6 aa, Entamoeba invadens
HEQRRA

SEQ ID NO: 3033153 - protein, 7 aa, Entamoeba invadens
HERTQTT

SEQ ID NO: 3033154 - protein, 10 aa, Entamoeba invadens
HEVEKKEESM

SEQ ID NO: 3033155 - protein, 5 aa, Entamoeba invadens
HFDDE

SEQ ID NO: 3033156 - protein, 4 aa, Entamoeba invadens
HFGP

SEQ ID NO: 3033157 - protein, 9 aa, Entamoeba invadens
HGDATTSTI

SEQ ID NO: 3033158 - protein, 17 aa, Entamoeba invadens
HGDRAPGDSYDSDNGNF

SEQ ID NO: 3033159 - protein, 17 aa, Entamoeba invadens
HGDRTPSNSYKGDNGKF

SEQ ID NO: 3033160 - protein, 8 aa, Entamoeba invadens
HGKETPYS

SEQ ID NO: 3033161 - protein, 19 aa, Entamoeba invadens
HGNTTEEAEAYAKKMSEDK

SEQ ID NO: 3033162 - protein, 6 aa, Entamoeba invadens
HGPESN

SEQ ID NO: 3033163 - protein, 6 aa, Entamoeba invadens
HGPKIT

SEQ ID NO: 3033164 - protein, 11 aa, Entamoeba invadens
HGPQSGFTQAP

SEQ ID NO: 3033165 - protein, 4 aa, Entamoeba invadens
HGSC

SEQ ID NO: 3033166 - protein, 15 aa, Entamoeba invadens
HGSCASNIYDGENGY

SEQ ID NO: 3033167 - protein, 5 aa, Entamoeba invadens
HGSCS

SEQ ID NO: 3033168 - protein, 6 aa, Entamoeba invadens
HGSCSS

SEQ ID NO: 3033169 - protein, 7 aa, Entamoeba invadens
HGSCTSN

SEQ ID NO: 3033170 - protein, 10 aa, Entamoeba invadens
HGSDEESGVD

SEQ ID NO: 3033171 - protein, 18 aa, Entamoeba invadens
HGSEYSSNENWTQTLKPT

SEQ ID NO: 3033172 - protein, 8 aa, Entamoeba invadens
HGSGSYGD

SEQ ID NO: 3033173 - protein, 6 aa, Entamoeba invadens
HGTCSQ

SEQ ID NO: 3033174 - protein, 14 aa, Entamoeba invadens
HGTCSSSVYGGENG

SEQ ID NO: 3033175 - protein, 17 aa, Entamoeba invadens
HGTCSTTTYGGPEGPID

SEQ ID NO: 3033176 - protein, 8 aa, Entamoeba invadens
HGTDPKFA

SEQ ID NO: 3033177 - protein, 18 aa, Entamoeba invadens
HGTDPKFADPISKNGFKV

SEQ ID NO: 3033178 - protein, 9 aa, Entamoeba invadens
HGTDSNFAN

SEQ ID NO: 3033179 - protein, 11 aa, Entamoeba invadens
HGTSSGTQIEA

SEQ ID NO: 3033180 - protein, 11 aa, Entamoeba invadens
HHGSDHSNNEN

SEQ ID NO: 3033181 - protein, 11 aa, Entamoeba invadens
HHGSEHSNNEE

SEQ ID NO: 3033182 - protein, 11 aa, Entamoeba invadens
HHGSEHSNNKD

SEQ ID NO: 3033183 - protein, 8 aa, Entamoeba invadens
HIPNDNTT

SEQ ID NO: 3033184 - protein, 6 aa, Entamoeba invadens
HISPDN

SEQ ID NO: 3033185 - protein, 4 aa, Entamoeba invadens
HKDK

SEQ ID NO: 3033186 - protein, 5 aa, Entamoeba invadens
HKDKT

SEQ ID NO: 3033187 - protein, 6 aa, Entamoeba invadens
HKDSNW

SEQ ID NO: 3033188 - protein, 10 aa, Entamoeba invadens
HKEEPNLGEN

SEQ ID NO: 3033189 - protein, 8 aa, Entamoeba invadens
HKEVETTI

SEQ ID NO: 3033190 - protein, 5 aa, Entamoeba invadens
HKGKG

SEQ ID NO: 3033191 - protein, 5 aa, Entamoeba invadens
HKKLQ

SEQ ID NO: 3033192 - protein, 5 aa, Entamoeba invadens
HKNEQ

SEQ ID NO: 3033193 - protein, 24 aa, Entamoeba invadens
HKNKESKPNKENKAQQKKKETKSV

SEQ ID NO: 3033194 - protein, 18 aa, Entamoeba invadens
HKQKNRREYKRNRKGEVK

SEQ ID NO: 3033195 - protein, 26 aa, Entamoeba invadens
HKSGSVAASPSGKYPTGGNDPVSYPG

SEQ ID NO: 3033196 - protein, 47 aa, Entamoeba invadens
HKSRAEKPYVKKDNKSSNTTNVATKSTTKKPKKELTQKTKQEENVAK

SEQ ID NO: 3033197 - protein, 8 aa, Entamoeba invadens
HKTPSSAD

SEQ ID NO: 3033198 - protein, 7 aa, Entamoeba invadens
HKTSEDI

SEQ ID NO: 3033199 - protein, 5 aa, Entamoeba invadens
HKTSH

SEQ ID NO: 3033200 - protein, 51 aa, Entamoeba invadens
HKVATKKSDLEYKGFEQKGENQESRTQNPVQQRETKGTTRQVVNEQEEPSL

SEQ ID NO: 3033201 - protein, 9 aa, Entamoeba invadens
HKVSDAARK

SEQ ID NO: 3033202 - protein, 8 aa, Entamoeba invadens
HNDPETST

SEQ ID NO: 3033203 - protein, 4 aa, Entamoeba invadens
HNET

SEQ ID NO: 3033204 - protein, 10 aa, Entamoeba invadens
HNETEGLNKT

SEQ ID NO: 3033205 - protein, 4 aa, Entamoeba invadens
HNIT

SEQ ID NO: 3033206 - protein, 8 aa, Entamoeba invadens
HNKEEDSI

SEQ ID NO: 3033207 - protein, 7 aa, Entamoeba invadens
HNRPTEK

SEQ ID NO: 3033208 - protein, 9 aa, Entamoeba invadens
HNSTSIPTT

SEQ ID NO: 3033209 - protein, 6 aa, Entamoeba invadens
HNTPQT

SEQ ID NO: 3033210 - protein, 9 aa, Entamoeba invadens
HPAQSEMTP

SEQ ID NO: 3033211 - protein, 16 aa, Entamoeba invadens
HPDKPSGDKKKYEEIN

SEQ ID NO: 3033212 - protein, 10 aa, Entamoeba invadens
HPDKPTGDKV

SEQ ID NO: 3033213 - protein, 5 aa, Entamoeba invadens
HPEDK

SEQ ID NO: 3033214 - protein, 24 aa, Entamoeba invadens
HPHDDNSTAPFEGSMDSQVPAPFP

SEQ ID NO: 3033215 - protein, 25 aa, Entamoeba invadens
HPHDDNSTAPFEGSMDSRVPPPFPF

SEQ ID NO: 3033216 - protein, 11 aa, Entamoeba invadens
HPPAKYDTNPT

SEQ ID NO: 3033217 - protein, 12 aa, Entamoeba invadens
HPPKNHDNNPTQ

SEQ ID NO: 3033218 - protein, 6 aa, Entamoeba invadens
HPQNKT

SEQ ID NO: 3033219 - protein, 5 aa, Entamoeba invadens
HPTLQ

SEQ ID NO: 3033220 - protein, 11 aa, Entamoeba invadens
HPVAPRQAEDP

SEQ ID NO: 3033221 - protein, 16 aa, Entamoeba invadens
HQADQQNAQGHGKKKQ

SEQ ID NO: 3033222 - protein, 9 aa, Entamoeba invadens
HQDTGFTEK

SEQ ID NO: 3033223 - protein, 18 aa, Entamoeba invadens
HQEKKMKKAQLRAAKREM

SEQ ID NO: 3033224 - protein, 9 aa, Entamoeba invadens
HQNEENELT

SEQ ID NO: 3033225 - protein, 6 aa, Entamoeba invadens
HQPSPW

SEQ ID NO: 3033226 - protein, 12 aa, Entamoeba invadens
HRTLSRKGWYTY

SEQ ID NO: 3033227 - protein, 6 aa, Entamoeba invadens
HSAEIS

SEQ ID NO: 3033228 - protein, 8 aa, Entamoeba invadens
HSDNGDDF

SEQ ID NO: 3033229 - protein, 8 aa, Entamoeba invadens
HSDQPTIV

SEQ ID NO: 3033230 - protein, 9 aa, Entamoeba invadens
HSFGPYSSF

SEQ ID NO: 3033231 - protein, 7 aa, Entamoeba invadens
HSTNHDS

SEQ ID NO: 3033232 - protein, 4 aa, Entamoeba invadens
HSTT

SEQ ID NO: 3033233 - protein, 7 aa, Entamoeba invadens
HSVTKKQ

SEQ ID NO: 3033234 - protein, 5 aa, Entamoeba invadens
HTAKI

SEQ ID NO: 3033235 - protein, 7 aa, Entamoeba invadens
HTESNEE

SEQ ID NO: 3033236 - protein, 5 aa, Entamoeba invadens
HTGNW

SEQ ID NO: 3033237 - protein, 15 aa, Entamoeba invadens
HTKDEKVGNEEQRTD

SEQ ID NO: 3033238 - protein, 8 aa, Entamoeba invadens
HTNSPVSK

SEQ ID NO: 3033239 - protein, 5 aa, Entamoeba invadens
HTPKH

SEQ ID NO: 3033240 - protein, 11 aa, Entamoeba invadens
HTQNGNKFGRP

SEQ ID NO: 3033241 - protein, 4 aa, Entamoeba invadens
HTRF

SEQ ID NO: 3033242 - protein, 9 aa, Entamoeba invadens
HVNKTRETW

SEQ ID NO: 3033243 - protein, 7 aa, Entamoeba invadens
HYKKPAD

SEQ ID NO: 3033244 - protein, 6 aa, Entamoeba invadens
IAATNG

SEQ ID NO: 3033245 - protein, 9 aa, Entamoeba invadens
IADGYANNR

SEQ ID NO: 3033246 - protein, 18 aa, Entamoeba invadens
IAEEEAKEKAKKIRAESL

SEQ ID NO: 3033247 - protein, 4 aa, Entamoeba invadens
IAEG

SEQ ID NO: 3033248 - protein, 21 aa, Entamoeba invadens
IAENEKQIDENNKNASEESKR

SEQ ID NO: 3033249 - protein, 24 aa, Entamoeba invadens
IAENEKQIDEYQHNEQINNTKIDE

SEQ ID NO: 3033250 - protein, 10 aa, Entamoeba invadens
IAEQQKAQDV

SEQ ID NO: 3033251 - protein, 7 aa, Entamoeba invadens
IAEYNQQ

SEQ ID NO: 3033252 - protein, 6 aa, Entamoeba invadens
IAGSSS

SEQ ID NO: 3033253 - protein, 6 aa, Entamoeba invadens
IAGTVN

SEQ ID NO: 3033254 - protein, 6 aa, Entamoeba invadens
IAPEPI

SEQ ID NO: 3033255 - protein, 9 aa, Entamoeba invadens
IAPKPKPVV

SEQ ID NO: 3033256 - protein, 9 aa, Entamoeba invadens
IAQKGTDTD

SEQ ID NO: 3033257 - protein, 21 aa, Entamoeba invadens
IASKTTDYIGDKASKLSGNAL

SEQ ID NO: 3033258 - protein, 8 aa, Entamoeba invadens
IASPSSYC

SEQ ID NO: 3033259 - protein, 6 aa, Entamoeba invadens
IASTGY

SEQ ID NO: 3033260 - protein, 16 aa, Entamoeba invadens
IASTKTDLDTKKKRYV

SEQ ID NO: 3033261 - protein, 7 aa, Entamoeba invadens
IATDSTK

SEQ ID NO: 3033262 - protein, 9 aa, Entamoeba invadens
IAVEGKSIK

SEQ ID NO: 3033263 - protein, 5 aa, Entamoeba invadens
ICSNE

SEQ ID NO: 3033264 - protein, 12 aa, Entamoeba invadens
IDAANKKRDEGL

SEQ ID NO: 3033265 - protein, 8 aa, Entamoeba invadens
IDANEGSI

SEQ ID NO: 3033266 - protein, 27 aa, Entamoeba invadens
IDASKGSGALASKDARKIKKTAKDAQY

SEQ ID NO: 3033267 - protein, 7 aa, Entamoeba invadens
IDASSAK

SEQ ID NO: 3033268 - protein, 9 aa, Entamoeba invadens
IDASSPKFS

SEQ ID NO: 3033269 - protein, 10 aa, Entamoeba invadens
IDDDDRKGIT

SEQ ID NO: 3033270 - protein, 18 aa, Entamoeba invadens
IDDIDTDANYWANKYFAR

SEQ ID NO: 3033271 - protein, 6 aa, Entamoeba invadens
IDDNVE

SEQ ID NO: 3033272 - protein, 55 aa, Entamoeba invadens
IDERDGNMTTNEKFSETKWEKEAIKEEDVLSKNKNETKNHLKKPRGEVKEQYDDQ

SEQ ID NO: 3033273 - protein, 10 aa, Entamoeba invadens
IDKAKNAGKK

SEQ ID NO: 3033274 - protein, 6 aa, Entamoeba invadens
IDKTNQ

SEQ ID NO: 3033275 - protein, 4 aa, Entamoeba invadens
IDNG

SEQ ID NO: 3033276 - protein, 9 aa, Entamoeba invadens
IDPNQSIDN

SEQ ID NO: 3033277 - protein, 18 aa, Entamoeba invadens
IDPPSTRKCTEEFRPQNG

SEQ ID NO: 3033278 - protein, 6 aa, Entamoeba invadens
IDPTDI

SEQ ID NO: 3033279 - protein, 10 aa, Entamoeba invadens
IDPTNNNEIS

SEQ ID NO: 3033280 - protein, 11 aa, Entamoeba invadens
IDQKTYSSNDF

SEQ ID NO: 3033281 - protein, 13 aa, Entamoeba invadens
IDQPAPQETKTDC

SEQ ID NO: 3033282 - protein, 4 aa, Entamoeba invadens
IDRN

SEQ ID NO: 3033283 - protein, 12 aa, Entamoeba invadens
IDSDQDSVVAGQ

SEQ ID NO: 3033284 - protein, 6 aa, Entamoeba invadens
IDSENN

SEQ ID NO: 3033285 - protein, 8 aa, Entamoeba invadens
IDSNQNTG

SEQ ID NO: 3033286 - protein, 5 aa, Entamoeba invadens
IDSST

SEQ ID NO: 3033287 - protein, 10 aa, Entamoeba invadens
IDSYDGSVDA

SEQ ID NO: 3033288 - protein, 19 aa, Entamoeba invadens
IDTQKENNKKLESLTTEQI

SEQ ID NO: 3033289 - protein, 5 aa, Entamoeba invadens
IDTTP

SEQ ID NO: 3033290 - protein, 5 aa, Entamoeba invadens
IEDEE

SEQ ID NO: 3033291 - protein, 9 aa, Entamoeba invadens
IEDNAGDAY

SEQ ID NO: 3033292 - protein, 13 aa, Entamoeba invadens
IEDPKISKPSDWV

SEQ ID NO: 3033293 - protein, 4 aa, Entamoeba invadens
IEDS

SEQ ID NO: 3033294 - protein, 10 aa, Entamoeba invadens
IEEDGVDGGG

SEQ ID NO: 3033295 - protein, 13 aa, Entamoeba invadens
IEEIEKEKKEAHE

SEQ ID NO: 3033296 - protein, 12 aa, Entamoeba invadens
IEEMNGKAAKTI

SEQ ID NO: 3033297 - protein, 5 aa, Entamoeba invadens
IEESR

SEQ ID NO: 3033298 - protein, 6 aa, Entamoeba invadens
IEGAET

SEQ ID NO: 3033299 - protein, 7 aa, Entamoeba invadens
IEGDQQK

SEQ ID NO: 3033300 - protein, 12 aa, Entamoeba invadens
IEGEKRSTWAGN

SEQ ID NO: 3033301 - protein, 10 aa, Entamoeba invadens
IEGLPDECGG

SEQ ID NO: 3033302 - protein, 4 aa, Entamoeba invadens
IEGS

SEQ ID NO: 3033303 - protein, 16 aa, Entamoeba invadens
IEGSQVNEFQKQSADM

SEQ ID NO: 3033304 - protein, 4 aa, Entamoeba invadens
IEKI

SEQ ID NO: 3033305 - protein, 8 aa, Entamoeba invadens
IEKNDAEV

SEQ ID NO: 3033306 - protein, 6 aa, Entamoeba invadens
IEKQQR

SEQ ID NO: 3033307 - protein, 8 aa, Entamoeba invadens
IEKSDQAI

SEQ ID NO: 3033308 - protein, 4 aa, Entamoeba invadens
IEKT

SEQ ID NO: 3033309 - protein, 4 aa, Entamoeba invadens
IELK

SEQ ID NO: 3033310 - protein, 6 aa, Entamoeba invadens
IENEEG

SEQ ID NO: 3033311 - protein, 6 aa, Entamoeba invadens
IEPKTS

SEQ ID NO: 3033312 - protein, 6 aa, Entamoeba invadens
IEQQRK

SEQ ID NO: 3033313 - protein, 8 aa, Entamoeba invadens
IESDRTCS

SEQ ID NO: 3033314 - protein, 7 aa, Entamoeba invadens
IESEKSV

SEQ ID NO: 3033315 - protein, 11 aa, Entamoeba invadens
IESGKVEKTEF

SEQ ID NO: 3033316 - protein, 10 aa, Entamoeba invadens
IESKYSSSKV

SEQ ID NO: 3033317 - protein, 8 aa, Entamoeba invadens
IESPTAPM

SEQ ID NO: 3033318 - protein, 4 aa, Entamoeba invadens
IETC

SEQ ID NO: 3033319 - protein, 8 aa, Entamoeba invadens
IETEDKKC

SEQ ID NO: 3033320 - protein, 11 aa, Entamoeba invadens
IETGDGDGTIN

SEQ ID NO: 3033321 - protein, 8 aa, Entamoeba invadens
IFSTPKRS

SEQ ID NO: 3033322 - protein, 15 aa, Entamoeba invadens
IFTKTKTKTLMMSEN

SEQ ID NO: 3033323 - protein, 4 aa, Entamoeba invadens
IGAN

SEQ ID NO: 3033324 - protein, 4 aa, Entamoeba invadens
IGDN

SEQ ID NO: 3033325 - protein, 6 aa, Entamoeba invadens
IGEDDT

SEQ ID NO: 3033326 - protein, 5 aa, Entamoeba invadens
IGEKS

SEQ ID NO: 3033327 - protein, 4 aa, Entamoeba invadens
IGEN

SEQ ID NO: 3033328 - protein, 10 aa, Entamoeba invadens
IGESRSESED

SEQ ID NO: 3033329 - protein, 5 aa, Entamoeba invadens
IGFDE

SEQ ID NO: 3033330 - protein, 13 aa, Entamoeba invadens
IGGKEAGEASPPW

SEQ ID NO: 3033331 - protein, 5 aa, Entamoeba invadens
IGMTR

SEQ ID NO: 3033332 - protein, 23 aa, Entamoeba invadens
IGNSGNRSGETTRPVIIENSGVL

SEQ ID NO: 3033333 - protein, 7 aa, Entamoeba invadens
IGSPQTV

SEQ ID NO: 3033334 - protein, 5 aa, Entamoeba invadens
IGTDN

SEQ ID NO: 3033335 - protein, 11 aa, Entamoeba invadens
IKDLKKQEKRV

SEQ ID NO: 3033336 - protein, 11 aa, Entamoeba invadens
IKDSRGRTPTI

SEQ ID NO: 3033337 - protein, 8 aa, Entamoeba invadens
IKEEERQK

SEQ ID NO: 3033338 - protein, 9 aa, Entamoeba invadens
IKEEKEQLE

SEQ ID NO: 3033339 - protein, 9 aa, Entamoeba invadens
IKEKTGKKA

SEQ ID NO: 3033340 - protein, 8 aa, Entamoeba invadens
IKGKAEKL

SEQ ID NO: 3033341 - protein, 9 aa, Entamoeba invadens
IKGRKRVEI

SEQ ID NO: 3033342 - protein, 7 aa, Entamoeba invadens
IKGTSKV

SEQ ID NO: 3033343 - protein, 5 aa, Entamoeba invadens
IKHPY

SEQ ID NO: 3033344 - protein, 25 aa, Entamoeba invadens
IKKAEKKAEKKAKKQGLNKKQTKAL

SEQ ID NO: 3033345 - protein, 8 aa, Entamoeba invadens
IKKNEVKN

SEQ ID NO: 3033346 - protein, 8 aa, Entamoeba invadens
IKKNNRRL

SEQ ID NO: 3033347 - protein, 10 aa, Entamoeba invadens
IKKNSNVKQI

SEQ ID NO: 3033348 - protein, 8 aa, Entamoeba invadens
IKKYEGKL

SEQ ID NO: 3033349 - protein, 11 aa, Entamoeba invadens
IKLSPPKRVSR

SEQ ID NO: 3033350 - protein, 13 aa, Entamoeba invadens
IKNATSKLADNAI

SEQ ID NO: 3033351 - protein, 14 aa, Entamoeba invadens
IKNIEKEKKELLQK

SEQ ID NO: 3033352 - protein, 9 aa, Entamoeba invadens
IKNPTGNTK

SEQ ID NO: 3033353 - protein, 26 aa, Entamoeba invadens
IKNTKKAAKDTKKATTPAAAKCVKPK

SEQ ID NO: 3033354 - protein, 9 aa, Entamoeba invadens
IKPSIGVAE

SEQ ID NO: 3033355 - protein, 4 aa, Entamoeba invadens
IKRT

SEQ ID NO: 3033356 - protein, 7 aa, Entamoeba invadens
IKSDNTL

SEQ ID NO: 3033357 - protein, 14 aa, Entamoeba invadens
IKSNEEQKKNNAIQ

SEQ ID NO: 3033358 - protein, 7 aa, Entamoeba invadens
IKSNNYG

SEQ ID NO: 3033359 - protein, 14 aa, Entamoeba invadens
IKSPSSLCSSLYKT

SEQ ID NO: 3033360 - protein, 11 aa, Entamoeba invadens
IKSRKYDKNRD

SEQ ID NO: 3033361 - protein, 9 aa, Entamoeba invadens
IKSTHGKKV

SEQ ID NO: 3033362 - protein, 9 aa, Entamoeba invadens
IKTATKEHV

SEQ ID NO: 3033363 - protein, 8 aa, Entamoeba invadens
IKTNETND

SEQ ID NO: 3033364 - protein, 11 aa, Entamoeba invadens
IKTSETKLTED

SEQ ID NO: 3033365 - protein, 8 aa, Entamoeba invadens
ILEQRQNQ

SEQ ID NO: 3033366 - protein, 19 aa, Entamoeba invadens
ILGTQPDFHKPKEDTNNTL

SEQ ID NO: 3033367 - protein, 33 aa, Entamoeba invadens
ILKNTKDSINKNAQKAAEKFRNTIKDQTDNMME

SEQ ID NO: 3033368 - protein, 7 aa, Entamoeba invadens
ILNGPTE

SEQ ID NO: 3033369 - protein, 9 aa, Entamoeba invadens
IMTTNPDKI

SEQ ID NO: 3033370 - protein, 9 aa, Entamoeba invadens
INEGSTSLT

SEQ ID NO: 3033371 - protein, 17 aa, Entamoeba invadens
INENRNSIKEIQGETAQ

SEQ ID NO: 3033372 - protein, 16 aa, Entamoeba invadens
INEQISTAGYEASGTS

SEQ ID NO: 3033373 - protein, 10 aa, Entamoeba invadens
INGATENGVV

SEQ ID NO: 3033374 - protein, 12 aa, Entamoeba invadens
INKANGGKVGYT

SEQ ID NO: 3033375 - protein, 4 aa, Entamoeba invadens
INKN

SEQ ID NO: 3033376 - protein, 12 aa, Entamoeba invadens
INNVSSKKVKGA

SEQ ID NO: 3033377 - protein, 31 aa, Entamoeba invadens
INPQQAKEEQLEQQKEEQMAKQALHGKQNEE

SEQ ID NO: 3033378 - protein, 9 aa, Entamoeba invadens
INPSQKDDI

SEQ ID NO: 3033379 - protein, 18 aa, Entamoeba invadens
INQESGCTKCNQGYYPSN

SEQ ID NO: 3033380 - protein, 14 aa, Entamoeba invadens
INRNVDAEEGGAFG

SEQ ID NO: 3033381 - protein, 5 aa, Entamoeba invadens
INSDM

SEQ ID NO: 3033382 - protein, 7 aa, Entamoeba invadens
INSDNKK

SEQ ID NO: 3033383 - protein, 4 aa, Entamoeba invadens
INSS

SEQ ID NO: 3033384 - protein, 16 aa, Entamoeba invadens
INTATGVDLGQEDLKE

SEQ ID NO: 3033385 - protein, 6 aa, Entamoeba invadens
INTTFT

SEQ ID NO: 3033386 - protein, 8 aa, Entamoeba invadens
IPCPTSSD

SEQ ID NO: 3033387 - protein, 8 aa, Entamoeba invadens
IPDKDNSI

SEQ ID NO: 3033388 - protein, 5 aa, Entamoeba invadens
IPDRQ

SEQ ID NO: 3033389 - protein, 5 aa, Entamoeba invadens
IPDTV

SEQ ID NO: 3033390 - protein, 4 aa, Entamoeba invadens
IPDY

SEQ ID NO: 3033391 - protein, 5 aa, Entamoeba invadens
IPDYK

SEQ ID NO: 3033392 - protein, 39 aa, Entamoeba invadens
IPEKKNTFPIEPEDTNKTEIEEEEPVREDENAPTPEEHE

SEQ ID NO: 3033393 - protein, 5 aa, Entamoeba invadens
IPGKA

SEQ ID NO: 3033394 - protein, 4 aa, Entamoeba invadens
IPGW

SEQ ID NO: 3033395 - protein, 9 aa, Entamoeba invadens
IPKGANAVV

SEQ ID NO: 3033396 - protein, 10 aa, Entamoeba invadens
IPKTKDRAKE

SEQ ID NO: 3033397 - protein, 5 aa, Entamoeba invadens
IPNGT

SEQ ID NO: 3033398 - protein, 6 aa, Entamoeba invadens
IPNPSH

SEQ ID NO: 3033399 - protein, 9 aa, Entamoeba invadens
IPNSTPQKQ

SEQ ID NO: 3033400 - protein, 5 aa, Entamoeba invadens
IPNTN

SEQ ID NO: 3033401 - protein, 4 aa, Entamoeba invadens
IPPE

SEQ ID NO: 3033402 - protein, 17 aa, Entamoeba invadens
IPPPTTMAPNAMSPQRP

SEQ ID NO: 3033403 - protein, 9 aa, Entamoeba invadens
IPPQQTPPV

SEQ ID NO: 3033404 - protein, 13 aa, Entamoeba invadens
IPSDTGDCTECNY

SEQ ID NO: 3033405 - protein, 10 aa, Entamoeba invadens
IPSGSTNTTV

SEQ ID NO: 3033406 - protein, 4 aa, Entamoeba invadens
IPSI

SEQ ID NO: 3033407 - protein, 18 aa, Entamoeba invadens
IPSKSKKAKRIEKAPKID

SEQ ID NO: 3033408 - protein, 6 aa, Entamoeba invadens
IPSNNT

SEQ ID NO: 3033409 - protein, 10 aa, Entamoeba invadens
IPSPKEEKKY

SEQ ID NO: 3033410 - protein, 36 aa, Entamoeba invadens
IPSQELKKEKDETKETEETEEKTQELLPEKDPSTYK

SEQ ID NO: 3033411 - protein, 6 aa, Entamoeba invadens
IPTEKA

SEQ ID NO: 3033412 - protein, 7 aa, Entamoeba invadens
IPTVPPR

SEQ ID NO: 3033413 - protein, 13 aa, Entamoeba invadens
IPTVSKSANENFE

SEQ ID NO: 3033414 - protein, 6 aa, Entamoeba invadens
IPVESE

SEQ ID NO: 3033415 - protein, 12 aa, Entamoeba invadens
IQIKRKRDEGIK

SEQ ID NO: 3033416 - protein, 10 aa, Entamoeba invadens
IQKETAKFTD

SEQ ID NO: 3033417 - protein, 6 aa, Entamoeba invadens
IQKPNN

SEQ ID NO: 3033418 - protein, 11 aa, Entamoeba invadens
IQKTQDGADIG

SEQ ID NO: 3033419 - protein, 7 aa, Entamoeba invadens
IQNEKKR

SEQ ID NO: 3033420 - protein, 5 aa, Entamoeba invadens
IQNSS

SEQ ID NO: 3033421 - protein, 6 aa, Entamoeba invadens
IQNTQS

SEQ ID NO: 3033422 - protein, 15 aa, Entamoeba invadens
IQNTTNTTEYTEPFD

SEQ ID NO: 3033423 - protein, 7 aa, Entamoeba invadens
IQQQTNK

SEQ ID NO: 3033424 - protein, 22 aa, Entamoeba invadens
IQSNRKLASACSNQITPPDVGA

SEQ ID NO: 3033425 - protein, 4 aa, Entamoeba invadens
IQSV

SEQ ID NO: 3033426 - protein, 10 aa, Entamoeba invadens
IQTDTPLTSS

SEQ ID NO: 3033427 - protein, 6 aa, Entamoeba invadens
IQTPQE

SEQ ID NO: 3033428 - protein, 5 aa, Entamoeba invadens
IQTPT

SEQ ID NO: 3033429 - protein, 7 aa, Entamoeba invadens
IQYTGSD

SEQ ID NO: 3033430 - protein, 7 aa, Entamoeba invadens
IRENTVE

SEQ ID NO: 3033431 - protein, 12 aa, Entamoeba invadens
IREPNNNYRSGQ

SEQ ID NO: 3033432 - protein, 14 aa, Entamoeba invadens
IRGDDELKIDGYPR

SEQ ID NO: 3033433 - protein, 8 aa, Entamoeba invadens
IRGSASIG

SEQ ID NO: 3033434 - protein, 8 aa, Entamoeba invadens
IRGSASVG

SEQ ID NO: 3033435 - protein, 12 aa, Entamoeba invadens
IRKETRKAKEKV

SEQ ID NO: 3033436 - protein, 5 aa, Entamoeba invadens
IRKNT

SEQ ID NO: 3033437 - protein, 10 aa, Entamoeba invadens
IRKPGRKLRE

SEQ ID NO: 3033438 - protein, 12 aa, Entamoeba invadens
IRKQAENAEYGA

SEQ ID NO: 3033439 - protein, 4 aa, Entamoeba invadens
IRPR

SEQ ID NO: 3033440 - protein, 5 aa, Entamoeba invadens
IRPRL

SEQ ID NO: 3033441 - protein, 12 aa, Entamoeba invadens
IRSGQRETTPIP

SEQ ID NO: 3033442 - protein, 10 aa, Entamoeba invadens
IRSPNPLEGL

SEQ ID NO: 3033443 - protein, 16 aa, Entamoeba invadens
IRSQNENLRKVRQTRR

SEQ ID NO: 3033444 - protein, 6 aa, Entamoeba invadens
IRSSKN

SEQ ID NO: 3033445 - protein, 5 aa, Entamoeba invadens
IRTDN

SEQ ID NO: 3033446 - protein, 7 aa, Entamoeba invadens
IRTGDGL

SEQ ID NO: 3033447 - protein, 5 aa, Entamoeba invadens
ISAAH

SEQ ID NO: 3033448 - protein, 14 aa, Entamoeba invadens
ISAGSMKKNCEERL

SEQ ID NO: 3033449 - protein, 5 aa, Entamoeba invadens
ISDGS

SEQ ID NO: 3033450 - protein, 10 aa, Entamoeba invadens
ISDNSNCHRE

SEQ ID NO: 3033451 - protein, 5 aa, Entamoeba invadens
ISDTT

SEQ ID NO: 3033452 - protein, 6 aa, Entamoeba invadens
ISEEDK

SEQ ID NO: 3033453 - protein, 4 aa, Entamoeba invadens
ISEQ

SEQ ID NO: 3033454 - protein, 5 aa, Entamoeba invadens
ISGES

SEQ ID NO: 3033455 - protein, 10 aa, Entamoeba invadens
ISGKLPSSLF

SEQ ID NO: 3033456 - protein, 7 aa, Entamoeba invadens
ISGMGPK

SEQ ID NO: 3033457 - protein, 4 aa, Entamoeba invadens
ISGS

SEQ ID NO: 3033458 - protein, 6 aa, Entamoeba invadens
ISKGMG

SEQ ID NO: 3033459 - protein, 5 aa, Entamoeba invadens
ISKRE

SEQ ID NO: 3033460 - protein, 4 aa, Entamoeba invadens
ISKT

SEQ ID NO: 3033461 - protein, 11 aa, Entamoeba invadens
ISKTPSAFSPA

SEQ ID NO: 3033462 - protein, 12 aa, Entamoeba invadens
ISKTPSAFSPAD

SEQ ID NO: 3033463 - protein, 6 aa, Entamoeba invadens
ISKYSD

SEQ ID NO: 3033464 - protein, 9 aa, Entamoeba invadens
ISMKGKGPF

SEQ ID NO: 3033465 - protein, 26 aa, Entamoeba invadens
ISNNNDNKKTSNKNKNKTVEQKTDNI

SEQ ID NO: 3033466 - protein, 7 aa, Entamoeba invadens
ISNNSKT

SEQ ID NO: 3033467 - protein, 7 aa, Entamoeba invadens
ISNNSLP

SEQ ID NO: 3033468 - protein, 8 aa, Entamoeba invadens
ISNQGGNF

SEQ ID NO: 3033469 - protein, 7 aa, Entamoeba invadens
ISNSTME

SEQ ID NO: 3033470 - protein, 6 aa, Entamoeba invadens
ISPDGY

SEQ ID NO: 3033471 - protein, 11 aa, Entamoeba invadens
ISPIPKDNTDL

SEQ ID NO: 3033472 - protein, 7 aa, Entamoeba invadens
ISPPQTE

SEQ ID NO: 3033473 - protein, 9 aa, Entamoeba invadens
ISPSTTPIE

SEQ ID NO: 3033474 - protein, 5 aa, Entamoeba invadens
ISPTA

SEQ ID NO: 3033475 - protein, 5 aa, Entamoeba invadens
ISQDN

SEQ ID NO: 3033476 - protein, 13 aa, Entamoeba invadens
ISRAETSDKPLNY

SEQ ID NO: 3033477 - protein, 9 aa, Entamoeba invadens
ISSPQYETQ

SEQ ID NO: 3033478 - protein, 11 aa, Entamoeba invadens
ISSSSYLGETY

SEQ ID NO: 3033479 - protein, 7 aa, Entamoeba invadens
ISSTKVS

SEQ ID NO: 3033480 - protein, 5 aa, Entamoeba invadens
ISTGT

SEQ ID NO: 3033481 - protein, 25 aa, Entamoeba invadens
ISTGTTCTSCDTGSVKTSQTTCKKM

SEQ ID NO: 3033482 - protein, 5 aa, Entamoeba invadens
ISTVT

SEQ ID NO: 3033483 - protein, 10 aa, Entamoeba invadens
ISYETISNNL

SEQ ID NO: 3033484 - protein, 26 aa, Entamoeba invadens
ITANPQPNDDQETSNQIESHDQDTSP

SEQ ID NO: 3033485 - protein, 13 aa, Entamoeba invadens
ITAPGGYASIGSY

SEQ ID NO: 3033486 - protein, 10 aa, Entamoeba invadens
ITDEEKKTTM

SEQ ID NO: 3033487 - protein, 5 aa, Entamoeba invadens
ITDSG

SEQ ID NO: 3033488 - protein, 31 aa, Entamoeba invadens
ITEAKKLEDKLSKAQDVKGVEEQIDKKRQEL

SEQ ID NO: 3033489 - protein, 18 aa, Entamoeba invadens
ITEDNGNCQIKVGVPSEC

SEQ ID NO: 3033490 - protein, 6 aa, Entamoeba invadens
ITEEEL

SEQ ID NO: 3033491 - protein, 10 aa, Entamoeba invadens
ITEKGKYLSP

SEQ ID NO: 3033492 - protein, 12 aa, Entamoeba invadens
ITENKENIPGSN

SEQ ID NO: 3033493 - protein, 11 aa, Entamoeba invadens
ITEPNDNLRSG

SEQ ID NO: 3033494 - protein, 5 aa, Entamoeba invadens
ITESD

SEQ ID NO: 3033495 - protein, 23 aa, Entamoeba invadens
ITETSKEESKEKSEHNSETLQCK

SEQ ID NO: 3033496 - protein, 7 aa, Entamoeba invadens
ITEYSEN

SEQ ID NO: 3033497 - protein, 12 aa, Entamoeba invadens
ITFTPNNDSTVR

SEQ ID NO: 3033498 - protein, 18 aa, Entamoeba invadens
ITGETTRAPERPAPKTDL

SEQ ID NO: 3033499 - protein, 6 aa, Entamoeba invadens
ITGRPD

SEQ ID NO: 3033500 - protein, 8 aa, Entamoeba invadens
ITHSNDDL

SEQ ID NO: 3033501 - protein, 10 aa, Entamoeba invadens
ITKDDNKDTN

SEQ ID NO: 3033502 - protein, 4 aa, Entamoeba invadens
ITKE

SEQ ID NO: 3033503 - protein, 12 aa, Entamoeba invadens
ITKEIKTNSQIT

SEQ ID NO: 3033504 - protein, 5 aa, Entamoeba invadens
ITKPK

SEQ ID NO: 3033505 - protein, 7 aa, Entamoeba invadens
ITKSKKL

SEQ ID NO: 3033506 - protein, 5 aa, Entamoeba invadens
ITKVD

SEQ ID NO: 3033507 - protein, 57 aa, Entamoeba invadens
ITLKPQKGGAGKSFASPKSKLKIAAPKKATLTKPKNTQKPKTKPIAKKSAPKPKAKI

SEQ ID NO: 3033508 - protein, 12 aa, Entamoeba invadens
ITNDSYPQGTNT

SEQ ID NO: 3033509 - protein, 10 aa, Entamoeba invadens
ITNEGDSDIE

SEQ ID NO: 3033510 - protein, 7 aa, Entamoeba invadens
ITNKTAN

SEQ ID NO: 3033511 - protein, 4 aa, Entamoeba invadens
ITNS

SEQ ID NO: 3033512 - protein, 9 aa, Entamoeba invadens
ITNSGSSTV

SEQ ID NO: 3033513 - protein, 17 aa, Entamoeba invadens
ITNVESSQQSKQRNLEV

SEQ ID NO: 3033514 - protein, 10 aa, Entamoeba invadens
ITPGSTTTLS

SEQ ID NO: 3033515 - protein, 7 aa, Entamoeba invadens
ITPSQEK

SEQ ID NO: 3033516 - protein, 9 aa, Entamoeba invadens
ITQAGGPNT

SEQ ID NO: 3033517 - protein, 4 aa, Entamoeba invadens
ITQT

SEQ ID NO: 3033518 - protein, 7 aa, Entamoeba invadens
ITRHESD

SEQ ID NO: 3033519 - protein, 4 aa, Entamoeba invadens
ITRQ

SEQ ID NO: 3033520 - protein, 6 aa, Entamoeba invadens
ITRQKE

SEQ ID NO: 3033521 - protein, 20 aa, Entamoeba invadens
ITRQQEVSAFGNDGVGDGGD

SEQ ID NO: 3033522 - protein, 6 aa, Entamoeba invadens
ITRQST

SEQ ID NO: 3033523 - protein, 4 aa, Entamoeba invadens
ITRT

SEQ ID NO: 3033524 - protein, 13 aa, Entamoeba invadens
ITSCPNGADMDGL

SEQ ID NO: 3033525 - protein, 6 aa, Entamoeba invadens
ITSDDV

SEQ ID NO: 3033526 - protein, 10 aa, Entamoeba invadens
ITSKNTRSFD

SEQ ID NO: 3033527 - protein, 5 aa, Entamoeba invadens
ITTEN

SEQ ID NO: 3033528 - protein, 16 aa, Entamoeba invadens
ITTKDNCDKYSIRTEP

SEQ ID NO: 3033529 - protein, 14 aa, Entamoeba invadens
ITTKGGCKKCEEME

SEQ ID NO: 3033530 - protein, 9 aa, Entamoeba invadens
ITTPDPEDF

SEQ ID NO: 3033531 - protein, 5 aa, Entamoeba invadens
ITTTK

SEQ ID NO: 3033532 - protein, 12 aa, Entamoeba invadens
IVESEEDSGKLV

SEQ ID NO: 3033533 - protein, 9 aa, Entamoeba invadens
IVKQPSGEY

SEQ ID NO: 3033534 - protein, 11 aa, Entamoeba invadens
IVQEKDYPYTA

SEQ ID NO: 3033535 - protein, 23 aa, Entamoeba invadens
IVQNETNKVEKKAKEDNTKNLEH

SEQ ID NO: 3033536 - protein, 5 aa, Entamoeba invadens
IYDEP

SEQ ID NO: 3033537 - protein, 7 aa, Entamoeba invadens
IYDGNEK

SEQ ID NO: 3033538 - protein, 5 aa, Entamoeba invadens
IYNDT

SEQ ID NO: 3033539 - protein, 12 aa, Entamoeba invadens
IYNPDDVTQSKY

SEQ ID NO: 3033540 - protein, 17 aa, Entamoeba invadens
IYPPQEVPRLTNGTADH

SEQ ID NO: 3033541 - protein, 37 aa, Entamoeba invadens
KAAKAQYKKMKKDLKKNVAPKAKVTKRSSSSKQQVKL

SEQ ID NO: 3033542 - protein, 8 aa, Entamoeba invadens
KAAKHAYN

SEQ ID NO: 3033543 - protein, 100 aa, Entamoeba invadens
KAAKKAQKKQSKKLAQKKKVVKKSSPKKSVQKQNLKKQKAVLKQKQKKLEKLQKKQQKATGKEKKAIQKKIEKKQKQIKQTKKQVKQTKKQLKQTKKQHK

SEQ ID NO: 3033544 - protein, 5 aa, Entamoeba invadens
KAALN

SEQ ID NO: 3033545 - protein, 10 aa, Entamoeba invadens
KADPNCDEYK

SEQ ID NO: 3033546 - protein, 10 aa, Entamoeba invadens
KAEAECSATA

SEQ ID NO: 3033547 - protein, 51 aa, Entamoeba invadens
KAENETKTLENTTKEKIKNLNAKNNAPNATSTEKRQNRNKKRTLSRKLKEA

SEQ ID NO: 3033548 - protein, 7 aa, Entamoeba invadens
KAESEIG

SEQ ID NO: 3033549 - protein, 4 aa, Entamoeba invadens
KAET

SEQ ID NO: 3033550 - protein, 7 aa, Entamoeba invadens
KAETELL

SEQ ID NO: 3033551 - protein, 6 aa, Entamoeba invadens
KAETKQ

SEQ ID NO: 3033552 - protein, 8 aa, Entamoeba invadens
KAFSETQL

SEQ ID NO: 3033553 - protein, 9 aa, Entamoeba invadens
KAFSGNKPQ

SEQ ID NO: 3033554 - protein, 5 aa, Entamoeba invadens
KAFTT

SEQ ID NO: 3033555 - protein, 7 aa, Entamoeba invadens
KAHPEAV

SEQ ID NO: 3033556 - protein, 14 aa, Entamoeba invadens
KAHQKRLEASDLSD

SEQ ID NO: 3033557 - protein, 17 aa, Entamoeba invadens
KAIKEANEMQKDANKKI

SEQ ID NO: 3033558 - protein, 10 aa, Entamoeba invadens
KAIKKANEPI

SEQ ID NO: 3033559 - protein, 18 aa, Entamoeba invadens
KAIRGDKRQYTESAGRDG

SEQ ID NO: 3033560 - protein, 55 aa, Entamoeba invadens
KAKAKKDAKKLAKVQKKAEKKIAKAQKTKTKKEVKKAIKPAEKKTETPMKKADKK

SEQ ID NO: 3033561 - protein, 7 aa, Entamoeba invadens
KAKANKM

SEQ ID NO: 3033562 - protein, 7 aa, Entamoeba invadens
KAKDMAK

SEQ ID NO: 3033563 - protein, 16 aa, Entamoeba invadens
KAKDSSKKGKKPIPVK

SEQ ID NO: 3033564 - protein, 8 aa, Entamoeba invadens
KAKEHNLS

SEQ ID NO: 3033565 - protein, 12 aa, Entamoeba invadens
KAKENEIREGAS

SEQ ID NO: 3033566 - protein, 7 aa, Entamoeba invadens
KAKGEKT

SEQ ID NO: 3033567 - protein, 5 aa, Entamoeba invadens
KAKPF

SEQ ID NO: 3033568 - protein, 5 aa, Entamoeba invadens
KAKQK

SEQ ID NO: 3033569 - protein, 7 aa, Entamoeba invadens
KAKSSIH

SEQ ID NO: 3033570 - protein, 14 aa, Entamoeba invadens
KAKTKVNNKINEAY

SEQ ID NO: 3033571 - protein, 7 aa, Entamoeba invadens
KAKTSTH

SEQ ID NO: 3033572 - protein, 9 aa, Entamoeba invadens
KAKYPNRIP

SEQ ID NO: 3033573 - protein, 62 aa, Entamoeba invadens
KALDTKKTAKQQTKKLQKIDKKVANAKKTADKTIKKTAEKKKQLKKQVKKDMKKEKKLLAKE

SEQ ID NO: 3033574 - protein, 14 aa, Entamoeba invadens
KALESGSRKKTKEL

SEQ ID NO: 3033575 - protein, 13 aa, Entamoeba invadens
KALKDPKKALNAL

SEQ ID NO: 3033576 - protein, 6 aa, Entamoeba invadens
KALQES

SEQ ID NO: 3033577 - protein, 16 aa, Entamoeba invadens
KANEIDDKDFAFKEII

SEQ ID NO: 3033578 - protein, 10 aa, Entamoeba invadens
KANGLSESDI

SEQ ID NO: 3033579 - protein, 6 aa, Entamoeba invadens
KANGSI

SEQ ID NO: 3033580 - protein, 9 aa, Entamoeba invadens
KAPGEEDPY

SEQ ID NO: 3033581 - protein, 14 aa, Entamoeba invadens
KAPINNAGFGGGDV

SEQ ID NO: 3033582 - protein, 6 aa, Entamoeba invadens
KAPITK

SEQ ID NO: 3033583 - protein, 7 aa, Entamoeba invadens
KAPRGIP

SEQ ID NO: 3033584 - protein, 14 aa, Entamoeba invadens
KAQATIKTKAADLA

SEQ ID NO: 3033585 - protein, 8 aa, Entamoeba invadens
KAQKKLKA

SEQ ID NO: 3033586 - protein, 9 aa, Entamoeba invadens
KAQREEKQI

SEQ ID NO: 3033587 - protein, 8 aa, Entamoeba invadens
KARKGSKR

SEQ ID NO: 3033588 - protein, 25 aa, Entamoeba invadens
KASAEDSRWQTPPRGSEDWKEGYQG

SEQ ID NO: 3033589 - protein, 13 aa, Entamoeba invadens
KASAKDNTNVTES

SEQ ID NO: 3033590 - protein, 21 aa, Entamoeba invadens
KASDEIEKMRQTEQVLENERK

SEQ ID NO: 3033591 - protein, 9 aa, Entamoeba invadens
KASNTPCNS

SEQ ID NO: 3033592 - protein, 6 aa, Entamoeba invadens
KASYEG

SEQ ID NO: 3033593 - protein, 9 aa, Entamoeba invadens
KATEKMKGG

SEQ ID NO: 3033594 - protein, 5 aa, Entamoeba invadens
KATFK

SEQ ID NO: 3033595 - protein, 14 aa, Entamoeba invadens
KATKLEKKNVGEIK

SEQ ID NO: 3033596 - protein, 7 aa, Entamoeba invadens
KATTFEN

SEQ ID NO: 3033597 - protein, 4 aa, Entamoeba invadens
KAVG

SEQ ID NO: 3033598 - protein, 16 aa, Entamoeba invadens
KAVKKGDKDKQTEYKA

SEQ ID NO: 3033599 - protein, 7 aa, Entamoeba invadens
KAYGAKP

SEQ ID NO: 3033600 - protein, 7 aa, Entamoeba invadens
KAYGGKP

SEQ ID NO: 3033601 - protein, 6 aa, Entamoeba invadens
KAYPDL

SEQ ID NO: 3033602 - protein, 25 aa, Entamoeba invadens
KAYQTTGGSFADKMKAGAKEGGKKL

SEQ ID NO: 3033603 - protein, 5 aa, Entamoeba invadens
KAYTT

SEQ ID NO: 3033604 - protein, 15 aa, Entamoeba invadens
KAYTVTPLPTNTDGI

SEQ ID NO: 3033605 - protein, 13 aa, Entamoeba invadens
KCAGATTKPYTSS

SEQ ID NO: 3033606 - protein, 7 aa, Entamoeba invadens
KCDESGK

SEQ ID NO: 3033607 - protein, 5 aa, Entamoeba invadens
KCDET

SEQ ID NO: 3033608 - protein, 18 aa, Entamoeba invadens
KCDGQTCSLPKGTHKTKE

SEQ ID NO: 3033609 - protein, 5 aa, Entamoeba invadens
KCEAE

SEQ ID NO: 3033610 - protein, 5 aa, Entamoeba invadens
KCECN

SEQ ID NO: 3033611 - protein, 8 aa, Entamoeba invadens
KCEDSTCS

SEQ ID NO: 3033612 - protein, 4 aa, Entamoeba invadens
KCEK

SEQ ID NO: 3033613 - protein, 7 aa, Entamoeba invadens
KCEKDDK

SEQ ID NO: 3033614 - protein, 6 aa, Entamoeba invadens
KCEKIP

SEQ ID NO: 3033615 - protein, 5 aa, Entamoeba invadens
KCENE

SEQ ID NO: 3033616 - protein, 12 aa, Entamoeba invadens
KCESCDNSKNTF

SEQ ID NO: 3033617 - protein, 8 aa, Entamoeba invadens
KCESCSTR

SEQ ID NO: 3033618 - protein, 6 aa, Entamoeba invadens
KCESDE

SEQ ID NO: 3033619 - protein, 16 aa, Entamoeba invadens
KCETPDSVEPKSEQKY

SEQ ID NO: 3033620 - protein, 9 aa, Entamoeba invadens
KCGLNERQK

SEQ ID NO: 3033621 - protein, 48 aa, Entamoeba invadens
  misc_feature (15)..(16): Xaa can be any naturally occurring amino acid
KCGNGLLDDGEEGVXXSNKSDSLKEKNELSSSVLQESSEVSKESREPI

SEQ ID NO: 3033622 - protein, 7 aa, Entamoeba invadens
KCGSQPV

SEQ ID NO: 3033623 - protein, 5 aa, Entamoeba invadens
KCHPA

SEQ ID NO: 3033624 - protein, 14 aa, Entamoeba invadens
KCITGNPGYELDSN

SEQ ID NO: 3033625 - protein, 9 aa, Entamoeba invadens
KCKEDKTTC

SEQ ID NO: 3033626 - protein, 29 aa, Entamoeba invadens
KCKSATECTECTTDNLQPDKTCKKNCPEA

SEQ ID NO: 3033627 - protein, 8 aa, Entamoeba invadens
KCNGDNVD

SEQ ID NO: 3033628 - protein, 8 aa, Entamoeba invadens
KCNKCTNG

SEQ ID NO: 3033629 - protein, 9 aa, Entamoeba invadens
KCPDDSSRY

SEQ ID NO: 3033630 - protein, 9 aa, Entamoeba invadens
KCPEERRKM

SEQ ID NO: 3033631 - protein, 14 aa, Entamoeba invadens
KCPEGYMTDKTKKK

SEQ ID NO: 3033632 - protein, 6 aa, Entamoeba invadens
KCPQNE

SEQ ID NO: 3033633 - protein, 12 aa, Entamoeba invadens
KCQNDLNEMAEK

SEQ ID NO: 3033634 - protein, 18 aa, Entamoeba invadens
KCSDDNCNECDDDTNTCQ

SEQ ID NO: 3033635 - protein, 30 aa, Entamoeba invadens
KCSDHTSTCNGGGDGDDNSNGNNPSKDEGE

SEQ ID NO: 3033636 - protein, 7 aa, Entamoeba invadens
KCSDPVN

SEQ ID NO: 3033637 - protein, 14 aa, Entamoeba invadens
KCSEESKTTCEGRD

SEQ ID NO: 3033638 - protein, 4 aa, Entamoeba invadens
KCSH

SEQ ID NO: 3033639 - protein, 29 aa, Entamoeba invadens
KCSKDDTCDKCSMGSSYMEGTTNKCDTNR

SEQ ID NO: 3033640 - protein, 6 aa, Entamoeba invadens
KCSSIE

SEQ ID NO: 3033641 - protein, 6 aa, Entamoeba invadens
KCSTRK

SEQ ID NO: 3033642 - protein, 7 aa, Entamoeba invadens
KCSTRTK

SEQ ID NO: 3033643 - protein, 4 aa, Entamoeba invadens
KCSY

SEQ ID NO: 3033644 - protein, 5 aa, Entamoeba invadens
KCTAC

SEQ ID NO: 3033645 - protein, 5 aa, Entamoeba invadens
KCTEC

SEQ ID NO: 3033646 - protein, 29 aa, Entamoeba invadens
KCTGTNKLSADKSQCGTKCPNGQKTGTNN

SEQ ID NO: 3033647 - protein, 12 aa, Entamoeba invadens
KCTNGRKPDNGF

SEQ ID NO: 3033648 - protein, 6 aa, Entamoeba invadens
KCTSCS

SEQ ID NO: 3033649 - protein, 8 aa, Entamoeba invadens
KCTTCQEN

SEQ ID NO: 3033650 - protein, 12 aa, Entamoeba invadens
KCTTKKCQQDNE

SEQ ID NO: 3033651 - protein, 7 aa, Entamoeba invadens
KCVKGNC

SEQ ID NO: 3033652 - protein, 13 aa, Entamoeba invadens
KCVTKKTMNTRNC

SEQ ID NO: 3033653 - protein, 13 aa, Entamoeba invadens
KDAIRKGRRVGRR

SEQ ID NO: 3033654 - protein, 8 aa, Entamoeba invadens
KDAKANNE

SEQ ID NO: 3033655 - protein, 13 aa, Entamoeba invadens
KDAKVSQFQDKSN

SEQ ID NO: 3033656 - protein, 7 aa, Entamoeba invadens
KDAKYAT

SEQ ID NO: 3033657 - protein, 5 aa, Entamoeba invadens
KDANG

SEQ ID NO: 3033658 - protein, 7 aa, Entamoeba invadens
KDAPNNY

SEQ ID NO: 3033659 - protein, 6 aa, Entamoeba invadens
KDAVEA

SEQ ID NO: 3033660 - protein, 7 aa, Entamoeba invadens
KDAYAKK

SEQ ID NO: 3033661 - protein, 5 aa, Entamoeba invadens
KDDAL

SEQ ID NO: 3033662 - protein, 8 aa, Entamoeba invadens
KDDAPKGV

SEQ ID NO: 3033663 - protein, 6 aa, Entamoeba invadens
KDDIEK

SEQ ID NO: 3033664 - protein, 7 aa, Entamoeba invadens
KDDKMPA

SEQ ID NO: 3033665 - protein, 16 aa, Entamoeba invadens
KDDKSCKKCSTGCSKC

SEQ ID NO: 3033666 - protein, 7 aa, Entamoeba invadens
KDDKSVP

SEQ ID NO: 3033667 - protein, 5 aa, Entamoeba invadens
KDDMA

SEQ ID NO: 3033668 - protein, 5 aa, Entamoeba invadens
KDDTF

SEQ ID NO: 3033669 - protein, 6 aa, Entamoeba invadens
KDDTTC

SEQ ID NO: 3033670 - protein, 18 aa, Entamoeba invadens
KDEEEKGTCQSCKAEKNE

SEQ ID NO: 3033671 - protein, 14 aa, Entamoeba invadens
KDEEFQRKKEEMKR

SEQ ID NO: 3033672 - protein, 5 aa, Entamoeba invadens
KDEKT

SEQ ID NO: 3033673 - protein, 8 aa, Entamoeba invadens
KDENGDDR

SEQ ID NO: 3033674 - protein, 10 aa, Entamoeba invadens
KDENRNPVSN

SEQ ID NO: 3033675 - protein, 15 aa, Entamoeba invadens
KDERKALASRPLPPL

SEQ ID NO: 3033676 - protein, 4 aa, Entamoeba invadens
KDES

SEQ ID NO: 3033677 - protein, 6 aa, Entamoeba invadens
KDETYN

SEQ ID NO: 3033678 - protein, 10 aa, Entamoeba invadens
KDEVDEKGDF

SEQ ID NO: 3033679 - protein, 19 aa, Entamoeba invadens
KDFKTKTLGEFTPKTMKKN

SEQ ID NO: 3033680 - protein, 7 aa, Entamoeba invadens
KDFNPSL

SEQ ID NO: 3033681 - protein, 25 aa, Entamoeba invadens
KDGAVAKSPSGKLPQGGSNPVSYPG

SEQ ID NO: 3033682 - protein, 6 aa, Entamoeba invadens
KDGDGD

SEQ ID NO: 3033683 - protein, 6 aa, Entamoeba invadens
KDGKVY

SEQ ID NO: 3033684 - protein, 18 aa, Entamoeba invadens
KDGLKNVKDKAKDAKDNL

SEQ ID NO: 3033685 - protein, 8 aa, Entamoeba invadens
KDGTTPCS

SEQ ID NO: 3033686 - protein, 6 aa, Entamoeba invadens
KDGVAK

SEQ ID NO: 3033687 - protein, 5 aa, Entamoeba invadens
KDGVE

SEQ ID NO: 3033688 - protein, 7 aa, Entamoeba invadens
KDGVKGV

SEQ ID NO: 3033689 - protein, 4 aa, Entamoeba invadens
KDGY

SEQ ID NO: 3033690 - protein, 13 aa, Entamoeba invadens
KDIADKYANNKTL

SEQ ID NO: 3033691 - protein, 8 aa, Entamoeba invadens
KDIKNDKD

SEQ ID NO: 3033692 - protein, 7 aa, Entamoeba invadens
KDISDEL

SEQ ID NO: 3033693 - protein, 5 aa, Entamoeba invadens
KDIVG

SEQ ID NO: 3033694 - protein, 7 aa, Entamoeba invadens
KDKCNSC

SEQ ID NO: 3033695 - protein, 6 aa, Entamoeba invadens
KDKHAY

SEQ ID NO: 3033696 - protein, 7 aa, Entamoeba invadens
KDKITTH

SEQ ID NO: 3033697 - protein, 18 aa, Entamoeba invadens
KDKLKKVNANIEDEKSAL

SEQ ID NO: 3033698 - protein, 8 aa, Entamoeba invadens
KDKNNCTS

SEQ ID NO: 3033699 - protein, 7 aa, Entamoeba invadens
KDKSRLS

SEQ ID NO: 3033700 - protein, 4 aa, Entamoeba invadens
KDKT

SEQ ID NO: 3033701 - protein, 6 aa, Entamoeba invadens
KDKYEK

SEQ ID NO: 3033702 - protein, 6 aa, Entamoeba invadens
KDLPNQ

SEQ ID NO: 3033703 - protein, 6 aa, Entamoeba invadens
KDLRDM

SEQ ID NO: 3033704 - protein, 5 aa, Entamoeba invadens
KDMTD

SEQ ID NO: 3033705 - protein, 8 aa, Entamoeba invadens
KDNGCAES

SEQ ID NO: 3033706 - protein, 7 aa, Entamoeba invadens
KDNKHTK

SEQ ID NO: 3033707 - protein, 6 aa, Entamoeba invadens
KDNNTY

SEQ ID NO: 3033708 - protein, 9 aa, Entamoeba invadens
KDNQNAKRA

SEQ ID NO: 3033709 - protein, 6 aa, Entamoeba invadens
KDNQTD

SEQ ID NO: 3033710 - protein, 5 aa, Entamoeba invadens
KDPGE

SEQ ID NO: 3033711 - protein, 65 aa, Entamoeba invadens
KDPKPKKSTQVSNVKAQSAPVAQSKKKTSKKVIRKNKSNKKAQVKKVKSPQSTTTKKISGNISSQ

SEQ ID NO: 3033712 - protein, 8 aa, Entamoeba invadens
KDPKYDIP

SEQ ID NO: 3033713 - protein, 12 aa, Entamoeba invadens
KDPSAPDAGVCW

SEQ ID NO: 3033714 - protein, 6 aa, Entamoeba invadens
KDPVTF

SEQ ID NO: 3033715 - protein, 9 aa, Entamoeba invadens
KDQHEIETE

SEQ ID NO: 3033716 - protein, 9 aa, Entamoeba invadens
KDQLENKSA

SEQ ID NO: 3033717 - protein, 9 aa, Entamoeba invadens
KDSEQKVNE

SEQ ID NO: 3033718 - protein, 7 aa, Entamoeba invadens
KDSPKEI

SEQ ID NO: 3033719 - protein, 42 aa, Entamoeba invadens
KDSSSGSNTTNGGADNNNNQPNDNNNDNNDNNNGGDESPTLK

SEQ ID NO: 3033720 - protein, 32 aa, Entamoeba invadens
KDSTVGAKKSYKKNLIETKKEVKENKKNMKQM

SEQ ID NO: 3033721 - protein, 8 aa, Entamoeba invadens
KDTGDSYD

SEQ ID NO: 3033722 - protein, 12 aa, Entamoeba invadens
KDTGKQYTVDNT

SEQ ID NO: 3033723 - protein, 7 aa, Entamoeba invadens
KDTKPEH

SEQ ID NO: 3033724 - protein, 43 aa, Entamoeba invadens
KDTLKDGIKEAKDKTKNEIKEMKDKKTNGFKGAKDKLTNKVNG

SEQ ID NO: 3033725 - protein, 8 aa, Entamoeba invadens
KDTQTKFT

SEQ ID NO: 3033726 - protein, 4 aa, Entamoeba invadens
KDVI

SEQ ID NO: 3033727 - protein, 14 aa, Entamoeba invadens
KDVKESYRKPVANT

SEQ ID NO: 3033728 - protein, 10 aa, Entamoeba invadens
KDVKNTQKAI

SEQ ID NO: 3033729 - protein, 7 aa, Entamoeba invadens
KDVPQKA

SEQ ID NO: 3033730 - protein, 13 aa, Entamoeba invadens
KDVRDSRSTWDGN

SEQ ID NO: 3033731 - protein, 14 aa, Entamoeba invadens
KDVTEEKESATKDF

SEQ ID NO: 3033732 - protein, 10 aa, Entamoeba invadens
KDVTRTDKDE

SEQ ID NO: 3033733 - protein, 7 aa, Entamoeba invadens
KDWEKAK

SEQ ID NO: 3033734 - protein, 12 aa, Entamoeba invadens
KDYCDAPTDAEQ

SEQ ID NO: 3033735 - protein, 17 aa, Entamoeba invadens
KDYNNKDLYKPTDSTYE

SEQ ID NO: 3033736 - protein, 14 aa, Entamoeba invadens
KDYPYTASDGKCEA

SEQ ID NO: 3033737 - protein, 7 aa, Entamoeba invadens
KDYSVGS

SEQ ID NO: 3033738 - protein, 25 aa, Entamoeba invadens
KEAALKKKLSATTQTEKNEAKNEIK

SEQ ID NO: 3033739 - protein, 6 aa, Entamoeba invadens
KEACQT

SEQ ID NO: 3033740 - protein, 7 aa, Entamoeba invadens
KEAGRVR

SEQ ID NO: 3033741 - protein, 6 aa, Entamoeba invadens
KEAKNA

SEQ ID NO: 3033742 - protein, 31 aa, Entamoeba invadens
KEATESVQKMQKAREDKAIKAQQVKMNGGSL

SEQ ID NO: 3033743 - protein, 9 aa, Entamoeba invadens
KECKKEVTC

SEQ ID NO: 3033744 - protein, 8 aa, Entamoeba invadens
KECSPKNV

SEQ ID NO: 3033745 - protein, 13 aa, Entamoeba invadens
KECTTENKCTSCK

SEQ ID NO: 3033746 - protein, 8 aa, Entamoeba invadens
KEDAGCDE

SEQ ID NO: 3033747 - protein, 9 aa, Entamoeba invadens
KEDANNRPF

SEQ ID NO: 3033748 - protein, 7 aa, Entamoeba invadens
KEDDKTC

SEQ ID NO: 3033749 - protein, 7 aa, Entamoeba invadens
KEDIESK

SEQ ID NO: 3033750 - protein, 8 aa, Entamoeba invadens
KEDIESKK

SEQ ID NO: 3033751 - protein, 8 aa, Entamoeba invadens
KEDTSSAY

SEQ ID NO: 3033752 - protein, 79 aa, Entamoeba invadens
KEDVPVDSSSSSESSTSQSSQSSESSTSSSDSSSTQSSQASSEASSQTSSQTSSSEKSSEHSETSSKPDSTNNNDSDGA

SEQ ID NO: 3033753 - protein, 7 aa, Entamoeba invadens
KEEEKKC

SEQ ID NO: 3033754 - protein, 6 aa, Entamoeba invadens
KEEETK

SEQ ID NO: 3033755 - protein, 10 aa, Entamoeba invadens
KEELEADNTG

SEQ ID NO: 3033756 - protein, 20 aa, Entamoeba invadens
KEENTMLSKSSKKTKKVNTF

SEQ ID NO: 3033757 - protein, 11 aa, Entamoeba invadens
KEERNDEERHR

SEQ ID NO: 3033758 - protein, 35 aa, Entamoeba invadens
KEESERTTQRLENETNQIKQNSQKNVTTLESQISD

SEQ ID NO: 3033759 - protein, 6 aa, Entamoeba invadens
KEFRGK

SEQ ID NO: 3033760 - protein, 4 aa, Entamoeba invadens
KEFS

SEQ ID NO: 3033761 - protein, 5 aa, Entamoeba invadens
KEGEI

SEQ ID NO: 3033762 - protein, 6 aa, Entamoeba invadens
KEGENY

SEQ ID NO: 3033763 - protein, 15 aa, Entamoeba invadens
KEGFGVEKEDKEFDS

SEQ ID NO: 3033764 - protein, 19 aa, Entamoeba invadens
KEGNDHKETIKSANRKIEE

SEQ ID NO: 3033765 - protein, 7 aa, Entamoeba invadens
KEGNKDY

SEQ ID NO: 3033766 - protein, 8 aa, Entamoeba invadens
KEGPRTFA

SEQ ID NO: 3033767 - protein, 8 aa, Entamoeba invadens
KEGRISNN

SEQ ID NO: 3033768 - protein, 7 aa, Entamoeba invadens
KEGSYYT

SEQ ID NO: 3033769 - protein, 7 aa, Entamoeba invadens
KEGTEAN

SEQ ID NO: 3033770 - protein, 13 aa, Entamoeba invadens
KEGYDDDNTCDHC

SEQ ID NO: 3033771 - protein, 7 aa, Entamoeba invadens
KEGYIKA

SEQ ID NO: 3033772 - protein, 8 aa, Entamoeba invadens
KEIATTGA

SEQ ID NO: 3033773 - protein, 16 aa, Entamoeba invadens
KEIDDPEDKKPEGWDD

SEQ ID NO: 3033774 - protein, 4 aa, Entamoeba invadens
KEIE

SEQ ID NO: 3033775 - protein, 5 aa, Entamoeba invadens
KEIEE

SEQ ID NO: 3033776 - protein, 8 aa, Entamoeba invadens
KEIEEAKR

SEQ ID NO: 3033777 - protein, 4 aa, Entamoeba invadens
KEIK

SEQ ID NO: 3033778 - protein, 18 aa, Entamoeba invadens
KEISKQLQNDNEKVKGEI

SEQ ID NO: 3033779 - protein, 31 aa, Entamoeba invadens
KEITQKLNDENESLKSAKEVTEKEKNELMTQ

SEQ ID NO: 3033780 - protein, 6 aa, Entamoeba invadens
KEKDRN

SEQ ID NO: 3033781 - protein, 19 aa, Entamoeba invadens
KEKEAKKLKTENDEIKEEV

SEQ ID NO: 3033782 - protein, 41 aa, Entamoeba invadens
KEKEKVEIQDNDYPITDYKSDGSEEDDQDKRRSDKTNQRQK

SEQ ID NO: 3033783 - protein, 34 aa, Entamoeba invadens
KEKELPKESPIPPQTPQKEEPVVRPKTTLPPQKV

SEQ ID NO: 3033784 - protein, 6 aa, Entamoeba invadens
KEKKQD

SEQ ID NO: 3033785 - protein, 7 aa, Entamoeba invadens
KEKKYNL

SEQ ID NO: 3033786 - protein, 8 aa, Entamoeba invadens
KEKLDKKI

SEQ ID NO: 3033787 - protein, 6 aa, Entamoeba invadens
KEKSRF

SEQ ID NO: 3033788 - protein, 9 aa, Entamoeba invadens
KEKSSTQRK

SEQ ID NO: 3033789 - protein, 6 aa, Entamoeba invadens
KEKTTC

SEQ ID NO: 3033790 - protein, 10 aa, Entamoeba invadens
KEKYKKAADV

SEQ ID NO: 3033791 - protein, 9 aa, Entamoeba invadens
KEKYSASPK

SEQ ID NO: 3033792 - protein, 4 aa, Entamoeba invadens
KELN

SEQ ID NO: 3033793 - protein, 9 aa, Entamoeba invadens
KELPAKKNQ

SEQ ID NO: 3033794 - protein, 9 aa, Entamoeba invadens
KELPGSGKQ

SEQ ID NO: 3033795 - protein, 7 aa, Entamoeba invadens
KELQSSS

SEQ ID NO: 3033796 - protein, 6 aa, Entamoeba invadens
KELREL

SEQ ID NO: 3033797 - protein, 5 aa, Entamoeba invadens
KELRN

SEQ ID NO: 3033798 - protein, 11 aa, Entamoeba invadens
KELSKEEEKKL

SEQ ID NO: 3033799 - protein, 8 aa, Entamoeba invadens
KELTLDSN

SEQ ID NO: 3033800 - protein, 8 aa, Entamoeba invadens
KEMTDADS

SEQ ID NO: 3033801 - protein, 6 aa, Entamoeba invadens
KENCNA

SEQ ID NO: 3033802 - protein, 7 aa, Entamoeba invadens
KENDDPA

SEQ ID NO: 3033803 - protein, 10 aa, Entamoeba invadens
KENDPNTDTR

SEQ ID NO: 3033804 - protein, 7 aa, Entamoeba invadens
KENEETL

SEQ ID NO: 3033805 - protein, 8 aa, Entamoeba invadens
KENEGDLE

SEQ ID NO: 3033806 - protein, 6 aa, Entamoeba invadens
KENELI

SEQ ID NO: 3033807 - protein, 6 aa, Entamoeba invadens
KENENQ

SEQ ID NO: 3033808 - protein, 7 aa, Entamoeba invadens
KENHESF

SEQ ID NO: 3033809 - protein, 9 aa, Entamoeba invadens
KENIQNCTD

SEQ ID NO: 3033810 - protein, 6 aa, Entamoeba invadens
KENKKC

SEQ ID NO: 3033811 - protein, 5 aa, Entamoeba invadens
KENKT

SEQ ID NO: 3033812 - protein, 17 aa, Entamoeba invadens
KENLKKENNEKKYRDSL

SEQ ID NO: 3033813 - protein, 5 aa, Entamoeba invadens
KENNM

SEQ ID NO: 3033814 - protein, 15 aa, Entamoeba invadens
KENNPKECDKCEQGY

SEQ ID NO: 3033815 - protein, 32 aa, Entamoeba invadens
KENQKIIKEKQEKEAAIKKKQDEEKAKRIEAE

SEQ ID NO: 3033816 - protein, 8 aa, Entamoeba invadens
KENSGTYN

SEQ ID NO: 3033817 - protein, 8 aa, Entamoeba invadens
KENSKNIT

SEQ ID NO: 3033818 - protein, 5 aa, Entamoeba invadens
KENTK

SEQ ID NO: 3033819 - protein, 12 aa, Entamoeba invadens
KEPFGDARFPSQ

SEQ ID NO: 3033820 - protein, 6 aa, Entamoeba invadens
KEPSYV

SEQ ID NO: 3033821 - protein, 14 aa, Entamoeba invadens
KEQDPKKKQELTTE

SEQ ID NO: 3033822 - protein, 6 aa, Entamoeba invadens
KEQERL

SEQ ID NO: 3033823 - protein, 17 aa, Entamoeba invadens
KEQKKLEERVKNAKSRI

SEQ ID NO: 3033824 - protein, 13 aa, Entamoeba invadens
KEQSKAKKLGEKA

SEQ ID NO: 3033825 - protein, 4 aa, Entamoeba invadens
KERA

SEQ ID NO: 3033826 - protein, 52 aa, Entamoeba invadens
KERHKESLRRSLSEPTTSSQASKIAKEFKPSKQSGQEKEQKEKAAPTKLELE

SEQ ID NO: 3033827 - protein, 6 aa, Entamoeba invadens
KERNET

SEQ ID NO: 3033828 - protein, 6 aa, Entamoeba invadens
KERSIR

SEQ ID NO: 3033829 - protein, 9 aa, Entamoeba invadens
KESERNNYP

SEQ ID NO: 3033830 - protein, 7 aa, Entamoeba invadens
KESHYAP

SEQ ID NO: 3033831 - protein, 17 aa, Entamoeba invadens
KESKLNAKEALKDFKDK

SEQ ID NO: 3033832 - protein, 5 aa, Entamoeba invadens
KESSC

SEQ ID NO: 3033833 - protein, 5 aa, Entamoeba invadens
KESSI

SEQ ID NO: 3033834 - protein, 19 aa, Entamoeba invadens
KESVRKAEQELQKRAEKLR

SEQ ID NO: 3033835 - protein, 56 aa, Entamoeba invadens
KETADQSTDIEPSKTPEESKTPEQSKTPEENKSEGSTTTSENGEQNNNNNGEDNAF

SEQ ID NO: 3033836 - protein, 7 aa, Entamoeba invadens
KETDESI

SEQ ID NO: 3033837 - protein, 10 aa, Entamoeba invadens
KETDPSTDTR

SEQ ID NO: 3033838 - protein, 5 aa, Entamoeba invadens
KETEK

SEQ ID NO: 3033839 - protein, 5 aa, Entamoeba invadens
KETES

SEQ ID NO: 3033840 - protein, 6 aa, Entamoeba invadens
KETFSA

SEQ ID NO: 3033841 - protein, 7 aa, Entamoeba invadens
KETGCSP

SEQ ID NO: 3033842 - protein, 8 aa, Entamoeba invadens
KETGNKKL

SEQ ID NO: 3033843 - protein, 8 aa, Entamoeba invadens
KETHNAKK

SEQ ID NO: 3033844 - protein, 11 aa, Entamoeba invadens
KETKQSNGTSL

SEQ ID NO: 3033845 - protein, 6 aa, Entamoeba invadens
KETQRL

SEQ ID NO: 3033846 - protein, 6 aa, Entamoeba invadens
KETQSD

SEQ ID NO: 3033847 - protein, 9 aa, Entamoeba invadens
KETTKGGSF

SEQ ID NO: 3033848 - protein, 5 aa, Entamoeba invadens
KETTV

SEQ ID NO: 3033849 - protein, 9 aa, Entamoeba invadens
KEVESYAQS

SEQ ID NO: 3033850 - protein, 6 aa, Entamoeba invadens
KEVNEN

SEQ ID NO: 3033851 - protein, 18 aa, Entamoeba invadens
KEVPAEAKDVKKRSSDTT

SEQ ID NO: 3033852 - protein, 5 aa, Entamoeba invadens
KEVPS

SEQ ID NO: 3033853 - protein, 6 aa, Entamoeba invadens
KEYDNY

SEQ ID NO: 3033854 - protein, 6 aa, Entamoeba invadens
KEYQDK

SEQ ID NO: 3033855 - protein, 7 aa, Entamoeba invadens
KEYTEQI

SEQ ID NO: 3033856 - protein, 7 aa, Entamoeba invadens
KFDDKTK

SEQ ID NO: 3033857 - protein, 5 aa, Entamoeba invadens
KFETP

SEQ ID NO: 3033858 - protein, 11 aa, Entamoeba invadens
KFEVPNYEGNY

SEQ ID NO: 3033859 - protein, 10 aa, Entamoeba invadens
KFGKARTDTG

SEQ ID NO: 3033860 - protein, 5 aa, Entamoeba invadens
KFGPS

SEQ ID NO: 3033861 - protein, 15 aa, Entamoeba invadens
KFKETNESPSPKNLT

SEQ ID NO: 3033862 - protein, 11 aa, Entamoeba invadens
KFNSTKESNYA

SEQ ID NO: 3033863 - protein, 7 aa, Entamoeba invadens
KFPEPVA

SEQ ID NO: 3033864 - protein, 14 aa, Entamoeba invadens
KFPPSPRSKNLNLS

SEQ ID NO: 3033865 - protein, 9 aa, Entamoeba invadens
KFPSEKDKT

SEQ ID NO: 3033866 - protein, 7 aa, Entamoeba invadens
KFRDGTD

SEQ ID NO: 3033867 - protein, 6 aa, Entamoeba invadens
KFREPY

SEQ ID NO: 3033868 - protein, 8 aa, Entamoeba invadens
KFSDQETV

SEQ ID NO: 3033869 - protein, 10 aa, Entamoeba invadens
KFYKDKKKMY

SEQ ID NO: 3033870 - protein, 20 aa, Entamoeba invadens
KGCSDGCSTCSGAATCTSCN

SEQ ID NO: 3033871 - protein, 6 aa, Entamoeba invadens
KGCSSG

SEQ ID NO: 3033872 - protein, 13 aa, Entamoeba invadens
KGCVKQKTGSTCA

SEQ ID NO: 3033873 - protein, 4 aa, Entamoeba invadens
KGDK

SEQ ID NO: 3033874 - protein, 6 aa, Entamoeba invadens
KGDKTC

SEQ ID NO: 3033875 - protein, 5 aa, Entamoeba invadens
KGDPF

SEQ ID NO: 3033876 - protein, 16 aa, Entamoeba invadens
KGDYGNSVQGAVSKEG

SEQ ID NO: 3033877 - protein, 6 aa, Entamoeba invadens
KGDYSS

SEQ ID NO: 3033878 - protein, 10 aa, Entamoeba invadens
KGEEDEDDLD

SEQ ID NO: 3033879 - protein, 10 aa, Entamoeba invadens
KGEKSYKSDG

SEQ ID NO: 3033880 - protein, 10 aa, Entamoeba invadens
KGEKVGKAET

SEQ ID NO: 3033881 - protein, 5 aa, Entamoeba invadens
KGENY

SEQ ID NO: 3033882 - protein, 6 aa, Entamoeba invadens
KGENYY

SEQ ID NO: 3033883 - protein, 8 aa, Entamoeba invadens
KGETRYPS

SEQ ID NO: 3033884 - protein, 9 aa, Entamoeba invadens
KGETSYKAD

SEQ ID NO: 3033885 - protein, 4 aa, Entamoeba invadens
KGFD

SEQ ID NO: 3033886 - protein, 8 aa, Entamoeba invadens
KGFQKSKI

SEQ ID NO: 3033887 - protein, 8 aa, Entamoeba invadens
KGGNGDCG

SEQ ID NO: 3033888 - protein, 5 aa, Entamoeba invadens
KGHVE

SEQ ID NO: 3033889 - protein, 6 aa, Entamoeba invadens
KGIEED

SEQ ID NO: 3033890 - protein, 25 aa, Entamoeba invadens
KGIGSESSFPYTTKDDYCKSTPRVA

SEQ ID NO: 3033891 - protein, 17 aa, Entamoeba invadens
KGILGTAKNLKKALSTM

SEQ ID NO: 3033892 - protein, 5 aa, Entamoeba invadens
KGITL

SEQ ID NO: 3033893 - protein, 21 aa, Entamoeba invadens
KGITLETSYPYKAADGTCNTA

SEQ ID NO: 3033894 - protein, 10 aa, Entamoeba invadens
KGKCQKDSLG

SEQ ID NO: 3033895 - protein, 5 aa, Entamoeba invadens
KGKDI

SEQ ID NO: 3033896 - protein, 30 aa, Entamoeba invadens
KGKKQREREEQEKKEREEKEKREKERKEQE

SEQ ID NO: 3033897 - protein, 12 aa, Entamoeba invadens
KGKKSLSPTTRF

SEQ ID NO: 3033898 - protein, 23 aa, Entamoeba invadens
KGKKTPKPQEESDFERLHKQFKP

SEQ ID NO: 3033899 - protein, 10 aa, Entamoeba invadens
KGKTDTSIGG

SEQ ID NO: 3033900 - protein, 53 aa, Entamoeba invadens
KGLEEEEEKDEDITIEEEETKEEEKKTEEKVDNNTNKENVTELNETDGNTTLI

SEQ ID NO: 3033901 - protein, 9 aa, Entamoeba invadens
KGLPSGRNY

SEQ ID NO: 3033902 - protein, 4 aa, Entamoeba invadens
KGLT

SEQ ID NO: 3033903 - protein, 8 aa, Entamoeba invadens
KGMRDGEE

SEQ ID NO: 3033904 - protein, 7 aa, Entamoeba invadens
KGNGPYP

SEQ ID NO: 3033905 - protein, 9 aa, Entamoeba invadens
KGNGPYPLE

SEQ ID NO: 3033906 - protein, 6 aa, Entamoeba invadens
KGNGQL

SEQ ID NO: 3033907 - protein, 10 aa, Entamoeba invadens
KGNQNTIEGR

SEQ ID NO: 3033908 - protein, 4 aa, Entamoeba invadens
KGNV

SEQ ID NO: 3033909 - protein, 5 aa, Entamoeba invadens
KGNYF

SEQ ID NO: 3033910 - protein, 9 aa, Entamoeba invadens
KGPNGPKQY

SEQ ID NO: 3033911 - protein, 5 aa, Entamoeba invadens
KGPVA

SEQ ID NO: 3033912 - protein, 17 aa, Entamoeba invadens
KGQISDTISGFESNWLK

SEQ ID NO: 3033913 - protein, 24 aa, Entamoeba invadens
KGQPDKPKEPEKQSEASGTTFPSL

SEQ ID NO: 3033914 - protein, 4 aa, Entamoeba invadens
KGQR

SEQ ID NO: 3033915 - protein, 5 aa, Entamoeba invadens
KGRRE

SEQ ID NO: 3033916 - protein, 5 aa, Entamoeba invadens
KGSGP

SEQ ID NO: 3033917 - protein, 8 aa, Entamoeba invadens
KGSKYAKK

SEQ ID NO: 3033918 - protein, 8 aa, Entamoeba invadens
KGSLRNAN

SEQ ID NO: 3033919 - protein, 9 aa, Entamoeba invadens
KGTFAGSSS

SEQ ID NO: 3033920 - protein, 15 aa, Entamoeba invadens
KGTIKKTKAKVANKV

SEQ ID NO: 3033921 - protein, 15 aa, Entamoeba invadens
KGTKCKGEEGNPYQY

SEQ ID NO: 3033922 - protein, 5 aa, Entamoeba invadens
KGTKG

SEQ ID NO: 3033923 - protein, 6 aa, Entamoeba invadens
KGTNAS

SEQ ID NO: 3033924 - protein, 11 aa, Entamoeba invadens
KGTPENLPTEE

SEQ ID NO: 3033925 - protein, 15 aa, Entamoeba invadens
KGTTDAIDYNGDRSF

SEQ ID NO: 3033926 - protein, 30 aa, Entamoeba invadens
KGVKKTTKKVAKKATKKATKKVTKKTAPKK

SEQ ID NO: 3033927 - protein, 9 aa, Entamoeba invadens
KGVKSRAKT

SEQ ID NO: 3033928 - protein, 25 aa, Entamoeba invadens
KGVMPRSRYPYEAETQDCKEFNNEY

SEQ ID NO: 3033929 - protein, 7 aa, Entamoeba invadens
KGVQKSV

SEQ ID NO: 3033930 - protein, 13 aa, Entamoeba invadens
KGYGLNNKNCTKC

SEQ ID NO: 3033931 - protein, 6 aa, Entamoeba invadens
KGYLDN

SEQ ID NO: 3033932 - protein, 11 aa, Entamoeba invadens
KGYPKEKEGEW

SEQ ID NO: 3033933 - protein, 12 aa, Entamoeba invadens
KGYPKEKEGEWI

SEQ ID NO: 3033934 - protein, 6 aa, Entamoeba invadens
KGYTRF

SEQ ID NO: 3033935 - protein, 5 aa, Entamoeba invadens
KHEST

SEQ ID NO: 3033936 - protein, 7 aa, Entamoeba invadens
KHETQYN

SEQ ID NO: 3033937 - protein, 5 aa, Entamoeba invadens
KHGSC

SEQ ID NO: 3033938 - protein, 8 aa, Entamoeba invadens
KHGSCSLT

SEQ ID NO: 3033939 - protein, 4 aa, Entamoeba invadens
KHGT

SEQ ID NO: 3033940 - protein, 8 aa, Entamoeba invadens
KHKKRDQE

SEQ ID NO: 3033941 - protein, 16 aa, Entamoeba invadens
KHKPSTPQPTQQEEQI

SEQ ID NO: 3033942 - protein, 4 aa, Entamoeba invadens
KHKS

SEQ ID NO: 3033943 - protein, 6 aa, Entamoeba invadens
KHLKEA

SEQ ID NO: 3033944 - protein, 5 aa, Entamoeba invadens
KHMAS

SEQ ID NO: 3033945 - protein, 8 aa, Entamoeba invadens
KHMKKEEK

SEQ ID NO: 3033946 - protein, 5 aa, Entamoeba invadens
KHNDK

SEQ ID NO: 3033947 - protein, 5 aa, Entamoeba invadens
KHNRR

SEQ ID NO: 3033948 - protein, 4 aa, Entamoeba invadens
KHPL

SEQ ID NO: 3033949 - protein, 16 aa, Entamoeba invadens
KHPYNKTSKNSEISQN

SEQ ID NO: 3033950 - protein, 9 aa, Entamoeba invadens
KHQTSKLSK

SEQ ID NO: 3033951 - protein, 5 aa, Entamoeba invadens
KHSDQ

SEQ ID NO: 3033952 - protein, 7 aa, Entamoeba invadens
KHSEAND

SEQ ID NO: 3033953 - protein, 11 aa, Entamoeba invadens
KHTEDEQRELQ

SEQ ID NO: 3033954 - protein, 5 aa, Entamoeba invadens
KHTFE

SEQ ID NO: 3033955 - protein, 13 aa, Entamoeba invadens
KHTNKKTDNIKID

SEQ ID NO: 3033956 - protein, 7 aa, Entamoeba invadens
KHTQISV

SEQ ID NO: 3033957 - protein, 15 aa, Entamoeba invadens
KIANTKESLATSEEV

SEQ ID NO: 3033958 - protein, 9 aa, Entamoeba invadens
KIASPDRDR

SEQ ID NO: 3033959 - protein, 12 aa, Entamoeba invadens
KIATGKIRRNNK

SEQ ID NO: 3033960 - protein, 38 aa, Entamoeba invadens
KIDAPNESNQVSQHEVEASEDESDCESVEDSSEDEFDE

SEQ ID NO: 3033961 - protein, 7 aa, Entamoeba invadens
KIDETER

SEQ ID NO: 3033962 - protein, 4 aa, Entamoeba invadens
KIEE

SEQ ID NO: 3033963 - protein, 9 aa, Entamoeba invadens
KIEEYNNNT

SEQ ID NO: 3033964 - protein, 16 aa, Entamoeba invadens
KIEKNKEKATATNDVY

SEQ ID NO: 3033965 - protein, 5 aa, Entamoeba invadens
KIETI

SEQ ID NO: 3033966 - protein, 18 aa, Entamoeba invadens
KIEVKSQHQITPQFQTKD

SEQ ID NO: 3033967 - protein, 10 aa, Entamoeba invadens
KIGASTKYAN

SEQ ID NO: 3033968 - protein, 10 aa, Entamoeba invadens
KIGDEEQKSF

SEQ ID NO: 3033969 - protein, 18 aa, Entamoeba invadens
KIGDESDYKDPSDGCVSS

SEQ ID NO: 3033970 - protein, 7 aa, Entamoeba invadens
KIGEGSY

SEQ ID NO: 3033971 - protein, 16 aa, Entamoeba invadens
KIKKSEKGTKKQAKTF

SEQ ID NO: 3033972 - protein, 19 aa, Entamoeba invadens
KIKNTVEEAYSKVSKKEVG

SEQ ID NO: 3033973 - protein, 7 aa, Entamoeba invadens
KIKSGGV

SEQ ID NO: 3033974 - protein, 7 aa, Entamoeba invadens
KIKSSGV

SEQ ID NO: 3033975 - protein, 6 aa, Entamoeba invadens
KIKTED

SEQ ID NO: 3033976 - protein, 22 aa, Entamoeba invadens
KILDRSGKCVEPTNCDSVDDSR

SEQ ID NO: 3033977 - protein, 5 aa, Entamoeba invadens
KINDT

SEQ ID NO: 3033978 - protein, 16 aa, Entamoeba invadens
KINNDEIRKGKKVSDS

SEQ ID NO: 3033979 - protein, 4 aa, Entamoeba invadens
KINS

SEQ ID NO: 3033980 - protein, 5 aa, Entamoeba invadens
KIPNC

SEQ ID NO: 3033981 - protein, 14 aa, Entamoeba invadens
KIPPIQQPGELPRF

SEQ ID NO: 3033982 - protein, 18 aa, Entamoeba invadens
KIQAKQTKNLKETTRNVE

SEQ ID NO: 3033983 - protein, 43 aa, Entamoeba invadens
KIQDEKEQIENEKKTLSDELEKTKEENENITQKLQTTTNEKVE

SEQ ID NO: 3033984 - protein, 9 aa, Entamoeba invadens
KIQENSFEE

SEQ ID NO: 3033985 - protein, 9 aa, Entamoeba invadens
KIRDQNPCG

SEQ ID NO: 3033986 - protein, 9 aa, Entamoeba invadens
KIREQDVKG

SEQ ID NO: 3033987 - protein, 19 aa, Entamoeba invadens
KIRNDEKKVVEELKQRNQA

SEQ ID NO: 3033988 - protein, 7 aa, Entamoeba invadens
KIRTKPK

SEQ ID NO: 3033989 - protein, 10 aa, Entamoeba invadens
KISDDESNPL

SEQ ID NO: 3033990 - protein, 13 aa, Entamoeba invadens
KISESRTKKALST

SEQ ID NO: 3033991 - protein, 16 aa, Entamoeba invadens
KISGANYKLSADPEYG

SEQ ID NO: 3033992 - protein, 11 aa, Entamoeba invadens
KISKNSVREEY

SEQ ID NO: 3033993 - protein, 4 aa, Entamoeba invadens
KISN

SEQ ID NO: 3033994 - protein, 6 aa, Entamoeba invadens
KISSRT

SEQ ID NO: 3033995 - protein, 8 aa, Entamoeba invadens
KITAAEQK

SEQ ID NO: 3033996 - protein, 6 aa, Entamoeba invadens
KITGMK

SEQ ID NO: 3033997 - protein, 8 aa, Entamoeba invadens
KITKGEGS

SEQ ID NO: 3033998 - protein, 8 aa, Entamoeba invadens
KITSEIPP

SEQ ID NO: 3033999 - protein, 20 aa, Entamoeba invadens
KIVGDDNKYPAEYNGTCSRE

SEQ ID NO: 3034000 - protein, 10 aa, Entamoeba invadens
KKAAEELNTK

SEQ ID NO: 3034001 - protein, 10 aa, Entamoeba invadens
KKAAPKPKPV

SEQ ID NO: 3034002 - protein, 14 aa, Entamoeba invadens
KKAEKKQKAAEKKV

SEQ ID NO: 3034003 - protein, 30 aa, Entamoeba invadens
KKAERQYNNAKSPEKRERKATALQGARSAY

SEQ ID NO: 3034004 - protein, 7 aa, Entamoeba invadens
KKAIGEK

SEQ ID NO: 3034005 - protein, 20 aa, Entamoeba invadens
KKAKKNLEKAKEEAKEAYRN

SEQ ID NO: 3034006 - protein, 13 aa, Entamoeba invadens
KKAKLSKLTTGGY

SEQ ID NO: 3034007 - protein, 30 aa, Entamoeba invadens
KKANIKAERQMSGEATRDVRRKVKEDMRKQ

SEQ ID NO: 3034008 - protein, 14 aa, Entamoeba invadens
KKAPFQTTPTVSSY

SEQ ID NO: 3034009 - protein, 19 aa, Entamoeba invadens
KKAPTSDAVKNYKTNNARD

SEQ ID NO: 3034010 - protein, 29 aa, Entamoeba invadens
KKAQAQKKKLQEKKKKLVKQAESKKTQIL

SEQ ID NO: 3034011 - protein, 7 aa, Entamoeba invadens
KKCDDRA

SEQ ID NO: 3034012 - protein, 10 aa, Entamoeba invadens
KKCGGQNAKL

SEQ ID NO: 3034013 - protein, 12 aa, Entamoeba invadens
KKCKSGQPVKEG

SEQ ID NO: 3034014 - protein, 18 aa, Entamoeba invadens
KKCKTGCSKCSDANTCTG

SEQ ID NO: 3034015 - protein, 4 aa, Entamoeba invadens
KKCS

SEQ ID NO: 3034016 - protein, 6 aa, Entamoeba invadens
KKCSSV

SEQ ID NO: 3034017 - protein, 5 aa, Entamoeba invadens
KKDAD

SEQ ID NO: 3034018 - protein, 13 aa, Entamoeba invadens
KKDAEEKEKQYTD

SEQ ID NO: 3034019 - protein, 7 aa, Entamoeba invadens
KKDEEEM

SEQ ID NO: 3034020 - protein, 10 aa, Entamoeba invadens
KKDGCTKCDN

SEQ ID NO: 3034021 - protein, 7 aa, Entamoeba invadens
KKDIEIP

SEQ ID NO: 3034022 - protein, 8 aa, Entamoeba invadens
KKDKCTQC

SEQ ID NO: 3034023 - protein, 17 aa, Entamoeba invadens
KKDKTTPQEKKKLAVTK

SEQ ID NO: 3034024 - protein, 8 aa, Entamoeba invadens
KKDLKKNG

SEQ ID NO: 3034025 - protein, 7 aa, Entamoeba invadens
KKDMKKQ

SEQ ID NO: 3034026 - protein, 7 aa, Entamoeba invadens
KKDRSVH

SEQ ID NO: 3034027 - protein, 5 aa, Entamoeba invadens
KKDTI

SEQ ID NO: 3034028 - protein, 11 aa, Entamoeba invadens
KKDTRSNEAAF

SEQ ID NO: 3034029 - protein, 21 aa, Entamoeba invadens
KKDVENTLENVEKDKSELERQ

SEQ ID NO: 3034030 - protein, 12 aa, Entamoeba invadens
KKEDMERVAKSN

SEQ ID NO: 3034031 - protein, 54 aa, Entamoeba invadens
KKEESNKKIKEMEENAIRKEEETNKMKSNYETSNNELKEKLEEDEKAKKERDER

SEQ ID NO: 3034032 - protein, 7 aa, Entamoeba invadens
KKEEYSK

SEQ ID NO: 3034033 - protein, 8 aa, Entamoeba invadens
KKEGKYEN

SEQ ID NO: 3034034 - protein, 7 aa, Entamoeba invadens
KKEHCDS

SEQ ID NO: 3034035 - protein, 6 aa, Entamoeba invadens
KKEINV

SEQ ID NO: 3034036 - protein, 4 aa, Entamoeba invadens
KKEN

SEQ ID NO: 3034037 - protein, 6 aa, Entamoeba invadens
KKENVC

SEQ ID NO: 3034038 - protein, 8 aa, Entamoeba invadens
KKENYKPA

SEQ ID NO: 3034039 - protein, 20 aa, Entamoeba invadens
KKEQSEPFEESPCVWLDQTE

SEQ ID NO: 3034040 - protein, 9 aa, Entamoeba invadens
KKESKASRM

SEQ ID NO: 3034041 - protein, 7 aa, Entamoeba invadens
KKESSDV

SEQ ID NO: 3034042 - protein, 6 aa, Entamoeba invadens
KKETDY

SEQ ID NO: 3034043 - protein, 11 aa, Entamoeba invadens
KKETEEVTQKT

SEQ ID NO: 3034044 - protein, 9 aa, Entamoeba invadens
KKETKKEVT

SEQ ID NO: 3034045 - protein, 8 aa, Entamoeba invadens
KKETKSVR

SEQ ID NO: 3034046 - protein, 7 aa, Entamoeba invadens
KKFEERQ

SEQ ID NO: 3034047 - protein, 7 aa, Entamoeba invadens
KKFKEEK

SEQ ID NO: 3034048 - protein, 4 aa, Entamoeba invadens
KKFS

SEQ ID NO: 3034049 - protein, 5 aa, Entamoeba invadens
KKGDK

SEQ ID NO: 3034050 - protein, 6 aa, Entamoeba invadens
KKGENY

SEQ ID NO: 3034051 - protein, 6 aa, Entamoeba invadens
KKGETQ

SEQ ID NO: 3034052 - protein, 6 aa, Entamoeba invadens
KKGGYY

SEQ ID NO: 3034053 - protein, 44 aa, Entamoeba invadens
KKGKRKTKSEQSKTPIETKPPFSPKTESKESQIVRPKTTQQPVK

SEQ ID NO: 3034054 - protein, 21 aa, Entamoeba invadens
KKGLKKGGLKKKVKMGSKKER

SEQ ID NO: 3034055 - protein, 9 aa, Entamoeba invadens
KKGNADKST

SEQ ID NO: 3034056 - protein, 6 aa, Entamoeba invadens
KKHADE

SEQ ID NO: 3034057 - protein, 6 aa, Entamoeba invadens
KKIDQS

SEQ ID NO: 3034058 - protein, 7 aa, Entamoeba invadens
KKIGARI

SEQ ID NO: 3034059 - protein, 10 aa, Entamoeba invadens
KKIGKRTNRI

SEQ ID NO: 3034060 - protein, 6 aa, Entamoeba invadens
KKIKSL

SEQ ID NO: 3034061 - protein, 5 aa, Entamoeba invadens
KKIST

SEQ ID NO: 3034062 - protein, 7 aa, Entamoeba invadens
KKITNED

SEQ ID NO: 3034063 - protein, 7 aa, Entamoeba invadens
KKKEECE

SEQ ID NO: 3034064 - protein, 16 aa, Entamoeba invadens
KKKGTELLDKGKNGLK

SEQ ID NO: 3034065 - protein, 17 aa, Entamoeba invadens
KKKIAADNYLPRDQGRE

SEQ ID NO: 3034066 - protein, 18 aa, Entamoeba invadens
KKKLKRQAQEQQQQQQQN

SEQ ID NO: 3034067 - protein, 16 aa, Entamoeba invadens
KKLEAKEDNSKDLETQ

SEQ ID NO: 3034068 - protein, 9 aa, Entamoeba invadens
KKLEDVEKE

SEQ ID NO: 3034069 - protein, 7 aa, Entamoeba invadens
KKLGEGS

SEQ ID NO: 3034070 - protein, 8 aa, Entamoeba invadens
KKLGEGSY

SEQ ID NO: 3034071 - protein, 45 aa, Entamoeba invadens
KKLKKTDDNKQTSNNSKGVQETTADTDKDESSKLNNKDKKAGLKI

SEQ ID NO: 3034072 - protein, 17 aa, Entamoeba invadens
KKLTEVGDSIKNHSEEI

SEQ ID NO: 3034073 - protein, 7 aa, Entamoeba invadens
KKMKMSS

SEQ ID NO: 3034074 - protein, 23 aa, Entamoeba invadens
KKMTPEEKQNADNAKAKLNELEE

SEQ ID NO: 3034075 - protein, 4 aa, Entamoeba invadens
KKNE

SEQ ID NO: 3034076 - protein, 8 aa, Entamoeba invadens
KKNNSQKM

SEQ ID NO: 3034077 - protein, 15 aa, Entamoeba invadens
KKNPEFTKKASYSKK

SEQ ID NO: 3034078 - protein, 7 aa, Entamoeba invadens
KKNSHRI

SEQ ID NO: 3034079 - protein, 6 aa, Entamoeba invadens
KKNTVV

SEQ ID NO: 3034080 - protein, 7 aa, Entamoeba invadens
KKPNELN

SEQ ID NO: 3034081 - protein, 5 aa, Entamoeba invadens
KKPTI

SEQ ID NO: 3034082 - protein, 7 aa, Entamoeba invadens
KKPVKKV

SEQ ID NO: 3034083 - protein, 12 aa, Entamoeba invadens
KKQCSKDSCPEG

SEQ ID NO: 3034084 - protein, 10 aa, Entamoeba invadens
KKQKELEEQQ

SEQ ID NO: 3034085 - protein, 6 aa, Entamoeba invadens
KKREEL

SEQ ID NO: 3034086 - protein, 14 aa, Entamoeba invadens
KKRTAEVKEKNAIK

SEQ ID NO: 3034087 - protein, 12 aa, Entamoeba invadens
KKRTTREARDSL

SEQ ID NO: 3034088 - protein, 4 aa, Entamoeba invadens
KKRV

SEQ ID NO: 3034089 - protein, 7 aa, Entamoeba invadens
KKSDDID

SEQ ID NO: 3034090 - protein, 7 aa, Entamoeba invadens
KKSDFSS

SEQ ID NO: 3034091 - protein, 8 aa, Entamoeba invadens
KKSEEECV

SEQ ID NO: 3034092 - protein, 6 aa, Entamoeba invadens
KKSEQW

SEQ ID NO: 3034093 - protein, 11 aa, Entamoeba invadens
KKSETKTDSIP

SEQ ID NO: 3034094 - protein, 5 aa, Entamoeba invadens
KKSGE

SEQ ID NO: 3034095 - protein, 13 aa, Entamoeba invadens
KKSKDSEVPDPYY

SEQ ID NO: 3034096 - protein, 12 aa, Entamoeba invadens
KKSKPMEGPSNF

SEQ ID NO: 3034097 - protein, 5 aa, Entamoeba invadens
KKSKT

SEQ ID NO: 3034098 - protein, 6 aa, Entamoeba invadens
KKSSKT

SEQ ID NO: 3034099 - protein, 10 aa, Entamoeba invadens
KKSSSFEGSQ

SEQ ID NO: 3034100 - protein, 12 aa, Entamoeba invadens
KKSTEAEDRVKE

SEQ ID NO: 3034101 - protein, 7 aa, Entamoeba invadens
KKTADSE

SEQ ID NO: 3034102 - protein, 4 aa, Entamoeba invadens
KKTC

SEQ ID NO: 3034103 - protein, 14 aa, Entamoeba invadens
KKTDCYDKNNCTYS

SEQ ID NO: 3034104 - protein, 11 aa, Entamoeba invadens
KKTEEVKNPTR

SEQ ID NO: 3034105 - protein, 8 aa, Entamoeba invadens
KKTGKTLT

SEQ ID NO: 3034106 - protein, 4 aa, Entamoeba invadens
KKTI

SEQ ID NO: 3034107 - protein, 15 aa, Entamoeba invadens
KKTKKPYEYEKSVTA

SEQ ID NO: 3034108 - protein, 10 aa, Entamoeba invadens
KKTKKTTKTA

SEQ ID NO: 3034109 - protein, 8 aa, Entamoeba invadens
KKTLDGDN

SEQ ID NO: 3034110 - protein, 8 aa, Entamoeba invadens
KKTNELDN

SEQ ID NO: 3034111 - protein, 5 aa, Entamoeba invadens
KKTNN

SEQ ID NO: 3034112 - protein, 9 aa, Entamoeba invadens
KKTPGETVN

SEQ ID NO: 3034113 - protein, 11 aa, Entamoeba invadens
KKTQTAYATGT

SEQ ID NO: 3034114 - protein, 15 aa, Entamoeba invadens
KKTVSTAESCTSGKI

SEQ ID NO: 3034115 - protein, 5 aa, Entamoeba invadens
KKTYI

SEQ ID NO: 3034116 - protein, 4 aa, Entamoeba invadens
KKVE

SEQ ID NO: 3034117 - protein, 10 aa, Entamoeba invadens
KKVEEGETTI

SEQ ID NO: 3034118 - protein, 8 aa, Entamoeba invadens
KKVERTNK

SEQ ID NO: 3034119 - protein, 21 aa, Entamoeba invadens
KKVGEKAEKKFGKLGKSITKK

SEQ ID NO: 3034120 - protein, 8 aa, Entamoeba invadens
KKVGSNEV

SEQ ID NO: 3034121 - protein, 14 aa, Entamoeba invadens
KKVNRQLRKSKKHL

SEQ ID NO: 3034122 - protein, 13 aa, Entamoeba invadens
KKVTKNDEENSIA

SEQ ID NO: 3034123 - protein, 9 aa, Entamoeba invadens
KKVTYDGVS

SEQ ID NO: 3034124 - protein, 9 aa, Entamoeba invadens
KKYDSCECT

SEQ ID NO: 3034125 - protein, 5 aa, Entamoeba invadens
KKYEG

SEQ ID NO: 3034126 - protein, 15 aa, Entamoeba invadens
KKYEQKSTMTNVRDQ

SEQ ID NO: 3034127 - protein, 4 aa, Entamoeba invadens
KKYG

SEQ ID NO: 3034128 - protein, 4 aa, Entamoeba invadens
KKYI

SEQ ID NO: 3034129 - protein, 7 aa, Entamoeba invadens
KKYITPA

SEQ ID NO: 3034130 - protein, 9 aa, Entamoeba invadens
KKYKKPSDV

SEQ ID NO: 3034131 - protein, 7 aa, Entamoeba invadens
KKYPKIQ

SEQ ID NO: 3034132 - protein, 7 aa, Entamoeba invadens
KKYSGNE

SEQ ID NO: 3034133 - protein, 6 aa, Entamoeba invadens
KKYTTQ

SEQ ID NO: 3034134 - protein, 35 aa, Entamoeba invadens
KLAAEQKALEEKAKNEQNEKKKKELEDKQKEIERQ

SEQ ID NO: 3034135 - protein, 10 aa, Entamoeba invadens
KLAEKNGMSD

SEQ ID NO: 3034136 - protein, 8 aa, Entamoeba invadens
KLAKKYAT

SEQ ID NO: 3034137 - protein, 7 aa, Entamoeba invadens
KLALSSP

SEQ ID NO: 3034138 - protein, 9 aa, Entamoeba invadens
KLATKQTTA

SEQ ID NO: 3034139 - protein, 5 aa, Entamoeba invadens
KLATS

SEQ ID NO: 3034140 - protein, 14 aa, Entamoeba invadens
KLDNVENEGERKKL

SEQ ID NO: 3034141 - protein, 11 aa, Entamoeba invadens
KLDTEGCDGGC

SEQ ID NO: 3034142 - protein, 5 aa, Entamoeba invadens
KLEGG

SEQ ID NO: 3034143 - protein, 12 aa, Entamoeba invadens
KLEKDNHTQSDK

SEQ ID NO: 3034144 - protein, 63 aa, Entamoeba invadens
KLEKSTTKKLGKTSSKRKQEQIKKNAQIKAKRLQKNAQLKAQRLRNNAKIQAQKKKAAAIKKE

SEQ ID NO: 3034145 - protein, 4 aa, Entamoeba invadens
KLES

SEQ ID NO: 3034146 - protein, 10 aa, Entamoeba invadens
KLGKPGERNQ

SEQ ID NO: 3034147 - protein, 8 aa, Entamoeba invadens
KLGRSTTE

SEQ ID NO: 3034148 - protein, 6 aa, Entamoeba invadens
KLGTPN

SEQ ID NO: 3034149 - protein, 6 aa, Entamoeba invadens
KLKQKE

SEQ ID NO: 3034150 - protein, 19 aa, Entamoeba invadens
KLKQSQKKNVNTTEKDKIK

SEQ ID NO: 3034151 - protein, 8 aa, Entamoeba invadens
KLKSGGVA

SEQ ID NO: 3034152 - protein, 11 aa, Entamoeba invadens
KLNKGKCENKG

SEQ ID NO: 3034153 - protein, 7 aa, Entamoeba invadens
KLPGDYE

SEQ ID NO: 3034154 - protein, 5 aa, Entamoeba invadens
KLPPS

SEQ ID NO: 3034155 - protein, 12 aa, Entamoeba invadens
KLPSTKAESKSF

SEQ ID NO: 3034156 - protein, 8 aa, Entamoeba invadens
KLQIGQSE

SEQ ID NO: 3034157 - protein, 5 aa, Entamoeba invadens
KLQTV

SEQ ID NO: 3034158 - protein, 10 aa, Entamoeba invadens
KLSGNSKNYT

SEQ ID NO: 3034159 - protein, 12 aa, Entamoeba invadens
KLSGTKNSIENT

SEQ ID NO: 3034160 - protein, 19 aa, Entamoeba invadens
KLSQKNENDEEQKSKLRNK

SEQ ID NO: 3034161 - protein, 22 aa, Entamoeba invadens
KLSSNKTSCNTNCPAGEIANNN

SEQ ID NO: 3034162 - protein, 9 aa, Entamoeba invadens
KLSTDGQTC

SEQ ID NO: 3034163 - protein, 8 aa, Entamoeba invadens
KLTGDDCD

SEQ ID NO: 3034164 - protein, 35 aa, Entamoeba invadens
KLTVSGGAKRKNTNGNKSSEGNLKAEYTGKKVQAT

SEQ ID NO: 3034165 - protein, 18 aa, Entamoeba invadens
KMERNNKDILKIRKLLHS

SEQ ID NO: 3034166 - protein, 11 aa, Entamoeba invadens
KMGNTTKLESL

SEQ ID NO: 3034167 - protein, 20 aa, Entamoeba invadens
KMGSKGCPNGLSQKTRNKLA

SEQ ID NO: 3034168 - protein, 5 aa, Entamoeba invadens
KMKDD

SEQ ID NO: 3034169 - protein, 6 aa, Entamoeba invadens
KMKQAE

SEQ ID NO: 3034170 - protein, 8 aa, Entamoeba invadens
KMNDDKKP

SEQ ID NO: 3034171 - protein, 7 aa, Entamoeba invadens
KMNPTNI

SEQ ID NO: 3034172 - protein, 7 aa, Entamoeba invadens
KMNTNTS

SEQ ID NO: 3034173 - protein, 20 aa, Entamoeba invadens
KMREGEDKKEKSNIDARNEL

SEQ ID NO: 3034174 - protein, 6 aa, Entamoeba invadens
KMTTSY

SEQ ID NO: 3034175 - protein, 8 aa, Entamoeba invadens
KMTVGNNS

SEQ ID NO: 3034176 - protein, 8 aa, Entamoeba invadens
KNAANTLP

SEQ ID NO: 3034177 - protein, 13 aa, Entamoeba invadens
KNAASAGFTAKTS

SEQ ID NO: 3034178 - protein, 5 aa, Entamoeba invadens
KNAGI

SEQ ID NO: 3034179 - protein, 10 aa, Entamoeba invadens
KNAKKVSSEL

SEQ ID NO: 3034180 - protein, 10 aa, Entamoeba invadens
KNANAAGFTI

SEQ ID NO: 3034181 - protein, 13 aa, Entamoeba invadens
KNAPGTVSEIRTP

SEQ ID NO: 3034182 - protein, 10 aa, Entamoeba invadens
KNAQTKNNGC

SEQ ID NO: 3034183 - protein, 5 aa, Entamoeba invadens
KNCDA

SEQ ID NO: 3034184 - protein, 6 aa, Entamoeba invadens
KNDMEY

SEQ ID NO: 3034185 - protein, 7 aa, Entamoeba invadens
KNDNYPP

SEQ ID NO: 3034186 - protein, 7 aa, Entamoeba invadens
KNDQKTC

SEQ ID NO: 3034187 - protein, 16 aa, Entamoeba invadens
KNEANEKKKTQNELTE

SEQ ID NO: 3034188 - protein, 7 aa, Entamoeba invadens
KNEIEEM

SEQ ID NO: 3034189 - protein, 7 aa, Entamoeba invadens
KNEIVSG

SEQ ID NO: 3034190 - protein, 12 aa, Entamoeba invadens
KNEKGRCPYSDQ

SEQ ID NO: 3034191 - protein, 7 aa, Entamoeba invadens
KNEKKTL

SEQ ID NO: 3034192 - protein, 15 aa, Entamoeba invadens
KNEKRVNELKNSIEE

SEQ ID NO: 3034193 - protein, 7 aa, Entamoeba invadens
KNEMRKA

SEQ ID NO: 3034194 - protein, 7 aa, Entamoeba invadens
KNENGAI

SEQ ID NO: 3034195 - protein, 4 aa, Entamoeba invadens
KNEP

SEQ ID NO: 3034196 - protein, 8 aa, Entamoeba invadens
KNESFSNN

SEQ ID NO: 3034197 - protein, 7 aa, Entamoeba invadens
KNEVREK

SEQ ID NO: 3034198 - protein, 6 aa, Entamoeba invadens
KNGDES

SEQ ID NO: 3034199 - protein, 13 aa, Entamoeba invadens
KNGEAISKGLDKV

SEQ ID NO: 3034200 - protein, 6 aa, Entamoeba invadens
KNGFDS

SEQ ID NO: 3034201 - protein, 16 aa, Entamoeba invadens
KNGGVPNERGICNSSP

SEQ ID NO: 3034202 - protein, 7 aa, Entamoeba invadens
KNGNDFK

SEQ ID NO: 3034203 - protein, 6 aa, Entamoeba invadens
KNGRFE

SEQ ID NO: 3034204 - protein, 4 aa, Entamoeba invadens
KNGT

SEQ ID NO: 3034205 - protein, 4 aa, Entamoeba invadens
KNIE

SEQ ID NO: 3034206 - protein, 27 aa, Entamoeba invadens
KNIEEQLTKTNDEKMKVEGELKNAKKV

SEQ ID NO: 3034207 - protein, 39 aa, Entamoeba invadens
KNKATQSIQKAETKTASSVAKIAKGVSKAVASKIPTRAL

SEQ ID NO: 3034208 - protein, 15 aa, Entamoeba invadens
KNKETTYSPSKSKEV

SEQ ID NO: 3034209 - protein, 7 aa, Entamoeba invadens
KNKFNPT

SEQ ID NO: 3034210 - protein, 4 aa, Entamoeba invadens
KNKG

SEQ ID NO: 3034211 - protein, 10 aa, Entamoeba invadens
KNKKGTDIQK

SEQ ID NO: 3034212 - protein, 13 aa, Entamoeba invadens
KNKKQRQNSICSL

SEQ ID NO: 3034213 - protein, 5 aa, Entamoeba invadens
KNKNI

SEQ ID NO: 3034214 - protein, 5 aa, Entamoeba invadens
KNKNL

SEQ ID NO: 3034215 - protein, 6 aa, Entamoeba invadens
KNKPKR

SEQ ID NO: 3034216 - protein, 12 aa, Entamoeba invadens
KNKPTRKQCGIQ

SEQ ID NO: 3034217 - protein, 20 aa, Entamoeba invadens
KNLANDKDQLSSEKKRNIAD

SEQ ID NO: 3034218 - protein, 13 aa, Entamoeba invadens
KNMEDQAKALNAQ

SEQ ID NO: 3034219 - protein, 15 aa, Entamoeba invadens
KNMETSSMRYTKSGD

SEQ ID NO: 3034220 - protein, 9 aa, Entamoeba invadens
KNNDNGGGD

SEQ ID NO: 3034221 - protein, 16 aa, Entamoeba invadens
KNNEKIEQNGRCSVTQ

SEQ ID NO: 3034222 - protein, 8 aa, Entamoeba invadens
KNNKITAA

SEQ ID NO: 3034223 - protein, 16 aa, Entamoeba invadens
KNNKITTASLHPGGVN

SEQ ID NO: 3034224 - protein, 8 aa, Entamoeba invadens
KNNNNNVF

SEQ ID NO: 3034225 - protein, 5 aa, Entamoeba invadens
KNNQE

SEQ ID NO: 3034226 - protein, 7 aa, Entamoeba invadens
KNNTEWQ

SEQ ID NO: 3034227 - protein, 5 aa, Entamoeba invadens
KNNVD

SEQ ID NO: 3034228 - protein, 5 aa, Entamoeba invadens
KNPES

SEQ ID NO: 3034229 - protein, 10 aa, Entamoeba invadens
KNPETIETIG

SEQ ID NO: 3034230 - protein, 10 aa, Entamoeba invadens
KNPNGEQNQT

SEQ ID NO: 3034231 - protein, 9 aa, Entamoeba invadens
KNPQNNGIK

SEQ ID NO: 3034232 - protein, 9 aa, Entamoeba invadens
KNPSNGTVS

SEQ ID NO: 3034233 - protein, 7 aa, Entamoeba invadens
KNQIEDE

SEQ ID NO: 3034234 - protein, 20 aa, Entamoeba invadens
KNQKRIAEEAKKQRDEKINK

SEQ ID NO: 3034235 - protein, 4 aa, Entamoeba invadens
KNRI

SEQ ID NO: 3034236 - protein, 4 aa, Entamoeba invadens
KNRK

SEQ ID NO: 3034237 - protein, 5 aa, Entamoeba invadens
KNRNE

SEQ ID NO: 3034238 - protein, 9 aa, Entamoeba invadens
KNRRVFGSR

SEQ ID NO: 3034239 - protein, 8 aa, Entamoeba invadens
KNSFYGRS

SEQ ID NO: 3034240 - protein, 6 aa, Entamoeba invadens
KNSKRM

SEQ ID NO: 3034241 - protein, 9 aa, Entamoeba invadens
KNSQPKTKK

SEQ ID NO: 3034242 - protein, 7 aa, Entamoeba invadens
KNSSTNS

SEQ ID NO: 3034243 - protein, 9 aa, Entamoeba invadens
KNSTGSVSC

SEQ ID NO: 3034244 - protein, 5 aa, Entamoeba invadens
KNSTH

SEQ ID NO: 3034245 - protein, 8 aa, Entamoeba invadens
KNTENITS

SEQ ID NO: 3034246 - protein, 8 aa, Entamoeba invadens
KNTGIKAE

SEQ ID NO: 3034247 - protein, 10 aa, Entamoeba invadens
KNTNQEEVIQ

SEQ ID NO: 3034248 - protein, 8 aa, Entamoeba invadens
KNTQITGK

SEQ ID NO: 3034249 - protein, 5 aa, Entamoeba invadens
KNTTF

SEQ ID NO: 3034250 - protein, 5 aa, Entamoeba invadens
KNVEE

SEQ ID NO: 3034251 - protein, 7 aa, Entamoeba invadens
KNVESHR

SEQ ID NO: 3034252 - protein, 12 aa, Entamoeba invadens
KNVIKTASSKLK

SEQ ID NO: 3034253 - protein, 46 aa, Entamoeba invadens
KNYDKQKRGSKDSKEANENKETKEKTSPKVEQTEELDNLNGRSKSK

SEQ ID NO: 3034254 - protein, 7 aa, Entamoeba invadens
KNYESTN

SEQ ID NO: 3034255 - protein, 5 aa, Entamoeba invadens
KNYKK

SEQ ID NO: 3034256 - protein, 12 aa, Entamoeba invadens
KNYREEKNSCGN

SEQ ID NO: 3034257 - protein, 5 aa, Entamoeba invadens
KNYRL

SEQ ID NO: 3034258 - protein, 7 aa, Entamoeba invadens
KNYSRNK

SEQ ID NO: 3034259 - protein, 5 aa, Entamoeba invadens
KNYTY

SEQ ID NO: 3034260 - protein, 7 aa, Entamoeba invadens
KPAEREF

SEQ ID NO: 3034261 - protein, 14 aa, Entamoeba invadens
KPDESFNRTETSIV

SEQ ID NO: 3034262 - protein, 6 aa, Entamoeba invadens
KPDNGK

SEQ ID NO: 3034263 - protein, 15 aa, Entamoeba invadens
KPEEEEKEQEQQKTE

SEQ ID NO: 3034264 - protein, 6 aa, Entamoeba invadens
KPETFE

SEQ ID NO: 3034265 - protein, 6 aa, Entamoeba invadens
KPFDNT

SEQ ID NO: 3034266 - protein, 7 aa, Entamoeba invadens
KPFPPKA

SEQ ID NO: 3034267 - protein, 4 aa, Entamoeba invadens
KPGD

SEQ ID NO: 3034268 - protein, 8 aa, Entamoeba invadens
KPGQCYKT

SEQ ID NO: 3034269 - protein, 7 aa, Entamoeba invadens
KPGSTTG

SEQ ID NO: 3034270 - protein, 5 aa, Entamoeba invadens
KPIEK

SEQ ID NO: 3034271 - protein, 5 aa, Entamoeba invadens
KPIKC

SEQ ID NO: 3034272 - protein, 13 aa, Entamoeba invadens
KPKNEKDTADSGN

SEQ ID NO: 3034273 - protein, 21 aa, Entamoeba invadens
KPKQEQKENSEQVQPQKKDGC

SEQ ID NO: 3034274 - protein, 5 aa, Entamoeba invadens
KPKRT

SEQ ID NO: 3034275 - protein, 6 aa, Entamoeba invadens
KPLDAD

SEQ ID NO: 3034276 - protein, 4 aa, Entamoeba invadens
KPNF

SEQ ID NO: 3034277 - protein, 11 aa, Entamoeba invadens
KPNGQIQEKNN

SEQ ID NO: 3034278 - protein, 7 aa, Entamoeba invadens
KPNSTTT

SEQ ID NO: 3034279 - protein, 11 aa, Entamoeba invadens
KPPLAEGTKNQ

SEQ ID NO: 3034280 - protein, 11 aa, Entamoeba invadens
KPPLDAETRNQ

SEQ ID NO: 3034281 - protein, 11 aa, Entamoeba invadens
KPPLDAGTKNQ

SEQ ID NO: 3034282 - protein, 11 aa, Entamoeba invadens
KPPLDEGTNNQ

SEQ ID NO: 3034283 - protein, 29 aa, Entamoeba invadens
KPQQTKKSKVIDKKKAEVKNKKQKLRARK

SEQ ID NO: 3034284 - protein, 16 aa, Entamoeba invadens
KPQTPEHPPPKERPKV

SEQ ID NO: 3034285 - protein, 9 aa, Entamoeba invadens
KPQTTKTLG

SEQ ID NO: 3034286 - protein, 7 aa, Entamoeba invadens
KPRKSVP

SEQ ID NO: 3034287 - protein, 8 aa, Entamoeba invadens
KPRKSVPV

SEQ ID NO: 3034288 - protein, 6 aa, Entamoeba invadens
KPRPFG

SEQ ID NO: 3034289 - protein, 27 aa, Entamoeba invadens
KPSITKKSKASFTTKKKTSLNRRKATF

SEQ ID NO: 3034290 - protein, 4 aa, Entamoeba invadens
KPTI

SEQ ID NO: 3034291 - protein, 4 aa, Entamoeba invadens
KPTL

SEQ ID NO: 3034292 - protein, 5 aa, Entamoeba invadens
KPTMH

SEQ ID NO: 3034293 - protein, 30 aa, Entamoeba invadens
KPTPVSTEKEFKKENYKNNQTTDEQDKETP

SEQ ID NO: 3034294 - protein, 5 aa, Entamoeba invadens
KPTTH

SEQ ID NO: 3034295 - protein, 7 aa, Entamoeba invadens
KPVETPV

SEQ ID NO: 3034296 - protein, 4 aa, Entamoeba invadens
KPVF

SEQ ID NO: 3034297 - protein, 7 aa, Entamoeba invadens
KPVGTQC

SEQ ID NO: 3034298 - protein, 6 aa, Entamoeba invadens
KPVPRS

SEQ ID NO: 3034299 - protein, 6 aa, Entamoeba invadens
KPYDPK

SEQ ID NO: 3034300 - protein, 4 aa, Entamoeba invadens
KPYG

SEQ ID NO: 3034301 - protein, 10 aa, Entamoeba invadens
KQADSLTGVE

SEQ ID NO: 3034302 - protein, 16 aa, Entamoeba invadens
KQAPKELNSEINDGDE

SEQ ID NO: 3034303 - protein, 5 aa, Entamoeba invadens
KQATD

SEQ ID NO: 3034304 - protein, 9 aa, Entamoeba invadens
KQCEDGYSP

SEQ ID NO: 3034305 - protein, 6 aa, Entamoeba invadens
KQCTTC

SEQ ID NO: 3034306 - protein, 9 aa, Entamoeba invadens
KQDADQIKS

SEQ ID NO: 3034307 - protein, 13 aa, Entamoeba invadens
KQEEDDMTDDEKT

SEQ ID NO: 3034308 - protein, 12 aa, Entamoeba invadens
KQEGISSKTKTL

SEQ ID NO: 3034309 - protein, 4 aa, Entamoeba invadens
KQET

SEQ ID NO: 3034310 - protein, 6 aa, Entamoeba invadens
KQFRAA

SEQ ID NO: 3034311 - protein, 4 aa, Entamoeba invadens
KQFT

SEQ ID NO: 3034312 - protein, 4 aa, Entamoeba invadens
KQGI

SEQ ID NO: 3034313 - protein, 5 aa, Entamoeba invadens
KQGNE

SEQ ID NO: 3034314 - protein, 15 aa, Entamoeba invadens
KQGQPNKNAPDNTDK

SEQ ID NO: 3034315 - protein, 12 aa, Entamoeba invadens
KQGVTATIGADE

SEQ ID NO: 3034316 - protein, 4 aa, Entamoeba invadens
KQGY

SEQ ID NO: 3034317 - protein, 7 aa, Entamoeba invadens
KQGYQDG

SEQ ID NO: 3034318 - protein, 11 aa, Entamoeba invadens
KQHVSTPLTQT

SEQ ID NO: 3034319 - protein, 9 aa, Entamoeba invadens
KQIGKDQAK

SEQ ID NO: 3034320 - protein, 17 aa, Entamoeba invadens
KQKGGPMNTPSAEKSKL

SEQ ID NO: 3034321 - protein, 9 aa, Entamoeba invadens
KQKKTSGII

SEQ ID NO: 3034322 - protein, 6 aa, Entamoeba invadens
KQLDNN

SEQ ID NO: 3034323 - protein, 63 aa, Entamoeba invadens
KQLGKTAKKLMKGGKLDLSAKNMKKTAKKMGKEFGKSVGKDVKNQMKKGKKIAKKATKGMKKG

SEQ ID NO: 3034324 - protein, 8 aa, Entamoeba invadens
KQLNQQKK

SEQ ID NO: 3034325 - protein, 5 aa, Entamoeba invadens
KQLTD

SEQ ID NO: 3034326 - protein, 9 aa, Entamoeba invadens
KQMDSGNNH

SEQ ID NO: 3034327 - protein, 14 aa, Entamoeba invadens
KQNDFSSKHEGTGF

SEQ ID NO: 3034328 - protein, 8 aa, Entamoeba invadens
KQNELKQK

SEQ ID NO: 3034329 - protein, 11 aa, Entamoeba invadens
KQNGQPQGDQA

SEQ ID NO: 3034330 - protein, 6 aa, Entamoeba invadens
KQNMTR

SEQ ID NO: 3034331 - protein, 7 aa, Entamoeba invadens
KQNQITG

SEQ ID NO: 3034332 - protein, 11 aa, Entamoeba invadens
KQNTNKSESLG

SEQ ID NO: 3034333 - protein, 8 aa, Entamoeba invadens
KQNVESQM

SEQ ID NO: 3034334 - protein, 5 aa, Entamoeba invadens
KQNYD

SEQ ID NO: 3034335 - protein, 10 aa, Entamoeba invadens
KQPPTKKHSY

SEQ ID NO: 3034336 - protein, 7 aa, Entamoeba invadens
KQPTIDE

SEQ ID NO: 3034337 - protein, 5 aa, Entamoeba invadens
KQPVA

SEQ ID NO: 3034338 - protein, 12 aa, Entamoeba invadens
KQQMEHPEEFTK

SEQ ID NO: 3034339 - protein, 10 aa, Entamoeba invadens
KQQRERGRYV

SEQ ID NO: 3034340 - protein, 9 aa, Entamoeba invadens
KQQTHRANI

SEQ ID NO: 3034341 - protein, 16 aa, Entamoeba invadens
KQRTSENLIEFAKSHA

SEQ ID NO: 3034342 - protein, 8 aa, Entamoeba invadens
KQRVNDNA

SEQ ID NO: 3034343 - protein, 8 aa, Entamoeba invadens
KQSCEPCQ

SEQ ID NO: 3034344 - protein, 7 aa, Entamoeba invadens
KQSGQKE

SEQ ID NO: 3034345 - protein, 6 aa, Entamoeba invadens
KQSKYA

SEQ ID NO: 3034346 - protein, 6 aa, Entamoeba invadens
KQSNDV

SEQ ID NO: 3034347 - protein, 7 aa, Entamoeba invadens
KQSTSRD

SEQ ID NO: 3034348 - protein, 6 aa, Entamoeba invadens
KQTFEP

SEQ ID NO: 3034349 - protein, 11 aa, Entamoeba invadens
KQTMDGTDPLG

SEQ ID NO: 3034350 - protein, 18 aa, Entamoeba invadens
KQTSQKATLTPLSSCTKG

SEQ ID NO: 3034351 - protein, 7 aa, Entamoeba invadens
KQTVKGY

SEQ ID NO: 3034352 - protein, 13 aa, Entamoeba invadens
KQVTNQNTGNEEC

SEQ ID NO: 3034353 - protein, 5 aa, Entamoeba invadens
KQYTD

SEQ ID NO: 3034354 - protein, 7 aa, Entamoeba invadens
KRAGNYA

SEQ ID NO: 3034355 - protein, 6 aa, Entamoeba invadens
KRCKND

SEQ ID NO: 3034356 - protein, 12 aa, Entamoeba invadens
KRDEENKESFTE

SEQ ID NO: 3034357 - protein, 7 aa, Entamoeba invadens
KRDEETC

SEQ ID NO: 3034358 - protein, 22 aa, Entamoeba invadens
KRDENGKLVSNAQANLKVGGAD

SEQ ID NO: 3034359 - protein, 6 aa, Entamoeba invadens
KRDPTI

SEQ ID NO: 3034360 - protein, 6 aa, Entamoeba invadens
KRDVGD

SEQ ID NO: 3034361 - protein, 10 aa, Entamoeba invadens
KREEKEIEAL

SEQ ID NO: 3034362 - protein, 6 aa, Entamoeba invadens
KREENK

SEQ ID NO: 3034363 - protein, 6 aa, Entamoeba invadens
KREKEN

SEQ ID NO: 3034364 - protein, 10 aa, Entamoeba invadens
KREKETESDA

SEQ ID NO: 3034365 - protein, 5 aa, Entamoeba invadens
KRERL

SEQ ID NO: 3034366 - protein, 13 aa, Entamoeba invadens
KREYDNSACYGKS

SEQ ID NO: 3034367 - protein, 6 aa, Entamoeba invadens
KREYRK

SEQ ID NO: 3034368 - protein, 12 aa, Entamoeba invadens
KRGTIKNENNIC

SEQ ID NO: 3034369 - protein, 6 aa, Entamoeba invadens
KRIEDK

SEQ ID NO: 3034370 - protein, 6 aa, Entamoeba invadens
KRIKKT

SEQ ID NO: 3034371 - protein, 5 aa, Entamoeba invadens
KRITD

SEQ ID NO: 3034372 - protein, 5 aa, Entamoeba invadens
KRKCG

SEQ ID NO: 3034373 - protein, 9 aa, Entamoeba invadens
KRKENTDMY

SEQ ID NO: 3034374 - protein, 8 aa, Entamoeba invadens
KRKLKGDF

SEQ ID NO: 3034375 - protein, 13 aa, Entamoeba invadens
KRKPFEGERSLTG

SEQ ID NO: 3034376 - protein, 4 aa, Entamoeba invadens
KRKV

SEQ ID NO: 3034377 - protein, 5 aa, Entamoeba invadens
KRLAR

SEQ ID NO: 3034378 - protein, 4 aa, Entamoeba invadens
KRLE

SEQ ID NO: 3034379 - protein, 10 aa, Entamoeba invadens
KRMSRNDETL

SEQ ID NO: 3034380 - protein, 6 aa, Entamoeba invadens
KRNAPF

SEQ ID NO: 3034381 - protein, 12 aa, Entamoeba invadens
KRPEETKQGFTE

SEQ ID NO: 3034382 - protein, 8 aa, Entamoeba invadens
KRPSIAKR

SEQ ID NO: 3034383 - protein, 5 aa, Entamoeba invadens
KRQDG

SEQ ID NO: 3034384 - protein, 5 aa, Entamoeba invadens
KRRET

SEQ ID NO: 3034385 - protein, 7 aa, Entamoeba invadens
KRRGQQS

SEQ ID NO: 3034386 - protein, 6 aa, Entamoeba invadens
KRRGVT

SEQ ID NO: 3034387 - protein, 9 aa, Entamoeba invadens
KRSADSERS

SEQ ID NO: 3034388 - protein, 28 aa, Entamoeba invadens
KRSHQDSEEEEDNSVSTQKESLKSFPET

SEQ ID NO: 3034389 - protein, 24 aa, Entamoeba invadens
KRSKEQENALSENEKTSRKTAKRR

SEQ ID NO: 3034390 - protein, 4 aa, Entamoeba invadens
KRSS

SEQ ID NO: 3034391 - protein, 8 aa, Entamoeba invadens
KRSSEQYN

SEQ ID NO: 3034392 - protein, 5 aa, Entamoeba invadens
KRTEG

SEQ ID NO: 3034393 - protein, 8 aa, Entamoeba invadens
KRTETGSV

SEQ ID NO: 3034394 - protein, 4 aa, Entamoeba invadens
KRTH

SEQ ID NO: 3034395 - protein, 4 aa, Entamoeba invadens
KRTI

SEQ ID NO: 3034396 - protein, 25 aa, Entamoeba invadens
KRTQKSFKSRQNGIKQNTKKFTSKL

SEQ ID NO: 3034397 - protein, 15 aa, Entamoeba invadens
KRTVKTEKKQVKQAK

SEQ ID NO: 3034398 - protein, 7 aa, Entamoeba invadens
KRVARKA

SEQ ID NO: 3034399 - protein, 4 aa, Entamoeba invadens
KRVE

SEQ ID NO: 3034400 - protein, 14 aa, Entamoeba invadens
KRVSQSSKKSTTNK

SEQ ID NO: 3034401 - protein, 12 aa, Entamoeba invadens
KRVTDGNEAGLQ

SEQ ID NO: 3034402 - protein, 12 aa, Entamoeba invadens
KRVTDGSETGLQ

SEQ ID NO: 3034403 - protein, 6 aa, Entamoeba invadens
KRYEEA

SEQ ID NO: 3034404 - protein, 6 aa, Entamoeba invadens
KSAEYT

SEQ ID NO: 3034405 - protein, 9 aa, Entamoeba invadens
KSAINRNEV

SEQ ID NO: 3034406 - protein, 7 aa, Entamoeba invadens
KSANGIK

SEQ ID NO: 3034407 - protein, 6 aa, Entamoeba invadens
KSAQIY

SEQ ID NO: 3034408 - protein, 7 aa, Entamoeba invadens
KSASKVL

SEQ ID NO: 3034409 - protein, 16 aa, Entamoeba invadens
KSASVSAFKAGNTKIE

SEQ ID NO: 3034410 - protein, 11 aa, Entamoeba invadens
KSCEDSTYKYA

SEQ ID NO: 3034411 - protein, 11 aa, Entamoeba invadens
KSCKDGETCDK

SEQ ID NO: 3034412 - protein, 8 aa, Entamoeba invadens
KSCSDATS

SEQ ID NO: 3034413 - protein, 6 aa, Entamoeba invadens
KSDAPP

SEQ ID NO: 3034414 - protein, 10 aa, Entamoeba invadens
KSDGTEEYTG

SEQ ID NO: 3034415 - protein, 15 aa, Entamoeba invadens
KSDNPKIAIDPKEMK

SEQ ID NO: 3034416 - protein, 11 aa, Entamoeba invadens
KSDQKDKYSNC

SEQ ID NO: 3034417 - protein, 5 aa, Entamoeba invadens
KSDRT

SEQ ID NO: 3034418 - protein, 7 aa, Entamoeba invadens
KSEFTDD

SEQ ID NO: 3034419 - protein, 15 aa, Entamoeba invadens
KSEIGKKASEEIGKH

SEQ ID NO: 3034420 - protein, 14 aa, Entamoeba invadens
KSEKKKEDTESYKD

SEQ ID NO: 3034421 - protein, 13 aa, Entamoeba invadens
KSELKTKHSSYPS

SEQ ID NO: 3034422 - protein, 8 aa, Entamoeba invadens
KSENEFDR

SEQ ID NO: 3034423 - protein, 5 aa, Entamoeba invadens
KSENF

SEQ ID NO: 3034424 - protein, 7 aa, Entamoeba invadens
KSENFEN

SEQ ID NO: 3034425 - protein, 5 aa, Entamoeba invadens
KSERS

SEQ ID NO: 3034426 - protein, 6 aa, Entamoeba invadens
KSFEIE

SEQ ID NO: 3034427 - protein, 6 aa, Entamoeba invadens
KSFNRI

SEQ ID NO: 3034428 - protein, 10 aa, Entamoeba invadens
KSGENITSIE

SEQ ID NO: 3034429 - protein, 8 aa, Entamoeba invadens
KSGIPNAS

SEQ ID NO: 3034430 - protein, 13 aa, Entamoeba invadens
KSGKKSGAGRYRD

SEQ ID NO: 3034431 - protein, 4 aa, Entamoeba invadens
KSGL

SEQ ID NO: 3034432 - protein, 7 aa, Entamoeba invadens
KSGLKKG

SEQ ID NO: 3034433 - protein, 10 aa, Entamoeba invadens
KSGNCLSGPG

SEQ ID NO: 3034434 - protein, 6 aa, Entamoeba invadens
KSGYTF

SEQ ID NO: 3034435 - protein, 7 aa, Entamoeba invadens
KSGYTFK

SEQ ID NO: 3034436 - protein, 11 aa, Entamoeba invadens
KSGYYNNSNTC

SEQ ID NO: 3034437 - protein, 6 aa, Entamoeba invadens
KSIATD

SEQ ID NO: 3034438 - protein, 5 aa, Entamoeba invadens
KSIEE

SEQ ID NO: 3034439 - protein, 10 aa, Entamoeba invadens
KSIPKRDAYV

SEQ ID NO: 3034440 - protein, 8 aa, Entamoeba invadens
KSIPKRQA

SEQ ID NO: 3034441 - protein, 7 aa, Entamoeba invadens
KSITKTT

SEQ ID NO: 3034442 - protein, 9 aa, Entamoeba invadens
KSKEGRSKI

SEQ ID NO: 3034443 - protein, 19 aa, Entamoeba invadens
KSKIEGVTSELDTTKEEKM

SEQ ID NO: 3034444 - protein, 4 aa, Entamoeba invadens
KSKL

SEQ ID NO: 3034445 - protein, 14 aa, Entamoeba invadens
KSKNGPIDEKESMR

SEQ ID NO: 3034446 - protein, 7 aa, Entamoeba invadens
KSKNPNL

SEQ ID NO: 3034447 - protein, 7 aa, Entamoeba invadens
KSKNPSL

SEQ ID NO: 3034448 - protein, 7 aa, Entamoeba invadens
KSKPYDN

SEQ ID NO: 3034449 - protein, 5 aa, Entamoeba invadens
KSKTD

SEQ ID NO: 3034450 - protein, 6 aa, Entamoeba invadens
KSKTGD

SEQ ID NO: 3034451 - protein, 11 aa, Entamoeba invadens
KSKTPLATQSA

SEQ ID NO: 3034452 - protein, 7 aa, Entamoeba invadens
KSKYPTT

SEQ ID NO: 3034453 - protein, 24 aa, Entamoeba invadens
KSLDLSKKNLKSKAAEALKSPFDY

SEQ ID NO: 3034454 - protein, 8 aa, Entamoeba invadens
KSLEETGY

SEQ ID NO: 3034455 - protein, 10 aa, Entamoeba invadens
KSLGAKGPQF

SEQ ID NO: 3034456 - protein, 8 aa, Entamoeba invadens
KSLGKTNV

SEQ ID NO: 3034457 - protein, 5 aa, Entamoeba invadens
KSLGN

SEQ ID NO: 3034458 - protein, 8 aa, Entamoeba invadens
KSLNTFSE

SEQ ID NO: 3034459 - protein, 9 aa, Entamoeba invadens
KSLPDECGG

SEQ ID NO: 3034460 - protein, 14 aa, Entamoeba invadens
KSLPKDKQRDQTKL

SEQ ID NO: 3034461 - protein, 8 aa, Entamoeba invadens
KSLTPPEI

SEQ ID NO: 3034462 - protein, 7 aa, Entamoeba invadens
KSNDEAM

SEQ ID NO: 3034463 - protein, 4 aa, Entamoeba invadens
KSNI

SEQ ID NO: 3034464 - protein, 6 aa, Entamoeba invadens
KSNSST

SEQ ID NO: 3034465 - protein, 8 aa, Entamoeba invadens
KSQAERAF

SEQ ID NO: 3034466 - protein, 6 aa, Entamoeba invadens
KSQNSK

SEQ ID NO: 3034467 - protein, 24 aa, Entamoeba invadens
KSQVAQKNPNYGKVKKDKKPKKVA

SEQ ID NO: 3034468 - protein, 10 aa, Entamoeba invadens
KSQYKNKPDD

SEQ ID NO: 3034469 - protein, 8 aa, Entamoeba invadens
KSQYTDIT

SEQ ID NO: 3034470 - protein, 6 aa, Entamoeba invadens
KSRGLS

SEQ ID NO: 3034471 - protein, 11 aa, Entamoeba invadens
KSRKISKNVQT

SEQ ID NO: 3034472 - protein, 8 aa, Entamoeba invadens
KSRTNLEQ

SEQ ID NO: 3034473 - protein, 4 aa, Entamoeba invadens
KSSG

SEQ ID NO: 3034474 - protein, 5 aa, Entamoeba invadens
KSSRC

SEQ ID NO: 3034475 - protein, 5 aa, Entamoeba invadens
KSSSF

SEQ ID NO: 3034476 - protein, 8 aa, Entamoeba invadens
KSSTFSES

SEQ ID NO: 3034477 - protein, 10 aa, Entamoeba invadens
KSSTQSSGIV

SEQ ID NO: 3034478 - protein, 16 aa, Entamoeba invadens
KSTATADDKAKYQKSS

SEQ ID NO: 3034479 - protein, 5 aa, Entamoeba invadens
KSTCF

SEQ ID NO: 3034480 - protein, 12 aa, Entamoeba invadens
KSTGKTYKASEL

SEQ ID NO: 3034481 - protein, 5 aa, Entamoeba invadens
KSTIT

SEQ ID NO: 3034482 - protein, 6 aa, Entamoeba invadens
KSTLES

SEQ ID NO: 3034483 - protein, 8 aa, Entamoeba invadens
KSTQQARG

SEQ ID NO: 3034484 - protein, 7 aa, Entamoeba invadens
KSTSPAI

SEQ ID NO: 3034485 - protein, 4 aa, Entamoeba invadens
KSTT

SEQ ID NO: 3034486 - protein, 7 aa, Entamoeba invadens
KSTTDIS

SEQ ID NO: 3034487 - protein, 6 aa, Entamoeba invadens
KSTTRY

SEQ ID NO: 3034488 - protein, 18 aa, Entamoeba invadens
KSVDTTAKTLKKATEVGG

SEQ ID NO: 3034489 - protein, 27 aa, Entamoeba invadens
KSVEKSLEKSVATPSVDKNEDIPSCKE

SEQ ID NO: 3034490 - protein, 5 aa, Entamoeba invadens
KSVES

SEQ ID NO: 3034491 - protein, 8 aa, Entamoeba invadens
KSVKTGVE

SEQ ID NO: 3034492 - protein, 8 aa, Entamoeba invadens
KSVNLNNK

SEQ ID NO: 3034493 - protein, 7 aa, Entamoeba invadens
KSVTTSQ

SEQ ID NO: 3034494 - protein, 12 aa, Entamoeba invadens
KSYDKAKQGEWI

SEQ ID NO: 3034495 - protein, 8 aa, Entamoeba invadens
KSYQTQYN

SEQ ID NO: 3034496 - protein, 13 aa, Entamoeba invadens
KSYTTPDCSGEPL

SEQ ID NO: 3034497 - protein, 6 aa, Entamoeba invadens
KTAAEE

SEQ ID NO: 3034498 - protein, 31 aa, Entamoeba invadens
KTAKEEFKNKVDADEEKKYTESLKSLNGQRK

SEQ ID NO: 3034499 - protein, 7 aa, Entamoeba invadens
KTAKEEY

SEQ ID NO: 3034500 - protein, 9 aa, Entamoeba invadens
KTAQRTNCD

SEQ ID NO: 3034501 - protein, 5 aa, Entamoeba invadens
KTART

SEQ ID NO: 3034502 - protein, 14 aa, Entamoeba invadens
KTATASELKKAYRS

SEQ ID NO: 3034503 - protein, 6 aa, Entamoeba invadens
KTATCS

SEQ ID NO: 3034504 - protein, 16 aa, Entamoeba invadens
KTATDDELKKAYKKKA

SEQ ID NO: 3034505 - protein, 5 aa, Entamoeba invadens
KTATS

SEQ ID NO: 3034506 - protein, 6 aa, Entamoeba invadens
KTCEKC

SEQ ID NO: 3034507 - protein, 8 aa, Entamoeba invadens
KTCENEYK

SEQ ID NO: 3034508 - protein, 6 aa, Entamoeba invadens
KTCETK

SEQ ID NO: 3034509 - protein, 6 aa, Entamoeba invadens
KTCNSR

SEQ ID NO: 3034510 - protein, 39 aa, Entamoeba invadens
KTCNSTKCTACKDTNALQENMGSTTACQTCKDGYAYNSD

SEQ ID NO: 3034511 - protein, 9 aa, Entamoeba invadens
KTCSNNTNY

SEQ ID NO: 3034512 - protein, 22 aa, Entamoeba invadens
KTCSSCPDNTYSLQNSSTCTNC

SEQ ID NO: 3034513 - protein, 7 aa, Entamoeba invadens
KTCTEET

SEQ ID NO: 3034514 - protein, 16 aa, Entamoeba invadens
KTDEINYADKKRGPSD

SEQ ID NO: 3034515 - protein, 16 aa, Entamoeba invadens
KTDEINYADKNGGPSD

SEQ ID NO: 3034516 - protein, 9 aa, Entamoeba invadens
KTDIPNSIG

SEQ ID NO: 3034517 - protein, 14 aa, Entamoeba invadens
KTEAQKTFTPVSPT

SEQ ID NO: 3034518 - protein, 21 aa, Entamoeba invadens
KTEDSSCEKCSSKCSAGCTMR

SEQ ID NO: 3034519 - protein, 5 aa, Entamoeba invadens
KTEFE

SEQ ID NO: 3034520 - protein, 7 aa, Entamoeba invadens
KTEQAKM

SEQ ID NO: 3034521 - protein, 24 aa, Entamoeba invadens
KTEQEKTKKLNEELEKCQNEKEQI

SEQ ID NO: 3034522 - protein, 6 aa, Entamoeba invadens
KTETGA

SEQ ID NO: 3034523 - protein, 4 aa, Entamoeba invadens
KTFK

SEQ ID NO: 3034524 - protein, 8 aa, Entamoeba invadens
KTFREAAD

SEQ ID NO: 3034525 - protein, 4 aa, Entamoeba invadens
KTGA

SEQ ID NO: 3034526 - protein, 6 aa, Entamoeba invadens
KTGKGY

SEQ ID NO: 3034527 - protein, 5 aa, Entamoeba invadens
KTGNY

SEQ ID NO: 3034528 - protein, 9 aa, Entamoeba invadens
KTGSDPNKY

SEQ ID NO: 3034529 - protein, 6 aa, Entamoeba invadens
KTGSSL

SEQ ID NO: 3034530 - protein, 9 aa, Entamoeba invadens
KTGTGSTIW

SEQ ID NO: 3034531 - protein, 6 aa, Entamoeba invadens
KTHEME

SEQ ID NO: 3034532 - protein, 5 aa, Entamoeba invadens
KTHPA

SEQ ID NO: 3034533 - protein, 5 aa, Entamoeba invadens
KTHPT

SEQ ID NO: 3034534 - protein, 5 aa, Entamoeba invadens
KTIKI

SEQ ID NO: 3034535 - protein, 10 aa, Entamoeba invadens
KTKAEEEEAK

SEQ ID NO: 3034536 - protein, 8 aa, Entamoeba invadens
KTKEDEFK

SEQ ID NO: 3034537 - protein, 22 aa, Entamoeba invadens
KTKINRNKAYATGETPSPNYNV

SEQ ID NO: 3034538 - protein, 22 aa, Entamoeba invadens
KTKINRNKAYATGETPSSNYNV

SEQ ID NO: 3034539 - protein, 7 aa, Entamoeba invadens
KTKIPDV

SEQ ID NO: 3034540 - protein, 6 aa, Entamoeba invadens
KTKIVE

SEQ ID NO: 3034541 - protein, 10 aa, Entamoeba invadens
KTKKSEREMS

SEQ ID NO: 3034542 - protein, 39 aa, Entamoeba invadens
KTKLKELKEKKEKNEGLTDNGTGKNENSKDDSKNTINDG

SEQ ID NO: 3034543 - protein, 4 aa, Entamoeba invadens
KTKQ

SEQ ID NO: 3034544 - protein, 12 aa, Entamoeba invadens
KTKYYKTDKNVS

SEQ ID NO: 3034545 - protein, 10 aa, Entamoeba invadens
KTKYYRTNTS

SEQ ID NO: 3034546 - protein, 4 aa, Entamoeba invadens
KTLE

SEQ ID NO: 3034547 - protein, 5 aa, Entamoeba invadens
KTLSN

SEQ ID NO: 3034548 - protein, 13 aa, Entamoeba invadens
KTMSEENKKIANE

SEQ ID NO: 3034549 - protein, 22 aa, Entamoeba invadens
KTMTDNSSTSSEISSKKHKTKR

SEQ ID NO: 3034550 - protein, 6 aa, Entamoeba invadens
KTNERC

SEQ ID NO: 3034551 - protein, 27 aa, Entamoeba invadens
KTNKPTKSRRISKPSSRGSSKKVQKKR

SEQ ID NO: 3034552 - protein, 8 aa, Entamoeba invadens
KTNKTEYW

SEQ ID NO: 3034553 - protein, 14 aa, Entamoeba invadens
KTNLGTIAKSGTAD

SEQ ID NO: 3034554 - protein, 9 aa, Entamoeba invadens
KTNSGTYLD

SEQ ID NO: 3034555 - protein, 8 aa, Entamoeba invadens
KTNVENTN

SEQ ID NO: 3034556 - protein, 6 aa, Entamoeba invadens
KTNYNT

SEQ ID NO: 3034557 - protein, 4 aa, Entamoeba invadens
KTPE

SEQ ID NO: 3034558 - protein, 7 aa, Entamoeba invadens
KTPFTQS

SEQ ID NO: 3034559 - protein, 10 aa, Entamoeba invadens
KTPGRGGDFP

SEQ ID NO: 3034560 - protein, 9 aa, Entamoeba invadens
KTPPLMSSP

SEQ ID NO: 3034561 - protein, 4 aa, Entamoeba invadens
KTPQ

SEQ ID NO: 3034562 - protein, 5 aa, Entamoeba invadens
KTQEA

SEQ ID NO: 3034563 - protein, 4 aa, Entamoeba invadens
KTQI

SEQ ID NO: 3034564 - protein, 9 aa, Entamoeba invadens
KTQKKEKLQ

SEQ ID NO: 3034565 - protein, 7 aa, Entamoeba invadens
KTQLSSS

SEQ ID NO: 3034566 - protein, 9 aa, Entamoeba invadens
KTQPAMTPF

SEQ ID NO: 3034567 - protein, 9 aa, Entamoeba invadens
KTQQNTTED

SEQ ID NO: 3034568 - protein, 13 aa, Entamoeba invadens
KTRCTDNACTVNN

SEQ ID NO: 3034569 - protein, 10 aa, Entamoeba invadens
KTRDTNTTYC

SEQ ID NO: 3034570 - protein, 6 aa, Entamoeba invadens
KTREIS

SEQ ID NO: 3034571 - protein, 13 aa, Entamoeba invadens
KTRKAQKKARWNS

SEQ ID NO: 3034572 - protein, 6 aa, Entamoeba invadens
KTRKVT

SEQ ID NO: 3034573 - protein, 6 aa, Entamoeba invadens
KTSCSN

SEQ ID NO: 3034574 - protein, 10 aa, Entamoeba invadens
KTSKPENANE

SEQ ID NO: 3034575 - protein, 15 aa, Entamoeba invadens
KTSLKAKDKCASRSP

SEQ ID NO: 3034576 - protein, 9 aa, Entamoeba invadens
KTSNIKNCN

SEQ ID NO: 3034577 - protein, 6 aa, Entamoeba invadens
KTSSIK

SEQ ID NO: 3034578 - protein, 31 aa, Entamoeba invadens
KTSSKKPTQNVVPRKSHRTRANSDSDISNLP

SEQ ID NO: 3034579 - protein, 6 aa, Entamoeba invadens
KTTDCP

SEQ ID NO: 3034580 - protein, 5 aa, Entamoeba invadens
KTTNF

SEQ ID NO: 3034581 - protein, 9 aa, Entamoeba invadens
KTTQKCGDF

SEQ ID NO: 3034582 - protein, 4 aa, Entamoeba invadens
KTTY

SEQ ID NO: 3034583 - protein, 6 aa, Entamoeba invadens
KTVAQA

SEQ ID NO: 3034584 - protein, 6 aa, Entamoeba invadens
KTVIEG

SEQ ID NO: 3034585 - protein, 9 aa, Entamoeba invadens
KTVNTSNVQ

SEQ ID NO: 3034586 - protein, 7 aa, Entamoeba invadens
KTVPKTV

SEQ ID NO: 3034587 - protein, 11 aa, Entamoeba invadens
KTVQNQKKSLE

SEQ ID NO: 3034588 - protein, 6 aa, Entamoeba invadens
KTVQNY

SEQ ID NO: 3034589 - protein, 8 aa, Entamoeba invadens
KTVSGSQF

SEQ ID NO: 3034590 - protein, 6 aa, Entamoeba invadens
KTVSNP

SEQ ID NO: 3034591 - protein, 4 aa, Entamoeba invadens
KTVV

SEQ ID NO: 3034592 - protein, 10 aa, Entamoeba invadens
KTYGGYKATK

SEQ ID NO: 3034593 - protein, 5 aa, Entamoeba invadens
KTYLN

SEQ ID NO: 3034594 - protein, 12 aa, Entamoeba invadens
KTYNDDKTKCVE

SEQ ID NO: 3034595 - protein, 6 aa, Entamoeba invadens
KTYPSS

SEQ ID NO: 3034596 - protein, 7 aa, Entamoeba invadens
KTYTSGF

SEQ ID NO: 3034597 - protein, 6 aa, Entamoeba invadens
KTYYYN

SEQ ID NO: 3034598 - protein, 14 aa, Entamoeba invadens
KTYYYNSDRCLAEH

SEQ ID NO: 3034599 - protein, 9 aa, Entamoeba invadens
KVAEDHPDY

SEQ ID NO: 3034600 - protein, 7 aa, Entamoeba invadens
KVDPTIR

SEQ ID NO: 3034601 - protein, 9 aa, Entamoeba invadens
KVDTKDRWD

SEQ ID NO: 3034602 - protein, 11 aa, Entamoeba invadens
KVEKETANKEK

SEQ ID NO: 3034603 - protein, 7 aa, Entamoeba invadens
KVEKNEL

SEQ ID NO: 3034604 - protein, 10 aa, Entamoeba invadens
KVFNDPPTTS

SEQ ID NO: 3034605 - protein, 11 aa, Entamoeba invadens
KVGDNNAYGDG

SEQ ID NO: 3034606 - protein, 7 aa, Entamoeba invadens
KVGEEQK

SEQ ID NO: 3034607 - protein, 10 aa, Entamoeba invadens
KVGKKIVKGA

SEQ ID NO: 3034608 - protein, 16 aa, Entamoeba invadens
KVGTQDTNAWESNGDG

SEQ ID NO: 3034609 - protein, 10 aa, Entamoeba invadens
KVKDTDEKGA

SEQ ID NO: 3034610 - protein, 5 aa, Entamoeba invadens
KVKEN

SEQ ID NO: 3034611 - protein, 7 aa, Entamoeba invadens
KVKKDDI

SEQ ID NO: 3034612 - protein, 5 aa, Entamoeba invadens
KVNGY

SEQ ID NO: 3034613 - protein, 4 aa, Entamoeba invadens
KVNI

SEQ ID NO: 3034614 - protein, 5 aa, Entamoeba invadens
KVPET

SEQ ID NO: 3034615 - protein, 51 aa, Entamoeba invadens
KVPREKRGEQKVLTSTEDQHERRQRRPSQTQTTKTPHQKTQQPQLAGKTST

SEQ ID NO: 3034616 - protein, 6 aa, Entamoeba invadens
KVQHGD

SEQ ID NO: 3034617 - protein, 12 aa, Entamoeba invadens
KVQKEGRKTSEY

SEQ ID NO: 3034618 - protein, 8 aa, Entamoeba invadens
KVQTIEDK

SEQ ID NO: 3034619 - protein, 4 aa, Entamoeba invadens
KVRT

SEQ ID NO: 3034620 - protein, 7 aa, Entamoeba invadens
KVSGNNK

SEQ ID NO: 3034621 - protein, 15 aa, Entamoeba invadens
KVSNELKDDPSKSIS

SEQ ID NO: 3034622 - protein, 4 aa, Entamoeba invadens
KVTE

SEQ ID NO: 3034623 - protein, 8 aa, Entamoeba invadens
KVTPKSRR

SEQ ID NO: 3034624 - protein, 16 aa, Entamoeba invadens
KVTSNRRMSCFDLIPN

SEQ ID NO: 3034625 - protein, 16 aa, Entamoeba invadens
KVVQTGAGAVSTITGV

SEQ ID NO: 3034626 - protein, 9 aa, Entamoeba invadens
KVYQTPSER

SEQ ID NO: 3034627 - protein, 10 aa, Entamoeba invadens
KWGGNTGTHY

SEQ ID NO: 3034628 - protein, 5 aa, Entamoeba invadens
KWGTD

SEQ ID NO: 3034629 - protein, 17 aa, Entamoeba invadens
KWYGDENNQGLQTSEDN

SEQ ID NO: 3034630 - protein, 13 aa, Entamoeba invadens
KYAISNDSPTSAF

SEQ ID NO: 3034631 - protein, 8 aa, Entamoeba invadens
KYAKERQL

SEQ ID NO: 3034632 - protein, 15 aa, Entamoeba invadens
KYAPSYGSTSCSTCP

SEQ ID NO: 3034633 - protein, 33 aa, Entamoeba invadens
KYASLAAKVEAQNVVEKATKKFKNDAKKIKEYV

SEQ ID NO: 3034634 - protein, 7 aa, Entamoeba invadens
KYASSTP

SEQ ID NO: 3034635 - protein, 7 aa, Entamoeba invadens
KYATSKV

SEQ ID NO: 3034636 - protein, 13 aa, Entamoeba invadens
KYAVSTDSTQTTV

SEQ ID NO: 3034637 - protein, 9 aa, Entamoeba invadens
KYCNPQDEL

SEQ ID NO: 3034638 - protein, 8 aa, Entamoeba invadens
KYDDGDDT

SEQ ID NO: 3034639 - protein, 8 aa, Entamoeba invadens
KYDNGDDT

SEQ ID NO: 3034640 - protein, 6 aa, Entamoeba invadens
KYDPGV

SEQ ID NO: 3034641 - protein, 10 aa, Entamoeba invadens
KYDPKPRECP

SEQ ID NO: 3034642 - protein, 12 aa, Entamoeba invadens
KYDVSGERPTFN

SEQ ID NO: 3034643 - protein, 5 aa, Entamoeba invadens
KYEAE

SEQ ID NO: 3034644 - protein, 32 aa, Entamoeba invadens
KYEKQKSEKLKKQDELNNIKKNGKHQSTHTVS

SEQ ID NO: 3034645 - protein, 6 aa, Entamoeba invadens
KYELSN

SEQ ID NO: 3034646 - protein, 6 aa, Entamoeba invadens
KYENGR

SEQ ID NO: 3034647 - protein, 7 aa, Entamoeba invadens
KYGDGAF

SEQ ID NO: 3034648 - protein, 6 aa, Entamoeba invadens
KYGTDE

SEQ ID NO: 3034649 - protein, 6 aa, Entamoeba invadens
KYIDES

SEQ ID NO: 3034650 - protein, 5 aa, Entamoeba invadens
KYKIS

SEQ ID NO: 3034651 - protein, 4 aa, Entamoeba invadens
KYKM

SEQ ID NO: 3034652 - protein, 7 aa, Entamoeba invadens
KYKPITK

SEQ ID NO: 3034653 - protein, 9 aa, Entamoeba invadens
KYKSKQQMH

SEQ ID NO: 3034654 - protein, 18 aa, Entamoeba invadens
KYNEEEFTQEECDNIKSQ

SEQ ID NO: 3034655 - protein, 8 aa, Entamoeba invadens
KYNESTGR

SEQ ID NO: 3034656 - protein, 7 aa, Entamoeba invadens
KYPCNDN

SEQ ID NO: 3034657 - protein, 4 aa, Entamoeba invadens
KYPL

SEQ ID NO: 3034658 - protein, 12 aa, Entamoeba invadens
KYPNADEEKRVS

SEQ ID NO: 3034659 - protein, 5 aa, Entamoeba invadens
KYPQN

SEQ ID NO: 3034660 - protein, 6 aa, Entamoeba invadens
KYPQQD

SEQ ID NO: 3034661 - protein, 8 aa, Entamoeba invadens
KYQGTDKL

SEQ ID NO: 3034662 - protein, 6 aa, Entamoeba invadens
KYQKTT

SEQ ID NO: 3034663 - protein, 6 aa, Entamoeba invadens
KYRGNA

SEQ ID NO: 3034664 - protein, 5 aa, Entamoeba invadens
KYSVG

SEQ ID NO: 3034665 - protein, 10 aa, Entamoeba invadens
KYSVTENSVK

SEQ ID NO: 3034666 - protein, 8 aa, Entamoeba invadens
KYSYDTTN

SEQ ID NO: 3034667 - protein, 11 aa, Entamoeba invadens
KYTDDDKIGDL

SEQ ID NO: 3034668 - protein, 9 aa, Entamoeba invadens
KYTGANNDD

SEQ ID NO: 3034669 - protein, 10 aa, Entamoeba invadens
KYTRNEQGYT

SEQ ID NO: 3034670 - protein, 4 aa, Entamoeba invadens
KYYD

SEQ ID NO: 3034671 - protein, 19 aa, Entamoeba invadens
KYYESNGKYIRTEECDGGV

SEQ ID NO: 3034672 - protein, 15 aa, Entamoeba invadens
KYYTDIGEQNNESYS

SEQ ID NO: 3034673 - protein, 18 aa, Entamoeba invadens
LAALQRKASHAHGNKKAQ

SEQ ID NO: 3034674 - protein, 15 aa, Entamoeba invadens
LAEAKNSPVGKSAVA

SEQ ID NO: 3034675 - protein, 9 aa, Entamoeba invadens
LAGNGNNVK

SEQ ID NO: 3034676 - protein, 9 aa, Entamoeba invadens
LAGSEGDNQ

SEQ ID NO: 3034677 - protein, 8 aa, Entamoeba invadens
LAKETGKE

SEQ ID NO: 3034678 - protein, 8 aa, Entamoeba invadens
LAKNERMK

SEQ ID NO: 3034679 - protein, 6 aa, Entamoeba invadens
LAKQGA

SEQ ID NO: 3034680 - protein, 31 aa, Entamoeba invadens
LAKQKTDLKKTIDQLKNSKTDQKYVKTEARY

SEQ ID NO: 3034681 - protein, 11 aa, Entamoeba invadens
LAKSDEKVTRK

SEQ ID NO: 3034682 - protein, 11 aa, Entamoeba invadens
LAKSEKDTTTL

SEQ ID NO: 3034683 - protein, 23 aa, Entamoeba invadens
LAPETTSVTPETSSPDQTKQEEQ

SEQ ID NO: 3034684 - protein, 7 aa, Entamoeba invadens
LAREEAQ

SEQ ID NO: 3034685 - protein, 9 aa, Entamoeba invadens
LARERTETK

SEQ ID NO: 3034686 - protein, 4 aa, Entamoeba invadens
LARQ

SEQ ID NO: 3034687 - protein, 10 aa, Entamoeba invadens
LASDNGGPSN

SEQ ID NO: 3034688 - protein, 8 aa, Entamoeba invadens
LATEDDYV

SEQ ID NO: 3034689 - protein, 13 aa, Entamoeba invadens
LATGSKSSPTTEK

SEQ ID NO: 3034690 - protein, 5 aa, Entamoeba invadens
LATGT

SEQ ID NO: 3034691 - protein, 7 aa, Entamoeba invadens
LDASKEM

SEQ ID NO: 3034692 - protein, 10 aa, Entamoeba invadens
LDDDKSMDEF

SEQ ID NO: 3034693 - protein, 30 aa, Entamoeba invadens
LDDEENNDRDVEFNNANKSEQFILSKKCTV

SEQ ID NO: 3034694 - protein, 6 aa, Entamoeba invadens
LDDKKF

SEQ ID NO: 3034695 - protein, 15 aa, Entamoeba invadens
LDEADIKSREDQEHI

SEQ ID NO: 3034696 - protein, 18 aa, Entamoeba invadens
LDEDSTPSYSKKKVRGCD

SEQ ID NO: 3034697 - protein, 6 aa, Entamoeba invadens
LDEEIA

SEQ ID NO: 3034698 - protein, 9 aa, Entamoeba invadens
LDEKDDKMS

SEQ ID NO: 3034699 - protein, 10 aa, Entamoeba invadens
LDENRPSPFG

SEQ ID NO: 3034700 - protein, 12 aa, Entamoeba invadens
LDESEKISTLEK

SEQ ID NO: 3034701 - protein, 11 aa, Entamoeba invadens
LDGNGQTEQLE

SEQ ID NO: 3034702 - protein, 9 aa, Entamoeba invadens
LDGSTVTVS

SEQ ID NO: 3034703 - protein, 12 aa, Entamoeba invadens
LDKATKDQIDKE

SEQ ID NO: 3034704 - protein, 10 aa, Entamoeba invadens
LDKGETQNPS

SEQ ID NO: 3034705 - protein, 9 aa, Entamoeba invadens
LDNDDGQSW

SEQ ID NO: 3034706 - protein, 5 aa, Entamoeba invadens
LDNPQ

SEQ ID NO: 3034707 - protein, 9 aa, Entamoeba invadens
LDPETSKHV

SEQ ID NO: 3034708 - protein, 7 aa, Entamoeba invadens
LDPNSAC

SEQ ID NO: 3034709 - protein, 7 aa, Entamoeba invadens
LDQEGYS

SEQ ID NO: 3034710 - protein, 8 aa, Entamoeba invadens
LDQTPISK

SEQ ID NO: 3034711 - protein, 9 aa, Entamoeba invadens
LDSASETSP

SEQ ID NO: 3034712 - protein, 18 aa, Entamoeba invadens
LDSENGQKLTKIASTGVN

SEQ ID NO: 3034713 - protein, 6 aa, Entamoeba invadens
LDSSTN

SEQ ID NO: 3034714 - protein, 13 aa, Entamoeba invadens
LDTDQDTIQEGQS

SEQ ID NO: 3034715 - protein, 17 aa, Entamoeba invadens
LDTKDTETDSYENSASS

SEQ ID NO: 3034716 - protein, 31 aa, Entamoeba invadens
LEAEDSEFDEEDDDEEEEDDNETNGEDDLEY

SEQ ID NO: 3034717 - protein, 13 aa, Entamoeba invadens
LEAKKNNKTMAEA

SEQ ID NO: 3034718 - protein, 14 aa, Entamoeba invadens
LEDALKEKGYQPVF

SEQ ID NO: 3034719 - protein, 9 aa, Entamoeba invadens
LEEGGRPDN

SEQ ID NO: 3034720 - protein, 9 aa, Entamoeba invadens
LEENNRPDN

SEQ ID NO: 3034721 - protein, 13 aa, Entamoeba invadens
LEENSEESEEANK

SEQ ID NO: 3034722 - protein, 43 aa, Entamoeba invadens; identical to SEQ ID NO: 2880328

SEQ ID NO: 3034723 - protein, 13 aa, Entamoeba invadens
LEETLPKEEESGF

SEQ ID NO: 3034724 - protein, 4 aa, Entamoeba invadens
LEGD

SEQ ID NO: 3034725 - protein, 11 aa, Entamoeba invadens
LEGENKLSDYN

SEQ ID NO: 3034726 - protein, 11 aa, Entamoeba invadens
LEGGKCSGAHT

SEQ ID NO: 3034727 - protein, 13 aa, Entamoeba invadens
LEISSSTINLSGN

SEQ ID NO: 3034728 - protein, 8 aa, Entamoeba invadens
LEKNKHKI

SEQ ID NO: 3034729 - protein, 6 aa, Entamoeba invadens
LEKTNG

SEQ ID NO: 3034730 - protein, 9 aa, Entamoeba invadens
LELPPKGVP

SEQ ID NO: 3034731 - protein, 9 aa, Entamoeba invadens
LENDGYEDN

SEQ ID NO: 3034732 - protein, 19 aa, Entamoeba invadens
LENEKNNYVQKRRVNNENV

SEQ ID NO: 3034733 - protein, 19 aa, Entamoeba invadens
LENETKEEKEEGGDDEKVP

SEQ ID NO: 3034734 - protein, 28 aa, Entamoeba invadens
LENSEKNEKIKIENQKSEFEKDLQNSRK

SEQ ID NO: 3034735 - protein, 4 aa, Entamoeba invadens
LENT

SEQ ID NO: 3034736 - protein, 16 aa, Entamoeba invadens
LENTKDEIRRLQTGEE

SEQ ID NO: 3034737 - protein, 10 aa, Entamoeba invadens
LESSEKEPLK

SEQ ID NO: 3034738 - protein, 10 aa, Entamoeba invadens
LETDDKKPIA

SEQ ID NO: 3034739 - protein, 4 aa, Entamoeba invadens
LETS

SEQ ID NO: 3034740 - protein, 8 aa, Entamoeba invadens
LGAVPEDV

SEQ ID NO: 3034741 - protein, 10 aa, Entamoeba invadens
LGDDQPTDQQ

SEQ ID NO: 3034742 - protein, 16 aa, Entamoeba invadens
LGDLQTDYATAEKQQK

SEQ ID NO: 3034743 - protein, 7 aa, Entamoeba invadens
LGDNADL

SEQ ID NO: 3034744 - protein, 12 aa, Entamoeba invadens
LGDQPSTRPNVE

SEQ ID NO: 3034745 - protein, 14 aa, Entamoeba invadens
LGEDSAKIALEETK

SEQ ID NO: 3034746 - protein, 5 aa, Entamoeba invadens
LGEES

SEQ ID NO: 3034747 - protein, 9 aa, Entamoeba invadens
LGEKWNNDD

SEQ ID NO: 3034748 - protein, 28 aa, Entamoeba invadens
LGERDNTTKLNEELDKTKREKENVKNEL

SEQ ID NO: 3034749 - protein, 79 aa, Entamoeba invadens
LGGALEKKEQANNTNVNANTNATVSASANSSANANNTTTTNGTTTNNNANNSLNNTTNTGLNGSTSPNVSSSNVTTPTV

SEQ ID NO: 3034750 - protein, 13 aa, Entamoeba invadens
LGGDSVNTALEET

SEQ ID NO: 3034751 - protein, 24 aa, Entamoeba invadens
LGGNGRDASNKCECKTGYAEDTTQ

SEQ ID NO: 3034752 - protein, 9 aa, Entamoeba invadens
LGGTSVRSL

SEQ ID NO: 3034753 - protein, 61 aa, Entamoeba invadens
LGKIDKKKGKSSKAEKAGTSTSKVQKAKTLQKTSKTGKSAKQKETKKMSPLKKGKVEKTKK

SEQ ID NO: 3034754 - protein, 10 aa, Entamoeba invadens
LGKKEYSYTK

SEQ ID NO: 3034755 - protein, 19 aa, Entamoeba invadens
LGKNEGFKKLTKEEEEAIK

SEQ ID NO: 3034756 - protein, 11 aa, Entamoeba invadens
LGLEEKGECKG

SEQ ID NO: 3034757 - protein, 4 aa, Entamoeba invadens
LGQI

SEQ ID NO: 3034758 - protein, 11 aa, Entamoeba invadens
LGRNSSQNEIE

SEQ ID NO: 3034759 - protein, 11 aa, Entamoeba invadens
LGSASQCKQCD

SEQ ID NO: 3034760 - protein, 9 aa, Entamoeba invadens
LGSETPDKI

SEQ ID NO: 3034761 - protein, 6 aa, Entamoeba invadens
LGSTWS

SEQ ID NO: 3034762 - protein, 10 aa, Entamoeba invadens
LGTKCGANGH

SEQ ID NO: 3034763 - protein, 6 aa, Entamoeba invadens
LGTTQK

SEQ ID NO: 3034764 - protein, 13 aa, Entamoeba invadens
LGTYTSTKNQTSC

SEQ ID NO: 3034765 - protein, 7 aa, Entamoeba invadens
LGVEDQS

SEQ ID NO: 3034766 - protein, 9 aa, Entamoeba invadens
LGYKDGADM

SEQ ID NO: 3034767 - protein, 5 aa, Entamoeba invadens
LGYSD

SEQ ID NO: 3034768 - protein, 7 aa, Entamoeba invadens
LHNSPSI

SEQ ID NO: 3034769 - protein, 10 aa, Entamoeba invadens
LHSDSQSHTL

SEQ ID NO: 3034770 - protein, 4 aa, Entamoeba invadens
LIDP

SEQ ID NO: 3034771 - protein, 9 aa, Entamoeba invadens
LIPPKEAER

SEQ ID NO: 3034772 - protein, 12 aa, Entamoeba invadens
LITPKSVGKTEI

SEQ ID NO: 3034773 - protein, 32 aa, Entamoeba invadens
LKDDKETLSKLGKQKIRSQKEVKAELKKTKIS

SEQ ID NO: 3034774 - protein, 18 aa, Entamoeba invadens
LKDDTKTQVEQAESQNEK

SEQ ID NO: 3034775 - protein, 24 aa, Entamoeba invadens
LKDQNTQLDAAKKDMKQWSIERNE

SEQ ID NO: 3034776 - protein, 9 aa, Entamoeba invadens
LKEAGTDGV

SEQ ID NO: 3034777 - protein, 19 aa, Entamoeba invadens
LKEANQLASDKKRFSQQKS

SEQ ID NO: 3034778 - protein, 5 aa, Entamoeba invadens
LKEKG

SEQ ID NO: 3034779 - protein, 9 aa, Entamoeba invadens
LKEKQKMQL

SEQ ID NO: 3034780 - protein, 12 aa, Entamoeba invadens
LKEMENKQVTTL

SEQ ID NO: 3034781 - protein, 4 aa, Entamoeba invadens
LKEN

SEQ ID NO: 3034782 - protein, 9 aa, Entamoeba invadens
LKEPSNAIA

SEQ ID NO: 3034783 - protein, 49 aa, Entamoeba invadens
LKERKEKKAAKEKEKAKKLAKERGKLHKQQKKEKAGKMKGKSAAQRKQY

SEQ ID NO: 3034784 - protein, 5 aa, Entamoeba invadens
LKESS

SEQ ID NO: 3034785 - protein, 13 aa, Entamoeba invadens
LKETTDSKYNRYN

SEQ ID NO: 3034786 - protein, 4 aa, Entamoeba invadens
LKGN

SEQ ID NO: 3034787 - protein, 7 aa, Entamoeba invadens
LKGNYRT

SEQ ID NO: 3034788 - protein, 6 aa, Entamoeba invadens
LKHSRH

SEQ ID NO: 3034789 - protein, 11 aa, Entamoeba invadens
LKKANKNKGPI

SEQ ID NO: 3034790 - protein, 5 aa, Entamoeba invadens
LKKEP

SEQ ID NO: 3034791 - protein, 9 aa, Entamoeba invadens
LKKESEKAK

SEQ ID NO: 3034792 - protein, 6 aa, Entamoeba invadens
LKKFPK

SEQ ID NO: 3034793 - protein, 6 aa, Entamoeba invadens
LKKGDK

SEQ ID NO: 3034794 - protein, 20 aa, Entamoeba invadens
LKKGEKGATEIRKTKEAFQD

SEQ ID NO: 3034795 - protein, 42 aa, Entamoeba invadens
LKKKQEEEAKKAEELKKQQQQIKEKQEKESASKKKQENEKTT

SEQ ID NO: 3034796 - protein, 60 aa, Entamoeba invadens
LKKNLSKKEMKELSKSEKAEQKEKKAEKSKIEKKKKSKAERKAKRAAKKAEKKIQKQTLE

SEQ ID NO: 3034797 - protein, 12 aa, Entamoeba invadens
LKKRSSKYADKL

SEQ ID NO: 3034798 - protein, 9 aa, Entamoeba invadens
LKNKRTTNN

SEQ ID NO: 3034799 - protein, 4 aa, Entamoeba invadens
LKNR

SEQ ID NO: 3034800 - protein, 6 aa, Entamoeba invadens
LKPGNE

SEQ ID NO: 3034801 - protein, 7 aa, Entamoeba invadens
LKPGTYS

SEQ ID NO: 3034802 - protein, 9 aa, Entamoeba invadens
LKPNYTSKI

SEQ ID NO: 3034803 - protein, 9 aa, Entamoeba invadens
LKPQTKLNK

SEQ ID NO: 3034804 - protein, 17 aa, Entamoeba invadens
LKPTEQTRQTPQREEQV

SEQ ID NO: 3034805 - protein, 9 aa, Entamoeba invadens
LKPTTHQER

SEQ ID NO: 3034806 - protein, 6 aa, Entamoeba invadens
LKPVES

SEQ ID NO: 3034807 - protein, 5 aa, Entamoeba invadens
LKPVS

SEQ ID NO: 3034808 - protein, 15 aa, Entamoeba invadens
LKQPTTEKQQEKAKE

SEQ ID NO: 3034809 - protein, 5 aa, Entamoeba invadens
LKQQG

SEQ ID NO: 3034810 - protein, 7 aa, Entamoeba invadens
LKRASGA

SEQ ID NO: 3034811 - protein, 33 aa, Entamoeba invadens
LKRDPRPQTPKSSTWPRTQKPTTEPDKRGSLKR

SEQ ID NO: 3034812 - protein, 10 aa, Entamoeba invadens
LKSAKKHNKI

SEQ ID NO: 3034813 - protein, 7 aa, Entamoeba invadens
LKSGGDV

SEQ ID NO: 3034814 - protein, 17 aa, Entamoeba invadens
LKSNRAFKNLKQKISKI

SEQ ID NO: 3034815 - protein, 27 aa, Entamoeba invadens
LKSRNQNEIVESNEISSNELEKIKNEE

SEQ ID NO: 3034816 - protein, 7 aa, Entamoeba invadens
LKTEPGV

SEQ ID NO: 3034817 - protein, 8 aa, Entamoeba invadens
LKTGPNKA

SEQ ID NO: 3034818 - protein, 7 aa, Entamoeba invadens
LKTNKEM

SEQ ID NO: 3034819 - protein, 6 aa, Entamoeba invadens
LKTSGV

SEQ ID NO: 3034820 - protein, 4 aa, Entamoeba invadens
LKVE

SEQ ID NO: 3034821 - protein, 7 aa, Entamoeba invadens
LKVEPNT

SEQ ID NO: 3034822 - protein, 11 aa, Entamoeba invadens
LKVESNSNQPL

SEQ ID NO: 3034823 - protein, 6 aa, Entamoeba invadens
LKVETE

SEQ ID NO: 3034824 - protein, 7 aa, Entamoeba invadens
LKVETEK

SEQ ID NO: 3034825 - protein, 13 aa, Entamoeba invadens
LKVETEKMYNTED

SEQ ID NO: 3034826 - protein, 6 aa, Entamoeba invadens
LKVETN

SEQ ID NO: 3034827 - protein, 19 aa, Entamoeba invadens
LKYHPDRVAQDKESQESAK

SEQ ID NO: 3034828 - protein, 7 aa, Entamoeba invadens
LLGKSGR

SEQ ID NO: 3034829 - protein, 4 aa, Entamoeba invadens
LLTN

SEQ ID NO: 3034830 - protein, 9 aa, Entamoeba invadens
LNANCGSCS

SEQ ID NO: 3034831 - protein, 6 aa, Entamoeba invadens
LNASQS

SEQ ID NO: 3034832 - protein, 5 aa, Entamoeba invadens
LNDDL

SEQ ID NO: 3034833 - protein, 18 aa, Entamoeba invadens
LNDEPTTGGCSTSNNKNY

SEQ ID NO: 3034834 - protein, 9 aa, Entamoeba invadens
LNDKNNKNV

SEQ ID NO: 3034835 - protein, 8 aa, Entamoeba invadens
LNDKTNTL

SEQ ID NO: 3034836 - protein, 5 aa, Entamoeba invadens
LNDSR

SEQ ID NO: 3034837 - protein, 11 aa, Entamoeba invadens
LNEAKKEDGVD

SEQ ID NO: 3034838 - protein, 5 aa, Entamoeba invadens
LNEPQ

SEQ ID NO: 3034839 - protein, 17 aa, Entamoeba invadens
LNESEEDESNTPTVESE

SEQ ID NO: 3034840 - protein, 8 aa, Entamoeba invadens
LNESRKVE

SEQ ID NO: 3034841 - protein, 17 aa, Entamoeba invadens
LNGDHHTESSPPSENDY

SEQ ID NO: 3034842 - protein, 9 aa, Entamoeba invadens
LNGETPETS

SEQ ID NO: 3034843 - protein, 5 aa, Entamoeba invadens
LNGGE

SEQ ID NO: 3034844 - protein, 11 aa, Entamoeba invadens
LNGNDGFPDGL

SEQ ID NO: 3034845 - protein, 12 aa, Entamoeba invadens
LNGSDKTKVDEF

SEQ ID NO: 3034846 - protein, 5 aa, Entamoeba invadens
LNIDT

SEQ ID NO: 3034847 - protein, 10 aa, Entamoeba invadens
LNITTDPGFK

SEQ ID NO: 3034848 - protein, 16 aa, Entamoeba invadens
LNKAKKEKDTTNIAAQ

SEQ ID NO: 3034849 - protein, 16 aa, Entamoeba invadens
LNKCPNGEYPNGTNKV

SEQ ID NO: 3034850 - protein, 8 aa, Entamoeba invadens
LNKDGADV

SEQ ID NO: 3034851 - protein, 5 aa, Entamoeba invadens
LNKEE

SEQ ID NO: 3034852 - protein, 24 aa, Entamoeba invadens
LNKGKSVDPVKTKALQKAQRKQAR

SEQ ID NO: 3034853 - protein, 9 aa, Entamoeba invadens
LNKTQSPIE

SEQ ID NO: 3034854 - protein, 20 aa, Entamoeba invadens
LNNGKCDTCSAGTYQSGGSC

SEQ ID NO: 3034855 - protein, 9 aa, Entamoeba invadens
LNNKTDGYK

SEQ ID NO: 3034856 - protein, 7 aa, Entamoeba invadens
LNNPSNI

SEQ ID NO: 3034857 - protein, 9 aa, Entamoeba invadens
LNPKPRKNK

SEQ ID NO: 3034858 - protein, 12 aa, Entamoeba invadens
LNPKTGQCGGSQ

SEQ ID NO: 3034859 - protein, 7 aa, Entamoeba invadens
LNPRARN

SEQ ID NO: 3034860 - protein, 12 aa, Entamoeba invadens
LNPTETETPYVR

SEQ ID NO: 3034861 - protein, 5 aa, Entamoeba invadens
LNPTN

SEQ ID NO: 3034862 - protein, 6 aa, Entamoeba invadens
LNQDTS

SEQ ID NO: 3034863 - protein, 6 aa, Entamoeba invadens
LNSKKK

SEQ ID NO: 3034864 - protein, 17 aa, Entamoeba invadens
LNSSKTKNEKQETEIQE

SEQ ID NO: 3034865 - protein, 10 aa, Entamoeba invadens
LNTTTGRCDG

SEQ ID NO: 3034866 - protein, 9 aa, Entamoeba invadens
LPAHAPGEY

SEQ ID NO: 3034867 - protein, 6 aa, Entamoeba invadens
LPDPME

SEQ ID NO: 3034868 - protein, 33 aa, Entamoeba invadens
LPDPTIPTNNTNSTNGTNSTIQPPPHYPIDPLV

SEQ ID NO: 3034869 - protein, 7 aa, Entamoeba invadens
LPETQGA

SEQ ID NO: 3034870 - protein, 6 aa, Entamoeba invadens
LPGDDG

SEQ ID NO: 3034871 - protein, 6 aa, Entamoeba invadens
LPGDQL

SEQ ID NO: 3034872 - protein, 9 aa, Entamoeba invadens
LPGGEDWST

SEQ ID NO: 3034873 - protein, 6 aa, Entamoeba invadens
LPGYYA

SEQ ID NO: 3034874 - protein, 37 aa, Entamoeba invadens
LPISSQPKDEEKEMSVRPKDPQQKHKHQRFPSRQPFP

SEQ ID NO: 3034875 - protein, 9 aa, Entamoeba invadens
LPKDTTIKS

SEQ ID NO: 3034876 - protein, 9 aa, Entamoeba invadens
LPKPDEMSQ

SEQ ID NO: 3034877 - protein, 5 aa, Entamoeba invadens
LPNEQ

SEQ ID NO: 3034878 - protein, 7 aa, Entamoeba invadens
LPNHPTA

SEQ ID NO: 3034879 - protein, 4 aa, Entamoeba invadens
LPNK

SEQ ID NO: 3034880 - protein, 11 aa, Entamoeba invadens
LPNTKTVTQIG

SEQ ID NO: 3034881 - protein, 12 aa, Entamoeba invadens
LPNYNQDTVKNA

SEQ ID NO: 3034882 - protein, 9 aa, Entamoeba invadens
LPPLPEGDV

SEQ ID NO: 3034883 - protein, 7 aa, Entamoeba invadens
LPQQTVY

SEQ ID NO: 3034884 - protein, 11 aa, Entamoeba invadens
LPRTSTLPKYM

SEQ ID NO: 3034885 - protein, 51 aa, Entamoeba invadens
LPSDSTAKPVEPSQPETPEKPSEPEKPVEPSKPVDPPVTSTEPSESDKPVK

SEQ ID NO: 3034886 - protein, 5 aa, Entamoeba invadens
LPSDV

SEQ ID NO: 3034887 - protein, 4 aa, Entamoeba invadens
LPSE

SEQ ID NO: 3034888 - protein, 9 aa, Entamoeba invadens
LPSKITNKE

SEQ ID NO: 3034889 - protein, 5 aa, Entamoeba invadens
LPSTL

SEQ ID NO: 3034890 - protein, 7 aa, Entamoeba invadens
LPTDSSA

SEQ ID NO: 3034891 - protein, 7 aa, Entamoeba invadens
LPTDSTA

SEQ ID NO: 3034892 - protein, 31 aa, Entamoeba invadens
LPTETSESGVPTGEKPFGETPPKPPRKKPGL

SEQ ID NO: 3034893 - protein, 4 aa, Entamoeba invadens
LPTG

SEQ ID NO: 3034894 - protein, 24 aa, Entamoeba invadens
LPTPQSPVTREIPDPQEKKIPFSK

SEQ ID NO: 3034895 - protein, 4 aa, Entamoeba invadens
LPTV

SEQ ID NO: 3034896 - protein, 10 aa, Entamoeba invadens
LPYPPGNERD

SEQ ID NO: 3034897 - protein, 22 aa, Entamoeba invadens
LQAPKTKKKYGNLKRKSPTKKL

SEQ ID NO: 3034898 - protein, 11 aa, Entamoeba invadens
LQDDGKAKSEL

SEQ ID NO: 3034899 - protein, 12 aa, Entamoeba invadens
LQDEKTAQVNKA

SEQ ID NO: 3034900 - protein, 6 aa, Entamoeba invadens
LQEESK

SEQ ID NO: 3034901 - protein, 21 aa, Entamoeba invadens
LQEKREKKSLISNERDTMTRR

SEQ ID NO: 3034902 - protein, 10 aa, Entamoeba invadens
LQKDGLSESD

SEQ ID NO: 3034903 - protein, 10 aa, Entamoeba invadens
LQKNGLSNSD

SEQ ID NO: 3034904 - protein, 8 aa, Entamoeba invadens
LQKTKEKL

SEQ ID NO: 3034905 - protein, 7 aa, Entamoeba invadens
LQKTRLT

SEQ ID NO: 3034906 - protein, 13 aa, Entamoeba invadens
LQNNNLKQNNLPH

SEQ ID NO: 3034907 - protein, 9 aa, Entamoeba invadens
LQPEEKQSL

SEQ ID NO: 3034908 - protein, 35 aa, Entamoeba invadens
LQQENQNTAFQTNYEENDIGNPTQQMEMDDADKTV

SEQ ID NO: 3034909 - protein, 9 aa, Entamoeba invadens
LQQQNDENV

SEQ ID NO: 3034910 - protein, 6 aa, Entamoeba invadens
LQSIPE

SEQ ID NO: 3034911 - protein, 4 aa, Entamoeba invadens
LQSQ

SEQ ID NO: 3034912 - protein, 7 aa, Entamoeba invadens
LQTENTE

SEQ ID NO: 3034913 - protein, 4 aa, Entamoeba invadens
LQTI

SEQ ID NO: 3034914 - protein, 10 aa, Entamoeba invadens
LQTTSGKAEH

SEQ ID NO: 3034915 - protein, 6 aa, Entamoeba invadens
LQTTSS

SEQ ID NO: 3034916 - protein, 9 aa, Entamoeba invadens
LRDPTNNAT

SEQ ID NO: 3034917 - protein, 11 aa, Entamoeba invadens
LREKGDRRAIR

SEQ ID NO: 3034918 - protein, 7 aa, Entamoeba invadens
LRERAKQ

SEQ ID NO: 3034919 - protein, 50 aa, Entamoeba invadens
LRGPGGDFRNDTNNNTIINNTDNSNTYNNSNNPIENESQSSDDNTENYTF

SEQ ID NO: 3034920 - protein, 5 aa, Entamoeba invadens
LRKDY

SEQ ID NO: 3034921 - protein, 12 aa, Entamoeba invadens
LRKTKGEGAKEI

SEQ ID NO: 3034922 - protein, 5 aa, Entamoeba invadens
LRNDK

SEQ ID NO: 3034923 - protein, 7 aa, Entamoeba invadens
LRNPNGK

SEQ ID NO: 3034924 - protein, 36 aa, Entamoeba invadens; identical to SEQ ID NO: 2882694

SEQ ID NO: 3034925 - protein, 7 aa, Entamoeba invadens
LRPSEGA

SEQ ID NO: 3034926 - protein, 6 aa, Entamoeba invadens
LRQPDA

SEQ ID NO: 3034927 - protein, 17 aa, Entamoeba invadens
LRQQGKVTKVKDQNPCG

SEQ ID NO: 3034928 - protein, 18 aa, Entamoeba invadens
LRQQGKVTKVRDQKSCGS

SEQ ID NO: 3034929 - protein, 6 aa, Entamoeba invadens
LRREER

SEQ ID NO: 3034930 - protein, 10 aa, Entamoeba invadens
LRRREARKAE

SEQ ID NO: 3034931 - protein, 6 aa, Entamoeba invadens
LRSPSF

SEQ ID NO: 3034932 - protein, 5 aa, Entamoeba invadens
LRSRE

SEQ ID NO: 3034933 - protein, 11 aa, Entamoeba invadens
LRTDNLSESYH

SEQ ID NO: 3034934 - protein, 5 aa, Entamoeba invadens
LRTEK

SEQ ID NO: 3034935 - protein, 28 aa, Entamoeba invadens
LRTEKTVEKQRKISQKEQEKKDKQHQKE

SEQ ID NO: 3034936 - protein, 5 aa, Entamoeba invadens
LSAKQ

SEQ ID NO: 3034937 - protein, 10 aa, Entamoeba invadens
LSAPDLNKDL

SEQ ID NO: 3034938 - protein, 7 aa, Entamoeba invadens
LSATSAL

SEQ ID NO: 3034939 - protein, 6 aa, Entamoeba invadens
LSDAKS

SEQ ID NO: 3034940 - protein, 4 aa, Entamoeba invadens
LSDD

SEQ ID NO: 3034941 - protein, 30 aa, Entamoeba invadens
LSDDKQRRIYDQGGEEAIKNPNRNGFGGGF

SEQ ID NO: 3034942 - protein, 7 aa, Entamoeba invadens
LSDDSVT

SEQ ID NO: 3034943 - protein, 10 aa, Entamoeba invadens
LSDKDKRGLY

SEQ ID NO: 3034944 - protein, 13 aa, Entamoeba invadens
LSDNQIKELSKIL

SEQ ID NO: 3034945 - protein, 8 aa, Entamoeba invadens
LSDPKGMK

SEQ ID NO: 3034946 - protein, 11 aa, Entamoeba invadens
LSEDNKDSTNC

SEQ ID NO: 3034947 - protein, 23 aa, Entamoeba invadens
LSEETPKKIGTKRTMKKDQKNVD

SEQ ID NO: 3034948 - protein, 9 aa, Entamoeba invadens
LSEKTTVSC

SEQ ID NO: 3034949 - protein, 27 aa, Entamoeba invadens
LSELKQEKRSVHSSKKVEDVKKHGKKY

SEQ ID NO: 3034950 - protein, 8 aa, Entamoeba invadens
LSEPKKGV

SEQ ID NO: 3034951 - protein, 6 aa, Entamoeba invadens
LSETSK

SEQ ID NO: 3034952 - protein, 4 aa, Entamoeba invadens
LSGN

SEQ ID NO: 3034953 - protein, 23 aa, Entamoeba invadens
LSGNEKPTYHKSKPIPEEKQKEI

SEQ ID NO: 3034954 - protein, 13 aa, Entamoeba invadens
LSGNEQAQEDKTV

SEQ ID NO: 3034955 - protein, 8 aa, Entamoeba invadens
LSGSNKTR

SEQ ID NO: 3034956 - protein, 9 aa, Entamoeba invadens
LSIGGEKET

SEQ ID NO: 3034957 - protein, 12 aa, Entamoeba invadens
LSKDAAKVTKKE

SEQ ID NO: 3034958 - protein, 9 aa, Entamoeba invadens
LSKDLSRTI

SEQ ID NO: 3034959 - protein, 17 aa, Entamoeba invadens
LSKEENKTLSATDRNNL

SEQ ID NO: 3034960 - protein, 5 aa, Entamoeba invadens
LSKGT

SEQ ID NO: 3034961 - protein, 17 aa, Entamoeba invadens
LSKKNSNITAVSEHPGC

SEQ ID NO: 3034962 - protein, 28 aa, Entamoeba invadens
LSKSFEKKAVKAAAQTAPAKKDVKDVAK

SEQ ID NO: 3034963 - protein, 13 aa, Entamoeba invadens
LSLQGKSTGTTTV

SEQ ID NO: 3034964 - protein, 8 aa, Entamoeba invadens
LSNEGPFA

SEQ ID NO: 3034965 - protein, 6 aa, Entamoeba invadens
LSNGKE

SEQ ID NO: 3034966 - protein, 16 aa, Entamoeba invadens
LSNGNISATTAQKNAI

SEQ ID NO: 3034967 - protein, 11 aa, Entamoeba invadens
LSNKQTKNNLK

SEQ ID NO: 3034968 - protein, 12 aa, Entamoeba invadens
LSNSANCDNQNR

SEQ ID NO: 3034969 - protein, 5 aa, Entamoeba invadens
LSNVK

SEQ ID NO: 3034970 - protein, 5 aa, Entamoeba invadens
LSPEN

SEQ ID NO: 3034971 - protein, 5 aa, Entamoeba invadens
LSPEQ

SEQ ID NO: 3034972 - protein, 5 aa, Entamoeba invadens
LSPGY

SEQ ID NO: 3034973 - protein, 9 aa, Entamoeba invadens
LSPNPEHWP

SEQ ID NO: 3034974 - protein, 6 aa, Entamoeba invadens
LSPSGN

SEQ ID NO: 3034975 - protein, 4 aa, Entamoeba invadens
LSPT

SEQ ID NO: 3034976 - protein, 9 aa, Entamoeba invadens
LSQNGTDKA

SEQ ID NO: 3034977 - protein, 18 aa, Entamoeba invadens
LSQSEEDESNTPSVTSDD

SEQ ID NO: 3034978 - protein, 14 aa, Entamoeba invadens
LSREDDGNTHQGNG

SEQ ID NO: 3034979 - protein, 16 aa, Entamoeba invadens
LSRGADGKIKANGGLN

SEQ ID NO: 3034980 - protein, 8 aa, Entamoeba invadens
LSRGKGLA

SEQ ID NO: 3034981 - protein, 5 aa, Entamoeba invadens
LSRKF

SEQ ID NO: 3034982 - protein, 10 aa, Entamoeba invadens
LSRKTKKTLR

SEQ ID NO: 3034983 - protein, 6 aa, Entamoeba invadens
LSRSDR

SEQ ID NO: 3034984 - protein, 17 aa, Entamoeba invadens
LSSANLKSTAKSKFKEA

SEQ ID NO: 3034985 - protein, 16 aa, Entamoeba invadens
LSSDRNKARQKVREER

SEQ ID NO: 3034986 - protein, 7 aa, Entamoeba invadens
LSSNTNN

SEQ ID NO: 3034987 - protein, 7 aa, Entamoeba invadens
LSSPQVD

SEQ ID NO: 3034988 - protein, 5 aa, Entamoeba invadens
LSSTN

SEQ ID NO: 3034989 - protein, 10 aa, Entamoeba invadens
LSSTSRDKIS

SEQ ID NO: 3034990 - protein, 8 aa, Entamoeba invadens
LSSTYGVN

SEQ ID NO: 3034991 - protein, 9 aa, Entamoeba invadens
LSTDSLKQT

SEQ ID NO: 3034992 - protein, 7 aa, Entamoeba invadens
LSTDSSL

SEQ ID NO: 3034993 - protein, 6 aa, Entamoeba invadens
LSTEDK

SEQ ID NO: 3034994 - protein, 21 aa, Entamoeba invadens
LSTGKSGAKSTEAKRSPTTEK

SEQ ID NO: 3034995 - protein, 7 aa, Entamoeba invadens
LSTSQNQ

SEQ ID NO: 3034996 - protein, 30 aa, Entamoeba invadens
LSTVKNGVKNLKGKSAKQIASAAKTGLKNV

SEQ ID NO: 3034997 - protein, 5 aa, Entamoeba invadens
LSTVP

SEQ ID NO: 3034998 - protein, 27 aa, Entamoeba invadens
LTADNKCKACTKESKCKTCSESTPDVC

SEQ ID NO: 3034999 - protein, 41 aa, Entamoeba invadens
LTAKFGKKNAKKALANIKRAEKKALKQAKKQGLNKKQTKAL

SEQ ID NO: 3035000 - protein, 12 aa, Entamoeba invadens
LTAPKSSQPQLK

SEQ ID NO: 3035001 - protein, 10 aa, Entamoeba invadens
LTDFGSSRNI

SEQ ID NO: 3035002 - protein, 10 aa, Entamoeba invadens
LTDHEKEDLE

SEQ ID NO: 3035003 - protein, 10 aa, Entamoeba invadens
LTDTNPKFKT

SEQ ID NO: 3035004 - protein, 6 aa, Entamoeba invadens
LTDYGK

SEQ ID NO: 3035005 - protein, 6 aa, Entamoeba invadens
LTEHQR

SEQ ID NO: 3035006 - protein, 11 aa, Entamoeba invadens
LTERKYNAEGK

SEQ ID NO: 3035007 - protein, 17 aa, Entamoeba invadens
LTGDHRSEQYPPSENDY

SEQ ID NO: 3035008 - protein, 16 aa, Entamoeba invadens
LTKDDEGKNLRRITGN

SEQ ID NO: 3035009 - protein, 9 aa, Entamoeba invadens
LTKDNNNNI

SEQ ID NO: 3035010 - protein, 11 aa, Entamoeba invadens
LTNGQANRNVS

SEQ ID NO: 3035011 - protein, 47 aa, Entamoeba invadens
LTNHTKPNKPHRHQNDTKPEHHHERNQTNSISCDNTTHPCDNDKPHH

SEQ ID NO: 3035012 - protein, 8 aa, Entamoeba invadens
LTNRSSKF

SEQ ID NO: 3035013 - protein, 7 aa, Entamoeba invadens
LTPDEGF

SEQ ID NO: 3035014 - protein, 10 aa, Entamoeba invadens
LTPDPNNLAN

SEQ ID NO: 3035015 - protein, 9 aa, Entamoeba invadens
LTPTATYAS

SEQ ID NO: 3035016 - protein, 4 aa, Entamoeba invadens
LTQD

SEQ ID NO: 3035017 - protein, 10 aa, Entamoeba invadens
LTQDQEKKIN

SEQ ID NO: 3035018 - protein, 25 aa, Entamoeba invadens
LTQEELKRPTPSFGSPKPSKPLKRQ

SEQ ID NO: 3035019 - protein, 47 aa, Entamoeba invadens
LTQEPAPEGGDPNAAGGDPNAAAGGAGGGEAGSWSQAATTERPSAND

SEQ ID NO: 3035020 - protein, 16 aa, Entamoeba invadens
LTQITQEETLEATAAA

SEQ ID NO: 3035021 - protein, 14 aa, Entamoeba invadens
LTQTKDDKSKIEEQ

SEQ ID NO: 3035022 - protein, 4 aa, Entamoeba invadens
LTRG

SEQ ID NO: 3035023 - protein, 9 aa, Entamoeba invadens
LTSYKSLDP

SEQ ID NO: 3035024 - protein, 4 aa, Entamoeba invadens
LTTF

SEQ ID NO: 3035025 - protein, 7 aa, Entamoeba invadens
LTVTQDS

SEQ ID NO: 3035026 - protein, 6 aa, Entamoeba invadens
LVKQPC

SEQ ID NO: 3035027 - protein, 20 aa, Entamoeba invadens
LVNSEKKRFNAETCRNSTES

SEQ ID NO: 3035028 - protein, 6 aa, Entamoeba invadens
LYDKNE

SEQ ID NO: 3035029 - protein, 10 aa, Entamoeba invadens
LYKDDDQYAM

SEQ ID NO: 3035030 - protein, 11 aa, Entamoeba invadens
LYNETQSSKQR

SEQ ID NO: 3035031 - protein, 10 aa, Entamoeba invadens
LYPNTENDNT

SEQ ID NO: 3035032 - protein, 16 aa, Entamoeba invadens
LYSSQAQEVNESSSLG

SEQ ID NO: 3035033 - protein, 10 aa, Entamoeba invadens
LYSTTTDTFK

SEQ ID NO: 3035034 - protein, 9 aa, Entamoeba invadens
LYYTSEDSD

SEQ ID NO: 3035035 - protein, 9 aa, Entamoeba invadens
LYYTSEESD

SEQ ID NO: 3035036 - protein, 12 aa, Entamoeba invadens
MAKSADIPKKEM

SEQ ID NO: 3035037 - protein, 9 aa, Entamoeba invadens
MARAEEKTG

SEQ ID NO: 3035038 - protein, 6 aa, Entamoeba invadens
MARERK

SEQ ID NO: 3035039 - protein, 13 aa, Entamoeba invadens
MARKGSESSVLPS

SEQ ID NO: 3035040 - protein, 4 aa, Entamoeba invadens
MDEF

SEQ ID NO: 3035041 - protein, 5 aa, Entamoeba invadens
MDKGK

SEQ ID NO: 3035042 - protein, 4 aa, Entamoeba invadens
MDPK

SEQ ID NO: 3035043 - protein, 16 aa, Entamoeba invadens
MDSDEDVDNSNTDATY

SEQ ID NO: 3035044 - protein, 7 aa, Entamoeba invadens
MDSEGSY

SEQ ID NO: 3035045 - protein, 4 aa, Entamoeba invadens
MDVT

SEQ ID NO: 3035046 - protein, 8 aa, Entamoeba invadens
MEGRVNKD

SEQ ID NO: 3035047 - protein, 8 aa, Entamoeba invadens
MENDSKQM

SEQ ID NO: 3035048 - protein, 12 aa, Entamoeba invadens
MEREKETKRRER

SEQ ID NO: 3035049 - protein, 5 aa, Entamoeba invadens
MESTE

SEQ ID NO: 3035050 - protein, 5 aa, Entamoeba invadens
MFGSP

SEQ ID NO: 3035051 - protein, 6 aa, Entamoeba invadens
MGDGTG

SEQ ID NO: 3035052 - protein, 10 aa, Entamoeba invadens
MGKKEQQREV

SEQ ID NO: 3035053 - protein, 9 aa, Entamoeba invadens
MGPSGELRY

SEQ ID NO: 3035054 - protein, 19 aa, Entamoeba invadens
MGPSIASHAGASPSTSTAS

SEQ ID NO: 3035055 - protein, 9 aa, Entamoeba invadens
MGQYTHGNE

SEQ ID NO: 3035056 - protein, 9 aa, Entamoeba invadens
MGSGQQAVT

SEQ ID NO: 3035057 - protein, 20 aa, Entamoeba invadens
MGSPTSGASRSGQCTGENGY

SEQ ID NO: 3035058 - protein, 9 aa, Entamoeba invadens
MGTDERRLA

SEQ ID NO: 3035059 - protein, 5 aa, Entamoeba invadens
MGTPL

SEQ ID NO: 3035060 - protein, 10 aa, Entamoeba invadens
MHPTADKCNE

SEQ ID NO: 3035061 - protein, 12 aa, Entamoeba invadens
MHRTKRDSDSDS

SEQ ID NO: 3035062 - protein, 14 aa, Entamoeba invadens
MKAEAKRRKTSGVT

SEQ ID NO: 3035063 - protein, 4 aa, Entamoeba invadens
MKDE

SEQ ID NO: 3035064 - protein, 12 aa, Entamoeba invadens
MKDEQKVSETNT

SEQ ID NO: 3035065 - protein, 7 aa, Entamoeba invadens
MKDTFTD

SEQ ID NO: 3035066 - protein, 5 aa, Entamoeba invadens
MKENE

SEQ ID NO: 3035067 - protein, 5 aa, Entamoeba invadens
MKENT

SEQ ID NO: 3035068 - protein, 11 aa, Entamoeba invadens
MKESVQRKLDE

SEQ ID NO: 3035069 - protein, 10 aa, Entamoeba invadens
MKKAGEKAIQ

SEQ ID NO: 3035070 - protein, 8 aa, Entamoeba invadens
MKKTPPVR

SEQ ID NO: 3035071 - protein, 13 aa, Entamoeba invadens
MKLGGNKADSAMS

SEQ ID NO: 3035072 - protein, 10 aa, Entamoeba invadens
MKNSNDDNKL

SEQ ID NO: 3035073 - protein, 22 aa, Entamoeba invadens
MKNTLGDIKKTTKGFKTTYNDN

SEQ ID NO: 3035074 - protein, 20 aa, Entamoeba invadens
MKQSGENTTLNNDKNDEEFE

SEQ ID NO: 3035075 - protein, 7 aa, Entamoeba invadens
MKRTQKR

SEQ ID NO: 3035076 - protein, 6 aa, Entamoeba invadens
MKSGDG

SEQ ID NO: 3035077 - protein, 6 aa, Entamoeba invadens
MKSYGG

SEQ ID NO: 3035078 - protein, 33 aa, Entamoeba invadens
MLTKRDKERLERLKTEKKKARQQVKEEKAKMKQ

SEQ ID NO: 3035079 - protein, 4 aa, Entamoeba invadens
MLTS

SEQ ID NO: 3035080 - protein, 16 aa, Entamoeba invadens
MNDAERAEAAAKDAAY

SEQ ID NO: 3035081 - protein, 8 aa, Entamoeba invadens
MNEEHNEE

SEQ ID NO: 3035082 - protein, 7 aa, Entamoeba invadens
MNNHTGC

SEQ ID NO: 3035083 - protein, 4 aa, Entamoeba invadens
MNNM

SEQ ID NO: 3035084 - protein, 9 aa, Entamoeba invadens
MNNNTSYQN

SEQ ID NO: 3035085 - protein, 7 aa, Entamoeba invadens
MNPPKGE

SEQ ID NO: 3035086 - protein, 9 aa, Entamoeba invadens
MNSDDDEEE

SEQ ID NO: 3035087 - protein, 4 aa, Entamoeba invadens
MNTY

SEQ ID NO: 3035088 - protein, 31 aa, Entamoeba invadens
MPAPSVPTPVTPSQPSNSGSSSNADATTSAL

SEQ ID NO: 3035089 - protein, 4 aa, Entamoeba invadens
MPEG

SEQ ID NO: 3035090 - protein, 5 aa, Entamoeba invadens
MPPDL

SEQ ID NO: 3035091 - protein, 21 aa, Entamoeba invadens
MPTETGSSGFTTEQKSCPHQI

SEQ ID NO: 3035092 - protein, 11 aa, Entamoeba invadens
MQEDNNTQNIN

SEQ ID NO: 3035093 - protein, 15 aa, Entamoeba invadens
MQGNKKRAGEDPFGE

SEQ ID NO: 3035094 - protein, 8 aa, Entamoeba invadens
MQKSGSFK

SEQ ID NO: 3035095 - protein, 6 aa, Entamoeba invadens
MRENDR

SEQ ID NO: 3035096 - protein, 6 aa, Entamoeba invadens
MRKDES

SEQ ID NO: 3035097 - protein, 5 aa, Entamoeba invadens
MRPNP

SEQ ID NO: 3035098 - protein, 7 aa, Entamoeba invadens
MSADEEA

SEQ ID NO: 3035099 - protein, 7 aa, Entamoeba invadens
MSAYRSD

SEQ ID NO: 3035100 - protein, 8 aa, Entamoeba invadens
MSDSNTCS

SEQ ID NO: 3035101 - protein, 6 aa, Entamoeba invadens
MSERSD

SEQ ID NO: 3035102 - protein, 13 aa, Entamoeba invadens
MSGESAMDNEKRE

SEQ ID NO: 3035103 - protein, 11 aa, Entamoeba invadens
MSHTNANSIDN

SEQ ID NO: 3035104 - protein, 6 aa, Entamoeba invadens
MSKEER

SEQ ID NO: 3035105 - protein, 4 aa, Entamoeba invadens
MSNT

SEQ ID NO: 3035106 - protein, 6 aa, Entamoeba invadens
MSPDLQ

SEQ ID NO: 3035107 - protein, 12 aa, Entamoeba invadens
MSSADAKHAAES

SEQ ID NO: 3035108 - protein, 5 aa, Entamoeba invadens
MSSKQ

SEQ ID NO: 3035109 - protein, 6 aa, Entamoeba invadens
MTATEK

SEQ ID NO: 3035110 - protein, 5 aa, Entamoeba invadens
MTDNN

SEQ ID NO: 3035111 - protein, 4 aa, Entamoeba invadens
MTEE

SEQ ID NO: 3035112 - protein, 9 aa, Entamoeba invadens
MTKKPTNKL

SEQ ID NO: 3035113 - protein, 5 aa, Entamoeba invadens
MTNPF

SEQ ID NO: 3035114 - protein, 7 aa, Entamoeba invadens
MTPPLSP

SEQ ID NO: 3035115 - protein, 5 aa, Entamoeba invadens
MTPTT

SEQ ID NO: 3035116 - protein, 11 aa, Entamoeba invadens
MTSSESAETQV

SEQ ID NO: 3035117 - protein, 4 aa, Entamoeba invadens
MTTS

SEQ ID NO: 3035118 - protein, 7 aa, Entamoeba invadens
MTYNTNT

SEQ ID NO: 3035119 - protein, 10 aa, Entamoeba invadens
MVPTNPPSTT

SEQ ID NO: 3035120 - protein, 27 aa, Entamoeba invadens
MYPDETTKTCKTCSTTCNGDCNQTSGI

SEQ ID NO: 3035121 - protein, 10 aa, Entamoeba invadens
MYPSSSGSCV

SEQ ID NO: 3035122 - protein, 5 aa, Entamoeba invadens
MYQRS

SEQ ID NO: 3035123 - protein, 5 aa, Entamoeba invadens
MYSGS

SEQ ID NO: 3035124 - protein, 21 aa, Entamoeba invadens
MYSSRNDKSNTVCTSGCGPTS

SEQ ID NO: 3035125 - protein, 12 aa, Entamoeba invadens
MYTNDSPTTMEG

SEQ ID NO: 3035126 - protein, 4 aa, Entamoeba invadens
NAAK

SEQ ID NO: 3035127 - protein, 25 aa, Entamoeba invadens
NACKPRENGTHSSTGGSTACTPCQG

SEQ ID NO: 3035128 - protein, 7 aa, Entamoeba invadens
NADDTTD

SEQ ID NO: 3035129 - protein, 8 aa, Entamoeba invadens
NADKNKLV

SEQ ID NO: 3035130 - protein, 5 aa, Entamoeba invadens
NADKT

SEQ ID NO: 3035131 - protein, 11 aa, Entamoeba invadens
NAEEGKKEVKI

SEQ ID NO: 3035132 - protein, 4 aa, Entamoeba invadens
NAEK

SEQ ID NO: 3035133 - protein, 12 aa, Entamoeba invadens
NAEKSNPDCSTA

SEQ ID NO: 3035134 - protein, 11 aa, Entamoeba invadens
NAEKVSNSAFE

SEQ ID NO: 3035135 - protein, 8 aa, Entamoeba invadens
NAFKGNKL

SEQ ID NO: 3035136 - protein, 7 aa, Entamoeba invadens
NAFQQSG

SEQ ID NO: 3035137 - protein, 6 aa, Entamoeba invadens
NAFSET

SEQ ID NO: 3035138 - protein, 9 aa, Entamoeba invadens
NAGDKLTNK

SEQ ID NO: 3035139 - protein, 7 aa, Entamoeba invadens
NAGETYG

SEQ ID NO: 3035140 - protein, 9 aa, Entamoeba invadens
NAGKDTNGS

SEQ ID NO: 3035141 - protein, 4 aa, Entamoeba invadens
NAGL

SEQ ID NO: 3035142 - protein, 12 aa, Entamoeba invadens
NAITQRELEQNG

SEQ ID NO: 3035143 - protein, 49 aa, Entamoeba invadens
NAKTENFEPHEDEKEWPEPIEDDEEEKERRQKNERLDKERIQKKKEMKE

SEQ ID NO: 3035144 - protein, 12 aa, Entamoeba invadens
NALEVDNEKINQ

SEQ ID NO: 3035145 - protein, 8 aa, Entamoeba invadens
NALNGRPY

SEQ ID NO: 3035146 - protein, 7 aa, Entamoeba invadens
NALPNNA

SEQ ID NO: 3035147 - protein, 11 aa, Entamoeba invadens
NAMKEERDGIE

SEQ ID NO: 3035148 - protein, 9 aa, Entamoeba invadens
NAMRTEKNK

SEQ ID NO: 3035149 - protein, 53 aa, Entamoeba invadens
NANAQKSKVNGQKSSQVGLGADYTSDKFSGSAKYTKSKTGSTKTTSGSINGKY

SEQ ID NO: 3035150 - protein, 8 aa, Entamoeba invadens
NANSEKDY

SEQ ID NO: 3035151 - protein, 17 aa, Entamoeba invadens
NANSVNGVSTISPDPIT

SEQ ID NO: 3035152 - protein, 7 aa, Entamoeba invadens
NAPAVND

SEQ ID NO: 3035153 - protein, 9 aa, Entamoeba invadens
NAPEADGMK

SEQ ID NO: 3035154 - protein, 9 aa, Entamoeba invadens
NAQAAPAPQ

SEQ ID NO: 3035155 - protein, 7 aa, Entamoeba invadens
NAQQAKA

SEQ ID NO: 3035156 - protein, 9 aa, Entamoeba invadens
NAQRRKQAV

SEQ ID NO: 3035157 - protein, 4 aa, Entamoeba invadens
NAQV

SEQ ID NO: 3035158 - protein, 17 aa, Entamoeba invadens
NASKGIDVSQSTSTSSF

SEQ ID NO: 3035159 - protein, 10 aa, Entamoeba invadens
NASKKNTASF

SEQ ID NO: 3035160 - protein, 7 aa, Entamoeba invadens
NASKSNL

SEQ ID NO: 3035161 - protein, 9 aa, Entamoeba invadens
NASLEETDD

SEQ ID NO: 3035162 - protein, 16 aa, Entamoeba invadens
NASNFASSIGKATKGM

SEQ ID NO: 3035163 - protein, 5 aa, Entamoeba invadens
NASSL

SEQ ID NO: 3035164 - protein, 5 aa, Entamoeba invadens
NASVT

SEQ ID NO: 3035165 - protein, 8 aa, Entamoeba invadens
NATGNSII

SEQ ID NO: 3035166 - protein, 27 aa, Entamoeba invadens
NATNTNQTTNTTTLNQKVDTDGIPIPQ

SEQ ID NO: 3035167 - protein, 18 aa, Entamoeba invadens
NATNVTTPHVSKEKPMKT

SEQ ID NO: 3035168 - protein, 7 aa, Entamoeba invadens
NATRENV

SEQ ID NO: 3035169 - protein, 10 aa, Entamoeba invadens
NATRSRGYDN

SEQ ID NO: 3035170 - protein, 7 aa, Entamoeba invadens
NATTSFQ

SEQ ID NO: 3035171 - protein, 8 aa, Entamoeba invadens
NAVDKGTK

SEQ ID NO: 3035172 - protein, 7 aa, Entamoeba invadens
NAYSGCQ

SEQ ID NO: 3035173 - protein, 7 aa, Entamoeba invadens
NAYSNGS

SEQ ID NO: 3035174 - protein, 10 aa, Entamoeba invadens
NAYTAGYTQS

SEQ ID NO: 3035175 - protein, 6 aa, Entamoeba invadens
NCDPPV

SEQ ID NO: 3035176 - protein, 15 aa, Entamoeba invadens
NCDSCKDGKQCDKCK

SEQ ID NO: 3035177 - protein, 16 aa, Entamoeba invadens
NCEDSKEICEKEEVQG

SEQ ID NO: 3035178 - protein, 15 aa, Entamoeba invadens
NCEGDDCEDKVEQDH

SEQ ID NO: 3035179 - protein, 8 aa, Entamoeba invadens
NCESCQSK

SEQ ID NO: 3035180 - protein, 8 aa, Entamoeba invadens
NCKKCSND

SEQ ID NO: 3035181 - protein, 8 aa, Entamoeba invadens
NCNNPEKI

SEQ ID NO: 3035182 - protein, 6 aa, Entamoeba invadens
NCPPNT

SEQ ID NO: 3035183 - protein, 6 aa, Entamoeba invadens
NCPQHP

SEQ ID NO: 3035184 - protein, 6 aa, Entamoeba invadens
NCQGYR

SEQ ID NO: 3035185 - protein, 4 aa, Entamoeba invadens
NCTE

SEQ ID NO: 3035186 - protein, 18 aa, Entamoeba invadens
NCTSENKGCSQASDSCSD

SEQ ID NO: 3035187 - protein, 6 aa, Entamoeba invadens
NCTSKY

SEQ ID NO: 3035188 - protein, 8 aa, Entamoeba invadens
NDADPIEV

SEQ ID NO: 3035189 - protein, 10 aa, Entamoeba invadens
NDAENYQSEY

SEQ ID NO: 3035190 - protein, 14 aa, Entamoeba invadens
NDAINNKDSYIETQ

SEQ ID NO: 3035191 - protein, 7 aa, Entamoeba invadens
NDAKPQK

SEQ ID NO: 3035192 - protein, 10 aa, Entamoeba invadens
NDATTDDEAL

SEQ ID NO: 3035193 - protein, 11 aa, Entamoeba invadens
NDCTTKSPGYY

SEQ ID NO: 3035194 - protein, 16 aa, Entamoeba invadens
NDDHDQQNPGSTSRNM

SEQ ID NO: 3035195 - protein, 6 aa, Entamoeba invadens
NDDKIK

SEQ ID NO: 3035196 - protein, 7 aa, Entamoeba invadens
NDDSNVF

SEQ ID NO: 3035197 - protein, 6 aa, Entamoeba invadens
NDEEFQ

SEQ ID NO: 3035198 - protein, 8 aa, Entamoeba invadens
NDEQSGIM

SEQ ID NO: 3035199 - protein, 6 aa, Entamoeba invadens
NDETPL

SEQ ID NO: 3035200 - protein, 8 aa, Entamoeba invadens
NDIDEGKE

SEQ ID NO: 3035201 - protein, 9 aa, Entamoeba invadens
NDKANFDEP

SEQ ID NO: 3035202 - protein, 7 aa, Entamoeba invadens
NDKNKRL

SEQ ID NO: 3035203 - protein, 7 aa, Entamoeba invadens
NDKRETF

SEQ ID NO: 3035204 - protein, 6 aa, Entamoeba invadens
NDLASF

SEQ ID NO: 3035205 - protein, 6 aa, Entamoeba invadens
NDLPST

SEQ ID NO: 3035206 - protein, 4 aa, Entamoeba invadens
NDMK

SEQ ID NO: 3035207 - protein, 8 aa, Entamoeba invadens
NDNANRTA

SEQ ID NO: 3035208 - protein, 6 aa, Entamoeba invadens
NDNASH

SEQ ID NO: 3035209 - protein, 7 aa, Entamoeba invadens
NDNAYKN

SEQ ID NO: 3035210 - protein, 10 aa, Entamoeba invadens
NDNEDHEDDF

SEQ ID NO: 3035211 - protein, 8 aa, Entamoeba invadens
NDNTKEYR

SEQ ID NO: 3035212 - protein, 7 aa, Entamoeba invadens
NDPKTFD

SEQ ID NO: 3035213 - protein, 5 aa, Entamoeba invadens
NDPTV

SEQ ID NO: 3035214 - protein, 9 aa, Entamoeba invadens
NDQGNRITP

SEQ ID NO: 3035215 - protein, 15 aa, Entamoeba invadens
NDQITSIEYEGKNGL

SEQ ID NO: 3035216 - protein, 5 aa, Entamoeba invadens
NDQPF

SEQ ID NO: 3035217 - protein, 4 aa, Entamoeba invadens
NDQQ

SEQ ID NO: 3035218 - protein, 4 aa, Entamoeba invadens
NDRF

SEQ ID NO: 3035219 - protein, 8 aa, Entamoeba invadens
NDRRDKNY

SEQ ID NO: 3035220 - protein, 6 aa, Entamoeba invadens
NDSGAF

SEQ ID NO: 3035221 - protein, 4 aa, Entamoeba invadens
NDSL

SEQ ID NO: 3035222 - protein, 17 aa, Entamoeba invadens
NDSVSTTIQDKDKTYKT

SEQ ID NO: 3035223 - protein, 4 aa, Entamoeba invadens
NDTA

SEQ ID NO: 3035224 - protein, 5 aa, Entamoeba invadens
NDTIA

SEQ ID NO: 3035225 - protein, 12 aa, Entamoeba invadens
NDTKAGRTYKRG

SEQ ID NO: 3035226 - protein, 5 aa, Entamoeba invadens
NDTSY

SEQ ID NO: 3035227 - protein, 8 aa, Entamoeba invadens
NDTYKYSK

SEQ ID NO: 3035228 - protein, 6 aa, Entamoeba invadens
NDVDEA

SEQ ID NO: 3035229 - protein, 6 aa, Entamoeba invadens
NDVDNE

SEQ ID NO: 3035230 - protein, 7 aa, Entamoeba invadens
NDVKTRR

SEQ ID NO: 3035231 - protein, 8 aa, Entamoeba invadens
NDVMGTRS

SEQ ID NO: 3035232 - protein, 17 aa, Entamoeba invadens
NDYDASNSCTGTPSNII

SEQ ID NO: 3035233 - protein, 8 aa, Entamoeba invadens
NDYREQNK

SEQ ID NO: 3035234 - protein, 4 aa, Entamoeba invadens
NEAQ

SEQ ID NO: 3035235 - protein, 5 aa, Entamoeba invadens
NEASS

SEQ ID NO: 3035236 - protein, 11 aa, Entamoeba invadens
NECGDTKYGDI

SEQ ID NO: 3035237 - protein, 15 aa, Entamoeba invadens
NECQNCADGCNSCTS

SEQ ID NO: 3035238 - protein, 7 aa, Entamoeba invadens
NECVQST

SEQ ID NO: 3035239 - protein, 9 aa, Entamoeba invadens
NEDANPDEV

SEQ ID NO: 3035240 - protein, 22 aa, Entamoeba invadens
NEDVENTTKETHDHKDDVTEIP

SEQ ID NO: 3035241 - protein, 7 aa, Entamoeba invadens
NEDWPEK

SEQ ID NO: 3035242 - protein, 10 aa, Entamoeba invadens
NEEKLFSPEE

SEQ ID NO: 3035243 - protein, 5 aa, Entamoeba invadens
NEEME

SEQ ID NO: 3035244 - protein, 6 aa, Entamoeba invadens
NEGDTV

SEQ ID NO: 3035245 - protein, 16 aa, Entamoeba invadens
NEGKVTGIQKGSATIT

SEQ ID NO: 3035246 - protein, 4 aa, Entamoeba invadens
NEHY

SEQ ID NO: 3035247 - protein, 4 aa, Entamoeba invadens
NEIG

SEQ ID NO: 3035248 - protein, 13 aa, Entamoeba invadens
NEINEENGQCTLP

SEQ ID NO: 3035249 - protein, 12 aa, Entamoeba invadens
NEISLNSNDNFC

SEQ ID NO: 3035250 - protein, 8 aa, Entamoeba invadens
NEISTPQT

SEQ ID NO: 3035251 - protein, 5 aa, Entamoeba invadens
NEKAG

SEQ ID NO: 3035252 - protein, 13 aa, Entamoeba invadens
NEKCETSSQHGCD

SEQ ID NO: 3035253 - protein, 6 aa, Entamoeba invadens
NEKGDY

SEQ ID NO: 3035254 - protein, 11 aa, Entamoeba invadens
NEKKNGVDTAD

SEQ ID NO: 3035255 - protein, 14 aa, Entamoeba invadens
NEKNTATLNGCSPA

SEQ ID NO: 3035256 - protein, 18 aa, Entamoeba invadens
NEKPCEKKTPQNTTNTKF

SEQ ID NO: 3035257 - protein, 19 aa, Entamoeba invadens
NEKTKIAKLNDEEIRKREA

SEQ ID NO: 3035258 - protein, 9 aa, Entamoeba invadens
NEKTKVEEQ

SEQ ID NO: 3035259 - protein, 13 aa, Entamoeba invadens
NEKTTEKEVINTS

SEQ ID NO: 3035260 - protein, 6 aa, Entamoeba invadens
NEKYDR

SEQ ID NO: 3035261 - protein, 11 aa, Entamoeba invadens
NELAQNSNVLD

SEQ ID NO: 3035262 - protein, 7 aa, Entamoeba invadens
NELNKQQ

SEQ ID NO: 3035263 - protein, 14 aa, Entamoeba invadens
NEMKPSIGMSEGGY

SEQ ID NO: 3035264 - protein, 7 aa, Entamoeba invadens
NENAPYN

SEQ ID NO: 3035265 - protein, 17 aa, Entamoeba invadens
NENLTTQTWNRIEIMLK

SEQ ID NO: 3035266 - protein, 10 aa, Entamoeba invadens
NENPLNESAQ

SEQ ID NO: 3035267 - protein, 17 aa, Entamoeba invadens
NENRKPVSGKACEGCNN

SEQ ID NO: 3035268 - protein, 8 aa, Entamoeba invadens
NENTLDLS

SEQ ID NO: 3035269 - protein, 10 aa, Entamoeba invadens
NEPKKRSLTE

SEQ ID NO: 3035270 - protein, 6 aa, Entamoeba invadens
NEPTEF

SEQ ID NO: 3035271 - protein, 14 aa, Entamoeba invadens
NEQIENEKKAIEGT

SEQ ID NO: 3035272 - protein, 6 aa, Entamoeba invadens
NEQKDV

SEQ ID NO: 3035273 - protein, 16 aa, Entamoeba invadens
NEQKNEEVKTEEKKTE

SEQ ID NO: 3035274 - protein, 11 aa, Entamoeba invadens
NEQTKNKYMNG

SEQ ID NO: 3035275 - protein, 11 aa, Entamoeba invadens
NEREKAKNLAN

SEQ ID NO: 3035276 - protein, 5 aa, Entamoeba invadens
NERMG

SEQ ID NO: 3035277 - protein, 20 aa, Entamoeba invadens
NESKSVFKSTRTDRTIKSAE

SEQ ID NO: 3035278 - protein, 6 aa, Entamoeba invadens
NETDEY

SEQ ID NO: 3035279 - protein, 7 aa, Entamoeba invadens
NETDKYT

SEQ ID NO: 3035280 - protein, 9 aa, Entamoeba invadens
NETEKNAWN

SEQ ID NO: 3035281 - protein, 4 aa, Entamoeba invadens
NETH

SEQ ID NO: 3035282 - protein, 17 aa, Entamoeba invadens
NETIASDNSTAKAEQNI

SEQ ID NO: 3035283 - protein, 9 aa, Entamoeba invadens
NETLSESYP

SEQ ID NO: 3035284 - protein, 5 aa, Entamoeba invadens
NETQK

SEQ ID NO: 3035285 - protein, 7 aa, Entamoeba invadens
NETTEKV

SEQ ID NO: 3035286 - protein, 11 aa, Entamoeba invadens
NETTNKLETIP

SEQ ID NO: 3035287 - protein, 12 aa, Entamoeba invadens
NETTNTSNLKNK

SEQ ID NO: 3035288 - protein, 6 aa, Entamoeba invadens
NEVEPA

SEQ ID NO: 3035289 - protein, 14 aa, Entamoeba invadens
NEVIDESDGTTRCE

SEQ ID NO: 3035290 - protein, 12 aa, Entamoeba invadens
NEVTQEKQENIK

SEQ ID NO: 3035291 - protein, 7 aa, Entamoeba invadens
NEYEAKK

SEQ ID NO: 3035292 - protein, 15 aa, Entamoeba invadens
NFDNNETQHSEDPHF

SEQ ID NO: 3035293 - protein, 10 aa, Entamoeba invadens
NFGATENKEK

SEQ ID NO: 3035294 - protein, 13 aa, Entamoeba invadens
NFQQEAPQSTSEP

SEQ ID NO: 3035295 - protein, 5 aa, Entamoeba invadens
NFVKN

SEQ ID NO: 3035296 - protein, 8 aa, Entamoeba invadens
NGATPNNC

SEQ ID NO: 3035297 - protein, 10 aa, Entamoeba invadens
NGCAKNKSTC

SEQ ID NO: 3035298 - protein, 9 aa, Entamoeba invadens
NGCEGGSME

SEQ ID NO: 3035299 - protein, 5 aa, Entamoeba invadens
NGCES

SEQ ID NO: 3035300 - protein, 11 aa, Entamoeba invadens
NGCTGSGTNNC

SEQ ID NO: 3035301 - protein, 8 aa, Entamoeba invadens
NGDENTTN

SEQ ID NO: 3035302 - protein, 5 aa, Entamoeba invadens
NGDGA

SEQ ID NO: 3035303 - protein, 4 aa, Entamoeba invadens
NGDM

SEQ ID NO: 3035304 - protein, 10 aa, Entamoeba invadens
NGDVSNSTFT

SEQ ID NO: 3035305 - protein, 6 aa, Entamoeba invadens
NGETGR

SEQ ID NO: 3035306 - protein, 8 aa, Entamoeba invadens
NGGIETAE

SEQ ID NO: 3035307 - protein, 9 aa, Entamoeba invadens
NGGKTTVEF

SEQ ID NO: 3035308 - protein, 7 aa, Entamoeba invadens
NGGKVST

SEQ ID NO: 3035309 - protein, 11 aa, Entamoeba invadens
NGGNTAFGSTP

SEQ ID NO: 3035310 - protein, 5 aa, Entamoeba invadens
NGGSY

SEQ ID NO: 3035311 - protein, 6 aa, Entamoeba invadens
NGIQSK

SEQ ID NO: 3035312 - protein, 8 aa, Entamoeba invadens
NGISGHPN

SEQ ID NO: 3035313 - protein, 5 aa, Entamoeba invadens
NGITL

SEQ ID NO: 3035314 - protein, 6 aa, Entamoeba invadens
NGITLD

SEQ ID NO: 3035315 - protein, 6 aa, Entamoeba invadens
NGITYP

SEQ ID NO: 3035316 - protein, 16 aa, Entamoeba invadens
NGKCQKATNCQGKSTL

SEQ ID NO: 3035317 - protein, 27 aa, Entamoeba invadens
NGKFASNGKCQDCDSTCGGACDGVSGH

SEQ ID NO: 3035318 - protein, 20 aa, Entamoeba invadens
NGKITSDKKCDTSENACGSG

SEQ ID NO: 3035319 - protein, 7 aa, Entamoeba invadens
NGKKGDF

SEQ ID NO: 3035320 - protein, 16 aa, Entamoeba invadens
NGKLQENAGRDKKMDK

SEQ ID NO: 3035321 - protein, 10 aa, Entamoeba invadens
NGKNPPNCDC

SEQ ID NO: 3035322 - protein, 6 aa, Entamoeba invadens
NGKSYL

SEQ ID NO: 3035323 - protein, 4 aa, Entamoeba invadens
NGKT

SEQ ID NO: 3035324 - protein, 15 aa, Entamoeba invadens
NGKYDSGYEECDTSN

SEQ ID NO: 3035325 - protein, 13 aa, Entamoeba invadens
NGLAGGNETEPGI

SEQ ID NO: 3035326 - protein, 10 aa, Entamoeba invadens
NGLEEARRRE

SEQ ID NO: 3035327 - protein, 13 aa, Entamoeba invadens
NGLEELTDDKQVC

SEQ ID NO: 3035328 - protein, 8 aa, Entamoeba invadens
NGNAPKNY

SEQ ID NO: 3035329 - protein, 13 aa, Entamoeba invadens
NGNDDRNSVNSTN

SEQ ID NO: 3035330 - protein, 5 aa, Entamoeba invadens
NGNDV

SEQ ID NO: 3035331 - protein, 7 aa, Entamoeba invadens
NGNNKDN

SEQ ID NO: 3035332 - protein, 6 aa, Entamoeba invadens
NGNQNG

SEQ ID NO: 3035333 - protein, 6 aa, Entamoeba invadens
NGPCKE

SEQ ID NO: 3035334 - protein, 7 aa, Entamoeba invadens
NGPNANN

SEQ ID NO: 3035335 - protein, 4 aa, Entamoeba invadens
NGPT

SEQ ID NO: 3035336 - protein, 10 aa, Entamoeba invadens
NGQCKTCQEG

SEQ ID NO: 3035337 - protein, 4 aa, Entamoeba invadens
NGQF

SEQ ID NO: 3035338 - protein, 6 aa, Entamoeba invadens
NGQPGW

SEQ ID NO: 3035339 - protein, 12 aa, Entamoeba invadens
NGRCKTDSTYGQ

SEQ ID NO: 3035340 - protein, 5 aa, Entamoeba invadens
NGRNY

SEQ ID NO: 3035341 - protein, 6 aa, Entamoeba invadens
NGSGDV

SEQ ID NO: 3035342 - protein, 9 aa, Entamoeba invadens
NGSPREYTE

SEQ ID NO: 3035343 - protein, 9 aa, Entamoeba invadens
NGTAKYGSS

SEQ ID NO: 3035344 - protein, 8 aa, Entamoeba invadens
NGTCKTGV

SEQ ID NO: 3035345 - protein, 18 aa, Entamoeba invadens
NGTITKQSLAKKNSTPAL

SEQ ID NO: 3035346 - protein, 16 aa, Entamoeba invadens
NGTRPTLSCNTAPKKY

SEQ ID NO: 3035347 - protein, 5 aa, Entamoeba invadens
NGTTA

SEQ ID NO: 3035348 - protein, 11 aa, Entamoeba invadens
NGTTCSQCKEN

SEQ ID NO: 3035349 - protein, 7 aa, Entamoeba invadens
NGTYKDE

SEQ ID NO: 3035350 - protein, 5 aa, Entamoeba invadens
NGTYT

SEQ ID NO: 3035351 - protein, 8 aa, Entamoeba invadens
NGTYTYPK

SEQ ID NO: 3035352 - protein, 6 aa, Entamoeba invadens
NGVGDI

SEQ ID NO: 3035353 - protein, 5 aa, Entamoeba invadens
NGVIN

SEQ ID NO: 3035354 - protein, 12 aa, Entamoeba invadens
NGVLTETDRQGI

SEQ ID NO: 3035355 - protein, 13 aa, Entamoeba invadens
NGVNVNSKGRITV

SEQ ID NO: 3035356 - protein, 5 aa, Entamoeba invadens
NGVSY

SEQ ID NO: 3035357 - protein, 6 aa, Entamoeba invadens
NGVTPR

SEQ ID NO: 3035358 - protein, 14 aa, Entamoeba invadens
NGVTTSYPKQEDDT

SEQ ID NO: 3035359 - protein, 20 aa, Entamoeba invadens
NGVVQEKDYPYTATEGNCGV

SEQ ID NO: 3035360 - protein, 5 aa, Entamoeba invadens
NGWGE

SEQ ID NO: 3035361 - protein, 10 aa, Entamoeba invadens
NGWKDDSYGT

SEQ ID NO: 3035362 - protein, 5 aa, Entamoeba invadens
NGYAN

SEQ ID NO: 3035363 - protein, 6 aa, Entamoeba invadens
NGYGGD

SEQ ID NO: 3035364 - protein, 10 aa, Entamoeba invadens
NGYPSNEKYS

SEQ ID NO: 3035365 - protein, 5 aa, Entamoeba invadens
NGYYP

SEQ ID NO: 3035366 - protein, 8 aa, Entamoeba invadens
NGYYPNDS

SEQ ID NO: 3035367 - protein, 9 aa, Entamoeba invadens
NGYYSNAGD

SEQ ID NO: 3035368 - protein, 11 aa, Entamoeba invadens
NHHGSSHSNNA

SEQ ID NO: 3035369 - protein, 9 aa, Entamoeba invadens
NHKGRPSAY

SEQ ID NO: 3035370 - protein, 5 aa, Entamoeba invadens
NHTFN

SEQ ID NO: 3035371 - protein, 6 aa, Entamoeba invadens
NHTVNR

SEQ ID NO: 3035372 - protein, 14 aa, Entamoeba invadens
NIASRRHKGLTGTD

SEQ ID NO: 3035373 - protein, 11 aa, Entamoeba invadens
NICSPADAISE

SEQ ID NO: 3035374 - protein, 6 aa, Entamoeba invadens
NIDEQK

SEQ ID NO: 3035375 - protein, 4 aa, Entamoeba invadens
NIDS

SEQ ID NO: 3035376 - protein, 4 aa, Entamoeba invadens
NIEH

SEQ ID NO: 3035377 - protein, 10 aa, Entamoeba invadens
NIEKNGETVV

SEQ ID NO: 3035378 - protein, 4 aa, Entamoeba invadens
NIEQ

SEQ ID NO: 3035379 - protein, 9 aa, Entamoeba invadens
NIKKESPSD

SEQ ID NO: 3035380 - protein, 8 aa, Entamoeba invadens
NIKNGKEC

SEQ ID NO: 3035381 - protein, 8 aa, Entamoeba invadens
NIKNKKPQ

SEQ ID NO: 3035382 - protein, 9 aa, Entamoeba invadens
NINKKRRVE

SEQ ID NO: 3035383 - protein, 4 aa, Entamoeba invadens
NINQ

SEQ ID NO: 3035384 - protein, 6 aa, Entamoeba invadens
NIPTTK

SEQ ID NO: 3035385 - protein, 12 aa, Entamoeba invadens
NIRDSMANQRAQ

SEQ ID NO: 3035386 - protein, 8 aa, Entamoeba invadens
NISQSADF

SEQ ID NO: 3035387 - protein, 5 aa, Entamoeba invadens
NITER

SEQ ID NO: 3035388 - protein, 9 aa, Entamoeba invadens
NITNPELNK

SEQ ID NO: 3035389 - protein, 7 aa, Entamoeba invadens
NITNSGK

SEQ ID NO: 3035390 - protein, 5 aa, Entamoeba invadens
NITSL

SEQ ID NO: 3035391 - protein, 10 aa, Entamoeba invadens
NITSNAAAIS

SEQ ID NO: 3035392 - protein, 7 aa, Entamoeba invadens
NKACPNG

SEQ ID NO: 3035393 - protein, 23 aa, Entamoeba invadens
NKAKERDKLASEVEEKTAAVGQL

SEQ ID NO: 3035394 - protein, 5 aa, Entamoeba invadens
NKAKV

SEQ ID NO: 3035395 - protein, 6 aa, Entamoeba invadens
NKANKL

SEQ ID NO: 3035396 - protein, 5 aa, Entamoeba invadens
NKARF

SEQ ID NO: 3035397 - protein, 18 aa, Entamoeba invadens
NKASFSDWSSYGGWSAPT

SEQ ID NO: 3035398 - protein, 8 aa, Entamoeba invadens
NKASNRCE

SEQ ID NO: 3035399 - protein, 5 aa, Entamoeba invadens
NKDGL

SEQ ID NO: 3035400 - protein, 7 aa, Entamoeba invadens
NKDGQYE

SEQ ID NO: 3035401 - protein, 5 aa, Entamoeba invadens
NKDIS

SEQ ID NO: 3035402 - protein, 7 aa, Entamoeba invadens
NKDKSTT

SEQ ID NO: 3035403 - protein, 5 aa, Entamoeba invadens
NKDTR

SEQ ID NO: 3035404 - protein, 9 aa, Entamoeba invadens
NKEIPNKEK

SEQ ID NO: 3035405 - protein, 4 aa, Entamoeba invadens
NKEK

SEQ ID NO: 3035406 - protein, 9 aa, Entamoeba invadens
NKEQYTYQQ

SEQ ID NO: 3035407 - protein, 22 aa, Entamoeba invadens
NKETYQKVRDTTLNEKKEATKV

SEQ ID NO: 3035408 - protein, 7 aa, Entamoeba invadens
NKFGGSD

SEQ ID NO: 3035409 - protein, 11 aa, Entamoeba invadens
NKFSGYANAEG

SEQ ID NO: 3035410 - protein, 9 aa, Entamoeba invadens
NKGDNRVKR

SEQ ID NO: 3035411 - protein, 17 aa, Entamoeba invadens
NKGGYSGGELGGVVENG

SEQ ID NO: 3035412 - protein, 8 aa, Entamoeba invadens
NKGNPHSY

SEQ ID NO: 3035413 - protein, 4 aa, Entamoeba invadens
NKHF

SEQ ID NO: 3035414 - protein, 20 aa, Entamoeba invadens
NKIDDNHQSVKNAFAQIKCA

SEQ ID NO: 3035415 - protein, 9 aa, Entamoeba invadens
NKINEEKVE

SEQ ID NO: 3035416 - protein, 10 aa, Entamoeba invadens
NKINKENRHL

SEQ ID NO: 3035417 - protein, 37 aa, Entamoeba invadens
NKIQKEKDSKKVKEAKKEVKEAVKKVEKKDDKKEEFK

SEQ ID NO: 3035418 - protein, 7 aa, Entamoeba invadens
NKKDLKK

SEQ ID NO: 3035419 - protein, 53 aa, Entamoeba invadens
NKKPFGPKIDSGQVPQPKGDTGPEPDMGDSEKKQTTNTVPKRRGGLRRSRTVN

SEQ ID NO: 3035420 - protein, 16 aa, Entamoeba invadens
NKKQDQLKKNLEKRIE

SEQ ID NO: 3035421 - protein, 13 aa, Entamoeba invadens
NKKRRKQKVEMKK

SEQ ID NO: 3035422 - protein, 17 aa, Entamoeba invadens
NKKTETLENELKEKKEE

SEQ ID NO: 3035423 - protein, 4 aa, Entamoeba invadens
NKLA

SEQ ID NO: 3035424 - protein, 9 aa, Entamoeba invadens
NKLAKNPKI

SEQ ID NO: 3035425 - protein, 30 aa, Entamoeba invadens
NKLEAEEDNSKDLETQLYEKEDDTADLEKE

SEQ ID NO: 3035426 - protein, 6 aa, Entamoeba invadens
NKLPEG

SEQ ID NO: 3035427 - protein, 6 aa, Entamoeba invadens
NKNDQC

SEQ ID NO: 3035428 - protein, 7 aa, Entamoeba invadens
NKNEEAE

SEQ ID NO: 3035429 - protein, 9 aa, Entamoeba invadens
NKNISSAEG

SEQ ID NO: 3035430 - protein, 4 aa, Entamoeba invadens
NKNL

SEQ ID NO: 3035431 - protein, 17 aa, Entamoeba invadens
NKNNDKHGETHKEVTYT

SEQ ID NO: 3035432 - protein, 7 aa, Entamoeba invadens
NKNNQCG

SEQ ID NO: 3035433 - protein, 8 aa, Entamoeba invadens
NKNPQRHD

SEQ ID NO: 3035434 - protein, 5 aa, Entamoeba invadens
NKNPY

SEQ ID NO: 3035435 - protein, 8 aa, Entamoeba invadens
NKNSCNVT

SEQ ID NO: 3035436 - protein, 7 aa, Entamoeba invadens
NKNSTLT

SEQ ID NO: 3035437 - protein, 12 aa, Entamoeba invadens
NKPIPSVSESSE

SEQ ID NO: 3035438 - protein, 7 aa, Entamoeba invadens
NKPYPKS

SEQ ID NO: 3035439 - protein, 4 aa, Entamoeba invadens
NKQK

SEQ ID NO: 3035440 - protein, 6 aa, Entamoeba invadens
NKQPID

SEQ ID NO: 3035441 - protein, 9 aa, Entamoeba invadens
NKQQPTVKQ

SEQ ID NO: 3035442 - protein, 11 aa, Entamoeba invadens
NKQTKNKYMNG

SEQ ID NO: 3035443 - protein, 14 aa, Entamoeba invadens
NKQTKNKYMNGNKC

SEQ ID NO: 3035444 - protein, 13 aa, Entamoeba invadens
NKQTQKRSDEQTN

SEQ ID NO: 3035445 - protein, 8 aa, Entamoeba invadens
NKQTTSNV

SEQ ID NO: 3035446 - protein, 6 aa, Entamoeba invadens
NKREAL

SEQ ID NO: 3035447 - protein, 9 aa, Entamoeba invadens
NKRKNPSDA

SEQ ID NO: 3035448 - protein, 16 aa, Entamoeba invadens
NKSDEDEVNTPSVSSE

SEQ ID NO: 3035449 - protein, 16 aa, Entamoeba invadens
NKSKEQQETYENEKRE

SEQ ID NO: 3035450 - protein, 8 aa, Entamoeba invadens
NKSNLGKK

SEQ ID NO: 3035451 - protein, 6 aa, Entamoeba invadens
NKSPHT

SEQ ID NO: 3035452 - protein, 8 aa, Entamoeba invadens
NKSTGRIN

SEQ ID NO: 3035453 - protein, 13 aa, Entamoeba invadens
NKTCDSGKCQDPL

SEQ ID NO: 3035454 - protein, 4 aa, Entamoeba invadens
NKTD

SEQ ID NO: 3035455 - protein, 9 aa, Entamoeba invadens
NKTDSTDEQ

SEQ ID NO: 3035456 - protein, 10 aa, Entamoeba invadens
NKTGKDKDEV

SEQ ID NO: 3035457 - protein, 10 aa, Entamoeba invadens
NKTKEKKYKT

SEQ ID NO: 3035458 - protein, 11 aa, Entamoeba invadens
NKTKLNPPQFV

SEQ ID NO: 3035459 - protein, 5 aa, Entamoeba invadens
NKTKP

SEQ ID NO: 3035460 - protein, 18 aa, Entamoeba invadens
NKTLRSELEAKAKEHTEA

SEQ ID NO: 3035461 - protein, 5 aa, Entamoeba invadens
NKTND

SEQ ID NO: 3035462 - protein, 8 aa, Entamoeba invadens
NKTVGDKP

SEQ ID NO: 3035463 - protein, 14 aa, Entamoeba invadens
NKVNAKLTDFGSSR

SEQ ID NO: 3035464 - protein, 12 aa, Entamoeba invadens
NKYDPKPVECPP

SEQ ID NO: 3035465 - protein, 7 aa, Entamoeba invadens
NKYNNAA

SEQ ID NO: 3035466 - protein, 19 aa, Entamoeba invadens
NKYNNAAFNTSNDIDYNNN

SEQ ID NO: 3035467 - protein, 7 aa, Entamoeba invadens
NKYNNTA

SEQ ID NO: 3035468 - protein, 6 aa, Entamoeba invadens
NKYPLK

SEQ ID NO: 3035469 - protein, 23 aa, Entamoeba invadens
NKYSAKEKEFYRNKRKEGEKAAF

SEQ ID NO: 3035470 - protein, 6 aa, Entamoeba invadens
NLEDCD

SEQ ID NO: 3035471 - protein, 4 aa, Entamoeba invadens
NLEE

SEQ ID NO: 3035472 - protein, 34 aa, Entamoeba invadens
NLEQTNTNVNDELEKTKNETKGIAEELSKANAEL

SEQ ID NO: 3035473 - protein, 9 aa, Entamoeba invadens
NLEQTQKEA

SEQ ID NO: 3035474 - protein, 11 aa, Entamoeba invadens
NLGTDTGKGVY

SEQ ID NO: 3035475 - protein, 17 aa, Entamoeba invadens
NLKKEYVKTRQSKFRHD

SEQ ID NO: 3035476 - protein, 10 aa, Entamoeba invadens
NLKKSKEQME

SEQ ID NO: 3035477 - protein, 8 aa, Entamoeba invadens
NLKKSSAK

SEQ ID NO: 3035478 - protein, 6 aa, Entamoeba invadens
NLKNDE

SEQ ID NO: 3035479 - protein, 8 aa, Entamoeba invadens
NLKTTEQI

SEQ ID NO: 3035480 - protein, 5 aa, Entamoeba invadens
NLLRN

SEQ ID NO: 3035481 - protein, 10 aa, Entamoeba invadens
NLNKTNTNYS

SEQ ID NO: 3035482 - protein, 7 aa, Entamoeba invadens
NLPENTA

SEQ ID NO: 3035483 - protein, 6 aa, Entamoeba invadens
NLPQQV

SEQ ID NO: 3035484 - protein, 9 aa, Entamoeba invadens
NLQKTEKGY

SEQ ID NO: 3035485 - protein, 10 aa, Entamoeba invadens
NLQMSSSTQR

SEQ ID NO: 3035486 - protein, 5 aa, Entamoeba invadens
NLRQN

SEQ ID NO: 3035487 - protein, 6 aa, Entamoeba invadens
NLSAEQ

SEQ ID NO: 3035488 - protein, 6 aa, Entamoeba invadens
NLTDNT

SEQ ID NO: 3035489 - protein, 18 aa, Entamoeba invadens
NLTQDPKIQQNVKDTRRR

SEQ ID NO: 3035490 - protein, 7 aa, Entamoeba invadens
NLTYSRS

SEQ ID NO: 3035491 - protein, 9 aa, Entamoeba invadens
NMPPTSTGF

SEQ ID NO: 3035492 - protein, 6 aa, Entamoeba invadens
NMTNGY

SEQ ID NO: 3035493 - protein, 7 aa, Entamoeba invadens
NMYPSLD

SEQ ID NO: 3035494 - protein, 10 aa, Entamoeba invadens
NMYPSPDTGK

SEQ ID NO: 3035495 - protein, 12 aa, Entamoeba invadens
NNADYQKCTQSM

SEQ ID NO: 3035496 - protein, 6 aa, Entamoeba invadens
NNAFNS

SEQ ID NO: 3035497 - protein, 8 aa, Entamoeba invadens
NNCNTHQQ

SEQ ID NO: 3035498 - protein, 6 aa, Entamoeba invadens
NNDETT

SEQ ID NO: 3035499 - protein, 13 aa, Entamoeba invadens
NNDITGDLSPMNY

SEQ ID NO: 3035500 - protein, 8 aa, Entamoeba invadens
NNDTPLPK

SEQ ID NO: 3035501 - protein, 11 aa, Entamoeba invadens
NNDVDGDNVDT

SEQ ID NO: 3035502 - protein, 26 aa, Entamoeba invadens
NNELKNELDEQNIQTNTKEDELNNEI

SEQ ID NO: 3035503 - protein, 6 aa, Entamoeba invadens
NNEQCS

SEQ ID NO: 3035504 - protein, 14 aa, Entamoeba invadens
NNERCRADTSNNIT

SEQ ID NO: 3035505 - protein, 9 aa, Entamoeba invadens
NNETGLSNK

SEQ ID NO: 3035506 - protein, 13 aa, Entamoeba invadens
NNFKSTGCGNVPE

SEQ ID NO: 3035507 - protein, 6 aa, Entamoeba invadens
NNFPHG

SEQ ID NO: 3035508 - protein, 10 aa, Entamoeba invadens
NNGCNGGTGS

SEQ ID NO: 3035509 - protein, 9 aa, Entamoeba invadens
NNGGGYVSA

SEQ ID NO: 3035510 - protein, 13 aa, Entamoeba invadens
NNGIRDDYTKYSK

SEQ ID NO: 3035511 - protein, 7 aa, Entamoeba invadens
NNGNFTY

SEQ ID NO: 3035512 - protein, 8 aa, Entamoeba invadens
NNGNPKCS

SEQ ID NO: 3035513 - protein, 7 aa, Entamoeba invadens
NNHQSNM

SEQ ID NO: 3035514 - protein, 10 aa, Entamoeba invadens
NNKCTSCSDG

SEQ ID NO: 3035515 - protein, 15 aa, Entamoeba invadens
NNKDPYMAKDIPRTV

SEQ ID NO: 3035516 - protein, 7 aa, Entamoeba invadens
NNKTNNL

SEQ ID NO: 3035517 - protein, 12 aa, Entamoeba invadens
NNMSEKEAIDSP

SEQ ID NO: 3035518 - protein, 8 aa, Entamoeba invadens
NNNADTTT

SEQ ID NO: 3035519 - protein, 10 aa, Entamoeba invadens
NNNKKTQEIN

SEQ ID NO: 3035520 - protein, 7 aa, Entamoeba invadens
NNNMRSN

SEQ ID NO: 3035521 - protein, 8 aa, Entamoeba invadens
NNNPDASS

SEQ ID NO: 3035522 - protein, 6 aa, Entamoeba invadens
NNNPTD

SEQ ID NO: 3035523 - protein, 6 aa, Entamoeba invadens
NNNYKD

SEQ ID NO: 3035524 - protein, 5 aa, Entamoeba invadens
NNPEE

SEQ ID NO: 3035525 - protein, 5 aa, Entamoeba invadens
NNPTL

SEQ ID NO: 3035526 - protein, 4 aa, Entamoeba invadens
NNQF

SEQ ID NO: 3035527 - protein, 10 aa, Entamoeba invadens
NNQKEESEQK

SEQ ID NO: 3035528 - protein, 11 aa, Entamoeba invadens
NNQTGRDLNNN

SEQ ID NO: 3035529 - protein, 8 aa, Entamoeba invadens
NNRISADS

SEQ ID NO: 3035530 - protein, 6 aa, Entamoeba invadens
NNSIPN

SEQ ID NO: 3035531 - protein, 6 aa, Entamoeba invadens
NNSNRE

SEQ ID NO: 3035532 - protein, 4 aa, Entamoeba invadens
NNTL

SEQ ID NO: 3035533 - protein, 7 aa, Entamoeba invadens
NNTRKEK

SEQ ID NO: 3035534 - protein, 11 aa, Entamoeba invadens
NNTRKEKTMKP

SEQ ID NO: 3035535 - protein, 7 aa, Entamoeba invadens
NNTTSGM

SEQ ID NO: 3035536 - protein, 10 aa, Entamoeba invadens
NNVQTSKDLT

SEQ ID NO: 3035537 - protein, 9 aa, Entamoeba invadens
NNYNQPKSY

SEQ ID NO: 3035538 - protein, 6 aa, Entamoeba invadens
NNYTTT

SEQ ID NO: 3035539 - protein, 8 aa, Entamoeba invadens
NPADENTF

SEQ ID NO: 3035540 - protein, 8 aa, Entamoeba invadens
NPASSLNN

SEQ ID NO: 3035541 - protein, 19 aa, Entamoeba invadens
NPAVAPSGYIENPSSSPIK

SEQ ID NO: 3035542 - protein, 4 aa, Entamoeba invadens
NPDY

SEQ ID NO: 3035543 - protein, 11 aa, Entamoeba invadens
NPFAPKDEEKM

SEQ ID NO: 3035544 - protein, 9 aa, Entamoeba invadens
NPFNPKPIN

SEQ ID NO: 3035545 - protein, 5 aa, Entamoeba invadens
NPGGF

SEQ ID NO: 3035546 - protein, 6 aa, Entamoeba invadens
NPHNTD

SEQ ID NO: 3035547 - protein, 18 aa, Entamoeba invadens
NPHPQDKHGTNISSWPPE

SEQ ID NO: 3035548 - protein, 10 aa, Entamoeba invadens
NPKEAGPDDS

SEQ ID NO: 3035549 - protein, 5 aa, Entamoeba invadens
NPKEF

SEQ ID NO: 3035550 - protein, 5 aa, Entamoeba invadens
NPKQF

SEQ ID NO: 3035551 - protein, 5 aa, Entamoeba invadens
NPKTR

SEQ ID NO: 3035552 - protein, 19 aa, Entamoeba invadens
NPKTRERRVPQQREPYEGD

SEQ ID NO: 3035553 - protein, 13 aa, Entamoeba invadens
NPKYTATDQAYAA

SEQ ID NO: 3035554 - protein, 7 aa, Entamoeba invadens
NPNGNTK

SEQ ID NO: 3035555 - protein, 6 aa, Entamoeba invadens
NPNKRI

SEQ ID NO: 3035556 - protein, 7 aa, Entamoeba invadens
NPNKRLL

SEQ ID NO: 3035557 - protein, 10 aa, Entamoeba invadens
NPNQNKNTFN

SEQ ID NO: 3035558 - protein, 13 aa, Entamoeba invadens
NPPIEGAPGSDNQ

SEQ ID NO: 3035559 - protein, 13 aa, Entamoeba invadens
NPPIEGAPGTDNQ

SEQ ID NO: 3035560 - protein, 5 aa, Entamoeba invadens
NPPII

SEQ ID NO: 3035561 - protein, 13 aa, Entamoeba invadens
NPPLSDAPGTQNQ

SEQ ID NO: 3035562 - protein, 13 aa, Entamoeba invadens
NPPMTPNGANPGL

SEQ ID NO: 3035563 - protein, 8 aa, Entamoeba invadens
NPPYSSVP

SEQ ID NO: 3035564 - protein, 6 aa, Entamoeba invadens
NPQLNR

SEQ ID NO: 3035565 - protein, 6 aa, Entamoeba invadens
NPRDRC

SEQ ID NO: 3035566 - protein, 6 aa, Entamoeba invadens
NPSFEQ

SEQ ID NO: 3035567 - protein, 7 aa, Entamoeba invadens
NPSTGHN

SEQ ID NO: 3035568 - protein, 8 aa, Entamoeba invadens
NPSTLEDV

SEQ ID NO: 3035569 - protein, 5 aa, Entamoeba invadens
NPSTR

SEQ ID NO: 3035570 - protein, 7 aa, Entamoeba invadens
NPTGDTK

SEQ ID NO: 3035571 - protein, 9 aa, Entamoeba invadens
NPTITDKYP

SEQ ID NO: 3035572 - protein, 5 aa, Entamoeba invadens
NPTLG

SEQ ID NO: 3035573 - protein, 5 aa, Entamoeba invadens
NPTSI

SEQ ID NO: 3035574 - protein, 15 aa, Entamoeba invadens
NPTTKFGENAFEESK

SEQ ID NO: 3035575 - protein, 5 aa, Entamoeba invadens
NPTVG

SEQ ID NO: 3035576 - protein, 7 aa, Entamoeba invadens
NPYSQSG

SEQ ID NO: 3035577 - protein, 13 aa, Entamoeba invadens
NQDMNKNVGESAV

SEQ ID NO: 3035578 - protein, 9 aa, Entamoeba invadens
NQDTSQRTL

SEQ ID NO: 3035579 - protein, 6 aa, Entamoeba invadens
NQDYSA

SEQ ID NO: 3035580 - protein, 6 aa, Entamoeba invadens
NQGNSF

SEQ ID NO: 3035581 - protein, 5 aa, Entamoeba invadens
NQHEF

SEQ ID NO: 3035582 - protein, 9 aa, Entamoeba invadens
NQISENKRE

SEQ ID NO: 3035583 - protein, 12 aa, Entamoeba invadens
NQKRNGRSRSAH

SEQ ID NO: 3035584 - protein, 15 aa, Entamoeba invadens
NQLENNEKAQKDLQN

SEQ ID NO: 3035585 - protein, 6 aa, Entamoeba invadens
NQLKRK

SEQ ID NO: 3035586 - protein, 14 aa, Entamoeba invadens
NQNKEGKVQAEVER

SEQ ID NO: 3035587 - protein, 10 aa, Entamoeba invadens
NQNLADDKQS

SEQ ID NO: 3035588 - protein, 4 aa, Entamoeba invadens
NQNN

SEQ ID NO: 3035589 - protein, 4 aa, Entamoeba invadens
NQNP

SEQ ID NO: 3035590 - protein, 4 aa, Entamoeba invadens
NQNV

SEQ ID NO: 3035591 - protein, 10 aa, Entamoeba invadens
NQPNYDEYDK

SEQ ID NO: 3035592 - protein, 7 aa, Entamoeba invadens
NQPQTTF

SEQ ID NO: 3035593 - protein, 4 aa, Entamoeba invadens
NQQI

SEQ ID NO: 3035594 - protein, 14 aa, Entamoeba invadens
NQQKITKSQLKETK

SEQ ID NO: 3035595 - protein, 4 aa, Entamoeba invadens
NQQL

SEQ ID NO: 3035596 - protein, 12 aa, Entamoeba invadens
NQQQQQRQQRLP

SEQ ID NO: 3035597 - protein, 17 aa, Entamoeba invadens
NQRTAYPYNGTLEKSGI

SEQ ID NO: 3035598 - protein, 6 aa, Entamoeba invadens
NQSFSD

SEQ ID NO: 3035599 - protein, 7 aa, Entamoeba invadens
NQSKVED

SEQ ID NO: 3035600 - protein, 5 aa, Entamoeba invadens
NQSNV

SEQ ID NO: 3035601 - protein, 4 aa, Entamoeba invadens
NQSS

SEQ ID NO: 3035602 - protein, 5 aa, Entamoeba invadens
NQTGC

SEQ ID NO: 3035603 - protein, 8 aa, Entamoeba invadens
NQTYPKNT

SEQ ID NO: 3035604 - protein, 4 aa, Entamoeba invadens
NQVG

SEQ ID NO: 3035605 - protein, 9 aa, Entamoeba invadens
NQVSGSLTA

SEQ ID NO: 3035606 - protein, 9 aa, Entamoeba invadens
NQVTSTKEK

SEQ ID NO: 3035607 - protein, 4 aa, Entamoeba invadens
NRCT

SEQ ID NO: 3035608 - protein, 7 aa, Entamoeba invadens
NRDPENN

SEQ ID NO: 3035609 - protein, 5 aa, Entamoeba invadens
NRECV

SEQ ID NO: 3035610 - protein, 4 aa, Entamoeba invadens
NREL

SEQ ID NO: 3035611 - protein, 6 aa, Entamoeba invadens
NRENAK

SEQ ID NO: 3035612 - protein, 11 aa, Entamoeba invadens
NRERMNSANAV

SEQ ID NO: 3035613 - protein, 5 aa, Entamoeba invadens
NRGPL

SEQ ID NO: 3035614 - protein, 35 aa, Entamoeba invadens
NRKDKKNTVSVGGEYKNDKFNVKGNAKVGGGDRSV

SEQ ID NO: 3035615 - protein, 5 aa, Entamoeba invadens
NRKYQ

SEQ ID NO: 3035616 - protein, 10 aa, Entamoeba invadens
NRLERREEIP

SEQ ID NO: 3035617 - protein, 10 aa, Entamoeba invadens
NRNKKCEKCK

SEQ ID NO: 3035618 - protein, 5 aa, Entamoeba invadens
NRNKV

SEQ ID NO: 3035619 - protein, 8 aa, Entamoeba invadens
NRNTDTMI

SEQ ID NO: 3035620 - protein, 7 aa, Entamoeba invadens
NRNVPQN

SEQ ID NO: 3035621 - protein, 4 aa, Entamoeba invadens
NRPE

SEQ ID NO: 3035622 - protein, 7 aa, Entamoeba invadens
NRPEETQ

SEQ ID NO: 3035623 - protein, 19 aa, Entamoeba invadens
NRPQKTPSAFQPSKVLFQV

SEQ ID NO: 3035624 - protein, 5 aa, Entamoeba invadens
NRPTM

SEQ ID NO: 3035625 - protein, 12 aa, Entamoeba invadens
NRQIENEKKRDT

SEQ ID NO: 3035626 - protein, 6 aa, Entamoeba invadens
NRQRDD

SEQ ID NO: 3035627 - protein, 12 aa, Entamoeba invadens
NRRSRRARATRR

SEQ ID NO: 3035628 - protein, 15 aa, Entamoeba invadens
NRTNRLKKQLSENNA

SEQ ID NO: 3035629 - protein, 6 aa, Entamoeba invadens
NRTPSI

SEQ ID NO: 3035630 - protein, 6 aa, Entamoeba invadens
NSADAL

SEQ ID NO: 3035631 - protein, 19 aa, Entamoeba invadens
NSALYKGSRQNQDASGSLY

SEQ ID NO: 3035632 - protein, 6 aa, Entamoeba invadens
NSASFS

SEQ ID NO: 3035633 - protein, 9 aa, Entamoeba invadens
NSCNKTQCQ

SEQ ID NO: 3035634 - protein, 8 aa, Entamoeba invadens
NSCPADEY

SEQ ID NO: 3035635 - protein, 17 aa, Entamoeba invadens
NSCQEALASTTKLETKT

SEQ ID NO: 3035636 - protein, 9 aa, Entamoeba invadens
NSCSNTNYR

SEQ ID NO: 3035637 - protein, 17 aa, Entamoeba invadens
NSCTKYDSNCGSCNPTS

SEQ ID NO: 3035638 - protein, 7 aa, Entamoeba invadens
NSCYGPN

SEQ ID NO: 3035639 - protein, 6 aa, Entamoeba invadens
NSDCQD

SEQ ID NO: 3035640 - protein, 9 aa, Entamoeba invadens
NSDCSTSQK

SEQ ID NO: 3035641 - protein, 6 aa, Entamoeba invadens
NSDGSC

SEQ ID NO: 3035642 - protein, 9 aa, Entamoeba invadens
NSDIEDRYK

SEQ ID NO: 3035643 - protein, 4 aa, Entamoeba invadens
NSDK

SEQ ID NO: 3035644 - protein, 6 aa, Entamoeba invadens
NSDKTL

SEQ ID NO: 3035645 - protein, 7 aa, Entamoeba invadens
NSDQVIN

SEQ ID NO: 3035646 - protein, 5 aa, Entamoeba invadens
NSDQY

SEQ ID NO: 3035647 - protein, 7 aa, Entamoeba invadens
NSDSTVN

SEQ ID NO: 3035648 - protein, 8 aa, Entamoeba invadens
NSECQPCA

SEQ ID NO: 3035649 - protein, 7 aa, Entamoeba invadens
NSEHNTH

SEQ ID NO: 3035650 - protein, 6 aa, Entamoeba invadens
NSEMDS

SEQ ID NO: 3035651 - protein, 4 aa, Entamoeba invadens
NSGK

SEQ ID NO: 3035652 - protein, 16 aa, Entamoeba invadens
NSGMGEEFDRPYTSGD

SEQ ID NO: 3035653 - protein, 5 aa, Entamoeba invadens
NSGSC

SEQ ID NO: 3035654 - protein, 12 aa, Entamoeba invadens
NSIENCKQNNQM

SEQ ID NO: 3035655 - protein, 14 aa, Entamoeba invadens
NSISSDNNTSCEQC

SEQ ID NO: 3035656 - protein, 7 aa, Entamoeba invadens
NSITKKQ

SEQ ID NO: 3035657 - protein, 6 aa, Entamoeba invadens
NSKCES

SEQ ID NO: 3035658 - protein, 9 aa, Entamoeba invadens
NSKQKKTMK

SEQ ID NO: 3035659 - protein, 5 aa, Entamoeba invadens
NSKTM

SEQ ID NO: 3035660 - protein, 19 aa, Entamoeba invadens
NSLEPKEKTETKPAAPEGV

SEQ ID NO: 3035661 - protein, 10 aa, Entamoeba invadens
NSLESDNESI

SEQ ID NO: 3035662 - protein, 13 aa, Entamoeba invadens
NSLGDVEVSNTYS

SEQ ID NO: 3035663 - protein, 8 aa, Entamoeba invadens
NSLKDGGY

SEQ ID NO: 3035664 - protein, 9 aa, Entamoeba invadens
NSLKGAKEK

SEQ ID NO: 3035665 - protein, 7 aa, Entamoeba invadens
NSLPPKE

SEQ ID NO: 3035666 - protein, 7 aa, Entamoeba invadens
NSNEGYT

SEQ ID NO: 3035667 - protein, 8 aa, Entamoeba invadens
NSNKGRVY

SEQ ID NO: 3035668 - protein, 9 aa, Entamoeba invadens
NSNKSTSRY

SEQ ID NO: 3035669 - protein, 9 aa, Entamoeba invadens
NSNRQFDSK

SEQ ID NO: 3035670 - protein, 5 aa, Entamoeba invadens
NSNYT

SEQ ID NO: 3035671 - protein, 7 aa, Entamoeba invadens
NSQFSLK

SEQ ID NO: 3035672 - protein, 8 aa, Entamoeba invadens
NSQKEYTC

SEQ ID NO: 3035673 - protein, 8 aa, Entamoeba invadens
NSQPQTPE

SEQ ID NO: 3035674 - protein, 7 aa, Entamoeba invadens
NSRGRTL

SEQ ID NO: 3035675 - protein, 5 aa, Entamoeba invadens
NSSDE

SEQ ID NO: 3035676 - protein, 11 aa, Entamoeba invadens
NSSINNGFSPS

SEQ ID NO: 3035677 - protein, 4 aa, Entamoeba invadens
NSSK

SEQ ID NO: 3035678 - protein, 5 aa, Entamoeba invadens
NSSKI

SEQ ID NO: 3035679 - protein, 6 aa, Entamoeba invadens
NSSKNV

SEQ ID NO: 3035680 - protein, 13 aa, Entamoeba invadens
NSSMTSVSRAMET

SEQ ID NO: 3035681 - protein, 5 aa, Entamoeba invadens
NSSRL

SEQ ID NO: 3035682 - protein, 11 aa, Entamoeba invadens
NSSSTGCNSCK

SEQ ID NO: 3035683 - protein, 4 aa, Entamoeba invadens
NSST

SEQ ID NO: 3035684 - protein, 7 aa, Entamoeba invadens
NSSYCEK

SEQ ID NO: 3035685 - protein, 8 aa, Entamoeba invadens
NSSYCEKN

SEQ ID NO: 3035686 - protein, 7 aa, Entamoeba invadens
NSTNGYC

SEQ ID NO: 3035687 - protein, 6 aa, Entamoeba invadens
NSTNIT

SEQ ID NO: 3035688 - protein, 7 aa, Entamoeba invadens
NSTQCSP

SEQ ID NO: 3035689 - protein, 8 aa, Entamoeba invadens
NSTQCSPC

SEQ ID NO: 3035690 - protein, 12 aa, Entamoeba invadens
NSTTEKSKLAKQ

SEQ ID NO: 3035691 - protein, 4 aa, Entamoeba invadens
NSTV

SEQ ID NO: 3035692 - protein, 6 aa, Entamoeba invadens
NSTVFS

SEQ ID NO: 3035693 - protein, 11 aa, Entamoeba invadens
NSVPRKNDAEL

SEQ ID NO: 3035694 - protein, 5 aa, Entamoeba invadens
NSVYD

SEQ ID NO: 3035695 - protein, 7 aa, Entamoeba invadens
NSYSTSV

SEQ ID NO: 3035696 - protein, 13 aa, Entamoeba invadens
NTCEQGRNFEEEY

SEQ ID NO: 3035697 - protein, 17 aa, Entamoeba invadens
NTCGVTSEPIIPTGVKY

SEQ ID NO: 3035698 - protein, 17 aa, Entamoeba invadens
NTCGVTSEPIVPTGIKY

SEQ ID NO: 3035699 - protein, 17 aa, Entamoeba invadens
NTCGVTTDPVYPTGVKY

SEQ ID NO: 3035700 - protein, 7 aa, Entamoeba invadens
NTCNTNA

SEQ ID NO: 3035701 - protein, 7 aa, Entamoeba invadens
NTCPGQL

SEQ ID NO: 3035702 - protein, 7 aa, Entamoeba invadens
NTCTKCG

SEQ ID NO: 3035703 - protein, 5 aa, Entamoeba invadens
NTDIN

SEQ ID NO: 3035704 - protein, 9 aa, Entamoeba invadens
NTDLGPYQN

SEQ ID NO: 3035705 - protein, 8 aa, Entamoeba invadens
NTEEHTTV

SEQ ID NO: 3035706 - protein, 10 aa, Entamoeba invadens
NTEEKKSIIT

SEQ ID NO: 3035707 - protein, 6 aa, Entamoeba invadens
NTEGDS

SEQ ID NO: 3035708 - protein, 4 aa, Entamoeba invadens
NTEK

SEQ ID NO: 3035709 - protein, 7 aa, Entamoeba invadens
NTEKKNE

SEQ ID NO: 3035710 - protein, 5 aa, Entamoeba invadens
NTELP

SEQ ID NO: 3035711 - protein, 5 aa, Entamoeba invadens
NTEMG

SEQ ID NO: 3035712 - protein, 24 aa, Entamoeba invadens
NTENDDKPLNIQSRYSKPIKHSHK

SEQ ID NO: 3035713 - protein, 6 aa, Entamoeba invadens
NTENEY

SEQ ID NO: 3035714 - protein, 5 aa, Entamoeba invadens
NTENK

SEQ ID NO: 3035715 - protein, 6 aa, Entamoeba invadens
NTEREK

SEQ ID NO: 3035716 - protein, 6 aa, Entamoeba invadens
NTETGV

SEQ ID NO: 3035717 - protein, 7 aa, Entamoeba invadens
NTETIDK

SEQ ID NO: 3035718 - protein, 8 aa, Entamoeba invadens
NTETTESG

SEQ ID NO: 3035719 - protein, 7 aa, Entamoeba invadens
NTEYPTG

SEQ ID NO: 3035720 - protein, 8 aa, Entamoeba invadens
NTGGATTC

SEQ ID NO: 3035721 - protein, 19 aa, Entamoeba invadens
NTGGSDNQCNGDKKSGSCA

SEQ ID NO: 3035722 - protein, 4 aa, Entamoeba invadens
NTHT

SEQ ID NO: 3035723 - protein, 8 aa, Entamoeba invadens
NTIEYPGE

SEQ ID NO: 3035724 - protein, 4 aa, Entamoeba invadens
NTIN

SEQ ID NO: 3035725 - protein, 4 aa, Entamoeba invadens
NTIS

SEQ ID NO: 3035726 - protein, 14 aa, Entamoeba invadens
NTISNITGANAGIS

SEQ ID NO: 3035727 - protein, 6 aa, Entamoeba invadens
NTISRC

SEQ ID NO: 3035728 - protein, 4 aa, Entamoeba invadens
NTKI

SEQ ID NO: 3035729 - protein, 13 aa, Entamoeba invadens
NTKIQKNVRDARQ

SEQ ID NO: 3035730 - protein, 4 aa, Entamoeba invadens
NTKK

SEQ ID NO: 3035731 - protein, 7 aa, Entamoeba invadens
NTLKSKN

SEQ ID NO: 3035732 - protein, 12 aa, Entamoeba invadens
NTLQKENEEMKK

SEQ ID NO: 3035733 - protein, 7 aa, Entamoeba invadens
NTLRSRD

SEQ ID NO: 3035734 - protein, 7 aa, Entamoeba invadens
NTMSSGD

SEQ ID NO: 3035735 - protein, 4 aa, Entamoeba invadens
NTNC

SEQ ID NO: 3035736 - protein, 12 aa, Entamoeba invadens
NTNENAQTFKDE

SEQ ID NO: 3035737 - protein, 8 aa, Entamoeba invadens
NTNGVNSC

SEQ ID NO: 3035738 - protein, 8 aa, Entamoeba invadens
NTNKTATK

SEQ ID NO: 3035739 - protein, 12 aa, Entamoeba invadens
NTNPNDPKAIPC

SEQ ID NO: 3035740 - protein, 7 aa, Entamoeba invadens
NTNTSDL

SEQ ID NO: 3035741 - protein, 5 aa, Entamoeba invadens
NTPEI

SEQ ID NO: 3035742 - protein, 5 aa, Entamoeba invadens
NTPLD

SEQ ID NO: 3035743 - protein, 13 aa, Entamoeba invadens
NTPNLKTIGENGF

SEQ ID NO: 3035744 - protein, 8 aa, Entamoeba invadens
NTPPKSGM

SEQ ID NO: 3035745 - protein, 8 aa, Entamoeba invadens
NTPVPGSS

SEQ ID NO: 3035746 - protein, 7 aa, Entamoeba invadens
NTQDTID

SEQ ID NO: 3035747 - protein, 18 aa, Entamoeba invadens
NTQTFSDLNGSSPITEFA

SEQ ID NO: 3035748 - protein, 4 aa, Entamoeba invadens
NTRI

SEQ ID NO: 3035749 - protein, 11 aa, Entamoeba invadens
NTRQAAKSRFK

SEQ ID NO: 3035750 - protein, 9 aa, Entamoeba invadens
NTSKCSSCS

SEQ ID NO: 3035751 - protein, 4 aa, Entamoeba invadens
NTSL

SEQ ID NO: 3035752 - protein, 7 aa, Entamoeba invadens
NTSPEDI

SEQ ID NO: 3035753 - protein, 7 aa, Entamoeba invadens
NTSTMEE

SEQ ID NO: 3035754 - protein, 8 aa, Entamoeba invadens
NTSTSGDP

SEQ ID NO: 3035755 - protein, 7 aa, Entamoeba invadens
NTSVNSN

SEQ ID NO: 3035756 - protein, 6 aa, Entamoeba invadens
NTTASV

SEQ ID NO: 3035757 - protein, 5 aa, Entamoeba invadens
NTTDK

SEQ ID NO: 3035758 - protein, 5 aa, Entamoeba invadens
NTTDR

SEQ ID NO: 3035759 - protein, 6 aa, Entamoeba invadens
NTTHSG

SEQ ID NO: 3035760 - protein, 9 aa, Entamoeba invadens
NTTISNEDQ

SEQ ID NO: 3035761 - protein, 5 aa, Entamoeba invadens
NTTLE

SEQ ID NO: 3035762 - protein, 10 aa, Entamoeba invadens
NTTVTTRLDS

SEQ ID NO: 3035763 - protein, 25 aa, Entamoeba invadens
NTVKGTSKADLKRQLTNTQADIQTE

SEQ ID NO: 3035764 - protein, 27 aa, Entamoeba invadens
NTYAKTSSGSCSSCKTTCKTCDSTNGD

SEQ ID NO: 3035765 - protein, 6 aa, Entamoeba invadens
NTYFPD

SEQ ID NO: 3035766 - protein, 6 aa, Entamoeba invadens
NTYLNN

SEQ ID NO: 3035767 - protein, 5 aa, Entamoeba invadens
NVAGT

SEQ ID NO: 3035768 - protein, 7 aa, Entamoeba invadens
NVASGPD

SEQ ID NO: 3035769 - protein, 5 aa, Entamoeba invadens
NVATN

SEQ ID NO: 3035770 - protein, 60 aa, Entamoeba invadens
NVEETSRDEIQEENNSVNEGGYEEVATDEQEEGEEHDIRKPVKRPRRPQPVKERIEQSRR

SEQ ID NO: 3035771 - protein, 5 aa, Entamoeba invadens
NVENS

SEQ ID NO: 3035772 - protein, 5 aa, Entamoeba invadens
NVESR

SEQ ID NO: 3035773 - protein, 6 aa, Entamoeba invadens
NVETCE

SEQ ID NO: 3035774 - protein, 12 aa, Entamoeba invadens
NVGSTSKEIDSR

SEQ ID NO: 3035775 - protein, 21 aa, Entamoeba invadens
NVIGKGKEYMNKGKKAAGTLV

SEQ ID NO: 3035776 - protein, 6 aa, Entamoeba invadens
NVKETI

SEQ ID NO: 3035777 - protein, 7 aa, Entamoeba invadens
NVKIEGN

SEQ ID NO: 3035778 - protein, 8 aa, Entamoeba invadens
NVKRGLGK

SEQ ID NO: 3035779 - protein, 9 aa, Entamoeba invadens
NVKSTEQGK

SEQ ID NO: 3035780 - protein, 18 aa, Entamoeba invadens
NVKTEKVDLQEEATKAIE

SEQ ID NO: 3035781 - protein, 7 aa, Entamoeba invadens
NVNKADK

SEQ ID NO: 3035782 - protein, 7 aa, Entamoeba invadens
NVRSSQR

SEQ ID NO: 3035783 - protein, 5 aa, Entamoeba invadens
NVSGN

SEQ ID NO: 3035784 - protein, 32 aa, Entamoeba invadens
NVSRLGDAAYNSTRNGQTDYSTVPDPDGSEIN

SEQ ID NO: 3035785 - protein, 5 aa, Entamoeba invadens
NVTNP

SEQ ID NO: 3035786 - protein, 22 aa, Entamoeba invadens
NVTQQLGDTKNQKREIEDKNQT

SEQ ID NO: 3035787 - protein, 10 aa, Entamoeba invadens
NVTRGRSKEL

SEQ ID NO: 3035788 - protein, 10 aa, Entamoeba invadens
NVTSTSNVTT

SEQ ID NO: 3035789 - protein, 7 aa, Entamoeba invadens
NWQNTQT

SEQ ID NO: 3035790 - protein, 9 aa, Entamoeba invadens
NYDETDDFS

SEQ ID NO: 3035791 - protein, 5 aa, Entamoeba invadens
NYDKY

SEQ ID NO: 3035792 - protein, 16 aa, Entamoeba invadens
NYEKINQTIESSSAMT

SEQ ID NO: 3035793 - protein, 5 aa, Entamoeba invadens
NYEYT

SEQ ID NO: 3035794 - protein, 9 aa, Entamoeba invadens
NYKEKDNYR

SEQ ID NO: 3035795 - protein, 9 aa, Entamoeba invadens
NYKGSRPAG

SEQ ID NO: 3035796 - protein, 70 aa, Entamoeba invadens
NYKPGTSNTPTAPTTPTAPTEPTNEPTTEPTSPTTPDPESAGGNDGSAPAGDAGGESAPPQNAKDKVKEV

SEQ ID NO: 3035797 - protein, 14 aa, Entamoeba invadens
NYKTSSGDCKSRSS

SEQ ID NO: 3035798 - protein, 13 aa, Entamoeba invadens
NYNNNDDNQENLK

SEQ ID NO: 3035799 - protein, 6 aa, Entamoeba invadens
NYPGDG

SEQ ID NO: 3035800 - protein, 18 aa, Entamoeba invadens
NYPPQNVPQNTSGTPTNP

SEQ ID NO: 3035801 - protein, 6 aa, Entamoeba invadens
NYPQQQ

SEQ ID NO: 3035802 - protein, 7 aa, Entamoeba invadens
NYPTPFS

SEQ ID NO: 3035803 - protein, 4 aa, Entamoeba invadens
NYQG

SEQ ID NO: 3035804 - protein, 4 aa, Entamoeba invadens
NYQS

SEQ ID NO: 3035805 - protein, 13 aa, Entamoeba invadens
NYQSEGKKTREHL

SEQ ID NO: 3035806 - protein, 9 aa, Entamoeba invadens
NYREERRRC

SEQ ID NO: 3035807 - protein, 4 aa, Entamoeba invadens
NYSN

SEQ ID NO: 3035808 - protein, 5 aa, Entamoeba invadens
NYSSY

SEQ ID NO: 3035809 - protein, 9 aa, Entamoeba invadens
NYTENGITF

SEQ ID NO: 3035810 - protein, 9 aa, Entamoeba invadens
NYTKSTFGN

SEQ ID NO: 3035811 - protein, 5 aa, Entamoeba invadens
NYTPT

SEQ ID NO: 3035812 - protein, 7 aa, Entamoeba invadens
NYTSGEI

SEQ ID NO: 3035813 - protein, 8 aa, Entamoeba invadens
NYTTTINS

SEQ ID NO: 3035814 - protein, 9 aa, Entamoeba invadens
NYTTYTSTM

SEQ ID NO: 3035815 - protein, 29 aa, Entamoeba invadens
NYVRDSNLSDNEEMEKRKDNLPKVNETAY

SEQ ID NO: 3035816 - protein, 4 aa, Entamoeba invadens
NYVS

SEQ ID NO: 3035817 - protein, 7 aa, Entamoeba invadens
NYVTDGK

SEQ ID NO: 3035818 - protein, 11 aa, Entamoeba invadens
NYYSSSGSFSC

SEQ ID NO: 3035819 - protein, 13 aa, Entamoeba invadens
PACPDSERVEKGC

SEQ ID NO: 3035820 - protein, 9 aa, Entamoeba invadens
PADSQDPVL

SEQ ID NO: 3035821 - protein, 12 aa, Entamoeba invadens
PAGTKPDTSNAT

SEQ ID NO: 3035822 - protein, 11 aa, Entamoeba invadens
PAGTKPNYYKT

SEQ ID NO: 3035823 - protein, 8 aa, Entamoeba invadens
PAKDQAHC

SEQ ID NO: 3035824 - protein, 9 aa, Entamoeba invadens
PAKDQEQCG

SEQ ID NO: 3035825 - protein, 15 aa, Entamoeba invadens
PAKTVATTENGKTIN

SEQ ID NO: 3035826 - protein, 10 aa, Entamoeba invadens
PALNPTNDTT

SEQ ID NO: 3035827 - protein, 12 aa, Entamoeba invadens
PANEDQGGRPVD

SEQ ID NO: 3035828 - protein, 14 aa, Entamoeba invadens
PANEDQGGRPVDTQ

SEQ ID NO: 3035829 - protein, 12 aa, Entamoeba invadens
PANKDQGGRPVD

SEQ ID NO: 3035830 - protein, 7 aa, Entamoeba invadens
PARADQY

SEQ ID NO: 3035831 - protein, 11 aa, Entamoeba invadens
PASEAEEYKHH

SEQ ID NO: 3035832 - protein, 4 aa, Entamoeba invadens
PASR

SEQ ID NO: 3035833 - protein, 15 aa, Entamoeba invadens
PASSSYQVKEGTTTV

SEQ ID NO: 3035834 - protein, 14 aa, Entamoeba invadens
PATDYPQTAGNELY

SEQ ID NO: 3035835 - protein, 6 aa, Entamoeba invadens
PATKKV

SEQ ID NO: 3035836 - protein, 8 aa, Entamoeba invadens
PATTTRYP

SEQ ID NO: 3035837 - protein, 7 aa, Entamoeba invadens
PAYTRSG

SEQ ID NO: 3035838 - protein, 9 aa, Entamoeba invadens
PCDRTNGKC

SEQ ID NO: 3035839 - protein, 7 aa, Entamoeba invadens
PCERTSG

SEQ ID NO: 3035840 - protein, 13 aa, Entamoeba invadens
PCGETRYPSYPGA

SEQ ID NO: 3035841 - protein, 6 aa, Entamoeba invadens
PCPSST

SEQ ID NO: 3035842 - protein, 15 aa, Entamoeba invadens
PCQTGTFSSVSGSAS

SEQ ID NO: 3035843 - protein, 15 aa, Entamoeba invadens
PCQTGTYSSVSGSAS

SEQ ID NO: 3035844 - protein, 13 aa, Entamoeba invadens
PCTTPSKAKEGQN

SEQ ID NO: 3035845 - protein, 18 aa, Entamoeba invadens
PDAKKPGKANLTKKNKLG

SEQ ID NO: 3035846 - protein, 7 aa, Entamoeba invadens
PDATDES

SEQ ID NO: 3035847 - protein, 6 aa, Entamoeba invadens
PDDENS

SEQ ID NO: 3035848 - protein, 14 aa, Entamoeba invadens
PDELKEEKKLGEGS

SEQ ID NO: 3035849 - protein, 7 aa, Entamoeba invadens
PDFDATK

SEQ ID NO: 3035850 - protein, 7 aa, Entamoeba invadens
PDGDASF

SEQ ID NO: 3035851 - protein, 9 aa, Entamoeba invadens
PDGQNAPNI

SEQ ID NO: 3035852 - protein, 11 aa, Entamoeba invadens
PDGSDERQTGF

SEQ ID NO: 3035853 - protein, 6 aa, Entamoeba invadens
PDIEKY

SEQ ID NO: 3035854 - protein, 7 aa, Entamoeba invadens
PDIQNSV

SEQ ID NO: 3035855 - protein, 7 aa, Entamoeba invadens
PDLEAND

SEQ ID NO: 3035856 - protein, 6 aa, Entamoeba invadens
PDLPEG

SEQ ID NO: 3035857 - protein, 10 aa, Entamoeba invadens
PDNGTCVRGG

SEQ ID NO: 3035858 - protein, 7 aa, Entamoeba invadens
PDNNGNK

SEQ ID NO: 3035859 - protein, 4 aa, Entamoeba invadens
PDNT

SEQ ID NO: 3035860 - protein, 5 aa, Entamoeba invadens
PDNTS

SEQ ID NO: 3035861 - protein, 8 aa, Entamoeba invadens
PDPKNTQS

SEQ ID NO: 3035862 - protein, 10 aa, Entamoeba invadens
PDRKEFSNGG

SEQ ID NO: 3035863 - protein, 16 aa, Entamoeba invadens
PDSAKTTFKKGGYYTK

SEQ ID NO: 3035864 - protein, 8 aa, Entamoeba invadens
PDSSNIDV

SEQ ID NO: 3035865 - protein, 17 aa, Entamoeba invadens
PEATPKPTSLKFLKKKR

SEQ ID NO: 3035866 - protein, 4 aa, Entamoeba invadens
PECE

SEQ ID NO: 3035867 - protein, 7 aa, Entamoeba invadens
PEGSKGF

SEQ ID NO: 3035868 - protein, 17 aa, Entamoeba invadens
PEGVTEKRSVKSAPESV

SEQ ID NO: 3035869 - protein, 7 aa, Entamoeba invadens
PEIASKS

SEQ ID NO: 3035870 - protein, 32 aa, Entamoeba invadens
PEKEMKSDAVALNNKKKNLEERKKFEASKEFA

SEQ ID NO: 3035871 - protein, 4 aa, Entamoeba invadens
PENF

SEQ ID NO: 3035872 - protein, 7 aa, Entamoeba invadens
PENSEKA

SEQ ID NO: 3035873 - protein, 5 aa, Entamoeba invadens
PEQKQ

SEQ ID NO: 3035874 - protein, 18 aa, Entamoeba invadens
PERARGEQLCEEEGGCAT

SEQ ID NO: 3035875 - protein, 7 aa, Entamoeba invadens
PESLGSL

SEQ ID NO: 3035876 - protein, 7 aa, Entamoeba invadens
PESTEKV

SEQ ID NO: 3035877 - protein, 5 aa, Entamoeba invadens
PESTL

SEQ ID NO: 3035878 - protein, 6 aa, Entamoeba invadens
PETFTD

SEQ ID NO: 3035879 - protein, 5 aa, Entamoeba invadens
PEVPG

SEQ ID NO: 3035880 - protein, 26 aa, Entamoeba invadens
PEYEDDSTKTSLCQTPSVQIDEDDMK

SEQ ID NO: 3035881 - protein, 5 aa, Entamoeba invadens
PEYKK

SEQ ID NO: 3035882 - protein, 6 aa, Entamoeba invadens
PEYNSD

SEQ ID NO: 3035883 - protein, 10 aa, Entamoeba invadens
PFAAHTNAEY

SEQ ID NO: 3035884 - protein, 4 aa, Entamoeba invadens
PFPP

SEQ ID NO: 3035885 - protein, 9 aa, Entamoeba invadens
PFPSQGGLL

SEQ ID NO: 3035886 - protein, 6 aa, Entamoeba invadens
PFRDPK

SEQ ID NO: 3035887 - protein, 7 aa, Entamoeba invadens
PFRQITP

SEQ ID NO: 3035888 - protein, 4 aa, Entamoeba invadens
PFSP

SEQ ID NO: 3035889 - protein, 6 aa, Entamoeba invadens
PFTKRK

SEQ ID NO: 3035890 - protein, 11 aa, Entamoeba invadens
PFTPEPPKEQM

SEQ ID NO: 3035891 - protein, 10 aa, Entamoeba invadens
PGAGKGTQCD

SEQ ID NO: 3035892 - protein, 29 aa, Entamoeba invadens
PGDCGGAYNDNAARSDGKISGFDAKQQDL

SEQ ID NO: 3035893 - protein, 20 aa, Entamoeba invadens
PGEKCSDDQCTFPKETEQLE

SEQ ID NO: 3035894 - protein, 12 aa, Entamoeba invadens
PGELRQDTNMPN

SEQ ID NO: 3035895 - protein, 5 aa, Entamoeba invadens
PGESL

SEQ ID NO: 3035896 - protein, 4 aa, Entamoeba invadens
PGFA

SEQ ID NO: 3035897 - protein, 12 aa, Entamoeba invadens
PGKHSTACPCTT

SEQ ID NO: 3035898 - protein, 10 aa, Entamoeba invadens
PGMPNSNGEC

SEQ ID NO: 3035899 - protein, 4 aa, Entamoeba invadens
PGMS

SEQ ID NO: 3035900 - protein, 4 aa, Entamoeba invadens
PGQL

SEQ ID NO: 3035901 - protein, 6 aa, Entamoeba invadens
PGQWTQ

SEQ ID NO: 3035902 - protein, 19 aa, Entamoeba invadens
PGSSEGAVGGIEPKEESEE

SEQ ID NO: 3035903 - protein, 9 aa, Entamoeba invadens
PGSSPSIGE

SEQ ID NO: 3035904 - protein, 7 aa, Entamoeba invadens
PGTSYGV

SEQ ID NO: 3035905 - protein, 8 aa, Entamoeba invadens
PGYFKNGT

SEQ ID NO: 3035906 - protein, 5 aa, Entamoeba invadens
PGYTQ

SEQ ID NO: 3035907 - protein, 10 aa, Entamoeba invadens
PHDSKAFTQG

SEQ ID NO: 3035908 - protein, 7 aa, Entamoeba invadens
PHNTQTR

SEQ ID NO: 3035909 - protein, 15 aa, Entamoeba invadens
PHQPQQQIQPPQQQV

SEQ ID NO: 3035910 - protein, 6 aa, Entamoeba invadens
PHRASF

SEQ ID NO: 3035911 - protein, 4 aa, Entamoeba invadens
PIAA

SEQ ID NO: 3035912 - protein, 6 aa, Entamoeba invadens
PIEKGQ

SEQ ID NO: 3035913 - protein, 13 aa, Entamoeba invadens
PIGEPYTDAKNNL

SEQ ID NO: 3035914 - protein, 6 aa, Entamoeba invadens
PIGEST

SEQ ID NO: 3035915 - protein, 11 aa, Entamoeba invadens
PIIPDGSKGVD

SEQ ID NO: 3035916 - protein, 8 aa, Entamoeba invadens
PINRDDNR

SEQ ID NO: 3035917 - protein, 12 aa, Entamoeba invadens
PIPPSQADPKPV

SEQ ID NO: 3035918 - protein, 10 aa, Entamoeba invadens
PIPQSDPTTK

SEQ ID NO: 3035919 - protein, 14 aa, Entamoeba invadens
PIQSPRSLQSPREK

SEQ ID NO: 3035920 - protein, 5 aa, Entamoeba invadens
PITPA

SEQ ID NO: 3035921 - protein, 8 aa, Entamoeba invadens
PKAPEDCF

SEQ ID NO: 3035922 - protein, 12 aa, Entamoeba invadens
PKDAKMDDNVEI

SEQ ID NO: 3035923 - protein, 9 aa, Entamoeba invadens
PKDDGDTYA

SEQ ID NO: 3035924 - protein, 10 aa, Entamoeba invadens
PKDEESEKEI

SEQ ID NO: 3035925 - protein, 11 aa, Entamoeba invadens
PKEDDGECVNP

SEQ ID NO: 3035926 - protein, 6 aa, Entamoeba invadens
PKEGVM

SEQ ID NO: 3035927 - protein, 8 aa, Entamoeba invadens
PKFGTNAE

SEQ ID NO: 3035928 - protein, 6 aa, Entamoeba invadens
PKFKAQ

SEQ ID NO: 3035929 - protein, 6 aa, Entamoeba invadens
PKFNED

SEQ ID NO: 3035930 - protein, 19 aa, Entamoeba invadens
PKGKKKGEKGKEVKTDKYN

SEQ ID NO: 3035931 - protein, 8 aa, Entamoeba invadens
PKGLFPQK

SEQ ID NO: 3035932 - protein, 27 aa, Entamoeba invadens
PKHPDHNNHIQKDPRNERKRVVKQAGK

SEQ ID NO: 3035933 - protein, 29 aa, Entamoeba invadens
PKHPEHNNHIQKDPRENKPRRVVQQMKAR

SEQ ID NO: 3035934 - protein, 27 aa, Entamoeba invadens
PKHPEHNNHIQKDPRNERKRVVKQAGK

SEQ ID NO: 3035935 - protein, 27 aa, Entamoeba invadens
PKHPEHNNHIQKDPRNERKRVVKQARK

SEQ ID NO: 3035936 - protein, 4 aa, Entamoeba invadens
PKKE

SEQ ID NO: 3035937 - protein, 8 aa, Entamoeba invadens
PKKTPRVR

SEQ ID NO: 3035938 - protein, 8 aa, Entamoeba invadens
PKKTPSVR

SEQ ID NO: 3035939 - protein, 8 aa, Entamoeba invadens
PKMSAKST

SEQ ID NO: 3035940 - protein, 7 aa, Entamoeba invadens
PKNEVTW

SEQ ID NO: 3035941 - protein, 4 aa, Entamoeba invadens
PKNK

SEQ ID NO: 3035942 - protein, 6 aa, Entamoeba invadens
PKNRPM

SEQ ID NO: 3035943 - protein, 6 aa, Entamoeba invadens
PKPYFG

SEQ ID NO: 3035944 - protein, 6 aa, Entamoeba invadens
PKQGVM

SEQ ID NO: 3035945 - protein, 12 aa, Entamoeba invadens
PKQNDFANCVVW

SEQ ID NO: 3035946 - protein, 8 aa, Entamoeba invadens
PKQPTQQQ

SEQ ID NO: 3035947 - protein, 10 aa, Entamoeba invadens
PKQSFTNSPY

SEQ ID NO: 3035948 - protein, 26 aa, Entamoeba invadens
PKRARSLSPNEKKKEEKKPKSPRNRF

SEQ ID NO: 3035949 - protein, 5 aa, Entamoeba invadens
PKRTS

SEQ ID NO: 3035950 - protein, 5 aa, Entamoeba invadens
PKSNL

SEQ ID NO: 3035951 - protein, 22 aa, Entamoeba invadens
PKSQDVPKVEQPPTKKAPRKSL

SEQ ID NO: 3035952 - protein, 6 aa, Entamoeba invadens
PKSTEM

SEQ ID NO: 3035953 - protein, 7 aa, Entamoeba invadens
PKTFKDP

SEQ ID NO: 3035954 - protein, 24 aa, Entamoeba invadens
PKTIQTQTPIHQPSQIQQKETTEI

SEQ ID NO: 3035955 - protein, 7 aa, Entamoeba invadens
PKTTKRV

SEQ ID NO: 3035956 - protein, 8 aa, Entamoeba invadens
PKTTSKVK

SEQ ID NO: 3035957 - protein, 7 aa, Entamoeba invadens
PKYGSTY

SEQ ID NO: 3035958 - protein, 7 aa, Entamoeba invadens
PKYSEAS

SEQ ID NO: 3035959 - protein, 10 aa, Entamoeba invadens
PLAQPGSEGS

SEQ ID NO: 3035960 - protein, 7 aa, Entamoeba invadens
PLASQSE

SEQ ID NO: 3035961 - protein, 7 aa, Entamoeba invadens
PLCPEQN

SEQ ID NO: 3035962 - protein, 7 aa, Entamoeba invadens
PLITPSN

SEQ ID NO: 3035963 - protein, 13 aa, Entamoeba invadens
PLNEKYIGKTKFK

SEQ ID NO: 3035964 - protein, 6 aa, Entamoeba invadens
PLNSSE

SEQ ID NO: 3035965 - protein, 36 aa, Entamoeba invadens
PLPENIEPEIGDANNKGDINTNTKRVTRKPSDTPVD

SEQ ID NO: 3035966 - protein, 13 aa, Entamoeba invadens
PLPQKYIGKTKHV

SEQ ID NO: 3035967 - protein, 46 aa, Entamoeba invadens
PLQETLPRYPRQPRNLPPRFRGREQRGGGRFQRPQPFEPKPPSFIP

SEQ ID NO: 3035968 - protein, 7 aa, Entamoeba invadens
PLSQSSI

SEQ ID NO: 3035969 - protein, 9 aa, Entamoeba invadens
PLSSNTYTC

SEQ ID NO: 3035970 - protein, 5 aa, Entamoeba invadens
PMGET

SEQ ID NO: 3035971 - protein, 8 aa, Entamoeba invadens
PMKTTKIE

SEQ ID NO: 3035972 - protein, 9 aa, Entamoeba invadens
PMTPTNSQW

SEQ ID NO: 3035973 - protein, 18 aa, Entamoeba invadens
PNADNQDSYTETSTTGAA

SEQ ID NO: 3035974 - protein, 13 aa, Entamoeba invadens
PNCLKTDKDDCRE

SEQ ID NO: 3035975 - protein, 12 aa, Entamoeba invadens
PNCSTCNGVSEN

SEQ ID NO: 3035976 - protein, 10 aa, Entamoeba invadens
PNDPLVNDPG

SEQ ID NO: 3035977 - protein, 4 aa, Entamoeba invadens
PNDV

SEQ ID NO: 3035978 - protein, 6 aa, Entamoeba invadens
PNEEDI

SEQ ID NO: 3035979 - protein, 6 aa, Entamoeba invadens
PNEEGY

SEQ ID NO: 3035980 - protein, 7 aa, Entamoeba invadens
PNENKVS

SEQ ID NO: 3035981 - protein, 9 aa, Entamoeba invadens
PNGELTEKC

SEQ ID NO: 3035982 - protein, 9 aa, Entamoeba invadens
PNGTENFQN

SEQ ID NO: 3035983 - protein, 4 aa, Entamoeba invadens
PNIT

SEQ ID NO: 3035984 - protein, 9 aa, Entamoeba invadens
PNKQYEDEE

SEQ ID NO: 3035985 - protein, 6 aa, Entamoeba invadens
PNKRIL

SEQ ID NO: 3035986 - protein, 10 aa, Entamoeba invadens
PNLPTSKTWP

SEQ ID NO: 3035987 - protein, 4 aa, Entamoeba invadens
PNMT

SEQ ID NO: 3035988 - protein, 6 aa, Entamoeba invadens
PNNLSR

SEQ ID NO: 3035989 - protein, 4 aa, Entamoeba invadens
PNNP

SEQ ID NO: 3035990 - protein, 8 aa, Entamoeba invadens
PNPPYPNV

SEQ ID NO: 3035991 - protein, 14 aa, Entamoeba invadens
PNPSFEEGSGTTIT

SEQ ID NO: 3035992 - protein, 10 aa, Entamoeba invadens
PNRKQFSNGG

SEQ ID NO: 3035993 - protein, 10 aa, Entamoeba invadens
PNRPPKCTSR

SEQ ID NO: 3035994 - protein, 6 aa, Entamoeba invadens
PNSLGT

SEQ ID NO: 3035995 - protein, 13 aa, Entamoeba invadens
PNSPNCQEGYDKN

SEQ ID NO: 3035996 - protein, 4 aa, Entamoeba invadens
PNVC

SEQ ID NO: 3035997 - protein, 27 aa, Entamoeba invadens
PNWKTGKKITQEASQFTKECKTVFVIW

SEQ ID NO: 3035998 - protein, 4 aa, Entamoeba invadens
PNYE

SEQ ID NO: 3035999 - protein, 27 aa, Entamoeba invadens
PNYREGKSVSQKISTFKSECKQFWILQ

SEQ ID NO: 3036000 - protein, 6 aa, Entamoeba invadens
PPDCGS

SEQ ID NO: 3036001 - protein, 7 aa, Entamoeba invadens
PPDFGST

SEQ ID NO: 3036002 - protein, 6 aa, Entamoeba invadens
PPDGLT

SEQ ID NO: 3036003 - protein, 7 aa, Entamoeba invadens
PPDVDST

SEQ ID NO: 3036004 - protein, 16 aa, Entamoeba invadens
PPELKRKETMPRNECF

SEQ ID NO: 3036005 - protein, 6 aa, Entamoeba invadens
PPGGTE

SEQ ID NO: 3036006 - protein, 19 aa, Entamoeba invadens
PPGVASHNAADHFDQTQQT

SEQ ID NO: 3036007 - protein, 4 aa, Entamoeba invadens
PPHN

SEQ ID NO: 3036008 - protein, 19 aa, Entamoeba invadens
PPHQQPLDQQQVPQTQQHQ

SEQ ID NO: 3036009 - protein, 4 aa, Entamoeba invadens
PPIP

SEQ ID NO: 3036010 - protein, 9 aa, Entamoeba invadens
PPKKSGAFH

SEQ ID NO: 3036011 - protein, 9 aa, Entamoeba invadens
PPLDIETKN

SEQ ID NO: 3036012 - protein, 9 aa, Entamoeba invadens
PPLDIGTNN

SEQ ID NO: 3036013 - protein, 6 aa, Entamoeba invadens
PPNDDF

SEQ ID NO: 3036014 - protein, 9 aa, Entamoeba invadens
PPPKCNCGP

SEQ ID NO: 3036015 - protein, 4 aa, Entamoeba invadens
PPQD

SEQ ID NO: 3036016 - protein, 4 aa, Entamoeba invadens
PPQN

SEQ ID NO: 3036017 - protein, 16 aa, Entamoeba invadens
PPRFRGRGRYQRPPFR

SEQ ID NO: 3036018 - protein, 5 aa, Entamoeba invadens
PPRVS

SEQ ID NO: 3036019 - protein, 8 aa, Entamoeba invadens
PPSKTLEA

SEQ ID NO: 3036020 - protein, 4 aa, Entamoeba invadens
PPSW

SEQ ID NO: 3036021 - protein, 5 aa, Entamoeba invadens
PPTVE

SEQ ID NO: 3036022 - protein, 4 aa, Entamoeba invadens
PQCS

SEQ ID NO: 3036023 - protein, 4 aa, Entamoeba invadens
PQDR

SEQ ID NO: 3036024 - protein, 7 aa, Entamoeba invadens
PQEPGTT

SEQ ID NO: 3036025 - protein, 4 aa, Entamoeba invadens
PQFK

SEQ ID NO: 3036026 - protein, 8 aa, Entamoeba invadens
PQGGISDA

SEQ ID NO: 3036027 - protein, 4 aa, Entamoeba invadens
PQHV

SEQ ID NO: 3036028 - protein, 4 aa, Entamoeba invadens
PQKC

SEQ ID NO: 3036029 - protein, 7 aa, Entamoeba invadens
PQKSGAK

SEQ ID NO: 3036030 - protein, 6 aa, Entamoeba invadens
PQLDKP

SEQ ID NO: 3036031 - protein, 6 aa, Entamoeba invadens
PQNDGN

SEQ ID NO: 3036032 - protein, 6 aa, Entamoeba invadens
PQNKGN

SEQ ID NO: 3036033 - protein, 4 aa, Entamoeba invadens
PQPD

SEQ ID NO: 3036034 - protein, 29 aa, Entamoeba invadens
PQVTPSTNTKNEKLSPLRRKSDEKETQPE

SEQ ID NO: 3036035 - protein, 14 aa, Entamoeba invadens
PQYNNKKEKGKKCE

SEQ ID NO: 3036036 - protein, 60 aa, Entamoeba invadens
PRAPRTTSSTKTPPSPKKTPPPSPPSARGPLPPIPTGTIPRTPRSGTTLRRSKSLPRGGW

SEQ ID NO: 3036037 - protein, 4 aa, Entamoeba invadens
PRGL

SEQ ID NO: 3036038 - protein, 7 aa, Entamoeba invadens
PRGNSRA

SEQ ID NO: 3036039 - protein, 5 aa, Entamoeba invadens
PRGNY

SEQ ID NO: 3036040 - protein, 7 aa, Entamoeba invadens
PRKDGVD

SEQ ID NO: 3036041 - protein, 11 aa, Entamoeba invadens
PRKQNVNSSVE

SEQ ID NO: 3036042 - protein, 9 aa, Entamoeba invadens
PRQMTDDEV

SEQ ID NO: 3036043 - protein, 4 aa, Entamoeba invadens
PRTL

SEQ ID NO: 3036044 - protein, 11 aa, Entamoeba invadens
PRTRSFTAGPV

SEQ ID NO: 3036045 - protein, 10 aa, Entamoeba invadens
PRYKGEDCGS

SEQ ID NO: 3036046 - protein, 4 aa, Entamoeba invadens
PSAA

SEQ ID NO: 3036047 - protein, 4 aa, Entamoeba invadens
PSAK

SEQ ID NO: 3036048 - protein, 11 aa, Entamoeba invadens
PSCNGNDKCDQ

SEQ ID NO: 3036049 - protein, 5 aa, Entamoeba invadens
PSDLR

SEQ ID NO: 3036050 - protein, 4 aa, Entamoeba invadens
PSDV

SEQ ID NO: 3036051 - protein, 12 aa, Entamoeba invadens
PSEGGASTVVPV

SEQ ID NO: 3036052 - protein, 13 aa, Entamoeba invadens
PSEKPISLTSPTI

SEQ ID NO: 3036053 - protein, 6 aa, Entamoeba invadens
PSELGE

SEQ ID NO: 3036054 - protein, 5 aa, Entamoeba invadens
PSETV

SEQ ID NO: 3036055 - protein, 6 aa, Entamoeba invadens
PSETVT

SEQ ID NO: 3036056 - protein, 6 aa, Entamoeba invadens
PSFDTN

SEQ ID NO: 3036057 - protein, 9 aa, Entamoeba invadens
PSFGLTDGD

SEQ ID NO: 3036058 - protein, 5 aa, Entamoeba invadens
PSFGY

SEQ ID NO: 3036059 - protein, 7 aa, Entamoeba invadens
PSGMNTG

SEQ ID NO: 3036060 - protein, 7 aa, Entamoeba invadens
PSGQNQT

SEQ ID NO: 3036061 - protein, 6 aa, Entamoeba invadens
PSGSVQ

SEQ ID NO: 3036062 - protein, 12 aa, Entamoeba invadens
PSHKENSLNRNS

SEQ ID NO: 3036063 - protein, 13 aa, Entamoeba invadens
PSIPGSRAGSAIA

SEQ ID NO: 3036064 - protein, 4 aa, Entamoeba invadens
PSKN

SEQ ID NO: 3036065 - protein, 7 aa, Entamoeba invadens
PSKPEFP

SEQ ID NO: 3036066 - protein, 8 aa, Entamoeba invadens
PSKRTVCT

SEQ ID NO: 3036067 - protein, 7 aa, Entamoeba invadens
PSKTPPC

SEQ ID NO: 3036068 - protein, 5 aa, Entamoeba invadens
PSLPD

SEQ ID NO: 3036069 - protein, 7 aa, Entamoeba invadens
PSMSPDQ

SEQ ID NO: 3036070 - protein, 7 aa, Entamoeba invadens
PSNFPDH

SEQ ID NO: 3036071 - protein, 5 aa, Entamoeba invadens
PSNKI

SEQ ID NO: 3036072 - protein, 5 aa, Entamoeba invadens
PSPLT

SEQ ID NO: 3036073 - protein, 5 aa, Entamoeba invadens
PSRNQ

SEQ ID NO: 3036074 - protein, 8 aa, Entamoeba invadens
PSSDANNN

SEQ ID NO: 3036075 - protein, 17 aa, Entamoeba invadens
PSSFSTVRGEGCAAHSV

SEQ ID NO: 3036076 - protein, 6 aa, Entamoeba invadens
PSTAGT

SEQ ID NO: 3036077 - protein, 62 aa, Entamoeba invadens
PSTEKSEEKSIEKSIEKSEESKHCNDKSCEVKSSTEKSEESKHCNDKSCEEKSCHEKSEEST

SEQ ID NO: 3036078 - protein, 25 aa, Entamoeba invadens
PSTLGTNSEIGSGLDCSKRSDQHLR

SEQ ID NO: 3036079 - protein, 11 aa, Entamoeba invadens
PSTNKKDSVKY

SEQ ID NO: 3036080 - protein, 7 aa, Entamoeba invadens
PSTPDVD

SEQ ID NO: 3036081 - protein, 35 aa, Entamoeba invadens
PSTTPETQPKAQQQQEPQTEQQTQPQQEPQEQAEA

SEQ ID NO: 3036082 - protein, 4 aa, Entamoeba invadens
PSTY

SEQ ID NO: 3036083 - protein, 7 aa, Entamoeba invadens
PSYPHGN

SEQ ID NO: 3036084 - protein, 15 aa, Entamoeba invadens
PTAEGYCGDEDNGQM

SEQ ID NO: 3036085 - protein, 4 aa, Entamoeba invadens
PTCG

SEQ ID NO: 3036086 - protein, 4 aa, Entamoeba invadens
PTFS

SEQ ID NO: 3036087 - protein, 4 aa, Entamoeba invadens
PTGI

SEQ ID NO: 3036088 - protein, 4 aa, Entamoeba invadens
PTGS

SEQ ID NO: 3036089 - protein, 10 aa, Entamoeba invadens
PTGWSGSQPQ

SEQ ID NO: 3036090 - protein, 21 aa, Entamoeba invadens
PTISGKTTITAVSDEDSTLTA

SEQ ID NO: 3036091 - protein, 8 aa, Entamoeba invadens
PTKDVNKY

SEQ ID NO: 3036092 - protein, 8 aa, Entamoeba invadens
PTKEENEW

SEQ ID NO: 3036093 - protein, 10 aa, Entamoeba invadens
PTLEPSADID

SEQ ID NO: 3036094 - protein, 4 aa, Entamoeba invadens
PTLP

SEQ ID NO: 3036095 - protein, 5 aa, Entamoeba invadens
PTLSE

SEQ ID NO: 3036096 - protein, 21 aa, Entamoeba invadens
PTLSGKTTITAVSAEDETISS

SEQ ID NO: 3036097 - protein, 7 aa, Entamoeba invadens
PTNTTNT

SEQ ID NO: 3036098 - protein, 19 aa, Entamoeba invadens
PTPEKVTGYSSMHGDTEVD

SEQ ID NO: 3036099 - protein, 6 aa, Entamoeba invadens
PTPGNH

SEQ ID NO: 3036100 - protein, 12 aa, Entamoeba invadens
PTPPKPAKQTEM

SEQ ID NO: 3036101 - protein, 6 aa, Entamoeba invadens
PTPSGN

SEQ ID NO: 3036102 - protein, 4 aa, Entamoeba invadens
PTPY

SEQ ID NO: 3036103 - protein, 8 aa, Entamoeba invadens
PTQPPGGL

SEQ ID NO: 3036104 - protein, 5 aa, Entamoeba invadens
PTSGI

SEQ ID NO: 3036105 - protein, 11 aa, Entamoeba invadens
PTSISATSKIT

SEQ ID NO: 3036106 - protein, 8 aa, Entamoeba invadens
PTSISEPF

SEQ ID NO: 3036107 - protein, 13 aa, Entamoeba invadens
PTSTNQAYMDGTI

SEQ ID NO: 3036108 - protein, 46 aa, Entamoeba invadens
PTTVGDGGFTTGTSTKSPPKSPEKKEEEPTVIPQKKGGLAARRKTG

SEQ ID NO: 3036109 - protein, 7 aa, Entamoeba invadens
PTVENSF

SEQ ID NO: 3036110 - protein, 4 aa, Entamoeba invadens
PTVN

SEQ ID NO: 3036111 - protein, 18 aa, Entamoeba invadens
PVDKNGHRIPPPKPKRKA

SEQ ID NO: 3036112 - protein, 8 aa, Entamoeba invadens
PVGAPPNA

SEQ ID NO: 3036113 - protein, 8 aa, Entamoeba invadens
PVNEETKQ

SEQ ID NO: 3036114 - protein, 11 aa, Entamoeba invadens
PVNNPSEGFGT

SEQ ID NO: 3036115 - protein, 39 aa, Entamoeba invadens
PVPTSPLSAEHSPLPVGESQPVSVGSPELDESPTKHHNK

SEQ ID NO: 3036116 - protein, 5 aa, Entamoeba invadens
PVSEI

SEQ ID NO: 3036117 - protein, 4 aa, Entamoeba invadens
PVSQ

SEQ ID NO: 3036118 - protein, 6 aa, Entamoeba invadens
PVTYTN

SEQ ID NO: 3036119 - protein, 7 aa, Entamoeba invadens
PWEDDEE

SEQ ID NO: 3036120 - protein, 10 aa, Entamoeba invadens
PWKEPGKKYY

SEQ ID NO: 3036121 - protein, 7 aa, Entamoeba invadens
PWPPESG

SEQ ID NO: 3036122 - protein, 12 aa, Entamoeba invadens
PYLDDNEKNIAK

SEQ ID NO: 3036123 - protein, 8 aa, Entamoeba invadens
PYPSNETH

SEQ ID NO: 3036124 - protein, 6 aa, Entamoeba invadens
PYPTEH

SEQ ID NO: 3036125 - protein, 8 aa, Entamoeba invadens
PYSDATNN

SEQ ID NO: 3036126 - protein, 4 aa, Entamoeba invadens
PYTG

SEQ ID NO: 3036127 - protein, 7 aa, Entamoeba invadens
PYTNEQT

SEQ ID NO: 3036128 - protein, 5 aa, Entamoeba invadens
PYVTQ

SEQ ID NO: 3036129 - protein, 23 aa, Entamoeba invadens
QAAGGAPAEEKSTGMGETGVTRV

SEQ ID NO: 3036130 - protein, 8 aa, Entamoeba invadens
QADEQTKH

SEQ ID NO: 3036131 - protein, 6 aa, Entamoeba invadens
QADGCD

SEQ ID NO: 3036132 - protein, 9 aa, Entamoeba invadens
QAEISSDNK

SEQ ID NO: 3036133 - protein, 6 aa, Entamoeba invadens
QAESTD

SEQ ID NO: 3036134 - protein, 7 aa, Entamoeba invadens
QAHNDRI

SEQ ID NO: 3036135 - protein, 7 aa, Entamoeba invadens
QAKLTAQ

SEQ ID NO: 3036136 - protein, 9 aa, Entamoeba invadens
QAKSQNVTY

SEQ ID NO: 3036137 - protein, 10 aa, Entamoeba invadens
QALPSSDEQV

SEQ ID NO: 3036138 - protein, 6 aa, Entamoeba invadens
QANANI

SEQ ID NO: 3036139 - protein, 4 aa, Entamoeba invadens
QAPQ

SEQ ID NO: 3036140 - protein, 8 aa, Entamoeba invadens
QAQEIQKR

SEQ ID NO: 3036141 - protein, 9 aa, Entamoeba invadens
QASQKQHTC

SEQ ID NO: 3036142 - protein, 10 aa, Entamoeba invadens
QASSLSDRIT

SEQ ID NO: 3036143 - protein, 10 aa, Entamoeba invadens
QASSSNSSSS

SEQ ID NO: 3036144 - protein, 6 aa, Entamoeba invadens
QATKSK

SEQ ID NO: 3036145 - protein, 6 aa, Entamoeba invadens
QATNQR

SEQ ID NO: 3036146 - protein, 8 aa, Entamoeba invadens
QATSDSKP

SEQ ID NO: 3036147 - protein, 16 aa, Entamoeba invadens
QATYYGTYTSGGEVST

SEQ ID NO: 3036148 - protein, 10 aa, Entamoeba invadens
QAVKSSKKMI

SEQ ID NO: 3036149 - protein, 5 aa, Entamoeba invadens
QAVLG

SEQ ID NO: 3036150 - protein, 5 aa, Entamoeba invadens
QAYDD

SEQ ID NO: 3036151 - protein, 21 aa, Entamoeba invadens
QCDPTNSEIDADDGEVKTYQE

SEQ ID NO: 3036152 - protein, 8 aa, Entamoeba invadens
QCGTDNCG

SEQ ID NO: 3036153 - protein, 15 aa, Entamoeba invadens
QCSPTCNGCNTTTGY

SEQ ID NO: 3036154 - protein, 10 aa, Entamoeba invadens
QCSSCKNKYD

SEQ ID NO: 3036155 - protein, 20 aa, Entamoeba invadens
QCTITDNATDVGQTKFEGRC

SEQ ID NO: 3036156 - protein, 5 aa, Entamoeba invadens
QCTQC

SEQ ID NO: 3036157 - protein, 19 aa, Entamoeba invadens
QCVAPQSTCGDGKLGTPPN

SEQ ID NO: 3036158 - protein, 4 aa, Entamoeba invadens
QDAT

SEQ ID NO: 3036159 - protein, 5 aa, Entamoeba invadens
QDDEY

SEQ ID NO: 3036160 - protein, 4 aa, Entamoeba invadens
QDDI

SEQ ID NO: 3036161 - protein, 8 aa, Entamoeba invadens
QDDSYMKR

SEQ ID NO: 3036162 - protein, 8 aa, Entamoeba invadens
QDEEIYGK

SEQ ID NO: 3036163 - protein, 4 aa, Entamoeba invadens
QDEF

SEQ ID NO: 3036164 - protein, 6 aa, Entamoeba invadens
QDESTI

SEQ ID NO: 3036165 - protein, 7 aa, Entamoeba invadens
QDGNANL

SEQ ID NO: 3036166 - protein, 8 aa, Entamoeba invadens
QDGNHTKE

SEQ ID NO: 3036167 - protein, 7 aa, Entamoeba invadens
QDGTAGG

SEQ ID NO: 3036168 - protein, 4 aa, Entamoeba invadens
QDKL

SEQ ID NO: 3036169 - protein, 6 aa, Entamoeba invadens
QDLPNY

SEQ ID NO: 3036170 - protein, 13 aa, Entamoeba invadens
QDNALKHANAQTL

SEQ ID NO: 3036171 - protein, 4 aa, Entamoeba invadens
QDNI

SEQ ID NO: 3036172 - protein, 8 aa, Entamoeba invadens
QDNSGSSY

SEQ ID NO: 3036173 - protein, 9 aa, Entamoeba invadens
QDPRERPDM

SEQ ID NO: 3036174 - protein, 6 aa, Entamoeba invadens
QDQGND

SEQ ID NO: 3036175 - protein, 18 aa, Entamoeba invadens
QDRPNYPNCTDYKPSQNI

SEQ ID NO: 3036176 - protein, 8 aa, Entamoeba invadens
QDRYSNTI

SEQ ID NO: 3036177 - protein, 9 aa, Entamoeba invadens
QDSPSNNQP

SEQ ID NO: 3036178 - protein, 5 aa, Entamoeba invadens
QDSRC

SEQ ID NO: 3036179 - protein, 7 aa, Entamoeba invadens
QDTENSP

SEQ ID NO: 3036180 - protein, 8 aa, Entamoeba invadens
QDVEGQTT

SEQ ID NO: 3036181 - protein, 17 aa, Entamoeba invadens
QDYDKSQKELQTQYNGL

SEQ ID NO: 3036182 - protein, 6 aa, Entamoeba invadens
QDYKPQ

SEQ ID NO: 3036183 - protein, 16 aa, Entamoeba invadens
QDYQEEPPKSPTTTKQ

SEQ ID NO: 3036184 - protein, 12 aa, Entamoeba invadens
QEAKEKYNVDEE

SEQ ID NO: 3036185 - protein, 9 aa, Entamoeba invadens
QEAKELRKN

SEQ ID NO: 3036186 - protein, 10 aa, Entamoeba invadens
QEENSDLKKD

SEQ ID NO: 3036187 - protein, 6 aa, Entamoeba invadens
QEGYAI

SEQ ID NO: 3036188 - protein, 10 aa, Entamoeba invadens
QEKGEDGSEI

SEQ ID NO: 3036189 - protein, 9 aa, Entamoeba invadens
QEKYKKSAD

SEQ ID NO: 3036190 - protein, 9 aa, Entamoeba invadens
QEKYTKSAD

SEQ ID NO: 3036191 - protein, 5 aa, Entamoeba invadens
QEMGD

SEQ ID NO: 3036192 - protein, 6 aa, Entamoeba invadens
QEMSTA

SEQ ID NO: 3036193 - protein, 5 aa, Entamoeba invadens
QENAD

SEQ ID NO: 3036194 - protein, 11 aa, Entamoeba invadens
QENADKIKAQL

SEQ ID NO: 3036195 - protein, 19 aa, Entamoeba invadens
QENETVERSQQKLQDELDE

SEQ ID NO: 3036196 - protein, 4 aa, Entamoeba invadens
QENS

SEQ ID NO: 3036197 - protein, 7 aa, Entamoeba invadens
QEPIERS

SEQ ID NO: 3036198 - protein, 6 aa, Entamoeba invadens
QEPPTY

SEQ ID NO: 3036199 - protein, 10 aa, Entamoeba invadens
QETSTRGGGF

SEQ ID NO: 3036200 - protein, 13 aa, Entamoeba invadens
QEVPKQKEEAVPQ

SEQ ID NO: 3036201 - protein, 6 aa, Entamoeba invadens
QEVRNS

SEQ ID NO: 3036202 - protein, 10 aa, Entamoeba invadens
QFGSTYSSSC

SEQ ID NO: 3036203 - protein, 5 aa, Entamoeba invadens
QFPGG

SEQ ID NO: 3036204 - protein, 6 aa, Entamoeba invadens
QFRSYS

SEQ ID NO: 3036205 - protein, 7 aa, Entamoeba invadens
QGEDNKF

SEQ ID NO: 3036206 - protein, 10 aa, Entamoeba invadens
QGEQEKPYGY

SEQ ID NO: 3036207 - protein, 17 aa, Entamoeba invadens
QGKKSNTQSHKKKEKKV

SEQ ID NO: 3036208 - protein, 67 aa, Entamoeba invadens
QGKRKSKKRESPPNNKQKKENKGQLTTTRKTGKSVQISGKGKKGSLSIKAERRDKNTRSTSVGGSVN

SEQ ID NO: 3036209 - protein, 4 aa, Entamoeba invadens
QGMD

SEQ ID NO: 3036210 - protein, 8 aa, Entamoeba invadens
QGQITKCP

SEQ ID NO: 3036211 - protein, 8 aa, Entamoeba invadens
QGQITKCS

SEQ ID NO: 3036212 - protein, 5 aa, Entamoeba invadens
QGSGD

SEQ ID NO: 3036213 - protein, 9 aa, Entamoeba invadens
QGSGSKIEF

SEQ ID NO: 3036214 - protein, 8 aa, Entamoeba invadens
QGWNSKTN

SEQ ID NO: 3036215 - protein, 8 aa, Entamoeba invadens
QGWNSQTN

SEQ ID NO: 3036216 - protein, 8 aa, Entamoeba invadens
QGYNSQTQ

SEQ ID NO: 3036217 - protein, 11 aa, Entamoeba invadens
QGYYSNEGATA

SEQ ID NO: 3036218 - protein, 6 aa, Entamoeba invadens
QHNKNY

SEQ ID NO: 3036219 - protein, 6 aa, Entamoeba invadens
QHPQQR

SEQ ID NO: 3036220 - protein, 10 aa, Entamoeba invadens
QHPTQQPPQH

SEQ ID NO: 3036221 - protein, 20 aa, Entamoeba invadens
QHPTTSDSDDSDKEGIYTKV

SEQ ID NO: 3036222 - protein, 8 aa, Entamoeba invadens
QHQVETGN

SEQ ID NO: 3036223 - protein, 4 aa, Entamoeba invadens
QIGV

SEQ ID NO: 3036224 - protein, 6 aa, Entamoeba invadens
QIHSQN

SEQ ID NO: 3036225 - protein, 13 aa, Entamoeba invadens
QIKEVKDQLEIIG

SEQ ID NO: 3036226 - protein, 8 aa, Entamoeba invadens
QINSQQLR

SEQ ID NO: 3036227 - protein, 28 aa, Entamoeba invadens
QINSTKDNVTNVTKTEQTNKTNATTDTN

SEQ ID NO: 3036228 - protein, 8 aa, Entamoeba invadens
QIPKPKDP

SEQ ID NO: 3036229 - protein, 7 aa, Entamoeba invadens
QIPSAEN

SEQ ID NO: 3036230 - protein, 15 aa, Entamoeba invadens
QIQSTNGNDGFPDGL

SEQ ID NO: 3036231 - protein, 9 aa, Entamoeba invadens
QIRNGGSYT

SEQ ID NO: 3036232 - protein, 13 aa, Entamoeba invadens
QISGMGQAGIEEV

SEQ ID NO: 3036233 - protein, 8 aa, Entamoeba invadens
QKANESKK

SEQ ID NO: 3036234 - protein, 24 aa, Entamoeba invadens
QKAPKQEDPQTKSKRHPHIKSEPG

SEQ ID NO: 3036235 - protein, 9 aa, Entamoeba invadens
QKASENHYK

SEQ ID NO: 3036236 - protein, 7 aa, Entamoeba invadens
QKCSDGY

SEQ ID NO: 3036237 - protein, 65 aa, Entamoeba invadens
QKDDKRRQRRLSTPDQKTPKSTPTLQRSLSEAEGKKKESGETKSEHSEQIRSGGQRTPRPQQSHP

SEQ ID NO: 3036238 - protein, 16 aa, Entamoeba invadens
QKEEEKKAKKAQADPY

SEQ ID NO: 3036239 - protein, 13 aa, Entamoeba invadens
QKEGNGYIEKENE

SEQ ID NO: 3036240 - protein, 10 aa, Entamoeba invadens
QKEIDQDTKI

SEQ ID NO: 3036241 - protein, 32 aa, Entamoeba invadens
QKEKEKNNNQIIKEEEEKETQKKTTKTVKKHC

SEQ ID NO: 3036242 - protein, 10 aa, Entamoeba invadens
QKEKTTQQEM

SEQ ID NO: 3036243 - protein, 7 aa, Entamoeba invadens
QKESHSL

SEQ ID NO: 3036244 - protein, 27 aa, Entamoeba invadens
QKESTFNTQIGKTQADLKKHDNQSETV

SEQ ID NO: 3036245 - protein, 9 aa, Entamoeba invadens
QKGPAGSKS

SEQ ID NO: 3036246 - protein, 9 aa, Entamoeba invadens
QKGSYTQKK

SEQ ID NO: 3036247 - protein, 16 aa, Entamoeba invadens
QKIEERKLANKKLRNL

SEQ ID NO: 3036248 - protein, 9 aa, Entamoeba invadens
QKISKTQNC

SEQ ID NO: 3036249 - protein, 6 aa, Entamoeba invadens
QKKTSR

SEQ ID NO: 3036250 - protein, 7 aa, Entamoeba invadens
QKLPYTE

SEQ ID NO: 3036251 - protein, 8 aa, Entamoeba invadens
QKNRQQEF

SEQ ID NO: 3036252 - protein, 8 aa, Entamoeba invadens
QKPAERIR

SEQ ID NO: 3036253 - protein, 10 aa, Entamoeba invadens
QKPEARPNFD

SEQ ID NO: 3036254 - protein, 14 aa, Entamoeba invadens
QKPLEEKKKGQFTK

SEQ ID NO: 3036255 - protein, 12 aa, Entamoeba invadens
QKPRNSEIECYK

SEQ ID NO: 3036256 - protein, 17 aa, Entamoeba invadens
QKPTMTEMKRESKSFEA

SEQ ID NO: 3036257 - protein, 5 aa, Entamoeba invadens
QKPVN

SEQ ID NO: 3036258 - protein, 13 aa, Entamoeba invadens
QKQGQKSKCQGTT

SEQ ID NO: 3036259 - protein, 8 aa, Entamoeba invadens
QKQKAKVP

SEQ ID NO: 3036260 - protein, 17 aa, Entamoeba invadens
QKQQGVVRSAKKEVKEL

SEQ ID NO: 3036261 - protein, 8 aa, Entamoeba invadens
QKRGNKLA

SEQ ID NO: 3036262 - protein, 13 aa, Entamoeba invadens
QKRINKKTQKYEN

SEQ ID NO: 3036263 - protein, 13 aa, Entamoeba invadens
QKRISDAQKGIIE

SEQ ID NO: 3036264 - protein, 6 aa, Entamoeba invadens
QKRQNR

SEQ ID NO: 3036265 - protein, 12 aa, Entamoeba invadens
QKRRQKKGVTRQ

SEQ ID NO: 3036266 - protein, 8 aa, Entamoeba invadens
QKRTPTHP

SEQ ID NO: 3036267 - protein, 15 aa, Entamoeba invadens
QKRVEEEQKKKEEYA

SEQ ID NO: 3036268 - protein, 8 aa, Entamoeba invadens
QKSKDRDY

SEQ ID NO: 3036269 - protein, 17 aa, Entamoeba invadens
QKSLNKENEEKKPKTLI

SEQ ID NO: 3036270 - protein, 5 aa, Entamoeba invadens
QKSTC

SEQ ID NO: 3036271 - protein, 15 aa, Entamoeba invadens
QKTAVSNSKECCETP

SEQ ID NO: 3036272 - protein, 6 aa, Entamoeba invadens
QKTFEK

SEQ ID NO: 3036273 - protein, 8 aa, Entamoeba invadens
QKTKDRDY

SEQ ID NO: 3036274 - protein, 9 aa, Entamoeba invadens
QKTKQGYDI

SEQ ID NO: 3036275 - protein, 11 aa, Entamoeba invadens
QKTVSVSSSTI

SEQ ID NO: 3036276 - protein, 8 aa, Entamoeba invadens
QKVDSPRE

SEQ ID NO: 3036277 - protein, 7 aa, Entamoeba invadens
QKVGTLE

SEQ ID NO: 3036278 - protein, 6 aa, Entamoeba invadens
QKYNKM

SEQ ID NO: 3036279 - protein, 8 aa, Entamoeba invadens
QLCERGED

SEQ ID NO: 3036280 - protein, 11 aa, Entamoeba invadens
QLDATTKRCVE

SEQ ID NO: 3036281 - protein, 41 aa, Entamoeba invadens
QLDEERQKAESADAVRKADSQKELEKERAMKQKPDKETQKL

SEQ ID NO: 3036282 - protein, 9 aa, Entamoeba invadens
QLDTVKKGG

SEQ ID NO: 3036283 - protein, 6 aa, Entamoeba invadens
QLEDEY

SEQ ID NO: 3036284 - protein, 6 aa, Entamoeba invadens
QLGGAI

SEQ ID NO: 3036285 - protein, 10 aa, Entamoeba invadens
QLKEERTDIR

SEQ ID NO: 3036286 - protein, 4 aa, Entamoeba invadens
QLNP

SEQ ID NO: 3036287 - protein, 12 aa, Entamoeba invadens
QLPDPFEGAPTV

SEQ ID NO: 3036288 - protein, 6 aa, Entamoeba invadens
QLPKPQ

SEQ ID NO: 3036289 - protein, 4 aa, Entamoeba invadens
QLPS

SEQ ID NO: 3036290 - protein, 21 aa, Entamoeba invadens
QLSATSSGVTITASNAYGARH

SEQ ID NO: 3036291 - protein, 5 aa, Entamoeba invadens
QLSSS

SEQ ID NO: 3036292 - protein, 15 aa, Entamoeba invadens
QLTNPSSGYSEETKH

SEQ ID NO: 3036293 - protein, 7 aa, Entamoeba invadens
QMGKGIN

SEQ ID NO: 3036294 - protein, 8 aa, Entamoeba invadens
QMNTQPEV

SEQ ID NO: 3036295 - protein, 7 aa, Entamoeba invadens
QMPQQTR

SEQ ID NO: 3036296 - protein, 5 aa, Entamoeba invadens
QMRNA

SEQ ID NO: 3036297 - protein, 16 aa, Entamoeba invadens
QMTTGSTLKTEKNLEL

SEQ ID NO: 3036298 - protein, 9 aa, Entamoeba invadens
QNAKENNEK

SEQ ID NO: 3036299 - protein, 10 aa, Entamoeba invadens
QNAQTKNNGC

SEQ ID NO: 3036300 - protein, 12 aa, Entamoeba invadens
QNATRPNSPPMY

SEQ ID NO: 3036301 - protein, 10 aa, Entamoeba invadens
QNEETEEIKQ

SEQ ID NO: 3036302 - protein, 22 aa, Entamoeba invadens
QNEGQEQEAQAAPKQEQLPPGQ

SEQ ID NO: 3036303 - protein, 6 aa, Entamoeba invadens
QNENGV

SEQ ID NO: 3036304 - protein, 4 aa, Entamoeba invadens
QNET

SEQ ID NO: 3036305 - protein, 7 aa, Entamoeba invadens
QNETKSH

SEQ ID NO: 3036306 - protein, 11 aa, Entamoeba invadens
QNGMKRDSAMR

SEQ ID NO: 3036307 - protein, 7 aa, Entamoeba invadens
QNGNINI

SEQ ID NO: 3036308 - protein, 9 aa, Entamoeba invadens
QNGPNGVSR

SEQ ID NO: 3036309 - protein, 5 aa, Entamoeba invadens
QNGTI

SEQ ID NO: 3036310 - protein, 9 aa, Entamoeba invadens
QNIKTAQDM

SEQ ID NO: 3036311 - protein, 12 aa, Entamoeba invadens
QNKFTELQTTEE

SEQ ID NO: 3036312 - protein, 8 aa, Entamoeba invadens
QNKKISRC

SEQ ID NO: 3036313 - protein, 9 aa, Entamoeba invadens
QNKNKDKTV

SEQ ID NO: 3036314 - protein, 5 aa, Entamoeba invadens
QNKTC

SEQ ID NO: 3036315 - protein, 9 aa, Entamoeba invadens
QNLGSSVPF

SEQ ID NO: 3036316 - protein, 10 aa, Entamoeba invadens
QNNGPDTNNS

SEQ ID NO: 3036317 - protein, 19 aa, Entamoeba invadens
QNNRCGIGKDSTYPTSVSL

SEQ ID NO: 3036318 - protein, 19 aa, Entamoeba invadens
QNNRCGIGRDSNLPEAVKL

SEQ ID NO: 3036319 - protein, 14 aa, Entamoeba invadens
QNPCYSTPSYFTEA

SEQ ID NO: 3036320 - protein, 4 aa, Entamoeba invadens
QNPD

SEQ ID NO: 3036321 - protein, 8 aa, Entamoeba invadens
QNPDPSQV

SEQ ID NO: 3036322 - protein, 8 aa, Entamoeba invadens
QNPNAPSL

SEQ ID NO: 3036323 - protein, 18 aa, Entamoeba invadens
QNPTPLPFPTPAPITAPE

SEQ ID NO: 3036324 - protein, 9 aa, Entamoeba invadens
QNQTKQTKC

SEQ ID NO: 3036325 - protein, 10 aa, Entamoeba invadens
QNRAQTIGEN

SEQ ID NO: 3036326 - protein, 16 aa, Entamoeba invadens
QNSCSNWEEDTTSQEV

SEQ ID NO: 3036327 - protein, 10 aa, Entamoeba invadens
QNSNSKHRES

SEQ ID NO: 3036328 - protein, 8 aa, Entamoeba invadens
QNTNRNTR

SEQ ID NO: 3036329 - protein, 26 aa, Entamoeba invadens
QNTPYGPSKWPNGTDKANDNTAYSQS

SEQ ID NO: 3036330 - protein, 8 aa, Entamoeba invadens
QNTQITTQ

SEQ ID NO: 3036331 - protein, 6 aa, Entamoeba invadens
QNVTES

SEQ ID NO: 3036332 - protein, 25 aa, Entamoeba invadens
QPDDSEVPGPSNPRPETPPPTVETP

SEQ ID NO: 3036333 - protein, 113 aa, Entamoeba invadens
QPDEPRRHGSHRERSHKRSHHTSSRPSTSHHRTQERPTTSTSSQPSTSTTSGKHTHKRKHTTHEDTSSQSKHESKRQKLESSSEQPSTSKQTAQSSSTREHKDEPPKQIPYPP

SEQ ID NO: 3036334 - protein, 30 aa, Entamoeba invadens
QPDKHKEESSRTPPQYPAYGHTQQTYQQHQ

SEQ ID NO: 3036335 - protein, 7 aa, Entamoeba invadens
QPDNPIN

SEQ ID NO: 3036336 - protein, 11 aa, Entamoeba invadens
QPDQPKDDPQE

SEQ ID NO: 3036337 - protein, 55 aa, Entamoeba invadens
QPDSSPHSSGSEYPSTSQQTSEGAKAKSKGRKQREQWKKTNEEKTSSEEGATSKL

SEQ ID NO: 3036338 - protein, 62 aa, Entamoeba invadens
QPEEPKESKIPPSKGLSEEQIPTTSTVTTKRAQDSEKVDPQKEVQKEKPESSQEEEKATGAM

SEQ ID NO: 3036339 - protein, 8 aa, Entamoeba invadens
QPEETSKN

SEQ ID NO: 3036340 - protein, 33 aa, Entamoeba invadens
QPEKPKTPTTEPKKSIKRKLEEEKPSTSQQAAK

SEQ ID NO: 3036341 - protein, 11 aa, Entamoeba invadens
QPESNNYKHSA

SEQ ID NO: 3036342 - protein, 61 aa, Entamoeba invadens
QPEYTEDSSQSPTTSTPSVQSQKPKSSHSKNKKKRQRRQERKGLGTQESVTQSPTTSSNEK

SEQ ID NO: 3036343 - protein, 19 aa, Entamoeba invadens
QPGASNQETVTLDEESRQK

SEQ ID NO: 3036344 - protein, 6 aa, Entamoeba invadens
QPKGEM

SEQ ID NO: 3036345 - protein, 5 aa, Entamoeba invadens
QPKLN

SEQ ID NO: 3036346 - protein, 4 aa, Entamoeba invadens
QPLP

SEQ ID NO: 3036347 - protein, 5 aa, Entamoeba invadens
QPLPV

SEQ ID NO: 3036348 - protein, 5 aa, Entamoeba invadens
QPNKI

SEQ ID NO: 3036349 - protein, 22 aa, Entamoeba invadens
QPNRQLATSCSNEINPPDKDTT

SEQ ID NO: 3036350 - protein, 4 aa, Entamoeba invadens
QPPH

SEQ ID NO: 3036351 - protein, 4 aa, Entamoeba invadens
QPPQ

SEQ ID NO: 3036352 - protein, 16 aa, Entamoeba invadens
QPQDPSQSDGNQNPIS

SEQ ID NO: 3036353 - protein, 6 aa, Entamoeba invadens
QPTGIP

SEQ ID NO: 3036354 - protein, 6 aa, Entamoeba invadens
QPTSKR

SEQ ID NO: 3036355 - protein, 11 aa, Entamoeba invadens
QPTTTAPSTAP

SEQ ID NO: 3036356 - protein, 13 aa, Entamoeba invadens
QPTVAPRTGNPDD

SEQ ID NO: 3036357 - protein, 5 aa, Entamoeba invadens
QPTYA

SEQ ID NO: 3036358 - protein, 22 aa, Entamoeba invadens
QPVANNLETSVSINTTKVQTEL

SEQ ID NO: 3036359 - protein, 28 aa, Entamoeba invadens
QPVESEDSKDPSGASGYTPKQSEFPSLQ

SEQ ID NO: 3036360 - protein, 19 aa, Entamoeba invadens
QQATATKPTPGTPQTPHVA

SEQ ID NO: 3036361 - protein, 60 aa, Entamoeba invadens
QQAVASTSTATSTTDKKAKKSAKEAKKAAKAAIKAVKKEEKNLKKEAAEAKAAEKKAIEE

SEQ ID NO: 3036362 - protein, 9 aa, Entamoeba invadens
QQDAVDSSN

SEQ ID NO: 3036363 - protein, 6 aa, Entamoeba invadens
QQGDQW

SEQ ID NO: 3036364 - protein, 14 aa, Entamoeba invadens
QQGISPQPKRELDD

SEQ ID NO: 3036365 - protein, 12 aa, Entamoeba invadens
QQGRAKYKQADD

SEQ ID NO: 3036366 - protein, 9 aa, Entamoeba invadens
QQGTYSNIG

SEQ ID NO: 3036367 - protein, 8 aa, Entamoeba invadens
QQKKVRKM

SEQ ID NO: 3036368 - protein, 10 aa, Entamoeba invadens
QQKPQQITAT

SEQ ID NO: 3036369 - protein, 6 aa, Entamoeba invadens
QQKYTF

SEQ ID NO: 3036370 - protein, 9 aa, Entamoeba invadens
QQLTQTHAE

SEQ ID NO: 3036371 - protein, 5 aa, Entamoeba invadens
QQNCT

SEQ ID NO: 3036372 - protein, 9 aa, Entamoeba invadens
QQNGYYNSN

SEQ ID NO: 3036373 - protein, 56 aa, Entamoeba invadens
QQNKEIRKVAKKSARKYGKIAAKAAGKKAAVEAKKKFGEDKQKIKMEKKKAEKSVY

SEQ ID NO: 3036374 - protein, 8 aa, Entamoeba invadens
QQNKENQK

SEQ ID NO: 3036375 - protein, 7 aa, Entamoeba invadens
QQNLPSQ

SEQ ID NO: 3036376 - protein, 8 aa, Entamoeba invadens
QQNLPSQH

SEQ ID NO: 3036377 - protein, 8 aa, Entamoeba invadens
QQNQSTSA

SEQ ID NO: 3036378 - protein, 24 aa, Entamoeba invadens
QQPEKPEDPSEKPSLLKRSSSIGD

SEQ ID NO: 3036379 - protein, 6 aa, Entamoeba invadens
QQQEKE

SEQ ID NO: 3036380 - protein, 9 aa, Entamoeba invadens
QQQENRPDI

SEQ ID NO: 3036381 - protein, 8 aa, Entamoeba invadens
QQQNQQMN

SEQ ID NO: 3036382 - protein, 24 aa, Entamoeba invadens
QQQPRRPLEIPQPQQQPPGPPHVP

SEQ ID NO: 3036383 - protein, 14 aa, Entamoeba invadens
QQQQQQQQSSQQSP

SEQ ID NO: 3036384 - protein, 8 aa, Entamoeba invadens
QQQQQVPH

SEQ ID NO: 3036385 - protein, 7 aa, Entamoeba invadens
QQQRPVV

SEQ ID NO: 3036386 - protein, 11 aa, Entamoeba invadens
QQQYEQLGARP

SEQ ID NO: 3036387 - protein, 7 aa, Entamoeba invadens
QQRQTER

SEQ ID NO: 3036388 - protein, 6 aa, Entamoeba invadens
QQSTYD

SEQ ID NO: 3036389 - protein, 9 aa, Entamoeba invadens
QQTRYQQPR

SEQ ID NO: 3036390 - protein, 15 aa, Entamoeba invadens
QQTTRCQSPSNTTMS

SEQ ID NO: 3036391 - protein, 12 aa, Entamoeba invadens
QQTVKTQLSRDK

SEQ ID NO: 3036392 - protein, 7 aa, Entamoeba invadens
QQVDQGR

SEQ ID NO: 3036393 - protein, 13 aa, Entamoeba invadens
QQYPQQQQQINPQ

SEQ ID NO: 3036394 - protein, 78 aa, Entamoeba invadens
QRDKAKRQKQKEKKKQKMMNNTNKRKASKPKKIQKPKIVNKPKIRKNKNKPKPQNRPKPQKRQKPTANAQKSQKKGKK

SEQ ID NO: 3036395 - protein, 16 aa, Entamoeba invadens
QRDVTTPKTPRKKPGL

SEQ ID NO: 3036396 - protein, 13 aa, Entamoeba invadens
QREKMNNGVNEYR

SEQ ID NO: 3036397 - protein, 6 aa, Entamoeba invadens
QRGGDA

SEQ ID NO: 3036398 - protein, 18 aa, Entamoeba invadens
QRITNSNAKLNSTKEEMS

SEQ ID NO: 3036399 - protein, 13 aa, Entamoeba invadens
QRKGDTYVYHWSL

SEQ ID NO: 3036400 - protein, 8 aa, Entamoeba invadens
QRKITPHG

SEQ ID NO: 3036401 - protein, 10 aa, Entamoeba invadens
QRKKKTSDVL

SEQ ID NO: 3036402 - protein, 22 aa, Entamoeba invadens
QRKQQRKAKRMSRMKESNGHRY

SEQ ID NO: 3036403 - protein, 15 aa, Entamoeba invadens
QRNNQISDVNDNSTK

SEQ ID NO: 3036404 - protein, 9 aa, Entamoeba invadens
QRNRTKVTK

SEQ ID NO: 3036405 - protein, 7 aa, Entamoeba invadens
QRQAEID

SEQ ID NO: 3036406 - protein, 23 aa, Entamoeba invadens
QRREAARRRRDSMSSGESSTEVL

SEQ ID NO: 3036407 - protein, 4 aa, Entamoeba invadens
QRSC

SEQ ID NO: 3036408 - protein, 16 aa, Entamoeba invadens
QRSQTGKSKSGSVDFQ

SEQ ID NO: 3036409 - protein, 11 aa, Entamoeba invadens
QSAEDKETTLR

SEQ ID NO: 3036410 - protein, 25 aa, Entamoeba invadens
QSASKTASGCEKADTCVESANGDQC

SEQ ID NO: 3036411 - protein, 13 aa, Entamoeba invadens
QSCAQTESDNNYD

SEQ ID NO: 3036412 - protein, 16 aa, Entamoeba invadens
QSCSTTQIQPPDANSE

SEQ ID NO: 3036413 - protein, 4 aa, Entamoeba invadens
QSDI

SEQ ID NO: 3036414 - protein, 12 aa, Entamoeba invadens
QSDNRIYNDAEA

SEQ ID NO: 3036415 - protein, 10 aa, Entamoeba invadens
QSDTDKTNGC

SEQ ID NO: 3036416 - protein, 9 aa, Entamoeba invadens
QSDTTSSLT

SEQ ID NO: 3036417 - protein, 7 aa, Entamoeba invadens
QSEQLSK

SEQ ID NO: 3036418 - protein, 4 aa, Entamoeba invadens
QSER

SEQ ID NO: 3036419 - protein, 12 aa, Entamoeba invadens
QSESPETSPKKV

SEQ ID NO: 3036420 - protein, 6 aa, Entamoeba invadens
QSETCG

SEQ ID NO: 3036421 - protein, 15 aa, Entamoeba invadens
QSETQQTLDTANTKM

SEQ ID NO: 3036422 - protein, 4 aa, Entamoeba invadens
QSEV

SEQ ID NO: 3036423 - protein, 5 aa, Entamoeba invadens
QSFSE

SEQ ID NO: 3036424 - protein, 7 aa, Entamoeba invadens
QSGDKSP

SEQ ID NO: 3036425 - protein, 8 aa, Entamoeba invadens
QSGIPDAT

SEQ ID NO: 3036426 - protein, 8 aa, Entamoeba invadens
QSGIPKAT

SEQ ID NO: 3036427 - protein, 7 aa, Entamoeba invadens
QSGSEVT

SEQ ID NO: 3036428 - protein, 11 aa, Entamoeba invadens
QSIRKDKTKPI

SEQ ID NO: 3036429 - protein, 17 aa, Entamoeba invadens
QSKAVRKISKPQKFTRV

SEQ ID NO: 3036430 - protein, 11 aa, Entamoeba invadens
QSKGEKDIKDY

SEQ ID NO: 3036431 - protein, 7 aa, Entamoeba invadens
QSKKTLR

SEQ ID NO: 3036432 - protein, 5 aa, Entamoeba invadens
QSKNA

SEQ ID NO: 3036433 - protein, 8 aa, Entamoeba invadens
QSKYGKAL

SEQ ID NO: 3036434 - protein, 6 aa, Entamoeba invadens
QSLDAR

SEQ ID NO: 3036435 - protein, 10 aa, Entamoeba invadens
QSNDQAKQYE

SEQ ID NO: 3036436 - protein, 4 aa, Entamoeba invadens
QSNN

SEQ ID NO: 3036437 - protein, 5 aa, Entamoeba invadens
QSNSA

SEQ ID NO: 3036438 - protein, 20 aa, Entamoeba invadens
QSQCSNCDSKCKTCDQKTGN

SEQ ID NO: 3036439 - protein, 9 aa, Entamoeba invadens
QSQDANLQT

SEQ ID NO: 3036440 - protein, 17 aa, Entamoeba invadens
QSQHGNAETFQENSNYG

SEQ ID NO: 3036441 - protein, 7 aa, Entamoeba invadens
QSSSSWE

SEQ ID NO: 3036442 - protein, 6 aa, Entamoeba invadens
QSTEET

SEQ ID NO: 3036443 - protein, 5 aa, Entamoeba invadens
QSTKS

SEQ ID NO: 3036444 - protein, 6 aa, Entamoeba invadens
QSTSEY

SEQ ID NO: 3036445 - protein, 10 aa, Entamoeba invadens
QSVGFTGDNS

SEQ ID NO: 3036446 - protein, 7 aa, Entamoeba invadens
QSVGYGE

SEQ ID NO: 3036447 - protein, 7 aa, Entamoeba invadens
QSVSNDN

SEQ ID NO: 3036448 - protein, 9 aa, Entamoeba invadens
QSYCNSPKL

SEQ ID NO: 3036449 - protein, 9 aa, Entamoeba invadens
QSYNSKQQT

SEQ ID NO: 3036450 - protein, 14 aa, Entamoeba invadens
QSYRKSIEKKSFKR

SEQ ID NO: 3036451 - protein, 23 aa, Entamoeba invadens
QSYVKKAASGPNYEPLKAGTKKI

SEQ ID NO: 3036452 - protein, 7 aa, Entamoeba invadens
QTCKSGG

SEQ ID NO: 3036453 - protein, 8 aa, Entamoeba invadens
QTCSTQSV

SEQ ID NO: 3036454 - protein, 9 aa, Entamoeba invadens
QTDKNHVRG

SEQ ID NO: 3036455 - protein, 9 aa, Entamoeba invadens
QTDNSKQPF

SEQ ID NO: 3036456 - protein, 5 aa, Entamoeba invadens
QTDPL

SEQ ID NO: 3036457 - protein, 21 aa, Entamoeba invadens
QTEAGFGVDKTPETVQKSKRR

SEQ ID NO: 3036458 - protein, 9 aa, Entamoeba invadens
QTEKRKCGD

SEQ ID NO: 3036459 - protein, 13 aa, Entamoeba invadens
QTFANSTKDKLEA

SEQ ID NO: 3036460 - protein, 8 aa, Entamoeba invadens
QTGNETKS

SEQ ID NO: 3036461 - protein, 5 aa, Entamoeba invadens
QTGSS

SEQ ID NO: 3036462 - protein, 4 aa, Entamoeba invadens
QTIS

SEQ ID NO: 3036463 - protein, 15 aa, Entamoeba invadens
QTKDTSDSRSTWEGN

SEQ ID NO: 3036464 - protein, 13 aa, Entamoeba invadens
QTLNDKKTEIERM

SEQ ID NO: 3036465 - protein, 7 aa, Entamoeba invadens
QTLPNDP

SEQ ID NO: 3036466 - protein, 21 aa, Entamoeba invadens
QTLSRKGKCSLSSTKIESTGG

SEQ ID NO: 3036467 - protein, 10 aa, Entamoeba invadens
QTPEEQEKRI

SEQ ID NO: 3036468 - protein, 36 aa, Entamoeba invadens
QTPPHPPPAKPTSSSRQLRRTLSESDLTGKTKRDQL

SEQ ID NO: 3036469 - protein, 22 aa, Entamoeba invadens
QTPSKKTKRTLKKKIKPDETAK

SEQ ID NO: 3036470 - protein, 5 aa, Entamoeba invadens
QTQDL

SEQ ID NO: 3036471 - protein, 8 aa, Entamoeba invadens
QTQVQNPF

SEQ ID NO: 3036472 - protein, 13 aa, Entamoeba invadens
QTRTKYKFKGKPI

SEQ ID NO: 3036473 - protein, 10 aa, Entamoeba invadens
QTSNDSESIF

SEQ ID NO: 3036474 - protein, 8 aa, Entamoeba invadens
QTTAEPQE

SEQ ID NO: 3036475 - protein, 8 aa, Entamoeba invadens
QTTNPNKV

SEQ ID NO: 3036476 - protein, 7 aa, Entamoeba invadens
QTTRPSI

SEQ ID NO: 3036477 - protein, 17 aa, Entamoeba invadens
QTYSTQCSKCKQGTVLT

SEQ ID NO: 3036478 - protein, 5 aa, Entamoeba invadens
QVASR

SEQ ID NO: 3036479 - protein, 10 aa, Entamoeba invadens
QVDTGCSNCE

SEQ ID NO: 3036480 - protein, 6 aa, Entamoeba invadens
QVEGRK

SEQ ID NO: 3036481 - protein, 43 aa, Entamoeba invadens
QVKPVKKQTTIQPAQQPQQSTPIEVQETQTQPTPQDNYQEQQY

SEQ ID NO: 3036482 - protein, 8 aa, Entamoeba invadens
QVKQSDFS

SEQ ID NO: 3036483 - protein, 8 aa, Entamoeba invadens
QVNEDRER

SEQ ID NO: 3036484 - protein, 4 aa, Entamoeba invadens
QVPE

SEQ ID NO: 3036485 - protein, 6 aa, Entamoeba invadens
QVPENM

SEQ ID NO: 3036486 - protein, 5 aa, Entamoeba invadens
QVQVK

SEQ ID NO: 3036487 - protein, 6 aa, Entamoeba invadens
QVRPEE

SEQ ID NO: 3036488 - protein, 10 aa, Entamoeba invadens
QVSTKNQNSN

SEQ ID NO: 3036489 - protein, 6 aa, Entamoeba invadens
QVTFSD

SEQ ID NO: 3036490 - protein, 5 aa, Entamoeba invadens
QVTKK

SEQ ID NO: 3036491 - protein, 5 aa, Entamoeba invadens
QVTNT

SEQ ID NO: 3036492 - protein, 9 aa, Entamoeba invadens
QVTPSSGAD

SEQ ID NO: 3036493 - protein, 5 aa, Entamoeba invadens
QVTRA

SEQ ID NO: 3036494 - protein, 4 aa, Entamoeba invadens
QYDD

SEQ ID NO: 3036495 - protein, 10 aa, Entamoeba invadens
QYDDQSDCNV

SEQ ID NO: 3036496 - protein, 5 aa, Entamoeba invadens
QYDKK

SEQ ID NO: 3036497 - protein, 15 aa, Entamoeba invadens
QYERSGKKSGEGRFR

SEQ ID NO: 3036498 - protein, 5 aa, Entamoeba invadens
QYGKS

SEQ ID NO: 3036499 - protein, 8 aa, Entamoeba invadens
QYGPLSDS

SEQ ID NO: 3036500 - protein, 9 aa, Entamoeba invadens
QYKRQDPGN

SEQ ID NO: 3036501 - protein, 10 aa, Entamoeba invadens
QYNADGTCSS

SEQ ID NO: 3036502 - protein, 7 aa, Entamoeba invadens
QYNEKTE

SEQ ID NO: 3036503 - protein, 8 aa, Entamoeba invadens
QYNSGTYN

SEQ ID NO: 3036504 - protein, 7 aa, Entamoeba invadens
QYPRNRK

SEQ ID NO: 3036505 - protein, 12 aa, Entamoeba invadens
QYPSVETSQTQL

SEQ ID NO: 3036506 - protein, 6 aa, Entamoeba invadens
QYQPVQ

SEQ ID NO: 3036507 - protein, 7 aa, Entamoeba invadens
QYTNQNL

SEQ ID NO: 3036508 - protein, 11 aa, Entamoeba invadens
QYTPAITQPSK

SEQ ID NO: 3036509 - protein, 9 aa, Entamoeba invadens
RAAESTSGY

SEQ ID NO: 3036510 - protein, 18 aa, Entamoeba invadens
RAEQQKYMQNKRDKQDME

SEQ ID NO: 3036511 - protein, 6 aa, Entamoeba invadens
RAESSL

SEQ ID NO: 3036512 - protein, 5 aa, Entamoeba invadens
RAIEN

SEQ ID NO: 3036513 - protein, 12 aa, Entamoeba invadens
RAKKVYGGERNL

SEQ ID NO: 3036514 - protein, 5 aa, Entamoeba invadens
RAKSL

SEQ ID NO: 3036515 - protein, 12 aa, Entamoeba invadens
RANSYEGFDSAN

SEQ ID NO: 3036516 - protein, 8 aa, Entamoeba invadens
RAQDLSTS

SEQ ID NO: 3036517 - protein, 7 aa, Entamoeba invadens
RAQQPFA

SEQ ID NO: 3036518 - protein, 6 aa, Entamoeba invadens
RARRKG

SEQ ID NO: 3036519 - protein, 9 aa, Entamoeba invadens
RASDDNKLS

SEQ ID NO: 3036520 - protein, 12 aa, Entamoeba invadens
RASMPEPQNDGM

SEQ ID NO: 3036521 - protein, 7 aa, Entamoeba invadens
RATQRRR

SEQ ID NO: 3036522 - protein, 4 aa, Entamoeba invadens
RATT

SEQ ID NO: 3036523 - protein, 8 aa, Entamoeba invadens
RAVDTSPS

SEQ ID NO: 3036524 - protein, 6 aa, Entamoeba invadens
RAYGGK

SEQ ID NO: 3036525 - protein, 4 aa, Entamoeba invadens
RAYK

SEQ ID NO: 3036526 - protein, 5 aa, Entamoeba invadens
RAYRG

SEQ ID NO: 3036527 - protein, 8 aa, Entamoeba invadens
RCDAASGK

SEQ ID NO: 3036528 - protein, 15 aa, Entamoeba invadens
RCKASEAKQIFTPIF

SEQ ID NO: 3036529 - protein, 7 aa, Entamoeba invadens
RCNATDG

SEQ ID NO: 3036530 - protein, 4 aa, Entamoeba invadens
RCPE

SEQ ID NO: 3036531 - protein, 14 aa, Entamoeba invadens
RCPEGKKTNLAENT

SEQ ID NO: 3036532 - protein, 12 aa, Entamoeba invadens
RCSSESNCNSCE

SEQ ID NO: 3036533 - protein, 15 aa, Entamoeba invadens
RCTASEAKQTFTPIF

SEQ ID NO: 3036534 - protein, 5 aa, Entamoeba invadens
RDAAY

SEQ ID NO: 3036535 - protein, 11 aa, Entamoeba invadens
RDAFSGNTNLT

SEQ ID NO: 3036536 - protein, 5 aa, Entamoeba invadens
RDDTR

SEQ ID NO: 3036537 - protein, 4 aa, Entamoeba invadens
RDDV

SEQ ID NO: 3036538 - protein, 9 aa, Entamoeba invadens
RDEADRDVK

SEQ ID NO: 3036539 - protein, 5 aa, Entamoeba invadens
RDEIT

SEQ ID NO: 3036540 - protein, 7 aa, Entamoeba invadens
RDGEDTV

SEQ ID NO: 3036541 - protein, 13 aa, Entamoeba invadens
RDHRPTPRESRYW

SEQ ID NO: 3036542 - protein, 9 aa, Entamoeba invadens
RDIGTYNGK

SEQ ID NO: 3036543 - protein, 13 aa, Entamoeba invadens
RDIRPYGILVLEC

SEQ ID NO: 3036544 - protein, 9 aa, Entamoeba invadens
RDKPKQGFH

SEQ ID NO: 3036545 - protein, 13 aa, Entamoeba invadens
RDKYINKSRNYAQ

SEQ ID NO: 3036546 - protein, 16 aa, Entamoeba invadens
RDNKKTLKYSKNKLIY

SEQ ID NO: 3036547 - protein, 7 aa, Entamoeba invadens
RDNSTTI

SEQ ID NO: 3036548 - protein, 9 aa, Entamoeba invadens
RDPNNTDND

SEQ ID NO: 3036549 - protein, 7 aa, Entamoeba invadens
RDQDQNK

SEQ ID NO: 3036550 - protein, 11 aa, Entamoeba invadens
RDQYGNKPDTF

SEQ ID NO: 3036551 - protein, 7 aa, Entamoeba invadens
RDRSGTL

SEQ ID NO: 3036552 - protein, 18 aa, Entamoeba invadens
RDSGVVKSGVTDCSTEDD

SEQ ID NO: 3036553 - protein, 18 aa, Entamoeba invadens
RDSGVVKSNVTDCSTEDD

SEQ ID NO: 3036554 - protein, 4 aa, Entamoeba invadens
RDSQ

SEQ ID NO: 3036555 - protein, 39 aa, Entamoeba invadens
RDSQTHPQSTQQAQNPQDDTKRLTRTAFTSRKPAPNPQI

SEQ ID NO: 3036556 - protein, 17 aa, Entamoeba invadens
RDTAKNPPQPPSRPTYH

SEQ ID NO: 3036557 - protein, 5 aa, Entamoeba invadens
RDTNG

SEQ ID NO: 3036558 - protein, 4 aa, Entamoeba invadens
RDVE

SEQ ID NO: 3036559 - protein, 28 aa, Entamoeba invadens
RDVKTKHGRSYSKSSVSYYTSDPSNKNF

SEQ ID NO: 3036560 - protein, 13 aa, Entamoeba invadens
RDVSTGATSANSG

SEQ ID NO: 3036561 - protein, 9 aa, Entamoeba invadens
REAKIREIN

SEQ ID NO: 3036562 - protein, 14 aa, Entamoeba invadens
REDKKAKGYTSTTC

SEQ ID NO: 3036563 - protein, 14 aa, Entamoeba invadens
REEEMKKSDQCNST

SEQ ID NO: 3036564 - protein, 18 aa, Entamoeba invadens
REEQHKSRKQAKKIKREA

SEQ ID NO: 3036565 - protein, 7 aa, Entamoeba invadens
REETAVN

SEQ ID NO: 3036566 - protein, 16 aa, Entamoeba invadens
REKEATSECVGETCTT

SEQ ID NO: 3036567 - protein, 80 aa, Entamoeba invadens
REKMNKRNANIRRNNMPKYNKLQNKAKNTRTKTNKPKSQKIQKAQQRKQVKANKPKANKSNRPNKSSKSNKSSASKNSKR

SEQ ID NO: 3036568 - protein, 8 aa, Entamoeba invadens
REKSKKTR

SEQ ID NO: 3036569 - protein, 11 aa, Entamoeba invadens
REKSLVETNED

SEQ ID NO: 3036570 - protein, 9 aa, Entamoeba invadens
REKYKKSAD

SEQ ID NO: 3036571 - protein, 7 aa, Entamoeba invadens
RELTEGQ

SEQ ID NO: 3036572 - protein, 5 aa, Entamoeba invadens
RENDK

SEQ ID NO: 3036573 - protein, 9 aa, Entamoeba invadens
RENKDQSDT

SEQ ID NO: 3036574 - protein, 9 aa, Entamoeba invadens
RENSGTYNN

SEQ ID NO: 3036575 - protein, 5 aa, Entamoeba invadens
RENYT

SEQ ID NO: 3036576 - protein, 4 aa, Entamoeba invadens
REQQ

SEQ ID NO: 3036577 - protein, 13 aa, Entamoeba invadens
RERWDTTAYRERR

SEQ ID NO: 3036578 - protein, 6 aa, Entamoeba invadens
RERYRS

SEQ ID NO: 3036579 - protein, 5 aa, Entamoeba invadens
RESGN

SEQ ID NO: 3036580 - protein, 15 aa, Entamoeba invadens
RESTGEEADKAIEAG

SEQ ID NO: 3036581 - protein, 4 aa, Entamoeba invadens
RETM

SEQ ID NO: 3036582 - protein, 15 aa, Entamoeba invadens
REYENAKLTAEKRRI

SEQ ID NO: 3036583 - protein, 5 aa, Entamoeba invadens
REYPD

SEQ ID NO: 3036584 - protein, 11 aa, Entamoeba invadens
RFTNADQALDA

SEQ ID NO: 3036585 - protein, 7 aa, Entamoeba invadens
RFTTNDM

SEQ ID NO: 3036586 - protein, 10 aa, Entamoeba invadens
RFTTSDTDTR

SEQ ID NO: 3036587 - protein, 10 aa, Entamoeba invadens
RGDDESNSGL

SEQ ID NO: 3036588 - protein, 9 aa, Entamoeba invadens
RGDTPGFEC

SEQ ID NO: 3036589 - protein, 5 aa, Entamoeba invadens
RGEGV

SEQ ID NO: 3036590 - protein, 7 aa, Entamoeba invadens
RGEQITG

SEQ ID NO: 3036591 - protein, 18 aa, Entamoeba invadens
RGGKGNSGKYGDYSCDAN

SEQ ID NO: 3036592 - protein, 6 aa, Entamoeba invadens
RGKEKG

SEQ ID NO: 3036593 - protein, 18 aa, Entamoeba invadens
RGKTSGRADDNADAAKKR

SEQ ID NO: 3036594 - protein, 4 aa, Entamoeba invadens
RGNN

SEQ ID NO: 3036595 - protein, 8 aa, Entamoeba invadens
RGNTQTNI

SEQ ID NO: 3036596 - protein, 9 aa, Entamoeba invadens
RGPQGPKSY

SEQ ID NO: 3036597 - protein, 6 aa, Entamoeba invadens
RGRLNQ

SEQ ID NO: 3036598 - protein, 10 aa, Entamoeba invadens
RGSDYTRTHR

SEQ ID NO: 3036599 - protein, 11 aa, Entamoeba invadens
RGSSDDDGQHL

SEQ ID NO: 3036600 - protein, 11 aa, Entamoeba invadens
RGSSPNYKPSI

SEQ ID NO: 3036601 - protein, 8 aa, Entamoeba invadens
RGTADPGN

SEQ ID NO: 3036602 - protein, 16 aa, Entamoeba invadens
RGTECNVDDNSKDVGQ

SEQ ID NO: 3036603 - protein, 5 aa, Entamoeba invadens
RGTPM

SEQ ID NO: 3036604 - protein, 8 aa, Entamoeba invadens
RGVNEGDT

SEQ ID NO: 3036605 - protein, 32 aa, Entamoeba invadens
RHEKPIEDSQVPEGSIAPPEFPHDDHNHGPHF

SEQ ID NO: 3036606 - protein, 5 aa, Entamoeba invadens
RHKKA

SEQ ID NO: 3036607 - protein, 14 aa, Entamoeba invadens
RIDDSTEKAIRNGI

SEQ ID NO: 3036608 - protein, 5 aa, Entamoeba invadens
RIDKT

SEQ ID NO: 3036609 - protein, 6 aa, Entamoeba invadens
RIKEDT

SEQ ID NO: 3036610 - protein, 8 aa, Entamoeba invadens
RIKPSKKT

SEQ ID NO: 3036611 - protein, 4 aa, Entamoeba invadens
RINP

SEQ ID NO: 3036612 - protein, 12 aa, Entamoeba invadens
RIQKRESITQEE

SEQ ID NO: 3036613 - protein, 10 aa, Entamoeba invadens
RIYTQKKRSL

SEQ ID NO: 3036614 - protein, 7 aa, Entamoeba invadens
RKAERVR

SEQ ID NO: 3036615 - protein, 7 aa, Entamoeba invadens
RKARQTK

SEQ ID NO: 3036616 - protein, 15 aa, Entamoeba invadens
RKASEARSTWSGNSN

SEQ ID NO: 3036617 - protein, 7 aa, Entamoeba invadens
RKATSID

SEQ ID NO: 3036618 - protein, 5 aa, Entamoeba invadens
RKCDA

SEQ ID NO: 3036619 - protein, 7 aa, Entamoeba invadens
RKDLNRT

SEQ ID NO: 3036620 - protein, 24 aa, Entamoeba invadens
RKDQAEKIRQKDLRELEKKERAEQ

SEQ ID NO: 3036621 - protein, 9 aa, Entamoeba invadens
RKDSNDDFV

SEQ ID NO: 3036622 - protein, 10 aa, Entamoeba invadens
RKDTTNRRQH

SEQ ID NO: 3036623 - protein, 6 aa, Entamoeba invadens
RKEELA

SEQ ID NO: 3036624 - protein, 6 aa, Entamoeba invadens
RKEKED

SEQ ID NO: 3036625 - protein, 11 aa, Entamoeba invadens
RKEVSDSSKPI

SEQ ID NO: 3036626 - protein, 7 aa, Entamoeba invadens
RKFGPKK

SEQ ID NO: 3036627 - protein, 7 aa, Entamoeba invadens
RKGVTKN

SEQ ID NO: 3036628 - protein, 12 aa, Entamoeba invadens
RKINEDNKPDSI

SEQ ID NO: 3036629 - protein, 10 aa, Entamoeba invadens
RKKEREREAE

SEQ ID NO: 3036630 - protein, 9 aa, Entamoeba invadens
RKKVTERIS

SEQ ID NO: 3036631 - protein, 9 aa, Entamoeba invadens
RKKYKKAAD

SEQ ID NO: 3036632 - protein, 4 aa, Entamoeba invadens
RKLE

SEQ ID NO: 3036633 - protein, 5 aa, Entamoeba invadens
RKNIP

SEQ ID NO: 3036634 - protein, 4 aa, Entamoeba invadens
RKNS

SEQ ID NO: 3036635 - protein, 7 aa, Entamoeba invadens
RKNSMTC

SEQ ID NO: 3036636 - protein, 15 aa, Entamoeba invadens
RKPDDFDDENYDEKY

SEQ ID NO: 3036637 - protein, 14 aa, Entamoeba invadens
RKPPKNSSNGFCGI

SEQ ID NO: 3036638 - protein, 5 aa, Entamoeba invadens
RKQNI

SEQ ID NO: 3036639 - protein, 7 aa, Entamoeba invadens
RKQSRGD

SEQ ID NO: 3036640 - protein, 11 aa, Entamoeba invadens
RKQTNRKEQKN

SEQ ID NO: 3036641 - protein, 12 aa, Entamoeba invadens
RKSADKVTQPFR

SEQ ID NO: 3036642 - protein, 20 aa, Entamoeba invadens
RKSDDAVYSTVTDAESTHNT

SEQ ID NO: 3036643 - protein, 7 aa, Entamoeba invadens
RKSKELY

SEQ ID NO: 3036644 - protein, 6 aa, Entamoeba invadens
RKTAKK

SEQ ID NO: 3036645 - protein, 27 aa, Entamoeba invadens
RKTEEEVTKELDPKEEKEDKKPQDKPE

SEQ ID NO: 3036646 - protein, 10 aa, Entamoeba invadens
RKTKNNSTLL

SEQ ID NO: 3036647 - protein, 22 aa, Entamoeba invadens
RKTPQLKEPTEFPKELTTSGRT

SEQ ID NO: 3036648 - protein, 6 aa, Entamoeba invadens
RKTTSH

SEQ ID NO: 3036649 - protein, 7 aa, Entamoeba invadens
RKTVSTI

SEQ ID NO: 3036650 - protein, 4 aa, Entamoeba invadens
RKVP

SEQ ID NO: 3036651 - protein, 10 aa, Entamoeba invadens
RKVQKESERD

SEQ ID NO: 3036652 - protein, 8 aa, Entamoeba invadens
RKVRGKRY

SEQ ID NO: 3036653 - protein, 12 aa, Entamoeba invadens
RLEKNTELLGEE

SEQ ID NO: 3036654 - protein, 5 aa, Entamoeba invadens
RLGTK

SEQ ID NO: 3036655 - protein, 4 aa, Entamoeba invadens
RLNN

SEQ ID NO: 3036656 - protein, 5 aa, Entamoeba invadens
RLNPH

SEQ ID NO: 3036657 - protein, 11 aa, Entamoeba invadens
RLNTDENSKRL

SEQ ID NO: 3036658 - protein, 12 aa, Entamoeba invadens
RLNTDENSKRLL

SEQ ID NO: 3036659 - protein, 18 aa, Entamoeba invadens
RLPESALQRAETSRVNEP

SEQ ID NO: 3036660 - protein, 8 aa, Entamoeba invadens
RLPSPGHK

SEQ ID NO: 3036661 - protein, 14 aa, Entamoeba invadens
RLSKECSKGESTDY

SEQ ID NO: 3036662 - protein, 10 aa, Entamoeba invadens
RLTEKENEKV

SEQ ID NO: 3036663 - protein, 12 aa, Entamoeba invadens
RLYKGKSSHPYS

SEQ ID NO: 3036664 - protein, 7 aa, Entamoeba invadens
RMGTRAQ

SEQ ID NO: 3036665 - protein, 25 aa, Entamoeba invadens
RMSEAADKVKKESEALKKAEKSMGK

SEQ ID NO: 3036666 - protein, 13 aa, Entamoeba invadens
RNANDKEIKKAYR

SEQ ID NO: 3036667 - protein, 4 aa, Entamoeba invadens
RNAV

SEQ ID NO: 3036668 - protein, 7 aa, Entamoeba invadens
RNAYGDG

SEQ ID NO: 3036669 - protein, 7 aa, Entamoeba invadens
RNDSLSD

SEQ ID NO: 3036670 - protein, 7 aa, Entamoeba invadens
RNDSLSN

SEQ ID NO: 3036671 - protein, 6 aa, Entamoeba invadens
RNDTLA

SEQ ID NO: 3036672 - protein, 10 aa, Entamoeba invadens
RNEKGHGKKC

SEQ ID NO: 3036673 - protein, 10 aa, Entamoeba invadens
RNGDLGYGDE

SEQ ID NO: 3036674 - protein, 8 aa, Entamoeba invadens
RNGQLGKS

SEQ ID NO: 3036675 - protein, 8 aa, Entamoeba invadens
RNINGADR

SEQ ID NO: 3036676 - protein, 10 aa, Entamoeba invadens
RNKDNQCSIA

SEQ ID NO: 3036677 - protein, 7 aa, Entamoeba invadens
RNKGEDV

SEQ ID NO: 3036678 - protein, 68 aa, Entamoeba invadens
RNKKEKAMRDEIKEKERKEAEEKKKIEDAKKAEEEAKKKAEEEKKAEEEKKEEPKKEPTPEEIKNKEE

SEQ ID NO: 3036679 - protein, 10 aa, Entamoeba invadens
RNKLNPNTMP

SEQ ID NO: 3036680 - protein, 5 aa, Entamoeba invadens
RNKMH

SEQ ID NO: 3036681 - protein, 4 aa, Entamoeba invadens
RNLN

SEQ ID NO: 3036682 - protein, 4 aa, Entamoeba invadens
RNME

SEQ ID NO: 3036683 - protein, 8 aa, Entamoeba invadens
RNNATIGE

SEQ ID NO: 3036684 - protein, 5 aa, Entamoeba invadens
RNNGI

SEQ ID NO: 3036685 - protein, 6 aa, Entamoeba invadens
RNNSIK

SEQ ID NO: 3036686 - protein, 10 aa, Entamoeba invadens
RNNTASKTFE

SEQ ID NO: 3036687 - protein, 7 aa, Entamoeba invadens
RNPLSKE

SEQ ID NO: 3036688 - protein, 9 aa, Entamoeba invadens
RNQSIPSSI

SEQ ID NO: 3036689 - protein, 4 aa, Entamoeba invadens
RNRR

SEQ ID NO: 3036690 - protein, 10 aa, Entamoeba invadens
RNRSGTMEPH

SEQ ID NO: 3036691 - protein, 4 aa, Entamoeba invadens
RNSE

SEQ ID NO: 3036692 - protein, 6 aa, Entamoeba invadens
RNSEVS

SEQ ID NO: 3036693 - protein, 6 aa, Entamoeba invadens
RNSMNS

SEQ ID NO: 3036694 - protein, 5 aa, Entamoeba invadens
RNSNN

SEQ ID NO: 3036695 - protein, 21 aa, Entamoeba invadens
RNTIPKDDEEQPQGGASGWGS

SEQ ID NO: 3036696 - protein, 18 aa, Entamoeba invadens
RNTLESGKQIIDKKDRVN

SEQ ID NO: 3036697 - protein, 8 aa, Entamoeba invadens
RNTSYTTE

SEQ ID NO: 3036698 - protein, 6 aa, Entamoeba invadens
RNVTQQ

SEQ ID NO: 3036699 - protein, 6 aa, Entamoeba invadens
RPAIAK

SEQ ID NO: 3036700 - protein, 7 aa, Entamoeba invadens
RPDKGIG

SEQ ID NO: 3036701 - protein, 6 aa, Entamoeba invadens
RPEAAK

SEQ ID NO: 3036702 - protein, 7 aa, Entamoeba invadens
RPEINKT

SEQ ID NO: 3036703 - protein, 6 aa, Entamoeba invadens
RPERMA

SEQ ID NO: 3036704 - protein, 18 aa, Entamoeba invadens
RPFGGNEEYDISKDGQKI

SEQ ID NO: 3036705 - protein, 16 aa, Entamoeba invadens
RPHYTTPQQQSPQTQH

SEQ ID NO: 3036706 - protein, 19 aa, Entamoeba invadens
RPIRQREQLKESEQAQQTE

SEQ ID NO: 3036707 - protein, 6 aa, Entamoeba invadens
RPITPQ

SEQ ID NO: 3036708 - protein, 6 aa, Entamoeba invadens
RPKTQF

SEQ ID NO: 3036709 - protein, 11 aa, Entamoeba invadens
RPNKNVKNKYY

SEQ ID NO: 3036710 - protein, 8 aa, Entamoeba invadens
RPNPSYGL

SEQ ID NO: 3036711 - protein, 6 aa, Entamoeba invadens
RPNYTY

SEQ ID NO: 3036712 - protein, 7 aa, Entamoeba invadens
RPSWSEE

SEQ ID NO: 3036713 - protein, 13 aa, Entamoeba invadens
RQAQITPSDIQTL

SEQ ID NO: 3036714 - protein, 4 aa, Entamoeba invadens
RQEK

SEQ ID NO: 3036715 - protein, 8 aa, Entamoeba invadens
RQGAEPGN

SEQ ID NO: 3036716 - protein, 5 aa, Entamoeba invadens
RQHTF

SEQ ID NO: 3036717 - protein, 4 aa, Entamoeba invadens
RQKC

SEQ ID NO: 3036718 - protein, 9 aa, Entamoeba invadens
RQKREMRET

SEQ ID NO: 3036719 - protein, 4 aa, Entamoeba invadens
RQNP

SEQ ID NO: 3036720 - protein, 4 aa, Entamoeba invadens
RQNQ

SEQ ID NO: 3036721 - protein, 9 aa, Entamoeba invadens
RQPKTTAND

SEQ ID NO: 3036722 - protein, 5 aa, Entamoeba invadens
RQPKV

SEQ ID NO: 3036723 - protein, 15 aa, Entamoeba invadens
RQQPTHNLGQQYPTH

SEQ ID NO: 3036724 - protein, 5 aa, Entamoeba invadens
RQQRL

SEQ ID NO: 3036725 - protein, 5 aa, Entamoeba invadens
RQSFE

SEQ ID NO: 3036726 - protein, 11 aa, Entamoeba invadens
RQSKEINKETI

SEQ ID NO: 3036727 - protein, 7 aa, Entamoeba invadens
RQSRLSK

SEQ ID NO: 3036728 - protein, 12 aa, Entamoeba invadens
RRAGPSRKRRHH

SEQ ID NO: 3036729 - protein, 7 aa, Entamoeba invadens
RRAKESL

SEQ ID NO: 3036730 - protein, 20 aa, Entamoeba invadens
RRAPKTVQEEKVQKKKICTL

SEQ ID NO: 3036731 - protein, 8 aa, Entamoeba invadens
RRAPTDKL

SEQ ID NO: 3036732 - protein, 7 aa, Entamoeba invadens
RRGSHEK

SEQ ID NO: 3036733 - protein, 7 aa, Entamoeba invadens
RRGSYEN

SEQ ID NO: 3036734 - protein, 19 aa, Entamoeba invadens
RRHRKELKHEEEMKNVIID

SEQ ID NO: 3036735 - protein, 12 aa, Entamoeba invadens
RRKAERKARKVE

SEQ ID NO: 3036736 - protein, 10 aa, Entamoeba invadens
RRKKEKNAEM

SEQ ID NO: 3036737 - protein, 12 aa, Entamoeba invadens
RRKTQKTKDKTE

SEQ ID NO: 3036738 - protein, 9 aa, Entamoeba invadens
RRKYTDNQC

SEQ ID NO: 3036739 - protein, 18 aa, Entamoeba invadens
RRLQRNKKIAETRQREEG

SEQ ID NO: 3036740 - protein, 12 aa, Entamoeba invadens
RRLTATKKKIEE

SEQ ID NO: 3036741 - protein, 7 aa, Entamoeba invadens
RRNEKQL

SEQ ID NO: 3036742 - protein, 6 aa, Entamoeba invadens
RRNPQI

SEQ ID NO: 3036743 - protein, 85 aa, Entamoeba invadens
RRRRRKEREERERRAREAREAQQRAWQQQQENIRRAQEEARRRQQEHQRRQAERRRREEAERRRRHEAARRKKEEERKRKLAARN

SEQ ID NO: 3036744 - protein, 8 aa, Entamoeba invadens
RRSAAQDE

SEQ ID NO: 3036745 - protein, 10 aa, Entamoeba invadens
RRTKKSRELN

SEQ ID NO: 3036746 - protein, 5 aa, Entamoeba invadens
RRVGL

SEQ ID NO: 3036747 - protein, 12 aa, Entamoeba invadens
RSADETKSTVAQ

SEQ ID NO: 3036748 - protein, 18 aa, Entamoeba invadens
RSAIEKRYKTEIDTMFNL

SEQ ID NO: 3036749 - protein, 23 aa, Entamoeba invadens
RSAPESLDLRTSNKVTPIRDQAQ

SEQ ID NO: 3036750 - protein, 13 aa, Entamoeba invadens
RSDQNEITKECEE

SEQ ID NO: 3036751 - protein, 21 aa, Entamoeba invadens
RSEDRYFKGQDEDKSDLEREL

SEQ ID NO: 3036752 - protein, 6 aa, Entamoeba invadens
RSEGTC

SEQ ID NO: 3036753 - protein, 7 aa, Entamoeba invadens
RSENCGT

SEQ ID NO: 3036754 - protein, 5 aa, Entamoeba invadens
RSERT

SEQ ID NO: 3036755 - protein, 8 aa, Entamoeba invadens
RSESEDTL

SEQ ID NO: 3036756 - protein, 6 aa, Entamoeba invadens
RSEVSP

SEQ ID NO: 3036757 - protein, 5 aa, Entamoeba invadens
RSEVT

SEQ ID NO: 3036758 - protein, 15 aa, Entamoeba invadens
RSGKLAGIEEAKKAE

SEQ ID NO: 3036759 - protein, 4 aa, Entamoeba invadens
RSGS

SEQ ID NO: 3036760 - protein, 6 aa, Entamoeba invadens
RSGSAE

SEQ ID NO: 3036761 - protein, 8 aa, Entamoeba invadens
RSHKNSVK

SEQ ID NO: 3036762 - protein, 4 aa, Entamoeba invadens
RSIY

SEQ ID NO: 3036763 - protein, 6 aa, Entamoeba invadens
RSKEVS

SEQ ID NO: 3036764 - protein, 8 aa, Entamoeba invadens
RSKSSENL

SEQ ID NO: 3036765 - protein, 28 aa, Entamoeba invadens
RSLPQPHPFDERPPSFRSRGRGQTRRQR

SEQ ID NO: 3036766 - protein, 7 aa, Entamoeba invadens
RSPAADG

SEQ ID NO: 3036767 - protein, 16 aa, Entamoeba invadens
RSPERPLDRETGVKRR

SEQ ID NO: 3036768 - protein, 6 aa, Entamoeba invadens
RSPREV

SEQ ID NO: 3036769 - protein, 19 aa, Entamoeba invadens
RSQDSRITRRRRTRSLSAT

SEQ ID NO: 3036770 - protein, 16 aa, Entamoeba invadens
RSQENASHNDINTKTE

SEQ ID NO: 3036771 - protein, 10 aa, Entamoeba invadens
RSQREKLTIT

SEQ ID NO: 3036772 - protein, 7 aa, Entamoeba invadens
RSSISTR

SEQ ID NO: 3036773 - protein, 6 aa, Entamoeba invadens
RSSMPN

SEQ ID NO: 3036774 - protein, 4 aa, Entamoeba invadens
RSSY

SEQ ID NO: 3036775 - protein, 11 aa, Entamoeba invadens
RSTADKVTQPF

SEQ ID NO: 3036776 - protein, 5 aa, Entamoeba invadens
RSTIS

SEQ ID NO: 3036777 - protein, 6 aa, Entamoeba invadens
RSYENK

SEQ ID NO: 3036778 - protein, 27 aa, Entamoeba invadens
RTAPKTQNATQTVQNNKKEEKKVKKTI

SEQ ID NO: 3036779 - protein, 6 aa, Entamoeba invadens
RTDKIE

SEQ ID NO: 3036780 - protein, 4 aa, Entamoeba invadens
RTDT

SEQ ID NO: 3036781 - protein, 7 aa, Entamoeba invadens
RTEGQNS

SEQ ID NO: 3036782 - protein, 6 aa, Entamoeba invadens
RTEKSV

SEQ ID NO: 3036783 - protein, 10 aa, Entamoeba invadens
RTGGNGFQSY

SEQ ID NO: 3036784 - protein, 7 aa, Entamoeba invadens
RTGITPY

SEQ ID NO: 3036785 - protein, 7 aa, Entamoeba invadens
RTGNEEV

SEQ ID NO: 3036786 - protein, 7 aa, Entamoeba invadens
RTLRRQT

SEQ ID NO: 3036787 - protein, 8 aa, Entamoeba invadens
RTNPTTGY

SEQ ID NO: 3036788 - protein, 8 aa, Entamoeba invadens
RTPRLSSP

SEQ ID NO: 3036789 - protein, 15 aa, Entamoeba invadens
RTPTQNTRNPNTSYP

SEQ ID NO: 3036790 - protein, 4 aa, Entamoeba invadens
RTPW

SEQ ID NO: 3036791 - protein, 7 aa, Entamoeba invadens
RTPYTQE

SEQ ID NO: 3036792 - protein, 13 aa, Entamoeba invadens
RTQTSLSSESDTI

SEQ ID NO: 3036793 - protein, 21 aa, Entamoeba invadens
RTQTYPSSIVAGSDKGFGVGD

SEQ ID NO: 3036794 - protein, 7 aa, Entamoeba invadens
RTRSTEK

SEQ ID NO: 3036795 - protein, 4 aa, Entamoeba invadens
RTSH

SEQ ID NO: 3036796 - protein, 6 aa, Entamoeba invadens
RTSPKN

SEQ ID NO: 3036797 - protein, 7 aa, Entamoeba invadens
RTTQSSN

SEQ ID NO: 3036798 - protein, 5 aa, Entamoeba invadens
RVDPS

SEQ ID NO: 3036799 - protein, 4 aa, Entamoeba invadens
RVES

SEQ ID NO: 3036800 - protein, 7 aa, Entamoeba invadens
RVQSTSN

SEQ ID NO: 3036801 - protein, 13 aa, Entamoeba invadens
RVTKTSASSLRGF

SEQ ID NO: 3036802 - protein, 10 aa, Entamoeba invadens
RYDKKKEEKE

SEQ ID NO: 3036803 - protein, 4 aa, Entamoeba invadens
RYEA

SEQ ID NO: 3036804 - protein, 5 aa, Entamoeba invadens
RYEKK

SEQ ID NO: 3036805 - protein, 7 aa, Entamoeba invadens
RYGANPT

SEQ ID NO: 3036806 - protein, 10 aa, Entamoeba invadens
RYGEKTGTCN

SEQ ID NO: 3036807 - protein, 6 aa, Entamoeba invadens
RYHDGY

SEQ ID NO: 3036808 - protein, 6 aa, Entamoeba invadens
RYHGRN

SEQ ID NO: 3036809 - protein, 11 aa, Entamoeba invadens
RYKTQDSIKKI

SEQ ID NO: 3036810 - protein, 7 aa, Entamoeba invadens
RYNRKKQ

SEQ ID NO: 3036811 - protein, 16 aa, Entamoeba invadens
RYPGVERSQTQQREEN

SEQ ID NO: 3036812 - protein, 6 aa, Entamoeba invadens
RYPQDS

SEQ ID NO: 3036813 - protein, 5 aa, Entamoeba invadens
RYSDE

SEQ ID NO: 3036814 - protein, 5 aa, Entamoeba invadens
RYVGK

SEQ ID NO: 3036815 - protein, 5 aa, Entamoeba invadens
SAANG

SEQ ID NO: 3036816 - protein, 5 aa, Entamoeba invadens
SAAQG

SEQ ID NO: 3036817 - protein, 9 aa, Entamoeba invadens
SAASSTANK

SEQ ID NO: 3036818 - protein, 10 aa, Entamoeba invadens
SACNGTGENN

SEQ ID NO: 3036819 - protein, 12 aa, Entamoeba invadens
SADKVASPERDR

SEQ ID NO: 3036820 - protein, 6 aa, Entamoeba invadens
SAEAKV

SEQ ID NO: 3036821 - protein, 7 aa, Entamoeba invadens
SAEDGYV

SEQ ID NO: 3036822 - protein, 6 aa, Entamoeba invadens
SAFEDC

SEQ ID NO: 3036823 - protein, 17 aa, Entamoeba invadens
SAFNKGDRINIRISFQG

SEQ ID NO: 3036824 - protein, 7 aa, Entamoeba invadens
SAGCTSQ

SEQ ID NO: 3036825 - protein, 22 aa, Entamoeba invadens
SAGGASSCTKCSAGYSSGTGAS

SEQ ID NO: 3036826 - protein, 19 aa, Entamoeba invadens
SAGTAGYHSGDQPDSRMRA

SEQ ID NO: 3036827 - protein, 5 aa, Entamoeba invadens
SAGYG

SEQ ID NO: 3036828 - protein, 9 aa, Entamoeba invadens
SAHENAVAD

SEQ ID NO: 3036829 - protein, 14 aa, Entamoeba invadens
SAIESEEKFTPDSN

SEQ ID NO: 3036830 - protein, 5 aa, Entamoeba invadens
SAKER

SEQ ID NO: 3036831 - protein, 12 aa, Entamoeba invadens
SAKKDKVTELPE

SEQ ID NO: 3036832 - protein, 8 aa, Entamoeba invadens
SAKNATNV

SEQ ID NO: 3036833 - protein, 6 aa, Entamoeba invadens
SAKNEN

SEQ ID NO: 3036834 - protein, 6 aa, Entamoeba invadens
SALPTE

SEQ ID NO: 3036835 - protein, 11 aa, Entamoeba invadens
SANRQVPVEEA

SEQ ID NO: 3036836 - protein, 11 aa, Entamoeba invadens
SANRSPSTNCQ

SEQ ID NO: 3036837 - protein, 5 aa, Entamoeba invadens
SAQIS

SEQ ID NO: 3036838 - protein, 8 aa, Entamoeba invadens
SAQSTSLD

SEQ ID NO: 3036839 - protein, 9 aa, Entamoeba invadens
SASGEKRGI

SEQ ID NO: 3036840 - protein, 9 aa, Entamoeba invadens
SASKVRNEN

SEQ ID NO: 3036841 - protein, 7 aa, Entamoeba invadens
SASPAQI

SEQ ID NO: 3036842 - protein, 13 aa, Entamoeba invadens
SASPERLEVTSQA

SEQ ID NO: 3036843 - protein, 7 aa, Entamoeba invadens
SASSEGL

SEQ ID NO: 3036844 - protein, 7 aa, Entamoeba invadens
SATFQGD

SEQ ID NO: 3036845 - protein, 7 aa, Entamoeba invadens
SATGGIE

SEQ ID NO: 3036846 - protein, 7 aa, Entamoeba invadens
SATQQTV

SEQ ID NO: 3036847 - protein, 14 aa, Entamoeba invadens
SATSGSFSGISPSS

SEQ ID NO: 3036848 - protein, 11 aa, Entamoeba invadens
SATSNSQTSRV

SEQ ID NO: 3036849 - protein, 6 aa, Entamoeba invadens
SATYTT

SEQ ID NO: 3036850 - protein, 14 aa, Entamoeba invadens
SAVAGKNKKAQKQL

SEQ ID NO: 3036851 - protein, 7 aa, Entamoeba invadens
SAVEKTK

SEQ ID NO: 3036852 - protein, 10 aa, Entamoeba invadens
SAVGTKKDQI

SEQ ID NO: 3036853 - protein, 14 aa, Entamoeba invadens
SAVTESQRGQRKNC

SEQ ID NO: 3036854 - protein, 9 aa, Entamoeba invadens
SCATSSTES

SEQ ID NO: 3036855 - protein, 9 aa, Entamoeba invadens
SCDGNQYID

SEQ ID NO: 3036856 - protein, 23 aa, Entamoeba invadens
SCDNTYDCENTECTVDNTSLDVG

SEQ ID NO: 3036857 - protein, 6 aa, Entamoeba invadens
SCDTTD

SEQ ID NO: 3036858 - protein, 14 aa, Entamoeba invadens
SCEKGINSTQKVSV

SEQ ID NO: 3036859 - protein, 7 aa, Entamoeba invadens
SCGPNEI

SEQ ID NO: 3036860 - protein, 10 aa, Entamoeba invadens
SCGRDNANAQ

SEQ ID NO: 3036861 - protein, 13 aa, Entamoeba invadens
SCISPKGFEANDK

SEQ ID NO: 3036862 - protein, 5 aa, Entamoeba invadens
SCKEC

SEQ ID NO: 3036863 - protein, 13 aa, Entamoeba invadens
SCKPPMSLTNSGE

SEQ ID NO: 3036864 - protein, 11 aa, Entamoeba invadens
SCKSNPEARDD

SEQ ID NO: 3036865 - protein, 12 aa, Entamoeba invadens
SCMPPGDATTST

SEQ ID NO: 3036866 - protein, 12 aa, Entamoeba invadens
SCMPPGDCTTST

SEQ ID NO: 3036867 - protein, 12 aa, Entamoeba invadens
SCMPPKDCTTST

SEQ ID NO: 3036868 - protein, 8 aa, Entamoeba invadens
SCNQSSNC

SEQ ID NO: 3036869 - protein, 10 aa, Entamoeba invadens
SCNSDDPAAC

SEQ ID NO: 3036870 - protein, 9 aa, Entamoeba invadens
SCNSGSDKC

SEQ ID NO: 3036871 - protein, 12 aa, Entamoeba invadens
SCNTCNDSGPNN

SEQ ID NO: 3036872 - protein, 4 aa, Entamoeba invadens
SCPE

SEQ ID NO: 3036873 - protein, 15 aa, Entamoeba invadens
SCPSGSYKNTETSCG

SEQ ID NO: 3036874 - protein, 5 aa, Entamoeba invadens
SCPSN

SEQ ID NO: 3036875 - protein, 7 aa, Entamoeba invadens
SCQNGCD

SEQ ID NO: 3036876 - protein, 9 aa, Entamoeba invadens
SCRTCNGIN

SEQ ID NO: 3036877 - protein, 13 aa, Entamoeba invadens
SCRTCNGSGPNNC

SEQ ID NO: 3036878 - protein, 11 aa, Entamoeba invadens
SCSSCDANGYC

SEQ ID NO: 3036879 - protein, 5 aa, Entamoeba invadens
SCSSY

SEQ ID NO: 3036880 - protein, 10 aa, Entamoeba invadens
SCSTCDPNNL

SEQ ID NO: 3036881 - protein, 12 aa, Entamoeba invadens
SCTDDTKASPEY

SEQ ID NO: 3036882 - protein, 5 aa, Entamoeba invadens
SCTKE

SEQ ID NO: 3036883 - protein, 14 aa, Entamoeba invadens
SCTNCNGGANKCNG

SEQ ID NO: 3036884 - protein, 13 aa, Entamoeba invadens
SCTNYYQGATSSV

SEQ ID NO: 3036885 - protein, 7 aa, Entamoeba invadens
SCTTTSC

SEQ ID NO: 3036886 - protein, 4 aa, Entamoeba invadens
SCTV

SEQ ID NO: 3036887 - protein, 6 aa, Entamoeba invadens
SDAAKG

SEQ ID NO: 3036888 - protein, 8 aa, Entamoeba invadens
SDACTYDA

SEQ ID NO: 3036889 - protein, 5 aa, Entamoeba invadens
SDAEI

SEQ ID NO: 3036890 - protein, 4 aa, Entamoeba invadens
SDAK

SEQ ID NO: 3036891 - protein, 42 aa, Entamoeba invadens
SDASTCSQCSSGSYKDENSKCKSCTSKCAADKCANDKCTECP

SEQ ID NO: 3036892 - protein, 5 aa, Entamoeba invadens
SDCLS

SEQ ID NO: 3036893 - protein, 8 aa, Entamoeba invadens
SDCTGISQ

SEQ ID NO: 3036894 - protein, 7 aa, Entamoeba invadens
SDDAEEF

SEQ ID NO: 3036895 - protein, 9 aa, Entamoeba invadens
SDDGCGAVG

SEQ ID NO: 3036896 - protein, 17 aa, Entamoeba invadens
SDDGNNLACYDVKFSLT

SEQ ID NO: 3036897 - protein, 7 aa, Entamoeba invadens
SDDGTVK

SEQ ID NO: 3036898 - protein, 16 aa, Entamoeba invadens
SDDKYYSDDSTTTSHK

SEQ ID NO: 3036899 - protein, 8 aa, Entamoeba invadens
SDEDSTLR

SEQ ID NO: 3036900 - protein, 4 aa, Entamoeba invadens
SDEV

SEQ ID NO: 3036901 - protein, 6 aa, Entamoeba invadens
SDGTIN

SEQ ID NO: 3036902 - protein, 5 aa, Entamoeba invadens
SDGTT

SEQ ID NO: 3036903 - protein, 5 aa, Entamoeba invadens
SDKKC

SEQ ID NO: 3036904 - protein, 30 aa, Entamoeba invadens
SDKKSQQKLKNAANATGHPEWGHNPTNAGY

SEQ ID NO: 3036905 - protein, 6 aa, Entamoeba invadens
SDKPDF

SEQ ID NO: 3036906 - protein, 6 aa, Entamoeba invadens
SDMKES

SEQ ID NO: 3036907 - protein, 7 aa, Entamoeba invadens
SDNESAI

SEQ ID NO: 3036908 - protein, 8 aa, Entamoeba invadens
SDNGHEGD

SEQ ID NO: 3036909 - protein, 8 aa, Entamoeba invadens
SDNNPSFS

SEQ ID NO: 3036910 - protein, 6 aa, Entamoeba invadens
SDNSDY

SEQ ID NO: 3036911 - protein, 21 aa, Entamoeba invadens
SDPDLKSNRAFKNLKQKISKI

SEQ ID NO: 3036912 - protein, 7 aa, Entamoeba invadens
SDPLSKT

SEQ ID NO: 3036913 - protein, 4 aa, Entamoeba invadens
SDPN

SEQ ID NO: 3036914 - protein, 14 aa, Entamoeba invadens
SDPTEDSKQGHEGD

SEQ ID NO: 3036915 - protein, 8 aa, Entamoeba invadens
SDQKVDSA

SEQ ID NO: 3036916 - protein, 10 aa, Entamoeba invadens
SDRGNTGNTI

SEQ ID NO: 3036917 - protein, 5 aa, Entamoeba invadens
SDRNN

SEQ ID NO: 3036918 - protein, 8 aa, Entamoeba invadens
SDSGHEDM

SEQ ID NO: 3036919 - protein, 10 aa, Entamoeba invadens
SDSKLSRVDE

SEQ ID NO: 3036920 - protein, 6 aa, Entamoeba invadens
SDSPRF

SEQ ID NO: 3036921 - protein, 8 aa, Entamoeba invadens
SDSVLSGK

SEQ ID NO: 3036922 - protein, 5 aa, Entamoeba invadens
SDTGF

SEQ ID NO: 3036923 - protein, 11 aa, Entamoeba invadens
SDTIKRYKENV

SEQ ID NO: 3036924 - protein, 7 aa, Entamoeba invadens
SDTKSQK

SEQ ID NO: 3036925 - protein, 6 aa, Entamoeba invadens
SDTTMS

SEQ ID NO: 3036926 - protein, 10 aa, Entamoeba invadens
SDTTTAVPHE

SEQ ID NO: 3036927 - protein, 6 aa, Entamoeba invadens
SDVDNL

SEQ ID NO: 3036928 - protein, 15 aa, Entamoeba invadens
SDVNAQNEDTGSTQL

SEQ ID NO: 3036929 - protein, 5 aa, Entamoeba invadens
SDWID

SEQ ID NO: 3036930 - protein, 19 aa, Entamoeba invadens
SDYDGKSSFSYADGDGTVN

SEQ ID NO: 3036931 - protein, 9 aa, Entamoeba invadens
SDYNGERKY

SEQ ID NO: 3036932 - protein, 9 aa, Entamoeba invadens
SDYQDDSIE

SEQ ID NO: 3036933 - protein, 14 aa, Entamoeba invadens
SEACSKCNSGKTVL

SEQ ID NO: 3036934 - protein, 10 aa, Entamoeba invadens
SEAQSSGKAE

SEQ ID NO: 3036935 - protein, 6 aa, Entamoeba invadens
SEAVFE

SEQ ID NO: 3036936 - protein, 6 aa, Entamoeba invadens
SECDQT

SEQ ID NO: 3036937 - protein, 11 aa, Entamoeba invadens
SECESGQKRVG

SEQ ID NO: 3036938 - protein, 10 aa, Entamoeba invadens
SECGSGRSTY

SEQ ID NO: 3036939 - protein, 8 aa, Entamoeba invadens
SECKRGNI

SEQ ID NO: 3036940 - protein, 9 aa, Entamoeba invadens
SECSDNSFN

SEQ ID NO: 3036941 - protein, 6 aa, Entamoeba invadens
SECTTV

SEQ ID NO: 3036942 - protein, 6 aa, Entamoeba invadens
SEDELS

SEQ ID NO: 3036943 - protein, 4 aa, Entamoeba invadens
SEDQ

SEQ ID NO: 3036944 - protein, 8 aa, Entamoeba invadens
SEDRERNR

SEQ ID NO: 3036945 - protein, 7 aa, Entamoeba invadens
SEDSDVD

SEQ ID NO: 3036946 - protein, 4 aa, Entamoeba invadens
SEDV

SEQ ID NO: 3036947 - protein, 6 aa, Entamoeba invadens
SEEEVP

SEQ ID NO: 3036948 - protein, 14 aa, Entamoeba invadens
SEEFPNQCKEETKY

SEQ ID NO: 3036949 - protein, 7 aa, Entamoeba invadens
SEEKTEF

SEQ ID NO: 3036950 - protein, 5 aa, Entamoeba invadens
SEESL

SEQ ID NO: 3036951 - protein, 5 aa, Entamoeba invadens
SEFTP

SEQ ID NO: 3036952 - protein, 4 aa, Entamoeba invadens
SEGD

SEQ ID NO: 3036953 - protein, 13 aa, Entamoeba invadens
SEGKRLEKKENMN

SEQ ID NO: 3036954 - protein, 15 aa, Entamoeba invadens
SEHDLNQKTKEKTEK

SEQ ID NO: 3036955 - protein, 20 aa, Entamoeba invadens
SEIAASKMNKEVDKKGGDIL

SEQ ID NO: 3036956 - protein, 12 aa, Entamoeba invadens
SEIIPTNSTIGE

SEQ ID NO: 3036957 - protein, 5 aa, Entamoeba invadens
SEITS

SEQ ID NO: 3036958 - protein, 8 aa, Entamoeba invadens
SEKEYQKV

SEQ ID NO: 3036959 - protein, 30 aa, Entamoeba invadens
SEKLKYEKKVEKVTKQKDNETLLKQQSEEK

SEQ ID NO: 3036960 - protein, 9 aa, Entamoeba invadens
SEKPIAEGA

SEQ ID NO: 3036961 - protein, 6 aa, Entamoeba invadens
SEKTPC

SEQ ID NO: 3036962 - protein, 21 aa, Entamoeba invadens
SELDTQLNSSKNSVEQKREIG

SEQ ID NO: 3036963 - protein, 19 aa, Entamoeba invadens
SELNSQIQKANISKISSQL

SEQ ID NO: 3036964 - protein, 4 aa, Entamoeba invadens
SELS

SEQ ID NO: 3036965 - protein, 37 aa, Entamoeba invadens
SELTREEEAIEERERYDQEHDIPSKKHKRYKKSGLSH

SEQ ID NO: 3036966 - protein, 19 aa, Entamoeba invadens
SEMGSSARTSLKEGEQTPL

SEQ ID NO: 3036967 - protein, 4 aa, Entamoeba invadens
SEMS

SEQ ID NO: 3036968 - protein, 7 aa, Entamoeba invadens
SENAKRN

SEQ ID NO: 3036969 - protein, 5 aa, Entamoeba invadens
SENCQ

SEQ ID NO: 3036970 - protein, 6 aa, Entamoeba invadens
SENEPD

SEQ ID NO: 3036971 - protein, 7 aa, Entamoeba invadens
SENETRV

SEQ ID NO: 3036972 - protein, 9 aa, Entamoeba invadens
SENPIAEGA

SEQ ID NO: 3036973 - protein, 8 aa, Entamoeba invadens
SENPVSPR

SEQ ID NO: 3036974 - protein, 5 aa, Entamoeba invadens
SENPY

SEQ ID NO: 3036975 - protein, 6 aa, Entamoeba invadens
SENQID

SEQ ID NO: 3036976 - protein, 7 aa, Entamoeba invadens
SENSTCK

SEQ ID NO: 3036977 - protein, 17 aa, Entamoeba invadens
SENTKIGTPRYSAPETF

SEQ ID NO: 3036978 - protein, 6 aa, Entamoeba invadens
SENTNK

SEQ ID NO: 3036979 - protein, 5 aa, Entamoeba invadens
SENTT

SEQ ID NO: 3036980 - protein, 7 aa, Entamoeba invadens
SENYTSS

SEQ ID NO: 3036981 - protein, 8 aa, Entamoeba invadens
SEPSSYYS

SEQ ID NO: 3036982 - protein, 5 aa, Entamoeba invadens
SEQEN

SEQ ID NO: 3036983 - protein, 6 aa, Entamoeba invadens
SEQKYT

SEQ ID NO: 3036984 - protein, 5 aa, Entamoeba invadens
SERER

SEQ ID NO: 3036985 - protein, 11 aa, Entamoeba invadens
SERSANRKNQV

SEQ ID NO: 3036986 - protein, 17 aa, Entamoeba invadens
SERVAQPTQNSVNSKFS

SEQ ID NO: 3036987 - protein, 12 aa, Entamoeba invadens
SESARCQLGTEN

SEQ ID NO: 3036988 - protein, 7 aa, Entamoeba invadens
SESDRVK

SEQ ID NO: 3036989 - protein, 9 aa, Entamoeba invadens
SESGEASQV

SEQ ID NO: 3036990 - protein, 7 aa, Entamoeba invadens
SESGWCE

SEQ ID NO: 3036991 - protein, 7 aa, Entamoeba invadens
SESQDTL

SEQ ID NO: 3036992 - protein, 5 aa, Entamoeba invadens
SESTC

SEQ ID NO: 3036993 - protein, 10 aa, Entamoeba invadens
SESTSRLKKI

SEQ ID NO: 3036994 - protein, 27 aa, Entamoeba invadens
SETEEDPVQLNTQRTETAAFIDELIKR

SEQ ID NO: 3036995 - protein, 8 aa, Entamoeba invadens
SETENGFQ

SEQ ID NO: 3036996 - protein, 9 aa, Entamoeba invadens
SETENGFQQ

SEQ ID NO: 3036997 - protein, 13 aa, Entamoeba invadens
SETGASTQSAGRL

SEQ ID NO: 3036998 - protein, 4 aa, Entamoeba invadens
SETN

SEQ ID NO: 3036999 - protein, 7 aa, Entamoeba invadens
SETSDKL

SEQ ID NO: 3037000 - protein, 9 aa, Entamoeba invadens
SETTNEIKN

SEQ ID NO: 3037001 - protein, 6 aa, Entamoeba invadens
SEVEHQ

SEQ ID NO: 3037002 - protein, 4 aa, Entamoeba invadens
SEVP

SEQ ID NO: 3037003 - protein, 11 aa, Entamoeba invadens
SEYEKIKKDNE

SEQ ID NO: 3037004 - protein, 6 aa, Entamoeba invadens
SEYENA

SEQ ID NO: 3037005 - protein, 7 aa, Entamoeba invadens
SEYGRSR

SEQ ID NO: 3037006 - protein, 11 aa, Entamoeba invadens
SEYQETDPANE

SEQ ID NO: 3037007 - protein, 6 aa, Entamoeba invadens
SEYTFK

SEQ ID NO: 3037008 - protein, 6 aa, Entamoeba invadens
SEYTNP

SEQ ID NO: 3037009 - protein, 7 aa, Entamoeba invadens
SFDGDNN

SEQ ID NO: 3037010 - protein, 5 aa, Entamoeba invadens
SFDNV

SEQ ID NO: 3037011 - protein, 9 aa, Entamoeba invadens
SFDTEENDG

SEQ ID NO: 3037012 - protein, 5 aa, Entamoeba invadens
SFEEY

SEQ ID NO: 3037013 - protein, 7 aa, Entamoeba invadens
SFEFDSN

SEQ ID NO: 3037014 - protein, 4 aa, Entamoeba invadens
SFER

SEQ ID NO: 3037015 - protein, 17 aa, Entamoeba invadens
SFGNGENEEHCNKPSTV

SEQ ID NO: 3037016 - protein, 11 aa, Entamoeba invadens
SFNETTINNTA

SEQ ID NO: 3037017 - protein, 8 aa, Entamoeba invadens
SFNGPQAR

SEQ ID NO: 3037018 - protein, 10 aa, Entamoeba invadens
SFNNQRMPKD

SEQ ID NO: 3037019 - protein, 18 aa, Entamoeba invadens
SFPKATKTGIAYEGNREV

SEQ ID NO: 3037020 - protein, 10 aa, Entamoeba invadens
SFQTNTKSDE

SEQ ID NO: 3037021 - protein, 4 aa, Entamoeba invadens
SFYQ

SEQ ID NO: 3037022 - protein, 22 aa, Entamoeba invadens
SGACTSCQSGLKDISNGSGNNC

SEQ ID NO: 3037023 - protein, 8 aa, Entamoeba invadens
SGAGCTGT

SEQ ID NO: 3037024 - protein, 5 aa, Entamoeba invadens
SGAND

SEQ ID NO: 3037025 - protein, 12 aa, Entamoeba invadens
SGASPVYSNNPG

SEQ ID NO: 3037026 - protein, 11 aa, Entamoeba invadens
SGAVKTVGGIA

SEQ ID NO: 3037027 - protein, 24 aa, Entamoeba invadens
SGAYSRKYYTDADCQTAGSTPVEN

SEQ ID NO: 3037028 - protein, 5 aa, Entamoeba invadens
SGCAS

SEQ ID NO: 3037029 - protein, 6 aa, Entamoeba invadens
SGCGPT

SEQ ID NO: 3037030 - protein, 14 aa, Entamoeba invadens
SGDAGTHAKITRDC

SEQ ID NO: 3037031 - protein, 14 aa, Entamoeba invadens
SGDTHLGGSDFDQR

SEQ ID NO: 3037032 - protein, 4 aa, Entamoeba invadens
SGDV

SEQ ID NO: 3037033 - protein, 24 aa, Entamoeba invadens
SGDVAGSKGTAGTCKQCKNDYTNY

SEQ ID NO: 3037034 - protein, 13 aa, Entamoeba invadens
SGEDSNCGSAPAA

SEQ ID NO: 3037035 - protein, 26 aa, Entamoeba invadens
SGFPSRVENTGSNNGYKIGDSRVNYG

SEQ ID NO: 3037036 - protein, 5 aa, Entamoeba invadens
SGFST

SEQ ID NO: 3037037 - protein, 7 aa, Entamoeba invadens
SGGGNDI

SEQ ID NO: 3037038 - protein, 6 aa, Entamoeba invadens
SGHPKS

SEQ ID NO: 3037039 - protein, 50 aa, Entamoeba invadens
SGHPTKTAKPAPKSVTKTTAKHPTTTKPAISKPQTTTSPRKYTTTGSRAN

SEQ ID NO: 3037040 - protein, 17 aa, Entamoeba invadens
SGIDVEKRRTKQARKTL

SEQ ID NO: 3037041 - protein, 5 aa, Entamoeba invadens
SGISP

SEQ ID NO: 3037042 - protein, 10 aa, Entamoeba invadens
SGKASVEYTE

SEQ ID NO: 3037043 - protein, 4 aa, Entamoeba invadens
SGKE

SEQ ID NO: 3037044 - protein, 7 aa, Entamoeba invadens
SGKFTEN

SEQ ID NO: 3037045 - protein, 6 aa, Entamoeba invadens
SGKIRT

SEQ ID NO: 3037046 - protein, 6 aa, Entamoeba invadens
SGKKIT

SEQ ID NO: 3037047 - protein, 10 aa, Entamoeba invadens
SGKNSIDYPG

SEQ ID NO: 3037048 - protein, 12 aa, Entamoeba invadens
SGKRFDNTQNIS

SEQ ID NO: 3037049 - protein, 5 aa, Entamoeba invadens
SGKRL

SEQ ID NO: 3037050 - protein, 5 aa, Entamoeba invadens
SGLPD

SEQ ID NO: 3037051 - protein, 14 aa, Entamoeba invadens
SGNEQLKKVSRQNP

SEQ ID NO: 3037052 - protein, 7 aa, Entamoeba invadens
SGNGLNV

SEQ ID NO: 3037053 - protein, 5 aa, Entamoeba invadens
SGNLP

SEQ ID NO: 3037054 - protein, 6 aa, Entamoeba invadens
SGNRYD

SEQ ID NO: 3037055 - protein, 9 aa, Entamoeba invadens
SGNYPPQHV

SEQ ID NO: 3037056 - protein, 9 aa, Entamoeba invadens
SGPETSAVK

SEQ ID NO: 3037057 - protein, 4 aa, Entamoeba invadens
SGPF

SEQ ID NO: 3037058 - protein, 10 aa, Entamoeba invadens
SGPTHQEQTP

SEQ ID NO: 3037059 - protein, 6 aa, Entamoeba invadens
SGPVKQ

SEQ ID NO: 3037060 - protein, 7 aa, Entamoeba invadens
SGRVGQY

SEQ ID NO: 3037061 - protein, 7 aa, Entamoeba invadens
SGSCTRC

SEQ ID NO: 3037062 - protein, 8 aa, Entamoeba invadens
SGSFDPWS

SEQ ID NO: 3037063 - protein, 22 aa, Entamoeba invadens
SGSNLKAKKVDDFNKNLNVLEA

SEQ ID NO: 3037064 - protein, 16 aa, Entamoeba invadens
SGSSTVPTATTYNGNT

SEQ ID NO: 3037065 - protein, 10 aa, Entamoeba invadens
SGTAKEPKGV

SEQ ID NO: 3037066 - protein, 4 aa, Entamoeba invadens
SGTI

SEQ ID NO: 3037067 - protein, 11 aa, Entamoeba invadens
SGTISNNCNEC

SEQ ID NO: 3037068 - protein, 4 aa, Entamoeba invadens
SGTL

SEQ ID NO: 3037069 - protein, 10 aa, Entamoeba invadens
SGTSKEPKGI

SEQ ID NO: 3037070 - protein, 13 aa, Entamoeba invadens
SGTSNSPKGVTVN

SEQ ID NO: 3037071 - protein, 10 aa, Entamoeba invadens
SGTTKNPKGV

SEQ ID NO: 3037072 - protein, 11 aa, Entamoeba invadens
SGTTKSPKGVL

SEQ ID NO: 3037073 - protein, 10 aa, Entamoeba invadens
SGTTRNPKGV

SEQ ID NO: 3037074 - protein, 4 aa, Entamoeba invadens
SGVE

SEQ ID NO: 3037075 - protein, 10 aa, Entamoeba invadens
SGVKQKGCAT

SEQ ID NO: 3037076 - protein, 10 aa, Entamoeba invadens
SGVPDSTIKS

SEQ ID NO: 3037077 - protein, 7 aa, Entamoeba invadens
SGVPECT

SEQ ID NO: 3037078 - protein, 9 aa, Entamoeba invadens
SGVSTPQTI

SEQ ID NO: 3037079 - protein, 5 aa, Entamoeba invadens
SGWTE

SEQ ID NO: 3037080 - protein, 8 aa, Entamoeba invadens
SGWYEKGS

SEQ ID NO: 3037081 - protein, 23 aa, Entamoeba invadens
SGYTEREKDYGERYSYTKSPRRR

SEQ ID NO: 3037082 - protein, 11 aa, Entamoeba invadens
SGYYKSNNGEC

SEQ ID NO: 3037083 - protein, 7 aa, Entamoeba invadens
SGYYPSN

SEQ ID NO: 3037084 - protein, 10 aa, Entamoeba invadens
SGYYPSSSTN

SEQ ID NO: 3037085 - protein, 14 aa, Entamoeba invadens
SHCQGCTNTSSYIK

SEQ ID NO: 3037086 - protein, 6 aa, Entamoeba invadens
SHDTTV

SEQ ID NO: 3037087 - protein, 4 aa, Entamoeba invadens
SHEA

SEQ ID NO: 3037088 - protein, 13 aa, Entamoeba invadens
SHEHSCEAEIKSD

SEQ ID NO: 3037089 - protein, 4 aa, Entamoeba invadens
SHEP

SEQ ID NO: 3037090 - protein, 11 aa, Entamoeba invadens
SHGKTSKVSSE

SEQ ID NO: 3037091 - protein, 15 aa, Entamoeba invadens
SHKDRKELEKKAEQR

SEQ ID NO: 3037092 - protein, 12 aa, Entamoeba invadens
SHKESVKDSEAF

SEQ ID NO: 3037093 - protein, 8 aa, Entamoeba invadens
SHKPNIKE

SEQ ID NO: 3037094 - protein, 25 aa, Entamoeba invadens
SHKPNTQESYVEPHTKEALKSFPES

SEQ ID NO: 3037095 - protein, 11 aa, Entamoeba invadens
SHNGENVTFSN

SEQ ID NO: 3037096 - protein, 9 aa, Entamoeba invadens
SHPPNSDRD

SEQ ID NO: 3037097 - protein, 126 aa, Entamoeba invadens
SHSNGSSSGSTTTTTSHASGSSSTSSSSTQTSTNTQSSTTQNTQNSSNGGNQETPSSTSSTTSSTSSSNSGATQSSPAISYTPSFTPSYTPSYTPTNTYTPTNTITPTITASPTNTVSSGTFTPTI

SEQ ID NO: 3037098 - protein, 10 aa, Entamoeba invadens
SHSQKGSKYG

SEQ ID NO: 3037099 - protein, 22 aa, Entamoeba invadens
SHSTTPNDQDNLSEKPSDREDE

SEQ ID NO: 3037100 - protein, 4 aa, Entamoeba invadens
SHTE

SEQ ID NO: 3037101 - protein, 6 aa, Entamoeba invadens
SHTNEI

SEQ ID NO: 3037102 - protein, 4 aa, Entamoeba invadens
SIAG

SEQ ID NO: 3037103 - protein, 12 aa, Entamoeba invadens
SIDKTQKKINKT

SEQ ID NO: 3037104 - protein, 6 aa, Entamoeba invadens
SIDNSN

SEQ ID NO: 3037105 - protein, 7 aa, Entamoeba invadens
SIDPDDF

SEQ ID NO: 3037106 - protein, 11 aa, Entamoeba invadens
SIEDSSQQIEN

SEQ ID NO: 3037107 - protein, 12 aa, Entamoeba invadens
SIEITPEPLNTS

SEQ ID NO: 3037108 - protein, 4 aa, Entamoeba invadens
SIEN

SEQ ID NO: 3037109 - protein, 5 aa, Entamoeba invadens
SIENE

SEQ ID NO: 3037110 - protein, 4 aa, Entamoeba invadens
SIEY

SEQ ID NO: 3037111 - protein, 5 aa, Entamoeba invadens
SIGSD

SEQ ID NO: 3037112 - protein, 6 aa, Entamoeba invadens
SIKDEP

SEQ ID NO: 3037113 - protein, 16 aa, Entamoeba invadens
SIKFDEDKDHGFVNIQ

SEQ ID NO: 3037114 - protein, 6 aa, Entamoeba invadens
SIKNQR

SEQ ID NO: 3037115 - protein, 6 aa, Entamoeba invadens
SINETR

SEQ ID NO: 3037116 - protein, 7 aa, Entamoeba invadens
SINPYDG

SEQ ID NO: 3037117 - protein, 5 aa, Entamoeba invadens
SIPDC

SEQ ID NO: 3037118 - protein, 5 aa, Entamoeba invadens
SIQDA

SEQ ID NO: 3037119 - protein, 4 aa, Entamoeba invadens
SIQQ

SEQ ID NO: 3037120 - protein, 5 aa, Entamoeba invadens
SISKS

SEQ ID NO: 3037121 - protein, 24 aa, Entamoeba invadens
SISSGSAKCTECAAGTRSEYTVSS

SEQ ID NO: 3037122 - protein, 16 aa, Entamoeba invadens
SITGLSSYSGRISSEI

SEQ ID NO: 3037123 - protein, 18 aa, Entamoeba invadens
SKAGIEKSLKKAKEAVKK

SEQ ID NO: 3037124 - protein, 8 aa, Entamoeba invadens
SKAIRDVK

SEQ ID NO: 3037125 - protein, 15 aa, Entamoeba invadens
SKAQSNNTTTFTKEE

SEQ ID NO: 3037126 - protein, 10 aa, Entamoeba invadens
SKATDTLTDA

SEQ ID NO: 3037127 - protein, 10 aa, Entamoeba invadens
SKCGGKGSIV

SEQ ID NO: 3037128 - protein, 5 aa, Entamoeba invadens
SKCGL

SEQ ID NO: 3037129 - protein, 8 aa, Entamoeba invadens
SKCGSDTI

SEQ ID NO: 3037130 - protein, 9 aa, Entamoeba invadens
SKCMESSKD

SEQ ID NO: 3037131 - protein, 13 aa, Entamoeba invadens
SKCSSSYDDDNSC

SEQ ID NO: 3037132 - protein, 15 aa, Entamoeba invadens
SKCSTSIDGKSNIEK

SEQ ID NO: 3037133 - protein, 9 aa, Entamoeba invadens
SKDFDNTKG

SEQ ID NO: 3037134 - protein, 5 aa, Entamoeba invadens
SKDGF

SEQ ID NO: 3037135 - protein, 6 aa, Entamoeba invadens
SKDKFS

SEQ ID NO: 3037136 - protein, 7 aa, Entamoeba invadens
SKDNCGS

SEQ ID NO: 3037137 - protein, 8 aa, Entamoeba invadens
SKDNQNEI

SEQ ID NO: 3037138 - protein, 7 aa, Entamoeba invadens
SKDSFES

SEQ ID NO: 3037139 - protein, 8 aa, Entamoeba invadens
SKDTGYQN

SEQ ID NO: 3037140 - protein, 4 aa, Entamoeba invadens
SKDY

SEQ ID NO: 3037141 - protein, 8 aa, Entamoeba invadens
SKDYNEKR

SEQ ID NO: 3037142 - protein, 7 aa, Entamoeba invadens
SKEATVF

SEQ ID NO: 3037143 - protein, 4 aa, Entamoeba invadens
SKEC

SEQ ID NO: 3037144 - protein, 4 aa, Entamoeba invadens
SKED

SEQ ID NO: 3037145 - protein, 6 aa, Entamoeba invadens
SKEKKV

SEQ ID NO: 3037146 - protein, 18 aa, Entamoeba invadens
SKEQGNNGCNGGLGKNAY

SEQ ID NO: 3037147 - protein, 8 aa, Entamoeba invadens
SKERNNDF

SEQ ID NO: 3037148 - protein, 8 aa, Entamoeba invadens
SKETAEDL

SEQ ID NO: 3037149 - protein, 5 aa, Entamoeba invadens
SKFDT

SEQ ID NO: 3037150 - protein, 6 aa, Entamoeba invadens
SKFGNN

SEQ ID NO: 3037151 - protein, 6 aa, Entamoeba invadens
SKFPKE

SEQ ID NO: 3037152 - protein, 7 aa, Entamoeba invadens
SKFTGKR

SEQ ID NO: 3037153 - protein, 17 aa, Entamoeba invadens
SKGERPAIELGDKEQKA

SEQ ID NO: 3037154 - protein, 9 aa, Entamoeba invadens
SKGVSEKQV

SEQ ID NO: 3037155 - protein, 17 aa, Entamoeba invadens
SKGYYKRPEEDKESFTQ

SEQ ID NO: 3037156 - protein, 13 aa, Entamoeba invadens
SKHLESKKAQLRN

SEQ ID NO: 3037157 - protein, 11 aa, Entamoeba invadens
SKIAGGDKALK

SEQ ID NO: 3037158 - protein, 10 aa, Entamoeba invadens
SKIPETDPKK

SEQ ID NO: 3037159 - protein, 5 aa, Entamoeba invadens
SKKDE

SEQ ID NO: 3037160 - protein, 6 aa, Entamoeba invadens
SKKGEF

SEQ ID NO: 3037161 - protein, 13 aa, Entamoeba invadens
SKKSKLEAVRDRK

SEQ ID NO: 3037162 - protein, 77 aa, Entamoeba invadens
SKKSKSKKKAATQQTSTQAKQKQPERRGSQQQPVVRPKETSPPQTTQVQKESRKEVQPAAVRPKTVVPQPQTSEQKV

SEQ ID NO: 3037163 - protein, 9 aa, Entamoeba invadens
SKKSQKTFQ

SEQ ID NO: 3037164 - protein, 68 aa, Entamoeba invadens
SKKVAKKQQKKAKKVAQKAQAKKIAKKENKKATKKAEKKVMKKQAKKAQKKLLNPAKLNTSTKKEKKV

SEQ ID NO: 3037165 - protein, 23 aa, Entamoeba invadens
SKLPKKLKTKVSQLKEKKKAFKA

SEQ ID NO: 3037166 - protein, 14 aa, Entamoeba invadens
SKLPNCKYQQNRVD

SEQ ID NO: 3037167 - protein, 41 aa, Entamoeba invadens
SKLSTDSGKVSSDTSSERKPETPVDRMRSSSPKEEKGTKEV

SEQ ID NO: 3037168 - protein, 10 aa, Entamoeba invadens
SKLSTEDEVS

SEQ ID NO: 3037169 - protein, 7 aa, Entamoeba invadens
SKNDHRR

SEQ ID NO: 3037170 - protein, 7 aa, Entamoeba invadens
SKNKQLA

SEQ ID NO: 3037171 - protein, 8 aa, Entamoeba invadens
SKNTDHPQ

SEQ ID NO: 3037172 - protein, 8 aa, Entamoeba invadens
SKPSLKSR

SEQ ID NO: 3037173 - protein, 6 aa, Entamoeba invadens
SKPTLT

SEQ ID NO: 3037174 - protein, 8 aa, Entamoeba invadens
SKPTMKTY

SEQ ID NO: 3037175 - protein, 7 aa, Entamoeba invadens
SKPTVPN

SEQ ID NO: 3037176 - protein, 14 aa, Entamoeba invadens
SKQAKESKKSTVET

SEQ ID NO: 3037177 - protein, 8 aa, Entamoeba invadens
SKQHISQG

SEQ ID NO: 3037178 - protein, 8 aa, Entamoeba invadens
SKQLDENR

SEQ ID NO: 3037179 - protein, 9 aa, Entamoeba invadens
SKQNTTYDK

SEQ ID NO: 3037180 - protein, 11 aa, Entamoeba invadens
SKRNYKKRGVK

SEQ ID NO: 3037181 - protein, 23 aa, Entamoeba invadens
SKSCSSCPENTYSLQNSSTCTNC

SEQ ID NO: 3037182 - protein, 6 aa, Entamoeba invadens
SKSCTY

SEQ ID NO: 3037183 - protein, 30 aa, Entamoeba invadens
SKSKKKLDPKKTKVTIDKKTGELKVKGGSD

SEQ ID NO: 3037184 - protein, 10 aa, Entamoeba invadens
SKSKSSKRQK

SEQ ID NO: 3037185 - protein, 9 aa, Entamoeba invadens
SKSNLSGPI

SEQ ID NO: 3037186 - protein, 8 aa, Entamoeba invadens
SKSREERA

SEQ ID NO: 3037187 - protein, 8 aa, Entamoeba invadens
SKSSEEIS

SEQ ID NO: 3037188 - protein, 6 aa, Entamoeba invadens
SKSSFN

SEQ ID NO: 3037189 - protein, 6 aa, Entamoeba invadens
SKSSID

SEQ ID NO: 3037190 - protein, 5 aa, Entamoeba invadens
SKSSL

SEQ ID NO: 3037191 - protein, 11 aa, Entamoeba invadens
SKTCGTSDLEH

SEQ ID NO: 3037192 - protein, 8 aa, Entamoeba invadens
SKTGISTD

SEQ ID NO: 3037193 - protein, 10 aa, Entamoeba invadens
SKTGTSYGPS

SEQ ID NO: 3037194 - protein, 14 aa, Entamoeba invadens
SKTIGTKLNTRNRS

SEQ ID NO: 3037195 - protein, 5 aa, Entamoeba invadens
SKTQL

SEQ ID NO: 3037196 - protein, 7 aa, Entamoeba invadens
SKTRKNL

SEQ ID NO: 3037197 - protein, 15 aa, Entamoeba invadens
SKTRSSVEKSGITAT

SEQ ID NO: 3037198 - protein, 8 aa, Entamoeba invadens
SKTSITEY

SEQ ID NO: 3037199 - protein, 8 aa, Entamoeba invadens
SKTSNGVN

SEQ ID NO: 3037200 - protein, 7 aa, Entamoeba invadens
SKTTGEC

SEQ ID NO: 3037201 - protein, 9 aa, Entamoeba invadens
SKTTGECTS

SEQ ID NO: 3037202 - protein, 6 aa, Entamoeba invadens
SKTTLH

SEQ ID NO: 3037203 - protein, 40 aa, Entamoeba invadens
SKVDEEKKTFEEDKRTKEKEKMEKEKKQRDRKSEIEKAEK

SEQ ID NO: 3037204 - protein, 8 aa, Entamoeba invadens
SKVDSSKV

SEQ ID NO: 3037205 - protein, 29 aa, Entamoeba invadens
SKVSELSNSQVSKATKKGDDDEDDKYKIN

SEQ ID NO: 3037206 - protein, 18 aa, Entamoeba invadens
SKYDTSPKRLKRAQADGG

SEQ ID NO: 3037207 - protein, 19 aa, Entamoeba invadens
SKYNEDTSCRGKGTTMDEK

SEQ ID NO: 3037208 - protein, 6 aa, Entamoeba invadens
SKYVGE

SEQ ID NO: 3037209 - protein, 4 aa, Entamoeba invadens
SLAL

SEQ ID NO: 3037210 - protein, 4 aa, Entamoeba invadens
SLAN

SEQ ID NO: 3037211 - protein, 6 aa, Entamoeba invadens
SLDGST

SEQ ID NO: 3037212 - protein, 14 aa, Entamoeba invadens
SLDKQTISVSQSAS

SEQ ID NO: 3037213 - protein, 127 aa, Entamoeba invadens
SLDNANSLADPTLPTSPSKPSSNNSPSSNTRSPSNNSGKSPSSGSTSSPAPSQASDTNPSASGTSPTPSEESGSAKIPEDPSGTSGSSTDTPTPVNPNAGGSPSYPYYTKGASVDSSPHPPCESQTR

SEQ ID NO: 3037214 - protein, 7 aa, Entamoeba invadens
SLEGKSR

SEQ ID NO: 3037215 - protein, 4 aa, Entamoeba invadens
SLEI

SEQ ID NO: 3037216 - protein, 10 aa, Entamoeba invadens
SLGDATGYTP

SEQ ID NO: 3037217 - protein, 9 aa, Entamoeba invadens
SLGYANPRT

SEQ ID NO: 3037218 - protein, 8 aa, Entamoeba invadens
SLHPGGVN

SEQ ID NO: 3037219 - protein, 9 aa, Entamoeba invadens
SLKENEDNL

SEQ ID NO: 3037220 - protein, 11 aa, Entamoeba invadens
SLKGKSVGTTD

SEQ ID NO: 3037221 - protein, 79 aa, Entamoeba invadens
SLKPGDYFDKSSEEPLPESSEPPEPEDSSEVKPEPPAESSSEEKPKPEESSEQPKPEESSEEKPKPEESSEEESGPKKV

SEQ ID NO: 3037222 - protein, 79 aa, Entamoeba invadens
SLKPGDYFDKSSEEPLPESSEPPEPEESSEVKPEPPAESSSEEKPKPEESSERPKPEESSEEKPKPEESSEEESGPKKV

SEQ ID NO: 3037223 - protein, 7 aa, Entamoeba invadens
SLKPNKD

SEQ ID NO: 3037224 - protein, 13 aa, Entamoeba invadens
SLKTVQTSAFSGC

SEQ ID NO: 3037225 - protein, 11 aa, Entamoeba invadens
SLNADNSDYYK

SEQ ID NO: 3037226 - protein, 10 aa, Entamoeba invadens
SLNQSEKGYY

SEQ ID NO: 3037227 - protein, 12 aa, Entamoeba invadens
SLPSDESDFVPN

SEQ ID NO: 3037228 - protein, 6 aa, Entamoeba invadens
SLPTMS

SEQ ID NO: 3037229 - protein, 24 aa, Entamoeba invadens
SLRARRSSSYDNSHTELESARRKS

SEQ ID NO: 3037230 - protein, 6 aa, Entamoeba invadens
SLRGNT

SEQ ID NO: 3037231 - protein, 15 aa, Entamoeba invadens
SLSANISNYGSNEVD

SEQ ID NO: 3037232 - protein, 8 aa, Entamoeba invadens
SLSATNDY

SEQ ID NO: 3037233 - protein, 9 aa, Entamoeba invadens
SLSEGSSVE

SEQ ID NO: 3037234 - protein, 45 aa, Entamoeba invadens
SLSQPTTSSQTPTTAGGVKPSKDSGQEKGAPTKAELEKKKEVEIP

SEQ ID NO: 3037235 - protein, 10 aa, Entamoeba invadens
SLSSSRNCTT

SEQ ID NO: 3037236 - protein, 5 aa, Entamoeba invadens
SLSST

SEQ ID NO: 3037237 - protein, 17 aa, Entamoeba invadens
SLSYNRESPFYYCLLFY

SEQ ID NO: 3037238 - protein, 9 aa, Entamoeba invadens
SLTAEGGNL

SEQ ID NO: 3037239 - protein, 35 aa, Entamoeba invadens
SLTQQSSSSSQVQDTEVSKDPSKDDSTKSQEETIN

SEQ ID NO: 3037240 - protein, 5 aa, Entamoeba invadens
SLTTT

SEQ ID NO: 3037241 - protein, 4 aa, Entamoeba invadens
SMEV

SEQ ID NO: 3037242 - protein, 14 aa, Entamoeba invadens
SMGGYGCYNQILIL

SEQ ID NO: 3037243 - protein, 8 aa, Entamoeba invadens
SMNASKAQ

SEQ ID NO: 3037244 - protein, 15 aa, Entamoeba invadens
SMNPSSLGEEEETLS

SEQ ID NO: 3037245 - protein, 4 aa, Entamoeba invadens
SMSE

SEQ ID NO: 3037246 - protein, 5 aa, Entamoeba invadens
SMSNA

SEQ ID NO: 3037247 - protein, 7 aa, Entamoeba invadens
SMSPVNQ

SEQ ID NO: 3037248 - protein, 8 aa, Entamoeba invadens
SMTNAESL

SEQ ID NO: 3037249 - protein, 7 aa, Entamoeba invadens
SMTNEEY

SEQ ID NO: 3037250 - protein, 5 aa, Entamoeba invadens
SNACT

SEQ ID NO: 3037251 - protein, 7 aa, Entamoeba invadens
SNAPLTK

SEQ ID NO: 3037252 - protein, 8 aa, Entamoeba invadens
SNAPQAKQ

SEQ ID NO: 3037253 - protein, 9 aa, Entamoeba invadens
SNCDKCSRN

SEQ ID NO: 3037254 - protein, 12 aa, Entamoeba invadens
SNCKTCKSDYTR

SEQ ID NO: 3037255 - protein, 9 aa, Entamoeba invadens
SNCRSGPFS

SEQ ID NO: 3037256 - protein, 4 aa, Entamoeba invadens
SNCS

SEQ ID NO: 3037257 - protein, 5 aa, Entamoeba invadens
SNDEG

SEQ ID NO: 3037258 - protein, 11 aa, Entamoeba invadens
SNDQFDSNGYA

SEQ ID NO: 3037259 - protein, 7 aa, Entamoeba invadens
SNDTTVP

SEQ ID NO: 3037260 - protein, 10 aa, Entamoeba invadens
SNEEGRGGRG

SEQ ID NO: 3037261 - protein, 7 aa, Entamoeba invadens
SNEHLTT

SEQ ID NO: 3037262 - protein, 9 aa, Entamoeba invadens
SNEMDTSEI

SEQ ID NO: 3037263 - protein, 10 aa, Entamoeba invadens
SNENVTKAYN

SEQ ID NO: 3037264 - protein, 4 aa, Entamoeba invadens
SNET

SEQ ID NO: 3037265 - protein, 11 aa, Entamoeba invadens
SNETRKQEFQN

SEQ ID NO: 3037266 - protein, 5 aa, Entamoeba invadens
SNFNN

SEQ ID NO: 3037267 - protein, 12 aa, Entamoeba invadens
SNGKYPKSTEGY

SEQ ID NO: 3037268 - protein, 9 aa, Entamoeba invadens
SNGNSLLDS

SEQ ID NO: 3037269 - protein, 10 aa, Entamoeba invadens
SNGNSQLDST

SEQ ID NO: 3037270 - protein, 5 aa, Entamoeba invadens
SNGQF

SEQ ID NO: 3037271 - protein, 4 aa, Entamoeba invadens
SNGV

SEQ ID NO: 3037272 - protein, 4 aa, Entamoeba invadens
SNGW

SEQ ID NO: 3037273 - protein, 7 aa, Entamoeba invadens
SNIAGTV

SEQ ID NO: 3037274 - protein, 7 aa, Entamoeba invadens
SNIQTEM

SEQ ID NO: 3037275 - protein, 8 aa, Entamoeba invadens
SNITRKST

SEQ ID NO: 3037276 - protein, 6 aa, Entamoeba invadens
SNKCEY

SEQ ID NO: 3037277 - protein, 10 aa, Entamoeba invadens
SNKKSTTKGL

SEQ ID NO: 3037278 - protein, 8 aa, Entamoeba invadens
SNKSGEFK

SEQ ID NO: 3037279 - protein, 4 aa, Entamoeba invadens
SNKT

SEQ ID NO: 3037280 - protein, 6 aa, Entamoeba invadens
SNLDSS

SEQ ID NO: 3037281 - protein, 10 aa, Entamoeba invadens
SNMKKSGDNV

SEQ ID NO: 3037282 - protein, 6 aa, Entamoeba invadens
SNNENI

SEQ ID NO: 3037283 - protein, 14 aa, Entamoeba invadens
SNNIEEGLKCQQSL

SEQ ID NO: 3037284 - protein, 9 aa, Entamoeba invadens
SNNKKEAQI

SEQ ID NO: 3037285 - protein, 8 aa, Entamoeba invadens
SNNPTDDV

SEQ ID NO: 3037286 - protein, 21 aa, Entamoeba invadens
SNPEGKPLVTKKQKDEPIGRD

SEQ ID NO: 3037287 - protein, 6 aa, Entamoeba invadens
SNPKIA

SEQ ID NO: 3037288 - protein, 5 aa, Entamoeba invadens
SNPNF

SEQ ID NO: 3037289 - protein, 6 aa, Entamoeba invadens
SNQCTK

SEQ ID NO: 3037290 - protein, 9 aa, Entamoeba invadens
SNQKLVNSE

SEQ ID NO: 3037291 - protein, 4 aa, Entamoeba invadens
SNQT

SEQ ID NO: 3037292 - protein, 12 aa, Entamoeba invadens
SNQVSYSSNHPD

SEQ ID NO: 3037293 - protein, 6 aa, Entamoeba invadens
SNSASS

SEQ ID NO: 3037294 - protein, 15 aa, Entamoeba invadens
SNSAVTIGSSAFQQA

SEQ ID NO: 3037295 - protein, 15 aa, Entamoeba invadens
SNSKLDGVTSKASQT

SEQ ID NO: 3037296 - protein, 13 aa, Entamoeba invadens
SNSNEVCKTGTCN

SEQ ID NO: 3037297 - protein, 17 aa, Entamoeba invadens
SNSQPSKNQKIETSGPC

SEQ ID NO: 3037298 - protein, 8 aa, Entamoeba invadens
SNSQRGLC

SEQ ID NO: 3037299 - protein, 5 aa, Entamoeba invadens
SNSVD

SEQ ID NO: 3037300 - protein, 5 aa, Entamoeba invadens
SNSVS

SEQ ID NO: 3037301 - protein, 18 aa, Entamoeba invadens
SNTEFKRKQAEQQKPPKL

SEQ ID NO: 3037302 - protein, 5 aa, Entamoeba invadens
SNTGL

SEQ ID NO: 3037303 - protein, 42 aa, Entamoeba invadens
SNTKSVKKKSLRTGPKKSEKRHRKRKKFRRKKKKTKNSNSSF

SEQ ID NO: 3037304 - protein, 8 aa, Entamoeba invadens
SNTLPGDF

SEQ ID NO: 3037305 - protein, 14 aa, Entamoeba invadens
SNTNCGNSTTSNIE

SEQ ID NO: 3037306 - protein, 5 aa, Entamoeba invadens
SNTNG

SEQ ID NO: 3037307 - protein, 4 aa, Entamoeba invadens
SNTS

SEQ ID NO: 3037308 - protein, 7 aa, Entamoeba invadens
SNTTLVG

SEQ ID NO: 3037309 - protein, 29 aa, Entamoeba invadens
SNVPKDTPYGPTKWPNGTDKANDNTAYSQ

SEQ ID NO: 3037310 - protein, 10 aa, Entamoeba invadens
SNVTAFTDGQ

SEQ ID NO: 3037311 - protein, 5 aa, Entamoeba invadens
SNWQK

SEQ ID NO: 3037312 - protein, 12 aa, Entamoeba invadens
SNYAEGTPTKCY

SEQ ID NO: 3037313 - protein, 11 aa, Entamoeba invadens
SNYDENRKQCT

SEQ ID NO: 3037314 - protein, 9 aa, Entamoeba invadens
SNYHDSEDC

SEQ ID NO: 3037315 - protein, 10 aa, Entamoeba invadens
SNYHDSEDGV

SEQ ID NO: 3037316 - protein, 12 aa, Entamoeba invadens
SNYIKDDNTTFN

SEQ ID NO: 3037317 - protein, 12 aa, Entamoeba invadens
SNYINNDKTTFD

SEQ ID NO: 3037318 - protein, 7 aa, Entamoeba invadens
SNYNNKK

SEQ ID NO: 3037319 - protein, 4 aa, Entamoeba invadens
SNYP

SEQ ID NO: 3037320 - protein, 21 aa, Entamoeba invadens
SNYSPAEIDDKQRRLNVLRKF

SEQ ID NO: 3037321 - protein, 7 aa, Entamoeba invadens
SNYTTSK

SEQ ID NO: 3037322 - protein, 7 aa, Entamoeba invadens
SPATKVQ

SEQ ID NO: 3037323 - protein, 6 aa, Entamoeba invadens
SPCGAA

SEQ ID NO: 3037324 - protein, 4 aa, Entamoeba invadens
SPEN

SEQ ID NO: 3037325 - protein, 7 aa, Entamoeba invadens
SPETANN

SEQ ID NO: 3037326 - protein, 6 aa, Entamoeba invadens
SPGCPD

SEQ ID NO: 3037327 - protein, 18 aa, Entamoeba invadens
SPGDLKGAASAVPDKGGI

SEQ ID NO: 3037328 - protein, 4 aa, Entamoeba invadens
SPHT

SEQ ID NO: 3037329 - protein, 7 aa, Entamoeba invadens
SPIDTAK

SEQ ID NO: 3037330 - protein, 7 aa, Entamoeba invadens
SPISTNC

SEQ ID NO: 3037331 - protein, 6 aa, Entamoeba invadens
SPITPN

SEQ ID NO: 3037332 - protein, 5 aa, Entamoeba invadens
SPKKY

SEQ ID NO: 3037333 - protein, 5 aa, Entamoeba invadens
SPKSK

SEQ ID NO: 3037334 - protein, 6 aa, Entamoeba invadens
SPLECS

SEQ ID NO: 3037335 - protein, 18 aa, Entamoeba invadens
SPLQITTKQTSTKSGFSS

SEQ ID NO: 3037336 - protein, 6 aa, Entamoeba invadens
SPLSQD

SEQ ID NO: 3037337 - protein, 4 aa, Entamoeba invadens
SPNG

SEQ ID NO: 3037338 - protein, 12 aa, Entamoeba invadens
SPNNGCNGGTGS

SEQ ID NO: 3037339 - protein, 8 aa, Entamoeba invadens
SPNSLDGS

SEQ ID NO: 3037340 - protein, 7 aa, Entamoeba invadens
SPPLTLT

SEQ ID NO: 3037341 - protein, 12 aa, Entamoeba invadens
SPPQPSGHPDYH

SEQ ID NO: 3037342 - protein, 6 aa, Entamoeba invadens
SPQLQG

SEQ ID NO: 3037343 - protein, 12 aa, Entamoeba invadens
SPQRRFQKPDHS

SEQ ID NO: 3037344 - protein, 6 aa, Entamoeba invadens
SPQVSD

SEQ ID NO: 3037345 - protein, 4 aa, Entamoeba invadens
SPRT

SEQ ID NO: 3037346 - protein, 12 aa, Entamoeba invadens
SPSGRKTLPEYA

SEQ ID NO: 3037347 - protein, 17 aa, Entamoeba invadens
SPSYSPWPSKCDRTKSQ

SEQ ID NO: 3037348 - protein, 5 aa, Entamoeba invadens
SPTEI

SEQ ID NO: 3037349 - protein, 5 aa, Entamoeba invadens
SPTGN

SEQ ID NO: 3037350 - protein, 11 aa, Entamoeba invadens
SPTQDSGVGYV

SEQ ID NO: 3037351 - protein, 9 aa, Entamoeba invadens
SPTVIPPQK

SEQ ID NO: 3037352 - protein, 17 aa, Entamoeba invadens
SQAQKDSSLPGHGDGKY

SEQ ID NO: 3037353 - protein, 11 aa, Entamoeba invadens
SQATEKAQRRK

SEQ ID NO: 3037354 - protein, 10 aa, Entamoeba invadens
SQCTDDNIEN

SEQ ID NO: 3037355 - protein, 6 aa, Entamoeba invadens
SQEAAL

SEQ ID NO: 3037356 - protein, 7 aa, Entamoeba invadens
SQEDEQK

SEQ ID NO: 3037357 - protein, 4 aa, Entamoeba invadens
SQEE

SEQ ID NO: 3037358 - protein, 34 aa, Entamoeba invadens
SQEKTNFEISEEDEALKKTKNGIYKNKEKKKWVL

SEQ ID NO: 3037359 - protein, 41 aa, Entamoeba invadens
SQEKTNFEISEEDEALKKTKNGIYKNKEKKNFIKNAADTKI

SEQ ID NO: 3037360 - protein, 6 aa, Entamoeba invadens
SQETET

SEQ ID NO: 3037361 - protein, 7 aa, Entamoeba invadens
SQFKNDI

SEQ ID NO: 3037362 - protein, 8 aa, Entamoeba invadens
SQGHPSGL

SEQ ID NO: 3037363 - protein, 13 aa, Entamoeba invadens
SQGIRNPEQLQND

SEQ ID NO: 3037364 - protein, 6 aa, Entamoeba invadens
SQGNAT

SEQ ID NO: 3037365 - protein, 4 aa, Entamoeba invadens
SQGV

SEQ ID NO: 3037366 - protein, 10 aa, Entamoeba invadens
SQKLSNEGGV

SEQ ID NO: 3037367 - protein, 8 aa, Entamoeba invadens
SQKSSECL

SEQ ID NO: 3037368 - protein, 9 aa, Entamoeba invadens
SQKTESTDM

SEQ ID NO: 3037369 - protein, 5 aa, Entamoeba invadens
SQKTV

SEQ ID NO: 3037370 - protein, 5 aa, Entamoeba invadens
SQLTS

SEQ ID NO: 3037371 - protein, 11 aa, Entamoeba invadens
SQNADCKSLTG

SEQ ID NO: 3037372 - protein, 18 aa, Entamoeba invadens
SQNETLRGDYEANPETID

SEQ ID NO: 3037373 - protein, 11 aa, Entamoeba invadens
SQNIPPKPNIA

SEQ ID NO: 3037374 - protein, 7 aa, Entamoeba invadens
SQNPTLG

SEQ ID NO: 3037375 - protein, 7 aa, Entamoeba invadens
SQNQEKY

SEQ ID NO: 3037376 - protein, 4 aa, Entamoeba invadens
SQPI

SEQ ID NO: 3037377 - protein, 42 aa, Entamoeba invadens
SQPPQDESDSEDSDTTSSSPHDYPTISTQSVRPKTTTKHYTH

SEQ ID NO: 3037378 - protein, 46 aa, Entamoeba invadens
SQPPQKPKPTPKQPAAEQPAAQAGPQNVHPHTAQREASKVKSSTNF

SEQ ID NO: 3037379 - protein, 6 aa, Entamoeba invadens
SQPSFQ

SEQ ID NO: 3037380 - protein, 7 aa, Entamoeba invadens
SQPTLTN

SEQ ID NO: 3037381 - protein, 8 aa, Entamoeba invadens
SQSGQTAY

SEQ ID NO: 3037382 - protein, 6 aa, Entamoeba invadens
SQSGTS

SEQ ID NO: 3037383 - protein, 7 aa, Entamoeba invadens
SQSIGST

SEQ ID NO: 3037384 - protein, 9 aa, Entamoeba invadens
SQSKGDQYN

SEQ ID NO: 3037385 - protein, 7 aa, Entamoeba invadens
SQSTRID

SEQ ID NO: 3037386 - protein, 4 aa, Entamoeba invadens
SQTI

SEQ ID NO: 3037387 - protein, 6 aa, Entamoeba invadens
SQTKTC

SEQ ID NO: 3037388 - protein, 6 aa, Entamoeba invadens
SQTTPY

SEQ ID NO: 3037389 - protein, 5 aa, Entamoeba invadens
SQVDT

SEQ ID NO: 3037390 - protein, 9 aa, Entamoeba invadens
SQVNGNGKC

SEQ ID NO: 3037391 - protein, 9 aa, Entamoeba invadens
SQVSFSSNH

SEQ ID NO: 3037392 - protein, 9 aa, Entamoeba invadens
SQYDPSQPK

SEQ ID NO: 3037393 - protein, 17 aa, Entamoeba invadens
SQYIPTKNSVQLNDPPL

SEQ ID NO: 3037394 - protein, 5 aa, Entamoeba invadens
SRAFA

SEQ ID NO: 3037395 - protein, 7 aa, Entamoeba invadens
SRAGTSA

SEQ ID NO: 3037396 - protein, 5 aa, Entamoeba invadens
SRARN

SEQ ID NO: 3037397 - protein, 8 aa, Entamoeba invadens
SRCDTTGK

SEQ ID NO: 3037398 - protein, 7 aa, Entamoeba invadens
SRCQSPV

SEQ ID NO: 3037399 - protein, 5 aa, Entamoeba invadens
SREED

SEQ ID NO: 3037400 - protein, 9 aa, Entamoeba invadens
SREHSEGVE

SEQ ID NO: 3037401 - protein, 17 aa, Entamoeba invadens
SRENKGCLEADENCAKC

SEQ ID NO: 3037402 - protein, 13 aa, Entamoeba invadens
SREYKITQAESKS

SEQ ID NO: 3037403 - protein, 5 aa, Entamoeba invadens
SRKEV

SEQ ID NO: 3037404 - protein, 13 aa, Entamoeba invadens
SRKVPSLTVPQPQ

SEQ ID NO: 3037405 - protein, 11 aa, Entamoeba invadens
SRNNNNENRFR

SEQ ID NO: 3037406 - protein, 6 aa, Entamoeba invadens
SRNPNL

SEQ ID NO: 3037407 - protein, 8 aa, Entamoeba invadens
SRSEFQGE

SEQ ID NO: 3037408 - protein, 15 aa, Entamoeba invadens
SRTQKVATVGKDAFK

SEQ ID NO: 3037409 - protein, 4 aa, Entamoeba invadens
SSAF

SEQ ID NO: 3037410 - protein, 9 aa, Entamoeba invadens
SSAKSLRTI

SEQ ID NO: 3037411 - protein, 7 aa, Entamoeba invadens
SSAMTPK

SEQ ID NO: 3037412 - protein, 14 aa, Entamoeba invadens
SSAPIDSDTPDSSA

SEQ ID NO: 3037413 - protein, 5 aa, Entamoeba invadens
SSAPL

SEQ ID NO: 3037414 - protein, 42 aa, Entamoeba invadens
SSAPVAAAPVAAAETKKEETKEEQKEEKKDEPEEDFGGFGDL

SEQ ID NO: 3037415 - protein, 9 aa, Entamoeba invadens
SSAQKTIKD

SEQ ID NO: 3037416 - protein, 9 aa, Entamoeba invadens
SSAQSSGLS

SEQ ID NO: 3037417 - protein, 6 aa, Entamoeba invadens
SSASFS

SEQ ID NO: 3037418 - protein, 26 aa, Entamoeba invadens
SSCDSTCGSCDKTNGNCTTCNSGDIL

SEQ ID NO: 3037419 - protein, 4 aa, Entamoeba invadens
SSCE

SEQ ID NO: 3037420 - protein, 4 aa, Entamoeba invadens
SSCK

SEQ ID NO: 3037421 - protein, 6 aa, Entamoeba invadens
SSCQTC

SEQ ID NO: 3037422 - protein, 21 aa, Entamoeba invadens
SSCTTKKEDIVDNTNWQNGND

SEQ ID NO: 3037423 - protein, 16 aa, Entamoeba invadens
SSDCTGEVNTTNIDRG

SEQ ID NO: 3037424 - protein, 6 aa, Entamoeba invadens
SSDECL

SEQ ID NO: 3037425 - protein, 4 aa, Entamoeba invadens
SSDK

SEQ ID NO: 3037426 - protein, 9 aa, Entamoeba invadens
SSDNQCTSC

SEQ ID NO: 3037427 - protein, 6 aa, Entamoeba invadens
SSDQAH

SEQ ID NO: 3037428 - protein, 8 aa, Entamoeba invadens
SSDSTHEI

SEQ ID NO: 3037429 - protein, 8 aa, Entamoeba invadens
SSDVNAEI

SEQ ID NO: 3037430 - protein, 9 aa, Entamoeba invadens
SSEAKQLET

SEQ ID NO: 3037431 - protein, 4 aa, Entamoeba invadens
SSEC

SEQ ID NO: 3037432 - protein, 7 aa, Entamoeba invadens
SSEDLNN

SEQ ID NO: 3037433 - protein, 10 aa, Entamoeba invadens
SSEGTPEEVE

SEQ ID NO: 3037434 - protein, 5 aa, Entamoeba invadens
SSEIT

SEQ ID NO: 3037435 - protein, 9 aa, Entamoeba invadens
SSEKATRGI

SEQ ID NO: 3037436 - protein, 7 aa, Entamoeba invadens
SSELTGS

SEQ ID NO: 3037437 - protein, 10 aa, Entamoeba invadens
SSENAMKYQT

SEQ ID NO: 3037438 - protein, 5 aa, Entamoeba invadens
SSENI

SEQ ID NO: 3037439 - protein, 7 aa, Entamoeba invadens
SSESGEY

SEQ ID NO: 3037440 - protein, 9 aa, Entamoeba invadens
SSETCSASF

SEQ ID NO: 3037441 - protein, 20 aa, Entamoeba invadens
SSFSTTTSYSYATSPKEGKY

SEQ ID NO: 3037442 - protein, 10 aa, Entamoeba invadens
SSGEETAEYA

SEQ ID NO: 3037443 - protein, 22 aa, Entamoeba invadens
SSGERKCNTCTNKTHPDETGKC

SEQ ID NO: 3037444 - protein, 4 aa, Entamoeba invadens
SSGF

SEQ ID NO: 3037445 - protein, 9 aa, Entamoeba invadens
SSGNEGGCF

SEQ ID NO: 3037446 - protein, 4 aa, Entamoeba invadens
SSGS

SEQ ID NO: 3037447 - protein, 5 aa, Entamoeba invadens
SSGSM

SEQ ID NO: 3037448 - protein, 7 aa, Entamoeba invadens
SSGSNDC

SEQ ID NO: 3037449 - protein, 9 aa, Entamoeba invadens
SSGSVPSLS

SEQ ID NO: 3037450 - protein, 22 aa, Entamoeba invadens
SSGSWDPNCASNCKNAHSAGMS

SEQ ID NO: 3037451 - protein, 6 aa, Entamoeba invadens
SSGTFD

SEQ ID NO: 3037452 - protein, 5 aa, Entamoeba invadens
SSHDV

SEQ ID NO: 3037453 - protein, 7 aa, Entamoeba invadens
SSHPPRG

SEQ ID NO: 3037454 - protein, 6 aa, Entamoeba invadens
SSHTPR

SEQ ID NO: 3037455 - protein, 11 aa, Entamoeba invadens
SSIDKTKLSSI

SEQ ID NO: 3037456 - protein, 4 aa, Entamoeba invadens
SSIE

SEQ ID NO: 3037457 - protein, 5 aa, Entamoeba invadens
SSIIN

SEQ ID NO: 3037458 - protein, 6 aa, Entamoeba invadens
SSIISE

SEQ ID NO: 3037459 - protein, 6 aa, Entamoeba invadens
SSIKNG

SEQ ID NO: 3037460 - protein, 10 aa, Entamoeba invadens
SSIPDNDTLE

SEQ ID NO: 3037461 - protein, 6 aa, Entamoeba invadens
SSIPKE

SEQ ID NO: 3037462 - protein, 5 aa, Entamoeba invadens
SSIPN

SEQ ID NO: 3037463 - protein, 4 aa, Entamoeba invadens
SSKE

SEQ ID NO: 3037464 - protein, 9 aa, Entamoeba invadens
SSKEGSGVQ

SEQ ID NO: 3037465 - protein, 11 aa, Entamoeba invadens
SSKEVGEACPP

SEQ ID NO: 3037466 - protein, 6 aa, Entamoeba invadens
SSKGIS

SEQ ID NO: 3037467 - protein, 9 aa, Entamoeba invadens
SSKGISSLG

SEQ ID NO: 3037468 - protein, 5 aa, Entamoeba invadens
SSKIA

SEQ ID NO: 3037469 - protein, 7 aa, Entamoeba invadens
SSKNNKL

SEQ ID NO: 3037470 - protein, 7 aa, Entamoeba invadens
SSLEDPG

SEQ ID NO: 3037471 - protein, 13 aa, Entamoeba invadens
SSLGDSTETTLTL

SEQ ID NO: 3037472 - protein, 11 aa, Entamoeba invadens
SSLNLTQETNF

SEQ ID NO: 3037473 - protein, 5 aa, Entamoeba invadens
SSLQA

SEQ ID NO: 3037474 - protein, 16 aa, Entamoeba invadens
SSLTQKHDTDNCGKTS

SEQ ID NO: 3037475 - protein, 7 aa, Entamoeba invadens
SSNCQND

SEQ ID NO: 3037476 - protein, 13 aa, Entamoeba invadens
SSNCTSCSQTTEE

SEQ ID NO: 3037477 - protein, 5 aa, Entamoeba invadens
SSNGN

SEQ ID NO: 3037478 - protein, 9 aa, Entamoeba invadens
SSNNLKGEV

SEQ ID NO: 3037479 - protein, 14 aa, Entamoeba invadens
SSNQFKTEKSISEE

SEQ ID NO: 3037480 - protein, 5 aa, Entamoeba invadens
SSNST

SEQ ID NO: 3037481 - protein, 6 aa, Entamoeba invadens
SSPGLI

SEQ ID NO: 3037482 - protein, 13 aa, Entamoeba invadens
SSQGTITAPKYKN

SEQ ID NO: 3037483 - protein, 16 aa, Entamoeba invadens
SSQIYNKTTQKCDSNA

SEQ ID NO: 3037484 - protein, 10 aa, Entamoeba invadens
SSQQLAEDPY

SEQ ID NO: 3037485 - protein, 7 aa, Entamoeba invadens
SSQTDCK

SEQ ID NO: 3037486 - protein, 5 aa, Entamoeba invadens
SSRGL

SEQ ID NO: 3037487 - protein, 8 aa, Entamoeba invadens
SSRNDKYK

SEQ ID NO: 3037488 - protein, 6 aa, Entamoeba invadens
SSSFTK

SEQ ID NO: 3037489 - protein, 10 aa, Entamoeba invadens
SSSGNTSGTI

SEQ ID NO: 3037490 - protein, 8 aa, Entamoeba invadens
SSSISPKD

SEQ ID NO: 3037491 - protein, 4 aa, Entamoeba invadens
SSSK

SEQ ID NO: 3037492 - protein, 10 aa, Entamoeba invadens
SSSKSSLSCQ

SEQ ID NO: 3037493 - protein, 11 aa, Entamoeba invadens
SSSNEAILKPG

SEQ ID NO: 3037494 - protein, 7 aa, Entamoeba invadens
SSSPGLI

SEQ ID NO: 3037495 - protein, 8 aa, Entamoeba invadens
SSSQCGAS

SEQ ID NO: 3037496 - protein, 8 aa, Entamoeba invadens
SSSTGELL

SEQ ID NO: 3037497 - protein, 6 aa, Entamoeba invadens
SSSTNC

SEQ ID NO: 3037498 - protein, 9 aa, Entamoeba invadens
SSSTTCQEC

SEQ ID NO: 3037499 - protein, 7 aa, Entamoeba invadens
SSSVEPN

SEQ ID NO: 3037500 - protein, 14 aa, Entamoeba invadens
SSSVYGNYTFDNST

SEQ ID NO: 3037501 - protein, 4 aa, Entamoeba invadens
SSTA

SEQ ID NO: 3037502 - protein, 8 aa, Entamoeba invadens
SSTAPRRS

SEQ ID NO: 3037503 - protein, 18 aa, Entamoeba invadens
SSTCGGQCNTINGECTGC

SEQ ID NO: 3037504 - protein, 22 aa, Entamoeba invadens
SSTFKNKESVKDFQKSKLGQRF

SEQ ID NO: 3037505 - protein, 4 aa, Entamoeba invadens
SSTH

SEQ ID NO: 3037506 - protein, 8 aa, Entamoeba invadens
SSTKSTCQ

SEQ ID NO: 3037507 - protein, 11 aa, Entamoeba invadens
SSTNKCEKCDP

SEQ ID NO: 3037508 - protein, 6 aa, Entamoeba invadens
SSTPSC

SEQ ID NO: 3037509 - protein, 8 aa, Entamoeba invadens
SSTQDAEE

SEQ ID NO: 3037510 - protein, 7 aa, Entamoeba invadens
SSTSCDT

SEQ ID NO: 3037511 - protein, 5 aa, Entamoeba invadens
SSTSQ

SEQ ID NO: 3037512 - protein, 5 aa, Entamoeba invadens
SSVDV

SEQ ID NO: 3037513 - protein, 5 aa, Entamoeba invadens
SSVKS

SEQ ID NO: 3037514 - protein, 11 aa, Entamoeba invadens
SSVLEDNQNER

SEQ ID NO: 3037515 - protein, 20 aa, Entamoeba invadens
SSVPARGDKGYGIGDSRLNY

SEQ ID NO: 3037516 - protein, 4 aa, Entamoeba invadens
SSYP

SEQ ID NO: 3037517 - protein, 8 aa, Entamoeba invadens
SSYPGVTH

SEQ ID NO: 3037518 - protein, 9 aa, Entamoeba invadens
SSYRKNGLE

SEQ ID NO: 3037519 - protein, 5 aa, Entamoeba invadens
STAGV

SEQ ID NO: 3037520 - protein, 8 aa, Entamoeba invadens
STAPNKIC

SEQ ID NO: 3037521 - protein, 8 aa, Entamoeba invadens
STASGDGV

SEQ ID NO: 3037522 - protein, 6 aa, Entamoeba invadens
STASLE

SEQ ID NO: 3037523 - protein, 18 aa, Entamoeba invadens
STCGDNEIGMGEQCDGGV

SEQ ID NO: 3037524 - protein, 13 aa, Entamoeba invadens
STCHGKGTQTKTM

SEQ ID NO: 3037525 - protein, 9 aa, Entamoeba invadens
STCKDSKQF

SEQ ID NO: 3037526 - protein, 8 aa, Entamoeba invadens
STCQPNTC

SEQ ID NO: 3037527 - protein, 13 aa, Entamoeba invadens
STCSNGCNTQTGY

SEQ ID NO: 3037528 - protein, 10 aa, Entamoeba invadens
STDAASSTHI

SEQ ID NO: 3037529 - protein, 6 aa, Entamoeba invadens
STDGWV

SEQ ID NO: 3037530 - protein, 4 aa, Entamoeba invadens
STDW

SEQ ID NO: 3037531 - protein, 25 aa, Entamoeba invadens
STECKKCDRKSGACTSCEVGNKRVD

SEQ ID NO: 3037532 - protein, 7 aa, Entamoeba invadens
STEEVEE

SEQ ID NO: 3037533 - protein, 8 aa, Entamoeba invadens
STEKKQIT

SEQ ID NO: 3037534 - protein, 7 aa, Entamoeba invadens
STEKNTQ

SEQ ID NO: 3037535 - protein, 8 aa, Entamoeba invadens
STELPPAF

SEQ ID NO: 3037536 - protein, 22 aa, Entamoeba invadens
STENSEVKSVEKSTEKSSEVDV

SEQ ID NO: 3037537 - protein, 7 aa, Entamoeba invadens
STERGYG

SEQ ID NO: 3037538 - protein, 7 aa, Entamoeba invadens
STETDEL

SEQ ID NO: 3037539 - protein, 6 aa, Entamoeba invadens
STFTMN

SEQ ID NO: 3037540 - protein, 6 aa, Entamoeba invadens
STGDIG

SEQ ID NO: 3037541 - protein, 5 aa, Entamoeba invadens
STGLY

SEQ ID NO: 3037542 - protein, 7 aa, Entamoeba invadens
STGSFDS

SEQ ID NO: 3037543 - protein, 6 aa, Entamoeba invadens
STHRPS

SEQ ID NO: 3037544 - protein, 6 aa, Entamoeba invadens
STHVDE

SEQ ID NO: 3037545 - protein, 7 aa, Entamoeba invadens
STIPGSQ

SEQ ID NO: 3037546 - protein, 6 aa, Entamoeba invadens
STIPPS

SEQ ID NO: 3037547 - protein, 6 aa, Entamoeba invadens
STIPSN

SEQ ID NO: 3037548 - protein, 4 aa, Entamoeba invadens
STIS

SEQ ID NO: 3037549 - protein, 5 aa, Entamoeba invadens
STKCL

SEQ ID NO: 3037550 - protein, 5 aa, Entamoeba invadens
STPDG

SEQ ID NO: 3037551 - protein, 6 aa, Entamoeba invadens
STPETF

SEQ ID NO: 3037552 - protein, 7 aa, Entamoeba invadens
STPKTQF

SEQ ID NO: 3037553 - protein, 19 aa, Entamoeba invadens
STPPPLHEDKATQTDFSEE

SEQ ID NO: 3037554 - protein, 15 aa, Entamoeba invadens
STQKGQLARDNNQRR

SEQ ID NO: 3037555 - protein, 9 aa, Entamoeba invadens
STQPFDDEV

SEQ ID NO: 3037556 - protein, 5 aa, Entamoeba invadens
STQQA

SEQ ID NO: 3037557 - protein, 6 aa, Entamoeba invadens
STQQDV

SEQ ID NO: 3037558 - protein, 5 aa, Entamoeba invadens
STQSY

SEQ ID NO: 3037559 - protein, 10 aa, Entamoeba invadens
STQTEQPVKG

SEQ ID NO: 3037560 - protein, 6 aa, Entamoeba invadens
STRIPK

SEQ ID NO: 3037561 - protein, 10 aa, Entamoeba invadens
STSDVNTEGA

SEQ ID NO: 3037562 - protein, 15 aa, Entamoeba invadens
STSGDLDGENSKSEF

SEQ ID NO: 3037563 - protein, 6 aa, Entamoeba invadens
STSNPN

SEQ ID NO: 3037564 - protein, 4 aa, Entamoeba invadens
STSP

SEQ ID NO: 3037565 - protein, 20 aa, Entamoeba invadens
STSPNIVPGDATYYPTPTID

SEQ ID NO: 3037566 - protein, 7 aa, Entamoeba invadens
STSPQYG

SEQ ID NO: 3037567 - protein, 9 aa, Entamoeba invadens
STSRNIRNV

SEQ ID NO: 3037568 - protein, 5 aa, Entamoeba invadens
STSSF

SEQ ID NO: 3037569 - protein, 13 aa, Entamoeba invadens
STSVGNNGCSGGS

SEQ ID NO: 3037570 - protein, 6 aa, Entamoeba invadens
STSVNP

SEQ ID NO: 3037571 - protein, 10 aa, Entamoeba invadens
STSVSSSELE

SEQ ID NO: 3037572 - protein, 4 aa, Entamoeba invadens
STSY

SEQ ID NO: 3037573 - protein, 6 aa, Entamoeba invadens
STTCNS

SEQ ID NO: 3037574 - protein, 16 aa, Entamoeba invadens
STTDFGSVESPYKGTK

SEQ ID NO: 3037575 - protein, 7 aa, Entamoeba invadens
STTDSPV

SEQ ID NO: 3037576 - protein, 5 aa, Entamoeba invadens
STTKR

SEQ ID NO: 3037577 - protein, 18 aa, Entamoeba invadens
STTLPTTQCTECTTKTNG

SEQ ID NO: 3037578 - protein, 5 aa, Entamoeba invadens
STTSA

SEQ ID NO: 3037579 - protein, 6 aa, Entamoeba invadens
STTSPY

SEQ ID NO: 3037580 - protein, 6 aa, Entamoeba invadens
STTSRG

SEQ ID NO: 3037581 - protein, 6 aa, Entamoeba invadens
STTSRK

SEQ ID NO: 3037582 - protein, 9 aa, Entamoeba invadens
STTTENGNT

SEQ ID NO: 3037583 - protein, 14 aa, Entamoeba invadens
STTYNTANTDNGYG

SEQ ID NO: 3037584 - protein, 6 aa, Entamoeba invadens
STTYTN

SEQ ID NO: 3037585 - protein, 44 aa, Entamoeba invadens
STVESSSRNLAKNTTKSTTKNNTTNNSSMTTRDKTAAEKQMDKK

SEQ ID NO: 3037586 - protein, 17 aa, Entamoeba invadens
STVKENNKAGDKKCEKK

SEQ ID NO: 3037587 - protein, 5 aa, Entamoeba invadens
STYCE

SEQ ID NO: 3037588 - protein, 7 aa, Entamoeba invadens
STYPKKL

SEQ ID NO: 3037589 - protein, 4 aa, Entamoeba invadens
SVDD

SEQ ID NO: 3037590 - protein, 4 aa, Entamoeba invadens
SVDG

SEQ ID NO: 3037591 - protein, 18 aa, Entamoeba invadens
SVDTTKDISTDDICQSDG

SEQ ID NO: 3037592 - protein, 11 aa, Entamoeba invadens
SVEGDGGNCTT

SEQ ID NO: 3037593 - protein, 233 aa, Entamoeba invadens
SVEKSEEKSKEKSKEKSEESKHCPEKSCEEKSCHEKSEESKVPVTPSVEKSEEKSKEKSEESKHCPEKSCEEKSCHEKSEESKEPVTPSVEKSEEKSKEKSCTEKSEESKVPVTPSVEKSEESKHCPEKSCEEKSCHEKSEESKVPVTPSVEKSEEKSKHCEDKSCEEKSCHEESKVPVTPSVEKSEEKSKHCEDKSCEEKSCHEKSKEPVTPSVEKSEELSFPSEDHECKQN

SEQ ID NO: 3037594 - protein, 11 aa, Entamoeba invadens
SVERPGNSDQT

SEQ ID NO: 3037595 - protein, 20 aa, Entamoeba invadens
SVFGNNGNNQQYFFQAPFNP

SEQ ID NO: 3037596 - protein, 13 aa, Entamoeba invadens
SVGATGNGEEADL

SEQ ID NO: 3037597 - protein, 4 aa, Entamoeba invadens
SVGE

SEQ ID NO: 3037598 - protein, 31 aa, Entamoeba invadens
SVKAEKEKKLREAEKRYEKVSGLEAKEAQKV

SEQ ID NO: 3037599 - protein, 8 aa, Entamoeba invadens
SVKFPSDQ

SEQ ID NO: 3037600 - protein, 15 aa, Entamoeba invadens
SVKGTNHVTEIGNSS

SEQ ID NO: 3037601 - protein, 13 aa, Entamoeba invadens
SVNDQTSQAEGEI

SEQ ID NO: 3037602 - protein, 181 aa, Entamoeba invadens
SVNGNAQKTNTNGQRSSSFGVGADYTSKKLTASTSYTQNKSPNSKTKNLKYSATYKPTDNLKLSTDGSFTKQNGQKSRDLSASADYTSKKLDANVKVSSSKSVQTKSKSITGGVTYRPTDKVTIGANGKYSKTNGVASKEVNVKGSYTGDKLSVNGALSSGKNGNDKTKSLSVDGKYKVND

SEQ ID NO: 3037603 - protein, 7 aa, Entamoeba invadens
SVPKDQF

SEQ ID NO: 3037604 - protein, 8 aa, Entamoeba invadens
SVPNDNIS

SEQ ID NO: 3037605 - protein, 6 aa, Entamoeba invadens
SVPVGS

SEQ ID NO: 3037606 - protein, 21 aa, Entamoeba invadens
SVQRDSETTPLKTVSKLRNML

SEQ ID NO: 3037607 - protein, 9 aa, Entamoeba invadens
SVQSKEIDF

SEQ ID NO: 3037608 - protein, 8 aa, Entamoeba invadens
SVRSGKGT

SEQ ID NO: 3037609 - protein, 6 aa, Entamoeba invadens
SVSAGT

SEQ ID NO: 3037610 - protein, 49 aa, Entamoeba invadens
SVSDGIKSVKTGIENSAKKFARDQISKTEFGKNALDKYDKVKTGIKTAK

SEQ ID NO: 3037611 - protein, 6 aa, Entamoeba invadens
SVSGDE

SEQ ID NO: 3037612 - protein, 8 aa, Entamoeba invadens
SVTAETKN

SEQ ID NO: 3037613 - protein, 5 aa, Entamoeba invadens
SVTAK

SEQ ID NO: 3037614 - protein, 5 aa, Entamoeba invadens
SVTRS

SEQ ID NO: 3037615 - protein, 4 aa, Entamoeba invadens
SVTT

SEQ ID NO: 3037616 - protein, 6 aa, Entamoeba invadens
SVVGSP

SEQ ID NO: 3037617 - protein, 10 aa, Entamoeba invadens
SVYTDKTNGI

SEQ ID NO: 3037618 - protein, 9 aa, Entamoeba invadens
SWLPPEESL

SEQ ID NO: 3037619 - protein, 10 aa, Entamoeba invadens
SWNGSDGNAH

SEQ ID NO: 3037620 - protein, 10 aa, Entamoeba invadens
SWNGTDGNAH

SEQ ID NO: 3037621 - protein, 6 aa, Entamoeba invadens
SWSDDI

SEQ ID NO: 3037622 - protein, 9 aa, Entamoeba invadens
SYAAGSGLK

SEQ ID NO: 3037623 - protein, 10 aa, Entamoeba invadens
SYADSNEVAK

SEQ ID NO: 3037624 - protein, 10 aa, Entamoeba invadens
SYDRTTEEGD

SEQ ID NO: 3037625 - protein, 10 aa, Entamoeba invadens
SYDSSNKNCS

SEQ ID NO: 3037626 - protein, 9 aa, Entamoeba invadens
SYEKPAERE

SEQ ID NO: 3037627 - protein, 10 aa, Entamoeba invadens
SYEKPAEREI

SEQ ID NO: 3037628 - protein, 50 aa, Entamoeba invadens
SYENEEHEAEDMNEFDDNEDATDDDDDNEDEEDDDSKFDEYELGDDDDDL

SEQ ID NO: 3037629 - protein, 10 aa, Entamoeba invadens
SYENTVNKTG

SEQ ID NO: 3037630 - protein, 7 aa, Entamoeba invadens
SYESEEH

SEQ ID NO: 3037631 - protein, 5 aa, Entamoeba invadens
SYESP

SEQ ID NO: 3037632 - protein, 17 aa, Entamoeba invadens
SYFPGAPTFKANGVKTN

SEQ ID NO: 3037633 - protein, 9 aa, Entamoeba invadens
SYGKTWGEN

SEQ ID NO: 3037634 - protein, 17 aa, Entamoeba invadens
SYGNNPPCTVRGDQNSK

SEQ ID NO: 3037635 - protein, 7 aa, Entamoeba invadens
SYGSNWG

SEQ ID NO: 3037636 - protein, 4 aa, Entamoeba invadens
SYGT

SEQ ID NO: 3037637 - protein, 18 aa, Entamoeba invadens
SYKSKENVYSTDSPKEGK

SEQ ID NO: 3037638 - protein, 4 aa, Entamoeba invadens
SYNK

SEQ ID NO: 3037639 - protein, 8 aa, Entamoeba invadens
SYNPTTQT

SEQ ID NO: 3037640 - protein, 10 aa, Entamoeba invadens
SYNSPYSKTI

SEQ ID NO: 3037641 - protein, 5 aa, Entamoeba invadens
SYNSR

SEQ ID NO: 3037642 - protein, 12 aa, Entamoeba invadens
SYPQPCTDDECK

SEQ ID NO: 3037643 - protein, 8 aa, Entamoeba invadens
SYPTGTGE

SEQ ID NO: 3037644 - protein, 14 aa, Entamoeba invadens
SYPYKAADGTCNTA

SEQ ID NO: 3037645 - protein, 6 aa, Entamoeba invadens
SYQATQ

SEQ ID NO: 3037646 - protein, 5 aa, Entamoeba invadens
SYQSD

SEQ ID NO: 3037647 - protein, 4 aa, Entamoeba invadens
SYRA

SEQ ID NO: 3037648 - protein, 5 aa, Entamoeba invadens
SYSAN

SEQ ID NO: 3037649 - protein, 7 aa, Entamoeba invadens
SYSESLA

SEQ ID NO: 3037650 - protein, 4 aa, Entamoeba invadens
SYSG

SEQ ID NO: 3037651 - protein, 13 aa, Entamoeba invadens
SYSGDTAYTPLAT

SEQ ID NO: 3037652 - protein, 10 aa, Entamoeba invadens
SYSLSGSSSC

SEQ ID NO: 3037653 - protein, 10 aa, Entamoeba invadens
SYSSDSTSDH

SEQ ID NO: 3037654 - protein, 7 aa, Entamoeba invadens
SYSTSTL

SEQ ID NO: 3037655 - protein, 7 aa, Entamoeba invadens
SYTKQDD

SEQ ID NO: 3037656 - protein, 8 aa, Entamoeba invadens
SYTKTNKC

SEQ ID NO: 3037657 - protein, 8 aa, Entamoeba invadens
SYTSQKQY

SEQ ID NO: 3037658 - protein, 6 aa, Entamoeba invadens
SYYDTD

SEQ ID NO: 3037659 - protein, 7 aa, Entamoeba invadens
SYYNPGS

SEQ ID NO: 3037660 - protein, 11 aa, Entamoeba invadens
SYYTDADSLEV

SEQ ID NO: 3037661 - protein, 21 aa, Entamoeba invadens
TAAMETSKKISKKIQKERDEL

SEQ ID NO: 3037662 - protein, 4 aa, Entamoeba invadens
TACS

SEQ ID NO: 3037663 - protein, 35 aa, Entamoeba invadens
TADDGQKRGSRQSLTGSGSNRNSRRRSSVSLRPRN

SEQ ID NO: 3037664 - protein, 8 aa, Entamoeba invadens
TADGIKQI

SEQ ID NO: 3037665 - protein, 9 aa, Entamoeba invadens
TADGKCEVN

SEQ ID NO: 3037666 - protein, 17 aa, Entamoeba invadens
TADISDKALTETIADGP

SEQ ID NO: 3037667 - protein, 7 aa, Entamoeba invadens
TAEKELV

SEQ ID NO: 3037668 - protein, 5 aa, Entamoeba invadens
TAEQN

SEQ ID NO: 3037669 - protein, 18 aa, Entamoeba invadens
TAETKSGCPNKDKKMTGV

SEQ ID NO: 3037670 - protein, 6 aa, Entamoeba invadens
TAFPDS

SEQ ID NO: 3037671 - protein, 6 aa, Entamoeba invadens
TAFPTS

SEQ ID NO: 3037672 - protein, 8 aa, Entamoeba invadens
TAFYDKSN

SEQ ID NO: 3037673 - protein, 13 aa, Entamoeba invadens
TAGDLDGEYSTGY

SEQ ID NO: 3037674 - protein, 14 aa, Entamoeba invadens
TAGDLDGQYSRGSA

SEQ ID NO: 3037675 - protein, 6 aa, Entamoeba invadens
TAGDLE

SEQ ID NO: 3037676 - protein, 12 aa, Entamoeba invadens
TAGNEQYSRPSC

SEQ ID NO: 3037677 - protein, 9 aa, Entamoeba invadens
TAGQEEYSA

SEQ ID NO: 3037678 - protein, 10 aa, Entamoeba invadens
TAGQEEYSSL

SEQ ID NO: 3037679 - protein, 8 aa, Entamoeba invadens
TAGQNAGA

SEQ ID NO: 3037680 - protein, 18 aa, Entamoeba invadens
TAHENCSSCSVDGNCTEC

SEQ ID NO: 3037681 - protein, 6 aa, Entamoeba invadens
TAHKND

SEQ ID NO: 3037682 - protein, 4 aa, Entamoeba invadens
TAHS

SEQ ID NO: 3037683 - protein, 5 aa, Entamoeba invadens
TAKAN

SEQ ID NO: 3037684 - protein, 23 aa, Entamoeba invadens
TAKGLLGKATASFGSKDKKVSFG

SEQ ID NO: 3037685 - protein, 9 aa, Entamoeba invadens
TAKNSFKNN

SEQ ID NO: 3037686 - protein, 8 aa, Entamoeba invadens
TAKNTTEI

SEQ ID NO: 3037687 - protein, 5 aa, Entamoeba invadens
TAKQQ

SEQ ID NO: 3037688 - protein, 13 aa, Entamoeba invadens
TAKTLTKDGLQTI

SEQ ID NO: 3037689 - protein, 8 aa, Entamoeba invadens
TALEEEGR

SEQ ID NO: 3037690 - protein, 5 aa, Entamoeba invadens
TALEP

SEQ ID NO: 3037691 - protein, 9 aa, Entamoeba invadens
TAMKQETCG

SEQ ID NO: 3037692 - protein, 5 aa, Entamoeba invadens
TANRH

SEQ ID NO: 3037693 - protein, 7 aa, Entamoeba invadens
TAPKERQ

SEQ ID NO: 3037694 - protein, 12 aa, Entamoeba invadens
TAQQRNDKCEFT

SEQ ID NO: 3037695 - protein, 6 aa, Entamoeba invadens
TAQSDI

SEQ ID NO: 3037696 - protein, 25 aa, Entamoeba invadens
TAQVGQKLKDTVQEVQTKNSNIDNL

SEQ ID NO: 3037697 - protein, 7 aa, Entamoeba invadens
TARGGKY

SEQ ID NO: 3037698 - protein, 5 aa, Entamoeba invadens
TARPT

SEQ ID NO: 3037699 - protein, 14 aa, Entamoeba invadens
TASFDDYKNPKYQF

SEQ ID NO: 3037700 - protein, 17 aa, Entamoeba invadens
TASGECLGNASNDTITS

SEQ ID NO: 3037701 - protein, 6 aa, Entamoeba invadens
TASQRL

SEQ ID NO: 3037702 - protein, 11 aa, Entamoeba invadens
TASVVKGEKGF

SEQ ID NO: 3037703 - protein, 24 aa, Entamoeba invadens
TATAHTGKQSVHCKDTKTDSATGI

SEQ ID NO: 3037704 - protein, 5 aa, Entamoeba invadens
TATEE

SEQ ID NO: 3037705 - protein, 14 aa, Entamoeba invadens
TATGCSKCKADQTT

SEQ ID NO: 3037706 - protein, 6 aa, Entamoeba invadens
TATNTC

SEQ ID NO: 3037707 - protein, 8 aa, Entamoeba invadens
TATPYPQY

SEQ ID NO: 3037708 - protein, 7 aa, Entamoeba invadens
TATSQTY

SEQ ID NO: 3037709 - protein, 36 aa, Entamoeba invadens
TATTQCSKCTGNNKLSPDKTKCTSSCQEGQYESTAN

SEQ ID NO: 3037710 - protein, 9 aa, Entamoeba invadens
TAVPRAQDS

SEQ ID NO: 3037711 - protein, 5 aa, Entamoeba invadens
TCAQN

SEQ ID NO: 3037712 - protein, 13 aa, Entamoeba invadens
TCASTGCNTQTGA

SEQ ID NO: 3037713 - protein, 7 aa, Entamoeba invadens
TCDENGQ

SEQ ID NO: 3037714 - protein, 5 aa, Entamoeba invadens
TCDKY

SEQ ID NO: 3037715 - protein, 9 aa, Entamoeba invadens
TCDSPPGVE

SEQ ID NO: 3037716 - protein, 13 aa, Entamoeba invadens
TCDSRKSQGKKWG

SEQ ID NO: 3037717 - protein, 15 aa, Entamoeba invadens
TCDSTNGKCTYTRHN

SEQ ID NO: 3037718 - protein, 21 aa, Entamoeba invadens
TCDTGYKARDASESVKQIAGG

SEQ ID NO: 3037719 - protein, 12 aa, Entamoeba invadens
TCEEVAKGTAQK

SEQ ID NO: 3037720 - protein, 12 aa, Entamoeba invadens
TCFTSTTGKYDG

SEQ ID NO: 3037721 - protein, 15 aa, Entamoeba invadens
TCGGACNGSNGFCTT

SEQ ID NO: 3037722 - protein, 16 aa, Entamoeba invadens
TCGGSCSDSTGYCSSC

SEQ ID NO: 3037723 - protein, 8 aa, Entamoeba invadens
TCGNGYEA

SEQ ID NO: 3037724 - protein, 5 aa, Entamoeba invadens
TCGSS

SEQ ID NO: 3037725 - protein, 16 aa, Entamoeba invadens
TCGSSCSDSTGYCSSC

SEQ ID NO: 3037726 - protein, 15 aa, Entamoeba invadens
TCGSSCSDSTRYCSS

SEQ ID NO: 3037727 - protein, 4 aa, Entamoeba invadens
TCKK

SEQ ID NO: 3037728 - protein, 10 aa, Entamoeba invadens
TCNAKEGIDP

SEQ ID NO: 3037729 - protein, 6 aa, Entamoeba invadens
TCNDTA

SEQ ID NO: 3037730 - protein, 15 aa, Entamoeba invadens
TCNEKNSLNFTTTKK

SEQ ID NO: 3037731 - protein, 5 aa, Entamoeba invadens
TCNET

SEQ ID NO: 3037732 - protein, 9 aa, Entamoeba invadens
TCNGPNKND

SEQ ID NO: 3037733 - protein, 9 aa, Entamoeba invadens
TCNGTGPEN

SEQ ID NO: 3037734 - protein, 6 aa, Entamoeba invadens
TCNKNA

SEQ ID NO: 3037735 - protein, 12 aa, Entamoeba invadens
TCNSNNGQFACS

SEQ ID NO: 3037736 - protein, 8 aa, Entamoeba invadens
TCNSNYSR

SEQ ID NO: 3037737 - protein, 13 aa, Entamoeba invadens
TCPAGTYQSGGSC

SEQ ID NO: 3037738 - protein, 6 aa, Entamoeba invadens
TCPGTL

SEQ ID NO: 3037739 - protein, 4 aa, Entamoeba invadens
TCQG

SEQ ID NO: 3037740 - protein, 10 aa, Entamoeba invadens
TCQPNGSNDV

SEQ ID NO: 3037741 - protein, 11 aa, Entamoeba invadens
TCQQNECNTAN

SEQ ID NO: 3037742 - protein, 6 aa, Entamoeba invadens
TCSKCP

SEQ ID NO: 3037743 - protein, 5 aa, Entamoeba invadens
TCSNA

SEQ ID NO: 3037744 - protein, 10 aa, Entamoeba invadens
TCSSNDVTSC

SEQ ID NO: 3037745 - protein, 8 aa, Entamoeba invadens
TCSSSGLG

SEQ ID NO: 3037746 - protein, 23 aa, Entamoeba invadens
TCSTPAATPVKKWSNRPKTTCYT

SEQ ID NO: 3037747 - protein, 6 aa, Entamoeba invadens
TCTQCN

SEQ ID NO: 3037748 - protein, 4 aa, Entamoeba invadens
TCTR

SEQ ID NO: 3037749 - protein, 6 aa, Entamoeba invadens
TCTSKN

SEQ ID NO: 3037750 - protein, 11 aa, Entamoeba invadens
TCTTNNPTKCE

SEQ ID NO: 3037751 - protein, 5 aa, Entamoeba invadens
TCTTS

SEQ ID NO: 3037752 - protein, 10 aa, Entamoeba invadens
TCYGGSNTEC

SEQ ID NO: 3037753 - protein, 10 aa, Entamoeba invadens
TCYNGTSDDC

SEQ ID NO: 3037754 - protein, 7 aa, Entamoeba invadens
TDAAKTS

SEQ ID NO: 3037755 - protein, 9 aa, Entamoeba invadens
TDAASSTHI

SEQ ID NO: 3037756 - protein, 5 aa, Entamoeba invadens
TDAEN

SEQ ID NO: 3037757 - protein, 4 aa, Entamoeba invadens
TDDG

SEQ ID NO: 3037758 - protein, 7 aa, Entamoeba invadens
TDDGEVE

SEQ ID NO: 3037759 - protein, 18 aa, Entamoeba invadens
TDEDNCLNDNGEFNDKKR

SEQ ID NO: 3037760 - protein, 9 aa, Entamoeba invadens
TDEEPFPTQ

SEQ ID NO: 3037761 - protein, 18 aa, Entamoeba invadens
TDEGWAGQKQFKNKPDLH

SEQ ID NO: 3037762 - protein, 7 aa, Entamoeba invadens
TDEITTA

SEQ ID NO: 3037763 - protein, 7 aa, Entamoeba invadens
TDEPGSQ

SEQ ID NO: 3037764 - protein, 7 aa, Entamoeba invadens
TDETSDG

SEQ ID NO: 3037765 - protein, 7 aa, Entamoeba invadens
TDFGSAR

SEQ ID NO: 3037766 - protein, 8 aa, Entamoeba invadens
TDFGSSRN

SEQ ID NO: 3037767 - protein, 5 aa, Entamoeba invadens
TDGNS

SEQ ID NO: 3037768 - protein, 15 aa, Entamoeba invadens
TDGNSTFYEETSRTV

SEQ ID NO: 3037769 - protein, 9 aa, Entamoeba invadens
TDGSTEAIE

SEQ ID NO: 3037770 - protein, 5 aa, Entamoeba invadens
TDIGK

SEQ ID NO: 3037771 - protein, 5 aa, Entamoeba invadens
TDKGV

SEQ ID NO: 3037772 - protein, 10 aa, Entamoeba invadens
TDKKEGYQTK

SEQ ID NO: 3037773 - protein, 14 aa, Entamoeba invadens
TDKLAKKPRNQIAS

SEQ ID NO: 3037774 - protein, 7 aa, Entamoeba invadens
TDKPSFD

SEQ ID NO: 3037775 - protein, 8 aa, Entamoeba invadens
TDLSNSDY

SEQ ID NO: 3037776 - protein, 13 aa, Entamoeba invadens
TDLTDTAKKYQKG

SEQ ID NO: 3037777 - protein, 10 aa, Entamoeba invadens
TDNLQPDNKS

SEQ ID NO: 3037778 - protein, 8 aa, Entamoeba invadens
TDNNHNKT

SEQ ID NO: 3037779 - protein, 8 aa, Entamoeba invadens
TDPKSTQC

SEQ ID NO: 3037780 - protein, 14 aa, Entamoeba invadens
TDPLTEGKPGATIA

SEQ ID NO: 3037781 - protein, 6 aa, Entamoeba invadens
TDPNEN

SEQ ID NO: 3037782 - protein, 8 aa, Entamoeba invadens
TDQINRGD

SEQ ID NO: 3037783 - protein, 4 aa, Entamoeba invadens
TDQN

SEQ ID NO: 3037784 - protein, 9 aa, Entamoeba invadens
TDRVGEKKK

SEQ ID NO: 3037785 - protein, 14 aa, Entamoeba invadens
TDSNYSPNYSPQTF

SEQ ID NO: 3037786 - protein, 10 aa, Entamoeba invadens
TDTNTQNSYS

SEQ ID NO: 3037787 - protein, 4 aa, Entamoeba invadens
TDTQ

SEQ ID NO: 3037788 - protein, 5 aa, Entamoeba invadens
TDVEE

SEQ ID NO: 3037789 - protein, 11 aa, Entamoeba invadens
TDYTPQGNETI

SEQ ID NO: 3037790 - protein, 17 aa, Entamoeba invadens
TEAAKKYKKVSKDSASK

SEQ ID NO: 3037791 - protein, 7 aa, Entamoeba invadens
TEAECTQ

SEQ ID NO: 3037792 - protein, 10 aa, Entamoeba invadens
TECSAGTYSV

SEQ ID NO: 3037793 - protein, 13 aa, Entamoeba invadens
TECTDDAREPLTN

SEQ ID NO: 3037794 - protein, 11 aa, Entamoeba invadens
TEDCSGTADKT

SEQ ID NO: 3037795 - protein, 168 aa, Entamoeba invadens
TEDFNDKSKSSKKKSATKSAKKKQKKSAAAPKPKKSTKSAATKQKKSAAKAQKKAAKAQQKKQKSQAKAQKKQQKAEKKAQKNQQKQLKNQAKAEKKQQKAEKKAAKAQQKQQKNQTKADKKQQKAEKKAQKAEQKQLKKQQKAEKKAERKKKSAEKSAEKRALRKEK

SEQ ID NO: 3037796 - protein, 16 aa, Entamoeba invadens
TEDLNSKSEVVYSDGD

SEQ ID NO: 3037797 - protein, 5 aa, Entamoeba invadens
TEDNT

SEQ ID NO: 3037798 - protein, 5 aa, Entamoeba invadens
TEDTV

SEQ ID NO: 3037799 - protein, 8 aa, Entamoeba invadens
TEEDGTKT

SEQ ID NO: 3037800 - protein, 14 aa, Entamoeba invadens
TEEEIGEVNTCDTN

SEQ ID NO: 3037801 - protein, 10 aa, Entamoeba invadens
TEEEKANVAE

SEQ ID NO: 3037802 - protein, 6 aa, Entamoeba invadens
TEEGRK

SEQ ID NO: 3037803 - protein, 5 aa, Entamoeba invadens
TEEMQ

SEQ ID NO: 3037804 - protein, 10 aa, Entamoeba invadens
TEERGTEKGD

SEQ ID NO: 3037805 - protein, 4 aa, Entamoeba invadens
TEES

SEQ ID NO: 3037806 - protein, 7 aa, Entamoeba invadens
TEETTDP

SEQ ID NO: 3037807 - protein, 11 aa, Entamoeba invadens
TEFDPNMSKGT

SEQ ID NO: 3037808 - protein, 16 aa, Entamoeba invadens
TEGDVNAAVDEGARTI

SEQ ID NO: 3037809 - protein, 17 aa, Entamoeba invadens
TEGEFDVTKPNSFASTR

SEQ ID NO: 3037810 - protein, 5 aa, Entamoeba invadens
TEGGR

SEQ ID NO: 3037811 - protein, 13 aa, Entamoeba invadens
TEGIEDFKEDNTH

SEQ ID NO: 3037812 - protein, 6 aa, Entamoeba invadens
TEGKEI

SEQ ID NO: 3037813 - protein, 12 aa, Entamoeba invadens
TEIEDSKDTDLQ

SEQ ID NO: 3037814 - protein, 6 aa, Entamoeba invadens
TEITGT

SEQ ID NO: 3037815 - protein, 9 aa, Entamoeba invadens
TEKECKEYY

SEQ ID NO: 3037816 - protein, 29 aa, Entamoeba invadens
TEKEEAQNAAAKAKKQAKQYTRKVEEAER

SEQ ID NO: 3037817 - protein, 9 aa, Entamoeba invadens
TELDSDSDM

SEQ ID NO: 3037818 - protein, 4 aa, Entamoeba invadens
TELG

SEQ ID NO: 3037819 - protein, 8 aa, Entamoeba invadens
TELGSDSD

SEQ ID NO: 3037820 - protein, 6 aa, Entamoeba invadens
TELTKD

SEQ ID NO: 3037821 - protein, 22 aa, Entamoeba invadens
TEMSTRLDPNEINEEKKLGEGS

SEQ ID NO: 3037822 - protein, 6 aa, Entamoeba invadens
TENQKD

SEQ ID NO: 3037823 - protein, 7 aa, Entamoeba invadens
TENREKY

SEQ ID NO: 3037824 - protein, 15 aa, Entamoeba invadens
TEPGSATIEYRPYRP

SEQ ID NO: 3037825 - protein, 4 aa, Entamoeba invadens
TEPK

SEQ ID NO: 3037826 - protein, 6 aa, Entamoeba invadens
TEPKDV

SEQ ID NO: 3037827 - protein, 4 aa, Entamoeba invadens
TESF

SEQ ID NO: 3037828 - protein, 5 aa, Entamoeba invadens
TESPS

SEQ ID NO: 3037829 - protein, 9 aa, Entamoeba invadens
TESSGLEEG

SEQ ID NO: 3037830 - protein, 5 aa, Entamoeba invadens
TETIS

SEQ ID NO: 3037831 - protein, 10 aa, Entamoeba invadens
TETTPFNGDA

SEQ ID NO: 3037832 - protein, 8 aa, Entamoeba invadens
TETTPKHF

SEQ ID NO: 3037833 - protein, 6 aa, Entamoeba invadens
TEVNDN

SEQ ID NO: 3037834 - protein, 4 aa, Entamoeba invadens
TEVS

SEQ ID NO: 3037835 - protein, 14 aa, Entamoeba invadens
TEYTRTGSTLKSTG

SEQ ID NO: 3037836 - protein, 9 aa, Entamoeba invadens
TFANESEKK

SEQ ID NO: 3037837 - protein, 11 aa, Entamoeba invadens
TFDEKSQAKDF

SEQ ID NO: 3037838 - protein, 4 aa, Entamoeba invadens
TFDQ

SEQ ID NO: 3037839 - protein, 5 aa, Entamoeba invadens
TFEKK

SEQ ID NO: 3037840 - protein, 12 aa, Entamoeba invadens
TFGGSYKISGES

SEQ ID NO: 3037841 - protein, 5 aa, Entamoeba invadens
TFHNT

SEQ ID NO: 3037842 - protein, 11 aa, Entamoeba invadens
TFSPNSGSIKC

SEQ ID NO: 3037843 - protein, 4 aa, Entamoeba invadens
TFTN

SEQ ID NO: 3037844 - protein, 11 aa, Entamoeba invadens
TFVPNSDASAN

SEQ ID NO: 3037845 - protein, 16 aa, Entamoeba invadens
TFYNNTKKSVIKSGDV

SEQ ID NO: 3037846 - protein, 6 aa, Entamoeba invadens
TGAKCS

SEQ ID NO: 3037847 - protein, 6 aa, Entamoeba invadens
TGAKDG

SEQ ID NO: 3037848 - protein, 12 aa, Entamoeba invadens
TGCSTGSCSANS

SEQ ID NO: 3037849 - protein, 9 aa, Entamoeba invadens
TGDNEHSTQ

SEQ ID NO: 3037850 - protein, 14 aa, Entamoeba invadens
TGDNNPDTLNNQNN

SEQ ID NO: 3037851 - protein, 6 aa, Entamoeba invadens
TGECTS

SEQ ID NO: 3037852 - protein, 8 aa, Entamoeba invadens
TGENGPLD

SEQ ID NO: 3037853 - protein, 10 aa, Entamoeba invadens
TGFNKDEQDL

SEQ ID NO: 3037854 - protein, 9 aa, Entamoeba invadens
TGGAAPDIK

SEQ ID NO: 3037855 - protein, 4 aa, Entamoeba invadens
TGGE

SEQ ID NO: 3037856 - protein, 5 aa, Entamoeba invadens
TGGFA

SEQ ID NO: 3037857 - protein, 33 aa, Entamoeba invadens
TGGLSPSGSTQVMSNSPTSGIKNGGTSGSTQNG

SEQ ID NO: 3037858 - protein, 6 aa, Entamoeba invadens
TGGNTY

SEQ ID NO: 3037859 - protein, 9 aa, Entamoeba invadens
TGGQSSATR

SEQ ID NO: 3037860 - protein, 18 aa, Entamoeba invadens
TGKCKPQVNNNNRDKAEG

SEQ ID NO: 3037861 - protein, 20 aa, Entamoeba invadens
TGKITTDKKCDSSANACGNG

SEQ ID NO: 3037862 - protein, 4 aa, Entamoeba invadens
TGKL

SEQ ID NO: 3037863 - protein, 4 aa, Entamoeba invadens
TGKN

SEQ ID NO: 3037864 - protein, 6 aa, Entamoeba invadens
TGKQTI

SEQ ID NO: 3037865 - protein, 8 aa, Entamoeba invadens
TGKRVTVN

SEQ ID NO: 3037866 - protein, 8 aa, Entamoeba invadens
TGKSYSGT

SEQ ID NO: 3037867 - protein, 5 aa, Entamoeba invadens
TGKTV

SEQ ID NO: 3037868 - protein, 8 aa, Entamoeba invadens
TGNEEQEY

SEQ ID NO: 3037869 - protein, 5 aa, Entamoeba invadens
TGNIK

SEQ ID NO: 3037870 - protein, 4 aa, Entamoeba invadens
TGPS

SEQ ID NO: 3037871 - protein, 6 aa, Entamoeba invadens
TGPSQK

SEQ ID NO: 3037872 - protein, 7 aa, Entamoeba invadens
TGPSQTN

SEQ ID NO: 3037873 - protein, 7 aa, Entamoeba invadens
TGPTQRS

SEQ ID NO: 3037874 - protein, 4 aa, Entamoeba invadens
TGRK

SEQ ID NO: 3037875 - protein, 4 aa, Entamoeba invadens
TGSN

SEQ ID NO: 3037876 - protein, 6 aa, Entamoeba invadens
TGSRDS

SEQ ID NO: 3037877 - protein, 13 aa, Entamoeba invadens
TGSYSPRYNQTNG

SEQ ID NO: 3037878 - protein, 14 aa, Entamoeba invadens
TGTDSNCGSTPANL

SEQ ID NO: 3037879 - protein, 6 aa, Entamoeba invadens
TGTPIT

SEQ ID NO: 3037880 - protein, 6 aa, Entamoeba invadens
TGTYSV

SEQ ID NO: 3037881 - protein, 11 aa, Entamoeba invadens
TGVLRSNESTY

SEQ ID NO: 3037882 - protein, 7 aa, Entamoeba invadens
TGYGNEK

SEQ ID NO: 3037883 - protein, 6 aa, Entamoeba invadens
TGYYSS

SEQ ID NO: 3037884 - protein, 6 aa, Entamoeba invadens
TGYYTT

SEQ ID NO: 3037885 - protein, 5 aa, Entamoeba invadens
THDSN

SEQ ID NO: 3037886 - protein, 5 aa, Entamoeba invadens
THENT

SEQ ID NO: 3037887 - protein, 4 aa, Entamoeba invadens
THNE

SEQ ID NO: 3037888 - protein, 8 aa, Entamoeba invadens
THNGQART

SEQ ID NO: 3037889 - protein, 6 aa, Entamoeba invadens
THNKKY

SEQ ID NO: 3037890 - protein, 10 aa, Entamoeba invadens
THSDEGHEGD

SEQ ID NO: 3037891 - protein, 5 aa, Entamoeba invadens
THSDP

SEQ ID NO: 3037892 - protein, 13 aa, Entamoeba invadens
THSDPDQNKVEHE

SEQ ID NO: 3037893 - protein, 11 aa, Entamoeba invadens
THSNTGNTNSC

SEQ ID NO: 3037894 - protein, 7 aa, Entamoeba invadens
THSRTKE

SEQ ID NO: 3037895 - protein, 9 aa, Entamoeba invadens
THSVSYSQR

SEQ ID NO: 3037896 - protein, 11 aa, Entamoeba invadens
THTDNQYSVGS

SEQ ID NO: 3037897 - protein, 14 aa, Entamoeba invadens
THTNAKQQNEDCIM

SEQ ID NO: 3037898 - protein, 4 aa, Entamoeba invadens
TIDG

SEQ ID NO: 3037899 - protein, 8 aa, Entamoeba invadens
TIDYPGEY

SEQ ID NO: 3037900 - protein, 9 aa, Entamoeba invadens
TIEDGPVPF

SEQ ID NO: 3037901 - protein, 6 aa, Entamoeba invadens
TIEDTY

SEQ ID NO: 3037902 - protein, 5 aa, Entamoeba invadens
TIEND

SEQ ID NO: 3037903 - protein, 8 aa, Entamoeba invadens
TIEPEGGH

SEQ ID NO: 3037904 - protein, 4 aa, Entamoeba invadens
TIER

SEQ ID NO: 3037905 - protein, 9 aa, Entamoeba invadens
TIETKPETQ

SEQ ID NO: 3037906 - protein, 7 aa, Entamoeba invadens
TIETPKC

SEQ ID NO: 3037907 - protein, 6 aa, Entamoeba invadens
TIGGLS

SEQ ID NO: 3037908 - protein, 16 aa, Entamoeba invadens
TIGMKKGDKGWEPQAG

SEQ ID NO: 3037909 - protein, 11 aa, Entamoeba invadens
TIGYSSQRTLT

SEQ ID NO: 3037910 - protein, 13 aa, Entamoeba invadens
TIKTERHAKEEMD

SEQ ID NO: 3037911 - protein, 8 aa, Entamoeba invadens
TINDDTKL

SEQ ID NO: 3037912 - protein, 7 aa, Entamoeba invadens
TINEDEG

SEQ ID NO: 3037913 - protein, 6 aa, Entamoeba invadens
TIPKST

SEQ ID NO: 3037914 - protein, 5 aa, Entamoeba invadens
TIPTE

SEQ ID NO: 3037915 - protein, 10 aa, Entamoeba invadens
TISEKKQVAP

SEQ ID NO: 3037916 - protein, 8 aa, Entamoeba invadens
TISTSENA

SEQ ID NO: 3037917 - protein, 10 aa, Entamoeba invadens
TITGKSTHMT

SEQ ID NO: 3037918 - protein, 10 aa, Entamoeba invadens
TITNPKCADG

SEQ ID NO: 3037919 - protein, 5 aa, Entamoeba invadens
TITNS

SEQ ID NO: 3037920 - protein, 4 aa, Entamoeba invadens
TITS

SEQ ID NO: 3037921 - protein, 8 aa, Entamoeba invadens
TITSTPGV

SEQ ID NO: 3037922 - protein, 7 aa, Entamoeba invadens
TKCASSV

SEQ ID NO: 3037923 - protein, 11 aa, Entamoeba invadens
TKCDGCDATNG

SEQ ID NO: 3037924 - protein, 16 aa, Entamoeba invadens
TKCDQTQGCTTCNGGY

SEQ ID NO: 3037925 - protein, 8 aa, Entamoeba invadens
TKCGENEY

SEQ ID NO: 3037926 - protein, 13 aa, Entamoeba invadens
TKCGNTPKETVSY

SEQ ID NO: 3037927 - protein, 10 aa, Entamoeba invadens
TKCGSGTDLI

SEQ ID NO: 3037928 - protein, 6 aa, Entamoeba invadens
TKCTDG

SEQ ID NO: 3037929 - protein, 10 aa, Entamoeba invadens
TKDCSGTAIK

SEQ ID NO: 3037930 - protein, 5 aa, Entamoeba invadens
TKDEI

SEQ ID NO: 3037931 - protein, 27 aa, Entamoeba invadens
TKDERSKYTDCTNYNPTPVYPEDHTNS

SEQ ID NO: 3037932 - protein, 19 aa, Entamoeba invadens
TKDFQDGNFTYGDGDGTVD

SEQ ID NO: 3037933 - protein, 9 aa, Entamoeba invadens
TKDNKKQNV

SEQ ID NO: 3037934 - protein, 9 aa, Entamoeba invadens
TKDPSQQYR

SEQ ID NO: 3037935 - protein, 19 aa, Entamoeba invadens
TKDSSTYTVSDSQNSKSHT

SEQ ID NO: 3037936 - protein, 6 aa, Entamoeba invadens
TKDTKA

SEQ ID NO: 3037937 - protein, 4 aa, Entamoeba invadens
TKEA

SEQ ID NO: 3037938 - protein, 19 aa, Entamoeba invadens
TKEDGYDKRHPDNNNDSAV

SEQ ID NO: 3037939 - protein, 8 aa, Entamoeba invadens
TKEDRTKV

SEQ ID NO: 3037940 - protein, 7 aa, Entamoeba invadens
TKEDRVD

SEQ ID NO: 3037941 - protein, 13 aa, Entamoeba invadens
TKEELNKTKHEIG

SEQ ID NO: 3037942 - protein, 6 aa, Entamoeba invadens
TKEGMY

SEQ ID NO: 3037943 - protein, 8 aa, Entamoeba invadens
TKEKENPL

SEQ ID NO: 3037944 - protein, 12 aa, Entamoeba invadens
TKEKQKAIGKAE

SEQ ID NO: 3037945 - protein, 8 aa, Entamoeba invadens
TKELEKTT

SEQ ID NO: 3037946 - protein, 7 aa, Entamoeba invadens
TKETFTE

SEQ ID NO: 3037947 - protein, 15 aa, Entamoeba invadens
TKEVITNDGTIRVST

SEQ ID NO: 3037948 - protein, 5 aa, Entamoeba invadens
TKGKT

SEQ ID NO: 3037949 - protein, 40 aa, Entamoeba invadens
TKGNTLSRDDSVTESATESTSNSATPSGIKHNGTKKYIPP

SEQ ID NO: 3037950 - protein, 29 aa, Entamoeba invadens
TKGQSDERRPIYTPKEGVDKESPSPREDI

SEQ ID NO: 3037951 - protein, 20 aa, Entamoeba invadens
TKGSVKEEVDNKRDQLSVTQ

SEQ ID NO: 3037952 - protein, 4 aa, Entamoeba invadens
TKGV

SEQ ID NO: 3037953 - protein, 4 aa, Entamoeba invadens
TKII

SEQ ID NO: 3037954 - protein, 23 aa, Entamoeba invadens
TKKCTENADCPSNYYKDNDNKKC

SEQ ID NO: 3037955 - protein, 5 aa, Entamoeba invadens
TKKCV

SEQ ID NO: 3037956 - protein, 7 aa, Entamoeba invadens
TKKDGNV

SEQ ID NO: 3037957 - protein, 14 aa, Entamoeba invadens
TKKGRSYTTDTNDY

SEQ ID NO: 3037958 - protein, 4 aa, Entamoeba invadens
TKKQ

SEQ ID NO: 3037959 - protein, 8 aa, Entamoeba invadens
TKKQLERE

SEQ ID NO: 3037960 - protein, 7 aa, Entamoeba invadens
TKKRERK

SEQ ID NO: 3037961 - protein, 19 aa, Entamoeba invadens
TKKSKKQNCSRSVSAVPSQ

SEQ ID NO: 3037962 - protein, 7 aa, Entamoeba invadens
TKKSNRM

SEQ ID NO: 3037963 - protein, 8 aa, Entamoeba invadens
TKKTCVSK

SEQ ID NO: 3037964 - protein, 13 aa, Entamoeba invadens
TKKVTPKASKGKK

SEQ ID NO: 3037965 - protein, 26 aa, Entamoeba invadens
TKLKEAKAKKVAKEAIKEKKAQIIEE

SEQ ID NO: 3037966 - protein, 12 aa, Entamoeba invadens
TKLTPQQKAELA

SEQ ID NO: 3037967 - protein, 6 aa, Entamoeba invadens
TKMSTN

SEQ ID NO: 3037968 - protein, 6 aa, Entamoeba invadens
TKNCVK

SEQ ID NO: 3037969 - protein, 10 aa, Entamoeba invadens
TKNDRFNPTP

SEQ ID NO: 3037970 - protein, 6 aa, Entamoeba invadens
TKNGAL

SEQ ID NO: 3037971 - protein, 8 aa, Entamoeba invadens
TKNKDSNN

SEQ ID NO: 3037972 - protein, 5 aa, Entamoeba invadens
TKNVP

SEQ ID NO: 3037973 - protein, 32 aa, Entamoeba invadens
TKPHKAIQKQTEINAAEKQNQKSLQSIGVHHD

SEQ ID NO: 3037974 - protein, 8 aa, Entamoeba invadens
TKPKHVHS

SEQ ID NO: 3037975 - protein, 6 aa, Entamoeba invadens
TKPQTL

SEQ ID NO: 3037976 - protein, 9 aa, Entamoeba invadens
TKPSQDVFT

SEQ ID NO: 3037977 - protein, 11 aa, Entamoeba invadens
TKPTKNTIGKS

SEQ ID NO: 3037978 - protein, 6 aa, Entamoeba invadens
TKQIEK

SEQ ID NO: 3037979 - protein, 25 aa, Entamoeba invadens
TKQLEEEIKEKDSVITNNKEKIDQM

SEQ ID NO: 3037980 - protein, 5 aa, Entamoeba invadens
TKRAF

SEQ ID NO: 3037981 - protein, 9 aa, Entamoeba invadens
TKRDTNRHG

SEQ ID NO: 3037982 - protein, 6 aa, Entamoeba invadens
TKRRIQ

SEQ ID NO: 3037983 - protein, 21 aa, Entamoeba invadens
TKSGDCNGAYDDNMARTDGHI

SEQ ID NO: 3037984 - protein, 6 aa, Entamoeba invadens
TKSGQC

SEQ ID NO: 3037985 - protein, 4 aa, Entamoeba invadens
TKSK

SEQ ID NO: 3037986 - protein, 7 aa, Entamoeba invadens
TKSLKLK

SEQ ID NO: 3037987 - protein, 9 aa, Entamoeba invadens
TKSLPCDNE

SEQ ID NO: 3037988 - protein, 10 aa, Entamoeba invadens
TKSRSSSKCF

SEQ ID NO: 3037989 - protein, 5 aa, Entamoeba invadens
TKTAY

SEQ ID NO: 3037990 - protein, 25 aa, Entamoeba invadens
TKTGGETRSTWDGNRNLQTTTTSYQ

SEQ ID NO: 3037991 - protein, 9 aa, Entamoeba invadens
TKTKESNSI

SEQ ID NO: 3037992 - protein, 10 aa, Entamoeba invadens
TKTSDEEKKL

SEQ ID NO: 3037993 - protein, 8 aa, Entamoeba invadens
TKTTNYST

SEQ ID NO: 3037994 - protein, 12 aa, Entamoeba invadens
TKVAKRNNDALK

SEQ ID NO: 3037995 - protein, 20 aa, Entamoeba invadens
TKVGESCERCTQTNCEKCKN

SEQ ID NO: 3037996 - protein, 5 aa, Entamoeba invadens
TKWEM

SEQ ID NO: 3037997 - protein, 6 aa, Entamoeba invadens
TKYDST

SEQ ID NO: 3037998 - protein, 8 aa, Entamoeba invadens
TKYEGGVE

SEQ ID NO: 3037999 - protein, 8 aa, Entamoeba invadens
TKYISTDK

SEQ ID NO: 3038000 - protein, 8 aa, Entamoeba invadens
TKYSDPVQ

SEQ ID NO: 3038001 - protein, 9 aa, Entamoeba invadens
TLADYPKDL

SEQ ID NO: 3038002 - protein, 11 aa, Entamoeba invadens
TLANTGTYARN

SEQ ID NO: 3038003 - protein, 9 aa, Entamoeba invadens
TLDTTSYTT

SEQ ID NO: 3038004 - protein, 8 aa, Entamoeba invadens
TLEENPDE

SEQ ID NO: 3038005 - protein, 11 aa, Entamoeba invadens
TLEESKLEGAK

SEQ ID NO: 3038006 - protein, 16 aa, Entamoeba invadens
TLENGINEKEKRVTEL

SEQ ID NO: 3038007 - protein, 11 aa, Entamoeba invadens
TLETKYQQTKT

SEQ ID NO: 3038008 - protein, 6 aa, Entamoeba invadens
TLGEES

SEQ ID NO: 3038009 - protein, 24 aa, Entamoeba invadens
TLGTNSEIGSGSDCSKRSDQHLRE

SEQ ID NO: 3038010 - protein, 18 aa, Entamoeba invadens
TLHKRSRLQNQTDCDATS

SEQ ID NO: 3038011 - protein, 8 aa, Entamoeba invadens
TLKDNEGK

SEQ ID NO: 3038012 - protein, 7 aa, Entamoeba invadens
TLNTNGV

SEQ ID NO: 3038013 - protein, 28 aa, Entamoeba invadens
TLPNETTKQTTKNEETQTDSHCEVSTTK

SEQ ID NO: 3038014 - protein, 5 aa, Entamoeba invadens
TLPNQ

SEQ ID NO: 3038015 - protein, 18 aa, Entamoeba invadens
TLPPPQNEEQQSRRRHHS

SEQ ID NO: 3038016 - protein, 6 aa, Entamoeba invadens
TLPQGT

SEQ ID NO: 3038017 - protein, 6 aa, Entamoeba invadens
TLPQTN

SEQ ID NO: 3038018 - protein, 11 aa, Entamoeba invadens
TLQTNSSECYQ

SEQ ID NO: 3038019 - protein, 17 aa, Entamoeba invadens
TLSGNGPIISESSEKEI

SEQ ID NO: 3038020 - protein, 4 aa, Entamoeba invadens
TLSQ

SEQ ID NO: 3038021 - protein, 8 aa, Entamoeba invadens
TLSQTSGF

SEQ ID NO: 3038022 - protein, 5 aa, Entamoeba invadens
TLSTD

SEQ ID NO: 3038023 - protein, 8 aa, Entamoeba invadens
TLTEDRTR

SEQ ID NO: 3038024 - protein, 9 aa, Entamoeba invadens
TLTSISTNS

SEQ ID NO: 3038025 - protein, 13 aa, Entamoeba invadens
TLTTANGGCELKS

SEQ ID NO: 3038026 - protein, 7 aa, Entamoeba invadens
TMPSSGE

SEQ ID NO: 3038027 - protein, 5 aa, Entamoeba invadens
TMSEI

SEQ ID NO: 3038028 - protein, 6 aa, Entamoeba invadens
TMSQGS

SEQ ID NO: 3038029 - protein, 16 aa, Entamoeba invadens
TMTQKQAKRTREAQLN

SEQ ID NO: 3038030 - protein, 14 aa, Entamoeba invadens
TNADGGKTIEGRGQ

SEQ ID NO: 3038031 - protein, 8 aa, Entamoeba invadens
TNADGIAN

SEQ ID NO: 3038032 - protein, 6 aa, Entamoeba invadens
TNAEEK

SEQ ID NO: 3038033 - protein, 6 aa, Entamoeba invadens
TNATFE

SEQ ID NO: 3038034 - protein, 7 aa, Entamoeba invadens
TNDAYGK

SEQ ID NO: 3038035 - protein, 5 aa, Entamoeba invadens
TNDLG

SEQ ID NO: 3038036 - protein, 6 aa, Entamoeba invadens
TNDQRQ

SEQ ID NO: 3038037 - protein, 10 aa, Entamoeba invadens
TNDSYPQGTS

SEQ ID NO: 3038038 - protein, 4 aa, Entamoeba invadens
TNDV

SEQ ID NO: 3038039 - protein, 5 aa, Entamoeba invadens
TNECD

SEQ ID NO: 3038040 - protein, 10 aa, Entamoeba invadens
TNEDGSVTEE

SEQ ID NO: 3038041 - protein, 10 aa, Entamoeba invadens
TNEDYKNNNG

SEQ ID NO: 3038042 - protein, 5 aa, Entamoeba invadens
TNEEF

SEQ ID NO: 3038043 - protein, 5 aa, Entamoeba invadens
TNENV

SEQ ID NO: 3038044 - protein, 6 aa, Entamoeba invadens
TNESSV

SEQ ID NO: 3038045 - protein, 13 aa, Entamoeba invadens
TNFDGTGGESIYG

SEQ ID NO: 3038046 - protein, 4 aa, Entamoeba invadens
TNFY

SEQ ID NO: 3038047 - protein, 6 aa, Entamoeba invadens
TNGGVD

SEQ ID NO: 3038048 - protein, 7 aa, Entamoeba invadens
TNGKSVN

SEQ ID NO: 3038049 - protein, 6 aa, Entamoeba invadens
TNINTE

SEQ ID NO: 3038050 - protein, 8 aa, Entamoeba invadens
TNINYPDL

SEQ ID NO: 3038051 - protein, 8 aa, Entamoeba invadens
TNKDTCSK

SEQ ID NO: 3038052 - protein, 5 aa, Entamoeba invadens
TNKEL

SEQ ID NO: 3038053 - protein, 12 aa, Entamoeba invadens
TNKFNPTPRACP

SEQ ID NO: 3038054 - protein, 16 aa, Entamoeba invadens
TNKKLNAEAKKIENAL

SEQ ID NO: 3038055 - protein, 11 aa, Entamoeba invadens
TNKKSPSEQQA

SEQ ID NO: 3038056 - protein, 10 aa, Entamoeba invadens
TNKKYSDKEQ

SEQ ID NO: 3038057 - protein, 9 aa, Entamoeba invadens
TNKNNTGDL

SEQ ID NO: 3038058 - protein, 4 aa, Entamoeba invadens
TNLN

SEQ ID NO: 3038059 - protein, 8 aa, Entamoeba invadens
TNNENSTI

SEQ ID NO: 3038060 - protein, 7 aa, Entamoeba invadens
TNNGDKY

SEQ ID NO: 3038061 - protein, 5 aa, Entamoeba invadens
TNNIT

SEQ ID NO: 3038062 - protein, 6 aa, Entamoeba invadens
TNNNEV

SEQ ID NO: 3038063 - protein, 6 aa, Entamoeba invadens
TNNPFQ

SEQ ID NO: 3038064 - protein, 5 aa, Entamoeba invadens
TNNSQ

SEQ ID NO: 3038065 - protein, 7 aa, Entamoeba invadens
TNNTFEG

SEQ ID NO: 3038066 - protein, 5 aa, Entamoeba invadens
TNNVP

SEQ ID NO: 3038067 - protein, 7 aa, Entamoeba invadens
TNNYEQN

SEQ ID NO: 3038068 - protein, 8 aa, Entamoeba invadens
TNPKSTQC

SEQ ID NO: 3038069 - protein, 4 aa, Entamoeba invadens
TNPM

SEQ ID NO: 3038070 - protein, 8 aa, Entamoeba invadens
TNPQSNQC

SEQ ID NO: 3038071 - protein, 9 aa, Entamoeba invadens
TNPSASTYC

SEQ ID NO: 3038072 - protein, 8 aa, Entamoeba invadens
TNPTGNSK

SEQ ID NO: 3038073 - protein, 5 aa, Entamoeba invadens
TNQQK

SEQ ID NO: 3038074 - protein, 6 aa, Entamoeba invadens
TNRPYS

SEQ ID NO: 3038075 - protein, 9 aa, Entamoeba invadens
TNRSKTRRC

SEQ ID NO: 3038076 - protein, 15 aa, Entamoeba invadens
TNRTNVKSTVEADND

SEQ ID NO: 3038077 - protein, 4 aa, Entamoeba invadens
TNSQ

SEQ ID NO: 3038078 - protein, 7 aa, Entamoeba invadens
TNSQYYA

SEQ ID NO: 3038079 - protein, 20 aa, Entamoeba invadens
TNSSKINNNVAGGSISSTKS

SEQ ID NO: 3038080 - protein, 6 aa, Entamoeba invadens
TNSTCK

SEQ ID NO: 3038081 - protein, 8 aa, Entamoeba invadens
TNSTTRAL

SEQ ID NO: 3038082 - protein, 8 aa, Entamoeba invadens
TNTAPRRE

SEQ ID NO: 3038083 - protein, 5 aa, Entamoeba invadens
TNTCN

SEQ ID NO: 3038084 - protein, 5 aa, Entamoeba invadens
TNTFT

SEQ ID NO: 3038085 - protein, 9 aa, Entamoeba invadens
TNTKLGNGK

SEQ ID NO: 3038086 - protein, 37 aa, Entamoeba invadens
TNTKSGSDCTGSSLETNYKELRDTTTYEKGNDGASGR

SEQ ID NO: 3038087 - protein, 6 aa, Entamoeba invadens
TNTTVP

SEQ ID NO: 3038088 - protein, 11 aa, Entamoeba invadens
TNVGKADHTGM

SEQ ID NO: 3038089 - protein, 9 aa, Entamoeba invadens
TNVSTRGRC

SEQ ID NO: 3038090 - protein, 14 aa, Entamoeba invadens
TNYENGSPNEHITP

SEQ ID NO: 3038091 - protein, 9 aa, Entamoeba invadens
TNYSAQTKH

SEQ ID NO: 3038092 - protein, 9 aa, Entamoeba invadens
TNYSAQTQY

SEQ ID NO: 3038093 - protein, 10 aa, Entamoeba invadens
TNYYPDTSTD

SEQ ID NO: 3038094 - protein, 4 aa, Entamoeba invadens
TPAL

SEQ ID NO: 3038095 - protein, 6 aa, Entamoeba invadens
TPCETG

SEQ ID NO: 3038096 - protein, 17 aa, Entamoeba invadens
TPEAGTDVNAGAPNGVQ

SEQ ID NO: 3038097 - protein, 18 aa, Entamoeba invadens
TPEAVYDGNPVNTPNGVQ

SEQ ID NO: 3038098 - protein, 5 aa, Entamoeba invadens
TPEKF

SEQ ID NO: 3038099 - protein, 7 aa, Entamoeba invadens
TPENVDP

SEQ ID NO: 3038100 - protein, 6 aa, Entamoeba invadens
TPEWED

SEQ ID NO: 3038101 - protein, 19 aa, Entamoeba invadens
TPFGQGSAYVPTTDDGTPM

SEQ ID NO: 3038102 - protein, 5 aa, Entamoeba invadens
TPGNH

SEQ ID NO: 3038103 - protein, 17 aa, Entamoeba invadens
TPGVAPAAKMAGEVTPK

SEQ ID NO: 3038104 - protein, 14 aa, Entamoeba invadens
TPIENKDKNKTQLE

SEQ ID NO: 3038105 - protein, 8 aa, Entamoeba invadens
TPIESSVD

SEQ ID NO: 3038106 - protein, 5 aa, Entamoeba invadens
TPITN

SEQ ID NO: 3038107 - protein, 4 aa, Entamoeba invadens
TPKE

SEQ ID NO: 3038108 - protein, 7 aa, Entamoeba invadens
TPKKITN

SEQ ID NO: 3038109 - protein, 10 aa, Entamoeba invadens
TPKNRRPGRQ

SEQ ID NO: 3038110 - protein, 12 aa, Entamoeba invadens
TPLESNGSISAD

SEQ ID NO: 3038111 - protein, 4 aa, Entamoeba invadens
TPLS

SEQ ID NO: 3038112 - protein, 5 aa, Entamoeba invadens
TPLSN

SEQ ID NO: 3038113 - protein, 5 aa, Entamoeba invadens
TPLTE

SEQ ID NO: 3038114 - protein, 6 aa, Entamoeba invadens
TPNISQ

SEQ ID NO: 3038115 - protein, 6 aa, Entamoeba invadens
TPNTTI

SEQ ID NO: 3038116 - protein, 12 aa, Entamoeba invadens
TPNTTQSEIDEY

SEQ ID NO: 3038117 - protein, 8 aa, Entamoeba invadens
TPPDEGAD

SEQ ID NO: 3038118 - protein, 5 aa, Entamoeba invadens
TPPEC

SEQ ID NO: 3038119 - protein, 31 aa, Entamoeba invadens
TPPEEGATGGADEVDYPTAFPQSPKKTIGQK

SEQ ID NO: 3038120 - protein, 6 aa, Entamoeba invadens
TPPGSY

SEQ ID NO: 3038121 - protein, 14 aa, Entamoeba invadens
TPPINSHQKTNELE

SEQ ID NO: 3038122 - protein, 5 aa, Entamoeba invadens
TPQQL

SEQ ID NO: 3038123 - protein, 13 aa, Entamoeba invadens
TPRESVQPISNSE

SEQ ID NO: 3038124 - protein, 10 aa, Entamoeba invadens
TPSEAAGQNI

SEQ ID NO: 3038125 - protein, 4 aa, Entamoeba invadens
TPSG

SEQ ID NO: 3038126 - protein, 27 aa, Entamoeba invadens
TPSTLGTNSEIGSGSDCYKRSDQHLRE

SEQ ID NO: 3038127 - protein, 5 aa, Entamoeba invadens
TPTKM

SEQ ID NO: 3038128 - protein, 8 aa, Entamoeba invadens
TPTLQSNT

SEQ ID NO: 3038129 - protein, 5 aa, Entamoeba invadens
TPTNG

SEQ ID NO: 3038130 - protein, 10 aa, Entamoeba invadens
TPTPYESAPV

SEQ ID NO: 3038131 - protein, 5 aa, Entamoeba invadens
TPTVG

SEQ ID NO: 3038132 - protein, 5 aa, Entamoeba invadens
TPVDS

SEQ ID NO: 3038133 - protein, 5 aa, Entamoeba invadens
TPVEL

SEQ ID NO: 3038134 - protein, 23 aa, Entamoeba invadens
TPVPGTSIYSNTKATKSEPCDDE

SEQ ID NO: 3038135 - protein, 6 aa, Entamoeba invadens
TPYMSK

SEQ ID NO: 3038136 - protein, 10 aa, Entamoeba invadens
TPYQSSSTHA

SEQ ID NO: 3038137 - protein, 7 aa, Entamoeba invadens
TQATFDN

SEQ ID NO: 3038138 - protein, 9 aa, Entamoeba invadens
TQCGNGNVN

SEQ ID NO: 3038139 - protein, 9 aa, Entamoeba invadens
TQDALSSKM

SEQ ID NO: 3038140 - protein, 20 aa, Entamoeba invadens
TQEDRPKYPNCTDYKPSQNI

SEQ ID NO: 3038141 - protein, 6 aa, Entamoeba invadens
TQEELK

SEQ ID NO: 3038142 - protein, 10 aa, Entamoeba invadens
TQETRANYTN

SEQ ID NO: 3038143 - protein, 8 aa, Entamoeba invadens
TQGNPSNN

SEQ ID NO: 3038144 - protein, 15 aa, Entamoeba invadens
TQHPPYSDDTFRQHA

SEQ ID NO: 3038145 - protein, 9 aa, Entamoeba invadens
TQKDLETYE

SEQ ID NO: 3038146 - protein, 14 aa, Entamoeba invadens
TQKLENETQRQKEQ

SEQ ID NO: 3038147 - protein, 7 aa, Entamoeba invadens
TQLKRQS

SEQ ID NO: 3038148 - protein, 4 aa, Entamoeba invadens
TQLS

SEQ ID NO: 3038149 - protein, 5 aa, Entamoeba invadens
TQMSD

SEQ ID NO: 3038150 - protein, 7 aa, Entamoeba invadens
TQNEESV

SEQ ID NO: 3038151 - protein, 18 aa, Entamoeba invadens
TQNEISEERARLDKKVGS

SEQ ID NO: 3038152 - protein, 7 aa, Entamoeba invadens
TQNQEKY

SEQ ID NO: 3038153 - protein, 12 aa, Entamoeba invadens
TQNTKCKSCTDF

SEQ ID NO: 3038154 - protein, 9 aa, Entamoeba invadens
TQNTRTMSR

SEQ ID NO: 3038155 - protein, 115 aa, Entamoeba invadens
TQPGKCYKKRATVNPVDPPKPVEPSKPADQVKPPVTPVEPSKPENPSQPEKPSDKPVTPPEPEKPTEPSKPEKPTDKPVNPPVTPSEPENPVDPVTSEEHTENSEISNLDGALLN

SEQ ID NO: 3038156 - protein, 15 aa, Entamoeba invadens
TQPSYLNSPSSGTYQ

SEQ ID NO: 3038157 - protein, 6 aa, Entamoeba invadens
TQQNNT

SEQ ID NO: 3038158 - protein, 13 aa, Entamoeba invadens
TQQNSKSETEDFT

SEQ ID NO: 3038159 - protein, 17 aa, Entamoeba invadens
TQQSYEIDETKIQPGQL

SEQ ID NO: 3038160 - protein, 8 aa, Entamoeba invadens
TQRASNIP

SEQ ID NO: 3038161 - protein, 4 aa, Entamoeba invadens
TQRK

SEQ ID NO: 3038162 - protein, 22 aa, Entamoeba invadens
TQRKRHTSAPQPKQKQTPASSV

SEQ ID NO: 3038163 - protein, 6 aa, Entamoeba invadens
TQRNLP

SEQ ID NO: 3038164 - protein, 10 aa, Entamoeba invadens
TQSDGFTEDD

SEQ ID NO: 3038165 - protein, 17 aa, Entamoeba invadens
TQSDVEKVSNSRFSSAE

SEQ ID NO: 3038166 - protein, 4 aa, Entamoeba invadens
TQTC

SEQ ID NO: 3038167 - protein, 6 aa, Entamoeba invadens
TQTFTA

SEQ ID NO: 3038168 - protein, 7 aa, Entamoeba invadens
TQTGKTF

SEQ ID NO: 3038169 - protein, 5 aa, Entamoeba invadens
TQTTG

SEQ ID NO: 3038170 - protein, 5 aa, Entamoeba invadens
TQTTR

SEQ ID NO: 3038171 - protein, 11 aa, Entamoeba invadens
TQVGQEGSKAF

SEQ ID NO: 3038172 - protein, 7 aa, Entamoeba invadens
TQVSGKL

SEQ ID NO: 3038173 - protein, 6 aa, Entamoeba invadens
TQYDLQ

SEQ ID NO: 3038174 - protein, 6 aa, Entamoeba invadens
TQYGDP

SEQ ID NO: 3038175 - protein, 9 aa, Entamoeba invadens
TQYRKDKND

SEQ ID NO: 3038176 - protein, 8 aa, Entamoeba invadens
TRAGMGRC

SEQ ID NO: 3038177 - protein, 13 aa, Entamoeba invadens
TRDVDEEVNEKDK

SEQ ID NO: 3038178 - protein, 9 aa, Entamoeba invadens
TREKNKCEQ

SEQ ID NO: 3038179 - protein, 6 aa, Entamoeba invadens
TRETFT

SEQ ID NO: 3038180 - protein, 4 aa, Entamoeba invadens
TRFG

SEQ ID NO: 3038181 - protein, 5 aa, Entamoeba invadens
TRGYT

SEQ ID NO: 3038182 - protein, 6 aa, Entamoeba invadens
TRKCNK

SEQ ID NO: 3038183 - protein, 10 aa, Entamoeba invadens
TRLKSQKKVD

SEQ ID NO: 3038184 - protein, 8 aa, Entamoeba invadens
TRNDPPHF

SEQ ID NO: 3038185 - protein, 4 aa, Entamoeba invadens
TRNL

SEQ ID NO: 3038186 - protein, 5 aa, Entamoeba invadens
TRRGL

SEQ ID NO: 3038187 - protein, 8 aa, Entamoeba invadens
TRRTTKNE

SEQ ID NO: 3038188 - protein, 6 aa, Entamoeba invadens
TRSEID

SEQ ID NO: 3038189 - protein, 10 aa, Entamoeba invadens
TRTATRTNCN

SEQ ID NO: 3038190 - protein, 7 aa, Entamoeba invadens
TRTVNER

SEQ ID NO: 3038191 - protein, 8 aa, Entamoeba invadens
TSAASSDC

SEQ ID NO: 3038192 - protein, 4 aa, Entamoeba invadens
TSAF

SEQ ID NO: 3038193 - protein, 9 aa, Entamoeba invadens
TSAKSYNWA

SEQ ID NO: 3038194 - protein, 11 aa, Entamoeba invadens
TSAKTRTIQST

SEQ ID NO: 3038195 - protein, 9 aa, Entamoeba invadens
TSANKANPE

SEQ ID NO: 3038196 - protein, 7 aa, Entamoeba invadens
TSAQTPC

SEQ ID NO: 3038197 - protein, 9 aa, Entamoeba invadens
TSAQYSQSD

SEQ ID NO: 3038198 - protein, 10 aa, Entamoeba invadens
TSCANDKEEW

SEQ ID NO: 3038199 - protein, 8 aa, Entamoeba invadens
TSCGSEGC

SEQ ID NO: 3038200 - protein, 10 aa, Entamoeba invadens
TSCKSGQIIQ

SEQ ID NO: 3038201 - protein, 14 aa, Entamoeba invadens
TSCKTDDPTKCEAC

SEQ ID NO: 3038202 - protein, 5 aa, Entamoeba invadens
TSCPN

SEQ ID NO: 3038203 - protein, 10 aa, Entamoeba invadens
TSCPNGNYTF

SEQ ID NO: 3038204 - protein, 20 aa, Entamoeba invadens
TSCQPGKGFYATSSKCSSCQ

SEQ ID NO: 3038205 - protein, 9 aa, Entamoeba invadens
TSCSGGQYL

SEQ ID NO: 3038206 - protein, 6 aa, Entamoeba invadens
TSCSQT

SEQ ID NO: 3038207 - protein, 5 aa, Entamoeba invadens
TSCSS

SEQ ID NO: 3038208 - protein, 6 aa, Entamoeba invadens
TSCSSG

SEQ ID NO: 3038209 - protein, 9 aa, Entamoeba invadens
TSCSSGQYL

SEQ ID NO: 3038210 - protein, 6 aa, Entamoeba invadens
TSCSTG

SEQ ID NO: 3038211 - protein, 4 aa, Entamoeba invadens
TSCY

SEQ ID NO: 3038212 - protein, 7 aa, Entamoeba invadens
TSDEQNP

SEQ ID NO: 3038213 - protein, 10 aa, Entamoeba invadens
TSDKNEGCQL

SEQ ID NO: 3038214 - protein, 9 aa, Entamoeba invadens
TSDNPPRGE

SEQ ID NO: 3038215 - protein, 6 aa, Entamoeba invadens
TSDVNL

SEQ ID NO: 3038216 - protein, 5 aa, Entamoeba invadens
TSEEC

SEQ ID NO: 3038217 - protein, 13 aa, Entamoeba invadens
TSEMNSNKMCENN

SEQ ID NO: 3038218 - protein, 19 aa, Entamoeba invadens
TSENMGNNSKIITTSEDGD

SEQ ID NO: 3038219 - protein, 10 aa, Entamoeba invadens
TSESSFIPEQ

SEQ ID NO: 3038220 - protein, 8 aa, Entamoeba invadens
TSETAEEI

SEQ ID NO: 3038221 - protein, 9 aa, Entamoeba invadens
TSETSKPYT

SEQ ID NO: 3038222 - protein, 4 aa, Entamoeba invadens
TSEV

SEQ ID NO: 3038223 - protein, 6 aa, Entamoeba invadens
TSFIGP

SEQ ID NO: 3038224 - protein, 10 aa, Entamoeba invadens
TSGADNAANY

SEQ ID NO: 3038225 - protein, 4 aa, Entamoeba invadens
TSGD

SEQ ID NO: 3038226 - protein, 9 aa, Entamoeba invadens
TSGFTNKKQ

SEQ ID NO: 3038227 - protein, 8 aa, Entamoeba invadens
TSGGISQS

SEQ ID NO: 3038228 - protein, 5 aa, Entamoeba invadens
TSGNF

SEQ ID NO: 3038229 - protein, 6 aa, Entamoeba invadens
TSGRSS

SEQ ID NO: 3038230 - protein, 9 aa, Entamoeba invadens
TSGTSDYAK

SEQ ID NO: 3038231 - protein, 4 aa, Entamoeba invadens
TSGV

SEQ ID NO: 3038232 - protein, 5 aa, Entamoeba invadens
TSHSL

SEQ ID NO: 3038233 - protein, 4 aa, Entamoeba invadens
TSIG

SEQ ID NO: 3038234 - protein, 5 aa, Entamoeba invadens
TSITG

SEQ ID NO: 3038235 - protein, 4 aa, Entamoeba invadens
TSKC

SEQ ID NO: 3038236 - protein, 11 aa, Entamoeba invadens
TSKCDSECPKG

SEQ ID NO: 3038237 - protein, 6 aa, Entamoeba invadens
TSKHNI

SEQ ID NO: 3038238 - protein, 16 aa, Entamoeba invadens
TSKKSKKKSEKSQIPI

SEQ ID NO: 3038239 - protein, 18 aa, Entamoeba invadens
TSKNNTSNLKSGGVNCGG

SEQ ID NO: 3038240 - protein, 12 aa, Entamoeba invadens
TSKTASTSCSSC

SEQ ID NO: 3038241 - protein, 5 aa, Entamoeba invadens
TSKTD

SEQ ID NO: 3038242 - protein, 10 aa, Entamoeba invadens
TSKTEPTRQT

SEQ ID NO: 3038243 - protein, 4 aa, Entamoeba invadens
TSLE

SEQ ID NO: 3038244 - protein, 17 aa, Entamoeba invadens
TSLGLDDQNLKEKIKSI

SEQ ID NO: 3038245 - protein, 4 aa, Entamoeba invadens
TSNG

SEQ ID NO: 3038246 - protein, 6 aa, Entamoeba invadens
TSNKLK

SEQ ID NO: 3038247 - protein, 4 aa, Entamoeba invadens
TSNT

SEQ ID NO: 3038248 - protein, 8 aa, Entamoeba invadens
TSNTKYSN

SEQ ID NO: 3038249 - protein, 4 aa, Entamoeba invadens
TSNW

SEQ ID NO: 3038250 - protein, 5 aa, Entamoeba invadens
TSPAD

SEQ ID NO: 3038251 - protein, 9 aa, Entamoeba invadens
TSPKTYNWD

SEQ ID NO: 3038252 - protein, 5 aa, Entamoeba invadens
TSPLP

SEQ ID NO: 3038253 - protein, 6 aa, Entamoeba invadens
TSPNDY

SEQ ID NO: 3038254 - protein, 7 aa, Entamoeba invadens
TSPQSTR

SEQ ID NO: 3038255 - protein, 5 aa, Entamoeba invadens
TSPST

SEQ ID NO: 3038256 - protein, 5 aa, Entamoeba invadens
TSPVQ

SEQ ID NO: 3038257 - protein, 11 aa, Entamoeba invadens
TSQGLEKESDI

SEQ ID NO: 3038258 - protein, 16 aa, Entamoeba invadens
TSQPTPVAESPVDGKS

SEQ ID NO: 3038259 - protein, 8 aa, Entamoeba invadens
TSSKFGVP

SEQ ID NO: 3038260 - protein, 4 aa, Entamoeba invadens
TSSN

SEQ ID NO: 3038261 - protein, 5 aa, Entamoeba invadens
TSSNV

SEQ ID NO: 3038262 - protein, 10 aa, Entamoeba invadens
TSSPQYTYTS

SEQ ID NO: 3038263 - protein, 19 aa, Entamoeba invadens
TSSQMKYSKMDSDTAIEEK

SEQ ID NO: 3038264 - protein, 6 aa, Entamoeba invadens
TSSTNY

SEQ ID NO: 3038265 - protein, 5 aa, Entamoeba invadens
TSTAT

SEQ ID NO: 3038266 - protein, 4 aa, Entamoeba invadens
TSTN

SEQ ID NO: 3038267 - protein, 7 aa, Entamoeba invadens
TSTPINS

SEQ ID NO: 3038268 - protein, 9 aa, Entamoeba invadens
TSTTAFDTI

SEQ ID NO: 3038269 - protein, 9 aa, Entamoeba invadens
TSTTANSPV

SEQ ID NO: 3038270 - protein, 6 aa, Entamoeba invadens
TSVKGG

SEQ ID NO: 3038271 - protein, 10 aa, Entamoeba invadens
TSVSGAESLS

SEQ ID NO: 3038272 - protein, 18 aa, Entamoeba invadens
TSYDSLNETTINNTAGYT

SEQ ID NO: 3038273 - protein, 9 aa, Entamoeba invadens
TSYKDKVGQ

SEQ ID NO: 3038274 - protein, 4 aa, Entamoeba invadens
TTAI

SEQ ID NO: 3038275 - protein, 5 aa, Entamoeba invadens
TTCES

SEQ ID NO: 3038276 - protein, 17 aa, Entamoeba invadens
TTCGGSCDQTDGHCTSC

SEQ ID NO: 3038277 - protein, 13 aa, Entamoeba invadens
TTCKTLSTDTSVY

SEQ ID NO: 3038278 - protein, 12 aa, Entamoeba invadens
TTCNGNCDQTSG

SEQ ID NO: 3038279 - protein, 13 aa, Entamoeba invadens
TTCSKGCNGTNGN

SEQ ID NO: 3038280 - protein, 8 aa, Entamoeba invadens
TTDDDPKP

SEQ ID NO: 3038281 - protein, 12 aa, Entamoeba invadens
TTDDPQKYKNCK

SEQ ID NO: 3038282 - protein, 6 aa, Entamoeba invadens
TTDFKT

SEQ ID NO: 3038283 - protein, 7 aa, Entamoeba invadens
TTDGSEV

SEQ ID NO: 3038284 - protein, 8 aa, Entamoeba invadens
TTDKNAKK

SEQ ID NO: 3038285 - protein, 14 aa, Entamoeba invadens
TTEAQWSTDDSGNV

SEQ ID NO: 3038286 - protein, 12 aa, Entamoeba invadens
TTEEEKDKIEKE

SEQ ID NO: 3038287 - protein, 4 aa, Entamoeba invadens
TTEH

SEQ ID NO: 3038288 - protein, 5 aa, Entamoeba invadens
TTELG

SEQ ID NO: 3038289 - protein, 11 aa, Entamoeba invadens
TTELSTTDISS

SEQ ID NO: 3038290 - protein, 6 aa, Entamoeba invadens
TTEQGL

SEQ ID NO: 3038291 - protein, 9 aa, Entamoeba invadens
TTERDSVEL

SEQ ID NO: 3038292 - protein, 8 aa, Entamoeba invadens
TTETTQSY

SEQ ID NO: 3038293 - protein, 4 aa, Entamoeba invadens
TTFD

SEQ ID NO: 3038294 - protein, 4 aa, Entamoeba invadens
TTFK

SEQ ID NO: 3038295 - protein, 7 aa, Entamoeba invadens
TTGGSES

SEQ ID NO: 3038296 - protein, 5 aa, Entamoeba invadens
TTGPV

SEQ ID NO: 3038297 - protein, 8 aa, Entamoeba invadens
TTHQTKGL

SEQ ID NO: 3038298 - protein, 7 aa, Entamoeba invadens
TTIPSGY

SEQ ID NO: 3038299 - protein, 11 aa, Entamoeba invadens
TTKEDKEERSN

SEQ ID NO: 3038300 - protein, 4 aa, Entamoeba invadens
TTKI

SEQ ID NO: 3038301 - protein, 7 aa, Entamoeba invadens
TTKNNLC

SEQ ID NO: 3038302 - protein, 12 aa, Entamoeba invadens
TTKPKCDENALS

SEQ ID NO: 3038303 - protein, 7 aa, Entamoeba invadens
TTKSEGD

SEQ ID NO: 3038304 - protein, 5 aa, Entamoeba invadens
TTKTG

SEQ ID NO: 3038305 - protein, 6 aa, Entamoeba invadens
TTKYGQ

SEQ ID NO: 3038306 - protein, 8 aa, Entamoeba invadens
TTNANCPV

SEQ ID NO: 3038307 - protein, 4 aa, Entamoeba invadens
TTNE

SEQ ID NO: 3038308 - protein, 6 aa, Entamoeba invadens
TTNEQW

SEQ ID NO: 3038309 - protein, 8 aa, Entamoeba invadens
TTNGDCTI

SEQ ID NO: 3038310 - protein, 4 aa, Entamoeba invadens
TTNI

SEQ ID NO: 3038311 - protein, 15 aa, Entamoeba invadens
TTNNCEGDISEATTF

SEQ ID NO: 3038312 - protein, 5 aa, Entamoeba invadens
TTNNH

SEQ ID NO: 3038313 - protein, 9 aa, Entamoeba invadens
TTNNSENIC

SEQ ID NO: 3038314 - protein, 6 aa, Entamoeba invadens
TTNQSE

SEQ ID NO: 3038315 - protein, 7 aa, Entamoeba invadens
TTNTNSE

SEQ ID NO: 3038316 - protein, 4 aa, Entamoeba invadens
TTPI

SEQ ID NO: 3038317 - protein, 5 aa, Entamoeba invadens
TTPSE

SEQ ID NO: 3038318 - protein, 8 aa, Entamoeba invadens
TTPSSTDF

SEQ ID NO: 3038319 - protein, 5 aa, Entamoeba invadens
TTPTH

SEQ ID NO: 3038320 - protein, 5 aa, Entamoeba invadens
TTQAR

SEQ ID NO: 3038321 - protein, 7 aa, Entamoeba invadens
TTQDRNI

SEQ ID NO: 3038322 - protein, 4 aa, Entamoeba invadens
TTRC

SEQ ID NO: 3038323 - protein, 10 aa, Entamoeba invadens
TTREKSFTIS

SEQ ID NO: 3038324 - protein, 8 aa, Entamoeba invadens
TTSCAGNQ

SEQ ID NO: 3038325 - protein, 8 aa, Entamoeba invadens
TTSEEMTE

SEQ ID NO: 3038326 - protein, 6 aa, Entamoeba invadens
TTSEKV

SEQ ID NO: 3038327 - protein, 11 aa, Entamoeba invadens
TTSGCTKCNSG

SEQ ID NO: 3038328 - protein, 20 aa, Entamoeba invadens
TTSNPGCVTADGKCDNCNKC

SEQ ID NO: 3038329 - protein, 10 aa, Entamoeba invadens
TTSSKGTEKV

SEQ ID NO: 3038330 - protein, 7 aa, Entamoeba invadens
TTTDRNI

SEQ ID NO: 3038331 - protein, 10 aa, Entamoeba invadens
TTTKKCSPNI

SEQ ID NO: 3038332 - protein, 10 aa, Entamoeba invadens
TTTNTQSNNE

SEQ ID NO: 3038333 - protein, 9 aa, Entamoeba invadens
TTTSTTKTA

SEQ ID NO: 3038334 - protein, 5 aa, Entamoeba invadens
TTTTS

SEQ ID NO: 3038335 - protein, 10 aa, Entamoeba invadens
TTTTYYDTDD

SEQ ID NO: 3038336 - protein, 7 aa, Entamoeba invadens
TTVDQKS

SEQ ID NO: 3038337 - protein, 18 aa, Entamoeba invadens
TTVTPTPVDPSNPSKEGT

SEQ ID NO: 3038338 - protein, 6 aa, Entamoeba invadens
TTYQNP

SEQ ID NO: 3038339 - protein, 9 aa, Entamoeba invadens
TVAATGDGF

SEQ ID NO: 3038340 - protein, 4 aa, Entamoeba invadens
TVAN

SEQ ID NO: 3038341 - protein, 8 aa, Entamoeba invadens
TVDGDEEV

SEQ ID NO: 3038342 - protein, 7 aa, Entamoeba invadens
TVDGYEG

SEQ ID NO: 3038343 - protein, 17 aa, Entamoeba invadens
TVDPTPEESGEINNGAK

SEQ ID NO: 3038344 - protein, 38 aa, Entamoeba invadens
TVEEDEEKKQHEEVKETRPENAYVPPALRNSPSPTQKV

SEQ ID NO: 3038345 - protein, 10 aa, Entamoeba invadens
TVEGKYSSIE

SEQ ID NO: 3038346 - protein, 8 aa, Entamoeba invadens
TVEQSGKM

SEQ ID NO: 3038347 - protein, 5 aa, Entamoeba invadens
TVGEC

SEQ ID NO: 3038348 - protein, 4 aa, Entamoeba invadens
TVKG

SEQ ID NO: 3038349 - protein, 9 aa, Entamoeba invadens
TVKSNSTES

SEQ ID NO: 3038350 - protein, 6 aa, Entamoeba invadens
TVPCSG

SEQ ID NO: 3038351 - protein, 14 aa, Entamoeba invadens
TVPFGANETTVAAT

SEQ ID NO: 3038352 - protein, 12 aa, Entamoeba invadens
TVPKTQPNYKQK

SEQ ID NO: 3038353 - protein, 7 aa, Entamoeba invadens
TVPKYTD

SEQ ID NO: 3038354 - protein, 6 aa, Entamoeba invadens
TVPPKG

SEQ ID NO: 3038355 - protein, 7 aa, Entamoeba invadens
TVPPKGE

SEQ ID NO: 3038356 - protein, 34 aa, Entamoeba invadens
TVPTEEKKETVLKEDDKKKEEDNEWAEFDQFKTD

SEQ ID NO: 3038357 - protein, 195 aa, Entamoeba invadens
TVQKSTSKKSEEKLAKKAAQKAIKKEQTKLKKAEAKKDAKTEAKKLEKTKAKKDEKKKAEVKKAEKKEQKKAKKVEKKLKAAKKEQKKIEKKAKKAEKKMKEEKKAKKATKKEQKKVEKKQQKKVEKKAKAAKKQAQKEQKKVVKQAKKQAKKAEKAAKKSQKKIEKAKKVTKKEAKKEAKKTLQKVDNKKISKK

SEQ ID NO: 3038358 - protein, 8 aa, Entamoeba invadens
TVRSETLG

SEQ ID NO: 3038359 - protein, 5 aa, Entamoeba invadens
TVSDE

SEQ ID NO: 3038360 - protein, 15 aa, Entamoeba invadens
TVSGSGSQIPESERE

SEQ ID NO: 3038361 - protein, 18 aa, Entamoeba invadens
TVTGAKRVTDGSEPGLQD

SEQ ID NO: 3038362 - protein, 56 aa, Entamoeba invadens
TVTGSVSKQTTKTPKGVSRTTNTKIGTTVRPTKRTQVRGSVERRETNGKRTHSYSA

SEQ ID NO: 3038363 - protein, 23 aa, Entamoeba invadens
TVTKNGRDKSKTFSADGSYTGKK

SEQ ID NO: 3038364 - protein, 11 aa, Entamoeba invadens
TVTSREDKAYL

SEQ ID NO: 3038365 - protein, 19 aa, Entamoeba invadens
TVTSSADGFYPNKNTGIQA

SEQ ID NO: 3038366 - protein, 12 aa, Entamoeba invadens
TWNGTDGKNTRC

SEQ ID NO: 3038367 - protein, 8 aa, Entamoeba invadens
TWSSPTTM

SEQ ID NO: 3038368 - protein, 10 aa, Entamoeba invadens
TWSSSASTNQ

SEQ ID NO: 3038369 - protein, 10 aa, Entamoeba invadens
TWTSSTTSFN

SEQ ID NO: 3038370 - protein, 12 aa, Entamoeba invadens
TYANTTGSTSCK

SEQ ID NO: 3038371 - protein, 10 aa, Entamoeba invadens
TYAPSKSPSC

SEQ ID NO: 3038372 - protein, 8 aa, Entamoeba invadens
TYAYKNST

SEQ ID NO: 3038373 - protein, 4 aa, Entamoeba invadens
TYDA

SEQ ID NO: 3038374 - protein, 6 aa, Entamoeba invadens
TYEDQG

SEQ ID NO: 3038375 - protein, 5 aa, Entamoeba invadens
TYGAF

SEQ ID NO: 3038376 - protein, 4 aa, Entamoeba invadens
TYGE

SEQ ID NO: 3038377 - protein, 5 aa, Entamoeba invadens
TYKDH

SEQ ID NO: 3038378 - protein, 9 aa, Entamoeba invadens
TYKGYSKCP

SEQ ID NO: 3038379 - protein, 5 aa, Entamoeba invadens
TYMSK

SEQ ID NO: 3038380 - protein, 4 aa, Entamoeba invadens
TYNL

SEQ ID NO: 3038381 - protein, 12 aa, Entamoeba invadens
TYNSENGPKDYL

SEQ ID NO: 3038382 - protein, 6 aa, Entamoeba invadens
TYNSSH

SEQ ID NO: 3038383 - protein, 9 aa, Entamoeba invadens
TYPDNYYKK

SEQ ID NO: 3038384 - protein, 5 aa, Entamoeba invadens
TYPNG

SEQ ID NO: 3038385 - protein, 12 aa, Entamoeba invadens
TYQLDSTKLTAQ

SEQ ID NO: 3038386 - protein, 8 aa, Entamoeba invadens
TYQSTTIS

SEQ ID NO: 3038387 - protein, 4 aa, Entamoeba invadens
TYRG

SEQ ID NO: 3038388 - protein, 9 aa, Entamoeba invadens
TYRGRDGPF

SEQ ID NO: 3038389 - protein, 11 aa, Entamoeba invadens
TYRGTSCTKCE

SEQ ID NO: 3038390 - protein, 5 aa, Entamoeba invadens
TYRQT

SEQ ID NO: 3038391 - protein, 10 aa, Entamoeba invadens
TYSDSDGADE

SEQ ID NO: 3038392 - protein, 5 aa, Entamoeba invadens
TYSGN

SEQ ID NO: 3038393 - protein, 7 aa, Entamoeba invadens
TYSNAGS

SEQ ID NO: 3038394 - protein, 10 aa, Entamoeba invadens
TYSPSPKSLQ

SEQ ID NO: 3038395 - protein, 11 aa, Entamoeba invadens
TYSSSPKSLQC

SEQ ID NO: 3038396 - protein, 11 aa, Entamoeba invadens
TYSSTNSSKCY

SEQ ID NO: 3038397 - protein, 9 aa, Entamoeba invadens
TYSVSTNST

SEQ ID NO: 3038398 - protein, 16 aa, Entamoeba invadens
TYSVSTNSTCSKCPEK

SEQ ID NO: 3038399 - protein, 11 aa, Entamoeba invadens
TYSYGNNKEVC

SEQ ID NO: 3038400 - protein, 9 aa, Entamoeba invadens
TYTGKNGPM

SEQ ID NO: 3038401 - protein, 9 aa, Entamoeba invadens
TYTGPNGPL

SEQ ID NO: 3038402 - protein, 13 aa, Entamoeba invadens
TYYGTESNKEDAS

SEQ ID NO: 3038403 - protein, 24 aa, Entamoeba invadens
VAAKKSVKVATKKFKGDAEKIKEY

SEQ ID NO: 3038404 - protein, 11 aa, Entamoeba invadens
VADNNPSPNYK

SEQ ID NO: 3038405 - protein, 9 aa, Entamoeba invadens
VADSSDKTY

SEQ ID NO: 3038406 - protein, 8 aa, Entamoeba invadens
VADTDAKA

SEQ ID NO: 3038407 - protein, 12 aa, Entamoeba invadens
VAEDDKGFGVGD

SEQ ID NO: 3038408 - protein, 8 aa, Entamoeba invadens
VAEPNVRP

SEQ ID NO: 3038409 - protein, 6 aa, Entamoeba invadens
VAETEI

SEQ ID NO: 3038410 - protein, 8 aa, Entamoeba invadens
VAGKHNKC

SEQ ID NO: 3038411 - protein, 4 aa, Entamoeba invadens
VAGQ

SEQ ID NO: 3038412 - protein, 4 aa, Entamoeba invadens
VAGV

SEQ ID NO: 3038413 - protein, 15 aa, Entamoeba invadens
VAHGKDPYFDPWPDT

SEQ ID NO: 3038414 - protein, 6 aa, Entamoeba invadens
VAKEDG

SEQ ID NO: 3038415 - protein, 8 aa, Entamoeba invadens
VAKEDGTC

SEQ ID NO: 3038416 - protein, 27 aa, Entamoeba invadens
VAKSSPKQPTGKITSAQKAQAKEAGIE

SEQ ID NO: 3038417 - protein, 20 aa, Entamoeba invadens
VAKSTVKKALEKVKNKKEKF

SEQ ID NO: 3038418 - protein, 20 aa, Entamoeba invadens
VANAVEQSNVLDQSDACKEY

SEQ ID NO: 3038419 - protein, 10 aa, Entamoeba invadens
VAPKPKPKPV

SEQ ID NO: 3038420 - protein, 6 aa, Entamoeba invadens
VAQTPR

SEQ ID NO: 3038421 - protein, 9 aa, Entamoeba invadens
VASGDEQMT

SEQ ID NO: 3038422 - protein, 6 aa, Entamoeba invadens
VASTVK

SEQ ID NO: 3038423 - protein, 18 aa, Entamoeba invadens
VATSEEDKKAESENKEKI

SEQ ID NO: 3038424 - protein, 20 aa, Entamoeba invadens
VCDDESKKLETTKNTDFTIE

SEQ ID NO: 3038425 - protein, 8 aa, Entamoeba invadens
VCNTPGDD

SEQ ID NO: 3038426 - protein, 8 aa, Entamoeba invadens
VCTADTES

SEQ ID NO: 3038427 - protein, 16 aa, Entamoeba invadens
VDAPKQNSNVKNAENE

SEQ ID NO: 3038428 - protein, 11 aa, Entamoeba invadens
VDDDESKELPN

SEQ ID NO: 3038429 - protein, 16 aa, Entamoeba invadens
VDDDSDTIQEKSGEFN

SEQ ID NO: 3038430 - protein, 13 aa, Entamoeba invadens
VDEADDETAPKEG

SEQ ID NO: 3038431 - protein, 7 aa, Entamoeba invadens
VDEAGRI

SEQ ID NO: 3038432 - protein, 9 aa, Entamoeba invadens
VDEDYPDEV

SEQ ID NO: 3038433 - protein, 7 aa, Entamoeba invadens
VDEGSTE

SEQ ID NO: 3038434 - protein, 10 aa, Entamoeba invadens
VDEREKIAKS

SEQ ID NO: 3038435 - protein, 6 aa, Entamoeba invadens
VDESAC

SEQ ID NO: 3038436 - protein, 6 aa, Entamoeba invadens
VDGGDE

SEQ ID NO: 3038437 - protein, 8 aa, Entamoeba invadens
VDGHSGTQ

SEQ ID NO: 3038438 - protein, 8 aa, Entamoeba invadens
VDGISGDP

SEQ ID NO: 3038439 - protein, 8 aa, Entamoeba invadens
VDGITGDP

SEQ ID NO: 3038440 - protein, 7 aa, Entamoeba invadens
VDGTSCE

SEQ ID NO: 3038441 - protein, 5 aa, Entamoeba invadens
VDITE

SEQ ID NO: 3038442 - protein, 22 aa, Entamoeba invadens
VDKLEKDVDAAQIRSTDLSTQL

SEQ ID NO: 3038443 - protein, 13 aa, Entamoeba invadens
VDLGGNTKTKTLN

SEQ ID NO: 3038444 - protein, 7 aa, Entamoeba invadens
VDLTPKN

SEQ ID NO: 3038445 - protein, 9 aa, Entamoeba invadens
VDNDESRQA

SEQ ID NO: 3038446 - protein, 13 aa, Entamoeba invadens
VDNSKSSYQYTSG

SEQ ID NO: 3038447 - protein, 6 aa, Entamoeba invadens
VDNTKT

SEQ ID NO: 3038448 - protein, 44 aa, Entamoeba invadens
VDPNAKKPEEWDDEDDGAWEAPTIENPAYKGEWKPKKIPNPAYK

SEQ ID NO: 3038449 - protein, 5 aa, Entamoeba invadens
VDPNW

SEQ ID NO: 3038450 - protein, 6 aa, Entamoeba invadens
VDPSGE

SEQ ID NO: 3038451 - protein, 14 aa, Entamoeba invadens
VDPSIAADLNTDAA

SEQ ID NO: 3038452 - protein, 11 aa, Entamoeba invadens
VDQPTTDSEYL

SEQ ID NO: 3038453 - protein, 9 aa, Entamoeba invadens
VDSATPAYT

SEQ ID NO: 3038454 - protein, 13 aa, Entamoeba invadens
VDSEMADTVAENL

SEQ ID NO: 3038455 - protein, 12 aa, Entamoeba invadens
VDSGKTDKVQYT

SEQ ID NO: 3038456 - protein, 9 aa, Entamoeba invadens
VDSNNTRIS

SEQ ID NO: 3038457 - protein, 10 aa, Entamoeba invadens
VDSNRDYGVN

SEQ ID NO: 3038458 - protein, 6 aa, Entamoeba invadens
VDSSGQ

SEQ ID NO: 3038459 - protein, 7 aa, Entamoeba invadens
VDTADQT

SEQ ID NO: 3038460 - protein, 10 aa, Entamoeba invadens
VDTHGQKPTK

SEQ ID NO: 3038461 - protein, 26 aa, Entamoeba invadens
VDTPYGPTSWENGTVKANDNTAYSQS

SEQ ID NO: 3038462 - protein, 11 aa, Entamoeba invadens
VEAAPVAKGFS

SEQ ID NO: 3038463 - protein, 9 aa, Entamoeba invadens
VEANIGSAD

SEQ ID NO: 3038464 - protein, 23 aa, Entamoeba invadens
VEARKEDSPKKEKMTEKKRAQMV

SEQ ID NO: 3038465 - protein, 6 aa, Entamoeba invadens
VEATKK

SEQ ID NO: 3038466 - protein, 4 aa, Entamoeba invadens
VECK

SEQ ID NO: 3038467 - protein, 4 aa, Entamoeba invadens
VEDD

SEQ ID NO: 3038468 - protein, 17 aa, Entamoeba invadens
VEDGTSTLNAPEPKNKR

SEQ ID NO: 3038469 - protein, 6 aa, Entamoeba invadens
VEDNST

SEQ ID NO: 3038470 - protein, 7 aa, Entamoeba invadens
VEDQERH

SEQ ID NO: 3038471 - protein, 10 aa, Entamoeba invadens
VEDQSLNDPW

SEQ ID NO: 3038472 - protein, 12 aa, Entamoeba invadens
VEDYDNTHPKEN

SEQ ID NO: 3038473 - protein, 54 aa, Entamoeba invadens
VEEDDEDDLIEDDDEEDELELEDDDDDMEDDEEDEDNEDDDMEDFTDDEEDRRH

SEQ ID NO: 3038474 - protein, 6 aa, Entamoeba invadens
VEEGKR

SEQ ID NO: 3038475 - protein, 10 aa, Entamoeba invadens
VEEKLKEVGE

SEQ ID NO: 3038476 - protein, 7 aa, Entamoeba invadens
VEEKYDN

SEQ ID NO: 3038477 - protein, 7 aa, Entamoeba invadens
VEELDNQ

SEQ ID NO: 3038478 - protein, 8 aa, Entamoeba invadens
VEENKNDS

SEQ ID NO: 3038479 - protein, 4 aa, Entamoeba invadens
VEES

SEQ ID NO: 3038480 - protein, 7 aa, Entamoeba invadens
VEETEPC

SEQ ID NO: 3038481 - protein, 6 aa, Entamoeba invadens
VEGGPK

SEQ ID NO: 3038482 - protein, 19 aa, Entamoeba invadens
VEGLTKEAKETKKKMITTQ

SEQ ID NO: 3038483 - protein, 7 aa, Entamoeba invadens
VEGQTAK

SEQ ID NO: 3038484 - protein, 8 aa, Entamoeba invadens
VEGTPTKR

SEQ ID NO: 3038485 - protein, 4 aa, Entamoeba invadens
VEGV

SEQ ID NO: 3038486 - protein, 5 aa, Entamoeba invadens
VEKAK

SEQ ID NO: 3038487 - protein, 4 aa, Entamoeba invadens
VEKE

SEQ ID NO: 3038488 - protein, 8 aa, Entamoeba invadens
VEKKKKVD

SEQ ID NO: 3038489 - protein, 8 aa, Entamoeba invadens
VEKKNMTG

SEQ ID NO: 3038490 - protein, 41 aa, Entamoeba invadens
VEKKVKDKIKGTLKTSINKTTARVGASAKKASTKAKKVVKG

SEQ ID NO: 3038491 - protein, 9 aa, Entamoeba invadens
VEKSSEEDA

SEQ ID NO: 3038492 - protein, 8 aa, Entamoeba invadens
VEKTSHDA

SEQ ID NO: 3038493 - protein, 14 aa, Entamoeba invadens
VENEESKRKDPSLL

SEQ ID NO: 3038494 - protein, 6 aa, Entamoeba invadens
VENGEE

SEQ ID NO: 3038495 - protein, 17 aa, Entamoeba invadens
VENKFDSSLSSGGETGI

SEQ ID NO: 3038496 - protein, 4 aa, Entamoeba invadens
VENN

SEQ ID NO: 3038497 - protein, 12 aa, Entamoeba invadens
VEQENDNMRSDS

SEQ ID NO: 3038498 - protein, 4 aa, Entamoeba invadens
VERR

SEQ ID NO: 3038499 - protein, 13 aa, Entamoeba invadens
VESETKEKTLNDA

SEQ ID NO: 3038500 - protein, 10 aa, Entamoeba invadens
VESGKRLPLK

SEQ ID NO: 3038501 - protein, 7 aa, Entamoeba invadens
VESNRGV

SEQ ID NO: 3038502 - protein, 4 aa, Entamoeba invadens
VEST

SEQ ID NO: 3038503 - protein, 43 aa, Entamoeba invadens
VESTVTKGANKLVDKGDTIQNKLGNVKEKLENPKKKAKKVKKY

SEQ ID NO: 3038504 - protein, 14 aa, Entamoeba invadens
VETDDKKREKLNRK

SEQ ID NO: 3038505 - protein, 8 aa, Entamoeba invadens
VETLPKTV

SEQ ID NO: 3038506 - protein, 27 aa, Entamoeba invadens
VETNSTNSNETNSTEDSEDLSEESEEI

SEQ ID NO: 3038507 - protein, 28 aa, Entamoeba invadens
VEVKDNETLSVNGTNSTINSTEQTNETF

SEQ ID NO: 3038508 - protein, 5 aa, Entamoeba invadens
VFESP

SEQ ID NO: 3038509 - protein, 7 aa, Entamoeba invadens
VFNDPKG

SEQ ID NO: 3038510 - protein, 7 aa, Entamoeba invadens
VFSTTNS

SEQ ID NO: 3038511 - protein, 5 aa, Entamoeba invadens
VGAAN

SEQ ID NO: 3038512 - protein, 11 aa, Entamoeba invadens
VGAGAVAGPVA

SEQ ID NO: 3038513 - protein, 9 aa, Entamoeba invadens
VGDKEITTQ

SEQ ID NO: 3038514 - protein, 5 aa, Entamoeba invadens
VGDKN

SEQ ID NO: 3038515 - protein, 6 aa, Entamoeba invadens
VGDPVK

SEQ ID NO: 3038516 - protein, 4 aa, Entamoeba invadens
VGEC

SEQ ID NO: 3038517 - protein, 6 aa, Entamoeba invadens
VGEGSF

SEQ ID NO: 3038518 - protein, 8 aa, Entamoeba invadens
VGETDHEL

SEQ ID NO: 3038519 - protein, 9 aa, Entamoeba invadens
VGGLSQENL

SEQ ID NO: 3038520 - protein, 11 aa, Entamoeba invadens
VGHKAKESYEL

SEQ ID NO: 3038521 - protein, 8 aa, Entamoeba invadens
VGKAPKLK

SEQ ID NO: 3038522 - protein, 5 aa, Entamoeba invadens
VGKEV

SEQ ID NO: 3038523 - protein, 70 aa, Entamoeba invadens
VGKKGKSGGKKGSKSGSKKGSKKGTKKAGKKAGSKKVGTKKSGSKKSTKKAGKPKAPSKKASKKSSGKKK

SEQ ID NO: 3038524 - protein, 9 aa, Entamoeba invadens
VGKNAFRDN

SEQ ID NO: 3038525 - protein, 5 aa, Entamoeba invadens
VGKSS

SEQ ID NO: 3038526 - protein, 7 aa, Entamoeba invadens
VGNSNKL

SEQ ID NO: 3038527 - protein, 7 aa, Entamoeba invadens
VGNTELK

SEQ ID NO: 3038528 - protein, 8 aa, Entamoeba invadens
VGSDQGRD

SEQ ID NO: 3038529 - protein, 10 aa, Entamoeba invadens
VGSQISINEN

SEQ ID NO: 3038530 - protein, 5 aa, Entamoeba invadens
VGTEF

SEQ ID NO: 3038531 - protein, 15 aa, Entamoeba invadens
VGTEKNSYKGTCVRG

SEQ ID NO: 3038532 - protein, 20 aa, Entamoeba invadens
VGTKSSDVFSPAGCENTETH

SEQ ID NO: 3038533 - protein, 18 aa, Entamoeba invadens
VGVPIQGEKLPKKAEQVQ

SEQ ID NO: 3038534 - protein, 9 aa, Entamoeba invadens
VGYASPRTL

SEQ ID NO: 3038535 - protein, 126 aa, Entamoeba invadens
VGYGDNGEKETTPATTPAAEPPKTEQEIAAQEAKQEQKEAIQEAQEKQKDEQLAQADTVKEKQADALAEQQEKEQEKQEQEEQKQAEGETTATPNTPTTTPSTTTAETTSPQGTEVNNNVNRKGAY

SEQ ID NO: 3038536 - protein, 5 aa, Entamoeba invadens
VHDTH

SEQ ID NO: 3038537 - protein, 8 aa, Entamoeba invadens
VHRETKEA

SEQ ID NO: 3038538 - protein, 7 aa, Entamoeba invadens
VIEEKQR

SEQ ID NO: 3038539 - protein, 20 aa, Entamoeba invadens
VIEKAQKKINKKINKPVKKA

SEQ ID NO: 3038540 - protein, 9 aa, Entamoeba invadens
VINPRDSIT

SEQ ID NO: 3038541 - protein, 11 aa, Entamoeba invadens
VISEKQKGKRK

SEQ ID NO: 3038542 - protein, 13 aa, Entamoeba invadens
VITKTKGECLKET

SEQ ID NO: 3038543 - protein, 382 aa, Entamoeba invadens
VKAAKKEAKTLAKESKQAAKDAKAEVKKQKDKIKKDNKKVEKKMKQVKKDMKAENKKSIKKAASKAKTVAKKQAGKAEKKMAKDVKKAEKKLKASEKKTAKDLKAKVKSAEKKSAEAKKSAKKSGKKAEKSAKKAAKDAKKDMKKQEKKAEKVAKSAKKAAKSAAKDAKKQVKKAEKKVSSTKKGLKKQLKKTEKATKKVKEAEKKQKSQLKKMKKDVKKGKKSAKDLKKLKSTVKSTKKAEKKLEKKEKQLKKDLKKKIAKNATKAKKEAKKQAKKAAGKAEKKAEKKSIKAAKKYTKKQTKKVEKKEEKKIKKAQKKLNKKVKKVQKQEKKDKKKLEKKEKKNAEKAKKATQKALTKAKKEAKKQAKKAEKKLKKNIKKT

SEQ ID NO: 3038544 - protein, 12 aa, Entamoeba invadens
VKAEKHSKELRT

SEQ ID NO: 3038545 - protein, 5 aa, Entamoeba invadens
VKAKY

SEQ ID NO: 3038546 - protein, 10 aa, Entamoeba invadens
VKDKNDAIRK

SEQ ID NO: 3038547 - protein, 8 aa, Entamoeba invadens
VKDQGSCG

SEQ ID NO: 3038548 - protein, 11 aa, Entamoeba invadens
VKDQNKKNEKA

SEQ ID NO: 3038549 - protein, 19 aa, Entamoeba invadens
VKEENQKAQNIVGKTSMKE

SEQ ID NO: 3038550 - protein, 10 aa, Entamoeba invadens
VKEHNGSPFK

SEQ ID NO: 3038551 - protein, 7 aa, Entamoeba invadens
VKEKFQE

SEQ ID NO: 3038552 - protein, 28 aa, Entamoeba invadens
VKEKSEQNKQSGENKDTQTEDKKEESKP

SEQ ID NO: 3038553 - protein, 6 aa, Entamoeba invadens
VKENGI

SEQ ID NO: 3038554 - protein, 6 aa, Entamoeba invadens
VKGPLD

SEQ ID NO: 3038555 - protein, 7 aa, Entamoeba invadens
VKGPSDL

SEQ ID NO: 3038556 - protein, 12 aa, Entamoeba invadens
VKKAGEKIGLGE

SEQ ID NO: 3038557 - protein, 36 aa, Entamoeba invadens
VKKAPKIKNPVRETKRAIEKTVDKVEKRAKREGLKP

SEQ ID NO: 3038558 - protein, 8 aa, Entamoeba invadens
VKKAPKKI

SEQ ID NO: 3038559 - protein, 9 aa, Entamoeba invadens
VKKEGKYEN

SEQ ID NO: 3038560 - protein, 7 aa, Entamoeba invadens
VKKKKPQ

SEQ ID NO: 3038561 - protein, 8 aa, Entamoeba invadens
VKKNHPEL

SEQ ID NO: 3038562 - protein, 10 aa, Entamoeba invadens
VKKQGETKYT

SEQ ID NO: 3038563 - protein, 8 aa, Entamoeba invadens
VKLGDDDR

SEQ ID NO: 3038564 - protein, 4 aa, Entamoeba invadens
VKNA

SEQ ID NO: 3038565 - protein, 7 aa, Entamoeba invadens
VKNRSVR

SEQ ID NO: 3038566 - protein, 5 aa, Entamoeba invadens
VKPEQ

SEQ ID NO: 3038567 - protein, 12 aa, Entamoeba invadens
VKQEDLDSKRGD

SEQ ID NO: 3038568 - protein, 23 aa, Entamoeba invadens
VKQEQKKSSLKIGPSEKKLAKKA

SEQ ID NO: 3038569 - protein, 121 aa, Entamoeba invadens
VKQPVTPKKDEPKKDEPKKEDPPKEDPKKEEPNKGGINGLNGTNGKDGINGVNGTNGINGKDGVNGKDGMNGMNGTNGKDGINGKDGANGKDGLNGKDGVNGKDGKDGVNGRDGRDGQTTV

SEQ ID NO: 3038570 - protein, 5 aa, Entamoeba invadens
VKQTV

SEQ ID NO: 3038571 - protein, 8 aa, Entamoeba invadens
VKRNTAQI

SEQ ID NO: 3038572 - protein, 9 aa, Entamoeba invadens
VKRQYQTTV

SEQ ID NO: 3038573 - protein, 5 aa, Entamoeba invadens
VKSDH

SEQ ID NO: 3038574 - protein, 5 aa, Entamoeba invadens
VKSGE

SEQ ID NO: 3038575 - protein, 4 aa, Entamoeba invadens
VKSM

SEQ ID NO: 3038576 - protein, 8 aa, Entamoeba invadens
VKSVPESV

SEQ ID NO: 3038577 - protein, 7 aa, Entamoeba invadens
VKTGALS

SEQ ID NO: 3038578 - protein, 7 aa, Entamoeba invadens
VKTGTDT

SEQ ID NO: 3038579 - protein, 18 aa, Entamoeba invadens
VKTNKKQQLIKEAKKKEF

SEQ ID NO: 3038580 - protein, 34 aa, Entamoeba invadens
VKTSTKKVTKKNTQKKIKKSAKKMNKKMNKKFNK

SEQ ID NO: 3038581 - protein, 5 aa, Entamoeba invadens
VKTTE

SEQ ID NO: 3038582 - protein, 7 aa, Entamoeba invadens
VLKTGSF

SEQ ID NO: 3038583 - protein, 5 aa, Entamoeba invadens
VLPNS

SEQ ID NO: 3038584 - protein, 7 aa, Entamoeba invadens
VLPSDQT

SEQ ID NO: 3038585 - protein, 7 aa, Entamoeba invadens
VLSSAKD

SEQ ID NO: 3038586 - protein, 10 aa, Entamoeba invadens
VNACGSGSKC

SEQ ID NO: 3038587 - protein, 4 aa, Entamoeba invadens
VNCP

SEQ ID NO: 3038588 - protein, 7 aa, Entamoeba invadens
VNDETKN

SEQ ID NO: 3038589 - protein, 7 aa, Entamoeba invadens
VNDPEAV

SEQ ID NO: 3038590 - protein, 6 aa, Entamoeba invadens
VNFNGA

SEQ ID NO: 3038591 - protein, 9 aa, Entamoeba invadens
VNGKDVEKN

SEQ ID NO: 3038592 - protein, 7 aa, Entamoeba invadens
VNGTRYT

SEQ ID NO: 3038593 - protein, 4 aa, Entamoeba invadens
VNGY

SEQ ID NO: 3038594 - protein, 7 aa, Entamoeba invadens
VNHSHRD

SEQ ID NO: 3038595 - protein, 8 aa, Entamoeba invadens
VNKDGTVA

SEQ ID NO: 3038596 - protein, 6 aa, Entamoeba invadens
VNNDKE

SEQ ID NO: 3038597 - protein, 8 aa, Entamoeba invadens
VNNDPDVG

SEQ ID NO: 3038598 - protein, 10 aa, Entamoeba invadens
VNNPDNWDVS

SEQ ID NO: 3038599 - protein, 4 aa, Entamoeba invadens
VNNY

SEQ ID NO: 3038600 - protein, 5 aa, Entamoeba invadens
VNPPV

SEQ ID NO: 3038601 - protein, 10 aa, Entamoeba invadens
VNPSKNSSMS

SEQ ID NO: 3038602 - protein, 8 aa, Entamoeba invadens
VNQENAKT

SEQ ID NO: 3038603 - protein, 11 aa, Entamoeba invadens
VNRADAAGAMA

SEQ ID NO: 3038604 - protein, 10 aa, Entamoeba invadens
VNRPKGDPVA

SEQ ID NO: 3038605 - protein, 4 aa, Entamoeba invadens
VNRQ

SEQ ID NO: 3038606 - protein, 15 aa, Entamoeba invadens
VNSNGLANQGQLTND

SEQ ID NO: 3038607 - protein, 16 aa, Entamoeba invadens
VNSNGTPNKTKSLKKH

SEQ ID NO: 3038608 - protein, 7 aa, Entamoeba invadens
VNSPSQT

SEQ ID NO: 3038609 - protein, 6 aa, Entamoeba invadens
VNTKTN

SEQ ID NO: 3038610 - protein, 11 aa, Entamoeba invadens
VNVNGKDVEKD

SEQ ID NO: 3038611 - protein, 22 aa, Entamoeba invadens
VPAPSAGWDTNPFEGTTKDGVV

SEQ ID NO: 3038612 - protein, 6 aa, Entamoeba invadens
VPCTSP

SEQ ID NO: 3038613 - protein, 8 aa, Entamoeba invadens
VPDSDSPC

SEQ ID NO: 3038614 - protein, 18 aa, Entamoeba invadens
VPDTENPCVEDPKKVENT

SEQ ID NO: 3038615 - protein, 5 aa, Entamoeba invadens
VPEET

SEQ ID NO: 3038616 - protein, 11 aa, Entamoeba invadens
VPEGDRLPRNH

SEQ ID NO: 3038617 - protein, 41 aa, Entamoeba invadens
VPEGIDTKTQQGAVGGKQTSRETKQRSSLKQPSSPEKEKRR

SEQ ID NO: 3038618 - protein, 12 aa, Entamoeba invadens
VPESYTLPGNCP

SEQ ID NO: 3038619 - protein, 10 aa, Entamoeba invadens
VPETFGPSIE

SEQ ID NO: 3038620 - protein, 14 aa, Entamoeba invadens
VPHTAKSSLKGYED

SEQ ID NO: 3038621 - protein, 5 aa, Entamoeba invadens
VPKKC

SEQ ID NO: 3038622 - protein, 15 aa, Entamoeba invadens
VPKPHVAKPTNDVAC

SEQ ID NO: 3038623 - protein, 8 aa, Entamoeba invadens
VPKSEAKK

SEQ ID NO: 3038624 - protein, 9 aa, Entamoeba invadens
VPKSNNQMQ

SEQ ID NO: 3038625 - protein, 8 aa, Entamoeba invadens
VPKSSDAK

SEQ ID NO: 3038626 - protein, 6 aa, Entamoeba invadens
VPNPFT

SEQ ID NO: 3038627 - protein, 5 aa, Entamoeba invadens
VPPKM

SEQ ID NO: 3038628 - protein, 22 aa, Entamoeba invadens
VPPPTQPSSAVKSVSSSPNSFD

SEQ ID NO: 3038629 - protein, 9 aa, Entamoeba invadens
VPQGSSTYE

SEQ ID NO: 3038630 - protein, 4 aa, Entamoeba invadens
VPQV

SEQ ID NO: 3038631 - protein, 14 aa, Entamoeba invadens
VPRTQQQQAQPTPL

SEQ ID NO: 3038632 - protein, 11 aa, Entamoeba invadens
VPSIDTTSKGC

SEQ ID NO: 3038633 - protein, 19 aa, Entamoeba invadens
VPSVSSKSPSTSKDGDEEV

SEQ ID NO: 3038634 - protein, 4 aa, Entamoeba invadens
VPTC

SEQ ID NO: 3038635 - protein, 45 aa, Entamoeba invadens
VPTETGDKGFTMGAPTASPPKSPQKEEQKTVIPQKKGGLAARRQT

SEQ ID NO: 3038636 - protein, 8 aa, Entamoeba invadens
VPTPTTAN

SEQ ID NO: 3038637 - protein, 13 aa, Entamoeba invadens
VPYQDPNIPGKDG

SEQ ID NO: 3038638 - protein, 5 aa, Entamoeba invadens
VPYTE

SEQ ID NO: 3038639 - protein, 25 aa, Entamoeba invadens
VQANYSKTKTPTTKSNSGSVSASYK

SEQ ID NO: 3038640 - protein, 5 aa, Entamoeba invadens
VQAPP

SEQ ID NO: 3038641 - protein, 10 aa, Entamoeba invadens
VQEGMASDDA

SEQ ID NO: 3038642 - protein, 8 aa, Entamoeba invadens
VQHDGTPA

SEQ ID NO: 3038643 - protein, 12 aa, Entamoeba invadens
VQKDQTTRKSQL

SEQ ID NO: 3038644 - protein, 5 aa, Entamoeba invadens
VQKRA

SEQ ID NO: 3038645 - protein, 20 aa, Entamoeba invadens
VQKSNGVIGNAQKEAEKQAT

SEQ ID NO: 3038646 - protein, 4 aa, Entamoeba invadens
VQMN

SEQ ID NO: 3038647 - protein, 4 aa, Entamoeba invadens
VQNS

SEQ ID NO: 3038648 - protein, 4 aa, Entamoeba invadens
VQNT

SEQ ID NO: 3038649 - protein, 13 aa, Entamoeba invadens
VQQPEKIEDPNEK

SEQ ID NO: 3038650 - protein, 4 aa, Entamoeba invadens
VQQT

SEQ ID NO: 3038651 - protein, 6 aa, Entamoeba invadens
VQRAND

SEQ ID NO: 3038652 - protein, 10 aa, Entamoeba invadens
VQREEAEVKE

SEQ ID NO: 3038653 - protein, 32 aa, Entamoeba invadens
VQSCQKSMSADNVRNLESAVQGSIGANVNGGF

SEQ ID NO: 3038654 - protein, 12 aa, Entamoeba invadens
VQSEKGSSAYLS

SEQ ID NO: 3038655 - protein, 9 aa, Entamoeba invadens
VQSGNGKQC

SEQ ID NO: 3038656 - protein, 12 aa, Entamoeba invadens
VQSPGLTASPAI

SEQ ID NO: 3038657 - protein, 4 aa, Entamoeba invadens
VQSV

SEQ ID NO: 3038658 - protein, 7 aa, Entamoeba invadens
VQSYGDG

SEQ ID NO: 3038659 - protein, 4 aa, Entamoeba invadens
VQTI

SEQ ID NO: 3038660 - protein, 13 aa, Entamoeba invadens
VRADDDSKYTNQN

SEQ ID NO: 3038661 - protein, 15 aa, Entamoeba invadens
VREDKKAKGYTSTTC

SEQ ID NO: 3038662 - protein, 5 aa, Entamoeba invadens
VREGK

SEQ ID NO: 3038663 - protein, 18 aa, Entamoeba invadens
VREKENIPCGCQNKRNTL

SEQ ID NO: 3038664 - protein, 4 aa, Entamoeba invadens
VRGF

SEQ ID NO: 3038665 - protein, 44 aa, Entamoeba invadens
VRKAPKRVKHHKAQTDNTTRLENNTSKRSEKRVKHTHKKVENLT

SEQ ID NO: 3038666 - protein, 5 aa, Entamoeba invadens
VRKSN

SEQ ID NO: 3038667 - protein, 7 aa, Entamoeba invadens
VRNTNAS

SEQ ID NO: 3038668 - protein, 19 aa, Entamoeba invadens
VRPKTTQRETPKQQPQQKI

SEQ ID NO: 3038669 - protein, 9 aa, Entamoeba invadens
VRRAERELR

SEQ ID NO: 3038670 - protein, 11 aa, Entamoeba invadens
VRRPKDQQELS

SEQ ID NO: 3038671 - protein, 4 aa, Entamoeba invadens
VRSE

SEQ ID NO: 3038672 - protein, 5 aa, Entamoeba invadens
VRSED

SEQ ID NO: 3038673 - protein, 18 aa, Entamoeba invadens
VRSGTGYSVSVQNSTNVT

SEQ ID NO: 3038674 - protein, 30 aa, Entamoeba invadens
VRSSNKNETISGVTATKLTRNEWTETLKNN

SEQ ID NO: 3038675 - protein, 7 aa, Entamoeba invadens
VSAEDRL

SEQ ID NO: 3038676 - protein, 12 aa, Entamoeba invadens
VSAEEGGKDRKI

SEQ ID NO: 3038677 - protein, 8 aa, Entamoeba invadens
VSDNLKKS

SEQ ID NO: 3038678 - protein, 4 aa, Entamoeba invadens
VSDS

SEQ ID NO: 3038679 - protein, 8 aa, Entamoeba invadens
VSDSKGVL

SEQ ID NO: 3038680 - protein, 9 aa, Entamoeba invadens
VSDSNEYSL

SEQ ID NO: 3038681 - protein, 7 aa, Entamoeba invadens
VSECPSP

SEQ ID NO: 3038682 - protein, 15 aa, Entamoeba invadens
VSEGRKSSSESEKND

SEQ ID NO: 3038683 - protein, 5 aa, Entamoeba invadens
VSEKS

SEQ ID NO: 3038684 - protein, 6 aa, Entamoeba invadens
VSENPY

SEQ ID NO: 3038685 - protein, 13 aa, Entamoeba invadens
VSFESQNKELQTR

SEQ ID NO: 3038686 - protein, 8 aa, Entamoeba invadens
VSFSSNHP

SEQ ID NO: 3038687 - protein, 27 aa, Entamoeba invadens
VSGEHQQKDDPPTKDESSTEKETGKTD

SEQ ID NO: 3038688 - protein, 10 aa, Entamoeba invadens
VSGKDGLTAN

SEQ ID NO: 3038689 - protein, 14 aa, Entamoeba invadens
VSGNYGTAERGKEN

SEQ ID NO: 3038690 - protein, 19 aa, Entamoeba invadens
VSGQVAKKAMEKSKTARTQ

SEQ ID NO: 3038691 - protein, 15 aa, Entamoeba invadens
VSGSPDFEINSTKKY

SEQ ID NO: 3038692 - protein, 33 aa, Entamoeba invadens
VSHAEYELEDDNKYEKEKAEISEKIREKIEKKI

SEQ ID NO: 3038693 - protein, 5 aa, Entamoeba invadens
VSIEK

SEQ ID NO: 3038694 - protein, 7 aa, Entamoeba invadens
VSISTSK

SEQ ID NO: 3038695 - protein, 7 aa, Entamoeba invadens
VSKATNK

SEQ ID NO: 3038696 - protein, 8 aa, Entamoeba invadens
VSKDATAL

SEQ ID NO: 3038697 - protein, 6 aa, Entamoeba invadens
VSKEDE

SEQ ID NO: 3038698 - protein, 20 aa, Entamoeba invadens
VSKRCGAKPEIISAEEPETC

SEQ ID NO: 3038699 - protein, 5 aa, Entamoeba invadens
VSKTQ

SEQ ID NO: 3038700 - protein, 11 aa, Entamoeba invadens
VSKYSGPLDAT

SEQ ID NO: 3038701 - protein, 10 aa, Entamoeba invadens
VSLGRNEEGY

SEQ ID NO: 3038702 - protein, 6 aa, Entamoeba invadens
VSNEEL

SEQ ID NO: 3038703 - protein, 22 aa, Entamoeba invadens
VSNGKCKSCDASCGGSCDTTNG

SEQ ID NO: 3038704 - protein, 6 aa, Entamoeba invadens
VSPEDM

SEQ ID NO: 3038705 - protein, 22 aa, Entamoeba invadens
VSPNTQSKKKTVDYQDDDVPTS

SEQ ID NO: 3038706 - protein, 9 aa, Entamoeba invadens
VSPTGSITT

SEQ ID NO: 3038707 - protein, 7 aa, Entamoeba invadens
VSPTTTP

SEQ ID NO: 3038708 - protein, 8 aa, Entamoeba invadens
VSQGGCSA

SEQ ID NO: 3038709 - protein, 10 aa, Entamoeba invadens
VSQPTDAGSI

SEQ ID NO: 3038710 - protein, 9 aa, Entamoeba invadens
VSQPTSASS

SEQ ID NO: 3038711 - protein, 10 aa, Entamoeba invadens
VSQPTSTSSF

SEQ ID NO: 3038712 - protein, 9 aa, Entamoeba invadens
VSRARDATK

SEQ ID NO: 3038713 - protein, 7 aa, Entamoeba invadens
VSRTSKV

SEQ ID NO: 3038714 - protein, 13 aa, Entamoeba invadens
VSSNVKSPSLNGV

SEQ ID NO: 3038715 - protein, 9 aa, Entamoeba invadens
VSSSKYSTL

SEQ ID NO: 3038716 - protein, 11 aa, Entamoeba invadens
VSSTTEQEQTD

SEQ ID NO: 3038717 - protein, 4 aa, Entamoeba invadens
VSSY

SEQ ID NO: 3038718 - protein, 7 aa, Entamoeba invadens
VSTDRTI

SEQ ID NO: 3038719 - protein, 4 aa, Entamoeba invadens
VSTE

SEQ ID NO: 3038720 - protein, 19 aa, Entamoeba invadens
VSTEDNRVSITNYSDSECK

SEQ ID NO: 3038721 - protein, 15 aa, Entamoeba invadens
VSTGKPTEDGLTDDA

SEQ ID NO: 3038722 - protein, 16 aa, Entamoeba invadens
VSTTTKCTKCTKTTDY

SEQ ID NO: 3038723 - protein, 6 aa, Entamoeba invadens
VTANGG

SEQ ID NO: 3038724 - protein, 24 aa, Entamoeba invadens
VTDDPDVPEPSETPINSEVKPVDN

SEQ ID NO: 3038725 - protein, 8 aa, Entamoeba invadens
VTDGTNKI

SEQ ID NO: 3038726 - protein, 12 aa, Entamoeba invadens
VTDNLSGAEREK

SEQ ID NO: 3038727 - protein, 19 aa, Entamoeba invadens
VTDSEAKLADAGATGASIA

SEQ ID NO: 3038728 - protein, 7 aa, Entamoeba invadens
VTEDSKS

SEQ ID NO: 3038729 - protein, 7 aa, Entamoeba invadens
VTEEEYN

SEQ ID NO: 3038730 - protein, 8 aa, Entamoeba invadens
VTEHAKDN

SEQ ID NO: 3038731 - protein, 4 aa, Entamoeba invadens
VTEK

SEQ ID NO: 3038732 - protein, 8 aa, Entamoeba invadens
VTEQGHSP

SEQ ID NO: 3038733 - protein, 11 aa, Entamoeba invadens
VTFETTNGGNY

SEQ ID NO: 3038734 - protein, 10 aa, Entamoeba invadens
VTGKQKEMNN

SEQ ID NO: 3038735 - protein, 10 aa, Entamoeba invadens
VTGSTKDDRG

SEQ ID NO: 3038736 - protein, 18 aa, Entamoeba invadens
VTGSTTQCQTCKNPNKLS

SEQ ID NO: 3038737 - protein, 15 aa, Entamoeba invadens
VTGWGDRDDSFRTLS

SEQ ID NO: 3038738 - protein, 60 aa, Entamoeba invadens
VTKDDNSTSSQTPQESNNSKEPETSDSSFNGNSTESETNETSSVSTSQGTNPEQPKDGVD

SEQ ID NO: 3038739 - protein, 10 aa, Entamoeba invadens
VTKKPADADG

SEQ ID NO: 3038740 - protein, 4 aa, Entamoeba invadens
VTKL

SEQ ID NO: 3038741 - protein, 5 aa, Entamoeba invadens
VTKQD

SEQ ID NO: 3038742 - protein, 14 aa, Entamoeba invadens
VTLSEGSSCNDDDL

SEQ ID NO: 3038743 - protein, 16 aa, Entamoeba invadens
VTLSGSTSPNTLSGKS

SEQ ID NO: 3038744 - protein, 10 aa, Entamoeba invadens
VTNGDNVQQV

SEQ ID NO: 3038745 - protein, 5 aa, Entamoeba invadens
VTNNS

SEQ ID NO: 3038746 - protein, 4 aa, Entamoeba invadens
VTNP

SEQ ID NO: 3038747 - protein, 9 aa, Entamoeba invadens
VTNSTNCQK

SEQ ID NO: 3038748 - protein, 42 aa, Entamoeba invadens
VTPAGQSQNTTLSNSTKLTNETNTTLPNIPQNTTTPITPTTI

SEQ ID NO: 3038749 - protein, 5 aa, Entamoeba invadens
VTPKN

SEQ ID NO: 3038750 - protein, 8 aa, Entamoeba invadens
VTPPETFA

SEQ ID NO: 3038751 - protein, 6 aa, Entamoeba invadens
VTPSTF

SEQ ID NO: 3038752 - protein, 7 aa, Entamoeba invadens
VTQGRHT

SEQ ID NO: 3038753 - protein, 19 aa, Entamoeba invadens
VTSNKIPQTAFKKSDRYKN

SEQ ID NO: 3038754 - protein, 5 aa, Entamoeba invadens
VTSTE

SEQ ID NO: 3038755 - protein, 10 aa, Entamoeba invadens
VTTQDRNRFP

SEQ ID NO: 3038756 - protein, 11 aa, Entamoeba invadens
VTTSDEKNDYK

SEQ ID NO: 3038757 - protein, 5 aa, Entamoeba invadens
VTYED

SEQ ID NO: 3038758 - protein, 14 aa, Entamoeba invadens
VVETPKKALPPQEE

SEQ ID NO: 3038759 - protein, 12 aa, Entamoeba invadens
VWEPSGYDGINR

SEQ ID NO: 3038760 - protein, 7 aa, Entamoeba invadens
VYDEPNC

SEQ ID NO: 3038761 - protein, 6 aa, Entamoeba invadens
VYDEPR

SEQ ID NO: 3038762 - protein, 8 aa, Entamoeba invadens
VYEDSQKG

SEQ ID NO: 3038763 - protein, 4 aa, Entamoeba invadens
VYNT

SEQ ID NO: 3038764 - protein, 7 aa, Entamoeba invadens
VYQTNED

SEQ ID NO: 3038765 - protein, 20 aa, Entamoeba invadens
VYSGDGVKVSHTASTKRGLV

SEQ ID NO: 3038766 - protein, 16 aa, Entamoeba invadens
VYSPDEKNESEKTPNG

SEQ ID NO: 3038767 - protein, 10 aa, Entamoeba invadens
VYSPEEKNES

SEQ ID NO: 3038768 - protein, 10 aa, Entamoeba invadens
VYTDTKCGTG

SEQ ID NO: 3038769 - protein, 10 aa, Entamoeba invadens
WAAPDKERMQ

SEQ ID NO: 3038770 - protein, 13 aa, Entamoeba invadens
WAKPTAKRYSPNN

SEQ ID NO: 3038771 - protein, 12 aa, Entamoeba invadens
WANQKTKNCDEC

SEQ ID NO: 3038772 - protein, 21 aa, Entamoeba invadens
WARSSSSAAFKDPQGNTNDEY

SEQ ID NO: 3038773 - protein, 7 aa, Entamoeba invadens
WASSAPL

SEQ ID NO: 3038774 - protein, 12 aa, Entamoeba invadens
WDPKGYDGVNRG

SEQ ID NO: 3038775 - protein, 21 aa, Entamoeba invadens
WGAGGNSDSEDLKRLKEASGR

SEQ ID NO: 3038776 - protein, 9 aa, Entamoeba invadens
WGDRSGSIK

SEQ ID NO: 3038777 - protein, 8 aa, Entamoeba invadens
WGSDWGEN

SEQ ID NO: 3038778 - protein, 6 aa, Entamoeba invadens
WGTEWG

SEQ ID NO: 3038779 - protein, 7 aa, Entamoeba invadens
WGTNWGE

SEQ ID NO: 3038780 - protein, 8 aa, Entamoeba invadens
WGTNWGEE

SEQ ID NO: 3038781 - protein, 8 aa, Entamoeba invadens
WGTNWGES

SEQ ID NO: 3038782 - protein, 7 aa, Entamoeba invadens
WGYNSQN

SEQ ID NO: 3038783 - protein, 9 aa, Entamoeba invadens
WHESVDDQN

SEQ ID NO: 3038784 - protein, 6 aa, Entamoeba invadens
WIDKGN

SEQ ID NO: 3038785 - protein, 12 aa, Entamoeba invadens
WIDSTSSGKTLG

SEQ ID NO: 3038786 - protein, 19 aa, Entamoeba invadens
WKETNKDRKCNKKYTQEEA

SEQ ID NO: 3038787 - protein, 7 aa, Entamoeba invadens
WKSDEKL

SEQ ID NO: 3038788 - protein, 10 aa, Entamoeba invadens
WKSSKTENTA

SEQ ID NO: 3038789 - protein, 7 aa, Entamoeba invadens
WLPPDDK

SEQ ID NO: 3038790 - protein, 8 aa, Entamoeba invadens
WNDDQNIP

SEQ ID NO: 3038791 - protein, 9 aa, Entamoeba invadens
WNKKAKGSR

SEQ ID NO: 3038792 - protein, 25 aa, Entamoeba invadens
WNKPPEQPTEGAANSKAPKKKGCSL

SEQ ID NO: 3038793 - protein, 5 aa, Entamoeba invadens
WNPYA

SEQ ID NO: 3038794 - protein, 5 aa, Entamoeba invadens
WNSPT

SEQ ID NO: 3038795 - protein, 20 aa, Entamoeba invadens
WSFSSSATVHTTDKKDGLQS

SEQ ID NO: 3038796 - protein, 10 aa, Entamoeba invadens
WSKNTQTNRK

SEQ ID NO: 3038797 - protein, 10 aa, Entamoeba invadens
WSSNKQTNIA

SEQ ID NO: 3038798 - protein, 14 aa, Entamoeba invadens
WTAPASSTAAFAPQ

SEQ ID NO: 3038799 - protein, 9 aa, Entamoeba invadens
WTGSYSSNK

SEQ ID NO: 3038800 - protein, 6 aa, Entamoeba invadens
WTPENG

SEQ ID NO: 3038801 - protein, 9 aa, Entamoeba invadens
WTSSVSTNR

SEQ ID NO: 3038802 - protein, 9 aa, Entamoeba invadens
WTSSVTSNR

SEQ ID NO: 3038803 - protein, 8 aa, Entamoeba invadens
YAAANGYK

SEQ ID NO: 3038804 - protein, 13 aa, Entamoeba invadens
YAAKEGSSSCEPC

SEQ ID NO: 3038805 - protein, 6 aa, Entamoeba invadens
YAAKNE

SEQ ID NO: 3038806 - protein, 12 aa, Entamoeba invadens
YADKKDTKKLVE

SEQ ID NO: 3038807 - protein, 11 aa, Entamoeba invadens
YAELSEAHETV

SEQ ID NO: 3038808 - protein, 16 aa, Entamoeba invadens
YAGSRYQKTYRNLPSQ

SEQ ID NO: 3038809 - protein, 21 aa, Entamoeba invadens
YAGVTDNTECTCKPTTTSVTN

SEQ ID NO: 3038810 - protein, 7 aa, Entamoeba invadens
YANDSNA

SEQ ID NO: 3038811 - protein, 16 aa, Entamoeba invadens
YANSANNKCQQCGDKT

SEQ ID NO: 3038812 - protein, 25 aa, Entamoeba invadens
YANSANNKCQQCGDKTYQPNEGQTF

SEQ ID NO: 3038813 - protein, 11 aa, Entamoeba invadens
YANTEGSTQCT

SEQ ID NO: 3038814 - protein, 12 aa, Entamoeba invadens
YAPPPAEGATDI

SEQ ID NO: 3038815 - protein, 7 aa, Entamoeba invadens
YAPRVNR

SEQ ID NO: 3038816 - protein, 7 aa, Entamoeba invadens
YAPSSSD

SEQ ID NO: 3038817 - protein, 11 aa, Entamoeba invadens
YAPSTDPFPNA

SEQ ID NO: 3038818 - protein, 7 aa, Entamoeba invadens
YAQPGTI

SEQ ID NO: 3038819 - protein, 6 aa, Entamoeba invadens
YAQTQN

SEQ ID NO: 3038820 - protein, 13 aa, Entamoeba invadens
YASSSGSSSCTQC

SEQ ID NO: 3038821 - protein, 6 aa, Entamoeba invadens
YATITG

SEQ ID NO: 3038822 - protein, 4 aa, Entamoeba invadens
YATN

SEQ ID NO: 3038823 - protein, 6 aa, Entamoeba invadens
YDAENV

SEQ ID NO: 3038824 - protein, 6 aa, Entamoeba invadens
YDARND

SEQ ID NO: 3038825 - protein, 10 aa, Entamoeba invadens
YDDATARARV

SEQ ID NO: 3038826 - protein, 8 aa, Entamoeba invadens
YDDEYADD

SEQ ID NO: 3038827 - protein, 6 aa, Entamoeba invadens
YDDSER

SEQ ID NO: 3038828 - protein, 4 aa, Entamoeba invadens
YDDT

SEQ ID NO: 3038829 - protein, 14 aa, Entamoeba invadens
YDEKKAEEKYCKNY

SEQ ID NO: 3038830 - protein, 6 aa, Entamoeba invadens
YDESKN

SEQ ID NO: 3038831 - protein, 16 aa, Entamoeba invadens
YDGANKPLGTKSYKVT

SEQ ID NO: 3038832 - protein, 4 aa, Entamoeba invadens
YDGD

SEQ ID NO: 3038833 - protein, 11 aa, Entamoeba invadens
YDGKKAKVVKK

SEQ ID NO: 3038834 - protein, 4 aa, Entamoeba invadens
YDGN

SEQ ID NO: 3038835 - protein, 8 aa, Entamoeba invadens
YDGNAGLV

SEQ ID NO: 3038836 - protein, 7 aa, Entamoeba invadens
YDKTAKN

SEQ ID NO: 3038837 - protein, 8 aa, Entamoeba invadens
YDNGDGVV

SEQ ID NO: 3038838 - protein, 6 aa, Entamoeba invadens
YDPQDF

SEQ ID NO: 3038839 - protein, 5 aa, Entamoeba invadens
YDPTL

SEQ ID NO: 3038840 - protein, 8 aa, Entamoeba invadens
YDTNSVDD

SEQ ID NO: 3038841 - protein, 5 aa, Entamoeba invadens
YDTYN

SEQ ID NO: 3038842 - protein, 8 aa, Entamoeba invadens
YECPNART

SEQ ID NO: 3038843 - protein, 5 aa, Entamoeba invadens
YEECG

SEQ ID NO: 3038844 - protein, 12 aa, Entamoeba invadens
YEGGTPATPEER

SEQ ID NO: 3038845 - protein, 13 aa, Entamoeba invadens
YEGMGSERPGFET

SEQ ID NO: 3038846 - protein, 4 aa, Entamoeba invadens
YEGY

SEQ ID NO: 3038847 - protein, 11 aa, Entamoeba invadens
YEIPPSTPINS

SEQ ID NO: 3038848 - protein, 21 aa, Entamoeba invadens
YEKSGYSQKYPDVNEYTDNAR

SEQ ID NO: 3038849 - protein, 6 aa, Entamoeba invadens
YEMKPG

SEQ ID NO: 3038850 - protein, 14 aa, Entamoeba invadens
YENEGDGTVESQSL

SEQ ID NO: 3038851 - protein, 6 aa, Entamoeba invadens
YENNVE

SEQ ID NO: 3038852 - protein, 11 aa, Entamoeba invadens
YENSLESDKDA

SEQ ID NO: 3038853 - protein, 5 aa, Entamoeba invadens
YENSR

SEQ ID NO: 3038854 - protein, 4 aa, Entamoeba invadens
YEQQ

SEQ ID NO: 3038855 - protein, 6 aa, Entamoeba invadens
YEQSRQ

SEQ ID NO: 3038856 - protein, 11 aa, Entamoeba invadens
YEQTEKRFKEN

SEQ ID NO: 3038857 - protein, 6 aa, Entamoeba invadens
YERGTT

SEQ ID NO: 3038858 - protein, 7 aa, Entamoeba invadens
YESDEYD

SEQ ID NO: 3038859 - protein, 16 aa, Entamoeba invadens
YESSAEYGVNSLSPSE

SEQ ID NO: 3038860 - protein, 6 aa, Entamoeba invadens
YETTDP

SEQ ID NO: 3038861 - protein, 8 aa, Entamoeba invadens
YFKSTQEK

SEQ ID NO: 3038862 - protein, 12 aa, Entamoeba invadens
YFSNSGDATCTK

SEQ ID NO: 3038863 - protein, 7 aa, Entamoeba invadens
YFTESGS

SEQ ID NO: 3038864 - protein, 9 aa, Entamoeba invadens
YGASTYPSC

SEQ ID NO: 3038865 - protein, 9 aa, Entamoeba invadens
YGDNYKTIS

SEQ ID NO: 3038866 - protein, 21 aa, Entamoeba invadens
YGDSNRANELRNRANELSTGF

SEQ ID NO: 3038867 - protein, 8 aa, Entamoeba invadens
YGEEDKSV

SEQ ID NO: 3038868 - protein, 10 aa, Entamoeba invadens
YGEELSGPEY

SEQ ID NO: 3038869 - protein, 4 aa, Entamoeba invadens
YGEP

SEQ ID NO: 3038870 - protein, 5 aa, Entamoeba invadens
YGGDD

SEQ ID NO: 3038871 - protein, 4 aa, Entamoeba invadens
YGGP

SEQ ID NO: 3038872 - protein, 5 aa, Entamoeba invadens
YGIKN

SEQ ID NO: 3038873 - protein, 8 aa, Entamoeba invadens
YGKNDDGE

SEQ ID NO: 3038874 - protein, 8 aa, Entamoeba invadens
YGKNTDGE

SEQ ID NO: 3038875 - protein, 17 aa, Entamoeba invadens
YGKSANCTFSDEEGLPK

SEQ ID NO: 3038876 - protein, 24 aa, Entamoeba invadens
YGNDKYTGKMNAPEFPGASYGPSN

SEQ ID NO: 3038877 - protein, 6 aa, Entamoeba invadens
YGNLNG

SEQ ID NO: 3038878 - protein, 6 aa, Entamoeba invadens
YGNPYS

SEQ ID NO: 3038879 - protein, 7 aa, Entamoeba invadens
YGQDYAE

SEQ ID NO: 3038880 - protein, 8 aa, Entamoeba invadens
YGSEKGED

SEQ ID NO: 3038881 - protein, 4 aa, Entamoeba invadens
YGSL

SEQ ID NO: 3038882 - protein, 4 aa, Entamoeba invadens
YGSP

SEQ ID NO: 3038883 - protein, 8 aa, Entamoeba invadens
YGSQNGND

SEQ ID NO: 3038884 - protein, 18 aa, Entamoeba invadens
YGSSQKSPESSPDTSKKS

SEQ ID NO: 3038885 - protein, 8 aa, Entamoeba invadens
YGSTEGGE

SEQ ID NO: 3038886 - protein, 5 aa, Entamoeba invadens
YGTLD

SEQ ID NO: 3038887 - protein, 7 aa, Entamoeba invadens
YGTLDGD

SEQ ID NO: 3038888 - protein, 6 aa, Entamoeba invadens
YGTLPK

SEQ ID NO: 3038889 - protein, 8 aa, Entamoeba invadens
YGTTEDGV

SEQ ID NO: 3038890 - protein, 8 aa, Entamoeba invadens
YGTTKDGQ

SEQ ID NO: 3038891 - protein, 9 aa, Entamoeba invadens
YGYAPKGSS

SEQ ID NO: 3038892 - protein, 19 aa, Entamoeba invadens
YGYDRDETGKVGKTAGRIA

SEQ ID NO: 3038893 - protein, 5 aa, Entamoeba invadens
YGYQH

SEQ ID NO: 3038894 - protein, 12 aa, Entamoeba invadens
YGYSQGNNDYWG

SEQ ID NO: 3038895 - protein, 12 aa, Entamoeba invadens
YGYSQSNNDYWG

SEQ ID NO: 3038896 - protein, 4 aa, Entamoeba invadens
YHDT

SEQ ID NO: 3038897 - protein, 5 aa, Entamoeba invadens
YHDTK

SEQ ID NO: 3038898 - protein, 14 aa, Entamoeba invadens
YHNPQEKTSEEDLE

SEQ ID NO: 3038899 - protein, 12 aa, Entamoeba invadens
YHTTNDNTVEQC

SEQ ID NO: 3038900 - protein, 12 aa, Entamoeba invadens
YIPNSPKTTSCQ

SEQ ID NO: 3038901 - protein, 5 aa, Entamoeba invadens
YIRSG

SEQ ID NO: 3038902 - protein, 12 aa, Entamoeba invadens
YKADPTTSARAM

SEQ ID NO: 3038903 - protein, 20 aa, Entamoeba invadens
YKCQSCSSTCGGACNGSNGF

SEQ ID NO: 3038904 - protein, 6 aa, Entamoeba invadens
YKDAKC

SEQ ID NO: 3038905 - protein, 13 aa, Entamoeba invadens
YKDGKSCKKCSAT

SEQ ID NO: 3038906 - protein, 9 aa, Entamoeba invadens
YKDYNGANA

SEQ ID NO: 3038907 - protein, 10 aa, Entamoeba invadens
YKEAKEEVQE

SEQ ID NO: 3038908 - protein, 5 aa, Entamoeba invadens
YKEQC

SEQ ID NO: 3038909 - protein, 4 aa, Entamoeba invadens
YKGK

SEQ ID NO: 3038910 - protein, 74 aa, Entamoeba invadens
YKHKPTPQVHSEPTSTQTGSAIQGTPIQHPEQPTVQQQGAQPTEHSSQSPTTTPVQETHPQQPKEPQHKQEQKR

SEQ ID NO: 3038911 - protein, 8 aa, Entamoeba invadens
YKINDRAK

SEQ ID NO: 3038912 - protein, 6 aa, Entamoeba invadens
YKKGVD

SEQ ID NO: 3038913 - protein, 9 aa, Entamoeba invadens
YKKSADKTC

SEQ ID NO: 3038914 - protein, 8 aa, Entamoeba invadens
YKKSQRHD

SEQ ID NO: 3038915 - protein, 4 aa, Entamoeba invadens
YKLT

SEQ ID NO: 3038916 - protein, 8 aa, Entamoeba invadens
YKLTTDNK

SEQ ID NO: 3038917 - protein, 8 aa, Entamoeba invadens
YKNEDDTF

SEQ ID NO: 3038918 - protein, 19 aa, Entamoeba invadens
YKNSKTTNIDHQRKNSMSC

SEQ ID NO: 3038919 - protein, 7 aa, Entamoeba invadens
YKNTGKK

SEQ ID NO: 3038920 - protein, 7 aa, Entamoeba invadens
YKNTSKC

SEQ ID NO: 3038921 - protein, 9 aa, Entamoeba invadens
YKPAPKNDI

SEQ ID NO: 3038922 - protein, 6 aa, Entamoeba invadens
YKPQDI

SEQ ID NO: 3038923 - protein, 10 aa, Entamoeba invadens
YKRKNTLDRS

SEQ ID NO: 3038924 - protein, 7 aa, Entamoeba invadens
YKSGDIS

SEQ ID NO: 3038925 - protein, 9 aa, Entamoeba invadens
YKSGQTCTK

SEQ ID NO: 3038926 - protein, 5 aa, Entamoeba invadens
YKSTI

SEQ ID NO: 3038927 - protein, 8 aa, Entamoeba invadens
YKSTPGDV

SEQ ID NO: 3038928 - protein, 10 aa, Entamoeba invadens
YKTGTEPKTS

SEQ ID NO: 3038929 - protein, 8 aa, Entamoeba invadens
YKTKEEAV

SEQ ID NO: 3038930 - protein, 9 aa, Entamoeba invadens
YKTKPCKFS

SEQ ID NO: 3038931 - protein, 5 aa, Entamoeba invadens
YKTWT

SEQ ID NO: 3038932 - protein, 15 aa, Entamoeba invadens
YKTYNTTVNGKEVKK

SEQ ID NO: 3038933 - protein, 6 aa, Entamoeba invadens
YKYDAE

SEQ ID NO: 3038934 - protein, 7 aa, Entamoeba invadens
YLSNGPK

SEQ ID NO: 3038935 - protein, 5 aa, Entamoeba invadens
YMRSG

SEQ ID NO: 3038936 - protein, 10 aa, Entamoeba invadens
YMRSSDGSTC

SEQ ID NO: 3038937 - protein, 6 aa, Entamoeba invadens
YNDSFE

SEQ ID NO: 3038938 - protein, 9 aa, Entamoeba invadens
YNDTKFAER

SEQ ID NO: 3038939 - protein, 7 aa, Entamoeba invadens
YNECPSD

SEQ ID NO: 3038940 - protein, 9 aa, Entamoeba invadens
YNGSNTECY

SEQ ID NO: 3038941 - protein, 5 aa, Entamoeba invadens
YNKDR

SEQ ID NO: 3038942 - protein, 7 aa, Entamoeba invadens
YNKQETC

SEQ ID NO: 3038943 - protein, 7 aa, Entamoeba invadens
YNKQTST

SEQ ID NO: 3038944 - protein, 13 aa, Entamoeba invadens
YNKRDSTRTSCSS

SEQ ID NO: 3038945 - protein, 11 aa, Entamoeba invadens
YNKYNNKDKKL

SEQ ID NO: 3038946 - protein, 12 aa, Entamoeba invadens
YNLDTSTNQDHI

SEQ ID NO: 3038947 - protein, 6 aa, Entamoeba invadens
YNNNPK

SEQ ID NO: 3038948 - protein, 9 aa, Entamoeba invadens
YNPFPRKNR

SEQ ID NO: 3038949 - protein, 9 aa, Entamoeba invadens
YNPNQQQQQ

SEQ ID NO: 3038950 - protein, 8 aa, Entamoeba invadens
YNQDCRNK

SEQ ID NO: 3038951 - protein, 14 aa, Entamoeba invadens
YNSDPTIDFSPEEL

SEQ ID NO: 3038952 - protein, 7 aa, Entamoeba invadens
YNSGTYN

SEQ ID NO: 3038953 - protein, 5 aa, Entamoeba invadens
YNSTT

SEQ ID NO: 3038954 - protein, 8 aa, Entamoeba invadens
YNSTTHTL

SEQ ID NO: 3038955 - protein, 7 aa, Entamoeba invadens
YNTERPK

SEQ ID NO: 3038956 - protein, 16 aa, Entamoeba invadens
YNTSTTCAGTPSNVVT

SEQ ID NO: 3038957 - protein, 15 aa, Entamoeba invadens
YNTSTTCAGTPTNVV

SEQ ID NO: 3038958 - protein, 8 aa, Entamoeba invadens
YNTTKSPF

SEQ ID NO: 3038959 - protein, 17 aa, Entamoeba invadens
YNYAKNAKFTDADDIKD

SEQ ID NO: 3038960 - protein, 4 aa, Entamoeba invadens
YNYT

SEQ ID NO: 3038961 - protein, 10 aa, Entamoeba invadens
YPAESGSCAT

SEQ ID NO: 3038962 - protein, 16 aa, Entamoeba invadens
YPATDNPQTAGNELYT

SEQ ID NO: 3038963 - protein, 11 aa, Entamoeba invadens
YPCQEGRYTYT

SEQ ID NO: 3038964 - protein, 6 aa, Entamoeba invadens
YPDENG

SEQ ID NO: 3038965 - protein, 8 aa, Entamoeba invadens
YPDESTKK

SEQ ID NO: 3038966 - protein, 4 aa, Entamoeba invadens
YPDL

SEQ ID NO: 3038967 - protein, 5 aa, Entamoeba invadens
YPDYA

SEQ ID NO: 3038968 - protein, 15 aa, Entamoeba invadens
YPESNVYTASNENYN

SEQ ID NO: 3038969 - protein, 15 aa, Entamoeba invadens
YPGDEDNEGSKEDVN

SEQ ID NO: 3038970 - protein, 6 aa, Entamoeba invadens
YPGYNG

SEQ ID NO: 3038971 - protein, 21 aa, Entamoeba invadens
YPHYKSTDTFTQEEKQNIVTE

SEQ ID NO: 3038972 - protein, 11 aa, Entamoeba invadens
YPISSTSNNHE

SEQ ID NO: 3038973 - protein, 5 aa, Entamoeba invadens
YPKED

SEQ ID NO: 3038974 - protein, 5 aa, Entamoeba invadens
YPKEE

SEQ ID NO: 3038975 - protein, 8 aa, Entamoeba invadens
YPKTHGDA

SEQ ID NO: 3038976 - protein, 5 aa, Entamoeba invadens
YPLPP

SEQ ID NO: 3038977 - protein, 21 aa, Entamoeba invadens
YPNSPNGPSLSDCENYSSTPS

SEQ ID NO: 3038978 - protein, 12 aa, Entamoeba invadens
YPNYPSTEGISS

SEQ ID NO: 3038979 - protein, 5 aa, Entamoeba invadens
YPPES

SEQ ID NO: 3038980 - protein, 6 aa, Entamoeba invadens
YPPPVQ

SEQ ID NO: 3038981 - protein, 5 aa, Entamoeba invadens
YPPQD

SEQ ID NO: 3038982 - protein, 10 aa, Entamoeba invadens
YPQLSDSTFE

SEQ ID NO: 3038983 - protein, 13 aa, Entamoeba invadens
YPQPEHNASQVYP

SEQ ID NO: 3038984 - protein, 14 aa, Entamoeba invadens
YPQQQQQQQQQQQI

SEQ ID NO: 3038985 - protein, 12 aa, Entamoeba invadens
YPQTKNSRNKAQ

SEQ ID NO: 3038986 - protein, 4 aa, Entamoeba invadens
YPQY

SEQ ID NO: 3038987 - protein, 27 aa, Entamoeba invadens
YPSSDESDASSSTTSTPSRKSSEERNI

SEQ ID NO: 3038988 - protein, 10 aa, Entamoeba invadens
YPSSTTPDTC

SEQ ID NO: 3038989 - protein, 5 aa, Entamoeba invadens
YPSTV

SEQ ID NO: 3038990 - protein, 24 aa, Entamoeba invadens
YPYTDYSYQSDNSTCQASGVESHQ

SEQ ID NO: 3038991 - protein, 8 aa, Entamoeba invadens
YQDKNGVY

SEQ ID NO: 3038992 - protein, 7 aa, Entamoeba invadens
YQEDTED

SEQ ID NO: 3038993 - protein, 27 aa, Entamoeba invadens
YQETSGKVSHTATSKTSLIDKKKNPYA

SEQ ID NO: 3038994 - protein, 8 aa, Entamoeba invadens
YQETSSRV

SEQ ID NO: 3038995 - protein, 11 aa, Entamoeba invadens
YQFGDGDDTVN

SEQ ID NO: 3038996 - protein, 10 aa, Entamoeba invadens
YQGRRPKNVT

SEQ ID NO: 3038997 - protein, 9 aa, Entamoeba invadens
YQGSNGPYD

SEQ ID NO: 3038998 - protein, 16 aa, Entamoeba invadens
YQGTTSMCSGSVDFNY

SEQ ID NO: 3038999 - protein, 5 aa, Entamoeba invadens
YQPEY

SEQ ID NO: 3039000 - protein, 6 aa, Entamoeba invadens
YQQPKQ

SEQ ID NO: 3039001 - protein, 8 aa, Entamoeba invadens
YQSEKGQS

SEQ ID NO: 3039002 - protein, 5 aa, Entamoeba invadens
YQSLS

SEQ ID NO: 3039003 - protein, 10 aa, Entamoeba invadens
YQSSGDPDCK

SEQ ID NO: 3039004 - protein, 14 aa, Entamoeba invadens
YQSTRIARPKPQIA

SEQ ID NO: 3039005 - protein, 12 aa, Entamoeba invadens
YQTSYNGNKNYP

SEQ ID NO: 3039006 - protein, 16 aa, Entamoeba invadens
YQTTEKEPKKKNKTYY

SEQ ID NO: 3039007 - protein, 4 aa, Entamoeba invadens
YRED

SEQ ID NO: 3039008 - protein, 10 aa, Entamoeba invadens
YRENGRQKGF

SEQ ID NO: 3039009 - protein, 4 aa, Entamoeba invadens
YREQ

SEQ ID NO: 3039010 - protein, 8 aa, Entamoeba invadens
YRPCSPGT

SEQ ID NO: 3039011 - protein, 13 aa, Entamoeba invadens
YRPVGTSNIDRTE

SEQ ID NO: 3039012 - protein, 5 aa, Entamoeba invadens
YRSDD

SEQ ID NO: 3039013 - protein, 8 aa, Entamoeba invadens
YRTHQPEE

SEQ ID NO: 3039014 - protein, 7 aa, Entamoeba invadens
YRTPNNV

SEQ ID NO: 3039015 - protein, 7 aa, Entamoeba invadens
YRTSSNV

SEQ ID NO: 3039016 - protein, 19 aa, Entamoeba invadens
YRWQTPPRGSEDWKEGYQG

SEQ ID NO: 3039017 - protein, 24 aa, Entamoeba invadens
YSAAGSSSCQQCDTKCDGCDATNG

SEQ ID NO: 3039018 - protein, 9 aa, Entamoeba invadens
YSAASSVGL

SEQ ID NO: 3039019 - protein, 15 aa, Entamoeba invadens
YSCPKGTFKNTQTTC

SEQ ID NO: 3039020 - protein, 6 aa, Entamoeba invadens
YSECPQ

SEQ ID NO: 3039021 - protein, 4 aa, Entamoeba invadens
YSEK

SEQ ID NO: 3039022 - protein, 16 aa, Entamoeba invadens
YSEKETDAPELKRARH

SEQ ID NO: 3039023 - protein, 4 aa, Entamoeba invadens
YSER

SEQ ID NO: 3039024 - protein, 9 aa, Entamoeba invadens
YSFSGSGIT

SEQ ID NO: 3039025 - protein, 4 aa, Entamoeba invadens
YSGG

SEQ ID NO: 3039026 - protein, 11 aa, Entamoeba invadens
YSGNANTTVGT

SEQ ID NO: 3039027 - protein, 8 aa, Entamoeba invadens
YSGNSYPS

SEQ ID NO: 3039028 - protein, 4 aa, Entamoeba invadens
YSGP

SEQ ID NO: 3039029 - protein, 8 aa, Entamoeba invadens
YSKEDDKC

SEQ ID NO: 3039030 - protein, 23 aa, Entamoeba invadens
YSKSGNATCSACPAGTYSAEGAS

SEQ ID NO: 3039031 - protein, 25 aa, Entamoeba invadens
YSLGGSSGCTTCSTSCKTCDQTNGN

SEQ ID NO: 3039032 - protein, 8 aa, Entamoeba invadens
YSLGGTSY

SEQ ID NO: 3039033 - protein, 9 aa, Entamoeba invadens
YSLRTNKAL

SEQ ID NO: 3039034 - protein, 25 aa, Entamoeba invadens
YSLSGSSGCTTCSTSCKTCDQTNGN

SEQ ID NO: 3039035 - protein, 11 aa, Entamoeba invadens
YSNEDRNVKSK

SEQ ID NO: 3039036 - protein, 7 aa, Entamoeba invadens
YSNEEMK

SEQ ID NO: 3039037 - protein, 6 aa, Entamoeba invadens
YSNGPQ

SEQ ID NO: 3039038 - protein, 17 aa, Entamoeba invadens
YSNGQPIDKTLCTKMNL

SEQ ID NO: 3039039 - protein, 37 aa, Entamoeba invadens
YSNKGATTCTSCPGGYYSQSSGSASCTACAGGTYSNS

SEQ ID NO: 3039040 - protein, 10 aa, Entamoeba invadens
YSNKMENSKT

SEQ ID NO: 3039041 - protein, 4 aa, Entamoeba invadens
YSNN

SEQ ID NO: 3039042 - protein, 10 aa, Entamoeba invadens
YSNPQTDTYG

SEQ ID NO: 3039043 - protein, 4 aa, Entamoeba invadens
YSNS

SEQ ID NO: 3039044 - protein, 9 aa, Entamoeba invadens
YSNSSSQNI

SEQ ID NO: 3039045 - protein, 25 aa, Entamoeba invadens
YSNTISSTECQKCSSTCQTCDPQSG

SEQ ID NO: 3039046 - protein, 15 aa, Entamoeba invadens
YSNWEESSDSWTGLD

SEQ ID NO: 3039047 - protein, 5 aa, Entamoeba invadens
YSPEA

SEQ ID NO: 3039048 - protein, 9 aa, Entamoeba invadens
YSPKSISGI

SEQ ID NO: 3039049 - protein, 8 aa, Entamoeba invadens
YSPLSNPV

SEQ ID NO: 3039050 - protein, 12 aa, Entamoeba invadens
YSPPEAYNADPN

SEQ ID NO: 3039051 - protein, 8 aa, Entamoeba invadens
YSQCDECA

SEQ ID NO: 3039052 - protein, 7 aa, Entamoeba invadens
YSSDQTN

SEQ ID NO: 3039053 - protein, 9 aa, Entamoeba invadens
YSSNKTLSR

SEQ ID NO: 3039054 - protein, 6 aa, Entamoeba invadens
YSTEKS

SEQ ID NO: 3039055 - protein, 8 aa, Entamoeba invadens
YSTEQQMV

SEQ ID NO: 3039056 - protein, 8 aa, Entamoeba invadens
YSTGGTST

SEQ ID NO: 3039057 - protein, 12 aa, Entamoeba invadens
YSTKKTDSNSRK

SEQ ID NO: 3039058 - protein, 8 aa, Entamoeba invadens
YSTLGSSG

SEQ ID NO: 3039059 - protein, 7 aa, Entamoeba invadens
YSTSSNT

SEQ ID NO: 3039060 - protein, 4 aa, Entamoeba invadens
YSVE

SEQ ID NO: 3039061 - protein, 10 aa, Entamoeba invadens
YSYANSNGVC

SEQ ID NO: 3039062 - protein, 6 aa, Entamoeba invadens
YSYDND

SEQ ID NO: 3039063 - protein, 7 aa, Entamoeba invadens
YSYGKEN

SEQ ID NO: 3039064 - protein, 15 aa, Entamoeba invadens
YTAAGSAGAVKCGEN

SEQ ID NO: 3039065 - protein, 11 aa, Entamoeba invadens
YTAQDTDPTGQ

SEQ ID NO: 3039066 - protein, 7 aa, Entamoeba invadens
YTDEVNN

SEQ ID NO: 3039067 - protein, 6 aa, Entamoeba invadens
YTDGCP

SEQ ID NO: 3039068 - protein, 5 aa, Entamoeba invadens
YTDTQ

SEQ ID NO: 3039069 - protein, 6 aa, Entamoeba invadens
YTEFST

SEQ ID NO: 3039070 - protein, 8 aa, Entamoeba invadens
YTENGKEK

SEQ ID NO: 3039071 - protein, 7 aa, Entamoeba invadens
YTETTET

SEQ ID NO: 3039072 - protein, 26 aa, Entamoeba invadens
YTFQNKTTQCTPCNPGTYSIGDTKNT

SEQ ID NO: 3039073 - protein, 8 aa, Entamoeba invadens
YTGEDGPL

SEQ ID NO: 3039074 - protein, 8 aa, Entamoeba invadens
YTGENGPL

SEQ ID NO: 3039075 - protein, 18 aa, Entamoeba invadens
YTGGSIPSTSPSSCISET

SEQ ID NO: 3039076 - protein, 4 aa, Entamoeba invadens
YTGK

SEQ ID NO: 3039077 - protein, 22 aa, Entamoeba invadens
YTGSNKYTKYIKDGKKARIYTS

SEQ ID NO: 3039078 - protein, 23 aa, Entamoeba invadens
YTGSNKYTKYVKDGEKARIYTSN

SEQ ID NO: 3039079 - protein, 22 aa, Entamoeba invadens
YTGSNTYTKYSKDGKKVRSYTS

SEQ ID NO: 3039080 - protein, 8 aa, Entamoeba invadens
YTGSSTTC

SEQ ID NO: 3039081 - protein, 9 aa, Entamoeba invadens
YTGSTGPID

SEQ ID NO: 3039082 - protein, 19 aa, Entamoeba invadens
YTIDDNGNCIQNNGEIEQS

SEQ ID NO: 3039083 - protein, 83 aa, Entamoeba invadens
YTKGHDGRSGVKVSGKIKRGRVEAAGSVEMGKRRGYSGSVAYETKRGTRIEGSVSSSNAGKKRETTVGGKVSTKIGKKGSGYI

SEQ ID NO: 3039084 - protein, 8 aa, Entamoeba invadens
YTKPDGSY

SEQ ID NO: 3039085 - protein, 5 aa, Entamoeba invadens
YTLNN

SEQ ID NO: 3039086 - protein, 4 aa, Entamoeba invadens
YTPA

SEQ ID NO: 3039087 - protein, 7 aa, Entamoeba invadens
YTPNGVQ

SEQ ID NO: 3039088 - protein, 8 aa, Entamoeba invadens
YTPNQSEY

SEQ ID NO: 3039089 - protein, 12 aa, Entamoeba invadens
YTPQQQAVEHPQ

SEQ ID NO: 3039090 - protein, 6 aa, Entamoeba invadens
YTPQTP

SEQ ID NO: 3039091 - protein, 8 aa, Entamoeba invadens
YTPRTNQF

SEQ ID NO: 3039092 - protein, 5 aa, Entamoeba invadens
YTQPN

SEQ ID NO: 3039093 - protein, 7 aa, Entamoeba invadens
YTQSADY

SEQ ID NO: 3039094 - protein, 7 aa, Entamoeba invadens
YTSAQPV

SEQ ID NO: 3039095 - protein, 16 aa, Entamoeba invadens
YTSATSRCCGGNPGDC

SEQ ID NO: 3039096 - protein, 5 aa, Entamoeba invadens
YTSQT

SEQ ID NO: 3039097 - protein, 8 aa, Entamoeba invadens
YTSTERTA

SEQ ID NO: 3039098 - protein, 8 aa, Entamoeba invadens
YTTCSNNQ

SEQ ID NO: 3039099 - protein, 4 aa, Entamoeba invadens
YTTE

SEQ ID NO: 3039100 - protein, 6 aa, Entamoeba invadens
YTTGCE

SEQ ID NO: 3039101 - protein, 11 aa, Entamoeba invadens
YTTNTDTTTTI

SEQ ID NO: 3039102 - protein, 30 aa, Entamoeba invadens
YTTNVDESQCKECPEGTGTLDGVNDNCDLD

SEQ ID NO: 3039103 - protein, 5 aa, Entamoeba invadens
YTTVN

SEQ ID NO: 3039104 - protein, 9 aa, Entamoeba invadens
YTYKQTNDT

SEQ ID NO: 3039105 - protein, 12 aa, Entamoeba invadens
YVNTPGDQGNCG

SEQ ID NO: 3039106 - protein, 9 aa, Entamoeba invadens
YVPQNSNTT

SEQ ID NO: 3039107 - protein, 7 aa, Entamoeba invadens
YVPSNTN

SEQ ID NO: 3039108 - protein, 6 aa, Entamoeba invadens
YVSQTA

SEQ ID NO: 3039109 - protein, 5 aa, Entamoeba invadens
YVSSE

SEQ ID NO: 3039110 - protein, 4 aa, Entamoeba invadens
YYDS

SEQ ID NO: 3039111 - protein, 8 aa, Entamoeba invadens
YYEDENGL

SEQ ID NO: 3039112 - protein, 10 aa, Entamoeba invadens
YYEEYEPTLE

SEQ ID NO: 3039113 - protein, 10 aa, Entamoeba invadens
YYKDTKRAEL

SEQ ID NO: 3039114 - protein, 9 aa, Entamoeba invadens
YYNANGNNA

SEQ ID NO: 3039115 - protein, 21 aa, Entamoeba invadens
YYNPYERSPYDTPSDQQGTLN

SEQ ID NO: 3039116 - protein, 12 aa, Entamoeba invadens
YYNSNGNNAYNT

SEQ ID NO: 3039117 - protein, 4 aa, Entamoeba invadens
YYPD

SEQ ID NO: 3039118 - protein, 6 aa, Entamoeba invadens
YYPGTN

SEQ ID NO: 3039119 - protein, 6 aa, Entamoeba invadens
YYPNEN

SEQ ID NO: 3039120 - protein, 9 aa, Entamoeba invadens
YYPPSTNSN

SEQ ID NO: 3039121 - protein, 10 aa, Entamoeba invadens
YYPTSTNSNC

SEQ ID NO: 3039122 - protein, 6 aa, Entamoeba invadens
YYSLGG

SEQ ID NO: 3039123 - protein, 4 aa, Entamoeba invadens
YYSN

SEQ ID NO: 3039124 - protein, 28 aa, Entamoeba invadens
YYSNKGATTCTTCPGGYYSASSGSAKCT

SEQ ID NO: 3039125 - protein, 7 aa, Entamoeba invadens
YYSTEKS

SEQ ID NO: 3039126 - protein, 10 aa, Entamoeba invadens
YYSTGKTGSC

SEQ ID NO: 3039127 - protein, 12 aa, Entamoeba invadens
YYSTTSKECDTT

SEQ ID NO: 3039128 - protein, 4 aa, Entamoeba invadens
YYTE

SEQ ID NO: 3039129 - protein, 24 aa, Entamoeba invadens
YINLEPLDFVWSIPAANLPSNYQK

SEQ ID NO: 3039130 - protein, 17 aa, Entamoeba invadens
ALELCGYGGCNTNGFNQ

SEQ ID NO: 3039131 - protein, 18 aa, Entamoeba invadens
GIGKCGENALELCGYGGC

SEQ ID NO: 3039132 - protein, 24 aa, Entamoeba invadens
GRTPIEIYKDFMASFKQNFQSYID

SEQ ID NO: 3039133 - protein, 17 aa, Entamoeba invadens
KIKSAGVAGVMSDVWWG

SEQ ID NO: 3039134 - protein, 24 aa, Entamoeba invadens
KNAGLKFQAVMSFHKCGGNVGDSV

SEQ ID NO: 3039135 - protein, 25 aa, Entamoeba invadens
KSAGVAGVMSDVWWGLVETSPKTYN

SEQ ID NO: 3039136 - protein, 17 aa, Entamoeba invadens
KTYNWNAYKTLVSMVKN

SEQ ID NO: 3039137 - protein, 24 aa, Entamoeba invadens
LAGKISGVHWWWTDNSHAAEMTAG

SEQ ID NO: 3039138 - protein, 17 aa, Entamoeba invadens
YNWNAYKTLVSMVKNAG

SEQ ID NO: 3039139 - protein, 19 aa, Entamoeba invadens
YQPVAYKLTSRMGTRAQYR

SEQ ID NO: 3039140 - protein, 19 aa, Entamoeba invadens
LNSWSDGFIMNAGYLSGLT

SEQ ID NO: 3039141 - protein, 17 aa, Entamoeba invadens
NGEVSTIIFTRTGDSTT

SEQ ID NO: 3039142 - protein, 17 aa, Entamoeba invadens
AFIKSAMSFARKYNLDG

SEQ ID NO: 3039143 - protein, 17 aa, Entamoeba invadens
AGTKCGAKGHYPYTVNP

SEQ ID NO: 3039144 - protein, 24 aa, Entamoeba invadens
AKDQAQCGSCWTFCTTAVMEGRVN

SEQ ID NO: 3039145 - protein, 24 aa, Entamoeba invadens
ANKAEYLYRLAVYLDNKRFVENTA

SEQ ID NO: 3039146 - protein, 20 aa, Entamoeba invadens
ARDSLEFATAMYTYNRGVFD

SEQ ID NO: 3039147 - protein, 17 aa, Entamoeba invadens
ARIEKRIGLENTLHLDR

SEQ ID NO: 3039148 - protein, 26 aa, Entamoeba invadens
CGETRYPSYPLSRWSYCGIGEFQCSD

SEQ ID NO: 3039149 - protein, 27 aa, Entamoeba invadens
CGETRYPSYPLSRWSYCGIGEFQCSDS

SEQ ID NO: 3039150 - protein, 18 aa, Entamoeba invadens
CKEDGLFCVIDGKHNDQY

SEQ ID NO: 3039151 - protein, 24 aa, Entamoeba invadens
DANCKRIVMDHCVTLVGYGKNTDG

SEQ ID NO: 3039152 - protein, 20 aa, Entamoeba invadens
DCGYPDYAYPNLFITNHDLL

SEQ ID NO: 3039153 - protein, 18 aa, Entamoeba invadens
DEQLRSCVNVDYRASPSS

SEQ ID NO: 3039154 - protein, 30 aa, Entamoeba invadens
DGLSDCSLCTGSYCGSCKSIPKRDAYVADA

SEQ ID NO: 3039155 - protein, 28 aa, Entamoeba invadens
DIMKVKIWQSWYPKEWGMGEGTIAWERL

SEQ ID NO: 3039156 - protein, 21 aa, Entamoeba invadens
DKHGTCSLTTFSGGDGPVDYF

SEQ ID NO: 3039157 - protein, 17 aa, Entamoeba invadens
DKKSVSFTLVITSNKEL

SEQ ID NO: 3039158 - protein, 20 aa, Entamoeba invadens
DSVSNINNWGYYASGGYGLR

SEQ ID NO: 3039159 - protein, 21 aa, Entamoeba invadens
EANCPAGNYIPSYILSTQKEL

SEQ ID NO: 3039160 - protein, 21 aa, Entamoeba invadens
ECYDCSFFGNSLCKSATKDCS

SEQ ID NO: 3039161 - protein, 19 aa, Entamoeba invadens
EGYQGYSHVVGYAQVKYTS

SEQ ID NO: 3039162 - protein, 26 aa, Entamoeba invadens
EISKVIPYKLSVIITKSWTQETTQRM

SEQ ID NO: 3039163 - protein, 25 aa, Entamoeba invadens
ENGKVFRTTLIFAVYTEIVTTRIGI

SEQ ID NO: 3039164 - protein, 20 aa, Entamoeba invadens
ERFKYAWNIADFTSGGKRLE

SEQ ID NO: 3039165 - protein, 22 aa, Entamoeba invadens
EYMNVYLLDKCYYSGGNTYTKY

SEQ ID NO: 3039166 - protein, 19 aa, Entamoeba invadens
FKKEIAMLDKFRSDYLVHF

SEQ ID NO: 3039167 - protein, 17 aa, Entamoeba invadens
FLLARPTPISYFFKYGK

SEQ ID NO: 3039168 - protein, 19 aa, Entamoeba invadens
FNFVLDLSSTCFKDENCLV

SEQ ID NO: 3039169 - protein, 19 aa, Entamoeba invadens
FQCSEFYTGFRPCSKGTWC

SEQ ID NO: 3039170 - protein, 19 aa, Entamoeba invadens
FVRKARIEKRIGLENTLHL

SEQ ID NO: 3039171 - protein, 23 aa, Entamoeba invadens
GDKEIRYVLRFLQRMLPEKTPFE

SEQ ID NO: 3039172 - protein, 19 aa, Entamoeba invadens
GKCIICKEGTYSVSTNSTC

SEQ ID NO: 3039173 - protein, 17 aa, Entamoeba invadens
GKCTSCYTGSYLESGEC

SEQ ID NO: 3039174 - protein, 29 aa, Entamoeba invadens
GLSDCSLCTGSYCGSCKSIPKRDAYVADA

SEQ ID NO: 3039175 - protein, 23 aa, Entamoeba invadens
GSASCMSCLYKSYSNTTSSISCT

SEQ ID NO: 3039176 - protein, 18 aa, Entamoeba invadens
GSAYGPLHFHCERSLNSW

SEQ ID NO: 3039177 - protein, 19 aa, Entamoeba invadens
IDDTSYLWCYGHTQGQITK

SEQ ID NO: 3039178 - protein, 20 aa, Entamoeba invadens
IEPRRLCVSKCPVEEYFELE

SEQ ID NO: 3039179 - protein, 17 aa, Entamoeba invadens
IKSAMSFARKYNLDGID

SEQ ID NO: 3039180 - protein, 21 aa, Entamoeba invadens
INGVQCLSCPNGMNTISGLGE

SEQ ID NO: 3039181 - protein, 23 aa, Entamoeba invadens
INKAHGLGIYVILDGVFGHHKGG

SEQ ID NO: 3039182 - protein, 22 aa, Entamoeba invadens
IPSDLYYLVFRGRILDEGINIS

SEQ ID NO: 3039183 - protein, 23 aa, Entamoeba invadens
KCPERFWQTASRCVNCIDNCQIC

SEQ ID NO: 3039184 - protein, 24 aa, Entamoeba invadens
KECEFMGKAGWLGVKVYPPQDGVL

SEQ ID NO: 3039185 - protein, 23 aa, Entamoeba invadens
KERCLSCKNTLLVDENCLPSNSI

SEQ ID NO: 3039186 - protein, 25 aa, Entamoeba invadens
KLSGGRSRLLLTIAAPAGPKNIENL

SEQ ID NO: 3039187 - protein, 23 aa, Entamoeba invadens
KTTGKCILCKAGYELTTDGKCII

SEQ ID NO: 3039188 - protein, 21 aa, Entamoeba invadens
KTYKTLRFHVKYDNDDLNNIP

SEQ ID NO: 3039189 - protein, 19 aa, Entamoeba invadens
LEMFTNLFVNNNIEEAVEV

SEQ ID NO: 3039190 - protein, 20 aa, Entamoeba invadens
LICSALAFRGRHEKPIEDSQ

SEQ ID NO: 3039191 - protein, 21 aa, Entamoeba invadens
LKEYICTNLTFSEYIQMGYNK

SEQ ID NO: 3039192 - protein, 19 aa, Entamoeba invadens
LKGIFDCGYPDYAYPNLFI

SEQ ID NO: 3039193 - protein, 25 aa, Entamoeba invadens
LNGNCLFCSPGTYAVDSKCETCADM

SEQ ID NO: 3039194 - protein, 19 aa, Entamoeba invadens
LNPWYWVYQPVAYKLTSRM

SEQ ID NO: 3039195 - protein, 28 aa, Entamoeba invadens
LTTQEMWARLLSIFGQYDFKKNMKNVLG

SEQ ID NO: 3039196 - protein, 18 aa, Entamoeba invadens
LVFFFAFFVFAIDLPMCV

SEQ ID NO: 3039197 - protein, 18 aa, Entamoeba invadens
MKIAVSMKDRFTLEQKVG

SEQ ID NO: 3039198 - protein, 27 aa, Entamoeba invadens
MRSVYKYAPYIKRYFLATADQVPSYLN

SEQ ID NO: 3039199 - protein, 22 aa, Entamoeba invadens
NEIKEHKEMIITLNTKIAENEK

SEQ ID NO: 3039200 - protein, 22 aa, Entamoeba invadens
NKAKVYGSVTCGNWVDQDPIEL

SEQ ID NO: 3039201 - protein, 17 aa, Entamoeba invadens
NPWYWVYQPVAYKLTSR

SEQ ID NO: 3039202 - protein, 23 aa, Entamoeba invadens
NSWGTSWGDEGYFLLARNQNNRC

SEQ ID NO: 3039203 - protein, 24 aa, Entamoeba invadens
PDECGGHLDALWLWVNGSEEKWVE

SEQ ID NO: 3039204 - protein, 19 aa, Entamoeba invadens
PGTICKGKGKFDIKVDPCV

SEQ ID NO: 3039205 - protein, 19 aa, Entamoeba invadens
PPAKMFVGMAHYGRGWTLK

SEQ ID NO: 3039206 - protein, 18 aa, Entamoeba invadens
PYDTDPCVWYDETTWGKK

SEQ ID NO: 3039207 - protein, 19 aa, Entamoeba invadens
QKFNLSCFTNYTYTTPDCT

SEQ ID NO: 3039208 - protein, 23 aa, Entamoeba invadens
QLIMPYKVCILCGNNCVRCREDG

SEQ ID NO: 3039209 - protein, 18 aa, Entamoeba invadens
QNSIDGWACKYTPDNIDP

SEQ ID NO: 3039210 - protein, 24 aa, Entamoeba invadens
QTPPRGSADWVEGYQGYSHVVGYA

SEQ ID NO: 3039211 - protein, 23 aa, Entamoeba invadens
QYFECSNTFQGLRPCAPGTECIA

SEQ ID NO: 3039212 - protein, 19 aa, Entamoeba invadens
RKCIKCSTPNMYPDDTSRT

SEQ ID NO: 3039213 - protein, 26 aa, Entamoeba invadens
RSCFHFPGRYNLVQTLACEESGKGGY

SEQ ID NO: 3039214 - protein, 25 aa, Entamoeba invadens
RSVKSAPESVDWRSIMNPAKDQAQC

SEQ ID NO: 3039215 - protein, 18 aa, Entamoeba invadens
SCTPCPEGTYSVGGSGTC

SEQ ID NO: 3039216 - protein, 23 aa, Entamoeba invadens
SMDSRVPAPFPFGPKHPEHNNHI

SEQ ID NO: 3039217 - protein, 19 aa, Entamoeba invadens
TDRNWTHRLLLSSYTLQDG

SEQ ID NO: 3039218 - protein, 24 aa, Entamoeba invadens
TNGNCLECKYGMWLNLNGNCLFCS

SEQ ID NO: 3039219 - protein, 22 aa, Entamoeba invadens
TSLLELEMAFPVEFEKQQNLKF

SEQ ID NO: 3039220 - protein, 21 aa, Entamoeba invadens
TWGTLGYMVGEIWDSVSNINN

SEQ ID NO: 3039221 - protein, 17 aa, Entamoeba invadens
TYMGGALPDDFMAYLEV

SEQ ID NO: 3039222 - protein, 24 aa, Entamoeba invadens
VCDHKLGGAMIWSLDLDKNYVNTK

SEQ ID NO: 3039223 - protein, 18 aa, Entamoeba invadens
YIKTNGIMAESDYKYTAT

SEQ ID NO: 3039224 - protein, 19 aa, Entamoeba invadens
YLCSKCPSLTYSVMGSSQC

SEQ ID NO: 3039225 - protein, 18 aa, Entamoeba invadens
AAAKKYGLNCKQYSCGDM

SEQ ID NO: 3039226 - protein, 20 aa, Entamoeba invadens
AAATCKKCKTGSNCLTCESD

SEQ ID NO: 3039227 - protein, 18 aa, Entamoeba invadens
AAFIRNAVSFCRRYNFDG

SEQ ID NO: 3039228 - protein, 25 aa, Entamoeba invadens
AAGSAKYKLGFFVDEMLADAESALN

SEQ ID NO: 3039229 - protein, 17 aa, Entamoeba invadens
AAKEVESFFAIASGLYD

SEQ ID NO: 3039230 - protein, 19 aa, Entamoeba invadens
AALMKEFYEYKISEAQSSG

SEQ ID NO: 3039231 - protein, 18 aa, Entamoeba invadens
AALPNIKVAEKLADKIVK

SEQ ID NO: 3039232 - protein, 17 aa, Entamoeba invadens
AANINAWGYYASGGYGL

SEQ ID NO: 3039233 - protein, 25 aa, Entamoeba invadens
AAQDEMDYFFSGLFGGYSKIFVSLV

SEQ ID NO: 3039234 - protein, 25 aa, Entamoeba invadens
AARGHIALMYCTKGSFFDTQIGGEF

SEQ ID NO: 3039235 - protein, 18 aa, Entamoeba invadens
AAVGQLEGKMMAIVGKMG

SEQ ID NO: 3039236 - protein, 23 aa, Entamoeba invadens
AAYPVDLQYPVAFWHVYVGIDTY

SEQ ID NO: 3039237 - protein, 19 aa, Entamoeba invadens
AAYPVDLQYPVPFWHVFVG

SEQ ID NO: 3039238 - protein, 21 aa, Entamoeba invadens
ACKQGMYVWQGQYAPRVNRAK

SEQ ID NO: 3039239 - protein, 30 aa, Entamoeba invadens
ACLLISSMLNCIFAVVIAVLVYHIIETQKL

SEQ ID NO: 3039240 - protein, 23 aa, Entamoeba invadens
ACMPSVFMKAMLFTLEYKGRGYV

SEQ ID NO: 3039241 - protein, 21 aa, Entamoeba invadens
ACQFTFYYVYLDLMMNPSLVI

SEQ ID NO: 3039242 - protein, 19 aa, Entamoeba invadens
ACRGSTCRRQVKSIMDKAE

SEQ ID NO: 3039243 - protein, 19 aa, Entamoeba invadens
ACSCRGITVVTVYATLGGD

SEQ ID NO: 3039244 - protein, 17 aa, Entamoeba invadens
ACSSTTGYCTYCIPGSR

SEQ ID NO: 3039245 - protein, 27 aa, Entamoeba invadens
ACVELVGPSLKKAVCTIVGAFSIDPTN

SEQ ID NO: 3039246 - protein, 17 aa, Entamoeba invadens
ACVPCERHMPGCLECDK

SEQ ID NO: 3039247 - protein, 20 aa, Entamoeba invadens
ACYMYNCITCHYDYWGNERC

SEQ ID NO: 3039248 - protein, 25 aa, Entamoeba invadens
ADAFQKLKYVTGFSSDAPYLYDYVD

SEQ ID NO: 3039249 - protein, 18 aa, Entamoeba invadens
ADCKSCPNGKSSKDGVTD

SEQ ID NO: 3039250 - protein, 18 aa, Entamoeba invadens
ADCLQAPLDLTQNFVNLV

SEQ ID NO: 3039251 - protein, 25 aa, Entamoeba invadens
ADDAEQLFSCAFSGTKLRNLKLPNK

SEQ ID NO: 3039252 - protein, 24 aa, Entamoeba invadens
ADKELRNDMSMYWFSNGKCRFPMY

SEQ ID NO: 3039253 - protein, 18 aa, Entamoeba invadens
ADLVYKTDFVEFTNTSFV

SEQ ID NO: 3039254 - protein, 25 aa, Entamoeba invadens
ADMDPCLDCKLDGYGGHTTDIRTVC

SEQ ID NO: 3039255 - protein, 25 aa, Entamoeba invadens
ADPKPVELVECPICGKKFSEGEIAK

SEQ ID NO: 3039256 - protein, 19 aa, Entamoeba invadens
ADVPAIPVFEGMPNLAPII

SEQ ID NO: 3039257 - protein, 28 aa, Entamoeba invadens
AEDFFPKKLEQLTCLYTIIPERSDTITR

SEQ ID NO: 3039258 - protein, 19 aa, Entamoeba invadens
AEEGGAFGASYYALAQGLG

SEQ ID NO: 3039259 - protein, 26 aa, Entamoeba invadens
AEGKCAACQDVNCVMCDGDKGNCIKC

SEQ ID NO: 3039260 - protein, 17 aa, Entamoeba invadens
AEGRLSYIVFLNKESVK

SEQ ID NO: 3039261 - protein, 18 aa, Entamoeba invadens
AEHQRLDPIAITKCTNDA

SEQ ID NO: 3039262 - protein, 26 aa, Entamoeba invadens
AEKMCKRCTDGSFLEYVTFYLTNRIH

SEQ ID NO: 3039263 - protein, 17 aa, Entamoeba invadens
AEKTFVVSIAEVVTDSI

SEQ ID NO: 3039264 - protein, 17 aa, Entamoeba invadens
AEKYLDIAFVDVAHNTI

SEQ ID NO: 3039265 - protein, 17 aa, Entamoeba invadens
AEQCTKCGTKYISTDKL

SEQ ID NO: 3039266 - protein, 17 aa, Entamoeba invadens
AERIKAILGKSYVDVAV

SEQ ID NO: 3039267 - protein, 18 aa, Entamoeba invadens
AESLITFNNSPLITPSNT

SEQ ID NO: 3039268 - protein, 21 aa, Entamoeba invadens
AESSLSCKICQMGYYSSDNQC

SEQ ID NO: 3039269 - protein, 23 aa, Entamoeba invadens
AESYGPWPKDCDRTKDWSRVWVD

SEQ ID NO: 3039270 - protein, 26 aa, Entamoeba invadens
AETGLPFTLNFGVFKRRYYIPCTNSI

SEQ ID NO: 3039271 - protein, 29 aa, Entamoeba invadens
AETIIDWPHIRGNPMDPMRFIPTVTDGII

SEQ ID NO: 3039272 - protein, 24 aa, Entamoeba invadens
AEYIFRTEKFRSFDFNTTNFERVK

SEQ ID NO: 3039273 - protein, 18 aa, Entamoeba invadens
AEYPDARQIYNFIRKNAE

SEQ ID NO: 3039274 - protein, 19 aa, Entamoeba invadens
AFDQFEFLTKIGVDVNSLE

SEQ ID NO: 3039275 - protein, 18 aa, Entamoeba invadens
AFHDFTVALILPNKKIVE

SEQ ID NO: 3039276 - protein, 19 aa, Entamoeba invadens
AFHLQWKMRTKCSGLVKYV

SEQ ID NO: 3039277 - protein, 23 aa, Entamoeba invadens
AFKVFGSEIGIVFDHHVTNGYKI

SEQ ID NO: 3039278 - protein, 17 aa, Entamoeba invadens
AFSACALYEVTLPNIET

SEQ ID NO: 3039279 - protein, 20 aa, Entamoeba invadens
AFSCDLKGKIVIGSKPNFLS

SEQ ID NO: 3039280 - protein, 18 aa, Entamoeba invadens
AFSRKPVFESGKYWVYDN

SEQ ID NO: 3039281 - protein, 17 aa, Entamoeba invadens
AFTKLANLFGRKMKDID

SEQ ID NO: 3039282 - protein, 18 aa, Entamoeba invadens
AGFLEGFLTKHLLQNFWD

SEQ ID NO: 3039283 - protein, 22 aa, Entamoeba invadens
AGLCLGCPKGYFVSQKACFPCG

SEQ ID NO: 3039284 - protein, 19 aa, Entamoeba invadens
AGNFTSLFKEMNKKTNFVL

SEQ ID NO: 3039285 - protein, 18 aa, Entamoeba invadens
AGRVRRALADQVKEIRKY

SEQ ID NO: 3039286 - protein, 23 aa, Entamoeba invadens
AGSSYPAYMVIPLDNPIMVKYVV

SEQ ID NO: 3039287 - protein, 21 aa, Entamoeba invadens
AGTSAAFYAWNGISWYVSDMG

SEQ ID NO: 3039288 - protein, 18 aa, Entamoeba invadens
AGTYKLGVDVARSKFPKE

SEQ ID NO: 3039289 - protein, 18 aa, Entamoeba invadens
AHCYLCENKKCLICNDTF

SEQ ID NO: 3039290 - protein, 29 aa, Entamoeba invadens
AHDPTTELLIRWYQAGALQPFFRQHCTNT

SEQ ID NO: 3039291 - protein, 26 aa, Entamoeba invadens
AHLKEAIKLFEFFSIEVLKVAQEAKE

SEQ ID NO: 3039292 - protein, 17 aa, Entamoeba invadens
AHLLLPIAEKLVKISIF

SEQ ID NO: 3039293 - protein, 28 aa, Entamoeba invadens
AHVRELYKSILPEVFDPELIHLRSSGKI

SEQ ID NO: 3039294 - protein, 17 aa, Entamoeba invadens
AHYGRGWTLTFANDHLM

SEQ ID NO: 3039295 - protein, 24 aa, Entamoeba invadens
AIASPENFGLLGVEAKVTPKSRRN

SEQ ID NO: 3039296 - protein, 20 aa, Entamoeba invadens
AIAVALPFTAEQNKVLKVKT

SEQ ID NO: 3039297 - protein, 18 aa, Entamoeba invadens
AIDFISGIKYFYINNKTQ

SEQ ID NO: 3039298 - protein, 23 aa, Entamoeba invadens
AIEKRNVLVATKFDVFNFPEQME

SEQ ID NO: 3039299 - protein, 23 aa, Entamoeba invadens
AIFCFFVLCSSKSKSSKRQKIYM

SEQ ID NO: 3039300 - protein, 17 aa, Entamoeba invadens
AIIVPKCSTVFHENIPV

SEQ ID NO: 3039301 - protein, 22 aa, Entamoeba invadens
AIKLYRKYDVWKILKESELKVE

SEQ ID NO: 3039302 - protein, 36 aa, Entamoeba invadens
AINIKKYFFFPAGYLSIWSSDIIDFIASWENYYTIA

SEQ ID NO: 3039303 - protein, 18 aa, Entamoeba invadens
AKAPRFVVVSSLNAGDWH

SEQ ID NO: 3039304 - protein, 18 aa, Entamoeba invadens
AKEGGKKLLKEGITLGAT

SEQ ID NO: 3039305 - protein, 19 aa, Entamoeba invadens
AKFGKKNAKKAMAKIKKAE

SEQ ID NO: 3039306 - protein, 17 aa, Entamoeba invadens
AKFLKDICKHEQFACNE

SEQ ID NO: 3039307 - protein, 24 aa, Entamoeba invadens
AKKGKKALTQLFAKKFKKDLKKNG

SEQ ID NO: 3039308 - protein, 17 aa, Entamoeba invadens
AKKGVDIATDFSKGYQK

SEQ ID NO: 3039309 - protein, 22 aa, Entamoeba invadens
AKKHKGLMLSVEHRFYGTSTPS

SEQ ID NO: 3039310 - protein, 32 aa, Entamoeba invadens
AKKYKECPEIFISCLQSIAFRHFQLEEYTPAA

SEQ ID NO: 3039311 - protein, 17 aa, Entamoeba invadens
AKLKLTQLEIEFSEKMK

SEQ ID NO: 3039312 - protein, 20 aa, Entamoeba invadens
AKLMKLRAANPALYKGSRQS

SEQ ID NO: 3039313 - protein, 17 aa, Entamoeba invadens
AKLNVRTLHKFDTNETS

SEQ ID NO: 3039314 - protein, 19 aa, Entamoeba invadens
AKLSLVFEKDVLFWVTIPC

SEQ ID NO: 3039315 - protein, 26 aa, Entamoeba invadens
AKNLKFELLDGLKKGKLVEISNGVFD

SEQ ID NO: 3039316 - protein, 40 aa, Entamoeba invadens
AKNYFVSEVIPFGLKEDVILWFKKYDFLNVLSDSNPEGIN

SEQ ID NO: 3039317 - protein, 24 aa, Entamoeba invadens
AKQKEILMVLPMRERVRLARRFDF

SEQ ID NO: 3039318 - protein, 17 aa, Entamoeba invadens
AKSGLYVTTKAIFSESA

SEQ ID NO: 3039319 - protein, 18 aa, Entamoeba invadens
AKSICINDFLAFNYEDDQ

SEQ ID NO: 3039320 - protein, 21 aa, Entamoeba invadens
AKSKTDVYCRIYVNYIYSPPL

SEQ ID NO: 3039321 - protein, 18 aa, Entamoeba invadens
AKTVRIGTFNGWKSSIIY

SEQ ID NO: 3039322 - protein, 19 aa, Entamoeba invadens
AKVLGVYEICPKICGLQRN

SEQ ID NO: 3039323 - protein, 18 aa, Entamoeba invadens
AKYGNYIVFHGMIGEMNQ

SEQ ID NO: 3039324 - protein, 19 aa, Entamoeba invadens
AKYNKRFSAVEALRRRAIF

SEQ ID NO: 3039325 - protein, 18 aa, Entamoeba invadens
ALCERKGYTRFTDCNDEE

SEQ ID NO: 3039326 - protein, 24 aa, Entamoeba invadens
ALELCGYGGCNTSGFNQIVSQAKK

SEQ ID NO: 3039327 - protein, 18 aa, Entamoeba invadens
ALGNSVLVVGHFPIGVSA

SEQ ID NO: 3039328 - protein, 17 aa, Entamoeba invadens
ALKKYKKTLHEMAQEAV

SEQ ID NO: 3039329 - protein, 23 aa, Entamoeba invadens
ALPTELQTFLTIILPGVAVVQGF

SEQ ID NO: 3039330 - protein, 23 aa, Entamoeba invadens
ALPTELQTFLTLILPKVSVVQGF

SEQ ID NO: 3039331 - protein, 17 aa, Entamoeba invadens
ALRIENVLFYFYMASEL

SEQ ID NO: 3039332 - protein, 24 aa, Entamoeba invadens
ALSEFNFPLNLKTIGKFCFSNCSS

SEQ ID NO: 3039333 - protein, 24 aa, Entamoeba invadens
ALTPEAIFDSAERLLVEVQVPAFS

SEQ ID NO: 3039334 - protein, 17 aa, Entamoeba invadens
ALVGTTCVMTYMRMGDL

SEQ ID NO: 3039335 - protein, 31 aa, Entamoeba invadens
ALYQRQAVDFSRLNLIILPRYFFNCLDNVQT

SEQ ID NO: 3039336 - protein, 21 aa, Entamoeba invadens
AMGASYGGYMMNWINSQNDRF

SEQ ID NO: 3039337 - protein, 20 aa, Entamoeba invadens
AMLDKFRCEYIVHFYGAVLI

SEQ ID NO: 3039338 - protein, 24 aa, Entamoeba invadens
ANATIKLSDYLGGTSVRSLNSNIT

SEQ ID NO: 3039339 - protein, 17 aa, Entamoeba invadens
  misc_feature (14)..(15): Xaa can be any naturally occurring amino acid
ANGYYSHYDVCLKXXPV

SEQ ID NO: 3039340 - protein, 24 aa, Entamoeba invadens
ANKAEYLYRLAVFLDNAKFVAANP

SEQ ID NO: 3039341 - protein, 24 aa, Entamoeba invadens
ANKAEYLYRLAVYLDNKKFVENTA

SEQ ID NO: 3039342 - protein, 26 aa, Entamoeba invadens
ANKEKALWLKQLIKVQRRHRKELKHE

SEQ ID NO: 3039343 - protein, 24 aa, Entamoeba invadens
ANKELTCCEFKFPIERTEHLIFKD

SEQ ID NO: 3039344 - protein, 21 aa, Entamoeba invadens
ANKMDICLVKTKYVDTHGQKP

SEQ ID NO: 3039345 - protein, 21 aa, Entamoeba invadens
ANKMKKVKCMLKKAKREGLKI

SEQ ID NO: 3039346 - protein, 25 aa, Entamoeba invadens
ANMDPCLDCKLDGYGGHSTDIRVVC

SEQ ID NO: 3039347 - protein, 26 aa, Entamoeba invadens
ANNHCSFCKYGYLLNKNNECVQSTNG

SEQ ID NO: 3039348 - protein, 17 aa, Entamoeba invadens
ANNLALGLVDAFVQSGF

SEQ ID NO: 3039349 - protein, 17 aa, Entamoeba invadens
APCKKFLNDYKNKQPKW

SEQ ID NO: 3039350 - protein, 21 aa, Entamoeba invadens
APECGAGTFGVYPNCQKCTVN

SEQ ID NO: 3039351 - protein, 21 aa, Entamoeba invadens
APEFPGASYGPSNFHCDKACD

SEQ ID NO: 3039352 - protein, 24 aa, Entamoeba invadens
APELKRARHKEMRFFEELLENLPK

SEQ ID NO: 3039353 - protein, 22 aa, Entamoeba invadens
APFTGPMAPAFAAVGATAGTIS

SEQ ID NO: 3039354 - protein, 17 aa, Entamoeba invadens
AQADGGKFFVRYYAPWC

SEQ ID NO: 3039355 - protein, 17 aa, Entamoeba invadens
AQTISYKERCACYVTQQ

SEQ ID NO: 3039356 - protein, 24 aa, Entamoeba invadens
AQTPCFGEAVIADLGFYINKTGSS

SEQ ID NO: 3039357 - protein, 21 aa, Entamoeba invadens
ARCEPRYYCPNGIDKKECGQG

SEQ ID NO: 3039358 - protein, 26 aa, Entamoeba invadens
ARDDAWYYPYGCLNYNTFSLNISETE

SEQ ID NO: 3039359 - protein, 19 aa, Entamoeba invadens
ARESVLSSVTFFKCDMTEF

SEQ ID NO: 3039360 - protein, 27 aa, Entamoeba invadens
ARFPSQLKQLIIKGLRPSWSEEKHIHP

SEQ ID NO: 3039361 - protein, 19 aa, Entamoeba invadens
ARGSFPLITLLNTEIARGM

SEQ ID NO: 3039362 - protein, 19 aa, Entamoeba invadens
ARKGSKRLIHLERKERSIR

SEQ ID NO: 3039363 - protein, 20 aa, Entamoeba invadens
ARPITFPSSPGFLHSKDDFY

SEQ ID NO: 3039364 - protein, 18 aa, Entamoeba invadens
ARRFKKSKTVIGFGLLNK

SEQ ID NO: 3039365 - protein, 25 aa, Entamoeba invadens
ARSKCTTCCRVIFATPYNYDNNRFF

SEQ ID NO: 3039366 - protein, 23 aa, Entamoeba invadens
ARVLKHPDIILANGQRVDPTKLV

SEQ ID NO: 3039367 - protein, 17 aa, Entamoeba invadens
ASCRSCYAGYYSNKGAT

SEQ ID NO: 3039368 - protein, 21 aa, Entamoeba invadens
ASCSLSSSRNCTTCKSIMYPD

SEQ ID NO: 3039369 - protein, 23 aa, Entamoeba invadens
ASGEKRGIVSYELYHVNNITTFL

SEQ ID NO: 3039370 - protein, 20 aa, Entamoeba invadens
ASGKTPVAWEEVYKKGNADK

SEQ ID NO: 3039371 - protein, 18 aa, Entamoeba invadens
ASKLFVSSSFGFENTAKA

SEQ ID NO: 3039372 - protein, 18 aa, Entamoeba invadens
ASNIPKLYLVQGPYSYQC

SEQ ID NO: 3039373 - protein, 18 aa, Entamoeba invadens
ASVRAFPYTNEQTAIIAK

SEQ ID NO: 3039374 - protein, 17 aa, Entamoeba invadens
ASYHPLYYYKVWSRDAV

SEQ ID NO: 3039375 - protein, 19 aa, Entamoeba invadens
ATCSACPAGTYSAEGASIC

SEQ ID NO: 3039376 - protein, 25 aa, Entamoeba invadens
ATDGKCLICAAGYGFDNGVCTLCGD

SEQ ID NO: 3039377 - protein, 18 aa, Entamoeba invadens
ATFIKSAMDFARKYNLDG

SEQ ID NO: 3039378 - protein, 18 aa, Entamoeba invadens
ATLTEDRTRLELEIEGIQ

SEQ ID NO: 3039379 - protein, 17 aa, Entamoeba invadens
ATMGVNYLGHFLLTNLV

SEQ ID NO: 3039380 - protein, 23 aa, Entamoeba invadens
ATQRKCKKCVFGYYPSTAGTCVE

SEQ ID NO: 3039381 - protein, 19 aa, Entamoeba invadens
ATYDWRSADLPSTYYEATK

SEQ ID NO: 3039382 - protein, 30 aa, Entamoeba invadens
AVDNCLECFPTWVGCALCEQGYTLMYRTVN

SEQ ID NO: 3039383 - protein, 17 aa, Entamoeba invadens
AVEALRRRAIFTANSRY

SEQ ID NO: 3039384 - protein, 20 aa, Entamoeba invadens
AVEGMCGAYVSFSYGASVKP

SEQ ID NO: 3039385 - protein, 23 aa, Entamoeba invadens
AVIPTPLSPLFAGVSLGASKIAA

SEQ ID NO: 3039386 - protein, 22 aa, Entamoeba invadens
AVNSRAFLGTSIRKVKLTPTAT

SEQ ID NO: 3039387 - protein, 17 aa, Entamoeba invadens
AVVKIMLEQAKAHPEAV

SEQ ID NO: 3039388 - protein, 23 aa, Entamoeba invadens
AWTLEHYEQLFIKKRSQENASHN

SEQ ID NO: 3039389 - protein, 22 aa, Entamoeba invadens
AYAKTRGIIVYPEIDLPAHAAS

SEQ ID NO: 3039390 - protein, 18 aa, Entamoeba invadens
AYDKTKVVAHISGQKSIA

SEQ ID NO: 3039391 - protein, 20 aa, Entamoeba invadens
AYDMFGVSIKIPFNFIENKT

SEQ ID NO: 3039392 - protein, 25 aa, Entamoeba invadens
AYFYPCISCGDAAGQVSTFWSKVIS

SEQ ID NO: 3039393 - protein, 17 aa, Entamoeba invadens
AYGGKPAFMCRNGNSVY

SEQ ID NO: 3039394 - protein, 32 aa, Entamoeba invadens
AYIDSECKVMVGCEYFEIGSCLVRTEVVKKSN

SEQ ID NO: 3039395 - protein, 24 aa, Entamoeba invadens
AYKSGECYYYSAKCHKFGISNSAV

SEQ ID NO: 3039396 - protein, 21 aa, Entamoeba invadens
AYLLEDGKILSGIKNAVDKGT

SEQ ID NO: 3039397 - protein, 22 aa, Entamoeba invadens
AYNLKAICYVSSSNFFIHKDGH

SEQ ID NO: 3039398 - protein, 26 aa, Entamoeba invadens
AYNTKRFHFSWNIAEFVVSGNRLERR

SEQ ID NO: 3039399 - protein, 22 aa, Entamoeba invadens
AYVEPYCPCSGRNCFVTPLENL

SEQ ID NO: 3039400 - protein, 25 aa, Entamoeba invadens
AYVPDTCYFRNNFQAAQKVVKKQGE

SEQ ID NO: 3039401 - protein, 18 aa, Entamoeba invadens
AYWIVRNSWGTSWGDKGY

SEQ ID NO: 3039402 - protein, 22 aa, Entamoeba invadens
CADNYYKLSGFCMKCGSPNVCT

SEQ ID NO: 3039403 - protein, 20 aa, Entamoeba invadens
CAGLKATGMMDVNAYFTQDF

SEQ ID NO: 3039404 - protein, 17 aa, Entamoeba invadens
CAGYDWRKARYTLDSYI

SEQ ID NO: 3039405 - protein, 18 aa, Entamoeba invadens
CAIADGICKNIISKDNGC

SEQ ID NO: 3039406 - protein, 20 aa, Entamoeba invadens
CAKCSSAFDRKCVMCNNGYY

SEQ ID NO: 3039407 - protein, 36 aa, Entamoeba invadens
CASEKVYSPQVIMYKDFIAKRFNGFTSELVNEVRNS

SEQ ID NO: 3039408 - protein, 18 aa, Entamoeba invadens
CATCADNGVRSCLICSVG

SEQ ID NO: 3039409 - protein, 17 aa, Entamoeba invadens
CATCASPYQLVGYSCYY

SEQ ID NO: 3039410 - protein, 20 aa, Entamoeba invadens
CATCSPDFSRKCVTCDSGYY

SEQ ID NO: 3039411 - protein, 21 aa, Entamoeba invadens
CAYDKTKVVAHISGQKSIAQG

SEQ ID NO: 3039412 - protein, 27 aa, Entamoeba invadens
CCPEKPLCPRSNVILDDTYKLILIKSF

SEQ ID NO: 3039413 - protein, 19 aa, Entamoeba invadens
CCVDCPIGTFSSTKGETTC

SEQ ID NO: 3039414 - protein, 23 aa, Entamoeba invadens
CDFGYYLSHGLCFSCSENCTSCI

SEQ ID NO: 3039415 - protein, 19 aa, Entamoeba invadens
CDFSKGDVFVSDFHFSART

SEQ ID NO: 3039416 - protein, 20 aa, Entamoeba invadens
CDHSNFKMCSSYTSQKQYSY

SEQ ID NO: 3039417 - protein, 26 aa, Entamoeba invadens
CDISNCKKCDAIGCVECLTNYTQSAD

SEQ ID NO: 3039418 - protein, 18 aa, Entamoeba invadens
CDNCKVCVGTMLTCTTCN

SEQ ID NO: 3039419 - protein, 18 aa, Entamoeba invadens
CDREMCSLPKSTEMVKEG

SEQ ID NO: 3039420 - protein, 30 aa, Entamoeba invadens
CDSECPKGSFVLGNVCKKCMSKCTECVSQD

SEQ ID NO: 3039421 - protein, 21 aa, Entamoeba invadens
CDSSRCLGCSTGLSLLNGMCT

SEQ ID NO: 3039422 - protein, 17 aa, Entamoeba invadens
CEFCVSGALLSEGRCVM

SEQ ID NO: 3039423 - protein, 20 aa, Entamoeba invadens
CEICNSTHCIACKNGFVNLG

SEQ ID NO: 3039424 - protein, 17 aa, Entamoeba invadens
CEINGCTDCDGNIKECK

SEQ ID NO: 3039425 - protein, 25 aa, Entamoeba invadens
CEKCTSIPKCVLCTLYGECRQCIYG

SEQ ID NO: 3039426 - protein, 23 aa, Entamoeba invadens
CEKDANGLCKFKSFYDHLQAKVL

SEQ ID NO: 3039427 - protein, 23 aa, Entamoeba invadens
CELKSVGDRAFYDCPITTLCPNE

SEQ ID NO: 3039428 - protein, 17 aa, Entamoeba invadens
CENEECTFPKTTEEIKE

SEQ ID NO: 3039429 - protein, 20 aa, Entamoeba invadens
CEPQCGMCRDGFVCNTMGMC

SEQ ID NO: 3039430 - protein, 23 aa, Entamoeba invadens
CEQCTDLNCLDCFYNTNECLRCQ

SEQ ID NO: 3039431 - protein, 33 aa, Entamoeba invadens
CEQYCGSCGVGYSCSKTGHCIRTPTQNTRNPNT

SEQ ID NO: 3039432 - protein, 17 aa, Entamoeba invadens
CETCPGGNEKKCTTCKT

SEQ ID NO: 3039433 - protein, 17 aa, Entamoeba invadens
CETCSTTKCVICNSNYY

SEQ ID NO: 3039434 - protein, 30 aa, Entamoeba invadens
CETRYEWMAFLLAACRQGIVIVTVYSTLSD

SEQ ID NO: 3039435 - protein, 17 aa, Entamoeba invadens
CEVNNVIYFDAFNPQLC

SEQ ID NO: 3039436 - protein, 20 aa, Entamoeba invadens
CFAAVLSLPFIDQVQVFNDV

SEQ ID NO: 3039437 - protein, 19 aa, Entamoeba invadens
CFFKFCIEKKLLNTVPKTQ

SEQ ID NO: 3039438 - protein, 21 aa, Entamoeba invadens
CFFVLLMAAPVHICTDHLHAV

SEQ ID NO: 3039439 - protein, 18 aa, Entamoeba invadens
CFTDCPLEYIDLDGNIVT

SEQ ID NO: 3039440 - protein, 25 aa, Entamoeba invadens
CGACTKSNCLYCNPDYYLLDNVCFR

SEQ ID NO: 3039441 - protein, 17 aa, Entamoeba invadens
CGCCYASAGVNLAQILL

SEQ ID NO: 3039442 - protein, 20 aa, Entamoeba invadens
CGGGYIKLIPKSAIESEEKF

SEQ ID NO: 3039443 - protein, 22 aa, Entamoeba invadens
CGGKACMLLIFGDEVDSEMADT

SEQ ID NO: 3039444 - protein, 20 aa, Entamoeba invadens
CGKRVSFKQFPKYLLDPSKA

SEQ ID NO: 3039445 - protein, 25 aa, Entamoeba invadens
CGNCKSIRLGSSFKCIVNDNCYSYD

SEQ ID NO: 3039446 - protein, 20 aa, Entamoeba invadens
CGPTAMAMVVATFKDRSVTP

SEQ ID NO: 3039447 - protein, 20 aa, Entamoeba invadens
CGPVLRVIFKSPVEGVQTAL

SEQ ID NO: 3039448 - protein, 20 aa, Entamoeba invadens
CGSSKRTHVIMSYKGKNHLI

SEQ ID NO: 3039449 - protein, 20 aa, Entamoeba invadens
CGSSSFNPCAFSFQEVADCN

SEQ ID NO: 3039450 - protein, 24 aa, Entamoeba invadens
CGVETNCFFPLFVRKVGDNPKPMN

SEQ ID NO: 3039451 - protein, 17 aa, Entamoeba invadens
CHIVIIFFSELPKRCKN

SEQ ID NO: 3039452 - protein, 22 aa, Entamoeba invadens
CIAKYGEKFLVGYTEDNTKFYL

SEQ ID NO: 3039453 - protein, 22 aa, Entamoeba invadens
CICSTFRGQWRIFFEDVEDTIR

SEQ ID NO: 3039454 - protein, 20 aa, Entamoeba invadens
CIMGVEICRKFYINNNNPDA

SEQ ID NO: 3039455 - protein, 17 aa, Entamoeba invadens
CIPNLRVESLNYLGISG

SEQ ID NO: 3039456 - protein, 24 aa, Entamoeba invadens
CISCSSIQGCSKCSSSDICTECTT

SEQ ID NO: 3039457 - protein, 25 aa, Entamoeba invadens
CITCTSLQCNACLNGFFVDQTVCKE

SEQ ID NO: 3039458 - protein, 18 aa, Entamoeba invadens
CKAGFKFDNGVCTYLNGF

SEQ ID NO: 3039459 - protein, 26 aa, Entamoeba invadens
CKAHNYKGLVVDGVFSIYSHFRKQAT

SEQ ID NO: 3039460 - protein, 19 aa, Entamoeba invadens
CKDRCSSCFDDLSKCSSCS

SEQ ID NO: 3039461 - protein, 25 aa, Entamoeba invadens
CKEGTSLYEIRVCYDPSKKRLNPEP

SEQ ID NO: 3039462 - protein, 17 aa, Entamoeba invadens
CKGSRKLFEKSISSVKS

SEQ ID NO: 3039463 - protein, 19 aa, Entamoeba invadens
CKHDRICMFSTQRIDLQNG

SEQ ID NO: 3039464 - protein, 25 aa, Entamoeba invadens
CKKCSGNCLHCNSEITCNLCNETFY

SEQ ID NO: 3039465 - protein, 19 aa, Entamoeba invadens
CKKSGWTVKYYYDDDDNDY

SEQ ID NO: 3039466 - protein, 20 aa, Entamoeba invadens
CKKSHVLSVEPCHHSKMERN

SEQ ID NO: 3039467 - protein, 24 aa, Entamoeba invadens
CKKVCEICEMYLFYYRKVMSQNSI

SEQ ID NO: 3039468 - protein, 18 aa, Entamoeba invadens
CKNGFKVGDNNAYGDGVY

SEQ ID NO: 3039469 - protein, 18 aa, Entamoeba invadens
CKPECTIDGCLSGCVTNQ

SEQ ID NO: 3039470 - protein, 17 aa, Entamoeba invadens
CKPEYFLKEGKCTSCSA

SEQ ID NO: 3039471 - protein, 25 aa, Entamoeba invadens
CKTCSLDFSRKCIDCEIGYYPAESG

SEQ ID NO: 3039472 - protein, 22 aa, Entamoeba invadens
CKTFFMDHCVTVVGYGKNTDGE

SEQ ID NO: 3039473 - protein, 24 aa, Entamoeba invadens
CKTGYWPRNGICAICHEKCAEDKC

SEQ ID NO: 3039474 - protein, 30 aa, Entamoeba invadens
CKTLASCEFVEFDVCLSIPLPGDQLEYTYS

SEQ ID NO: 3039475 - protein, 17 aa, Entamoeba invadens
CLEDCDYPDLEKVTQIM

SEQ ID NO: 3039476 - protein, 18 aa, Entamoeba invadens
CLEGYKLEDGICYQCGTG

SEQ ID NO: 3039477 - protein, 20 aa, Entamoeba invadens
CLESDCTINSLLLVENTRTC

SEQ ID NO: 3039478 - protein, 18 aa, Entamoeba invadens
CLFMTVFSEEGSSLELAD

SEQ ID NO: 3039479 - protein, 22 aa, Entamoeba invadens
CLKCGDGCKRCDPEYLEMCVGC

SEQ ID NO: 3039480 - protein, 21 aa, Entamoeba invadens
CLLCLALSLAFNKTAQRTNCD

SEQ ID NO: 3039481 - protein, 27 aa, Entamoeba invadens
CLMPAPDCGGYCFKTEELLTSNTCVNG

SEQ ID NO: 3039482 - protein, 19 aa, Entamoeba invadens
CLSHSFTFEEWVKKHNKHF

SEQ ID NO: 3039483 - protein, 22 aa, Entamoeba invadens
CLSPCLLFCEKTELVDCGYATI

SEQ ID NO: 3039484 - protein, 19 aa, Entamoeba invadens
CLTCSSSFERKCAKCLTGS

SEQ ID NO: 3039485 - protein, 24 aa, Entamoeba invadens
CLTIKKLHFPGGLISADVASFINC

SEQ ID NO: 3039486 - protein, 21 aa, Entamoeba invadens
CLTRRPYYYLSNGYCLKCDSS

SEQ ID NO: 3039487 - protein, 18 aa, Entamoeba invadens
CLVAGTIRITKGVVQDDI

SEQ ID NO: 3039488 - protein, 19 aa, Entamoeba invadens
CLVCFSFGSECYKIDENNK

SEQ ID NO: 3039489 - protein, 18 aa, Entamoeba invadens
CMCIDGYGGDDCHQLCYY

SEQ ID NO: 3039490 - protein, 19 aa, Entamoeba invadens
CNDPLKLDYYIMADYYHTS

SEQ ID NO: 3039491 - protein, 18 aa, Entamoeba invadens
CNHLCGWNGQQCVESHCE

SEQ ID NO: 3039492 - protein, 21 aa, Entamoeba invadens
CNIQNCLACSSESVCTQCIDN

SEQ ID NO: 3039493 - protein, 19 aa, Entamoeba invadens
CNKCSSAFDRKCVMCNNGY

SEQ ID NO: 3039494 - protein, 23 aa, Entamoeba invadens
CNKNARCVKSIIVKPNSTTTLSI

SEQ ID NO: 3039495 - protein, 18 aa, Entamoeba invadens
CNNCKSIPKRQAYVADAP

SEQ ID NO: 3039496 - protein, 23 aa, Entamoeba invadens
CNPLPRLDYMYQYKEDTSSAYAC

SEQ ID NO: 3039497 - protein, 25 aa, Entamoeba invadens
CNSKLEECITCFDPYYLSKQNCYSC

SEQ ID NO: 3039498 - protein, 20 aa, Entamoeba invadens
CNTEQPIVFCCGTTNAEEKY

SEQ ID NO: 3039499 - protein, 23 aa, Entamoeba invadens
CNTNLRCLTCNITNYKTSSGDCK

SEQ ID NO: 3039500 - protein, 17 aa, Entamoeba invadens
CNTPGFAEEVKYFGKYQ

SEQ ID NO: 3039501 - protein, 28 aa, Entamoeba invadens
CPCNSDSTVNCRLKFSEMFDLYNMSDFD

SEQ ID NO: 3039502 - protein, 17 aa, Entamoeba invadens
CPDTLKVFEMMRTCVAQ

SEQ ID NO: 3039503 - protein, 18 aa, Entamoeba invadens
CPHICSKFSVSSYPTLLL

SEQ ID NO: 3039504 - protein, 17 aa, Entamoeba invadens
CPKGTWCKGEQDKPYET

SEQ ID NO: 3039505 - protein, 17 aa, Entamoeba invadens
CPKNTTLERTVVCTLNQ

SEQ ID NO: 3039506 - protein, 21 aa, Entamoeba invadens
CPLGTKCGANGHYPFTINPCI

SEQ ID NO: 3039507 - protein, 22 aa, Entamoeba invadens
CPMENCLYCNLTQCFKFTLVQR

SEQ ID NO: 3039508 - protein, 26 aa, Entamoeba invadens
CPPNTMKLDLIWKYKSGDLCVDTCEV

SEQ ID NO: 3039509 - protein, 24 aa, Entamoeba invadens
CPRKVTRFEEKTCGKRVSFKQFPK

SEQ ID NO: 3039510 - protein, 19 aa, Entamoeba invadens
CPSDPTTHIIVRMLTGKEI

SEQ ID NO: 3039511 - protein, 24 aa, Entamoeba invadens
CPYYDKSYVCPSWVDGITDEEKKT

SEQ ID NO: 3039512 - protein, 24 aa, Entamoeba invadens
CQSTICSFGPFIGQSQKLSNEGGV

SEQ ID NO: 3039513 - protein, 26 aa, Entamoeba invadens
CQTCKSGGVRLCLTCNNGYHFSTTSP

SEQ ID NO: 3039514 - protein, 17 aa, Entamoeba invadens
CQVCIGSGTDIAWCSRC

SEQ ID NO: 3039515 - protein, 19 aa, Entamoeba invadens
CQVYLPKGLWFNFFSDEII

SEQ ID NO: 3039516 - protein, 17 aa, Entamoeba invadens
CRMRVKQVMRKCKLYEK

SEQ ID NO: 3039517 - protein, 18 aa, Entamoeba invadens
CRNTMKLLNNLLDKSVTT

SEQ ID NO: 3039518 - protein, 19 aa, Entamoeba invadens
CRQADGCDVKARIELLVPY

SEQ ID NO: 3039519 - protein, 18 aa, Entamoeba invadens
CRTLKIVLLPLQILYHST

SEQ ID NO: 3039520 - protein, 19 aa, Entamoeba invadens
CSDGYKFNYLSGVCEVGIE

SEQ ID NO: 3039521 - protein, 22 aa, Entamoeba invadens
CSEAYPVMVMYTGFDGKRICFE

SEQ ID NO: 3039522 - protein, 17 aa, Entamoeba invadens
CSIKNQRAHVTVTTKYG

SEQ ID NO: 3039523 - protein, 25 aa, Entamoeba invadens
CSMLNEPYTLIVLLSLQSSNQFKTE

SEQ ID NO: 3039524 - protein, 26 aa, Entamoeba invadens
CSPAFKELRAFVPNQCSRVYTGGSIP

SEQ ID NO: 3039525 - protein, 24 aa, Entamoeba invadens
CSPVLRHKVNFIPNKTHIVYNEVV

SEQ ID NO: 3039526 - protein, 17 aa, Entamoeba invadens
CSRCKAGKCTVSGGCSE

SEQ ID NO: 3039527 - protein, 21 aa, Entamoeba invadens
CSSDECLHCKEGASQVAYSCY

SEQ ID NO: 3039528 - protein, 18 aa, Entamoeba invadens
CSSGCFYDIHGVYEQSTL

SEQ ID NO: 3039529 - protein, 20 aa, Entamoeba invadens
CSTASCVSCNSGSDKCVECK

SEQ ID NO: 3039530 - protein, 21 aa, Entamoeba invadens
CSTPDCLTCGTGDVCNKCRDN

SEQ ID NO: 3039531 - protein, 18 aa, Entamoeba invadens
CSTRKPVVLIHGILSSVL

SEQ ID NO: 3039532 - protein, 19 aa, Entamoeba invadens
CSVRKVVVSGCLDFTINNL

SEQ ID NO: 3039533 - protein, 25 aa, Entamoeba invadens
CTEFECLECQTGFYLNDNKLCSLCS

SEQ ID NO: 3039534 - protein, 17 aa, Entamoeba invadens
CTIKGNGPYPLENVNQT

SEQ ID NO: 3039535 - protein, 24 aa, Entamoeba invadens
CTKEACKLPKILSTYVGGDKINYL

SEQ ID NO: 3039536 - protein, 17 aa, Entamoeba invadens
CTLCPDKYYSNTISSTE

SEQ ID NO: 3039537 - protein, 20 aa, Entamoeba invadens
CTQRKCFGGYDLEYDGEKKD

SEQ ID NO: 3039538 - protein, 18 aa, Entamoeba invadens
CTQRSCFFDESIQYDKKN

SEQ ID NO: 3039539 - protein, 18 aa, Entamoeba invadens
CTSCDSGLVFTNPPSTVC

SEQ ID NO: 3039540 - protein, 26 aa, Entamoeba invadens
CTSDECLMCKTGFYLQSGVCVTCPNT

SEQ ID NO: 3039541 - protein, 18 aa, Entamoeba invadens
CTSGCGPTAMAMVVATFK

SEQ ID NO: 3039542 - protein, 18 aa, Entamoeba invadens
CTSGCGPTSMAMVVATLA

SEQ ID NO: 3039543 - protein, 24 aa, Entamoeba invadens
CTSGKIAAALSCISNASKVFKGGI

SEQ ID NO: 3039544 - protein, 20 aa, Entamoeba invadens
CTTCKNGTFSLEKATSCTPC

SEQ ID NO: 3039545 - protein, 17 aa, Entamoeba invadens
CTTCKSGYTFKNSSYCE

SEQ ID NO: 3039546 - protein, 17 aa, Entamoeba invadens
CTTCKSIMYPDVSNGKC

SEQ ID NO: 3039547 - protein, 21 aa, Entamoeba invadens
CTTDDGYFVGQALNWFFTGGD

SEQ ID NO: 3039548 - protein, 23 aa, Entamoeba invadens
CVFADAFHDFTIALVLPNKKVVE

SEQ ID NO: 3039549 - protein, 18 aa, Entamoeba invadens
CVGSCPKPYFGTYDTAMC

SEQ ID NO: 3039550 - protein, 17 aa, Entamoeba invadens
CVKCIEGYYRNGLDCNK

SEQ ID NO: 3039551 - protein, 32 aa, Entamoeba invadens
CVKCSSHCLRCVKNSCVLCDSGYLLILQNGVS

SEQ ID NO: 3039552 - protein, 18 aa, Entamoeba invadens
CVPCTSPNCKVCNSIDKT

SEQ ID NO: 3039553 - protein, 21 aa, Entamoeba invadens
CVSCATNGSRACVNCKTNMYP

SEQ ID NO: 3039554 - protein, 23 aa, Entamoeba invadens
CVSPNECLYCDGEGYQSSCASCT

SEQ ID NO: 3039555 - protein, 17 aa, Entamoeba invadens
CVTCADMQYSLAGSTTC

SEQ ID NO: 3039556 - protein, 20 aa, Entamoeba invadens
CVTQCAAPSFGLTDGDLKKC

SEQ ID NO: 3039557 - protein, 18 aa, Entamoeba invadens
CVVKNNFIHDVFPIAIYT

SEQ ID NO: 3039558 - protein, 17 aa, Entamoeba invadens
CYCKSHGKYAILRTPLF

SEQ ID NO: 3039559 - protein, 24 aa, Entamoeba invadens
CYDLYHMWVWTFKDFYANDPTKEF

SEQ ID NO: 3039560 - protein, 18 aa, Entamoeba invadens
CYDYDVCALCEDSYYYQE

SEQ ID NO: 3039561 - protein, 20 aa, Entamoeba invadens
CYFAHNSFYQSFGGINFARC

SEQ ID NO: 3039562 - protein, 32 aa, Entamoeba invadens
CYHSSLVKRLSCKKPTIGKLIIHLMKIEESEI

SEQ ID NO: 3039563 - protein, 22 aa, Entamoeba invadens
CYLCDFTAMLLNGVCNVKNEKC

SEQ ID NO: 3039564 - protein, 23 aa, Entamoeba invadens
CYNCANCKRGTIKNENNICESKV

SEQ ID NO: 3039565 - protein, 17 aa, Entamoeba invadens
CYRLSNVNMTYVYVNKT

SEQ ID NO: 3039566 - protein, 24 aa, Entamoeba invadens
CYSVCPEGLFYIVGFKECVEVCPN

SEQ ID NO: 3039567 - protein, 19 aa, Entamoeba invadens
CYVQKRIEQVASRTKVLNF

SEQ ID NO: 3039568 - protein, 24 aa, Entamoeba invadens
CYYNGCTVPNCEKCYSSSVCTTCK

SEQ ID NO: 3039569 - protein, 29 aa, Entamoeba invadens
DACLPYDELGKWFLVRGVDQSISISTCDS

SEQ ID NO: 3039570 - protein, 19 aa, Entamoeba invadens
DAFHDFTVALVLPNKNIIK

SEQ ID NO: 3039571 - protein, 19 aa, Entamoeba invadens
DAIDREKEVFVTPTELVGM

SEQ ID NO: 3039572 - protein, 22 aa, Entamoeba invadens
DAMKGTCGISHYNIDIEMPEIC

SEQ ID NO: 3039573 - protein, 34 aa, Entamoeba invadens
DAMKKMMAVLPVEQRLAMLRRLKIEHRFSSVKEM

SEQ ID NO: 3039574 - protein, 19 aa, Entamoeba invadens
DARLFGKKEICIEANDPTI

SEQ ID NO: 3039575 - protein, 32 aa, Entamoeba invadens
DARMKTRLKLYLVLDFNWFLNRRSMLKELSSF

SEQ ID NO: 3039576 - protein, 19 aa, Entamoeba invadens
DASFGNFVAFGGWSKPTMK

SEQ ID NO: 3039577 - protein, 22 aa, Entamoeba invadens
DASRLSFQFYRKGTIYNDTNCK

SEQ ID NO: 3039578 - protein, 22 aa, Entamoeba invadens
DATCTACPAGSYSGKGYSICNK

SEQ ID NO: 3039579 - protein, 20 aa, Entamoeba invadens
DCHQLCYYNNAWTVKDYSGL

SEQ ID NO: 3039580 - protein, 19 aa, Entamoeba invadens
DCPLEFRIDSLLYDQDEDS

SEQ ID NO: 3039581 - protein, 20 aa, Entamoeba invadens
DCSPPFEVVCNATYYQNAFE

SEQ ID NO: 3039582 - protein, 28 aa, Entamoeba invadens
DDAEVSLFLKWLQKVEVVSYRQEVMDSV

SEQ ID NO: 3039583 - protein, 19 aa, Entamoeba invadens
DDFPYIIFHRGLYKDRVYR

SEQ ID NO: 3039584 - protein, 25 aa, Entamoeba invadens
DDGCGAVGGCGRVTKPSPLVRIPVF

SEQ ID NO: 3039585 - protein, 38 aa, Entamoeba invadens
DDGCGAVGGCSRVLKPSSLVRIPLFYRDDGAYIVTATS

SEQ ID NO: 3039586 - protein, 29 aa, Entamoeba invadens
DDGTVKTIWGWGCSHMTSGLQGWNSQTNT

SEQ ID NO: 3039587 - protein, 19 aa, Entamoeba invadens
DDIFGETDLDNFLEVFEGN

SEQ ID NO: 3039588 - protein, 29 aa, Entamoeba invadens
DDIYSPFKRSCVIQNRINSVTAETKNLQM

SEQ ID NO: 3039589 - protein, 17 aa, Entamoeba invadens
DDKRYEKYFQFLNTTYI

SEQ ID NO: 3039590 - protein, 19 aa, Entamoeba invadens
DDKSVPVYLNRSAPESLDL

SEQ ID NO: 3039591 - protein, 24 aa, Entamoeba invadens
DDLEYQLGDDFFSYYGNAYYTDPF

SEQ ID NO: 3039592 - protein, 20 aa, Entamoeba invadens
DDLRHLLIIVEKRNHINKEM

SEQ ID NO: 3039593 - protein, 25 aa, Entamoeba invadens
DDMKDDDWCWTRSCRRRRRKEREER

SEQ ID NO: 3039594 - protein, 23 aa, Entamoeba invadens
DDTCDKCSMGSSYMEGTTNKCDT

SEQ ID NO: 3039595 - protein, 23 aa, Entamoeba invadens
DDTIPSIHLYPSLKTLNDDLSSF

SEQ ID NO: 3039596 - protein, 24 aa, Entamoeba invadens
DDVRCRDMIKLLPLPEYLRNPEKI

SEQ ID NO: 3039597 - protein, 21 aa, Entamoeba invadens
DDVRLGRRIIRDMNSRGRTLE

SEQ ID NO: 3039598 - protein, 26 aa, Entamoeba invadens
DEFRLLPSEDPIVMSVGSGASPVYSN

SEQ ID NO: 3039599 - protein, 22 aa, Entamoeba invadens
DEIKLKLDALKSVKAEKEKKLR

SEQ ID NO: 3039600 - protein, 26 aa, Entamoeba invadens
DEILNIKRLLLRGIKLEAEEDNSKDL

SEQ ID NO: 3039601 - protein, 17 aa, Entamoeba invadens
DEITEVVILKATEYFDT

SEQ ID NO: 3039602 - protein, 25 aa, Entamoeba invadens
DEKCKRFVMDHCVTVVGYGKNDDGE

SEQ ID NO: 3039603 - protein, 18 aa, Entamoeba invadens
DEKCTACSDNCYICTDAN

SEQ ID NO: 3039604 - protein, 17 aa, Entamoeba invadens
DELCLDYQVIGSDLQCT

SEQ ID NO: 3039605 - protein, 17 aa, Entamoeba invadens
DENSLLIEGEWMVSTEI

SEQ ID NO: 3039606 - protein, 24 aa, Entamoeba invadens
DESKELPNRCFAVSIQPEVPGLES

SEQ ID NO: 3039607 - protein, 19 aa, Entamoeba invadens
DESRQAFIAGHKLAQTISY

SEQ ID NO: 3039608 - protein, 25 aa, Entamoeba invadens
DESYYHFRHGCIMHKRMIKVQKNTK

SEQ ID NO: 3039609 - protein, 27 aa, Entamoeba invadens
DETDCYKCKTGLFLRDGKCLSCGDIYD

SEQ ID NO: 3039610 - protein, 26 aa, Entamoeba invadens
DEVSRLYQFFPQFSFQLQLYSVPLDG

SEQ ID NO: 3039611 - protein, 22 aa, Entamoeba invadens
DEYFHSCYDWFTGGRASMPEPQ

SEQ ID NO: 3039612 - protein, 17 aa, Entamoeba invadens
DFDLNVSPSLWVLNNTT

SEQ ID NO: 3039613 - protein, 27 aa, Entamoeba invadens
DFDSWVIKFNKRFSAVESLRRRAIFVQ

SEQ ID NO: 3039614 - protein, 22 aa, Entamoeba invadens
DFFSDDDIDSFMTFFENDDFDL

SEQ ID NO: 3039615 - protein, 24 aa, Entamoeba invadens
DFIKRRSVQVTDRFPSSKRTEYKF

SEQ ID NO: 3039616 - protein, 27 aa, Entamoeba invadens
DFKVFLYRHELLLKLSSFIGLLKSPHF

SEQ ID NO: 3039617 - protein, 22 aa, Entamoeba invadens
DFLESLKILYSDESLKIHRRPM

SEQ ID NO: 3039618 - protein, 17 aa, Entamoeba invadens
DFLFTKIVNNWMSIKSC

SEQ ID NO: 3039619 - protein, 18 aa, Entamoeba invadens
DFYEYYGSDCFSKCSSLQ

SEQ ID NO: 3039620 - protein, 24 aa, Entamoeba invadens
DFYTKAAQMFKMYGSRFTFTCFEM

SEQ ID NO: 3039621 - protein, 27 aa, Entamoeba invadens
DGCDVKARIELLVPYFNTVASFFRPKM

SEQ ID NO: 3039622 - protein, 18 aa, Entamoeba invadens
DGDLLYKYLVYNFERHYN

SEQ ID NO: 3039623 - protein, 19 aa, Entamoeba invadens
DGEVSTIIFTRTGDSTTSV

SEQ ID NO: 3039624 - protein, 21 aa, Entamoeba invadens
DGFSGWRILLINTPTEVIVRH

SEQ ID NO: 3039625 - protein, 20 aa, Entamoeba invadens
DGGDFFKQFGYVEDRFSGSV

SEQ ID NO: 3039626 - protein, 21 aa, Entamoeba invadens
DGIKCTPCQTGTFSSVSGSAS

SEQ ID NO: 3039627 - protein, 18 aa, Entamoeba invadens
DGQSWANLAYVYVTSNNK

SEQ ID NO: 3039628 - protein, 20 aa, Entamoeba invadens
DGSTKYDREWLRDIIEKVYG

SEQ ID NO: 3039629 - protein, 18 aa, Entamoeba invadens
DGSVEFFQRPLVLSQLFD

SEQ ID NO: 3039630 - protein, 17 aa, Entamoeba invadens
DGSYLLFNECIPCSLKY

SEQ ID NO: 3039631 - protein, 19 aa, Entamoeba invadens
DGTINLQSLEFCRTLTADW

SEQ ID NO: 3039632 - protein, 23 aa, Entamoeba invadens
DGVYCSPCFETAASYSKDKIDDE

SEQ ID NO: 3039633 - protein, 24 aa, Entamoeba invadens
DGYYLKGEICTKCGSNCIQCSDAK

SEQ ID NO: 3039634 - protein, 18 aa, Entamoeba invadens
DHCFPCNENTYAYKNSTK

SEQ ID NO: 3039635 - protein, 23 aa, Entamoeba invadens
DHERVVEGKKLAALMKIQKKEIE

SEQ ID NO: 3039636 - protein, 23 aa, Entamoeba invadens
DHVVLKWHVEYYWGSLFIASYQY

SEQ ID NO: 3039637 - protein, 17 aa, Entamoeba invadens
DIARAFPLIYVGDTNDN

SEQ ID NO: 3039638 - protein, 21 aa, Entamoeba invadens
DIDNACAMGASYGGYMMNWIN

SEQ ID NO: 3039639 - protein, 24 aa, Entamoeba invadens
DIDQRFDIWLKRNPTSIPYVHVDG

SEQ ID NO: 3039640 - protein, 20 aa, Entamoeba invadens
DIDQRFWIEFYRTITQIAYL

SEQ ID NO: 3039641 - protein, 17 aa, Entamoeba invadens
DIEFGIGNEMVIVVPGK

SEQ ID NO: 3039642 - protein, 20 aa, Entamoeba invadens
DIGVSIPIVAQFVNCPSKTP

SEQ ID NO: 3039643 - protein, 20 aa, Entamoeba invadens
DIILCTDCVVKNNFIHDVFP

SEQ ID NO: 3039644 - protein, 18 aa, Entamoeba invadens
DIKMECRSAIDGLIRRLE

SEQ ID NO: 3039645 - protein, 21 aa, Entamoeba invadens
DIKPDNFLVFSLESGIDVNAK

SEQ ID NO: 3039646 - protein, 19 aa, Entamoeba invadens
DILALEWEGCYGDTLMTVS

SEQ ID NO: 3039647 - protein, 17 aa, Entamoeba invadens
DIMKVKIWQSWYPSEWG

SEQ ID NO: 3039648 - protein, 21 aa, Entamoeba invadens
DINNRYLLWMFYNKTSDVNLE

SEQ ID NO: 3039649 - protein, 18 aa, Entamoeba invadens
DITNCFEEYFGVKNINSI

SEQ ID NO: 3039650 - protein, 23 aa, Entamoeba invadens
DIVADCWDYIKTWTYNENLPALN

SEQ ID NO: 3039651 - protein, 18 aa, Entamoeba invadens
DIVGCLFCSQTEYKCYRC

SEQ ID NO: 3039652 - protein, 25 aa, Entamoeba invadens
DIVLPRKGECLMKYMSGVWNETTNK

SEQ ID NO: 3039653 - protein, 22 aa, Entamoeba invadens
DIYKALWKRMDVVVLTVKTDNL

SEQ ID NO: 3039654 - protein, 18 aa, Entamoeba invadens
DIYSCEMCDFERSDQNEI

SEQ ID NO: 3039655 - protein, 21 aa, Entamoeba invadens
DKCELCQRIAKVAVKEHAYDA

SEQ ID NO: 3039656 - protein, 25 aa, Entamoeba invadens
DKEACGLSLFVGWEGYAGSRYQKTY

SEQ ID NO: 3039657 - protein, 23 aa, Entamoeba invadens
DKEVQRDIKIFPFTIVDQENKPY

SEQ ID NO: 3039658 - protein, 18 aa, Entamoeba invadens
DKICKKCLAGCTICTGDT

SEQ ID NO: 3039659 - protein, 20 aa, Entamoeba invadens
DKICRRAKHQLECYKSLIEV

SEQ ID NO: 3039660 - protein, 22 aa, Entamoeba invadens
DKKAKGYTSTTCGNWHDEGSFD

SEQ ID NO: 3039661 - protein, 25 aa, Entamoeba invadens
DKKKEEKEWWGVRVRKIHPDLEAND

SEQ ID NO: 3039662 - protein, 19 aa, Entamoeba invadens
DKKLKGIVKSVIFPCPTGV

SEQ ID NO: 3039663 - protein, 25 aa, Entamoeba invadens
DKLASRYSLYYTFPSGYFSIFSNDI

SEQ ID NO: 3039664 - protein, 24 aa, Entamoeba invadens
DKLCDMKAKIAVANVELKNQKRIA

SEQ ID NO: 3039665 - protein, 18 aa, Entamoeba invadens
DKLFLAIIHTIPSKLHHV

SEQ ID NO: 3039666 - protein, 17 aa, Entamoeba invadens
DKLRAAVVKLLKSNTTL

SEQ ID NO: 3039667 - protein, 17 aa, Entamoeba invadens
DKLSVMRWYLFKITDGK

SEQ ID NO: 3039668 - protein, 17 aa, Entamoeba invadens
DKMHVTSFHCAEQSEVC

SEQ ID NO: 3039669 - protein, 27 aa, Entamoeba invadens
DKNEFKFPWKIAEFVSEGKRLEKKENM

SEQ ID NO: 3039670 - protein, 19 aa, Entamoeba invadens
DKPFSLNQFYAMTKRKENT

SEQ ID NO: 3039671 - protein, 26 aa, Entamoeba invadens
DKPPIVLWKSDWLHLYTNTTDKNFYI

SEQ ID NO: 3039672 - protein, 20 aa, Entamoeba invadens
DKQVPLISWFIGRQATIHQR

SEQ ID NO: 3039673 - protein, 18 aa, Entamoeba invadens
DKSGYYCLDDVDYVYQYL

SEQ ID NO: 3039674 - protein, 19 aa, Entamoeba invadens
DKTIKLWGYDQALLNVLYY

SEQ ID NO: 3039675 - protein, 19 aa, Entamoeba invadens
DKTKCIICVNGYGLNNTDC

SEQ ID NO: 3039676 - protein, 18 aa, Entamoeba invadens
DKVCTACVDDCKTCTEET

SEQ ID NO: 3039677 - protein, 19 aa, Entamoeba invadens
DKYILRWIAMSTPFIGTGI

SEQ ID NO: 3039678 - protein, 23 aa, Entamoeba invadens
DLANRLAAYGTRKMKSELELYEL

SEQ ID NO: 3039679 - protein, 19 aa, Entamoeba invadens
DLCASSCRSCVDGTSCESC

SEQ ID NO: 3039680 - protein, 24 aa, Entamoeba invadens
DLDGEYSTGYGYVYHDIETPYKDN

SEQ ID NO: 3039681 - protein, 23 aa, Entamoeba invadens
DLESIPRLFIFDGTKDEIKKVMM

SEQ ID NO: 3039682 - protein, 24 aa, Entamoeba invadens
DLFKKTMGPVRMVLDDAKVKKDDI

SEQ ID NO: 3039683 - protein, 23 aa, Entamoeba invadens
DLGIPIVCGICKSVVSHLEELLL

SEQ ID NO: 3039684 - protein, 20 aa, Entamoeba invadens
DLKKDIPFFEKVRENAKRLR

SEQ ID NO: 3039685 - protein, 18 aa, Entamoeba invadens
DLQCLKCDEILTNCIKCG

SEQ ID NO: 3039686 - protein, 24 aa, Entamoeba invadens
DLQHLKITVSIFKSGVLKKTQTAY

SEQ ID NO: 3039687 - protein, 24 aa, Entamoeba invadens
DLQNSRKSLFANFNKICASLKLGD

SEQ ID NO: 3039688 - protein, 24 aa, Entamoeba invadens
DLQYPVPFWHVFVGIDTHFGTSFN

SEQ ID NO: 3039689 - protein, 24 aa, Entamoeba invadens
DLRSTELPPAFGAIDGKIVKVSEP

SEQ ID NO: 3039690 - protein, 18 aa, Entamoeba invadens
DLVNGARCLEAECRNTMK

SEQ ID NO: 3039691 - protein, 24 aa, Entamoeba invadens
DLYSCKKCINCLRCKSDTVCIKGT

SEQ ID NO: 3039692 - protein, 19 aa, Entamoeba invadens
DMCSGKLCRMRVKQVMRKC

SEQ ID NO: 3039693 - protein, 24 aa, Entamoeba invadens
DMKLLCVINLKIIETPIIKPNATI

SEQ ID NO: 3039694 - protein, 24 aa, Entamoeba invadens
DMLGAPYDWRYFRFDEYSHKENWY

SEQ ID NO: 3039695 - protein, 24 aa, Entamoeba invadens
DNAIDEVVEFGGKYVKKAGEKIGL

SEQ ID NO: 3039696 - protein, 17 aa, Entamoeba invadens
DNCGSCINDYILKDNTC

SEQ ID NO: 3039697 - protein, 23 aa, Entamoeba invadens
DNFKEGDLVLCVLKTITQCMFAS

SEQ ID NO: 3039698 - protein, 23 aa, Entamoeba invadens
DNFYRYVKGIKYPQCGACVELVG

SEQ ID NO: 3039699 - protein, 31 aa, Entamoeba invadens
DNGACGYGPIVRGGSFGSIGYAALNEEMYNN

SEQ ID NO: 3039700 - protein, 27 aa, Entamoeba invadens
DNGVRSCLICSVGYYPSSGMCVSCTAT

SEQ ID NO: 3039701 - protein, 18 aa, Entamoeba invadens
DNLESLSIVQNMVTEIYL

SEQ ID NO: 3039702 - protein, 19 aa, Entamoeba invadens
DNLRSGISKVFTLLCFVVI

SEQ ID NO: 3039703 - protein, 22 aa, Entamoeba invadens
DNNRSILWSNWDLMVRTIDLVM

SEQ ID NO: 3039704 - protein, 30 aa, Entamoeba invadens; identical to SEQ ID NO: 2788262

SEQ ID NO: 3039705 - protein, 19 aa, Entamoeba invadens
DNTCVFKRDLFCEETFENQ

SEQ ID NO: 3039706 - protein, 24 aa, Entamoeba invadens
DNVTCKNCPLGCLTCSNEFSCESC

SEQ ID NO: 3039707 - protein, 20 aa, Entamoeba invadens
DNWMSIDMCRFATYQLDKHG

SEQ ID NO: 3039708 - protein, 22 aa, Entamoeba invadens
DPDWYNSECFQMLRKFIQREHN

SEQ ID NO: 3039709 - protein, 18 aa, Entamoeba invadens
DPLMAWITTYKVSLDSLD

SEQ ID NO: 3039710 - protein, 22 aa, Entamoeba invadens
DPNCMACVISSTHCITCPLGYY

SEQ ID NO: 3039711 - protein, 19 aa, Entamoeba invadens
DPSSEKGVVFAFSRKDDAL

SEQ ID NO: 3039712 - protein, 19 aa, Entamoeba invadens
DPTHCTLCNNGYFLENTVC

SEQ ID NO: 3039713 - protein, 19 aa, Entamoeba invadens
DPYIWIKMDKDIGVDVSID

SEQ ID NO: 3039714 - protein, 23 aa, Entamoeba invadens
DQAQCGSCYTFGSTASLEGRLLM

SEQ ID NO: 3039715 - protein, 24 aa, Entamoeba invadens
DQAQCGSCYTFSALASVENRLLIA

SEQ ID NO: 3039716 - protein, 21 aa, Entamoeba invadens
DQCTVCPIGSQVNGNGKCVCP

SEQ ID NO: 3039717 - protein, 18 aa, Entamoeba invadens
DQCYSCNHLCGWNGQQCV

SEQ ID NO: 3039718 - protein, 24 aa, Entamoeba invadens
DQGNCGSCYSFAITAYLDTNMLLN

SEQ ID NO: 3039719 - protein, 18 aa, Entamoeba invadens
DQHWWIVFHRNETLSYSP

SEQ ID NO: 3039720 - protein, 23 aa, Entamoeba invadens
DQIRTTFGIGYPTVIKMYVHFSQ

SEQ ID NO: 3039721 - protein, 24 aa, Entamoeba invadens
DQKNCGSCYSFGAVSVIESLILIT

SEQ ID NO: 3039722 - protein, 24 aa, Entamoeba invadens
DQKSCGSCYSFGALASLEGRLLFL

SEQ ID NO: 3039723 - protein, 24 aa, Entamoeba invadens
DQNPCGGCYSFGALASLEGRLLFI

SEQ ID NO: 3039724 - protein, 24 aa, Entamoeba invadens
DQNPCGSCYSFGALASLEGRLLFV

SEQ ID NO: 3039725 - protein, 24 aa, Entamoeba invadens
DQPLPRKILVNFTMDDYNALVDEY

SEQ ID NO: 3039726 - protein, 20 aa, Entamoeba invadens
DQTTCLSCTVGYYLKSGSCI

SEQ ID NO: 3039727 - protein, 21 aa, Entamoeba invadens
DRIAVLQSRKLRVYRKYVKIL

SEQ ID NO: 3039728 - protein, 24 aa, Entamoeba invadens
DRKEFSNGGSIKFLINKNSYIRLQ

SEQ ID NO: 3039729 - protein, 32 aa, Entamoeba invadens
DRLNLTNCQDFKPSEPVTIIVMKCNNTLIRIK

SEQ ID NO: 3039730 - protein, 25 aa, Entamoeba invadens
DRMKCTTCCRVLFASDYNFRTKTVF

SEQ ID NO: 3039731 - protein, 24 aa, Entamoeba invadens
DRNGRCAIIPNCLLKRSNRCLKCS

SEQ ID NO: 3039732 - protein, 29 aa, Entamoeba invadens
DRNKDEFRLWLSLKDGIPYMNDCQMAYLT

SEQ ID NO: 3039733 - protein, 17 aa, Entamoeba invadens
DRNWTHRLLLSSFTLVD

SEQ ID NO: 3039734 - protein, 17 aa, Entamoeba invadens
DRNWTHRLLLSSYTLQD

SEQ ID NO: 3039735 - protein, 25 aa, Entamoeba invadens
DRPKYPNCTDYKPSQNITYTLIVCN

SEQ ID NO: 3039736 - protein, 24 aa, Entamoeba invadens
DRSHWEVVTMLPGDKIVFTTNDSV

SEQ ID NO: 3039737 - protein, 21 aa, Entamoeba invadens
DRSHWEVVTMLPGEEIVFTTN

SEQ ID NO: 3039738 - protein, 18 aa, Entamoeba invadens
DRTRLELEIEGIQKKLHD

SEQ ID NO: 3039739 - protein, 35 aa, Entamoeba invadens
DRYKNTFYTLLFVPKFYYLCMYKTLIEISKDKKFS

SEQ ID NO: 3039740 - protein, 18 aa, Entamoeba invadens
DSGISRVLYSLGVSENTK

SEQ ID NO: 3039741 - protein, 23 aa, Entamoeba invadens
DSIEVRWFWEMVEEMTEEERVLL

SEQ ID NO: 3039742 - protein, 22 aa, Entamoeba invadens
DSKYLKHCMYLDYACKTLASCE

SEQ ID NO: 3039743 - protein, 21 aa, Entamoeba invadens
DSLKYKAYMTTLSLLVEKSKN

SEQ ID NO: 3039744 - protein, 31 aa, Entamoeba invadens
DSLRHELDLLLKYYPKVGVRVTKDFWNKTFT

SEQ ID NO: 3039745 - protein, 17 aa, Entamoeba invadens
DSPCVLESSISVDTTKD

SEQ ID NO: 3039746 - protein, 19 aa, Entamoeba invadens
DSPRFKWRGLMLDCARNPL

SEQ ID NO: 3039747 - protein, 21 aa, Entamoeba invadens
DSQLIVFPSGYSILIDAGETS

SEQ ID NO: 3039748 - protein, 25 aa, Entamoeba invadens
DSQLIVFPSGYSILIDAGETSTGSM

SEQ ID NO: 3039749 - protein, 21 aa, Entamoeba invadens
DSQLIVFPSGYSILVDAGEVK

SEQ ID NO: 3039750 - protein, 17 aa, Entamoeba invadens
DSRMEAITWDTFCNDCA

SEQ ID NO: 3039751 - protein, 26 aa, Entamoeba invadens
DSSTCLRCKMPFTLNGENCFDCSDFE

SEQ ID NO: 3039752 - protein, 17 aa, Entamoeba invadens
DSYCTTLGITISDQGML

SEQ ID NO: 3039753 - protein, 18 aa, Entamoeba invadens
DTCGNGYEAYKYECVSCN

SEQ ID NO: 3039754 - protein, 18 aa, Entamoeba invadens
DTESDCVWCSSTSACCAS

SEQ ID NO: 3039755 - protein, 23 aa, Entamoeba invadens
DTGIYCLLLARALERDTQYYCKL

SEQ ID NO: 3039756 - protein, 22 aa, Entamoeba invadens
DTHIVDFGLKMFVSATSLQSVA

SEQ ID NO: 3039757 - protein, 25 aa, Entamoeba invadens
DTHPCGLYHSMCMNGNYTLSILALE

SEQ ID NO: 3039758 - protein, 24 aa, Entamoeba invadens
DTIETPKCEKRIISHRMEHFQEQT

SEQ ID NO: 3039759 - protein, 27 aa, Entamoeba invadens
DTKALEIIPFKTFPSVTILSMKSKEAT

SEQ ID NO: 3039760 - protein, 25 aa, Entamoeba invadens
DTKRCLECIPGYYLDENTYICHPGN

SEQ ID NO: 3039761 - protein, 23 aa, Entamoeba invadens
DTLRVFIAVHLYYSYLSNTCEQG

SEQ ID NO: 3039762 - protein, 24 aa, Entamoeba invadens
DTMWAKFMKHYAMELPYSCEGTCR

SEQ ID NO: 3039763 - protein, 23 aa, Entamoeba invadens
DTQCLFCSNGFYSNGPQCVQCDT

SEQ ID NO: 3039764 - protein, 18 aa, Entamoeba invadens
DTSLMRFFFPPLSRAGTS

SEQ ID NO: 3039765 - protein, 22 aa, Entamoeba invadens
DTYKASIPFNGEIIPLDILDTA

SEQ ID NO: 3039766 - protein, 25 aa, Entamoeba invadens
DVESFSFDGYDFFDDIMSLNDATTD

SEQ ID NO: 3039767 - protein, 25 aa, Entamoeba invadens
DVIKRKGVTKNGFLAWANLISIKFN

SEQ ID NO: 3039768 - protein, 22 aa, Entamoeba invadens
DVILKWHVEYYWGSLYIASHQY

SEQ ID NO: 3039769 - protein, 17 aa, Entamoeba invadens
DVKDCPICHGTGMRTET

SEQ ID NO: 3039770 - protein, 18 aa, Entamoeba invadens
DVKMKIREDIAFLLNERV

SEQ ID NO: 3039771 - protein, 22 aa, Entamoeba invadens
DVLKKKFGVEPSFVCRDQISVY

SEQ ID NO: 3039772 - protein, 23 aa, Entamoeba invadens
DVMKVKIWQSWYPNEWNKCEGTI

SEQ ID NO: 3039773 - protein, 19 aa, Entamoeba invadens
DVMQGFGMTEVCGAVSVMP

SEQ ID NO: 3039774 - protein, 19 aa, Entamoeba invadens
DVPVLFYYYISAMTGATFM

SEQ ID NO: 3039775 - protein, 26 aa, Entamoeba invadens
DVTLTWRVEYYWGTLFIASYKYDDQL

SEQ ID NO: 3039776 - protein, 22 aa, Entamoeba invadens
DVVLKWHVEYYWGSLFIASYQY

SEQ ID NO: 3039777 - protein, 19 aa, Entamoeba invadens
DVYPIIGFISSIPMLDNYF

SEQ ID NO: 3039778 - protein, 26 aa, Entamoeba invadens
DVYSFAVTMLTCFTWDNPFPKTLYPF

SEQ ID NO: 3039779 - protein, 19 aa, Entamoeba invadens
DWCDLLHLMASRLKTYKIT

SEQ ID NO: 3039780 - protein, 22 aa, Entamoeba invadens
DWLRDMLSPVYLFVSTQSEIQR

SEQ ID NO: 3039781 - protein, 24 aa, Entamoeba invadens
DWNYPDCRYNHSLYNLDLTNDVDN

SEQ ID NO: 3039782 - protein, 20 aa, Entamoeba invadens
DYFLSDNIFEEFFDGTANVF

SEQ ID NO: 3039783 - protein, 23 aa, Entamoeba invadens
DYGKGLTGAVCFCYVVDKTKTAY

SEQ ID NO: 3039784 - protein, 24 aa, Entamoeba invadens
DYLCKTCKFGGLGNCSTCMISYYY

SEQ ID NO: 3039785 - protein, 24 aa, Entamoeba invadens
DYLDSYKGGIVWSTEGKEIGALYM

SEQ ID NO: 3039786 - protein, 31 aa, Entamoeba invadens
DYLNKKLKAPRCVVEGINLKKCDRLFRSKVN

SEQ ID NO: 3039787 - protein, 18 aa, Entamoeba invadens
DYNFYLRKTCSSPYISVF

SEQ ID NO: 3039788 - protein, 17 aa, Entamoeba invadens
DYSISLRIQYGNFVYST

SEQ ID NO: 3039789 - protein, 20 aa, Entamoeba invadens
DYSSRLCVRCASGMYPSSSG

SEQ ID NO: 3039790 - protein, 27 aa, Entamoeba invadens
DYVPLPYKLKVRMLYDTSRGMEFLHEN

SEQ ID NO: 3039791 - protein, 25 aa, Entamoeba invadens
DYYFTFKHYCCSFQTMIFRENETDK

SEQ ID NO: 3039792 - protein, 28 aa, Entamoeba invadens
EAAFSNYLAWCLLKRGYTLDVNTVGLKY

SEQ ID NO: 3039793 - protein, 21 aa, Entamoeba invadens
EAAFTKLTWLLAQGLSPENVR

SEQ ID NO: 3039794 - protein, 19 aa, Entamoeba invadens
EADVIKGFDGVHTKFVQAV

SEQ ID NO: 3039795 - protein, 23 aa, Entamoeba invadens
EAFKKGLITIEFVQNIFPKVTRM

SEQ ID NO: 3039796 - protein, 18 aa, Entamoeba invadens
EAFSFFLDVFSTYSTEQQ

SEQ ID NO: 3039797 - protein, 24 aa, Entamoeba invadens
EAGEASPPWGVVTMFMSWAELLYD

SEQ ID NO: 3039798 - protein, 17 aa, Entamoeba invadens
EAIPWPPESGVTIIITM

SEQ ID NO: 3039799 - protein, 20 aa, Entamoeba invadens
EAKRRVAFKKVMYSKKREEL

SEQ ID NO: 3039800 - protein, 21 aa, Entamoeba invadens
EAKVLKALAITDFTQFKTDLS

SEQ ID NO: 3039801 - protein, 20 aa, Entamoeba invadens
EALETFKIAGYYNEMIDTDI

SEQ ID NO: 3039802 - protein, 18 aa, Entamoeba invadens
EAQKVVGYLKAMIDESET

SEQ ID NO: 3039803 - protein, 20 aa, Entamoeba invadens
EARITVEIEDVEDWKFIQSD

SEQ ID NO: 3039804 - protein, 18 aa, Entamoeba invadens
EASIDFLVMSLELLKDVS

SEQ ID NO: 3039805 - protein, 19 aa, Entamoeba invadens
EAVDASLFKQGQPNKNAPD

SEQ ID NO: 3039806 - protein, 19 aa, Entamoeba invadens
EAYMELYPKTCVKNKFGGS

SEQ ID NO: 3039807 - protein, 18 aa, Entamoeba invadens
ECEFMGKAGWLGVKVYPP

SEQ ID NO: 3039808 - protein, 22 aa, Entamoeba invadens
ECEQCPVFFQFFNVNPRFRKLS

SEQ ID NO: 3039809 - protein, 19 aa, Entamoeba invadens
ECLSCPQGYYLQDGECENC

SEQ ID NO: 3039810 - protein, 21 aa, Entamoeba invadens
ECSATAIGCSKCKADQTTCLS

SEQ ID NO: 3039811 - protein, 19 aa, Entamoeba invadens
ECSQRIYAYEKRKCGDKVM

SEQ ID NO: 3039812 - protein, 24 aa, Entamoeba invadens
ECTKARITYYSGYESGGACGFPDI

SEQ ID NO: 3039813 - protein, 24 aa, Entamoeba invadens
EDIKRFKQQFLWIVNATIQTPTLT

SEQ ID NO: 3039814 - protein, 22 aa, Entamoeba invadens
EDITFRLNCVVNNLKISSLGKY

SEQ ID NO: 3039815 - protein, 26 aa, Entamoeba invadens
EDIYRELWGFLSFYQGVLFDSTIPTD

SEQ ID NO: 3039816 - protein, 24 aa, Entamoeba invadens
EDLKRLKEASGRVLKQLKEKKYVS

SEQ ID NO: 3039817 - protein, 21 aa, Entamoeba invadens
EDLTLKIAQFNADKNKLVNDL

SEQ ID NO: 3039818 - protein, 19 aa, Entamoeba invadens
EDRICKGCLRGYYCPDGIL

SEQ ID NO: 3039819 - protein, 25 aa, Entamoeba invadens
EDRICKRCLRDYYCPNGILMYPCLL

SEQ ID NO: 3039820 - protein, 22 aa, Entamoeba invadens
EDTHMTKGWGFLTVETNKKSPS

SEQ ID NO: 3039821 - protein, 18 aa, Entamoeba invadens
EDVFKTFFTNFGNGGEDS

SEQ ID NO: 3039822 - protein, 27 aa, Entamoeba invadens
EDVILTWRVEYYWGTLFVASYKYDDQL

SEQ ID NO: 3039823 - protein, 24 aa, Entamoeba invadens
EEAKRRELPILAFFTADECEQCPV

SEQ ID NO: 3039824 - protein, 17 aa, Entamoeba invadens
EEAMYICKNTWKETNKD

SEQ ID NO: 3039825 - protein, 21 aa, Entamoeba invadens
EECGYDFIPFEVLEKYNQNYV

SEQ ID NO: 3039826 - protein, 20 aa, Entamoeba invadens
EECITKEEFDTMVANIYHDN

SEQ ID NO: 3039827 - protein, 31 aa, Entamoeba invadens
EEERRELFTSLALAFKFLLSQQQCNTINVTE

SEQ ID NO: 3039828 - protein, 22 aa, Entamoeba invadens
EEGGCATGLVGQLTGAAVDSYS

SEQ ID NO: 3039829 - protein, 24 aa, Entamoeba invadens
EEGYPGTFYLEFDRCTFLRKEGFD

SEQ ID NO: 3039830 - protein, 19 aa, Entamoeba invadens
EEIKESAFESCYSLESIKF

SEQ ID NO: 3039831 - protein, 17 aa, Entamoeba invadens
EEISSFVNSTKFTFLCF

SEQ ID NO: 3039832 - protein, 27 aa, Entamoeba invadens
EEIVRGWMWNSFVPRWCELTERNLMLF

SEQ ID NO: 3039833 - protein, 17 aa, Entamoeba invadens
EEKGYFVEAIWQDSKKQ

SEQ ID NO: 3039834 - protein, 17 aa, Entamoeba invadens
EEKLKEVGEVAVRKAMR

SEQ ID NO: 3039835 - protein, 19 aa, Entamoeba invadens
EEKMIKQKALSLIKKTSEF

SEQ ID NO: 3039836 - protein, 39 aa, Entamoeba invadens
EELRNIVFFRYPKWVGGLYCSPSIPGSRAGSAIAGAWAS

SEQ ID NO: 3039837 - protein, 24 aa, Entamoeba invadens
EELRSPREVYSWKLQTLEILNSPL

SEQ ID NO: 3039838 - protein, 24 aa, Entamoeba invadens
EENEWKMSKFVSMSPRVEVIGDEI

SEQ ID NO: 3039839 - protein, 27 aa, Entamoeba invadens
EEPFPKIRFKFAWDIVDFVVSGKRLKK

SEQ ID NO: 3039840 - protein, 17 aa, Entamoeba invadens
EERMKCLSGPETSAVKY

SEQ ID NO: 3039841 - protein, 24 aa, Entamoeba invadens
EESAYLLDDGWFQGLKEGISDAVD

SEQ ID NO: 3039842 - protein, 18 aa, Entamoeba invadens
EESCYWWYIKDSKINHYA

SEQ ID NO: 3039843 - protein, 25 aa, Entamoeba invadens
EESKRLQLVIEDRVAEITKLQNEVI

SEQ ID NO: 3039844 - protein, 24 aa, Entamoeba invadens
EESVTFRAFFEAWSDANLLRKNNL

SEQ ID NO: 3039845 - protein, 23 aa, Entamoeba invadens
EETKRYKQQFVWITNSSVNCPQM

SEQ ID NO: 3039846 - protein, 18 aa, Entamoeba invadens
EEVFFYQCDSRWKSKMYS

SEQ ID NO: 3039847 - protein, 23 aa, Entamoeba invadens
EEVIPRVVERIAKAIENLRGCNI

SEQ ID NO: 3039848 - protein, 24 aa, Entamoeba invadens
EEVIPSIKRVVIWYEVTFNETQTL

SEQ ID NO: 3039849 - protein, 19 aa, Entamoeba invadens
EEVKKLILKAKAQTKKAVK

SEQ ID NO: 3039850 - protein, 25 aa, Entamoeba invadens
EEWVLCGSILRECLSIEDVQNKLAN

SEQ ID NO: 3039851 - protein, 29 aa, Entamoeba invadens
EFAPYKMFISFPIPRRVHDIRRGAFEGYT

SEQ ID NO: 3039852 - protein, 29 aa, Entamoeba invadens
EFAPYKMFISFPIPRRVHDIRSGAIVGNT

SEQ ID NO: 3039853 - protein, 27 aa, Entamoeba invadens
EFAPYKMYISFAIPRRVHDIRQGAEPG

SEQ ID NO: 3039854 - protein, 26 aa, Entamoeba invadens
EFAPYKMYISFPIPKRVHDIRGSASV

SEQ ID NO: 3039855 - protein, 29 aa, Entamoeba invadens
EFDRCTFLRKEGFDTFKLTKKDGNVVFKK

SEQ ID NO: 3039856 - protein, 26 aa, Entamoeba invadens
EFDSRFPADKGGNCYYVVNDDVYSPD

SEQ ID NO: 3039857 - protein, 24 aa, Entamoeba invadens
EFFRAHNKFADFLTTLKVVMEEGH

SEQ ID NO: 3039858 - protein, 17 aa, Entamoeba invadens
EFFVRRGNNYVSQLNDL

SEQ ID NO: 3039859 - protein, 18 aa, Entamoeba invadens
EFGKSFVFIANTNNNEVV

SEQ ID NO: 3039860 - protein, 24 aa, Entamoeba invadens
EFILKEYEEMFAIFDLFTEQNGYK

SEQ ID NO: 3039861 - protein, 17 aa, Entamoeba invadens
EFMSMRYYCESKLAMAM

SEQ ID NO: 3039862 - protein, 23 aa, Entamoeba invadens
EFTGPYCIQTIFGSIDHYKENCV

SEQ ID NO: 3039863 - protein, 29 aa, Entamoeba invadens
EFTQIPTIQWEFSPQLDLKVKVVCKRTIS

SEQ ID NO: 3039864 - protein, 17 aa, Entamoeba invadens
EGACIFCNKYFRQCSEC

SEQ ID NO: 3039865 - protein, 23 aa, Entamoeba invadens
EGALRKLPVLPLTETDIFILNSD

SEQ ID NO: 3039866 - protein, 20 aa, Entamoeba invadens
EGATRCKACLSICNTCDKTT

SEQ ID NO: 3039867 - protein, 21 aa, Entamoeba invadens
EGCVPYCGVCHLGETCNKNAR

SEQ ID NO: 3039868 - protein, 20 aa, Entamoeba invadens
EGDQRLLFWKSKDERKALAS

SEQ ID NO: 3039869 - protein, 18 aa, Entamoeba invadens
EGEFEVFAMLALFIACLL

SEQ ID NO: 3039870 - protein, 20 aa, Entamoeba invadens
EGFHVHGFWPQLYTGNVLKC

SEQ ID NO: 3039871 - protein, 21 aa, Entamoeba invadens
EGGRVKCLISDFGTSGVQLFE

SEQ ID NO: 3039872 - protein, 21 aa, Entamoeba invadens
EGQTTCKLCDLSCASCNATNG

SEQ ID NO: 3039873 - protein, 20 aa, Entamoeba invadens
EGQTTCKLCDSSCASCNATN

SEQ ID NO: 3039874 - protein, 25 aa, Entamoeba invadens
EGRTPIEIYGDFMASFKQNFQKYID

SEQ ID NO: 3039875 - protein, 21 aa, Entamoeba invadens
EGSITFNVFNFFDVAKLNIFN

SEQ ID NO: 3039876 - protein, 27 aa, Entamoeba invadens
EGTYWEFFCSVASKYGMRCEQRSCSDM

SEQ ID NO: 3039877 - protein, 17 aa, Entamoeba invadens
EGVAHCTSECLCEDNYF

SEQ ID NO: 3039878 - protein, 23 aa, Entamoeba invadens
EGVFKLLDYFQVNWIEKWPIRIW

SEQ ID NO: 3039879 - protein, 18 aa, Entamoeba invadens
EGYDDIISYTFNLEAANI

SEQ ID NO: 3039880 - protein, 27 aa, Entamoeba invadens
EHCTIKGSGPYPLEMLIKTGCVKTSVT

SEQ ID NO: 3039881 - protein, 22 aa, Entamoeba invadens
EHNDCFKRRKLWKQVRAAQEER

SEQ ID NO: 3039882 - protein, 27 aa, Entamoeba invadens
EHPGCVRTALWQFFPYWMQIVCGPVLR

SEQ ID NO: 3039883 - protein, 28 aa, Entamoeba invadens
EHTRTSLPSVLKWQIWQGTVSGSGSQIP

SEQ ID NO: 3039884 - protein, 21 aa, Entamoeba invadens
EIDEVPFALIFSTKDNKKQNV

SEQ ID NO: 3039885 - protein, 19 aa, Entamoeba invadens
EIDMKLRVKFMKDGAKGVL

SEQ ID NO: 3039886 - protein, 20 aa, Entamoeba invadens
EIFLSTPVSFTFDESSDVDY

SEQ ID NO: 3039887 - protein, 24 aa, Entamoeba invadens
EIGYICPCRRRFVGDGKRKKKSTT

SEQ ID NO: 3039888 - protein, 28 aa, Entamoeba invadens
EIHKNVKCVGRFAFYNSIDINNVLFMDP

SEQ ID NO: 3039889 - protein, 18 aa, Entamoeba invadens
EIISCAYKYGASGCDGAP

SEQ ID NO: 3039890 - protein, 29 aa, Entamoeba invadens
EIKSLKIQCSITFKFVYDTESILLYETNN

SEQ ID NO: 3039891 - protein, 20 aa, Entamoeba invadens
EILQRVETILLKGSISKSEF

SEQ ID NO: 3039892 - protein, 20 aa, Entamoeba invadens
EILSRRPITLNANMNNISIV

SEQ ID NO: 3039893 - protein, 26 aa, Entamoeba invadens
EIVKEGFFLHGFWPQFYTQKHLQCCH

SEQ ID NO: 3039894 - protein, 20 aa, Entamoeba invadens
EIYAGGIVQYSDYVVITGML

SEQ ID NO: 3039895 - protein, 23 aa, Entamoeba invadens
EIYRITLKLLPTIFDPAIVKIRT

SEQ ID NO: 3039896 - protein, 24 aa, Entamoeba invadens
EKAQRRKLPILGFFSGLECAQCSS

SEQ ID NO: 3039897 - protein, 25 aa, Entamoeba invadens
EKDECQRNLELMKCDFENVQKDQTT

SEQ ID NO: 3039898 - protein, 18 aa, Entamoeba invadens
EKGKCIECSVGCKNCIKN

SEQ ID NO: 3039899 - protein, 17 aa, Entamoeba invadens
EKIGIWLLSTTKLDLKP

SEQ ID NO: 3039900 - protein, 32 aa, Entamoeba invadens
EKIGVKLNYVRFHWPYFMFKQVSKTRLIWAYK

SEQ ID NO: 3039901 - protein, 18 aa, Entamoeba invadens
EKKLLAKEKKVLKDLNKA

SEQ ID NO: 3039902 - protein, 25 aa, Entamoeba invadens
EKKYNLGQWFKLRADSITTDHFLIV

SEQ ID NO: 3039903 - protein, 19 aa, Entamoeba invadens
EKLDHRTAFLLKNAGMTLL

SEQ ID NO: 3039904 - protein, 17 aa, Entamoeba invadens
EKLKLEDIYLLNSVGDL

SEQ ID NO: 3039905 - protein, 21 aa, Entamoeba invadens
EKLKVLVPQVIRRRNEKQLKL

SEQ ID NO: 3039906 - protein, 19 aa, Entamoeba invadens
EKLLLRALLIVTREDAVLF

SEQ ID NO: 3039907 - protein, 18 aa, Entamoeba invadens
EKLNSGALGHTGKKVLNK

SEQ ID NO: 3039908 - protein, 20 aa, Entamoeba invadens
EKMGCLITKLVSREEDLADV

SEQ ID NO: 3039909 - protein, 27 aa, Entamoeba invadens
EKMKQMLRLYVRRVFVSGDFYKTIPEY

SEQ ID NO: 3039910 - protein, 24 aa, Entamoeba invadens
EKPVGCLFTDGLSCLKCEDKYELS

SEQ ID NO: 3039911 - protein, 20 aa, Entamoeba invadens
EKQFKFDLNIMKEQLSNCVD

SEQ ID NO: 3039912 - protein, 25 aa, Entamoeba invadens
EKRLVMMRRLRGMAEKKVISEKQKG

SEQ ID NO: 3039913 - protein, 19 aa, Entamoeba invadens
EKRRLCAKFELTLRGGHAS

SEQ ID NO: 3039914 - protein, 25 aa, Entamoeba invadens
EKSFLKRNLALIGFSEKRRLCAKFE

SEQ ID NO: 3039915 - protein, 27 aa, Entamoeba invadens
EKSYKSDGFTFEWSLVYIINKKTREIS

SEQ ID NO: 3039916 - protein, 21 aa, Entamoeba invadens
EKTEFKYSEFVDTTFSNSKFE

SEQ ID NO: 3039917 - protein, 21 aa, Entamoeba invadens
EKTFQYLTIMEVFKDEVALDF

SEQ ID NO: 3039918 - protein, 18 aa, Entamoeba invadens
EKTKELNKALGKIDKKKG

SEQ ID NO: 3039919 - protein, 33 aa, Entamoeba invadens
EKTPCKVCVELGRRAKESLAMTLDNNMLLKNVQ

SEQ ID NO: 3039920 - protein, 21 aa, Entamoeba invadens
EKVPPFIVVGTLTIHNDFEEV

SEQ ID NO: 3039921 - protein, 23 aa, Entamoeba invadens
EKYKEVFGRKILRASDDNKLSDF

SEQ ID NO: 3039922 - protein, 30 aa, Entamoeba invadens
EKYKISSDIYFWRHHFVISGKRIQKRESIT

SEQ ID NO: 3039923 - protein, 21 aa, Entamoeba invadens
EKYKKGEIGMFRKNENPLNES

SEQ ID NO: 3039924 - protein, 23 aa, Entamoeba invadens
ELFKTCYQLSSVIGIETVTQVGK

SEQ ID NO: 3039925 - protein, 20 aa, Entamoeba invadens
ELFNITDFIKRRSVQVTDRF

SEQ ID NO: 3039926 - protein, 18 aa, Entamoeba invadens
ELGFKKGDKIGIYCETRY

SEQ ID NO: 3039927 - protein, 20 aa, Entamoeba invadens
ELHKGYGKYILHLSENLAKV

SEQ ID NO: 3039928 - protein, 28 aa, Entamoeba invadens
ELIDYAELRGIIVYPELDMPAHAASWGK

SEQ ID NO: 3039929 - protein, 18 aa, Entamoeba invadens
ELMLKKKIPVGFGSLIHD

SEQ ID NO: 3039930 - protein, 19 aa, Entamoeba invadens
ELMRKCKLYEEVGGTGTCE

SEQ ID NO: 3039931 - protein, 18 aa, Entamoeba invadens
ELNKALGKIDKKKGKSSK

SEQ ID NO: 3039932 - protein, 25 aa, Entamoeba invadens
ELNKPRIILWNSTYIHLNKNITGRP

SEQ ID NO: 3039933 - protein, 25 aa, Entamoeba invadens
ELNNPRIIIWNSTYLQLTFNYSDKP

SEQ ID NO: 3039934 - protein, 26 aa, Entamoeba invadens
ELQLNYVVNCPFSLPNTLTRLSLNIC

SEQ ID NO: 3039935 - protein, 21 aa, Entamoeba invadens
ELQTRLYTEKEITQKLNDENE

SEQ ID NO: 3039936 - protein, 20 aa, Entamoeba invadens
ELRKPLKPTCLLTPKKATKA

SEQ ID NO: 3039937 - protein, 23 aa, Entamoeba invadens
ELSKVYGMEGCSWGESCDDQNWF

SEQ ID NO: 3039938 - protein, 30 aa, Entamoeba invadens
ELTFPIDQSIFYKKVMALLEKAKKFVDEQQ

SEQ ID NO: 3039939 - protein, 26 aa, Entamoeba invadens
ELTNNRYKLYYGFNVTQNGNINIGSY

SEQ ID NO: 3039940 - protein, 32 aa, Entamoeba invadens
ELTQRMPYYYDPLYGYGMGYYGFKHFLPSAYP

SEQ ID NO: 3039941 - protein, 25 aa, Entamoeba invadens
ELVDCGYATIAIEEIINGFEFVFDT

SEQ ID NO: 3039942 - protein, 25 aa, Entamoeba invadens
ELVKHMNCIVCPRGCPIEVKIDTKT

SEQ ID NO: 3039943 - protein, 18 aa, Entamoeba invadens
ELVRCLERDKIFYRGDSL

SEQ ID NO: 3039944 - protein, 23 aa, Entamoeba invadens
EMFRSKMDFDQCVVDLTLKDTCG

SEQ ID NO: 3039945 - protein, 22 aa, Entamoeba invadens
EMLKNIMKVLLFNDDCIEHLLE

SEQ ID NO: 3039946 - protein, 25 aa, Entamoeba invadens
EMVKEGFWLHGFWPQYYTNNRVFLC

SEQ ID NO: 3039947 - protein, 22 aa, Entamoeba invadens
ENCKSENFVSQGILLLTTDCKN

SEQ ID NO: 3039948 - protein, 19 aa, Entamoeba invadens
ENDIGWLIECFGPKAPEDC

SEQ ID NO: 3039949 - protein, 20 aa, Entamoeba invadens
ENDYSIALRIQHGDFVYSTA

SEQ ID NO: 3039950 - protein, 25 aa, Entamoeba invadens
ENDYSICLRVKYGNFVYATCGDLDG

SEQ ID NO: 3039951 - protein, 26 aa, Entamoeba invadens
ENEHCKSEKFVQCFGTGVVTYDGPIL

SEQ ID NO: 3039952 - protein, 19 aa, Entamoeba invadens
ENEKFPGFIEAVGVQSPGL

SEQ ID NO: 3039953 - protein, 25 aa, Entamoeba invadens
ENELKEKKEEIVVCTKDIQEKEKHL

SEQ ID NO: 3039954 - protein, 17 aa, Entamoeba invadens
ENGLCFENAPCIISNKN

SEQ ID NO: 3039955 - protein, 25 aa, Entamoeba invadens
ENHWVLRPYNSIDWHAQVQDWLKLY

SEQ ID NO: 3039956 - protein, 23 aa, Entamoeba invadens
ENIFKNKQLGGAIKDELYNVIVL

SEQ ID NO: 3039957 - protein, 22 aa, Entamoeba invadens
ENIKAAIWCPTTAVVDPYEMTI

SEQ ID NO: 3039958 - protein, 24 aa, Entamoeba invadens
ENKKNEIEAILALTNNQLENNEKA

SEQ ID NO: 3039959 - protein, 17 aa, Entamoeba invadens
ENNIFNIVTKFLVRSVG

SEQ ID NO: 3039960 - protein, 20 aa, Entamoeba invadens
ENPYKCQICADGYTTVNGQC

SEQ ID NO: 3039961 - protein, 23 aa, Entamoeba invadens
ENSRDMVCCIYPISDREIEKRML

SEQ ID NO: 3039962 - protein, 18 aa, Entamoeba invadens
ENVMHIYPTFGMVDGTSN

SEQ ID NO: 3039963 - protein, 26 aa, Entamoeba invadens
EPLFIKFYAPWCGHCRKLKPVFENVS

SEQ ID NO: 3039964 - protein, 23 aa, Entamoeba invadens
EQEGRLGRVLREFNQSDITPLAI

SEQ ID NO: 3039965 - protein, 26 aa, Entamoeba invadens
EQKALLRFSMKLADLKSIQDATEFVF

SEQ ID NO: 3039966 - protein, 22 aa, Entamoeba invadens
EQNKTVLLAAHICPGVSERYNW

SEQ ID NO: 3039967 - protein, 18 aa, Entamoeba invadens
EQRSCSDMNYIRSKIDAG

SEQ ID NO: 3039968 - protein, 24 aa, Entamoeba invadens
EQTGCGGCWSFASIAAVEAQYLIN

SEQ ID NO: 3039969 - protein, 25 aa, Entamoeba invadens
EQTITEFFPVVSFAKQTSQKATLTP

SEQ ID NO: 3039970 - protein, 20 aa, Entamoeba invadens
EQWCSEHFNIPFFETSAKNA

SEQ ID NO: 3039971 - protein, 17 aa, Entamoeba invadens
EQYRLIRRMDLRHRFNL

SEQ ID NO: 3039972 - protein, 19 aa, Entamoeba invadens
ERAFRCINRTKGVMPRSRY

SEQ ID NO: 3039973 - protein, 17 aa, Entamoeba invadens
ERGSRYTEYVGFEKNVR

SEQ ID NO: 3039974 - protein, 18 aa, Entamoeba invadens
ERIFPMRFNQRLLDAAKD

SEQ ID NO: 3039975 - protein, 22 aa, Entamoeba invadens
ERKCLSCASPYFVGNNGANCVQ

SEQ ID NO: 3039976 - protein, 21 aa, Entamoeba invadens
ERKCLSCASPYFVHISGANCD

SEQ ID NO: 3039977 - protein, 26 aa, Entamoeba invadens
ERLVKERLTLLYAREELNDQVMLNKI

SEQ ID NO: 3039978 - protein, 18 aa, Entamoeba invadens
ERLYRYNIFLSNLREIDF

SEQ ID NO: 3039979 - protein, 18 aa, Entamoeba invadens
ERMYLVFKTKFNETNNLY

SEQ ID NO: 3039980 - protein, 18 aa, Entamoeba invadens
ERSLEMFRKGGYYSELIE

SEQ ID NO: 3039981 - protein, 26 aa, Entamoeba invadens
ERVEKGCKVSHMYVWTNRDFYNSDPT

SEQ ID NO: 3039982 - protein, 19 aa, Entamoeba invadens
ESAIKYGLQTLSFINESQV

SEQ ID NO: 3039983 - protein, 23 aa, Entamoeba invadens
ESDEISHLYTLIVKPDNTYVVKI

SEQ ID NO: 3039984 - protein, 34 aa, Entamoeba invadens
ESFFQYNPYRIFRFTAKDLYTFVATLDFSGDDGM

SEQ ID NO: 3039985 - protein, 39 aa, Entamoeba invadens
ESGEYCDFNCFVKALTFTLDFNGSFSFQGYNIPSLTFHD

SEQ ID NO: 3039986 - protein, 20 aa, Entamoeba invadens
ESICKFSPATKVQRVAQLDK

SEQ ID NO: 3039987 - protein, 24 aa, Entamoeba invadens
ESISIKAPTVFGLRNSFETLVQLF

SEQ ID NO: 3039988 - protein, 19 aa, Entamoeba invadens
ESLQFCNTPGFAEEVKYFG

SEQ ID NO: 3039989 - protein, 19 aa, Entamoeba invadens
ESNCVLNITELLKMNYESM

SEQ ID NO: 3039990 - protein, 27 aa, Entamoeba invadens
ESRRCLSCSVASCSRCDTTGKCVECNT

SEQ ID NO: 3039991 - protein, 17 aa, Entamoeba invadens
ESSDGWTSLSVPLQYYG

SEQ ID NO: 3039992 - protein, 23 aa, Entamoeba invadens
ESSLRFAKGGLWTVKALPERARG

SEQ ID NO: 3039993 - protein, 21 aa, Entamoeba invadens
ESTSVMHFYVWDAITDNNGIT

SEQ ID NO: 3039994 - protein, 22 aa, Entamoeba invadens
ESTSVMHFYVWDAITDNNGITL

SEQ ID NO: 3039995 - protein, 23 aa, Entamoeba invadens
ESVKRMSSGTAFKATEATASYTS

SEQ ID NO: 3039996 - protein, 28 aa, Entamoeba invadens
ESVNWSAPRLKVRYGVNPVLYGMRLVAY

SEQ ID NO: 3039997 - protein, 19 aa, Entamoeba invadens
ESWFTLQLKNINAYLMALD

SEQ ID NO: 3039998 - protein, 23 aa, Entamoeba invadens
ESYICNKCTYGVLVKCYNVDGDI

SEQ ID NO: 3039999 - protein, 24 aa, Entamoeba invadens
ETDDAFLVGYYVKYNFYKDNDCTT

SEQ ID NO: 3040000 - protein, 22 aa, Entamoeba invadens
ETDICALKELINVTETIRNMDV

SEQ ID NO: 3040001 - protein, 28 aa, Entamoeba invadens
ETDNLCSCKFLWSDERGVHYNKWDCDIY

SEQ ID NO: 3040002 - protein, 25 aa, Entamoeba invadens
ETDPKKVALRTWLSSIYVALNDKDR

SEQ ID NO: 3040003 - protein, 27 aa, Entamoeba invadens
ETEECFRCYEGAWKRDLVVVLFVLFLL

SEQ ID NO: 3040004 - protein, 27 aa, Entamoeba invadens
ETEKVIRSYGLFSIEIEKHRKLFTPKL

SEQ ID NO: 3040005 - protein, 22 aa, Entamoeba invadens
ETELFLRGLKYSNYHDSEDCTA

SEQ ID NO: 3040006 - protein, 34 aa, Entamoeba invadens
ETEMKRLEDIERHWHDVIDHLNLDATVAVGADIP

SEQ ID NO: 3040007 - protein, 25 aa, Entamoeba invadens
ETESYRFWYQESWKNALNGRPYHIS

SEQ ID NO: 3040008 - protein, 25 aa, Entamoeba invadens
ETETLRIAIFINKKCYKVLQHTLQT

SEQ ID NO: 3040009 - protein, 23 aa, Entamoeba invadens
ETHECTLCKTGFVYNTTTKKCSP

SEQ ID NO: 3040010 - protein, 19 aa, Entamoeba invadens
ETITQIGDFCFSKCISLTH

SEQ ID NO: 3040011 - protein, 24 aa, Entamoeba invadens
ETKEKRKLLKEEKRLEKEKKKASK

SEQ ID NO: 3040012 - protein, 25 aa, Entamoeba invadens
ETMRPNPSCCPIISSIEKGYLDNEE

SEQ ID NO: 3040013 - protein, 26 aa, Entamoeba invadens
ETSTRGGGYFAKGIDIENGWFDCNKE

SEQ ID NO: 3040014 - protein, 24 aa, Entamoeba invadens
ETTPIPFRPNIVIFEKFEMCENYQ

SEQ ID NO: 3040015 - protein, 18 aa, Entamoeba invadens
ETVTFSYTPGVAIRLPDK

SEQ ID NO: 3040016 - protein, 23 aa, Entamoeba invadens
EVAMLDKFRCEYIIHFYGAVFIP

SEQ ID NO: 3040017 - protein, 19 aa, Entamoeba invadens
EVDIFKKFYDDFCCETDED

SEQ ID NO: 3040018 - protein, 17 aa, Entamoeba invadens
EVFSGSVKTIFYHGTTK

SEQ ID NO: 3040019 - protein, 24 aa, Entamoeba invadens
EVGEACPPWGVTTMFMTWAEMIYD

SEQ ID NO: 3040020 - protein, 18 aa, Entamoeba invadens
EVGEVAVRKAMRLEEYIV

SEQ ID NO: 3040021 - protein, 24 aa, Entamoeba invadens
EVIKEVKRELSVDVSKAGIEKSLK

SEQ ID NO: 3040022 - protein, 28 aa, Entamoeba invadens
EVIKRFKAEKARVVVLVMNKIDLEVVVD

SEQ ID NO: 3040023 - protein, 26 aa, Entamoeba invadens
EVLKTKILRKDVLVAFYGPSLPDKIV

SEQ ID NO: 3040024 - protein, 22 aa, Entamoeba invadens
EVLKYITRQEVRGTYKGTPVKK

SEQ ID NO: 3040025 - protein, 23 aa, Entamoeba invadens
EVLPNRTPMLWYMNETISDTTRL

SEQ ID NO: 3040026 - protein, 18 aa, Entamoeba invadens
EVNGCGRYQRAIIARHEM

SEQ ID NO: 3040027 - protein, 24 aa, Entamoeba invadens
EVNGVLCSLALVKLITIKINSYKI

SEQ ID NO: 3040028 - protein, 23 aa, Entamoeba invadens
EVPKSVPESVDWRAQGKVPAVRD

SEQ ID NO: 3040029 - protein, 17 aa, Entamoeba invadens
EVSTIIFTRTGDSTTSV

SEQ ID NO: 3040030 - protein, 19 aa, Entamoeba invadens
EVYFPSTLTHIGREVFSGC

SEQ ID NO: 3040031 - protein, 25 aa, Entamoeba invadens
EWKGQDMAWWMNVVVFPLFDRLDDD

SEQ ID NO: 3040032 - protein, 22 aa, Entamoeba invadens
EYDKHGVCLTNIYKGVEGPKQY

SEQ ID NO: 3040033 - protein, 17 aa, Entamoeba invadens
EYERTRDAFSLFVRTGR

SEQ ID NO: 3040034 - protein, 17 aa, Entamoeba invadens
EYFFREVSSGSNDCNII

SEQ ID NO: 3040035 - protein, 25 aa, Entamoeba invadens
EYGRSRGVIVYPEIDIPAHAASWNL

SEQ ID NO: 3040036 - protein, 29 aa, Entamoeba invadens
EYHDYYTLNVGRAFVLSSLDFHFRHNLVM

SEQ ID NO: 3040037 - protein, 20 aa, Entamoeba invadens
EYHTLMVFKFNSTKQIEKYS

SEQ ID NO: 3040038 - protein, 33 aa, Entamoeba invadens
EYLNTIKVWYFKSLKVLKTLVLYVDSFYSYTND

SEQ ID NO: 3040039 - protein, 20 aa, Entamoeba invadens
EYLWENTLFFSKELSVYQSG

SEQ ID NO: 3040040 - protein, 22 aa, Entamoeba invadens
EYMNVYLLDKCYYTGGNTYTKY

SEQ ID NO: 3040041 - protein, 20 aa, Entamoeba invadens
EYNNLCLTPAQYVTFNISND

SEQ ID NO: 3040042 - protein, 32 aa, Entamoeba invadens
EYTNCLSFTKDKCLRCNDGFVFEGNNCVNITE

SEQ ID NO: 3040043 - protein, 18 aa, Entamoeba invadens
FADSICKNGFKVGDNNAY

SEQ ID NO: 3040044 - protein, 22 aa, Entamoeba invadens
FAFSNCLLCPDGTYTFQNKTTQ

SEQ ID NO: 3040045 - protein, 22 aa, Entamoeba invadens
FAITMFEVFSWEEAFKKDDERF

SEQ ID NO: 3040046 - protein, 24 aa, Entamoeba invadens
FAIVRFWPGEVCRTKVCAIPKKTP

SEQ ID NO: 3040047 - protein, 28 aa, Entamoeba invadens
FAIVRFWPGEVCRTKWCAIPKKTPSVRE

SEQ ID NO: 3040048 - protein, 17 aa, Entamoeba invadens
FAKENKARFELSKFSLE

SEQ ID NO: 3040049 - protein, 23 aa, Entamoeba invadens
FAKNTRALLQWFSFFQQDTENSP

SEQ ID NO: 3040050 - protein, 20 aa, Entamoeba invadens
FALDKKIVLLRRLRGMVEKK

SEQ ID NO: 3040051 - protein, 18 aa, Entamoeba invadens
FALISALLVNEKVSFGQL

SEQ ID NO: 3040052 - protein, 17 aa, Entamoeba invadens
FANAIVLNYEANIGDTL

SEQ ID NO: 3040053 - protein, 20 aa, Entamoeba invadens
FAPGYDWRYANRQRDDWIAK

SEQ ID NO: 3040054 - protein, 25 aa, Entamoeba invadens
FAPLRLEVFKEPLLPSERVAQPTQN

SEQ ID NO: 3040055 - protein, 25 aa, Entamoeba invadens
FAPYKMFISFVYPKRVHDIRAGANV

SEQ ID NO: 3040056 - protein, 28 aa, Entamoeba invadens
FAPYKMYISFPIPRRVHDIRGTADPGNT

SEQ ID NO: 3040057 - protein, 19 aa, Entamoeba invadens
FAQSVLLGLISLRIQQNAV

SEQ ID NO: 3040058 - protein, 18 aa, Entamoeba invadens
FASHALRTMLNAKRCIYP

SEQ ID NO: 3040059 - protein, 18 aa, Entamoeba invadens
FASKISGIHWWFMHASRA

SEQ ID NO: 3040060 - protein, 25 aa, Entamoeba invadens
FASYKMFTVYVLPRRVHDIRRGSHE

SEQ ID NO: 3040061 - protein, 25 aa, Entamoeba invadens
FASYKMFTVYVLPRRVHDIRRGSYE

SEQ ID NO: 3040062 - protein, 19 aa, Entamoeba invadens
FATNFKPKRSIYFMSGADE

SEQ ID NO: 3040063 - protein, 29 aa, Entamoeba invadens
FCETRYEWMALLLAACRQGIIAVTVYATL

SEQ ID NO: 3040064 - protein, 26 aa, Entamoeba invadens
FCHNSKFCFFIYLIIGIKCQQNKENQ

SEQ ID NO: 3040065 - protein, 19 aa, Entamoeba invadens
FCIEHGYFFNSIYSKKSQK

SEQ ID NO: 3040066 - protein, 17 aa, Entamoeba invadens
FCIIQALSQPVANNLET

SEQ ID NO: 3040067 - protein, 23 aa, Entamoeba invadens
FCLMCLKGTYCPDGIYMYRCPKV

SEQ ID NO: 3040068 - protein, 24 aa, Entamoeba invadens
FCNTCGDSGCTACNAEYLVPDGVK

SEQ ID NO: 3040069 - protein, 18 aa, Entamoeba invadens
FCSFKADNYKGSTCEKAL

SEQ ID NO: 3040070 - protein, 20 aa, Entamoeba invadens
FCWGCNPGYYVVDASYCEKC

SEQ ID NO: 3040071 - protein, 26 aa, Entamoeba invadens
FDANAWKLKKEALFICEQMPGLMKSL

SEQ ID NO: 3040072 - protein, 19 aa, Entamoeba invadens
FDCNKEWLGRDNVTVLNYS

SEQ ID NO: 3040073 - protein, 25 aa, Entamoeba invadens
FDDRGFKTAETYVFPIEQTNMKLFS

SEQ ID NO: 3040074 - protein, 20 aa, Entamoeba invadens
FDELRLCSQIPYFNEVKEPN

SEQ ID NO: 3040075 - protein, 23 aa, Entamoeba invadens
FDEMQRKALRKWGAGGNSDSEDL

SEQ ID NO: 3040076 - protein, 19 aa, Entamoeba invadens
FDGDMLWAHDPNYREGKSV

SEQ ID NO: 3040077 - protein, 19 aa, Entamoeba invadens
FDGLDPFRWEDGYIEGSSF

SEQ ID NO: 3040078 - protein, 23 aa, Entamoeba invadens
FDIKSPCYVNEHFLDVNKGDNRV

SEQ ID NO: 3040079 - protein, 17 aa, Entamoeba invadens
FDIPKIQQFFEIGTLPI

SEQ ID NO: 3040080 - protein, 19 aa, Entamoeba invadens
FDNCYEYYCGTCSGDKACH

SEQ ID NO: 3040081 - protein, 17 aa, Entamoeba invadens
FDNEFLCLESLSVTNAV

SEQ ID NO: 3040082 - protein, 19 aa, Entamoeba invadens
FDNKFEFSLEEEDDVYHKA

SEQ ID NO: 3040083 - protein, 25 aa, Entamoeba invadens
FDQRISQYLVEICKRKYKADPTTSA

SEQ ID NO: 3040084 - protein, 18 aa, Entamoeba invadens
FDRKCVMCNNGYYPDEIG

SEQ ID NO: 3040085 - protein, 18 aa, Entamoeba invadens
FDRKCVMCNNGYYPNENG

SEQ ID NO: 3040086 - protein, 28 aa, Entamoeba invadens
FDSETTLIVSFPFPIVLSNYYSSLLSVF

SEQ ID NO: 3040087 - protein, 19 aa, Entamoeba invadens
FDSLNNWRDEFLVQAQPKN

SEQ ID NO: 3040088 - protein, 28 aa, Entamoeba invadens
FDSPFVVDGTNILKCALFAEVHFINKQF

SEQ ID NO: 3040089 - protein, 24 aa, Entamoeba invadens
FDTTYFKLFFCPLHTTEIHVVTGE

SEQ ID NO: 3040090 - protein, 17 aa, Entamoeba invadens
FDVLCLTCSSSFERKCA

SEQ ID NO: 3040091 - protein, 17 aa, Entamoeba invadens
FDVVKRAAFFTRNGKIV

SEQ ID NO: 3040092 - protein, 23 aa, Entamoeba invadens
FDWLKMSYGQIKWHDEEEEHTFI

SEQ ID NO: 3040093 - protein, 25 aa, Entamoeba invadens
FECNGNCKANCLCAVRYPKQNDFAN

SEQ ID NO: 3040094 - protein, 18 aa, Entamoeba invadens
FECSNYFRGLRPCAPGTQ

SEQ ID NO: 3040095 - protein, 22 aa, Entamoeba invadens
FEETPFLKNAMIKRSSEQYNKL

SEQ ID NO: 3040096 - protein, 27 aa, Entamoeba invadens
FEEVSRLGVKFLSSPIFKNEVPYQDPN

SEQ ID NO: 3040097 - protein, 18 aa, Entamoeba invadens
FEEYFGVKNINSINDYLD

SEQ ID NO: 3040098 - protein, 22 aa, Entamoeba invadens
FEGCSKLSSIHLYEGLSTLGEE

SEQ ID NO: 3040099 - protein, 17 aa, Entamoeba invadens
FEILWTFMDYVASQIVD

SEQ ID NO: 3040100 - protein, 17 aa, Entamoeba invadens
FEKCLKLNTVDFGGNIE

SEQ ID NO: 3040101 - protein, 18 aa, Entamoeba invadens
FEKEVAMLDKFRCEYIIH

SEQ ID NO: 3040102 - protein, 18 aa, Entamoeba invadens
FEKYNWTIPFGVDTYCAY

SEQ ID NO: 3040103 - protein, 30 aa, Entamoeba invadens
FENPMSLNIFIDVLKFLHKMSLEECEKVVL

SEQ ID NO: 3040104 - protein, 17 aa, Entamoeba invadens
FEPWLSERSLEMFRKGG

SEQ ID NO: 3040105 - protein, 25 aa, Entamoeba invadens
FERKCAKCLTGSYLSNGPKCTLCDT

SEQ ID NO: 3040106 - protein, 20 aa, Entamoeba invadens
FERNSEGILTFGKREKSLVE

SEQ ID NO: 3040107 - protein, 18 aa, Entamoeba invadens
FETGDIVFTLCVLKHDRF

SEQ ID NO: 3040108 - protein, 26 aa, Entamoeba invadens
FEVLKSRLRGSVAWGSYENTVNKTGW

SEQ ID NO: 3040109 - protein, 24 aa, Entamoeba invadens
FEYSKCYRYDGWYIKYEKSANGIK

SEQ ID NO: 3040110 - protein, 18 aa, Entamoeba invadens
FFATCTVFLEIIQKIQNQ

SEQ ID NO: 3040111 - protein, 25 aa, Entamoeba invadens
FFDRIRQANTFMLLLLDPDWYNSEC

SEQ ID NO: 3040112 - protein, 20 aa, Entamoeba invadens
FFEQYYCKIQPTVNAALSKF

SEQ ID NO: 3040113 - protein, 22 aa, Entamoeba invadens
FFGSGGQFLLLIEEWNTVVVHM

SEQ ID NO: 3040114 - protein, 18 aa, Entamoeba invadens
FFHTHFKEEMFVAQREID

SEQ ID NO: 3040115 - protein, 18 aa, Entamoeba invadens
FFKGGYFGNCSNESYYNW

SEQ ID NO: 3040116 - protein, 28 aa, Entamoeba invadens
FFLCVTLGIRWCFEYENVVFCTNNNERC

SEQ ID NO: 3040117 - protein, 17 aa, Entamoeba invadens
FFLIPRRVIHFEMCGGS

SEQ ID NO: 3040118 - protein, 18 aa, Entamoeba invadens
FFLPRTANSFGLGYSNSL

SEQ ID NO: 3040119 - protein, 17 aa, Entamoeba invadens
FFLSSVVSFEMWHLTDV

SEQ ID NO: 3040120 - protein, 18 aa, Entamoeba invadens
FFNFGDGFNFGGDSNQGF

SEQ ID NO: 3040121 - protein, 18 aa, Entamoeba invadens
FFQKALDIQKEFKRQFNE

SEQ ID NO: 3040122 - protein, 25 aa, Entamoeba invadens
FFSPYCPHCRNFAPAYKEFSVKTTE

SEQ ID NO: 3040123 - protein, 17 aa, Entamoeba invadens
FFTELFYDKDLISAYVD

SEQ ID NO: 3040124 - protein, 19 aa, Entamoeba invadens
FFTTCLSLKWCGNGGQVEC

SEQ ID NO: 3040125 - protein, 24 aa, Entamoeba invadens
FFVFAIDLPMCVDVKTIKVQLDKS

SEQ ID NO: 3040126 - protein, 19 aa, Entamoeba invadens
FGADSLAVFGGRTPLQIYK

SEQ ID NO: 3040127 - protein, 19 aa, Entamoeba invadens
FGAFGGWSSPYMKQYRGDV

SEQ ID NO: 3040128 - protein, 25 aa, Entamoeba invadens
FGDFGGFGGWSWPTMKQYRGDVSIC

SEQ ID NO: 3040129 - protein, 18 aa, Entamoeba invadens
FGESLTAVNSRAFLGTSI

SEQ ID NO: 3040130 - protein, 26 aa, Entamoeba invadens
FGIAGSGYSAYWLIPLENPIMGKYVV

SEQ ID NO: 3040131 - protein, 21 aa, Entamoeba invadens
FGKEALLGKSGRIEMLKEFPA

SEQ ID NO: 3040132 - protein, 21 aa, Entamoeba invadens
FGLNAQRLFPTKKHLRIITKA

SEQ ID NO: 3040133 - protein, 18 aa, Entamoeba invadens
FGLSMKISFMPSLPSDES

SEQ ID NO: 3040134 - protein, 23 aa, Entamoeba invadens
FGNLRVHRGFEDFLPLNKAMFSM

SEQ ID NO: 3040135 - protein, 17 aa, Entamoeba invadens
FGNSALCGVGITHINFN

SEQ ID NO: 3040136 - protein, 18 aa, Entamoeba invadens
FGPYSFKLHAEWLEQFYS

SEQ ID NO: 3040137 - protein, 25 aa, Entamoeba invadens
FGSKDKKVSFGLSRGADGKIKANGG

SEQ ID NO: 3040138 - protein, 19 aa, Entamoeba invadens
FGTALAVACAFRAQKKKKD

SEQ ID NO: 3040139 - protein, 21 aa, Entamoeba invadens
FGTIHMYLRIKKMTPIQRLEL

SEQ ID NO: 3040140 - protein, 26 aa, Entamoeba invadens
FGVSPLSAISLMRFVPKEQRVKADSR

SEQ ID NO: 3040141 - protein, 19 aa, Entamoeba invadens
FGVSYWGWSPVAYYSEITV

SEQ ID NO: 3040142 - protein, 21 aa, Entamoeba invadens
FGYSGDQWFSFDDKDTFEHKV

SEQ ID NO: 3040143 - protein, 17 aa, Entamoeba invadens
FHCYMKLFLNMTLNLSQ

SEQ ID NO: 3040144 - protein, 25 aa, Entamoeba invadens
FHFSARTPQKCRFLVDDVVYQEHTR

SEQ ID NO: 3040145 - protein, 21 aa, Entamoeba invadens
FHFYRLKKVLFDFSNAKFLFY

SEQ ID NO: 3040146 - protein, 19 aa, Entamoeba invadens
FHRVIPGFMIQGGDFTNFD

SEQ ID NO: 3040147 - protein, 22 aa, Entamoeba invadens
FIADPFLDRGVAYVVRKVDGTT

SEQ ID NO: 3040148 - protein, 21 aa, Entamoeba invadens
FIAYILVQHGFAFNITLTTIK

SEQ ID NO: 3040149 - protein, 24 aa, Entamoeba invadens
FICDVCSKAMVFTVWENQSKYGKA

SEQ ID NO: 3040150 - protein, 21 aa, Entamoeba invadens
FIDHHWHGISLFSDIDQYFYI

SEQ ID NO: 3040151 - protein, 23 aa, Entamoeba invadens
FIECEFDCNIAFCDKKRYVGKTQ

SEQ ID NO: 3040152 - protein, 23 aa, Entamoeba invadens
FIEKETLRGLSIKRVEENVKIHT

SEQ ID NO: 3040153 - protein, 18 aa, Entamoeba invadens
FIFFVLSSYPFQRSNIEE

SEQ ID NO: 3040154 - protein, 22 aa, Entamoeba invadens
FIGNQVFRFYRRIIRDYLTRNN

SEQ ID NO: 3040155 - protein, 19 aa, Entamoeba invadens
FIGNSCFAYCSSLCEINLP

SEQ ID NO: 3040156 - protein, 26 aa, Entamoeba invadens
FIKTNYFGKFLFDFQNNVNFLKDSGK

SEQ ID NO: 3040157 - protein, 22 aa, Entamoeba invadens
FILGFATCWKDGEKPYLTFVDQ

SEQ ID NO: 3040158 - protein, 17 aa, Entamoeba invadens
FILSTGFYSGIQQYGGV

SEQ ID NO: 3040159 - protein, 28 aa, Entamoeba invadens
FIRKARAYRGKVGFVYTPEIEEVEYLRQ

SEQ ID NO: 3040160 - protein, 18 aa, Entamoeba invadens
FISGRYPFIYNHPMFKSF

SEQ ID NO: 3040161 - protein, 28 aa, Entamoeba invadens
FIVPETILDWLRIVVAVRHSDNGDDFFE

SEQ ID NO: 3040162 - protein, 23 aa, Entamoeba invadens
FIYLEKISHLFVSSLHNLMNRMK

SEQ ID NO: 3040163 - protein, 20 aa, Entamoeba invadens
FKAACSGSLTKKRMSFVIKK

SEQ ID NO: 3040164 - protein, 22 aa, Entamoeba invadens
FKASEIPHRFDIINNKAVSCKF

SEQ ID NO: 3040165 - protein, 25 aa, Entamoeba invadens
FKCVSETFINFNMCLNCGDNCVSCK

SEQ ID NO: 3040166 - protein, 25 aa, Entamoeba invadens
FKDRENWFSPNLWKLVNELKDLESE

SEQ ID NO: 3040167 - protein, 17 aa, Entamoeba invadens
FKDVFIFADAFKTFSND

SEQ ID NO: 3040168 - protein, 17 aa, Entamoeba invadens
FKHKKIIKRIVELDPLE

SEQ ID NO: 3040169 - protein, 22 aa, Entamoeba invadens
FKKGEQYRVLFGMHDYGDIKNW

SEQ ID NO: 3040170 - protein, 17 aa, Entamoeba invadens
FKKLGELVNAFESKIYK

SEQ ID NO: 3040171 - protein, 20 aa, Entamoeba invadens
FKKSKTVIGFGLLNKPIGVW

SEQ ID NO: 3040172 - protein, 17 aa, Entamoeba invadens
FKLKVSLHIPQVSRKNY

SEQ ID NO: 3040173 - protein, 19 aa, Entamoeba invadens
FKNITIVKGKPFSFQVHVN

SEQ ID NO: 3040174 - protein, 22 aa, Entamoeba invadens
FKNPNVWFTIKDRAVRCLKVAQ

SEQ ID NO: 3040175 - protein, 17 aa, Entamoeba invadens
FKPKRSIYFMSGADEEV

SEQ ID NO: 3040176 - protein, 22 aa, Entamoeba invadens
FKRYMLFIIQSMFTFVERTSES

SEQ ID NO: 3040177 - protein, 19 aa, Entamoeba invadens
FKSLEVLDSNVIIKASSVL

SEQ ID NO: 3040178 - protein, 17 aa, Entamoeba invadens
FKTPFTLGTNSEIGSGS

SEQ ID NO: 3040179 - protein, 25 aa, Entamoeba invadens
FKVTSLRLSAKVSLCQYLNNFPNLR

SEQ ID NO: 3040180 - protein, 17 aa, Entamoeba invadens
FKYGKDFTYEHEITTYL

SEQ ID NO: 3040181 - protein, 19 aa, Entamoeba invadens
FKYLLIKHGPLIGLIHTTD

SEQ ID NO: 3040182 - protein, 18 aa, Entamoeba invadens
FLAVFLLERGFTLVTSTK

SEQ ID NO: 3040183 - protein, 18 aa, Entamoeba invadens
FLAWANLISIKFNLHNIE

SEQ ID NO: 3040184 - protein, 18 aa, Entamoeba invadens
FLCLFFVSPVSSHDVESF

SEQ ID NO: 3040185 - protein, 17 aa, Entamoeba invadens
FLFVSTLMSSFSKMVAE

SEQ ID NO: 3040186 - protein, 17 aa, Entamoeba invadens
FLHKMSLEECEKVVLTC

SEQ ID NO: 3040187 - protein, 17 aa, Entamoeba invadens
FLKANNKFGDFIETLGK

SEQ ID NO: 3040188 - protein, 25 aa, Entamoeba invadens
FLNEKARTWWAGLYGYDKYQKTTNI

SEQ ID NO: 3040189 - protein, 23 aa, Entamoeba invadens
FLQNFPFPFLSLFEDILNKKETK

SEQ ID NO: 3040190 - protein, 33 aa, Entamoeba invadens
FLQNRARRKGIKFPIEFADKVLRIKNEEMENHK

SEQ ID NO: 3040191 - protein, 21 aa, Entamoeba invadens
FLRIFCPAIASPENFGLLGVE

SEQ ID NO: 3040192 - protein, 20 aa, Entamoeba invadens
FLTFGVSFSQPVEVASAANG

SEQ ID NO: 3040193 - protein, 17 aa, Entamoeba invadens
FLTLLGLNMKIVGTYGY

SEQ ID NO: 3040194 - protein, 18 aa, Entamoeba invadens
FLTWDVEYYWGTLYISSY

SEQ ID NO: 3040195 - protein, 24 aa, Entamoeba invadens
FLVGKISCIHWWWMDDSHAGEMTA

SEQ ID NO: 3040196 - protein, 17 aa, Entamoeba invadens
FMDTLFYLYRDLKYATL

SEQ ID NO: 3040197 - protein, 18 aa, Entamoeba invadens
FMEALSLNWASLSKCKFF

SEQ ID NO: 3040198 - protein, 20 aa, Entamoeba invadens
FMGKAGWLAVKVYPPQDAVL

SEQ ID NO: 3040199 - protein, 20 aa, Entamoeba invadens
FMGKAGWLGVKVYPPQDGVL

SEQ ID NO: 3040200 - protein, 22 aa, Entamoeba invadens
FMGTWEHYHCFAPSSLEDPGFG

SEQ ID NO: 3040201 - protein, 20 aa, Entamoeba invadens
FNAMLPLDIISTSGFTNKKQ

SEQ ID NO: 3040202 - protein, 17 aa, Entamoeba invadens
FNASGVFELVSFDNEKI

SEQ ID NO: 3040203 - protein, 19 aa, Entamoeba invadens
FNCHICPVGTYANSANNKC

SEQ ID NO: 3040204 - protein, 19 aa, Entamoeba invadens
FNEEFSMDLPVVVTHMTSS

SEQ ID NO: 3040205 - protein, 19 aa, Entamoeba invadens
FNFPDCRYNSTAFDLDLSM

SEQ ID NO: 3040206 - protein, 24 aa, Entamoeba invadens
FNGSQCSFGVFVNSSFSCLGPLTI

SEQ ID NO: 3040207 - protein, 23 aa, Entamoeba invadens
FNISNDFFLALFVDYLNTIQISM

SEQ ID NO: 3040208 - protein, 18 aa, Entamoeba invadens
FNIVTKFLVRSVGASALP

SEQ ID NO: 3040209 - protein, 20 aa, Entamoeba invadens
FNKICASLKLGDNADLNTLI

SEQ ID NO: 3040210 - protein, 26 aa, Entamoeba invadens
FNLDWRVPTKLNFCKYDRLLQDIDKT

SEQ ID NO: 3040211 - protein, 28 aa, Entamoeba invadens
FNLLCSGRCPESILSLVIHVDSIGENGY

SEQ ID NO: 3040212 - protein, 26 aa, Entamoeba invadens
FNPKMIKCPPYMFRKEERKCAKEVMF

SEQ ID NO: 3040213 - protein, 18 aa, Entamoeba invadens
FNPSAKFSLGNTLDGTVT

SEQ ID NO: 3040214 - protein, 17 aa, Entamoeba invadens
FNQPACKKYHRLCKKVY

SEQ ID NO: 3040215 - protein, 27 aa, Entamoeba invadens
FNTYGFFKVAYGNTVFALKDIKVKENG

SEQ ID NO: 3040216 - protein, 24 aa, Entamoeba invadens
FNVPKFDFQIEGVRSISCDTHKYG

SEQ ID NO: 3040217 - protein, 22 aa, Entamoeba invadens
FNVTLRLALASGNRYDVTIEKF

SEQ ID NO: 3040218 - protein, 18 aa, Entamoeba invadens
FNYLSGVCEVGIEHCLDA

SEQ ID NO: 3040219 - protein, 24 aa, Entamoeba invadens
FPEDFKSKIIRELKLDVRFNQVDS

SEQ ID NO: 3040220 - protein, 27 aa, Entamoeba invadens
FPENERPTCYSTAFKVAKYAANLFDPE

SEQ ID NO: 3040221 - protein, 17 aa, Entamoeba invadens
FPFHLLDPKTAPRNNCE

SEQ ID NO: 3040222 - protein, 17 aa, Entamoeba invadens
FPIRLSSYYDDIFYWCT

SEQ ID NO: 3040223 - protein, 18 aa, Entamoeba invadens
FPIVIVGNKCDLEEMREV

SEQ ID NO: 3040224 - protein, 32 aa, Entamoeba invadens
FPKSLKRIGELAFYRCVKLKEVIIPSNVTQIG

SEQ ID NO: 3040225 - protein, 19 aa, Entamoeba invadens
FPMRFNQRLLDAAKDEKTV

SEQ ID NO: 3040226 - protein, 28 aa, Entamoeba invadens
FPNIPVITYWPHFPLKEGAIPCEWGNEY

SEQ ID NO: 3040227 - protein, 30 aa, Entamoeba invadens
FPNIPVITYWPHLLIKEGAYPCEWGNEYYS

SEQ ID NO: 3040228 - protein, 20 aa, Entamoeba invadens
FPNLRKLIIENAEYLNTIKV

SEQ ID NO: 3040229 - protein, 25 aa, Entamoeba invadens
FPQRKVADIIIPWGEISNNALEVDN

SEQ ID NO: 3040230 - protein, 20 aa, Entamoeba invadens
FPRGCLKHKDKYVKFTTILN

SEQ ID NO: 3040231 - protein, 23 aa, Entamoeba invadens
FPRKNRELSIIGGLILLPMQRLP

SEQ ID NO: 3040232 - protein, 17 aa, Entamoeba invadens
FPSAGVCTRCDLHCDAL

SEQ ID NO: 3040233 - protein, 18 aa, Entamoeba invadens
FPSGYSILIDAGETSSGS

SEQ ID NO: 3040234 - protein, 17 aa, Entamoeba invadens
FPSTILSIGSNAFSETG

SEQ ID NO: 3040235 - protein, 20 aa, Entamoeba invadens
FQCEKCLSGYFLDVATDECF

SEQ ID NO: 3040236 - protein, 18 aa, Entamoeba invadens
FQHFRLPKMHPYLFRIVL

SEQ ID NO: 3040237 - protein, 18 aa, Entamoeba invadens
FQLYYAATCSDKASDWII

SEQ ID NO: 3040238 - protein, 22 aa, Entamoeba invadens
FQTFEMEWNYFFDFKINHNKNH

SEQ ID NO: 3040239 - protein, 24 aa, Entamoeba invadens
FQTFEMEWNYFFDFKINHNKNHES

SEQ ID NO: 3040240 - protein, 28 aa, Entamoeba invadens
FQVNWIEKWPIRIWCQFNQQIRTDNLSE

SEQ ID NO: 3040241 - protein, 20 aa, Entamoeba invadens
FREFPKYLLDPITAPRNNCE

SEQ ID NO: 3040242 - protein, 20 aa, Entamoeba invadens
FRETCCSIQTMILRDNETDE

SEQ ID NO: 3040243 - protein, 21 aa, Entamoeba invadens
FRKEFEAQFVYIKKGGNGDCG

SEQ ID NO: 3040244 - protein, 22 aa, Entamoeba invadens
FRKVQCPIVERLVCCLMQHGRN

SEQ ID NO: 3040245 - protein, 21 aa, Entamoeba invadens
FRKYKLPAFNTLKEEKMWYSS

SEQ ID NO: 3040246 - protein, 26 aa, Entamoeba invadens
FRLMEFSDKSVVGWKQYVLDIEKCNV

SEQ ID NO: 3040247 - protein, 17 aa, Entamoeba invadens
FRNFVWMFEFLIEKLEV

SEQ ID NO: 3040248 - protein, 17 aa, Entamoeba invadens
FRSEYIVHFYGAVFIIS

SEQ ID NO: 3040249 - protein, 20 aa, Entamoeba invadens
FRSGSDFYLVCRDFESYVAI

SEQ ID NO: 3040250 - protein, 17 aa, Entamoeba invadens
FRSKSRAFANSFAFLHS

SEQ ID NO: 3040251 - protein, 26 aa, Entamoeba invadens
FSAIRIKCKMARHFEEISIYFDRFIN

SEQ ID NO: 3040252 - protein, 27 aa, Entamoeba invadens
FSCKLDKLKTLFVFKGYQITFKEKLDN

SEQ ID NO: 3040253 - protein, 19 aa, Entamoeba invadens
FSECTKLSSVILPDNLLYI

SEQ ID NO: 3040254 - protein, 23 aa, Entamoeba invadens
FSENAWGIAKPHYIDFSSEDPLF

SEQ ID NO: 3040255 - protein, 17 aa, Entamoeba invadens
FSGNEFTQIPTIQWEFS

SEQ ID NO: 3040256 - protein, 18 aa, Entamoeba invadens
FSGNEFTQIPTLQWDDDY

SEQ ID NO: 3040257 - protein, 17 aa, Entamoeba invadens
FSGSVKTIFYHGTTKPK

SEQ ID NO: 3040258 - protein, 18 aa, Entamoeba invadens
FSIFSLFSDFSMAFHSSL

SEQ ID NO: 3040259 - protein, 21 aa, Entamoeba invadens
FSIIFKPNRKYILNGLENNEN

SEQ ID NO: 3040260 - protein, 23 aa, Entamoeba invadens
FSIIFKPNRKYILNGLETHENTI

SEQ ID NO: 3040261 - protein, 25 aa, Entamoeba invadens
FSKISEYLGAYVFYDIIKSPPQPSG

SEQ ID NO: 3040262 - protein, 20 aa, Entamoeba invadens
FSKKGDRVVNMFDQRKQGIV

SEQ ID NO: 3040263 - protein, 21 aa, Entamoeba invadens
FSKKILKSRMSKLKMGTDERR

SEQ ID NO: 3040264 - protein, 17 aa, Entamoeba invadens
FSKNIHKFVKYREKEKT

SEQ ID NO: 3040265 - protein, 22 aa, Entamoeba invadens
FSKSLEETGYFGSYNLPAIQET

SEQ ID NO: 3040266 - protein, 21 aa, Entamoeba invadens
FSKVMNYFWPSYFTVSTPPPL

SEQ ID NO: 3040267 - protein, 23 aa, Entamoeba invadens
FSKYKYPEMELLSSKRIEDKYFS

SEQ ID NO: 3040268 - protein, 19 aa, Entamoeba invadens
FSLNNFDVSPLRIIYDETN

SEQ ID NO: 3040269 - protein, 18 aa, Entamoeba invadens
FSMDLPVVVTHMTSSCGV

SEQ ID NO: 3040270 - protein, 20 aa, Entamoeba invadens
FSNFLSFVLVQRGYSLCLNL

SEQ ID NO: 3040271 - protein, 24 aa, Entamoeba invadens
FSNIDQRWWLSFHRDSTMLYSPYL

SEQ ID NO: 3040272 - protein, 22 aa, Entamoeba invadens
FSPEEISSMILHKMAKIAAQYL

SEQ ID NO: 3040273 - protein, 18 aa, Entamoeba invadens
FSPSKCTFFSNTRSYCFN

SEQ ID NO: 3040274 - protein, 28 aa, Entamoeba invadens
FSQCTKQLCTPHQAFGEMRKAKITKVDA

SEQ ID NO: 3040275 - protein, 23 aa, Entamoeba invadens
FSQFKCQLEVNFVLEIIDVKLML

SEQ ID NO: 3040276 - protein, 20 aa, Entamoeba invadens
FSWQLWRFNPDLKTWKVSLD

SEQ ID NO: 3040277 - protein, 17 aa, Entamoeba invadens
FSYFTYKEVEATKKYVK

SEQ ID NO: 3040278 - protein, 22 aa, Entamoeba invadens
FSYSELKQLVGFESVTSIAENA

SEQ ID NO: 3040279 - protein, 23 aa, Entamoeba invadens
FTAETKSGCPNKDKKMTGVYNND

SEQ ID NO: 3040280 - protein, 19 aa, Entamoeba invadens
FTAMGCSDIKNFAFQNNNL

SEQ ID NO: 3040281 - protein, 18 aa, Entamoeba invadens
FTGKRLARERTETKIQFW

SEQ ID NO: 3040282 - protein, 24 aa, Entamoeba invadens
FTIAFRPNPAFGLHNFDDVIVTWC

SEQ ID NO: 3040283 - protein, 17 aa, Entamoeba invadens
FTLIASADYIKLYDDGD

SEQ ID NO: 3040284 - protein, 26 aa, Entamoeba invadens
FTLLSWQRVLVAMYFQKTCKKVVETI

SEQ ID NO: 3040285 - protein, 17 aa, Entamoeba invadens
FTLMDLFTLPKQLRNVD

SEQ ID NO: 3040286 - protein, 17 aa, Entamoeba invadens
FTPSRVTVLLKFLQEVM

SEQ ID NO: 3040287 - protein, 19 aa, Entamoeba invadens
FTQCLTCSDGFFVDNGNCM

SEQ ID NO: 3040288 - protein, 18 aa, Entamoeba invadens
FTQIPTLQWDDDYTHKDL

SEQ ID NO: 3040289 - protein, 18 aa, Entamoeba invadens
FTSSRIVFSSVLLVASNM

SEQ ID NO: 3040290 - protein, 20 aa, Entamoeba invadens
FTTAEILRRRAIFVDNLNYV

SEQ ID NO: 3040291 - protein, 17 aa, Entamoeba invadens
FTTPCSVKFDTSTNTFS

SEQ ID NO: 3040292 - protein, 30 aa, Entamoeba invadens
FTTSCGAGDFWVVWGERAFKRCMQIDKKKE

SEQ ID NO: 3040293 - protein, 23 aa, Entamoeba invadens
FTYDRSNEILLWDNTQTGKTFEK

SEQ ID NO: 3040294 - protein, 21 aa, Entamoeba invadens
FVAFGGWSKPTMKTYEKNVWY

SEQ ID NO: 3040295 - protein, 22 aa, Entamoeba invadens
FVCKEDGLFCVIDGIHNNQYYE

SEQ ID NO: 3040296 - protein, 22 aa, Entamoeba invadens
FVFAIDLPMCVDVKTIKVQLDK

SEQ ID NO: 3040297 - protein, 20 aa, Entamoeba invadens
FVHLKFPIRLSSYYDDIFYW

SEQ ID NO: 3040298 - protein, 25 aa, Entamoeba invadens
FVKGFKREKENFLRAGTYKLGVDVA

SEQ ID NO: 3040299 - protein, 25 aa, Entamoeba invadens
FVKGRHHLVELLKRIKAEKTLQISK

SEQ ID NO: 3040300 - protein, 17 aa, Entamoeba invadens
FVKTAKLGVQFKFGKEE

SEQ ID NO: 3040301 - protein, 20 aa, Entamoeba invadens
FVLTFKVNFNMRIVNVAISI

SEQ ID NO: 3040302 - protein, 30 aa, Entamoeba invadens
FVLVKYFAPWCAHCKALAPIFEELSNITDN

SEQ ID NO: 3040303 - protein, 17 aa, Entamoeba invadens
FVMMASADYIKLYDDGD

SEQ ID NO: 3040304 - protein, 18 aa, Entamoeba invadens
FVMMVSADYIKLYDDGDF

SEQ ID NO: 3040305 - protein, 18 aa, Entamoeba invadens
FVNYLALNLVQRGYSLIT

SEQ ID NO: 3040306 - protein, 18 aa, Entamoeba invadens
FVPTTLCKITIQTSHSLS

SEQ ID NO: 3040307 - protein, 18 aa, Entamoeba invadens
FVRSRWFRRYNRSHKNSV

SEQ ID NO: 3040308 - protein, 17 aa, Entamoeba invadens
FVRTGRTAQAEWSKNFG

SEQ ID NO: 3040309 - protein, 24 aa, Entamoeba invadens
FVSLAVALPSKWGYAFPTNRYYQL

SEQ ID NO: 3040310 - protein, 24 aa, Entamoeba invadens
FVTCLEALNFLFATNFKPKRSIYF

SEQ ID NO: 3040311 - protein, 18 aa, Entamoeba invadens
FVVVSSLNAGDWHEKELP

SEQ ID NO: 3040312 - protein, 20 aa, Entamoeba invadens
FWIEFYRTITQIAYLFIDGN

SEQ ID NO: 3040313 - protein, 17 aa, Entamoeba invadens
FWQSKFLTYILIVKYSI

SEQ ID NO: 3040314 - protein, 23 aa, Entamoeba invadens
FWYLMETAGISFGKFVDRDSGAM

SEQ ID NO: 3040315 - protein, 20 aa, Entamoeba invadens
FYFVKGCLEDCDYPDLEKVT

SEQ ID NO: 3040316 - protein, 20 aa, Entamoeba invadens
FYFVKGCMDDCDFPDLEKVT

SEQ ID NO: 3040317 - protein, 18 aa, Entamoeba invadens
FYGAVLIPSKMCLVTEFA

SEQ ID NO: 3040318 - protein, 21 aa, Entamoeba invadens
FYICADGYHGFLDCPKGTKCK

SEQ ID NO: 3040319 - protein, 21 aa, Entamoeba invadens
FYLRKTCSSPYISVFFVTLLI

SEQ ID NO: 3040320 - protein, 22 aa, Entamoeba invadens
FYQCDSRWKSKMYSSRNDKSNT

SEQ ID NO: 3040321 - protein, 24 aa, Entamoeba invadens
FYYDEWNAGTIYEFLREGTTPVTV

SEQ ID NO: 3040322 - protein, 24 aa, Entamoeba invadens
GAAFRLPYGRCVAVLLKSETMAEG

SEQ ID NO: 3040323 - protein, 21 aa, Entamoeba invadens
GAASCNLCNAGYYSNKGATTC

SEQ ID NO: 3040324 - protein, 19 aa, Entamoeba invadens
GAEPGNTLIIWDKKPPLDI

SEQ ID NO: 3040325 - protein, 31 aa, Entamoeba invadens
GAGDFPFRFGQRGGDAFSFFEEVFGSSFREF

SEQ ID NO: 3040326 - protein, 21 aa, Entamoeba invadens
GAKKVIPGWEQGLLGTCANDE

SEQ ID NO: 3040327 - protein, 18 aa, Entamoeba invadens
GALFEGAQVRFLKTKESH

SEQ ID NO: 3040328 - protein, 21 aa, Entamoeba invadens
GAMGELRICYDINETNKFNPT

SEQ ID NO: 3040329 - protein, 18 aa, Entamoeba invadens
GASICTRCSQGYYSNEGA

SEQ ID NO: 3040330 - protein, 18 aa, Entamoeba invadens
GASSCTKCNLGYYASSSG

SEQ ID NO: 3040331 - protein, 21 aa, Entamoeba invadens
GATCRLCENFVDKALEYVTNG

SEQ ID NO: 3040332 - protein, 21 aa, Entamoeba invadens
GCALCEQGYTLVYGMINALKE

SEQ ID NO: 3040333 - protein, 23 aa, Entamoeba invadens
GCIAKYGDKFLVGYTEDKTNFYL

SEQ ID NO: 3040334 - protein, 19 aa, Entamoeba invadens
GCLFCSQTEYKCYRCDVNY

SEQ ID NO: 3040335 - protein, 18 aa, Entamoeba invadens
GDEYKVIKVLSLPEYYYA

SEQ ID NO: 3040336 - protein, 17 aa, Entamoeba invadens
GDFCFSKCISLTHVDLP

SEQ ID NO: 3040337 - protein, 25 aa, Entamoeba invadens
GDFRLYKRDMCKRTETGSVIYTADK

SEQ ID NO: 3040338 - protein, 22 aa, Entamoeba invadens
GDGIKCTPCQTGTYSSVSGSAS

SEQ ID NO: 3040339 - protein, 19 aa, Entamoeba invadens
GDGTVNIQSLRYCEQLHAF

SEQ ID NO: 3040340 - protein, 23 aa, Entamoeba invadens
GDIIPLYHSYCGPYVMNNTEREK

SEQ ID NO: 3040341 - protein, 19 aa, Entamoeba invadens
GDINMCGVDVDLNYKPGTS

SEQ ID NO: 3040342 - protein, 23 aa, Entamoeba invadens
GDKKCTICPAGYFSKSGNATCTI

SEQ ID NO: 3040343 - protein, 28 aa, Entamoeba invadens
GDKKSGSCALSIQVPQWRGFQFTTGNHQ

SEQ ID NO: 3040344 - protein, 17 aa, Entamoeba invadens
GDLRSYKISDDESNPLY

SEQ ID NO: 3040345 - protein, 17 aa, Entamoeba invadens
GDNMISYLYITDSDDGC

SEQ ID NO: 3040346 - protein, 20 aa, Entamoeba invadens
GDPFMNRWFDLTVATNEIYN

SEQ ID NO: 3040347 - protein, 20 aa, Entamoeba invadens
GDQALTIAMDRSGKLAGIEE

SEQ ID NO: 3040348 - protein, 25 aa, Entamoeba invadens
GDSAFFKCYLLTQFEFGESLTAVNS

SEQ ID NO: 3040349 - protein, 17 aa, Entamoeba invadens
GDSIFTLFDKFRLHSNM

SEQ ID NO: 3040350 - protein, 23 aa, Entamoeba invadens
GDSVFRALLFIPSKAVNPFAPKD

SEQ ID NO: 3040351 - protein, 22 aa, Entamoeba invadens
GEASPPWGVTTMFMAWAELLID

SEQ ID NO: 3040352 - protein, 23 aa, Entamoeba invadens
GEDELLRLGTYYKTMLNSLYKGK

SEQ ID NO: 3040353 - protein, 19 aa, Entamoeba invadens
GEFDEMMKNLGLANADLED

SEQ ID NO: 3040354 - protein, 25 aa, Entamoeba invadens
GEGSFGVVFKGIFRENVVAIKKMKN

SEQ ID NO: 3040355 - protein, 17 aa, Entamoeba invadens
GEIIPLDILDTAGQEEY

SEQ ID NO: 3040356 - protein, 23 aa, Entamoeba invadens
GEKIHDIRVMLRLKRDRLKRRLQ

SEQ ID NO: 3040357 - protein, 19 aa, Entamoeba invadens
GELLIRGPSLFKEYFNRPE

SEQ ID NO: 3040358 - protein, 26 aa, Entamoeba invadens
GENLGIKCYIHKDFLLVNLTPNNLSR

SEQ ID NO: 3040359 - protein, 19 aa, Entamoeba invadens
GESLRNVFDLHKKAIDSVF

SEQ ID NO: 3040360 - protein, 20 aa, Entamoeba invadens
GESTDYCTAIAIKGAAELKV

SEQ ID NO: 3040361 - protein, 19 aa, Entamoeba invadens
GETDLDNFLEVFEGNESDF

SEQ ID NO: 3040362 - protein, 21 aa, Entamoeba invadens
GETRVLRGCFGVEKLVDYNVQ

SEQ ID NO: 3040363 - protein, 27 aa, Entamoeba invadens
GEVEKVWPWGCSHMMSGLQGWNNKTKT

SEQ ID NO: 3040364 - protein, 21 aa, Entamoeba invadens
GFDCARNEMKPSIGMSEGGYA

SEQ ID NO: 3040365 - protein, 23 aa, Entamoeba invadens
GFEKSSITKIIFKTTKPIVVNKY

SEQ ID NO: 3040366 - protein, 25 aa, Entamoeba invadens
GFTIISNFVLLCFANIHSNNNFYIK

SEQ ID NO: 3040367 - protein, 27 aa, Entamoeba invadens
GFVHLKFPLRLSSYYDDIFYWCTKLET

SEQ ID NO: 3040368 - protein, 31 aa, Entamoeba invadens
GFWPQIRINRNLICCEFKLPISKTEKLILNN

SEQ ID NO: 3040369 - protein, 18 aa, Entamoeba invadens
GGDLCIKQTMSQGSCGCC

SEQ ID NO: 3040370 - protein, 18 aa, Entamoeba invadens
GGGTFALTFNYIKKDGVG

SEQ ID NO: 3040371 - protein, 19 aa, Entamoeba invadens
GGIISFLFNFVLESCHVFA

SEQ ID NO: 3040372 - protein, 25 aa, Entamoeba invadens
GGIRLSPRTALRMMRIFDTDFNGHI

SEQ ID NO: 3040373 - protein, 19 aa, Entamoeba invadens
GGKFFVRYYAPWCGYCQEM

SEQ ID NO: 3040374 - protein, 27 aa, Entamoeba invadens
GGKKYSRPCGYMRYALNVLGKYDNGDD

SEQ ID NO: 3040375 - protein, 27 aa, Entamoeba invadens
GGKNYSRPCGYMRYALNVLGKYDDGDD

SEQ ID NO: 3040376 - protein, 24 aa, Entamoeba invadens
GGKVSTECIGLWNGARNGVLTETD

SEQ ID NO: 3040377 - protein, 18 aa, Entamoeba invadens
GGQRRWGFDQAVYNKLVY

SEQ ID NO: 3040378 - protein, 23 aa, Entamoeba invadens
GGSDYRIDVVAGYQQFTTLQRKN

SEQ ID NO: 3040379 - protein, 23 aa, Entamoeba invadens
GGVLDRVPCKLTKPVPRSKIMEV

SEQ ID NO: 3040380 - protein, 26 aa, Entamoeba invadens
GGVLLQCIHSGFGLGRYGEELSGPEY

SEQ ID NO: 3040381 - protein, 22 aa, Entamoeba invadens
GGVNGIYNFGFRINQTDKNHVR

SEQ ID NO: 3040382 - protein, 17 aa, Entamoeba invadens
GGWCFKETSMNLGTDTG

SEQ ID NO: 3040383 - protein, 20 aa, Entamoeba invadens
GGYYIIKLPNGMNVISLQTA

SEQ ID NO: 3040384 - protein, 25 aa, Entamoeba invadens
GHECLVSTCALDLVLSEIKNSKRMQ

SEQ ID NO: 3040385 - protein, 20 aa, Entamoeba invadens
GHSLKFWLQQHSIKEEMQIC

SEQ ID NO: 3040386 - protein, 20 aa, Entamoeba invadens
GICTTCKIGYIPNSTPQKQC

SEQ ID NO: 3040387 - protein, 24 aa, Entamoeba invadens
GIDIPRLVPKLIFVSEDGIDRKEL

SEQ ID NO: 3040388 - protein, 17 aa, Entamoeba invadens
GIFEYTRTAILLYKKYD

SEQ ID NO: 3040389 - protein, 18 aa, Entamoeba invadens
GIGTPVYMAFEILNKQHY

SEQ ID NO: 3040390 - protein, 18 aa, Entamoeba invadens
GITALTLPNTVKCIESFL

SEQ ID NO: 3040391 - protein, 24 aa, Entamoeba invadens
GITRFDVEGLREWTDAMRKDESVF

SEQ ID NO: 3040392 - protein, 23 aa, Entamoeba invadens
GKAKCSGAALLLGSTTRLYDFEI

SEQ ID NO: 3040393 - protein, 26 aa, Entamoeba invadens
GKAYPGVGVDCWDYASKPTMHYGENL

SEQ ID NO: 3040394 - protein, 20 aa, Entamoeba invadens
GKCRDCDGIFPGCSKCTEAA

SEQ ID NO: 3040395 - protein, 21 aa, Entamoeba invadens
GKCSACNTIAGCGKCKSATEC

SEQ ID NO: 3040396 - protein, 19 aa, Entamoeba invadens
GKCTLCKQNYLLQDSNKCE

SEQ ID NO: 3040397 - protein, 20 aa, Entamoeba invadens
GKCTSCSLGSGFVSDGVCKA

SEQ ID NO: 3040398 - protein, 24 aa, Entamoeba invadens
GKDGMCKMTTFFKTNRKLPSMLVR

SEQ ID NO: 3040399 - protein, 19 aa, Entamoeba invadens
GKDVYLRVVNTILGLSPQR

SEQ ID NO: 3040400 - protein, 21 aa, Entamoeba invadens
GKGKKGSLSIKAERRDKNTRS

SEQ ID NO: 3040401 - protein, 17 aa, Entamoeba invadens
GKGPFILNSKEVIKGNI

SEQ ID NO: 3040402 - protein, 18 aa, Entamoeba invadens
GKGTFAMHLVNYAVREGY

SEQ ID NO: 3040403 - protein, 24 aa, Entamoeba invadens
GKIECVICKELIPMKDIITHINAH

SEQ ID NO: 3040404 - protein, 21 aa, Entamoeba invadens
GKIQVMRKMDRVCRKSKYPTT

SEQ ID NO: 3040405 - protein, 21 aa, Entamoeba invadens
GKIWKSLIVATDFFYQNLTLH

SEQ ID NO: 3040406 - protein, 20 aa, Entamoeba invadens
GKKLLAMRVVEEAFDIIHLL

SEQ ID NO: 3040407 - protein, 25 aa, Entamoeba invadens
GKKLLKEGITLGATILVDKATDKLT

SEQ ID NO: 3040408 - protein, 24 aa, Entamoeba invadens
GKKMKLKSVFFERSTQYDLQNDCG

SEQ ID NO: 3040409 - protein, 26 aa, Entamoeba invadens
GKKPTLMTDPVWKRIGLPDPTIPTNN

SEQ ID NO: 3040410 - protein, 19 aa, Entamoeba invadens
GKKRFDAALHEMLKLPNYF

SEQ ID NO: 3040411 - protein, 18 aa, Entamoeba invadens
GKLGTPPNCQMCGVENCK

SEQ ID NO: 3040412 - protein, 20 aa, Entamoeba invadens
GKNKLCYEICRGNDFQPSTY

SEQ ID NO: 3040413 - protein, 23 aa, Entamoeba invadens
GKPIEIRWALLQKKVNFEELNFD

SEQ ID NO: 3040414 - protein, 33 aa, Entamoeba invadens
GKPVLVKFFAPWCGHCKKLAPTYEEFSNVAETE

SEQ ID NO: 3040415 - protein, 21 aa, Entamoeba invadens
GKRRGYSGSVAYETKRGTRIE

SEQ ID NO: 3040416 - protein, 22 aa, Entamoeba invadens
GKSKFPEPVAQAAVQAKPSATP

SEQ ID NO: 3040417 - protein, 19 aa, Entamoeba invadens
GKSNTVWFIYMDKCTTNNK

SEQ ID NO: 3040418 - protein, 22 aa, Entamoeba invadens
GKSSHPYSKLFGKGYGYYGSQF

SEQ ID NO: 3040419 - protein, 30 aa, Entamoeba invadens
GKSVVKFYAPWCSHCIALKPVFEKLSDEFQ

SEQ ID NO: 3040420 - protein, 19 aa, Entamoeba invadens
GKTALNYAKDWAVDKAVGM

SEQ ID NO: 3040421 - protein, 19 aa, Entamoeba invadens
GKTCSKCPLGTYTSTKNQT

SEQ ID NO: 3040422 - protein, 25 aa, Entamoeba invadens
GKTSILYRCVYNIFDNIYDPTIEDN

SEQ ID NO: 3040423 - protein, 18 aa, Entamoeba invadens
GKTSTVFKILTTKPSQDV

SEQ ID NO: 3040424 - protein, 24 aa, Entamoeba invadens
GKVGRLRLKLLIAKQDMKVIRRVL

SEQ ID NO: 3040425 - protein, 17 aa, Entamoeba invadens
GKVPMGCPLTIGEYGFS

SEQ ID NO: 3040426 - protein, 26 aa, Entamoeba invadens
GKVSESVTLPGWYLLVLEMTDHKLFH

SEQ ID NO: 3040427 - protein, 27 aa, Entamoeba invadens
GKVSESVTLPGWYLLVLEMTDHKLFHN

SEQ ID NO: 3040428 - protein, 22 aa, Entamoeba invadens
GLAETLMRLELHFITNLQNINS

SEQ ID NO: 3040429 - protein, 33 aa, Entamoeba invadens
GLECKCGFTTMNPCAWSYQDLGNMCVGKPGDYF

SEQ ID NO: 3040430 - protein, 22 aa, Entamoeba invadens
GLELRSVSLFSDIDQRFDIWLK

SEQ ID NO: 3040431 - protein, 26 aa, Entamoeba invadens
GLFYKFAPEYNSDVARYIKIFNNLQQ

SEQ ID NO: 3040432 - protein, 27 aa, Entamoeba invadens
GLHDYKYYFCSTYYKGYLPCPLGTKCG

SEQ ID NO: 3040433 - protein, 17 aa, Entamoeba invadens
GLIKLLPDYSDLFVAQD

SEQ ID NO: 3040434 - protein, 25 aa, Entamoeba invadens
GLMVDCARNPFTLSTYYKIINAMAM

SEQ ID NO: 3040435 - protein, 20 aa, Entamoeba invadens
GLNSFKGEKQVLVFDLGGGT

SEQ ID NO: 3040436 - protein, 46 aa, Entamoeba invadens
GLNYIFCFYCRVITKFDHIICIIILIKLKILFCGSMSTEQFDVITK

SEQ ID NO: 3040437 - protein, 19 aa, Entamoeba invadens
GLRKFCYNTSCPENYLSYN

SEQ ID NO: 3040438 - protein, 20 aa, Entamoeba invadens
GLSDCSLCTGNYCNNCKSIP

SEQ ID NO: 3040439 - protein, 32 aa, Entamoeba invadens
GLVCKCGKTAYNPCVWSWTDLPDCSLKPGDYF

SEQ ID NO: 3040440 - protein, 17 aa, Entamoeba invadens
GMCTLCIDNYVVTSPFS

SEQ ID NO: 3040441 - protein, 18 aa, Entamoeba invadens
GMNCKNCIKNCLSCTESD

SEQ ID NO: 3040442 - protein, 27 aa, Entamoeba invadens
GMVYKRPCGYMRYALNVIGKFDNGNDT

SEQ ID NO: 3040443 - protein, 20 aa, Entamoeba invadens
GNATCTICPAGTYSNAGASG

SEQ ID NO: 3040444 - protein, 18 aa, Entamoeba invadens
GNCLSCYDGYFLNGKMCD

SEQ ID NO: 3040445 - protein, 17 aa, Entamoeba invadens
GNCLSCYDGYFMNGKIC

SEQ ID NO: 3040446 - protein, 23 aa, Entamoeba invadens
GNCRERLLCAFTHHNEQEYIDCL

SEQ ID NO: 3040447 - protein, 24 aa, Entamoeba invadens
GNEAFRSSLLSSFVASNGIKQLGT

SEQ ID NO: 3040448 - protein, 24 aa, Entamoeba invadens
GNERCEICNIGLYSLGGVCYPCEG

SEQ ID NO: 3040449 - protein, 23 aa, Entamoeba invadens
GNESDFLLDDGWLDKAKSSIHNV

SEQ ID NO: 3040450 - protein, 21 aa, Entamoeba invadens
GNIFSCLDIWYGCGSCTKEKC

SEQ ID NO: 3040451 - protein, 23 aa, Entamoeba invadens
GNLKKDFLCSSIALTEQTFIDCL

SEQ ID NO: 3040452 - protein, 24 aa, Entamoeba invadens
GNLRITKRSTLIFGDNLVINTNEI

SEQ ID NO: 3040453 - protein, 22 aa, Entamoeba invadens
GNPRTLLSVGCIECDSDIVALQ

SEQ ID NO: 3040454 - protein, 24 aa, Entamoeba invadens
GNPRWKWDRYLKHMRINYYFLNGL

SEQ ID NO: 3040455 - protein, 18 aa, Entamoeba invadens
GNTLIIWDKKPPLDIETK

SEQ ID NO: 3040456 - protein, 17 aa, Entamoeba invadens
GNTLIIWNKKPPLAEGT

SEQ ID NO: 3040457 - protein, 25 aa, Entamoeba invadens
GNVGLKMNGCDGVFNGQPGWYEKRI

SEQ ID NO: 3040458 - protein, 19 aa, Entamoeba invadens
GPAIKWICYSTNTLLQTKV

SEQ ID NO: 3040459 - protein, 17 aa, Entamoeba invadens
GPIPHSLFLGKSLEKVD

SEQ ID NO: 3040460 - protein, 23 aa, Entamoeba invadens
GPNNCLSCLFSYGFSNGYCVKCD

SEQ ID NO: 3040461 - protein, 24 aa, Entamoeba invadens
GPQARPMMFKSFKGLPKNTQSVDT

SEQ ID NO: 3040462 - protein, 19 aa, Entamoeba invadens
GPTSMAMVVATLADRSVTP

SEQ ID NO: 3040463 - protein, 24 aa, Entamoeba invadens
GQCMKCTINGCLKCVSENPYKCQI

SEQ ID NO: 3040464 - protein, 18 aa, Entamoeba invadens
GQCTSCYTGYGLFLSNVC

SEQ ID NO: 3040465 - protein, 17 aa, Entamoeba invadens
GQFDCVLVEGSYTCYVY

SEQ ID NO: 3040466 - protein, 24 aa, Entamoeba invadens
GQRICLKCKVGYRLDTNKTCVSCD

SEQ ID NO: 3040467 - protein, 18 aa, Entamoeba invadens
GQRKNCYGYTVMPEEKKY

SEQ ID NO: 3040468 - protein, 20 aa, Entamoeba invadens
GQRSSSFGVGADYTSKKLTA

SEQ ID NO: 3040469 - protein, 25 aa, Entamoeba invadens
GQSMALRVFLMPSKTQLSSSEVLLS

SEQ ID NO: 3040470 - protein, 22 aa, Entamoeba invadens
GQSMKLRVYLMPYKTPLFSSDV

SEQ ID NO: 3040471 - protein, 20 aa, Entamoeba invadens
GQTTCKLCDSSCARCNATDG

SEQ ID NO: 3040472 - protein, 25 aa, Entamoeba invadens
GRAMLGFMKPILKRILNDFKTTDKL

SEQ ID NO: 3040473 - protein, 24 aa, Entamoeba invadens
GRCGCCYAASLANYGQYAYANISY

SEQ ID NO: 3040474 - protein, 18 aa, Entamoeba invadens
GRCTKCFGPFKPVDGKCT

SEQ ID NO: 3040475 - protein, 17 aa, Entamoeba invadens
GRGMWLLSVVIGFVFLL

SEQ ID NO: 3040476 - protein, 23 aa, Entamoeba invadens
GRIEMLKEFPAFMDRVKEPYVKP

SEQ ID NO: 3040477 - protein, 17 aa, Entamoeba invadens
GRLCKELTMQKTYTSGF

SEQ ID NO: 3040478 - protein, 20 aa, Entamoeba invadens
GRLIRYCPDKYATLIQNQNN

SEQ ID NO: 3040479 - protein, 17 aa, Entamoeba invadens
GRLSYIVFLNKESVKRM

SEQ ID NO: 3040480 - protein, 18 aa, Entamoeba invadens
GRLSYIVFLNKESVKRMS

SEQ ID NO: 3040481 - protein, 17 aa, Entamoeba invadens
GRSCSVLTYKTPMVHYS

SEQ ID NO: 3040482 - protein, 27 aa, Entamoeba invadens
GRSGVKVSGKIKRGRVEAAGSVEMGKR

SEQ ID NO: 3040483 - protein, 19 aa, Entamoeba invadens
GRTPLQIYKDFMASFKSNF

SEQ ID NO: 3040484 - protein, 17 aa, Entamoeba invadens
GRTTLYILFDISNSNRQ

SEQ ID NO: 3040485 - protein, 18 aa, Entamoeba invadens
GRYQRAIIARHEMVEDRI

SEQ ID NO: 3040486 - protein, 17 aa, Entamoeba invadens
GSFDPWSPLAKHETQYN

SEQ ID NO: 3040487 - protein, 17 aa, Entamoeba invadens
GSFSFALKLLISSENCF

SEQ ID NO: 3040488 - protein, 23 aa, Entamoeba invadens
GSHYEIYNSLFFFNSNSEHNTHI

SEQ ID NO: 3040489 - protein, 23 aa, Entamoeba invadens
GSIHGRHGFDYAHTRDVKTKHGR

SEQ ID NO: 3040490 - protein, 21 aa, Entamoeba invadens
GSKGFVKREFHAWKVNPKFKA

SEQ ID NO: 3040491 - protein, 19 aa, Entamoeba invadens
GSLCQKCPAGTYQIGVYIS

SEQ ID NO: 3040492 - protein, 17 aa, Entamoeba invadens
GSLGCKGGGTFALTFNY

SEQ ID NO: 3040493 - protein, 19 aa, Entamoeba invadens
GSLTKKRMSFVIKKAKNEI

SEQ ID NO: 3040494 - protein, 24 aa, Entamoeba invadens
GSMDSRVPPPFPFGPKHPDHNNHI

SEQ ID NO: 3040495 - protein, 19 aa, Entamoeba invadens
GSSCLECENGFYLESNVCK

SEQ ID NO: 3040496 - protein, 21 aa, Entamoeba invadens
GSSSCKLCDAGSYSSSTGAAS

SEQ ID NO: 3040497 - protein, 17 aa, Entamoeba invadens
GSTYGLDQLDPVFVIKQ

SEQ ID NO: 3040498 - protein, 23 aa, Entamoeba invadens
GSYFKYVEKNGGIVIEKYTDHNC

SEQ ID NO: 3040499 - protein, 19 aa, Entamoeba invadens
GSYGVVFKGTFRGNTVAIK

SEQ ID NO: 3040500 - protein, 17 aa, Entamoeba invadens
GSYTCYVYVLLSAIFLI

SEQ ID NO: 3040501 - protein, 17 aa, Entamoeba invadens
GTFEYKYTKMVETIFKK

SEQ ID NO: 3040502 - protein, 21 aa, Entamoeba invadens
GTFGTRFFKTLPRAPRTTSST

SEQ ID NO: 3040503 - protein, 21 aa, Entamoeba invadens
GTGCAPVIRHKIWFNNRRIYY

SEQ ID NO: 3040504 - protein, 20 aa, Entamoeba invadens
GTTCYKCFDTTKTGVALVKV

SEQ ID NO: 3040505 - protein, 19 aa, Entamoeba invadens
GTTYLLGRAVNKLGKNMIG

SEQ ID NO: 3040506 - protein, 24 aa, Entamoeba invadens
GVALEQCSLCKYGYHLDGVNKKCY

SEQ ID NO: 3040507 - protein, 18 aa, Entamoeba invadens
GVALISEFFVRRGNNYVS

SEQ ID NO: 3040508 - protein, 19 aa, Entamoeba invadens
GVCEECKLFFTHCADCNET

SEQ ID NO: 3040509 - protein, 29 aa, Entamoeba invadens
GVFHFPVCMPTFLLKMVVFTINFNGNYSL

SEQ ID NO: 3040510 - protein, 24 aa, Entamoeba invadens
GVKQKGCATAVVSRIAQQANPSPI

SEQ ID NO: 3040511 - protein, 18 aa, Entamoeba invadens
GVLAKGITIEDGWFDCNK

SEQ ID NO: 3040512 - protein, 19 aa, Entamoeba invadens
GVLSCKSCGTGCGTCSSAS

SEQ ID NO: 3040513 - protein, 27 aa, Entamoeba invadens
GVNSCKRCKPHFAQCLTLQTPVPGTSI

SEQ ID NO: 3040514 - protein, 24 aa, Entamoeba invadens
GVSIMASNILKIFQRTNFEDFMKR

SEQ ID NO: 3040515 - protein, 18 aa, Entamoeba invadens
GVVADCWSTIKTWRYGEN

SEQ ID NO: 3040516 - protein, 25 aa, Entamoeba invadens
GVYYIDARSSMTMARCYSQMNLMLI

SEQ ID NO: 3040517 - protein, 18 aa, Entamoeba invadens
GWQKLFDIIDDWQSLSKV

SEQ ID NO: 3040518 - protein, 27 aa, Entamoeba invadens
GWVAKSVCTRSNFKRIMLFKENEITEG

SEQ ID NO: 3040519 - protein, 18 aa, Entamoeba invadens
GYAVLLMNGHQSVGYGEK

SEQ ID NO: 3040520 - protein, 19 aa, Entamoeba invadens
GYCDHKLDLHYSFDSTITN

SEQ ID NO: 3040521 - protein, 18 aa, Entamoeba invadens
GYCTGCLSNYVFISSMSL

SEQ ID NO: 3040522 - protein, 22 aa, Entamoeba invadens
GYCTSCKLGYVLKLDKQSLICE

SEQ ID NO: 3040523 - protein, 17 aa, Entamoeba invadens
GYFVEAIWQDSKKQKVI

SEQ ID NO: 3040524 - protein, 19 aa, Entamoeba invadens
GYGGDDCHQLCYYNNAWTV

SEQ ID NO: 3040525 - protein, 19 aa, Entamoeba invadens
GYLAKYEIDAAIPSSNVQY

SEQ ID NO: 3040526 - protein, 24 aa, Entamoeba invadens
GYLPCPLGTKCGYKGKVPNEESPC

SEQ ID NO: 3040527 - protein, 25 aa, Entamoeba invadens
GYQRSSRCVLFRFNPIKYNQLNRTI

SEQ ID NO: 3040528 - protein, 18 aa, Entamoeba invadens
GYTPVLLQMVFRHGDRSP

SEQ ID NO: 3040529 - protein, 21 aa, Entamoeba invadens
GYYFKSGFCTRCATGCLSCSD

SEQ ID NO: 3040530 - protein, 25 aa, Entamoeba invadens
HAIPRCWRSSGSWDPNCASNCKNAH

SEQ ID NO: 3040531 - protein, 26 aa, Entamoeba invadens
HAYLAPYRIQWMIDHSGPDFIPAGEA

SEQ ID NO: 3040532 - protein, 17 aa, Entamoeba invadens
HCLWPEMKGFHHGNHTR

SEQ ID NO: 3040533 - protein, 23 aa, Entamoeba invadens
HCPCDGEKCTISILPTKSVNLNN

SEQ ID NO: 3040534 - protein, 17 aa, Entamoeba invadens
HCSCCDGFLTLFFRPLL

SEQ ID NO: 3040535 - protein, 22 aa, Entamoeba invadens
HCTIKGSGPYPIEMLIKPGCVK

SEQ ID NO: 3040536 - protein, 20 aa, Entamoeba invadens
HCTLKVVPMEGCSRQNGEKC

SEQ ID NO: 3040537 - protein, 21 aa, Entamoeba invadens
HCTSCKYGQIIRSSKCVSCEA

SEQ ID NO: 3040538 - protein, 19 aa, Entamoeba invadens
HCTSECLCEDNYFSIAGVN

SEQ ID NO: 3040539 - protein, 17 aa, Entamoeba invadens
HDGRSGVKVSGKIKRGR

SEQ ID NO: 3040540 - protein, 26 aa, Entamoeba invadens
HDIFGGRVVIPFSFEINQTYQSTTIS

SEQ ID NO: 3040541 - protein, 20 aa, Entamoeba invadens
HDPRRVLMVYSGGTIGMKKG

SEQ ID NO: 3040542 - protein, 23 aa, Entamoeba invadens
HEIPYILEYAFKYNETILETSQQ

SEQ ID NO: 3040543 - protein, 24 aa, Entamoeba invadens
HENCKTSSWMQCFVTGAIAPKVPI

SEQ ID NO: 3040544 - protein, 24 aa, Entamoeba invadens
HFGYGRRYGYFMARQYEGYYPGYP

SEQ ID NO: 3040545 - protein, 23 aa, Entamoeba invadens
HFKEKCFYSSRISEITFGSIVSE

SEQ ID NO: 3040546 - protein, 19 aa, Entamoeba invadens
HFLKRFGVTDSNVIDLIQL

SEQ ID NO: 3040547 - protein, 17 aa, Entamoeba invadens
HFTHGCYVQKRIEQVAS

SEQ ID NO: 3040548 - protein, 37 aa, Entamoeba invadens
HGFWPHLHINRNLFCCLNWHGPENFENSLLMDKVLLK

SEQ ID NO: 3040549 - protein, 17 aa, Entamoeba invadens
HGSCAMKTYTGKNGPMQ

SEQ ID NO: 3040550 - protein, 31 aa, Entamoeba invadens
HHGGYKRGGIWSLIENYGFTFKKYVDRDIGT

SEQ ID NO: 3040551 - protein, 20 aa, Entamoeba invadens
HHIFPGMKYGMFPNGYPLGY

SEQ ID NO: 3040552 - protein, 18 aa, Entamoeba invadens
HHSGSLFPVISLLHPNKR

SEQ ID NO: 3040553 - protein, 24 aa, Entamoeba invadens
HICDSDAYPAFGMFAEADRSNTLY

SEQ ID NO: 3040554 - protein, 23 aa, Entamoeba invadens
HIDKSKMKWGYDQALINWLFYNG

SEQ ID NO: 3040555 - protein, 24 aa, Entamoeba invadens
HIDRIKRKVVRKVLQLIQDLSETN

SEQ ID NO: 3040556 - protein, 23 aa, Entamoeba invadens
HIFALRKEVGMRMLLMGDPSAAI

SEQ ID NO: 3040557 - protein, 26 aa, Entamoeba invadens
HIKLYFKNYKKYGIMGKKFGKKGKMT

SEQ ID NO: 3040558 - protein, 20 aa, Entamoeba invadens
HIRYNVPINTAFSIGSPQTV

SEQ ID NO: 3040559 - protein, 22 aa, Entamoeba invadens
HISSLMFEYSYNFTDGKGYLIS

SEQ ID NO: 3040560 - protein, 21 aa, Entamoeba invadens
HKFRDGTDCAVPFMHAAYSVE

SEQ ID NO: 3040561 - protein, 21 aa, Entamoeba invadens
HKHFYSHLFGHGYGYSGAYFS

SEQ ID NO: 3040562 - protein, 19 aa, Entamoeba invadens
HKKIIKRIVELDPLEEKMI

SEQ ID NO: 3040563 - protein, 28 aa, Entamoeba invadens
HKKSGEIVMKMRIKLMLDTAKGIQYLHA

SEQ ID NO: 3040564 - protein, 20 aa, Entamoeba invadens
HKNLRTMYPLAITEPKDVDM

SEQ ID NO: 3040565 - protein, 17 aa, Entamoeba invadens
HKQIVLGNFRFAHAETV

SEQ ID NO: 3040566 - protein, 31 aa, Entamoeba invadens
HKYCMKCYPGFRLSIDTMKCIFGDEFCAQYY

SEQ ID NO: 3040567 - protein, 25 aa, Entamoeba invadens
HLAHLRLHLDFYKKELMKVVNTKDP

SEQ ID NO: 3040568 - protein, 24 aa, Entamoeba invadens
HLCDSDAYPGFGMFAENDKNKRLY

SEQ ID NO: 3040569 - protein, 20 aa, Entamoeba invadens
HLDILSKLCAVRTAKNTTEI

SEQ ID NO: 3040570 - protein, 23 aa, Entamoeba invadens
HLGIKIDLFFTKGCENCQFPEFD

SEQ ID NO: 3040571 - protein, 23 aa, Entamoeba invadens
HLKQHLKKKISVFKANKETYQKV

SEQ ID NO: 3040572 - protein, 19 aa, Entamoeba invadens
HLNKTYCKTLTNWDYEQSR

SEQ ID NO: 3040573 - protein, 18 aa, Entamoeba invadens
HLTKNIVVTKVFTITEDP

SEQ ID NO: 3040574 - protein, 20 aa, Entamoeba invadens
HNLSKKWPLYVAYTQNENGV

SEQ ID NO: 3040575 - protein, 18 aa, Entamoeba invadens
HNVGSLTTTSIEWVCYAT

SEQ ID NO: 3040576 - protein, 20 aa, Entamoeba invadens
HNVTKLGNKCFKNCKLLSRI

SEQ ID NO: 3040577 - protein, 25 aa, Entamoeba invadens
HPDLAYDIPRTFFLPKKLVTDIAVV

SEQ ID NO: 3040578 - protein, 25 aa, Entamoeba invadens
HPIFTRKGSDLFASINVSLLESLVG

SEQ ID NO: 3040579 - protein, 18 aa, Entamoeba invadens
HPKSCLKFNTNRCTQPYC

SEQ ID NO: 3040580 - protein, 21 aa, Entamoeba invadens
HPQEFLYAAGCNKDISGKFYI

SEQ ID NO: 3040581 - protein, 23 aa, Entamoeba invadens
HRASFKTKQFIKIKEVNFDRFDQ

SEQ ID NO: 3040582 - protein, 17 aa, Entamoeba invadens
HREFNQQHCLSIQNLNN

SEQ ID NO: 3040583 - protein, 19 aa, Entamoeba invadens
HRFYGRSLPVGGLSQENLG

SEQ ID NO: 3040584 - protein, 17 aa, Entamoeba invadens
HRKDCKVITRKDQHEIE

SEQ ID NO: 3040585 - protein, 25 aa, Entamoeba invadens
HSGTQFECPFCFKDLGNAQSLQHHV

SEQ ID NO: 3040586 - protein, 20 aa, Entamoeba invadens
HSLFGKRLTSIVIGGSALPV

SEQ ID NO: 3040587 - protein, 23 aa, Entamoeba invadens
HSMGGLMSYKLLDYVGKDFATKY

SEQ ID NO: 3040588 - protein, 18 aa, Entamoeba invadens
HSNFKCCSSYTKQDDFAY

SEQ ID NO: 3040589 - protein, 20 aa, Entamoeba invadens
HSYGFLKEAFSFFLDVFSTY

SEQ ID NO: 3040590 - protein, 23 aa, Entamoeba invadens
HTDLVLKWHVEYYWGSLYISSYQ

SEQ ID NO: 3040591 - protein, 18 aa, Entamoeba invadens
HTERVCKCMYEYNYYSYP

SEQ ID NO: 3040592 - protein, 23 aa, Entamoeba invadens
HTKFDFAVNIFAPCCNVNKIRTK

SEQ ID NO: 3040593 - protein, 17 aa, Entamoeba invadens
HTNMMYGAMSPRVTNVA

SEQ ID NO: 3040594 - protein, 18 aa, Entamoeba invadens
HTPFPPSLLPILKSVNPS

SEQ ID NO: 3040595 - protein, 24 aa, Entamoeba invadens
HTRFPDKWYELHSHCTGLIKLLPD

SEQ ID NO: 3040596 - protein, 18 aa, Entamoeba invadens
HVASLESMLERFNDKIVF

SEQ ID NO: 3040597 - protein, 25 aa, Entamoeba invadens
HVDLCGKSSFFGCVSVIEQKRLEKC

SEQ ID NO: 3040598 - protein, 32 aa, Entamoeba invadens
HVFVKFFAPWCGHCKKLAPEYVKLADKYKSND

SEQ ID NO: 3040599 - protein, 35 aa, Entamoeba invadens
HVGVPFKSGFWYLLESSGINFGKIIDRDSGVVKSG

SEQ ID NO: 3040600 - protein, 27 aa, Entamoeba invadens
HVGVPFKSGFWYLLETSGISFGQIIDR

SEQ ID NO: 3040601 - protein, 17 aa, Entamoeba invadens
HVIMSYKGKNHLIKKEI

SEQ ID NO: 3040602 - protein, 20 aa, Entamoeba invadens
HVVFGEVIEGLDIVDKIAAV

SEQ ID NO: 3040603 - protein, 24 aa, Entamoeba invadens
HWKGLRCVYYVRLLSVLLVVQQLG

SEQ ID NO: 3040604 - protein, 37 aa, Entamoeba invadens
HYHRNKNLYCCINWYGPDNFDTLLLMEKDLLKEVRNK

SEQ ID NO: 3040605 - protein, 19 aa, Entamoeba invadens
HYYPQKRFQVPTMPFYPMN

SEQ ID NO: 3040606 - protein, 26 aa, Entamoeba invadens
IAFYKPSDIPLMFEKIRRHIKMEDFE

SEQ ID NO: 3040607 - protein, 26 aa, Entamoeba invadens
IAGDGCSFKVLFGRVEWNGAQIATNT

SEQ ID NO: 3040608 - protein, 24 aa, Entamoeba invadens
IAGKISGIHWWWKDNSHAAELTAG

SEQ ID NO: 3040609 - protein, 38 aa, Entamoeba invadens
IAKVKLWMSWFPMEVGKCDGRELVPWERLVIENDDHDQ

SEQ ID NO: 3040610 - protein, 19 aa, Entamoeba invadens
IAPEPITSFVVSETVKGLK

SEQ ID NO: 3040611 - protein, 29 aa, Entamoeba invadens
IASNLFKKFWCKVLPVARVALSGFTGVRF

SEQ ID NO: 3040612 - protein, 26 aa, Entamoeba invadens
ICEKAGFDKLRFHVEAGPTHDDQEVL

SEQ ID NO: 3040613 - protein, 21 aa, Entamoeba invadens
ICGFYKITGYPTVNFYKSGTF

SEQ ID NO: 3040614 - protein, 20 aa, Entamoeba invadens
ICGNQKLKYCVTVDSSNSVY

SEQ ID NO: 3040615 - protein, 17 aa, Entamoeba invadens
ICINDFLAFNYEDDQTP

SEQ ID NO: 3040616 - protein, 24 aa, Entamoeba invadens
ICKDVNLPGVCSCEGIRSYYDATL

SEQ ID NO: 3040617 - protein, 28 aa, Entamoeba invadens
ICRLSSGLRKMGFKKGDKIGIFCETRYE

SEQ ID NO: 3040618 - protein, 19 aa, Entamoeba invadens
ICRRDNYNRFVLQQQPVTY

SEQ ID NO: 3040619 - protein, 23 aa, Entamoeba invadens
ICTEAYKGFSKCPSGTVCKGNGR

SEQ ID NO: 3040620 - protein, 21 aa, Entamoeba invadens
ICTKCLSGYYLQDGECLQIKN

SEQ ID NO: 3040621 - protein, 17 aa, Entamoeba invadens
ICVEKPVGCLFTDGLSC

SEQ ID NO: 3040622 - protein, 19 aa, Entamoeba invadens
ICVSCSSGYVLDDNYNCIL

SEQ ID NO: 3040623 - protein, 18 aa, Entamoeba invadens
IDCSSTHKGCYLVTDDSC

SEQ ID NO: 3040624 - protein, 24 aa, Entamoeba invadens
IDFKQDFLVDIVVDKCKNKNLLKE

SEQ ID NO: 3040625 - protein, 20 aa, Entamoeba invadens
IDIGCAHINGSYDGIYYTDQ

SEQ ID NO: 3040626 - protein, 24 aa, Entamoeba invadens
IDIILCTDCTVINNYLHDVFPIEI

SEQ ID NO: 3040627 - protein, 17 aa, Entamoeba invadens
IDIKMRIKFMIDAAKGI

SEQ ID NO: 3040628 - protein, 22 aa, Entamoeba invadens
IDKKWQYPLIVFFKSDSKKPHF

SEQ ID NO: 3040629 - protein, 23 aa, Entamoeba invadens
IDLPRLAPKVLIFAKSQLVVSGA

SEQ ID NO: 3040630 - protein, 17 aa, Entamoeba invadens
IDNICVFADPFHDFIVA

SEQ ID NO: 3040631 - protein, 17 aa, Entamoeba invadens
IDQFAAIPQVERLPESA

SEQ ID NO: 3040632 - protein, 18 aa, Entamoeba invadens
IDQFRSGSDFYLVCRDFE

SEQ ID NO: 3040633 - protein, 17 aa, Entamoeba invadens
IDSFVTTSHELFKLEND

SEQ ID NO: 3040634 - protein, 17 aa, Entamoeba invadens
IDVPRLATKLIVKVEGK

SEQ ID NO: 3040635 - protein, 18 aa, Entamoeba invadens
IDYIKTALFLNSKFEFWK

SEQ ID NO: 3040636 - protein, 26 aa, Entamoeba invadens
IEAKTIKKLTLMKWFEKIDECYDLHS

SEQ ID NO: 3040637 - protein, 18 aa, Entamoeba invadens
IECREGYIRDNNKCITAN

SEQ ID NO: 3040638 - protein, 18 aa, Entamoeba invadens
IEDLKKLVKRGVVRARDV

SEQ ID NO: 3040639 - protein, 18 aa, Entamoeba invadens
IEDVKAFKANEIDDKDFA

SEQ ID NO: 3040640 - protein, 18 aa, Entamoeba invadens
IEGCTTCLDHMYYNTTTR

SEQ ID NO: 3040641 - protein, 19 aa, Entamoeba invadens
IEHALPAEMGHVWVDAHAC

SEQ ID NO: 3040642 - protein, 20 aa, Entamoeba invadens
IEHLLELVDLLATLLQMNND

SEQ ID NO: 3040643 - protein, 17 aa, Entamoeba invadens
IEKEKKEAHEIIENIKM

SEQ ID NO: 3040644 - protein, 25 aa, Entamoeba invadens
IEKEYIHDFRVCFNVEQDPFNPGPA

SEQ ID NO: 3040645 - protein, 18 aa, Entamoeba invadens
IEKHRKLFTPKLEITVQQ

SEQ ID NO: 3040646 - protein, 22 aa, Entamoeba invadens
IEKKKLLALRKREYENAKLTAE

SEQ ID NO: 3040647 - protein, 25 aa, Entamoeba invadens
IEKRHTVSIPIEFIEKANGNTSPTE

SEQ ID NO: 3040648 - protein, 17 aa, Entamoeba invadens
IELLKEYIQRIKSAHEN

SEQ ID NO: 3040649 - protein, 24 aa, Entamoeba invadens
IEMLDEFRCDYIVYFSGAIFIINK

SEQ ID NO: 3040650 - protein, 22 aa, Entamoeba invadens
IEMLEKIALRYQDIIVSYLTTK

SEQ ID NO: 3040651 - protein, 20 aa, Entamoeba invadens
IENVLFYFYMASELFFSINN

SEQ ID NO: 3040652 - protein, 18 aa, Entamoeba invadens
IEQQRKSFIDNYKKMKIE

SEQ ID NO: 3040653 - protein, 24 aa, Entamoeba invadens
IERESIRWGQDFNVIEDAAEFDLY

SEQ ID NO: 3040654 - protein, 25 aa, Entamoeba invadens
IESLKRKSIPFSMVLFSSNETRKQE

SEQ ID NO: 3040655 - protein, 17 aa, Entamoeba invadens
IETIPLLFPSGGVERWG

SEQ ID NO: 3040656 - protein, 26 aa, Entamoeba invadens
IEVDGKLRGLASMTVFPSMTLEESAA

SEQ ID NO: 3040657 - protein, 23 aa, Entamoeba invadens
IFAHKFKGIFFEEIVIRSINDKI

SEQ ID NO: 3040658 - protein, 17 aa, Entamoeba invadens
IFCYQLTQSRLIDIVQL

SEQ ID NO: 3040659 - protein, 19 aa, Entamoeba invadens
IFIDYCPLQSVAERMFERL

SEQ ID NO: 3040660 - protein, 19 aa, Entamoeba invadens
IFKGLKKQIVMKIELIQKE

SEQ ID NO: 3040661 - protein, 19 aa, Entamoeba invadens
IFLEKSMKKAWEIKRQKLG

SEQ ID NO: 3040662 - protein, 26 aa, Entamoeba invadens
IFLMDIRIVLFYSDFFQTFSNDEISW

SEQ ID NO: 3040663 - protein, 21 aa, Entamoeba invadens
IFNKICTFKSLEVLDSNVIIK

SEQ ID NO: 3040664 - protein, 24 aa, Entamoeba invadens
IFNYKTRSFYGFKITHQPSPWIKD

SEQ ID NO: 3040665 - protein, 22 aa, Entamoeba invadens
IFRPCVSCGDTAGQLSGYHVNS

SEQ ID NO: 3040666 - protein, 18 aa, Entamoeba invadens
IFVWTSEDILDWDPFYLE

SEQ ID NO: 3040667 - protein, 20 aa, Entamoeba invadens
IFYSLPWCIHCKELRPVIEE

SEQ ID NO: 3040668 - protein, 21 aa, Entamoeba invadens
IGADITNFLGFTITNEQKDVR

SEQ ID NO: 3040669 - protein, 21 aa, Entamoeba invadens
IGAGCVGAFAALEFSKYKNLK

SEQ ID NO: 3040670 - protein, 17 aa, Entamoeba invadens
IGAPVWSEQIFRKYMTV

SEQ ID NO: 3040671 - protein, 23 aa, Entamoeba invadens
IGDSRLNYGNGLFHAYTHTHSDE

SEQ ID NO: 3040672 - protein, 17 aa, Entamoeba invadens
IGEEFKIEGKVYTRPDF

SEQ ID NO: 3040673 - protein, 28 aa, Entamoeba invadens
IGEGSYRIRLKFGIPKTCYGYLNSIGIT

SEQ ID NO: 3040674 - protein, 24 aa, Entamoeba invadens
IGFNTVRFLLSYRFFEDDNAPYQY

SEQ ID NO: 3040675 - protein, 26 aa, Entamoeba invadens
IGGAKGMFYYSYFDFVYMDDKGDPFM

SEQ ID NO: 3040676 - protein, 26 aa, Entamoeba invadens
IGIETIKEFISFGFIEVATRSEIDKR

SEQ ID NO: 3040677 - protein, 21 aa, Entamoeba invadens
IGIPPESRFITIIDPLSLPDR

SEQ ID NO: 3040678 - protein, 17 aa, Entamoeba invadens
IGLETSLHLNREVIVNQ

SEQ ID NO: 3040679 - protein, 17 aa, Entamoeba invadens
IGNKCYTITTGVSVKIE

SEQ ID NO: 3040680 - protein, 24 aa, Entamoeba invadens
IGQFGVGFYSSYLVAENVTVISRK

SEQ ID NO: 3040681 - protein, 24 aa, Entamoeba invadens
IGSAYCFNCLAGTYAAKEGSSSCE

SEQ ID NO: 3040682 - protein, 18 aa, Entamoeba invadens
IGSMKAGQWTTGGHFITI

SEQ ID NO: 3040683 - protein, 25 aa, Entamoeba invadens
IGSTEVFSLLKYVDEFIVFSTGFSE

SEQ ID NO: 3040684 - protein, 18 aa, Entamoeba invadens
IHCLAGTYFSGSSCVSCK

SEQ ID NO: 3040685 - protein, 26 aa, Entamoeba invadens
IHICDSDAFPAFGMFAENSKTYILYS

SEQ ID NO: 3040686 - protein, 17 aa, Entamoeba invadens
IHIQNSFTLHSNSLAKI

SEQ ID NO: 3040687 - protein, 27 aa, Entamoeba invadens
IHKNRFHTIMFVKFWPGEKCSGITCSL

SEQ ID NO: 3040688 - protein, 17 aa, Entamoeba invadens
IHLLYFFIQTRFNDSRI

SEQ ID NO: 3040689 - protein, 23 aa, Entamoeba invadens
IHSLKRFFMLTISYDENLINENT

SEQ ID NO: 3040690 - protein, 23 aa, Entamoeba invadens
IHTKRIIFCYKEYTELLNKDVYI

SEQ ID NO: 3040691 - protein, 18 aa, Entamoeba invadens
IHVDYKLQVGRSYFHPSQ

SEQ ID NO: 3040692 - protein, 19 aa, Entamoeba invadens
IIGLLKIIFEKHNGFLKKL

SEQ ID NO: 3040693 - protein, 18 aa, Entamoeba invadens
IIHRSFEVFYERGEWNEL

SEQ ID NO: 3040694 - protein, 18 aa, Entamoeba invadens
IIILICILLVFVRLFAAG

SEQ ID NO: 3040695 - protein, 19 aa, Entamoeba invadens
IIILICILLVFVRLYAAGG

SEQ ID NO: 3040696 - protein, 21 aa, Entamoeba invadens
IIKADGSWLPPEESLTEVYLN

SEQ ID NO: 3040697 - protein, 19 aa, Entamoeba invadens
IIKEYGLFWPQILNIAINR

SEQ ID NO: 3040698 - protein, 24 aa, Entamoeba invadens
IILPGVAVVQGFGMTELCGASSCM

SEQ ID NO: 3040699 - protein, 21 aa, Entamoeba invadens
IINKMCMVTEFAIYGSLNDLI

SEQ ID NO: 3040700 - protein, 23 aa, Entamoeba invadens
IINLLLRIVFKSPLEGVQTALHL

SEQ ID NO: 3040701 - protein, 19 aa, Entamoeba invadens
IITCSSLGHSVDQYKFFVV

SEQ ID NO: 3040702 - protein, 28 aa, Entamoeba invadens
IIVRPMAALSDRIFGLLFKPESTEKVPV

SEQ ID NO: 3040703 - protein, 17 aa, Entamoeba invadens
IIVYPEIDLPAHAASWG

SEQ ID NO: 3040704 - protein, 17 aa, Entamoeba invadens
IKAKYGNYIVFHGMIGE

SEQ ID NO: 3040705 - protein, 24 aa, Entamoeba invadens
IKANGGLNIGGFGINLGSDSGLST

SEQ ID NO: 3040706 - protein, 19 aa, Entamoeba invadens
IKCDPTCRVCNGPNANNCL

SEQ ID NO: 3040707 - protein, 18 aa, Entamoeba invadens
IKCTIEGCAICEKVDECT

SEQ ID NO: 3040708 - protein, 23 aa, Entamoeba invadens
IKDELYNVIVLKTEYFNSLLKVL

SEQ ID NO: 3040709 - protein, 24 aa, Entamoeba invadens
IKDFPRFKWRGLMVDCARNPFTLS

SEQ ID NO: 3040710 - protein, 18 aa, Entamoeba invadens
IKECKWCNHEFILSNNTC

SEQ ID NO: 3040711 - protein, 17 aa, Entamoeba invadens
IKEGLKQGGKTALNYAK

SEQ ID NO: 3040712 - protein, 21 aa, Entamoeba invadens
IKEKVIRCEDMIRKEKSRFER

SEQ ID NO: 3040713 - protein, 17 aa, Entamoeba invadens
IKEMICNLITNFNLSQE

SEQ ID NO: 3040714 - protein, 24 aa, Entamoeba invadens
IKESVTLPGWYLLVLEMTDHKLFH

SEQ ID NO: 3040715 - protein, 22 aa, Entamoeba invadens
IKFEQNIDCGGGYIKLIPKSAI

SEQ ID NO: 3040716 - protein, 17 aa, Entamoeba invadens
IKFGNGVTHIGSKAFSE

SEQ ID NO: 3040717 - protein, 18 aa, Entamoeba invadens
IKFNKSFSAVESLRRRAI

SEQ ID NO: 3040718 - protein, 17 aa, Entamoeba invadens
IKFSSYPGVTHSLDDFW

SEQ ID NO: 3040719 - protein, 33 aa, Entamoeba invadens
IKGETRYPSFPLNLWSYCGVGAFQCSDKKSQQK

SEQ ID NO: 3040720 - protein, 23 aa, Entamoeba invadens
IKGNGPYPLEMLIKTGCVKTSVT

SEQ ID NO: 3040721 - protein, 17 aa, Entamoeba invadens
IKGNGPYPLENVNQTGC

SEQ ID NO: 3040722 - protein, 21 aa, Entamoeba invadens
IKGRLRLRSFLVPLAQEQLNP

SEQ ID NO: 3040723 - protein, 20 aa, Entamoeba invadens
IKIILQYCFDNCQKLKNISL

SEQ ID NO: 3040724 - protein, 20 aa, Entamoeba invadens
IKIISLDFEKVVMPTILEKV

SEQ ID NO: 3040725 - protein, 27 aa, Entamoeba invadens
IKISTCSTPAATPVKKWSNRPKTTCYT

SEQ ID NO: 3040726 - protein, 25 aa, Entamoeba invadens
IKKCLHPVLRYFAFQKYITENREKY

SEQ ID NO: 3040727 - protein, 18 aa, Entamoeba invadens
IKKLELATTLVLKDSLKN

SEQ ID NO: 3040728 - protein, 21 aa, Entamoeba invadens
IKKNEDIFNYFILSDQSSIIS

SEQ ID NO: 3040729 - protein, 17 aa, Entamoeba invadens
IKKSVCLSELADSITSD

SEQ ID NO: 3040730 - protein, 20 aa, Entamoeba invadens
IKKVVLLRKRVRQIEAQITE

SEQ ID NO: 3040731 - protein, 17 aa, Entamoeba invadens
IKLKAKYAKERQLGGVM

SEQ ID NO: 3040732 - protein, 18 aa, Entamoeba invadens
IKLLRMFDDQLAQNILLL

SEQ ID NO: 3040733 - protein, 17 aa, Entamoeba invadens
IKLPNGMNVISLQTAYF

SEQ ID NO: 3040734 - protein, 17 aa, Entamoeba invadens
IKLSNCEDYHPPKPYFT

SEQ ID NO: 3040735 - protein, 17 aa, Entamoeba invadens
IKLSPPKRVSRLSQDFL

SEQ ID NO: 3040736 - protein, 17 aa, Entamoeba invadens
IKMECRSAIDGLIRRLE

SEQ ID NO: 3040737 - protein, 20 aa, Entamoeba invadens
IKMRIKFMIDAAKGISYLHK

SEQ ID NO: 3040738 - protein, 20 aa, Entamoeba invadens
IKMYRRINIWKVLRRSKLKV

SEQ ID NO: 3040739 - protein, 22 aa, Entamoeba invadens
IKNEEKCMIVVAATLRAYKKRV

SEQ ID NO: 3040740 - protein, 23 aa, Entamoeba invadens
IKPDNILVFSLDFNYKVNAKLTD

SEQ ID NO: 3040741 - protein, 22 aa, Entamoeba invadens
IKPDNLLVFSFDINNRVNAKLT

SEQ ID NO: 3040742 - protein, 20 aa, Entamoeba invadens
IKPLLKEQIEKVWPSQHDVK

SEQ ID NO: 3040743 - protein, 21 aa, Entamoeba invadens
IKPNLKFLFVSTLMSSFSKMV

SEQ ID NO: 3040744 - protein, 18 aa, Entamoeba invadens
IKQKLQIEKSLARRVTIQ

SEQ ID NO: 3040745 - protein, 26 aa, Entamoeba invadens
IKRSEGTCRYRLFKVTVKKVDECEPF

SEQ ID NO: 3040746 - protein, 21 aa, Entamoeba invadens
IKRYKENVEEFGVLEEEERRE

SEQ ID NO: 3040747 - protein, 20 aa, Entamoeba invadens
IKSAESFLKGLFANNFQNYT

SEQ ID NO: 3040748 - protein, 18 aa, Entamoeba invadens
IKSKGIGSESSFPYTTKD

SEQ ID NO: 3040749 - protein, 19 aa, Entamoeba invadens
IKSKLRVARRLEQQLKMSS

SEQ ID NO: 3040750 - protein, 21 aa, Entamoeba invadens
IKSMINERMYLVFKTKFNETN

SEQ ID NO: 3040751 - protein, 25 aa, Entamoeba invadens
IKTALFLNSKFEFWKVLRESELKVE

SEQ ID NO: 3040752 - protein, 20 aa, Entamoeba invadens
IKTFNGSSIWWFAVVVSEHT

SEQ ID NO: 3040753 - protein, 17 aa, Entamoeba invadens
IKTGGFATDIGFWDVSR

SEQ ID NO: 3040754 - protein, 19 aa, Entamoeba invadens
IKTNSQITGVQWMNDKLIV

SEQ ID NO: 3040755 - protein, 17 aa, Entamoeba invadens
ILECNGINPSEDETYYP

SEQ ID NO: 3040756 - protein, 19 aa, Entamoeba invadens
ILFFMSIGYSISWCEENGV

SEQ ID NO: 3040757 - protein, 20 aa, Entamoeba invadens
ILHFDFPSTILSIGSNAFSE

SEQ ID NO: 3040758 - protein, 25 aa, Entamoeba invadens
ILKRSLKIEPVFECSEMTSIAEIRT

SEQ ID NO: 3040759 - protein, 17 aa, Entamoeba invadens
ILLLTGFSTDLKKYRKY

SEQ ID NO: 3040760 - protein, 17 aa, Entamoeba invadens
ILLSFIITTFGECVGMN

SEQ ID NO: 3040761 - protein, 17 aa, Entamoeba invadens
ILLVVCKDLTAQCNQLQ

SEQ ID NO: 3040762 - protein, 17 aa, Entamoeba invadens
ILMCCVYPRSDIEVEEQ

SEQ ID NO: 3040763 - protein, 20 aa, Entamoeba invadens
ILMCVLFTFLYFTTPQFLID

SEQ ID NO: 3040764 - protein, 19 aa, Entamoeba invadens
ILNHNCIYGDGTVCIKCET

SEQ ID NO: 3040765 - protein, 18 aa, Entamoeba invadens
ILPFIKYLIGREFEEAHS

SEQ ID NO: 3040766 - protein, 19 aa, Entamoeba invadens
ILQILRILSNFFFSSHTQL

SEQ ID NO: 3040767 - protein, 20 aa, Entamoeba invadens
ILQPPHFITPVAKPIITSKI

SEQ ID NO: 3040768 - protein, 20 aa, Entamoeba invadens
ILQREGAAFVNRTVNVTAFK

SEQ ID NO: 3040769 - protein, 25 aa, Entamoeba invadens
ILSTQTKLGFSYILGGVNGIYNFGF

SEQ ID NO: 3040770 - protein, 24 aa, Entamoeba invadens
ILTDGRCTPCWAGTYPNGDMCVEC

SEQ ID NO: 3040771 - protein, 23 aa, Entamoeba invadens
ILYKKGKQFRKMYGMYEYGQLKD

SEQ ID NO: 3040772 - protein, 20 aa, Entamoeba invadens
IMIFRTTARIAYLFIDGNVM

SEQ ID NO: 3040773 - protein, 22 aa, Entamoeba invadens
IMIIKNGVKFTVKCICNNSLPT

SEQ ID NO: 3040774 - protein, 17 aa, Entamoeba invadens
IMSVLQYQKLVPLFKYD

SEQ ID NO: 3040775 - protein, 24 aa, Entamoeba invadens
INDRAKVGMRVGRDEGRGNFVGIG

SEQ ID NO: 3040776 - protein, 18 aa, Entamoeba invadens
INFVFKGKDVYLRVVNTI

SEQ ID NO: 3040777 - protein, 21 aa, Entamoeba invadens
INGKCLQCYSGSMIVGSLCQK

SEQ ID NO: 3040778 - protein, 23 aa, Entamoeba invadens
INGKYKFNDKFSVNGNAQKTNTN

SEQ ID NO: 3040779 - protein, 18 aa, Entamoeba invadens
INGYAEFFLVSPTVLQLS

SEQ ID NO: 3040780 - protein, 17 aa, Entamoeba invadens
INHYACEKCSAGTYSPG

SEQ ID NO: 3040781 - protein, 17 aa, Entamoeba invadens
INLKTGFTMNMDIEITK

SEQ ID NO: 3040782 - protein, 17 aa, Entamoeba invadens
INPSVIISTQFGEMQIR

SEQ ID NO: 3040783 - protein, 17 aa, Entamoeba invadens
INPTLAFNDAIKNKDVI

SEQ ID NO: 3040784 - protein, 18 aa, Entamoeba invadens
INRQWKMSELSPFSTHLM

SEQ ID NO: 3040785 - protein, 24 aa, Entamoeba invadens
INRTKGVMPRSRYPYEAETQDCKE

SEQ ID NO: 3040786 - protein, 17 aa, Entamoeba invadens
INSLLLVENTRTCVEAC

SEQ ID NO: 3040787 - protein, 17 aa, Entamoeba invadens
INTLIHLRTLSLGSNSI

SEQ ID NO: 3040788 - protein, 26 aa, Entamoeba invadens
IPEECVRASPEFLLWQNVSFLSKNPI

SEQ ID NO: 3040789 - protein, 26 aa, Entamoeba invadens
IPEVVMVFGGLLMRGNRVTKTSASSL

SEQ ID NO: 3040790 - protein, 18 aa, Entamoeba invadens
IPFGQTFHKVETLLAKPM

SEQ ID NO: 3040791 - protein, 17 aa, Entamoeba invadens
IPIDFTLTMTSIYDNSL

SEQ ID NO: 3040792 - protein, 23 aa, Entamoeba invadens
IPIYFETTPSFGYTTNYLTNDVI

SEQ ID NO: 3040793 - protein, 17 aa, Entamoeba invadens
IPKVRDLLKEFFNGKEP

SEQ ID NO: 3040794 - protein, 19 aa, Entamoeba invadens
IPLLGLRQSQIENILDRRG

SEQ ID NO: 3040795 - protein, 18 aa, Entamoeba invadens
IPPKAVGALKKLIINLES

SEQ ID NO: 3040796 - protein, 23 aa, Entamoeba invadens
IPTERFLAIRSALPVTVEEDEEK

SEQ ID NO: 3040797 - protein, 21 aa, Entamoeba invadens
IPTTLPIDFDIPQSIRKDKTK

SEQ ID NO: 3040798 - protein, 24 aa, Entamoeba invadens
IPTVPPRVTVQQLFPSTTPETQPK

SEQ ID NO: 3040799 - protein, 18 aa, Entamoeba invadens
IPVFEGMPNLAPIITKIA

SEQ ID NO: 3040800 - protein, 17 aa, Entamoeba invadens
IPVTFSFHNLHLEAIQK

SEQ ID NO: 3040801 - protein, 21 aa, Entamoeba invadens
IPWPPESGVTIIITMNITTSE

SEQ ID NO: 3040802 - protein, 17 aa, Entamoeba invadens
IQFGDFVYFTAGDLDGE

SEQ ID NO: 3040803 - protein, 17 aa, Entamoeba invadens
IQIKALLDKLDSFQMCR

SEQ ID NO: 3040804 - protein, 20 aa, Entamoeba invadens
IQKDFKELRVEMEIDGDYEF

SEQ ID NO: 3040805 - protein, 24 aa, Entamoeba invadens
IQKMLKMKILRLRDRYNRKKQIQI

SEQ ID NO: 3040806 - protein, 17 aa, Entamoeba invadens
IQLDKYHMMVCVKYFNT

SEQ ID NO: 3040807 - protein, 17 aa, Entamoeba invadens
IQPSGLFYSNEKEVQLL

SEQ ID NO: 3040808 - protein, 18 aa, Entamoeba invadens
IQQAGLHWQPVLSFHACG

SEQ ID NO: 3040809 - protein, 24 aa, Entamoeba invadens
IQQFAENANHEFMRVNIDPELRED

SEQ ID NO: 3040810 - protein, 24 aa, Entamoeba invadens
IQQFFEIGTLPIIYYFMDSSSVQV

SEQ ID NO: 3040811 - protein, 20 aa, Entamoeba invadens
IQVIGPFIVRNGYHRSVVVE

SEQ ID NO: 3040812 - protein, 19 aa, Entamoeba invadens
IQYNIKFEQNIDCGGGYIK

SEQ ID NO: 3040813 - protein, 19 aa, Entamoeba invadens
IRCALEFPESELLEKMQNG

SEQ ID NO: 3040814 - protein, 24 aa, Entamoeba invadens
IRCTRGEGVGEFIVDEISNYPMTI

SEQ ID NO: 3040815 - protein, 23 aa, Entamoeba invadens
IREINRRKRLILAEQLKAAKITR

SEQ ID NO: 3040816 - protein, 22 aa, Entamoeba invadens
IRKIAVPCYKMITPPDEGADVE

SEQ ID NO: 3040817 - protein, 26 aa, Entamoeba invadens
IRKRSIRIGLSLQRHVIKKARKGSKR

SEQ ID NO: 3040818 - protein, 23 aa, Entamoeba invadens
IRLPDKYYGLFLGYAMDAYGLNP

SEQ ID NO: 3040819 - protein, 17 aa, Entamoeba invadens
IRLSSYYDDIFYWCTKL

SEQ ID NO: 3040820 - protein, 19 aa, Entamoeba invadens
IRLVEDISIAMEFLHEKQI

SEQ ID NO: 3040821 - protein, 21 aa, Entamoeba invadens
IRNAVSFCRRYNFDGIDIDWE

SEQ ID NO: 3040822 - protein, 25 aa, Entamoeba invadens
IRNKWMSLQRCRFAIYQFDKHGTCS

SEQ ID NO: 3040823 - protein, 28 aa, Entamoeba invadens
IRPRLKHKMREVIKVLPKREQYRLIRRM

SEQ ID NO: 3040824 - protein, 18 aa, Entamoeba invadens
IRQLYKIAPVVLIGTMFD

SEQ ID NO: 3040825 - protein, 25 aa, Entamoeba invadens
IRTNWKSERSVCEWYGVECEDGKVL

SEQ ID NO: 3040826 - protein, 26 aa, Entamoeba invadens
IRVFKKGCIPFCGICSKNEVCNKNAK

SEQ ID NO: 3040827 - protein, 20 aa, Entamoeba invadens
IRVGRLGYTSAQPVYKKLRT

SEQ ID NO: 3040828 - protein, 23 aa, Entamoeba invadens
ISALQFVLLFIFVYCYSVNTNGI

SEQ ID NO: 3040829 - protein, 23 aa, Entamoeba invadens
ISATLFRSICRTMETCSLLFPNG

SEQ ID NO: 3040830 - protein, 31 aa, Entamoeba invadens
ISDAGVVSKIWNWGCSHMLSGLQGYNSQTQS

SEQ ID NO: 3040831 - protein, 18 aa, Entamoeba invadens
ISENIFLTNDCYAPSTDP

SEQ ID NO: 3040832 - protein, 17 aa, Entamoeba invadens
ISFSDGSIFVFGNLKVT

SEQ ID NO: 3040833 - protein, 25 aa, Entamoeba invadens
ISGGYCLKGEVPNCYEYRSHEYLHS

SEQ ID NO: 3040834 - protein, 18 aa, Entamoeba invadens
ISGKFYIQYVYDEDKNTV

SEQ ID NO: 3040835 - protein, 19 aa, Entamoeba invadens
ISGMVKWNDLVFVTLENYD

SEQ ID NO: 3040836 - protein, 17 aa, Entamoeba invadens
ISHLRSQLVVLHTRKLA

SEQ ID NO: 3040837 - protein, 17 aa, Entamoeba invadens
ISHSMGGLMSYKLLDYV

SEQ ID NO: 3040838 - protein, 19 aa, Entamoeba invadens
ISHYRMCFPKRKKIERFHY

SEQ ID NO: 3040839 - protein, 19 aa, Entamoeba invadens
ISINSFDGDMLWAHDPNYR

SEQ ID NO: 3040840 - protein, 21 aa, Entamoeba invadens
ISISVKTVFGLRHAFETFIQL

SEQ ID NO: 3040841 - protein, 18 aa, Entamoeba invadens
ISLFKLSENALFSVQGNV

SEQ ID NO: 3040842 - protein, 18 aa, Entamoeba invadens
ISLLSRYALQTTSSGIFV

SEQ ID NO: 3040843 - protein, 24 aa, Entamoeba invadens
ISPLKNVISKKVEWIEDKVKQIGK

SEQ ID NO: 3040844 - protein, 21 aa, Entamoeba invadens
ISRRKHRRSTYAVSEYQKKLK

SEQ ID NO: 3040845 - protein, 26 aa, Entamoeba invadens
ISSTHCITCPLGYYLSNNTCNTNAKL

SEQ ID NO: 3040846 - protein, 21 aa, Entamoeba invadens
ISVFIAIFLVLVRLYAAGGVN

SEQ ID NO: 3040847 - protein, 17 aa, Entamoeba invadens
ISVFSSLVIIFFTLTLF

SEQ ID NO: 3040848 - protein, 23 aa, Entamoeba invadens
ISVLSGFYTMKVIKRSEGTCRYR

SEQ ID NO: 3040849 - protein, 24 aa, Entamoeba invadens
ITAFNLKAVCYVSPSNFFIQKDNL

SEQ ID NO: 3040850 - protein, 21 aa, Entamoeba invadens
ITFYETLKWGEAYDKNEFKFP

SEQ ID NO: 3040851 - protein, 25 aa, Entamoeba invadens
ITHAWGEGIDFIFCTECVARNNYIH

SEQ ID NO: 3040852 - protein, 19 aa, Entamoeba invadens
ITIESGWFDCNKEWEGRDD

SEQ ID NO: 3040853 - protein, 18 aa, Entamoeba invadens
ITINSFDGNTIWAHDPNW

SEQ ID NO: 3040854 - protein, 20 aa, Entamoeba invadens
ITKCPSGLVCKCGKTAYNPC

SEQ ID NO: 3040855 - protein, 17 aa, Entamoeba invadens
ITLKYFFIQTRFRDSRI

SEQ ID NO: 3040856 - protein, 17 aa, Entamoeba invadens
ITLSVCFGQPEKPKTPT

SEQ ID NO: 3040857 - protein, 19 aa, Entamoeba invadens
ITMNPSWRVNKKVDLGGNT

SEQ ID NO: 3040858 - protein, 24 aa, Entamoeba invadens
ITMYECFTWTNAYPKEYFKFPWTI

SEQ ID NO: 3040859 - protein, 17 aa, Entamoeba invadens
ITNCPYQNLPFAVATKI

SEQ ID NO: 3040860 - protein, 28 aa, Entamoeba invadens
ITNPMLLWYFYRVNYRFQSELLDFIKPV

SEQ ID NO: 3040861 - protein, 23 aa, Entamoeba invadens
ITQNKFFVVYTFIETDNIIIESE

SEQ ID NO: 3040862 - protein, 22 aa, Entamoeba invadens
ITSIGKFYFKKNLVINTQIIIS

SEQ ID NO: 3040863 - protein, 19 aa, Entamoeba invadens
ITSNITLLVMKNELQEIQK

SEQ ID NO: 3040864 - protein, 20 aa, Entamoeba invadens
ITSVKGGSLFGVIQPTVPLT

SEQ ID NO: 3040865 - protein, 17 aa, Entamoeba invadens
ITTIMALANDSFPNAKR

SEQ ID NO: 3040866 - protein, 27 aa, Entamoeba invadens
ITTKSEGDCAMFFKQLCYSVFTEDAMT

SEQ ID NO: 3040867 - protein, 24 aa, Entamoeba invadens
ITTLKSACSFALPGDTIEFLTGNY

SEQ ID NO: 3040868 - protein, 21 aa, Entamoeba invadens
ITTNFNLVVLLGMTVDYGKGL

SEQ ID NO: 3040869 - protein, 24 aa, Entamoeba invadens
ITVPGCIGCSVVSSPITPNTLLDC

SEQ ID NO: 3040870 - protein, 17 aa, Entamoeba invadens
IVANLKLDRRFTNADQA

SEQ ID NO: 3040871 - protein, 21 aa, Entamoeba invadens
IVASAFDFDSWVIKFNKRFSA

SEQ ID NO: 3040872 - protein, 18 aa, Entamoeba invadens
IVCVTCEMGGNQMSPKVT

SEQ ID NO: 3040873 - protein, 18 aa, Entamoeba invadens
IVDHKEIFPNPKDLPVFN

SEQ ID NO: 3040874 - protein, 22 aa, Entamoeba invadens
IVGCSVCKTGTPITCTTCKPGY

SEQ ID NO: 3040875 - protein, 28 aa, Entamoeba invadens
IVIPASRFVWYFVKDRWDNLTLIKNVTI

SEQ ID NO: 3040876 - protein, 22 aa, Entamoeba invadens
IVKQKLCYDRIPNYTHVIHGYD

SEQ ID NO: 3040877 - protein, 17 aa, Entamoeba invadens
IVMWEIDTDLGINPSMI

SEQ ID NO: 3040878 - protein, 19 aa, Entamoeba invadens
IVNLVCPYYDKSYVCPSWV

SEQ ID NO: 3040879 - protein, 25 aa, Entamoeba invadens
IVNTIMLRYMIPFHFGVVPVSLPET

SEQ ID NO: 3040880 - protein, 17 aa, Entamoeba invadens
IVRTLRLSKEYFNLLNV

SEQ ID NO: 3040881 - protein, 17 aa, Entamoeba invadens
IVSNGRLIRYCPDKYAT

SEQ ID NO: 3040882 - protein, 18 aa, Entamoeba invadens
IVTFHKWFYGINPSVIIS

SEQ ID NO: 3040883 - protein, 26 aa, Entamoeba invadens
IVTHSMGGLLLYKFLDFVGKKFCNKY

SEQ ID NO: 3040884 - protein, 25 aa, Entamoeba invadens
IVTQAKWYGLTAFTYLRMTRALLDD

SEQ ID NO: 3040885 - protein, 18 aa, Entamoeba invadens
IVTTRIGIEATITDVKVD

SEQ ID NO: 3040886 - protein, 17 aa, Entamoeba invadens
IVTTRIGIEATVTDVKV

SEQ ID NO: 3040887 - protein, 18 aa, Entamoeba invadens
IVVNLEIPDNVMTERILS

SEQ ID NO: 3040888 - protein, 32 aa, Entamoeba invadens
IVYSNLWKDWHPWLLWVLSPSFYIFWKNPKEA

SEQ ID NO: 3040889 - protein, 23 aa, Entamoeba invadens
IWELVSKLKTIAFYKPSDIPLMF

SEQ ID NO: 3040890 - protein, 26 aa, Entamoeba invadens
IWSAECYPACGSCGRKEYCSEEGKCV

SEQ ID NO: 3040891 - protein, 19 aa, Entamoeba invadens
IYDEPKCKYVDHVVSVVGY

SEQ ID NO: 3040892 - protein, 17 aa, Entamoeba invadens
IYFKNPNVWFTIKDRAV

SEQ ID NO: 3040893 - protein, 17 aa, Entamoeba invadens
IYINSGYLKKVKLGKKE

SEQ ID NO: 3040894 - protein, 17 aa, Entamoeba invadens
IYKLTGNNFDEFIATKG

SEQ ID NO: 3040895 - protein, 21 aa, Entamoeba invadens
IYMYRCPKVLLIFAKHVFPGL

SEQ ID NO: 3040896 - protein, 18 aa, Entamoeba invadens
IYNSTRWAMFASGTNITI

SEQ ID NO: 3040897 - protein, 19 aa, Entamoeba invadens
IYQTFPTVKIYLERVNKSV

SEQ ID NO: 3040898 - protein, 19 aa, Entamoeba invadens
IYSSLKFADFFDFNGNSTM

SEQ ID NO: 3040899 - protein, 17 aa, Entamoeba invadens
KAAEALKSPFDYKKNIK

SEQ ID NO: 3040900 - protein, 17 aa, Entamoeba invadens
KAALKPKGKKCMKQTDC

SEQ ID NO: 3040901 - protein, 23 aa, Entamoeba invadens
KAEQRFAVEFLRIKKHQDHLKQH

SEQ ID NO: 3040902 - protein, 21 aa, Entamoeba invadens
KAHSKLSDFVLTLLQFHVKQT

SEQ ID NO: 3040903 - protein, 18 aa, Entamoeba invadens
KAKGSRVLIVYTGGTIGM

SEQ ID NO: 3040904 - protein, 21 aa, Entamoeba invadens
KAKPFKKTMCITDDSLKLFSL

SEQ ID NO: 3040905 - protein, 22 aa, Entamoeba invadens
KAKVPLNYCDDFFFMNELTNNR

SEQ ID NO: 3040906 - protein, 22 aa, Entamoeba invadens
KALDLRSGFPSRVENTGSNNGY

SEQ ID NO: 3040907 - protein, 17 aa, Entamoeba invadens
KAPKLKQRLFFTSLSLK

SEQ ID NO: 3040908 - protein, 19 aa, Entamoeba invadens
KAQVMLYNYSAIDFISGIK

SEQ ID NO: 3040909 - protein, 21 aa, Entamoeba invadens
KARVLPRKTVSTIKKVGEKAE

SEQ ID NO: 3040910 - protein, 25 aa, Entamoeba invadens
KASKECDLMVWALFKNLKKTLKMTT

SEQ ID NO: 3040911 - protein, 18 aa, Entamoeba invadens
KASLLERAGIKVVVIIDR

SEQ ID NO: 3040912 - protein, 17 aa, Entamoeba invadens
KAWEIKRQKLGLPKNNK

SEQ ID NO: 3040913 - protein, 24 aa, Entamoeba invadens
KCDMTCLTCSSYGICESCISSENA

SEQ ID NO: 3040914 - protein, 21 aa, Entamoeba invadens
KCEKCGIVGCSLCNSTGIDCL

SEQ ID NO: 3040915 - protein, 25 aa, Entamoeba invadens
KCEKCISEQCLKCDNSYEESCLRCK

SEQ ID NO: 3040916 - protein, 23 aa, Entamoeba invadens
KCEKCKPGFWIEDFECVTCETCG

SEQ ID NO: 3040917 - protein, 34 aa, Entamoeba invadens
KCENCANTNCLKCNSDVCRLCQTGYVLNDTKNCV

SEQ ID NO: 3040918 - protein, 23 aa, Entamoeba invadens
KCETNICSPADAISEMKTDLFPK

SEQ ID NO: 3040919 - protein, 19 aa, Entamoeba invadens
KCGDKVMFLDFPKYLLDLE

SEQ ID NO: 3040920 - protein, 19 aa, Entamoeba invadens
KCGSCDLGMVCNNHGKCMY

SEQ ID NO: 3040921 - protein, 18 aa, Entamoeba invadens
KCIACKPNYYIKMSGDYK

SEQ ID NO: 3040922 - protein, 19 aa, Entamoeba invadens
KCIKCIIEGCATCEKVNEC

SEQ ID NO: 3040923 - protein, 18 aa, Entamoeba invadens
KCKCKTGYYTTSWDACVP

SEQ ID NO: 3040924 - protein, 24 aa, Entamoeba invadens
KCKGGHPSNAFAFIKSNNGITLEE

SEQ ID NO: 3040925 - protein, 20 aa, Entamoeba invadens
KCKYVDHVVSVVGYGSQNGN

SEQ ID NO: 3040926 - protein, 20 aa, Entamoeba invadens
KCLDFKQKHLHRWMKETYGI

SEQ ID NO: 3040927 - protein, 23 aa, Entamoeba invadens
KCLSVCPAGRVVDVTNKVCYDSC

SEQ ID NO: 3040928 - protein, 27 aa, Entamoeba invadens
KCMKQTDCKICRKLGKVAKYGITRHES

SEQ ID NO: 3040929 - protein, 33 aa, Entamoeba invadens
KCNEMYKKLEGVVHPILRRYGAIHHTKDEKVGN

SEQ ID NO: 3040930 - protein, 20 aa, Entamoeba invadens
KCTKPKCNCQKIKKLKIKVH

SEQ ID NO: 3040931 - protein, 17 aa, Entamoeba invadens
KCTSCPNNALLLEDTGK

SEQ ID NO: 3040932 - protein, 18 aa, Entamoeba invadens
KCVECLTPNRQCRVCTNG

SEQ ID NO: 3040933 - protein, 18 aa, Entamoeba invadens
KCVVCGYGDLENGVCDVE

SEQ ID NO: 3040934 - protein, 22 aa, Entamoeba invadens
KCYCESKLAMAMFAKQLSIKNN

SEQ ID NO: 3040935 - protein, 24 aa, Entamoeba invadens
KDAGLKLQVVMSFHKCGGNVGDTC

SEQ ID NO: 3040936 - protein, 17 aa, Entamoeba invadens
KDCDRTKDWSRVWVDAD

SEQ ID NO: 3040937 - protein, 21 aa, Entamoeba invadens
KDDALNFSVVMQPFPRWGNFQ

SEQ ID NO: 3040938 - protein, 22 aa, Entamoeba invadens
KDDEIKEKEELTGINEEKKTSQ

SEQ ID NO: 3040939 - protein, 20 aa, Entamoeba invadens
KDDYFGYFVIYIVDKCYVTG

SEQ ID NO: 3040940 - protein, 26 aa, Entamoeba invadens
KDFATKYIKRWAAMSTPWIGSVKATA

SEQ ID NO: 3040941 - protein, 17 aa, Entamoeba invadens
KDFKYGKDFTYEHEITT

SEQ ID NO: 3040942 - protein, 17 aa, Entamoeba invadens
KDFRISLFSVIDIPHIT

SEQ ID NO: 3040943 - protein, 27 aa, Entamoeba invadens
KDKKFSFNQHLRRAIELLKEYIQRIKS

SEQ ID NO: 3040944 - protein, 24 aa, Entamoeba invadens
KDKSRLSLKNIIYFNDTVLVVMNQ

SEQ ID NO: 3040945 - protein, 20 aa, Entamoeba invadens
KDKVDFFSWQLWRFNPDLKT

SEQ ID NO: 3040946 - protein, 26 aa, Entamoeba invadens
KDKYYKSIRFMVRFDDSGDVKYLPLN

SEQ ID NO: 3040947 - protein, 17 aa, Entamoeba invadens
KDLCGKFGISGFPTLKF

SEQ ID NO: 3040948 - protein, 29 aa, Entamoeba invadens
KDLKKNGWMAKLDKIKCPEERRKMYEKLK

SEQ ID NO: 3040949 - protein, 18 aa, Entamoeba invadens
KDQFSSLQFYVKSSSCEK

SEQ ID NO: 3040950 - protein, 24 aa, Entamoeba invadens
KDQGSCGSCYIFGAVATVESRLLM

SEQ ID NO: 3040951 - protein, 24 aa, Entamoeba invadens
KDTRRRVIEYGLTPDEGFKKMTPE

SEQ ID NO: 3040952 - protein, 19 aa, Entamoeba invadens
KDTVVCKISRKFYERSLQR

SEQ ID NO: 3040953 - protein, 20 aa, Entamoeba invadens
KDWVRMAVVVNENYDKYDGF

SEQ ID NO: 3040954 - protein, 17 aa, Entamoeba invadens
KDYEIVGWFAAMANCEP

SEQ ID NO: 3040955 - protein, 19 aa, Entamoeba invadens
KDYNSVLFTPTLNGSFYNS

SEQ ID NO: 3040956 - protein, 19 aa, Entamoeba invadens
KEAEKQATFAIKRAKNQNI

SEQ ID NO: 3040957 - protein, 18 aa, Entamoeba invadens
KEAHEIIENIKMLKNNLE

SEQ ID NO: 3040958 - protein, 18 aa, Entamoeba invadens
KEAVGDYRRGVVIEESGK

SEQ ID NO: 3040959 - protein, 21 aa, Entamoeba invadens
KEAYRNAFRKTLKGMRKGHPC

SEQ ID NO: 3040960 - protein, 25 aa, Entamoeba invadens
KECEFMGKAGWLGVKVFPPQDSVIS

SEQ ID NO: 3040961 - protein, 26 aa, Entamoeba invadens
KEDFCYEGRTSFYIFRINEDDTVELH

SEQ ID NO: 3040962 - protein, 26 aa, Entamoeba invadens
KEEVQGFPTLILFRKGRAKKVYGGER

SEQ ID NO: 3040963 - protein, 17 aa, Entamoeba invadens
KEFDDTYIIPRIKDDIN

SEQ ID NO: 3040964 - protein, 20 aa, Entamoeba invadens
KEFEKEVAMLDKFRNEYIVH

SEQ ID NO: 3040965 - protein, 21 aa, Entamoeba invadens
KEGFILHGYWPHYYKNRNLFC

SEQ ID NO: 3040966 - protein, 18 aa, Entamoeba invadens
KEGRKCDDFVQFKKFPEY

SEQ ID NO: 3040967 - protein, 18 aa, Entamoeba invadens
KEHCKAHNYKGLVVDGVF

SEQ ID NO: 3040968 - protein, 20 aa, Entamoeba invadens
KEHKEIVAVHVHPGIVYSNL

SEQ ID NO: 3040969 - protein, 23 aa, Entamoeba invadens
KEIDSRFVGDGICDCCDGSDEAQ

SEQ ID NO: 3040970 - protein, 21 aa, Entamoeba invadens
KEIERQKLLKAKEEEELNKIE

SEQ ID NO: 3040971 - protein, 25 aa, Entamoeba invadens
KEIGSLFEIKICFDIDIDKYDPKPR

SEQ ID NO: 3040972 - protein, 21 aa, Entamoeba invadens
KEIQIGMGIKGETRYPSFPLN

SEQ ID NO: 3040973 - protein, 17 aa, Entamoeba invadens
KEITTIMALANDSFPNA

SEQ ID NO: 3040974 - protein, 21 aa, Entamoeba invadens
KEKCDICINGYYIYDNSCFVC

SEQ ID NO: 3040975 - protein, 19 aa, Entamoeba invadens
KEKCLTCRNDLEMTASGLC

SEQ ID NO: 3040976 - protein, 32 aa, Entamoeba invadens
KEKEDYVVLPYKLKVRMLFDTARGMQFLHENR

SEQ ID NO: 3040977 - protein, 19 aa, Entamoeba invadens
KEKELPKESPIPPQTPQKE

SEQ ID NO: 3040978 - protein, 19 aa, Entamoeba invadens
KEKHLKEARSLLAGLPEMS

SEQ ID NO: 3040979 - protein, 26 aa, Entamoeba invadens
KEKLGAECDCMKKTMAELEEIAKLNE

SEQ ID NO: 3040980 - protein, 26 aa, Entamoeba invadens
KEKLGAECDCMKKTMAELEENLKKEQ

SEQ ID NO: 3040981 - protein, 18 aa, Entamoeba invadens
KENFELATKQRKEMTSQK

SEQ ID NO: 3040982 - protein, 19 aa, Entamoeba invadens
KENIKVEFLIEVFINNLTI

SEQ ID NO: 3040983 - protein, 25 aa, Entamoeba invadens
KENSFIKWWVCFWWGSKNEKKTLEI

SEQ ID NO: 3040984 - protein, 29 aa, Entamoeba invadens
KERFFLHGLWPNFWANQNMLCCSTYYTPL

SEQ ID NO: 3040985 - protein, 17 aa, Entamoeba invadens
KERTLLTHLQCALIAFI

SEQ ID NO: 3040986 - protein, 21 aa, Entamoeba invadens
KESLTMSGVKQKGCATAVVSR

SEQ ID NO: 3040987 - protein, 23 aa, Entamoeba invadens
KESVTLPGWYLLVLEMTDHKLYH

SEQ ID NO: 3040988 - protein, 22 aa, Entamoeba invadens
KESVTLPGWYSLVLEMTDNNLY

SEQ ID NO: 3040989 - protein, 20 aa, Entamoeba invadens
KETKIHKSVDFIRSQTRLGD

SEQ ID NO: 3040990 - protein, 35 aa, Entamoeba invadens
KETKSVVKQMLINILSFFSAHSFGKNHNHNNATQS

SEQ ID NO: 3040991 - protein, 19 aa, Entamoeba invadens
KETLARQELDRIQWRKKLA

SEQ ID NO: 3040992 - protein, 23 aa, Entamoeba invadens
KETPMMIRIYRIVHRENNDSNPL

SEQ ID NO: 3040993 - protein, 25 aa, Entamoeba invadens
KEVCERFGYKRFLFFEKSYKTTYLS

SEQ ID NO: 3040994 - protein, 20 aa, Entamoeba invadens
KEVESFFAIASGLYDFTVGL

SEQ ID NO: 3040995 - protein, 24 aa, Entamoeba invadens
KEVIPLDLFLNASRTFESVYAMAP

SEQ ID NO: 3040996 - protein, 31 aa, Entamoeba invadens
KEVYCDVCSIGYFPEAVCKICSEISGCDQCV

SEQ ID NO: 3040997 - protein, 25 aa, Entamoeba invadens
KEYKVIGYFSAWAQYRNGQLGKSNF

SEQ ID NO: 3040998 - protein, 19 aa, Entamoeba invadens
KEYVEKKATMAYTSTHSKI

SEQ ID NO: 3040999 - protein, 18 aa, Entamoeba invadens
KFDFDLDFFSQDDIFGET

SEQ ID NO: 3041000 - protein, 17 aa, Entamoeba invadens
KFERVWFDIEGTWTGSY

SEQ ID NO: 3041001 - protein, 20 aa, Entamoeba invadens
KFGKIWKRLIVISLTSISCN

SEQ ID NO: 3041002 - protein, 21 aa, Entamoeba invadens
KFGYKCFKIEANLNKDGADVV

SEQ ID NO: 3041003 - protein, 19 aa, Entamoeba invadens
KFHLERYGMEMDRVKIVRK

SEQ ID NO: 3041004 - protein, 24 aa, Entamoeba invadens
KFLDSRLTANLFRRRSEDRYFKGQ

SEQ ID NO: 3041005 - protein, 20 aa, Entamoeba invadens
KFLTYILIVKYSIYSNTKSV

SEQ ID NO: 3041006 - protein, 22 aa, Entamoeba invadens
KFLVLDFPNLVFFDKKNKETTY

SEQ ID NO: 3041007 - protein, 24 aa, Entamoeba invadens
KFNLKFKKVCLGSSSFTKRLNELL

SEQ ID NO: 3041008 - protein, 20 aa, Entamoeba invadens
KFVMNGGLIVGTWDGANVEI

SEQ ID NO: 3041009 - protein, 19 aa, Entamoeba invadens
KGDSIVIRCALEFPESELL

SEQ ID NO: 3041010 - protein, 23 aa, Entamoeba invadens
KGECKGVSVIEGMYRGCTVFPDN

SEQ ID NO: 3041011 - protein, 20 aa, Entamoeba invadens
KGEFGLMIAITVDYAKGLTG

SEQ ID NO: 3041012 - protein, 24 aa, Entamoeba invadens
KGFSPRLFNKWNYDEVHVPDMSLV

SEQ ID NO: 3041013 - protein, 19 aa, Entamoeba invadens
KGGNGDCGTFFTKLLPKVF

SEQ ID NO: 3041014 - protein, 25 aa, Entamoeba invadens
KGHGKKCERCFELAKTVRIGTFNGW

SEQ ID NO: 3041015 - protein, 18 aa, Entamoeba invadens
KGHPCKPTTVIVTPVELV

SEQ ID NO: 3041016 - protein, 17 aa, Entamoeba invadens
KGIQVWDEMVAKYQIKA

SEQ ID NO: 3041017 - protein, 19 aa, Entamoeba invadens
KGITLEASYPYKAADGTCN

SEQ ID NO: 3041018 - protein, 21 aa, Entamoeba invadens
KGKCQKDSLGNYVVISEIVQP

SEQ ID NO: 3041019 - protein, 24 aa, Entamoeba invadens
KGKDIKLPLLPPLRPKTPKPTEEQ

SEQ ID NO: 3041020 - protein, 26 aa, Entamoeba invadens
KGKKEESVCLASFMRMDVLDVKKELP

SEQ ID NO: 3041021 - protein, 31 aa, Entamoeba invadens
KGNITFTSLFTWQRIMSAIYFAKTAQRVLHA

SEQ ID NO: 3041022 - protein, 18 aa, Entamoeba invadens
KGNSCPRGDAYVRQEHIE

SEQ ID NO: 3041023 - protein, 20 aa, Entamoeba invadens
KGPSDLHLSLKIADSTNYKI

SEQ ID NO: 3041024 - protein, 20 aa, Entamoeba invadens
KGVDKLVIFCVERVEVCKYF

SEQ ID NO: 3041025 - protein, 19 aa, Entamoeba invadens
KGVIFPTEVYCHINDSNFN

SEQ ID NO: 3041026 - protein, 19 aa, Entamoeba invadens
KGYGYYGSQFISGRYPFIY

SEQ ID NO: 3041027 - protein, 22 aa, Entamoeba invadens
KHCTIKGSGPYPIEMLIKPGCV

SEQ ID NO: 3041028 - protein, 23 aa, Entamoeba invadens
KHCTIKGSGPYPIEMLIKPGCVK

SEQ ID NO: 3041029 - protein, 18 aa, Entamoeba invadens
KHDLTRLAKLNIELQKVE

SEQ ID NO: 3041030 - protein, 20 aa, Entamoeba invadens
KHGTCALSTYRGRDGPFDYM

SEQ ID NO: 3041031 - protein, 21 aa, Entamoeba invadens
KHGTCSSSVYGGENGHFDYIQ

SEQ ID NO: 3041032 - protein, 26 aa, Entamoeba invadens
KHHNKRISLTHSQSFCNTAQVNVAEQ

SEQ ID NO: 3041033 - protein, 17 aa, Entamoeba invadens
KHILVKLQNIFSVDSNS

SEQ ID NO: 3041034 - protein, 18 aa, Entamoeba invadens
KHIQTMLILLGFSCGSSG

SEQ ID NO: 3041035 - protein, 25 aa, Entamoeba invadens
KHLHRWMKETYGINVADQYKNNGSL

SEQ ID NO: 3041036 - protein, 18 aa, Entamoeba invadens
KHLQCCHTKYGIRDIEKM

SEQ ID NO: 3041037 - protein, 17 aa, Entamoeba invadens
KHNKCLDDDTLLEKLWD

SEQ ID NO: 3041038 - protein, 21 aa, Entamoeba invadens
KHVFPGLIPLGIIKKFAQSVL

SEQ ID NO: 3041039 - protein, 20 aa, Entamoeba invadens
KIAPVVLIGTMFDLREDKIK

SEQ ID NO: 3041040 - protein, 25 aa, Entamoeba invadens
KIDGTNCKRLIDLIQRNSPLQITTK

SEQ ID NO: 3041041 - protein, 23 aa, Entamoeba invadens
KIEEGFMLHGLWPQLEINRNYVC

SEQ ID NO: 3041042 - protein, 23 aa, Entamoeba invadens
KIFGWGELNNVIGLNYYGSSDEW

SEQ ID NO: 3041043 - protein, 19 aa, Entamoeba invadens
KIHSLCSTEFLILNMDSSE

SEQ ID NO: 3041044 - protein, 24 aa, Entamoeba invadens
KIICDRYKVFVEMSGAMGSRTKYQ

SEQ ID NO: 3041045 - protein, 17 aa, Entamoeba invadens
KIKREAKVLKALAITDF

SEQ ID NO: 3041046 - protein, 23 aa, Entamoeba invadens
KIKYINCTFLKYVEIYFVEQRKA

SEQ ID NO: 3041047 - protein, 23 aa, Entamoeba invadens
KILPFEYLTNFLIVSNGRLIRYC

SEQ ID NO: 3041048 - protein, 18 aa, Entamoeba invadens
KIMKVVRGPEPFSEPPKG

SEQ ID NO: 3041049 - protein, 25 aa, Entamoeba invadens
KINKFWKYMNWGVCVDAYNCYMDDF

SEQ ID NO: 3041050 - protein, 23 aa, Entamoeba invadens
KIRGIVAEGFFSNSIYDGNEKKY

SEQ ID NO: 3041051 - protein, 17 aa, Entamoeba invadens
KIRPALNAKVVFETATS

SEQ ID NO: 3041052 - protein, 24 aa, Entamoeba invadens
KIVLNRMFYNLGFEQAYPAIGFST

SEQ ID NO: 3041053 - protein, 18 aa, Entamoeba invadens
KIVSITLPQSLVFFDKVK

SEQ ID NO: 3041054 - protein, 19 aa, Entamoeba invadens
KIYLERVNKSVLFEKDSPK

SEQ ID NO: 3041055 - protein, 21 aa, Entamoeba invadens
KKAEIKAHLLGLNEQQKVKLI

SEQ ID NO: 3041056 - protein, 18 aa, Entamoeba invadens
KKAFKALRKRHKKEKKPL

SEQ ID NO: 3041057 - protein, 24 aa, Entamoeba invadens
KKAGKKFGILGYMVGEIWDNAANI

SEQ ID NO: 3041058 - protein, 21 aa, Entamoeba invadens
KKAKGYTSTTCGNWHDEGSFD

SEQ ID NO: 3041059 - protein, 20 aa, Entamoeba invadens
KKALSTSLVLFWVLKENAKI

SEQ ID NO: 3041060 - protein, 18 aa, Entamoeba invadens
KKATMAYTSTHSKIVQRI

SEQ ID NO: 3041061 - protein, 25 aa, Entamoeba invadens
KKAYLKAFRIVQRFIEKETLRGLSI

SEQ ID NO: 3041062 - protein, 20 aa, Entamoeba invadens
KKCDCKYGYVSEFGKVDICM

SEQ ID NO: 3041063 - protein, 17 aa, Entamoeba invadens
KKCDDRAVLKDGICSNE

SEQ ID NO: 3041064 - protein, 22 aa, Entamoeba invadens
KKCEVKSCKACRTNCAECTNAT

SEQ ID NO: 3041065 - protein, 24 aa, Entamoeba invadens
KKCVKGNCPDMYFKDNAEKMCKRC

SEQ ID NO: 3041066 - protein, 19 aa, Entamoeba invadens
KKDLPFLVVRSEADDPIRK

SEQ ID NO: 3041067 - protein, 18 aa, Entamoeba invadens
KKEGYCMSNSASSGFIFI

SEQ ID NO: 3041068 - protein, 20 aa, Entamoeba invadens
KKELGAVPEDVRNNIIANLK

SEQ ID NO: 3041069 - protein, 24 aa, Entamoeba invadens
KKESCAYLGDPKCTIWTKLNNKMI

SEQ ID NO: 3041070 - protein, 23 aa, Entamoeba invadens
KKFFPYQKVRPLASGFVNNAPKI

SEQ ID NO: 3041071 - protein, 20 aa, Entamoeba invadens
KKFGKKGKMTYHLDFDVTAM

SEQ ID NO: 3041072 - protein, 17 aa, Entamoeba invadens
KKFKKDLKKNGWMAKLD

SEQ ID NO: 3041073 - protein, 19 aa, Entamoeba invadens
KKILAYAFADTGFVHLKFP

SEQ ID NO: 3041074 - protein, 21 aa, Entamoeba invadens
KKILHHYGPFLAGIRTGGNGF

SEQ ID NO: 3041075 - protein, 25 aa, Entamoeba invadens
KKILQMLSTFVRYFPQSKIVEKAKN

SEQ ID NO: 3041076 - protein, 23 aa, Entamoeba invadens
KKISKKLTFKKLAKFLDTKTQKA

SEQ ID NO: 3041077 - protein, 18 aa, Entamoeba invadens
KKKALKFEKFTTAYNKLQ

SEQ ID NO: 3041078 - protein, 29 aa, Entamoeba invadens
KKKMYKRVKVVIKRLTKKVEVFSSQVKEH

SEQ ID NO: 3041079 - protein, 29 aa, Entamoeba invadens
KKKVLYLKRCLRARIAVNDEIKKKQIENK

SEQ ID NO: 3041080 - protein, 30 aa, Entamoeba invadens
KKKVRGCDARSFYHNMYWNGYDQYFLGYAS

SEQ ID NO: 3041081 - protein, 29 aa, Entamoeba invadens
KKLLKRIKSGLKKGFKLKHVIKLGKKIHK

SEQ ID NO: 3041082 - protein, 21 aa, Entamoeba invadens
KKLSVLEIYFINAMGDLSTLN

SEQ ID NO: 3041083 - protein, 29 aa, Entamoeba invadens
KKMDEFRKEVAMLAKFVSPYLIRFYGACF

SEQ ID NO: 3041084 - protein, 21 aa, Entamoeba invadens
KKMWYSSVFTVLFSQNPTLGT

SEQ ID NO: 3041085 - protein, 24 aa, Entamoeba invadens
KKNCPEAYFAKDKVCTACVDDCKT

SEQ ID NO: 3041086 - protein, 24 aa, Entamoeba invadens
KKNEQVCLVLRLQLLNKLRSHPFR

SEQ ID NO: 3041087 - protein, 18 aa, Entamoeba invadens
KKNFEILVLTKGVRRAER

SEQ ID NO: 3041088 - protein, 19 aa, Entamoeba invadens
KKPGLKLKLPTTVGDGGFT

SEQ ID NO: 3041089 - protein, 27 aa, Entamoeba invadens
KKQYKIKDFVPYDWYLESPFLEKEIRL

SEQ ID NO: 3041090 - protein, 18 aa, Entamoeba invadens
KKRCAQKVMFKEFPEYLL

SEQ ID NO: 3041091 - protein, 29 aa, Entamoeba invadens
KKRGVICASCGNHGLAVAFCAKTLDVPAT

SEQ ID NO: 3041092 - protein, 23 aa, Entamoeba invadens
KKSRELNEIVVLLFNIEKDDAPK

SEQ ID NO: 3041093 - protein, 20 aa, Entamoeba invadens
KKTARTFEALVMMAPIGGYW

SEQ ID NO: 3041094 - protein, 18 aa, Entamoeba invadens
KKTLRMERITTIFLEGML

SEQ ID NO: 3041095 - protein, 18 aa, Entamoeba invadens
KKVLFDFSNAKFLFYHNT

SEQ ID NO: 3041096 - protein, 19 aa, Entamoeba invadens
KKYDDYRMKQIEQQRKSFI

SEQ ID NO: 3041097 - protein, 18 aa, Entamoeba invadens
KKYNEDFVQSVKDRAVLI

SEQ ID NO: 3041098 - protein, 24 aa, Entamoeba invadens
KLAKKYEGSFVFFSFNKVISEDQV

SEQ ID NO: 3041099 - protein, 24 aa, Entamoeba invadens
KLANSFETLWGFLVHLSQIYQNVL

SEQ ID NO: 3041100 - protein, 17 aa, Entamoeba invadens
KLCYEICRGNDFQPGTD

SEQ ID NO: 3041101 - protein, 20 aa, Entamoeba invadens
KLDLRFELNHPLVLEQPKGE

SEQ ID NO: 3041102 - protein, 19 aa, Entamoeba invadens
KLDVEGVVEAFKSAAQGIE

SEQ ID NO: 3041103 - protein, 28 aa, Entamoeba invadens
KLEKRKQEMMFMLEMVQSVRDELEVKTK

SEQ ID NO: 3041104 - protein, 20 aa, Entamoeba invadens
KLENDPAMVLLRPKEPLIEY

SEQ ID NO: 3041105 - protein, 17 aa, Entamoeba invadens
KLENRMRINPDYISVAD

SEQ ID NO: 3041106 - protein, 23 aa, Entamoeba invadens
KLFKHYRGGVYFNEDCTRRGLSH

SEQ ID NO: 3041107 - protein, 24 aa, Entamoeba invadens
KLFNKTFAFCLSLKTILIPESVEK

SEQ ID NO: 3041108 - protein, 24 aa, Entamoeba invadens
KLFRGEAIHPVLFDFVKGKYSYDT

SEQ ID NO: 3041109 - protein, 29 aa, Entamoeba invadens
KLFSKPHIAEGWKTLGGALEKKEQANNTN

SEQ ID NO: 3041110 - protein, 18 aa, Entamoeba invadens
KLGEKFKVVSDAFNTTGI

SEQ ID NO: 3041111 - protein, 24 aa, Entamoeba invadens
KLIRFCPNGILLDKDVVCTLKSQY

SEQ ID NO: 3041112 - protein, 17 aa, Entamoeba invadens
KLIRFCPNNTPLDKEVV

SEQ ID NO: 3041113 - protein, 18 aa, Entamoeba invadens
KLITKCWCQNQIERLKIE

SEQ ID NO: 3041114 - protein, 24 aa, Entamoeba invadens
KLKEIPQHLSYCGKYVKNNDNGGG

SEQ ID NO: 3041115 - protein, 24 aa, Entamoeba invadens
KLKKRMYINYNICPPYLFMPLLHV

SEQ ID NO: 3041116 - protein, 19 aa, Entamoeba invadens
KLKLSWKQLKRTLMIIDCF

SEQ ID NO: 3041117 - protein, 18 aa, Entamoeba invadens
KLKNVILMNHFEKEKHLK

SEQ ID NO: 3041118 - protein, 32 aa, Entamoeba invadens
KLKRRMGLCPMNRLRIKRRLRVYKKEVKIATG

SEQ ID NO: 3041119 - protein, 19 aa, Entamoeba invadens
KLKYLAEALKKYKKTLHEM

SEQ ID NO: 3041120 - protein, 19 aa, Entamoeba invadens
KLLSWQRILGSLYYDTDAK

SEQ ID NO: 3041121 - protein, 18 aa, Entamoeba invadens
KLMKEFEKEVAMLDKFRN

SEQ ID NO: 3041122 - protein, 26 aa, Entamoeba invadens
KLNWLEKWPIKLWCQFNQKLRTDNLS

SEQ ID NO: 3041123 - protein, 25 aa, Entamoeba invadens
KLTGNRKRLLLTIAAPAGPKNIVNL

SEQ ID NO: 3041124 - protein, 25 aa, Entamoeba invadens
KLTQLEVMRCFAWSNTFTSLVNISS

SEQ ID NO: 3041125 - protein, 24 aa, Entamoeba invadens
KLVDELPSFVLVRYDYGVFLGCQF

SEQ ID NO: 3041126 - protein, 27 aa, Entamoeba invadens
KLVGYSCYYNGCTVANCETCSSSGVCS

SEQ ID NO: 3041127 - protein, 20 aa, Entamoeba invadens
KLVVEGDIAIVMKKGKFNVF

SEQ ID NO: 3041128 - protein, 21 aa, Entamoeba invadens
KMCVSVCPNGTYTDVINMQCL

SEQ ID NO: 3041129 - protein, 26 aa, Entamoeba invadens
KMDTCIKTGTGSTIWTTNDWTYFQNK

SEQ ID NO: 3041130 - protein, 22 aa, Entamoeba invadens
KMFGEGIAIFGDEMYQLTWKNR

SEQ ID NO: 3041131 - protein, 19 aa, Entamoeba invadens
KMFLKGMKGKRCAVDQKAI

SEQ ID NO: 3041132 - protein, 18 aa, Entamoeba invadens
KMIRFCPNGIQLDTNVIC

SEQ ID NO: 3041133 - protein, 19 aa, Entamoeba invadens
KMLLFLSLLVLALSRSGIW

SEQ ID NO: 3041134 - protein, 21 aa, Entamoeba invadens
KMVDSGGIAIGSMKAGQWTTG

SEQ ID NO: 3041135 - protein, 20 aa, Entamoeba invadens
KMYMGGALPDDFMAYLEVIT

SEQ ID NO: 3041136 - protein, 20 aa, Entamoeba invadens
KNAGIGMCNVRLVVEVADGV

SEQ ID NO: 3041137 - protein, 24 aa, Entamoeba invadens
KNAGLKFQAVMSFHKCGGNVGDTC

SEQ ID NO: 3041138 - protein, 18 aa, Entamoeba invadens
KNAKKVEIELNREIDTQK

SEQ ID NO: 3041139 - protein, 23 aa, Entamoeba invadens
KNGVCSLCGNGKYDSGYEECDTS

SEQ ID NO: 3041140 - protein, 19 aa, Entamoeba invadens
KNHSCVVCKNDSFYQQNKC

SEQ ID NO: 3041141 - protein, 24 aa, Entamoeba invadens
KNKACPNGIDVVWLWVNGSDPNFL

SEQ ID NO: 3041142 - protein, 37 aa, Entamoeba invadens
KNKDCKATNGINCIKCYKGELNANCGSCSDVNCMTCE

SEQ ID NO: 3041143 - protein, 23 aa, Entamoeba invadens
KNKLAALQRKASHAHGNKKAQLM

SEQ ID NO: 3041144 - protein, 17 aa, Entamoeba invadens
KNLKVALLEKARDVSTG

SEQ ID NO: 3041145 - protein, 23 aa, Entamoeba invadens
KNNKCFRCYNGYHIYHGKCIKNE

SEQ ID NO: 3041146 - protein, 18 aa, Entamoeba invadens
KNNVLAVLNCDSMEDVLK

SEQ ID NO: 3041147 - protein, 25 aa, Entamoeba invadens
KNNWWPSKGYYIGIFGFEYQTVNKE

SEQ ID NO: 3041148 - protein, 30 aa, Entamoeba invadens
KNNYACQFTFKHVYLDLGMNPSLVIVERKK

SEQ ID NO: 3041149 - protein, 20 aa, Entamoeba invadens
KNPNLMSGIHKFWMSLLNCR

SEQ ID NO: 3041150 - protein, 18 aa, Entamoeba invadens
KNRLLDFCNSLVSKQVPE

SEQ ID NO: 3041151 - protein, 24 aa, Entamoeba invadens
KNRNLFCCTNFFGPDNAENMLLRD

SEQ ID NO: 3041152 - protein, 23 aa, Entamoeba invadens
KNRNMYCCTNFFGPDNVENMLLQ

SEQ ID NO: 3041153 - protein, 17 aa, Entamoeba invadens
KNRRPGRQFKMPVFDDV

SEQ ID NO: 3041154 - protein, 18 aa, Entamoeba invadens
KNVNRCYECLEGYKLEDG

SEQ ID NO: 3041155 - protein, 23 aa, Entamoeba invadens
KNVTELNFTLSYKMIDNDNANRT

SEQ ID NO: 3041156 - protein, 18 aa, Entamoeba invadens
KNYFGVDVSICCRNDNSL

SEQ ID NO: 3041157 - protein, 26 aa, Entamoeba invadens
KPAGVPLCTNYDAFVRRMQHRIVNNY

SEQ ID NO: 3041158 - protein, 20 aa, Entamoeba invadens
KPEIKNRIMDIESQINSQQL

SEQ ID NO: 3041159 - protein, 19 aa, Entamoeba invadens
KPFAKKALQESFKPFLDKW

SEQ ID NO: 3041160 - protein, 18 aa, Entamoeba invadens
KPFTCAIAGMYTVRPDAF

SEQ ID NO: 3041161 - protein, 20 aa, Entamoeba invadens
KPGMLYAIEQMPGFYGVGDR

SEQ ID NO: 3041162 - protein, 18 aa, Entamoeba invadens
KPITKRKIANFVANEIKN

SEQ ID NO: 3041163 - protein, 24 aa, Entamoeba invadens
KPIYEKMARFFGEVTYNWYDSYFD

SEQ ID NO: 3041164 - protein, 20 aa, Entamoeba invadens
KPIYRDGNKLTFSFTSNTTF

SEQ ID NO: 3041165 - protein, 21 aa, Entamoeba invadens
KPTCPEMLEDIFTTYYTGNDV

SEQ ID NO: 3041166 - protein, 21 aa, Entamoeba invadens
KPVFESGKYWVYDNINTQLIV

SEQ ID NO: 3041167 - protein, 26 aa, Entamoeba invadens
KPVIKRVAPKPAPKRVAPKPVKASIK

SEQ ID NO: 3041168 - protein, 19 aa, Entamoeba invadens
KQATFAIKRAKNQNIKQIQ

SEQ ID NO: 3041169 - protein, 25 aa, Entamoeba invadens
KQFFKDYTEFIVLLNHHREFFKDRE

SEQ ID NO: 3041170 - protein, 21 aa, Entamoeba invadens
KQFYNRLNVHVGVLSYRGFGV

SEQ ID NO: 3041171 - protein, 26 aa, Entamoeba invadens
KQGNDLAHEWKVLFFETSAKNKINII

SEQ ID NO: 3041172 - protein, 24 aa, Entamoeba invadens
KQLGFCVAGFFGILLGDREFKRME

SEQ ID NO: 3041173 - protein, 25 aa, Entamoeba invadens
KQLGFCVAGFFGILLGKREFKKINK

SEQ ID NO: 3041174 - protein, 21 aa, Entamoeba invadens
KQNCYSCPKGTFKNTQTTCDN

SEQ ID NO: 3041175 - protein, 25 aa, Entamoeba invadens
KQSFLKGYPSLFLFHNGTIYQEYKM

SEQ ID NO: 3041176 - protein, 22 aa, Entamoeba invadens
KQSKYALKVLIGKTVQIDQKTY

SEQ ID NO: 3041177 - protein, 20 aa, Entamoeba invadens
KQTEVHAMMLPKLQTPPHPP

SEQ ID NO: 3041178 - protein, 18 aa, Entamoeba invadens
KQTKALIKKAAKKAQKKQ

SEQ ID NO: 3041179 - protein, 19 aa, Entamoeba invadens
KQTTLSMVTNGYRKCKYNV

SEQ ID NO: 3041180 - protein, 23 aa, Entamoeba invadens
KREVKQKRLWVAIKDINPFVNDC

SEQ ID NO: 3041181 - protein, 19 aa, Entamoeba invadens
KRGFACEFEIFLTPYCTMN

SEQ ID NO: 3041182 - protein, 22 aa, Entamoeba invadens
KRHKDMINSMLLGHVHRDEFRL

SEQ ID NO: 3041183 - protein, 23 aa, Entamoeba invadens
KRHPHIKSEPGVFTLIPVPPEII

SEQ ID NO: 3041184 - protein, 17 aa, Entamoeba invadens
KRIKAEKTLQISKSPSV

SEQ ID NO: 3041185 - protein, 17 aa, Entamoeba invadens
KRINAVLQLTSEQVNIV

SEQ ID NO: 3041186 - protein, 20 aa, Entamoeba invadens
KRLAYIEARDDVSIIAGDGT

SEQ ID NO: 3041187 - protein, 20 aa, Entamoeba invadens
KRLDLCPANQHLLQKQIKKN

SEQ ID NO: 3041188 - protein, 19 aa, Entamoeba invadens
KRLKRQAMNYQFVYEPESH

SEQ ID NO: 3041189 - protein, 24 aa, Entamoeba invadens
KRLPEIKHQIQLRIQKVTRRLTAT

SEQ ID NO: 3041190 - protein, 19 aa, Entamoeba invadens
KRLYSHIANMGGYSGGELG

SEQ ID NO: 3041191 - protein, 19 aa, Entamoeba invadens
KRQNEFGIGGSYKANENTN

SEQ ID NO: 3041192 - protein, 20 aa, Entamoeba invadens
KRTLMLKSLAMHFAGVLNFY

SEQ ID NO: 3041193 - protein, 18 aa, Entamoeba invadens
KRVHDIRAGANVGSRLII

SEQ ID NO: 3041194 - protein, 26 aa, Entamoeba invadens
KRVSKRLSTVPSFKVAWIDASTDDVG

SEQ ID NO: 3041195 - protein, 20 aa, Entamoeba invadens
KRYGISLILEMEVPQGGISD

SEQ ID NO: 3041196 - protein, 18 aa, Entamoeba invadens
KRYICHNSSVSIEKSKCM

SEQ ID NO: 3041197 - protein, 20 aa, Entamoeba invadens
KSDVYSFGIIMWELVERKEP

SEQ ID NO: 3041198 - protein, 25 aa, Entamoeba invadens
KSENEFDRYPDLFNFNNTVFNLYSR

SEQ ID NO: 3041199 - protein, 23 aa, Entamoeba invadens
KSEYGKFFLNWYHQQLIKHAENI

SEQ ID NO: 3041200 - protein, 24 aa, Entamoeba invadens
KSGAKHFECCSSFYKINDVEKRIM

SEQ ID NO: 3041201 - protein, 20 aa, Entamoeba invadens
KSGFVCEFEVFITPYCTMDL

SEQ ID NO: 3041202 - protein, 20 aa, Entamoeba invadens
  misc_feature (16)..(17): Xaa can be any naturally occurring amino acid
KSGFWLLNGFIRLKHXXVRR

SEQ ID NO: 3041203 - protein, 17 aa, Entamoeba invadens
KSHHTVLIFPNAFGTIL

SEQ ID NO: 3041204 - protein, 18 aa, Entamoeba invadens
KSIFIFKTLGFFNSYFTI

SEQ ID NO: 3041205 - protein, 17 aa, Entamoeba invadens
KSIKAAVKRMMKEGNDH

SEQ ID NO: 3041206 - protein, 17 aa, Entamoeba invadens
KSIKFSSYPGVTHSLDD

SEQ ID NO: 3041207 - protein, 23 aa, Entamoeba invadens
KSIPDCPVYSLSIIYKCNQTALE

SEQ ID NO: 3041208 - protein, 24 aa, Entamoeba invadens
KSITGGVTYRPTDKVTIGANGKYS

SEQ ID NO: 3041209 - protein, 20 aa, Entamoeba invadens
KSKFKEAFNVKKKMKNTLGD

SEQ ID NO: 3041210 - protein, 25 aa, Entamoeba invadens
KSLLVKANMKAIIIVSEDVTKQDYL

SEQ ID NO: 3041211 - protein, 19 aa, Entamoeba invadens
KSNEIIVMTDHFCFSACSL

SEQ ID NO: 3041212 - protein, 26 aa, Entamoeba invadens
KSNWFKRFMFSTGFYIKKALYVDYNL

SEQ ID NO: 3041213 - protein, 25 aa, Entamoeba invadens
KSRSSSKCFPNRYVWNGIDNAATMG

SEQ ID NO: 3041214 - protein, 19 aa, Entamoeba invadens
KSSGFGDMVIIRGWEEIYN

SEQ ID NO: 3041215 - protein, 26 aa, Entamoeba invadens
KSSTNFALREVRFFHTHFKEEMFVAQ

SEQ ID NO: 3041216 - protein, 17 aa, Entamoeba invadens
KSSVIPEITCTEFFLGI

SEQ ID NO: 3041217 - protein, 20 aa, Entamoeba invadens
KSTIVEVWSDISLLKKAVDD

SEQ ID NO: 3041218 - protein, 23 aa, Entamoeba invadens
KSVESLGGFCFENCVSLREIELP

SEQ ID NO: 3041219 - protein, 28 aa, Entamoeba invadens
KSVNLRYRMLPYWYSLLYYHRVNQVPAL

SEQ ID NO: 3041220 - protein, 20 aa, Entamoeba invadens
KSWGDEGYFLLARNQNNRCG

SEQ ID NO: 3041221 - protein, 17 aa, Entamoeba invadens
KSYMKVTLFLHSTSQYW

SEQ ID NO: 3041222 - protein, 19 aa, Entamoeba invadens
KTCDSSFLRRCYECQSGYY

SEQ ID NO: 3041223 - protein, 20 aa, Entamoeba invadens
KTCLARQLINKRFDEATDST

SEQ ID NO: 3041224 - protein, 19 aa, Entamoeba invadens
KTCNAKEGIDPIVGPVHKK

SEQ ID NO: 3041225 - protein, 21 aa, Entamoeba invadens
KTCYGYLNSIGITFANDIGTI

SEQ ID NO: 3041226 - protein, 23 aa, Entamoeba invadens
KTDCSMCLTGYRLLDNKCEKDDK

SEQ ID NO: 3041227 - protein, 21 aa, Entamoeba invadens
KTDLSNKIRSMFVDSKAKANK

SEQ ID NO: 3041228 - protein, 22 aa, Entamoeba invadens
KTEGTCNLCIFVQGVEATKGGV

SEQ ID NO: 3041229 - protein, 21 aa, Entamoeba invadens
KTELKYLFEHFGRERNMELSK

SEQ ID NO: 3041230 - protein, 20 aa, Entamoeba invadens
KTGCINCKAGSYSTNTSRCL

SEQ ID NO: 3041231 - protein, 24 aa, Entamoeba invadens
KTGTCNVVGVGLVFNVLQTECDIF

SEQ ID NO: 3041232 - protein, 23 aa, Entamoeba invadens
KTIKKRGFLDWLRFLDRSYNLHE

SEQ ID NO: 3041233 - protein, 20 aa, Entamoeba invadens
KTILMTYAFFNMRINYRQGM

SEQ ID NO: 3041234 - protein, 35 aa, Entamoeba invadens
KTILVKFFAPWCGHCKRLAPTYVELATAMKENENV

SEQ ID NO: 3041235 - protein, 19 aa, Entamoeba invadens
KTKCFECNDGFRLEAGKCT

SEQ ID NO: 3041236 - protein, 18 aa, Entamoeba invadens
KTKICLDSSKGISYLHEN

SEQ ID NO: 3041237 - protein, 19 aa, Entamoeba invadens
KTKKLFIEEAISLKKGEKG

SEQ ID NO: 3041238 - protein, 23 aa, Entamoeba invadens
KTKQIVKVLLRYYSIERNNKKVP

SEQ ID NO: 3041239 - protein, 22 aa, Entamoeba invadens
KTKRMKFLVFGRLFEPRIADTP

SEQ ID NO: 3041240 - protein, 23 aa, Entamoeba invadens
KTLELKVAFNIKSMLYANVITIT

SEQ ID NO: 3041241 - protein, 19 aa, Entamoeba invadens
KTLSFSIDYHPIIKESNMF

SEQ ID NO: 3041242 - protein, 19 aa, Entamoeba invadens
KTLTKPIIRNGVRVDENLE

SEQ ID NO: 3041243 - protein, 19 aa, Entamoeba invadens
KTMEVCFILPKGSVSDSTV

SEQ ID NO: 3041244 - protein, 21 aa, Entamoeba invadens
KTMIPRKQYFSSLEKLNVYGS

SEQ ID NO: 3041245 - protein, 25 aa, Entamoeba invadens
KTPFVKEGFWLHGLWPQKRQNRNIY

SEQ ID NO: 3041246 - protein, 25 aa, Entamoeba invadens
KTPGRGGDFPSEFYISKTLTKPIIR

SEQ ID NO: 3041247 - protein, 19 aa, Entamoeba invadens
KTQCQECALGYFVDKGQCN

SEQ ID NO: 3041248 - protein, 18 aa, Entamoeba invadens
KTREARDSLEFATAMYTY

SEQ ID NO: 3041249 - protein, 26 aa, Entamoeba invadens
KTSHPLRFWLVEDFLSPSGRKTLPEY

SEQ ID NO: 3041250 - protein, 18 aa, Entamoeba invadens
KTSLIYFRKVDAVGKEVY

SEQ ID NO: 3041251 - protein, 19 aa, Entamoeba invadens
KTSLLSKCGKRVYLTKSEY

SEQ ID NO: 3041252 - protein, 17 aa, Entamoeba invadens
KTTEWCYYFHSTKSRSS

SEQ ID NO: 3041253 - protein, 23 aa, Entamoeba invadens
KTVIECGNNMFVYIKVISQYFCL

SEQ ID NO: 3041254 - protein, 32 aa, Entamoeba invadens
KTVYLSTAFPFPIKISKHYAILNLKLETTVPL

SEQ ID NO: 3041255 - protein, 25 aa, Entamoeba invadens
KTYAECCKLVLKKGVKRYIEASITP

SEQ ID NO: 3041256 - protein, 20 aa, Entamoeba invadens
KTYKTLRFHVKYDNDDLKNI

SEQ ID NO: 3041257 - protein, 20 aa, Entamoeba invadens
KTYKTLRFHVKYDNDDLNNI

SEQ ID NO: 3041258 - protein, 22 aa, Entamoeba invadens
KTYKTLRFHVKYDNDDLNNIPL

SEQ ID NO: 3041259 - protein, 25 aa, Entamoeba invadens
KTYRWNIRVLYDMIDIAALNGYKTY

SEQ ID NO: 3041260 - protein, 20 aa, Entamoeba invadens
KTYSGAGCTGTFTLGNEIAT

SEQ ID NO: 3041261 - protein, 19 aa, Entamoeba invadens
KVACDTLDTFLREKIPEVC

SEQ ID NO: 3041262 - protein, 20 aa, Entamoeba invadens
KVAKKSARKYGKIAAKAAGK

SEQ ID NO: 3041263 - protein, 25 aa, Entamoeba invadens
KVEKAKLMKWIELIEKAYNLQKTEK

SEQ ID NO: 3041264 - protein, 22 aa, Entamoeba invadens
KVGGTCVFKASVMTLLSVPNTI

SEQ ID NO: 3041265 - protein, 18 aa, Entamoeba invadens
KVISEFWCDISRNKGEDV

SEQ ID NO: 3041266 - protein, 18 aa, Entamoeba invadens
KVLEDLSSFLRLRKSPAF

SEQ ID NO: 3041267 - protein, 19 aa, Entamoeba invadens
KVNFNMRIVNVAISISKKI

SEQ ID NO: 3041268 - protein, 28 aa, Entamoeba invadens
KVPFTQTCFPVFLYLALPSLEGKSRVEF

SEQ ID NO: 3041269 - protein, 19 aa, Entamoeba invadens
KVPLKGWNTWLHKRITLRN

SEQ ID NO: 3041270 - protein, 20 aa, Entamoeba invadens
KVPTLISYGDLDFVVDKSQP

SEQ ID NO: 3041271 - protein, 26 aa, Entamoeba invadens
KVTAEQYFDWCFKAIQLIEDRKNSKD

SEQ ID NO: 3041272 - protein, 17 aa, Entamoeba invadens
KVTELPEGLDFRKFNKL

SEQ ID NO: 3041273 - protein, 28 aa, Entamoeba invadens
KVTLLEMKVKYLVLFAKLLKVQKTPEFF

SEQ ID NO: 3041274 - protein, 19 aa, Entamoeba invadens
KVTWDFVLLVTTWPGYFCS

SEQ ID NO: 3041275 - protein, 20 aa, Entamoeba invadens
KWGTDGLMRFVEILGDQNIK

SEQ ID NO: 3041276 - protein, 25 aa, Entamoeba invadens
KWMSIGMCRFAIYQWDKHGSCTMKL

SEQ ID NO: 3041277 - protein, 22 aa, Entamoeba invadens
KWRKYKNHFFLPFYNQTDLCYE

SEQ ID NO: 3041278 - protein, 19 aa, Entamoeba invadens
KYDFLVLVQYWPGERCAHQ

SEQ ID NO: 3041279 - protein, 17 aa, Entamoeba invadens
KYDGRYILYTQMSSGSY

SEQ ID NO: 3041280 - protein, 19 aa, Entamoeba invadens
KYESCVICNNGFYQVSDSK

SEQ ID NO: 3041281 - protein, 22 aa, Entamoeba invadens
KYEVLKTKAINRLHTRRSQMYA

SEQ ID NO: 3041282 - protein, 19 aa, Entamoeba invadens
KYFKAVIEMRIRCTRGEGV

SEQ ID NO: 3041283 - protein, 21 aa, Entamoeba invadens
KYFYFPLGFFSMFSRDIVEFM

SEQ ID NO: 3041284 - protein, 19 aa, Entamoeba invadens
KYGERLKAVITVRDLYSYN

SEQ ID NO: 3041285 - protein, 17 aa, Entamoeba invadens
KYKAWSFYVSSGNEQLK

SEQ ID NO: 3041286 - protein, 20 aa, Entamoeba invadens
KYKGMMLAIEHRFYGRSLPV

SEQ ID NO: 3041287 - protein, 18 aa, Entamoeba invadens
KYKKGIFRMTYDDNCVSN

SEQ ID NO: 3041288 - protein, 29 aa, Entamoeba invadens
KYKMSDYKWFSSIEFYHLICRLSAGIRHI

SEQ ID NO: 3041289 - protein, 26 aa, Entamoeba invadens
KYKMSDYKWISSIEFYHMVCRLSAGL

SEQ ID NO: 3041290 - protein, 30 aa, Entamoeba invadens
KYKMSEYKWISSLEFYHMICRLSSGLRKMG

SEQ ID NO: 3041291 - protein, 18 aa, Entamoeba invadens
KYLDIAFVDVAHNTIETC

SEQ ID NO: 3041292 - protein, 22 aa, Entamoeba invadens
KYMKKPVYLFVFVQYWPGDKCD

SEQ ID NO: 3041293 - protein, 17 aa, Entamoeba invadens
KYMTVNYLFRSALHHSI

SEQ ID NO: 3041294 - protein, 18 aa, Entamoeba invadens
KYNIAVLPLPGMRVTHTP

SEQ ID NO: 3041295 - protein, 20 aa, Entamoeba invadens
KYNNCILNHNCIYGDGTVCI

SEQ ID NO: 3041296 - protein, 26 aa, Entamoeba invadens
KYPHCPCTQSNCVVQFSGDVFNLQNV

SEQ ID NO: 3041297 - protein, 21 aa, Entamoeba invadens
KYPQCGACVELVGPSLKKAVC

SEQ ID NO: 3041298 - protein, 19 aa, Entamoeba invadens
KYQKTTNIVFAWNDMNEPT

SEQ ID NO: 3041299 - protein, 18 aa, Entamoeba invadens
KYSIYVMAPQLLENFETI

SEQ ID NO: 3041300 - protein, 17 aa, Entamoeba invadens
KYSRCGTQILITGPSQK

SEQ ID NO: 3041301 - protein, 28 aa, Entamoeba invadens
KYTCGRGHAITLWGYELGDFDMVDSGEC

SEQ ID NO: 3041302 - protein, 18 aa, Entamoeba invadens
KYVKMYVVMTYDYFNPNQ

SEQ ID NO: 3041303 - protein, 23 aa, Entamoeba invadens
KYYKESCPFCVKIVKEFQKFEND

SEQ ID NO: 3041304 - protein, 25 aa, Entamoeba invadens
KYYKQCGICNGFGIAGSSYLAYMVI

SEQ ID NO: 3041305 - protein, 24 aa, Entamoeba invadens
LAAGKCAICPKGTYYMSSVCQSCG

SEQ ID NO: 3041306 - protein, 26 aa, Entamoeba invadens
LAAGKCAICPRGTYYLSSVCQSCGEM

SEQ ID NO: 3041307 - protein, 21 aa, Entamoeba invadens
LAAQSTHFYVLKYYETENNLS

SEQ ID NO: 3041308 - protein, 17 aa, Entamoeba invadens
LACNGIFNGDLRTEKTV

SEQ ID NO: 3041309 - protein, 17 aa, Entamoeba invadens
LACSRCKAGKCTVSGGC

SEQ ID NO: 3041310 - protein, 19 aa, Entamoeba invadens
LADLVYKTDFVEFTNTSFV

SEQ ID NO: 3041311 - protein, 19 aa, Entamoeba invadens
LAEHLALPETLYIPVGCIK

SEQ ID NO: 3041312 - protein, 18 aa, Entamoeba invadens
LAEMKIKNVDLVALVQKR

SEQ ID NO: 3041313 - protein, 17 aa, Entamoeba invadens
LAFCVLGYITQIPIDVF

SEQ ID NO: 3041314 - protein, 17 aa, Entamoeba invadens
LAFHPCVDNIISTASGD

SEQ ID NO: 3041315 - protein, 19 aa, Entamoeba invadens
LAHIFELCIEFAIMSYTGT

SEQ ID NO: 3041316 - protein, 20 aa, Entamoeba invadens
LAHIFELCIEFAVMMHSGTV

SEQ ID NO: 3041317 - protein, 20 aa, Entamoeba invadens
LAHIFELCLEFGVMSNLGSL

SEQ ID NO: 3041318 - protein, 25 aa, Entamoeba invadens
LAHNTWRPYYAMSRIYKTYVLAYTR

SEQ ID NO: 3041319 - protein, 17 aa, Entamoeba invadens
LAIFSSYAYEVDAADVE

SEQ ID NO: 3041320 - protein, 24 aa, Entamoeba invadens
LAIGKCAICPRGTYYTSSVCQSCS

SEQ ID NO: 3041321 - protein, 22 aa, Entamoeba invadens
LAKNPKIAFGHINVLLNDVLVK

SEQ ID NO: 3041322 - protein, 17 aa, Entamoeba invadens
LANAFTLGDDQPTDQQA

SEQ ID NO: 3041323 - protein, 19 aa, Entamoeba invadens
LANEFRMKNVDTINVGLAF

SEQ ID NO: 3041324 - protein, 17 aa, Entamoeba invadens
LAPLFEFGTIGIGRMIN

SEQ ID NO: 3041325 - protein, 18 aa, Entamoeba invadens
LAPNLPIEPFKEIYNSIT

SEQ ID NO: 3041326 - protein, 32 aa, Entamoeba invadens
LARHLRFTRDGQYLRCHSRLENLIAELLTPSE

SEQ ID NO: 3041327 - protein, 17 aa, Entamoeba invadens
LATKLIVKVEGKTVIEG

SEQ ID NO: 3041328 - protein, 17 aa, Entamoeba invadens
LAVFGGRTPLQIYKDFM

SEQ ID NO: 3041329 - protein, 21 aa, Entamoeba invadens
LAVNIPKYFYFPLGFFSMFSR

SEQ ID NO: 3041330 - protein, 20 aa, Entamoeba invadens
LCCLVLYSSGHESLFVDEFD

SEQ ID NO: 3041331 - protein, 17 aa, Entamoeba invadens
LCDSGYLLILQNGVSIC

SEQ ID NO: 3041332 - protein, 18 aa, Entamoeba invadens
LCDSVPFISCCNDSKVKV

SEQ ID NO: 3041333 - protein, 22 aa, Entamoeba invadens
LCEAIKCPPRMDGCGMKQNKKR

SEQ ID NO: 3041334 - protein, 17 aa, Entamoeba invadens
LCGKFGISGFPTLKFFA

SEQ ID NO: 3041335 - protein, 24 aa, Entamoeba invadens
LCGNELLSWARIKLAKCCESKEVA

SEQ ID NO: 3041336 - protein, 17 aa, Entamoeba invadens
LCLCKKRLTSKCVNSQL

SEQ ID NO: 3041337 - protein, 17 aa, Entamoeba invadens
LCLSYVQAVEDDHEVQD

SEQ ID NO: 3041338 - protein, 18 aa, Entamoeba invadens
LCMVAGSFHPKLYGEEIT

SEQ ID NO: 3041339 - protein, 24 aa, Entamoeba invadens
LCNVCVNGVLTMCYGVDGVPAYVD

SEQ ID NO: 3041340 - protein, 17 aa, Entamoeba invadens
LCSTEFLILNMDSSELS

SEQ ID NO: 3041341 - protein, 19 aa, Entamoeba invadens
LCTGNYCNNCKSIPKRQAY

SEQ ID NO: 3041342 - protein, 24 aa, Entamoeba invadens
LCVKCSVTNCLNCEIATATTQCSK

SEQ ID NO: 3041343 - protein, 21 aa, Entamoeba invadens
LCVVFPFVLSVELKKCMYIPY

SEQ ID NO: 3041344 - protein, 18 aa, Entamoeba invadens
LCYVKPKQFDDFVDANRI

SEQ ID NO: 3041345 - protein, 20 aa, Entamoeba invadens
LDALFGKELPSVFTSEYIHI

SEQ ID NO: 3041346 - protein, 24 aa, Entamoeba invadens
LDDFRLSLFAPIDLINLTPDIQNS

SEQ ID NO: 3041347 - protein, 23 aa, Entamoeba invadens
LDDGKKWIGGMMQQFDVLKFNGD

SEQ ID NO: 3041348 - protein, 24 aa, Entamoeba invadens
LDDTYKLILIKSFKHENSGYLPIG

SEQ ID NO: 3041349 - protein, 21 aa, Entamoeba invadens
LDGDDPCKGKVVIKSDAPPAI

SEQ ID NO: 3041350 - protein, 21 aa, Entamoeba invadens
LDGKICIGCDGQFLYREDTKS

SEQ ID NO: 3041351 - protein, 17 aa, Entamoeba invadens
LDKGTCWAFGIIGMLEH

SEQ ID NO: 3041352 - protein, 18 aa, Entamoeba invadens
LDKIINKKLIKGIVNYSK

SEQ ID NO: 3041353 - protein, 28 aa, Entamoeba invadens
LDKLDSFQMCREYKKLAPHEYMVYAEYW

SEQ ID NO: 3041354 - protein, 26 aa, Entamoeba invadens
LDKTCQGLRYFLNFFEAFTQLPILSN

SEQ ID NO: 3041355 - protein, 20 aa, Entamoeba invadens
LDKTCYMSKCLNEYTDRSNY

SEQ ID NO: 3041356 - protein, 31 aa, Entamoeba invadens
LDNICILSTMFPYKFDDGIGYLISNQRLIRF

SEQ ID NO: 3041357 - protein, 21 aa, Entamoeba invadens
LDNLKRLTVIESDYVSLPEIN

SEQ ID NO: 3041358 - protein, 26 aa, Entamoeba invadens
LDNLNCRKNSWGQCFSTYAIDPYIPT

SEQ ID NO: 3041359 - protein, 18 aa, Entamoeba invadens
LDPELVHLKILRTVNPKT

SEQ ID NO: 3041360 - protein, 25 aa, Entamoeba invadens
LDRIDEYLGAYAFRDTAKNPPQPPS

SEQ ID NO: 3041361 - protein, 18 aa, Entamoeba invadens
LDTPVLMYYYTTRMTKAT

SEQ ID NO: 3041362 - protein, 28 aa, Entamoeba invadens
LDVPATIICPSFTFPRRVETMKRYGATV

SEQ ID NO: 3041363 - protein, 22 aa, Entamoeba invadens
LDVSKEFMIMFSHMSLNMKLSV

SEQ ID NO: 3041364 - protein, 19 aa, Entamoeba invadens
LEAECRNTMKLLNNLLDKS

SEQ ID NO: 3041365 - protein, 24 aa, Entamoeba invadens
LEAMKNWLESAAMPPVKESNKEEI

SEQ ID NO: 3041366 - protein, 19 aa, Entamoeba invadens
LEAQKKMALEDKAEAEKTA

SEQ ID NO: 3041367 - protein, 24 aa, Entamoeba invadens
LEDFRLSLHAAIDIPHITPIDPTD

SEQ ID NO: 3041368 - protein, 26 aa, Entamoeba invadens
LEERKKFEASKEFAEKIKVWKGVSNI

SEQ ID NO: 3041369 - protein, 20 aa, Entamoeba invadens
LEFVKCDLMDLACVKKAAEY

SEQ ID NO: 3041370 - protein, 19 aa, Entamoeba invadens
LEGKMMAIVGKMGKVKEKF

SEQ ID NO: 3041371 - protein, 26 aa, Entamoeba invadens
LEIPADFRLLVGVALLNGFVRMNFVG

SEQ ID NO: 3041372 - protein, 21 aa, Entamoeba invadens
LEKKLKVKLAEFTMRETNYKK

SEQ ID NO: 3041373 - protein, 29 aa, Entamoeba invadens
LEKKLSDDIFMWFGFFSSFLVKTAKFLKD

SEQ ID NO: 3041374 - protein, 25 aa, Entamoeba invadens
LEKMKLKTGMKMKKLKTSGVFEEIV

SEQ ID NO: 3041375 - protein, 24 aa, Entamoeba invadens
LEKVDLKLTMYFAEKRKKVTERIS

SEQ ID NO: 3041376 - protein, 22 aa, Entamoeba invadens
LELCGYGGCNTSGFNQIVTQAK

SEQ ID NO: 3041377 - protein, 20 aa, Entamoeba invadens
LELEGYEFSDCVKLTEIVGL

SEQ ID NO: 3041378 - protein, 37 aa, Entamoeba invadens
LELEYKLKIQRLLKEKCKLRLAMKTNKVAVAMTTKVE

SEQ ID NO: 3041379 - protein, 18 aa, Entamoeba invadens
LELLVLVEYWPGDKCSKE

SEQ ID NO: 3041380 - protein, 29 aa, Entamoeba invadens
LELPPKGVPMAQAIRGVMQQKQLNQQKKI

SEQ ID NO: 3041381 - protein, 20 aa, Entamoeba invadens
LEMHRLRMGNYKEKDNYRRK

SEQ ID NO: 3041382 - protein, 18 aa, Entamoeba invadens
LEMTGPSIIPTQCVVTGT

SEQ ID NO: 3041383 - protein, 18 aa, Entamoeba invadens
LENTKILFLEKYVKKDDI

SEQ ID NO: 3041384 - protein, 18 aa, Entamoeba invadens
LEPIDVFILKMESASLGV

SEQ ID NO: 3041385 - protein, 17 aa, Entamoeba invadens
LERKVLIAIDIDMNNDK

SEQ ID NO: 3041386 - protein, 17 aa, Entamoeba invadens
LESFKHGGYYYMQFPAK

SEQ ID NO: 3041387 - protein, 18 aa, Entamoeba invadens
LESIKFPKSLKRIGELAF

SEQ ID NO: 3041388 - protein, 18 aa, Entamoeba invadens
LESMLERFNDKIVFLTEC

SEQ ID NO: 3041389 - protein, 19 aa, Entamoeba invadens
LESYIKVLTDLSNKYVEKF

SEQ ID NO: 3041390 - protein, 19 aa, Entamoeba invadens
LETIPGVSLRVPEFGSTYG

SEQ ID NO: 3041391 - protein, 23 aa, Entamoeba invadens
LETIPHCEFFRCYKLSEIKVPNS

SEQ ID NO: 3041392 - protein, 28 aa, Entamoeba invadens
LETLSSYSMCKFYMDQFVPDFIVHSRYW

SEQ ID NO: 3041393 - protein, 24 aa, Entamoeba invadens
LEVPYKLDPTFSYKKVDLPPLSFF

SEQ ID NO: 3041394 - protein, 19 aa, Entamoeba invadens
LEYKKHKKMLTKRDKERLE

SEQ ID NO: 3041395 - protein, 18 aa, Entamoeba invadens
LFAGLSFGLFKVACDTLD

SEQ ID NO: 3041396 - protein, 18 aa, Entamoeba invadens
LFDFALLNMFHKIRYYET

SEQ ID NO: 3041397 - protein, 25 aa, Entamoeba invadens
LFESENYVIALFCYFTQQSCVPYIQ

SEQ ID NO: 3041398 - protein, 23 aa, Entamoeba invadens
LFICAALSRELRNGFKNITRTAT

SEQ ID NO: 3041399 - protein, 17 aa, Entamoeba invadens
LFKALPMIHTLVPHVSL

SEQ ID NO: 3041400 - protein, 17 aa, Entamoeba invadens
LFLCTNGRLQVLNLTNF

SEQ ID NO: 3041401 - protein, 26 aa, Entamoeba invadens
LFLKGEYTLLLQIKGRLRLRSFLVPL

SEQ ID NO: 3041402 - protein, 39 aa, Entamoeba invadens
LFNECIPCSLKYGKMCSKCDVTNCFNCSGNGVINNDNIC

SEQ ID NO: 3041403 - protein, 25 aa, Entamoeba invadens
LFNFVLESCHVFAPKGLNLLIETFK

SEQ ID NO: 3041404 - protein, 34 aa, Entamoeba invadens
LFQFYPKILVIIAHPLLRIVFKSPLEGVQTALHL

SEQ ID NO: 3041405 - protein, 25 aa, Entamoeba invadens
LFQREFTPKFARTFFNKFKQWPPNL

SEQ ID NO: 3041406 - protein, 18 aa, Entamoeba invadens
LFSTIKHRFFYIEKGVLY

SEQ ID NO: 3041407 - protein, 18 aa, Entamoeba invadens
LFTLEYKGRGYVFIDTRA

SEQ ID NO: 3041408 - protein, 22 aa, Entamoeba invadens
LFTVGIGKVVVWNTTQIVPLNA

SEQ ID NO: 3041409 - protein, 18 aa, Entamoeba invadens
LFTYGMKCYEDCTAIEKY

SEQ ID NO: 3041410 - protein, 26 aa, Entamoeba invadens
LFVHKSRATIDFSIPILHLTNIIMNN

SEQ ID NO: 3041411 - protein, 23 aa, Entamoeba invadens
LFVIQGGCYFYGLVKIKKQIHSQ

SEQ ID NO: 3041412 - protein, 17 aa, Entamoeba invadens
LFVLNIATEHFDDESDL

SEQ ID NO: 3041413 - protein, 17 aa, Entamoeba invadens
LFVVKDVGCCRKLIFGY

SEQ ID NO: 3041414 - protein, 17 aa, Entamoeba invadens
LGAPVWSDQIFRKYMTV

SEQ ID NO: 3041415 - protein, 18 aa, Entamoeba invadens
LGCSTGLSLLNGMCTSCS

SEQ ID NO: 3041416 - protein, 18 aa, Entamoeba invadens
LGDGFVLPFEDGCYPKCG

SEQ ID NO: 3041417 - protein, 23 aa, Entamoeba invadens
LGEEAKAAGAVCLVNTYVTDVEN

SEQ ID NO: 3041418 - protein, 23 aa, Entamoeba invadens
LGGASVCRLCLSLSCVSCGSTTG

SEQ ID NO: 3041419 - protein, 26 aa, Entamoeba invadens
LGGVYELKMYLGIGEKSLNTFSESFR

SEQ ID NO: 3041420 - protein, 25 aa, Entamoeba invadens
LGLLKLKADNYLFVLTSLVNKLRKF

SEQ ID NO: 3041421 - protein, 25 aa, Entamoeba invadens
LGNFCLDCKSDLIALQPTFVIGVPT

SEQ ID NO: 3041422 - protein, 18 aa, Entamoeba invadens
LGTKKIRKVISLRERAAY

SEQ ID NO: 3041423 - protein, 26 aa, Entamoeba invadens
LGVDEARLAFSNSYLSSPQVDQFQHE

SEQ ID NO: 3041424 - protein, 18 aa, Entamoeba invadens
LGVLSVFRESHKVSDLMK

SEQ ID NO: 3041425 - protein, 17 aa, Entamoeba invadens
LGVSMVLKLLNKLQQQN

SEQ ID NO: 3041426 - protein, 25 aa, Entamoeba invadens
LGYAFRPNPSYGLTNFKDMTMGWCA

SEQ ID NO: 3041427 - protein, 19 aa, Entamoeba invadens
LGYTSAQPVYKKLRTILTK

SEQ ID NO: 3041428 - protein, 26 aa, Entamoeba invadens
LHAKICKLKRCRLIYGKKENYLRAHK

SEQ ID NO: 3041429 - protein, 17 aa, Entamoeba invadens
LHCGLNFLKKDQKKVEL

SEQ ID NO: 3041430 - protein, 20 aa, Entamoeba invadens
LHIKTFFRSKSRAFANSFAF

SEQ ID NO: 3041431 - protein, 19 aa, Entamoeba invadens
LHLYSDIDQMWIISKNKTV

SEQ ID NO: 3041432 - protein, 18 aa, Entamoeba invadens
LHPQQCVLVLQSNSLKKF

SEQ ID NO: 3041433 - protein, 20 aa, Entamoeba invadens
LICSALAFRGRHEKPVEDSQ

SEQ ID NO: 3041434 - protein, 17 aa, Entamoeba invadens
LIEQLKQILKEGIVNQE

SEQ ID NO: 3041435 - protein, 17 aa, Entamoeba invadens
LIETCWNTSATLRPQFD

SEQ ID NO: 3041436 - protein, 25 aa, Entamoeba invadens
LIEYKEAWQTSVMTEWVFHYISPAT

SEQ ID NO: 3041437 - protein, 19 aa, Entamoeba invadens
LIFSALAFRGRHEKPIEDS

SEQ ID NO: 3041438 - protein, 24 aa, Entamoeba invadens
LIGLGAKESFSFTRFDATDDGSYF

SEQ ID NO: 3041439 - protein, 17 aa, Entamoeba invadens
LIIEMAESLIQQFNSIK

SEQ ID NO: 3041440 - protein, 23 aa, Entamoeba invadens
LIIKAQETITRFLTYYENVVLNL

SEQ ID NO: 3041441 - protein, 18 aa, Entamoeba invadens
LILCSKAIEDTECYTLDE

SEQ ID NO: 3041442 - protein, 19 aa, Entamoeba invadens
LILDLCFYGPYGIPVYTPI

SEQ ID NO: 3041443 - protein, 18 aa, Entamoeba invadens
LILNFKWINTEFTQIDST

SEQ ID NO: 3041444 - protein, 17 aa, Entamoeba invadens
LIMARRMTLEGAKVLGV

SEQ ID NO: 3041445 - protein, 18 aa, Entamoeba invadens
LIQLCIGLSYIEDTFIST

SEQ ID NO: 3041446 - protein, 18 aa, Entamoeba invadens
LISDFGTSGVQLFEENVF

SEQ ID NO: 3041447 - protein, 17 aa, Entamoeba invadens
LKAQRLRNNAKIQAQKK

SEQ ID NO: 3041448 - protein, 17 aa, Entamoeba invadens
LKASNLINSRVKQLVVL

SEQ ID NO: 3041449 - protein, 21 aa, Entamoeba invadens
LKAVECTLCPDGQNAPNIMST

SEQ ID NO: 3041450 - protein, 18 aa, Entamoeba invadens
LKAVITVRDLYSYNKNSC

SEQ ID NO: 3041451 - protein, 19 aa, Entamoeba invadens
LKDICKHEQFACNENFRLL

SEQ ID NO: 3041452 - protein, 26 aa, Entamoeba invadens
LKDNTCLPCTLIGCFKCTEFECLECQ

SEQ ID NO: 3041453 - protein, 21 aa, Entamoeba invadens
LKEEKHMLIGEVRRLEQKYNK

SEQ ID NO: 3041454 - protein, 22 aa, Entamoeba invadens
LKEIRLTRTINIILKQMAHVLV

SEQ ID NO: 3041455 - protein, 19 aa, Entamoeba invadens
LKEKGIWTAGFSFKQLYGV

SEQ ID NO: 3041456 - protein, 23 aa, Entamoeba invadens
LKELGRKMVLIFEGNEFENCFGE

SEQ ID NO: 3041457 - protein, 18 aa, Entamoeba invadens
LKELNFWRDPGLLGRNSS

SEQ ID NO: 3041458 - protein, 19 aa, Entamoeba invadens
LKERKEKKAAKEKEKAKKL

SEQ ID NO: 3041459 - protein, 19 aa, Entamoeba invadens
LKFTSEINEFGFFDADLSN

SEQ ID NO: 3041460 - protein, 18 aa, Entamoeba invadens
LKITRAMSDTVQRLRTSV

SEQ ID NO: 3041461 - protein, 19 aa, Entamoeba invadens
LKITRAMSDTVQRLRTSVK

SEQ ID NO: 3041462 - protein, 21 aa, Entamoeba invadens
LKKATEVGGEMVVDNVVDTAK

SEQ ID NO: 3041463 - protein, 23 aa, Entamoeba invadens
LKKAYKKKALKYHPDRVAQDKES

SEQ ID NO: 3041464 - protein, 18 aa, Entamoeba invadens
LKKFGKRLDLCPANQHLL

SEQ ID NO: 3041465 - protein, 18 aa, Entamoeba invadens
LKKGKLVEISNGVFDYTP

SEQ ID NO: 3041466 - protein, 21 aa, Entamoeba invadens
LKKLASEWDCPCYETSAKNKI

SEQ ID NO: 3041467 - protein, 19 aa, Entamoeba invadens
LKKLVKRGVVRARDVEGVN

SEQ ID NO: 3041468 - protein, 21 aa, Entamoeba invadens
LKKVFACFYDIIKRYTYGSTF

SEQ ID NO: 3041469 - protein, 21 aa, Entamoeba invadens
LKKVIKNKFGVEPVFNCVESN

SEQ ID NO: 3041470 - protein, 22 aa, Entamoeba invadens
LKKVLHHYGPFVVSLYTDNRFK

SEQ ID NO: 3041471 - protein, 17 aa, Entamoeba invadens
LKLEMMKMKKMLAESKK

SEQ ID NO: 3041472 - protein, 19 aa, Entamoeba invadens
LKLKRPAINLKYLPQIQQM

SEQ ID NO: 3041473 - protein, 23 aa, Entamoeba invadens
LKLMKSLYFFVGLMRRIKSTFKA

SEQ ID NO: 3041474 - protein, 25 aa, Entamoeba invadens
LKLYESVDLWQVLKESILKVEVEKV

SEQ ID NO: 3041475 - protein, 19 aa, Entamoeba invadens
LKMVIQSSGVKPIYRDGNK

SEQ ID NO: 3041476 - protein, 19 aa, Entamoeba invadens
LKNEVYVNAILRLENYIET

SEQ ID NO: 3041477 - protein, 17 aa, Entamoeba invadens
LKNIYKNHCNITTVILL

SEQ ID NO: 3041478 - protein, 21 aa, Entamoeba invadens
LKPNKDCCPIIKTLDTATAQS

SEQ ID NO: 3041479 - protein, 17 aa, Entamoeba invadens
LKPTFEKKPNFLIMKKA

SEQ ID NO: 3041480 - protein, 17 aa, Entamoeba invadens
LKQKFGKIWKRLIVISL

SEQ ID NO: 3041481 - protein, 33 aa, Entamoeba invadens
LKRCLFFNYEFLKHATCLPSLFSGKDAPSDFAS

SEQ ID NO: 3041482 - protein, 21 aa, Entamoeba invadens
LKSSKLLDFVIRKAVAPYPDM

SEQ ID NO: 3041483 - protein, 34 aa, Entamoeba invadens
LKTARGGKYISFRYDWRSLLAVVRMHLPAIEYFV

SEQ ID NO: 3041484 - protein, 19 aa, Entamoeba invadens
LKTSGVFEEIVRGWMWNSF

SEQ ID NO: 3041485 - protein, 19 aa, Entamoeba invadens
LKVAQSGIPKATRKVLLLS

SEQ ID NO: 3041486 - protein, 17 aa, Entamoeba invadens
LKVIGAYAHKYAKMASE

SEQ ID NO: 3041487 - protein, 18 aa, Entamoeba invadens
LKVLQFLARHLRFTRDGQ

SEQ ID NO: 3041488 - protein, 20 aa, Entamoeba invadens
LLCPICLSFEQPGEPRRHGS

SEQ ID NO: 3041489 - protein, 25 aa, Entamoeba invadens
LLDYPHNLPVFWFFSDKKHMKKEEK

SEQ ID NO: 3041490 - protein, 21 aa, Entamoeba invadens
LLESEMKRLEDVERHLHDVLD

SEQ ID NO: 3041491 - protein, 21 aa, Entamoeba invadens
LLFIKKLNVTFTYHKASHEHS

SEQ ID NO: 3041492 - protein, 18 aa, Entamoeba invadens
LLFPSGGVERWGDKEVMR

SEQ ID NO: 3041493 - protein, 19 aa, Entamoeba invadens
LLHFPIDIATPLNITESSL

SEQ ID NO: 3041494 - protein, 20 aa, Entamoeba invadens
LLKDTCCINESVVFDDRGFK

SEQ ID NO: 3041495 - protein, 17 aa, Entamoeba invadens
LLKEFREAINAEKLTGN

SEQ ID NO: 3041496 - protein, 28 aa, Entamoeba invadens
LLKRSNRCLKCSNGYLLVVGSCQKSTNC

SEQ ID NO: 3041497 - protein, 18 aa, Entamoeba invadens
LLKVIGAYAHKYAKMASE

SEQ ID NO: 3041498 - protein, 24 aa, Entamoeba invadens
LLLGSFYRFRTVGFYDTNKAQILC

SEQ ID NO: 3041499 - protein, 19 aa, Entamoeba invadens
LLLHKCATFNVPLKITSSI

SEQ ID NO: 3041500 - protein, 17 aa, Entamoeba invadens
LLLVFLALGDTLPQTNV

SEQ ID NO: 3041501 - protein, 21 aa, Entamoeba invadens
LLSFLCVLGKYITNDQRQYVN

SEQ ID NO: 3041502 - protein, 18 aa, Entamoeba invadens
LLSTRAKIFNKIKRVEEK

SEQ ID NO: 3041503 - protein, 31 aa, Entamoeba invadens
LLVLALSRSGIWGGLDYQGLRVRDWENGLEE

SEQ ID NO: 3041504 - protein, 17 aa, Entamoeba invadens
LLYNVSAAKQWCENDGV

SEQ ID NO: 3041505 - protein, 24 aa, Entamoeba invadens
LMFFELKRKVLLQLGKETKIHKSV

SEQ ID NO: 3041506 - protein, 18 aa, Entamoeba invadens
LMIWYTYKVNKTFKPELL

SEQ ID NO: 3041507 - protein, 25 aa, Entamoeba invadens
LMKDKARYILDNSIKPFFEKYNWTI

SEQ ID NO: 3041508 - protein, 17 aa, Entamoeba invadens
LMLCSKAIEDTECCTLD

SEQ ID NO: 3041509 - protein, 23 aa, Entamoeba invadens
LMLDCARNPLSKETFVKVINSLA

SEQ ID NO: 3041510 - protein, 22 aa, Entamoeba invadens
LMLDKFRSEYIVHFYGAVFIPN

SEQ ID NO: 3041511 - protein, 30 aa, Entamoeba invadens
LMPAPDCGGYCFKTEELLTCNTCVNGVLVH

SEQ ID NO: 3041512 - protein, 18 aa, Entamoeba invadens
LMYFKLNWLEKWPIKLWC

SEQ ID NO: 3041513 - protein, 18 aa, Entamoeba invadens
LMYPCLPGTHSDYNAIEC

SEQ ID NO: 3041514 - protein, 27 aa, Entamoeba invadens
LNAKCINLFKFERKYIYKNEVEKKQYR

SEQ ID NO: 3041515 - protein, 20 aa, Entamoeba invadens
LNFRSRETLFIFLQVSKICL

SEQ ID NO: 3041516 - protein, 23 aa, Entamoeba invadens
LNGGECQLCPSGKYYNPNSKNCQ

SEQ ID NO: 3041517 - protein, 17 aa, Entamoeba invadens
LNHPLVLEQPKGEMKYH

SEQ ID NO: 3041518 - protein, 18 aa, Entamoeba invadens
LNIDKLILNFKWINTEFT

SEQ ID NO: 3041519 - protein, 19 aa, Entamoeba invadens
LNIQSRYSKPIKHSHKKVG

SEQ ID NO: 3041520 - protein, 26 aa, Entamoeba invadens
LNKDFRFTELTIFGSLLISSPNVITI

SEQ ID NO: 3041521 - protein, 17 aa, Entamoeba invadens
LNLFGTIHMYLRIKKMT

SEQ ID NO: 3041522 - protein, 17 aa, Entamoeba invadens
LNLVLMAFIPVMVNKNI

SEQ ID NO: 3041523 - protein, 21 aa, Entamoeba invadens
LNLYQCMSRVLYLIPSNLYDC

SEQ ID NO: 3041524 - protein, 20 aa, Entamoeba invadens
LNMLGFFCGGDVGGFAHDPT

SEQ ID NO: 3041525 - protein, 18 aa, Entamoeba invadens
LNNIMPMYFGEFDRSYVI

SEQ ID NO: 3041526 - protein, 17 aa, Entamoeba invadens
LNNKFNHPHINAMTRIN

SEQ ID NO: 3041527 - protein, 24 aa, Entamoeba invadens
LNPKKNRCLLKYMTPVYNTETGVL

SEQ ID NO: 3041528 - protein, 17 aa, Entamoeba invadens
LNRLRGVCTRIAADRQK

SEQ ID NO: 3041529 - protein, 26 aa, Entamoeba invadens
LNRNSMNRLLLLSFKTPSTLGTNSEI

SEQ ID NO: 3041530 - protein, 19 aa, Entamoeba invadens
LNSKFLRRIAKTSLHNNLD

SEQ ID NO: 3041531 - protein, 24 aa, Entamoeba invadens
LNSLEYCKELGFTLKHMGKKTHMT

SEQ ID NO: 3041532 - protein, 29 aa, Entamoeba invadens
LNTLVRRKAKILSTMKVYLESVPVDVRNN

SEQ ID NO: 3041533 - protein, 25 aa, Entamoeba invadens
LNVNCNLKFASGLTWVDMSDYYYYF

SEQ ID NO: 3041534 - protein, 17 aa, Entamoeba invadens
LNYLNKAVHAIRAEINS

SEQ ID NO: 3041535 - protein, 21 aa, Entamoeba invadens
LPAEMGHVWVDAHACKSGEQV

SEQ ID NO: 3041536 - protein, 17 aa, Entamoeba invadens
LPCEFCGKNSISSDNNT

SEQ ID NO: 3041537 - protein, 19 aa, Entamoeba invadens
LPDYSDLFVAQDTWSSPTT

SEQ ID NO: 3041538 - protein, 17 aa, Entamoeba invadens
LPIHIQNSFTLHSNSLA

SEQ ID NO: 3041539 - protein, 18 aa, Entamoeba invadens
LPKTYKANISYYDTDNTC

SEQ ID NO: 3041540 - protein, 18 aa, Entamoeba invadens
LPLKITKKYFFEAEQDTL

SEQ ID NO: 3041541 - protein, 22 aa, Entamoeba invadens
LPNLPTSKTWPLKRDPRPQTPK

SEQ ID NO: 3041542 - protein, 17 aa, Entamoeba invadens
LPPSHIITFNKKRKCDA

SEQ ID NO: 3041543 - protein, 18 aa, Entamoeba invadens
LPSLASYLMLEMFDENGS

SEQ ID NO: 3041544 - protein, 17 aa, Entamoeba invadens
LPYYDIIELNPLLDSSA

SEQ ID NO: 3041545 - protein, 18 aa, Entamoeba invadens
LQCSTCADGTYANTTGST

SEQ ID NO: 3041546 - protein, 24 aa, Entamoeba invadens
LQDGKCLFGDYVMKHCKTFKNNKC

SEQ ID NO: 3041547 - protein, 23 aa, Entamoeba invadens
LQEGFLIHGMWPRYFKNERLKCC

SEQ ID NO: 3041548 - protein, 27 aa, Entamoeba invadens
LQEKFKFPWKIAEFISSGKRLKRIDSI

SEQ ID NO: 3041549 - protein, 20 aa, Entamoeba invadens
LQEKREKKSLISNERDTMTR

SEQ ID NO: 3041550 - protein, 26 aa, Entamoeba invadens
LQFVKHKYPGVPIVFCIGNNDFNPSY

SEQ ID NO: 3041551 - protein, 17 aa, Entamoeba invadens
LQILEIYNSPLNEKYIG

SEQ ID NO: 3041552 - protein, 24 aa, Entamoeba invadens
LQLPSTLFKAFLNFLERVAAIQHT

SEQ ID NO: 3041553 - protein, 19 aa, Entamoeba invadens
LQNKHDILLSYGLVNSSIP

SEQ ID NO: 3041554 - protein, 24 aa, Entamoeba invadens
LQNLKAGFGNYIFYISRNIEYVNK

SEQ ID NO: 3041555 - protein, 23 aa, Entamoeba invadens
LQNLKAGFGNYLFYVSRNVENVK

SEQ ID NO: 3041556 - protein, 17 aa, Entamoeba invadens
LQPFFRQHCTNTAPRRE

SEQ ID NO: 3041557 - protein, 18 aa, Entamoeba invadens
LQRLLSLELARNIDGNMV

SEQ ID NO: 3041558 - protein, 25 aa, Entamoeba invadens
LQTLKELPPYVVIRRVYDEGSQCVI

SEQ ID NO: 3041559 - protein, 26 aa, Entamoeba invadens
LQVYLRWLQASTFLPLFRGYSEMHTF

SEQ ID NO: 3041560 - protein, 22 aa, Entamoeba invadens
LRAYKKRVVEPLIKRLQNVKIY

SEQ ID NO: 3041561 - protein, 19 aa, Entamoeba invadens
LREQVKRVLLEAKKAIKKA

SEQ ID NO: 3041562 - protein, 19 aa, Entamoeba invadens
LRFWNSKFIECHINEVPVI

SEQ ID NO: 3041563 - protein, 20 aa, Entamoeba invadens
LRGIIKAIPYIKSLGMNTLW

SEQ ID NO: 3041564 - protein, 17 aa, Entamoeba invadens
LRHMKIFVMLKQIEKHL

SEQ ID NO: 3041565 - protein, 17 aa, Entamoeba invadens
LRHMMSGTRLHSLQVTY

SEQ ID NO: 3041566 - protein, 18 aa, Entamoeba invadens
LRIIKARKYIATLMEIRA

SEQ ID NO: 3041567 - protein, 20 aa, Entamoeba invadens
LRILSNFFFSSHTQLFSNSV

SEQ ID NO: 3041568 - protein, 20 aa, Entamoeba invadens
LRKLGLKKGDKIGMFCETRY

SEQ ID NO: 3041569 - protein, 20 aa, Entamoeba invadens
LRLSKEYFNLLNVKLSDLKT

SEQ ID NO: 3041570 - protein, 26 aa, Entamoeba invadens
LRLVGPSQKQFICYVAGTMELSAPDL

SEQ ID NO: 3041571 - protein, 24 aa, Entamoeba invadens
LRMSPNGMVNRAFLQIISYSQSLV

SEQ ID NO: 3041572 - protein, 20 aa, Entamoeba invadens
LRPDKGIGEYWIDDFTLIPV

SEQ ID NO: 3041573 - protein, 24 aa, Entamoeba invadens
LRPLKPGNELQFWEFAPYKMYISF

SEQ ID NO: 3041574 - protein, 18 aa, Entamoeba invadens
LRRRAIFHMNSRIVENLN

SEQ ID NO: 3041575 - protein, 26 aa, Entamoeba invadens
LRSHPFRFIPSLEVYYCVCLMEYLII

SEQ ID NO: 3041576 - protein, 18 aa, Entamoeba invadens
LRSVCLVNHGLTFQIRLV

SEQ ID NO: 3041577 - protein, 19 aa, Entamoeba invadens
LRTAVKRSKVLLETMSIKQ

SEQ ID NO: 3041578 - protein, 22 aa, Entamoeba invadens
LRTDKFSGLNVRGLAAEADGTY

SEQ ID NO: 3041579 - protein, 21 aa, Entamoeba invadens
LRTFPIFPIIDFPLFERVQDL

SEQ ID NO: 3041580 - protein, 17 aa, Entamoeba invadens
LRTRIGFQTGQWYGLSA

SEQ ID NO: 3041581 - protein, 19 aa, Entamoeba invadens
LRVNTTVPIAFDISISGIK

SEQ ID NO: 3041582 - protein, 20 aa, Entamoeba invadens
LRVPEFGSTYGLDQLDPVFV

SEQ ID NO: 3041583 - protein, 21 aa, Entamoeba invadens
LSACTTRKPLLFIPGVMSTVL

SEQ ID NO: 3041584 - protein, 24 aa, Entamoeba invadens
LSADPEYGVNCYFLSDCVPNYRDS

SEQ ID NO: 3041585 - protein, 17 aa, Entamoeba invadens
LSAEKYLDIAFVDVAHN

SEQ ID NO: 3041586 - protein, 20 aa, Entamoeba invadens
LSCGTTILPLFDLGGLDNPQ

SEQ ID NO: 3041587 - protein, 17 aa, Entamoeba invadens
LSCTVGYYLKSGSCIKC

SEQ ID NO: 3041588 - protein, 19 aa, Entamoeba invadens
LSDGCLVSYVSVDTLKAKI

SEQ ID NO: 3041589 - protein, 22 aa, Entamoeba invadens
LSEDFKTVYVLKGRRCDELTMQ

SEQ ID NO: 3041590 - protein, 22 aa, Entamoeba invadens
LSEIKRQKCEQLLKETELDSDS

SEQ ID NO: 3041591 - protein, 24 aa, Entamoeba invadens
LSETCTRHPVVIVPGIMASMLNAV

SEQ ID NO: 3041592 - protein, 17 aa, Entamoeba invadens
LSFALGDVTANGGWVQE

SEQ ID NO: 3041593 - protein, 20 aa, Entamoeba invadens
LSFGDAFGVLRVIDLQTNKI

SEQ ID NO: 3041594 - protein, 23 aa, Entamoeba invadens
LSFNTLWFDVEVNSWSKNTQTNR

SEQ ID NO: 3041595 - protein, 24 aa, Entamoeba invadens
LSGKEIVKHIALISEDWNPENEML

SEQ ID NO: 3041596 - protein, 23 aa, Entamoeba invadens
LSGKSKLVCLNMFSKTVGSQISI

SEQ ID NO: 3041597 - protein, 19 aa, Entamoeba invadens
LSGVIAKLDVEGVVEAFKS

SEQ ID NO: 3041598 - protein, 20 aa, Entamoeba invadens
LSKKMSAKFGKKNAKKAMAK

SEQ ID NO: 3041599 - protein, 25 aa, Entamoeba invadens
LSKKYVNPVLLCYGKVNQDYSAFKN

SEQ ID NO: 3041600 - protein, 29 aa, Entamoeba invadens
LSLKINPLYQRIWYALGITYMQLNNLKEA

SEQ ID NO: 3041601 - protein, 20 aa, Entamoeba invadens
LSLLFVFFIFAFVVSTDNSI

SEQ ID NO: 3041602 - protein, 24 aa, Entamoeba invadens
LSNKEIIKHIALVSDEWNPENDML

SEQ ID NO: 3041603 - protein, 17 aa, Entamoeba invadens
LSPEQVTAMLIKRQLKN

SEQ ID NO: 3041604 - protein, 22 aa, Entamoeba invadens
LSQKRLIRFCKTLFDDSVLCHM

SEQ ID NO: 3041605 - protein, 17 aa, Entamoeba invadens
LSQSFKCETIDLTIPDS

SEQ ID NO: 3041606 - protein, 17 aa, Entamoeba invadens
LSRDWKTAHKHTGDSCT

SEQ ID NO: 3041607 - protein, 27 aa, Entamoeba invadens
LSSCTKGRITFYPEWEKGGCCNYGPRT

SEQ ID NO: 3041608 - protein, 21 aa, Entamoeba invadens
LSSFALLLLMVLTFTIQPNTN

SEQ ID NO: 3041609 - protein, 22 aa, Entamoeba invadens
LSSFALLLLMVLTFTIQPNTNF

SEQ ID NO: 3041610 - protein, 24 aa, Entamoeba invadens
LSSFLRLRKSPAFLKAHSKLSDFV

SEQ ID NO: 3041611 - protein, 17 aa, Entamoeba invadens
LSTEALETFKIAGYYNE

SEQ ID NO: 3041612 - protein, 18 aa, Entamoeba invadens
LSTSEVICSFSNTSVLTI

SEQ ID NO: 3041613 - protein, 25 aa, Entamoeba invadens
LSTYYKIINAMAMFKSNMLHLHLTD

SEQ ID NO: 3041614 - protein, 20 aa, Entamoeba invadens
LSVRNIFFIRGCQNCTFSDM

SEQ ID NO: 3041615 - protein, 20 aa, Entamoeba invadens
LSYNISFNCYSHIPNYKTLI

SEQ ID NO: 3041616 - protein, 24 aa, Entamoeba invadens
LSYVICFLEKTIIKFDKAHATSLT

SEQ ID NO: 3041617 - protein, 25 aa, Entamoeba invadens
LTAALKFKRNFIASKYKSTIDKLFA

SEQ ID NO: 3041618 - protein, 17 aa, Entamoeba invadens
LTAGFAYEGDNFVQVTV

SEQ ID NO: 3041619 - protein, 18 aa, Entamoeba invadens
LTCKTYFYLTNGYCQPCD

SEQ ID NO: 3041620 - protein, 19 aa, Entamoeba invadens
LTCRSGLYLSNGYCLPCDK

SEQ ID NO: 3041621 - protein, 27 aa, Entamoeba invadens
LTDGNSCLKCSAGDYTTRCESCEANCE

SEQ ID NO: 3041622 - protein, 19 aa, Entamoeba invadens
LTFDCKFNLYTYTSNLILS

SEQ ID NO: 3041623 - protein, 18 aa, Entamoeba invadens
LTFWEKVIVIAYEIFNFF

SEQ ID NO: 3041624 - protein, 19 aa, Entamoeba invadens
LTGSDLLLWASSAQFTSSR

SEQ ID NO: 3041625 - protein, 30 aa, Entamoeba invadens
LTIMEVFKDEVALDFGCTIDDFCQRQYETE

SEQ ID NO: 3041626 - protein, 23 aa, Entamoeba invadens
LTIRFDPEIVVLKSGFACEFSIY

SEQ ID NO: 3041627 - protein, 24 aa, Entamoeba invadens
LTKVKEFLSMFSSGIVQNVEEMIK

SEQ ID NO: 3041628 - protein, 21 aa, Entamoeba invadens
LTLMALEIQKDFELNVYTPNT

SEQ ID NO: 3041629 - protein, 20 aa, Entamoeba invadens
LTLSETYLKFIPTQIALLPN

SEQ ID NO: 3041630 - protein, 29 aa, Entamoeba invadens
LTPCLLSVGLFCSPAILAGENFSELFTDA

SEQ ID NO: 3041631 - protein, 20 aa, Entamoeba invadens
LTPGRAFILSSLDFHFRHNL

SEQ ID NO: 3041632 - protein, 20 aa, Entamoeba invadens
LTQEEVWGAFGAFRSSDEAK

SEQ ID NO: 3041633 - protein, 17 aa, Entamoeba invadens
LTRHSSLVVGRPHRASF

SEQ ID NO: 3041634 - protein, 21 aa, Entamoeba invadens
LTTTSIEWVCYATQTKLVTKI

SEQ ID NO: 3041635 - protein, 17 aa, Entamoeba invadens
LTWKNRVVNVFNKYDLK

SEQ ID NO: 3041636 - protein, 31 aa, Entamoeba invadens
LVCKCGKTAYTPCVWSWTDLPDCSLKPGDYF

SEQ ID NO: 3041637 - protein, 20 aa, Entamoeba invadens
LVCTECKNGGVPNERGICNS

SEQ ID NO: 3041638 - protein, 18 aa, Entamoeba invadens
LVEKRIDMRNEVMSGESA

SEQ ID NO: 3041639 - protein, 29 aa, Entamoeba invadens
LVENCQFCGYDLCYECYDGYYAFGYECHK

SEQ ID NO: 3041640 - protein, 17 aa, Entamoeba invadens
LVEWKGQDMAWWMNVVV

SEQ ID NO: 3041641 - protein, 24 aa, Entamoeba invadens
LVGLGAKESFSFSRFAANDDGSYF

SEQ ID NO: 3041642 - protein, 18 aa, Entamoeba invadens
LVHLSDGCLVSYVSVDTL

SEQ ID NO: 3041643 - protein, 18 aa, Entamoeba invadens
LVKNHWVKIELDTFDVDK

SEQ ID NO: 3041644 - protein, 28 aa, Entamoeba invadens
LVKRNIFWRRMVFLFLLFASAFSQTQTQ

SEQ ID NO: 3041645 - protein, 17 aa, Entamoeba invadens
LVLPRSYFEKLFNFLTK

SEQ ID NO: 3041646 - protein, 22 aa, Entamoeba invadens
LVMDYYSLGVLSVFRESHKVSD

SEQ ID NO: 3041647 - protein, 19 aa, Entamoeba invadens
LVMSLELLKDVSSTTEQEQ

SEQ ID NO: 3041648 - protein, 17 aa, Entamoeba invadens
LVNHLKEAISIPTVSKS

SEQ ID NO: 3041649 - protein, 21 aa, Entamoeba invadens
LVSFRSIWSDEHFLLQIEEKC

SEQ ID NO: 3041650 - protein, 28 aa, Entamoeba invadens
LVTDAMVFLLACEGYKLTIKKTKKTTKT

SEQ ID NO: 3041651 - protein, 23 aa, Entamoeba invadens
LVTDCLPCPSGTYSYGENKSSCT

SEQ ID NO: 3041652 - protein, 24 aa, Entamoeba invadens
LVTDCLPCPSGTYSYGENKSSCTP

SEQ ID NO: 3041653 - protein, 26 aa, Entamoeba invadens
LVTHSYGGPMAMEFFDAVGKEFCDKY

SEQ ID NO: 3041654 - protein, 28 aa, Entamoeba invadens
LVVGQFPECRGTVCKKLFEEVKAKIAEY

SEQ ID NO: 3041655 - protein, 17 aa, Entamoeba invadens
LVVLLGMTVDYGKGLTG

SEQ ID NO: 3041656 - protein, 24 aa, Entamoeba invadens
LVYNKAQVMLYDFSGINIDSNQNT

SEQ ID NO: 3041657 - protein, 17 aa, Entamoeba invadens
LVYSFQCSPGCPDGCIT

SEQ ID NO: 3041658 - protein, 25 aa, Entamoeba invadens
LYAPWCGHCKHLAPEFAAAAKEVNG

SEQ ID NO: 3041659 - protein, 18 aa, Entamoeba invadens
LYAVVLFLVGRNCWEGAQ

SEQ ID NO: 3041660 - protein, 19 aa, Entamoeba invadens
LYDFSCEFNFVLDLSSTCF

SEQ ID NO: 3041661 - protein, 20 aa, Entamoeba invadens
LYDFSCEFNFVLDLSSTCFK

SEQ ID NO: 3041662 - protein, 23 aa, Entamoeba invadens
LYDVKTGIDLFKFGNECDNKMQK

SEQ ID NO: 3041663 - protein, 20 aa, Entamoeba invadens
LYIKGTTQFMVFRKVSKNVE

SEQ ID NO: 3041664 - protein, 26 aa, Entamoeba invadens
LYKFENFKYIGIDVWQVKSGTIYDDI

SEQ ID NO: 3041665 - protein, 26 aa, Entamoeba invadens
LYLVKNCPLLEVIGLTGNKVMTIPRS

SEQ ID NO: 3041666 - protein, 17 aa, Entamoeba invadens
LYLVQGPYSYQCYDRDI

SEQ ID NO: 3041667 - protein, 17 aa, Entamoeba invadens
LYTSYKFYARVDDCVMV

SEQ ID NO: 3041668 - protein, 21 aa, Entamoeba invadens
LYVEMFYDVFIARDDLLNAFG

SEQ ID NO: 3041669 - protein, 29 aa, Entamoeba invadens
LYVKMQMRPRLLFYPLIKLTDILVFNGIK

SEQ ID NO: 3041670 - protein, 20 aa, Entamoeba invadens
LYYYKTWTRDAAYSAAILTA

SEQ ID NO: 3041671 - protein, 21 aa, Entamoeba invadens
MAMKALHTFDPAKFEVTEVCT

SEQ ID NO: 3041672 - protein, 27 aa, Entamoeba invadens
MASDDALSILLSFIVRKDERRTKDDEV

SEQ ID NO: 3041673 - protein, 22 aa, Entamoeba invadens
MCGVENCKTCLNKETCEVCINN

SEQ ID NO: 3041674 - protein, 21 aa, Entamoeba invadens
MCKKCSIDHCKVCGTNYKECT

SEQ ID NO: 3041675 - protein, 17 aa, Entamoeba invadens
MCRDGFVCNTMGMCQKE

SEQ ID NO: 3041676 - protein, 18 aa, Entamoeba invadens
MCYIKCPSGYIGNSATHI

SEQ ID NO: 3041677 - protein, 25 aa, Entamoeba invadens
MDHLGVPFKNGFWYLMETAGISFGK

SEQ ID NO: 3041678 - protein, 17 aa, Entamoeba invadens
MDKHGSCSYDIYKGPNG

SEQ ID NO: 3041679 - protein, 27 aa, Entamoeba invadens
MDKTCKEFTNGLLIRYKSKTGDILILK

SEQ ID NO: 3041680 - protein, 21 aa, Entamoeba invadens
MEELKGVGIVNGEYDTIRRQI

SEQ ID NO: 3041681 - protein, 17 aa, Entamoeba invadens
MEILSKRLGIPMTSVSK

SEQ ID NO: 3041682 - protein, 25 aa, Entamoeba invadens
MELKKRLYIDYQICPPYLFMPLLKM

SEQ ID NO: 3041683 - protein, 22 aa, Entamoeba invadens
MENGELVLPIGLYYSTVGNTEL

SEQ ID NO: 3041684 - protein, 25 aa, Entamoeba invadens
MFALSIDWCWEGDMLQCFNEKKEHC

SEQ ID NO: 3041685 - protein, 18 aa, Entamoeba invadens
MFGRYFCDSNKNLFLESV

SEQ ID NO: 3041686 - protein, 22 aa, Entamoeba invadens
MFGYSGDQWFSFDDKDTFEHKV

SEQ ID NO: 3041687 - protein, 17 aa, Entamoeba invadens
MFNCGFTSQPTPVAESP

SEQ ID NO: 3041688 - protein, 24 aa, Entamoeba invadens
MFNYAADLWVPFLTKDALESFKHG

SEQ ID NO: 3041689 - protein, 21 aa, Entamoeba invadens
MFQDRGGGVVGNIYEKTRFLF

SEQ ID NO: 3041690 - protein, 19 aa, Entamoeba invadens
MFTGCYNLAEIVGLESVTK

SEQ ID NO: 3041691 - protein, 20 aa, Entamoeba invadens
MGYYGFKHFLPSAYPMTHYY

SEQ ID NO: 3041692 - protein, 18 aa, Entamoeba invadens
MHSLTCKSLKRASGAVDL

SEQ ID NO: 3041693 - protein, 23 aa, Entamoeba invadens
MIDAGKIYLWFGAKSINETRRFS

SEQ ID NO: 3041694 - protein, 18 aa, Entamoeba invadens
MILQGGFDIPKIQQFFEI

SEQ ID NO: 3041695 - protein, 19 aa, Entamoeba invadens
MINEIFPKKNIKYFGGSEE

SEQ ID NO: 3041696 - protein, 26 aa, Entamoeba invadens
MIPYRRPSIKMLDLMNLKYGERLKAV

SEQ ID NO: 3041697 - protein, 23 aa, Entamoeba invadens
MIRKEKSRFERLLAQKKKLLKEA

SEQ ID NO: 3041698 - protein, 19 aa, Entamoeba invadens
MIVSHSYGGLISTFLADKF

SEQ ID NO: 3041699 - protein, 23 aa, Entamoeba invadens
MKCEKCTIGGCETCETVASAEQC

SEQ ID NO: 3041700 - protein, 23 aa, Entamoeba invadens
MKCYCESKLAMAMFAKQLSIKNN

SEQ ID NO: 3041701 - protein, 17 aa, Entamoeba invadens
MKDEITEVVILKATEYF

SEQ ID NO: 3041702 - protein, 23 aa, Entamoeba invadens
MKGMLNKRFKGLWEIPLSDWVDE

SEQ ID NO: 3041703 - protein, 19 aa, Entamoeba invadens
MKGQRMFVYLIGHGGEGFM

SEQ ID NO: 3041704 - protein, 20 aa, Entamoeba invadens
MKHNELHFYLGDDGNATTLF

SEQ ID NO: 3041705 - protein, 21 aa, Entamoeba invadens
MKHQLVVDWLHKEFEEAMNKT

SEQ ID NO: 3041706 - protein, 18 aa, Entamoeba invadens
MKIGCKPTPVSTEKEFKK

SEQ ID NO: 3041707 - protein, 21 aa, Entamoeba invadens
MKKELKPIVDKVLPQIKAKEN

SEQ ID NO: 3041708 - protein, 25 aa, Entamoeba invadens
MKKFGKKLESAFVKAAKKGKKALTQ

SEQ ID NO: 3041709 - protein, 19 aa, Entamoeba invadens
MKKGMKVAKKMVGKKGKSG

SEQ ID NO: 3041710 - protein, 21 aa, Entamoeba invadens
MKKLKRSSLAVVKAAKKVERT

SEQ ID NO: 3041711 - protein, 25 aa, Entamoeba invadens
MKKQLKTLWRLRIMDHRLRHLKHKR

SEQ ID NO: 3041712 - protein, 18 aa, Entamoeba invadens
MKKTPPVRISRWVRGVLR

SEQ ID NO: 3041713 - protein, 20 aa, Entamoeba invadens
MKKVKLNPAITYQANTFQGC

SEQ ID NO: 3041714 - protein, 20 aa, Entamoeba invadens
MKLLALRKREAKIREINRRK

SEQ ID NO: 3041715 - protein, 24 aa, Entamoeba invadens
MKLLKTADAWTVFKAAGAVADGKT

SEQ ID NO: 3041716 - protein, 25 aa, Entamoeba invadens
MKLLKVFNICCPFKQLDFSFHSFEQ

SEQ ID NO: 3041717 - protein, 22 aa, Entamoeba invadens
MKLMPGSLYLFKTLNKLYSIEG

SEQ ID NO: 3041718 - protein, 23 aa, Entamoeba invadens
MKMLESYNKMYTLFRLALTEKLF

SEQ ID NO: 3041719 - protein, 20 aa, Entamoeba invadens
MKNLPEYSAIVYSYLDAKHC

SEQ ID NO: 3041720 - protein, 27 aa, Entamoeba invadens
MKSEGMKEFIFNNIFPIFTNFDQEYIS

SEQ ID NO: 3041721 - protein, 17 aa, Entamoeba invadens
MKSFSVIKRRFRKIQKQ

SEQ ID NO: 3041722 - protein, 17 aa, Entamoeba invadens
MKTKWVVLESVSHLILL

SEQ ID NO: 3041723 - protein, 17 aa, Entamoeba invadens
MKTRFGDTLRVFIAVHL

SEQ ID NO: 3041724 - protein, 19 aa, Entamoeba invadens
MKVGEKMLLHQIKITEKLE

SEQ ID NO: 3041725 - protein, 21 aa, Entamoeba invadens
MKVKIWQSWYPSEWGKCEGTI

SEQ ID NO: 3041726 - protein, 21 aa, Entamoeba invadens
MKVVFTLLLVYIAASRVVLDP

SEQ ID NO: 3041727 - protein, 20 aa, Entamoeba invadens
MLFVNGLFFIPFFIFGVQAV

SEQ ID NO: 3041728 - protein, 18 aa, Entamoeba invadens
MLGKAILNEKPCEKKTPQ

SEQ ID NO: 3041729 - protein, 21 aa, Entamoeba invadens
MLKEFPGYLLDPSIIPRNNCE

SEQ ID NO: 3041730 - protein, 17 aa, Entamoeba invadens
MLLPESITRQAQITPSD

SEQ ID NO: 3041731 - protein, 26 aa, Entamoeba invadens
MLNAKRCIYPLFLFLHGMECLLQSYP

SEQ ID NO: 3041732 - protein, 24 aa, Entamoeba invadens
MLVNSFDFNSACTIKITDFGTSRF

SEQ ID NO: 3041733 - protein, 19 aa, Entamoeba invadens
MMFDLLLEKGFFFNSTLSR

SEQ ID NO: 3041734 - protein, 22 aa, Entamoeba invadens
MMKSDEVIKEFVLSDWMSLEKC

SEQ ID NO: 3041735 - protein, 28 aa, Entamoeba invadens
MNDDCLKHELDLLFKYYPKVGVAVNKEF

SEQ ID NO: 3041736 - protein, 23 aa, Entamoeba invadens
MNECHYILIQRCWNQQQENRPDI

SEQ ID NO: 3041737 - protein, 18 aa, Entamoeba invadens
MNLMMGCYEQPMTMKSTI

SEQ ID NO: 3041738 - protein, 19 aa, Entamoeba invadens
MNNHTGCVDNGVLGFSNSD

SEQ ID NO: 3041739 - protein, 24 aa, Entamoeba invadens
MNNLCTAKSLALCQQYGEPDVFTY

SEQ ID NO: 3041740 - protein, 25 aa, Entamoeba invadens
MNSYSKIKECLFLYIMNDAQVMLYD

SEQ ID NO: 3041741 - protein, 29 aa, Entamoeba invadens
MNTEKLLCCNLCLFDFIGCVNVNELTLPK

SEQ ID NO: 3041742 - protein, 19 aa, Entamoeba invadens
MNYGYRMNYPYNHPIYGYT

SEQ ID NO: 3041743 - protein, 19 aa, Entamoeba invadens
MNYVRCMNLRRGISKGMGP

SEQ ID NO: 3041744 - protein, 25 aa, Entamoeba invadens
MPFWPDESYRAMPGMLFSKKMIEYV

SEQ ID NO: 3041745 - protein, 17 aa, Entamoeba invadens
MPTFYTAGNYKLVRKAG

SEQ ID NO: 3041746 - protein, 17 aa, Entamoeba invadens
MPYCGTCEDAADKCNTC

SEQ ID NO: 3041747 - protein, 18 aa, Entamoeba invadens
MQKERAMKRLEQLEQKMI

SEQ ID NO: 3041748 - protein, 17 aa, Entamoeba invadens
MQKLFRPVGLVGGGATC

SEQ ID NO: 3041749 - protein, 19 aa, Entamoeba invadens
MRERVRLARRFDFRHRYDL

SEQ ID NO: 3041750 - protein, 19 aa, Entamoeba invadens
MRHDAVCVLNFVIPLFIQN

SEQ ID NO: 3041751 - protein, 17 aa, Entamoeba invadens
MRHQIFLNMFYYREKLE

SEQ ID NO: 3041752 - protein, 20 aa, Entamoeba invadens
MRKLPLVFKECEKKYDSCEC

SEQ ID NO: 3041753 - protein, 21 aa, Entamoeba invadens
MRQLERIARVKAIKKMIKKIE

SEQ ID NO: 3041754 - protein, 20 aa, Entamoeba invadens
MRQMKFALDKKIVLLRRLRG

SEQ ID NO: 3041755 - protein, 19 aa, Entamoeba invadens
MRSDLCIIAYSITDKPSFD

SEQ ID NO: 3041756 - protein, 18 aa, Entamoeba invadens
MRTKCSGLVKYVKDKHDI

SEQ ID NO: 3041757 - protein, 23 aa, Entamoeba invadens
MRYFESKLAVGMFINEFAKEHKE

SEQ ID NO: 3041758 - protein, 21 aa, Entamoeba invadens
MRYYCESKLAMAMFAKQLSKK

SEQ ID NO: 3041759 - protein, 17 aa, Entamoeba invadens
MSARAAIKYFKKEKFIG

SEQ ID NO: 3041760 - protein, 18 aa, Entamoeba invadens
MSAWYLFNALGFYSTMPS

SEQ ID NO: 3041761 - protein, 24 aa, Entamoeba invadens
MSEFLKLPTPVYHWGKHLSKDVNW

SEQ ID NO: 3041762 - protein, 20 aa, Entamoeba invadens
MSIGYSISWCEENGVISLDK

SEQ ID NO: 3041763 - protein, 19 aa, Entamoeba invadens
MSLCISTHLNCRVCKDDIC

SEQ ID NO: 3041764 - protein, 17 aa, Entamoeba invadens
MSLDACRLVGYQWDKHG

SEQ ID NO: 3041765 - protein, 31 aa, Entamoeba invadens
MSLYLGRKILRICPIEYNYDIGCILEHRDMS

SEQ ID NO: 3041766 - protein, 38 aa, Entamoeba invadens
MSQSHIIRQLHMERYFKVYPFIVPNIRKEIPINRDDNR

SEQ ID NO: 3041767 - protein, 22 aa, Entamoeba invadens
MSSKTIQFYAWAKIIPPVGNSF

SEQ ID NO: 3041768 - protein, 21 aa, Entamoeba invadens
MSTVCVLCAPGTYSYGNNKEV

SEQ ID NO: 3041769 - protein, 23 aa, Entamoeba invadens
MTDLLSQRLLRICPTNNENSTIA

SEQ ID NO: 3041770 - protein, 27 aa, Entamoeba invadens
MTFAGGAKGVFYFSYYDIKRMDYKTPF

SEQ ID NO: 3041771 - protein, 17 aa, Entamoeba invadens
MTFRYIKTNGIMAESDY

SEQ ID NO: 3041772 - protein, 18 aa, Entamoeba invadens
MTGNGVLYVGLLNKADRI

SEQ ID NO: 3041773 - protein, 17 aa, Entamoeba invadens
MTKCKFIASPLLYSEKH

SEQ ID NO: 3041774 - protein, 25 aa, Entamoeba invadens
MTKLKACGFDYYYDKAFLDKCESGV

SEQ ID NO: 3041775 - protein, 17 aa, Entamoeba invadens
MTVTEMIKNPGIEIPPP

SEQ ID NO: 3041776 - protein, 18 aa, Entamoeba invadens
MVACEISTNLIIMTPSGI

SEQ ID NO: 3041777 - protein, 26 aa, Entamoeba invadens
MVCTDCSSKDKIAFATINAAFGKMLG

SEQ ID NO: 3041778 - protein, 17 aa, Entamoeba invadens
MVFTQFWPGQKCIEDKC

SEQ ID NO: 3041779 - protein, 20 aa, Entamoeba invadens
MVKLKKFPFHLLDPKTAPRN

SEQ ID NO: 3041780 - protein, 25 aa, Entamoeba invadens
MVLALDLCFYGPYGIPFYTPLIQPC

SEQ ID NO: 3041781 - protein, 29 aa, Entamoeba invadens
MVNENKLALDLVKTCKYDAENVNNVIVIK

SEQ ID NO: 3041782 - protein, 32 aa, Entamoeba invadens
MVQNQYRLKVEWPLFSYHSLSGMIIPPPLMTK

SEQ ID NO: 3041783 - protein, 23 aa, Entamoeba invadens
MVSSIICAPSFKIDNYTPTIQYI

SEQ ID NO: 3041784 - protein, 32 aa, Entamoeba invadens
MVSYFTNWAQYRWASIDGWACKFTPENVDPTI

SEQ ID NO: 3041785 - protein, 17 aa, Entamoeba invadens
MWDSLTLARYSMRNAHI

SEQ ID NO: 3041786 - protein, 22 aa, Entamoeba invadens
MYAAPFDWRYFRFDEYSHVSNW

SEQ ID NO: 3041787 - protein, 19 aa, Entamoeba invadens
MYEECMDRYPMDHVPNNVP

SEQ ID NO: 3041788 - protein, 23 aa, Entamoeba invadens
MYENAFCLIGKAGRVFVSNQLQL

SEQ ID NO: 3041789 - protein, 24 aa, Entamoeba invadens
MYFVKRGPSELAITAFTHSLFDEN

SEQ ID NO: 3041790 - protein, 17 aa, Entamoeba invadens
MYNEISLVGATQQTTRI

SEQ ID NO: 3041791 - protein, 19 aa, Entamoeba invadens
MYTSFPIPKRVHDIRGSAS

SEQ ID NO: 3041792 - protein, 18 aa, Entamoeba invadens
MYVHFSQFSMDFEVKNCS

SEQ ID NO: 3041793 - protein, 17 aa, Entamoeba invadens
NAAEIAKMRSVVTQEEL

SEQ ID NO: 3041794 - protein, 22 aa, Entamoeba invadens
NAAQCGVCYEIVGPKGVLYVRI

SEQ ID NO: 3041795 - protein, 20 aa, Entamoeba invadens
NADCSVCIPPYIVDLETHEC

SEQ ID NO: 3041796 - protein, 23 aa, Entamoeba invadens
NAFKGCDMLESINLYESLLQISD

SEQ ID NO: 3041797 - protein, 21 aa, Entamoeba invadens
NAGLVPKRIQWMIDHTGPDFI

SEQ ID NO: 3041798 - protein, 24 aa, Entamoeba invadens
NAHPAWLKGCELMHITPVIIPIND

SEQ ID NO: 3041799 - protein, 18 aa, Entamoeba invadens
NAIFKCEMCEVKCTNLYL

SEQ ID NO: 3041800 - protein, 24 aa, Entamoeba invadens
NAIHLYKSVHVEFGKLTKYDSTQV

SEQ ID NO: 3041801 - protein, 21 aa, Entamoeba invadens
NAKMGVGCVVNCVSLTRLDIP

SEQ ID NO: 3041802 - protein, 27 aa, Entamoeba invadens
NALFWLFKCVMDIIQPFYFCENDTIMR

SEQ ID NO: 3041803 - protein, 25 aa, Entamoeba invadens
NALLRFGESKLFFCHLNETNDVYNA

SEQ ID NO: 3041804 - protein, 22 aa, Entamoeba invadens
NANRTAYMVGIGRDIPINETLN

SEQ ID NO: 3041805 - protein, 17 aa, Entamoeba invadens
NAQLKAQRLRNNAKIQA

SEQ ID NO: 3041806 - protein, 21 aa, Entamoeba invadens
NAVTVNGNWVSKVYRVREKVQ

SEQ ID NO: 3041807 - protein, 27 aa, Entamoeba invadens
NCAPQERTAICRKEIYQTFPTVKIYLE

SEQ ID NO: 3041808 - protein, 21 aa, Entamoeba invadens
NCIYGDGTVCIKCETGESHSK

SEQ ID NO: 3041809 - protein, 18 aa, Entamoeba invadens
NCKSCKDGETCDKCHDNF

SEQ ID NO: 3041810 - protein, 18 aa, Entamoeba invadens
NCLSCSKFYYLLNGQCLE

SEQ ID NO: 3041811 - protein, 25 aa, Entamoeba invadens
NCQDYKPQEFIPIVCNGTIMNVTVQ

SEQ ID NO: 3041812 - protein, 24 aa, Entamoeba invadens
NCQKARISHFSGWENGGACQFGPV

SEQ ID NO: 3041813 - protein, 18 aa, Entamoeba invadens
NCQRQAWNTWNYTPQTPL

SEQ ID NO: 3041814 - protein, 20 aa, Entamoeba invadens
NCRSRCLTCLYKDKCTSCNS

SEQ ID NO: 3041815 - protein, 19 aa, Entamoeba invadens
NCTDYKPSQNITYTLIVCN

SEQ ID NO: 3041816 - protein, 21 aa, Entamoeba invadens
NCYQGKCIEANIQQYGALQIV

SEQ ID NO: 3041817 - protein, 17 aa, Entamoeba invadens
NDAEFMEALSLNWASLS

SEQ ID NO: 3041818 - protein, 25 aa, Entamoeba invadens
NDCGLKRFDCNNVECTIDLNNTIED

SEQ ID NO: 3041819 - protein, 22 aa, Entamoeba invadens
NDCIICEGVGYYPGTNVSYIFQ

SEQ ID NO: 3041820 - protein, 26 aa, Entamoeba invadens
NDECFLISGWYKYFIVKENGKSYLKK

SEQ ID NO: 3041821 - protein, 19 aa, Entamoeba invadens
NDITHFFADWDKYYNIAPS

SEQ ID NO: 3041822 - protein, 30 aa, Entamoeba invadens
NDIYRLPITSGRSSLNLVSFLNEKIKFENV

SEQ ID NO: 3041823 - protein, 23 aa, Entamoeba invadens
NDKRETFVTTEWIQIKTKPTKNT

SEQ ID NO: 3041824 - protein, 17 aa, Entamoeba invadens
NDKTYCLIRQKLSQIRS

SEQ ID NO: 3041825 - protein, 23 aa, Entamoeba invadens
NDNFCNRSGWTVTYNYDDYYFTF

SEQ ID NO: 3041826 - protein, 24 aa, Entamoeba invadens
NDVTCLTCEPVALGGNGRDASNKC

SEQ ID NO: 3041827 - protein, 30 aa, Entamoeba invadens
NDYKLRIVSHKEIFPDTSVLPIFNSNALEV

SEQ ID NO: 3041828 - protein, 19 aa, Entamoeba invadens
NDYWGRHKAALAFLAAYSG

SEQ ID NO: 3041829 - protein, 24 aa, Entamoeba invadens
NEAILKPGNYLSVIGVSQGNATIT

SEQ ID NO: 3041830 - protein, 23 aa, Entamoeba invadens
NECKAMYLEDWIRDVCLEYKGYN

SEQ ID NO: 3041831 - protein, 23 aa, Entamoeba invadens
NEDCTRRGLSHAMNLVGYGTTKD

SEQ ID NO: 3041832 - protein, 18 aa, Entamoeba invadens
NEESPCVLLDSSIEDSSQ

SEQ ID NO: 3041833 - protein, 17 aa, Entamoeba invadens
NEFTQIPTLQWDDDYTH

SEQ ID NO: 3041834 - protein, 18 aa, Entamoeba invadens
NEGICTSGVLYAEAVFQS

SEQ ID NO: 3041835 - protein, 17 aa, Entamoeba invadens
NEISENIFLTNDCYAPS

SEQ ID NO: 3041836 - protein, 17 aa, Entamoeba invadens
NEKIKRNAAEIAKMRSV

SEQ ID NO: 3041837 - protein, 21 aa, Entamoeba invadens
NEMKKREVVIVKNEKGDYELL

SEQ ID NO: 3041838 - protein, 25 aa, Entamoeba invadens
NENKVSYCPKLIYIGDEAFYQTNLI

SEQ ID NO: 3041839 - protein, 22 aa, Entamoeba invadens
NERFQSLGVAFYRGADCCALVH

SEQ ID NO: 3041840 - protein, 19 aa, Entamoeba invadens
NERLKCCKTSFTELQVENQ

SEQ ID NO: 3041841 - protein, 20 aa, Entamoeba invadens
NESKCGLPVDNCRLTQNSYC

SEQ ID NO: 3041842 - protein, 18 aa, Entamoeba invadens
NESVYFLKWHILQPDYAI

SEQ ID NO: 3041843 - protein, 20 aa, Entamoeba invadens
NESYFKWDVPTYCFVPHNKS

SEQ ID NO: 3041844 - protein, 18 aa, Entamoeba invadens
NETHPMLVISEVKNISIG

SEQ ID NO: 3041845 - protein, 22 aa, Entamoeba invadens
NETKPLLMYDFAVTNYDFNEVN

SEQ ID NO: 3041846 - protein, 24 aa, Entamoeba invadens
NETRRFSLQFALEVAKRRGQQSVL

SEQ ID NO: 3041847 - protein, 21 aa, Entamoeba invadens
NEYMLRPEYYETFNNKDPYMA

SEQ ID NO: 3041848 - protein, 23 aa, Entamoeba invadens
NEYMNIYLLDKCYYTGGNTYTKY

SEQ ID NO: 3041849 - protein, 23 aa, Entamoeba invadens
NEYMNVYLLDKCYYTGGNTYTKY

SEQ ID NO: 3041850 - protein, 23 aa, Entamoeba invadens
NFANSICKNGFIIGDRNAYGDGV

SEQ ID NO: 3041851 - protein, 18 aa, Entamoeba invadens
NFDLKMVIQSSGVKPIYR

SEQ ID NO: 3041852 - protein, 19 aa, Entamoeba invadens
NFECEVCTGGQSSATRKYV

SEQ ID NO: 3041853 - protein, 25 aa, Entamoeba invadens
NFFQGCTSLKSVIGFDKITDFGQSS

SEQ ID NO: 3041854 - protein, 23 aa, Entamoeba invadens
NFHLLFHPLVSFMMRNEDVSKKV

SEQ ID NO: 3041855 - protein, 22 aa, Entamoeba invadens
NFIAYILVQHGFAFNITLTTIK

SEQ ID NO: 3041856 - protein, 22 aa, Entamoeba invadens
NFKEIKMEWLWVDDKKENVCSN

SEQ ID NO: 3041857 - protein, 22 aa, Entamoeba invadens
NFKIECPNIIKSLNLYENSKIF

SEQ ID NO: 3041858 - protein, 24 aa, Entamoeba invadens
NFNKCPKHLLANGKLYRLTPDNIF

SEQ ID NO: 3041859 - protein, 24 aa, Entamoeba invadens
NFNYKGKCSKVFKYKKNNPRDLFL

SEQ ID NO: 3041860 - protein, 19 aa, Entamoeba invadens
NFYKCAANAYAAGYTKSQF

SEQ ID NO: 3041861 - protein, 18 aa, Entamoeba invadens
NGDGWLLIMNSITPEAGT

SEQ ID NO: 3041862 - protein, 19 aa, Entamoeba invadens
NGDGWLLIMNSITPEAVYD

SEQ ID NO: 3041863 - protein, 19 aa, Entamoeba invadens
NGDGWLLIMNSITPEVVHN

SEQ ID NO: 3041864 - protein, 18 aa, Entamoeba invadens
NGDLKVSEFELVYNKSVI

SEQ ID NO: 3041865 - protein, 18 aa, Entamoeba invadens
NGEKCLECDFGYYLDLTK

SEQ ID NO: 3041866 - protein, 19 aa, Entamoeba invadens
NGEVSTIIFTRTGDSTTSV

SEQ ID NO: 3041867 - protein, 22 aa, Entamoeba invadens
NGGFGYKVYDYIKENGIVQEKD

SEQ ID NO: 3041868 - protein, 25 aa, Entamoeba invadens
NGGFKTVCDRFLKAPDIEKYNAQHV

SEQ ID NO: 3041869 - protein, 25 aa, Entamoeba invadens
NGGGHAITMWGYELGDYDMVDAEEC

SEQ ID NO: 3041870 - protein, 22 aa, Entamoeba invadens
NGKCGICDDGFYLSNEKCVRIT

SEQ ID NO: 3041871 - protein, 23 aa, Entamoeba invadens
NGKCLTCAAGYGFDNGVCTLCGD

SEQ ID NO: 3041872 - protein, 24 aa, Entamoeba invadens
NGKCLTCAAGYGFDSGVCTLCGDL

SEQ ID NO: 3041873 - protein, 22 aa, Entamoeba invadens
NGKCQICPAGTWANQKTKNCDE

SEQ ID NO: 3041874 - protein, 21 aa, Entamoeba invadens
NGKCQYVPFCYLFNKDKTKCI

SEQ ID NO: 3041875 - protein, 19 aa, Entamoeba invadens
NGKECYNSITIKGVTKQST

SEQ ID NO: 3041876 - protein, 19 aa, Entamoeba invadens
NGLEWYAQPYLIAESIPSD

SEQ ID NO: 3041877 - protein, 23 aa, Entamoeba invadens
NGLYRLKEKGNWRCVSTCPATTT

SEQ ID NO: 3041878 - protein, 23 aa, Entamoeba invadens
NGMLALLVNEGYSFVEKKVKRAH

SEQ ID NO: 3041879 - protein, 24 aa, Entamoeba invadens
NGNTFKTTLIFSVYTDIVTTNIGI

SEQ ID NO: 3041880 - protein, 18 aa, Entamoeba invadens
NGNTKCFDVFSLNNQNNL

SEQ ID NO: 3041881 - protein, 25 aa, Entamoeba invadens
NGRGCSLCPAGYFSPGGISTCTVCR

SEQ ID NO: 3041882 - protein, 26 aa, Entamoeba invadens
NGRPYHISALFIIDFDNFRRDDVGTV

SEQ ID NO: 3041883 - protein, 23 aa, Entamoeba invadens
NGTCVRGGMDNCLIYISQSECDT

SEQ ID NO: 3041884 - protein, 18 aa, Entamoeba invadens
NGTRFLVKNQDATIVKTY

SEQ ID NO: 3041885 - protein, 18 aa, Entamoeba invadens
NGVFDYTPSFALNETDYF

SEQ ID NO: 3041886 - protein, 26 aa, Entamoeba invadens
NGVRSCLMCLTGYYPSSGMCVECSAT

SEQ ID NO: 3041887 - protein, 31 aa, Entamoeba invadens
NGWKDDSYGTAWALFPAAAKKYGLNCKQYSC

SEQ ID NO: 3041888 - protein, 18 aa, Entamoeba invadens
NGYEAYKYECVSCNTGGA

SEQ ID NO: 3041889 - protein, 18 aa, Entamoeba invadens
NGYNRILYFGKTEINVYA

SEQ ID NO: 3041890 - protein, 25 aa, Entamoeba invadens
NHDTICFSYNFIFFYTTYYFNEIVI

SEQ ID NO: 3041891 - protein, 26 aa, Entamoeba invadens
NHDVWRFGNLIRRKFGITRQSTEYWL

SEQ ID NO: 3041892 - protein, 22 aa, Entamoeba invadens
NHRKCLRYYPLKKGKYDFLVLV

SEQ ID NO: 3041893 - protein, 24 aa, Entamoeba invadens
NICTPMKFVFFVVFLLTTNGYHCD

SEQ ID NO: 3041894 - protein, 21 aa, Entamoeba invadens
NICVFADPFHDFIVALISPSH

SEQ ID NO: 3041895 - protein, 18 aa, Entamoeba invadens
NIDQKWLIGYQVNEKSLY

SEQ ID NO: 3041896 - protein, 18 aa, Entamoeba invadens
NIFMETWSPSTYVRNINA

SEQ ID NO: 3041897 - protein, 20 aa, Entamoeba invadens
NIGTALAGYVQYNSSVWKKN

SEQ ID NO: 3041898 - protein, 29 aa, Entamoeba invadens
NIIANLKLDRRFSGVDIVLGKSKFPEPVA

SEQ ID NO: 3041899 - protein, 24 aa, Entamoeba invadens
NIIKEAKRKGVRDVTVNYNMLRSM

SEQ ID NO: 3041900 - protein, 19 aa, Entamoeba invadens
NIIKTKIDLSRNINGADRV

SEQ ID NO: 3041901 - protein, 32 aa, Entamoeba invadens
NIITKVCEWCPVTFYFYKYQCVKCSSHCLRCV

SEQ ID NO: 3041902 - protein, 23 aa, Entamoeba invadens
NILISGKCFVFFGENVTEVHYLS

SEQ ID NO: 3041903 - protein, 25 aa, Entamoeba invadens
NINIWRDITNYFKTNAVTPDMFNKT

SEQ ID NO: 3041904 - protein, 32 aa, Entamoeba invadens
NIPGSNFDEVWSFRAIKKGFVWVNATYNIPTT

SEQ ID NO: 3041905 - protein, 23 aa, Entamoeba invadens
NITVSLYAWFEFKNVELKENSHI

SEQ ID NO: 3041906 - protein, 19 aa, Entamoeba invadens
NIYILLSLLNFTSSQICSF

SEQ ID NO: 3041907 - protein, 20 aa, Entamoeba invadens
NKAKVTWDYVLHVQTWPGNF

SEQ ID NO: 3041908 - protein, 19 aa, Entamoeba invadens
NKAVHAIRAEINSSMTSVS

SEQ ID NO: 3041909 - protein, 19 aa, Entamoeba invadens
NKCEYCPLGMYSSSKSSLS

SEQ ID NO: 3041910 - protein, 21 aa, Entamoeba invadens
NKCLVKRMFLFLKRMLHSNNS

SEQ ID NO: 3041911 - protein, 25 aa, Entamoeba invadens
NKEGLKASFFTWRVLQINRDNSTTI

SEQ ID NO: 3041912 - protein, 18 aa, Entamoeba invadens
NKEHCIFCNNKITVEGKY

SEQ ID NO: 3041913 - protein, 25 aa, Entamoeba invadens
NKELRKAYVTFIVKVSKWVKLLDKL

SEQ ID NO: 3041914 - protein, 18 aa, Entamoeba invadens
NKGEDVFNGIAYDESKNR

SEQ ID NO: 3041915 - protein, 17 aa, Entamoeba invadens
NKICLVTQFAEYGSLQN

SEQ ID NO: 3041916 - protein, 17 aa, Entamoeba invadens
NKKEITTIMALANDSFP

SEQ ID NO: 3041917 - protein, 19 aa, Entamoeba invadens
NKKLIKGIVNYSKKAPFQT

SEQ ID NO: 3041918 - protein, 19 aa, Entamoeba invadens
NKKYNVWAPVYGMTSSIPD

SEQ ID NO: 3041919 - protein, 17 aa, Entamoeba invadens
NKLCKLAKITDDIYSCE

SEQ ID NO: 3041920 - protein, 20 aa, Entamoeba invadens
NKLKEEKENFELATKQRKEM

SEQ ID NO: 3041921 - protein, 20 aa, Entamoeba invadens
NKLKEKAYCETGKKLEVEKT

SEQ ID NO: 3041922 - protein, 25 aa, Entamoeba invadens
NKLKPNCIWLNVIDGWYSDIPDRQG

SEQ ID NO: 3041923 - protein, 18 aa, Entamoeba invadens
NKLTFSFTSNTTFTFGFS

SEQ ID NO: 3041924 - protein, 20 aa, Entamoeba invadens
NKMIKYVVVDGINAEELVFD

SEQ ID NO: 3041925 - protein, 23 aa, Entamoeba invadens
NKNKFLICSDVFKGFLTCPSGSV

SEQ ID NO: 3041926 - protein, 22 aa, Entamoeba invadens
NKTAVFQFFFDVILRCKEIGEY

SEQ ID NO: 3041927 - protein, 24 aa, Entamoeba invadens
NKVDCKRVWFDIEGTWSSSASTNQ

SEQ ID NO: 3041928 - protein, 17 aa, Entamoeba invadens
NKVESTVTKGANKLVDK

SEQ ID NO: 3041929 - protein, 26 aa, Entamoeba invadens
NKYLFIYFALEKCVYSGNNVYMKVSR

SEQ ID NO: 3041930 - protein, 24 aa, Entamoeba invadens
NLEKRIEGKMVRKTVKGMAKKFEH

SEQ ID NO: 3041931 - protein, 25 aa, Entamoeba invadens
NLIKRQDMFSHLLALISGGLDEMSI

SEQ ID NO: 3041932 - protein, 22 aa, Entamoeba invadens
NLISKGERPAIELGDKEQKALI

SEQ ID NO: 3041933 - protein, 22 aa, Entamoeba invadens
NLKFPCPLHVLIDGPSEQTETD

SEQ ID NO: 3041934 - protein, 23 aa, Entamoeba invadens
NLKKSSAKIHVCYDRVIVVKKNI

SEQ ID NO: 3041935 - protein, 19 aa, Entamoeba invadens
NLLKVPHHIIANYTEVSEQ

SEQ ID NO: 3041936 - protein, 25 aa, Entamoeba invadens
NLNKVWKETRLKSQKKVDLKRLSST

SEQ ID NO: 3041937 - protein, 19 aa, Entamoeba invadens
NLNNKRINAVLQLTSEQVN

SEQ ID NO: 3041938 - protein, 18 aa, Entamoeba invadens
NLPEYSAIVYSYLDAKHC

SEQ ID NO: 3041939 - protein, 18 aa, Entamoeba invadens
NLPEYSAVVYSYLDAEHC

SEQ ID NO: 3041940 - protein, 22 aa, Entamoeba invadens
NLPNFKMCRGYKIHKNRFHTIM

SEQ ID NO: 3041941 - protein, 28 aa, Entamoeba invadens
NLTGVSFMPPRFAVGFHNSKWGYNSQNV

SEQ ID NO: 3041942 - protein, 19 aa, Entamoeba invadens
NLVTELAKYLLLERDGTVV

SEQ ID NO: 3041943 - protein, 26 aa, Entamoeba invadens
NMCKDCSNTKCKTCASNPTSGCDSCP

SEQ ID NO: 3041944 - protein, 20 aa, Entamoeba invadens
NMELAVGLWASEQYKNVTEE

SEQ ID NO: 3041945 - protein, 29 aa, Entamoeba invadens
NMFYYREKLELISLLALYFKCETTETYLL

SEQ ID NO: 3041946 - protein, 24 aa, Entamoeba invadens
NMKFNKLWISLEVFVTHSLKTDVE

SEQ ID NO: 3041947 - protein, 30 aa, Entamoeba invadens
NMPLFKRIESMDVYALWYFYQTSIPKVHEE

SEQ ID NO: 3041948 - protein, 22 aa, Entamoeba invadens
NNCRSCLLYYYLSNGYCLPCDS

SEQ ID NO: 3041949 - protein, 20 aa, Entamoeba invadens
NNDYWGRHKAALAFLAAYSG

SEQ ID NO: 3041950 - protein, 25 aa, Entamoeba invadens
NNECKRLNNQNCLKLLQGDTSYKWF

SEQ ID NO: 3041951 - protein, 23 aa, Entamoeba invadens
NNEKCFLCKNYTYLFNNKCYPIS

SEQ ID NO: 3041952 - protein, 17 aa, Entamoeba invadens
NNFAIVRFWPGEVCRTK

SEQ ID NO: 3041953 - protein, 18 aa, Entamoeba invadens
NNFVFSTYQWEAALVNKN

SEQ ID NO: 3041954 - protein, 20 aa, Entamoeba invadens
NNKSKWWGAATYFEMPNNIV

SEQ ID NO: 3041955 - protein, 23 aa, Entamoeba invadens
NNMKFKRVWYDIEGTWTSSVSTN

SEQ ID NO: 3041956 - protein, 26 aa, Entamoeba invadens
NNNLCTACKVNGCVTCTSGPNKCDVC

SEQ ID NO: 3041957 - protein, 17 aa, Entamoeba invadens
NNNYKDCHGCDGGSLSC

SEQ ID NO: 3041958 - protein, 26 aa, Entamoeba invadens
NNPEEWNTMCLRCIARMGKFSSDRSI

SEQ ID NO: 3041959 - protein, 19 aa, Entamoeba invadens
NNRCIVCNDGYYLGDDGMC

SEQ ID NO: 3041960 - protein, 20 aa, Entamoeba invadens
NNRFYTMYSEGEFEVFAMLA

SEQ ID NO: 3041961 - protein, 18 aa, Entamoeba invadens
NNTPLDKEVVCILKQNNY

SEQ ID NO: 3041962 - protein, 20 aa, Entamoeba invadens
NNVTLKFDVMYNKSNYVNFI

SEQ ID NO: 3041963 - protein, 18 aa, Entamoeba invadens
NNYACQFTFYYVYLDLMM

SEQ ID NO: 3041964 - protein, 21 aa, Entamoeba invadens
NPCTFSIKNNQVFVKVPKTIG

SEQ ID NO: 3041965 - protein, 22 aa, Entamoeba invadens
NPLPLPIVQPFPIPPSQADPKP

SEQ ID NO: 3041966 - protein, 21 aa, Entamoeba invadens
NPPRGELMFKGLPVTKGYFKR

SEQ ID NO: 3041967 - protein, 27 aa, Entamoeba invadens
NPPVLKQGLLFKMLHDFEIDDFNTLLN

SEQ ID NO: 3041968 - protein, 28 aa, Entamoeba invadens
NPSFSDFRRFGGWAKPTAKRYSPNNYVC

SEQ ID NO: 3041969 - protein, 19 aa, Entamoeba invadens
NPTPLPFPTPAPITAPEKV

SEQ ID NO: 3041970 - protein, 19 aa, Entamoeba invadens
NPTSCLGCNGNYYLKDGMC

SEQ ID NO: 3041971 - protein, 18 aa, Entamoeba invadens
NPVFSCKEIGSLFEIKIC

SEQ ID NO: 3041972 - protein, 25 aa, Entamoeba invadens
NPVSPRLYPTFSFLSTVPPKMREEL

SEQ ID NO: 3041973 - protein, 17 aa, Entamoeba invadens
NQFCLKCNGKAQPTSGE

SEQ ID NO: 3041974 - protein, 22 aa, Entamoeba invadens
NQIESFGIGVFEMCISLTEVKI

SEQ ID NO: 3041975 - protein, 24 aa, Entamoeba invadens
NQIPDFLNTSSFQFNEYTLRIVDH

SEQ ID NO: 3041976 - protein, 20 aa, Entamoeba invadens
NQIRLFKFTFWVTSVDLEEI

SEQ ID NO: 3041977 - protein, 25 aa, Entamoeba invadens
NQISVFEIKICYDINTNPNDPKAIP

SEQ ID NO: 3041978 - protein, 23 aa, Entamoeba invadens
NQNPDLRLSFKQITPIVQHISKN

SEQ ID NO: 3041979 - protein, 50 aa, Entamoeba invadens
NQQKALSMLCAFKTFNWKKVEGTPTKRAVLCMKSMFVVNNREYFKVEVDF

SEQ ID NO: 3041980 - protein, 17 aa, Entamoeba invadens
NRCEEFLGDVVLLQKMR

SEQ ID NO: 3041981 - protein, 24 aa, Entamoeba invadens
NRELNYFFKWSFHKVNPDLSIISL

SEQ ID NO: 3041982 - protein, 25 aa, Entamoeba invadens
NREYFKVEVDFSMCDVKPKLAGLYI

SEQ ID NO: 3041983 - protein, 17 aa, Entamoeba invadens
NRFKKYKKGIFRMTYDD

SEQ ID NO: 3041984 - protein, 20 aa, Entamoeba invadens
NRFRASGICQLRSNVNNYAQ

SEQ ID NO: 3041985 - protein, 24 aa, Entamoeba invadens
NRIQHKKNFLLFIIKMSLSENQID

SEQ ID NO: 3041986 - protein, 33 aa, Entamoeba invadens
NRKGAYKRLVRSSRGLGLKRVAGRNIKSATTQT

SEQ ID NO: 3041987 - protein, 21 aa, Entamoeba invadens
NRKLELMVFTQFWPGQKCIED

SEQ ID NO: 3041988 - protein, 23 aa, Entamoeba invadens
NRMKRRYIVYGLDKWVLIERIKQ

SEQ ID NO: 3041989 - protein, 22 aa, Entamoeba invadens
NRMNFKRVWFDIEGDWYNDVGS

SEQ ID NO: 3041990 - protein, 18 aa, Entamoeba invadens
NRNIYCCRNNFNIYEIER

SEQ ID NO: 3041991 - protein, 20 aa, Entamoeba invadens
NRNTRCYVTTTFMFNTIGDK

SEQ ID NO: 3041992 - protein, 20 aa, Entamoeba invadens
NRVNCILCTSKYQLVNGKVF

SEQ ID NO: 3041993 - protein, 19 aa, Entamoeba invadens
NSCKLCAAGTYSNQNSTSC

SEQ ID NO: 3041994 - protein, 22 aa, Entamoeba invadens
NSCKYKDDYECRIVHSGCLDVV

SEQ ID NO: 3041995 - protein, 20 aa, Entamoeba invadens
NSDRCLAEHLALPETLYIPV

SEQ ID NO: 3041996 - protein, 23 aa, Entamoeba invadens
NSFTLSAYSIFAFKEEDLNFTFK

SEQ ID NO: 3041997 - protein, 18 aa, Entamoeba invadens
NSGFYLFNGRCVVCDSTC

SEQ ID NO: 3041998 - protein, 27 aa, Entamoeba invadens
NSHVELLGSFIFKLSRNNLQMSSSTQR

SEQ ID NO: 3041999 - protein, 18 aa, Entamoeba invadens
NSICTKCFDGYYAKNNAC

SEQ ID NO: 3042000 - protein, 25 aa, Entamoeba invadens
NSIKQKLLMFFFVLFVCAFSQCTKQ

SEQ ID NO: 3042001 - protein, 18 aa, Entamoeba invadens
NSKFRNIFMETWSPSTYV

SEQ ID NO: 3042002 - protein, 25 aa, Entamoeba invadens
NSLAKIEGYFSIAGKLLILNPKLDI

SEQ ID NO: 3042003 - protein, 23 aa, Entamoeba invadens
NSLSRSEFQGELSAYNFIDSLPP

SEQ ID NO: 3042004 - protein, 19 aa, Entamoeba invadens
NSNEYAMWIQSLVQKELNS

SEQ ID NO: 3042005 - protein, 25 aa, Entamoeba invadens
NSNIKYIICTLLKYVEINLVKQRKE

SEQ ID NO: 3042006 - protein, 27 aa, Entamoeba invadens
NSNKCGICYEMVGPLGTLRFRVDNSCP

SEQ ID NO: 3042007 - protein, 24 aa, Entamoeba invadens
NSNSSFSRLFSFVIRNKKSKPMEG

SEQ ID NO: 3042008 - protein, 27 aa, Entamoeba invadens
NSRFSSAEIQKCRFFADPLVWSENKEG

SEQ ID NO: 3042009 - protein, 19 aa, Entamoeba invadens
NSTESVIVYRIVVPSKEIA

SEQ ID NO: 3042010 - protein, 25 aa, Entamoeba invadens
NSVGNFYFKGGISIETVSLDSSTNF

SEQ ID NO: 3042011 - protein, 18 aa, Entamoeba invadens
NSWGKSWGDEGYFLLARN

SEQ ID NO: 3042012 - protein, 18 aa, Entamoeba invadens
NSWGNSWGEKGYGRLSTD

SEQ ID NO: 3042013 - protein, 19 aa, Entamoeba invadens
NSWGSDWGENGYIRISTRN

SEQ ID NO: 3042014 - protein, 21 aa, Entamoeba invadens
NSWGTSWGDKGYILMAAEGNT

SEQ ID NO: 3042015 - protein, 19 aa, Entamoeba invadens
NTCLMCLENTYSLGGTSYC

SEQ ID NO: 3042016 - protein, 26 aa, Entamoeba invadens
NTEVKEGFTLHGYWPHFYKNRNMYCC

SEQ ID NO: 3042017 - protein, 18 aa, Entamoeba invadens
NTFPDCRYNSSLFDLNLT

SEQ ID NO: 3042018 - protein, 23 aa, Entamoeba invadens
NTGDLKLQFVLFWDDKKSTEAED

SEQ ID NO: 3042019 - protein, 18 aa, Entamoeba invadens
NTIIARNSFQAMPKMIYS

SEQ ID NO: 3042020 - protein, 25 aa, Entamoeba invadens
NTLARPLVDIGHGYLDKKAPTSDAV

SEQ ID NO: 3042021 - protein, 22 aa, Entamoeba invadens
NTNVKWVLGKIYGFEKTTSDFP

SEQ ID NO: 3042022 - protein, 24 aa, Entamoeba invadens
NTRIPLRKCRTEGQNSVIYDTTFD

SEQ ID NO: 3042023 - protein, 18 aa, Entamoeba invadens
NTRYSWYAKDNIINHYAY

SEQ ID NO: 3042024 - protein, 19 aa, Entamoeba invadens
NTTTVLGFVIFEDFIVLPG

SEQ ID NO: 3042025 - protein, 27 aa, Entamoeba invadens
NTVPKRRGGLRRSRTVNVNKYDQFLKQ

SEQ ID NO: 3042026 - protein, 17 aa, Entamoeba invadens
NVCLKIYGVKGKAKCSG

SEQ ID NO: 3042027 - protein, 24 aa, Entamoeba invadens
NVDFSFVLTRARFNELNMDLFKKT

SEQ ID NO: 3042028 - protein, 18 aa, Entamoeba invadens
NVIKEINPTLAFNDAIKN

SEQ ID NO: 3042029 - protein, 22 aa, Entamoeba invadens
NVKEKFFLHGFWPQYENSRDMV

SEQ ID NO: 3042030 - protein, 17 aa, Entamoeba invadens
NVKEMICNLIANFNLSQ

SEQ ID NO: 3042031 - protein, 26 aa, Entamoeba invadens
NVLTDFLRENGFLMITSSNFIEKSDQ

SEQ ID NO: 3042032 - protein, 25 aa, Entamoeba invadens
NVNTKLFISKSVKFFQIYDFGDQNE

SEQ ID NO: 3042033 - protein, 23 aa, Entamoeba invadens
NVPKLNVGMGVWAFPDAIRIDKN

SEQ ID NO: 3042034 - protein, 18 aa, Entamoeba invadens
NVSGVGCYDDIDDIDIDE

SEQ ID NO: 3042035 - protein, 23 aa, Entamoeba invadens
NVSLIISCPLHFNNTLNIESGAV

SEQ ID NO: 3042036 - protein, 24 aa, Entamoeba invadens
NVSMCGMCLEIVGPSTKPFHCQVG

SEQ ID NO: 3042037 - protein, 23 aa, Entamoeba invadens
NVTTLYFNLVFQVLQTDKGVKKM

SEQ ID NO: 3042038 - protein, 24 aa, Entamoeba invadens
NVVVKFYAPWCGICKGMKDKYEKL

SEQ ID NO: 3042039 - protein, 23 aa, Entamoeba invadens
NVYEYLPSLDLFGSDTYPVNVTG

SEQ ID NO: 3042040 - protein, 18 aa, Entamoeba invadens
NVYNPMMYMGRPFMAQSP

SEQ ID NO: 3042041 - protein, 17 aa, Entamoeba invadens
NWNLVLEQWKYHLLHTA

SEQ ID NO: 3042042 - protein, 24 aa, Entamoeba invadens
NYDFECLECIRLDALNGDLQKLFR

SEQ ID NO: 3042043 - protein, 27 aa, Entamoeba invadens
NYKGSRPAGLCQLRWSTNNYEQNLLQG

SEQ ID NO: 3042044 - protein, 23 aa, Entamoeba invadens
NYLSPYLFWPIIKVLDLVVFQNL

SEQ ID NO: 3042045 - protein, 18 aa, Entamoeba invadens
NYMSTSFCTVTVTKAHCS

SEQ ID NO: 3042046 - protein, 18 aa, Entamoeba invadens
NYTNRWECYGNVDNANIR

SEQ ID NO: 3042047 - protein, 17 aa, Entamoeba invadens
NYVCCLVDINDIMVEQK

SEQ ID NO: 3042048 - protein, 25 aa, Entamoeba invadens
NYYIGVIFRNHIVGIKKVQISFGGN

SEQ ID NO: 3042049 - protein, 27 aa, Entamoeba invadens
PAKDQAHCGGCWAFCTAATMEGRVNKD

SEQ ID NO: 3042050 - protein, 19 aa, Entamoeba invadens
PAMFLTLFLCTLAVEAGKK

SEQ ID NO: 3042051 - protein, 24 aa, Entamoeba invadens
PANSVLKFDIKVVSVVKYADLRKQ

SEQ ID NO: 3042052 - protein, 19 aa, Entamoeba invadens
PAVTGFFVAPIYKIEEKVG

SEQ ID NO: 3042053 - protein, 19 aa, Entamoeba invadens
PCAFDYSDVDFCNGRVGTY

SEQ ID NO: 3042054 - protein, 28 aa, Entamoeba invadens
PCGETRYPAYPLSRWTYCGVGEFQCSDS

SEQ ID NO: 3042055 - protein, 23 aa, Entamoeba invadens
PDFLKTAYLFNNEMHNIIKEAKR

SEQ ID NO: 3042056 - protein, 24 aa, Entamoeba invadens
PDICIDCNYPGMPNSNGECVDCSD

SEQ ID NO: 3042057 - protein, 25 aa, Entamoeba invadens
PDLKTWKVSLDVPKYVEMKPNYVTD

SEQ ID NO: 3042058 - protein, 19 aa, Entamoeba invadens
PDNKRSTVYIKIKYHPEDK

SEQ ID NO: 3042059 - protein, 17 aa, Entamoeba invadens
PEDFEWNKLSGQVKQIE

SEQ ID NO: 3042060 - protein, 18 aa, Entamoeba invadens
PEDVRNNIIANLKLDRRF

SEQ ID NO: 3042061 - protein, 22 aa, Entamoeba invadens
PEEIYEMIQMCWNQNPRDRCTI

SEQ ID NO: 3042062 - protein, 20 aa, Entamoeba invadens
PEGDRLPRNHSYCGSYVNYN

SEQ ID NO: 3042063 - protein, 17 aa, Entamoeba invadens
PEGLDFRKFNKLTYVRE

SEQ ID NO: 3042064 - protein, 22 aa, Entamoeba invadens
PEHWPQEPIVTFKGNGKEYYAK

SEQ ID NO: 3042065 - protein, 20 aa, Entamoeba invadens
PEICTSCYDGFVLNNGKCLK

SEQ ID NO: 3042066 - protein, 23 aa, Entamoeba invadens
PEILRLSACTNLKNVIVYMIESV

SEQ ID NO: 3042067 - protein, 18 aa, Entamoeba invadens
PELKESWFTLQLKNINAY

SEQ ID NO: 3042068 - protein, 23 aa, Entamoeba invadens
PENANECCTLWDDYSILYKDGFV

SEQ ID NO: 3042069 - protein, 17 aa, Entamoeba invadens
PENMLVNSFDFNSACTI

SEQ ID NO: 3042070 - protein, 19 aa, Entamoeba invadens
PENMSPCVLDESSKQKSEE

SEQ ID NO: 3042071 - protein, 18 aa, Entamoeba invadens
PENTKWKAAEGFFLPALN

SEQ ID NO: 3042072 - protein, 19 aa, Entamoeba invadens
PEQCEFIECREGYIRDNNK

SEQ ID NO: 3042073 - protein, 20 aa, Entamoeba invadens
PEQVTAMLIKRQLKNVKRQY

SEQ ID NO: 3042074 - protein, 34 aa, Entamoeba invadens
PESPWTNDFHYRWNPQVIAGFGYIVFAPNFHGSG

SEQ ID NO: 3042075 - protein, 19 aa, Entamoeba invadens
PETLYIPVGCIKHHRESFR

SEQ ID NO: 3042076 - protein, 20 aa, Entamoeba invadens
PETMKYMIDDSALEFKQYDV

SEQ ID NO: 3042077 - protein, 22 aa, Entamoeba invadens
PEVVTLKSGYACEFSVYVKPLC

SEQ ID NO: 3042078 - protein, 22 aa, Entamoeba invadens
PEVVVTFGGHLYRGNRVQKLRA

SEQ ID NO: 3042079 - protein, 19 aa, Entamoeba invadens
PEYFLKEGKCTSCSAGCSI

SEQ ID NO: 3042080 - protein, 17 aa, Entamoeba invadens
PEYYETFNNKDPYMAKD

SEQ ID NO: 3042081 - protein, 21 aa, Entamoeba invadens
PFHRWKHFTKDNVINYYSLNL

SEQ ID NO: 3042082 - protein, 25 aa, Entamoeba invadens
PFKVLLDGHLLRYGTSDKIYCHVNH

SEQ ID NO: 3042083 - protein, 22 aa, Entamoeba invadens
PFLRICKAVFIDTQFYDKRAVS

SEQ ID NO: 3042084 - protein, 19 aa, Entamoeba invadens
PFMAQSPYMMAMRRPIYPS

SEQ ID NO: 3042085 - protein, 24 aa, Entamoeba invadens
PFRYKIAALHLTPPINSNFYVDYT

SEQ ID NO: 3042086 - protein, 22 aa, Entamoeba invadens
PFTINPCILDGYIFKSTENSEV

SEQ ID NO: 3042087 - protein, 25 aa, Entamoeba invadens
PFTQSWEELRHVVAEVEKYKDFILE

SEQ ID NO: 3042088 - protein, 18 aa, Entamoeba invadens
PFYHKWNYTVPNGVKMGC

SEQ ID NO: 3042089 - protein, 24 aa, Entamoeba invadens
PGDKCSKEVCSLPLGTQNVKEKFF

SEQ ID NO: 3042090 - protein, 20 aa, Entamoeba invadens
PGDYEDLSFEISLSLIQVKV

SEQ ID NO: 3042091 - protein, 25 aa, Entamoeba invadens
PGEKCSGITCSLPLSTLRVKEEFFL

SEQ ID NO: 3042092 - protein, 26 aa, Entamoeba invadens
PGGTECLPGFFGILLGRKEAKRFFKM

SEQ ID NO: 3042093 - protein, 21 aa, Entamoeba invadens
PGKCYKKRATVNPVDPPKPVE

SEQ ID NO: 3042094 - protein, 19 aa, Entamoeba invadens
PGKEPIPFQGQRTEETLTN

SEQ ID NO: 3042095 - protein, 19 aa, Entamoeba invadens
PGQCYKTRAAVDPVEPSKP

SEQ ID NO: 3042096 - protein, 24 aa, Entamoeba invadens
PHCPCTTYDGFTCTIYIENGIVDL

SEQ ID NO: 3042097 - protein, 21 aa, Entamoeba invadens
PHVEKFINFKVDYEQYLNDKK

SEQ ID NO: 3042098 - protein, 19 aa, Entamoeba invadens
PHVIDAKAVQEGMASDDAL

SEQ ID NO: 3042099 - protein, 22 aa, Entamoeba invadens
PHYKGNYTLRVISFENNKLELR

SEQ ID NO: 3042100 - protein, 26 aa, Entamoeba invadens
PIIIRPSLNAKLVFETLIGAYNVFSI

SEQ ID NO: 3042101 - protein, 19 aa, Entamoeba invadens
PINSEWKLKMSFTAVDGGD

SEQ ID NO: 3042102 - protein, 23 aa, Entamoeba invadens
PKCSKCFPQFVVFDGKCILGNSE

SEQ ID NO: 3042103 - protein, 18 aa, Entamoeba invadens
PKEYYIEEWNRMVDAMKG

SEQ ID NO: 3042104 - protein, 17 aa, Entamoeba invadens
PKFIPFNATMNVPHIDL

SEQ ID NO: 3042105 - protein, 20 aa, Entamoeba invadens
PKGELMIRGLPVSKGYYKRP

SEQ ID NO: 3042106 - protein, 21 aa, Entamoeba invadens
PKGRRGKKCRARLARLNAQRR

SEQ ID NO: 3042107 - protein, 18 aa, Entamoeba invadens
PKGVVALHKNLLPITWSY

SEQ ID NO: 3042108 - protein, 25 aa, Entamoeba invadens
PKHYKDAKCKPVVRLVQTSKTEPTR

SEQ ID NO: 3042109 - protein, 26 aa, Entamoeba invadens
PKIAAECAESVFADYLLLTHFSPRYQ

SEQ ID NO: 3042110 - protein, 17 aa, Entamoeba invadens
PKLDAYVANFSESFKNI

SEQ ID NO: 3042111 - protein, 23 aa, Entamoeba invadens
PKLDIPPLVLWNSPYLHLNRNMS

SEQ ID NO: 3042112 - protein, 21 aa, Entamoeba invadens
PKLSGLTKLYALVIDNNQVSG

SEQ ID NO: 3042113 - protein, 23 aa, Entamoeba invadens
PKLTKLIGEACFIGCKSLKNIDF

SEQ ID NO: 3042114 - protein, 20 aa, Entamoeba invadens
PKMDYIMFVQFWPGVSCTAT

SEQ ID NO: 3042115 - protein, 17 aa, Entamoeba invadens
PKNKIFLEKSMKKAWEI

SEQ ID NO: 3042116 - protein, 19 aa, Entamoeba invadens
PKRKVHLLIFCAKRSENCQ

SEQ ID NO: 3042117 - protein, 20 aa, Entamoeba invadens
PKRSKFLLKSIVKKPSITKK

SEQ ID NO: 3042118 - protein, 20 aa, Entamoeba invadens
PKRYILFLVGLLNYIEVLDD

SEQ ID NO: 3042119 - protein, 19 aa, Entamoeba invadens
PKSEWMLSFMADLFSEWLS

SEQ ID NO: 3042120 - protein, 21 aa, Entamoeba invadens
PKSTITLCRNREAAFSNFIAY

SEQ ID NO: 3042121 - protein, 22 aa, Entamoeba invadens
PKSTITLCRNREAAFSNFIAYI

SEQ ID NO: 3042122 - protein, 26 aa, Entamoeba invadens
PKTFKDPKIRVVLYYVAYGDNYKNFL

SEQ ID NO: 3042123 - protein, 18 aa, Entamoeba invadens
PKTGYGIGYGPSAHKGDL

SEQ ID NO: 3042124 - protein, 18 aa, Entamoeba invadens
PKTTNLILRNWVSVEKCG

SEQ ID NO: 3042125 - protein, 26 aa, Entamoeba invadens
PKWVAPEVMRGFPFEMKSDVYSFGII

SEQ ID NO: 3042126 - protein, 25 aa, Entamoeba invadens
PLAHIFEIGIEFALLMDFATIGYAG

SEQ ID NO: 3042127 - protein, 17 aa, Entamoeba invadens
PLDLKINRQWKMSELSP

SEQ ID NO: 3042128 - protein, 22 aa, Entamoeba invadens
PLFFKTDLPKLIGDLKENENQM

SEQ ID NO: 3042129 - protein, 19 aa, Entamoeba invadens
PLHLEHFERNIPLFQTPSQ

SEQ ID NO: 3042130 - protein, 27 aa, Entamoeba invadens
PLHYKGCKFHRVIPNFILQSGDITQAN

SEQ ID NO: 3042131 - protein, 17 aa, Entamoeba invadens
PLIIPYYLQVTAISGES

SEQ ID NO: 3042132 - protein, 22 aa, Entamoeba invadens
PLNLKSECIIVFGKEEQLGFFS

SEQ ID NO: 3042133 - protein, 17 aa, Entamoeba invadens
PLSRAGTSAAFYAWNGI

SEQ ID NO: 3042134 - protein, 24 aa, Entamoeba invadens
PLTEFRAENALALYWPKEGTEANW

SEQ ID NO: 3042135 - protein, 17 aa, Entamoeba invadens
PLTEGKPGATIAARYDL

SEQ ID NO: 3042136 - protein, 19 aa, Entamoeba invadens
PLYDMMKLMMDSGSYQDLF

SEQ ID NO: 3042137 - protein, 25 aa, Entamoeba invadens
PLYYYKVWSRDAVFSSIIMTALGEY

SEQ ID NO: 3042138 - protein, 17 aa, Entamoeba invadens
PMKCILCSQNAYFKTPK

SEQ ID NO: 3042139 - protein, 20 aa, Entamoeba invadens
PMMYMGRPFMAQSPYMMAMR

SEQ ID NO: 3042140 - protein, 17 aa, Entamoeba invadens
PMQRLPRYELLLKDLLK

SEQ ID NO: 3042141 - protein, 25 aa, Entamoeba invadens
PMQRLPRYELLLLDLIKSPQLQGNV

SEQ ID NO: 3042142 - protein, 17 aa, Entamoeba invadens
PMWFQFLTNKKIKVAII

SEQ ID NO: 3042143 - protein, 19 aa, Entamoeba invadens
PNDKFGIEGNAKFGKENGK

SEQ ID NO: 3042144 - protein, 19 aa, Entamoeba invadens
PNKLTRIGINCFVGCTNLK

SEQ ID NO: 3042145 - protein, 30 aa, Entamoeba invadens
PNLKSEEFILCPKCLICGNDELSCVLPKRT

SEQ ID NO: 3042146 - protein, 18 aa, Entamoeba invadens
PNNLACVVFMTMTLFTCL

SEQ ID NO: 3042147 - protein, 18 aa, Entamoeba invadens
PNNLFSTTQIESHVEKTV

SEQ ID NO: 3042148 - protein, 25 aa, Entamoeba invadens
PNNYEFIYPLITSWIAPENVMHIYP

SEQ ID NO: 3042149 - protein, 17 aa, Entamoeba invadens
PNPVFIKIICNNTVIEI

SEQ ID NO: 3042150 - protein, 18 aa, Entamoeba invadens
PNRPPKCTSRTWCGLNRF

SEQ ID NO: 3042151 - protein, 37 aa, Entamoeba invadens
PNTRCAKEGRTPFGYNPCIYIESFDCDEKSGGHCHSE

SEQ ID NO: 3042152 - protein, 25 aa, Entamoeba invadens
PNTTCFILCFSLVYLDSFGHIKTFW

SEQ ID NO: 3042153 - protein, 17 aa, Entamoeba invadens
PNYAEIYVGGVLTKVTA

SEQ ID NO: 3042154 - protein, 27 aa, Entamoeba invadens
PPKCTSRTWCGLNRFRSASHYTTSPMK

SEQ ID NO: 3042155 - protein, 22 aa, Entamoeba invadens
PPKSGMYTGFYVYVKVTEECNS

SEQ ID NO: 3042156 - protein, 19 aa, Entamoeba invadens
PPNLYFKSYNIFNLSTLSR

SEQ ID NO: 3042157 - protein, 17 aa, Entamoeba invadens
PPSENDYSIALRIQHGD

SEQ ID NO: 3042158 - protein, 17 aa, Entamoeba invadens
PPSENDYTIALRVQYGD

SEQ ID NO: 3042159 - protein, 20 aa, Entamoeba invadens
PPVRISRWVRGVLRNDPTVL

SEQ ID NO: 3042160 - protein, 17 aa, Entamoeba invadens
PPYLFTPLLKVVDGIIF

SEQ ID NO: 3042161 - protein, 17 aa, Entamoeba invadens
PQELFKIDVTAFDSKLQ

SEQ ID NO: 3042162 - protein, 19 aa, Entamoeba invadens
PQIPILLVVCKDLTAQCNQ

SEQ ID NO: 3042163 - protein, 20 aa, Entamoeba invadens
PQKQCISCFSFDSNCVSCAT

SEQ ID NO: 3042164 - protein, 18 aa, Entamoeba invadens
PQPPSRPTYHKKFDIDAE

SEQ ID NO: 3042165 - protein, 17 aa, Entamoeba invadens
PQSFNLWALQPIQGSWM

SEQ ID NO: 3042166 - protein, 17 aa, Entamoeba invadens
PRCDPYVLFKPFPPELK

SEQ ID NO: 3042167 - protein, 18 aa, Entamoeba invadens
PRDLFLTAIYFKNPNVWF

SEQ ID NO: 3042168 - protein, 19 aa, Entamoeba invadens
PRDLFLTAIYFKNPNVWFT

SEQ ID NO: 3042169 - protein, 20 aa, Entamoeba invadens
PRGSPDWYASYQGYSHVVGY

SEQ ID NO: 3042170 - protein, 18 aa, Entamoeba invadens
PRKSVPVDFSKSIEGLPD

SEQ ID NO: 3042171 - protein, 28 aa, Entamoeba invadens
PRLKQKMREVIKVLPKREQYRLIRKMDL

SEQ ID NO: 3042172 - protein, 17 aa, Entamoeba invadens
PRMVLSLVTTFSENPVS

SEQ ID NO: 3042173 - protein, 18 aa, Entamoeba invadens
PRNTVCGYQGRIPDTENP

SEQ ID NO: 3042174 - protein, 25 aa, Entamoeba invadens
PRTRGPLVDGFRCVEKGIYAAGNQL

SEQ ID NO: 3042175 - protein, 18 aa, Entamoeba invadens
PRVLSMMCDVVLQDIPMH

SEQ ID NO: 3042176 - protein, 27 aa, Entamoeba invadens
PRYNQTNGWEKLCFNTYIIKNETHTYT

SEQ ID NO: 3042177 - protein, 18 aa, Entamoeba invadens
PSAAMCWDEKEIVTISGN

SEQ ID NO: 3042178 - protein, 24 aa, Entamoeba invadens
PSAYCSQCTGTLCNACIDNYVLVD

SEQ ID NO: 3042179 - protein, 21 aa, Entamoeba invadens
PSHTGCVFCADGTRYVGFDKV

SEQ ID NO: 3042180 - protein, 26 aa, Entamoeba invadens
PSHVKSVGYYSCFSCVKLKKVVLPEG

SEQ ID NO: 3042181 - protein, 19 aa, Entamoeba invadens
PSIGVAEGQFDCVLVEGSY

SEQ ID NO: 3042182 - protein, 31 aa, Entamoeba invadens
PSINQSCLWYIFDFLNLVLKYKELNLMNEEN

SEQ ID NO: 3042183 - protein, 22 aa, Entamoeba invadens
PSLPGVGGVNTFLSKQNGQPQG

SEQ ID NO: 3042184 - protein, 25 aa, Entamoeba invadens
PSMVGFPSDRLFVLKPQEPGTTIIE

SEQ ID NO: 3042185 - protein, 17 aa, Entamoeba invadens
PSPFGAVDCKINSKTMG

SEQ ID NO: 3042186 - protein, 24 aa, Entamoeba invadens
PSPLVRIPVFYRDNGAYVVTATNC

SEQ ID NO: 3042187 - protein, 20 aa, Entamoeba invadens
PSQFSKFSIKGQISDTISGF

SEQ ID NO: 3042188 - protein, 20 aa, Entamoeba invadens
PSQLNWYRYLYLFTSTYTMI

SEQ ID NO: 3042189 - protein, 19 aa, Entamoeba invadens
PTCKVSNCQTCVTGSTTQC

SEQ ID NO: 3042190 - protein, 17 aa, Entamoeba invadens
PTDKLKKRLRFIESEKK

SEQ ID NO: 3042191 - protein, 18 aa, Entamoeba invadens
PTDKVTIGANGKYSKTNG

SEQ ID NO: 3042192 - protein, 18 aa, Entamoeba invadens
PTFVIGVPTVFGRVRKAI

SEQ ID NO: 3042193 - protein, 19 aa, Entamoeba invadens
PTIRSSVVPTQFNQNVTEL

SEQ ID NO: 3042194 - protein, 17 aa, Entamoeba invadens
PTKIYNLTLNYYSNSSS

SEQ ID NO: 3042195 - protein, 27 aa, Entamoeba invadens
PTLQELRVMSWLGFIGGAKGMFYYSYF

SEQ ID NO: 3042196 - protein, 25 aa, Entamoeba invadens
PTNSQWRATLSFKREENKIGCVRLD

SEQ ID NO: 3042197 - protein, 24 aa, Entamoeba invadens
PTNYDWYTGSVIGFVEPQYDAVGV

SEQ ID NO: 3042198 - protein, 24 aa, Entamoeba invadens
PTQRSQLCMIAGYVVVKSKDISDE

SEQ ID NO: 3042199 - protein, 24 aa, Entamoeba invadens
PTSGIKHTLCMRGDEEYYLVRILA

SEQ ID NO: 3042200 - protein, 17 aa, Entamoeba invadens
PTTCYQIITKIGSRIYN

SEQ ID NO: 3042201 - protein, 33 aa, Entamoeba invadens
PTTVIVTPVELVFPFSTIPQIRRAQIYMNNNWV

SEQ ID NO: 3042202 - protein, 18 aa, Entamoeba invadens
PVCKTCYSGFFVNSEGKC

SEQ ID NO: 3042203 - protein, 19 aa, Entamoeba invadens
PVFHCANVPKLDNFKKQPS

SEQ ID NO: 3042204 - protein, 18 aa, Entamoeba invadens
PVKKSVMINEIFPKKNIK

SEQ ID NO: 3042205 - protein, 22 aa, Entamoeba invadens
PVLRSGFSLIIKMLNAPIRLLL

SEQ ID NO: 3042206 - protein, 20 aa, Entamoeba invadens
PVPFDDGCIPFCGTCRTGMI

SEQ ID NO: 3042207 - protein, 17 aa, Entamoeba invadens
PVTLCVVRNNLFVPCKY

SEQ ID NO: 3042208 - protein, 25 aa, Entamoeba invadens
PVTMYNCLRGSGNICDECYNSFTLG

SEQ ID NO: 3042209 - protein, 23 aa, Entamoeba invadens
PWCIHCKELRPVIEELDAQNQNK

SEQ ID NO: 3042210 - protein, 18 aa, Entamoeba invadens
PWFSGRYIVVGEVIEGYD

SEQ ID NO: 3042211 - protein, 19 aa, Entamoeba invadens
PYIKSLGMNTLWMTPIFNS

SEQ ID NO: 3042212 - protein, 18 aa, Entamoeba invadens
PYLLKNLIETCWNTSATL

SEQ ID NO: 3042213 - protein, 19 aa, Entamoeba invadens
PYQNLPFAVATKIIDDTLT

SEQ ID NO: 3042214 - protein, 31 aa, Entamoeba invadens
PYSYSSMFRPSFNAYNPYSFYGNKLGMYGGM

SEQ ID NO: 3042215 - protein, 24 aa, Entamoeba invadens
PYTFVFKNWSTVLPIAVKILEALS

SEQ ID NO: 3042216 - protein, 18 aa, Entamoeba invadens
QALIKLGEEIITIVDKSN

SEQ ID NO: 3042217 - protein, 19 aa, Entamoeba invadens
QAMNMAMKALHTFDPAKFE

SEQ ID NO: 3042218 - protein, 31 aa, Entamoeba invadens
QATFDNGYCKTEFFNRIILFSKGDALDELSE

SEQ ID NO: 3042219 - protein, 34 aa, Entamoeba invadens
QAVQLEVGFQYSFCAWVKASSFSHGIEICIEGMK

SEQ ID NO: 3042220 - protein, 19 aa, Entamoeba invadens
QCFVTGAIAPKVPILSRNI

SEQ ID NO: 3042221 - protein, 20 aa, Entamoeba invadens
QCKECPEGTGTLDGVNDNCD

SEQ ID NO: 3042222 - protein, 21 aa, Entamoeba invadens
QCMKCEVNGCKKCVSENPYKC

SEQ ID NO: 3042223 - protein, 17 aa, Entamoeba invadens
QCSMEKIGIWLLSTTKL

SEQ ID NO: 3042224 - protein, 17 aa, Entamoeba invadens
QCVGGYYLSNGVCNSCI

SEQ ID NO: 3042225 - protein, 28 aa, Entamoeba invadens
QDAKFEYSFMIPKRVDYVGFTSDKNEGC

SEQ ID NO: 3042226 - protein, 28 aa, Entamoeba invadens
QDALPWVELTNFFLARAFYIITTSDVLK

SEQ ID NO: 3042227 - protein, 24 aa, Entamoeba invadens
QDCRNKEACFVNYLALNLVQRGYS

SEQ ID NO: 3042228 - protein, 18 aa, Entamoeba invadens
QDCTYAFPNCNECSTTNY

SEQ ID NO: 3042229 - protein, 19 aa, Entamoeba invadens
QDFKEARITVEIEDVEDWK

SEQ ID NO: 3042230 - protein, 23 aa, Entamoeba invadens
QDIVKRLLLSINFFDNKHKVMQQ

SEQ ID NO: 3042231 - protein, 19 aa, Entamoeba invadens
QDLDVDFCYTIKQESLQIV

SEQ ID NO: 3042232 - protein, 24 aa, Entamoeba invadens
QDRNRFPQCTDFVPSGSVQNVTIV

SEQ ID NO: 3042233 - protein, 29 aa, Entamoeba invadens
QDVKGSLTLVRSGLKFDYYQNGDIVKLKA

SEQ ID NO: 3042234 - protein, 18 aa, Entamoeba invadens
QEDMCAAACTFANKMKAL

SEQ ID NO: 3042235 - protein, 19 aa, Entamoeba invadens
QEDMCAAACTFANKMKALI

SEQ ID NO: 3042236 - protein, 18 aa, Entamoeba invadens
QEEEEIRKYTTLKVDNDE

SEQ ID NO: 3042237 - protein, 25 aa, Entamoeba invadens
QEIQKRLPGFKVFPTPGNHDYFTHS

SEQ ID NO: 3042238 - protein, 23 aa, Entamoeba invadens
QEKPYGYNPCVWLDQTKWFGNST

SEQ ID NO: 3042239 - protein, 20 aa, Entamoeba invadens
QELQHFLTVILPNVAIMQGF

SEQ ID NO: 3042240 - protein, 24 aa, Entamoeba invadens
QELRELVNRLTLKINKIKFVRRKT

SEQ ID NO: 3042241 - protein, 25 aa, Entamoeba invadens
QEVIYSDGIYNWKINDSALINYYEY

SEQ ID NO: 3042242 - protein, 25 aa, Entamoeba invadens
QEVKSVPESVDWRSIMNPAKDQAHC

SEQ ID NO: 3042243 - protein, 19 aa, Entamoeba invadens
QEVRNSVDWREEGKVTAIK

SEQ ID NO: 3042244 - protein, 23 aa, Entamoeba invadens
QFDKHGTCSMTHYTGEDGPLDYM

SEQ ID NO: 3042245 - protein, 18 aa, Entamoeba invadens
QFGAPYFQYGQYPMNYYH

SEQ ID NO: 3042246 - protein, 18 aa, Entamoeba invadens
QFIKRSSFEKVVRSGSAE

SEQ ID NO: 3042247 - protein, 19 aa, Entamoeba invadens
QFMKRNAQIAAKIVKLDSI

SEQ ID NO: 3042248 - protein, 19 aa, Entamoeba invadens
QGDFMFSCVNALYNSSKAM

SEQ ID NO: 3042249 - protein, 17 aa, Entamoeba invadens
QGFPTVKLFSAQKTHSK

SEQ ID NO: 3042250 - protein, 29 aa, Entamoeba invadens
QGKEPREFLEIFKEKFIVHLGGYTEYCEK

SEQ ID NO: 3042251 - protein, 17 aa, Entamoeba invadens
QGKWFKMDVTKIQKDHI

SEQ ID NO: 3042252 - protein, 25 aa, Entamoeba invadens
QGLQFKLLINRSMWLQESGSFYGFI

SEQ ID NO: 3042253 - protein, 25 aa, Entamoeba invadens
QGSCGCCYAMAIAQILQAHYTHLTG

SEQ ID NO: 3042254 - protein, 24 aa, Entamoeba invadens
QHEFSDCHSCYSFASVSTLESLYL

SEQ ID NO: 3042255 - protein, 19 aa, Entamoeba invadens
QHLPGFTVLPSIGNHDYFE

SEQ ID NO: 3042256 - protein, 17 aa, Entamoeba invadens
QHLVFSLINSEQRVSLL

SEQ ID NO: 3042257 - protein, 22 aa, Entamoeba invadens
QHTCYSAALGLMANFDKKKLNI

SEQ ID NO: 3042258 - protein, 18 aa, Entamoeba invadens
QIDNWKKMGSYVVTVGNK

SEQ ID NO: 3042259 - protein, 17 aa, Entamoeba invadens
QIGAKKVIPGWEQGLLG

SEQ ID NO: 3042260 - protein, 26 aa, Entamoeba invadens
QIGDIIDFKFGWIITENTEYPTGYYS

SEQ ID NO: 3042261 - protein, 20 aa, Entamoeba invadens
QIKCLKCDKENFILGYGDEQ

SEQ ID NO: 3042262 - protein, 20 aa, Entamoeba invadens
QIPAESNLCYFGSKDCDQYC

SEQ ID NO: 3042263 - protein, 17 aa, Entamoeba invadens
QIPRFVFAGMEEDNCKY

SEQ ID NO: 3042264 - protein, 21 aa, Entamoeba invadens
QIVTVKRVIKLITLIKKTLNI

SEQ ID NO: 3042265 - protein, 24 aa, Entamoeba invadens
QKCILKNVRLASAFDNTTNSTYFV

SEQ ID NO: 3042266 - protein, 21 aa, Entamoeba invadens
QKFNLFCFTNYTYTTPDCTGT

SEQ ID NO: 3042267 - protein, 19 aa, Entamoeba invadens
QKGGIKEGLKQGGKTALNY

SEQ ID NO: 3042268 - protein, 17 aa, Entamoeba invadens
QKGKRKMLLRKIRKMGQ

SEQ ID NO: 3042269 - protein, 24 aa, Entamoeba invadens
QKKFGYKCAFIMVKSTVEQSGKMD

SEQ ID NO: 3042270 - protein, 23 aa, Entamoeba invadens
QKKNIPDSLDWRTYGYVTPVKDQ

SEQ ID NO: 3042271 - protein, 24 aa, Entamoeba invadens
QKLKDEFYKLSALKEKQKMQLKAS

SEQ ID NO: 3042272 - protein, 26 aa, Entamoeba invadens
QKLLHEARMSKVRVLREMRSTADKVT

SEQ ID NO: 3042273 - protein, 24 aa, Entamoeba invadens
QKQKLSFRFKEDFGSATVTAKVGD

SEQ ID NO: 3042274 - protein, 17 aa, Entamoeba invadens
QKRAILRKMRHSADKVA

SEQ ID NO: 3042275 - protein, 20 aa, Entamoeba invadens
QKSFHCMVVGSAVMFYQNQN

SEQ ID NO: 3042276 - protein, 23 aa, Entamoeba invadens
QKTEKGYGCYMFHLKTNINNVQT

SEQ ID NO: 3042277 - protein, 23 aa, Entamoeba invadens
QKTGNCLSCYLGSFVSEGICISC

SEQ ID NO: 3042278 - protein, 21 aa, Entamoeba invadens
QLAYRNGIIAYGFQNTTLSVK

SEQ ID NO: 3042279 - protein, 24 aa, Entamoeba invadens
QLIGPSEKVVDCMVAGYIVIETDG

SEQ ID NO: 3042280 - protein, 17 aa, Entamoeba invadens
QLILPFVTQQVFEPPKG

SEQ ID NO: 3042281 - protein, 24 aa, Entamoeba invadens
QLKKLIKRFDVVSKIKVAKIVKHL

SEQ ID NO: 3042282 - protein, 25 aa, Entamoeba invadens
QLNDFKFVGGSIKKVEFKDSMVKSS

SEQ ID NO: 3042283 - protein, 24 aa, Entamoeba invadens
QLPYNLVLDFSWFSAEEVPQNIII

SEQ ID NO: 3042284 - protein, 25 aa, Entamoeba invadens
QLTGPSHKIVYCMVVGTINPIYQNV

SEQ ID NO: 3042285 - protein, 28 aa, Entamoeba invadens
QLVGYSCYYNGCTVLNCETCYSSSVCTT

SEQ ID NO: 3042286 - protein, 22 aa, Entamoeba invadens
QMKKRMPGLRVYPVPGNHDYFL

SEQ ID NO: 3042287 - protein, 26 aa, Entamoeba invadens
QMTAIKRKITFEISKELDLLKNEVYV

SEQ ID NO: 3042288 - protein, 17 aa, Entamoeba invadens
QNCLLCRSGYTFNGTNC

SEQ ID NO: 3042289 - protein, 26 aa, Entamoeba invadens
QNDRFKCIICHDGIMDSEGSYYYMDE

SEQ ID NO: 3042290 - protein, 24 aa, Entamoeba invadens
QNEIVKLKEIIHVLESDLTQTKDD

SEQ ID NO: 3042291 - protein, 20 aa, Entamoeba invadens
QNFIELPSLASYLMLEMFDE

SEQ ID NO: 3042292 - protein, 24 aa, Entamoeba invadens
QNGDNKVSFGLKRDENGKLVSNAQ

SEQ ID NO: 3042293 - protein, 17 aa, Entamoeba invadens
QNIFPKVTRMSLLSLET

SEQ ID NO: 3042294 - protein, 18 aa, Entamoeba invadens
QNIVEEWDDVTLQYINRN

SEQ ID NO: 3042295 - protein, 22 aa, Entamoeba invadens
QNKCAFTLNNKCVECTDNYTID

SEQ ID NO: 3042296 - protein, 20 aa, Entamoeba invadens
QNLCLNMKGYYCVNDGEHTT

SEQ ID NO: 3042297 - protein, 21 aa, Entamoeba invadens
QNLLIDFCIEHGYFFNSIYSK

SEQ ID NO: 3042298 - protein, 18 aa, Entamoeba invadens
QNMFCCVNQFTFDDVEKR

SEQ ID NO: 3042299 - protein, 18 aa, Entamoeba invadens
QNQIECFEFISFEKEKDR

SEQ ID NO: 3042300 - protein, 33 aa, Entamoeba invadens
QNSFNKCQCCRKCLEVQPPVFHCANVPKLDNFK

SEQ ID NO: 3042301 - protein, 23 aa, Entamoeba invadens
QNSKLKIFASIGGWDFSSEKATR

SEQ ID NO: 3042302 - protein, 19 aa, Entamoeba invadens
QNYDFANAIVLNYEANIGD

SEQ ID NO: 3042303 - protein, 17 aa, Entamoeba invadens
QPFPSVLNLPNFKMCRG

SEQ ID NO: 3042304 - protein, 21 aa, Entamoeba invadens
QPRTAMLLHRLFAIGMAVCDV

SEQ ID NO: 3042305 - protein, 25 aa, Entamoeba invadens
QQKCKVCVKLGEFILRKARNGSTKR

SEQ ID NO: 3042306 - protein, 18 aa, Entamoeba invadens
QQKVICASEKVYSPQVIM

SEQ ID NO: 3042307 - protein, 24 aa, Entamoeba invadens
QQLNSYKAVLNYVNGNSYIINDVL

SEQ ID NO: 3042308 - protein, 30 aa, Entamoeba invadens
QQRDITYFFCFKWNALLFKRLFNEKDLLRV

SEQ ID NO: 3042309 - protein, 19 aa, Entamoeba invadens
QREEGVLRFNKSLRLGTKK

SEQ ID NO: 3042310 - protein, 17 aa, Entamoeba invadens
QRKAMTIFLNYKNFNLK

SEQ ID NO: 3042311 - protein, 20 aa, Entamoeba invadens
QRKNIPSKLVVYPEENHWVL

SEQ ID NO: 3042312 - protein, 20 aa, Entamoeba invadens
QRKSFIDNYKKMKIEEKRLD

SEQ ID NO: 3042313 - protein, 24 aa, Entamoeba invadens
QRLPRYELLLKDLLKTPVFKDNQN

SEQ ID NO: 3042314 - protein, 18 aa, Entamoeba invadens
QRQMVLALDLCFYGPYGI

SEQ ID NO: 3042315 - protein, 25 aa, Entamoeba invadens
QRVCFGEAWSTIWDPQTGAIFTKET

SEQ ID NO: 3042316 - protein, 21 aa, Entamoeba invadens
QRVIRYKLFIENISKLPQFKG

SEQ ID NO: 3042317 - protein, 20 aa, Entamoeba invadens
QSACIRVPNCLEIDTETQGK

SEQ ID NO: 3042318 - protein, 17 aa, Entamoeba invadens
QSCFSFCNSLREAKFSP

SEQ ID NO: 3042319 - protein, 25 aa, Entamoeba invadens
QSDLCALEPTILLGVPTVFNRVQKA

SEQ ID NO: 3042320 - protein, 26 aa, Entamoeba invadens
QSNSAFKLACHKNEVCGVDINESGYL

SEQ ID NO: 3042321 - protein, 21 aa, Entamoeba invadens
QSNYALKVLIGKQVVINDVTY

SEQ ID NO: 3042322 - protein, 24 aa, Entamoeba invadens
QSPNVFYTQNFVKMRSELDKETGN

SEQ ID NO: 3042323 - protein, 17 aa, Entamoeba invadens
QSSMCMGTPLSSNTYTC

SEQ ID NO: 3042324 - protein, 23 aa, Entamoeba invadens
QSSSSWEGLQFVIKEALSMSISG

SEQ ID NO: 3042325 - protein, 26 aa, Entamoeba invadens
QTARMIKRICKRMRLGKKTCKKLAMK

SEQ ID NO: 3042326 - protein, 21 aa, Entamoeba invadens
QTDCKSCINKSYWLDTSTNKC

SEQ ID NO: 3042327 - protein, 19 aa, Entamoeba invadens
QTDLKIIKEYGLFWPQILN

SEQ ID NO: 3042328 - protein, 25 aa, Entamoeba invadens
QTILFKFNYDYVFGENYGSGRYLFT

SEQ ID NO: 3042329 - protein, 18 aa, Entamoeba invadens
QTKALVKKAAKAQYKKMK

SEQ ID NO: 3042330 - protein, 20 aa, Entamoeba invadens
QTNCEKCKNGVYIKIVHVKM

SEQ ID NO: 3042331 - protein, 26 aa, Entamoeba invadens
QTNVEIFPAIQLYSTRCATTGSTSSR

SEQ ID NO: 3042332 - protein, 26 aa, Entamoeba invadens
  misc_feature (25)..(26): Xaa can be any naturally occurring amino acid
QTPRKYCLSSKCGNGLLDDGEEGVXX

SEQ ID NO: 3042333 - protein, 21 aa, Entamoeba invadens
QTPVIKRYDCYLDLPDPMVVK

SEQ ID NO: 3042334 - protein, 23 aa, Entamoeba invadens
QTSCISCNLKFFLNDKTCENCIE

SEQ ID NO: 3042335 - protein, 17 aa, Entamoeba invadens
QTVCALKTLKMYVTKVT

SEQ ID NO: 3042336 - protein, 17 aa, Entamoeba invadens
QVITSFVYLPAQKVEIG

SEQ ID NO: 3042337 - protein, 26 aa, Entamoeba invadens
QVSKICLSALCSLKVNPVFITESTVI

SEQ ID NO: 3042338 - protein, 24 aa, Entamoeba invadens
QVSKTRLIWAYKMFFNDLMFPQNI

SEQ ID NO: 3042339 - protein, 18 aa, Entamoeba invadens
QVTGDFKWFDRKYFERKN

SEQ ID NO: 3042340 - protein, 23 aa, Entamoeba invadens
QVVFVVGKKGMFEVRGFAEDNLN

SEQ ID NO: 3042341 - protein, 34 aa, Entamoeba invadens
QWNEVLSLNCINGLKFTLLDSKRAFYIEKSYSSD

SEQ ID NO: 3042342 - protein, 23 aa, Entamoeba invadens
QYAFLKCFLLTKFEFSDDLHDVG

SEQ ID NO: 3042343 - protein, 18 aa, Entamoeba invadens
QYAPRVNRAKAIELAQRW

SEQ ID NO: 3042344 - protein, 18 aa, Entamoeba invadens
QYLDTVQYLPSFDAFGLD

SEQ ID NO: 3042345 - protein, 22 aa, Entamoeba invadens
QYLSGTICFSCRAGTYSSGGTT

SEQ ID NO: 3042346 - protein, 18 aa, Entamoeba invadens
QYPGSMCYIKCPSGYIGN

SEQ ID NO: 3042347 - protein, 25 aa, Entamoeba invadens
QYRLVCGETIGRYCETEFVDVICDD

SEQ ID NO: 3042348 - protein, 24 aa, Entamoeba invadens
QYSLRSVYEYAPYIKNYYIVTMDQ

SEQ ID NO: 3042349 - protein, 27 aa, Entamoeba invadens
QYVKNKGLCLEEQFKFCGKDNNCPSAN

SEQ ID NO: 3042350 - protein, 30 aa, Entamoeba invadens
QYYECANTFKGFRPCAPGTWCQGEQEKPYG

SEQ ID NO: 3042351 - protein, 26 aa, Entamoeba invadens
QYYECSEVFQGYKPCVLGKKCTSKER

SEQ ID NO: 3042352 - protein, 24 aa, Entamoeba invadens
QYYETENRLSLLESEMKRLEDVER

SEQ ID NO: 3042353 - protein, 27 aa, Entamoeba invadens
QYYRPSCTTCCRVLFASDYNYVTQSRF

SEQ ID NO: 3042354 - protein, 20 aa, Entamoeba invadens
RAEIKAESEIGLKVKSIIAN

SEQ ID NO: 3042355 - protein, 18 aa, Entamoeba invadens
RAGIKVVVIIDRETKEVI

SEQ ID NO: 3042356 - protein, 19 aa, Entamoeba invadens
RAGVDMRKNLNIWTKFKEE

SEQ ID NO: 3042357 - protein, 18 aa, Entamoeba invadens
RAHKLQIVLFKINQKLET

SEQ ID NO: 3042358 - protein, 19 aa, Entamoeba invadens
RAILVAFILTFTRDAEDLK

SEQ ID NO: 3042359 - protein, 21 aa, Entamoeba invadens
RAKEKFFLHGYWPEIVVNQNM

SEQ ID NO: 3042360 - protein, 18 aa, Entamoeba invadens
RAKREGLKPMKHQLIQRK

SEQ ID NO: 3042361 - protein, 24 aa, Entamoeba invadens
RANDRVCVAGFFGMVLGKREFKRW

SEQ ID NO: 3042362 - protein, 18 aa, Entamoeba invadens
RATIPVIQIMDWTWYAKK

SEQ ID NO: 3042363 - protein, 18 aa, Entamoeba invadens
RAVRCLKVAQSGIPDATR

SEQ ID NO: 3042364 - protein, 18 aa, Entamoeba invadens
RAVRCLKVAQSGIPKATR

SEQ ID NO: 3042365 - protein, 21 aa, Entamoeba invadens
RCATCADNGVRSCLMCLTGYY

SEQ ID NO: 3042366 - protein, 20 aa, Entamoeba invadens
RCGQALRLVGPSQKQFICYV

SEQ ID NO: 3042367 - protein, 17 aa, Entamoeba invadens
RCKAGKCTVSGGCSECE

SEQ ID NO: 3042368 - protein, 24 aa, Entamoeba invadens
RCKNDYRKLISLKIEFVKVTKKET

SEQ ID NO: 3042369 - protein, 26 aa, Entamoeba invadens
RCNSTHCLGCKDWGLIVEPPVGAPPN

SEQ ID NO: 3042370 - protein, 22 aa, Entamoeba invadens
RCQDGYTLKFCLLLDAYYCDSS

SEQ ID NO: 3042371 - protein, 18 aa, Entamoeba invadens
RCSITGSCILCKSGYVPS

SEQ ID NO: 3042372 - protein, 20 aa, Entamoeba invadens
RCSQIALNHAVNIVGYGVEN

SEQ ID NO: 3042373 - protein, 27 aa, Entamoeba invadens
RDDAWYYPYGCLNFRTFSLNISETENG

SEQ ID NO: 3042374 - protein, 25 aa, Entamoeba invadens
RDDQCMWWNVPNCISYIERGVCATC

SEQ ID NO: 3042375 - protein, 19 aa, Entamoeba invadens
RDEGLQRVISVVGDVVTGK

SEQ ID NO: 3042376 - protein, 23 aa, Entamoeba invadens
RDKISSVNMFFRGKAYQSLSDIK

SEQ ID NO: 3042377 - protein, 27 aa, Entamoeba invadens
RDKSEALEFLRWIKFNYMSESQDTLGE

SEQ ID NO: 3042378 - protein, 19 aa, Entamoeba invadens
RDLLELRPVEVEKSVMKMV

SEQ ID NO: 3042379 - protein, 18 aa, Entamoeba invadens
RDLQCYLHPSNFYIHKAN

SEQ ID NO: 3042380 - protein, 21 aa, Entamoeba invadens
RDMKIAVSMKDRFTLEQKVGK

SEQ ID NO: 3042381 - protein, 28 aa, Entamoeba invadens
RDNGFNGFFICRSWCSPGYFDDNAPYTL

SEQ ID NO: 3042382 - protein, 19 aa, Entamoeba invadens
RDQEIVVMSVLSYLNKYNT

SEQ ID NO: 3042383 - protein, 25 aa, Entamoeba invadens
RDQGNCGSCYAFATASLIESKMLYK

SEQ ID NO: 3042384 - protein, 21 aa, Entamoeba invadens
RDRYMKSGDGYVIVYSITSTS

SEQ ID NO: 3042385 - protein, 25 aa, Entamoeba invadens
RDSFKRRKLIESDKMYSVQRDSETT

SEQ ID NO: 3042386 - protein, 29 aa, Entamoeba invadens
RDTYRKKANEWSNKWVKTDVNGQWSGKNF

SEQ ID NO: 3042387 - protein, 17 aa, Entamoeba invadens
RDWKFSGIINMKHIFFM

SEQ ID NO: 3042388 - protein, 26 aa, Entamoeba invadens
RDYYIEYLKKMVIPHIKRGTPMGLNV

SEQ ID NO: 3042389 - protein, 20 aa, Entamoeba invadens
REDIAFLLNERVYFESKTSN

SEQ ID NO: 3042390 - protein, 24 aa, Entamoeba invadens
REELLRQQMRTMWKKEDQYENEMK

SEQ ID NO: 3042391 - protein, 21 aa, Entamoeba invadens
REERRRCGNQIMFAPFPEYLL

SEQ ID NO: 3042392 - protein, 22 aa, Entamoeba invadens
REIFNWKLQILEIYNSPLNEKY

SEQ ID NO: 3042393 - protein, 17 aa, Entamoeba invadens
REKEKRSNEEIAKKNEN

SEQ ID NO: 3042394 - protein, 19 aa, Entamoeba invadens
REKLCGSCHGSGGEMETCP

SEQ ID NO: 3042395 - protein, 18 aa, Entamoeba invadens
RELKRKLRGITMKKNKIQ

SEQ ID NO: 3042396 - protein, 26 aa, Entamoeba invadens
RELPTKIVGGFLFLRIFCPAIASPEN

SEQ ID NO: 3042397 - protein, 23 aa, Entamoeba invadens
RERDISLFPAFVIIRHHDQKDMI

SEQ ID NO: 3042398 - protein, 20 aa, Entamoeba invadens
REYHDFFTLTPGRAFILSSL

SEQ ID NO: 3042399 - protein, 18 aa, Entamoeba invadens
RFDTYGCTSCAKGYGLNN

SEQ ID NO: 3042400 - protein, 19 aa, Entamoeba invadens
RFFKALAEVEVRGVRSPKL

SEQ ID NO: 3042401 - protein, 19 aa, Entamoeba invadens
RFLYVHPYAGYPTTATYAQ

SEQ ID NO: 3042402 - protein, 18 aa, Entamoeba invadens
RFNMKPNGQIQEKNNVNV

SEQ ID NO: 3042403 - protein, 19 aa, Entamoeba invadens
RFNPKPIRCPLKIEKVEKK

SEQ ID NO: 3042404 - protein, 25 aa, Entamoeba invadens
RFQSELLDFIKPVIITRENDKEVML

SEQ ID NO: 3042405 - protein, 19 aa, Entamoeba invadens
RFTKPRKSVPVDFSKSIEG

SEQ ID NO: 3042406 - protein, 19 aa, Entamoeba invadens
RFTKPRKSVPVDFTDSLKS

SEQ ID NO: 3042407 - protein, 24 aa, Entamoeba invadens
RFVRKARIEKRIGLETSLHLNREV

SEQ ID NO: 3042408 - protein, 21 aa, Entamoeba invadens
RFVSRAGVLLRSVCLVNHGLT

SEQ ID NO: 3042409 - protein, 19 aa, Entamoeba invadens
RGDKGYGIGDSRLNYGNGL

SEQ ID NO: 3042410 - protein, 18 aa, Entamoeba invadens
RGDLILEEVITYCNRLLR

SEQ ID NO: 3042411 - protein, 19 aa, Entamoeba invadens
RGDYMITYFYITDSDDGCG

SEQ ID NO: 3042412 - protein, 19 aa, Entamoeba invadens
RGGWGSRLFGSQSGPGVRH

SEQ ID NO: 3042413 - protein, 21 aa, Entamoeba invadens
RGKEKGLCKVVQMPIPEQLQT

SEQ ID NO: 3042414 - protein, 23 aa, Entamoeba invadens
RGKFPTKIGSFVPEKEMKSDAVA

SEQ ID NO: 3042415 - protein, 19 aa, Entamoeba invadens
RGPLEYMQTALFLYDKYDL

SEQ ID NO: 3042416 - protein, 27 aa, Entamoeba invadens
RGSEDWKEGYQGYSHVVGYAQVKYTST

SEQ ID NO: 3042417 - protein, 28 aa, Entamoeba invadens
RGSEDWKEGYQGYSHVVGYARVKYTSTA

SEQ ID NO: 3042418 - protein, 17 aa, Entamoeba invadens
RGVSKLILENGFSSLKE

SEQ ID NO: 3042419 - protein, 19 aa, Entamoeba invadens
RGYKIHKNRFHTIMFVKFW

SEQ ID NO: 3042420 - protein, 20 aa, Entamoeba invadens
RGYYAMLRIYKIYDVKYNNR

SEQ ID NO: 3042421 - protein, 23 aa, Entamoeba invadens
RHCPKNTWCKGEQKLPYTESPCV

SEQ ID NO: 3042422 - protein, 26 aa, Entamoeba invadens
RHKKAVSCAMLLMGALFEGAQVRFLK

SEQ ID NO: 3042423 - protein, 21 aa, Entamoeba invadens
RHTYWALSKLRRLLRRIKGRK

SEQ ID NO: 3042424 - protein, 17 aa, Entamoeba invadens
RIAELKETLARQELDRI

SEQ ID NO: 3042425 - protein, 19 aa, Entamoeba invadens
RIDNIYIFDEIDVVNAHLL

SEQ ID NO: 3042426 - protein, 19 aa, Entamoeba invadens
RIEALPVHTNFPFVRTSGV

SEQ ID NO: 3042427 - protein, 23 aa, Entamoeba invadens
RIEKFATAQFEWDEEDIKKNRLH

SEQ ID NO: 3042428 - protein, 20 aa, Entamoeba invadens
RIELKMQKERAMKRLEQLEQ

SEQ ID NO: 3042429 - protein, 19 aa, Entamoeba invadens
RIFIPGHPLYEATIVEIYE

SEQ ID NO: 3042430 - protein, 22 aa, Entamoeba invadens
RIGTFNGWKSSIIYKELMRKCK

SEQ ID NO: 3042431 - protein, 23 aa, Entamoeba invadens
RIILELKDKYFLDENVLKELVSK

SEQ ID NO: 3042432 - protein, 17 aa, Entamoeba invadens
RINEISENIFLTNDCYA

SEQ ID NO: 3042433 - protein, 17 aa, Entamoeba invadens
RINIWKVLRRSKLKVRT

SEQ ID NO: 3042434 - protein, 24 aa, Entamoeba invadens
RIPPPKPKRKALLRQNNFQDYQEE

SEQ ID NO: 3042435 - protein, 20 aa, Entamoeba invadens
RIQKCREFIVGNTYVDIMRK

SEQ ID NO: 3042436 - protein, 18 aa, Entamoeba invadens
RIQKRVSALEARVEQFKK

SEQ ID NO: 3042437 - protein, 18 aa, Entamoeba invadens
RIRGMKIPYTVWFSKSKT

SEQ ID NO: 3042438 - protein, 24 aa, Entamoeba invadens
RIRKLEDFLLYRDWKNLIKPDYSI

SEQ ID NO: 3042439 - protein, 21 aa, Entamoeba invadens
RITERRVFTALLFIEPMLDVF

SEQ ID NO: 3042440 - protein, 21 aa, Entamoeba invadens
RKARQTKLEILRALRKQADSL

SEQ ID NO: 3042441 - protein, 25 aa, Entamoeba invadens
RKDLNRTALSFSWMLQYCQQSGIDV

SEQ ID NO: 3042442 - protein, 18 aa, Entamoeba invadens
RKEERKCAKEVMFKKFPE

SEQ ID NO: 3042443 - protein, 22 aa, Entamoeba invadens
RKEVQRIVDFINLRTFPIFPII

SEQ ID NO: 3042444 - protein, 27 aa, Entamoeba invadens
RKFEFKPSVLLKYLFVREANMNVRIYL

SEQ ID NO: 3042445 - protein, 18 aa, Entamoeba invadens
RKGKCSLSSTKIESTGGK

SEQ ID NO: 3042446 - protein, 25 aa, Entamoeba invadens
RKIARTKRLVLSKMYKILRVLSPLE

SEQ ID NO: 3042447 - protein, 25 aa, Entamoeba invadens
RKIGNGVLIVGHFPFGVAAYDCKSY

SEQ ID NO: 3042448 - protein, 31 aa, Entamoeba invadens
RKKDTISFRYDWRALLAVVRMHLPAIEYFVG

SEQ ID NO: 3042449 - protein, 18 aa, Entamoeba invadens
RKNLKVKIAKMLEKKKNA

SEQ ID NO: 3042450 - protein, 20 aa, Entamoeba invadens
RKSPTKKLVRGMPSLVKGVS

SEQ ID NO: 3042451 - protein, 20 aa, Entamoeba invadens
RKTLQLEKIVSITLPQSLVF

SEQ ID NO: 3042452 - protein, 23 aa, Entamoeba invadens
RKTYNLRFLLLFKPTTGVLRSNE

SEQ ID NO: 3042453 - protein, 19 aa, Entamoeba invadens
RKWIRGCEPQCGMCRDGFV

SEQ ID NO: 3042454 - protein, 18 aa, Entamoeba invadens
RKWKSGCEPICGRCNEGY

SEQ ID NO: 3042455 - protein, 27 aa, Entamoeba invadens
RLAKETGKEVVKWGVNKVVSKATDTLT

SEQ ID NO: 3042456 - protein, 17 aa, Entamoeba invadens
RLDLVKRGMEPGKKPTL

SEQ ID NO: 3042457 - protein, 33 aa, Entamoeba invadens
RLEDVERHLHDVLDRLGLDLSVTLEKDKPEIKN

SEQ ID NO: 3042458 - protein, 19 aa, Entamoeba invadens
RLEEILGKKEIDVLVLTHV

SEQ ID NO: 3042459 - protein, 22 aa, Entamoeba invadens
RLELVPRVKIFAGKAAIGYAMA

SEQ ID NO: 3042460 - protein, 19 aa, Entamoeba invadens
RLFSDELIDVLVCGDDDER

SEQ ID NO: 3042461 - protein, 25 aa, Entamoeba invadens
RLIGKCLREKVCVDLVFSDDILIGL

SEQ ID NO: 3042462 - protein, 18 aa, Entamoeba invadens
RLISVAFNTFSPFVLSYN

SEQ ID NO: 3042463 - protein, 19 aa, Entamoeba invadens
RLKFAGTTTTMFDIMTQKD

SEQ ID NO: 3042464 - protein, 19 aa, Entamoeba invadens
RLKSWGFNALPNWVDTKMF

SEQ ID NO: 3042465 - protein, 27 aa, Entamoeba invadens
RLNNDFYYANCKDIFGVSKEKLDKKIK

SEQ ID NO: 3042466 - protein, 23 aa, Entamoeba invadens
RLQRISFKMSQRMNFEKDMTNAI

SEQ ID NO: 3042467 - protein, 24 aa, Entamoeba invadens
RLYIREISNLMLYHNSKININSSY

SEQ ID NO: 3042468 - protein, 17 aa, Entamoeba invadens
RMEAITWDTFCNDCASS

SEQ ID NO: 3042469 - protein, 27 aa, Entamoeba invadens
RMEKFYKYVKWGVCVDAYNCYMDDFLN

SEQ ID NO: 3042470 - protein, 20 aa, Entamoeba invadens
RMKNVDTINVGLAFGGILKM

SEQ ID NO: 3042471 - protein, 26 aa, Entamoeba invadens
RMKSRLNLYLMFDFKVFLYRHELLLK

SEQ ID NO: 3042472 - protein, 17 aa, Entamoeba invadens
RMMQGFVDITHSSIDRL

SEQ ID NO: 3042473 - protein, 19 aa, Entamoeba invadens
RMNREFWYFRNENGKLQEN

SEQ ID NO: 3042474 - protein, 21 aa, Entamoeba invadens
RMTLEGAKVLGVYEICPKICG

SEQ ID NO: 3042475 - protein, 18 aa, Entamoeba invadens
RNGKRKPFEGERSLTGIQ

SEQ ID NO: 3042476 - protein, 22 aa, Entamoeba invadens
RNKWMSTTACRFATYQYDKHGS

SEQ ID NO: 3042477 - protein, 24 aa, Entamoeba invadens
RNKYPLKNYEVWKMEDDEYLIMTK

SEQ ID NO: 3042478 - protein, 27 aa, Entamoeba invadens
RNLGFNSFFIFRAWRSLGSWDPNAYQI

SEQ ID NO: 3042479 - protein, 31 aa, Entamoeba invadens
RNNGFTGFFICRAWCSPGYFDSNSVYTLQQA

SEQ ID NO: 3042480 - protein, 17 aa, Entamoeba invadens
RNPNGKYLMSIVGDSVD

SEQ ID NO: 3042481 - protein, 18 aa, Entamoeba invadens
RNSNNRWIYDPDKPLIIP

SEQ ID NO: 3042482 - protein, 24 aa, Entamoeba invadens
RNSWGASWGLDGYILMSRNKNNQC

SEQ ID NO: 3042483 - protein, 19 aa, Entamoeba invadens
RNTRCYVTTTFMFNTIGDK

SEQ ID NO: 3042484 - protein, 20 aa, Entamoeba invadens
RNTWWFPLLNTISMDQYQRV

SEQ ID NO: 3042485 - protein, 17 aa, Entamoeba invadens
RPACGPCREGFVCTTAG

SEQ ID NO: 3042486 - protein, 21 aa, Entamoeba invadens
RPAVYEIRGKEKGLCKVVQMP

SEQ ID NO: 3042487 - protein, 19 aa, Entamoeba invadens
RPDHQIFVVGYGVENNEEF

SEQ ID NO: 3042488 - protein, 24 aa, Entamoeba invadens
RPEINKTAIPRCFSKISLTNGQAN

SEQ ID NO: 3042489 - protein, 19 aa, Entamoeba invadens
RPENFFISFGCFNNENSCR

SEQ ID NO: 3042490 - protein, 21 aa, Entamoeba invadens
RPKTTCYTEQQLLTSSLFGPV

SEQ ID NO: 3042491 - protein, 18 aa, Entamoeba invadens
RPNVEFEEALDFVSIEIL

SEQ ID NO: 3042492 - protein, 20 aa, Entamoeba invadens
RQDGGLLCYVKPKQFDDFVD

SEQ ID NO: 3042493 - protein, 17 aa, Entamoeba invadens
RQLGGVMFWAIDLDPEM

SEQ ID NO: 3042494 - protein, 27 aa, Entamoeba invadens
RQNNLCTRLLTAFARSASKKFLNNTLK

SEQ ID NO: 3042495 - protein, 24 aa, Entamoeba invadens
RQSTEYWLRHKAIFGVLASYSGPI

SEQ ID NO: 3042496 - protein, 24 aa, Entamoeba invadens
RQTGFCPGTIFKCENVGSTSKEID

SEQ ID NO: 3042497 - protein, 20 aa, Entamoeba invadens
RRFPGVPIVFCLGNNEVEPA

SEQ ID NO: 3042498 - protein, 17 aa, Entamoeba invadens
RRGEMKSFSVIKRRFRK

SEQ ID NO: 3042499 - protein, 17 aa, Entamoeba invadens
RRHKHFYSHLFGHGYGY

SEQ ID NO: 3042500 - protein, 24 aa, Entamoeba invadens
RRKMIKKHADGVMRITSNITLLVM

SEQ ID NO: 3042501 - protein, 24 aa, Entamoeba invadens
RRKPVKRCFSKICLTRTSAFSKKM

SEQ ID NO: 3042502 - protein, 21 aa, Entamoeba invadens
RRLEGSDVYSSFNVTYDNGDG

SEQ ID NO: 3042503 - protein, 17 aa, Entamoeba invadens
RRMKLVTCYMTINCTTR

SEQ ID NO: 3042504 - protein, 23 aa, Entamoeba invadens
RRPGRQFKMPVFDDVVLETNSYP

SEQ ID NO: 3042505 - protein, 20 aa, Entamoeba invadens
RRRLEGISRQELFPESAPFI

SEQ ID NO: 3042506 - protein, 22 aa, Entamoeba invadens
RRRRRHGRSWRGRRRHHRRGGR

SEQ ID NO: 3042507 - protein, 17 aa, Entamoeba invadens
RRSHPPLIRTKGQSDER

SEQ ID NO: 3042508 - protein, 25 aa, Entamoeba invadens
RRSMLKELSSFIGLLKSGHYLKAQN

SEQ ID NO: 3042509 - protein, 17 aa, Entamoeba invadens
RRVIHFEMCGGSVTAKN

SEQ ID NO: 3042510 - protein, 17 aa, Entamoeba invadens
RRWLWTTKRRLRRLQRT

SEQ ID NO: 3042511 - protein, 19 aa, Entamoeba invadens
RSASTRLIVLLGFFLFFTF

SEQ ID NO: 3042512 - protein, 25 aa, Entamoeba invadens
RSDTITRLVLRGCDDSTNLLEYKKL

SEQ ID NO: 3042513 - protein, 23 aa, Entamoeba invadens
RSHWEVVTMLPGDKIVFTTNDSV

SEQ ID NO: 3042514 - protein, 24 aa, Entamoeba invadens
RSHWEVVTMLPGDYIVFTTNDSVS

SEQ ID NO: 3042515 - protein, 19 aa, Entamoeba invadens
RSHWEVVTMLPGEEIVFTT

SEQ ID NO: 3042516 - protein, 24 aa, Entamoeba invadens
RSIYLQLLYHFDWINTFDKKLLVL

SEQ ID NO: 3042517 - protein, 22 aa, Entamoeba invadens
RSKASLILEKYVKKFEEKKYAT

SEQ ID NO: 3042518 - protein, 20 aa, Entamoeba invadens
RSLELCSGRVYYLPNCYTND

SEQ ID NO: 3042519 - protein, 17 aa, Entamoeba invadens
RSLNSGNIFWVKAPQNK

SEQ ID NO: 3042520 - protein, 17 aa, Entamoeba invadens
RSNFVWCHNHLDGSKMT

SEQ ID NO: 3042521 - protein, 19 aa, Entamoeba invadens
RSRIVRFVGGFDVEDVTKF

SEQ ID NO: 3042522 - protein, 18 aa, Entamoeba invadens
RSSSDGWVAKSVCTRSNF

SEQ ID NO: 3042523 - protein, 26 aa, Entamoeba invadens
RSTSPFILSIFIFRSNKFEEFFTMNN

SEQ ID NO: 3042524 - protein, 25 aa, Entamoeba invadens
RSVKSVPESVDWRSIMNPAKDQEQC

SEQ ID NO: 3042525 - protein, 18 aa, Entamoeba invadens
RTAQAEWSKNFGATENKE

SEQ ID NO: 3042526 - protein, 19 aa, Entamoeba invadens
RTEKKIVKMFLKGMKGKRC

SEQ ID NO: 3042527 - protein, 17 aa, Entamoeba invadens
RTETLKQIRLMKKQREK

SEQ ID NO: 3042528 - protein, 24 aa, Entamoeba invadens
RTIRDLPIFFTYQINMTIFSFQNS

SEQ ID NO: 3042529 - protein, 20 aa, Entamoeba invadens
RTKLSSIKFGNGVTHIGSKA

SEQ ID NO: 3042530 - protein, 18 aa, Entamoeba invadens
RTMYPLKSGENITSIEED

SEQ ID NO: 3042531 - protein, 18 aa, Entamoeba invadens
RTQLGMWLAKCKKQLTDA

SEQ ID NO: 3042532 - protein, 21 aa, Entamoeba invadens
RTRDAFSLFVRTGRTAQAEWS

SEQ ID NO: 3042533 - protein, 18 aa, Entamoeba invadens
RTSVKAFCKVVNVNHLMP

SEQ ID NO: 3042534 - protein, 18 aa, Entamoeba invadens
RTSVKAFCKVVNVNHVMP

SEQ ID NO: 3042535 - protein, 24 aa, Entamoeba invadens
RTVNPKTRFSAVFFESEMTTTVSF

SEQ ID NO: 3042536 - protein, 23 aa, Entamoeba invadens
RTVYFDEIHLIKSIDPPSTRKCT

SEQ ID NO: 3042537 - protein, 20 aa, Entamoeba invadens
RVAMPNCHIVIIFFSELPKR

SEQ ID NO: 3042538 - protein, 28 aa, Entamoeba invadens
RVKEIKKRMEPFFCLGTVAYLKEKKKND

SEQ ID NO: 3042539 - protein, 22 aa, Entamoeba invadens
RVKIVRKRMFVLDEVLRETRTI

SEQ ID NO: 3042540 - protein, 18 aa, Entamoeba invadens
RVKQLVVLSSVFDLEQIP

SEQ ID NO: 3042541 - protein, 17 aa, Entamoeba invadens
RVLEKCLKVRADIAEEE

SEQ ID NO: 3042542 - protein, 25 aa, Entamoeba invadens
RVNRAKAIELAQRWATKERDGCMVK

SEQ ID NO: 3042543 - protein, 19 aa, Entamoeba invadens
RVPILSLPQEWLWCESWCN

SEQ ID NO: 3042544 - protein, 19 aa, Entamoeba invadens
RVREEFLLHGFWPQIQANK

SEQ ID NO: 3042545 - protein, 24 aa, Entamoeba invadens
RVSKSCFRNCMKLESITFKNSTHK

SEQ ID NO: 3042546 - protein, 20 aa, Entamoeba invadens
RVVSISTPWLGAVKTIKALL

SEQ ID NO: 3042547 - protein, 22 aa, Entamoeba invadens
RVYFLHQVFYGMEVMASEQKYT

SEQ ID NO: 3042548 - protein, 19 aa, Entamoeba invadens
RWTYCGVGEFQCSDSNSLS

SEQ ID NO: 3042549 - protein, 29 aa, Entamoeba invadens
RYDLTAVCKYGWYSNQWFSFDDEITIKLK

SEQ ID NO: 3042550 - protein, 18 aa, Entamoeba invadens
RYDYGVFLGCQFGEEKAH

SEQ ID NO: 3042551 - protein, 28 aa, Entamoeba invadens
RYEWMAFALACARQGIVLVTVYATLGEE

SEQ ID NO: 3042552 - protein, 17 aa, Entamoeba invadens
RYFKNERLKCCKTSFTE

SEQ ID NO: 3042553 - protein, 20 aa, Entamoeba invadens
RYNPIPVRSKKLFPYMETQH

SEQ ID NO: 3042554 - protein, 26 aa, Entamoeba invadens
RYSAPETFKGIPTFMSDVYSFGVTVF

SEQ ID NO: 3042555 - protein, 20 aa, Entamoeba invadens
RYSYDTFFYRSRWSSKEVGE

SEQ ID NO: 3042556 - protein, 18 aa, Entamoeba invadens
RYTTGKNKLCYEICRGND

SEQ ID NO: 3042557 - protein, 25 aa, Entamoeba invadens
SAEKRALRKEKVDKFLDSENGQKLT

SEQ ID NO: 3042558 - protein, 19 aa, Entamoeba invadens
SAEKSAEKRALRKEKVDKF

SEQ ID NO: 3042559 - protein, 18 aa, Entamoeba invadens
SAELGLIYNNSWPIQGKY

SEQ ID NO: 3042560 - protein, 21 aa, Entamoeba invadens
SAFKGTKGVIPFNEKQIEYNV

SEQ ID NO: 3042561 - protein, 19 aa, Entamoeba invadens
SAGFREYHDFFTLTPGRAF

SEQ ID NO: 3042562 - protein, 24 aa, Entamoeba invadens
SAGIRHIGFKKGDKIGMFCETRYE

SEQ ID NO: 3042563 - protein, 17 aa, Entamoeba invadens
SAGLRKLGLKKGDKIGM

SEQ ID NO: 3042564 - protein, 19 aa, Entamoeba invadens
SALKLPFQVKVTSIAGDSV

SEQ ID NO: 3042565 - protein, 18 aa, Entamoeba invadens
SATRKYVILFFCYASVIS

SEQ ID NO: 3042566 - protein, 18 aa, Entamoeba invadens
SAVGKSCMFKRFITDKFN

SEQ ID NO: 3042567 - protein, 17 aa, Entamoeba invadens
SAYGPLHFHCERSLNSW

SEQ ID NO: 3042568 - protein, 21 aa, Entamoeba invadens
SCCDGFLTLFFRPLLTSTGDI

SEQ ID NO: 3042569 - protein, 22 aa, Entamoeba invadens
SCEANCELCENGKCTLCKQNYL

SEQ ID NO: 3042570 - protein, 24 aa, Entamoeba invadens
SCEGTCRKQRLCSMQNMRESDYAD

SEQ ID NO: 3042571 - protein, 20 aa, Entamoeba invadens
SCEICRRGTYSYGTKCVDCE

SEQ ID NO: 3042572 - protein, 25 aa, Entamoeba invadens
SCFHFPGRYNLVQTLACEESGAGGY

SEQ ID NO: 3042573 - protein, 21 aa, Entamoeba invadens
SCGCCYAAAVANHAQLIYANY

SEQ ID NO: 3042574 - protein, 18 aa, Entamoeba invadens
SCGRKEYCSEEGKCVKIT

SEQ ID NO: 3042575 - protein, 18 aa, Entamoeba invadens
SCHGSGGEMETCPVCQGS

SEQ ID NO: 3042576 - protein, 17 aa, Entamoeba invadens
SCILCKSGYVPSIDTTS

SEQ ID NO: 3042577 - protein, 19 aa, Entamoeba invadens
SCKEEGLYCVFDGKHDHEY

SEQ ID NO: 3042578 - protein, 18 aa, Entamoeba invadens
SCMFKRFITDKFNLSEKT

SEQ ID NO: 3042579 - protein, 17 aa, Entamoeba invadens
SCNTGGATTCTHCVGGK

SEQ ID NO: 3042580 - protein, 25 aa, Entamoeba invadens
SCQTCSSSGLGNCLTCKPYHYYSNG

SEQ ID NO: 3042581 - protein, 17 aa, Entamoeba invadens
SCSDVNCMTCENNRCIV

SEQ ID NO: 3042582 - protein, 20 aa, Entamoeba invadens
SCSSCFFEFTLIDSQRCENC

SEQ ID NO: 3042583 - protein, 18 aa, Entamoeba invadens
SCSTCPAGYFSAGGASSC

SEQ ID NO: 3042584 - protein, 19 aa, Entamoeba invadens
SCTSGYYFKSGFCTRCATG

SEQ ID NO: 3042585 - protein, 17 aa, Entamoeba invadens
SCTTTSCTECLSSYVLR

SEQ ID NO: 3042586 - protein, 24 aa, Entamoeba invadens
SCVSCAPSGYSICAQTRHQMVFVY

SEQ ID NO: 3042587 - protein, 19 aa, Entamoeba invadens
SCVTCPDMQYSFAGSTTCK

SEQ ID NO: 3042588 - protein, 20 aa, Entamoeba invadens
SCVTCPDMQYSLAGSTMCKS

SEQ ID NO: 3042589 - protein, 19 aa, Entamoeba invadens
SCWKLDDKTNRRWITDTFG

SEQ ID NO: 3042590 - protein, 19 aa, Entamoeba invadens
SCYKGMFITLLGFCESCDA

SEQ ID NO: 3042591 - protein, 25 aa, Entamoeba invadens
SDACKEYRKKLHLPMREVKDKIMKL

SEQ ID NO: 3042592 - protein, 25 aa, Entamoeba invadens
SDAPYLYDYVDIITPRVCHDQPLPR

SEQ ID NO: 3042593 - protein, 26 aa, Entamoeba invadens
SDCVVICYCPYIPRSFDRVIEAAKEA

SEQ ID NO: 3042594 - protein, 23 aa, Entamoeba invadens
SDEAQGVCANRCKEETQGHIDEV

SEQ ID NO: 3042595 - protein, 17 aa, Entamoeba invadens
SDFKDVFIFADAFKTFS

SEQ ID NO: 3042596 - protein, 27 aa, Entamoeba invadens
SDIDQRFWIKIYRTITQIAYLFIDGYV

SEQ ID NO: 3042597 - protein, 17 aa, Entamoeba invadens
SDIEMLEKIALRYQDII

SEQ ID NO: 3042598 - protein, 20 aa, Entamoeba invadens
SDIRNSICKADFVQTADMID

SEQ ID NO: 3042599 - protein, 18 aa, Entamoeba invadens
SDKGYGIGDSRVNYGDGK

SEQ ID NO: 3042600 - protein, 20 aa, Entamoeba invadens
SDLERELSGVIAKLDVEGVV

SEQ ID NO: 3042601 - protein, 17 aa, Entamoeba invadens
SDLLIAVMVNGRVHAKN

SEQ ID NO: 3042602 - protein, 20 aa, Entamoeba invadens
SDLMKIRLVEDISIAMEFLH

SEQ ID NO: 3042603 - protein, 24 aa, Entamoeba invadens
SDLNVWNTIIFMKSYQSLIIGTDI

SEQ ID NO: 3042604 - protein, 23 aa, Entamoeba invadens
SDLSDRVVSMWRAMRKREEKEIE

SEQ ID NO: 3042605 - protein, 32 aa, Entamoeba invadens
SDQAIQKFLACLIKKYWFKDYDVTPSTFDKWA

SEQ ID NO: 3042606 - protein, 25 aa, Entamoeba invadens
SDSESWGSLCINGVFNPEQCEFIEC

SEQ ID NO: 3042607 - protein, 22 aa, Entamoeba invadens
SDSYYAMTVMFSFLYELCPCLN

SEQ ID NO: 3042608 - protein, 24 aa, Entamoeba invadens
SDTKCLSCIDGFYLADEGKCSACN

SEQ ID NO: 3042609 - protein, 23 aa, Entamoeba invadens
SDWLKEFACEFDGHYVDYSGNAN

SEQ ID NO: 3042610 - protein, 21 aa, Entamoeba invadens
SEDGVAHVICRFVNRTNVELN

SEQ ID NO: 3042611 - protein, 22 aa, Entamoeba invadens
SEDIISCGKAEFVASGDEQMTT

SEQ ID NO: 3042612 - protein, 18 aa, Entamoeba invadens
SEDILDWDPFYLEFDNVG

SEQ ID NO: 3042613 - protein, 27 aa, Entamoeba invadens
SEDPLFPLRLAWIFSAAFSTSPNIVPG

SEQ ID NO: 3042614 - protein, 17 aa, Entamoeba invadens
SEEQCFAKVKGYIPHNV

SEQ ID NO: 3042615 - protein, 31 aa, Entamoeba invadens
SEESLVKDCFFFKWSLILKINRKSKELYDVK

SEQ ID NO: 3042616 - protein, 19 aa, Entamoeba invadens
SEGATCFAILMVFALTLFF

SEQ ID NO: 3042617 - protein, 26 aa, Entamoeba invadens
SEIPMFELFDGLRLLIMVMQDQLFDW

SEQ ID NO: 3042618 - protein, 23 aa, Entamoeba invadens
SEKAQHILYFWQGRDASLMDLGT

SEQ ID NO: 3042619 - protein, 21 aa, Entamoeba invadens
SEKCLSLSGNEFVQKEVTDGN

SEQ ID NO: 3042620 - protein, 22 aa, Entamoeba invadens
SEKGYYNGIAFDFDVPSETVMK

SEQ ID NO: 3042621 - protein, 18 aa, Entamoeba invadens
SEKSFCLVMDYYSLGVLS

SEQ ID NO: 3042622 - protein, 19 aa, Entamoeba invadens
SELKKAYRSLSLKYHPDKP

SEQ ID NO: 3042623 - protein, 29 aa, Entamoeba invadens
SELKLKVVDEVQRQFALILDLCFYGPYGI

SEQ ID NO: 3042624 - protein, 17 aa, Entamoeba invadens
SEMFKMMLMQQQQQNQQ

SEQ ID NO: 3042625 - protein, 24 aa, Entamoeba invadens
SENALKRFFMISTSYDENLINEST

SEQ ID NO: 3042626 - protein, 22 aa, Entamoeba invadens
SENDYTIALRIQFGDFVYFTAG

SEQ ID NO: 3042627 - protein, 21 aa, Entamoeba invadens
SENDYTIALRVQYGDFVYSTA

SEQ ID NO: 3042628 - protein, 38 aa, Entamoeba invadens
SEQFCGHYMFPYCILDKHLPFWGGYVGSHFEIQWKDQS

SEQ ID NO: 3042629 - protein, 23 aa, Entamoeba invadens
SESRVDFDIVEMDPLLDSSSISP

SEQ ID NO: 3042630 - protein, 27 aa, Entamoeba invadens
SEVFEKIRMCVKFSSEFSVSDVEYKKM

SEQ ID NO: 3042631 - protein, 26 aa, Entamoeba invadens
SFALRQCYIEDLFYNSCIKYYDKDNS

SEQ ID NO: 3042632 - protein, 22 aa, Entamoeba invadens
SFDLFIRRVIHPCSKSSEEISW

SEQ ID NO: 3042633 - protein, 25 aa, Entamoeba invadens
SFDNIKSVGSYAFALSGLHKITLNP

SEQ ID NO: 3042634 - protein, 29 aa, Entamoeba invadens
SFGGINFARCGICLELIGPSKRTVCTSVG

SEQ ID NO: 3042635 - protein, 17 aa, Entamoeba invadens
SFGKFVDRDSGAMKAGK

SEQ ID NO: 3042636 - protein, 18 aa, Entamoeba invadens
SFLREIIEAKTIKKLTLM

SEQ ID NO: 3042637 - protein, 24 aa, Entamoeba invadens
SFPARADQYGALQFYIRSSFDSES

SEQ ID NO: 3042638 - protein, 25 aa, Entamoeba invadens
SFSCLGPLTICYEGNYNITERKCEK

SEQ ID NO: 3042639 - protein, 20 aa, Entamoeba invadens
SFTLSYEFWQITDIHYDENY

SEQ ID NO: 3042640 - protein, 22 aa, Entamoeba invadens
SFTSNTTFTFGFSYLAIIDALG

SEQ ID NO: 3042641 - protein, 19 aa, Entamoeba invadens
SGCDSCPTGKVLQSDKKDC

SEQ ID NO: 3042642 - protein, 23 aa, Entamoeba invadens
SGCHQLKTLIGFEGVETIDAKAL

SEQ ID NO: 3042643 - protein, 24 aa, Entamoeba invadens
SGCYGSSMSCYACENGFYSAGIDT

SEQ ID NO: 3042644 - protein, 18 aa, Entamoeba invadens
SGDIGLIMARRMTLEGAK

SEQ ID NO: 3042645 - protein, 22 aa, Entamoeba invadens
SGDSFPILDLFVKIHKLVASPK

SEQ ID NO: 3042646 - protein, 19 aa, Entamoeba invadens
SGFGVGYWGWSDVAYYSDI

SEQ ID NO: 3042647 - protein, 28 aa, Entamoeba invadens
SGKGLLSCFDFPSRYALVETFAMSETGA

SEQ ID NO: 3042648 - protein, 25 aa, Entamoeba invadens
SGKHLKSSKCYLRLHDNILNTSTSG

SEQ ID NO: 3042649 - protein, 24 aa, Entamoeba invadens
SGKRLKRIDSIPVNLFNIINNSWQ

SEQ ID NO: 3042650 - protein, 27 aa, Entamoeba invadens
SGNEVMLRKIMKMLLLNDECIEHLLEL

SEQ ID NO: 3042651 - protein, 21 aa, Entamoeba invadens
SGPNNCLSCYSWYGVSNGQCV

SEQ ID NO: 3042652 - protein, 23 aa, Entamoeba invadens
SGPSKGREAIRRGIDWLLENGYF

SEQ ID NO: 3042653 - protein, 24 aa, Entamoeba invadens
SGRAWMFQTCVAYGYYQAVSEKSN

SEQ ID NO: 3042654 - protein, 17 aa, Entamoeba invadens
SGSCIKCTIGCSVCSDA

SEQ ID NO: 3042655 - protein, 20 aa, Entamoeba invadens
SGSCTLCPDGYYSTGKTGSC

SEQ ID NO: 3042656 - protein, 19 aa, Entamoeba invadens
SGSGIRYGIYSSSGVWPSV

SEQ ID NO: 3042657 - protein, 19 aa, Entamoeba invadens
SGSKCAACVEVTGKQTIKC

SEQ ID NO: 3042658 - protein, 22 aa, Entamoeba invadens
SGSVCLPCSAGTYSSSIDSSTC

SEQ ID NO: 3042659 - protein, 26 aa, Entamoeba invadens
SGTCKLGKIPLCIDYESQFECSECSG

SEQ ID NO: 3042660 - protein, 25 aa, Entamoeba invadens
SGTCKLGKIPLCIEYESQFECSECS

SEQ ID NO: 3042661 - protein, 19 aa, Entamoeba invadens
SGTQTHCIGNFTQIEPKVG

SEQ ID NO: 3042662 - protein, 24 aa, Entamoeba invadens
SGVPECTSKEWLVPTADDGQKRGS

SEQ ID NO: 3042663 - protein, 23 aa, Entamoeba invadens
SGVWPSVMGSGYVSQTAAALPMW

SEQ ID NO: 3042664 - protein, 23 aa, Entamoeba invadens
SHDGYRWGDPFVEGGPKQYLFSV

SEQ ID NO: 3042665 - protein, 18 aa, Entamoeba invadens
SHELFKLENDPAMVLLRP

SEQ ID NO: 3042666 - protein, 17 aa, Entamoeba invadens
SHIAKLYEKSALKMAKY

SEQ ID NO: 3042667 - protein, 24 aa, Entamoeba invadens
SHNTWRPYYAMLRIYKNYYFPYTQ

SEQ ID NO: 3042668 - protein, 18 aa, Entamoeba invadens
SHTIDCLCSVFLDSIKQD

SEQ ID NO: 3042669 - protein, 25 aa, Entamoeba invadens
SIADEWGCGFFETSAKERINILESF

SEQ ID NO: 3042670 - protein, 21 aa, Entamoeba invadens
SIARCGICIELTGPSMKPFTC

SEQ ID NO: 3042671 - protein, 28 aa, Entamoeba invadens
SIEESVTLPGWYFLKVRMTNFEEYRSCY

SEQ ID NO: 3042672 - protein, 26 aa, Entamoeba invadens
SIELFGSLKNRSWRSILTHISKNYKK

SEQ ID NO: 3042673 - protein, 29 aa, Entamoeba invadens
SIGGVLPRKIAKDIIKESLTMSGVKQKGC

SEQ ID NO: 3042674 - protein, 19 aa, Entamoeba invadens
SIGKFYFKKNLIINTQILI

SEQ ID NO: 3042675 - protein, 18 aa, Entamoeba invadens
SIHKNCKICIDTNCELCD

SEQ ID NO: 3042676 - protein, 19 aa, Entamoeba invadens
SIKALEAQKKMALEDKAEA

SEQ ID NO: 3042677 - protein, 27 aa, Entamoeba invadens
SINIKFEISKWFSLLFKMNNVYILESI

SEQ ID NO: 3042678 - protein, 19 aa, Entamoeba invadens
SIQMGCAYLATGHDELVTM

SEQ ID NO: 3042679 - protein, 21 aa, Entamoeba invadens
SITMYECFGWSEAYNTKRFHF

SEQ ID NO: 3042680 - protein, 25 aa, Entamoeba invadens
SIVSDTRISYSISIVNSKTTIVITK

SEQ ID NO: 3042681 - protein, 26 aa, Entamoeba invadens
SIYMVKGCLQDCDFPDYDRVIRTLQV

SEQ ID NO: 3042682 - protein, 18 aa, Entamoeba invadens
SKAQLRLATAKMRDINKS

SEQ ID NO: 3042683 - protein, 23 aa, Entamoeba invadens
SKCAPHITLYLTLFKEEVIPRVV

SEQ ID NO: 3042684 - protein, 17 aa, Entamoeba invadens
SKCDHSNFKMCSSYTSQ

SEQ ID NO: 3042685 - protein, 17 aa, Entamoeba invadens
SKCDRTKSQFRAWLNLK

SEQ ID NO: 3042686 - protein, 22 aa, Entamoeba invadens
SKCIRCKKGFIMKDIEFCVESD

SEQ ID NO: 3042687 - protein, 18 aa, Entamoeba invadens
SKFPKEFTYKLGANSVFG

SEQ ID NO: 3042688 - protein, 18 aa, Entamoeba invadens
SKHGICVTEPVYNLREAT

SEQ ID NO: 3042689 - protein, 26 aa, Entamoeba invadens
SKHPNCKVCAVDKCYQCKDDKYLKED

SEQ ID NO: 3042690 - protein, 24 aa, Entamoeba invadens
SKIDRFYKLWVEIARRFKKSKTVI

SEQ ID NO: 3042691 - protein, 23 aa, Entamoeba invadens
SKIKFNFASGKIVIRNEAQTKLF

SEQ ID NO: 3042692 - protein, 23 aa, Entamoeba invadens
SKIKSGGVVGVMSDIWWGLVETS

SEQ ID NO: 3042693 - protein, 23 aa, Entamoeba invadens
SKINSVGSFYVHKGGVITLNGMA

SEQ ID NO: 3042694 - protein, 23 aa, Entamoeba invadens
SKKKFRVGMEGPYAALTSLEYQK

SEQ ID NO: 3042695 - protein, 19 aa, Entamoeba invadens
SKKTAHFFIWNKIITPENV

SEQ ID NO: 3042696 - protein, 24 aa, Entamoeba invadens
SKLGQRFNKKLGEYVKDQAKTGLK

SEQ ID NO: 3042697 - protein, 26 aa, Entamoeba invadens
SKLHLVLRLRGGGISQFAIDNNLLSP

SEQ ID NO: 3042698 - protein, 21 aa, Entamoeba invadens
SKLRFDEMLRNMDVVYSSLRS

SEQ ID NO: 3042699 - protein, 26 aa, Entamoeba invadens
SKNAFSQICMPDFLAINMDSSDVNAE

SEQ ID NO: 3042700 - protein, 22 aa, Entamoeba invadens
SKRTEYKFVMEKNIYTGVVQKD

SEQ ID NO: 3042701 - protein, 18 aa, Entamoeba invadens
SKSVFQLMYGENRREGEV

SEQ ID NO: 3042702 - protein, 17 aa, Entamoeba invadens
SKTFQPFVLVSYSHNGM

SEQ ID NO: 3042703 - protein, 18 aa, Entamoeba invadens
SLADGIRCDMAHLDLNDV

SEQ ID NO: 3042704 - protein, 31 aa, Entamoeba invadens
SLDSFPFSPSIKMILAYAFADTGFVHLKFPL

SEQ ID NO: 3042705 - protein, 18 aa, Entamoeba invadens
SLEDPGFGHFLYKYYTTT

SEQ ID NO: 3042706 - protein, 17 aa, Entamoeba invadens
SLEPKFAVYFTEESGDR

SEQ ID NO: 3042707 - protein, 21 aa, Entamoeba invadens
SLGNSCFKSSGLTHIDVLGTL

SEQ ID NO: 3042708 - protein, 19 aa, Entamoeba invadens
SLGSLPSIVEILLGHNKIS

SEQ ID NO: 3042709 - protein, 24 aa, Entamoeba invadens
SLKIHRRPMLVLPKPQTPEHPPPK

SEQ ID NO: 3042710 - protein, 18 aa, Entamoeba invadens
SLKKFEFNQDAVFIYDGA

SEQ ID NO: 3042711 - protein, 24 aa, Entamoeba invadens
SLLNLCPSRGVLKTVLQLPIETSV

SEQ ID NO: 3042712 - protein, 21 aa, Entamoeba invadens
SLLVAIFCCALLYTRQQELIF

SEQ ID NO: 3042713 - protein, 18 aa, Entamoeba invadens
SLNSAIRVNKAYLSLNNL

SEQ ID NO: 3042714 - protein, 25 aa, Entamoeba invadens
SLPQEWLWCESWCNKGVKSRAKTID

SEQ ID NO: 3042715 - protein, 20 aa, Entamoeba invadens
SLQRRIKKNITYFTQNLLID

SEQ ID NO: 3042716 - protein, 21 aa, Entamoeba invadens
SLREKIDLWGILRTSELHVEM

SEQ ID NO: 3042717 - protein, 17 aa, Entamoeba invadens
SLSSTAINWICYATQQT

SEQ ID NO: 3042718 - protein, 23 aa, Entamoeba invadens
SLVKELLLFPNIQTLSIPAGQIN

SEQ ID NO: 3042719 - protein, 18 aa, Entamoeba invadens
SLVKGVSTEQLFPDLSSE

SEQ ID NO: 3042720 - protein, 26 aa, Entamoeba invadens
SMCDVKPKLAGLYIETQQNNTFLSLQ

SEQ ID NO: 3042721 - protein, 17 aa, Entamoeba invadens
SMKGGWLSVLGDVEKKK

SEQ ID NO: 3042722 - protein, 20 aa, Entamoeba invadens
SMQFRFWKKNIFRKPDDFDD

SEQ ID NO: 3042723 - protein, 17 aa, Entamoeba invadens
SMRTVGIVVNRTLNEAK

SEQ ID NO: 3042724 - protein, 24 aa, Entamoeba invadens
SMYWFSNGKCRFPMYEFDKHGTCA

SEQ ID NO: 3042725 - protein, 19 aa, Entamoeba invadens
SNAFKNCHSLVIIDVHKVQ

SEQ ID NO: 3042726 - protein, 18 aa, Entamoeba invadens
SNDILLWNVAYSVKPFQK

SEQ ID NO: 3042727 - protein, 18 aa, Entamoeba invadens
SNDLPSTFYETFKNRIIE

SEQ ID NO: 3042728 - protein, 25 aa, Entamoeba invadens
SNECPINMTQCLSIHKNCKICIDTN

SEQ ID NO: 3042729 - protein, 24 aa, Entamoeba invadens
SNEEGRGGRGLGLLFQKTASGECL

SEQ ID NO: 3042730 - protein, 24 aa, Entamoeba invadens
SNESYYNWKVEKYCFIPHKESVLY

SEQ ID NO: 3042731 - protein, 17 aa, Entamoeba invadens
SNFEMLYHVPIAMIINP

SEQ ID NO: 3042732 - protein, 21 aa, Entamoeba invadens
SNGIISYGVFETCTKKGRSYT

SEQ ID NO: 3042733 - protein, 26 aa, Entamoeba invadens
SNGNVYPCIGIPYGKQCVTFQTEYFT

SEQ ID NO: 3042734 - protein, 23 aa, Entamoeba invadens
SNKITQFVPFRFQEVVNKECSNV

SEQ ID NO: 3042735 - protein, 22 aa, Entamoeba invadens
SNLLTKCGRRAVLKTSINTLCD

SEQ ID NO: 3042736 - protein, 17 aa, Entamoeba invadens
SNNAEWLLALKPTVSVI

SEQ ID NO: 3042737 - protein, 25 aa, Entamoeba invadens
SNNLKGEVPPLFVLQHVKKIDVSNN

SEQ ID NO: 3042738 - protein, 21 aa, Entamoeba invadens
SNSYVDFSFCYYRQKYRQGKW

SEQ ID NO: 3042739 - protein, 23 aa, Entamoeba invadens
SNTECYSCAWGYYLQGSNTCVKC

SEQ ID NO: 3042740 - protein, 25 aa, Entamoeba invadens
SNVLTFKLTPTWSVNQNLQLSIFAY

SEQ ID NO: 3042741 - protein, 29 aa, Entamoeba invadens
SNVMFGRMNKLQGSIDMCKDIYNIDNQTL

SEQ ID NO: 3042742 - protein, 22 aa, Entamoeba invadens
SNYAEKVFIGEEFKIEGKVYTR

SEQ ID NO: 3042743 - protein, 20 aa, Entamoeba invadens
SNYALKVLIGKQVVINDVTY

SEQ ID NO: 3042744 - protein, 18 aa, Entamoeba invadens
SNYFIDNLVCRKCNKHCK

SEQ ID NO: 3042745 - protein, 22 aa, Entamoeba invadens
SPFGIYLHGPWFTPSRVTVLLK

SEQ ID NO: 3042746 - protein, 23 aa, Entamoeba invadens
SPFKRTAVIQNRINTVRSETLGL

SEQ ID NO: 3042747 - protein, 24 aa, Entamoeba invadens
SPIEEFRLTHLIREIGRKKSASTI

SEQ ID NO: 3042748 - protein, 18 aa, Entamoeba invadens
SPLGMLCKARDTFYNNTK

SEQ ID NO: 3042749 - protein, 17 aa, Entamoeba invadens
SPLTRLTSPFLTGQWFK

SEQ ID NO: 3042750 - protein, 18 aa, Entamoeba invadens
SPMAFAVSLGVNRDLFEK

SEQ ID NO: 3042751 - protein, 23 aa, Entamoeba invadens
SPSQTCFEYGLTVNNIISSTNDV

SEQ ID NO: 3042752 - protein, 24 aa, Entamoeba invadens
SPVLKKSIFFFSFGLKEKLYINYN

SEQ ID NO: 3042753 - protein, 17 aa, Entamoeba invadens
SPYKLVGYSCYYNGCTV

SEQ ID NO: 3042754 - protein, 19 aa, Entamoeba invadens
SPYYKYTFNEVKCVLECDS

SEQ ID NO: 3042755 - protein, 24 aa, Entamoeba invadens
SQDKFDLCSMFDLKIFVETDDDVR

SEQ ID NO: 3042756 - protein, 25 aa, Entamoeba invadens
SQDVPPCIFGVCKNRYEKKMRKQFA

SEQ ID NO: 3042757 - protein, 19 aa, Entamoeba invadens
SQFWASAGIMEMQIDDLRH

SEQ ID NO: 3042758 - protein, 19 aa, Entamoeba invadens
SQGAYEIFAFLALLLVCLF

SEQ ID NO: 3042759 - protein, 25 aa, Entamoeba invadens
SQGKKWGTLGYMVGEIWDSAANINA

SEQ ID NO: 3042760 - protein, 29 aa, Entamoeba invadens
SQIDMYFEPCFGCGNLDVQLNDFWNLVKS

SEQ ID NO: 3042761 - protein, 26 aa, Entamoeba invadens
SQLFKRFTRATGIHGMIQKEITKSVN

SEQ ID NO: 3042762 - protein, 20 aa, Entamoeba invadens
SQQLRKASVLESMKKELGAV

SEQ ID NO: 3042763 - protein, 19 aa, Entamoeba invadens
SQQPINCLVAGTIRITKGV

SEQ ID NO: 3042764 - protein, 18 aa, Entamoeba invadens
SQSLYCFLLPRKRIFINK

SEQ ID NO: 3042765 - protein, 26 aa, Entamoeba invadens
SQSYFRGRHAMCFCFDITRKETFSAV

SEQ ID NO: 3042766 - protein, 18 aa, Entamoeba invadens
SQTRFMALAERFWSSKEM

SEQ ID NO: 3042767 - protein, 21 aa, Entamoeba invadens
SQTRLGDFLESLKILYSDESL

SEQ ID NO: 3042768 - protein, 33 aa, Entamoeba invadens
SQYKINCHCCLKIFRRLCFFLADTSSIPIFSYF

SEQ ID NO: 3042769 - protein, 17 aa, Entamoeba invadens
SRAGTSAAFYAWNGISW

SEQ ID NO: 3042770 - protein, 28 aa, Entamoeba invadens
SRGNLYPCIGSPFGPHCFTFQTESRYDG

SEQ ID NO: 3042771 - protein, 22 aa, Entamoeba invadens
SRIVFSSVLLVASNMIFFQNSN

SEQ ID NO: 3042772 - protein, 17 aa, Entamoeba invadens
SRKCTKCTSGMYPSTTS

SEQ ID NO: 3042773 - protein, 23 aa, Entamoeba invadens
SRKLRVYRKYVKILKREETAVNN

SEQ ID NO: 3042774 - protein, 20 aa, Entamoeba invadens
SRLWFYLYGVHGMMEKLSRA

SEQ ID NO: 3042775 - protein, 24 aa, Entamoeba invadens
SRMPFLRRQQSKFSMQYEKKADST

SEQ ID NO: 3042776 - protein, 22 aa, Entamoeba invadens
SRMQFLLFVLFWPGEKCYDIEC

SEQ ID NO: 3042777 - protein, 22 aa, Entamoeba invadens
SRMRAAGLGRGYTFDHISRQVK

SEQ ID NO: 3042778 - protein, 25 aa, Entamoeba invadens
SRNDSGAFCGVKFVSYQDVKNFYDN

SEQ ID NO: 3042779 - protein, 18 aa, Entamoeba invadens
SRYDLRPKECIPSPTNPA

SEQ ID NO: 3042780 - protein, 22 aa, Entamoeba invadens
SRYEMIRFDLLTNLKMLNITNR

SEQ ID NO: 3042781 - protein, 18 aa, Entamoeba invadens
SRYWLGELCVDGHCNFPV

SEQ ID NO: 3042782 - protein, 20 aa, Entamoeba invadens
SSADLNLISSFLKQKASENH

SEQ ID NO: 3042783 - protein, 17 aa, Entamoeba invadens
SSALNFVLLALTFIALL

SEQ ID NO: 3042784 - protein, 17 aa, Entamoeba invadens
SSCKTCADGYYSTTGSS

SEQ ID NO: 3042785 - protein, 21 aa, Entamoeba invadens
SSCSFNYKFVDGVCTQCAEVA

SEQ ID NO: 3042786 - protein, 20 aa, Entamoeba invadens
SSFLRRCYECQSGYYPSSST

SEQ ID NO: 3042787 - protein, 27 aa, Entamoeba invadens
SSIENCTRINGSYCVKCTEYSHIANGK

SEQ ID NO: 3042788 - protein, 30 aa, Entamoeba invadens
SSKLKEGIVFIKDVVVFQVKLFEAILESID

SEQ ID NO: 3042789 - protein, 26 aa, Entamoeba invadens
SSLEDPGFGFLIWKYTKENNMKVNLI

SEQ ID NO: 3042790 - protein, 18 aa, Entamoeba invadens
SSLGHSVDQYKFFVVSNA

SEQ ID NO: 3042791 - protein, 18 aa, Entamoeba invadens
SSLSCFKSSGFGDMVIIR

SEQ ID NO: 3042792 - protein, 25 aa, Entamoeba invadens
SSNIPVYCMIAGSFNFTFQGKPFPP

SEQ ID NO: 3042793 - protein, 22 aa, Entamoeba invadens
SSQICSFSDTILKNVTLSDTCT

SEQ ID NO: 3042794 - protein, 31 aa, Entamoeba invadens
SSQLRCKSCIFWFRFKMSASNALGLTSATDF

SEQ ID NO: 3042795 - protein, 25 aa, Entamoeba invadens
SSRVRRDGYTFVFETFSSVDCSGVS

SEQ ID NO: 3042796 - protein, 18 aa, Entamoeba invadens
SSSLKFDFDLDFFSQDDI

SEQ ID NO: 3042797 - protein, 19 aa, Entamoeba invadens
SSSMFILFSTEVILGENNR

SEQ ID NO: 3042798 - protein, 20 aa, Entamoeba invadens
SSSTCLSCKTGTYLVGSLCI

SEQ ID NO: 3042799 - protein, 23 aa, Entamoeba invadens
SSTKCKICYEGFAVQNGVCEKCE

SEQ ID NO: 3042800 - protein, 21 aa, Entamoeba invadens
SSTKCVTCGRGTYSSSGSAYC

SEQ ID NO: 3042801 - protein, 23 aa, Entamoeba invadens
SSTKCVTCGRGTYSSSGSAYCTD

SEQ ID NO: 3042802 - protein, 23 aa, Entamoeba invadens
STCKKCLSGYLIDRQRNICVTCD

SEQ ID NO: 3042803 - protein, 24 aa, Entamoeba invadens
STCKYCKNSYLLKNQCYNYDDNCM

SEQ ID NO: 3042804 - protein, 18 aa, Entamoeba invadens
STCSKCFDGYYYKEDDKT

SEQ ID NO: 3042805 - protein, 17 aa, Entamoeba invadens
STESQCFLCKDKVIEDE

SEQ ID NO: 3042806 - protein, 23 aa, Entamoeba invadens
STFSESYLKDVSFEGAYKSRKEG

SEQ ID NO: 3042807 - protein, 17 aa, Entamoeba invadens
STGLLSIGLMKGDKLGI

SEQ ID NO: 3042808 - protein, 23 aa, Entamoeba invadens
STGYCSSCSTGLVYTNPQSNQCE

SEQ ID NO: 3042809 - protein, 18 aa, Entamoeba invadens
STHCIACKNGFVNLGDNF

SEQ ID NO: 3042810 - protein, 17 aa, Entamoeba invadens
STIACIEKASPIATSIT

SEQ ID NO: 3042811 - protein, 25 aa, Entamoeba invadens
STIRIADCILLCFSLYTDKSTCFTK

SEQ ID NO: 3042812 - protein, 31 aa, Entamoeba invadens
STKLSDYFLNLEVLNGVMLYVEMFYDVFIAR

SEQ ID NO: 3042813 - protein, 22 aa, Entamoeba invadens
STKMPFLMWYFYSVYNNVPHMM

SEQ ID NO: 3042814 - protein, 18 aa, Entamoeba invadens
STLKHLIRELNFRRKQTN

SEQ ID NO: 3042815 - protein, 17 aa, Entamoeba invadens
STLLVMFGASPIFEVNE

SEQ ID NO: 3042816 - protein, 17 aa, Entamoeba invadens
STLPKYMPSTGLIYSKT

SEQ ID NO: 3042817 - protein, 17 aa, Entamoeba invadens
STLRVKEEFFLHGFWPE

SEQ ID NO: 3042818 - protein, 27 aa, Entamoeba invadens
STNNGKCLGCIEGFFLTADFRCEGCSK

SEQ ID NO: 3042819 - protein, 22 aa, Entamoeba invadens
STRLPRKQVHTLMRPTQYTIGV

SEQ ID NO: 3042820 - protein, 22 aa, Entamoeba invadens
STTCLLCRDGFYSTEKSSICLQ

SEQ ID NO: 3042821 - protein, 19 aa, Entamoeba invadens
STTKCVICNSNYYLLNDVC

SEQ ID NO: 3042822 - protein, 18 aa, Entamoeba invadens
STTRYGISCFAHCNIKSV

SEQ ID NO: 3042823 - protein, 24 aa, Entamoeba invadens
STVASAVCPRGQWTAPASSTAAFA

SEQ ID NO: 3042824 - protein, 19 aa, Entamoeba invadens
STVGFKISNYFRLVDNVVL

SEQ ID NO: 3042825 - protein, 24 aa, Entamoeba invadens
STYEHPIVYSIPDFIAAKYTYDAT

SEQ ID NO: 3042826 - protein, 19 aa, Entamoeba invadens
STYYTPLMVEQRIREDAKL

SEQ ID NO: 3042827 - protein, 18 aa, Entamoeba invadens
SVALCGDSAVGKSCMFKR

SEQ ID NO: 3042828 - protein, 22 aa, Entamoeba invadens
SVCARKGYERFLLFKNDEIESL

SEQ ID NO: 3042829 - protein, 18 aa, Entamoeba invadens
SVCERNGYNRILYFGKTE

SEQ ID NO: 3042830 - protein, 25 aa, Entamoeba invadens
SVCGFKGEVPYTSSPCVTKSLTQQS

SEQ ID NO: 3042831 - protein, 20 aa, Entamoeba invadens
SVCYNCPNLQYSLGSASQCK

SEQ ID NO: 3042832 - protein, 20 aa, Entamoeba invadens
SVEGLSVFRRSLVVITASAA

SEQ ID NO: 3042833 - protein, 19 aa, Entamoeba invadens
SVEKCRFAAFQMDKHGSCA

SEQ ID NO: 3042834 - protein, 19 aa, Entamoeba invadens
SVILFKSILAFVPPFSKAK

SEQ ID NO: 3042835 - protein, 22 aa, Entamoeba invadens
SVKRMSSGTAFKATEATASYTS

SEQ ID NO: 3042836 - protein, 19 aa, Entamoeba invadens
SVLDRFRYNPIPVRSKKLF

SEQ ID NO: 3042837 - protein, 20 aa, Entamoeba invadens
SVLEIRVCYDPSKNKYNPES

SEQ ID NO: 3042838 - protein, 27 aa, Entamoeba invadens
SVLKSAWRFPNPIFRSIQYLRYNRSYE

SEQ ID NO: 3042839 - protein, 20 aa, Entamoeba invadens
SVLTWIRVQVANWLSSKEGS

SEQ ID NO: 3042840 - protein, 22 aa, Entamoeba invadens
SVNPEWSVNILKELIESKTGIS

SEQ ID NO: 3042841 - protein, 20 aa, Entamoeba invadens
SVPLWYPHYDNWASFGDFGA

SEQ ID NO: 3042842 - protein, 24 aa, Entamoeba invadens
SVTFFKCDMTEFGIEKMRLQDVAM

SEQ ID NO: 3042843 - protein, 22 aa, Entamoeba invadens
SVYEIKICYDIYKNPFNPKPIN

SEQ ID NO: 3042844 - protein, 24 aa, Entamoeba invadens
SWADGFILNSGWLVGLSDLAVEQE

SEQ ID NO: 3042845 - protein, 18 aa, Entamoeba invadens
SWANLAYVYVTSNNKKEA

SEQ ID NO: 3042846 - protein, 21 aa, Entamoeba invadens
SWDIAYLFKEMEIMNRYKEML

SEQ ID NO: 3042847 - protein, 19 aa, Entamoeba invadens
SWGRSWGDKGYILMAIEGN

SEQ ID NO: 3042848 - protein, 20 aa, Entamoeba invadens
SWGTEWGDKGYIYMSRNKNN

SEQ ID NO: 3042849 - protein, 19 aa, Entamoeba invadens
SWTGFPNVFSDLWKPYLEI

SEQ ID NO: 3042850 - protein, 19 aa, Entamoeba invadens
SYCSKKFSLKTLWLSVESF

SEQ ID NO: 3042851 - protein, 22 aa, Entamoeba invadens
SYDEWKDNLKVFMDLHTANYRV

SEQ ID NO: 3042852 - protein, 27 aa, Entamoeba invadens
SYDFRSSCVPSMMWDSLTLARYSMRNA

SEQ ID NO: 3042853 - protein, 22 aa, Entamoeba invadens
SYDVPCLLGMRVETIENIGVSG

SEQ ID NO: 3042854 - protein, 25 aa, Entamoeba invadens
SYFFPCKEILYNLYSQLFKRFTRAT

SEQ ID NO: 3042855 - protein, 17 aa, Entamoeba invadens
SYFPDYAPFLIPPVYPS

SEQ ID NO: 3042856 - protein, 26 aa, Entamoeba invadens
SYGKENSLYWGRHKAALAFLATYTGP

SEQ ID NO: 3042857 - protein, 25 aa, Entamoeba invadens
SYHSALVKRLCCKKPTLNKLLITLM

SEQ ID NO: 3042858 - protein, 25 aa, Entamoeba invadens
SYIDFQWQNINGFTIISNFVLLCFA

SEQ ID NO: 3042859 - protein, 27 aa, Entamoeba invadens
SYKADAFDFEWCLTYGMSLSKKRITDM

SEQ ID NO: 3042860 - protein, 21 aa, Entamoeba invadens
SYKGTCVRGKQTLLELQNFTS

SEQ ID NO: 3042861 - protein, 20 aa, Entamoeba invadens
SYLGGCCFNCCESLVEVELP

SEQ ID NO: 3042862 - protein, 22 aa, Entamoeba invadens
SYRVSPYPAIVVVSGDVSAHSP

SEQ ID NO: 3042863 - protein, 30 aa, Entamoeba invadens
SYSFKYPHCPCFGDDCIIEVPLDFNSTFVE

SEQ ID NO: 3042864 - protein, 22 aa, Entamoeba invadens
SYSISHRVSFNFLNTSKELTVF

SEQ ID NO: 3042865 - protein, 24 aa, Entamoeba invadens
SYSPEAMKDFVLYLIKESQNNQHP

SEQ ID NO: 3042866 - protein, 25 aa, Entamoeba invadens
SYTLPGNCPHQLKGQIWVNKKDIYP

SEQ ID NO: 3042867 - protein, 28 aa, Entamoeba invadens
SYVRLSDYYLFVLFWPIKCYDIVCSLPQ

SEQ ID NO: 3042868 - protein, 24 aa, Entamoeba invadens
TAAIPRKQKYFIFIAPMTQLNVDE

SEQ ID NO: 3042869 - protein, 19 aa, Entamoeba invadens
TADPGNTLIIWNKKPPLAE

SEQ ID NO: 3042870 - protein, 23 aa, Entamoeba invadens
TAEEIRPVLKIGVDESYTLSVTK

SEQ ID NO: 3042871 - protein, 25 aa, Entamoeba invadens
TAFLNKASQCGICYEAVGEVGSVRF

SEQ ID NO: 3042872 - protein, 21 aa, Entamoeba invadens
TAFLNKFGNWAIVPMLGNHDA

SEQ ID NO: 3042873 - protein, 17 aa, Entamoeba invadens
TAGFSFKQLYGVEDASP

SEQ ID NO: 3042874 - protein, 23 aa, Entamoeba invadens
TAILLYKKYDVWKILKESELKVE

SEQ ID NO: 3042875 - protein, 23 aa, Entamoeba invadens
TAINLWKRIDIWKILKNSHLNIK

SEQ ID NO: 3042876 - protein, 25 aa, Entamoeba invadens
TAIRLYKNMNIWKFLQRSELKVETN

SEQ ID NO: 3042877 - protein, 20 aa, Entamoeba invadens
TALFLYDKYDLWKLLQESEL

SEQ ID NO: 3042878 - protein, 19 aa, Entamoeba invadens
TALTQFSFDNIKSVGSYAF

SEQ ID NO: 3042879 - protein, 17 aa, Entamoeba invadens
TANSFGLGYSNSLFINQ

SEQ ID NO: 3042880 - protein, 25 aa, Entamoeba invadens
TAVPRAQDSAVYWMKGFSFDEPENL

SEQ ID NO: 3042881 - protein, 22 aa, Entamoeba invadens
TAWLDGRHVVFGEVIEGLDIVD

SEQ ID NO: 3042882 - protein, 19 aa, Entamoeba invadens
TCADHPIYEAIVVEIYNQI

SEQ ID NO: 3042883 - protein, 18 aa, Entamoeba invadens
TCAYMLKLPKYKSKQQMH

SEQ ID NO: 3042884 - protein, 18 aa, Entamoeba invadens
TCISCPINTYSLGNASMC

SEQ ID NO: 3042885 - protein, 26 aa, Entamoeba invadens
TCLTLAEPTNRGWIRTSFGKDIADKY

SEQ ID NO: 3042886 - protein, 25 aa, Entamoeba invadens
TCQGPRYFLDFFEAFTQLPILSNDG

SEQ ID NO: 3042887 - protein, 21 aa, Entamoeba invadens
TCQKMDFPNCMSVTKGKTCGM

SEQ ID NO: 3042888 - protein, 17 aa, Entamoeba invadens
TCSGHPKSCLKFNTNRC

SEQ ID NO: 3042889 - protein, 18 aa, Entamoeba invadens
TCTICPAGFYSKSGNATC

SEQ ID NO: 3042890 - protein, 21 aa, Entamoeba invadens
TCVAVCPIPYYSDKKTWTCVK

SEQ ID NO: 3042891 - protein, 20 aa, Entamoeba invadens
TCVEKMVLRGVHFIANLNFD

SEQ ID NO: 3042892 - protein, 38 aa, Entamoeba invadens
TDCPAGLVCKCGFTIYNPCAWPWSDLAICDGEPGKYFG

SEQ ID NO: 3042893 - protein, 21 aa, Entamoeba invadens
TDDECKACTTVTPTPVDPSNP

SEQ ID NO: 3042894 - protein, 21 aa, Entamoeba invadens
TDERYGFCDDIVKTKVKENLH

SEQ ID NO: 3042895 - protein, 20 aa, Entamoeba invadens
TDFKCKICDATCNGSCNTRN

SEQ ID NO: 3042896 - protein, 25 aa, Entamoeba invadens
TDFPYNFTDGTAFLLSKNRLLRFCP

SEQ ID NO: 3042897 - protein, 23 aa, Entamoeba invadens
TDGKGMLSFGFFYPTEISIENDF

SEQ ID NO: 3042898 - protein, 23 aa, Entamoeba invadens
TDGKNTRCTLEITTQLQTTSGKA

SEQ ID NO: 3042899 - protein, 18 aa, Entamoeba invadens
TDHFCFSACSLFAKNVVE

SEQ ID NO: 3042900 - protein, 18 aa, Entamoeba invadens
TDKFTGYSVRGLTVKDDG

SEQ ID NO: 3042901 - protein, 27 aa, Entamoeba invadens
TDKVCPEGIDVVWLWVNGSDPVFRQQY

SEQ ID NO: 3042902 - protein, 24 aa, Entamoeba invadens
TDLFPKADALIILDRIDEYLGAYA

SEQ ID NO: 3042903 - protein, 19 aa, Entamoeba invadens
TDMVEFLKFYTIFNDDTTK

SEQ ID NO: 3042904 - protein, 25 aa, Entamoeba invadens
TDNLTTCAFGECKITQQGISPQPKR

SEQ ID NO: 3042905 - protein, 19 aa, Entamoeba invadens
TDNPNCKSFSFVQGSNGAT

SEQ ID NO: 3042906 - protein, 35 aa, Entamoeba invadens
TDQIRFLEGRLNTVQSRCGFVVKDEKVINQKLKAY

SEQ ID NO: 3042907 - protein, 22 aa, Entamoeba invadens
TDRTIKDLPLFFVSNTTSITGF

SEQ ID NO: 3042908 - protein, 17 aa, Entamoeba invadens
TDTFTGYSVRGLTVKDD

SEQ ID NO: 3042909 - protein, 17 aa, Entamoeba invadens
TDTSIGGVLPRKIAKDI

SEQ ID NO: 3042910 - protein, 18 aa, Entamoeba invadens
TDWRVMKQSTVWTQNIKK

SEQ ID NO: 3042911 - protein, 21 aa, Entamoeba invadens
TDYFAVSGFSKKGDRVVNMFD

SEQ ID NO: 3042912 - protein, 21 aa, Entamoeba invadens
TDYGKFYLKFIAQLLLDHGDR

SEQ ID NO: 3042913 - protein, 20 aa, Entamoeba invadens
TDYQCVNCGMGHYYHPAGQS

SEQ ID NO: 3042914 - protein, 53 aa, Entamoeba invadens
TEAAKGIDCAYAMSVDAIKCIIGKGQGDFIVIRGWRSNNVFDQEAPRTYANAK

SEQ ID NO: 3042915 - protein, 26 aa, Entamoeba invadens
TEALPEIEIYMLLSVGDLENLNEVYK

SEQ ID NO: 3042916 - protein, 19 aa, Entamoeba invadens
TECGYKYANCATCNETECL

SEQ ID NO: 3042917 - protein, 23 aa, Entamoeba invadens
TEDVKLIYIYSFKLVATCCSSTT

SEQ ID NO: 3042918 - protein, 24 aa, Entamoeba invadens
TEDWLSQVFCMWIGRPIIDVNCVS

SEQ ID NO: 3042919 - protein, 20 aa, Entamoeba invadens
TEECNSCLLFKAKNPQNNGI

SEQ ID NO: 3042920 - protein, 20 aa, Entamoeba invadens
TEEEKTRRFLIFKSEVNTIR

SEQ ID NO: 3042921 - protein, 22 aa, Entamoeba invadens
TEFETRLAVQTLFQASGEERAI

SEQ ID NO: 3042922 - protein, 21 aa, Entamoeba invadens
TEFGGNCFDSVSIEGELKLNG

SEQ ID NO: 3042923 - protein, 24 aa, Entamoeba invadens
TEFPITYPFCRYRGKQGYFEDLYP

SEQ ID NO: 3042924 - protein, 25 aa, Entamoeba invadens
TEGGEINWFYSFPFLYDKILPSAVC

SEQ ID NO: 3042925 - protein, 24 aa, Entamoeba invadens
TEIALSALFVRTGLSSSYVEFGDL

SEQ ID NO: 3042926 - protein, 34 aa, Entamoeba invadens
TEIIPPFYTVLIRFRHGYQFEFWLYYIKTFQQGR

SEQ ID NO: 3042927 - protein, 18 aa, Entamoeba invadens
TEIRIFISGHPLYEATIV

SEQ ID NO: 3042928 - protein, 17 aa, Entamoeba invadens
TEKAKYIGCETFGDTGC

SEQ ID NO: 3042929 - protein, 20 aa, Entamoeba invadens
TEKCTKCSPNAFDINSKCQL

SEQ ID NO: 3042930 - protein, 25 aa, Entamoeba invadens
TEKIICVLIKLLSHKSLLIVEVTVA

SEQ ID NO: 3042931 - protein, 21 aa, Entamoeba invadens
TELFLRGLKYSNYHDSEDGVA

SEQ ID NO: 3042932 - protein, 18 aa, Entamoeba invadens
TELLTLIRNKWMSLQRCR

SEQ ID NO: 3042933 - protein, 20 aa, Entamoeba invadens
TEMKQRLYFSYFPLNGDMNN

SEQ ID NO: 3042934 - protein, 17 aa, Entamoeba invadens
TENKVRCCKSVIKEDSM

SEQ ID NO: 3042935 - protein, 28 aa, Entamoeba invadens
TEPFPARYASGWLLRDILNYQMDRINGV

SEQ ID NO: 3042936 - protein, 23 aa, Entamoeba invadens
TERKCLSCASPYFVGNSGANCVQ

SEQ ID NO: 3042937 - protein, 23 aa, Entamoeba invadens
TESDQYWYGLEFQNPDPSQVTFY

SEQ ID NO: 3042938 - protein, 23 aa, Entamoeba invadens
TESLKLLVVFICVQKPSHKENSL

SEQ ID NO: 3042939 - protein, 24 aa, Entamoeba invadens
TESRCIACLPGTFSPNSGSIKCEE

SEQ ID NO: 3042940 - protein, 17 aa, Entamoeba invadens
TFACSKLAPNVPGKSTD

SEQ ID NO: 3042941 - protein, 20 aa, Entamoeba invadens
TFEKYGWWTTPNMSYYTSQT

SEQ ID NO: 3042942 - protein, 20 aa, Entamoeba invadens
TFFSNTRSYCFNNYFNFSTR

SEQ ID NO: 3042943 - protein, 25 aa, Entamoeba invadens
TFKDTLFQHGWGFLRINSAQSTSLD

SEQ ID NO: 3042944 - protein, 24 aa, Entamoeba invadens
TFNKLFRHFLILTLLLLLSPVQSK

SEQ ID NO: 3042945 - protein, 19 aa, Entamoeba invadens
TGCAPVIRHKIRFKNSKIL

SEQ ID NO: 3042946 - protein, 19 aa, Entamoeba invadens
TGCSPVIRHKIWFDNYKHY

SEQ ID NO: 3042947 - protein, 19 aa, Entamoeba invadens
TGEEMKLLALRKREAKIRE

SEQ ID NO: 3042948 - protein, 19 aa, Entamoeba invadens
TGIDCLRCDKTHFSTTLPT

SEQ ID NO: 3042949 - protein, 24 aa, Entamoeba invadens
TGKCFKCLDGFYLVSGQCALCNNT

SEQ ID NO: 3042950 - protein, 24 aa, Entamoeba invadens
TGKVECNKCASNVYTACYESSAPI

SEQ ID NO: 3042951 - protein, 22 aa, Entamoeba invadens
TGQRALVAMHICPGVAERFNYS

SEQ ID NO: 3042952 - protein, 25 aa, Entamoeba invadens
TGRLVCVECALPLDNDVEDCSSQAN

SEQ ID NO: 3042953 - protein, 21 aa, Entamoeba invadens
TGSDFTNCFELISYQSETQQT

SEQ ID NO: 3042954 - protein, 22 aa, Entamoeba invadens
TGSSCLVCRSGFFCPDGLDEYP

SEQ ID NO: 3042955 - protein, 17 aa, Entamoeba invadens
THCAECSDIAYLNTATN

SEQ ID NO: 3042956 - protein, 18 aa, Entamoeba invadens
THCLKCTTDGFFSETPVD

SEQ ID NO: 3042957 - protein, 23 aa, Entamoeba invadens
THISKFAFKHCISLTSFNSESVS

SEQ ID NO: 3042958 - protein, 17 aa, Entamoeba invadens
THLNCRVCKDDICQQCK

SEQ ID NO: 3042959 - protein, 20 aa, Entamoeba invadens
THLRNLRKLRSMRNGILSVI

SEQ ID NO: 3042960 - protein, 18 aa, Entamoeba invadens
THPTRFALISALLVNEKV

SEQ ID NO: 3042961 - protein, 20 aa, Entamoeba invadens
THVLEFSRERFIAYLPLAHI

SEQ ID NO: 3042962 - protein, 24 aa, Entamoeba invadens
TIEVIKTKGGVLLEIAQLQGNVTF

SEQ ID NO: 3042963 - protein, 19 aa, Entamoeba invadens
TIGLFFVVFCVNLELVNGC

SEQ ID NO: 3042964 - protein, 30 aa, Entamoeba invadens
TIGSFAFQFSALTSFDFKGVTSIGNNAFHF

SEQ ID NO: 3042965 - protein, 18 aa, Entamoeba invadens
TIHLPLWAEKSILTNDAF

SEQ ID NO: 3042966 - protein, 25 aa, Entamoeba invadens
TIKDCKGKSVCVECDNGIDELIETE

SEQ ID NO: 3042967 - protein, 22 aa, Entamoeba invadens
TIKQCRNSTCPSCYQICKNGAE

SEQ ID NO: 3042968 - protein, 18 aa, Entamoeba invadens
TIKRSAALSKKEVKKTEK

SEQ ID NO: 3042969 - protein, 24 aa, Entamoeba invadens
TILPWTDVMQGFGMTELCGASSCM

SEQ ID NO: 3042970 - protein, 25 aa, Entamoeba invadens
TIRLCARGGELSQFFTDKSRHFETV

SEQ ID NO: 3042971 - protein, 26 aa, Entamoeba invadens
TISDFPRFKWRGLLVDPSRNQILPKT

SEQ ID NO: 3042972 - protein, 18 aa, Entamoeba invadens
TISRCGQALRLVGPSQKQ

SEQ ID NO: 3042973 - protein, 18 aa, Entamoeba invadens
TKCEKALCTSCYSDYSQC

SEQ ID NO: 3042974 - protein, 20 aa, Entamoeba invadens
TKCTACLSGYYLDDNNNKCT

SEQ ID NO: 3042975 - protein, 20 aa, Entamoeba invadens
TKDATGWGQLYLKSNQNLAD

SEQ ID NO: 3042976 - protein, 25 aa, Entamoeba invadens
TKDWSRVWVDADIVLPRKGECLMKY

SEQ ID NO: 3042977 - protein, 24 aa, Entamoeba invadens
TKEGGLPPFDWKRFPKVQHDGTPA

SEQ ID NO: 3042978 - protein, 23 aa, Entamoeba invadens
TKEIRLFPRLISVAFNTFSPFVL

SEQ ID NO: 3042979 - protein, 25 aa, Entamoeba invadens
TKERFWLHGFWPQYSNNRILMCCVY

SEQ ID NO: 3042980 - protein, 25 aa, Entamoeba invadens
TKGCLRCLSGYYLADRMCVKCEYPC

SEQ ID NO: 3042981 - protein, 17 aa, Entamoeba invadens
TKHTVQLPKGVWYDYFN

SEQ ID NO: 3042982 - protein, 17 aa, Entamoeba invadens
TKIDLSRNINGADRVTF

SEQ ID NO: 3042983 - protein, 26 aa, Entamoeba invadens
TKISTLYQRFGIITASQIKEVREQMA

SEQ ID NO: 3042984 - protein, 19 aa, Entamoeba invadens
TKKAPRKSLAEMIAEQRFM

SEQ ID NO: 3042985 - protein, 23 aa, Entamoeba invadens
TKKCVKGAIAHCLSYSSASICQK

SEQ ID NO: 3042986 - protein, 19 aa, Entamoeba invadens
TKKCVPREILIDVNKETHN

SEQ ID NO: 3042987 - protein, 23 aa, Entamoeba invadens
TKKEVTELFVALCHDTFCSRLYN

SEQ ID NO: 3042988 - protein, 22 aa, Entamoeba invadens
TKKLKLVEEIAEEIAKREAAEK

SEQ ID NO: 3042989 - protein, 25 aa, Entamoeba invadens
TKLIKGIFRNCTKLDEIIGLENVVD
